United States Patent 7,314,750 (ADDRESSABLE OLIGONUCLEOTIDE ARRAY OF THE RAT GENOME) - sequence listing, part 8

SEQ ID NO: 265173 - DNA, 25 bp, Rattus norvegicus
ctcagcttatttttctgttaggtaa

SEQ ID NO: 265174 - DNA, 25 bp, Rattus norvegicus
ctcagcttcaagctggtctaccaca

SEQ ID NO: 265175 - DNA, 25 bp, Rattus norvegicus
ctcagcttcaaggtggtctaccaca

SEQ ID NO: 265176 - DNA, 25 bp, Rattus norvegicus
ctcagcttcctgcagcaactctaaa

SEQ ID NO: 265177 - DNA, 25 bp, Rattus norvegicus
ctcagcttcctggagcaactctaaa

SEQ ID NO: 265178 - DNA, 25 bp, Rattus norvegicus
ctcagcttcttcaggcggtagctga

SEQ ID NO: 265179 - DNA, 25 bp, Rattus norvegicus
ctcagcttcttctggcggtagctga

SEQ ID NO: 265180 - DNA, 25 bp, Rattus norvegicus
ctcagcttgcctccgatgatcaaga

SEQ ID NO: 265181 - DNA, 25 bp, Rattus norvegicus
ctcagcttgcctgcgatgatcaaga

SEQ ID NO: 265182 - DNA, 25 bp, Rattus norvegicus
ctcagcttgctccttttctttatag

SEQ ID NO: 265183 - DNA, 25 bp, Rattus norvegicus
ctcagcttgctcgttttctttatag

SEQ ID NO: 265184 - DNA, 25 bp, Rattus norvegicus
ctcagcttgctgagtttcttaccgg

SEQ ID NO: 265185 - DNA, 25 bp, Rattus norvegicus
ctcagcttgctgtgtttcttaccgg

SEQ ID NO: 265186 - DNA, 25 bp, Rattus norvegicus
ctcagcttgtcaaccaacttcatga

SEQ ID NO: 265187 - DNA, 25 bp, Rattus norvegicus
ctcagcttgtcatccaacttcatga

SEQ ID NO: 265188 - DNA, 25 bp, Rattus norvegicus
ctcagcttgtgccttataaataaac

SEQ ID NO: 265189 - DNA, 25 bp, Rattus norvegicus
ctcagcttgtgcgttataaataaac

SEQ ID NO: 265190 - DNA, 25 bp, Rattus norvegicus
ctcagcttgtgtctcaggaacatga

SEQ ID NO: 265191 - DNA, 25 bp, Rattus norvegicus
ctcagcttgtgtgtcaggaacatga

SEQ ID NO: 265192 - DNA, 25 bp, Rattus norvegicus
ctcagctttgcactttccaacgtat

SEQ ID NO: 265193 - DNA, 25 bp, Rattus norvegicus
ctcagctttgcagtttccaacgtat

SEQ ID NO: 265194 - DNA, 25 bp, Rattus norvegicus
ctcagctttgttctcagcttgttta

SEQ ID NO: 265195 - DNA, 25 bp, Rattus norvegicus
ctcagctttgttgtcagcttgttta

SEQ ID NO: 265196 - DNA, 25 bp, Rattus norvegicus
ctcagcttttccctggagagccaaa

SEQ ID NO: 265197 - DNA, 25 bp, Rattus norvegicus
ctcagcttttccgtggagagccaaa

SEQ ID NO: 265198 - DNA, 25 bp, Rattus norvegicus
ctcagcttttgacagtcaagtggat

SEQ ID NO: 265199 - DNA, 25 bp, Rattus norvegicus
ctcagcttttgagagtcaagtggat

SEQ ID NO: 265200 - DNA, 25 bp, Rattus norvegicus
ctcaggaaacctcgacaaggctttg

SEQ ID NO: 265201 - DNA, 25 bp, Rattus norvegicus
ctcaggaaacctggacaaggctttg

SEQ ID NO: 265202 - DNA, 25 bp, Rattus norvegicus
ctcaggaacacgacgggcccgtagc

SEQ ID NO: 265203 - DNA, 25 bp, Rattus norvegicus
ctcaggaacacgtcgggcccgtagc

SEQ ID NO: 265204 - DNA, 25 bp, Rattus norvegicus
ctcaggaagcggcaaaacgttcaaa

SEQ ID NO: 265205 - DNA, 25 bp, Rattus norvegicus
ctcaggaagcgggaaaacgttcaaa

SEQ ID NO: 265206 - DNA, 25 bp, Rattus norvegicus
ctcaggaatattaggagctgtgcaa

SEQ ID NO: 265207 - DNA, 25 bp, Rattus norvegicus
ctcaggaatatttggagctgtgcaa

SEQ ID NO: 265208 - DNA, 25 bp, Rattus norvegicus
ctcaggacaagtagcagcggctaca

SEQ ID NO: 265209 - DNA, 25 bp, Rattus norvegicus
ctcaggacaagttgcagcggctaca

SEQ ID NO: 265210 - DNA, 25 bp, Rattus norvegicus
ctcaggaccaggctgttggcttaga

SEQ ID NO: 265211 - DNA, 25 bp, Rattus norvegicus
ctcaggaccagggtgttggcttaga

SEQ ID NO: 265212 - DNA, 25 bp, Rattus norvegicus
ctcaggacccgaagcagttgtcaaa

SEQ ID NO: 265213 - DNA, 25 bp, Rattus norvegicus
ctcaggacccgatgcagttgtcaaa

SEQ ID NO: 265214 - DNA, 25 bp, Rattus norvegicus
ctcaggacctggagtcagagttctt

SEQ ID NO: 265215 - DNA, 25 bp, Rattus norvegicus
ctcaggacctggtgtcagagttctt

SEQ ID NO: 265216 - DNA, 25 bp, Rattus norvegicus
ctcaggaccttaacttctcttgaaa

SEQ ID NO: 265217 - DNA, 25 bp, Rattus norvegicus
ctcaggaccttatcttctcttgaaa

SEQ ID NO: 265218 - DNA, 25 bp, Rattus norvegicus
ctcaggagaagtcgctcagaggcta

SEQ ID NO: 265219 - DNA, 25 bp, Rattus norvegicus
ctcaggagaagtggctcagaggcta

SEQ ID NO: 265220 - DNA, 25 bp, Rattus norvegicus
ctcaggagaggcacagagagttgta

SEQ ID NO: 265221 - DNA, 25 bp, Rattus norvegicus
ctcaggagaggctcagagagttgta

SEQ ID NO: 265222 - DNA, 25 bp, Rattus norvegicus
ctcaggagccagagagaggtaagct

SEQ ID NO: 265223 - DNA, 25 bp, Rattus norvegicus
ctcaggagccagtgagaggtaagct

SEQ ID NO: 265224 - DNA, 25 bp, Rattus norvegicus
ctcaggaggcaaaaggcaagtgcat

SEQ ID NO: 265225 - DNA, 25 bp, Rattus norvegicus
ctcaggaggcaataggcaagtgcat

SEQ ID NO: 265226 - DNA, 25 bp, Rattus norvegicus
ctcaggagtaccacacagaagctat

SEQ ID NO: 265227 - DNA, 25 bp, Rattus norvegicus
ctcaggagtacctcacagaagctat

SEQ ID NO: 265228 - DNA, 25 bp, Rattus norvegicus
ctcaggagttatcaatagacggctt

SEQ ID NO: 265229 - DNA, 25 bp, Rattus norvegicus
ctcaggagttatgaatagacggctt

SEQ ID NO: 265230 - DNA, 25 bp, Rattus norvegicus
ctcaggatccttcgctgctttagat

SEQ ID NO: 265231 - DNA, 25 bp, Rattus norvegicus
ctcaggatccttggctgctttagat

SEQ ID NO: 265232 - DNA, 25 bp, Rattus norvegicus
ctcaggatgggcacttgtctttaag

SEQ ID NO: 265233 - DNA, 25 bp, Rattus norvegicus
ctcaggatgggctcttgtctttaag

SEQ ID NO: 265234 - DNA, 25 bp, Rattus norvegicus
ctcaggatgtaccatgaaggctctt

SEQ ID NO: 265235 - DNA, 25 bp, Rattus norvegicus
ctcaggatgtacgatgaaggctctt

SEQ ID NO: 265236 - DNA, 25 bp, Rattus norvegicus
ctcaggcacagtaccgtatggcaga

SEQ ID NO: 265237 - DNA, 25 bp, Rattus norvegicus
ctcaggcacagttccgtatggcaga

SEQ ID NO: 265238 - DNA, 25 bp, Rattus norvegicus
ctcaggcaccatacagtactgtgtg

SEQ ID NO: 265239 - DNA, 25 bp, Rattus norvegicus
ctcaggcaccattcagtactgtgtg

SEQ ID NO: 265240 - DNA, 25 bp, Rattus norvegicus
ctcaggcacctgattcttacaatta

SEQ ID NO: 265241 - DNA, 25 bp, Rattus norvegicus
ctcaggcacctgtttcttacaatta

SEQ ID NO: 265242 - DNA, 25 bp, Rattus norvegicus
ctcaggcactggctggaactggatt

SEQ ID NO: 265243 - DNA, 25 bp, Rattus norvegicus
ctcaggcactgggtggaactggatt

SEQ ID NO: 265244 - DNA, 25 bp, Rattus norvegicus
ctcaggcagtacagatccacaggca

SEQ ID NO: 265245 - DNA, 25 bp, Rattus norvegicus
ctcaggcagtactgatccacaggca

SEQ ID NO: 265246 - DNA, 25 bp, Rattus norvegicus
ctcaggcagtctatgaactcattac

SEQ ID NO: 265247 - DNA, 25 bp, Rattus norvegicus
ctcaggcagtctttgaactcattac

SEQ ID NO: 265248 - DNA, 25 bp, Rattus norvegicus
ctcaggcatgctacccattaagtgc

SEQ ID NO: 265249 - DNA, 25 bp, Rattus norvegicus
ctcaggcatgcttcccattaagtgc

SEQ ID NO: 265250 - DNA, 25 bp, Rattus norvegicus
ctcaggccaactccagggtaggtag

SEQ ID NO: 265251 - DNA, 25 bp, Rattus norvegicus
ctcaggccaactgcagggtaggtag

SEQ ID NO: 265252 - DNA, 25 bp, Rattus norvegicus
ctcaggccacaccagaggaaactgt

SEQ ID NO: 265253 - DNA, 25 bp, Rattus norvegicus
ctcaggccacacgagaggaaactgt

SEQ ID NO: 265254 - DNA, 25 bp, Rattus norvegicus
ctcaggccactgacagcagtaacga

SEQ ID NO: 265255 - DNA, 25 bp, Rattus norvegicus
ctcaggccactgtcagcagtaacga

SEQ ID NO: 265256 - DNA, 25 bp, Rattus norvegicus
ctcaggccggtgcaccatagctaga

SEQ ID NO: 265257 - DNA, 25 bp, Rattus norvegicus
ctcaggccggtggaccatagctaga

SEQ ID NO: 265258 - DNA, 25 bp, Rattus norvegicus
ctcaggccttgtccacatgaattga

SEQ ID NO: 265259 - DNA, 25 bp, Rattus norvegicus
ctcaggccttgtgcacatgaattga

SEQ ID NO: 265260 - DNA, 25 bp, Rattus norvegicus
ctcaggcgctgcacgagctggagat

SEQ ID NO: 265261 - DNA, 25 bp, Rattus norvegicus
ctcaggcgctgctcgagctggagat

SEQ ID NO: 265262 - DNA, 25 bp, Rattus norvegicus
ctcaggcgggctcaatggataccgt

SEQ ID NO: 265263 - DNA, 25 bp, Rattus norvegicus
ctcaggcgggctgaatggataccgt

SEQ ID NO: 265264 - DNA, 25 bp, Rattus norvegicus
ctcaggctcaagaggaggacggcaa

SEQ ID NO: 265265 - DNA, 25 bp, Rattus norvegicus
ctcaggctcaagtggaggacggcaa

SEQ ID NO: 265266 - DNA, 25 bp, Rattus norvegicus
ctcaggctgaccacactgggaagat

SEQ ID NO: 265267 - DNA, 25 bp, Rattus norvegicus
ctcaggctgacctcactgggaagat

SEQ ID NO: 265268 - DNA, 25 bp, Rattus norvegicus
ctcaggctgcggcagagttacagat

SEQ ID NO: 265269 - DNA, 25 bp, Rattus norvegicus
ctcaggctgcgggagagttacagat

SEQ ID NO: 265270 - DNA, 25 bp, Rattus norvegicus
ctcagggaactgactttcgggcgtg

SEQ ID NO: 265271 - DNA, 25 bp, Rattus norvegicus
ctcagggaactgtctttcgggcgtg

SEQ ID NO: 265272 - DNA, 25 bp, Rattus norvegicus
ctcagggacaggcacacaggacaat

SEQ ID NO: 265273 - DNA, 25 bp, Rattus norvegicus
ctcagggacagggacacaggacaat

SEQ ID NO: 265274 - DNA, 25 bp, Rattus norvegicus
ctcagggaggtgcttcctatcaata

SEQ ID NO: 265275 - DNA, 25 bp, Rattus norvegicus
ctcagggaggtggttcctatcaata

SEQ ID NO: 265276 - DNA, 25 bp, Rattus norvegicus
ctcagggatgataacacccacggga

SEQ ID NO: 265277 - DNA, 25 bp, Rattus norvegicus
ctcagggatgattacacccacggga

SEQ ID NO: 265278 - DNA, 25 bp, Rattus norvegicus
ctcagggattcccagcccagagtga

SEQ ID NO: 265279 - DNA, 25 bp, Rattus norvegicus
ctcagggattccgagcccagagtga

SEQ ID NO: 265280 - DNA, 25 bp, Rattus norvegicus
ctcagggccactagatgaccctggg

SEQ ID NO: 265281 - DNA, 25 bp, Rattus norvegicus
ctcagggccacttgatgaccctggg

SEQ ID NO: 265282 - DNA, 25 bp, Rattus norvegicus
ctcagggcctgcaacaacattttaa

SEQ ID NO: 265283 - DNA, 25 bp, Rattus norvegicus
ctcagggcctgctacaacattttaa

SEQ ID NO: 265284 - DNA, 25 bp, Rattus norvegicus
ctcagggcctgtattctaagtagaa

SEQ ID NO: 265285 - DNA, 25 bp, Rattus norvegicus
ctcagggcctgttttctaagtagaa

SEQ ID NO: 265286 - DNA, 25 bp, Rattus norvegicus
ctcagggcctttcgagttttcaaag

SEQ ID NO: 265287 - DNA, 25 bp, Rattus norvegicus
ctcagggcctttggagttttcaaag

SEQ ID NO: 265288 - DNA, 25 bp, Rattus norvegicus
ctcagggctgttagtgctaggagct

SEQ ID NO: 265289 - DNA, 25 bp, Rattus norvegicus
ctcagggctgtttgtgctaggagct

SEQ ID NO: 265290 - DNA, 25 bp, Rattus norvegicus
ctcagggtccacatcttgagcttaa

SEQ ID NO: 265291 - DNA, 25 bp, Rattus norvegicus
ctcagggtccacttcttgagcttaa

SEQ ID NO: 265292 - DNA, 25 bp, Rattus norvegicus
ctcagggtgtctagggctagtgtat

SEQ ID NO: 265293 - DNA, 25 bp, Rattus norvegicus
ctcagggtgtcttgggctagtgtat

SEQ ID NO: 265294 - DNA, 25 bp, Rattus norvegicus
ctcagggttgggagcatggttactc

SEQ ID NO: 265295 - DNA, 25 bp, Rattus norvegicus
ctcagggttgggtgcatggttactc

SEQ ID NO: 265296 - DNA, 25 bp, Rattus norvegicus
ctcagggtttttccaggtgttcata

SEQ ID NO: 265297 - DNA, 25 bp, Rattus norvegicus
ctcagggtttttgcaggtgttcata

SEQ ID NO: 265298 - DNA, 25 bp, Rattus norvegicus
ctcaggtactgtattgcttcggtta

SEQ ID NO: 265299 - DNA, 25 bp, Rattus norvegicus
ctcaggtactgttttgcttcggtta

SEQ ID NO: 265300 - DNA, 25 bp, Rattus norvegicus
ctcaggtacttcaggtgtatctcaa

SEQ ID NO: 265301 - DNA, 25 bp, Rattus norvegicus
ctcaggtacttctggtgtatctcaa

SEQ ID NO: 265302 - DNA, 25 bp, Rattus norvegicus
ctcaggtagagcattggcctagcat

SEQ ID NO: 265303 - DNA, 25 bp, Rattus norvegicus
ctcaggtagagctttggcctagcat

SEQ ID NO: 265304 - DNA, 25 bp, Rattus norvegicus
ctcaggtcatgcaaggtgaacgctt

SEQ ID NO: 265305 - DNA, 25 bp, Rattus norvegicus
ctcaggtcatgctaggtgaacgctt

SEQ ID NO: 265306 - DNA, 25 bp, Rattus norvegicus
ctcaggtccccgcgaaggaagatga

SEQ ID NO: 265307 - DNA, 25 bp, Rattus norvegicus
ctcaggtccccgggaaggaagatga

SEQ ID NO: 265308 - DNA, 25 bp, Rattus norvegicus
ctcaggtccctgatagtagtacttg

SEQ ID NO: 265309 - DNA, 25 bp, Rattus norvegicus
ctcaggtccctgttagtagtacttg

SEQ ID NO: 265310 - DNA, 25 bp, Rattus norvegicus
ctcaggtcctttctaatgttgtcta

SEQ ID NO: 265311 - DNA, 25 bp, Rattus norvegicus
ctcaggtcctttgtaatgttgtcta

SEQ ID NO: 265312 - DNA, 25 bp, Rattus norvegicus
ctcaggtctgtgctacttggttttt

SEQ ID NO: 265313 - DNA, 25 bp, Rattus norvegicus
ctcaggtctgtggtacttggttttt

SEQ ID NO: 265314 - DNA, 25 bp, Rattus norvegicus
ctcaggtgaagcctcccattggaag

SEQ ID NO: 265315 - DNA, 25 bp, Rattus norvegicus
ctcaggtgaagcgtcccattggaag

SEQ ID NO: 265316 - DNA, 25 bp, Rattus norvegicus
ctcaggtgcttaatggacagtcttt

SEQ ID NO: 265317 - DNA, 25 bp, Rattus norvegicus
ctcaggtgcttattggacagtcttt

SEQ ID NO: 265318 - DNA, 25 bp, Rattus norvegicus
ctcaggttaagactgtcagggcaga

SEQ ID NO: 265319 - DNA, 25 bp, Rattus norvegicus
ctcaggttaagagtgtcagggcaga

SEQ ID NO: 265320 - DNA, 25 bp, Rattus norvegicus
ctcaggttccagattcattgctgaa

SEQ ID NO: 265321 - DNA, 25 bp, Rattus norvegicus
ctcaggttccagtttcattgctgaa

SEQ ID NO: 265322 - DNA, 25 bp, Rattus norvegicus
ctcaggttcccaagtccagagcaag

SEQ ID NO: 265323 - DNA, 25 bp, Rattus norvegicus
ctcaggttcccatgtccagagcaag

SEQ ID NO: 265324 - DNA, 25 bp, Rattus norvegicus
ctcaggttctgcatccaacaacaag

SEQ ID NO: 265325 - DNA, 25 bp, Rattus norvegicus
ctcaggttctgcttccaacaacaag

SEQ ID NO: 265326 - DNA, 25 bp, Rattus norvegicus
ctcaggttctgtcgtggtcatctct

SEQ ID NO: 265327 - DNA, 25 bp, Rattus norvegicus
ctcaggttctgtggtggtcatctct

SEQ ID NO: 265328 - DNA, 25 bp, Rattus norvegicus
ctcagtaataccactcctctaataa

SEQ ID NO: 265329 - DNA, 25 bp, Rattus norvegicus
ctcagtaatacctctcctctaataa

SEQ ID NO: 265330 - DNA, 25 bp, Rattus norvegicus
ctcagtaatctgatggtagctatta

SEQ ID NO: 265331 - DNA, 25 bp, Rattus norvegicus
ctcagtaatctgttggtagctatta

SEQ ID NO: 265332 - DNA, 25 bp, Rattus norvegicus
ctcagtacgtctccttcaaaaatta

SEQ ID NO: 265333 - DNA, 25 bp, Rattus norvegicus
ctcagtacgtctgcttcaaaaatta

SEQ ID NO: 265334 - DNA, 25 bp, Rattus norvegicus
ctcagtactaccaggagcaggagca

SEQ ID NO: 265335 - DNA, 25 bp, Rattus norvegicus
ctcagtactacctggagcaggagca

SEQ ID NO: 265336 - DNA, 25 bp, Rattus norvegicus
ctcagtagcgtcaccacgatgttca

SEQ ID NO: 265337 - DNA, 25 bp, Rattus norvegicus
ctcagtagcgtctccacgatgttca

SEQ ID NO: 265338 - DNA, 25 bp, Rattus norvegicus
ctcagtatgtttccccaggtccaat

SEQ ID NO: 265339 - DNA, 25 bp, Rattus norvegicus
ctcagtatgtttgcccaggtccaat

SEQ ID NO: 265340 - DNA, 25 bp, Rattus norvegicus
ctcagtcagagcaggacaacgtgtt

SEQ ID NO: 265341 - DNA, 25 bp, Rattus norvegicus
ctcagtcagagctggacaacgtgtt

SEQ ID NO: 265342 - DNA, 25 bp, Rattus norvegicus
ctcagtcagctcacgagtcacagaa

SEQ ID NO: 265343 - DNA, 25 bp, Rattus norvegicus
ctcagtcagctctcgagtcacagaa

SEQ ID NO: 265344 - DNA, 25 bp, Rattus norvegicus
ctcagtcaggcgcttctaaacagta

SEQ ID NO: 265345 - DNA, 25 bp, Rattus norvegicus
ctcagtcaggcggttctaaacagta

SEQ ID NO: 265346 - DNA, 25 bp, Rattus norvegicus
ctcagtcattcaacaggagccctgt

SEQ ID NO: 265347 - DNA, 25 bp, Rattus norvegicus
ctcagtcattcatcaggagccctgt

SEQ ID NO: 265348 - DNA, 25 bp, Rattus norvegicus
ctcagtccagagcttttggtttctc

SEQ ID NO: 265349 - DNA, 25 bp, Rattus norvegicus
ctcagtccagaggttttggtttctc

SEQ ID NO: 265350 - DNA, 25 bp, Rattus norvegicus
ctcagtcctggaatgaatgctggaa

SEQ ID NO: 265351 - DNA, 25 bp, Rattus norvegicus
ctcagtcctggattgaatgctggaa

SEQ ID NO: 265352 - DNA, 25 bp, Rattus norvegicus
ctcagtcctgtaattaaagttttct

SEQ ID NO: 265353 - DNA, 25 bp, Rattus norvegicus
ctcagtcctgtaccacgtgtatatc

SEQ ID NO: 265354 - DNA, 25 bp, Rattus norvegicus
ctcagtcctgtagcacgtgtatatc

SEQ ID NO: 265355 - DNA, 25 bp, Rattus norvegicus
ctcagtcctgtatttaaagttttct

SEQ ID NO: 265356 - DNA, 25 bp, Rattus norvegicus
ctcagtctaccacaccaggttataa

SEQ ID NO: 265357 - DNA, 25 bp, Rattus norvegicus
ctcagtctaccagaccaggttataa

SEQ ID NO: 265358 - DNA, 25 bp, Rattus norvegicus
ctcagtctcagaagtacacctcaga

SEQ ID NO: 265359 - DNA, 25 bp, Rattus norvegicus
ctcagtctcagatgtacacctcaga

SEQ ID NO: 265360 - DNA, 25 bp, Rattus norvegicus
ctcagtctccttacctgtagaatga

SEQ ID NO: 265361 - DNA, 25 bp, Rattus norvegicus
ctcagtctcctttcctgtagaatga

SEQ ID NO: 265362 - DNA, 25 bp, Rattus norvegicus
ctcagtctctggatggattgtgttc

SEQ ID NO: 265363 - DNA, 25 bp, Rattus norvegicus
ctcagtctctggttggattgtgttc

SEQ ID NO: 265364 - DNA, 25 bp, Rattus norvegicus
ctcagtctgacgattcactgtgaat

SEQ ID NO: 265365 - DNA, 25 bp, Rattus norvegicus
ctcagtctgacgtttcactgtgaat

SEQ ID NO: 265366 - DNA, 25 bp, Rattus norvegicus
ctcagtctggaacacagcggccgga

SEQ ID NO: 265367 - DNA, 25 bp, Rattus norvegicus
ctcagtctggaagacagcggccgga

SEQ ID NO: 265368 - DNA, 25 bp, Rattus norvegicus
ctcagtctggtcatagagttgtcaa

SEQ ID NO: 265369 - DNA, 25 bp, Rattus norvegicus
ctcagtctggtcttagagttgtcaa

SEQ ID NO: 265370 - DNA, 25 bp, Rattus norvegicus
ctcagtctgtgacatggcattcagt

SEQ ID NO: 265371 - DNA, 25 bp, Rattus norvegicus
ctcagtctgtgagatggcattcagt

SEQ ID NO: 265372 - DNA, 25 bp, Rattus norvegicus
ctcagtcttagtccaatgtttcttt

SEQ ID NO: 265373 - DNA, 25 bp, Rattus norvegicus
ctcagtcttagtgcaatgtttcttt

SEQ ID NO: 265374 - DNA, 25 bp, Rattus norvegicus
ctcagtctttgtcggaagcaggtcc

SEQ ID NO: 265375 - DNA, 25 bp, Rattus norvegicus
ctcagtctttgtgggaagcaggtcc

SEQ ID NO: 265376 - DNA, 25 bp, Rattus norvegicus
ctcagtgaagaacaagctcgcctac

SEQ ID NO: 265377 - DNA, 25 bp, Rattus norvegicus
ctcagtgaagaagaagctcgcctac

SEQ ID NO: 265378 - DNA, 25 bp, Rattus norvegicus
ctcagtgaagggagagggcacctct

SEQ ID NO: 265379 - DNA, 25 bp, Rattus norvegicus
ctcagtgaagggtgagggcacctct

SEQ ID NO: 265380 - DNA, 25 bp, Rattus norvegicus
ctcagtgactcactgcactctcata

SEQ ID NO: 265381 - DNA, 25 bp, Rattus norvegicus
ctcagtgactcagtgcactctcata

SEQ ID NO: 265382 - DNA, 25 bp, Rattus norvegicus
ctcagtgatggaaatggtcccttaa

SEQ ID NO: 265383 - DNA, 25 bp, Rattus norvegicus
ctcagtgatggatatggtcccttaa

SEQ ID NO: 265384 - DNA, 25 bp, Rattus norvegicus
ctcagtgattagcttttggtatgtc

SEQ ID NO: 265385 - DNA, 25 bp, Rattus norvegicus
ctcagtgattaggttttggtatgtc

SEQ ID NO: 265386 - DNA, 25 bp, Rattus norvegicus
ctcagtgcagggagcaggtctaaac

SEQ ID NO: 265387 - DNA, 25 bp, Rattus norvegicus
ctcagtgcagggtgcaggtctaaac

SEQ ID NO: 265388 - DNA, 25 bp, Rattus norvegicus
ctcagtgccatgcgttcgctgaaag

SEQ ID NO: 265389 - DNA, 25 bp, Rattus norvegicus
ctcagtgccatgggttcgctgaaag

SEQ ID NO: 265390 - DNA, 25 bp, Rattus norvegicus
ctcagtgccctcatctaaagacaat

SEQ ID NO: 265391 - DNA, 25 bp, Rattus norvegicus
ctcagtgccctcttctaaagacaat

SEQ ID NO: 265392 - DNA, 25 bp, Rattus norvegicus
ctcagtgcctaccactgtctttaaa

SEQ ID NO: 265393 - DNA, 25 bp, Rattus norvegicus
ctcagtgcctacgactgtctttaaa

SEQ ID NO: 265394 - DNA, 25 bp, Rattus norvegicus
ctcagtgcctttctagctggagtgt

SEQ ID NO: 265395 - DNA, 25 bp, Rattus norvegicus
ctcagtgcctttgtagctggagtgt

SEQ ID NO: 265396 - DNA, 25 bp, Rattus norvegicus
ctcagtgctcagatggatgctctaa

SEQ ID NO: 265397 - DNA, 25 bp, Rattus norvegicus
ctcagtgctcagcatgaactgttca

SEQ ID NO: 265398 - DNA, 25 bp, Rattus norvegicus
ctcagtgctcaggatgaactgttca

SEQ ID NO: 265399 - DNA, 25 bp, Rattus norvegicus
ctcagtgctcagttggatgctctaa

SEQ ID NO: 265400 - DNA, 25 bp, Rattus norvegicus
ctcagtgctgcaaagatggatttaa

SEQ ID NO: 265401 - DNA, 25 bp, Rattus norvegicus
ctcagtgctgcatagatggatttaa

SEQ ID NO: 265402 - DNA, 25 bp, Rattus norvegicus
ctcagtgctttaaaatgtcattgtg

SEQ ID NO: 265403 - DNA, 25 bp, Rattus norvegicus
ctcagtgctttataatgtcattgtg

SEQ ID NO: 265404 - DNA, 25 bp, Rattus norvegicus
ctcagtggacatcggaacggacaga

SEQ ID NO: 265405 - DNA, 25 bp, Rattus norvegicus
ctcagtggacatgggaacggacaga

SEQ ID NO: 265406 - DNA, 25 bp, Rattus norvegicus
ctcagtggagccatcccatgagaga

SEQ ID NO: 265407 - DNA, 25 bp, Rattus norvegicus
ctcagtggagccttcccatgagaga

SEQ ID NO: 265408 - DNA, 25 bp, Rattus norvegicus
ctcagtggataaaggtacttgccca

SEQ ID NO: 265409 - DNA, 25 bp, Rattus norvegicus
ctcagtggataatggtacttgccca

SEQ ID NO: 265410 - DNA, 25 bp, Rattus norvegicus
ctcagtggccaactcagggtcagaa

SEQ ID NO: 265411 - DNA, 25 bp, Rattus norvegicus
ctcagtggccaagtcagggtcagaa

SEQ ID NO: 265412 - DNA, 25 bp, Rattus norvegicus
ctcagtgggaaaaatcgctcttatc

SEQ ID NO: 265413 - DNA, 25 bp, Rattus norvegicus
ctcagtgggaaaagtagccttgttt

SEQ ID NO: 265414 - DNA, 25 bp, Rattus norvegicus
ctcagtgggaaatatcgctcttatc

SEQ ID NO: 265415 - DNA, 25 bp, Rattus norvegicus
ctcagtgggaaatgtagccttgttt

SEQ ID NO: 265416 - DNA, 25 bp, Rattus norvegicus
ctcagtgggatgcaagggtttcttt

SEQ ID NO: 265417 - DNA, 25 bp, Rattus norvegicus
ctcagtgggatggaagggtttcttt

SEQ ID NO: 265418 - DNA, 25 bp, Rattus norvegicus
ctcagtgggcaactatcctgtggat

SEQ ID NO: 265419 - DNA, 25 bp, Rattus norvegicus
ctcagtgggcaagtatcctgtggat

SEQ ID NO: 265420 - DNA, 25 bp, Rattus norvegicus
ctcagtgggctcattccagaagata

SEQ ID NO: 265421 - DNA, 25 bp, Rattus norvegicus
ctcagtgggctctttccagaagata

SEQ ID NO: 265422 - DNA, 25 bp, Rattus norvegicus
ctcagtgggtctaccaggtgatgga

SEQ ID NO: 265423 - DNA, 25 bp, Rattus norvegicus
ctcagtgggtcttccaggtgatgga

SEQ ID NO: 265424 - DNA, 25 bp, Rattus norvegicus
ctcagtggttagcagcactggctac

SEQ ID NO: 265425 - DNA, 25 bp, Rattus norvegicus
ctcagtggttaggagcactggctac

SEQ ID NO: 265426 - DNA, 25 bp, Rattus norvegicus
ctcagtggttatcagcacctgctgt

SEQ ID NO: 265427 - DNA, 25 bp, Rattus norvegicus
ctcagtggttatgagcacctgctgt

SEQ ID NO: 265428 - DNA, 25 bp, Rattus norvegicus
ctcagtgtccccatggattttaaca

SEQ ID NO: 265429 - DNA, 25 bp, Rattus norvegicus
ctcagtgtccccttggattttaaca

SEQ ID NO: 265430 - DNA, 25 bp, Rattus norvegicus
ctcagtgttgacacttccatagcaa

SEQ ID NO: 265431 - DNA, 25 bp, Rattus norvegicus
ctcagtgttgactcttccatagcaa

SEQ ID NO: 265432 - DNA, 25 bp, Rattus norvegicus
ctcagtgttgtccaagaacagctct

SEQ ID NO: 265433 - DNA, 25 bp, Rattus norvegicus
ctcagtgttgtcgaagaacagctct

SEQ ID NO: 265434 - DNA, 25 bp, Rattus norvegicus
ctcagttaaaccactttggaaatat

SEQ ID NO: 265435 - DNA, 25 bp, Rattus norvegicus
ctcagttaaacctctttggaaatat

SEQ ID NO: 265436 - DNA, 25 bp, Rattus norvegicus
ctcagttaacctcccagtgtgggtt

SEQ ID NO: 265437 - DNA, 25 bp, Rattus norvegicus
ctcagttaacctgccagtgtgggtt

SEQ ID NO: 265438 - DNA, 25 bp, Rattus norvegicus
ctcagttacggcaccacggattaga

SEQ ID NO: 265439 - DNA, 25 bp, Rattus norvegicus
ctcagttacggctccacggattaga

SEQ ID NO: 265440 - DNA, 25 bp, Rattus norvegicus
ctcagttactcccaaggtagcagaa

SEQ ID NO: 265441 - DNA, 25 bp, Rattus norvegicus
ctcagttactccgaaggtagcagaa

SEQ ID NO: 265442 - DNA, 25 bp, Rattus norvegicus
ctcagttagccgaaccagtcaaggt

SEQ ID NO: 265443 - DNA, 25 bp, Rattus norvegicus
ctcagttagccgtaccagtcaaggt

SEQ ID NO: 265444 - DNA, 25 bp, Rattus norvegicus
ctcagttgagctcccaacgacgtga

SEQ ID NO: 265445 - DNA, 25 bp, Rattus norvegicus
ctcagttgagctgccaacgacgtga

SEQ ID NO: 265446 - DNA, 25 bp, Rattus norvegicus
ctcagttgctcccaagtaacagtga

SEQ ID NO: 265447 - DNA, 25 bp, Rattus norvegicus
ctcagttgctccgaagtaacagtga

SEQ ID NO: 265448 - DNA, 25 bp, Rattus norvegicus
ctcagttgctgcaacatatggttgt

SEQ ID NO: 265449 - DNA, 25 bp, Rattus norvegicus
ctcagttgctgctacatatggttgt

SEQ ID NO: 265450 - DNA, 25 bp, Rattus norvegicus
ctcagtttccacatttgtacaaatg

SEQ ID NO: 265451 - DNA, 25 bp, Rattus norvegicus
ctcagtttccacttttgtacaaatg

SEQ ID NO: 265452 - DNA, 25 bp, Rattus norvegicus
ctcagttttttcatccatgtttgtg

SEQ ID NO: 265453 - DNA, 25 bp, Rattus norvegicus
ctcagttttttcttccatgtttgtg

SEQ ID NO: 265454 - DNA, 25 bp, Rattus norvegicus
ctcataacacatacagactctccat

SEQ ID NO: 265455 - DNA, 25 bp, Rattus norvegicus
ctcataacacattcagactctccat

SEQ ID NO: 265456 - DNA, 25 bp, Rattus norvegicus
ctcatacccaggctcaaatggaatg

SEQ ID NO: 265457 - DNA, 25 bp, Rattus norvegicus
ctcatacccagggtcaaatggaatg

SEQ ID NO: 265458 - DNA, 25 bp, Rattus norvegicus
ctcatacccttaactgcaaaccaag

SEQ ID NO: 265459 - DNA, 25 bp, Rattus norvegicus
ctcatacccttatctgcaaaccaag

SEQ ID NO: 265460 - DNA, 25 bp, Rattus norvegicus
ctcataccttggctgtcaatcacag

SEQ ID NO: 265461 - DNA, 25 bp, Rattus norvegicus
ctcataccttgggtgtcaatcacag

SEQ ID NO: 265462 - DNA, 25 bp, Rattus norvegicus
ctcatacctttactgctgctcatta

SEQ ID NO: 265463 - DNA, 25 bp, Rattus norvegicus
ctcatacctttagtgctgctcatta

SEQ ID NO: 265464 - DNA, 25 bp, Rattus norvegicus
ctcatacggatgatggtgcctacaa

SEQ ID NO: 265465 - DNA, 25 bp, Rattus norvegicus
ctcatacggatgttggtgcctacaa

SEQ ID NO: 265466 - DNA, 25 bp, Rattus norvegicus
ctcatagagaccactgcgggctgat

SEQ ID NO: 265467 - DNA, 25 bp, Rattus norvegicus
ctcatagagacctctgcgggctgat

SEQ ID NO: 265468 - DNA, 25 bp, Rattus norvegicus
ctcatagccagcctagattgctgct

SEQ ID NO: 265469 - DNA, 25 bp, Rattus norvegicus
ctcatagccagcgtagattgctgct

SEQ ID NO: 265470 - DNA, 25 bp, Rattus norvegicus
ctcatagcctgcagacatttcacag

SEQ ID NO: 265471 - DNA, 25 bp, Rattus norvegicus
ctcatagcctgctgacatttcacag

SEQ ID NO: 265472 - DNA, 25 bp, Rattus norvegicus
ctcatataggctatgtgttcatttg

SEQ ID NO: 265473 - DNA, 25 bp, Rattus norvegicus
ctcatataggctttgtgttcatttg

SEQ ID NO: 265474 - DNA, 25 bp, Rattus norvegicus
ctcatatcttcacttggcaagctca

SEQ ID NO: 265475 - DNA, 25 bp, Rattus norvegicus
ctcatatcttcagttggcaagctca

SEQ ID NO: 265476 - DNA, 25 bp, Rattus norvegicus
ctcatatgggatcgtccctggacca

SEQ ID NO: 265477 - DNA, 25 bp, Rattus norvegicus
ctcatatgggatggtccctggacca

SEQ ID NO: 265478 - DNA, 25 bp, Rattus norvegicus
ctcatcaagcagatgccacccagaa

SEQ ID NO: 265479 - DNA, 25 bp, Rattus norvegicus
ctcatcaagcagttgccacccagaa

SEQ ID NO: 265480 - DNA, 25 bp, Rattus norvegicus
ctcatcacacttagggtttcttcag

SEQ ID NO: 265481 - DNA, 25 bp, Rattus norvegicus
ctcatcacactttgggtttcttcag

SEQ ID NO: 265482 - DNA, 25 bp, Rattus norvegicus
ctcatcacggatatggactctgtac

SEQ ID NO: 265483 - DNA, 25 bp, Rattus norvegicus
ctcatcacggatttggactctgtac

SEQ ID NO: 265484 - DNA, 25 bp, Rattus norvegicus
ctcatcactgttacctccagatgta

SEQ ID NO: 265485 - DNA, 25 bp, Rattus norvegicus
ctcatcactgtttcctccagatgta

SEQ ID NO: 265486 - DNA, 25 bp, Rattus norvegicus
ctcatcagccacataacaacttaca

SEQ ID NO: 265487 - DNA, 25 bp, Rattus norvegicus
ctcatcagccacttaacaacttaca

SEQ ID NO: 265488 - DNA, 25 bp, Rattus norvegicus
ctcatcatcttcctgctcgaaaggg

SEQ ID NO: 265489 - DNA, 25 bp, Rattus norvegicus
ctcatcatcttcgtgctcgaaaggg

SEQ ID NO: 265490 - DNA, 25 bp, Rattus norvegicus
ctcatcattagtccgtttgtctttc

SEQ ID NO: 265491 - DNA, 25 bp, Rattus norvegicus
ctcatcattagtgcgtttgtctttc

SEQ ID NO: 265492 - DNA, 25 bp, Rattus norvegicus
ctcatcattccccagaaactttttt

SEQ ID NO: 265493 - DNA, 25 bp, Rattus norvegicus
ctcatcattcccgagaaactttttt

SEQ ID NO: 265494 - DNA, 25 bp, Rattus norvegicus
ctcatccaagaaatcgtcatcacgc

SEQ ID NO: 265495 - DNA, 25 bp, Rattus norvegicus
ctcatccaagaactccgatccagtg

SEQ ID NO: 265496 - DNA, 25 bp, Rattus norvegicus
ctcatccaagaagtccgatccagtg

SEQ ID NO: 265497 - DNA, 25 bp, Rattus norvegicus
ctcatccaagaattcgtcatcacgc

SEQ ID NO: 265498 - DNA, 25 bp, Rattus norvegicus
ctcatccagcaactctcttcataaa

SEQ ID NO: 265499 - DNA, 25 bp, Rattus norvegicus
ctcatccagcaagtctcttcataaa

SEQ ID NO: 265500 - DNA, 25 bp, Rattus norvegicus
ctcatccatttccaaccttgtacaa

SEQ ID NO: 265501 - DNA, 25 bp, Rattus norvegicus
ctcatccatttcgaaccttgtacaa

SEQ ID NO: 265502 - DNA, 25 bp, Rattus norvegicus
ctcatccccgccctgggaagtgatt

SEQ ID NO: 265503 - DNA, 25 bp, Rattus norvegicus
ctcatccccgccgtgggaagtgatt

SEQ ID NO: 265504 - DNA, 25 bp, Rattus norvegicus
ctcatccggacgcactgggaaggaa

SEQ ID NO: 265505 - DNA, 25 bp, Rattus norvegicus
ctcatccggacggactgggaaggaa

SEQ ID NO: 265506 - DNA, 25 bp, Rattus norvegicus
ctcatccgtgggaagccttttaatt

SEQ ID NO: 265507 - DNA, 25 bp, Rattus norvegicus
ctcatccgtgggtagccttttaatt

SEQ ID NO: 265508 - DNA, 25 bp, Rattus norvegicus
ctcatccgtttcagcacattatttg

SEQ ID NO: 265509 - DNA, 25 bp, Rattus norvegicus
ctcatccgtttctgcacattatttg

SEQ ID NO: 265510 - DNA, 25 bp, Rattus norvegicus
ctcatcctctctaaattcctgagat

SEQ ID NO: 265511 - DNA, 25 bp, Rattus norvegicus
ctcatcctctcttaattcctgagat

SEQ ID NO: 265512 - DNA, 25 bp, Rattus norvegicus
ctcatcctctttagttttactccat

SEQ ID NO: 265513 - DNA, 25 bp, Rattus norvegicus
ctcatcctcttttgttttactccat

SEQ ID NO: 265514 - DNA, 25 bp, Rattus norvegicus
ctcatcctgggcagttctaacaaat

SEQ ID NO: 265515 - DNA, 25 bp, Rattus norvegicus
ctcatcctgggctgttctaacaaat

SEQ ID NO: 265516 - DNA, 25 bp, Rattus norvegicus
ctcatccttagtccagagaagcctg

SEQ ID NO: 265517 - DNA, 25 bp, Rattus norvegicus
ctcatccttagtgcagagaagcctg

SEQ ID NO: 265518 - DNA, 25 bp, Rattus norvegicus
ctcatcgacttaaggaatccagtta

SEQ ID NO: 265519 - DNA, 25 bp, Rattus norvegicus
ctcatcgacttatggaatccagtta

SEQ ID NO: 265520 - DNA, 25 bp, Rattus norvegicus
ctcatcgcactcacttgtaatagca

SEQ ID NO: 265521 - DNA, 25 bp, Rattus norvegicus
ctcatcgcactctcttgtaatagca

SEQ ID NO: 265522 - DNA, 25 bp, Rattus norvegicus
ctcatcgcatctcaatcttcattga

SEQ ID NO: 265523 - DNA, 25 bp, Rattus norvegicus
ctcatcgcatctgaatcttcattga

SEQ ID NO: 265524 - DNA, 25 bp, Rattus norvegicus
ctcatcgtctgcaaagtcattctca

SEQ ID NO: 265525 - DNA, 25 bp, Rattus norvegicus
ctcatcgtctgctaagtcattctca

SEQ ID NO: 265526 - DNA, 25 bp, Rattus norvegicus
ctcatcgtgacgaatgacactgaac

SEQ ID NO: 265527 - DNA, 25 bp, Rattus norvegicus
ctcatcgtgacgtatgacactgaac

SEQ ID NO: 265528 - DNA, 25 bp, Rattus norvegicus
ctcatcgttagcaaccgaggttgac

SEQ ID NO: 265529 - DNA, 25 bp, Rattus norvegicus
ctcatcgttagctaccgaggttgac

SEQ ID NO: 265530 - DNA, 25 bp, Rattus norvegicus
ctcatctaacctctgcacttagaaa

SEQ ID NO: 265531 - DNA, 25 bp, Rattus norvegicus
ctcatctaacctgtgcacttagaaa

SEQ ID NO: 265532 - DNA, 25 bp, Rattus norvegicus
ctcatctacatacctggtcctgtgg

SEQ ID NO: 265533 - DNA, 25 bp, Rattus norvegicus
ctcatctacatagctggtcctgtgg

SEQ ID NO: 265534 - DNA, 25 bp, Rattus norvegicus
ctcatctatgcaccgacttcgattt

SEQ ID NO: 265535 - DNA, 25 bp, Rattus norvegicus
ctcatctatgcagcgacttcgattt

SEQ ID NO: 265536 - DNA, 25 bp, Rattus norvegicus
ctcatctcatctacacacatttgca

SEQ ID NO: 265537 - DNA, 25 bp, Rattus norvegicus
ctcatctcatcttcacacatttgca

SEQ ID NO: 265538 - DNA, 25 bp, Rattus norvegicus
ctcatctcattcctcctacaaaaat

SEQ ID NO: 265539 - DNA, 25 bp, Rattus norvegicus
ctcatctcattcgtcctacaaaaat

SEQ ID NO: 265540 - DNA, 25 bp, Rattus norvegicus
ctcatctcggtactgagtggtactt

SEQ ID NO: 265541 - DNA, 25 bp, Rattus norvegicus
ctcatctcggtagtgagtggtactt

SEQ ID NO: 265542 - DNA, 25 bp, Rattus norvegicus
ctcatctcggtcctcaaagcattga

SEQ ID NO: 265543 - DNA, 25 bp, Rattus norvegicus
ctcatctcggtcgtcaaagcattga

SEQ ID NO: 265544 - DNA, 25 bp, Rattus norvegicus
ctcatctgagatccctgtacacaag

SEQ ID NO: 265545 - DNA, 25 bp, Rattus norvegicus
ctcatctgagatgcctgtacacaag

SEQ ID NO: 265546 - DNA, 25 bp, Rattus norvegicus
ctcatctggtaacatggtgatctta

SEQ ID NO: 265547 - DNA, 25 bp, Rattus norvegicus
ctcatctggtaagatggtgatctta

SEQ ID NO: 265548 - DNA, 25 bp, Rattus norvegicus
ctcatctgtcttcttctggagaact

SEQ ID NO: 265549 - DNA, 25 bp, Rattus norvegicus
ctcatctgtcttgttctggagaact

SEQ ID NO: 265550 - DNA, 25 bp, Rattus norvegicus
ctcatcttaactattcagtccacct

SEQ ID NO: 265551 - DNA, 25 bp, Rattus norvegicus
ctcatcttaacttttcagtccacct

SEQ ID NO: 265552 - DNA, 25 bp, Rattus norvegicus
ctcatcttcatcctcattctgtatg

SEQ ID NO: 265553 - DNA, 25 bp, Rattus norvegicus
ctcatcttcatcgtcattctgtatg

SEQ ID NO: 265554 - DNA, 25 bp, Rattus norvegicus
ctcatctttgctcgaggagccccat

SEQ ID NO: 265555 - DNA, 25 bp, Rattus norvegicus
ctcatctttgctggaggagccccat

SEQ ID NO: 265556 - DNA, 25 bp, Rattus norvegicus
ctcatctttttaagtcgcttaaggg

SEQ ID NO: 265557 - DNA, 25 bp, Rattus norvegicus
ctcatctttttatgtcgcttaaggg

SEQ ID NO: 265558 - DNA, 25 bp, Rattus norvegicus
ctcatgacgaccagctcagtctcgg

SEQ ID NO: 265559 - DNA, 25 bp, Rattus norvegicus
ctcatgacgacctgctcagtctcgg

SEQ ID NO: 265560 - DNA, 25 bp, Rattus norvegicus
ctcatgactcacatgcccttggaat

SEQ ID NO: 265561 - DNA, 25 bp, Rattus norvegicus
ctcatgactcacttgcccttggaat

SEQ ID NO: 265562 - DNA, 25 bp, Rattus norvegicus
ctcatgattgacctggctgtgctac

SEQ ID NO: 265563 - DNA, 25 bp, Rattus norvegicus
ctcatgattgacgtggctgtgctac

SEQ ID NO: 265564 - DNA, 25 bp, Rattus norvegicus
ctcatgcaagataattccccaggtc

SEQ ID NO: 265565 - DNA, 25 bp, Rattus norvegicus
ctcatgcaagattattccccaggtc

SEQ ID NO: 265566 - DNA, 25 bp, Rattus norvegicus
ctcatgccaaaacgctggttcttaa

SEQ ID NO: 265567 - DNA, 25 bp, Rattus norvegicus
ctcatgccaaaaggctggttcttaa

SEQ ID NO: 265568 - DNA, 25 bp, Rattus norvegicus
ctcatgccccatcctaaatagataa

SEQ ID NO: 265569 - DNA, 25 bp, Rattus norvegicus
ctcatgccccatgctaaatagataa

SEQ ID NO: 265570 - DNA, 25 bp, Rattus norvegicus
ctcatgcccgcaaatatccagttga

SEQ ID NO: 265571 - DNA, 25 bp, Rattus norvegicus
ctcatgcccgcatatatccagttga

SEQ ID NO: 265572 - DNA, 25 bp, Rattus norvegicus
ctcatgcctataatcagtatttgtg

SEQ ID NO: 265573 - DNA, 25 bp, Rattus norvegicus
ctcatgcctatattcagtatttgtg

SEQ ID NO: 265574 - DNA, 25 bp, Rattus norvegicus
ctcatgcctgtacgaagaggagatc

SEQ ID NO: 265575 - DNA, 25 bp, Rattus norvegicus
ctcatgcctgtaggaagaggagatc

SEQ ID NO: 265576 - DNA, 25 bp, Rattus norvegicus
ctcatgcctgtgaaatcttagcact

SEQ ID NO: 265577 - DNA, 25 bp, Rattus norvegicus
ctcatgcctgtgtaatcttagcact

SEQ ID NO: 265578 - DNA, 25 bp, Rattus norvegicus
ctcatgcgtcttagtttgtttgctt

SEQ ID NO: 265579 - DNA, 25 bp, Rattus norvegicus
ctcatgcgtctttgtttgtttgctt

SEQ ID NO: 265580 - DNA, 25 bp, Rattus norvegicus
ctcatgctctcaatactaccatggg

SEQ ID NO: 265581 - DNA, 25 bp, Rattus norvegicus
ctcatgctctcattactaccatggg

SEQ ID NO: 265582 - DNA, 25 bp, Rattus norvegicus
ctcatgctgctcattgtttcagatt

SEQ ID NO: 265583 - DNA, 25 bp, Rattus norvegicus
ctcatgctgctctttgtttcagatt

SEQ ID NO: 265584 - DNA, 25 bp, Rattus norvegicus
ctcatggaaagactgctgctgctca

SEQ ID NO: 265585 - DNA, 25 bp, Rattus norvegicus
ctcatggaaagagtgctgctgctca

SEQ ID NO: 265586 - DNA, 25 bp, Rattus norvegicus
ctcatggaaggcctctgttgtcaaa

SEQ ID NO: 265587 - DNA, 25 bp, Rattus norvegicus
ctcatggaaggcgtctgttgtcaaa

SEQ ID NO: 265588 - DNA, 25 bp, Rattus norvegicus
ctcatggatcatagatgctgtaaac

SEQ ID NO: 265589 - DNA, 25 bp, Rattus norvegicus
ctcatggatcattgatgctgtaaac

SEQ ID NO: 265590 - DNA, 25 bp, Rattus norvegicus
ctcatggccagaatgaacccgttat

SEQ ID NO: 265591 - DNA, 25 bp, Rattus norvegicus
ctcatggccagaatgtcattctgtg

SEQ ID NO: 265592 - DNA, 25 bp, Rattus norvegicus
ctcatggccagattgaacccgttat

SEQ ID NO: 265593 - DNA, 25 bp, Rattus norvegicus
ctcatggccagattgtcattctgtg

SEQ ID NO: 265594 - DNA, 25 bp, Rattus norvegicus
ctcatggctaagaggctggtgaacc

SEQ ID NO: 265595 - DNA, 25 bp, Rattus norvegicus
ctcatggctaagtggctggtgaacc

SEQ ID NO: 265596 - DNA, 25 bp, Rattus norvegicus
ctcatggctcagatgaagaggtcat

SEQ ID NO: 265597 - DNA, 25 bp, Rattus norvegicus
ctcatggctcagttgaagaggtcat

SEQ ID NO: 265598 - DNA, 25 bp, Rattus norvegicus
ctcatgggacttcgcgtgcactctg

SEQ ID NO: 265599 - DNA, 25 bp, Rattus norvegicus
ctcatgggacttggcgtgcactctg

SEQ ID NO: 265600 - DNA, 25 bp, Rattus norvegicus
ctcatgggagccactctgaggagga

SEQ ID NO: 265601 - DNA, 25 bp, Rattus norvegicus
ctcatgggagcctctctgaggagga

SEQ ID NO: 265602 - DNA, 25 bp, Rattus norvegicus
ctcatgggcaggacttggtgctact

SEQ ID NO: 265603 - DNA, 25 bp, Rattus norvegicus
ctcatgggcaggtcttggtgctact

SEQ ID NO: 265604 - DNA, 25 bp, Rattus norvegicus
ctcatggtctctatgggtttgttat

SEQ ID NO: 265605 - DNA, 25 bp, Rattus norvegicus
ctcatggtctctttgggtttgttat

SEQ ID NO: 265606 - DNA, 25 bp, Rattus norvegicus
ctcatggtggtcatcaggaactggg

SEQ ID NO: 265607 - DNA, 25 bp, Rattus norvegicus
ctcatggtggtcttcaggaactggg

SEQ ID NO: 265608 - DNA, 25 bp, Rattus norvegicus
ctcatggtttacattctttggctga

SEQ ID NO: 265609 - DNA, 25 bp, Rattus norvegicus
ctcatggtttactttctttggctga

SEQ ID NO: 265610 - DNA, 25 bp, Rattus norvegicus
ctcatgtaacagacctcaaccataa

SEQ ID NO: 265611 - DNA, 25 bp, Rattus norvegicus
ctcatgtaacagtcctcaaccataa

SEQ ID NO: 265612 - DNA, 25 bp, Rattus norvegicus
ctcatgtaactgatgactctggacc

SEQ ID NO: 265613 - DNA, 25 bp, Rattus norvegicus
ctcatgtaactgttgactctggacc

SEQ ID NO: 265614 - DNA, 25 bp, Rattus norvegicus
ctcatgtagcagattcacagccctc

SEQ ID NO: 265615 - DNA, 25 bp, Rattus norvegicus
ctcatgtagcagtttcacagccctc

SEQ ID NO: 265616 - DNA, 25 bp, Rattus norvegicus
ctcatgtatggccttttgtctagta

SEQ ID NO: 265617 - DNA, 25 bp, Rattus norvegicus
ctcatgtatggcgttttgtctagta

SEQ ID NO: 265618 - DNA, 25 bp, Rattus norvegicus
ctcatgtattagcaagcagctcata

SEQ ID NO: 265619 - DNA, 25 bp, Rattus norvegicus
ctcatgtattaggaagcagctcata

SEQ ID NO: 265620 - DNA, 25 bp, Rattus norvegicus
ctcatgtcccacatggttgtttagt

SEQ ID NO: 265621 - DNA, 25 bp, Rattus norvegicus
ctcatgtcccacttggttgtttagt

SEQ ID NO: 265622 - DNA, 25 bp, Rattus norvegicus
ctcatgtctatgaaacactcctaca

SEQ ID NO: 265623 - DNA, 25 bp, Rattus norvegicus
ctcatgtctatgtaacactcctaca

SEQ ID NO: 265624 - DNA, 25 bp, Rattus norvegicus
ctcatgtctcacctgatgtatttac

SEQ ID NO: 265625 - DNA, 25 bp, Rattus norvegicus
ctcatgtctcacgtgatgtatttac

SEQ ID NO: 265626 - DNA, 25 bp, Rattus norvegicus
ctcatgtctgccacaagggtgctaa

SEQ ID NO: 265627 - DNA, 25 bp, Rattus norvegicus
ctcatgtctgcctcaagggtgctaa

SEQ ID NO: 265628 - DNA, 25 bp, Rattus norvegicus
ctcatgtgccatcagcactagggta

SEQ ID NO: 265629 - DNA, 25 bp, Rattus norvegicus
ctcatgtgccatgagcactagggta

SEQ ID NO: 265630 - DNA, 25 bp, Rattus norvegicus
ctcatgtgtaccactccatatttaa

SEQ ID NO: 265631 - DNA, 25 bp, Rattus norvegicus
ctcatgtgtacctctccatatttaa

SEQ ID NO: 265632 - DNA, 25 bp, Rattus norvegicus
ctcatgttcacaagggcagatggaa

SEQ ID NO: 265633 - DNA, 25 bp, Rattus norvegicus
ctcatgttcacatgggcagatggaa

SEQ ID NO: 265634 - DNA, 25 bp, Rattus norvegicus
ctcatgttgaaaccttgcatcccca

SEQ ID NO: 265635 - DNA, 25 bp, Rattus norvegicus
ctcatgttgaaagcttgcatcccca

SEQ ID NO: 265636 - DNA, 25 bp, Rattus norvegicus
ctcatgtttatcactgtcagtcggc

SEQ ID NO: 265637 - DNA, 25 bp, Rattus norvegicus
ctcatgtttatctctgtcagtcggc

SEQ ID NO: 265638 - DNA, 25 bp, Rattus norvegicus
ctcattaatttgaaaggaggcattt

SEQ ID NO: 265639 - DNA, 25 bp, Rattus norvegicus
ctcattaatttgtaaggaggcattt

SEQ ID NO: 265640 - DNA, 25 bp, Rattus norvegicus
ctcattagctctacctgattcaatt

SEQ ID NO: 265641 - DNA, 25 bp, Rattus norvegicus
ctcattagctcttcctgattcaatt

SEQ ID NO: 265642 - DNA, 25 bp, Rattus norvegicus
ctcattatgcttatgccagagttaa

SEQ ID NO: 265643 - DNA, 25 bp, Rattus norvegicus
ctcattatgcttttgccagagttaa

SEQ ID NO: 265644 - DNA, 25 bp, Rattus norvegicus
ctcattattcacatcgggccttaga

SEQ ID NO: 265645 - DNA, 25 bp, Rattus norvegicus
ctcattattcacttcgggccttaga

SEQ ID NO: 265646 - DNA, 25 bp, Rattus norvegicus
ctcattcacagaccagcttcaatta

SEQ ID NO: 265647 - DNA, 25 bp, Rattus norvegicus
ctcattcacagagcagcttcaatta

SEQ ID NO: 265648 - DNA, 25 bp, Rattus norvegicus
ctcattcagtgtattagtggccttg

SEQ ID NO: 265649 - DNA, 25 bp, Rattus norvegicus
ctcattcagtgttttagtggccttg

SEQ ID NO: 265650 - DNA, 25 bp, Rattus norvegicus
ctcattccacggctgtgtagtaaca

SEQ ID NO: 265651 - DNA, 25 bp, Rattus norvegicus
ctcattccacgggtgtgtagtaaca

SEQ ID NO: 265652 - DNA, 25 bp, Rattus norvegicus
ctcattcccttcagataaaggtact

SEQ ID NO: 265653 - DNA, 25 bp, Rattus norvegicus
ctcattcccttctgataaaggtact

SEQ ID NO: 265654 - DNA, 25 bp, Rattus norvegicus
ctcattctacctaccagatgtctag

SEQ ID NO: 265655 - DNA, 25 bp, Rattus norvegicus
ctcattctaccttccagatgtctag

SEQ ID NO: 265656 - DNA, 25 bp, Rattus norvegicus
ctcattctgaggcttacggcaaaga

SEQ ID NO: 265657 - DNA, 25 bp, Rattus norvegicus
ctcattctgagggttacggcaaaga

SEQ ID NO: 265658 - DNA, 25 bp, Rattus norvegicus
ctcattctgggcacatttcatcaaa

SEQ ID NO: 265659 - DNA, 25 bp, Rattus norvegicus
ctcattctgggctcatttcatcaaa

SEQ ID NO: 265660 - DNA, 25 bp, Rattus norvegicus
ctcattgatgtccatctggaggcca

SEQ ID NO: 265661 - DNA, 25 bp, Rattus norvegicus
ctcattgatgtcgatctggaggcca

SEQ ID NO: 265662 - DNA, 25 bp, Rattus norvegicus
ctcattgcgggtctgttcattcagt

SEQ ID NO: 265663 - DNA, 25 bp, Rattus norvegicus
ctcattgcgggtgtgttcattcagt

SEQ ID NO: 265664 - DNA, 25 bp, Rattus norvegicus
ctcattgctgtcatgtggcctaaag

SEQ ID NO: 265665 - DNA, 25 bp, Rattus norvegicus
ctcattgctgtcttgtggcctaaag

SEQ ID NO: 265666 - DNA, 25 bp, Rattus norvegicus
ctcattggagtcatcagggctgtgc

SEQ ID NO: 265667 - DNA, 25 bp, Rattus norvegicus
ctcattggagtcttcagggctgtgc

SEQ ID NO: 265668 - DNA, 25 bp, Rattus norvegicus
ctcattgggcggataattagctctt

SEQ ID NO: 265669 - DNA, 25 bp, Rattus norvegicus
ctcattgggcggttaattagctctt

SEQ ID NO: 265670 - DNA, 25 bp, Rattus norvegicus
ctcattggtatgattgtttctgttt

SEQ ID NO: 265671 - DNA, 25 bp, Rattus norvegicus
ctcattggtatgtttgtttctgttt

SEQ ID NO: 265672 - DNA, 25 bp, Rattus norvegicus
ctcattgttctacacttatctcgga

SEQ ID NO: 265673 - DNA, 25 bp, Rattus norvegicus
ctcattgttctagacttatctcgga

SEQ ID NO: 265674 - DNA, 25 bp, Rattus norvegicus
ctcatttatgaaatcccacttctgg

SEQ ID NO: 265675 - DNA, 25 bp, Rattus norvegicus
ctcatttatgaattcccacttctgg

SEQ ID NO: 265676 - DNA, 25 bp, Rattus norvegicus
ctcatttcaatgaagcctggctgct

SEQ ID NO: 265677 - DNA, 25 bp, Rattus norvegicus
ctcatttcaatgtagcctggctgct

SEQ ID NO: 265678 - DNA, 25 bp, Rattus norvegicus
ctcatttcagcccagtataccaagt

SEQ ID NO: 265679 - DNA, 25 bp, Rattus norvegicus
ctcatttcagccgagtataccaagt

SEQ ID NO: 265680 - DNA, 25 bp, Rattus norvegicus
ctcatttcgatgactctctgtttga

SEQ ID NO: 265681 - DNA, 25 bp, Rattus norvegicus
ctcatttcgatgtctctctgtttga

SEQ ID NO: 265682 - DNA, 25 bp, Rattus norvegicus
ctcatttctgttccttttactacac

SEQ ID NO: 265683 - DNA, 25 bp, Rattus norvegicus
ctcatttctgttgcttttactacac

SEQ ID NO: 265684 - DNA, 25 bp, Rattus norvegicus
ctcatttcttctagacagtatcatc

SEQ ID NO: 265685 - DNA, 25 bp, Rattus norvegicus
ctcatttcttcttgacagtatcatc

SEQ ID NO: 265686 - DNA, 25 bp, Rattus norvegicus
ctcatttgccccatggtctctttat

SEQ ID NO: 265687 - DNA, 25 bp, Rattus norvegicus
ctcatttgccccttggtctctttat

SEQ ID NO: 265688 - DNA, 25 bp, Rattus norvegicus
ctcattttctacattgccacggatt

SEQ ID NO: 265689 - DNA, 25 bp, Rattus norvegicus
ctcattttctactttgccacggatt

SEQ ID NO: 265690 - DNA, 25 bp, Rattus norvegicus
ctcatttttcatctaagccctctta

SEQ ID NO: 265691 - DNA, 25 bp, Rattus norvegicus
ctcatttttcatgtaagccctctta

SEQ ID NO: 265692 - DNA, 25 bp, Rattus norvegicus
ctcatttttgcgctgttggcacaaa

SEQ ID NO: 265693 - DNA, 25 bp, Rattus norvegicus
ctcatttttgcggtgttggcacaaa

SEQ ID NO: 265694 - DNA, 25 bp, Rattus norvegicus
ctccaaaaacaactggccatccttt

SEQ ID NO: 265695 - DNA, 25 bp, Rattus norvegicus
ctccaaaaacaagtggccatccttt

SEQ ID NO: 265696 - DNA, 25 bp, Rattus norvegicus
ctccaaaagggcaactcatgtagta

SEQ ID NO: 265697 - DNA, 25 bp, Rattus norvegicus
ctccaaaagggctactcatgtagta

SEQ ID NO: 265698 - DNA, 25 bp, Rattus norvegicus
ctccaaaatggtcttcagcttctac

SEQ ID NO: 265699 - DNA, 25 bp, Rattus norvegicus
ctccaaaatggtgttcagcttctac

SEQ ID NO: 265700 - DNA, 25 bp, Rattus norvegicus
ctccaaacaaccatcagacttctaa

SEQ ID NO: 265701 - DNA, 25 bp, Rattus norvegicus
ctccaaacaaccttcagacttctaa

SEQ ID NO: 265702 - DNA, 25 bp, Rattus norvegicus
ctccaaacctcaccttgttgggcaa

SEQ ID NO: 265703 - DNA, 25 bp, Rattus norvegicus
ctccaaacctcagcttgttgggcaa

SEQ ID NO: 265704 - DNA, 25 bp, Rattus norvegicus
ctccaaacgatgcatcctgacttgt

SEQ ID NO: 265705 - DNA, 25 bp, Rattus norvegicus
ctccaaacgatggatcctgacttgt

SEQ ID NO: 265706 - DNA, 25 bp, Rattus norvegicus
ctccaaactaaacaatggcagtcta

SEQ ID NO: 265707 - DNA, 25 bp, Rattus norvegicus
ctccaaactaaagaatggcagtcta

SEQ ID NO: 265708 - DNA, 25 bp, Rattus norvegicus
ctccaaagcttgcagtcgcgaattt

SEQ ID NO: 265709 - DNA, 25 bp, Rattus norvegicus
ctccaaagcttggagtcgcgaattt

SEQ ID NO: 265710 - DNA, 25 bp, Rattus norvegicus
ctccaaagggtcatcaatacaagtt

SEQ ID NO: 265711 - DNA, 25 bp, Rattus norvegicus
ctccaaagggtcttcaatacaagtt

SEQ ID NO: 265712 - DNA, 25 bp, Rattus norvegicus
ctccaaatgaatctagctgacaggt

SEQ ID NO: 265713 - DNA, 25 bp, Rattus norvegicus
ctccaaatgaatgtagctgacaggt

SEQ ID NO: 265714 - DNA, 25 bp, Rattus norvegicus
ctccaaatggaccacaacctctatt

SEQ ID NO: 265715 - DNA, 25 bp, Rattus norvegicus
ctccaaatggacgacaacctctatt

SEQ ID NO: 265716 - DNA, 25 bp, Rattus norvegicus
ctccaaatgggaaagctgcaggctt

SEQ ID NO: 265717 - DNA, 25 bp, Rattus norvegicus
ctccaaatgggatagctgcaggctt

SEQ ID NO: 265718 - DNA, 25 bp, Rattus norvegicus
ctccaacagattctaatggtgtgtc

SEQ ID NO: 265719 - DNA, 25 bp, Rattus norvegicus
ctccaacagattgtaatggtgtgtc

SEQ ID NO: 265720 - DNA, 25 bp, Rattus norvegicus
ctccaacctcttcctttttatgact

SEQ ID NO: 265721 - DNA, 25 bp, Rattus norvegicus
ctccaacctcttgctttttatgact

SEQ ID NO: 265722 - DNA, 25 bp, Rattus norvegicus
ctccaactccaacggatctgaaaca

SEQ ID NO: 265723 - DNA, 25 bp, Rattus norvegicus
ctccaactccaagggatctgaaaca

SEQ ID NO: 265724 - DNA, 25 bp, Rattus norvegicus
ctccaactgtcacacttctgtaata

SEQ ID NO: 265725 - DNA, 25 bp, Rattus norvegicus
ctccaactgtcagacttctgtaata

SEQ ID NO: 265726 - DNA, 25 bp, Rattus norvegicus
ctccaagagaccaggcgagacgcgc

SEQ ID NO: 265727 - DNA, 25 bp, Rattus norvegicus
ctccaagagacctggcgagacgcgc

SEQ ID NO: 265728 - DNA, 25 bp, Rattus norvegicus
ctccaagaggtaccttccagagtgg

SEQ ID NO: 265729 - DNA, 25 bp, Rattus norvegicus
ctccaagaggtagcttccagagtgg

SEQ ID NO: 265730 - DNA, 25 bp, Rattus norvegicus
ctccaagatcttcgccgctgtgggt

SEQ ID NO: 265731 - DNA, 25 bp, Rattus norvegicus
ctccaagatcttggccgctgtgggt

SEQ ID NO: 265732 - DNA, 25 bp, Rattus norvegicus
ctccaagatggcaagctgcagctat

SEQ ID NO: 265733 - DNA, 25 bp, Rattus norvegicus
ctccaagatggctagctgcagctat

SEQ ID NO: 265734 - DNA, 25 bp, Rattus norvegicus
ctccaagcagggacagctctgagag

SEQ ID NO: 265735 - DNA, 25 bp, Rattus norvegicus
ctccaagcagggtcagctctgagag

SEQ ID NO: 265736 - DNA, 25 bp, Rattus norvegicus
ctccaagcctgacttcatctggtaa

SEQ ID NO: 265737 - DNA, 25 bp, Rattus norvegicus
ctccaagcctgagttcatctggtaa

SEQ ID NO: 265738 - DNA, 25 bp, Rattus norvegicus
ctccaagcttttcatcctactataa

SEQ ID NO: 265739 - DNA, 25 bp, Rattus norvegicus
ctccaagcttttgatcctactataa

SEQ ID NO: 265740 - DNA, 25 bp, Rattus norvegicus
ctccaaggacacatgattaggcaca

SEQ ID NO: 265741 - DNA, 25 bp, Rattus norvegicus
ctccaaggacacctttgtgacagag

SEQ ID NO: 265742 - DNA, 25 bp, Rattus norvegicus
ctccaaggacacgtttgtgacagag

SEQ ID NO: 265743 - DNA, 25 bp, Rattus norvegicus
ctccaaggacacttgattaggcaca

SEQ ID NO: 265744 - DNA, 25 bp, Rattus norvegicus
ctccaagggcaccagacatgtatgt

SEQ ID NO: 265745 - DNA, 25 bp, Rattus norvegicus
ctccaagggcacgagacatgtatgt

SEQ ID NO: 265746 - DNA, 25 bp, Rattus norvegicus
ctccaagtgagtaaaaattgtgcct

SEQ ID NO: 265747 - DNA, 25 bp, Rattus norvegicus
ctccaagtgagttaaaattgtgcct

SEQ ID NO: 265748 - DNA, 25 bp, Rattus norvegicus
ctccaagtggctcatggcttcatct

SEQ ID NO: 265749 - DNA, 25 bp, Rattus norvegicus
ctccaagtggctgatggcttcatct

SEQ ID NO: 265750 - DNA, 25 bp, Rattus norvegicus
ctccaataaagtctccagtgtcctg

SEQ ID NO: 265751 - DNA, 25 bp, Rattus norvegicus
ctccaataaagtgtccagtgtcctg

SEQ ID NO: 265752 - DNA, 25 bp, Rattus norvegicus
ctccaatggactaaggtaacccctg

SEQ ID NO: 265753 - DNA, 25 bp, Rattus norvegicus
ctccaatggacttaggtaacccctg

SEQ ID NO: 265754 - DNA, 25 bp, Rattus norvegicus
ctccaatgttccctgagtttttctg

SEQ ID NO: 265755 - DNA, 25 bp, Rattus norvegicus
ctccaatgttccgtgagtttttctg

SEQ ID NO: 265756 - DNA, 25 bp, Rattus norvegicus
ctccaattgcacacatttcctgaaa

SEQ ID NO: 265757 - DNA, 25 bp, Rattus norvegicus
ctccaattgcactcatttcctgaaa

SEQ ID NO: 265758 - DNA, 25 bp, Rattus norvegicus
ctccaattgtaacggcgaggccggc

SEQ ID NO: 265759 - DNA, 25 bp, Rattus norvegicus
ctccaattgtaagggcgaggccggc

SEQ ID NO: 265760 - DNA, 25 bp, Rattus norvegicus
ctccacacatgtcccgtgaaatgca

SEQ ID NO: 265761 - DNA, 25 bp, Rattus norvegicus
ctccacacatgtgccgtgaaatgca

SEQ ID NO: 265762 - DNA, 25 bp, Rattus norvegicus
ctccacaccagcaaaggctacataa

SEQ ID NO: 265763 - DNA, 25 bp, Rattus norvegicus
ctccacaccagctaaggctacataa

SEQ ID NO: 265764 - DNA, 25 bp, Rattus norvegicus
ctccacaccataaagcaagacattt

SEQ ID NO: 265765 - DNA, 25 bp, Rattus norvegicus
ctccacaccatatagcaagacattt

SEQ ID NO: 265766 - DNA, 25 bp, Rattus norvegicus
ctccacaccgtgatggtcaaatgat

SEQ ID NO: 265767 - DNA, 25 bp, Rattus norvegicus
ctccacaccgtgttggtcaaatgat

SEQ ID NO: 265768 - DNA, 25 bp, Rattus norvegicus
ctccacacgctgatgatgacttttt

SEQ ID NO: 265769 - DNA, 25 bp, Rattus norvegicus
ctccacacgctgttgatgacttttt

SEQ ID NO: 265770 - DNA, 25 bp, Rattus norvegicus
ctccacactcttagtcatggtttga

SEQ ID NO: 265771 - DNA, 25 bp, Rattus norvegicus
ctccacactctttgtcatggtttga

SEQ ID NO: 265772 - DNA, 25 bp, Rattus norvegicus
ctccacacttcaagacgtaaataga

SEQ ID NO: 265773 - DNA, 25 bp, Rattus norvegicus
ctccacacttcatgacgtaaataga

SEQ ID NO: 265774 - DNA, 25 bp, Rattus norvegicus
ctccacagatgacggcttccttaaa

SEQ ID NO: 265775 - DNA, 25 bp, Rattus norvegicus
ctccacagatgagggcttccttaaa

SEQ ID NO: 265776 - DNA, 25 bp, Rattus norvegicus
ctccacaggacaccacatgcagagt

SEQ ID NO: 265777 - DNA, 25 bp, Rattus norvegicus
ctccacaggacagcacatgcagagt

SEQ ID NO: 265778 - DNA, 25 bp, Rattus norvegicus
ctccacaggcagaagccgcaagtta

SEQ ID NO: 265779 - DNA, 25 bp, Rattus norvegicus
ctccacaggcagtagccgcaagtta

SEQ ID NO: 265780 - DNA, 25 bp, Rattus norvegicus
ctccacagggtcctggtgtaggaaa

SEQ ID NO: 265781 - DNA, 25 bp, Rattus norvegicus
ctccacagggtcgtggtgtaggaaa

SEQ ID NO: 265782 - DNA, 25 bp, Rattus norvegicus
ctccacatcttcattatctttcttt

SEQ ID NO: 265783 - DNA, 25 bp, Rattus norvegicus
ctccacatcttctttatctttcttt

SEQ ID NO: 265784 - DNA, 25 bp, Rattus norvegicus
ctccacatgctgctgcatcatttta

SEQ ID NO: 265785 - DNA, 25 bp, Rattus norvegicus
ctccacatgctggtgcatcatttta

SEQ ID NO: 265786 - DNA, 25 bp, Rattus norvegicus
ctccacatttatacttgatctctag

SEQ ID NO: 265787 - DNA, 25 bp, Rattus norvegicus
ctccacatttattcttgatctctag

SEQ ID NO: 265788 - DNA, 25 bp, Rattus norvegicus
ctccacatttttccgaagctacttg

SEQ ID NO: 265789 - DNA, 25 bp, Rattus norvegicus
ctccacatttttgcgaagctacttg

SEQ ID NO: 265790 - DNA, 25 bp, Rattus norvegicus
ctccaccacagtacagttttggcta

SEQ ID NO: 265791 - DNA, 25 bp, Rattus norvegicus
ctccaccacagttcagttttggcta

SEQ ID NO: 265792 - DNA, 25 bp, Rattus norvegicus
ctccaccagcctctgtatttatatg

SEQ ID NO: 265793 - DNA, 25 bp, Rattus norvegicus
ctccaccagcctgtgtatttatatg

SEQ ID NO: 265794 - DNA, 25 bp, Rattus norvegicus
ctccaccatcgaaagccatttatag

SEQ ID NO: 265795 - DNA, 25 bp, Rattus norvegicus
ctccaccatcgatagccatttatag

SEQ ID NO: 265796 - DNA, 25 bp, Rattus norvegicus
ctccacccatgtctgacagtgacat

SEQ ID NO: 265797 - DNA, 25 bp, Rattus norvegicus
ctccacccatgtgtgacagtgacat

SEQ ID NO: 265798 - DNA, 25 bp, Rattus norvegicus
ctccaccgaattcccgatgctgaag

SEQ ID NO: 265799 - DNA, 25 bp, Rattus norvegicus
ctccaccgaattgccgatgctgaag

SEQ ID NO: 265800 - DNA, 25 bp, Rattus norvegicus
ctccacctatagaaagtcgcctttg

SEQ ID NO: 265801 - DNA, 25 bp, Rattus norvegicus
ctccacctatagtaagtcgcctttg

SEQ ID NO: 265802 - DNA, 25 bp, Rattus norvegicus
ctccacctcagtcttatgtcagtgt

SEQ ID NO: 265803 - DNA, 25 bp, Rattus norvegicus
ctccacctcagtgttatgtcagtgt

SEQ ID NO: 265804 - DNA, 25 bp, Rattus norvegicus
ctccacctccacatgtgggataggg

SEQ ID NO: 265805 - DNA, 25 bp, Rattus norvegicus
ctccacctccacttgtgggataggg

SEQ ID NO: 265806 - DNA, 25 bp, Rattus norvegicus
ctccacctgggtattagggtgtcat

SEQ ID NO: 265807 - DNA, 25 bp, Rattus norvegicus
ctccacctgggttttagggtgtcat

SEQ ID NO: 265808 - DNA, 25 bp, Rattus norvegicus
ctccacctgtggctgaagactgagg

SEQ ID NO: 265809 - DNA, 25 bp, Rattus norvegicus
ctccacctgtgggtgaagactgagg

SEQ ID NO: 265810 - DNA, 25 bp, Rattus norvegicus
ctccacctgtttcatctgctggaag

SEQ ID NO: 265811 - DNA, 25 bp, Rattus norvegicus
ctccacctgtttgatctgctggaag

SEQ ID NO: 265812 - DNA, 25 bp, Rattus norvegicus
ctccacgtctggaattacatgttga

SEQ ID NO: 265813 - DNA, 25 bp, Rattus norvegicus
ctccacgtctggtattacatgttga

SEQ ID NO: 265814 - DNA, 25 bp, Rattus norvegicus
ctccacgtgggccacttttgataaa

SEQ ID NO: 265815 - DNA, 25 bp, Rattus norvegicus
ctccacgtgggcgacttttgataaa

SEQ ID NO: 265816 - DNA, 25 bp, Rattus norvegicus
ctccacgttgttatcaaaagcctgt

SEQ ID NO: 265817 - DNA, 25 bp, Rattus norvegicus
ctccacgttgttttcaaaagcctgt

SEQ ID NO: 265818 - DNA, 25 bp, Rattus norvegicus
ctccactaagtaccaagttcaaggc

SEQ ID NO: 265819 - DNA, 25 bp, Rattus norvegicus
ctccactaagtagcaagttcaaggc

SEQ ID NO: 265820 - DNA, 25 bp, Rattus norvegicus
ctccactaatatatagccagccttc

SEQ ID NO: 265821 - DNA, 25 bp, Rattus norvegicus
ctccactaatatttagccagccttc

SEQ ID NO: 265822 - DNA, 25 bp, Rattus norvegicus
ctccactacatgaacagggtatata

SEQ ID NO: 265823 - DNA, 25 bp, Rattus norvegicus
ctccactacatgtacagggtatata

SEQ ID NO: 265824 - DNA, 25 bp, Rattus norvegicus
ctccactcaagaccccagggaatgg

SEQ ID NO: 265825 - DNA, 25 bp, Rattus norvegicus
ctccactcaagagcccagggaatgg

SEQ ID NO: 265826 - DNA, 25 bp, Rattus norvegicus
ctccactcacctatgaagtcattgg

SEQ ID NO: 265827 - DNA, 25 bp, Rattus norvegicus
ctccactcacctttgaagtcattgg

SEQ ID NO: 265828 - DNA, 25 bp, Rattus norvegicus
ctccactcatctaacggacttttga

SEQ ID NO: 265829 - DNA, 25 bp, Rattus norvegicus
ctccactcatcttacggacttttga

SEQ ID NO: 265830 - DNA, 25 bp, Rattus norvegicus
ctccactcccttaattcatttctta

SEQ ID NO: 265831 - DNA, 25 bp, Rattus norvegicus
ctccactccctttattcatttctta

SEQ ID NO: 265832 - DNA, 25 bp, Rattus norvegicus
ctccactgacctatttaaagtcctg

SEQ ID NO: 265833 - DNA, 25 bp, Rattus norvegicus
ctccactgacctttttaaagtcctg

SEQ ID NO: 265834 - DNA, 25 bp, Rattus norvegicus
ctccactgccagatgctgtgaaatg

SEQ ID NO: 265835 - DNA, 25 bp, Rattus norvegicus
ctccactgccagttgctgtgaaatg

SEQ ID NO: 265836 - DNA, 25 bp, Rattus norvegicus
ctccactgggaaccgattctgcttg

SEQ ID NO: 265837 - DNA, 25 bp, Rattus norvegicus
ctccactgggaagcgattctgcttg

SEQ ID NO: 265838 - DNA, 25 bp, Rattus norvegicus
ctccactggtggatgaaggcactta

SEQ ID NO: 265839 - DNA, 25 bp, Rattus norvegicus
ctccactggtggttgaaggcactta

SEQ ID NO: 265840 - DNA, 25 bp, Rattus norvegicus
ctccacttacacattccagatgaaa

SEQ ID NO: 265841 - DNA, 25 bp, Rattus norvegicus
ctccacttacactttccagatgaaa

SEQ ID NO: 265842 - DNA, 25 bp, Rattus norvegicus
ctccacttactaacaggccttttaa

SEQ ID NO: 265843 - DNA, 25 bp, Rattus norvegicus
ctccacttactatcaggccttttaa

SEQ ID NO: 265844 - DNA, 25 bp, Rattus norvegicus
ctccacttaggaacaggtcagctgt

SEQ ID NO: 265845 - DNA, 25 bp, Rattus norvegicus
ctccacttaggatcaggtcagctgt

SEQ ID NO: 265846 - DNA, 25 bp, Rattus norvegicus
ctccacttctgtagctatctgcagt

SEQ ID NO: 265847 - DNA, 25 bp, Rattus norvegicus
ctccacttctgttgctatctgcagt

SEQ ID NO: 265848 - DNA, 25 bp, Rattus norvegicus
ctccacttggctactaacttatttc

SEQ ID NO: 265849 - DNA, 25 bp, Rattus norvegicus
ctccacttggcttctaacttatttc

SEQ ID NO: 265850 - DNA, 25 bp, Rattus norvegicus
ctccactttaatctcttacccttat

SEQ ID NO: 265851 - DNA, 25 bp, Rattus norvegicus
ctccactttaatgtcttacccttat

SEQ ID NO: 265852 - DNA, 25 bp, Rattus norvegicus
ctccactttattacataactggccc

SEQ ID NO: 265853 - DNA, 25 bp, Rattus norvegicus
ctccactttatttcataactggccc

SEQ ID NO: 265854 - DNA, 25 bp, Rattus norvegicus
ctccactttggaatggtgttggcac

SEQ ID NO: 265855 - DNA, 25 bp, Rattus norvegicus
ctccactttggattggtgttggcac

SEQ ID NO: 265856 - DNA, 25 bp, Rattus norvegicus
ctccagaacaccaacgtgctttagt

SEQ ID NO: 265857 - DNA, 25 bp, Rattus norvegicus
ctccagaacacctacgtgctttagt

SEQ ID NO: 265858 - DNA, 25 bp, Rattus norvegicus
ctccagaacgcacagctgactgtag

SEQ ID NO: 265859 - DNA, 25 bp, Rattus norvegicus
ctccagaacgcagagctgactgtag

SEQ ID NO: 265860 - DNA, 25 bp, Rattus norvegicus
ctccagagcaccacagggacactgt

SEQ ID NO: 265861 - DNA, 25 bp, Rattus norvegicus
ctccagagcacctcagggacactgt

SEQ ID NO: 265862 - DNA, 25 bp, Rattus norvegicus
ctccagagccaaccgggagagccgt

SEQ ID NO: 265863 - DNA, 25 bp, Rattus norvegicus
ctccagagccaagcgggagagccgt

SEQ ID NO: 265864 - DNA, 25 bp, Rattus norvegicus
ctccagagccatacagggttttatt

SEQ ID NO: 265865 - DNA, 25 bp, Rattus norvegicus
ctccagagccattcagggttttatt

SEQ ID NO: 265866 - DNA, 25 bp, Rattus norvegicus
ctccagagctccagtttattcatgg

SEQ ID NO: 265867 - DNA, 25 bp, Rattus norvegicus
ctccagagctcctgtttattcatgg

SEQ ID NO: 265868 - DNA, 25 bp, Rattus norvegicus
ctccagagtgctcacatgtgcatgt

SEQ ID NO: 265869 - DNA, 25 bp, Rattus norvegicus
ctccagagtgctgacatgtgcatgt

SEQ ID NO: 265870 - DNA, 25 bp, Rattus norvegicus
ctccagagttggatgcaggcccagc

SEQ ID NO: 265871 - DNA, 25 bp, Rattus norvegicus
ctccagagttggttgcaggcccagc

SEQ ID NO: 265872 - DNA, 25 bp, Rattus norvegicus
ctccagatatacactcttcatcatg

SEQ ID NO: 265873 - DNA, 25 bp, Rattus norvegicus
ctccagatatactctcttcatcatg

SEQ ID NO: 265874 - DNA, 25 bp, Rattus norvegicus
ctccagatcctgaggtattcaggct

SEQ ID NO: 265875 - DNA, 25 bp, Rattus norvegicus
ctccagatcctgtggtattcaggct

SEQ ID NO: 265876 - DNA, 25 bp, Rattus norvegicus
ctccagatctctaactccttttatt

SEQ ID NO: 265877 - DNA, 25 bp, Rattus norvegicus
ctccagatctcttactccttttatt

SEQ ID NO: 265878 - DNA, 25 bp, Rattus norvegicus
ctccagattcataatagagttcata

SEQ ID NO: 265879 - DNA, 25 bp, Rattus norvegicus
ctccagattcattatagagttcata

SEQ ID NO: 265880 - DNA, 25 bp, Rattus norvegicus
ctccagcaaggtcggagttactgct

SEQ ID NO: 265881 - DNA, 25 bp, Rattus norvegicus
ctccagcaaggtgggagttactgct

SEQ ID NO: 265882 - DNA, 25 bp, Rattus norvegicus
ctccagcagctgatgaagcaaaact

SEQ ID NO: 265883 - DNA, 25 bp, Rattus norvegicus
ctccagcagctgttgaagcaaaact

SEQ ID NO: 265884 - DNA, 25 bp, Rattus norvegicus
ctccagcatgccagtgattgttgtc

SEQ ID NO: 265885 - DNA, 25 bp, Rattus norvegicus
ctccagcatgcctgtgattgttgtc

SEQ ID NO: 265886 - DNA, 25 bp, Rattus norvegicus
ctccagccacacaaccagatttggg

SEQ ID NO: 265887 - DNA, 25 bp, Rattus norvegicus
ctccagccacactaccagatttggg

SEQ ID NO: 265888 - DNA, 25 bp, Rattus norvegicus
ctccagccccagagatgaattattt

SEQ ID NO: 265889 - DNA, 25 bp, Rattus norvegicus
ctccagccccagtgatgaattattt

SEQ ID NO: 265890 - DNA, 25 bp, Rattus norvegicus
ctccagccccttagtgttagaaatg

SEQ ID NO: 265891 - DNA, 25 bp, Rattus norvegicus
ctccagcccctttgtgttagaaatg

SEQ ID NO: 265892 - DNA, 25 bp, Rattus norvegicus
ctccagccctgaatagtcctagtta

SEQ ID NO: 265893 - DNA, 25 bp, Rattus norvegicus
ctccagccctgacaagtagattttt

SEQ ID NO: 265894 - DNA, 25 bp, Rattus norvegicus
ctccagccctgacgaaacagctagg

SEQ ID NO: 265895 - DNA, 25 bp, Rattus norvegicus
ctccagccctgagaagtagattttt

SEQ ID NO: 265896 - DNA, 25 bp, Rattus norvegicus
ctccagccctgaggaaacagctagg

SEQ ID NO: 265897 - DNA, 25 bp, Rattus norvegicus
ctccagccctgattagtcctagtta

SEQ ID NO: 265898 - DNA, 25 bp, Rattus norvegicus
ctccagccgacacgcttgggattat

SEQ ID NO: 265899 - DNA, 25 bp, Rattus norvegicus
ctccagccgacaggcttgggattat

SEQ ID NO: 265900 - DNA, 25 bp, Rattus norvegicus
ctccagcctatcctgaagcagacat

SEQ ID NO: 265901 - DNA, 25 bp, Rattus norvegicus
ctccagcctatcgtgaagcagacat

SEQ ID NO: 265902 - DNA, 25 bp, Rattus norvegicus
ctccagcctctgatactaatgtcag

SEQ ID NO: 265903 - DNA, 25 bp, Rattus norvegicus
ctccagcctctgttactaatgtcag

SEQ ID NO: 265904 - DNA, 25 bp, Rattus norvegicus
ctccagcgcattatctacctgaaat

SEQ ID NO: 265905 - DNA, 25 bp, Rattus norvegicus
ctccagcgcattttctacctgaaat

SEQ ID NO: 265906 - DNA, 25 bp, Rattus norvegicus
ctccagcgttaacagcacacattat

SEQ ID NO: 265907 - DNA, 25 bp, Rattus norvegicus
ctccagcgttaagagcacacattat

SEQ ID NO: 265908 - DNA, 25 bp, Rattus norvegicus
ctccagctctaacggccagtagttt

SEQ ID NO: 265909 - DNA, 25 bp, Rattus norvegicus
ctccagctctaagggccagtagttt

SEQ ID NO: 265910 - DNA, 25 bp, Rattus norvegicus
ctccagctgcaccaacaagtagaaa

SEQ ID NO: 265911 - DNA, 25 bp, Rattus norvegicus
ctccagctgcacgaacaagtagaaa

SEQ ID NO: 265912 - DNA, 25 bp, Rattus norvegicus
ctccagcttgacacatctgtaaagt

SEQ ID NO: 265913 - DNA, 25 bp, Rattus norvegicus
ctccagcttgactcatctgtaaagt

SEQ ID NO: 265914 - DNA, 25 bp, Rattus norvegicus
ctccaggaaattcctgagctgattt

SEQ ID NO: 265915 - DNA, 25 bp, Rattus norvegicus
ctccaggaaattgctgagctgattt

SEQ ID NO: 265916 - DNA, 25 bp, Rattus norvegicus
ctccaggactcacctctaatacatg

SEQ ID NO: 265917 - DNA, 25 bp, Rattus norvegicus
ctccaggactcagctctaatacatg

SEQ ID NO: 265918 - DNA, 25 bp, Rattus norvegicus
ctccaggagggcactgccacgggca

SEQ ID NO: 265919 - DNA, 25 bp, Rattus norvegicus
ctccaggagggctctgccacgggca

SEQ ID NO: 265920 - DNA, 25 bp, Rattus norvegicus
ctccaggccattatacccgagagga

SEQ ID NO: 265921 - DNA, 25 bp, Rattus norvegicus
ctccaggccattttacccgagagga

SEQ ID NO: 265922 - DNA, 25 bp, Rattus norvegicus
ctccaggccctgactgagatgagag

SEQ ID NO: 265923 - DNA, 25 bp, Rattus norvegicus
ctccaggccctgtctgagatgagag

SEQ ID NO: 265924 - DNA, 25 bp, Rattus norvegicus
ctccaggctccacaaatgacaaagt

SEQ ID NO: 265925 - DNA, 25 bp, Rattus norvegicus
ctccaggctccagaaatgacaaagt

SEQ ID NO: 265926 - DNA, 25 bp, Rattus norvegicus
ctccagggcaatattctgttgtatt

SEQ ID NO: 265927 - DNA, 25 bp, Rattus norvegicus
ctccagggcaattttctgttgtatt

SEQ ID NO: 265928 - DNA, 25 bp, Rattus norvegicus
ctccagggcagcaggcactgtggaa

SEQ ID NO: 265929 - DNA, 25 bp, Rattus norvegicus
ctccagggcagctggcactgtggaa

SEQ ID NO: 265930 - DNA, 25 bp, Rattus norvegicus
ctccagggccctacagctgctgaag

SEQ ID NO: 265931 - DNA, 25 bp, Rattus norvegicus
ctccagggcccttcagctgctgaag

SEQ ID NO: 265932 - DNA, 25 bp, Rattus norvegicus
ctccagggcgtgacctggcctcggt

SEQ ID NO: 265933 - DNA, 25 bp, Rattus norvegicus
ctccagggcgtgtcctggcctcggt

SEQ ID NO: 265934 - DNA, 25 bp, Rattus norvegicus
ctccagggctggactgaggcctgaa

SEQ ID NO: 265935 - DNA, 25 bp, Rattus norvegicus
ctccagggctggtctgaggcctgaa

SEQ ID NO: 265936 - DNA, 25 bp, Rattus norvegicus
ctccaggtcagtagtaggtactttt

SEQ ID NO: 265937 - DNA, 25 bp, Rattus norvegicus
ctccaggtcagttgtaggtactttt

SEQ ID NO: 265938 - DNA, 25 bp, Rattus norvegicus
ctccaggtctcacagaggaaccaga

SEQ ID NO: 265939 - DNA, 25 bp, Rattus norvegicus
ctccaggtctcagagaggaaccaga

SEQ ID NO: 265940 - DNA, 25 bp, Rattus norvegicus
ctccaggtggcccagaagcggacac

SEQ ID NO: 265941 - DNA, 25 bp, Rattus norvegicus
ctccaggtggccgagaagcggacac

SEQ ID NO: 265942 - DNA, 25 bp, Rattus norvegicus
ctccaggtgggcaatctccagtgag

SEQ ID NO: 265943 - DNA, 25 bp, Rattus norvegicus
ctccaggtgggctatctccagtgag

SEQ ID NO: 265944 - DNA, 25 bp, Rattus norvegicus
ctccagtattccattgccatgtaaa

SEQ ID NO: 265945 - DNA, 25 bp, Rattus norvegicus
ctccagtattcctttgccatgtaaa

SEQ ID NO: 265946 - DNA, 25 bp, Rattus norvegicus
ctccagtcacttctgcttagattac

SEQ ID NO: 265947 - DNA, 25 bp, Rattus norvegicus
ctccagtcacttgtgcttagattac

SEQ ID NO: 265948 - DNA, 25 bp, Rattus norvegicus
ctccagtccccaagaatggctcaag

SEQ ID NO: 265949 - DNA, 25 bp, Rattus norvegicus
ctccagtccccatgaatggctcaag

SEQ ID NO: 265950 - DNA, 25 bp, Rattus norvegicus
ctccagtccctaagaattctctttg

SEQ ID NO: 265951 - DNA, 25 bp, Rattus norvegicus
ctccagtccctatgaattctctttg

SEQ ID NO: 265952 - DNA, 25 bp, Rattus norvegicus
ctccagtccggtcccaggtaataga

SEQ ID NO: 265953 - DNA, 25 bp, Rattus norvegicus
ctccagtccggtgccaggtaataga

SEQ ID NO: 265954 - DNA, 25 bp, Rattus norvegicus
ctccagtcgggaaatcagtcggtga

SEQ ID NO: 265955 - DNA, 25 bp, Rattus norvegicus
ctccagtcgggatatcagtcggtga

SEQ ID NO: 265956 - DNA, 25 bp, Rattus norvegicus
ctccagtctagtccccaaaagaggt

SEQ ID NO: 265957 - DNA, 25 bp, Rattus norvegicus
ctccagtctagtgcccaaaagaggt

SEQ ID NO: 265958 - DNA, 25 bp, Rattus norvegicus
ctccagtgaaggaagcgagagctat

SEQ ID NO: 265959 - DNA, 25 bp, Rattus norvegicus
ctccagtgaaggtagcgagagctat

SEQ ID NO: 265960 - DNA, 25 bp, Rattus norvegicus
ctccagtgccaaagaagccggcgaa

SEQ ID NO: 265961 - DNA, 25 bp, Rattus norvegicus
ctccagtgccaatgaagccggcgaa

SEQ ID NO: 265962 - DNA, 25 bp, Rattus norvegicus
ctccagtggcagctgtcacctgtaa

SEQ ID NO: 265963 - DNA, 25 bp, Rattus norvegicus
ctccagtggcaggtgtcacctgtaa

SEQ ID NO: 265964 - DNA, 25 bp, Rattus norvegicus
ctccagtgtgatagagactagtcta

SEQ ID NO: 265965 - DNA, 25 bp, Rattus norvegicus
ctccagtgtgattgagactagtcta

SEQ ID NO: 265966 - DNA, 25 bp, Rattus norvegicus
ctccagtgttctatcatacatccac

SEQ ID NO: 265967 - DNA, 25 bp, Rattus norvegicus
ctccagtgttctatcctatgtgatt

SEQ ID NO: 265968 - DNA, 25 bp, Rattus norvegicus
ctccagtgttctttcatacatccac

SEQ ID NO: 265969 - DNA, 25 bp, Rattus norvegicus
ctccagtgttctttcctatgtgatt

SEQ ID NO: 265970 - DNA, 25 bp, Rattus norvegicus
ctccagtgtttcaagcctcaagtta

SEQ ID NO: 265971 - DNA, 25 bp, Rattus norvegicus
ctccagtgtttctagcctcaagtta

SEQ ID NO: 265972 - DNA, 25 bp, Rattus norvegicus
ctccagtgttttcttacctagttat

SEQ ID NO: 265973 - DNA, 25 bp, Rattus norvegicus
ctccagtgttttgttacctagttat

SEQ ID NO: 265974 - DNA, 25 bp, Rattus norvegicus
ctccagttaagtcctctcctttata

SEQ ID NO: 265975 - DNA, 25 bp, Rattus norvegicus
ctccagttaagtgctctcctttata

SEQ ID NO: 265976 - DNA, 25 bp, Rattus norvegicus
ctccagttaattctttacccagtca

SEQ ID NO: 265977 - DNA, 25 bp, Rattus norvegicus
ctccagttaattgtttacccagtca

SEQ ID NO: 265978 - DNA, 25 bp, Rattus norvegicus
ctccagttactcacaggacctgaat

SEQ ID NO: 265979 - DNA, 25 bp, Rattus norvegicus
ctccagttactctcaggacctgaat

SEQ ID NO: 265980 - DNA, 25 bp, Rattus norvegicus
ctccagttgcatccttgttctttta

SEQ ID NO: 265981 - DNA, 25 bp, Rattus norvegicus
ctccagttgcatgcttgttctttta

SEQ ID NO: 265982 - DNA, 25 bp, Rattus norvegicus
ctccatacttctctacggtttttga

SEQ ID NO: 265983 - DNA, 25 bp, Rattus norvegicus
ctccatacttctgtacggtttttga

SEQ ID NO: 265984 - DNA, 25 bp, Rattus norvegicus
ctccatatgtctccctagcaacagt

SEQ ID NO: 265985 - DNA, 25 bp, Rattus norvegicus
ctccatatgtctgcctagcaacagt

SEQ ID NO: 265986 - DNA, 25 bp, Rattus norvegicus
ctccatattcccattctgcaaaatg

SEQ ID NO: 265987 - DNA, 25 bp, Rattus norvegicus
ctccatattccctttctgcaaaatg

SEQ ID NO: 265988 - DNA, 25 bp, Rattus norvegicus
ctccatcagcctcgatttctgagta

SEQ ID NO: 265989 - DNA, 25 bp, Rattus norvegicus
ctccatcagcctggatttctgagta

SEQ ID NO: 265990 - DNA, 25 bp, Rattus norvegicus
ctccatcatgatcccacaagtagtg

SEQ ID NO: 265991 - DNA, 25 bp, Rattus norvegicus
ctccatcatgatgccacaagtagtg

SEQ ID NO: 265992 - DNA, 25 bp, Rattus norvegicus
ctccatcatggacaggatctctgcg

SEQ ID NO: 265993 - DNA, 25 bp, Rattus norvegicus
ctccatcatggagaggatctctgcg

SEQ ID NO: 265994 - DNA, 25 bp, Rattus norvegicus
ctccatccatgtctcacaatagcta

SEQ ID NO: 265995 - DNA, 25 bp, Rattus norvegicus
ctccatccatgtgtcacaatagcta

SEQ ID NO: 265996 - DNA, 25 bp, Rattus norvegicus
ctccatcccaggcaaggtgcaagag

SEQ ID NO: 265997 - DNA, 25 bp, Rattus norvegicus
ctccatcccagggaaggtgcaagag

SEQ ID NO: 265998 - DNA, 25 bp, Rattus norvegicus
ctccatccccagagtttgaggtgga

SEQ ID NO: 265999 - DNA, 25 bp, Rattus norvegicus
ctccatccccagtgtttgaggtgga

SEQ ID NO: 266000 - DNA, 25 bp, Rattus norvegicus
ctccatccctcacggtgggttctta

SEQ ID NO: 266001 - DNA, 25 bp, Rattus norvegicus
ctccatccctcagggtgggttctta

SEQ ID NO: 266002 - DNA, 25 bp, Rattus norvegicus
ctccatcctcaaatggacaagactg

SEQ ID NO: 266003 - DNA, 25 bp, Rattus norvegicus
ctccatcctcaattggacaagactg

SEQ ID NO: 266004 - DNA, 25 bp, Rattus norvegicus
ctccatcctggaattgttgatagtc

SEQ ID NO: 266005 - DNA, 25 bp, Rattus norvegicus
ctccatcctggatttgttgatagtc

SEQ ID NO: 266006 - DNA, 25 bp, Rattus norvegicus
ctccatcgggatcctaatgctgtgt

SEQ ID NO: 266007 - DNA, 25 bp, Rattus norvegicus
ctccatcgggatgctaatgctgtgt

SEQ ID NO: 266008 - DNA, 25 bp, Rattus norvegicus
ctccatctaactagactatgctggg

SEQ ID NO: 266009 - DNA, 25 bp, Rattus norvegicus
ctccatctaacttgactatgctggg

SEQ ID NO: 266010 - DNA, 25 bp, Rattus norvegicus
ctccatctagttctgacctcctgga

SEQ ID NO: 266011 - DNA, 25 bp, Rattus norvegicus
ctccatctagttgtgacctcctgga

SEQ ID NO: 266012 - DNA, 25 bp, Rattus norvegicus
ctccatctcatcaaagcagctctaa

SEQ ID NO: 266013 - DNA, 25 bp, Rattus norvegicus
ctccatctcatctaagcagctctaa

SEQ ID NO: 266014 - DNA, 25 bp, Rattus norvegicus
ctccatctgtgtccgcgagcagtga

SEQ ID NO: 266015 - DNA, 25 bp, Rattus norvegicus
ctccatctgtgtgcgcgagcagtga

SEQ ID NO: 266016 - DNA, 25 bp, Rattus norvegicus
ctccatcttatacggaaagggcatt

SEQ ID NO: 266017 - DNA, 25 bp, Rattus norvegicus
ctccatcttatagggaaagggcatt

SEQ ID NO: 266018 - DNA, 25 bp, Rattus norvegicus
ctccatcttcttcttgggtaaggac

SEQ ID NO: 266019 - DNA, 25 bp, Rattus norvegicus
ctccatcttcttgttgggtaaggac

SEQ ID NO: 266020 - DNA, 25 bp, Rattus norvegicus
ctccatcttgcactgaggatctgaa

SEQ ID NO: 266021 - DNA, 25 bp, Rattus norvegicus
ctccatcttgcagtgaggatctgaa

SEQ ID NO: 266022 - DNA, 25 bp, Rattus norvegicus
ctccatcttgtgacgtatcttttta

SEQ ID NO: 266023 - DNA, 25 bp, Rattus norvegicus
ctccatcttgtgtcgtatcttttta

SEQ ID NO: 266024 - DNA, 25 bp, Rattus norvegicus
ctccatcttgttccattgtctgaaa

SEQ ID NO: 266025 - DNA, 25 bp, Rattus norvegicus
ctccatcttgttgcattgtctgaaa

SEQ ID NO: 266026 - DNA, 25 bp, Rattus norvegicus
ctccatgaccccaatctagatgtag

SEQ ID NO: 266027 - DNA, 25 bp, Rattus norvegicus
ctccatgacccctatctagatgtag

SEQ ID NO: 266028 - DNA, 25 bp, Rattus norvegicus
ctccatgaggttctgcagtggccat

SEQ ID NO: 266029 - DNA, 25 bp, Rattus norvegicus
ctccatgaggttgtgcagtggccat

SEQ ID NO: 266030 - DNA, 25 bp, Rattus norvegicus
ctccatgcacatatgggtcacgatg

SEQ ID NO: 266031 - DNA, 25 bp, Rattus norvegicus
ctccatgcacatttgggtcacgatg

SEQ ID NO: 266032 - DNA, 25 bp, Rattus norvegicus
ctccatgctgctccgttaaataaaa

SEQ ID NO: 266033 - DNA, 25 bp, Rattus norvegicus
ctccatgctgctgcgttaaataaaa

SEQ ID NO: 266034 - DNA, 25 bp, Rattus norvegicus
ctccatggcctcagatgtcttttat

SEQ ID NO: 266035 - DNA, 25 bp, Rattus norvegicus
ctccatggcctctgatgtcttttat

SEQ ID NO: 266036 - DNA, 25 bp, Rattus norvegicus
ctccatgggtaaccggctcagggat

SEQ ID NO: 266037 - DNA, 25 bp, Rattus norvegicus
ctccatgggtaagcggctcagggat

SEQ ID NO: 266038 - DNA, 25 bp, Rattus norvegicus
ctccatggtacaacctcaaatctga

SEQ ID NO: 266039 - DNA, 25 bp, Rattus norvegicus
ctccatggtacatcctcaaatctga

SEQ ID NO: 266040 - DNA, 25 bp, Rattus norvegicus
ctccatggtctgagatctgtgctaa

SEQ ID NO: 266041 - DNA, 25 bp, Rattus norvegicus
ctccatggtctgtgatctgtgctaa

SEQ ID NO: 266042 - DNA, 25 bp, Rattus norvegicus
ctccatgtcatgactgcacttgaag

SEQ ID NO: 266043 - DNA, 25 bp, Rattus norvegicus
ctccatgtcatgtctgcacttgaag

SEQ ID NO: 266044 - DNA, 25 bp, Rattus norvegicus
ctccatgtctgtcctggaatatgaa

SEQ ID NO: 266045 - DNA, 25 bp, Rattus norvegicus
ctccatgtctgtgctggaatatgaa

SEQ ID NO: 266046 - DNA, 25 bp, Rattus norvegicus
ctccatgtgctcaggatgaggctgt

SEQ ID NO: 266047 - DNA, 25 bp, Rattus norvegicus
ctccatgtgctctggatgaggctgt

SEQ ID NO: 266048 - DNA, 25 bp, Rattus norvegicus
ctccatgtggagagcagttctagtc

SEQ ID NO: 266049 - DNA, 25 bp, Rattus norvegicus
ctccatgtggagtgcagttctagtc

SEQ ID NO: 266050 - DNA, 25 bp, Rattus norvegicus
ctccatgttccaatcctggaaggag

SEQ ID NO: 266051 - DNA, 25 bp, Rattus norvegicus
ctccatgttccattcctggaaggag

SEQ ID NO: 266052 - DNA, 25 bp, Rattus norvegicus
ctccatgttgtgacttatcctattt

SEQ ID NO: 266053 - DNA, 25 bp, Rattus norvegicus
ctccatgttgtgtcttatcctattt

SEQ ID NO: 266054 - DNA, 25 bp, Rattus norvegicus
ctccattaccaccattaagcactgg

SEQ ID NO: 266055 - DNA, 25 bp, Rattus norvegicus
ctccattaccacgattaagcactgg

SEQ ID NO: 266056 - DNA, 25 bp, Rattus norvegicus
ctccattcatctcagacagtctctg

SEQ ID NO: 266057 - DNA, 25 bp, Rattus norvegicus
ctccattcatctgagacagtctctg

SEQ ID NO: 266058 - DNA, 25 bp, Rattus norvegicus
ctccattcggttacatctcagatta

SEQ ID NO: 266059 - DNA, 25 bp, Rattus norvegicus
ctccattcggtttcatctcagatta

SEQ ID NO: 266060 - DNA, 25 bp, Rattus norvegicus
ctccattgcaaacttgtggcatctt

SEQ ID NO: 266061 - DNA, 25 bp, Rattus norvegicus
ctccattgcaaagttgtggcatctt

SEQ ID NO: 266062 - DNA, 25 bp, Rattus norvegicus
ctccattggcttctcagggattggg

SEQ ID NO: 266063 - DNA, 25 bp, Rattus norvegicus
ctccattggcttgtcagggattggg

SEQ ID NO: 266064 - DNA, 25 bp, Rattus norvegicus
ctccatttaaacacttaggtcacca

SEQ ID NO: 266065 - DNA, 25 bp, Rattus norvegicus
ctccatttaaactcttaggtcacca

SEQ ID NO: 266066 - DNA, 25 bp, Rattus norvegicus
ctccatttacacatgaaacctctca

SEQ ID NO: 266067 - DNA, 25 bp, Rattus norvegicus
ctccatttacacttgaaacctctca

SEQ ID NO: 266068 - DNA, 25 bp, Rattus norvegicus
ctccatttagctattttgaggcaaa

SEQ ID NO: 266069 - DNA, 25 bp, Rattus norvegicus
ctccatttagcttttttgaggcaaa

SEQ ID NO: 266070 - DNA, 25 bp, Rattus norvegicus
ctccatttcagtcctttgtattgta

SEQ ID NO: 266071 - DNA, 25 bp, Rattus norvegicus
ctccatttcagtgctttgtattgta

SEQ ID NO: 266072 - DNA, 25 bp, Rattus norvegicus
ctccatttctcccagaagccttggg

SEQ ID NO: 266073 - DNA, 25 bp, Rattus norvegicus
ctccatttctccgagaagccttggg

SEQ ID NO: 266074 - DNA, 25 bp, Rattus norvegicus
ctccatttcttacacctctttactg

SEQ ID NO: 266075 - DNA, 25 bp, Rattus norvegicus
ctccatttcttagacctctttactg

SEQ ID NO: 266076 - DNA, 25 bp, Rattus norvegicus
ctccatttgagaccctgcgaggctg

SEQ ID NO: 266077 - DNA, 25 bp, Rattus norvegicus
ctccatttgagagcctgcgaggctg

SEQ ID NO: 266078 - DNA, 25 bp, Rattus norvegicus
ctccatttgagcctgccatttgaag

SEQ ID NO: 266079 - DNA, 25 bp, Rattus norvegicus
ctccatttgagcgtgccatttgaag

SEQ ID NO: 266080 - DNA, 25 bp, Rattus norvegicus
ctcccaaccccacatatgtttttat

SEQ ID NO: 266081 - DNA, 25 bp, Rattus norvegicus
ctcccaaccccagatatgtttttat

SEQ ID NO: 266082 - DNA, 25 bp, Rattus norvegicus
ctcccaaccgcacatacattttgaa

SEQ ID NO: 266083 - DNA, 25 bp, Rattus norvegicus
ctcccaaccgcagatacattttgaa

SEQ ID NO: 266084 - DNA, 25 bp, Rattus norvegicus
ctcccaaccgttaaccgtgtgctgg

SEQ ID NO: 266085 - DNA, 25 bp, Rattus norvegicus
ctcccaaccgtttaccgtgtgctgg

SEQ ID NO: 266086 - DNA, 25 bp, Rattus norvegicus
ctcccaactctgctcagatgtataa

SEQ ID NO: 266087 - DNA, 25 bp, Rattus norvegicus
ctcccaactctggtcagatgtataa

SEQ ID NO: 266088 - DNA, 25 bp, Rattus norvegicus
ctcccaactgttcaactgtgtacca

SEQ ID NO: 266089 - DNA, 25 bp, Rattus norvegicus
ctcccaactgttgaactgtgtacca

SEQ ID NO: 266090 - DNA, 25 bp, Rattus norvegicus
ctcccaagtcccctgaagaagtaat

SEQ ID NO: 266091 - DNA, 25 bp, Rattus norvegicus
ctcccaagtcccgtgaagaagtaat

SEQ ID NO: 266092 - DNA, 25 bp, Rattus norvegicus
ctcccaagttcaagagactctggtt

SEQ ID NO: 266093 - DNA, 25 bp, Rattus norvegicus
ctcccaagttcatgagactctggtt

SEQ ID NO: 266094 - DNA, 25 bp, Rattus norvegicus
ctcccaatacatacaggtcgtctga

SEQ ID NO: 266095 - DNA, 25 bp, Rattus norvegicus
ctcccaatacattcaggtcgtctga

SEQ ID NO: 266096 - DNA, 25 bp, Rattus norvegicus
ctcccacacataacgcattacattg

SEQ ID NO: 266097 - DNA, 25 bp, Rattus norvegicus
ctcccacacatatcgcattacattg

SEQ ID NO: 266098 - DNA, 25 bp, Rattus norvegicus
ctcccacagatcagcgctgaatgag

SEQ ID NO: 266099 - DNA, 25 bp, Rattus norvegicus
ctcccacagatctgcgctgaatgag

SEQ ID NO: 266100 - DNA, 25 bp, Rattus norvegicus
ctcccaccatgactgctgagcttaa

SEQ ID NO: 266101 - DNA, 25 bp, Rattus norvegicus
ctcccaccatgagtgctgagcttaa

SEQ ID NO: 266102 - DNA, 25 bp, Rattus norvegicus
ctcccaccggaaaactgtatactgc

SEQ ID NO: 266103 - DNA, 25 bp, Rattus norvegicus
ctcccaccggaatactgtatactgc

SEQ ID NO: 266104 - DNA, 25 bp, Rattus norvegicus
ctcccacctataatgttgcccagag

SEQ ID NO: 266105 - DNA, 25 bp, Rattus norvegicus
ctcccacctatattgttgcccagag

SEQ ID NO: 266106 - DNA, 25 bp, Rattus norvegicus
ctcccaccttatccctagatattta

SEQ ID NO: 266107 - DNA, 25 bp, Rattus norvegicus
ctcccaccttatgcctagatattta

SEQ ID NO: 266108 - DNA, 25 bp, Rattus norvegicus
ctcccactctctctggtgatggaga

SEQ ID NO: 266109 - DNA, 25 bp, Rattus norvegicus
ctcccactctctgtggtgatggaga

SEQ ID NO: 266110 - DNA, 25 bp, Rattus norvegicus
ctcccactctgtctctaagttattt

SEQ ID NO: 266111 - DNA, 25 bp, Rattus norvegicus
ctcccactctgtgtctaagttattt

SEQ ID NO: 266112 - DNA, 25 bp, Rattus norvegicus
ctcccactgggaatctgccaggtaa

SEQ ID NO: 266113 - DNA, 25 bp, Rattus norvegicus
ctcccactgggattctgccaggtaa

SEQ ID NO: 266114 - DNA, 25 bp, Rattus norvegicus
ctcccacttttccataagcagaaca

SEQ ID NO: 266115 - DNA, 25 bp, Rattus norvegicus
ctcccacttttcgataagcagaaca

SEQ ID NO: 266116 - DNA, 25 bp, Rattus norvegicus
ctcccagaaccgaggcctttgtgaa

SEQ ID NO: 266117 - DNA, 25 bp, Rattus norvegicus
ctcccagaaccgtggcctttgtgaa

SEQ ID NO: 266118 - DNA, 25 bp, Rattus norvegicus
ctcccagacacgaatactcacaagg

SEQ ID NO: 266119 - DNA, 25 bp, Rattus norvegicus
ctcccagacacgtatactcacaagg

SEQ ID NO: 266120 - DNA, 25 bp, Rattus norvegicus
ctcccagacagacctaatccattag

SEQ ID NO: 266121 - DNA, 25 bp, Rattus norvegicus
ctcccagacagagctaatccattag

SEQ ID NO: 266122 - DNA, 25 bp, Rattus norvegicus
ctcccagaccctactgttacagggt

SEQ ID NO: 266123 - DNA, 25 bp, Rattus norvegicus
ctcccagacccttctgttacagggt

SEQ ID NO: 266124 - DNA, 25 bp, Rattus norvegicus
ctcccagactccatcagattttgaa

SEQ ID NO: 266125 - DNA, 25 bp, Rattus norvegicus
ctcccagactccttcagattttgaa

SEQ ID NO: 266126 - DNA, 25 bp, Rattus norvegicus
ctcccagactctaccacaggaaaat

SEQ ID NO: 266127 - DNA, 25 bp, Rattus norvegicus
ctcccagactcttccacaggaaaat

SEQ ID NO: 266128 - DNA, 25 bp, Rattus norvegicus
ctcccagagttcatgtgctagctgg

SEQ ID NO: 266129 - DNA, 25 bp, Rattus norvegicus
ctcccagagttcttgtgctagctgg

SEQ ID NO: 266130 - DNA, 25 bp, Rattus norvegicus
ctcccagagttgctgagtagccgtt

SEQ ID NO: 266131 - DNA, 25 bp, Rattus norvegicus
ctcccagagttggtgagtagccgtt

SEQ ID NO: 266132 - DNA, 25 bp, Rattus norvegicus
ctcccagatgtccagctttaatgaa

SEQ ID NO: 266133 - DNA, 25 bp, Rattus norvegicus
ctcccagatgtcgagctttaatgaa

SEQ ID NO: 266134 - DNA, 25 bp, Rattus norvegicus
ctcccagatttgcttgtacttcaga

SEQ ID NO: 266135 - DNA, 25 bp, Rattus norvegicus
ctcccagatttggttgtacttcaga

SEQ ID NO: 266136 - DNA, 25 bp, Rattus norvegicus
ctcccagcacatatgtagcggatgt

SEQ ID NO: 266137 - DNA, 25 bp, Rattus norvegicus
ctcccagcacatttgtagcggatgt

SEQ ID NO: 266138 - DNA, 25 bp, Rattus norvegicus
ctcccagcagacagggcagtgagtg

SEQ ID NO: 266139 - DNA, 25 bp, Rattus norvegicus
ctcccagcagactgggcagtgagtg

SEQ ID NO: 266140 - DNA, 25 bp, Rattus norvegicus
ctcccagccctgatgaacagcaagt

SEQ ID NO: 266141 - DNA, 25 bp, Rattus norvegicus
ctcccagccctgttgaacagcaagt

SEQ ID NO: 266142 - DNA, 25 bp, Rattus norvegicus
ctcccagcccttcatttagaagggt

SEQ ID NO: 266143 - DNA, 25 bp, Rattus norvegicus
ctcccagcccttgatttagaagggt

SEQ ID NO: 266144 - DNA, 25 bp, Rattus norvegicus
ctcccagccgtgctcaacggaggga

SEQ ID NO: 266145 - DNA, 25 bp, Rattus norvegicus
ctcccagccgtggtcaacggaggga

SEQ ID NO: 266146 - DNA, 25 bp, Rattus norvegicus
ctcccagccttgagttgtcaatttg

SEQ ID NO: 266147 - DNA, 25 bp, Rattus norvegicus
ctcccagccttgtgttgtcaatttg

SEQ ID NO: 266148 - DNA, 25 bp, Rattus norvegicus
ctcccagctgacattctatatgaag

SEQ ID NO: 266149 - DNA, 25 bp, Rattus norvegicus
ctcccagctgactttctatatgaag

SEQ ID NO: 266150 - DNA, 25 bp, Rattus norvegicus
ctcccagcttttccgtacataaaca

SEQ ID NO: 266151 - DNA, 25 bp, Rattus norvegicus
ctcccagcttttgcgtacataaaca

SEQ ID NO: 266152 - DNA, 25 bp, Rattus norvegicus
ctcccaggacctattatcttgttgt

SEQ ID NO: 266153 - DNA, 25 bp, Rattus norvegicus
ctcccaggaccttttatcttgttgt

SEQ ID NO: 266154 - DNA, 25 bp, Rattus norvegicus
ctcccagggacgacaaccaaatatg

SEQ ID NO: 266155 - DNA, 25 bp, Rattus norvegicus
ctcccagggacgtcaaccaaatatg

SEQ ID NO: 266156 - DNA, 25 bp, Rattus norvegicus
ctcccagggataacaagtgaatacg

SEQ ID NO: 266157 - DNA, 25 bp, Rattus norvegicus
ctcccagggatatcaagtgaatacg

SEQ ID NO: 266158 - DNA, 25 bp, Rattus norvegicus
ctcccagggcatatatttactcctt

SEQ ID NO: 266159 - DNA, 25 bp, Rattus norvegicus
ctcccagggcatttatttactcctt

SEQ ID NO: 266160 - DNA, 25 bp, Rattus norvegicus
ctcccaggtgctcggttcaaaggtt

SEQ ID NO: 266161 - DNA, 25 bp, Rattus norvegicus
ctcccaggtgctgggttcaaaggtt

SEQ ID NO: 266162 - DNA, 25 bp, Rattus norvegicus
ctcccaggttcccttcatatattaa

SEQ ID NO: 266163 - DNA, 25 bp, Rattus norvegicus
ctcccaggttccgttcatatattaa

SEQ ID NO: 266164 - DNA, 25 bp, Rattus norvegicus
ctcccagtcacacggacactgtaga

SEQ ID NO: 266165 - DNA, 25 bp, Rattus norvegicus
ctcccagtcacagggacactgtaga

SEQ ID NO: 266166 - DNA, 25 bp, Rattus norvegicus
ctcccagtcgctcctgattatgtgg

SEQ ID NO: 266167 - DNA, 25 bp, Rattus norvegicus
ctcccagtcgctgctgattatgtgg

SEQ ID NO: 266168 - DNA, 25 bp, Rattus norvegicus
ctcccagtgaagagctgccccaggt

SEQ ID NO: 266169 - DNA, 25 bp, Rattus norvegicus
ctcccagtgaagtgctgccccaggt

SEQ ID NO: 266170 - DNA, 25 bp, Rattus norvegicus
ctcccagtgctgatctaaggcatga

SEQ ID NO: 266171 - DNA, 25 bp, Rattus norvegicus
ctcccagtgctgttctaaggcatga

SEQ ID NO: 266172 - DNA, 25 bp, Rattus norvegicus
ctcccagtggacaccgggacggaga

SEQ ID NO: 266173 - DNA, 25 bp, Rattus norvegicus
ctcccagtggactccgggacggaga

SEQ ID NO: 266174 - DNA, 25 bp, Rattus norvegicus
ctcccagttcatctgcgatcttaaa

SEQ ID NO: 266175 - DNA, 25 bp, Rattus norvegicus
ctcccagttcatgtgcgatcttaaa

SEQ ID NO: 266176 - DNA, 25 bp, Rattus norvegicus
ctcccagttcctacgaataaactat

SEQ ID NO: 266177 - DNA, 25 bp, Rattus norvegicus
ctcccagttccttcgaataaactat

SEQ ID NO: 266178 - DNA, 25 bp, Rattus norvegicus
ctcccataatctccttctttaagtc

SEQ ID NO: 266179 - DNA, 25 bp, Rattus norvegicus
ctcccataatctgcttctttaagtc

SEQ ID NO: 266180 - DNA, 25 bp, Rattus norvegicus
ctcccatacccaatttaagacttct

SEQ ID NO: 266181 - DNA, 25 bp, Rattus norvegicus
ctcccatacccattttaagacttct

SEQ ID NO: 266182 - DNA, 25 bp, Rattus norvegicus
ctcccatagcgcactgtaaacatga

SEQ ID NO: 266183 - DNA, 25 bp, Rattus norvegicus
ctcccatagcgctctgtaaacatga

SEQ ID NO: 266184 - DNA, 25 bp, Rattus norvegicus
ctcccatcaagccttctggatatag

SEQ ID NO: 266185 - DNA, 25 bp, Rattus norvegicus
ctcccatcaagcgttctggatatag

SEQ ID NO: 266186 - DNA, 25 bp, Rattus norvegicus
ctcccatcactcacgagagaagtct

SEQ ID NO: 266187 - DNA, 25 bp, Rattus norvegicus
ctcccatcactctcgagagaagtct

SEQ ID NO: 266188 - DNA, 25 bp, Rattus norvegicus
ctcccatccaaactgtgctcattag

SEQ ID NO: 266189 - DNA, 25 bp, Rattus norvegicus
ctcccatccaaagtgtgctcattag

SEQ ID NO: 266190 - DNA, 25 bp, Rattus norvegicus
ctcccatccatacaagcaaactttt

SEQ ID NO: 266191 - DNA, 25 bp, Rattus norvegicus
ctcccatccatagaagcaaactttt

SEQ ID NO: 266192 - DNA, 25 bp, Rattus norvegicus
ctcccatccttaactgtcttttaag

SEQ ID NO: 266193 - DNA, 25 bp, Rattus norvegicus
ctcccatccttatctgtcttttaag

SEQ ID NO: 266194 - DNA, 25 bp, Rattus norvegicus
ctcccatcgggaagttgtgctttat

SEQ ID NO: 266195 - DNA, 25 bp, Rattus norvegicus
ctcccatcgggatgttgtgctttat

SEQ ID NO: 266196 - DNA, 25 bp, Rattus norvegicus
ctcccatctcttctcgaggaaagaa

SEQ ID NO: 266197 - DNA, 25 bp, Rattus norvegicus
ctcccatctcttgtcgaggaaagaa

SEQ ID NO: 266198 - DNA, 25 bp, Rattus norvegicus
ctcccatgaaggactctctagtaag

SEQ ID NO: 266199 - DNA, 25 bp, Rattus norvegicus
ctcccatgaaggtctctctagtaag

SEQ ID NO: 266200 - DNA, 25 bp, Rattus norvegicus
ctcccatgatagatttcccagcaga

SEQ ID NO: 266201 - DNA, 25 bp, Rattus norvegicus
ctcccatgatagttttcccagcaga

SEQ ID NO: 266202 - DNA, 25 bp, Rattus norvegicus
ctcccatgatgcagagaggaagctt

SEQ ID NO: 266203 - DNA, 25 bp, Rattus norvegicus
ctcccatgatgctgagaggaagctt

SEQ ID NO: 266204 - DNA, 25 bp, Rattus norvegicus
ctcccatgcagaaatcgtccttaat

SEQ ID NO: 266205 - DNA, 25 bp, Rattus norvegicus
ctcccatgcagatatcgtccttaat

SEQ ID NO: 266206 - DNA, 25 bp, Rattus norvegicus
ctcccatgtatcaccttgtatttaa

SEQ ID NO: 266207 - DNA, 25 bp, Rattus norvegicus
ctcccatgtatctccttgtatttaa

SEQ ID NO: 266208 - DNA, 25 bp, Rattus norvegicus
ctcccatgtgcactcagacagtgag

SEQ ID NO: 266209 - DNA, 25 bp, Rattus norvegicus
ctcccatgtgcagtcagacagtgag

SEQ ID NO: 266210 - DNA, 25 bp, Rattus norvegicus
ctcccatgtgggactatttccttta

SEQ ID NO: 266211 - DNA, 25 bp, Rattus norvegicus
ctcccatgtgggtctatttccttta

SEQ ID NO: 266212 - DNA, 25 bp, Rattus norvegicus
ctcccattccctatgatgttatttt

SEQ ID NO: 266213 - DNA, 25 bp, Rattus norvegicus
ctcccattccctttgatgttatttt

SEQ ID NO: 266214 - DNA, 25 bp, Rattus norvegicus
ctcccattcttaaccttatcagtaa

SEQ ID NO: 266215 - DNA, 25 bp, Rattus norvegicus
ctcccattcttatccttatcagtaa

SEQ ID NO: 266216 - DNA, 25 bp, Rattus norvegicus
ctcccattgggcagtcttgttaata

SEQ ID NO: 266217 - DNA, 25 bp, Rattus norvegicus
ctcccattgggctgtcttgttaata

SEQ ID NO: 266218 - DNA, 25 bp, Rattus norvegicus
ctcccattgttgagttgtaggctaa

SEQ ID NO: 266219 - DNA, 25 bp, Rattus norvegicus
ctcccattgttgtgttgtaggctaa

SEQ ID NO: 266220 - DNA, 25 bp, Rattus norvegicus
ctcccatttatgctagtggcattac

SEQ ID NO: 266221 - DNA, 25 bp, Rattus norvegicus
ctcccatttatggtagtggcattac

SEQ ID NO: 266222 - DNA, 25 bp, Rattus norvegicus
ctcccattttgcactgtgtgttgat

SEQ ID NO: 266223 - DNA, 25 bp, Rattus norvegicus
ctcccattttgctctgtgtgttgat

SEQ ID NO: 266224 - DNA, 25 bp, Rattus norvegicus
ctcccattttgtccatctgtttcaa

SEQ ID NO: 266225 - DNA, 25 bp, Rattus norvegicus
ctcccattttgtgcatctgtttcaa

SEQ ID NO: 266226 - DNA, 25 bp, Rattus norvegicus
ctccccaaacacaaatccgaagtgg

SEQ ID NO: 266227 - DNA, 25 bp, Rattus norvegicus
ctccccaaacactaatccgaagtgg

SEQ ID NO: 266228 - DNA, 25 bp, Rattus norvegicus
ctccccaaatccagtcatcaaagag

SEQ ID NO: 266229 - DNA, 25 bp, Rattus norvegicus
ctccccaaatcctgtcatcaaagag

SEQ ID NO: 266230 - DNA, 25 bp, Rattus norvegicus
ctccccaacgtcagtagcagtagat

SEQ ID NO: 266231 - DNA, 25 bp, Rattus norvegicus
ctccccaacgtctgtagcagtagat

SEQ ID NO: 266232 - DNA, 25 bp, Rattus norvegicus
ctccccaactgtctcaaagtgctgg

SEQ ID NO: 266233 - DNA, 25 bp, Rattus norvegicus
ctccccaactgtgtcaaagtgctgg

SEQ ID NO: 266234 - DNA, 25 bp, Rattus norvegicus
ctccccaagcatattaggcatgtga

SEQ ID NO: 266235 - DNA, 25 bp, Rattus norvegicus
ctccccaagcattttaggcatgtga

SEQ ID NO: 266236 - DNA, 25 bp, Rattus norvegicus
ctccccaagttgcttcatggaagct

SEQ ID NO: 266237 - DNA, 25 bp, Rattus norvegicus
ctccccaagttggttcatggaagct

SEQ ID NO: 266238 - DNA, 25 bp, Rattus norvegicus
ctccccacattgaaaatacacttta

SEQ ID NO: 266239 - DNA, 25 bp, Rattus norvegicus
ctccccacattgtaaatacacttta

SEQ ID NO: 266240 - DNA, 25 bp, Rattus norvegicus
ctccccaccacaataaaacggtgag

SEQ ID NO: 266241 - DNA, 25 bp, Rattus norvegicus
ctccccaccacattaaaacggtgag

SEQ ID NO: 266242 - DNA, 25 bp, Rattus norvegicus
ctccccaccttcaaaacatgtataa

SEQ ID NO: 266243 - DNA, 25 bp, Rattus norvegicus
ctccccaccttctaaacatgtataa

SEQ ID NO: 266244 - DNA, 25 bp, Rattus norvegicus
ctccccagagtgaccgtagccattt

SEQ ID NO: 266245 - DNA, 25 bp, Rattus norvegicus
ctccccagagtgtccgtagccattt

SEQ ID NO: 266246 - DNA, 25 bp, Rattus norvegicus
ctccccagcattccctagaggaaaa

SEQ ID NO: 266247 - DNA, 25 bp, Rattus norvegicus
ctccccagcattgcctagaggaaaa

SEQ ID NO: 266248 - DNA, 25 bp, Rattus norvegicus
ctccccagggctacacaagacatgt

SEQ ID NO: 266249 - DNA, 25 bp, Rattus norvegicus
ctccccagggcttcacaagacatgt

SEQ ID NO: 266250 - DNA, 25 bp, Rattus norvegicus
ctccccatgatgctcacgtttaaat

SEQ ID NO: 266251 - DNA, 25 bp, Rattus norvegicus
ctccccatgatggtcacgtttaaat

SEQ ID NO: 266252 - DNA, 25 bp, Rattus norvegicus
ctccccatgcagacaagtactttga

SEQ ID NO: 266253 - DNA, 25 bp, Rattus norvegicus
ctccccatgcagtcaagtactttga

SEQ ID NO: 266254 - DNA, 25 bp, Rattus norvegicus
ctccccgacaagctctcagataaaa

SEQ ID NO: 266255 - DNA, 25 bp, Rattus norvegicus
ctccccgacaaggtctcagataaaa

SEQ ID NO: 266256 - DNA, 25 bp, Rattus norvegicus
ctccccgaggccagtagtggtggaa

SEQ ID NO: 266257 - DNA, 25 bp, Rattus norvegicus
ctccccgaggcctgtagtggtggaa

SEQ ID NO: 266258 - DNA, 25 bp, Rattus norvegicus
ctccccgagtaacaccatttaagtg

SEQ ID NO: 266259 - DNA, 25 bp, Rattus norvegicus
ctccccgagtaagaccatttaagtg

SEQ ID NO: 266260 - DNA, 25 bp, Rattus norvegicus
ctccccgagttgcttcatggaagct

SEQ ID NO: 266261 - DNA, 25 bp, Rattus norvegicus
ctccccgagttggttcatggaagct

SEQ ID NO: 266262 - DNA, 25 bp, Rattus norvegicus
ctccccgcagggatccagagggaaa

SEQ ID NO: 266263 - DNA, 25 bp, Rattus norvegicus
ctccccgcagggttccagagggaaa

SEQ ID NO: 266264 - DNA, 25 bp, Rattus norvegicus
ctccccggcggtaagtgctgagagt

SEQ ID NO: 266265 - DNA, 25 bp, Rattus norvegicus
ctccccggcggttagtgctgagagt

SEQ ID NO: 266266 - DNA, 25 bp, Rattus norvegicus
ctccccgttttgactgcaagtgaag

SEQ ID NO: 266267 - DNA, 25 bp, Rattus norvegicus
ctccccgttttgtctgcaagtgaag

SEQ ID NO: 266268 - DNA, 25 bp, Rattus norvegicus
ctcccctaaacccttaagatgtcat

SEQ ID NO: 266269 - DNA, 25 bp, Rattus norvegicus
ctcccctaaaccgttaagatgtcat

SEQ ID NO: 266270 - DNA, 25 bp, Rattus norvegicus
ctcccctcaggcaagttgttatgta

SEQ ID NO: 266271 - DNA, 25 bp, Rattus norvegicus
ctcccctcaggctagttgttatgta

SEQ ID NO: 266272 - DNA, 25 bp, Rattus norvegicus
ctcccctccaagataacgtctgaag

SEQ ID NO: 266273 - DNA, 25 bp, Rattus norvegicus
ctcccctccaagttaacgtctgaag

SEQ ID NO: 266274 - DNA, 25 bp, Rattus norvegicus
ctcccctccatacgacttgaagttt

SEQ ID NO: 266275 - DNA, 25 bp, Rattus norvegicus
ctcccctccataggacttgaagttt

SEQ ID NO: 266276 - DNA, 25 bp, Rattus norvegicus
ctcccctgagttaggcaacaagtcg

SEQ ID NO: 266277 - DNA, 25 bp, Rattus norvegicus
ctcccctgagtttggcaacaagtcg

SEQ ID NO: 266278 - DNA, 25 bp, Rattus norvegicus
ctcccctgctttaagtctgaatttt

SEQ ID NO: 266279 - DNA, 25 bp, Rattus norvegicus
ctcccctgctttcgttgaaaatcat

SEQ ID NO: 266280 - DNA, 25 bp, Rattus norvegicus
ctcccctgctttctgagttaggcgt

SEQ ID NO: 266281 - DNA, 25 bp, Rattus norvegicus
ctcccctgctttggttgaaaatcat

SEQ ID NO: 266282 - DNA, 25 bp, Rattus norvegicus
ctcccctgctttgtgagttaggcgt

SEQ ID NO: 266283 - DNA, 25 bp, Rattus norvegicus
ctcccctgcttttagtctgaatttt

SEQ ID NO: 266284 - DNA, 25 bp, Rattus norvegicus
ctcccctggactaaaggcaaaattg

SEQ ID NO: 266285 - DNA, 25 bp, Rattus norvegicus
ctcccctggacttaaggcaaaattg

SEQ ID NO: 266286 - DNA, 25 bp, Rattus norvegicus
ctcccctggtacactaggaatcaga

SEQ ID NO: 266287 - DNA, 25 bp, Rattus norvegicus
ctcccctggtactctaggaatcaga

SEQ ID NO: 266288 - DNA, 25 bp, Rattus norvegicus
ctcccctggtcacatttagaagtca

SEQ ID NO: 266289 - DNA, 25 bp, Rattus norvegicus
ctcccctggtcagatttagaagtca

SEQ ID NO: 266290 - DNA, 25 bp, Rattus norvegicus
ctcccctgtaatactcctaagtgta

SEQ ID NO: 266291 - DNA, 25 bp, Rattus norvegicus
ctcccctgtaattctcctaagtgta

SEQ ID NO: 266292 - DNA, 25 bp, Rattus norvegicus
ctcccctgtactctgacaaggtatt

SEQ ID NO: 266293 - DNA, 25 bp, Rattus norvegicus
ctcccctgtactgtgacaaggtatt

SEQ ID NO: 266294 - DNA, 25 bp, Rattus norvegicus
ctccccttaaagctactatctgtga

SEQ ID NO: 266295 - DNA, 25 bp, Rattus norvegicus
ctccccttaaaggtactatctgtga

SEQ ID NO: 266296 - DNA, 25 bp, Rattus norvegicus
ctccccttaaatatccaatatcttg

SEQ ID NO: 266297 - DNA, 25 bp, Rattus norvegicus
ctccccttaaatttccaatatcttg

SEQ ID NO: 266298 - DNA, 25 bp, Rattus norvegicus
ctccccttattcacaaaccagaagt

SEQ ID NO: 266299 - DNA, 25 bp, Rattus norvegicus
ctccccttattctcaaaccagaagt

SEQ ID NO: 266300 - DNA, 25 bp, Rattus norvegicus
ctccccttcattatagatgcctgtt

SEQ ID NO: 266301 - DNA, 25 bp, Rattus norvegicus
ctccccttcattttagatgcctgtt

SEQ ID NO: 266302 - DNA, 25 bp, Rattus norvegicus
ctccccttccatcatgctatttata

SEQ ID NO: 266303 - DNA, 25 bp, Rattus norvegicus
ctccccttccatgatgctatttata

SEQ ID NO: 266304 - DNA, 25 bp, Rattus norvegicus
ctccccttctatctcttgtatgtat

SEQ ID NO: 266305 - DNA, 25 bp, Rattus norvegicus
ctccccttctatgtcttgtatgtat

SEQ ID NO: 266306 - DNA, 25 bp, Rattus norvegicus
ctcccctttaaaccttcagcgtagt

SEQ ID NO: 266307 - DNA, 25 bp, Rattus norvegicus
ctcccctttaaagcttcagcgtagt

SEQ ID NO: 266308 - DNA, 25 bp, Rattus norvegicus
ctcccctttcccatatcataattaa

SEQ ID NO: 266309 - DNA, 25 bp, Rattus norvegicus
ctcccctttcccttatcataattaa

SEQ ID NO: 266310 - DNA, 25 bp, Rattus norvegicus
ctcccctttcctcagtagaaatgtg

SEQ ID NO: 266311 - DNA, 25 bp, Rattus norvegicus
ctcccctttcctgagtagaaatgtg

SEQ ID NO: 266312 - DNA, 25 bp, Rattus norvegicus
ctcccctttgtgatggactgcaaat

SEQ ID NO: 266313 - DNA, 25 bp, Rattus norvegicus
ctcccctttgtgttggactgcaaat

SEQ ID NO: 266314 - DNA, 25 bp, Rattus norvegicus
ctcccgagccgaccagagcgctgta

SEQ ID NO: 266315 - DNA, 25 bp, Rattus norvegicus
ctcccgagccgagcagagcgctgta

SEQ ID NO: 266316 - DNA, 25 bp, Rattus norvegicus
ctcccgaggtggaggaacgccttgt

SEQ ID NO: 266317 - DNA, 25 bp, Rattus norvegicus
ctcccgaggtggtggaacgccttgt

SEQ ID NO: 266318 - DNA, 25 bp, Rattus norvegicus
ctcccgagtgcacgttgaggtgatc

SEQ ID NO: 266319 - DNA, 25 bp, Rattus norvegicus
ctcccgagtgcaggttgaggtgatc

SEQ ID NO: 266320 - DNA, 25 bp, Rattus norvegicus
ctcccgagtgccaggcgagattaaa

SEQ ID NO: 266321 - DNA, 25 bp, Rattus norvegicus
ctcccgagtgcctggcgagattaaa

SEQ ID NO: 266322 - DNA, 25 bp, Rattus norvegicus
ctcccgagtgctcgatttaggtgca

SEQ ID NO: 266323 - DNA, 25 bp, Rattus norvegicus
ctcccgagtgctggatttaggtgca

SEQ ID NO: 266324 - DNA, 25 bp, Rattus norvegicus
ctcccgatgcctatgttcacagctg

SEQ ID NO: 266325 - DNA, 25 bp, Rattus norvegicus
ctcccgatgcctttgttcacagctg

SEQ ID NO: 266326 - DNA, 25 bp, Rattus norvegicus
ctcccgcactggcaatatagatggt

SEQ ID NO: 266327 - DNA, 25 bp, Rattus norvegicus
ctcccgcactgggaatatagatggt

SEQ ID NO: 266328 - DNA, 25 bp, Rattus norvegicus
ctcccgcagcagaaacactattaat

SEQ ID NO: 266329 - DNA, 25 bp, Rattus norvegicus
ctcccgcagcagtaacactattaat

SEQ ID NO: 266330 - DNA, 25 bp, Rattus norvegicus
ctcccgcatttgcttcttcctgtgg

SEQ ID NO: 266331 - DNA, 25 bp, Rattus norvegicus
ctcccgcatttggttcttcctgtgg

SEQ ID NO: 266332 - DNA, 25 bp, Rattus norvegicus
ctcccgcggacaccgcggagatgaa

SEQ ID NO: 266333 - DNA, 25 bp, Rattus norvegicus
ctcccgcggacagcgcggagatgaa

SEQ ID NO: 266334 - DNA, 25 bp, Rattus norvegicus
ctcccgctatggctaattttcaatt

SEQ ID NO: 266335 - DNA, 25 bp, Rattus norvegicus
ctcccgctatgggtaattttcaatt

SEQ ID NO: 266336 - DNA, 25 bp, Rattus norvegicus
ctcccgctcttcctctgtgggaaaa

SEQ ID NO: 266337 - DNA, 25 bp, Rattus norvegicus
ctcccgctcttcgtctgtgggaaaa

SEQ ID NO: 266338 - DNA, 25 bp, Rattus norvegicus
ctcccggagttcagatcttacaagt

SEQ ID NO: 266339 - DNA, 25 bp, Rattus norvegicus
ctcccggagttctgatcttacaagt

SEQ ID NO: 266340 - DNA, 25 bp, Rattus norvegicus
ctcccggcagccaggggaccgtgta

SEQ ID NO: 266341 - DNA, 25 bp, Rattus norvegicus
ctcccggcagcctggggaccgtgta

SEQ ID NO: 266342 - DNA, 25 bp, Rattus norvegicus
ctcccggctgcgagggttggtcctc

SEQ ID NO: 266343 - DNA, 25 bp, Rattus norvegicus
ctcccggctgcgtgggttggtcctc

SEQ ID NO: 266344 - DNA, 25 bp, Rattus norvegicus
ctcccgggaggaagtgttgaacttt

SEQ ID NO: 266345 - DNA, 25 bp, Rattus norvegicus
ctcccgggaggatgtgttgaacttt

SEQ ID NO: 266346 - DNA, 25 bp, Rattus norvegicus
ctcccgggtggaagaagccaggcgt

SEQ ID NO: 266347 - DNA, 25 bp, Rattus norvegicus
ctcccgggtggatgaagccaggcgt

SEQ ID NO: 266348 - DNA, 25 bp, Rattus norvegicus
ctcccgtaggcaccaatcaggtgtt

SEQ ID NO: 266349 - DNA, 25 bp, Rattus norvegicus
ctcccgtaggcagcaatcaggtgtt

SEQ ID NO: 266350 - DNA, 25 bp, Rattus norvegicus
ctcccgtcagagactctcgggatga

SEQ ID NO: 266351 - DNA, 25 bp, Rattus norvegicus
ctcccgtcagagtctctcgggatga

SEQ ID NO: 266352 - DNA, 25 bp, Rattus norvegicus
ctcccgtgcccaattctaataaaat

SEQ ID NO: 266353 - DNA, 25 bp, Rattus norvegicus
ctcccgtgcccatttctaataaaat

SEQ ID NO: 266354 - DNA, 25 bp, Rattus norvegicus
ctcccgttctcaattttactgctgg

SEQ ID NO: 266355 - DNA, 25 bp, Rattus norvegicus
ctcccgttctcatttttactgctgg

SEQ ID NO: 266356 - DNA, 25 bp, Rattus norvegicus
ctccctaaatttactaccgctattg

SEQ ID NO: 266357 - DNA, 25 bp, Rattus norvegicus
ctccctaaattttctaccgctattg

SEQ ID NO: 266358 - DNA, 25 bp, Rattus norvegicus
ctccctaacctgagtgtgtctttaa

SEQ ID NO: 266359 - DNA, 25 bp, Rattus norvegicus
ctccctaacctgtgtgtgtctttaa

SEQ ID NO: 266360 - DNA, 25 bp, Rattus norvegicus
ctccctaactgccttcaataatctg

SEQ ID NO: 266361 - DNA, 25 bp, Rattus norvegicus
ctccctaactgcgttcaataatctg

SEQ ID NO: 266362 - DNA, 25 bp, Rattus norvegicus
ctccctaacttgaattctctggcaa

SEQ ID NO: 266363 - DNA, 25 bp, Rattus norvegicus
ctccctaacttgtattctctggcaa

SEQ ID NO: 266364 - DNA, 25 bp, Rattus norvegicus
ctccctaagtttctcacatgccaga

SEQ ID NO: 266365 - DNA, 25 bp, Rattus norvegicus
ctccctaagtttgtcacatgccaga

SEQ ID NO: 266366 - DNA, 25 bp, Rattus norvegicus
ctccctacacaacccattataggtg

SEQ ID NO: 266367 - DNA, 25 bp, Rattus norvegicus
ctccctacacaagccattataggtg

SEQ ID NO: 266368 - DNA, 25 bp, Rattus norvegicus
ctccctacccacaagaaaatcagtt

SEQ ID NO: 266369 - DNA, 25 bp, Rattus norvegicus
ctccctacccactagaaaatcagtt

SEQ ID NO: 266370 - DNA, 25 bp, Rattus norvegicus
ctccctacgacaagctaagccatag

SEQ ID NO: 266371 - DNA, 25 bp, Rattus norvegicus
ctccctacgacatgctaagccatag

SEQ ID NO: 266372 - DNA, 25 bp, Rattus norvegicus
ctccctacttctaagagagtgtgac

SEQ ID NO: 266373 - DNA, 25 bp, Rattus norvegicus
ctccctacttcttagagagtgtgac

SEQ ID NO: 266374 - DNA, 25 bp, Rattus norvegicus
ctccctagcctcctggaatagagaa

SEQ ID NO: 266375 - DNA, 25 bp, Rattus norvegicus
ctccctagcctcgtggaatagagaa

SEQ ID NO: 266376 - DNA, 25 bp, Rattus norvegicus
ctccctagtctgcatattttcatca

SEQ ID NO: 266377 - DNA, 25 bp, Rattus norvegicus
ctccctagtctggatattttcatca

SEQ ID NO: 266378 - DNA, 25 bp, Rattus norvegicus
ctccctatggctctgatgtctggca

SEQ ID NO: 266379 - DNA, 25 bp, Rattus norvegicus
ctccctatggctgtgatgtctggca

SEQ ID NO: 266380 - DNA, 25 bp, Rattus norvegicus
ctccctcaattccaaatgcatcagg

SEQ ID NO: 266381 - DNA, 25 bp, Rattus norvegicus
ctccctcaattcgaaatgcatcagg

SEQ ID NO: 266382 - DNA, 25 bp, Rattus norvegicus
ctccctcacaggacaatttactatt

SEQ ID NO: 266383 - DNA, 25 bp, Rattus norvegicus
ctccctcacaggtcaatttactatt

SEQ ID NO: 266384 - DNA, 25 bp, Rattus norvegicus
ctccctcagtggagagaagatgaga

SEQ ID NO: 266385 - DNA, 25 bp, Rattus norvegicus
ctccctcagtggtgagaagatgaga

SEQ ID NO: 266386 - DNA, 25 bp, Rattus norvegicus
ctccctccaaagcaatgaagtttgg

SEQ ID NO: 266387 - DNA, 25 bp, Rattus norvegicus
ctccctccaaaggaatgaagtttgg

SEQ ID NO: 266388 - DNA, 25 bp, Rattus norvegicus
ctccctcccttgacagggaaatgac

SEQ ID NO: 266389 - DNA, 25 bp, Rattus norvegicus
ctccctcccttgacatgtaaggtat

SEQ ID NO: 266390 - DNA, 25 bp, Rattus norvegicus
ctccctcccttgatttaaagacatg

SEQ ID NO: 266391 - DNA, 25 bp, Rattus norvegicus
ctccctcccttgtcagggaaatgac

SEQ ID NO: 266392 - DNA, 25 bp, Rattus norvegicus
ctccctcccttgtcatgtaaggtat

SEQ ID NO: 266393 - DNA, 25 bp, Rattus norvegicus
ctccctcccttgttttaaagacatg

SEQ ID NO: 266394 - DNA, 25 bp, Rattus norvegicus
ctccctcctggcagctggagcaggg

SEQ ID NO: 266395 - DNA, 25 bp, Rattus norvegicus
ctccctcctggctgctggagcaggg

SEQ ID NO: 266396 - DNA, 25 bp, Rattus norvegicus
ctccctcctgtaacttctataaaat

SEQ ID NO: 266397 - DNA, 25 bp, Rattus norvegicus
ctccctcctgtatcttctataaaat

SEQ ID NO: 266398 - DNA, 25 bp, Rattus norvegicus
ctccctcggcagaaggtgatggctg

SEQ ID NO: 266399 - DNA, 25 bp, Rattus norvegicus
ctccctcggcagtaggtgatggctg

SEQ ID NO: 266400 - DNA, 25 bp, Rattus norvegicus
ctccctcgtctgaacatgatacaaa

SEQ ID NO: 266401 - DNA, 25 bp, Rattus norvegicus
ctccctcgtctgtacatgatacaaa

SEQ ID NO: 266402 - DNA, 25 bp, Rattus norvegicus
ctccctcgtggcatatatatttctt

SEQ ID NO: 266403 - DNA, 25 bp, Rattus norvegicus
ctccctcgtggcttatatatttctt

SEQ ID NO: 266404 - DNA, 25 bp, Rattus norvegicus
ctccctcgttggcttgcatgaagaa

SEQ ID NO: 266405 - DNA, 25 bp, Rattus norvegicus
ctccctcgttgggttgcatgaagaa

SEQ ID NO: 266406 - DNA, 25 bp, Rattus norvegicus
ctccctctagctagtagtctagcag

SEQ ID NO: 266407 - DNA, 25 bp, Rattus norvegicus
ctccctctagcttgtagtctagcag

SEQ ID NO: 266408 - DNA, 25 bp, Rattus norvegicus
ctccctctagttatatgccaagtga

SEQ ID NO: 266409 - DNA, 25 bp, Rattus norvegicus
ctccctctagttttatgccaagtga

SEQ ID NO: 266410 - DNA, 25 bp, Rattus norvegicus
ctccctctcaccatgtattttataa

SEQ ID NO: 266411 - DNA, 25 bp, Rattus norvegicus
ctccctctcaccttgtattttataa

SEQ ID NO: 266412 - DNA, 25 bp, Rattus norvegicus
ctccctctctgtctctatcaaaatg

SEQ ID NO: 266413 - DNA, 25 bp, Rattus norvegicus
ctccctctctgtgtctatcaaaatg

SEQ ID NO: 266414 - DNA, 25 bp, Rattus norvegicus
ctccctctgagaacctgaagacatt

SEQ ID NO: 266415 - DNA, 25 bp, Rattus norvegicus
ctccctctgagatcctgaagacatt

SEQ ID NO: 266416 - DNA, 25 bp, Rattus norvegicus
ctccctctgtgtcccaaggaaggga

SEQ ID NO: 266417 - DNA, 25 bp, Rattus norvegicus
ctccctctgtgtgccaaggaaggga

SEQ ID NO: 266418 - DNA, 25 bp, Rattus norvegicus
ctccctcttgataattcatccacaa

SEQ ID NO: 266419 - DNA, 25 bp, Rattus norvegicus
ctccctcttgattattcatccacaa

SEQ ID NO: 266420 - DNA, 25 bp, Rattus norvegicus
ctccctgaaaacctcacacgtatat

SEQ ID NO: 266421 - DNA, 25 bp, Rattus norvegicus
ctccctgaaaacgtcacacgtatat

SEQ ID NO: 266422 - DNA, 25 bp, Rattus norvegicus
ctccctgaccttacaccagagaaat

SEQ ID NO: 266423 - DNA, 25 bp, Rattus norvegicus
ctccctgacctttcaccagagaaat

SEQ ID NO: 266424 - DNA, 25 bp, Rattus norvegicus
ctccctgaggatagagccaatggtg

SEQ ID NO: 266425 - DNA, 25 bp, Rattus norvegicus
ctccctgaggattgagccaatggtg

SEQ ID NO: 266426 - DNA, 25 bp, Rattus norvegicus
ctccctgagtctcctaggaatatgt

SEQ ID NO: 266427 - DNA, 25 bp, Rattus norvegicus
ctccctgagtctgctaggaatatgt

SEQ ID NO: 266428 - DNA, 25 bp, Rattus norvegicus
ctccctgatattatcggcacaagta

SEQ ID NO: 266429 - DNA, 25 bp, Rattus norvegicus
ctccctgatattttcggcacaagta

SEQ ID NO: 266430 - DNA, 25 bp, Rattus norvegicus
ctccctgccaagcactaaaaagctg

SEQ ID NO: 266431 - DNA, 25 bp, Rattus norvegicus
ctccctgccaaggactaaaaagctg

SEQ ID NO: 266432 - DNA, 25 bp, Rattus norvegicus
ctccctgcctgacccatgagtggga

SEQ ID NO: 266433 - DNA, 25 bp, Rattus norvegicus
ctccctgcctgagccatgagtggga

SEQ ID NO: 266434 - DNA, 25 bp, Rattus norvegicus
ctccctgcgggaagtgcttggtgat

SEQ ID NO: 266435 - DNA, 25 bp, Rattus norvegicus
ctccctgcgggatgtgcttggtgat

SEQ ID NO: 266436 - DNA, 25 bp, Rattus norvegicus
ctccctgctgagcaacatgctgttt

SEQ ID NO: 266437 - DNA, 25 bp, Rattus norvegicus
ctccctgctgaggaacatgctgttt

SEQ ID NO: 266438 - DNA, 25 bp, Rattus norvegicus
ctccctgctgcaagagaggaagcat

SEQ ID NO: 266439 - DNA, 25 bp, Rattus norvegicus
ctccctgctgcatgagaggaagcat

SEQ ID NO: 266440 - DNA, 25 bp, Rattus norvegicus
ctccctgctgcgatggacaaatcaa

SEQ ID NO: 266441 - DNA, 25 bp, Rattus norvegicus
ctccctgctgcgttggacaaatcaa

SEQ ID NO: 266442 - DNA, 25 bp, Rattus norvegicus
ctccctgctggtatgcaagggtagg

SEQ ID NO: 266443 - DNA, 25 bp, Rattus norvegicus
ctccctgctggtttgcaagggtagg

SEQ ID NO: 266444 - DNA, 25 bp, Rattus norvegicus
ctccctgctgtcctgtgtgtcttta

SEQ ID NO: 266445 - DNA, 25 bp, Rattus norvegicus
ctccctgctgtcgtgtgtgtcttta

SEQ ID NO: 266446 - DNA, 25 bp, Rattus norvegicus
ctccctggatccatgtggattttga

SEQ ID NO: 266447 - DNA, 25 bp, Rattus norvegicus
ctccctggatccttgtggattttga

SEQ ID NO: 266448 - DNA, 25 bp, Rattus norvegicus
ctccctggcggaccagaattttcta

SEQ ID NO: 266449 - DNA, 25 bp, Rattus norvegicus
ctccctggcggagcagaattttcta

SEQ ID NO: 266450 - DNA, 25 bp, Rattus norvegicus
ctccctggctgcatgaggtttcaga

SEQ ID NO: 266451 - DNA, 25 bp, Rattus norvegicus
ctccctggctgcttgaggtttcaga

SEQ ID NO: 266452 - DNA, 25 bp, Rattus norvegicus
ctccctggctgtaaacctttactag

SEQ ID NO: 266453 - DNA, 25 bp, Rattus norvegicus
ctccctggctgtatatgattggcat

SEQ ID NO: 266454 - DNA, 25 bp, Rattus norvegicus
ctccctggctgttaacctttactag

SEQ ID NO: 266455 - DNA, 25 bp, Rattus norvegicus
ctccctggctgtttatgattggcat

SEQ ID NO: 266456 - DNA, 25 bp, Rattus norvegicus
ctccctgggacacaggatggtagaa

SEQ ID NO: 266457 - DNA, 25 bp, Rattus norvegicus
ctccctgggacagaggatggtagaa

SEQ ID NO: 266458 - DNA, 25 bp, Rattus norvegicus
ctccctggtattcctttgtttctta

SEQ ID NO: 266459 - DNA, 25 bp, Rattus norvegicus
ctccctggtattgctttgtttctta

SEQ ID NO: 266460 - DNA, 25 bp, Rattus norvegicus
ctccctggtcttcctttgtttgtgt

SEQ ID NO: 266461 - DNA, 25 bp, Rattus norvegicus
ctccctggtcttgctttgtttgtgt

SEQ ID NO: 266462 - DNA, 25 bp, Rattus norvegicus
ctccctggtttcattatttgcagtt

SEQ ID NO: 266463 - DNA, 25 bp, Rattus norvegicus
ctccctggtttctttatttgcagtt

SEQ ID NO: 266464 - DNA, 25 bp, Rattus norvegicus
ctccctgtaatcactgtgtcataga

SEQ ID NO: 266465 - DNA, 25 bp, Rattus norvegicus
ctccctgtaatctctgtgtcataga

SEQ ID NO: 266466 - DNA, 25 bp, Rattus norvegicus
ctccctgtactgacttctctataaa

SEQ ID NO: 266467 - DNA, 25 bp, Rattus norvegicus
ctccctgtactgtcttctctataaa

SEQ ID NO: 266468 - DNA, 25 bp, Rattus norvegicus
ctccctgtgttgagtgccattgcca

SEQ ID NO: 266469 - DNA, 25 bp, Rattus norvegicus
ctccctgtgttgtgtgccattgcca

SEQ ID NO: 266470 - DNA, 25 bp, Rattus norvegicus
ctccctgttagtcgaggtggcctgt

SEQ ID NO: 266471 - DNA, 25 bp, Rattus norvegicus
ctccctgttagtggaggtggcctgt

SEQ ID NO: 266472 - DNA, 25 bp, Rattus norvegicus
ctccctgttgctcatttttgttgaa

SEQ ID NO: 266473 - DNA, 25 bp, Rattus norvegicus
ctccctgttgctgatttttgttgaa

SEQ ID NO: 266474 - DNA, 25 bp, Rattus norvegicus
ctccctgtttgtccttgtaatgctt

SEQ ID NO: 266475 - DNA, 25 bp, Rattus norvegicus
ctccctgtttgtgcttgtaatgctt

SEQ ID NO: 266476 - DNA, 25 bp, Rattus norvegicus
ctcccttacttcattgtttgagaca

SEQ ID NO: 266477 - DNA, 25 bp, Rattus norvegicus
ctcccttacttctttgtttgagaca

SEQ ID NO: 266478 - DNA, 25 bp, Rattus norvegicus
ctcccttatccacaaggacatggtt

SEQ ID NO: 266479 - DNA, 25 bp, Rattus norvegicus
ctcccttatccagaaggacatggtt

SEQ ID NO: 266480 - DNA, 25 bp, Rattus norvegicus
ctcccttcacgtccatggttaatca

SEQ ID NO: 266481 - DNA, 25 bp, Rattus norvegicus
ctcccttcacgtgcatggttaatca

SEQ ID NO: 266482 - DNA, 25 bp, Rattus norvegicus
ctcccttcatgtcttttgctgtaga

SEQ ID NO: 266483 - DNA, 25 bp, Rattus norvegicus
ctcccttcatgtgttttgctgtaga

SEQ ID NO: 266484 - DNA, 25 bp, Rattus norvegicus
ctcccttccacaaggattgaaaaca

SEQ ID NO: 266485 - DNA, 25 bp, Rattus norvegicus
ctcccttccacatggattgaaaaca

SEQ ID NO: 266486 - DNA, 25 bp, Rattus norvegicus
ctcccttccttgaacctgatgaaaa

SEQ ID NO: 266487 - DNA, 25 bp, Rattus norvegicus
ctcccttccttgtacctgatgaaaa

SEQ ID NO: 266488 - DNA, 25 bp, Rattus norvegicus
ctcccttcgtaaacctagaagcttt

SEQ ID NO: 266489 - DNA, 25 bp, Rattus norvegicus
ctcccttcgtaatcctagaagcttt

SEQ ID NO: 266490 - DNA, 25 bp, Rattus norvegicus
ctcccttcgttgatccaagtgtaca

SEQ ID NO: 266491 - DNA, 25 bp, Rattus norvegicus
ctcccttcgttgttccaagtgtaca

SEQ ID NO: 266492 - DNA, 25 bp, Rattus norvegicus
ctcccttctgttagtgctcttgtaa

SEQ ID NO: 266493 - DNA, 25 bp, Rattus norvegicus
ctcccttctgtttgtgctcttgtaa

SEQ ID NO: 266494 - DNA, 25 bp, Rattus norvegicus
ctcccttcttgaatgaggatgtcat

SEQ ID NO: 266495 - DNA, 25 bp, Rattus norvegicus
ctcccttcttgattgaggatgtcat

SEQ ID NO: 266496 - DNA, 25 bp, Rattus norvegicus
ctcccttgcgctcagaggaagaatt

SEQ ID NO: 266497 - DNA, 25 bp, Rattus norvegicus
ctcccttgcgctgagaggaagaatt

SEQ ID NO: 266498 - DNA, 25 bp, Rattus norvegicus
ctcccttgctcccaggagaggaaaa

SEQ ID NO: 266499 - DNA, 25 bp, Rattus norvegicus
ctcccttgctccgaggagaggaaaa

SEQ ID NO: 266500 - DNA, 25 bp, Rattus norvegicus
ctcccttggaccagtacatctaaat

SEQ ID NO: 266501 - DNA, 25 bp, Rattus norvegicus
ctcccttggacctgtacatctaaat

SEQ ID NO: 266502 - DNA, 25 bp, Rattus norvegicus
ctcccttggactatgagtggaatct

SEQ ID NO: 266503 - DNA, 25 bp, Rattus norvegicus
ctcccttggactttgagtggaatct

SEQ ID NO: 266504 - DNA, 25 bp, Rattus norvegicus
ctcccttggcaaacacagaacactg

SEQ ID NO: 266505 - DNA, 25 bp, Rattus norvegicus
ctcccttggcaatcacagaacactg

SEQ ID NO: 266506 - DNA, 25 bp, Rattus norvegicus
ctcccttgtggtatcctatttatgt

SEQ ID NO: 266507 - DNA, 25 bp, Rattus norvegicus
ctcccttgtggtttcctatttatgt

SEQ ID NO: 266508 - DNA, 25 bp, Rattus norvegicus
ctcccttgtgtgatcacttctatta

SEQ ID NO: 266509 - DNA, 25 bp, Rattus norvegicus
ctcccttgtgtgttcacttctatta

SEQ ID NO: 266510 - DNA, 25 bp, Rattus norvegicus
ctcccttgttctagtggaatccacc

SEQ ID NO: 266511 - DNA, 25 bp, Rattus norvegicus
ctcccttgttcttgtggaatccacc

SEQ ID NO: 266512 - DNA, 25 bp, Rattus norvegicus
ctccctttacctactacatgttaag

SEQ ID NO: 266513 - DNA, 25 bp, Rattus norvegicus
ctccctttaccttctacatgttaag

SEQ ID NO: 266514 - DNA, 25 bp, Rattus norvegicus
ctccctttcaatatactgcttgctg

SEQ ID NO: 266515 - DNA, 25 bp, Rattus norvegicus
ctccctttcaatttactgcttgctg

SEQ ID NO: 266516 - DNA, 25 bp, Rattus norvegicus
ctccctttcctgatcaagatcattt

SEQ ID NO: 266517 - DNA, 25 bp, Rattus norvegicus
ctccctttcctgttcaagatcattt

SEQ ID NO: 266518 - DNA, 25 bp, Rattus norvegicus
ctccctttctctaaagtgtgttaat

SEQ ID NO: 266519 - DNA, 25 bp, Rattus norvegicus
ctccctttctcttaagtgtgttaat

SEQ ID NO: 266520 - DNA, 25 bp, Rattus norvegicus
ctccctttgactctcagactatgga

SEQ ID NO: 266521 - DNA, 25 bp, Rattus norvegicus
ctccctttgactgtcagactatgga

SEQ ID NO: 266522 - DNA, 25 bp, Rattus norvegicus
ctccctttgcttaactgaaggccac

SEQ ID NO: 266523 - DNA, 25 bp, Rattus norvegicus
ctccctttgctttactgaaggccac

SEQ ID NO: 266524 - DNA, 25 bp, Rattus norvegicus
ctccctttggagagacgcattttgt

SEQ ID NO: 266525 - DNA, 25 bp, Rattus norvegicus
ctccctttggagtgacgcattttgt

SEQ ID NO: 266526 - DNA, 25 bp, Rattus norvegicus
ctccctttggctacatagcagtgta

SEQ ID NO: 266527 - DNA, 25 bp, Rattus norvegicus
ctccctttggcttcatagcagtgta

SEQ ID NO: 266528 - DNA, 25 bp, Rattus norvegicus
ctccctttgtgacgccccagagtat

SEQ ID NO: 266529 - DNA, 25 bp, Rattus norvegicus
ctccctttgtgaggccccagagtat

SEQ ID NO: 266530 - DNA, 25 bp, Rattus norvegicus
ctcccttttgctattactctatttg

SEQ ID NO: 266531 - DNA, 25 bp, Rattus norvegicus
ctcccttttgcttttactctatttg

SEQ ID NO: 266532 - DNA, 25 bp, Rattus norvegicus
ctcccttttgtgcttgacattgttt

SEQ ID NO: 266533 - DNA, 25 bp, Rattus norvegicus
ctcccttttgtggttgacattgttt

SEQ ID NO: 266534 - DNA, 25 bp, Rattus norvegicus
ctcccttttttaagtggtcatttgt

SEQ ID NO: 266535 - DNA, 25 bp, Rattus norvegicus
ctcccttttttatgtggtcatttgt

SEQ ID NO: 266536 - DNA, 25 bp, Rattus norvegicus
ctccgaaagggcagctactctgagc

SEQ ID NO: 266537 - DNA, 25 bp, Rattus norvegicus
ctccgaaagggctgctactctgagc

SEQ ID NO: 266538 - DNA, 25 bp, Rattus norvegicus
ctccgaacgcggctcgaatggcaag

SEQ ID NO: 266539 - DNA, 25 bp, Rattus norvegicus
ctccgaacgcgggtcgaatggcaag

SEQ ID NO: 266540 - DNA, 25 bp, Rattus norvegicus
ctccgaccgaggcaggacgagcgag

SEQ ID NO: 266541 - DNA, 25 bp, Rattus norvegicus
ctccgaccgagggaggacgagcgag

SEQ ID NO: 266542 - DNA, 25 bp, Rattus norvegicus
ctccgacctggtaagattttgctac

SEQ ID NO: 266543 - DNA, 25 bp, Rattus norvegicus
ctccgacctggttagattttgctac

SEQ ID NO: 266544 - DNA, 25 bp, Rattus norvegicus
ctccgactcaccagaacgattaaac

SEQ ID NO: 266545 - DNA, 25 bp, Rattus norvegicus
ctccgactcacctgaacgattaaac

SEQ ID NO: 266546 - DNA, 25 bp, Rattus norvegicus
ctccgacttttcagtgttggtttca

SEQ ID NO: 266547 - DNA, 25 bp, Rattus norvegicus
ctccgacttttctgtgttggtttca

SEQ ID NO: 266548 - DNA, 25 bp, Rattus norvegicus
ctccgagagtagctatgaaccagat

SEQ ID NO: 266549 - DNA, 25 bp, Rattus norvegicus
ctccgagagtaggtatgaaccagat

SEQ ID NO: 266550 - DNA, 25 bp, Rattus norvegicus
ctccgagagtggcatctgcagactt

SEQ ID NO: 266551 - DNA, 25 bp, Rattus norvegicus
ctccgagagtgggatctgcagactt

SEQ ID NO: 266552 - DNA, 25 bp, Rattus norvegicus
ctccgagcctctactttgaatttgt

SEQ ID NO: 266553 - DNA, 25 bp, Rattus norvegicus
ctccgagcctcttctttgaatttgt

SEQ ID NO: 266554 - DNA, 25 bp, Rattus norvegicus
ctccgaggtggaactgtgggcatac

SEQ ID NO: 266555 - DNA, 25 bp, Rattus norvegicus
ctccgaggtggatctgtgggcatac

SEQ ID NO: 266556 - DNA, 25 bp, Rattus norvegicus
ctccgagtcccacttaaaaactgct

SEQ ID NO: 266557 - DNA, 25 bp, Rattus norvegicus
ctccgagtcccagttaaaaactgct

SEQ ID NO: 266558 - DNA, 25 bp, Rattus norvegicus
ctccgagtccttctggatgtagcca

SEQ ID NO: 266559 - DNA, 25 bp, Rattus norvegicus
ctccgagtccttgtggatgtagcca

SEQ ID NO: 266560 - DNA, 25 bp, Rattus norvegicus
ctccgagtctaaacctcactttgag

SEQ ID NO: 266561 - DNA, 25 bp, Rattus norvegicus
ctccgagtctaatcctcactttgag

SEQ ID NO: 266562 - DNA, 25 bp, Rattus norvegicus
ctccgagttcctccaacaggagtaa

SEQ ID NO: 266563 - DNA, 25 bp, Rattus norvegicus
ctccgagttcctgcaacaggagtaa

SEQ ID NO: 266564 - DNA, 25 bp, Rattus norvegicus
ctccgatcgggtaactggtgttagg

SEQ ID NO: 266565 - DNA, 25 bp, Rattus norvegicus
ctccgatcgggttactggtgttagg

SEQ ID NO: 266566 - DNA, 25 bp, Rattus norvegicus
ctccgatcttaaacctactcagtga

SEQ ID NO: 266567 - DNA, 25 bp, Rattus norvegicus
ctccgatcttaatcctactcagtga

SEQ ID NO: 266568 - DNA, 25 bp, Rattus norvegicus
ctccgcaacttgagttccacagatg

SEQ ID NO: 266569 - DNA, 25 bp, Rattus norvegicus
ctccgcaacttgtgttccacagatg

SEQ ID NO: 266570 - DNA, 25 bp, Rattus norvegicus
ctccgcaataatacaccagaccaga

SEQ ID NO: 266571 - DNA, 25 bp, Rattus norvegicus
ctccgcaataattcaccagaccaga

SEQ ID NO: 266572 - DNA, 25 bp, Rattus norvegicus
ctccgcacagttatccacatgtaaa

SEQ ID NO: 266573 - DNA, 25 bp, Rattus norvegicus
ctccgcacagttttccacatgtaaa

SEQ ID NO: 266574 - DNA, 25 bp, Rattus norvegicus
ctccgcaccctcctttataataaat

SEQ ID NO: 266575 - DNA, 25 bp, Rattus norvegicus
ctccgcaccctcgtttataataaat

SEQ ID NO: 266576 - DNA, 25 bp, Rattus norvegicus
ctccgcactaatcctggactatttg

SEQ ID NO: 266577 - DNA, 25 bp, Rattus norvegicus
ctccgcactaatgctggactatttg

SEQ ID NO: 266578 - DNA, 25 bp, Rattus norvegicus
ctccgcactgagctgaaatgtctat

SEQ ID NO: 266579 - DNA, 25 bp, Rattus norvegicus
ctccgcactgaggtgaaatgtctat

SEQ ID NO: 266580 - DNA, 25 bp, Rattus norvegicus
ctccgcagtcacaaaccgggccggg

SEQ ID NO: 266581 - DNA, 25 bp, Rattus norvegicus
ctccgcagtcactaaccgggccggg

SEQ ID NO: 266582 - DNA, 25 bp, Rattus norvegicus
ctccgccaaggacgactcccatacc

SEQ ID NO: 266583 - DNA, 25 bp, Rattus norvegicus
ctccgccaaggaggactcccatacc

SEQ ID NO: 266584 - DNA, 25 bp, Rattus norvegicus
ctccgccacgtaatgtagtcttaga

SEQ ID NO: 266585 - DNA, 25 bp, Rattus norvegicus
ctccgccacgtattgtagtcttaga

SEQ ID NO: 266586 - DNA, 25 bp, Rattus norvegicus
ctccgccgcatgatggcggcgctaa

SEQ ID NO: 266587 - DNA, 25 bp, Rattus norvegicus
ctccgccgcatgttggcggcgctaa

SEQ ID NO: 266588 - DNA, 25 bp, Rattus norvegicus
ctccgcctttgaaggagtccacact

SEQ ID NO: 266589 - DNA, 25 bp, Rattus norvegicus
ctccgcctttgatggagtccacact

SEQ ID NO: 266590 - DNA, 25 bp, Rattus norvegicus
ctccgcggcagtacacatacaaaag

SEQ ID NO: 266591 - DNA, 25 bp, Rattus norvegicus
ctccgcggcagttcacatacaaaag

SEQ ID NO: 266592 - DNA, 25 bp, Rattus norvegicus
ctccgcggcggtcaagcaagcagta

SEQ ID NO: 266593 - DNA, 25 bp, Rattus norvegicus
ctccgcggcggtgaagcaagcagta

SEQ ID NO: 266594 - DNA, 25 bp, Rattus norvegicus
ctccgcgtgcctctcattaagatgg

SEQ ID NO: 266595 - DNA, 25 bp, Rattus norvegicus
ctccgcgtgcctgtcattaagatgg

SEQ ID NO: 266596 - DNA, 25 bp, Rattus norvegicus
ctccgctaattcatgaaccgtactg

SEQ ID NO: 266597 - DNA, 25 bp, Rattus norvegicus
ctccgctaattcttgaaccgtactg

SEQ ID NO: 266598 - DNA, 25 bp, Rattus norvegicus
ctccgctcatggctgcatttagaaa

SEQ ID NO: 266599 - DNA, 25 bp, Rattus norvegicus
ctccgctcatgggtgcatttagaaa

SEQ ID NO: 266600 - DNA, 25 bp, Rattus norvegicus
ctccgctgagcaacttttacttatg

SEQ ID NO: 266601 - DNA, 25 bp, Rattus norvegicus
ctccgctgagcatcttttacttatg

SEQ ID NO: 266602 - DNA, 25 bp, Rattus norvegicus
ctccgctgctagagacgccataggc

SEQ ID NO: 266603 - DNA, 25 bp, Rattus norvegicus
ctccgctgctagtgacgccataggc

SEQ ID NO: 266604 - DNA, 25 bp, Rattus norvegicus
ctccgcttccatcgcgaaatattgg

SEQ ID NO: 266605 - DNA, 25 bp, Rattus norvegicus
ctccgcttccatggcgaaatattgg

SEQ ID NO: 266606 - DNA, 25 bp, Rattus norvegicus
ctccgcttgggcaatacttcaaatt

SEQ ID NO: 266607 - DNA, 25 bp, Rattus norvegicus
ctccgcttgggctatacttcaaatt

SEQ ID NO: 266608 - DNA, 25 bp, Rattus norvegicus
ctccggaagtccattgcagaaactt

SEQ ID NO: 266609 - DNA, 25 bp, Rattus norvegicus
ctccggaagtcctttgcagaaactt

SEQ ID NO: 266610 - DNA, 25 bp, Rattus norvegicus
ctccggactggtcaaggctggcttt

SEQ ID NO: 266611 - DNA, 25 bp, Rattus norvegicus
ctccggactggtgaaggctggcttt

SEQ ID NO: 266612 - DNA, 25 bp, Rattus norvegicus
ctccggagagacagctgctgattta

SEQ ID NO: 266613 - DNA, 25 bp, Rattus norvegicus
ctccggagagactgctgctgattta

SEQ ID NO: 266614 - DNA, 25 bp, Rattus norvegicus
ctccggagccctcgaagccgtaggt

SEQ ID NO: 266615 - DNA, 25 bp, Rattus norvegicus
ctccggagccctggaagccgtaggt

SEQ ID NO: 266616 - DNA, 25 bp, Rattus norvegicus
ctccggaggctcagcgaggccctgt

SEQ ID NO: 266617 - DNA, 25 bp, Rattus norvegicus
ctccggaggctctgcgaggccctgt

SEQ ID NO: 266618 - DNA, 25 bp, Rattus norvegicus
ctccggatgtttattgattgcctgt

SEQ ID NO: 266619 - DNA, 25 bp, Rattus norvegicus
ctccggatgttttttgattgcctgt

SEQ ID NO: 266620 - DNA, 25 bp, Rattus norvegicus
ctccggcacgtgacaaactctatga

SEQ ID NO: 266621 - DNA, 25 bp, Rattus norvegicus
ctccggcacgtgtcaaactctatga

SEQ ID NO: 266622 - DNA, 25 bp, Rattus norvegicus
ctccggcagctgacattggctagga

SEQ ID NO: 266623 - DNA, 25 bp, Rattus norvegicus
ctccggcagctgtcattggctagga

SEQ ID NO: 266624 - DNA, 25 bp, Rattus norvegicus
ctccggcccttgaaattattgttgt

SEQ ID NO: 266625 - DNA, 25 bp, Rattus norvegicus
ctccggcccttgtaattattgttgt

SEQ ID NO: 266626 - DNA, 25 bp, Rattus norvegicus
ctccggcgtgctacaatgtattcat

SEQ ID NO: 266627 - DNA, 25 bp, Rattus norvegicus
ctccggcgtgcttcaatgtattcat

SEQ ID NO: 266628 - DNA, 25 bp, Rattus norvegicus
ctccggctgcctcgttagaattatc

SEQ ID NO: 266629 - DNA, 25 bp, Rattus norvegicus
ctccggctgcctggttagaattatc

SEQ ID NO: 266630 - DNA, 25 bp, Rattus norvegicus
ctccggctttgccatggtggccatg

SEQ ID NO: 266631 - DNA, 25 bp, Rattus norvegicus
ctccggctttgcgatggtggccatg

SEQ ID NO: 266632 - DNA, 25 bp, Rattus norvegicus
ctccgggcagtaacttgagctgggt

SEQ ID NO: 266633 - DNA, 25 bp, Rattus norvegicus
ctccgggcagtatcttgagctgggt

SEQ ID NO: 266634 - DNA, 25 bp, Rattus norvegicus
ctccgggcccgaccacatgtgggaa

SEQ ID NO: 266635 - DNA, 25 bp, Rattus norvegicus
ctccgggcccgagcacatgtgggaa

SEQ ID NO: 266636 - DNA, 25 bp, Rattus norvegicus
ctccgggctggactgtgaaacctag

SEQ ID NO: 266637 - DNA, 25 bp, Rattus norvegicus
ctccgggctggagtgtgaaacctag

SEQ ID NO: 266638 - DNA, 25 bp, Rattus norvegicus
ctccgggtcagacagtgaaccagaa

SEQ ID NO: 266639 - DNA, 25 bp, Rattus norvegicus
ctccgggtcagagagtgaaccagaa

SEQ ID NO: 266640 - DNA, 25 bp, Rattus norvegicus
ctccgggtcagtccctgttgtttct

SEQ ID NO: 266641 - DNA, 25 bp, Rattus norvegicus
ctccgggtcagtgcctgttgtttct

SEQ ID NO: 266642 - DNA, 25 bp, Rattus norvegicus
ctccgggttacaagcagaagtcaga

SEQ ID NO: 266643 - DNA, 25 bp, Rattus norvegicus
ctccgggttacatgcagaagtcaga

SEQ ID NO: 266644 - DNA, 25 bp, Rattus norvegicus
ctccgggttccacaagagtcaggtg

SEQ ID NO: 266645 - DNA, 25 bp, Rattus norvegicus
ctccgggttccagaagagtcaggtg

SEQ ID NO: 266646 - DNA, 25 bp, Rattus norvegicus
ctccgggttgggagcagtgtgattc

SEQ ID NO: 266647 - DNA, 25 bp, Rattus norvegicus
ctccgggttgggtgcagtgtgattc

SEQ ID NO: 266648 - DNA, 25 bp, Rattus norvegicus
ctccggtgacctagaacttgcagaa

SEQ ID NO: 266649 - DNA, 25 bp, Rattus norvegicus
ctccggtgaccttgaacttgcagaa

SEQ ID NO: 266650 - DNA, 25 bp, Rattus norvegicus
ctccggtgagagagtctagcttcat

SEQ ID NO: 266651 - DNA, 25 bp, Rattus norvegicus
ctccggtgagagtgtctagcttcat

SEQ ID NO: 266652 - DNA, 25 bp, Rattus norvegicus
ctccggtgcccaccgagtttgatgt

SEQ ID NO: 266653 - DNA, 25 bp, Rattus norvegicus
ctccggtgcccagcgagtttgatgt

SEQ ID NO: 266654 - DNA, 25 bp, Rattus norvegicus
ctccggttccatatttagtcaccat

SEQ ID NO: 266655 - DNA, 25 bp, Rattus norvegicus
ctccggttccatttttagtcaccat

SEQ ID NO: 266656 - DNA, 25 bp, Rattus norvegicus
ctccggttgtgcagtgtgctgtaca

SEQ ID NO: 266657 - DNA, 25 bp, Rattus norvegicus
ctccggttgtgctgtgtgctgtaca

SEQ ID NO: 266658 - DNA, 25 bp, Rattus norvegicus
ctccgtaagaagaactaaggctagc

SEQ ID NO: 266659 - DNA, 25 bp, Rattus norvegicus
ctccgtaagaagtactaaggctagc

SEQ ID NO: 266660 - DNA, 25 bp, Rattus norvegicus
ctccgtagacccctgagcagggacg

SEQ ID NO: 266661 - DNA, 25 bp, Rattus norvegicus
ctccgtagacccgtgagcagggacg

SEQ ID NO: 266662 - DNA, 25 bp, Rattus norvegicus
ctccgtatggagcttccagagcagt

SEQ ID NO: 266663 - DNA, 25 bp, Rattus norvegicus
ctccgtatggaggttccagagcagt

SEQ ID NO: 266664 - DNA, 25 bp, Rattus norvegicus
ctccgtcatcctcctagtttgtgat

SEQ ID NO: 266665 - DNA, 25 bp, Rattus norvegicus
ctccgtcatcctgctagtttgtgat

SEQ ID NO: 266666 - DNA, 25 bp, Rattus norvegicus
ctccgtcatttcagcccagtggaaa

SEQ ID NO: 266667 - DNA, 25 bp, Rattus norvegicus
ctccgtcatttctgcccagtggaaa

SEQ ID NO: 266668 - DNA, 25 bp, Rattus norvegicus
ctccgtcccctgcagaaatgatgaa

SEQ ID NO: 266669 - DNA, 25 bp, Rattus norvegicus
ctccgtcccctggagaaatgatgaa

SEQ ID NO: 266670 - DNA, 25 bp, Rattus norvegicus
ctccgtccccttattttcaagagag

SEQ ID NO: 266671 - DNA, 25 bp, Rattus norvegicus
ctccgtcccctttttttcaagagag

SEQ ID NO: 266672 - DNA, 25 bp, Rattus norvegicus
ctccgtcccttaactgtaaacaaca

SEQ ID NO: 266673 - DNA, 25 bp, Rattus norvegicus
ctccgtcccttatctgtaaacaaca

SEQ ID NO: 266674 - DNA, 25 bp, Rattus norvegicus
ctccgtctctgacgatggttcacat

SEQ ID NO: 266675 - DNA, 25 bp, Rattus norvegicus
ctccgtctctgaggatggttcacat

SEQ ID NO: 266676 - DNA, 25 bp, Rattus norvegicus
ctccgtgacccacaaatcttttggt

SEQ ID NO: 266677 - DNA, 25 bp, Rattus norvegicus
ctccgtgacccagaaatcttttggt

SEQ ID NO: 266678 - DNA, 25 bp, Rattus norvegicus
ctccgtgagataattccttgtgaaa

SEQ ID NO: 266679 - DNA, 25 bp, Rattus norvegicus
ctccgtgagatatttccttgtgaaa

SEQ ID NO: 266680 - DNA, 25 bp, Rattus norvegicus
ctccgtgatactacgccgtttatta

SEQ ID NO: 266681 - DNA, 25 bp, Rattus norvegicus
ctccgtgatacttcgccgtttatta

SEQ ID NO: 266682 - DNA, 25 bp, Rattus norvegicus
ctccgtgcccagatttgagcaggga

SEQ ID NO: 266683 - DNA, 25 bp, Rattus norvegicus
ctccgtgcccagttttgagcaggga

SEQ ID NO: 266684 - DNA, 25 bp, Rattus norvegicus
ctccgtgcttgcatggtataggtta

SEQ ID NO: 266685 - DNA, 25 bp, Rattus norvegicus
ctccgtgcttgcttggtataggtta

SEQ ID NO: 266686 - DNA, 25 bp, Rattus norvegicus
ctccgtggcaaaaggctttctgaac

SEQ ID NO: 266687 - DNA, 25 bp, Rattus norvegicus
ctccgtggcaaatggctttctgaac

SEQ ID NO: 266688 - DNA, 25 bp, Rattus norvegicus
ctccgtggctgcaccgtgtgagacg

SEQ ID NO: 266689 - DNA, 25 bp, Rattus norvegicus
ctccgtggctgctccgtgtgagacg

SEQ ID NO: 266690 - DNA, 25 bp, Rattus norvegicus
ctccgtggcttcattggctctgaac

SEQ ID NO: 266691 - DNA, 25 bp, Rattus norvegicus
ctccgtggcttctttggctctgaac

SEQ ID NO: 266692 - DNA, 25 bp, Rattus norvegicus
ctccgtgggagtatttcctacagtg

SEQ ID NO: 266693 - DNA, 25 bp, Rattus norvegicus
ctccgtgggagtttttcctacagtg

SEQ ID NO: 266694 - DNA, 25 bp, Rattus norvegicus
ctccgtggtgtgagatgtgtgattc

SEQ ID NO: 266695 - DNA, 25 bp, Rattus norvegicus
ctccgtggtgtgtgatgtgtgattc

SEQ ID NO: 266696 - DNA, 25 bp, Rattus norvegicus
ctccgtgtaacaaagcctggtggca

SEQ ID NO: 266697 - DNA, 25 bp, Rattus norvegicus
ctccgtgtaacatagcctggtggca

SEQ ID NO: 266698 - DNA, 25 bp, Rattus norvegicus
ctccgtgtaacgattcctcagatgg

SEQ ID NO: 266699 - DNA, 25 bp, Rattus norvegicus
ctccgtgtaacgtttcctcagatgg

SEQ ID NO: 266700 - DNA, 25 bp, Rattus norvegicus
ctccgtgtcaatcaagcagtgcagt

SEQ ID NO: 266701 - DNA, 25 bp, Rattus norvegicus
ctccgtgtcaatgaagcagtgcagt

SEQ ID NO: 266702 - DNA, 25 bp, Rattus norvegicus
ctccgtgtggtcagggcctggtact

SEQ ID NO: 266703 - DNA, 25 bp, Rattus norvegicus
ctccgtgtggtctgggcctggtact

SEQ ID NO: 266704 - DNA, 25 bp, Rattus norvegicus
ctccgtgttgttaaaaatgtcctgc

SEQ ID NO: 266705 - DNA, 25 bp, Rattus norvegicus
ctccgtgttgtttaaaatgtcctgc

SEQ ID NO: 266706 - DNA, 25 bp, Rattus norvegicus
ctccgttaccttctcctgacaaagt

SEQ ID NO: 266707 - DNA, 25 bp, Rattus norvegicus
ctccgttaccttgtcctgacaaagt

SEQ ID NO: 266708 - DNA, 25 bp, Rattus norvegicus
ctccgttttcatcccagttctgtaa

SEQ ID NO: 266709 - DNA, 25 bp, Rattus norvegicus
ctccgttttcatgccagttctgtaa

SEQ ID NO: 266710 - DNA, 25 bp, Rattus norvegicus
ctcctaaatcagaccacctgttttt

SEQ ID NO: 266711 - DNA, 25 bp, Rattus norvegicus
ctcctaaatcagtccacctgttttt

SEQ ID NO: 266712 - DNA, 25 bp, Rattus norvegicus
ctcctaacatttacccacagagggt

SEQ ID NO: 266713 - DNA, 25 bp, Rattus norvegicus
ctcctaacattttcccacagagggt

SEQ ID NO: 266714 - DNA, 25 bp, Rattus norvegicus
ctcctaactgatctgtgctctctac

SEQ ID NO: 266715 - DNA, 25 bp, Rattus norvegicus
ctcctaactgatgtgtgctctctac

SEQ ID NO: 266716 - DNA, 25 bp, Rattus norvegicus
ctcctaaggtcactttcagctcaaa

SEQ ID NO: 266717 - DNA, 25 bp, Rattus norvegicus
ctcctaaggtcagtttcagctcaaa

SEQ ID NO: 266718 - DNA, 25 bp, Rattus norvegicus
ctcctaagtgctcgattggaaagct

SEQ ID NO: 266719 - DNA, 25 bp, Rattus norvegicus
ctcctaagtgctggattggaaagct

SEQ ID NO: 266720 - DNA, 25 bp, Rattus norvegicus
ctcctaccagagaccagcataaaga

SEQ ID NO: 266721 - DNA, 25 bp, Rattus norvegicus
ctcctaccagagtccagcataaaga

SEQ ID NO: 266722 - DNA, 25 bp, Rattus norvegicus
ctcctacccatcacagcatacaaag

SEQ ID NO: 266723 - DNA, 25 bp, Rattus norvegicus
ctcctacccatctcagcatacaaag

SEQ ID NO: 266724 - DNA, 25 bp, Rattus norvegicus
ctcctacccttgcagaacacaatgg

SEQ ID NO: 266725 - DNA, 25 bp, Rattus norvegicus
ctcctacccttggagaacacaatgg

SEQ ID NO: 266726 - DNA, 25 bp, Rattus norvegicus
ctcctaccgtggctatgtgatgtgg

SEQ ID NO: 266727 - DNA, 25 bp, Rattus norvegicus
ctcctaccgtgggtatgtgatgtgg

SEQ ID NO: 266728 - DNA, 25 bp, Rattus norvegicus
ctcctacctcttcagatctctgaat

SEQ ID NO: 266729 - DNA, 25 bp, Rattus norvegicus
ctcctacctcttgagatctctgaat

SEQ ID NO: 266730 - DNA, 25 bp, Rattus norvegicus
ctcctacgggcaagcgggtagctga

SEQ ID NO: 266731 - DNA, 25 bp, Rattus norvegicus
ctcctacgggcatgcgggtagctga

SEQ ID NO: 266732 - DNA, 25 bp, Rattus norvegicus
ctcctactggctacctttggataaa

SEQ ID NO: 266733 - DNA, 25 bp, Rattus norvegicus
ctcctactggcttcctttggataaa

SEQ ID NO: 266734 - DNA, 25 bp, Rattus norvegicus
ctcctactgttgcaggaccacatag

SEQ ID NO: 266735 - DNA, 25 bp, Rattus norvegicus
ctcctactgttggaggaccacatag

SEQ ID NO: 266736 - DNA, 25 bp, Rattus norvegicus
ctcctagagcttagccttaacacaa

SEQ ID NO: 266737 - DNA, 25 bp, Rattus norvegicus
ctcctagagctttgccttaacacaa

SEQ ID NO: 266738 - DNA, 25 bp, Rattus norvegicus
ctcctaggagcactgaacatggtac

SEQ ID NO: 266739 - DNA, 25 bp, Rattus norvegicus
ctcctaggagcagtgaacatggtac

SEQ ID NO: 266740 - DNA, 25 bp, Rattus norvegicus
ctcctaggagccaggatcgcttgga

SEQ ID NO: 266741 - DNA, 25 bp, Rattus norvegicus
ctcctaggagcctggatcgcttgga

SEQ ID NO: 266742 - DNA, 25 bp, Rattus norvegicus
ctcctagtccccaacatgttattag

SEQ ID NO: 266743 - DNA, 25 bp, Rattus norvegicus
ctcctagtcccctacatgttattag

SEQ ID NO: 266744 - DNA, 25 bp, Rattus norvegicus
ctcctagtcgttactctgagagggt

SEQ ID NO: 266745 - DNA, 25 bp, Rattus norvegicus
ctcctagtcgtttctctgagagggt

SEQ ID NO: 266746 - DNA, 25 bp, Rattus norvegicus
ctcctataccgtatcttgagtttat

SEQ ID NO: 266747 - DNA, 25 bp, Rattus norvegicus
ctcctataccgtttcttgagtttat

SEQ ID NO: 266748 - DNA, 25 bp, Rattus norvegicus
ctcctatagacaacgcgtctttcaa

SEQ ID NO: 266749 - DNA, 25 bp, Rattus norvegicus
ctcctatagacatcgcgtctttcaa

SEQ ID NO: 266750 - DNA, 25 bp, Rattus norvegicus
ctcctatcagatcggtctcagggat

SEQ ID NO: 266751 - DNA, 25 bp, Rattus norvegicus
ctcctatcagatgggtctcagggat

SEQ ID NO: 266752 - DNA, 25 bp, Rattus norvegicus
ctcctatcctggaaagatcaccaat

SEQ ID NO: 266753 - DNA, 25 bp, Rattus norvegicus
ctcctatcctggtaagatcaccaat

SEQ ID NO: 266754 - DNA, 25 bp, Rattus norvegicus
ctcctatctctcaatccagtaagtt

SEQ ID NO: 266755 - DNA, 25 bp, Rattus norvegicus
ctcctatctctctatccagtaagtt

SEQ ID NO: 266756 - DNA, 25 bp, Rattus norvegicus
ctcctatgaaggcttgctgctgaca

SEQ ID NO: 266757 - DNA, 25 bp, Rattus norvegicus
ctcctatgaagggttgctgctgaca

SEQ ID NO: 266758 - DNA, 25 bp, Rattus norvegicus
ctcctatgaggcagctggttttgtt

SEQ ID NO: 266759 - DNA, 25 bp, Rattus norvegicus
ctcctatgaggctgctggttttgtt

SEQ ID NO: 266760 - DNA, 25 bp, Rattus norvegicus
ctcctatggagactgttgctttagt

SEQ ID NO: 266761 - DNA, 25 bp, Rattus norvegicus
ctcctatggagagtgttgctttagt

SEQ ID NO: 266762 - DNA, 25 bp, Rattus norvegicus
ctcctatggctcatgtgatttgtca

SEQ ID NO: 266763 - DNA, 25 bp, Rattus norvegicus
ctcctatggctcttgtgatttgtca

SEQ ID NO: 266764 - DNA, 25 bp, Rattus norvegicus
ctcctatgtcagctctcaaccattt

SEQ ID NO: 266765 - DNA, 25 bp, Rattus norvegicus
ctcctatgtcaggtctcaaccattt

SEQ ID NO: 266766 - DNA, 25 bp, Rattus norvegicus
ctcctatttcctcgttttgtacata

SEQ ID NO: 266767 - DNA, 25 bp, Rattus norvegicus
ctcctatttcctggttttgtacata

SEQ ID NO: 266768 - DNA, 25 bp, Rattus norvegicus
ctcctcaacaaacctttgatgccat

SEQ ID NO: 266769 - DNA, 25 bp, Rattus norvegicus
ctcctcaacaaagctttgatgccat

SEQ ID NO: 266770 - DNA, 25 bp, Rattus norvegicus
ctcctcaataacctgcttaactaca

SEQ ID NO: 266771 - DNA, 25 bp, Rattus norvegicus
ctcctcaataacgtgcttaactaca

SEQ ID NO: 266772 - DNA, 25 bp, Rattus norvegicus
ctcctcaatatcactgggtgtttgg

SEQ ID NO: 266773 - DNA, 25 bp, Rattus norvegicus
ctcctcaatatctctgggtgtttgg

SEQ ID NO: 266774 - DNA, 25 bp, Rattus norvegicus
ctcctcacagtcctccagtaagaag

SEQ ID NO: 266775 - DNA, 25 bp, Rattus norvegicus
ctcctcacagtcgtccagtaagaag

SEQ ID NO: 266776 - DNA, 25 bp, Rattus norvegicus
ctcctcacatctaggctcatgtata

SEQ ID NO: 266777 - DNA, 25 bp, Rattus norvegicus
ctcctcacatcttggctcatgtata

SEQ ID NO: 266778 - DNA, 25 bp, Rattus norvegicus
ctcctcacccggcatgaatgtgttt

SEQ ID NO: 266779 - DNA, 25 bp, Rattus norvegicus
ctcctcacccgggatgaatgtgttt

SEQ ID NO: 266780 - DNA, 25 bp, Rattus norvegicus
ctcctcacctaaaatctgttctcat

SEQ ID NO: 266781 - DNA, 25 bp, Rattus norvegicus
ctcctcacctaatatctgttctcat

SEQ ID NO: 266782 - DNA, 25 bp, Rattus norvegicus
ctcctcacggatcccactgaaaagg

SEQ ID NO: 266783 - DNA, 25 bp, Rattus norvegicus
ctcctcacggatgccactgaaaagg

SEQ ID NO: 266784 - DNA, 25 bp, Rattus norvegicus
ctcctcactactaactgtgcatgtt

SEQ ID NO: 266785 - DNA, 25 bp, Rattus norvegicus
ctcctcactacttactgtgcatgtt

SEQ ID NO: 266786 - DNA, 25 bp, Rattus norvegicus
ctcctcactgaaaaactcagcctgg

SEQ ID NO: 266787 - DNA, 25 bp, Rattus norvegicus
ctcctcactgaataactcagcctgg

SEQ ID NO: 266788 - DNA, 25 bp, Rattus norvegicus
ctcctcactgttagcaatctgtgta

SEQ ID NO: 266789 - DNA, 25 bp, Rattus norvegicus
ctcctcactgtttgcaatctgtgta

SEQ ID NO: 266790 - DNA, 25 bp, Rattus norvegicus
ctcctcacttgtaaacttgtagatt

SEQ ID NO: 266791 - DNA, 25 bp, Rattus norvegicus
ctcctcacttgttaacttgtagatt

SEQ ID NO: 266792 - DNA, 25 bp, Rattus norvegicus
ctcctcagatgccagagacttgtct

SEQ ID NO: 266793 - DNA, 25 bp, Rattus norvegicus
ctcctcagatgcgagagacttgtct

SEQ ID NO: 266794 - DNA, 25 bp, Rattus norvegicus
ctcctcaggcggagactgtgattta

SEQ ID NO: 266795 - DNA, 25 bp, Rattus norvegicus
ctcctcaggcggtgactgtgattta

SEQ ID NO: 266796 - DNA, 25 bp, Rattus norvegicus
ctcctcagtcttcaaggcctagtga

SEQ ID NO: 266797 - DNA, 25 bp, Rattus norvegicus
ctcctcagtcttgaaggcctagtga

SEQ ID NO: 266798 - DNA, 25 bp, Rattus norvegicus
ctcctcatcgtaattaagcctctga

SEQ ID NO: 266799 - DNA, 25 bp, Rattus norvegicus
ctcctcatcgtatttaagcctctga

SEQ ID NO: 266800 - DNA, 25 bp, Rattus norvegicus
ctcctcatggttacttgcttttgtc

SEQ ID NO: 266801 - DNA, 25 bp, Rattus norvegicus
ctcctcatggtttcttgcttttgtc

SEQ ID NO: 266802 - DNA, 25 bp, Rattus norvegicus
ctcctccaaaccaagctgggtatgg

SEQ ID NO: 266803 - DNA, 25 bp, Rattus norvegicus
ctcctccaaacctagctgggtatgg

SEQ ID NO: 266804 - DNA, 25 bp, Rattus norvegicus
ctcctccacagaatgttctttgact

SEQ ID NO: 266805 - DNA, 25 bp, Rattus norvegicus
ctcctccacagattgttctttgact

SEQ ID NO: 266806 - DNA, 25 bp, Rattus norvegicus
ctcctccacagtagccaagatttat

SEQ ID NO: 266807 - DNA, 25 bp, Rattus norvegicus
ctcctccacagttgccaagatttat

SEQ ID NO: 266808 - DNA, 25 bp, Rattus norvegicus
ctcctccagcctaaggatatgcctg

SEQ ID NO: 266809 - DNA, 25 bp, Rattus norvegicus
ctcctccagccttaggatatgcctg

SEQ ID NO: 266810 - DNA, 25 bp, Rattus norvegicus
ctcctccaggctatcttaagaatgt

SEQ ID NO: 266811 - DNA, 25 bp, Rattus norvegicus
ctcctccaggctttcttaagaatgt

SEQ ID NO: 266812 - DNA, 25 bp, Rattus norvegicus
ctcctccagtctccagaataactaa

SEQ ID NO: 266813 - DNA, 25 bp, Rattus norvegicus
ctcctccagtctgcagaataactaa

SEQ ID NO: 266814 - DNA, 25 bp, Rattus norvegicus
ctcctccatcctcaacaagtatgat

SEQ ID NO: 266815 - DNA, 25 bp, Rattus norvegicus
ctcctccatcctgaacaagtatgat

SEQ ID NO: 266816 - DNA, 25 bp, Rattus norvegicus
ctcctcccactgaatatttttgtag

SEQ ID NO: 266817 - DNA, 25 bp, Rattus norvegicus
ctcctcccactgtatatttttgtag

SEQ ID NO: 266818 - DNA, 25 bp, Rattus norvegicus
ctcctcccaggtacaattgcagtaa

SEQ ID NO: 266819 - DNA, 25 bp, Rattus norvegicus
ctcctcccaggttcaattgcagtaa

SEQ ID NO: 266820 - DNA, 25 bp, Rattus norvegicus
ctcctcccatgcattttgaagctta

SEQ ID NO: 266821 - DNA, 25 bp, Rattus norvegicus
ctcctcccatgctttttgaagctta

SEQ ID NO: 266822 - DNA, 25 bp, Rattus norvegicus
ctcctcccggtcctggaaaggatga

SEQ ID NO: 266823 - DNA, 25 bp, Rattus norvegicus
ctcctcccggtcgtggaaaggatga

SEQ ID NO: 266824 - DNA, 25 bp, Rattus norvegicus
ctcctcccgtttaatgtctatgtaa

SEQ ID NO: 266825 - DNA, 25 bp, Rattus norvegicus
ctcctcccgttttatgtctatgtaa

SEQ ID NO: 266826 - DNA, 25 bp, Rattus norvegicus
ctcctccctaagagcctgaaaatga

SEQ ID NO: 266827 - DNA, 25 bp, Rattus norvegicus
ctcctccctaagtgcctgaaaatga

SEQ ID NO: 266828 - DNA, 25 bp, Rattus norvegicus
ctcctccctgtcctaagagcataat

SEQ ID NO: 266829 - DNA, 25 bp, Rattus norvegicus
ctcctccctgtcgtaagagcataat

SEQ ID NO: 266830 - DNA, 25 bp, Rattus norvegicus
ctcctccgctggactgttgggaaaa

SEQ ID NO: 266831 - DNA, 25 bp, Rattus norvegicus
ctcctccgctggtctgttgggaaaa

SEQ ID NO: 266832 - DNA, 25 bp, Rattus norvegicus
ctcctccggatgaactcatggcaag

SEQ ID NO: 266833 - DNA, 25 bp, Rattus norvegicus
ctcctccggatgtactcatggcaag

SEQ ID NO: 266834 - DNA, 25 bp, Rattus norvegicus
ctcctccgggcacgcatggaagtaa

SEQ ID NO: 266835 - DNA, 25 bp, Rattus norvegicus
ctcctccgggcaggcatggaagtaa

SEQ ID NO: 266836 - DNA, 25 bp, Rattus norvegicus
ctcctcctacatagtactcattcat

SEQ ID NO: 266837 - DNA, 25 bp, Rattus norvegicus
ctcctcctacattgtactcattcat

SEQ ID NO: 266838 - DNA, 25 bp, Rattus norvegicus
ctcctcctaggcacagagtctaatt

SEQ ID NO: 266839 - DNA, 25 bp, Rattus norvegicus
ctcctcctaggctcagagtctaatt

SEQ ID NO: 266840 - DNA, 25 bp, Rattus norvegicus
ctcctcctcagtaacagtgctgaaa

SEQ ID NO: 266841 - DNA, 25 bp, Rattus norvegicus
ctcctcctcagttacagtgctgaaa

SEQ ID NO: 266842 - DNA, 25 bp, Rattus norvegicus
ctcctcctctgtattgatttttgta

SEQ ID NO: 266843 - DNA, 25 bp, Rattus norvegicus
ctcctcctctgttttgatttttgta

SEQ ID NO: 266844 - DNA, 25 bp, Rattus norvegicus
ctcctcctgcagacagaagttacag

SEQ ID NO: 266845 - DNA, 25 bp, Rattus norvegicus
ctcctcctgcagcttgtgtgtggct

SEQ ID NO: 266846 - DNA, 25 bp, Rattus norvegicus
ctcctcctgcaggttgtgtgtggct

SEQ ID NO: 266847 - DNA, 25 bp, Rattus norvegicus
ctcctcctgcagtcagaagttacag

SEQ ID NO: 266848 - DNA, 25 bp, Rattus norvegicus
ctcctcctgcatatgttaattctga

SEQ ID NO: 266849 - DNA, 25 bp, Rattus norvegicus
ctcctcctgcatttgttaattctga

SEQ ID NO: 266850 - DNA, 25 bp, Rattus norvegicus
ctcctcgacccaagatgcggtagga

SEQ ID NO: 266851 - DNA, 25 bp, Rattus norvegicus
ctcctcgacccatgatgcggtagga

SEQ ID NO: 266852 - DNA, 25 bp, Rattus norvegicus
ctcctcggtgaacagccgtactggg

SEQ ID NO: 266853 - DNA, 25 bp, Rattus norvegicus
ctcctcggtgaagagccgtactggg

SEQ ID NO: 266854 - DNA, 25 bp, Rattus norvegicus
ctcctcgttttgatactatctcatg

SEQ ID NO: 266855 - DNA, 25 bp, Rattus norvegicus
ctcctcgttttgttactatctcatg

SEQ ID NO: 266856 - DNA, 25 bp, Rattus norvegicus
ctcctctacagtcaggtgctgggaa

SEQ ID NO: 266857 - DNA, 25 bp, Rattus norvegicus
ctcctctacagtgaggtgctgggaa

SEQ ID NO: 266858 - DNA, 25 bp, Rattus norvegicus
ctcctctaccataacatcctataaa

SEQ ID NO: 266859 - DNA, 25 bp, Rattus norvegicus
ctcctctaccattacatcctataaa

SEQ ID NO: 266860 - DNA, 25 bp, Rattus norvegicus
ctcctctatagaaccacagccgggt

SEQ ID NO: 266861 - DNA, 25 bp, Rattus norvegicus
ctcctctatagatccacagccgggt

SEQ ID NO: 266862 - DNA, 25 bp, Rattus norvegicus
ctcctctcactcagaactttgtaga

SEQ ID NO: 266863 - DNA, 25 bp, Rattus norvegicus
ctcctctcactctgaactttgtaga

SEQ ID NO: 266864 - DNA, 25 bp, Rattus norvegicus
ctcctctcacttcaaggtttttcga

SEQ ID NO: 266865 - DNA, 25 bp, Rattus norvegicus
ctcctctcacttgaaggtttttcga

SEQ ID NO: 266866 - DNA, 25 bp, Rattus norvegicus
ctcctctctcacagatatacacatg

SEQ ID NO: 266867 - DNA, 25 bp, Rattus norvegicus
ctcctctctcactgatatacacatg

SEQ ID NO: 266868 - DNA, 25 bp, Rattus norvegicus
ctcctctctgaacctggtgttgaag

SEQ ID NO: 266869 - DNA, 25 bp, Rattus norvegicus
ctcctctctgaagctggtgttgaag

SEQ ID NO: 266870 - DNA, 25 bp, Rattus norvegicus
ctcctctgactacagtgtctcatgt

SEQ ID NO: 266871 - DNA, 25 bp, Rattus norvegicus
ctcctctgactagagtgtctcatgt

SEQ ID NO: 266872 - DNA, 25 bp, Rattus norvegicus
ctcctctgacttcataatccgaaac

SEQ ID NO: 266873 - DNA, 25 bp, Rattus norvegicus
ctcctctgacttgataatccgaaac

SEQ ID NO: 266874 - DNA, 25 bp, Rattus norvegicus
ctcctctggtaaactccatggcata

SEQ ID NO: 266875 - DNA, 25 bp, Rattus norvegicus
ctcctctggtaatctccatggcata

SEQ ID NO: 266876 - DNA, 25 bp, Rattus norvegicus
ctcctctggtggctcaggcaaagaa

SEQ ID NO: 266877 - DNA, 25 bp, Rattus norvegicus
ctcctctggtgggtcaggcaaagaa

SEQ ID NO: 266878 - DNA, 25 bp, Rattus norvegicus
ctcctctgtaaacattcccttaatg

SEQ ID NO: 266879 - DNA, 25 bp, Rattus norvegicus
ctcctctgtaaagattcccttaatg

SEQ ID NO: 266880 - DNA, 25 bp, Rattus norvegicus
ctcctctgtgtgactgggacaatga

SEQ ID NO: 266881 - DNA, 25 bp, Rattus norvegicus
ctcctctgtgtgtctgggacaatga

SEQ ID NO: 266882 - DNA, 25 bp, Rattus norvegicus
ctcctcttattcatttcatcttcta

SEQ ID NO: 266883 - DNA, 25 bp, Rattus norvegicus
ctcctcttattcttttcatcttcta

SEQ ID NO: 266884 - DNA, 25 bp, Rattus norvegicus
ctcctcttcaaaacatgactcctta

SEQ ID NO: 266885 - DNA, 25 bp, Rattus norvegicus
ctcctcttcaaatcatgactcctta

SEQ ID NO: 266886 - DNA, 25 bp, Rattus norvegicus
ctcctcttcagacggccggagttca

SEQ ID NO: 266887 - DNA, 25 bp, Rattus norvegicus
ctcctcttcagagggccggagttca

SEQ ID NO: 266888 - DNA, 25 bp, Rattus norvegicus
ctcctctttgtaatatacagggtga

SEQ ID NO: 266889 - DNA, 25 bp, Rattus norvegicus
ctcctctttgtattatacagggtga

SEQ ID NO: 266890 - DNA, 25 bp, Rattus norvegicus
ctcctgaagagccagctgtggacag

SEQ ID NO: 266891 - DNA, 25 bp, Rattus norvegicus
ctcctgaagagcgagctgtggacag

SEQ ID NO: 266892 - DNA, 25 bp, Rattus norvegicus
ctcctgacacatctacttatctgct

SEQ ID NO: 266893 - DNA, 25 bp, Rattus norvegicus
ctcctgacacatgtacttatctgct

SEQ ID NO: 266894 - DNA, 25 bp, Rattus norvegicus
ctcctgacacctcggattgcagatg

SEQ ID NO: 266895 - DNA, 25 bp, Rattus norvegicus
ctcctgacacctgggattgcagatg

SEQ ID NO: 266896 - DNA, 25 bp, Rattus norvegicus
ctcctgacatcaatctgctggatga

SEQ ID NO: 266897 - DNA, 25 bp, Rattus norvegicus
ctcctgacatcattctgctggatga

SEQ ID NO: 266898 - DNA, 25 bp, Rattus norvegicus
ctcctgaccacaactcattgtagag

SEQ ID NO: 266899 - DNA, 25 bp, Rattus norvegicus
ctcctgaccacatctcattgtagag

SEQ ID NO: 266900 - DNA, 25 bp, Rattus norvegicus
ctcctgacccgcagcgaggttgagg

SEQ ID NO: 266901 - DNA, 25 bp, Rattus norvegicus
ctcctgacccgctgcgaggttgagg

SEQ ID NO: 266902 - DNA, 25 bp, Rattus norvegicus
ctcctgacttttaccgcaatgttgg

SEQ ID NO: 266903 - DNA, 25 bp, Rattus norvegicus
ctcctgactttttccgcaatgttgg

SEQ ID NO: 266904 - DNA, 25 bp, Rattus norvegicus
ctcctgagacgcagtgctgtgacat

SEQ ID NO: 266905 - DNA, 25 bp, Rattus norvegicus
ctcctgagacgctgtgctgtgacat

SEQ ID NO: 266906 - DNA, 25 bp, Rattus norvegicus
ctcctgagcagccatgtcacatgag

SEQ ID NO: 266907 - DNA, 25 bp, Rattus norvegicus
ctcctgagcagcgatgtcacatgag

SEQ ID NO: 266908 - DNA, 25 bp, Rattus norvegicus
ctcctgagcctacactgtcaaaatt

SEQ ID NO: 266909 - DNA, 25 bp, Rattus norvegicus
ctcctgagcctagactgtcaaaatt

SEQ ID NO: 266910 - DNA, 25 bp, Rattus norvegicus
ctcctgagctcacctagagggtagg

SEQ ID NO: 266911 - DNA, 25 bp, Rattus norvegicus
ctcctgagctcagctagagggtagg

SEQ ID NO: 266912 - DNA, 25 bp, Rattus norvegicus
ctcctgaggaggatctggtcttgaa

SEQ ID NO: 266913 - DNA, 25 bp, Rattus norvegicus
ctcctgaggaggttctggtcttgaa

SEQ ID NO: 266914 - DNA, 25 bp, Rattus norvegicus
ctcctgagttttaggctgagtcaat

SEQ ID NO: 266915 - DNA, 25 bp, Rattus norvegicus
ctcctgagtttttggctgagtcaat

SEQ ID NO: 266916 - DNA, 25 bp, Rattus norvegicus
ctcctgatcaagagatggctgttcg

SEQ ID NO: 266917 - DNA, 25 bp, Rattus norvegicus
ctcctgatcaagtgatggctgttcg

SEQ ID NO: 266918 - DNA, 25 bp, Rattus norvegicus
ctcctgattcttcccaatgtgtttg

SEQ ID NO: 266919 - DNA, 25 bp, Rattus norvegicus
ctcctgattcttgccaatgtgtttg

SEQ ID NO: 266920 - DNA, 25 bp, Rattus norvegicus
ctcctgatttgcacagttcagcaga

SEQ ID NO: 266921 - DNA, 25 bp, Rattus norvegicus
ctcctgatttgctcagttcagcaga

SEQ ID NO: 266922 - DNA, 25 bp, Rattus norvegicus
ctcctgcaaaagctctaccagagaa

SEQ ID NO: 266923 - DNA, 25 bp, Rattus norvegicus
ctcctgcaaaaggtctaccagagaa

SEQ ID NO: 266924 - DNA, 25 bp, Rattus norvegicus
ctcctgcagagtcatgtgtgcttgg

SEQ ID NO: 266925 - DNA, 25 bp, Rattus norvegicus
ctcctgcagagtgatgtgtgcttgg

SEQ ID NO: 266926 - DNA, 25 bp, Rattus norvegicus
ctcctgcaggatccatggacactgt

SEQ ID NO: 266927 - DNA, 25 bp, Rattus norvegicus
ctcctgcaggatgcatggacactgt

SEQ ID NO: 266928 - DNA, 25 bp, Rattus norvegicus
ctcctgcagtcaccacgtaagaaat

SEQ ID NO: 266929 - DNA, 25 bp, Rattus norvegicus
ctcctgcagtcagcacgtaagaaat

SEQ ID NO: 266930 - DNA, 25 bp, Rattus norvegicus
ctcctgccaggaagactgtggactg

SEQ ID NO: 266931 - DNA, 25 bp, Rattus norvegicus
ctcctgccaggatgactgtggactg

SEQ ID NO: 266932 - DNA, 25 bp, Rattus norvegicus
ctcctgccagtcatcttaattggaa

SEQ ID NO: 266933 - DNA, 25 bp, Rattus norvegicus
ctcctgccagtcttcttaattggaa

SEQ ID NO: 266934 - DNA, 25 bp, Rattus norvegicus
ctcctgcccatacaaggttcctgaa

SEQ ID NO: 266935 - DNA, 25 bp, Rattus norvegicus
ctcctgcccatagaaggttcctgaa

SEQ ID NO: 266936 - DNA, 25 bp, Rattus norvegicus
ctcctgccctctagggaggtaatat

SEQ ID NO: 266937 - DNA, 25 bp, Rattus norvegicus
ctcctgccctcttgggaggtaatat

SEQ ID NO: 266938 - DNA, 25 bp, Rattus norvegicus
ctcctgcctctacatattcatagtt

SEQ ID NO: 266939 - DNA, 25 bp, Rattus norvegicus
ctcctgcctctagatattcatagtt

SEQ ID NO: 266940 - DNA, 25 bp, Rattus norvegicus
ctcctgcctctcaatttatttattt

SEQ ID NO: 266941 - DNA, 25 bp, Rattus norvegicus
ctcctgcctctctatttatttattt

SEQ ID NO: 266942 - DNA, 25 bp, Rattus norvegicus
ctcctgcctctgcattttaggtgtt

SEQ ID NO: 266943 - DNA, 25 bp, Rattus norvegicus
ctcctgcctctggattttaggtgtt

SEQ ID NO: 266944 - DNA, 25 bp, Rattus norvegicus
ctcctgccttgaattctacatgtta

SEQ ID NO: 266945 - DNA, 25 bp, Rattus norvegicus
ctcctgccttgatttctacatgtta

SEQ ID NO: 266946 - DNA, 25 bp, Rattus norvegicus
ctcctgccttggatttgtggtggaa

SEQ ID NO: 266947 - DNA, 25 bp, Rattus norvegicus
ctcctgccttggttttgtggtggaa

SEQ ID NO: 266948 - DNA, 25 bp, Rattus norvegicus
ctcctgctacccactgaattaattt

SEQ ID NO: 266949 - DNA, 25 bp, Rattus norvegicus
ctcctgctaccctctgaattaattt

SEQ ID NO: 266950 - DNA, 25 bp, Rattus norvegicus
ctcctgctagcaactgaaacacaat

SEQ ID NO: 266951 - DNA, 25 bp, Rattus norvegicus
ctcctgctagcatctgaaacacaat

SEQ ID NO: 266952 - DNA, 25 bp, Rattus norvegicus
ctcctgctagtcagaatgtgcattt

SEQ ID NO: 266953 - DNA, 25 bp, Rattus norvegicus
ctcctgctagtctgaatgtgcattt

SEQ ID NO: 266954 - DNA, 25 bp, Rattus norvegicus
ctcctgctccagaaacagttacaga

SEQ ID NO: 266955 - DNA, 25 bp, Rattus norvegicus
ctcctgctccagtaacagttacaga

SEQ ID NO: 266956 - DNA, 25 bp, Rattus norvegicus
ctcctgctcctactttctaaatgat

SEQ ID NO: 266957 - DNA, 25 bp, Rattus norvegicus
ctcctgctcctagtttctaaatgat

SEQ ID NO: 266958 - DNA, 25 bp, Rattus norvegicus
ctcctgctgcctccgtgagagaaag

SEQ ID NO: 266959 - DNA, 25 bp, Rattus norvegicus
ctcctgctgcctgcgtgagagaaag

SEQ ID NO: 266960 - DNA, 25 bp, Rattus norvegicus
ctcctgctgggaatcgatgtcgaac

SEQ ID NO: 266961 - DNA, 25 bp, Rattus norvegicus
ctcctgctgggattcgatgtcgaac

SEQ ID NO: 266962 - DNA, 25 bp, Rattus norvegicus
ctcctgctgtctctgaggagactct

SEQ ID NO: 266963 - DNA, 25 bp, Rattus norvegicus
ctcctgctgtctgtgaggagactct

SEQ ID NO: 266964 - DNA, 25 bp, Rattus norvegicus
ctcctgctgtgtctgttctaaggaa

SEQ ID NO: 266965 - DNA, 25 bp, Rattus norvegicus
ctcctgctgtgtgtgttctaaggaa

SEQ ID NO: 266966 - DNA, 25 bp, Rattus norvegicus
ctcctgcttcaccatatgctgaaaa

SEQ ID NO: 266967 - DNA, 25 bp, Rattus norvegicus
ctcctgcttcacgatatgctgaaaa

SEQ ID NO: 266968 - DNA, 25 bp, Rattus norvegicus
ctcctgcttttgcattggcgcaaga

SEQ ID NO: 266969 - DNA, 25 bp, Rattus norvegicus
ctcctgcttttggattggcgcaaga

SEQ ID NO: 266970 - DNA, 25 bp, Rattus norvegicus
ctcctggagctgaagctggaacaga

SEQ ID NO: 266971 - DNA, 25 bp, Rattus norvegicus
ctcctggagctgtagctggaacaga

SEQ ID NO: 266972 - DNA, 25 bp, Rattus norvegicus
ctcctggagtgaaacggcgtctgca

SEQ ID NO: 266973 - DNA, 25 bp, Rattus norvegicus
ctcctggagtgatacggcgtctgca

SEQ ID NO: 266974 - DNA, 25 bp, Rattus norvegicus
ctcctggattggctttggctttgtt

SEQ ID NO: 266975 - DNA, 25 bp, Rattus norvegicus
ctcctggattgggtttggctttgtt

SEQ ID NO: 266976 - DNA, 25 bp, Rattus norvegicus
ctcctggcactgcattcctgctggg

SEQ ID NO: 266977 - DNA, 25 bp, Rattus norvegicus
ctcctggcactggattcctgctggg

SEQ ID NO: 266978 - DNA, 25 bp, Rattus norvegicus
ctcctggccagtctgggttatgtat

SEQ ID NO: 266979 - DNA, 25 bp, Rattus norvegicus
ctcctggccagtgtgggttatgtat

SEQ ID NO: 266980 - DNA, 25 bp, Rattus norvegicus
ctcctggcctacatcttggataaag

SEQ ID NO: 266981 - DNA, 25 bp, Rattus norvegicus
ctcctggcctacttcttggataaag

SEQ ID NO: 266982 - DNA, 25 bp, Rattus norvegicus
ctcctggcctcacattgtgttagat

SEQ ID NO: 266983 - DNA, 25 bp, Rattus norvegicus
ctcctggcctcagattgtgttagat

SEQ ID NO: 266984 - DNA, 25 bp, Rattus norvegicus
ctcctggcgatgcttttgacattat

SEQ ID NO: 266985 - DNA, 25 bp, Rattus norvegicus
ctcctggcgatggttttgacattat

SEQ ID NO: 266986 - DNA, 25 bp, Rattus norvegicus
ctcctggctcttaccacataaaata

SEQ ID NO: 266987 - DNA, 25 bp, Rattus norvegicus
ctcctggctctttccacataaaata

SEQ ID NO: 266988 - DNA, 25 bp, Rattus norvegicus
ctcctggctgatcagctgacggttt

SEQ ID NO: 266989 - DNA, 25 bp, Rattus norvegicus
ctcctggctgatgagctgacggttt

SEQ ID NO: 266990 - DNA, 25 bp, Rattus norvegicus
ctcctggctgttatgttcttctgaa

SEQ ID NO: 266991 - DNA, 25 bp, Rattus norvegicus
ctcctggctgttttgttcttctgaa

SEQ ID NO: 266992 - DNA, 25 bp, Rattus norvegicus
ctcctggctttcagaggcttttgaa

SEQ ID NO: 266993 - DNA, 25 bp, Rattus norvegicus
ctcctggctttctgaggcttttgaa

SEQ ID NO: 266994 - DNA, 25 bp, Rattus norvegicus
ctcctgggaacacctccacctcggg

SEQ ID NO: 266995 - DNA, 25 bp, Rattus norvegicus
ctcctgggaacagctccacctcggg

SEQ ID NO: 266996 - DNA, 25 bp, Rattus norvegicus
ctcctgggaatgacggtctgggcaa

SEQ ID NO: 266997 - DNA, 25 bp, Rattus norvegicus
ctcctgggaatgtcggtctgggcaa

SEQ ID NO: 266998 - DNA, 25 bp, Rattus norvegicus
ctcctgggaattcgtaagcatcatg

SEQ ID NO: 266999 - DNA, 25 bp, Rattus norvegicus
ctcctgggaattggtaagcatcatg

SEQ ID NO: 267000 - DNA, 25 bp, Rattus norvegicus
ctcctgggacctctgtgaatattta

SEQ ID NO: 267001 - DNA, 25 bp, Rattus norvegicus
ctcctgggacctgtgtgaatattta

SEQ ID NO: 267002 - DNA, 25 bp, Rattus norvegicus
ctcctgggatgtcaaatagctggca

SEQ ID NO: 267003 - DNA, 25 bp, Rattus norvegicus
ctcctgggatgtgaaatagctggca

SEQ ID NO: 267004 - DNA, 25 bp, Rattus norvegicus
ctcctgggcactcttcagcagaaag

SEQ ID NO: 267005 - DNA, 25 bp, Rattus norvegicus
ctcctgggcactgttcagcagaaag

SEQ ID NO: 267006 - DNA, 25 bp, Rattus norvegicus
ctcctgggcagcaggcattcaggaa

SEQ ID NO: 267007 - DNA, 25 bp, Rattus norvegicus
ctcctgggcagctggcattcaggaa

SEQ ID NO: 267008 - DNA, 25 bp, Rattus norvegicus
ctcctgggtcagctcagaaggttct

SEQ ID NO: 267009 - DNA, 25 bp, Rattus norvegicus
ctcctgggtcagcttattctaataa

SEQ ID NO: 267010 - DNA, 25 bp, Rattus norvegicus
ctcctgggtcaggtcagaaggttct

SEQ ID NO: 267011 - DNA, 25 bp, Rattus norvegicus
ctcctgggtcaggttattctaataa

SEQ ID NO: 267012 - DNA, 25 bp, Rattus norvegicus
ctcctgggttttatggcctgtgtat

SEQ ID NO: 267013 - DNA, 25 bp, Rattus norvegicus
ctcctgggttttttggcctgtgtat

SEQ ID NO: 267014 - DNA, 25 bp, Rattus norvegicus
ctcctggtcctgctgggcataaaga

SEQ ID NO: 267015 - DNA, 25 bp, Rattus norvegicus
ctcctggtcctggtgggcataaaga

SEQ ID NO: 267016 - DNA, 25 bp, Rattus norvegicus
ctcctggtgatgatattttttctct

SEQ ID NO: 267017 - DNA, 25 bp, Rattus norvegicus
ctcctggtgatgttattttttctct

SEQ ID NO: 267018 - DNA, 25 bp, Rattus norvegicus
ctcctggtgcaacagctggtcctgg

SEQ ID NO: 267019 - DNA, 25 bp, Rattus norvegicus
ctcctggtgcaagagctggtcctgg

SEQ ID NO: 267020 - DNA, 25 bp, Rattus norvegicus
ctcctggtgcttcttgactcttggg

SEQ ID NO: 267021 - DNA, 25 bp, Rattus norvegicus
ctcctggtgcttgttgactcttggg

SEQ ID NO: 267022 - DNA, 25 bp, Rattus norvegicus
ctcctggtgttgaggtctgtgtgaa

SEQ ID NO: 267023 - DNA, 25 bp, Rattus norvegicus
ctcctggtgttgtggtctgtgtgaa

SEQ ID NO: 267024 - DNA, 25 bp, Rattus norvegicus
ctcctggttaaactctggccaccgg

SEQ ID NO: 267025 - DNA, 25 bp, Rattus norvegicus
ctcctggttaaagtctggccaccgg

SEQ ID NO: 267026 - DNA, 25 bp, Rattus norvegicus
ctcctggttagtataatggttgcca

SEQ ID NO: 267027 - DNA, 25 bp, Rattus norvegicus
ctcctggttagtttaatggttgcca

SEQ ID NO: 267028 - DNA, 25 bp, Rattus norvegicus
ctcctggttttcctccatagtaaag

SEQ ID NO: 267029 - DNA, 25 bp, Rattus norvegicus
ctcctggttttcgtccatagtaaag

SEQ ID NO: 267030 - DNA, 25 bp, Rattus norvegicus
ctcctgtagccgcacatgactaatg

SEQ ID NO: 267031 - DNA, 25 bp, Rattus norvegicus
ctcctgtagccggacatgactaatg

SEQ ID NO: 267032 - DNA, 25 bp, Rattus norvegicus
ctcctgtagggtcttgcctagggaa

SEQ ID NO: 267033 - DNA, 25 bp, Rattus norvegicus
ctcctgtagggtgttgcctagggaa

SEQ ID NO: 267034 - DNA, 25 bp, Rattus norvegicus
ctcctgtagtctaggcaagcactct

SEQ ID NO: 267035 - DNA, 25 bp, Rattus norvegicus
ctcctgtagtcttggcaagcactct

SEQ ID NO: 267036 - DNA, 25 bp, Rattus norvegicus
ctcctgtatcctatctcaatgtagt

SEQ ID NO: 267037 - DNA, 25 bp, Rattus norvegicus
ctcctgtatcctttctcaatgtagt

SEQ ID NO: 267038 - DNA, 25 bp, Rattus norvegicus
ctcctgtatggacagaatttctata

SEQ ID NO: 267039 - DNA, 25 bp, Rattus norvegicus
ctcctgtatggagagaatttctata

SEQ ID NO: 267040 - DNA, 25 bp, Rattus norvegicus
ctcctgtcattacggtctcttcgga

SEQ ID NO: 267041 - DNA, 25 bp, Rattus norvegicus
ctcctgtcattagggtctcttcgga

SEQ ID NO: 267042 - DNA, 25 bp, Rattus norvegicus
ctcctgtccatgagaaggtgtggag

SEQ ID NO: 267043 - DNA, 25 bp, Rattus norvegicus
ctcctgtccatgtgaaggtgtggag

SEQ ID NO: 267044 - DNA, 25 bp, Rattus norvegicus
ctcctgtctcagagcttgtattact

SEQ ID NO: 267045 - DNA, 25 bp, Rattus norvegicus
ctcctgtctcagtgcttgtattact

SEQ ID NO: 267046 - DNA, 25 bp, Rattus norvegicus
ctcctgtctgaacacggcagcggca

SEQ ID NO: 267047 - DNA, 25 bp, Rattus norvegicus
ctcctgtctgaagacggcagcggca

SEQ ID NO: 267048 - DNA, 25 bp, Rattus norvegicus
ctcctgtctgccagctggaaaagta

SEQ ID NO: 267049 - DNA, 25 bp, Rattus norvegicus
ctcctgtctgcctgctggaaaagta

SEQ ID NO: 267050 - DNA, 25 bp, Rattus norvegicus
ctcctgtctgttcccagcttttgca

SEQ ID NO: 267051 - DNA, 25 bp, Rattus norvegicus
ctcctgtctgttgccagcttttgca

SEQ ID NO: 267052 - DNA, 25 bp, Rattus norvegicus
ctcctgtgacttagatctcggatca

SEQ ID NO: 267053 - DNA, 25 bp, Rattus norvegicus
ctcctgtgactttgatctcggatca

SEQ ID NO: 267054 - DNA, 25 bp, Rattus norvegicus
ctcctgtgcagtacaactctttatg

SEQ ID NO: 267055 - DNA, 25 bp, Rattus norvegicus
ctcctgtgcagttcaactctttatg

SEQ ID NO: 267056 - DNA, 25 bp, Rattus norvegicus
ctcctgtgcccaagaagctactgat

SEQ ID NO: 267057 - DNA, 25 bp, Rattus norvegicus
ctcctgtgcccatgaagctactgat

SEQ ID NO: 267058 - DNA, 25 bp, Rattus norvegicus
ctcctgtgtcgtccaggtggctcta

SEQ ID NO: 267059 - DNA, 25 bp, Rattus norvegicus
ctcctgtgtcgtgcaggtggctcta

SEQ ID NO: 267060 - DNA, 25 bp, Rattus norvegicus
ctcctgtgtctgagaagcctaacaa

SEQ ID NO: 267061 - DNA, 25 bp, Rattus norvegicus
ctcctgtgtctgtgaagcctaacaa

SEQ ID NO: 267062 - DNA, 25 bp, Rattus norvegicus
ctcctgttctcaagggtggaagcaa

SEQ ID NO: 267063 - DNA, 25 bp, Rattus norvegicus
ctcctgttctcatgggtggaagcaa

SEQ ID NO: 267064 - DNA, 25 bp, Rattus norvegicus
ctcctgtttctcaacactaaagggc

SEQ ID NO: 267065 - DNA, 25 bp, Rattus norvegicus
ctcctgtttctctacactaaagggc

SEQ ID NO: 267066 - DNA, 25 bp, Rattus norvegicus
ctcctgtttctgagtgaagctaacc

SEQ ID NO: 267067 - DNA, 25 bp, Rattus norvegicus
ctcctgtttctgtgtgaagctaacc

SEQ ID NO: 267068 - DNA, 25 bp, Rattus norvegicus
ctcctgtttgtgctcagaataaact

SEQ ID NO: 267069 - DNA, 25 bp, Rattus norvegicus
ctcctgtttgtggtcagaataaact

SEQ ID NO: 267070 - DNA, 25 bp, Rattus norvegicus
ctccttaacccaagaactagctgta

SEQ ID NO: 267071 - DNA, 25 bp, Rattus norvegicus
ctccttaacccatgaactagctgta

SEQ ID NO: 267072 - DNA, 25 bp, Rattus norvegicus
ctccttacggatactcagacctgga

SEQ ID NO: 267073 - DNA, 25 bp, Rattus norvegicus
ctccttacggattctcagacctgga

SEQ ID NO: 267074 - DNA, 25 bp, Rattus norvegicus
ctccttagcattacgttgtctggta

SEQ ID NO: 267075 - DNA, 25 bp, Rattus norvegicus
ctccttagcatttcgttgtctggta

SEQ ID NO: 267076 - DNA, 25 bp, Rattus norvegicus
ctccttatcaggaattcactgacca

SEQ ID NO: 267077 - DNA, 25 bp, Rattus norvegicus
ctccttatcaggtattcactgacca

SEQ ID NO: 267078 - DNA, 25 bp, Rattus norvegicus
ctccttatcctgacgtgaacacatt

SEQ ID NO: 267079 - DNA, 25 bp, Rattus norvegicus
ctccttatcctgtcgtgaacacatt

SEQ ID NO: 267080 - DNA, 25 bp, Rattus norvegicus
ctccttcacataactgtctttcttt

SEQ ID NO: 267081 - DNA, 25 bp, Rattus norvegicus
ctccttcacatatctgtctttcttt

SEQ ID NO: 267082 - DNA, 25 bp, Rattus norvegicus
ctccttcacttgattgacttcattc

SEQ ID NO: 267083 - DNA, 25 bp, Rattus norvegicus
ctccttcacttgtttgacttcattc

SEQ ID NO: 267084 - DNA, 25 bp, Rattus norvegicus
ctccttcagaaacctcttcctggaa

SEQ ID NO: 267085 - DNA, 25 bp, Rattus norvegicus
ctccttcagaaagctcttcctggaa

SEQ ID NO: 267086 - DNA, 25 bp, Rattus norvegicus
ctccttcagatgagctacttggaaa

SEQ ID NO: 267087 - DNA, 25 bp, Rattus norvegicus
ctccttcagatgtgctacttggaaa

SEQ ID NO: 267088 - DNA, 25 bp, Rattus norvegicus
ctccttcagattcatgcagctgtct

SEQ ID NO: 267089 - DNA, 25 bp, Rattus norvegicus
ctccttcagattgatgcagctgtct

SEQ ID NO: 267090 - DNA, 25 bp, Rattus norvegicus
ctccttcagcctagcagatttttaa

SEQ ID NO: 267091 - DNA, 25 bp, Rattus norvegicus
ctccttcagccttgcagatttttaa

SEQ ID NO: 267092 - DNA, 25 bp, Rattus norvegicus
ctccttcagctgctaagcatgggtt

SEQ ID NO: 267093 - DNA, 25 bp, Rattus norvegicus
ctccttcagctggtaagcatgggtt

SEQ ID NO: 267094 - DNA, 25 bp, Rattus norvegicus
ctccttcagcttcaagactgcagac

SEQ ID NO: 267095 - DNA, 25 bp, Rattus norvegicus
ctccttcagcttgaagactgcagac

SEQ ID NO: 267096 - DNA, 25 bp, Rattus norvegicus
ctccttcatttgacctcagtgtgaa

SEQ ID NO: 267097 - DNA, 25 bp, Rattus norvegicus
ctccttcatttgtcctcagtgtgaa

SEQ ID NO: 267098 - DNA, 25 bp, Rattus norvegicus
ctccttccaaataagaagaccaggt

SEQ ID NO: 267099 - DNA, 25 bp, Rattus norvegicus
ctccttccaaattagaagaccaggt

SEQ ID NO: 267100 - DNA, 25 bp, Rattus norvegicus
ctccttccagataacttacacattc

SEQ ID NO: 267101 - DNA, 25 bp, Rattus norvegicus
ctccttccagattacttacacattc

SEQ ID NO: 267102 - DNA, 25 bp, Rattus norvegicus
ctccttccatggcaccaacagagat

SEQ ID NO: 267103 - DNA, 25 bp, Rattus norvegicus
ctccttccatgggaccaacagagat

SEQ ID NO: 267104 - DNA, 25 bp, Rattus norvegicus
ctccttccctgtctggaagttgaag

SEQ ID NO: 267105 - DNA, 25 bp, Rattus norvegicus
ctccttccctgtgtggaagttgaag

SEQ ID NO: 267106 - DNA, 25 bp, Rattus norvegicus
ctccttcctatgaatacctgtgtgt

SEQ ID NO: 267107 - DNA, 25 bp, Rattus norvegicus
ctccttcctatgtatacctgtgtgt

SEQ ID NO: 267108 - DNA, 25 bp, Rattus norvegicus
ctccttcctgacattatccaacaga

SEQ ID NO: 267109 - DNA, 25 bp, Rattus norvegicus
ctccttcctgactttatccaacaga

SEQ ID NO: 267110 - DNA, 25 bp, Rattus norvegicus
ctccttccttatcctttgactcaaa

SEQ ID NO: 267111 - DNA, 25 bp, Rattus norvegicus
ctccttccttatgctttgactcaaa

SEQ ID NO: 267112 - DNA, 25 bp, Rattus norvegicus
ctccttcgcattagcaggttctgaa

SEQ ID NO: 267113 - DNA, 25 bp, Rattus norvegicus
ctccttcgcatttgcaggttctgaa

SEQ ID NO: 267114 - DNA, 25 bp, Rattus norvegicus
ctccttcgctcaatactgtttcaaa

SEQ ID NO: 267115 - DNA, 25 bp, Rattus norvegicus
ctccttcgctcattactgtttcaaa

SEQ ID NO: 267116 - DNA, 25 bp, Rattus norvegicus
ctccttcgctgtactgagtgggaaa

SEQ ID NO: 267117 - DNA, 25 bp, Rattus norvegicus
ctccttcgctgttctgagtgggaaa

SEQ ID NO: 267118 - DNA, 25 bp, Rattus norvegicus
ctccttctaccaagtacgggttggg

SEQ ID NO: 267119 - DNA, 25 bp, Rattus norvegicus
ctccttctaccatgtacgggttggg

SEQ ID NO: 267120 - DNA, 25 bp, Rattus norvegicus
ctccttctcctccaacagttttgga

SEQ ID NO: 267121 - DNA, 25 bp, Rattus norvegicus
ctccttctcctcgaacagttttgga

SEQ ID NO: 267122 - DNA, 25 bp, Rattus norvegicus
ctccttctcgagaggtccacaaatt

SEQ ID NO: 267123 - DNA, 25 bp, Rattus norvegicus
ctccttctcgagtggtccacaaatt

SEQ ID NO: 267124 - DNA, 25 bp, Rattus norvegicus
ctccttctgcctctgtgtgagcatt

SEQ ID NO: 267125 - DNA, 25 bp, Rattus norvegicus
ctccttctgcctgtgtgtgagcatt

SEQ ID NO: 267126 - DNA, 25 bp, Rattus norvegicus
ctccttctggagaatgcatggcact

SEQ ID NO: 267127 - DNA, 25 bp, Rattus norvegicus
ctccttctggagtatgcatggcact

SEQ ID NO: 267128 - DNA, 25 bp, Rattus norvegicus
ctccttctgggcaacaaatcattga

SEQ ID NO: 267129 - DNA, 25 bp, Rattus norvegicus
ctccttctgggctacaaatcattga

SEQ ID NO: 267130 - DNA, 25 bp, Rattus norvegicus
ctccttcttaccagcatacatgatg

SEQ ID NO: 267131 - DNA, 25 bp, Rattus norvegicus
ctccttcttacctgcatacatgatg

SEQ ID NO: 267132 - DNA, 25 bp, Rattus norvegicus
ctccttgaccgtcggccatatttta

SEQ ID NO: 267133 - DNA, 25 bp, Rattus norvegicus
ctccttgaccgtgggccatatttta

SEQ ID NO: 267134 - DNA, 25 bp, Rattus norvegicus
ctccttgactgaccccatgaagaag

SEQ ID NO: 267135 - DNA, 25 bp, Rattus norvegicus
ctccttgactgagcccatgaagaag

SEQ ID NO: 267136 - DNA, 25 bp, Rattus norvegicus
ctccttgcaagcaggattcacacaa

SEQ ID NO: 267137 - DNA, 25 bp, Rattus norvegicus
ctccttgcaagctggattcacacaa

SEQ ID NO: 267138 - DNA, 25 bp, Rattus norvegicus
ctccttgcagccaatgtatatgaat

SEQ ID NO: 267139 - DNA, 25 bp, Rattus norvegicus
ctccttgcagcctatgtatatgaat

SEQ ID NO: 267140 - DNA, 25 bp, Rattus norvegicus
ctccttgccacacgtttatatgttt

SEQ ID NO: 267141 - DNA, 25 bp, Rattus norvegicus
ctccttgccacaggtttatatgttt

SEQ ID NO: 267142 - DNA, 25 bp, Rattus norvegicus
ctccttgccctcagtaatgctaaga

SEQ ID NO: 267143 - DNA, 25 bp, Rattus norvegicus
ctccttgccctctgtaatgctaaga

SEQ ID NO: 267144 - DNA, 25 bp, Rattus norvegicus
ctccttgctgagatggtgtgtcgct

SEQ ID NO: 267145 - DNA, 25 bp, Rattus norvegicus
ctccttgctgagttggtgtgtcgct

SEQ ID NO: 267146 - DNA, 25 bp, Rattus norvegicus
ctccttgctgtcctttaaactgtta

SEQ ID NO: 267147 - DNA, 25 bp, Rattus norvegicus
ctccttgctgtcgtttaaactgtta

SEQ ID NO: 267148 - DNA, 25 bp, Rattus norvegicus
ctccttgcttccagttcaaatgtga

SEQ ID NO: 267149 - DNA, 25 bp, Rattus norvegicus
ctccttgcttcctgttcaaatgtga

SEQ ID NO: 267150 - DNA, 25 bp, Rattus norvegicus
ctccttgcttgaattctgggccaat

SEQ ID NO: 267151 - DNA, 25 bp, Rattus norvegicus
ctccttgcttgatttctgggccaat

SEQ ID NO: 267152 - DNA, 25 bp, Rattus norvegicus
ctccttgcttttctagtctaggttc

SEQ ID NO: 267153 - DNA, 25 bp, Rattus norvegicus
ctccttgcttttgtagtctaggttc

SEQ ID NO: 267154 - DNA, 25 bp, Rattus norvegicus
ctccttggacacatacctaaattat

SEQ ID NO: 267155 - DNA, 25 bp, Rattus norvegicus
ctccttggacacttacctaaattat

SEQ ID NO: 267156 - DNA, 25 bp, Rattus norvegicus
ctccttggaggaccagagcagcttt

SEQ ID NO: 267157 - DNA, 25 bp, Rattus norvegicus
ctccttggaggagcagagcagcttt

SEQ ID NO: 267158 - DNA, 25 bp, Rattus norvegicus
ctccttgtagcaagtccagggcgca

SEQ ID NO: 267159 - DNA, 25 bp, Rattus norvegicus
ctccttgtagcatgtccagggcgca

SEQ ID NO: 267160 - DNA, 25 bp, Rattus norvegicus
ctccttgtagttcggctagctctaa

SEQ ID NO: 267161 - DNA, 25 bp, Rattus norvegicus
ctccttgtagttgggctagctctaa

SEQ ID NO: 267162 - DNA, 25 bp, Rattus norvegicus
ctccttgtcctaagtactgctgaat

SEQ ID NO: 267163 - DNA, 25 bp, Rattus norvegicus
ctccttgtcctatgtactgctgaat

SEQ ID NO: 267164 - DNA, 25 bp, Rattus norvegicus
ctccttgtgagtcctattaaatttc

SEQ ID NO: 267165 - DNA, 25 bp, Rattus norvegicus
ctccttgtgagtgctattaaatttc

SEQ ID NO: 267166 - DNA, 25 bp, Rattus norvegicus
ctccttgtgcctctgttgatactga

SEQ ID NO: 267167 - DNA, 25 bp, Rattus norvegicus
ctccttgtgcctgtgttgatactga

SEQ ID NO: 267168 - DNA, 25 bp, Rattus norvegicus
ctccttgtgttgcttctagtgagca

SEQ ID NO: 267169 - DNA, 25 bp, Rattus norvegicus
ctccttgtgttggttctagtgagca

SEQ ID NO: 267170 - DNA, 25 bp, Rattus norvegicus
ctccttgttttcattctgcttgcag

SEQ ID NO: 267171 - DNA, 25 bp, Rattus norvegicus
ctccttgttttctttctgcttgcag

SEQ ID NO: 267172 - DNA, 25 bp, Rattus norvegicus
ctcctttagctcacaagtccaaatg

SEQ ID NO: 267173 - DNA, 25 bp, Rattus norvegicus
ctcctttagctctcaagtccaaatg

SEQ ID NO: 267174 - DNA, 25 bp, Rattus norvegicus
ctcctttatcccagtcattatgtaa

SEQ ID NO: 267175 - DNA, 25 bp, Rattus norvegicus
ctcctttatccctgtcattatgtaa

SEQ ID NO: 267176 - DNA, 25 bp, Rattus norvegicus
ctcctttcaggacgtagccttgggt

SEQ ID NO: 267177 - DNA, 25 bp, Rattus norvegicus
ctcctttcaggaggtagccttgggt

SEQ ID NO: 267178 - DNA, 25 bp, Rattus norvegicus
ctcctttcagtcatgtgagttgctg

SEQ ID NO: 267179 - DNA, 25 bp, Rattus norvegicus
ctcctttcagtcttgtgagttgctg

SEQ ID NO: 267180 - DNA, 25 bp, Rattus norvegicus
ctcctttccctactgatgcaaaaaa

SEQ ID NO: 267181 - DNA, 25 bp, Rattus norvegicus
ctcctttccctagtgatgcaaaaaa

SEQ ID NO: 267182 - DNA, 25 bp, Rattus norvegicus
ctcctttcctatcccactaaatatg

SEQ ID NO: 267183 - DNA, 25 bp, Rattus norvegicus
ctcctttcctatgccactaaatatg

SEQ ID NO: 267184 - DNA, 25 bp, Rattus norvegicus
ctcctttcggtaatttggaccgcag

SEQ ID NO: 267185 - DNA, 25 bp, Rattus norvegicus
ctcctttcggtattttggaccgcag

SEQ ID NO: 267186 - DNA, 25 bp, Rattus norvegicus
ctcctttctaccactacttaaatga

SEQ ID NO: 267187 - DNA, 25 bp, Rattus norvegicus
ctcctttctacctctacttaaatga

SEQ ID NO: 267188 - DNA, 25 bp, Rattus norvegicus
ctcctttcttgccattttatgactt

SEQ ID NO: 267189 - DNA, 25 bp, Rattus norvegicus
ctcctttcttgcgattttatgactt

SEQ ID NO: 267190 - DNA, 25 bp, Rattus norvegicus
ctcctttctttaaacatggaagcaa

SEQ ID NO: 267191 - DNA, 25 bp, Rattus norvegicus
ctcctttctttaactctagctcaga

SEQ ID NO: 267192 - DNA, 25 bp, Rattus norvegicus
ctcctttctttatacatggaagcaa

SEQ ID NO: 267193 - DNA, 25 bp, Rattus norvegicus
ctcctttctttatctctagctcaga

SEQ ID NO: 267194 - DNA, 25 bp, Rattus norvegicus
ctcctttgaacaccatccgagatgt

SEQ ID NO: 267195 - DNA, 25 bp, Rattus norvegicus
ctcctttgaacagcatccgagatgt

SEQ ID NO: 267196 - DNA, 25 bp, Rattus norvegicus
ctcctttgacagaccagtattcata

SEQ ID NO: 267197 - DNA, 25 bp, Rattus norvegicus
ctcctttgacagtccagtattcata

SEQ ID NO: 267198 - DNA, 25 bp, Rattus norvegicus
ctcctttgaggacctgagtggtccg

SEQ ID NO: 267199 - DNA, 25 bp, Rattus norvegicus
ctcctttgaggagctgagtggtccg

SEQ ID NO: 267200 - DNA, 25 bp, Rattus norvegicus
ctcctttgaggcatgtggtcagagg

SEQ ID NO: 267201 - DNA, 25 bp, Rattus norvegicus
ctcctttgaggccacttgtaaacgt

SEQ ID NO: 267202 - DNA, 25 bp, Rattus norvegicus
ctcctttgaggcgacttgtaaacgt

SEQ ID NO: 267203 - DNA, 25 bp, Rattus norvegicus
ctcctttgaggcttgtggtcagagg

SEQ ID NO: 267204 - DNA, 25 bp, Rattus norvegicus
ctcctttgcagcatgctacagggaa

SEQ ID NO: 267205 - DNA, 25 bp, Rattus norvegicus
ctcctttgcagcttgctacagggaa

SEQ ID NO: 267206 - DNA, 25 bp, Rattus norvegicus
ctcctttgctctctttcttttatat

SEQ ID NO: 267207 - DNA, 25 bp, Rattus norvegicus
ctcctttgctctgtttcttttatat

SEQ ID NO: 267208 - DNA, 25 bp, Rattus norvegicus
ctcctttgctttaatgtatcttctg

SEQ ID NO: 267209 - DNA, 25 bp, Rattus norvegicus
ctcctttgcttttatgtatcttctg

SEQ ID NO: 267210 - DNA, 25 bp, Rattus norvegicus
ctcctttggctaccaactgttcaga

SEQ ID NO: 267211 - DNA, 25 bp, Rattus norvegicus
ctcctttggctagcaactgttcaga

SEQ ID NO: 267212 - DNA, 25 bp, Rattus norvegicus
ctccttttacctctgagtcagtgta

SEQ ID NO: 267213 - DNA, 25 bp, Rattus norvegicus
ctccttttacctgtgagtcagtgta

SEQ ID NO: 267214 - DNA, 25 bp, Rattus norvegicus
ctccttttattacatccttcaaagt

SEQ ID NO: 267215 - DNA, 25 bp, Rattus norvegicus
ctccttttattagatccttcaaagt

SEQ ID NO: 267216 - DNA, 25 bp, Rattus norvegicus
ctccttttccatcacacagaagcag

SEQ ID NO: 267217 - DNA, 25 bp, Rattus norvegicus
ctccttttccatgacacagaagcag

SEQ ID NO: 267218 - DNA, 25 bp, Rattus norvegicus
ctccttttctccactgtattttgta

SEQ ID NO: 267219 - DNA, 25 bp, Rattus norvegicus
ctccttttctcctctgtattttgta

SEQ ID NO: 267220 - DNA, 25 bp, Rattus norvegicus
ctccttttcttcaagctttgcaata

SEQ ID NO: 267221 - DNA, 25 bp, Rattus norvegicus
ctccttttcttctagctttgcaata

SEQ ID NO: 267222 - DNA, 25 bp, Rattus norvegicus
ctccttttcttgattgtattcctgg

SEQ ID NO: 267223 - DNA, 25 bp, Rattus norvegicus
ctccttttcttgtttgtattcctgg

SEQ ID NO: 267224 - DNA, 25 bp, Rattus norvegicus
ctccttttgactaccatttgttcag

SEQ ID NO: 267225 - DNA, 25 bp, Rattus norvegicus
ctccttttgacttccatttgttcag

SEQ ID NO: 267226 - DNA, 25 bp, Rattus norvegicus
ctccttttgcacatgtcattcagaa

SEQ ID NO: 267227 - DNA, 25 bp, Rattus norvegicus
ctccttttgcacttgtcattcagaa

SEQ ID NO: 267228 - DNA, 25 bp, Rattus norvegicus
ctccttttgcctattctattcagaa

SEQ ID NO: 267229 - DNA, 25 bp, Rattus norvegicus
ctccttttgccttttctattcagaa

SEQ ID NO: 267230 - DNA, 25 bp, Rattus norvegicus
ctccttttgtcaacacgtgctataa

SEQ ID NO: 267231 - DNA, 25 bp, Rattus norvegicus
ctccttttgtcatcacgtgctataa

SEQ ID NO: 267232 - DNA, 25 bp, Rattus norvegicus
ctccttttgtggcagtcactttggg

SEQ ID NO: 267233 - DNA, 25 bp, Rattus norvegicus
ctccttttgtgggagtcactttggg

SEQ ID NO: 267234 - DNA, 25 bp, Rattus norvegicus
ctcctttttagcacccatgggactg

SEQ ID NO: 267235 - DNA, 25 bp, Rattus norvegicus
ctcctttttagctcccatgggactg

SEQ ID NO: 267236 - DNA, 25 bp, Rattus norvegicus
ctcctttttcccatatgttacatca

SEQ ID NO: 267237 - DNA, 25 bp, Rattus norvegicus
ctcctttttcccttatgttacatca

SEQ ID NO: 267238 - DNA, 25 bp, Rattus norvegicus
ctcgaaactaccaacgggcatgtat

SEQ ID NO: 267239 - DNA, 25 bp, Rattus norvegicus
ctcgaaactacctacgggcatgtat

SEQ ID NO: 267240 - DNA, 25 bp, Rattus norvegicus
ctcgaaccagccactattctagaag

SEQ ID NO: 267241 - DNA, 25 bp, Rattus norvegicus
ctcgaaccagcctctattctagaag

SEQ ID NO: 267242 - DNA, 25 bp, Rattus norvegicus
ctcgaacccggcacataatgtatgt

SEQ ID NO: 267243 - DNA, 25 bp, Rattus norvegicus
ctcgaacccggctcataatgtatgt

SEQ ID NO: 267244 - DNA, 25 bp, Rattus norvegicus
ctcgaactcctgactctgtgagaat

SEQ ID NO: 267245 - DNA, 25 bp, Rattus norvegicus
ctcgaactcctgtctctgtgagaat

SEQ ID NO: 267246 - DNA, 25 bp, Rattus norvegicus
ctcgaatccagaaaccagcaaggtt

SEQ ID NO: 267247 - DNA, 25 bp, Rattus norvegicus
ctcgaatccagataccagcaaggtt

SEQ ID NO: 267248 - DNA, 25 bp, Rattus norvegicus
ctcgaccaagacagaggagggcaga

SEQ ID NO: 267249 - DNA, 25 bp, Rattus norvegicus
ctcgaccaagactgaggagggcaga

SEQ ID NO: 267250 - DNA, 25 bp, Rattus norvegicus
ctcgaccacctgcacaaatgtatta

SEQ ID NO: 267251 - DNA, 25 bp, Rattus norvegicus
ctcgaccacctggacaaatgtatta

SEQ ID NO: 267252 - DNA, 25 bp, Rattus norvegicus
ctcgacctcggcaagtaaactctgt

SEQ ID NO: 267253 - DNA, 25 bp, Rattus norvegicus
ctcgacctcggctagtaaactctgt

SEQ ID NO: 267254 - DNA, 25 bp, Rattus norvegicus
ctcgacgacgggagagccttggcaa

SEQ ID NO: 267255 - DNA, 25 bp, Rattus norvegicus
ctcgacgacgggtgagccttggcaa

SEQ ID NO: 267256 - DNA, 25 bp, Rattus norvegicus
ctcgacgccttcatacactgtcaaa

SEQ ID NO: 267257 - DNA, 25 bp, Rattus norvegicus
ctcgacgccttcttacactgtcaaa

SEQ ID NO: 267258 - DNA, 25 bp, Rattus norvegicus
ctcgacgcttttaggatctgggtta

SEQ ID NO: 267259 - DNA, 25 bp, Rattus norvegicus
ctcgacgctttttggatctgggtta

SEQ ID NO: 267260 - DNA, 25 bp, Rattus norvegicus
ctcgacggacagctatggcaggcaa

SEQ ID NO: 267261 - DNA, 25 bp, Rattus norvegicus
ctcgacggacaggtatggcaggcaa

SEQ ID NO: 267262 - DNA, 25 bp, Rattus norvegicus
ctcgacgtcattcagcttcacggtg

SEQ ID NO: 267263 - DNA, 25 bp, Rattus norvegicus
ctcgacgtcattgagcttcacggtg

SEQ ID NO: 267264 - DNA, 25 bp, Rattus norvegicus
ctcgacgtgggaacagctcagactg

SEQ ID NO: 267265 - DNA, 25 bp, Rattus norvegicus
ctcgacgtgggatcagctcagactg

SEQ ID NO: 267266 - DNA, 25 bp, Rattus norvegicus
ctcgactctgagacactgatcgagc

SEQ ID NO: 267267 - DNA, 25 bp, Rattus norvegicus
ctcgactctgagtcactgatcgagc

SEQ ID NO: 267268 - DNA, 25 bp, Rattus norvegicus
ctcgactctttgatgttacgtgcaa

SEQ ID NO: 267269 - DNA, 25 bp, Rattus norvegicus
ctcgactctttgttgttacgtgcaa

SEQ ID NO: 267270 - DNA, 25 bp, Rattus norvegicus
ctcgacttctacagagcatctcaaa

SEQ ID NO: 267271 - DNA, 25 bp, Rattus norvegicus
ctcgacttctactgagcatctcaaa

SEQ ID NO: 267272 - DNA, 25 bp, Rattus norvegicus
ctcgagacctttaacgaaacatggt

SEQ ID NO: 267273 - DNA, 25 bp, Rattus norvegicus
ctcgagaccttttacgaaacatggt

SEQ ID NO: 267274 - DNA, 25 bp, Rattus norvegicus
ctcgagatgttcctccagatatctt

SEQ ID NO: 267275 - DNA, 25 bp, Rattus norvegicus
ctcgagatgttcgtccagatatctt

SEQ ID NO: 267276 - DNA, 25 bp, Rattus norvegicus
ctcgagattccgaccgaggccgaag

SEQ ID NO: 267277 - DNA, 25 bp, Rattus norvegicus
ctcgagattccgtccgaggccgaag

SEQ ID NO: 267278 - DNA, 25 bp, Rattus norvegicus
ctcgagccgtgtacgtgctgttgga

SEQ ID NO: 267279 - DNA, 25 bp, Rattus norvegicus
ctcgagccgtgttcgtgctgttgga

SEQ ID NO: 267280 - DNA, 25 bp, Rattus norvegicus
ctcgagctgggcactacctgagcgc

SEQ ID NO: 267281 - DNA, 25 bp, Rattus norvegicus
ctcgagctgggctctacctgagcgc

SEQ ID NO: 267282 - DNA, 25 bp, Rattus norvegicus
ctcgagggcggaacctgcaagttga

SEQ ID NO: 267283 - DNA, 25 bp, Rattus norvegicus
ctcgagggcggatcctgcaagttga

SEQ ID NO: 267284 - DNA, 25 bp, Rattus norvegicus
ctcgaggtatatccccaattctttc

SEQ ID NO: 267285 - DNA, 25 bp, Rattus norvegicus
ctcgaggtatatgcccaattctttc

SEQ ID NO: 267286 - DNA, 25 bp, Rattus norvegicus
ctcgagtatactcaacactgccctg

SEQ ID NO: 267287 - DNA, 25 bp, Rattus norvegicus
ctcgagtatactgaacactgccctg

SEQ ID NO: 267288 - DNA, 25 bp, Rattus norvegicus
ctcgagtcttcgattttgctgagag

SEQ ID NO: 267289 - DNA, 25 bp, Rattus norvegicus
ctcgagtcttcgtttttgctgagag

SEQ ID NO: 267290 - DNA, 25 bp, Rattus norvegicus
ctcgagtgtcctctgtattactgtt

SEQ ID NO: 267291 - DNA, 25 bp, Rattus norvegicus
ctcgagtgtcctgtgtattactgtt

SEQ ID NO: 267292 - DNA, 25 bp, Rattus norvegicus
ctcgagtgtggacgacaggttaccc

SEQ ID NO: 267293 - DNA, 25 bp, Rattus norvegicus
ctcgagtgtggaggacaggttaccc

SEQ ID NO: 267294 - DNA, 25 bp, Rattus norvegicus
ctcgatacgggaagccaaggtctgt

SEQ ID NO: 267295 - DNA, 25 bp, Rattus norvegicus
ctcgatacgggatgccaaggtctgt

SEQ ID NO: 267296 - DNA, 25 bp, Rattus norvegicus
ctcgatagtgcgccgaatgtgtctg

SEQ ID NO: 267297 - DNA, 25 bp, Rattus norvegicus
ctcgatagtgcggcgaatgtgtctg

SEQ ID NO: 267298 - DNA, 25 bp, Rattus norvegicus
ctcgatatctatcgccgggtgctca

SEQ ID NO: 267299 - DNA, 25 bp, Rattus norvegicus
ctcgatatctatggccgggtgctca

SEQ ID NO: 267300 - DNA, 25 bp, Rattus norvegicus
ctcgatcaccttaggagcacagggt

SEQ ID NO: 267301 - DNA, 25 bp, Rattus norvegicus
ctcgatcacctttggagcacagggt

SEQ ID NO: 267302 - DNA, 25 bp, Rattus norvegicus
ctcgatcattctatccctgagagaa

SEQ ID NO: 267303 - DNA, 25 bp, Rattus norvegicus
ctcgatcattctttccctgagagaa

SEQ ID NO: 267304 - DNA, 25 bp, Rattus norvegicus
ctcgatcctggaagcgcaggccggt

SEQ ID NO: 267305 - DNA, 25 bp, Rattus norvegicus
ctcgatcctggatgcgcaggccggt

SEQ ID NO: 267306 - DNA, 25 bp, Rattus norvegicus
ctcgatgcatttacgtcctgagaaa

SEQ ID NO: 267307 - DNA, 25 bp, Rattus norvegicus
ctcgatgcattttcgtcctgagaaa

SEQ ID NO: 267308 - DNA, 25 bp, Rattus norvegicus
ctcgatgcctcactgtaggagaata

SEQ ID NO: 267309 - DNA, 25 bp, Rattus norvegicus
ctcgatgcctcagtgtaggagaata

SEQ ID NO: 267310 - DNA, 25 bp, Rattus norvegicus
ctcgatgcctgcagagggacttttt

SEQ ID NO: 267311 - DNA, 25 bp, Rattus norvegicus
ctcgatgcctgctgagggacttttt

SEQ ID NO: 267312 - DNA, 25 bp, Rattus norvegicus
ctcgatgtctctatggtagccagat

SEQ ID NO: 267313 - DNA, 25 bp, Rattus norvegicus
ctcgatgtctctttggtagccagat

SEQ ID NO: 267314 - DNA, 25 bp, Rattus norvegicus
ctcgattccataatgctctctttag

SEQ ID NO: 267315 - DNA, 25 bp, Rattus norvegicus
ctcgattccatattgctctctttag

SEQ ID NO: 267316 - DNA, 25 bp, Rattus norvegicus
ctcgattgggctaggtggtgtaaac

SEQ ID NO: 267317 - DNA, 25 bp, Rattus norvegicus
ctcgattgggcttggtggtgtaaac

SEQ ID NO: 267318 - DNA, 25 bp, Rattus norvegicus
ctcgcaaagtctacattcctgatga

SEQ ID NO: 267319 - DNA, 25 bp, Rattus norvegicus
ctcgcaaagtcttcattcctgatga

SEQ ID NO: 267320 - DNA, 25 bp, Rattus norvegicus
ctcgcaatcatgaataactccagtt

SEQ ID NO: 267321 - DNA, 25 bp, Rattus norvegicus
ctcgcaatcatgtataactccagtt

SEQ ID NO: 267322 - DNA, 25 bp, Rattus norvegicus
ctcgcagcattcaggtggacggcaa

SEQ ID NO: 267323 - DNA, 25 bp, Rattus norvegicus
ctcgcagcattctggtggacggcaa

SEQ ID NO: 267324 - DNA, 25 bp, Rattus norvegicus
ctcgcaggtcctcctgttgttgcag

SEQ ID NO: 267325 - DNA, 25 bp, Rattus norvegicus
ctcgcaggtcctgctgttgttgcag

SEQ ID NO: 267326 - DNA, 25 bp, Rattus norvegicus
ctcgcagtacataaccagctgtgat

SEQ ID NO: 267327 - DNA, 25 bp, Rattus norvegicus
ctcgcagtacattaccagctgtgat

SEQ ID NO: 267328 - DNA, 25 bp, Rattus norvegicus
ctcgccacagttcctgatgaacatt

SEQ ID NO: 267329 - DNA, 25 bp, Rattus norvegicus
ctcgccacagttgctgatgaacatt

SEQ ID NO: 267330 - DNA, 25 bp, Rattus norvegicus
ctcgccacctaacccagtgtgtttt

SEQ ID NO: 267331 - DNA, 25 bp, Rattus norvegicus
ctcgccacctaagccagtgtgtttt

SEQ ID NO: 267332 - DNA, 25 bp, Rattus norvegicus
ctcgccactgttcacgatctatttg

SEQ ID NO: 267333 - DNA, 25 bp, Rattus norvegicus
ctcgccactgttgacgatctatttg

SEQ ID NO: 267334 - DNA, 25 bp, Rattus norvegicus
ctcgccagaacacttggttcactga

SEQ ID NO: 267335 - DNA, 25 bp, Rattus norvegicus
ctcgccagaacagttggttcactga

SEQ ID NO: 267336 - DNA, 25 bp, Rattus norvegicus
ctcgccatccataagtgtgatctca

SEQ ID NO: 267337 - DNA, 25 bp, Rattus norvegicus
ctcgccatccattagtgtgatctca

SEQ ID NO: 267338 - DNA, 25 bp, Rattus norvegicus
ctcgcccctgggaaggtggtagcca

SEQ ID NO: 267339 - DNA, 25 bp, Rattus norvegicus
ctcgcccctgggtaggtggtagcca

SEQ ID NO: 267340 - DNA, 25 bp, Rattus norvegicus
ctcgcccctttcagcagcctgggag

SEQ ID NO: 267341 - DNA, 25 bp, Rattus norvegicus
ctcgcccctttctgcagcctgggag

SEQ ID NO: 267342 - DNA, 25 bp, Rattus norvegicus
ctcgccctgggactttgattcaaag

SEQ ID NO: 267343 - DNA, 25 bp, Rattus norvegicus
ctcgccctgggagtttgattcaaag

SEQ ID NO: 267344 - DNA, 25 bp, Rattus norvegicus
ctcgccctgggtcggtactcagagt

SEQ ID NO: 267345 - DNA, 25 bp, Rattus norvegicus
ctcgccctgggtgggtactcagagt

SEQ ID NO: 267346 - DNA, 25 bp, Rattus norvegicus
ctcgccgagtcacaagatgctgatt

SEQ ID NO: 267347 - DNA, 25 bp, Rattus norvegicus
ctcgccgagtcagaagatgctgatt

SEQ ID NO: 267348 - DNA, 25 bp, Rattus norvegicus
ctcgccgcagtcagctaagcagaag

SEQ ID NO: 267349 - DNA, 25 bp, Rattus norvegicus
ctcgccgcagtctgctaagcagaag

SEQ ID NO: 267350 - DNA, 25 bp, Rattus norvegicus
ctcgccggaaaccttgatgtcttaa

SEQ ID NO: 267351 - DNA, 25 bp, Rattus norvegicus
ctcgccggaaacgttgatgtcttaa

SEQ ID NO: 267352 - DNA, 25 bp, Rattus norvegicus
ctcgcctatggcatacagtttgaca

SEQ ID NO: 267353 - DNA, 25 bp, Rattus norvegicus
ctcgcctatggcttacagtttgaca

SEQ ID NO: 267354 - DNA, 25 bp, Rattus norvegicus
ctcgcctcatccatataggtgagca

SEQ ID NO: 267355 - DNA, 25 bp, Rattus norvegicus
ctcgcctcatccttataggtgagca

SEQ ID NO: 267356 - DNA, 25 bp, Rattus norvegicus
ctcgcctcccacaagagaatgtgga

SEQ ID NO: 267357 - DNA, 25 bp, Rattus norvegicus
ctcgcctcccactagagaatgtgga

SEQ ID NO: 267358 - DNA, 25 bp, Rattus norvegicus
ctcgcctctctgcagtataatgaat

SEQ ID NO: 267359 - DNA, 25 bp, Rattus norvegicus
ctcgcctctctggagtataatgaat

SEQ ID NO: 267360 - DNA, 25 bp, Rattus norvegicus
ctcgcctctggcacttggaaaaagc

SEQ ID NO: 267361 - DNA, 25 bp, Rattus norvegicus
ctcgcctctggctcttggaaaaagc

SEQ ID NO: 267362 - DNA, 25 bp, Rattus norvegicus
ctcgcctgcgggaaacactgggttt

SEQ ID NO: 267363 - DNA, 25 bp, Rattus norvegicus
ctcgcctgcgggtaacactgggttt

SEQ ID NO: 267364 - DNA, 25 bp, Rattus norvegicus
ctcgcctggatgacgaatgtgcctt

SEQ ID NO: 267365 - DNA, 25 bp, Rattus norvegicus
ctcgcctggatgtcgaatgtgcctt

SEQ ID NO: 267366 - DNA, 25 bp, Rattus norvegicus
ctcgcctggtatcttagctgcagaa

SEQ ID NO: 267367 - DNA, 25 bp, Rattus norvegicus
ctcgcctggtatgttagctgcagaa

SEQ ID NO: 267368 - DNA, 25 bp, Rattus norvegicus
ctcgccttaaggcaaggcctttgca

SEQ ID NO: 267369 - DNA, 25 bp, Rattus norvegicus
ctcgccttaagggaaggcctttgca

SEQ ID NO: 267370 - DNA, 25 bp, Rattus norvegicus
ctcgcctttatcatgcctaagagag

SEQ ID NO: 267371 - DNA, 25 bp, Rattus norvegicus
ctcgcctttatcttgcctaagagag

SEQ ID NO: 267372 - DNA, 25 bp, Rattus norvegicus
ctcgccttttgcaacttgctttaaa

SEQ ID NO: 267373 - DNA, 25 bp, Rattus norvegicus
ctcgccttttgctacttgctttaaa

SEQ ID NO: 267374 - DNA, 25 bp, Rattus norvegicus
ctcgcgcagtacatggtagttcagc

SEQ ID NO: 267375 - DNA, 25 bp, Rattus norvegicus
ctcgcgcagtacttggtagttcagc

SEQ ID NO: 267376 - DNA, 25 bp, Rattus norvegicus
ctcgcgctgctaagtctgtgaccag

SEQ ID NO: 267377 - DNA, 25 bp, Rattus norvegicus
ctcgcgctgctatgtctgtgaccag

SEQ ID NO: 267378 - DNA, 25 bp, Rattus norvegicus
ctcgcggatgcaatcgggatttttg

SEQ ID NO: 267379 - DNA, 25 bp, Rattus norvegicus
ctcgcggatgcattcgggatttttg

SEQ ID NO: 267380 - DNA, 25 bp, Rattus norvegicus
ctcgcggcagatactctggtctaat

SEQ ID NO: 267381 - DNA, 25 bp, Rattus norvegicus
ctcgcggcagattctctggtctaat

SEQ ID NO: 267382 - DNA, 25 bp, Rattus norvegicus
ctcgcggtgcccctggtgatgccat

SEQ ID NO: 267383 - DNA, 25 bp, Rattus norvegicus
ctcgcggtgcccgtggtgatgccat

SEQ ID NO: 267384 - DNA, 25 bp, Rattus norvegicus
ctcgcggtgtttacatccagttaat

SEQ ID NO: 267385 - DNA, 25 bp, Rattus norvegicus
ctcgcggtgttttcatccagttaat

SEQ ID NO: 267386 - DNA, 25 bp, Rattus norvegicus
ctcgcgtaatgacgctgcatcgctc

SEQ ID NO: 267387 - DNA, 25 bp, Rattus norvegicus
ctcgcgtaatgaggctgcatcgctc

SEQ ID NO: 267388 - DNA, 25 bp, Rattus norvegicus
ctcgcgttgaggaagcgcaatttgc

SEQ ID NO: 267389 - DNA, 25 bp, Rattus norvegicus
ctcgcgttgaggtagcgcaatttgc

SEQ ID NO: 267390 - DNA, 25 bp, Rattus norvegicus
ctcgctagacctaaactcagactgt

SEQ ID NO: 267391 - DNA, 25 bp, Rattus norvegicus
ctcgctagaccttaactcagactgt

SEQ ID NO: 267392 - DNA, 25 bp, Rattus norvegicus
ctcgctcaacctcttttgttcagta

SEQ ID NO: 267393 - DNA, 25 bp, Rattus norvegicus
ctcgctcaacctgttttgttcagta

SEQ ID NO: 267394 - DNA, 25 bp, Rattus norvegicus
ctcgctcattccacacaagttttaa

SEQ ID NO: 267395 - DNA, 25 bp, Rattus norvegicus
ctcgctcattcctcacaagttttaa

SEQ ID NO: 267396 - DNA, 25 bp, Rattus norvegicus
ctcgctccacatcagaggtgtctga

SEQ ID NO: 267397 - DNA, 25 bp, Rattus norvegicus
ctcgctccacatgagaggtgtctga

SEQ ID NO: 267398 - DNA, 25 bp, Rattus norvegicus
ctcgctcctcaacttggcaaaaatg

SEQ ID NO: 267399 - DNA, 25 bp, Rattus norvegicus
ctcgctcctcaagttggcaaaaatg

SEQ ID NO: 267400 - DNA, 25 bp, Rattus norvegicus
ctcgctctcttcaggtggtacatga

SEQ ID NO: 267401 - DNA, 25 bp, Rattus norvegicus
ctcgctctcttctggtggtacatga

SEQ ID NO: 267402 - DNA, 25 bp, Rattus norvegicus
ctcgctgaccccacagagtatgaaa

SEQ ID NO: 267403 - DNA, 25 bp, Rattus norvegicus
ctcgctgacccctcagagtatgaaa

SEQ ID NO: 267404 - DNA, 25 bp, Rattus norvegicus
ctcgctgagagcatgggtctttaaa

SEQ ID NO: 267405 - DNA, 25 bp, Rattus norvegicus
ctcgctgagagcttgggtctttaaa

SEQ ID NO: 267406 - DNA, 25 bp, Rattus norvegicus
ctcgctgagtttatgagcaggctgt

SEQ ID NO: 267407 - DNA, 25 bp, Rattus norvegicus
ctcgctgagtttttgagcaggctgt

SEQ ID NO: 267408 - DNA, 25 bp, Rattus norvegicus
ctcgctgcaataccggtttgctaga

SEQ ID NO: 267409 - DNA, 25 bp, Rattus norvegicus
ctcgctgcaatagcggtttgctaga

SEQ ID NO: 267410 - DNA, 25 bp, Rattus norvegicus
ctcgctgcacgtcctagagggctgc

SEQ ID NO: 267411 - DNA, 25 bp, Rattus norvegicus
ctcgctgcacgtgctagagggctgc

SEQ ID NO: 267412 - DNA, 25 bp, Rattus norvegicus
ctcgctgcagtgcttgtttttctaa

SEQ ID NO: 267413 - DNA, 25 bp, Rattus norvegicus
ctcgctgcagtggttgtttttctaa

SEQ ID NO: 267414 - DNA, 25 bp, Rattus norvegicus
ctcgctgccacaattgtaccagata

SEQ ID NO: 267415 - DNA, 25 bp, Rattus norvegicus
ctcgctgccacatttgtaccagata

SEQ ID NO: 267416 - DNA, 25 bp, Rattus norvegicus
ctcgctgccggtattctgaaataag

SEQ ID NO: 267417 - DNA, 25 bp, Rattus norvegicus
ctcgctgccggttttctgaaataag

SEQ ID NO: 267418 - DNA, 25 bp, Rattus norvegicus
ctcgctgctctcaataaagaagcct

SEQ ID NO: 267419 - DNA, 25 bp, Rattus norvegicus
ctcgctgctctctataaagaagcct

SEQ ID NO: 267420 - DNA, 25 bp, Rattus norvegicus
ctcgctgctgtcaggcactgagaag

SEQ ID NO: 267421 - DNA, 25 bp, Rattus norvegicus
ctcgctgctgtctggcactgagaag

SEQ ID NO: 267422 - DNA, 25 bp, Rattus norvegicus
ctcgctggagccaggagaactggcc

SEQ ID NO: 267423 - DNA, 25 bp, Rattus norvegicus
ctcgctggagcctggagaactggcc

SEQ ID NO: 267424 - DNA, 25 bp, Rattus norvegicus
ctcgctggcgcacaatgagagagct

SEQ ID NO: 267425 - DNA, 25 bp, Rattus norvegicus
ctcgctggcgcagaatgagagagct

SEQ ID NO: 267426 - DNA, 25 bp, Rattus norvegicus
ctcgctgtcgctcgaagaagttctt

SEQ ID NO: 267427 - DNA, 25 bp, Rattus norvegicus
ctcgctgtcgctggaagaagttctt

SEQ ID NO: 267428 - DNA, 25 bp, Rattus norvegicus
ctcgctgtggagcagctgtacctga

SEQ ID NO: 267429 - DNA, 25 bp, Rattus norvegicus
ctcgctgtggaggagctgtacctga

SEQ ID NO: 267430 - DNA, 25 bp, Rattus norvegicus
ctcgcttacttaacagggtcattgt

SEQ ID NO: 267431 - DNA, 25 bp, Rattus norvegicus
ctcgcttacttatcagggtcattgt

SEQ ID NO: 267432 - DNA, 25 bp, Rattus norvegicus
ctcgcttctgcacatctggtattaa

SEQ ID NO: 267433 - DNA, 25 bp, Rattus norvegicus
ctcgcttctgcagatctggtattaa

SEQ ID NO: 267434 - DNA, 25 bp, Rattus norvegicus
ctcgctttaacgcagctccctgaaa

SEQ ID NO: 267435 - DNA, 25 bp, Rattus norvegicus
ctcgctttaacggagctccctgaaa

SEQ ID NO: 267436 - DNA, 25 bp, Rattus norvegicus
ctcgctttataaagtttcggatctt

SEQ ID NO: 267437 - DNA, 25 bp, Rattus norvegicus
ctcgctttataatgtttcggatctt

SEQ ID NO: 267438 - DNA, 25 bp, Rattus norvegicus
ctcgctttccagatagtccaattct

SEQ ID NO: 267439 - DNA, 25 bp, Rattus norvegicus
ctcgctttccagttagtccaattct

SEQ ID NO: 267440 - DNA, 25 bp, Rattus norvegicus
ctcgcttttcggcatgttgtgatga

SEQ ID NO: 267441 - DNA, 25 bp, Rattus norvegicus
ctcgcttttcgggatgttgtgatga

SEQ ID NO: 267442 - DNA, 25 bp, Rattus norvegicus
ctcggaacactgacaacgcatggat

SEQ ID NO: 267443 - DNA, 25 bp, Rattus norvegicus
ctcggaacactgtcaacgcatggat

SEQ ID NO: 267444 - DNA, 25 bp, Rattus norvegicus
ctcggaaccgtgaggcctactttag

SEQ ID NO: 267445 - DNA, 25 bp, Rattus norvegicus
ctcggaaccgtgtggcctactttag

SEQ ID NO: 267446 - DNA, 25 bp, Rattus norvegicus
ctcggacactagacaagccattttg

SEQ ID NO: 267447 - DNA, 25 bp, Rattus norvegicus
ctcggacactagtcaagccattttg

SEQ ID NO: 267448 - DNA, 25 bp, Rattus norvegicus
ctcggacagctcaattcggacaaca

SEQ ID NO: 267449 - DNA, 25 bp, Rattus norvegicus
ctcggacagctctattcggacaaca

SEQ ID NO: 267450 - DNA, 25 bp, Rattus norvegicus
ctcggacctcaacggcatgctgtct

SEQ ID NO: 267451 - DNA, 25 bp, Rattus norvegicus
ctcggacctcaagggcatgctgtct

SEQ ID NO: 267452 - DNA, 25 bp, Rattus norvegicus
ctcggaccttgaaccagaactgtgg

SEQ ID NO: 267453 - DNA, 25 bp, Rattus norvegicus
ctcggaccttgatccagaactgtgg

SEQ ID NO: 267454 - DNA, 25 bp, Rattus norvegicus
ctcggactggaacgagtgtctctcc

SEQ ID NO: 267455 - DNA, 25 bp, Rattus norvegicus
ctcggactggaaggagtgtctctcc

SEQ ID NO: 267456 - DNA, 25 bp, Rattus norvegicus
ctcggagaacaaccggccatggacg

SEQ ID NO: 267457 - DNA, 25 bp, Rattus norvegicus
ctcggagaacaagcggccatggacg

SEQ ID NO: 267458 - DNA, 25 bp, Rattus norvegicus
ctcggagcccatcttttctgaaggt

SEQ ID NO: 267459 - DNA, 25 bp, Rattus norvegicus
ctcggagcccatgttttctgaaggt

SEQ ID NO: 267460 - DNA, 25 bp, Rattus norvegicus
ctcggaggaggtactgtgcaacact

SEQ ID NO: 267461 - DNA, 25 bp, Rattus norvegicus
ctcggaggaggttctgtgcaacact

SEQ ID NO: 267462 - DNA, 25 bp, Rattus norvegicus
ctcggaggcctaattctatgttagc

SEQ ID NO: 267463 - DNA, 25 bp, Rattus norvegicus
ctcggaggcctatttctatgttagc

SEQ ID NO: 267464 - DNA, 25 bp, Rattus norvegicus
ctcggaggcgcgcagcagggactga

SEQ ID NO: 267465 - DNA, 25 bp, Rattus norvegicus
ctcggaggcgcggagcagggactga

SEQ ID NO: 267466 - DNA, 25 bp, Rattus norvegicus
ctcggaggctccatgacaaaccagg

SEQ ID NO: 267467 - DNA, 25 bp, Rattus norvegicus
ctcggaggctccttgacaaaccagg

SEQ ID NO: 267468 - DNA, 25 bp, Rattus norvegicus
ctcggaggtgttagctgctttacaa

SEQ ID NO: 267469 - DNA, 25 bp, Rattus norvegicus
ctcggaggtgtttgctgctttacaa

SEQ ID NO: 267470 - DNA, 25 bp, Rattus norvegicus
ctcggagtctttatgctggtgtgtc

SEQ ID NO: 267471 - DNA, 25 bp, Rattus norvegicus
ctcggagtctttttgctggtgtgtc

SEQ ID NO: 267472 - DNA, 25 bp, Rattus norvegicus
ctcggagtggctaccgcacagtgaa

SEQ ID NO: 267473 - DNA, 25 bp, Rattus norvegicus
ctcggagtggcttccgcacagtgaa

SEQ ID NO: 267474 - DNA, 25 bp, Rattus norvegicus
ctcggagttgtcagcgtccagggaa

SEQ ID NO: 267475 - DNA, 25 bp, Rattus norvegicus
ctcggagttgtctgcgtccagggaa

SEQ ID NO: 267476 - DNA, 25 bp, Rattus norvegicus
ctcggatcaaagagctcttccagaa

SEQ ID NO: 267477 - DNA, 25 bp, Rattus norvegicus
ctcggatcaaagtgctcttccagaa

SEQ ID NO: 267478 - DNA, 25 bp, Rattus norvegicus
ctcggatccctgacagcactgaaga

SEQ ID NO: 267479 - DNA, 25 bp, Rattus norvegicus
ctcggatccctgtcagcactgaaga

SEQ ID NO: 267480 - DNA, 25 bp, Rattus norvegicus
ctcggatccgccaagttattcagga

SEQ ID NO: 267481 - DNA, 25 bp, Rattus norvegicus
ctcggatccgcctagttattcagga

SEQ ID NO: 267482 - DNA, 25 bp, Rattus norvegicus
ctcggatccgcgctcttctggaggc

SEQ ID NO: 267483 - DNA, 25 bp, Rattus norvegicus
ctcggatccgcggtcttctggaggc

SEQ ID NO: 267484 - DNA, 25 bp, Rattus norvegicus
ctcggatctttacctggaaccacag

SEQ ID NO: 267485 - DNA, 25 bp, Rattus norvegicus
ctcggatctttagctggaaccacag

SEQ ID NO: 267486 - DNA, 25 bp, Rattus norvegicus
ctcggatgtggcctgactctcataa

SEQ ID NO: 267487 - DNA, 25 bp, Rattus norvegicus
ctcggatgtggcgtgactctcataa

SEQ ID NO: 267488 - DNA, 25 bp, Rattus norvegicus
ctcggattacgacgacgtttcgaat

SEQ ID NO: 267489 - DNA, 25 bp, Rattus norvegicus
ctcggattacgaggacgtttcgaat

SEQ ID NO: 267490 - DNA, 25 bp, Rattus norvegicus
ctcggcaattgtagcctcggcagct

SEQ ID NO: 267491 - DNA, 25 bp, Rattus norvegicus
ctcggcaattgttgcctcggcagct

SEQ ID NO: 267492 - DNA, 25 bp, Rattus norvegicus
ctcggcaggtgacttttctctgaga

SEQ ID NO: 267493 - DNA, 25 bp, Rattus norvegicus
ctcggcaggtgagttttctctgaga

SEQ ID NO: 267494 - DNA, 25 bp, Rattus norvegicus
ctcggcatctgacctttcataggaa

SEQ ID NO: 267495 - DNA, 25 bp, Rattus norvegicus
ctcggcatctgagctttcataggaa

SEQ ID NO: 267496 - DNA, 25 bp, Rattus norvegicus
ctcggccactttagttaatgcactg

SEQ ID NO: 267497 - DNA, 25 bp, Rattus norvegicus
ctcggccacttttgttaatgcactg

SEQ ID NO: 267498 - DNA, 25 bp, Rattus norvegicus
ctcggcccagtgaccgtgataggaa

SEQ ID NO: 267499 - DNA, 25 bp, Rattus norvegicus
ctcggcccagtgtccgtgataggaa

SEQ ID NO: 267500 - DNA, 25 bp, Rattus norvegicus
ctcggcgactggaagagcaaggtct

SEQ ID NO: 267501 - DNA, 25 bp, Rattus norvegicus
ctcggcgactggtagagcaaggtct

SEQ ID NO: 267502 - DNA, 25 bp, Rattus norvegicus
ctcggcgtaaagcactgggcacgaa

SEQ ID NO: 267503 - DNA, 25 bp, Rattus norvegicus
ctcggcgtaaaggactgggcacgaa

SEQ ID NO: 267504 - DNA, 25 bp, Rattus norvegicus
ctcggcgtcgcacatgaatttcatt

SEQ ID NO: 267505 - DNA, 25 bp, Rattus norvegicus
ctcggcgtcgcagatgaatttcatt

SEQ ID NO: 267506 - DNA, 25 bp, Rattus norvegicus
ctcggctacaagcatactgctgggt

SEQ ID NO: 267507 - DNA, 25 bp, Rattus norvegicus
ctcggctacaaggatactgctgggt

SEQ ID NO: 267508 - DNA, 25 bp, Rattus norvegicus
ctcggctagcacaaggagctggcta

SEQ ID NO: 267509 - DNA, 25 bp, Rattus norvegicus
ctcggctagcactaggagctggcta

SEQ ID NO: 267510 - DNA, 25 bp, Rattus norvegicus
ctcggctatagcacattttcattat

SEQ ID NO: 267511 - DNA, 25 bp, Rattus norvegicus
ctcggctatagctcattttcattat

SEQ ID NO: 267512 - DNA, 25 bp, Rattus norvegicus
ctcggctcagggaatttcgcttgga

SEQ ID NO: 267513 - DNA, 25 bp, Rattus norvegicus
ctcggctcagggtatttcgcttgga

SEQ ID NO: 267514 - DNA, 25 bp, Rattus norvegicus
ctcggctcatgacaggtctggaata

SEQ ID NO: 267515 - DNA, 25 bp, Rattus norvegicus
ctcggctcatgagaggtctggaata

SEQ ID NO: 267516 - DNA, 25 bp, Rattus norvegicus
ctcggctccatcacaagttcaaaag

SEQ ID NO: 267517 - DNA, 25 bp, Rattus norvegicus
ctcggctccatctcaagttcaaaag

SEQ ID NO: 267518 - DNA, 25 bp, Rattus norvegicus
ctcggctcttcgagcttgaaagcag

SEQ ID NO: 267519 - DNA, 25 bp, Rattus norvegicus
ctcggctcttcgtgcttgaaagcag

SEQ ID NO: 267520 - DNA, 25 bp, Rattus norvegicus
ctcggctcttgacattcctagttta

SEQ ID NO: 267521 - DNA, 25 bp, Rattus norvegicus
ctcggctcttgagattcctagttta

SEQ ID NO: 267522 - DNA, 25 bp, Rattus norvegicus
ctcggctgcgccagattttattaga

SEQ ID NO: 267523 - DNA, 25 bp, Rattus norvegicus
ctcggctgcgcctgattttattaga

SEQ ID NO: 267524 - DNA, 25 bp, Rattus norvegicus
ctcggctgctggatccatagcggaa

SEQ ID NO: 267525 - DNA, 25 bp, Rattus norvegicus
ctcggctgctggttccatagcggaa

SEQ ID NO: 267526 - DNA, 25 bp, Rattus norvegicus
ctcggctgggcactcaaggcagggt

SEQ ID NO: 267527 - DNA, 25 bp, Rattus norvegicus
ctcggctgggcagtcaaggcagggt

SEQ ID NO: 267528 - DNA, 25 bp, Rattus norvegicus
ctcggcttctagagctgtttgcagg

SEQ ID NO: 267529 - DNA, 25 bp, Rattus norvegicus
ctcggcttctagtgctgtttgcagg

SEQ ID NO: 267530 - DNA, 25 bp, Rattus norvegicus
ctcggcttgctgctaattgtgctgt

SEQ ID NO: 267531 - DNA, 25 bp, Rattus norvegicus
ctcggcttgctggtaattgtgctgt

SEQ ID NO: 267532 - DNA, 25 bp, Rattus norvegicus
ctcggctttcaacttcttttgcatg

SEQ ID NO: 267533 - DNA, 25 bp, Rattus norvegicus
ctcggctttcaagttcttttgcatg

SEQ ID NO: 267534 - DNA, 25 bp, Rattus norvegicus
ctcggctttgtgcagcaagcataga

SEQ ID NO: 267535 - DNA, 25 bp, Rattus norvegicus
ctcggctttgtggagcaagcataga

SEQ ID NO: 267536 - DNA, 25 bp, Rattus norvegicus
ctcggcttttgaaggatgcacctgt

SEQ ID NO: 267537 - DNA, 25 bp, Rattus norvegicus
ctcggcttttgatggatgcacctgt

SEQ ID NO: 267538 - DNA, 25 bp, Rattus norvegicus
ctcgggaccacgagggtgaccagca

SEQ ID NO: 267539 - DNA, 25 bp, Rattus norvegicus
ctcgggaccacgtgggtgaccagca

SEQ ID NO: 267540 - DNA, 25 bp, Rattus norvegicus
ctcgggagatccaaagctttgccta

SEQ ID NO: 267541 - DNA, 25 bp, Rattus norvegicus
ctcgggagatcctaagctttgccta

SEQ ID NO: 267542 - DNA, 25 bp, Rattus norvegicus
ctcgggagatggatcagttggcaaa

SEQ ID NO: 267543 - DNA, 25 bp, Rattus norvegicus
ctcgggagatggttcagttggcaaa

SEQ ID NO: 267544 - DNA, 25 bp, Rattus norvegicus
ctcgggagccgcagcgcgatccaga

SEQ ID NO: 267545 - DNA, 25 bp, Rattus norvegicus
ctcgggagccgctgcgcgatccaga

SEQ ID NO: 267546 - DNA, 25 bp, Rattus norvegicus
ctcgggaggtccactggtgtgcaac

SEQ ID NO: 267547 - DNA, 25 bp, Rattus norvegicus
ctcgggaggtcctctggtgtgcaac

SEQ ID NO: 267548 - DNA, 25 bp, Rattus norvegicus
ctcgggagtggactccttcgatgaa

SEQ ID NO: 267549 - DNA, 25 bp, Rattus norvegicus
ctcgggagtggagtccttcgatgaa

SEQ ID NO: 267550 - DNA, 25 bp, Rattus norvegicus
ctcgggatggttccacgactgctgc

SEQ ID NO: 267551 - DNA, 25 bp, Rattus norvegicus
ctcgggatggttgcacgactgctgc

SEQ ID NO: 267552 - DNA, 25 bp, Rattus norvegicus
ctcgggatttcaattctaacctggt

SEQ ID NO: 267553 - DNA, 25 bp, Rattus norvegicus
ctcgggatttcatttctaacctggt

SEQ ID NO: 267554 - DNA, 25 bp, Rattus norvegicus
ctcgggcaaattactcatggatcat

SEQ ID NO: 267555 - DNA, 25 bp, Rattus norvegicus
ctcgggcaaatttctcatggatcat

SEQ ID NO: 267556 - DNA, 25 bp, Rattus norvegicus
ctcgggcaggtcattcagtagggat

SEQ ID NO: 267557 - DNA, 25 bp, Rattus norvegicus
ctcgggcaggtctttcagtagggat

SEQ ID NO: 267558 - DNA, 25 bp, Rattus norvegicus
ctcgggcagtgcattcttttttgaa

SEQ ID NO: 267559 - DNA, 25 bp, Rattus norvegicus
ctcgggcagtgctttcttttttgaa

SEQ ID NO: 267560 - DNA, 25 bp, Rattus norvegicus
ctcgggcctcttatacaggagtact

SEQ ID NO: 267561 - DNA, 25 bp, Rattus norvegicus
ctcgggcctcttttacaggagtact

SEQ ID NO: 267562 - DNA, 25 bp, Rattus norvegicus
ctcgggcgactcacagaacacaaga

SEQ ID NO: 267563 - DNA, 25 bp, Rattus norvegicus
ctcgggcgactctcagaacacaaga

SEQ ID NO: 267564 - DNA, 25 bp, Rattus norvegicus
ctcgggctaactatgctgttgggaa

SEQ ID NO: 267565 - DNA, 25 bp, Rattus norvegicus
ctcgggctaactttgctgttgggaa

SEQ ID NO: 267566 - DNA, 25 bp, Rattus norvegicus
ctcgggctatttatctgtttccaag

SEQ ID NO: 267567 - DNA, 25 bp, Rattus norvegicus
ctcgggctatttttctgtttccaag

SEQ ID NO: 267568 - DNA, 25 bp, Rattus norvegicus
ctcgggctccatactgaatgtgact

SEQ ID NO: 267569 - DNA, 25 bp, Rattus norvegicus
ctcgggctccattctgaatgtgact

SEQ ID NO: 267570 - DNA, 25 bp, Rattus norvegicus
ctcgggctctgcctccaaggattgg

SEQ ID NO: 267571 - DNA, 25 bp, Rattus norvegicus
ctcgggctctgcgtccaaggattgg

SEQ ID NO: 267572 - DNA, 25 bp, Rattus norvegicus
ctcgggcttttaagatcttattttc

SEQ ID NO: 267573 - DNA, 25 bp, Rattus norvegicus
ctcgggcttttatgatcttattttc

SEQ ID NO: 267574 - DNA, 25 bp, Rattus norvegicus
ctcgggtgggagagcgaccactatt

SEQ ID NO: 267575 - DNA, 25 bp, Rattus norvegicus
ctcgggtgggagtgcgaccactatt

SEQ ID NO: 267576 - DNA, 25 bp, Rattus norvegicus
ctcgggtgtcccattgtgagaacaa

SEQ ID NO: 267577 - DNA, 25 bp, Rattus norvegicus
ctcgggtgtccctttgtgagaacaa

SEQ ID NO: 267578 - DNA, 25 bp, Rattus norvegicus
ctcgggttggttaccttgtgcagga

SEQ ID NO: 267579 - DNA, 25 bp, Rattus norvegicus
ctcgggttggtttccttgtgcagga

SEQ ID NO: 267580 - DNA, 25 bp, Rattus norvegicus
ctcgggtttggtactgtgatttaag

SEQ ID NO: 267581 - DNA, 25 bp, Rattus norvegicus
ctcgggtttggttctgtgatttaag

SEQ ID NO: 267582 - DNA, 25 bp, Rattus norvegicus
ctcggtaataccaagctgcacagta

SEQ ID NO: 267583 - DNA, 25 bp, Rattus norvegicus
ctcggtaatacctagctgcacagta

SEQ ID NO: 267584 - DNA, 25 bp, Rattus norvegicus
ctcggtaccgttctccatgtgaata

SEQ ID NO: 267585 - DNA, 25 bp, Rattus norvegicus
ctcggtaccgttgtccatgtgaata

SEQ ID NO: 267586 - DNA, 25 bp, Rattus norvegicus
ctcggtactgcgcttgcacagagta

SEQ ID NO: 267587 - DNA, 25 bp, Rattus norvegicus
ctcggtactgcggttgcacagagta

SEQ ID NO: 267588 - DNA, 25 bp, Rattus norvegicus
ctcggtataaatacagatggacttg

SEQ ID NO: 267589 - DNA, 25 bp, Rattus norvegicus
ctcggtataaattcagatggacttg

SEQ ID NO: 267590 - DNA, 25 bp, Rattus norvegicus
ctcggtatctcacactctgacaggg

SEQ ID NO: 267591 - DNA, 25 bp, Rattus norvegicus
ctcggtatctcagactctgacaggg

SEQ ID NO: 267592 - DNA, 25 bp, Rattus norvegicus
ctcggtctctgtatcatcatcaaga

SEQ ID NO: 267593 - DNA, 25 bp, Rattus norvegicus
ctcggtctctgtttcatcatcaaga

SEQ ID NO: 267594 - DNA, 25 bp, Rattus norvegicus
ctcggtgccattcctgggtaggtaa

SEQ ID NO: 267595 - DNA, 25 bp, Rattus norvegicus
ctcggtgccattgctgggtaggtaa

SEQ ID NO: 267596 - DNA, 25 bp, Rattus norvegicus
ctcggtgcgatactgatgatgaaat

SEQ ID NO: 267597 - DNA, 25 bp, Rattus norvegicus
ctcggtgcgatagtgatgatgaaat

SEQ ID NO: 267598 - DNA, 25 bp, Rattus norvegicus
ctcggtgctatgagtgtggcttata

SEQ ID NO: 267599 - DNA, 25 bp, Rattus norvegicus
ctcggtgctatgtgtgtggcttata

SEQ ID NO: 267600 - DNA, 25 bp, Rattus norvegicus
ctcggtgctcgcattgtttaaatat

SEQ ID NO: 267601 - DNA, 25 bp, Rattus norvegicus
ctcggtgctcgctttgtttaaatat

SEQ ID NO: 267602 - DNA, 25 bp, Rattus norvegicus
ctcggtgctgccagaatgagcggat

SEQ ID NO: 267603 - DNA, 25 bp, Rattus norvegicus
ctcggtgctgcctgaatgagcggat

SEQ ID NO: 267604 - DNA, 25 bp, Rattus norvegicus
ctcggtggtcctcctgtgggtcctc

SEQ ID NO: 267605 - DNA, 25 bp, Rattus norvegicus
ctcggtggtcctgctgtgggtcctc

SEQ ID NO: 267606 - DNA, 25 bp, Rattus norvegicus
ctcggtgtggctcacattcgcacag

SEQ ID NO: 267607 - DNA, 25 bp, Rattus norvegicus
ctcggtgtggctgacattcgcacag

SEQ ID NO: 267608 - DNA, 25 bp, Rattus norvegicus
ctcggtgttcacatgcttggcgata

SEQ ID NO: 267609 - DNA, 25 bp, Rattus norvegicus
ctcggtgttcacttgcttggcgata

SEQ ID NO: 267610 - DNA, 25 bp, Rattus norvegicus
ctcggtgttcttagcatccaagtgg

SEQ ID NO: 267611 - DNA, 25 bp, Rattus norvegicus
ctcggtgttctttgcatccaagtgg

SEQ ID NO: 267612 - DNA, 25 bp, Rattus norvegicus
ctcggtgtttcaatctgcatgcata

SEQ ID NO: 267613 - DNA, 25 bp, Rattus norvegicus
ctcggtgtttcattctgcatgcata

SEQ ID NO: 267614 - DNA, 25 bp, Rattus norvegicus
ctcggtgttttgcagcatttgttgc

SEQ ID NO: 267615 - DNA, 25 bp, Rattus norvegicus
ctcggtgttttggagcatttgttgc

SEQ ID NO: 267616 - DNA, 25 bp, Rattus norvegicus
ctcggttaacctcgcggctgaaaga

SEQ ID NO: 267617 - DNA, 25 bp, Rattus norvegicus
ctcggttaacctggcggctgaaaga

SEQ ID NO: 267618 - DNA, 25 bp, Rattus norvegicus
ctcggtttcgctcggatgtttgcac

SEQ ID NO: 267619 - DNA, 25 bp, Rattus norvegicus
ctcggtttcgctgggatgtttgcac

SEQ ID NO: 267620 - DNA, 25 bp, Rattus norvegicus
ctcggtttctctcacatgtactaga

SEQ ID NO: 267621 - DNA, 25 bp, Rattus norvegicus
ctcggtttctctgacatgtactaga

SEQ ID NO: 267622 - DNA, 25 bp, Rattus norvegicus
ctcggtttctgcaacgcacatccag

SEQ ID NO: 267623 - DNA, 25 bp, Rattus norvegicus
ctcggtttctgcagtgagccctgac

SEQ ID NO: 267624 - DNA, 25 bp, Rattus norvegicus
ctcggtttctgctacgcacatccag

SEQ ID NO: 267625 - DNA, 25 bp, Rattus norvegicus
ctcggtttctgctgtgagccctgac

SEQ ID NO: 267626 - DNA, 25 bp, Rattus norvegicus
ctcgtaagtgtcctctcagtagatt

SEQ ID NO: 267627 - DNA, 25 bp, Rattus norvegicus
ctcgtaagtgtcgtctcagtagatt

SEQ ID NO: 267628 - DNA, 25 bp, Rattus norvegicus
ctcgtaccagctcttgtctgttagt

SEQ ID NO: 267629 - DNA, 25 bp, Rattus norvegicus
ctcgtaccagctgttgtctgttagt

SEQ ID NO: 267630 - DNA, 25 bp, Rattus norvegicus
ctcgtaccaggcagggcggttgtaa

SEQ ID NO: 267631 - DNA, 25 bp, Rattus norvegicus
ctcgtaccaggctgggcggttgtaa

SEQ ID NO: 267632 - DNA, 25 bp, Rattus norvegicus
ctcgtactgtagagctctagccttt

SEQ ID NO: 267633 - DNA, 25 bp, Rattus norvegicus
ctcgtactgtagtgctctagccttt

SEQ ID NO: 267634 - DNA, 25 bp, Rattus norvegicus
ctcgtagcgtatacgggttctttgt

SEQ ID NO: 267635 - DNA, 25 bp, Rattus norvegicus
ctcgtagcgtattcgggttctttgt

SEQ ID NO: 267636 - DNA, 25 bp, Rattus norvegicus
ctcgtagctggtctttgttttctta

SEQ ID NO: 267637 - DNA, 25 bp, Rattus norvegicus
ctcgtagctggtgtttgttttctta

SEQ ID NO: 267638 - DNA, 25 bp, Rattus norvegicus
ctcgtaggtaatcggttccaggcca

SEQ ID NO: 267639 - DNA, 25 bp, Rattus norvegicus
ctcgtaggtaatgggttccaggcca

SEQ ID NO: 267640 - DNA, 25 bp, Rattus norvegicus
ctcgtatgctcgctagtcttgtaat

SEQ ID NO: 267641 - DNA, 25 bp, Rattus norvegicus
ctcgtatgctcggtagtcttgtaat

SEQ ID NO: 267642 - DNA, 25 bp, Rattus norvegicus
ctcgtcagacagaccggctgggtta

SEQ ID NO: 267643 - DNA, 25 bp, Rattus norvegicus
ctcgtcagacagtccggctgggtta

SEQ ID NO: 267644 - DNA, 25 bp, Rattus norvegicus
ctcgtcagacatacatcatccaaga

SEQ ID NO: 267645 - DNA, 25 bp, Rattus norvegicus
ctcgtcagacattcatcatccaaga

SEQ ID NO: 267646 - DNA, 25 bp, Rattus norvegicus
ctcgtcagagtccatcactaatcta

SEQ ID NO: 267647 - DNA, 25 bp, Rattus norvegicus
ctcgtcagagtcgatcactaatcta

SEQ ID NO: 267648 - DNA, 25 bp, Rattus norvegicus
ctcgtcagcattctcctctttggaa

SEQ ID NO: 267649 - DNA, 25 bp, Rattus norvegicus
ctcgtcagcattgtcctctttggaa

SEQ ID NO: 267650 - DNA, 25 bp, Rattus norvegicus
ctcgtcatacaaatgccatccatgc

SEQ ID NO: 267651 - DNA, 25 bp, Rattus norvegicus
ctcgtcatacaattgccatccatgc

SEQ ID NO: 267652 - DNA, 25 bp, Rattus norvegicus
ctcgtccaagaactccagtccagtg

SEQ ID NO: 267653 - DNA, 25 bp, Rattus norvegicus
ctcgtccaagaagtccagtccagtg

SEQ ID NO: 267654 - DNA, 25 bp, Rattus norvegicus
ctcgtccccgctcgagctgttggag

SEQ ID NO: 267655 - DNA, 25 bp, Rattus norvegicus
ctcgtccccgctggagctgttggag

SEQ ID NO: 267656 - DNA, 25 bp, Rattus norvegicus
ctcgtccgccagcttctaaataaag

SEQ ID NO: 267657 - DNA, 25 bp, Rattus norvegicus
ctcgtccgccaggttctaaataaag

SEQ ID NO: 267658 - DNA, 25 bp, Rattus norvegicus
ctcgtccggctgcatagaggagctc

SEQ ID NO: 267659 - DNA, 25 bp, Rattus norvegicus
ctcgtccggctggatagaggagctc

SEQ ID NO: 267660 - DNA, 25 bp, Rattus norvegicus
ctcgtcgccttccaaagcaaatggg

SEQ ID NO: 267661 - DNA, 25 bp, Rattus norvegicus
ctcgtcgccttcgaaagcaaatggg

SEQ ID NO: 267662 - DNA, 25 bp, Rattus norvegicus
ctcgtcgtaaccagacattgtccag

SEQ ID NO: 267663 - DNA, 25 bp, Rattus norvegicus
ctcgtcgtaacctgacattgtccag

SEQ ID NO: 267664 - DNA, 25 bp, Rattus norvegicus
ctcgtctatctcaggatcttggaaa

SEQ ID NO: 267665 - DNA, 25 bp, Rattus norvegicus
ctcgtctatctctggatcttggaaa

SEQ ID NO: 267666 - DNA, 25 bp, Rattus norvegicus
ctcgtctatctgcatggctacacat

SEQ ID NO: 267667 - DNA, 25 bp, Rattus norvegicus
ctcgtctatctggatggctacacat

SEQ ID NO: 267668 - DNA, 25 bp, Rattus norvegicus
ctcgtctgatctcggaagctaagca

SEQ ID NO: 267669 - DNA, 25 bp, Rattus norvegicus
ctcgtctgatctgggaagctaagca

SEQ ID NO: 267670 - DNA, 25 bp, Rattus norvegicus
ctcgtctttcagataccgactcata

SEQ ID NO: 267671 - DNA, 25 bp, Rattus norvegicus
ctcgtctttcagttaccgactcata

SEQ ID NO: 267672 - DNA, 25 bp, Rattus norvegicus
ctcgtgaagagtcttctgcttggca

SEQ ID NO: 267673 - DNA, 25 bp, Rattus norvegicus
ctcgtgaagagtgttctgcttggca

SEQ ID NO: 267674 - DNA, 25 bp, Rattus norvegicus
ctcgtgaatacgatcaattttttat

SEQ ID NO: 267675 - DNA, 25 bp, Rattus norvegicus
ctcgtgaatacgttcaattttttat

SEQ ID NO: 267676 - DNA, 25 bp, Rattus norvegicus
ctcgtgagacttctgggtgtaccat

SEQ ID NO: 267677 - DNA, 25 bp, Rattus norvegicus
ctcgtgagacttgtgggtgtaccat

SEQ ID NO: 267678 - DNA, 25 bp, Rattus norvegicus
ctcgtgagccttcttcagaatctga

SEQ ID NO: 267679 - DNA, 25 bp, Rattus norvegicus
ctcgtgagccttgttcagaatctga

SEQ ID NO: 267680 - DNA, 25 bp, Rattus norvegicus
ctcgtgcgtctaccgtttagttaag

SEQ ID NO: 267681 - DNA, 25 bp, Rattus norvegicus
ctcgtgcgtctagcgtttagttaag

SEQ ID NO: 267682 - DNA, 25 bp, Rattus norvegicus
ctcgtgctttgcactttgaagactg

SEQ ID NO: 267683 - DNA, 25 bp, Rattus norvegicus
ctcgtgctttgctctttgaagactg

SEQ ID NO: 267684 - DNA, 25 bp, Rattus norvegicus
ctcgtggactgtctgcaacttcagt

SEQ ID NO: 267685 - DNA, 25 bp, Rattus norvegicus
ctcgtggactgtgtgcaacttcagt

SEQ ID NO: 267686 - DNA, 25 bp, Rattus norvegicus
ctcgtggcaggtcgtacttcttgtc

SEQ ID NO: 267687 - DNA, 25 bp, Rattus norvegicus
ctcgtggcaggtggtacttcttgtc

SEQ ID NO: 267688 - DNA, 25 bp, Rattus norvegicus
ctcgtggccacacaccggttaaagc

SEQ ID NO: 267689 - DNA, 25 bp, Rattus norvegicus
ctcgtggccacagaccggttaaagc

SEQ ID NO: 267690 - DNA, 25 bp, Rattus norvegicus
ctcgtgggcgttattggagcttatt

SEQ ID NO: 267691 - DNA, 25 bp, Rattus norvegicus
ctcgtgggcgtttttggagcttatt

SEQ ID NO: 267692 - DNA, 25 bp, Rattus norvegicus
ctcgtgggtgagattgcattcgtgt

SEQ ID NO: 267693 - DNA, 25 bp, Rattus norvegicus
ctcgtgggtgagtttgcattcgtgt

SEQ ID NO: 267694 - DNA, 25 bp, Rattus norvegicus
ctcgtggtctggctgtggtctcttc

SEQ ID NO: 267695 - DNA, 25 bp, Rattus norvegicus
ctcgtggtctgggtgtggtctcttc

SEQ ID NO: 267696 - DNA, 25 bp, Rattus norvegicus
ctcgtggtctgtccttgctcagaaa

SEQ ID NO: 267697 - DNA, 25 bp, Rattus norvegicus
ctcgtggtctgtgcttgctcagaaa

SEQ ID NO: 267698 - DNA, 25 bp, Rattus norvegicus
ctcgtgtctctcctgattagctttt

SEQ ID NO: 267699 - DNA, 25 bp, Rattus norvegicus
ctcgtgtctctcgtgattagctttt

SEQ ID NO: 267700 - DNA, 25 bp, Rattus norvegicus
ctcgtgtgccagcataggtcagtgc

SEQ ID NO: 267701 - DNA, 25 bp, Rattus norvegicus
ctcgtgtgccaggataggtcagtgc

SEQ ID NO: 267702 - DNA, 25 bp, Rattus norvegicus
ctcgtgtgcctgatgtgtctggtaa

SEQ ID NO: 267703 - DNA, 25 bp, Rattus norvegicus
ctcgtgtgcctgttgtgtctggtaa

SEQ ID NO: 267704 - DNA, 25 bp, Rattus norvegicus
ctcgtgttcttgataatcttcccgg

SEQ ID NO: 267705 - DNA, 25 bp, Rattus norvegicus
ctcgtgttcttgttaatcttcccgg

SEQ ID NO: 267706 - DNA, 25 bp, Rattus norvegicus
ctcgttacgagccaattccatttag

SEQ ID NO: 267707 - DNA, 25 bp, Rattus norvegicus
ctcgttacgagcgaattccatttag

SEQ ID NO: 267708 - DNA, 25 bp, Rattus norvegicus
ctcgttcagaggattgcacagtcgc

SEQ ID NO: 267709 - DNA, 25 bp, Rattus norvegicus
ctcgttcagaggtttgcacagtcgc

SEQ ID NO: 267710 - DNA, 25 bp, Rattus norvegicus
ctcgttcatgccctagtcattaaac

SEQ ID NO: 267711 - DNA, 25 bp, Rattus norvegicus
ctcgttcatgccgtagtcattaaac

SEQ ID NO: 267712 - DNA, 25 bp, Rattus norvegicus
ctcgttcctttcctgttatgataca

SEQ ID NO: 267713 - DNA, 25 bp, Rattus norvegicus
ctcgttcctttcgtgttatgataca

SEQ ID NO: 267714 - DNA, 25 bp, Rattus norvegicus
ctcgttcgaccactcgcggacggtg

SEQ ID NO: 267715 - DNA, 25 bp, Rattus norvegicus
ctcgttcgaccagtcgcggacggtg

SEQ ID NO: 267716 - DNA, 25 bp, Rattus norvegicus
ctcgttcgctgtcaagcttttcaaa

SEQ ID NO: 267717 - DNA, 25 bp, Rattus norvegicus
ctcgttcgctgtgaagcttttcaaa

SEQ ID NO: 267718 - DNA, 25 bp, Rattus norvegicus
ctcgttctttgtagtattgatgatg

SEQ ID NO: 267719 - DNA, 25 bp, Rattus norvegicus
ctcgttctttgttgtattgatgatg

SEQ ID NO: 267720 - DNA, 25 bp, Rattus norvegicus
ctcgttggacttcttgtttaatttg

SEQ ID NO: 267721 - DNA, 25 bp, Rattus norvegicus
ctcgttggacttgttgtttaatttg

SEQ ID NO: 267722 - DNA, 25 bp, Rattus norvegicus
ctcgttggcatactatagcttccct

SEQ ID NO: 267723 - DNA, 25 bp, Rattus norvegicus
ctcgttggcatagtatagcttccct

SEQ ID NO: 267724 - DNA, 25 bp, Rattus norvegicus
ctcgttgttagacgccatgtggagt

SEQ ID NO: 267725 - DNA, 25 bp, Rattus norvegicus
ctcgttgttagaggccatgtggagt

SEQ ID NO: 267726 - DNA, 25 bp, Rattus norvegicus
ctcgtttacatacacaaggaacctc

SEQ ID NO: 267727 - DNA, 25 bp, Rattus norvegicus
ctcgtttacatagacaaggaacctc

SEQ ID NO: 267728 - DNA, 25 bp, Rattus norvegicus
ctcgtttcccttctggctggataaa

SEQ ID NO: 267729 - DNA, 25 bp, Rattus norvegicus
ctcgtttcccttgtggctggataaa

SEQ ID NO: 267730 - DNA, 25 bp, Rattus norvegicus
ctcgtttccgttacctgattggaga

SEQ ID NO: 267731 - DNA, 25 bp, Rattus norvegicus
ctcgtttccgtttcctgattggaga

SEQ ID NO: 267732 - DNA, 25 bp, Rattus norvegicus
ctcgtttgtaccacagtggctgatg

SEQ ID NO: 267733 - DNA, 25 bp, Rattus norvegicus
ctcgtttgtacctcagtggctgatg

SEQ ID NO: 267734 - DNA, 25 bp, Rattus norvegicus
ctcgttttcattctggtgactgcca

SEQ ID NO: 267735 - DNA, 25 bp, Rattus norvegicus
ctcgttttcattgtggtgactgcca

SEQ ID NO: 267736 - DNA, 25 bp, Rattus norvegicus
ctcgttttcccaactgtcaaattgg

SEQ ID NO: 267737 - DNA, 25 bp, Rattus norvegicus
ctcgttttcccatctgtcaaattgg

SEQ ID NO: 267738 - DNA, 25 bp, Rattus norvegicus
ctcgttttctttacgaatctggtag

SEQ ID NO: 267739 - DNA, 25 bp, Rattus norvegicus
ctcgttttcttttcgaatctggtag

SEQ ID NO: 267740 - DNA, 25 bp, Rattus norvegicus
ctctaaatcagtattttcttccctg

SEQ ID NO: 267741 - DNA, 25 bp, Rattus norvegicus
ctctaaatcagttttttcttccctg

SEQ ID NO: 267742 - DNA, 25 bp, Rattus norvegicus
ctctaaatcatcatgcgacagtctc

SEQ ID NO: 267743 - DNA, 25 bp, Rattus norvegicus
ctctaaatcatcttgcgacagtctc

SEQ ID NO: 267744 - DNA, 25 bp, Rattus norvegicus
ctctaacccttgatgaggaccgaaa

SEQ ID NO: 267745 - DNA, 25 bp, Rattus norvegicus
ctctaacccttgttgaggaccgaaa

SEQ ID NO: 267746 - DNA, 25 bp, Rattus norvegicus
ctctaaccgggcagcatacaccagt

SEQ ID NO: 267747 - DNA, 25 bp, Rattus norvegicus
ctctaaccgggctgcatacaccagt

SEQ ID NO: 267748 - DNA, 25 bp, Rattus norvegicus
ctctaacttcacacacatcactgaa

SEQ ID NO: 267749 - DNA, 25 bp, Rattus norvegicus
ctctaacttcactcacatcactgaa

SEQ ID NO: 267750 - DNA, 25 bp, Rattus norvegicus
ctctaacttgggacaagctgacaaa

SEQ ID NO: 267751 - DNA, 25 bp, Rattus norvegicus
ctctaacttgggtcaagctgacaaa

SEQ ID NO: 267752 - DNA, 25 bp, Rattus norvegicus
ctctaactttgaagtcaggactttg

SEQ ID NO: 267753 - DNA, 25 bp, Rattus norvegicus
ctctaactttgatgtcaggactttg

SEQ ID NO: 267754 - DNA, 25 bp, Rattus norvegicus
ctctaacttttgcattctgtgtcat

SEQ ID NO: 267755 - DNA, 25 bp, Rattus norvegicus
ctctaacttttggattctgtgtcat

SEQ ID NO: 267756 - DNA, 25 bp, Rattus norvegicus
ctctaagactaaactggctcctcag

SEQ ID NO: 267757 - DNA, 25 bp, Rattus norvegicus
ctctaagactaatctggctcctcag

SEQ ID NO: 267758 - DNA, 25 bp, Rattus norvegicus
ctctaagcatctctggtttgttcat

SEQ ID NO: 267759 - DNA, 25 bp, Rattus norvegicus
ctctaagcatctgtggtttgttcat

SEQ ID NO: 267760 - DNA, 25 bp, Rattus norvegicus
ctctaagcatttaagcatttccttt

SEQ ID NO: 267761 - DNA, 25 bp, Rattus norvegicus
ctctaagcattttagcatttccttt

SEQ ID NO: 267762 - DNA, 25 bp, Rattus norvegicus
ctctaagccactccaggtctgagaa

SEQ ID NO: 267763 - DNA, 25 bp, Rattus norvegicus
ctctaagccactgcaggtctgagaa

SEQ ID NO: 267764 - DNA, 25 bp, Rattus norvegicus
ctctaagccggtataagtgatgcga

SEQ ID NO: 267765 - DNA, 25 bp, Rattus norvegicus
ctctaagccggtttaagtgatgcga

SEQ ID NO: 267766 - DNA, 25 bp, Rattus norvegicus
ctctaagctgagagtggtacgtgca

SEQ ID NO: 267767 - DNA, 25 bp, Rattus norvegicus
ctctaagctgagtgtggtacgtgca

SEQ ID NO: 267768 - DNA, 25 bp, Rattus norvegicus
ctctaataccttccttcttaccaat

SEQ ID NO: 267769 - DNA, 25 bp, Rattus norvegicus
ctctaataccttgcttcttaccaat

SEQ ID NO: 267770 - DNA, 25 bp, Rattus norvegicus
ctctaatcctttatcagctttctca

SEQ ID NO: 267771 - DNA, 25 bp, Rattus norvegicus
ctctaatcctttttcagctttctca

SEQ ID NO: 267772 - DNA, 25 bp, Rattus norvegicus
ctctaatctaaacggccagctctgg

SEQ ID NO: 267773 - DNA, 25 bp, Rattus norvegicus
ctctaatctaaagggccagctctgg

SEQ ID NO: 267774 - DNA, 25 bp, Rattus norvegicus
ctctaatctgctcagcgggagttga

SEQ ID NO: 267775 - DNA, 25 bp, Rattus norvegicus
ctctaatctgctgagcgggagttga

SEQ ID NO: 267776 - DNA, 25 bp, Rattus norvegicus
ctctaattcgaaactgtcctgcagt

SEQ ID NO: 267777 - DNA, 25 bp, Rattus norvegicus
ctctaattcgaatctgtcctgcagt

SEQ ID NO: 267778 - DNA, 25 bp, Rattus norvegicus
ctctaattgcccatttgtgcctaat

SEQ ID NO: 267779 - DNA, 25 bp, Rattus norvegicus
ctctaattgcccttttgtgcctaat

SEQ ID NO: 267780 - DNA, 25 bp, Rattus norvegicus
ctctaatttcttcaacatcttctaa

SEQ ID NO: 267781 - DNA, 25 bp, Rattus norvegicus
ctctaatttcttgaacatcttctaa

SEQ ID NO: 267782 - DNA, 25 bp, Rattus norvegicus
ctctacacacacagcttgtgaggtt

SEQ ID NO: 267783 - DNA, 25 bp, Rattus norvegicus
ctctacacacactgcttgtgaggtt

SEQ ID NO: 267784 - DNA, 25 bp, Rattus norvegicus
ctctacacatatccagtagccactg

SEQ ID NO: 267785 - DNA, 25 bp, Rattus norvegicus
ctctacacatatgcagtagccactg

SEQ ID NO: 267786 - DNA, 25 bp, Rattus norvegicus
ctctacacatgcctcactttaaata

SEQ ID NO: 267787 - DNA, 25 bp, Rattus norvegicus
ctctacacatgcgtcactttaaata

SEQ ID NO: 267788 - DNA, 25 bp, Rattus norvegicus
ctctacacctgccacgggaaaggtg

SEQ ID NO: 267789 - DNA, 25 bp, Rattus norvegicus
ctctacacctgcgacgggaaaggtg

SEQ ID NO: 267790 - DNA, 25 bp, Rattus norvegicus
ctctacagtcaacggtgcaggcaca

SEQ ID NO: 267791 - DNA, 25 bp, Rattus norvegicus
ctctacagtcaagggtgcaggcaca

SEQ ID NO: 267792 - DNA, 25 bp, Rattus norvegicus
ctctaccaccttactctgtgtaaat

SEQ ID NO: 267793 - DNA, 25 bp, Rattus norvegicus
ctctaccacctttctctgtgtaaat

SEQ ID NO: 267794 - DNA, 25 bp, Rattus norvegicus
ctctaccatcttcgtgcttagaatc

SEQ ID NO: 267795 - DNA, 25 bp, Rattus norvegicus
ctctaccatcttggtgcttagaatc

SEQ ID NO: 267796 - DNA, 25 bp, Rattus norvegicus
ctctacctatgcaattttgggaatg

SEQ ID NO: 267797 - DNA, 25 bp, Rattus norvegicus
ctctacctatgctattttgggaatg

SEQ ID NO: 267798 - DNA, 25 bp, Rattus norvegicus
ctctacctctaaagtgctggcatgc

SEQ ID NO: 267799 - DNA, 25 bp, Rattus norvegicus
ctctacctctaatgtgctggcatgc

SEQ ID NO: 267800 - DNA, 25 bp, Rattus norvegicus
ctctacctgaggcatggcacataat

SEQ ID NO: 267801 - DNA, 25 bp, Rattus norvegicus
ctctacctgagggatggcacataat

SEQ ID NO: 267802 - DNA, 25 bp, Rattus norvegicus
ctctacctggtcaaggcaaccagaa

SEQ ID NO: 267803 - DNA, 25 bp, Rattus norvegicus
ctctacctggtctaggcaaccagaa

SEQ ID NO: 267804 - DNA, 25 bp, Rattus norvegicus
ctctacgagctcagtcatgttgtca

SEQ ID NO: 267805 - DNA, 25 bp, Rattus norvegicus
ctctacgagctctgtcatgttgtca

SEQ ID NO: 267806 - DNA, 25 bp, Rattus norvegicus
ctctacgaggctatgggattccaaa

SEQ ID NO: 267807 - DNA, 25 bp, Rattus norvegicus
ctctacgaggctttgggattccaaa

SEQ ID NO: 267808 - DNA, 25 bp, Rattus norvegicus
ctctacgcagaactggccagtacaa

SEQ ID NO: 267809 - DNA, 25 bp, Rattus norvegicus
ctctacgcagaagtggccagtacaa

SEQ ID NO: 267810 - DNA, 25 bp, Rattus norvegicus
ctctacgcaggcacttgttgcccag

SEQ ID NO: 267811 - DNA, 25 bp, Rattus norvegicus
ctctacgcaggctcttgttgcccag

SEQ ID NO: 267812 - DNA, 25 bp, Rattus norvegicus
ctctacgggctacctatgtgggaga

SEQ ID NO: 267813 - DNA, 25 bp, Rattus norvegicus
ctctacgggctagctatgtgggaga

SEQ ID NO: 267814 - DNA, 25 bp, Rattus norvegicus
ctctactccctcagagagttttcaa

SEQ ID NO: 267815 - DNA, 25 bp, Rattus norvegicus
ctctactccctctgagagttttcaa

SEQ ID NO: 267816 - DNA, 25 bp, Rattus norvegicus
ctctactcctagattgctttagctg

SEQ ID NO: 267817 - DNA, 25 bp, Rattus norvegicus
ctctactcctagtttgctttagctg

SEQ ID NO: 267818 - DNA, 25 bp, Rattus norvegicus
ctctactccttaatttccattctta

SEQ ID NO: 267819 - DNA, 25 bp, Rattus norvegicus
ctctactccttattttccattctta

SEQ ID NO: 267820 - DNA, 25 bp, Rattus norvegicus
ctctactcctttcttagtctttttg

SEQ ID NO: 267821 - DNA, 25 bp, Rattus norvegicus
ctctactcctttgttagtctttttg

SEQ ID NO: 267822 - DNA, 25 bp, Rattus norvegicus
ctctactctcagacctatggagttt

SEQ ID NO: 267823 - DNA, 25 bp, Rattus norvegicus
ctctactctcagtcctatggagttt

SEQ ID NO: 267824 - DNA, 25 bp, Rattus norvegicus
ctctactgcgtgatgttcatactga

SEQ ID NO: 267825 - DNA, 25 bp, Rattus norvegicus
ctctactgcgtgttgttcatactga

SEQ ID NO: 267826 - DNA, 25 bp, Rattus norvegicus
ctctacttaagtctgttgtttccat

SEQ ID NO: 267827 - DNA, 25 bp, Rattus norvegicus
ctctacttaagtgtgttgtttccat

SEQ ID NO: 267828 - DNA, 25 bp, Rattus norvegicus
ctctacttcctgactcactgagata

SEQ ID NO: 267829 - DNA, 25 bp, Rattus norvegicus
ctctacttcctgtctcactgagata

SEQ ID NO: 267830 - DNA, 25 bp, Rattus norvegicus
ctctacttctacaatgtggatatca

SEQ ID NO: 267831 - DNA, 25 bp, Rattus norvegicus
ctctacttctactatgtggatatca

SEQ ID NO: 267832 - DNA, 25 bp, Rattus norvegicus
ctctagaatctaagaatgctgctgt

SEQ ID NO: 267833 - DNA, 25 bp, Rattus norvegicus
ctctagaatctatgaatgctgctgt

SEQ ID NO: 267834 - DNA, 25 bp, Rattus norvegicus
ctctagaatgaacagccccagattc

SEQ ID NO: 267835 - DNA, 25 bp, Rattus norvegicus
ctctagaatgaagagccccagattc

SEQ ID NO: 267836 - DNA, 25 bp, Rattus norvegicus
ctctagacctttaaggaaacatgga

SEQ ID NO: 267837 - DNA, 25 bp, Rattus norvegicus
ctctagaccttttaggaaacatgga

SEQ ID NO: 267838 - DNA, 25 bp, Rattus norvegicus
ctctagacggttactttagggccag

SEQ ID NO: 267839 - DNA, 25 bp, Rattus norvegicus
ctctagacggtttctttagggccag

SEQ ID NO: 267840 - DNA, 25 bp, Rattus norvegicus
ctctagatgtcactgtggtgccaaa

SEQ ID NO: 267841 - DNA, 25 bp, Rattus norvegicus
ctctagatgtcagtgtggtgccaaa

SEQ ID NO: 267842 - DNA, 25 bp, Rattus norvegicus
ctctagattcccatcttgttttctc

SEQ ID NO: 267843 - DNA, 25 bp, Rattus norvegicus
ctctagattcccttcttgttttctc

SEQ ID NO: 267844 - DNA, 25 bp, Rattus norvegicus
ctctagcctattataagccttcctt

SEQ ID NO: 267845 - DNA, 25 bp, Rattus norvegicus
ctctagcctattttaagccttcctt

SEQ ID NO: 267846 - DNA, 25 bp, Rattus norvegicus
ctctagcctccaactcaaatgaatt

SEQ ID NO: 267847 - DNA, 25 bp, Rattus norvegicus
ctctagcctccatctcaaatgaatt

SEQ ID NO: 267848 - DNA, 25 bp, Rattus norvegicus
ctctagcctcttagtggagcttatg

SEQ ID NO: 267849 - DNA, 25 bp, Rattus norvegicus
ctctagcctctttgtggagcttatg

SEQ ID NO: 267850 - DNA, 25 bp, Rattus norvegicus
ctctagcgttcgaacgcactgattt

SEQ ID NO: 267851 - DNA, 25 bp, Rattus norvegicus
ctctagcgttcgtacgcactgattt

SEQ ID NO: 267852 - DNA, 25 bp, Rattus norvegicus
ctctaggcttacccgcatgagctct

SEQ ID NO: 267853 - DNA, 25 bp, Rattus norvegicus
ctctaggcttacgcgcatgagctct

SEQ ID NO: 267854 - DNA, 25 bp, Rattus norvegicus
ctctaggtcggtcggctccatggca

SEQ ID NO: 267855 - DNA, 25 bp, Rattus norvegicus
ctctaggtcggtgggctccatggca

SEQ ID NO: 267856 - DNA, 25 bp, Rattus norvegicus
ctctaggtgggccttgctggctcta

SEQ ID NO: 267857 - DNA, 25 bp, Rattus norvegicus
ctctaggtgggcgttgctggctcta

SEQ ID NO: 267858 - DNA, 25 bp, Rattus norvegicus
ctctaggtttttctgtgtgtacgca

SEQ ID NO: 267859 - DNA, 25 bp, Rattus norvegicus
ctctaggtttttgtgtgtgtacgca

SEQ ID NO: 267860 - DNA, 25 bp, Rattus norvegicus
ctctagtccttgaaagattccctga

SEQ ID NO: 267861 - DNA, 25 bp, Rattus norvegicus
ctctagtccttgtaagattccctga

SEQ ID NO: 267862 - DNA, 25 bp, Rattus norvegicus
ctctagtcgaatactccaggcagga

SEQ ID NO: 267863 - DNA, 25 bp, Rattus norvegicus
ctctagtcgaattctccaggcagga

SEQ ID NO: 267864 - DNA, 25 bp, Rattus norvegicus
ctctagtctgagctgtcctgaatac

SEQ ID NO: 267865 - DNA, 25 bp, Rattus norvegicus
ctctagtctgaggtgtcctgaatac

SEQ ID NO: 267866 - DNA, 25 bp, Rattus norvegicus
ctctagtggctgactttgtaggcta

SEQ ID NO: 267867 - DNA, 25 bp, Rattus norvegicus
ctctagtggctgtctttgtaggcta

SEQ ID NO: 267868 - DNA, 25 bp, Rattus norvegicus
ctctagtttagtctgttctctgtga

SEQ ID NO: 267869 - DNA, 25 bp, Rattus norvegicus
ctctagtttagtgtgttctctgtga

SEQ ID NO: 267870 - DNA, 25 bp, Rattus norvegicus
ctctagtttgctagggtgtacacac

SEQ ID NO: 267871 - DNA, 25 bp, Rattus norvegicus
ctctagtttgcttgggtgtacacac

SEQ ID NO: 267872 - DNA, 25 bp, Rattus norvegicus
ctctatacatccctatgtctcatag

SEQ ID NO: 267873 - DNA, 25 bp, Rattus norvegicus
ctctatacatccgtatgtctcatag

SEQ ID NO: 267874 - DNA, 25 bp, Rattus norvegicus
ctctatagttagatgttgcccacag

SEQ ID NO: 267875 - DNA, 25 bp, Rattus norvegicus
ctctatagttagttgttgcccacag

SEQ ID NO: 267876 - DNA, 25 bp, Rattus norvegicus
ctctatataagcagaagtgcaccaa

SEQ ID NO: 267877 - DNA, 25 bp, Rattus norvegicus
ctctatataagctgaagtgcaccaa

SEQ ID NO: 267878 - DNA, 25 bp, Rattus norvegicus
ctctatatgagtcttttggcagtga

SEQ ID NO: 267879 - DNA, 25 bp, Rattus norvegicus
ctctatatgagtgttttggcagtga

SEQ ID NO: 267880 - DNA, 25 bp, Rattus norvegicus
ctctatcacgcgaacggggggatca

SEQ ID NO: 267881 - DNA, 25 bp, Rattus norvegicus
ctctatcacgcgtacggggggatca

SEQ ID NO: 267882 - DNA, 25 bp, Rattus norvegicus
ctctatcccattcctatcttcataa

SEQ ID NO: 267883 - DNA, 25 bp, Rattus norvegicus
ctctatcccattgctatcttcataa

SEQ ID NO: 267884 - DNA, 25 bp, Rattus norvegicus
ctctatccctctacagctaaatgga

SEQ ID NO: 267885 - DNA, 25 bp, Rattus norvegicus
ctctatccctcttcagctaaatgga

SEQ ID NO: 267886 - DNA, 25 bp, Rattus norvegicus
ctctatcctctgagtatgcatgcaa

SEQ ID NO: 267887 - DNA, 25 bp, Rattus norvegicus
ctctatcctctgtgtatgcatgcaa

SEQ ID NO: 267888 - DNA, 25 bp, Rattus norvegicus
ctctatcgtgcgattgctgtagttt

SEQ ID NO: 267889 - DNA, 25 bp, Rattus norvegicus
ctctatcgtgcgtttgctgtagttt

SEQ ID NO: 267890 - DNA, 25 bp, Rattus norvegicus
ctctatctcagcctgggaacagatg

SEQ ID NO: 267891 - DNA, 25 bp, Rattus norvegicus
ctctatctcagcgtgggaacagatg

SEQ ID NO: 267892 - DNA, 25 bp, Rattus norvegicus
ctctatctgcacaacatttctagct

SEQ ID NO: 267893 - DNA, 25 bp, Rattus norvegicus
ctctatctgcactacatttctagct

SEQ ID NO: 267894 - DNA, 25 bp, Rattus norvegicus
ctctatcttcccattctagtagcaa

SEQ ID NO: 267895 - DNA, 25 bp, Rattus norvegicus
ctctatcttccctttctagtagcaa

SEQ ID NO: 267896 - DNA, 25 bp, Rattus norvegicus
ctctatctttgtactattcacatgc

SEQ ID NO: 267897 - DNA, 25 bp, Rattus norvegicus
ctctatctttgttctattcacatgc

SEQ ID NO: 267898 - DNA, 25 bp, Rattus norvegicus
ctctatgacgatcggctctcggaag

SEQ ID NO: 267899 - DNA, 25 bp, Rattus norvegicus
ctctatgacgatgggctctcggaag

SEQ ID NO: 267900 - DNA, 25 bp, Rattus norvegicus
ctctatgatgttattgtctaatgta

SEQ ID NO: 267901 - DNA, 25 bp, Rattus norvegicus
ctctatgatgtttttgtctaatgta

SEQ ID NO: 267902 - DNA, 25 bp, Rattus norvegicus
ctctatgcctttcctctagtgttaa

SEQ ID NO: 267903 - DNA, 25 bp, Rattus norvegicus
ctctatgcctttgctctagtgttaa

SEQ ID NO: 267904 - DNA, 25 bp, Rattus norvegicus
ctctatggagtaagcacaggaccta

SEQ ID NO: 267905 - DNA, 25 bp, Rattus norvegicus
ctctatggagtatgcacaggaccta

SEQ ID NO: 267906 - DNA, 25 bp, Rattus norvegicus
ctctatggatggctgatcttcctgt

SEQ ID NO: 267907 - DNA, 25 bp, Rattus norvegicus
ctctatggatgggtgatcttcctgt

SEQ ID NO: 267908 - DNA, 25 bp, Rattus norvegicus
ctctatgtgcgcctatgctgcagga

SEQ ID NO: 267909 - DNA, 25 bp, Rattus norvegicus
ctctatgtgcgcgtatgctgcagga

SEQ ID NO: 267910 - DNA, 25 bp, Rattus norvegicus
ctctattccttgatcgccgattaca

SEQ ID NO: 267911 - DNA, 25 bp, Rattus norvegicus
ctctattccttgttcgccgattaca

SEQ ID NO: 267912 - DNA, 25 bp, Rattus norvegicus
ctctattctgctatgaccttggttc

SEQ ID NO: 267913 - DNA, 25 bp, Rattus norvegicus
ctctattctgctttgaccttggttc

SEQ ID NO: 267914 - DNA, 25 bp, Rattus norvegicus
ctctattgttgcaggagtgctcatc

SEQ ID NO: 267915 - DNA, 25 bp, Rattus norvegicus
ctctattgttgctggagtgctcatc

SEQ ID NO: 267916 - DNA, 25 bp, Rattus norvegicus
ctctatttctcacatcctctagttg

SEQ ID NO: 267917 - DNA, 25 bp, Rattus norvegicus
ctctatttctcagatcctctagttg

SEQ ID NO: 267918 - DNA, 25 bp, Rattus norvegicus
ctctattttttcatgttctcagggc

SEQ ID NO: 267919 - DNA, 25 bp, Rattus norvegicus
ctctattttttcttgttctcagggc

SEQ ID NO: 267920 - DNA, 25 bp, Rattus norvegicus
ctctcaacgataagacttccataga

SEQ ID NO: 267921 - DNA, 25 bp, Rattus norvegicus
ctctcaacgatatgacttccataga

SEQ ID NO: 267922 - DNA, 25 bp, Rattus norvegicus
ctctcaagcagaaccgaggcgacta

SEQ ID NO: 267923 - DNA, 25 bp, Rattus norvegicus
ctctcaagcagatccgaggcgacta

SEQ ID NO: 267924 - DNA, 25 bp, Rattus norvegicus
ctctcaagcagtaccatgtcaaatt

SEQ ID NO: 267925 - DNA, 25 bp, Rattus norvegicus
ctctcaagcagttccatgtcaaatt

SEQ ID NO: 267926 - DNA, 25 bp, Rattus norvegicus
ctctcaaggagtacccgctgtaggg

SEQ ID NO: 267927 - DNA, 25 bp, Rattus norvegicus
ctctcaaggagttcccgctgtaggg

SEQ ID NO: 267928 - DNA, 25 bp, Rattus norvegicus
ctctcaagtctccaggctacgtgaa

SEQ ID NO: 267929 - DNA, 25 bp, Rattus norvegicus
ctctcaagtctcgaggctacgtgaa

SEQ ID NO: 267930 - DNA, 25 bp, Rattus norvegicus
ctctcaatttggatcatttctctag

SEQ ID NO: 267931 - DNA, 25 bp, Rattus norvegicus
ctctcaatttggttcatttctctag

SEQ ID NO: 267932 - DNA, 25 bp, Rattus norvegicus
ctctcacacagcacagtagtcttag

SEQ ID NO: 267933 - DNA, 25 bp, Rattus norvegicus
ctctcacacagctcagtagtcttag

SEQ ID NO: 267934 - DNA, 25 bp, Rattus norvegicus
ctctcacagggcatagtggacacct

SEQ ID NO: 267935 - DNA, 25 bp, Rattus norvegicus
ctctcacagggcttagtggacacct

SEQ ID NO: 267936 - DNA, 25 bp, Rattus norvegicus
ctctcacccagtaggctgtatttta

SEQ ID NO: 267937 - DNA, 25 bp, Rattus norvegicus
ctctcacccagttggctgtatttta

SEQ ID NO: 267938 - DNA, 25 bp, Rattus norvegicus
ctctcacccattctgcttactaata

SEQ ID NO: 267939 - DNA, 25 bp, Rattus norvegicus
ctctcacccattgtgcttactaata

SEQ ID NO: 267940 - DNA, 25 bp, Rattus norvegicus
ctctcaccccgactaagaactgagt

SEQ ID NO: 267941 - DNA, 25 bp, Rattus norvegicus
ctctcaccccgagtaagaactgagt

SEQ ID NO: 267942 - DNA, 25 bp, Rattus norvegicus
ctctcacctccaatctacagagata

SEQ ID NO: 267943 - DNA, 25 bp, Rattus norvegicus
ctctcacctccattctacagagata

SEQ ID NO: 267944 - DNA, 25 bp, Rattus norvegicus
ctctcacctgggacttgctagaaga

SEQ ID NO: 267945 - DNA, 25 bp, Rattus norvegicus
ctctcacctgggtcttgctagaaga

SEQ ID NO: 267946 - DNA, 25 bp, Rattus norvegicus
ctctcaccttccactgtaaaaatag

SEQ ID NO: 267947 - DNA, 25 bp, Rattus norvegicus
ctctcaccttcctctgtaaaaatag

SEQ ID NO: 267948 - DNA, 25 bp, Rattus norvegicus
ctctcacgttaccgctgattctcta

SEQ ID NO: 267949 - DNA, 25 bp, Rattus norvegicus
ctctcacgttacggctgattctcta

SEQ ID NO: 267950 - DNA, 25 bp, Rattus norvegicus
ctctcactagcccagaaatttgtaa

SEQ ID NO: 267951 - DNA, 25 bp, Rattus norvegicus
ctctcactagccgagaaatttgtaa

SEQ ID NO: 267952 - DNA, 25 bp, Rattus norvegicus
ctctcacttagaaacacgttagcat

SEQ ID NO: 267953 - DNA, 25 bp, Rattus norvegicus
ctctcacttagacgaacaaggatta

SEQ ID NO: 267954 - DNA, 25 bp, Rattus norvegicus
ctctcacttagaggaacaaggatta

SEQ ID NO: 267955 - DNA, 25 bp, Rattus norvegicus
ctctcacttagatacacgttagcat

SEQ ID NO: 267956 - DNA, 25 bp, Rattus norvegicus
ctctcacttccacttcacaatgaag

SEQ ID NO: 267957 - DNA, 25 bp, Rattus norvegicus
ctctcacttccagttcacaatgaag

SEQ ID NO: 267958 - DNA, 25 bp, Rattus norvegicus
ctctcacttcctctcagattgtcaa

SEQ ID NO: 267959 - DNA, 25 bp, Rattus norvegicus
ctctcacttcctgtcagattgtcaa

SEQ ID NO: 267960 - DNA, 25 bp, Rattus norvegicus
ctctcacttttgactgtcatagcag

SEQ ID NO: 267961 - DNA, 25 bp, Rattus norvegicus
ctctcacttttgacttcattggtga

SEQ ID NO: 267962 - DNA, 25 bp, Rattus norvegicus
ctctcacttttgtctgtcatagcag

SEQ ID NO: 267963 - DNA, 25 bp, Rattus norvegicus
ctctcacttttgtcttcattggtga

SEQ ID NO: 267964 - DNA, 25 bp, Rattus norvegicus
ctctcagagaaaaaccagcgggcta

SEQ ID NO: 267965 - DNA, 25 bp, Rattus norvegicus
ctctcagagaaataccagcgggcta

SEQ ID NO: 267966 - DNA, 25 bp, Rattus norvegicus
ctctcagaggagcttctgttgcttt

SEQ ID NO: 267967 - DNA, 25 bp, Rattus norvegicus
ctctcagaggaggttctgttgcttt

SEQ ID NO: 267968 - DNA, 25 bp, Rattus norvegicus
ctctcagagtgtcgtctagttctat

SEQ ID NO: 267969 - DNA, 25 bp, Rattus norvegicus
ctctcagagtgtggtctagttctat

SEQ ID NO: 267970 - DNA, 25 bp, Rattus norvegicus
ctctcagatcagagcctctgaggga

SEQ ID NO: 267971 - DNA, 25 bp, Rattus norvegicus
ctctcagatcagtgcctctgaggga

SEQ ID NO: 267972 - DNA, 25 bp, Rattus norvegicus
ctctcagatgtcatgtttttgcttc

SEQ ID NO: 267973 - DNA, 25 bp, Rattus norvegicus
ctctcagatgtcttgtttttgcttc

SEQ ID NO: 267974 - DNA, 25 bp, Rattus norvegicus
ctctcagcacagacaataccggaag

SEQ ID NO: 267975 - DNA, 25 bp, Rattus norvegicus
ctctcagcacagtcaataccggaag

SEQ ID NO: 267976 - DNA, 25 bp, Rattus norvegicus
ctctcagcagttaagtgtcacgttt

SEQ ID NO: 267977 - DNA, 25 bp, Rattus norvegicus
ctctcagcagtttagtgtcacgttt

SEQ ID NO: 267978 - DNA, 25 bp, Rattus norvegicus
ctctcagccatgaatgggtcccaga

SEQ ID NO: 267979 - DNA, 25 bp, Rattus norvegicus
ctctcagccatgtatgggtcccaga

SEQ ID NO: 267980 - DNA, 25 bp, Rattus norvegicus
ctctcagctgttctgtgccaaatat

SEQ ID NO: 267981 - DNA, 25 bp, Rattus norvegicus
ctctcagctgttgtgtgccaaatat

SEQ ID NO: 267982 - DNA, 25 bp, Rattus norvegicus
ctctcagcttggagttcatggataa

SEQ ID NO: 267983 - DNA, 25 bp, Rattus norvegicus
ctctcagcttggtgttcatggataa

SEQ ID NO: 267984 - DNA, 25 bp, Rattus norvegicus
ctctcaggaacaccgtgctgtagat

SEQ ID NO: 267985 - DNA, 25 bp, Rattus norvegicus
ctctcaggaacagcgtgctgtagat

SEQ ID NO: 267986 - DNA, 25 bp, Rattus norvegicus
ctctcaggcaaaagtgaaacacata

SEQ ID NO: 267987 - DNA, 25 bp, Rattus norvegicus
ctctcaggcaaatgtgaaacacata

SEQ ID NO: 267988 - DNA, 25 bp, Rattus norvegicus
ctctcaggcttgcttgcttagaaga

SEQ ID NO: 267989 - DNA, 25 bp, Rattus norvegicus
ctctcaggcttggttgcttagaaga

SEQ ID NO: 267990 - DNA, 25 bp, Rattus norvegicus
ctctcagggcacactgtgaacacct

SEQ ID NO: 267991 - DNA, 25 bp, Rattus norvegicus
ctctcagggcactctgtgaacacct

SEQ ID NO: 267992 - DNA, 25 bp, Rattus norvegicus
ctctcatagcacattacccaaggat

SEQ ID NO: 267993 - DNA, 25 bp, Rattus norvegicus
ctctcatagcactttacccaaggat

SEQ ID NO: 267994 - DNA, 25 bp, Rattus norvegicus
ctctcatcaggtcagtttacatcac

SEQ ID NO: 267995 - DNA, 25 bp, Rattus norvegicus
ctctcatcaggtgagtttacatcac

SEQ ID NO: 267996 - DNA, 25 bp, Rattus norvegicus
ctctcatcggatcttctgttaatca

SEQ ID NO: 267997 - DNA, 25 bp, Rattus norvegicus
ctctcatcggatgttctgttaatca

SEQ ID NO: 267998 - DNA, 25 bp, Rattus norvegicus
ctctcatctagtattggctgtggtt

SEQ ID NO: 267999 - DNA, 25 bp, Rattus norvegicus
ctctcatctagttttggctgtggtt

SEQ ID NO: 268000 - DNA, 25 bp, Rattus norvegicus
ctctcatctgagctttactgaaagg

SEQ ID NO: 268001 - DNA, 25 bp, Rattus norvegicus
ctctcatctgaggtttactgaaagg

SEQ ID NO: 268002 - DNA, 25 bp, Rattus norvegicus
ctctcatctgttagggttaacccca

SEQ ID NO: 268003 - DNA, 25 bp, Rattus norvegicus
ctctcatctgtttgggttaacccca

SEQ ID NO: 268004 - DNA, 25 bp, Rattus norvegicus
ctctcatgatgacgtgttgtgcaat

SEQ ID NO: 268005 - DNA, 25 bp, Rattus norvegicus
ctctcatgatgaggtgttgtgcaat

SEQ ID NO: 268006 - DNA, 25 bp, Rattus norvegicus
ctctcatgctgaagtgtaccggtta

SEQ ID NO: 268007 - DNA, 25 bp, Rattus norvegicus
ctctcatgctgatgtgtaccggtta

SEQ ID NO: 268008 - DNA, 25 bp, Rattus norvegicus
ctctcatggtctccttgtcagaaga

SEQ ID NO: 268009 - DNA, 25 bp, Rattus norvegicus
ctctcatggtctgcttgtcagaaga

SEQ ID NO: 268010 - DNA, 25 bp, Rattus norvegicus
ctctcatgtactaggactgggtcac

SEQ ID NO: 268011 - DNA, 25 bp, Rattus norvegicus
ctctcatgtacttggactgggtcac

SEQ ID NO: 268012 - DNA, 25 bp, Rattus norvegicus
ctctcattaaccagacaccaagtag

SEQ ID NO: 268013 - DNA, 25 bp, Rattus norvegicus
ctctcattaacctgacaccaagtag

SEQ ID NO: 268014 - DNA, 25 bp, Rattus norvegicus
ctctcattaattctccctgggaaca

SEQ ID NO: 268015 - DNA, 25 bp, Rattus norvegicus
ctctcattaattgtccctgggaaca

SEQ ID NO: 268016 - DNA, 25 bp, Rattus norvegicus
ctctcattccttcccgagcggaggg

SEQ ID NO: 268017 - DNA, 25 bp, Rattus norvegicus
ctctcattccttgccgagcggaggg

SEQ ID NO: 268018 - DNA, 25 bp, Rattus norvegicus
ctctcattcttcatttcacaatcca

SEQ ID NO: 268019 - DNA, 25 bp, Rattus norvegicus
ctctcattcttcttttcacaatcca

SEQ ID NO: 268020 - DNA, 25 bp, Rattus norvegicus
ctctcattctttatggtttagggat

SEQ ID NO: 268021 - DNA, 25 bp, Rattus norvegicus
ctctcattctttttggtttagggat

SEQ ID NO: 268022 - DNA, 25 bp, Rattus norvegicus
ctctcattgctaccgtgtctggaaa

SEQ ID NO: 268023 - DNA, 25 bp, Rattus norvegicus
ctctcattgctagcgtgtctggaaa

SEQ ID NO: 268024 - DNA, 25 bp, Rattus norvegicus
ctctcatttagtcgaggtcaatctg

SEQ ID NO: 268025 - DNA, 25 bp, Rattus norvegicus
ctctcatttagtggaggtcaatctg

SEQ ID NO: 268026 - DNA, 25 bp, Rattus norvegicus
ctctcatttcccaacaaagcactgg

SEQ ID NO: 268027 - DNA, 25 bp, Rattus norvegicus
ctctcatttccctacaaagcactgg

SEQ ID NO: 268028 - DNA, 25 bp, Rattus norvegicus
ctctcattttgtatgggatgtccac

SEQ ID NO: 268029 - DNA, 25 bp, Rattus norvegicus
ctctcattttgtttgggatgtccac

SEQ ID NO: 268030 - DNA, 25 bp, Rattus norvegicus
ctctcatttttcctactcatactaa

SEQ ID NO: 268031 - DNA, 25 bp, Rattus norvegicus
ctctcatttttcgtactcatactaa

SEQ ID NO: 268032 - DNA, 25 bp, Rattus norvegicus
ctctccaaagcccaaagggataaat

SEQ ID NO: 268033 - DNA, 25 bp, Rattus norvegicus
ctctccaaagccgaaagggataaat

SEQ ID NO: 268034 - DNA, 25 bp, Rattus norvegicus
ctctccaaatctccatttcctagga

SEQ ID NO: 268035 - DNA, 25 bp, Rattus norvegicus
ctctccaaatctgcatttcctagga

SEQ ID NO: 268036 - DNA, 25 bp, Rattus norvegicus
ctctccaacctccttcatgttatga

SEQ ID NO: 268037 - DNA, 25 bp, Rattus norvegicus
ctctccaacctcgttcatgttatga

SEQ ID NO: 268038 - DNA, 25 bp, Rattus norvegicus
ctctccaagagcacagggttattac

SEQ ID NO: 268039 - DNA, 25 bp, Rattus norvegicus
ctctccaagagctcagggttattac

SEQ ID NO: 268040 - DNA, 25 bp, Rattus norvegicus
ctctccaatgctcatcgcttgtgaa

SEQ ID NO: 268041 - DNA, 25 bp, Rattus norvegicus
ctctccaatgctgatcgcttgtgaa

SEQ ID NO: 268042 - DNA, 25 bp, Rattus norvegicus
ctctccaccttcagtattgagtcaa

SEQ ID NO: 268043 - DNA, 25 bp, Rattus norvegicus
ctctccaccttctgtattgagtcaa

SEQ ID NO: 268044 - DNA, 25 bp, Rattus norvegicus
ctctccacggcactttctgatgaat

SEQ ID NO: 268045 - DNA, 25 bp, Rattus norvegicus
ctctccacggcagtttctgatgaat

SEQ ID NO: 268046 - DNA, 25 bp, Rattus norvegicus
ctctccagatgccagtacgaagaca

SEQ ID NO: 268047 - DNA, 25 bp, Rattus norvegicus
ctctccagatgcgagtacgaagaca

SEQ ID NO: 268048 - DNA, 25 bp, Rattus norvegicus
ctctccagcccgagggttctacttt

SEQ ID NO: 268049 - DNA, 25 bp, Rattus norvegicus
ctctccagcccgtgggttctacttt

SEQ ID NO: 268050 - DNA, 25 bp, Rattus norvegicus
ctctccagccctaattttgtgaagc

SEQ ID NO: 268051 - DNA, 25 bp, Rattus norvegicus
ctctccagccctagaactagtgtta

SEQ ID NO: 268052 - DNA, 25 bp, Rattus norvegicus
ctctccagcccttattttgtgaagc

SEQ ID NO: 268053 - DNA, 25 bp, Rattus norvegicus
ctctccagcccttgaactagtgtta

SEQ ID NO: 268054 - DNA, 25 bp, Rattus norvegicus
ctctccagggtcaaatgttccattt

SEQ ID NO: 268055 - DNA, 25 bp, Rattus norvegicus
ctctccagggtctaatgttccattt

SEQ ID NO: 268056 - DNA, 25 bp, Rattus norvegicus
ctctccagttggcttttcagctaga

SEQ ID NO: 268057 - DNA, 25 bp, Rattus norvegicus
ctctccagttgggttttcagctaga

SEQ ID NO: 268058 - DNA, 25 bp, Rattus norvegicus
ctctccatcaagctcttcattagct

SEQ ID NO: 268059 - DNA, 25 bp, Rattus norvegicus
ctctccatcaaggtcttcattagct

SEQ ID NO: 268060 - DNA, 25 bp, Rattus norvegicus
ctctccatcactctgaacacatggg

SEQ ID NO: 268061 - DNA, 25 bp, Rattus norvegicus
ctctccatcactgtgaacacatggg

SEQ ID NO: 268062 - DNA, 25 bp, Rattus norvegicus
ctctccatcgctaacaaactgatca

SEQ ID NO: 268063 - DNA, 25 bp, Rattus norvegicus
ctctccatcgcttacaaactgatca

SEQ ID NO: 268064 - DNA, 25 bp, Rattus norvegicus
ctctccatctctcagtgtcgtgaaa

SEQ ID NO: 268065 - DNA, 25 bp, Rattus norvegicus
ctctccatctctgagtgtcgtgaaa

SEQ ID NO: 268066 - DNA, 25 bp, Rattus norvegicus
ctctccatgtaaccgcagatttgct

SEQ ID NO: 268067 - DNA, 25 bp, Rattus norvegicus
ctctccatgtaagcgcagatttgct

SEQ ID NO: 268068 - DNA, 25 bp, Rattus norvegicus
ctctccattgcacccagaagttata

SEQ ID NO: 268069 - DNA, 25 bp, Rattus norvegicus
ctctccattgcagccagaagttata

SEQ ID NO: 268070 - DNA, 25 bp, Rattus norvegicus
ctctcccaccaaccttgtggtagaa

SEQ ID NO: 268071 - DNA, 25 bp, Rattus norvegicus
ctctcccaccaagcttgtggtagaa

SEQ ID NO: 268072 - DNA, 25 bp, Rattus norvegicus
ctctcccaggagatgaccaagtcat

SEQ ID NO: 268073 - DNA, 25 bp, Rattus norvegicus
ctctcccaggagttgaccaagtcat

SEQ ID NO: 268074 - DNA, 25 bp, Rattus norvegicus
ctctccccatatcctgtagtttata

SEQ ID NO: 268075 - DNA, 25 bp, Rattus norvegicus
ctctccccatatgctgtagtttata

SEQ ID NO: 268076 - DNA, 25 bp, Rattus norvegicus
ctctcccctagcatgggttgaagga

SEQ ID NO: 268077 - DNA, 25 bp, Rattus norvegicus
ctctcccctagcttgggttgaagga

SEQ ID NO: 268078 - DNA, 25 bp, Rattus norvegicus
ctctcccctgatcagcatagttgaa

SEQ ID NO: 268079 - DNA, 25 bp, Rattus norvegicus
ctctcccctgatgagcatagttgaa

SEQ ID NO: 268080 - DNA, 25 bp, Rattus norvegicus
ctctcccctgcactgtaaaatgttg

SEQ ID NO: 268081 - DNA, 25 bp, Rattus norvegicus
ctctcccctgcagtgtaaaatgttg

SEQ ID NO: 268082 - DNA, 25 bp, Rattus norvegicus
ctctcccctttgaaagttgctgaaa

SEQ ID NO: 268083 - DNA, 25 bp, Rattus norvegicus
ctctcccctttgtaagttgctgaaa

SEQ ID NO: 268084 - DNA, 25 bp, Rattus norvegicus
ctctcccgatgtcatggtataagtg

SEQ ID NO: 268085 - DNA, 25 bp, Rattus norvegicus
ctctcccgatgtgatggtataagtg

SEQ ID NO: 268086 - DNA, 25 bp, Rattus norvegicus
ctctcccgggaactggaaccatgag

SEQ ID NO: 268087 - DNA, 25 bp, Rattus norvegicus
ctctcccgggaagtggaaccatgag

SEQ ID NO: 268088 - DNA, 25 bp, Rattus norvegicus
ctctccctagtgattctgatggcag

SEQ ID NO: 268089 - DNA, 25 bp, Rattus norvegicus
ctctccctagtgtttctgatggcag

SEQ ID NO: 268090 - DNA, 25 bp, Rattus norvegicus
ctctccctccttcgtatatgtacaa

SEQ ID NO: 268091 - DNA, 25 bp, Rattus norvegicus
ctctccctccttggtatatgtacaa

SEQ ID NO: 268092 - DNA, 25 bp, Rattus norvegicus
ctctccctgagtcatcattggctga

SEQ ID NO: 268093 - DNA, 25 bp, Rattus norvegicus
ctctccctgagtgatcattggctga

SEQ ID NO: 268094 - DNA, 25 bp, Rattus norvegicus
ctctccctggagacatgatgctgtg

SEQ ID NO: 268095 - DNA, 25 bp, Rattus norvegicus
ctctccctggagtcatgatgctgtg

SEQ ID NO: 268096 - DNA, 25 bp, Rattus norvegicus
ctctccctggtgcttgttgggattt

SEQ ID NO: 268097 - DNA, 25 bp, Rattus norvegicus
ctctccctggtggttgttgggattt

SEQ ID NO: 268098 - DNA, 25 bp, Rattus norvegicus
ctctccctgtgcagtttttgtttga

SEQ ID NO: 268099 - DNA, 25 bp, Rattus norvegicus
ctctccctgtgctgtttttgtttga

SEQ ID NO: 268100 - DNA, 25 bp, Rattus norvegicus
ctctccgaccacataacgtgttttt

SEQ ID NO: 268101 - DNA, 25 bp, Rattus norvegicus
ctctccgaccacttaacgtgttttt

SEQ ID NO: 268102 - DNA, 25 bp, Rattus norvegicus
ctctccgaccagagccgggcaggaa

SEQ ID NO: 268103 - DNA, 25 bp, Rattus norvegicus
ctctccgaccagtgccgggcaggaa

SEQ ID NO: 268104 - DNA, 25 bp, Rattus norvegicus
ctctccgatgctctgatgttcataa

SEQ ID NO: 268105 - DNA, 25 bp, Rattus norvegicus
ctctccgatgctgtgatgttcataa

SEQ ID NO: 268106 - DNA, 25 bp, Rattus norvegicus
ctctccgattctaaccatcaggata

SEQ ID NO: 268107 - DNA, 25 bp, Rattus norvegicus
ctctccgattcttaccatcaggata

SEQ ID NO: 268108 - DNA, 25 bp, Rattus norvegicus
ctctccgcacagatgatggtgacct

SEQ ID NO: 268109 - DNA, 25 bp, Rattus norvegicus
ctctccgcacagttgatggtgacct

SEQ ID NO: 268110 - DNA, 25 bp, Rattus norvegicus
ctctccgggcttcggaaagctgcga

SEQ ID NO: 268111 - DNA, 25 bp, Rattus norvegicus
ctctccgggcttgggaaagctgcga

SEQ ID NO: 268112 - DNA, 25 bp, Rattus norvegicus
ctctccgtagttcattctctgaaga

SEQ ID NO: 268113 - DNA, 25 bp, Rattus norvegicus
ctctccgtagttgattctctgaaga

SEQ ID NO: 268114 - DNA, 25 bp, Rattus norvegicus
ctctccgtcataaccttatattcta

SEQ ID NO: 268115 - DNA, 25 bp, Rattus norvegicus
ctctccgtcatatccttatattcta

SEQ ID NO: 268116 - DNA, 25 bp, Rattus norvegicus
ctctccgtgggaagtggttctcaag

SEQ ID NO: 268117 - DNA, 25 bp, Rattus norvegicus
ctctccgtgggatgtggttctcaag

SEQ ID NO: 268118 - DNA, 25 bp, Rattus norvegicus
ctctcctaaatcaacctggttggtt

SEQ ID NO: 268119 - DNA, 25 bp, Rattus norvegicus
ctctcctaaatctacctggttggtt

SEQ ID NO: 268120 - DNA, 25 bp, Rattus norvegicus
ctctcctaattcacagagaccttaa

SEQ ID NO: 268121 - DNA, 25 bp, Rattus norvegicus
ctctcctaattctcagagaccttaa

SEQ ID NO: 268122 - DNA, 25 bp, Rattus norvegicus
ctctcctacatgatctttacttgac

SEQ ID NO: 268123 - DNA, 25 bp, Rattus norvegicus
ctctcctacatgttctttacttgac

SEQ ID NO: 268124 - DNA, 25 bp, Rattus norvegicus
ctctcctacctgcatcagtcatgat

SEQ ID NO: 268125 - DNA, 25 bp, Rattus norvegicus
ctctcctacctggatcagtcatgat

SEQ ID NO: 268126 - DNA, 25 bp, Rattus norvegicus
ctctcctagctcattgtctattaga

SEQ ID NO: 268127 - DNA, 25 bp, Rattus norvegicus
ctctcctagctctttgtctattaga

SEQ ID NO: 268128 - DNA, 25 bp, Rattus norvegicus
ctctcctcattgcattgggcattag

SEQ ID NO: 268129 - DNA, 25 bp, Rattus norvegicus
ctctcctcattggattgggcattag

SEQ ID NO: 268130 - DNA, 25 bp, Rattus norvegicus
ctctcctcatttctctaagtgacag

SEQ ID NO: 268131 - DNA, 25 bp, Rattus norvegicus
ctctcctcatttgtctaagtgacag

SEQ ID NO: 268132 - DNA, 25 bp, Rattus norvegicus
ctctcctccacacttgttatattta

SEQ ID NO: 268133 - DNA, 25 bp, Rattus norvegicus
ctctcctccacagttgttatattta

SEQ ID NO: 268134 - DNA, 25 bp, Rattus norvegicus
ctctcctcctcaaataactcattaa

SEQ ID NO: 268135 - DNA, 25 bp, Rattus norvegicus
ctctcctcctcatataactcattaa

SEQ ID NO: 268136 - DNA, 25 bp, Rattus norvegicus
ctctcctcctttaactctatgaaat

SEQ ID NO: 268137 - DNA, 25 bp, Rattus norvegicus
ctctcctccttttactctatgaaat

SEQ ID NO: 268138 - DNA, 25 bp, Rattus norvegicus
ctctcctcgttgactataactcttt

SEQ ID NO: 268139 - DNA, 25 bp, Rattus norvegicus
ctctcctcgttgtctataactcttt

SEQ ID NO: 268140 - DNA, 25 bp, Rattus norvegicus
ctctcctctcagagacaaccaaaga

SEQ ID NO: 268141 - DNA, 25 bp, Rattus norvegicus
ctctcctctcagtgacaaccaaaga

SEQ ID NO: 268142 - DNA, 25 bp, Rattus norvegicus
ctctcctctccacattgagtttgta

SEQ ID NO: 268143 - DNA, 25 bp, Rattus norvegicus
ctctcctctccagattgagtttgta

SEQ ID NO: 268144 - DNA, 25 bp, Rattus norvegicus
ctctcctgaaagcttctcctaaaaa

SEQ ID NO: 268145 - DNA, 25 bp, Rattus norvegicus
ctctcctgaaaggttctcctaaaaa

SEQ ID NO: 268146 - DNA, 25 bp, Rattus norvegicus
ctctcctgagctctcaagctactaa

SEQ ID NO: 268147 - DNA, 25 bp, Rattus norvegicus
ctctcctgagctgtcaagctactaa

SEQ ID NO: 268148 - DNA, 25 bp, Rattus norvegicus
ctctcctggactctgcatgatggta

SEQ ID NO: 268149 - DNA, 25 bp, Rattus norvegicus
ctctcctggactgtgcatgatggta

SEQ ID NO: 268150 - DNA, 25 bp, Rattus norvegicus
ctctcctggataaccttgtgttgta

SEQ ID NO: 268151 - DNA, 25 bp, Rattus norvegicus
ctctcctggatatccttgtgttgta

SEQ ID NO: 268152 - DNA, 25 bp, Rattus norvegicus
ctctcctgggctacatttatttttt

SEQ ID NO: 268153 - DNA, 25 bp, Rattus norvegicus
ctctcctgggcttcatttatttttt

SEQ ID NO: 268154 - DNA, 25 bp, Rattus norvegicus
ctctcctgtttcatgataataaata

SEQ ID NO: 268155 - DNA, 25 bp, Rattus norvegicus
ctctcctgtttcttgataataaata

SEQ ID NO: 268156 - DNA, 25 bp, Rattus norvegicus
ctctcctgttttctgtatacgttca

SEQ ID NO: 268157 - DNA, 25 bp, Rattus norvegicus
ctctcctgttttgtgtatacgttca

SEQ ID NO: 268158 - DNA, 25 bp, Rattus norvegicus
ctctccttcctaattgtgggtgcaa

SEQ ID NO: 268159 - DNA, 25 bp, Rattus norvegicus
ctctccttcctatttgtgggtgcaa

SEQ ID NO: 268160 - DNA, 25 bp, Rattus norvegicus
ctctccttggatatcttctcagtaa

SEQ ID NO: 268161 - DNA, 25 bp, Rattus norvegicus
ctctccttggatttcttctcagtaa

SEQ ID NO: 268162 - DNA, 25 bp, Rattus norvegicus
ctctcctttgtgacagtctctaaaa

SEQ ID NO: 268163 - DNA, 25 bp, Rattus norvegicus
ctctcctttgtgtcagtctctaaaa

SEQ ID NO: 268164 - DNA, 25 bp, Rattus norvegicus
ctctcgagagttccagatcctgtat

SEQ ID NO: 268165 - DNA, 25 bp, Rattus norvegicus
ctctcgagagttgcagatcctgtat

SEQ ID NO: 268166 - DNA, 25 bp, Rattus norvegicus
ctctcgatcgcgagacggttgtcgc

SEQ ID NO: 268167 - DNA, 25 bp, Rattus norvegicus
ctctcgatcgcgtgacggttgtcgc

SEQ ID NO: 268168 - DNA, 25 bp, Rattus norvegicus
ctctcgcactggagaaaatcggcca

SEQ ID NO: 268169 - DNA, 25 bp, Rattus norvegicus
ctctcgcactggtgaaaatcggcca

SEQ ID NO: 268170 - DNA, 25 bp, Rattus norvegicus
ctctcgcatgttaaatgacaaccgt

SEQ ID NO: 268171 - DNA, 25 bp, Rattus norvegicus
ctctcgcatgtttaatgacaaccgt

SEQ ID NO: 268172 - DNA, 25 bp, Rattus norvegicus
ctctcgcctgctcgatgagttggaa

SEQ ID NO: 268173 - DNA, 25 bp, Rattus norvegicus
ctctcgcctgctggatgagttggaa

SEQ ID NO: 268174 - DNA, 25 bp, Rattus norvegicus
ctctcgctacctccctggaataaat

SEQ ID NO: 268175 - DNA, 25 bp, Rattus norvegicus
ctctcgctacctgcctggaataaat

SEQ ID NO: 268176 - DNA, 25 bp, Rattus norvegicus
ctctcgctcgtgagaactcggtgcg

SEQ ID NO: 268177 - DNA, 25 bp, Rattus norvegicus
ctctcgctcgtgtgaactcggtgcg

SEQ ID NO: 268178 - DNA, 25 bp, Rattus norvegicus
ctctcgctgagcaaggtctgacaat

SEQ ID NO: 268179 - DNA, 25 bp, Rattus norvegicus
ctctcgctgagctaggtctgacaat

SEQ ID NO: 268180 - DNA, 25 bp, Rattus norvegicus
ctctcggacggaccagaggacctgt

SEQ ID NO: 268181 - DNA, 25 bp, Rattus norvegicus
ctctcggacggagcagaggacctgt

SEQ ID NO: 268182 - DNA, 25 bp, Rattus norvegicus
ctctcggcctcacaggtccaggctc

SEQ ID NO: 268183 - DNA, 25 bp, Rattus norvegicus
ctctcggcctcagaggtccaggctc

SEQ ID NO: 268184 - DNA, 25 bp, Rattus norvegicus
ctctcggcttggcagcctgtaacct

SEQ ID NO: 268185 - DNA, 25 bp, Rattus norvegicus
ctctcggcttgggagcctgtaacct

SEQ ID NO: 268186 - DNA, 25 bp, Rattus norvegicus
ctctcgggctgcatcagggtcacag

SEQ ID NO: 268187 - DNA, 25 bp, Rattus norvegicus
ctctcgggctgcttcagggtcacag

SEQ ID NO: 268188 - DNA, 25 bp, Rattus norvegicus
ctctcgggcttgctcatttcaagaa

SEQ ID NO: 268189 - DNA, 25 bp, Rattus norvegicus
ctctcgggcttggtcatttcaagaa

SEQ ID NO: 268190 - DNA, 25 bp, Rattus norvegicus
ctctcgggttccatcattacaaatg

SEQ ID NO: 268191 - DNA, 25 bp, Rattus norvegicus
ctctcgggttccttcattacaaatg

SEQ ID NO: 268192 - DNA, 25 bp, Rattus norvegicus
ctctcggtggacctctcaagggccg

SEQ ID NO: 268193 - DNA, 25 bp, Rattus norvegicus
ctctcggtggacgtctcaagggccg

SEQ ID NO: 268194 - DNA, 25 bp, Rattus norvegicus
ctctcggttaccaggcttacaagaa

SEQ ID NO: 268195 - DNA, 25 bp, Rattus norvegicus
ctctcggttacctggcttacaagaa

SEQ ID NO: 268196 - DNA, 25 bp, Rattus norvegicus
ctctcgtaagctacggtggcaatac

SEQ ID NO: 268197 - DNA, 25 bp, Rattus norvegicus
ctctcgtaagcttcggtggcaatac

SEQ ID NO: 268198 - DNA, 25 bp, Rattus norvegicus
ctctcgtcaaccctggtttcaaaag

SEQ ID NO: 268199 - DNA, 25 bp, Rattus norvegicus
ctctcgtcaaccgtggtttcaaaag

SEQ ID NO: 268200 - DNA, 25 bp, Rattus norvegicus
ctctcgtgcagacgcgcccagatta

SEQ ID NO: 268201 - DNA, 25 bp, Rattus norvegicus
ctctcgtgcagaggcgcccagatta

SEQ ID NO: 268202 - DNA, 25 bp, Rattus norvegicus
ctctcgtgttataccagtcacatat

SEQ ID NO: 268203 - DNA, 25 bp, Rattus norvegicus
ctctcgtgttattccagtcacatat

SEQ ID NO: 268204 - DNA, 25 bp, Rattus norvegicus
ctctctaatctgaactatatttcta

SEQ ID NO: 268205 - DNA, 25 bp, Rattus norvegicus
ctctctaatctgtactatatttcta

SEQ ID NO: 268206 - DNA, 25 bp, Rattus norvegicus
ctctctacaagaagcacccacagta

SEQ ID NO: 268207 - DNA, 25 bp, Rattus norvegicus
ctctctacaagatgcacccacagta

SEQ ID NO: 268208 - DNA, 25 bp, Rattus norvegicus
ctctctacagtgaccatattcctta

SEQ ID NO: 268209 - DNA, 25 bp, Rattus norvegicus
ctctctacagtgtccatattcctta

SEQ ID NO: 268210 - DNA, 25 bp, Rattus norvegicus
ctctctaccccaaggacttagtgtc

SEQ ID NO: 268211 - DNA, 25 bp, Rattus norvegicus
ctctctaccccatggacttagtgtc

SEQ ID NO: 268212 - DNA, 25 bp, Rattus norvegicus
ctctctacctgcataacattttcta

SEQ ID NO: 268213 - DNA, 25 bp, Rattus norvegicus
ctctctacctgcttaacattttcta

SEQ ID NO: 268214 - DNA, 25 bp, Rattus norvegicus
ctctctactctgaatttctttggat

SEQ ID NO: 268215 - DNA, 25 bp, Rattus norvegicus
ctctctactctgtatttctttggat

SEQ ID NO: 268216 - DNA, 25 bp, Rattus norvegicus
ctctctagctgtctgatcttcccaa

SEQ ID NO: 268217 - DNA, 25 bp, Rattus norvegicus
ctctctagctgtgtgatcttcccaa

SEQ ID NO: 268218 - DNA, 25 bp, Rattus norvegicus
ctctctattttcagttgctctcctt

SEQ ID NO: 268219 - DNA, 25 bp, Rattus norvegicus
ctctctattttctgttgctctcctt

SEQ ID NO: 268220 - DNA, 25 bp, Rattus norvegicus
ctctctcaacttcctgtacttaaaa

SEQ ID NO: 268221 - DNA, 25 bp, Rattus norvegicus
ctctctcaacttctttttctgtgac

SEQ ID NO: 268222 - DNA, 25 bp, Rattus norvegicus
ctctctcaacttgctgtacttaaaa

SEQ ID NO: 268223 - DNA, 25 bp, Rattus norvegicus
ctctctcaacttgtttttctgtgac

SEQ ID NO: 268224 - DNA, 25 bp, Rattus norvegicus
ctctctcacggtcggtagcatgttg

SEQ ID NO: 268225 - DNA, 25 bp, Rattus norvegicus
ctctctcacggtgggtagcatgttg

SEQ ID NO: 268226 - DNA, 25 bp, Rattus norvegicus
ctctctcactgcagtgattaactga

SEQ ID NO: 268227 - DNA, 25 bp, Rattus norvegicus
ctctctcactgctgtgattaactga

SEQ ID NO: 268228 - DNA, 25 bp, Rattus norvegicus
ctctctcagaagctgctgggccaag

SEQ ID NO: 268229 - DNA, 25 bp, Rattus norvegicus
ctctctcagaaggtgctgggccaag

SEQ ID NO: 268230 - DNA, 25 bp, Rattus norvegicus
ctctctcagacaacaagccggtttg

SEQ ID NO: 268231 - DNA, 25 bp, Rattus norvegicus
ctctctcagacatcaagccggtttg

SEQ ID NO: 268232 - DNA, 25 bp, Rattus norvegicus
ctctctcatgtgctggacttaggca

SEQ ID NO: 268233 - DNA, 25 bp, Rattus norvegicus
ctctctcatgtggtggacttaggca

SEQ ID NO: 268234 - DNA, 25 bp, Rattus norvegicus
ctctctcattccctattaggtaaat

SEQ ID NO: 268235 - DNA, 25 bp, Rattus norvegicus
ctctctcattccgtattaggtaaat

SEQ ID NO: 268236 - DNA, 25 bp, Rattus norvegicus
ctctctcattctctgtgtctcacat

SEQ ID NO: 268237 - DNA, 25 bp, Rattus norvegicus
ctctctcattctgtgtgtctcacat

SEQ ID NO: 268238 - DNA, 25 bp, Rattus norvegicus
ctctctcatttcaattctggctcac

SEQ ID NO: 268239 - DNA, 25 bp, Rattus norvegicus
ctctctcatttctattctggctcac

SEQ ID NO: 268240 - DNA, 25 bp, Rattus norvegicus
ctctctcattttatagggagggagg

SEQ ID NO: 268241 - DNA, 25 bp, Rattus norvegicus
ctctctcattttttagggagggagg

SEQ ID NO: 268242 - DNA, 25 bp, Rattus norvegicus
ctctctccatctatctttcaaatgt

SEQ ID NO: 268243 - DNA, 25 bp, Rattus norvegicus
ctctctccatctttctttcaaatgt

SEQ ID NO: 268244 - DNA, 25 bp, Rattus norvegicus
ctctctcccagacaggtgtatgttt

SEQ ID NO: 268245 - DNA, 25 bp, Rattus norvegicus
ctctctcccagagaggtgtatgttt

SEQ ID NO: 268246 - DNA, 25 bp, Rattus norvegicus
ctctctccccacatgtatagaatta

SEQ ID NO: 268247 - DNA, 25 bp, Rattus norvegicus
ctctctccccacttgtatagaatta

SEQ ID NO: 268248 - DNA, 25 bp, Rattus norvegicus
ctctctcccggtagtatatttgaaa

SEQ ID NO: 268249 - DNA, 25 bp, Rattus norvegicus
ctctctcccggttgtatatttgaaa

SEQ ID NO: 268250 - DNA, 25 bp, Rattus norvegicus
ctctctccctccatatttattatta

SEQ ID NO: 268251 - DNA, 25 bp, Rattus norvegicus
ctctctccctccttatttattatta

SEQ ID NO: 268252 - DNA, 25 bp, Rattus norvegicus
ctctctccctgcctttagaaaagat

SEQ ID NO: 268253 - DNA, 25 bp, Rattus norvegicus
ctctctccctgcgtttagaaaagat

SEQ ID NO: 268254 - DNA, 25 bp, Rattus norvegicus
ctctctcccttaccaactttatatg

SEQ ID NO: 268255 - DNA, 25 bp, Rattus norvegicus
ctctctcccttagcaactttatatg

SEQ ID NO: 268256 - DNA, 25 bp, Rattus norvegicus
ctctctccctttattatggcatctt

SEQ ID NO: 268257 - DNA, 25 bp, Rattus norvegicus
ctctctcccttttttatggcatctt

SEQ ID NO: 268258 - DNA, 25 bp, Rattus norvegicus
ctctctccgtttaaagtctacgtgt

SEQ ID NO: 268259 - DNA, 25 bp, Rattus norvegicus
ctctctccgtttctacagaaggttg

SEQ ID NO: 268260 - DNA, 25 bp, Rattus norvegicus
ctctctccgtttgtacagaaggttg

SEQ ID NO: 268261 - DNA, 25 bp, Rattus norvegicus
ctctctccgttttaagtctacgtgt

SEQ ID NO: 268262 - DNA, 25 bp, Rattus norvegicus
ctctctcctcaaatgtatctttcaa

SEQ ID NO: 268263 - DNA, 25 bp, Rattus norvegicus
ctctctcctcaattgtatctttcaa

SEQ ID NO: 268264 - DNA, 25 bp, Rattus norvegicus
ctctctcctcagcttagcagtggaa

SEQ ID NO: 268265 - DNA, 25 bp, Rattus norvegicus
ctctctcctcaggttagcagtggaa

SEQ ID NO: 268266 - DNA, 25 bp, Rattus norvegicus
ctctctcctcataagctaagcatcg

SEQ ID NO: 268267 - DNA, 25 bp, Rattus norvegicus
ctctctcctcattagctaagcatcg

SEQ ID NO: 268268 - DNA, 25 bp, Rattus norvegicus
ctctctccttggcataagctatcct

SEQ ID NO: 268269 - DNA, 25 bp, Rattus norvegicus
ctctctccttgggataagctatcct

SEQ ID NO: 268270 - DNA, 25 bp, Rattus norvegicus
ctctctcctttcaaagtactaggac

SEQ ID NO: 268271 - DNA, 25 bp, Rattus norvegicus
ctctctcctttctaagtactaggac

SEQ ID NO: 268272 - DNA, 25 bp, Rattus norvegicus
ctctctcgagaaactgtactgtcct

SEQ ID NO: 268273 - DNA, 25 bp, Rattus norvegicus
ctctctcgagaatctgtactgtcct

SEQ ID NO: 268274 - DNA, 25 bp, Rattus norvegicus
ctctctcgaggtaactttgcagcaa

SEQ ID NO: 268275 - DNA, 25 bp, Rattus norvegicus
ctctctcgaggttactttgcagcaa

SEQ ID NO: 268276 - DNA, 25 bp, Rattus norvegicus
ctctctcgctttaccaaacaaaacg

SEQ ID NO: 268277 - DNA, 25 bp, Rattus norvegicus
ctctctcgcttttccaaacaaaacg

SEQ ID NO: 268278 - DNA, 25 bp, Rattus norvegicus
ctctctcggaatctgaagagccaga

SEQ ID NO: 268279 - DNA, 25 bp, Rattus norvegicus
ctctctcggaatgtgaagagccaga

SEQ ID NO: 268280 - DNA, 25 bp, Rattus norvegicus
ctctctcgttttctggaccctggag

SEQ ID NO: 268281 - DNA, 25 bp, Rattus norvegicus
ctctctcgttttgtggaccctggag

SEQ ID NO: 268282 - DNA, 25 bp, Rattus norvegicus
ctctctctagagctttgtctcagct

SEQ ID NO: 268283 - DNA, 25 bp, Rattus norvegicus
ctctctctagaggtttgtctcagct

SEQ ID NO: 268284 - DNA, 25 bp, Rattus norvegicus
ctctctctattaaacaccagtgtgt

SEQ ID NO: 268285 - DNA, 25 bp, Rattus norvegicus
ctctctctattatacaccagtgtgt

SEQ ID NO: 268286 - DNA, 25 bp, Rattus norvegicus
ctctctctcaggcttatgaccagga

SEQ ID NO: 268287 - DNA, 25 bp, Rattus norvegicus
ctctctctcagggttatgaccagga

SEQ ID NO: 268288 - DNA, 25 bp, Rattus norvegicus
ctctctctccgtcgcaatgtatatg

SEQ ID NO: 268289 - DNA, 25 bp, Rattus norvegicus
ctctctctccgtggcaatgtatatg

SEQ ID NO: 268290 - DNA, 25 bp, Rattus norvegicus
ctctctctgaggacaatgacttggt

SEQ ID NO: 268291 - DNA, 25 bp, Rattus norvegicus
ctctctctgaggtcaatgacttggt

SEQ ID NO: 268292 - DNA, 25 bp, Rattus norvegicus
ctctctctggagcttgaatcaatat

SEQ ID NO: 268293 - DNA, 25 bp, Rattus norvegicus
ctctctctggaggttgaatcaatat

SEQ ID NO: 268294 - DNA, 25 bp, Rattus norvegicus
ctctctctgggcatgttgattcgga

SEQ ID NO: 268295 - DNA, 25 bp, Rattus norvegicus
ctctctctgggcttgttgattcgga

SEQ ID NO: 268296 - DNA, 25 bp, Rattus norvegicus
ctctctctgtcgaagtatccaatgc

SEQ ID NO: 268297 - DNA, 25 bp, Rattus norvegicus
ctctctctgtcgtagtatccaatgc

SEQ ID NO: 268298 - DNA, 25 bp, Rattus norvegicus
ctctctcttagcctttcttatggat

SEQ ID NO: 268299 - DNA, 25 bp, Rattus norvegicus
ctctctcttagcgtttcttatggat

SEQ ID NO: 268300 - DNA, 25 bp, Rattus norvegicus
ctctctcttctgacggacactaaat

SEQ ID NO: 268301 - DNA, 25 bp, Rattus norvegicus
ctctctcttctgtcggacactaaat

SEQ ID NO: 268302 - DNA, 25 bp, Rattus norvegicus
ctctctgactttcaatctgtttcca

SEQ ID NO: 268303 - DNA, 25 bp, Rattus norvegicus
ctctctgactttccaagtggacatt

SEQ ID NO: 268304 - DNA, 25 bp, Rattus norvegicus
ctctctgactttgaatctgtttcca

SEQ ID NO: 268305 - DNA, 25 bp, Rattus norvegicus
ctctctgactttgcaagtggacatt

SEQ ID NO: 268306 - DNA, 25 bp, Rattus norvegicus
ctctctgagagactctgggtccaga

SEQ ID NO: 268307 - DNA, 25 bp, Rattus norvegicus
ctctctgagagagtctgggtccaga

SEQ ID NO: 268308 - DNA, 25 bp, Rattus norvegicus
ctctctgagaggcagatcaaaatct

SEQ ID NO: 268309 - DNA, 25 bp, Rattus norvegicus
ctctctgagagggagatcaaaatct

SEQ ID NO: 268310 - DNA, 25 bp, Rattus norvegicus
ctctctgagtctatcggccagtaaa

SEQ ID NO: 268311 - DNA, 25 bp, Rattus norvegicus
ctctctgagtctttcggccagtaaa

SEQ ID NO: 268312 - DNA, 25 bp, Rattus norvegicus
ctctctgatcctccgaatcatctga

SEQ ID NO: 268313 - DNA, 25 bp, Rattus norvegicus
ctctctgatcctgcgaatcatctga

SEQ ID NO: 268314 - DNA, 25 bp, Rattus norvegicus
ctctctgatgtgcactttgtttttt

SEQ ID NO: 268315 - DNA, 25 bp, Rattus norvegicus
ctctctgatgtggactttgtttttt

SEQ ID NO: 268316 - DNA, 25 bp, Rattus norvegicus
ctctctgcaagcctagaagtgtagt

SEQ ID NO: 268317 - DNA, 25 bp, Rattus norvegicus
ctctctgcaagcgtagaagtgtagt

SEQ ID NO: 268318 - DNA, 25 bp, Rattus norvegicus
ctctctgcacatcatggaggtgtca

SEQ ID NO: 268319 - DNA, 25 bp, Rattus norvegicus
ctctctgcacatctgatgtgttaca

SEQ ID NO: 268320 - DNA, 25 bp, Rattus norvegicus
ctctctgcacatgatggaggtgtca

SEQ ID NO: 268321 - DNA, 25 bp, Rattus norvegicus
ctctctgcacatgtgatgtgttaca

SEQ ID NO: 268322 - DNA, 25 bp, Rattus norvegicus
ctctctgcactccatctattagata

SEQ ID NO: 268323 - DNA, 25 bp, Rattus norvegicus
ctctctgcactcgatctattagata

SEQ ID NO: 268324 - DNA, 25 bp, Rattus norvegicus
ctctctgccatcaactatggttact

SEQ ID NO: 268325 - DNA, 25 bp, Rattus norvegicus
ctctctgccatctactatggttact

SEQ ID NO: 268326 - DNA, 25 bp, Rattus norvegicus
ctctctgcgtacatgaccgttagaa

SEQ ID NO: 268327 - DNA, 25 bp, Rattus norvegicus
ctctctgcgtacttgaccgttagaa

SEQ ID NO: 268328 - DNA, 25 bp, Rattus norvegicus
ctctctgctaacaacaaacatccta

SEQ ID NO: 268329 - DNA, 25 bp, Rattus norvegicus
ctctctgctaactacaaacatccta

SEQ ID NO: 268330 - DNA, 25 bp, Rattus norvegicus
ctctctgctctacttcatggtgtaa

SEQ ID NO: 268331 - DNA, 25 bp, Rattus norvegicus
ctctctgctctagttcatggtgtaa

SEQ ID NO: 268332 - DNA, 25 bp, Rattus norvegicus
ctctctgctgagaaatacttgttgg

SEQ ID NO: 268333 - DNA, 25 bp, Rattus norvegicus
ctctctgctgagtaatacttgttgg

SEQ ID NO: 268334 - DNA, 25 bp, Rattus norvegicus
ctctctgctgccagtgtgtggataa

SEQ ID NO: 268335 - DNA, 25 bp, Rattus norvegicus
ctctctgctgcctgtgtgtggataa

SEQ ID NO: 268336 - DNA, 25 bp, Rattus norvegicus
ctctctgcttccactcataaaggta

SEQ ID NO: 268337 - DNA, 25 bp, Rattus norvegicus
ctctctgcttccctgtagtcagaaa

SEQ ID NO: 268338 - DNA, 25 bp, Rattus norvegicus
ctctctgcttccgtgtagtcagaaa

SEQ ID NO: 268339 - DNA, 25 bp, Rattus norvegicus
ctctctgcttcctctcataaaggta

SEQ ID NO: 268340 - DNA, 25 bp, Rattus norvegicus
ctctctgcttttcgtgtgtgtgaaa

SEQ ID NO: 268341 - DNA, 25 bp, Rattus norvegicus
ctctctgcttttggtgtgtgtgaaa

SEQ ID NO: 268342 - DNA, 25 bp, Rattus norvegicus
ctctctggacagcatggactattct

SEQ ID NO: 268343 - DNA, 25 bp, Rattus norvegicus
ctctctggacaggatggactattct

SEQ ID NO: 268344 - DNA, 25 bp, Rattus norvegicus
ctctctggagagagctgctgtaaca

SEQ ID NO: 268345 - DNA, 25 bp, Rattus norvegicus
ctctctggagagtgctgctgtaaca

SEQ ID NO: 268346 - DNA, 25 bp, Rattus norvegicus
ctctctggaggaactgtacctgtat

SEQ ID NO: 268347 - DNA, 25 bp, Rattus norvegicus
ctctctggaggatctgtacctgtat

SEQ ID NO: 268348 - DNA, 25 bp, Rattus norvegicus
ctctctggccatagttactatgtga

SEQ ID NO: 268349 - DNA, 25 bp, Rattus norvegicus
ctctctggccattgttactatgtga

SEQ ID NO: 268350 - DNA, 25 bp, Rattus norvegicus
ctctctggcccgcaaagtggttgaa

SEQ ID NO: 268351 - DNA, 25 bp, Rattus norvegicus
ctctctggcccggaaagtggttgaa

SEQ ID NO: 268352 - DNA, 25 bp, Rattus norvegicus
ctctctggctggctatgggactctt

SEQ ID NO: 268353 - DNA, 25 bp, Rattus norvegicus
ctctctggctgggtatgggactctt

SEQ ID NO: 268354 - DNA, 25 bp, Rattus norvegicus
ctctctggctttacgtgtgttaaca

SEQ ID NO: 268355 - DNA, 25 bp, Rattus norvegicus
ctctctggcttttcgtgtgttaaca

SEQ ID NO: 268356 - DNA, 25 bp, Rattus norvegicus
ctctctgggactatgttttgttgct

SEQ ID NO: 268357 - DNA, 25 bp, Rattus norvegicus
ctctctgggactttgttttgttgct

SEQ ID NO: 268358 - DNA, 25 bp, Rattus norvegicus
ctctctgggaggacaactggttttc

SEQ ID NO: 268359 - DNA, 25 bp, Rattus norvegicus
ctctctgggaggtcaactggttttc

SEQ ID NO: 268360 - DNA, 25 bp, Rattus norvegicus
ctctctgggcagacattttatccta

SEQ ID NO: 268361 - DNA, 25 bp, Rattus norvegicus
ctctctgggcagtcattttatccta

SEQ ID NO: 268362 - DNA, 25 bp, Rattus norvegicus
ctctctgggccgatacactgatgtg

SEQ ID NO: 268363 - DNA, 25 bp, Rattus norvegicus
ctctctgggccgttacactgatgtg

SEQ ID NO: 268364 - DNA, 25 bp, Rattus norvegicus
ctctctgggctcatatgttcactga

SEQ ID NO: 268365 - DNA, 25 bp, Rattus norvegicus
ctctctgggctcttatgttcactga

SEQ ID NO: 268366 - DNA, 25 bp, Rattus norvegicus
ctctctgggttgatggcagtttcct

SEQ ID NO: 268367 - DNA, 25 bp, Rattus norvegicus
ctctctgggttgttggcagtttcct

SEQ ID NO: 268368 - DNA, 25 bp, Rattus norvegicus
ctctctgggtttctagtgctattta

SEQ ID NO: 268369 - DNA, 25 bp, Rattus norvegicus
ctctctgggtttgtagtgctattta

SEQ ID NO: 268370 - DNA, 25 bp, Rattus norvegicus
ctctctggttccaagctgcagtgag

SEQ ID NO: 268371 - DNA, 25 bp, Rattus norvegicus
ctctctggttcctagctgcagtgag

SEQ ID NO: 268372 - DNA, 25 bp, Rattus norvegicus
ctctctgtaatgaatagccttagct

SEQ ID NO: 268373 - DNA, 25 bp, Rattus norvegicus
ctctctgtaatgtatagccttagct

SEQ ID NO: 268374 - DNA, 25 bp, Rattus norvegicus
ctctctgtctacactatctagctaa

SEQ ID NO: 268375 - DNA, 25 bp, Rattus norvegicus
ctctctgtctactctatctagctaa

SEQ ID NO: 268376 - DNA, 25 bp, Rattus norvegicus
ctctctgtctctctcgtaatcatat

SEQ ID NO: 268377 - DNA, 25 bp, Rattus norvegicus
ctctctgtctctgtcgtaatcatat

SEQ ID NO: 268378 - DNA, 25 bp, Rattus norvegicus
ctctctgtctttctactggagttca

SEQ ID NO: 268379 - DNA, 25 bp, Rattus norvegicus
ctctctgtctttgtactggagttca

SEQ ID NO: 268380 - DNA, 25 bp, Rattus norvegicus
ctctctgtgaatagcccctctttag

SEQ ID NO: 268381 - DNA, 25 bp, Rattus norvegicus
ctctctgtgaattgcccctctttag

SEQ ID NO: 268382 - DNA, 25 bp, Rattus norvegicus
ctctctgtgagcatagtgtttctga

SEQ ID NO: 268383 - DNA, 25 bp, Rattus norvegicus
ctctctgtgagcttagtgtttctga

SEQ ID NO: 268384 - DNA, 25 bp, Rattus norvegicus
ctctctgtggtgagttgtgttgtga

SEQ ID NO: 268385 - DNA, 25 bp, Rattus norvegicus
ctctctgtggtgtgttgtgttgtga

SEQ ID NO: 268386 - DNA, 25 bp, Rattus norvegicus
ctctctgtgtgtccttgaacctgca

SEQ ID NO: 268387 - DNA, 25 bp, Rattus norvegicus
ctctctgtgtgtgcttgaacctgca

SEQ ID NO: 268388 - DNA, 25 bp, Rattus norvegicus
ctctctgtgtttctttcctttataa

SEQ ID NO: 268389 - DNA, 25 bp, Rattus norvegicus
ctctctgtgtttgtttcctttataa

SEQ ID NO: 268390 - DNA, 25 bp, Rattus norvegicus
ctctctgttctccagttgtcaggaa

SEQ ID NO: 268391 - DNA, 25 bp, Rattus norvegicus
ctctctgttctcgagttgtcaggaa

SEQ ID NO: 268392 - DNA, 25 bp, Rattus norvegicus
ctctcttaagagactcagcctgcag

SEQ ID NO: 268393 - DNA, 25 bp, Rattus norvegicus
ctctcttaagagtctcagcctgcag

SEQ ID NO: 268394 - DNA, 25 bp, Rattus norvegicus
ctctcttaccccatggtaggaacat

SEQ ID NO: 268395 - DNA, 25 bp, Rattus norvegicus
ctctcttaccccttggtaggaacat

SEQ ID NO: 268396 - DNA, 25 bp, Rattus norvegicus
ctctcttatacacatgtgctttgtg

SEQ ID NO: 268397 - DNA, 25 bp, Rattus norvegicus
ctctcttatacagatgtgctttgtg

SEQ ID NO: 268398 - DNA, 25 bp, Rattus norvegicus
ctctcttatggcattccagaatcca

SEQ ID NO: 268399 - DNA, 25 bp, Rattus norvegicus
ctctcttatggctttccagaatcca

SEQ ID NO: 268400 - DNA, 25 bp, Rattus norvegicus
ctctcttattatccaccacaggaaa

SEQ ID NO: 268401 - DNA, 25 bp, Rattus norvegicus
ctctcttattatgcaccacaggaaa

SEQ ID NO: 268402 - DNA, 25 bp, Rattus norvegicus
ctctcttccacaagggtgtcggaat

SEQ ID NO: 268403 - DNA, 25 bp, Rattus norvegicus
ctctcttccacatgggtgtcggaat

SEQ ID NO: 268404 - DNA, 25 bp, Rattus norvegicus
ctctcttccttgactgccaataaag

SEQ ID NO: 268405 - DNA, 25 bp, Rattus norvegicus
ctctcttccttgaggagtgggtata

SEQ ID NO: 268406 - DNA, 25 bp, Rattus norvegicus
ctctcttccttgtctgccaataaag

SEQ ID NO: 268407 - DNA, 25 bp, Rattus norvegicus
ctctcttccttgtggagtgggtata

SEQ ID NO: 268408 - DNA, 25 bp, Rattus norvegicus
ctctcttgagtgagggttggttttt

SEQ ID NO: 268409 - DNA, 25 bp, Rattus norvegicus
ctctcttgagtgtgggttggttttt

SEQ ID NO: 268410 - DNA, 25 bp, Rattus norvegicus
ctctcttgcattattgtgactctaa

SEQ ID NO: 268411 - DNA, 25 bp, Rattus norvegicus
ctctcttgcatttttgtgactctaa

SEQ ID NO: 268412 - DNA, 25 bp, Rattus norvegicus
ctctctttacctacatggttgcatg

SEQ ID NO: 268413 - DNA, 25 bp, Rattus norvegicus
ctctctttaccttcatggttgcatg

SEQ ID NO: 268414 - DNA, 25 bp, Rattus norvegicus
ctctctttcccgacactgaaataga

SEQ ID NO: 268415 - DNA, 25 bp, Rattus norvegicus
ctctctttcccgtcactgaaataga

SEQ ID NO: 268416 - DNA, 25 bp, Rattus norvegicus
ctctctttcctaacctgtgtattaa

SEQ ID NO: 268417 - DNA, 25 bp, Rattus norvegicus
ctctctttcctatcctgtgtattaa

SEQ ID NO: 268418 - DNA, 25 bp, Rattus norvegicus
ctctctttctatctatatatctcga

SEQ ID NO: 268419 - DNA, 25 bp, Rattus norvegicus
ctctctttctatctcgtgatgatgg

SEQ ID NO: 268420 - DNA, 25 bp, Rattus norvegicus
ctctctttctatgtatatatctcga

SEQ ID NO: 268421 - DNA, 25 bp, Rattus norvegicus
ctctctttctatgtcgtgatgatgg

SEQ ID NO: 268422 - DNA, 25 bp, Rattus norvegicus
ctctctttgggaatcgtcggctaaa

SEQ ID NO: 268423 - DNA, 25 bp, Rattus norvegicus
ctctctttgggattcgtcggctaaa

SEQ ID NO: 268424 - DNA, 25 bp, Rattus norvegicus
ctctcttttctgctctaactttatt

SEQ ID NO: 268425 - DNA, 25 bp, Rattus norvegicus
ctctcttttctggtctaactttatt

SEQ ID NO: 268426 - DNA, 25 bp, Rattus norvegicus
ctctcttttcttcggcctctaagaa

SEQ ID NO: 268427 - DNA, 25 bp, Rattus norvegicus
ctctcttttcttgggcctctaagaa

SEQ ID NO: 268428 - DNA, 25 bp, Rattus norvegicus
ctctctttttatcctattggaccaa

SEQ ID NO: 268429 - DNA, 25 bp, Rattus norvegicus
ctctctttttatgctattggaccaa

SEQ ID NO: 268430 - DNA, 25 bp, Rattus norvegicus
ctctcttttttgaaactgaactcga

SEQ ID NO: 268431 - DNA, 25 bp, Rattus norvegicus
ctctcttttttgtaactgaactcga

SEQ ID NO: 268432 - DNA, 25 bp, Rattus norvegicus
ctctgaaaagccattctgttgtggg

SEQ ID NO: 268433 - DNA, 25 bp, Rattus norvegicus
ctctgaaaagcctttctgttgtggg

SEQ ID NO: 268434 - DNA, 25 bp, Rattus norvegicus
ctctgaaataaaccacctgtgggtt

SEQ ID NO: 268435 - DNA, 25 bp, Rattus norvegicus
ctctgaaataaagcacctgtgggtt

SEQ ID NO: 268436 - DNA, 25 bp, Rattus norvegicus
ctctgaaatcagagccaccccaagg

SEQ ID NO: 268437 - DNA, 25 bp, Rattus norvegicus
ctctgaaatcagtgccaccccaagg

SEQ ID NO: 268438 - DNA, 25 bp, Rattus norvegicus
ctctgaacacccattctaagtctaa

SEQ ID NO: 268439 - DNA, 25 bp, Rattus norvegicus
ctctgaacaccctttctaagtctaa

SEQ ID NO: 268440 - DNA, 25 bp, Rattus norvegicus
ctctgaacagtgaggcaatctcgcc

SEQ ID NO: 268441 - DNA, 25 bp, Rattus norvegicus
ctctgaacagtgtggcaatctcgcc

SEQ ID NO: 268442 - DNA, 25 bp, Rattus norvegicus
ctctgaaccagcacaggctaagggt

SEQ ID NO: 268443 - DNA, 25 bp, Rattus norvegicus
ctctgaaccagctcaggctaagggt

SEQ ID NO: 268444 - DNA, 25 bp, Rattus norvegicus
ctctgaactgtcaggctcgtggtga

SEQ ID NO: 268445 - DNA, 25 bp, Rattus norvegicus
ctctgaactgtctggctcgtggtga

SEQ ID NO: 268446 - DNA, 25 bp, Rattus norvegicus
ctctgaagacagcacttcccaggaa

SEQ ID NO: 268447 - DNA, 25 bp, Rattus norvegicus
ctctgaagacaggacttcccaggaa

SEQ ID NO: 268448 - DNA, 25 bp, Rattus norvegicus
ctctgaagccttctttgtgacctgg

SEQ ID NO: 268449 - DNA, 25 bp, Rattus norvegicus
ctctgaagccttgtttgtgacctgg

SEQ ID NO: 268450 - DNA, 25 bp, Rattus norvegicus
ctctgaatctggctagtgttatagc

SEQ ID NO: 268451 - DNA, 25 bp, Rattus norvegicus
ctctgaatctgggtagtgttatagc

SEQ ID NO: 268452 - DNA, 25 bp, Rattus norvegicus
ctctgaatgaatatctttccttttg

SEQ ID NO: 268453 - DNA, 25 bp, Rattus norvegicus
ctctgaatgaatttctttccttttg

SEQ ID NO: 268454 - DNA, 25 bp, Rattus norvegicus
ctctgaatgcccctgggtcatgtga

SEQ ID NO: 268455 - DNA, 25 bp, Rattus norvegicus
ctctgaatgcccgtgggtcatgtga

SEQ ID NO: 268456 - DNA, 25 bp, Rattus norvegicus
ctctgaatgctgagtctggtcggtc

SEQ ID NO: 268457 - DNA, 25 bp, Rattus norvegicus
ctctgaatgctgtgtctggtcggtc

SEQ ID NO: 268458 - DNA, 25 bp, Rattus norvegicus
ctctgacagtcccagtttgatctga

SEQ ID NO: 268459 - DNA, 25 bp, Rattus norvegicus
ctctgacagtccgagtttgatctga

SEQ ID NO: 268460 - DNA, 25 bp, Rattus norvegicus
ctctgacatccactcacgtgggaaa

SEQ ID NO: 268461 - DNA, 25 bp, Rattus norvegicus
ctctgacatccagtcacgtgggaaa

SEQ ID NO: 268462 - DNA, 25 bp, Rattus norvegicus
ctctgaccactcatcttggaggtga

SEQ ID NO: 268463 - DNA, 25 bp, Rattus norvegicus
ctctgaccactcttcttggaggtga

SEQ ID NO: 268464 - DNA, 25 bp, Rattus norvegicus
ctctgacccaagctgtctcaagaaa

SEQ ID NO: 268465 - DNA, 25 bp, Rattus norvegicus
ctctgacccaaggtgtctcaagaaa

SEQ ID NO: 268466 - DNA, 25 bp, Rattus norvegicus
ctctgacccgggagtgggaataaag

SEQ ID NO: 268467 - DNA, 25 bp, Rattus norvegicus
ctctgacccgggtgtgggaataaag

SEQ ID NO: 268468 - DNA, 25 bp, Rattus norvegicus
ctctgaccttctaacactacatatg

SEQ ID NO: 268469 - DNA, 25 bp, Rattus norvegicus
ctctgaccttcttacactacatatg

SEQ ID NO: 268470 - DNA, 25 bp, Rattus norvegicus
ctctgactaacccactttctaaatg

SEQ ID NO: 268471 - DNA, 25 bp, Rattus norvegicus
ctctgactaaccgactttctaaatg

SEQ ID NO: 268472 - DNA, 25 bp, Rattus norvegicus
ctctgactaactccagtaactgaaa

SEQ ID NO: 268473 - DNA, 25 bp, Rattus norvegicus
ctctgactaactgcagtaactgaaa

SEQ ID NO: 268474 - DNA, 25 bp, Rattus norvegicus
ctctgactctctaatcgaccaagat

SEQ ID NO: 268475 - DNA, 25 bp, Rattus norvegicus
ctctgactctcttatcgaccaagat

SEQ ID NO: 268476 - DNA, 25 bp, Rattus norvegicus
ctctgactgacaccttgctcagtaa

SEQ ID NO: 268477 - DNA, 25 bp, Rattus norvegicus
ctctgactgacagcttgctcagtaa

SEQ ID NO: 268478 - DNA, 25 bp, Rattus norvegicus
ctctgacttccaactggcatcatat

SEQ ID NO: 268479 - DNA, 25 bp, Rattus norvegicus
ctctgacttccatctggcatcatat

SEQ ID NO: 268480 - DNA, 25 bp, Rattus norvegicus
ctctgactttggctgttggtctggt

SEQ ID NO: 268481 - DNA, 25 bp, Rattus norvegicus
ctctgactttgggtgttggtctggt

SEQ ID NO: 268482 - DNA, 25 bp, Rattus norvegicus
ctctgacttttgaatttcaccctga

SEQ ID NO: 268483 - DNA, 25 bp, Rattus norvegicus
ctctgacttttgcttctgatcgatc

SEQ ID NO: 268484 - DNA, 25 bp, Rattus norvegicus
ctctgacttttggttctgatcgatc

SEQ ID NO: 268485 - DNA, 25 bp, Rattus norvegicus
ctctgacttttgtatttcaccctga

SEQ ID NO: 268486 - DNA, 25 bp, Rattus norvegicus
ctctgagaagagctgatgcacatca

SEQ ID NO: 268487 - DNA, 25 bp, Rattus norvegicus
ctctgagaagaggtgatgcacatca

SEQ ID NO: 268488 - DNA, 25 bp, Rattus norvegicus
ctctgagaccctacaggcccagtat

SEQ ID NO: 268489 - DNA, 25 bp, Rattus norvegicus
ctctgagacccttcaggcccagtat

SEQ ID NO: 268490 - DNA, 25 bp, Rattus norvegicus
ctctgagaccgacaccaggtatttt

SEQ ID NO: 268491 - DNA, 25 bp, Rattus norvegicus
ctctgagaccgagaccaggtatttt

SEQ ID NO: 268492 - DNA, 25 bp, Rattus norvegicus
ctctgagacgccaggtaagctttac

SEQ ID NO: 268493 - DNA, 25 bp, Rattus norvegicus
ctctgagacgcctggtaagctttac

SEQ ID NO: 268494 - DNA, 25 bp, Rattus norvegicus
ctctgagaggcacgtctgtgctgtc

SEQ ID NO: 268495 - DNA, 25 bp, Rattus norvegicus
ctctgagaggcaggtctgtgctgtc

SEQ ID NO: 268496 - DNA, 25 bp, Rattus norvegicus
ctctgagaggctcgaaccccaggaa

SEQ ID NO: 268497 - DNA, 25 bp, Rattus norvegicus
ctctgagaggctggaaccccaggaa

SEQ ID NO: 268498 - DNA, 25 bp, Rattus norvegicus
ctctgagagggtactctgcttctgc

SEQ ID NO: 268499 - DNA, 25 bp, Rattus norvegicus
ctctgagagggttctctgcttctgc

SEQ ID NO: 268500 - DNA, 25 bp, Rattus norvegicus
ctctgagatctcaaaggaatcatca

SEQ ID NO: 268501 - DNA, 25 bp, Rattus norvegicus
ctctgagatctctaaggaatcatca

SEQ ID NO: 268502 - DNA, 25 bp, Rattus norvegicus
ctctgagcaagacgcagctgggaca

SEQ ID NO: 268503 - DNA, 25 bp, Rattus norvegicus
ctctgagcaagaggcagctgggaca

SEQ ID NO: 268504 - DNA, 25 bp, Rattus norvegicus
ctctgagcagcacggcagtgactga

SEQ ID NO: 268505 - DNA, 25 bp, Rattus norvegicus
ctctgagcagcagggcagtgactga

SEQ ID NO: 268506 - DNA, 25 bp, Rattus norvegicus
ctctgagcccagaagacactgcatt

SEQ ID NO: 268507 - DNA, 25 bp, Rattus norvegicus
ctctgagcccagtagacactgcatt

SEQ ID NO: 268508 - DNA, 25 bp, Rattus norvegicus
ctctgagcctcgagatccttaggat

SEQ ID NO: 268509 - DNA, 25 bp, Rattus norvegicus
ctctgagcctcgtgatccttaggat

SEQ ID NO: 268510 - DNA, 25 bp, Rattus norvegicus
ctctgagcctggagctgtgttgatg

SEQ ID NO: 268511 - DNA, 25 bp, Rattus norvegicus
ctctgagcctggtgctgtgttgatg

SEQ ID NO: 268512 - DNA, 25 bp, Rattus norvegicus
ctctgagctaacctgggttccagaa

SEQ ID NO: 268513 - DNA, 25 bp, Rattus norvegicus
ctctgagctaacgtgggttccagaa

SEQ ID NO: 268514 - DNA, 25 bp, Rattus norvegicus
ctctgaggaatgagcgtgtgccctg

SEQ ID NO: 268515 - DNA, 25 bp, Rattus norvegicus
ctctgaggaatgtgcgtgtgccctg

SEQ ID NO: 268516 - DNA, 25 bp, Rattus norvegicus
ctctgaggacacacgggcaggagca

SEQ ID NO: 268517 - DNA, 25 bp, Rattus norvegicus
ctctgaggacactcgggcaggagca

SEQ ID NO: 268518 - DNA, 25 bp, Rattus norvegicus
ctctgaggacagacgggccatttgt

SEQ ID NO: 268519 - DNA, 25 bp, Rattus norvegicus
ctctgaggacagtcgggccatttgt

SEQ ID NO: 268520 - DNA, 25 bp, Rattus norvegicus
ctctgaggccacacaagctgttaca

SEQ ID NO: 268521 - DNA, 25 bp, Rattus norvegicus
ctctgaggccactcaagctgttaca

SEQ ID NO: 268522 - DNA, 25 bp, Rattus norvegicus
ctctgaggctctacaaaaattgctt

SEQ ID NO: 268523 - DNA, 25 bp, Rattus norvegicus
ctctgaggctcttcaaaaattgctt

SEQ ID NO: 268524 - DNA, 25 bp, Rattus norvegicus
ctctgagggcttagctgggagatac

SEQ ID NO: 268525 - DNA, 25 bp, Rattus norvegicus
ctctgagggctttgctgggagatac

SEQ ID NO: 268526 - DNA, 25 bp, Rattus norvegicus
ctctgagggttcacaccttgttaag

SEQ ID NO: 268527 - DNA, 25 bp, Rattus norvegicus
ctctgagggttctcaccttgttaag

SEQ ID NO: 268528 - DNA, 25 bp, Rattus norvegicus
ctctgaggtagaacctgtcaccata

SEQ ID NO: 268529 - DNA, 25 bp, Rattus norvegicus
ctctgaggtagatcctgtcaccata

SEQ ID NO: 268530 - DNA, 25 bp, Rattus norvegicus
ctctgagtgtctcccttgtgcttgc

SEQ ID NO: 268531 - DNA, 25 bp, Rattus norvegicus
ctctgagtgtctgccttgtgcttgc

SEQ ID NO: 268532 - DNA, 25 bp, Rattus norvegicus
ctctgagtgttcatgctcccaggta

SEQ ID NO: 268533 - DNA, 25 bp, Rattus norvegicus
ctctgagtgttcttgctcccaggta

SEQ ID NO: 268534 - DNA, 25 bp, Rattus norvegicus
ctctgagttcagagaaatgctgtct

SEQ ID NO: 268535 - DNA, 25 bp, Rattus norvegicus
ctctgagttcagtgaaatgctgtct

SEQ ID NO: 268536 - DNA, 25 bp, Rattus norvegicus
ctctgagttcctcctaggttttgta

SEQ ID NO: 268537 - DNA, 25 bp, Rattus norvegicus
ctctgagttcctgctaggttttgta

SEQ ID NO: 268538 - DNA, 25 bp, Rattus norvegicus
ctctgagttcgacatctctgagatc

SEQ ID NO: 268539 - DNA, 25 bp, Rattus norvegicus
ctctgagttcgagatctctgagatc

SEQ ID NO: 268540 - DNA, 25 bp, Rattus norvegicus
ctctgagttctgatctactctagaa

SEQ ID NO: 268541 - DNA, 25 bp, Rattus norvegicus
ctctgagttctgttctactctagaa

SEQ ID NO: 268542 - DNA, 25 bp, Rattus norvegicus
ctctgatcacagatgagcccttgaa

SEQ ID NO: 268543 - DNA, 25 bp, Rattus norvegicus
ctctgatcacagttgagcccttgaa

SEQ ID NO: 268544 - DNA, 25 bp, Rattus norvegicus
ctctgatccccacagtactgtaata

SEQ ID NO: 268545 - DNA, 25 bp, Rattus norvegicus
ctctgatccccagagtactgtaata

SEQ ID NO: 268546 - DNA, 25 bp, Rattus norvegicus
ctctgatctcaccagtcactaaata

SEQ ID NO: 268547 - DNA, 25 bp, Rattus norvegicus
ctctgatctcacgagtcactaaata

SEQ ID NO: 268548 - DNA, 25 bp, Rattus norvegicus
ctctgatctggaaggtccctgtcta

SEQ ID NO: 268549 - DNA, 25 bp, Rattus norvegicus
ctctgatctggatggtccctgtcta

SEQ ID NO: 268550 - DNA, 25 bp, Rattus norvegicus
ctctgatgacacataggcttcttaa

SEQ ID NO: 268551 - DNA, 25 bp, Rattus norvegicus
ctctgatgacacttaggcttcttaa

SEQ ID NO: 268552 - DNA, 25 bp, Rattus norvegicus
ctctgatgacccaagactctgttaa

SEQ ID NO: 268553 - DNA, 25 bp, Rattus norvegicus
ctctgatgaccctagactctgttaa

SEQ ID NO: 268554 - DNA, 25 bp, Rattus norvegicus
ctctgatgattaaccctgatggaga

SEQ ID NO: 268555 - DNA, 25 bp, Rattus norvegicus
ctctgatgattatccctgatggaga

SEQ ID NO: 268556 - DNA, 25 bp, Rattus norvegicus
ctctgatgccgtccttgaggtggaa

SEQ ID NO: 268557 - DNA, 25 bp, Rattus norvegicus
ctctgatgccgtgcttgaggtggaa

SEQ ID NO: 268558 - DNA, 25 bp, Rattus norvegicus
ctctgatgggacaggttcgaacctt

SEQ ID NO: 268559 - DNA, 25 bp, Rattus norvegicus
ctctgatgggactggttcgaacctt

SEQ ID NO: 268560 - DNA, 25 bp, Rattus norvegicus
ctctgattctgcacacttggcataa

SEQ ID NO: 268561 - DNA, 25 bp, Rattus norvegicus
ctctgattctgctcacttggcataa

SEQ ID NO: 268562 - DNA, 25 bp, Rattus norvegicus
ctctgattctttcagtccttttgaa

SEQ ID NO: 268563 - DNA, 25 bp, Rattus norvegicus
ctctgattctttgagtccttttgaa

SEQ ID NO: 268564 - DNA, 25 bp, Rattus norvegicus
ctctgcaagctcaccaagttaaacc

SEQ ID NO: 268565 - DNA, 25 bp, Rattus norvegicus
ctctgcaagctctccaagttaaacc

SEQ ID NO: 268566 - DNA, 25 bp, Rattus norvegicus
ctctgcaagctgctgattctcctta

SEQ ID NO: 268567 - DNA, 25 bp, Rattus norvegicus
ctctgcaagctggtgattctcctta

SEQ ID NO: 268568 - DNA, 25 bp, Rattus norvegicus
ctctgcaattggactattacacatt

SEQ ID NO: 268569 - DNA, 25 bp, Rattus norvegicus
ctctgcaattggtctattacacatt

SEQ ID NO: 268570 - DNA, 25 bp, Rattus norvegicus
ctctgcacaggaagggctgtattca

SEQ ID NO: 268571 - DNA, 25 bp, Rattus norvegicus
ctctgcacaggatgggctgtattca

SEQ ID NO: 268572 - DNA, 25 bp, Rattus norvegicus
ctctgcacagtcagcatatgtatga

SEQ ID NO: 268573 - DNA, 25 bp, Rattus norvegicus
ctctgcacagtctgcatatgtatga

SEQ ID NO: 268574 - DNA, 25 bp, Rattus norvegicus
ctctgcaccacactcaaactgtgaa

SEQ ID NO: 268575 - DNA, 25 bp, Rattus norvegicus
ctctgcaccacactgatggagattt

SEQ ID NO: 268576 - DNA, 25 bp, Rattus norvegicus
ctctgcaccacagtcaaactgtgaa

SEQ ID NO: 268577 - DNA, 25 bp, Rattus norvegicus
ctctgcaccacagtgatggagattt

SEQ ID NO: 268578 - DNA, 25 bp, Rattus norvegicus
ctctgcaccatcagtgggctgaaat

SEQ ID NO: 268579 - DNA, 25 bp, Rattus norvegicus
ctctgcaccatctgtgggctgaaat

SEQ ID NO: 268580 - DNA, 25 bp, Rattus norvegicus
ctctgcaccgagaaaggccatcttt

SEQ ID NO: 268581 - DNA, 25 bp, Rattus norvegicus
ctctgcaccgagtaaggccatcttt

SEQ ID NO: 268582 - DNA, 25 bp, Rattus norvegicus
ctctgcacggttatggcggcatgaa

SEQ ID NO: 268583 - DNA, 25 bp, Rattus norvegicus
ctctgcacggttttggcggcatgaa

SEQ ID NO: 268584 - DNA, 25 bp, Rattus norvegicus
ctctgcactgtcctgtcagtattta

SEQ ID NO: 268585 - DNA, 25 bp, Rattus norvegicus
ctctgcactgtcgtgtcagtattta

SEQ ID NO: 268586 - DNA, 25 bp, Rattus norvegicus
ctctgcagacagagaactggtctac

SEQ ID NO: 268587 - DNA, 25 bp, Rattus norvegicus
ctctgcagacagtgaactggtctac

SEQ ID NO: 268588 - DNA, 25 bp, Rattus norvegicus
ctctgcagacataagctaacgtttg

SEQ ID NO: 268589 - DNA, 25 bp, Rattus norvegicus
ctctgcagacattagctaacgtttg

SEQ ID NO: 268590 - DNA, 25 bp, Rattus norvegicus
ctctgcagagggatcaagggtgtca

SEQ ID NO: 268591 - DNA, 25 bp, Rattus norvegicus
ctctgcagagggttcaagggtgtca

SEQ ID NO: 268592 - DNA, 25 bp, Rattus norvegicus
ctctgcagccacctttgtgaaagtg

SEQ ID NO: 268593 - DNA, 25 bp, Rattus norvegicus
ctctgcagccacgtttgtgaaagtg

SEQ ID NO: 268594 - DNA, 25 bp, Rattus norvegicus
ctctgcagcccaactttgtttatta

SEQ ID NO: 268595 - DNA, 25 bp, Rattus norvegicus
ctctgcagcccatctttgtttatta

SEQ ID NO: 268596 - DNA, 25 bp, Rattus norvegicus
ctctgcagctttagagtagccactg

SEQ ID NO: 268597 - DNA, 25 bp, Rattus norvegicus
ctctgcagcttttgagtagccactg

SEQ ID NO: 268598 - DNA, 25 bp, Rattus norvegicus
ctctgcagtcttaggagaatggccc

SEQ ID NO: 268599 - DNA, 25 bp, Rattus norvegicus
ctctgcagtctttggagaatggccc

SEQ ID NO: 268600 - DNA, 25 bp, Rattus norvegicus
ctctgcagtgacagccctggccaag

SEQ ID NO: 268601 - DNA, 25 bp, Rattus norvegicus
ctctgcagtgactgccctggccaag

SEQ ID NO: 268602 - DNA, 25 bp, Rattus norvegicus
ctctgcagttacacaaggccatggg

SEQ ID NO: 268603 - DNA, 25 bp, Rattus norvegicus
ctctgcagttactcaaggccatggg

SEQ ID NO: 268604 - DNA, 25 bp, Rattus norvegicus
ctctgcatgcttattctgtaaataa

SEQ ID NO: 268605 - DNA, 25 bp, Rattus norvegicus
ctctgcatgctttttctgtaaataa

SEQ ID NO: 268606 - DNA, 25 bp, Rattus norvegicus
ctctgcatggttcacagttctgcca

SEQ ID NO: 268607 - DNA, 25 bp, Rattus norvegicus
ctctgcatggttgacagttctgcca

SEQ ID NO: 268608 - DNA, 25 bp, Rattus norvegicus
ctctgcatgtgcagtcctgtggagg

SEQ ID NO: 268609 - DNA, 25 bp, Rattus norvegicus
ctctgcatgtgctgtcctgtggagg

SEQ ID NO: 268610 - DNA, 25 bp, Rattus norvegicus
ctctgcattgccatttggaataaaa

SEQ ID NO: 268611 - DNA, 25 bp, Rattus norvegicus
ctctgcattgccttttggaataaaa

SEQ ID NO: 268612 - DNA, 25 bp, Rattus norvegicus
ctctgcatttgcaggtttcttcttt

SEQ ID NO: 268613 - DNA, 25 bp, Rattus norvegicus
ctctgcatttgctggtttcttcttt

SEQ ID NO: 268614 - DNA, 25 bp, Rattus norvegicus
ctctgccaagctatacgaacattct

SEQ ID NO: 268615 - DNA, 25 bp, Rattus norvegicus
ctctgccaagctttacgaacattct

SEQ ID NO: 268616 - DNA, 25 bp, Rattus norvegicus
ctctgccaattcagctaactgtgca

SEQ ID NO: 268617 - DNA, 25 bp, Rattus norvegicus
ctctgccaattctgctaactgtgca

SEQ ID NO: 268618 - DNA, 25 bp, Rattus norvegicus
ctctgccagtgactaggaccagtgg

SEQ ID NO: 268619 - DNA, 25 bp, Rattus norvegicus
ctctgccagtgagtaggaccagtgg

SEQ ID NO: 268620 - DNA, 25 bp, Rattus norvegicus
ctctgccagtggatttgtagcctaa

SEQ ID NO: 268621 - DNA, 25 bp, Rattus norvegicus
ctctgccagtggttttgtagcctaa

SEQ ID NO: 268622 - DNA, 25 bp, Rattus norvegicus
ctctgccatcccagatcaaatcaaa

SEQ ID NO: 268623 - DNA, 25 bp, Rattus norvegicus
ctctgccatccctgatcaaatcaaa

SEQ ID NO: 268624 - DNA, 25 bp, Rattus norvegicus
ctctgccatggcatcgtacagctat

SEQ ID NO: 268625 - DNA, 25 bp, Rattus norvegicus
ctctgccatggcttcgtacagctat

SEQ ID NO: 268626 - DNA, 25 bp, Rattus norvegicus
ctctgcccacttaaaccatttggga

SEQ ID NO: 268627 - DNA, 25 bp, Rattus norvegicus
ctctgcccactttaaccatttggga

SEQ ID NO: 268628 - DNA, 25 bp, Rattus norvegicus
ctctgcccatctcgtgaatgaaaca

SEQ ID NO: 268629 - DNA, 25 bp, Rattus norvegicus
ctctgcccatctggtgaatgaaaca

SEQ ID NO: 268630 - DNA, 25 bp, Rattus norvegicus
ctctgccccataattatgatcccat

SEQ ID NO: 268631 - DNA, 25 bp, Rattus norvegicus
ctctgccccatatttatgatcccat

SEQ ID NO: 268632 - DNA, 25 bp, Rattus norvegicus
ctctgcccctagctcaaaaactgta

SEQ ID NO: 268633 - DNA, 25 bp, Rattus norvegicus
ctctgcccctaggtcaaaaactgta

SEQ ID NO: 268634 - DNA, 25 bp, Rattus norvegicus
ctctgccccttgaggaggccattga

SEQ ID NO: 268635 - DNA, 25 bp, Rattus norvegicus
ctctgccccttgtggaggccattga

SEQ ID NO: 268636 - DNA, 25 bp, Rattus norvegicus
ctctgcccgcaacagggacacgtaa

SEQ ID NO: 268637 - DNA, 25 bp, Rattus norvegicus
ctctgcccgcaagagggacacgtaa

SEQ ID NO: 268638 - DNA, 25 bp, Rattus norvegicus
ctctgccctaaacatggtgtacttg

SEQ ID NO: 268639 - DNA, 25 bp, Rattus norvegicus
ctctgccctaaagatggtgtacttg

SEQ ID NO: 268640 - DNA, 25 bp, Rattus norvegicus
ctctgccggaccaaaaatttctatc

SEQ ID NO: 268641 - DNA, 25 bp, Rattus norvegicus
ctctgccggacctaaaatttctatc

SEQ ID NO: 268642 - DNA, 25 bp, Rattus norvegicus
ctctgcctcaaaattttaaaagtgg

SEQ ID NO: 268643 - DNA, 25 bp, Rattus norvegicus
ctctgcctcaaatttttaaaagtgg

SEQ ID NO: 268644 - DNA, 25 bp, Rattus norvegicus
ctctgcctccataagctacattgga

SEQ ID NO: 268645 - DNA, 25 bp, Rattus norvegicus
ctctgcctccattagctacattgga

SEQ ID NO: 268646 - DNA, 25 bp, Rattus norvegicus
ctctgcctccccagaagatgaaaga

SEQ ID NO: 268647 - DNA, 25 bp, Rattus norvegicus
ctctgcctcccctgaagatgaaaga

SEQ ID NO: 268648 - DNA, 25 bp, Rattus norvegicus
ctctgcctcctcctatggtgatggg

SEQ ID NO: 268649 - DNA, 25 bp, Rattus norvegicus
ctctgcctcctcgtatggtgatggg

SEQ ID NO: 268650 - DNA, 25 bp, Rattus norvegicus
ctctgcctccttcatgctaactaag

SEQ ID NO: 268651 - DNA, 25 bp, Rattus norvegicus
ctctgcctccttgatgctaactaag

SEQ ID NO: 268652 - DNA, 25 bp, Rattus norvegicus
ctctgcctcgcactgaaaagatcat

SEQ ID NO: 268653 - DNA, 25 bp, Rattus norvegicus
ctctgcctcgcagtgaaaagatcat

SEQ ID NO: 268654 - DNA, 25 bp, Rattus norvegicus
ctctgcctctacacatttttgagtg

SEQ ID NO: 268655 - DNA, 25 bp, Rattus norvegicus
ctctgcctctactcatttttgagtg

SEQ ID NO: 268656 - DNA, 25 bp, Rattus norvegicus
ctctgcctctcgattttatgctctt

SEQ ID NO: 268657 - DNA, 25 bp, Rattus norvegicus
ctctgcctctcgtttttatgctctt

SEQ ID NO: 268658 - DNA, 25 bp, Rattus norvegicus
ctctgcctctgtaatccacaataaa

SEQ ID NO: 268659 - DNA, 25 bp, Rattus norvegicus
ctctgcctctgttatccacaataaa

SEQ ID NO: 268660 - DNA, 25 bp, Rattus norvegicus
ctctgcctcttgcaagattgctgga

SEQ ID NO: 268661 - DNA, 25 bp, Rattus norvegicus
ctctgcctcttgctgtctaaatggg

SEQ ID NO: 268662 - DNA, 25 bp, Rattus norvegicus
ctctgcctcttggaagattgctgga

SEQ ID NO: 268663 - DNA, 25 bp, Rattus norvegicus
ctctgcctcttggtgtctaaatggg

SEQ ID NO: 268664 - DNA, 25 bp, Rattus norvegicus
ctctgcctgaacattgggctggtaa

SEQ ID NO: 268665 - DNA, 25 bp, Rattus norvegicus
ctctgcctgaactttgggctggtaa

SEQ ID NO: 268666 - DNA, 25 bp, Rattus norvegicus
ctctgcctgcggagttgcacaaaga

SEQ ID NO: 268667 - DNA, 25 bp, Rattus norvegicus
ctctgcctgcggtgttgcacaaaga

SEQ ID NO: 268668 - DNA, 25 bp, Rattus norvegicus
ctctgcctgcttatcttattcaaag

SEQ ID NO: 268669 - DNA, 25 bp, Rattus norvegicus
ctctgcctgcttttcttattcaaag

SEQ ID NO: 268670 - DNA, 25 bp, Rattus norvegicus
ctctgcctggtgattatgtacagtt

SEQ ID NO: 268671 - DNA, 25 bp, Rattus norvegicus
ctctgcctggtgtttatgtacagtt

SEQ ID NO: 268672 - DNA, 25 bp, Rattus norvegicus
ctctgcctgttgatgcccagaaaat

SEQ ID NO: 268673 - DNA, 25 bp, Rattus norvegicus
ctctgcctgttgttgcccagaaaat

SEQ ID NO: 268674 - DNA, 25 bp, Rattus norvegicus
ctctgccttaatcggatgggcttca

SEQ ID NO: 268675 - DNA, 25 bp, Rattus norvegicus
ctctgccttaatgggatgggcttca

SEQ ID NO: 268676 - DNA, 25 bp, Rattus norvegicus
ctctgccttctaaggagagtctgct

SEQ ID NO: 268677 - DNA, 25 bp, Rattus norvegicus
ctctgccttctatggagagtctgct

SEQ ID NO: 268678 - DNA, 25 bp, Rattus norvegicus
ctctgccttgcaatatttaaccctt

SEQ ID NO: 268679 - DNA, 25 bp, Rattus norvegicus
ctctgccttgcattatttaaccctt

SEQ ID NO: 268680 - DNA, 25 bp, Rattus norvegicus
ctctgccttggcaactgtatggaag

SEQ ID NO: 268681 - DNA, 25 bp, Rattus norvegicus
ctctgccttggcagagtattgaagt

SEQ ID NO: 268682 - DNA, 25 bp, Rattus norvegicus
ctctgccttggctactgtatggaag

SEQ ID NO: 268683 - DNA, 25 bp, Rattus norvegicus
ctctgccttggctgagtattgaagt

SEQ ID NO: 268684 - DNA, 25 bp, Rattus norvegicus
ctctgccttttaaatgccaattctc

SEQ ID NO: 268685 - DNA, 25 bp, Rattus norvegicus
ctctgccttttaaccaatgcaagtt

SEQ ID NO: 268686 - DNA, 25 bp, Rattus norvegicus
ctctgccttttatatgccaattctc

SEQ ID NO: 268687 - DNA, 25 bp, Rattus norvegicus
ctctgccttttatccaatgcaagtt

SEQ ID NO: 268688 - DNA, 25 bp, Rattus norvegicus
ctctgcgccgagagctgaaagcgaa

SEQ ID NO: 268689 - DNA, 25 bp, Rattus norvegicus
ctctgcgccgagtgctgaaagcgaa

SEQ ID NO: 268690 - DNA, 25 bp, Rattus norvegicus
ctctgcggctctcgcgctgctttga

SEQ ID NO: 268691 - DNA, 25 bp, Rattus norvegicus
ctctgcggctctggcgctgctttga

SEQ ID NO: 268692 - DNA, 25 bp, Rattus norvegicus
ctctgctacagcctcagggtttagt

SEQ ID NO: 268693 - DNA, 25 bp, Rattus norvegicus
ctctgctacagcgtcagggtttagt

SEQ ID NO: 268694 - DNA, 25 bp, Rattus norvegicus
ctctgctacctcatgtgtacaaaat

SEQ ID NO: 268695 - DNA, 25 bp, Rattus norvegicus
ctctgctacctcttgtgtacaaaat

SEQ ID NO: 268696 - DNA, 25 bp, Rattus norvegicus
ctctgctagttcataccgcatgttt

SEQ ID NO: 268697 - DNA, 25 bp, Rattus norvegicus
ctctgctagttcttaccgcatgttt

SEQ ID NO: 268698 - DNA, 25 bp, Rattus norvegicus
ctctgctattatatcgtgctgttta

SEQ ID NO: 268699 - DNA, 25 bp, Rattus norvegicus
ctctgctattatttcgtgctgttta

SEQ ID NO: 268700 - DNA, 25 bp, Rattus norvegicus
ctctgctattcaccttctgttaaaa

SEQ ID NO: 268701 - DNA, 25 bp, Rattus norvegicus
ctctgctattcagcttctgttaaaa

SEQ ID NO: 268702 - DNA, 25 bp, Rattus norvegicus
ctctgctccaatcctattttctatg

SEQ ID NO: 268703 - DNA, 25 bp, Rattus norvegicus
ctctgctccaatgctattttctatg

SEQ ID NO: 268704 - DNA, 25 bp, Rattus norvegicus
ctctgctccaggctgtgttagatgt

SEQ ID NO: 268705 - DNA, 25 bp, Rattus norvegicus
ctctgctccagggtgtgttagatgt

SEQ ID NO: 268706 - DNA, 25 bp, Rattus norvegicus
ctctgctccctcaaaatgtcagtta

SEQ ID NO: 268707 - DNA, 25 bp, Rattus norvegicus
ctctgctccctctaaatgtcagtta

SEQ ID NO: 268708 - DNA, 25 bp, Rattus norvegicus
ctctgctcctaacttgtatccaata

SEQ ID NO: 268709 - DNA, 25 bp, Rattus norvegicus
ctctgctcctaagttgtatccaata

SEQ ID NO: 268710 - DNA, 25 bp, Rattus norvegicus
ctctgctctttgcatgactgtgtaa

SEQ ID NO: 268711 - DNA, 25 bp, Rattus norvegicus
ctctgctctttggatgactgtgtaa

SEQ ID NO: 268712 - DNA, 25 bp, Rattus norvegicus
ctctgctgaagacccattcattgca

SEQ ID NO: 268713 - DNA, 25 bp, Rattus norvegicus
ctctgctgaagactttggtcatctg

SEQ ID NO: 268714 - DNA, 25 bp, Rattus norvegicus
ctctgctgaagagccattcattgca

SEQ ID NO: 268715 - DNA, 25 bp, Rattus norvegicus
ctctgctgaagagtttggtcatctg

SEQ ID NO: 268716 - DNA, 25 bp, Rattus norvegicus
ctctgctgaatgcacttctatctat

SEQ ID NO: 268717 - DNA, 25 bp, Rattus norvegicus
ctctgctgaatggacttctatctat

SEQ ID NO: 268718 - DNA, 25 bp, Rattus norvegicus
ctctgctgacatccacattctaaaa

SEQ ID NO: 268719 - DNA, 25 bp, Rattus norvegicus
ctctgctgacatgcacattctaaaa

SEQ ID NO: 268720 - DNA, 25 bp, Rattus norvegicus
ctctgctgcatgatcaggcatgttt

SEQ ID NO: 268721 - DNA, 25 bp, Rattus norvegicus
ctctgctgcatgttcaggcatgttt

SEQ ID NO: 268722 - DNA, 25 bp, Rattus norvegicus
ctctgctgctctaggatctgactga

SEQ ID NO: 268723 - DNA, 25 bp, Rattus norvegicus
ctctgctgctcttggatctgactga

SEQ ID NO: 268724 - DNA, 25 bp, Rattus norvegicus
ctctgctgctgcctctaggtacctt

SEQ ID NO: 268725 - DNA, 25 bp, Rattus norvegicus
ctctgctgctgcgtctaggtacctt

SEQ ID NO: 268726 - DNA, 25 bp, Rattus norvegicus
ctctgctggcgactgtacatagtgt

SEQ ID NO: 268727 - DNA, 25 bp, Rattus norvegicus
ctctgctggcgagtgtacatagtgt

SEQ ID NO: 268728 - DNA, 25 bp, Rattus norvegicus
ctctgctgtgaaataacttgttctg

SEQ ID NO: 268729 - DNA, 25 bp, Rattus norvegicus
ctctgctgtgaattaacttgttctg

SEQ ID NO: 268730 - DNA, 25 bp, Rattus norvegicus
ctctgctgtttcactttttggacga

SEQ ID NO: 268731 - DNA, 25 bp, Rattus norvegicus
ctctgctgtttctctttttggacga

SEQ ID NO: 268732 - DNA, 25 bp, Rattus norvegicus
ctctgcttagagctccttcaaaagg

SEQ ID NO: 268733 - DNA, 25 bp, Rattus norvegicus
ctctgcttagaggtccttcaaaagg

SEQ ID NO: 268734 - DNA, 25 bp, Rattus norvegicus
ctctgcttcatccaactaagactat

SEQ ID NO: 268735 - DNA, 25 bp, Rattus norvegicus
ctctgcttcatcgaactaagactat

SEQ ID NO: 268736 - DNA, 25 bp, Rattus norvegicus
ctctgcttctcaagagataaagctt

SEQ ID NO: 268737 - DNA, 25 bp, Rattus norvegicus
ctctgcttctcatgagataaagctt

SEQ ID NO: 268738 - DNA, 25 bp, Rattus norvegicus
ctctgcttgctcaggacaatgccaa

SEQ ID NO: 268739 - DNA, 25 bp, Rattus norvegicus
ctctgcttgctctggacaatgccaa

SEQ ID NO: 268740 - DNA, 25 bp, Rattus norvegicus
ctctgcttgggtaccagggtctgaa

SEQ ID NO: 268741 - DNA, 25 bp, Rattus norvegicus
ctctgcttgggttccagggtctgaa

SEQ ID NO: 268742 - DNA, 25 bp, Rattus norvegicus
ctctgcttgttaattcaccttgaaa

SEQ ID NO: 268743 - DNA, 25 bp, Rattus norvegicus
ctctgcttgttatttcaccttgaaa

SEQ ID NO: 268744 - DNA, 25 bp, Rattus norvegicus
ctctgctttcaactttgtgtttgaa

SEQ ID NO: 268745 - DNA, 25 bp, Rattus norvegicus
ctctgctttcaagtttgtgtttgaa

SEQ ID NO: 268746 - DNA, 25 bp, Rattus norvegicus
ctctgctttcgcagctgatatggaa

SEQ ID NO: 268747 - DNA, 25 bp, Rattus norvegicus
ctctgctttcgctgctgatatggaa

SEQ ID NO: 268748 - DNA, 25 bp, Rattus norvegicus
ctctgctttgagaggctgtggttcg

SEQ ID NO: 268749 - DNA, 25 bp, Rattus norvegicus
ctctgctttgagtggctgtggttcg

SEQ ID NO: 268750 - DNA, 25 bp, Rattus norvegicus
ctctgctttgtcattcgaaccggaa

SEQ ID NO: 268751 - DNA, 25 bp, Rattus norvegicus
ctctgctttgtctttcgaaccggaa

SEQ ID NO: 268752 - DNA, 25 bp, Rattus norvegicus
ctctggaaccatcttgactgtcaca

SEQ ID NO: 268753 - DNA, 25 bp, Rattus norvegicus
ctctggaaccatgttgactgtcaca

SEQ ID NO: 268754 - DNA, 25 bp, Rattus norvegicus
ctctggaagggaaaggctgtgggct

SEQ ID NO: 268755 - DNA, 25 bp, Rattus norvegicus
ctctggaagggataggctgtgggct

SEQ ID NO: 268756 - DNA, 25 bp, Rattus norvegicus
ctctggaagttcctcttactctgag

SEQ ID NO: 268757 - DNA, 25 bp, Rattus norvegicus
ctctggaagttcgtcttactctgag

SEQ ID NO: 268758 - DNA, 25 bp, Rattus norvegicus
ctctggaatgggatctgtgtttcaa

SEQ ID NO: 268759 - DNA, 25 bp, Rattus norvegicus
ctctggaatgggttctgtgtttcaa

SEQ ID NO: 268760 - DNA, 25 bp, Rattus norvegicus
ctctggacatccagttctaggtgtt

SEQ ID NO: 268761 - DNA, 25 bp, Rattus norvegicus
ctctggacatcctgttctaggtgtt

SEQ ID NO: 268762 - DNA, 25 bp, Rattus norvegicus
ctctggacatgtcagctggcctgat

SEQ ID NO: 268763 - DNA, 25 bp, Rattus norvegicus
ctctggacatgtgagctggcctgat

SEQ ID NO: 268764 - DNA, 25 bp, Rattus norvegicus
ctctggacctctctacaggtggcac

SEQ ID NO: 268765 - DNA, 25 bp, Rattus norvegicus
ctctggacctctgtacaggtggcac

SEQ ID NO: 268766 - DNA, 25 bp, Rattus norvegicus
ctctggactccacaagcaagggtgg

SEQ ID NO: 268767 - DNA, 25 bp, Rattus norvegicus
ctctggactccagaagcaagggtgg

SEQ ID NO: 268768 - DNA, 25 bp, Rattus norvegicus
ctctggagaattaagtgggctctgt

SEQ ID NO: 268769 - DNA, 25 bp, Rattus norvegicus
ctctggagaatttagtgggctctgt

SEQ ID NO: 268770 - DNA, 25 bp, Rattus norvegicus
ctctggagatgcaagcagctgcctg

SEQ ID NO: 268771 - DNA, 25 bp, Rattus norvegicus
ctctggagatgctagcagctgcctg

SEQ ID NO: 268772 - DNA, 25 bp, Rattus norvegicus
ctctggagctggatcttgttggtga

SEQ ID NO: 268773 - DNA, 25 bp, Rattus norvegicus
ctctggagctggttcttgttggtga

SEQ ID NO: 268774 - DNA, 25 bp, Rattus norvegicus
ctctggagcttgaccgccattgtgg

SEQ ID NO: 268775 - DNA, 25 bp, Rattus norvegicus
ctctggagcttgtccgccattgtgg

SEQ ID NO: 268776 - DNA, 25 bp, Rattus norvegicus
ctctggaggacccaccattgaggaa

SEQ ID NO: 268777 - DNA, 25 bp, Rattus norvegicus
ctctggaggaccgaccattgaggaa

SEQ ID NO: 268778 - DNA, 25 bp, Rattus norvegicus
ctctggaggagcagtctcagtgcag

SEQ ID NO: 268779 - DNA, 25 bp, Rattus norvegicus
ctctggaggagctgtctcagtgcag

SEQ ID NO: 268780 - DNA, 25 bp, Rattus norvegicus
ctctggagttgtaatttcccactag

SEQ ID NO: 268781 - DNA, 25 bp, Rattus norvegicus
ctctggagttgttatttcccactag

SEQ ID NO: 268782 - DNA, 25 bp, Rattus norvegicus
ctctggatcagcacatggcttgcaa

SEQ ID NO: 268783 - DNA, 25 bp, Rattus norvegicus
ctctggatcagctcatggcttgcaa

SEQ ID NO: 268784 - DNA, 25 bp, Rattus norvegicus
ctctggatcgctctggagaatgcca

SEQ ID NO: 268785 - DNA, 25 bp, Rattus norvegicus
ctctggatcgctgtggagaatgcca

SEQ ID NO: 268786 - DNA, 25 bp, Rattus norvegicus
ctctggatcgggaagcctggtgaca

SEQ ID NO: 268787 - DNA, 25 bp, Rattus norvegicus
ctctggatcgggtagcctggtgaca

SEQ ID NO: 268788 - DNA, 25 bp, Rattus norvegicus
ctctggatctttctctttcatcatt

SEQ ID NO: 268789 - DNA, 25 bp, Rattus norvegicus
ctctggatctttgtctttcatcatt

SEQ ID NO: 268790 - DNA, 25 bp, Rattus norvegicus
ctctggattacactgcactgggcag

SEQ ID NO: 268791 - DNA, 25 bp, Rattus norvegicus
ctctggattacagtgcactgggcag

SEQ ID NO: 268792 - DNA, 25 bp, Rattus norvegicus
ctctggattctcagactgagactca

SEQ ID NO: 268793 - DNA, 25 bp, Rattus norvegicus
ctctggattctctgactgagactca

SEQ ID NO: 268794 - DNA, 25 bp, Rattus norvegicus
ctctggatttctcgtgtgtggcata

SEQ ID NO: 268795 - DNA, 25 bp, Rattus norvegicus
ctctggatttctggtgtgtggcata

SEQ ID NO: 268796 - DNA, 25 bp, Rattus norvegicus
ctctggattttgaagctatatggat

SEQ ID NO: 268797 - DNA, 25 bp, Rattus norvegicus
ctctggattttgtagctatatggat

SEQ ID NO: 268798 - DNA, 25 bp, Rattus norvegicus
ctctggcacagcatcctgtagaaag

SEQ ID NO: 268799 - DNA, 25 bp, Rattus norvegicus
ctctggcacagcttcctgtagaaag

SEQ ID NO: 268800 - DNA, 25 bp, Rattus norvegicus
ctctggcaccagatattcatatgat

SEQ ID NO: 268801 - DNA, 25 bp, Rattus norvegicus
ctctggcaccagttattcatatgat

SEQ ID NO: 268802 - DNA, 25 bp, Rattus norvegicus
ctctggcacttgaaccttatcttca

SEQ ID NO: 268803 - DNA, 25 bp, Rattus norvegicus
ctctggcacttgtaccttatcttca

SEQ ID NO: 268804 - DNA, 25 bp, Rattus norvegicus
ctctggcagtggaggaagtctcttt

SEQ ID NO: 268805 - DNA, 25 bp, Rattus norvegicus
ctctggcagtggtggaagtctcttt

SEQ ID NO: 268806 - DNA, 25 bp, Rattus norvegicus
ctctggccacccacggtgatggagg

SEQ ID NO: 268807 - DNA, 25 bp, Rattus norvegicus
ctctggccaccctcggtgatggagg

SEQ ID NO: 268808 - DNA, 25 bp, Rattus norvegicus
ctctggcccaagaaatcctgtgtat

SEQ ID NO: 268809 - DNA, 25 bp, Rattus norvegicus
ctctggcccaagtaatcctgtgtat

SEQ ID NO: 268810 - DNA, 25 bp, Rattus norvegicus
ctctggcccaggaaaccaaggacca

SEQ ID NO: 268811 - DNA, 25 bp, Rattus norvegicus
ctctggcccaggtaaccaaggacca

SEQ ID NO: 268812 - DNA, 25 bp, Rattus norvegicus
ctctggccgtaaaaacctcgattat

SEQ ID NO: 268813 - DNA, 25 bp, Rattus norvegicus
ctctggccgtaataacctcgattat

SEQ ID NO: 268814 - DNA, 25 bp, Rattus norvegicus
ctctggccgtgcatgaggtggtata

SEQ ID NO: 268815 - DNA, 25 bp, Rattus norvegicus
ctctggccgtgcttgaggtggtata

SEQ ID NO: 268816 - DNA, 25 bp, Rattus norvegicus
ctctggcctctgatgtcatgagtaa

SEQ ID NO: 268817 - DNA, 25 bp, Rattus norvegicus
ctctggcctctgttgtcatgagtaa

SEQ ID NO: 268818 - DNA, 25 bp, Rattus norvegicus
ctctggcctgttagggtgaaggaca

SEQ ID NO: 268819 - DNA, 25 bp, Rattus norvegicus
ctctggcctgtttgggtgaaggaca

SEQ ID NO: 268820 - DNA, 25 bp, Rattus norvegicus
ctctggccttgtacaatcactatga

SEQ ID NO: 268821 - DNA, 25 bp, Rattus norvegicus
ctctggccttgttcaatcactatga

SEQ ID NO: 268822 - DNA, 25 bp, Rattus norvegicus
ctctggcctttcattggtgtataca

SEQ ID NO: 268823 - DNA, 25 bp, Rattus norvegicus
ctctggcctttctttggtgtataca

SEQ ID NO: 268824 - DNA, 25 bp, Rattus norvegicus
ctctggcgactgagtggtgaatctt

SEQ ID NO: 268825 - DNA, 25 bp, Rattus norvegicus
ctctggcgactgtgtggtgaatctt

SEQ ID NO: 268826 - DNA, 25 bp, Rattus norvegicus
ctctggctaccaccgggatggatat

SEQ ID NO: 268827 - DNA, 25 bp, Rattus norvegicus
ctctggctaccagcgggatggatat

SEQ ID NO: 268828 - DNA, 25 bp, Rattus norvegicus
ctctggctcaccacttgtgcatgtg

SEQ ID NO: 268829 - DNA, 25 bp, Rattus norvegicus
ctctggctcacctcttgtgcatgtg

SEQ ID NO: 268830 - DNA, 25 bp, Rattus norvegicus
ctctggctgccaagtttgtttgtgt

SEQ ID NO: 268831 - DNA, 25 bp, Rattus norvegicus
ctctggctgccatgtttgtttgtgt

SEQ ID NO: 268832 - DNA, 25 bp, Rattus norvegicus
ctctggctggatctcgggttgcact

SEQ ID NO: 268833 - DNA, 25 bp, Rattus norvegicus
ctctggctggatgtcgggttgcact

SEQ ID NO: 268834 - DNA, 25 bp, Rattus norvegicus
ctctggctgggtatcatgtacaaga

SEQ ID NO: 268835 - DNA, 25 bp, Rattus norvegicus
ctctggctgggtatgggactctttg

SEQ ID NO: 268836 - DNA, 25 bp, Rattus norvegicus
ctctggctgggtttcatgtacaaga

SEQ ID NO: 268837 - DNA, 25 bp, Rattus norvegicus
ctctggctgggtttgggactctttg

SEQ ID NO: 268838 - DNA, 25 bp, Rattus norvegicus
ctctggcttctgaatgcatgtgtac

SEQ ID NO: 268839 - DNA, 25 bp, Rattus norvegicus
ctctggcttctgtatgcatgtgtac

SEQ ID NO: 268840 - DNA, 25 bp, Rattus norvegicus
ctctggcttgtaaccaggtcttgga

SEQ ID NO: 268841 - DNA, 25 bp, Rattus norvegicus
ctctggcttgtatccaggtcttgga

SEQ ID NO: 268842 - DNA, 25 bp, Rattus norvegicus
ctctggctttatctttttgactctg

SEQ ID NO: 268843 - DNA, 25 bp, Rattus norvegicus
ctctggctttatgtttttgactctg

SEQ ID NO: 268844 - DNA, 25 bp, Rattus norvegicus
ctctggctttgacaatatcctcttc

SEQ ID NO: 268845 - DNA, 25 bp, Rattus norvegicus
ctctggctttgagaatatcctcttc

SEQ ID NO: 268846 - DNA, 25 bp, Rattus norvegicus
ctctgggaactgagggctctattac

SEQ ID NO: 268847 - DNA, 25 bp, Rattus norvegicus
ctctgggaactgtgggctctattac

SEQ ID NO: 268848 - DNA, 25 bp, Rattus norvegicus
ctctgggaccctaatttcgtgtggt

SEQ ID NO: 268849 - DNA, 25 bp, Rattus norvegicus
ctctgggacccttatttcgtgtggt

SEQ ID NO: 268850 - DNA, 25 bp, Rattus norvegicus
ctctgggacgagcagatcctcctgt

SEQ ID NO: 268851 - DNA, 25 bp, Rattus norvegicus
ctctgggacgaggagatcctcctgt

SEQ ID NO: 268852 - DNA, 25 bp, Rattus norvegicus
ctctgggagagcacggattcagctt

SEQ ID NO: 268853 - DNA, 25 bp, Rattus norvegicus
ctctgggagagctcggattcagctt

SEQ ID NO: 268854 - DNA, 25 bp, Rattus norvegicus
ctctgggaggcgactgagccaccga

SEQ ID NO: 268855 - DNA, 25 bp, Rattus norvegicus
ctctgggaggcgtctgagccaccga

SEQ ID NO: 268856 - DNA, 25 bp, Rattus norvegicus
ctctgggatagcaactgctcatcta

SEQ ID NO: 268857 - DNA, 25 bp, Rattus norvegicus
ctctgggatagctactgctcatcta

SEQ ID NO: 268858 - DNA, 25 bp, Rattus norvegicus
ctctgggatccactatggtaccatg

SEQ ID NO: 268859 - DNA, 25 bp, Rattus norvegicus
ctctgggatccagtatggtaccatg

SEQ ID NO: 268860 - DNA, 25 bp, Rattus norvegicus
ctctgggattttccttgtttgctgt

SEQ ID NO: 268861 - DNA, 25 bp, Rattus norvegicus
ctctgggattttgcttgtttgctgt

SEQ ID NO: 268862 - DNA, 25 bp, Rattus norvegicus
ctctgggcacagactccaagggatt

SEQ ID NO: 268863 - DNA, 25 bp, Rattus norvegicus
ctctgggcacagtctccaagggatt

SEQ ID NO: 268864 - DNA, 25 bp, Rattus norvegicus
ctctgggcagctcgataggatcatc

SEQ ID NO: 268865 - DNA, 25 bp, Rattus norvegicus
ctctgggcagctggataggatcatc

SEQ ID NO: 268866 - DNA, 25 bp, Rattus norvegicus
ctctgggcatttccggcatttcaaa

SEQ ID NO: 268867 - DNA, 25 bp, Rattus norvegicus
ctctgggcatttgcggcatttcaaa

SEQ ID NO: 268868 - DNA, 25 bp, Rattus norvegicus
ctctgggcctatcttctgatggaaa

SEQ ID NO: 268869 - DNA, 25 bp, Rattus norvegicus
ctctgggcctatgttctgatggaaa

SEQ ID NO: 268870 - DNA, 25 bp, Rattus norvegicus
ctctgggctctgcaacaacttgtct

SEQ ID NO: 268871 - DNA, 25 bp, Rattus norvegicus
ctctgggctctggaacaacttgtct

SEQ ID NO: 268872 - DNA, 25 bp, Rattus norvegicus
ctctgggctttcctgtcaatcaaag

SEQ ID NO: 268873 - DNA, 25 bp, Rattus norvegicus
ctctgggctttcgtgtcaatcaaag

SEQ ID NO: 268874 - DNA, 25 bp, Rattus norvegicus
ctctgggctttgatcacttagtgtg

SEQ ID NO: 268875 - DNA, 25 bp, Rattus norvegicus
ctctgggctttgcttatgctaagca

SEQ ID NO: 268876 - DNA, 25 bp, Rattus norvegicus
ctctgggctttggttatgctaagca

SEQ ID NO: 268877 - DNA, 25 bp, Rattus norvegicus
ctctgggctttgttcacttagtgtg

SEQ ID NO: 268878 - DNA, 25 bp, Rattus norvegicus
ctctgggtaccaactgagatttaca

SEQ ID NO: 268879 - DNA, 25 bp, Rattus norvegicus
ctctgggtaccatctgagatttaca

SEQ ID NO: 268880 - DNA, 25 bp, Rattus norvegicus
ctctgggtataaagctgtaggaact

SEQ ID NO: 268881 - DNA, 25 bp, Rattus norvegicus
ctctgggtataatgctgtaggaact

SEQ ID NO: 268882 - DNA, 25 bp, Rattus norvegicus
ctctgggtcatgattgtcctgctga

SEQ ID NO: 268883 - DNA, 25 bp, Rattus norvegicus
ctctgggtcatgtttgtcctgctga

SEQ ID NO: 268884 - DNA, 25 bp, Rattus norvegicus
ctctgggtccctactgaactaagca

SEQ ID NO: 268885 - DNA, 25 bp, Rattus norvegicus
ctctgggtcccttctgaactaagca

SEQ ID NO: 268886 - DNA, 25 bp, Rattus norvegicus
ctctgggtgattattggtgctgaac

SEQ ID NO: 268887 - DNA, 25 bp, Rattus norvegicus
ctctgggtgatttttggtgctgaac

SEQ ID NO: 268888 - DNA, 25 bp, Rattus norvegicus
ctctgggtgcagaagaccgtcttac

SEQ ID NO: 268889 - DNA, 25 bp, Rattus norvegicus
ctctgggtgcagtagaccgtcttac

SEQ ID NO: 268890 - DNA, 25 bp, Rattus norvegicus
ctctgggtgctgagttacgaatgtc

SEQ ID NO: 268891 - DNA, 25 bp, Rattus norvegicus
ctctgggtgctgtgttacgaatgtc

SEQ ID NO: 268892 - DNA, 25 bp, Rattus norvegicus
ctctgggtggctacacatacgtgga

SEQ ID NO: 268893 - DNA, 25 bp, Rattus norvegicus
ctctgggtggcttcacatacgtgga

SEQ ID NO: 268894 - DNA, 25 bp, Rattus norvegicus
ctctgggtggttcttgctgtagtta

SEQ ID NO: 268895 - DNA, 25 bp, Rattus norvegicus
ctctgggtggttgttgctgtagtta

SEQ ID NO: 268896 - DNA, 25 bp, Rattus norvegicus
ctctgggtgttcattgtgctcctca

SEQ ID NO: 268897 - DNA, 25 bp, Rattus norvegicus
ctctgggtgttctttgtgctcctca

SEQ ID NO: 268898 - DNA, 25 bp, Rattus norvegicus
ctctggtaaatacgtcttgggttct

SEQ ID NO: 268899 - DNA, 25 bp, Rattus norvegicus
ctctggtaaataggtcttgggttct

SEQ ID NO: 268900 - DNA, 25 bp, Rattus norvegicus
ctctggtagccacggagccctagaa

SEQ ID NO: 268901 - DNA, 25 bp, Rattus norvegicus
ctctggtagccagggagccctagaa

SEQ ID NO: 268902 - DNA, 25 bp, Rattus norvegicus
ctctggtatgatactgaggccatct

SEQ ID NO: 268903 - DNA, 25 bp, Rattus norvegicus
ctctggtatgattctgaggccatct

SEQ ID NO: 268904 - DNA, 25 bp, Rattus norvegicus
ctctggtcgtaccactggcattgtg

SEQ ID NO: 268905 - DNA, 25 bp, Rattus norvegicus
ctctggtcgtacgactggcattgtg

SEQ ID NO: 268906 - DNA, 25 bp, Rattus norvegicus
ctctggtctgttattctctattaag

SEQ ID NO: 268907 - DNA, 25 bp, Rattus norvegicus
ctctggtctgtttttctctattaag

SEQ ID NO: 268908 - DNA, 25 bp, Rattus norvegicus
ctctggtgacttcggttagctctga

SEQ ID NO: 268909 - DNA, 25 bp, Rattus norvegicus
ctctggtgacttgggttagctctga

SEQ ID NO: 268910 - DNA, 25 bp, Rattus norvegicus
ctctggtgagacacagcacgggctt

SEQ ID NO: 268911 - DNA, 25 bp, Rattus norvegicus
ctctggtgagactcagcacgggctt

SEQ ID NO: 268912 - DNA, 25 bp, Rattus norvegicus
ctctggtggtccattgatctgcaaa

SEQ ID NO: 268913 - DNA, 25 bp, Rattus norvegicus
ctctggtggtcctttgatctgcaaa

SEQ ID NO: 268914 - DNA, 25 bp, Rattus norvegicus
ctctggtggtgcagttctttattgt

SEQ ID NO: 268915 - DNA, 25 bp, Rattus norvegicus
ctctggtggtgctgttctttattgt

SEQ ID NO: 268916 - DNA, 25 bp, Rattus norvegicus
ctctggtgtttcatgtgttgcattt

SEQ ID NO: 268917 - DNA, 25 bp, Rattus norvegicus
ctctggtgtttcttgtgttgcattt

SEQ ID NO: 268918 - DNA, 25 bp, Rattus norvegicus
ctctggtgttttatactgttttatg

SEQ ID NO: 268919 - DNA, 25 bp, Rattus norvegicus
ctctggtgttttttactgttttatg

SEQ ID NO: 268920 - DNA, 25 bp, Rattus norvegicus
ctctggttctgcctgtgagacatga

SEQ ID NO: 268921 - DNA, 25 bp, Rattus norvegicus
ctctggttctgcgtgtgagacatga

SEQ ID NO: 268922 - DNA, 25 bp, Rattus norvegicus
ctctggtttctgaggtgtttttgaa

SEQ ID NO: 268923 - DNA, 25 bp, Rattus norvegicus
ctctggtttctgtggtgtttttgaa

SEQ ID NO: 268924 - DNA, 25 bp, Rattus norvegicus
ctctggtttgttcattcttaaatta

SEQ ID NO: 268925 - DNA, 25 bp, Rattus norvegicus
ctctggtttgttgattcttaaatta

SEQ ID NO: 268926 - DNA, 25 bp, Rattus norvegicus
ctctggttttcacggtaacttctct

SEQ ID NO: 268927 - DNA, 25 bp, Rattus norvegicus
ctctggttttcagggtaacttctct

SEQ ID NO: 268928 - DNA, 25 bp, Rattus norvegicus
ctctgtaaagtcaaggatctggaag

SEQ ID NO: 268929 - DNA, 25 bp, Rattus norvegicus
ctctgtaaagtctaggatctggaag

SEQ ID NO: 268930 - DNA, 25 bp, Rattus norvegicus
ctctgtaagcttctgtgctgtgctg

SEQ ID NO: 268931 - DNA, 25 bp, Rattus norvegicus
ctctgtaagcttgtgtgctgtgctg

SEQ ID NO: 268932 - DNA, 25 bp, Rattus norvegicus
ctctgtaatgtaaagccttagctcc

SEQ ID NO: 268933 - DNA, 25 bp, Rattus norvegicus
ctctgtaatgtatagccttagctcc

SEQ ID NO: 268934 - DNA, 25 bp, Rattus norvegicus
ctctgtacaggacagggttaaactt

SEQ ID NO: 268935 - DNA, 25 bp, Rattus norvegicus
ctctgtacaggagagggttaaactt

SEQ ID NO: 268936 - DNA, 25 bp, Rattus norvegicus
ctctgtactaagactgattggctca

SEQ ID NO: 268937 - DNA, 25 bp, Rattus norvegicus
ctctgtactaagtctgattggctca

SEQ ID NO: 268938 - DNA, 25 bp, Rattus norvegicus
ctctgtagcatgagaggctctgtac

SEQ ID NO: 268939 - DNA, 25 bp, Rattus norvegicus
ctctgtagcatgtgaggctctgtac

SEQ ID NO: 268940 - DNA, 25 bp, Rattus norvegicus
ctctgtagccaaagccgtcccatga

SEQ ID NO: 268941 - DNA, 25 bp, Rattus norvegicus
ctctgtagccaatgccgtcccatga

SEQ ID NO: 268942 - DNA, 25 bp, Rattus norvegicus
ctctgtaggtacatcttggtttggc

SEQ ID NO: 268943 - DNA, 25 bp, Rattus norvegicus
ctctgtaggtacttcttggtttggc

SEQ ID NO: 268944 - DNA, 25 bp, Rattus norvegicus
ctctgtagtcttcccagccttaggg

SEQ ID NO: 268945 - DNA, 25 bp, Rattus norvegicus
ctctgtagtcttgccagccttaggg

SEQ ID NO: 268946 - DNA, 25 bp, Rattus norvegicus
ctctgtatactaattccgtgttgca

SEQ ID NO: 268947 - DNA, 25 bp, Rattus norvegicus
ctctgtatactatttccgtgttgca

SEQ ID NO: 268948 - DNA, 25 bp, Rattus norvegicus
ctctgtcaagtgctccttttgggag

SEQ ID NO: 268949 - DNA, 25 bp, Rattus norvegicus
ctctgtcaagtggtccttttgggag

SEQ ID NO: 268950 - DNA, 25 bp, Rattus norvegicus
ctctgtcacttgaggtggtctctaa

SEQ ID NO: 268951 - DNA, 25 bp, Rattus norvegicus
ctctgtcacttgtggtggtctctaa

SEQ ID NO: 268952 - DNA, 25 bp, Rattus norvegicus
ctctgtcagccaccgtgtgtgcgaa

SEQ ID NO: 268953 - DNA, 25 bp, Rattus norvegicus
ctctgtcagccagcgtgtgtgcgaa

SEQ ID NO: 268954 - DNA, 25 bp, Rattus norvegicus
ctctgtcatcaaccccattagcatt

SEQ ID NO: 268955 - DNA, 25 bp, Rattus norvegicus
ctctgtcatcaagcccattagcatt

SEQ ID NO: 268956 - DNA, 25 bp, Rattus norvegicus
ctctgtccaataaagtatgtgcatc

SEQ ID NO: 268957 - DNA, 25 bp, Rattus norvegicus
ctctgtccaatatagtatgtgcatc

SEQ ID NO: 268958 - DNA, 25 bp, Rattus norvegicus
ctctgtccatctcaatgtctattct

SEQ ID NO: 268959 - DNA, 25 bp, Rattus norvegicus
ctctgtccatctgaatgtctattct

SEQ ID NO: 268960 - DNA, 25 bp, Rattus norvegicus
ctctgtccccttcgtttaggatgga

SEQ ID NO: 268961 - DNA, 25 bp, Rattus norvegicus
ctctgtccccttggtttaggatgga

SEQ ID NO: 268962 - DNA, 25 bp, Rattus norvegicus
ctctgtccctctatgagaatgctga

SEQ ID NO: 268963 - DNA, 25 bp, Rattus norvegicus
ctctgtccctctttgagaatgctga

SEQ ID NO: 268964 - DNA, 25 bp, Rattus norvegicus
ctctgtccctgtctgtcactttcaa

SEQ ID NO: 268965 - DNA, 25 bp, Rattus norvegicus
ctctgtccctgtgtgtcactttcaa

SEQ ID NO: 268966 - DNA, 25 bp, Rattus norvegicus
ctctgtcctagcagcttttgaaggt

SEQ ID NO: 268967 - DNA, 25 bp, Rattus norvegicus
ctctgtcctagctgcttttgaaggt

SEQ ID NO: 268968 - DNA, 25 bp, Rattus norvegicus
ctctgtcctcatcttttttatatta

SEQ ID NO: 268969 - DNA, 25 bp, Rattus norvegicus
ctctgtcctcatgttttttatatta

SEQ ID NO: 268970 - DNA, 25 bp, Rattus norvegicus
ctctgtcctctgagcagtaactatg

SEQ ID NO: 268971 - DNA, 25 bp, Rattus norvegicus
ctctgtcctctgtgcagtaactatg

SEQ ID NO: 268972 - DNA, 25 bp, Rattus norvegicus
ctctgtcctgcaacagggtttcaga

SEQ ID NO: 268973 - DNA, 25 bp, Rattus norvegicus
ctctgtcctgcatcagggtttcaga

SEQ ID NO: 268974 - DNA, 25 bp, Rattus norvegicus
ctctgtcgcgggaagcattggagct

SEQ ID NO: 268975 - DNA, 25 bp, Rattus norvegicus
ctctgtcgcgggtagcattggagct

SEQ ID NO: 268976 - DNA, 25 bp, Rattus norvegicus
ctctgtcgctgtctttttaataaaa

SEQ ID NO: 268977 - DNA, 25 bp, Rattus norvegicus
ctctgtcgctgtgtttttaataaaa

SEQ ID NO: 268978 - DNA, 25 bp, Rattus norvegicus
ctctgtctcaagagtgggtgccaca

SEQ ID NO: 268979 - DNA, 25 bp, Rattus norvegicus
ctctgtctcaagtgtgggtgccaca

SEQ ID NO: 268980 - DNA, 25 bp, Rattus norvegicus
ctctgtctcacaagggctggtaata

SEQ ID NO: 268981 - DNA, 25 bp, Rattus norvegicus
ctctgtctcacatgggctggtaata

SEQ ID NO: 268982 - DNA, 25 bp, Rattus norvegicus
ctctgtctcccactggagaggctga

SEQ ID NO: 268983 - DNA, 25 bp, Rattus norvegicus
ctctgtctcccagtggagaggctga

SEQ ID NO: 268984 - DNA, 25 bp, Rattus norvegicus
ctctgtctcctgagatcattctaaa

SEQ ID NO: 268985 - DNA, 25 bp, Rattus norvegicus
ctctgtctcctgtgatcattctaaa

SEQ ID NO: 268986 - DNA, 25 bp, Rattus norvegicus
ctctgtctctgaccgctggaatcaa

SEQ ID NO: 268987 - DNA, 25 bp, Rattus norvegicus
ctctgtctctgagcgctggaatcaa

SEQ ID NO: 268988 - DNA, 25 bp, Rattus norvegicus
ctctgtctgagcagaaggctgtgat

SEQ ID NO: 268989 - DNA, 25 bp, Rattus norvegicus
ctctgtctgagctgaaggctgtgat

SEQ ID NO: 268990 - DNA, 25 bp, Rattus norvegicus
ctctgtcttcacagacctagaagga

SEQ ID NO: 268991 - DNA, 25 bp, Rattus norvegicus
ctctgtcttcactgacctagaagga

SEQ ID NO: 268992 - DNA, 25 bp, Rattus norvegicus
ctctgtcttcttagtgctcgaagga

SEQ ID NO: 268993 - DNA, 25 bp, Rattus norvegicus
ctctgtcttctttgtgctcgaagga

SEQ ID NO: 268994 - DNA, 25 bp, Rattus norvegicus
ctctgtcttgccagctggtgggaag

SEQ ID NO: 268995 - DNA, 25 bp, Rattus norvegicus
ctctgtcttgcctgctggtgggaag

SEQ ID NO: 268996 - DNA, 25 bp, Rattus norvegicus
ctctgtcttggcacaaaagggcagt

SEQ ID NO: 268997 - DNA, 25 bp, Rattus norvegicus
ctctgtcttggctcaaaagggcagt

SEQ ID NO: 268998 - DNA, 25 bp, Rattus norvegicus
ctctgtcttgttaagtggccttgga

SEQ ID NO: 268999 - DNA, 25 bp, Rattus norvegicus
ctctgtcttgtttagtggccttgga

SEQ ID NO: 269000 - DNA, 25 bp, Rattus norvegicus
ctctgtctttggatttgggtcatgg

SEQ ID NO: 269001 - DNA, 25 bp, Rattus norvegicus
ctctgtctttggttttgggtcatgg

SEQ ID NO: 269002 - DNA, 25 bp, Rattus norvegicus
ctctgtcttttcacattggcttttg

SEQ ID NO: 269003 - DNA, 25 bp, Rattus norvegicus
ctctgtcttttctcattggcttttg

SEQ ID NO: 269004 - DNA, 25 bp, Rattus norvegicus
ctctgtgaaattaacctcaaagtgg

SEQ ID NO: 269005 - DNA, 25 bp, Rattus norvegicus
ctctgtgaaatttacctcaaagtgg

SEQ ID NO: 269006 - DNA, 25 bp, Rattus norvegicus
ctctgtgaacaaccccattctgagg

SEQ ID NO: 269007 - DNA, 25 bp, Rattus norvegicus
ctctgtgaacaagcccattctgagg

SEQ ID NO: 269008 - DNA, 25 bp, Rattus norvegicus
ctctgtgaagacaaagctggccctg

SEQ ID NO: 269009 - DNA, 25 bp, Rattus norvegicus
ctctgtgaagactaagctggccctg

SEQ ID NO: 269010 - DNA, 25 bp, Rattus norvegicus
ctctgtgaagccagcatgggtgtca

SEQ ID NO: 269011 - DNA, 25 bp, Rattus norvegicus
ctctgtgaagcctgcatgggtgtca

SEQ ID NO: 269012 - DNA, 25 bp, Rattus norvegicus
ctctgtgacctcatgactattatct

SEQ ID NO: 269013 - DNA, 25 bp, Rattus norvegicus
ctctgtgacctcttgactattatct

SEQ ID NO: 269014 - DNA, 25 bp, Rattus norvegicus
ctctgtgagagcagggaccatatca

SEQ ID NO: 269015 - DNA, 25 bp, Rattus norvegicus
ctctgtgagagctgggaccatatca

SEQ ID NO: 269016 - DNA, 25 bp, Rattus norvegicus
ctctgtgatattactttgtgccaaa

SEQ ID NO: 269017 - DNA, 25 bp, Rattus norvegicus
ctctgtgatatttctttgtgccaaa

SEQ ID NO: 269018 - DNA, 25 bp, Rattus norvegicus
ctctgtgatgctcacttcaattctt

SEQ ID NO: 269019 - DNA, 25 bp, Rattus norvegicus
ctctgtgatgctgacttcaattctt

SEQ ID NO: 269020 - DNA, 25 bp, Rattus norvegicus
ctctgtgcaaggctccatggtagag

SEQ ID NO: 269021 - DNA, 25 bp, Rattus norvegicus
ctctgtgcaagggtccatggtagag

SEQ ID NO: 269022 - DNA, 25 bp, Rattus norvegicus
ctctgtgcagccagtactgtattgc

SEQ ID NO: 269023 - DNA, 25 bp, Rattus norvegicus
ctctgtgcagcctgtactgtattgc

SEQ ID NO: 269024 - DNA, 25 bp, Rattus norvegicus
ctctgtgcctcaatcaactcagtaa

SEQ ID NO: 269025 - DNA, 25 bp, Rattus norvegicus
ctctgtgcctcattcaactcagtaa

SEQ ID NO: 269026 - DNA, 25 bp, Rattus norvegicus
ctctgtgccttgattccttgggaga

SEQ ID NO: 269027 - DNA, 25 bp, Rattus norvegicus
ctctgtgccttgtttccttgggaga

SEQ ID NO: 269028 - DNA, 25 bp, Rattus norvegicus
ctctgtgctatgagctggtgccttg

SEQ ID NO: 269029 - DNA, 25 bp, Rattus norvegicus
ctctgtgctatgtgctggtgccttg

SEQ ID NO: 269030 - DNA, 25 bp, Rattus norvegicus
ctctgtgctcacagaggttgttcag

SEQ ID NO: 269031 - DNA, 25 bp, Rattus norvegicus
ctctgtgctcactgaggttgttcag

SEQ ID NO: 269032 - DNA, 25 bp, Rattus norvegicus
ctctgtgctgagctgtgtgtttgcc

SEQ ID NO: 269033 - DNA, 25 bp, Rattus norvegicus
ctctgtgctgaggtgtgtgtttgcc

SEQ ID NO: 269034 - DNA, 25 bp, Rattus norvegicus
ctctgtgctggcaacactcaagaca

SEQ ID NO: 269035 - DNA, 25 bp, Rattus norvegicus
ctctgtgctggctacactcaagaca

SEQ ID NO: 269036 - DNA, 25 bp, Rattus norvegicus
ctctgtgctgtaacctggtacaaaa

SEQ ID NO: 269037 - DNA, 25 bp, Rattus norvegicus
ctctgtgctgtaattgccaatgaaa

SEQ ID NO: 269038 - DNA, 25 bp, Rattus norvegicus
ctctgtgctgtatcctggtacaaaa

SEQ ID NO: 269039 - DNA, 25 bp, Rattus norvegicus
ctctgtgctgtatttgccaatgaaa

SEQ ID NO: 269040 - DNA, 25 bp, Rattus norvegicus
ctctgtgcttacatgaagtctccta

SEQ ID NO: 269041 - DNA, 25 bp, Rattus norvegicus
ctctgtgcttacttgaagtctccta

SEQ ID NO: 269042 - DNA, 25 bp, Rattus norvegicus
ctctgtgcttctcgaggcaaggatg

SEQ ID NO: 269043 - DNA, 25 bp, Rattus norvegicus
ctctgtgcttctggaggcaaggatg

SEQ ID NO: 269044 - DNA, 25 bp, Rattus norvegicus
ctctgtggaccgcattgacctcaaa

SEQ ID NO: 269045 - DNA, 25 bp, Rattus norvegicus
ctctgtggaccggattgacctcaaa

SEQ ID NO: 269046 - DNA, 25 bp, Rattus norvegicus
ctctgtggagaaaaaagcaccctat

SEQ ID NO: 269047 - DNA, 25 bp, Rattus norvegicus
ctctgtggagaataaagcaccctat

SEQ ID NO: 269048 - DNA, 25 bp, Rattus norvegicus
ctctgtggcacacctgaggagcact

SEQ ID NO: 269049 - DNA, 25 bp, Rattus norvegicus
ctctgtggcacagctgaggagcact

SEQ ID NO: 269050 - DNA, 25 bp, Rattus norvegicus
ctctgtggcaggacatggccagttt

SEQ ID NO: 269051 - DNA, 25 bp, Rattus norvegicus
ctctgtggcaggtcatggccagttt

SEQ ID NO: 269052 - DNA, 25 bp, Rattus norvegicus
ctctgtggcagtaccgtggcacaaa

SEQ ID NO: 269053 - DNA, 25 bp, Rattus norvegicus
ctctgtggcagttccgtggcacaaa

SEQ ID NO: 269054 - DNA, 25 bp, Rattus norvegicus
ctctgtggccaaactgtatgctttt

SEQ ID NO: 269055 - DNA, 25 bp, Rattus norvegicus
ctctgtggccaatctgtatgctttt

SEQ ID NO: 269056 - DNA, 25 bp, Rattus norvegicus
ctctgtggccagattattaaatcta

SEQ ID NO: 269057 - DNA, 25 bp, Rattus norvegicus
ctctgtggccagtttattaaatcta

SEQ ID NO: 269058 - DNA, 25 bp, Rattus norvegicus
ctctgtggcgctcctgtgagtgttc

SEQ ID NO: 269059 - DNA, 25 bp, Rattus norvegicus
ctctgtggcgctgctgtgagtgttc

SEQ ID NO: 269060 - DNA, 25 bp, Rattus norvegicus
ctctgtggctcgagctgggcagaaa

SEQ ID NO: 269061 - DNA, 25 bp, Rattus norvegicus
ctctgtggctcgtgctgggcagaaa

SEQ ID NO: 269062 - DNA, 25 bp, Rattus norvegicus
ctctgtggctggatctgtggacatg

SEQ ID NO: 269063 - DNA, 25 bp, Rattus norvegicus
ctctgtggctggttctgtggacatg

SEQ ID NO: 269064 - DNA, 25 bp, Rattus norvegicus
ctctgtgggccaaaattgtattctt

SEQ ID NO: 269065 - DNA, 25 bp, Rattus norvegicus
ctctgtgggccataattgtattctt

SEQ ID NO: 269066 - DNA, 25 bp, Rattus norvegicus
ctctgtggtagtcacgtttgtacta

SEQ ID NO: 269067 - DNA, 25 bp, Rattus norvegicus
ctctgtggtagtgacgtttgtacta

SEQ ID NO: 269068 - DNA, 25 bp, Rattus norvegicus
ctctgtggtattcaccttcagtttt

SEQ ID NO: 269069 - DNA, 25 bp, Rattus norvegicus
ctctgtggtattgaccttcagtttt

SEQ ID NO: 269070 - DNA, 25 bp, Rattus norvegicus
ctctgtggtctgagaggccccaaca

SEQ ID NO: 269071 - DNA, 25 bp, Rattus norvegicus
ctctgtggtctgtgaggccccaaca

SEQ ID NO: 269072 - DNA, 25 bp, Rattus norvegicus
ctctgtgtagctatggcagtccgga

SEQ ID NO: 269073 - DNA, 25 bp, Rattus norvegicus
ctctgtgtagctttggcagtccgga

SEQ ID NO: 269074 - DNA, 25 bp, Rattus norvegicus
ctctgtgtatgcaggtgactctgac

SEQ ID NO: 269075 - DNA, 25 bp, Rattus norvegicus
ctctgtgtatgctggtgactctgac

SEQ ID NO: 269076 - DNA, 25 bp, Rattus norvegicus
ctctgtgtattgaatgtgttttaaa

SEQ ID NO: 269077 - DNA, 25 bp, Rattus norvegicus
ctctgtgtattgagccttgtggtga

SEQ ID NO: 269078 - DNA, 25 bp, Rattus norvegicus
ctctgtgtattgtatgtgttttaaa

SEQ ID NO: 269079 - DNA, 25 bp, Rattus norvegicus
ctctgtgtattgtgccttgtggtga

SEQ ID NO: 269080 - DNA, 25 bp, Rattus norvegicus
ctctgtgtctggagttgcattggaa

SEQ ID NO: 269081 - DNA, 25 bp, Rattus norvegicus
ctctgtgtctggtgttgcattggaa

SEQ ID NO: 269082 - DNA, 25 bp, Rattus norvegicus
ctctgtgtgaatcagcacctacctc

SEQ ID NO: 269083 - DNA, 25 bp, Rattus norvegicus
ctctgtgtgaatgagcacctacctc

SEQ ID NO: 269084 - DNA, 25 bp, Rattus norvegicus
ctctgtgtgaccactggtgagtgat

SEQ ID NO: 269085 - DNA, 25 bp, Rattus norvegicus
ctctgtgtgacctctggtgagtgat

SEQ ID NO: 269086 - DNA, 25 bp, Rattus norvegicus
ctctgtgtgagcatgttatctttta

SEQ ID NO: 269087 - DNA, 25 bp, Rattus norvegicus
ctctgtgtgagcttgttatctttta

SEQ ID NO: 269088 - DNA, 25 bp, Rattus norvegicus
ctctgtgtggtcactttattctatg

SEQ ID NO: 269089 - DNA, 25 bp, Rattus norvegicus
ctctgtgtggtctctttattctatg

SEQ ID NO: 269090 - DNA, 25 bp, Rattus norvegicus
ctctgtgttactatttctcttctgc

SEQ ID NO: 269091 - DNA, 25 bp, Rattus norvegicus
ctctgtgttactttttctcttctgc

SEQ ID NO: 269092 - DNA, 25 bp, Rattus norvegicus
ctctgtgttcaacccgggctgcgaa

SEQ ID NO: 269093 - DNA, 25 bp, Rattus norvegicus
ctctgtgttcaagccgggctgcgaa

SEQ ID NO: 269094 - DNA, 25 bp, Rattus norvegicus
ctctgtgttcgtcgacaacagttct

SEQ ID NO: 269095 - DNA, 25 bp, Rattus norvegicus
ctctgtgttcgtggacaacagttct

SEQ ID NO: 269096 - DNA, 25 bp, Rattus norvegicus
ctctgtgttgctcgtcggtaatgtg

SEQ ID NO: 269097 - DNA, 25 bp, Rattus norvegicus
ctctgtgttgctggtcggtaatgtg

SEQ ID NO: 269098 - DNA, 25 bp, Rattus norvegicus
ctctgtgtttccatctcttcatata

SEQ ID NO: 269099 - DNA, 25 bp, Rattus norvegicus
ctctgtgtttccttctcttcatata

SEQ ID NO: 269100 - DNA, 25 bp, Rattus norvegicus
ctctgtgtttgtcttcctttgtaaa

SEQ ID NO: 269101 - DNA, 25 bp, Rattus norvegicus
ctctgtgtttgtgttcctttgtaaa

SEQ ID NO: 269102 - DNA, 25 bp, Rattus norvegicus
ctctgttaacgcagctgctgagcta

SEQ ID NO: 269103 - DNA, 25 bp, Rattus norvegicus
ctctgttaacgctgctgctgagcta

SEQ ID NO: 269104 - DNA, 25 bp, Rattus norvegicus
ctctgttacagtatacctccactta

SEQ ID NO: 269105 - DNA, 25 bp, Rattus norvegicus
ctctgttacagtttacctccactta

SEQ ID NO: 269106 - DNA, 25 bp, Rattus norvegicus
ctctgttacattctcctagcttagg

SEQ ID NO: 269107 - DNA, 25 bp, Rattus norvegicus
ctctgttacattgtcctagcttagg

SEQ ID NO: 269108 - DNA, 25 bp, Rattus norvegicus
ctctgttagattcggaggcctcaca

SEQ ID NO: 269109 - DNA, 25 bp, Rattus norvegicus
ctctgttagattgggaggcctcaca

SEQ ID NO: 269110 - DNA, 25 bp, Rattus norvegicus
ctctgttcatggaggtccgttgcaa

SEQ ID NO: 269111 - DNA, 25 bp, Rattus norvegicus
ctctgttcatggtggtccgttgcaa

SEQ ID NO: 269112 - DNA, 25 bp, Rattus norvegicus
ctctgttcatgtattcaattgtaaa

SEQ ID NO: 269113 - DNA, 25 bp, Rattus norvegicus
ctctgttcatgttttcaattgtaaa

SEQ ID NO: 269114 - DNA, 25 bp, Rattus norvegicus
ctctgttcattcactaacctctaca

SEQ ID NO: 269115 - DNA, 25 bp, Rattus norvegicus
ctctgttcattctctaacctctaca

SEQ ID NO: 269116 - DNA, 25 bp, Rattus norvegicus
ctctgttccactcatacactgggac

SEQ ID NO: 269117 - DNA, 25 bp, Rattus norvegicus
ctctgttccactgatacactgggac

SEQ ID NO: 269118 - DNA, 25 bp, Rattus norvegicus
ctctgttcccatccaattgttcagg

SEQ ID NO: 269119 - DNA, 25 bp, Rattus norvegicus
ctctgttcccatgcaattgttcagg

SEQ ID NO: 269120 - DNA, 25 bp, Rattus norvegicus
ctctgttcccctcgctctaatagaa

SEQ ID NO: 269121 - DNA, 25 bp, Rattus norvegicus
ctctgttcccctggctctaatagaa

SEQ ID NO: 269122 - DNA, 25 bp, Rattus norvegicus
ctctgttcgggcaaggatagtcact

SEQ ID NO: 269123 - DNA, 25 bp, Rattus norvegicus
ctctgttcgggctaggatagtcact

SEQ ID NO: 269124 - DNA, 25 bp, Rattus norvegicus
ctctgttctatcctgggcttgaata

SEQ ID NO: 269125 - DNA, 25 bp, Rattus norvegicus
ctctgttctatcgtgggcttgaata

SEQ ID NO: 269126 - DNA, 25 bp, Rattus norvegicus
ctctgttctcacaaaattgctttct

SEQ ID NO: 269127 - DNA, 25 bp, Rattus norvegicus
ctctgttctcactaaattgctttct

SEQ ID NO: 269128 - DNA, 25 bp, Rattus norvegicus
ctctgttctgcgctttactaaggaa

SEQ ID NO: 269129 - DNA, 25 bp, Rattus norvegicus
ctctgttctgcggtttactaaggaa

SEQ ID NO: 269130 - DNA, 25 bp, Rattus norvegicus
ctctgttctgtgagaccgacgtcgt

SEQ ID NO: 269131 - DNA, 25 bp, Rattus norvegicus
ctctgttctgtgtgaccgacgtcgt

SEQ ID NO: 269132 - DNA, 25 bp, Rattus norvegicus
ctctgttctgttacactgtccataa

SEQ ID NO: 269133 - DNA, 25 bp, Rattus norvegicus
ctctgttctgttctctcattgttga

SEQ ID NO: 269134 - DNA, 25 bp, Rattus norvegicus
ctctgttctgttgtctcattgttga

SEQ ID NO: 269135 - DNA, 25 bp, Rattus norvegicus
ctctgttctgtttcactgtccataa

SEQ ID NO: 269136 - DNA, 25 bp, Rattus norvegicus
ctctgttgagtcaccggcccggagg

SEQ ID NO: 269137 - DNA, 25 bp, Rattus norvegicus
ctctgttgagtctccggcccggagg

SEQ ID NO: 269138 - DNA, 25 bp, Rattus norvegicus
ctctgttgccggcaaccaggaggaa

SEQ ID NO: 269139 - DNA, 25 bp, Rattus norvegicus
ctctgttgccgggaaccaggaggaa

SEQ ID NO: 269140 - DNA, 25 bp, Rattus norvegicus
ctctgttggcaccaggcgtggatat

SEQ ID NO: 269141 - DNA, 25 bp, Rattus norvegicus
ctctgttggcacgaggcgtggatat

SEQ ID NO: 269142 - DNA, 25 bp, Rattus norvegicus
ctctgttggcagaaggcgtcatttt

SEQ ID NO: 269143 - DNA, 25 bp, Rattus norvegicus
ctctgttggcagtaggcgtcatttt

SEQ ID NO: 269144 - DNA, 25 bp, Rattus norvegicus
ctctgttgttcgactttaccatcgt

SEQ ID NO: 269145 - DNA, 25 bp, Rattus norvegicus
ctctgttgttcgtctttaccatcgt

SEQ ID NO: 269146 - DNA, 25 bp, Rattus norvegicus
ctctgtttatctctggcaaggccta

SEQ ID NO: 269147 - DNA, 25 bp, Rattus norvegicus
ctctgtttatctgtggcaaggccta

SEQ ID NO: 269148 - DNA, 25 bp, Rattus norvegicus
ctctgtttcatgattcatggcaata

SEQ ID NO: 269149 - DNA, 25 bp, Rattus norvegicus
ctctgtttcatgtttcatggcaata

SEQ ID NO: 269150 - DNA, 25 bp, Rattus norvegicus
ctctgtttccagaagggtggcaacc

SEQ ID NO: 269151 - DNA, 25 bp, Rattus norvegicus
ctctgtttccagtagggtggcaacc

SEQ ID NO: 269152 - DNA, 25 bp, Rattus norvegicus
ctctgtttctccctctgtgatataa

SEQ ID NO: 269153 - DNA, 25 bp, Rattus norvegicus
ctctgtttctccgtctgtgatataa

SEQ ID NO: 269154 - DNA, 25 bp, Rattus norvegicus
ctctgtttctctacaaatcctggga

SEQ ID NO: 269155 - DNA, 25 bp, Rattus norvegicus
ctctgtttctcttcaaatcctggga

SEQ ID NO: 269156 - DNA, 25 bp, Rattus norvegicus
ctctgtttgagcaggagcaggccaa

SEQ ID NO: 269157 - DNA, 25 bp, Rattus norvegicus
ctctgtttgagctggagcaggccaa

SEQ ID NO: 269158 - DNA, 25 bp, Rattus norvegicus
ctctgtttgcagctgtttggtttcc

SEQ ID NO: 269159 - DNA, 25 bp, Rattus norvegicus
ctctgtttgcaggtgtttggtttcc

SEQ ID NO: 269160 - DNA, 25 bp, Rattus norvegicus
ctctgttttcaccagtgtctcagga

SEQ ID NO: 269161 - DNA, 25 bp, Rattus norvegicus
ctctgttttcacgagtgtctcagga

SEQ ID NO: 269162 - DNA, 25 bp, Rattus norvegicus
ctctgttttctacgcactgttcgat

SEQ ID NO: 269163 - DNA, 25 bp, Rattus norvegicus
ctctgttttctaggcactgttcgat

SEQ ID NO: 269164 - DNA, 25 bp, Rattus norvegicus
ctctgtttttcccaaattctttctg

SEQ ID NO: 269165 - DNA, 25 bp, Rattus norvegicus
ctctgtttttccgaaattctttctg

SEQ ID NO: 269166 - DNA, 25 bp, Rattus norvegicus
ctctgtttttctagctgttgttgat

SEQ ID NO: 269167 - DNA, 25 bp, Rattus norvegicus
ctctgtttttcttgctgttgttgat

SEQ ID NO: 269168 - DNA, 25 bp, Rattus norvegicus
ctcttaaacttgaaagcctgccctt

SEQ ID NO: 269169 - DNA, 25 bp, Rattus norvegicus
ctcttaaacttgtaagcctgccctt

SEQ ID NO: 269170 - DNA, 25 bp, Rattus norvegicus
ctcttaaatcaaaaccaggccctgt

SEQ ID NO: 269171 - DNA, 25 bp, Rattus norvegicus
ctcttaaatcaataccaggccctgt

SEQ ID NO: 269172 - DNA, 25 bp, Rattus norvegicus
ctcttaacttccacattgtctgtag

SEQ ID NO: 269173 - DNA, 25 bp, Rattus norvegicus
ctcttaacttcctcattgtctgtag

SEQ ID NO: 269174 - DNA, 25 bp, Rattus norvegicus
ctcttaagtgttcctcatgttgtca

SEQ ID NO: 269175 - DNA, 25 bp, Rattus norvegicus
ctcttaagtgttgctcatgttgtca

SEQ ID NO: 269176 - DNA, 25 bp, Rattus norvegicus
ctcttaattcctaattcctccaagg

SEQ ID NO: 269177 - DNA, 25 bp, Rattus norvegicus
ctcttaattccttattcctccaagg

SEQ ID NO: 269178 - DNA, 25 bp, Rattus norvegicus
ctcttaattgttcctccttttggtc

SEQ ID NO: 269179 - DNA, 25 bp, Rattus norvegicus
ctcttaattgttgctccttttggtc

SEQ ID NO: 269180 - DNA, 25 bp, Rattus norvegicus
ctcttacccggaacctaacaggatg

SEQ ID NO: 269181 - DNA, 25 bp, Rattus norvegicus
ctcttacccggatcctaacaggatg

SEQ ID NO: 269182 - DNA, 25 bp, Rattus norvegicus
ctcttacctgtcacgatgtctttga

SEQ ID NO: 269183 - DNA, 25 bp, Rattus norvegicus
ctcttacctgtctcgatgtctttga

SEQ ID NO: 269184 - DNA, 25 bp, Rattus norvegicus
ctcttaccttgtcttcagtagctaa

SEQ ID NO: 269185 - DNA, 25 bp, Rattus norvegicus
ctcttaccttgtgttcagtagctaa

SEQ ID NO: 269186 - DNA, 25 bp, Rattus norvegicus
ctcttactgattcgagtctggcaca

SEQ ID NO: 269187 - DNA, 25 bp, Rattus norvegicus
ctcttactgattggagtctggcaca

SEQ ID NO: 269188 - DNA, 25 bp, Rattus norvegicus
ctcttactgggcattcttaaatact

SEQ ID NO: 269189 - DNA, 25 bp, Rattus norvegicus
ctcttactgggctttcttaaatact

SEQ ID NO: 269190 - DNA, 25 bp, Rattus norvegicus
ctcttacttctgagcttggtctcaa

SEQ ID NO: 269191 - DNA, 25 bp, Rattus norvegicus
ctcttacttctgtgcttggtctcaa

SEQ ID NO: 269192 - DNA, 25 bp, Rattus norvegicus
ctcttagacaacaggtggatatcat

SEQ ID NO: 269193 - DNA, 25 bp, Rattus norvegicus
ctcttagacaactggtggatatcat

SEQ ID NO: 269194 - DNA, 25 bp, Rattus norvegicus
ctcttagcacacagccgggcctagg

SEQ ID NO: 269195 - DNA, 25 bp, Rattus norvegicus
ctcttagcacactgccgggcctagg

SEQ ID NO: 269196 - DNA, 25 bp, Rattus norvegicus
ctcttagcttggatctgtgtgggat

SEQ ID NO: 269197 - DNA, 25 bp, Rattus norvegicus
ctcttagcttggttctgtgtgggat

SEQ ID NO: 269198 - DNA, 25 bp, Rattus norvegicus
ctcttagggaagcttctgtggacta

SEQ ID NO: 269199 - DNA, 25 bp, Rattus norvegicus
ctcttagggaaggttctgtggacta

SEQ ID NO: 269200 - DNA, 25 bp, Rattus norvegicus
ctcttagtgtggatgtggtttccct

SEQ ID NO: 269201 - DNA, 25 bp, Rattus norvegicus
ctcttagtgtggttgtggtttccct

SEQ ID NO: 269202 - DNA, 25 bp, Rattus norvegicus
ctcttagttctccttgctttgataa

SEQ ID NO: 269203 - DNA, 25 bp, Rattus norvegicus
ctcttagttctcgttgctttgataa

SEQ ID NO: 269204 - DNA, 25 bp, Rattus norvegicus
ctcttatatttcacagtgccattgg

SEQ ID NO: 269205 - DNA, 25 bp, Rattus norvegicus
ctcttatatttctcagtgccattgg

SEQ ID NO: 269206 - DNA, 25 bp, Rattus norvegicus
ctcttatcttggacccctgttatct

SEQ ID NO: 269207 - DNA, 25 bp, Rattus norvegicus
ctcttatcttggtcccctgttatct

SEQ ID NO: 269208 - DNA, 25 bp, Rattus norvegicus
ctcttatgacgactttggcttctcc

SEQ ID NO: 269209 - DNA, 25 bp, Rattus norvegicus
ctcttatgacgagtttggcttctcc

SEQ ID NO: 269210 - DNA, 25 bp, Rattus norvegicus
ctcttatgcctgctgtgatggctag

SEQ ID NO: 269211 - DNA, 25 bp, Rattus norvegicus
ctcttatgcctggtgtgatggctag

SEQ ID NO: 269212 - DNA, 25 bp, Rattus norvegicus
ctcttcaaccaacaggagctctttg

SEQ ID NO: 269213 - DNA, 25 bp, Rattus norvegicus
ctcttcaaccaagaggagctctttg

SEQ ID NO: 269214 - DNA, 25 bp, Rattus norvegicus
ctcttcaagctacatgggaccacag

SEQ ID NO: 269215 - DNA, 25 bp, Rattus norvegicus
ctcttcaagctagatgggaccacag

SEQ ID NO: 269216 - DNA, 25 bp, Rattus norvegicus
ctcttcaaggacagaagttttctga

SEQ ID NO: 269217 - DNA, 25 bp, Rattus norvegicus
ctcttcaaggactgaagttttctga

SEQ ID NO: 269218 - DNA, 25 bp, Rattus norvegicus
ctcttcaatggccacttctagaata

SEQ ID NO: 269219 - DNA, 25 bp, Rattus norvegicus
ctcttcaatggcgacttctagaata

SEQ ID NO: 269220 - DNA, 25 bp, Rattus norvegicus
ctcttcaccattattgctttcatca

SEQ ID NO: 269221 - DNA, 25 bp, Rattus norvegicus
ctcttcaccatttttgctttcatca

SEQ ID NO: 269222 - DNA, 25 bp, Rattus norvegicus
ctcttcactgctatgtgactctggt

SEQ ID NO: 269223 - DNA, 25 bp, Rattus norvegicus
ctcttcactgctttgtgactctggt

SEQ ID NO: 269224 - DNA, 25 bp, Rattus norvegicus
ctcttcagatacatcttttcgtttt

SEQ ID NO: 269225 - DNA, 25 bp, Rattus norvegicus
ctcttcagatacttcttttcgtttt

SEQ ID NO: 269226 - DNA, 25 bp, Rattus norvegicus
ctcttcagctctacttctatatgtg

SEQ ID NO: 269227 - DNA, 25 bp, Rattus norvegicus
ctcttcagctcttcttctatatgtg

SEQ ID NO: 269228 - DNA, 25 bp, Rattus norvegicus
ctcttcagcttcactgatgcttgaa

SEQ ID NO: 269229 - DNA, 25 bp, Rattus norvegicus
ctcttcagcttctctgatgcttgaa

SEQ ID NO: 269230 - DNA, 25 bp, Rattus norvegicus
ctcttcagtcttagtttccagcata

SEQ ID NO: 269231 - DNA, 25 bp, Rattus norvegicus
ctcttcagtctttgtttccagcata

SEQ ID NO: 269232 - DNA, 25 bp, Rattus norvegicus
ctcttcagttcacccagatgtatct

SEQ ID NO: 269233 - DNA, 25 bp, Rattus norvegicus
ctcttcagttcagccagatgtatct

SEQ ID NO: 269234 - DNA, 25 bp, Rattus norvegicus
ctcttcatctctcttagtgctggaa

SEQ ID NO: 269235 - DNA, 25 bp, Rattus norvegicus
ctcttcatctctgttagtgctggaa

SEQ ID NO: 269236 - DNA, 25 bp, Rattus norvegicus
ctcttccaaactcatctcttacttt

SEQ ID NO: 269237 - DNA, 25 bp, Rattus norvegicus
ctcttccaaactgatctcttacttt

SEQ ID NO: 269238 - DNA, 25 bp, Rattus norvegicus
ctcttccacggtatgctcgatgaaa

SEQ ID NO: 269239 - DNA, 25 bp, Rattus norvegicus
ctcttccacggtttgctcgatgaaa

SEQ ID NO: 269240 - DNA, 25 bp, Rattus norvegicus
ctcttccaggatcatgtttgtatgt

SEQ ID NO: 269241 - DNA, 25 bp, Rattus norvegicus
ctcttccaggatgatgtttgtatgt

SEQ ID NO: 269242 - DNA, 25 bp, Rattus norvegicus
ctcttccaggccattgtggagaggg

SEQ ID NO: 269243 - DNA, 25 bp, Rattus norvegicus
ctcttccaggcctttgtggagaggg

SEQ ID NO: 269244 - DNA, 25 bp, Rattus norvegicus
ctcttcccaaatctcccaaaggtga

SEQ ID NO: 269245 - DNA, 25 bp, Rattus norvegicus
ctcttcccaaatgtcccaaaggtga

SEQ ID NO: 269246 - DNA, 25 bp, Rattus norvegicus
ctcttcccacttctgctaattcaga

SEQ ID NO: 269247 - DNA, 25 bp, Rattus norvegicus
ctcttcccacttgtgctaattcaga

SEQ ID NO: 269248 - DNA, 25 bp, Rattus norvegicus
ctcttcccagcaaggtgatggctga

SEQ ID NO: 269249 - DNA, 25 bp, Rattus norvegicus
ctcttcccagcatggtgatggctga

SEQ ID NO: 269250 - DNA, 25 bp, Rattus norvegicus
ctcttcccatgactattgagtaagt

SEQ ID NO: 269251 - DNA, 25 bp, Rattus norvegicus
ctcttcccatgagtattgagtaagt

SEQ ID NO: 269252 - DNA, 25 bp, Rattus norvegicus
ctcttcccatgcagtcatggtgaga

SEQ ID NO: 269253 - DNA, 25 bp, Rattus norvegicus
ctcttcccatgctgtcatggtgaga

SEQ ID NO: 269254 - DNA, 25 bp, Rattus norvegicus
ctcttccccttcacattagtttgaa

SEQ ID NO: 269255 - DNA, 25 bp, Rattus norvegicus
ctcttccccttctcattagtttgaa

SEQ ID NO: 269256 - DNA, 25 bp, Rattus norvegicus
ctcttccctcttcactgctttgtga

SEQ ID NO: 269257 - DNA, 25 bp, Rattus norvegicus
ctcttccctcttgactgctttgtga

SEQ ID NO: 269258 - DNA, 25 bp, Rattus norvegicus
ctcttccctgtcagtgtaaattgtt

SEQ ID NO: 269259 - DNA, 25 bp, Rattus norvegicus
ctcttccctgtctgtgtaaattgtt

SEQ ID NO: 269260 - DNA, 25 bp, Rattus norvegicus
ctcttcctagcaacccgttaataga

SEQ ID NO: 269261 - DNA, 25 bp, Rattus norvegicus
ctcttcctagcatcccgttaataga

SEQ ID NO: 269262 - DNA, 25 bp, Rattus norvegicus
ctcttcctcgacaatcacaaattac

SEQ ID NO: 269263 - DNA, 25 bp, Rattus norvegicus
ctcttcctcgactatcacaaattac

SEQ ID NO: 269264 - DNA, 25 bp, Rattus norvegicus
ctcttcctcttcagggaaaaaggag

SEQ ID NO: 269265 - DNA, 25 bp, Rattus norvegicus
ctcttcctcttctgggaaaaaggag

SEQ ID NO: 269266 - DNA, 25 bp, Rattus norvegicus
ctcttccttagccagtctcataaaa

SEQ ID NO: 269267 - DNA, 25 bp, Rattus norvegicus
ctcttccttagcgagtctcataaaa

SEQ ID NO: 269268 - DNA, 25 bp, Rattus norvegicus
ctcttccttcaaactgtgttgtgca

SEQ ID NO: 269269 - DNA, 25 bp, Rattus norvegicus
ctcttccttcaatctgtgttgtgca

SEQ ID NO: 269270 - DNA, 25 bp, Rattus norvegicus
ctcttccttggcattcaaggcttaa

SEQ ID NO: 269271 - DNA, 25 bp, Rattus norvegicus
ctcttccttggctttcaaggcttaa

SEQ ID NO: 269272 - DNA, 25 bp, Rattus norvegicus
ctcttccttttaatgctcagggaga

SEQ ID NO: 269273 - DNA, 25 bp, Rattus norvegicus
ctcttccttttattgctcagggaga

SEQ ID NO: 269274 - DNA, 25 bp, Rattus norvegicus
ctcttcgaaccccagtgactggaat

SEQ ID NO: 269275 - DNA, 25 bp, Rattus norvegicus
ctcttcgaacccgagtgactggaat

SEQ ID NO: 269276 - DNA, 25 bp, Rattus norvegicus
ctcttcgacactcagctcattattg

SEQ ID NO: 269277 - DNA, 25 bp, Rattus norvegicus
ctcttcgacactgagctcattattg

SEQ ID NO: 269278 - DNA, 25 bp, Rattus norvegicus
ctcttcgaccttcagtttcttaatt

SEQ ID NO: 269279 - DNA, 25 bp, Rattus norvegicus
ctcttcgaccttgagtttcttaatt

SEQ ID NO: 269280 - DNA, 25 bp, Rattus norvegicus
ctcttcgcaggtcactcggttaagt

SEQ ID NO: 269281 - DNA, 25 bp, Rattus norvegicus
ctcttcgcaggtgactcggttaagt

SEQ ID NO: 269282 - DNA, 25 bp, Rattus norvegicus
ctcttcgctccgctgaaggaatatt

SEQ ID NO: 269283 - DNA, 25 bp, Rattus norvegicus
ctcttcgctccggtgaaggaatatt

SEQ ID NO: 269284 - DNA, 25 bp, Rattus norvegicus
ctcttcggtctccatcttggaaaga

SEQ ID NO: 269285 - DNA, 25 bp, Rattus norvegicus
ctcttcggtctcgatcttggaaaga

SEQ ID NO: 269286 - DNA, 25 bp, Rattus norvegicus
ctcttcgtatgtccgctgtgaggaa

SEQ ID NO: 269287 - DNA, 25 bp, Rattus norvegicus
ctcttcgtatgtgcgctgtgaggaa

SEQ ID NO: 269288 - DNA, 25 bp, Rattus norvegicus
ctcttcgtcctgatgctgtgttaat

SEQ ID NO: 269289 - DNA, 25 bp, Rattus norvegicus
ctcttcgtcctgttgctgtgttaat

SEQ ID NO: 269290 - DNA, 25 bp, Rattus norvegicus
ctcttctaaaatccctgacttcctt

SEQ ID NO: 269291 - DNA, 25 bp, Rattus norvegicus
ctcttctaaaatgcctgacttcctt

SEQ ID NO: 269292 - DNA, 25 bp, Rattus norvegicus
ctcttctagggacaggcacaggcac

SEQ ID NO: 269293 - DNA, 25 bp, Rattus norvegicus
ctcttctagggagaggcacaggcac

SEQ ID NO: 269294 - DNA, 25 bp, Rattus norvegicus
ctcttctaggttatctatctctcca

SEQ ID NO: 269295 - DNA, 25 bp, Rattus norvegicus
ctcttctaggttttctatctctcca

SEQ ID NO: 269296 - DNA, 25 bp, Rattus norvegicus
ctcttctcaaagaggcgtcttttag

SEQ ID NO: 269297 - DNA, 25 bp, Rattus norvegicus
ctcttctcaaagtggcgtcttttag

SEQ ID NO: 269298 - DNA, 25 bp, Rattus norvegicus
ctcttctcaatgacaacatggtcaa

SEQ ID NO: 269299 - DNA, 25 bp, Rattus norvegicus
ctcttctcaatgtcaacatggtcaa

SEQ ID NO: 269300 - DNA, 25 bp, Rattus norvegicus
ctcttctcacttcaggcttatttta

SEQ ID NO: 269301 - DNA, 25 bp, Rattus norvegicus
ctcttctcacttgaggcttatttta

SEQ ID NO: 269302 - DNA, 25 bp, Rattus norvegicus
ctcttctcagtcaaccaggacttta

SEQ ID NO: 269303 - DNA, 25 bp, Rattus norvegicus
ctcttctcagtcagatctctttaac

SEQ ID NO: 269304 - DNA, 25 bp, Rattus norvegicus
ctcttctcagtctaccaggacttta

SEQ ID NO: 269305 - DNA, 25 bp, Rattus norvegicus
ctcttctcagtctgatctctttaac

SEQ ID NO: 269306 - DNA, 25 bp, Rattus norvegicus
ctcttctcatcaagtgtgtcactta

SEQ ID NO: 269307 - DNA, 25 bp, Rattus norvegicus
ctcttctcatcatgtgtgtcactta

SEQ ID NO: 269308 - DNA, 25 bp, Rattus norvegicus
ctcttctccattccatgttgtcaaa

SEQ ID NO: 269309 - DNA, 25 bp, Rattus norvegicus
ctcttctccattgcatgttgtcaaa

SEQ ID NO: 269310 - DNA, 25 bp, Rattus norvegicus
ctcttctcgtccattgttatgatga

SEQ ID NO: 269311 - DNA, 25 bp, Rattus norvegicus
ctcttctcgtcctttgttatgatga

SEQ ID NO: 269312 - DNA, 25 bp, Rattus norvegicus
ctcttctctctcagtatatacataa

SEQ ID NO: 269313 - DNA, 25 bp, Rattus norvegicus
ctcttctctctctgtatatacataa

SEQ ID NO: 269314 - DNA, 25 bp, Rattus norvegicus
ctcttctgtatcagcataggcttga

SEQ ID NO: 269315 - DNA, 25 bp, Rattus norvegicus
ctcttctgtatctgcataggcttga

SEQ ID NO: 269316 - DNA, 25 bp, Rattus norvegicus
ctcttcttaagtcccatcattctgg

SEQ ID NO: 269317 - DNA, 25 bp, Rattus norvegicus
ctcttcttaagtgccatcattctgg

SEQ ID NO: 269318 - DNA, 25 bp, Rattus norvegicus
ctcttcttctgcctttactgaggaa

SEQ ID NO: 269319 - DNA, 25 bp, Rattus norvegicus
ctcttcttctgcgtttactgaggaa

SEQ ID NO: 269320 - DNA, 25 bp, Rattus norvegicus
ctcttcttcttcacttagcagcaga

SEQ ID NO: 269321 - DNA, 25 bp, Rattus norvegicus
ctcttcttcttctcttagcagcaga

SEQ ID NO: 269322 - DNA, 25 bp, Rattus norvegicus
ctcttcttgcttccaggatgaggat

SEQ ID NO: 269323 - DNA, 25 bp, Rattus norvegicus
ctcttcttgcttgcaggatgaggat

SEQ ID NO: 269324 - DNA, 25 bp, Rattus norvegicus
ctcttcttgtttacagggcatgtgt

SEQ ID NO: 269325 - DNA, 25 bp, Rattus norvegicus
ctcttcttgttttcagggcatgtgt

SEQ ID NO: 269326 - DNA, 25 bp, Rattus norvegicus
ctcttctttagaatgccgggaaatg

SEQ ID NO: 269327 - DNA, 25 bp, Rattus norvegicus
ctcttctttagattgccgggaaatg

SEQ ID NO: 269328 - DNA, 25 bp, Rattus norvegicus
ctcttctttcgacgcggtttctgga

SEQ ID NO: 269329 - DNA, 25 bp, Rattus norvegicus
ctcttctttcgaggcggtttctgga

SEQ ID NO: 269330 - DNA, 25 bp, Rattus norvegicus
ctcttcttttgaccatttccataaa

SEQ ID NO: 269331 - DNA, 25 bp, Rattus norvegicus
ctcttcttttgagcatttccataaa

SEQ ID NO: 269332 - DNA, 25 bp, Rattus norvegicus
ctcttgaaccagacaactctctgaa

SEQ ID NO: 269333 - DNA, 25 bp, Rattus norvegicus
ctcttgaaccagtcaactctctgaa

SEQ ID NO: 269334 - DNA, 25 bp, Rattus norvegicus
ctcttgaagagtaagaccccaggtt

SEQ ID NO: 269335 - DNA, 25 bp, Rattus norvegicus
ctcttgaagagttagaccccaggtt

SEQ ID NO: 269336 - DNA, 25 bp, Rattus norvegicus
ctcttgacccctctggatttaaaca

SEQ ID NO: 269337 - DNA, 25 bp, Rattus norvegicus
ctcttgacccctgtggatttaaaca

SEQ ID NO: 269338 - DNA, 25 bp, Rattus norvegicus
ctcttgatcacaccctggtttacat

SEQ ID NO: 269339 - DNA, 25 bp, Rattus norvegicus
ctcttgatcacagcctggtttacat

SEQ ID NO: 269340 - DNA, 25 bp, Rattus norvegicus
ctcttgatttttctgacacagggaa

SEQ ID NO: 269341 - DNA, 25 bp, Rattus norvegicus
ctcttgatttttgtgacacagggaa

SEQ ID NO: 269342 - DNA, 25 bp, Rattus norvegicus
ctcttgcacaccagaatactatgga

SEQ ID NO: 269343 - DNA, 25 bp, Rattus norvegicus
ctcttgcacacctgaatactatgga

SEQ ID NO: 269344 - DNA, 25 bp, Rattus norvegicus
ctcttgcacattccctgcctggatg

SEQ ID NO: 269345 - DNA, 25 bp, Rattus norvegicus
ctcttgcacattgcctgcctggatg

SEQ ID NO: 269346 - DNA, 25 bp, Rattus norvegicus
ctcttgcatgccaggtacctaaggg

SEQ ID NO: 269347 - DNA, 25 bp, Rattus norvegicus
ctcttgcatgcctggtacctaaggg

SEQ ID NO: 269348 - DNA, 25 bp, Rattus norvegicus
ctcttgccagctctgagggtggtaa

SEQ ID NO: 269349 - DNA, 25 bp, Rattus norvegicus
ctcttgccagctgtgagggtggtaa

SEQ ID NO: 269350 - DNA, 25 bp, Rattus norvegicus
ctcttgcccgccacattaataaagt

SEQ ID NO: 269351 - DNA, 25 bp, Rattus norvegicus
ctcttgcccgcctcattaataaagt

SEQ ID NO: 269352 - DNA, 25 bp, Rattus norvegicus
ctcttgccctacatgctgaatagaa

SEQ ID NO: 269353 - DNA, 25 bp, Rattus norvegicus
ctcttgccctacttgctgaatagaa

SEQ ID NO: 269354 - DNA, 25 bp, Rattus norvegicus
ctcttgccctagctttacatatgat

SEQ ID NO: 269355 - DNA, 25 bp, Rattus norvegicus
ctcttgccctaggtttacatatgat

SEQ ID NO: 269356 - DNA, 25 bp, Rattus norvegicus
ctcttgccttctaggtattgggatt

SEQ ID NO: 269357 - DNA, 25 bp, Rattus norvegicus
ctcttgccttcttggtattgggatt

SEQ ID NO: 269358 - DNA, 25 bp, Rattus norvegicus
ctcttgcctttcacatatgctagga

SEQ ID NO: 269359 - DNA, 25 bp, Rattus norvegicus
ctcttgcctttctcatatgctagga

SEQ ID NO: 269360 - DNA, 25 bp, Rattus norvegicus
ctcttgcgggacagtcctggtacct

SEQ ID NO: 269361 - DNA, 25 bp, Rattus norvegicus
ctcttgcgggactgtcctggtacct

SEQ ID NO: 269362 - DNA, 25 bp, Rattus norvegicus
ctcttgcgtgagcaatcttttactt

SEQ ID NO: 269363 - DNA, 25 bp, Rattus norvegicus
ctcttgcgtgaggaatcttttactt

SEQ ID NO: 269364 - DNA, 25 bp, Rattus norvegicus
ctcttgctctatattaaccactgct

SEQ ID NO: 269365 - DNA, 25 bp, Rattus norvegicus
ctcttgctctattttaaccactgct

SEQ ID NO: 269366 - DNA, 25 bp, Rattus norvegicus
ctcttgctgcatagctgctttgcaa

SEQ ID NO: 269367 - DNA, 25 bp, Rattus norvegicus
ctcttgctgcattgctgctttgcaa

SEQ ID NO: 269368 - DNA, 25 bp, Rattus norvegicus
ctcttgctggcaaaggtctgttggg

SEQ ID NO: 269369 - DNA, 25 bp, Rattus norvegicus
ctcttgctggcataggtctgttggg

SEQ ID NO: 269370 - DNA, 25 bp, Rattus norvegicus
ctcttgcttgctccctggaagataa

SEQ ID NO: 269371 - DNA, 25 bp, Rattus norvegicus
ctcttgcttgctgcctggaagataa

SEQ ID NO: 269372 - DNA, 25 bp, Rattus norvegicus
ctcttgctttggctatggaacggga

SEQ ID NO: 269373 - DNA, 25 bp, Rattus norvegicus
ctcttgctttggctgttgtgctgta

SEQ ID NO: 269374 - DNA, 25 bp, Rattus norvegicus
ctcttgctttgggtatggaacggga

SEQ ID NO: 269375 - DNA, 25 bp, Rattus norvegicus
ctcttgctttgggtgttgtgctgta

SEQ ID NO: 269376 - DNA, 25 bp, Rattus norvegicus
ctcttggaaatgaagtcccaccagt

SEQ ID NO: 269377 - DNA, 25 bp, Rattus norvegicus
ctcttggaaatgtagtcccaccagt

SEQ ID NO: 269378 - DNA, 25 bp, Rattus norvegicus
ctcttggagttacttcacagcggcc

SEQ ID NO: 269379 - DNA, 25 bp, Rattus norvegicus
ctcttggagttagttcacagcggcc

SEQ ID NO: 269380 - DNA, 25 bp, Rattus norvegicus
ctcttggatcaactgagctgtacca

SEQ ID NO: 269381 - DNA, 25 bp, Rattus norvegicus
ctcttggatcaagtgagctgtacca

SEQ ID NO: 269382 - DNA, 25 bp, Rattus norvegicus
ctcttggcctttaaagttcatcctt

SEQ ID NO: 269383 - DNA, 25 bp, Rattus norvegicus
ctcttggccttttaagttcatcctt

SEQ ID NO: 269384 - DNA, 25 bp, Rattus norvegicus
ctcttggctgctatagtgattcctt

SEQ ID NO: 269385 - DNA, 25 bp, Rattus norvegicus
ctcttggctgctatattgggtggga

SEQ ID NO: 269386 - DNA, 25 bp, Rattus norvegicus
ctcttggctgctttagtgattcctt

SEQ ID NO: 269387 - DNA, 25 bp, Rattus norvegicus
ctcttggctgctttattgggtggga

SEQ ID NO: 269388 - DNA, 25 bp, Rattus norvegicus
ctcttggcttcactctgaggcaggg

SEQ ID NO: 269389 - DNA, 25 bp, Rattus norvegicus
ctcttggcttcagtctgaggcaggg

SEQ ID NO: 269390 - DNA, 25 bp, Rattus norvegicus
ctcttgggaggcattcgatggccat

SEQ ID NO: 269391 - DNA, 25 bp, Rattus norvegicus
ctcttgggaggctttcgatggccat

SEQ ID NO: 269392 - DNA, 25 bp, Rattus norvegicus
ctcttgggccatcatttctcagaaa

SEQ ID NO: 269393 - DNA, 25 bp, Rattus norvegicus
ctcttgggccatgatttctcagaaa

SEQ ID NO: 269394 - DNA, 25 bp, Rattus norvegicus
ctcttgggccggcaggacacagact

SEQ ID NO: 269395 - DNA, 25 bp, Rattus norvegicus
ctcttgggccgggaggacacagact

SEQ ID NO: 269396 - DNA, 25 bp, Rattus norvegicus
ctcttgggcgctcgtggcctgaaac

SEQ ID NO: 269397 - DNA, 25 bp, Rattus norvegicus
ctcttgggcgctggtggcctgaaac

SEQ ID NO: 269398 - DNA, 25 bp, Rattus norvegicus
ctcttggtagatcgcccatctgaag

SEQ ID NO: 269399 - DNA, 25 bp, Rattus norvegicus
ctcttggtagatggcccatctgaag

SEQ ID NO: 269400 - DNA, 25 bp, Rattus norvegicus
ctcttggtctttatgcctgttgtaa

SEQ ID NO: 269401 - DNA, 25 bp, Rattus norvegicus
ctcttggtctttttgcctgttgtaa

SEQ ID NO: 269402 - DNA, 25 bp, Rattus norvegicus
ctcttggtgaggaggtcactggatc

SEQ ID NO: 269403 - DNA, 25 bp, Rattus norvegicus
ctcttggtgaggtggtcactggatc

SEQ ID NO: 269404 - DNA, 25 bp, Rattus norvegicus
ctcttggtttcgattgggtaatcag

SEQ ID NO: 269405 - DNA, 25 bp, Rattus norvegicus
ctcttggtttcgtttgggtaatcag

SEQ ID NO: 269406 - DNA, 25 bp, Rattus norvegicus
ctcttgtagcttcttcgttttctgt

SEQ ID NO: 269407 - DNA, 25 bp, Rattus norvegicus
ctcttgtagcttgttcgttttctgt

SEQ ID NO: 269408 - DNA, 25 bp, Rattus norvegicus
ctcttgtccactccggtgtgtaaat

SEQ ID NO: 269409 - DNA, 25 bp, Rattus norvegicus
ctcttgtccactgcggtgtgtaaat

SEQ ID NO: 269410 - DNA, 25 bp, Rattus norvegicus
ctcttgtctaatagaggcctccatg

SEQ ID NO: 269411 - DNA, 25 bp, Rattus norvegicus
ctcttgtctaattgaggcctccatg

SEQ ID NO: 269412 - DNA, 25 bp, Rattus norvegicus
ctcttgtctgccatgttagcttgga

SEQ ID NO: 269413 - DNA, 25 bp, Rattus norvegicus
ctcttgtctgccttgttagcttgga

SEQ ID NO: 269414 - DNA, 25 bp, Rattus norvegicus
ctcttgtctgttatatggcactcac

SEQ ID NO: 269415 - DNA, 25 bp, Rattus norvegicus
ctcttgtctgttttatggcactcac

SEQ ID NO: 269416 - DNA, 25 bp, Rattus norvegicus
ctcttgtcttctactaacttgtagt

SEQ ID NO: 269417 - DNA, 25 bp, Rattus norvegicus
ctcttgtcttcttctaacttgtagt

SEQ ID NO: 269418 - DNA, 25 bp, Rattus norvegicus
ctcttgtctttgagtttgttgtctg

SEQ ID NO: 269419 - DNA, 25 bp, Rattus norvegicus
ctcttgtctttgtgtttgttgtctg

SEQ ID NO: 269420 - DNA, 25 bp, Rattus norvegicus
ctcttgtgaacaaagcgactggata

SEQ ID NO: 269421 - DNA, 25 bp, Rattus norvegicus
ctcttgtgaacatagcgactggata

SEQ ID NO: 269422 - DNA, 25 bp, Rattus norvegicus
ctcttgtgaggccaggcataaactc

SEQ ID NO: 269423 - DNA, 25 bp, Rattus norvegicus
ctcttgtgaggcgaggcataaactc

SEQ ID NO: 269424 - DNA, 25 bp, Rattus norvegicus
ctcttgtgggtaaacgtgctgggcc

SEQ ID NO: 269425 - DNA, 25 bp, Rattus norvegicus
ctcttgtgggtatacgtgctgggcc

SEQ ID NO: 269426 - DNA, 25 bp, Rattus norvegicus
ctcttgtggttcagttctttgtgca

SEQ ID NO: 269427 - DNA, 25 bp, Rattus norvegicus
ctcttgtggttctgttctttgtgca

SEQ ID NO: 269428 - DNA, 25 bp, Rattus norvegicus
ctcttgttgcgaccacaggcagtgt

SEQ ID NO: 269429 - DNA, 25 bp, Rattus norvegicus
ctcttgttgcgagcacaggcagtgt

SEQ ID NO: 269430 - DNA, 25 bp, Rattus norvegicus
ctctttaaattcaaggacatcctgg

SEQ ID NO: 269431 - DNA, 25 bp, Rattus norvegicus
ctctttaaattctaggacatcctgg

SEQ ID NO: 269432 - DNA, 25 bp, Rattus norvegicus
ctctttaagatcagtgtcccaaatg

SEQ ID NO: 269433 - DNA, 25 bp, Rattus norvegicus
ctctttaagatctgtgtcccaaatg

SEQ ID NO: 269434 - DNA, 25 bp, Rattus norvegicus
ctctttatagatctgtgtcccacat

SEQ ID NO: 269435 - DNA, 25 bp, Rattus norvegicus
ctctttatagatgtgtgtcccacat

SEQ ID NO: 269436 - DNA, 25 bp, Rattus norvegicus
ctctttatatgtatagtatcgggaa

SEQ ID NO: 269437 - DNA, 25 bp, Rattus norvegicus
ctctttatatgtttagtatcgggaa

SEQ ID NO: 269438 - DNA, 25 bp, Rattus norvegicus
ctctttatgtgcaccagctattttt

SEQ ID NO: 269439 - DNA, 25 bp, Rattus norvegicus
ctctttatgtgctccagctattttt

SEQ ID NO: 269440 - DNA, 25 bp, Rattus norvegicus
ctctttattttcagagccgtccaat

SEQ ID NO: 269441 - DNA, 25 bp, Rattus norvegicus
ctctttattttctgagccgtccaat

SEQ ID NO: 269442 - DNA, 25 bp, Rattus norvegicus
ctctttcaaatcactttccatctgg

SEQ ID NO: 269443 - DNA, 25 bp, Rattus norvegicus
ctctttcaaatctctttccatctgg

SEQ ID NO: 269444 - DNA, 25 bp, Rattus norvegicus
ctctttcaaccaatttcgccattat

SEQ ID NO: 269445 - DNA, 25 bp, Rattus norvegicus
ctctttcaaccattttcgccattat

SEQ ID NO: 269446 - DNA, 25 bp, Rattus norvegicus
ctctttcaagtgatcgtgccagcga

SEQ ID NO: 269447 - DNA, 25 bp, Rattus norvegicus
ctctttcaagtgttcgtgccagcga

SEQ ID NO: 269448 - DNA, 25 bp, Rattus norvegicus
ctctttcagctgaaatgttctcaaa

SEQ ID NO: 269449 - DNA, 25 bp, Rattus norvegicus
ctctttcagctgtaatgttctcaaa

SEQ ID NO: 269450 - DNA, 25 bp, Rattus norvegicus
ctctttccattgagataggccatga

SEQ ID NO: 269451 - DNA, 25 bp, Rattus norvegicus
ctctttccattgtgataggccatga

SEQ ID NO: 269452 - DNA, 25 bp, Rattus norvegicus
ctctttccgagcattctgtcaaaaa

SEQ ID NO: 269453 - DNA, 25 bp, Rattus norvegicus
ctctttccgagctttctgtcaaaaa

SEQ ID NO: 269454 - DNA, 25 bp, Rattus norvegicus
ctctttcgggcacacgatgctttaa

SEQ ID NO: 269455 - DNA, 25 bp, Rattus norvegicus
ctctttcgggcagacgatgctttaa

SEQ ID NO: 269456 - DNA, 25 bp, Rattus norvegicus
ctctttctcctacttgtttcatttc

SEQ ID NO: 269457 - DNA, 25 bp, Rattus norvegicus
ctctttctcctagttgtttcatttc

SEQ ID NO: 269458 - DNA, 25 bp, Rattus norvegicus
ctctttctgactaagctctaggaca

SEQ ID NO: 269459 - DNA, 25 bp, Rattus norvegicus
ctctttctgacttagctctaggaca

SEQ ID NO: 269460 - DNA, 25 bp, Rattus norvegicus
ctctttctgaggacggtgttatttc

SEQ ID NO: 269461 - DNA, 25 bp, Rattus norvegicus
ctctttctgaggtcggtgttatttc

SEQ ID NO: 269462 - DNA, 25 bp, Rattus norvegicus
ctctttcttcatacctgacagtgag

SEQ ID NO: 269463 - DNA, 25 bp, Rattus norvegicus
ctctttcttcattcctgacagtgag

SEQ ID NO: 269464 - DNA, 25 bp, Rattus norvegicus
ctctttcttgttagtggttcattaa

SEQ ID NO: 269465 - DNA, 25 bp, Rattus norvegicus
ctctttcttgtttgtggttcattaa

SEQ ID NO: 269466 - DNA, 25 bp, Rattus norvegicus
ctctttctttttctcatcagtagga

SEQ ID NO: 269467 - DNA, 25 bp, Rattus norvegicus
ctctttctttttgtcatcagtagga

SEQ ID NO: 269468 - DNA, 25 bp, Rattus norvegicus
ctctttgacaaacccacctgacagg

SEQ ID NO: 269469 - DNA, 25 bp, Rattus norvegicus
ctctttgacaaagccacctgacagg

SEQ ID NO: 269470 - DNA, 25 bp, Rattus norvegicus
ctctttgacatacatggtttccatg

SEQ ID NO: 269471 - DNA, 25 bp, Rattus norvegicus
ctctttgacatagatggtttccatg

SEQ ID NO: 269472 - DNA, 25 bp, Rattus norvegicus
ctctttgatttccatggagccacac

SEQ ID NO: 269473 - DNA, 25 bp, Rattus norvegicus
ctctttgatttcgatggagccacac

SEQ ID NO: 269474 - DNA, 25 bp, Rattus norvegicus
ctctttgccttgagtagatcacaga

SEQ ID NO: 269475 - DNA, 25 bp, Rattus norvegicus
ctctttgccttgtgtagatcacaga

SEQ ID NO: 269476 - DNA, 25 bp, Rattus norvegicus
ctctttgctactaggattggtccta

SEQ ID NO: 269477 - DNA, 25 bp, Rattus norvegicus
ctctttgctactattgctcttgtat

SEQ ID NO: 269478 - DNA, 25 bp, Rattus norvegicus
ctctttgctacttggattggtccta

SEQ ID NO: 269479 - DNA, 25 bp, Rattus norvegicus
ctctttgctacttttgctcttgtat

SEQ ID NO: 269480 - DNA, 25 bp, Rattus norvegicus
ctctttggaggtcacaggcaggtca

SEQ ID NO: 269481 - DNA, 25 bp, Rattus norvegicus
ctctttggaggtccctctcgggaga

SEQ ID NO: 269482 - DNA, 25 bp, Rattus norvegicus
ctctttggaggtgacaggcaggtca

SEQ ID NO: 269483 - DNA, 25 bp, Rattus norvegicus
ctctttggaggtgcctctcgggaga

SEQ ID NO: 269484 - DNA, 25 bp, Rattus norvegicus
ctctttggcaccctgtactttgaaa

SEQ ID NO: 269485 - DNA, 25 bp, Rattus norvegicus
ctctttggcaccgtgtactttgaaa

SEQ ID NO: 269486 - DNA, 25 bp, Rattus norvegicus
ctctttggccacaccaggagatgga

SEQ ID NO: 269487 - DNA, 25 bp, Rattus norvegicus
ctctttggccactccaggagatgga

SEQ ID NO: 269488 - DNA, 25 bp, Rattus norvegicus
ctctttggtcagactctatgtggtt

SEQ ID NO: 269489 - DNA, 25 bp, Rattus norvegicus
ctctttggtcagtctctatgtggtt

SEQ ID NO: 269490 - DNA, 25 bp, Rattus norvegicus
ctctttgtcacacggatgggtactt

SEQ ID NO: 269491 - DNA, 25 bp, Rattus norvegicus
ctctttgtcacagggatgggtactt

SEQ ID NO: 269492 - DNA, 25 bp, Rattus norvegicus
ctctttgtgacaaacgcttgtggaa

SEQ ID NO: 269493 - DNA, 25 bp, Rattus norvegicus
ctctttgtgacatacgcttgtggaa

SEQ ID NO: 269494 - DNA, 25 bp, Rattus norvegicus
ctctttgtgggtcactggtattctt

SEQ ID NO: 269495 - DNA, 25 bp, Rattus norvegicus
ctctttgtgggtgactggtattctt

SEQ ID NO: 269496 - DNA, 25 bp, Rattus norvegicus
ctctttgtgtgcctggagccctgtt

SEQ ID NO: 269497 - DNA, 25 bp, Rattus norvegicus
ctctttgtgtgcgtggagccctgtt

SEQ ID NO: 269498 - DNA, 25 bp, Rattus norvegicus
ctctttgtttccatatattcgctaa

SEQ ID NO: 269499 - DNA, 25 bp, Rattus norvegicus
ctctttgtttccttatattcgctaa

SEQ ID NO: 269500 - DNA, 25 bp, Rattus norvegicus
ctctttgttttgattgtccatctct

SEQ ID NO: 269501 - DNA, 25 bp, Rattus norvegicus
ctctttgttttgtttgtccatctct

SEQ ID NO: 269502 - DNA, 25 bp, Rattus norvegicus
ctcttttacagaaatgttagctcca

SEQ ID NO: 269503 - DNA, 25 bp, Rattus norvegicus
ctcttttacagatatgttagctcca

SEQ ID NO: 269504 - DNA, 25 bp, Rattus norvegicus
ctcttttagccccatgttctcttct

SEQ ID NO: 269505 - DNA, 25 bp, Rattus norvegicus
ctcttttagcccgatgttctcttct

SEQ ID NO: 269506 - DNA, 25 bp, Rattus norvegicus
ctcttttcactgagtatttgccaat

SEQ ID NO: 269507 - DNA, 25 bp, Rattus norvegicus
ctcttttcactgtgtatttgccaat

SEQ ID NO: 269508 - DNA, 25 bp, Rattus norvegicus
ctcttttcagtcagtagtttgggaa

SEQ ID NO: 269509 - DNA, 25 bp, Rattus norvegicus
ctcttttcagtctgtagtttgggaa

SEQ ID NO: 269510 - DNA, 25 bp, Rattus norvegicus
ctcttttcagttccgcgtgcgtgcg

SEQ ID NO: 269511 - DNA, 25 bp, Rattus norvegicus
ctcttttcagttgcgcgtgcgtgcg

SEQ ID NO: 269512 - DNA, 25 bp, Rattus norvegicus
ctcttttccttccagattgagaaca

SEQ ID NO: 269513 - DNA, 25 bp, Rattus norvegicus
ctcttttccttcgagattgagaaca

SEQ ID NO: 269514 - DNA, 25 bp, Rattus norvegicus
ctcttttcgtttcaggcagatttaa

SEQ ID NO: 269515 - DNA, 25 bp, Rattus norvegicus
ctcttttcgtttgaggcagatttaa

SEQ ID NO: 269516 - DNA, 25 bp, Rattus norvegicus
ctcttttctgctccaagaagtgaca

SEQ ID NO: 269517 - DNA, 25 bp, Rattus norvegicus
ctcttttctgctgcaagaagtgaca

SEQ ID NO: 269518 - DNA, 25 bp, Rattus norvegicus
ctcttttgacttacagggtttctca

SEQ ID NO: 269519 - DNA, 25 bp, Rattus norvegicus
ctcttttgactttcagggtttctca

SEQ ID NO: 269520 - DNA, 25 bp, Rattus norvegicus
ctcttttgcgtaccatcacagttgt

SEQ ID NO: 269521 - DNA, 25 bp, Rattus norvegicus
ctcttttgcgtagcatcacagttgt

SEQ ID NO: 269522 - DNA, 25 bp, Rattus norvegicus
ctcttttgctgtcaggagctgccat

SEQ ID NO: 269523 - DNA, 25 bp, Rattus norvegicus
ctcttttgctgtgaggagctgccat

SEQ ID NO: 269524 - DNA, 25 bp, Rattus norvegicus
ctcttttggctgagatgggcgcata

SEQ ID NO: 269525 - DNA, 25 bp, Rattus norvegicus
ctcttttggctgtgatgggcgcata

SEQ ID NO: 269526 - DNA, 25 bp, Rattus norvegicus
ctctttttcctcacagggagctaat

SEQ ID NO: 269527 - DNA, 25 bp, Rattus norvegicus
ctctttttcctctcagggagctaat

SEQ ID NO: 269528 - DNA, 25 bp, Rattus norvegicus
ctctttttgtcaagtcttttttcca

SEQ ID NO: 269529 - DNA, 25 bp, Rattus norvegicus
ctctttttgtcatgtcttttttcca

SEQ ID NO: 269530 - DNA, 25 bp, Rattus norvegicus
ctcttttttggcatccagaggaact

SEQ ID NO: 269531 - DNA, 25 bp, Rattus norvegicus
ctcttttttggcttccagaggaact

SEQ ID NO: 269532 - DNA, 25 bp, Rattus norvegicus
ctgaaaaactttactcacctatgtt

SEQ ID NO: 269533 - DNA, 25 bp, Rattus norvegicus
ctgaaaaacttttctcacctatgtt

SEQ ID NO: 269534 - DNA, 25 bp, Rattus norvegicus
ctgaaaactatgatggccacacccc

SEQ ID NO: 269535 - DNA, 25 bp, Rattus norvegicus
ctgaaaactatgttggccacacccc

SEQ ID NO: 269536 - DNA, 25 bp, Rattus norvegicus
ctgaaaactgctacatttgactaat

SEQ ID NO: 269537 - DNA, 25 bp, Rattus norvegicus
ctgaaaactgcttcatttgactaat

SEQ ID NO: 269538 - DNA, 25 bp, Rattus norvegicus
ctgaaaactgtgatctgtgcttttg

SEQ ID NO: 269539 - DNA, 25 bp, Rattus norvegicus
ctgaaaactgtgttctgtgcttttg

SEQ ID NO: 269540 - DNA, 25 bp, Rattus norvegicus
ctgaaaagaggcattctcctggttt

SEQ ID NO: 269541 - DNA, 25 bp, Rattus norvegicus
ctgaaaagaggctttctcctggttt

SEQ ID NO: 269542 - DNA, 25 bp, Rattus norvegicus
ctgaaaagtactatccctcgaccat

SEQ ID NO: 269543 - DNA, 25 bp, Rattus norvegicus
ctgaaaagtactttccctcgaccat

SEQ ID NO: 269544 - DNA, 25 bp, Rattus norvegicus
ctgaaaagtggcaaggccctgggtc

SEQ ID NO: 269545 - DNA, 25 bp, Rattus norvegicus
ctgaaaagtggctaggccctgggtc

SEQ ID NO: 269546 - DNA, 25 bp, Rattus norvegicus
ctgaaaatcataccactttggtggc

SEQ ID NO: 269547 - DNA, 25 bp, Rattus norvegicus
ctgaaaatcatagcactttggtggc

SEQ ID NO: 269548 - DNA, 25 bp, Rattus norvegicus
ctgaaaattttgatgtagacgggaa

SEQ ID NO: 269549 - DNA, 25 bp, Rattus norvegicus
ctgaaaattttgttgtagacgggaa

SEQ ID NO: 269550 - DNA, 25 bp, Rattus norvegicus
ctgaaacaggctatctccatattgt

SEQ ID NO: 269551 - DNA, 25 bp, Rattus norvegicus
ctgaaacaggctttctccatattgt

SEQ ID NO: 269552 - DNA, 25 bp, Rattus norvegicus
ctgaaacattttcctttgtcatata

SEQ ID NO: 269553 - DNA, 25 bp, Rattus norvegicus
ctgaaacattttgctttgtcatata

SEQ ID NO: 269554 - DNA, 25 bp, Rattus norvegicus
ctgaaaccaagcaagggactgactg

SEQ ID NO: 269555 - DNA, 25 bp, Rattus norvegicus
ctgaaaccaagctagggactgactg

SEQ ID NO: 269556 - DNA, 25 bp, Rattus norvegicus
ctgaaacctcgccgccacttgtttt

SEQ ID NO: 269557 - DNA, 25 bp, Rattus norvegicus
ctgaaacctcgcggccacttgtttt

SEQ ID NO: 269558 - DNA, 25 bp, Rattus norvegicus
ctgaaaccttccaagcctgggtaat

SEQ ID NO: 269559 - DNA, 25 bp, Rattus norvegicus
ctgaaaccttcctagcctgggtaat

SEQ ID NO: 269560 - DNA, 25 bp, Rattus norvegicus
ctgaaaccttgtccatgctagccaa

SEQ ID NO: 269561 - DNA, 25 bp, Rattus norvegicus
ctgaaaccttgtgcatgctagccaa

SEQ ID NO: 269562 - DNA, 25 bp, Rattus norvegicus
ctgaaactggtcacattattttgct

SEQ ID NO: 269563 - DNA, 25 bp, Rattus norvegicus
ctgaaactggtctcattattttgct

SEQ ID NO: 269564 - DNA, 25 bp, Rattus norvegicus
ctgaaacttgctcagaggcccgaga

SEQ ID NO: 269565 - DNA, 25 bp, Rattus norvegicus
ctgaaacttgctgagaggcccgaga

SEQ ID NO: 269566 - DNA, 25 bp, Rattus norvegicus
ctgaaagccaccatttgacccaggt

SEQ ID NO: 269567 - DNA, 25 bp, Rattus norvegicus
ctgaaagccaccttttgacccaggt

SEQ ID NO: 269568 - DNA, 25 bp, Rattus norvegicus
ctgaaagccagactgtgcgagaact

SEQ ID NO: 269569 - DNA, 25 bp, Rattus norvegicus
ctgaaagccagagtgtgcgagaact

SEQ ID NO: 269570 - DNA, 25 bp, Rattus norvegicus
ctgaaagcctgacagctgccgcaga

SEQ ID NO: 269571 - DNA, 25 bp, Rattus norvegicus
ctgaaagcctgagagctgccgcaga

SEQ ID NO: 269572 - DNA, 25 bp, Rattus norvegicus
ctgaaagctgctccctattatttga

SEQ ID NO: 269573 - DNA, 25 bp, Rattus norvegicus
ctgaaagctgctgcctattatttga

SEQ ID NO: 269574 - DNA, 25 bp, Rattus norvegicus
ctgaaaggcatccgtgccacgcatc

SEQ ID NO: 269575 - DNA, 25 bp, Rattus norvegicus
ctgaaaggcatcggtgccacgcatc

SEQ ID NO: 269576 - DNA, 25 bp, Rattus norvegicus
ctgaaaggcctgatttggagaggct

SEQ ID NO: 269577 - DNA, 25 bp, Rattus norvegicus
ctgaaaggcctgttttggagaggct

SEQ ID NO: 269578 - DNA, 25 bp, Rattus norvegicus
ctgaaagtacagatacacacataga

SEQ ID NO: 269579 - DNA, 25 bp, Rattus norvegicus
ctgaaagtacagttacacacataga

SEQ ID NO: 269580 - DNA, 25 bp, Rattus norvegicus
ctgaaagtgctcaatcagttccggg

SEQ ID NO: 269581 - DNA, 25 bp, Rattus norvegicus
ctgaaagtgctctatcagttccggg

SEQ ID NO: 269582 - DNA, 25 bp, Rattus norvegicus
ctgaaagtgcttaccggaagttgga

SEQ ID NO: 269583 - DNA, 25 bp, Rattus norvegicus
ctgaaagtgctttccggaagttgga

SEQ ID NO: 269584 - DNA, 25 bp, Rattus norvegicus
ctgaaataaatgctgtctgtcacgt

SEQ ID NO: 269585 - DNA, 25 bp, Rattus norvegicus
ctgaaataaatggtgtctgtcacgt

SEQ ID NO: 269586 - DNA, 25 bp, Rattus norvegicus
ctgaaatcactcatgggactgccgt

SEQ ID NO: 269587 - DNA, 25 bp, Rattus norvegicus
ctgaaatcactcttgggactgccgt

SEQ ID NO: 269588 - DNA, 25 bp, Rattus norvegicus
ctgaaatccactcccacatgaatgt

SEQ ID NO: 269589 - DNA, 25 bp, Rattus norvegicus
ctgaaatccactgccacatgaatgt

SEQ ID NO: 269590 - DNA, 25 bp, Rattus norvegicus
ctgaaatccttgaagtactcacttt

SEQ ID NO: 269591 - DNA, 25 bp, Rattus norvegicus
ctgaaatccttgtagtactcacttt

SEQ ID NO: 269592 - DNA, 25 bp, Rattus norvegicus
ctgaaatctatcacctagcctgtaa

SEQ ID NO: 269593 - DNA, 25 bp, Rattus norvegicus
ctgaaatctatctcctagcctgtaa

SEQ ID NO: 269594 - DNA, 25 bp, Rattus norvegicus
ctgaaatctgtcatggccattggtc

SEQ ID NO: 269595 - DNA, 25 bp, Rattus norvegicus
ctgaaatctgtcttggccattggtc

SEQ ID NO: 269596 - DNA, 25 bp, Rattus norvegicus
ctgaaatgcacactggtctccaggg

SEQ ID NO: 269597 - DNA, 25 bp, Rattus norvegicus
ctgaaatgcacagtggtctccaggg

SEQ ID NO: 269598 - DNA, 25 bp, Rattus norvegicus
ctgaaatgccagagcctctaactaa

SEQ ID NO: 269599 - DNA, 25 bp, Rattus norvegicus
ctgaaatgccagtgcctctaactaa

SEQ ID NO: 269600 - DNA, 25 bp, Rattus norvegicus
ctgaaattatcaaccacacgccttt

SEQ ID NO: 269601 - DNA, 25 bp, Rattus norvegicus
ctgaaattatcatccacacgccttt

SEQ ID NO: 269602 - DNA, 25 bp, Rattus norvegicus
ctgaaattttgtaccacggccagga

SEQ ID NO: 269603 - DNA, 25 bp, Rattus norvegicus
ctgaaattttgttccacggccagga

SEQ ID NO: 269604 - DNA, 25 bp, Rattus norvegicus
ctgaacaaggccaggcctcggccgg

SEQ ID NO: 269605 - DNA, 25 bp, Rattus norvegicus
ctgaacaaggcctggcctcggccgg

SEQ ID NO: 269606 - DNA, 25 bp, Rattus norvegicus
ctgaacaatcaaagcacttggactc

SEQ ID NO: 269607 - DNA, 25 bp, Rattus norvegicus
ctgaacaatcaatgcacttggactc

SEQ ID NO: 269608 - DNA, 25 bp, Rattus norvegicus
ctgaacacagtacagggtagccacc

SEQ ID NO: 269609 - DNA, 25 bp, Rattus norvegicus
ctgaacacagtagagggtagccacc

SEQ ID NO: 269610 - DNA, 25 bp, Rattus norvegicus
ctgaacacggaacgacccatctctt

SEQ ID NO: 269611 - DNA, 25 bp, Rattus norvegicus
ctgaacacggaaggacccatctctt

SEQ ID NO: 269612 - DNA, 25 bp, Rattus norvegicus
ctgaacacttgaccctgtagacgga

SEQ ID NO: 269613 - DNA, 25 bp, Rattus norvegicus
ctgaacacttgagcctgtagacgga

SEQ ID NO: 269614 - DNA, 25 bp, Rattus norvegicus
ctgaacactttaacctgcatttttt

SEQ ID NO: 269615 - DNA, 25 bp, Rattus norvegicus
ctgaacactttatcctgcatttttt

SEQ ID NO: 269616 - DNA, 25 bp, Rattus norvegicus
ctgaacagattactgcacttcctct

SEQ ID NO: 269617 - DNA, 25 bp, Rattus norvegicus
ctgaacagattagtgcacttcctct

SEQ ID NO: 269618 - DNA, 25 bp, Rattus norvegicus
ctgaacatactcacgttgcctctga

SEQ ID NO: 269619 - DNA, 25 bp, Rattus norvegicus
ctgaacatactctcgttgcctctga

SEQ ID NO: 269620 - DNA, 25 bp, Rattus norvegicus
ctgaacatcggtcgccccagggaaa

SEQ ID NO: 269621 - DNA, 25 bp, Rattus norvegicus
ctgaacatcggtggccccagggaaa

SEQ ID NO: 269622 - DNA, 25 bp, Rattus norvegicus
ctgaaccaagaacggagcacgattt

SEQ ID NO: 269623 - DNA, 25 bp, Rattus norvegicus
ctgaaccaagaagggagcacgattt

SEQ ID NO: 269624 - DNA, 25 bp, Rattus norvegicus
ctgaacccaagaaccttttctctta

SEQ ID NO: 269625 - DNA, 25 bp, Rattus norvegicus
ctgaacccaagatccttttctctta

SEQ ID NO: 269626 - DNA, 25 bp, Rattus norvegicus
ctgaacccagatagtcacctgacta

SEQ ID NO: 269627 - DNA, 25 bp, Rattus norvegicus
ctgaacccagattgtcacctgacta

SEQ ID NO: 269628 - DNA, 25 bp, Rattus norvegicus
ctgaaccccagcacaaactttgaga

SEQ ID NO: 269629 - DNA, 25 bp, Rattus norvegicus
ctgaaccccagctcaaactttgaga

SEQ ID NO: 269630 - DNA, 25 bp, Rattus norvegicus
ctgaaccctgtcattagcttggaga

SEQ ID NO: 269631 - DNA, 25 bp, Rattus norvegicus
ctgaaccctgtctttagcttggaga

SEQ ID NO: 269632 - DNA, 25 bp, Rattus norvegicus
ctgaacctctatccctatcattggt

SEQ ID NO: 269633 - DNA, 25 bp, Rattus norvegicus
ctgaacctctatgcctatcattggt

SEQ ID NO: 269634 - DNA, 25 bp, Rattus norvegicus
ctgaacctgaatcagtacaacttga

SEQ ID NO: 269635 - DNA, 25 bp, Rattus norvegicus
ctgaacctgaatgagtacaacttga

SEQ ID NO: 269636 - DNA, 25 bp, Rattus norvegicus
ctgaaccttttaaggtattccttat

SEQ ID NO: 269637 - DNA, 25 bp, Rattus norvegicus
ctgaaccttttatggtattccttat

SEQ ID NO: 269638 - DNA, 25 bp, Rattus norvegicus
ctgaacgagatgaagaccttcccca

SEQ ID NO: 269639 - DNA, 25 bp, Rattus norvegicus
ctgaacgagatgtagaccttcccca

SEQ ID NO: 269640 - DNA, 25 bp, Rattus norvegicus
ctgaacgcagcccaaagtgtcatat

SEQ ID NO: 269641 - DNA, 25 bp, Rattus norvegicus
ctgaacgcagccgaaagtgtcatat

SEQ ID NO: 269642 - DNA, 25 bp, Rattus norvegicus
ctgaacgccccgagcaggtgaaggt

SEQ ID NO: 269643 - DNA, 25 bp, Rattus norvegicus
ctgaacgccccgtgcaggtgaaggt

SEQ ID NO: 269644 - DNA, 25 bp, Rattus norvegicus
ctgaacgcgccccatctcgtctgat

SEQ ID NO: 269645 - DNA, 25 bp, Rattus norvegicus
ctgaacgcgcccgatctcgtctgat

SEQ ID NO: 269646 - DNA, 25 bp, Rattus norvegicus
ctgaacgggccaatgaacaagtatt

SEQ ID NO: 269647 - DNA, 25 bp, Rattus norvegicus
ctgaacgggccattgaacaagtatt

SEQ ID NO: 269648 - DNA, 20 bp, Rattus norvegicus
ctgaacggtagcatcttgac

SEQ ID NO: 269649 - DNA, 25 bp, Rattus norvegicus
ctgaacgtcagcaggcattgaggcc

SEQ ID NO: 269650 - DNA, 25 bp, Rattus norvegicus
ctgaacgtcagctggcattgaggcc

SEQ ID NO: 269651 - DNA, 25 bp, Rattus norvegicus
ctgaacgttttgctgccttgagaaa

SEQ ID NO: 269652 - DNA, 25 bp, Rattus norvegicus
ctgaacgttttggtgccttgagaaa

SEQ ID NO: 269653 - DNA, 25 bp, Rattus norvegicus
ctgaactcagaaaccagggagaata

SEQ ID NO: 269654 - DNA, 25 bp, Rattus norvegicus
ctgaactcagaatccagggagaata

SEQ ID NO: 269655 - DNA, 25 bp, Rattus norvegicus
ctgaactcctgtagtaatggctaaa

SEQ ID NO: 269656 - DNA, 25 bp, Rattus norvegicus
ctgaactcctgttgtaatggctaaa

SEQ ID NO: 269657 - DNA, 25 bp, Rattus norvegicus
ctgaactctcagctacagattttga

SEQ ID NO: 269658 - DNA, 25 bp, Rattus norvegicus
ctgaactctcaggtacagattttga

SEQ ID NO: 269659 - DNA, 25 bp, Rattus norvegicus
ctgaactctttaagcacccttaatt

SEQ ID NO: 269660 - DNA, 25 bp, Rattus norvegicus
ctgaactctttatgcacccttaatt

SEQ ID NO: 269661 - DNA, 25 bp, Rattus norvegicus
ctgaactgcagcctccgaggaaatc

SEQ ID NO: 269662 - DNA, 25 bp, Rattus norvegicus
ctgaactgcagcgtccgaggaaatc

SEQ ID NO: 269663 - DNA, 25 bp, Rattus norvegicus
ctgaactggattccccttcaataca

SEQ ID NO: 269664 - DNA, 25 bp, Rattus norvegicus
ctgaactggattgcccttcaataca

SEQ ID NO: 269665 - DNA, 25 bp, Rattus norvegicus
ctgaactggttgagacattactatc

SEQ ID NO: 269666 - DNA, 25 bp, Rattus norvegicus
ctgaactggttgtgacattactatc

SEQ ID NO: 269667 - DNA, 25 bp, Rattus norvegicus
ctgaactgtcccagcatgaggtgga

SEQ ID NO: 269668 - DNA, 25 bp, Rattus norvegicus
ctgaactgtccctgcatgaggtgga

SEQ ID NO: 269669 - DNA, 25 bp, Rattus norvegicus
ctgaacttcaggactccagaggaga

SEQ ID NO: 269670 - DNA, 25 bp, Rattus norvegicus
ctgaacttcaggtctccagaggaga

SEQ ID NO: 269671 - DNA, 25 bp, Rattus norvegicus
ctgaacttgcggcttcccaggaaag

SEQ ID NO: 269672 - DNA, 25 bp, Rattus norvegicus
ctgaacttgcgggttcccaggaaag

SEQ ID NO: 269673 - DNA, 25 bp, Rattus norvegicus
ctgaactttgtgcaggaactctgta

SEQ ID NO: 269674 - DNA, 25 bp, Rattus norvegicus
ctgaactttgtggaggaactctgta

SEQ ID NO: 269675 - DNA, 25 bp, Rattus norvegicus
ctgaagaacttcaaggcaccctcaa

SEQ ID NO: 269676 - DNA, 25 bp, Rattus norvegicus
ctgaagaacttctaggcaccctcaa

SEQ ID NO: 269677 - DNA, 25 bp, Rattus norvegicus
ctgaagaagaatccccgaaagactt

SEQ ID NO: 269678 - DNA, 25 bp, Rattus norvegicus
ctgaagaagaatgcccgaaagactt

SEQ ID NO: 269679 - DNA, 25 bp, Rattus norvegicus
ctgaagaagtttcctcctcctgctt

SEQ ID NO: 269680 - DNA, 25 bp, Rattus norvegicus
ctgaagaagtttgctcctcctgctt

SEQ ID NO: 269681 - DNA, 25 bp, Rattus norvegicus
ctgaagacagtactccacaaggtga

SEQ ID NO: 269682 - DNA, 25 bp, Rattus norvegicus
ctgaagacagtagtccacaaggtga

SEQ ID NO: 269683 - DNA, 25 bp, Rattus norvegicus
ctgaagacagtgaagtcacatacat

SEQ ID NO: 269684 - DNA, 25 bp, Rattus norvegicus
ctgaagacagtgtagtcacatacat

SEQ ID NO: 269685 - DNA, 25 bp, Rattus norvegicus
ctgaagacccctccagagagaaaat

SEQ ID NO: 269686 - DNA, 25 bp, Rattus norvegicus
ctgaagacccctgcagagagaaaat

SEQ ID NO: 269687 - DNA, 25 bp, Rattus norvegicus
ctgaagagcactcaagcctctgtga

SEQ ID NO: 269688 - DNA, 25 bp, Rattus norvegicus
ctgaagagcactgaagcctctgtga

SEQ ID NO: 269689 - DNA, 25 bp, Rattus norvegicus
ctgaagagcccacttccaagtcaat

SEQ ID NO: 269690 - DNA, 25 bp, Rattus norvegicus
ctgaagagcccagttccaagtcaat

SEQ ID NO: 269691 - DNA, 25 bp, Rattus norvegicus
ctgaagagtcagctttgggctaaag

SEQ ID NO: 269692 - DNA, 25 bp, Rattus norvegicus
ctgaagagtcaggtttgggctaaag

SEQ ID NO: 269693 - DNA, 25 bp, Rattus norvegicus
ctgaagatggtccacagcttccata

SEQ ID NO: 269694 - DNA, 25 bp, Rattus norvegicus
ctgaagatggtcgacagcttccata

SEQ ID NO: 269695 - DNA, 25 bp, Rattus norvegicus
ctgaagatgttcagcaccggcttgt

SEQ ID NO: 269696 - DNA, 25 bp, Rattus norvegicus
ctgaagatgttcagtctgcagtgaa

SEQ ID NO: 269697 - DNA, 25 bp, Rattus norvegicus
ctgaagatgttctgcaccggcttgt

SEQ ID NO: 269698 - DNA, 25 bp, Rattus norvegicus
ctgaagatgttctgtctgcagtgaa

SEQ ID NO: 269699 - DNA, 25 bp, Rattus norvegicus
ctgaagcaaggaacctcatgtcggg

SEQ ID NO: 269700 - DNA, 25 bp, Rattus norvegicus
ctgaagcaaggatcctcatgtcggg

SEQ ID NO: 269701 - DNA, 25 bp, Rattus norvegicus
ctgaagcaccgtccgccgtagatga

SEQ ID NO: 269702 - DNA, 25 bp, Rattus norvegicus
ctgaagcaccgtgcgccgtagatga

SEQ ID NO: 269703 - DNA, 25 bp, Rattus norvegicus
ctgaagcagcagcatccaggccctt

SEQ ID NO: 269704 - DNA, 25 bp, Rattus norvegicus
ctgaagcagcaggatccaggccctt

SEQ ID NO: 269705 - DNA, 25 bp, Rattus norvegicus
ctgaagcagcgcatgcgagctttgg

SEQ ID NO: 269706 - DNA, 25 bp, Rattus norvegicus
ctgaagcagcgcttgcgagctttgg

SEQ ID NO: 269707 - DNA, 25 bp, Rattus norvegicus
ctgaagcatctcatggtgtctgttt

SEQ ID NO: 269708 - DNA, 25 bp, Rattus norvegicus
ctgaagcatctcttggtgtctgttt

SEQ ID NO: 269709 - DNA, 25 bp, Rattus norvegicus
ctgaagccaaggacaggtcggtcag

SEQ ID NO: 269710 - DNA, 25 bp, Rattus norvegicus
ctgaagccaaggtcaggtcggtcag

SEQ ID NO: 269711 - DNA, 25 bp, Rattus norvegicus
ctgaagccacaacagcacagctgat

SEQ ID NO: 269712 - DNA, 25 bp, Rattus norvegicus
ctgaagccacaagagcacagctgat

SEQ ID NO: 269713 - DNA, 25 bp, Rattus norvegicus
ctgaagccacatcattaccccaagt

SEQ ID NO: 269714 - DNA, 25 bp, Rattus norvegicus
ctgaagccacatgattaccccaagt

SEQ ID NO: 269715 - DNA, 25 bp, Rattus norvegicus
ctgaagccacttaacattcctgagc

SEQ ID NO: 269716 - DNA, 25 bp, Rattus norvegicus
ctgaagccactttacattcctgagc

SEQ ID NO: 269717 - DNA, 25 bp, Rattus norvegicus
ctgaagccagagctgatgtactttc

SEQ ID NO: 269718 - DNA, 25 bp, Rattus norvegicus
ctgaagccagaggtgatgtactttc

SEQ ID NO: 269719 - DNA, 25 bp, Rattus norvegicus
ctgaagccatccaccttttattttt

SEQ ID NO: 269720 - DNA, 25 bp, Rattus norvegicus
ctgaagccatcctccttttattttt

SEQ ID NO: 269721 - DNA, 25 bp, Rattus norvegicus
ctgaagcccactccggaaactaaag

SEQ ID NO: 269722 - DNA, 25 bp, Rattus norvegicus
ctgaagcccactgcggaaactaaag

SEQ ID NO: 269723 - DNA, 25 bp, Rattus norvegicus
ctgaagccttgaatgagcgtgggca

SEQ ID NO: 269724 - DNA, 25 bp, Rattus norvegicus
ctgaagccttgattgagcgtgggca

SEQ ID NO: 269725 - DNA, 25 bp, Rattus norvegicus
ctgaagctcagccagctctgacttt

SEQ ID NO: 269726 - DNA, 25 bp, Rattus norvegicus
ctgaagctcagcgagctctgacttt

SEQ ID NO: 269727 - DNA, 25 bp, Rattus norvegicus
ctgaagctccccaaaatctgacaat

SEQ ID NO: 269728 - DNA, 25 bp, Rattus norvegicus
ctgaagctcccctaaatctgacaat

SEQ ID NO: 269729 - DNA, 25 bp, Rattus norvegicus
ctgaagctcctgattccttttaagt

SEQ ID NO: 269730 - DNA, 25 bp, Rattus norvegicus
ctgaagctcctgtttccttttaagt

SEQ ID NO: 269731 - DNA, 25 bp, Rattus norvegicus
ctgaagctgagacagatcatgctgt

SEQ ID NO: 269732 - DNA, 25 bp, Rattus norvegicus
ctgaagctgagagagatcatgctgt

SEQ ID NO: 269733 - DNA, 25 bp, Rattus norvegicus
ctgaagctgctaacacttgctgtga

SEQ ID NO: 269734 - DNA, 25 bp, Rattus norvegicus
ctgaagctgctatcacttgctgtga

SEQ ID NO: 269735 - DNA, 25 bp, Rattus norvegicus
ctgaagcttctgatcctgggagaga

SEQ ID NO: 269736 - DNA, 25 bp, Rattus norvegicus
ctgaagcttctgttcctgggagaga

SEQ ID NO: 269737 - DNA, 25 bp, Rattus norvegicus
ctgaagctttttccaccaacagagc

SEQ ID NO: 269738 - DNA, 25 bp, Rattus norvegicus
ctgaagctttttgcaccaacagagc

SEQ ID NO: 269739 - DNA, 25 bp, Rattus norvegicus
ctgaaggaccctcctgggaagagta

SEQ ID NO: 269740 - DNA, 25 bp, Rattus norvegicus
ctgaaggaccctgctgggaagagta

SEQ ID NO: 269741 - DNA, 25 bp, Rattus norvegicus
ctgaaggacttcaggtaagcccaga

SEQ ID NO: 269742 - DNA, 25 bp, Rattus norvegicus
ctgaaggacttctggtaagcccaga

SEQ ID NO: 269743 - DNA, 25 bp, Rattus norvegicus
ctgaaggatgagagttcccgggcct

SEQ ID NO: 269744 - DNA, 25 bp, Rattus norvegicus
ctgaaggatgagtgttcccgggcct

SEQ ID NO: 269745 - DNA, 25 bp, Rattus norvegicus
ctgaaggcaatccacagacgtgtgt

SEQ ID NO: 269746 - DNA, 25 bp, Rattus norvegicus
ctgaaggcaatcgacagacgtgtgt

SEQ ID NO: 269747 - DNA, 25 bp, Rattus norvegicus
ctgaaggcagcacggaacctaccac

SEQ ID NO: 269748 - DNA, 25 bp, Rattus norvegicus
ctgaaggcagcagggaacctaccac

SEQ ID NO: 269749 - DNA, 25 bp, Rattus norvegicus
ctgaaggccacacctcccatgagaa

SEQ ID NO: 269750 - DNA, 25 bp, Rattus norvegicus
ctgaaggccacagctcccatgagaa

SEQ ID NO: 269751 - DNA, 25 bp, Rattus norvegicus
ctgaaggcctacagggctgagagta

SEQ ID NO: 269752 - DNA, 25 bp, Rattus norvegicus
ctgaaggcctactgggctgagagta

SEQ ID NO: 269753 - DNA, 25 bp, Rattus norvegicus
ctgaagggctttctacccaggacaa

SEQ ID NO: 269754 - DNA, 25 bp, Rattus norvegicus
ctgaagggctttgtacccaggacaa

SEQ ID NO: 269755 - DNA, 25 bp, Rattus norvegicus
ctgaaggtaactccattctgtgtaa

SEQ ID NO: 269756 - DNA, 25 bp, Rattus norvegicus
ctgaaggtaactgcattctgtgtaa

SEQ ID NO: 269757 - DNA, 25 bp, Rattus norvegicus
ctgaaggtactgaggactctgtgtc

SEQ ID NO: 269758 - DNA, 25 bp, Rattus norvegicus
ctgaaggtactgtggactctgtgtc

SEQ ID NO: 269759 - DNA, 25 bp, Rattus norvegicus
ctgaaggtcatcagtgtgagctcca

SEQ ID NO: 269760 - DNA, 25 bp, Rattus norvegicus
ctgaaggtcatctgtgtgagctcca

SEQ ID NO: 269761 - DNA, 25 bp, Rattus norvegicus
ctgaaggtccagatgaggccccttt

SEQ ID NO: 269762 - DNA, 25 bp, Rattus norvegicus
ctgaaggtccagttgaggccccttt

SEQ ID NO: 269763 - DNA, 25 bp, Rattus norvegicus
ctgaagtacatacggccactgggta

SEQ ID NO: 269764 - DNA, 25 bp, Rattus norvegicus
ctgaagtacatagggccactgggta

SEQ ID NO: 269765 - DNA, 25 bp, Rattus norvegicus
ctgaagtatcgaattgccctggcaa

SEQ ID NO: 269766 - DNA, 25 bp, Rattus norvegicus
ctgaagtatcgatttgccctggcaa

SEQ ID NO: 269767 - DNA, 25 bp, Rattus norvegicus
ctgaagtcccagctgtagacacagt

SEQ ID NO: 269768 - DNA, 25 bp, Rattus norvegicus
ctgaagtcccaggtgtagacacagt

SEQ ID NO: 269769 - DNA, 25 bp, Rattus norvegicus
ctgaagtctcaacgtcccagaggcc

SEQ ID NO: 269770 - DNA, 25 bp, Rattus norvegicus
ctgaagtctcaaggtcccagaggcc

SEQ ID NO: 269771 - DNA, 25 bp, Rattus norvegicus
ctgaagtcttggaaggcaaaggagc

SEQ ID NO: 269772 - DNA, 25 bp, Rattus norvegicus
ctgaagtcttggtaggcaaaggagc

SEQ ID NO: 269773 - DNA, 25 bp, Rattus norvegicus
ctgaagtctttgctgttgccttgta

SEQ ID NO: 269774 - DNA, 25 bp, Rattus norvegicus
ctgaagtctttggtgttgccttgta

SEQ ID NO: 269775 - DNA, 25 bp, Rattus norvegicus
ctgaagtggatgagctctcttgcga

SEQ ID NO: 269776 - DNA, 25 bp, Rattus norvegicus
ctgaagtggatgtgctctcttgcga

SEQ ID NO: 269777 - DNA, 25 bp, Rattus norvegicus
ctgaagtgggagagcaccagcagaa

SEQ ID NO: 269778 - DNA, 25 bp, Rattus norvegicus
ctgaagtgggagtgcaccagcagaa

SEQ ID NO: 269779 - DNA, 25 bp, Rattus norvegicus
ctgaagtgggcgaccctaagcgcac

SEQ ID NO: 269780 - DNA, 25 bp, Rattus norvegicus
ctgaagtgggcgtccctaagcgcac

SEQ ID NO: 269781 - DNA, 25 bp, Rattus norvegicus
ctgaagtgtctgagtgctgctgaag

SEQ ID NO: 269782 - DNA, 25 bp, Rattus norvegicus
ctgaagtgtctgtgtgctgctgaag

SEQ ID NO: 269783 - DNA, 25 bp, Rattus norvegicus
ctgaagttcaggagctggctggcct

SEQ ID NO: 269784 - DNA, 25 bp, Rattus norvegicus
ctgaagttcaggtgctggctggcct

SEQ ID NO: 269785 - DNA, 25 bp, Rattus norvegicus
ctgaagttgtcaccccgattaacaa

SEQ ID NO: 269786 - DNA, 25 bp, Rattus norvegicus
ctgaagttgtcagcccgattaacaa

SEQ ID NO: 269787 - DNA, 25 bp, Rattus norvegicus
ctgaagttgtggatgctgagtctgc

SEQ ID NO: 269788 - DNA, 25 bp, Rattus norvegicus
ctgaagttgtggttgctgagtctgc

SEQ ID NO: 269789 - DNA, 25 bp, Rattus norvegicus
ctgaagtttcttcctaaatgggtct

SEQ ID NO: 269790 - DNA, 25 bp, Rattus norvegicus
ctgaagtttcttgctaaatgggtct

SEQ ID NO: 269791 - DNA, 25 bp, Rattus norvegicus
ctgaagtttgaccaccttgagcctt

SEQ ID NO: 269792 - DNA, 25 bp, Rattus norvegicus
ctgaagtttgacgaccttgagcctt

SEQ ID NO: 269793 - DNA, 25 bp, Rattus norvegicus
ctgaataacggtcagtcattgccca

SEQ ID NO: 269794 - DNA, 25 bp, Rattus norvegicus
ctgaataacggtgagtcattgccca

SEQ ID NO: 269795 - DNA, 25 bp, Rattus norvegicus
ctgaatacttgcatctgtgcctgaa

SEQ ID NO: 269796 - DNA, 25 bp, Rattus norvegicus
ctgaatacttgcttctgtgcctgaa

SEQ ID NO: 269797 - DNA, 25 bp, Rattus norvegicus
ctgaataggcgaacacaacgtgcat

SEQ ID NO: 269798 - DNA, 25 bp, Rattus norvegicus
ctgaataggcgatcacaacgtgcat

SEQ ID NO: 269799 - DNA, 25 bp, Rattus norvegicus
ctgaatagtaggcagctctggctgt

SEQ ID NO: 269800 - DNA, 25 bp, Rattus norvegicus
ctgaatagtagggagctctggctgt

SEQ ID NO: 269801 - DNA, 25 bp, Rattus norvegicus
ctgaatatatgaccacgctcacccg

SEQ ID NO: 269802 - DNA, 25 bp, Rattus norvegicus
ctgaatatatgagcacgctcacccg

SEQ ID NO: 269803 - DNA, 25 bp, Rattus norvegicus
ctgaatatctcaactgctgtctgca

SEQ ID NO: 269804 - DNA, 25 bp, Rattus norvegicus
ctgaatatctcatctgctgtctgca

SEQ ID NO: 269805 - DNA, 25 bp, Rattus norvegicus
ctgaatatctgtcctaatggtgtct

SEQ ID NO: 269806 - DNA, 25 bp, Rattus norvegicus
ctgaatatctgtgctaatggtgtct

SEQ ID NO: 269807 - DNA, 25 bp, Rattus norvegicus
ctgaatatcttgctagtcgtcacaa

SEQ ID NO: 269808 - DNA, 25 bp, Rattus norvegicus
ctgaatatcttggtagtcgtcacaa

SEQ ID NO: 269809 - DNA, 25 bp, Rattus norvegicus
ctgaatcccatcaccaaggttactg

SEQ ID NO: 269810 - DNA, 25 bp, Rattus norvegicus
ctgaatcccatctccaaggttactg

SEQ ID NO: 269811 - DNA, 25 bp, Rattus norvegicus
ctgaatcccctccaattgttgagga

SEQ ID NO: 269812 - DNA, 25 bp, Rattus norvegicus
ctgaatcccctcgaattgttgagga

SEQ ID NO: 269813 - DNA, 25 bp, Rattus norvegicus
ctgaatccgtggaggtaggacccgt

SEQ ID NO: 269814 - DNA, 25 bp, Rattus norvegicus
ctgaatccgtggtggtaggacccgt

SEQ ID NO: 269815 - DNA, 25 bp, Rattus norvegicus
ctgaatcctgacaaccttggttcta

SEQ ID NO: 269816 - DNA, 25 bp, Rattus norvegicus
ctgaatcctgactaccttggttcta

SEQ ID NO: 269817 - DNA, 25 bp, Rattus norvegicus
ctgaatcgctggatgtttggtctct

SEQ ID NO: 269818 - DNA, 25 bp, Rattus norvegicus
ctgaatcgctggttgtttggtctct

SEQ ID NO: 269819 - DNA, 25 bp, Rattus norvegicus
ctgaatctctggcacgagtggccaa

SEQ ID NO: 269820 - DNA, 25 bp, Rattus norvegicus
ctgaatctctgggacgagtggccaa

SEQ ID NO: 269821 - DNA, 25 bp, Rattus norvegicus
ctgaatctgattactgcctttcctg

SEQ ID NO: 269822 - DNA, 25 bp, Rattus norvegicus
ctgaatctgatttctgcctttcctg

SEQ ID NO: 269823 - DNA, 25 bp, Rattus norvegicus
ctgaatctgcggctgatgctgaaga

SEQ ID NO: 269824 - DNA, 25 bp, Rattus norvegicus
ctgaatctgcgggtgatgctgaaga

SEQ ID NO: 269825 - DNA, 25 bp, Rattus norvegicus
ctgaatgacaatcttgccatggaga

SEQ ID NO: 269826 - DNA, 25 bp, Rattus norvegicus
ctgaatgacaatgttgccatggaga

SEQ ID NO: 269827 - DNA, 25 bp, Rattus norvegicus
ctgaatgaggacacccgggaaccgg

SEQ ID NO: 269828 - DNA, 25 bp, Rattus norvegicus
ctgaatgaggactcccgggaaccgg

SEQ ID NO: 269829 - DNA, 25 bp, Rattus norvegicus
ctgaatgaggcgactcggtggtcca

SEQ ID NO: 269830 - DNA, 25 bp, Rattus norvegicus
ctgaatgaggcgtctcggtggtcca

SEQ ID NO: 269831 - DNA, 25 bp, Rattus norvegicus
ctgaatgatggacccaacccctgaa

SEQ ID NO: 269832 - DNA, 25 bp, Rattus norvegicus
ctgaatgatggagccaacccctgaa

SEQ ID NO: 269833 - DNA, 25 bp, Rattus norvegicus
ctgaatgcactgagagcctatgagg

SEQ ID NO: 269834 - DNA, 25 bp, Rattus norvegicus
ctgaatgcactgtgagcctatgagg

SEQ ID NO: 269835 - DNA, 25 bp, Rattus norvegicus
ctgaatgccggccagttgcagtata

SEQ ID NO: 269836 - DNA, 25 bp, Rattus norvegicus
ctgaatgccggcgagttgcagtata

SEQ ID NO: 269837 - DNA, 25 bp, Rattus norvegicus
ctgaatgctcttcgttttgtagaat

SEQ ID NO: 269838 - DNA, 25 bp, Rattus norvegicus
ctgaatgctcttggttttgtagaat

SEQ ID NO: 269839 - DNA, 25 bp, Rattus norvegicus
ctgaatgctgacctggtgtggtcat

SEQ ID NO: 269840 - DNA, 25 bp, Rattus norvegicus
ctgaatgctgacgtggtgtggtcat

SEQ ID NO: 269841 - DNA, 25 bp, Rattus norvegicus
ctgaatggcttcattttcatgtttc

SEQ ID NO: 269842 - DNA, 25 bp, Rattus norvegicus
ctgaatggcttctttttcatgtttc

SEQ ID NO: 269843 - DNA, 25 bp, Rattus norvegicus
ctgaatggtgtccagcctggtgccc

SEQ ID NO: 269844 - DNA, 25 bp, Rattus norvegicus
ctgaatggtgtcgagcctggtgccc

SEQ ID NO: 269845 - DNA, 25 bp, Rattus norvegicus
ctgaatgtgtgcagctgcctctggt

SEQ ID NO: 269846 - DNA, 25 bp, Rattus norvegicus
ctgaatgtgtgctgctgcctctggt

SEQ ID NO: 269847 - DNA, 25 bp, Rattus norvegicus
ctgaatgtttaaacttctcacctct

SEQ ID NO: 269848 - DNA, 25 bp, Rattus norvegicus
ctgaatgtttaatcttctcacctct

SEQ ID NO: 269849 - DNA, 25 bp, Rattus norvegicus
ctgaattccatcaacttttacctac

SEQ ID NO: 269850 - DNA, 25 bp, Rattus norvegicus
ctgaattccatctacttttacctac

SEQ ID NO: 269851 - DNA, 25 bp, Rattus norvegicus
ctgaattcctttcaccaagctggtc

SEQ ID NO: 269852 - DNA, 25 bp, Rattus norvegicus
ctgaattcctttgaccaagctggtc

SEQ ID NO: 269853 - DNA, 25 bp, Rattus norvegicus
ctgaattcttatcttgtctctgctg

SEQ ID NO: 269854 - DNA, 25 bp, Rattus norvegicus
ctgaattcttatgttgtctctgctg

SEQ ID NO: 269855 - DNA, 25 bp, Rattus norvegicus
ctgaattggatgacaggtgtcttcc

SEQ ID NO: 269856 - DNA, 25 bp, Rattus norvegicus
ctgaattggatgtcaggtgtcttcc

SEQ ID NO: 269857 - DNA, 25 bp, Rattus norvegicus
ctgaattgtcataggctaactccct

SEQ ID NO: 269858 - DNA, 25 bp, Rattus norvegicus
ctgaattgtcattggctaactccct

SEQ ID NO: 269859 - DNA, 25 bp, Rattus norvegicus
ctgaatttaggcctcatgcatgcta

SEQ ID NO: 269860 - DNA, 25 bp, Rattus norvegicus
ctgaatttaggcgtcatgcatgcta

SEQ ID NO: 269861 - DNA, 25 bp, Rattus norvegicus
ctgaatttctcacccttacttatta

SEQ ID NO: 269862 - DNA, 25 bp, Rattus norvegicus
ctgaatttctcagccttacttatta

SEQ ID NO: 269863 - DNA, 25 bp, Rattus norvegicus
ctgacaaaccatcgcactctgtgtt

SEQ ID NO: 269864 - DNA, 25 bp, Rattus norvegicus
ctgacaaaccatggcactctgtgtt

SEQ ID NO: 269865 - DNA, 25 bp, Rattus norvegicus
ctgacaaagtcgaggacaagtgtgg

SEQ ID NO: 269866 - DNA, 25 bp, Rattus norvegicus
ctgacaaagtcgtggacaagtgtgg

SEQ ID NO: 269867 - DNA, 25 bp, Rattus norvegicus
ctgacaactgacacttccaaatttt

SEQ ID NO: 269868 - DNA, 25 bp, Rattus norvegicus
ctgacaactgactcttccaaatttt

SEQ ID NO: 269869 - DNA, 25 bp, Rattus norvegicus
ctgacaacttcacgagctgttcttt

SEQ ID NO: 269870 - DNA, 25 bp, Rattus norvegicus
ctgacaacttcaggagctgttcttt

SEQ ID NO: 269871 - DNA, 25 bp, Rattus norvegicus
ctgacaatctaacccgcaagtacta

SEQ ID NO: 269872 - DNA, 25 bp, Rattus norvegicus
ctgacaatctaagccgcaagtacta

SEQ ID NO: 269873 - DNA, 25 bp, Rattus norvegicus
ctgacaatgtagctgctgactggaa

SEQ ID NO: 269874 - DNA, 25 bp, Rattus norvegicus
ctgacaatgtaggtgctgactggaa

SEQ ID NO: 269875 - DNA, 25 bp, Rattus norvegicus
ctgacaattatgatgatgttttaac

SEQ ID NO: 269876 - DNA, 25 bp, Rattus norvegicus
ctgacaattatgttgatgttttaac

SEQ ID NO: 269877 - DNA, 25 bp, Rattus norvegicus
ctgacacagcttccctgccttgaga

SEQ ID NO: 269878 - DNA, 25 bp, Rattus norvegicus
ctgacacagcttgcctgccttgaga

SEQ ID NO: 269879 - DNA, 25 bp, Rattus norvegicus
ctgacacaggataatgaggaatgga

SEQ ID NO: 269880 - DNA, 25 bp, Rattus norvegicus
ctgacacaggattatgaggaatgga

SEQ ID NO: 269881 - DNA, 25 bp, Rattus norvegicus
ctgacacatcacaccttttctgaat

SEQ ID NO: 269882 - DNA, 25 bp, Rattus norvegicus
ctgacacatcactccttttctgaat

SEQ ID NO: 269883 - DNA, 25 bp, Rattus norvegicus
ctgacacatcagattccggaactta

SEQ ID NO: 269884 - DNA, 25 bp, Rattus norvegicus
ctgacacatcagtttccggaactta

SEQ ID NO: 269885 - DNA, 25 bp, Rattus norvegicus
ctgacacatctgaccttcgggaagg

SEQ ID NO: 269886 - DNA, 25 bp, Rattus norvegicus
ctgacacatctgtccttcgggaagg

SEQ ID NO: 269887 - DNA, 25 bp, Rattus norvegicus
ctgacacccaatccctgaggaggaa

SEQ ID NO: 269888 - DNA, 25 bp, Rattus norvegicus
ctgacacccaatgcctgaggaggaa

SEQ ID NO: 269889 - DNA, 25 bp, Rattus norvegicus
ctgacacccgagcaccagtgagtgc

SEQ ID NO: 269890 - DNA, 25 bp, Rattus norvegicus
ctgacacccgaggaccagtgagtgc

SEQ ID NO: 269891 - DNA, 25 bp, Rattus norvegicus
ctgacaccggagcaatacttttctc

SEQ ID NO: 269892 - DNA, 25 bp, Rattus norvegicus
ctgacaccggaggaatacttttctc

SEQ ID NO: 269893 - DNA, 25 bp, Rattus norvegicus
ctgacaccgggtatgcttagttaag

SEQ ID NO: 269894 - DNA, 25 bp, Rattus norvegicus
ctgacaccgggtttgcttagttaag

SEQ ID NO: 269895 - DNA, 25 bp, Rattus norvegicus
ctgacacctcttacctgtggttcac

SEQ ID NO: 269896 - DNA, 25 bp, Rattus norvegicus
ctgacacctctttcctgtggttcac

SEQ ID NO: 269897 - DNA, 25 bp, Rattus norvegicus
ctgacacctgtgaaccacggagctg

SEQ ID NO: 269898 - DNA, 25 bp, Rattus norvegicus
ctgacacctgtgtaccacggagctg

SEQ ID NO: 269899 - DNA, 25 bp, Rattus norvegicus
ctgacaccttctctgtttcactaat

SEQ ID NO: 269900 - DNA, 25 bp, Rattus norvegicus
ctgacaccttctgtgtttcactaat

SEQ ID NO: 269901 - DNA, 25 bp, Rattus norvegicus
ctgacacgaccaacacaatttctga

SEQ ID NO: 269902 - DNA, 25 bp, Rattus norvegicus
ctgacacgaccatcacaatttctga

SEQ ID NO: 269903 - DNA, 25 bp, Rattus norvegicus
ctgacacgagccacaggatttctga

SEQ ID NO: 269904 - DNA, 25 bp, Rattus norvegicus
ctgacacgagcctcaggatttctga

SEQ ID NO: 269905 - DNA, 25 bp, Rattus norvegicus
ctgacacgagggacttggttggtat

SEQ ID NO: 269906 - DNA, 25 bp, Rattus norvegicus
ctgacacgagggtcttggttggtat

SEQ ID NO: 269907 - DNA, 25 bp, Rattus norvegicus
ctgacacggcttccagtgagcagtt

SEQ ID NO: 269908 - DNA, 25 bp, Rattus norvegicus
ctgacacggcttgcagtgagcagtt

SEQ ID NO: 269909 - DNA, 25 bp, Rattus norvegicus
ctgacactgcctcctagggaggaga

SEQ ID NO: 269910 - DNA, 25 bp, Rattus norvegicus
ctgacactgcctgctagggaggaga

SEQ ID NO: 269911 - DNA, 25 bp, Rattus norvegicus
ctgacacttaccaccatagaaacac

SEQ ID NO: 269912 - DNA, 25 bp, Rattus norvegicus
ctgacacttacctccatagaaacac

SEQ ID NO: 269913 - DNA, 25 bp, Rattus norvegicus
ctgacacttcctattctaatttctt

SEQ ID NO: 269914 - DNA, 25 bp, Rattus norvegicus
ctgacacttccttttctaatttctt

SEQ ID NO: 269915 - DNA, 25 bp, Rattus norvegicus
ctgacacttgcacttaactaacctt

SEQ ID NO: 269916 - DNA, 25 bp, Rattus norvegicus
ctgacacttgcagttaactaacctt

SEQ ID NO: 269917 - DNA, 25 bp, Rattus norvegicus
ctgacagaagaaatgggttgagccc

SEQ ID NO: 269918 - DNA, 25 bp, Rattus norvegicus
ctgacagaagaattgggttgagccc

SEQ ID NO: 269919 - DNA, 25 bp, Rattus norvegicus
ctgacagacttgaagccatgtaggg

SEQ ID NO: 269920 - DNA, 25 bp, Rattus norvegicus
ctgacagacttgtagccatgtaggg

SEQ ID NO: 269921 - DNA, 25 bp, Rattus norvegicus
ctgacagaggacactcggcagctgg

SEQ ID NO: 269922 - DNA, 25 bp, Rattus norvegicus
ctgacagaggactctcggcagctgg

SEQ ID NO: 269923 - DNA, 25 bp, Rattus norvegicus
ctgacagaggctcggcattttttcc

SEQ ID NO: 269924 - DNA, 25 bp, Rattus norvegicus
ctgacagaggctgggcattttttcc

SEQ ID NO: 269925 - DNA, 25 bp, Rattus norvegicus
ctgacagcaataatccgtgtatttt

SEQ ID NO: 269926 - DNA, 25 bp, Rattus norvegicus
ctgacagcaatattccgtgtatttt

SEQ ID NO: 269927 - DNA, 25 bp, Rattus norvegicus
ctgacagcacagatggattttctcc

SEQ ID NO: 269928 - DNA, 25 bp, Rattus norvegicus
ctgacagcacagttggattttctcc

SEQ ID NO: 269929 - DNA, 25 bp, Rattus norvegicus
ctgacagcaccacttccaaatgttg

SEQ ID NO: 269930 - DNA, 25 bp, Rattus norvegicus
ctgacagcaccagttccaaatgttg

SEQ ID NO: 269931 - DNA, 25 bp, Rattus norvegicus
ctgacagcacttccgtcacagaaat

SEQ ID NO: 269932 - DNA, 25 bp, Rattus norvegicus
ctgacagcacttgcgtcacagaaat

SEQ ID NO: 269933 - DNA, 25 bp, Rattus norvegicus
ctgacagcagcactgatgtggagca

SEQ ID NO: 269934 - DNA, 25 bp, Rattus norvegicus
ctgacagcagcagtgatgtggagca

SEQ ID NO: 269935 - DNA, 25 bp, Rattus norvegicus
ctgacagcaggtactgggccacaga

SEQ ID NO: 269936 - DNA, 25 bp, Rattus norvegicus
ctgacagcaggttctgggccacaga

SEQ ID NO: 269937 - DNA, 25 bp, Rattus norvegicus
ctgacagctgtcaactatcaattga

SEQ ID NO: 269938 - DNA, 25 bp, Rattus norvegicus
ctgacagctgtctactatcaattga

SEQ ID NO: 269939 - DNA, 25 bp, Rattus norvegicus
ctgacaggcagcctgagggcaatct

SEQ ID NO: 269940 - DNA, 25 bp, Rattus norvegicus
ctgacaggcagcgtgagggcaatct

SEQ ID NO: 269941 - DNA, 25 bp, Rattus norvegicus
ctgacaggcgtacaggacaacacta

SEQ ID NO: 269942 - DNA, 25 bp, Rattus norvegicus
ctgacaggcgtagaggacaacacta

SEQ ID NO: 269943 - DNA, 25 bp, Rattus norvegicus
ctgacagggttgaggctgacttcat

SEQ ID NO: 269944 - DNA, 25 bp, Rattus norvegicus
ctgacagggttgtggctgacttcat

SEQ ID NO: 269945 - DNA, 25 bp, Rattus norvegicus
ctgacagtcctgagcttagtgttag

SEQ ID NO: 269946 - DNA, 25 bp, Rattus norvegicus
ctgacagtcctgtgcttagtgttag

SEQ ID NO: 269947 - DNA, 25 bp, Rattus norvegicus
ctgacagtgactaggctatgagctt

SEQ ID NO: 269948 - DNA, 25 bp, Rattus norvegicus
ctgacagtgacttggctatgagctt

SEQ ID NO: 269949 - DNA, 25 bp, Rattus norvegicus
ctgacagtgcagctcggattctgat

SEQ ID NO: 269950 - DNA, 25 bp, Rattus norvegicus
ctgacagtgcaggtcggattctgat

SEQ ID NO: 269951 - DNA, 25 bp, Rattus norvegicus
ctgacagtggagagtctgacaccct

SEQ ID NO: 269952 - DNA, 25 bp, Rattus norvegicus
ctgacagtggagtgtctgacaccct

SEQ ID NO: 269953 - DNA, 25 bp, Rattus norvegicus
ctgacataggtgagtgctggccccg

SEQ ID NO: 269954 - DNA, 25 bp, Rattus norvegicus
ctgacataggtgtgtgctggccccg

SEQ ID NO: 269955 - DNA, 25 bp, Rattus norvegicus
ctgacatcttccagattgattcctg

SEQ ID NO: 269956 - DNA, 25 bp, Rattus norvegicus
ctgacatcttcctgattgattcctg

SEQ ID NO: 269957 - DNA, 25 bp, Rattus norvegicus
ctgacatgccgcctggagaaacctg

SEQ ID NO: 269958 - DNA, 25 bp, Rattus norvegicus
ctgacatgccgcgtggagaaacctg

SEQ ID NO: 269959 - DNA, 25 bp, Rattus norvegicus
ctgacatgggaaaggctcttacctg

SEQ ID NO: 269960 - DNA, 25 bp, Rattus norvegicus
ctgacatgggaatggctcttacctg

SEQ ID NO: 269961 - DNA, 25 bp, Rattus norvegicus
ctgacattagtcatgcctgcttggg

SEQ ID NO: 269962 - DNA, 25 bp, Rattus norvegicus
ctgacattagtcttgcctgcttggg

SEQ ID NO: 269963 - DNA, 25 bp, Rattus norvegicus
ctgacattccacattcctagagtat

SEQ ID NO: 269964 - DNA, 25 bp, Rattus norvegicus
ctgacattccactttcctagagtat

SEQ ID NO: 269965 - DNA, 25 bp, Rattus norvegicus
ctgacattcccgaggttcaaggaca

SEQ ID NO: 269966 - DNA, 25 bp, Rattus norvegicus
ctgacattcccgtggttcaaggaca

SEQ ID NO: 269967 - DNA, 25 bp, Rattus norvegicus
ctgacattgggacatcacctggaat

SEQ ID NO: 269968 - DNA, 25 bp, Rattus norvegicus
ctgacattgggagatcacctggaat

SEQ ID NO: 269969 - DNA, 25 bp, Rattus norvegicus
ctgacatttacaatgggtttcctaa

SEQ ID NO: 269970 - DNA, 25 bp, Rattus norvegicus
ctgacatttacattgggtttcctaa

SEQ ID NO: 269971 - DNA, 25 bp, Rattus norvegicus
ctgaccaacatcaccagttgcaatg

SEQ ID NO: 269972 - DNA, 25 bp, Rattus norvegicus
ctgaccaacatctccagttgcaatg

SEQ ID NO: 269973 - DNA, 25 bp, Rattus norvegicus
ctgaccacacttctgcttcagagag

SEQ ID NO: 269974 - DNA, 25 bp, Rattus norvegicus
ctgaccacacttgtgcttcagagag

SEQ ID NO: 269975 - DNA, 25 bp, Rattus norvegicus
ctgaccacagtgcattctgcaagaa

SEQ ID NO: 269976 - DNA, 25 bp, Rattus norvegicus
ctgaccacagtggattctgcaagaa

SEQ ID NO: 269977 - DNA, 25 bp, Rattus norvegicus
ctgaccaccttaaccttcagaatat

SEQ ID NO: 269978 - DNA, 25 bp, Rattus norvegicus
ctgaccaccttatccttcagaatat

SEQ ID NO: 269979 - DNA, 25 bp, Rattus norvegicus
ctgaccacttggctgcgccgaagag

SEQ ID NO: 269980 - DNA, 25 bp, Rattus norvegicus
ctgaccacttgggtgcgccgaagag

SEQ ID NO: 269981 - DNA, 25 bp, Rattus norvegicus
ctgaccactttgacttcatcgcaaa

SEQ ID NO: 269982 - DNA, 25 bp, Rattus norvegicus
ctgaccactttgtcttcatcgcaaa

SEQ ID NO: 269983 - DNA, 25 bp, Rattus norvegicus
ctgaccaggcctcattcttaggatg

SEQ ID NO: 269984 - DNA, 25 bp, Rattus norvegicus
ctgaccaggcctgattcttaggatg

SEQ ID NO: 269985 - DNA, 25 bp, Rattus norvegicus
ctgaccagtatcatcctgtctccat

SEQ ID NO: 269986 - DNA, 25 bp, Rattus norvegicus
ctgaccagtatcttcctgtctccat

SEQ ID NO: 269987 - DNA, 25 bp, Rattus norvegicus
ctgaccagtgagagaagccagcccc

SEQ ID NO: 269988 - DNA, 25 bp, Rattus norvegicus
ctgaccagtgagtgaagccagcccc

SEQ ID NO: 269989 - DNA, 25 bp, Rattus norvegicus
ctgaccatgtagacgccaggcgtgt

SEQ ID NO: 269990 - DNA, 25 bp, Rattus norvegicus
ctgaccatgtagtcgccaggcgtgt

SEQ ID NO: 269991 - DNA, 25 bp, Rattus norvegicus
ctgaccatgtctcgacaactcacta

SEQ ID NO: 269992 - DNA, 25 bp, Rattus norvegicus
ctgaccatgtctggacaactcacta

SEQ ID NO: 269993 - DNA, 25 bp, Rattus norvegicus
ctgaccattcagatgccgggagcaa

SEQ ID NO: 269994 - DNA, 25 bp, Rattus norvegicus
ctgaccattcagttgccgggagcaa

SEQ ID NO: 269995 - DNA, 25 bp, Rattus norvegicus
ctgaccattcttagtaccctttaag

SEQ ID NO: 269996 - DNA, 25 bp, Rattus norvegicus
ctgaccattctttgtaccctttaag

SEQ ID NO: 269997 - DNA, 25 bp, Rattus norvegicus
ctgacccactccaaagaatgactgt

SEQ ID NO: 269998 - DNA, 25 bp, Rattus norvegicus
ctgacccactcctaagaatgactgt

SEQ ID NO: 269999 - DNA, 25 bp, Rattus norvegicus
ctgacccagaaaccacaggaggtga

SEQ ID NO: 270000 - DNA, 25 bp, Rattus norvegicus
ctgacccagaaagcacaggaggtga

SEQ ID NO: 270001 - DNA, 25 bp, Rattus norvegicus
ctgacccagaggaaggcctctattt

SEQ ID NO: 270002 - DNA, 25 bp, Rattus norvegicus
ctgacccagaggtaggcctctattt

SEQ ID NO: 270003 - DNA, 25 bp, Rattus norvegicus
ctgacccatctcaagttcgggaagt

SEQ ID NO: 270004 - DNA, 25 bp, Rattus norvegicus
ctgacccatctctagttcgggaagt

SEQ ID NO: 270005 - DNA, 25 bp, Rattus norvegicus
ctgacccatgtcagtatatctgtgc

SEQ ID NO: 270006 - DNA, 25 bp, Rattus norvegicus
ctgacccatgtctgtatatctgtgc

SEQ ID NO: 270007 - DNA, 25 bp, Rattus norvegicus
ctgaccccactacaagaggagccaa

SEQ ID NO: 270008 - DNA, 25 bp, Rattus norvegicus
ctgaccccactagaagaggagccaa

SEQ ID NO: 270009 - DNA, 25 bp, Rattus norvegicus
ctgaccccactgcagcttttggaaa

SEQ ID NO: 270010 - DNA, 25 bp, Rattus norvegicus
ctgaccccactggagcttttggaaa

SEQ ID NO: 270011 - DNA, 25 bp, Rattus norvegicus
ctgaccccaggaagctctgggtgaa

SEQ ID NO: 270012 - DNA, 25 bp, Rattus norvegicus
ctgaccccaggatgctctgggtgaa

SEQ ID NO: 270013 - DNA, 25 bp, Rattus norvegicus
ctgacccctggtaaatgatagcatt

SEQ ID NO: 270014 - DNA, 25 bp, Rattus norvegicus
ctgacccctggtcggaataccgatt

SEQ ID NO: 270015 - DNA, 25 bp, Rattus norvegicus
ctgacccctggtgggaataccgatt

SEQ ID NO: 270016 - DNA, 25 bp, Rattus norvegicus
ctgacccctggttaatgatagcatt

SEQ ID NO: 270017 - DNA, 25 bp, Rattus norvegicus
ctgaccctaacacaagcactggtgg

SEQ ID NO: 270018 - DNA, 25 bp, Rattus norvegicus
ctgaccctaacagaagcactggtgg

SEQ ID NO: 270019 - DNA, 25 bp, Rattus norvegicus
ctgaccctgacaacattggaaccat

SEQ ID NO: 270020 - DNA, 25 bp, Rattus norvegicus
ctgaccctgacacgcgtgatagttt

SEQ ID NO: 270021 - DNA, 25 bp, Rattus norvegicus
ctgaccctgacaggcgtgatagttt

SEQ ID NO: 270022 - DNA, 25 bp, Rattus norvegicus
ctgaccctgacatcattggaaccat

SEQ ID NO: 270023 - DNA, 25 bp, Rattus norvegicus
ctgaccctgagcctagtctgtggag

SEQ ID NO: 270024 - DNA, 25 bp, Rattus norvegicus
ctgaccctgagcgtagtctgtggag

SEQ ID NO: 270025 - DNA, 25 bp, Rattus norvegicus
ctgaccctgcctatgggagcaggtt

SEQ ID NO: 270026 - DNA, 25 bp, Rattus norvegicus
ctgaccctgcctttgggagcaggtt

SEQ ID NO: 270027 - DNA, 25 bp, Rattus norvegicus
ctgaccctggagatgtactacaccg

SEQ ID NO: 270028 - DNA, 25 bp, Rattus norvegicus
ctgaccctggagttgtactacaccg

SEQ ID NO: 270029 - DNA, 25 bp, Rattus norvegicus
ctgaccctttcaccgaatggcagtg

SEQ ID NO: 270030 - DNA, 25 bp, Rattus norvegicus
ctgaccctttcagcgaatggcagtg

SEQ ID NO: 270031 - DNA, 25 bp, Rattus norvegicus
ctgaccgaaactccggactgtctgt

SEQ ID NO: 270032 - DNA, 25 bp, Rattus norvegicus
ctgaccgaaactgcggactgtctgt

SEQ ID NO: 270033 - DNA, 25 bp, Rattus norvegicus
ctgaccgccttcagctgtaactagg

SEQ ID NO: 270034 - DNA, 25 bp, Rattus norvegicus
ctgaccgccttctgctgtaactagg

SEQ ID NO: 270035 - DNA, 25 bp, Rattus norvegicus
ctgaccgtcagccagtttttgaaac

SEQ ID NO: 270036 - DNA, 25 bp, Rattus norvegicus
ctgaccgtcagcgagtttttgaaac

SEQ ID NO: 270037 - DNA, 25 bp, Rattus norvegicus
ctgaccgtgcagatcgtgaccggca

SEQ ID NO: 270038 - DNA, 25 bp, Rattus norvegicus
ctgaccgtgcagttcgtgaccggca

SEQ ID NO: 270039 - DNA, 25 bp, Rattus norvegicus
ctgaccgtgtttcgcagctgtggaa

SEQ ID NO: 270040 - DNA, 25 bp, Rattus norvegicus
ctgaccgtgtttggcagctgtggaa

SEQ ID NO: 270041 - DNA, 25 bp, Rattus norvegicus
ctgacctacatgaccagtctttttt

SEQ ID NO: 270042 - DNA, 25 bp, Rattus norvegicus
ctgacctacatgtccagtctttttt

SEQ ID NO: 270043 - DNA, 25 bp, Rattus norvegicus
ctgacctactaacagcgagcgatgt

SEQ ID NO: 270044 - DNA, 25 bp, Rattus norvegicus
ctgacctactaagagcgagcgatgt

SEQ ID NO: 270045 - DNA, 25 bp, Rattus norvegicus
ctgacctctctccaagaatctgtat

SEQ ID NO: 270046 - DNA, 25 bp, Rattus norvegicus
ctgacctctctcgaagaatctgtat

SEQ ID NO: 270047 - DNA, 25 bp, Rattus norvegicus
ctgacctgcgttctttgccaagaga

SEQ ID NO: 270048 - DNA, 25 bp, Rattus norvegicus
ctgacctgcgttgtttgccaagaga

SEQ ID NO: 270049 - DNA, 25 bp, Rattus norvegicus
ctgacctgctctagactgtccgcat

SEQ ID NO: 270050 - DNA, 25 bp, Rattus norvegicus
ctgacctgctcttgactgtccgcat

SEQ ID NO: 270051 - DNA, 25 bp, Rattus norvegicus
ctgacctgcttcacaaaggacactg

SEQ ID NO: 270052 - DNA, 25 bp, Rattus norvegicus
ctgacctgcttctcaaaggacactg

SEQ ID NO: 270053 - DNA, 25 bp, Rattus norvegicus
ctgaccttaaacacactgtgtaact

SEQ ID NO: 270054 - DNA, 25 bp, Rattus norvegicus
ctgaccttaaactcactgtgtaact

SEQ ID NO: 270055 - DNA, 25 bp, Rattus norvegicus
ctgaccttcaccacaaggatgaagt

SEQ ID NO: 270056 - DNA, 25 bp, Rattus norvegicus
ctgaccttcacctcaaggatgaagt

SEQ ID NO: 270057 - DNA, 25 bp, Rattus norvegicus
ctgaccttggtccagaagtgctatt

SEQ ID NO: 270058 - DNA, 25 bp, Rattus norvegicus
ctgaccttggtcgagaagtgctatt

SEQ ID NO: 270059 - DNA, 25 bp, Rattus norvegicus
ctgaccttgtccagcttggctgaga

SEQ ID NO: 270060 - DNA, 25 bp, Rattus norvegicus
ctgaccttgtcctgcttggctgaga

SEQ ID NO: 270061 - DNA, 25 bp, Rattus norvegicus
ctgacctttcataggaagttggaat

SEQ ID NO: 270062 - DNA, 25 bp, Rattus norvegicus
ctgacctttcattggaagttggaat

SEQ ID NO: 270063 - DNA, 25 bp, Rattus norvegicus
ctgacctttctaaagcgtgatgcat

SEQ ID NO: 270064 - DNA, 25 bp, Rattus norvegicus
ctgacctttctatagcgtgatgcat

SEQ ID NO: 270065 - DNA, 25 bp, Rattus norvegicus
ctgacctttttaatcaacttgtatg

SEQ ID NO: 270066 - DNA, 25 bp, Rattus norvegicus
ctgacctttttattcaacttgtatg

SEQ ID NO: 270067 - DNA, 25 bp, Rattus norvegicus
ctgacgagcagtacttccagcgtaa

SEQ ID NO: 270068 - DNA, 25 bp, Rattus norvegicus
ctgacgagcagttcttccagcgtaa

SEQ ID NO: 270069 - DNA, 25 bp, Rattus norvegicus
ctgacgcctcaacagcactgagaag

SEQ ID NO: 270070 - DNA, 25 bp, Rattus norvegicus
ctgacgcctcaagagcactgagaag

SEQ ID NO: 270071 - DNA, 25 bp, Rattus norvegicus
ctgacgctgcgccaaattgttttga

SEQ ID NO: 270072 - DNA, 25 bp, Rattus norvegicus
ctgacgctgcgcgaaattgttttga

SEQ ID NO: 270073 - DNA, 25 bp, Rattus norvegicus
ctgacgctgtgcactgggaaagtgc

SEQ ID NO: 270074 - DNA, 25 bp, Rattus norvegicus
ctgacgctgtgctctgggaaagtgc

SEQ ID NO: 270075 - DNA, 25 bp, Rattus norvegicus
ctgacgctttgcagggtcgatggat

SEQ ID NO: 270076 - DNA, 25 bp, Rattus norvegicus
ctgacgctttgctgggtcgatggat

SEQ ID NO: 270077 - DNA, 25 bp, Rattus norvegicus
ctgacggaacccagaaccaagttga

SEQ ID NO: 270078 - DNA, 25 bp, Rattus norvegicus
ctgacggaaccctgaaccaagttga

SEQ ID NO: 270079 - DNA, 25 bp, Rattus norvegicus
ctgacggagggccacatcattgata

SEQ ID NO: 270080 - DNA, 25 bp, Rattus norvegicus
ctgacggagggcgacatcattgata

SEQ ID NO: 270081 - DNA, 25 bp, Rattus norvegicus
ctgacggccagtctccatacaaaaa

SEQ ID NO: 270082 - DNA, 25 bp, Rattus norvegicus
ctgacggccagtgtccatacaaaaa

SEQ ID NO: 270083 - DNA, 25 bp, Rattus norvegicus
ctgacgggtgtgagtgccatcattg

SEQ ID NO: 270084 - DNA, 25 bp, Rattus norvegicus
ctgacgggtgtgtgtgccatcattg

SEQ ID NO: 270085 - DNA, 25 bp, Rattus norvegicus
ctgacggtttggctttacactggac

SEQ ID NO: 270086 - DNA, 25 bp, Rattus norvegicus
ctgacggtttgggtttacactggac

SEQ ID NO: 270087 - DNA, 25 bp, Rattus norvegicus
ctgacgtatgacaaaaccagactga

SEQ ID NO: 270088 - DNA, 25 bp, Rattus norvegicus
ctgacgtatgactaaaccagactga

SEQ ID NO: 270089 - DNA, 25 bp, Rattus norvegicus
ctgacgtcaggaaagtaccactggt

SEQ ID NO: 270090 - DNA, 25 bp, Rattus norvegicus
ctgacgtcaggatagtaccactggt

SEQ ID NO: 270091 - DNA, 25 bp, Rattus norvegicus
ctgacgtctgttcttctagatggtt

SEQ ID NO: 270092 - DNA, 25 bp, Rattus norvegicus
ctgacgtctgttgttctagatggtt

SEQ ID NO: 270093 - DNA, 25 bp, Rattus norvegicus
ctgacgtgctgtaaaataaacctct

SEQ ID NO: 270094 - DNA, 25 bp, Rattus norvegicus
ctgacgtgctgttaaataaacctct

SEQ ID NO: 270095 - DNA, 25 bp, Rattus norvegicus
ctgacgtttcctctggctgtagaac

SEQ ID NO: 270096 - DNA, 25 bp, Rattus norvegicus
ctgacgtttcctgtggctgtagaac

SEQ ID NO: 270097 - DNA, 25 bp, Rattus norvegicus
ctgactacccagcatgcagttcatc

SEQ ID NO: 270098 - DNA, 25 bp, Rattus norvegicus
ctgactacccaggatgcagttcatc

SEQ ID NO: 270099 - DNA, 25 bp, Rattus norvegicus
ctgactacctagacccttgaggatg

SEQ ID NO: 270100 - DNA, 25 bp, Rattus norvegicus
ctgactacctagtcccttgaggatg

SEQ ID NO: 270101 - DNA, 25 bp, Rattus norvegicus
ctgactagatagcacataccattta

SEQ ID NO: 270102 - DNA, 25 bp, Rattus norvegicus
ctgactagataggacataccattta

SEQ ID NO: 270103 - DNA, 25 bp, Rattus norvegicus
ctgactattttgagaccagcagcct

SEQ ID NO: 270104 - DNA, 25 bp, Rattus norvegicus
ctgactattttgtgaccagcagcct

SEQ ID NO: 270105 - DNA, 25 bp, Rattus norvegicus
ctgactcacgtaaccaagactctgg

SEQ ID NO: 270106 - DNA, 25 bp, Rattus norvegicus
ctgactcacgtatccaagactctgg

SEQ ID NO: 270107 - DNA, 25 bp, Rattus norvegicus
ctgactcagctacctcaggtggaga

SEQ ID NO: 270108 - DNA, 25 bp, Rattus norvegicus
ctgactcagctagctcaggtggaga

SEQ ID NO: 270109 - DNA, 25 bp, Rattus norvegicus
ctgactcattccatacgggtaggat

SEQ ID NO: 270110 - DNA, 25 bp, Rattus norvegicus
ctgactcattccttacgggtaggat

SEQ ID NO: 270111 - DNA, 25 bp, Rattus norvegicus
ctgactccacagctctttcatgaag

SEQ ID NO: 270112 - DNA, 25 bp, Rattus norvegicus
ctgactccacaggtctttcatgaag

SEQ ID NO: 270113 - DNA, 25 bp, Rattus norvegicus
ctgactcccattaacaatagctact

SEQ ID NO: 270114 - DNA, 25 bp, Rattus norvegicus
ctgactcccatttacaatagctact

SEQ ID NO: 270115 - DNA, 25 bp, Rattus norvegicus
ctgactcctgagcagacatagcttg

SEQ ID NO: 270116 - DNA, 25 bp, Rattus norvegicus
ctgactcctgaggagacatagcttg

SEQ ID NO: 270117 - DNA, 25 bp, Rattus norvegicus
ctgactcctgggaaaccaggccagt

SEQ ID NO: 270118 - DNA, 25 bp, Rattus norvegicus
ctgactcctgggtaaccaggccagt

SEQ ID NO: 270119 - DNA, 25 bp, Rattus norvegicus
ctgactcgaaggcttgttttgcaat

SEQ ID NO: 270120 - DNA, 25 bp, Rattus norvegicus
ctgactcgaagggttgttttgcaat

SEQ ID NO: 270121 - DNA, 25 bp, Rattus norvegicus
ctgactctcctcctgtagaatctgt

SEQ ID NO: 270122 - DNA, 25 bp, Rattus norvegicus
ctgactctcctcgtgtagaatctgt

SEQ ID NO: 270123 - DNA, 25 bp, Rattus norvegicus
ctgactctggctcggtatcatgtac

SEQ ID NO: 270124 - DNA, 25 bp, Rattus norvegicus
ctgactctggctgggtatcatgtac

SEQ ID NO: 270125 - DNA, 25 bp, Rattus norvegicus
ctgactctgttgactgccattggat

SEQ ID NO: 270126 - DNA, 25 bp, Rattus norvegicus
ctgactctgttgtctgccattggat

SEQ ID NO: 270127 - DNA, 25 bp, Rattus norvegicus
ctgactcttgtaaggtttatggtaa

SEQ ID NO: 270128 - DNA, 25 bp, Rattus norvegicus
ctgactcttgtatggtttatggtaa

SEQ ID NO: 270129 - DNA, 25 bp, Rattus norvegicus
ctgactgaaccacctgccaggagag

SEQ ID NO: 270130 - DNA, 25 bp, Rattus norvegicus
ctgactgaaccagctgccaggagag

SEQ ID NO: 270131 - DNA, 25 bp, Rattus norvegicus
ctgactgaagcgcacctgggtgtct

SEQ ID NO: 270132 - DNA, 25 bp, Rattus norvegicus
ctgactgaagcggacctgggtgtct

SEQ ID NO: 270133 - DNA, 25 bp, Rattus norvegicus
ctgactgaggtaccgcacttcccaa

SEQ ID NO: 270134 - DNA, 25 bp, Rattus norvegicus
ctgactgaggtagcgcacttcccaa

SEQ ID NO: 270135 - DNA, 25 bp, Rattus norvegicus
ctgactgagtttattatatattgac

SEQ ID NO: 270136 - DNA, 25 bp, Rattus norvegicus
ctgactgagttttttatatattgac

SEQ ID NO: 270137 - DNA, 25 bp, Rattus norvegicus
ctgactgatattcgctaagggttat

SEQ ID NO: 270138 - DNA, 25 bp, Rattus norvegicus
ctgactgatattggctaagggttat

SEQ ID NO: 270139 - DNA, 25 bp, Rattus norvegicus
ctgactgatctgaaggcaaagctct

SEQ ID NO: 270140 - DNA, 25 bp, Rattus norvegicus
ctgactgatctgtaggcaaagctct

SEQ ID NO: 270141 - DNA, 25 bp, Rattus norvegicus
ctgactgcagacatttcgtcacaaa

SEQ ID NO: 270142 - DNA, 25 bp, Rattus norvegicus
ctgactgcagacttttcgtcacaaa

SEQ ID NO: 270143 - DNA, 25 bp, Rattus norvegicus
ctgactgccatcactttgtttgaag

SEQ ID NO: 270144 - DNA, 25 bp, Rattus norvegicus
ctgactgccatctctttgtttgaag

SEQ ID NO: 270145 - DNA, 25 bp, Rattus norvegicus
ctgactgctgtcatgatgttgggaa

SEQ ID NO: 270146 - DNA, 25 bp, Rattus norvegicus
ctgactgctgtcttgatgttgggaa

SEQ ID NO: 270147 - DNA, 25 bp, Rattus norvegicus
ctgactgcttacactctgtgggaaa

SEQ ID NO: 270148 - DNA, 25 bp, Rattus norvegicus
ctgactgcttactctctgtgggaaa

SEQ ID NO: 270149 - DNA, 25 bp, Rattus norvegicus
ctgactggccagatccacaatggag

SEQ ID NO: 270150 - DNA, 25 bp, Rattus norvegicus
ctgactggccagttccacaatggag

SEQ ID NO: 270151 - DNA, 25 bp, Rattus norvegicus
ctgactggcccaaatgtacataact

SEQ ID NO: 270152 - DNA, 25 bp, Rattus norvegicus
ctgactggcccatatgtacataact

SEQ ID NO: 270153 - DNA, 25 bp, Rattus norvegicus
ctgactgggaaaaggagctacaaca

SEQ ID NO: 270154 - DNA, 25 bp, Rattus norvegicus
ctgactgggaaatggagctacaaca

SEQ ID NO: 270155 - DNA, 25 bp, Rattus norvegicus
ctgactgggtcacccattaaaattt

SEQ ID NO: 270156 - DNA, 25 bp, Rattus norvegicus
ctgactgggtcagccattaaaattt

SEQ ID NO: 270157 - DNA, 25 bp, Rattus norvegicus
ctgactggtcacaggaaggcttgct

SEQ ID NO: 270158 - DNA, 25 bp, Rattus norvegicus
ctgactggtcactggaaggcttgct

SEQ ID NO: 270159 - DNA, 25 bp, Rattus norvegicus
ctgactggtcttacgcggatggccg

SEQ ID NO: 270160 - DNA, 25 bp, Rattus norvegicus
ctgactggtctttcgcggatggccg

SEQ ID NO: 270161 - DNA, 25 bp, Rattus norvegicus
ctgactggtgctcctacgcaggtag

SEQ ID NO: 270162 - DNA, 25 bp, Rattus norvegicus
ctgactggtgctgctacgcaggtag

SEQ ID NO: 270163 - DNA, 25 bp, Rattus norvegicus
ctgactgtccccaggcgaggaggac

SEQ ID NO: 270164 - DNA, 25 bp, Rattus norvegicus
ctgactgtcccctggcgaggaggac

SEQ ID NO: 270165 - DNA, 25 bp, Rattus norvegicus
ctgactgtcccgaggtgtgtgttca

SEQ ID NO: 270166 - DNA, 25 bp, Rattus norvegicus
ctgactgtcccgtggtgtgtgttca

SEQ ID NO: 270167 - DNA, 25 bp, Rattus norvegicus
ctgactgtcctgcttgataacctgc

SEQ ID NO: 270168 - DNA, 25 bp, Rattus norvegicus
ctgactgtcctggttgataacctgc

SEQ ID NO: 270169 - DNA, 25 bp, Rattus norvegicus
ctgactgtggcaagagctaccgctc

SEQ ID NO: 270170 - DNA, 25 bp, Rattus norvegicus
ctgactgtggcatgagctaccgctc

SEQ ID NO: 270171 - DNA, 25 bp, Rattus norvegicus
ctgactgttgacatgaatgtgccta

SEQ ID NO: 270172 - DNA, 25 bp, Rattus norvegicus
ctgactgttgacttgaatgtgccta

SEQ ID NO: 270173 - DNA, 25 bp, Rattus norvegicus
ctgactgttgtaatgttccagccaa

SEQ ID NO: 270174 - DNA, 25 bp, Rattus norvegicus
ctgactgttgtattgttccagccaa

SEQ ID NO: 270175 - DNA, 25 bp, Rattus norvegicus
ctgacttatctcaggtgtctgactt

SEQ ID NO: 270176 - DNA, 25 bp, Rattus norvegicus
ctgacttatctctggtgtctgactt

SEQ ID NO: 270177 - DNA, 25 bp, Rattus norvegicus
ctgacttcagcaacatttgatggag

SEQ ID NO: 270178 - DNA, 25 bp, Rattus norvegicus
ctgacttcagcatcatttgatggag

SEQ ID NO: 270179 - DNA, 25 bp, Rattus norvegicus
ctgacttcagcccttcatgtagaag

SEQ ID NO: 270180 - DNA, 25 bp, Rattus norvegicus
ctgacttcagccgttcatgtagaag

SEQ ID NO: 270181 - DNA, 25 bp, Rattus norvegicus
ctgacttcagttccacacagacagc

SEQ ID NO: 270182 - DNA, 25 bp, Rattus norvegicus
ctgacttcagttgcacacagacagc

SEQ ID NO: 270183 - DNA, 25 bp, Rattus norvegicus
ctgacttcccagcttgagattttct

SEQ ID NO: 270184 - DNA, 25 bp, Rattus norvegicus
ctgacttcccaggttgagattttct

SEQ ID NO: 270185 - DNA, 25 bp, Rattus norvegicus
ctgacttcccttcgagaaggactgt

SEQ ID NO: 270186 - DNA, 25 bp, Rattus norvegicus
ctgacttcccttggagaaggactgt

SEQ ID NO: 270187 - DNA, 25 bp, Rattus norvegicus
ctgacttccggcctctactaagaag

SEQ ID NO: 270188 - DNA, 25 bp, Rattus norvegicus
ctgacttccggcgtctactaagaag

SEQ ID NO: 270189 - DNA, 25 bp, Rattus norvegicus
ctgacttctgccagtgcatgctgct

SEQ ID NO: 270190 - DNA, 25 bp, Rattus norvegicus
ctgacttctgcctgtgcatgctgct

SEQ ID NO: 270191 - DNA, 25 bp, Rattus norvegicus
ctgacttctgtaaatgatgcactga

SEQ ID NO: 270192 - DNA, 25 bp, Rattus norvegicus
ctgacttctgtatatgatgcactga

SEQ ID NO: 270193 - DNA, 25 bp, Rattus norvegicus
ctgacttcttgtctatcgtgtgtct

SEQ ID NO: 270194 - DNA, 25 bp, Rattus norvegicus
ctgacttcttgtgtatcgtgtgtct

SEQ ID NO: 270195 - DNA, 25 bp, Rattus norvegicus
ctgacttgacagcatcctagcgtta

SEQ ID NO: 270196 - DNA, 25 bp, Rattus norvegicus
ctgacttgacaggatcctagcgtta

SEQ ID NO: 270197 - DNA, 25 bp, Rattus norvegicus
ctgacttgaccgatcttactgagac

SEQ ID NO: 270198 - DNA, 25 bp, Rattus norvegicus
ctgacttgaccgttcttactgagac

SEQ ID NO: 270199 - DNA, 25 bp, Rattus norvegicus
ctgacttgactgatgtgttacgggt

SEQ ID NO: 270200 - DNA, 25 bp, Rattus norvegicus
ctgacttgactgttgtgttacgggt

SEQ ID NO: 270201 - DNA, 25 bp, Rattus norvegicus
ctgacttgggtgcagcatttgctga

SEQ ID NO: 270202 - DNA, 25 bp, Rattus norvegicus
ctgacttgggtggagcatttgctga

SEQ ID NO: 270203 - DNA, 25 bp, Rattus norvegicus
ctgacttgtatcacgaggttgagac

SEQ ID NO: 270204 - DNA, 25 bp, Rattus norvegicus
ctgacttgtatctcgaggttgagac

SEQ ID NO: 270205 - DNA, 25 bp, Rattus norvegicus
ctgactttacatagagcggattgca

SEQ ID NO: 270206 - DNA, 25 bp, Rattus norvegicus
ctgactttacattgagcggattgca

SEQ ID NO: 270207 - DNA, 25 bp, Rattus norvegicus
ctgactttcgttcggtgggagcaca

SEQ ID NO: 270208 - DNA, 25 bp, Rattus norvegicus
ctgactttcgttgggtgggagcaca

SEQ ID NO: 270209 - DNA, 25 bp, Rattus norvegicus
ctgactttctttaggtaagcattac

SEQ ID NO: 270210 - DNA, 25 bp, Rattus norvegicus
ctgactttcttttggtaagcattac

SEQ ID NO: 270211 - DNA, 25 bp, Rattus norvegicus
ctgactttgaaaattgtccagtttg

SEQ ID NO: 270212 - DNA, 25 bp, Rattus norvegicus
ctgactttgaaatttgtccagtttg

SEQ ID NO: 270213 - DNA, 25 bp, Rattus norvegicus
ctgactttgcagattctagtctgaa

SEQ ID NO: 270214 - DNA, 25 bp, Rattus norvegicus
ctgactttgcagtttctagtctgaa

SEQ ID NO: 270215 - DNA, 25 bp, Rattus norvegicus
ctgacttttctgagggctacactga

SEQ ID NO: 270216 - DNA, 25 bp, Rattus norvegicus
ctgacttttctgtgggctacactga

SEQ ID NO: 270217 - DNA, 25 bp, Rattus norvegicus
ctgagaaaacatcgccaccattctg

SEQ ID NO: 270218 - DNA, 25 bp, Rattus norvegicus
ctgagaaaacatggccaccattctg

SEQ ID NO: 270219 - DNA, 25 bp, Rattus norvegicus
ctgagaaaacctactggctcttggt

SEQ ID NO: 270220 - DNA, 25 bp, Rattus norvegicus
ctgagaaaaccttctggctcttggt

SEQ ID NO: 270221 - DNA, 25 bp, Rattus norvegicus
ctgagaaaagctataacacaggtgg

SEQ ID NO: 270222 - DNA, 25 bp, Rattus norvegicus
ctgagaaaagctttaacacaggtgg

SEQ ID NO: 270223 - DNA, 25 bp, Rattus norvegicus
ctgagaaacttgctatgtggaacgg

SEQ ID NO: 270224 - DNA, 25 bp, Rattus norvegicus
ctgagaaacttggtatgtggaacgg

SEQ ID NO: 270225 - DNA, 25 bp, Rattus norvegicus
ctgagaaaggccacctgcttgctgg

SEQ ID NO: 270226 - DNA, 25 bp, Rattus norvegicus
ctgagaaaggcctcctgcttgctgg

SEQ ID NO: 270227 - DNA, 25 bp, Rattus norvegicus
ctgagaaagtgcatcgggtcctgca

SEQ ID NO: 270228 - DNA, 25 bp, Rattus norvegicus
ctgagaaagtgcttcgggtcctgca

SEQ ID NO: 270229 - DNA, 25 bp, Rattus norvegicus
ctgagaaccactcctgcacatatat

SEQ ID NO: 270230 - DNA, 25 bp, Rattus norvegicus
ctgagaaccactgctgcacatatat

SEQ ID NO: 270231 - DNA, 25 bp, Rattus norvegicus
ctgagaagactaacaccggagcgaa

SEQ ID NO: 270232 - DNA, 25 bp, Rattus norvegicus
ctgagaagactatcaccggagcgaa

SEQ ID NO: 270233 - DNA, 25 bp, Rattus norvegicus
ctgagaagactcaggtgtggaagct

SEQ ID NO: 270234 - DNA, 25 bp, Rattus norvegicus
ctgagaagactctggtgtggaagct

SEQ ID NO: 270235 - DNA, 25 bp, Rattus norvegicus
ctgagaagcccaaagctagcatgat

SEQ ID NO: 270236 - DNA, 25 bp, Rattus norvegicus
ctgagaagcccatagctagcatgat

SEQ ID NO: 270237 - DNA, 25 bp, Rattus norvegicus
ctgagaagcttcaccatgggctggc

SEQ ID NO: 270238 - DNA, 25 bp, Rattus norvegicus
ctgagaagcttctccatgggctggc

SEQ ID NO: 270239 - DNA, 25 bp, Rattus norvegicus
ctgagaagtactatgccacttggta

SEQ ID NO: 270240 - DNA, 25 bp, Rattus norvegicus
ctgagaagtactttgccacttggta

SEQ ID NO: 270241 - DNA, 25 bp, Rattus norvegicus
ctgagaagtgttctttggtttcctt

SEQ ID NO: 270242 - DNA, 25 bp, Rattus norvegicus
ctgagaagtgttgtttggtttcctt

SEQ ID NO: 270243 - DNA, 25 bp, Rattus norvegicus
ctgagaatcaagcagatggtgttaa

SEQ ID NO: 270244 - DNA, 25 bp, Rattus norvegicus
ctgagaatcaaggagatggtgttaa

SEQ ID NO: 270245 - DNA, 25 bp, Rattus norvegicus
ctgagaatgctcagcctagtgatga

SEQ ID NO: 270246 - DNA, 25 bp, Rattus norvegicus
ctgagaatgctctgcctagtgatga

SEQ ID NO: 270247 - DNA, 25 bp, Rattus norvegicus
ctgagaatggccctgtgttacctgg

SEQ ID NO: 270248 - DNA, 25 bp, Rattus norvegicus
ctgagaatggccgtgtgttacctgg

SEQ ID NO: 270249 - DNA, 25 bp, Rattus norvegicus
ctgagacactaacaacttgcctgat

SEQ ID NO: 270250 - DNA, 25 bp, Rattus norvegicus
ctgagacactaagaacttgcctgat

SEQ ID NO: 270251 - DNA, 25 bp, Rattus norvegicus
ctgagacatgagctgtgcactccag

SEQ ID NO: 270252 - DNA, 25 bp, Rattus norvegicus
ctgagacatgaggtgtgcactccag

SEQ ID NO: 270253 - DNA, 25 bp, Rattus norvegicus
ctgagaccatttacttttccttatt

SEQ ID NO: 270254 - DNA, 25 bp, Rattus norvegicus
ctgagaccattttcttttccttatt

SEQ ID NO: 270255 - DNA, 25 bp, Rattus norvegicus
ctgagacccagacaagcattccatg

SEQ ID NO: 270256 - DNA, 25 bp, Rattus norvegicus
ctgagacccagagaagcattccatg

SEQ ID NO: 270257 - DNA, 25 bp, Rattus norvegicus
ctgagacccatcagttggcagaact

SEQ ID NO: 270258 - DNA, 25 bp, Rattus norvegicus
ctgagacccatctgttggcagaact

SEQ ID NO: 270259 - DNA, 25 bp, Rattus norvegicus
ctgagaccccagcatgtgccaaaat

SEQ ID NO: 270260 - DNA, 25 bp, Rattus norvegicus
ctgagaccccaggatgtgccaaaat

SEQ ID NO: 270261 - DNA, 25 bp, Rattus norvegicus
ctgagacccctgaggcagaaggaaa

SEQ ID NO: 270262 - DNA, 25 bp, Rattus norvegicus
ctgagacccctgtggcagaaggaaa

SEQ ID NO: 270263 - DNA, 25 bp, Rattus norvegicus
ctgagacctggaaagcaagctgtac

SEQ ID NO: 270264 - DNA, 25 bp, Rattus norvegicus
ctgagacctggatagcaagctgtac

SEQ ID NO: 270265 - DNA, 25 bp, Rattus norvegicus
ctgagactatctctgcagcagcaag

SEQ ID NO: 270266 - DNA, 25 bp, Rattus norvegicus
ctgagactatctgtgcagcagcaag

SEQ ID NO: 270267 - DNA, 25 bp, Rattus norvegicus
ctgagactcatgagcaactctgaca

SEQ ID NO: 270268 - DNA, 25 bp, Rattus norvegicus
ctgagactcatgtgcaactctgaca

SEQ ID NO: 270269 - DNA, 25 bp, Rattus norvegicus
ctgagactccgaaggctgcctgggt

SEQ ID NO: 270270 - DNA, 25 bp, Rattus norvegicus
ctgagactccgatggctgcctgggt

SEQ ID NO: 270271 - DNA, 25 bp, Rattus norvegicus
ctgagactcgtcagtgcctttggaa

SEQ ID NO: 270272 - DNA, 25 bp, Rattus norvegicus
ctgagactcgtctgtgcctttggaa

SEQ ID NO: 270273 - DNA, 25 bp, Rattus norvegicus
ctgagactgacgatctttcaggtat

SEQ ID NO: 270274 - DNA, 25 bp, Rattus norvegicus
ctgagactgacgttctttcaggtat

SEQ ID NO: 270275 - DNA, 25 bp, Rattus norvegicus
ctgagactgctcagtgctcatcttc

SEQ ID NO: 270276 - DNA, 25 bp, Rattus norvegicus
ctgagactgctctgtgctcatcttc

SEQ ID NO: 270277 - DNA, 25 bp, Rattus norvegicus
ctgagactgttcagtgtggagacca

SEQ ID NO: 270278 - DNA, 25 bp, Rattus norvegicus
ctgagactgttctgtgtggagacca

SEQ ID NO: 270279 - DNA, 25 bp, Rattus norvegicus
ctgagacttcgcagagggcagtatt

SEQ ID NO: 270280 - DNA, 25 bp, Rattus norvegicus
ctgagacttcgctgagggcagtatt

SEQ ID NO: 270281 - DNA, 25 bp, Rattus norvegicus
ctgagagagcctcccggatgatgaa

SEQ ID NO: 270282 - DNA, 25 bp, Rattus norvegicus
ctgagagagcctgccggatgatgaa

SEQ ID NO: 270283 - DNA, 25 bp, Rattus norvegicus
ctgagagagggtcgcacatgctcct

SEQ ID NO: 270284 - DNA, 25 bp, Rattus norvegicus
ctgagagagggtggcacatgctcct

SEQ ID NO: 270285 - DNA, 25 bp, Rattus norvegicus
ctgagagatagacagggccgtccaa

SEQ ID NO: 270286 - DNA, 25 bp, Rattus norvegicus
ctgagagatagagagggccgtccaa

SEQ ID NO: 270287 - DNA, 25 bp, Rattus norvegicus
ctgagagatgcaacgagtccctgat

SEQ ID NO: 270288 - DNA, 25 bp, Rattus norvegicus
ctgagagatgcatcgagtccctgat

SEQ ID NO: 270289 - DNA, 25 bp, Rattus norvegicus
ctgagagatgtcacccacgggacag

SEQ ID NO: 270290 - DNA, 25 bp, Rattus norvegicus
ctgagagatgtctcccacgggacag

SEQ ID NO: 270291 - DNA, 25 bp, Rattus norvegicus
ctgagagcaactccctgctgaagct

SEQ ID NO: 270292 - DNA, 25 bp, Rattus norvegicus
ctgagagcaactctgctctgcaggg

SEQ ID NO: 270293 - DNA, 25 bp, Rattus norvegicus
ctgagagcaactgcctgctgaagct

SEQ ID NO: 270294 - DNA, 25 bp, Rattus norvegicus
ctgagagcaactgtgctctgcaggg

SEQ ID NO: 270295 - DNA, 25 bp, Rattus norvegicus
ctgagagccaatcagagtctgagag

SEQ ID NO: 270296 - DNA, 25 bp, Rattus norvegicus
ctgagagccaatgagagtctgagag

SEQ ID NO: 270297 - DNA, 25 bp, Rattus norvegicus
ctgagagccagacgcgcctggacca

SEQ ID NO: 270298 - DNA, 25 bp, Rattus norvegicus
ctgagagccagaggcgcctggacca

SEQ ID NO: 270299 - DNA, 25 bp, Rattus norvegicus
ctgagagccccacactgagcagtaa

SEQ ID NO: 270300 - DNA, 25 bp, Rattus norvegicus
ctgagagccccagactgagcagtaa

SEQ ID NO: 270301 - DNA, 25 bp, Rattus norvegicus
ctgagagccctgaacttttgagaca

SEQ ID NO: 270302 - DNA, 25 bp, Rattus norvegicus
ctgagagccctgtacttttgagaca

SEQ ID NO: 270303 - DNA, 25 bp, Rattus norvegicus
ctgagagccgtgaagcagtgtctgt

SEQ ID NO: 270304 - DNA, 25 bp, Rattus norvegicus
ctgagagccgtgtagcagtgtctgt

SEQ ID NO: 270305 - DNA, 25 bp, Rattus norvegicus
ctgagagcgaggagacgcccctgac

SEQ ID NO: 270306 - DNA, 25 bp, Rattus norvegicus
ctgagagcgaggtgacgcccctgac

SEQ ID NO: 270307 - DNA, 25 bp, Rattus norvegicus
ctgagagctactcagcacagcaact

SEQ ID NO: 270308 - DNA, 25 bp, Rattus norvegicus
ctgagagctactgagcacagcaact

SEQ ID NO: 270309 - DNA, 25 bp, Rattus norvegicus
ctgagaggacacacgcatgtgtaaa

SEQ ID NO: 270310 - DNA, 25 bp, Rattus norvegicus
ctgagaggacactcgcatgtgtaaa

SEQ ID NO: 270311 - DNA, 25 bp, Rattus norvegicus
ctgagaggagagagtcttccttgtt

SEQ ID NO: 270312 - DNA, 25 bp, Rattus norvegicus
ctgagaggagagtgtcttccttgtt

SEQ ID NO: 270313 - DNA, 25 bp, Rattus norvegicus
ctgagagggttcatcagcggcaacc

SEQ ID NO: 270314 - DNA, 25 bp, Rattus norvegicus
ctgagagggttcttcagcggcaacc

SEQ ID NO: 270315 - DNA, 25 bp, Rattus norvegicus
ctgagaggtctcagggacacctgag

SEQ ID NO: 270316 - DNA, 25 bp, Rattus norvegicus
ctgagaggtctctgggacacctgag

SEQ ID NO: 270317 - DNA, 25 bp, Rattus norvegicus
ctgagagtgggcacccaggcctgca

SEQ ID NO: 270318 - DNA, 25 bp, Rattus norvegicus
ctgagagtgggctcccaggcctgca

SEQ ID NO: 270319 - DNA, 25 bp, Rattus norvegicus
ctgagagttctgctctgctgagagt

SEQ ID NO: 270320 - DNA, 25 bp, Rattus norvegicus
ctgagagttctgctgtttgagctga

SEQ ID NO: 270321 - DNA, 25 bp, Rattus norvegicus
ctgagagttctggtctgctgagagt

SEQ ID NO: 270322 - DNA, 25 bp, Rattus norvegicus
ctgagagttctggtgtttgagctga

SEQ ID NO: 270323 - DNA, 25 bp, Rattus norvegicus
ctgagataagcacccggacgttacc

SEQ ID NO: 270324 - DNA, 25 bp, Rattus norvegicus
ctgagataagcagccggacgttacc

SEQ ID NO: 270325 - DNA, 25 bp, Rattus norvegicus
ctgagatatactaactctgtgcttg

SEQ ID NO: 270326 - DNA, 25 bp, Rattus norvegicus
ctgagatatacttactctgtgcttg

SEQ ID NO: 270327 - DNA, 25 bp, Rattus norvegicus
ctgagatcagtccagagacccatct

SEQ ID NO: 270328 - DNA, 25 bp, Rattus norvegicus
ctgagatcagtcgagagacccatct

SEQ ID NO: 270329 - DNA, 25 bp, Rattus norvegicus
ctgagatcatctacggtatcccaag

SEQ ID NO: 270330 - DNA, 25 bp, Rattus norvegicus
ctgagatcatcttcggtatcccaag

SEQ ID NO: 270331 - DNA, 25 bp, Rattus norvegicus
ctgagatcccttatggagttgccta

SEQ ID NO: 270332 - DNA, 25 bp, Rattus norvegicus
ctgagatcccttttggagttgccta

SEQ ID NO: 270333 - DNA, 25 bp, Rattus norvegicus
ctgagatccgagcagactggtcttt

SEQ ID NO: 270334 - DNA, 25 bp, Rattus norvegicus
ctgagatccgaggagactggtcttt

SEQ ID NO: 270335 - DNA, 25 bp, Rattus norvegicus
ctgagatcgcagaggagtcccggaa

SEQ ID NO: 270336 - DNA, 25 bp, Rattus norvegicus
ctgagatcgcagtggagtcccggaa

SEQ ID NO: 270337 - DNA, 25 bp, Rattus norvegicus
ctgagatctgagattgtacaggaac

SEQ ID NO: 270338 - DNA, 25 bp, Rattus norvegicus
ctgagatctgagtttgtacaggaac

SEQ ID NO: 270339 - DNA, 25 bp, Rattus norvegicus
ctgagatctggacgctcagtgctgt

SEQ ID NO: 270340 - DNA, 25 bp, Rattus norvegicus
ctgagatctggaggctcagtgctgt

SEQ ID NO: 270341 - DNA, 25 bp, Rattus norvegicus
ctgagattcggcaggccatctttgc

SEQ ID NO: 270342 - DNA, 25 bp, Rattus norvegicus
ctgagattcggctggccatctttgc

SEQ ID NO: 270343 - DNA, 25 bp, Rattus norvegicus
ctgagattctgcactccatgaaaaa

SEQ ID NO: 270344 - DNA, 25 bp, Rattus norvegicus
ctgagattctgctctccatgaaaaa

SEQ ID NO: 270345 - DNA, 25 bp, Rattus norvegicus
ctgagattgccaaccggcagagtgt

SEQ ID NO: 270346 - DNA, 25 bp, Rattus norvegicus
ctgagattgccatccggcagagtgt

SEQ ID NO: 270347 - DNA, 25 bp, Rattus norvegicus
ctgagattgtagatttccttccgcc

SEQ ID NO: 270348 - DNA, 25 bp, Rattus norvegicus
ctgagattgtagttttccttccgcc

SEQ ID NO: 270349 - DNA, 25 bp, Rattus norvegicus
ctgagatttctgactttcccaaagg

SEQ ID NO: 270350 - DNA, 25 bp, Rattus norvegicus
ctgagatttctgtctttcccaaagg

SEQ ID NO: 270351 - DNA, 25 bp, Rattus norvegicus
ctgagatttttgcttttgcccagta

SEQ ID NO: 270352 - DNA, 25 bp, Rattus norvegicus
ctgagatttttggttttgcccagta

SEQ ID NO: 270353 - DNA, 25 bp, Rattus norvegicus
ctgagcaactgtatcgttttacttt

SEQ ID NO: 270354 - DNA, 25 bp, Rattus norvegicus
ctgagcaactgtcccagcttggaga

SEQ ID NO: 270355 - DNA, 25 bp, Rattus norvegicus
ctgagcaactgtgccagcttggaga

SEQ ID NO: 270356 - DNA, 25 bp, Rattus norvegicus
ctgagcaactgtttcgttttacttt

SEQ ID NO: 270357 - DNA, 25 bp, Rattus norvegicus
ctgagcacagacacttttccttttg

SEQ ID NO: 270358 - DNA, 25 bp, Rattus norvegicus
ctgagcacagactcttttccttttg

SEQ ID NO: 270359 - DNA, 25 bp, Rattus norvegicus
ctgagcacatccaaaactgacctgt

SEQ ID NO: 270360 - DNA, 25 bp, Rattus norvegicus
ctgagcacatcctaaactgacctgt

SEQ ID NO: 270361 - DNA, 25 bp, Rattus norvegicus
ctgagcaccctaccttgcaagtaaa

SEQ ID NO: 270362 - DNA, 25 bp, Rattus norvegicus
ctgagcaccctagcttgcaagtaaa

SEQ ID NO: 270363 - DNA, 25 bp, Rattus norvegicus
ctgagcacggtgactgggtgtccaa

SEQ ID NO: 270364 - DNA, 25 bp, Rattus norvegicus
ctgagcacggtgtctgggtgtccaa

SEQ ID NO: 270365 - DNA, 25 bp, Rattus norvegicus
ctgagcactcttaggcgggtggcat

SEQ ID NO: 270366 - DNA, 25 bp, Rattus norvegicus
ctgagcactctttggcgggtggcat

SEQ ID NO: 270367 - DNA, 25 bp, Rattus norvegicus
ctgagcactgggactgatgcggact

SEQ ID NO: 270368 - DNA, 25 bp, Rattus norvegicus
ctgagcactgggtctgatgcggact

SEQ ID NO: 270369 - DNA, 25 bp, Rattus norvegicus
ctgagcagcgaaccctccgaggtgc

SEQ ID NO: 270370 - DNA, 25 bp, Rattus norvegicus
ctgagcagcgaagcctccgaggtgc

SEQ ID NO: 270371 - DNA, 25 bp, Rattus norvegicus
ctgagcaggcttcctatgttttgga

SEQ ID NO: 270372 - DNA, 25 bp, Rattus norvegicus
ctgagcaggcttgctatgttttgga

SEQ ID NO: 270373 - DNA, 25 bp, Rattus norvegicus
ctgagcaggtcacgcccatcaagat

SEQ ID NO: 270374 - DNA, 25 bp, Rattus norvegicus
ctgagcaggtcaggcccatcaagat

SEQ ID NO: 270375 - DNA, 25 bp, Rattus norvegicus
ctgagcataagcagaggtgcccttt

SEQ ID NO: 270376 - DNA, 25 bp, Rattus norvegicus
ctgagcataagctgaggtgcccttt

SEQ ID NO: 270377 - DNA, 25 bp, Rattus norvegicus
ctgagcatggtacctgcggagactt

SEQ ID NO: 270378 - DNA, 25 bp, Rattus norvegicus
ctgagcatggtagctgcggagactt

SEQ ID NO: 270379 - DNA, 25 bp, Rattus norvegicus
ctgagccaagctcccatgtctgaag

SEQ ID NO: 270380 - DNA, 25 bp, Rattus norvegicus
ctgagccaagctgccatgtctgaag

SEQ ID NO: 270381 - DNA, 25 bp, Rattus norvegicus
ctgagccacactatgagcggacggt

SEQ ID NO: 270382 - DNA, 25 bp, Rattus norvegicus
ctgagccacactttgagcggacggt

SEQ ID NO: 270383 - DNA, 25 bp, Rattus norvegicus
ctgagccacagacaaggccatgctg

SEQ ID NO: 270384 - DNA, 25 bp, Rattus norvegicus
ctgagccacagagaaggccatgctg

SEQ ID NO: 270385 - DNA, 25 bp, Rattus norvegicus
ctgagccacctgattgcaagcaata

SEQ ID NO: 270386 - DNA, 25 bp, Rattus norvegicus
ctgagccacctgtttgcaagcaata

SEQ ID NO: 270387 - DNA, 25 bp, Rattus norvegicus
ctgagccagtagacgcgggcccgtc

SEQ ID NO: 270388 - DNA, 25 bp, Rattus norvegicus
ctgagccagtagtcgcgggcccgtc

SEQ ID NO: 270389 - DNA, 25 bp, Rattus norvegicus
ctgagccatctgcagtactgaggaa

SEQ ID NO: 270390 - DNA, 25 bp, Rattus norvegicus
ctgagccatctggagtactgaggaa

SEQ ID NO: 270391 - DNA, 25 bp, Rattus norvegicus
ctgagcccggccataagggcatgga

SEQ ID NO: 270392 - DNA, 25 bp, Rattus norvegicus
ctgagcccggccttaagggcatgga

SEQ ID NO: 270393 - DNA, 25 bp, Rattus norvegicus
ctgagccctcgaagtctagagcaga

SEQ ID NO: 270394 - DNA, 25 bp, Rattus norvegicus
ctgagccctcgatgtctagagcaga

SEQ ID NO: 270395 - DNA, 25 bp, Rattus norvegicus
ctgagcccttgcatacattttctgg

SEQ ID NO: 270396 - DNA, 25 bp, Rattus norvegicus
ctgagcccttgcttacattttctgg

SEQ ID NO: 270397 - DNA, 25 bp, Rattus norvegicus
ctgagccgtaggcaaactgaactgt

SEQ ID NO: 270398 - DNA, 25 bp, Rattus norvegicus
ctgagccgtagggaaactgaactgt

SEQ ID NO: 270399 - DNA, 25 bp, Rattus norvegicus
ctgagcctattgagagtgctgtgta

SEQ ID NO: 270400 - DNA, 25 bp, Rattus norvegicus
ctgagcctattgtgagtgctgtgta

SEQ ID NO: 270401 - DNA, 25 bp, Rattus norvegicus
ctgagcctcaccctgttctgtgtgt

SEQ ID NO: 270402 - DNA, 25 bp, Rattus norvegicus
ctgagcctcaccgtgttctgtgtgt

SEQ ID NO: 270403 - DNA, 25 bp, Rattus norvegicus
ctgagcctcagtctatgtatctggt

SEQ ID NO: 270404 - DNA, 25 bp, Rattus norvegicus
ctgagcctcagtgtatgtatctggt

SEQ ID NO: 270405 - DNA, 25 bp, Rattus norvegicus
ctgagcctccagagctgagtggaga

SEQ ID NO: 270406 - DNA, 25 bp, Rattus norvegicus
ctgagcctccagattgcagggcaag

SEQ ID NO: 270407 - DNA, 25 bp, Rattus norvegicus
ctgagcctccagtgctgagtggaga

SEQ ID NO: 270408 - DNA, 25 bp, Rattus norvegicus
ctgagcctccagtttgcagggcaag

SEQ ID NO: 270409 - DNA, 25 bp, Rattus norvegicus
ctgagcctcgggattggttctgtga

SEQ ID NO: 270410 - DNA, 25 bp, Rattus norvegicus
ctgagcctcgggtttggttctgtga

SEQ ID NO: 270411 - DNA, 25 bp, Rattus norvegicus
ctgagcctggagagttgacatgagc

SEQ ID NO: 270412 - DNA, 25 bp, Rattus norvegicus
ctgagcctggagtgttgacatgagc

SEQ ID NO: 270413 - DNA, 25 bp, Rattus norvegicus
ctgagcctggcaaagtgatctgtga

SEQ ID NO: 270414 - DNA, 25 bp, Rattus norvegicus
ctgagcctggcatagtgatctgtga

SEQ ID NO: 270415 - DNA, 25 bp, Rattus norvegicus
ctgagcctgtccatgggccgattta

SEQ ID NO: 270416 - DNA, 25 bp, Rattus norvegicus
ctgagcctgtccttgggccgattta

SEQ ID NO: 270417 - DNA, 25 bp, Rattus norvegicus
ctgagccttcatcctgacagggaac

SEQ ID NO: 270418 - DNA, 25 bp, Rattus norvegicus
ctgagccttcatgctgacagggaac

SEQ ID NO: 270419 - DNA, 25 bp, Rattus norvegicus
ctgagccttccaccagactgtggtg

SEQ ID NO: 270420 - DNA, 25 bp, Rattus norvegicus
ctgagccttccagcagactgtggtg

SEQ ID NO: 270421 - DNA, 25 bp, Rattus norvegicus
ctgagccttgctaggaaatgactat

SEQ ID NO: 270422 - DNA, 25 bp, Rattus norvegicus
ctgagccttgcttggaaatgactat

SEQ ID NO: 270423 - DNA, 25 bp, Rattus norvegicus
ctgagccttggcatgaattctgtgt

SEQ ID NO: 270424 - DNA, 25 bp, Rattus norvegicus
ctgagccttggcttgaattctgtgt

SEQ ID NO: 270425 - DNA, 25 bp, Rattus norvegicus
ctgagcgaggttcccctgcagactg

SEQ ID NO: 270426 - DNA, 25 bp, Rattus norvegicus
ctgagcgaggttgccctgcagactg

SEQ ID NO: 270427 - DNA, 25 bp, Rattus norvegicus
ctgagcgatccactgcattcaacac

SEQ ID NO: 270428 - DNA, 25 bp, Rattus norvegicus
ctgagcgatccagtgcattcaacac

SEQ ID NO: 270429 - DNA, 25 bp, Rattus norvegicus
ctgagcgctgcgagtgttcaccact

SEQ ID NO: 270430 - DNA, 25 bp, Rattus norvegicus
ctgagcgctgcgtgtgttcaccact

SEQ ID NO: 270431 - DNA, 25 bp, Rattus norvegicus
ctgagcgttcctcccttgagaaaga

SEQ ID NO: 270432 - DNA, 25 bp, Rattus norvegicus
ctgagcgttcctgccttgagaaaga

SEQ ID NO: 270433 - DNA, 25 bp, Rattus norvegicus
ctgagctagcttatcttatgggcaa

SEQ ID NO: 270434 - DNA, 25 bp, Rattus norvegicus
ctgagctagcttttcttatgggcaa

SEQ ID NO: 270435 - DNA, 25 bp, Rattus norvegicus
ctgagctattctctgtctccaagag

SEQ ID NO: 270436 - DNA, 25 bp, Rattus norvegicus
ctgagctattctgtgtctccaagag

SEQ ID NO: 270437 - DNA, 25 bp, Rattus norvegicus
ctgagctcaggtcacattggcatct

SEQ ID NO: 270438 - DNA, 25 bp, Rattus norvegicus
ctgagctcaggtgacattggcatct

SEQ ID NO: 270439 - DNA, 25 bp, Rattus norvegicus
ctgagctccgagactttcgaggaaa

SEQ ID NO: 270440 - DNA, 25 bp, Rattus norvegicus
ctgagctccgagtctttcgaggaaa

SEQ ID NO: 270441 - DNA, 25 bp, Rattus norvegicus
ctgagctcgtacaatgcgttaccac

SEQ ID NO: 270442 - DNA, 25 bp, Rattus norvegicus
ctgagctcgtactatgcgttaccac

SEQ ID NO: 270443 - DNA, 25 bp, Rattus norvegicus
ctgagctcgtctctcttttcatgga

SEQ ID NO: 270444 - DNA, 25 bp, Rattus norvegicus
ctgagctcgtctgtcttttcatgga

SEQ ID NO: 270445 - DNA, 25 bp, Rattus norvegicus
ctgagctctcctcactttgtgaaaa

SEQ ID NO: 270446 - DNA, 25 bp, Rattus norvegicus
ctgagctctcctgactttgtgaaaa

SEQ ID NO: 270447 - DNA, 25 bp, Rattus norvegicus
ctgagctctctgattaggtgacaca

SEQ ID NO: 270448 - DNA, 25 bp, Rattus norvegicus
ctgagctctctgtttaggtgacaca

SEQ ID NO: 270449 - DNA, 25 bp, Rattus norvegicus
ctgagctctcttacctggatttata

SEQ ID NO: 270450 - DNA, 25 bp, Rattus norvegicus
ctgagctctctttcctggatttata

SEQ ID NO: 270451 - DNA, 25 bp, Rattus norvegicus
ctgagctgaactaggctcatcttcc

SEQ ID NO: 270452 - DNA, 25 bp, Rattus norvegicus
ctgagctgaacttggctcatcttcc

SEQ ID NO: 270453 - DNA, 25 bp, Rattus norvegicus
ctgagctgcagcagagagcgcgcag

SEQ ID NO: 270454 - DNA, 25 bp, Rattus norvegicus
ctgagctgcagctgagagcgcgcag

SEQ ID NO: 270455 - DNA, 25 bp, Rattus norvegicus
ctgagctgcagtcacttgtctgtaa

SEQ ID NO: 270456 - DNA, 25 bp, Rattus norvegicus
ctgagctgcagtgacttgtctgtaa

SEQ ID NO: 270457 - DNA, 25 bp, Rattus norvegicus
ctgagctgcttgagactgggtgact

SEQ ID NO: 270458 - DNA, 25 bp, Rattus norvegicus
ctgagctgcttgtgactgggtgact

SEQ ID NO: 270459 - DNA, 25 bp, Rattus norvegicus
ctgagctgttatccccattcattta

SEQ ID NO: 270460 - DNA, 25 bp, Rattus norvegicus
ctgagctgttatgcccattcattta

SEQ ID NO: 270461 - DNA, 25 bp, Rattus norvegicus
ctgagcttagttaaccttagtgtat

SEQ ID NO: 270462 - DNA, 25 bp, Rattus norvegicus
ctgagcttagtttaccttagtgtat

SEQ ID NO: 270463 - DNA, 25 bp, Rattus norvegicus
ctgagcttctacctttgtgttcaaa

SEQ ID NO: 270464 - DNA, 25 bp, Rattus norvegicus
ctgagcttctacgtttgtgttcaaa

SEQ ID NO: 270465 - DNA, 25 bp, Rattus norvegicus
ctgagcttctttaccctacaaatat

SEQ ID NO: 270466 - DNA, 25 bp, Rattus norvegicus
ctgagcttcttttccctacaaatat

SEQ ID NO: 270467 - DNA, 25 bp, Rattus norvegicus
ctgagcttgctgatctgagtgtgaa

SEQ ID NO: 270468 - DNA, 25 bp, Rattus norvegicus
ctgagcttgctgttctgagtgtgaa

SEQ ID NO: 270469 - DNA, 25 bp, Rattus norvegicus
ctgagcttggctccattggtctaga

SEQ ID NO: 270470 - DNA, 25 bp, Rattus norvegicus
ctgagcttggctgcattggtctaga

SEQ ID NO: 270471 - DNA, 25 bp, Rattus norvegicus
ctgagctttatcacagaggtcttcc

SEQ ID NO: 270472 - DNA, 25 bp, Rattus norvegicus
ctgagctttatctcagaggtcttcc

SEQ ID NO: 270473 - DNA, 25 bp, Rattus norvegicus
ctgagctttcttacattctaccatt

SEQ ID NO: 270474 - DNA, 25 bp, Rattus norvegicus
ctgagctttctttcattctaccatt

SEQ ID NO: 270475 - DNA, 25 bp, Rattus norvegicus
ctgagctttgatactccaggacgag

SEQ ID NO: 270476 - DNA, 25 bp, Rattus norvegicus
ctgagctttgattctccaggacgag

SEQ ID NO: 270477 - DNA, 25 bp, Rattus norvegicus
ctgagctttgtcagacacttccaca

SEQ ID NO: 270478 - DNA, 25 bp, Rattus norvegicus
ctgagctttgtctgacacttccaca

SEQ ID NO: 270479 - DNA, 25 bp, Rattus norvegicus
ctgaggaaaagcatcaccctcttcc

SEQ ID NO: 270480 - DNA, 25 bp, Rattus norvegicus
ctgaggaaaagcttcaccctcttcc

SEQ ID NO: 270481 - DNA, 25 bp, Rattus norvegicus
ctgaggaacatccagggcctgtttg

SEQ ID NO: 270482 - DNA, 25 bp, Rattus norvegicus
ctgaggaacatcgagggcctgtttg

SEQ ID NO: 270483 - DNA, 25 bp, Rattus norvegicus
ctgaggaacccacggatgccagtgt

SEQ ID NO: 270484 - DNA, 25 bp, Rattus norvegicus
ctgaggaacccagggatgccagtgt

SEQ ID NO: 270485 - DNA, 25 bp, Rattus norvegicus
ctgaggaacttaagtctgcagactt

SEQ ID NO: 270486 - DNA, 25 bp, Rattus norvegicus
ctgaggaacttatgtctgcagactt

SEQ ID NO: 270487 - DNA, 25 bp, Rattus norvegicus
ctgaggaagcggagatctgtagcac

SEQ ID NO: 270488 - DNA, 25 bp, Rattus norvegicus
ctgaggaagcggtgatctgtagcac

SEQ ID NO: 270489 - DNA, 25 bp, Rattus norvegicus
ctgaggaccaaacatcccagtacct

SEQ ID NO: 270490 - DNA, 25 bp, Rattus norvegicus
ctgaggaccaaagatcccagtacct

SEQ ID NO: 270491 - DNA, 25 bp, Rattus norvegicus
ctgaggaccaagagctgtgtgagaa

SEQ ID NO: 270492 - DNA, 25 bp, Rattus norvegicus
ctgaggaccaagtgctgtgtgagaa

SEQ ID NO: 270493 - DNA, 25 bp, Rattus norvegicus
ctgaggaccctcagagtgcaggaga

SEQ ID NO: 270494 - DNA, 25 bp, Rattus norvegicus
ctgaggaccctctgagtgcaggaga

SEQ ID NO: 270495 - DNA, 25 bp, Rattus norvegicus
ctgaggacctgacttggcatcttca

SEQ ID NO: 270496 - DNA, 25 bp, Rattus norvegicus
ctgaggacctgagttggcatcttca

SEQ ID NO: 270497 - DNA, 25 bp, Rattus norvegicus
ctgaggacctttcccaggactgctt

SEQ ID NO: 270498 - DNA, 25 bp, Rattus norvegicus
ctgaggacctttgccaggactgctt

SEQ ID NO: 270499 - DNA, 25 bp, Rattus norvegicus
ctgaggacgactaagctggcatctt

SEQ ID NO: 270500 - DNA, 25 bp, Rattus norvegicus
ctgaggacgacttagctggcatctt

SEQ ID NO: 270501 - DNA, 25 bp, Rattus norvegicus
ctgaggacgttcaaccttgtcaata

SEQ ID NO: 270502 - DNA, 25 bp, Rattus norvegicus
ctgaggacgttctaccttgtcaata

SEQ ID NO: 270503 - DNA, 25 bp, Rattus norvegicus
ctgaggactccactcctaggaaatc

SEQ ID NO: 270504 - DNA, 25 bp, Rattus norvegicus
ctgaggactccagtcctaggaaatc

SEQ ID NO: 270505 - DNA, 25 bp, Rattus norvegicus
ctgaggactgatctgagccacatgg

SEQ ID NO: 270506 - DNA, 25 bp, Rattus norvegicus
ctgaggactgatgtgagccacatgg

SEQ ID NO: 270507 - DNA, 25 bp, Rattus norvegicus
ctgaggagaccaagctgctggtgct

SEQ ID NO: 270508 - DNA, 25 bp, Rattus norvegicus
ctgaggagaccatgctgctggtgct

SEQ ID NO: 270509 - DNA, 25 bp, Rattus norvegicus
ctgaggagagcaacactgttttact

SEQ ID NO: 270510 - DNA, 25 bp, Rattus norvegicus
ctgaggagagcatcactgttttact

SEQ ID NO: 270511 - DNA, 25 bp, Rattus norvegicus
ctgaggagagttctttccagcactg

SEQ ID NO: 270512 - DNA, 25 bp, Rattus norvegicus
ctgaggagagttgtttccagcactg

SEQ ID NO: 270513 - DNA, 25 bp, Rattus norvegicus
ctgaggagcgagatgttttaacaca

SEQ ID NO: 270514 - DNA, 25 bp, Rattus norvegicus
ctgaggagcgagttgttttaacaca

SEQ ID NO: 270515 - DNA, 25 bp, Rattus norvegicus
ctgaggaggacaagcctgtttgctg

SEQ ID NO: 270516 - DNA, 25 bp, Rattus norvegicus
ctgaggaggacatgcctgtttgctg

SEQ ID NO: 270517 - DNA, 25 bp, Rattus norvegicus
ctgaggaggcccacaacaccgggtg

SEQ ID NO: 270518 - DNA, 25 bp, Rattus norvegicus
ctgaggaggccctcaacaccgggtg

SEQ ID NO: 270519 - DNA, 25 bp, Rattus norvegicus
ctgaggaggctgaagtgtcatcccc

SEQ ID NO: 270520 - DNA, 25 bp, Rattus norvegicus
ctgaggaggctgtagtgtcatcccc

SEQ ID NO: 270521 - DNA, 25 bp, Rattus norvegicus
ctgaggagggcaagactttatgact

SEQ ID NO: 270522 - DNA, 25 bp, Rattus norvegicus
ctgaggagggcatgactttatgact

SEQ ID NO: 270523 - DNA, 25 bp, Rattus norvegicus
ctgaggatgacaaggctcctgctga

SEQ ID NO: 270524 - DNA, 25 bp, Rattus norvegicus
ctgaggatgacatggctcctgctga

SEQ ID NO: 270525 - DNA, 25 bp, Rattus norvegicus
ctgaggatgccactgagaccgacct

SEQ ID NO: 270526 - DNA, 25 bp, Rattus norvegicus
ctgaggatgccagtgagaccgacct

SEQ ID NO: 270527 - DNA, 25 bp, Rattus norvegicus
ctgaggatgctgactcttcggtgaa

SEQ ID NO: 270528 - DNA, 25 bp, Rattus norvegicus
ctgaggatgctgtctcttcggtgaa

SEQ ID NO: 270529 - DNA, 25 bp, Rattus norvegicus
ctgaggatgtgacaacatgaggaac

SEQ ID NO: 270530 - DNA, 25 bp, Rattus norvegicus
ctgaggatgtgagaacatgaggaac

SEQ ID NO: 270531 - DNA, 25 bp, Rattus norvegicus
ctgaggattaaaccctggcccttgt

SEQ ID NO: 270532 - DNA, 25 bp, Rattus norvegicus
ctgaggattaaagcctggcccttgt

SEQ ID NO: 270533 - DNA, 25 bp, Rattus norvegicus
ctgaggcagtttaaagatccaatct

SEQ ID NO: 270534 - DNA, 25 bp, Rattus norvegicus
ctgaggcagttttaagatccaatct

SEQ ID NO: 270535 - DNA, 25 bp, Rattus norvegicus
ctgaggcatggactagatgtctcct

SEQ ID NO: 270536 - DNA, 25 bp, Rattus norvegicus
ctgaggcatggagtagatgtctcct

SEQ ID NO: 270537 - DNA, 25 bp, Rattus norvegicus
ctgaggccacttactccaatgtggg

SEQ ID NO: 270538 - DNA, 25 bp, Rattus norvegicus
ctgaggccactttctccaatgtggg

SEQ ID NO: 270539 - DNA, 25 bp, Rattus norvegicus
ctgaggccatctccgccttgtgtca

SEQ ID NO: 270540 - DNA, 25 bp, Rattus norvegicus
ctgaggccatctgcgccttgtgtca

SEQ ID NO: 270541 - DNA, 25 bp, Rattus norvegicus
ctgaggcccaatcaagaagttactt

SEQ ID NO: 270542 - DNA, 25 bp, Rattus norvegicus
ctgaggcccaatgaagaagttactt

SEQ ID NO: 270543 - DNA, 25 bp, Rattus norvegicus
ctgaggcctaggagaatcaagagtt

SEQ ID NO: 270544 - DNA, 25 bp, Rattus norvegicus
ctgaggcctaggtgaatcaagagtt

SEQ ID NO: 270545 - DNA, 25 bp, Rattus norvegicus
ctgaggcctgaaagaaaagcgggtc

SEQ ID NO: 270546 - DNA, 25 bp, Rattus norvegicus
ctgaggcctgaatgaaaagcgggtc

SEQ ID NO: 270547 - DNA, 25 bp, Rattus norvegicus
ctgaggcctgcacttgtacagcatg

SEQ ID NO: 270548 - DNA, 25 bp, Rattus norvegicus
ctgaggcctgcagttgtacagcatg

SEQ ID NO: 270549 - DNA, 25 bp, Rattus norvegicus
ctgaggcctggtcaacctatcttta

SEQ ID NO: 270550 - DNA, 25 bp, Rattus norvegicus
ctgaggcctggtgaacctatcttta

SEQ ID NO: 270551 - DNA, 25 bp, Rattus norvegicus
ctgaggcgatgccaggcaaatcttt

SEQ ID NO: 270552 - DNA, 25 bp, Rattus norvegicus
ctgaggcgatgcgaggcaaatcttt

SEQ ID NO: 270553 - DNA, 25 bp, Rattus norvegicus
ctgaggcggcttatcttagttgatg

SEQ ID NO: 270554 - DNA, 25 bp, Rattus norvegicus
ctgaggcggcttttcttagttgatg

SEQ ID NO: 270555 - DNA, 25 bp, Rattus norvegicus
ctgaggctacaacgccaggtctgta

SEQ ID NO: 270556 - DNA, 25 bp, Rattus norvegicus
ctgaggctacaaggccaggtctgta

SEQ ID NO: 270557 - DNA, 25 bp, Rattus norvegicus
ctgaggctatgcagggacatgcagc

SEQ ID NO: 270558 - DNA, 25 bp, Rattus norvegicus
ctgaggctatgctgggacatgcagc

SEQ ID NO: 270559 - DNA, 25 bp, Rattus norvegicus
ctgaggctccagagtcaaagctgac

SEQ ID NO: 270560 - DNA, 25 bp, Rattus norvegicus
ctgaggctccagtgtcaaagctgac

SEQ ID NO: 270561 - DNA, 25 bp, Rattus norvegicus
ctgaggctcctgcacatagcatttg

SEQ ID NO: 270562 - DNA, 25 bp, Rattus norvegicus
ctgaggctcctggacatagcatttg

SEQ ID NO: 270563 - DNA, 25 bp, Rattus norvegicus
ctgaggctcgcacgtctaagaccaa

SEQ ID NO: 270564 - DNA, 25 bp, Rattus norvegicus
ctgaggctcgcaggtctaagaccaa

SEQ ID NO: 270565 - DNA, 25 bp, Rattus norvegicus
ctgaggctgacaaagttcgcaccat

SEQ ID NO: 270566 - DNA, 25 bp, Rattus norvegicus
ctgaggctgacatagttcgcaccat

SEQ ID NO: 270567 - DNA, 25 bp, Rattus norvegicus
ctgaggctgccaatttaacacccgt

SEQ ID NO: 270568 - DNA, 25 bp, Rattus norvegicus
ctgaggctgccattttaacacccgt

SEQ ID NO: 270569 - DNA, 25 bp, Rattus norvegicus
ctgaggctgctgcaagctgcacaaa

SEQ ID NO: 270570 - DNA, 25 bp, Rattus norvegicus
ctgaggctgctggaagctgcacaaa

SEQ ID NO: 270571 - DNA, 25 bp, Rattus norvegicus
ctgaggctgtacctcgcattgttga

SEQ ID NO: 270572 - DNA, 25 bp, Rattus norvegicus
ctgaggctgtacgtcgcattgttga

SEQ ID NO: 270573 - DNA, 25 bp, Rattus norvegicus
ctgaggcttctgatatgtgaccaaa

SEQ ID NO: 270574 - DNA, 25 bp, Rattus norvegicus
ctgaggcttctgttatgtgaccaaa

SEQ ID NO: 270575 - DNA, 25 bp, Rattus norvegicus
ctgaggctttcccaatttgttcata

SEQ ID NO: 270576 - DNA, 25 bp, Rattus norvegicus
ctgaggctttccgaatttgttcata

SEQ ID NO: 270577 - DNA, 25 bp, Rattus norvegicus
ctgaggcttttgaatctggtagtcc

SEQ ID NO: 270578 - DNA, 25 bp, Rattus norvegicus
ctgaggcttttgtatctggtagtcc

SEQ ID NO: 270579 - DNA, 25 bp, Rattus norvegicus
ctgagggaactcaaagaagtggcta

SEQ ID NO: 270580 - DNA, 25 bp, Rattus norvegicus
ctgagggaactctaagaagtggcta

SEQ ID NO: 270581 - DNA, 25 bp, Rattus norvegicus
ctgagggaagtgacctccctgggtt

SEQ ID NO: 270582 - DNA, 25 bp, Rattus norvegicus
ctgagggaagtgtcctccctgggtt

SEQ ID NO: 270583 - DNA, 25 bp, Rattus norvegicus
ctgagggacctgatttttgaaagct

SEQ ID NO: 270584 - DNA, 25 bp, Rattus norvegicus
ctgagggacctgttttttgaaagct

SEQ ID NO: 270585 - DNA, 25 bp, Rattus norvegicus
ctgagggcaagcatccgtgttgata

SEQ ID NO: 270586 - DNA, 25 bp, Rattus norvegicus
ctgagggcaagcttccgtgttgata

SEQ ID NO: 270587 - DNA, 25 bp, Rattus norvegicus
ctgagggcactcacacacttggtgt

SEQ ID NO: 270588 - DNA, 25 bp, Rattus norvegicus
ctgagggcactctcacacttggtgt

SEQ ID NO: 270589 - DNA, 25 bp, Rattus norvegicus
ctgagggcaggcactttcctggaaa

SEQ ID NO: 270590 - DNA, 25 bp, Rattus norvegicus
ctgagggcaggctctttcctggaaa

SEQ ID NO: 270591 - DNA, 25 bp, Rattus norvegicus
ctgagggcccatagagtttaaactt

SEQ ID NO: 270592 - DNA, 25 bp, Rattus norvegicus
ctgagggcccattgagtttaaactt

SEQ ID NO: 270593 - DNA, 25 bp, Rattus norvegicus
ctgagggccctgcatttgctgttat

SEQ ID NO: 270594 - DNA, 25 bp, Rattus norvegicus
ctgagggccctggatttgctgttat

SEQ ID NO: 270595 - DNA, 25 bp, Rattus norvegicus
ctgagggctcaacgaggctgactcc

SEQ ID NO: 270596 - DNA, 25 bp, Rattus norvegicus
ctgagggctcaaggaggctgactcc

SEQ ID NO: 270597 - DNA, 25 bp, Rattus norvegicus
ctgagggctgtcagggctctctcct

SEQ ID NO: 270598 - DNA, 25 bp, Rattus norvegicus
ctgagggctgtctgggctctctcct

SEQ ID NO: 270599 - DNA, 25 bp, Rattus norvegicus
ctgagggtaaccacggacatccgga

SEQ ID NO: 270600 - DNA, 25 bp, Rattus norvegicus
ctgagggtaacctcggacatccgga

SEQ ID NO: 270601 - DNA, 25 bp, Rattus norvegicus
ctgagggtacgaacgtgtgttgtct

SEQ ID NO: 270602 - DNA, 25 bp, Rattus norvegicus
ctgagggtacgatcgtgtgttgtct

SEQ ID NO: 270603 - DNA, 25 bp, Rattus norvegicus
ctgagggtccaaagctcctgcggtg

SEQ ID NO: 270604 - DNA, 25 bp, Rattus norvegicus
ctgagggtccaatgctcctgcggtg

SEQ ID NO: 270605 - DNA, 25 bp, Rattus norvegicus
ctgagggtccagcagttcaactttt

SEQ ID NO: 270606 - DNA, 25 bp, Rattus norvegicus
ctgagggtccaggagttcaactttt

SEQ ID NO: 270607 - DNA, 25 bp, Rattus norvegicus
ctgagggtccccagtctttcacaca

SEQ ID NO: 270608 - DNA, 25 bp, Rattus norvegicus
ctgagggtcccctgtctttcacaca

SEQ ID NO: 270609 - DNA, 25 bp, Rattus norvegicus
ctgagggtcctgatgatattaatga

SEQ ID NO: 270610 - DNA, 25 bp, Rattus norvegicus
ctgagggtcctgttgatattaatga

SEQ ID NO: 270611 - DNA, 25 bp, Rattus norvegicus
ctgagggttaggcagtattgcactt

SEQ ID NO: 270612 - DNA, 25 bp, Rattus norvegicus
ctgagggttagggagtattgcactt

SEQ ID NO: 270613 - DNA, 25 bp, Rattus norvegicus
ctgagggttctaaaaggactggcaa

SEQ ID NO: 270614 - DNA, 25 bp, Rattus norvegicus
ctgagggttctataaggactggcaa

SEQ ID NO: 270615 - DNA, 25 bp, Rattus norvegicus
ctgagggttctcaccttgttaagtg

SEQ ID NO: 270616 - DNA, 25 bp, Rattus norvegicus
ctgagggttctctccttgttaagtg

SEQ ID NO: 270617 - DNA, 25 bp, Rattus norvegicus
ctgaggtagatcatgttagtgcccc

SEQ ID NO: 270618 - DNA, 25 bp, Rattus norvegicus
ctgaggtagatcttgttagtgcccc

SEQ ID NO: 270619 - DNA, 25 bp, Rattus norvegicus
ctgaggtcactcaagggtacataat

SEQ ID NO: 270620 - DNA, 25 bp, Rattus norvegicus
ctgaggtcactctagggtacataat

SEQ ID NO: 270621 - DNA, 25 bp, Rattus norvegicus
ctgaggtcagtcaggaaaggcctaa

SEQ ID NO: 270622 - DNA, 25 bp, Rattus norvegicus
ctgaggtcagtctggaaaggcctaa

SEQ ID NO: 270623 - DNA, 25 bp, Rattus norvegicus
ctgaggtccctgataccaaactgga

SEQ ID NO: 270624 - DNA, 25 bp, Rattus norvegicus
ctgaggtccctgttaccaaactgga

SEQ ID NO: 270625 - DNA, 25 bp, Rattus norvegicus
ctgaggtcctccagaaggtcgtggt

SEQ ID NO: 270626 - DNA, 25 bp, Rattus norvegicus
ctgaggtcctcctgaaggtcgtggt

SEQ ID NO: 270627 - DNA, 25 bp, Rattus norvegicus
ctgaggtctcagctccagaacagaa

SEQ ID NO: 270628 - DNA, 25 bp, Rattus norvegicus
ctgaggtctcaggtccagaacagaa

SEQ ID NO: 270629 - DNA, 25 bp, Rattus norvegicus
ctgaggtctcccaaggatggtcctt

SEQ ID NO: 270630 - DNA, 25 bp, Rattus norvegicus
ctgaggtctccctaggatggtcctt

SEQ ID NO: 270631 - DNA, 25 bp, Rattus norvegicus
ctgaggtctgacctctgtaaagtac

SEQ ID NO: 270632 - DNA, 25 bp, Rattus norvegicus
ctgaggtctgacgtctgtaaagtac

SEQ ID NO: 270633 - DNA, 25 bp, Rattus norvegicus
ctgaggtcttcacaggcggagcaaa

SEQ ID NO: 270634 - DNA, 25 bp, Rattus norvegicus
ctgaggtcttcagaggcggagcaaa

SEQ ID NO: 270635 - DNA, 25 bp, Rattus norvegicus
ctgaggtctttaaaatcgagttatt

SEQ ID NO: 270636 - DNA, 25 bp, Rattus norvegicus
ctgaggtctttataatcgagttatt

SEQ ID NO: 270637 - DNA, 25 bp, Rattus norvegicus
ctgaggtgcagtacgtgcgcgatct

SEQ ID NO: 270638 - DNA, 25 bp, Rattus norvegicus
ctgaggtgcagttcgtgcgcgatct

SEQ ID NO: 270639 - DNA, 25 bp, Rattus norvegicus
ctgaggtgcttcaggttgtgacaac

SEQ ID NO: 270640 - DNA, 25 bp, Rattus norvegicus
ctgaggtgcttctggttgtgacaac

SEQ ID NO: 270641 - DNA, 25 bp, Rattus norvegicus
ctgaggtggcctatttattcttgct

SEQ ID NO: 270642 - DNA, 25 bp, Rattus norvegicus
ctgaggtggcctttttattcttgct

SEQ ID NO: 270643 - DNA, 25 bp, Rattus norvegicus
ctgaggtgtgtcagcagtgcccagt

SEQ ID NO: 270644 - DNA, 25 bp, Rattus norvegicus
ctgaggtgtgtctgcagtgcccagt

SEQ ID NO: 270645 - DNA, 25 bp, Rattus norvegicus
ctgaggttaaggatttcgacggcat

SEQ ID NO: 270646 - DNA, 25 bp, Rattus norvegicus
ctgaggttaaggcttttctaaatgg

SEQ ID NO: 270647 - DNA, 25 bp, Rattus norvegicus
ctgaggttaagggttttctaaatgg

SEQ ID NO: 270648 - DNA, 25 bp, Rattus norvegicus
ctgaggttaaggttttcgacggcat

SEQ ID NO: 270649 - DNA, 25 bp, Rattus norvegicus
ctgaggttagaccagagacttcctt

SEQ ID NO: 270650 - DNA, 25 bp, Rattus norvegicus
ctgaggttagacgagagacttcctt

SEQ ID NO: 270651 - DNA, 25 bp, Rattus norvegicus
ctgaggttcatcaggaggactgtaa

SEQ ID NO: 270652 - DNA, 25 bp, Rattus norvegicus
ctgaggttcatctggaggactgtaa

SEQ ID NO: 270653 - DNA, 25 bp, Rattus norvegicus
ctgaggttctctatttcttggtgct

SEQ ID NO: 270654 - DNA, 25 bp, Rattus norvegicus
ctgaggttctctttttcttggtgct

SEQ ID NO: 270655 - DNA, 25 bp, Rattus norvegicus
ctgaggttgagtctatcaagtaatc

SEQ ID NO: 270656 - DNA, 25 bp, Rattus norvegicus
ctgaggttgagtgtatcaagtaatc

SEQ ID NO: 270657 - DNA, 25 bp, Rattus norvegicus
ctgaggttgatcagttccagctaca

SEQ ID NO: 270658 - DNA, 25 bp, Rattus norvegicus
ctgaggttgatctgttccagctaca

SEQ ID NO: 270659 - DNA, 25 bp, Rattus norvegicus
ctgaggtttctgaaccacaagcaaa

SEQ ID NO: 270660 - DNA, 25 bp, Rattus norvegicus
ctgaggtttctgtaccacaagcaaa

SEQ ID NO: 270661 - DNA, 25 bp, Rattus norvegicus
ctgaggttttgtatatgcatgtgga

SEQ ID NO: 270662 - DNA, 25 bp, Rattus norvegicus
ctgaggttttgtttatgcatgtgga

SEQ ID NO: 270663 - DNA, 25 bp, Rattus norvegicus
ctgagtaggtttatctctttctgct

SEQ ID NO: 270664 - DNA, 25 bp, Rattus norvegicus
ctgagtaggtttttctctttctgct

SEQ ID NO: 270665 - DNA, 25 bp, Rattus norvegicus
ctgagtatgctgagtggagccccac

SEQ ID NO: 270666 - DNA, 25 bp, Rattus norvegicus
ctgagtatgctgtgtggagccccac

SEQ ID NO: 270667 - DNA, 25 bp, Rattus norvegicus
ctgagtatgtgtcagatcccctgaa

SEQ ID NO: 270668 - DNA, 25 bp, Rattus norvegicus
ctgagtatgtgtgagatcccctgaa

SEQ ID NO: 270669 - DNA, 25 bp, Rattus norvegicus
ctgagtcacaggcacccagtggcaa

SEQ ID NO: 270670 - DNA, 25 bp, Rattus norvegicus
ctgagtcacagggacccagtggcaa

SEQ ID NO: 270671 - DNA, 25 bp, Rattus norvegicus
ctgagtcatgtacccttgtccaagc

SEQ ID NO: 270672 - DNA, 25 bp, Rattus norvegicus
ctgagtcatgtagccttgtccaagc

SEQ ID NO: 270673 - DNA, 25 bp, Rattus norvegicus
ctgagtccaagacccaatgagagtt

SEQ ID NO: 270674 - DNA, 25 bp, Rattus norvegicus
ctgagtccaagagccaatgagagtt

SEQ ID NO: 270675 - DNA, 25 bp, Rattus norvegicus
ctgagtccacctcactgaggagtta

SEQ ID NO: 270676 - DNA, 25 bp, Rattus norvegicus
ctgagtccacctgactgaggagtta

SEQ ID NO: 270677 - DNA, 25 bp, Rattus norvegicus
ctgagtccactacactagcaggaaa

SEQ ID NO: 270678 - DNA, 25 bp, Rattus norvegicus
ctgagtccactagactagcaggaaa

SEQ ID NO: 270679 - DNA, 25 bp, Rattus norvegicus
ctgagtccacttcccggaactttga

SEQ ID NO: 270680 - DNA, 25 bp, Rattus norvegicus
ctgagtccacttgccggaactttga

SEQ ID NO: 270681 - DNA, 25 bp, Rattus norvegicus
ctgagtcccaccaatagctggaaag

SEQ ID NO: 270682 - DNA, 25 bp, Rattus norvegicus
ctgagtcccacctatagctggaaag

SEQ ID NO: 270683 - DNA, 25 bp, Rattus norvegicus
ctgagtcccaggcatgttatagcca

SEQ ID NO: 270684 - DNA, 25 bp, Rattus norvegicus
ctgagtcccagggatgttatagcca

SEQ ID NO: 270685 - DNA, 25 bp, Rattus norvegicus
ctgagtccccgacagaatgcaagga

SEQ ID NO: 270686 - DNA, 25 bp, Rattus norvegicus
ctgagtccccgagagaatgcaagga

SEQ ID NO: 270687 - DNA, 25 bp, Rattus norvegicus
ctgagtccccgcagctgtccaagag

SEQ ID NO: 270688 - DNA, 25 bp, Rattus norvegicus
ctgagtccccgctgctgtccaagag

SEQ ID NO: 270689 - DNA, 25 bp, Rattus norvegicus
ctgagtccgagacgagcgcgaccca

SEQ ID NO: 270690 - DNA, 25 bp, Rattus norvegicus
ctgagtccgagaggagcgcgaccca

SEQ ID NO: 270691 - DNA, 25 bp, Rattus norvegicus
ctgagtccgatcagaaagttgtttc

SEQ ID NO: 270692 - DNA, 25 bp, Rattus norvegicus
ctgagtccgatctgaaagttgtttc

SEQ ID NO: 270693 - DNA, 25 bp, Rattus norvegicus
ctgagtccgtgtaagatcccatggc

SEQ ID NO: 270694 - DNA, 25 bp, Rattus norvegicus
ctgagtccgtgttagatcccatggc

SEQ ID NO: 270695 - DNA, 25 bp, Rattus norvegicus
ctgagtcctggcaggctgatttatc

SEQ ID NO: 270696 - DNA, 25 bp, Rattus norvegicus
ctgagtcctggctggctgatttatc

SEQ ID NO: 270697 - DNA, 25 bp, Rattus norvegicus
ctgagtcctgggatcagaggtacat

SEQ ID NO: 270698 - DNA, 25 bp, Rattus norvegicus
ctgagtcctgggttcagaggtacat

SEQ ID NO: 270699 - DNA, 25 bp, Rattus norvegicus
ctgagtcctttgagctgtcctgtaa

SEQ ID NO: 270700 - DNA, 25 bp, Rattus norvegicus
ctgagtcctttgtgctgtcctgtaa

SEQ ID NO: 270701 - DNA, 25 bp, Rattus norvegicus
ctgagtctcacgaagccgagtttaa

SEQ ID NO: 270702 - DNA, 25 bp, Rattus norvegicus
ctgagtctcacgtagccgagtttaa

SEQ ID NO: 270703 - DNA, 25 bp, Rattus norvegicus
ctgagtctcagtatcctttactata

SEQ ID NO: 270704 - DNA, 25 bp, Rattus norvegicus
ctgagtctcagtttcctttactata

SEQ ID NO: 270705 - DNA, 25 bp, Rattus norvegicus
ctgagtctcggcagtggaaagcttt

SEQ ID NO: 270706 - DNA, 25 bp, Rattus norvegicus
ctgagtctcggctgtggaaagcttt

SEQ ID NO: 270707 - DNA, 25 bp, Rattus norvegicus
ctgagtctggtaagccattttttaa

SEQ ID NO: 270708 - DNA, 25 bp, Rattus norvegicus
ctgagtctggtatgccattttttaa

SEQ ID NO: 270709 - DNA, 25 bp, Rattus norvegicus
ctgagtcttactcggcaagtgctta

SEQ ID NO: 270710 - DNA, 25 bp, Rattus norvegicus
ctgagtcttactgggcaagtgctta

SEQ ID NO: 270711 - DNA, 25 bp, Rattus norvegicus
ctgagtctttgactttgaggctctt

SEQ ID NO: 270712 - DNA, 25 bp, Rattus norvegicus
ctgagtctttgagtttgaggctctt

SEQ ID NO: 270713 - DNA, 25 bp, Rattus norvegicus
ctgagtgaaataataccctgcctgt

SEQ ID NO: 270714 - DNA, 25 bp, Rattus norvegicus
ctgagtgaaatattaccctgcctgt

SEQ ID NO: 270715 - DNA, 25 bp, Rattus norvegicus
ctgagtgaccctagtacccatagaa

SEQ ID NO: 270716 - DNA, 25 bp, Rattus norvegicus
ctgagtgacccttgtacccatagaa

SEQ ID NO: 270717 - DNA, 25 bp, Rattus norvegicus
ctgagtgagcacaccctgaaactga

SEQ ID NO: 270718 - DNA, 25 bp, Rattus norvegicus
ctgagtgagcactccctgaaactga

SEQ ID NO: 270719 - DNA, 25 bp, Rattus norvegicus
ctgagtgagcgaccagccacgagtc

SEQ ID NO: 270720 - DNA, 25 bp, Rattus norvegicus
ctgagtgagcgagcagccacgagtc

SEQ ID NO: 270721 - DNA, 25 bp, Rattus norvegicus
ctgagtgaggagacacccgccggtc

SEQ ID NO: 270722 - DNA, 25 bp, Rattus norvegicus
ctgagtgaggagtcacccgccggtc

SEQ ID NO: 270723 - DNA, 25 bp, Rattus norvegicus
ctgagtgcagcgacggactggacct

SEQ ID NO: 270724 - DNA, 25 bp, Rattus norvegicus
ctgagtgcagcgtcggactggacct

SEQ ID NO: 270725 - DNA, 25 bp, Rattus norvegicus
ctgagtgccagtcatctgcgcaaac

SEQ ID NO: 270726 - DNA, 25 bp, Rattus norvegicus
ctgagtgccagtgatctgcgcaaac

SEQ ID NO: 270727 - DNA, 25 bp, Rattus norvegicus
ctgagtgcccgtatctttggtgaag

SEQ ID NO: 270728 - DNA, 25 bp, Rattus norvegicus
ctgagtgcccgtttctttggtgaag

SEQ ID NO: 270729 - DNA, 25 bp, Rattus norvegicus
ctgagtgccctaagcgtttcatgag

SEQ ID NO: 270730 - DNA, 25 bp, Rattus norvegicus
ctgagtgccctatgcgtttcatgag

SEQ ID NO: 270731 - DNA, 25 bp, Rattus norvegicus
ctgagtgctctgacacagaccttga

SEQ ID NO: 270732 - DNA, 25 bp, Rattus norvegicus
ctgagtgctctgtcacagaccttga

SEQ ID NO: 270733 - DNA, 25 bp, Rattus norvegicus
ctgagtgctgctcaggtgaccaaag

SEQ ID NO: 270734 - DNA, 25 bp, Rattus norvegicus
ctgagtgctgctgaggtgaccaaag

SEQ ID NO: 270735 - DNA, 25 bp, Rattus norvegicus
ctgagtgctggaatgaaggtggtct

SEQ ID NO: 270736 - DNA, 25 bp, Rattus norvegicus
ctgagtgctggattgaaggtggtct

SEQ ID NO: 270737 - DNA, 25 bp, Rattus norvegicus
ctgagtgctgggattctttgcagat

SEQ ID NO: 270738 - DNA, 25 bp, Rattus norvegicus
ctgagtgctgggtttctttgcagat

SEQ ID NO: 270739 - DNA, 25 bp, Rattus norvegicus
ctgagtgcttcaccgccttcgggaa

SEQ ID NO: 270740 - DNA, 25 bp, Rattus norvegicus
ctgagtgcttcagcgccttcgggaa

SEQ ID NO: 270741 - DNA, 25 bp, Rattus norvegicus
ctgagtggcacgaagcagaccgtta

SEQ ID NO: 270742 - DNA, 25 bp, Rattus norvegicus
ctgagtggcacgtagcagaccgtta

SEQ ID NO: 270743 - DNA, 25 bp, Rattus norvegicus
ctgagtgggttgcagccaccactga

SEQ ID NO: 270744 - DNA, 25 bp, Rattus norvegicus
ctgagtgggttggagccaccactga

SEQ ID NO: 270745 - DNA, 25 bp, Rattus norvegicus
ctgagtggtccgagtttccattgat

SEQ ID NO: 270746 - DNA, 25 bp, Rattus norvegicus
ctgagtggtccgtgtttccattgat

SEQ ID NO: 270747 - DNA, 25 bp, Rattus norvegicus
ctgagtgtctgcatctttagtcttg

SEQ ID NO: 270748 - DNA, 25 bp, Rattus norvegicus
ctgagtgtctgcttctttagtcttg

SEQ ID NO: 270749 - DNA, 25 bp, Rattus norvegicus
ctgagtgtgacaccggatctctgct

SEQ ID NO: 270750 - DNA, 25 bp, Rattus norvegicus
ctgagtgtgacagcggatctctgct

SEQ ID NO: 270751 - DNA, 25 bp, Rattus norvegicus
ctgagtgtgcttcatttggacctgc

SEQ ID NO: 270752 - DNA, 25 bp, Rattus norvegicus
ctgagtgtgcttgatttggacctgc

SEQ ID NO: 270753 - DNA, 25 bp, Rattus norvegicus
ctgagtgtggtgacgaatgccttta

SEQ ID NO: 270754 - DNA, 25 bp, Rattus norvegicus
ctgagtgtggtgtcgaatgccttta

SEQ ID NO: 270755 - DNA, 25 bp, Rattus norvegicus
ctgagtgtttttcccttcacctaat

SEQ ID NO: 270756 - DNA, 25 bp, Rattus norvegicus
ctgagtgtttttgccttcacctaat

SEQ ID NO: 270757 - DNA, 25 bp, Rattus norvegicus
ctgagttacagccagaagccttaat

SEQ ID NO: 270758 - DNA, 25 bp, Rattus norvegicus
ctgagttacagcgagaagccttaat

SEQ ID NO: 270759 - DNA, 25 bp, Rattus norvegicus
ctgagttcagggaggcctccagtgt

SEQ ID NO: 270760 - DNA, 25 bp, Rattus norvegicus
ctgagttcagggtggcctccagtgt

SEQ ID NO: 270761 - DNA, 25 bp, Rattus norvegicus
ctgagttcagttcccctggatatgt

SEQ ID NO: 270762 - DNA, 25 bp, Rattus norvegicus
ctgagttcagttgccctggatatgt

SEQ ID NO: 270763 - DNA, 25 bp, Rattus norvegicus
ctgagttcccaaccataggatttaa

SEQ ID NO: 270764 - DNA, 25 bp, Rattus norvegicus
ctgagttcccaacccaagcaagaga

SEQ ID NO: 270765 - DNA, 25 bp, Rattus norvegicus
ctgagttcccaagcataggatttaa

SEQ ID NO: 270766 - DNA, 25 bp, Rattus norvegicus
ctgagttcccaagccaagcaagaga

SEQ ID NO: 270767 - DNA, 25 bp, Rattus norvegicus
ctgagttcctttaaggagaacagca

SEQ ID NO: 270768 - DNA, 25 bp, Rattus norvegicus
ctgagttccttttaggagaacagca

SEQ ID NO: 270769 - DNA, 25 bp, Rattus norvegicus
ctgagttctagacgccccaacacgt

SEQ ID NO: 270770 - DNA, 25 bp, Rattus norvegicus
ctgagttctagaggccccaacacgt

SEQ ID NO: 270771 - DNA, 25 bp, Rattus norvegicus
ctgagttctccacattcctgtggaa

SEQ ID NO: 270772 - DNA, 25 bp, Rattus norvegicus
ctgagttctccagattcctgtggaa

SEQ ID NO: 270773 - DNA, 25 bp, Rattus norvegicus
ctgagttgggccaaggtgtatccta

SEQ ID NO: 270774 - DNA, 25 bp, Rattus norvegicus
ctgagttgggcctaggtgtatccta

SEQ ID NO: 270775 - DNA, 25 bp, Rattus norvegicus
ctgagttggtgtcgctggccctact

SEQ ID NO: 270776 - DNA, 25 bp, Rattus norvegicus
ctgagttggtgtggctggccctact

SEQ ID NO: 270777 - DNA, 25 bp, Rattus norvegicus
ctgagttgttaacttatgcagacac

SEQ ID NO: 270778 - DNA, 25 bp, Rattus norvegicus
ctgagttgttaagttatgcagacac

SEQ ID NO: 270779 - DNA, 25 bp, Rattus norvegicus
ctgagtttcagtatggagagctaag

SEQ ID NO: 270780 - DNA, 25 bp, Rattus norvegicus
ctgagtttcagtttggagagctaag

SEQ ID NO: 270781 - DNA, 25 bp, Rattus norvegicus
ctgagtttcgatccctctgtgtgtc

SEQ ID NO: 270782 - DNA, 25 bp, Rattus norvegicus
ctgagtttcgatgcctctgtgtgtc

SEQ ID NO: 270783 - DNA, 25 bp, Rattus norvegicus
ctgagtttctaaccccagcactgtg

SEQ ID NO: 270784 - DNA, 25 bp, Rattus norvegicus
ctgagtttctaagcccagcactgtg

SEQ ID NO: 270785 - DNA, 25 bp, Rattus norvegicus
ctgagtttctcaccccagaaagagt

SEQ ID NO: 270786 - DNA, 25 bp, Rattus norvegicus
ctgagtttctcagcccagaaagagt

SEQ ID NO: 270787 - DNA, 25 bp, Rattus norvegicus
ctgagtttggttaggttctttgcct

SEQ ID NO: 270788 - DNA, 25 bp, Rattus norvegicus
ctgagtttggtttggttctttgcct

SEQ ID NO: 270789 - DNA, 25 bp, Rattus norvegicus
ctgagtttgtcaattcttggtctaa

SEQ ID NO: 270790 - DNA, 25 bp, Rattus norvegicus
ctgagtttgtcatttcttggtctaa

SEQ ID NO: 270791 - DNA, 25 bp, Rattus norvegicus
ctgagtttgtgtaaagcggcgtgtt

SEQ ID NO: 270792 - DNA, 25 bp, Rattus norvegicus
ctgagtttgtgttaagcggcgtgtt

SEQ ID NO: 270793 - DNA, 25 bp, Rattus norvegicus
ctgagttttcatctgtggatcgtgt

SEQ ID NO: 270794 - DNA, 25 bp, Rattus norvegicus
ctgagttttcatgtgtggatcgtgt

SEQ ID NO: 270795 - DNA, 25 bp, Rattus norvegicus
ctgagttttcctctaggccaatgaa

SEQ ID NO: 270796 - DNA, 25 bp, Rattus norvegicus
ctgagttttcctgtaggccaatgaa

SEQ ID NO: 270797 - DNA, 25 bp, Rattus norvegicus
ctgagttttgttctcctgcttggag

SEQ ID NO: 270798 - DNA, 25 bp, Rattus norvegicus
ctgagttttgttgtcctgcttggag

SEQ ID NO: 270799 - DNA, 25 bp, Rattus norvegicus
ctgataaaccctaggctgcctggag

SEQ ID NO: 270800 - DNA, 25 bp, Rattus norvegicus
ctgataaacccttggctgcctggag

SEQ ID NO: 270801 - DNA, 25 bp, Rattus norvegicus
ctgataaatctgaccaagccgtgag

SEQ ID NO: 270802 - DNA, 25 bp, Rattus norvegicus
ctgataaatctgtccaagccgtgag

SEQ ID NO: 270803 - DNA, 25 bp, Rattus norvegicus
ctgataagaaggctctccacgtggt

SEQ ID NO: 270804 - DNA, 25 bp, Rattus norvegicus
ctgataagaagggtctccacgtggt

SEQ ID NO: 270805 - DNA, 25 bp, Rattus norvegicus
ctgataataagcacgttgtcctctg

SEQ ID NO: 270806 - DNA, 25 bp, Rattus norvegicus
ctgataataagctcgttgtcctctg

SEQ ID NO: 270807 - DNA, 25 bp, Rattus norvegicus
ctgataatccccattcctgatagtt

SEQ ID NO: 270808 - DNA, 25 bp, Rattus norvegicus
ctgataatcccctttcctgatagtt

SEQ ID NO: 270809 - DNA, 25 bp, Rattus norvegicus
ctgataatccctaagtgtgttttct

SEQ ID NO: 270810 - DNA, 25 bp, Rattus norvegicus
ctgataatcccttagtgtgttttct

SEQ ID NO: 270811 - DNA, 25 bp, Rattus norvegicus
ctgataccggtaaagtgctttaagc

SEQ ID NO: 270812 - DNA, 25 bp, Rattus norvegicus
ctgataccggtatagtgctttaagc

SEQ ID NO: 270813 - DNA, 25 bp, Rattus norvegicus
ctgatacctatgaagagtgtgcaat

SEQ ID NO: 270814 - DNA, 25 bp, Rattus norvegicus
ctgatacctatgtagagtgtgcaat

SEQ ID NO: 270815 - DNA, 25 bp, Rattus norvegicus
ctgatactccatatcttcaccaaaa

SEQ ID NO: 270816 - DNA, 25 bp, Rattus norvegicus
ctgatactccatttcttcaccaaaa

SEQ ID NO: 270817 - DNA, 25 bp, Rattus norvegicus
ctgatactctccctgaacagagaat

SEQ ID NO: 270818 - DNA, 25 bp, Rattus norvegicus
ctgatactctccgtgaacagagaat

SEQ ID NO: 270819 - DNA, 25 bp, Rattus norvegicus
ctgatactgtgtctgggctgattta

SEQ ID NO: 270820 - DNA, 25 bp, Rattus norvegicus
ctgatactgtgtgtgggctgattta

SEQ ID NO: 270821 - DNA, 25 bp, Rattus norvegicus
ctgatacttgcaaagagaaattttc

SEQ ID NO: 270822 - DNA, 25 bp, Rattus norvegicus
ctgatacttgcatagagaaattttc

SEQ ID NO: 270823 - DNA, 25 bp, Rattus norvegicus
ctgataggcctgctcttctggatga

SEQ ID NO: 270824 - DNA, 25 bp, Rattus norvegicus
ctgataggcctggtcttctggatga

SEQ ID NO: 270825 - DNA, 25 bp, Rattus norvegicus
ctgatagtgtcaccctgtaatccca

SEQ ID NO: 270826 - DNA, 25 bp, Rattus norvegicus
ctgatagtgtcagcctgtaatccca

SEQ ID NO: 270827 - DNA, 25 bp, Rattus norvegicus
ctgatcaacagccacccgaaaacgg

SEQ ID NO: 270828 - DNA, 25 bp, Rattus norvegicus
ctgatcaacagcgacccgaaaacgg

SEQ ID NO: 270829 - DNA, 25 bp, Rattus norvegicus
ctgatcaccatgagctctgctctgt

SEQ ID NO: 270830 - DNA, 25 bp, Rattus norvegicus
ctgatcaccatgtgctctgctctgt

SEQ ID NO: 270831 - DNA, 25 bp, Rattus norvegicus
ctgatcacccacactctgattatat

SEQ ID NO: 270832 - DNA, 25 bp, Rattus norvegicus
ctgatcacccactctctgattatat

SEQ ID NO: 270833 - DNA, 25 bp, Rattus norvegicus
ctgatcatcaaacccctcaaggagc

SEQ ID NO: 270834 - DNA, 25 bp, Rattus norvegicus
ctgatcatcaaagccctcaaggagc

SEQ ID NO: 270835 - DNA, 25 bp, Rattus norvegicus
ctgatcatcaagaacgtgcgtctgg

SEQ ID NO: 270836 - DNA, 25 bp, Rattus norvegicus
ctgatcatcaagtacgtgcgtctgg

SEQ ID NO: 270837 - DNA, 25 bp, Rattus norvegicus
ctgatcatctcacgccaaccagagg

SEQ ID NO: 270838 - DNA, 25 bp, Rattus norvegicus
ctgatcatctcaggccaaccagagg

SEQ ID NO: 270839 - DNA, 25 bp, Rattus norvegicus
ctgatcatgtccagctagcacttga

SEQ ID NO: 270840 - DNA, 25 bp, Rattus norvegicus
ctgatcatgtcctgctagcacttga

SEQ ID NO: 270841 - DNA, 25 bp, Rattus norvegicus
ctgatccaattcatccatggtgcca

SEQ ID NO: 270842 - DNA, 25 bp, Rattus norvegicus
ctgatccaattcttccatggtgcca

SEQ ID NO: 270843 - DNA, 25 bp, Rattus norvegicus
ctgatccccaaaagccaacatagta

SEQ ID NO: 270844 - DNA, 25 bp, Rattus norvegicus
ctgatccccaaatgccaacatagta

SEQ ID NO: 270845 - DNA, 25 bp, Rattus norvegicus
ctgatccctgctatgtatcttatga

SEQ ID NO: 270846 - DNA, 25 bp, Rattus norvegicus
ctgatccctgctttgtatcttatga

SEQ ID NO: 270847 - DNA, 25 bp, Rattus norvegicus
ctgatccgaagaccccaggagaaca

SEQ ID NO: 270848 - DNA, 25 bp, Rattus norvegicus
ctgatccgaagagcccaggagaaca

SEQ ID NO: 270849 - DNA, 25 bp, Rattus norvegicus
ctgatccgctccaggaaaagttagc

SEQ ID NO: 270850 - DNA, 25 bp, Rattus norvegicus
ctgatccgctcctggaaaagttagc

SEQ ID NO: 270851 - DNA, 25 bp, Rattus norvegicus
ctgatcctacttactgctgttctca

SEQ ID NO: 270852 - DNA, 25 bp, Rattus norvegicus
ctgatcctactttctgctgttctca

SEQ ID NO: 270853 - DNA, 25 bp, Rattus norvegicus
ctgatcctcttgatgctttctagaa

SEQ ID NO: 270854 - DNA, 25 bp, Rattus norvegicus
ctgatcctcttgttgctttctagaa

SEQ ID NO: 270855 - DNA, 25 bp, Rattus norvegicus
ctgatcctgaccagagaggccagaa

SEQ ID NO: 270856 - DNA, 25 bp, Rattus norvegicus
ctgatcctgacctgagaggccagaa

SEQ ID NO: 270857 - DNA, 25 bp, Rattus norvegicus
ctgatcctgagcagcgctgaagact

SEQ ID NO: 270858 - DNA, 25 bp, Rattus norvegicus
ctgatcctgagctgcgctgaagact

SEQ ID NO: 270859 - DNA, 25 bp, Rattus norvegicus
ctgatcctgattcttgccgatagac

SEQ ID NO: 270860 - DNA, 25 bp, Rattus norvegicus
ctgatcctgattgttgccgatagac

SEQ ID NO: 270861 - DNA, 25 bp, Rattus norvegicus
ctgatcctgctcagggtacagtctc

SEQ ID NO: 270862 - DNA, 25 bp, Rattus norvegicus
ctgatcctgctctgggtacagtctc

SEQ ID NO: 270863 - DNA, 25 bp, Rattus norvegicus
ctgatcctgtgacctagtgagtcta

SEQ ID NO: 270864 - DNA, 25 bp, Rattus norvegicus
ctgatcctgtgagctagtgagtcta

SEQ ID NO: 270865 - DNA, 25 bp, Rattus norvegicus
ctgatcctttttccctgatgcagag

SEQ ID NO: 270866 - DNA, 25 bp, Rattus norvegicus
ctgatcctttttgcctgatgcagag

SEQ ID NO: 270867 - DNA, 25 bp, Rattus norvegicus
ctgatcgagtagactgccagtcacc

SEQ ID NO: 270868 - DNA, 25 bp, Rattus norvegicus
ctgatcgagtagtctgccagtcacc

SEQ ID NO: 270869 - DNA, 25 bp, Rattus norvegicus
ctgatcgctgccaattgtagtgttg

SEQ ID NO: 270870 - DNA, 25 bp, Rattus norvegicus
ctgatcgctgcctattgtagtgttg

SEQ ID NO: 270871 - DNA, 25 bp, Rattus norvegicus
ctgatcggcttaagacgtatgtgac

SEQ ID NO: 270872 - DNA, 25 bp, Rattus norvegicus
ctgatcggcttatgacgtatgtgac

SEQ ID NO: 270873 - DNA, 25 bp, Rattus norvegicus
ctgatcgtcaccattgagggactga

SEQ ID NO: 270874 - DNA, 25 bp, Rattus norvegicus
ctgatcgtcacctttgagggactga

SEQ ID NO: 270875 - DNA, 25 bp, Rattus norvegicus
ctgatcgtgtcactgggatactcaa

SEQ ID NO: 270876 - DNA, 25 bp, Rattus norvegicus
ctgatcgtgtcagtgggatactcaa

SEQ ID NO: 270877 - DNA, 25 bp, Rattus norvegicus
ctgatcgttgtgaagttttatgtaa

SEQ ID NO: 270878 - DNA, 25 bp, Rattus norvegicus
ctgatcgttgtgtagttttatgtaa

SEQ ID NO: 270879 - DNA, 25 bp, Rattus norvegicus
ctgatctaaagacccacctgagttg

SEQ ID NO: 270880 - DNA, 25 bp, Rattus norvegicus
ctgatctaaagagccacctgagttg

SEQ ID NO: 270881 - DNA, 25 bp, Rattus norvegicus
ctgatctacagactgagttctggga

SEQ ID NO: 270882 - DNA, 25 bp, Rattus norvegicus
ctgatctacagagtgagttctggga

SEQ ID NO: 270883 - DNA, 25 bp, Rattus norvegicus
ctgatctccacaaatgctccatggc

SEQ ID NO: 270884 - DNA, 25 bp, Rattus norvegicus
ctgatctccacatatgctccatggc

SEQ ID NO: 270885 - DNA, 25 bp, Rattus norvegicus
ctgatctccaggacctttcccattg

SEQ ID NO: 270886 - DNA, 25 bp, Rattus norvegicus
ctgatctccaggtcctttcccattg

SEQ ID NO: 270887 - DNA, 25 bp, Rattus norvegicus
ctgatctccagtcaagcatttatat

SEQ ID NO: 270888 - DNA, 25 bp, Rattus norvegicus
ctgatctccagtgaagcatttatat

SEQ ID NO: 270889 - DNA, 25 bp, Rattus norvegicus
ctgatctcctagctgcttttcaaaa

SEQ ID NO: 270890 - DNA, 25 bp, Rattus norvegicus
ctgatctcctaggtgcttttcaaaa

SEQ ID NO: 270891 - DNA, 25 bp, Rattus norvegicus
ctgatctcggaacctaagcagggtc

SEQ ID NO: 270892 - DNA, 25 bp, Rattus norvegicus
ctgatctcggaagctaagcagggtc

SEQ ID NO: 270893 - DNA, 25 bp, Rattus norvegicus
ctgatctctgctaatttaacataaa

SEQ ID NO: 270894 - DNA, 25 bp, Rattus norvegicus
ctgatctctgcttatttaacataaa

SEQ ID NO: 270895 - DNA, 25 bp, Rattus norvegicus
ctgatctctgtaatagacccactct

SEQ ID NO: 270896 - DNA, 25 bp, Rattus norvegicus
ctgatctctgtattagacccactct

SEQ ID NO: 270897 - DNA, 25 bp, Rattus norvegicus
ctgatctgagagaaccaagccttgg

SEQ ID NO: 270898 - DNA, 25 bp, Rattus norvegicus
ctgatctgagagtaccaagccttgg

SEQ ID NO: 270899 - DNA, 25 bp, Rattus norvegicus
ctgatctgcatgactgggtgtgtct

SEQ ID NO: 270900 - DNA, 25 bp, Rattus norvegicus
ctgatctgcatgtctgggtgtgtct

SEQ ID NO: 270901 - DNA, 25 bp, Rattus norvegicus
ctgatctgccacacatttgggtctc

SEQ ID NO: 270902 - DNA, 25 bp, Rattus norvegicus
ctgatctgccactcatttgggtctc

SEQ ID NO: 270903 - DNA, 25 bp, Rattus norvegicus
ctgatctggtggagtttgctgagct

SEQ ID NO: 270904 - DNA, 25 bp, Rattus norvegicus
ctgatctggtggtgtttgctgagct

SEQ ID NO: 270905 - DNA, 25 bp, Rattus norvegicus
ctgatctgtctacggcaagaggcaa

SEQ ID NO: 270906 - DNA, 25 bp, Rattus norvegicus
ctgatctgtctagggcaagaggcaa

SEQ ID NO: 270907 - DNA, 25 bp, Rattus norvegicus
ctgatcttcggtctgagctgagtca

SEQ ID NO: 270908 - DNA, 25 bp, Rattus norvegicus
ctgatcttcggtgtgagctgagtca

SEQ ID NO: 270909 - DNA, 25 bp, Rattus norvegicus
ctgatcttgatccatccaaagccac

SEQ ID NO: 270910 - DNA, 25 bp, Rattus norvegicus
ctgatcttgatcgatccaaagccac

SEQ ID NO: 270911 - DNA, 25 bp, Rattus norvegicus
ctgatcttgcaacaaaccagaaata

SEQ ID NO: 270912 - DNA, 25 bp, Rattus norvegicus
ctgatcttgcaagaaaccagaaata

SEQ ID NO: 270913 - DNA, 25 bp, Rattus norvegicus
ctgatctttgatcttctgcaatgaa

SEQ ID NO: 270914 - DNA, 25 bp, Rattus norvegicus
ctgatctttgatgttctgcaatgaa

SEQ ID NO: 270915 - DNA, 25 bp, Rattus norvegicus
ctgatgaacagaattctacaattgt

SEQ ID NO: 270916 - DNA, 25 bp, Rattus norvegicus
ctgatgaacagatttctacaattgt

SEQ ID NO: 270917 - DNA, 25 bp, Rattus norvegicus
ctgatgaatgtgagtccatcctgct

SEQ ID NO: 270918 - DNA, 25 bp, Rattus norvegicus
ctgatgaatgtgtgtccatcctgct

SEQ ID NO: 270919 - DNA, 25 bp, Rattus norvegicus
ctgatgacttacagtgatgcccacg

SEQ ID NO: 270920 - DNA, 25 bp, Rattus norvegicus
ctgatgacttactgtgatgcccacg

SEQ ID NO: 270921 - DNA, 25 bp, Rattus norvegicus
ctgatgagagaacaccatgtacact

SEQ ID NO: 270922 - DNA, 25 bp, Rattus norvegicus
ctgatgagagaagaccatgtacact

SEQ ID NO: 270923 - DNA, 25 bp, Rattus norvegicus
ctgatgagcagtcggccactaggca

SEQ ID NO: 270924 - DNA, 25 bp, Rattus norvegicus
ctgatgagcagtgggccactaggca

SEQ ID NO: 270925 - DNA, 25 bp, Rattus norvegicus
ctgatgatacttctctgctccacgg

SEQ ID NO: 270926 - DNA, 25 bp, Rattus norvegicus
ctgatgatacttgtctgctccacgg

SEQ ID NO: 270927 - DNA, 25 bp, Rattus norvegicus
ctgatgatagttagaacagccaaat

SEQ ID NO: 270928 - DNA, 25 bp, Rattus norvegicus
ctgatgatagtttgaacagccaaat

SEQ ID NO: 270929 - DNA, 25 bp, Rattus norvegicus
ctgatgatctctctctcttctgaaa

SEQ ID NO: 270930 - DNA, 25 bp, Rattus norvegicus
ctgatgatctctgtctcttctgaaa

SEQ ID NO: 270931 - DNA, 25 bp, Rattus norvegicus
ctgatgatgggcctcctggagagct

SEQ ID NO: 270932 - DNA, 25 bp, Rattus norvegicus
ctgatgatgggcgtcctggagagct

SEQ ID NO: 270933 - DNA, 25 bp, Rattus norvegicus
ctgatgatgttaaccttgcaagcat

SEQ ID NO: 270934 - DNA, 25 bp, Rattus norvegicus
ctgatgatgttatccttgcaagcat

SEQ ID NO: 270935 - DNA, 25 bp, Rattus norvegicus
ctgatgcaacatcgccgggtcttat

SEQ ID NO: 270936 - DNA, 25 bp, Rattus norvegicus
ctgatgcaacatggccgggtcttat

SEQ ID NO: 270937 - DNA, 25 bp, Rattus norvegicus
ctgatgcctccaccttctaagtgct

SEQ ID NO: 270938 - DNA, 25 bp, Rattus norvegicus
ctgatgcctccagcttctaagtgct

SEQ ID NO: 270939 - DNA, 25 bp, Rattus norvegicus
ctgatgcctgacctaaagcctgtgt

SEQ ID NO: 270940 - DNA, 25 bp, Rattus norvegicus
ctgatgcctgacgtaaagcctgtgt

SEQ ID NO: 270941 - DNA, 25 bp, Rattus norvegicus
ctgatgctgagaaggacgcggcctt

SEQ ID NO: 270942 - DNA, 25 bp, Rattus norvegicus
ctgatgctgagatggacgcggcctt

SEQ ID NO: 270943 - DNA, 25 bp, Rattus norvegicus
ctgatgctggtacactgcgcgagct

SEQ ID NO: 270944 - DNA, 25 bp, Rattus norvegicus
ctgatgctggtagactgcgcgagct

SEQ ID NO: 270945 - DNA, 25 bp, Rattus norvegicus
ctgatgctgttgactcgggccagaa

SEQ ID NO: 270946 - DNA, 25 bp, Rattus norvegicus
ctgatgctgttgtctcgggccagaa

SEQ ID NO: 270947 - DNA, 25 bp, Rattus norvegicus
ctgatgctgtttcttgtattgggaa

SEQ ID NO: 270948 - DNA, 25 bp, Rattus norvegicus
ctgatgctgtttgttgtattgggaa

SEQ ID NO: 270949 - DNA, 25 bp, Rattus norvegicus
ctgatgcttagaactgtgggcttct

SEQ ID NO: 270950 - DNA, 25 bp, Rattus norvegicus
ctgatgcttagatctgtgggcttct

SEQ ID NO: 270951 - DNA, 25 bp, Rattus norvegicus
ctgatgcttcacagttctgcaaggt

SEQ ID NO: 270952 - DNA, 25 bp, Rattus norvegicus
ctgatgcttcactgttctgcaaggt

SEQ ID NO: 270953 - DNA, 25 bp, Rattus norvegicus
ctgatgcttctcacaccatttagaa

SEQ ID NO: 270954 - DNA, 25 bp, Rattus norvegicus
ctgatgcttctctcaccatttagaa

SEQ ID NO: 270955 - DNA, 25 bp, Rattus norvegicus
ctgatggccattcaggacgaaggaa

SEQ ID NO: 270956 - DNA, 25 bp, Rattus norvegicus
ctgatggccattgaggacgaaggaa

SEQ ID NO: 270957 - DNA, 25 bp, Rattus norvegicus
ctgatggcggacactggttggaccc

SEQ ID NO: 270958 - DNA, 25 bp, Rattus norvegicus
ctgatggcggactctggttggaccc

SEQ ID NO: 270959 - DNA, 25 bp, Rattus norvegicus
ctgatgggactcagagatcttgctg

SEQ ID NO: 270960 - DNA, 25 bp, Rattus norvegicus
ctgatgggactctgagatcttgctg

SEQ ID NO: 270961 - DNA, 25 bp, Rattus norvegicus
ctgatgggcatccagctgctttggt

SEQ ID NO: 270962 - DNA, 25 bp, Rattus norvegicus
ctgatgggcatcgagctgctttggt

SEQ ID NO: 270963 - DNA, 25 bp, Rattus norvegicus
ctgatgggcggcattgggaaaacca

SEQ ID NO: 270964 - DNA, 25 bp, Rattus norvegicus
ctgatgggcggctttgggaaaacca

SEQ ID NO: 270965 - DNA, 25 bp, Rattus norvegicus
ctgatgggctgccaacatggactga

SEQ ID NO: 270966 - DNA, 25 bp, Rattus norvegicus
ctgatgggctgcgaacatggactga

SEQ ID NO: 270967 - DNA, 25 bp, Rattus norvegicus
ctgatgggtcctaacagtcactttt

SEQ ID NO: 270968 - DNA, 25 bp, Rattus norvegicus
ctgatgggtccttacagtcactttt

SEQ ID NO: 270969 - DNA, 25 bp, Rattus norvegicus
ctgatgggtgagaccaggcagctct

SEQ ID NO: 270970 - DNA, 25 bp, Rattus norvegicus
ctgatgggtgagtccaggcagctct

SEQ ID NO: 270971 - DNA, 25 bp, Rattus norvegicus
ctgatggtggtaatgcttctctgca

SEQ ID NO: 270972 - DNA, 25 bp, Rattus norvegicus
ctgatggtggtattgcttctctgca

SEQ ID NO: 270973 - DNA, 25 bp, Rattus norvegicus
ctgatggtggttaggctgcacactt

SEQ ID NO: 270974 - DNA, 25 bp, Rattus norvegicus
ctgatggtggtttggctgcacactt

SEQ ID NO: 270975 - DNA, 25 bp, Rattus norvegicus
ctgatggtgttcagtggctttcttt

SEQ ID NO: 270976 - DNA, 25 bp, Rattus norvegicus
ctgatggtgttctgtggctttcttt

SEQ ID NO: 270977 - DNA, 25 bp, Rattus norvegicus
ctgatggttttacgtgacccctgtg

SEQ ID NO: 270978 - DNA, 25 bp, Rattus norvegicus
ctgatggttttaggtgacccctgtg

SEQ ID NO: 270979 - DNA, 25 bp, Rattus norvegicus
ctgatgtaaaaactcttctagcctg

SEQ ID NO: 270980 - DNA, 25 bp, Rattus norvegicus
ctgatgtaaaaagtcttctagcctg

SEQ ID NO: 270981 - DNA, 25 bp, Rattus norvegicus
ctgatgtcccatcccagttaatgga

SEQ ID NO: 270982 - DNA, 25 bp, Rattus norvegicus
ctgatgtcccatgccagttaatgga

SEQ ID NO: 270983 - DNA, 25 bp, Rattus norvegicus
ctgatgtccctgatgttggcatgta

SEQ ID NO: 270984 - DNA, 25 bp, Rattus norvegicus
ctgatgtccctgttgttggcatgta

SEQ ID NO: 270985 - DNA, 25 bp, Rattus norvegicus
ctgatgtctacacagaggtccggga

SEQ ID NO: 270986 - DNA, 25 bp, Rattus norvegicus
ctgatgtctacagagaggtccggga

SEQ ID NO: 270987 - DNA, 25 bp, Rattus norvegicus
ctgatgtgaagtatttaatcccagc

SEQ ID NO: 270988 - DNA, 25 bp, Rattus norvegicus
ctgatgtgaagtttttaatcccagc

SEQ ID NO: 270989 - DNA, 25 bp, Rattus norvegicus
ctgatgtgacagaaccctctcaagg

SEQ ID NO: 270990 - DNA, 25 bp, Rattus norvegicus
ctgatgtgacagtaccctctcaagg

SEQ ID NO: 270991 - DNA, 25 bp, Rattus norvegicus
ctgatgtgacttcaattcgctttga

SEQ ID NO: 270992 - DNA, 25 bp, Rattus norvegicus
ctgatgtgacttgaattcgctttga

SEQ ID NO: 270993 - DNA, 25 bp, Rattus norvegicus
ctgatgtgatgcctcctcaagatag

SEQ ID NO: 270994 - DNA, 25 bp, Rattus norvegicus
ctgatgtgatgcgtcctcaagatag

SEQ ID NO: 270995 - DNA, 25 bp, Rattus norvegicus
ctgatgtgcgcaagagggaacagaa

SEQ ID NO: 270996 - DNA, 25 bp, Rattus norvegicus
ctgatgtgcgcatgagggaacagaa

SEQ ID NO: 270997 - DNA, 25 bp, Rattus norvegicus
ctgatgtggctgctggcaatgaaac

SEQ ID NO: 270998 - DNA, 25 bp, Rattus norvegicus
ctgatgtggctggtggcaatgaaac

SEQ ID NO: 270999 - DNA, 25 bp, Rattus norvegicus
ctgatgtgggacaggagcagacctt

SEQ ID NO: 271000 - DNA, 25 bp, Rattus norvegicus
ctgatgtgggactggagcagacctt

SEQ ID NO: 271001 - DNA, 25 bp, Rattus norvegicus
ctgatgtggtggcacagccctgtaa

SEQ ID NO: 271002 - DNA, 25 bp, Rattus norvegicus
ctgatgtggtgggacagccctgtaa

SEQ ID NO: 271003 - DNA, 25 bp, Rattus norvegicus
ctgatgtgtgagacttcatgttcct

SEQ ID NO: 271004 - DNA, 25 bp, Rattus norvegicus
ctgatgtgtgagtcttcatgttcct

SEQ ID NO: 271005 - DNA, 25 bp, Rattus norvegicus
ctgatgttacccaattatcgtctaa

SEQ ID NO: 271006 - DNA, 25 bp, Rattus norvegicus
ctgatgttaccctattatcgtctaa

SEQ ID NO: 271007 - DNA, 25 bp, Rattus norvegicus
ctgatgttataaattgcgacttgaa

SEQ ID NO: 271008 - DNA, 25 bp, Rattus norvegicus
ctgatgttataatttgcgacttgaa

SEQ ID NO: 271009 - DNA, 25 bp, Rattus norvegicus
ctgatgttcaggaccaggctgggta

SEQ ID NO: 271010 - DNA, 25 bp, Rattus norvegicus
ctgatgttcaggtccaggctgggta

SEQ ID NO: 271011 - DNA, 25 bp, Rattus norvegicus
ctgatgttcgatcccctggttgaaa

SEQ ID NO: 271012 - DNA, 25 bp, Rattus norvegicus
ctgatgttcgatgccctggttgaaa

SEQ ID NO: 271013 - DNA, 25 bp, Rattus norvegicus
ctgatgtttaagctttccttgtaat

SEQ ID NO: 271014 - DNA, 25 bp, Rattus norvegicus
ctgatgtttaaggtttccttgtaat

SEQ ID NO: 271015 - DNA, 25 bp, Rattus norvegicus
ctgatgtttgtcactcctttgaaaa

SEQ ID NO: 271016 - DNA, 25 bp, Rattus norvegicus
ctgatgtttgtctctcctttgaaaa

SEQ ID NO: 271017 - DNA, 25 bp, Rattus norvegicus
ctgatgttttgaagccatttgtctt

SEQ ID NO: 271018 - DNA, 25 bp, Rattus norvegicus
ctgatgttttgatgccatttgtctt

SEQ ID NO: 271019 - DNA, 25 bp, Rattus norvegicus
ctgattaagtctaggagctccgcat

SEQ ID NO: 271020 - DNA, 25 bp, Rattus norvegicus
ctgattaagtcttggagctccgcat

SEQ ID NO: 271021 - DNA, 25 bp, Rattus norvegicus
ctgattaatacaccccttcaaaatg

SEQ ID NO: 271022 - DNA, 25 bp, Rattus norvegicus
ctgattaatacagcccttcaaaatg

SEQ ID NO: 271023 - DNA, 25 bp, Rattus norvegicus
ctgattactgccctgttgttttaag

SEQ ID NO: 271024 - DNA, 25 bp, Rattus norvegicus
ctgattactgccgtgttgttttaag

SEQ ID NO: 271025 - DNA, 25 bp, Rattus norvegicus
ctgattagaaaaccctccctgagtc

SEQ ID NO: 271026 - DNA, 25 bp, Rattus norvegicus
ctgattagaaaagcctccctgagtc

SEQ ID NO: 271027 - DNA, 25 bp, Rattus norvegicus
ctgattatgcggctgcacttgttgt

SEQ ID NO: 271028 - DNA, 25 bp, Rattus norvegicus
ctgattatgcgggtgcacttgttgt

SEQ ID NO: 271029 - DNA, 25 bp, Rattus norvegicus
ctgattattcggctgctggttggtc

SEQ ID NO: 271030 - DNA, 25 bp, Rattus norvegicus
ctgattattcgggtgctggttggtc

SEQ ID NO: 271031 - DNA, 25 bp, Rattus norvegicus
ctgattcagagcacaaatcccaggt

SEQ ID NO: 271032 - DNA, 25 bp, Rattus norvegicus
ctgattcagagctcaaatcccaggt

SEQ ID NO: 271033 - DNA, 25 bp, Rattus norvegicus
ctgattcagcaacgccctggcaagt

SEQ ID NO: 271034 - DNA, 25 bp, Rattus norvegicus
ctgattcagcaaggccctggcaagt

SEQ ID NO: 271035 - DNA, 25 bp, Rattus norvegicus
ctgattcccactactaatttctttt

SEQ ID NO: 271036 - DNA, 25 bp, Rattus norvegicus
ctgattcccacttctaatttctttt

SEQ ID NO: 271037 - DNA, 25 bp, Rattus norvegicus
ctgattccctccagagtgcactttt

SEQ ID NO: 271038 - DNA, 25 bp, Rattus norvegicus
ctgattccctcctgagtgcactttt

SEQ ID NO: 271039 - DNA, 25 bp, Rattus norvegicus
ctgattcctgaaaggtctcactacc

SEQ ID NO: 271040 - DNA, 25 bp, Rattus norvegicus
ctgattcctgaatggtctcactacc

SEQ ID NO: 271041 - DNA, 25 bp, Rattus norvegicus
ctgattcggataagctactaagggt

SEQ ID NO: 271042 - DNA, 25 bp, Rattus norvegicus
ctgattcggatatgctactaagggt

SEQ ID NO: 271043 - DNA, 25 bp, Rattus norvegicus
ctgattcggattaccattgtgtgtt

SEQ ID NO: 271044 - DNA, 25 bp, Rattus norvegicus
ctgattcggatttccattgtgtgtt

SEQ ID NO: 271045 - DNA, 25 bp, Rattus norvegicus
ctgattcggctcaccttaggtgata

SEQ ID NO: 271046 - DNA, 25 bp, Rattus norvegicus
ctgattcggctctccttaggtgata

SEQ ID NO: 271047 - DNA, 25 bp, Rattus norvegicus
ctgattctcctgatttaaaccgaat

SEQ ID NO: 271048 - DNA, 25 bp, Rattus norvegicus
ctgattctcctgttttaaaccgaat

SEQ ID NO: 271049 - DNA, 25 bp, Rattus norvegicus
ctgattctccttctgttaagtcgaa

SEQ ID NO: 271050 - DNA, 25 bp, Rattus norvegicus
ctgattctccttgtgttaagtcgaa

SEQ ID NO: 271051 - DNA, 25 bp, Rattus norvegicus
ctgattctgctcattgatctctgaa

SEQ ID NO: 271052 - DNA, 25 bp, Rattus norvegicus
ctgattctgctctttgatctctgaa

SEQ ID NO: 271053 - DNA, 25 bp, Rattus norvegicus
ctgattctggaaccaacgttctttc

SEQ ID NO: 271054 - DNA, 25 bp, Rattus norvegicus
ctgattctggaagcaacgttctttc

SEQ ID NO: 271055 - DNA, 25 bp, Rattus norvegicus
ctgattcttgaactttcccactcat

SEQ ID NO: 271056 - DNA, 25 bp, Rattus norvegicus
ctgattcttgaagtttcccactcat

SEQ ID NO: 271057 - DNA, 25 bp, Rattus norvegicus
ctgattcttgggatcctgctttgaa

SEQ ID NO: 271058 - DNA, 25 bp, Rattus norvegicus
ctgattcttgggttcctgctttgaa

SEQ ID NO: 271059 - DNA, 25 bp, Rattus norvegicus
ctgattctttgtacatatctttaat

SEQ ID NO: 271060 - DNA, 25 bp, Rattus norvegicus
ctgattctttgttcatatctttaat

SEQ ID NO: 271061 - DNA, 25 bp, Rattus norvegicus
ctgattgacctgcaacttactatgt

SEQ ID NO: 271062 - DNA, 25 bp, Rattus norvegicus
ctgattgacctggaacttactatgt

SEQ ID NO: 271063 - DNA, 25 bp, Rattus norvegicus
ctgattgcaccaaattgttctctca

SEQ ID NO: 271064 - DNA, 25 bp, Rattus norvegicus
ctgattgcaccatattgttctctca

SEQ ID NO: 271065 - DNA, 25 bp, Rattus norvegicus
ctgattgccaatccggataacttcc

SEQ ID NO: 271066 - DNA, 25 bp, Rattus norvegicus
ctgattgccaatgcggataacttcc

SEQ ID NO: 271067 - DNA, 25 bp, Rattus norvegicus
ctgattgcttttcttgtctgatgga

SEQ ID NO: 271068 - DNA, 25 bp, Rattus norvegicus
ctgattgcttttgttgtctgatgga

SEQ ID NO: 271069 - DNA, 25 bp, Rattus norvegicus
ctgattggccggattctcgaatggg

SEQ ID NO: 271070 - DNA, 25 bp, Rattus norvegicus
ctgattggccggtttctcgaatggg

SEQ ID NO: 271071 - DNA, 25 bp, Rattus norvegicus
ctgattggggctactctctgagttt

SEQ ID NO: 271072 - DNA, 25 bp, Rattus norvegicus
ctgattggggcttctctctgagttt

SEQ ID NO: 271073 - DNA, 25 bp, Rattus norvegicus
ctgattgtgctgatctctgtctgct

SEQ ID NO: 271074 - DNA, 25 bp, Rattus norvegicus
ctgattgtgctgttctctgtctgct

SEQ ID NO: 271075 - DNA, 25 bp, Rattus norvegicus
ctgatttaactaagtcattggtgcc

SEQ ID NO: 271076 - DNA, 25 bp, Rattus norvegicus
ctgatttaactatgtcattggtgcc

SEQ ID NO: 271077 - DNA, 25 bp, Rattus norvegicus
ctgatttactgcacttctttgggaa

SEQ ID NO: 271078 - DNA, 25 bp, Rattus norvegicus
ctgatttactgctcttctttgggaa

SEQ ID NO: 271079 - DNA, 25 bp, Rattus norvegicus
ctgatttagccccttaccttgacaa

SEQ ID NO: 271080 - DNA, 25 bp, Rattus norvegicus
ctgatttagcccgttaccttgacaa

SEQ ID NO: 271081 - DNA, 25 bp, Rattus norvegicus
ctgatttagtagctctgttccaaga

SEQ ID NO: 271082 - DNA, 25 bp, Rattus norvegicus
ctgatttagtaggtctgttccaaga

SEQ ID NO: 271083 - DNA, 25 bp, Rattus norvegicus
ctgatttatcctccccggattacaa

SEQ ID NO: 271084 - DNA, 25 bp, Rattus norvegicus
ctgatttatcctgcccggattacaa

SEQ ID NO: 271085 - DNA, 25 bp, Rattus norvegicus
ctgatttatctcagctgttctggtc

SEQ ID NO: 271086 - DNA, 25 bp, Rattus norvegicus
ctgatttatctctgctgttctggtc

SEQ ID NO: 271087 - DNA, 25 bp, Rattus norvegicus
ctgatttcacctactcgttggatat

SEQ ID NO: 271088 - DNA, 25 bp, Rattus norvegicus
ctgatttcaccttctcgttggatat

SEQ ID NO: 271089 - DNA, 25 bp, Rattus norvegicus
ctgatttcagcgctgtctttcatat

SEQ ID NO: 271090 - DNA, 25 bp, Rattus norvegicus
ctgatttcagcggtgtctttcatat

SEQ ID NO: 271091 - DNA, 25 bp, Rattus norvegicus
ctgatttcatcacggagaacgtctc

SEQ ID NO: 271092 - DNA, 25 bp, Rattus norvegicus
ctgatttcatcagggagaacgtctc

SEQ ID NO: 271093 - DNA, 25 bp, Rattus norvegicus
ctgatttctatcactagtctacaga

SEQ ID NO: 271094 - DNA, 25 bp, Rattus norvegicus
ctgatttctatctctagtctacaga

SEQ ID NO: 271095 - DNA, 25 bp, Rattus norvegicus
ctgatttctttgacactcgtgatta

SEQ ID NO: 271096 - DNA, 25 bp, Rattus norvegicus
ctgatttctttgtcactcgtgatta

SEQ ID NO: 271097 - DNA, 25 bp, Rattus norvegicus
ctgatttggcaaatctggctatata

SEQ ID NO: 271098 - DNA, 25 bp, Rattus norvegicus
ctgatttggcaattctggctatata

SEQ ID NO: 271099 - DNA, 25 bp, Rattus norvegicus
ctgattttagcccagcgagagagcc

SEQ ID NO: 271100 - DNA, 25 bp, Rattus norvegicus
ctgattttagccgagcgagagagcc

SEQ ID NO: 271101 - DNA, 25 bp, Rattus norvegicus
ctgattttgtggacaccagacgtgt

SEQ ID NO: 271102 - DNA, 25 bp, Rattus norvegicus
ctgattttgtggtcaccagacgtgt

SEQ ID NO: 271103 - DNA, 25 bp, Rattus norvegicus
ctgcaaacatggagagtctgtcata

SEQ ID NO: 271104 - DNA, 25 bp, Rattus norvegicus
ctgcaaacatggtgagtctgtcata

SEQ ID NO: 271105 - DNA, 25 bp, Rattus norvegicus
ctgcaaacccatacccattaagatt

SEQ ID NO: 271106 - DNA, 25 bp, Rattus norvegicus
ctgcaaacccattcccattaagatt

SEQ ID NO: 271107 - DNA, 25 bp, Rattus norvegicus
ctgcaaacccgaacaagtagtctta

SEQ ID NO: 271108 - DNA, 25 bp, Rattus norvegicus
ctgcaaacccgatcaagtagtctta

SEQ ID NO: 271109 - DNA, 25 bp, Rattus norvegicus
ctgcaaaccctacatgaagccattt

SEQ ID NO: 271110 - DNA, 25 bp, Rattus norvegicus
ctgcaaaccctagatgaagccattt

SEQ ID NO: 271111 - DNA, 25 bp, Rattus norvegicus
ctgcaaacgccaaagttggctcttt

SEQ ID NO: 271112 - DNA, 25 bp, Rattus norvegicus
ctgcaaacgccatagttggctcttt

SEQ ID NO: 271113 - DNA, 25 bp, Rattus norvegicus
ctgcaaactcccaaggacaggcaaa

SEQ ID NO: 271114 - DNA, 25 bp, Rattus norvegicus
ctgcaaactccctaggacaggcaaa

SEQ ID NO: 271115 - DNA, 25 bp, Rattus norvegicus
ctgcaaatctttcgtcctaaacatt

SEQ ID NO: 271116 - DNA, 25 bp, Rattus norvegicus
ctgcaaatctttggtcctaaacatt

SEQ ID NO: 271117 - DNA, 25 bp, Rattus norvegicus
ctgcaaattcctaatccttcttcat

SEQ ID NO: 271118 - DNA, 25 bp, Rattus norvegicus
ctgcaaattcctagtcctgcaaatt

SEQ ID NO: 271119 - DNA, 25 bp, Rattus norvegicus
ctgcaaattccttatccttcttcat

SEQ ID NO: 271120 - DNA, 25 bp, Rattus norvegicus
ctgcaaattccttgtcctgcaaatt

SEQ ID NO: 271121 - DNA, 25 bp, Rattus norvegicus
ctgcaaattcgccttgtggtctggg

SEQ ID NO: 271122 - DNA, 25 bp, Rattus norvegicus
ctgcaaattcgcgttgtggtctggg

SEQ ID NO: 271123 - DNA, 25 bp, Rattus norvegicus
ctgcaaatttctccctgccagtaaa

SEQ ID NO: 271124 - DNA, 25 bp, Rattus norvegicus
ctgcaaatttctgcctgccagtaaa

SEQ ID NO: 271125 - DNA, 25 bp, Rattus norvegicus
ctgcaaccacctaaattaccaaaag

SEQ ID NO: 271126 - DNA, 25 bp, Rattus norvegicus
ctgcaaccaccttaattaccaaaag

SEQ ID NO: 271127 - DNA, 25 bp, Rattus norvegicus
ctgcaactcgtgctgtcctagtgaa

SEQ ID NO: 271128 - DNA, 25 bp, Rattus norvegicus
ctgcaactcgtggtgtcctagtgaa

SEQ ID NO: 271129 - DNA, 25 bp, Rattus norvegicus
ctgcaaggagtcaaaaccacgtcga

SEQ ID NO: 271130 - DNA, 25 bp, Rattus norvegicus
ctgcaaggagtctaaaccacgtcga

SEQ ID NO: 271131 - DNA, 25 bp, Rattus norvegicus
ctgcaaggtgtgctaggtatcgtat

SEQ ID NO: 271132 - DNA, 25 bp, Rattus norvegicus
ctgcaaggtgtggtaggtatcgtat

SEQ ID NO: 271133 - DNA, 25 bp, Rattus norvegicus
ctgcaagtaaaaccacatacacgat

SEQ ID NO: 271134 - DNA, 25 bp, Rattus norvegicus
ctgcaagtaaaagcacatacacgat

SEQ ID NO: 271135 - DNA, 25 bp, Rattus norvegicus
ctgcaagtgcttcggtcatgtatac

SEQ ID NO: 271136 - DNA, 25 bp, Rattus norvegicus
ctgcaagtgcttgggtcatgtatac

SEQ ID NO: 271137 - DNA, 25 bp, Rattus norvegicus
ctgcaataaaaaccctgtcctcaac

SEQ ID NO: 271138 - DNA, 25 bp, Rattus norvegicus
ctgcaataaaaagcctgtcctcaac

SEQ ID NO: 271139 - DNA, 25 bp, Rattus norvegicus
ctgcaatagcatactgttctacagg

SEQ ID NO: 271140 - DNA, 25 bp, Rattus norvegicus
ctgcaatagcattctgttctacagg

SEQ ID NO: 271141 - DNA, 25 bp, Rattus norvegicus
ctgcaatcctggcactttggaggtt

SEQ ID NO: 271142 - DNA, 25 bp, Rattus norvegicus
ctgcaatcctgggactttggaggtt

SEQ ID NO: 271143 - DNA, 25 bp, Rattus norvegicus
ctgcaatccttgctttggtgatgtt

SEQ ID NO: 271144 - DNA, 25 bp, Rattus norvegicus
ctgcaatccttggtttggtgatgtt

SEQ ID NO: 271145 - DNA, 25 bp, Rattus norvegicus
ctgcaatggccactactcagacctg

SEQ ID NO: 271146 - DNA, 25 bp, Rattus norvegicus
ctgcaatggccagtactcagacctg

SEQ ID NO: 271147 - DNA, 25 bp, Rattus norvegicus
ctgcaattacagacgctagccacca

SEQ ID NO: 271148 - DNA, 25 bp, Rattus norvegicus
ctgcaattacagtcgctagccacca

SEQ ID NO: 271149 - DNA, 25 bp, Rattus norvegicus
ctgcaattacttcctttgcaccaaa

SEQ ID NO: 271150 - DNA, 25 bp, Rattus norvegicus
ctgcaattacttgctttgcaccaaa

SEQ ID NO: 271151 - DNA, 25 bp, Rattus norvegicus
ctgcaatttagcatgttgggaagtc

SEQ ID NO: 271152 - DNA, 25 bp, Rattus norvegicus
ctgcaatttagcttgttgggaagtc

SEQ ID NO: 271153 - DNA, 25 bp, Rattus norvegicus
ctgcacaaagccatccttataggaa

SEQ ID NO: 271154 - DNA, 25 bp, Rattus norvegicus
ctgcacaaagccttccttataggaa

SEQ ID NO: 271155 - DNA, 25 bp, Rattus norvegicus
ctgcacaattttcggctagcgattt

SEQ ID NO: 271156 - DNA, 25 bp, Rattus norvegicus
ctgcacaattttgggctagcgattt

SEQ ID NO: 271157 - DNA, 25 bp, Rattus norvegicus
ctgcacacactcaacaatgtctttg

SEQ ID NO: 271158 - DNA, 25 bp, Rattus norvegicus
ctgcacacactctacaatgtctttg

SEQ ID NO: 271159 - DNA, 25 bp, Rattus norvegicus
ctgcacacccttcatctgagctggg

SEQ ID NO: 271160 - DNA, 25 bp, Rattus norvegicus
ctgcacacccttgatctgagctggg

SEQ ID NO: 271161 - DNA, 25 bp, Rattus norvegicus
ctgcacacggcgattttccgaataa

SEQ ID NO: 271162 - DNA, 25 bp, Rattus norvegicus
ctgcacacggcgtttttccgaataa

SEQ ID NO: 271163 - DNA, 25 bp, Rattus norvegicus
ctgcacactcacatacgtgcgcatg

SEQ ID NO: 271164 - DNA, 25 bp, Rattus norvegicus
ctgcacactcacttacgtgcgcatg

SEQ ID NO: 271165 - DNA, 25 bp, Rattus norvegicus
ctgcacagggtacctgttttcctac

SEQ ID NO: 271166 - DNA, 25 bp, Rattus norvegicus
ctgcacagggtagctgttttcctac

SEQ ID NO: 271167 - DNA, 25 bp, Rattus norvegicus
ctgcacagtcatctatttccatcaa

SEQ ID NO: 271168 - DNA, 25 bp, Rattus norvegicus
ctgcacagtcatgtatttccatcaa

SEQ ID NO: 271169 - DNA, 25 bp, Rattus norvegicus
ctgcacagtcgcaatggcctgaggg

SEQ ID NO: 271170 - DNA, 25 bp, Rattus norvegicus
ctgcacagtcgctatggcctgaggg

SEQ ID NO: 271171 - DNA, 25 bp, Rattus norvegicus
ctgcacagttcgcaaccttatgttg

SEQ ID NO: 271172 - DNA, 25 bp, Rattus norvegicus
ctgcacagttcggaaccttatgttg

SEQ ID NO: 271173 - DNA, 25 bp, Rattus norvegicus
ctgcacatatatcttacccagacat

SEQ ID NO: 271174 - DNA, 25 bp, Rattus norvegicus
ctgcacatatatgttacccagacat

SEQ ID NO: 271175 - DNA, 25 bp, Rattus norvegicus
ctgcacatccatactttcttatcaa

SEQ ID NO: 271176 - DNA, 25 bp, Rattus norvegicus
ctgcacatccattctttcttatcaa

SEQ ID NO: 271177 - DNA, 25 bp, Rattus norvegicus
ctgcacatctcacgcgcaagaggaa

SEQ ID NO: 271178 - DNA, 25 bp, Rattus norvegicus
ctgcacatctcaggcgcaagaggaa

SEQ ID NO: 271179 - DNA, 25 bp, Rattus norvegicus
ctgcacattggtatttggctgttgt

SEQ ID NO: 271180 - DNA, 25 bp, Rattus norvegicus
ctgcacattggtttttggctgttgt

SEQ ID NO: 271181 - DNA, 25 bp, Rattus norvegicus
ctgcaccagtcaatgatgagcccat

SEQ ID NO: 271182 - DNA, 25 bp, Rattus norvegicus
ctgcaccagtcattgatgagcccat

SEQ ID NO: 271183 - DNA, 25 bp, Rattus norvegicus
ctgcacccaggacaatttgccatgg

SEQ ID NO: 271184 - DNA, 25 bp, Rattus norvegicus
ctgcacccaggagaatttgccatgg

SEQ ID NO: 271185 - DNA, 25 bp, Rattus norvegicus
ctgcaccccaagagacacgtggcat

SEQ ID NO: 271186 - DNA, 25 bp, Rattus norvegicus
ctgcaccccaagtgacacgtggcat

SEQ ID NO: 271187 - DNA, 25 bp, Rattus norvegicus
ctgcacccctgaagtggcatatgga

SEQ ID NO: 271188 - DNA, 25 bp, Rattus norvegicus
ctgcacccctgatgtggcatatgga

SEQ ID NO: 271189 - DNA, 25 bp, Rattus norvegicus
ctgcaccctgccagggcagcatgtg

SEQ ID NO: 271190 - DNA, 25 bp, Rattus norvegicus
ctgcaccctgcctgggcagcatgtg

SEQ ID NO: 271191 - DNA, 25 bp, Rattus norvegicus
ctgcaccgcggacctcatcgtggag

SEQ ID NO: 271192 - DNA, 25 bp, Rattus norvegicus
ctgcaccgcggagctcatcgtggag

SEQ ID NO: 271193 - DNA, 25 bp, Rattus norvegicus
ctgcaccgggttactgtggctgtat

SEQ ID NO: 271194 - DNA, 25 bp, Rattus norvegicus
ctgcaccgggtttctgtggctgtat

SEQ ID NO: 271195 - DNA, 25 bp, Rattus norvegicus
ctgcacctacgtcttctcaagaagg

SEQ ID NO: 271196 - DNA, 25 bp, Rattus norvegicus
ctgcacctacgtgttctcaagaagg

SEQ ID NO: 271197 - DNA, 25 bp, Rattus norvegicus
ctgcacctgagtcaggacaccaccc

SEQ ID NO: 271198 - DNA, 25 bp, Rattus norvegicus
ctgcacctgagtgaggacaccaccc

SEQ ID NO: 271199 - DNA, 25 bp, Rattus norvegicus
ctgcacctgcataagctgctacaaa

SEQ ID NO: 271200 - DNA, 25 bp, Rattus norvegicus
ctgcacctgcattagctgctacaaa

SEQ ID NO: 271201 - DNA, 25 bp, Rattus norvegicus
ctgcacctgtagagctgttatagtt

SEQ ID NO: 271202 - DNA, 25 bp, Rattus norvegicus
ctgcacctgtagtgctgttatagtt

SEQ ID NO: 271203 - DNA, 25 bp, Rattus norvegicus
ctgcacgatgtcctccttcctggag

SEQ ID NO: 271204 - DNA, 25 bp, Rattus norvegicus
ctgcacgatgtcgtccttcctggag

SEQ ID NO: 271205 - DNA, 25 bp, Rattus norvegicus
ctgcacgcaaacagacagccgagta

SEQ ID NO: 271206 - DNA, 25 bp, Rattus norvegicus
ctgcacgcaaactgacagccgagta

SEQ ID NO: 271207 - DNA, 25 bp, Rattus norvegicus
ctgcacgcacagatcacagtttgaa

SEQ ID NO: 271208 - DNA, 25 bp, Rattus norvegicus
ctgcacgcacagttcacagtttgaa

SEQ ID NO: 271209 - DNA, 25 bp, Rattus norvegicus
ctgcacgctctacatgaacttaaaa

SEQ ID NO: 271210 - DNA, 25 bp, Rattus norvegicus
ctgcacgctctagatgaacttaaaa

SEQ ID NO: 271211 - DNA, 25 bp, Rattus norvegicus
ctgcacggcagcacacaaatgttga

SEQ ID NO: 271212 - DNA, 25 bp, Rattus norvegicus
ctgcacggcagctcacaaatgttga

SEQ ID NO: 271213 - DNA, 25 bp, Rattus norvegicus
ctgcacgtggatcacgctctggcgc

SEQ ID NO: 271214 - DNA, 25 bp, Rattus norvegicus
ctgcacgtggatgacgctctggcgc

SEQ ID NO: 271215 - DNA, 25 bp, Rattus norvegicus
ctgcactaattgcttaatcgaatct

SEQ ID NO: 271216 - DNA, 25 bp, Rattus norvegicus
ctgcactaattggttaatcgaatct

SEQ ID NO: 271217 - DNA, 25 bp, Rattus norvegicus
ctgcactacaggacactttggagaa

SEQ ID NO: 271218 - DNA, 25 bp, Rattus norvegicus
ctgcactacaggtcactttggagaa

SEQ ID NO: 271219 - DNA, 25 bp, Rattus norvegicus
ctgcactactttccctatcagagtc

SEQ ID NO: 271220 - DNA, 25 bp, Rattus norvegicus
ctgcactactttgcctatcagagtc

SEQ ID NO: 271221 - DNA, 25 bp, Rattus norvegicus
ctgcactaggatcggctgctacatt

SEQ ID NO: 271222 - DNA, 25 bp, Rattus norvegicus
ctgcactaggatgggctgctacatt

SEQ ID NO: 271223 - DNA, 25 bp, Rattus norvegicus
ctgcactaggtccttggagggtttt

SEQ ID NO: 271224 - DNA, 25 bp, Rattus norvegicus
ctgcactaggtcgttggagggtttt

SEQ ID NO: 271225 - DNA, 25 bp, Rattus norvegicus
ctgcactattcaagcgtttggagag

SEQ ID NO: 271226 - DNA, 25 bp, Rattus norvegicus
ctgcactattcatgcgtttggagag

SEQ ID NO: 271227 - DNA, 25 bp, Rattus norvegicus
ctgcactcaggccagttctggagaa

SEQ ID NO: 271228 - DNA, 25 bp, Rattus norvegicus
ctgcactcaggcgagttctggagaa

SEQ ID NO: 271229 - DNA, 25 bp, Rattus norvegicus
ctgcactcagttatgtcctgctgaa

SEQ ID NO: 271230 - DNA, 25 bp, Rattus norvegicus
ctgcactcagttttgtcctgctgaa

SEQ ID NO: 271231 - DNA, 25 bp, Rattus norvegicus
ctgcactcatggcttgtctgctgga

SEQ ID NO: 271232 - DNA, 25 bp, Rattus norvegicus
ctgcactcatgggttgtctgctgga

SEQ ID NO: 271233 - DNA, 25 bp, Rattus norvegicus
ctgcactccactattgtacacataa

SEQ ID NO: 271234 - DNA, 25 bp, Rattus norvegicus
ctgcactccacttttgtacacataa

SEQ ID NO: 271235 - DNA, 25 bp, Rattus norvegicus
ctgcactcttcccacaattaggtaa

SEQ ID NO: 271236 - DNA, 25 bp, Rattus norvegicus
ctgcactcttccgacaattaggtaa

SEQ ID NO: 271237 - DNA, 25 bp, Rattus norvegicus
ctgcactctttcctgtgattgaata

SEQ ID NO: 271238 - DNA, 25 bp, Rattus norvegicus
ctgcactctttcgtgtgattgaata

SEQ ID NO: 271239 - DNA, 25 bp, Rattus norvegicus
ctgcactgaaacagactcacggtgt

SEQ ID NO: 271240 - DNA, 25 bp, Rattus norvegicus
ctgcactgaaactgactcacggtgt

SEQ ID NO: 271241 - DNA, 25 bp, Rattus norvegicus
ctgcactgagccatactgagtcata

SEQ ID NO: 271242 - DNA, 25 bp, Rattus norvegicus
ctgcactgagccttactgagtcata

SEQ ID NO: 271243 - DNA, 25 bp, Rattus norvegicus
ctgcactgcccaccgaaaagtataa

SEQ ID NO: 271244 - DNA, 25 bp, Rattus norvegicus
ctgcactgcccagcgaaaagtataa

SEQ ID NO: 271245 - DNA, 25 bp, Rattus norvegicus
ctgcactgctaaaatcctactgatt

SEQ ID NO: 271246 - DNA, 25 bp, Rattus norvegicus
ctgcactgctaatatcctactgatt

SEQ ID NO: 271247 - DNA, 25 bp, Rattus norvegicus
ctgcactgctggagtctgccgtgga

SEQ ID NO: 271248 - DNA, 25 bp, Rattus norvegicus
ctgcactgctggtgtctgccgtgga

SEQ ID NO: 271249 - DNA, 25 bp, Rattus norvegicus
ctgcactggcctcataggagatgta

SEQ ID NO: 271250 - DNA, 25 bp, Rattus norvegicus
ctgcactggcctgataggagatgta

SEQ ID NO: 271251 - DNA, 25 bp, Rattus norvegicus
ctgcactgggttactcttttccctt

SEQ ID NO: 271252 - DNA, 25 bp, Rattus norvegicus
ctgcactgggtttctcttttccctt

SEQ ID NO: 271253 - DNA, 25 bp, Rattus norvegicus
ctgcacttctatctttgcctgaaaa

SEQ ID NO: 271254 - DNA, 25 bp, Rattus norvegicus
ctgcacttctatgtttgcctgaaaa

SEQ ID NO: 271255 - DNA, 25 bp, Rattus norvegicus
ctgcacttgagaatccttgacggta

SEQ ID NO: 271256 - DNA, 25 bp, Rattus norvegicus
ctgcacttgagattccttgacggta

SEQ ID NO: 271257 - DNA, 25 bp, Rattus norvegicus
ctgcacttgagcatgaatgggtagt

SEQ ID NO: 271258 - DNA, 25 bp, Rattus norvegicus
ctgcacttgagcttgaatgggtagt

SEQ ID NO: 271259 - DNA, 25 bp, Rattus norvegicus
ctgcacttggcacggattcggtcct

SEQ ID NO: 271260 - DNA, 25 bp, Rattus norvegicus
ctgcacttggcagggattcggtcct

SEQ ID NO: 271261 - DNA, 25 bp, Rattus norvegicus
ctgcacttggtacctagggactctt

SEQ ID NO: 271262 - DNA, 25 bp, Rattus norvegicus
ctgcacttggtagctagggactctt

SEQ ID NO: 271263 - DNA, 25 bp, Rattus norvegicus
ctgcagacacagagccttactaggt

SEQ ID NO: 271264 - DNA, 25 bp, Rattus norvegicus
ctgcagacacagtgccttactaggt

SEQ ID NO: 271265 - DNA, 25 bp, Rattus norvegicus
ctgcagaccctccatcaataaatga

SEQ ID NO: 271266 - DNA, 25 bp, Rattus norvegicus
ctgcagaccctcgatcaataaatga

SEQ ID NO: 271267 - DNA, 25 bp, Rattus norvegicus
ctgcagactcggacagggtcagaaa

SEQ ID NO: 271268 - DNA, 25 bp, Rattus norvegicus
ctgcagactcggtcagggtcagaaa

SEQ ID NO: 271269 - DNA, 25 bp, Rattus norvegicus
ctgcagactctgatactaccacaag

SEQ ID NO: 271270 - DNA, 25 bp, Rattus norvegicus
ctgcagactctgttactaccacaag

SEQ ID NO: 271271 - DNA, 25 bp, Rattus norvegicus
ctgcagacttccctaacacacatga

SEQ ID NO: 271272 - DNA, 25 bp, Rattus norvegicus
ctgcagacttccgtaacacacatga

SEQ ID NO: 271273 - DNA, 25 bp, Rattus norvegicus
ctgcagagagctcccacagtggttc

SEQ ID NO: 271274 - DNA, 25 bp, Rattus norvegicus
ctgcagagagctgccacagtggttc

SEQ ID NO: 271275 - DNA, 25 bp, Rattus norvegicus
ctgcagagcaaccatccggatgata

SEQ ID NO: 271276 - DNA, 25 bp, Rattus norvegicus
ctgcagagcaacgatccggatgata

SEQ ID NO: 271277 - DNA, 25 bp, Rattus norvegicus
ctgcagaggcttcactatggctgtg

SEQ ID NO: 271278 - DNA, 25 bp, Rattus norvegicus
ctgcagaggcttgactatggctgtg

SEQ ID NO: 271279 - DNA, 25 bp, Rattus norvegicus
ctgcagaggttcatccagtggctga

SEQ ID NO: 271280 - DNA, 25 bp, Rattus norvegicus
ctgcagaggttcttccagtggctga

SEQ ID NO: 271281 - DNA, 25 bp, Rattus norvegicus
ctgcagatgcctacgccatctcttg

SEQ ID NO: 271282 - DNA, 25 bp, Rattus norvegicus
ctgcagatgccttcgccatctcttg

SEQ ID NO: 271283 - DNA, 25 bp, Rattus norvegicus
ctgcagattggcaaaaactgtcact

SEQ ID NO: 271284 - DNA, 25 bp, Rattus norvegicus
ctgcagattggctaaaactgtcact

SEQ ID NO: 271285 - DNA, 25 bp, Rattus norvegicus
ctgcagcaacacattattcatcttc

SEQ ID NO: 271286 - DNA, 25 bp, Rattus norvegicus
ctgcagcaacactttattcatcttc

SEQ ID NO: 271287 - DNA, 25 bp, Rattus norvegicus
ctgcagcagcgcctgccagcagatg

SEQ ID NO: 271288 - DNA, 25 bp, Rattus norvegicus
ctgcagcagcgcgtgccagcagatg

SEQ ID NO: 271289 - DNA, 25 bp, Rattus norvegicus
ctgcagccagatcccggaacaagaa

SEQ ID NO: 271290 - DNA, 25 bp, Rattus norvegicus
ctgcagccagatgccggaacaagaa

SEQ ID NO: 271291 - DNA, 25 bp, Rattus norvegicus
ctgcagccagtgagaacctgtgggt

SEQ ID NO: 271292 - DNA, 25 bp, Rattus norvegicus
ctgcagccagtgtgaacctgtgggt

SEQ ID NO: 271293 - DNA, 25 bp, Rattus norvegicus
ctgcagccctgacccaataggacaa

SEQ ID NO: 271294 - DNA, 25 bp, Rattus norvegicus
ctgcagccctgagccaataggacaa

SEQ ID NO: 271295 - DNA, 25 bp, Rattus norvegicus
ctgcagccgccaagccaaaaggaaa

SEQ ID NO: 271296 - DNA, 25 bp, Rattus norvegicus
ctgcagccgccatgccaaaaggaaa

SEQ ID NO: 271297 - DNA, 25 bp, Rattus norvegicus
ctgcagcctcgtcagattcagagac

SEQ ID NO: 271298 - DNA, 25 bp, Rattus norvegicus
ctgcagcctcgtgagattcagagac

SEQ ID NO: 271299 - DNA, 25 bp, Rattus norvegicus
ctgcagcctgccacagttatagata

SEQ ID NO: 271300 - DNA, 25 bp, Rattus norvegicus
ctgcagcctgcctcagttatagata

SEQ ID NO: 271301 - DNA, 25 bp, Rattus norvegicus
ctgcagcctgggaccaggataagga

SEQ ID NO: 271302 - DNA, 25 bp, Rattus norvegicus
ctgcagcctgggtccaggataagga

SEQ ID NO: 271303 - DNA, 25 bp, Rattus norvegicus
ctgcagcctggtaataccacacaga

SEQ ID NO: 271304 - DNA, 25 bp, Rattus norvegicus
ctgcagcctggttataccacacaga

SEQ ID NO: 271305 - DNA, 25 bp, Rattus norvegicus
ctgcagcgagcgctgaacttacttg

SEQ ID NO: 271306 - DNA, 25 bp, Rattus norvegicus
ctgcagcgagcggtgaacttacttg

SEQ ID NO: 271307 - DNA, 25 bp, Rattus norvegicus
ctgcagcggaccaggttgtgtatga

SEQ ID NO: 271308 - DNA, 25 bp, Rattus norvegicus
ctgcagcggacctggttgtgtatga

SEQ ID NO: 271309 - DNA, 25 bp, Rattus norvegicus
ctgcagcggctgactgagtacatgg

SEQ ID NO: 271310 - DNA, 25 bp, Rattus norvegicus
ctgcagcggctgtctgagtacatgg

SEQ ID NO: 271311 - DNA, 25 bp, Rattus norvegicus
ctgcagcgggtgaaggagtcaactc

SEQ ID NO: 271312 - DNA, 25 bp, Rattus norvegicus
ctgcagcgggtgtaggagtcaactc

SEQ ID NO: 271313 - DNA, 25 bp, Rattus norvegicus
ctgcagctatggcacgatgacttgg

SEQ ID NO: 271314 - DNA, 25 bp, Rattus norvegicus
ctgcagctatgggacgatgacttgg

SEQ ID NO: 271315 - DNA, 25 bp, Rattus norvegicus
ctgcagctctaacactgaaggagaa

SEQ ID NO: 271316 - DNA, 25 bp, Rattus norvegicus
ctgcagctctaagactgaaggagaa

SEQ ID NO: 271317 - DNA, 25 bp, Rattus norvegicus
ctgcagctgagcaccagtgacggct

SEQ ID NO: 271318 - DNA, 25 bp, Rattus norvegicus
ctgcagctgagctccagtgacggct

SEQ ID NO: 271319 - DNA, 25 bp, Rattus norvegicus
ctgcagctgctgaatcaccaataaa

SEQ ID NO: 271320 - DNA, 25 bp, Rattus norvegicus
ctgcagctgctgtatcaccaataaa

SEQ ID NO: 271321 - DNA, 25 bp, Rattus norvegicus
ctgcagctgcttctgggtgacttca

SEQ ID NO: 271322 - DNA, 25 bp, Rattus norvegicus
ctgcagctgcttgtgggtgacttca

SEQ ID NO: 271323 - DNA, 25 bp, Rattus norvegicus
ctgcagctggataacgcaacagtaa

SEQ ID NO: 271324 - DNA, 25 bp, Rattus norvegicus
ctgcagctggattacgcaacagtaa

SEQ ID NO: 271325 - DNA, 25 bp, Rattus norvegicus
ctgcagctggcccacatggtgtcct

SEQ ID NO: 271326 - DNA, 25 bp, Rattus norvegicus
ctgcagctggccgacatggtgtcct

SEQ ID NO: 271327 - DNA, 25 bp, Rattus norvegicus
ctgcagctgtagcaatggctcaaca

SEQ ID NO: 271328 - DNA, 25 bp, Rattus norvegicus
ctgcagctgtaggaatggctcaaca

SEQ ID NO: 271329 - DNA, 25 bp, Rattus norvegicus
ctgcagcttaagctgtaaacgagta

SEQ ID NO: 271330 - DNA, 25 bp, Rattus norvegicus
ctgcagcttaaggtgtaaacgagta

SEQ ID NO: 271331 - DNA, 25 bp, Rattus norvegicus
ctgcagcttgagaccaggatgcggt

SEQ ID NO: 271332 - DNA, 25 bp, Rattus norvegicus
ctgcagcttgagtccaggatgcggt

SEQ ID NO: 271333 - DNA, 25 bp, Rattus norvegicus
ctgcaggacatgactggacgctcta

SEQ ID NO: 271334 - DNA, 25 bp, Rattus norvegicus
ctgcaggacatgtctggacgctcta

SEQ ID NO: 271335 - DNA, 25 bp, Rattus norvegicus
ctgcaggaccgcatccacttcagtg

SEQ ID NO: 271336 - DNA, 25 bp, Rattus norvegicus
ctgcaggaccgcttccacttcagtg

SEQ ID NO: 271337 - DNA, 25 bp, Rattus norvegicus
ctgcaggagctgctgcgcaagctgg

SEQ ID NO: 271338 - DNA, 25 bp, Rattus norvegicus
ctgcaggagctggtgcgcaagctgg

SEQ ID NO: 271339 - DNA, 25 bp, Rattus norvegicus
ctgcaggagcttcctgtgggcatca

SEQ ID NO: 271340 - DNA, 25 bp, Rattus norvegicus
ctgcaggagcttgctgtgggcatca

SEQ ID NO: 271341 - DNA, 25 bp, Rattus norvegicus
ctgcaggagtaacccctctactatt

SEQ ID NO: 271342 - DNA, 25 bp, Rattus norvegicus
ctgcaggagtaagccctctactatt

SEQ ID NO: 271343 - DNA, 25 bp, Rattus norvegicus
ctgcaggcaaagcatacccagtata

SEQ ID NO: 271344 - DNA, 25 bp, Rattus norvegicus
ctgcaggcaaaggatacccagtata

SEQ ID NO: 271345 - DNA, 25 bp, Rattus norvegicus
ctgcaggcagatcaggcgtgtcctt

SEQ ID NO: 271346 - DNA, 25 bp, Rattus norvegicus
ctgcaggcagatgaggcgtgtcctt

SEQ ID NO: 271347 - DNA, 25 bp, Rattus norvegicus
ctgcaggcagccaacgagaggaacg

SEQ ID NO: 271348 - DNA, 25 bp, Rattus norvegicus
ctgcaggcagccatgagctataaca

SEQ ID NO: 271349 - DNA, 25 bp, Rattus norvegicus
ctgcaggcagcccaggaggcatttc

SEQ ID NO: 271350 - DNA, 25 bp, Rattus norvegicus
ctgcaggcagccgaggaggcatttc

SEQ ID NO: 271351 - DNA, 25 bp, Rattus norvegicus
ctgcaggcagcctacgagaggaacg

SEQ ID NO: 271352 - DNA, 25 bp, Rattus norvegicus
ctgcaggcagccttgagctataaca

SEQ ID NO: 271353 - DNA, 25 bp, Rattus norvegicus
ctgcaggccagtctcttgagaacaa

SEQ ID NO: 271354 - DNA, 25 bp, Rattus norvegicus
ctgcaggccagtgtcttgagaacaa

SEQ ID NO: 271355 - DNA, 25 bp, Rattus norvegicus
ctgcaggctactactgtggctttaa

SEQ ID NO: 271356 - DNA, 25 bp, Rattus norvegicus
ctgcaggctacttctgtggctttaa

SEQ ID NO: 271357 - DNA, 25 bp, Rattus norvegicus
ctgcaggctcccagcaaggagcaga

SEQ ID NO: 271358 - DNA, 25 bp, Rattus norvegicus
ctgcaggctccctgcaaggagcaga

SEQ ID NO: 271359 - DNA, 25 bp, Rattus norvegicus
ctgcaggctgcacatttacttatta

SEQ ID NO: 271360 - DNA, 25 bp, Rattus norvegicus
ctgcaggctgcagatttacttatta

SEQ ID NO: 271361 - DNA, 25 bp, Rattus norvegicus
ctgcagggaagtactgggtaccttt

SEQ ID NO: 271362 - DNA, 25 bp, Rattus norvegicus
ctgcagggaagttctgggtaccttt

SEQ ID NO: 271363 - DNA, 25 bp, Rattus norvegicus
ctgcagggaataacggcgggcactc

SEQ ID NO: 271364 - DNA, 25 bp, Rattus norvegicus
ctgcagggaatatcggcgggcactc

SEQ ID NO: 271365 - DNA, 25 bp, Rattus norvegicus
ctgcagggaatgaagattgtgaact

SEQ ID NO: 271366 - DNA, 25 bp, Rattus norvegicus
ctgcagggaatgtagattgtgaact

SEQ ID NO: 271367 - DNA, 25 bp, Rattus norvegicus
ctgcagggcagacgccggttacgta

SEQ ID NO: 271368 - DNA, 25 bp, Rattus norvegicus
ctgcagggcagaggccggttacgta

SEQ ID NO: 271369 - DNA, 25 bp, Rattus norvegicus
ctgcagggcaggctctatatatctt

SEQ ID NO: 271370 - DNA, 25 bp, Rattus norvegicus
ctgcagggcagggtctatatatctt

SEQ ID NO: 271371 - DNA, 25 bp, Rattus norvegicus
ctgcagggcctgctgttaaagtgtc

SEQ ID NO: 271372 - DNA, 25 bp, Rattus norvegicus
ctgcagggcctggtgttaaagtgtc

SEQ ID NO: 271373 - DNA, 25 bp, Rattus norvegicus
ctgcaggggaaaaagagcggtcttt

SEQ ID NO: 271374 - DNA, 25 bp, Rattus norvegicus
ctgcaggggaaatagagcggtcttt

SEQ ID NO: 271375 - DNA, 25 bp, Rattus norvegicus
ctgcagggtgcaacttcaaggttta

SEQ ID NO: 271376 - DNA, 25 bp, Rattus norvegicus
ctgcagggtgcatcttcaaggttta

SEQ ID NO: 271377 - DNA, 25 bp, Rattus norvegicus
ctgcaggtaaaactctcacacatat

SEQ ID NO: 271378 - DNA, 25 bp, Rattus norvegicus
ctgcaggtaaaagtctcacacatat

SEQ ID NO: 271379 - DNA, 25 bp, Rattus norvegicus
ctgcaggtgcgcacatggtgtatga

SEQ ID NO: 271380 - DNA, 25 bp, Rattus norvegicus
ctgcaggtgcgctcatggtgtatga

SEQ ID NO: 271381 - DNA, 25 bp, Rattus norvegicus
ctgcaggttcagagataagggacaa

SEQ ID NO: 271382 - DNA, 25 bp, Rattus norvegicus
ctgcaggttcagtgataagggacaa

SEQ ID NO: 271383 - DNA, 25 bp, Rattus norvegicus
ctgcagtaaaggcatttggccacat

SEQ ID NO: 271384 - DNA, 25 bp, Rattus norvegicus
ctgcagtaaagggatttggccacat

SEQ ID NO: 271385 - DNA, 25 bp, Rattus norvegicus
ctgcagtacactcgcccattggaat

SEQ ID NO: 271386 - DNA, 25 bp, Rattus norvegicus
ctgcagtacactggcccattggaat

SEQ ID NO: 271387 - DNA, 25 bp, Rattus norvegicus
ctgcagtatgtcacctgtgagtgac

SEQ ID NO: 271388 - DNA, 25 bp, Rattus norvegicus
ctgcagtatgtctcctgtgagtgac

SEQ ID NO: 271389 - DNA, 25 bp, Rattus norvegicus
ctgcagtcggcgacttttgtacatt

SEQ ID NO: 271390 - DNA, 25 bp, Rattus norvegicus
ctgcagtcggcgtcttttgtacatt

SEQ ID NO: 271391 - DNA, 25 bp, Rattus norvegicus
ctgcagtcgggtcttttatctgtac

SEQ ID NO: 271392 - DNA, 25 bp, Rattus norvegicus
ctgcagtcgggtgttttatctgtac

SEQ ID NO: 271393 - DNA, 25 bp, Rattus norvegicus
ctgcagtctctgaggtcaatgtaaa

SEQ ID NO: 271394 - DNA, 25 bp, Rattus norvegicus
ctgcagtctctgtggtcaatgtaaa

SEQ ID NO: 271395 - DNA, 25 bp, Rattus norvegicus
ctgcagtctgatagctgtgttacaa

SEQ ID NO: 271396 - DNA, 25 bp, Rattus norvegicus
ctgcagtctgattgctgtgttacaa

SEQ ID NO: 271397 - DNA, 25 bp, Rattus norvegicus
ctgcagtctgcaagagctcgtgaga

SEQ ID NO: 271398 - DNA, 25 bp, Rattus norvegicus
ctgcagtctgcacgatggctcaagc

SEQ ID NO: 271399 - DNA, 25 bp, Rattus norvegicus
ctgcagtctgcaggatggctcaagc

SEQ ID NO: 271400 - DNA, 25 bp, Rattus norvegicus
ctgcagtctgcatgagctcgtgaga

SEQ ID NO: 271401 - DNA, 25 bp, Rattus norvegicus
ctgcagtgaaccaaatgtcctcgag

SEQ ID NO: 271402 - DNA, 25 bp, Rattus norvegicus
ctgcagtgaacctaatgtcctcgag

SEQ ID NO: 271403 - DNA, 25 bp, Rattus norvegicus
ctgcagtgaaggagaaagcgagtcc

SEQ ID NO: 271404 - DNA, 25 bp, Rattus norvegicus
ctgcagtgaaggtgaaagcgagtcc

SEQ ID NO: 271405 - DNA, 25 bp, Rattus norvegicus
ctgcagtgaggcagtccccaaggag

SEQ ID NO: 271406 - DNA, 25 bp, Rattus norvegicus
ctgcagtgaggctgtccccaaggag

SEQ ID NO: 271407 - DNA, 25 bp, Rattus norvegicus
ctgcagtgcaatatatgaactcggc

SEQ ID NO: 271408 - DNA, 25 bp, Rattus norvegicus
ctgcagtgcaatttatgaactcggc

SEQ ID NO: 271409 - DNA, 25 bp, Rattus norvegicus
ctgcagtgctttcaagtgggccagc

SEQ ID NO: 271410 - DNA, 25 bp, Rattus norvegicus
ctgcagtgctttgaagtgggccagc

SEQ ID NO: 271411 - DNA, 25 bp, Rattus norvegicus
ctgcagtggatgacgaggatgccaa

SEQ ID NO: 271412 - DNA, 25 bp, Rattus norvegicus
ctgcagtggatgtcgaggatgccaa

SEQ ID NO: 271413 - DNA, 25 bp, Rattus norvegicus
ctgcagtggcaaatatctaaggata

SEQ ID NO: 271414 - DNA, 25 bp, Rattus norvegicus
ctgcagtggcaattatctaaggata

SEQ ID NO: 271415 - DNA, 25 bp, Rattus norvegicus
ctgcagtgtctgaaagccctctttg

SEQ ID NO: 271416 - DNA, 25 bp, Rattus norvegicus
ctgcagtgtctgatatctaggttag

SEQ ID NO: 271417 - DNA, 25 bp, Rattus norvegicus
ctgcagtgtctgtaagccctctttg

SEQ ID NO: 271418 - DNA, 25 bp, Rattus norvegicus
ctgcagtgtctgttatctaggttag

SEQ ID NO: 271419 - DNA, 25 bp, Rattus norvegicus
ctgcagtttacacgactagaacaaa

SEQ ID NO: 271420 - DNA, 25 bp, Rattus norvegicus
ctgcagtttacaggactagaacaaa

SEQ ID NO: 271421 - DNA, 25 bp, Rattus norvegicus
ctgcagtttctcagactggtcagga

SEQ ID NO: 271422 - DNA, 25 bp, Rattus norvegicus
ctgcagtttctctgactggtcagga

SEQ ID NO: 271423 - DNA, 25 bp, Rattus norvegicus
ctgcagtttgctcagtttgtctgta

SEQ ID NO: 271424 - DNA, 25 bp, Rattus norvegicus
ctgcagtttgctgagtttgtctgta

SEQ ID NO: 271425 - DNA, 25 bp, Rattus norvegicus
ctgcagtttggccttctggtataga

SEQ ID NO: 271426 - DNA, 25 bp, Rattus norvegicus
ctgcagtttggcgttctggtataga

SEQ ID NO: 271427 - DNA, 25 bp, Rattus norvegicus
ctgcagttttatcacctccaaaggt

SEQ ID NO: 271428 - DNA, 25 bp, Rattus norvegicus
ctgcagttttatgacctccaaaggt

SEQ ID NO: 271429 - DNA, 25 bp, Rattus norvegicus
ctgcataatgagactgccctggtta

SEQ ID NO: 271430 - DNA, 25 bp, Rattus norvegicus
ctgcataatgagtctgccctggtta

SEQ ID NO: 271431 - DNA, 25 bp, Rattus norvegicus
ctgcataatttaaagctttgttgat

SEQ ID NO: 271432 - DNA, 25 bp, Rattus norvegicus
ctgcataatttatagctttgttgat

SEQ ID NO: 271433 - DNA, 25 bp, Rattus norvegicus
ctgcatacagagatgaatggacctt

SEQ ID NO: 271434 - DNA, 25 bp, Rattus norvegicus
ctgcatacagagttgaatggacctt

SEQ ID NO: 271435 - DNA, 25 bp, Rattus norvegicus
ctgcatagagtgctgtctgcatttt

SEQ ID NO: 271436 - DNA, 25 bp, Rattus norvegicus
ctgcatagagtggtgtctgcatttt

SEQ ID NO: 271437 - DNA, 25 bp, Rattus norvegicus
ctgcatatgctcaacaaaccctaaa

SEQ ID NO: 271438 - DNA, 25 bp, Rattus norvegicus
ctgcatatgctctacaaaccctaaa

SEQ ID NO: 271439 - DNA, 25 bp, Rattus norvegicus
ctgcatatttccatctattctactg

SEQ ID NO: 271440 - DNA, 25 bp, Rattus norvegicus
ctgcatatttccttctattctactg

SEQ ID NO: 271441 - DNA, 25 bp, Rattus norvegicus
ctgcatatttctacgtaacttctga

SEQ ID NO: 271442 - DNA, 25 bp, Rattus norvegicus
ctgcatatttcttcgtaacttctga

SEQ ID NO: 271443 - DNA, 25 bp, Rattus norvegicus
ctgcatcaactgaatggtggccgtt

SEQ ID NO: 271444 - DNA, 25 bp, Rattus norvegicus
ctgcatcaactgtatggtggccgtt

SEQ ID NO: 271445 - DNA, 25 bp, Rattus norvegicus
ctgcatcaattgctgtgacggttca

SEQ ID NO: 271446 - DNA, 25 bp, Rattus norvegicus
ctgcatcaattggtgtgacggttca

SEQ ID NO: 271447 - DNA, 25 bp, Rattus norvegicus
ctgcatcaccatatctccaaaggaa

SEQ ID NO: 271448 - DNA, 25 bp, Rattus norvegicus
ctgcatcaccatttctccaaaggaa

SEQ ID NO: 271449 - DNA, 25 bp, Rattus norvegicus
ctgcatcagtgacgctttccataat

SEQ ID NO: 271450 - DNA, 25 bp, Rattus norvegicus
ctgcatcagtgaggctttccataat

SEQ ID NO: 271451 - DNA, 25 bp, Rattus norvegicus
ctgcatcatctgagcgctggtagaa

SEQ ID NO: 271452 - DNA, 25 bp, Rattus norvegicus
ctgcatcatctgtgcgctggtagaa

SEQ ID NO: 271453 - DNA, 25 bp, Rattus norvegicus
ctgcatcatggtaagtgttcaagct

SEQ ID NO: 271454 - DNA, 25 bp, Rattus norvegicus
ctgcatcatggttagtgttcaagct

SEQ ID NO: 271455 - DNA, 25 bp, Rattus norvegicus
ctgcatcattttcctgtttggcgat

SEQ ID NO: 271456 - DNA, 25 bp, Rattus norvegicus
ctgcatcattttgctgtttggcgat

SEQ ID NO: 271457 - DNA, 25 bp, Rattus norvegicus
ctgcatcccctaaaaagttcctttt

SEQ ID NO: 271458 - DNA, 25 bp, Rattus norvegicus
ctgcatcccctataaagttcctttt

SEQ ID NO: 271459 - DNA, 25 bp, Rattus norvegicus
ctgcatcctgttactctgtgctgcc

SEQ ID NO: 271460 - DNA, 25 bp, Rattus norvegicus
ctgcatcctgtttctctgtgctgcc

SEQ ID NO: 271461 - DNA, 25 bp, Rattus norvegicus
ctgcatcgatccagtcgacaggcga

SEQ ID NO: 271462 - DNA, 25 bp, Rattus norvegicus
ctgcatcgatcctgtcgacaggcga

SEQ ID NO: 271463 - DNA, 25 bp, Rattus norvegicus
ctgcatcgccaaactggaagcataa

SEQ ID NO: 271464 - DNA, 25 bp, Rattus norvegicus
ctgcatcgccaatctggaagcataa

SEQ ID NO: 271465 - DNA, 25 bp, Rattus norvegicus
ctgcatcttaagactgttctgttgt

SEQ ID NO: 271466 - DNA, 25 bp, Rattus norvegicus
ctgcatcttaagtctgttctgttgt

SEQ ID NO: 271467 - DNA, 25 bp, Rattus norvegicus
ctgcatgacattctggagatccact

SEQ ID NO: 271468 - DNA, 25 bp, Rattus norvegicus
ctgcatgacattgtggagatccact

SEQ ID NO: 271469 - DNA, 25 bp, Rattus norvegicus
ctgcatgagctgcacgttctcacag

SEQ ID NO: 271470 - DNA, 25 bp, Rattus norvegicus
ctgcatgagctggacgttctcacag

SEQ ID NO: 271471 - DNA, 25 bp, Rattus norvegicus
ctgcatgcatgcagtctagagccta

SEQ ID NO: 271472 - DNA, 25 bp, Rattus norvegicus
ctgcatgcatgctgtctagagccta

SEQ ID NO: 271473 - DNA, 25 bp, Rattus norvegicus
ctgcatgccatgatattctgaatca

SEQ ID NO: 271474 - DNA, 25 bp, Rattus norvegicus
ctgcatgccatgttattctgaatca

SEQ ID NO: 271475 - DNA, 25 bp, Rattus norvegicus
ctgcatgccgcgatagaacactgag

SEQ ID NO: 271476 - DNA, 25 bp, Rattus norvegicus
ctgcatgccgcgttagaacactgag

SEQ ID NO: 271477 - DNA, 25 bp, Rattus norvegicus
ctgcatgccggcaggccacagtgag

SEQ ID NO: 271478 - DNA, 25 bp, Rattus norvegicus
ctgcatgccggctggccacagtgag

SEQ ID NO: 271479 - DNA, 25 bp, Rattus norvegicus
ctgcatgctctcacttgttgttgga

SEQ ID NO: 271480 - DNA, 25 bp, Rattus norvegicus
ctgcatgctctctcttgttgttgga

SEQ ID NO: 271481 - DNA, 25 bp, Rattus norvegicus
ctgcatgctgcacggttataaccac

SEQ ID NO: 271482 - DNA, 25 bp, Rattus norvegicus
ctgcatgctgcagggttataaccac

SEQ ID NO: 271483 - DNA, 25 bp, Rattus norvegicus
ctgcatgcttggctctgtgagcaga

SEQ ID NO: 271484 - DNA, 25 bp, Rattus norvegicus
ctgcatgcttgggtctgtgagcaga

SEQ ID NO: 271485 - DNA, 25 bp, Rattus norvegicus
ctgcatggctgacagctagggcctt

SEQ ID NO: 271486 - DNA, 25 bp, Rattus norvegicus
ctgcatggctgagagctagggcctt

SEQ ID NO: 271487 - DNA, 25 bp, Rattus norvegicus
ctgcatgggtgcagagtctctacaa

SEQ ID NO: 271488 - DNA, 25 bp, Rattus norvegicus
ctgcatgggtgctgagtctctacaa

SEQ ID NO: 271489 - DNA, 25 bp, Rattus norvegicus
ctgcatggtctgcagaggtgaacac

SEQ ID NO: 271490 - DNA, 25 bp, Rattus norvegicus
ctgcatggtctggagaggtgaacac

SEQ ID NO: 271491 - DNA, 25 bp, Rattus norvegicus
ctgcatgtaacactggagcctttcc

SEQ ID NO: 271492 - DNA, 25 bp, Rattus norvegicus
ctgcatgtaacagtggagcctttcc

SEQ ID NO: 271493 - DNA, 25 bp, Rattus norvegicus
ctgcatgtacatcgctgcttcaagt

SEQ ID NO: 271494 - DNA, 25 bp, Rattus norvegicus
ctgcatgtacatggctgcttcaagt

SEQ ID NO: 271495 - DNA, 25 bp, Rattus norvegicus
ctgcatgtatgcagtgcccacccaa

SEQ ID NO: 271496 - DNA, 25 bp, Rattus norvegicus
ctgcatgtatgctgtgcccacccaa

SEQ ID NO: 271497 - DNA, 25 bp, Rattus norvegicus
ctgcatgtcccaaacagtcaggatt

SEQ ID NO: 271498 - DNA, 25 bp, Rattus norvegicus
ctgcatgtcccatacagtcaggatt

SEQ ID NO: 271499 - DNA, 25 bp, Rattus norvegicus
ctgcatgtgtctcgcacagcagggc

SEQ ID NO: 271500 - DNA, 25 bp, Rattus norvegicus
ctgcatgtgtctggcacagcagggc

SEQ ID NO: 271501 - DNA, 25 bp, Rattus norvegicus
ctgcatgtgtgccttagacgttgac

SEQ ID NO: 271502 - DNA, 25 bp, Rattus norvegicus
ctgcatgtgtgcgttagacgttgac

SEQ ID NO: 271503 - DNA, 25 bp, Rattus norvegicus
ctgcatgtgttcatggtgttggacc

SEQ ID NO: 271504 - DNA, 25 bp, Rattus norvegicus
ctgcatgtgttcttggtgttggacc

SEQ ID NO: 271505 - DNA, 25 bp, Rattus norvegicus
ctgcatgttaccatcctgtaggatt

SEQ ID NO: 271506 - DNA, 25 bp, Rattus norvegicus
ctgcatgttaccttcctgtaggatt

SEQ ID NO: 271507 - DNA, 25 bp, Rattus norvegicus
ctgcatgttcgtactgtgactctgg

SEQ ID NO: 271508 - DNA, 25 bp, Rattus norvegicus
ctgcatgttcgttctgtgactctgg

SEQ ID NO: 271509 - DNA, 25 bp, Rattus norvegicus
ctgcatgttcttcctagtgtagctt

SEQ ID NO: 271510 - DNA, 25 bp, Rattus norvegicus
ctgcatgttcttgctagtgtagctt

SEQ ID NO: 271511 - DNA, 25 bp, Rattus norvegicus
ctgcatgttggcagtcactatgtta

SEQ ID NO: 271512 - DNA, 25 bp, Rattus norvegicus
ctgcatgttggctgtcactatgtta

SEQ ID NO: 271513 - DNA, 25 bp, Rattus norvegicus
ctgcattagttcaggtccttcctat

SEQ ID NO: 271514 - DNA, 25 bp, Rattus norvegicus
ctgcattagttctggtccttcctat

SEQ ID NO: 271515 - DNA, 25 bp, Rattus norvegicus
ctgcattcatggacagccagagcgt

SEQ ID NO: 271516 - DNA, 25 bp, Rattus norvegicus
ctgcattcatggtcagccagagcgt

SEQ ID NO: 271517 - DNA, 25 bp, Rattus norvegicus
ctgcattcccagacagctatggaag

SEQ ID NO: 271518 - DNA, 25 bp, Rattus norvegicus
ctgcattcccagtcagctatggaag

SEQ ID NO: 271519 - DNA, 25 bp, Rattus norvegicus
ctgcattcccatccccttaaaaaag

SEQ ID NO: 271520 - DNA, 25 bp, Rattus norvegicus
ctgcattcccatgcccttaaaaaag

SEQ ID NO: 271521 - DNA, 25 bp, Rattus norvegicus
ctgcattccccaaaagaacgctttt

SEQ ID NO: 271522 - DNA, 25 bp, Rattus norvegicus
ctgcattccccataagaacgctttt

SEQ ID NO: 271523 - DNA, 25 bp, Rattus norvegicus
ctgcattcctggatgtattcctaat

SEQ ID NO: 271524 - DNA, 25 bp, Rattus norvegicus
ctgcattcctggttgtattcctaat

SEQ ID NO: 271525 - DNA, 25 bp, Rattus norvegicus
ctgcattccttgatttgacttgtgt

SEQ ID NO: 271526 - DNA, 25 bp, Rattus norvegicus
ctgcattccttgttttgacttgtgt

SEQ ID NO: 271527 - DNA, 25 bp, Rattus norvegicus
ctgcattcgatgacatcccatcaat

SEQ ID NO: 271528 - DNA, 25 bp, Rattus norvegicus
ctgcattcgatgtcatcccatcaat

SEQ ID NO: 271529 - DNA, 25 bp, Rattus norvegicus
ctgcattctgaacggacaggcctgt

SEQ ID NO: 271530 - DNA, 25 bp, Rattus norvegicus
ctgcattctgaagggacaggcctgt

SEQ ID NO: 271531 - DNA, 25 bp, Rattus norvegicus
ctgcattctgacaaggtttccaagg

SEQ ID NO: 271532 - DNA, 25 bp, Rattus norvegicus
ctgcattctgactaggtttccaagg

SEQ ID NO: 271533 - DNA, 25 bp, Rattus norvegicus
ctgcattctgccctggttaagtaag

SEQ ID NO: 271534 - DNA, 25 bp, Rattus norvegicus
ctgcattctgccgtggttaagtaag

SEQ ID NO: 271535 - DNA, 25 bp, Rattus norvegicus
ctgcattctgttctaaggttttcac

SEQ ID NO: 271536 - DNA, 25 bp, Rattus norvegicus
ctgcattctgttgtaaggttttcac

SEQ ID NO: 271537 - DNA, 25 bp, Rattus norvegicus
ctgcattgcagacctttccctaaat

SEQ ID NO: 271538 - DNA, 25 bp, Rattus norvegicus
ctgcattgcagagctttccctaaat

SEQ ID NO: 271539 - DNA, 25 bp, Rattus norvegicus
ctgcattgttcaattctgtgtacaa

SEQ ID NO: 271540 - DNA, 25 bp, Rattus norvegicus
ctgcattgttcatttctgtgtacaa

SEQ ID NO: 271541 - DNA, 25 bp, Rattus norvegicus
ctgcatttccgaaacggcatgggtg

SEQ ID NO: 271542 - DNA, 25 bp, Rattus norvegicus
ctgcatttccgatacggcatgggtg

SEQ ID NO: 271543 - DNA, 25 bp, Rattus norvegicus
ctgcatttctgacaccttgggaatc

SEQ ID NO: 271544 - DNA, 25 bp, Rattus norvegicus
ctgcatttctgagaccttgggaatc

SEQ ID NO: 271545 - DNA, 25 bp, Rattus norvegicus
ctgcatttgagcagagtgttctttc

SEQ ID NO: 271546 - DNA, 25 bp, Rattus norvegicus
ctgcatttgagctgagtgttctttc

SEQ ID NO: 271547 - DNA, 25 bp, Rattus norvegicus
ctgcattttagtccccgagtgtaga

SEQ ID NO: 271548 - DNA, 25 bp, Rattus norvegicus
ctgcattttagtgcccgagtgtaga

SEQ ID NO: 271549 - DNA, 25 bp, Rattus norvegicus
ctgcatttttgaagggtgtgctaat

SEQ ID NO: 271550 - DNA, 25 bp, Rattus norvegicus
ctgcatttttgatgggtgtgctaat

SEQ ID NO: 271551 - DNA, 25 bp, Rattus norvegicus
ctgccaaaacatacctttccatcaa

SEQ ID NO: 271552 - DNA, 25 bp, Rattus norvegicus
ctgccaaaacattcctttccatcaa

SEQ ID NO: 271553 - DNA, 25 bp, Rattus norvegicus
ctgccaaagcaccaccagagtttta

SEQ ID NO: 271554 - DNA, 25 bp, Rattus norvegicus
ctgccaaagcacgaccagagtttta

SEQ ID NO: 271555 - DNA, 25 bp, Rattus norvegicus
ctgccaaagctgactgtcctagaaa

SEQ ID NO: 271556 - DNA, 25 bp, Rattus norvegicus
ctgccaaagctgtctgtcctagaaa

SEQ ID NO: 271557 - DNA, 25 bp, Rattus norvegicus
ctgccaacctttatatccagttcta

SEQ ID NO: 271558 - DNA, 25 bp, Rattus norvegicus
ctgccaacctttttatccagttcta

SEQ ID NO: 271559 - DNA, 25 bp, Rattus norvegicus
ctgccaacgtggacgcctcggtgat

SEQ ID NO: 271560 - DNA, 25 bp, Rattus norvegicus
ctgccaacgtggtcgcctcggtgat

SEQ ID NO: 271561 - DNA, 25 bp, Rattus norvegicus
ctgccaactgtaagtgaggtccctt

SEQ ID NO: 271562 - DNA, 25 bp, Rattus norvegicus
ctgccaactgtactaatgatgcttt

SEQ ID NO: 271563 - DNA, 25 bp, Rattus norvegicus
ctgccaactgtagtaatgatgcttt

SEQ ID NO: 271564 - DNA, 25 bp, Rattus norvegicus
ctgccaactgtatgtgaggtccctt

SEQ ID NO: 271565 - DNA, 25 bp, Rattus norvegicus
ctgccaactgtgaggacgaggtgtc

SEQ ID NO: 271566 - DNA, 25 bp, Rattus norvegicus
ctgccaactgtgtggacgaggtgtc

SEQ ID NO: 271567 - DNA, 25 bp, Rattus norvegicus
ctgccaacttttacttttagctata

SEQ ID NO: 271568 - DNA, 25 bp, Rattus norvegicus
ctgccaactttttcttttagctata

SEQ ID NO: 271569 - DNA, 25 bp, Rattus norvegicus
ctgccaaggctgagggcaaggtcat

SEQ ID NO: 271570 - DNA, 25 bp, Rattus norvegicus
ctgccaaggctgtgggcaaggtcat

SEQ ID NO: 271571 - DNA, 25 bp, Rattus norvegicus
ctgccaagtacaaggagctgggctt

SEQ ID NO: 271572 - DNA, 25 bp, Rattus norvegicus
ctgccaagtacatggagctgggctt

SEQ ID NO: 271573 - DNA, 25 bp, Rattus norvegicus
ctgccaagtcccaggaaggtgtcaa

SEQ ID NO: 271574 - DNA, 25 bp, Rattus norvegicus
ctgccaagtccctggaaggtgtcaa

SEQ ID NO: 271575 - DNA, 25 bp, Rattus norvegicus
ctgccaagttggaaagtctctcatc

SEQ ID NO: 271576 - DNA, 25 bp, Rattus norvegicus
ctgccaagttggtaagtctctcatc

SEQ ID NO: 271577 - DNA, 25 bp, Rattus norvegicus
ctgccaatggatagctttgcctcta

SEQ ID NO: 271578 - DNA, 25 bp, Rattus norvegicus
ctgccaatggattgctttgcctcta

SEQ ID NO: 271579 - DNA, 25 bp, Rattus norvegicus
ctgccaatgggacctcttctcttgt

SEQ ID NO: 271580 - DNA, 25 bp, Rattus norvegicus
ctgccaatgggagctcttctcttgt

SEQ ID NO: 271581 - DNA, 25 bp, Rattus norvegicus
ctgccaattggcctgagtctgtgga

SEQ ID NO: 271582 - DNA, 25 bp, Rattus norvegicus
ctgccaattggcgtgagtctgtgga

SEQ ID NO: 271583 - DNA, 25 bp, Rattus norvegicus
ctgccacaacccagtgacagtgaat

SEQ ID NO: 271584 - DNA, 25 bp, Rattus norvegicus
ctgccacaaccctgtgacagtgaat

SEQ ID NO: 271585 - DNA, 25 bp, Rattus norvegicus
ctgccacaatcaccatgactgtata

SEQ ID NO: 271586 - DNA, 25 bp, Rattus norvegicus
ctgccacaatcagcatgactgtata

SEQ ID NO: 271587 - DNA, 25 bp, Rattus norvegicus
ctgccacacagtctctcttgtgaag

SEQ ID NO: 271588 - DNA, 25 bp, Rattus norvegicus
ctgccacacagtgtctcttgtgaag

SEQ ID NO: 271589 - DNA, 25 bp, Rattus norvegicus
ctgccacagtggctgtaactgctaa

SEQ ID NO: 271590 - DNA, 25 bp, Rattus norvegicus
ctgccacagtgggtgtaactgctaa

SEQ ID NO: 271591 - DNA, 25 bp, Rattus norvegicus
ctgccacccgttccaaggagctggg

SEQ ID NO: 271592 - DNA, 25 bp, Rattus norvegicus
ctgccacccgttgcaaggagctggg

SEQ ID NO: 271593 - DNA, 25 bp, Rattus norvegicus
ctgccaccgtagcgcggaccttggg

SEQ ID NO: 271594 - DNA, 25 bp, Rattus norvegicus
ctgccaccgtagggcggaccttggg

SEQ ID NO: 271595 - DNA, 25 bp, Rattus norvegicus
ctgccacgatctctgactggaggaa

SEQ ID NO: 271596 - DNA, 25 bp, Rattus norvegicus
ctgccacgatctgtgactggaggaa

SEQ ID NO: 271597 - DNA, 25 bp, Rattus norvegicus
ctgccacggccgacaaggaggctgc

SEQ ID NO: 271598 - DNA, 25 bp, Rattus norvegicus
ctgccacggccgtcaaggaggctgc

SEQ ID NO: 271599 - DNA, 25 bp, Rattus norvegicus
ctgccacggttgatcttagtactgt

SEQ ID NO: 271600 - DNA, 25 bp, Rattus norvegicus
ctgccacggttgttcttagtactgt

SEQ ID NO: 271601 - DNA, 25 bp, Rattus norvegicus
ctgccacggtttacagtttctgcaa

SEQ ID NO: 271602 - DNA, 25 bp, Rattus norvegicus
ctgccacggttttcagtttctgcaa

SEQ ID NO: 271603 - DNA, 25 bp, Rattus norvegicus
ctgccactatttatatactagcatc

SEQ ID NO: 271604 - DNA, 25 bp, Rattus norvegicus
ctgccactatttttatactagcatc

SEQ ID NO: 271605 - DNA, 25 bp, Rattus norvegicus
ctgccactcacaatccttggagaaa

SEQ ID NO: 271606 - DNA, 25 bp, Rattus norvegicus
ctgccactcacattccttggagaaa

SEQ ID NO: 271607 - DNA, 25 bp, Rattus norvegicus
ctgccactcatcattactttgggag

SEQ ID NO: 271608 - DNA, 25 bp, Rattus norvegicus
ctgccactcatctttactttgggag

SEQ ID NO: 271609 - DNA, 25 bp, Rattus norvegicus
ctgccactctccaaatgtttttaat

SEQ ID NO: 271610 - DNA, 25 bp, Rattus norvegicus
ctgccactctcctaatgtttttaat

SEQ ID NO: 271611 - DNA, 25 bp, Rattus norvegicus
ctgccactctggctttgttcagtgt

SEQ ID NO: 271612 - DNA, 25 bp, Rattus norvegicus
ctgccactctgggtttgttcagtgt

SEQ ID NO: 271613 - DNA, 25 bp, Rattus norvegicus
ctgccactgccaatctggagaataa

SEQ ID NO: 271614 - DNA, 25 bp, Rattus norvegicus
ctgccactgccattctggagaataa

SEQ ID NO: 271615 - DNA, 25 bp, Rattus norvegicus
ctgccactgcttagtctgggaggga

SEQ ID NO: 271616 - DNA, 25 bp, Rattus norvegicus
ctgccactgctttgtctgggaggga

SEQ ID NO: 271617 - DNA, 25 bp, Rattus norvegicus
ctgccactgtggacctctagataag

SEQ ID NO: 271618 - DNA, 25 bp, Rattus norvegicus
ctgccactgtggagcagttcgtttt

SEQ ID NO: 271619 - DNA, 25 bp, Rattus norvegicus
ctgccactgtggtcctctagataag

SEQ ID NO: 271620 - DNA, 25 bp, Rattus norvegicus
ctgccactgtggtgcagttcgtttt

SEQ ID NO: 271621 - DNA, 20 bp, Rattus norvegicus
ctgccacttccaacatgaga

SEQ ID NO: 271622 - DNA, 20 bp, Rattus norvegicus
ctgccacttcccacatgaga

SEQ ID NO: 271623 - DNA, 20 bp, Rattus norvegicus
ctgccacttccgacatgaga

SEQ ID NO: 271624 - DNA, 20 bp, Rattus norvegicus
ctgccacttcctacatgaga

SEQ ID NO: 271625 - DNA, 25 bp, Rattus norvegicus
ctgccactttgtctatttctgtttt

SEQ ID NO: 271626 - DNA, 25 bp, Rattus norvegicus
ctgccactttgtgtatttctgtttt

SEQ ID NO: 271627 - DNA, 25 bp, Rattus norvegicus
ctgccagaagtcacagtgattggaa

SEQ ID NO: 271628 - DNA, 25 bp, Rattus norvegicus
ctgccagaagtctcagtgattggaa

SEQ ID NO: 271629 - DNA, 25 bp, Rattus norvegicus
ctgccagaccgacggtgcttttttg

SEQ ID NO: 271630 - DNA, 25 bp, Rattus norvegicus
ctgccagaccgagggtgcttttttg

SEQ ID NO: 271631 - DNA, 25 bp, Rattus norvegicus
ctgccagacctgacgattgaactca

SEQ ID NO: 271632 - DNA, 25 bp, Rattus norvegicus
ctgccagacctgtcgattgaactca

SEQ ID NO: 271633 - DNA, 25 bp, Rattus norvegicus
ctgccagaggctactatctgtgata

SEQ ID NO: 271634 - DNA, 25 bp, Rattus norvegicus
ctgccagaggcttctatctgtgata

SEQ ID NO: 271635 - DNA, 25 bp, Rattus norvegicus
ctgccagagggtactaaattcaaaa

SEQ ID NO: 271636 - DNA, 25 bp, Rattus norvegicus
ctgccagagggttctaaattcaaaa

SEQ ID NO: 271637 - DNA, 25 bp, Rattus norvegicus
ctgccagatcttcaagctttacaat

SEQ ID NO: 271638 - DNA, 25 bp, Rattus norvegicus
ctgccagatcttgaagctttacaat

SEQ ID NO: 271639 - DNA, 25 bp, Rattus norvegicus
ctgccagcaggacccatggaacgga

SEQ ID NO: 271640 - DNA, 25 bp, Rattus norvegicus
ctgccagcaggagccatggaacgga

SEQ ID NO: 271641 - DNA, 25 bp, Rattus norvegicus
ctgccagccagtccatgtggtcaat

SEQ ID NO: 271642 - DNA, 25 bp, Rattus norvegicus
ctgccagccagtgcatgtggtcaat

SEQ ID NO: 271643 - DNA, 25 bp, Rattus norvegicus
ctgccagccttacacattgagttat

SEQ ID NO: 271644 - DNA, 25 bp, Rattus norvegicus
ctgccagccttagacattgagttat

SEQ ID NO: 271645 - DNA, 25 bp, Rattus norvegicus
ctgccagcgtcacgccaggaatgga

SEQ ID NO: 271646 - DNA, 25 bp, Rattus norvegicus
ctgccagcgtcaggccaggaatgga

SEQ ID NO: 271647 - DNA, 25 bp, Rattus norvegicus
ctgccagctctgaggccgatcggca

SEQ ID NO: 271648 - DNA, 25 bp, Rattus norvegicus
ctgccagctctgtggccgatcggca

SEQ ID NO: 271649 - DNA, 25 bp, Rattus norvegicus
ctgccagctgttagggtgacttgta

SEQ ID NO: 271650 - DNA, 25 bp, Rattus norvegicus
ctgccagctgtttgggtgacttgta

SEQ ID NO: 271651 - DNA, 25 bp, Rattus norvegicus
ctgccaggaatgcagaaccagattc

SEQ ID NO: 271652 - DNA, 25 bp, Rattus norvegicus
ctgccaggaatggagaaccagattc

SEQ ID NO: 271653 - DNA, 25 bp, Rattus norvegicus
ctgccaggagcaccgggtgaaacct

SEQ ID NO: 271654 - DNA, 25 bp, Rattus norvegicus
ctgccaggagcagcgggtgaaacct

SEQ ID NO: 271655 - DNA, 25 bp, Rattus norvegicus
ctgccaggccaaagcgaagctgatt

SEQ ID NO: 271656 - DNA, 25 bp, Rattus norvegicus
ctgccaggccaatgcgaagctgatt

SEQ ID NO: 271657 - DNA, 25 bp, Rattus norvegicus
ctgccaggcctgatgagttgagttt

SEQ ID NO: 271658 - DNA, 25 bp, Rattus norvegicus
ctgccaggcctgttgagttgagttt

SEQ ID NO: 271659 - DNA, 25 bp, Rattus norvegicus
ctgccaggctcacgtacatggaatt

SEQ ID NO: 271660 - DNA, 25 bp, Rattus norvegicus
ctgccaggctcaggtacatggaatt

SEQ ID NO: 271661 - DNA, 25 bp, Rattus norvegicus
ctgccagggctgagccccatggcag

SEQ ID NO: 271662 - DNA, 25 bp, Rattus norvegicus
ctgccagggctgatgtctagacagt

SEQ ID NO: 271663 - DNA, 25 bp, Rattus norvegicus
ctgccagggctgtgccccatggcag

SEQ ID NO: 271664 - DNA, 25 bp, Rattus norvegicus
ctgccagggctgttgtctagacagt

SEQ ID NO: 271665 - DNA, 25 bp, Rattus norvegicus
ctgccagggttgatagagtttgtta

SEQ ID NO: 271666 - DNA, 25 bp, Rattus norvegicus
ctgccagggttgttagagtttgtta

SEQ ID NO: 271667 - DNA, 25 bp, Rattus norvegicus
ctgccagtaaacaggtggtaccaca

SEQ ID NO: 271668 - DNA, 25 bp, Rattus norvegicus
ctgccagtaaactggtggtaccaca

SEQ ID NO: 271669 - DNA, 25 bp, Rattus norvegicus
ctgccagtacagaattacctattga

SEQ ID NO: 271670 - DNA, 25 bp, Rattus norvegicus
ctgccagtacagtattacctattga

SEQ ID NO: 271671 - DNA, 25 bp, Rattus norvegicus
ctgccagtagggagctttgcagtca

SEQ ID NO: 271672 - DNA, 25 bp, Rattus norvegicus
ctgccagtagggtgctttgcagtca

SEQ ID NO: 271673 - DNA, 25 bp, Rattus norvegicus
ctgccagtcttcatcattgttcata

SEQ ID NO: 271674 - DNA, 25 bp, Rattus norvegicus
ctgccagtcttcttcattgttcata

SEQ ID NO: 271675 - DNA, 25 bp, Rattus norvegicus
ctgccagtgccaatgtcaaagttgt

SEQ ID NO: 271676 - DNA, 25 bp, Rattus norvegicus
ctgccagtgccacgtaatggaagca

SEQ ID NO: 271677 - DNA, 25 bp, Rattus norvegicus
ctgccagtgccaggtaatggaagca

SEQ ID NO: 271678 - DNA, 25 bp, Rattus norvegicus
ctgccagtgccattgtcaaagttgt

SEQ ID NO: 271679 - DNA, 25 bp, Rattus norvegicus
ctgccagtgtgcattttgtcactta

SEQ ID NO: 271680 - DNA, 25 bp, Rattus norvegicus
ctgccagtgtgctttttgtcactta

SEQ ID NO: 271681 - DNA, 25 bp, Rattus norvegicus
ctgccagtgttgctttctttcaaag

SEQ ID NO: 271682 - DNA, 25 bp, Rattus norvegicus
ctgccagtgttggtttctttcaaag

SEQ ID NO: 271683 - DNA, 25 bp, Rattus norvegicus
ctgccatatactaacacagcaggcg

SEQ ID NO: 271684 - DNA, 25 bp, Rattus norvegicus
ctgccatatacttacacagcaggcg

SEQ ID NO: 271685 - DNA, 25 bp, Rattus norvegicus
ctgccatatgacaggatccgtgcag

SEQ ID NO: 271686 - DNA, 25 bp, Rattus norvegicus
ctgccatatgactggatccgtgcag

SEQ ID NO: 271687 - DNA, 25 bp, Rattus norvegicus
ctgccatcagaaaatccaaagactt

SEQ ID NO: 271688 - DNA, 25 bp, Rattus norvegicus
ctgccatcagaatatccaaagactt

SEQ ID NO: 271689 - DNA, 25 bp, Rattus norvegicus
ctgccatcagtcactacttggatat

SEQ ID NO: 271690 - DNA, 25 bp, Rattus norvegicus
ctgccatcagtctctacttggatat

SEQ ID NO: 271691 - DNA, 25 bp, Rattus norvegicus
ctgccatccacgaactggtcacggg

SEQ ID NO: 271692 - DNA, 25 bp, Rattus norvegicus
ctgccatccacgtactggtcacggg

SEQ ID NO: 271693 - DNA, 25 bp, Rattus norvegicus
ctgccatcctggagaagggcacacg

SEQ ID NO: 271694 - DNA, 25 bp, Rattus norvegicus
ctgccatcctggtgaagggcacacg

SEQ ID NO: 271695 - DNA, 25 bp, Rattus norvegicus
ctgccatgccttccacaaatgtggg

SEQ ID NO: 271696 - DNA, 25 bp, Rattus norvegicus
ctgccatgccttgcacaaatgtggg

SEQ ID NO: 271697 - DNA, 25 bp, Rattus norvegicus
ctgccatggaagaaggatgcccctc

SEQ ID NO: 271698 - DNA, 25 bp, Rattus norvegicus
ctgccatggaagtaggatgcccctc

SEQ ID NO: 271699 - DNA, 25 bp, Rattus norvegicus
ctgccatggatgaggtctacgcgct

SEQ ID NO: 271700 - DNA, 25 bp, Rattus norvegicus
ctgccatggatgtggtctacgcgct

SEQ ID NO: 271701 - DNA, 25 bp, Rattus norvegicus
ctgccatggctgctgaatgaagttg

SEQ ID NO: 271702 - DNA, 25 bp, Rattus norvegicus
ctgccatggctggtgaatgaagttg

SEQ ID NO: 271703 - DNA, 25 bp, Rattus norvegicus
ctgccatggtgaccgtgctagagat

SEQ ID NO: 271704 - DNA, 25 bp, Rattus norvegicus
ctgccatggtgagcgtgctagagat

SEQ ID NO: 271705 - DNA, 25 bp, Rattus norvegicus
ctgccatgtataagtgtttagcaca

SEQ ID NO: 271706 - DNA, 25 bp, Rattus norvegicus
ctgccatgtatatgtgtttagcaca

SEQ ID NO: 271707 - DNA, 25 bp, Rattus norvegicus
ctgccatgtgcacagtctggtggat

SEQ ID NO: 271708 - DNA, 25 bp, Rattus norvegicus
ctgccatgtgcagagtctggtggat

SEQ ID NO: 271709 - DNA, 25 bp, Rattus norvegicus
ctgccatgttgacgctgccagagga

SEQ ID NO: 271710 - DNA, 25 bp, Rattus norvegicus
ctgccatgttgaggctgccagagga

SEQ ID NO: 271711 - DNA, 25 bp, Rattus norvegicus
ctgccatgttggagcggctgcaaga

SEQ ID NO: 271712 - DNA, 25 bp, Rattus norvegicus
ctgccatgttggtgcggctgcaaga

SEQ ID NO: 271713 - DNA, 25 bp, Rattus norvegicus
ctgccattatccctgctattataat

SEQ ID NO: 271714 - DNA, 25 bp, Rattus norvegicus
ctgccattatccgtgctattataat

SEQ ID NO: 271715 - DNA, 25 bp, Rattus norvegicus
ctgccattctaaaggacctgggttc

SEQ ID NO: 271716 - DNA, 25 bp, Rattus norvegicus
ctgccattctaatggacctgggttc

SEQ ID NO: 271717 - DNA, 25 bp, Rattus norvegicus
ctgccattcttcatcttggaggaaa

SEQ ID NO: 271718 - DNA, 25 bp, Rattus norvegicus
ctgccattcttcttcttggaggaaa

SEQ ID NO: 271719 - DNA, 25 bp, Rattus norvegicus
ctgccattgctgcttttgtttttgg

SEQ ID NO: 271720 - DNA, 25 bp, Rattus norvegicus
ctgccattgctggttttgtttttgg

SEQ ID NO: 271721 - DNA, 25 bp, Rattus norvegicus
ctgccattgttcagagggctttcaa

SEQ ID NO: 271722 - DNA, 25 bp, Rattus norvegicus
ctgccattgttctgagggctttcaa

SEQ ID NO: 271723 - DNA, 25 bp, Rattus norvegicus
ctgccatttaatattagcctcgtat

SEQ ID NO: 271724 - DNA, 25 bp, Rattus norvegicus
ctgccatttaattttagcctcgtat

SEQ ID NO: 271725 - DNA, 25 bp, Rattus norvegicus
ctgccatttcctaattacttgctac

SEQ ID NO: 271726 - DNA, 25 bp, Rattus norvegicus
ctgccatttccttattacttgctac

SEQ ID NO: 271727 - DNA, 25 bp, Rattus norvegicus
ctgcccaacaggcttctctgaagaa

SEQ ID NO: 271728 - DNA, 25 bp, Rattus norvegicus
ctgcccaacagggttctctgaagaa

SEQ ID NO: 271729 - DNA, 25 bp, Rattus norvegicus
ctgcccaagggtcctgtgctctaca

SEQ ID NO: 271730 - DNA, 25 bp, Rattus norvegicus
ctgcccaagggtgctgtgctctaca

SEQ ID NO: 271731 - DNA, 25 bp, Rattus norvegicus
ctgcccacagagcacatcacattga

SEQ ID NO: 271732 - DNA, 25 bp, Rattus norvegicus
ctgcccacagaggacatcacattga

SEQ ID NO: 271733 - DNA, 25 bp, Rattus norvegicus
ctgcccacaggaccatgtacatatg

SEQ ID NO: 271734 - DNA, 25 bp, Rattus norvegicus
ctgcccacaggagcatgtacatatg

SEQ ID NO: 271735 - DNA, 25 bp, Rattus norvegicus
ctgcccacagtgcaggagctcaaag

SEQ ID NO: 271736 - DNA, 25 bp, Rattus norvegicus
ctgcccacagtggaggagctcaaag

SEQ ID NO: 271737 - DNA, 25 bp, Rattus norvegicus
ctgcccacatatcttacgtgcttaa

SEQ ID NO: 271738 - DNA, 25 bp, Rattus norvegicus
ctgcccacatatgttacgtgcttaa

SEQ ID NO: 271739 - DNA, 25 bp, Rattus norvegicus
ctgcccactggcacaagaagaggtg

SEQ ID NO: 271740 - DNA, 25 bp, Rattus norvegicus
ctgcccactggctcaagaagaggtg

SEQ ID NO: 271741 - DNA, 25 bp, Rattus norvegicus
ctgcccactgggattacgagaagaa

SEQ ID NO: 271742 - DNA, 25 bp, Rattus norvegicus
ctgcccactgggtttacgagaagaa

SEQ ID NO: 271743 - DNA, 25 bp, Rattus norvegicus
ctgcccagagtaccaactgtctttt

SEQ ID NO: 271744 - DNA, 25 bp, Rattus norvegicus
ctgcccagagtagcaactgtctttt

SEQ ID NO: 271745 - DNA, 25 bp, Rattus norvegicus
ctgcccagcactaggttactttgat

SEQ ID NO: 271746 - DNA, 25 bp, Rattus norvegicus
ctgcccagcacttggttactttgat

SEQ ID NO: 271747 - DNA, 25 bp, Rattus norvegicus
ctgcccagcagacgccaagtggttt

SEQ ID NO: 271748 - DNA, 25 bp, Rattus norvegicus
ctgcccagcagaggccaagtggttt

SEQ ID NO: 271749 - DNA, 25 bp, Rattus norvegicus
ctgcccagcctgagtcacaagaaga

SEQ ID NO: 271750 - DNA, 25 bp, Rattus norvegicus
ctgcccagcctgtgtcacaagaaga

SEQ ID NO: 271751 - DNA, 25 bp, Rattus norvegicus
ctgcccaggtcacttgtacgaggag

SEQ ID NO: 271752 - DNA, 25 bp, Rattus norvegicus
ctgcccaggtcagttgtacgaggag

SEQ ID NO: 271753 - DNA, 25 bp, Rattus norvegicus
ctgcccaggtttatgacctcatgaa

SEQ ID NO: 271754 - DNA, 25 bp, Rattus norvegicus
ctgcccaggtttttgacctcatgaa

SEQ ID NO: 271755 - DNA, 25 bp, Rattus norvegicus
ctgcccagtgccataaacgtgagaa

SEQ ID NO: 271756 - DNA, 25 bp, Rattus norvegicus
ctgcccagtgccttaaacgtgagaa

SEQ ID NO: 271757 - DNA, 25 bp, Rattus norvegicus
ctgcccagtgtcacaaagcacaagg

SEQ ID NO: 271758 - DNA, 25 bp, Rattus norvegicus
ctgcccagtgtctcaaagcacaagg

SEQ ID NO: 271759 - DNA, 25 bp, Rattus norvegicus
ctgcccagttccatttgatttctaa

SEQ ID NO: 271760 - DNA, 25 bp, Rattus norvegicus
ctgcccagttccttttgatttctaa

SEQ ID NO: 271761 - DNA, 25 bp, Rattus norvegicus
ctgcccataatgagagtgaccctct

SEQ ID NO: 271762 - DNA, 25 bp, Rattus norvegicus
ctgcccataatgtgagtgaccctct

SEQ ID NO: 271763 - DNA, 25 bp, Rattus norvegicus
ctgcccatacagacctttcattagg

SEQ ID NO: 271764 - DNA, 25 bp, Rattus norvegicus
ctgcccatacagtcctttcattagg

SEQ ID NO: 271765 - DNA, 25 bp, Rattus norvegicus
ctgcccatcattcggttaggctgat

SEQ ID NO: 271766 - DNA, 25 bp, Rattus norvegicus
ctgcccatcattgggttaggctgat

SEQ ID NO: 271767 - DNA, 25 bp, Rattus norvegicus
ctgcccatgggcaccattaaaaatg

SEQ ID NO: 271768 - DNA, 25 bp, Rattus norvegicus
ctgcccatgggctccattaaaaatg

SEQ ID NO: 271769 - DNA, 25 bp, Rattus norvegicus
ctgcccatggtgagtttggaaaaca

SEQ ID NO: 271770 - DNA, 25 bp, Rattus norvegicus
ctgcccatggtgtgtttggaaaaca

SEQ ID NO: 271771 - DNA, 25 bp, Rattus norvegicus
ctgcccatgtttcccatcttgatga

SEQ ID NO: 271772 - DNA, 25 bp, Rattus norvegicus
ctgcccatgtttgccatcttgatga

SEQ ID NO: 271773 - DNA, 25 bp, Rattus norvegicus
ctgccccacaagatttatatccaat

SEQ ID NO: 271774 - DNA, 25 bp, Rattus norvegicus
ctgccccacaagttttatatccaat

SEQ ID NO: 271775 - DNA, 25 bp, Rattus norvegicus
ctgccccacactcaatgaaactgaa

SEQ ID NO: 271776 - DNA, 25 bp, Rattus norvegicus
ctgccccacactgaatgaaactgaa

SEQ ID NO: 271777 - DNA, 25 bp, Rattus norvegicus
ctgccccacagaaccttttgtaaag

SEQ ID NO: 271778 - DNA, 25 bp, Rattus norvegicus
ctgccccacagatccttttgtaaag

SEQ ID NO: 271779 - DNA, 25 bp, Rattus norvegicus
ctgccccaccctaatgatattgtaa

SEQ ID NO: 271780 - DNA, 25 bp, Rattus norvegicus
ctgccccacccttatgatattgtaa

SEQ ID NO: 271781 - DNA, 25 bp, Rattus norvegicus
ctgccccagaagcagctttggaact

SEQ ID NO: 271782 - DNA, 25 bp, Rattus norvegicus
ctgccccagaaggagctttggaact

SEQ ID NO: 271783 - DNA, 25 bp, Rattus norvegicus
ctgccccagacaagactacgataga

SEQ ID NO: 271784 - DNA, 25 bp, Rattus norvegicus
ctgccccagacatgactacgataga

SEQ ID NO: 271785 - DNA, 25 bp, Rattus norvegicus
ctgccccagaccctgaatggtgtga

SEQ ID NO: 271786 - DNA, 25 bp, Rattus norvegicus
ctgccccagaccgtgaatggtgtga

SEQ ID NO: 271787 - DNA, 25 bp, Rattus norvegicus
ctgccccaggtaccgagtgaccttt

SEQ ID NO: 271788 - DNA, 25 bp, Rattus norvegicus
ctgccccaggtagcgagtgaccttt

SEQ ID NO: 271789 - DNA, 25 bp, Rattus norvegicus
ctgccccaggttctaagcaagttta

SEQ ID NO: 271790 - DNA, 25 bp, Rattus norvegicus
ctgccccaggttgtaagcaagttta

SEQ ID NO: 271791 - DNA, 25 bp, Rattus norvegicus
ctgccccattccctagagagaataa

SEQ ID NO: 271792 - DNA, 25 bp, Rattus norvegicus
ctgccccattccgtagagagaataa

SEQ ID NO: 271793 - DNA, 25 bp, Rattus norvegicus
ctgccccgacatacttgattcatgg

SEQ ID NO: 271794 - DNA, 25 bp, Rattus norvegicus
ctgccccgacattcttgattcatgg

SEQ ID NO: 271795 - DNA, 25 bp, Rattus norvegicus
ctgccccgggagacgctggccgtta

SEQ ID NO: 271796 - DNA, 25 bp, Rattus norvegicus
ctgccccgggagtcgctggccgtta

SEQ ID NO: 271797 - DNA, 25 bp, Rattus norvegicus
ctgcccctcagaaattcaatctctg

SEQ ID NO: 271798 - DNA, 25 bp, Rattus norvegicus
ctgcccctcagatattcaatctctg

SEQ ID NO: 271799 - DNA, 25 bp, Rattus norvegicus
ctgcccctccagattgcctggtgat

SEQ ID NO: 271800 - DNA, 25 bp, Rattus norvegicus
ctgcccctccagtttgcctggtgat

SEQ ID NO: 271801 - DNA, 25 bp, Rattus norvegicus
ctgcccctctgcacacttttctgtt

SEQ ID NO: 271802 - DNA, 25 bp, Rattus norvegicus
ctgcccctctgctcacttttctgtt

SEQ ID NO: 271803 - DNA, 25 bp, Rattus norvegicus
ctgcccctgaggatgacaaggctcc

SEQ ID NO: 271804 - DNA, 25 bp, Rattus norvegicus
ctgcccctgaggttgacaaggctcc

SEQ ID NO: 271805 - DNA, 25 bp, Rattus norvegicus
ctgcccctgatgaagctgatactag

SEQ ID NO: 271806 - DNA, 25 bp, Rattus norvegicus
ctgcccctgatgtagctgatactag

SEQ ID NO: 271807 - DNA, 25 bp, Rattus norvegicus
ctgccccttcatattgctgagaaaa

SEQ ID NO: 271808 - DNA, 25 bp, Rattus norvegicus
ctgccccttcattttgctgagaaaa

SEQ ID NO: 271809 - DNA, 25 bp, Rattus norvegicus
ctgccccttgctagggaagtggaag

SEQ ID NO: 271810 - DNA, 25 bp, Rattus norvegicus
ctgccccttgcttgggaagtggaag

SEQ ID NO: 271811 - DNA, 25 bp, Rattus norvegicus
ctgcccgcaggtatcaaagccaggg

SEQ ID NO: 271812 - DNA, 25 bp, Rattus norvegicus
ctgcccgcaggtttcaaagccaggg

SEQ ID NO: 271813 - DNA, 25 bp, Rattus norvegicus
ctgcccgctcaaactgtcaaataca

SEQ ID NO: 271814 - DNA, 25 bp, Rattus norvegicus
ctgcccgctcaatctgtcaaataca

SEQ ID NO: 271815 - DNA, 25 bp, Rattus norvegicus
ctgcccgctgcaattttgattatat

SEQ ID NO: 271816 - DNA, 25 bp, Rattus norvegicus
ctgcccgctgcatttttgattatat

SEQ ID NO: 271817 - DNA, 25 bp, Rattus norvegicus
ctgcccggattgcttaactttccat

SEQ ID NO: 271818 - DNA, 25 bp, Rattus norvegicus
ctgcccggattggttaactttccat

SEQ ID NO: 271819 - DNA, 25 bp, Rattus norvegicus
ctgcccggctgtcaaagatcacaaa

SEQ ID NO: 271820 - DNA, 25 bp, Rattus norvegicus
ctgcccggctgtgaaagatcacaaa

SEQ ID NO: 271821 - DNA, 25 bp, Rattus norvegicus
ctgcccgggtttatatatactatag

SEQ ID NO: 271822 - DNA, 25 bp, Rattus norvegicus
ctgcccgggtttttatatactatag

SEQ ID NO: 271823 - DNA, 25 bp, Rattus norvegicus
ctgcccggtctcagtgaatacaatt

SEQ ID NO: 271824 - DNA, 25 bp, Rattus norvegicus
ctgcccggtctctgtgaatacaatt

SEQ ID NO: 271825 - DNA, 25 bp, Rattus norvegicus
ctgcccgtctagatctcacaaaatg

SEQ ID NO: 271826 - DNA, 25 bp, Rattus norvegicus
ctgcccgtctagttctcacaaaatg

SEQ ID NO: 271827 - DNA, 25 bp, Rattus norvegicus
ctgccctaaagcagacgtcacagat

SEQ ID NO: 271828 - DNA, 25 bp, Rattus norvegicus
ctgccctaaagctgacgtcacagat

SEQ ID NO: 271829 - DNA, 25 bp, Rattus norvegicus
ctgccctaccagcaggtcagattca

SEQ ID NO: 271830 - DNA, 25 bp, Rattus norvegicus
ctgccctaccaggaggtcagattca

SEQ ID NO: 271831 - DNA, 25 bp, Rattus norvegicus
ctgccctcagttctgtagactagtt

SEQ ID NO: 271832 - DNA, 25 bp, Rattus norvegicus
ctgccctcagttgtgtagactagtt

SEQ ID NO: 271833 - DNA, 25 bp, Rattus norvegicus
ctgccctcattgctgttacctgaga

SEQ ID NO: 271834 - DNA, 25 bp, Rattus norvegicus
ctgccctcattggtgttacctgaga

SEQ ID NO: 271835 - DNA, 25 bp, Rattus norvegicus
ctgccctccattcttggaagacagg

SEQ ID NO: 271836 - DNA, 25 bp, Rattus norvegicus
ctgccctccattgttggaagacagg

SEQ ID NO: 271837 - DNA, 25 bp, Rattus norvegicus
ctgccctcccagaaagtaaatacac

SEQ ID NO: 271838 - DNA, 25 bp, Rattus norvegicus
ctgccctcccagtaagtaaatacac

SEQ ID NO: 271839 - DNA, 25 bp, Rattus norvegicus
ctgccctcctatcgaagacacgaga

SEQ ID NO: 271840 - DNA, 25 bp, Rattus norvegicus
ctgccctcctatggaagacacgaga

SEQ ID NO: 271841 - DNA, 25 bp, Rattus norvegicus
ctgccctccttcatacataaacaag

SEQ ID NO: 271842 - DNA, 25 bp, Rattus norvegicus
ctgccctccttcttacataaacaag

SEQ ID NO: 271843 - DNA, 25 bp, Rattus norvegicus
ctgccctcgctaatgtatctcttgg

SEQ ID NO: 271844 - DNA, 25 bp, Rattus norvegicus
ctgccctcgctattgtatctcttgg

SEQ ID NO: 271845 - DNA, 25 bp, Rattus norvegicus
ctgccctcggttattaaatgccgat

SEQ ID NO: 271846 - DNA, 25 bp, Rattus norvegicus
ctgccctcggtttttaaatgccgat

SEQ ID NO: 271847 - DNA, 25 bp, Rattus norvegicus
ctgccctcgtctactttcataaata

SEQ ID NO: 271848 - DNA, 25 bp, Rattus norvegicus
ctgccctcgtcttctttcataaata

SEQ ID NO: 271849 - DNA, 25 bp, Rattus norvegicus
ctgccctctgatctcctgaattctc

SEQ ID NO: 271850 - DNA, 25 bp, Rattus norvegicus
ctgccctctgatgtcctgaattctc

SEQ ID NO: 271851 - DNA, 25 bp, Rattus norvegicus
ctgccctctgtcctcaaagaaaatg

SEQ ID NO: 271852 - DNA, 25 bp, Rattus norvegicus
ctgccctctgtcgtcaaagaaaatg

SEQ ID NO: 271853 - DNA, 25 bp, Rattus norvegicus
ctgccctgaactctgtagctgctgg

SEQ ID NO: 271854 - DNA, 25 bp, Rattus norvegicus
ctgccctgaactgtgtagctgctgg

SEQ ID NO: 271855 - DNA, 25 bp, Rattus norvegicus
ctgccctgaatgactgtgagcctgg

SEQ ID NO: 271856 - DNA, 25 bp, Rattus norvegicus
ctgccctgaatgtctgtgagcctgg

SEQ ID NO: 271857 - DNA, 25 bp, Rattus norvegicus
ctgccctgaattattgaagacccca

SEQ ID NO: 271858 - DNA, 25 bp, Rattus norvegicus
ctgccctgaatttttgaagacccca

SEQ ID NO: 271859 - DNA, 25 bp, Rattus norvegicus
ctgccctgagttatttcgtgtaggg

SEQ ID NO: 271860 - DNA, 25 bp, Rattus norvegicus
ctgccctgagttttttcgtgtaggg

SEQ ID NO: 271861 - DNA, 25 bp, Rattus norvegicus
ctgccctgatggacacagctgagaa

SEQ ID NO: 271862 - DNA, 25 bp, Rattus norvegicus
ctgccctgatggtcacagctgagaa

SEQ ID NO: 271863 - DNA, 25 bp, Rattus norvegicus
ctgccctgcaagatttagatccaat

SEQ ID NO: 271864 - DNA, 25 bp, Rattus norvegicus
ctgccctgcaagttttagatccaat

SEQ ID NO: 271865 - DNA, 25 bp, Rattus norvegicus
ctgccctgcaggagtttatgaattt

SEQ ID NO: 271866 - DNA, 25 bp, Rattus norvegicus
ctgccctgcaggtgtttatgaattt

SEQ ID NO: 271867 - DNA, 25 bp, Rattus norvegicus
ctgccctggagcacacaaagtactt

SEQ ID NO: 271868 - DNA, 25 bp, Rattus norvegicus
ctgccctggagctcacaaagtactt

SEQ ID NO: 271869 - DNA, 25 bp, Rattus norvegicus
ctgccctggataactggtatttcac

SEQ ID NO: 271870 - DNA, 25 bp, Rattus norvegicus
ctgccctggatatctggtatttcac

SEQ ID NO: 271871 - DNA, 25 bp, Rattus norvegicus
ctgccctggctgctttagattacac

SEQ ID NO: 271872 - DNA, 25 bp, Rattus norvegicus
ctgccctggctggtttagattacac

SEQ ID NO: 271873 - DNA, 25 bp, Rattus norvegicus
ctgccctgggacctgtgacgtacag

SEQ ID NO: 271874 - DNA, 25 bp, Rattus norvegicus
ctgccctgggacgtgtgacgtacag

SEQ ID NO: 271875 - DNA, 25 bp, Rattus norvegicus
ctgccctgggataagaagttggcca

SEQ ID NO: 271876 - DNA, 25 bp, Rattus norvegicus
ctgccctgggattagaagttggcca

SEQ ID NO: 271877 - DNA, 25 bp, Rattus norvegicus
ctgccctgggtcacttagagggtta

SEQ ID NO: 271878 - DNA, 25 bp, Rattus norvegicus
ctgccctgggtcctgttttatatat

SEQ ID NO: 271879 - DNA, 25 bp, Rattus norvegicus
ctgccctgggtcgtgttttatatat

SEQ ID NO: 271880 - DNA, 25 bp, Rattus norvegicus
ctgccctgggtctcttagagggtta

SEQ ID NO: 271881 - DNA, 25 bp, Rattus norvegicus
ctgccctggtcacaattgctgcaaa

SEQ ID NO: 271882 - DNA, 25 bp, Rattus norvegicus
ctgccctggtcagaattgctgcaaa

SEQ ID NO: 271883 - DNA, 25 bp, Rattus norvegicus
ctgccctggttaataatgttgccct

SEQ ID NO: 271884 - DNA, 25 bp, Rattus norvegicus
ctgccctggttattaatgttgccct

SEQ ID NO: 271885 - DNA, 25 bp, Rattus norvegicus
ctgccctgtatgagtctttgtttga

SEQ ID NO: 271886 - DNA, 25 bp, Rattus norvegicus
ctgccctgtatgtgtctttgtttga

SEQ ID NO: 271887 - DNA, 25 bp, Rattus norvegicus
ctgccctgtcctctaaagtatctga

SEQ ID NO: 271888 - DNA, 25 bp, Rattus norvegicus
ctgccctgtcctgtaaagtatctga

SEQ ID NO: 271889 - DNA, 25 bp, Rattus norvegicus
ctgccctgtgagctaggtctagacc

SEQ ID NO: 271890 - DNA, 25 bp, Rattus norvegicus
ctgccctgtgaggtaggtctagacc

SEQ ID NO: 271891 - DNA, 25 bp, Rattus norvegicus
ctgccctgtgctaacgtaattgcat

SEQ ID NO: 271892 - DNA, 25 bp, Rattus norvegicus
ctgccctgtgcttacgtaattgcat

SEQ ID NO: 271893 - DNA, 25 bp, Rattus norvegicus
ctgccctgtggtaatatgtgctgta

SEQ ID NO: 271894 - DNA, 25 bp, Rattus norvegicus
ctgccctgtggttatatgtgctgta

SEQ ID NO: 271895 - DNA, 25 bp, Rattus norvegicus
ctgccctgtgtgacttcctttggtg

SEQ ID NO: 271896 - DNA, 25 bp, Rattus norvegicus
ctgccctgtgtgtcttcctttggtg

SEQ ID NO: 271897 - DNA, 25 bp, Rattus norvegicus
ctgcccttacccagagtcctgagtt

SEQ ID NO: 271898 - DNA, 25 bp, Rattus norvegicus
ctgcccttaccctgagtcctgagtt

SEQ ID NO: 271899 - DNA, 25 bp, Rattus norvegicus
ctgcccttactgctgagcggataaa

SEQ ID NO: 271900 - DNA, 25 bp, Rattus norvegicus
ctgcccttactggtgagcggataaa

SEQ ID NO: 271901 - DNA, 25 bp, Rattus norvegicus
ctgcccttcacaatgggaacagtat

SEQ ID NO: 271902 - DNA, 25 bp, Rattus norvegicus
ctgcccttcacattgggaacagtat

SEQ ID NO: 271903 - DNA, 25 bp, Rattus norvegicus
ctgcccttccccattaatgaatgaa

SEQ ID NO: 271904 - DNA, 25 bp, Rattus norvegicus
ctgcccttcccctttaatgaatgaa

SEQ ID NO: 271905 - DNA, 25 bp, Rattus norvegicus
ctgcccttcctcagagatgatggag

SEQ ID NO: 271906 - DNA, 25 bp, Rattus norvegicus
ctgcccttcctctgagatgatggag

SEQ ID NO: 271907 - DNA, 25 bp, Rattus norvegicus
ctgcccttcctgctttagttaacat

SEQ ID NO: 271908 - DNA, 25 bp, Rattus norvegicus
ctgcccttcctggtttagttaacat

SEQ ID NO: 271909 - DNA, 25 bp, Rattus norvegicus
ctgcccttccttcgttgtagaatat

SEQ ID NO: 271910 - DNA, 25 bp, Rattus norvegicus
ctgcccttccttggttgtagaatat

SEQ ID NO: 271911 - DNA, 25 bp, Rattus norvegicus
ctgcccttctgtcagactgatcgaa

SEQ ID NO: 271912 - DNA, 25 bp, Rattus norvegicus
ctgcccttctgtgagactgatcgaa

SEQ ID NO: 271913 - DNA, 25 bp, Rattus norvegicus
ctgcccttcttccaattcacaatat

SEQ ID NO: 271914 - DNA, 25 bp, Rattus norvegicus
ctgcccttcttcgaattcacaatat

SEQ ID NO: 271915 - DNA, 25 bp, Rattus norvegicus
ctgcccttgccaaatgttttatagc

SEQ ID NO: 271916 - DNA, 25 bp, Rattus norvegicus
ctgcccttgccatatgttttatagc

SEQ ID NO: 271917 - DNA, 25 bp, Rattus norvegicus
ctgcccttgtgccttagttagttcc

SEQ ID NO: 271918 - DNA, 25 bp, Rattus norvegicus
ctgcccttgtgcgttagttagttcc

SEQ ID NO: 271919 - DNA, 25 bp, Rattus norvegicus
ctgccctttaccatatcttttgaga

SEQ ID NO: 271920 - DNA, 25 bp, Rattus norvegicus
ctgccctttaccttatcttttgaga

SEQ ID NO: 271921 - DNA, 25 bp, Rattus norvegicus
ctgccctttccgatacatttgtatt

SEQ ID NO: 271922 - DNA, 25 bp, Rattus norvegicus
ctgccctttccgttacatttgtatt

SEQ ID NO: 271923 - DNA, 25 bp, Rattus norvegicus
ctgccctttgatcccgacattagtg

SEQ ID NO: 271924 - DNA, 25 bp, Rattus norvegicus
ctgccctttgatgccgacattagtg

SEQ ID NO: 271925 - DNA, 25 bp, Rattus norvegicus
ctgccctttttcacttggagatgtt

SEQ ID NO: 271926 - DNA, 25 bp, Rattus norvegicus
ctgccctttttctcttggagatgtt

SEQ ID NO: 271927 - DNA, 25 bp, Rattus norvegicus
ctgccgacactacccttggaagatt

SEQ ID NO: 271928 - DNA, 25 bp, Rattus norvegicus
ctgccgacactagccttggaagatt

SEQ ID NO: 271929 - DNA, 25 bp, Rattus norvegicus
ctgccgagcctaatttttctctaaa

SEQ ID NO: 271930 - DNA, 25 bp, Rattus norvegicus
ctgccgagcctattttttctctaaa

SEQ ID NO: 271931 - DNA, 25 bp, Rattus norvegicus
ctgccgagcttgattctatttcata

SEQ ID NO: 271932 - DNA, 25 bp, Rattus norvegicus
ctgccgagcttgtttctatttcata

SEQ ID NO: 271933 - DNA, 25 bp, Rattus norvegicus
ctgccgcaaagcagtaagggatata

SEQ ID NO: 271934 - DNA, 25 bp, Rattus norvegicus
ctgccgcaaagctgtaagggatata

SEQ ID NO: 271935 - DNA, 25 bp, Rattus norvegicus
ctgccgccaaacacagattcagact

SEQ ID NO: 271936 - DNA, 25 bp, Rattus norvegicus
ctgccgccaaactcagattcagact

SEQ ID NO: 271937 - DNA, 25 bp, Rattus norvegicus
ctgccgccacgcataatagactaag

SEQ ID NO: 271938 - DNA, 25 bp, Rattus norvegicus
ctgccgccacgcttaatagactaag

SEQ ID NO: 271939 - DNA, 25 bp, Rattus norvegicus
ctgccgccgccaagcaaagcgagga

SEQ ID NO: 271940 - DNA, 25 bp, Rattus norvegicus
ctgccgccgccatgcaaagcgagga

SEQ ID NO: 271941 - DNA, 25 bp, Rattus norvegicus
ctgccgcctgctcaaaggcctgtaa

SEQ ID NO: 271942 - DNA, 25 bp, Rattus norvegicus
ctgccgcctgctgaaaggcctgtaa

SEQ ID NO: 271943 - DNA, 25 bp, Rattus norvegicus
ctgccgcctgtcatcttgaagtaaa

SEQ ID NO: 271944 - DNA, 25 bp, Rattus norvegicus
ctgccgcctgtcttcttgaagtaaa

SEQ ID NO: 271945 - DNA, 25 bp, Rattus norvegicus
ctgccgctttcccatgaaatgttga

SEQ ID NO: 271946 - DNA, 25 bp, Rattus norvegicus
ctgccgctttccgatgaaatgttga

SEQ ID NO: 271947 - DNA, 25 bp, Rattus norvegicus
ctgccggcagctcatttggtacaat

SEQ ID NO: 271948 - DNA, 25 bp, Rattus norvegicus
ctgccggcagctgatttggtacaat

SEQ ID NO: 271949 - DNA, 25 bp, Rattus norvegicus
ctgccggcctcacggagtgaacatg

SEQ ID NO: 271950 - DNA, 25 bp, Rattus norvegicus
ctgccggcctcagggagtgaacatg

SEQ ID NO: 271951 - DNA, 25 bp, Rattus norvegicus
ctgccggctacaactggagggacat

SEQ ID NO: 271952 - DNA, 25 bp, Rattus norvegicus
ctgccggctacatctggagggacat

SEQ ID NO: 271953 - DNA, 25 bp, Rattus norvegicus
ctgccggctggtatgtttctgtata

SEQ ID NO: 271954 - DNA, 25 bp, Rattus norvegicus
ctgccggctggtttgtttctgtata

SEQ ID NO: 271955 - DNA, 25 bp, Rattus norvegicus
ctgccgggaagaagtggtccatgat

SEQ ID NO: 271956 - DNA, 25 bp, Rattus norvegicus
ctgccgggaagatgtggtccatgat

SEQ ID NO: 271957 - DNA, 25 bp, Rattus norvegicus
ctgccgggaagcctgtgaagatcaa

SEQ ID NO: 271958 - DNA, 25 bp, Rattus norvegicus
ctgccgggaagcgtgtgaagatcaa

SEQ ID NO: 271959 - DNA, 25 bp, Rattus norvegicus
ctgccgggctggcagtatgcacact

SEQ ID NO: 271960 - DNA, 25 bp, Rattus norvegicus
ctgccgggctgggagtatgcacact

SEQ ID NO: 271961 - DNA, 25 bp, Rattus norvegicus
ctgccggtgtctctagtttatctaa

SEQ ID NO: 271962 - DNA, 25 bp, Rattus norvegicus
ctgccggtgtctgtagtttatctaa

SEQ ID NO: 271963 - DNA, 25 bp, Rattus norvegicus
ctgccgtactgtcctgcttgacctg

SEQ ID NO: 271964 - DNA, 25 bp, Rattus norvegicus
ctgccgtactgtgctgcttgacctg

SEQ ID NO: 271965 - DNA, 25 bp, Rattus norvegicus
ctgccgtgcctgcaggacctggtat

SEQ ID NO: 271966 - DNA, 25 bp, Rattus norvegicus
ctgccgtgcctggaggacctggtat

SEQ ID NO: 271967 - DNA, 25 bp, Rattus norvegicus
ctgccgtggaggatcacagcaaggt

SEQ ID NO: 271968 - DNA, 25 bp, Rattus norvegicus
ctgccgtggaggttcacagcaaggt

SEQ ID NO: 271969 - DNA, 25 bp, Rattus norvegicus
ctgccgttagcgactgcgacgttcg

SEQ ID NO: 271970 - DNA, 25 bp, Rattus norvegicus
ctgccgttagcgtctgcgacgttcg

SEQ ID NO: 271971 - DNA, 25 bp, Rattus norvegicus
ctgccgttcagaccgtctggcaaaa

SEQ ID NO: 271972 - DNA, 25 bp, Rattus norvegicus
ctgccgttcagagcgtctggcaaaa

SEQ ID NO: 271973 - DNA, 25 bp, Rattus norvegicus
ctgccgttttggacttggtacaaat

SEQ ID NO: 271974 - DNA, 25 bp, Rattus norvegicus
ctgccgttttggtcttggtacaaat

SEQ ID NO: 271975 - DNA, 25 bp, Rattus norvegicus
ctgcctaagttcactggtcttgaat

SEQ ID NO: 271976 - DNA, 25 bp, Rattus norvegicus
ctgcctaagttctctggtcttgaat

SEQ ID NO: 271977 - DNA, 25 bp, Rattus norvegicus
ctgcctacaagaaacatctagtttt

SEQ ID NO: 271978 - DNA, 25 bp, Rattus norvegicus
ctgcctacaagatacatctagtttt

SEQ ID NO: 271979 - DNA, 25 bp, Rattus norvegicus
ctgcctacagggaagagaccccgga

SEQ ID NO: 271980 - DNA, 25 bp, Rattus norvegicus
ctgcctacagggtagagaccccgga

SEQ ID NO: 271981 - DNA, 25 bp, Rattus norvegicus
ctgcctacatcccaagactgagatt

SEQ ID NO: 271982 - DNA, 25 bp, Rattus norvegicus
ctgcctacatccgaagactgagatt

SEQ ID NO: 271983 - DNA, 25 bp, Rattus norvegicus
ctgcctaccagaatcctaatgttat

SEQ ID NO: 271984 - DNA, 25 bp, Rattus norvegicus
ctgcctaccagattcctaatgttat

SEQ ID NO: 271985 - DNA, 25 bp, Rattus norvegicus
ctgcctactgaaagtcacccagata

SEQ ID NO: 271986 - DNA, 25 bp, Rattus norvegicus
ctgcctactgaatgtcacccagata

SEQ ID NO: 271987 - DNA, 25 bp, Rattus norvegicus
ctgcctactggcaactactttggag

SEQ ID NO: 271988 - DNA, 25 bp, Rattus norvegicus
ctgcctactggctactactttggag

SEQ ID NO: 271989 - DNA, 25 bp, Rattus norvegicus
ctgcctagaagtacctgcacagagc

SEQ ID NO: 271990 - DNA, 25 bp, Rattus norvegicus
ctgcctagaagttcctgcacagagc

SEQ ID NO: 271991 - DNA, 25 bp, Rattus norvegicus
ctgcctagacccagattcagcaagg

SEQ ID NO: 271992 - DNA, 25 bp, Rattus norvegicus
ctgcctagaccctgattcagcaagg

SEQ ID NO: 271993 - DNA, 25 bp, Rattus norvegicus
ctgcctagatggatactttgctttc

SEQ ID NO: 271994 - DNA, 25 bp, Rattus norvegicus
ctgcctagatggttactttgctttc

SEQ ID NO: 271995 - DNA, 25 bp, Rattus norvegicus
ctgcctagcagacggagtgagactc

SEQ ID NO: 271996 - DNA, 25 bp, Rattus norvegicus
ctgcctagcagagggagtgagactc

SEQ ID NO: 271997 - DNA, 25 bp, Rattus norvegicus
ctgcctagggctacggatacctggt

SEQ ID NO: 271998 - DNA, 25 bp, Rattus norvegicus
ctgcctagggcttcggatacctggt

SEQ ID NO: 271999 - DNA, 25 bp, Rattus norvegicus
ctgcctagtgacaccctaaagtttt

SEQ ID NO: 272000 - DNA, 25 bp, Rattus norvegicus
ctgcctagtgactccctaaagtttt

SEQ ID NO: 272001 - DNA, 25 bp, Rattus norvegicus
ctgcctagttaccactgtgcaaatc

SEQ ID NO: 272002 - DNA, 25 bp, Rattus norvegicus
ctgcctagttacgactgtgcaaatc

SEQ ID NO: 272003 - DNA, 25 bp, Rattus norvegicus
ctgcctatgattaaagccatctctt

SEQ ID NO: 272004 - DNA, 25 bp, Rattus norvegicus
ctgcctatgatttaagccatctctt

SEQ ID NO: 272005 - DNA, 25 bp, Rattus norvegicus
ctgcctatggcaacatcgacaacaa

SEQ ID NO: 272006 - DNA, 25 bp, Rattus norvegicus
ctgcctatggcatcatcgacaacaa

SEQ ID NO: 272007 - DNA, 25 bp, Rattus norvegicus
ctgcctattttcatgctaattacag

SEQ ID NO: 272008 - DNA, 25 bp, Rattus norvegicus
ctgcctattttcttgctaattacag

SEQ ID NO: 272009 - DNA, 25 bp, Rattus norvegicus
ctgcctcaatgtcataaacccgtgg

SEQ ID NO: 272010 - DNA, 25 bp, Rattus norvegicus
ctgcctcaatgtgataaacccgtgg

SEQ ID NO: 272011 - DNA, 25 bp, Rattus norvegicus
ctgcctcaccagaccaagtataaag

SEQ ID NO: 272012 - DNA, 25 bp, Rattus norvegicus
ctgcctcaccagtccaagtataaag

SEQ ID NO: 272013 - DNA, 25 bp, Rattus norvegicus
ctgcctcactgtcaggaatgaagaa

SEQ ID NO: 272014 - DNA, 25 bp, Rattus norvegicus
ctgcctcactgtgaggaatgaagaa

SEQ ID NO: 272015 - DNA, 25 bp, Rattus norvegicus
ctgcctcagctgcttgaatgctgga

SEQ ID NO: 272016 - DNA, 25 bp, Rattus norvegicus
ctgcctcagctggttgaatgctgga

SEQ ID NO: 272017 - DNA, 25 bp, Rattus norvegicus
ctgcctcagtatccctcagatagta

SEQ ID NO: 272018 - DNA, 25 bp, Rattus norvegicus
ctgcctcagtatgcctcagatagta

SEQ ID NO: 272019 - DNA, 25 bp, Rattus norvegicus
ctgcctcatcagaatgccaggatta

SEQ ID NO: 272020 - DNA, 25 bp, Rattus norvegicus
ctgcctcatcagtatgccaggatta

SEQ ID NO: 272021 - DNA, 25 bp, Rattus norvegicus
ctgcctcatctcagtaacaacgaca

SEQ ID NO: 272022 - DNA, 25 bp, Rattus norvegicus
ctgcctcatctctgtaacaacgaca

SEQ ID NO: 272023 - DNA, 25 bp, Rattus norvegicus
ctgcctcatggcattgtcttgtggg

SEQ ID NO: 272024 - DNA, 25 bp, Rattus norvegicus
ctgcctcatggctttgtcttgtggg

SEQ ID NO: 272025 - DNA, 25 bp, Rattus norvegicus
ctgcctccagagagccaatgttaaa

SEQ ID NO: 272026 - DNA, 25 bp, Rattus norvegicus
ctgcctccagagtgccaatgttaaa

SEQ ID NO: 272027 - DNA, 25 bp, Rattus norvegicus
ctgcctccagtgaaatttcacaggt

SEQ ID NO: 272028 - DNA, 25 bp, Rattus norvegicus
ctgcctccagtgtaatttcacaggt

SEQ ID NO: 272029 - DNA, 25 bp, Rattus norvegicus
ctgcctccagttactgtaatgcaaa

SEQ ID NO: 272030 - DNA, 25 bp, Rattus norvegicus
ctgcctccagtttctgtaatgcaaa

SEQ ID NO: 272031 - DNA, 25 bp, Rattus norvegicus
ctgcctccatttcaagagctgggtt

SEQ ID NO: 272032 - DNA, 25 bp, Rattus norvegicus
ctgcctccatttgaagagctgggtt

SEQ ID NO: 272033 - DNA, 25 bp, Rattus norvegicus
ctgcctcccaagcatagaattgaaa

SEQ ID NO: 272034 - DNA, 25 bp, Rattus norvegicus
ctgcctcccaaggatagaattgaaa

SEQ ID NO: 272035 - DNA, 25 bp, Rattus norvegicus
ctgcctcccgagaactggtgttaaa

SEQ ID NO: 272036 - DNA, 25 bp, Rattus norvegicus
ctgcctcccgagtactggtgttaaa

SEQ ID NO: 272037 - DNA, 25 bp, Rattus norvegicus
ctgcctcccttgaagattgtccaaa

SEQ ID NO: 272038 - DNA, 25 bp, Rattus norvegicus
ctgcctcccttgtagattgtccaaa

SEQ ID NO: 272039 - DNA, 25 bp, Rattus norvegicus
ctgcctccgaagcatttcacagaag

SEQ ID NO: 272040 - DNA, 25 bp, Rattus norvegicus
ctgcctccgaaggatttcacagaag

SEQ ID NO: 272041 - DNA, 25 bp, Rattus norvegicus
ctgcctccgaatcctggtattagat

SEQ ID NO: 272042 - DNA, 25 bp, Rattus norvegicus
ctgcctccgaatgctggtattagat

SEQ ID NO: 272043 - DNA, 25 bp, Rattus norvegicus
ctgcctccgcagaaaaacatgaaaa

SEQ ID NO: 272044 - DNA, 25 bp, Rattus norvegicus
ctgcctccgcagtaaaacatgaaaa

SEQ ID NO: 272045 - DNA, 25 bp, Rattus norvegicus
ctgcctccgctgatttagaactagt

SEQ ID NO: 272046 - DNA, 25 bp, Rattus norvegicus
ctgcctccgctgttttagaactagt

SEQ ID NO: 272047 - DNA, 25 bp, Rattus norvegicus
ctgcctccgttgctgtttttacata

SEQ ID NO: 272048 - DNA, 25 bp, Rattus norvegicus
ctgcctccgttggtgtttttacata

SEQ ID NO: 272049 - DNA, 25 bp, Rattus norvegicus
ctgcctcctattacaaactgtgtat

SEQ ID NO: 272050 - DNA, 25 bp, Rattus norvegicus
ctgcctcctatttcaaactgtgtat

SEQ ID NO: 272051 - DNA, 25 bp, Rattus norvegicus
ctgcctcctgacagcggttttaaag

SEQ ID NO: 272052 - DNA, 25 bp, Rattus norvegicus
ctgcctcctgactgcggttttaaag

SEQ ID NO: 272053 - DNA, 25 bp, Rattus norvegicus
ctgcctcctgagaatgggttagttt

SEQ ID NO: 272054 - DNA, 25 bp, Rattus norvegicus
ctgcctcctgagcaccactggaaat

SEQ ID NO: 272055 - DNA, 25 bp, Rattus norvegicus
ctgcctcctgaggaccactggaaat

SEQ ID NO: 272056 - DNA, 25 bp, Rattus norvegicus
ctgcctcctgagtatgggttagttt

SEQ ID NO: 272057 - DNA, 25 bp, Rattus norvegicus
ctgcctccttcaccgtataaagtga

SEQ ID NO: 272058 - DNA, 25 bp, Rattus norvegicus
ctgcctccttcagcgtataaagtga

SEQ ID NO: 272059 - DNA, 25 bp, Rattus norvegicus
ctgcctccttgacatgctgtatata

SEQ ID NO: 272060 - DNA, 25 bp, Rattus norvegicus
ctgcctccttgagatgctgtatata

SEQ ID NO: 272061 - DNA, 25 bp, Rattus norvegicus
ctgcctctagcacgctgtgacgtga

SEQ ID NO: 272062 - DNA, 25 bp, Rattus norvegicus
ctgcctctagcaggctgtgacgtga

SEQ ID NO: 272063 - DNA, 25 bp, Rattus norvegicus
ctgcctctctgtcttctaaacatgg

SEQ ID NO: 272064 - DNA, 25 bp, Rattus norvegicus
ctgcctctctgtgttctaaacatgg

SEQ ID NO: 272065 - DNA, 25 bp, Rattus norvegicus
ctgcctctgacacctgtctttaaat

SEQ ID NO: 272066 - DNA, 25 bp, Rattus norvegicus
ctgcctctgacagctgtctttaaat

SEQ ID NO: 272067 - DNA, 25 bp, Rattus norvegicus
ctgcctctgaggagctgtttaattc

SEQ ID NO: 272068 - DNA, 25 bp, Rattus norvegicus
ctgcctctgaggatgcccacttggg

SEQ ID NO: 272069 - DNA, 25 bp, Rattus norvegicus
ctgcctctgaggtgctgtttaattc

SEQ ID NO: 272070 - DNA, 25 bp, Rattus norvegicus
ctgcctctgaggttgcccacttggg

SEQ ID NO: 272071 - DNA, 25 bp, Rattus norvegicus
ctgcctctggaaatcttttctggtt

SEQ ID NO: 272072 - DNA, 25 bp, Rattus norvegicus
ctgcctctggaattcttttctggtt

SEQ ID NO: 272073 - DNA, 25 bp, Rattus norvegicus
ctgcctctgggcagaagaactttgg

SEQ ID NO: 272074 - DNA, 25 bp, Rattus norvegicus
ctgcctctgggctgaagaactttgg

SEQ ID NO: 272075 - DNA, 25 bp, Rattus norvegicus
ctgcctcttctaagcaaacctgaaa

SEQ ID NO: 272076 - DNA, 25 bp, Rattus norvegicus
ctgcctcttctatgcaaacctgaaa

SEQ ID NO: 272077 - DNA, 25 bp, Rattus norvegicus
ctgcctcttgcgaagtatccggcaa

SEQ ID NO: 272078 - DNA, 25 bp, Rattus norvegicus
ctgcctcttgcgtagtatccggcaa

SEQ ID NO: 272079 - DNA, 25 bp, Rattus norvegicus
ctgcctctttgcaagtcttacttta

SEQ ID NO: 272080 - DNA, 25 bp, Rattus norvegicus
ctgcctctttgctagtcttacttta

SEQ ID NO: 272081 - DNA, 25 bp, Rattus norvegicus
ctgcctcttttgataaccagattca

SEQ ID NO: 272082 - DNA, 25 bp, Rattus norvegicus
ctgcctcttttgttaaccagattca

SEQ ID NO: 272083 - DNA, 25 bp, Rattus norvegicus
ctgcctgaaagcactgtattgtatt

SEQ ID NO: 272084 - DNA, 25 bp, Rattus norvegicus
ctgcctgaaagctctgtattgtatt

SEQ ID NO: 272085 - DNA, 25 bp, Rattus norvegicus
ctgcctgaaatgcagattgccctgc

SEQ ID NO: 272086 - DNA, 25 bp, Rattus norvegicus
ctgcctgaaatggagattgccctgc

SEQ ID NO: 272087 - DNA, 25 bp, Rattus norvegicus
ctgcctgaacttaatcttgggaatc

SEQ ID NO: 272088 - DNA, 25 bp, Rattus norvegicus
ctgcctgaactttatcttgggaatc

SEQ ID NO: 272089 - DNA, 25 bp, Rattus norvegicus
ctgcctgaaggccttggtgctcaag

SEQ ID NO: 272090 - DNA, 25 bp, Rattus norvegicus
ctgcctgaaggcgttggtgctcaag

SEQ ID NO: 272091 - DNA, 25 bp, Rattus norvegicus
ctgcctgaagttcgtgctggtagcc

SEQ ID NO: 272092 - DNA, 25 bp, Rattus norvegicus
ctgcctgaagttggtgctggtagcc

SEQ ID NO: 272093 - DNA, 25 bp, Rattus norvegicus
ctgcctgaatggacgaatggtctgt

SEQ ID NO: 272094 - DNA, 25 bp, Rattus norvegicus
ctgcctgaatggtcgaatggtctgt

SEQ ID NO: 272095 - DNA, 25 bp, Rattus norvegicus
ctgcctgacaggcagagtctacaga

SEQ ID NO: 272096 - DNA, 25 bp, Rattus norvegicus
ctgcctgacagggagagtctacaga

SEQ ID NO: 272097 - DNA, 25 bp, Rattus norvegicus
ctgcctgacatgctatcacctttaa

SEQ ID NO: 272098 - DNA, 25 bp, Rattus norvegicus
ctgcctgacatggtatcacctttaa

SEQ ID NO: 272099 - DNA, 25 bp, Rattus norvegicus
ctgcctgactttctctaagcaatgc

SEQ ID NO: 272100 - DNA, 25 bp, Rattus norvegicus
ctgcctgactttgtctaagcaatgc

SEQ ID NO: 272101 - DNA, 25 bp, Rattus norvegicus
ctgcctgagagcaccttggtcaagg

SEQ ID NO: 272102 - DNA, 25 bp, Rattus norvegicus
ctgcctgagagctccttggtcaagg

SEQ ID NO: 272103 - DNA, 25 bp, Rattus norvegicus
ctgcctgagatgcagtgcttaactt

SEQ ID NO: 272104 - DNA, 25 bp, Rattus norvegicus
ctgcctgagatggagtgcttaactt

SEQ ID NO: 272105 - DNA, 25 bp, Rattus norvegicus
ctgcctgagcaccataggtctttac

SEQ ID NO: 272106 - DNA, 25 bp, Rattus norvegicus
ctgcctgagcacgataggtctttac

SEQ ID NO: 272107 - DNA, 25 bp, Rattus norvegicus
ctgcctgagcagaaccaaggtctta

SEQ ID NO: 272108 - DNA, 25 bp, Rattus norvegicus
ctgcctgagcagtaccaaggtctta

SEQ ID NO: 272109 - DNA, 25 bp, Rattus norvegicus
ctgcctgatatgcatgctggtaata

SEQ ID NO: 272110 - DNA, 25 bp, Rattus norvegicus
ctgcctgatatggatgctggtaata

SEQ ID NO: 272111 - DNA, 25 bp, Rattus norvegicus
ctgcctgatgtactctctgggttga

SEQ ID NO: 272112 - DNA, 25 bp, Rattus norvegicus
ctgcctgatgtagtctctgggttga

SEQ ID NO: 272113 - DNA, 25 bp, Rattus norvegicus
ctgcctgcaggccttttgtttgttt

SEQ ID NO: 272114 - DNA, 25 bp, Rattus norvegicus
ctgcctgcaggcgttttgtttgttt

SEQ ID NO: 272115 - DNA, 25 bp, Rattus norvegicus
ctgcctgccctaatgtgaggaagta

SEQ ID NO: 272116 - DNA, 25 bp, Rattus norvegicus
ctgcctgccctattgtgaggaagta

SEQ ID NO: 272117 - DNA, 25 bp, Rattus norvegicus
ctgcctgccctgagtcgaaagatgg

SEQ ID NO: 272118 - DNA, 25 bp, Rattus norvegicus
ctgcctgccctgtgtcgaaagatgg

SEQ ID NO: 272119 - DNA, 25 bp, Rattus norvegicus
ctgcctgccgtcacagtgtaactga

SEQ ID NO: 272120 - DNA, 25 bp, Rattus norvegicus
ctgcctgccgtctcagtgtaactga

SEQ ID NO: 272121 - DNA, 25 bp, Rattus norvegicus
ctgcctgcctcgctaaaaccaagaa

SEQ ID NO: 272122 - DNA, 25 bp, Rattus norvegicus
ctgcctgcctcggtaaaaccaagaa

SEQ ID NO: 272123 - DNA, 25 bp, Rattus norvegicus
ctgcctgccttgaaggagccgataa

SEQ ID NO: 272124 - DNA, 25 bp, Rattus norvegicus
ctgcctgccttgagattatgacttg

SEQ ID NO: 272125 - DNA, 25 bp, Rattus norvegicus
ctgcctgccttgtaggagccgataa

SEQ ID NO: 272126 - DNA, 25 bp, Rattus norvegicus
ctgcctgccttgtgattatgacttg

SEQ ID NO: 272127 - DNA, 25 bp, Rattus norvegicus
ctgcctgcgggcctgtttaaaaact

SEQ ID NO: 272128 - DNA, 25 bp, Rattus norvegicus
ctgcctgcgggcgtgtttaaaaact

SEQ ID NO: 272129 - DNA, 25 bp, Rattus norvegicus
ctgcctgcgggtaagagttttgtca

SEQ ID NO: 272130 - DNA, 25 bp, Rattus norvegicus
ctgcctgcgggttagagttttgtca

SEQ ID NO: 272131 - DNA, 25 bp, Rattus norvegicus
ctgcctgctcacaatcaattctaaa

SEQ ID NO: 272132 - DNA, 25 bp, Rattus norvegicus
ctgcctgctcactatcaattctaaa

SEQ ID NO: 272133 - DNA, 25 bp, Rattus norvegicus
ctgcctgctgaactggtctgatttt

SEQ ID NO: 272134 - DNA, 25 bp, Rattus norvegicus
ctgcctgctgaagtggtctgatttt

SEQ ID NO: 272135 - DNA, 25 bp, Rattus norvegicus
ctgcctgctggaccaccatgggagt

SEQ ID NO: 272136 - DNA, 25 bp, Rattus norvegicus
ctgcctgctggagcaccatgggagt

SEQ ID NO: 272137 - DNA, 25 bp, Rattus norvegicus
ctgcctgctgggaacactcaaggta

SEQ ID NO: 272138 - DNA, 25 bp, Rattus norvegicus
ctgcctgctgggtacactcaaggta

SEQ ID NO: 272139 - DNA, 25 bp, Rattus norvegicus
ctgcctgcttacagtgctagaaata

SEQ ID NO: 272140 - DNA, 25 bp, Rattus norvegicus
ctgcctgcttactgtgctagaaata

SEQ ID NO: 272141 - DNA, 25 bp, Rattus norvegicus
ctgcctgcttctcaactgtgtgtaa

SEQ ID NO: 272142 - DNA, 25 bp, Rattus norvegicus
ctgcctgcttctgaactgtgtgtaa

SEQ ID NO: 272143 - DNA, 25 bp, Rattus norvegicus
ctgcctggaaatatgttcttctttt

SEQ ID NO: 272144 - DNA, 25 bp, Rattus norvegicus
ctgcctggaaatttgttcttctttt

SEQ ID NO: 272145 - DNA, 25 bp, Rattus norvegicus
ctgcctggaagtcaccactcagaga

SEQ ID NO: 272146 - DNA, 25 bp, Rattus norvegicus
ctgcctggaagtgaccactcagaga

SEQ ID NO: 272147 - DNA, 25 bp, Rattus norvegicus
ctgcctggactcatctcaagttgaa

SEQ ID NO: 272148 - DNA, 25 bp, Rattus norvegicus
ctgcctggactcttctcaagttgaa

SEQ ID NO: 272149 - DNA, 25 bp, Rattus norvegicus
ctgcctggactgaatgtggatgtgt

SEQ ID NO: 272150 - DNA, 25 bp, Rattus norvegicus
ctgcctggactgtatgtggatgtgt

SEQ ID NO: 272151 - DNA, 25 bp, Rattus norvegicus
ctgcctggagttactttttcatcaa

SEQ ID NO: 272152 - DNA, 25 bp, Rattus norvegicus
ctgcctggagtttctttttcatcaa

SEQ ID NO: 272153 - DNA, 25 bp, Rattus norvegicus
ctgcctggcatcatggtgtgggcaa

SEQ ID NO: 272154 - DNA, 25 bp, Rattus norvegicus
ctgcctggcatcttggtgtgggcaa

SEQ ID NO: 272155 - DNA, 25 bp, Rattus norvegicus
ctgcctggcctcagtaaatgtgttg

SEQ ID NO: 272156 - DNA, 25 bp, Rattus norvegicus
ctgcctggcctctgtaaatgtgttg

SEQ ID NO: 272157 - DNA, 25 bp, Rattus norvegicus
ctgcctggcgtgagaggatactgcc

SEQ ID NO: 272158 - DNA, 25 bp, Rattus norvegicus
ctgcctggcgtgtgaggatactgcc

SEQ ID NO: 272159 - DNA, 25 bp, Rattus norvegicus
ctgcctggctgactagctgcaggaa

SEQ ID NO: 272160 - DNA, 25 bp, Rattus norvegicus
ctgcctggctgagtagctgcaggaa

SEQ ID NO: 272161 - DNA, 25 bp, Rattus norvegicus
ctgcctggcttcagttgagaagtta

SEQ ID NO: 272162 - DNA, 25 bp, Rattus norvegicus
ctgcctggcttctgttgagaagtta

SEQ ID NO: 272163 - DNA, 25 bp, Rattus norvegicus
ctgcctgggacacccaaaaggcttt

SEQ ID NO: 272164 - DNA, 25 bp, Rattus norvegicus
ctgcctgggacagccaaaaggcttt

SEQ ID NO: 272165 - DNA, 25 bp, Rattus norvegicus
ctgcctgggcaacactaagggccgc

SEQ ID NO: 272166 - DNA, 25 bp, Rattus norvegicus
ctgcctgggcaagactaagggccgc

SEQ ID NO: 272167 - DNA, 25 bp, Rattus norvegicus
ctgcctgggctaatggatatggatc

SEQ ID NO: 272168 - DNA, 25 bp, Rattus norvegicus
ctgcctgggctattggatatggatc

SEQ ID NO: 272169 - DNA, 25 bp, Rattus norvegicus
ctgcctgggctgcaattccaagtag

SEQ ID NO: 272170 - DNA, 25 bp, Rattus norvegicus
ctgcctgggctggaattccaagtag

SEQ ID NO: 272171 - DNA, 25 bp, Rattus norvegicus
ctgcctgggtctccccaaggattgg

SEQ ID NO: 272172 - DNA, 25 bp, Rattus norvegicus
ctgcctgggtctgcccaaggattgg

SEQ ID NO: 272173 - DNA, 25 bp, Rattus norvegicus
ctgcctggtccactttaatacccaa

SEQ ID NO: 272174 - DNA, 25 bp, Rattus norvegicus
ctgcctggtccagtttaatacccaa

SEQ ID NO: 272175 - DNA, 25 bp, Rattus norvegicus
ctgcctggtcttaggattactgtca

SEQ ID NO: 272176 - DNA, 25 bp, Rattus norvegicus
ctgcctggtcttccatttgcaggat

SEQ ID NO: 272177 - DNA, 25 bp, Rattus norvegicus
ctgcctggtcttgcatttgcaggat

SEQ ID NO: 272178 - DNA, 25 bp, Rattus norvegicus
ctgcctggtctttggattactgtca

SEQ ID NO: 272179 - DNA, 25 bp, Rattus norvegicus
ctgcctggtgcaagaaaactcttat

SEQ ID NO: 272180 - DNA, 25 bp, Rattus norvegicus
ctgcctggtgcatgaaaactcttat

SEQ ID NO: 272181 - DNA, 25 bp, Rattus norvegicus
ctgcctggtgtgattcttgtgtcta

SEQ ID NO: 272182 - DNA, 25 bp, Rattus norvegicus
ctgcctggtgtgtttcttgtgtcta

SEQ ID NO: 272183 - DNA, 25 bp, Rattus norvegicus
ctgcctgtacagacaccgtggatgt

SEQ ID NO: 272184 - DNA, 25 bp, Rattus norvegicus
ctgcctgtacagtcaccgtggatgt

SEQ ID NO: 272185 - DNA, 25 bp, Rattus norvegicus
ctgcctgtagctcgcttatacttga

SEQ ID NO: 272186 - DNA, 25 bp, Rattus norvegicus
ctgcctgtagctggcttatacttga

SEQ ID NO: 272187 - DNA, 25 bp, Rattus norvegicus
ctgcctgtaggactagccctggaaa

SEQ ID NO: 272188 - DNA, 25 bp, Rattus norvegicus
ctgcctgtaggagtagccctggaaa

SEQ ID NO: 272189 - DNA, 25 bp, Rattus norvegicus
ctgcctgtcaggatgttgctatata

SEQ ID NO: 272190 - DNA, 25 bp, Rattus norvegicus
ctgcctgtcaggttgttgctatata

SEQ ID NO: 272191 - DNA, 25 bp, Rattus norvegicus
ctgcctgtcccacagtacagggaaa

SEQ ID NO: 272192 - DNA, 25 bp, Rattus norvegicus
ctgcctgtcccagagtacagggaaa

SEQ ID NO: 272193 - DNA, 25 bp, Rattus norvegicus
ctgcctgtctggcatgcccaggatc

SEQ ID NO: 272194 - DNA, 25 bp, Rattus norvegicus
ctgcctgtctgggatgcccaggatc

SEQ ID NO: 272195 - DNA, 25 bp, Rattus norvegicus
ctgcctgtgcgtcggactttatcaa

SEQ ID NO: 272196 - DNA, 25 bp, Rattus norvegicus
ctgcctgtgcgtgggactttatcaa

SEQ ID NO: 272197 - DNA, 25 bp, Rattus norvegicus
ctgcctgtgtaccttcagtgattaa

SEQ ID NO: 272198 - DNA, 25 bp, Rattus norvegicus
ctgcctgtgtacgttcagtgattaa

SEQ ID NO: 272199 - DNA, 25 bp, Rattus norvegicus
ctgcctgtgtggacaggaggcccac

SEQ ID NO: 272200 - DNA, 25 bp, Rattus norvegicus
ctgcctgtgtggtcaggaggcccac

SEQ ID NO: 272201 - DNA, 25 bp, Rattus norvegicus
ctgcctgttctaaatgatggtcttt

SEQ ID NO: 272202 - DNA, 25 bp, Rattus norvegicus
ctgcctgttctatatgatggtcttt

SEQ ID NO: 272203 - DNA, 25 bp, Rattus norvegicus
ctgcctgttgacatcaaaacgccta

SEQ ID NO: 272204 - DNA, 25 bp, Rattus norvegicus
ctgcctgttgacttcaaaacgccta

SEQ ID NO: 272205 - DNA, 25 bp, Rattus norvegicus
ctgcctgttgcacaatcagctttct

SEQ ID NO: 272206 - DNA, 25 bp, Rattus norvegicus
ctgcctgttgcagaatcagctttct

SEQ ID NO: 272207 - DNA, 25 bp, Rattus norvegicus
ctgcctgtttgaagtcactccaaga

SEQ ID NO: 272208 - DNA, 25 bp, Rattus norvegicus
ctgcctgtttgatgtcactccaaga

SEQ ID NO: 272209 - DNA, 25 bp, Rattus norvegicus
ctgcctgtttgcagagggccaacat

SEQ ID NO: 272210 - DNA, 25 bp, Rattus norvegicus
ctgcctgtttgctgagggccaacat

SEQ ID NO: 272211 - DNA, 25 bp, Rattus norvegicus
ctgccttaagtacacacaatgttta

SEQ ID NO: 272212 - DNA, 25 bp, Rattus norvegicus
ctgccttaagtagacacaatgttta

SEQ ID NO: 272213 - DNA, 25 bp, Rattus norvegicus
ctgccttactggcattccatgtgtt

SEQ ID NO: 272214 - DNA, 25 bp, Rattus norvegicus
ctgccttactgggattccatgtgtt

SEQ ID NO: 272215 - DNA, 25 bp, Rattus norvegicus
ctgccttacttcaatgtcatctact

SEQ ID NO: 272216 - DNA, 25 bp, Rattus norvegicus
ctgccttacttctatgtcatctact

SEQ ID NO: 272217 - DNA, 25 bp, Rattus norvegicus
ctgccttagcccagtggtgctttaa

SEQ ID NO: 272218 - DNA, 25 bp, Rattus norvegicus
ctgccttagcccattaatatgcctg

SEQ ID NO: 272219 - DNA, 25 bp, Rattus norvegicus
ctgccttagccctgtggtgctttaa

SEQ ID NO: 272220 - DNA, 25 bp, Rattus norvegicus
ctgccttagccctttaatatgcctg

SEQ ID NO: 272221 - DNA, 25 bp, Rattus norvegicus
ctgccttagcttacttcttgtcaaa

SEQ ID NO: 272222 - DNA, 25 bp, Rattus norvegicus
ctgccttagctttcttcttgtcaaa

SEQ ID NO: 272223 - DNA, 25 bp, Rattus norvegicus
ctgccttcagatctcctggagaatg

SEQ ID NO: 272224 - DNA, 25 bp, Rattus norvegicus
ctgccttcagatgtcctggagaatg

SEQ ID NO: 272225 - DNA, 25 bp, Rattus norvegicus
ctgccttcagtgcatttccttcttt

SEQ ID NO: 272226 - DNA, 25 bp, Rattus norvegicus
ctgccttcagtggatttccttcttt

SEQ ID NO: 272227 - DNA, 25 bp, Rattus norvegicus
ctgccttcatgtcaatgttcctgta

SEQ ID NO: 272228 - DNA, 25 bp, Rattus norvegicus
ctgccttcatgtgaatgttcctgta

SEQ ID NO: 272229 - DNA, 25 bp, Rattus norvegicus
ctgccttccaagagtgtgtattatt

SEQ ID NO: 272230 - DNA, 25 bp, Rattus norvegicus
ctgccttccaagtgtgtgtattatt

SEQ ID NO: 272231 - DNA, 25 bp, Rattus norvegicus
ctgccttcctacagtgaacgtgggt

SEQ ID NO: 272232 - DNA, 25 bp, Rattus norvegicus
ctgccttcctactgtgaacgtgggt

SEQ ID NO: 272233 - DNA, 25 bp, Rattus norvegicus
ctgccttcctgtaattttggattct

SEQ ID NO: 272234 - DNA, 25 bp, Rattus norvegicus
ctgccttcctgttattttggattct

SEQ ID NO: 272235 - DNA, 25 bp, Rattus norvegicus
ctgccttcggaaccctgagttttga

SEQ ID NO: 272236 - DNA, 25 bp, Rattus norvegicus
ctgccttcggaagcctgagttttga

SEQ ID NO: 272237 - DNA, 25 bp, Rattus norvegicus
ctgccttctcagaaaacacttttcc

SEQ ID NO: 272238 - DNA, 25 bp, Rattus norvegicus
ctgccttctcagtaaacacttttcc

SEQ ID NO: 272239 - DNA, 25 bp, Rattus norvegicus
ctgccttctgatactttgaccatat

SEQ ID NO: 272240 - DNA, 25 bp, Rattus norvegicus
ctgccttctgattctttgaccatat

SEQ ID NO: 272241 - DNA, 25 bp, Rattus norvegicus
ctgccttctgcaaatgtaaactgtt

SEQ ID NO: 272242 - DNA, 25 bp, Rattus norvegicus
ctgccttctgcatatgtaaactgtt

SEQ ID NO: 272243 - DNA, 25 bp, Rattus norvegicus
ctgccttctgcgattttgagatgtg

SEQ ID NO: 272244 - DNA, 25 bp, Rattus norvegicus
ctgccttctgcgtttttgagatgtg

SEQ ID NO: 272245 - DNA, 25 bp, Rattus norvegicus
ctgccttcttcccaatagtgttaac

SEQ ID NO: 272246 - DNA, 25 bp, Rattus norvegicus
ctgccttcttccgaatagtgttaac

SEQ ID NO: 272247 - DNA, 25 bp, Rattus norvegicus
ctgccttcttgtctgtgctaatata

SEQ ID NO: 272248 - DNA, 25 bp, Rattus norvegicus
ctgccttcttgtgtgtgctaatata

SEQ ID NO: 272249 - DNA, 25 bp, Rattus norvegicus
ctgccttctttaaagacccagcttt

SEQ ID NO: 272250 - DNA, 25 bp, Rattus norvegicus
ctgccttctttatagacccagcttt

SEQ ID NO: 272251 - DNA, 25 bp, Rattus norvegicus
ctgccttgatccattcatctatttc

SEQ ID NO: 272252 - DNA, 25 bp, Rattus norvegicus
ctgccttgatcctttcatctatttc

SEQ ID NO: 272253 - DNA, 25 bp, Rattus norvegicus
ctgccttgcccgcatatggaaggtt

SEQ ID NO: 272254 - DNA, 25 bp, Rattus norvegicus
ctgccttgcccggatatggaaggtt

SEQ ID NO: 272255 - DNA, 25 bp, Rattus norvegicus
ctgccttgccttcggaccagagcaa

SEQ ID NO: 272256 - DNA, 25 bp, Rattus norvegicus
ctgccttgccttgggaccagagcaa

SEQ ID NO: 272257 - DNA, 25 bp, Rattus norvegicus
ctgccttgcgttactattgggatga

SEQ ID NO: 272258 - DNA, 25 bp, Rattus norvegicus
ctgccttgcgtttctattgggatga

SEQ ID NO: 272259 - DNA, 25 bp, Rattus norvegicus
ctgccttgctagctcagttgaggac

SEQ ID NO: 272260 - DNA, 25 bp, Rattus norvegicus
ctgccttgctaggtcagttgaggac

SEQ ID NO: 272261 - DNA, 25 bp, Rattus norvegicus
ctgccttgctccaactgaaggattt

SEQ ID NO: 272262 - DNA, 25 bp, Rattus norvegicus
ctgccttgctcctactgaaggattt

SEQ ID NO: 272263 - DNA, 25 bp, Rattus norvegicus
ctgccttgcttccaggctcagaaga

SEQ ID NO: 272264 - DNA, 25 bp, Rattus norvegicus
ctgccttgcttcgaggctcagaaga

SEQ ID NO: 272265 - DNA, 25 bp, Rattus norvegicus
ctgccttggaatacaggagtactta

SEQ ID NO: 272266 - DNA, 25 bp, Rattus norvegicus
ctgccttggaattcaggagtactta

SEQ ID NO: 272267 - DNA, 25 bp, Rattus norvegicus
ctgccttggctcatgttttatttta

SEQ ID NO: 272268 - DNA, 25 bp, Rattus norvegicus
ctgccttggctcttgttttatttta

SEQ ID NO: 272269 - DNA, 25 bp, Rattus norvegicus
ctgccttgggagagtctgtctggaa

SEQ ID NO: 272270 - DNA, 25 bp, Rattus norvegicus
ctgccttgggagtgtctgtctggaa

SEQ ID NO: 272271 - DNA, 25 bp, Rattus norvegicus
ctgccttgggtcacaagggaactgg

SEQ ID NO: 272272 - DNA, 25 bp, Rattus norvegicus
ctgccttgggtctcaagggaactgg

SEQ ID NO: 272273 - DNA, 25 bp, Rattus norvegicus
ctgccttgtagtctggtgagcttca

SEQ ID NO: 272274 - DNA, 25 bp, Rattus norvegicus
ctgccttgtagtgtggtgagcttca

SEQ ID NO: 272275 - DNA, 25 bp, Rattus norvegicus
ctgccttgtgtcaagtgagactaga

SEQ ID NO: 272276 - DNA, 25 bp, Rattus norvegicus
ctgccttgtgtctagtgagactaga

SEQ ID NO: 272277 - DNA, 25 bp, Rattus norvegicus
ctgccttgtgtgaggctgtcagcta

SEQ ID NO: 272278 - DNA, 25 bp, Rattus norvegicus
ctgccttgtgtgtggctgtcagcta

SEQ ID NO: 272279 - DNA, 25 bp, Rattus norvegicus
ctgccttgtttcatgttgctaacaa

SEQ ID NO: 272280 - DNA, 25 bp, Rattus norvegicus
ctgccttgtttcttgttgctaacaa

SEQ ID NO: 272281 - DNA, 25 bp, Rattus norvegicus
ctgcctttacttccagtgctgcaat

SEQ ID NO: 272282 - DNA, 25 bp, Rattus norvegicus
ctgcctttacttgcagtgctgcaat

SEQ ID NO: 272283 - DNA, 25 bp, Rattus norvegicus
ctgcctttagtcacatgcgcttata

SEQ ID NO: 272284 - DNA, 25 bp, Rattus norvegicus
ctgcctttagtctcatgcgcttata

SEQ ID NO: 272285 - DNA, 25 bp, Rattus norvegicus
ctgcctttatttatggtgaagactc

SEQ ID NO: 272286 - DNA, 25 bp, Rattus norvegicus
ctgcctttatttttggtgaagactc

SEQ ID NO: 272287 - DNA, 25 bp, Rattus norvegicus
ctgcctttcaaacattactaccaac

SEQ ID NO: 272288 - DNA, 25 bp, Rattus norvegicus
ctgcctttcaaagattactaccaac

SEQ ID NO: 272289 - DNA, 25 bp, Rattus norvegicus
ctgcctttcactcggctgaaacaca

SEQ ID NO: 272290 - DNA, 25 bp, Rattus norvegicus
ctgcctttcactgggctgaaacaca

SEQ ID NO: 272291 - DNA, 25 bp, Rattus norvegicus
ctgcctttcatgctggccaatcata

SEQ ID NO: 272292 - DNA, 25 bp, Rattus norvegicus
ctgcctttcatggtggccaatcata

SEQ ID NO: 272293 - DNA, 25 bp, Rattus norvegicus
ctgcctttcctgagagtctcgataa

SEQ ID NO: 272294 - DNA, 25 bp, Rattus norvegicus
ctgcctttcctgtgagtctcgataa

SEQ ID NO: 272295 - DNA, 25 bp, Rattus norvegicus
ctgcctttccttaagtatttactga

SEQ ID NO: 272296 - DNA, 25 bp, Rattus norvegicus
ctgcctttcctttagtatttactga

SEQ ID NO: 272297 - DNA, 25 bp, Rattus norvegicus
ctgcctttgaatagccatgcgtgta

SEQ ID NO: 272298 - DNA, 25 bp, Rattus norvegicus
ctgcctttgaattgccatgcgtgta

SEQ ID NO: 272299 - DNA, 25 bp, Rattus norvegicus
ctgcctttgcctacataggtcaatg

SEQ ID NO: 272300 - DNA, 25 bp, Rattus norvegicus
ctgcctttgccttcataggtcaatg

SEQ ID NO: 272301 - DNA, 25 bp, Rattus norvegicus
ctgcctttggccagagagctggttg

SEQ ID NO: 272302 - DNA, 25 bp, Rattus norvegicus
ctgcctttggcctgagagctggttg

SEQ ID NO: 272303 - DNA, 25 bp, Rattus norvegicus
ctgcctttggtgctactggactgga

SEQ ID NO: 272304 - DNA, 25 bp, Rattus norvegicus
ctgcctttggtggtactggactgga

SEQ ID NO: 272305 - DNA, 25 bp, Rattus norvegicus
ctgcctttgttgctttgtctggaga

SEQ ID NO: 272306 - DNA, 25 bp, Rattus norvegicus
ctgcctttgttggtttgtctggaga

SEQ ID NO: 272307 - DNA, 25 bp, Rattus norvegicus
ctgccttttacacctattgcgtgaa

SEQ ID NO: 272308 - DNA, 25 bp, Rattus norvegicus
ctgccttttacagctattgcgtgaa

SEQ ID NO: 272309 - DNA, 25 bp, Rattus norvegicus
ctgccttttctaagtgggttctggt

SEQ ID NO: 272310 - DNA, 25 bp, Rattus norvegicus
ctgccttttctatgtgggttctggt

SEQ ID NO: 272311 - DNA, 25 bp, Rattus norvegicus
ctgccttttgaaattctgtccttat

SEQ ID NO: 272312 - DNA, 25 bp, Rattus norvegicus
ctgccttttgaatttctgtccttat

SEQ ID NO: 272313 - DNA, 25 bp, Rattus norvegicus
ctgccttttgcaagtgtgtatccta

SEQ ID NO: 272314 - DNA, 25 bp, Rattus norvegicus
ctgccttttgcatgtgtgtatccta

SEQ ID NO: 272315 - DNA, 25 bp, Rattus norvegicus
ctgccttttgtcaggtgggatacca

SEQ ID NO: 272316 - DNA, 25 bp, Rattus norvegicus
ctgccttttgtctggtgggatacca

SEQ ID NO: 272317 - DNA, 25 bp, Rattus norvegicus
ctgcgaacctcacagtctactcatt

SEQ ID NO: 272318 - DNA, 25 bp, Rattus norvegicus
ctgcgaacctcagagtctactcatt

SEQ ID NO: 272319 - DNA, 25 bp, Rattus norvegicus
ctgcgaacttccctaacagatttca

SEQ ID NO: 272320 - DNA, 25 bp, Rattus norvegicus
ctgcgaacttccgtaacagatttca

SEQ ID NO: 272321 - DNA, 25 bp, Rattus norvegicus
ctgcgaagcgcccatgaagccgatg

SEQ ID NO: 272322 - DNA, 25 bp, Rattus norvegicus
ctgcgaagcgccgatgaagccgatg

SEQ ID NO: 272323 - DNA, 25 bp, Rattus norvegicus
ctgcgaagtgtgaccgcctcgcggt

SEQ ID NO: 272324 - DNA, 25 bp, Rattus norvegicus
ctgcgaagtgtgtccgcctcgcggt

SEQ ID NO: 272325 - DNA, 25 bp, Rattus norvegicus
ctgcgacacggcctgcacgcaggtt

SEQ ID NO: 272326 - DNA, 25 bp, Rattus norvegicus
ctgcgacacggcgtgcacgcaggtt

SEQ ID NO: 272327 - DNA, 25 bp, Rattus norvegicus
ctgcgacactgcaggagccggtgct

SEQ ID NO: 272328 - DNA, 25 bp, Rattus norvegicus
ctgcgacactgctggagccggtgct

SEQ ID NO: 272329 - DNA, 25 bp, Rattus norvegicus
ctgcgaccatgcagtcctgaagaag

SEQ ID NO: 272330 - DNA, 25 bp, Rattus norvegicus
ctgcgaccatgctgtcctgaagaag

SEQ ID NO: 272331 - DNA, 25 bp, Rattus norvegicus
ctgcgacccaaccaaggatgacaag

SEQ ID NO: 272332 - DNA, 25 bp, Rattus norvegicus
ctgcgacccaacgaaggatgacaag

SEQ ID NO: 272333 - DNA, 25 bp, Rattus norvegicus
ctgcgagcatggctgaggaacacaa

SEQ ID NO: 272334 - DNA, 25 bp, Rattus norvegicus
ctgcgagcatgggtgaggaacacaa

SEQ ID NO: 272335 - DNA, 25 bp, Rattus norvegicus
ctgcgaggcgacctgggcttggaga

SEQ ID NO: 272336 - DNA, 25 bp, Rattus norvegicus
ctgcgaggcgacgtgggcttggaga

SEQ ID NO: 272337 - DNA, 25 bp, Rattus norvegicus
ctgcgagtgcggctgggtcgaaggt

SEQ ID NO: 272338 - DNA, 25 bp, Rattus norvegicus
ctgcgagtgcgggtgggtcgaaggt

SEQ ID NO: 272339 - DNA, 25 bp, Rattus norvegicus
ctgcgatagaatataggccacggtc

SEQ ID NO: 272340 - DNA, 25 bp, Rattus norvegicus
ctgcgatagaatttaggccacggtc

SEQ ID NO: 272341 - DNA, 25 bp, Rattus norvegicus
ctgcgatcatctcggtaacctcagg

SEQ ID NO: 272342 - DNA, 25 bp, Rattus norvegicus
ctgcgatcatctgggtaacctcagg

SEQ ID NO: 272343 - DNA, 25 bp, Rattus norvegicus
ctgcgatcggctactgttcggaaat

SEQ ID NO: 272344 - DNA, 25 bp, Rattus norvegicus
ctgcgatcggcttctgttcggaaat

SEQ ID NO: 272345 - DNA, 25 bp, Rattus norvegicus
ctgcgatgtatgagtgctctggtgc

SEQ ID NO: 272346 - DNA, 25 bp, Rattus norvegicus
ctgcgatgtatgtgtgctctggtgc

SEQ ID NO: 272347 - DNA, 25 bp, Rattus norvegicus
ctgcgcaagttcaaggaataccttt

SEQ ID NO: 272348 - DNA, 25 bp, Rattus norvegicus
ctgcgcaagttctaggaataccttt

SEQ ID NO: 272349 - DNA, 25 bp, Rattus norvegicus
ctgcgcagctatacgctcaaactaa

SEQ ID NO: 272350 - DNA, 25 bp, Rattus norvegicus
ctgcgcagctattcgctcaaactaa

SEQ ID NO: 272351 - DNA, 25 bp, Rattus norvegicus
ctgcgcagggtaacatccaggtgct

SEQ ID NO: 272352 - DNA, 25 bp, Rattus norvegicus
ctgcgcagggtatcatccaggtgct

SEQ ID NO: 272353 - DNA, 25 bp, Rattus norvegicus
ctgcgcaggttcagtcagggcagaa

SEQ ID NO: 272354 - DNA, 25 bp, Rattus norvegicus
ctgcgcaggttctgtcagggcagaa

SEQ ID NO: 272355 - DNA, 25 bp, Rattus norvegicus
ctgcgcatctgcaccagttttaaag

SEQ ID NO: 272356 - DNA, 25 bp, Rattus norvegicus
ctgcgcatctgctccagttttaaag

SEQ ID NO: 272357 - DNA, 25 bp, Rattus norvegicus
ctgcgcatgaagaactctgaagaac

SEQ ID NO: 272358 - DNA, 25 bp, Rattus norvegicus
ctgcgcatgaagtactctgaagaac

SEQ ID NO: 272359 - DNA, 25 bp, Rattus norvegicus
ctgcgccagcttatgaaggccggaa

SEQ ID NO: 272360 - DNA, 25 bp, Rattus norvegicus
ctgcgccagcttttgaaggccggaa

SEQ ID NO: 272361 - DNA, 25 bp, Rattus norvegicus
ctgcgccgcaggctacatttgtata

SEQ ID NO: 272362 - DNA, 25 bp, Rattus norvegicus
ctgcgccgcagggtacatttgtata

SEQ ID NO: 272363 - DNA, 25 bp, Rattus norvegicus
ctgcgccgccataccgggagagagt

SEQ ID NO: 272364 - DNA, 25 bp, Rattus norvegicus
ctgcgccgccattccgggagagagt

SEQ ID NO: 272365 - DNA, 25 bp, Rattus norvegicus
ctgcgcctatgaatggctatccaat

SEQ ID NO: 272366 - DNA, 25 bp, Rattus norvegicus
ctgcgcctatgattggctatccaat

SEQ ID NO: 272367 - DNA, 25 bp, Rattus norvegicus
ctgcgcctggaacacctgggtgaaa

SEQ ID NO: 272368 - DNA, 25 bp, Rattus norvegicus
ctgcgcctggaagacctgggtgaaa

SEQ ID NO: 272369 - DNA, 25 bp, Rattus norvegicus
ctgcgcctgggaccgtcacaaataa

SEQ ID NO: 272370 - DNA, 25 bp, Rattus norvegicus
ctgcgcctgggagcgtcacaaataa

SEQ ID NO: 272371 - DNA, 25 bp, Rattus norvegicus
ctgcgcgcaaggacacttacatatt

SEQ ID NO: 272372 - DNA, 25 bp, Rattus norvegicus
ctgcgcgcaaggtcacttacatatt

SEQ ID NO: 272373 - DNA, 25 bp, Rattus norvegicus
ctgcgcgcgcgtagagcaaatgcta

SEQ ID NO: 272374 - DNA, 25 bp, Rattus norvegicus
ctgcgcgcgcgttgagcaaatgcta

SEQ ID NO: 272375 - DNA, 25 bp, Rattus norvegicus
ctgcgcgtcgttcccaacagcaagg

SEQ ID NO: 272376 - DNA, 25 bp, Rattus norvegicus
ctgcgcgtcgttgccaacagcaagg

SEQ ID NO: 272377 - DNA, 25 bp, Rattus norvegicus
ctgcgcgtttggatctcggttgtac

SEQ ID NO: 272378 - DNA, 25 bp, Rattus norvegicus
ctgcgcgtttggttctcggttgtac

SEQ ID NO: 272379 - DNA, 25 bp, Rattus norvegicus
ctgcgctagaggctaaggtaccaca

SEQ ID NO: 272380 - DNA, 25 bp, Rattus norvegicus
ctgcgctagagggtaaggtaccaca

SEQ ID NO: 272381 - DNA, 25 bp, Rattus norvegicus
ctgcgctccccgacgggaattgtag

SEQ ID NO: 272382 - DNA, 25 bp, Rattus norvegicus
ctgcgctccccgtcgggaattgtag

SEQ ID NO: 272383 - DNA, 25 bp, Rattus norvegicus
ctgcgctccggcaagaggttcatct

SEQ ID NO: 272384 - DNA, 25 bp, Rattus norvegicus
ctgcgctccggctagaggttcatct

SEQ ID NO: 272385 - DNA, 25 bp, Rattus norvegicus
ctgcgctctgatatgttgactgaaa

SEQ ID NO: 272386 - DNA, 25 bp, Rattus norvegicus
ctgcgctctgatttgttgactgaaa

SEQ ID NO: 272387 - DNA, 25 bp, Rattus norvegicus
ctgcgctctgcacaggtggtgacca

SEQ ID NO: 272388 - DNA, 25 bp, Rattus norvegicus
ctgcgctctgcagaggtggtgacca

SEQ ID NO: 272389 - DNA, 25 bp, Rattus norvegicus
ctgcgctgctctaagaacatctcat

SEQ ID NO: 272390 - DNA, 25 bp, Rattus norvegicus
ctgcgctgctcttagaacatctcat

SEQ ID NO: 272391 - DNA, 25 bp, Rattus norvegicus
ctgcgctgggttacttcacgagtga

SEQ ID NO: 272392 - DNA, 25 bp, Rattus norvegicus
ctgcgctgggtttcttcacgagtga

SEQ ID NO: 272393 - DNA, 25 bp, Rattus norvegicus
ctgcgctgtagcagtggcttttgac

SEQ ID NO: 272394 - DNA, 25 bp, Rattus norvegicus
ctgcgctgtagctgtggcttttgac

SEQ ID NO: 272395 - DNA, 25 bp, Rattus norvegicus
ctgcgctgtcagagttttcttaaag

SEQ ID NO: 272396 - DNA, 25 bp, Rattus norvegicus
ctgcgctgtcagtgttttcttaaag

SEQ ID NO: 272397 - DNA, 25 bp, Rattus norvegicus
ctgcgcttgtgcagatctgggagaa

SEQ ID NO: 272398 - DNA, 25 bp, Rattus norvegicus
ctgcgcttgtgctgatctgggagaa

SEQ ID NO: 272399 - DNA, 25 bp, Rattus norvegicus
ctgcggaaattcatgtgcgcacact

SEQ ID NO: 272400 - DNA, 25 bp, Rattus norvegicus
ctgcggaaattcttgtgcgcacact

SEQ ID NO: 272401 - DNA, 25 bp, Rattus norvegicus
ctgcggaacacgacaggttgcctga

SEQ ID NO: 272402 - DNA, 25 bp, Rattus norvegicus
ctgcggaacacgtcaggttgcctga

SEQ ID NO: 272403 - DNA, 25 bp, Rattus norvegicus
ctgcggaccccgatgatacaaagtg

SEQ ID NO: 272404 - DNA, 25 bp, Rattus norvegicus
ctgcggaccccgttgatacaaagtg

SEQ ID NO: 272405 - DNA, 25 bp, Rattus norvegicus
ctgcggactcgtcagaggttgtaaa

SEQ ID NO: 272406 - DNA, 25 bp, Rattus norvegicus
ctgcggactcgtgagaggttgtaaa

SEQ ID NO: 272407 - DNA, 25 bp, Rattus norvegicus
ctgcggagaagaaaaataccactgt

SEQ ID NO: 272408 - DNA, 25 bp, Rattus norvegicus
ctgcggagaagataaataccactgt

SEQ ID NO: 272409 - DNA, 25 bp, Rattus norvegicus
ctgcggatcatcatccttcatgctg

SEQ ID NO: 272410 - DNA, 25 bp, Rattus norvegicus
ctgcggatcatcttccttcatgctg

SEQ ID NO: 272411 - DNA, 25 bp, Rattus norvegicus
ctgcggatcatgactgagattgttc

SEQ ID NO: 272412 - DNA, 25 bp, Rattus norvegicus
ctgcggatcatgtctgagattgttc

SEQ ID NO: 272413 - DNA, 25 bp, Rattus norvegicus
ctgcggatgctgattcacagggaac

SEQ ID NO: 272414 - DNA, 25 bp, Rattus norvegicus
ctgcggatgctgtttcacagggaac

SEQ ID NO: 272415 - DNA, 25 bp, Rattus norvegicus
ctgcggcacatcctgcagcaggtgt

SEQ ID NO: 272416 - DNA, 25 bp, Rattus norvegicus
ctgcggcacatcgtgcagcaggtgt

SEQ ID NO: 272417 - DNA, 25 bp, Rattus norvegicus
ctgcggcagaaaatagaccacggtg

SEQ ID NO: 272418 - DNA, 25 bp, Rattus norvegicus
ctgcggcagaaattagaccacggtg

SEQ ID NO: 272419 - DNA, 25 bp, Rattus norvegicus
ctgcggcagcggaattaacgtggac

SEQ ID NO: 272420 - DNA, 25 bp, Rattus norvegicus
ctgcggcagcggtattaacgtggac

SEQ ID NO: 272421 - DNA, 25 bp, Rattus norvegicus
ctgcggcccttcatttcaggtttga

SEQ ID NO: 272422 - DNA, 25 bp, Rattus norvegicus
ctgcggcccttcttttcaggtttga

SEQ ID NO: 272423 - DNA, 25 bp, Rattus norvegicus
ctgcggcggcttcattgagtgtata

SEQ ID NO: 272424 - DNA, 25 bp, Rattus norvegicus
ctgcggcggcttgattgagtgtata

SEQ ID NO: 272425 - DNA, 25 bp, Rattus norvegicus
ctgcggctcactagcttggctggtg

SEQ ID NO: 272426 - DNA, 25 bp, Rattus norvegicus
ctgcggctcacttgcttggctggtg

SEQ ID NO: 272427 - DNA, 25 bp, Rattus norvegicus
ctgcggctccctattctggatcttt

SEQ ID NO: 272428 - DNA, 25 bp, Rattus norvegicus
ctgcggctcccttttctggatcttt

SEQ ID NO: 272429 - DNA, 25 bp, Rattus norvegicus
ctgcgggaaacactgggtttgccat

SEQ ID NO: 272430 - DNA, 25 bp, Rattus norvegicus
ctgcgggaaacagtgggtttgccat

SEQ ID NO: 272431 - DNA, 25 bp, Rattus norvegicus
ctgcgggaccagataaaggctgcga

SEQ ID NO: 272432 - DNA, 25 bp, Rattus norvegicus
ctgcgggaccagttaaaggctgcga

SEQ ID NO: 272433 - DNA, 25 bp, Rattus norvegicus
ctgcgggacctcctcggaggattat

SEQ ID NO: 272434 - DNA, 25 bp, Rattus norvegicus
ctgcgggacctcgtcggaggattat

SEQ ID NO: 272435 - DNA, 25 bp, Rattus norvegicus
ctgcgggactacacaaggaccattc

SEQ ID NO: 272436 - DNA, 25 bp, Rattus norvegicus
ctgcgggactactcaaggaccattc

SEQ ID NO: 272437 - DNA, 25 bp, Rattus norvegicus
ctgcgggagaagatggctgccacta

SEQ ID NO: 272438 - DNA, 25 bp, Rattus norvegicus
ctgcgggagaagttggctgccacta

SEQ ID NO: 272439 - DNA, 25 bp, Rattus norvegicus
ctgcgggcaggcactgaggtctcaa

SEQ ID NO: 272440 - DNA, 25 bp, Rattus norvegicus
ctgcgggcaggctctgaggtctcaa

SEQ ID NO: 272441 - DNA, 25 bp, Rattus norvegicus
ctgcgggcatctcccgaggctctga

SEQ ID NO: 272442 - DNA, 25 bp, Rattus norvegicus
ctgcgggcatctgccgaggctctga

SEQ ID NO: 272443 - DNA, 25 bp, Rattus norvegicus
ctgcgggcgactcggtctgtcagga

SEQ ID NO: 272444 - DNA, 25 bp, Rattus norvegicus
ctgcgggcgactgggtctgtcagga

SEQ ID NO: 272445 - DNA, 25 bp, Rattus norvegicus
ctgcgggtgtctcctggtgtccaca

SEQ ID NO: 272446 - DNA, 25 bp, Rattus norvegicus
ctgcgggtgtctgctggtgtccaca

SEQ ID NO: 272447 - DNA, 25 bp, Rattus norvegicus
ctgcggtcaggtacctcagctgagg

SEQ ID NO: 272448 - DNA, 25 bp, Rattus norvegicus
ctgcggtcaggtactggatgtgcca

SEQ ID NO: 272449 - DNA, 25 bp, Rattus norvegicus
ctgcggtcaggttcctcagctgagg

SEQ ID NO: 272450 - DNA, 25 bp, Rattus norvegicus
ctgcggtcaggttctggatgtgcca

SEQ ID NO: 272451 - DNA, 25 bp, Rattus norvegicus
ctgcggtctgaacctggagattact

SEQ ID NO: 272452 - DNA, 25 bp, Rattus norvegicus
ctgcggtctgaagctggagattact

SEQ ID NO: 272453 - DNA, 25 bp, Rattus norvegicus
ctgcggtgaccacgtgtgtcgacaa

SEQ ID NO: 272454 - DNA, 25 bp, Rattus norvegicus
ctgcggtgaccaggtgtgtcgacaa

SEQ ID NO: 272455 - DNA, 25 bp, Rattus norvegicus
ctgcggtgacttctggagcttacta

SEQ ID NO: 272456 - DNA, 25 bp, Rattus norvegicus
ctgcggtgacttgtggagcttacta

SEQ ID NO: 272457 - DNA, 25 bp, Rattus norvegicus
ctgcggtgcagaagatgcccactag

SEQ ID NO: 272458 - DNA, 25 bp, Rattus norvegicus
ctgcggtgcagatgatgcccactag

SEQ ID NO: 272459 - DNA, 25 bp, Rattus norvegicus
ctgcggttaattaatctgttgttga

SEQ ID NO: 272460 - DNA, 25 bp, Rattus norvegicus
ctgcggttaatttatctgttgttga

SEQ ID NO: 272461 - DNA, 25 bp, Rattus norvegicus
ctgcggttccttaggttaccatgga

SEQ ID NO: 272462 - DNA, 25 bp, Rattus norvegicus
ctgcggttcctttggttaccatgga

SEQ ID NO: 272463 - DNA, 25 bp, Rattus norvegicus
ctgcggttctgtatgtgtgctacac

SEQ ID NO: 272464 - DNA, 25 bp, Rattus norvegicus
ctgcggttctgtttgtgtgctacac

SEQ ID NO: 272465 - DNA, 25 bp, Rattus norvegicus
ctgcggttgagcatggttctgttga

SEQ ID NO: 272466 - DNA, 25 bp, Rattus norvegicus
ctgcggttgagcttggttctgttga

SEQ ID NO: 272467 - DNA, 25 bp, Rattus norvegicus
ctgcggtttcagattcgacagtaac

SEQ ID NO: 272468 - DNA, 25 bp, Rattus norvegicus
ctgcggtttcagtttcgacagtaac

SEQ ID NO: 272469 - DNA, 25 bp, Rattus norvegicus
ctgcggtttcccaaacagaggagaa

SEQ ID NO: 272470 - DNA, 25 bp, Rattus norvegicus
ctgcggtttccctaacagaggagaa

SEQ ID NO: 272471 - DNA, 25 bp, Rattus norvegicus
ctgcgtaagccccaaaatgtcaaga

SEQ ID NO: 272472 - DNA, 25 bp, Rattus norvegicus
ctgcgtaagcccgaaaatgtcaaga

SEQ ID NO: 272473 - DNA, 25 bp, Rattus norvegicus
ctgcgtatttggcttttggattgaa

SEQ ID NO: 272474 - DNA, 25 bp, Rattus norvegicus
ctgcgtatttgggttttggattgaa

SEQ ID NO: 272475 - DNA, 25 bp, Rattus norvegicus
ctgcgtcactggctgttgctgtaaa

SEQ ID NO: 272476 - DNA, 25 bp, Rattus norvegicus
ctgcgtcactgggtgttgctgtaaa

SEQ ID NO: 272477 - DNA, 25 bp, Rattus norvegicus
ctgcgtccaaagatctaaggtgtag

SEQ ID NO: 272478 - DNA, 25 bp, Rattus norvegicus
ctgcgtccaaagttctaaggtgtag

SEQ ID NO: 272479 - DNA, 25 bp, Rattus norvegicus
ctgcgtcctacaccattgagaccaa

SEQ ID NO: 272480 - DNA, 25 bp, Rattus norvegicus
ctgcgtcctacagcattgagaccaa

SEQ ID NO: 272481 - DNA, 25 bp, Rattus norvegicus
ctgcgtccttttccttcgttaagaa

SEQ ID NO: 272482 - DNA, 25 bp, Rattus norvegicus
ctgcgtccttttgcttcgttaagaa

SEQ ID NO: 272483 - DNA, 25 bp, Rattus norvegicus
ctgcgtctgagaactacctttttac

SEQ ID NO: 272484 - DNA, 25 bp, Rattus norvegicus
ctgcgtctgagatctacctttttac

SEQ ID NO: 272485 - DNA, 25 bp, Rattus norvegicus
ctgcgtctgatcctcaatttttgta

SEQ ID NO: 272486 - DNA, 25 bp, Rattus norvegicus
ctgcgtctgatcgtcaatttttgta

SEQ ID NO: 272487 - DNA, 25 bp, Rattus norvegicus
ctgcgtcttctaatccatggaacat

SEQ ID NO: 272488 - DNA, 25 bp, Rattus norvegicus
ctgcgtcttctattccatggaacat

SEQ ID NO: 272489 - DNA, 25 bp, Rattus norvegicus
ctgcgtgacaggctccagtcattat

SEQ ID NO: 272490 - DNA, 25 bp, Rattus norvegicus
ctgcgtgacagggtccagtcattat

SEQ ID NO: 272491 - DNA, 25 bp, Rattus norvegicus
ctgcgtgatccaccctgtgccaaaa

SEQ ID NO: 272492 - DNA, 25 bp, Rattus norvegicus
ctgcgtgatccagcctgtgccaaaa

SEQ ID NO: 272493 - DNA, 25 bp, Rattus norvegicus
ctgcgtgggcagaccaagaaagata

SEQ ID NO: 272494 - DNA, 25 bp, Rattus norvegicus
ctgcgtgggcagtccaagaaagata

SEQ ID NO: 272495 - DNA, 25 bp, Rattus norvegicus
ctgcgttaaaggctcacagcgttag

SEQ ID NO: 272496 - DNA, 25 bp, Rattus norvegicus
ctgcgttaaagggtcacagcgttag

SEQ ID NO: 272497 - DNA, 25 bp, Rattus norvegicus
ctgcgttaggttactggaggttgtc

SEQ ID NO: 272498 - DNA, 25 bp, Rattus norvegicus
ctgcgttaggtttctggaggttgtc

SEQ ID NO: 272499 - DNA, 25 bp, Rattus norvegicus
ctgcgttagtgccttgtcttaaatg

SEQ ID NO: 272500 - DNA, 25 bp, Rattus norvegicus
ctgcgttagtgcgttgtcttaaatg

SEQ ID NO: 272501 - DNA, 25 bp, Rattus norvegicus
ctgcgttagttcctgcctgatttca

SEQ ID NO: 272502 - DNA, 25 bp, Rattus norvegicus
ctgcgttagttcgtgcctgatttca

SEQ ID NO: 272503 - DNA, 25 bp, Rattus norvegicus
ctgcgttcaagcaccaggaggagaa

SEQ ID NO: 272504 - DNA, 25 bp, Rattus norvegicus
ctgcgttcaagctccaggaggagaa

SEQ ID NO: 272505 - DNA, 25 bp, Rattus norvegicus
ctgcgttcacccagtgatggtatgt

SEQ ID NO: 272506 - DNA, 25 bp, Rattus norvegicus
ctgcgttcaccctgtgatggtatgt

SEQ ID NO: 272507 - DNA, 25 bp, Rattus norvegicus
ctgcgttcacgtcctttgcgtaaga

SEQ ID NO: 272508 - DNA, 25 bp, Rattus norvegicus
ctgcgttcacgtgctttgcgtaaga

SEQ ID NO: 272509 - DNA, 25 bp, Rattus norvegicus
ctgcgttccaggctatccatgctac

SEQ ID NO: 272510 - DNA, 25 bp, Rattus norvegicus
ctgcgttccagggtatccatgctac

SEQ ID NO: 272511 - DNA, 25 bp, Rattus norvegicus
ctgcgttctgttagctttaggtttt

SEQ ID NO: 272512 - DNA, 25 bp, Rattus norvegicus
ctgcgttctgtttgctttaggtttt

SEQ ID NO: 272513 - DNA, 25 bp, Rattus norvegicus
ctgcgttgaacgcttcattgataca

SEQ ID NO: 272514 - DNA, 25 bp, Rattus norvegicus
ctgcgttgaacggttcattgataca

SEQ ID NO: 272515 - DNA, 25 bp, Rattus norvegicus
ctgcgttttagcatacaatcatatt

SEQ ID NO: 272516 - DNA, 25 bp, Rattus norvegicus
ctgcgttttagcttacaatcatatt

SEQ ID NO: 272517 - DNA, 25 bp, Rattus norvegicus
ctgcgttttttaaactgggaagtgg

SEQ ID NO: 272518 - DNA, 25 bp, Rattus norvegicus
ctgcgttttttatactgggaagtgg

SEQ ID NO: 272519 - DNA, 25 bp, Rattus norvegicus
ctgcgtttttttatacttggaagtg

SEQ ID NO: 272520 - DNA, 25 bp, Rattus norvegicus
ctgcgtttttttttacttggaagtg

SEQ ID NO: 272521 - DNA, 25 bp, Rattus norvegicus
ctgctaacagacagccactcaactg

SEQ ID NO: 272522 - DNA, 25 bp, Rattus norvegicus
ctgctaacagactgccactcaactg

SEQ ID NO: 272523 - DNA, 25 bp, Rattus norvegicus
ctgctaacatttaattacctcccac

SEQ ID NO: 272524 - DNA, 25 bp, Rattus norvegicus
ctgctaacattttattacctcccac

SEQ ID NO: 272525 - DNA, 25 bp, Rattus norvegicus
ctgctaaccctgatggcctgagtca

SEQ ID NO: 272526 - DNA, 25 bp, Rattus norvegicus
ctgctaaccctgttggcctgagtca

SEQ ID NO: 272527 - DNA, 25 bp, Rattus norvegicus
ctgctaactcacactcttataggat

SEQ ID NO: 272528 - DNA, 25 bp, Rattus norvegicus
ctgctaactcactctcttataggat

SEQ ID NO: 272529 - DNA, 25 bp, Rattus norvegicus
ctgctaagtagcactaacggtctgg

SEQ ID NO: 272530 - DNA, 25 bp, Rattus norvegicus
ctgctaagtagctctaacggtctgg

SEQ ID NO: 272531 - DNA, 25 bp, Rattus norvegicus
ctgctaatgcttaggtaataatctt

SEQ ID NO: 272532 - DNA, 25 bp, Rattus norvegicus
ctgctaatgctttggtaataatctt

SEQ ID NO: 272533 - DNA, 25 bp, Rattus norvegicus
ctgctaatgtagattttgatatgta

SEQ ID NO: 272534 - DNA, 25 bp, Rattus norvegicus
ctgctaatgtagtttttgatatgta

SEQ ID NO: 272535 - DNA, 25 bp, Rattus norvegicus
ctgctacagccacagcttatttagg

SEQ ID NO: 272536 - DNA, 25 bp, Rattus norvegicus
ctgctacagccagagcttatttagg

SEQ ID NO: 272537 - DNA, 25 bp, Rattus norvegicus
ctgctacatgtcatccgttcattta

SEQ ID NO: 272538 - DNA, 25 bp, Rattus norvegicus
ctgctacatgtcttccgttcattta

SEQ ID NO: 272539 - DNA, 25 bp, Rattus norvegicus
ctgctacccatgctttcctgttaag

SEQ ID NO: 272540 - DNA, 25 bp, Rattus norvegicus
ctgctacccatggtttcctgttaag

SEQ ID NO: 272541 - DNA, 25 bp, Rattus norvegicus
ctgctaccgactatgactttactga

SEQ ID NO: 272542 - DNA, 25 bp, Rattus norvegicus
ctgctaccgactttgactttactga

SEQ ID NO: 272543 - DNA, 25 bp, Rattus norvegicus
ctgctactcaacaattgccagtgca

SEQ ID NO: 272544 - DNA, 25 bp, Rattus norvegicus
ctgctactcaacaggcctcaaggta

SEQ ID NO: 272545 - DNA, 25 bp, Rattus norvegicus
ctgctactcaactattgccagtgca

SEQ ID NO: 272546 - DNA, 25 bp, Rattus norvegicus
ctgctactcaactggcctcaaggta

SEQ ID NO: 272547 - DNA, 25 bp, Rattus norvegicus
ctgctactcgagaactatttttatg

SEQ ID NO: 272548 - DNA, 25 bp, Rattus norvegicus
ctgctactcgagtactatttttatg

SEQ ID NO: 272549 - DNA, 25 bp, Rattus norvegicus
ctgctactctcgattcctttgagaa

SEQ ID NO: 272550 - DNA, 25 bp, Rattus norvegicus
ctgctactctcgtttcctttgagaa

SEQ ID NO: 272551 - DNA, 25 bp, Rattus norvegicus
ctgctactgaggctcacggtacaga

SEQ ID NO: 272552 - DNA, 25 bp, Rattus norvegicus
ctgctactgagggtcacggtacaga

SEQ ID NO: 272553 - DNA, 25 bp, Rattus norvegicus
ctgctacttgctactagcttggtta

SEQ ID NO: 272554 - DNA, 25 bp, Rattus norvegicus
ctgctacttgcttctagcttggtta

SEQ ID NO: 272555 - DNA, 25 bp, Rattus norvegicus
ctgctacttttgagatgagaccatt

SEQ ID NO: 272556 - DNA, 25 bp, Rattus norvegicus
ctgctacttttgtgatgagaccatt

SEQ ID NO: 272557 - DNA, 25 bp, Rattus norvegicus
ctgctagcggcaatatcttcttggc

SEQ ID NO: 272558 - DNA, 25 bp, Rattus norvegicus
ctgctagcggcattatcttcttggc

SEQ ID NO: 272559 - DNA, 25 bp, Rattus norvegicus
ctgctagcttagcaacactggtgag

SEQ ID NO: 272560 - DNA, 25 bp, Rattus norvegicus
ctgctagcttaggaacactggtgag

SEQ ID NO: 272561 - DNA, 25 bp, Rattus norvegicus
ctgctatcccgtcaagatctttgta

SEQ ID NO: 272562 - DNA, 25 bp, Rattus norvegicus
ctgctatcccgtgaagatctttgta

SEQ ID NO: 272563 - DNA, 25 bp, Rattus norvegicus
ctgctatccgttcctactgaaaaac

SEQ ID NO: 272564 - DNA, 25 bp, Rattus norvegicus
ctgctatccgttgctactgaaaaac

SEQ ID NO: 272565 - DNA, 25 bp, Rattus norvegicus
ctgctatcctgcagatcgtggtggg

SEQ ID NO: 272566 - DNA, 25 bp, Rattus norvegicus
ctgctatcctgctgatcgtggtggg

SEQ ID NO: 272567 - DNA, 25 bp, Rattus norvegicus
ctgctatgccacaaaggttttattt

SEQ ID NO: 272568 - DNA, 25 bp, Rattus norvegicus
ctgctatgccactaaggttttattt

SEQ ID NO: 272569 - DNA, 25 bp, Rattus norvegicus
ctgctatggcagcagctctgcaggc

SEQ ID NO: 272570 - DNA, 25 bp, Rattus norvegicus
ctgctatggcaggagctctgcaggc

SEQ ID NO: 272571 - DNA, 25 bp, Rattus norvegicus
ctgctatgggctaggcacagtgata

SEQ ID NO: 272572 - DNA, 25 bp, Rattus norvegicus
ctgctatgggcttggcacagtgata

SEQ ID NO: 272573 - DNA, 25 bp, Rattus norvegicus
ctgctatttactaaactgtacttgg

SEQ ID NO: 272574 - DNA, 25 bp, Rattus norvegicus
ctgctatttacttaactgtacttgg

SEQ ID NO: 272575 - DNA, 25 bp, Rattus norvegicus
ctgctcaacccgacagtgatattat

SEQ ID NO: 272576 - DNA, 25 bp, Rattus norvegicus
ctgctcaacccgtcagtgatattat

SEQ ID NO: 272577 - DNA, 25 bp, Rattus norvegicus
ctgctcaacctgaggatccagataa

SEQ ID NO: 272578 - DNA, 25 bp, Rattus norvegicus
ctgctcaacctgtggatccagataa

SEQ ID NO: 272579 - DNA, 25 bp, Rattus norvegicus
ctgctcaagaaaaacgggctactat

SEQ ID NO: 272580 - DNA, 25 bp, Rattus norvegicus
ctgctcaagaaatacgggctactat

SEQ ID NO: 272581 - DNA, 25 bp, Rattus norvegicus
ctgctcacacccaatatgtttcaat

SEQ ID NO: 272582 - DNA, 25 bp, Rattus norvegicus
ctgctcacaccctatatgtttcaat

SEQ ID NO: 272583 - DNA, 25 bp, Rattus norvegicus
ctgctcaccaggaggaaatggaagg

SEQ ID NO: 272584 - DNA, 25 bp, Rattus norvegicus
ctgctcaccaggtggaaatggaagg

SEQ ID NO: 272585 - DNA, 25 bp, Rattus norvegicus
ctgctcaccctcagtcaagaggagt

SEQ ID NO: 272586 - DNA, 25 bp, Rattus norvegicus
ctgctcaccctctgtcaagaggagt

SEQ ID NO: 272587 - DNA, 25 bp, Rattus norvegicus
ctgctcactcacaagggcatctgga

SEQ ID NO: 272588 - DNA, 25 bp, Rattus norvegicus
ctgctcactcactagggcatctgga

SEQ ID NO: 272589 - DNA, 25 bp, Rattus norvegicus
ctgctcactgatccctgcaacagag

SEQ ID NO: 272590 - DNA, 25 bp, Rattus norvegicus
ctgctcactgatgcctgcaacagag

SEQ ID NO: 272591 - DNA, 25 bp, Rattus norvegicus
ctgctcagacctccaataaaactcg

SEQ ID NO: 272592 - DNA, 25 bp, Rattus norvegicus
ctgctcagacctgcaataaaactcg

SEQ ID NO: 272593 - DNA, 25 bp, Rattus norvegicus
ctgctcagccctcggacaaagggaa

SEQ ID NO: 272594 - DNA, 25 bp, Rattus norvegicus
ctgctcagccctgggacaaagggaa

SEQ ID NO: 272595 - DNA, 25 bp, Rattus norvegicus
ctgctcagtcgtctgtgtcattgaa

SEQ ID NO: 272596 - DNA, 25 bp, Rattus norvegicus
ctgctcagtcgtgtgtgtcattgaa

SEQ ID NO: 272597 - DNA, 25 bp, Rattus norvegicus
ctgctcagtgagaccttttttgtag

SEQ ID NO: 272598 - DNA, 25 bp, Rattus norvegicus
ctgctcagtgagtccttttttgtag

SEQ ID NO: 272599 - DNA, 25 bp, Rattus norvegicus
ctgctcagtgcaatgcccagaaata

SEQ ID NO: 272600 - DNA, 25 bp, Rattus norvegicus
ctgctcagtgcattgcccagaaata

SEQ ID NO: 272601 - DNA, 25 bp, Rattus norvegicus
ctgctcagtttccaagtcatctatg

SEQ ID NO: 272602 - DNA, 25 bp, Rattus norvegicus
ctgctcagtttcgaagtcatctatg

SEQ ID NO: 272603 - DNA, 25 bp, Rattus norvegicus
ctgctcatgaacagccagggctttg

SEQ ID NO: 272604 - DNA, 25 bp, Rattus norvegicus
ctgctcatgaactgccagggctttg

SEQ ID NO: 272605 - DNA, 25 bp, Rattus norvegicus
ctgctcatggccagattgtcattct

SEQ ID NO: 272606 - DNA, 25 bp, Rattus norvegicus
ctgctcatggcctgattgtcattct

SEQ ID NO: 272607 - DNA, 25 bp, Rattus norvegicus
ctgctcatgtagctgtttgattgct

SEQ ID NO: 272608 - DNA, 25 bp, Rattus norvegicus
ctgctcatgtaggtgtttgattgct

SEQ ID NO: 272609 - DNA, 25 bp, Rattus norvegicus
ctgctcattcggaacagaggcaatt

SEQ ID NO: 272610 - DNA, 25 bp, Rattus norvegicus
ctgctcattcggtacagaggcaatt

SEQ ID NO: 272611 - DNA, 25 bp, Rattus norvegicus
ctgctccaacttacaatcagacttg

SEQ ID NO: 272612 - DNA, 25 bp, Rattus norvegicus
ctgctccaactttcaatcagacttg

SEQ ID NO: 272613 - DNA, 25 bp, Rattus norvegicus
ctgctccaagggacgcagccgggtt

SEQ ID NO: 272614 - DNA, 25 bp, Rattus norvegicus
ctgctccaagggtcgcagccgggtt

SEQ ID NO: 272615 - DNA, 25 bp, Rattus norvegicus
ctgctccactttatctatcttggaa

SEQ ID NO: 272616 - DNA, 25 bp, Rattus norvegicus
ctgctccactttttctatcttggaa

SEQ ID NO: 272617 - DNA, 25 bp, Rattus norvegicus
ctgctccagatacggacagctgcca

SEQ ID NO: 272618 - DNA, 25 bp, Rattus norvegicus
ctgctccagatagggacagctgcca

SEQ ID NO: 272619 - DNA, 25 bp, Rattus norvegicus
ctgctcccaaatcatgggccagtaa

SEQ ID NO: 272620 - DNA, 25 bp, Rattus norvegicus
ctgctcccaaatgatgggccagtaa

SEQ ID NO: 272621 - DNA, 25 bp, Rattus norvegicus
ctgctcccaagtactgaggtcacag

SEQ ID NO: 272622 - DNA, 25 bp, Rattus norvegicus
ctgctcccaagttctgaggtcacag

SEQ ID NO: 272623 - DNA, 25 bp, Rattus norvegicus
ctgctcccaggtcaacagagtactg

SEQ ID NO: 272624 - DNA, 25 bp, Rattus norvegicus
ctgctcccaggtgaacagagtactg

SEQ ID NO: 272625 - DNA, 25 bp, Rattus norvegicus
ctgctccccataccagagtagtatt

SEQ ID NO: 272626 - DNA, 25 bp, Rattus norvegicus
ctgctccccatagcagagtagtatt

SEQ ID NO: 272627 - DNA, 25 bp, Rattus norvegicus
ctgctccccattatatgtgtgacat

SEQ ID NO: 272628 - DNA, 25 bp, Rattus norvegicus
ctgctccccattttatgtgtgacat

SEQ ID NO: 272629 - DNA, 25 bp, Rattus norvegicus
ctgctccctattcccaaagagtgaa

SEQ ID NO: 272630 - DNA, 25 bp, Rattus norvegicus
ctgctccctattgccaaagagtgaa

SEQ ID NO: 272631 - DNA, 25 bp, Rattus norvegicus
ctgctcccttgaccacagagatata

SEQ ID NO: 272632 - DNA, 25 bp, Rattus norvegicus
ctgctcccttgagcacagagatata

SEQ ID NO: 272633 - DNA, 25 bp, Rattus norvegicus
ctgctccggctcctggtgatcactg

SEQ ID NO: 272634 - DNA, 25 bp, Rattus norvegicus
ctgctccggctcgtggtgatcactg

SEQ ID NO: 272635 - DNA, 25 bp, Rattus norvegicus
ctgctcctcattattctgttcaggg

SEQ ID NO: 272636 - DNA, 25 bp, Rattus norvegicus
ctgctcctcatttttctgttcaggg

SEQ ID NO: 272637 - DNA, 25 bp, Rattus norvegicus
ctgctcctccctctcaagaagttgg

SEQ ID NO: 272638 - DNA, 25 bp, Rattus norvegicus
ctgctcctccctgtcaagaagttgg

SEQ ID NO: 272639 - DNA, 25 bp, Rattus norvegicus
ctgctcctgaatccccgggtgcaag

SEQ ID NO: 272640 - DNA, 25 bp, Rattus norvegicus
ctgctcctgaatgcccgggtgcaag

SEQ ID NO: 272641 - DNA, 25 bp, Rattus norvegicus
ctgctcctgctactgataaggaagg

SEQ ID NO: 272642 - DNA, 25 bp, Rattus norvegicus
ctgctcctgctagtgataaggaagg

SEQ ID NO: 272643 - DNA, 25 bp, Rattus norvegicus
ctgctcctggctagggccatggaca

SEQ ID NO: 272644 - DNA, 25 bp, Rattus norvegicus
ctgctcctggcttgggccatggaca

SEQ ID NO: 272645 - DNA, 25 bp, Rattus norvegicus
ctgctcctgtggaattccagcaaga

SEQ ID NO: 272646 - DNA, 25 bp, Rattus norvegicus
ctgctcctgtggtattccagcaaga

SEQ ID NO: 272647 - DNA, 25 bp, Rattus norvegicus
ctgctcctgtgtacgatggtcttca

SEQ ID NO: 272648 - DNA, 25 bp, Rattus norvegicus
ctgctcctgtgttcgatggtcttca

SEQ ID NO: 272649 - DNA, 25 bp, Rattus norvegicus
ctgctccttaaccttaaagccattt

SEQ ID NO: 272650 - DNA, 25 bp, Rattus norvegicus
ctgctccttaacgttaaagccattt

SEQ ID NO: 272651 - DNA, 25 bp, Rattus norvegicus
ctgctccttcataatctcacatata

SEQ ID NO: 272652 - DNA, 25 bp, Rattus norvegicus
ctgctccttcattatctcacatata

SEQ ID NO: 272653 - DNA, 25 bp, Rattus norvegicus
ctgctccttggaatctgatctacaa

SEQ ID NO: 272654 - DNA, 25 bp, Rattus norvegicus
ctgctccttggattctgatctacaa

SEQ ID NO: 272655 - DNA, 25 bp, Rattus norvegicus
ctgctcctttgccttagttgtaact

SEQ ID NO: 272656 - DNA, 25 bp, Rattus norvegicus
ctgctcctttgcgttagttgtaact

SEQ ID NO: 272657 - DNA, 25 bp, Rattus norvegicus
ctgctcgaagctcgcattctgtata

SEQ ID NO: 272658 - DNA, 25 bp, Rattus norvegicus
ctgctcgaagctggcattctgtata

SEQ ID NO: 272659 - DNA, 25 bp, Rattus norvegicus
ctgctcgctggaaggctatgacgga

SEQ ID NO: 272660 - DNA, 25 bp, Rattus norvegicus
ctgctcgctggatggctatgacgga

SEQ ID NO: 272661 - DNA, 25 bp, Rattus norvegicus
ctgctcggttgacttcaggtactga

SEQ ID NO: 272662 - DNA, 25 bp, Rattus norvegicus
ctgctcggttgagttcaggtactga

SEQ ID NO: 272663 - DNA, 25 bp, Rattus norvegicus
ctgctcgtgtggctttttatgtttg

SEQ ID NO: 272664 - DNA, 25 bp, Rattus norvegicus
ctgctcgtgtgggtttttatgtttg

SEQ ID NO: 272665 - DNA, 25 bp, Rattus norvegicus
ctgctctaagccactgggtactagg

SEQ ID NO: 272666 - DNA, 25 bp, Rattus norvegicus
ctgctctaagcctctgggtactagg

SEQ ID NO: 272667 - DNA, 25 bp, Rattus norvegicus
ctgctctaccaacagtcctgagttc

SEQ ID NO: 272668 - DNA, 25 bp, Rattus norvegicus
ctgctctaccaagagtcctgagttc

SEQ ID NO: 272669 - DNA, 25 bp, Rattus norvegicus
ctgctctagtgacagctcccatcat

SEQ ID NO: 272670 - DNA, 25 bp, Rattus norvegicus
ctgctctagtgagagctcccatcat

SEQ ID NO: 272671 - DNA, 25 bp, Rattus norvegicus
ctgctctagtggagactcatgctta

SEQ ID NO: 272672 - DNA, 25 bp, Rattus norvegicus
ctgctctagtggtgactcatgctta

SEQ ID NO: 272673 - DNA, 25 bp, Rattus norvegicus
ctgctctatcagcactggtgaccag

SEQ ID NO: 272674 - DNA, 25 bp, Rattus norvegicus
ctgctctatcaggactggtgaccag

SEQ ID NO: 272675 - DNA, 25 bp, Rattus norvegicus
ctgctctatggcagagggacacttt

SEQ ID NO: 272676 - DNA, 25 bp, Rattus norvegicus
ctgctctatggctgagggacacttt

SEQ ID NO: 272677 - DNA, 25 bp, Rattus norvegicus
ctgctctcactgaagttctttgggt

SEQ ID NO: 272678 - DNA, 25 bp, Rattus norvegicus
ctgctctcactgtagttctttgggt

SEQ ID NO: 272679 - DNA, 25 bp, Rattus norvegicus
ctgctctcagaactgtccgtccaag

SEQ ID NO: 272680 - DNA, 25 bp, Rattus norvegicus
ctgctctcagaagtgtccgtccaag

SEQ ID NO: 272681 - DNA, 25 bp, Rattus norvegicus
ctgctctcagacaaaaccttgctat

SEQ ID NO: 272682 - DNA, 25 bp, Rattus norvegicus
ctgctctcagactaaaccttgctat

SEQ ID NO: 272683 - DNA, 25 bp, Rattus norvegicus
ctgctctccaggcatgtggctggta

SEQ ID NO: 272684 - DNA, 25 bp, Rattus norvegicus
ctgctctccagggatgtggctggta

SEQ ID NO: 272685 - DNA, 25 bp, Rattus norvegicus
ctgctctcgtggatgctggaactgc

SEQ ID NO: 272686 - DNA, 25 bp, Rattus norvegicus
ctgctctcgtggttgctggaactgc

SEQ ID NO: 272687 - DNA, 25 bp, Rattus norvegicus
ctgctctctactaggctcaaaacaa

SEQ ID NO: 272688 - DNA, 25 bp, Rattus norvegicus
ctgctctctacttggctcaaaacaa

SEQ ID NO: 272689 - DNA, 25 bp, Rattus norvegicus
ctgctctctgggattagtctgaggg

SEQ ID NO: 272690 - DNA, 25 bp, Rattus norvegicus
ctgctctctgggtttagtctgaggg

SEQ ID NO: 272691 - DNA, 25 bp, Rattus norvegicus
ctgctctcttacacacatctggaaa

SEQ ID NO: 272692 - DNA, 25 bp, Rattus norvegicus
ctgctctcttactcacatctggaaa

SEQ ID NO: 272693 - DNA, 25 bp, Rattus norvegicus
ctgctctcttagacctcttaggaac

SEQ ID NO: 272694 - DNA, 25 bp, Rattus norvegicus
ctgctctcttagtcctcttaggaac

SEQ ID NO: 272695 - DNA, 25 bp, Rattus norvegicus
ctgctctcttgtcactgtgttcatg

SEQ ID NO: 272696 - DNA, 25 bp, Rattus norvegicus
ctgctctcttgtgactgtgttcatg

SEQ ID NO: 272697 - DNA, 25 bp, Rattus norvegicus
ctgctctctttgattccaagttcaa

SEQ ID NO: 272698 - DNA, 25 bp, Rattus norvegicus
ctgctctctttgtttccaagttcaa

SEQ ID NO: 272699 - DNA, 25 bp, Rattus norvegicus
ctgctctgacctagttttctcagga

SEQ ID NO: 272700 - DNA, 25 bp, Rattus norvegicus
ctgctctgaccttgttttctcagga

SEQ ID NO: 272701 - DNA, 25 bp, Rattus norvegicus
ctgctctgcaagctagacgcgggaa

SEQ ID NO: 272702 - DNA, 25 bp, Rattus norvegicus
ctgctctgcaaggtagacgcgggaa

SEQ ID NO: 272703 - DNA, 25 bp, Rattus norvegicus
ctgctctgcattacaaaacgtaggg

SEQ ID NO: 272704 - DNA, 25 bp, Rattus norvegicus
ctgctctgcatttcaaaacgtaggg

SEQ ID NO: 272705 - DNA, 25 bp, Rattus norvegicus
ctgctctgctggctcagatgatcca

SEQ ID NO: 272706 - DNA, 25 bp, Rattus norvegicus
ctgctctgctgggtcagatgatcca

SEQ ID NO: 272707 - DNA, 25 bp, Rattus norvegicus
ctgctctggaatcctgttctggaga

SEQ ID NO: 272708 - DNA, 25 bp, Rattus norvegicus
ctgctctggaatgctgttctggaga

SEQ ID NO: 272709 - DNA, 25 bp, Rattus norvegicus
ctgctctggactacgggctaattag

SEQ ID NO: 272710 - DNA, 25 bp, Rattus norvegicus
ctgctctggacttcgggctaattag

SEQ ID NO: 272711 - DNA, 25 bp, Rattus norvegicus
ctgctctgggacctcaggagacaat

SEQ ID NO: 272712 - DNA, 25 bp, Rattus norvegicus
ctgctctgggacgtcaggagacaat

SEQ ID NO: 272713 - DNA, 25 bp, Rattus norvegicus
ctgctctggttcaggcggaagaaat

SEQ ID NO: 272714 - DNA, 25 bp, Rattus norvegicus
ctgctctggttctggcggaagaaat

SEQ ID NO: 272715 - DNA, 25 bp, Rattus norvegicus
ctgctctgtaccctttttctttttg

SEQ ID NO: 272716 - DNA, 25 bp, Rattus norvegicus
ctgctctgtaccgtttttctttttg

SEQ ID NO: 272717 - DNA, 25 bp, Rattus norvegicus
ctgctcttacctaggcactagagag

SEQ ID NO: 272718 - DNA, 25 bp, Rattus norvegicus
ctgctcttaccttggcactagagag

SEQ ID NO: 272719 - DNA, 25 bp, Rattus norvegicus
ctgctcttcaacctcatggattggc

SEQ ID NO: 272720 - DNA, 25 bp, Rattus norvegicus
ctgctcttcaacgtcatggattggc

SEQ ID NO: 272721 - DNA, 25 bp, Rattus norvegicus
ctgctcttctacatgtcaccatgaa

SEQ ID NO: 272722 - DNA, 25 bp, Rattus norvegicus
ctgctcttctacttgtcaccatgaa

SEQ ID NO: 272723 - DNA, 25 bp, Rattus norvegicus
ctgctcttctccaaaaggtgctaag

SEQ ID NO: 272724 - DNA, 25 bp, Rattus norvegicus
ctgctcttctcctaaaggtgctaag

SEQ ID NO: 272725 - DNA, 25 bp, Rattus norvegicus
ctgctcttgactctgcaatgcaatg

SEQ ID NO: 272726 - DNA, 25 bp, Rattus norvegicus
ctgctcttgactgtgcaatgcaatg

SEQ ID NO: 272727 - DNA, 25 bp, Rattus norvegicus
ctgctcttgaggaacgcactgtgaa

SEQ ID NO: 272728 - DNA, 25 bp, Rattus norvegicus
ctgctcttgaggtacgcactgtgaa

SEQ ID NO: 272729 - DNA, 25 bp, Rattus norvegicus
ctgctcttgatgatgccggccctga

SEQ ID NO: 272730 - DNA, 25 bp, Rattus norvegicus
ctgctcttgatgttgccggccctga

SEQ ID NO: 272731 - DNA, 25 bp, Rattus norvegicus
ctgctcttgcagagactctaactta

SEQ ID NO: 272732 - DNA, 25 bp, Rattus norvegicus
ctgctcttgcagtgactctaactta

SEQ ID NO: 272733 - DNA, 25 bp, Rattus norvegicus
ctgctcttggctatcaaagtctcag

SEQ ID NO: 272734 - DNA, 25 bp, Rattus norvegicus
ctgctcttggctttcaaagtctcag

SEQ ID NO: 272735 - DNA, 25 bp, Rattus norvegicus
ctgctcttgggacgctctggtatcc

SEQ ID NO: 272736 - DNA, 25 bp, Rattus norvegicus
ctgctcttgggaggctctggtatcc

SEQ ID NO: 272737 - DNA, 25 bp, Rattus norvegicus
ctgctctttagaagatgtgccaaaa

SEQ ID NO: 272738 - DNA, 25 bp, Rattus norvegicus
ctgctctttagatgatgtgccaaaa

SEQ ID NO: 272739 - DNA, 25 bp, Rattus norvegicus
ctgctgaaaagcaggcgcgggatct

SEQ ID NO: 272740 - DNA, 25 bp, Rattus norvegicus
ctgctgaaaagctggcgcgggatct

SEQ ID NO: 272741 - DNA, 25 bp, Rattus norvegicus
ctgctgacaccgacagagcggaact

SEQ ID NO: 272742 - DNA, 25 bp, Rattus norvegicus
ctgctgacaccgtcagagcggaact

SEQ ID NO: 272743 - DNA, 25 bp, Rattus norvegicus
ctgctgacacttctgatactgctga

SEQ ID NO: 272744 - DNA, 25 bp, Rattus norvegicus
ctgctgacacttgtgatactgctga

SEQ ID NO: 272745 - DNA, 25 bp, Rattus norvegicus
ctgctgacccatcgcttttattaca

SEQ ID NO: 272746 - DNA, 25 bp, Rattus norvegicus
ctgctgacccatggcttttattaca

SEQ ID NO: 272747 - DNA, 25 bp, Rattus norvegicus
ctgctgacctgcagtaaacatctgt

SEQ ID NO: 272748 - DNA, 25 bp, Rattus norvegicus
ctgctgacctgctgtaaacatctgt

SEQ ID NO: 272749 - DNA, 25 bp, Rattus norvegicus
ctgctgactgctcgcgaaggtttgt

SEQ ID NO: 272750 - DNA, 25 bp, Rattus norvegicus
ctgctgactgctggcgaaggtttgt

SEQ ID NO: 272751 - DNA, 25 bp, Rattus norvegicus
ctgctgactttcatccgggtgatgg

SEQ ID NO: 272752 - DNA, 25 bp, Rattus norvegicus
ctgctgactttcttccgggtgatgg

SEQ ID NO: 272753 - DNA, 25 bp, Rattus norvegicus
ctgctgagagcccaaactggtactt

SEQ ID NO: 272754 - DNA, 25 bp, Rattus norvegicus
ctgctgagagccgaaactggtactt

SEQ ID NO: 272755 - DNA, 25 bp, Rattus norvegicus
ctgctgagagctctgcttgggtttc

SEQ ID NO: 272756 - DNA, 25 bp, Rattus norvegicus
ctgctgagagctgtgcttgggtttc

SEQ ID NO: 272757 - DNA, 25 bp, Rattus norvegicus
ctgctgagcagaatcccatggaacc

SEQ ID NO: 272758 - DNA, 25 bp, Rattus norvegicus
ctgctgagcagattcccatggaacc

SEQ ID NO: 272759 - DNA, 25 bp, Rattus norvegicus
ctgctgagcgatcccacgatggaga

SEQ ID NO: 272760 - DNA, 25 bp, Rattus norvegicus
ctgctgagcgatgccacgatggaga

SEQ ID NO: 272761 - DNA, 25 bp, Rattus norvegicus
ctgctgaggctgcaaacacttgaac

SEQ ID NO: 272762 - DNA, 25 bp, Rattus norvegicus
ctgctgaggctggaaacacttgaac

SEQ ID NO: 272763 - DNA, 25 bp, Rattus norvegicus
ctgctgagggctccgagccaaagtt

SEQ ID NO: 272764 - DNA, 25 bp, Rattus norvegicus
ctgctgagggctgcgagccaaagtt

SEQ ID NO: 272765 - DNA, 25 bp, Rattus norvegicus
ctgctgagttgccttgctcagagta

SEQ ID NO: 272766 - DNA, 25 bp, Rattus norvegicus
ctgctgagttgcgttgctcagagta

SEQ ID NO: 272767 - DNA, 25 bp, Rattus norvegicus
ctgctgatcagtcgttttcctgttc

SEQ ID NO: 272768 - DNA, 25 bp, Rattus norvegicus
ctgctgatcagtggttttcctgttc

SEQ ID NO: 272769 - DNA, 25 bp, Rattus norvegicus
ctgctgatcgagcacttggaggcca

SEQ ID NO: 272770 - DNA, 25 bp, Rattus norvegicus
ctgctgatcgaggacttggaggcca

SEQ ID NO: 272771 - DNA, 25 bp, Rattus norvegicus
ctgctgatgaccctgctgtctgtga

SEQ ID NO: 272772 - DNA, 25 bp, Rattus norvegicus
ctgctgatgaccgtgctgtctgtga

SEQ ID NO: 272773 - DNA, 25 bp, Rattus norvegicus
ctgctgatgactataccaagccata

SEQ ID NO: 272774 - DNA, 25 bp, Rattus norvegicus
ctgctgatgactttaccaagccata

SEQ ID NO: 272775 - DNA, 25 bp, Rattus norvegicus
ctgctgatgcttactaggtatccgt

SEQ ID NO: 272776 - DNA, 25 bp, Rattus norvegicus
ctgctgatgctttctaggtatccgt

SEQ ID NO: 272777 - DNA, 25 bp, Rattus norvegicus
ctgctgatggccagactctgtttgc

SEQ ID NO: 272778 - DNA, 25 bp, Rattus norvegicus
ctgctgatggcctgactctgtttgc

SEQ ID NO: 272779 - DNA, 25 bp, Rattus norvegicus
ctgctgatgtgaccctccttgagaa

SEQ ID NO: 272780 - DNA, 25 bp, Rattus norvegicus
ctgctgatgtgagcctccttgagaa

SEQ ID NO: 272781 - DNA, 25 bp, Rattus norvegicus
ctgctgcactccaactgtgatagaa

SEQ ID NO: 272782 - DNA, 25 bp, Rattus norvegicus
ctgctgcactcctactgtgatagaa

SEQ ID NO: 272783 - DNA, 25 bp, Rattus norvegicus
ctgctgcactggatctcatgtgtgt

SEQ ID NO: 272784 - DNA, 25 bp, Rattus norvegicus
ctgctgcactggttctcatgtgtgt

SEQ ID NO: 272785 - DNA, 25 bp, Rattus norvegicus
ctgctgcagctgctttcctagaaaa

SEQ ID NO: 272786 - DNA, 25 bp, Rattus norvegicus
ctgctgcagctggtttcctagaaaa

SEQ ID NO: 272787 - DNA, 25 bp, Rattus norvegicus
ctgctgcaggagcagctcaaacagg

SEQ ID NO: 272788 - DNA, 25 bp, Rattus norvegicus
ctgctgcaggaggagctcaaacagg

SEQ ID NO: 272789 - DNA, 25 bp, Rattus norvegicus
ctgctgcatcttcctttgagttgaa

SEQ ID NO: 272790 - DNA, 25 bp, Rattus norvegicus
ctgctgcatcttgctttgagttgaa

SEQ ID NO: 272791 - DNA, 25 bp, Rattus norvegicus
ctgctgcatgctactggagtggaca

SEQ ID NO: 272792 - DNA, 25 bp, Rattus norvegicus
ctgctgcatgcttctggagtggaca

SEQ ID NO: 272793 - DNA, 25 bp, Rattus norvegicus
ctgctgccaagcctgtgattaagaa

SEQ ID NO: 272794 - DNA, 25 bp, Rattus norvegicus
ctgctgccaagcgtgtgattaagaa

SEQ ID NO: 272795 - DNA, 25 bp, Rattus norvegicus
ctgctgccaggtacatacaggcgta

SEQ ID NO: 272796 - DNA, 25 bp, Rattus norvegicus
ctgctgccaggttcatacaggcgta

SEQ ID NO: 272797 - DNA, 25 bp, Rattus norvegicus
ctgctgccatgtagattgtctttta

SEQ ID NO: 272798 - DNA, 25 bp, Rattus norvegicus
ctgctgccatgttgattgtctttta

SEQ ID NO: 272799 - DNA, 25 bp, Rattus norvegicus
ctgctgccgcccaaaaagaactgaa

SEQ ID NO: 272800 - DNA, 25 bp, Rattus norvegicus
ctgctgccgccctaaaagaactgaa

SEQ ID NO: 272801 - DNA, 25 bp, Rattus norvegicus
ctgctgccggaactgaccagatatg

SEQ ID NO: 272802 - DNA, 25 bp, Rattus norvegicus
ctgctgccggaagtgaccagatatg

SEQ ID NO: 272803 - DNA, 25 bp, Rattus norvegicus
ctgctgcctcaccagaagagagtac

SEQ ID NO: 272804 - DNA, 25 bp, Rattus norvegicus
ctgctgcctcacgagaagagagtac

SEQ ID NO: 272805 - DNA, 25 bp, Rattus norvegicus
ctgctgccttcgaagtgtgcgaaca

SEQ ID NO: 272806 - DNA, 25 bp, Rattus norvegicus
ctgctgccttcgtagtgtgcgaaca

SEQ ID NO: 272807 - DNA, 25 bp, Rattus norvegicus
ctgctgcgggttctctaagggaact

SEQ ID NO: 272808 - DNA, 25 bp, Rattus norvegicus
ctgctgcgggttgtctaagggaact

SEQ ID NO: 272809 - DNA, 25 bp, Rattus norvegicus
ctgctgcgtcgtcactttaagtcta

SEQ ID NO: 272810 - DNA, 25 bp, Rattus norvegicus
ctgctgcgtcgtgactttaagtcta

SEQ ID NO: 272811 - DNA, 25 bp, Rattus norvegicus
ctgctgctaactaggatcctgaggc

SEQ ID NO: 272812 - DNA, 25 bp, Rattus norvegicus
ctgctgctaacttggatcctgaggc

SEQ ID NO: 272813 - DNA, 25 bp, Rattus norvegicus
ctgctgctaaggaaccgggattctc

SEQ ID NO: 272814 - DNA, 25 bp, Rattus norvegicus
ctgctgctaaggtaccgggattctc

SEQ ID NO: 272815 - DNA, 25 bp, Rattus norvegicus
ctgctgctacctcttaaaccagaag

SEQ ID NO: 272816 - DNA, 25 bp, Rattus norvegicus
ctgctgctacctgttaaaccagaag

SEQ ID NO: 272817 - DNA, 25 bp, Rattus norvegicus
ctgctgctactgaacctgaatcaaa

SEQ ID NO: 272818 - DNA, 25 bp, Rattus norvegicus
ctgctgctactgtacctgaatcaaa

SEQ ID NO: 272819 - DNA, 25 bp, Rattus norvegicus
ctgctgctagccacttggaattata

SEQ ID NO: 272820 - DNA, 25 bp, Rattus norvegicus
ctgctgctagcccagagagctaaca

SEQ ID NO: 272821 - DNA, 25 bp, Rattus norvegicus
ctgctgctagccgagagagctaaca

SEQ ID NO: 272822 - DNA, 25 bp, Rattus norvegicus
ctgctgctagcctcttggaattata

SEQ ID NO: 272823 - DNA, 25 bp, Rattus norvegicus
ctgctgctattcaagtgcctcaaat

SEQ ID NO: 272824 - DNA, 25 bp, Rattus norvegicus
ctgctgctattctagtgcctcaaat

SEQ ID NO: 272825 - DNA, 25 bp, Rattus norvegicus
ctgctgctattgcacttcaccaggg

SEQ ID NO: 272826 - DNA, 25 bp, Rattus norvegicus
ctgctgctattggacttcaccaggg

SEQ ID NO: 272827 - DNA, 25 bp, Rattus norvegicus
ctgctgctcaacagtggacgttaga

SEQ ID NO: 272828 - DNA, 25 bp, Rattus norvegicus
ctgctgctcaactgtggacgttaga

SEQ ID NO: 272829 - DNA, 25 bp, Rattus norvegicus
ctgctgctcaccactattttacaga

SEQ ID NO: 272830 - DNA, 25 bp, Rattus norvegicus
ctgctgctcacctctattttacaga

SEQ ID NO: 272831 - DNA, 25 bp, Rattus norvegicus
ctgctgctcgccctgttcaagaagg

SEQ ID NO: 272832 - DNA, 25 bp, Rattus norvegicus
ctgctgctcgccgtgttcaagaagg

SEQ ID NO: 272833 - DNA, 25 bp, Rattus norvegicus
ctgctgctgcagatgtgcacggaat

SEQ ID NO: 272834 - DNA, 25 bp, Rattus norvegicus
ctgctgctgcagttgtgcacggaat

SEQ ID NO: 272835 - DNA, 25 bp, Rattus norvegicus
ctgctgctggagagctctcgcgaac

SEQ ID NO: 272836 - DNA, 25 bp, Rattus norvegicus
ctgctgctggagtgctctcgcgaac

SEQ ID NO: 272837 - DNA, 25 bp, Rattus norvegicus
ctgctgctgtctctgactactgtaa

SEQ ID NO: 272838 - DNA, 25 bp, Rattus norvegicus
ctgctgctgtctgtgactactgtaa

SEQ ID NO: 272839 - DNA, 25 bp, Rattus norvegicus
ctgctgcttctgagcttggattaga

SEQ ID NO: 272840 - DNA, 25 bp, Rattus norvegicus
ctgctgcttctgtgcttggattaga

SEQ ID NO: 272841 - DNA, 25 bp, Rattus norvegicus
ctgctgctttggactttaggatcta

SEQ ID NO: 272842 - DNA, 25 bp, Rattus norvegicus
ctgctgctttggctaattggtgtcc

SEQ ID NO: 272843 - DNA, 25 bp, Rattus norvegicus
ctgctgctttgggtaattggtgtcc

SEQ ID NO: 272844 - DNA, 25 bp, Rattus norvegicus
ctgctgctttggtctttaggatcta

SEQ ID NO: 272845 - DNA, 25 bp, Rattus norvegicus
ctgctgcttttgactgtctgtcatt

SEQ ID NO: 272846 - DNA, 25 bp, Rattus norvegicus
ctgctgcttttgtctgtctgtcatt

SEQ ID NO: 272847 - DNA, 25 bp, Rattus norvegicus
ctgctggacagaaaacaagtacaat

SEQ ID NO: 272848 - DNA, 25 bp, Rattus norvegicus
ctgctggacagataacaagtacaat

SEQ ID NO: 272849 - DNA, 25 bp, Rattus norvegicus
ctgctggaccggctgatgatcatca

SEQ ID NO: 272850 - DNA, 25 bp, Rattus norvegicus
ctgctggaccgggtgatgatcatca

SEQ ID NO: 272851 - DNA, 25 bp, Rattus norvegicus
ctgctggactcaagccaaaaggatg

SEQ ID NO: 272852 - DNA, 25 bp, Rattus norvegicus
ctgctggactcatgccaaaaggatg

SEQ ID NO: 272853 - DNA, 25 bp, Rattus norvegicus
ctgctggacttcctcaacgtgaaga

SEQ ID NO: 272854 - DNA, 25 bp, Rattus norvegicus
ctgctggacttcgtcaacgtgaaga

SEQ ID NO: 272855 - DNA, 25 bp, Rattus norvegicus
ctgctggagcttatgctggttacac

SEQ ID NO: 272856 - DNA, 25 bp, Rattus norvegicus
ctgctggagcttttgctggttacac

SEQ ID NO: 272857 - DNA, 25 bp, Rattus norvegicus
ctgctggagtccagactggcaggcc

SEQ ID NO: 272858 - DNA, 25 bp, Rattus norvegicus
ctgctggagtcctgactggcaggcc

SEQ ID NO: 272859 - DNA, 25 bp, Rattus norvegicus
ctgctggagttgaggtgtgtccctc

SEQ ID NO: 272860 - DNA, 25 bp, Rattus norvegicus
ctgctggagttgtggtgtgtccctc

SEQ ID NO: 272861 - DNA, 25 bp, Rattus norvegicus
ctgctggatgaaatgcactgtgcaa

SEQ ID NO: 272862 - DNA, 25 bp, Rattus norvegicus
ctgctggatgaattgcactgtgcaa

SEQ ID NO: 272863 - DNA, 25 bp, Rattus norvegicus
ctgctggattacaccttgtgtcact

SEQ ID NO: 272864 - DNA, 25 bp, Rattus norvegicus
ctgctggattactccttgtgtcact

SEQ ID NO: 272865 - DNA, 25 bp, Rattus norvegicus
ctgctggattttcttgtgcatcatt

SEQ ID NO: 272866 - DNA, 25 bp, Rattus norvegicus
ctgctggattttgttgtgcatcatt

SEQ ID NO: 272867 - DNA, 25 bp, Rattus norvegicus
ctgctggcaagaagtgggccctgtt

SEQ ID NO: 272868 - DNA, 25 bp, Rattus norvegicus
ctgctggcaagatgtgggccctgtt

SEQ ID NO: 272869 - DNA, 25 bp, Rattus norvegicus
ctgctggcacagagctgcatggaca

SEQ ID NO: 272870 - DNA, 25 bp, Rattus norvegicus
ctgctggcacagtgctgcatggaca

SEQ ID NO: 272871 - DNA, 25 bp, Rattus norvegicus
ctgctggcagctctagtttctaatc

SEQ ID NO: 272872 - DNA, 25 bp, Rattus norvegicus
ctgctggcagctgtagtttctaatc

SEQ ID NO: 272873 - DNA, 25 bp, Rattus norvegicus
ctgctggcagttattcctgttttcc

SEQ ID NO: 272874 - DNA, 25 bp, Rattus norvegicus
ctgctggcagtttttcctgttttcc

SEQ ID NO: 272875 - DNA, 25 bp, Rattus norvegicus
ctgctggccagacgcgcaagatgct

SEQ ID NO: 272876 - DNA, 25 bp, Rattus norvegicus
ctgctggccagaggcgcaagatgct

SEQ ID NO: 272877 - DNA, 25 bp, Rattus norvegicus
ctgctggccagtcgatacgactctc

SEQ ID NO: 272878 - DNA, 25 bp, Rattus norvegicus
ctgctggccagtggatacgactctc

SEQ ID NO: 272879 - DNA, 25 bp, Rattus norvegicus
ctgctggccctacactgagggcaga

SEQ ID NO: 272880 - DNA, 25 bp, Rattus norvegicus
ctgctggccctagactgagggcaga

SEQ ID NO: 272881 - DNA, 25 bp, Rattus norvegicus
ctgctggccgctaaggattcagaac

SEQ ID NO: 272882 - DNA, 25 bp, Rattus norvegicus
ctgctggccgcttaggattcagaac

SEQ ID NO: 272883 - DNA, 25 bp, Rattus norvegicus
ctgctggccttgctggcagtaacca

SEQ ID NO: 272884 - DNA, 25 bp, Rattus norvegicus
ctgctggccttggtggcagtaacca

SEQ ID NO: 272885 - DNA, 25 bp, Rattus norvegicus
ctgctggcgccccagatcatggagg

SEQ ID NO: 272886 - DNA, 25 bp, Rattus norvegicus
ctgctggcgcccgagatcatggagg

SEQ ID NO: 272887 - DNA, 25 bp, Rattus norvegicus
ctgctggcggagatgaaggctaaac

SEQ ID NO: 272888 - DNA, 25 bp, Rattus norvegicus
ctgctggcggagttgaaggctaaac

SEQ ID NO: 272889 - DNA, 25 bp, Rattus norvegicus
ctgctggcgtccagatctgatggag

SEQ ID NO: 272890 - DNA, 25 bp, Rattus norvegicus
ctgctggcgtcctgatctgatggag

SEQ ID NO: 272891 - DNA, 25 bp, Rattus norvegicus
ctgctggctatcaagagggattcct

SEQ ID NO: 272892 - DNA, 25 bp, Rattus norvegicus
ctgctggctatctagagggattcct

SEQ ID NO: 272893 - DNA, 25 bp, Rattus norvegicus
ctgctggctcaccaagtaggctttg

SEQ ID NO: 272894 - DNA, 25 bp, Rattus norvegicus
ctgctggctcacgaagtaggctttg

SEQ ID NO: 272895 - DNA, 25 bp, Rattus norvegicus
ctgctggctgggaattctttccata

SEQ ID NO: 272896 - DNA, 25 bp, Rattus norvegicus
ctgctggctgggtattctttccata

SEQ ID NO: 272897 - DNA, 25 bp, Rattus norvegicus
ctgctggctgtgaggccttaagtaa

SEQ ID NO: 272898 - DNA, 25 bp, Rattus norvegicus
ctgctggctgtgtggccttaagtaa

SEQ ID NO: 272899 - DNA, 25 bp, Rattus norvegicus
ctgctggcttctcccaaagagttat

SEQ ID NO: 272900 - DNA, 25 bp, Rattus norvegicus
ctgctggcttctgccaaagagttat

SEQ ID NO: 272901 - DNA, 25 bp, Rattus norvegicus
ctgctggcttggatgacggtcatga

SEQ ID NO: 272902 - DNA, 25 bp, Rattus norvegicus
ctgctggcttggttgacggtcatga

SEQ ID NO: 272903 - DNA, 25 bp, Rattus norvegicus
ctgctgggactgatccaggtaacct

SEQ ID NO: 272904 - DNA, 25 bp, Rattus norvegicus
ctgctgggactgttccaggtaacct

SEQ ID NO: 272905 - DNA, 25 bp, Rattus norvegicus
ctgctgggacttctggactacaaca

SEQ ID NO: 272906 - DNA, 25 bp, Rattus norvegicus
ctgctgggacttgtggactacaaca

SEQ ID NO: 272907 - DNA, 25 bp, Rattus norvegicus
ctgctgggagagatcccctggcttg

SEQ ID NO: 272908 - DNA, 25 bp, Rattus norvegicus
ctgctgggagagttcccctggcttg

SEQ ID NO: 272909 - DNA, 25 bp, Rattus norvegicus
ctgctgggagcaccttgcctatggt

SEQ ID NO: 272910 - DNA, 25 bp, Rattus norvegicus
ctgctgggagcagcttgcctatggt

SEQ ID NO: 272911 - DNA, 25 bp, Rattus norvegicus
ctgctgggcaggaccctatggtaca

SEQ ID NO: 272912 - DNA, 25 bp, Rattus norvegicus
ctgctgggcaggtccctatggtaca

SEQ ID NO: 272913 - DNA, 25 bp, Rattus norvegicus
ctgctgggtcatattttgtgtagta

SEQ ID NO: 272914 - DNA, 25 bp, Rattus norvegicus
ctgctgggtcattttttgtgtagta

SEQ ID NO: 272915 - DNA, 25 bp, Rattus norvegicus
ctgctgggtcgactcgatctaggct

SEQ ID NO: 272916 - DNA, 25 bp, Rattus norvegicus
ctgctgggtcgagtcgatctaggct

SEQ ID NO: 272917 - DNA, 25 bp, Rattus norvegicus
ctgctgggtgctctttggactgtat

SEQ ID NO: 272918 - DNA, 25 bp, Rattus norvegicus
ctgctgggtgctgtttggactgtat

SEQ ID NO: 272919 - DNA, 25 bp, Rattus norvegicus
ctgctgggtttccaattcttttcca

SEQ ID NO: 272920 - DNA, 25 bp, Rattus norvegicus
ctgctgggtttcgaattcttttcca

SEQ ID NO: 272921 - DNA, 25 bp, Rattus norvegicus
ctgctggtccctcggcttcaggact

SEQ ID NO: 272922 - DNA, 25 bp, Rattus norvegicus
ctgctggtccctgggcttcaggact

SEQ ID NO: 272923 - DNA, 25 bp, Rattus norvegicus
ctgctggtcctgaaagaatttctat

SEQ ID NO: 272924 - DNA, 25 bp, Rattus norvegicus
ctgctggtcctgtaagaatttctat

SEQ ID NO: 272925 - DNA, 25 bp, Rattus norvegicus
ctgctggtctccataggactggagt

SEQ ID NO: 272926 - DNA, 25 bp, Rattus norvegicus
ctgctggtctccttaggactggagt

SEQ ID NO: 272927 - DNA, 25 bp, Rattus norvegicus
ctgctggtctctcatctggaatgaa

SEQ ID NO: 272928 - DNA, 25 bp, Rattus norvegicus
ctgctggtctctgatctggaatgaa

SEQ ID NO: 272929 - DNA, 25 bp, Rattus norvegicus
ctgctggtgaagagcttctccgaga

SEQ ID NO: 272930 - DNA, 25 bp, Rattus norvegicus
ctgctggtgaagtgcttctccgaga

SEQ ID NO: 272931 - DNA, 25 bp, Rattus norvegicus
ctgctggtgacaagcctggcataga

SEQ ID NO: 272932 - DNA, 25 bp, Rattus norvegicus
ctgctggtgacatgcctggcataga

SEQ ID NO: 272933 - DNA, 25 bp, Rattus norvegicus
ctgctggtgataagagtctgcctca

SEQ ID NO: 272934 - DNA, 25 bp, Rattus norvegicus
ctgctggtgatatgagtctgcctca

SEQ ID NO: 272935 - DNA, 25 bp, Rattus norvegicus
ctgctggtgatgaagagtcttgact

SEQ ID NO: 272936 - DNA, 25 bp, Rattus norvegicus
ctgctggtgatgtagagtcttgact

SEQ ID NO: 272937 - DNA, 25 bp, Rattus norvegicus
ctgctggtgcagaatgccacgggaa

SEQ ID NO: 272938 - DNA, 25 bp, Rattus norvegicus
ctgctggtgcagtatgccacgggaa

SEQ ID NO: 272939 - DNA, 25 bp, Rattus norvegicus
ctgctggtgcctagcatttcaaaaa

SEQ ID NO: 272940 - DNA, 25 bp, Rattus norvegicus
ctgctggtgccttgcatttcaaaaa

SEQ ID NO: 272941 - DNA, 25 bp, Rattus norvegicus
ctgctggttcgtacacaacagtggg

SEQ ID NO: 272942 - DNA, 25 bp, Rattus norvegicus
ctgctggttcgttcacaacagtggg

SEQ ID NO: 272943 - DNA, 25 bp, Rattus norvegicus
ctgctggtttcactacatgagaact

SEQ ID NO: 272944 - DNA, 25 bp, Rattus norvegicus
ctgctggtttcagtacatgagaact

SEQ ID NO: 272945 - DNA, 25 bp, Rattus norvegicus
ctgctgtaagctatcctgtttttgt

SEQ ID NO: 272946 - DNA, 25 bp, Rattus norvegicus
ctgctgtaagctttcctgtttttgt

SEQ ID NO: 272947 - DNA, 25 bp, Rattus norvegicus
ctgctgtacgcacattgctttgata

SEQ ID NO: 272948 - DNA, 25 bp, Rattus norvegicus
ctgctgtacgcagattgctttgata

SEQ ID NO: 272949 - DNA, 25 bp, Rattus norvegicus
ctgctgtactgcaagtcccactagt

SEQ ID NO: 272950 - DNA, 25 bp, Rattus norvegicus
ctgctgtactgctagtcccactagt

SEQ ID NO: 272951 - DNA, 25 bp, Rattus norvegicus
ctgctgtaggctcagaacggccata

SEQ ID NO: 272952 - DNA, 25 bp, Rattus norvegicus
ctgctgtaggctgagaacggccata

SEQ ID NO: 272953 - DNA, 25 bp, Rattus norvegicus
ctgctgtatgctccttggttggtag

SEQ ID NO: 272954 - DNA, 25 bp, Rattus norvegicus
ctgctgtatgctgcttggttggtag

SEQ ID NO: 272955 - DNA, 25 bp, Rattus norvegicus
ctgctgtatgtcaccaggatttgga

SEQ ID NO: 272956 - DNA, 25 bp, Rattus norvegicus
ctgctgtatgtctccaggatttgga

SEQ ID NO: 272957 - DNA, 25 bp, Rattus norvegicus
ctgctgtattgcctctgaagtctaa

SEQ ID NO: 272958 - DNA, 25 bp, Rattus norvegicus
ctgctgtattgcgtctgaagtctaa

SEQ ID NO: 272959 - DNA, 25 bp, Rattus norvegicus
ctgctgtattgtagggtttcttctt

SEQ ID NO: 272960 - DNA, 25 bp, Rattus norvegicus
ctgctgtattgttgggtttcttctt

SEQ ID NO: 272961 - DNA, 25 bp, Rattus norvegicus
ctgctgtatttaatagtgggctcca

SEQ ID NO: 272962 - DNA, 25 bp, Rattus norvegicus
ctgctgtatttattagtgggctcca

SEQ ID NO: 272963 - DNA, 25 bp, Rattus norvegicus
ctgctgtcactgaagagcccgggaa

SEQ ID NO: 272964 - DNA, 25 bp, Rattus norvegicus
ctgctgtcactgtagagcccgggaa

SEQ ID NO: 272965 - DNA, 25 bp, Rattus norvegicus
ctgctgtcagtgagcatgtcagtga

SEQ ID NO: 272966 - DNA, 25 bp, Rattus norvegicus
ctgctgtcagtgtgcatgtcagtga

SEQ ID NO: 272967 - DNA, 25 bp, Rattus norvegicus
ctgctgtcatgtcgcctggaataaa

SEQ ID NO: 272968 - DNA, 25 bp, Rattus norvegicus
ctgctgtcatgtggcctggaataaa

SEQ ID NO: 272969 - DNA, 25 bp, Rattus norvegicus
ctgctgtccagactgtaaggtgcct

SEQ ID NO: 272970 - DNA, 25 bp, Rattus norvegicus
ctgctgtccagagtgtaaggtgcct

SEQ ID NO: 272971 - DNA, 25 bp, Rattus norvegicus
ctgctgtccctactccatgggaaga

SEQ ID NO: 272972 - DNA, 25 bp, Rattus norvegicus
ctgctgtccctagtccatgggaaga

SEQ ID NO: 272973 - DNA, 25 bp, Rattus norvegicus
ctgctgtcctttcagagttgagata

SEQ ID NO: 272974 - DNA, 25 bp, Rattus norvegicus
ctgctgtcctttgagagttgagata

SEQ ID NO: 272975 - DNA, 25 bp, Rattus norvegicus
ctgctgtctcttaacgctactaaaa

SEQ ID NO: 272976 - DNA, 25 bp, Rattus norvegicus
ctgctgtctctttacgctactaaaa

SEQ ID NO: 272977 - DNA, 25 bp, Rattus norvegicus
ctgctgtctgctcggtcaagttcaa

SEQ ID NO: 272978 - DNA, 25 bp, Rattus norvegicus
ctgctgtctgctgggtcaagttcaa

SEQ ID NO: 272979 - DNA, 25 bp, Rattus norvegicus
ctgctgtctttgaataccctgggaa

SEQ ID NO: 272980 - DNA, 25 bp, Rattus norvegicus
ctgctgtctttgtataccctgggaa

SEQ ID NO: 272981 - DNA, 25 bp, Rattus norvegicus
ctgctgtgaggtcgtggcccttcca

SEQ ID NO: 272982 - DNA, 25 bp, Rattus norvegicus
ctgctgtgaggtggtggcccttcca

SEQ ID NO: 272983 - DNA, 25 bp, Rattus norvegicus
ctgctgtgatgtctttgtcagtaat

SEQ ID NO: 272984 - DNA, 25 bp, Rattus norvegicus
ctgctgtgatgtgtttgtcagtaat

SEQ ID NO: 272985 - DNA, 25 bp, Rattus norvegicus
ctgctgtgattgctgctccctgggc

SEQ ID NO: 272986 - DNA, 25 bp, Rattus norvegicus
ctgctgtgattggtgctccctgggc

SEQ ID NO: 272987 - DNA, 25 bp, Rattus norvegicus
ctgctgtgcaagctgtatgtcaaca

SEQ ID NO: 272988 - DNA, 25 bp, Rattus norvegicus
ctgctgtgcaaggtgtatgtcaaca

SEQ ID NO: 272989 - DNA, 25 bp, Rattus norvegicus
ctgctgtgcaggctatcttactgaa

SEQ ID NO: 272990 - DNA, 25 bp, Rattus norvegicus
ctgctgtgcagggtatcttactgaa

SEQ ID NO: 272991 - DNA, 25 bp, Rattus norvegicus
ctgctgtgcagtcccaggtagacta

SEQ ID NO: 272992 - DNA, 25 bp, Rattus norvegicus
ctgctgtgcagtgccaggtagacta

SEQ ID NO: 272993 - DNA, 25 bp, Rattus norvegicus
ctgctgtgccgcctctggaagaagc

SEQ ID NO: 272994 - DNA, 25 bp, Rattus norvegicus
ctgctgtgccgcgtctggaagaagc

SEQ ID NO: 272995 - DNA, 25 bp, Rattus norvegicus
ctgctgtgctggcttcttttgaatc

SEQ ID NO: 272996 - DNA, 25 bp, Rattus norvegicus
ctgctgtgctgggttcttttgaatc

SEQ ID NO: 272997 - DNA, 25 bp, Rattus norvegicus
ctgctgtggaaaccaattttaactt

SEQ ID NO: 272998 - DNA, 25 bp, Rattus norvegicus
ctgctgtggaaagcaattttaactt

SEQ ID NO: 272999 - DNA, 25 bp, Rattus norvegicus
ctgctgtggcagacatgggtagaac

SEQ ID NO: 273000 - DNA, 25 bp, Rattus norvegicus
ctgctgtggcagtcatgggtagaac

SEQ ID NO: 273001 - DNA, 25 bp, Rattus norvegicus
ctgctgtggcttatgccaaagagga

SEQ ID NO: 273002 - DNA, 25 bp, Rattus norvegicus
ctgctgtggcttttgccaaagagga

SEQ ID NO: 273003 - DNA, 25 bp, Rattus norvegicus
ctgctgtgtcaaactgagggctctc

SEQ ID NO: 273004 - DNA, 25 bp, Rattus norvegicus
ctgctgtgtcaatctgagggctctc

SEQ ID NO: 273005 - DNA, 25 bp, Rattus norvegicus
ctgctgtgtgcacaacctttgacat

SEQ ID NO: 273006 - DNA, 25 bp, Rattus norvegicus
ctgctgtgtgcagaacctttgacat

SEQ ID NO: 273007 - DNA, 25 bp, Rattus norvegicus
ctgctgttacctagacagtctcaaa

SEQ ID NO: 273008 - DNA, 25 bp, Rattus norvegicus
ctgctgttaccttgacagtctcaaa

SEQ ID NO: 273009 - DNA, 25 bp, Rattus norvegicus
ctgctgttagcaaattcccgtgaaa

SEQ ID NO: 273010 - DNA, 25 bp, Rattus norvegicus
ctgctgttagcatattcccgtgaaa

SEQ ID NO: 273011 - DNA, 25 bp, Rattus norvegicus
ctgctgttcaagatttacgcgtaag

SEQ ID NO: 273012 - DNA, 25 bp, Rattus norvegicus
ctgctgttcaagttttacgcgtaag

SEQ ID NO: 273013 - DNA, 25 bp, Rattus norvegicus
ctgctgttcgccaggcatcttggtg

SEQ ID NO: 273014 - DNA, 25 bp, Rattus norvegicus
ctgctgttcgcctggcatcttggtg

SEQ ID NO: 273015 - DNA, 25 bp, Rattus norvegicus
ctgctgttcgcgcttctgtggaccg

SEQ ID NO: 273016 - DNA, 25 bp, Rattus norvegicus
ctgctgttcgcggttctgtggaccg

SEQ ID NO: 273017 - DNA, 25 bp, Rattus norvegicus
ctgctgttgctcattattccttaaa

SEQ ID NO: 273018 - DNA, 25 bp, Rattus norvegicus
ctgctgttgctctttattccttaaa

SEQ ID NO: 273019 - DNA, 25 bp, Rattus norvegicus
ctgctgttgctgacacttctcggtg

SEQ ID NO: 273020 - DNA, 25 bp, Rattus norvegicus
ctgctgttgctgtcacttctcggtg

SEQ ID NO: 273021 - DNA, 25 bp, Rattus norvegicus
ctgctgttgtgtacaccacactaag

SEQ ID NO: 273022 - DNA, 25 bp, Rattus norvegicus
ctgctgttgtgttcaccacactaag

SEQ ID NO: 273023 - DNA, 25 bp, Rattus norvegicus
ctgcttaaagtccagcgagctctgt

SEQ ID NO: 273024 - DNA, 25 bp, Rattus norvegicus
ctgcttaaagtcgagcgagctctgt

SEQ ID NO: 273025 - DNA, 25 bp, Rattus norvegicus
ctgcttacccataaaggtgcctgta

SEQ ID NO: 273026 - DNA, 25 bp, Rattus norvegicus
ctgcttacccattaaggtgcctgta

SEQ ID NO: 273027 - DNA, 25 bp, Rattus norvegicus
ctgcttacccctcattatcattgga

SEQ ID NO: 273028 - DNA, 25 bp, Rattus norvegicus
ctgcttacccctgattatcattgga

SEQ ID NO: 273029 - DNA, 25 bp, Rattus norvegicus
ctgcttacctgcagggaactccagc

SEQ ID NO: 273030 - DNA, 25 bp, Rattus norvegicus
ctgcttacctgcagttgtgcttcac

SEQ ID NO: 273031 - DNA, 25 bp, Rattus norvegicus
ctgcttacctgctgggaactccagc

SEQ ID NO: 273032 - DNA, 25 bp, Rattus norvegicus
ctgcttacctgctgttgtgcttcac

SEQ ID NO: 273033 - DNA, 25 bp, Rattus norvegicus
ctgcttagacagacgcatggcataa

SEQ ID NO: 273034 - DNA, 25 bp, Rattus norvegicus
ctgcttagacagtcgcatggcataa

SEQ ID NO: 273035 - DNA, 25 bp, Rattus norvegicus
ctgcttagttcgagttcttcggttc

SEQ ID NO: 273036 - DNA, 25 bp, Rattus norvegicus
ctgcttagttcgtgttcttcggttc

SEQ ID NO: 273037 - DNA, 25 bp, Rattus norvegicus
ctgcttatctcaagttagctgtacc

SEQ ID NO: 273038 - DNA, 25 bp, Rattus norvegicus
ctgcttatctcatgttagctgtacc

SEQ ID NO: 273039 - DNA, 25 bp, Rattus norvegicus
ctgcttcaatgtacagtttccagaa

SEQ ID NO: 273040 - DNA, 25 bp, Rattus norvegicus
ctgcttcaatgttcagtttccagaa

SEQ ID NO: 273041 - DNA, 25 bp, Rattus norvegicus
ctgcttcaccttacttaacttgagt

SEQ ID NO: 273042 - DNA, 25 bp, Rattus norvegicus
ctgcttcacctttcttaacttgagt

SEQ ID NO: 273043 - DNA, 25 bp, Rattus norvegicus
ctgcttcagagtctctaaggagccg

SEQ ID NO: 273044 - DNA, 25 bp, Rattus norvegicus
ctgcttcagagtgtctaaggagccg

SEQ ID NO: 273045 - DNA, 25 bp, Rattus norvegicus
ctgcttcagggaagtgagcatacaa

SEQ ID NO: 273046 - DNA, 25 bp, Rattus norvegicus
ctgcttcagggatgtgagcatacaa

SEQ ID NO: 273047 - DNA, 25 bp, Rattus norvegicus
ctgcttccaatcatctttttctaga

SEQ ID NO: 273048 - DNA, 25 bp, Rattus norvegicus
ctgcttccaatcttctttttctaga

SEQ ID NO: 273049 - DNA, 25 bp, Rattus norvegicus
ctgcttcccactctgttgaattgtg

SEQ ID NO: 273050 - DNA, 25 bp, Rattus norvegicus
ctgcttcccactgtgttgaattgtg

SEQ ID NO: 273051 - DNA, 25 bp, Rattus norvegicus
ctgcttcccaggagctagaattgta

SEQ ID NO: 273052 - DNA, 25 bp, Rattus norvegicus
ctgcttcccaggtgctagaattgta

SEQ ID NO: 273053 - DNA, 25 bp, Rattus norvegicus
ctgcttccccagacaattgagtgac

SEQ ID NO: 273054 - DNA, 25 bp, Rattus norvegicus
ctgcttccccagtcaattgagtgac

SEQ ID NO: 273055 - DNA, 25 bp, Rattus norvegicus
ctgcttcccttcagtctgcatttgt

SEQ ID NO: 273056 - DNA, 25 bp, Rattus norvegicus
ctgcttcccttctgtctgcatttgt

SEQ ID NO: 273057 - DNA, 25 bp, Rattus norvegicus
ctgcttccctttcgacatgattagt

SEQ ID NO: 273058 - DNA, 25 bp, Rattus norvegicus
ctgcttccctttggacatgattagt

SEQ ID NO: 273059 - DNA, 25 bp, Rattus norvegicus
ctgcttccgagacactgtggctata

SEQ ID NO: 273060 - DNA, 25 bp, Rattus norvegicus
ctgcttccgagagactgtggctata

SEQ ID NO: 273061 - DNA, 25 bp, Rattus norvegicus
ctgcttcctcagataatccagggaa

SEQ ID NO: 273062 - DNA, 25 bp, Rattus norvegicus
ctgcttcctcagttaatccagggaa

SEQ ID NO: 273063 - DNA, 25 bp, Rattus norvegicus
ctgcttcctcttagtgcattgacaa

SEQ ID NO: 273064 - DNA, 25 bp, Rattus norvegicus
ctgcttcctctttgtgcattgacaa

SEQ ID NO: 273065 - DNA, 25 bp, Rattus norvegicus
ctgcttcctgctcgcactgaggatt

SEQ ID NO: 273066 - DNA, 25 bp, Rattus norvegicus
ctgcttcctgctggcactgaggatt

SEQ ID NO: 273067 - DNA, 25 bp, Rattus norvegicus
ctgcttcctgtcatgtagtgactgt

SEQ ID NO: 273068 - DNA, 25 bp, Rattus norvegicus
ctgcttcctgtcttgtagtgactgt

SEQ ID NO: 273069 - DNA, 25 bp, Rattus norvegicus
ctgcttcctgtgatgatctttgtca

SEQ ID NO: 273070 - DNA, 25 bp, Rattus norvegicus
ctgcttcctgtgttgatctttgtca

SEQ ID NO: 273071 - DNA, 25 bp, Rattus norvegicus
ctgcttcctgttctgtctgtgtctg

SEQ ID NO: 273072 - DNA, 25 bp, Rattus norvegicus
ctgcttcctgttgtgtctgtgtctg

SEQ ID NO: 273073 - DNA, 25 bp, Rattus norvegicus
ctgcttccttccctggagtagcaag

SEQ ID NO: 273074 - DNA, 25 bp, Rattus norvegicus
ctgcttccttccgtggagtagcaag

SEQ ID NO: 273075 - DNA, 25 bp, Rattus norvegicus
ctgcttccttgcagggagattcata

SEQ ID NO: 273076 - DNA, 25 bp, Rattus norvegicus
ctgcttccttgctgggagattcata

SEQ ID NO: 273077 - DNA, 25 bp, Rattus norvegicus
ctgcttcgccgcatgggttgtggaa

SEQ ID NO: 273078 - DNA, 25 bp, Rattus norvegicus
ctgcttcgccgcttgggttgtggaa

SEQ ID NO: 273079 - DNA, 25 bp, Rattus norvegicus
ctgcttcgtcctcggaggattgaca

SEQ ID NO: 273080 - DNA, 25 bp, Rattus norvegicus
ctgcttcgtcctgggaggattgaca

SEQ ID NO: 273081 - DNA, 25 bp, Rattus norvegicus
ctgcttctaaggaatatatttgttt

SEQ ID NO: 273082 - DNA, 25 bp, Rattus norvegicus
ctgcttctaaggtatatatttgttt

SEQ ID NO: 273083 - DNA, 25 bp, Rattus norvegicus
ctgcttctactgagaatactgaggt

SEQ ID NO: 273084 - DNA, 25 bp, Rattus norvegicus
ctgcttctactgtgaatactgaggt

SEQ ID NO: 273085 - DNA, 25 bp, Rattus norvegicus
ctgcttctatggctggtgtacactt

SEQ ID NO: 273086 - DNA, 25 bp, Rattus norvegicus
ctgcttctatgggtggtgtacactt

SEQ ID NO: 273087 - DNA, 25 bp, Rattus norvegicus
ctgcttctcatgacgatacccaaga

SEQ ID NO: 273088 - DNA, 25 bp, Rattus norvegicus
ctgcttctcatgtcgatacccaaga

SEQ ID NO: 273089 - DNA, 25 bp, Rattus norvegicus
ctgcttctccccaaatattaaacac

SEQ ID NO: 273090 - DNA, 25 bp, Rattus norvegicus
ctgcttctcccctaatattaaacac

SEQ ID NO: 273091 - DNA, 25 bp, Rattus norvegicus
ctgcttctcttcagactgggaaata

SEQ ID NO: 273092 - DNA, 25 bp, Rattus norvegicus
ctgcttctcttctgactgggaaata

SEQ ID NO: 273093 - DNA, 25 bp, Rattus norvegicus
ctgcttctctttacctgtattaggc

SEQ ID NO: 273094 - DNA, 25 bp, Rattus norvegicus
ctgcttctcttttcctgtattaggc

SEQ ID NO: 273095 - DNA, 25 bp, Rattus norvegicus
ctgcttctgaaacccctgtcgtaaa

SEQ ID NO: 273096 - DNA, 25 bp, Rattus norvegicus
ctgcttctgaaagccctgtcgtaaa

SEQ ID NO: 273097 - DNA, 25 bp, Rattus norvegicus
ctgcttctgcaaagtggaagactga

SEQ ID NO: 273098 - DNA, 25 bp, Rattus norvegicus
ctgcttctgcaactgctgagtgtga

SEQ ID NO: 273099 - DNA, 25 bp, Rattus norvegicus
ctgcttctgcaagtgctgagtgtga

SEQ ID NO: 273100 - DNA, 25 bp, Rattus norvegicus
ctgcttctgcaatgtggaagactga

SEQ ID NO: 273101 - DNA, 25 bp, Rattus norvegicus
ctgcttctgcttatgtgaaagtata

SEQ ID NO: 273102 - DNA, 25 bp, Rattus norvegicus
ctgcttctgcttcaggagggtttga

SEQ ID NO: 273103 - DNA, 25 bp, Rattus norvegicus
ctgcttctgcttctgaaacgagaat

SEQ ID NO: 273104 - DNA, 25 bp, Rattus norvegicus
ctgcttctgcttgaggagggtttga

SEQ ID NO: 273105 - DNA, 25 bp, Rattus norvegicus
ctgcttctgcttgtgaaacgagaat

SEQ ID NO: 273106 - DNA, 25 bp, Rattus norvegicus
ctgcttctgcttttgtgaaagtata

SEQ ID NO: 273107 - DNA, 25 bp, Rattus norvegicus
ctgcttctgggtccagattcttgca

SEQ ID NO: 273108 - DNA, 25 bp, Rattus norvegicus
ctgcttctgggtgcagattcttgca

SEQ ID NO: 273109 - DNA, 25 bp, Rattus norvegicus
ctgcttctgtagctctgatggttct

SEQ ID NO: 273110 - DNA, 25 bp, Rattus norvegicus
ctgcttctgtaggtctgatggttct

SEQ ID NO: 273111 - DNA, 25 bp, Rattus norvegicus
ctgcttctgttcaataccctttaaa

SEQ ID NO: 273112 - DNA, 25 bp, Rattus norvegicus
ctgcttctgttctataccctttaaa

SEQ ID NO: 273113 - DNA, 25 bp, Rattus norvegicus
ctgcttcttaatatgatctctgtgg

SEQ ID NO: 273114 - DNA, 25 bp, Rattus norvegicus
ctgcttcttaatttgatctctgtgg

SEQ ID NO: 273115 - DNA, 25 bp, Rattus norvegicus
ctgcttcttactctatacttctata

SEQ ID NO: 273116 - DNA, 25 bp, Rattus norvegicus
ctgcttcttactgtatacttctata

SEQ ID NO: 273117 - DNA, 25 bp, Rattus norvegicus
ctgcttctttgacctgtagaatcta

SEQ ID NO: 273118 - DNA, 25 bp, Rattus norvegicus
ctgcttctttgactatgactggttt

SEQ ID NO: 273119 - DNA, 25 bp, Rattus norvegicus
ctgcttctttgagctgtagaatcta

SEQ ID NO: 273120 - DNA, 25 bp, Rattus norvegicus
ctgcttctttgagtatgactggttt

SEQ ID NO: 273121 - DNA, 25 bp, Rattus norvegicus
ctgcttgaagacctggctgctggac

SEQ ID NO: 273122 - DNA, 25 bp, Rattus norvegicus
ctgcttgaagacgtggctgctggac

SEQ ID NO: 273123 - DNA, 25 bp, Rattus norvegicus
ctgcttgaccgactgcaaacttgga

SEQ ID NO: 273124 - DNA, 25 bp, Rattus norvegicus
ctgcttgaccgagtgcaaacttgga

SEQ ID NO: 273125 - DNA, 25 bp, Rattus norvegicus
ctgcttgacgcgaattaagacacat

SEQ ID NO: 273126 - DNA, 25 bp, Rattus norvegicus
ctgcttgacgcgtattaagacacat

SEQ ID NO: 273127 - DNA, 25 bp, Rattus norvegicus
ctgcttgagtctaccttaccatata

SEQ ID NO: 273128 - DNA, 25 bp, Rattus norvegicus
ctgcttgagtcttccttaccatata

SEQ ID NO: 273129 - DNA, 25 bp, Rattus norvegicus
ctgcttgatgctctgtagtgtcttt

SEQ ID NO: 273130 - DNA, 25 bp, Rattus norvegicus
ctgcttgatgctgtgtagtgtcttt

SEQ ID NO: 273131 - DNA, 25 bp, Rattus norvegicus
ctgcttgcaatcattgccatgtgta

SEQ ID NO: 273132 - DNA, 25 bp, Rattus norvegicus
ctgcttgcaatctttgccatgtgta

SEQ ID NO: 273133 - DNA, 25 bp, Rattus norvegicus
ctgcttgcatatactctgtctggtc

SEQ ID NO: 273134 - DNA, 25 bp, Rattus norvegicus
ctgcttgcatattctctgtctggtc

SEQ ID NO: 273135 - DNA, 25 bp, Rattus norvegicus
ctgcttgccaaaatagtctatcttc

SEQ ID NO: 273136 - DNA, 25 bp, Rattus norvegicus
ctgcttgccaaattagtctatcttc

SEQ ID NO: 273137 - DNA, 25 bp, Rattus norvegicus
ctgcttgccatgaatccagcacaga

SEQ ID NO: 273138 - DNA, 25 bp, Rattus norvegicus
ctgcttgccatgtatccagcacaga

SEQ ID NO: 273139 - DNA, 25 bp, Rattus norvegicus
ctgcttgccggactctgtttggaga

SEQ ID NO: 273140 - DNA, 25 bp, Rattus norvegicus
ctgcttgccggagtctgtttggaga

SEQ ID NO: 273141 - DNA, 25 bp, Rattus norvegicus
ctgcttgctagacaggcacagggac

SEQ ID NO: 273142 - DNA, 25 bp, Rattus norvegicus
ctgcttgctagagaggcacagggac

SEQ ID NO: 273143 - DNA, 25 bp, Rattus norvegicus
ctgcttgctggtaaaatggtttcac

SEQ ID NO: 273144 - DNA, 25 bp, Rattus norvegicus
ctgcttgctggttaaatggtttcac

SEQ ID NO: 273145 - DNA, 25 bp, Rattus norvegicus
ctgcttgctgtcaccaataaagttt

SEQ ID NO: 273146 - DNA, 25 bp, Rattus norvegicus
ctgcttgctgtctccaataaagttt

SEQ ID NO: 273147 - DNA, 25 bp, Rattus norvegicus
ctgcttgcttttctggactctggaa

SEQ ID NO: 273148 - DNA, 25 bp, Rattus norvegicus
ctgcttgcttttgtggactctggaa

SEQ ID NO: 273149 - DNA, 25 bp, Rattus norvegicus
ctgcttggactaactcttggacact

SEQ ID NO: 273150 - DNA, 25 bp, Rattus norvegicus
ctgcttggactatctcttggacact

SEQ ID NO: 273151 - DNA, 25 bp, Rattus norvegicus
ctgcttggccagataatccaggttt

SEQ ID NO: 273152 - DNA, 25 bp, Rattus norvegicus
ctgcttggccagttaatccaggttt

SEQ ID NO: 273153 - DNA, 25 bp, Rattus norvegicus
ctgcttggccctagagagaatgtga

SEQ ID NO: 273154 - DNA, 25 bp, Rattus norvegicus
ctgcttggcccttgagagaatgtga

SEQ ID NO: 273155 - DNA, 25 bp, Rattus norvegicus
ctgcttggccgcagtgtggaataaa

SEQ ID NO: 273156 - DNA, 25 bp, Rattus norvegicus
ctgcttggccgctgtgtggaataaa

SEQ ID NO: 273157 - DNA, 25 bp, Rattus norvegicus
ctgcttgggcagctaactattttgt

SEQ ID NO: 273158 - DNA, 25 bp, Rattus norvegicus
ctgcttgggcaggtaactattttgt

SEQ ID NO: 273159 - DNA, 25 bp, Rattus norvegicus
ctgcttggtccaaagaaactcaggg

SEQ ID NO: 273160 - DNA, 25 bp, Rattus norvegicus
ctgcttggtccatagaaactcaggg

SEQ ID NO: 273161 - DNA, 25 bp, Rattus norvegicus
ctgcttgtctatccacaaaggttat

SEQ ID NO: 273162 - DNA, 25 bp, Rattus norvegicus
ctgcttgtctatgcacaaaggttat

SEQ ID NO: 273163 - DNA, 25 bp, Rattus norvegicus
ctgcttgtcttgcactgctcaagga

SEQ ID NO: 273164 - DNA, 25 bp, Rattus norvegicus
ctgcttgtcttggactgctcaagga

SEQ ID NO: 273165 - DNA, 25 bp, Rattus norvegicus
ctgcttgtgtttctacaccacatgt

SEQ ID NO: 273166 - DNA, 25 bp, Rattus norvegicus
ctgcttgtgtttgtacaccacatgt

SEQ ID NO: 273167 - DNA, 25 bp, Rattus norvegicus
ctgcttgttccgatgttattttcca

SEQ ID NO: 273168 - DNA, 25 bp, Rattus norvegicus
ctgcttgttccgttgttattttcca

SEQ ID NO: 273169 - DNA, 25 bp, Rattus norvegicus
ctgcttgttgccaattgaccgggag

SEQ ID NO: 273170 - DNA, 25 bp, Rattus norvegicus
ctgcttgttgcctattgaccgggag

SEQ ID NO: 273171 - DNA, 25 bp, Rattus norvegicus
ctgctttataaacgcaccgaaaact

SEQ ID NO: 273172 - DNA, 25 bp, Rattus norvegicus
ctgctttataaaggcaccgaaaact

SEQ ID NO: 273173 - DNA, 25 bp, Rattus norvegicus
ctgctttatctacagtttcccttaa

SEQ ID NO: 273174 - DNA, 25 bp, Rattus norvegicus
ctgctttatctagagtttcccttaa

SEQ ID NO: 273175 - DNA, 25 bp, Rattus norvegicus
ctgctttattttaacagcccacgtc

SEQ ID NO: 273176 - DNA, 25 bp, Rattus norvegicus
ctgctttatttttacagcccacgtc

SEQ ID NO: 273177 - DNA, 25 bp, Rattus norvegicus
ctgctttcacggattaacacctgtc

SEQ ID NO: 273178 - DNA, 25 bp, Rattus norvegicus
ctgctttcacggtttaacacctgtc

SEQ ID NO: 273179 - DNA, 25 bp, Rattus norvegicus
ctgctttcctcaaggcctcttgagt

SEQ ID NO: 273180 - DNA, 25 bp, Rattus norvegicus
ctgctttcctcatggcctcttgagt

SEQ ID NO: 273181 - DNA, 25 bp, Rattus norvegicus
ctgctttcctccactggagactgaa

SEQ ID NO: 273182 - DNA, 25 bp, Rattus norvegicus
ctgctttcctcctctggagactgaa

SEQ ID NO: 273183 - DNA, 25 bp, Rattus norvegicus
ctgctttcctctaccaaatgctagg

SEQ ID NO: 273184 - DNA, 25 bp, Rattus norvegicus
ctgctttcctcttccaaatgctagg

SEQ ID NO: 273185 - DNA, 25 bp, Rattus norvegicus
ctgctttctaccctcattaacaatt

SEQ ID NO: 273186 - DNA, 25 bp, Rattus norvegicus
ctgctttctaccgtcattaacaatt

SEQ ID NO: 273187 - DNA, 25 bp, Rattus norvegicus
ctgctttctagcaacctttttctaa

SEQ ID NO: 273188 - DNA, 25 bp, Rattus norvegicus
ctgctttctagctacctttttctaa

SEQ ID NO: 273189 - DNA, 25 bp, Rattus norvegicus
ctgctttctgctcaatgtggccaca

SEQ ID NO: 273190 - DNA, 25 bp, Rattus norvegicus
ctgctttctgctgaatgtggccaca

SEQ ID NO: 273191 - DNA, 25 bp, Rattus norvegicus
ctgctttgaggcacatctcgatgga

SEQ ID NO: 273192 - DNA, 25 bp, Rattus norvegicus
ctgctttgaggctcatctcgatgga

SEQ ID NO: 273193 - DNA, 25 bp, Rattus norvegicus
ctgctttgccctacctttaataaga

SEQ ID NO: 273194 - DNA, 25 bp, Rattus norvegicus
ctgctttgcccttcctttaataaga

SEQ ID NO: 273195 - DNA, 25 bp, Rattus norvegicus
ctgctttggcagctgcagagcacca

SEQ ID NO: 273196 - DNA, 25 bp, Rattus norvegicus
ctgctttggcaggtgcagagcacca

SEQ ID NO: 273197 - DNA, 25 bp, Rattus norvegicus
ctgctttgggccctgaaattttgat

SEQ ID NO: 273198 - DNA, 25 bp, Rattus norvegicus
ctgctttgggccgtgaaattttgat

SEQ ID NO: 273199 - DNA, 25 bp, Rattus norvegicus
ctgctttgtgctcacttaggaggaa

SEQ ID NO: 273200 - DNA, 25 bp, Rattus norvegicus
ctgctttgtgctgacttaggaggaa

SEQ ID NO: 273201 - DNA, 25 bp, Rattus norvegicus
ctgctttgttgacagaatgctgtgt

SEQ ID NO: 273202 - DNA, 25 bp, Rattus norvegicus
ctgctttgttgagagaatgctgtgt

SEQ ID NO: 273203 - DNA, 25 bp, Rattus norvegicus
ctgcttttaccacaggcacaaggac

SEQ ID NO: 273204 - DNA, 25 bp, Rattus norvegicus
ctgcttttaccagaggcacaaggac

SEQ ID NO: 273205 - DNA, 25 bp, Rattus norvegicus
ctgcttttacttactatttctctct

SEQ ID NO: 273206 - DNA, 25 bp, Rattus norvegicus
ctgcttttactttctatttctctct

SEQ ID NO: 273207 - DNA, 25 bp, Rattus norvegicus
ctgcttttctacacattctacggag

SEQ ID NO: 273208 - DNA, 25 bp, Rattus norvegicus
ctgcttttctactcattctacggag

SEQ ID NO: 273209 - DNA, 25 bp, Rattus norvegicus
ctgcttttcttcagtatgcccaatc

SEQ ID NO: 273210 - DNA, 25 bp, Rattus norvegicus
ctgcttttcttctgtatgcccaatc

SEQ ID NO: 273211 - DNA, 25 bp, Rattus norvegicus
ctgcttttgcccctgaagagagaaa

SEQ ID NO: 273212 - DNA, 25 bp, Rattus norvegicus
ctgcttttgcccgtgaagagagaaa

SEQ ID NO: 273213 - DNA, 25 bp, Rattus norvegicus
ctgcttttgctcagtctgtcccaag

SEQ ID NO: 273214 - DNA, 25 bp, Rattus norvegicus
ctgcttttgctctgtctgtcccaag

SEQ ID NO: 273215 - DNA, 25 bp, Rattus norvegicus
ctgcttttggtgattgtacatgtaa

SEQ ID NO: 273216 - DNA, 25 bp, Rattus norvegicus
ctgcttttggtgtttgtacatgtaa

SEQ ID NO: 273217 - DNA, 25 bp, Rattus norvegicus
ctgcttttgtctcccaggtaagtca

SEQ ID NO: 273218 - DNA, 25 bp, Rattus norvegicus
ctgcttttgtctgccaggtaagtca

SEQ ID NO: 273219 - DNA, 25 bp, Rattus norvegicus
ctgcttttgttccttttccatgaaa

SEQ ID NO: 273220 - DNA, 25 bp, Rattus norvegicus
ctgcttttgttcgttttccatgaaa

SEQ ID NO: 273221 - DNA, 25 bp, Rattus norvegicus
ctgctttttgggacactggtgctga

SEQ ID NO: 273222 - DNA, 25 bp, Rattus norvegicus
ctgctttttgggtcactggtgctga

SEQ ID NO: 273223 - DNA, 25 bp, Rattus norvegicus
ctggaaagcaacagggcgacgcgat

SEQ ID NO: 273224 - DNA, 25 bp, Rattus norvegicus
ctggaaagcaactgggcgacgcgat

SEQ ID NO: 273225 - DNA, 25 bp, Rattus norvegicus
ctggaaattactcagcgagtcctga

SEQ ID NO: 273226 - DNA, 25 bp, Rattus norvegicus
ctggaaattactgagcgagtcctga

SEQ ID NO: 273227 - DNA, 25 bp, Rattus norvegicus
ctggaaattttgaaagctttgctgt

SEQ ID NO: 273228 - DNA, 25 bp, Rattus norvegicus
ctggaaattttgtaagctttgctgt

SEQ ID NO: 273229 - DNA, 25 bp, Rattus norvegicus
ctggaacacaagaagcgctcgcggc

SEQ ID NO: 273230 - DNA, 25 bp, Rattus norvegicus
ctggaacacaagtagcgctcgcggc

SEQ ID NO: 273231 - DNA, 25 bp, Rattus norvegicus
ctggaaccaattatatattcagtaa

SEQ ID NO: 273232 - DNA, 25 bp, Rattus norvegicus
ctggaaccaattttatattcagtaa

SEQ ID NO: 273233 - DNA, 25 bp, Rattus norvegicus
ctggaaccatcacctgtatcagtta

SEQ ID NO: 273234 - DNA, 25 bp, Rattus norvegicus
ctggaaccatcagctgtatcagtta

SEQ ID NO: 273235 - DNA, 25 bp, Rattus norvegicus
ctggaacccaatctcagattctaag

SEQ ID NO: 273236 - DNA, 25 bp, Rattus norvegicus
ctggaacccaatgtcagattctaag

SEQ ID NO: 273237 - DNA, 25 bp, Rattus norvegicus
ctggaacccatgacaaatctcttgc

SEQ ID NO: 273238 - DNA, 25 bp, Rattus norvegicus
ctggaacccatgtcaaatctcttgc

SEQ ID NO: 273239 - DNA, 25 bp, Rattus norvegicus
ctggaacccattacctacgagggca

SEQ ID NO: 273240 - DNA, 25 bp, Rattus norvegicus
ctggaacccatttcctacgagggca

SEQ ID NO: 273241 - DNA, 25 bp, Rattus norvegicus
ctggaaccccagcaaacattctgca

SEQ ID NO: 273242 - DNA, 25 bp, Rattus norvegicus
ctggaaccccaggaaacattctgca

SEQ ID NO: 273243 - DNA, 25 bp, Rattus norvegicus
ctggaacccttgagattatttgaga

SEQ ID NO: 273244 - DNA, 25 bp, Rattus norvegicus
ctggaacccttgtgattatttgaga

SEQ ID NO: 273245 - DNA, 25 bp, Rattus norvegicus
ctggaacctcccaggaactactgca

SEQ ID NO: 273246 - DNA, 25 bp, Rattus norvegicus
ctggaacctccctggaactactgca

SEQ ID NO: 273247 - DNA, 25 bp, Rattus norvegicus
ctggaacctgccagtctctgaggtg

SEQ ID NO: 273248 - DNA, 25 bp, Rattus norvegicus
ctggaacctgcctgtctctgaggtg

SEQ ID NO: 273249 - DNA, 25 bp, Rattus norvegicus
ctggaacgtcggctgtaagtcaatc

SEQ ID NO: 273250 - DNA, 25 bp, Rattus norvegicus
ctggaacgtcgggtgtaagtcaatc

SEQ ID NO: 273251 - DNA, 25 bp, Rattus norvegicus
ctggaactcgttattggattcacaa

SEQ ID NO: 273252 - DNA, 25 bp, Rattus norvegicus
ctggaactcgtttttggattcacaa

SEQ ID NO: 273253 - DNA, 25 bp, Rattus norvegicus
ctggaactgaacctgagacctctgt

SEQ ID NO: 273254 - DNA, 25 bp, Rattus norvegicus
ctggaactgaacgtgagacctctgt

SEQ ID NO: 273255 - DNA, 25 bp, Rattus norvegicus
ctggaactgcttagggactcggagt

SEQ ID NO: 273256 - DNA, 25 bp, Rattus norvegicus
ctggaactgctttgggactcggagt

SEQ ID NO: 273257 - DNA, 25 bp, Rattus norvegicus
ctggaactgtaacaggtggagccta

SEQ ID NO: 273258 - DNA, 25 bp, Rattus norvegicus
ctggaactgtaagaggtggagccta

SEQ ID NO: 273259 - DNA, 25 bp, Rattus norvegicus
ctggaacttcacaaactggctactg

SEQ ID NO: 273260 - DNA, 25 bp, Rattus norvegicus
ctggaacttcactaactggctactg

SEQ ID NO: 273261 - DNA, 25 bp, Rattus norvegicus
ctggaagagtatccctgggtcccac

SEQ ID NO: 273262 - DNA, 25 bp, Rattus norvegicus
ctggaagagtatgcctgggtcccac

SEQ ID NO: 273263 - DNA, 25 bp, Rattus norvegicus
ctggaagcaacgatctttccattca

SEQ ID NO: 273264 - DNA, 25 bp, Rattus norvegicus
ctggaagcaacgttctttccattca

SEQ ID NO: 273265 - DNA, 25 bp, Rattus norvegicus
ctggaagcaatacggacgcaccgaa

SEQ ID NO: 273266 - DNA, 25 bp, Rattus norvegicus
ctggaagcaatagggacgcaccgaa

SEQ ID NO: 273267 - DNA, 25 bp, Rattus norvegicus
ctggaagccataatcccggttcttc

SEQ ID NO: 273268 - DNA, 25 bp, Rattus norvegicus
ctggaagccatattcccggttcttc

SEQ ID NO: 273269 - DNA, 25 bp, Rattus norvegicus
ctggaagccttccagcgctatggag

SEQ ID NO: 273270 - DNA, 25 bp, Rattus norvegicus
ctggaagccttcgagcgctatggag

SEQ ID NO: 273271 - DNA, 25 bp, Rattus norvegicus
ctggaagctgtcatgctcccacctt

SEQ ID NO: 273272 - DNA, 25 bp, Rattus norvegicus
ctggaagctgtcttgctcccacctt

SEQ ID NO: 273273 - DNA, 25 bp, Rattus norvegicus
ctggaaggacggctcctgtgactaa

SEQ ID NO: 273274 - DNA, 25 bp, Rattus norvegicus
ctggaaggacgggtcctgtgactaa

SEQ ID NO: 273275 - DNA, 25 bp, Rattus norvegicus
ctggaaggagacaggcgatccgaaa

SEQ ID NO: 273276 - DNA, 25 bp, Rattus norvegicus
ctggaaggagactggcgatccgaaa

SEQ ID NO: 273277 - DNA, 25 bp, Rattus norvegicus
ctggaagggcttcggatgtccctgg

SEQ ID NO: 273278 - DNA, 25 bp, Rattus norvegicus
ctggaagggcttgggatgtccctgg

SEQ ID NO: 273279 - DNA, 25 bp, Rattus norvegicus
ctggaaggtcttcttgctttcaagg

SEQ ID NO: 273280 - DNA, 25 bp, Rattus norvegicus
ctggaaggtcttgttgctttcaagg

SEQ ID NO: 273281 - DNA, 25 bp, Rattus norvegicus
ctggaaggtgtcacctataggctct

SEQ ID NO: 273282 - DNA, 25 bp, Rattus norvegicus
ctggaaggtgtctcctataggctct

SEQ ID NO: 273283 - DNA, 25 bp, Rattus norvegicus
ctggaagtattcagatggctctgga

SEQ ID NO: 273284 - DNA, 25 bp, Rattus norvegicus
ctggaagtattctgatggctctgga

SEQ ID NO: 273285 - DNA, 25 bp, Rattus norvegicus
ctggaagtcactcctcgatactgca

SEQ ID NO: 273286 - DNA, 25 bp, Rattus norvegicus
ctggaagtcactgctcgatactgca

SEQ ID NO: 273287 - DNA, 25 bp, Rattus norvegicus
ctggaagtgcaaacctgaccgtctt

SEQ ID NO: 273288 - DNA, 25 bp, Rattus norvegicus
ctggaagtgcaatcctgaccgtctt

SEQ ID NO: 273289 - DNA, 25 bp, Rattus norvegicus
ctggaagtgcttcagtatctgttaa

SEQ ID NO: 273290 - DNA, 25 bp, Rattus norvegicus
ctggaagtgcttgagtatctgttaa

SEQ ID NO: 273291 - DNA, 25 bp, Rattus norvegicus
ctggaagttccaccggcttgctacc

SEQ ID NO: 273292 - DNA, 25 bp, Rattus norvegicus
ctggaagttccagcggcttgctacc

SEQ ID NO: 273293 - DNA, 25 bp, Rattus norvegicus
ctggaagttctacactcctgcaggg

SEQ ID NO: 273294 - DNA, 25 bp, Rattus norvegicus
ctggaagttctagactcctgcaggg

SEQ ID NO: 273295 - DNA, 25 bp, Rattus norvegicus
ctggaagtttgcatagctctcactc

SEQ ID NO: 273296 - DNA, 25 bp, Rattus norvegicus
ctggaagtttgcttagctctcactc

SEQ ID NO: 273297 - DNA, 25 bp, Rattus norvegicus
ctggaataaccaccggagtccccat

SEQ ID NO: 273298 - DNA, 25 bp, Rattus norvegicus
ctggaataaccagcggagtccccat

SEQ ID NO: 273299 - DNA, 25 bp, Rattus norvegicus
ctggaatatgagcagctgctgaacg

SEQ ID NO: 273300 - DNA, 25 bp, Rattus norvegicus
ctggaatatgaggagctgctgaacg

SEQ ID NO: 273301 - DNA, 25 bp, Rattus norvegicus
ctggaatcccaaaacgacgcatgca

SEQ ID NO: 273302 - DNA, 25 bp, Rattus norvegicus
ctggaatcccaatacgacgcatgca

SEQ ID NO: 273303 - DNA, 25 bp, Rattus norvegicus
ctggaatctcaacctgggagaagga

SEQ ID NO: 273304 - DNA, 25 bp, Rattus norvegicus
ctggaatctcaagctgggagaagga

SEQ ID NO: 273305 - DNA, 25 bp, Rattus norvegicus
ctggaatctggaatctgacttgaca

SEQ ID NO: 273306 - DNA, 25 bp, Rattus norvegicus
ctggaatctggattctgacttgaca

SEQ ID NO: 273307 - DNA, 25 bp, Rattus norvegicus
ctggaatgaacaaggagctactggg

SEQ ID NO: 273308 - DNA, 25 bp, Rattus norvegicus
ctggaatgaacatggagctactggg

SEQ ID NO: 273309 - DNA, 25 bp, Rattus norvegicus
ctggaatgatctattaccacatcta

SEQ ID NO: 273310 - DNA, 25 bp, Rattus norvegicus
ctggaatgatcttttaccacatcta

SEQ ID NO: 273311 - DNA, 25 bp, Rattus norvegicus
ctggaatgcctcactctgtaaatga

SEQ ID NO: 273312 - DNA, 25 bp, Rattus norvegicus
ctggaatgcctctctctgtaaatga

SEQ ID NO: 273313 - DNA, 25 bp, Rattus norvegicus
ctggaattaattagcagccaccaaa

SEQ ID NO: 273314 - DNA, 25 bp, Rattus norvegicus
ctggaattaatttgcagccaccaaa

SEQ ID NO: 273315 - DNA, 25 bp, Rattus norvegicus
ctggaattccacaaatcactattta

SEQ ID NO: 273316 - DNA, 25 bp, Rattus norvegicus
ctggaattccactaatcactattta

SEQ ID NO: 273317 - DNA, 25 bp, Rattus norvegicus
ctggaattcctcacatgttcattat

SEQ ID NO: 273318 - DNA, 25 bp, Rattus norvegicus
ctggaattcctctcatgttcattat

SEQ ID NO: 273319 - DNA, 25 bp, Rattus norvegicus
ctggaattctttcctaaccgtgacc

SEQ ID NO: 273320 - DNA, 25 bp, Rattus norvegicus
ctggaattctttgctaaccgtgacc

SEQ ID NO: 273321 - DNA, 25 bp, Rattus norvegicus
ctggaatttctgatcatgcctgatt

SEQ ID NO: 273322 - DNA, 25 bp, Rattus norvegicus
ctggaatttctgttcatgcctgatt

SEQ ID NO: 273323 - DNA, 25 bp, Rattus norvegicus
ctggacaacactcagctggactttg

SEQ ID NO: 273324 - DNA, 25 bp, Rattus norvegicus
ctggacaacactgagctggactttg

SEQ ID NO: 273325 - DNA, 25 bp, Rattus norvegicus
ctggacaatcaacgcagtacattct

SEQ ID NO: 273326 - DNA, 25 bp, Rattus norvegicus
ctggacaatcaaggcagtacattct

SEQ ID NO: 273327 - DNA, 25 bp, Rattus norvegicus
ctggacacatccctcgacgaaagac

SEQ ID NO: 273328 - DNA, 25 bp, Rattus norvegicus
ctggacacatccgtcgacgaaagac

SEQ ID NO: 273329 - DNA, 25 bp, Rattus norvegicus
ctggacaccacaccagcatttgttt

SEQ ID NO: 273330 - DNA, 25 bp, Rattus norvegicus
ctggacaccacagcagcatttgttt

SEQ ID NO: 273331 - DNA, 25 bp, Rattus norvegicus
ctggacacccacatattagctcata

SEQ ID NO: 273332 - DNA, 25 bp, Rattus norvegicus
ctggacacccacttattagctcata

SEQ ID NO: 273333 - DNA, 25 bp, Rattus norvegicus
ctggacactggccacgaagctgaat

SEQ ID NO: 273334 - DNA, 25 bp, Rattus norvegicus
ctggacactggccttggacttcaag

SEQ ID NO: 273335 - DNA, 25 bp, Rattus norvegicus
ctggacactggcgacgaagctgaat

SEQ ID NO: 273336 - DNA, 25 bp, Rattus norvegicus
ctggacactggcgttggacttcaag

SEQ ID NO: 273337 - DNA, 25 bp, Rattus norvegicus
ctggacacttctattatttcactga

SEQ ID NO: 273338 - DNA, 25 bp, Rattus norvegicus
ctggacacttcttttatttcactga

SEQ ID NO: 273339 - DNA, 25 bp, Rattus norvegicus
ctggacagacatacttggagagtga

SEQ ID NO: 273340 - DNA, 25 bp, Rattus norvegicus
ctggacagacattcttggagagtga

SEQ ID NO: 273341 - DNA, 25 bp, Rattus norvegicus
ctggacagagtgctcgccgacagaa

SEQ ID NO: 273342 - DNA, 25 bp, Rattus norvegicus
ctggacagagtggtcgccgacagaa

SEQ ID NO: 273343 - DNA, 25 bp, Rattus norvegicus
ctggacagctggatagccatgtaat

SEQ ID NO: 273344 - DNA, 25 bp, Rattus norvegicus
ctggacagctggttagccatgtaat

SEQ ID NO: 273345 - DNA, 25 bp, Rattus norvegicus
ctggacaggcctcaggagtctgtta

SEQ ID NO: 273346 - DNA, 25 bp, Rattus norvegicus
ctggacaggcctgaggagtctgtta

SEQ ID NO: 273347 - DNA, 25 bp, Rattus norvegicus
ctggacatatttattgaggcgctca

SEQ ID NO: 273348 - DNA, 25 bp, Rattus norvegicus
ctggacatattttttgaggcgctca

SEQ ID NO: 273349 - DNA, 25 bp, Rattus norvegicus
ctggacatgatgacctttctagacc

SEQ ID NO: 273350 - DNA, 25 bp, Rattus norvegicus
ctggacatgatgtcctttctagacc

SEQ ID NO: 273351 - DNA, 25 bp, Rattus norvegicus
ctggacattactcggctgcttatat

SEQ ID NO: 273352 - DNA, 25 bp, Rattus norvegicus
ctggacattactgggctgcttatat

SEQ ID NO: 273353 - DNA, 25 bp, Rattus norvegicus
ctggaccaaaaaatcgggtgtgcca

SEQ ID NO: 273354 - DNA, 25 bp, Rattus norvegicus
ctggaccaaaaattcgggtgtgcca

SEQ ID NO: 273355 - DNA, 25 bp, Rattus norvegicus
ctggaccaactgctgtgtacacaat

SEQ ID NO: 273356 - DNA, 25 bp, Rattus norvegicus
ctggaccaactggtgtgtacacaat

SEQ ID NO: 273357 - DNA, 25 bp, Rattus norvegicus
ctggaccaagctaggaacatttcat

SEQ ID NO: 273358 - DNA, 25 bp, Rattus norvegicus
ctggaccaagcttggaacatttcat

SEQ ID NO: 273359 - DNA, 25 bp, Rattus norvegicus
ctggaccatgtactaggaccgcata

SEQ ID NO: 273360 - DNA, 25 bp, Rattus norvegicus
ctggaccatgtagtaggaccgcata

SEQ ID NO: 273361 - DNA, 25 bp, Rattus norvegicus
ctggaccattagcactgtgctgtgc

SEQ ID NO: 273362 - DNA, 25 bp, Rattus norvegicus
ctggaccattaggactgtgctgtgc

SEQ ID NO: 273363 - DNA, 25 bp, Rattus norvegicus
ctggacccatgcagcagacacacat

SEQ ID NO: 273364 - DNA, 25 bp, Rattus norvegicus
ctggacccatgctgcagacacacat

SEQ ID NO: 273365 - DNA, 25 bp, Rattus norvegicus
ctggaccccagcaaagtgttcaaga

SEQ ID NO: 273366 - DNA, 25 bp, Rattus norvegicus
ctggaccccagctaagtgttcaaga

SEQ ID NO: 273367 - DNA, 25 bp, Rattus norvegicus
ctggacccggcgatgttcgatgcgc

SEQ ID NO: 273368 - DNA, 25 bp, Rattus norvegicus
ctggacccggcgttgttcgatgcgc

SEQ ID NO: 273369 - DNA, 25 bp, Rattus norvegicus
ctggacccgggacgtcaggttcatt

SEQ ID NO: 273370 - DNA, 25 bp, Rattus norvegicus
ctggacccgggaggtcaggttcatt

SEQ ID NO: 273371 - DNA, 25 bp, Rattus norvegicus
ctggaccctagccacaggataagtg

SEQ ID NO: 273372 - DNA, 25 bp, Rattus norvegicus
ctggaccctagcgacaggataagtg

SEQ ID NO: 273373 - DNA, 25 bp, Rattus norvegicus
ctggacctccgtcagaaagccctgg

SEQ ID NO: 273374 - DNA, 25 bp, Rattus norvegicus
ctggacctccgtgagaaagccctgg

SEQ ID NO: 273375 - DNA, 25 bp, Rattus norvegicus
ctggacctctccaagttcaggctgc

SEQ ID NO: 273376 - DNA, 25 bp, Rattus norvegicus
ctggacctctcctagttcaggctgc

SEQ ID NO: 273377 - DNA, 25 bp, Rattus norvegicus
ctggacctgcgacccaagaagacaa

SEQ ID NO: 273378 - DNA, 25 bp, Rattus norvegicus
ctggacctgcgagccaagaagacaa

SEQ ID NO: 273379 - DNA, 25 bp, Rattus norvegicus
ctggacctgggtccgccaggattct

SEQ ID NO: 273380 - DNA, 25 bp, Rattus norvegicus
ctggacctgggtgcgccaggattct

SEQ ID NO: 273381 - DNA, 25 bp, Rattus norvegicus
ctggaccttgccactttttgtaaga

SEQ ID NO: 273382 - DNA, 25 bp, Rattus norvegicus
ctggaccttgcctctttttgtaaga

SEQ ID NO: 273383 - DNA, 25 bp, Rattus norvegicus
ctggacctttgtcgcgtctttgaag

SEQ ID NO: 273384 - DNA, 25 bp, Rattus norvegicus
ctggacctttgtggcgtctttgaag

SEQ ID NO: 273385 - DNA, 25 bp, Rattus norvegicus
ctggacgaccgtctacatgacgata

SEQ ID NO: 273386 - DNA, 25 bp, Rattus norvegicus
ctggacgaccgtgtacatgacgata

SEQ ID NO: 273387 - DNA, 25 bp, Rattus norvegicus
ctggacgacggaactgtgtacacat

SEQ ID NO: 273388 - DNA, 25 bp, Rattus norvegicus
ctggacgacggatctgtgtacacat

SEQ ID NO: 273389 - DNA, 25 bp, Rattus norvegicus
ctggacgagccgcttctaaaacact

SEQ ID NO: 273390 - DNA, 25 bp, Rattus norvegicus
ctggacgagccggttctaaaacact

SEQ ID NO: 273391 - DNA, 25 bp, Rattus norvegicus
ctggacgagtctcacagtgtggaca

SEQ ID NO: 273392 - DNA, 25 bp, Rattus norvegicus
ctggacgagtctgacagtgtggaca

SEQ ID NO: 273393 - DNA, 25 bp, Rattus norvegicus
ctggacgcccacattgaagaactga

SEQ ID NO: 273394 - DNA, 25 bp, Rattus norvegicus
ctggacgcccactttgaagaactga

SEQ ID NO: 273395 - DNA, 25 bp, Rattus norvegicus
ctggacgcctttagctttcacaaag

SEQ ID NO: 273396 - DNA, 25 bp, Rattus norvegicus
ctggacgccttttgctttcacaaag

SEQ ID NO: 273397 - DNA, 25 bp, Rattus norvegicus
ctggacgcgttcagatgtcggtgtc

SEQ ID NO: 273398 - DNA, 25 bp, Rattus norvegicus
ctggacgcgttctgatgtcggtgtc

SEQ ID NO: 273399 - DNA, 25 bp, Rattus norvegicus
ctggacggcatgcaaacgctgcttt

SEQ ID NO: 273400 - DNA, 25 bp, Rattus norvegicus
ctggacggcatggaaacgctgcttt

SEQ ID NO: 273401 - DNA, 25 bp, Rattus norvegicus
ctggacgggaaacccactgcagcgt

SEQ ID NO: 273402 - DNA, 25 bp, Rattus norvegicus
ctggacgggaaagccactgcagcgt

SEQ ID NO: 273403 - DNA, 25 bp, Rattus norvegicus
ctggacgggccacaaggtttgcact

SEQ ID NO: 273404 - DNA, 25 bp, Rattus norvegicus
ctggacgggccagaaggtttgcact

SEQ ID NO: 273405 - DNA, 25 bp, Rattus norvegicus
ctggactcagggattgaactcaagc

SEQ ID NO: 273406 - DNA, 25 bp, Rattus norvegicus
ctggactcagggtttgaactcaagc

SEQ ID NO: 273407 - DNA, 25 bp, Rattus norvegicus
ctggactccccgaagaggaagaaga

SEQ ID NO: 273408 - DNA, 25 bp, Rattus norvegicus
ctggactccccgtagaggaagaaga

SEQ ID NO: 273409 - DNA, 25 bp, Rattus norvegicus
ctggactcctccactgtgaattggg

SEQ ID NO: 273410 - DNA, 25 bp, Rattus norvegicus
ctggactcctcctctgtgaattggg

SEQ ID NO: 273411 - DNA, 25 bp, Rattus norvegicus
ctggactcgcagaggctaccccggg

SEQ ID NO: 273412 - DNA, 25 bp, Rattus norvegicus
ctggactcgcagtggctaccccggg

SEQ ID NO: 273413 - DNA, 25 bp, Rattus norvegicus
ctggactctatcagacacttgtgga

SEQ ID NO: 273414 - DNA, 25 bp, Rattus norvegicus
ctggactctatctgacacttgtgga

SEQ ID NO: 273415 - DNA, 25 bp, Rattus norvegicus
ctggactctccaagacatctaaggt

SEQ ID NO: 273416 - DNA, 25 bp, Rattus norvegicus
ctggactctccatgacatctaaggt

SEQ ID NO: 273417 - DNA, 25 bp, Rattus norvegicus
ctggactctgggagaactgggtggt

SEQ ID NO: 273418 - DNA, 25 bp, Rattus norvegicus
ctggactctgggtgaactgggtggt

SEQ ID NO: 273419 - DNA, 25 bp, Rattus norvegicus
ctggactctgttatgtgagatggac

SEQ ID NO: 273420 - DNA, 25 bp, Rattus norvegicus
ctggactctgttttgtgagatggac

SEQ ID NO: 273421 - DNA, 25 bp, Rattus norvegicus
ctggactgctcacctttgtagagaa

SEQ ID NO: 273422 - DNA, 25 bp, Rattus norvegicus
ctggactgctcagctttgtagagaa

SEQ ID NO: 273423 - DNA, 25 bp, Rattus norvegicus
ctggactgtttaactttagccggga

SEQ ID NO: 273424 - DNA, 25 bp, Rattus norvegicus
ctggactgtttatctttagccggga

SEQ ID NO: 273425 - DNA, 25 bp, Rattus norvegicus
ctggacttaggtcgtcttagcccaa

SEQ ID NO: 273426 - DNA, 25 bp, Rattus norvegicus
ctggacttaggtggtcttagcccaa

SEQ ID NO: 273427 - DNA, 25 bp, Rattus norvegicus
ctggacttctaaaggtttccgctgt

SEQ ID NO: 273428 - DNA, 25 bp, Rattus norvegicus
ctggacttctaatggtttccgctgt

SEQ ID NO: 273429 - DNA, 25 bp, Rattus norvegicus
ctggacttggctatacatccttatt

SEQ ID NO: 273430 - DNA, 25 bp, Rattus norvegicus
ctggacttggctttacatccttatt

SEQ ID NO: 273431 - DNA, 25 bp, Rattus norvegicus
ctggagaaacctcccaagtatgatg

SEQ ID NO: 273432 - DNA, 25 bp, Rattus norvegicus
ctggagaaacctgccaagtatgatg

SEQ ID NO: 273433 - DNA, 25 bp, Rattus norvegicus
ctggagaaatcgacagctgctgaag

SEQ ID NO: 273434 - DNA, 25 bp, Rattus norvegicus
ctggagaaatcgtcagctgctgaag

SEQ ID NO: 273435 - DNA, 25 bp, Rattus norvegicus
ctggagaaatctatgcttggtgcct

SEQ ID NO: 273436 - DNA, 25 bp, Rattus norvegicus
ctggagaaatctttgcttggtgcct

SEQ ID NO: 273437 - DNA, 25 bp, Rattus norvegicus
ctggagaatactagtaagtttcact

SEQ ID NO: 273438 - DNA, 25 bp, Rattus norvegicus
ctggagaatacttgtaagtttcact

SEQ ID NO: 273439 - DNA, 25 bp, Rattus norvegicus
ctggagaattttcctcagcactgca

SEQ ID NO: 273440 - DNA, 25 bp, Rattus norvegicus
ctggagaattttgctcagcactgca

SEQ ID NO: 273441 - DNA, 25 bp, Rattus norvegicus
ctggagacccatcgcaggaccatat

SEQ ID NO: 273442 - DNA, 25 bp, Rattus norvegicus
ctggagacccatggcaggaccatat

SEQ ID NO: 273443 - DNA, 25 bp, Rattus norvegicus
ctggagaccctgatcaaactgttca

SEQ ID NO: 273444 - DNA, 25 bp, Rattus norvegicus
ctggagaccctgttcaaactgttca

SEQ ID NO: 273445 - DNA, 25 bp, Rattus norvegicus
ctggagactctaaaatgctttcaat

SEQ ID NO: 273446 - DNA, 25 bp, Rattus norvegicus
ctggagactctataatgctttcaat

SEQ ID NO: 273447 - DNA, 25 bp, Rattus norvegicus
ctggagactggcatgggaacctgta

SEQ ID NO: 273448 - DNA, 25 bp, Rattus norvegicus
ctggagactggcttgggaacctgta

SEQ ID NO: 273449 - DNA, 25 bp, Rattus norvegicus
ctggagagaattctcacagatccca

SEQ ID NO: 273450 - DNA, 25 bp, Rattus norvegicus
ctggagagaattgtcacagatccca

SEQ ID NO: 273451 - DNA, 25 bp, Rattus norvegicus
ctggagagatgacttcgtgattaag

SEQ ID NO: 273452 - DNA, 25 bp, Rattus norvegicus
ctggagagatgagttcgtgattaag

SEQ ID NO: 273453 - DNA, 25 bp, Rattus norvegicus
ctggagagcctcagggagctgttca

SEQ ID NO: 273454 - DNA, 25 bp, Rattus norvegicus
ctggagagcctctgggagctgttca

SEQ ID NO: 273455 - DNA, 25 bp, Rattus norvegicus
ctggagaggttcagtgagctgcctt

SEQ ID NO: 273456 - DNA, 25 bp, Rattus norvegicus
ctggagaggttctgtgagctgcctt

SEQ ID NO: 273457 - DNA, 25 bp, Rattus norvegicus
ctggagagtcagaagctttgcctag

SEQ ID NO: 273458 - DNA, 25 bp, Rattus norvegicus
ctggagagtcagtagctttgcctag

SEQ ID NO: 273459 - DNA, 25 bp, Rattus norvegicus
ctggagagtcgcagagtgagcccaa

SEQ ID NO: 273460 - DNA, 25 bp, Rattus norvegicus
ctggagagtcgctgagtgagcccaa

SEQ ID NO: 273461 - DNA, 25 bp, Rattus norvegicus
ctggagatcctacccatgcggttca

SEQ ID NO: 273462 - DNA, 25 bp, Rattus norvegicus
ctggagatcctagccatgcggttca

SEQ ID NO: 273463 - DNA, 25 bp, Rattus norvegicus
ctggagatggatactgcggtgccct

SEQ ID NO: 273464 - DNA, 25 bp, Rattus norvegicus
ctggagatggattctgcggtgccct

SEQ ID NO: 273465 - DNA, 25 bp, Rattus norvegicus
ctggagattgccactggtcaggata

SEQ ID NO: 273466 - DNA, 25 bp, Rattus norvegicus
ctggagattgcctctggtcaggata

SEQ ID NO: 273467 - DNA, 25 bp, Rattus norvegicus
ctggagatttccaacctggtgagtt

SEQ ID NO: 273468 - DNA, 25 bp, Rattus norvegicus
ctggagatttcctacctggtgagtt

SEQ ID NO: 273469 - DNA, 25 bp, Rattus norvegicus
ctggagcaatcaagccacgggcagt

SEQ ID NO: 273470 - DNA, 25 bp, Rattus norvegicus
ctggagcaatcatgccacgggcagt

SEQ ID NO: 273471 - DNA, 25 bp, Rattus norvegicus
ctggagcacgagatggttgacctta

SEQ ID NO: 273472 - DNA, 25 bp, Rattus norvegicus
ctggagcacgagttggttgacctta

SEQ ID NO: 273473 - DNA, 25 bp, Rattus norvegicus
ctggagcaggatctcaaggttgcaa

SEQ ID NO: 273474 - DNA, 25 bp, Rattus norvegicus
ctggagcaggatgtcaaggttgcaa

SEQ ID NO: 273475 - DNA, 25 bp, Rattus norvegicus
ctggagcatgccagaactggctgaa

SEQ ID NO: 273476 - DNA, 25 bp, Rattus norvegicus
ctggagcatgcctgaactggctgaa

SEQ ID NO: 273477 - DNA, 25 bp, Rattus norvegicus
ctggagcatgtccaaagttcaactt

SEQ ID NO: 273478 - DNA, 25 bp, Rattus norvegicus
ctggagcatgtcgaaagttcaactt

SEQ ID NO: 273479 - DNA, 25 bp, Rattus norvegicus
ctggagccactgacggattgaataa

SEQ ID NO: 273480 - DNA, 25 bp, Rattus norvegicus
ctggagccactgtcggattgaataa

SEQ ID NO: 273481 - DNA, 25 bp, Rattus norvegicus
ctggagccctttcgattgtctggtg

SEQ ID NO: 273482 - DNA, 25 bp, Rattus norvegicus
ctggagccctttggattgtctggtg

SEQ ID NO: 273483 - DNA, 25 bp, Rattus norvegicus
ctggagcctacgacgtcgggagacc

SEQ ID NO: 273484 - DNA, 25 bp, Rattus norvegicus
ctggagcctacgtcgtcgggagacc

SEQ ID NO: 273485 - DNA, 25 bp, Rattus norvegicus
ctggagcctcccagccatgaaacag

SEQ ID NO: 273486 - DNA, 25 bp, Rattus norvegicus
ctggagcctccctgccatgaaacag

SEQ ID NO: 273487 - DNA, 25 bp, Rattus norvegicus
ctggagccttggacgctttgcgaga

SEQ ID NO: 273488 - DNA, 25 bp, Rattus norvegicus
ctggagccttggtcgctttgcgaga

SEQ ID NO: 273489 - DNA, 25 bp, Rattus norvegicus
ctggagcgcccaacaatgatcaaat

SEQ ID NO: 273490 - DNA, 25 bp, Rattus norvegicus
ctggagcgcccatcaatgatcaaat

SEQ ID NO: 273491 - DNA, 25 bp, Rattus norvegicus
ctggagcggagcctgaacttggcac

SEQ ID NO: 273492 - DNA, 25 bp, Rattus norvegicus
ctggagcggagcgtgaacttggcac

SEQ ID NO: 273493 - DNA, 25 bp, Rattus norvegicus
ctggagcgtggaaccaagctgagtt

SEQ ID NO: 273494 - DNA, 25 bp, Rattus norvegicus
ctggagcgtggatccaagctgagtt

SEQ ID NO: 273495 - DNA, 25 bp, Rattus norvegicus
ctggagctcacaaagtacttctgcc

SEQ ID NO: 273496 - DNA, 25 bp, Rattus norvegicus
ctggagctcacatagtacttctgcc

SEQ ID NO: 273497 - DNA, 25 bp, Rattus norvegicus
ctggagctgaggagccactgtgctt

SEQ ID NO: 273498 - DNA, 25 bp, Rattus norvegicus
ctggagctgaggtgccactgtgctt

SEQ ID NO: 273499 - DNA, 25 bp, Rattus norvegicus
ctggagctgcgcattgaggctgcac

SEQ ID NO: 273500 - DNA, 25 bp, Rattus norvegicus
ctggagctgcgctttgaggctgcac

SEQ ID NO: 273501 - DNA, 25 bp, Rattus norvegicus
ctggagctgtggacactgcttcatt

SEQ ID NO: 273502 - DNA, 25 bp, Rattus norvegicus
ctggagctgtggcaactgagtaatt

SEQ ID NO: 273503 - DNA, 25 bp, Rattus norvegicus
ctggagctgtgggaactgagtaatt

SEQ ID NO: 273504 - DNA, 25 bp, Rattus norvegicus
ctggagctgtggtcactgcttcatt

SEQ ID NO: 273505 - DNA, 25 bp, Rattus norvegicus
ctggaggagaccactgtggctgtta

SEQ ID NO: 273506 - DNA, 25 bp, Rattus norvegicus
ctggaggagacctctgtggctgtta

SEQ ID NO: 273507 - DNA, 25 bp, Rattus norvegicus
ctggaggagctgatgcccaaaggta

SEQ ID NO: 273508 - DNA, 25 bp, Rattus norvegicus
ctggaggagctgcaccctgcagacc

SEQ ID NO: 273509 - DNA, 25 bp, Rattus norvegicus
ctggaggagctggaccctgcagacc

SEQ ID NO: 273510 - DNA, 25 bp, Rattus norvegicus
ctggaggagctgttgcccaaaggta

SEQ ID NO: 273511 - DNA, 25 bp, Rattus norvegicus
ctggaggaggctatcgagttcgtca

SEQ ID NO: 273512 - DNA, 25 bp, Rattus norvegicus
ctggaggaggctttcgagttcgtca

SEQ ID NO: 273513 - DNA, 25 bp, Rattus norvegicus
ctggaggcagcccagcttagatgca

SEQ ID NO: 273514 - DNA, 25 bp, Rattus norvegicus
ctggaggcagccgagcttagatgca

SEQ ID NO: 273515 - DNA, 25 bp, Rattus norvegicus
ctggaggcccatcaggtcatcctga

SEQ ID NO: 273516 - DNA, 25 bp, Rattus norvegicus
ctggaggcccatgaggtcatcctga

SEQ ID NO: 273517 - DNA, 25 bp, Rattus norvegicus
ctggaggcctttagcagggacacga

SEQ ID NO: 273518 - DNA, 25 bp, Rattus norvegicus
ctggaggccttttgcagggacacga

SEQ ID NO: 273519 - DNA, 25 bp, Rattus norvegicus
ctggaggctctcagaggactgctta

SEQ ID NO: 273520 - DNA, 25 bp, Rattus norvegicus
ctggaggctctctgaggactgctta

SEQ ID NO: 273521 - DNA, 25 bp, Rattus norvegicus
ctggaggctctgaatgtctaacttt

SEQ ID NO: 273522 - DNA, 25 bp, Rattus norvegicus
ctggaggctctgtatgtctaacttt

SEQ ID NO: 273523 - DNA, 25 bp, Rattus norvegicus
ctggaggcttttagtctggattttc

SEQ ID NO: 273524 - DNA, 25 bp, Rattus norvegicus
ctggaggctttttgtctggattttc

SEQ ID NO: 273525 - DNA, 25 bp, Rattus norvegicus
ctggagggaagtatcatgattgcat

SEQ ID NO: 273526 - DNA, 25 bp, Rattus norvegicus
ctggagggaagtttcatgattgcat

SEQ ID NO: 273527 - DNA, 25 bp, Rattus norvegicus
ctggagggctatcgcttgctcaaat

SEQ ID NO: 273528 - DNA, 25 bp, Rattus norvegicus
ctggagggctatggcttgctcaaat

SEQ ID NO: 273529 - DNA, 25 bp, Rattus norvegicus
ctggaggtggtgaccctactgatga

SEQ ID NO: 273530 - DNA, 25 bp, Rattus norvegicus
ctggaggtggtgtccctactgatga

SEQ ID NO: 273531 - DNA, 25 bp, Rattus norvegicus
ctggaggtttccatgacactggtct

SEQ ID NO: 273532 - DNA, 25 bp, Rattus norvegicus
ctggaggtttccttgacactggtct

SEQ ID NO: 273533 - DNA, 25 bp, Rattus norvegicus
ctggagtaacaacatggcggcatcg

SEQ ID NO: 273534 - DNA, 25 bp, Rattus norvegicus
ctggagtaacaagatggcggcatcg

SEQ ID NO: 273535 - DNA, 25 bp, Rattus norvegicus
ctggagtatgggatctatttatttt

SEQ ID NO: 273536 - DNA, 25 bp, Rattus norvegicus
ctggagtatgggttctatttatttt

SEQ ID NO: 273537 - DNA, 25 bp, Rattus norvegicus
ctggagtattctctatggcctggta

SEQ ID NO: 273538 - DNA, 25 bp, Rattus norvegicus
ctggagtattctgtatggcctggta

SEQ ID NO: 273539 - DNA, 25 bp, Rattus norvegicus
ctggagtcagttaagcgatgtcgaa

SEQ ID NO: 273540 - DNA, 25 bp, Rattus norvegicus
ctggagtcagttcgtggctaaacac

SEQ ID NO: 273541 - DNA, 25 bp, Rattus norvegicus
ctggagtcagttggtggctaaacac

SEQ ID NO: 273542 - DNA, 25 bp, Rattus norvegicus
ctggagtcagtttagcgatgtcgaa

SEQ ID NO: 273543 - DNA, 25 bp, Rattus norvegicus
ctggagtcctctatctgtttgtgtc

SEQ ID NO: 273544 - DNA, 25 bp, Rattus norvegicus
ctggagtcctctttctgtttgtgtc

SEQ ID NO: 273545 - DNA, 25 bp, Rattus norvegicus
ctggagtgactcatatctgatgata

SEQ ID NO: 273546 - DNA, 25 bp, Rattus norvegicus
ctggagtgactcttatctgatgata

SEQ ID NO: 273547 - DNA, 25 bp, Rattus norvegicus
ctggagtgcgagagaatgtagcccc

SEQ ID NO: 273548 - DNA, 25 bp, Rattus norvegicus
ctggagtgcgagtgaatgtagcccc

SEQ ID NO: 273549 - DNA, 25 bp, Rattus norvegicus
ctggagtggaacagccatcacagaa

SEQ ID NO: 273550 - DNA, 25 bp, Rattus norvegicus
ctggagtggaactgccatcacagaa

SEQ ID NO: 273551 - DNA, 25 bp, Rattus norvegicus
ctggagtttgctacatttgcagcaa

SEQ ID NO: 273552 - DNA, 25 bp, Rattus norvegicus
ctggagtttgcttcatttgcagcaa

SEQ ID NO: 273553 - DNA, 25 bp, Rattus norvegicus
ctggagttttgaatggcctccgcac

SEQ ID NO: 273554 - DNA, 25 bp, Rattus norvegicus
ctggagttttgattggcctccgcac

SEQ ID NO: 273555 - DNA, 25 bp, Rattus norvegicus
ctggataaaggcagccctgggtgct

SEQ ID NO: 273556 - DNA, 25 bp, Rattus norvegicus
ctggataaaggctgccctgggtgct

SEQ ID NO: 273557 - DNA, 25 bp, Rattus norvegicus
ctggataacctcatggcctttgtgt

SEQ ID NO: 273558 - DNA, 25 bp, Rattus norvegicus
ctggataacctcttggcctttgtgt

SEQ ID NO: 273559 - DNA, 25 bp, Rattus norvegicus
ctggataactacacgcgggtgcttt

SEQ ID NO: 273560 - DNA, 25 bp, Rattus norvegicus
ctggataactactcgcgggtgcttt

SEQ ID NO: 273561 - DNA, 25 bp, Rattus norvegicus
ctggataagaccacgtaactgtgat

SEQ ID NO: 273562 - DNA, 25 bp, Rattus norvegicus
ctggataagacctcgtaactgtgat

SEQ ID NO: 273563 - DNA, 25 bp, Rattus norvegicus
ctggatacattgcacctgctgatat

SEQ ID NO: 273564 - DNA, 25 bp, Rattus norvegicus
ctggatacattggacctgctgatat

SEQ ID NO: 273565 - DNA, 25 bp, Rattus norvegicus
ctggatacccagctgtcctgtgaat

SEQ ID NO: 273566 - DNA, 25 bp, Rattus norvegicus
ctggatacccaggtgtcctgtgaat

SEQ ID NO: 273567 - DNA, 25 bp, Rattus norvegicus
ctggataccctgcatgagtcttgag

SEQ ID NO: 273568 - DNA, 25 bp, Rattus norvegicus
ctggataccctggatgagtcttgag

SEQ ID NO: 273569 - DNA, 25 bp, Rattus norvegicus
ctggatactgctagccaaagggctc

SEQ ID NO: 273570 - DNA, 25 bp, Rattus norvegicus
ctggatactgcttgccaaagggctc

SEQ ID NO: 273571 - DNA, 25 bp, Rattus norvegicus
ctggatattccacggtcaaccaatt

SEQ ID NO: 273572 - DNA, 25 bp, Rattus norvegicus
ctggatattccagggtcaaccaatt

SEQ ID NO: 273573 - DNA, 25 bp, Rattus norvegicus
ctggatcaccatcgcgaccagcaag

SEQ ID NO: 273574 - DNA, 25 bp, Rattus norvegicus
ctggatcaccatggcgaccagcaag

SEQ ID NO: 273575 - DNA, 25 bp, Rattus norvegicus
ctggatcatccccacaggaaggtgg

SEQ ID NO: 273576 - DNA, 25 bp, Rattus norvegicus
ctggatcatcccgacaggaaggtgg

SEQ ID NO: 273577 - DNA, 25 bp, Rattus norvegicus
ctggatcatgatcttgctgccaaga

SEQ ID NO: 273578 - DNA, 25 bp, Rattus norvegicus
ctggatcatgatgttgctgccaaga

SEQ ID NO: 273579 - DNA, 25 bp, Rattus norvegicus
ctggatccaagactaaagccgctta

SEQ ID NO: 273580 - DNA, 25 bp, Rattus norvegicus
ctggatccaagagtaaagccgctta

SEQ ID NO: 273581 - DNA, 25 bp, Rattus norvegicus
ctggatccgggcactgagttctttt

SEQ ID NO: 273582 - DNA, 25 bp, Rattus norvegicus
ctggatccgggctctgagttctttt

SEQ ID NO: 273583 - DNA, 25 bp, Rattus norvegicus
ctggatcctgagagtatcttcgaga

SEQ ID NO: 273584 - DNA, 25 bp, Rattus norvegicus
ctggatcctgagtgtatcttcgaga

SEQ ID NO: 273585 - DNA, 25 bp, Rattus norvegicus
ctggatctcatccatctgtggaggt

SEQ ID NO: 273586 - DNA, 25 bp, Rattus norvegicus
ctggatctcatcgatctgtggaggt

SEQ ID NO: 273587 - DNA, 25 bp, Rattus norvegicus
ctggatctcctccagttggaggcag

SEQ ID NO: 273588 - DNA, 25 bp, Rattus norvegicus
ctggatctcctcgagttggaggcag

SEQ ID NO: 273589 - DNA, 25 bp, Rattus norvegicus
ctggatctccttctggatcaacatg

SEQ ID NO: 273590 - DNA, 25 bp, Rattus norvegicus
ctggatctccttgtggatcaacatg

SEQ ID NO: 273591 - DNA, 25 bp, Rattus norvegicus
ctggatctgctgattgaagcgcagc

SEQ ID NO: 273592 - DNA, 25 bp, Rattus norvegicus
ctggatctgctgtttgaagcgcagc

SEQ ID NO: 273593 - DNA, 25 bp, Rattus norvegicus
ctggatctgggcctccagggacgtg

SEQ ID NO: 273594 - DNA, 25 bp, Rattus norvegicus
ctggatctgggcgtccagggacgtg

SEQ ID NO: 273595 - DNA, 25 bp, Rattus norvegicus
ctggatctggtcagggctaaggtat

SEQ ID NO: 273596 - DNA, 25 bp, Rattus norvegicus
ctggatctggtctgggctaaggtat

SEQ ID NO: 273597 - DNA, 25 bp, Rattus norvegicus
ctggatcttctaaggtggattctcc

SEQ ID NO: 273598 - DNA, 25 bp, Rattus norvegicus
ctggatcttctatggtggattctcc

SEQ ID NO: 273599 - DNA, 25 bp, Rattus norvegicus
ctggatcttggtatgtaggcccgac

SEQ ID NO: 273600 - DNA, 25 bp, Rattus norvegicus
ctggatcttggtttgtaggcccgac

SEQ ID NO: 273601 - DNA, 25 bp, Rattus norvegicus
ctggatgaagccaatgttacactga

SEQ ID NO: 273602 - DNA, 25 bp, Rattus norvegicus
ctggatgaagcctatgttacactga

SEQ ID NO: 273603 - DNA, 25 bp, Rattus norvegicus
ctggatgacacgcatgctctgggca

SEQ ID NO: 273604 - DNA, 25 bp, Rattus norvegicus
ctggatgacacggatgctctgggca

SEQ ID NO: 273605 - DNA, 25 bp, Rattus norvegicus
ctggatgaggacctttgtgctgctc

SEQ ID NO: 273606 - DNA, 25 bp, Rattus norvegicus
ctggatgaggacgtttgtgctgctc

SEQ ID NO: 273607 - DNA, 25 bp, Rattus norvegicus
ctggatgcaggactgaaggccaata

SEQ ID NO: 273608 - DNA, 25 bp, Rattus norvegicus
ctggatgcaggagtgaaggccaata

SEQ ID NO: 273609 - DNA, 25 bp, Rattus norvegicus
ctggatgccagtctagagagagtac

SEQ ID NO: 273610 - DNA, 25 bp, Rattus norvegicus
ctggatgccagtgtagagagagtac

SEQ ID NO: 273611 - DNA, 25 bp, Rattus norvegicus
ctggatgccatcctttatcatccac

SEQ ID NO: 273612 - DNA, 25 bp, Rattus norvegicus
ctggatgccatcgtttatcatccac

SEQ ID NO: 273613 - DNA, 25 bp, Rattus norvegicus
ctggatgcctgtacatttcacaaac

SEQ ID NO: 273614 - DNA, 25 bp, Rattus norvegicus
ctggatgcctgttcatttcacaaac

SEQ ID NO: 273615 - DNA, 25 bp, Rattus norvegicus
ctggatgctgctctggtcttatcag

SEQ ID NO: 273616 - DNA, 25 bp, Rattus norvegicus
ctggatgctgctgtggtcttatcag

SEQ ID NO: 273617 - DNA, 25 bp, Rattus norvegicus
ctggatggaacacgctgggcactct

SEQ ID NO: 273618 - DNA, 25 bp, Rattus norvegicus
ctggatggaacaggctgggcactct

SEQ ID NO: 273619 - DNA, 25 bp, Rattus norvegicus
ctggatggatctcgtgtgcttgtat

SEQ ID NO: 273620 - DNA, 25 bp, Rattus norvegicus
ctggatggatctggtgtgcttgtat

SEQ ID NO: 273621 - DNA, 25 bp, Rattus norvegicus
ctggatggtgtgctagtcttacttt

SEQ ID NO: 273622 - DNA, 25 bp, Rattus norvegicus
ctggatggtgtggtagtcttacttt

SEQ ID NO: 273623 - DNA, 25 bp, Rattus norvegicus
ctggatgtaattactgccatgacac

SEQ ID NO: 273624 - DNA, 25 bp, Rattus norvegicus
ctggatgtaatttctgccatgacac

SEQ ID NO: 273625 - DNA, 25 bp, Rattus norvegicus
ctggatgtcccacccaaacaaatat

SEQ ID NO: 273626 - DNA, 25 bp, Rattus norvegicus
ctggatgtcccagccaaacaaatat

SEQ ID NO: 273627 - DNA, 25 bp, Rattus norvegicus
ctggatgtgaatacttaagccgtga

SEQ ID NO: 273628 - DNA, 25 bp, Rattus norvegicus
ctggatgtgaattcttaagccgtga

SEQ ID NO: 273629 - DNA, 25 bp, Rattus norvegicus
ctggattcaccacaggatcagtccg

SEQ ID NO: 273630 - DNA, 25 bp, Rattus norvegicus
ctggattcaccagaggatcagtccg

SEQ ID NO: 273631 - DNA, 25 bp, Rattus norvegicus
ctggattcacggcagtgtgttcaat

SEQ ID NO: 273632 - DNA, 25 bp, Rattus norvegicus
ctggattcacgggagtgtgttcaat

SEQ ID NO: 273633 - DNA, 25 bp, Rattus norvegicus
ctggattcccctctgggatggagat

SEQ ID NO: 273634 - DNA, 25 bp, Rattus norvegicus
ctggattcccctgtgggatggagat

SEQ ID NO: 273635 - DNA, 25 bp, Rattus norvegicus
ctggattccgtcctggtcatcgtgt

SEQ ID NO: 273636 - DNA, 25 bp, Rattus norvegicus
ctggattccgtcgtggtcatcgtgt

SEQ ID NO: 273637 - DNA, 25 bp, Rattus norvegicus
ctggattcgaatcaggtacgcactg

SEQ ID NO: 273638 - DNA, 25 bp, Rattus norvegicus
ctggattcgaatgaggtacgcactg

SEQ ID NO: 273639 - DNA, 25 bp, Rattus norvegicus
ctggattctgcccatttcatctttg

SEQ ID NO: 273640 - DNA, 25 bp, Rattus norvegicus
ctggattctgccgatttcatctttg

SEQ ID NO: 273641 - DNA, 25 bp, Rattus norvegicus
ctggattcttctctccaaggtttca

SEQ ID NO: 273642 - DNA, 25 bp, Rattus norvegicus
ctggattcttctgtccaaggtttca

SEQ ID NO: 273643 - DNA, 25 bp, Rattus norvegicus
ctggattgcccaactatgctggaac

SEQ ID NO: 273644 - DNA, 25 bp, Rattus norvegicus
ctggattgcccatctatgctggaac

SEQ ID NO: 273645 - DNA, 25 bp, Rattus norvegicus
ctggattggagccttccctgaagaa

SEQ ID NO: 273646 - DNA, 25 bp, Rattus norvegicus
ctggattggagcgttccctgaagaa

SEQ ID NO: 273647 - DNA, 25 bp, Rattus norvegicus
ctggatttaatcatggttgggctta

SEQ ID NO: 273648 - DNA, 25 bp, Rattus norvegicus
ctggatttaatcttggttgggctta

SEQ ID NO: 273649 - DNA, 25 bp, Rattus norvegicus
ctggatttactaagctgcacctggt

SEQ ID NO: 273650 - DNA, 25 bp, Rattus norvegicus
ctggatttactatgctgcacctggt

SEQ ID NO: 273651 - DNA, 25 bp, Rattus norvegicus
ctggatttatcaattatgctgactg

SEQ ID NO: 273652 - DNA, 25 bp, Rattus norvegicus
ctggatttatcatttatgctgactg

SEQ ID NO: 273653 - DNA, 25 bp, Rattus norvegicus
ctggatttatttcggtcctggacca

SEQ ID NO: 273654 - DNA, 25 bp, Rattus norvegicus
ctggatttatttgggtcctggacca

SEQ ID NO: 273655 - DNA, 25 bp, Rattus norvegicus
ctggatttccagagtttgaactgaa

SEQ ID NO: 273656 - DNA, 25 bp, Rattus norvegicus
ctggatttccagtgtttgaactgaa

SEQ ID NO: 273657 - DNA, 25 bp, Rattus norvegicus
ctggatttcctgatcagttgtagca

SEQ ID NO: 273658 - DNA, 25 bp, Rattus norvegicus
ctggatttcctgttcagttgtagca

SEQ ID NO: 273659 - DNA, 25 bp, Rattus norvegicus
ctggatttctgcaaatgccatcacg

SEQ ID NO: 273660 - DNA, 25 bp, Rattus norvegicus
ctggatttctgctaatgccatcacg

SEQ ID NO: 273661 - DNA, 25 bp, Rattus norvegicus
ctggatttgctcatgggacctgtca

SEQ ID NO: 273662 - DNA, 25 bp, Rattus norvegicus
ctggatttgctcttgggacctgtca

SEQ ID NO: 273663 - DNA, 25 bp, Rattus norvegicus
ctggattttcttctcagtaatgtca

SEQ ID NO: 273664 - DNA, 25 bp, Rattus norvegicus
ctggattttcttgtcagtaatgtca

SEQ ID NO: 273665 - DNA, 25 bp, Rattus norvegicus
ctggcaaagagaccaaaactcctct

SEQ ID NO: 273666 - DNA, 25 bp, Rattus norvegicus
ctggcaaagagagcaaaactcctct

SEQ ID NO: 273667 - DNA, 25 bp, Rattus norvegicus
ctggcaaattctcccagttgcttgg

SEQ ID NO: 273668 - DNA, 25 bp, Rattus norvegicus
ctggcaaattctgccagttgcttgg

SEQ ID NO: 273669 - DNA, 25 bp, Rattus norvegicus
ctggcaacagtgatccggagcagct

SEQ ID NO: 273670 - DNA, 25 bp, Rattus norvegicus
ctggcaacagtgttccggagcagct

SEQ ID NO: 273671 - DNA, 25 bp, Rattus norvegicus
ctggcaaccatcacctgaaacagtg

SEQ ID NO: 273672 - DNA, 25 bp, Rattus norvegicus
ctggcaaccatctcctgaaacagtg

SEQ ID NO: 273673 - DNA, 25 bp, Rattus norvegicus
ctggcaagaggccttttttacaatc

SEQ ID NO: 273674 - DNA, 25 bp, Rattus norvegicus
ctggcaagaggcgttttttacaatc

SEQ ID NO: 273675 - DNA, 25 bp, Rattus norvegicus
ctggcaagatggctcggcaagttaa

SEQ ID NO: 273676 - DNA, 25 bp, Rattus norvegicus
ctggcaagatgggtcggcaagttaa

SEQ ID NO: 273677 - DNA, 25 bp, Rattus norvegicus
ctggcaaggtttacatctcactcac

SEQ ID NO: 273678 - DNA, 25 bp, Rattus norvegicus
ctggcaaggttttcatctcactcac

SEQ ID NO: 273679 - DNA, 25 bp, Rattus norvegicus
ctggcaatttctccaacttgtgtat

SEQ ID NO: 273680 - DNA, 25 bp, Rattus norvegicus
ctggcaatttctgcaacttgtgtat

SEQ ID NO: 273681 - DNA, 25 bp, Rattus norvegicus
ctggcacaccagcttgtgcttcttc

SEQ ID NO: 273682 - DNA, 25 bp, Rattus norvegicus
ctggcacaccaggttgtgcttcttc

SEQ ID NO: 273683 - DNA, 25 bp, Rattus norvegicus
ctggcacactgcacagctggaagat

SEQ ID NO: 273684 - DNA, 25 bp, Rattus norvegicus
ctggcacactgctcagctggaagat

SEQ ID NO: 273685 - DNA, 25 bp, Rattus norvegicus
ctggcacattcacctctggtggtgg

SEQ ID NO: 273686 - DNA, 25 bp, Rattus norvegicus
ctggcacattcagctctggtggtgg

SEQ ID NO: 273687 - DNA, 25 bp, Rattus norvegicus
ctggcaccaaggctgcaatgttaga

SEQ ID NO: 273688 - DNA, 25 bp, Rattus norvegicus
ctggcaccaagggtgcaatgttaga

SEQ ID NO: 273689 - DNA, 25 bp, Rattus norvegicus
ctggcaccagctatcttcatggata

SEQ ID NO: 273690 - DNA, 25 bp, Rattus norvegicus
ctggcaccagctttcttcatggata

SEQ ID NO: 273691 - DNA, 25 bp, Rattus norvegicus
ctggcaccaggaacgaataggcaaa

SEQ ID NO: 273692 - DNA, 25 bp, Rattus norvegicus
ctggcaccaggatcgaataggcaaa

SEQ ID NO: 273693 - DNA, 25 bp, Rattus norvegicus
ctggcacctctaactaatgcagtga

SEQ ID NO: 273694 - DNA, 25 bp, Rattus norvegicus
ctggcacctctatctaatgcagtga

SEQ ID NO: 273695 - DNA, 25 bp, Rattus norvegicus
ctggcacctggtactatgatatcat

SEQ ID NO: 273696 - DNA, 25 bp, Rattus norvegicus
ctggcacctggttctatgatatcat

SEQ ID NO: 273697 - DNA, 25 bp, Rattus norvegicus
ctggcacgaccgaattgcccgtatc

SEQ ID NO: 273698 - DNA, 25 bp, Rattus norvegicus
ctggcacgaccgtattgcccgtatc

SEQ ID NO: 273699 - DNA, 25 bp, Rattus norvegicus
ctggcactcaaactcaagactgggt

SEQ ID NO: 273700 - DNA, 25 bp, Rattus norvegicus
ctggcactcaaagtcaagactgggt

SEQ ID NO: 273701 - DNA, 25 bp, Rattus norvegicus
ctggcactcctgctgttgcttggtg

SEQ ID NO: 273702 - DNA, 25 bp, Rattus norvegicus
ctggcactcctggtgttgcttggtg

SEQ ID NO: 273703 - DNA, 25 bp, Rattus norvegicus
ctggcactcgtgcatagttttggca

SEQ ID NO: 273704 - DNA, 25 bp, Rattus norvegicus
ctggcactcgtggatagttttggca

SEQ ID NO: 273705 - DNA, 25 bp, Rattus norvegicus
ctggcactctagaaattttactttt

SEQ ID NO: 273706 - DNA, 25 bp, Rattus norvegicus
ctggcactctagtaattttactttt

SEQ ID NO: 273707 - DNA, 25 bp, Rattus norvegicus
ctggcactgccaaaaaatgatgttt

SEQ ID NO: 273708 - DNA, 25 bp, Rattus norvegicus
ctggcactgccataaaatgatgttt

SEQ ID NO: 273709 - DNA, 25 bp, Rattus norvegicus
ctggcactgcttatagagatctctt

SEQ ID NO: 273710 - DNA, 25 bp, Rattus norvegicus
ctggcactgcttttagagatctctt

SEQ ID NO: 273711 - DNA, 25 bp, Rattus norvegicus
ctggcactgtcaagtaactcctctt

SEQ ID NO: 273712 - DNA, 25 bp, Rattus norvegicus
ctggcactgtcatgtaactcctctt

SEQ ID NO: 273713 - DNA, 25 bp, Rattus norvegicus
ctggcacttggaaacatggagggat

SEQ ID NO: 273714 - DNA, 25 bp, Rattus norvegicus
ctggcacttggatacatggagggat

SEQ ID NO: 273715 - DNA, 25 bp, Rattus norvegicus
ctggcacttgggaagcaggcagatt

SEQ ID NO: 273716 - DNA, 25 bp, Rattus norvegicus
ctggcacttgggtagcaggcagatt

SEQ ID NO: 273717 - DNA, 25 bp, Rattus norvegicus
ctggcactttgtacgtgtgggacct

SEQ ID NO: 273718 - DNA, 25 bp, Rattus norvegicus
ctggcactttgttcgtgtgggacct

SEQ ID NO: 273719 - DNA, 25 bp, Rattus norvegicus
ctggcagaccccaaagatctacatg

SEQ ID NO: 273720 - DNA, 25 bp, Rattus norvegicus
ctggcagacccctaagatctacatg

SEQ ID NO: 273721 - DNA, 25 bp, Rattus norvegicus
ctggcagagctcatggccctggtga

SEQ ID NO: 273722 - DNA, 25 bp, Rattus norvegicus
ctggcagagctcttggccctggtga

SEQ ID NO: 273723 - DNA, 25 bp, Rattus norvegicus
ctggcagatgacatcggaggacttt

SEQ ID NO: 273724 - DNA, 25 bp, Rattus norvegicus
ctggcagatgacttcggaggacttt

SEQ ID NO: 273725 - DNA, 25 bp, Rattus norvegicus
ctggcagcagcaaacaataaaactt

SEQ ID NO: 273726 - DNA, 25 bp, Rattus norvegicus
ctggcagcagcacccgatatgagga

SEQ ID NO: 273727 - DNA, 25 bp, Rattus norvegicus
ctggcagcagcagccgatatgagga

SEQ ID NO: 273728 - DNA, 25 bp, Rattus norvegicus
ctggcagcagcatacaataaaactt

SEQ ID NO: 273729 - DNA, 25 bp, Rattus norvegicus
ctggcagcagtgcacatagcctcca

SEQ ID NO: 273730 - DNA, 25 bp, Rattus norvegicus
ctggcagcagtggacatagcctcca

SEQ ID NO: 273731 - DNA, 25 bp, Rattus norvegicus
ctggcagcctgcacagttgctcaga

SEQ ID NO: 273732 - DNA, 25 bp, Rattus norvegicus
ctggcagcctgctcagttgctcaga

SEQ ID NO: 273733 - DNA, 25 bp, Rattus norvegicus
ctggcagcctttcaggaaggaccct

SEQ ID NO: 273734 - DNA, 25 bp, Rattus norvegicus
ctggcagcctttgaggaaggaccct

SEQ ID NO: 273735 - DNA, 25 bp, Rattus norvegicus
ctggcagcgaaaagaccccggaagg

SEQ ID NO: 273736 - DNA, 25 bp, Rattus norvegicus
ctggcagcgaaatgaccccggaagg

SEQ ID NO: 273737 - DNA, 25 bp, Rattus norvegicus
ctggcagcgggtaatccggaatgac

SEQ ID NO: 273738 - DNA, 25 bp, Rattus norvegicus
ctggcagcgggttatccggaatgac

SEQ ID NO: 273739 - DNA, 25 bp, Rattus norvegicus
ctggcagcttctctctgaggaaaca

SEQ ID NO: 273740 - DNA, 25 bp, Rattus norvegicus
ctggcagcttctgtctgaggaaaca

SEQ ID NO: 273741 - DNA, 25 bp, Rattus norvegicus
ctggcaggactgctggctgattact

SEQ ID NO: 273742 - DNA, 25 bp, Rattus norvegicus
ctggcaggactggtggctgattact

SEQ ID NO: 273743 - DNA, 25 bp, Rattus norvegicus
ctggcaggaggcagcatcaccaagt

SEQ ID NO: 273744 - DNA, 25 bp, Rattus norvegicus
ctggcaggaggctgcatcaccaagt

SEQ ID NO: 273745 - DNA, 25 bp, Rattus norvegicus
ctggcaggcactacagcagtgggca

SEQ ID NO: 273746 - DNA, 25 bp, Rattus norvegicus
ctggcaggcacttcagcagtgggca

SEQ ID NO: 273747 - DNA, 25 bp, Rattus norvegicus
ctggcaggcgcaatcggattggacc

SEQ ID NO: 273748 - DNA, 25 bp, Rattus norvegicus
ctggcaggcgcattcggattggacc

SEQ ID NO: 273749 - DNA, 25 bp, Rattus norvegicus
ctggcagggccacgtacctgagctc

SEQ ID NO: 273750 - DNA, 25 bp, Rattus norvegicus
ctggcagggccaggtacctgagctc

SEQ ID NO: 273751 - DNA, 25 bp, Rattus norvegicus
ctggcagggttaagagagattaata

SEQ ID NO: 273752 - DNA, 25 bp, Rattus norvegicus
ctggcagggttatgagagattaata

SEQ ID NO: 273753 - DNA, 25 bp, Rattus norvegicus
ctggcaggtggaatccagctgtaaa

SEQ ID NO: 273754 - DNA, 25 bp, Rattus norvegicus
ctggcaggtggattccagctgtaaa

SEQ ID NO: 273755 - DNA, 25 bp, Rattus norvegicus
ctggcagtacctatggcagcaggac

SEQ ID NO: 273756 - DNA, 25 bp, Rattus norvegicus
ctggcagtacctttggcagcaggac

SEQ ID NO: 273757 - DNA, 25 bp, Rattus norvegicus
ctggcagtcaccattttctttttcg

SEQ ID NO: 273758 - DNA, 25 bp, Rattus norvegicus
ctggcagtcacctttttctttttcg

SEQ ID NO: 273759 - DNA, 25 bp, Rattus norvegicus
ctggcagtccaaaatcctggcaaca

SEQ ID NO: 273760 - DNA, 25 bp, Rattus norvegicus
ctggcagtccaatatcctggcaaca

SEQ ID NO: 273761 - DNA, 25 bp, Rattus norvegicus
ctggcagtgggtcttgtccatgaac

SEQ ID NO: 273762 - DNA, 25 bp, Rattus norvegicus
ctggcagtgggtgttgtccatgaac

SEQ ID NO: 273763 - DNA, 25 bp, Rattus norvegicus
ctggcagttgccagtttctgtctaa

SEQ ID NO: 273764 - DNA, 25 bp, Rattus norvegicus
ctggcagttgcctgtttctgtctaa

SEQ ID NO: 273765 - DNA, 25 bp, Rattus norvegicus
ctggcagttgttactagtgagctct

SEQ ID NO: 273766 - DNA, 25 bp, Rattus norvegicus
ctggcagttgtttctagtgagctct

SEQ ID NO: 273767 - DNA, 25 bp, Rattus norvegicus
ctggcatagatgatgctgcagctac

SEQ ID NO: 273768 - DNA, 25 bp, Rattus norvegicus
ctggcatagatgttgctgcagctac

SEQ ID NO: 273769 - DNA, 25 bp, Rattus norvegicus
ctggcatccaatactcagtttaatt

SEQ ID NO: 273770 - DNA, 25 bp, Rattus norvegicus
ctggcatccaattctcagtttaatt

SEQ ID NO: 273771 - DNA, 25 bp, Rattus norvegicus
ctggcatccccaacatcgcatcgtt

SEQ ID NO: 273772 - DNA, 25 bp, Rattus norvegicus
ctggcatccccatcatcgcatcgtt

SEQ ID NO: 273773 - DNA, 25 bp, Rattus norvegicus
ctggcatccctcagtgaactatgac

SEQ ID NO: 273774 - DNA, 25 bp, Rattus norvegicus
ctggcatccctctgtgaactatgac

SEQ ID NO: 273775 - DNA, 25 bp, Rattus norvegicus
ctggcatctggcatcagtgtttggc

SEQ ID NO: 273776 - DNA, 25 bp, Rattus norvegicus
ctggcatctggcttcagtgtttggc

SEQ ID NO: 273777 - DNA, 25 bp, Rattus norvegicus
ctggcatcttctattcttacttcaa

SEQ ID NO: 273778 - DNA, 25 bp, Rattus norvegicus
ctggcatcttcttttcttacttcaa

SEQ ID NO: 273779 - DNA, 25 bp, Rattus norvegicus
ctggcatgcaggcttatacctagca

SEQ ID NO: 273780 - DNA, 25 bp, Rattus norvegicus
ctggcatgcagggttatacctagca

SEQ ID NO: 273781 - DNA, 25 bp, Rattus norvegicus
ctggcatgcttcaaataatttcaaa

SEQ ID NO: 273782 - DNA, 25 bp, Rattus norvegicus
ctggcatgcttctaataatttcaaa

SEQ ID NO: 273783 - DNA, 25 bp, Rattus norvegicus
ctggcatggtggatggtcagcatct

SEQ ID NO: 273784 - DNA, 25 bp, Rattus norvegicus
ctggcatggtggttggtcagcatct

SEQ ID NO: 273785 - DNA, 25 bp, Rattus norvegicus
ctggcatgtgacagccgcatttata

SEQ ID NO: 273786 - DNA, 25 bp, Rattus norvegicus
ctggcatgtgactgccgcatttata

SEQ ID NO: 273787 - DNA, 25 bp, Rattus norvegicus
ctggcatgtgctcagagtatccttt

SEQ ID NO: 273788 - DNA, 25 bp, Rattus norvegicus
ctggcatgtgctgagagtatccttt

SEQ ID NO: 273789 - DNA, 25 bp, Rattus norvegicus
ctggcattcgcgctggagttaaaaa

SEQ ID NO: 273790 - DNA, 25 bp, Rattus norvegicus
ctggcattcgcggtggagttaaaaa

SEQ ID NO: 273791 - DNA, 25 bp, Rattus norvegicus
ctggcattctgcatttagtcctata

SEQ ID NO: 273792 - DNA, 25 bp, Rattus norvegicus
ctggcattctgcttttagtcctata

SEQ ID NO: 273793 - DNA, 25 bp, Rattus norvegicus
ctggcattgctcagctgtctcatac

SEQ ID NO: 273794 - DNA, 25 bp, Rattus norvegicus
ctggcattgctctgctgtctcatac

SEQ ID NO: 273795 - DNA, 25 bp, Rattus norvegicus
ctggcattgtatcgtgggccgaaat

SEQ ID NO: 273796 - DNA, 25 bp, Rattus norvegicus
ctggcattgtatggtgggccgaaat

SEQ ID NO: 273797 - DNA, 25 bp, Rattus norvegicus
ctggcatttcctctgtatgttgtca

SEQ ID NO: 273798 - DNA, 25 bp, Rattus norvegicus
ctggcatttcctgtgtatgttgtca

SEQ ID NO: 273799 - DNA, 25 bp, Rattus norvegicus
ctggcattttacagcttgtcatgga

SEQ ID NO: 273800 - DNA, 25 bp, Rattus norvegicus
ctggcattttactgcttgtcatgga

SEQ ID NO: 273801 - DNA, 25 bp, Rattus norvegicus
ctggcattttgtactcaactcgtaa

SEQ ID NO: 273802 - DNA, 25 bp, Rattus norvegicus
ctggcattttgttctcaactcgtaa

SEQ ID NO: 273803 - DNA, 25 bp, Rattus norvegicus
ctggccaaacatcaggtgcctgaca

SEQ ID NO: 273804 - DNA, 25 bp, Rattus norvegicus
ctggccaaacatgaggtgcctgaca

SEQ ID NO: 273805 - DNA, 25 bp, Rattus norvegicus
ctggccaactgtccctctgtaaagt

SEQ ID NO: 273806 - DNA, 25 bp, Rattus norvegicus
ctggccaactgtgcctctgtaaagt

SEQ ID NO: 273807 - DNA, 25 bp, Rattus norvegicus
ctggccaagctgagcctgacttttt

SEQ ID NO: 273808 - DNA, 25 bp, Rattus norvegicus
ctggccaagctgtgcctgacttttt

SEQ ID NO: 273809 - DNA, 25 bp, Rattus norvegicus
ctggccaaggcgctgatgctactac

SEQ ID NO: 273810 - DNA, 25 bp, Rattus norvegicus
ctggccaaggcggtgatgctactac

SEQ ID NO: 273811 - DNA, 25 bp, Rattus norvegicus
ctggccacaaggctgcagtgtatat

SEQ ID NO: 273812 - DNA, 25 bp, Rattus norvegicus
ctggccacaagggtgcagtgtatat

SEQ ID NO: 273813 - DNA, 25 bp, Rattus norvegicus
ctggccacagagctgataccctaac

SEQ ID NO: 273814 - DNA, 25 bp, Rattus norvegicus
ctggccacagaggtgataccctaac

SEQ ID NO: 273815 - DNA, 25 bp, Rattus norvegicus
ctggccacaggcatttcacttaatt

SEQ ID NO: 273816 - DNA, 25 bp, Rattus norvegicus
ctggccacaggcttttcacttaatt

SEQ ID NO: 273817 - DNA, 25 bp, Rattus norvegicus
ctggccacatcaagcctgtaaggtg

SEQ ID NO: 273818 - DNA, 25 bp, Rattus norvegicus
ctggccacatcatgcctgtaaggtg

SEQ ID NO: 273819 - DNA, 25 bp, Rattus norvegicus
ctggccaccagaccttagacacaag

SEQ ID NO: 273820 - DNA, 25 bp, Rattus norvegicus
ctggccaccagagcttagacacaag

SEQ ID NO: 273821 - DNA, 25 bp, Rattus norvegicus
ctggccaccaggactcagcacaaga

SEQ ID NO: 273822 - DNA, 25 bp, Rattus norvegicus
ctggccaccaggattgttcgaattc

SEQ ID NO: 273823 - DNA, 25 bp, Rattus norvegicus
ctggccaccaggtctcagcacaaga

SEQ ID NO: 273824 - DNA, 25 bp, Rattus norvegicus
ctggccaccaggtttgttcgaattc

SEQ ID NO: 273825 - DNA, 25 bp, Rattus norvegicus
ctggccaccctcatttattttaatt

SEQ ID NO: 273826 - DNA, 25 bp, Rattus norvegicus
ctggccaccctcttttattttaatt

SEQ ID NO: 273827 - DNA, 25 bp, Rattus norvegicus
ctggccagcaccagtgatgagtcag

SEQ ID NO: 273828 - DNA, 25 bp, Rattus norvegicus
ctggccagcacctgtgatgagtcag

SEQ ID NO: 273829 - DNA, 25 bp, Rattus norvegicus
ctggccagccagacttggaagagca

SEQ ID NO: 273830 - DNA, 25 bp, Rattus norvegicus
ctggccagccagtcttggaagagca

SEQ ID NO: 273831 - DNA, 25 bp, Rattus norvegicus
ctggccagcctgcactagtgatatc

SEQ ID NO: 273832 - DNA, 25 bp, Rattus norvegicus
ctggccagcctggactagtgatatc

SEQ ID NO: 273833 - DNA, 25 bp, Rattus norvegicus
ctggccagctgtctgacaacaacag

SEQ ID NO: 273834 - DNA, 25 bp, Rattus norvegicus
ctggccagctgtgtgacaacaacag

SEQ ID NO: 273835 - DNA, 25 bp, Rattus norvegicus
ctggccagcttcatcgaacaagttg

SEQ ID NO: 273836 - DNA, 25 bp, Rattus norvegicus
ctggccagcttcttcgaacaagttg

SEQ ID NO: 273837 - DNA, 25 bp, Rattus norvegicus
ctggccaggcagctcatcgagtatg

SEQ ID NO: 273838 - DNA, 25 bp, Rattus norvegicus
ctggccaggcaggtcatcgagtatg

SEQ ID NO: 273839 - DNA, 25 bp, Rattus norvegicus
ctggccagggccattgttcgaaaga

SEQ ID NO: 273840 - DNA, 25 bp, Rattus norvegicus
ctggccagggcctttgttcgaaaga

SEQ ID NO: 273841 - DNA, 25 bp, Rattus norvegicus
ctggccagtatgatggagacatttc

SEQ ID NO: 273842 - DNA, 25 bp, Rattus norvegicus
ctggccagtatgttggagacatttc

SEQ ID NO: 273843 - DNA, 25 bp, Rattus norvegicus
ctggccagtcccaattactgttaag

SEQ ID NO: 273844 - DNA, 25 bp, Rattus norvegicus
ctggccagtccctattactgttaag

SEQ ID NO: 273845 - DNA, 25 bp, Rattus norvegicus
ctggccagtggaatgtatgtgaact

SEQ ID NO: 273846 - DNA, 25 bp, Rattus norvegicus
ctggccagtggattgtatgtgaact

SEQ ID NO: 273847 - DNA, 25 bp, Rattus norvegicus
ctggccatcccaagtgtggcgtttc

SEQ ID NO: 273848 - DNA, 25 bp, Rattus norvegicus
ctggccatcccatgtgtggcgtttc

SEQ ID NO: 273849 - DNA, 25 bp, Rattus norvegicus
ctggccatcggcatgttcttcactg

SEQ ID NO: 273850 - DNA, 25 bp, Rattus norvegicus
ctggccatcggcttgttcttcactg

SEQ ID NO: 273851 - DNA, 25 bp, Rattus norvegicus
ctggccatgatgagttccgtttctg

SEQ ID NO: 273852 - DNA, 25 bp, Rattus norvegicus
ctggccatgatgtgttccgtttctg

SEQ ID NO: 273853 - DNA, 25 bp, Rattus norvegicus
ctggccattgccctgatgagaacaa

SEQ ID NO: 273854 - DNA, 25 bp, Rattus norvegicus
ctggccattgccgtgatgagaacaa

SEQ ID NO: 273855 - DNA, 25 bp, Rattus norvegicus
ctggcccacatcacaatttgacatt

SEQ ID NO: 273856 - DNA, 25 bp, Rattus norvegicus
ctggcccacatctcaatttgacatt

SEQ ID NO: 273857 - DNA, 25 bp, Rattus norvegicus
ctggcccagagcaggagccgagaca

SEQ ID NO: 273858 - DNA, 25 bp, Rattus norvegicus
ctggcccagagctggagccgagaca

SEQ ID NO: 273859 - DNA, 25 bp, Rattus norvegicus
ctggcccattttaaggtaatctcat

SEQ ID NO: 273860 - DNA, 25 bp, Rattus norvegicus
ctggcccatttttaggtaatctcat

SEQ ID NO: 273861 - DNA, 25 bp, Rattus norvegicus
ctggccccaaacatgtgaagatcct

SEQ ID NO: 273862 - DNA, 25 bp, Rattus norvegicus
ctggccccaaacttgtgaagatcct

SEQ ID NO: 273863 - DNA, 25 bp, Rattus norvegicus
ctggccccaacaactattctaatga

SEQ ID NO: 273864 - DNA, 25 bp, Rattus norvegicus
ctggccccaacatctattctaatga

SEQ ID NO: 273865 - DNA, 25 bp, Rattus norvegicus
ctggccccacggcatggagaactta

SEQ ID NO: 273866 - DNA, 25 bp, Rattus norvegicus
ctggccccacgggatggagaactta

SEQ ID NO: 273867 - DNA, 25 bp, Rattus norvegicus
ctggccccaggtcgcaagcttggat

SEQ ID NO: 273868 - DNA, 25 bp, Rattus norvegicus
ctggccccaggtggcaagcttggat

SEQ ID NO: 273869 - DNA, 25 bp, Rattus norvegicus
ctggcccctgagagcttatagtgta

SEQ ID NO: 273870 - DNA, 25 bp, Rattus norvegicus
ctggcccctgagtgcttatagtgta

SEQ ID NO: 273871 - DNA, 25 bp, Rattus norvegicus
ctggccctccaaaatttctatgtca

SEQ ID NO: 273872 - DNA, 25 bp, Rattus norvegicus
ctggccctccaatatttctatgtca

SEQ ID NO: 273873 - DNA, 25 bp, Rattus norvegicus
ctggccctccagaaaaatataattt

SEQ ID NO: 273874 - DNA, 25 bp, Rattus norvegicus
ctggccctccagtaaaatataattt

SEQ ID NO: 273875 - DNA, 25 bp, Rattus norvegicus
ctggccctgcttaagctggatggac

SEQ ID NO: 273876 - DNA, 25 bp, Rattus norvegicus
ctggccctgctttagctggatggac

SEQ ID NO: 273877 - DNA, 25 bp, Rattus norvegicus
ctggccctggtacctgtcagaaaag

SEQ ID NO: 273878 - DNA, 25 bp, Rattus norvegicus
ctggccctggtagctgtcagaaaag

SEQ ID NO: 273879 - DNA, 25 bp, Rattus norvegicus
ctggccctggttcctgggattgcat

SEQ ID NO: 273880 - DNA, 25 bp, Rattus norvegicus
ctggccctggttgctgggattgcat

SEQ ID NO: 273881 - DNA, 25 bp, Rattus norvegicus
ctggccctgtgaccagctttgctgt

SEQ ID NO: 273882 - DNA, 25 bp, Rattus norvegicus
ctggccctgtgagcagctttgctgt

SEQ ID NO: 273883 - DNA, 25 bp, Rattus norvegicus
ctggccctgtggatacgtggtagta

SEQ ID NO: 273884 - DNA, 25 bp, Rattus norvegicus
ctggccctgtggttacgtggtagta

SEQ ID NO: 273885 - DNA, 25 bp, Rattus norvegicus
ctggcccttaacacacaggtttaat

SEQ ID NO: 273886 - DNA, 25 bp, Rattus norvegicus
ctggcccttaactcacaggtttaat

SEQ ID NO: 273887 - DNA, 25 bp, Rattus norvegicus
ctggcccttgaaacactttggttat

SEQ ID NO: 273888 - DNA, 25 bp, Rattus norvegicus
ctggcccttgaatcactttggttat

SEQ ID NO: 273889 - DNA, 25 bp, Rattus norvegicus
ctggcccttggcatgtgaacttaga

SEQ ID NO: 273890 - DNA, 25 bp, Rattus norvegicus
ctggcccttggcttgtgaacttaga

SEQ ID NO: 273891 - DNA, 25 bp, Rattus norvegicus
ctggccctttcaactttttaaatat

SEQ ID NO: 273892 - DNA, 25 bp, Rattus norvegicus
ctggccctttcatctttttaaatat

SEQ ID NO: 273893 - DNA, 25 bp, Rattus norvegicus
ctggccgaggaactccaatgggcat

SEQ ID NO: 273894 - DNA, 25 bp, Rattus norvegicus
ctggccgaggaagtccaatgggcat

SEQ ID NO: 273895 - DNA, 25 bp, Rattus norvegicus
ctggccgcatgtccgttcttaagaa

SEQ ID NO: 273896 - DNA, 25 bp, Rattus norvegicus
ctggccgcatgtgcgttcttaagaa

SEQ ID NO: 273897 - DNA, 25 bp, Rattus norvegicus
ctggccgcccttaattacatacagc

SEQ ID NO: 273898 - DNA, 25 bp, Rattus norvegicus
ctggccgccctttattacatacagc

SEQ ID NO: 273899 - DNA, 25 bp, Rattus norvegicus
ctggccgctgtacggccctatctag

SEQ ID NO: 273900 - DNA, 25 bp, Rattus norvegicus
ctggccgctgtagggccctatctag

SEQ ID NO: 273901 - DNA, 25 bp, Rattus norvegicus
ctggccgctgttcacttgtaagata

SEQ ID NO: 273902 - DNA, 25 bp, Rattus norvegicus
ctggccgctgttgacttgtaagata

SEQ ID NO: 273903 - DNA, 25 bp, Rattus norvegicus
ctggccggatgtcactgaccatgaa

SEQ ID NO: 273904 - DNA, 25 bp, Rattus norvegicus
ctggccggatgtgactgaccatgaa

SEQ ID NO: 273905 - DNA, 25 bp, Rattus norvegicus
ctggccgtccatatccaagaggaag

SEQ ID NO: 273906 - DNA, 25 bp, Rattus norvegicus
ctggccgtccatttccaagaggaag

SEQ ID NO: 273907 - DNA, 25 bp, Rattus norvegicus
ctggccgttctgagcagtactaagt

SEQ ID NO: 273908 - DNA, 25 bp, Rattus norvegicus
ctggccgttctgtgcagtactaagt

SEQ ID NO: 273909 - DNA, 25 bp, Rattus norvegicus
ctggcctaagctctcatgggattta

SEQ ID NO: 273910 - DNA, 25 bp, Rattus norvegicus
ctggcctaagctgtcatgggattta

SEQ ID NO: 273911 - DNA, 25 bp, Rattus norvegicus
ctggcctacccacattgtatcatgt

SEQ ID NO: 273912 - DNA, 25 bp, Rattus norvegicus
ctggcctacccagattgtatcatgt

SEQ ID NO: 273913 - DNA, 25 bp, Rattus norvegicus
ctggcctactctcctggaaaactag

SEQ ID NO: 273914 - DNA, 25 bp, Rattus norvegicus
ctggcctactctgctggaaaactag

SEQ ID NO: 273915 - DNA, 25 bp, Rattus norvegicus
ctggcctactgcctttttgtgtaag

SEQ ID NO: 273916 - DNA, 25 bp, Rattus norvegicus
ctggcctactgcgtttttgtgtaag

SEQ ID NO: 273917 - DNA, 25 bp, Rattus norvegicus
ctggcctaggccattagatgacagc

SEQ ID NO: 273918 - DNA, 25 bp, Rattus norvegicus
ctggcctaggcctttagatgacagc

SEQ ID NO: 273919 - DNA, 25 bp, Rattus norvegicus
ctggcctcaaaacactcggaagctg

SEQ ID NO: 273920 - DNA, 25 bp, Rattus norvegicus
ctggcctcaaaagactcggaagctg

SEQ ID NO: 273921 - DNA, 25 bp, Rattus norvegicus
ctggcctcaaagctgaccttttaaa

SEQ ID NO: 273922 - DNA, 25 bp, Rattus norvegicus
ctggcctcaaaggtgaccttttaaa

SEQ ID NO: 273923 - DNA, 25 bp, Rattus norvegicus
ctggcctcaaatatgccttgattct

SEQ ID NO: 273924 - DNA, 25 bp, Rattus norvegicus
ctggcctcaaatttgccttgattct

SEQ ID NO: 273925 - DNA, 25 bp, Rattus norvegicus
ctggcctcagtcattctttagggac

SEQ ID NO: 273926 - DNA, 25 bp, Rattus norvegicus
ctggcctcagtctttctttagggac

SEQ ID NO: 273927 - DNA, 25 bp, Rattus norvegicus
ctggcctcatttactattttacaat

SEQ ID NO: 273928 - DNA, 25 bp, Rattus norvegicus
ctggcctcattttctattttacaat

SEQ ID NO: 273929 - DNA, 25 bp, Rattus norvegicus
ctggcctccacaactgtacatgcat

SEQ ID NO: 273930 - DNA, 25 bp, Rattus norvegicus
ctggcctccacatctgtacatgcat

SEQ ID NO: 273931 - DNA, 25 bp, Rattus norvegicus
ctggcctccttcctaataatctagg

SEQ ID NO: 273932 - DNA, 25 bp, Rattus norvegicus
ctggcctccttcgtaataatctagg

SEQ ID NO: 273933 - DNA, 25 bp, Rattus norvegicus
ctggcctctaagcagctgggttcac

SEQ ID NO: 273934 - DNA, 25 bp, Rattus norvegicus
ctggcctctaaggagctgggttcac

SEQ ID NO: 273935 - DNA, 25 bp, Rattus norvegicus
ctggcctctcatagtcatagaccaa

SEQ ID NO: 273936 - DNA, 25 bp, Rattus norvegicus
ctggcctctcattgtcatagaccaa

SEQ ID NO: 273937 - DNA, 25 bp, Rattus norvegicus
ctggcctctccaaaagtgctagttt

SEQ ID NO: 273938 - DNA, 25 bp, Rattus norvegicus
ctggcctctccataagtgctagttt

SEQ ID NO: 273939 - DNA, 25 bp, Rattus norvegicus
ctggcctctgcacgtggtgcacaga

SEQ ID NO: 273940 - DNA, 25 bp, Rattus norvegicus
ctggcctctgcaggtggtgcacaga

SEQ ID NO: 273941 - DNA, 25 bp, Rattus norvegicus
ctggcctctggccttggagaaagat

SEQ ID NO: 273942 - DNA, 25 bp, Rattus norvegicus
ctggcctctggcgttggagaaagat

SEQ ID NO: 273943 - DNA, 25 bp, Rattus norvegicus
ctggcctctgtgcatgcatgaaaat

SEQ ID NO: 273944 - DNA, 25 bp, Rattus norvegicus
ctggcctctgtggatgcatgaaaat

SEQ ID NO: 273945 - DNA, 25 bp, Rattus norvegicus
ctggcctcttcacctaaactactga

SEQ ID NO: 273946 - DNA, 25 bp, Rattus norvegicus
ctggcctcttcagctaaactactga

SEQ ID NO: 273947 - DNA, 25 bp, Rattus norvegicus
ctggcctcttccagtaaatactgta

SEQ ID NO: 273948 - DNA, 25 bp, Rattus norvegicus
ctggcctcttcctgtaaatactgta

SEQ ID NO: 273949 - DNA, 25 bp, Rattus norvegicus
ctggcctcttggacacgtcagggag

SEQ ID NO: 273950 - DNA, 25 bp, Rattus norvegicus
ctggcctcttggagaagtgctgcaa

SEQ ID NO: 273951 - DNA, 25 bp, Rattus norvegicus
ctggcctcttggtcacgtcagggag

SEQ ID NO: 273952 - DNA, 25 bp, Rattus norvegicus
ctggcctcttggtgaagtgctgcaa

SEQ ID NO: 273953 - DNA, 25 bp, Rattus norvegicus
ctggcctgaaacacaagttgctctt

SEQ ID NO: 273954 - DNA, 25 bp, Rattus norvegicus
ctggcctgaaactcaagttgctctt

SEQ ID NO: 273955 - DNA, 25 bp, Rattus norvegicus
ctggcctgcggtctggtagatacat

SEQ ID NO: 273956 - DNA, 25 bp, Rattus norvegicus
ctggcctgcggtgtggtagatacat

SEQ ID NO: 273957 - DNA, 25 bp, Rattus norvegicus
ctggcctgctgtccatagtcatgaa

SEQ ID NO: 273958 - DNA, 25 bp, Rattus norvegicus
ctggcctgctgtgcatagtcatgaa

SEQ ID NO: 273959 - DNA, 25 bp, Rattus norvegicus
ctggcctgcttactttagtattgtc

SEQ ID NO: 273960 - DNA, 25 bp, Rattus norvegicus
ctggcctgcttagtttagtattgtc

SEQ ID NO: 273961 - DNA, 25 bp, Rattus norvegicus
ctggcctggaggacaaaagggacca

SEQ ID NO: 273962 - DNA, 25 bp, Rattus norvegicus
ctggcctggaggtcaaaagggacca

SEQ ID NO: 273963 - DNA, 25 bp, Rattus norvegicus
ctggcctgggatacttgtcaggata

SEQ ID NO: 273964 - DNA, 25 bp, Rattus norvegicus
ctggcctgggattcttgtcaggata

SEQ ID NO: 273965 - DNA, 25 bp, Rattus norvegicus
ctggcctggtttcggtaatttgtag

SEQ ID NO: 273966 - DNA, 25 bp, Rattus norvegicus
ctggcctggtttgggtaatttgtag

SEQ ID NO: 273967 - DNA, 25 bp, Rattus norvegicus
ctggcctgtcaaactggtcttgaag

SEQ ID NO: 273968 - DNA, 25 bp, Rattus norvegicus
ctggcctgtcaatctggtcttgaag

SEQ ID NO: 273969 - DNA, 25 bp, Rattus norvegicus
ctggccttacttattgcatgtttaa

SEQ ID NO: 273970 - DNA, 25 bp, Rattus norvegicus
ctggccttactttttgcatgtttaa

SEQ ID NO: 273971 - DNA, 25 bp, Rattus norvegicus
ctggccttagggactcagtctaaaa

SEQ ID NO: 273972 - DNA, 25 bp, Rattus norvegicus
ctggccttagggtctcagtctaaaa

SEQ ID NO: 273973 - DNA, 25 bp, Rattus norvegicus
ctggccttagtgatcctttagaatt

SEQ ID NO: 273974 - DNA, 25 bp, Rattus norvegicus
ctggccttagtgttcctttagaatt

SEQ ID NO: 273975 - DNA, 25 bp, Rattus norvegicus
ctggccttcatactgacgggactca

SEQ ID NO: 273976 - DNA, 25 bp, Rattus norvegicus
ctggccttcatagtgacgggactca

SEQ ID NO: 273977 - DNA, 25 bp, Rattus norvegicus
ctggccttcccaaactgcttttgat

SEQ ID NO: 273978 - DNA, 25 bp, Rattus norvegicus
ctggccttcccatactgcttttgat

SEQ ID NO: 273979 - DNA, 25 bp, Rattus norvegicus
ctggccttcgctacttaatttattt

SEQ ID NO: 273980 - DNA, 25 bp, Rattus norvegicus
ctggccttcgcttcttaatttattt

SEQ ID NO: 273981 - DNA, 25 bp, Rattus norvegicus
ctggccttcggacgtgatttcaagt

SEQ ID NO: 273982 - DNA, 25 bp, Rattus norvegicus
ctggccttcggaggtgatttcaagt

SEQ ID NO: 273983 - DNA, 25 bp, Rattus norvegicus
ctggccttcgtgcacactgttctca

SEQ ID NO: 273984 - DNA, 25 bp, Rattus norvegicus
ctggccttcgtggacactgttctca

SEQ ID NO: 273985 - DNA, 25 bp, Rattus norvegicus
ctggccttcgttcgaggccttatat

SEQ ID NO: 273986 - DNA, 25 bp, Rattus norvegicus
ctggccttcgttggaggccttatat

SEQ ID NO: 273987 - DNA, 25 bp, Rattus norvegicus
ctggccttctcgatgtagtggtgat

SEQ ID NO: 273988 - DNA, 25 bp, Rattus norvegicus
ctggccttctcgttgtagtggtgat

SEQ ID NO: 273989 - DNA, 25 bp, Rattus norvegicus
ctggccttgaggctttacaatgtaa

SEQ ID NO: 273990 - DNA, 25 bp, Rattus norvegicus
ctggccttgagggtttacaatgtaa

SEQ ID NO: 273991 - DNA, 25 bp, Rattus norvegicus
ctggccttgcaccacacaggtagaa

SEQ ID NO: 273992 - DNA, 25 bp, Rattus norvegicus
ctggccttgcacgacacaggtagaa

SEQ ID NO: 273993 - DNA, 25 bp, Rattus norvegicus
ctggccttgccacgtgtgaaactaa

SEQ ID NO: 273994 - DNA, 25 bp, Rattus norvegicus
ctggccttgccaggtgtgaaactaa

SEQ ID NO: 273995 - DNA, 25 bp, Rattus norvegicus
ctggccttggaaccctgtcaggata

SEQ ID NO: 273996 - DNA, 25 bp, Rattus norvegicus
ctggccttggaagcctgtcaggata

SEQ ID NO: 273997 - DNA, 25 bp, Rattus norvegicus
ctggccttgggtattctctgtaata

SEQ ID NO: 273998 - DNA, 25 bp, Rattus norvegicus
ctggccttgggttttctctgtaata

SEQ ID NO: 273999 - DNA, 25 bp, Rattus norvegicus
ctggcctttaagcaaactgagttgt

SEQ ID NO: 274000 - DNA, 25 bp, Rattus norvegicus
ctggcctttaaggaaactgagttgt

SEQ ID NO: 274001 - DNA, 25 bp, Rattus norvegicus
ctggcctttctacgtgtagcacaca

SEQ ID NO: 274002 - DNA, 25 bp, Rattus norvegicus
ctggcctttctaggtgtagcacaca

SEQ ID NO: 274003 - DNA, 25 bp, Rattus norvegicus
ctggcctttctcctggaaatagctg

SEQ ID NO: 274004 - DNA, 25 bp, Rattus norvegicus
ctggcctttctcgtggaaatagctg

SEQ ID NO: 274005 - DNA, 25 bp, Rattus norvegicus
ctggccttttggcaatgcttgaact

SEQ ID NO: 274006 - DNA, 25 bp, Rattus norvegicus
ctggccttttgggaatgcttgaact

SEQ ID NO: 274007 - DNA, 25 bp, Rattus norvegicus
ctggcgaccatcaaagccctggtgt

SEQ ID NO: 274008 - DNA, 25 bp, Rattus norvegicus
ctggcgaccatctaagccctggtgt

SEQ ID NO: 274009 - DNA, 25 bp, Rattus norvegicus
ctggcgacggacactgtcattcaaa

SEQ ID NO: 274010 - DNA, 25 bp, Rattus norvegicus
ctggcgacggactctgtcattcaaa

SEQ ID NO: 274011 - DNA, 25 bp, Rattus norvegicus
ctggcgactttcaggagaactgaat

SEQ ID NO: 274012 - DNA, 25 bp, Rattus norvegicus
ctggcgactttctggagaactgaat

SEQ ID NO: 274013 - DNA, 25 bp, Rattus norvegicus
ctggcgagtctgaggatgtgtgtta

SEQ ID NO: 274014 - DNA, 25 bp, Rattus norvegicus
ctggcgagtctgtggatgtgtgtta

SEQ ID NO: 274015 - DNA, 25 bp, Rattus norvegicus
ctggcgcaaggcagaatggagttaa

SEQ ID NO: 274016 - DNA, 25 bp, Rattus norvegicus
ctggcgcaaggctgaatggagttaa

SEQ ID NO: 274017 - DNA, 25 bp, Rattus norvegicus
ctggcgcgtgtaaccaagttgagtt

SEQ ID NO: 274018 - DNA, 25 bp, Rattus norvegicus
ctggcgcgtgtatccaagttgagtt

SEQ ID NO: 274019 - DNA, 25 bp, Rattus norvegicus
ctggcgctgaagcactggatgcaaa

SEQ ID NO: 274020 - DNA, 25 bp, Rattus norvegicus
ctggcgctgaaggactggatgcaaa

SEQ ID NO: 274021 - DNA, 25 bp, Rattus norvegicus
ctggcgcttaggcacagaagttgaa

SEQ ID NO: 274022 - DNA, 25 bp, Rattus norvegicus
ctggcgcttagggacagaagttgaa

SEQ ID NO: 274023 - DNA, 25 bp, Rattus norvegicus
ctggcggacgaccttcattaaactg

SEQ ID NO: 274024 - DNA, 25 bp, Rattus norvegicus
ctggcggacgacgttcattaaactg

SEQ ID NO: 274025 - DNA, 25 bp, Rattus norvegicus
ctggcggagccacacagctacctaa

SEQ ID NO: 274026 - DNA, 25 bp, Rattus norvegicus
ctggcggagccagacagctacctaa

SEQ ID NO: 274027 - DNA, 25 bp, Rattus norvegicus
ctggcggcatgccattttgattctg

SEQ ID NO: 274028 - DNA, 25 bp, Rattus norvegicus
ctggcggcatgcgattttgattctg

SEQ ID NO: 274029 - DNA, 25 bp, Rattus norvegicus
ctggcggccacactgatacttcagt

SEQ ID NO: 274030 - DNA, 25 bp, Rattus norvegicus
ctggcggccacagtgatacttcagt

SEQ ID NO: 274031 - DNA, 25 bp, Rattus norvegicus
ctggcggccagcaattacgatcaaa

SEQ ID NO: 274032 - DNA, 25 bp, Rattus norvegicus
ctggcggccagctattacgatcaaa

SEQ ID NO: 274033 - DNA, 25 bp, Rattus norvegicus
ctggcggtatctccagtctcagggc

SEQ ID NO: 274034 - DNA, 25 bp, Rattus norvegicus
ctggcggtatctgcagtctcagggc

SEQ ID NO: 274035 - DNA, 25 bp, Rattus norvegicus
ctggcggttttgcactgagagacat

SEQ ID NO: 274036 - DNA, 25 bp, Rattus norvegicus
ctggcggttttggactgagagacat

SEQ ID NO: 274037 - DNA, 25 bp, Rattus norvegicus
ctggcgtagcatatcaacttgactt

SEQ ID NO: 274038 - DNA, 25 bp, Rattus norvegicus
ctggcgtagcatttcaacttgactt

SEQ ID NO: 274039 - DNA, 25 bp, Rattus norvegicus
ctggcgtccatgcagttgtcagcag

SEQ ID NO: 274040 - DNA, 25 bp, Rattus norvegicus
ctggcgtccatggagttgtcagcag

SEQ ID NO: 274041 - DNA, 25 bp, Rattus norvegicus
ctggcgtctgtaaggactgcgactt

SEQ ID NO: 274042 - DNA, 25 bp, Rattus norvegicus
ctggcgtctgtatggactgcgactt

SEQ ID NO: 274043 - DNA, 25 bp, Rattus norvegicus
ctggcgtgcacacaatccgggagca

SEQ ID NO: 274044 - DNA, 25 bp, Rattus norvegicus
ctggcgtgcacagaatccgggagca

SEQ ID NO: 274045 - DNA, 25 bp, Rattus norvegicus
ctggcgtggctcatttcatgtataa

SEQ ID NO: 274046 - DNA, 25 bp, Rattus norvegicus
ctggcgtggctcttttcatgtataa

SEQ ID NO: 274047 - DNA, 25 bp, Rattus norvegicus
ctggcgtgtttgattcattcctaaa

SEQ ID NO: 274048 - DNA, 25 bp, Rattus norvegicus
ctggcgtgtttgtttcattcctaaa

SEQ ID NO: 274049 - DNA, 25 bp, Rattus norvegicus
ctggcgttcattctgcactatacaa

SEQ ID NO: 274050 - DNA, 25 bp, Rattus norvegicus
ctggcgttcattgtgcactatacaa

SEQ ID NO: 274051 - DNA, 25 bp, Rattus norvegicus
ctggctaatggcaaatgactgaaga

SEQ ID NO: 274052 - DNA, 25 bp, Rattus norvegicus
ctggctaatggctaatgactgaaga

SEQ ID NO: 274053 - DNA, 25 bp, Rattus norvegicus
ctggctacaaccatccctgttagaa

SEQ ID NO: 274054 - DNA, 25 bp, Rattus norvegicus
ctggctacaaccttccctgttagaa

SEQ ID NO: 274055 - DNA, 25 bp, Rattus norvegicus
ctggctacaagtcaacctgacaaaa

SEQ ID NO: 274056 - DNA, 25 bp, Rattus norvegicus
ctggctacaagtgaacctgacaaaa

SEQ ID NO: 274057 - DNA, 25 bp, Rattus norvegicus
ctggctacctagacttgtcaagtca

SEQ ID NO: 274058 - DNA, 25 bp, Rattus norvegicus
ctggctacctagtcttgtcaagtca

SEQ ID NO: 274059 - DNA, 25 bp, Rattus norvegicus
ctggctacctttcgatcaggatgca

SEQ ID NO: 274060 - DNA, 25 bp, Rattus norvegicus
ctggctacctttggatcaggatgca

SEQ ID NO: 274061 - DNA, 25 bp, Rattus norvegicus
ctggctacgccgctacatcaagtgg

SEQ ID NO: 274062 - DNA, 25 bp, Rattus norvegicus
ctggctacgccggtacatcaagtgg

SEQ ID NO: 274063 - DNA, 25 bp, Rattus norvegicus
ctggctactgccagcacatcatgaa

SEQ ID NO: 274064 - DNA, 25 bp, Rattus norvegicus
ctggctactgcctgcacatcatgaa

SEQ ID NO: 274065 - DNA, 25 bp, Rattus norvegicus
ctggctagcctgagagtcactatgt

SEQ ID NO: 274066 - DNA, 25 bp, Rattus norvegicus
ctggctagcctgtgagtcactatgt

SEQ ID NO: 274067 - DNA, 25 bp, Rattus norvegicus
ctggctaggaagatgtgcctctgtc

SEQ ID NO: 274068 - DNA, 25 bp, Rattus norvegicus
ctggctaggaagttgtgcctctgtc

SEQ ID NO: 274069 - DNA, 25 bp, Rattus norvegicus
ctggctaggtctccaggcttctgca

SEQ ID NO: 274070 - DNA, 25 bp, Rattus norvegicus
ctggctaggtctgcaggcttctgca

SEQ ID NO: 274071 - DNA, 25 bp, Rattus norvegicus
ctggctagtaagagatgcgtgcgtt

SEQ ID NO: 274072 - DNA, 25 bp, Rattus norvegicus
ctggctagtaagtgatgcgtgcgtt

SEQ ID NO: 274073 - DNA, 25 bp, Rattus norvegicus
ctggctagtgaaaggccgactgtaa

SEQ ID NO: 274074 - DNA, 25 bp, Rattus norvegicus
ctggctagtgaatggccgactgtaa

SEQ ID NO: 274075 - DNA, 25 bp, Rattus norvegicus
ctggctagtgggagtgctttgtaaa

SEQ ID NO: 274076 - DNA, 25 bp, Rattus norvegicus
ctggctagtgggtgtgctttgtaaa

SEQ ID NO: 274077 - DNA, 25 bp, Rattus norvegicus
ctggctagtgttatagctcatataa

SEQ ID NO: 274078 - DNA, 25 bp, Rattus norvegicus
ctggctagtgttttagctcatataa

SEQ ID NO: 274079 - DNA, 25 bp, Rattus norvegicus
ctggctatagcacgcagcttttctg

SEQ ID NO: 274080 - DNA, 25 bp, Rattus norvegicus
ctggctatagcaggcagcttttctg

SEQ ID NO: 274081 - DNA, 25 bp, Rattus norvegicus
ctggctatgagtatgtcatcttgga

SEQ ID NO: 274082 - DNA, 25 bp, Rattus norvegicus
ctggctatgagtttgtcatcttgga

SEQ ID NO: 274083 - DNA, 25 bp, Rattus norvegicus
ctggctatggccaagcagaaattgc

SEQ ID NO: 274084 - DNA, 25 bp, Rattus norvegicus
ctggctatggcctagcagaaattgc

SEQ ID NO: 274085 - DNA, 25 bp, Rattus norvegicus
ctggctatgtggcttcaagttgtaa

SEQ ID NO: 274086 - DNA, 25 bp, Rattus norvegicus
ctggctatgtgggttcaagttgtaa

SEQ ID NO: 274087 - DNA, 25 bp, Rattus norvegicus
ctggctattccacggctcactgtgt

SEQ ID NO: 274088 - DNA, 25 bp, Rattus norvegicus
ctggctattccagggctcactgtgt

SEQ ID NO: 274089 - DNA, 25 bp, Rattus norvegicus
ctggctcaaaggcaggctctgtcgc

SEQ ID NO: 274090 - DNA, 25 bp, Rattus norvegicus
ctggctcaaagggaggctctgtcgc

SEQ ID NO: 274091 - DNA, 25 bp, Rattus norvegicus
ctggctcaacaaactactggcttta

SEQ ID NO: 274092 - DNA, 25 bp, Rattus norvegicus
ctggctcaacaatctactggcttta

SEQ ID NO: 274093 - DNA, 25 bp, Rattus norvegicus
ctggctcaagctctgttttctaatg

SEQ ID NO: 274094 - DNA, 25 bp, Rattus norvegicus
ctggctcaagctgtgttttctaatg

SEQ ID NO: 274095 - DNA, 25 bp, Rattus norvegicus
ctggctcaatagaataacctcttct

SEQ ID NO: 274096 - DNA, 25 bp, Rattus norvegicus
ctggctcaatagtataacctcttct

SEQ ID NO: 274097 - DNA, 25 bp, Rattus norvegicus
ctggctcacttgactgacttggtga

SEQ ID NO: 274098 - DNA, 25 bp, Rattus norvegicus
ctggctcacttgtctgacttggtga

SEQ ID NO: 274099 - DNA, 25 bp, Rattus norvegicus
ctggctcagccaataaatcctaagg

SEQ ID NO: 274100 - DNA, 25 bp, Rattus norvegicus
ctggctcagccattaaatcctaagg

SEQ ID NO: 274101 - DNA, 25 bp, Rattus norvegicus
ctggctcagcgccttagagatcaat

SEQ ID NO: 274102 - DNA, 25 bp, Rattus norvegicus
ctggctcagcgcgttagagatcaat

SEQ ID NO: 274103 - DNA, 25 bp, Rattus norvegicus
ctggctcaggagaacctcgtgggat

SEQ ID NO: 274104 - DNA, 25 bp, Rattus norvegicus
ctggctcaggagtacctcgtgggat

SEQ ID NO: 274105 - DNA, 25 bp, Rattus norvegicus
ctggctcagggcactcaggctgtag

SEQ ID NO: 274106 - DNA, 25 bp, Rattus norvegicus
ctggctcagggctctcaggctgtag

SEQ ID NO: 274107 - DNA, 25 bp, Rattus norvegicus
ctggctcagggtccatgacttgtga

SEQ ID NO: 274108 - DNA, 25 bp, Rattus norvegicus
ctggctcagggtgcatgacttgtga

SEQ ID NO: 274109 - DNA, 25 bp, Rattus norvegicus
ctggctccatagaaaaaccctttct

SEQ ID NO: 274110 - DNA, 25 bp, Rattus norvegicus
ctggctccatagtaaaaccctttct

SEQ ID NO: 274111 - DNA, 25 bp, Rattus norvegicus
ctggctccctggaagaactgggtta

SEQ ID NO: 274112 - DNA, 25 bp, Rattus norvegicus
ctggctccctggtagaactgggtta

SEQ ID NO: 274113 - DNA, 25 bp, Rattus norvegicus
ctggctcctgctattcatgagaatc

SEQ ID NO: 274114 - DNA, 25 bp, Rattus norvegicus
ctggctcctgcttttcatgagaatc

SEQ ID NO: 274115 - DNA, 25 bp, Rattus norvegicus
ctggctcgaccacatcagagtgtgt

SEQ ID NO: 274116 - DNA, 25 bp, Rattus norvegicus
ctggctcgaccagatcagagtgtgt

SEQ ID NO: 274117 - DNA, 25 bp, Rattus norvegicus
ctggctcgcgtcacattgtgagtga

SEQ ID NO: 274118 - DNA, 25 bp, Rattus norvegicus
ctggctcgcgtctcattgtgagtga

SEQ ID NO: 274119 - DNA, 25 bp, Rattus norvegicus
ctggctctagctcaggtaggagtat

SEQ ID NO: 274120 - DNA, 25 bp, Rattus norvegicus
ctggctctagctgaggtaggagtat

SEQ ID NO: 274121 - DNA, 25 bp, Rattus norvegicus
ctggctctcactaaattctctgaaa

SEQ ID NO: 274122 - DNA, 25 bp, Rattus norvegicus
ctggctctcacttaattctctgaaa

SEQ ID NO: 274123 - DNA, 25 bp, Rattus norvegicus
ctggctctcagaatgtaaggctaaa

SEQ ID NO: 274124 - DNA, 25 bp, Rattus norvegicus
ctggctctcagattgtaaggctaaa

SEQ ID NO: 274125 - DNA, 25 bp, Rattus norvegicus
ctggctctcatcacagtggtactgt

SEQ ID NO: 274126 - DNA, 25 bp, Rattus norvegicus
ctggctctcatctcagtggtactgt

SEQ ID NO: 274127 - DNA, 25 bp, Rattus norvegicus
ctggctctgaggaacctccatggaa

SEQ ID NO: 274128 - DNA, 25 bp, Rattus norvegicus
ctggctctgaggtacctccatggaa

SEQ ID NO: 274129 - DNA, 25 bp, Rattus norvegicus
ctggctctgctgaagacgttgatga

SEQ ID NO: 274130 - DNA, 25 bp, Rattus norvegicus
ctggctctgctgaaggaggatacca

SEQ ID NO: 274131 - DNA, 25 bp, Rattus norvegicus
ctggctctgctgtagacgttgatga

SEQ ID NO: 274132 - DNA, 25 bp, Rattus norvegicus
ctggctctgctgtaggaggatacca

SEQ ID NO: 274133 - DNA, 25 bp, Rattus norvegicus
ctggctctggaacaagatctggaag

SEQ ID NO: 274134 - DNA, 25 bp, Rattus norvegicus
ctggctctggaagaagatctggaag

SEQ ID NO: 274135 - DNA, 25 bp, Rattus norvegicus
ctggctctgtgcatgggctgtctac

SEQ ID NO: 274136 - DNA, 25 bp, Rattus norvegicus
ctggctctgtgcttgggctgtctac

SEQ ID NO: 274137 - DNA, 25 bp, Rattus norvegicus
ctggctctgttcagtacttgctggg

SEQ ID NO: 274138 - DNA, 25 bp, Rattus norvegicus
ctggctctgttctgtacttgctggg

SEQ ID NO: 274139 - DNA, 25 bp, Rattus norvegicus
ctggctctgttgactgagtgtgatt

SEQ ID NO: 274140 - DNA, 25 bp, Rattus norvegicus
ctggctctgttgtctgagtgtgatt

SEQ ID NO: 274141 - DNA, 25 bp, Rattus norvegicus
ctggctcttagactgcaatttcctt

SEQ ID NO: 274142 - DNA, 25 bp, Rattus norvegicus
ctggctcttagagtgcaatttcctt

SEQ ID NO: 274143 - DNA, 25 bp, Rattus norvegicus
ctggctcttggacccagtggaagaa

SEQ ID NO: 274144 - DNA, 25 bp, Rattus norvegicus
ctggctcttggactgtcaggtgaca

SEQ ID NO: 274145 - DNA, 25 bp, Rattus norvegicus
ctggctcttggagccagtggaagaa

SEQ ID NO: 274146 - DNA, 25 bp, Rattus norvegicus
ctggctcttggagtgtcaggtgaca

SEQ ID NO: 274147 - DNA, 25 bp, Rattus norvegicus
ctggctcttggtctgctaacgtttg

SEQ ID NO: 274148 - DNA, 25 bp, Rattus norvegicus
ctggctcttggtgtgctaacgtttg

SEQ ID NO: 274149 - DNA, 25 bp, Rattus norvegicus
ctggctgaacccctaaataagacat

SEQ ID NO: 274150 - DNA, 25 bp, Rattus norvegicus
ctggctgaacccgtaaataagacat

SEQ ID NO: 274151 - DNA, 25 bp, Rattus norvegicus
ctggctgaccttcaatctgcattga

SEQ ID NO: 274152 - DNA, 25 bp, Rattus norvegicus
ctggctgaccttgaatctgcattga

SEQ ID NO: 274153 - DNA, 25 bp, Rattus norvegicus
ctggctgacgccagcgatatgacaa

SEQ ID NO: 274154 - DNA, 25 bp, Rattus norvegicus
ctggctgacgcctgcgatatgacaa

SEQ ID NO: 274155 - DNA, 25 bp, Rattus norvegicus
ctggctgactggacttcgctgaaac

SEQ ID NO: 274156 - DNA, 25 bp, Rattus norvegicus
ctggctgactggtcttcgctgaaac

SEQ ID NO: 274157 - DNA, 25 bp, Rattus norvegicus
ctggctgagccaacattgcactgtg

SEQ ID NO: 274158 - DNA, 25 bp, Rattus norvegicus
ctggctgagccatcattgcactgtg

SEQ ID NO: 274159 - DNA, 25 bp, Rattus norvegicus
ctggctgatctaatacttgctgggt

SEQ ID NO: 274160 - DNA, 25 bp, Rattus norvegicus
ctggctgatctattacttgctgggt

SEQ ID NO: 274161 - DNA, 25 bp, Rattus norvegicus
ctggctgatggaatggtacgtgcac

SEQ ID NO: 274162 - DNA, 25 bp, Rattus norvegicus
ctggctgatggattggtacgtgcac

SEQ ID NO: 274163 - DNA, 25 bp, Rattus norvegicus
ctggctgcaagccatgttcatggtc

SEQ ID NO: 274164 - DNA, 25 bp, Rattus norvegicus
ctggctgcaagcgatgttcatggtc

SEQ ID NO: 274165 - DNA, 25 bp, Rattus norvegicus
ctggctgcagagatcaaaagggaca

SEQ ID NO: 274166 - DNA, 25 bp, Rattus norvegicus
ctggctgcagagttcaaaagggaca

SEQ ID NO: 274167 - DNA, 25 bp, Rattus norvegicus
ctggctgcagctagggtctaggatt

SEQ ID NO: 274168 - DNA, 25 bp, Rattus norvegicus
ctggctgcagcttgggtctaggatt

SEQ ID NO: 274169 - DNA, 25 bp, Rattus norvegicus
ctggctgccaaaattatacctgttt

SEQ ID NO: 274170 - DNA, 25 bp, Rattus norvegicus
ctggctgccaaatttatacctgttt

SEQ ID NO: 274171 - DNA, 25 bp, Rattus norvegicus
ctggctgccccaagatagagttatt

SEQ ID NO: 274172 - DNA, 25 bp, Rattus norvegicus
ctggctgccccatgatagagttatt

SEQ ID NO: 274173 - DNA, 25 bp, Rattus norvegicus
ctggctgccctacttaggaaacaca

SEQ ID NO: 274174 - DNA, 25 bp, Rattus norvegicus
ctggctgccctagttaggaaacaca

SEQ ID NO: 274175 - DNA, 25 bp, Rattus norvegicus
ctggctgcctacagtacgctgggaa

SEQ ID NO: 274176 - DNA, 25 bp, Rattus norvegicus
ctggctgcctactgtacgctgggaa

SEQ ID NO: 274177 - DNA, 25 bp, Rattus norvegicus
ctggctgcctggaagttactgtata

SEQ ID NO: 274178 - DNA, 25 bp, Rattus norvegicus
ctggctgcctggtagttactgtata

SEQ ID NO: 274179 - DNA, 25 bp, Rattus norvegicus
ctggctgccttcaaacttgcagtta

SEQ ID NO: 274180 - DNA, 25 bp, Rattus norvegicus
ctggctgccttcatttcaggagggt

SEQ ID NO: 274181 - DNA, 25 bp, Rattus norvegicus
ctggctgccttctaacttgcagtta

SEQ ID NO: 274182 - DNA, 25 bp, Rattus norvegicus
ctggctgccttcttttcaggagggt

SEQ ID NO: 274183 - DNA, 25 bp, Rattus norvegicus
ctggctgctgacacctacaaagagt

SEQ ID NO: 274184 - DNA, 25 bp, Rattus norvegicus
ctggctgctgactcctacaaagagt

SEQ ID NO: 274185 - DNA, 25 bp, Rattus norvegicus
ctggctgctgatctaggaacgctgc

SEQ ID NO: 274186 - DNA, 25 bp, Rattus norvegicus
ctggctgctgatgtaggaacgctgc

SEQ ID NO: 274187 - DNA, 25 bp, Rattus norvegicus
ctggctgctgctcgattaagaacta

SEQ ID NO: 274188 - DNA, 25 bp, Rattus norvegicus
ctggctgctgctggattaagaacta

SEQ ID NO: 274189 - DNA, 25 bp, Rattus norvegicus
ctggctgctgggaaaaggtctcaca

SEQ ID NO: 274190 - DNA, 25 bp, Rattus norvegicus
ctggctgctgggtaaaggtctcaca

SEQ ID NO: 274191 - DNA, 25 bp, Rattus norvegicus
ctggctgctgtcaactcaggcatcc

SEQ ID NO: 274192 - DNA, 25 bp, Rattus norvegicus
ctggctgctgtctactcaggcatcc

SEQ ID NO: 274193 - DNA, 25 bp, Rattus norvegicus
ctggctgctgttcggtggctctcca

SEQ ID NO: 274194 - DNA, 25 bp, Rattus norvegicus
ctggctgctgttgggtggctctcca

SEQ ID NO: 274195 - DNA, 25 bp, Rattus norvegicus
ctggctggaatgacacacctttaat

SEQ ID NO: 274196 - DNA, 25 bp, Rattus norvegicus
ctggctggaatgtcacacctttaat

SEQ ID NO: 274197 - DNA, 25 bp, Rattus norvegicus
ctggctggagccaagtagactgtat

SEQ ID NO: 274198 - DNA, 25 bp, Rattus norvegicus
ctggctggagcctagtagactgtat

SEQ ID NO: 274199 - DNA, 25 bp, Rattus norvegicus
ctggctggagtaatggctcaccaaa

SEQ ID NO: 274200 - DNA, 25 bp, Rattus norvegicus
ctggctggagtattggctcaccaaa

SEQ ID NO: 274201 - DNA, 25 bp, Rattus norvegicus
ctggctggctgtcgaatgaaatgac

SEQ ID NO: 274202 - DNA, 25 bp, Rattus norvegicus
ctggctggctgtggaatgaaatgac

SEQ ID NO: 274203 - DNA, 25 bp, Rattus norvegicus
ctggctggcttcagacacaaactag

SEQ ID NO: 274204 - DNA, 25 bp, Rattus norvegicus
ctggctggcttctgacacaaactag

SEQ ID NO: 274205 - DNA, 25 bp, Rattus norvegicus
ctggctgggtatcggactctttgtc

SEQ ID NO: 274206 - DNA, 25 bp, Rattus norvegicus
ctggctgggtatgggactctttgtc

SEQ ID NO: 274207 - DNA, 25 bp, Rattus norvegicus
ctggctgggtgcaagcttttttcaa

SEQ ID NO: 274208 - DNA, 25 bp, Rattus norvegicus
ctggctgggtgctagcttttttcaa

SEQ ID NO: 274209 - DNA, 25 bp, Rattus norvegicus
ctggctggtatacgtaggtttcctt

SEQ ID NO: 274210 - DNA, 25 bp, Rattus norvegicus
ctggctggtataggtaggtttcctt

SEQ ID NO: 274211 - DNA, 25 bp, Rattus norvegicus
ctggctggtgaaatggagaactctt

SEQ ID NO: 274212 - DNA, 25 bp, Rattus norvegicus
ctggctggtgaattggagaactctt

SEQ ID NO: 274213 - DNA, 25 bp, Rattus norvegicus
ctggctggttccctctgaatataag

SEQ ID NO: 274214 - DNA, 25 bp, Rattus norvegicus
ctggctggttccgtctgaatataag

SEQ ID NO: 274215 - DNA, 25 bp, Rattus norvegicus
ctggctgtacatcactgaagctgag

SEQ ID NO: 274216 - DNA, 25 bp, Rattus norvegicus
ctggctgtacatgactgaagctgag

SEQ ID NO: 274217 - DNA, 25 bp, Rattus norvegicus
ctggctgtactgctttctcctttta

SEQ ID NO: 274218 - DNA, 25 bp, Rattus norvegicus
ctggctgtactggtttctcctttta

SEQ ID NO: 274219 - DNA, 25 bp, Rattus norvegicus
ctggctgtagtcagccttgacagct

SEQ ID NO: 274220 - DNA, 25 bp, Rattus norvegicus
ctggctgtagtctgccttgacagct

SEQ ID NO: 274221 - DNA, 25 bp, Rattus norvegicus
ctggctgtcatgcaactcaagagat

SEQ ID NO: 274222 - DNA, 25 bp, Rattus norvegicus
ctggctgtcatggaactcaagagat

SEQ ID NO: 274223 - DNA, 25 bp, Rattus norvegicus
ctggctgtcccaagagctatcaaag

SEQ ID NO: 274224 - DNA, 25 bp, Rattus norvegicus
ctggctgtcccaattaaagatccta

SEQ ID NO: 274225 - DNA, 25 bp, Rattus norvegicus
ctggctgtcccatgagctatcaaag

SEQ ID NO: 274226 - DNA, 25 bp, Rattus norvegicus
ctggctgtcccatttaaagatccta

SEQ ID NO: 274227 - DNA, 25 bp, Rattus norvegicus
ctggctgtcctaatttctcaaatgc

SEQ ID NO: 274228 - DNA, 25 bp, Rattus norvegicus
ctggctgtcctattttctcaaatgc

SEQ ID NO: 274229 - DNA, 25 bp, Rattus norvegicus
ctggctgtcttcagagatcgaggaa

SEQ ID NO: 274230 - DNA, 25 bp, Rattus norvegicus
ctggctgtcttctgagatcgaggaa

SEQ ID NO: 274231 - DNA, 25 bp, Rattus norvegicus
ctggctgtctttacttctgagttaa

SEQ ID NO: 274232 - DNA, 25 bp, Rattus norvegicus
ctggctgtctttatctctgatgggt

SEQ ID NO: 274233 - DNA, 25 bp, Rattus norvegicus
ctggctgtcttttcttctgagttaa

SEQ ID NO: 274234 - DNA, 25 bp, Rattus norvegicus
ctggctgtctttttctctgatgggt

SEQ ID NO: 274235 - DNA, 25 bp, Rattus norvegicus
ctggctgtgaatccgcttgtctgac

SEQ ID NO: 274236 - DNA, 25 bp, Rattus norvegicus
ctggctgtgaatgcgcttgtctgac

SEQ ID NO: 274237 - DNA, 25 bp, Rattus norvegicus
ctggctgtgcgaataaagctacaat

SEQ ID NO: 274238 - DNA, 25 bp, Rattus norvegicus
ctggctgtgcgattaaagctacaat

SEQ ID NO: 274239 - DNA, 25 bp, Rattus norvegicus
ctggctgtgctcactcacatatcta

SEQ ID NO: 274240 - DNA, 25 bp, Rattus norvegicus
ctggctgtgctctctcacatatcta

SEQ ID NO: 274241 - DNA, 25 bp, Rattus norvegicus
ctggctgtggctagggaaacccgct

SEQ ID NO: 274242 - DNA, 25 bp, Rattus norvegicus
ctggctgtggcttgggaaacccgct

SEQ ID NO: 274243 - DNA, 25 bp, Rattus norvegicus
ctggctgttcacattttcatgtttt

SEQ ID NO: 274244 - DNA, 25 bp, Rattus norvegicus
ctggctgttcactttttcatgtttt

SEQ ID NO: 274245 - DNA, 25 bp, Rattus norvegicus
ctggctgtttgtccagtggtgtcta

SEQ ID NO: 274246 - DNA, 25 bp, Rattus norvegicus
ctggctgtttgtgcagtggtgtcta

SEQ ID NO: 274247 - DNA, 25 bp, Rattus norvegicus
ctggcttaccttcagcggatagttg

SEQ ID NO: 274248 - DNA, 25 bp, Rattus norvegicus
ctggcttaccttgagcggatagttg

SEQ ID NO: 274249 - DNA, 25 bp, Rattus norvegicus
ctggcttcacggcagtttcatattg

SEQ ID NO: 274250 - DNA, 25 bp, Rattus norvegicus
ctggcttcacgggagtttcatattg

SEQ ID NO: 274251 - DNA, 25 bp, Rattus norvegicus
ctggcttcagtgctaaggactggac

SEQ ID NO: 274252 - DNA, 25 bp, Rattus norvegicus
ctggcttcagtggtaaggactggac

SEQ ID NO: 274253 - DNA, 25 bp, Rattus norvegicus
ctggcttcataccacactttttgtg

SEQ ID NO: 274254 - DNA, 25 bp, Rattus norvegicus
ctggcttcatacgacactttttgtg

SEQ ID NO: 274255 - DNA, 25 bp, Rattus norvegicus
ctggcttccagtctgtaacttttgt

SEQ ID NO: 274256 - DNA, 25 bp, Rattus norvegicus
ctggcttccagtgtgtaacttttgt

SEQ ID NO: 274257 - DNA, 25 bp, Rattus norvegicus
ctggcttccgtgctacatcaaatag

SEQ ID NO: 274258 - DNA, 25 bp, Rattus norvegicus
ctggcttccgtggtacatcaaatag

SEQ ID NO: 274259 - DNA, 25 bp, Rattus norvegicus
ctggcttcctctagactgattagaa

SEQ ID NO: 274260 - DNA, 25 bp, Rattus norvegicus
ctggcttcctcttgactgattagaa

SEQ ID NO: 274261 - DNA, 25 bp, Rattus norvegicus
ctggcttctaacatactgtttcctt

SEQ ID NO: 274262 - DNA, 25 bp, Rattus norvegicus
ctggcttctaacttactgtttcctt

SEQ ID NO: 274263 - DNA, 25 bp, Rattus norvegicus
ctggcttctgatactttgttcatat

SEQ ID NO: 274264 - DNA, 25 bp, Rattus norvegicus
ctggcttctgattctttgttcatat

SEQ ID NO: 274265 - DNA, 25 bp, Rattus norvegicus
ctggcttctgcacgtgctatttgta

SEQ ID NO: 274266 - DNA, 25 bp, Rattus norvegicus
ctggcttctgcaggtgctatttgta

SEQ ID NO: 274267 - DNA, 25 bp, Rattus norvegicus
ctggcttctgcccttttatgtgtgt

SEQ ID NO: 274268 - DNA, 25 bp, Rattus norvegicus
ctggcttctgccgttttatgtgtgt

SEQ ID NO: 274269 - DNA, 25 bp, Rattus norvegicus
ctggcttctgtgagtatggatgctc

SEQ ID NO: 274270 - DNA, 25 bp, Rattus norvegicus
ctggcttctgtgattctgctacaaa

SEQ ID NO: 274271 - DNA, 25 bp, Rattus norvegicus
ctggcttctgtgtgtatggatgctc

SEQ ID NO: 274272 - DNA, 25 bp, Rattus norvegicus
ctggcttctgtgtttctgctacaaa

SEQ ID NO: 274273 - DNA, 25 bp, Rattus norvegicus
ctggcttctgttcactaatctgttg

SEQ ID NO: 274274 - DNA, 25 bp, Rattus norvegicus
ctggcttctgttgactaatctgttg

SEQ ID NO: 274275 - DNA, 25 bp, Rattus norvegicus
ctggcttcttctctatcttgatgtt

SEQ ID NO: 274276 - DNA, 25 bp, Rattus norvegicus
ctggcttcttctgtatcttgatgtt

SEQ ID NO: 274277 - DNA, 25 bp, Rattus norvegicus
ctggcttctttgcttggtatttgaa

SEQ ID NO: 274278 - DNA, 25 bp, Rattus norvegicus
ctggcttctttggttggtatttgaa

SEQ ID NO: 274279 - DNA, 25 bp, Rattus norvegicus
ctggcttgcagcactgaacagtgca

SEQ ID NO: 274280 - DNA, 25 bp, Rattus norvegicus
ctggcttgcagctctgaacagtgca

SEQ ID NO: 274281 - DNA, 25 bp, Rattus norvegicus
ctggcttgccatattttactgactt

SEQ ID NO: 274282 - DNA, 25 bp, Rattus norvegicus
ctggcttgccattttttactgactt

SEQ ID NO: 274283 - DNA, 25 bp, Rattus norvegicus
ctggcttgcctgctaaggccaagga

SEQ ID NO: 274284 - DNA, 25 bp, Rattus norvegicus
ctggcttgcctggtaaggccaagga

SEQ ID NO: 274285 - DNA, 25 bp, Rattus norvegicus
ctggcttggagcatctgtgtaaaat

SEQ ID NO: 274286 - DNA, 25 bp, Rattus norvegicus
ctggcttggagcttctgtgtaaaat

SEQ ID NO: 274287 - DNA, 25 bp, Rattus norvegicus
ctggcttggtgacgtcccttgctca

SEQ ID NO: 274288 - DNA, 25 bp, Rattus norvegicus
ctggcttggtgaggtcccttgctca

SEQ ID NO: 274289 - DNA, 25 bp, Rattus norvegicus
ctggcttgtcaacagcttccaaagg

SEQ ID NO: 274290 - DNA, 25 bp, Rattus norvegicus
ctggcttgtcaagagcttccaaagg

SEQ ID NO: 274291 - DNA, 25 bp, Rattus norvegicus
ctggctttaaatcacattgcacccc

SEQ ID NO: 274292 - DNA, 25 bp, Rattus norvegicus
ctggctttaaatgacattgcacccc

SEQ ID NO: 274293 - DNA, 25 bp, Rattus norvegicus
ctggctttccagcattcttgttagg

SEQ ID NO: 274294 - DNA, 25 bp, Rattus norvegicus
ctggctttccaggattcttgttagg

SEQ ID NO: 274295 - DNA, 25 bp, Rattus norvegicus
ctggctttccccagaaggtagaggt

SEQ ID NO: 274296 - DNA, 25 bp, Rattus norvegicus
ctggctttcccctgaaggtagaggt

SEQ ID NO: 274297 - DNA, 25 bp, Rattus norvegicus
ctggctttctatcaccgatgcttaa

SEQ ID NO: 274298 - DNA, 25 bp, Rattus norvegicus
ctggctttctatgaccgatgcttaa

SEQ ID NO: 274299 - DNA, 25 bp, Rattus norvegicus
ctggctttctcaagtgcgtccttag

SEQ ID NO: 274300 - DNA, 25 bp, Rattus norvegicus
ctggctttctcatgtgcgtccttag

SEQ ID NO: 274301 - DNA, 25 bp, Rattus norvegicus
ctggctttctccagtcatctatcca

SEQ ID NO: 274302 - DNA, 25 bp, Rattus norvegicus
ctggctttctcctgtcatctatcca

SEQ ID NO: 274303 - DNA, 25 bp, Rattus norvegicus
ctggctttcttaattcaatgtgtga

SEQ ID NO: 274304 - DNA, 25 bp, Rattus norvegicus
ctggctttcttatttcaatgtgtga

SEQ ID NO: 274305 - DNA, 25 bp, Rattus norvegicus
ctggctttcttgcacttctaactag

SEQ ID NO: 274306 - DNA, 25 bp, Rattus norvegicus
ctggctttcttggacttctaactag

SEQ ID NO: 274307 - DNA, 25 bp, Rattus norvegicus
ctggctttgaagacagttacccaag

SEQ ID NO: 274308 - DNA, 25 bp, Rattus norvegicus
ctggctttgaagtcagttacccaag

SEQ ID NO: 274309 - DNA, 25 bp, Rattus norvegicus
ctggctttgctaatgacttgggatg

SEQ ID NO: 274310 - DNA, 25 bp, Rattus norvegicus
ctggctttgctattgacttgggatg

SEQ ID NO: 274311 - DNA, 25 bp, Rattus norvegicus
ctggctttgctcatcaacatgaggg

SEQ ID NO: 274312 - DNA, 25 bp, Rattus norvegicus
ctggctttgctcttcaacatgaggg

SEQ ID NO: 274313 - DNA, 25 bp, Rattus norvegicus
ctggctttgctgcttgagagtatca

SEQ ID NO: 274314 - DNA, 25 bp, Rattus norvegicus
ctggctttgctggttgagagtatca

SEQ ID NO: 274315 - DNA, 25 bp, Rattus norvegicus
ctggctttgcttcagtcaactctat

SEQ ID NO: 274316 - DNA, 25 bp, Rattus norvegicus
ctggctttgcttgagtcaactctat

SEQ ID NO: 274317 - DNA, 25 bp, Rattus norvegicus
ctggctttgggcatatgcagtgcta

SEQ ID NO: 274318 - DNA, 25 bp, Rattus norvegicus
ctggctttgggcttatgcagtgcta

SEQ ID NO: 274319 - DNA, 25 bp, Rattus norvegicus
ctggctttgggtatccaagtgctta

SEQ ID NO: 274320 - DNA, 25 bp, Rattus norvegicus
ctggctttgggtttccaagtgctta

SEQ ID NO: 274321 - DNA, 25 bp, Rattus norvegicus
ctggcttttggcatgtctccttact

SEQ ID NO: 274322 - DNA, 25 bp, Rattus norvegicus
ctggcttttggcttgtctccttact

SEQ ID NO: 274323 - DNA, 25 bp, Rattus norvegicus
ctgggaaaattcagtcactgtctca

SEQ ID NO: 274324 - DNA, 25 bp, Rattus norvegicus
ctgggaaaattctgtcactgtctca

SEQ ID NO: 274325 - DNA, 25 bp, Rattus norvegicus
ctgggaaacagaaacctgtgcaaga

SEQ ID NO: 274326 - DNA, 25 bp, Rattus norvegicus
ctgggaaacagatacctgtgcaaga

SEQ ID NO: 274327 - DNA, 25 bp, Rattus norvegicus
ctgggaaagagccacttacttacta

SEQ ID NO: 274328 - DNA, 25 bp, Rattus norvegicus
ctgggaaagagcgacttacttacta

SEQ ID NO: 274329 - DNA, 25 bp, Rattus norvegicus
ctgggaaaggctcccatttgaggcc

SEQ ID NO: 274330 - DNA, 25 bp, Rattus norvegicus
ctgggaaaggctgccatttgaggcc

SEQ ID NO: 274331 - DNA, 25 bp, Rattus norvegicus
ctgggaacaacactctagggacctt

SEQ ID NO: 274332 - DNA, 25 bp, Rattus norvegicus
ctgggaacaacagtctagggacctt

SEQ ID NO: 274333 - DNA, 25 bp, Rattus norvegicus
ctgggaaccagtctggccaaatcct

SEQ ID NO: 274334 - DNA, 25 bp, Rattus norvegicus
ctgggaaccagtgtggccaaatcct

SEQ ID NO: 274335 - DNA, 25 bp, Rattus norvegicus
ctgggaacttggacattggcatctt

SEQ ID NO: 274336 - DNA, 25 bp, Rattus norvegicus
ctgggaacttggtcattggcatctt

SEQ ID NO: 274337 - DNA, 25 bp, Rattus norvegicus
ctgggaagaaccacaggcggtcgct

SEQ ID NO: 274338 - DNA, 25 bp, Rattus norvegicus
ctgggaagaacctcaggcggtcgct

SEQ ID NO: 274339 - DNA, 25 bp, Rattus norvegicus
ctgggaagcgatctgctcagcacac

SEQ ID NO: 274340 - DNA, 25 bp, Rattus norvegicus
ctgggaagcgatgtgctcagcacac

SEQ ID NO: 274341 - DNA, 25 bp, Rattus norvegicus
ctgggaaggctcctcattgtatatc

SEQ ID NO: 274342 - DNA, 25 bp, Rattus norvegicus
ctgggaaggctcgtcattgtatatc

SEQ ID NO: 274343 - DNA, 25 bp, Rattus norvegicus
ctgggaaggttcagctactgttact

SEQ ID NO: 274344 - DNA, 25 bp, Rattus norvegicus
ctgggaaggttctgctactgttact

SEQ ID NO: 274345 - DNA, 25 bp, Rattus norvegicus
ctgggaatcagtacctcttgtcaaa

SEQ ID NO: 274346 - DNA, 25 bp, Rattus norvegicus
ctgggaatcagttcctcttgtcaaa

SEQ ID NO: 274347 - DNA, 25 bp, Rattus norvegicus
ctgggaatgcccaaaaccatcttac

SEQ ID NO: 274348 - DNA, 25 bp, Rattus norvegicus
ctgggaatgccctaaaccatcttac

SEQ ID NO: 274349 - DNA, 25 bp, Rattus norvegicus
ctgggaatgtggaagcctgccatgt

SEQ ID NO: 274350 - DNA, 25 bp, Rattus norvegicus
ctgggaatgtggtagcctgccatgt

SEQ ID NO: 274351 - DNA, 25 bp, Rattus norvegicus
ctgggaattccaaccatctaatcgg

SEQ ID NO: 274352 - DNA, 25 bp, Rattus norvegicus
ctgggaattccatccatctaatcgg

SEQ ID NO: 274353 - DNA, 25 bp, Rattus norvegicus
ctgggaattcttagagtagctttgc

SEQ ID NO: 274354 - DNA, 25 bp, Rattus norvegicus
ctgggaattctttgagtagctttgc

SEQ ID NO: 274355 - DNA, 25 bp, Rattus norvegicus
ctgggacaccaccatccttggctca

SEQ ID NO: 274356 - DNA, 25 bp, Rattus norvegicus
ctgggacaccacgatccttggctca

SEQ ID NO: 274357 - DNA, 25 bp, Rattus norvegicus
ctgggaccaaggagtcatgggacat

SEQ ID NO: 274358 - DNA, 25 bp, Rattus norvegicus
ctgggaccaaggtgtcatgggacat

SEQ ID NO: 274359 - DNA, 25 bp, Rattus norvegicus
ctgggaccagagcagtgctgtttct

SEQ ID NO: 274360 - DNA, 25 bp, Rattus norvegicus
ctgggaccagaggagtgctgtttct

SEQ ID NO: 274361 - DNA, 25 bp, Rattus norvegicus
ctgggaccagcgaaggcagaccgaa

SEQ ID NO: 274362 - DNA, 25 bp, Rattus norvegicus
ctgggaccagcgtaggcagaccgaa

SEQ ID NO: 274363 - DNA, 25 bp, Rattus norvegicus
ctgggaccaggcaccccgtgggcaa

SEQ ID NO: 274364 - DNA, 25 bp, Rattus norvegicus
ctgggaccaggctccccgtgggcaa

SEQ ID NO: 274365 - DNA, 25 bp, Rattus norvegicus
ctgggaccaggtagacttctgtcta

SEQ ID NO: 274366 - DNA, 25 bp, Rattus norvegicus
ctgggaccaggttgacttctgtcta

SEQ ID NO: 274367 - DNA, 25 bp, Rattus norvegicus
ctgggaccctgtatttactgactat

SEQ ID NO: 274368 - DNA, 25 bp, Rattus norvegicus
ctgggaccctgtttttactgactat

SEQ ID NO: 274369 - DNA, 25 bp, Rattus norvegicus
ctgggacctagccagcatcccggag

SEQ ID NO: 274370 - DNA, 25 bp, Rattus norvegicus
ctgggacctagcgagcatcccggag

SEQ ID NO: 274371 - DNA, 25 bp, Rattus norvegicus
ctgggacgtcccaggaatcttctag

SEQ ID NO: 274372 - DNA, 25 bp, Rattus norvegicus
ctgggacgtccctggaatcttctag

SEQ ID NO: 274373 - DNA, 25 bp, Rattus norvegicus
ctgggacgttgactgcgatacctgc

SEQ ID NO: 274374 - DNA, 25 bp, Rattus norvegicus
ctgggacgttgagtgcgatacctgc

SEQ ID NO: 274375 - DNA, 25 bp, Rattus norvegicus
ctgggactatgacgtcgaccaagtt

SEQ ID NO: 274376 - DNA, 25 bp, Rattus norvegicus
ctgggactatgaggtcgaccaagtt

SEQ ID NO: 274377 - DNA, 25 bp, Rattus norvegicus
ctgggactccaacttcagtgctata

SEQ ID NO: 274378 - DNA, 25 bp, Rattus norvegicus
ctgggactccaagttcagtgctata

SEQ ID NO: 274379 - DNA, 25 bp, Rattus norvegicus
ctgggactgctgcaaattaacttga

SEQ ID NO: 274380 - DNA, 25 bp, Rattus norvegicus
ctgggactgctggaaattaacttga

SEQ ID NO: 274381 - DNA, 25 bp, Rattus norvegicus
ctgggacttgttatctgtgttttca

SEQ ID NO: 274382 - DNA, 25 bp, Rattus norvegicus
ctgggacttgttttctgtgttttca

SEQ ID NO: 274383 - DNA, 25 bp, Rattus norvegicus
ctgggactttacaggtacagcgctt

SEQ ID NO: 274384 - DNA, 25 bp, Rattus norvegicus
ctgggactttactggtacagcgctt

SEQ ID NO: 274385 - DNA, 25 bp, Rattus norvegicus
ctgggagaaagcagcctgtcgctaa

SEQ ID NO: 274386 - DNA, 25 bp, Rattus norvegicus
ctgggagaaagctgcctgtcgctaa

SEQ ID NO: 274387 - DNA, 25 bp, Rattus norvegicus
ctgggagaaatcctcagcctcagct

SEQ ID NO: 274388 - DNA, 25 bp, Rattus norvegicus
ctgggagaaatcgtcagcctcagct

SEQ ID NO: 274389 - DNA, 25 bp, Rattus norvegicus
ctgggagacagaacgtgactccatc

SEQ ID NO: 274390 - DNA, 25 bp, Rattus norvegicus
ctgggagacagatcgtgactccatc

SEQ ID NO: 274391 - DNA, 25 bp, Rattus norvegicus
ctgggagaccatcgcctatcctagg

SEQ ID NO: 274392 - DNA, 25 bp, Rattus norvegicus
ctgggagaccatggcctatcctagg

SEQ ID NO: 274393 - DNA, 25 bp, Rattus norvegicus
ctgggagacctgcttttttcagaaa

SEQ ID NO: 274394 - DNA, 25 bp, Rattus norvegicus
ctgggagacctggttttttcagaaa

SEQ ID NO: 274395 - DNA, 25 bp, Rattus norvegicus
ctgggagactctcgcctggatgact

SEQ ID NO: 274396 - DNA, 25 bp, Rattus norvegicus
ctgggagactctggcctggatgact

SEQ ID NO: 274397 - DNA, 25 bp, Rattus norvegicus
ctgggagagatgagacttgctattc

SEQ ID NO: 274398 - DNA, 25 bp, Rattus norvegicus
ctgggagagatgtgacttgctattc

SEQ ID NO: 274399 - DNA, 25 bp, Rattus norvegicus
ctgggagatacaacctgcaacgttt

SEQ ID NO: 274400 - DNA, 25 bp, Rattus norvegicus
ctgggagatacatcctgcaacgttt

SEQ ID NO: 274401 - DNA, 25 bp, Rattus norvegicus
ctgggagatggcctatactgaaaat

SEQ ID NO: 274402 - DNA, 25 bp, Rattus norvegicus
ctgggagatggcgtatactgaaaat

SEQ ID NO: 274403 - DNA, 25 bp, Rattus norvegicus
ctgggagccaagactcttgctgatt

SEQ ID NO: 274404 - DNA, 25 bp, Rattus norvegicus
ctgggagccaagtctcttgctgatt

SEQ ID NO: 274405 - DNA, 25 bp, Rattus norvegicus
ctgggagccagaacaaatcattctt

SEQ ID NO: 274406 - DNA, 25 bp, Rattus norvegicus
ctgggagccagatcaaatcattctt

SEQ ID NO: 274407 - DNA, 25 bp, Rattus norvegicus
ctgggagccatacgtacatctttac

SEQ ID NO: 274408 - DNA, 25 bp, Rattus norvegicus
ctgggagccataggtacatctttac

SEQ ID NO: 274409 - DNA, 25 bp, Rattus norvegicus
ctgggagcctgtactgcatgtggaa

SEQ ID NO: 274410 - DNA, 25 bp, Rattus norvegicus
ctgggagcctgtcttctgactgaag

SEQ ID NO: 274411 - DNA, 25 bp, Rattus norvegicus
ctgggagcctgtgttctgactgaag

SEQ ID NO: 274412 - DNA, 25 bp, Rattus norvegicus
ctgggagcctgttctgcatgtggaa

SEQ ID NO: 274413 - DNA, 25 bp, Rattus norvegicus
ctgggagctctacgcactgggctac

SEQ ID NO: 274414 - DNA, 25 bp, Rattus norvegicus
ctgggagctctaggcactgggctac

SEQ ID NO: 274415 - DNA, 25 bp, Rattus norvegicus
ctgggagcttaaatacctggtgtca

SEQ ID NO: 274416 - DNA, 25 bp, Rattus norvegicus
ctgggagcttaattacctggtgtca

SEQ ID NO: 274417 - DNA, 25 bp, Rattus norvegicus
ctgggagggccgaccttgtctgtca

SEQ ID NO: 274418 - DNA, 25 bp, Rattus norvegicus
ctgggagggccgtccttgtctgtca

SEQ ID NO: 274419 - DNA, 25 bp, Rattus norvegicus
ctgggaggtgccactgagttctgct

SEQ ID NO: 274420 - DNA, 25 bp, Rattus norvegicus
ctgggaggtgcctctgagttctgct

SEQ ID NO: 274421 - DNA, 25 bp, Rattus norvegicus
ctgggagtaaatccctgtgccacca

SEQ ID NO: 274422 - DNA, 25 bp, Rattus norvegicus
ctgggagtaaatgcctgtgccacca

SEQ ID NO: 274423 - DNA, 25 bp, Rattus norvegicus
ctgggagtaaggaggctgctgctgc

SEQ ID NO: 274424 - DNA, 25 bp, Rattus norvegicus
ctgggagtaaggtggctgctgctgc

SEQ ID NO: 274425 - DNA, 25 bp, Rattus norvegicus
ctgggagtacacatcatctgcgggt

SEQ ID NO: 274426 - DNA, 25 bp, Rattus norvegicus
ctgggagtacacttcatctgcgggt

SEQ ID NO: 274427 - DNA, 25 bp, Rattus norvegicus
ctgggagtcactcgacattttcctc

SEQ ID NO: 274428 - DNA, 25 bp, Rattus norvegicus
ctgggagtcactggacattttcctc

SEQ ID NO: 274429 - DNA, 25 bp, Rattus norvegicus
ctgggagtccacaagtgctgcatat

SEQ ID NO: 274430 - DNA, 25 bp, Rattus norvegicus
ctgggagtccactagtgctgcatat

SEQ ID NO: 274431 - DNA, 25 bp, Rattus norvegicus
ctgggagtgctcatgtcagcagact

SEQ ID NO: 274432 - DNA, 25 bp, Rattus norvegicus
ctgggagtgctcttgtcagcagact

SEQ ID NO: 274433 - DNA, 25 bp, Rattus norvegicus
ctgggagttctacggcctcaaggaa

SEQ ID NO: 274434 - DNA, 25 bp, Rattus norvegicus
ctgggagttctagggcctcaaggaa

SEQ ID NO: 274435 - DNA, 25 bp, Rattus norvegicus
ctgggagtttccattgtattcagaa

SEQ ID NO: 274436 - DNA, 25 bp, Rattus norvegicus
ctgggagtttcctttgtattcagaa

SEQ ID NO: 274437 - DNA, 25 bp, Rattus norvegicus
ctgggatacaagatggacgacctgc

SEQ ID NO: 274438 - DNA, 25 bp, Rattus norvegicus
ctgggatacaagttggacgacctgc

SEQ ID NO: 274439 - DNA, 25 bp, Rattus norvegicus
ctgggatacggcagtggccatgtta

SEQ ID NO: 274440 - DNA, 25 bp, Rattus norvegicus
ctgggatacggctgtggccatgtta

SEQ ID NO: 274441 - DNA, 25 bp, Rattus norvegicus
ctgggatactggatagagatattag

SEQ ID NO: 274442 - DNA, 25 bp, Rattus norvegicus
ctgggatactggttagagatattag

SEQ ID NO: 274443 - DNA, 25 bp, Rattus norvegicus
ctgggatagccacaggtgttataca

SEQ ID NO: 274444 - DNA, 25 bp, Rattus norvegicus
ctgggatagccagaggtgttataca

SEQ ID NO: 274445 - DNA, 25 bp, Rattus norvegicus
ctgggatcaaacaggcctgcaaaat

SEQ ID NO: 274446 - DNA, 25 bp, Rattus norvegicus
ctgggatcaaactggcctgcaaaat

SEQ ID NO: 274447 - DNA, 25 bp, Rattus norvegicus
ctgggatcatgaaaaaccgttgaaa

SEQ ID NO: 274448 - DNA, 25 bp, Rattus norvegicus
ctgggatcatgataaaccgttgaaa

SEQ ID NO: 274449 - DNA, 25 bp, Rattus norvegicus
ctgggatccaaactcagggcctcat

SEQ ID NO: 274450 - DNA, 25 bp, Rattus norvegicus
ctgggatccaaagtcagggcctcat

SEQ ID NO: 274451 - DNA, 25 bp, Rattus norvegicus
ctgggatccagccattgcttcaatt

SEQ ID NO: 274452 - DNA, 25 bp, Rattus norvegicus
ctgggatccagcgattgcttcaatt

SEQ ID NO: 274453 - DNA, 25 bp, Rattus norvegicus
ctgggatccctaatggtccatcata

SEQ ID NO: 274454 - DNA, 25 bp, Rattus norvegicus
ctgggatccctattggtccatcata

SEQ ID NO: 274455 - DNA, 25 bp, Rattus norvegicus
ctgggatctgcccagctggagttta

SEQ ID NO: 274456 - DNA, 25 bp, Rattus norvegicus
ctgggatctgccgagctggagttta

SEQ ID NO: 274457 - DNA, 25 bp, Rattus norvegicus
ctgggatcttttctcatggtttgat

SEQ ID NO: 274458 - DNA, 25 bp, Rattus norvegicus
ctgggatcttttgtcatggtttgat

SEQ ID NO: 274459 - DNA, 25 bp, Rattus norvegicus
ctgggatgccatctagttgagttaa

SEQ ID NO: 274460 - DNA, 25 bp, Rattus norvegicus
ctgggatgccatgtagttgagttaa

SEQ ID NO: 274461 - DNA, 25 bp, Rattus norvegicus
ctgggatggcagcaaggccttttca

SEQ ID NO: 274462 - DNA, 25 bp, Rattus norvegicus
ctgggatggcaggaaggccttttca

SEQ ID NO: 274463 - DNA, 25 bp, Rattus norvegicus
ctgggatggccaccctatcctgaga

SEQ ID NO: 274464 - DNA, 25 bp, Rattus norvegicus
ctgggatggccagcctatcctgaga

SEQ ID NO: 274465 - DNA, 25 bp, Rattus norvegicus
ctgggatgtccactgcaaaagccga

SEQ ID NO: 274466 - DNA, 25 bp, Rattus norvegicus
ctgggatgtccagtgcaaaagccga

SEQ ID NO: 274467 - DNA, 25 bp, Rattus norvegicus
ctgggattaaggctctgcacctcca

SEQ ID NO: 274468 - DNA, 25 bp, Rattus norvegicus
ctgggattaagggtctgcacctcca

SEQ ID NO: 274469 - DNA, 25 bp, Rattus norvegicus
ctgggattacagcagctttctccac

SEQ ID NO: 274470 - DNA, 25 bp, Rattus norvegicus
ctgggattacaggagctttctccac

SEQ ID NO: 274471 - DNA, 25 bp, Rattus norvegicus
ctgggattacggatgagagctgata

SEQ ID NO: 274472 - DNA, 25 bp, Rattus norvegicus
ctgggattacggttgagagctgata

SEQ ID NO: 274473 - DNA, 25 bp, Rattus norvegicus
ctgggattcaggcattcacggttga

SEQ ID NO: 274474 - DNA, 25 bp, Rattus norvegicus
ctgggattcagggattcacggttga

SEQ ID NO: 274475 - DNA, 25 bp, Rattus norvegicus
ctgggattcagtatcgttcttggag

SEQ ID NO: 274476 - DNA, 25 bp, Rattus norvegicus
ctgggattcagtttcgttcttggag

SEQ ID NO: 274477 - DNA, 25 bp, Rattus norvegicus
ctgggattcccaatgtccatacaat

SEQ ID NO: 274478 - DNA, 25 bp, Rattus norvegicus
ctgggattcccattgtccatacaat

SEQ ID NO: 274479 - DNA, 25 bp, Rattus norvegicus
ctgggattccccagaacatgtggaa

SEQ ID NO: 274480 - DNA, 25 bp, Rattus norvegicus
ctgggattcccctgaacatgtggaa

SEQ ID NO: 274481 - DNA, 25 bp, Rattus norvegicus
ctgggattgtctcactagtctgtag

SEQ ID NO: 274482 - DNA, 25 bp, Rattus norvegicus
ctgggattgtctgactagtctgtag

SEQ ID NO: 274483 - DNA, 25 bp, Rattus norvegicus
ctgggattgtggatccctagggcca

SEQ ID NO: 274484 - DNA, 25 bp, Rattus norvegicus
ctgggattgtggttccctagggcca

SEQ ID NO: 274485 - DNA, 25 bp, Rattus norvegicus
ctgggatttctacgtctttgctcta

SEQ ID NO: 274486 - DNA, 25 bp, Rattus norvegicus
ctgggatttctaggtctttgctcta

SEQ ID NO: 274487 - DNA, 25 bp, Rattus norvegicus
ctgggcaaacagcatgaccgtgtag

SEQ ID NO: 274488 - DNA, 25 bp, Rattus norvegicus
ctgggcaaacaggatgaccgtgtag

SEQ ID NO: 274489 - DNA, 25 bp, Rattus norvegicus
ctgggcaaagccctgacctgagatc

SEQ ID NO: 274490 - DNA, 25 bp, Rattus norvegicus
ctgggcaaagccgtgacctgagatc

SEQ ID NO: 274491 - DNA, 25 bp, Rattus norvegicus
ctgggcaaagtgcacatgcctgtaa

SEQ ID NO: 274492 - DNA, 25 bp, Rattus norvegicus
ctgggcaaagtggacatgcctgtaa

SEQ ID NO: 274493 - DNA, 25 bp, Rattus norvegicus
ctgggcaacggcactctgctcgtgg

SEQ ID NO: 274494 - DNA, 25 bp, Rattus norvegicus
ctgggcaacggctctctgctcgtgg

SEQ ID NO: 274495 - DNA, 25 bp, Rattus norvegicus
ctgggcaagaccagcaggcgaagct

SEQ ID NO: 274496 - DNA, 25 bp, Rattus norvegicus
ctgggcaagacctgcaggcgaagct

SEQ ID NO: 274497 - DNA, 25 bp, Rattus norvegicus
ctgggcaagagtacgcgcgcgcgcg

SEQ ID NO: 274498 - DNA, 25 bp, Rattus norvegicus
ctgggcaagagttcgcgcgcgcgcg

SEQ ID NO: 274499 - DNA, 25 bp, Rattus norvegicus
ctgggcacaacgacattgagctgta

SEQ ID NO: 274500 - DNA, 25 bp, Rattus norvegicus
ctgggcacaacgtcattgagctgta

SEQ ID NO: 274501 - DNA, 25 bp, Rattus norvegicus
ctgggcacagctccggttattgtta

SEQ ID NO: 274502 - DNA, 25 bp, Rattus norvegicus
ctgggcacagctgcggttattgtta

SEQ ID NO: 274503 - DNA, 25 bp, Rattus norvegicus
ctgggcacctggctctgtggtttat

SEQ ID NO: 274504 - DNA, 25 bp, Rattus norvegicus
ctgggcacctgggtctgtggtttat

SEQ ID NO: 274505 - DNA, 25 bp, Rattus norvegicus
ctgggcaccttcatgctgatttggg

SEQ ID NO: 274506 - DNA, 25 bp, Rattus norvegicus
ctgggcaccttcttgctgatttggg

SEQ ID NO: 274507 - DNA, 25 bp, Rattus norvegicus
ctgggcacgttgattgggatgcctt

SEQ ID NO: 274508 - DNA, 25 bp, Rattus norvegicus
ctgggcacgttgtttgggatgcctt

SEQ ID NO: 274509 - DNA, 25 bp, Rattus norvegicus
ctgggcactctcaatgcttgtatac

SEQ ID NO: 274510 - DNA, 25 bp, Rattus norvegicus
ctgggcactctctatgcttgtatac

SEQ ID NO: 274511 - DNA, 25 bp, Rattus norvegicus
ctgggcacttgactgagctcagtga

SEQ ID NO: 274512 - DNA, 25 bp, Rattus norvegicus
ctgggcacttgagtgagctcagtga

SEQ ID NO: 274513 - DNA, 25 bp, Rattus norvegicus
ctgggcagacgtagggtcaccctat

SEQ ID NO: 274514 - DNA, 25 bp, Rattus norvegicus
ctgggcagacgttgggtcaccctat

SEQ ID NO: 274515 - DNA, 25 bp, Rattus norvegicus
ctgggcagcatgagaagtccttgtg

SEQ ID NO: 274516 - DNA, 25 bp, Rattus norvegicus
ctgggcagcatgtgaagtccttgtg

SEQ ID NO: 274517 - DNA, 25 bp, Rattus norvegicus
ctgggcagcttgaggctatgtctca

SEQ ID NO: 274518 - DNA, 25 bp, Rattus norvegicus
ctgggcagcttgtggctatgtctca

SEQ ID NO: 274519 - DNA, 25 bp, Rattus norvegicus
ctgggcaggatactatttcccgtgc

SEQ ID NO: 274520 - DNA, 25 bp, Rattus norvegicus
ctgggcaggatagtatttcccgtgc

SEQ ID NO: 274521 - DNA, 25 bp, Rattus norvegicus
ctgggcagtgcaagtgttagtatac

SEQ ID NO: 274522 - DNA, 25 bp, Rattus norvegicus
ctgggcagtgcatgtgttagtatac

SEQ ID NO: 274523 - DNA, 25 bp, Rattus norvegicus
ctgggcatccatacgggttttctaa

SEQ ID NO: 274524 - DNA, 25 bp, Rattus norvegicus
ctgggcatccattcgggttttctaa

SEQ ID NO: 274525 - DNA, 25 bp, Rattus norvegicus
ctgggcatcgctctagaggaattct

SEQ ID NO: 274526 - DNA, 25 bp, Rattus norvegicus
ctgggcatcgctgtagaggaattct

SEQ ID NO: 274527 - DNA, 25 bp, Rattus norvegicus
ctgggcatctgtcacacgaaagcta

SEQ ID NO: 274528 - DNA, 25 bp, Rattus norvegicus
ctgggcatctgtcctaagtcaatgt

SEQ ID NO: 274529 - DNA, 25 bp, Rattus norvegicus
ctgggcatctgtgacacgaaagcta

SEQ ID NO: 274530 - DNA, 25 bp, Rattus norvegicus
ctgggcatctgtgctaagtcaatgt

SEQ ID NO: 274531 - DNA, 25 bp, Rattus norvegicus
ctgggcatgatgcttactgtaggca

SEQ ID NO: 274532 - DNA, 25 bp, Rattus norvegicus
ctgggcatgatggttactgtaggca

SEQ ID NO: 274533 - DNA, 25 bp, Rattus norvegicus
ctgggcatgctgctgcatacctata

SEQ ID NO: 274534 - DNA, 25 bp, Rattus norvegicus
ctgggcatgctggtgcatacctata

SEQ ID NO: 274535 - DNA, 25 bp, Rattus norvegicus
ctgggcattgctattgtggaggtcc

SEQ ID NO: 274536 - DNA, 25 bp, Rattus norvegicus
ctgggcattgcttttgtggaggtcc

SEQ ID NO: 274537 - DNA, 25 bp, Rattus norvegicus
ctgggccaacagcatgcaatgggaa

SEQ ID NO: 274538 - DNA, 25 bp, Rattus norvegicus
ctgggccaacaggatgcaatgggaa

SEQ ID NO: 274539 - DNA, 25 bp, Rattus norvegicus
ctgggccaatgtccagcatcctggg

SEQ ID NO: 274540 - DNA, 25 bp, Rattus norvegicus
ctgggccaatgtgcagcatcctggg

SEQ ID NO: 274541 - DNA, 25 bp, Rattus norvegicus
ctgggccacaggaaccttatgtcta

SEQ ID NO: 274542 - DNA, 25 bp, Rattus norvegicus
ctgggccacaggtaccttatgtcta

SEQ ID NO: 274543 - DNA, 25 bp, Rattus norvegicus
ctgggccaccagaatgagtcttaat

SEQ ID NO: 274544 - DNA, 25 bp, Rattus norvegicus
ctgggccaccagtatgagtcttaat

SEQ ID NO: 274545 - DNA, 25 bp, Rattus norvegicus
ctgggccactggacactatgataaa

SEQ ID NO: 274546 - DNA, 25 bp, Rattus norvegicus
ctgggccactggtcactatgataaa

SEQ ID NO: 274547 - DNA, 25 bp, Rattus norvegicus
ctgggccagtcaccacaatgattct

SEQ ID NO: 274548 - DNA, 25 bp, Rattus norvegicus
ctgggccagtcagcacaatgattct

SEQ ID NO: 274549 - DNA, 25 bp, Rattus norvegicus
ctgggccatccaaagatacgctgtc

SEQ ID NO: 274550 - DNA, 25 bp, Rattus norvegicus
ctgggccatccatagatacgctgtc

SEQ ID NO: 274551 - DNA, 25 bp, Rattus norvegicus
ctgggccatgtgcacagctatgaaa

SEQ ID NO: 274552 - DNA, 25 bp, Rattus norvegicus
ctgggccatgtggacagctatgaaa

SEQ ID NO: 274553 - DNA, 25 bp, Rattus norvegicus
ctgggcccactcacaatttagaatt

SEQ ID NO: 274554 - DNA, 25 bp, Rattus norvegicus
ctgggcccactctcaatttagaatt

SEQ ID NO: 274555 - DNA, 25 bp, Rattus norvegicus
ctgggcccatgaaccccacggagga

SEQ ID NO: 274556 - DNA, 25 bp, Rattus norvegicus
ctgggcccatgatccccacggagga

SEQ ID NO: 274557 - DNA, 25 bp, Rattus norvegicus
ctgggccccggcattgaaaggaatg

SEQ ID NO: 274558 - DNA, 25 bp, Rattus norvegicus
ctgggccccggctttgaaaggaatg

SEQ ID NO: 274559 - DNA, 25 bp, Rattus norvegicus
ctgggcccggatagcagttttgtaa

SEQ ID NO: 274560 - DNA, 25 bp, Rattus norvegicus
ctgggcccggattgcagttttgtaa

SEQ ID NO: 274561 - DNA, 25 bp, Rattus norvegicus
ctgggccctgtgcaactcgaagaaa

SEQ ID NO: 274562 - DNA, 25 bp, Rattus norvegicus
ctgggccctgtggaactcgaagaaa

SEQ ID NO: 274563 - DNA, 25 bp, Rattus norvegicus
ctgggccggaagaaaaagccacctg

SEQ ID NO: 274564 - DNA, 25 bp, Rattus norvegicus
ctgggccggaagtaaaagccacctg

SEQ ID NO: 274565 - DNA, 25 bp, Rattus norvegicus
ctgggcctacccattgtgtgtggta

SEQ ID NO: 274566 - DNA, 25 bp, Rattus norvegicus
ctgggcctaccctttgtgtgtggta

SEQ ID NO: 274567 - DNA, 25 bp, Rattus norvegicus
ctgggcctatcacccctggctggag

SEQ ID NO: 274568 - DNA, 25 bp, Rattus norvegicus
ctgggcctatcagccctggctggag

SEQ ID NO: 274569 - DNA, 25 bp, Rattus norvegicus
ctgggcctcgagatgtttgacacac

SEQ ID NO: 274570 - DNA, 25 bp, Rattus norvegicus
ctgggcctcgagttgtttgacacac

SEQ ID NO: 274571 - DNA, 25 bp, Rattus norvegicus
ctgggcctgataccatatgacttta

SEQ ID NO: 274572 - DNA, 25 bp, Rattus norvegicus
ctgggcctgatagcatatgacttta

SEQ ID NO: 274573 - DNA, 25 bp, Rattus norvegicus
ctgggcctgggtctcaattggaact

SEQ ID NO: 274574 - DNA, 25 bp, Rattus norvegicus
ctgggcctgggtgtcaattggaact

SEQ ID NO: 274575 - DNA, 25 bp, Rattus norvegicus
ctgggcctggttcagatggtcttac

SEQ ID NO: 274576 - DNA, 25 bp, Rattus norvegicus
ctgggcctggttgagatggtcttac

SEQ ID NO: 274577 - DNA, 25 bp, Rattus norvegicus
ctgggcctgtgtatcctacggaaat

SEQ ID NO: 274578 - DNA, 25 bp, Rattus norvegicus
ctgggcctgtgtttcctacggaaat

SEQ ID NO: 274579 - DNA, 25 bp, Rattus norvegicus
ctgggccttaaaaaactctgcaaat

SEQ ID NO: 274580 - DNA, 25 bp, Rattus norvegicus
ctgggccttaaataactctgcaaat

SEQ ID NO: 274581 - DNA, 25 bp, Rattus norvegicus
ctgggccttgttccggagaaacaca

SEQ ID NO: 274582 - DNA, 25 bp, Rattus norvegicus
ctgggccttgttgcggagaaacaca

SEQ ID NO: 274583 - DNA, 25 bp, Rattus norvegicus
ctgggcctttacacagcaagttaga

SEQ ID NO: 274584 - DNA, 25 bp, Rattus norvegicus
ctgggcctttactcagcaagttaga

SEQ ID NO: 274585 - DNA, 25 bp, Rattus norvegicus
ctgggcctttggatgtgtacggtaa

SEQ ID NO: 274586 - DNA, 25 bp, Rattus norvegicus
ctgggcctttggttgtgtacggtaa

SEQ ID NO: 274587 - DNA, 25 bp, Rattus norvegicus
ctgggcgataggcaatgtcccaccg

SEQ ID NO: 274588 - DNA, 25 bp, Rattus norvegicus
ctgggcgatagggaatgtcccaccg

SEQ ID NO: 274589 - DNA, 25 bp, Rattus norvegicus
ctgggcgatcccacatcaatgatta

SEQ ID NO: 274590 - DNA, 25 bp, Rattus norvegicus
ctgggcgatccctcatcaatgatta

SEQ ID NO: 274591 - DNA, 25 bp, Rattus norvegicus
ctgggcgcgccaagttgagctagtc

SEQ ID NO: 274592 - DNA, 25 bp, Rattus norvegicus
ctgggcgcgccatgttgagctagtc

SEQ ID NO: 274593 - DNA, 25 bp, Rattus norvegicus
ctgggcgtacttaaacgttagtcat

SEQ ID NO: 274594 - DNA, 25 bp, Rattus norvegicus
ctgggcgtactttaacgttagtcat

SEQ ID NO: 274595 - DNA, 25 bp, Rattus norvegicus
ctgggcgtatttcaagaagatgcta

SEQ ID NO: 274596 - DNA, 25 bp, Rattus norvegicus
ctgggcgtatttgaagaagatgcta

SEQ ID NO: 274597 - DNA, 25 bp, Rattus norvegicus
ctgggcgtggtaccgcatgccctta

SEQ ID NO: 274598 - DNA, 25 bp, Rattus norvegicus
ctgggcgtggtagcgcatgccctta

SEQ ID NO: 274599 - DNA, 25 bp, Rattus norvegicus
ctgggctaagaacgctctgtttcaa

SEQ ID NO: 274600 - DNA, 25 bp, Rattus norvegicus
ctgggctaagaaggctctgtttcaa

SEQ ID NO: 274601 - DNA, 25 bp, Rattus norvegicus
ctgggctacataatgaattctaaga

SEQ ID NO: 274602 - DNA, 25 bp, Rattus norvegicus
ctgggctacatattgaattctaaga

SEQ ID NO: 274603 - DNA, 25 bp, Rattus norvegicus
ctgggctacatgaaagcttgactga

SEQ ID NO: 274604 - DNA, 25 bp, Rattus norvegicus
ctgggctacatgtaagcttgactga

SEQ ID NO: 274605 - DNA, 25 bp, Rattus norvegicus
ctgggctacattcatgaccctgtct

SEQ ID NO: 274606 - DNA, 25 bp, Rattus norvegicus
ctgggctacattgatgaccctgtct

SEQ ID NO: 274607 - DNA, 25 bp, Rattus norvegicus
ctgggctacggaactcttctacaaa

SEQ ID NO: 274608 - DNA, 25 bp, Rattus norvegicus
ctgggctacggatctcttctacaaa

SEQ ID NO: 274609 - DNA, 25 bp, Rattus norvegicus
ctgggctactggctatgctacgtca

SEQ ID NO: 274610 - DNA, 25 bp, Rattus norvegicus
ctgggctactgggtatgctacgtca

SEQ ID NO: 274611 - DNA, 25 bp, Rattus norvegicus
ctgggctacttaagatactgaggca

SEQ ID NO: 274612 - DNA, 25 bp, Rattus norvegicus
ctgggctacttatgatactgaggca

SEQ ID NO: 274613 - DNA, 25 bp, Rattus norvegicus
ctgggctagctcatcagtggaacta

SEQ ID NO: 274614 - DNA, 25 bp, Rattus norvegicus
ctgggctagctcttcagtggaacta

SEQ ID NO: 274615 - DNA, 25 bp, Rattus norvegicus
ctgggctagctgctgtactttgtaa

SEQ ID NO: 274616 - DNA, 25 bp, Rattus norvegicus
ctgggctagctggtgtactttgtaa

SEQ ID NO: 274617 - DNA, 25 bp, Rattus norvegicus
ctgggctatgacatcctgtacatat

SEQ ID NO: 274618 - DNA, 25 bp, Rattus norvegicus
ctgggctatgacttcctgtacatat

SEQ ID NO: 274619 - DNA, 25 bp, Rattus norvegicus
ctgggctatgtaatacctccttgaa

SEQ ID NO: 274620 - DNA, 25 bp, Rattus norvegicus
ctgggctatgtattacctccttgaa

SEQ ID NO: 274621 - DNA, 25 bp, Rattus norvegicus
ctgggctattaaactggccactaat

SEQ ID NO: 274622 - DNA, 25 bp, Rattus norvegicus
ctgggctattaatctggccactaat

SEQ ID NO: 274623 - DNA, 25 bp, Rattus norvegicus
ctgggctcaaatagcatgtgataga

SEQ ID NO: 274624 - DNA, 25 bp, Rattus norvegicus
ctgggctcaaattgcatgtgataga

SEQ ID NO: 274625 - DNA, 25 bp, Rattus norvegicus
ctgggctcagctaggcaatggtgta

SEQ ID NO: 274626 - DNA, 25 bp, Rattus norvegicus
ctgggctcagcttggcaatggtgta

SEQ ID NO: 274627 - DNA, 25 bp, Rattus norvegicus
ctgggctcaggcagccggcattgtc

SEQ ID NO: 274628 - DNA, 25 bp, Rattus norvegicus
ctgggctcaggctgccggcattgtc

SEQ ID NO: 274629 - DNA, 25 bp, Rattus norvegicus
ctgggctcagttctttaatttcctc

SEQ ID NO: 274630 - DNA, 25 bp, Rattus norvegicus
ctgggctcagttgtttaatttcctc

SEQ ID NO: 274631 - DNA, 25 bp, Rattus norvegicus
ctgggctccaaaatctagctgataa

SEQ ID NO: 274632 - DNA, 25 bp, Rattus norvegicus
ctgggctccaaattctagctgataa

SEQ ID NO: 274633 - DNA, 25 bp, Rattus norvegicus
ctgggctccttacaggtctgtgctt

SEQ ID NO: 274634 - DNA, 25 bp, Rattus norvegicus
ctgggctccttagaggtctgtgctt

SEQ ID NO: 274635 - DNA, 25 bp, Rattus norvegicus
ctgggctctctgaagatcagtggat

SEQ ID NO: 274636 - DNA, 25 bp, Rattus norvegicus
ctgggctctctgtagatcagtggat

SEQ ID NO: 274637 - DNA, 25 bp, Rattus norvegicus
ctgggctctgccatgcaatatttaa

SEQ ID NO: 274638 - DNA, 25 bp, Rattus norvegicus
ctgggctctgccttgcaatatttaa

SEQ ID NO: 274639 - DNA, 25 bp, Rattus norvegicus
ctgggctctgttacgatggtgttga

SEQ ID NO: 274640 - DNA, 25 bp, Rattus norvegicus
ctgggctctgtttcgatggtgttga

SEQ ID NO: 274641 - DNA, 25 bp, Rattus norvegicus
ctgggctgatggcttagcttgcact

SEQ ID NO: 274642 - DNA, 25 bp, Rattus norvegicus
ctgggctgatgggttagcttgcact

SEQ ID NO: 274643 - DNA, 25 bp, Rattus norvegicus
ctgggctgctgaacagtaagcttta

SEQ ID NO: 274644 - DNA, 25 bp, Rattus norvegicus
ctgggctgctgatcagtaagcttta

SEQ ID NO: 274645 - DNA, 25 bp, Rattus norvegicus
ctgggctgctgtagtgagcatccta

SEQ ID NO: 274646 - DNA, 25 bp, Rattus norvegicus
ctgggctgctgttgtgagcatccta

SEQ ID NO: 274647 - DNA, 25 bp, Rattus norvegicus
ctgggctggtctatctatagtgtac

SEQ ID NO: 274648 - DNA, 25 bp, Rattus norvegicus
ctgggctggtctttctatagtgtac

SEQ ID NO: 274649 - DNA, 25 bp, Rattus norvegicus
ctgggctgtcatcagtcagacttgt

SEQ ID NO: 274650 - DNA, 25 bp, Rattus norvegicus
ctgggctgtcatgagtcagacttgt

SEQ ID NO: 274651 - DNA, 25 bp, Rattus norvegicus
ctgggctgtgaaagcttctctggca

SEQ ID NO: 274652 - DNA, 25 bp, Rattus norvegicus
ctgggctgtgaatgcttctctggca

SEQ ID NO: 274653 - DNA, 25 bp, Rattus norvegicus
ctgggctgtgcaaagtgttgtcaca

SEQ ID NO: 274654 - DNA, 25 bp, Rattus norvegicus
ctgggctgtgcatagtgttgtcaca

SEQ ID NO: 274655 - DNA, 25 bp, Rattus norvegicus
ctgggcttaaacctatgcgttaata

SEQ ID NO: 274656 - DNA, 25 bp, Rattus norvegicus
ctgggcttaaacgtatgcgttaata

SEQ ID NO: 274657 - DNA, 25 bp, Rattus norvegicus
ctgggcttactactgcttatcaggt

SEQ ID NO: 274658 - DNA, 25 bp, Rattus norvegicus
ctgggcttactagtgcttatcaggt

SEQ ID NO: 274659 - DNA, 25 bp, Rattus norvegicus
ctgggcttatgaactgcaagagatg

SEQ ID NO: 274660 - DNA, 25 bp, Rattus norvegicus
ctgggcttatgatctgcaagagatg

SEQ ID NO: 274661 - DNA, 25 bp, Rattus norvegicus
ctgggcttcataccgtattcctact

SEQ ID NO: 274662 - DNA, 25 bp, Rattus norvegicus
ctgggcttcatagcgtattcctact

SEQ ID NO: 274663 - DNA, 25 bp, Rattus norvegicus
ctgggcttcctacgcagaattcata

SEQ ID NO: 274664 - DNA, 25 bp, Rattus norvegicus
ctgggcttcctaggcagaattcata

SEQ ID NO: 274665 - DNA, 25 bp, Rattus norvegicus
ctgggcttcctgaccctggaaggga

SEQ ID NO: 274666 - DNA, 25 bp, Rattus norvegicus
ctgggcttcctgagtaacttgaggc

SEQ ID NO: 274667 - DNA, 25 bp, Rattus norvegicus
ctgggcttcctgtccctggaaggga

SEQ ID NO: 274668 - DNA, 25 bp, Rattus norvegicus
ctgggcttcctgtgtaacttgaggc

SEQ ID NO: 274669 - DNA, 25 bp, Rattus norvegicus
ctgggcttggagcacgacgacacac

SEQ ID NO: 274670 - DNA, 25 bp, Rattus norvegicus
ctgggcttggaggacgacgacacac

SEQ ID NO: 274671 - DNA, 25 bp, Rattus norvegicus
ctgggctttaaccagggttgatgaa

SEQ ID NO: 274672 - DNA, 25 bp, Rattus norvegicus
ctgggctttaacgagggttgatgaa

SEQ ID NO: 274673 - DNA, 25 bp, Rattus norvegicus
ctgggctttgccatcagctaacaaa

SEQ ID NO: 274674 - DNA, 25 bp, Rattus norvegicus
ctgggctttgccttcagctaacaaa

SEQ ID NO: 274675 - DNA, 25 bp, Rattus norvegicus
ctgggctttgtgatttagaccgtat

SEQ ID NO: 274676 - DNA, 25 bp, Rattus norvegicus
ctgggctttgtgttttagaccgtat

SEQ ID NO: 274677 - DNA, 25 bp, Rattus norvegicus
ctgggcttttatacatctcggagaa

SEQ ID NO: 274678 - DNA, 25 bp, Rattus norvegicus
ctgggcttttattcatctcggagaa

SEQ ID NO: 274679 - DNA, 25 bp, Rattus norvegicus
ctgggcttttccaactactgataac

SEQ ID NO: 274680 - DNA, 25 bp, Rattus norvegicus
ctgggcttttcctactactgataac

SEQ ID NO: 274681 - DNA, 25 bp, Rattus norvegicus
ctggggctttaacccatgcggtgaa

SEQ ID NO: 274682 - DNA, 25 bp, Rattus norvegicus
ctggggctttaagccatgcggtgaa

SEQ ID NO: 274683 - DNA, 25 bp, Rattus norvegicus
ctgggtaaacctcatctgcaagtcg

SEQ ID NO: 274684 - DNA, 25 bp, Rattus norvegicus
ctgggtaaacctgatctgcaagtcg

SEQ ID NO: 274685 - DNA, 25 bp, Rattus norvegicus
ctgggtaaactgagctccttgtgtg

SEQ ID NO: 274686 - DNA, 25 bp, Rattus norvegicus
ctgggtaaactgtgctccttgtgtg

SEQ ID NO: 274687 - DNA, 25 bp, Rattus norvegicus
ctgggtaactgactgcttttctgac

SEQ ID NO: 274688 - DNA, 25 bp, Rattus norvegicus
ctgggtaactgagtgcttttctgac

SEQ ID NO: 274689 - DNA, 25 bp, Rattus norvegicus
ctgggtaatgaaaattgccttggga

SEQ ID NO: 274690 - DNA, 25 bp, Rattus norvegicus
ctgggtaatgaatattgccttggga

SEQ ID NO: 274691 - DNA, 25 bp, Rattus norvegicus
ctgggtaccctgcaactttatatag

SEQ ID NO: 274692 - DNA, 25 bp, Rattus norvegicus
ctgggtaccctggaactttatatag

SEQ ID NO: 274693 - DNA, 25 bp, Rattus norvegicus
ctgggtacgccaccacaactgtgag

SEQ ID NO: 274694 - DNA, 25 bp, Rattus norvegicus
ctgggtacgccagcacaactgtgag

SEQ ID NO: 274695 - DNA, 25 bp, Rattus norvegicus
ctgggtactgtacgatctgcactga

SEQ ID NO: 274696 - DNA, 25 bp, Rattus norvegicus
ctgggtactgtaggatctgcactga

SEQ ID NO: 274697 - DNA, 25 bp, Rattus norvegicus
ctgggtagagccattattttttctg

SEQ ID NO: 274698 - DNA, 25 bp, Rattus norvegicus
ctgggtagagcctttattttttctg

SEQ ID NO: 274699 - DNA, 25 bp, Rattus norvegicus
ctgggtagtcctcaaagcatgtagt

SEQ ID NO: 274700 - DNA, 25 bp, Rattus norvegicus
ctgggtagtcctgaaagcatgtagt

SEQ ID NO: 274701 - DNA, 25 bp, Rattus norvegicus
ctgggtagtgcacttcctggcagat

SEQ ID NO: 274702 - DNA, 25 bp, Rattus norvegicus
ctgggtagtgcagttcctggcagat

SEQ ID NO: 274703 - DNA, 25 bp, Rattus norvegicus
ctgggtatcctgatgaagggtccaa

SEQ ID NO: 274704 - DNA, 25 bp, Rattus norvegicus
ctgggtatcctgttgaagggtccaa

SEQ ID NO: 274705 - DNA, 25 bp, Rattus norvegicus
ctgggtattttcactcgtgtgctga

SEQ ID NO: 274706 - DNA, 25 bp, Rattus norvegicus
ctgggtattttctctcgtgtgctga

SEQ ID NO: 274707 - DNA, 25 bp, Rattus norvegicus
ctgggtcaaaataacctatctgaag

SEQ ID NO: 274708 - DNA, 25 bp, Rattus norvegicus
ctgggtcaaaattacctatctgaag

SEQ ID NO: 274709 - DNA, 25 bp, Rattus norvegicus
ctgggtcaaggtaacttccagctgc

SEQ ID NO: 274710 - DNA, 25 bp, Rattus norvegicus
ctgggtcaaggttacttccagctgc

SEQ ID NO: 274711 - DNA, 25 bp, Rattus norvegicus
ctgggtcacaccagggagggactta

SEQ ID NO: 274712 - DNA, 25 bp, Rattus norvegicus
ctgggtcacacctgggagggactta

SEQ ID NO: 274713 - DNA, 25 bp, Rattus norvegicus
ctgggtcacagtcggcttctgcaac

SEQ ID NO: 274714 - DNA, 25 bp, Rattus norvegicus
ctgggtcacagtgggcttctgcaac

SEQ ID NO: 274715 - DNA, 25 bp, Rattus norvegicus
ctgggtcacggtctagtgtcgtcat

SEQ ID NO: 274716 - DNA, 25 bp, Rattus norvegicus
ctgggtcacggtgtagtgtcgtcat

SEQ ID NO: 274717 - DNA, 25 bp, Rattus norvegicus
ctgggtcagcacctagaactcattg

SEQ ID NO: 274718 - DNA, 25 bp, Rattus norvegicus
ctgggtcagcacgtagaactcattg

SEQ ID NO: 274719 - DNA, 25 bp, Rattus norvegicus
ctgggtcagccacctaggcaatgaa

SEQ ID NO: 274720 - DNA, 25 bp, Rattus norvegicus
ctgggtcagccagctaggcaatgaa

SEQ ID NO: 274721 - DNA, 25 bp, Rattus norvegicus
ctgggtcagggcaaagtgttgaatt

SEQ ID NO: 274722 - DNA, 25 bp, Rattus norvegicus
ctgggtcagggctaagtgttgaatt

SEQ ID NO: 274723 - DNA, 25 bp, Rattus norvegicus
ctgggtcagtacagttcttaaccac

SEQ ID NO: 274724 - DNA, 25 bp, Rattus norvegicus
ctgggtcagtactgttcttaaccac

SEQ ID NO: 274725 - DNA, 25 bp, Rattus norvegicus
ctgggtcatctcacaccaatcaggg

SEQ ID NO: 274726 - DNA, 25 bp, Rattus norvegicus
ctgggtcatctctcaccaatcaggg

SEQ ID NO: 274727 - DNA, 25 bp, Rattus norvegicus
ctgggtcattatcgcttgtcacaag

SEQ ID NO: 274728 - DNA, 25 bp, Rattus norvegicus
ctgggtcattatggcttgtcacaag

SEQ ID NO: 274729 - DNA, 25 bp, Rattus norvegicus
ctgggtccaagcatctctagagtgt

SEQ ID NO: 274730 - DNA, 25 bp, Rattus norvegicus
ctgggtccaagcttctctagagtgt

SEQ ID NO: 274731 - DNA, 25 bp, Rattus norvegicus
ctgggtccagctattagttcttaga

SEQ ID NO: 274732 - DNA, 25 bp, Rattus norvegicus
ctgggtccagcttttagttcttaga

SEQ ID NO: 274733 - DNA, 25 bp, Rattus norvegicus
ctgggtcccaagattagtcctagag

SEQ ID NO: 274734 - DNA, 25 bp, Rattus norvegicus
ctgggtcccaagtttagtcctagag

SEQ ID NO: 274735 - DNA, 25 bp, Rattus norvegicus
ctgggtcccagacctagtgtctgag

SEQ ID NO: 274736 - DNA, 25 bp, Rattus norvegicus
ctgggtcccagagctagtgtctgag

SEQ ID NO: 274737 - DNA, 25 bp, Rattus norvegicus
ctgggtccctgaagatcgggagcta

SEQ ID NO: 274738 - DNA, 25 bp, Rattus norvegicus
ctgggtccctgatgatcgggagcta

SEQ ID NO: 274739 - DNA, 25 bp, Rattus norvegicus
ctgggtccctgtcagatggtgttca

SEQ ID NO: 274740 - DNA, 25 bp, Rattus norvegicus
ctgggtccctgtgagatggtgttca

SEQ ID NO: 274741 - DNA, 25 bp, Rattus norvegicus
ctgggtcctcctcgatctaaaagtg

SEQ ID NO: 274742 - DNA, 25 bp, Rattus norvegicus
ctgggtcctcctggatctaaaagtg

SEQ ID NO: 274743 - DNA, 25 bp, Rattus norvegicus
ctgggtcctgtcaggtcatgctgtg

SEQ ID NO: 274744 - DNA, 25 bp, Rattus norvegicus
ctgggtcctgtcagtattctgggaa

SEQ ID NO: 274745 - DNA, 25 bp, Rattus norvegicus
ctgggtcctgtctggtcatgctgtg

SEQ ID NO: 274746 - DNA, 25 bp, Rattus norvegicus
ctgggtcctgtctgtattctgggaa

SEQ ID NO: 274747 - DNA, 25 bp, Rattus norvegicus
ctgggtcggagcctcagcattgaaa

SEQ ID NO: 274748 - DNA, 25 bp, Rattus norvegicus
ctgggtcggagcgtcagcattgaaa

SEQ ID NO: 274749 - DNA, 25 bp, Rattus norvegicus
ctgggtctacatactgctacggaag

SEQ ID NO: 274750 - DNA, 25 bp, Rattus norvegicus
ctgggtctacattctgctacggaag

SEQ ID NO: 274751 - DNA, 25 bp, Rattus norvegicus
ctgggtctcacacgagcttaagtgc

SEQ ID NO: 274752 - DNA, 25 bp, Rattus norvegicus
ctgggtctcacaggagcttaagtgc

SEQ ID NO: 274753 - DNA, 25 bp, Rattus norvegicus
ctgggtctcctgaaagtgccaagat

SEQ ID NO: 274754 - DNA, 25 bp, Rattus norvegicus
ctgggtctcctgtaagtgccaagat

SEQ ID NO: 274755 - DNA, 25 bp, Rattus norvegicus
ctgggtctgcctacggatgagaata

SEQ ID NO: 274756 - DNA, 25 bp, Rattus norvegicus
ctgggtctgccttcggatgagaata

SEQ ID NO: 274757 - DNA, 25 bp, Rattus norvegicus
ctgggtctgcttatctctgtaataa

SEQ ID NO: 274758 - DNA, 25 bp, Rattus norvegicus
ctgggtctgcttttctctgtaataa

SEQ ID NO: 274759 - DNA, 25 bp, Rattus norvegicus
ctgggtctgggtagagtttgctttt

SEQ ID NO: 274760 - DNA, 25 bp, Rattus norvegicus
ctgggtctgggttgagtttgctttt

SEQ ID NO: 274761 - DNA, 25 bp, Rattus norvegicus
ctgggtcttccaactagaactgttt

SEQ ID NO: 274762 - DNA, 25 bp, Rattus norvegicus
ctgggtcttccatctagaactgttt

SEQ ID NO: 274763 - DNA, 25 bp, Rattus norvegicus
ctgggtcttgagaaccgagccaacc

SEQ ID NO: 274764 - DNA, 25 bp, Rattus norvegicus
ctgggtcttgagtaccgagccaacc

SEQ ID NO: 274765 - DNA, 25 bp, Rattus norvegicus
ctgggtcttgtccttaatattgtct

SEQ ID NO: 274766 - DNA, 25 bp, Rattus norvegicus
ctgggtcttgtcgttaatattgtct

SEQ ID NO: 274767 - DNA, 25 bp, Rattus norvegicus
ctgggtgaacccactaaagttgatt

SEQ ID NO: 274768 - DNA, 25 bp, Rattus norvegicus
ctgggtgaaccctctaaagttgatt

SEQ ID NO: 274769 - DNA, 25 bp, Rattus norvegicus
ctgggtgagcgcagcacactgcaca

SEQ ID NO: 274770 - DNA, 25 bp, Rattus norvegicus
ctgggtgagcgctgcacactgcaca

SEQ ID NO: 274771 - DNA, 25 bp, Rattus norvegicus
ctgggtgccactatccgaagggatg

SEQ ID NO: 274772 - DNA, 25 bp, Rattus norvegicus
ctgggtgccactttccgaagggatg

SEQ ID NO: 274773 - DNA, 25 bp, Rattus norvegicus
ctgggtgccagtaacaggtgtttgc

SEQ ID NO: 274774 - DNA, 25 bp, Rattus norvegicus
ctgggtgccagttacaggtgtttgc

SEQ ID NO: 274775 - DNA, 25 bp, Rattus norvegicus
ctgggtgccatcagcagacagtgat

SEQ ID NO: 274776 - DNA, 25 bp, Rattus norvegicus
ctgggtgccatctgcagacagtgat

SEQ ID NO: 274777 - DNA, 25 bp, Rattus norvegicus
ctgggtgccctgaagaagtgactct

SEQ ID NO: 274778 - DNA, 25 bp, Rattus norvegicus
ctgggtgccctgtagaagtgactct

SEQ ID NO: 274779 - DNA, 25 bp, Rattus norvegicus
ctgggtgccttcagcagaggtcaga

SEQ ID NO: 274780 - DNA, 25 bp, Rattus norvegicus
ctgggtgccttctgcagaggtcaga

SEQ ID NO: 274781 - DNA, 25 bp, Rattus norvegicus
ctgggtgctcagatcacaggtgtgt

SEQ ID NO: 274782 - DNA, 25 bp, Rattus norvegicus
ctgggtgctcagttcacaggtgtgt

SEQ ID NO: 274783 - DNA, 25 bp, Rattus norvegicus
ctgggtgctgtcactaggtctgata

SEQ ID NO: 274784 - DNA, 25 bp, Rattus norvegicus
ctgggtgctgtctctaggtctgata

SEQ ID NO: 274785 - DNA, 25 bp, Rattus norvegicus
ctgggtggaaaactcattgtaaact

SEQ ID NO: 274786 - DNA, 25 bp, Rattus norvegicus
ctgggtggaaaagtcattgtaaact

SEQ ID NO: 274787 - DNA, 25 bp, Rattus norvegicus
ctgggtggaatgactcttcctttga

SEQ ID NO: 274788 - DNA, 25 bp, Rattus norvegicus
ctgggtggaatgtctcttcctttga

SEQ ID NO: 274789 - DNA, 25 bp, Rattus norvegicus
ctgggtggaccaatgccaacggact

SEQ ID NO: 274790 - DNA, 25 bp, Rattus norvegicus
ctgggtggaccattgccaacggact

SEQ ID NO: 274791 - DNA, 25 bp, Rattus norvegicus
ctgggtggagacagtaccgtgtacc

SEQ ID NO: 274792 - DNA, 25 bp, Rattus norvegicus
ctgggtggagactgtaccgtgtacc

SEQ ID NO: 274793 - DNA, 25 bp, Rattus norvegicus
ctgggtggcagtcctaatgcacagt

SEQ ID NO: 274794 - DNA, 25 bp, Rattus norvegicus
ctgggtggcagtgctaatgcacagt

SEQ ID NO: 274795 - DNA, 25 bp, Rattus norvegicus
ctgggtggcatcatctttatgaatt

SEQ ID NO: 274796 - DNA, 25 bp, Rattus norvegicus
ctgggtggcatcttctttatgaatt

SEQ ID NO: 274797 - DNA, 25 bp, Rattus norvegicus
ctgggtggccagaaacgcagttttt

SEQ ID NO: 274798 - DNA, 25 bp, Rattus norvegicus
ctgggtggccagtaacgcagttttt

SEQ ID NO: 274799 - DNA, 25 bp, Rattus norvegicus
ctgggtggccatattctatttgttt

SEQ ID NO: 274800 - DNA, 25 bp, Rattus norvegicus
ctgggtggccattttctatttgttt

SEQ ID NO: 274801 - DNA, 25 bp, Rattus norvegicus
ctgggtgggagaagttaaaagcttt

SEQ ID NO: 274802 - DNA, 25 bp, Rattus norvegicus
ctgggtgggagatgttaaaagcttt

SEQ ID NO: 274803 - DNA, 25 bp, Rattus norvegicus
ctgggtgggcgcacactgtttgccc

SEQ ID NO: 274804 - DNA, 25 bp, Rattus norvegicus
ctgggtgggcgctcactgtttgccc

SEQ ID NO: 274805 - DNA, 25 bp, Rattus norvegicus
ctgggtgggtgcatcagttgtcaat

SEQ ID NO: 274806 - DNA, 25 bp, Rattus norvegicus
ctgggtgggtgcttcagttgtcaat

SEQ ID NO: 274807 - DNA, 25 bp, Rattus norvegicus
ctgggtggtcctaataaaatctcat

SEQ ID NO: 274808 - DNA, 25 bp, Rattus norvegicus
ctgggtggtccttataaaatctcat

SEQ ID NO: 274809 - DNA, 25 bp, Rattus norvegicus
ctgggtgtaaagatgactgtgcgta

SEQ ID NO: 274810 - DNA, 25 bp, Rattus norvegicus
ctgggtgtaaagttgactgtgcgta

SEQ ID NO: 274811 - DNA, 25 bp, Rattus norvegicus
ctgggtgtaaatccttcgatgtcta

SEQ ID NO: 274812 - DNA, 25 bp, Rattus norvegicus
ctgggtgtaaatgcttcgatgtcta

SEQ ID NO: 274813 - DNA, 25 bp, Rattus norvegicus
ctgggtgtacttagtagacttagcc

SEQ ID NO: 274814 - DNA, 25 bp, Rattus norvegicus
ctgggtgtactttgtagacttagcc

SEQ ID NO: 274815 - DNA, 25 bp, Rattus norvegicus
ctgggtgtagtcacagtccacaaat

SEQ ID NO: 274816 - DNA, 25 bp, Rattus norvegicus
ctgggtgtagtctcagtccacaaat

SEQ ID NO: 274817 - DNA, 25 bp, Rattus norvegicus
ctgggtgtctatatcattgagctcc

SEQ ID NO: 274818 - DNA, 25 bp, Rattus norvegicus
ctgggtgtctatttcattgagctcc

SEQ ID NO: 274819 - DNA, 25 bp, Rattus norvegicus
ctgggtgtctgtcaacattcattcc

SEQ ID NO: 274820 - DNA, 25 bp, Rattus norvegicus
ctgggtgtctgtgaacattcattcc

SEQ ID NO: 274821 - DNA, 25 bp, Rattus norvegicus
ctgggtgtgcttatcattcagctaa

SEQ ID NO: 274822 - DNA, 25 bp, Rattus norvegicus
ctgggtgtgcttttcattcagctaa

SEQ ID NO: 274823 - DNA, 25 bp, Rattus norvegicus
ctgggtgtggagacttcagacatat

SEQ ID NO: 274824 - DNA, 25 bp, Rattus norvegicus
ctgggtgtggagtcttcagacatat

SEQ ID NO: 274825 - DNA, 25 bp, Rattus norvegicus
ctgggtgttaacacatgctttgtac

SEQ ID NO: 274826 - DNA, 25 bp, Rattus norvegicus
ctgggtgttaactcatgctttgtac

SEQ ID NO: 274827 - DNA, 25 bp, Rattus norvegicus
ctgggtgttttcctgcagagatctt

SEQ ID NO: 274828 - DNA, 25 bp, Rattus norvegicus
ctgggtgttttcgtgcagagatctt

SEQ ID NO: 274829 - DNA, 25 bp, Rattus norvegicus
ctgggttacaatacaggattactaa

SEQ ID NO: 274830 - DNA, 25 bp, Rattus norvegicus
ctgggttacaattcaggattactaa

SEQ ID NO: 274831 - DNA, 25 bp, Rattus norvegicus
ctgggttacaggctcagtgcagtta

SEQ ID NO: 274832 - DNA, 25 bp, Rattus norvegicus
ctgggttacagggtcagtgcagtta

SEQ ID NO: 274833 - DNA, 25 bp, Rattus norvegicus
ctgggttacttgaatctctgctgat

SEQ ID NO: 274834 - DNA, 25 bp, Rattus norvegicus
ctgggttacttgtatctctgctgat

SEQ ID NO: 274835 - DNA, 25 bp, Rattus norvegicus
ctgggttatatcaagtgactctgta

SEQ ID NO: 274836 - DNA, 25 bp, Rattus norvegicus
ctgggttatatctagtgactctgta

SEQ ID NO: 274837 - DNA, 25 bp, Rattus norvegicus
ctgggttatcttagcctgtcaggaa

SEQ ID NO: 274838 - DNA, 25 bp, Rattus norvegicus
ctgggttatctttgcctgtcaggaa

SEQ ID NO: 274839 - DNA, 25 bp, Rattus norvegicus
ctgggttcaatcaccgtgctgtaag

SEQ ID NO: 274840 - DNA, 25 bp, Rattus norvegicus
ctgggttcaatctccgtgctgtaag

SEQ ID NO: 274841 - DNA, 25 bp, Rattus norvegicus
ctgggttcaattactagtacctaca

SEQ ID NO: 274842 - DNA, 25 bp, Rattus norvegicus
ctgggttcaatttctagtacctaca

SEQ ID NO: 274843 - DNA, 25 bp, Rattus norvegicus
ctgggttcagtcctagcaccggaaa

SEQ ID NO: 274844 - DNA, 25 bp, Rattus norvegicus
ctgggttcagtcgtagcaccggaaa

SEQ ID NO: 274845 - DNA, 25 bp, Rattus norvegicus
ctgggttccaggcatcatcactatg

SEQ ID NO: 274846 - DNA, 25 bp, Rattus norvegicus
ctgggttccagggatcatcactatg

SEQ ID NO: 274847 - DNA, 25 bp, Rattus norvegicus
ctgggttccagtcctttagggagat

SEQ ID NO: 274848 - DNA, 25 bp, Rattus norvegicus
ctgggttccagtgctttagggagat

SEQ ID NO: 274849 - DNA, 25 bp, Rattus norvegicus
ctgggttccatacacagcaccaaaa

SEQ ID NO: 274850 - DNA, 25 bp, Rattus norvegicus
ctgggttccatagacagcaccaaaa

SEQ ID NO: 274851 - DNA, 25 bp, Rattus norvegicus
ctgggttcccgtcaactcagggatt

SEQ ID NO: 274852 - DNA, 25 bp, Rattus norvegicus
ctgggttcccgtgaactcagggatt

SEQ ID NO: 274853 - DNA, 25 bp, Rattus norvegicus
ctgggttccctgaggacttggacaa

SEQ ID NO: 274854 - DNA, 25 bp, Rattus norvegicus
ctgggttccctgtggacttggacaa

SEQ ID NO: 274855 - DNA, 25 bp, Rattus norvegicus
ctgggttcgggactatggtctcctc

SEQ ID NO: 274856 - DNA, 25 bp, Rattus norvegicus
ctgggttcgggagtatggtctcctc

SEQ ID NO: 274857 - DNA, 25 bp, Rattus norvegicus
ctgggttcggtcctctacagtgaag

SEQ ID NO: 274858 - DNA, 25 bp, Rattus norvegicus
ctgggttcggtcgtctacagtgaag

SEQ ID NO: 274859 - DNA, 25 bp, Rattus norvegicus
ctgggttctagtccttgctgtcctg

SEQ ID NO: 274860 - DNA, 25 bp, Rattus norvegicus
ctgggttctagtgcttgctgtcctg

SEQ ID NO: 274861 - DNA, 25 bp, Rattus norvegicus
ctgggttctattctgagcgcacaca

SEQ ID NO: 274862 - DNA, 25 bp, Rattus norvegicus
ctgggttctattgtgagcgcacaca

SEQ ID NO: 274863 - DNA, 25 bp, Rattus norvegicus
ctgggttcttccagcctgtgaatgt

SEQ ID NO: 274864 - DNA, 25 bp, Rattus norvegicus
ctgggttcttcctgcctgtgaatgt

SEQ ID NO: 274865 - DNA, 25 bp, Rattus norvegicus
ctgggttgacagatgctctaccaaa

SEQ ID NO: 274866 - DNA, 25 bp, Rattus norvegicus
ctgggttgacagttgctctaccaaa

SEQ ID NO: 274867 - DNA, 25 bp, Rattus norvegicus
ctgggtttaagcatcgcttgggtga

SEQ ID NO: 274868 - DNA, 25 bp, Rattus norvegicus
ctgggtttaagcttcgcttgggtga

SEQ ID NO: 274869 - DNA, 25 bp, Rattus norvegicus
ctgggtttcccaccggtgatttaat

SEQ ID NO: 274870 - DNA, 25 bp, Rattus norvegicus
ctgggtttcccagcggtgatttaat

SEQ ID NO: 274871 - DNA, 25 bp, Rattus norvegicus
ctgggtttctgccacttgaatttgg

SEQ ID NO: 274872 - DNA, 25 bp, Rattus norvegicus
ctgggtttctgcgacttgaatttgg

SEQ ID NO: 274873 - DNA, 25 bp, Rattus norvegicus
ctgggtttgaatcttagggacactt

SEQ ID NO: 274874 - DNA, 25 bp, Rattus norvegicus
ctgggtttgaatgttagggacactt

SEQ ID NO: 274875 - DNA, 25 bp, Rattus norvegicus
ctgggtttgaccactgttgtactga

SEQ ID NO: 274876 - DNA, 25 bp, Rattus norvegicus
ctgggtttgacctctgttgtactga

SEQ ID NO: 274877 - DNA, 25 bp, Rattus norvegicus
ctgggtttgcaaaggcctggctgta

SEQ ID NO: 274878 - DNA, 25 bp, Rattus norvegicus
ctgggtttgcaatggcctggctgta

SEQ ID NO: 274879 - DNA, 25 bp, Rattus norvegicus
ctgggtttgggtatgttctgtgtca

SEQ ID NO: 274880 - DNA, 25 bp, Rattus norvegicus
ctgggtttgggtttgttctgtgtca

SEQ ID NO: 274881 - DNA, 25 bp, Rattus norvegicus
ctgggtttgtgcaaactggagccta

SEQ ID NO: 274882 - DNA, 25 bp, Rattus norvegicus
ctgggtttgtgctaactggagccta

SEQ ID NO: 274883 - DNA, 25 bp, Rattus norvegicus
ctgggttttccacgtatccaaagat

SEQ ID NO: 274884 - DNA, 25 bp, Rattus norvegicus
ctgggttttccaggtatccaaagat

SEQ ID NO: 274885 - DNA, 25 bp, Rattus norvegicus
ctgggttttgccaacacctgttata

SEQ ID NO: 274886 - DNA, 25 bp, Rattus norvegicus
ctgggttttgcctacacctgttata

SEQ ID NO: 274887 - DNA, 25 bp, Rattus norvegicus
ctgggttttgctactagttgcttga

SEQ ID NO: 274888 - DNA, 25 bp, Rattus norvegicus
ctgggttttgctcgctgtgtattta

SEQ ID NO: 274889 - DNA, 25 bp, Rattus norvegicus
ctgggttttgctggctgtgtattta

SEQ ID NO: 274890 - DNA, 25 bp, Rattus norvegicus
ctgggttttgcttctagttgcttga

SEQ ID NO: 274891 - DNA, 25 bp, Rattus norvegicus
ctggtaaaagctagaacacacgtgt

SEQ ID NO: 274892 - DNA, 25 bp, Rattus norvegicus
ctggtaaaagcttgaacacacgtgt

SEQ ID NO: 274893 - DNA, 25 bp, Rattus norvegicus
ctggtaaacttcaatgccttctatt

SEQ ID NO: 274894 - DNA, 25 bp, Rattus norvegicus
ctggtaaacttctatgccttctatt

SEQ ID NO: 274895 - DNA, 25 bp, Rattus norvegicus
ctggtaacagtaaggctgggcccca

SEQ ID NO: 274896 - DNA, 25 bp, Rattus norvegicus
ctggtaacagtatggctgggcccca

SEQ ID NO: 274897 - DNA, 25 bp, Rattus norvegicus
ctggtaacccagattgcttgagaat

SEQ ID NO: 274898 - DNA, 25 bp, Rattus norvegicus
ctggtaacccagtttgcttgagaat

SEQ ID NO: 274899 - DNA, 25 bp, Rattus norvegicus
ctggtaacttgtcatcattgaggaa

SEQ ID NO: 274900 - DNA, 25 bp, Rattus norvegicus
ctggtaacttgtgatcattgaggaa

SEQ ID NO: 274901 - DNA, 25 bp, Rattus norvegicus
ctggtaagactgcactacgcctgtg

SEQ ID NO: 274902 - DNA, 25 bp, Rattus norvegicus
ctggtaagactggactacgcctgtg

SEQ ID NO: 274903 - DNA, 25 bp, Rattus norvegicus
ctggtaagggctcaggctctgaact

SEQ ID NO: 274904 - DNA, 25 bp, Rattus norvegicus
ctggtaagggctgaggctctgaact

SEQ ID NO: 274905 - DNA, 25 bp, Rattus norvegicus
ctggtaatactgagacttcccgtct

SEQ ID NO: 274906 - DNA, 25 bp, Rattus norvegicus
ctggtaatactgtgacttcccgtct

SEQ ID NO: 274907 - DNA, 25 bp, Rattus norvegicus
ctggtaatccttagtaactgtagta

SEQ ID NO: 274908 - DNA, 25 bp, Rattus norvegicus
ctggtaatcctttgtaactgtagta

SEQ ID NO: 274909 - DNA, 25 bp, Rattus norvegicus
ctggtaattatgaatagctagtgat

SEQ ID NO: 274910 - DNA, 25 bp, Rattus norvegicus
ctggtaattatgtatagctagtgat

SEQ ID NO: 274911 - DNA, 25 bp, Rattus norvegicus
ctggtaattcatactttttctttgt

SEQ ID NO: 274912 - DNA, 25 bp, Rattus norvegicus
ctggtaattcattctttttctttgt

SEQ ID NO: 274913 - DNA, 25 bp, Rattus norvegicus
ctggtacacttcatctgcactgtat

SEQ ID NO: 274914 - DNA, 25 bp, Rattus norvegicus
ctggtacacttcttctgcactgtat

SEQ ID NO: 274915 - DNA, 25 bp, Rattus norvegicus
ctggtacagcaacgctcagcgcagc

SEQ ID NO: 274916 - DNA, 25 bp, Rattus norvegicus
ctggtacagcaaggctcagcgcagc

SEQ ID NO: 274917 - DNA, 25 bp, Rattus norvegicus
ctggtacatcagagccaagagcaaa

SEQ ID NO: 274918 - DNA, 25 bp, Rattus norvegicus
ctggtacatcagtgccaagagcaaa

SEQ ID NO: 274919 - DNA, 25 bp, Rattus norvegicus
ctggtacccaatctcaggtctggaa

SEQ ID NO: 274920 - DNA, 25 bp, Rattus norvegicus
ctggtacccaatgtcaggtctggaa

SEQ ID NO: 274921 - DNA, 25 bp, Rattus norvegicus
ctggtacccacaagtctggtagtat

SEQ ID NO: 274922 - DNA, 25 bp, Rattus norvegicus
ctggtacccacatgtctggtagtat

SEQ ID NO: 274923 - DNA, 25 bp, Rattus norvegicus
ctggtacctcttactacctattgta

SEQ ID NO: 274924 - DNA, 25 bp, Rattus norvegicus
ctggtacctctttctacctattgta

SEQ ID NO: 274925 - DNA, 25 bp, Rattus norvegicus
ctggtacctgagaagcaactattga

SEQ ID NO: 274926 - DNA, 25 bp, Rattus norvegicus
ctggtacctgagatctgagattgta

SEQ ID NO: 274927 - DNA, 25 bp, Rattus norvegicus
ctggtacctgagtagcaactattga

SEQ ID NO: 274928 - DNA, 25 bp, Rattus norvegicus
ctggtacctgagttctgagattgta

SEQ ID NO: 274929 - DNA, 25 bp, Rattus norvegicus
ctggtacctgtgacctgctcggaac

SEQ ID NO: 274930 - DNA, 25 bp, Rattus norvegicus
ctggtacctgtgtcctgctcggaac

SEQ ID NO: 274931 - DNA, 25 bp, Rattus norvegicus
ctggtactcattctgtagcctggct

SEQ ID NO: 274932 - DNA, 25 bp, Rattus norvegicus
ctggtactcattgtgtagcctggct

SEQ ID NO: 274933 - DNA, 25 bp, Rattus norvegicus
ctggtactgcccaaatggaatttat

SEQ ID NO: 274934 - DNA, 25 bp, Rattus norvegicus
ctggtactgccctaatggaatttat

SEQ ID NO: 274935 - DNA, 25 bp, Rattus norvegicus
ctggtacttctacagcggctgctta

SEQ ID NO: 274936 - DNA, 25 bp, Rattus norvegicus
ctggtacttctagagcggctgctta

SEQ ID NO: 274937 - DNA, 25 bp, Rattus norvegicus
ctggtagaagccctgaccggtacac

SEQ ID NO: 274938 - DNA, 25 bp, Rattus norvegicus
ctggtagaagccgtgaccggtacac

SEQ ID NO: 274939 - DNA, 25 bp, Rattus norvegicus
ctggtagatttcctccttgactaaa

SEQ ID NO: 274940 - DNA, 25 bp, Rattus norvegicus
ctggtagatttcgtccttgactaaa

SEQ ID NO: 274941 - DNA, 25 bp, Rattus norvegicus
ctggtagccacacagaagcagtgag

SEQ ID NO: 274942 - DNA, 25 bp, Rattus norvegicus
ctggtagccacagagaagcagtgag

SEQ ID NO: 274943 - DNA, 25 bp, Rattus norvegicus
ctggtagccccaacttgagtccttg

SEQ ID NO: 274944 - DNA, 25 bp, Rattus norvegicus
ctggtagccccatcttgagtccttg

SEQ ID NO: 274945 - DNA, 25 bp, Rattus norvegicus
ctggtagcggacagggcgcggcaca

SEQ ID NO: 274946 - DNA, 25 bp, Rattus norvegicus
ctggtagcggactgggcgcggcaca

SEQ ID NO: 274947 - DNA, 25 bp, Rattus norvegicus
ctggtagcgttgctgcttctggttc

SEQ ID NO: 274948 - DNA, 25 bp, Rattus norvegicus
ctggtagcgttggtgcttctggttc

SEQ ID NO: 274949 - DNA, 25 bp, Rattus norvegicus
ctggtagggccaagtgcttatctta

SEQ ID NO: 274950 - DNA, 25 bp, Rattus norvegicus
ctggtagggccatgtgcttatctta

SEQ ID NO: 274951 - DNA, 25 bp, Rattus norvegicus
ctggtagtaaccatggtaacccatg

SEQ ID NO: 274952 - DNA, 25 bp, Rattus norvegicus
ctggtagtaaccttggtaacccatg

SEQ ID NO: 274953 - DNA, 25 bp, Rattus norvegicus
ctggtagtgcctactatggttgtat

SEQ ID NO: 274954 - DNA, 25 bp, Rattus norvegicus
ctggtagtgccttctatggttgtat

SEQ ID NO: 274955 - DNA, 25 bp, Rattus norvegicus
ctggtagtgttgaagtgccccgtct

SEQ ID NO: 274956 - DNA, 25 bp, Rattus norvegicus
ctggtagtgttgtagtgccccgtct

SEQ ID NO: 274957 - DNA, 25 bp, Rattus norvegicus
ctggtagttagtcttctgctgtctt

SEQ ID NO: 274958 - DNA, 25 bp, Rattus norvegicus
ctggtagttagtgttctgctgtctt

SEQ ID NO: 274959 - DNA, 25 bp, Rattus norvegicus
ctggtagttggcactgaaaaccttt

SEQ ID NO: 274960 - DNA, 25 bp, Rattus norvegicus
ctggtagttggctctgaaaaccttt

SEQ ID NO: 274961 - DNA, 25 bp, Rattus norvegicus
ctggtatcggctccggtaatgacct

SEQ ID NO: 274962 - DNA, 25 bp, Rattus norvegicus
ctggtatcggctgcggtaatgacct

SEQ ID NO: 274963 - DNA, 25 bp, Rattus norvegicus
ctggtatgctctcttgcttgattgc

SEQ ID NO: 274964 - DNA, 25 bp, Rattus norvegicus
ctggtatgctctgttgcttgattgc

SEQ ID NO: 274965 - DNA, 25 bp, Rattus norvegicus
ctggtatgcttcagtgcaaatctaa

SEQ ID NO: 274966 - DNA, 25 bp, Rattus norvegicus
ctggtatgcttctgtgcaaatctaa

SEQ ID NO: 274967 - DNA, 25 bp, Rattus norvegicus
ctggtattaaacagggtgtggcact

SEQ ID NO: 274968 - DNA, 25 bp, Rattus norvegicus
ctggtattaaactgggtgtggcact

SEQ ID NO: 274969 - DNA, 25 bp, Rattus norvegicus
ctggtattacagcaaaagtcacata

SEQ ID NO: 274970 - DNA, 25 bp, Rattus norvegicus
ctggtattacaggaaaagtcacata

SEQ ID NO: 274971 - DNA, 25 bp, Rattus norvegicus
ctggtattccaaagcgccgggtcac

SEQ ID NO: 274972 - DNA, 25 bp, Rattus norvegicus
ctggtattccaatgcgccgggtcac

SEQ ID NO: 274973 - DNA, 25 bp, Rattus norvegicus
ctggtattggatccgtggctcgaac

SEQ ID NO: 274974 - DNA, 25 bp, Rattus norvegicus
ctggtattggatgcgtggctcgaac

SEQ ID NO: 274975 - DNA, 25 bp, Rattus norvegicus
ctggtattgtagctccagcggctat

SEQ ID NO: 274976 - DNA, 25 bp, Rattus norvegicus
ctggtattgtaggtccagcggctat

SEQ ID NO: 274977 - DNA, 25 bp, Rattus norvegicus
ctggtatttcatatttgagattttt

SEQ ID NO: 274978 - DNA, 25 bp, Rattus norvegicus
ctggtatttcatttttgagattttt

SEQ ID NO: 274979 - DNA, 25 bp, Rattus norvegicus
ctggtattttagatcccactctgct

SEQ ID NO: 274980 - DNA, 25 bp, Rattus norvegicus
ctggtattttagttcccactctgct

SEQ ID NO: 274981 - DNA, 25 bp, Rattus norvegicus
ctggtcaaataacccctttagcaag

SEQ ID NO: 274982 - DNA, 25 bp, Rattus norvegicus
ctggtcaaataagccctttagcaag

SEQ ID NO: 274983 - DNA, 25 bp, Rattus norvegicus
ctggtcaacaaaacctctgctttaa

SEQ ID NO: 274984 - DNA, 25 bp, Rattus norvegicus
ctggtcaacaaatcctctgctttaa

SEQ ID NO: 274985 - DNA, 25 bp, Rattus norvegicus
ctggtcaacagcacaaaagtaagta

SEQ ID NO: 274986 - DNA, 25 bp, Rattus norvegicus
ctggtcaacagctcaaaagtaagta

SEQ ID NO: 274987 - DNA, 25 bp, Rattus norvegicus
ctggtcaccagtacttgtatggtga

SEQ ID NO: 274988 - DNA, 25 bp, Rattus norvegicus
ctggtcaccagttcttgtatggtga

SEQ ID NO: 274989 - DNA, 25 bp, Rattus norvegicus
ctggtcacgttgactgggcagcaca

SEQ ID NO: 274990 - DNA, 25 bp, Rattus norvegicus
ctggtcacgttgtctgggcagcaca

SEQ ID NO: 274991 - DNA, 25 bp, Rattus norvegicus
ctggtcagcactaccttctaaagga

SEQ ID NO: 274992 - DNA, 25 bp, Rattus norvegicus
ctggtcagcacttccttctaaagga

SEQ ID NO: 274993 - DNA, 25 bp, Rattus norvegicus
ctggtcagttggatcaaggctcaca

SEQ ID NO: 274994 - DNA, 25 bp, Rattus norvegicus
ctggtcagttggttcaaggctcaca

SEQ ID NO: 274995 - DNA, 25 bp, Rattus norvegicus
ctggtcataaggaattattcactgt

SEQ ID NO: 274996 - DNA, 25 bp, Rattus norvegicus
ctggtcataaggtattattcactgt

SEQ ID NO: 274997 - DNA, 25 bp, Rattus norvegicus
ctggtcatgtggcatgcctgtgtat

SEQ ID NO: 274998 - DNA, 25 bp, Rattus norvegicus
ctggtcatgtgggatgcctgtgtat

SEQ ID NO: 274999 - DNA, 25 bp, Rattus norvegicus
ctggtccaaaaaagcaagtgtctgt

SEQ ID NO: 275000 - DNA, 25 bp, Rattus norvegicus
ctggtccaaaaatgcaagtgtctgt

SEQ ID NO: 275001 - DNA, 25 bp, Rattus norvegicus
ctggtccaaacactagcttttcaac

SEQ ID NO: 275002 - DNA, 25 bp, Rattus norvegicus
ctggtccaaacagtagcttttcaac

SEQ ID NO: 275003 - DNA, 25 bp, Rattus norvegicus
ctggtccaaggacagagacttctga

SEQ ID NO: 275004 - DNA, 25 bp, Rattus norvegicus
ctggtccaaggagagagacttctga

SEQ ID NO: 275005 - DNA, 25 bp, Rattus norvegicus
ctggtccactgtagggcattgatgc

SEQ ID NO: 275006 - DNA, 25 bp, Rattus norvegicus
ctggtccactgttgggcattgatgc

SEQ ID NO: 275007 - DNA, 25 bp, Rattus norvegicus
ctggtccagcctcagcaagagaata

SEQ ID NO: 275008 - DNA, 25 bp, Rattus norvegicus
ctggtccagcctgagcaagagaata

SEQ ID NO: 275009 - DNA, 25 bp, Rattus norvegicus
ctggtcccaaacacatgtaactact

SEQ ID NO: 275010 - DNA, 25 bp, Rattus norvegicus
ctggtcccaaactcatgtaactact

SEQ ID NO: 275011 - DNA, 25 bp, Rattus norvegicus
ctggtccctccacgtaacttgatga

SEQ ID NO: 275012 - DNA, 25 bp, Rattus norvegicus
ctggtccctccaggtaacttgatga

SEQ ID NO: 275013 - DNA, 25 bp, Rattus norvegicus
ctggtccctggaaacgtcatatatt

SEQ ID NO: 275014 - DNA, 25 bp, Rattus norvegicus
ctggtccctggatacgtcatatatt

SEQ ID NO: 275015 - DNA, 25 bp, Rattus norvegicus
ctggtccctgtaattcttttgggtg

SEQ ID NO: 275016 - DNA, 25 bp, Rattus norvegicus
ctggtccctgtatttcttttgggtg

SEQ ID NO: 275017 - DNA, 25 bp, Rattus norvegicus
ctggtccctgtgctatgctgagtac

SEQ ID NO: 275018 - DNA, 25 bp, Rattus norvegicus
ctggtccctgtggtatgctgagtac

SEQ ID NO: 275019 - DNA, 25 bp, Rattus norvegicus
ctggtcctcagtcccttcaaataaa

SEQ ID NO: 275020 - DNA, 25 bp, Rattus norvegicus
ctggtcctcagtgccttcaaataaa

SEQ ID NO: 275021 - DNA, 25 bp, Rattus norvegicus
ctggtcctcctccttgtagcaagtc

SEQ ID NO: 275022 - DNA, 25 bp, Rattus norvegicus
ctggtcctcctcgttgtagcaagtc

SEQ ID NO: 275023 - DNA, 25 bp, Rattus norvegicus
ctggtcctctggcttgtttggcaag

SEQ ID NO: 275024 - DNA, 25 bp, Rattus norvegicus
ctggtcctctgggttgtttggcaag

SEQ ID NO: 275025 - DNA, 25 bp, Rattus norvegicus
ctggtcctctttacctgatacaaaa

SEQ ID NO: 275026 - DNA, 25 bp, Rattus norvegicus
ctggtcctcttttcctgatacaaaa

SEQ ID NO: 275027 - DNA, 25 bp, Rattus norvegicus
ctggtcctgggaagtgtgtatacac

SEQ ID NO: 275028 - DNA, 25 bp, Rattus norvegicus
ctggtcctgggatgtgtgtatacac

SEQ ID NO: 275029 - DNA, 25 bp, Rattus norvegicus
ctggtcctgtccctggttaaaatga

SEQ ID NO: 275030 - DNA, 25 bp, Rattus norvegicus
ctggtcctgtccgtggttaaaatga

SEQ ID NO: 275031 - DNA, 25 bp, Rattus norvegicus
ctggtcctgtttcattctgagtttt

SEQ ID NO: 275032 - DNA, 25 bp, Rattus norvegicus
ctggtcctgtttgattctgagtttt

SEQ ID NO: 275033 - DNA, 25 bp, Rattus norvegicus
ctggtcggccgaccaatctaaggtt

SEQ ID NO: 275034 - DNA, 25 bp, Rattus norvegicus
ctggtcggccgagcaatctaaggtt

SEQ ID NO: 275035 - DNA, 25 bp, Rattus norvegicus
ctggtcggtgaacagagtgcactcc

SEQ ID NO: 275036 - DNA, 25 bp, Rattus norvegicus
ctggtcggtgaagagagtgcactcc

SEQ ID NO: 275037 - DNA, 25 bp, Rattus norvegicus
ctggtctataatctagtacatactg

SEQ ID NO: 275038 - DNA, 25 bp, Rattus norvegicus
ctggtctataatgtagtacatactg

SEQ ID NO: 275039 - DNA, 25 bp, Rattus norvegicus
ctggtctccgttcatggctacatga

SEQ ID NO: 275040 - DNA, 25 bp, Rattus norvegicus
ctggtctccgttgatggctacatga

SEQ ID NO: 275041 - DNA, 25 bp, Rattus norvegicus
ctggtctcgctcctgttgaagtgtg

SEQ ID NO: 275042 - DNA, 25 bp, Rattus norvegicus
ctggtctcgctcgtgttgaagtgtg

SEQ ID NO: 275043 - DNA, 25 bp, Rattus norvegicus
ctggtctctgagcacttagtggcca

SEQ ID NO: 275044 - DNA, 25 bp, Rattus norvegicus
ctggtctctgagctcatgaagacac

SEQ ID NO: 275045 - DNA, 25 bp, Rattus norvegicus
ctggtctctgaggacttagtggcca

SEQ ID NO: 275046 - DNA, 25 bp, Rattus norvegicus
ctggtctctgaggtcatgaagacac

SEQ ID NO: 275047 - DNA, 25 bp, Rattus norvegicus
ctggtctctttgctgacctatttaa

SEQ ID NO: 275048 - DNA, 25 bp, Rattus norvegicus
ctggtctctttggtgacctatttaa

SEQ ID NO: 275049 - DNA, 25 bp, Rattus norvegicus
ctggtctgcctactgagtttcacat

SEQ ID NO: 275050 - DNA, 25 bp, Rattus norvegicus
ctggtctgcctagtgagtttcacat

SEQ ID NO: 275051 - DNA, 25 bp, Rattus norvegicus
ctggtctggacacagtgcccgtgtc

SEQ ID NO: 275052 - DNA, 25 bp, Rattus norvegicus
ctggtctggacagagtgcccgtgtc

SEQ ID NO: 275053 - DNA, 25 bp, Rattus norvegicus
ctggtctgtggtcaacttgattgtc

SEQ ID NO: 275054 - DNA, 25 bp, Rattus norvegicus
ctggtctgtggtgaacttgattgtc

SEQ ID NO: 275055 - DNA, 25 bp, Rattus norvegicus
ctggtctgttagctaattgaaggca

SEQ ID NO: 275056 - DNA, 25 bp, Rattus norvegicus
ctggtctgttaggtaattgaaggca

SEQ ID NO: 275057 - DNA, 25 bp, Rattus norvegicus
ctggtcttcagtacttgttccttag

SEQ ID NO: 275058 - DNA, 25 bp, Rattus norvegicus
ctggtcttcagttcttgttccttag

SEQ ID NO: 275059 - DNA, 25 bp, Rattus norvegicus
ctggtcttcctgcattgctgagaaa

SEQ ID NO: 275060 - DNA, 25 bp, Rattus norvegicus
ctggtcttcctggattgctgagaaa

SEQ ID NO: 275061 - DNA, 25 bp, Rattus norvegicus
ctggtgaagactaggcagtcagact

SEQ ID NO: 275062 - DNA, 25 bp, Rattus norvegicus
ctggtgaagacttggcagtcagact

SEQ ID NO: 275063 - DNA, 25 bp, Rattus norvegicus
ctggtgaagtgcaggtgtacgctca

SEQ ID NO: 275064 - DNA, 25 bp, Rattus norvegicus
ctggtgaagtgctggtgtacgctca

SEQ ID NO: 275065 - DNA, 25 bp, Rattus norvegicus
ctggtgaccaggacattgcttggct

SEQ ID NO: 275066 - DNA, 25 bp, Rattus norvegicus
ctggtgaccaggtcattgcttggct

SEQ ID NO: 275067 - DNA, 25 bp, Rattus norvegicus
ctggtgacctgaaacttcccataaa

SEQ ID NO: 275068 - DNA, 25 bp, Rattus norvegicus
ctggtgacctgatacttcccataaa

SEQ ID NO: 275069 - DNA, 25 bp, Rattus norvegicus
ctggtgactccactgcgcatggtga

SEQ ID NO: 275070 - DNA, 25 bp, Rattus norvegicus
ctggtgactccagtgcgcatggtga

SEQ ID NO: 275071 - DNA, 25 bp, Rattus norvegicus
ctggtgagacttcctgatcctggga

SEQ ID NO: 275072 - DNA, 25 bp, Rattus norvegicus
ctggtgagacttgctgatcctggga

SEQ ID NO: 275073 - DNA, 25 bp, Rattus norvegicus
ctggtgagcaccatggttccattgc

SEQ ID NO: 275074 - DNA, 25 bp, Rattus norvegicus
ctggtgagcaccttggttccattgc

SEQ ID NO: 275075 - DNA, 25 bp, Rattus norvegicus
ctggtgatcactctgcagggcttaa

SEQ ID NO: 275076 - DNA, 25 bp, Rattus norvegicus
ctggtgatcactgtgcagggcttaa

SEQ ID NO: 275077 - DNA, 25 bp, Rattus norvegicus
ctggtgatccagaggcgggacacat

SEQ ID NO: 275078 - DNA, 25 bp, Rattus norvegicus
ctggtgatccagtggcgggacacat

SEQ ID NO: 275079 - DNA, 25 bp, Rattus norvegicus
ctggtgatgcagactttaaaaacaa

SEQ ID NO: 275080 - DNA, 25 bp, Rattus norvegicus
ctggtgatgcagtctttaaaaacaa

SEQ ID NO: 275081 - DNA, 25 bp, Rattus norvegicus
ctggtgatggtgcacgctcttaaga

SEQ ID NO: 275082 - DNA, 25 bp, Rattus norvegicus
ctggtgatggtggacgctcttaaga

SEQ ID NO: 275083 - DNA, 25 bp, Rattus norvegicus
ctggtgcacagaaaacattagtagg

SEQ ID NO: 275084 - DNA, 25 bp, Rattus norvegicus
ctggtgcacagataacattagtagg

SEQ ID NO: 275085 - DNA, 25 bp, Rattus norvegicus
ctggtgcaccagatgacggaacttt

SEQ ID NO: 275086 - DNA, 25 bp, Rattus norvegicus
ctggtgcaccagttgacggaacttt

SEQ ID NO: 275087 - DNA, 20 bp, Rattus norvegicus
ctggtgcatccctatacagc

SEQ ID NO: 275088 - DNA, 25 bp, Rattus norvegicus
ctggtgcatgaaataagtccccttt

SEQ ID NO: 275089 - DNA, 25 bp, Rattus norvegicus
ctggtgcatgaattaagtccccttt

SEQ ID NO: 275090 - DNA, 25 bp, Rattus norvegicus
ctggtgcatgttcttctctggaaaa

SEQ ID NO: 275091 - DNA, 25 bp, Rattus norvegicus
ctggtgcatgttgttctctggaaaa

SEQ ID NO: 275092 - DNA, 25 bp, Rattus norvegicus
ctggtgccacttatactagaaactt

SEQ ID NO: 275093 - DNA, 25 bp, Rattus norvegicus
ctggtgccacttttactagaaactt

SEQ ID NO: 275094 - DNA, 25 bp, Rattus norvegicus
ctggtgccaggcatggtgagcaaac

SEQ ID NO: 275095 - DNA, 25 bp, Rattus norvegicus
ctggtgccaggcttggtgagcaaac

SEQ ID NO: 275096 - DNA, 25 bp, Rattus norvegicus
ctggtgcccacacaatccaaaggaa

SEQ ID NO: 275097 - DNA, 25 bp, Rattus norvegicus
ctggtgcccacagaatccaaaggaa

SEQ ID NO: 275098 - DNA, 25 bp, Rattus norvegicus
ctggtgcccagacactgacagcctg

SEQ ID NO: 275099 - DNA, 25 bp, Rattus norvegicus
ctggtgcccagagactgacagcctg

SEQ ID NO: 275100 - DNA, 25 bp, Rattus norvegicus
ctggtgcccatgcagcactgcataa

SEQ ID NO: 275101 - DNA, 25 bp, Rattus norvegicus
ctggtgcccatggagcactgcataa

SEQ ID NO: 275102 - DNA, 25 bp, Rattus norvegicus
ctggtgccccatcagacctaagaaa

SEQ ID NO: 275103 - DNA, 25 bp, Rattus norvegicus
ctggtgccccatgagacctaagaaa

SEQ ID NO: 275104 - DNA, 25 bp, Rattus norvegicus
ctggtgcccttacccaaggagatga

SEQ ID NO: 275105 - DNA, 25 bp, Rattus norvegicus
ctggtgcccttagccaaggagatga

SEQ ID NO: 275106 - DNA, 25 bp, Rattus norvegicus
ctggtgccgccacctttgtgatggt

SEQ ID NO: 275107 - DNA, 25 bp, Rattus norvegicus
ctggtgccgccagctttgtgatggt

SEQ ID NO: 275108 - DNA, 25 bp, Rattus norvegicus
ctggtgcctcacagggctgaaactc

SEQ ID NO: 275109 - DNA, 25 bp, Rattus norvegicus
ctggtgcctcactgggctgaaactc

SEQ ID NO: 275110 - DNA, 20 bp, Rattus norvegicus
ctggtgcctccctatacagc

SEQ ID NO: 275111 - DNA, 25 bp, Rattus norvegicus
ctggtgcctgagacctcattccggc

SEQ ID NO: 275112 - DNA, 25 bp, Rattus norvegicus
ctggtgcctgagtcctcattccggc

SEQ ID NO: 275113 - DNA, 25 bp, Rattus norvegicus
ctggtgcctggacactctaagggaa

SEQ ID NO: 275114 - DNA, 25 bp, Rattus norvegicus
ctggtgcctggagactctaagggaa

SEQ ID NO: 275115 - DNA, 25 bp, Rattus norvegicus
ctggtgcgagatacgagccctggac

SEQ ID NO: 275116 - DNA, 25 bp, Rattus norvegicus
ctggtgcgagattcgagccctggac

SEQ ID NO: 275117 - DNA, 20 bp, Rattus norvegicus
ctggtgcgtccctatacagc

SEQ ID NO: 275118 - DNA, 25 bp, Rattus norvegicus
ctggtgctcaacacacagtaggcct

SEQ ID NO: 275119 - DNA, 25 bp, Rattus norvegicus
ctggtgctcaactcacagtaggcct

SEQ ID NO: 275120 - DNA, 25 bp, Rattus norvegicus
ctggtgctcattcccttctgcgtta

SEQ ID NO: 275121 - DNA, 25 bp, Rattus norvegicus
ctggtgctcattgccttctgcgtta

SEQ ID NO: 275122 - DNA, 25 bp, Rattus norvegicus
ctggtgctccttccagcagtagaag

SEQ ID NO: 275123 - DNA, 25 bp, Rattus norvegicus
ctggtgctccttgcagcagtagaag

SEQ ID NO: 275124 - DNA, 25 bp, Rattus norvegicus
ctggtgctgctgatgattgccacac

SEQ ID NO: 275125 - DNA, 25 bp, Rattus norvegicus
ctggtgctgctgttgattgccacac

SEQ ID NO: 275126 - DNA, 25 bp, Rattus norvegicus
ctggtgctggatctgctgtcattac

SEQ ID NO: 275127 - DNA, 25 bp, Rattus norvegicus
ctggtgctggatgtgctgtcattac

SEQ ID NO: 275128 - DNA, 25 bp, Rattus norvegicus
ctggtgctggcactggtgttcaata

SEQ ID NO: 275129 - DNA, 25 bp, Rattus norvegicus
ctggtgctggcagtggtgttcaata

SEQ ID NO: 275130 - DNA, 25 bp, Rattus norvegicus
ctggtgctgggtcatggtcatatct

SEQ ID NO: 275131 - DNA, 25 bp, Rattus norvegicus
ctggtgctgggtgatggtcatatct

SEQ ID NO: 275132 - DNA, 25 bp, Rattus norvegicus
ctggtgctgtgtccctcaagcccaa

SEQ ID NO: 275133 - DNA, 25 bp, Rattus norvegicus
ctggtgctgtgtgcctcaagcccaa

SEQ ID NO: 275134 - DNA, 20 bp, Rattus norvegicus
ctggtgcttccctatacagc

SEQ ID NO: 275135 - DNA, 25 bp, Rattus norvegicus
ctggtggaaatcaatgtttcttctt

SEQ ID NO: 275136 - DNA, 25 bp, Rattus norvegicus
ctggtggaaatctatgtttcttctt

SEQ ID NO: 275137 - DNA, 25 bp, Rattus norvegicus
ctggtggaatctcacaggcagttct

SEQ ID NO: 275138 - DNA, 25 bp, Rattus norvegicus
ctggtggaatctgacaggcagttct

SEQ ID NO: 275139 - DNA, 25 bp, Rattus norvegicus
ctggtggaccacctattatgggcaa

SEQ ID NO: 275140 - DNA, 25 bp, Rattus norvegicus
ctggtggaccacgtattatgggcaa

SEQ ID NO: 275141 - DNA, 25 bp, Rattus norvegicus
ctggtggagctcattggaaaggatt

SEQ ID NO: 275142 - DNA, 25 bp, Rattus norvegicus
ctggtggagctctttggaaaggatt

SEQ ID NO: 275143 - DNA, 25 bp, Rattus norvegicus
ctggtggagggcatatttctgaaat

SEQ ID NO: 275144 - DNA, 25 bp, Rattus norvegicus
ctggtggagggcttatttctgaaat

SEQ ID NO: 275145 - DNA, 25 bp, Rattus norvegicus
ctggtggatgccatgtttctgaaac

SEQ ID NO: 275146 - DNA, 25 bp, Rattus norvegicus
ctggtggatgccttgtttctgaaac

SEQ ID NO: 275147 - DNA, 25 bp, Rattus norvegicus
ctggtggcacccataattcaataaa

SEQ ID NO: 275148 - DNA, 25 bp, Rattus norvegicus
ctggtggcacccttaattcaataaa

SEQ ID NO: 275149 - DNA, 25 bp, Rattus norvegicus
ctggtggcatgactgggcttcccaa

SEQ ID NO: 275150 - DNA, 25 bp, Rattus norvegicus
ctggtggcatgagtgggcttcccaa

SEQ ID NO: 275151 - DNA, 25 bp, Rattus norvegicus
ctggtggccaggcaatgaactgcta

SEQ ID NO: 275152 - DNA, 25 bp, Rattus norvegicus
ctggtggccagggaatgaactgcta

SEQ ID NO: 275153 - DNA, 25 bp, Rattus norvegicus
ctggtggcccacaagtacaagaaga

SEQ ID NO: 275154 - DNA, 25 bp, Rattus norvegicus
ctggtggcccactagtacaagaaga

SEQ ID NO: 275155 - DNA, 25 bp, Rattus norvegicus
ctggtggcccttctgaggacagaac

SEQ ID NO: 275156 - DNA, 25 bp, Rattus norvegicus
ctggtggcccttcttgctgtaagaa

SEQ ID NO: 275157 - DNA, 25 bp, Rattus norvegicus
ctggtggcccttgtgaggacagaac

SEQ ID NO: 275158 - DNA, 25 bp, Rattus norvegicus
ctggtggcccttgttgctgtaagaa

SEQ ID NO: 275159 - DNA, 25 bp, Rattus norvegicus
ctggtggcctcgagcaagtgcaagc

SEQ ID NO: 275160 - DNA, 25 bp, Rattus norvegicus
ctggtggcctcgtgcaagtgcaagc

SEQ ID NO: 275161 - DNA, 25 bp, Rattus norvegicus
ctggtggccttcagctcctgtctgg

SEQ ID NO: 275162 - DNA, 25 bp, Rattus norvegicus
ctggtggccttctgctcctgtctgg

SEQ ID NO: 275163 - DNA, 25 bp, Rattus norvegicus
ctggtggcgacgagcagcaacattc

SEQ ID NO: 275164 - DNA, 25 bp, Rattus norvegicus
ctggtggcgacgtgcagcaacattc

SEQ ID NO: 275165 - DNA, 25 bp, Rattus norvegicus
ctggtggctcaaaaagggtctgttc

SEQ ID NO: 275166 - DNA, 25 bp, Rattus norvegicus
ctggtggctcaataagggtctgttc

SEQ ID NO: 275167 - DNA, 25 bp, Rattus norvegicus
ctggtggctggaccaatgtaaatat

SEQ ID NO: 275168 - DNA, 25 bp, Rattus norvegicus
ctggtggctggagcaatgtaaatat

SEQ ID NO: 275169 - DNA, 25 bp, Rattus norvegicus
ctggtggctttcctcactggaaaat

SEQ ID NO: 275170 - DNA, 25 bp, Rattus norvegicus
ctggtggctttcgtcactggaaaat

SEQ ID NO: 275171 - DNA, 25 bp, Rattus norvegicus
ctggtgggacagattatgaaatgac

SEQ ID NO: 275172 - DNA, 25 bp, Rattus norvegicus
ctggtgggacagtttatgaaatgac

SEQ ID NO: 275173 - DNA, 25 bp, Rattus norvegicus
ctggtgggcctcatcaatgtttgat

SEQ ID NO: 275174 - DNA, 25 bp, Rattus norvegicus
ctggtgggcctcttcaatgtttgat

SEQ ID NO: 275175 - DNA, 25 bp, Rattus norvegicus
ctggtgggtctaccagcctggacca

SEQ ID NO: 275176 - DNA, 25 bp, Rattus norvegicus
ctggtgggtctagcagcctggacca

SEQ ID NO: 275177 - DNA, 25 bp, Rattus norvegicus
ctggtgggttttactttagtgacat

SEQ ID NO: 275178 - DNA, 25 bp, Rattus norvegicus
ctggtgggtttttctttagtgacat

SEQ ID NO: 275179 - DNA, 25 bp, Rattus norvegicus
ctggtggtcaagaataataatcata

SEQ ID NO: 275180 - DNA, 25 bp, Rattus norvegicus
ctggtggtcaagtataataatcata

SEQ ID NO: 275181 - DNA, 25 bp, Rattus norvegicus
ctggtggtctgcatgataggcgtca

SEQ ID NO: 275182 - DNA, 25 bp, Rattus norvegicus
ctggtggtctgcttgataggcgtca

SEQ ID NO: 275183 - DNA, 25 bp, Rattus norvegicus
ctggtggtctggagtacctggtact

SEQ ID NO: 275184 - DNA, 25 bp, Rattus norvegicus
ctggtggtctggtgtacctggtact

SEQ ID NO: 275185 - DNA, 25 bp, Rattus norvegicus
ctggtggtctttcgcatctgtggca

SEQ ID NO: 275186 - DNA, 25 bp, Rattus norvegicus
ctggtggtctttggcatctgtggca

SEQ ID NO: 275187 - DNA, 25 bp, Rattus norvegicus
ctggtggttgacatagggcatcctt

SEQ ID NO: 275188 - DNA, 25 bp, Rattus norvegicus
ctggtggttgacttagggcatcctt

SEQ ID NO: 275189 - DNA, 25 bp, Rattus norvegicus
ctggtggttgccacagatgaactga

SEQ ID NO: 275190 - DNA, 25 bp, Rattus norvegicus
ctggtggttgcctcagatgaactga

SEQ ID NO: 275191 - DNA, 25 bp, Rattus norvegicus
ctggtggttgttcaacacacgcaca

SEQ ID NO: 275192 - DNA, 25 bp, Rattus norvegicus
ctggtggttgttgaacacacgcaca

SEQ ID NO: 275193 - DNA, 25 bp, Rattus norvegicus
ctggtgtaaataatttccattctta

SEQ ID NO: 275194 - DNA, 25 bp, Rattus norvegicus
ctggtgtaaatattttccattctta

SEQ ID NO: 275195 - DNA, 25 bp, Rattus norvegicus
ctggtgtaatccctaggcttcaacc

SEQ ID NO: 275196 - DNA, 25 bp, Rattus norvegicus
ctggtgtaatccgtaggcttcaacc

SEQ ID NO: 275197 - DNA, 25 bp, Rattus norvegicus
ctggtgtaatttccgatgtagttaa

SEQ ID NO: 275198 - DNA, 25 bp, Rattus norvegicus
ctggtgtaatttgcgatgtagttaa

SEQ ID NO: 275199 - DNA, 25 bp, Rattus norvegicus
ctggtgtaggagagcggcttcccca

SEQ ID NO: 275200 - DNA, 25 bp, Rattus norvegicus
ctggtgtaggagtgcggcttcccca

SEQ ID NO: 275201 - DNA, 25 bp, Rattus norvegicus
ctggtgtatggaatggaccaaatac

SEQ ID NO: 275202 - DNA, 25 bp, Rattus norvegicus
ctggtgtatggattggaccaaatac

SEQ ID NO: 275203 - DNA, 25 bp, Rattus norvegicus
ctggtgtcatagacaagctcttcaa

SEQ ID NO: 275204 - DNA, 25 bp, Rattus norvegicus
ctggtgtcatagtcaagctcttcaa

SEQ ID NO: 275205 - DNA, 25 bp, Rattus norvegicus
ctggtgtcatcacactttgggacgt

SEQ ID NO: 275206 - DNA, 25 bp, Rattus norvegicus
ctggtgtcatcagactttgggacgt

SEQ ID NO: 275207 - DNA, 25 bp, Rattus norvegicus
ctggtgtccattcgtctaggttgac

SEQ ID NO: 275208 - DNA, 25 bp, Rattus norvegicus
ctggtgtccattggtctaggttgac

SEQ ID NO: 275209 - DNA, 25 bp, Rattus norvegicus
ctggtgtctctcaaagtctggctaa

SEQ ID NO: 275210 - DNA, 25 bp, Rattus norvegicus
ctggtgtctctctaagtctggctaa

SEQ ID NO: 275211 - DNA, 25 bp, Rattus norvegicus
ctggtgtcttggagagcacaggctt

SEQ ID NO: 275212 - DNA, 25 bp, Rattus norvegicus
ctggtgtcttggtgagcacaggctt

SEQ ID NO: 275213 - DNA, 25 bp, Rattus norvegicus
ctggtgtgccaaattttataggaaa

SEQ ID NO: 275214 - DNA, 25 bp, Rattus norvegicus
ctggtgtgccaatttttataggaaa

SEQ ID NO: 275215 - DNA, 25 bp, Rattus norvegicus
ctggtgtgcctccagtgtgtaaaac

SEQ ID NO: 275216 - DNA, 25 bp, Rattus norvegicus
ctggtgtgcctcgagtgtgtaaaac

SEQ ID NO: 275217 - DNA, 25 bp, Rattus norvegicus
ctggtgtggccaccgtccccaggat

SEQ ID NO: 275218 - DNA, 25 bp, Rattus norvegicus
ctggtgtggccagcgtccccaggat

SEQ ID NO: 275219 - DNA, 25 bp, Rattus norvegicus
ctggtgtgggacagcctatgaagat

SEQ ID NO: 275220 - DNA, 25 bp, Rattus norvegicus
ctggtgtgggactgcctatgaagat

SEQ ID NO: 275221 - DNA, 25 bp, Rattus norvegicus
ctggtgttctcacacttcttgtgaa

SEQ ID NO: 275222 - DNA, 25 bp, Rattus norvegicus
ctggtgttctcagacttcttgtgaa

SEQ ID NO: 275223 - DNA, 25 bp, Rattus norvegicus
ctggtgttgcatccggagcctgaac

SEQ ID NO: 275224 - DNA, 25 bp, Rattus norvegicus
ctggtgttgcatgcggagcctgaac

SEQ ID NO: 275225 - DNA, 25 bp, Rattus norvegicus
ctggtgttggccaatgctctgcata

SEQ ID NO: 275226 - DNA, 25 bp, Rattus norvegicus
ctggtgttggcctatgctctgcata

SEQ ID NO: 275227 - DNA, 25 bp, Rattus norvegicus
ctggtgtttcagcaatgtcagctta

SEQ ID NO: 275228 - DNA, 25 bp, Rattus norvegicus
ctggtgtttcaggaatgtcagctta

SEQ ID NO: 275229 - DNA, 25 bp, Rattus norvegicus
ctggtgtttccaatattccgttaag

SEQ ID NO: 275230 - DNA, 25 bp, Rattus norvegicus
ctggtgtttccattattccgttaag

SEQ ID NO: 275231 - DNA, 25 bp, Rattus norvegicus
ctggtgtttctaagcatgtgacaaa

SEQ ID NO: 275232 - DNA, 25 bp, Rattus norvegicus
ctggtgtttctatgcatgtgacaaa

SEQ ID NO: 275233 - DNA, 25 bp, Rattus norvegicus
ctggtgtttctgattgacatttgtt

SEQ ID NO: 275234 - DNA, 25 bp, Rattus norvegicus
ctggtgtttctgtttgacatttgtt

SEQ ID NO: 275235 - DNA, 25 bp, Rattus norvegicus
ctggtgtttgtgagctgggacccaa

SEQ ID NO: 275236 - DNA, 25 bp, Rattus norvegicus
ctggtgtttgtgtgctgggacccaa

SEQ ID NO: 275237 - DNA, 25 bp, Rattus norvegicus
ctggttaaagtcaggccaccggact

SEQ ID NO: 275238 - DNA, 25 bp, Rattus norvegicus
ctggttaaagtctggccaccggact

SEQ ID NO: 275239 - DNA, 25 bp, Rattus norvegicus
ctggttaataccaagagccatttta

SEQ ID NO: 275240 - DNA, 25 bp, Rattus norvegicus
ctggttaatacctagagccatttta

SEQ ID NO: 275241 - DNA, 25 bp, Rattus norvegicus
ctggttacgcgcaggcttgtagagc

SEQ ID NO: 275242 - DNA, 25 bp, Rattus norvegicus
ctggttacgcgctggcttgtagagc

SEQ ID NO: 275243 - DNA, 25 bp, Rattus norvegicus
ctggttactgacactgcactgtagt

SEQ ID NO: 275244 - DNA, 25 bp, Rattus norvegicus
ctggttactgactctgcactgtagt

SEQ ID NO: 275245 - DNA, 25 bp, Rattus norvegicus
ctggttagtgtcaactcttggcaat

SEQ ID NO: 275246 - DNA, 25 bp, Rattus norvegicus
ctggttagtgtctactcttggcaat

SEQ ID NO: 275247 - DNA, 25 bp, Rattus norvegicus
ctggttatgagcagtgttacctcct

SEQ ID NO: 275248 - DNA, 25 bp, Rattus norvegicus
ctggttatgagctgtgttacctcct

SEQ ID NO: 275249 - DNA, 25 bp, Rattus norvegicus
ctggttattggaacagagactccca

SEQ ID NO: 275250 - DNA, 25 bp, Rattus norvegicus
ctggttattggatcagagactccca

SEQ ID NO: 275251 - DNA, 25 bp, Rattus norvegicus
ctggttatttgcattgcccgtgaaa

SEQ ID NO: 275252 - DNA, 25 bp, Rattus norvegicus
ctggttatttgctttgcccgtgaaa

SEQ ID NO: 275253 - DNA, 25 bp, Rattus norvegicus
ctggttcaaaggatctctctaagaa

SEQ ID NO: 275254 - DNA, 25 bp, Rattus norvegicus
ctggttcaaaggttctctctaagaa

SEQ ID NO: 275255 - DNA, 25 bp, Rattus norvegicus
ctggttcaacctctcatctaatatt

SEQ ID NO: 275256 - DNA, 25 bp, Rattus norvegicus
ctggttcaacctgtcatctaatatt

SEQ ID NO: 275257 - DNA, 25 bp, Rattus norvegicus
ctggttcagaggcagacttgttttt

SEQ ID NO: 275258 - DNA, 25 bp, Rattus norvegicus
ctggttcagagggagacttgttttt

SEQ ID NO: 275259 - DNA, 25 bp, Rattus norvegicus
ctggttcagtatactcttaggtcac

SEQ ID NO: 275260 - DNA, 25 bp, Rattus norvegicus
ctggttcagtattctcttaggtcac

SEQ ID NO: 275261 - DNA, 25 bp, Rattus norvegicus
ctggttccacacagctgtactagga

SEQ ID NO: 275262 - DNA, 25 bp, Rattus norvegicus
ctggttccacactgctgtactagga

SEQ ID NO: 275263 - DNA, 25 bp, Rattus norvegicus
ctggttccacagactaggcttttaa

SEQ ID NO: 275264 - DNA, 25 bp, Rattus norvegicus
ctggttccacagtctaggcttttaa

SEQ ID NO: 275265 - DNA, 25 bp, Rattus norvegicus
ctggttcccaggactgactggatga

SEQ ID NO: 275266 - DNA, 25 bp, Rattus norvegicus
ctggttcccaggtctgactggatga

SEQ ID NO: 275267 - DNA, 25 bp, Rattus norvegicus
ctggttctcagactcttaggtgtga

SEQ ID NO: 275268 - DNA, 25 bp, Rattus norvegicus
ctggttctcagagtcttaggtgtga

SEQ ID NO: 275269 - DNA, 25 bp, Rattus norvegicus
ctggttctctataaagcatgcattt

SEQ ID NO: 275270 - DNA, 25 bp, Rattus norvegicus
ctggttctctattaagcatgcattt

SEQ ID NO: 275271 - DNA, 25 bp, Rattus norvegicus
ctggttctgctcagtggttttctct

SEQ ID NO: 275272 - DNA, 25 bp, Rattus norvegicus
ctggttctgctctgtggttttctct

SEQ ID NO: 275273 - DNA, 25 bp, Rattus norvegicus
ctggttctgtctcagcgtgtgatgc

SEQ ID NO: 275274 - DNA, 25 bp, Rattus norvegicus
ctggttctgtctgagcgtgtgatgc

SEQ ID NO: 275275 - DNA, 25 bp, Rattus norvegicus
ctggttctgtttcagtggtcctaca

SEQ ID NO: 275276 - DNA, 25 bp, Rattus norvegicus
ctggttctgtttgagtggtcctaca

SEQ ID NO: 275277 - DNA, 25 bp, Rattus norvegicus
ctggttgaagtccacccgggctatg

SEQ ID NO: 275278 - DNA, 25 bp, Rattus norvegicus
ctggttgaagtcgacccgggctatg

SEQ ID NO: 275279 - DNA, 25 bp, Rattus norvegicus
ctggttgaatctagcacttagtgct

SEQ ID NO: 275280 - DNA, 25 bp, Rattus norvegicus
ctggttgaatcttgcacttagtgct

SEQ ID NO: 275281 - DNA, 25 bp, Rattus norvegicus
ctggttgactttaccaggttcttct

SEQ ID NO: 275282 - DNA, 25 bp, Rattus norvegicus
ctggttgacttttccaggttcttct

SEQ ID NO: 275283 - DNA, 25 bp, Rattus norvegicus
ctggttgagcacatgttctgaggac

SEQ ID NO: 275284 - DNA, 25 bp, Rattus norvegicus
ctggttgagcacttgttctgaggac

SEQ ID NO: 275285 - DNA, 25 bp, Rattus norvegicus
ctggttgagtaaccccgtcagtagc

SEQ ID NO: 275286 - DNA, 25 bp, Rattus norvegicus
ctggttgagtaagcccgtcagtagc

SEQ ID NO: 275287 - DNA, 25 bp, Rattus norvegicus
ctggttgccatgacctgggtctcct

SEQ ID NO: 275288 - DNA, 25 bp, Rattus norvegicus
ctggttgccatgcaaatagcagcca

SEQ ID NO: 275289 - DNA, 25 bp, Rattus norvegicus
ctggttgccatggaaatagcagcca

SEQ ID NO: 275290 - DNA, 25 bp, Rattus norvegicus
ctggttgccatgtcctgggtctcct

SEQ ID NO: 275291 - DNA, 25 bp, Rattus norvegicus
ctggttggctatcatcatggccttt

SEQ ID NO: 275292 - DNA, 25 bp, Rattus norvegicus
ctggttggctatgatcatggccttt

SEQ ID NO: 275293 - DNA, 25 bp, Rattus norvegicus
ctggttgtaataaggctgctggcct

SEQ ID NO: 275294 - DNA, 25 bp, Rattus norvegicus
ctggttgtaatatggctgctggcct

SEQ ID NO: 275295 - DNA, 25 bp, Rattus norvegicus
ctggttgtacagattgggatcccat

SEQ ID NO: 275296 - DNA, 25 bp, Rattus norvegicus
ctggttgtacagtttgggatcccat

SEQ ID NO: 275297 - DNA, 25 bp, Rattus norvegicus
ctggttgtactgagagcttgcttct

SEQ ID NO: 275298 - DNA, 25 bp, Rattus norvegicus
ctggttgtactgtgagcttgcttct

SEQ ID NO: 275299 - DNA, 25 bp, Rattus norvegicus
ctggttgtccttacttatgatccaa

SEQ ID NO: 275300 - DNA, 25 bp, Rattus norvegicus
ctggttgtcctttcttatgatccaa

SEQ ID NO: 275301 - DNA, 25 bp, Rattus norvegicus
ctggttgttgctatggaatcctgtc

SEQ ID NO: 275302 - DNA, 25 bp, Rattus norvegicus
ctggttgttgctttggaatcctgtc

SEQ ID NO: 275303 - DNA, 25 bp, Rattus norvegicus
ctggttgttttgattctgttcccta

SEQ ID NO: 275304 - DNA, 25 bp, Rattus norvegicus
ctggttgttttgtttctgttcccta

SEQ ID NO: 275305 - DNA, 25 bp, Rattus norvegicus
ctggtttaccaaatccatgatgcca

SEQ ID NO: 275306 - DNA, 25 bp, Rattus norvegicus
ctggtttaccaattccatgatgcca

SEQ ID NO: 275307 - DNA, 25 bp, Rattus norvegicus
ctggtttcctgccaatgtgagcaaa

SEQ ID NO: 275308 - DNA, 25 bp, Rattus norvegicus
ctggtttcctgcgaatgtgagcaaa

SEQ ID NO: 275309 - DNA, 25 bp, Rattus norvegicus
ctggtttcctggagagggtcctgca

SEQ ID NO: 275310 - DNA, 25 bp, Rattus norvegicus
ctggtttcctggtgagggtcctgca

SEQ ID NO: 275311 - DNA, 25 bp, Rattus norvegicus
ctggtttctcagagttgcagagtaa

SEQ ID NO: 275312 - DNA, 25 bp, Rattus norvegicus
ctggtttctcagcacctgcaggtgc

SEQ ID NO: 275313 - DNA, 25 bp, Rattus norvegicus
ctggtttctcaggacctgcaggtgc

SEQ ID NO: 275314 - DNA, 25 bp, Rattus norvegicus
ctggtttctcagtgttgcagagtaa

SEQ ID NO: 275315 - DNA, 25 bp, Rattus norvegicus
ctggtttgactacaattttcagggt

SEQ ID NO: 275316 - DNA, 25 bp, Rattus norvegicus
ctggtttgactagaattttcagggt

SEQ ID NO: 275317 - DNA, 25 bp, Rattus norvegicus
ctggtttgcatgagtggaaggtcta

SEQ ID NO: 275318 - DNA, 25 bp, Rattus norvegicus
ctggtttgcatgtgtggaaggtcta

SEQ ID NO: 275319 - DNA, 25 bp, Rattus norvegicus
ctggtttgtagcatcagtcacagaa

SEQ ID NO: 275320 - DNA, 25 bp, Rattus norvegicus
ctggtttgtagcttcagtcacagaa

SEQ ID NO: 275321 - DNA, 25 bp, Rattus norvegicus
ctggtttgtcatagttgccttttaa

SEQ ID NO: 275322 - DNA, 25 bp, Rattus norvegicus
ctggtttgtcattgttgccttttaa

SEQ ID NO: 275323 - DNA, 25 bp, Rattus norvegicus
ctggtttgttacacttccttcattt

SEQ ID NO: 275324 - DNA, 25 bp, Rattus norvegicus
ctggtttgttactcttccttcattt

SEQ ID NO: 275325 - DNA, 25 bp, Rattus norvegicus
ctggtttgttcaatagctattagat

SEQ ID NO: 275326 - DNA, 25 bp, Rattus norvegicus
ctggtttgttcattagctattagat

SEQ ID NO: 275327 - DNA, 25 bp, Rattus norvegicus
ctggtttgttgtaggttagctgatt

SEQ ID NO: 275328 - DNA, 25 bp, Rattus norvegicus
ctggtttgttgttggttagctgatt

SEQ ID NO: 275329 - DNA, 25 bp, Rattus norvegicus
ctggttttatttccctgctgctatg

SEQ ID NO: 275330 - DNA, 25 bp, Rattus norvegicus
ctggttttatttgcctgctgctatg

SEQ ID NO: 275331 - DNA, 25 bp, Rattus norvegicus
ctggttttcccaacatgagtgtaag

SEQ ID NO: 275332 - DNA, 25 bp, Rattus norvegicus
ctggttttcccatcatgagtgtaag

SEQ ID NO: 275333 - DNA, 25 bp, Rattus norvegicus
ctggttttcctcaagtgtacataga

SEQ ID NO: 275334 - DNA, 25 bp, Rattus norvegicus
ctggttttcctctagtgtacataga

SEQ ID NO: 275335 - DNA, 25 bp, Rattus norvegicus
ctggttttgcagatgacgtgattat

SEQ ID NO: 275336 - DNA, 25 bp, Rattus norvegicus
ctggttttgcagttgacgtgattat

SEQ ID NO: 275337 - DNA, 25 bp, Rattus norvegicus
ctggttttgcatccttcgtggaaga

SEQ ID NO: 275338 - DNA, 25 bp, Rattus norvegicus
ctggttttgcatgcttcgtggaaga

SEQ ID NO: 275339 - DNA, 25 bp, Rattus norvegicus
ctggttttgtgaatttctgcttctc

SEQ ID NO: 275340 - DNA, 25 bp, Rattus norvegicus
ctggttttgtgattttctgcttctc

SEQ ID NO: 275341 - DNA, 25 bp, Rattus norvegicus
ctggtttttatgaccatgtttccca

SEQ ID NO: 275342 - DNA, 25 bp, Rattus norvegicus
ctggtttttatgtccatgtttccca

SEQ ID NO: 275343 - DNA, 25 bp, Rattus norvegicus
ctggtttttctaactctaacgctgt

SEQ ID NO: 275344 - DNA, 25 bp, Rattus norvegicus
ctggtttttctatctctaacgctgt

SEQ ID NO: 275345 - DNA, 25 bp, Rattus norvegicus
ctgtaaaacctactgtcaggcccca

SEQ ID NO: 275346 - DNA, 25 bp, Rattus norvegicus
ctgtaaaacctagtgtcaggcccca

SEQ ID NO: 275347 - DNA, 25 bp, Rattus norvegicus
ctgtaaaagttcacctctgtaaaag

SEQ ID NO: 275348 - DNA, 25 bp, Rattus norvegicus
ctgtaaaagttctcctctgtaaaag

SEQ ID NO: 275349 - DNA, 25 bp, Rattus norvegicus
ctgtaaaattgtctcctcttgtgta

SEQ ID NO: 275350 - DNA, 25 bp, Rattus norvegicus
ctgtaaaattgtgtcctcttgtgta

SEQ ID NO: 275351 - DNA, 25 bp, Rattus norvegicus
ctgtaaacaggcaggcgggttcttt

SEQ ID NO: 275352 - DNA, 25 bp, Rattus norvegicus
ctgtaaacaggctggcgggttcttt

SEQ ID NO: 275353 - DNA, 25 bp, Rattus norvegicus
ctgtaaactggcatcttcatccttt

SEQ ID NO: 275354 - DNA, 25 bp, Rattus norvegicus
ctgtaaactggcttcttcatccttt

SEQ ID NO: 275355 - DNA, 25 bp, Rattus norvegicus
ctgtaaagacagatgggaactcgtg

SEQ ID NO: 275356 - DNA, 25 bp, Rattus norvegicus
ctgtaaagacagttgggaactcgtg

SEQ ID NO: 275357 - DNA, 25 bp, Rattus norvegicus
ctgtaaagtcaacgatctggaagag

SEQ ID NO: 275358 - DNA, 25 bp, Rattus norvegicus
ctgtaaagtcaaggatctggaagag

SEQ ID NO: 275359 - DNA, 25 bp, Rattus norvegicus
ctgtaaagtcttactgcatatggca

SEQ ID NO: 275360 - DNA, 25 bp, Rattus norvegicus
ctgtaaagtctttctgcatatggca

SEQ ID NO: 275361 - DNA, 25 bp, Rattus norvegicus
ctgtaaatatgtcatctgggctggg

SEQ ID NO: 275362 - DNA, 25 bp, Rattus norvegicus
ctgtaaatatgtgatctgggctggg

SEQ ID NO: 275363 - DNA, 25 bp, Rattus norvegicus
ctgtaacaaagtcgagagcctcccg

SEQ ID NO: 275364 - DNA, 25 bp, Rattus norvegicus
ctgtaacaaagtggagagcctcccg

SEQ ID NO: 275365 - DNA, 25 bp, Rattus norvegicus
ctgtaacaatctcaaggccggcgga

SEQ ID NO: 275366 - DNA, 25 bp, Rattus norvegicus
ctgtaacaatctgaaggccggcgga

SEQ ID NO: 275367 - DNA, 25 bp, Rattus norvegicus
ctgtaacacgccatgtaaaacggtt

SEQ ID NO: 275368 - DNA, 25 bp, Rattus norvegicus
ctgtaacacgccttgtaaaacggtt

SEQ ID NO: 275369 - DNA, 25 bp, Rattus norvegicus
ctgtaacacggcatcatggcgggaa

SEQ ID NO: 275370 - DNA, 25 bp, Rattus norvegicus
ctgtaacacggcttcatggcgggaa

SEQ ID NO: 275371 - DNA, 25 bp, Rattus norvegicus
ctgtaacagatcaaacaccggcgct

SEQ ID NO: 275372 - DNA, 25 bp, Rattus norvegicus
ctgtaacagatctaacaccggcgct

SEQ ID NO: 275373 - DNA, 25 bp, Rattus norvegicus
ctgtaacatactctcttagggcttt

SEQ ID NO: 275374 - DNA, 25 bp, Rattus norvegicus
ctgtaacatactgtcttagggcttt

SEQ ID NO: 275375 - DNA, 25 bp, Rattus norvegicus
ctgtaacatcccatttgcaactgag

SEQ ID NO: 275376 - DNA, 25 bp, Rattus norvegicus
ctgtaacatcccttttgcaactgag

SEQ ID NO: 275377 - DNA, 25 bp, Rattus norvegicus
ctgtaacccacaaccaattcaaacg

SEQ ID NO: 275378 - DNA, 25 bp, Rattus norvegicus
ctgtaacccacatccaattcaaacg

SEQ ID NO: 275379 - DNA, 25 bp, Rattus norvegicus
ctgtaacccacgagctgctgtgagg

SEQ ID NO: 275380 - DNA, 25 bp, Rattus norvegicus
ctgtaacccacgtgctgctgtgagg

SEQ ID NO: 275381 - DNA, 25 bp, Rattus norvegicus
ctgtaacctctgagggattgtgacc

SEQ ID NO: 275382 - DNA, 25 bp, Rattus norvegicus
ctgtaacctctgtgggattgtgacc

SEQ ID NO: 275383 - DNA, 25 bp, Rattus norvegicus
ctgtaacctgagagactgtctgtca

SEQ ID NO: 275384 - DNA, 25 bp, Rattus norvegicus
ctgtaacctgagtgactgtctgtca

SEQ ID NO: 275385 - DNA, 25 bp, Rattus norvegicus
ctgtaacctgtgacttgtctttgaa

SEQ ID NO: 275386 - DNA, 25 bp, Rattus norvegicus
ctgtaacctgtgtcttgtctttgaa

SEQ ID NO: 275387 - DNA, 25 bp, Rattus norvegicus
ctgtaacgggaaaaactgtgctgta

SEQ ID NO: 275388 - DNA, 25 bp, Rattus norvegicus
ctgtaacgggaataactgtgctgta

SEQ ID NO: 275389 - DNA, 25 bp, Rattus norvegicus
ctgtaacgggatccgatggcttctt

SEQ ID NO: 275390 - DNA, 25 bp, Rattus norvegicus
ctgtaacgggatgcgatggcttctt

SEQ ID NO: 275391 - DNA, 25 bp, Rattus norvegicus
ctgtaactcgtgacaagcattggtt

SEQ ID NO: 275392 - DNA, 25 bp, Rattus norvegicus
ctgtaactcgtgtcaagcattggtt

SEQ ID NO: 275393 - DNA, 25 bp, Rattus norvegicus
ctgtaactgttaacatggccatttt

SEQ ID NO: 275394 - DNA, 25 bp, Rattus norvegicus
ctgtaactgttatcatggccatttt

SEQ ID NO: 275395 - DNA, 25 bp, Rattus norvegicus
ctgtaacttggacttgtgatccgaa

SEQ ID NO: 275396 - DNA, 25 bp, Rattus norvegicus
ctgtaacttggagttgtgatccgaa

SEQ ID NO: 275397 - DNA, 25 bp, Rattus norvegicus
ctgtaagccaagaaagccatcatta

SEQ ID NO: 275398 - DNA, 25 bp, Rattus norvegicus
ctgtaagccaagtaagccatcatta

SEQ ID NO: 275399 - DNA, 25 bp, Rattus norvegicus
ctgtaagccctgatttatggccttc

SEQ ID NO: 275400 - DNA, 25 bp, Rattus norvegicus
ctgtaagccctgttttatggccttc

SEQ ID NO: 275401 - DNA, 25 bp, Rattus norvegicus
ctgtaaggaattctgtgaggaccta

SEQ ID NO: 275402 - DNA, 25 bp, Rattus norvegicus
ctgtaaggaattgtgtgaggaccta

SEQ ID NO: 275403 - DNA, 25 bp, Rattus norvegicus
ctgtaaggctatctcactaaagatt

SEQ ID NO: 275404 - DNA, 25 bp, Rattus norvegicus
ctgtaaggctatgtcactaaagatt

SEQ ID NO: 275405 - DNA, 25 bp, Rattus norvegicus
ctgtaagtacctcccacaggagcaa

SEQ ID NO: 275406 - DNA, 25 bp, Rattus norvegicus
ctgtaagtacctgccacaggagcaa

SEQ ID NO: 275407 - DNA, 25 bp, Rattus norvegicus
ctgtaagtctgtcattcggttggat

SEQ ID NO: 275408 - DNA, 25 bp, Rattus norvegicus
ctgtaagtctgtgattcggttggat

SEQ ID NO: 275409 - DNA, 25 bp, Rattus norvegicus
ctgtaagtgggcagttggtgtcttt

SEQ ID NO: 275410 - DNA, 25 bp, Rattus norvegicus
ctgtaagtgggctgttggtgtcttt

SEQ ID NO: 275411 - DNA, 25 bp, Rattus norvegicus
ctgtaataagccaggtttgttcatt

SEQ ID NO: 275412 - DNA, 25 bp, Rattus norvegicus
ctgtaataagcctggtttgttcatt

SEQ ID NO: 275413 - DNA, 25 bp, Rattus norvegicus
ctgtaataattcagaggtggcccca

SEQ ID NO: 275414 - DNA, 25 bp, Rattus norvegicus
ctgtaataattctgaggtggcccca

SEQ ID NO: 275415 - DNA, 25 bp, Rattus norvegicus
ctgtaatcacctaacttctgccgac

SEQ ID NO: 275416 - DNA, 25 bp, Rattus norvegicus
ctgtaatcaccttacttctgccgac

SEQ ID NO: 275417 - DNA, 25 bp, Rattus norvegicus
ctgtaatccccaaacctgggaggga

SEQ ID NO: 275418 - DNA, 25 bp, Rattus norvegicus
ctgtaatccccatacctgggaggga

SEQ ID NO: 275419 - DNA, 25 bp, Rattus norvegicus
ctgtaatcccctacacatgagagat

SEQ ID NO: 275420 - DNA, 25 bp, Rattus norvegicus
ctgtaatcccctagaacccaagtgc

SEQ ID NO: 275421 - DNA, 25 bp, Rattus norvegicus
ctgtaatccccttcacatgagagat

SEQ ID NO: 275422 - DNA, 25 bp, Rattus norvegicus
ctgtaatccccttgaacccaagtgc

SEQ ID NO: 275423 - DNA, 25 bp, Rattus norvegicus
ctgtaatccctgctgcaaatgtttt

SEQ ID NO: 275424 - DNA, 25 bp, Rattus norvegicus
ctgtaatccctggtgcaaatgtttt

SEQ ID NO: 275425 - DNA, 25 bp, Rattus norvegicus
ctgtaatcctagaacatgagactga

SEQ ID NO: 275426 - DNA, 25 bp, Rattus norvegicus
ctgtaatcctagtacatgagactga

SEQ ID NO: 275427 - DNA, 25 bp, Rattus norvegicus
ctgtaatctctcatcttggttggct

SEQ ID NO: 275428 - DNA, 25 bp, Rattus norvegicus
ctgtaatctctcttcttggttggct

SEQ ID NO: 275429 - DNA, 25 bp, Rattus norvegicus
ctgtaatctgcactcaactgtttga

SEQ ID NO: 275430 - DNA, 25 bp, Rattus norvegicus
ctgtaatctgcagtcaactgtttga

SEQ ID NO: 275431 - DNA, 25 bp, Rattus norvegicus
ctgtaatgggatctgtaatgggatc

SEQ ID NO: 275432 - DNA, 25 bp, Rattus norvegicus
ctgtaatgggatgtgtaatgggatc

SEQ ID NO: 275433 - DNA, 25 bp, Rattus norvegicus
ctgtaatgtaacctgggcaccaagt

SEQ ID NO: 275434 - DNA, 25 bp, Rattus norvegicus
ctgtaatgtaacgtgggcaccaagt

SEQ ID NO: 275435 - DNA, 25 bp, Rattus norvegicus
ctgtaattgtagcattctgttccat

SEQ ID NO: 275436 - DNA, 25 bp, Rattus norvegicus
ctgtaattgtaggattctgttccat

SEQ ID NO: 275437 - DNA, 25 bp, Rattus norvegicus
ctgtaatttcagcttgggtgtacgc

SEQ ID NO: 275438 - DNA, 25 bp, Rattus norvegicus
ctgtaatttcaggttgggtgtacgc

SEQ ID NO: 275439 - DNA, 25 bp, Rattus norvegicus
ctgtaatttcatctctgagctccct

SEQ ID NO: 275440 - DNA, 25 bp, Rattus norvegicus
ctgtaatttcatgtctgagctccct

SEQ ID NO: 275441 - DNA, 25 bp, Rattus norvegicus
ctgtaatttgatacacatgttttca

SEQ ID NO: 275442 - DNA, 25 bp, Rattus norvegicus
ctgtaatttgattcacatgttttca

SEQ ID NO: 275443 - DNA, 25 bp, Rattus norvegicus
ctgtacaatcgtatcatcattcggc

SEQ ID NO: 275444 - DNA, 25 bp, Rattus norvegicus
ctgtacaatcgtttcatcattcggc

SEQ ID NO: 275445 - DNA, 25 bp, Rattus norvegicus
ctgtacaccacacggcccttaggag

SEQ ID NO: 275446 - DNA, 25 bp, Rattus norvegicus
ctgtacaccacagggcccttaggag

SEQ ID NO: 275447 - DNA, 25 bp, Rattus norvegicus
ctgtacactaagaggtcagtttacc

SEQ ID NO: 275448 - DNA, 25 bp, Rattus norvegicus
ctgtacactaagtggtcagtttacc

SEQ ID NO: 275449 - DNA, 25 bp, Rattus norvegicus
ctgtacactgtaatcctgggaccgg

SEQ ID NO: 275450 - DNA, 25 bp, Rattus norvegicus
ctgtacactgtattcctgggaccgg

SEQ ID NO: 275451 - DNA, 25 bp, Rattus norvegicus
ctgtacagacagacaccttagtggt

SEQ ID NO: 275452 - DNA, 25 bp, Rattus norvegicus
ctgtacagacagtcaccttagtggt

SEQ ID NO: 275453 - DNA, 25 bp, Rattus norvegicus
ctgtacagagagacattacttaata

SEQ ID NO: 275454 - DNA, 25 bp, Rattus norvegicus
ctgtacagagagtcattacttaata

SEQ ID NO: 275455 - DNA, 25 bp, Rattus norvegicus
ctgtacagtgaccagggtgtctcct

SEQ ID NO: 275456 - DNA, 25 bp, Rattus norvegicus
ctgtacagtgacgagggtgtctcct

SEQ ID NO: 275457 - DNA, 25 bp, Rattus norvegicus
ctgtacatacatcttaacgcctggg

SEQ ID NO: 275458 - DNA, 25 bp, Rattus norvegicus
ctgtacatacatgttaacgcctggg

SEQ ID NO: 275459 - DNA, 25 bp, Rattus norvegicus
ctgtacatgatgatgcgggactgct

SEQ ID NO: 275460 - DNA, 25 bp, Rattus norvegicus
ctgtacatgatgttgcgggactgct

SEQ ID NO: 275461 - DNA, 25 bp, Rattus norvegicus
ctgtacattccaaaaactcaacttt

SEQ ID NO: 275462 - DNA, 25 bp, Rattus norvegicus
ctgtacattccataaactcaacttt

SEQ ID NO: 275463 - DNA, 25 bp, Rattus norvegicus
ctgtaccaagttatgcagctccttt

SEQ ID NO: 275464 - DNA, 25 bp, Rattus norvegicus
ctgtaccaagttttgcagctccttt

SEQ ID NO: 275465 - DNA, 25 bp, Rattus norvegicus
ctgtaccaggcaagcggcctccagg

SEQ ID NO: 275466 - DNA, 25 bp, Rattus norvegicus
ctgtaccaggcatgcggcctccagg

SEQ ID NO: 275467 - DNA, 25 bp, Rattus norvegicus
ctgtaccataagattgcgttgtgtt

SEQ ID NO: 275468 - DNA, 25 bp, Rattus norvegicus
ctgtaccataagtttgcgttgtgtt

SEQ ID NO: 275469 - DNA, 25 bp, Rattus norvegicus
ctgtaccatgccagtccagatgctg

SEQ ID NO: 275470 - DNA, 25 bp, Rattus norvegicus
ctgtaccatgcctgtccagatgctg

SEQ ID NO: 275471 - DNA, 25 bp, Rattus norvegicus
ctgtacccacgaagccactgatgat

SEQ ID NO: 275472 - DNA, 25 bp, Rattus norvegicus
ctgtacccacgatgccactgatgat

SEQ ID NO: 275473 - DNA, 25 bp, Rattus norvegicus
ctgtacccagggatggaataggctt

SEQ ID NO: 275474 - DNA, 25 bp, Rattus norvegicus
ctgtacccagggttggaataggctt

SEQ ID NO: 275475 - DNA, 25 bp, Rattus norvegicus
ctgtacccatacaactatgtctcag

SEQ ID NO: 275476 - DNA, 25 bp, Rattus norvegicus
ctgtacccatactactatgtctcag

SEQ ID NO: 275477 - DNA, 25 bp, Rattus norvegicus
ctgtacctcgtgagtatctgaagac

SEQ ID NO: 275478 - DNA, 25 bp, Rattus norvegicus
ctgtacctcgtgtgtatctgaagac

SEQ ID NO: 275479 - DNA, 25 bp, Rattus norvegicus
ctgtacctgagtcagctgtaaataa

SEQ ID NO: 275480 - DNA, 25 bp, Rattus norvegicus
ctgtacctgagtgagctgtaaataa

SEQ ID NO: 275481 - DNA, 25 bp, Rattus norvegicus
ctgtacctgattccactgagtgcta

SEQ ID NO: 275482 - DNA, 25 bp, Rattus norvegicus
ctgtacctgattgcactgagtgcta

SEQ ID NO: 275483 - DNA, 25 bp, Rattus norvegicus
ctgtacctggtaatgattgcatgtt

SEQ ID NO: 275484 - DNA, 25 bp, Rattus norvegicus
ctgtacctggtattgattgcatgtt

SEQ ID NO: 275485 - DNA, 25 bp, Rattus norvegicus
ctgtaccttcttcctggagttttga

SEQ ID NO: 275486 - DNA, 25 bp, Rattus norvegicus
ctgtaccttcttgctggagttttga

SEQ ID NO: 275487 - DNA, 25 bp, Rattus norvegicus
ctgtacgacactcttaatgcctgga

SEQ ID NO: 275488 - DNA, 25 bp, Rattus norvegicus
ctgtacgacactgttaatgcctgga

SEQ ID NO: 275489 - DNA, 25 bp, Rattus norvegicus
ctgtacgcggtcagtcataggagga

SEQ ID NO: 275490 - DNA, 25 bp, Rattus norvegicus
ctgtacgcggtctgtcataggagga

SEQ ID NO: 275491 - DNA, 25 bp, Rattus norvegicus
ctgtactcttcgcatggactgggaa

SEQ ID NO: 275492 - DNA, 25 bp, Rattus norvegicus
ctgtactcttcggatggactgggaa

SEQ ID NO: 275493 - DNA, 25 bp, Rattus norvegicus
ctgtactggcttagggacggcaaga

SEQ ID NO: 275494 - DNA, 25 bp, Rattus norvegicus
ctgtactggctttgggacggcaaga

SEQ ID NO: 275495 - DNA, 25 bp, Rattus norvegicus
ctgtactgggtacgcagtggccttc

SEQ ID NO: 275496 - DNA, 25 bp, Rattus norvegicus
ctgtactgggtaggcagtggccttc

SEQ ID NO: 275497 - DNA, 25 bp, Rattus norvegicus
ctgtactgggttatttggaggatag

SEQ ID NO: 275498 - DNA, 25 bp, Rattus norvegicus
ctgtactgggttttttggaggatag

SEQ ID NO: 275499 - DNA, 25 bp, Rattus norvegicus
ctgtactgtactaaactgcttactt

SEQ ID NO: 275500 - DNA, 25 bp, Rattus norvegicus
ctgtactgtacttaactgcttactt

SEQ ID NO: 275501 - DNA, 25 bp, Rattus norvegicus
ctgtactgtattcccctgttttata

SEQ ID NO: 275502 - DNA, 25 bp, Rattus norvegicus
ctgtactgtattgccctgttttata

SEQ ID NO: 275503 - DNA, 25 bp, Rattus norvegicus
ctgtactgtgaacgatatataccat

SEQ ID NO: 275504 - DNA, 25 bp, Rattus norvegicus
ctgtactgtgaaggatatataccat

SEQ ID NO: 275505 - DNA, 25 bp, Rattus norvegicus
ctgtagagctgcctgtggtcaataa

SEQ ID NO: 275506 - DNA, 25 bp, Rattus norvegicus
ctgtagagctgcgtgtggtcaataa

SEQ ID NO: 275507 - DNA, 25 bp, Rattus norvegicus
ctgtagagggcaccatccctgggat

SEQ ID NO: 275508 - DNA, 25 bp, Rattus norvegicus
ctgtagagggcagcatccctgggat

SEQ ID NO: 275509 - DNA, 25 bp, Rattus norvegicus
ctgtagagtcctagaagctttcaat

SEQ ID NO: 275510 - DNA, 25 bp, Rattus norvegicus
ctgtagagtccttgaagctttcaat

SEQ ID NO: 275511 - DNA, 25 bp, Rattus norvegicus
ctgtagcaatgcatggagacccctt

SEQ ID NO: 275512 - DNA, 25 bp, Rattus norvegicus
ctgtagcaatgcttggagacccctt

SEQ ID NO: 275513 - DNA, 25 bp, Rattus norvegicus
ctgtagcatacaaccggtcgaatca

SEQ ID NO: 275514 - DNA, 25 bp, Rattus norvegicus
ctgtagcatacatccggtcgaatca

SEQ ID NO: 275515 - DNA, 25 bp, Rattus norvegicus
ctgtagccatggagatgaccatttt

SEQ ID NO: 275516 - DNA, 25 bp, Rattus norvegicus
ctgtagccatggtgatgaccatttt

SEQ ID NO: 275517 - DNA, 25 bp, Rattus norvegicus
ctgtagcgacagcaattcttggact

SEQ ID NO: 275518 - DNA, 25 bp, Rattus norvegicus
ctgtagcgacaggaattcttggact

SEQ ID NO: 275519 - DNA, 25 bp, Rattus norvegicus
ctgtagctattcattgaccaaactg

SEQ ID NO: 275520 - DNA, 25 bp, Rattus norvegicus
ctgtagctattctttgaccaaactg

SEQ ID NO: 275521 - DNA, 25 bp, Rattus norvegicus
ctgtagctggtaacctggctcaagg

SEQ ID NO: 275522 - DNA, 25 bp, Rattus norvegicus
ctgtagctggtatcctggctcaagg

SEQ ID NO: 275523 - DNA, 25 bp, Rattus norvegicus
ctgtagctgtggcttttgaccgctg

SEQ ID NO: 275524 - DNA, 25 bp, Rattus norvegicus
ctgtagctgtgggttttgaccgctg

SEQ ID NO: 275525 - DNA, 25 bp, Rattus norvegicus
ctgtagcttcttccttctgaatgat

SEQ ID NO: 275526 - DNA, 25 bp, Rattus norvegicus
ctgtagcttcttgcttctgaatgat

SEQ ID NO: 275527 - DNA, 25 bp, Rattus norvegicus
ctgtaggaccggcactgatgcatgt

SEQ ID NO: 275528 - DNA, 25 bp, Rattus norvegicus
ctgtaggaccgggactgatgcatgt

SEQ ID NO: 275529 - DNA, 25 bp, Rattus norvegicus
ctgtaggaggttcctgatccgcata

SEQ ID NO: 275530 - DNA, 25 bp, Rattus norvegicus
ctgtaggaggttgctgatccgcata

SEQ ID NO: 275531 - DNA, 25 bp, Rattus norvegicus
ctgtaggataggaccaaggaacttt

SEQ ID NO: 275532 - DNA, 25 bp, Rattus norvegicus
ctgtaggataggtccaaggaacttt

SEQ ID NO: 275533 - DNA, 25 bp, Rattus norvegicus
ctgtaggccttgctgatgccatttc

SEQ ID NO: 275534 - DNA, 25 bp, Rattus norvegicus
ctgtaggccttggtgatgccatttc

SEQ ID NO: 275535 - DNA, 25 bp, Rattus norvegicus
ctgtagggccttaatgacctcataa

SEQ ID NO: 275536 - DNA, 25 bp, Rattus norvegicus
ctgtagggcctttatgacctcataa

SEQ ID NO: 275537 - DNA, 25 bp, Rattus norvegicus
ctgtaggttcacagggcttgactat

SEQ ID NO: 275538 - DNA, 25 bp, Rattus norvegicus
ctgtaggttcactgggcttgactat

SEQ ID NO: 275539 - DNA, 25 bp, Rattus norvegicus
ctgtaggttccacccacgtggtggt

SEQ ID NO: 275540 - DNA, 25 bp, Rattus norvegicus
ctgtaggttccagccacgtggtggt

SEQ ID NO: 275541 - DNA, 25 bp, Rattus norvegicus
ctgtaggttttaattgttgcatact

SEQ ID NO: 275542 - DNA, 25 bp, Rattus norvegicus
ctgtaggttttatttgttgcatact

SEQ ID NO: 275543 - DNA, 25 bp, Rattus norvegicus
ctgtagtacagcagccaccagggat

SEQ ID NO: 275544 - DNA, 25 bp, Rattus norvegicus
ctgtagtacagctgccaccagggat

SEQ ID NO: 275545 - DNA, 25 bp, Rattus norvegicus
ctgtagtccagtcatgaggaggtct

SEQ ID NO: 275546 - DNA, 25 bp, Rattus norvegicus
ctgtagtccagtgatgaggaggtct

SEQ ID NO: 275547 - DNA, 25 bp, Rattus norvegicus
ctgtagtcccttatcttttatcact

SEQ ID NO: 275548 - DNA, 25 bp, Rattus norvegicus
ctgtagtcccttttcttttatcact

SEQ ID NO: 275549 - DNA, 25 bp, Rattus norvegicus
ctgtagtcctagacctgggtactaa

SEQ ID NO: 275550 - DNA, 25 bp, Rattus norvegicus
ctgtagtcctagtcctgggtactaa

SEQ ID NO: 275551 - DNA, 25 bp, Rattus norvegicus
ctgtagtctttcatggttgtggtca

SEQ ID NO: 275552 - DNA, 25 bp, Rattus norvegicus
ctgtagtctttcttggttgtggtca

SEQ ID NO: 275553 - DNA, 25 bp, Rattus norvegicus
ctgtagtgccttcgacctggacaaa

SEQ ID NO: 275554 - DNA, 25 bp, Rattus norvegicus
ctgtagtgccttggacctggacaaa

SEQ ID NO: 275555 - DNA, 25 bp, Rattus norvegicus
ctgtagtgggttagtgtagtttcct

SEQ ID NO: 275556 - DNA, 25 bp, Rattus norvegicus
ctgtagtgggtttgtgtagtttcct

SEQ ID NO: 275557 - DNA, 25 bp, Rattus norvegicus
ctgtagtgtgatcccgccgtgagct

SEQ ID NO: 275558 - DNA, 25 bp, Rattus norvegicus
ctgtagtgtgatctgatgctttctt

SEQ ID NO: 275559 - DNA, 25 bp, Rattus norvegicus
ctgtagtgtgatgccgccgtgagct

SEQ ID NO: 275560 - DNA, 25 bp, Rattus norvegicus
ctgtagtgtgatgtgatgctttctt

SEQ ID NO: 275561 - DNA, 25 bp, Rattus norvegicus
ctgtagttagggaccgtgcagtgct

SEQ ID NO: 275562 - DNA, 25 bp, Rattus norvegicus
ctgtagttagggtccgtgcagtgct

SEQ ID NO: 275563 - DNA, 25 bp, Rattus norvegicus
ctgtagttcaggctgatgttctcct

SEQ ID NO: 275564 - DNA, 25 bp, Rattus norvegicus
ctgtagttcagggtgatgttctcct

SEQ ID NO: 275565 - DNA, 25 bp, Rattus norvegicus
ctgtagttcttcagcctggaagagt

SEQ ID NO: 275566 - DNA, 25 bp, Rattus norvegicus
ctgtagttcttctgcctggaagagt

SEQ ID NO: 275567 - DNA, 25 bp, Rattus norvegicus
ctgtagttgcctagcaggtggtgca

SEQ ID NO: 275568 - DNA, 25 bp, Rattus norvegicus
ctgtagttgccttgcaggtggtgca

SEQ ID NO: 275569 - DNA, 25 bp, Rattus norvegicus
ctgtagttttctatcctaggacttg

SEQ ID NO: 275570 - DNA, 25 bp, Rattus norvegicus
ctgtagttttctttcctaggacttg

SEQ ID NO: 275571 - DNA, 25 bp, Rattus norvegicus
ctgtataacagtcaagccctccgtt

SEQ ID NO: 275572 - DNA, 25 bp, Rattus norvegicus
ctgtataacagtgaagccctccgtt

SEQ ID NO: 275573 - DNA, 25 bp, Rattus norvegicus
ctgtataccttcctcttttaactgc

SEQ ID NO: 275574 - DNA, 25 bp, Rattus norvegicus
ctgtataccttcgtcttttaactgc

SEQ ID NO: 275575 - DNA, 25 bp, Rattus norvegicus
ctgtatagagcactagttctcagcc

SEQ ID NO: 275576 - DNA, 25 bp, Rattus norvegicus
ctgtatagagcagtagttctcagcc

SEQ ID NO: 275577 - DNA, 25 bp, Rattus norvegicus
ctgtatatagggaccatgtgcaata

SEQ ID NO: 275578 - DNA, 25 bp, Rattus norvegicus
ctgtatatagggtccatgtgcaata

SEQ ID NO: 275579 - DNA, 25 bp, Rattus norvegicus
ctgtatatcgttcatgggatgccaa

SEQ ID NO: 275580 - DNA, 25 bp, Rattus norvegicus
ctgtatatcgttgatgggatgccaa

SEQ ID NO: 275581 - DNA, 25 bp, Rattus norvegicus
ctgtatatgatgaaactgtgtcccc

SEQ ID NO: 275582 - DNA, 25 bp, Rattus norvegicus
ctgtatatgatgtaactgtgtcccc

SEQ ID NO: 275583 - DNA, 25 bp, Rattus norvegicus
ctgtatattgccattttgctggaaa

SEQ ID NO: 275584 - DNA, 25 bp, Rattus norvegicus
ctgtatattgcctttttgctggaaa

SEQ ID NO: 275585 - DNA, 25 bp, Rattus norvegicus
ctgtatatttttctgcacttgagct

SEQ ID NO: 275586 - DNA, 25 bp, Rattus norvegicus
ctgtatatttttgtgcacttgagct

SEQ ID NO: 275587 - DNA, 25 bp, Rattus norvegicus
ctgtatcaggttattggttgtacat

SEQ ID NO: 275588 - DNA, 25 bp, Rattus norvegicus
ctgtatcaggtttttggttgtacat

SEQ ID NO: 275589 - DNA, 25 bp, Rattus norvegicus
ctgtatccaactctgcctgaagcta

SEQ ID NO: 275590 - DNA, 25 bp, Rattus norvegicus
ctgtatccaactgtgcctgaagcta

SEQ ID NO: 275591 - DNA, 25 bp, Rattus norvegicus
ctgtatccccagagcttggaacaga

SEQ ID NO: 275592 - DNA, 25 bp, Rattus norvegicus
ctgtatccccagattctagagtgaa

SEQ ID NO: 275593 - DNA, 25 bp, Rattus norvegicus
ctgtatccccagtgcttggaacaga

SEQ ID NO: 275594 - DNA, 25 bp, Rattus norvegicus
ctgtatccccagtttctagagtgaa

SEQ ID NO: 275595 - DNA, 25 bp, Rattus norvegicus
ctgtatcgggttacttctgatgcta

SEQ ID NO: 275596 - DNA, 25 bp, Rattus norvegicus
ctgtatcgggtttcttctgatgcta

SEQ ID NO: 275597 - DNA, 25 bp, Rattus norvegicus
ctgtatctctggcaatatctcctaa

SEQ ID NO: 275598 - DNA, 25 bp, Rattus norvegicus
ctgtatctctgggaatatctcctaa

SEQ ID NO: 275599 - DNA, 25 bp, Rattus norvegicus
ctgtatctgtgtctgtgtggatatc

SEQ ID NO: 275600 - DNA, 25 bp, Rattus norvegicus
ctgtatctgtgtgtgtgtggatatc

SEQ ID NO: 275601 - DNA, 25 bp, Rattus norvegicus
ctgtatcttaaacaaacctgccctc

SEQ ID NO: 275602 - DNA, 25 bp, Rattus norvegicus
ctgtatcttaaagaaacctgccctc

SEQ ID NO: 275603 - DNA, 25 bp, Rattus norvegicus
ctgtatcttctgatttccttactgg

SEQ ID NO: 275604 - DNA, 25 bp, Rattus norvegicus
ctgtatcttctgttttccttactgg

SEQ ID NO: 275605 - DNA, 25 bp, Rattus norvegicus
ctgtatcttgccagtttgtatgtat

SEQ ID NO: 275606 - DNA, 25 bp, Rattus norvegicus
ctgtatcttgcctgtttgtatgtat

SEQ ID NO: 275607 - DNA, 25 bp, Rattus norvegicus
ctgtatcttgtcaggctctgtagta

SEQ ID NO: 275608 - DNA, 25 bp, Rattus norvegicus
ctgtatcttgtctggctctgtagta

SEQ ID NO: 275609 - DNA, 25 bp, Rattus norvegicus
ctgtatgaacagcactatcgggaga

SEQ ID NO: 275610 - DNA, 25 bp, Rattus norvegicus
ctgtatgaacaggactatcgggaga

SEQ ID NO: 275611 - DNA, 25 bp, Rattus norvegicus
ctgtatgacaggaggaacttcccgg

SEQ ID NO: 275612 - DNA, 25 bp, Rattus norvegicus
ctgtatgacaggtggaacttcccgg

SEQ ID NO: 275613 - DNA, 25 bp, Rattus norvegicus
ctgtatgctcgtcctgtaagtgtca

SEQ ID NO: 275614 - DNA, 25 bp, Rattus norvegicus
ctgtatgctcgtgctgtaagtgtca

SEQ ID NO: 275615 - DNA, 25 bp, Rattus norvegicus
ctgtatgctcttcagggtgcaagat

SEQ ID NO: 275616 - DNA, 25 bp, Rattus norvegicus
ctgtatgctcttgagggtgcaagat

SEQ ID NO: 275617 - DNA, 25 bp, Rattus norvegicus
ctgtatgggttcaaaatctgtctgt

SEQ ID NO: 275618 - DNA, 25 bp, Rattus norvegicus
ctgtatgggttctaaatctgtctgt

SEQ ID NO: 275619 - DNA, 25 bp, Rattus norvegicus
ctgtatgtacagctctgctgcttta

SEQ ID NO: 275620 - DNA, 25 bp, Rattus norvegicus
ctgtatgtacaggtctgctgcttta

SEQ ID NO: 275621 - DNA, 25 bp, Rattus norvegicus
ctgtatgtctgtaatgtactctgtg

SEQ ID NO: 275622 - DNA, 25 bp, Rattus norvegicus
ctgtatgtctgttatgtactctgtg

SEQ ID NO: 275623 - DNA, 25 bp, Rattus norvegicus
ctgtatgtggtaatgctgatcatgg

SEQ ID NO: 275624 - DNA, 25 bp, Rattus norvegicus
ctgtatgtggtattgctgatcatgg

SEQ ID NO: 275625 - DNA, 25 bp, Rattus norvegicus
ctgtatgtgtagctcaaactcttgt

SEQ ID NO: 275626 - DNA, 25 bp, Rattus norvegicus
ctgtatgtgtaggtcaaactcttgt

SEQ ID NO: 275627 - DNA, 25 bp, Rattus norvegicus
ctgtattagagcctgaccccagcag

SEQ ID NO: 275628 - DNA, 25 bp, Rattus norvegicus
ctgtattagagcgtgaccccagcag

SEQ ID NO: 275629 - DNA, 25 bp, Rattus norvegicus
ctgtattataagatgcaccaagcaa

SEQ ID NO: 275630 - DNA, 25 bp, Rattus norvegicus
ctgtattataagttgcaccaagcaa

SEQ ID NO: 275631 - DNA, 25 bp, Rattus norvegicus
ctgtattatccgaagctgttgctga

SEQ ID NO: 275632 - DNA, 25 bp, Rattus norvegicus
ctgtattatccgtagctgttgctga

SEQ ID NO: 275633 - DNA, 25 bp, Rattus norvegicus
ctgtattcagcccatttcacatgta

SEQ ID NO: 275634 - DNA, 25 bp, Rattus norvegicus
ctgtattcagccgatttcacatgta

SEQ ID NO: 275635 - DNA, 25 bp, Rattus norvegicus
ctgtattccaaaaagtggtgtcctc

SEQ ID NO: 275636 - DNA, 25 bp, Rattus norvegicus
ctgtattccaaatagtggtgtcctc

SEQ ID NO: 275637 - DNA, 25 bp, Rattus norvegicus
ctgtattctacaacaagcctccaga

SEQ ID NO: 275638 - DNA, 25 bp, Rattus norvegicus
ctgtattctacatcaagcctccaga

SEQ ID NO: 275639 - DNA, 25 bp, Rattus norvegicus
ctgtattgggcaaactccactctac

SEQ ID NO: 275640 - DNA, 25 bp, Rattus norvegicus
ctgtattgggcatactccactctac

SEQ ID NO: 275641 - DNA, 25 bp, Rattus norvegicus
ctgtattgtgtacagccggtggccc

SEQ ID NO: 275642 - DNA, 25 bp, Rattus norvegicus
ctgtattgtgtagagccggtggccc

SEQ ID NO: 275643 - DNA, 25 bp, Rattus norvegicus
ctgtatttaactatgtgagcttttt

SEQ ID NO: 275644 - DNA, 25 bp, Rattus norvegicus
ctgtatttaactttgtgagcttttt

SEQ ID NO: 275645 - DNA, 25 bp, Rattus norvegicus
ctgtatttacgtcgaactgttgctt

SEQ ID NO: 275646 - DNA, 25 bp, Rattus norvegicus
ctgtatttacgtggaactgttgctt

SEQ ID NO: 275647 - DNA, 25 bp, Rattus norvegicus
ctgtatttcctcctttccagaaaca

SEQ ID NO: 275648 - DNA, 25 bp, Rattus norvegicus
ctgtatttcctcgtttccagaaaca

SEQ ID NO: 275649 - DNA, 25 bp, Rattus norvegicus
ctgtatttctagctgatgtgctcgt

SEQ ID NO: 275650 - DNA, 25 bp, Rattus norvegicus
ctgtatttctaggtgatgtgctcgt

SEQ ID NO: 275651 - DNA, 25 bp, Rattus norvegicus
ctgtatttgtatctctcactgtgat

SEQ ID NO: 275652 - DNA, 25 bp, Rattus norvegicus
ctgtatttgtatgtctcactgtgat

SEQ ID NO: 275653 - DNA, 25 bp, Rattus norvegicus
ctgtattttaacaccagacggtatt

SEQ ID NO: 275654 - DNA, 25 bp, Rattus norvegicus
ctgtattttaactccagacggtatt

SEQ ID NO: 275655 - DNA, 25 bp, Rattus norvegicus
ctgtattttaatacttcatgttcca

SEQ ID NO: 275656 - DNA, 25 bp, Rattus norvegicus
ctgtattttaattcttcatgttcca

SEQ ID NO: 275657 - DNA, 25 bp, Rattus norvegicus
ctgtattttactcttcctttatgtg

SEQ ID NO: 275658 - DNA, 25 bp, Rattus norvegicus
ctgtattttactgttcctttatgtg

SEQ ID NO: 275659 - DNA, 25 bp, Rattus norvegicus
ctgtattttcagctgtccctacact

SEQ ID NO: 275660 - DNA, 25 bp, Rattus norvegicus
ctgtattttcaggtgtccctacact

SEQ ID NO: 275661 - DNA, 25 bp, Rattus norvegicus
ctgtattttgtgcatttcgtgtctt

SEQ ID NO: 275662 - DNA, 25 bp, Rattus norvegicus
ctgtattttgtggatttcgtgtctt

SEQ ID NO: 275663 - DNA, 25 bp, Rattus norvegicus
ctgtcaaaaattcagtcacgtccga

SEQ ID NO: 275664 - DNA, 25 bp, Rattus norvegicus
ctgtcaaaaattgagtcacgtccga

SEQ ID NO: 275665 - DNA, 25 bp, Rattus norvegicus
ctgtcaaaccctagcaagcttgtga

SEQ ID NO: 275666 - DNA, 25 bp, Rattus norvegicus
ctgtcaaacccttgcaagcttgtga

SEQ ID NO: 275667 - DNA, 25 bp, Rattus norvegicus
ctgtcaaagaagacccacactctgg

SEQ ID NO: 275668 - DNA, 25 bp, Rattus norvegicus
ctgtcaaagaagtcccacactctgg

SEQ ID NO: 275669 - DNA, 25 bp, Rattus norvegicus
ctgtcaacctctagctatcattagt

SEQ ID NO: 275670 - DNA, 25 bp, Rattus norvegicus
ctgtcaacctcttgctatcattagt

SEQ ID NO: 275671 - DNA, 25 bp, Rattus norvegicus
ctgtcaagcattccaggccatgaga

SEQ ID NO: 275672 - DNA, 25 bp, Rattus norvegicus
ctgtcaagcattgcaggccatgaga

SEQ ID NO: 275673 - DNA, 25 bp, Rattus norvegicus
ctgtcaagcttcaccattgcgaagt

SEQ ID NO: 275674 - DNA, 25 bp, Rattus norvegicus
ctgtcaagcttctccattgcgaagt

SEQ ID NO: 275675 - DNA, 25 bp, Rattus norvegicus
ctgtcaatgcctacccatgagaggg

SEQ ID NO: 275676 - DNA, 25 bp, Rattus norvegicus
ctgtcaatgcctacctaatttactg

SEQ ID NO: 275677 - DNA, 25 bp, Rattus norvegicus
ctgtcaatgccttcccatgagaggg

SEQ ID NO: 275678 - DNA, 25 bp, Rattus norvegicus
ctgtcaatgccttcctaatttactg

SEQ ID NO: 275679 - DNA, 25 bp, Rattus norvegicus
ctgtcaatgctgaacgattttgtat

SEQ ID NO: 275680 - DNA, 25 bp, Rattus norvegicus
ctgtcaatgctgtacgattttgtat

SEQ ID NO: 275681 - DNA, 25 bp, Rattus norvegicus
ctgtcacacagtactgctatatgga

SEQ ID NO: 275682 - DNA, 25 bp, Rattus norvegicus
ctgtcacacagttctgctatatgga

SEQ ID NO: 275683 - DNA, 25 bp, Rattus norvegicus
ctgtcacagccacatctggttgtaa

SEQ ID NO: 275684 - DNA, 25 bp, Rattus norvegicus
ctgtcacagccagatctggttgtaa

SEQ ID NO: 275685 - DNA, 25 bp, Rattus norvegicus
ctgtcacatcaactaattcctctaa

SEQ ID NO: 275686 - DNA, 25 bp, Rattus norvegicus
ctgtcacatcaagtaattcctctaa

SEQ ID NO: 275687 - DNA, 25 bp, Rattus norvegicus
ctgtcaccacgtcgctgttcttagt

SEQ ID NO: 275688 - DNA, 25 bp, Rattus norvegicus
ctgtcaccacgtggctgttcttagt

SEQ ID NO: 275689 - DNA, 25 bp, Rattus norvegicus
ctgtcaccactgactttactattat

SEQ ID NO: 275690 - DNA, 25 bp, Rattus norvegicus
ctgtcaccactgtctttactattat

SEQ ID NO: 275691 - DNA, 25 bp, Rattus norvegicus
ctgtcaccagctaaacaatgtccgt

SEQ ID NO: 275692 - DNA, 25 bp, Rattus norvegicus
ctgtcaccagcttaacaatgtccgt

SEQ ID NO: 275693 - DNA, 25 bp, Rattus norvegicus
ctgtcaccatagacacacgtgttgt

SEQ ID NO: 275694 - DNA, 25 bp, Rattus norvegicus
ctgtcaccatagtcacacgtgttgt

SEQ ID NO: 275695 - DNA, 25 bp, Rattus norvegicus
ctgtcaccattgacgtatgacaaat

SEQ ID NO: 275696 - DNA, 25 bp, Rattus norvegicus
ctgtcaccattgtcgtatgacaaat

SEQ ID NO: 275697 - DNA, 25 bp, Rattus norvegicus
ctgtcacccctgatgaagagtcatg

SEQ ID NO: 275698 - DNA, 25 bp, Rattus norvegicus
ctgtcacccctgcaagaaggctttg

SEQ ID NO: 275699 - DNA, 25 bp, Rattus norvegicus
ctgtcacccctggaagaaggctttg

SEQ ID NO: 275700 - DNA, 25 bp, Rattus norvegicus
ctgtcacccctgttgaagagtcatg

SEQ ID NO: 275701 - DNA, 25 bp, Rattus norvegicus
ctgtcaccctttagagcacagctga

SEQ ID NO: 275702 - DNA, 25 bp, Rattus norvegicus
ctgtcacccttttgagcacagctga

SEQ ID NO: 275703 - DNA, 25 bp, Rattus norvegicus
ctgtcaccgagtcagctttggttat

SEQ ID NO: 275704 - DNA, 25 bp, Rattus norvegicus
ctgtcaccgagtgagctttggttat

SEQ ID NO: 275705 - DNA, 25 bp, Rattus norvegicus
ctgtcacctcatctatccatataaa

SEQ ID NO: 275706 - DNA, 25 bp, Rattus norvegicus
ctgtcacctcatgtatccatataaa

SEQ ID NO: 275707 - DNA, 25 bp, Rattus norvegicus
ctgtcacctctcagtatctgtgtct

SEQ ID NO: 275708 - DNA, 25 bp, Rattus norvegicus
ctgtcacctctctgtatctgtgtct

SEQ ID NO: 275709 - DNA, 25 bp, Rattus norvegicus
ctgtcacctgaacacatcatgctta

SEQ ID NO: 275710 - DNA, 25 bp, Rattus norvegicus
ctgtcacctgaagacatcatgctta

SEQ ID NO: 275711 - DNA, 25 bp, Rattus norvegicus
ctgtcacctggtagttctgtcaaga

SEQ ID NO: 275712 - DNA, 25 bp, Rattus norvegicus
ctgtcacctggttgttctgtcaaga

SEQ ID NO: 275713 - DNA, 25 bp, Rattus norvegicus
ctgtcacctgttcctgaaatgtcaa

SEQ ID NO: 275714 - DNA, 25 bp, Rattus norvegicus
ctgtcacctgttgctgaaatgtcaa

SEQ ID NO: 275715 - DNA, 25 bp, Rattus norvegicus
ctgtcacgaattcgatgtttgtcat

SEQ ID NO: 275716 - DNA, 25 bp, Rattus norvegicus
ctgtcacgaattggatgtttgtcat

SEQ ID NO: 275717 - DNA, 25 bp, Rattus norvegicus
ctgtcacggctgatattgcacacat

SEQ ID NO: 275718 - DNA, 25 bp, Rattus norvegicus
ctgtcacggctgttattgcacacat

SEQ ID NO: 275719 - DNA, 25 bp, Rattus norvegicus
ctgtcactaaccctaagtagaagga

SEQ ID NO: 275720 - DNA, 25 bp, Rattus norvegicus
ctgtcactaaccgtaagtagaagga

SEQ ID NO: 275721 - DNA, 25 bp, Rattus norvegicus
ctgtcactaatgcatgcagctcttg

SEQ ID NO: 275722 - DNA, 25 bp, Rattus norvegicus
ctgtcactaatggatgcagctcttg

SEQ ID NO: 275723 - DNA, 25 bp, Rattus norvegicus
ctgtcactacttacggtttgtccgg

SEQ ID NO: 275724 - DNA, 25 bp, Rattus norvegicus
ctgtcactactttcggtttgtccgg

SEQ ID NO: 275725 - DNA, 25 bp, Rattus norvegicus
ctgtcactaggcacttttaaaaggg

SEQ ID NO: 275726 - DNA, 25 bp, Rattus norvegicus
ctgtcactaggctcttttaaaaggg

SEQ ID NO: 275727 - DNA, 25 bp, Rattus norvegicus
ctgtcactatcactcttctgtaagt

SEQ ID NO: 275728 - DNA, 25 bp, Rattus norvegicus
ctgtcactatcagtcttctgtaagt

SEQ ID NO: 275729 - DNA, 25 bp, Rattus norvegicus
ctgtcactgaagagcccgggaagga

SEQ ID NO: 275730 - DNA, 25 bp, Rattus norvegicus
ctgtcactgaagtgcccgggaagga

SEQ ID NO: 275731 - DNA, 25 bp, Rattus norvegicus
ctgtcactgcgcactgagtcaccaa

SEQ ID NO: 275732 - DNA, 25 bp, Rattus norvegicus
ctgtcactgcgctctgagtcaccaa

SEQ ID NO: 275733 - DNA, 25 bp, Rattus norvegicus
ctgtcactgcttctccaaggatgag

SEQ ID NO: 275734 - DNA, 25 bp, Rattus norvegicus
ctgtcactgcttgtccaaggatgag

SEQ ID NO: 275735 - DNA, 25 bp, Rattus norvegicus
ctgtcactgggtagcagcacggtgt

SEQ ID NO: 275736 - DNA, 25 bp, Rattus norvegicus
ctgtcactgggtaggttgtgtacct

SEQ ID NO: 275737 - DNA, 25 bp, Rattus norvegicus
ctgtcactgggttgcagcacggtgt

SEQ ID NO: 275738 - DNA, 25 bp, Rattus norvegicus
ctgtcactgggttggttgtgtacct

SEQ ID NO: 275739 - DNA, 25 bp, Rattus norvegicus
ctgtcactgttcctagaggtgttgg

SEQ ID NO: 275740 - DNA, 25 bp, Rattus norvegicus
ctgtcactgttcgtagaggtgttgg

SEQ ID NO: 275741 - DNA, 25 bp, Rattus norvegicus
ctgtcagagaggcaccgcacctaaa

SEQ ID NO: 275742 - DNA, 25 bp, Rattus norvegicus
ctgtcagagagggaccgcacctaaa

SEQ ID NO: 275743 - DNA, 25 bp, Rattus norvegicus
ctgtcagagctgagcagaggttcct

SEQ ID NO: 275744 - DNA, 25 bp, Rattus norvegicus
ctgtcagagctgtgcagaggttcct

SEQ ID NO: 275745 - DNA, 25 bp, Rattus norvegicus
ctgtcagatcataggctggccttta

SEQ ID NO: 275746 - DNA, 25 bp, Rattus norvegicus
ctgtcagatcattggctggccttta

SEQ ID NO: 275747 - DNA, 25 bp, Rattus norvegicus
ctgtcagatgctcgtcagaccggac

SEQ ID NO: 275748 - DNA, 25 bp, Rattus norvegicus
ctgtcagatgctggtcagaccggac

SEQ ID NO: 275749 - DNA, 25 bp, Rattus norvegicus
ctgtcagcagcacttaatttggaat

SEQ ID NO: 275750 - DNA, 25 bp, Rattus norvegicus
ctgtcagcagcagttaatttggaat

SEQ ID NO: 275751 - DNA, 25 bp, Rattus norvegicus
ctgtcagcgatccacttcatggaat

SEQ ID NO: 275752 - DNA, 25 bp, Rattus norvegicus
ctgtcagcgatcgacttcatggaat

SEQ ID NO: 275753 - DNA, 25 bp, Rattus norvegicus
ctgtcagcgcttcctgtcagtgtga

SEQ ID NO: 275754 - DNA, 25 bp, Rattus norvegicus
ctgtcagcgcttgctgtcagtgtga

SEQ ID NO: 275755 - DNA, 25 bp, Rattus norvegicus
ctgtcagctaatcctcagccaaaga

SEQ ID NO: 275756 - DNA, 25 bp, Rattus norvegicus
ctgtcagctaatgctcagccaaaga

SEQ ID NO: 275757 - DNA, 25 bp, Rattus norvegicus
ctgtcagctactccccagggaagga

SEQ ID NO: 275758 - DNA, 25 bp, Rattus norvegicus
ctgtcagctactgcccagggaagga

SEQ ID NO: 275759 - DNA, 25 bp, Rattus norvegicus
ctgtcagctgacactctgaaacttt

SEQ ID NO: 275760 - DNA, 25 bp, Rattus norvegicus
ctgtcagctgactctctgaaacttt

SEQ ID NO: 275761 - DNA, 25 bp, Rattus norvegicus
ctgtcaggacataagctgtgctgct

SEQ ID NO: 275762 - DNA, 25 bp, Rattus norvegicus
ctgtcaggacattagctgtgctgct

SEQ ID NO: 275763 - DNA, 25 bp, Rattus norvegicus
ctgtcaggagcaacgagccccggag

SEQ ID NO: 275764 - DNA, 25 bp, Rattus norvegicus
ctgtcaggagcatcgagccccggag

SEQ ID NO: 275765 - DNA, 25 bp, Rattus norvegicus
ctgtcaggcctgaccccaggagtgg

SEQ ID NO: 275766 - DNA, 25 bp, Rattus norvegicus
ctgtcaggcctgtccccaggagtgg

SEQ ID NO: 275767 - DNA, 25 bp, Rattus norvegicus
ctgtcaggcttgactggagtggcat

SEQ ID NO: 275768 - DNA, 25 bp, Rattus norvegicus
ctgtcaggcttgtctggagtggcat

SEQ ID NO: 275769 - DNA, 25 bp, Rattus norvegicus
ctgtcagggcacagcgtgccggcca

SEQ ID NO: 275770 - DNA, 25 bp, Rattus norvegicus
ctgtcagggcactgcgtgccggcca

SEQ ID NO: 275771 - DNA, 25 bp, Rattus norvegicus
ctgtcagggctacctggtagaacct

SEQ ID NO: 275772 - DNA, 25 bp, Rattus norvegicus
ctgtcagggctagctggtagaacct

SEQ ID NO: 275773 - DNA, 25 bp, Rattus norvegicus
ctgtcaggtcgtccccataaaagca

SEQ ID NO: 275774 - DNA, 25 bp, Rattus norvegicus
ctgtcaggtcgtgcccataaaagca

SEQ ID NO: 275775 - DNA, 25 bp, Rattus norvegicus
ctgtcaggtgctctgttgcagtgat

SEQ ID NO: 275776 - DNA, 25 bp, Rattus norvegicus
ctgtcaggtgctgtgttgcagtgat

SEQ ID NO: 275777 - DNA, 25 bp, Rattus norvegicus
ctgtcagtaattccctttaacctcc

SEQ ID NO: 275778 - DNA, 25 bp, Rattus norvegicus
ctgtcagtaattgcctttaacctcc

SEQ ID NO: 275779 - DNA, 25 bp, Rattus norvegicus
ctgtcagtatctattggttcctagt

SEQ ID NO: 275780 - DNA, 25 bp, Rattus norvegicus
ctgtcagtatcttttggttcctagt

SEQ ID NO: 275781 - DNA, 25 bp, Rattus norvegicus
ctgtcagtcaagaccttacctattt

SEQ ID NO: 275782 - DNA, 25 bp, Rattus norvegicus
ctgtcagtcaagtccttacctattt

SEQ ID NO: 275783 - DNA, 25 bp, Rattus norvegicus
ctgtcagtccctctgtgggtgatag

SEQ ID NO: 275784 - DNA, 25 bp, Rattus norvegicus
ctgtcagtccctgtgtgggtgatag

SEQ ID NO: 275785 - DNA, 25 bp, Rattus norvegicus
ctgtcagtctgcagattgtttcctg

SEQ ID NO: 275786 - DNA, 25 bp, Rattus norvegicus
ctgtcagtctgctgattgtttcctg

SEQ ID NO: 275787 - DNA, 25 bp, Rattus norvegicus
ctgtcagttaacagtgcagtctgtt

SEQ ID NO: 275788 - DNA, 25 bp, Rattus norvegicus
ctgtcagttaactgtgcagtctgtt

SEQ ID NO: 275789 - DNA, 25 bp, Rattus norvegicus
ctgtcatatcgccaatagctcttta

SEQ ID NO: 275790 - DNA, 25 bp, Rattus norvegicus
ctgtcatatcgcgaatagctcttta

SEQ ID NO: 275791 - DNA, 25 bp, Rattus norvegicus
ctgtcatcactgacgtatgacaaaa

SEQ ID NO: 275792 - DNA, 25 bp, Rattus norvegicus
ctgtcatcactgtcgtatgacaaaa

SEQ ID NO: 275793 - DNA, 25 bp, Rattus norvegicus
ctgtcatccagcacactgttaagtg

SEQ ID NO: 275794 - DNA, 25 bp, Rattus norvegicus
ctgtcatccagctcactgttaagtg

SEQ ID NO: 275795 - DNA, 25 bp, Rattus norvegicus
ctgtcatccaggatcaaggcagtga

SEQ ID NO: 275796 - DNA, 25 bp, Rattus norvegicus
ctgtcatccaggttcaaggcagtga

SEQ ID NO: 275797 - DNA, 25 bp, Rattus norvegicus
ctgtcatccatcataattcatccgt

SEQ ID NO: 275798 - DNA, 25 bp, Rattus norvegicus
ctgtcatccatcttaattcatccgt

SEQ ID NO: 275799 - DNA, 25 bp, Rattus norvegicus
ctgtcatcctgtccatggtgtttca

SEQ ID NO: 275800 - DNA, 25 bp, Rattus norvegicus
ctgtcatcctgtgcatggtgtttca

SEQ ID NO: 275801 - DNA, 25 bp, Rattus norvegicus
ctgtcatccttgcacttgggaagta

SEQ ID NO: 275802 - DNA, 25 bp, Rattus norvegicus
ctgtcatccttggacttgggaagta

SEQ ID NO: 275803 - DNA, 25 bp, Rattus norvegicus
ctgtcatcgtgaaggccaagttctt

SEQ ID NO: 275804 - DNA, 25 bp, Rattus norvegicus
ctgtcatcgtgatggccaagttctt

SEQ ID NO: 275805 - DNA, 25 bp, Rattus norvegicus
ctgtcatcgtgcagcggttaacata

SEQ ID NO: 275806 - DNA, 25 bp, Rattus norvegicus
ctgtcatcgtgctgcggttaacata

SEQ ID NO: 275807 - DNA, 25 bp, Rattus norvegicus
ctgtcatctatcacctagatccaaa

SEQ ID NO: 275808 - DNA, 25 bp, Rattus norvegicus
ctgtcatctatctcctagatccaaa

SEQ ID NO: 275809 - DNA, 25 bp, Rattus norvegicus
ctgtcatcttccaagcagcgtctga

SEQ ID NO: 275810 - DNA, 25 bp, Rattus norvegicus
ctgtcatcttcctagcagcgtctga

SEQ ID NO: 275811 - DNA, 25 bp, Rattus norvegicus
ctgtcatgtagtcgccagcggcgct

SEQ ID NO: 275812 - DNA, 25 bp, Rattus norvegicus
ctgtcatgtagtggccagcggcgct

SEQ ID NO: 275813 - DNA, 25 bp, Rattus norvegicus
ctgtcatgtccaccttggagcctgg

SEQ ID NO: 275814 - DNA, 25 bp, Rattus norvegicus
ctgtcatgtccagcttggagcctgg

SEQ ID NO: 275815 - DNA, 25 bp, Rattus norvegicus
ctgtcatgtctgctaggtatgcctt

SEQ ID NO: 275816 - DNA, 25 bp, Rattus norvegicus
ctgtcatgtctggtaggtatgcctt

SEQ ID NO: 275817 - DNA, 25 bp, Rattus norvegicus
ctgtcatgttttctgatggatagaa

SEQ ID NO: 275818 - DNA, 25 bp, Rattus norvegicus
ctgtcatgttttgtgatggatagaa

SEQ ID NO: 275819 - DNA, 25 bp, Rattus norvegicus
ctgtcattcctgcaagtcctaagag

SEQ ID NO: 275820 - DNA, 25 bp, Rattus norvegicus
ctgtcattcctggaagtcctaagag

SEQ ID NO: 275821 - DNA, 25 bp, Rattus norvegicus
ctgtcatttaacctttgtcactcca

SEQ ID NO: 275822 - DNA, 25 bp, Rattus norvegicus
ctgtcatttaacgtttgtcactcca

SEQ ID NO: 275823 - DNA, 25 bp, Rattus norvegicus
ctgtcatttagcctgtgcatcatgg

SEQ ID NO: 275824 - DNA, 25 bp, Rattus norvegicus
ctgtcatttagcgtgtgcatcatgg

SEQ ID NO: 275825 - DNA, 25 bp, Rattus norvegicus
ctgtcatttctgctagcattcaaat

SEQ ID NO: 275826 - DNA, 25 bp, Rattus norvegicus
ctgtcatttctggtagcattcaaat

SEQ ID NO: 275827 - DNA, 25 bp, Rattus norvegicus
ctgtcatttgtcatgctgtgtccac

SEQ ID NO: 275828 - DNA, 25 bp, Rattus norvegicus
ctgtcatttgtcttgctgtgtccac

SEQ ID NO: 275829 - DNA, 25 bp, Rattus norvegicus
ctgtcattttccaggtgtggaacta

SEQ ID NO: 275830 - DNA, 25 bp, Rattus norvegicus
ctgtcattttcctggtgtggaacta

SEQ ID NO: 275831 - DNA, 25 bp, Rattus norvegicus
ctgtccaaaggccagtctgtgtgtc

SEQ ID NO: 275832 - DNA, 25 bp, Rattus norvegicus
ctgtccaaaggcgagtctgtgtgtc

SEQ ID NO: 275833 - DNA, 25 bp, Rattus norvegicus
ctgtccaacaaaatccaccaacatg

SEQ ID NO: 275834 - DNA, 25 bp, Rattus norvegicus
ctgtccaacaaattccaccaacatg

SEQ ID NO: 275835 - DNA, 25 bp, Rattus norvegicus
ctgtccaacagtcccaaagatgaag

SEQ ID NO: 275836 - DNA, 25 bp, Rattus norvegicus
ctgtccaacagtgccaaagatgaag

SEQ ID NO: 275837 - DNA, 25 bp, Rattus norvegicus
ctgtccaacctgaacttacattcca

SEQ ID NO: 275838 - DNA, 25 bp, Rattus norvegicus
ctgtccaacctgtacttacattcca

SEQ ID NO: 275839 - DNA, 25 bp, Rattus norvegicus
ctgtccaagttgatattcctgtatt

SEQ ID NO: 275840 - DNA, 25 bp, Rattus norvegicus
ctgtccaagttgttattcctgtatt

SEQ ID NO: 275841 - DNA, 25 bp, Rattus norvegicus
ctgtccacacagaagttacaataat

SEQ ID NO: 275842 - DNA, 25 bp, Rattus norvegicus
ctgtccacacagtagttacaataat

SEQ ID NO: 275843 - DNA, 25 bp, Rattus norvegicus
ctgtccacattcactataattttga

SEQ ID NO: 275844 - DNA, 25 bp, Rattus norvegicus
ctgtccacattctctataattttga

SEQ ID NO: 275845 - DNA, 25 bp, Rattus norvegicus
ctgtccaccaggcttaccaaatgag

SEQ ID NO: 275846 - DNA, 25 bp, Rattus norvegicus
ctgtccaccagggttaccaaatgag

SEQ ID NO: 275847 - DNA, 25 bp, Rattus norvegicus
ctgtccactctcacttaaggcaata

SEQ ID NO: 275848 - DNA, 25 bp, Rattus norvegicus
ctgtccactctctcttaaggcaata

SEQ ID NO: 275849 - DNA, 25 bp, Rattus norvegicus
ctgtccactggactagagatgttaa

SEQ ID NO: 275850 - DNA, 25 bp, Rattus norvegicus
ctgtccactggagtagagatgttaa

SEQ ID NO: 275851 - DNA, 25 bp, Rattus norvegicus
ctgtccagacagaaaactcaactct

SEQ ID NO: 275852 - DNA, 25 bp, Rattus norvegicus
ctgtccagacagtaaactcaactct

SEQ ID NO: 275853 - DNA, 25 bp, Rattus norvegicus
ctgtccagcacaatttgctcttgta

SEQ ID NO: 275854 - DNA, 25 bp, Rattus norvegicus
ctgtccagcacattttgctcttgta

SEQ ID NO: 275855 - DNA, 25 bp, Rattus norvegicus
ctgtccagcaccacttggttaaata

SEQ ID NO: 275856 - DNA, 25 bp, Rattus norvegicus
ctgtccagcacctcttggttaaata

SEQ ID NO: 275857 - DNA, 25 bp, Rattus norvegicus
ctgtccagcttgctatcctgtgaaa

SEQ ID NO: 275858 - DNA, 25 bp, Rattus norvegicus
ctgtccagcttggtatcctgtgaaa

SEQ ID NO: 275859 - DNA, 25 bp, Rattus norvegicus
ctgtccaggctgaggcttacataaa

SEQ ID NO: 275860 - DNA, 25 bp, Rattus norvegicus
ctgtccaggctgtggcttacataaa

SEQ ID NO: 275861 - DNA, 25 bp, Rattus norvegicus
ctgtccagtaagagggatccgttgg

SEQ ID NO: 275862 - DNA, 25 bp, Rattus norvegicus
ctgtccagtaagtgggatccgttgg

SEQ ID NO: 275863 - DNA, 25 bp, Rattus norvegicus
ctgtccagtgttcagagggctatct

SEQ ID NO: 275864 - DNA, 25 bp, Rattus norvegicus
ctgtccagtgttgagagggctatct

SEQ ID NO: 275865 - DNA, 25 bp, Rattus norvegicus
ctgtccagttgaacctcttttgtaa

SEQ ID NO: 275866 - DNA, 25 bp, Rattus norvegicus
ctgtccagttgatcctcttttgtaa

SEQ ID NO: 275867 - DNA, 25 bp, Rattus norvegicus
ctgtccatcagcagggttagtccct

SEQ ID NO: 275868 - DNA, 25 bp, Rattus norvegicus
ctgtccatcagctgggttagtccct

SEQ ID NO: 275869 - DNA, 25 bp, Rattus norvegicus
ctgtccatcgttactcttgtttatg

SEQ ID NO: 275870 - DNA, 25 bp, Rattus norvegicus
ctgtccatcgttagttgaaccgcgg

SEQ ID NO: 275871 - DNA, 25 bp, Rattus norvegicus
ctgtccatcgtttctcttgtttatg

SEQ ID NO: 275872 - DNA, 25 bp, Rattus norvegicus
ctgtccatcgtttgttgaaccgcgg

SEQ ID NO: 275873 - DNA, 25 bp, Rattus norvegicus
ctgtccatctagctttgtgctagaa

SEQ ID NO: 275874 - DNA, 25 bp, Rattus norvegicus
ctgtccatctaggtttgtgctagaa

SEQ ID NO: 275875 - DNA, 25 bp, Rattus norvegicus
ctgtccatgaaactgcccaaagctc

SEQ ID NO: 275876 - DNA, 25 bp, Rattus norvegicus
ctgtccatgaaagtgcccaaagctc

SEQ ID NO: 275877 - DNA, 25 bp, Rattus norvegicus
ctgtccattcggatcattcattccg

SEQ ID NO: 275878 - DNA, 25 bp, Rattus norvegicus
ctgtccattcggttcattcattccg

SEQ ID NO: 275879 - DNA, 25 bp, Rattus norvegicus
ctgtcccaccctcgaatttcaaata

SEQ ID NO: 275880 - DNA, 25 bp, Rattus norvegicus
ctgtcccaccctggaatttcaaata

SEQ ID NO: 275881 - DNA, 25 bp, Rattus norvegicus
ctgtcccactctctagatactttac

SEQ ID NO: 275882 - DNA, 25 bp, Rattus norvegicus
ctgtcccactctgtagatactttac

SEQ ID NO: 275883 - DNA, 25 bp, Rattus norvegicus
ctgtcccagagccacatgaggaagg

SEQ ID NO: 275884 - DNA, 25 bp, Rattus norvegicus
ctgtcccagagcgacatgaggaagg

SEQ ID NO: 275885 - DNA, 25 bp, Rattus norvegicus
ctgtcccaggctccttaaaaagctg

SEQ ID NO: 275886 - DNA, 25 bp, Rattus norvegicus
ctgtcccaggctgcttaaaaagctg

SEQ ID NO: 275887 - DNA, 25 bp, Rattus norvegicus
ctgtcccattgcaaggagctggcaa

SEQ ID NO: 275888 - DNA, 25 bp, Rattus norvegicus
ctgtcccattgctaggagctggcaa

SEQ ID NO: 275889 - DNA, 25 bp, Rattus norvegicus
ctgtcccctccacaaacatgtagaa

SEQ ID NO: 275890 - DNA, 25 bp, Rattus norvegicus
ctgtcccctccagaaacatgtagaa

SEQ ID NO: 275891 - DNA, 25 bp, Rattus norvegicus
ctgtcccctcctaagctacattttt

SEQ ID NO: 275892 - DNA, 25 bp, Rattus norvegicus
ctgtcccctccttagctacattttt

SEQ ID NO: 275893 - DNA, 25 bp, Rattus norvegicus
ctgtcccctggcaaatagtcagtat

SEQ ID NO: 275894 - DNA, 25 bp, Rattus norvegicus
ctgtcccctggctaatagtcagtat

SEQ ID NO: 275895 - DNA, 25 bp, Rattus norvegicus
ctgtcccctttgaatagactcttgt

SEQ ID NO: 275896 - DNA, 25 bp, Rattus norvegicus
ctgtcccctttgtatagactcttgt

SEQ ID NO: 275897 - DNA, 25 bp, Rattus norvegicus
ctgtcccggctgagagatccagagc

SEQ ID NO: 275898 - DNA, 25 bp, Rattus norvegicus
ctgtcccggctgtgagatccagagc

SEQ ID NO: 275899 - DNA, 25 bp, Rattus norvegicus
ctgtccctaactcgtctgtttattt

SEQ ID NO: 275900 - DNA, 25 bp, Rattus norvegicus
ctgtccctaactggtctgtttattt

SEQ ID NO: 275901 - DNA, 25 bp, Rattus norvegicus
ctgtccctattcaaaattcccatgg

SEQ ID NO: 275902 - DNA, 25 bp, Rattus norvegicus
ctgtccctattctaaattcccatgg

SEQ ID NO: 275903 - DNA, 25 bp, Rattus norvegicus
ctgtccctcatgagcctgtcaataa

SEQ ID NO: 275904 - DNA, 25 bp, Rattus norvegicus
ctgtccctcatgagtgtctttaaat

SEQ ID NO: 275905 - DNA, 25 bp, Rattus norvegicus
ctgtccctcatgtgcctgtcaataa

SEQ ID NO: 275906 - DNA, 25 bp, Rattus norvegicus
ctgtccctcatgtgtgtctttaaat

SEQ ID NO: 275907 - DNA, 25 bp, Rattus norvegicus
ctgtccctcattcgtgaacatggtt

SEQ ID NO: 275908 - DNA, 25 bp, Rattus norvegicus
ctgtccctcattggtgaacatggtt

SEQ ID NO: 275909 - DNA, 25 bp, Rattus norvegicus
ctgtccctcggcaggaatgtgattt

SEQ ID NO: 275910 - DNA, 25 bp, Rattus norvegicus
ctgtccctcggctggaatgtgattt

SEQ ID NO: 275911 - DNA, 25 bp, Rattus norvegicus
ctgtccctgatgacatgatgccaaa

SEQ ID NO: 275912 - DNA, 25 bp, Rattus norvegicus
ctgtccctgatgtcatgatgccaaa

SEQ ID NO: 275913 - DNA, 25 bp, Rattus norvegicus
ctgtccctgcaaagtagtacctata

SEQ ID NO: 275914 - DNA, 25 bp, Rattus norvegicus
ctgtccctgcaatgtagtacctata

SEQ ID NO: 275915 - DNA, 25 bp, Rattus norvegicus
ctgtccctggacaccttaagatagg

SEQ ID NO: 275916 - DNA, 25 bp, Rattus norvegicus
ctgtccctggactccttaagatagg

SEQ ID NO: 275917 - DNA, 25 bp, Rattus norvegicus
ctgtccctgggtacagattgctgcc

SEQ ID NO: 275918 - DNA, 25 bp, Rattus norvegicus
ctgtccctgggttcagattgctgcc

SEQ ID NO: 275919 - DNA, 25 bp, Rattus norvegicus
ctgtccctgtctccttagaatggaa

SEQ ID NO: 275920 - DNA, 25 bp, Rattus norvegicus
ctgtccctgtctgcttagaatggaa

SEQ ID NO: 275921 - DNA, 25 bp, Rattus norvegicus
ctgtcccttaagacacggagttggt

SEQ ID NO: 275922 - DNA, 25 bp, Rattus norvegicus
ctgtcccttaagtcacggagttggt

SEQ ID NO: 275923 - DNA, 25 bp, Rattus norvegicus
ctgtcccttcagatgcacaaaagca

SEQ ID NO: 275924 - DNA, 25 bp, Rattus norvegicus
ctgtcccttcagttgcacaaaagca

SEQ ID NO: 275925 - DNA, 25 bp, Rattus norvegicus
ctgtcccttggaagcaccagagaga

SEQ ID NO: 275926 - DNA, 25 bp, Rattus norvegicus
ctgtcccttggacgaatttgtcata

SEQ ID NO: 275927 - DNA, 25 bp, Rattus norvegicus
ctgtcccttggaggaatttgtcata

SEQ ID NO: 275928 - DNA, 25 bp, Rattus norvegicus
ctgtcccttggatgcaccagagaga

SEQ ID NO: 275929 - DNA, 25 bp, Rattus norvegicus
ctgtccctttcaagagtggccaaag

SEQ ID NO: 275930 - DNA, 25 bp, Rattus norvegicus
ctgtccctttcatgagtggccaaag

SEQ ID NO: 275931 - DNA, 25 bp, Rattus norvegicus
ctgtccgagcagatttcagattgga

SEQ ID NO: 275932 - DNA, 25 bp, Rattus norvegicus
ctgtccgagcagttttcagattgga

SEQ ID NO: 275933 - DNA, 25 bp, Rattus norvegicus
ctgtccgtacagaatcctagagata

SEQ ID NO: 275934 - DNA, 25 bp, Rattus norvegicus
ctgtccgtacagtatcctagagata

SEQ ID NO: 275935 - DNA, 25 bp, Rattus norvegicus
ctgtccgtcttaatatcactctcaa

SEQ ID NO: 275936 - DNA, 25 bp, Rattus norvegicus
ctgtccgtcttattatcactctcaa

SEQ ID NO: 275937 - DNA, 25 bp, Rattus norvegicus
ctgtccgtggacagagctgatctgt

SEQ ID NO: 275938 - DNA, 25 bp, Rattus norvegicus
ctgtccgtggactgagctgatctgt

SEQ ID NO: 275939 - DNA, 25 bp, Rattus norvegicus
ctgtcctacaatccctggcaggtgg

SEQ ID NO: 275940 - DNA, 25 bp, Rattus norvegicus
ctgtcctacaatgcctggcaggtgg

SEQ ID NO: 275941 - DNA, 25 bp, Rattus norvegicus
ctgtcctacccaataaagctctgtg

SEQ ID NO: 275942 - DNA, 25 bp, Rattus norvegicus
ctgtcctacccattaaagctctgtg

SEQ ID NO: 275943 - DNA, 25 bp, Rattus norvegicus
ctgtcctcaagcctaggccaaagct

SEQ ID NO: 275944 - DNA, 25 bp, Rattus norvegicus
ctgtcctcaagcgtaggccaaagct

SEQ ID NO: 275945 - DNA, 25 bp, Rattus norvegicus
ctgtcctcagtcatactgcagttta

SEQ ID NO: 275946 - DNA, 25 bp, Rattus norvegicus
ctgtcctcagtcttactgcagttta

SEQ ID NO: 275947 - DNA, 25 bp, Rattus norvegicus
ctgtcctcatgaagtcctctgatga

SEQ ID NO: 275948 - DNA, 25 bp, Rattus norvegicus
ctgtcctcatgatgtcctctgatga

SEQ ID NO: 275949 - DNA, 25 bp, Rattus norvegicus
ctgtcctcatgcatgaacctggtaa

SEQ ID NO: 275950 - DNA, 25 bp, Rattus norvegicus
ctgtcctcatgcttgaacctggtaa

SEQ ID NO: 275951 - DNA, 25 bp, Rattus norvegicus
ctgtcctccaagagctatgactaca

SEQ ID NO: 275952 - DNA, 25 bp, Rattus norvegicus
ctgtcctccaagtgctatgactaca

SEQ ID NO: 275953 - DNA, 25 bp, Rattus norvegicus
ctgtcctccatgactgtggagcaaa

SEQ ID NO: 275954 - DNA, 25 bp, Rattus norvegicus
ctgtcctccatgtctgtggagcaaa

SEQ ID NO: 275955 - DNA, 25 bp, Rattus norvegicus
ctgtcctccgacagagcagagcgag

SEQ ID NO: 275956 - DNA, 25 bp, Rattus norvegicus
ctgtcctccgactgagcagagcgag

SEQ ID NO: 275957 - DNA, 25 bp, Rattus norvegicus
ctgtcctccgctcagttgtagaaag

SEQ ID NO: 275958 - DNA, 25 bp, Rattus norvegicus
ctgtcctccgctgagttgtagaaag

SEQ ID NO: 275959 - DNA, 25 bp, Rattus norvegicus
ctgtcctccggaatcacatttaatg

SEQ ID NO: 275960 - DNA, 25 bp, Rattus norvegicus
ctgtcctccggattcacatttaatg

SEQ ID NO: 275961 - DNA, 25 bp, Rattus norvegicus
ctgtcctcctggagtcatgtggtgt

SEQ ID NO: 275962 - DNA, 25 bp, Rattus norvegicus
ctgtcctcctggtgtcatgtggtgt

SEQ ID NO: 275963 - DNA, 25 bp, Rattus norvegicus
ctgtcctctagactggtcttcagat

SEQ ID NO: 275964 - DNA, 25 bp, Rattus norvegicus
ctgtcctctagagtggtcttcagat

SEQ ID NO: 275965 - DNA, 25 bp, Rattus norvegicus
ctgtcctctcagctaaggtttccaa

SEQ ID NO: 275966 - DNA, 25 bp, Rattus norvegicus
ctgtcctctcaggtaaggtttccaa

SEQ ID NO: 275967 - DNA, 25 bp, Rattus norvegicus
ctgtcctctgaaacatcagtgttaa

SEQ ID NO: 275968 - DNA, 25 bp, Rattus norvegicus
ctgtcctctgaatcatcagtgttaa

SEQ ID NO: 275969 - DNA, 25 bp, Rattus norvegicus
ctgtcctctgctcgttggaggtaga

SEQ ID NO: 275970 - DNA, 25 bp, Rattus norvegicus
ctgtcctctgctggttggaggtaga

SEQ ID NO: 275971 - DNA, 25 bp, Rattus norvegicus
ctgtcctgagagaagggcctgcata

SEQ ID NO: 275972 - DNA, 25 bp, Rattus norvegicus
ctgtcctgagagtagggcctgcata

SEQ ID NO: 275973 - DNA, 25 bp, Rattus norvegicus
ctgtcctgagtgagagaatcctgaa

SEQ ID NO: 275974 - DNA, 25 bp, Rattus norvegicus
ctgtcctgagtgtgagaatcctgaa

SEQ ID NO: 275975 - DNA, 25 bp, Rattus norvegicus
ctgtcctgcattcccatgatgtgca

SEQ ID NO: 275976 - DNA, 25 bp, Rattus norvegicus
ctgtcctgcattgccatgatgtgca

SEQ ID NO: 275977 - DNA, 25 bp, Rattus norvegicus
ctgtcctgcctgagtcagagctgga

SEQ ID NO: 275978 - DNA, 25 bp, Rattus norvegicus
ctgtcctgcctgtgtcagagctgga

SEQ ID NO: 275979 - DNA, 25 bp, Rattus norvegicus
ctgtcctggattccagcctggagaa

SEQ ID NO: 275980 - DNA, 25 bp, Rattus norvegicus
ctgtcctggattgcagcctggagaa

SEQ ID NO: 275981 - DNA, 25 bp, Rattus norvegicus
ctgtcctggcagctgaagttgactt

SEQ ID NO: 275982 - DNA, 25 bp, Rattus norvegicus
ctgtcctggcaggtgaagttgactt

SEQ ID NO: 275983 - DNA, 25 bp, Rattus norvegicus
ctgtcctgggtgcattcagtgtcca

SEQ ID NO: 275984 - DNA, 25 bp, Rattus norvegicus
ctgtcctgggtggattcagtgtcca

SEQ ID NO: 275985 - DNA, 25 bp, Rattus norvegicus
ctgtcctgtcttctggcagcagcac

SEQ ID NO: 275986 - DNA, 25 bp, Rattus norvegicus
ctgtcctgtcttgtggcagcagcac

SEQ ID NO: 275987 - DNA, 25 bp, Rattus norvegicus
ctgtcctgttttcacccagagaaac

SEQ ID NO: 275988 - DNA, 25 bp, Rattus norvegicus
ctgtcctgttttgacccagagaaac

SEQ ID NO: 275989 - DNA, 25 bp, Rattus norvegicus
ctgtccttagctactcactatatag

SEQ ID NO: 275990 - DNA, 25 bp, Rattus norvegicus
ctgtccttagcttctcactatatag

SEQ ID NO: 275991 - DNA, 25 bp, Rattus norvegicus
ctgtccttcacccattatgatcaga

SEQ ID NO: 275992 - DNA, 25 bp, Rattus norvegicus
ctgtccttcaccgattatgatcaga

SEQ ID NO: 275993 - DNA, 25 bp, Rattus norvegicus
ctgtccttcagaagagccatggctc

SEQ ID NO: 275994 - DNA, 25 bp, Rattus norvegicus
ctgtccttcagatgagccatggctc

SEQ ID NO: 275995 - DNA, 25 bp, Rattus norvegicus
ctgtccttccccaaagcttagaagt

SEQ ID NO: 275996 - DNA, 25 bp, Rattus norvegicus
ctgtccttcccctaagcttagaagt

SEQ ID NO: 275997 - DNA, 25 bp, Rattus norvegicus
ctgtccttccctagggtatagagga

SEQ ID NO: 275998 - DNA, 25 bp, Rattus norvegicus
ctgtccttcccttgggtatagagga

SEQ ID NO: 275999 - DNA, 25 bp, Rattus norvegicus
ctgtccttcctaactgcaaatcagt

SEQ ID NO: 276000 - DNA, 25 bp, Rattus norvegicus
ctgtccttcctatctgcaaatcagt

SEQ ID NO: 276001 - DNA, 25 bp, Rattus norvegicus
ctgtccttccttacttattcagatt

SEQ ID NO: 276002 - DNA, 25 bp, Rattus norvegicus
ctgtccttccttcgtgactggaaat

SEQ ID NO: 276003 - DNA, 25 bp, Rattus norvegicus
ctgtccttccttggtgactggaaat

SEQ ID NO: 276004 - DNA, 25 bp, Rattus norvegicus
ctgtccttcctttcttattcagatt

SEQ ID NO: 276005 - DNA, 25 bp, Rattus norvegicus
ctgtccttctgactgagactcgata

SEQ ID NO: 276006 - DNA, 25 bp, Rattus norvegicus
ctgtccttctgagtgagactcgata

SEQ ID NO: 276007 - DNA, 25 bp, Rattus norvegicus
ctgtccttgcctctcaggatgatat

SEQ ID NO: 276008 - DNA, 25 bp, Rattus norvegicus
ctgtccttgcctgtcaggatgatat

SEQ ID NO: 276009 - DNA, 25 bp, Rattus norvegicus
ctgtccttggagagcagcctcaggg

SEQ ID NO: 276010 - DNA, 25 bp, Rattus norvegicus
ctgtccttggagtgcagcctcaggg

SEQ ID NO: 276011 - DNA, 25 bp, Rattus norvegicus
ctgtcctttcagcagtgtgcagctc

SEQ ID NO: 276012 - DNA, 25 bp, Rattus norvegicus
ctgtcctttcaggagtgtgcagctc

SEQ ID NO: 276013 - DNA, 25 bp, Rattus norvegicus
ctgtcctttgccatgtaccaaacaa

SEQ ID NO: 276014 - DNA, 25 bp, Rattus norvegicus
ctgtcctttgccttgtaccaaacaa

SEQ ID NO: 276015 - DNA, 25 bp, Rattus norvegicus
ctgtcgatgcctcaactttgagttg

SEQ ID NO: 276016 - DNA, 25 bp, Rattus norvegicus
ctgtcgatgcctgaactttgagttg

SEQ ID NO: 276017 - DNA, 25 bp, Rattus norvegicus
ctgtcgattcccacacaggtgaaag

SEQ ID NO: 276018 - DNA, 25 bp, Rattus norvegicus
ctgtcgattccctcacaggtgaaag

SEQ ID NO: 276019 - DNA, 25 bp, Rattus norvegicus
ctgtcgcacatgagagggccggacc

SEQ ID NO: 276020 - DNA, 25 bp, Rattus norvegicus
ctgtcgcacatgtgagggccggacc

SEQ ID NO: 276021 - DNA, 25 bp, Rattus norvegicus
ctgtcgcagcccatgtgtaggtgtt

SEQ ID NO: 276022 - DNA, 25 bp, Rattus norvegicus
ctgtcgcagcccttgtgtaggtgtt

SEQ ID NO: 276023 - DNA, 25 bp, Rattus norvegicus
ctgtcgcagtgcatggttgcagtga

SEQ ID NO: 276024 - DNA, 25 bp, Rattus norvegicus
ctgtcgcagtgcttggttgcagtga

SEQ ID NO: 276025 - DNA, 25 bp, Rattus norvegicus
ctgtcgcatccaatatttatccttt

SEQ ID NO: 276026 - DNA, 25 bp, Rattus norvegicus
ctgtcgcatccattatttatccttt

SEQ ID NO: 276027 - DNA, 25 bp, Rattus norvegicus
ctgtcgccacagaagactcttgcaa

SEQ ID NO: 276028 - DNA, 25 bp, Rattus norvegicus
ctgtcgccacagtagactcttgcaa

SEQ ID NO: 276029 - DNA, 25 bp, Rattus norvegicus
ctgtcgccatgcctagttcatttga

SEQ ID NO: 276030 - DNA, 25 bp, Rattus norvegicus
ctgtcgccatgcgtagttcatttga

SEQ ID NO: 276031 - DNA, 25 bp, Rattus norvegicus
ctgtcggagtgcctaatcttgtggt

SEQ ID NO: 276032 - DNA, 25 bp, Rattus norvegicus
ctgtcggagtgcgtaatcttgtggt

SEQ ID NO: 276033 - DNA, 25 bp, Rattus norvegicus
ctgtcggagttcatcgtgtactacg

SEQ ID NO: 276034 - DNA, 25 bp, Rattus norvegicus
ctgtcggagttcttcgtgtactacg

SEQ ID NO: 276035 - DNA, 25 bp, Rattus norvegicus
ctgtcggcagcaaaagaattccttt

SEQ ID NO: 276036 - DNA, 25 bp, Rattus norvegicus
ctgtcggcagcataagaattccttt

SEQ ID NO: 276037 - DNA, 25 bp, Rattus norvegicus
ctgtcggcaggcacatgggatatgt

SEQ ID NO: 276038 - DNA, 25 bp, Rattus norvegicus
ctgtcggcaggctcatgggatatgt

SEQ ID NO: 276039 - DNA, 25 bp, Rattus norvegicus
ctgtcggcctgtaggcatgcatgga

SEQ ID NO: 276040 - DNA, 25 bp, Rattus norvegicus
ctgtcggcctgttggcatgcatgga

SEQ ID NO: 276041 - DNA, 25 bp, Rattus norvegicus
ctgtcgggatacagaggcaagctta

SEQ ID NO: 276042 - DNA, 25 bp, Rattus norvegicus
ctgtcgggatactgaggcaagctta

SEQ ID NO: 276043 - DNA, 25 bp, Rattus norvegicus
ctgtcggtaaccatcctaatcaatt

SEQ ID NO: 276044 - DNA, 25 bp, Rattus norvegicus
ctgtcggtaaccttcctaatcaatt

SEQ ID NO: 276045 - DNA, 25 bp, Rattus norvegicus
ctgtcggtcaccaagagtctgcttc

SEQ ID NO: 276046 - DNA, 25 bp, Rattus norvegicus
ctgtcggtcacctagagtctgcttc

SEQ ID NO: 276047 - DNA, 25 bp, Rattus norvegicus
ctgtcgtatgcaacatttccccttt

SEQ ID NO: 276048 - DNA, 25 bp, Rattus norvegicus
ctgtcgtatgcatcatttccccttt

SEQ ID NO: 276049 - DNA, 25 bp, Rattus norvegicus
ctgtcgtcatggagagcatctactt

SEQ ID NO: 276050 - DNA, 25 bp, Rattus norvegicus
ctgtcgtcatggtgagcatctactt

SEQ ID NO: 276051 - DNA, 25 bp, Rattus norvegicus
ctgtcgtcctgacctgtatgtgtga

SEQ ID NO: 276052 - DNA, 25 bp, Rattus norvegicus
ctgtcgtcctgagctgtatgtgtga

SEQ ID NO: 276053 - DNA, 25 bp, Rattus norvegicus
ctgtcgtctccaaaagcaaccaaag

SEQ ID NO: 276054 - DNA, 25 bp, Rattus norvegicus
ctgtcgtctccataagcaaccaaag

SEQ ID NO: 276055 - DNA, 25 bp, Rattus norvegicus
ctgtcgtctgcaatgaccaggtgaa

SEQ ID NO: 276056 - DNA, 25 bp, Rattus norvegicus
ctgtcgtctgcattgaccaggtgaa

SEQ ID NO: 276057 - DNA, 25 bp, Rattus norvegicus
ctgtcgtgaggaccaccgtgatcaa

SEQ ID NO: 276058 - DNA, 25 bp, Rattus norvegicus
ctgtcgtgaggagcaccgtgatcaa

SEQ ID NO: 276059 - DNA, 25 bp, Rattus norvegicus
ctgtcgtgcctcatgggttatagaa

SEQ ID NO: 276060 - DNA, 25 bp, Rattus norvegicus
ctgtcgtgcctcttgggttatagaa

SEQ ID NO: 276061 - DNA, 25 bp, Rattus norvegicus
ctgtcgtgctggctgtgatcatgac

SEQ ID NO: 276062 - DNA, 25 bp, Rattus norvegicus
ctgtcgtgctgggtgtgatcatgac

SEQ ID NO: 276063 - DNA, 25 bp, Rattus norvegicus
ctgtcgtgtcttactatgctcatga

SEQ ID NO: 276064 - DNA, 25 bp, Rattus norvegicus
ctgtcgtgtctttctatgctcatga

SEQ ID NO: 276065 - DNA, 25 bp, Rattus norvegicus
ctgtcgtgtgatattgttgtttgta

SEQ ID NO: 276066 - DNA, 25 bp, Rattus norvegicus
ctgtcgtgtgattttgttgtttgta

SEQ ID NO: 276067 - DNA, 25 bp, Rattus norvegicus
ctgtcgttaactagctgattctacc

SEQ ID NO: 276068 - DNA, 25 bp, Rattus norvegicus
ctgtcgttaacttgctgattctacc

SEQ ID NO: 276069 - DNA, 25 bp, Rattus norvegicus
ctgtctacaccaccctaggcaagaa

SEQ ID NO: 276070 - DNA, 25 bp, Rattus norvegicus
ctgtctacaccagcctaggcaagaa

SEQ ID NO: 276071 - DNA, 25 bp, Rattus norvegicus
ctgtctacatgcattctcatccaag

SEQ ID NO: 276072 - DNA, 25 bp, Rattus norvegicus
ctgtctacatgctttctcatccaag

SEQ ID NO: 276073 - DNA, 25 bp, Rattus norvegicus
ctgtctacccgacgagctccagaga

SEQ ID NO: 276074 - DNA, 25 bp, Rattus norvegicus
ctgtctacccgaggagctccagaga

SEQ ID NO: 276075 - DNA, 25 bp, Rattus norvegicus
ctgtctaggcttcctggctctggtg

SEQ ID NO: 276076 - DNA, 25 bp, Rattus norvegicus
ctgtctaggcttgctggctctggtg

SEQ ID NO: 276077 - DNA, 25 bp, Rattus norvegicus
ctgtctatatttctggtggcctgtg

SEQ ID NO: 276078 - DNA, 25 bp, Rattus norvegicus
ctgtctatatttgtggtggcctgtg

SEQ ID NO: 276079 - DNA, 25 bp, Rattus norvegicus
ctgtctattctgaggagttgctgga

SEQ ID NO: 276080 - DNA, 25 bp, Rattus norvegicus
ctgtctattctgtggagttgctgga

SEQ ID NO: 276081 - DNA, 25 bp, Rattus norvegicus
ctgtctcaaaaaccttcaaagttga

SEQ ID NO: 276082 - DNA, 25 bp, Rattus norvegicus
ctgtctcaaaaagcttcaaagttga

SEQ ID NO: 276083 - DNA, 25 bp, Rattus norvegicus
ctgtctcaatctcgagttcctcaat

SEQ ID NO: 276084 - DNA, 25 bp, Rattus norvegicus
ctgtctcaatctggagttcctcaat

SEQ ID NO: 276085 - DNA, 25 bp, Rattus norvegicus
ctgtctcacacactcggccaagaat

SEQ ID NO: 276086 - DNA, 25 bp, Rattus norvegicus
ctgtctcacacagtcggccaagaat

SEQ ID NO: 276087 - DNA, 25 bp, Rattus norvegicus
ctgtctcagaaaacatgccttgcat

SEQ ID NO: 276088 - DNA, 25 bp, Rattus norvegicus
ctgtctcagaaacagccacaggctg

SEQ ID NO: 276089 - DNA, 25 bp, Rattus norvegicus
ctgtctcagaaagagccacaggctg

SEQ ID NO: 276090 - DNA, 25 bp, Rattus norvegicus
ctgtctcagaaatcatgccttgcat

SEQ ID NO: 276091 - DNA, 25 bp, Rattus norvegicus
ctgtctcattcgatacagcaacgtt

SEQ ID NO: 276092 - DNA, 25 bp, Rattus norvegicus
ctgtctcattcgttacagcaacgtt

SEQ ID NO: 276093 - DNA, 25 bp, Rattus norvegicus
ctgtctccaaacaaaggctccttta

SEQ ID NO: 276094 - DNA, 25 bp, Rattus norvegicus
ctgtctccaaactaaggctccttta

SEQ ID NO: 276095 - DNA, 25 bp, Rattus norvegicus
ctgtctccaacacttctttcattaa

SEQ ID NO: 276096 - DNA, 25 bp, Rattus norvegicus
ctgtctccaacagttctttcattaa

SEQ ID NO: 276097 - DNA, 25 bp, Rattus norvegicus
ctgtctccacctatgtcatattaaa

SEQ ID NO: 276098 - DNA, 25 bp, Rattus norvegicus
ctgtctccacctttgtcatattaaa

SEQ ID NO: 276099 - DNA, 25 bp, Rattus norvegicus
ctgtctccagtacggtttctttgaa

SEQ ID NO: 276100 - DNA, 25 bp, Rattus norvegicus
ctgtctccagtagggtttctttgaa

SEQ ID NO: 276101 - DNA, 25 bp, Rattus norvegicus
ctgtctccatccattacatctaaag

SEQ ID NO: 276102 - DNA, 25 bp, Rattus norvegicus
ctgtctccatcctttacatctaaag

SEQ ID NO: 276103 - DNA, 25 bp, Rattus norvegicus
ctgtctccatttcattcttatgctg

SEQ ID NO: 276104 - DNA, 25 bp, Rattus norvegicus
ctgtctccatttgattcttatgctg

SEQ ID NO: 276105 - DNA, 25 bp, Rattus norvegicus
ctgtctcccgatcaaaacatatctt

SEQ ID NO: 276106 - DNA, 25 bp, Rattus norvegicus
ctgtctcccgatgaaaacatatctt

SEQ ID NO: 276107 - DNA, 25 bp, Rattus norvegicus
ctgtctccctctagatttaagttgt

SEQ ID NO: 276108 - DNA, 25 bp, Rattus norvegicus
ctgtctccctcttgatttaagttgt

SEQ ID NO: 276109 - DNA, 25 bp, Rattus norvegicus
ctgtctccggcaatcgagggttaga

SEQ ID NO: 276110 - DNA, 25 bp, Rattus norvegicus
ctgtctccggcattcgagggttaga

SEQ ID NO: 276111 - DNA, 25 bp, Rattus norvegicus
ctgtctccggttatctctggtttat

SEQ ID NO: 276112 - DNA, 25 bp, Rattus norvegicus
ctgtctccggttttctctggtttat

SEQ ID NO: 276113 - DNA, 25 bp, Rattus norvegicus
ctgtctcctaatccagtgcatttag

SEQ ID NO: 276114 - DNA, 25 bp, Rattus norvegicus
ctgtctcctaatgcagtgcatttag

SEQ ID NO: 276115 - DNA, 25 bp, Rattus norvegicus
ctgtctcctacactaacactcagta

SEQ ID NO: 276116 - DNA, 25 bp, Rattus norvegicus
ctgtctcctacagtaacactcagta

SEQ ID NO: 276117 - DNA, 25 bp, Rattus norvegicus
ctgtctcctatgaacctctgttata

SEQ ID NO: 276118 - DNA, 25 bp, Rattus norvegicus
ctgtctcctatgtacctctgttata

SEQ ID NO: 276119 - DNA, 25 bp, Rattus norvegicus
ctgtctcctcagagggtatttttat

SEQ ID NO: 276120 - DNA, 25 bp, Rattus norvegicus
ctgtctcctcagtgggtatttttat

SEQ ID NO: 276121 - DNA, 25 bp, Rattus norvegicus
ctgtctcctctgactggaacaagga

SEQ ID NO: 276122 - DNA, 25 bp, Rattus norvegicus
ctgtctcctctgtctggaacaagga

SEQ ID NO: 276123 - DNA, 25 bp, Rattus norvegicus
ctgtctcctgctccagagtggaaaa

SEQ ID NO: 276124 - DNA, 25 bp, Rattus norvegicus
ctgtctcctgctgcagagtggaaaa

SEQ ID NO: 276125 - DNA, 25 bp, Rattus norvegicus
ctgtctcctgggaactgggactata

SEQ ID NO: 276126 - DNA, 25 bp, Rattus norvegicus
ctgtctcctgggtactgggactata

SEQ ID NO: 276127 - DNA, 25 bp, Rattus norvegicus
ctgtctcctgttatacttttctgtg

SEQ ID NO: 276128 - DNA, 25 bp, Rattus norvegicus
ctgtctcctgttttacttttctgtg

SEQ ID NO: 276129 - DNA, 25 bp, Rattus norvegicus
ctgtctccttgtcacctgatgtgta

SEQ ID NO: 276130 - DNA, 25 bp, Rattus norvegicus
ctgtctccttgtgacctgatgtgta

SEQ ID NO: 276131 - DNA, 25 bp, Rattus norvegicus
ctgtctcggtgcatatttgctaaaa

SEQ ID NO: 276132 - DNA, 25 bp, Rattus norvegicus
ctgtctcggtgcttatttgctaaaa

SEQ ID NO: 276133 - DNA, 25 bp, Rattus norvegicus
ctgtctctagacctaatcattgtga

SEQ ID NO: 276134 - DNA, 25 bp, Rattus norvegicus
ctgtctctagacgtaatcattgtga

SEQ ID NO: 276135 - DNA, 25 bp, Rattus norvegicus
ctgtctctcaggcagtttcttctgc

SEQ ID NO: 276136 - DNA, 25 bp, Rattus norvegicus
ctgtctctcagggagtttcttctgc

SEQ ID NO: 276137 - DNA, 25 bp, Rattus norvegicus
ctgtctctccagcacctgaaattaa

SEQ ID NO: 276138 - DNA, 25 bp, Rattus norvegicus
ctgtctctccaggacctgaaattaa

SEQ ID NO: 276139 - DNA, 25 bp, Rattus norvegicus
ctgtctctcctaaaatgttctccat

SEQ ID NO: 276140 - DNA, 25 bp, Rattus norvegicus
ctgtctctcctataatgttctccat

SEQ ID NO: 276141 - DNA, 25 bp, Rattus norvegicus
ctgtctctctacaaacatcctgaag

SEQ ID NO: 276142 - DNA, 25 bp, Rattus norvegicus
ctgtctctctactaacatcctgaag

SEQ ID NO: 276143 - DNA, 25 bp, Rattus norvegicus
ctgtctctgcatattgttacttgat

SEQ ID NO: 276144 - DNA, 25 bp, Rattus norvegicus
ctgtctctgcattttgttacttgat

SEQ ID NO: 276145 - DNA, 25 bp, Rattus norvegicus
ctgtctctgctgaactgaggtgttt

SEQ ID NO: 276146 - DNA, 25 bp, Rattus norvegicus
ctgtctctgctgtactgaggtgttt

SEQ ID NO: 276147 - DNA, 25 bp, Rattus norvegicus
ctgtctctgggcctggtcaagaaac

SEQ ID NO: 276148 - DNA, 25 bp, Rattus norvegicus
ctgtctctgggcgtggtcaagaaac

SEQ ID NO: 276149 - DNA, 25 bp, Rattus norvegicus
ctgtctcttcaaatgacgagatttg

SEQ ID NO: 276150 - DNA, 25 bp, Rattus norvegicus
ctgtctcttcaattgacgagatttg

SEQ ID NO: 276151 - DNA, 25 bp, Rattus norvegicus
ctgtctcttctaagtgtttcttcaa

SEQ ID NO: 276152 - DNA, 25 bp, Rattus norvegicus
ctgtctcttctatgtgtttcttcaa

SEQ ID NO: 276153 - DNA, 25 bp, Rattus norvegicus
ctgtctctttcactctacatttttg

SEQ ID NO: 276154 - DNA, 25 bp, Rattus norvegicus
ctgtctctttcagtctacatttttg

SEQ ID NO: 276155 - DNA, 25 bp, Rattus norvegicus
ctgtctctttcgcttcattctcaaa

SEQ ID NO: 276156 - DNA, 25 bp, Rattus norvegicus
ctgtctctttcggttcattctcaaa

SEQ ID NO: 276157 - DNA, 25 bp, Rattus norvegicus
ctgtctctttttaaatgtccttctt

SEQ ID NO: 276158 - DNA, 25 bp, Rattus norvegicus
ctgtctcttttttaatgtccttctt

SEQ ID NO: 276159 - DNA, 25 bp, Rattus norvegicus
ctgtctgaacgcacttttcaggaga

SEQ ID NO: 276160 - DNA, 25 bp, Rattus norvegicus
ctgtctgaacgctcttttcaggaga

SEQ ID NO: 276161 - DNA, 25 bp, Rattus norvegicus
ctgtctgaatcacggcgtgcctttc

SEQ ID NO: 276162 - DNA, 25 bp, Rattus norvegicus
ctgtctgaatcagggcgtgcctttc

SEQ ID NO: 276163 - DNA, 25 bp, Rattus norvegicus
ctgtctgagtttcgcctcatgccag

SEQ ID NO: 276164 - DNA, 25 bp, Rattus norvegicus
ctgtctgagtttggcctcatgccag

SEQ ID NO: 276165 - DNA, 25 bp, Rattus norvegicus
ctgtctgatatcaagtgtctgctat

SEQ ID NO: 276166 - DNA, 25 bp, Rattus norvegicus
ctgtctgatatctagtgtctgctat

SEQ ID NO: 276167 - DNA, 25 bp, Rattus norvegicus
ctgtctgatccactgcttaacttca

SEQ ID NO: 276168 - DNA, 25 bp, Rattus norvegicus
ctgtctgatccagtgcttaacttca

SEQ ID NO: 276169 - DNA, 25 bp, Rattus norvegicus
ctgtctgatgtaccccacgtggaaa

SEQ ID NO: 276170 - DNA, 25 bp, Rattus norvegicus
ctgtctgatgtagcccacgtggaaa

SEQ ID NO: 276171 - DNA, 25 bp, Rattus norvegicus
ctgtctgatgttatggttgtacgaa

SEQ ID NO: 276172 - DNA, 25 bp, Rattus norvegicus
ctgtctgatgttttggttgtacgaa

SEQ ID NO: 276173 - DNA, 25 bp, Rattus norvegicus
ctgtctgcagcactggagtctggaa

SEQ ID NO: 276174 - DNA, 25 bp, Rattus norvegicus
ctgtctgcagcagtggagtctggaa

SEQ ID NO: 276175 - DNA, 25 bp, Rattus norvegicus
ctgtctgcaggtactttgatttgga

SEQ ID NO: 276176 - DNA, 25 bp, Rattus norvegicus
ctgtctgcaggttctttgatttgga

SEQ ID NO: 276177 - DNA, 25 bp, Rattus norvegicus
ctgtctgcatgtatcctttggctgt

SEQ ID NO: 276178 - DNA, 25 bp, Rattus norvegicus
ctgtctgcatgtttcctttggctgt

SEQ ID NO: 276179 - DNA, 25 bp, Rattus norvegicus
ctgtctgccaggagttgggctcaaa

SEQ ID NO: 276180 - DNA, 25 bp, Rattus norvegicus
ctgtctgccaggtgttgggctcaaa

SEQ ID NO: 276181 - DNA, 25 bp, Rattus norvegicus
ctgtctgccgtgctttttgagggac

SEQ ID NO: 276182 - DNA, 25 bp, Rattus norvegicus
ctgtctgccgtggtttttgagggac

SEQ ID NO: 276183 - DNA, 25 bp, Rattus norvegicus
ctgtctgcctctacgtaagcggaag

SEQ ID NO: 276184 - DNA, 25 bp, Rattus norvegicus
ctgtctgcctcttcgtaagcggaag

SEQ ID NO: 276185 - DNA, 25 bp, Rattus norvegicus
ctgtctgcctgaagtctgtgtaaag

SEQ ID NO: 276186 - DNA, 25 bp, Rattus norvegicus
ctgtctgcctgatgtctgtgtaaag

SEQ ID NO: 276187 - DNA, 25 bp, Rattus norvegicus
ctgtctgcctttaaaactcgttgca

SEQ ID NO: 276188 - DNA, 25 bp, Rattus norvegicus
ctgtctgccttttaaactcgttgca

SEQ ID NO: 276189 - DNA, 25 bp, Rattus norvegicus
ctgtctgctctcagcaaagatggca

SEQ ID NO: 276190 - DNA, 25 bp, Rattus norvegicus
ctgtctgctctctgcaaagatggca

SEQ ID NO: 276191 - DNA, 25 bp, Rattus norvegicus
ctgtctgctgacctcttttagttaa

SEQ ID NO: 276192 - DNA, 25 bp, Rattus norvegicus
ctgtctgctgacgtcttttagttaa

SEQ ID NO: 276193 - DNA, 25 bp, Rattus norvegicus
ctgtctggaaaacgccagcggcgca

SEQ ID NO: 276194 - DNA, 25 bp, Rattus norvegicus
ctgtctggaaaaggccagcggcgca

SEQ ID NO: 276195 - DNA, 25 bp, Rattus norvegicus
ctgtctggaactaacctcgtgggta

SEQ ID NO: 276196 - DNA, 25 bp, Rattus norvegicus
ctgtctggaacttacctcgtgggta

SEQ ID NO: 276197 - DNA, 25 bp, Rattus norvegicus
ctgtctggagaccttcgaatctgag

SEQ ID NO: 276198 - DNA, 25 bp, Rattus norvegicus
ctgtctggagacgttcgaatctgag

SEQ ID NO: 276199 - DNA, 25 bp, Rattus norvegicus
ctgtctggagtcataagcttacgtt

SEQ ID NO: 276200 - DNA, 25 bp, Rattus norvegicus
ctgtctggagtcttaagcttacgtt

SEQ ID NO: 276201 - DNA, 25 bp, Rattus norvegicus
ctgtctggatctagtcagtccttaa

SEQ ID NO: 276202 - DNA, 25 bp, Rattus norvegicus
ctgtctggatcttgtcagtccttaa

SEQ ID NO: 276203 - DNA, 25 bp, Rattus norvegicus
ctgtctggcagaagagtgctggtca

SEQ ID NO: 276204 - DNA, 25 bp, Rattus norvegicus
ctgtctggcagatgagtgctggtca

SEQ ID NO: 276205 - DNA, 25 bp, Rattus norvegicus
ctgtctggctgcctgtccttgcagg

SEQ ID NO: 276206 - DNA, 25 bp, Rattus norvegicus
ctgtctggctgcgtgtccttgcagg

SEQ ID NO: 276207 - DNA, 25 bp, Rattus norvegicus
ctgtctgggagcacacattgtgatc

SEQ ID NO: 276208 - DNA, 25 bp, Rattus norvegicus
ctgtctgggagctcacattgtgatc

SEQ ID NO: 276209 - DNA, 25 bp, Rattus norvegicus
ctgtctggtctcagtctgcaaggaa

SEQ ID NO: 276210 - DNA, 25 bp, Rattus norvegicus
ctgtctggtctctgtctgcaaggaa

SEQ ID NO: 276211 - DNA, 25 bp, Rattus norvegicus
ctgtctggttgtacctgggcttaac

SEQ ID NO: 276212 - DNA, 25 bp, Rattus norvegicus
ctgtctggttgttcctgggcttaac

SEQ ID NO: 276213 - DNA, 25 bp, Rattus norvegicus
ctgtctgtaactccattttcaagga

SEQ ID NO: 276214 - DNA, 25 bp, Rattus norvegicus
ctgtctgtaactgcattttcaagga

SEQ ID NO: 276215 - DNA, 25 bp, Rattus norvegicus
ctgtctgtagaaaagctggttagtc

SEQ ID NO: 276216 - DNA, 25 bp, Rattus norvegicus
ctgtctgtagaatagctggttagtc

SEQ ID NO: 276217 - DNA, 25 bp, Rattus norvegicus
ctgtctgtaggtccctgggatgcct

SEQ ID NO: 276218 - DNA, 25 bp, Rattus norvegicus
ctgtctgtaggtgcctgggatgcct

SEQ ID NO: 276219 - DNA, 25 bp, Rattus norvegicus
ctgtctgtagtgatttgtggagttc

SEQ ID NO: 276220 - DNA, 25 bp, Rattus norvegicus
ctgtctgtagtgttttgtggagttc

SEQ ID NO: 276221 - DNA, 25 bp, Rattus norvegicus
ctgtctgtatgcactttggtttatc

SEQ ID NO: 276222 - DNA, 25 bp, Rattus norvegicus
ctgtctgtatgctctttggtttatc

SEQ ID NO: 276223 - DNA, 25 bp, Rattus norvegicus
ctgtctgtcaccatgagcaaagcga

SEQ ID NO: 276224 - DNA, 25 bp, Rattus norvegicus
ctgtctgtcaccttgagcaaagcga

SEQ ID NO: 276225 - DNA, 25 bp, Rattus norvegicus
ctgtctgtcaggctttcctaggaaa

SEQ ID NO: 276226 - DNA, 25 bp, Rattus norvegicus
ctgtctgtcagggtttcctaggaaa

SEQ ID NO: 276227 - DNA, 25 bp, Rattus norvegicus
ctgtctgtccgtcacactgtgcaca

SEQ ID NO: 276228 - DNA, 25 bp, Rattus norvegicus
ctgtctgtccgtgacactgtgcaca

SEQ ID NO: 276229 - DNA, 25 bp, Rattus norvegicus
ctgtctgtccttcgtgttgttagca

SEQ ID NO: 276230 - DNA, 25 bp, Rattus norvegicus
ctgtctgtccttggtgttgttagca

SEQ ID NO: 276231 - DNA, 25 bp, Rattus norvegicus
ctgtctgtcgggatcagcatttttg

SEQ ID NO: 276232 - DNA, 25 bp, Rattus norvegicus
ctgtctgtcgggttcagcatttttg

SEQ ID NO: 276233 - DNA, 25 bp, Rattus norvegicus
ctgtctgtctaacaatggcgtgtgt

SEQ ID NO: 276234 - DNA, 25 bp, Rattus norvegicus
ctgtctgtctaagaatggcgtgtgt

SEQ ID NO: 276235 - DNA, 25 bp, Rattus norvegicus
ctgtctgtctatcttttgtgggttg

SEQ ID NO: 276236 - DNA, 25 bp, Rattus norvegicus
ctgtctgtctatgttttgtgggttg

SEQ ID NO: 276237 - DNA, 25 bp, Rattus norvegicus
ctgtctgtctgacagtctggcctga

SEQ ID NO: 276238 - DNA, 25 bp, Rattus norvegicus
ctgtctgtctgaccgtgcaacgtaa

SEQ ID NO: 276239 - DNA, 25 bp, Rattus norvegicus
ctgtctgtctgagagtctggcctga

SEQ ID NO: 276240 - DNA, 25 bp, Rattus norvegicus
ctgtctgtctgagcgtgcaacgtaa

SEQ ID NO: 276241 - DNA, 25 bp, Rattus norvegicus
ctgtctgtctgcaaagggagtgtcc

SEQ ID NO: 276242 - DNA, 25 bp, Rattus norvegicus
ctgtctgtctgcactgatggatttc

SEQ ID NO: 276243 - DNA, 25 bp, Rattus norvegicus
ctgtctgtctgctaagggagtgtcc

SEQ ID NO: 276244 - DNA, 25 bp, Rattus norvegicus
ctgtctgtctgctctgatggatttc

SEQ ID NO: 276245 - DNA, 25 bp, Rattus norvegicus
ctgtctgtcttcatctctgtttata

SEQ ID NO: 276246 - DNA, 25 bp, Rattus norvegicus
ctgtctgtcttcttctctgtttata

SEQ ID NO: 276247 - DNA, 25 bp, Rattus norvegicus
ctgtctgtctttacgtctgcaaaga

SEQ ID NO: 276248 - DNA, 25 bp, Rattus norvegicus
ctgtctgtcttttcgtctgcaaaga

SEQ ID NO: 276249 - DNA, 25 bp, Rattus norvegicus
ctgtctgtgagccttctgtggaaga

SEQ ID NO: 276250 - DNA, 25 bp, Rattus norvegicus
ctgtctgtgagcgttctgtggaaga

SEQ ID NO: 276251 - DNA, 25 bp, Rattus norvegicus
ctgtctgtgcatacaccgttgtgaa

SEQ ID NO: 276252 - DNA, 25 bp, Rattus norvegicus
ctgtctgtgcattcaccgttgtgaa

SEQ ID NO: 276253 - DNA, 25 bp, Rattus norvegicus
ctgtctgtgcccagaacatctaata

SEQ ID NO: 276254 - DNA, 25 bp, Rattus norvegicus
ctgtctgtgccctgaacatctaata

SEQ ID NO: 276255 - DNA, 25 bp, Rattus norvegicus
ctgtctgtgcctatctattttgaag

SEQ ID NO: 276256 - DNA, 25 bp, Rattus norvegicus
ctgtctgtgcctttctattttgaag

SEQ ID NO: 276257 - DNA, 25 bp, Rattus norvegicus
ctgtctgtgctcacactgaaagcat

SEQ ID NO: 276258 - DNA, 25 bp, Rattus norvegicus
ctgtctgtgctctcactgaaagcat

SEQ ID NO: 276259 - DNA, 25 bp, Rattus norvegicus
ctgtctgtgtcacatgcccaaaggt

SEQ ID NO: 276260 - DNA, 25 bp, Rattus norvegicus
ctgtctgtgtcagatgcccaaaggt

SEQ ID NO: 276261 - DNA, 25 bp, Rattus norvegicus
ctgtctgtgtttatgtcgggctgga

SEQ ID NO: 276262 - DNA, 25 bp, Rattus norvegicus
ctgtctgtgtttttgtcgggctgga

SEQ ID NO: 276263 - DNA, 25 bp, Rattus norvegicus
ctgtctgttatcatagtgctgtact

SEQ ID NO: 276264 - DNA, 25 bp, Rattus norvegicus
ctgtctgttatcttagtgctgtact

SEQ ID NO: 276265 - DNA, 25 bp, Rattus norvegicus
ctgtctgtttctactcataattaat

SEQ ID NO: 276266 - DNA, 25 bp, Rattus norvegicus
ctgtctgtttcttctcataattaat

SEQ ID NO: 276267 - DNA, 25 bp, Rattus norvegicus
ctgtcttacaggagggtgagtcttc

SEQ ID NO: 276268 - DNA, 25 bp, Rattus norvegicus
ctgtcttacaggtgggtgagtcttc

SEQ ID NO: 276269 - DNA, 25 bp, Rattus norvegicus
ctgtcttaggtgactgtgtagccct

SEQ ID NO: 276270 - DNA, 25 bp, Rattus norvegicus
ctgtcttaggtgtctgtgtagccct

SEQ ID NO: 276271 - DNA, 25 bp, Rattus norvegicus
ctgtcttagttgatggtgttttctc

SEQ ID NO: 276272 - DNA, 25 bp, Rattus norvegicus
ctgtcttagttgttggtgttttctc

SEQ ID NO: 276273 - DNA, 25 bp, Rattus norvegicus
ctgtcttatatcaatctaggctgga

SEQ ID NO: 276274 - DNA, 25 bp, Rattus norvegicus
ctgtcttatatctatctaggctgga

SEQ ID NO: 276275 - DNA, 25 bp, Rattus norvegicus
ctgtcttatcttaactacacatatt

SEQ ID NO: 276276 - DNA, 25 bp, Rattus norvegicus
ctgtcttatctttactacacatatt

SEQ ID NO: 276277 - DNA, 25 bp, Rattus norvegicus
ctgtcttcagcccaatggtgtgcaa

SEQ ID NO: 276278 - DNA, 25 bp, Rattus norvegicus
ctgtcttcagccgaatggtgtgcaa

SEQ ID NO: 276279 - DNA, 25 bp, Rattus norvegicus
ctgtcttcaggccaacatgttttct

SEQ ID NO: 276280 - DNA, 25 bp, Rattus norvegicus
ctgtcttcaggcgaacatgttttct

SEQ ID NO: 276281 - DNA, 25 bp, Rattus norvegicus
ctgtcttccagactgttgggcagga

SEQ ID NO: 276282 - DNA, 25 bp, Rattus norvegicus
ctgtcttccagagtgttgggcagga

SEQ ID NO: 276283 - DNA, 25 bp, Rattus norvegicus
ctgtcttcctgcacctaataaagtt

SEQ ID NO: 276284 - DNA, 25 bp, Rattus norvegicus
ctgtcttcctgctcctaataaagtt

SEQ ID NO: 276285 - DNA, 25 bp, Rattus norvegicus
ctgtcttctcttaggtttttgggct

SEQ ID NO: 276286 - DNA, 25 bp, Rattus norvegicus
ctgtcttctctttggtttttgggct

SEQ ID NO: 276287 - DNA, 25 bp, Rattus norvegicus
ctgtcttctgaaccggttggtcgaa

SEQ ID NO: 276288 - DNA, 25 bp, Rattus norvegicus
ctgtcttctgaagcggttggtcgaa

SEQ ID NO: 276289 - DNA, 25 bp, Rattus norvegicus
ctgtcttctgccagatccacgggaa

SEQ ID NO: 276290 - DNA, 25 bp, Rattus norvegicus
ctgtcttctgcctgatccacgggaa

SEQ ID NO: 276291 - DNA, 25 bp, Rattus norvegicus
ctgtcttctgtcaataggttgctca

SEQ ID NO: 276292 - DNA, 25 bp, Rattus norvegicus
ctgtcttctgtctataggttgctca

SEQ ID NO: 276293 - DNA, 25 bp, Rattus norvegicus
ctgtcttgaaagatgctgggtgtgc

SEQ ID NO: 276294 - DNA, 25 bp, Rattus norvegicus
ctgtcttgaaagttgctgggtgtgc

SEQ ID NO: 276295 - DNA, 25 bp, Rattus norvegicus
ctgtcttgaactcttctgtttccaa

SEQ ID NO: 276296 - DNA, 25 bp, Rattus norvegicus
ctgtcttgaactgttctgtttccaa

SEQ ID NO: 276297 - DNA, 25 bp, Rattus norvegicus
ctgtcttgatttatcccacctataa

SEQ ID NO: 276298 - DNA, 25 bp, Rattus norvegicus
ctgtcttgatttttcccacctataa

SEQ ID NO: 276299 - DNA, 25 bp, Rattus norvegicus
ctgtcttggactacataccctttat

SEQ ID NO: 276300 - DNA, 25 bp, Rattus norvegicus
ctgtcttggactattctgttaatat

SEQ ID NO: 276301 - DNA, 25 bp, Rattus norvegicus
ctgtcttggacttcataccctttat

SEQ ID NO: 276302 - DNA, 25 bp, Rattus norvegicus
ctgtcttggacttttctgttaatat

SEQ ID NO: 276303 - DNA, 25 bp, Rattus norvegicus
ctgtcttgggctatgaagtccgtta

SEQ ID NO: 276304 - DNA, 25 bp, Rattus norvegicus
ctgtcttgggctttgaagtccgtta

SEQ ID NO: 276305 - DNA, 25 bp, Rattus norvegicus
ctgtcttgtctcatcagggctgtgc

SEQ ID NO: 276306 - DNA, 25 bp, Rattus norvegicus
ctgtcttgtctcttcagggctgtgc

SEQ ID NO: 276307 - DNA, 25 bp, Rattus norvegicus
ctgtcttgtcttatgtctcttgaaa

SEQ ID NO: 276308 - DNA, 25 bp, Rattus norvegicus
ctgtcttgtcttttgtctcttgaaa

SEQ ID NO: 276309 - DNA, 25 bp, Rattus norvegicus
ctgtcttgtgtaccatctcagagtt

SEQ ID NO: 276310 - DNA, 25 bp, Rattus norvegicus
ctgtcttgtgtagcatctcagagtt

SEQ ID NO: 276311 - DNA, 25 bp, Rattus norvegicus
ctgtctttaaacaggtgtttctcct

SEQ ID NO: 276312 - DNA, 25 bp, Rattus norvegicus
ctgtctttaaactggtgtttctcct

SEQ ID NO: 276313 - DNA, 25 bp, Rattus norvegicus
ctgtctttaatcacttggctgcctg

SEQ ID NO: 276314 - DNA, 25 bp, Rattus norvegicus
ctgtctttaatctcttggctgcctg

SEQ ID NO: 276315 - DNA, 25 bp, Rattus norvegicus
ctgtctttacctagccatttcaaaa

SEQ ID NO: 276316 - DNA, 25 bp, Rattus norvegicus
ctgtctttaccttgccatttcaaaa

SEQ ID NO: 276317 - DNA, 25 bp, Rattus norvegicus
ctgtctttcgccaaaaacctcaaat

SEQ ID NO: 276318 - DNA, 25 bp, Rattus norvegicus
ctgtctttcgcctaaaacctcaaat

SEQ ID NO: 276319 - DNA, 25 bp, Rattus norvegicus
ctgtctttcttgatagtgttcgctg

SEQ ID NO: 276320 - DNA, 25 bp, Rattus norvegicus
ctgtctttcttgttagtgttcgctg

SEQ ID NO: 276321 - DNA, 25 bp, Rattus norvegicus
ctgtctttgcccaatccagaggaag

SEQ ID NO: 276322 - DNA, 25 bp, Rattus norvegicus
ctgtctttgccctatccagaggaag

SEQ ID NO: 276323 - DNA, 25 bp, Rattus norvegicus
ctgtcttttgtaatctctgatgcca

SEQ ID NO: 276324 - DNA, 25 bp, Rattus norvegicus
ctgtcttttgtattctctgatgcca

SEQ ID NO: 276325 - DNA, 25 bp, Rattus norvegicus
ctgtcttttgttaccaaagtcacga

SEQ ID NO: 276326 - DNA, 25 bp, Rattus norvegicus
ctgtcttttgtttccaaagtcacga

SEQ ID NO: 276327 - DNA, 25 bp, Rattus norvegicus
ctgtgaaaacagctctcccttagaa

SEQ ID NO: 276328 - DNA, 25 bp, Rattus norvegicus
ctgtgaaaacaggtctcccttagaa

SEQ ID NO: 276329 - DNA, 25 bp, Rattus norvegicus
ctgtgaaaccccatttttcaacatc

SEQ ID NO: 276330 - DNA, 25 bp, Rattus norvegicus
ctgtgaaaccccttttttcaacatc

SEQ ID NO: 276331 - DNA, 25 bp, Rattus norvegicus
ctgtgaaaggagcttcaggctttgt

SEQ ID NO: 276332 - DNA, 25 bp, Rattus norvegicus
ctgtgaaaggaggttcaggctttgt

SEQ ID NO: 276333 - DNA, 25 bp, Rattus norvegicus
ctgtgaaatggccagagctcaaccc

SEQ ID NO: 276334 - DNA, 25 bp, Rattus norvegicus
ctgtgaaatggcgagagctcaaccc

SEQ ID NO: 276335 - DNA, 25 bp, Rattus norvegicus
ctgtgaacctgccaatctgctgtaa

SEQ ID NO: 276336 - DNA, 25 bp, Rattus norvegicus
ctgtgaacctgcgaatctgctgtaa

SEQ ID NO: 276337 - DNA, 25 bp, Rattus norvegicus
ctgtgaaccttgaggacctcgatgg

SEQ ID NO: 276338 - DNA, 25 bp, Rattus norvegicus
ctgtgaaccttgtggacctcgatgg

SEQ ID NO: 276339 - DNA, 25 bp, Rattus norvegicus
ctgtgaacgattcccagtatctggt

SEQ ID NO: 276340 - DNA, 25 bp, Rattus norvegicus
ctgtgaacgattgccagtatctggt

SEQ ID NO: 276341 - DNA, 25 bp, Rattus norvegicus
ctgtgaagcgacaggcgtgaagccc

SEQ ID NO: 276342 - DNA, 25 bp, Rattus norvegicus
ctgtgaagcgactggcgtgaagccc

SEQ ID NO: 276343 - DNA, 25 bp, Rattus norvegicus
ctgtgaagggttctcaaggttgcat

SEQ ID NO: 276344 - DNA, 25 bp, Rattus norvegicus
ctgtgaagggttgtcaaggttgcat

SEQ ID NO: 276345 - DNA, 25 bp, Rattus norvegicus
ctgtgaagtccaaccaagggacccc

SEQ ID NO: 276346 - DNA, 25 bp, Rattus norvegicus
ctgtgaagtccatccaagggacccc

SEQ ID NO: 276347 - DNA, 25 bp, Rattus norvegicus
ctgtgaagtcccaggattggatctt

SEQ ID NO: 276348 - DNA, 25 bp, Rattus norvegicus
ctgtgaagtccctggattggatctt

SEQ ID NO: 276349 - DNA, 25 bp, Rattus norvegicus
ctgtgaatcacacgccttgacatcc

SEQ ID NO: 276350 - DNA, 25 bp, Rattus norvegicus
ctgtgaatcacaggccttgacatcc

SEQ ID NO: 276351 - DNA, 25 bp, Rattus norvegicus
ctgtgaatcattcagtcctggtggt

SEQ ID NO: 276352 - DNA, 25 bp, Rattus norvegicus
ctgtgaatcattgagtcctggtggt

SEQ ID NO: 276353 - DNA, 25 bp, Rattus norvegicus
ctgtgaatctgcacttggctggctt

SEQ ID NO: 276354 - DNA, 25 bp, Rattus norvegicus
ctgtgaatctgctcttggctggctt

SEQ ID NO: 276355 - DNA, 25 bp, Rattus norvegicus
ctgtgaatgtgtcttggctagccct

SEQ ID NO: 276356 - DNA, 25 bp, Rattus norvegicus
ctgtgaatgtgtgttggctagccct

SEQ ID NO: 276357 - DNA, 25 bp, Rattus norvegicus
ctgtgaattctgatgcactgacaaa

SEQ ID NO: 276358 - DNA, 25 bp, Rattus norvegicus
ctgtgaattctgttgcactgacaaa

SEQ ID NO: 276359 - DNA, 25 bp, Rattus norvegicus
ctgtgacaaggtatttctgtggtat

SEQ ID NO: 276360 - DNA, 25 bp, Rattus norvegicus
ctgtgacaaggtttttctgtggtat

SEQ ID NO: 276361 - DNA, 25 bp, Rattus norvegicus
ctgtgacactttctttatgggtttt

SEQ ID NO: 276362 - DNA, 25 bp, Rattus norvegicus
ctgtgacactttgtttatgggtttt

SEQ ID NO: 276363 - DNA, 25 bp, Rattus norvegicus
ctgtgacagacaatcttgaaagtga

SEQ ID NO: 276364 - DNA, 25 bp, Rattus norvegicus
ctgtgacagacattcttgaaagtga

SEQ ID NO: 276365 - DNA, 25 bp, Rattus norvegicus
ctgtgacaggccacaagctcctttc

SEQ ID NO: 276366 - DNA, 25 bp, Rattus norvegicus
ctgtgacaggcctcaagctcctttc

SEQ ID NO: 276367 - DNA, 25 bp, Rattus norvegicus
ctgtgacatcagagggctagcatct

SEQ ID NO: 276368 - DNA, 25 bp, Rattus norvegicus
ctgtgacatcagtgggctagcatct

SEQ ID NO: 276369 - DNA, 25 bp, Rattus norvegicus
ctgtgacatttcaaccactgttgga

SEQ ID NO: 276370 - DNA, 25 bp, Rattus norvegicus
ctgtgacatttctaccactgttgga

SEQ ID NO: 276371 - DNA, 25 bp, Rattus norvegicus
ctgtgaccatgtcctgtgctcaaag

SEQ ID NO: 276372 - DNA, 25 bp, Rattus norvegicus
ctgtgaccatgtgctgtgctcaaag

SEQ ID NO: 276373 - DNA, 25 bp, Rattus norvegicus
ctgtgaccattactttcccagtggc

SEQ ID NO: 276374 - DNA, 25 bp, Rattus norvegicus
ctgtgaccattagtttcccagtggc

SEQ ID NO: 276375 - DNA, 25 bp, Rattus norvegicus
ctgtgaccccagatccagtgaggag

SEQ ID NO: 276376 - DNA, 25 bp, Rattus norvegicus
ctgtgaccccagttccagtgaggag

SEQ ID NO: 276377 - DNA, 25 bp, Rattus norvegicus
ctgtgacctcacaactcagtattgt

SEQ ID NO: 276378 - DNA, 25 bp, Rattus norvegicus
ctgtgacctcactactcagtattgt

SEQ ID NO: 276379 - DNA, 25 bp, Rattus norvegicus
ctgtgactaatcatgtgtattgagc

SEQ ID NO: 276380 - DNA, 25 bp, Rattus norvegicus
ctgtgactaatcttgtgtattgagc

SEQ ID NO: 276381 - DNA, 25 bp, Rattus norvegicus
ctgtgactccagacgttagtgacaa

SEQ ID NO: 276382 - DNA, 25 bp, Rattus norvegicus
ctgtgactccagattggatagatca

SEQ ID NO: 276383 - DNA, 25 bp, Rattus norvegicus
ctgtgactccagtcgttagtgacaa

SEQ ID NO: 276384 - DNA, 25 bp, Rattus norvegicus
ctgtgactccagtttggatagatca

SEQ ID NO: 276385 - DNA, 25 bp, Rattus norvegicus
ctgtgactgctgctttgcatgaaaa

SEQ ID NO: 276386 - DNA, 25 bp, Rattus norvegicus
ctgtgactgctggtttgcatgaaaa

SEQ ID NO: 276387 - DNA, 25 bp, Rattus norvegicus
ctgtgactgtggattacccgactgt

SEQ ID NO: 276388 - DNA, 25 bp, Rattus norvegicus
ctgtgactgtggtttacccgactgt

SEQ ID NO: 276389 - DNA, 25 bp, Rattus norvegicus
ctgtgacttcagatctaggtgattc

SEQ ID NO: 276390 - DNA, 25 bp, Rattus norvegicus
ctgtgacttcagttctaggtgattc

SEQ ID NO: 276391 - DNA, 25 bp, Rattus norvegicus
ctgtgacttttaagaactcctgtgt

SEQ ID NO: 276392 - DNA, 25 bp, Rattus norvegicus
ctgtgacttttatgaactcctgtgt

SEQ ID NO: 276393 - DNA, 25 bp, Rattus norvegicus
ctgtgagaagatctcggagtcccta

SEQ ID NO: 276394 - DNA, 25 bp, Rattus norvegicus
ctgtgagaagatgtcggagtcccta

SEQ ID NO: 276395 - DNA, 25 bp, Rattus norvegicus
ctgtgagaccagaacccagtttcat

SEQ ID NO: 276396 - DNA, 25 bp, Rattus norvegicus
ctgtgagaccagtacccagtttcat

SEQ ID NO: 276397 - DNA, 25 bp, Rattus norvegicus
ctgtgagacccaataccatactttg

SEQ ID NO: 276398 - DNA, 25 bp, Rattus norvegicus
ctgtgagacccattaccatactttg

SEQ ID NO: 276399 - DNA, 25 bp, Rattus norvegicus
ctgtgagactgaaggcctctaatct

SEQ ID NO: 276400 - DNA, 25 bp, Rattus norvegicus
ctgtgagactgatggcctctaatct

SEQ ID NO: 276401 - DNA, 25 bp, Rattus norvegicus
ctgtgagatagaccacttcttctgt

SEQ ID NO: 276402 - DNA, 25 bp, Rattus norvegicus
ctgtgagatagagcacttcttctgt

SEQ ID NO: 276403 - DNA, 25 bp, Rattus norvegicus
ctgtgagatcacaggcttcggacaa

SEQ ID NO: 276404 - DNA, 25 bp, Rattus norvegicus
ctgtgagatcactggcttcggacaa

SEQ ID NO: 276405 - DNA, 25 bp, Rattus norvegicus
ctgtgagatgttatgaatgtgccct

SEQ ID NO: 276406 - DNA, 25 bp, Rattus norvegicus
ctgtgagatgttttgaatgtgccct

SEQ ID NO: 276407 - DNA, 25 bp, Rattus norvegicus
ctgtgagcaacacccattctctggt

SEQ ID NO: 276408 - DNA, 25 bp, Rattus norvegicus
ctgtgagcaacagccattctctggt

SEQ ID NO: 276409 - DNA, 25 bp, Rattus norvegicus
ctgtgagcagaacccgtaccctgtg

SEQ ID NO: 276410 - DNA, 25 bp, Rattus norvegicus
ctgtgagcagaagccgtaccctgtg

SEQ ID NO: 276411 - DNA, 25 bp, Rattus norvegicus
ctgtgagcatgccttggttttctta

SEQ ID NO: 276412 - DNA, 25 bp, Rattus norvegicus
ctgtgagcatgcgttggttttctta

SEQ ID NO: 276413 - DNA, 25 bp, Rattus norvegicus
ctgtgagccagaccactttggagga

SEQ ID NO: 276414 - DNA, 25 bp, Rattus norvegicus
ctgtgagccagagcactttggagga

SEQ ID NO: 276415 - DNA, 25 bp, Rattus norvegicus
ctgtgagcgaatcgcttcagtctgt

SEQ ID NO: 276416 - DNA, 25 bp, Rattus norvegicus
ctgtgagcgaatggcttcagtctgt

SEQ ID NO: 276417 - DNA, 25 bp, Rattus norvegicus
ctgtgagctgctatggtggagttcc

SEQ ID NO: 276418 - DNA, 25 bp, Rattus norvegicus
ctgtgagctgctttggtggagttcc

SEQ ID NO: 276419 - DNA, 25 bp, Rattus norvegicus
ctgtgagctggccaaagtgctgcat

SEQ ID NO: 276420 - DNA, 25 bp, Rattus norvegicus
ctgtgagctggcgaaagtgctgcat

SEQ ID NO: 276421 - DNA, 25 bp, Rattus norvegicus
ctgtgagctttcactgtgggtgaca

SEQ ID NO: 276422 - DNA, 25 bp, Rattus norvegicus
ctgtgagctttctctgtgggtgaca

SEQ ID NO: 276423 - DNA, 25 bp, Rattus norvegicus
ctgtgagctttgcaacaagactgaa

SEQ ID NO: 276424 - DNA, 25 bp, Rattus norvegicus
ctgtgagctttggaacaagactgaa

SEQ ID NO: 276425 - DNA, 25 bp, Rattus norvegicus
ctgtgaggcactccacagtggtaaa

SEQ ID NO: 276426 - DNA, 25 bp, Rattus norvegicus
ctgtgaggcactgcacagtggtaaa

SEQ ID NO: 276427 - DNA, 25 bp, Rattus norvegicus
ctgtgaggccttaaggacaagctgg

SEQ ID NO: 276428 - DNA, 25 bp, Rattus norvegicus
ctgtgaggcctttaggacaagctgg

SEQ ID NO: 276429 - DNA, 25 bp, Rattus norvegicus
ctgtgaggtctcatcaaactgaatt

SEQ ID NO: 276430 - DNA, 25 bp, Rattus norvegicus
ctgtgaggtctcttcaaactgaatt

SEQ ID NO: 276431 - DNA, 25 bp, Rattus norvegicus
ctgtgaggtcttaagcacctccttt

SEQ ID NO: 276432 - DNA, 25 bp, Rattus norvegicus
ctgtgaggtctttagcacctccttt

SEQ ID NO: 276433 - DNA, 25 bp, Rattus norvegicus
ctgtgagtacagatgtcctttgtgt

SEQ ID NO: 276434 - DNA, 25 bp, Rattus norvegicus
ctgtgagtacagctccaggagagct

SEQ ID NO: 276435 - DNA, 25 bp, Rattus norvegicus
ctgtgagtacaggtccaggagagct

SEQ ID NO: 276436 - DNA, 25 bp, Rattus norvegicus
ctgtgagtacagttgtcctttgtgt

SEQ ID NO: 276437 - DNA, 25 bp, Rattus norvegicus
ctgtgagtcacaacagggtctttgt

SEQ ID NO: 276438 - DNA, 25 bp, Rattus norvegicus
ctgtgagtcacatcagggtctttgt

SEQ ID NO: 276439 - DNA, 25 bp, Rattus norvegicus
ctgtgagtcatcagcaatgagggag

SEQ ID NO: 276440 - DNA, 25 bp, Rattus norvegicus
ctgtgagtcatctgcaatgagggag

SEQ ID NO: 276441 - DNA, 25 bp, Rattus norvegicus
ctgtgagtgcagctctacactgtac

SEQ ID NO: 276442 - DNA, 25 bp, Rattus norvegicus
ctgtgagtgcaggtctacactgtac

SEQ ID NO: 276443 - DNA, 25 bp, Rattus norvegicus
ctgtgagtgcctattggtctggaaa

SEQ ID NO: 276444 - DNA, 25 bp, Rattus norvegicus
ctgtgagtgccttttggtctggaaa

SEQ ID NO: 276445 - DNA, 25 bp, Rattus norvegicus
ctgtgagtgctcacggagaggccca

SEQ ID NO: 276446 - DNA, 25 bp, Rattus norvegicus
ctgtgagtgctctcggagaggccca

SEQ ID NO: 276447 - DNA, 25 bp, Rattus norvegicus
ctgtgagtgggcattggcttcagaa

SEQ ID NO: 276448 - DNA, 25 bp, Rattus norvegicus
ctgtgagtgggctttggcttcagaa

SEQ ID NO: 276449 - DNA, 25 bp, Rattus norvegicus
ctgtgagttctgctttccttcaaga

SEQ ID NO: 276450 - DNA, 25 bp, Rattus norvegicus
ctgtgagttctggtttccttcaaga

SEQ ID NO: 276451 - DNA, 25 bp, Rattus norvegicus
ctgtgagttgaacgccagactagtc

SEQ ID NO: 276452 - DNA, 25 bp, Rattus norvegicus
ctgtgagttgaaggccagactagtc

SEQ ID NO: 276453 - DNA, 25 bp, Rattus norvegicus
ctgtgagtttctcctccaaaatggg

SEQ ID NO: 276454 - DNA, 25 bp, Rattus norvegicus
ctgtgagtttctgctccaaaatggg

SEQ ID NO: 276455 - DNA, 25 bp, Rattus norvegicus
ctgtgataactcatttccaggctta

SEQ ID NO: 276456 - DNA, 25 bp, Rattus norvegicus
ctgtgataactcttttccaggctta

SEQ ID NO: 276457 - DNA, 25 bp, Rattus norvegicus
ctgtgatagttccacattctgggtg

SEQ ID NO: 276458 - DNA, 25 bp, Rattus norvegicus
ctgtgatagttcgacattctgggtg

SEQ ID NO: 276459 - DNA, 25 bp, Rattus norvegicus
ctgtgatatctgagtcttttagtgc

SEQ ID NO: 276460 - DNA, 25 bp, Rattus norvegicus
ctgtgatatctgtgtcttttagtgc

SEQ ID NO: 276461 - DNA, 25 bp, Rattus norvegicus
ctgtgatcagaaagtactctatgaa

SEQ ID NO: 276462 - DNA, 25 bp, Rattus norvegicus
ctgtgatcagaatgtactctatgaa

SEQ ID NO: 276463 - DNA, 25 bp, Rattus norvegicus
ctgtgatcccagctatgtcaaggat

SEQ ID NO: 276464 - DNA, 25 bp, Rattus norvegicus
ctgtgatcccaggtatgtcaaggat

SEQ ID NO: 276465 - DNA, 25 bp, Rattus norvegicus
ctgtgatctgcgctttgacttggac

SEQ ID NO: 276466 - DNA, 25 bp, Rattus norvegicus
ctgtgatctgcggtttgacttggac

SEQ ID NO: 276467 - DNA, 25 bp, Rattus norvegicus
ctgtgatctgctctgtttgggacta

SEQ ID NO: 276468 - DNA, 25 bp, Rattus norvegicus
ctgtgatctgctgtgtttgggacta

SEQ ID NO: 276469 - DNA, 25 bp, Rattus norvegicus
ctgtgatcttttacctccagtactg

SEQ ID NO: 276470 - DNA, 25 bp, Rattus norvegicus
ctgtgatctttttcctccagtactg

SEQ ID NO: 276471 - DNA, 25 bp, Rattus norvegicus
ctgtgatgaccacttctgctaggaa

SEQ ID NO: 276472 - DNA, 25 bp, Rattus norvegicus
ctgtgatgaccagttctgctaggaa

SEQ ID NO: 276473 - DNA, 25 bp, Rattus norvegicus
ctgtgatgagacctctgaaagaaca

SEQ ID NO: 276474 - DNA, 25 bp, Rattus norvegicus
ctgtgatgagacgtctgaaagaaca

SEQ ID NO: 276475 - DNA, 25 bp, Rattus norvegicus
ctgtgatgctaactctctgagggat

SEQ ID NO: 276476 - DNA, 25 bp, Rattus norvegicus
ctgtgatgctaagtctctgagggat

SEQ ID NO: 276477 - DNA, 25 bp, Rattus norvegicus
ctgtgatgctgtatcccggaggtaa

SEQ ID NO: 276478 - DNA, 25 bp, Rattus norvegicus
ctgtgatgctgtttcccggaggtaa

SEQ ID NO: 276479 - DNA, 25 bp, Rattus norvegicus
ctgtgatgcttcagaggcctgtgtc

SEQ ID NO: 276480 - DNA, 25 bp, Rattus norvegicus
ctgtgatgcttctgaggcctgtgtc

SEQ ID NO: 276481 - DNA, 25 bp, Rattus norvegicus
ctgtgatgtcaccaagctgctttta

SEQ ID NO: 276482 - DNA, 25 bp, Rattus norvegicus
ctgtgatgtcacgaagctgctttta

SEQ ID NO: 276483 - DNA, 25 bp, Rattus norvegicus
ctgtgatgtgtcatagagggttctc

SEQ ID NO: 276484 - DNA, 25 bp, Rattus norvegicus
ctgtgatgtgtcttagagggttctc

SEQ ID NO: 276485 - DNA, 25 bp, Rattus norvegicus
ctgtgatgttaaatccagatgacaa

SEQ ID NO: 276486 - DNA, 25 bp, Rattus norvegicus
ctgtgatgttaattccagatgacaa

SEQ ID NO: 276487 - DNA, 25 bp, Rattus norvegicus
ctgtgatgtttgaccttctactgaa

SEQ ID NO: 276488 - DNA, 25 bp, Rattus norvegicus
ctgtgatgtttgatgtgcggacctc

SEQ ID NO: 276489 - DNA, 25 bp, Rattus norvegicus
ctgtgatgtttgtccttctactgaa

SEQ ID NO: 276490 - DNA, 25 bp, Rattus norvegicus
ctgtgatgtttgttgtgcggacctc

SEQ ID NO: 276491 - DNA, 25 bp, Rattus norvegicus
ctgtgattacagaccatgtggccct

SEQ ID NO: 276492 - DNA, 25 bp, Rattus norvegicus
ctgtgattacagctctcagcagcaa

SEQ ID NO: 276493 - DNA, 25 bp, Rattus norvegicus
ctgtgattacaggtctcagcagcaa

SEQ ID NO: 276494 - DNA, 25 bp, Rattus norvegicus
ctgtgattacagtccatgtggccct

SEQ ID NO: 276495 - DNA, 25 bp, Rattus norvegicus
ctgtgattacgtagtgtccctggac

SEQ ID NO: 276496 - DNA, 25 bp, Rattus norvegicus
ctgtgattacgttgtgtccctggac

SEQ ID NO: 276497 - DNA, 25 bp, Rattus norvegicus
ctgtgattacttaccctgcaaaagg

SEQ ID NO: 276498 - DNA, 25 bp, Rattus norvegicus
ctgtgattactttccctgcaaaagg

SEQ ID NO: 276499 - DNA, 25 bp, Rattus norvegicus
ctgtgattcactattgacttctccc

SEQ ID NO: 276500 - DNA, 25 bp, Rattus norvegicus
ctgtgattcacttttgacttctccc

SEQ ID NO: 276501 - DNA, 25 bp, Rattus norvegicus
ctgtgattctagcacatgggatatg

SEQ ID NO: 276502 - DNA, 25 bp, Rattus norvegicus
ctgtgattctaggacatgggatatg

SEQ ID NO: 276503 - DNA, 25 bp, Rattus norvegicus
ctgtgattctcaccagccacgtggc

SEQ ID NO: 276504 - DNA, 25 bp, Rattus norvegicus
ctgtgattctcagcagccacgtggc

SEQ ID NO: 276505 - DNA, 25 bp, Rattus norvegicus
ctgtgattctgcctcggattcctaa

SEQ ID NO: 276506 - DNA, 25 bp, Rattus norvegicus
ctgtgattctgcgtcggattcctaa

SEQ ID NO: 276507 - DNA, 25 bp, Rattus norvegicus
ctgtgattcttgaaatgcctgccct

SEQ ID NO: 276508 - DNA, 25 bp, Rattus norvegicus
ctgtgattcttgtaatgcctgccct

SEQ ID NO: 276509 - DNA, 25 bp, Rattus norvegicus
ctgtgatttcgtcccttgtgaagga

SEQ ID NO: 276510 - DNA, 25 bp, Rattus norvegicus
ctgtgatttcgtgccttgtgaagga

SEQ ID NO: 276511 - DNA, 25 bp, Rattus norvegicus
ctgtgatttctacttgccgatccct

SEQ ID NO: 276512 - DNA, 25 bp, Rattus norvegicus
ctgtgatttctagttgccgatccct

SEQ ID NO: 276513 - DNA, 25 bp, Rattus norvegicus
ctgtgatttgatctgcgtcttcgca

SEQ ID NO: 276514 - DNA, 25 bp, Rattus norvegicus
ctgtgatttgatgtgcgtcttcgca

SEQ ID NO: 276515 - DNA, 25 bp, Rattus norvegicus
ctgtgattttcaaaacccgttgcct

SEQ ID NO: 276516 - DNA, 25 bp, Rattus norvegicus
ctgtgattttcataacccgttgcct

SEQ ID NO: 276517 - DNA, 25 bp, Rattus norvegicus
ctgtgcaataccacatttaatctgt

SEQ ID NO: 276518 - DNA, 25 bp, Rattus norvegicus
ctgtgcaatacctcatttaatctgt

SEQ ID NO: 276519 - DNA, 25 bp, Rattus norvegicus
ctgtgcaattgaagagagctgtgtt

SEQ ID NO: 276520 - DNA, 25 bp, Rattus norvegicus
ctgtgcaattgatgagagctgtgtt

SEQ ID NO: 276521 - DNA, 25 bp, Rattus norvegicus
ctgtgcaccatgcatatgtctgtct

SEQ ID NO: 276522 - DNA, 25 bp, Rattus norvegicus
ctgtgcaccatggatatgtctgtct

SEQ ID NO: 276523 - DNA, 25 bp, Rattus norvegicus
ctgtgcacccttatgaagttgccga

SEQ ID NO: 276524 - DNA, 25 bp, Rattus norvegicus
ctgtgcacccttttgaagttgccga

SEQ ID NO: 276525 - DNA, 25 bp, Rattus norvegicus
ctgtgcaccgctcctgtctcactgg

SEQ ID NO: 276526 - DNA, 25 bp, Rattus norvegicus
ctgtgcaccgctgctgtctcactgg

SEQ ID NO: 276527 - DNA, 25 bp, Rattus norvegicus
ctgtgcactgtgctatctgcgctct

SEQ ID NO: 276528 - DNA, 25 bp, Rattus norvegicus
ctgtgcactgtggtatctgcgctct

SEQ ID NO: 276529 - DNA, 25 bp, Rattus norvegicus
ctgtgcagggtcactgtcttcagag

SEQ ID NO: 276530 - DNA, 25 bp, Rattus norvegicus
ctgtgcagggtctctgtcttcagag

SEQ ID NO: 276531 - DNA, 25 bp, Rattus norvegicus
ctgtgcagtcctcgctgtactgaaa

SEQ ID NO: 276532 - DNA, 25 bp, Rattus norvegicus
ctgtgcagtcctggctgtactgaaa

SEQ ID NO: 276533 - DNA, 25 bp, Rattus norvegicus
ctgtgcagtctcagcagtctgtgag

SEQ ID NO: 276534 - DNA, 25 bp, Rattus norvegicus
ctgtgcagtctctgcagtctgtgag

SEQ ID NO: 276535 - DNA, 25 bp, Rattus norvegicus
ctgtgcatatgaatcaagggcagtg

SEQ ID NO: 276536 - DNA, 25 bp, Rattus norvegicus
ctgtgcatatgattcaagggcagtg

SEQ ID NO: 276537 - DNA, 25 bp, Rattus norvegicus
ctgtgcatccatagtttccattgag

SEQ ID NO: 276538 - DNA, 25 bp, Rattus norvegicus
ctgtgcatccattgtttccattgag

SEQ ID NO: 276539 - DNA, 25 bp, Rattus norvegicus
ctgtgcatcctgagtgccaggatta

SEQ ID NO: 276540 - DNA, 25 bp, Rattus norvegicus
ctgtgcatcctgtgtgccaggatta

SEQ ID NO: 276541 - DNA, 25 bp, Rattus norvegicus
ctgtgcatcgcgctgtaaaagttgg

SEQ ID NO: 276542 - DNA, 25 bp, Rattus norvegicus
ctgtgcatcgcggtgtaaaagttgg

SEQ ID NO: 276543 - DNA, 25 bp, Rattus norvegicus
ctgtgcatcggtctagactgacctc

SEQ ID NO: 276544 - DNA, 25 bp, Rattus norvegicus
ctgtgcatcggtgtagactgacctc

SEQ ID NO: 276545 - DNA, 25 bp, Rattus norvegicus
ctgtgcatgcccattcattatgtga

SEQ ID NO: 276546 - DNA, 25 bp, Rattus norvegicus
ctgtgcatgccctttcattatgtga

SEQ ID NO: 276547 - DNA, 25 bp, Rattus norvegicus
ctgtgcatgctacctaagcactcta

SEQ ID NO: 276548 - DNA, 25 bp, Rattus norvegicus
ctgtgcatgctagctaagcactcta

SEQ ID NO: 276549 - DNA, 25 bp, Rattus norvegicus
ctgtgcatgcttatgctgccacaga

SEQ ID NO: 276550 - DNA, 25 bp, Rattus norvegicus
ctgtgcatgcttttgctgccacaga

SEQ ID NO: 276551 - DNA, 25 bp, Rattus norvegicus
ctgtgcatgttaccagcccgggcag

SEQ ID NO: 276552 - DNA, 25 bp, Rattus norvegicus
ctgtgcatgttagcagcccgggcag

SEQ ID NO: 276553 - DNA, 25 bp, Rattus norvegicus
ctgtgcattattcgccgtgtctcta

SEQ ID NO: 276554 - DNA, 25 bp, Rattus norvegicus
ctgtgcattattggccgtgtctcta

SEQ ID NO: 276555 - DNA, 25 bp, Rattus norvegicus
ctgtgcatttagaaactgtgtacaa

SEQ ID NO: 276556 - DNA, 25 bp, Rattus norvegicus
ctgtgcatttagtaactgtgtacaa

SEQ ID NO: 276557 - DNA, 25 bp, Rattus norvegicus
ctgtgccaagcccatttggatggat

SEQ ID NO: 276558 - DNA, 25 bp, Rattus norvegicus
ctgtgccaagccgatttggatggat

SEQ ID NO: 276559 - DNA, 25 bp, Rattus norvegicus
ctgtgccaaggccaagagctgcaat

SEQ ID NO: 276560 - DNA, 25 bp, Rattus norvegicus
ctgtgccaaggcgaagagctgcaat

SEQ ID NO: 276561 - DNA, 25 bp, Rattus norvegicus
ctgtgccaagtacgtctgctgcttc

SEQ ID NO: 276562 - DNA, 25 bp, Rattus norvegicus
ctgtgccaagtaggtctgctgcttc

SEQ ID NO: 276563 - DNA, 25 bp, Rattus norvegicus
ctgtgccaatccaaacaacgtgtgt

SEQ ID NO: 276564 - DNA, 25 bp, Rattus norvegicus
ctgtgccaatcctaacaacgtgtgt

SEQ ID NO: 276565 - DNA, 25 bp, Rattus norvegicus
ctgtgccaccaaatgtggctttcaa

SEQ ID NO: 276566 - DNA, 25 bp, Rattus norvegicus
ctgtgccaccaattgtggctttcaa

SEQ ID NO: 276567 - DNA, 25 bp, Rattus norvegicus
ctgtgccacctgagtttcaacaaag

SEQ ID NO: 276568 - DNA, 25 bp, Rattus norvegicus
ctgtgccacctgtgtttcaacaaag

SEQ ID NO: 276569 - DNA, 25 bp, Rattus norvegicus
ctgtgccagcacatctctcataagt

SEQ ID NO: 276570 - DNA, 25 bp, Rattus norvegicus
ctgtgccagcacttctctcataagt

SEQ ID NO: 276571 - DNA, 25 bp, Rattus norvegicus
ctgtgccatggacaagatgtttttc

SEQ ID NO: 276572 - DNA, 25 bp, Rattus norvegicus
ctgtgccatggagaagatgtttttc

SEQ ID NO: 276573 - DNA, 25 bp, Rattus norvegicus
ctgtgccatggccattaatgttgca

SEQ ID NO: 276574 - DNA, 25 bp, Rattus norvegicus
ctgtgccatggcgattaatgttgca

SEQ ID NO: 276575 - DNA, 25 bp, Rattus norvegicus
ctgtgcccaaacagtgccgcataaa

SEQ ID NO: 276576 - DNA, 25 bp, Rattus norvegicus
ctgtgcccaaactgtgccgcataaa

SEQ ID NO: 276577 - DNA, 25 bp, Rattus norvegicus
ctgtgcccacatcatactctttaga

SEQ ID NO: 276578 - DNA, 25 bp, Rattus norvegicus
ctgtgcccacatgatactctttaga

SEQ ID NO: 276579 - DNA, 25 bp, Rattus norvegicus
ctgtgcccagagcaaccagctgaaa

SEQ ID NO: 276580 - DNA, 25 bp, Rattus norvegicus
ctgtgcccagaggaaccagctgaaa

SEQ ID NO: 276581 - DNA, 25 bp, Rattus norvegicus
ctgtgcccagccataaaattttgag

SEQ ID NO: 276582 - DNA, 25 bp, Rattus norvegicus
ctgtgcccagccttaaaattttgag

SEQ ID NO: 276583 - DNA, 25 bp, Rattus norvegicus
ctgtgcccatataagtccatctgta

SEQ ID NO: 276584 - DNA, 25 bp, Rattus norvegicus
ctgtgcccatattagtccatctgta

SEQ ID NO: 276585 - DNA, 25 bp, Rattus norvegicus
ctgtgcccatctccgttttcttttt

SEQ ID NO: 276586 - DNA, 25 bp, Rattus norvegicus
ctgtgcccatctgcgttttcttttt

SEQ ID NO: 276587 - DNA, 25 bp, Rattus norvegicus
ctgtgccccaggcatgacaggaact

SEQ ID NO: 276588 - DNA, 25 bp, Rattus norvegicus
ctgtgccccagggatgacaggaact

SEQ ID NO: 276589 - DNA, 25 bp, Rattus norvegicus
ctgtgccccagtagatgaatccgaa

SEQ ID NO: 276590 - DNA, 25 bp, Rattus norvegicus
ctgtgccccagttgatgaatccgaa

SEQ ID NO: 276591 - DNA, 25 bp, Rattus norvegicus
ctgtgccccgtgagcgtaacgtgcg

SEQ ID NO: 276592 - DNA, 25 bp, Rattus norvegicus
ctgtgccccgtgtgcgtaacgtgcg

SEQ ID NO: 276593 - DNA, 25 bp, Rattus norvegicus
ctgtgcccctaaacactacattaga

SEQ ID NO: 276594 - DNA, 25 bp, Rattus norvegicus
ctgtgcccctaatcactacattaga

SEQ ID NO: 276595 - DNA, 25 bp, Rattus norvegicus
ctgtgccctgtaagcatctgaggaa

SEQ ID NO: 276596 - DNA, 25 bp, Rattus norvegicus
ctgtgccctgtatgcatctgaggaa

SEQ ID NO: 276597 - DNA, 25 bp, Rattus norvegicus
ctgtgccctttgacatatcctaaga

SEQ ID NO: 276598 - DNA, 25 bp, Rattus norvegicus
ctgtgccctttgtcatatcctaaga

SEQ ID NO: 276599 - DNA, 25 bp, Rattus norvegicus
ctgtgccgcgtcaggaagaagcaat

SEQ ID NO: 276600 - DNA, 25 bp, Rattus norvegicus
ctgtgccgcgtctggaagaagcaat

SEQ ID NO: 276601 - DNA, 25 bp, Rattus norvegicus
ctgtgccggaacattctgaccaaga

SEQ ID NO: 276602 - DNA, 25 bp, Rattus norvegicus
ctgtgccggaactttctgaccaaga

SEQ ID NO: 276603 - DNA, 25 bp, Rattus norvegicus
ctgtgcctaacaccagcgtttgagg

SEQ ID NO: 276604 - DNA, 25 bp, Rattus norvegicus
ctgtgcctaacagcagcgtttgagg

SEQ ID NO: 276605 - DNA, 25 bp, Rattus norvegicus
ctgtgcctaagtattgtggtgtcta

SEQ ID NO: 276606 - DNA, 25 bp, Rattus norvegicus
ctgtgcctaagttttgtggtgtcta

SEQ ID NO: 276607 - DNA, 25 bp, Rattus norvegicus
ctgtgcctcacaactttttctataa

SEQ ID NO: 276608 - DNA, 25 bp, Rattus norvegicus
ctgtgcctcacatctttttctataa

SEQ ID NO: 276609 - DNA, 25 bp, Rattus norvegicus
ctgtgcctccagaatccagcaagag

SEQ ID NO: 276610 - DNA, 25 bp, Rattus norvegicus
ctgtgcctccagtatccagcaagag

SEQ ID NO: 276611 - DNA, 25 bp, Rattus norvegicus
ctgtgcctcccaactagattaggga

SEQ ID NO: 276612 - DNA, 25 bp, Rattus norvegicus
ctgtgcctcccatctagattaggga

SEQ ID NO: 276613 - DNA, 25 bp, Rattus norvegicus
ctgtgcctctgccacagccaaaggg

SEQ ID NO: 276614 - DNA, 25 bp, Rattus norvegicus
ctgtgcctctgcgacagccaaaggg

SEQ ID NO: 276615 - DNA, 25 bp, Rattus norvegicus
ctgtgcctctttatgctggtggtaa

SEQ ID NO: 276616 - DNA, 25 bp, Rattus norvegicus
ctgtgcctctttttgctggtggtaa

SEQ ID NO: 276617 - DNA, 25 bp, Rattus norvegicus
ctgtgcctgtccctagaagaggcta

SEQ ID NO: 276618 - DNA, 25 bp, Rattus norvegicus
ctgtgcctgtccgtagaagaggcta

SEQ ID NO: 276619 - DNA, 25 bp, Rattus norvegicus
ctgtgcctgtgtacaggttcctaaa

SEQ ID NO: 276620 - DNA, 25 bp, Rattus norvegicus
ctgtgcctgtgttcaggttcctaaa

SEQ ID NO: 276621 - DNA, 25 bp, Rattus norvegicus
ctgtgccttagacagacctgtgctt

SEQ ID NO: 276622 - DNA, 25 bp, Rattus norvegicus
ctgtgccttagagagacctgtgctt

SEQ ID NO: 276623 - DNA, 25 bp, Rattus norvegicus
ctgtgccttctgcatgttgggaaag

SEQ ID NO: 276624 - DNA, 25 bp, Rattus norvegicus
ctgtgccttctggatgttgggaaag

SEQ ID NO: 276625 - DNA, 25 bp, Rattus norvegicus
ctgtgccttggtctggctgagaagt

SEQ ID NO: 276626 - DNA, 25 bp, Rattus norvegicus
ctgtgccttggtgtggctgagaagt

SEQ ID NO: 276627 - DNA, 25 bp, Rattus norvegicus
ctgtgcctttggcacaactacggga

SEQ ID NO: 276628 - DNA, 25 bp, Rattus norvegicus
ctgtgcctttgggacaactacggga

SEQ ID NO: 276629 - DNA, 25 bp, Rattus norvegicus
ctgtgccttttaaaccatgcaatat

SEQ ID NO: 276630 - DNA, 25 bp, Rattus norvegicus
ctgtgccttttataccatgcaatat

SEQ ID NO: 276631 - DNA, 25 bp, Rattus norvegicus
ctgtgcgaagggactgtcagagcat

SEQ ID NO: 276632 - DNA, 25 bp, Rattus norvegicus
ctgtgcgaagggtctgtcagagcat

SEQ ID NO: 276633 - DNA, 25 bp, Rattus norvegicus
ctgtgcgatttacccatgctgttgt

SEQ ID NO: 276634 - DNA, 25 bp, Rattus norvegicus
ctgtgcgatttagccatgctgttgt

SEQ ID NO: 276635 - DNA, 25 bp, Rattus norvegicus
ctgtgcgcatggagggcattcgaaa

SEQ ID NO: 276636 - DNA, 25 bp, Rattus norvegicus
ctgtgcgcatggtgggcattcgaaa

SEQ ID NO: 276637 - DNA, 25 bp, Rattus norvegicus
ctgtgcggtacacacatcacctgga

SEQ ID NO: 276638 - DNA, 25 bp, Rattus norvegicus
ctgtgcggtacagacatcacctgga

SEQ ID NO: 276639 - DNA, 25 bp, Rattus norvegicus
ctgtgcgtaagaacctgagtcatgt

SEQ ID NO: 276640 - DNA, 25 bp, Rattus norvegicus
ctgtgcgtaagatcctgagtcatgt

SEQ ID NO: 276641 - DNA, 25 bp, Rattus norvegicus
ctgtgcgtcggcacaacagcgggaa

SEQ ID NO: 276642 - DNA, 25 bp, Rattus norvegicus
ctgtgcgtcggctcaacagcgggaa

SEQ ID NO: 276643 - DNA, 25 bp, Rattus norvegicus
ctgtgcgtgggcactgccccttggc

SEQ ID NO: 276644 - DNA, 25 bp, Rattus norvegicus
ctgtgcgtgggctctgccccttggc

SEQ ID NO: 276645 - DNA, 25 bp, Rattus norvegicus
ctgtgctaagcaaagtctgttgtat

SEQ ID NO: 276646 - DNA, 25 bp, Rattus norvegicus
ctgtgctaagcatagtctgttgtat

SEQ ID NO: 276647 - DNA, 25 bp, Rattus norvegicus
ctgtgctaagttccgagtcctggta

SEQ ID NO: 276648 - DNA, 25 bp, Rattus norvegicus
ctgtgctaagttgcgagtcctggta

SEQ ID NO: 276649 - DNA, 25 bp, Rattus norvegicus
ctgtgctaatctaatcgctgttctt

SEQ ID NO: 276650 - DNA, 25 bp, Rattus norvegicus
ctgtgctaatcttatcgctgttctt

SEQ ID NO: 276651 - DNA, 25 bp, Rattus norvegicus
ctgtgctacattagctttaagggaa

SEQ ID NO: 276652 - DNA, 25 bp, Rattus norvegicus
ctgtgctacatttgctttaagggaa

SEQ ID NO: 276653 - DNA, 25 bp, Rattus norvegicus
ctgtgctcaactcactctgaaacaa

SEQ ID NO: 276654 - DNA, 25 bp, Rattus norvegicus
ctgtgctcaactgactctgaaacaa

SEQ ID NO: 276655 - DNA, 25 bp, Rattus norvegicus
ctgtgctcaggcctagattgttctt

SEQ ID NO: 276656 - DNA, 25 bp, Rattus norvegicus
ctgtgctcaggcgtagattgttctt

SEQ ID NO: 276657 - DNA, 25 bp, Rattus norvegicus
ctgtgctcggtactgatagtcgcta

SEQ ID NO: 276658 - DNA, 25 bp, Rattus norvegicus
ctgtgctcggtagtgatagtcgcta

SEQ ID NO: 276659 - DNA, 25 bp, Rattus norvegicus
ctgtgctctcctctaagaagacatc

SEQ ID NO: 276660 - DNA, 25 bp, Rattus norvegicus
ctgtgctctcctgtaagaagacatc

SEQ ID NO: 276661 - DNA, 25 bp, Rattus norvegicus
ctgtgctctgtcagaatgggaacca

SEQ ID NO: 276662 - DNA, 25 bp, Rattus norvegicus
ctgtgctctgtctgaatgggaacca

SEQ ID NO: 276663 - DNA, 25 bp, Rattus norvegicus
ctgtgctcttggcatctgaacgcgg

SEQ ID NO: 276664 - DNA, 25 bp, Rattus norvegicus
ctgtgctcttgggatctgaacgcgg

SEQ ID NO: 276665 - DNA, 25 bp, Rattus norvegicus
ctgtgctgaaagaatgttatctgtt

SEQ ID NO: 276666 - DNA, 25 bp, Rattus norvegicus
ctgtgctgaaagtatgttatctgtt

SEQ ID NO: 276667 - DNA, 25 bp, Rattus norvegicus
ctgtgctgacttctgcaatgctgta

SEQ ID NO: 276668 - DNA, 25 bp, Rattus norvegicus
ctgtgctgacttgtgcaatgctgta

SEQ ID NO: 276669 - DNA, 25 bp, Rattus norvegicus
ctgtgctgcactcctgggagtgtca

SEQ ID NO: 276670 - DNA, 25 bp, Rattus norvegicus
ctgtgctgcactgctgggagtgtca

SEQ ID NO: 276671 - DNA, 25 bp, Rattus norvegicus
ctgtgctgcagcctcggtcagaaaa

SEQ ID NO: 276672 - DNA, 25 bp, Rattus norvegicus
ctgtgctgcagcgtcggtcagaaaa

SEQ ID NO: 276673 - DNA, 25 bp, Rattus norvegicus
ctgtgctgccttagccagaagagtg

SEQ ID NO: 276674 - DNA, 25 bp, Rattus norvegicus
ctgtgctgcctttgccagaagagtg

SEQ ID NO: 276675 - DNA, 25 bp, Rattus norvegicus
ctgtgctggatccatcccagaagaa

SEQ ID NO: 276676 - DNA, 25 bp, Rattus norvegicus
ctgtgctggatcgatcccagaagaa

SEQ ID NO: 276677 - DNA, 25 bp, Rattus norvegicus
ctgtgctgtctcagcagaatgaggt

SEQ ID NO: 276678 - DNA, 25 bp, Rattus norvegicus
ctgtgctgtctctgcagaatgaggt

SEQ ID NO: 276679 - DNA, 25 bp, Rattus norvegicus
ctgtgctgtgttacttgtgacgttc

SEQ ID NO: 276680 - DNA, 25 bp, Rattus norvegicus
ctgtgctgtgtttcttgtgacgttc

SEQ ID NO: 276681 - DNA, 25 bp, Rattus norvegicus
ctgtgctgtttcatagcttgctttt

SEQ ID NO: 276682 - DNA, 25 bp, Rattus norvegicus
ctgtgctgtttcttagcttgctttt

SEQ ID NO: 276683 - DNA, 25 bp, Rattus norvegicus
ctgtgcttatatctggagttacttt

SEQ ID NO: 276684 - DNA, 25 bp, Rattus norvegicus
ctgtgcttatatgtggagttacttt

SEQ ID NO: 276685 - DNA, 25 bp, Rattus norvegicus
ctgtgcttattaacattacggcgat

SEQ ID NO: 276686 - DNA, 25 bp, Rattus norvegicus
ctgtgcttattatcattacggcgat

SEQ ID NO: 276687 - DNA, 25 bp, Rattus norvegicus
ctgtgcttcaccactagttgggaaa

SEQ ID NO: 276688 - DNA, 25 bp, Rattus norvegicus
ctgtgcttcacctctagttgggaaa

SEQ ID NO: 276689 - DNA, 25 bp, Rattus norvegicus
ctgtgcttcattcctctctaaagag

SEQ ID NO: 276690 - DNA, 25 bp, Rattus norvegicus
ctgtgcttcattcctgtctaatgaa

SEQ ID NO: 276691 - DNA, 25 bp, Rattus norvegicus
ctgtgcttcattgctctctaaagag

SEQ ID NO: 276692 - DNA, 25 bp, Rattus norvegicus
ctgtgcttcattgctgtctaatgaa

SEQ ID NO: 276693 - DNA, 25 bp, Rattus norvegicus
ctgtgcttcctcaggatggtttaga

SEQ ID NO: 276694 - DNA, 25 bp, Rattus norvegicus
ctgtgcttcctctggatggtttaga

SEQ ID NO: 276695 - DNA, 25 bp, Rattus norvegicus
ctgtgcttccttatgctaagagatg

SEQ ID NO: 276696 - DNA, 25 bp, Rattus norvegicus
ctgtgcttccttttgctaagagatg

SEQ ID NO: 276697 - DNA, 25 bp, Rattus norvegicus
ctgtgcttgaggcaatggtgactct

SEQ ID NO: 276698 - DNA, 25 bp, Rattus norvegicus
ctgtgcttgagggaatggtgactct

SEQ ID NO: 276699 - DNA, 25 bp, Rattus norvegicus
ctgtgcttgctgattttcagacccc

SEQ ID NO: 276700 - DNA, 25 bp, Rattus norvegicus
ctgtgcttgctgtttttcagacccc

SEQ ID NO: 276701 - DNA, 25 bp, Rattus norvegicus
ctgtgcttgtccatatctttcttaa

SEQ ID NO: 276702 - DNA, 25 bp, Rattus norvegicus
ctgtgcttgtccttatctttcttaa

SEQ ID NO: 276703 - DNA, 25 bp, Rattus norvegicus
ctgtgctttaaccttgtgctgagat

SEQ ID NO: 276704 - DNA, 25 bp, Rattus norvegicus
ctgtgctttaacgttgtgctgagat

SEQ ID NO: 276705 - DNA, 25 bp, Rattus norvegicus
ctgtgctttagaagtaattaccgga

SEQ ID NO: 276706 - DNA, 25 bp, Rattus norvegicus
ctgtgctttagatgtaattaccgga

SEQ ID NO: 276707 - DNA, 25 bp, Rattus norvegicus
ctgtgctttccacttagaccaaaaa

SEQ ID NO: 276708 - DNA, 25 bp, Rattus norvegicus
ctgtgctttccagttagaccaaaaa

SEQ ID NO: 276709 - DNA, 25 bp, Rattus norvegicus
ctgtgctttgtgatcccatcatgga

SEQ ID NO: 276710 - DNA, 25 bp, Rattus norvegicus
ctgtgctttgtgttcccatcatgga

SEQ ID NO: 276711 - DNA, 25 bp, Rattus norvegicus
ctgtggaaaagactccgcgcggcac

SEQ ID NO: 276712 - DNA, 25 bp, Rattus norvegicus
ctgtggaaaagagtccgcgcggcac

SEQ ID NO: 276713 - DNA, 25 bp, Rattus norvegicus
ctgtggaacagtccccttcagggat

SEQ ID NO: 276714 - DNA, 25 bp, Rattus norvegicus
ctgtggaacagtgcccttcagggat

SEQ ID NO: 276715 - DNA, 25 bp, Rattus norvegicus
ctgtggaatcacctcagcatcctat

SEQ ID NO: 276716 - DNA, 25 bp, Rattus norvegicus
ctgtggaatcacgtcagcatcctat

SEQ ID NO: 276717 - DNA, 25 bp, Rattus norvegicus
ctgtggacaaatccccattgtggcg

SEQ ID NO: 276718 - DNA, 25 bp, Rattus norvegicus
ctgtggacaaatgcccattgtggcg

SEQ ID NO: 276719 - DNA, 25 bp, Rattus norvegicus
ctgtggacattgctatgcttttttc

SEQ ID NO: 276720 - DNA, 25 bp, Rattus norvegicus
ctgtggacattggtatgcttttttc

SEQ ID NO: 276721 - DNA, 25 bp, Rattus norvegicus
ctgtggacatttacatatgtgtgat

SEQ ID NO: 276722 - DNA, 25 bp, Rattus norvegicus
ctgtggacattttcatatgtgtgat

SEQ ID NO: 276723 - DNA, 25 bp, Rattus norvegicus
ctgtggaccactcggcgtggacaca

SEQ ID NO: 276724 - DNA, 25 bp, Rattus norvegicus
ctgtggaccactgggcgtggacaca

SEQ ID NO: 276725 - DNA, 25 bp, Rattus norvegicus
ctgtggacgctcagctcatttggga

SEQ ID NO: 276726 - DNA, 25 bp, Rattus norvegicus
ctgtggacgctctgctcatttggga

SEQ ID NO: 276727 - DNA, 25 bp, Rattus norvegicus
ctgtggactgcactgttggagcctt

SEQ ID NO: 276728 - DNA, 25 bp, Rattus norvegicus
ctgtggactgcagtgttggagcctt

SEQ ID NO: 276729 - DNA, 25 bp, Rattus norvegicus
ctgtggagaagacgccatgctgttt

SEQ ID NO: 276730 - DNA, 25 bp, Rattus norvegicus
ctgtggagaagaggccatgctgttt

SEQ ID NO: 276731 - DNA, 25 bp, Rattus norvegicus
ctgtggagccaacaaccgtgtcttt

SEQ ID NO: 276732 - DNA, 25 bp, Rattus norvegicus
ctgtggagccaagaaccgtgtcttt

SEQ ID NO: 276733 - DNA, 25 bp, Rattus norvegicus
ctgtggagggctatcagtcttggat

SEQ ID NO: 276734 - DNA, 25 bp, Rattus norvegicus
ctgtggagggctttcagtcttggat

SEQ ID NO: 276735 - DNA, 25 bp, Rattus norvegicus
ctgtggagtccaacttctgaaattc

SEQ ID NO: 276736 - DNA, 25 bp, Rattus norvegicus
ctgtggagtccatcttctgaaattc

SEQ ID NO: 276737 - DNA, 25 bp, Rattus norvegicus
ctgtggatattcctaggtgtcttta

SEQ ID NO: 276738 - DNA, 25 bp, Rattus norvegicus
ctgtggatattcgtaggtgtcttta

SEQ ID NO: 276739 - DNA, 25 bp, Rattus norvegicus
ctgtggatcacaaagctggtaatat

SEQ ID NO: 276740 - DNA, 25 bp, Rattus norvegicus
ctgtggatcacatagctggtaatat

SEQ ID NO: 276741 - DNA, 25 bp, Rattus norvegicus
ctgtggatgacaagtgggacgccct

SEQ ID NO: 276742 - DNA, 25 bp, Rattus norvegicus
ctgtggatgacatgtgggacgccct

SEQ ID NO: 276743 - DNA, 25 bp, Rattus norvegicus
ctgtggatgtctcgccctgggtcct

SEQ ID NO: 276744 - DNA, 25 bp, Rattus norvegicus
ctgtggatgtctggccctgggtcct

SEQ ID NO: 276745 - DNA, 25 bp, Rattus norvegicus
ctgtggatgtgcctgtcattgtgaa

SEQ ID NO: 276746 - DNA, 25 bp, Rattus norvegicus
ctgtggatgtgcgtgtcattgtgaa

SEQ ID NO: 276747 - DNA, 25 bp, Rattus norvegicus
ctgtggatgttgaagaccctgggat

SEQ ID NO: 276748 - DNA, 25 bp, Rattus norvegicus
ctgtggatgttgatcagcatcacct

SEQ ID NO: 276749 - DNA, 25 bp, Rattus norvegicus
ctgtggatgttgtagaccctgggat

SEQ ID NO: 276750 - DNA, 25 bp, Rattus norvegicus
ctgtggatgttgttcagcatcacct

SEQ ID NO: 276751 - DNA, 25 bp, Rattus norvegicus
ctgtggattcacatctggagaggaa

SEQ ID NO: 276752 - DNA, 25 bp, Rattus norvegicus
ctgtggattcacttctggagaggaa

SEQ ID NO: 276753 - DNA, 25 bp, Rattus norvegicus
ctgtggattgtaagtttgtgaggac

SEQ ID NO: 276754 - DNA, 25 bp, Rattus norvegicus
ctgtggattgtatgtttgtgaggac

SEQ ID NO: 276755 - DNA, 25 bp, Rattus norvegicus
ctgtggattttgactgcgtgatttc

SEQ ID NO: 276756 - DNA, 25 bp, Rattus norvegicus
ctgtggattttgtctgcgtgatttc

SEQ ID NO: 276757 - DNA, 25 bp, Rattus norvegicus
ctgtggcaacacaactactcaaaac

SEQ ID NO: 276758 - DNA, 25 bp, Rattus norvegicus
ctgtggcaacactactactcaaaac

SEQ ID NO: 276759 - DNA, 25 bp, Rattus norvegicus
ctgtggcacatgattaaacctcctc

SEQ ID NO: 276760 - DNA, 25 bp, Rattus norvegicus
ctgtggcacatgtttaaacctcctc

SEQ ID NO: 276761 - DNA, 25 bp, Rattus norvegicus
ctgtggcacattcgtctctgagaaa

SEQ ID NO: 276762 - DNA, 25 bp, Rattus norvegicus
ctgtggcacattggtctctgagaaa

SEQ ID NO: 276763 - DNA, 25 bp, Rattus norvegicus
ctgtggcacggaacttctagtctta

SEQ ID NO: 276764 - DNA, 25 bp, Rattus norvegicus
ctgtggcacggaaggctttcgcaat

SEQ ID NO: 276765 - DNA, 25 bp, Rattus norvegicus
ctgtggcacggatcttctagtctta

SEQ ID NO: 276766 - DNA, 25 bp, Rattus norvegicus
ctgtggcacggatggctttcgcaat

SEQ ID NO: 276767 - DNA, 25 bp, Rattus norvegicus
ctgtggcactggaaccatagggcta

SEQ ID NO: 276768 - DNA, 25 bp, Rattus norvegicus
ctgtggcactggtaccatagggcta

SEQ ID NO: 276769 - DNA, 25 bp, Rattus norvegicus
ctgtggcatctgaggcaaggtcttc

SEQ ID NO: 276770 - DNA, 25 bp, Rattus norvegicus
ctgtggcatctgtggcaaggtcttc

SEQ ID NO: 276771 - DNA, 25 bp, Rattus norvegicus
ctgtggcatttgctcttgctgaaat

SEQ ID NO: 276772 - DNA, 25 bp, Rattus norvegicus
ctgtggcatttggtcttgctgaaat

SEQ ID NO: 276773 - DNA, 25 bp, Rattus norvegicus
ctgtggccacagagccagctaagga

SEQ ID NO: 276774 - DNA, 25 bp, Rattus norvegicus
ctgtggccacagagctgagttctga

SEQ ID NO: 276775 - DNA, 25 bp, Rattus norvegicus
ctgtggccacagtgccagctaagga

SEQ ID NO: 276776 - DNA, 25 bp, Rattus norvegicus
ctgtggccacagtgctgagttctga

SEQ ID NO: 276777 - DNA, 25 bp, Rattus norvegicus
ctgtggccacttatttgggtttgct

SEQ ID NO: 276778 - DNA, 25 bp, Rattus norvegicus
ctgtggccacttttttgggtttgct

SEQ ID NO: 276779 - DNA, 25 bp, Rattus norvegicus
ctgtggccagctcacattttgtaaa

SEQ ID NO: 276780 - DNA, 25 bp, Rattus norvegicus
ctgtggccagctgacattttgtaaa

SEQ ID NO: 276781 - DNA, 25 bp, Rattus norvegicus
ctgtggcctcaccttactgtgtaaa

SEQ ID NO: 276782 - DNA, 25 bp, Rattus norvegicus
ctgtggcctcacgttactgtgtaaa

SEQ ID NO: 276783 - DNA, 25 bp, Rattus norvegicus
ctgtggcctctgaaatgctgttgta

SEQ ID NO: 276784 - DNA, 25 bp, Rattus norvegicus
ctgtggcctctgtaatgctgttgta

SEQ ID NO: 276785 - DNA, 25 bp, Rattus norvegicus
ctgtggcctgaacctgtatatgttc

SEQ ID NO: 276786 - DNA, 25 bp, Rattus norvegicus
ctgtggcctgaagctgtatatgttc

SEQ ID NO: 276787 - DNA, 25 bp, Rattus norvegicus
ctgtggcctgttcccaaaacctgtg

SEQ ID NO: 276788 - DNA, 25 bp, Rattus norvegicus
ctgtggcctgttgccaaaacctgtg

SEQ ID NO: 276789 - DNA, 25 bp, Rattus norvegicus
ctgtggccttgcagtggcttcgtca

SEQ ID NO: 276790 - DNA, 25 bp, Rattus norvegicus
ctgtggccttgctgtggcttcgtca

SEQ ID NO: 276791 - DNA, 25 bp, Rattus norvegicus
ctgtggcgcaaacctggctccatgg

SEQ ID NO: 276792 - DNA, 25 bp, Rattus norvegicus
ctgtggcgcaaagctggctccatgg

SEQ ID NO: 276793 - DNA, 25 bp, Rattus norvegicus
ctgtggcggccgatcagacgctaga

SEQ ID NO: 276794 - DNA, 25 bp, Rattus norvegicus
ctgtggcggccgttcagacgctaga

SEQ ID NO: 276795 - DNA, 25 bp, Rattus norvegicus
ctgtggctaagcaaccgatttattg

SEQ ID NO: 276796 - DNA, 25 bp, Rattus norvegicus
ctgtggctaagcagttctggagtga

SEQ ID NO: 276797 - DNA, 25 bp, Rattus norvegicus
ctgtggctaagctaccgatttattg

SEQ ID NO: 276798 - DNA, 25 bp, Rattus norvegicus
ctgtggctaagctgttctggagtga

SEQ ID NO: 276799 - DNA, 25 bp, Rattus norvegicus
ctgtggctacagctgctgggctact

SEQ ID NO: 276800 - DNA, 25 bp, Rattus norvegicus
ctgtggctacaggtgctgggctact

SEQ ID NO: 276801 - DNA, 25 bp, Rattus norvegicus
ctgtggctacctccttgaggtcaaa

SEQ ID NO: 276802 - DNA, 25 bp, Rattus norvegicus
ctgtggctacctgcttgaggtcaaa

SEQ ID NO: 276803 - DNA, 25 bp, Rattus norvegicus
ctgtggctctttctcttaaacctca

SEQ ID NO: 276804 - DNA, 25 bp, Rattus norvegicus
ctgtggctctttgtcttaaacctca

SEQ ID NO: 276805 - DNA, 25 bp, Rattus norvegicus
ctgtggctgacaagctggagacgca

SEQ ID NO: 276806 - DNA, 25 bp, Rattus norvegicus
ctgtggctgacatgctggagacgca

SEQ ID NO: 276807 - DNA, 25 bp, Rattus norvegicus
ctgtggctgccaactctgagtgtga

SEQ ID NO: 276808 - DNA, 25 bp, Rattus norvegicus
ctgtggctgccatctctgagtgtga

SEQ ID NO: 276809 - DNA, 25 bp, Rattus norvegicus
ctgtggctgctgcttgtaatatggc

SEQ ID NO: 276810 - DNA, 25 bp, Rattus norvegicus
ctgtggctgctggttgtaatatggc

SEQ ID NO: 276811 - DNA, 25 bp, Rattus norvegicus
ctgtggctggctcgacctgatgatc

SEQ ID NO: 276812 - DNA, 25 bp, Rattus norvegicus
ctgtggctggctggacctgatgatc

SEQ ID NO: 276813 - DNA, 25 bp, Rattus norvegicus
ctgtggctgtgtcaggagcatccct

SEQ ID NO: 276814 - DNA, 25 bp, Rattus norvegicus
ctgtggctgtgtgaggagcatccct

SEQ ID NO: 276815 - DNA, 25 bp, Rattus norvegicus
ctgtggcttctcagcagcacctttg

SEQ ID NO: 276816 - DNA, 25 bp, Rattus norvegicus
ctgtggcttctctgcagcacctttg

SEQ ID NO: 276817 - DNA, 25 bp, Rattus norvegicus
ctgtggcttgtgctcatgtgcaaac

SEQ ID NO: 276818 - DNA, 25 bp, Rattus norvegicus
ctgtggcttgtggtcatgtgcaaac

SEQ ID NO: 276819 - DNA, 25 bp, Rattus norvegicus
ctgtggctttataaatctactcctt

SEQ ID NO: 276820 - DNA, 25 bp, Rattus norvegicus
ctgtggctttattaatctactcctt

SEQ ID NO: 276821 - DNA, 25 bp, Rattus norvegicus
ctgtgggaaggcagtgttctctcac

SEQ ID NO: 276822 - DNA, 25 bp, Rattus norvegicus
ctgtgggaaggctgtgttctctcac

SEQ ID NO: 276823 - DNA, 25 bp, Rattus norvegicus
ctgtgggaatgcaccccgagccgac

SEQ ID NO: 276824 - DNA, 25 bp, Rattus norvegicus
ctgtgggaatgctccccgagccgac

SEQ ID NO: 276825 - DNA, 25 bp, Rattus norvegicus
ctgtgggacagcagaaccggcagct

SEQ ID NO: 276826 - DNA, 25 bp, Rattus norvegicus
ctgtgggacagctgaaccggcagct

SEQ ID NO: 276827 - DNA, 25 bp, Rattus norvegicus
ctgtgggacccacgtgagttctgta

SEQ ID NO: 276828 - DNA, 25 bp, Rattus norvegicus
ctgtgggacccaggtgagttctgta

SEQ ID NO: 276829 - DNA, 25 bp, Rattus norvegicus
ctgtgggaccctaagcttggagctt

SEQ ID NO: 276830 - DNA, 25 bp, Rattus norvegicus
ctgtgggacccttagcttggagctt

SEQ ID NO: 276831 - DNA, 25 bp, Rattus norvegicus
ctgtgggacctcaggtgcgatccat

SEQ ID NO: 276832 - DNA, 25 bp, Rattus norvegicus
ctgtgggacctctggtgcgatccat

SEQ ID NO: 276833 - DNA, 25 bp, Rattus norvegicus
ctgtgggacgaccattcagttctac

SEQ ID NO: 276834 - DNA, 25 bp, Rattus norvegicus
ctgtgggacgacgattcagttctac

SEQ ID NO: 276835 - DNA, 25 bp, Rattus norvegicus
ctgtgggcaaacacctgctatgaat

SEQ ID NO: 276836 - DNA, 25 bp, Rattus norvegicus
ctgtgggcaaactcctgctatgaat

SEQ ID NO: 276837 - DNA, 25 bp, Rattus norvegicus
ctgtgggcagttagggccatgcaac

SEQ ID NO: 276838 - DNA, 25 bp, Rattus norvegicus
ctgtgggcagtttgggccatgcaac

SEQ ID NO: 276839 - DNA, 25 bp, Rattus norvegicus
ctgtgggcatgaatcctggcaagga

SEQ ID NO: 276840 - DNA, 25 bp, Rattus norvegicus
ctgtgggcatgattcctggcaagga

SEQ ID NO: 276841 - DNA, 25 bp, Rattus norvegicus
ctgtgggccctcagatgtttacaga

SEQ ID NO: 276842 - DNA, 25 bp, Rattus norvegicus
ctgtgggccctctgatgtttacaga

SEQ ID NO: 276843 - DNA, 25 bp, Rattus norvegicus
ctgtgggcctgtagcaatactttaa

SEQ ID NO: 276844 - DNA, 25 bp, Rattus norvegicus
ctgtgggcctgttgcaatactttaa

SEQ ID NO: 276845 - DNA, 25 bp, Rattus norvegicus
ctgtgggccttactcaactgtgaaa

SEQ ID NO: 276846 - DNA, 25 bp, Rattus norvegicus
ctgtgggccttagtcaactgtgaaa

SEQ ID NO: 276847 - DNA, 25 bp, Rattus norvegicus
ctgtgggctggtattctttctgaaa

SEQ ID NO: 276848 - DNA, 25 bp, Rattus norvegicus
ctgtgggctggtcttatcgtatgta

SEQ ID NO: 276849 - DNA, 25 bp, Rattus norvegicus
ctgtgggctggtgttatcgtatgta

SEQ ID NO: 276850 - DNA, 25 bp, Rattus norvegicus
ctgtgggctggttttctttctgaaa

SEQ ID NO: 276851 - DNA, 25 bp, Rattus norvegicus
ctgtgggcttggagagaccccatac

SEQ ID NO: 276852 - DNA, 25 bp, Rattus norvegicus
ctgtgggcttggtgagaccccatac

SEQ ID NO: 276853 - DNA, 25 bp, Rattus norvegicus
ctgtgggtaaataagctttgctctt

SEQ ID NO: 276854 - DNA, 25 bp, Rattus norvegicus
ctgtgggtaaattagctttgctctt

SEQ ID NO: 276855 - DNA, 25 bp, Rattus norvegicus
ctgtgggtaccgaactcatgagcaa

SEQ ID NO: 276856 - DNA, 25 bp, Rattus norvegicus
ctgtgggtaccgtactcatgagcaa

SEQ ID NO: 276857 - DNA, 25 bp, Rattus norvegicus
ctgtgggtacctcacatgcatgtgg

SEQ ID NO: 276858 - DNA, 25 bp, Rattus norvegicus
ctgtgggtacctgacatgcatgtgg

SEQ ID NO: 276859 - DNA, 25 bp, Rattus norvegicus
ctgtgggtccctacgggcagtccca

SEQ ID NO: 276860 - DNA, 25 bp, Rattus norvegicus
ctgtgggtcccttcgggcagtccca

SEQ ID NO: 276861 - DNA, 25 bp, Rattus norvegicus
ctgtgggtcctacagctccttcggg

SEQ ID NO: 276862 - DNA, 25 bp, Rattus norvegicus
ctgtgggtcctagagctccttcggg

SEQ ID NO: 276863 - DNA, 25 bp, Rattus norvegicus
ctgtgggtcggcatctatgtatgag

SEQ ID NO: 276864 - DNA, 25 bp, Rattus norvegicus
ctgtgggtcggcttctatgtatgag

SEQ ID NO: 276865 - DNA, 25 bp, Rattus norvegicus
ctgtgggtctgcactggtatgtgaa

SEQ ID NO: 276866 - DNA, 25 bp, Rattus norvegicus
ctgtgggtctgctctggtatgtgaa

SEQ ID NO: 276867 - DNA, 25 bp, Rattus norvegicus
ctgtgggtgtctatgccaggctgat

SEQ ID NO: 276868 - DNA, 25 bp, Rattus norvegicus
ctgtgggtgtctttgccaggctgat

SEQ ID NO: 276869 - DNA, 25 bp, Rattus norvegicus
ctgtgggttctaactgctgtcttag

SEQ ID NO: 276870 - DNA, 25 bp, Rattus norvegicus
ctgtgggttctatctgctgtcttag

SEQ ID NO: 276871 - DNA, 25 bp, Rattus norvegicus
ctgtggtatcagaataaaaggactt

SEQ ID NO: 276872 - DNA, 25 bp, Rattus norvegicus
ctgtggtatcagtataaaaggactt

SEQ ID NO: 276873 - DNA, 25 bp, Rattus norvegicus
ctgtggtcgactccccagatttaac

SEQ ID NO: 276874 - DNA, 25 bp, Rattus norvegicus
ctgtggtcgactgcccagatttaac

SEQ ID NO: 276875 - DNA, 25 bp, Rattus norvegicus
ctgtggtcttcaccgtttgtgtgaa

SEQ ID NO: 276876 - DNA, 25 bp, Rattus norvegicus
ctgtggtcttcagcgtttgtgtgaa

SEQ ID NO: 276877 - DNA, 25 bp, Rattus norvegicus
ctgtggtgaagcagttcgggcccct

SEQ ID NO: 276878 - DNA, 25 bp, Rattus norvegicus
ctgtggtgaagctgttcgggcccct

SEQ ID NO: 276879 - DNA, 25 bp, Rattus norvegicus
ctgtggtgacccatgaaggctaatt

SEQ ID NO: 276880 - DNA, 25 bp, Rattus norvegicus
ctgtggtgacccttgaaggctaatt

SEQ ID NO: 276881 - DNA, 25 bp, Rattus norvegicus
ctgtggtgatttatagacttctggt

SEQ ID NO: 276882 - DNA, 25 bp, Rattus norvegicus
ctgtggtgatttttagacttctggt

SEQ ID NO: 276883 - DNA, 25 bp, Rattus norvegicus
ctgtggtgcggaacatggagcaagt

SEQ ID NO: 276884 - DNA, 25 bp, Rattus norvegicus
ctgtggtgcggatcatggagcaagt

SEQ ID NO: 276885 - DNA, 25 bp, Rattus norvegicus
ctgtggtggctgattgcctcagaac

SEQ ID NO: 276886 - DNA, 25 bp, Rattus norvegicus
ctgtggtggctgtttgcctcagaac

SEQ ID NO: 276887 - DNA, 25 bp, Rattus norvegicus
ctgtggtgtggcactggtctctgta

SEQ ID NO: 276888 - DNA, 25 bp, Rattus norvegicus
ctgtggtgtggctctggtctctgta

SEQ ID NO: 276889 - DNA, 25 bp, Rattus norvegicus
ctgtggttagagatgatacctccat

SEQ ID NO: 276890 - DNA, 25 bp, Rattus norvegicus
ctgtggttagagttgatacctccat

SEQ ID NO: 276891 - DNA, 25 bp, Rattus norvegicus
ctgtggttgctcctcttacaacagg

SEQ ID NO: 276892 - DNA, 25 bp, Rattus norvegicus
ctgtggttgctcgtcttacaacagg

SEQ ID NO: 276893 - DNA, 25 bp, Rattus norvegicus
ctgtggttgtgaactgccatccatg

SEQ ID NO: 276894 - DNA, 25 bp, Rattus norvegicus
ctgtggttgtgatctgccatccatg

SEQ ID NO: 276895 - DNA, 25 bp, Rattus norvegicus
ctgtggttgtggcaactgcctgata

SEQ ID NO: 276896 - DNA, 25 bp, Rattus norvegicus
ctgtggttgtgggaactgcctgata

SEQ ID NO: 276897 - DNA, 25 bp, Rattus norvegicus
ctgtggtttctcactccaaaaatgg

SEQ ID NO: 276898 - DNA, 25 bp, Rattus norvegicus
ctgtggtttctctctccaaaaatgg

SEQ ID NO: 276899 - DNA, 25 bp, Rattus norvegicus
ctgtggtttctgatgcacgtgtgca

SEQ ID NO: 276900 - DNA, 25 bp, Rattus norvegicus
ctgtggtttctgttgcacgtgtgca

SEQ ID NO: 276901 - DNA, 25 bp, Rattus norvegicus
ctgtggtttggccagcagctgtatc

SEQ ID NO: 276902 - DNA, 25 bp, Rattus norvegicus
ctgtggtttggcgagcagctgtatc

SEQ ID NO: 276903 - DNA, 25 bp, Rattus norvegicus
ctgtggttttaacgcatgccccatg

SEQ ID NO: 276904 - DNA, 25 bp, Rattus norvegicus
ctgtggttttaaggcatgccccatg

SEQ ID NO: 276905 - DNA, 25 bp, Rattus norvegicus
ctgtgtaatatgctgtaatgcccaa

SEQ ID NO: 276906 - DNA, 25 bp, Rattus norvegicus
ctgtgtaatatggtgtaatgcccaa

SEQ ID NO: 276907 - DNA, 25 bp, Rattus norvegicus
ctgtgtacaacacagcatgctcact

SEQ ID NO: 276908 - DNA, 25 bp, Rattus norvegicus
ctgtgtacaacagagcatgctcact

SEQ ID NO: 276909 - DNA, 25 bp, Rattus norvegicus
ctgtgtacagacaggcaaggcctct

SEQ ID NO: 276910 - DNA, 25 bp, Rattus norvegicus
ctgtgtacagactggcaaggcctct

SEQ ID NO: 276911 - DNA, 25 bp, Rattus norvegicus
ctgtgtacagtacttcgtggttagt

SEQ ID NO: 276912 - DNA, 25 bp, Rattus norvegicus
ctgtgtacagtagttcgtggttagt

SEQ ID NO: 276913 - DNA, 25 bp, Rattus norvegicus
ctgtgtaccacccatgaatctaggt

SEQ ID NO: 276914 - DNA, 25 bp, Rattus norvegicus
ctgtgtaccaccgatgaatctaggt

SEQ ID NO: 276915 - DNA, 25 bp, Rattus norvegicus
ctgtgtaccgctctttattatcatc

SEQ ID NO: 276916 - DNA, 25 bp, Rattus norvegicus
ctgtgtaccgctgtttattatcatc

SEQ ID NO: 276917 - DNA, 25 bp, Rattus norvegicus
ctgtgtacctctaactctctgcaac

SEQ ID NO: 276918 - DNA, 25 bp, Rattus norvegicus
ctgtgtacctcttactctctgcaac

SEQ ID NO: 276919 - DNA, 25 bp, Rattus norvegicus
ctgtgtacgttcacttgtagacctt

SEQ ID NO: 276920 - DNA, 25 bp, Rattus norvegicus
ctgtgtacgttctcttgtagacctt

SEQ ID NO: 276921 - DNA, 25 bp, Rattus norvegicus
ctgtgtactacaagcttgcctggta

SEQ ID NO: 276922 - DNA, 25 bp, Rattus norvegicus
ctgtgtactacatgcttgcctggta

SEQ ID NO: 276923 - DNA, 25 bp, Rattus norvegicus
ctgtgtagatagctgggttgaccct

SEQ ID NO: 276924 - DNA, 25 bp, Rattus norvegicus
ctgtgtagataggtgggttgaccct

SEQ ID NO: 276925 - DNA, 25 bp, Rattus norvegicus
ctgtgtagcatcacattttcaccga

SEQ ID NO: 276926 - DNA, 25 bp, Rattus norvegicus
ctgtgtagcatctcattttcaccga

SEQ ID NO: 276927 - DNA, 25 bp, Rattus norvegicus
ctgtgtagcttcaaggccctggtga

SEQ ID NO: 276928 - DNA, 25 bp, Rattus norvegicus
ctgtgtagcttctaggccctggtga

SEQ ID NO: 276929 - DNA, 25 bp, Rattus norvegicus
ctgtgtagtgacacagtgtgctgac

SEQ ID NO: 276930 - DNA, 25 bp, Rattus norvegicus
ctgtgtagtgactcagtgtgctgac

SEQ ID NO: 276931 - DNA, 25 bp, Rattus norvegicus
ctgtgtagtgtgactgtgaatggat

SEQ ID NO: 276932 - DNA, 25 bp, Rattus norvegicus
ctgtgtagtgtgtctgtgaatggat

SEQ ID NO: 276933 - DNA, 25 bp, Rattus norvegicus
ctgtgtatactaccctctttctcaa

SEQ ID NO: 276934 - DNA, 25 bp, Rattus norvegicus
ctgtgtatactagcctctttctcaa

SEQ ID NO: 276935 - DNA, 25 bp, Rattus norvegicus
ctgtgtatatgacccaacctgtgag

SEQ ID NO: 276936 - DNA, 25 bp, Rattus norvegicus
ctgtgtatatgagccaacctgtgag

SEQ ID NO: 276937 - DNA, 25 bp, Rattus norvegicus
ctgtgtatcagcctttgctcagagg

SEQ ID NO: 276938 - DNA, 25 bp, Rattus norvegicus
ctgtgtatcagcgtttgctcagagg

SEQ ID NO: 276939 - DNA, 25 bp, Rattus norvegicus
ctgtgtatgtggctgttactatgga

SEQ ID NO: 276940 - DNA, 25 bp, Rattus norvegicus
ctgtgtatgtgggtgttactatgga

SEQ ID NO: 276941 - DNA, 25 bp, Rattus norvegicus
ctgtgtattaatcacggtctctttt

SEQ ID NO: 276942 - DNA, 25 bp, Rattus norvegicus
ctgtgtattaatgacggtctctttt

SEQ ID NO: 276943 - DNA, 25 bp, Rattus norvegicus
ctgtgtattatcaaggagtctcctc

SEQ ID NO: 276944 - DNA, 25 bp, Rattus norvegicus
ctgtgtattatcagtccctaccttg

SEQ ID NO: 276945 - DNA, 25 bp, Rattus norvegicus
ctgtgtattatctaggagtctcctc

SEQ ID NO: 276946 - DNA, 25 bp, Rattus norvegicus
ctgtgtattatctgtccctaccttg

SEQ ID NO: 276947 - DNA, 25 bp, Rattus norvegicus
ctgtgtcaacacattggttcaagta

SEQ ID NO: 276948 - DNA, 25 bp, Rattus norvegicus
ctgtgtcaacactttggttcaagta

SEQ ID NO: 276949 - DNA, 25 bp, Rattus norvegicus
ctgtgtcaacagaagctccatggag

SEQ ID NO: 276950 - DNA, 25 bp, Rattus norvegicus
ctgtgtcaacagtagctccatggag

SEQ ID NO: 276951 - DNA, 25 bp, Rattus norvegicus
ctgtgtcaacgccatcaaggtgtat

SEQ ID NO: 276952 - DNA, 25 bp, Rattus norvegicus
ctgtgtcaacgcgatcaaggtgtat

SEQ ID NO: 276953 - DNA, 25 bp, Rattus norvegicus
ctgtgtcacctcataaaccttggta

SEQ ID NO: 276954 - DNA, 25 bp, Rattus norvegicus
ctgtgtcacctcttaaaccttggta

SEQ ID NO: 276955 - DNA, 25 bp, Rattus norvegicus
ctgtgtcacctgaagaaccctaaga

SEQ ID NO: 276956 - DNA, 25 bp, Rattus norvegicus
ctgtgtcacctgtagaaccctaaga

SEQ ID NO: 276957 - DNA, 25 bp, Rattus norvegicus
ctgtgtcactctcgatggttttgca

SEQ ID NO: 276958 - DNA, 25 bp, Rattus norvegicus
ctgtgtcactctggatggttttgca

SEQ ID NO: 276959 - DNA, 25 bp, Rattus norvegicus
ctgtgtcagcaaacccagctagagg

SEQ ID NO: 276960 - DNA, 25 bp, Rattus norvegicus
ctgtgtcagcaatcccagctagagg

SEQ ID NO: 276961 - DNA, 25 bp, Rattus norvegicus
ctgtgtcaggctaaccttcaggaag

SEQ ID NO: 276962 - DNA, 25 bp, Rattus norvegicus
ctgtgtcaggcttaccttcaggaag

SEQ ID NO: 276963 - DNA, 25 bp, Rattus norvegicus
ctgtgtcagtgtatccttagggcaa

SEQ ID NO: 276964 - DNA, 25 bp, Rattus norvegicus
ctgtgtcagtgtttccttagggcaa

SEQ ID NO: 276965 - DNA, 25 bp, Rattus norvegicus
ctgtgtcataccatcctgaggagga

SEQ ID NO: 276966 - DNA, 25 bp, Rattus norvegicus
ctgtgtcataccttcctgaggagga

SEQ ID NO: 276967 - DNA, 25 bp, Rattus norvegicus
ctgtgtcatattctttagctccgaa

SEQ ID NO: 276968 - DNA, 25 bp, Rattus norvegicus
ctgtgtcatattgtttagctccgaa

SEQ ID NO: 276969 - DNA, 25 bp, Rattus norvegicus
ctgtgtcatgaactctgcctggtat

SEQ ID NO: 276970 - DNA, 25 bp, Rattus norvegicus
ctgtgtcatgaagtctgcctggtat

SEQ ID NO: 276971 - DNA, 25 bp, Rattus norvegicus
ctgtgtccagtcaacatttttactt

SEQ ID NO: 276972 - DNA, 25 bp, Rattus norvegicus
ctgtgtccagtctacatttttactt

SEQ ID NO: 276973 - DNA, 20 bp, Rattus norvegicus
ctgtgtccatccagatggtc

SEQ ID NO: 276974 - DNA, 25 bp, Rattus norvegicus
ctgtgtccatctattactgagagac

SEQ ID NO: 276975 - DNA, 25 bp, Rattus norvegicus
ctgtgtccatcttttactgagagac

SEQ ID NO: 276976 - DNA, 25 bp, Rattus norvegicus
ctgtgtccatttcatgtgttcccat

SEQ ID NO: 276977 - DNA, 25 bp, Rattus norvegicus
ctgtgtccatttgatgtgttcccat

SEQ ID NO: 276978 - DNA, 25 bp, Rattus norvegicus
ctgtgtcccctgctttggtgcaatg

SEQ ID NO: 276979 - DNA, 25 bp, Rattus norvegicus
ctgtgtcccctggtttggtgcaatg

SEQ ID NO: 276980 - DNA, 20 bp, Rattus norvegicus
ctgtgtccctccagatggtc

SEQ ID NO: 276981 - DNA, 25 bp, Rattus norvegicus
ctgtgtccctgcatatcagtgttga

SEQ ID NO: 276982 - DNA, 25 bp, Rattus norvegicus
ctgtgtccctgcttatcagtgttga

SEQ ID NO: 276983 - DNA, 25 bp, Rattus norvegicus
ctgtgtcccttcaacgtagcatagt

SEQ ID NO: 276984 - DNA, 25 bp, Rattus norvegicus
ctgtgtcccttctacgtagcatagt

SEQ ID NO: 276985 - DNA, 25 bp, Rattus norvegicus
ctgtgtccgagaagaagccctgctg

SEQ ID NO: 276986 - DNA, 25 bp, Rattus norvegicus
ctgtgtccgagatgaagccctgctg

SEQ ID NO: 276987 - DNA, 25 bp, Rattus norvegicus
ctgtgtccgggaagaagcagaccat

SEQ ID NO: 276988 - DNA, 25 bp, Rattus norvegicus
ctgtgtccgggatgaagcagaccat

SEQ ID NO: 276989 - DNA, 20 bp, Rattus norvegicus
ctgtgtccgtccagatggtc

SEQ ID NO: 276990 - DNA, 20 bp, Rattus norvegicus
ctgtgtccttccagatggtc

SEQ ID NO: 276991 - DNA, 25 bp, Rattus norvegicus
ctgtgtccttttcatgctgctctca

SEQ ID NO: 276992 - DNA, 25 bp, Rattus norvegicus
ctgtgtccttttgatgctgctctca

SEQ ID NO: 276993 - DNA, 25 bp, Rattus norvegicus
ctgtgtcgccctcagcaaaagccga

SEQ ID NO: 276994 - DNA, 25 bp, Rattus norvegicus
ctgtgtcgccctgagcaaaagccga

SEQ ID NO: 276995 - DNA, 25 bp, Rattus norvegicus
ctgtgtcggttgcttctgatgatga

SEQ ID NO: 276996 - DNA, 25 bp, Rattus norvegicus
ctgtgtcggttggttctgatgatga

SEQ ID NO: 276997 - DNA, 25 bp, Rattus norvegicus
ctgtgtcgtgcacgtggctctacaa

SEQ ID NO: 276998 - DNA, 25 bp, Rattus norvegicus
ctgtgtcgtgcaggtggctctacaa

SEQ ID NO: 276999 - DNA, 25 bp, Rattus norvegicus
ctgtgtctacagaggaaggctgtga

SEQ ID NO: 277000 - DNA, 25 bp, Rattus norvegicus
ctgtgtctacagtggaaggctgtga

SEQ ID NO: 277001 - DNA, 25 bp, Rattus norvegicus
ctgtgtctactaccagaggctgagg

SEQ ID NO: 277002 - DNA, 25 bp, Rattus norvegicus
ctgtgtctactagcagaggctgagg

SEQ ID NO: 277003 - DNA, 25 bp, Rattus norvegicus
ctgtgtctagcaaaggcgggtgttc

SEQ ID NO: 277004 - DNA, 25 bp, Rattus norvegicus
ctgtgtctagcataggcgggtgttc

SEQ ID NO: 277005 - DNA, 25 bp, Rattus norvegicus
ctgtgtctcaggcattccatagtta

SEQ ID NO: 277006 - DNA, 25 bp, Rattus norvegicus
ctgtgtctcagggattccatagtta

SEQ ID NO: 277007 - DNA, 25 bp, Rattus norvegicus
ctgtgtctcataataacctgtgcat

SEQ ID NO: 277008 - DNA, 25 bp, Rattus norvegicus
ctgtgtctcatattaacctgtgcat

SEQ ID NO: 277009 - DNA, 25 bp, Rattus norvegicus
ctgtgtctctttcgctccagcttga

SEQ ID NO: 277010 - DNA, 25 bp, Rattus norvegicus
ctgtgtctctttggctccagcttga

SEQ ID NO: 277011 - DNA, 25 bp, Rattus norvegicus
ctgtgtctgaccaccctgctggtgg

SEQ ID NO: 277012 - DNA, 25 bp, Rattus norvegicus
ctgtgtctgacctccctgctggtgg

SEQ ID NO: 277013 - DNA, 25 bp, Rattus norvegicus
ctgtgtctgatcctcaggaccaaca

SEQ ID NO: 277014 - DNA, 25 bp, Rattus norvegicus
ctgtgtctgatcgtcaggaccaaca

SEQ ID NO: 277015 - DNA, 25 bp, Rattus norvegicus
ctgtgtctgctactgtgctttaaga

SEQ ID NO: 277016 - DNA, 25 bp, Rattus norvegicus
ctgtgtctgctagtgtgctttaaga

SEQ ID NO: 277017 - DNA, 25 bp, Rattus norvegicus
ctgtgtctgtcacctgggtctgaaa

SEQ ID NO: 277018 - DNA, 25 bp, Rattus norvegicus
ctgtgtctgtcagctgggtctgaaa

SEQ ID NO: 277019 - DNA, 25 bp, Rattus norvegicus
ctgtgtctgtggcagtccaaggttc

SEQ ID NO: 277020 - DNA, 25 bp, Rattus norvegicus
ctgtgtctgtgggagtccaaggttc

SEQ ID NO: 277021 - DNA, 25 bp, Rattus norvegicus
ctgtgtctgtgtcattttcgatcaa

SEQ ID NO: 277022 - DNA, 25 bp, Rattus norvegicus
ctgtgtctgtgtccagccaggaaga

SEQ ID NO: 277023 - DNA, 25 bp, Rattus norvegicus
ctgtgtctgtgtgattttcgatcaa

SEQ ID NO: 277024 - DNA, 25 bp, Rattus norvegicus
ctgtgtctgtgtgcagccaggaaga

SEQ ID NO: 277025 - DNA, 25 bp, Rattus norvegicus
ctgtgtcttcagctgctagtttgag

SEQ ID NO: 277026 - DNA, 25 bp, Rattus norvegicus
ctgtgtcttcaggtgctagtttgag

SEQ ID NO: 277027 - DNA, 25 bp, Rattus norvegicus
ctgtgtcttcttagctcattatagt

SEQ ID NO: 277028 - DNA, 25 bp, Rattus norvegicus
ctgtgtcttctttgctcattatagt

SEQ ID NO: 277029 - DNA, 25 bp, Rattus norvegicus
ctgtgtcttgacctgtgttatttac

SEQ ID NO: 277030 - DNA, 25 bp, Rattus norvegicus
ctgtgtcttgacgtgtgttatttac

SEQ ID NO: 277031 - DNA, 25 bp, Rattus norvegicus
ctgtgtcttggtcagcagtctctga

SEQ ID NO: 277032 - DNA, 25 bp, Rattus norvegicus
ctgtgtcttggtgagcagtctctga

SEQ ID NO: 277033 - DNA, 25 bp, Rattus norvegicus
ctgtgtcttttaatgaccttaatga

SEQ ID NO: 277034 - DNA, 25 bp, Rattus norvegicus
ctgtgtcttttattgaccttaatga

SEQ ID NO: 277035 - DNA, 25 bp, Rattus norvegicus
ctgtgtgaaagtcttgcagctttgg

SEQ ID NO: 277036 - DNA, 25 bp, Rattus norvegicus
ctgtgtgaaagtgttgcagctttgg

SEQ ID NO: 277037 - DNA, 25 bp, Rattus norvegicus
ctgtgtgacaacataatggttcttc

SEQ ID NO: 277038 - DNA, 25 bp, Rattus norvegicus
ctgtgtgacaacttaatggttcttc

SEQ ID NO: 277039 - DNA, 25 bp, Rattus norvegicus
ctgtgtgacctactacttctcttgt

SEQ ID NO: 277040 - DNA, 25 bp, Rattus norvegicus
ctgtgtgacctagtacttctcttgt

SEQ ID NO: 277041 - DNA, 25 bp, Rattus norvegicus
ctgtgtgagaccactctgggataca

SEQ ID NO: 277042 - DNA, 25 bp, Rattus norvegicus
ctgtgtgagacctctctgggataca

SEQ ID NO: 277043 - DNA, 25 bp, Rattus norvegicus
ctgtgtgagataataaccagccacc

SEQ ID NO: 277044 - DNA, 25 bp, Rattus norvegicus
ctgtgtgagatattaaccagccacc

SEQ ID NO: 277045 - DNA, 25 bp, Rattus norvegicus
ctgtgtgagcaacagtccgagtgcc

SEQ ID NO: 277046 - DNA, 25 bp, Rattus norvegicus
ctgtgtgagcaagagtccgagtgcc

SEQ ID NO: 277047 - DNA, 25 bp, Rattus norvegicus
ctgtgtgagtcactatcgtggagca

SEQ ID NO: 277048 - DNA, 25 bp, Rattus norvegicus
ctgtgtgagtcagtatcgtggagca

SEQ ID NO: 277049 - DNA, 25 bp, Rattus norvegicus
ctgtgtgagtttactagtggtgtac

SEQ ID NO: 277050 - DNA, 25 bp, Rattus norvegicus
ctgtgtgagttttctagtggtgtac

SEQ ID NO: 277051 - DNA, 25 bp, Rattus norvegicus
ctgtgtgatatgatgttgctaaaat

SEQ ID NO: 277052 - DNA, 25 bp, Rattus norvegicus
ctgtgtgatatgttgttgctaaaat

SEQ ID NO: 277053 - DNA, 25 bp, Rattus norvegicus
ctgtgtgattagagtacctctctga

SEQ ID NO: 277054 - DNA, 25 bp, Rattus norvegicus
ctgtgtgattagtgtacctctctga

SEQ ID NO: 277055 - DNA, 25 bp, Rattus norvegicus
ctgtgtgatttaccggtcctgactc

SEQ ID NO: 277056 - DNA, 25 bp, Rattus norvegicus
ctgtgtgatttagcggtcctgactc

SEQ ID NO: 277057 - DNA, 25 bp, Rattus norvegicus
ctgtgtgattttacccatgtgcaat

SEQ ID NO: 277058 - DNA, 25 bp, Rattus norvegicus
ctgtgtgatttttcccatgtgcaat

SEQ ID NO: 277059 - DNA, 25 bp, Rattus norvegicus
ctgtgtgcacaccaagggcttttca

SEQ ID NO: 277060 - DNA, 25 bp, Rattus norvegicus
ctgtgtgcacacgaagggcttttca

SEQ ID NO: 277061 - DNA, 25 bp, Rattus norvegicus
ctgtgtgcagacactgtgtttccat

SEQ ID NO: 277062 - DNA, 25 bp, Rattus norvegicus
ctgtgtgcagactctgtgtttccat

SEQ ID NO: 277063 - DNA, 25 bp, Rattus norvegicus
ctgtgtgcagcaatcttttgtggat

SEQ ID NO: 277064 - DNA, 25 bp, Rattus norvegicus
ctgtgtgcagcaattgcctttggtc

SEQ ID NO: 277065 - DNA, 25 bp, Rattus norvegicus
ctgtgtgcagcattcttttgtggat

SEQ ID NO: 277066 - DNA, 25 bp, Rattus norvegicus
ctgtgtgcagcatttgcctttggtc

SEQ ID NO: 277067 - DNA, 25 bp, Rattus norvegicus
ctgtgtgccagcacttagctaaggg

SEQ ID NO: 277068 - DNA, 25 bp, Rattus norvegicus
ctgtgtgccagctcttagctaaggg

SEQ ID NO: 277069 - DNA, 25 bp, Rattus norvegicus
ctgtgtgccccacggtcaatgcaga

SEQ ID NO: 277070 - DNA, 25 bp, Rattus norvegicus
ctgtgtgccccagggtcaatgcaga

SEQ ID NO: 277071 - DNA, 25 bp, Rattus norvegicus
ctgtgtgcccctaatgcggtgtgcg

SEQ ID NO: 277072 - DNA, 25 bp, Rattus norvegicus
ctgtgtgccccttatgcggtgtgcg

SEQ ID NO: 277073 - DNA, 25 bp, Rattus norvegicus
ctgtgtgccgccagagtatagcagg

SEQ ID NO: 277074 - DNA, 25 bp, Rattus norvegicus
ctgtgtgccgcctgagtatagcagg

SEQ ID NO: 277075 - DNA, 25 bp, Rattus norvegicus
ctgtgtgccgttagtctttttgtta

SEQ ID NO: 277076 - DNA, 25 bp, Rattus norvegicus
ctgtgtgccgtttgtctttttgtta

SEQ ID NO: 277077 - DNA, 25 bp, Rattus norvegicus
ctgtgtgcctagcttgtgcattgca

SEQ ID NO: 277078 - DNA, 25 bp, Rattus norvegicus
ctgtgtgcctaggttgtgcattgca

SEQ ID NO: 277079 - DNA, 25 bp, Rattus norvegicus
ctgtgtgcctccacaagcagaggaa

SEQ ID NO: 277080 - DNA, 25 bp, Rattus norvegicus
ctgtgtgcctcctcaagcagaggaa

SEQ ID NO: 277081 - DNA, 25 bp, Rattus norvegicus
ctgtgtgcgtctcttcattgtcatc

SEQ ID NO: 277082 - DNA, 25 bp, Rattus norvegicus
ctgtgtgcgtctgttcattgtcatc

SEQ ID NO: 277083 - DNA, 25 bp, Rattus norvegicus
ctgtgtgctacacatgttcagtgcc

SEQ ID NO: 277084 - DNA, 25 bp, Rattus norvegicus
ctgtgtgctacagatgttcagtgcc

SEQ ID NO: 277085 - DNA, 25 bp, Rattus norvegicus
ctgtgtgctgagacctggctggcca

SEQ ID NO: 277086 - DNA, 25 bp, Rattus norvegicus
ctgtgtgctgagagtgtcaacaaag

SEQ ID NO: 277087 - DNA, 25 bp, Rattus norvegicus
ctgtgtgctgagctttgtagcctaa

SEQ ID NO: 277088 - DNA, 25 bp, Rattus norvegicus
ctgtgtgctgaggtttgtagcctaa

SEQ ID NO: 277089 - DNA, 25 bp, Rattus norvegicus
ctgtgtgctgagtcctggctggcca

SEQ ID NO: 277090 - DNA, 25 bp, Rattus norvegicus
ctgtgtgctgagtgtgtcaacaaag

SEQ ID NO: 277091 - DNA, 25 bp, Rattus norvegicus
ctgtgtgctgcaatccttctgagga

SEQ ID NO: 277092 - DNA, 25 bp, Rattus norvegicus
ctgtgtgctgcaatgtcattgatct

SEQ ID NO: 277093 - DNA, 25 bp, Rattus norvegicus
ctgtgtgctgcattccttctgagga

SEQ ID NO: 277094 - DNA, 25 bp, Rattus norvegicus
ctgtgtgctgcattgtcattgatct

SEQ ID NO: 277095 - DNA, 25 bp, Rattus norvegicus
ctgtgtgctgttaagagaccctcat

SEQ ID NO: 277096 - DNA, 25 bp, Rattus norvegicus
ctgtgtgctgttctaatcattttat

SEQ ID NO: 277097 - DNA, 25 bp, Rattus norvegicus
ctgtgtgctgttgtaatcattttat

SEQ ID NO: 277098 - DNA, 25 bp, Rattus norvegicus
ctgtgtgctgtttagagaccctcat

SEQ ID NO: 277099 - DNA, 25 bp, Rattus norvegicus
ctgtgtgcttttcgccaactttgat

SEQ ID NO: 277100 - DNA, 25 bp, Rattus norvegicus
ctgtgtgcttttggccaactttgat

SEQ ID NO: 277101 - DNA, 25 bp, Rattus norvegicus
ctgtgtggacctaattgattgctta

SEQ ID NO: 277102 - DNA, 25 bp, Rattus norvegicus
ctgtgtggaccttattgattgctta

SEQ ID NO: 277103 - DNA, 25 bp, Rattus norvegicus
ctgtgtggacttatgggacacccat

SEQ ID NO: 277104 - DNA, 25 bp, Rattus norvegicus
ctgtgtggacttttgggacacccat

SEQ ID NO: 277105 - DNA, 25 bp, Rattus norvegicus
ctgtgtggattgattgccgctttat

SEQ ID NO: 277106 - DNA, 25 bp, Rattus norvegicus
ctgtgtggattgtttgccgctttat

SEQ ID NO: 277107 - DNA, 25 bp, Rattus norvegicus
ctgtgtggcaccaggttgtttcaaa

SEQ ID NO: 277108 - DNA, 25 bp, Rattus norvegicus
ctgtgtggcacctggttgtttcaaa

SEQ ID NO: 277109 - DNA, 25 bp, Rattus norvegicus
ctgtgtggcatgatgagagctatct

SEQ ID NO: 277110 - DNA, 25 bp, Rattus norvegicus
ctgtgtggcatgttgagagctatct

SEQ ID NO: 277111 - DNA, 25 bp, Rattus norvegicus
ctgtgtggccacatgtctctggtgt

SEQ ID NO: 277112 - DNA, 25 bp, Rattus norvegicus
ctgtgtggccacttgtctctggtgt

SEQ ID NO: 277113 - DNA, 25 bp, Rattus norvegicus
ctgtgtggccatataaagctctgtg

SEQ ID NO: 277114 - DNA, 25 bp, Rattus norvegicus
ctgtgtggccatttaaagctctgtg

SEQ ID NO: 277115 - DNA, 25 bp, Rattus norvegicus
ctgtgtggcccaagcaggtcttgaa

SEQ ID NO: 277116 - DNA, 25 bp, Rattus norvegicus
ctgtgtggcccatgcaggtcttgaa

SEQ ID NO: 277117 - DNA, 25 bp, Rattus norvegicus
ctgtgtggcctactagtagctgagt

SEQ ID NO: 277118 - DNA, 25 bp, Rattus norvegicus
ctgtgtggcctagtagtagctgagt

SEQ ID NO: 277119 - DNA, 25 bp, Rattus norvegicus
ctgtgtggccttagtcttagattgt

SEQ ID NO: 277120 - DNA, 25 bp, Rattus norvegicus
ctgtgtggcctttgtcttagattgt

SEQ ID NO: 277121 - DNA, 25 bp, Rattus norvegicus
ctgtgtgggaaacgtagccgtccat

SEQ ID NO: 277122 - DNA, 25 bp, Rattus norvegicus
ctgtgtgggaaaggtagccgtccat

SEQ ID NO: 277123 - DNA, 25 bp, Rattus norvegicus
ctgtgtgggcttacagttcagtaga

SEQ ID NO: 277124 - DNA, 25 bp, Rattus norvegicus
ctgtgtgggctttcagttcagtaga

SEQ ID NO: 277125 - DNA, 25 bp, Rattus norvegicus
ctgtgtggtttactaggcttagcct

SEQ ID NO: 277126 - DNA, 25 bp, Rattus norvegicus
ctgtgtggtttagtaggcttagcct

SEQ ID NO: 277127 - DNA, 25 bp, Rattus norvegicus
ctgtgtggttttcggttccagtaat

SEQ ID NO: 277128 - DNA, 25 bp, Rattus norvegicus
ctgtgtggttttgggttccagtaat

SEQ ID NO: 277129 - DNA, 25 bp, Rattus norvegicus
ctgtgtgtcatgacccctttgtggg

SEQ ID NO: 277130 - DNA, 25 bp, Rattus norvegicus
ctgtgtgtcatgtcccctttgtggg

SEQ ID NO: 277131 - DNA, 25 bp, Rattus norvegicus
ctgtgtgtccagaatagttaaggaa

SEQ ID NO: 277132 - DNA, 25 bp, Rattus norvegicus
ctgtgtgtccagtatagttaaggaa

SEQ ID NO: 277133 - DNA, 25 bp, Rattus norvegicus
ctgtgtgtctctcaataggctccga

SEQ ID NO: 277134 - DNA, 25 bp, Rattus norvegicus
ctgtgtgtctctgaataggctccga

SEQ ID NO: 277135 - DNA, 25 bp, Rattus norvegicus
ctgtgtgtctgaaggtcattgtctt

SEQ ID NO: 277136 - DNA, 25 bp, Rattus norvegicus
ctgtgtgtctgatggtcattgtctt

SEQ ID NO: 277137 - DNA, 25 bp, Rattus norvegicus
ctgtgtgtctttctacttggacttc

SEQ ID NO: 277138 - DNA, 25 bp, Rattus norvegicus
ctgtgtgtctttgtacttggacttc

SEQ ID NO: 277139 - DNA, 25 bp, Rattus norvegicus
ctgtgtgtgactatgtccattaggg

SEQ ID NO: 277140 - DNA, 25 bp, Rattus norvegicus
ctgtgtgtgactttgtccattaggg

SEQ ID NO: 277141 - DNA, 25 bp, Rattus norvegicus
ctgtgtgtgctaacctctcttgtat

SEQ ID NO: 277142 - DNA, 25 bp, Rattus norvegicus
ctgtgtgtgctatcctctcttgtat

SEQ ID NO: 277143 - DNA, 25 bp, Rattus norvegicus
ctgtgtgtgtgacacgcccatggtc

SEQ ID NO: 277144 - DNA, 25 bp, Rattus norvegicus
ctgtgtgtgtgagacgcccatggtc

SEQ ID NO: 277145 - DNA, 25 bp, Rattus norvegicus
ctgtgtgtgtgtcacccaactgcgg

SEQ ID NO: 277146 - DNA, 25 bp, Rattus norvegicus
ctgtgtgtgtgtgacccaactgcgg

SEQ ID NO: 277147 - DNA, 25 bp, Rattus norvegicus
ctgtgtgttcctccccttgtgcctt

SEQ ID NO: 277148 - DNA, 25 bp, Rattus norvegicus
ctgtgtgttcctgcccttgtgcctt

SEQ ID NO: 277149 - DNA, 25 bp, Rattus norvegicus
ctgtgtgttctgcacatggttctca

SEQ ID NO: 277150 - DNA, 25 bp, Rattus norvegicus
ctgtgtgttctggacatggttctca

SEQ ID NO: 277151 - DNA, 25 bp, Rattus norvegicus
ctgtgtgtttccacctaatttgaga

SEQ ID NO: 277152 - DNA, 25 bp, Rattus norvegicus
ctgtgtgtttccatttgctgcagga

SEQ ID NO: 277153 - DNA, 25 bp, Rattus norvegicus
ctgtgtgtttcctcctaatttgaga

SEQ ID NO: 277154 - DNA, 25 bp, Rattus norvegicus
ctgtgtgtttccttttgctgcagga

SEQ ID NO: 277155 - DNA, 25 bp, Rattus norvegicus
ctgtgttaaacaatggcctgggtgc

SEQ ID NO: 277156 - DNA, 25 bp, Rattus norvegicus
ctgtgttaaacattggcctgggtgc

SEQ ID NO: 277157 - DNA, 25 bp, Rattus norvegicus
ctgtgttaacacaggtactttatta

SEQ ID NO: 277158 - DNA, 25 bp, Rattus norvegicus
ctgtgttaacactggtactttatta

SEQ ID NO: 277159 - DNA, 25 bp, Rattus norvegicus
ctgtgttaatttctagtctctggta

SEQ ID NO: 277160 - DNA, 25 bp, Rattus norvegicus
ctgtgttaatttgtagtctctggta

SEQ ID NO: 277161 - DNA, 25 bp, Rattus norvegicus
ctgtgttattagcagccttgggaac

SEQ ID NO: 277162 - DNA, 25 bp, Rattus norvegicus
ctgtgttattaggagccttgggaac

SEQ ID NO: 277163 - DNA, 25 bp, Rattus norvegicus
ctgtgttcacagctgcttctagtaa

SEQ ID NO: 277164 - DNA, 25 bp, Rattus norvegicus
ctgtgttcacaggtgcttctagtaa

SEQ ID NO: 277165 - DNA, 25 bp, Rattus norvegicus
ctgtgttcacgaaggtgtgctgtct

SEQ ID NO: 277166 - DNA, 25 bp, Rattus norvegicus
ctgtgttcacgatggtgtgctgtct

SEQ ID NO: 277167 - DNA, 25 bp, Rattus norvegicus
ctgtgttcccttagtgggcaagagc

SEQ ID NO: 277168 - DNA, 25 bp, Rattus norvegicus
ctgtgttccctttgtgggcaagagc

SEQ ID NO: 277169 - DNA, 25 bp, Rattus norvegicus
ctgtgttctactattactggcaatg

SEQ ID NO: 277170 - DNA, 25 bp, Rattus norvegicus
ctgtgttctacttttactggcaatg

SEQ ID NO: 277171 - DNA, 25 bp, Rattus norvegicus
ctgtgttctattacagtgccaataa

SEQ ID NO: 277172 - DNA, 25 bp, Rattus norvegicus
ctgtgttctatttcagtgccaataa

SEQ ID NO: 277173 - DNA, 25 bp, Rattus norvegicus
ctgtgttctcacagatggagtcaga

SEQ ID NO: 277174 - DNA, 25 bp, Rattus norvegicus
ctgtgttctcactgatggagtcaga

SEQ ID NO: 277175 - DNA, 25 bp, Rattus norvegicus
ctgtgttctcagatttgtcctagac

SEQ ID NO: 277176 - DNA, 25 bp, Rattus norvegicus
ctgtgttctcagttttgtcctagac

SEQ ID NO: 277177 - DNA, 25 bp, Rattus norvegicus
ctgtgttctctactgattcattgga

SEQ ID NO: 277178 - DNA, 25 bp, Rattus norvegicus
ctgtgttctctagtgattcattgga

SEQ ID NO: 277179 - DNA, 25 bp, Rattus norvegicus
ctgtgttctctgatcaccattgaat

SEQ ID NO: 277180 - DNA, 25 bp, Rattus norvegicus
ctgtgttctctgttcaccattgaat

SEQ ID NO: 277181 - DNA, 25 bp, Rattus norvegicus
ctgtgttctgttcccttcggaataa

SEQ ID NO: 277182 - DNA, 25 bp, Rattus norvegicus
ctgtgttctgttgccttcggaataa

SEQ ID NO: 277183 - DNA, 25 bp, Rattus norvegicus
ctgtgttctttgatggtattgggcc

SEQ ID NO: 277184 - DNA, 25 bp, Rattus norvegicus
ctgtgttctttgttggtattgggcc

SEQ ID NO: 277185 - DNA, 25 bp, Rattus norvegicus
ctgtgttcttttactgttctgtctg

SEQ ID NO: 277186 - DNA, 25 bp, Rattus norvegicus
ctgtgttctttttctgttctgtctg

SEQ ID NO: 277187 - DNA, 25 bp, Rattus norvegicus
ctgtgttgaccaatggcttcggatt

SEQ ID NO: 277188 - DNA, 25 bp, Rattus norvegicus
ctgtgttgaccattggcttcggatt

SEQ ID NO: 277189 - DNA, 25 bp, Rattus norvegicus
ctgtgttgccatctgttatgtgcct

SEQ ID NO: 277190 - DNA, 25 bp, Rattus norvegicus
ctgtgttgccatgtgttatgtgcct

SEQ ID NO: 277191 - DNA, 25 bp, Rattus norvegicus
ctgtgttggctcatgtggttgttta

SEQ ID NO: 277192 - DNA, 25 bp, Rattus norvegicus
ctgtgttggctcttgtggttgttta

SEQ ID NO: 277193 - DNA, 25 bp, Rattus norvegicus
ctgtgttgtaggatagccatggcta

SEQ ID NO: 277194 - DNA, 25 bp, Rattus norvegicus
ctgtgttgtaggttagccatggcta

SEQ ID NO: 277195 - DNA, 25 bp, Rattus norvegicus
ctgtgtttaagtatcgtgttgcaag

SEQ ID NO: 277196 - DNA, 25 bp, Rattus norvegicus
ctgtgtttaagtttcgtgttgcaag

SEQ ID NO: 277197 - DNA, 25 bp, Rattus norvegicus
ctgtgtttcaagatgttacggtctt

SEQ ID NO: 277198 - DNA, 25 bp, Rattus norvegicus
ctgtgtttcaagttgttacggtctt

SEQ ID NO: 277199 - DNA, 25 bp, Rattus norvegicus
ctgtgtttcactctgggcagctata

SEQ ID NO: 277200 - DNA, 25 bp, Rattus norvegicus
ctgtgtttcactgtgggcagctata

SEQ ID NO: 277201 - DNA, 25 bp, Rattus norvegicus
ctgtgtttcagtatcatctctttta

SEQ ID NO: 277202 - DNA, 25 bp, Rattus norvegicus
ctgtgtttcagtttcatctctttta

SEQ ID NO: 277203 - DNA, 25 bp, Rattus norvegicus
ctgtgtttcatcattcactggacaa

SEQ ID NO: 277204 - DNA, 25 bp, Rattus norvegicus
ctgtgtttcatctttcactggacaa

SEQ ID NO: 277205 - DNA, 25 bp, Rattus norvegicus
ctgtgtttcatgaggcctgtctgga

SEQ ID NO: 277206 - DNA, 25 bp, Rattus norvegicus
ctgtgtttcatgtggcctgtctgga

SEQ ID NO: 277207 - DNA, 25 bp, Rattus norvegicus
ctgtgtttcattcgaatcaaccctt

SEQ ID NO: 277208 - DNA, 25 bp, Rattus norvegicus
ctgtgtttcattggaatcaaccctt

SEQ ID NO: 277209 - DNA, 25 bp, Rattus norvegicus
ctgtgtttccatacgtgagtctgtg

SEQ ID NO: 277210 - DNA, 25 bp, Rattus norvegicus
ctgtgtttccatctttttagctgta

SEQ ID NO: 277211 - DNA, 25 bp, Rattus norvegicus
ctgtgtttccatgtttttagctgta

SEQ ID NO: 277212 - DNA, 25 bp, Rattus norvegicus
ctgtgtttccattcgtgagtctgtg

SEQ ID NO: 277213 - DNA, 25 bp, Rattus norvegicus
ctgtgtttccttaccaggtgacaag

SEQ ID NO: 277214 - DNA, 25 bp, Rattus norvegicus
ctgtgtttcctttccaggtgacaag

SEQ ID NO: 277215 - DNA, 25 bp, Rattus norvegicus
ctgtgtttctgaccttcctgatttc

SEQ ID NO: 277216 - DNA, 25 bp, Rattus norvegicus
ctgtgtttctgagcttcctgatttc

SEQ ID NO: 277217 - DNA, 25 bp, Rattus norvegicus
ctgtgtttctgtaatcttcccagaa

SEQ ID NO: 277218 - DNA, 25 bp, Rattus norvegicus
ctgtgtttctgtagtgggagttcag

SEQ ID NO: 277219 - DNA, 25 bp, Rattus norvegicus
ctgtgtttctgttatcttcccagaa

SEQ ID NO: 277220 - DNA, 25 bp, Rattus norvegicus
ctgtgtttctgttgtgggagttcag

SEQ ID NO: 277221 - DNA, 25 bp, Rattus norvegicus
ctgtgtttctttcactcctgggaat

SEQ ID NO: 277222 - DNA, 25 bp, Rattus norvegicus
ctgtgtttctttgactcctgggaat

SEQ ID NO: 277223 - DNA, 25 bp, Rattus norvegicus
ctgtgtttgaatctgtggcctgatg

SEQ ID NO: 277224 - DNA, 25 bp, Rattus norvegicus
ctgtgtttgaatgtgtggcctgatg

SEQ ID NO: 277225 - DNA, 25 bp, Rattus norvegicus
ctgtgtttgccgctgttagagttca

SEQ ID NO: 277226 - DNA, 25 bp, Rattus norvegicus
ctgtgtttgccggtgttagagttca

SEQ ID NO: 277227 - DNA, 25 bp, Rattus norvegicus
ctgtgtttgtgtcaccttatgacct

SEQ ID NO: 277228 - DNA, 25 bp, Rattus norvegicus
ctgtgtttgtgtgaccttatgacct

SEQ ID NO: 277229 - DNA, 25 bp, Rattus norvegicus
ctgtgttttcataccattcgatggc

SEQ ID NO: 277230 - DNA, 25 bp, Rattus norvegicus
ctgtgttttcattccattcgatggc

SEQ ID NO: 277231 - DNA, 25 bp, Rattus norvegicus
ctgtgttttccaaggtctcagacaa

SEQ ID NO: 277232 - DNA, 25 bp, Rattus norvegicus
ctgtgttttccatggtctcagacaa

SEQ ID NO: 277233 - DNA, 25 bp, Rattus norvegicus
ctgtgttttggcctcctgggagtcc

SEQ ID NO: 277234 - DNA, 25 bp, Rattus norvegicus
ctgtgttttggcgtcctgggagtcc

SEQ ID NO: 277235 - DNA, 25 bp, Rattus norvegicus
ctgttaacatttatactcgcctcgg

SEQ ID NO: 277236 - DNA, 25 bp, Rattus norvegicus
ctgttaacatttttactcgcctcgg

SEQ ID NO: 277237 - DNA, 25 bp, Rattus norvegicus
ctgttaacggttactattccatgat

SEQ ID NO: 277238 - DNA, 25 bp, Rattus norvegicus
ctgttaacggtttctattccatgat

SEQ ID NO: 277239 - DNA, 25 bp, Rattus norvegicus
ctgttaactacaaagctcacgccga

SEQ ID NO: 277240 - DNA, 25 bp, Rattus norvegicus
ctgttaactacatagctcacgccga

SEQ ID NO: 277241 - DNA, 25 bp, Rattus norvegicus
ctgttaagagttagcccagccataa

SEQ ID NO: 277242 - DNA, 25 bp, Rattus norvegicus
ctgttaagagtttgcccagccataa

SEQ ID NO: 277243 - DNA, 25 bp, Rattus norvegicus
ctgttacaccttacattttatcttt

SEQ ID NO: 277244 - DNA, 25 bp, Rattus norvegicus
ctgttacacctttcattttatcttt

SEQ ID NO: 277245 - DNA, 25 bp, Rattus norvegicus
ctgttaccatatcccaagtgtctga

SEQ ID NO: 277246 - DNA, 25 bp, Rattus norvegicus
ctgttaccatatgccaagtgtctga

SEQ ID NO: 277247 - DNA, 25 bp, Rattus norvegicus
ctgttaccggtgatggactcctgaa

SEQ ID NO: 277248 - DNA, 25 bp, Rattus norvegicus
ctgttaccggtgttggactcctgaa

SEQ ID NO: 277249 - DNA, 25 bp, Rattus norvegicus
ctgttactatgacaatggcccttcc

SEQ ID NO: 277250 - DNA, 25 bp, Rattus norvegicus
ctgttactatgagaatggcccttcc

SEQ ID NO: 277251 - DNA, 25 bp, Rattus norvegicus
ctgttactctttacctgtgctgata

SEQ ID NO: 277252 - DNA, 25 bp, Rattus norvegicus
ctgttactcttttcctgtgctgata

SEQ ID NO: 277253 - DNA, 25 bp, Rattus norvegicus
ctgttactgggactgaggctgcttt

SEQ ID NO: 277254 - DNA, 25 bp, Rattus norvegicus
ctgttactgggagtgaggctgcttt

SEQ ID NO: 277255 - DNA, 25 bp, Rattus norvegicus
ctgttactttgaacttttgatgagt

SEQ ID NO: 277256 - DNA, 25 bp, Rattus norvegicus
ctgttactttgatcttttgatgagt

SEQ ID NO: 277257 - DNA, 25 bp, Rattus norvegicus
ctgttacttttgatttccacttgaa

SEQ ID NO: 277258 - DNA, 25 bp, Rattus norvegicus
ctgttacttttgttttccacttgaa

SEQ ID NO: 277259 - DNA, 25 bp, Rattus norvegicus
ctgttagcaatgaggccttactgga

SEQ ID NO: 277260 - DNA, 25 bp, Rattus norvegicus
ctgttagcaatgtggccttactgga

SEQ ID NO: 277261 - DNA, 25 bp, Rattus norvegicus
ctgttagcatccagttactcgtaaa

SEQ ID NO: 277262 - DNA, 25 bp, Rattus norvegicus
ctgttagcatcctgttactcgtaaa

SEQ ID NO: 277263 - DNA, 25 bp, Rattus norvegicus
ctgttagctaaaaccctgttttgaa

SEQ ID NO: 277264 - DNA, 25 bp, Rattus norvegicus
ctgttagctaaatccctgttttgaa

SEQ ID NO: 277265 - DNA, 25 bp, Rattus norvegicus
ctgttaggacttcatattggcatgt

SEQ ID NO: 277266 - DNA, 25 bp, Rattus norvegicus
ctgttaggacttgatattggcatgt

SEQ ID NO: 277267 - DNA, 25 bp, Rattus norvegicus
ctgttaggccctatgctcattcatt

SEQ ID NO: 277268 - DNA, 25 bp, Rattus norvegicus
ctgttaggccctttgctcattcatt

SEQ ID NO: 277269 - DNA, 25 bp, Rattus norvegicus
ctgttataacatcctcctgtgctgt

SEQ ID NO: 277270 - DNA, 25 bp, Rattus norvegicus
ctgttataacatgctcctgtgctgt

SEQ ID NO: 277271 - DNA, 25 bp, Rattus norvegicus
ctgttatgccttacagtgcgttact

SEQ ID NO: 277272 - DNA, 25 bp, Rattus norvegicus
ctgttatgcctttcagtgcgttact

SEQ ID NO: 277273 - DNA, 25 bp, Rattus norvegicus
ctgttatggcttccagcggtgtgac

SEQ ID NO: 277274 - DNA, 25 bp, Rattus norvegicus
ctgttatggcttgcagcggtgtgac

SEQ ID NO: 277275 - DNA, 25 bp, Rattus norvegicus
ctgttattacataggttgctcattc

SEQ ID NO: 277276 - DNA, 25 bp, Rattus norvegicus
ctgttattacattggttgctcattc

SEQ ID NO: 277277 - DNA, 25 bp, Rattus norvegicus
ctgttattacctctgatgctggata

SEQ ID NO: 277278 - DNA, 25 bp, Rattus norvegicus
ctgttattacctgtgatgctggata

SEQ ID NO: 277279 - DNA, 25 bp, Rattus norvegicus
ctgttattcaggcaccaggcactaa

SEQ ID NO: 277280 - DNA, 25 bp, Rattus norvegicus
ctgttattcagggaccaggcactaa

SEQ ID NO: 277281 - DNA, 25 bp, Rattus norvegicus
ctgttattccggatggccttgagct

SEQ ID NO: 277282 - DNA, 25 bp, Rattus norvegicus
ctgttattccggttggccttgagct

SEQ ID NO: 277283 - DNA, 25 bp, Rattus norvegicus
ctgttatttaaaagatttggcctct

SEQ ID NO: 277284 - DNA, 25 bp, Rattus norvegicus
ctgttatttaaatgatttggcctct

SEQ ID NO: 277285 - DNA, 25 bp, Rattus norvegicus
ctgttatttgtactatgttgtgtcc

SEQ ID NO: 277286 - DNA, 25 bp, Rattus norvegicus
ctgttatttgtagtatgttgtgtcc

SEQ ID NO: 277287 - DNA, 25 bp, Rattus norvegicus
ctgttattttatcttggctcgatgc

SEQ ID NO: 277288 - DNA, 25 bp, Rattus norvegicus
ctgttattttatgttggctcgatgc

SEQ ID NO: 277289 - DNA, 25 bp, Rattus norvegicus
ctgttcaaagtgcagggcccaacct

SEQ ID NO: 277290 - DNA, 25 bp, Rattus norvegicus
ctgttcaaagtggagggcccaacct

SEQ ID NO: 277291 - DNA, 25 bp, Rattus norvegicus
ctgttcaacaacactatggtttaat

SEQ ID NO: 277292 - DNA, 25 bp, Rattus norvegicus
ctgttcaacaactctatggtttaat

SEQ ID NO: 277293 - DNA, 25 bp, Rattus norvegicus
ctgttcacagccaatgcaggcttta

SEQ ID NO: 277294 - DNA, 25 bp, Rattus norvegicus
ctgttcacagcctatgcaggcttta

SEQ ID NO: 277295 - DNA, 25 bp, Rattus norvegicus
ctgttcacttatctgtgatcccttc

SEQ ID NO: 277296 - DNA, 25 bp, Rattus norvegicus
ctgttcacttatgtgtgatcccttc

SEQ ID NO: 277297 - DNA, 25 bp, Rattus norvegicus
ctgttcaggtctccagctagcagga

SEQ ID NO: 277298 - DNA, 25 bp, Rattus norvegicus
ctgttcaggtctgcagctagcagga

SEQ ID NO: 277299 - DNA, 25 bp, Rattus norvegicus
ctgttcagtctcattaagctttaaa

SEQ ID NO: 277300 - DNA, 25 bp, Rattus norvegicus
ctgttcagtctctttaagctttaaa

SEQ ID NO: 277301 - DNA, 25 bp, Rattus norvegicus
ctgttcagttctagctgtacttgga

SEQ ID NO: 277302 - DNA, 25 bp, Rattus norvegicus
ctgttcagttctcaggaagaggctg

SEQ ID NO: 277303 - DNA, 25 bp, Rattus norvegicus
ctgttcagttctgaggaagaggctg

SEQ ID NO: 277304 - DNA, 25 bp, Rattus norvegicus
ctgttcagttcttgctgtacttgga

SEQ ID NO: 277305 - DNA, 25 bp, Rattus norvegicus
ctgttcatacagcttctagagtcaa

SEQ ID NO: 277306 - DNA, 25 bp, Rattus norvegicus
ctgttcatacaggttctagagtcaa

SEQ ID NO: 277307 - DNA, 25 bp, Rattus norvegicus
ctgttcatactcattaccctggaaa

SEQ ID NO: 277308 - DNA, 25 bp, Rattus norvegicus
ctgttcatactctttaccctggaaa

SEQ ID NO: 277309 - DNA, 25 bp, Rattus norvegicus
ctgttcatcagtcagagatcctcag

SEQ ID NO: 277310 - DNA, 25 bp, Rattus norvegicus
ctgttcatcagtgagagatcctcag

SEQ ID NO: 277311 - DNA, 25 bp, Rattus norvegicus
ctgttcatcatgagggtctttccct

SEQ ID NO: 277312 - DNA, 25 bp, Rattus norvegicus
ctgttcatcatgtgggtctttccct

SEQ ID NO: 277313 - DNA, 25 bp, Rattus norvegicus
ctgttcatgaggcacttgtgtgacc

SEQ ID NO: 277314 - DNA, 25 bp, Rattus norvegicus
ctgttcatgagggacttgtgtgacc

SEQ ID NO: 277315 - DNA, 25 bp, Rattus norvegicus
ctgttcattcagagccgaagatcaa

SEQ ID NO: 277316 - DNA, 25 bp, Rattus norvegicus
ctgttcattcagtgccgaagatcaa

SEQ ID NO: 277317 - DNA, 25 bp, Rattus norvegicus
ctgttcattcatccaactcggcaaa

SEQ ID NO: 277318 - DNA, 25 bp, Rattus norvegicus
ctgttcattcatgcaactcggcaaa

SEQ ID NO: 277319 - DNA, 25 bp, Rattus norvegicus
ctgttcattctgagattagagagtc

SEQ ID NO: 277320 - DNA, 25 bp, Rattus norvegicus
ctgttcattctgtgattagagagtc

SEQ ID NO: 277321 - DNA, 25 bp, Rattus norvegicus
ctgttccaaaacctgcaggctgcac

SEQ ID NO: 277322 - DNA, 25 bp, Rattus norvegicus
ctgttccaaaacgtgcaggctgcac

SEQ ID NO: 277323 - DNA, 25 bp, Rattus norvegicus
ctgttccaagggaatctgacgcctc

SEQ ID NO: 277324 - DNA, 25 bp, Rattus norvegicus
ctgttccaagggtatctgacgcctc

SEQ ID NO: 277325 - DNA, 25 bp, Rattus norvegicus
ctgttccagaatagctagaagccga

SEQ ID NO: 277326 - DNA, 25 bp, Rattus norvegicus
ctgttccagaattgctagaagccga

SEQ ID NO: 277327 - DNA, 25 bp, Rattus norvegicus
ctgttcccaaacaatgcacattcga

SEQ ID NO: 277328 - DNA, 25 bp, Rattus norvegicus
ctgttcccaaactatgcacattcga

SEQ ID NO: 277329 - DNA, 25 bp, Rattus norvegicus
ctgttcccaggacagcttcaaaaaa

SEQ ID NO: 277330 - DNA, 25 bp, Rattus norvegicus
ctgttcccaggagagcttcaaaaaa

SEQ ID NO: 277331 - DNA, 25 bp, Rattus norvegicus
ctgttccccgaaactggtcagtaga

SEQ ID NO: 277332 - DNA, 25 bp, Rattus norvegicus
ctgttccccgaatctggtcagtaga

SEQ ID NO: 277333 - DNA, 25 bp, Rattus norvegicus
ctgttcccggacagtctctgagaag

SEQ ID NO: 277334 - DNA, 25 bp, Rattus norvegicus
ctgttcccggactgtctctgagaag

SEQ ID NO: 277335 - DNA, 25 bp, Rattus norvegicus
ctgttccctcctcctttgattttta

SEQ ID NO: 277336 - DNA, 25 bp, Rattus norvegicus
ctgttccctcctgctttgattttta

SEQ ID NO: 277337 - DNA, 25 bp, Rattus norvegicus
ctgttcctaaacatttcactaccat

SEQ ID NO: 277338 - DNA, 25 bp, Rattus norvegicus
ctgttcctaaacttttcactaccat

SEQ ID NO: 277339 - DNA, 25 bp, Rattus norvegicus
ctgttcctcacaatggctcaagatt

SEQ ID NO: 277340 - DNA, 25 bp, Rattus norvegicus
ctgttcctcacattggctcaagatt

SEQ ID NO: 277341 - DNA, 25 bp, Rattus norvegicus
ctgttcctcctgaatcacaaacaat

SEQ ID NO: 277342 - DNA, 25 bp, Rattus norvegicus
ctgttcctcctgtatcacaaacaat

SEQ ID NO: 277343 - DNA, 25 bp, Rattus norvegicus
ctgttcctcgctctgcagggagagt

SEQ ID NO: 277344 - DNA, 25 bp, Rattus norvegicus
ctgttcctcgctgtgcagggagagt

SEQ ID NO: 277345 - DNA, 25 bp, Rattus norvegicus
ctgttcctctggaccattgtgtgaa

SEQ ID NO: 277346 - DNA, 25 bp, Rattus norvegicus
ctgttcctctggtccattgtgtgaa

SEQ ID NO: 277347 - DNA, 25 bp, Rattus norvegicus
ctgttcctgatgcattgactcttca

SEQ ID NO: 277348 - DNA, 25 bp, Rattus norvegicus
ctgttcctgatggattgactcttca

SEQ ID NO: 277349 - DNA, 25 bp, Rattus norvegicus
ctgttcctgtatatgcagtggtgta

SEQ ID NO: 277350 - DNA, 25 bp, Rattus norvegicus
ctgttcctgtatttgcagtggtgta

SEQ ID NO: 277351 - DNA, 25 bp, Rattus norvegicus
ctgttcctgttgatacctataccga

SEQ ID NO: 277352 - DNA, 25 bp, Rattus norvegicus
ctgttcctgttgttacctataccga

SEQ ID NO: 277353 - DNA, 25 bp, Rattus norvegicus
ctgttccttagccactgtgcctatg

SEQ ID NO: 277354 - DNA, 25 bp, Rattus norvegicus
ctgttccttagcgactgtgcctatg

SEQ ID NO: 277355 - DNA, 25 bp, Rattus norvegicus
ctgttcctttctcggacaggatggg

SEQ ID NO: 277356 - DNA, 25 bp, Rattus norvegicus
ctgttcctttctgggacaggatggg

SEQ ID NO: 277357 - DNA, 25 bp, Rattus norvegicus
ctgttcctttggaatcatctagtaa

SEQ ID NO: 277358 - DNA, 25 bp, Rattus norvegicus
ctgttcctttggtatcatctagtaa

SEQ ID NO: 277359 - DNA, 25 bp, Rattus norvegicus
ctgttccttttcagaatttcccgag

SEQ ID NO: 277360 - DNA, 25 bp, Rattus norvegicus
ctgttccttttctgaatttcccgag

SEQ ID NO: 277361 - DNA, 25 bp, Rattus norvegicus
ctgttccttttgagactgtcattca

SEQ ID NO: 277362 - DNA, 25 bp, Rattus norvegicus
ctgttccttttgtgactgtcattca

SEQ ID NO: 277363 - DNA, 25 bp, Rattus norvegicus
ctgttcgagaggctgatgtgctcac

SEQ ID NO: 277364 - DNA, 25 bp, Rattus norvegicus
ctgttcgagagggtgatgtgctcac

SEQ ID NO: 277365 - DNA, 25 bp, Rattus norvegicus
ctgttcgctgtcaatgccagggttg

SEQ ID NO: 277366 - DNA, 25 bp, Rattus norvegicus
ctgttcgctgtctatgccagggttg

SEQ ID NO: 277367 - DNA, 25 bp, Rattus norvegicus
ctgttcggtttgcatggtttcccat

SEQ ID NO: 277368 - DNA, 25 bp, Rattus norvegicus
ctgttcggtttggatggtttcccat

SEQ ID NO: 277369 - DNA, 25 bp, Rattus norvegicus
ctgttcgtggctactaatgtgttac

SEQ ID NO: 277370 - DNA, 25 bp, Rattus norvegicus
ctgttcgtggcttctaatgtgttac

SEQ ID NO: 277371 - DNA, 25 bp, Rattus norvegicus
ctgttctacttgacacctttcaata

SEQ ID NO: 277372 - DNA, 25 bp, Rattus norvegicus
ctgttctacttgtcacctttcaata

SEQ ID NO: 277373 - DNA, 25 bp, Rattus norvegicus
ctgttctatagaccccatattccat

SEQ ID NO: 277374 - DNA, 25 bp, Rattus norvegicus
ctgttctatagagcccatattccat

SEQ ID NO: 277375 - DNA, 25 bp, Rattus norvegicus
ctgttctatatgaaaggtactgtat

SEQ ID NO: 277376 - DNA, 25 bp, Rattus norvegicus
ctgttctatatgtaaggtactgtat

SEQ ID NO: 277377 - DNA, 25 bp, Rattus norvegicus
ctgttctcagttatcctattattgt

SEQ ID NO: 277378 - DNA, 25 bp, Rattus norvegicus
ctgttctcagttcctcaggaggatg

SEQ ID NO: 277379 - DNA, 25 bp, Rattus norvegicus
ctgttctcagttgctcaggaggatg

SEQ ID NO: 277380 - DNA, 25 bp, Rattus norvegicus
ctgttctcagttttcctattattgt

SEQ ID NO: 277381 - DNA, 25 bp, Rattus norvegicus
ctgttctccatgcttgcttctgggt

SEQ ID NO: 277382 - DNA, 25 bp, Rattus norvegicus
ctgttctccatggttgcttctgggt

SEQ ID NO: 277383 - DNA, 25 bp, Rattus norvegicus
ctgttctctaatcctggcctagaaa

SEQ ID NO: 277384 - DNA, 25 bp, Rattus norvegicus
ctgttctctaatgctggcctagaaa

SEQ ID NO: 277385 - DNA, 25 bp, Rattus norvegicus
ctgttctctacacgctttgaagacc

SEQ ID NO: 277386 - DNA, 25 bp, Rattus norvegicus
ctgttctctacaggctttgaagacc

SEQ ID NO: 277387 - DNA, 25 bp, Rattus norvegicus
ctgttctctcagctcctgtaggtag

SEQ ID NO: 277388 - DNA, 25 bp, Rattus norvegicus
ctgttctctcaggtcctgtaggtag

SEQ ID NO: 277389 - DNA, 25 bp, Rattus norvegicus
ctgttctctcataacgttctttcaa

SEQ ID NO: 277390 - DNA, 25 bp, Rattus norvegicus
ctgttctctcattacgttctttcaa

SEQ ID NO: 277391 - DNA, 25 bp, Rattus norvegicus
ctgttctctgcgacctagaggttgt

SEQ ID NO: 277392 - DNA, 25 bp, Rattus norvegicus
ctgttctctgcgtcctagaggttgt

SEQ ID NO: 277393 - DNA, 25 bp, Rattus norvegicus
ctgttctcttgcattttagccgtag

SEQ ID NO: 277394 - DNA, 25 bp, Rattus norvegicus
ctgttctcttgctttttagccgtag

SEQ ID NO: 277395 - DNA, 25 bp, Rattus norvegicus
ctgttctgccacatgattgtctttg

SEQ ID NO: 277396 - DNA, 25 bp, Rattus norvegicus
ctgttctgccacttgattgtctttg

SEQ ID NO: 277397 - DNA, 25 bp, Rattus norvegicus
ctgttctgccagagaccggaagagt

SEQ ID NO: 277398 - DNA, 25 bp, Rattus norvegicus
ctgttctgccagtgaccggaagagt

SEQ ID NO: 277399 - DNA, 25 bp, Rattus norvegicus
ctgttctggaatctctgttcgttga

SEQ ID NO: 277400 - DNA, 25 bp, Rattus norvegicus
ctgttctggaatgtctgttcgttga

SEQ ID NO: 277401 - DNA, 25 bp, Rattus norvegicus
ctgttctgggccagggaagattgct

SEQ ID NO: 277402 - DNA, 25 bp, Rattus norvegicus
ctgttctgggcctgggaagattgct

SEQ ID NO: 277403 - DNA, 25 bp, Rattus norvegicus
ctgttctgtagacttgtatttgtaa

SEQ ID NO: 277404 - DNA, 25 bp, Rattus norvegicus
ctgttctgtagagttgtatttgtaa

SEQ ID NO: 277405 - DNA, 25 bp, Rattus norvegicus
ctgttctgtgaacccttgaccctgt

SEQ ID NO: 277406 - DNA, 25 bp, Rattus norvegicus
ctgttctgtgaagccttgaccctgt

SEQ ID NO: 277407 - DNA, 25 bp, Rattus norvegicus
ctgttctgtggaaggcagacctgct

SEQ ID NO: 277408 - DNA, 25 bp, Rattus norvegicus
ctgttctgtggatggcagacctgct

SEQ ID NO: 277409 - DNA, 25 bp, Rattus norvegicus
ctgttcttaactaccatgattgctt

SEQ ID NO: 277410 - DNA, 25 bp, Rattus norvegicus
ctgttcttaacttccatgattgctt

SEQ ID NO: 277411 - DNA, 25 bp, Rattus norvegicus
ctgttcttaatgatgctgcactctt

SEQ ID NO: 277412 - DNA, 25 bp, Rattus norvegicus
ctgttcttaatgttgctgcactctt

SEQ ID NO: 277413 - DNA, 25 bp, Rattus norvegicus
ctgttcttactgactgcatacttga

SEQ ID NO: 277414 - DNA, 25 bp, Rattus norvegicus
ctgttcttactgtctgcatacttga

SEQ ID NO: 277415 - DNA, 25 bp, Rattus norvegicus
ctgttcttagccattctgtggtttc

SEQ ID NO: 277416 - DNA, 25 bp, Rattus norvegicus
ctgttcttagcctttctgtggtttc

SEQ ID NO: 277417 - DNA, 25 bp, Rattus norvegicus
ctgttcttatgaagcttgtgattct

SEQ ID NO: 277418 - DNA, 25 bp, Rattus norvegicus
ctgttcttatgatgcttgtgattct

SEQ ID NO: 277419 - DNA, 25 bp, Rattus norvegicus
ctgttcttcattatgtaggtcagat

SEQ ID NO: 277420 - DNA, 25 bp, Rattus norvegicus
ctgttcttcattttgtaggtcagat

SEQ ID NO: 277421 - DNA, 25 bp, Rattus norvegicus
ctgttcttcctcaatcagtggcaga

SEQ ID NO: 277422 - DNA, 25 bp, Rattus norvegicus
ctgttcttcctctatcagtggcaga

SEQ ID NO: 277423 - DNA, 25 bp, Rattus norvegicus
ctgttcttcctgaggacctaggttc

SEQ ID NO: 277424 - DNA, 25 bp, Rattus norvegicus
ctgttcttcctgtggacctaggttc

SEQ ID NO: 277425 - DNA, 25 bp, Rattus norvegicus
ctgttctttcagatctgttgccata

SEQ ID NO: 277426 - DNA, 25 bp, Rattus norvegicus
ctgttctttcagttctgttgccata

SEQ ID NO: 277427 - DNA, 25 bp, Rattus norvegicus
ctgttctttgaaattgggccattta

SEQ ID NO: 277428 - DNA, 25 bp, Rattus norvegicus
ctgttctttgaatttgggccattta

SEQ ID NO: 277429 - DNA, 25 bp, Rattus norvegicus
ctgttgaacttaagtttcgatgtgg

SEQ ID NO: 277430 - DNA, 25 bp, Rattus norvegicus
ctgttgaacttatgtttcgatgtgg

SEQ ID NO: 277431 - DNA, 25 bp, Rattus norvegicus
ctgttgacatcacacatggactatt

SEQ ID NO: 277432 - DNA, 25 bp, Rattus norvegicus
ctgttgacatcagacatggactatt

SEQ ID NO: 277433 - DNA, 25 bp, Rattus norvegicus
ctgttgactgtaatgacgtagaatt

SEQ ID NO: 277434 - DNA, 25 bp, Rattus norvegicus
ctgttgactgtattgacgtagaatt

SEQ ID NO: 277435 - DNA, 25 bp, Rattus norvegicus
ctgttgagccaaataccatattttt

SEQ ID NO: 277436 - DNA, 25 bp, Rattus norvegicus
ctgttgagccaattaccatattttt

SEQ ID NO: 277437 - DNA, 25 bp, Rattus norvegicus
ctgttgagtatgactgttgtagcca

SEQ ID NO: 277438 - DNA, 25 bp, Rattus norvegicus
ctgttgagtatgtctgttgtagcca

SEQ ID NO: 277439 - DNA, 25 bp, Rattus norvegicus
ctgttgatagctatttgtcctgtaa

SEQ ID NO: 277440 - DNA, 25 bp, Rattus norvegicus
ctgttgatagctttttgtcctgtaa

SEQ ID NO: 277441 - DNA, 25 bp, Rattus norvegicus
ctgttgatatcccaggctattccta

SEQ ID NO: 277442 - DNA, 25 bp, Rattus norvegicus
ctgttgatatccgaggctattccta

SEQ ID NO: 277443 - DNA, 25 bp, Rattus norvegicus
ctgttgatcctgagtttcctagaag

SEQ ID NO: 277444 - DNA, 25 bp, Rattus norvegicus
ctgttgatcctgatgggctcctggg

SEQ ID NO: 277445 - DNA, 25 bp, Rattus norvegicus
ctgttgatcctgtgtttcctagaag

SEQ ID NO: 277446 - DNA, 25 bp, Rattus norvegicus
ctgttgatcctgttgggctcctggg

SEQ ID NO: 277447 - DNA, 25 bp, Rattus norvegicus
ctgttgattatcatacttgccctga

SEQ ID NO: 277448 - DNA, 25 bp, Rattus norvegicus
ctgttgattatcttacttgccctga

SEQ ID NO: 277449 - DNA, 25 bp, Rattus norvegicus
ctgttgcaaggccaatttatccatt

SEQ ID NO: 277450 - DNA, 25 bp, Rattus norvegicus
ctgttgcaaggcgaatttatccatt

SEQ ID NO: 277451 - DNA, 25 bp, Rattus norvegicus
ctgttgccagtcaaggtagtaacct

SEQ ID NO: 277452 - DNA, 25 bp, Rattus norvegicus
ctgttgccagtctaggtagtaacct

SEQ ID NO: 277453 - DNA, 25 bp, Rattus norvegicus
ctgttgcccagaatggaatctcggt

SEQ ID NO: 277454 - DNA, 25 bp, Rattus norvegicus
ctgttgcccagattggaatctcggt

SEQ ID NO: 277455 - DNA, 25 bp, Rattus norvegicus
ctgttgccgggtccagcttgaagca

SEQ ID NO: 277456 - DNA, 25 bp, Rattus norvegicus
ctgttgccgggtgcagcttgaagca

SEQ ID NO: 277457 - DNA, 25 bp, Rattus norvegicus
ctgttgcctaggatggctggcacca

SEQ ID NO: 277458 - DNA, 25 bp, Rattus norvegicus
ctgttgcctaggttggctggcacca

SEQ ID NO: 277459 - DNA, 25 bp, Rattus norvegicus
ctgttgcgccgcaatagttttagtg

SEQ ID NO: 277460 - DNA, 25 bp, Rattus norvegicus
ctgttgcgccgctatagttttagtg

SEQ ID NO: 277461 - DNA, 25 bp, Rattus norvegicus
ctgttgcgtgctaggtggactctct

SEQ ID NO: 277462 - DNA, 25 bp, Rattus norvegicus
ctgttgcgtgcttggtggactctct

SEQ ID NO: 277463 - DNA, 25 bp, Rattus norvegicus
ctgttgcgttacaatatggctggat

SEQ ID NO: 277464 - DNA, 25 bp, Rattus norvegicus
ctgttgcgttactatatggctggat

SEQ ID NO: 277465 - DNA, 25 bp, Rattus norvegicus
ctgttgctatctccagtgttcccaa

SEQ ID NO: 277466 - DNA, 25 bp, Rattus norvegicus
ctgttgctatctgcagtgttcccaa

SEQ ID NO: 277467 - DNA, 25 bp, Rattus norvegicus
ctgttgctccttaatacttcctaga

SEQ ID NO: 277468 - DNA, 25 bp, Rattus norvegicus
ctgttgctcctttatacttcctaga

SEQ ID NO: 277469 - DNA, 25 bp, Rattus norvegicus
ctgttgctctgtctctgtgaataaa

SEQ ID NO: 277470 - DNA, 25 bp, Rattus norvegicus
ctgttgctctgtgtctgtgaataaa

SEQ ID NO: 277471 - DNA, 25 bp, Rattus norvegicus
ctgttgctgagcacaatgggaccca

SEQ ID NO: 277472 - DNA, 25 bp, Rattus norvegicus
ctgttgctgagctcaatgggaccca

SEQ ID NO: 277473 - DNA, 25 bp, Rattus norvegicus
ctgttgctgttacctttcgatgaat

SEQ ID NO: 277474 - DNA, 25 bp, Rattus norvegicus
ctgttgctgttagctttcgatgaat

SEQ ID NO: 277475 - DNA, 25 bp, Rattus norvegicus
ctgttggactttcttctcttttgca

SEQ ID NO: 277476 - DNA, 25 bp, Rattus norvegicus
ctgttggactttgttctcttttgca

SEQ ID NO: 277477 - DNA, 25 bp, Rattus norvegicus
ctgttggagcaacgccgcctgttgt

SEQ ID NO: 277478 - DNA, 25 bp, Rattus norvegicus
ctgttggagcaaggccgcctgttgt

SEQ ID NO: 277479 - DNA, 25 bp, Rattus norvegicus
ctgttggatgaactcactggtcccc

SEQ ID NO: 277480 - DNA, 25 bp, Rattus norvegicus
ctgttggatgaagtcactggtcccc

SEQ ID NO: 277481 - DNA, 25 bp, Rattus norvegicus
ctgttggcacgcatgaggacttgat

SEQ ID NO: 277482 - DNA, 25 bp, Rattus norvegicus
ctgttggcacgcttgaggacttgat

SEQ ID NO: 277483 - DNA, 25 bp, Rattus norvegicus
ctgttggccaaaaagcgagggacca

SEQ ID NO: 277484 - DNA, 25 bp, Rattus norvegicus
ctgttggccaaatagcgagggacca

SEQ ID NO: 277485 - DNA, 25 bp, Rattus norvegicus
ctgttggctataactgaaacatgcc

SEQ ID NO: 277486 - DNA, 25 bp, Rattus norvegicus
ctgttggctatatctgaaacatgcc

SEQ ID NO: 277487 - DNA, 25 bp, Rattus norvegicus
ctgttggctgccaacgatgaggaga

SEQ ID NO: 277488 - DNA, 25 bp, Rattus norvegicus
ctgttggctgcctacgatgaggaga

SEQ ID NO: 277489 - DNA, 25 bp, Rattus norvegicus
ctgttggctggtattactctggaga

SEQ ID NO: 277490 - DNA, 25 bp, Rattus norvegicus
ctgttggctggttttactctggaga

SEQ ID NO: 277491 - DNA, 25 bp, Rattus norvegicus
ctgttggctgtaacagcagccccaa

SEQ ID NO: 277492 - DNA, 25 bp, Rattus norvegicus
ctgttggctgtatcagcagccccaa

SEQ ID NO: 277493 - DNA, 25 bp, Rattus norvegicus
ctgttgggacaaaacacttgataca

SEQ ID NO: 277494 - DNA, 25 bp, Rattus norvegicus
ctgttgggacaatacacttgataca

SEQ ID NO: 277495 - DNA, 25 bp, Rattus norvegicus
ctgttgggacagatatgaggctcta

SEQ ID NO: 277496 - DNA, 25 bp, Rattus norvegicus
ctgttgggacagttatgaggctcta

SEQ ID NO: 277497 - DNA, 25 bp, Rattus norvegicus
ctgttgggtgcacacagtctactga

SEQ ID NO: 277498 - DNA, 25 bp, Rattus norvegicus
ctgttgggtgcagacagtctactga

SEQ ID NO: 277499 - DNA, 25 bp, Rattus norvegicus
ctgttggtcatcagacactctcaag

SEQ ID NO: 277500 - DNA, 25 bp, Rattus norvegicus
ctgttggtcatctgacactctcaag

SEQ ID NO: 277501 - DNA, 25 bp, Rattus norvegicus
ctgttggtccagcaagcatctatca

SEQ ID NO: 277502 - DNA, 25 bp, Rattus norvegicus
ctgttggtccaggaagcatctatca

SEQ ID NO: 277503 - DNA, 25 bp, Rattus norvegicus
ctgttggtcctgcagaggactcagt

SEQ ID NO: 277504 - DNA, 25 bp, Rattus norvegicus
ctgttggtcctggagaggactcagt

SEQ ID NO: 277505 - DNA, 25 bp, Rattus norvegicus
ctgttggtctgtatatgagttctct

SEQ ID NO: 277506 - DNA, 25 bp, Rattus norvegicus
ctgttggtctgtttatgagttctct

SEQ ID NO: 277507 - DNA, 25 bp, Rattus norvegicus
ctgttggttgccaccttctacgcaa

SEQ ID NO: 277508 - DNA, 25 bp, Rattus norvegicus
ctgttggttgcctccttctacgcaa

SEQ ID NO: 277509 - DNA, 25 bp, Rattus norvegicus
ctgttggtttgaattgtgcttttct

SEQ ID NO: 277510 - DNA, 25 bp, Rattus norvegicus
ctgttggtttgatttgtgcttttct

SEQ ID NO: 277511 - DNA, 25 bp, Rattus norvegicus
ctgttgtaaagtacacactgtgtgt

SEQ ID NO: 277512 - DNA, 25 bp, Rattus norvegicus
ctgttgtaaagttcacactgtgtgt

SEQ ID NO: 277513 - DNA, 25 bp, Rattus norvegicus
ctgttgtacacaattagcatcacgt

SEQ ID NO: 277514 - DNA, 25 bp, Rattus norvegicus
ctgttgtacacatttagcatcacgt

SEQ ID NO: 277515 - DNA, 25 bp, Rattus norvegicus
ctgttgtagggtccctatgtgccat

SEQ ID NO: 277516 - DNA, 25 bp, Rattus norvegicus
ctgttgtagggtgcctatgtgccat

SEQ ID NO: 277517 - DNA, 25 bp, Rattus norvegicus
ctgttgtcacaccagctgaagcgac

SEQ ID NO: 277518 - DNA, 25 bp, Rattus norvegicus
ctgttgtcacacgagctgaagcgac

SEQ ID NO: 277519 - DNA, 25 bp, Rattus norvegicus
ctgttgtcgcttacgttgtggcaga

SEQ ID NO: 277520 - DNA, 25 bp, Rattus norvegicus
ctgttgtcgctttcgttgtggcaga

SEQ ID NO: 277521 - DNA, 25 bp, Rattus norvegicus
ctgttgtcggacatcactgagagca

SEQ ID NO: 277522 - DNA, 25 bp, Rattus norvegicus
ctgttgtcggacttcactgagagca

SEQ ID NO: 277523 - DNA, 25 bp, Rattus norvegicus
ctgttgtctgagactgtactactga

SEQ ID NO: 277524 - DNA, 25 bp, Rattus norvegicus
ctgttgtctgagtctgtactactga

SEQ ID NO: 277525 - DNA, 25 bp, Rattus norvegicus
ctgttgtgtctgactgtgcaatcta

SEQ ID NO: 277526 - DNA, 25 bp, Rattus norvegicus
ctgttgtgtctgtctgtgcaatcta

SEQ ID NO: 277527 - DNA, 25 bp, Rattus norvegicus
ctgttgttccctcttaacctctgga

SEQ ID NO: 277528 - DNA, 25 bp, Rattus norvegicus
ctgttgttccctgttaacctctgga

SEQ ID NO: 277529 - DNA, 25 bp, Rattus norvegicus
ctgttgttgaatcgcagcctctgct

SEQ ID NO: 277530 - DNA, 25 bp, Rattus norvegicus
ctgttgttgaatggcagcctctgct

SEQ ID NO: 277531 - DNA, 25 bp, Rattus norvegicus
ctgttgttgcagaaggaggtcagca

SEQ ID NO: 277532 - DNA, 25 bp, Rattus norvegicus
ctgttgttgcagtaggaggtcagca

SEQ ID NO: 277533 - DNA, 25 bp, Rattus norvegicus
ctgttgtttgacatgctcagtgagc

SEQ ID NO: 277534 - DNA, 25 bp, Rattus norvegicus
ctgttgtttgacttgctcagtgagc

SEQ ID NO: 277535 - DNA, 25 bp, Rattus norvegicus
ctgttgtttgtcagtttcacgtgaa

SEQ ID NO: 277536 - DNA, 25 bp, Rattus norvegicus
ctgttgtttgtctgtttcacgtgaa

SEQ ID NO: 277537 - DNA, 25 bp, Rattus norvegicus
ctgttgttttgtactccagaatttg

SEQ ID NO: 277538 - DNA, 25 bp, Rattus norvegicus
ctgttgttttgttctccagaatttg

SEQ ID NO: 277539 - DNA, 25 bp, Rattus norvegicus
ctgtttaaacagaatgccctcattt

SEQ ID NO: 277540 - DNA, 25 bp, Rattus norvegicus
ctgtttaaacagtatgccctcattt

SEQ ID NO: 277541 - DNA, 25 bp, Rattus norvegicus
ctgtttaacaaactgtgcacacccc

SEQ ID NO: 277542 - DNA, 25 bp, Rattus norvegicus
ctgtttaacaaagtgtgcacacccc

SEQ ID NO: 277543 - DNA, 25 bp, Rattus norvegicus
ctgtttaactgtcaggtgaccaacc

SEQ ID NO: 277544 - DNA, 25 bp, Rattus norvegicus
ctgtttaactgtgaggtgaccaacc

SEQ ID NO: 277545 - DNA, 25 bp, Rattus norvegicus
ctgtttaacttcctaagatgcaaag

SEQ ID NO: 277546 - DNA, 25 bp, Rattus norvegicus
ctgtttaacttcgtaagatgcaaag

SEQ ID NO: 277547 - DNA, 25 bp, Rattus norvegicus
ctgtttacatatagaggcgttcctc

SEQ ID NO: 277548 - DNA, 25 bp, Rattus norvegicus
ctgtttacatattgaggcgttcctc

SEQ ID NO: 277549 - DNA, 25 bp, Rattus norvegicus
ctgtttacctttcgcaccgcaggca

SEQ ID NO: 277550 - DNA, 25 bp, Rattus norvegicus
ctgtttacctttggcaccgcaggca

SEQ ID NO: 277551 - DNA, 25 bp, Rattus norvegicus
ctgtttatgcatatcttccacctaa

SEQ ID NO: 277552 - DNA, 25 bp, Rattus norvegicus
ctgtttatgcatttcttccacctaa

SEQ ID NO: 277553 - DNA, 25 bp, Rattus norvegicus
ctgtttatttatagtactctagtta

SEQ ID NO: 277554 - DNA, 25 bp, Rattus norvegicus
ctgtttatttattgtactctagtta

SEQ ID NO: 277555 - DNA, 25 bp, Rattus norvegicus
ctgtttatttcacgtagccttggga

SEQ ID NO: 277556 - DNA, 25 bp, Rattus norvegicus
ctgtttatttcaggtagccttggga

SEQ ID NO: 277557 - DNA, 25 bp, Rattus norvegicus
ctgtttcactcccaagtagcttgga

SEQ ID NO: 277558 - DNA, 25 bp, Rattus norvegicus
ctgtttcactccgaagtagcttgga

SEQ ID NO: 277559 - DNA, 25 bp, Rattus norvegicus
ctgtttcagactccctaggcaagaa

SEQ ID NO: 277560 - DNA, 25 bp, Rattus norvegicus
ctgtttcagactgcctaggcaagaa

SEQ ID NO: 277561 - DNA, 25 bp, Rattus norvegicus
ctgtttcagctactgcagccttaaa

SEQ ID NO: 277562 - DNA, 25 bp, Rattus norvegicus
ctgtttcagctagtgcagccttaaa

SEQ ID NO: 277563 - DNA, 25 bp, Rattus norvegicus
ctgtttccattgaggcactgaacaa

SEQ ID NO: 277564 - DNA, 25 bp, Rattus norvegicus
ctgtttccattgtggcactgaacaa

SEQ ID NO: 277565 - DNA, 25 bp, Rattus norvegicus
ctgtttccccagctataaagtggtg

SEQ ID NO: 277566 - DNA, 25 bp, Rattus norvegicus
ctgtttccccaggtataaagtggtg

SEQ ID NO: 277567 - DNA, 25 bp, Rattus norvegicus
ctgtttccctgacctgtacatatgt

SEQ ID NO: 277568 - DNA, 25 bp, Rattus norvegicus
ctgtttccctgagctgtacatatgt

SEQ ID NO: 277569 - DNA, 25 bp, Rattus norvegicus
ctgtttcccttcctttgcaaataat

SEQ ID NO: 277570 - DNA, 25 bp, Rattus norvegicus
ctgtttcccttcgtttgcaaataat

SEQ ID NO: 277571 - DNA, 25 bp, Rattus norvegicus
ctgtttcccttgatcagggtattga

SEQ ID NO: 277572 - DNA, 25 bp, Rattus norvegicus
ctgtttcccttgcgccgaagttcag

SEQ ID NO: 277573 - DNA, 25 bp, Rattus norvegicus
ctgtttcccttgggccgaagttcag

SEQ ID NO: 277574 - DNA, 25 bp, Rattus norvegicus
ctgtttcccttgttcagggtattga

SEQ ID NO: 277575 - DNA, 25 bp, Rattus norvegicus
ctgtttcctctgaatatcatgtggg

SEQ ID NO: 277576 - DNA, 25 bp, Rattus norvegicus
ctgtttcctctgtatatcatgtggg

SEQ ID NO: 277577 - DNA, 25 bp, Rattus norvegicus
ctgtttcctgatcgtcatgagggac

SEQ ID NO: 277578 - DNA, 25 bp, Rattus norvegicus
ctgtttcctgatggtcatgagggac

SEQ ID NO: 277579 - DNA, 25 bp, Rattus norvegicus
ctgtttccttggagtaccggacaat

SEQ ID NO: 277580 - DNA, 25 bp, Rattus norvegicus
ctgtttccttggtgtaccggacaat

SEQ ID NO: 277581 - DNA, 25 bp, Rattus norvegicus
ctgtttcctttgagcagcctagaag

SEQ ID NO: 277582 - DNA, 25 bp, Rattus norvegicus
ctgtttcctttgtgcagcctagaag

SEQ ID NO: 277583 - DNA, 25 bp, Rattus norvegicus
ctgtttccttttcctcactgctcag

SEQ ID NO: 277584 - DNA, 25 bp, Rattus norvegicus
ctgtttccttttgctcactgctcag

SEQ ID NO: 277585 - DNA, 25 bp, Rattus norvegicus
ctgtttcgatttaacttcttcaagg

SEQ ID NO: 277586 - DNA, 25 bp, Rattus norvegicus
ctgtttcgattttacttcttcaagg

SEQ ID NO: 277587 - DNA, 25 bp, Rattus norvegicus
ctgtttctagcccaggtgcaagagc

SEQ ID NO: 277588 - DNA, 25 bp, Rattus norvegicus
ctgtttctagccgaggtgcaagagc

SEQ ID NO: 277589 - DNA, 25 bp, Rattus norvegicus
ctgtttctctgtaattccgtgtttt

SEQ ID NO: 277590 - DNA, 25 bp, Rattus norvegicus
ctgtttctctgttattccgtgtttt

SEQ ID NO: 277591 - DNA, 25 bp, Rattus norvegicus
ctgtttctgctgcatgtttcttcat

SEQ ID NO: 277592 - DNA, 25 bp, Rattus norvegicus
ctgtttctgctggatgtttcttcat

SEQ ID NO: 277593 - DNA, 25 bp, Rattus norvegicus
ctgtttcttccaaggcgcaaaggta

SEQ ID NO: 277594 - DNA, 25 bp, Rattus norvegicus
ctgtttcttccatggcgcaaaggta

SEQ ID NO: 277595 - DNA, 25 bp, Rattus norvegicus
ctgtttcttcctcaggctcaaatga

SEQ ID NO: 277596 - DNA, 25 bp, Rattus norvegicus
ctgtttcttcctgaggctcaaatga

SEQ ID NO: 277597 - DNA, 25 bp, Rattus norvegicus
ctgtttctttctacaggagagtgat

SEQ ID NO: 277598 - DNA, 25 bp, Rattus norvegicus
ctgtttctttcttcaggagagtgat

SEQ ID NO: 277599 - DNA, 25 bp, Rattus norvegicus
ctgtttctttgcagcgtgtttttaa

SEQ ID NO: 277600 - DNA, 25 bp, Rattus norvegicus
ctgtttctttgctgcgtgtttttaa

SEQ ID NO: 277601 - DNA, 25 bp, Rattus norvegicus
ctgtttgaaataagacgtgccacca

SEQ ID NO: 277602 - DNA, 25 bp, Rattus norvegicus
ctgtttgaaatatgacgtgccacca

SEQ ID NO: 277603 - DNA, 25 bp, Rattus norvegicus
ctgtttgaagatatcctgtgtcctc

SEQ ID NO: 277604 - DNA, 25 bp, Rattus norvegicus
ctgtttgaagatttcctgtgtcctc

SEQ ID NO: 277605 - DNA, 25 bp, Rattus norvegicus
ctgtttgaccagaaacttctgcatg

SEQ ID NO: 277606 - DNA, 25 bp, Rattus norvegicus
ctgtttgaccagtaacttctgcatg

SEQ ID NO: 277607 - DNA, 25 bp, Rattus norvegicus
ctgtttgacctgagagtctctgaca

SEQ ID NO: 277608 - DNA, 25 bp, Rattus norvegicus
ctgtttgacctgtgagtctctgaca

SEQ ID NO: 277609 - DNA, 25 bp, Rattus norvegicus
ctgtttgcagcccaattaatttttt

SEQ ID NO: 277610 - DNA, 25 bp, Rattus norvegicus
ctgtttgcagccgaattaatttttt

SEQ ID NO: 277611 - DNA, 25 bp, Rattus norvegicus
ctgtttgcagttaatgttcttgttc

SEQ ID NO: 277612 - DNA, 25 bp, Rattus norvegicus
ctgtttgcagtttatgttcttgttc

SEQ ID NO: 277613 - DNA, 25 bp, Rattus norvegicus
ctgtttgcatcgagtgtctttagta

SEQ ID NO: 277614 - DNA, 25 bp, Rattus norvegicus
ctgtttgcatcgtgtgtctttagta

SEQ ID NO: 277615 - DNA, 25 bp, Rattus norvegicus
ctgtttgccaagaggagctgctgtt

SEQ ID NO: 277616 - DNA, 25 bp, Rattus norvegicus
ctgtttgccaagtggagctgctgtt

SEQ ID NO: 277617 - DNA, 25 bp, Rattus norvegicus
ctgtttgcctgaatcaagtgtctga

SEQ ID NO: 277618 - DNA, 25 bp, Rattus norvegicus
ctgtttgcctgattcaagtgtctga

SEQ ID NO: 277619 - DNA, 25 bp, Rattus norvegicus
ctgtttgctacaagtcttcctgcca

SEQ ID NO: 277620 - DNA, 25 bp, Rattus norvegicus
ctgtttgctacatgtcttcctgcca

SEQ ID NO: 277621 - DNA, 25 bp, Rattus norvegicus
ctgtttgctcaacctctgcttacaa

SEQ ID NO: 277622 - DNA, 25 bp, Rattus norvegicus
ctgtttgctcaagctctgcttacaa

SEQ ID NO: 277623 - DNA, 25 bp, Rattus norvegicus
ctgtttgctctgctctgaggaggta

SEQ ID NO: 277624 - DNA, 25 bp, Rattus norvegicus
ctgtttgctctggtctgaggaggta

SEQ ID NO: 277625 - DNA, 25 bp, Rattus norvegicus
ctgtttgcttgcagagtggctttct

SEQ ID NO: 277626 - DNA, 25 bp, Rattus norvegicus
ctgtttgcttgctgagtggctttct

SEQ ID NO: 277627 - DNA, 25 bp, Rattus norvegicus
ctgtttgctttgagtgccctgagaa

SEQ ID NO: 277628 - DNA, 25 bp, Rattus norvegicus
ctgtttgctttgatggatggtctta

SEQ ID NO: 277629 - DNA, 25 bp, Rattus norvegicus
ctgtttgctttgtgtgccctgagaa

SEQ ID NO: 277630 - DNA, 25 bp, Rattus norvegicus
ctgtttgctttgttggatggtctta

SEQ ID NO: 277631 - DNA, 25 bp, Rattus norvegicus
ctgtttggcttcctactgcagaaag

SEQ ID NO: 277632 - DNA, 25 bp, Rattus norvegicus
ctgtttggcttcgtactgcagaaag

SEQ ID NO: 277633 - DNA, 25 bp, Rattus norvegicus
ctgtttggtaatctcacttagtgta

SEQ ID NO: 277634 - DNA, 25 bp, Rattus norvegicus
ctgtttggtaatgtcacttagtgta

SEQ ID NO: 277635 - DNA, 25 bp, Rattus norvegicus
ctgtttggtgaaattgcgtttttgg

SEQ ID NO: 277636 - DNA, 25 bp, Rattus norvegicus
ctgtttggtgaatttgcgtttttgg

SEQ ID NO: 277637 - DNA, 25 bp, Rattus norvegicus
ctgtttgtaggtattgtttggcttg

SEQ ID NO: 277638 - DNA, 25 bp, Rattus norvegicus
ctgtttgtaggttttgtttggcttg

SEQ ID NO: 277639 - DNA, 25 bp, Rattus norvegicus
ctgtttgtccggcctcaggaatgtg

SEQ ID NO: 277640 - DNA, 25 bp, Rattus norvegicus
ctgtttgtccgggctcaggaatgtg

SEQ ID NO: 277641 - DNA, 25 bp, Rattus norvegicus
ctgtttgtcttcagctctagctgag

SEQ ID NO: 277642 - DNA, 25 bp, Rattus norvegicus
ctgtttgtcttctgctctagctgag

SEQ ID NO: 277643 - DNA, 25 bp, Rattus norvegicus
ctgtttgtgcagattctccaaggag

SEQ ID NO: 277644 - DNA, 25 bp, Rattus norvegicus
ctgtttgtgcagtttctccaaggag

SEQ ID NO: 277645 - DNA, 25 bp, Rattus norvegicus
ctgtttgtgtgtctcttaaaaggaa

SEQ ID NO: 277646 - DNA, 25 bp, Rattus norvegicus
ctgtttgtgtgtgtcttaaaaggaa

SEQ ID NO: 277647 - DNA, 25 bp, Rattus norvegicus
ctgttttaagatctgcacgtgtgcc

SEQ ID NO: 277648 - DNA, 25 bp, Rattus norvegicus
ctgttttaagatgtgcacgtgtgcc

SEQ ID NO: 277649 - DNA, 25 bp, Rattus norvegicus
ctgttttaagtcatgctggcactgt

SEQ ID NO: 277650 - DNA, 25 bp, Rattus norvegicus
ctgttttaagtcttgctggcactgt

SEQ ID NO: 277651 - DNA, 25 bp, Rattus norvegicus
ctgttttacccaccagagattgtag

SEQ ID NO: 277652 - DNA, 25 bp, Rattus norvegicus
ctgttttacccagcagagattgtag

SEQ ID NO: 277653 - DNA, 25 bp, Rattus norvegicus
ctgttttactacagaagagcttcca

SEQ ID NO: 277654 - DNA, 25 bp, Rattus norvegicus
ctgttttactactgaagagcttcca

SEQ ID NO: 277655 - DNA, 25 bp, Rattus norvegicus
ctgttttactttcttgcttttctgg

SEQ ID NO: 277656 - DNA, 25 bp, Rattus norvegicus
ctgttttactttgttgcttttctgg

SEQ ID NO: 277657 - DNA, 25 bp, Rattus norvegicus
ctgttttcagtcagtgggtctctgt

SEQ ID NO: 277658 - DNA, 25 bp, Rattus norvegicus
ctgttttcagtctgtgggtctctgt

SEQ ID NO: 277659 - DNA, 25 bp, Rattus norvegicus
ctgttttcatgtcatgcctgagcac

SEQ ID NO: 277660 - DNA, 25 bp, Rattus norvegicus
ctgttttcatgtgatgcctgagcac

SEQ ID NO: 277661 - DNA, 25 bp, Rattus norvegicus
ctgttttccactctgcaagctgaga

SEQ ID NO: 277662 - DNA, 25 bp, Rattus norvegicus
ctgttttccactgtgcaagctgaga

SEQ ID NO: 277663 - DNA, 25 bp, Rattus norvegicus
ctgttttccattattctgcctttga

SEQ ID NO: 277664 - DNA, 25 bp, Rattus norvegicus
ctgttttccatttttctgcctttga

SEQ ID NO: 277665 - DNA, 25 bp, Rattus norvegicus
ctgttttccttaaggctttacggtg

SEQ ID NO: 277666 - DNA, 25 bp, Rattus norvegicus
ctgttttccttatggctttacggtg

SEQ ID NO: 277667 - DNA, 25 bp, Rattus norvegicus
ctgttttctgttcatggtggctgcc

SEQ ID NO: 277668 - DNA, 25 bp, Rattus norvegicus
ctgttttctgttgatggtggctgcc

SEQ ID NO: 277669 - DNA, 25 bp, Rattus norvegicus
ctgttttcttttcttcattttggtg

SEQ ID NO: 277670 - DNA, 25 bp, Rattus norvegicus
ctgttttcttttgttcattttggtg

SEQ ID NO: 277671 - DNA, 25 bp, Rattus norvegicus
ctgttttgaaagcttacccaagaga

SEQ ID NO: 277672 - DNA, 25 bp, Rattus norvegicus
ctgttttgaaaggttacccaagaga

SEQ ID NO: 277673 - DNA, 25 bp, Rattus norvegicus
ctgttttgccctcctatactaaata

SEQ ID NO: 277674 - DNA, 25 bp, Rattus norvegicus
ctgttttgccctgctatactaaata

SEQ ID NO: 277675 - DNA, 25 bp, Rattus norvegicus
ctgttttgccggctcagaaaaaatg

SEQ ID NO: 277676 - DNA, 25 bp, Rattus norvegicus
ctgttttgccgggtcagaaaaaatg

SEQ ID NO: 277677 - DNA, 25 bp, Rattus norvegicus
ctgttttggctgattactctgctaa

SEQ ID NO: 277678 - DNA, 25 bp, Rattus norvegicus
ctgttttggctgtttactctgctaa

SEQ ID NO: 277679 - DNA, 25 bp, Rattus norvegicus
ctgttttggttgcatctgaataaaa

SEQ ID NO: 277680 - DNA, 25 bp, Rattus norvegicus
ctgttttggttggatctgaataaaa

SEQ ID NO: 277681 - DNA, 25 bp, Rattus norvegicus
ctgtttttaaggaagcgctgtctgt

SEQ ID NO: 277682 - DNA, 25 bp, Rattus norvegicus
ctgtttttaaggtagcgctgtctgt

SEQ ID NO: 277683 - DNA, 25 bp, Rattus norvegicus
ctgtttttccatattgtcattgctg

SEQ ID NO: 277684 - DNA, 25 bp, Rattus norvegicus
ctgtttttccattttgtcattgctg

SEQ ID NO: 277685 - DNA, 25 bp, Rattus norvegicus
cttaaaaacagtccccgtccgtgag

SEQ ID NO: 277686 - DNA, 25 bp, Rattus norvegicus
cttaaaaacagtgcccgtccgtgag

SEQ ID NO: 277687 - DNA, 25 bp, Rattus norvegicus
cttaaaaatttaacccatggcatat

SEQ ID NO: 277688 - DNA, 25 bp, Rattus norvegicus
cttaaaaatttatcccatggcatat

SEQ ID NO: 277689 - DNA, 25 bp, Rattus norvegicus
cttaaacctatgatcctttccaggg

SEQ ID NO: 277690 - DNA, 25 bp, Rattus norvegicus
cttaaacctatgttcctttccaggg

SEQ ID NO: 277691 - DNA, 25 bp, Rattus norvegicus
cttaaacctcggacagtggcaacac

SEQ ID NO: 277692 - DNA, 25 bp, Rattus norvegicus
cttaaacctcggtcagtggcaacac

SEQ ID NO: 277693 - DNA, 25 bp, Rattus norvegicus
cttaaacctttaatcatcgtgactt

SEQ ID NO: 277694 - DNA, 25 bp, Rattus norvegicus
cttaaacctttattcatcgtgactt

SEQ ID NO: 277695 - DNA, 25 bp, Rattus norvegicus
cttaaactaaatatgtctgtggtgt

SEQ ID NO: 277696 - DNA, 25 bp, Rattus norvegicus
cttaaactaaatttgtctgtggtgt

SEQ ID NO: 277697 - DNA, 25 bp, Rattus norvegicus
cttaaacttcatctgcttgcctgga

SEQ ID NO: 277698 - DNA, 25 bp, Rattus norvegicus
cttaaacttcatgtgcttgcctgga

SEQ ID NO: 277699 - DNA, 25 bp, Rattus norvegicus
cttaaagaggccctgatcacaggca

SEQ ID NO: 277700 - DNA, 25 bp, Rattus norvegicus
cttaaagaggccgtgatcacaggca

SEQ ID NO: 277701 - DNA, 25 bp, Rattus norvegicus
cttaaagcatcgagggttgttctgt

SEQ ID NO: 277702 - DNA, 25 bp, Rattus norvegicus
cttaaagcatcgtgggttgttctgt

SEQ ID NO: 277703 - DNA, 25 bp, Rattus norvegicus
cttaaagggagaaggagctatctaa

SEQ ID NO: 277704 - DNA, 25 bp, Rattus norvegicus
cttaaagggagatggagctatctaa

SEQ ID NO: 277705 - DNA, 25 bp, Rattus norvegicus
cttaaagggcatccacatctgcttt

SEQ ID NO: 277706 - DNA, 25 bp, Rattus norvegicus
cttaaagggcatgcacatctgcttt

SEQ ID NO: 277707 - DNA, 25 bp, Rattus norvegicus
cttaaagtcttccacccatacaaga

SEQ ID NO: 277708 - DNA, 25 bp, Rattus norvegicus
cttaaagtcttcgacccatacaaga

SEQ ID NO: 277709 - DNA, 25 bp, Rattus norvegicus
cttaaagtgtttatgaacctggcat

SEQ ID NO: 277710 - DNA, 25 bp, Rattus norvegicus
cttaaagtgtttttgaacctggcat

SEQ ID NO: 277711 - DNA, 25 bp, Rattus norvegicus
cttaaatacgctcccattgactggg

SEQ ID NO: 277712 - DNA, 25 bp, Rattus norvegicus
cttaaatacgctgccattgactggg

SEQ ID NO: 277713 - DNA, 25 bp, Rattus norvegicus
cttaaatcactgaacgggtttctgt

SEQ ID NO: 277714 - DNA, 25 bp, Rattus norvegicus
cttaaatcactgtacgggtttctgt

SEQ ID NO: 277715 - DNA, 25 bp, Rattus norvegicus
cttaaatggtacagggtggcacaat

SEQ ID NO: 277716 - DNA, 25 bp, Rattus norvegicus
cttaaatggtactgggtggcacaat

SEQ ID NO: 277717 - DNA, 25 bp, Rattus norvegicus
cttaaattactgcagctccgtttcc

SEQ ID NO: 277718 - DNA, 25 bp, Rattus norvegicus
cttaaattactggagctccgtttcc

SEQ ID NO: 277719 - DNA, 25 bp, Rattus norvegicus
cttaaattcctgactgcagttcaga

SEQ ID NO: 277720 - DNA, 25 bp, Rattus norvegicus
cttaaattcctgtctgcagttcaga

SEQ ID NO: 277721 - DNA, 25 bp, Rattus norvegicus
cttaacagcacaacaggtccgattt

SEQ ID NO: 277722 - DNA, 25 bp, Rattus norvegicus
cttaacagcacatcaggtccgattt

SEQ ID NO: 277723 - DNA, 25 bp, Rattus norvegicus
cttaacagcgtcacagagaaccagt

SEQ ID NO: 277724 - DNA, 25 bp, Rattus norvegicus
cttaacagcgtctcagagaaccagt

SEQ ID NO: 277725 - DNA, 25 bp, Rattus norvegicus
cttaacagggatatacagtgcaatg

SEQ ID NO: 277726 - DNA, 25 bp, Rattus norvegicus
cttaacagggatttacagtgcaatg

SEQ ID NO: 277727 - DNA, 25 bp, Rattus norvegicus
cttaacagtcctaagttgcccatag

SEQ ID NO: 277728 - DNA, 25 bp, Rattus norvegicus
cttaacagtccttagttgcccatag

SEQ ID NO: 277729 - DNA, 25 bp, Rattus norvegicus
cttaacatttctattacagggctga

SEQ ID NO: 277730 - DNA, 25 bp, Rattus norvegicus
cttaacatttcttttacagggctga

SEQ ID NO: 277731 - DNA, 25 bp, Rattus norvegicus
cttaaccaatgcactgtttcacaca

SEQ ID NO: 277732 - DNA, 25 bp, Rattus norvegicus
cttaaccaatgctctgtttcacaca

SEQ ID NO: 277733 - DNA, 25 bp, Rattus norvegicus
cttaacccacaaccgcctgggtgga

SEQ ID NO: 277734 - DNA, 25 bp, Rattus norvegicus
cttaacccacaagcgcctgggtgga

SEQ ID NO: 277735 - DNA, 25 bp, Rattus norvegicus
cttaaccctgttacaagctgcttgt

SEQ ID NO: 277736 - DNA, 25 bp, Rattus norvegicus
cttaaccctgtttcaagctgcttgt

SEQ ID NO: 277737 - DNA, 25 bp, Rattus norvegicus
cttaacctgtgtcttctagctggaa

SEQ ID NO: 277738 - DNA, 25 bp, Rattus norvegicus
cttaacctgtgtgttctagctggaa

SEQ ID NO: 277739 - DNA, 25 bp, Rattus norvegicus
cttaacgtggtgctgcttctgagca

SEQ ID NO: 277740 - DNA, 25 bp, Rattus norvegicus
cttaacgtggtggtgcttctgagca

SEQ ID NO: 277741 - DNA, 25 bp, Rattus norvegicus
cttaactaagctacccatgttctgg

SEQ ID NO: 277742 - DNA, 25 bp, Rattus norvegicus
cttaactaagcttcccatgttctgg

SEQ ID NO: 277743 - DNA, 25 bp, Rattus norvegicus
cttaactcatagctatacactgtaa

SEQ ID NO: 277744 - DNA, 25 bp, Rattus norvegicus
cttaactcataggtatacactgtaa

SEQ ID NO: 277745 - DNA, 25 bp, Rattus norvegicus
cttaactctgaaaccttgctcttac

SEQ ID NO: 277746 - DNA, 25 bp, Rattus norvegicus
cttaactctgaatccttgctcttac

SEQ ID NO: 277747 - DNA, 25 bp, Rattus norvegicus
cttaactgttgcctgagtacacaat

SEQ ID NO: 277748 - DNA, 25 bp, Rattus norvegicus
cttaactgttgcgtgagtacacaat

SEQ ID NO: 277749 - DNA, 25 bp, Rattus norvegicus
cttaacttcctacatgctgttcaac

SEQ ID NO: 277750 - DNA, 25 bp, Rattus norvegicus
cttaacttcctagatgctgttcaac

SEQ ID NO: 277751 - DNA, 25 bp, Rattus norvegicus
cttaacttcctgcttctttctagaa

SEQ ID NO: 277752 - DNA, 25 bp, Rattus norvegicus
cttaacttcctggttctttctagaa

SEQ ID NO: 277753 - DNA, 25 bp, Rattus norvegicus
cttaacttggttatatgtgtgcttc

SEQ ID NO: 277754 - DNA, 25 bp, Rattus norvegicus
cttaacttggttttatgtgtgcttc

SEQ ID NO: 277755 - DNA, 25 bp, Rattus norvegicus
cttaacttgtaacgtgcttcttgga

SEQ ID NO: 277756 - DNA, 25 bp, Rattus norvegicus
cttaacttgtaaggtgcttcttgga

SEQ ID NO: 277757 - DNA, 25 bp, Rattus norvegicus
cttaagaatactcccggctctttca

SEQ ID NO: 277758 - DNA, 25 bp, Rattus norvegicus
cttaagaatactgccggctctttca

SEQ ID NO: 277759 - DNA, 25 bp, Rattus norvegicus
cttaagacattgaaattgagcacat

SEQ ID NO: 277760 - DNA, 25 bp, Rattus norvegicus
cttaagacattgtaattgagcacat

SEQ ID NO: 277761 - DNA, 25 bp, Rattus norvegicus
cttaagagtacacagggatagacct

SEQ ID NO: 277762 - DNA, 25 bp, Rattus norvegicus
cttaagagtacagagggatagacct

SEQ ID NO: 277763 - DNA, 25 bp, Rattus norvegicus
cttaagagtgccacagtgtcaccag

SEQ ID NO: 277764 - DNA, 25 bp, Rattus norvegicus
cttaagagtgcctcagtgtcaccag

SEQ ID NO: 277765 - DNA, 25 bp, Rattus norvegicus
cttaagagtggtacccacactgggt

SEQ ID NO: 277766 - DNA, 25 bp, Rattus norvegicus
cttaagagtggttcccacactgggt

SEQ ID NO: 277767 - DNA, 25 bp, Rattus norvegicus
cttaagatgtctatgccaggcattt

SEQ ID NO: 277768 - DNA, 25 bp, Rattus norvegicus
cttaagatgtctttgccaggcattt

SEQ ID NO: 277769 - DNA, 25 bp, Rattus norvegicus
cttaagccccttccttctcagtggg

SEQ ID NO: 277770 - DNA, 25 bp, Rattus norvegicus
cttaagccccttgcttctcagtggg

SEQ ID NO: 277771 - DNA, 25 bp, Rattus norvegicus
cttaagcgtttcaaatggcagcaaa

SEQ ID NO: 277772 - DNA, 25 bp, Rattus norvegicus
cttaagcgtttctaatggcagcaaa

SEQ ID NO: 277773 - DNA, 25 bp, Rattus norvegicus
cttaagctcagcatggtgacatatg

SEQ ID NO: 277774 - DNA, 25 bp, Rattus norvegicus
cttaagctcagcttggtgacatatg

SEQ ID NO: 277775 - DNA, 25 bp, Rattus norvegicus
cttaaggaaatgaagggctgtgctg

SEQ ID NO: 277776 - DNA, 25 bp, Rattus norvegicus
cttaaggaaatgtagggctgtgctg

SEQ ID NO: 277777 - DNA, 25 bp, Rattus norvegicus
cttaaggaggctctaattctgctat

SEQ ID NO: 277778 - DNA, 25 bp, Rattus norvegicus
cttaaggaggctgtaattctgctat

SEQ ID NO: 277779 - DNA, 25 bp, Rattus norvegicus
cttaaggcaaggcaaatccatggat

SEQ ID NO: 277780 - DNA, 25 bp, Rattus norvegicus
cttaaggcaagggaaatccatggat

SEQ ID NO: 277781 - DNA, 25 bp, Rattus norvegicus
cttaaggctcacacaacagaacagt

SEQ ID NO: 277782 - DNA, 25 bp, Rattus norvegicus
cttaaggctcactcaacagaacagt

SEQ ID NO: 277783 - DNA, 25 bp, Rattus norvegicus
cttaagtattctatgctgttctgga

SEQ ID NO: 277784 - DNA, 25 bp, Rattus norvegicus
cttaagtattctttgctgttctgga

SEQ ID NO: 277785 - DNA, 25 bp, Rattus norvegicus
cttaagtgccgacccatttcaccag

SEQ ID NO: 277786 - DNA, 25 bp, Rattus norvegicus
cttaagtgccgagccatttcaccag

SEQ ID NO: 277787 - DNA, 25 bp, Rattus norvegicus
cttaataactcgaggcttctggctt

SEQ ID NO: 277788 - DNA, 25 bp, Rattus norvegicus
cttaataactcgtggcttctggctt

SEQ ID NO: 277789 - DNA, 25 bp, Rattus norvegicus
cttaatactcctatctgctgttaca

SEQ ID NO: 277790 - DNA, 25 bp, Rattus norvegicus
cttaatactcctttctgctgttaca

SEQ ID NO: 277791 - DNA, 25 bp, Rattus norvegicus
cttaatcaccgacctttttgtccag

SEQ ID NO: 277792 - DNA, 25 bp, Rattus norvegicus
cttaatcaccgagctttttgtccag

SEQ ID NO: 277793 - DNA, 25 bp, Rattus norvegicus
cttaatccctacctgtactgcctgg

SEQ ID NO: 277794 - DNA, 25 bp, Rattus norvegicus
cttaatccctacgtgtactgcctgg

SEQ ID NO: 277795 - DNA, 25 bp, Rattus norvegicus
cttaatcggctgcataatcgggcgc

SEQ ID NO: 277796 - DNA, 25 bp, Rattus norvegicus
cttaatcggctggataatcgggcgc

SEQ ID NO: 277797 - DNA, 25 bp, Rattus norvegicus
cttaatctgggcacttgggaatcag

SEQ ID NO: 277798 - DNA, 25 bp, Rattus norvegicus
cttaatctgggctcttgggaatcag

SEQ ID NO: 277799 - DNA, 25 bp, Rattus norvegicus
cttaatctgtgaaaataccttggca

SEQ ID NO: 277800 - DNA, 25 bp, Rattus norvegicus
cttaatctgtgataataccttggca

SEQ ID NO: 277801 - DNA, 25 bp, Rattus norvegicus
cttaatctttctcctttctatctga

SEQ ID NO: 277802 - DNA, 25 bp, Rattus norvegicus
cttaatctttctgctttctatctga

SEQ ID NO: 277803 - DNA, 25 bp, Rattus norvegicus
cttaatgcagagaggaacacgttta

SEQ ID NO: 277804 - DNA, 25 bp, Rattus norvegicus
cttaatgcagagtggaacacgttta

SEQ ID NO: 277805 - DNA, 25 bp, Rattus norvegicus
cttaatggtcataaagctagctctt

SEQ ID NO: 277806 - DNA, 25 bp, Rattus norvegicus
cttaatggtcattaagctagctctt

SEQ ID NO: 277807 - DNA, 25 bp, Rattus norvegicus
cttaatggttaaatctccacgtagt

SEQ ID NO: 277808 - DNA, 25 bp, Rattus norvegicus
cttaatggttaattctccacgtagt

SEQ ID NO: 277809 - DNA, 25 bp, Rattus norvegicus
cttaatgtgacaaagccatgggcat

SEQ ID NO: 277810 - DNA, 25 bp, Rattus norvegicus
cttaatgtgacatagccatgggcat

SEQ ID NO: 277811 - DNA, 25 bp, Rattus norvegicus
cttaatgtgtggattatctgtctaa

SEQ ID NO: 277812 - DNA, 25 bp, Rattus norvegicus
cttaatgtgtggtttatctgtctaa

SEQ ID NO: 277813 - DNA, 25 bp, Rattus norvegicus
cttaattatcctcacgacagcagtc

SEQ ID NO: 277814 - DNA, 25 bp, Rattus norvegicus
cttaattatcctgacgacagcagtc

SEQ ID NO: 277815 - DNA, 25 bp, Rattus norvegicus
cttaattctcggagtttagtagcat

SEQ ID NO: 277816 - DNA, 25 bp, Rattus norvegicus
cttaattctcggtgtttagtagcat

SEQ ID NO: 277817 - DNA, 25 bp, Rattus norvegicus
cttaattctcttagtcatgcactga

SEQ ID NO: 277818 - DNA, 25 bp, Rattus norvegicus
cttaattctctttgtcatgcactga

SEQ ID NO: 277819 - DNA, 25 bp, Rattus norvegicus
cttaattctgggatgcttgttttat

SEQ ID NO: 277820 - DNA, 25 bp, Rattus norvegicus
cttaattctgggttgcttgttttat

SEQ ID NO: 277821 - DNA, 25 bp, Rattus norvegicus
cttaatttctctctggcatttgcca

SEQ ID NO: 277822 - DNA, 25 bp, Rattus norvegicus
cttaatttctctgtggcatttgcca

SEQ ID NO: 277823 - DNA, 25 bp, Rattus norvegicus
cttacaaactctagggctttctggg

SEQ ID NO: 277824 - DNA, 25 bp, Rattus norvegicus
cttacaaactcttgggctttctggg

SEQ ID NO: 277825 - DNA, 25 bp, Rattus norvegicus
cttacaaggtgaagacagtcggaga

SEQ ID NO: 277826 - DNA, 25 bp, Rattus norvegicus
cttacaaggtgatgacagtcggaga

SEQ ID NO: 277827 - DNA, 25 bp, Rattus norvegicus
cttacaatgtcactttccatctggg

SEQ ID NO: 277828 - DNA, 25 bp, Rattus norvegicus
cttacaatgtcagtttccatctggg

SEQ ID NO: 277829 - DNA, 25 bp, Rattus norvegicus
cttacacaccttagggaacattgag

SEQ ID NO: 277830 - DNA, 25 bp, Rattus norvegicus
cttacacacctttgggaacattgag

SEQ ID NO: 277831 - DNA, 25 bp, Rattus norvegicus
cttacacacgccatacttggtgtat

SEQ ID NO: 277832 - DNA, 25 bp, Rattus norvegicus
cttacacacgccttacttggtgtat

SEQ ID NO: 277833 - DNA, 25 bp, Rattus norvegicus
cttacaccaactacaggcgctgtga

SEQ ID NO: 277834 - DNA, 25 bp, Rattus norvegicus
cttacaccaacttcaggcgctgtga

SEQ ID NO: 277835 - DNA, 25 bp, Rattus norvegicus
cttacaccttcgcagaacccacttc

SEQ ID NO: 277836 - DNA, 25 bp, Rattus norvegicus
cttacaccttcggagaacccacttc

SEQ ID NO: 277837 - DNA, 25 bp, Rattus norvegicus
cttacactccttactgtgatcacag

SEQ ID NO: 277838 - DNA, 25 bp, Rattus norvegicus
cttacactcctttctgtgatcacag

SEQ ID NO: 277839 - DNA, 25 bp, Rattus norvegicus
cttacactggttagggtttcattat

SEQ ID NO: 277840 - DNA, 25 bp, Rattus norvegicus
cttacactggtttgggtttcattat

SEQ ID NO: 277841 - DNA, 25 bp, Rattus norvegicus
cttacacttagcaccacgagtaact

SEQ ID NO: 277842 - DNA, 25 bp, Rattus norvegicus
cttacacttagctccacgagtaact

SEQ ID NO: 277843 - DNA, 25 bp, Rattus norvegicus
cttacagctgcgataccttggaaaa

SEQ ID NO: 277844 - DNA, 25 bp, Rattus norvegicus
cttacagctgcgttaccttggaaaa

SEQ ID NO: 277845 - DNA, 25 bp, Rattus norvegicus
cttacagggataacagactgactta

SEQ ID NO: 277846 - DNA, 25 bp, Rattus norvegicus
cttacagggatatcagactgactta

SEQ ID NO: 277847 - DNA, 25 bp, Rattus norvegicus
cttacagtacctccgaacctcagag

SEQ ID NO: 277848 - DNA, 25 bp, Rattus norvegicus
cttacagtacctgcgaacctcagag

SEQ ID NO: 277849 - DNA, 25 bp, Rattus norvegicus
cttacagtcatcactcactcgtgga

SEQ ID NO: 277850 - DNA, 25 bp, Rattus norvegicus
cttacagtcatctctcactcgtgga

SEQ ID NO: 277851 - DNA, 25 bp, Rattus norvegicus
cttacagttcacatcaatcattgga

SEQ ID NO: 277852 - DNA, 25 bp, Rattus norvegicus
cttacagttcacttcaatcattgga

SEQ ID NO: 277853 - DNA, 25 bp, Rattus norvegicus
cttacagtttacagtttggtcacct

SEQ ID NO: 277854 - DNA, 25 bp, Rattus norvegicus
cttacagtttactgtttggtcacct

SEQ ID NO: 277855 - DNA, 25 bp, Rattus norvegicus
cttacataaatcactgtgtgacagg

SEQ ID NO: 277856 - DNA, 25 bp, Rattus norvegicus
cttacataaatctctgtgtgacagg

SEQ ID NO: 277857 - DNA, 25 bp, Rattus norvegicus
cttacatccgctacattacacattt

SEQ ID NO: 277858 - DNA, 25 bp, Rattus norvegicus
cttacatccgcttcattacacattt

SEQ ID NO: 277859 - DNA, 25 bp, Rattus norvegicus
cttacatgccttacttatgcagact

SEQ ID NO: 277860 - DNA, 25 bp, Rattus norvegicus
cttacatgcctttcttatgcagact

SEQ ID NO: 277861 - DNA, 25 bp, Rattus norvegicus
cttacatttgccaaacattttgcca

SEQ ID NO: 277862 - DNA, 25 bp, Rattus norvegicus
cttacatttgcctaacattttgcca

SEQ ID NO: 277863 - DNA, 25 bp, Rattus norvegicus
cttaccacttctatctaggttctat

SEQ ID NO: 277864 - DNA, 25 bp, Rattus norvegicus
cttaccacttctttctaggttctat

SEQ ID NO: 277865 - DNA, 25 bp, Rattus norvegicus
cttaccataggacaaggccctgctt

SEQ ID NO: 277866 - DNA, 25 bp, Rattus norvegicus
cttaccataggagaaggccctgctt

SEQ ID NO: 277867 - DNA, 25 bp, Rattus norvegicus
cttaccatctctactgtggttcttt

SEQ ID NO: 277868 - DNA, 25 bp, Rattus norvegicus
cttaccatctcttctgtggttcttt

SEQ ID NO: 277869 - DNA, 25 bp, Rattus norvegicus
cttaccatgggcatcactgtataaa

SEQ ID NO: 277870 - DNA, 25 bp, Rattus norvegicus
cttaccatgggcttcactgtataaa

SEQ ID NO: 277871 - DNA, 25 bp, Rattus norvegicus
cttaccatggttcacactgtttcag

SEQ ID NO: 277872 - DNA, 25 bp, Rattus norvegicus
cttaccatggttgacactgtttcag

SEQ ID NO: 277873 - DNA, 25 bp, Rattus norvegicus
cttaccattactccacttatcttaa

SEQ ID NO: 277874 - DNA, 25 bp, Rattus norvegicus
cttaccattactgcacttatcttaa

SEQ ID NO: 277875 - DNA, 25 bp, Rattus norvegicus
cttaccatttccctcatagttagtg

SEQ ID NO: 277876 - DNA, 25 bp, Rattus norvegicus
cttaccatttccgtcatagttagtg

SEQ ID NO: 277877 - DNA, 25 bp, Rattus norvegicus
cttacccacgtgacattgcacatgg

SEQ ID NO: 277878 - DNA, 25 bp, Rattus norvegicus
cttacccacgtgtcattgcacatgg

SEQ ID NO: 277879 - DNA, 25 bp, Rattus norvegicus
cttacccactcaacaccaaggagga

SEQ ID NO: 277880 - DNA, 25 bp, Rattus norvegicus
cttacccactcatcaccaaggagga

SEQ ID NO: 277881 - DNA, 25 bp, Rattus norvegicus
cttacccaggtgacttttaacaatg

SEQ ID NO: 277882 - DNA, 25 bp, Rattus norvegicus
cttacccaggtgtcttttaacaatg

SEQ ID NO: 277883 - DNA, 25 bp, Rattus norvegicus
cttaccccatggaaggaacatagcg

SEQ ID NO: 277884 - DNA, 25 bp, Rattus norvegicus
cttaccccatggtaggaacatagcg

SEQ ID NO: 277885 - DNA, 25 bp, Rattus norvegicus
cttaccctacaactgccttgaatat

SEQ ID NO: 277886 - DNA, 25 bp, Rattus norvegicus
cttaccctacaagtgccttgaatat

SEQ ID NO: 277887 - DNA, 25 bp, Rattus norvegicus
cttaccgtagcacctcatcaaggag

SEQ ID NO: 277888 - DNA, 25 bp, Rattus norvegicus
cttaccgtagcagctcatcaaggag

SEQ ID NO: 277889 - DNA, 25 bp, Rattus norvegicus
cttaccgtgcggagtgttcagatca

SEQ ID NO: 277890 - DNA, 25 bp, Rattus norvegicus
cttaccgtgcggtgtgttcagatca

SEQ ID NO: 277891 - DNA, 25 bp, Rattus norvegicus
cttaccgtgtatcccgctgctgagg

SEQ ID NO: 277892 - DNA, 25 bp, Rattus norvegicus
cttaccgtgtatgccgctgctgagg

SEQ ID NO: 277893 - DNA, 25 bp, Rattus norvegicus
cttacctccgtcatgctattttgaa

SEQ ID NO: 277894 - DNA, 25 bp, Rattus norvegicus
cttacctccgtcttgctattttgaa

SEQ ID NO: 277895 - DNA, 25 bp, Rattus norvegicus
cttacctctcttagtgatcagtgtt

SEQ ID NO: 277896 - DNA, 25 bp, Rattus norvegicus
cttacctctctttgtgatcagtgtt

SEQ ID NO: 277897 - DNA, 25 bp, Rattus norvegicus
cttacctggtctaggtatctaattc

SEQ ID NO: 277898 - DNA, 25 bp, Rattus norvegicus
cttacctggtcttggtatctaattc

SEQ ID NO: 277899 - DNA, 25 bp, Rattus norvegicus
cttacctgtcagacacatctggtga

SEQ ID NO: 277900 - DNA, 25 bp, Rattus norvegicus
cttacctgtcagtcacatctggtga

SEQ ID NO: 277901 - DNA, 25 bp, Rattus norvegicus
cttacctgtggtccctggagaatca

SEQ ID NO: 277902 - DNA, 25 bp, Rattus norvegicus
cttacctgtggtgcctggagaatca

SEQ ID NO: 277903 - DNA, 25 bp, Rattus norvegicus
cttacctgttttacctccaagtatg

SEQ ID NO: 277904 - DNA, 25 bp, Rattus norvegicus
cttacctgtttttcctccaagtatg

SEQ ID NO: 277905 - DNA, 25 bp, Rattus norvegicus
cttaccttaaagatcatgggagctt

SEQ ID NO: 277906 - DNA, 25 bp, Rattus norvegicus
cttaccttaaagttcatgggagctt

SEQ ID NO: 277907 - DNA, 25 bp, Rattus norvegicus
cttaccttactcagcaacactgaga

SEQ ID NO: 277908 - DNA, 25 bp, Rattus norvegicus
cttaccttactctgcaacactgaga

SEQ ID NO: 277909 - DNA, 25 bp, Rattus norvegicus
cttaccttctgtatgtcccatggaa

SEQ ID NO: 277910 - DNA, 25 bp, Rattus norvegicus
cttaccttctgtttgtcccatggaa

SEQ ID NO: 277911 - DNA, 25 bp, Rattus norvegicus
cttaccttgattatcgggccaacag

SEQ ID NO: 277912 - DNA, 25 bp, Rattus norvegicus
cttaccttgattttcgggccaacag

SEQ ID NO: 277913 - DNA, 25 bp, Rattus norvegicus
cttaccttggaaactgactcagcct

SEQ ID NO: 277914 - DNA, 25 bp, Rattus norvegicus
cttaccttggaatctgactcagcct

SEQ ID NO: 277915 - DNA, 25 bp, Rattus norvegicus
cttacgaaatagatgcctcaggcat

SEQ ID NO: 277916 - DNA, 25 bp, Rattus norvegicus
cttacgaaatagttgcctcaggcat

SEQ ID NO: 277917 - DNA, 25 bp, Rattus norvegicus
cttacgatgcttagtgagtgccact

SEQ ID NO: 277918 - DNA, 25 bp, Rattus norvegicus
cttacgatgctttgtgagtgccact

SEQ ID NO: 277919 - DNA, 25 bp, Rattus norvegicus
cttacgccgaaacccgagtagtgtg

SEQ ID NO: 277920 - DNA, 25 bp, Rattus norvegicus
cttacgccgaaagccgagtagtgtg

SEQ ID NO: 277921 - DNA, 25 bp, Rattus norvegicus
cttacgcctcacaccaagggaagga

SEQ ID NO: 277922 - DNA, 25 bp, Rattus norvegicus
cttacgcctcactccaagggaagga

SEQ ID NO: 277923 - DNA, 25 bp, Rattus norvegicus
cttacgctctgcaggtgcttggaaa

SEQ ID NO: 277924 - DNA, 25 bp, Rattus norvegicus
cttacgctctgctggtgcttggaaa

SEQ ID NO: 277925 - DNA, 25 bp, Rattus norvegicus
cttacgctggaaaaggaactgactc

SEQ ID NO: 277926 - DNA, 25 bp, Rattus norvegicus
cttacgctggaataggaactgactc

SEQ ID NO: 277927 - DNA, 25 bp, Rattus norvegicus
cttacggctggcagctattgaataa

SEQ ID NO: 277928 - DNA, 25 bp, Rattus norvegicus
cttacggctggctgctattgaataa

SEQ ID NO: 277929 - DNA, 25 bp, Rattus norvegicus
cttacgtgctcaatgggacccagat

SEQ ID NO: 277930 - DNA, 25 bp, Rattus norvegicus
cttacgtgctcattgggacccagat

SEQ ID NO: 277931 - DNA, 25 bp, Rattus norvegicus
cttactatgtggattctctgattct

SEQ ID NO: 277932 - DNA, 25 bp, Rattus norvegicus
cttactatgtggtttctctgattct

SEQ ID NO: 277933 - DNA, 25 bp, Rattus norvegicus
cttactattcagcttttattccaaa

SEQ ID NO: 277934 - DNA, 25 bp, Rattus norvegicus
cttactattcaggttttattccaaa

SEQ ID NO: 277935 - DNA, 25 bp, Rattus norvegicus
cttactcagctgatctgtctgtgga

SEQ ID NO: 277936 - DNA, 25 bp, Rattus norvegicus
cttactcagctgttctgtctgtgga

SEQ ID NO: 277937 - DNA, 25 bp, Rattus norvegicus
cttactcaggctatgtggttttcga

SEQ ID NO: 277938 - DNA, 25 bp, Rattus norvegicus
cttactcaggctttgtggttttcga

SEQ ID NO: 277939 - DNA, 25 bp, Rattus norvegicus
cttactccaccaccaggaagaagat

SEQ ID NO: 277940 - DNA, 25 bp, Rattus norvegicus
cttactccaccagcaggaagaagat

SEQ ID NO: 277941 - DNA, 25 bp, Rattus norvegicus
cttactccttttccacatcatatga

SEQ ID NO: 277942 - DNA, 25 bp, Rattus norvegicus
cttactccttttgcacatcatatga

SEQ ID NO: 277943 - DNA, 25 bp, Rattus norvegicus
cttactcgtagtcgcggaagatctc

SEQ ID NO: 277944 - DNA, 25 bp, Rattus norvegicus
cttactcgtagtggcggaagatctc

SEQ ID NO: 277945 - DNA, 25 bp, Rattus norvegicus
cttactctccgcagttttatcatga

SEQ ID NO: 277946 - DNA, 25 bp, Rattus norvegicus
cttactctccgctgttttatcatga

SEQ ID NO: 277947 - DNA, 25 bp, Rattus norvegicus
cttactctggctacttcatacatgt

SEQ ID NO: 277948 - DNA, 25 bp, Rattus norvegicus
cttactctggcttcttcatacatgt

SEQ ID NO: 277949 - DNA, 25 bp, Rattus norvegicus
cttactctttctccagtttcaggaa

SEQ ID NO: 277950 - DNA, 25 bp, Rattus norvegicus
cttactctttctgcagtttcaggaa

SEQ ID NO: 277951 - DNA, 25 bp, Rattus norvegicus
cttactgacgtgagtggatttctac

SEQ ID NO: 277952 - DNA, 25 bp, Rattus norvegicus
cttactgacgtgtgtggatttctac

SEQ ID NO: 277953 - DNA, 25 bp, Rattus norvegicus
cttactgaggagatatctttgggat

SEQ ID NO: 277954 - DNA, 25 bp, Rattus norvegicus
cttactgaggagttatctttgggat

SEQ ID NO: 277955 - DNA, 25 bp, Rattus norvegicus
cttactgcaaccatctttgaaggtt

SEQ ID NO: 277956 - DNA, 25 bp, Rattus norvegicus
cttactgcaaccttctttgaaggtt

SEQ ID NO: 277957 - DNA, 25 bp, Rattus norvegicus
cttactgcaataactcgtgagcctc

SEQ ID NO: 277958 - DNA, 25 bp, Rattus norvegicus
cttactgcaatatctcgtgagcctc

SEQ ID NO: 277959 - DNA, 25 bp, Rattus norvegicus
cttactgctataccttggtcacgac

SEQ ID NO: 277960 - DNA, 25 bp, Rattus norvegicus
cttactgctatagcttggtcacgac

SEQ ID NO: 277961 - DNA, 25 bp, Rattus norvegicus
cttactgggctgacatcagcaccat

SEQ ID NO: 277962 - DNA, 25 bp, Rattus norvegicus
cttactgggctgtcatcagcaccat

SEQ ID NO: 277963 - DNA, 25 bp, Rattus norvegicus
cttactggtctcatttgcttgtcta

SEQ ID NO: 277964 - DNA, 25 bp, Rattus norvegicus
cttactggtctcttttgcttgtcta

SEQ ID NO: 277965 - DNA, 25 bp, Rattus norvegicus
cttactggtgtaatgtgggtactca

SEQ ID NO: 277966 - DNA, 25 bp, Rattus norvegicus
cttactggtgtacaaattaatgcct

SEQ ID NO: 277967 - DNA, 25 bp, Rattus norvegicus
cttactggtgtagaaattaatgcct

SEQ ID NO: 277968 - DNA, 25 bp, Rattus norvegicus
cttactggtgtattgtgggtactca

SEQ ID NO: 277969 - DNA, 25 bp, Rattus norvegicus
cttactgtaagtctcctggtttatt

SEQ ID NO: 277970 - DNA, 25 bp, Rattus norvegicus
cttactgtaagtgtcctggtttatt

SEQ ID NO: 277971 - DNA, 25 bp, Rattus norvegicus
cttactgtccttagggtctttggtg

SEQ ID NO: 277972 - DNA, 25 bp, Rattus norvegicus
cttactgtcctttgggtctttggtg

SEQ ID NO: 277973 - DNA, 25 bp, Rattus norvegicus
cttactgtcttgaagcaacagggca

SEQ ID NO: 277974 - DNA, 25 bp, Rattus norvegicus
cttactgtcttgtagcaacagggca

SEQ ID NO: 277975 - DNA, 25 bp, Rattus norvegicus
cttactgtggtcctggcagcctgga

SEQ ID NO: 277976 - DNA, 25 bp, Rattus norvegicus
cttactgtggtcgtggcagcctgga

SEQ ID NO: 277977 - DNA, 25 bp, Rattus norvegicus
cttactgtgtttagtgaattgccca

SEQ ID NO: 277978 - DNA, 25 bp, Rattus norvegicus
cttactgtgttttgtgaattgccca

SEQ ID NO: 277979 - DNA, 25 bp, Rattus norvegicus
cttactgttaaaagtaggtgctggg

SEQ ID NO: 277980 - DNA, 25 bp, Rattus norvegicus
cttactgttaaatgtaggtgctggg

SEQ ID NO: 277981 - DNA, 25 bp, Rattus norvegicus
cttactgttatgactggctgggtta

SEQ ID NO: 277982 - DNA, 25 bp, Rattus norvegicus
cttactgttatgtctggctgggtta

SEQ ID NO: 277983 - DNA, 25 bp, Rattus norvegicus
cttactgttccacccaggaggagga

SEQ ID NO: 277984 - DNA, 25 bp, Rattus norvegicus
cttactgttccagccaggaggagga

SEQ ID NO: 277985 - DNA, 25 bp, Rattus norvegicus
cttactgttgatagtgtgtgcattt

SEQ ID NO: 277986 - DNA, 25 bp, Rattus norvegicus
cttactgttgattgtgtgtgcattt

SEQ ID NO: 277987 - DNA, 25 bp, Rattus norvegicus
cttacttactctactcgttaaacag

SEQ ID NO: 277988 - DNA, 25 bp, Rattus norvegicus
cttacttactcttctcgttaaacag

SEQ ID NO: 277989 - DNA, 25 bp, Rattus norvegicus
cttacttatattcctgcttcttttc

SEQ ID NO: 277990 - DNA, 25 bp, Rattus norvegicus
cttacttatattgctgcttcttttc

SEQ ID NO: 277991 - DNA, 25 bp, Rattus norvegicus
cttacttcagggatttttgttcttg

SEQ ID NO: 277992 - DNA, 25 bp, Rattus norvegicus
cttacttcagggttttttgttcttg

SEQ ID NO: 277993 - DNA, 25 bp, Rattus norvegicus
cttacttgacttcaatgtgcaccca

SEQ ID NO: 277994 - DNA, 25 bp, Rattus norvegicus
cttacttgacttgaatgtgcaccca

SEQ ID NO: 277995 - DNA, 25 bp, Rattus norvegicus
cttacttgctccatggtctctttat

SEQ ID NO: 277996 - DNA, 25 bp, Rattus norvegicus
cttacttgctccttggtctctttat

SEQ ID NO: 277997 - DNA, 25 bp, Rattus norvegicus
cttacttgggaaaatactgggctat

SEQ ID NO: 277998 - DNA, 25 bp, Rattus norvegicus
cttacttgggaatatactgggctat

SEQ ID NO: 277999 - DNA, 25 bp, Rattus norvegicus
cttacttgggcaaatctctgctggc

SEQ ID NO: 278000 - DNA, 25 bp, Rattus norvegicus
cttacttgggcatatctctgctggc

SEQ ID NO: 278001 - DNA, 25 bp, Rattus norvegicus
cttactttacatcccctatacttga

SEQ ID NO: 278002 - DNA, 25 bp, Rattus norvegicus
cttactttacatgccctatacttga

SEQ ID NO: 278003 - DNA, 25 bp, Rattus norvegicus
cttactttggagacagcctggtcta

SEQ ID NO: 278004 - DNA, 25 bp, Rattus norvegicus
cttactttggagtcagcctggtcta

SEQ ID NO: 278005 - DNA, 25 bp, Rattus norvegicus
cttacttttcaacgcagtgtccctg

SEQ ID NO: 278006 - DNA, 25 bp, Rattus norvegicus
cttacttttcaaggcagtgtccctg

SEQ ID NO: 278007 - DNA, 25 bp, Rattus norvegicus
cttagaaccacaaacattacctcac

SEQ ID NO: 278008 - DNA, 25 bp, Rattus norvegicus
cttagaaccacatacattacctcac

SEQ ID NO: 278009 - DNA, 25 bp, Rattus norvegicus
cttagaactagtcaggtgctcctcc

SEQ ID NO: 278010 - DNA, 25 bp, Rattus norvegicus
cttagaactagtgaggtgctcctcc

SEQ ID NO: 278011 - DNA, 25 bp, Rattus norvegicus
cttagaattgctacacctgcacagt

SEQ ID NO: 278012 - DNA, 25 bp, Rattus norvegicus
cttagaattgcttcacctgcacagt

SEQ ID NO: 278013 - DNA, 25 bp, Rattus norvegicus
cttagacagcttccctttgggataa

SEQ ID NO: 278014 - DNA, 25 bp, Rattus norvegicus
cttagacagcttgcctttgggataa

SEQ ID NO: 278015 - DNA, 25 bp, Rattus norvegicus
cttagactttatatccaactccacg

SEQ ID NO: 278016 - DNA, 25 bp, Rattus norvegicus
cttagactttatatgtaaacctgga

SEQ ID NO: 278017 - DNA, 25 bp, Rattus norvegicus
cttagactttatttccaactccacg

SEQ ID NO: 278018 - DNA, 25 bp, Rattus norvegicus
cttagactttatttgtaaacctgga

SEQ ID NO: 278019 - DNA, 25 bp, Rattus norvegicus
cttagagacatcataatgctcatgt

SEQ ID NO: 278020 - DNA, 25 bp, Rattus norvegicus
cttagagacatcttaatgctcatgt

SEQ ID NO: 278021 - DNA, 25 bp, Rattus norvegicus
cttagagaccagagcttctcaacct

SEQ ID NO: 278022 - DNA, 25 bp, Rattus norvegicus
cttagagaccagtgcttctcaacct

SEQ ID NO: 278023 - DNA, 25 bp, Rattus norvegicus
cttagagagcaaatcagttttttct

SEQ ID NO: 278024 - DNA, 25 bp, Rattus norvegicus
cttagagagcaattcagttttttct

SEQ ID NO: 278025 - DNA, 25 bp, Rattus norvegicus
cttagagatcatcgctcgctgcagc

SEQ ID NO: 278026 - DNA, 25 bp, Rattus norvegicus
cttagagatcatggctcgctgcagc

SEQ ID NO: 278027 - DNA, 25 bp, Rattus norvegicus
cttagagctctaaagtgtcactgga

SEQ ID NO: 278028 - DNA, 25 bp, Rattus norvegicus
cttagagctctatagtgtcactgga

SEQ ID NO: 278029 - DNA, 25 bp, Rattus norvegicus
cttagaggacacaggcaaaggccgg

SEQ ID NO: 278030 - DNA, 25 bp, Rattus norvegicus
cttagaggacactggcaaaggccgg

SEQ ID NO: 278031 - DNA, 25 bp, Rattus norvegicus
cttagaggaccaactgtggctggct

SEQ ID NO: 278032 - DNA, 25 bp, Rattus norvegicus
cttagaggaccatctgtggctggct

SEQ ID NO: 278033 - DNA, 25 bp, Rattus norvegicus
cttagagggaccacacagtgccggg

SEQ ID NO: 278034 - DNA, 25 bp, Rattus norvegicus
cttagagggacctcacagtgccggg

SEQ ID NO: 278035 - DNA, 25 bp, Rattus norvegicus
cttagagtatttccattcccactga

SEQ ID NO: 278036 - DNA, 25 bp, Rattus norvegicus
cttagagtatttgcattcccactga

SEQ ID NO: 278037 - DNA, 25 bp, Rattus norvegicus
cttagagtgtggacctttggaaact

SEQ ID NO: 278038 - DNA, 25 bp, Rattus norvegicus
cttagagtgtggtcctttggaaact

SEQ ID NO: 278039 - DNA, 25 bp, Rattus norvegicus
cttagattcatcagcccaggataca

SEQ ID NO: 278040 - DNA, 25 bp, Rattus norvegicus
cttagattcatctgcccaggataca

SEQ ID NO: 278041 - DNA, 25 bp, Rattus norvegicus
cttagcacgctgaccagtgagtgat

SEQ ID NO: 278042 - DNA, 25 bp, Rattus norvegicus
cttagcacgctgtccagtgagtgat

SEQ ID NO: 278043 - DNA, 25 bp, Rattus norvegicus
cttagcactcgcagcaaagttcttt

SEQ ID NO: 278044 - DNA, 25 bp, Rattus norvegicus
cttagcactcgctgcaaagttcttt

SEQ ID NO: 278045 - DNA, 25 bp, Rattus norvegicus
cttagcagtctgattcacattgaga

SEQ ID NO: 278046 - DNA, 25 bp, Rattus norvegicus
cttagcagtctgtttcacattgaga

SEQ ID NO: 278047 - DNA, 25 bp, Rattus norvegicus
cttagcatcatgctgctgccagaga

SEQ ID NO: 278048 - DNA, 25 bp, Rattus norvegicus
cttagcatcatggtgctgccagaga

SEQ ID NO: 278049 - DNA, 25 bp, Rattus norvegicus
cttagcatcctaccctagagcgaat

SEQ ID NO: 278050 - DNA, 25 bp, Rattus norvegicus
cttagcatcctagcctagagcgaat

SEQ ID NO: 278051 - DNA, 25 bp, Rattus norvegicus
cttagcatcctcctcagagtcggaa

SEQ ID NO: 278052 - DNA, 25 bp, Rattus norvegicus
cttagcatcctcgtcagagtcggaa

SEQ ID NO: 278053 - DNA, 25 bp, Rattus norvegicus
cttagcatctttaagcccagacatt

SEQ ID NO: 278054 - DNA, 25 bp, Rattus norvegicus
cttagcatcttttagcccagacatt

SEQ ID NO: 278055 - DNA, 25 bp, Rattus norvegicus
cttagcatttataagcactgtgttg

SEQ ID NO: 278056 - DNA, 25 bp, Rattus norvegicus
cttagcatttattagcactgtgttg

SEQ ID NO: 278057 - DNA, 25 bp, Rattus norvegicus
cttagccaagacatgctgctactgc

SEQ ID NO: 278058 - DNA, 25 bp, Rattus norvegicus
cttagccaagacttgctgctactgc

SEQ ID NO: 278059 - DNA, 25 bp, Rattus norvegicus
cttagccagtctagtgatgtagcct

SEQ ID NO: 278060 - DNA, 25 bp, Rattus norvegicus
cttagccagtcttgtgatgtagcct

SEQ ID NO: 278061 - DNA, 25 bp, Rattus norvegicus
cttagccatcgtcacacatgtggag

SEQ ID NO: 278062 - DNA, 25 bp, Rattus norvegicus
cttagccatcgtgacacatgtggag

SEQ ID NO: 278063 - DNA, 25 bp, Rattus norvegicus
cttagccatgttatctcttttgatc

SEQ ID NO: 278064 - DNA, 25 bp, Rattus norvegicus
cttagccatgttttctcttttgatc

SEQ ID NO: 278065 - DNA, 25 bp, Rattus norvegicus
cttagccatttcctgtgtctgtaat

SEQ ID NO: 278066 - DNA, 25 bp, Rattus norvegicus
cttagccatttcgtgtgtctgtaat

SEQ ID NO: 278067 - DNA, 25 bp, Rattus norvegicus
cttagcctagatagaagttggttaa

SEQ ID NO: 278068 - DNA, 25 bp, Rattus norvegicus
cttagcctagattgaagttggttaa

SEQ ID NO: 278069 - DNA, 25 bp, Rattus norvegicus
cttagcctcactcgagcctggagaa

SEQ ID NO: 278070 - DNA, 25 bp, Rattus norvegicus
cttagcctcactggagcctggagaa

SEQ ID NO: 278071 - DNA, 25 bp, Rattus norvegicus
cttagcctctctaacagcccatggg

SEQ ID NO: 278072 - DNA, 25 bp, Rattus norvegicus
cttagcctctcttacagcccatggg

SEQ ID NO: 278073 - DNA, 25 bp, Rattus norvegicus
cttagccttcatacagtgtgtctta

SEQ ID NO: 278074 - DNA, 25 bp, Rattus norvegicus
cttagccttcatattatgccaatgt

SEQ ID NO: 278075 - DNA, 25 bp, Rattus norvegicus
cttagccttcattcagtgtgtctta

SEQ ID NO: 278076 - DNA, 25 bp, Rattus norvegicus
cttagccttcattttatgccaatgt

SEQ ID NO: 278077 - DNA, 25 bp, Rattus norvegicus
cttagccttggtaatgagactgcga

SEQ ID NO: 278078 - DNA, 25 bp, Rattus norvegicus
cttagccttggttatgagactgcga

SEQ ID NO: 278079 - DNA, 25 bp, Rattus norvegicus
cttagcgataacaatcttctcccac

SEQ ID NO: 278080 - DNA, 25 bp, Rattus norvegicus
cttagcgataactatcttctcccac

SEQ ID NO: 278081 - DNA, 25 bp, Rattus norvegicus
cttagcgccaggcaactctttgact

SEQ ID NO: 278082 - DNA, 25 bp, Rattus norvegicus
cttagcgccagggaactctttgact

SEQ ID NO: 278083 - DNA, 25 bp, Rattus norvegicus
cttagcgcctttcttgtttaacatg

SEQ ID NO: 278084 - DNA, 25 bp, Rattus norvegicus
cttagcgcctttgttgtttaacatg

SEQ ID NO: 278085 - DNA, 25 bp, Rattus norvegicus
cttagctagtttagggattgtgtga

SEQ ID NO: 278086 - DNA, 25 bp, Rattus norvegicus
cttagctagttttgggattgtgtga

SEQ ID NO: 278087 - DNA, 25 bp, Rattus norvegicus
cttagctcacaactgtttgctgtta

SEQ ID NO: 278088 - DNA, 25 bp, Rattus norvegicus
cttagctcacaagtgtttgctgtta

SEQ ID NO: 278089 - DNA, 25 bp, Rattus norvegicus
cttagctgagtcatcaattgtggga

SEQ ID NO: 278090 - DNA, 25 bp, Rattus norvegicus
cttagctgagtcttcaattgtggga

SEQ ID NO: 278091 - DNA, 25 bp, Rattus norvegicus
cttagctgcactccctaaagttgca

SEQ ID NO: 278092 - DNA, 25 bp, Rattus norvegicus
cttagctgcactgcctaaagttgca

SEQ ID NO: 278093 - DNA, 25 bp, Rattus norvegicus
cttagctgggtcctttctagtctgt

SEQ ID NO: 278094 - DNA, 25 bp, Rattus norvegicus
cttagctgggtcgtttctagtctgt

SEQ ID NO: 278095 - DNA, 25 bp, Rattus norvegicus
cttagcttctttactcctgagacag

SEQ ID NO: 278096 - DNA, 25 bp, Rattus norvegicus
cttagcttcttttctcctgagacag

SEQ ID NO: 278097 - DNA, 25 bp, Rattus norvegicus
cttagctttgctctctggtatattt

SEQ ID NO: 278098 - DNA, 25 bp, Rattus norvegicus
cttagctttgctgtctggtatattt

SEQ ID NO: 278099 - DNA, 25 bp, Rattus norvegicus
cttaggacattgaggctgttcccgt

SEQ ID NO: 278100 - DNA, 25 bp, Rattus norvegicus
cttaggacattgtggctgttcccgt

SEQ ID NO: 278101 - DNA, 25 bp, Rattus norvegicus
cttaggactctacgttcagggacaa

SEQ ID NO: 278102 - DNA, 25 bp, Rattus norvegicus
cttaggactctaggttcagggacaa

SEQ ID NO: 278103 - DNA, 25 bp, Rattus norvegicus
cttaggagcaggaggcctggcctct

SEQ ID NO: 278104 - DNA, 25 bp, Rattus norvegicus
cttaggagcaggtggcctggcctct

SEQ ID NO: 278105 - DNA, 25 bp, Rattus norvegicus
cttaggatcatacggtactcctgat

SEQ ID NO: 278106 - DNA, 25 bp, Rattus norvegicus
cttaggatcatagggtactcctgat

SEQ ID NO: 278107 - DNA, 25 bp, Rattus norvegicus
cttaggatgtatcccctcaaaccta

SEQ ID NO: 278108 - DNA, 25 bp, Rattus norvegicus
cttaggatgtatgccctcaaaccta

SEQ ID NO: 278109 - DNA, 25 bp, Rattus norvegicus
cttaggcaaactcttcatggctcag

SEQ ID NO: 278110 - DNA, 25 bp, Rattus norvegicus
cttaggcaaactgttcatggctcag

SEQ ID NO: 278111 - DNA, 25 bp, Rattus norvegicus
cttaggcaggcacgcaagatctcag

SEQ ID NO: 278112 - DNA, 25 bp, Rattus norvegicus
cttaggcaggcaggcaagatctcag

SEQ ID NO: 278113 - DNA, 25 bp, Rattus norvegicus
cttaggcaggccactgggacaccaa

SEQ ID NO: 278114 - DNA, 25 bp, Rattus norvegicus
cttaggcaggcctctgggacaccaa

SEQ ID NO: 278115 - DNA, 25 bp, Rattus norvegicus
cttaggcagtcaaatggtaaagctt

SEQ ID NO: 278116 - DNA, 25 bp, Rattus norvegicus
cttaggcagtcatatggtaaagctt

SEQ ID NO: 278117 - DNA, 25 bp, Rattus norvegicus
cttaggcctctcaggatactattta

SEQ ID NO: 278118 - DNA, 25 bp, Rattus norvegicus
cttaggcctctctggatactattta

SEQ ID NO: 278119 - DNA, 25 bp, Rattus norvegicus
cttaggcgaagacctgcgtggtccc

SEQ ID NO: 278120 - DNA, 25 bp, Rattus norvegicus
cttaggcgaagagctgcgtggtccc

SEQ ID NO: 278121 - DNA, 25 bp, Rattus norvegicus
cttaggctatgcagaggtactccca

SEQ ID NO: 278122 - DNA, 25 bp, Rattus norvegicus
cttaggctatgctgaggtactccca

SEQ ID NO: 278123 - DNA, 25 bp, Rattus norvegicus
cttaggctccttatagaactgcttg

SEQ ID NO: 278124 - DNA, 25 bp, Rattus norvegicus
cttaggctccttttagaactgcttg

SEQ ID NO: 278125 - DNA, 25 bp, Rattus norvegicus
cttaggcttagtattcagggcttgt

SEQ ID NO: 278126 - DNA, 25 bp, Rattus norvegicus
cttaggcttagttttcagggcttgt

SEQ ID NO: 278127 - DNA, 25 bp, Rattus norvegicus
cttaggcttcgaccacagctagcaa

SEQ ID NO: 278128 - DNA, 25 bp, Rattus norvegicus
cttaggcttcgagcacagctagcaa

SEQ ID NO: 278129 - DNA, 25 bp, Rattus norvegicus
cttaggctttcaatccagtttggtt

SEQ ID NO: 278130 - DNA, 25 bp, Rattus norvegicus
cttaggctttcattccagtttggtt

SEQ ID NO: 278131 - DNA, 25 bp, Rattus norvegicus
cttaggctttttcgcgctgggcttc

SEQ ID NO: 278132 - DNA, 25 bp, Rattus norvegicus
cttaggctttttggcgctgggcttc

SEQ ID NO: 278133 - DNA, 25 bp, Rattus norvegicus
cttagggaggcgacttgtctcactg

SEQ ID NO: 278134 - DNA, 25 bp, Rattus norvegicus
cttagggaggcgtcttgtctcactg

SEQ ID NO: 278135 - DNA, 25 bp, Rattus norvegicus
cttagggcagctcttcaggaatctc

SEQ ID NO: 278136 - DNA, 25 bp, Rattus norvegicus
cttagggcagctgttcaggaatctc

SEQ ID NO: 278137 - DNA, 25 bp, Rattus norvegicus
cttagggccatgctgctggacctga

SEQ ID NO: 278138 - DNA, 25 bp, Rattus norvegicus
cttagggccatggtgctggacctga

SEQ ID NO: 278139 - DNA, 25 bp, Rattus norvegicus
cttagggccttcactagttacctga

SEQ ID NO: 278140 - DNA, 25 bp, Rattus norvegicus
cttagggccttctctagttacctga

SEQ ID NO: 278141 - DNA, 25 bp, Rattus norvegicus
cttagggcttttctccagtgtgaat

SEQ ID NO: 278142 - DNA, 25 bp, Rattus norvegicus
cttagggcttttgtccagtgtgaat

SEQ ID NO: 278143 - DNA, 25 bp, Rattus norvegicus
cttagggtaccgctggaggccatca

SEQ ID NO: 278144 - DNA, 25 bp, Rattus norvegicus
cttagggtaccggtggaggccatca

SEQ ID NO: 278145 - DNA, 25 bp, Rattus norvegicus
cttaggtctcttaccctgatctaaa

SEQ ID NO: 278146 - DNA, 25 bp, Rattus norvegicus
cttaggtctctttccctgatctaaa

SEQ ID NO: 278147 - DNA, 25 bp, Rattus norvegicus
cttaggttcagacatgtctgcctct

SEQ ID NO: 278148 - DNA, 25 bp, Rattus norvegicus
cttaggttcagagatgtctgcctct

SEQ ID NO: 278149 - DNA, 25 bp, Rattus norvegicus
cttaggttgttgagtgcatccggga

SEQ ID NO: 278150 - DNA, 25 bp, Rattus norvegicus
cttaggttgttgtgtgcatccggga

SEQ ID NO: 278151 - DNA, 25 bp, Rattus norvegicus
cttaggtttataatagtaggcgagt

SEQ ID NO: 278152 - DNA, 25 bp, Rattus norvegicus
cttaggtttatattagtaggcgagt

SEQ ID NO: 278153 - DNA, 25 bp, Rattus norvegicus
cttagtaaaaccacagtcatctccc

SEQ ID NO: 278154 - DNA, 25 bp, Rattus norvegicus
cttagtaaaacctcagtcatctccc

SEQ ID NO: 278155 - DNA, 25 bp, Rattus norvegicus
cttagtaaggctccctcttttgctg

SEQ ID NO: 278156 - DNA, 25 bp, Rattus norvegicus
cttagtaaggctgcctcttttgctg

SEQ ID NO: 278157 - DNA, 25 bp, Rattus norvegicus
cttagtaagggacctgcatgggaca

SEQ ID NO: 278158 - DNA, 25 bp, Rattus norvegicus
cttagtaagggagctgcatgggaca

SEQ ID NO: 278159 - DNA, 25 bp, Rattus norvegicus
cttagtagtgttactgggttctgca

SEQ ID NO: 278160 - DNA, 25 bp, Rattus norvegicus
cttagtagtgtttctgggttctgca

SEQ ID NO: 278161 - DNA, 25 bp, Rattus norvegicus
cttagtatgtttcctctgtgtgtgc

SEQ ID NO: 278162 - DNA, 25 bp, Rattus norvegicus
cttagtatgtttgctctgtgtgtgc

SEQ ID NO: 278163 - DNA, 25 bp, Rattus norvegicus
cttagtcattctcaggtcgggtgga

SEQ ID NO: 278164 - DNA, 25 bp, Rattus norvegicus
cttagtcattctgaggtcgggtgga

SEQ ID NO: 278165 - DNA, 25 bp, Rattus norvegicus
cttagtccaatgcaggtgtcaccgt

SEQ ID NO: 278166 - DNA, 25 bp, Rattus norvegicus
cttagtccaatggaggtgtcaccgt

SEQ ID NO: 278167 - DNA, 25 bp, Rattus norvegicus
cttagtcctcagaagacaaagttta

SEQ ID NO: 278168 - DNA, 25 bp, Rattus norvegicus
cttagtcctcagtagacaaagttta

SEQ ID NO: 278169 - DNA, 25 bp, Rattus norvegicus
cttagtcctgagctacctgtgagag

SEQ ID NO: 278170 - DNA, 25 bp, Rattus norvegicus
cttagtcctgaggtacctgtgagag

SEQ ID NO: 278171 - DNA, 25 bp, Rattus norvegicus
cttagtctaatgcaggcagtttcat

SEQ ID NO: 278172 - DNA, 25 bp, Rattus norvegicus
cttagtctaatggaggcagtttcat

SEQ ID NO: 278173 - DNA, 25 bp, Rattus norvegicus
cttagtctctgaaggcaggaggcaa

SEQ ID NO: 278174 - DNA, 25 bp, Rattus norvegicus
cttagtctctgaatagcagctggag

SEQ ID NO: 278175 - DNA, 25 bp, Rattus norvegicus
cttagtctctgatggcaggaggcaa

SEQ ID NO: 278176 - DNA, 25 bp, Rattus norvegicus
cttagtctctgattagcagctggag

SEQ ID NO: 278177 - DNA, 25 bp, Rattus norvegicus
cttagtctctttacaatgttcacga

SEQ ID NO: 278178 - DNA, 25 bp, Rattus norvegicus
cttagtctcttttcaatgttcacga

SEQ ID NO: 278179 - DNA, 25 bp, Rattus norvegicus
cttagtcttaagctcctacgttgaa

SEQ ID NO: 278180 - DNA, 25 bp, Rattus norvegicus
cttagtcttaaggtcctacgttgaa

SEQ ID NO: 278181 - DNA, 25 bp, Rattus norvegicus
cttagtcttgaaagccctctgaaat

SEQ ID NO: 278182 - DNA, 25 bp, Rattus norvegicus
cttagtcttgaatgccctctgaaat

SEQ ID NO: 278183 - DNA, 25 bp, Rattus norvegicus
cttagtgaagccctgcatcatagat

SEQ ID NO: 278184 - DNA, 25 bp, Rattus norvegicus
cttagtgaagccgtgcatcatagat

SEQ ID NO: 278185 - DNA, 25 bp, Rattus norvegicus
cttagtgacccacgagataatgagg

SEQ ID NO: 278186 - DNA, 25 bp, Rattus norvegicus
cttagtgacccaggagataatgagg

SEQ ID NO: 278187 - DNA, 25 bp, Rattus norvegicus
cttagtgacctaatttgggagaatc

SEQ ID NO: 278188 - DNA, 25 bp, Rattus norvegicus
cttagtgacctattttgggagaatc

SEQ ID NO: 278189 - DNA, 25 bp, Rattus norvegicus
cttagtgcacaccaagcgtttgttc

SEQ ID NO: 278190 - DNA, 25 bp, Rattus norvegicus
cttagtgcacacgaagcgtttgttc

SEQ ID NO: 278191 - DNA, 25 bp, Rattus norvegicus
cttagtgcactcatgtaggcttaga

SEQ ID NO: 278192 - DNA, 25 bp, Rattus norvegicus
cttagtgcactcttgtaggcttaga

SEQ ID NO: 278193 - DNA, 25 bp, Rattus norvegicus
cttagtgccaaaaagaacatacctt

SEQ ID NO: 278194 - DNA, 25 bp, Rattus norvegicus
cttagtgccaaatagaacatacctt

SEQ ID NO: 278195 - DNA, 25 bp, Rattus norvegicus
cttagtggccaacgtcagtgacttt

SEQ ID NO: 278196 - DNA, 25 bp, Rattus norvegicus
cttagtggccaaggtcagtgacttt

SEQ ID NO: 278197 - DNA, 25 bp, Rattus norvegicus
cttagtggctttactatttacccag

SEQ ID NO: 278198 - DNA, 25 bp, Rattus norvegicus
cttagtggcttttctatttacccag

SEQ ID NO: 278199 - DNA, 25 bp, Rattus norvegicus
cttagtggttaactactcttgagtt

SEQ ID NO: 278200 - DNA, 25 bp, Rattus norvegicus
cttagtggttaagtactcttgagtt

SEQ ID NO: 278201 - DNA, 25 bp, Rattus norvegicus
cttagtgtgtgaataccacccaggg

SEQ ID NO: 278202 - DNA, 25 bp, Rattus norvegicus
cttagtgtgtgattaccacccaggg

SEQ ID NO: 278203 - DNA, 25 bp, Rattus norvegicus
cttagttaagtccacagcagctgtt

SEQ ID NO: 278204 - DNA, 25 bp, Rattus norvegicus
cttagttaagtcgacagcagctgtt

SEQ ID NO: 278205 - DNA, 25 bp, Rattus norvegicus
cttagttatgtgcttcatgaggaag

SEQ ID NO: 278206 - DNA, 25 bp, Rattus norvegicus
cttagttatgtggttcatgaggaag

SEQ ID NO: 278207 - DNA, 25 bp, Rattus norvegicus
cttagttccctcctctgaaaaagag

SEQ ID NO: 278208 - DNA, 25 bp, Rattus norvegicus
cttagttccctcgtctgaaaaagag

SEQ ID NO: 278209 - DNA, 25 bp, Rattus norvegicus
cttagttggcaacctctctgaagag

SEQ ID NO: 278210 - DNA, 25 bp, Rattus norvegicus
cttagttggcaagctctctgaagag

SEQ ID NO: 278211 - DNA, 25 bp, Rattus norvegicus
cttagtttagtcattgtccttcaat

SEQ ID NO: 278212 - DNA, 25 bp, Rattus norvegicus
cttagtttagtctttgtccttcaat

SEQ ID NO: 278213 - DNA, 25 bp, Rattus norvegicus
cttagtttcagcaaactagcagtaa

SEQ ID NO: 278214 - DNA, 25 bp, Rattus norvegicus
cttagtttcagctaactagcagtaa

SEQ ID NO: 278215 - DNA, 25 bp, Rattus norvegicus
cttagtttgggtatcagtgctgtga

SEQ ID NO: 278216 - DNA, 25 bp, Rattus norvegicus
cttagtttgggtttcagtgctgtga

SEQ ID NO: 278217 - DNA, 25 bp, Rattus norvegicus
cttataagttccaatcagttggtga

SEQ ID NO: 278218 - DNA, 25 bp, Rattus norvegicus
cttataagttcctatcagttggtga

SEQ ID NO: 278219 - DNA, 25 bp, Rattus norvegicus
cttatacactaacgcctgtgctcgg

SEQ ID NO: 278220 - DNA, 25 bp, Rattus norvegicus
cttatacactaaggcctgtgctcgg

SEQ ID NO: 278221 - DNA, 25 bp, Rattus norvegicus
cttatacatgcacacaacacactca

SEQ ID NO: 278222 - DNA, 25 bp, Rattus norvegicus
cttatacatgcagacaacacactca

SEQ ID NO: 278223 - DNA, 25 bp, Rattus norvegicus
cttatacttaggcagttggaggtca

SEQ ID NO: 278224 - DNA, 25 bp, Rattus norvegicus
cttatacttagggagttggaggtca

SEQ ID NO: 278225 - DNA, 25 bp, Rattus norvegicus
cttatatagagaagcctgtctgtgc

SEQ ID NO: 278226 - DNA, 25 bp, Rattus norvegicus
cttatatagagatgcctgtctgtgc

SEQ ID NO: 278227 - DNA, 25 bp, Rattus norvegicus
cttatatcctatcgcagttcactgt

SEQ ID NO: 278228 - DNA, 25 bp, Rattus norvegicus
cttatatcctatggcagttcactgt

SEQ ID NO: 278229 - DNA, 25 bp, Rattus norvegicus
cttatattcgctaaataaagcagat

SEQ ID NO: 278230 - DNA, 25 bp, Rattus norvegicus
cttatattcgcttaataaagcagat

SEQ ID NO: 278231 - DNA, 25 bp, Rattus norvegicus
cttatattgttaaatagcgtcccct

SEQ ID NO: 278232 - DNA, 25 bp, Rattus norvegicus
cttatattgttatatagcgtcccct

SEQ ID NO: 278233 - DNA, 25 bp, Rattus norvegicus
cttatcagactgcacaagagacaca

SEQ ID NO: 278234 - DNA, 25 bp, Rattus norvegicus
cttatcagactggacaagagacaca

SEQ ID NO: 278235 - DNA, 25 bp, Rattus norvegicus
cttatcatatacaggctgaccttcc

SEQ ID NO: 278236 - DNA, 25 bp, Rattus norvegicus
cttatcatatactggctgaccttcc

SEQ ID NO: 278237 - DNA, 25 bp, Rattus norvegicus
cttatcatgcctccgtgtacataga

SEQ ID NO: 278238 - DNA, 25 bp, Rattus norvegicus
cttatcatgcctgcgtgtacataga

SEQ ID NO: 278239 - DNA, 25 bp, Rattus norvegicus
cttatccacttccaaacgtactgtt

SEQ ID NO: 278240 - DNA, 25 bp, Rattus norvegicus
cttatccacttcgaaacgtactgtt

SEQ ID NO: 278241 - DNA, 25 bp, Rattus norvegicus
cttatccccaatcacttttctatta

SEQ ID NO: 278242 - DNA, 25 bp, Rattus norvegicus
cttatccccaatgacttttctatta

SEQ ID NO: 278243 - DNA, 25 bp, Rattus norvegicus
cttatcccggatctgcatctgaaaa

SEQ ID NO: 278244 - DNA, 25 bp, Rattus norvegicus
cttatcccggatgtgcatctgaaaa

SEQ ID NO: 278245 - DNA, 25 bp, Rattus norvegicus
cttatccctatcaccaggatcgaaa

SEQ ID NO: 278246 - DNA, 25 bp, Rattus norvegicus
cttatccctatctccaggatcgaaa

SEQ ID NO: 278247 - DNA, 25 bp, Rattus norvegicus
cttatccgatacaggccatgtcaaa

SEQ ID NO: 278248 - DNA, 25 bp, Rattus norvegicus
cttatccgatactggccatgtcaaa

SEQ ID NO: 278249 - DNA, 25 bp, Rattus norvegicus
cttatccgccctcaacaaagatggc

SEQ ID NO: 278250 - DNA, 25 bp, Rattus norvegicus
cttatccgccctgaacaaagatggc

SEQ ID NO: 278251 - DNA, 25 bp, Rattus norvegicus
cttatcctggaaaccgtcaaagaag

SEQ ID NO: 278252 - DNA, 25 bp, Rattus norvegicus
cttatcctggaatccgtcaaagaag

SEQ ID NO: 278253 - DNA, 25 bp, Rattus norvegicus
cttatctcaaaacgaggccggcggg

SEQ ID NO: 278254 - DNA, 25 bp, Rattus norvegicus
cttatctcaaaaggaggccggcggg

SEQ ID NO: 278255 - DNA, 25 bp, Rattus norvegicus
cttatctcatccagtcataaccttt

SEQ ID NO: 278256 - DNA, 25 bp, Rattus norvegicus
cttatctcatcctgtcataaccttt

SEQ ID NO: 278257 - DNA, 25 bp, Rattus norvegicus
cttatctcatgtaagctgtaccagt

SEQ ID NO: 278258 - DNA, 25 bp, Rattus norvegicus
cttatctcatgttagctgtaccagt

SEQ ID NO: 278259 - DNA, 25 bp, Rattus norvegicus
cttatctctttgaattcctgtttgg

SEQ ID NO: 278260 - DNA, 25 bp, Rattus norvegicus
cttatctctttgtattcctgtttgg

SEQ ID NO: 278261 - DNA, 25 bp, Rattus norvegicus
cttatctgtaggaagcttgagccca

SEQ ID NO: 278262 - DNA, 25 bp, Rattus norvegicus
cttatctgtaggtagcttgagccca

SEQ ID NO: 278263 - DNA, 25 bp, Rattus norvegicus
cttatgaccaggatagtgtctgcac

SEQ ID NO: 278264 - DNA, 25 bp, Rattus norvegicus
cttatgaccaggttagtgtctgcac

SEQ ID NO: 278265 - DNA, 25 bp, Rattus norvegicus
cttatgaccttcattgtggttttct

SEQ ID NO: 278266 - DNA, 25 bp, Rattus norvegicus
cttatgaccttctttgtggttttct

SEQ ID NO: 278267 - DNA, 25 bp, Rattus norvegicus
cttatgcatcgacagggtcttcctt

SEQ ID NO: 278268 - DNA, 25 bp, Rattus norvegicus
cttatgcatcgagagggtcttcctt

SEQ ID NO: 278269 - DNA, 25 bp, Rattus norvegicus
cttatgcatgcacttttggtcatca

SEQ ID NO: 278270 - DNA, 25 bp, Rattus norvegicus
cttatgcatgcagttttggtcatca

SEQ ID NO: 278271 - DNA, 25 bp, Rattus norvegicus
cttatgcctaaaaccaagagagatg

SEQ ID NO: 278272 - DNA, 25 bp, Rattus norvegicus
cttatgcctaaatccaagagagatg

SEQ ID NO: 278273 - DNA, 25 bp, Rattus norvegicus
cttatgcctgaacactggaccctaa

SEQ ID NO: 278274 - DNA, 25 bp, Rattus norvegicus
cttatgcctgaagactggaccctaa

SEQ ID NO: 278275 - DNA, 25 bp, Rattus norvegicus
cttatgccttgaattacacaccggg

SEQ ID NO: 278276 - DNA, 25 bp, Rattus norvegicus
cttatgccttgatttacacaccggg

SEQ ID NO: 278277 - DNA, 25 bp, Rattus norvegicus
cttatgctaggtattgcaatgggac

SEQ ID NO: 278278 - DNA, 25 bp, Rattus norvegicus
cttatgctaggttttgcaatgggac

SEQ ID NO: 278279 - DNA, 25 bp, Rattus norvegicus
cttatgctgctccttgggtggcaaa

SEQ ID NO: 278280 - DNA, 25 bp, Rattus norvegicus
cttatgctgctcgttgggtggcaaa

SEQ ID NO: 278281 - DNA, 25 bp, Rattus norvegicus
cttatgctgggaaggctgtttgttt

SEQ ID NO: 278282 - DNA, 25 bp, Rattus norvegicus
cttatgctgggatggctgtttgttt

SEQ ID NO: 278283 - DNA, 25 bp, Rattus norvegicus
cttatgcttctgatgaacttcacaa

SEQ ID NO: 278284 - DNA, 25 bp, Rattus norvegicus
cttatgcttctgttgaacttcacaa

SEQ ID NO: 278285 - DNA, 25 bp, Rattus norvegicus
cttatggaatctcggcttgctgtca

SEQ ID NO: 278286 - DNA, 25 bp, Rattus norvegicus
cttatggaatctgggcttgctgtca

SEQ ID NO: 278287 - DNA, 25 bp, Rattus norvegicus
cttatggcccaaaggctgtctgcag

SEQ ID NO: 278288 - DNA, 25 bp, Rattus norvegicus
cttatggcccaatggctgtctgcag

SEQ ID NO: 278289 - DNA, 25 bp, Rattus norvegicus
cttatggcgagtcgccacccctgag

SEQ ID NO: 278290 - DNA, 25 bp, Rattus norvegicus
cttatggcgagtggccacccctgag

SEQ ID NO: 278291 - DNA, 25 bp, Rattus norvegicus
cttatgggacagattcaaaccgtag

SEQ ID NO: 278292 - DNA, 25 bp, Rattus norvegicus
cttatgggacagtttcaaaccgtag

SEQ ID NO: 278293 - DNA, 25 bp, Rattus norvegicus
cttatgtacgtcagccccagaaata

SEQ ID NO: 278294 - DNA, 25 bp, Rattus norvegicus
cttatgtacgtctgccccagaaata

SEQ ID NO: 278295 - DNA, 25 bp, Rattus norvegicus
cttatgtcttatcctgctcagattc

SEQ ID NO: 278296 - DNA, 25 bp, Rattus norvegicus
cttatgtcttatgctgctcagattc

SEQ ID NO: 278297 - DNA, 25 bp, Rattus norvegicus
cttatgtcttcccaattactaggat

SEQ ID NO: 278298 - DNA, 25 bp, Rattus norvegicus
cttatgtcttccgaattactaggat

SEQ ID NO: 278299 - DNA, 25 bp, Rattus norvegicus
cttatgtggattccagattcttttt

SEQ ID NO: 278300 - DNA, 25 bp, Rattus norvegicus
cttatgtggattgcagattcttttt

SEQ ID NO: 278301 - DNA, 25 bp, Rattus norvegicus
cttatgtggtgaagggctaactccc

SEQ ID NO: 278302 - DNA, 25 bp, Rattus norvegicus
cttatgtggtgatgggctaactccc

SEQ ID NO: 278303 - DNA, 25 bp, Rattus norvegicus
cttatgtgtgtaactagctgggcat

SEQ ID NO: 278304 - DNA, 25 bp, Rattus norvegicus
cttatgtgtgtatctagctgggcat

SEQ ID NO: 278305 - DNA, 25 bp, Rattus norvegicus
cttatgttcctcagcaaactctcaa

SEQ ID NO: 278306 - DNA, 25 bp, Rattus norvegicus
cttatgttcctctgcaaactctcaa

SEQ ID NO: 278307 - DNA, 25 bp, Rattus norvegicus
cttattaacatcaaggccgggacct

SEQ ID NO: 278308 - DNA, 25 bp, Rattus norvegicus
cttattaacatctaggccgggacct

SEQ ID NO: 278309 - DNA, 25 bp, Rattus norvegicus
cttattcactacctcagatctcaag

SEQ ID NO: 278310 - DNA, 25 bp, Rattus norvegicus
cttattcactacgtcagatctcaag

SEQ ID NO: 278311 - DNA, 25 bp, Rattus norvegicus
cttattcagctccatttccattatt

SEQ ID NO: 278312 - DNA, 25 bp, Rattus norvegicus
cttattcagctcgatttccattatt

SEQ ID NO: 278313 - DNA, 25 bp, Rattus norvegicus
cttattcagtcacccaggtcagctt

SEQ ID NO: 278314 - DNA, 25 bp, Rattus norvegicus
cttattcagtcagccaggtcagctt

SEQ ID NO: 278315 - DNA, 25 bp, Rattus norvegicus
cttattccacccaaacttcagaagg

SEQ ID NO: 278316 - DNA, 25 bp, Rattus norvegicus
cttattccaccctaacttcagaagg

SEQ ID NO: 278317 - DNA, 25 bp, Rattus norvegicus
cttattcgaatacctcctggagtgg

SEQ ID NO: 278318 - DNA, 25 bp, Rattus norvegicus
cttattcgaatagctcctggagtgg

SEQ ID NO: 278319 - DNA, 25 bp, Rattus norvegicus
cttattctctgtcccttaaggccaa

SEQ ID NO: 278320 - DNA, 25 bp, Rattus norvegicus
cttattctctgtgccttaaggccaa

SEQ ID NO: 278321 - DNA, 25 bp, Rattus norvegicus
cttattctgtttcaaccccaatgac

SEQ ID NO: 278322 - DNA, 25 bp, Rattus norvegicus
cttattctgtttgaaccccaatgac

SEQ ID NO: 278323 - DNA, 25 bp, Rattus norvegicus
cttattgggcccctgggtatataat

SEQ ID NO: 278324 - DNA, 25 bp, Rattus norvegicus
cttattgggcccgtgggtatataat

SEQ ID NO: 278325 - DNA, 25 bp, Rattus norvegicus
cttattgtaggtcttggcgctccaa

SEQ ID NO: 278326 - DNA, 25 bp, Rattus norvegicus
cttattgtaggtgttggcgctccaa

SEQ ID NO: 278327 - DNA, 25 bp, Rattus norvegicus
cttattgtatcactccaggttcaga

SEQ ID NO: 278328 - DNA, 25 bp, Rattus norvegicus
cttattgtatcagtccaggttcaga

SEQ ID NO: 278329 - DNA, 25 bp, Rattus norvegicus
cttatttaggcactgacagcaggga

SEQ ID NO: 278330 - DNA, 25 bp, Rattus norvegicus
cttatttaggcagtgacagcaggga

SEQ ID NO: 278331 - DNA, 25 bp, Rattus norvegicus
cttatttccatcactggtcacttga

SEQ ID NO: 278332 - DNA, 25 bp, Rattus norvegicus
cttatttccatctctggtcacttga

SEQ ID NO: 278333 - DNA, 25 bp, Rattus norvegicus
cttatttccgttactcaaggcaggg

SEQ ID NO: 278334 - DNA, 25 bp, Rattus norvegicus
cttatttccgtttctcaaggcaggg

SEQ ID NO: 278335 - DNA, 25 bp, Rattus norvegicus
cttatttctctactctgggtggtga

SEQ ID NO: 278336 - DNA, 25 bp, Rattus norvegicus
cttatttctctagtctgggtggtga

SEQ ID NO: 278337 - DNA, 25 bp, Rattus norvegicus
cttatttgctttaattctgtgtgtg

SEQ ID NO: 278338 - DNA, 25 bp, Rattus norvegicus
cttatttgcttttattctgtgtgtg

SEQ ID NO: 278339 - DNA, 25 bp, Rattus norvegicus
cttatttgggcccccagagttatgt

SEQ ID NO: 278340 - DNA, 25 bp, Rattus norvegicus
cttatttgggccgccagagttatgt

SEQ ID NO: 278341 - DNA, 25 bp, Rattus norvegicus
cttatttgtcatcggccctagcata

SEQ ID NO: 278342 - DNA, 25 bp, Rattus norvegicus
cttatttgtcatgggccctagcata

SEQ ID NO: 278343 - DNA, 25 bp, Rattus norvegicus
cttattttgtttcatgttggtggag

SEQ ID NO: 278344 - DNA, 25 bp, Rattus norvegicus
cttattttgtttgatgttggtggag

SEQ ID NO: 278345 - DNA, 25 bp, Rattus norvegicus
cttatttttcaaagtgcacctgcca

SEQ ID NO: 278346 - DNA, 25 bp, Rattus norvegicus
cttatttttcaatgtgcacctgcca

SEQ ID NO: 278347 - DNA, 25 bp, Rattus norvegicus
cttcaaaaatgactgccccagcggt

SEQ ID NO: 278348 - DNA, 25 bp, Rattus norvegicus
cttcaaaaatgagtgccccagcggt

SEQ ID NO: 278349 - DNA, 25 bp, Rattus norvegicus
cttcaaaatgtcagctcggtgtcac

SEQ ID NO: 278350 - DNA, 25 bp, Rattus norvegicus
cttcaaaatgtctgctcggtgtcac

SEQ ID NO: 278351 - DNA, 25 bp, Rattus norvegicus
cttcaaacaagcaactgtgggcgat

SEQ ID NO: 278352 - DNA, 25 bp, Rattus norvegicus
cttcaaacaagctactgtgggcgat

SEQ ID NO: 278353 - DNA, 25 bp, Rattus norvegicus
cttcaaacacttaccgcaaatctgt

SEQ ID NO: 278354 - DNA, 25 bp, Rattus norvegicus
cttcaaacactttccgcaaatctgt

SEQ ID NO: 278355 - DNA, 25 bp, Rattus norvegicus
cttcaaacagctatccctagaggga

SEQ ID NO: 278356 - DNA, 25 bp, Rattus norvegicus
cttcaaacagctttccctagaggga

SEQ ID NO: 278357 - DNA, 25 bp, Rattus norvegicus
cttcaaaccatcacgaggactattt

SEQ ID NO: 278358 - DNA, 25 bp, Rattus norvegicus
cttcaaaccatctcgaggactattt

SEQ ID NO: 278359 - DNA, 25 bp, Rattus norvegicus
cttcaaagcaagatctgggacagtc

SEQ ID NO: 278360 - DNA, 25 bp, Rattus norvegicus
cttcaaagcaagttctgggacagtc

SEQ ID NO: 278361 - DNA, 25 bp, Rattus norvegicus
cttcaaagtttgattccgcgccacg

SEQ ID NO: 278362 - DNA, 25 bp, Rattus norvegicus
cttcaaagtttgtttccgcgccacg

SEQ ID NO: 278363 - DNA, 25 bp, Rattus norvegicus
cttcaaatgcttaatacacagttat

SEQ ID NO: 278364 - DNA, 25 bp, Rattus norvegicus
cttcaaatgctttatacacagttat

SEQ ID NO: 278365 - DNA, 25 bp, Rattus norvegicus
cttcaaatgtcactggcaacccaag

SEQ ID NO: 278366 - DNA, 25 bp, Rattus norvegicus
cttcaaatgtcagtggcaacccaag

SEQ ID NO: 278367 - DNA, 25 bp, Rattus norvegicus
cttcaacaaatgaccttcaacccat

SEQ ID NO: 278368 - DNA, 25 bp, Rattus norvegicus
cttcaacaaatgtccttcaacccat

SEQ ID NO: 278369 - DNA, 25 bp, Rattus norvegicus
cttcaacaggagactgtatttcccc

SEQ ID NO: 278370 - DNA, 25 bp, Rattus norvegicus
cttcaacaggagtctgtatttcccc

SEQ ID NO: 278371 - DNA, 25 bp, Rattus norvegicus
cttcaacatcacagacaggcctggg

SEQ ID NO: 278372 - DNA, 25 bp, Rattus norvegicus
cttcaacatcactgacaggcctggg

SEQ ID NO: 278373 - DNA, 25 bp, Rattus norvegicus
cttcaacgttaaatccagaggtgga

SEQ ID NO: 278374 - DNA, 25 bp, Rattus norvegicus
cttcaacgttaattccagaggtgga

SEQ ID NO: 278375 - DNA, 25 bp, Rattus norvegicus
cttcaactatacaacctttttacag

SEQ ID NO: 278376 - DNA, 25 bp, Rattus norvegicus
cttcaactatactacctttttacag

SEQ ID NO: 278377 - DNA, 25 bp, Rattus norvegicus
cttcaactcagtattctacccataa

SEQ ID NO: 278378 - DNA, 25 bp, Rattus norvegicus
cttcaactcagttttctacccataa

SEQ ID NO: 278379 - DNA, 25 bp, Rattus norvegicus
cttcaactctgtcgctgtgttttta

SEQ ID NO: 278380 - DNA, 25 bp, Rattus norvegicus
cttcaactctgtggctgtgttttta

SEQ ID NO: 278381 - DNA, 25 bp, Rattus norvegicus
cttcaactcttcagccattgtaagg

SEQ ID NO: 278382 - DNA, 25 bp, Rattus norvegicus
cttcaactcttctgccattgtaagg

SEQ ID NO: 278383 - DNA, 25 bp, Rattus norvegicus
cttcaactgcaaagtctgggactct

SEQ ID NO: 278384 - DNA, 25 bp, Rattus norvegicus
cttcaactgcaatgtctgggactct

SEQ ID NO: 278385 - DNA, 25 bp, Rattus norvegicus
cttcaactgcctcgcatgacggagg

SEQ ID NO: 278386 - DNA, 25 bp, Rattus norvegicus
cttcaactgcctggcatgacggagg

SEQ ID NO: 278387 - DNA, 25 bp, Rattus norvegicus
cttcaactttgtcggcgccttcatg

SEQ ID NO: 278388 - DNA, 25 bp, Rattus norvegicus
cttcaactttgtgggcgccttcatg

SEQ ID NO: 278389 - DNA, 25 bp, Rattus norvegicus
cttcaagaagtcaaagcttggcttt

SEQ ID NO: 278390 - DNA, 25 bp, Rattus norvegicus
cttcaagaagtccttcaagctgagc

SEQ ID NO: 278391 - DNA, 25 bp, Rattus norvegicus
cttcaagaagtcgttcaagctgagc

SEQ ID NO: 278392 - DNA, 25 bp, Rattus norvegicus
cttcaagaagtctaagcttggcttt

SEQ ID NO: 278393 - DNA, 25 bp, Rattus norvegicus
cttcaagacctcctacagtgctgta

SEQ ID NO: 278394 - DNA, 25 bp, Rattus norvegicus
cttcaagacctcgtacagtgctgta

SEQ ID NO: 278395 - DNA, 25 bp, Rattus norvegicus
cttcaagagggaccccggatgttct

SEQ ID NO: 278396 - DNA, 25 bp, Rattus norvegicus
cttcaagagggagcccggatgttct

SEQ ID NO: 278397 - DNA, 25 bp, Rattus norvegicus
cttcaagcatcacgccacagacatg

SEQ ID NO: 278398 - DNA, 25 bp, Rattus norvegicus
cttcaagcatcaggccacagacatg

SEQ ID NO: 278399 - DNA, 25 bp, Rattus norvegicus
cttcaagcggaaccagcagcaccag

SEQ ID NO: 278400 - DNA, 25 bp, Rattus norvegicus
cttcaagcggaagcagcagcaccag

SEQ ID NO: 278401 - DNA, 25 bp, Rattus norvegicus
cttcaagctggaacctgtgctgatg

SEQ ID NO: 278402 - DNA, 25 bp, Rattus norvegicus
cttcaagctggatcctgtgctgatg

SEQ ID NO: 278403 - DNA, 25 bp, Rattus norvegicus
cttcaaggaggtccgtctggtccct

SEQ ID NO: 278404 - DNA, 25 bp, Rattus norvegicus
cttcaaggaggtgcgtctggtccct

SEQ ID NO: 278405 - DNA, 25 bp, Rattus norvegicus
cttcaaggcactaggctggatggct

SEQ ID NO: 278406 - DNA, 25 bp, Rattus norvegicus
cttcaaggcacttggctggatggct

SEQ ID NO: 278407 - DNA, 25 bp, Rattus norvegicus
cttcaaggcataatgcacattcccc

SEQ ID NO: 278408 - DNA, 25 bp, Rattus norvegicus
cttcaaggcatattgcacattcccc

SEQ ID NO: 278409 - DNA, 25 bp, Rattus norvegicus
cttcaaggtattccagcatgctgat

SEQ ID NO: 278410 - DNA, 25 bp, Rattus norvegicus
cttcaaggtattgcagcatgctgat

SEQ ID NO: 278411 - DNA, 25 bp, Rattus norvegicus
cttcaaggtttacagagatccactt

SEQ ID NO: 278412 - DNA, 25 bp, Rattus norvegicus
cttcaaggtttagagagatccactt

SEQ ID NO: 278413 - DNA, 25 bp, Rattus norvegicus
cttcaagtcagcatatagttcgttt

SEQ ID NO: 278414 - DNA, 25 bp, Rattus norvegicus
cttcaagtcagcttatagttcgttt

SEQ ID NO: 278415 - DNA, 25 bp, Rattus norvegicus
cttcaagtgcagagtgtgagccgta

SEQ ID NO: 278416 - DNA, 25 bp, Rattus norvegicus
cttcaagtgcagtgtgtgagccgta

SEQ ID NO: 278417 - DNA, 25 bp, Rattus norvegicus
cttcaatacctcctactagtctgta

SEQ ID NO: 278418 - DNA, 25 bp, Rattus norvegicus
cttcaatacctcgtactagtctgta

SEQ ID NO: 278419 - DNA, 25 bp, Rattus norvegicus
cttcaatagcctatcaactgtcaaa

SEQ ID NO: 278420 - DNA, 25 bp, Rattus norvegicus
cttcaatagcctttcaactgtcaaa

SEQ ID NO: 278421 - DNA, 25 bp, Rattus norvegicus
cttcaatccactacaatgcacttgt

SEQ ID NO: 278422 - DNA, 25 bp, Rattus norvegicus
cttcaatccacttcaatgcacttgt

SEQ ID NO: 278423 - DNA, 25 bp, Rattus norvegicus
cttcaatgaggtcctgcggcagtgc

SEQ ID NO: 278424 - DNA, 25 bp, Rattus norvegicus
cttcaatgaggtgctgcggcagtgc

SEQ ID NO: 278425 - DNA, 25 bp, Rattus norvegicus
cttcaatggtatcggacactcctca

SEQ ID NO: 278426 - DNA, 25 bp, Rattus norvegicus
cttcaatggtatgggacactcctca

SEQ ID NO: 278427 - DNA, 25 bp, Rattus norvegicus
cttcaattcctcctggccaagagag

SEQ ID NO: 278428 - DNA, 25 bp, Rattus norvegicus
cttcaattcctcgtggccaagagag

SEQ ID NO: 278429 - DNA, 25 bp, Rattus norvegicus
cttcacaactatcagctgccaattg

SEQ ID NO: 278430 - DNA, 25 bp, Rattus norvegicus
cttcacaactatgagctgccaattg

SEQ ID NO: 278431 - DNA, 25 bp, Rattus norvegicus
cttcacaccactatggagccactgt

SEQ ID NO: 278432 - DNA, 25 bp, Rattus norvegicus
cttcacaccactttggagccactgt

SEQ ID NO: 278433 - DNA, 25 bp, Rattus norvegicus
cttcacagtagaaagcagagtccac

SEQ ID NO: 278434 - DNA, 25 bp, Rattus norvegicus
cttcacagtagatagcagagtccac

SEQ ID NO: 278435 - DNA, 25 bp, Rattus norvegicus
cttcacagtcttccagtagcttata

SEQ ID NO: 278436 - DNA, 25 bp, Rattus norvegicus
cttcacagtcttgcagtagcttata

SEQ ID NO: 278437 - DNA, 25 bp, Rattus norvegicus
cttcacatctaaattccccaggaaa

SEQ ID NO: 278438 - DNA, 25 bp, Rattus norvegicus
cttcacatctaatttccccaggaaa

SEQ ID NO: 278439 - DNA, 25 bp, Rattus norvegicus
cttcacatctctactttcatcaatg

SEQ ID NO: 278440 - DNA, 25 bp, Rattus norvegicus
cttcacatctcttctttcatcaatg

SEQ ID NO: 278441 - DNA, 25 bp, Rattus norvegicus
cttcacattcgtactgtggcgtatg

SEQ ID NO: 278442 - DNA, 25 bp, Rattus norvegicus
cttcacattcgttctgtggcgtatg

SEQ ID NO: 278443 - DNA, 25 bp, Rattus norvegicus
cttcacattgtcaaggcagcatttg

SEQ ID NO: 278444 - DNA, 25 bp, Rattus norvegicus
cttcacattgtctaggcagcatttg

SEQ ID NO: 278445 - DNA, 25 bp, Rattus norvegicus
cttcaccaagtgacagctgtgggta

SEQ ID NO: 278446 - DNA, 25 bp, Rattus norvegicus
cttcaccaagtgtcagctgtgggta

SEQ ID NO: 278447 - DNA, 25 bp, Rattus norvegicus
cttcaccacccgcaagactgtgaga

SEQ ID NO: 278448 - DNA, 25 bp, Rattus norvegicus
cttcaccacccggaagactgtgaga

SEQ ID NO: 278449 - DNA, 25 bp, Rattus norvegicus
cttcaccacgtaacaactgcacgag

SEQ ID NO: 278450 - DNA, 25 bp, Rattus norvegicus
cttcaccacgtatcaactgcacgag

SEQ ID NO: 278451 - DNA, 25 bp, Rattus norvegicus
cttcacccttgcctgtgtaatttta

SEQ ID NO: 278452 - DNA, 25 bp, Rattus norvegicus
cttcacccttgcgtgtgtaatttta

SEQ ID NO: 278453 - DNA, 25 bp, Rattus norvegicus
cttcaccctttacctacatgactta

SEQ ID NO: 278454 - DNA, 25 bp, Rattus norvegicus
cttcaccctttagctacatgactta

SEQ ID NO: 278455 - DNA, 25 bp, Rattus norvegicus
cttcaccgtcacagttccagaaaag

SEQ ID NO: 278456 - DNA, 25 bp, Rattus norvegicus
cttcaccgtcactgttccagaaaag

SEQ ID NO: 278457 - DNA, 25 bp, Rattus norvegicus
cttcaccgtctgagttggtggtgga

SEQ ID NO: 278458 - DNA, 25 bp, Rattus norvegicus
cttcaccgtctgtgttggtggtgga

SEQ ID NO: 278459 - DNA, 25 bp, Rattus norvegicus
cttcacctccgacaatcacaaggga

SEQ ID NO: 278460 - DNA, 25 bp, Rattus norvegicus
cttcacctccgagaatcacaaggga

SEQ ID NO: 278461 - DNA, 25 bp, Rattus norvegicus
cttcacctctccagcagtagagtta

SEQ ID NO: 278462 - DNA, 25 bp, Rattus norvegicus
cttcacctctcctgcagtagagtta

SEQ ID NO: 278463 - DNA, 25 bp, Rattus norvegicus
cttcacctctgtagtcactgttaga

SEQ ID NO: 278464 - DNA, 25 bp, Rattus norvegicus
cttcacctctgttgtcactgttaga

SEQ ID NO: 278465 - DNA, 25 bp, Rattus norvegicus
cttcacctgcatatacattccatgg

SEQ ID NO: 278466 - DNA, 25 bp, Rattus norvegicus
cttcacctgcatttacattccatgg

SEQ ID NO: 278467 - DNA, 25 bp, Rattus norvegicus
cttcaccttcaccttttatttgaat

SEQ ID NO: 278468 - DNA, 25 bp, Rattus norvegicus
cttcaccttcacgttttatttgaat

SEQ ID NO: 278469 - DNA, 25 bp, Rattus norvegicus
cttcacgctgtcatccgattggata

SEQ ID NO: 278470 - DNA, 25 bp, Rattus norvegicus
cttcacgctgtcttccgattggata

SEQ ID NO: 278471 - DNA, 25 bp, Rattus norvegicus
cttcacggagttattgcagagtttt

SEQ ID NO: 278472 - DNA, 25 bp, Rattus norvegicus
cttcacggagtttttgcagagtttt

SEQ ID NO: 278473 - DNA, 25 bp, Rattus norvegicus
cttcacggtggacagcgcggacgct

SEQ ID NO: 278474 - DNA, 25 bp, Rattus norvegicus
cttcacggtggagagcgcggacgct

SEQ ID NO: 278475 - DNA, 25 bp, Rattus norvegicus
cttcacggttcaacagaggcgattt

SEQ ID NO: 278476 - DNA, 25 bp, Rattus norvegicus
cttcacggttcatcagaggcgattt

SEQ ID NO: 278477 - DNA, 25 bp, Rattus norvegicus
cttcacgtagttccctcgatggaaa

SEQ ID NO: 278478 - DNA, 25 bp, Rattus norvegicus
cttcacgtagttgcctcgatggaaa

SEQ ID NO: 278479 - DNA, 25 bp, Rattus norvegicus
cttcacgtctctcagggtcttcaaa

SEQ ID NO: 278480 - DNA, 25 bp, Rattus norvegicus
cttcacgtctctgagggtcttcaaa

SEQ ID NO: 278481 - DNA, 25 bp, Rattus norvegicus
cttcactaaggcacgcgggccggta

SEQ ID NO: 278482 - DNA, 25 bp, Rattus norvegicus
cttcactaaggctcgcgggccggta

SEQ ID NO: 278483 - DNA, 25 bp, Rattus norvegicus
cttcactatcaactacctgcaggag

SEQ ID NO: 278484 - DNA, 25 bp, Rattus norvegicus
cttcactatcaagtacctgcaggag

SEQ ID NO: 278485 - DNA, 25 bp, Rattus norvegicus
cttcactcatctcaaggccaaggga

SEQ ID NO: 278486 - DNA, 25 bp, Rattus norvegicus
cttcactcatctgaaggccaaggga

SEQ ID NO: 278487 - DNA, 25 bp, Rattus norvegicus
cttcactccactctgtatctatgga

SEQ ID NO: 278488 - DNA, 25 bp, Rattus norvegicus
cttcactccactgtgtatctatgga

SEQ ID NO: 278489 - DNA, 25 bp, Rattus norvegicus
cttcactcggccattttgttaatgg

SEQ ID NO: 278490 - DNA, 25 bp, Rattus norvegicus
cttcactcggcctttttgttaatgg

SEQ ID NO: 278491 - DNA, 25 bp, Rattus norvegicus
cttcactctgtccatactgggatag

SEQ ID NO: 278492 - DNA, 25 bp, Rattus norvegicus
cttcactctgtcgatactgggatag

SEQ ID NO: 278493 - DNA, 25 bp, Rattus norvegicus
cttcactcttgcaaagtgcctgtga

SEQ ID NO: 278494 - DNA, 25 bp, Rattus norvegicus
cttcactcttgctaagtgcctgtga

SEQ ID NO: 278495 - DNA, 25 bp, Rattus norvegicus
cttcactcttgtccattggtgtttt

SEQ ID NO: 278496 - DNA, 25 bp, Rattus norvegicus
cttcactcttgtgcattggtgtttt

SEQ ID NO: 278497 - DNA, 25 bp, Rattus norvegicus
cttcactttgtgctatgacaatggg

SEQ ID NO: 278498 - DNA, 25 bp, Rattus norvegicus
cttcactttgtggtatgacaatggg

SEQ ID NO: 278499 - DNA, 25 bp, Rattus norvegicus
cttcagaaatgacagcgcccagcct

SEQ ID NO: 278500 - DNA, 25 bp, Rattus norvegicus
cttcagaaatgagagcgcccagcct

SEQ ID NO: 278501 - DNA, 25 bp, Rattus norvegicus
cttcagaatacactccaggcaggct

SEQ ID NO: 278502 - DNA, 25 bp, Rattus norvegicus
cttcagaatacagtccaggcaggct

SEQ ID NO: 278503 - DNA, 25 bp, Rattus norvegicus
cttcagacatgcctgttgtgtattt

SEQ ID NO: 278504 - DNA, 25 bp, Rattus norvegicus
cttcagacatgcgtgttgtgtattt

SEQ ID NO: 278505 - DNA, 25 bp, Rattus norvegicus
cttcagactctaaacctagcacgga

SEQ ID NO: 278506 - DNA, 25 bp, Rattus norvegicus
cttcagactctatacctagcacgga

SEQ ID NO: 278507 - DNA, 25 bp, Rattus norvegicus
cttcagagactgctctgtcctggaa

SEQ ID NO: 278508 - DNA, 25 bp, Rattus norvegicus
cttcagagactggtctgtcctggaa

SEQ ID NO: 278509 - DNA, 25 bp, Rattus norvegicus
cttcagagagttcgagtagcgcagt

SEQ ID NO: 278510 - DNA, 25 bp, Rattus norvegicus
cttcagagagttggagtagcgcagt

SEQ ID NO: 278511 - DNA, 25 bp, Rattus norvegicus
cttcagagcactccagacagttctg

SEQ ID NO: 278512 - DNA, 25 bp, Rattus norvegicus
cttcagagcactgcagacagttctg

SEQ ID NO: 278513 - DNA, 25 bp, Rattus norvegicus
cttcagagcagcagtgggagttgct

SEQ ID NO: 278514 - DNA, 25 bp, Rattus norvegicus
cttcagagcagctgtgggagttgct

SEQ ID NO: 278515 - DNA, 25 bp, Rattus norvegicus
cttcagagtcggatcagtagttaga

SEQ ID NO: 278516 - DNA, 25 bp, Rattus norvegicus
cttcagagtcggttcagtagttaga

SEQ ID NO: 278517 - DNA, 25 bp, Rattus norvegicus
cttcagattgccagcctaatatgta

SEQ ID NO: 278518 - DNA, 25 bp, Rattus norvegicus
cttcagattgcctgcctaatatgta

SEQ ID NO: 278519 - DNA, 25 bp, Rattus norvegicus
cttcagcaataaccccaaccagtgg

SEQ ID NO: 278520 - DNA, 25 bp, Rattus norvegicus
cttcagcaataagcccaaccagtgg

SEQ ID NO: 278521 - DNA, 25 bp, Rattus norvegicus
cttcagcacagcacaactttgggtc

SEQ ID NO: 278522 - DNA, 25 bp, Rattus norvegicus
cttcagcacagctcaactttgggtc

SEQ ID NO: 278523 - DNA, 25 bp, Rattus norvegicus
cttcagcagctgcaaactctacttg

SEQ ID NO: 278524 - DNA, 25 bp, Rattus norvegicus
cttcagcagctggaaactctacttg

SEQ ID NO: 278525 - DNA, 25 bp, Rattus norvegicus
cttcagccactgctcttgagaatta

SEQ ID NO: 278526 - DNA, 25 bp, Rattus norvegicus
cttcagccactggtcttgagaatta

SEQ ID NO: 278527 - DNA, 25 bp, Rattus norvegicus
cttcagccagacctcgggaatagaa

SEQ ID NO: 278528 - DNA, 25 bp, Rattus norvegicus
cttcagccagacgtcgggaatagaa

SEQ ID NO: 278529 - DNA, 25 bp, Rattus norvegicus
cttcagcccatcattgtgagttaca

SEQ ID NO: 278530 - DNA, 25 bp, Rattus norvegicus
cttcagcccatctttgtgagttaca

SEQ ID NO: 278531 - DNA, 25 bp, Rattus norvegicus
cttcagcctattaaagagaacactt

SEQ ID NO: 278532 - DNA, 25 bp, Rattus norvegicus
cttcagcctatttaagagaacactt

SEQ ID NO: 278533 - DNA, 25 bp, Rattus norvegicus
cttcagcctcataggacgttataat

SEQ ID NO: 278534 - DNA, 25 bp, Rattus norvegicus
cttcagcctcattggacgttataat

SEQ ID NO: 278535 - DNA, 25 bp, Rattus norvegicus
cttcagcctgacatttcctggtggg

SEQ ID NO: 278536 - DNA, 25 bp, Rattus norvegicus
cttcagcctgacttttcctggtggg

SEQ ID NO: 278537 - DNA, 25 bp, Rattus norvegicus
cttcagctagagaatgccagtgtaa

SEQ ID NO: 278538 - DNA, 25 bp, Rattus norvegicus
cttcagctagagtatgccagtgtaa

SEQ ID NO: 278539 - DNA, 25 bp, Rattus norvegicus
cttcagctcctgagtatttacttag

SEQ ID NO: 278540 - DNA, 25 bp, Rattus norvegicus
cttcagctcctgtgtatttacttag

SEQ ID NO: 278541 - DNA, 25 bp, Rattus norvegicus
cttcagctgagcacgggactctgca

SEQ ID NO: 278542 - DNA, 25 bp, Rattus norvegicus
cttcagctgagctcgggactctgca

SEQ ID NO: 278543 - DNA, 25 bp, Rattus norvegicus
cttcagcttttccagcgtcaagaat

SEQ ID NO: 278544 - DNA, 25 bp, Rattus norvegicus
cttcagcttttcgagcgtcaagaat

SEQ ID NO: 278545 - DNA, 25 bp, Rattus norvegicus
cttcaggacctgcacttaatgtttg

SEQ ID NO: 278546 - DNA, 25 bp, Rattus norvegicus
cttcaggacctggacttaatgtttg

SEQ ID NO: 278547 - DNA, 25 bp, Rattus norvegicus
cttcaggaggaacagcgccagcaca

SEQ ID NO: 278548 - DNA, 25 bp, Rattus norvegicus
cttcaggaggaagagcgccagcaca

SEQ ID NO: 278549 - DNA, 25 bp, Rattus norvegicus
cttcaggagtgtattgtgtgtcttc

SEQ ID NO: 278550 - DNA, 25 bp, Rattus norvegicus
cttcaggagtgttttgtgtgtcttc

SEQ ID NO: 278551 - DNA, 25 bp, Rattus norvegicus
cttcaggatcccatatcccaataat

SEQ ID NO: 278552 - DNA, 25 bp, Rattus norvegicus
cttcaggatcccttatcccaataat

SEQ ID NO: 278553 - DNA, 25 bp, Rattus norvegicus
cttcaggcaggacagggtacgataa

SEQ ID NO: 278554 - DNA, 25 bp, Rattus norvegicus
cttcaggcaggagagggtacgataa

SEQ ID NO: 278555 - DNA, 25 bp, Rattus norvegicus
cttcaggccaccatctttgaggtac

SEQ ID NO: 278556 - DNA, 25 bp, Rattus norvegicus
cttcaggccaccttctttgaggtac

SEQ ID NO: 278557 - DNA, 25 bp, Rattus norvegicus
cttcaggcctggcaacctactgata

SEQ ID NO: 278558 - DNA, 25 bp, Rattus norvegicus
cttcaggcctgggaacctactgata

SEQ ID NO: 278559 - DNA, 25 bp, Rattus norvegicus
cttcagggactgatgtggcccgtga

SEQ ID NO: 278560 - DNA, 25 bp, Rattus norvegicus
cttcagggactgttgtggcccgtga

SEQ ID NO: 278561 - DNA, 25 bp, Rattus norvegicus
cttcagggcagacatcatggctttc

SEQ ID NO: 278562 - DNA, 25 bp, Rattus norvegicus
cttcagggcagagatcatggctttc

SEQ ID NO: 278563 - DNA, 25 bp, Rattus norvegicus
cttcagggccataatgacctgttct

SEQ ID NO: 278564 - DNA, 25 bp, Rattus norvegicus
cttcagggccattatgacctgttct

SEQ ID NO: 278565 - DNA, 25 bp, Rattus norvegicus
cttcagggtgggactttcagcaaaa

SEQ ID NO: 278566 - DNA, 25 bp, Rattus norvegicus
cttcagggtgggtctttcagcaaaa

SEQ ID NO: 278567 - DNA, 25 bp, Rattus norvegicus
cttcaggtacttccacccaaataca

SEQ ID NO: 278568 - DNA, 25 bp, Rattus norvegicus
cttcaggtacttgcacccaaataca

SEQ ID NO: 278569 - DNA, 25 bp, Rattus norvegicus
cttcaggtgcttatgtggctaaaat

SEQ ID NO: 278570 - DNA, 25 bp, Rattus norvegicus
cttcaggtgcttttgtggctaaaat

SEQ ID NO: 278571 - DNA, 25 bp, Rattus norvegicus
cttcaggtgtggcattttgttttct

SEQ ID NO: 278572 - DNA, 25 bp, Rattus norvegicus
cttcaggtgtgggattttgttttct

SEQ ID NO: 278573 - DNA, 25 bp, Rattus norvegicus
cttcaggttcctcccttttgaaatt

SEQ ID NO: 278574 - DNA, 25 bp, Rattus norvegicus
cttcaggttcctgccttttgaaatt

SEQ ID NO: 278575 - DNA, 25 bp, Rattus norvegicus
cttcagtagcataaccacatgtgga

SEQ ID NO: 278576 - DNA, 25 bp, Rattus norvegicus
cttcagtagcattaccacatgtgga

SEQ ID NO: 278577 - DNA, 25 bp, Rattus norvegicus
cttcagtcatgtaggcttagtttct

SEQ ID NO: 278578 - DNA, 25 bp, Rattus norvegicus
cttcagtcatgtctcactggcagca

SEQ ID NO: 278579 - DNA, 25 bp, Rattus norvegicus
cttcagtcatgtgtcactggcagca

SEQ ID NO: 278580 - DNA, 25 bp, Rattus norvegicus
cttcagtcatgttggcttagtttct

SEQ ID NO: 278581 - DNA, 25 bp, Rattus norvegicus
cttcagtctgcaatcccggcgggca

SEQ ID NO: 278582 - DNA, 25 bp, Rattus norvegicus
cttcagtctgcattcccggcgggca

SEQ ID NO: 278583 - DNA, 25 bp, Rattus norvegicus
cttcagtgaagaagcctcctccagg

SEQ ID NO: 278584 - DNA, 25 bp, Rattus norvegicus
cttcagtgaagatgcctcctccagg

SEQ ID NO: 278585 - DNA, 25 bp, Rattus norvegicus
cttcagtgagtaccgctgcccggcg

SEQ ID NO: 278586 - DNA, 25 bp, Rattus norvegicus
cttcagtgagtagcgctgcccggcg

SEQ ID NO: 278587 - DNA, 25 bp, Rattus norvegicus
cttcagtggtgcatggtggctgttt

SEQ ID NO: 278588 - DNA, 25 bp, Rattus norvegicus
cttcagtggtgcttggtggctgttt

SEQ ID NO: 278589 - DNA, 25 bp, Rattus norvegicus
cttcagtgtagacctcttgttcttt

SEQ ID NO: 278590 - DNA, 25 bp, Rattus norvegicus
cttcagtgtagagctcttgttcttt

SEQ ID NO: 278591 - DNA, 25 bp, Rattus norvegicus
cttcagtgtgttaatgggtttcaga

SEQ ID NO: 278592 - DNA, 25 bp, Rattus norvegicus
cttcagtgtgtttatgggtttcaga

SEQ ID NO: 278593 - DNA, 25 bp, Rattus norvegicus
cttcagttcagtccccgagcatcag

SEQ ID NO: 278594 - DNA, 25 bp, Rattus norvegicus
cttcagttcagtgcccgagcatcag

SEQ ID NO: 278595 - DNA, 25 bp, Rattus norvegicus
cttcagttctcacagtcttgggaca

SEQ ID NO: 278596 - DNA, 25 bp, Rattus norvegicus
cttcagttctcagagtcttgggaca

SEQ ID NO: 278597 - DNA, 25 bp, Rattus norvegicus
cttcagttcttcctcgggaacataa

SEQ ID NO: 278598 - DNA, 25 bp, Rattus norvegicus
cttcagttcttcgtcgggaacataa

SEQ ID NO: 278599 - DNA, 25 bp, Rattus norvegicus
cttcagtttgatatccaggaagtag

SEQ ID NO: 278600 - DNA, 25 bp, Rattus norvegicus
cttcagtttgatttccaggaagtag

SEQ ID NO: 278601 - DNA, 25 bp, Rattus norvegicus
cttcataactgcctcctggaaagta

SEQ ID NO: 278602 - DNA, 25 bp, Rattus norvegicus
cttcataactgcgtcctggaaagta

SEQ ID NO: 278603 - DNA, 25 bp, Rattus norvegicus
cttcataatggcatgtctgtattca

SEQ ID NO: 278604 - DNA, 25 bp, Rattus norvegicus
cttcataatggcttgtctgtattca

SEQ ID NO: 278605 - DNA, 25 bp, Rattus norvegicus
cttcatacccttaattcactgtcaa

SEQ ID NO: 278606 - DNA, 25 bp, Rattus norvegicus
cttcataccctttattcactgtcaa

SEQ ID NO: 278607 - DNA, 25 bp, Rattus norvegicus
cttcataccttgatgacttcattat

SEQ ID NO: 278608 - DNA, 25 bp, Rattus norvegicus
cttcataccttgttgacttcattat

SEQ ID NO: 278609 - DNA, 25 bp, Rattus norvegicus
cttcatacttttcttcatgggctat

SEQ ID NO: 278610 - DNA, 25 bp, Rattus norvegicus
cttcatacttttgttcatgggctat

SEQ ID NO: 278611 - DNA, 25 bp, Rattus norvegicus
cttcatagtgccctctacttttaaa

SEQ ID NO: 278612 - DNA, 25 bp, Rattus norvegicus
cttcatagtgccgtctacttttaaa

SEQ ID NO: 278613 - DNA, 25 bp, Rattus norvegicus
cttcatatggctaatatcctcactc

SEQ ID NO: 278614 - DNA, 25 bp, Rattus norvegicus
cttcatatggcttatatcctcactc

SEQ ID NO: 278615 - DNA, 25 bp, Rattus norvegicus
cttcatatgtccaaacagagtaaat

SEQ ID NO: 278616 - DNA, 25 bp, Rattus norvegicus
cttcatatgtcctaacagagtaaat

SEQ ID NO: 278617 - DNA, 25 bp, Rattus norvegicus
cttcatcaagaactatcccgtggtc

SEQ ID NO: 278618 - DNA, 25 bp, Rattus norvegicus
cttcatcaagaagtatcccgtggtc

SEQ ID NO: 278619 - DNA, 25 bp, Rattus norvegicus
cttcatcaagttcccgtacaaactg

SEQ ID NO: 278620 - DNA, 25 bp, Rattus norvegicus
cttcatcaagttgccgtacaaactg

SEQ ID NO: 278621 - DNA, 25 bp, Rattus norvegicus
cttcatcaccttcatgtaacgtcta

SEQ ID NO: 278622 - DNA, 25 bp, Rattus norvegicus
cttcatcaccttgatgtaacgtcta

SEQ ID NO: 278623 - DNA, 25 bp, Rattus norvegicus
cttcatcagtgacagcccagttcat

SEQ ID NO: 278624 - DNA, 25 bp, Rattus norvegicus
cttcatcagtgagagcccagttcat

SEQ ID NO: 278625 - DNA, 25 bp, Rattus norvegicus
cttcatcatgcaaggatctccagtc

SEQ ID NO: 278626 - DNA, 25 bp, Rattus norvegicus
cttcatcatgcatggatctccagtc

SEQ ID NO: 278627 - DNA, 25 bp, Rattus norvegicus
cttcatccacacatctccagaatca

SEQ ID NO: 278628 - DNA, 25 bp, Rattus norvegicus
cttcatccacacttctccagaatca

SEQ ID NO: 278629 - DNA, 25 bp, Rattus norvegicus
cttcatccgtcaccctctaaatggg

SEQ ID NO: 278630 - DNA, 25 bp, Rattus norvegicus
cttcatccgtcagcctctaaatggg

SEQ ID NO: 278631 - DNA, 25 bp, Rattus norvegicus
cttcatcctcatctgaagttgaggt

SEQ ID NO: 278632 - DNA, 25 bp, Rattus norvegicus
cttcatcctcatgtgaagttgaggt

SEQ ID NO: 278633 - DNA, 25 bp, Rattus norvegicus
cttcatcctgacagggaaccaagtt

SEQ ID NO: 278634 - DNA, 25 bp, Rattus norvegicus
cttcatcctgactgggaaccaagtt

SEQ ID NO: 278635 - DNA, 25 bp, Rattus norvegicus
cttcatcctgctccttctgagtggg

SEQ ID NO: 278636 - DNA, 25 bp, Rattus norvegicus
cttcatcctgctgcttctgagtggg

SEQ ID NO: 278637 - DNA, 25 bp, Rattus norvegicus
cttcatcctggaatgcaacgacaaa

SEQ ID NO: 278638 - DNA, 25 bp, Rattus norvegicus
cttcatcctggattgcaacgacaaa

SEQ ID NO: 278639 - DNA, 25 bp, Rattus norvegicus
cttcatctccctcctagaaggtgct

SEQ ID NO: 278640 - DNA, 25 bp, Rattus norvegicus
cttcatctccctgctagaaggtgct

SEQ ID NO: 278641 - DNA, 25 bp, Rattus norvegicus
cttcatctcttcaaagtcgtcttgc

SEQ ID NO: 278642 - DNA, 25 bp, Rattus norvegicus
cttcatctcttctaagtcgtcttgc

SEQ ID NO: 278643 - DNA, 25 bp, Rattus norvegicus
cttcatctggagaggccatttccaa

SEQ ID NO: 278644 - DNA, 25 bp, Rattus norvegicus
cttcatctggagtggccatttccaa

SEQ ID NO: 278645 - DNA, 25 bp, Rattus norvegicus
cttcatctgtccaatctgtatgtga

SEQ ID NO: 278646 - DNA, 25 bp, Rattus norvegicus
cttcatctgtcctatctgtatgtga

SEQ ID NO: 278647 - DNA, 25 bp, Rattus norvegicus
cttcatcttgttactatcctgtcaa

SEQ ID NO: 278648 - DNA, 25 bp, Rattus norvegicus
cttcatcttgtttctatcctgtcaa

SEQ ID NO: 278649 - DNA, 25 bp, Rattus norvegicus
cttcatctttcacgcttctcttcgg

SEQ ID NO: 278650 - DNA, 25 bp, Rattus norvegicus
cttcatctttcaggcttctcttcgg

SEQ ID NO: 278651 - DNA, 25 bp, Rattus norvegicus
cttcatgacattatcatataaggtt

SEQ ID NO: 278652 - DNA, 25 bp, Rattus norvegicus
cttcatgacattttcatataaggtt

SEQ ID NO: 278653 - DNA, 25 bp, Rattus norvegicus
cttcatgacgccaagccacctgttg

SEQ ID NO: 278654 - DNA, 25 bp, Rattus norvegicus
cttcatgacgcctagccacctgttg

SEQ ID NO: 278655 - DNA, 25 bp, Rattus norvegicus
cttcatgcaacgcagactgcggtgc

SEQ ID NO: 278656 - DNA, 25 bp, Rattus norvegicus
cttcatgcaacggagactgcggtgc

SEQ ID NO: 278657 - DNA, 25 bp, Rattus norvegicus
cttcatgcattcagggttcggattc

SEQ ID NO: 278658 - DNA, 25 bp, Rattus norvegicus
cttcatgcattctgggttcggattc

SEQ ID NO: 278659 - DNA, 25 bp, Rattus norvegicus
cttcatggagttctcagtagccttg

SEQ ID NO: 278660 - DNA, 25 bp, Rattus norvegicus
cttcatggagttgtcagtagccttg

SEQ ID NO: 278661 - DNA, 25 bp, Rattus norvegicus
cttcatggccttcagctgtcataga

SEQ ID NO: 278662 - DNA, 25 bp, Rattus norvegicus
cttcatggccttgagctgtcataga

SEQ ID NO: 278663 - DNA, 25 bp, Rattus norvegicus
cttcatggcgcaccccggaaatgag

SEQ ID NO: 278664 - DNA, 25 bp, Rattus norvegicus
cttcatggcgcagcccggaaatgag

SEQ ID NO: 278665 - DNA, 25 bp, Rattus norvegicus
cttcatgtatgaccctaagaaaagg

SEQ ID NO: 278666 - DNA, 25 bp, Rattus norvegicus
cttcatgtatgagcctaagaaaagg

SEQ ID NO: 278667 - DNA, 25 bp, Rattus norvegicus
cttcatgtcatacccaccatggtga

SEQ ID NO: 278668 - DNA, 25 bp, Rattus norvegicus
cttcatgtcatagccaccatggtga

SEQ ID NO: 278669 - DNA, 25 bp, Rattus norvegicus
cttcatgtctccaaaaggtgcttag

SEQ ID NO: 278670 - DNA, 25 bp, Rattus norvegicus
cttcatgtctcctaaaggtgcttag

SEQ ID NO: 278671 - DNA, 25 bp, Rattus norvegicus
cttcatgttagtaagcaagatgctt

SEQ ID NO: 278672 - DNA, 25 bp, Rattus norvegicus
cttcatgttagttagcaagatgctt

SEQ ID NO: 278673 - DNA, 25 bp, Rattus norvegicus
cttcatgttgttccttgggtactct

SEQ ID NO: 278674 - DNA, 25 bp, Rattus norvegicus
cttcatgttgttgcttgggtactct

SEQ ID NO: 278675 - DNA, 25 bp, Rattus norvegicus
cttcattactctattccgatactgg

SEQ ID NO: 278676 - DNA, 25 bp, Rattus norvegicus
cttcattactcttttccgatactgg

SEQ ID NO: 278677 - DNA, 25 bp, Rattus norvegicus
cttcattcacatactggcatagtcc

SEQ ID NO: 278678 - DNA, 25 bp, Rattus norvegicus
cttcattcacattctggcatagtcc

SEQ ID NO: 278679 - DNA, 25 bp, Rattus norvegicus
cttcattcataacccggagccccgg

SEQ ID NO: 278680 - DNA, 25 bp, Rattus norvegicus
cttcattcataagccggagccccgg

SEQ ID NO: 278681 - DNA, 25 bp, Rattus norvegicus
cttcattcccttctacgtagtttat

SEQ ID NO: 278682 - DNA, 25 bp, Rattus norvegicus
cttcattcccttgtacgtagtttat

SEQ ID NO: 278683 - DNA, 25 bp, Rattus norvegicus
cttcattctcaaagctgacttcctt

SEQ ID NO: 278684 - DNA, 25 bp, Rattus norvegicus
cttcattctcaatgctgacttcctt

SEQ ID NO: 278685 - DNA, 25 bp, Rattus norvegicus
cttcattctcttaaccactttcttg

SEQ ID NO: 278686 - DNA, 25 bp, Rattus norvegicus
cttcattctctttaccactttcttg

SEQ ID NO: 278687 - DNA, 25 bp, Rattus norvegicus
cttcattgacctcaactacatggtc

SEQ ID NO: 278688 - DNA, 25 bp, Rattus norvegicus
cttcattgacctgaactacatggtc

SEQ ID NO: 278689 - DNA, 25 bp, Rattus norvegicus
cttcattgagacactgccccaaaag

SEQ ID NO: 278690 - DNA, 25 bp, Rattus norvegicus
cttcattgagactctgccccaaaag

SEQ ID NO: 278691 - DNA, 25 bp, Rattus norvegicus
cttcatttcctcatcgggttttaga

SEQ ID NO: 278692 - DNA, 25 bp, Rattus norvegicus
cttcatttcctcttcgggttttaga

SEQ ID NO: 278693 - DNA, 25 bp, Rattus norvegicus
cttcatttctctcccctctgagagg

SEQ ID NO: 278694 - DNA, 25 bp, Rattus norvegicus
cttcatttctctgccctctgagagg

SEQ ID NO: 278695 - DNA, 25 bp, Rattus norvegicus
cttcatttgaaaaacttaggctgct

SEQ ID NO: 278696 - DNA, 25 bp, Rattus norvegicus
cttcatttgaaatacttaggctgct

SEQ ID NO: 278697 - DNA, 25 bp, Rattus norvegicus
cttccaaacaggcagcagttaccgg

SEQ ID NO: 278698 - DNA, 25 bp, Rattus norvegicus
cttccaaacagggagcagttaccgg

SEQ ID NO: 278699 - DNA, 25 bp, Rattus norvegicus
cttccaaaggaaagggcagtcccag

SEQ ID NO: 278700 - DNA, 25 bp, Rattus norvegicus
cttccaaaggaatgggcagtcccag

SEQ ID NO: 278701 - DNA, 25 bp, Rattus norvegicus
cttccaaatctcattctcatggttg

SEQ ID NO: 278702 - DNA, 25 bp, Rattus norvegicus
cttccaaatctctttctcatggttg

SEQ ID NO: 278703 - DNA, 25 bp, Rattus norvegicus
cttccaacacttacagactgcatac

SEQ ID NO: 278704 - DNA, 25 bp, Rattus norvegicus
cttccaacactttcagactgcatac

SEQ ID NO: 278705 - DNA, 25 bp, Rattus norvegicus
cttccaacccagaccttgagtagat

SEQ ID NO: 278706 - DNA, 25 bp, Rattus norvegicus
cttccaacccagtccttgagtagat

SEQ ID NO: 278707 - DNA, 25 bp, Rattus norvegicus
cttccaacgacaaactaaaccagct

SEQ ID NO: 278708 - DNA, 25 bp, Rattus norvegicus
cttccaacgacatactaaaccagct

SEQ ID NO: 278709 - DNA, 25 bp, Rattus norvegicus
cttccaacgtatcctgttttgtgca

SEQ ID NO: 278710 - DNA, 25 bp, Rattus norvegicus
cttccaacgtatgctgttttgtgca

SEQ ID NO: 278711 - DNA, 25 bp, Rattus norvegicus
cttccaagaggaacccggagttctg

SEQ ID NO: 278712 - DNA, 25 bp, Rattus norvegicus
cttccaagaggatcccggagttctg

SEQ ID NO: 278713 - DNA, 25 bp, Rattus norvegicus
cttccaaggcctcatctatgcatta

SEQ ID NO: 278714 - DNA, 25 bp, Rattus norvegicus
cttccaaggcctgatctatgcatta

SEQ ID NO: 278715 - DNA, 25 bp, Rattus norvegicus
cttccaagtggacgttctaggcaac

SEQ ID NO: 278716 - DNA, 25 bp, Rattus norvegicus
cttccaagtggaggttctaggcaac

SEQ ID NO: 278717 - DNA, 25 bp, Rattus norvegicus
cttccaagttcaactgcttacacat

SEQ ID NO: 278718 - DNA, 25 bp, Rattus norvegicus
cttccaagttcatctgcttacacat

SEQ ID NO: 278719 - DNA, 25 bp, Rattus norvegicus
cttccaatcatacccagagctgtgc

SEQ ID NO: 278720 - DNA, 25 bp, Rattus norvegicus
cttccaatcatagccagagctgtgc

SEQ ID NO: 278721 - DNA, 25 bp, Rattus norvegicus
cttccaatcttgctttatgggttgt

SEQ ID NO: 278722 - DNA, 25 bp, Rattus norvegicus
cttccaatcttggtttatgggttgt

SEQ ID NO: 278723 - DNA, 25 bp, Rattus norvegicus
cttccacaaaccatcactgcatata

SEQ ID NO: 278724 - DNA, 25 bp, Rattus norvegicus
cttccacaaaccttcactgcatata

SEQ ID NO: 278725 - DNA, 25 bp, Rattus norvegicus
cttccacacctcactataatttatg

SEQ ID NO: 278726 - DNA, 25 bp, Rattus norvegicus
cttccacacctctctataatttatg

SEQ ID NO: 278727 - DNA, 25 bp, Rattus norvegicus
cttccacagtttaattcgatctttt

SEQ ID NO: 278728 - DNA, 25 bp, Rattus norvegicus
cttccacagttttattcgatctttt

SEQ ID NO: 278729 - DNA, 25 bp, Rattus norvegicus
cttccaccactactctatgataggt

SEQ ID NO: 278730 - DNA, 25 bp, Rattus norvegicus
cttccaccactagtctatgataggt

SEQ ID NO: 278731 - DNA, 25 bp, Rattus norvegicus
cttccaccacttccataaacagagg

SEQ ID NO: 278732 - DNA, 25 bp, Rattus norvegicus
cttccaccacttgcataaacagagg

SEQ ID NO: 278733 - DNA, 25 bp, Rattus norvegicus
cttccaccagcacagcctttgaaag

SEQ ID NO: 278734 - DNA, 25 bp, Rattus norvegicus
cttccaccagcagagcctttgaaag

SEQ ID NO: 278735 - DNA, 25 bp, Rattus norvegicus
cttccacccagccatgtaactaaaa

SEQ ID NO: 278736 - DNA, 25 bp, Rattus norvegicus
cttccacccagcgatgtaactaaaa

SEQ ID NO: 278737 - DNA, 25 bp, Rattus norvegicus
cttccacccaggcagttgacagagg

SEQ ID NO: 278738 - DNA, 25 bp, Rattus norvegicus
cttccacccagggagttgacagagg

SEQ ID NO: 278739 - DNA, 25 bp, Rattus norvegicus
cttccacctggaattactgtaacat

SEQ ID NO: 278740 - DNA, 25 bp, Rattus norvegicus
cttccacctggatttactgtaacat

SEQ ID NO: 278741 - DNA, 25 bp, Rattus norvegicus
cttccacgacatcacaaagcgtgct

SEQ ID NO: 278742 - DNA, 25 bp, Rattus norvegicus
cttccacgacatgacaaagcgtgct

SEQ ID NO: 278743 - DNA, 25 bp, Rattus norvegicus
cttccacggtatcctcgatgaaata

SEQ ID NO: 278744 - DNA, 25 bp, Rattus norvegicus
cttccacggtatgctcgatgaaata

SEQ ID NO: 278745 - DNA, 25 bp, Rattus norvegicus
cttccactagaactggaggtgacgg

SEQ ID NO: 278746 - DNA, 25 bp, Rattus norvegicus
cttccactagaagtggaggtgacgg

SEQ ID NO: 278747 - DNA, 25 bp, Rattus norvegicus
cttccactatgcagtgtttgtgcga

SEQ ID NO: 278748 - DNA, 25 bp, Rattus norvegicus
cttccactatgctgtgtttgtgcga

SEQ ID NO: 278749 - DNA, 25 bp, Rattus norvegicus
cttccactggcgcttagggacagaa

SEQ ID NO: 278750 - DNA, 25 bp, Rattus norvegicus
cttccactggcggttagggacagaa

SEQ ID NO: 278751 - DNA, 25 bp, Rattus norvegicus
cttccactttctcttgcttgtggaa

SEQ ID NO: 278752 - DNA, 25 bp, Rattus norvegicus
cttccactttctgttgcttgtggaa

SEQ ID NO: 278753 - DNA, 25 bp, Rattus norvegicus
cttccacttttcagacttccaagaa

SEQ ID NO: 278754 - DNA, 25 bp, Rattus norvegicus
cttccacttttctgacttccaagaa

SEQ ID NO: 278755 - DNA, 25 bp, Rattus norvegicus
cttccagactttagccacattatcg

SEQ ID NO: 278756 - DNA, 25 bp, Rattus norvegicus
cttccagacttttgccacattatcg

SEQ ID NO: 278757 - DNA, 25 bp, Rattus norvegicus
cttccagaggccaggatttggttcc

SEQ ID NO: 278758 - DNA, 25 bp, Rattus norvegicus
cttccagaggcctggatttggttcc

SEQ ID NO: 278759 - DNA, 25 bp, Rattus norvegicus
cttccagagggacggcatgacttca

SEQ ID NO: 278760 - DNA, 25 bp, Rattus norvegicus
cttccagagggagggcatgacttca

SEQ ID NO: 278761 - DNA, 25 bp, Rattus norvegicus
cttccagatgcgagcaggcctgctt

SEQ ID NO: 278762 - DNA, 25 bp, Rattus norvegicus
cttccagatgcgtgcaggcctgctt

SEQ ID NO: 278763 - DNA, 25 bp, Rattus norvegicus
cttccagattaaccccatgtgacag

SEQ ID NO: 278764 - DNA, 25 bp, Rattus norvegicus
cttccagattaagcccatgtgacag

SEQ ID NO: 278765 - DNA, 25 bp, Rattus norvegicus
cttccagccaagctgctgtgagaca

SEQ ID NO: 278766 - DNA, 25 bp, Rattus norvegicus
cttccagccaaggtgctgtgagaca

SEQ ID NO: 278767 - DNA, 25 bp, Rattus norvegicus
cttccagcgattccaagccagaggg

SEQ ID NO: 278768 - DNA, 25 bp, Rattus norvegicus
cttccagcgattgcaagccagaggg

SEQ ID NO: 278769 - DNA, 25 bp, Rattus norvegicus
cttccagcgtgaagtctcagacaaa

SEQ ID NO: 278770 - DNA, 25 bp, Rattus norvegicus
cttccagcgtgatgtctcagacaaa

SEQ ID NO: 278771 - DNA, 25 bp, Rattus norvegicus
cttccagctcttcaggatgtgtgaa

SEQ ID NO: 278772 - DNA, 25 bp, Rattus norvegicus
cttccagctcttgaggatgtgtgaa

SEQ ID NO: 278773 - DNA, 25 bp, Rattus norvegicus
cttccagctgagacacccaagaaag

SEQ ID NO: 278774 - DNA, 25 bp, Rattus norvegicus
cttccagctgagtcacccaagaaag

SEQ ID NO: 278775 - DNA, 25 bp, Rattus norvegicus
cttccagctttgatttgaaccagct

SEQ ID NO: 278776 - DNA, 25 bp, Rattus norvegicus
cttccagctttgttttgaaccagct

SEQ ID NO: 278777 - DNA, 25 bp, Rattus norvegicus
cttccaggaagtaggcagcagggac

SEQ ID NO: 278778 - DNA, 25 bp, Rattus norvegicus
cttccaggaagttggcagcagggac

SEQ ID NO: 278779 - DNA, 25 bp, Rattus norvegicus
cttccaggactcaggcagtgggagt

SEQ ID NO: 278780 - DNA, 25 bp, Rattus norvegicus
cttccaggactctggcagtgggagt

SEQ ID NO: 278781 - DNA, 25 bp, Rattus norvegicus
cttccaggactgctcatgtgggatc

SEQ ID NO: 278782 - DNA, 25 bp, Rattus norvegicus
cttccaggactggtcatgtgggatc

SEQ ID NO: 278783 - DNA, 25 bp, Rattus norvegicus
cttccaggagacctgtccaggaacc

SEQ ID NO: 278784 - DNA, 25 bp, Rattus norvegicus
cttccaggagacgtgtccaggaacc

SEQ ID NO: 278785 - DNA, 25 bp, Rattus norvegicus
cttccaggagcgagatcccgtcaag

SEQ ID NO: 278786 - DNA, 25 bp, Rattus norvegicus
cttccaggagcgtgatcccgtcaag

SEQ ID NO: 278787 - DNA, 25 bp, Rattus norvegicus
cttccaggaggactttcttaaacat

SEQ ID NO: 278788 - DNA, 25 bp, Rattus norvegicus
cttccaggaggagtttcttaaacat

SEQ ID NO: 278789 - DNA, 25 bp, Rattus norvegicus
cttccaggatcacaaactgtggcat

SEQ ID NO: 278790 - DNA, 25 bp, Rattus norvegicus
cttccaggatcagaaactgtggcat

SEQ ID NO: 278791 - DNA, 25 bp, Rattus norvegicus
cttccaggcggacgaggagacctca

SEQ ID NO: 278792 - DNA, 25 bp, Rattus norvegicus
cttccaggcggaggaggagacctca

SEQ ID NO: 278793 - DNA, 25 bp, Rattus norvegicus
cttccagggaggaagagctagttta

SEQ ID NO: 278794 - DNA, 25 bp, Rattus norvegicus
cttccagggaggtagagctagttta

SEQ ID NO: 278795 - DNA, 25 bp, Rattus norvegicus
cttccagggctcaactcaaggtaac

SEQ ID NO: 278796 - DNA, 25 bp, Rattus norvegicus
cttccagggctctactcaaggtaac

SEQ ID NO: 278797 - DNA, 25 bp, Rattus norvegicus
cttccaggtattacaggctgtttcc

SEQ ID NO: 278798 - DNA, 25 bp, Rattus norvegicus
cttccaggtatttcaggctgtttcc

SEQ ID NO: 278799 - DNA, 25 bp, Rattus norvegicus
cttccaggttgcactctgttggata

SEQ ID NO: 278800 - DNA, 25 bp, Rattus norvegicus
cttccaggttgctctctgttggata

SEQ ID NO: 278801 - DNA, 25 bp, Rattus norvegicus
cttccagtgctcatttcaacagaca

SEQ ID NO: 278802 - DNA, 25 bp, Rattus norvegicus
cttccagtgctcttttcaacagaca

SEQ ID NO: 278803 - DNA, 25 bp, Rattus norvegicus
cttccagtgcttcgtgactctggga

SEQ ID NO: 278804 - DNA, 25 bp, Rattus norvegicus
cttccagtgcttggtgactctggga

SEQ ID NO: 278805 - DNA, 25 bp, Rattus norvegicus
cttccagtgggaacagcgtctgtgt

SEQ ID NO: 278806 - DNA, 25 bp, Rattus norvegicus
cttccagtgggatcagcgtctgtgt

SEQ ID NO: 278807 - DNA, 25 bp, Rattus norvegicus
cttccataaattagttgccaccacc

SEQ ID NO: 278808 - DNA, 25 bp, Rattus norvegicus
cttccataaatttgttgccaccacc

SEQ ID NO: 278809 - DNA, 25 bp, Rattus norvegicus
cttccatacggcaaggctgctgtaa

SEQ ID NO: 278810 - DNA, 25 bp, Rattus norvegicus
cttccatacggctaggctgctgtaa

SEQ ID NO: 278811 - DNA, 25 bp, Rattus norvegicus
cttccatagctgaccttactaggga

SEQ ID NO: 278812 - DNA, 25 bp, Rattus norvegicus
cttccatagctgtccttactaggga

SEQ ID NO: 278813 - DNA, 25 bp, Rattus norvegicus
cttccatatagcagtactgtgtgac

SEQ ID NO: 278814 - DNA, 25 bp, Rattus norvegicus
cttccatatagctgtactgtgtgac

SEQ ID NO: 278815 - DNA, 25 bp, Rattus norvegicus
cttccatcaacccttgatctgagat

SEQ ID NO: 278816 - DNA, 25 bp, Rattus norvegicus
cttccatcaaccgttgatctgagat

SEQ ID NO: 278817 - DNA, 25 bp, Rattus norvegicus
cttccatcttctcctaaactgaatg

SEQ ID NO: 278818 - DNA, 25 bp, Rattus norvegicus
cttccatcttctgctaaactgaatg

SEQ ID NO: 278819 - DNA, 25 bp, Rattus norvegicus
cttccatgccctacagtgagagaca

SEQ ID NO: 278820 - DNA, 25 bp, Rattus norvegicus
cttccatgccctctgtgtatattca

SEQ ID NO: 278821 - DNA, 25 bp, Rattus norvegicus
cttccatgccctgtgtgtatattca

SEQ ID NO: 278822 - DNA, 25 bp, Rattus norvegicus
cttccatgcccttcagtgagagaca

SEQ ID NO: 278823 - DNA, 25 bp, Rattus norvegicus
cttccatgcctgcacctgggtcggg

SEQ ID NO: 278824 - DNA, 25 bp, Rattus norvegicus
cttccatgcctggacctgggtcggg

SEQ ID NO: 278825 - DNA, 25 bp, Rattus norvegicus
cttccatgctcaccctatttagtga

SEQ ID NO: 278826 - DNA, 25 bp, Rattus norvegicus
cttccatgctcagcctatttagtga

SEQ ID NO: 278827 - DNA, 25 bp, Rattus norvegicus
cttccatggtgtcgttctgggcttg

SEQ ID NO: 278828 - DNA, 25 bp, Rattus norvegicus
cttccatggtgtggttctgggcttg

SEQ ID NO: 278829 - DNA, 25 bp, Rattus norvegicus
cttccatggttcctgtcatttgaaa

SEQ ID NO: 278830 - DNA, 25 bp, Rattus norvegicus
cttccatggttcgtgtcatttgaaa

SEQ ID NO: 278831 - DNA, 25 bp, Rattus norvegicus
cttccattaacaacatctctcattc

SEQ ID NO: 278832 - DNA, 25 bp, Rattus norvegicus
cttccattaacatcatctctcattc

SEQ ID NO: 278833 - DNA, 25 bp, Rattus norvegicus
cttccattaagcctgggctgagtga

SEQ ID NO: 278834 - DNA, 25 bp, Rattus norvegicus
cttccattaagcgtgggctgagtga

SEQ ID NO: 278835 - DNA, 25 bp, Rattus norvegicus
cttccattgacgcagttttcctaaa

SEQ ID NO: 278836 - DNA, 25 bp, Rattus norvegicus
cttccattgacggagttttcctaaa

SEQ ID NO: 278837 - DNA, 25 bp, Rattus norvegicus
cttccattgagacgcagtccgcata

SEQ ID NO: 278838 - DNA, 25 bp, Rattus norvegicus
cttccattgagacgctgttcgtctt

SEQ ID NO: 278839 - DNA, 25 bp, Rattus norvegicus
cttccattgagaggcagtccgcata

SEQ ID NO: 278840 - DNA, 25 bp, Rattus norvegicus
cttccattgagaggctgttcgtctt

SEQ ID NO: 278841 - DNA, 25 bp, Rattus norvegicus
cttccattgctgatggttttaaaat

SEQ ID NO: 278842 - DNA, 25 bp, Rattus norvegicus
cttccattgctgttggttttaaaat

SEQ ID NO: 278843 - DNA, 25 bp, Rattus norvegicus
cttcccacagcacaatcaagctaat

SEQ ID NO: 278844 - DNA, 25 bp, Rattus norvegicus
cttcccacagcagaatcaagctaat

SEQ ID NO: 278845 - DNA, 25 bp, Rattus norvegicus
cttcccaccaagactaacagttcag

SEQ ID NO: 278846 - DNA, 25 bp, Rattus norvegicus
cttcccaccaagtctaacagttcag

SEQ ID NO: 278847 - DNA, 25 bp, Rattus norvegicus
cttcccactagtacattcgtttact

SEQ ID NO: 278848 - DNA, 25 bp, Rattus norvegicus
cttcccactagttcattcgtttact

SEQ ID NO: 278849 - DNA, 25 bp, Rattus norvegicus
cttcccactcttccaggattaatat

SEQ ID NO: 278850 - DNA, 25 bp, Rattus norvegicus
cttcccactcttgcaggattaatat

SEQ ID NO: 278851 - DNA, 25 bp, Rattus norvegicus
cttcccagaacccttctcagtaaag

SEQ ID NO: 278852 - DNA, 25 bp, Rattus norvegicus
cttcccagaaccgttctcagtaaag

SEQ ID NO: 278853 - DNA, 25 bp, Rattus norvegicus
cttcccagagcgactgaatttgcat

SEQ ID NO: 278854 - DNA, 25 bp, Rattus norvegicus
cttcccagagcgtctgaatttgcat

SEQ ID NO: 278855 - DNA, 25 bp, Rattus norvegicus
cttcccagatgcctagagttgaaag

SEQ ID NO: 278856 - DNA, 25 bp, Rattus norvegicus
cttcccagatgcgtagagttgaaag

SEQ ID NO: 278857 - DNA, 25 bp, Rattus norvegicus
cttcccagccggatggagttcaagt

SEQ ID NO: 278858 - DNA, 25 bp, Rattus norvegicus
cttcccagccggttggagttcaagt

SEQ ID NO: 278859 - DNA, 25 bp, Rattus norvegicus
cttcccagccttactgtttggataa

SEQ ID NO: 278860 - DNA, 25 bp, Rattus norvegicus
cttcccagcctttctgtttggataa

SEQ ID NO: 278861 - DNA, 25 bp, Rattus norvegicus
cttcccagcgttacgggcacatgtg

SEQ ID NO: 278862 - DNA, 25 bp, Rattus norvegicus
cttcccagcgtttcgggcacatgtg

SEQ ID NO: 278863 - DNA, 25 bp, Rattus norvegicus
cttcccagggaacttgcaaacagac

SEQ ID NO: 278864 - DNA, 25 bp, Rattus norvegicus
cttcccagggaagttgcaaacagac

SEQ ID NO: 278865 - DNA, 25 bp, Rattus norvegicus
cttcccagttggaagctgctgcatt

SEQ ID NO: 278866 - DNA, 25 bp, Rattus norvegicus
cttcccagttggtagctgctgcatt

SEQ ID NO: 278867 - DNA, 25 bp, Rattus norvegicus
cttcccataaggatgtcagcgatgt

SEQ ID NO: 278868 - DNA, 25 bp, Rattus norvegicus
cttcccataaggttgtcagcgatgt

SEQ ID NO: 278869 - DNA, 25 bp, Rattus norvegicus
cttcccataccacggtgacagaact

SEQ ID NO: 278870 - DNA, 25 bp, Rattus norvegicus
cttcccataccagggtgacagaact

SEQ ID NO: 278871 - DNA, 25 bp, Rattus norvegicus
cttcccatgacgatgcagtattttt

SEQ ID NO: 278872 - DNA, 25 bp, Rattus norvegicus
cttcccatgacgttgcagtattttt

SEQ ID NO: 278873 - DNA, 25 bp, Rattus norvegicus
cttcccatgtacagctcggtatgat

SEQ ID NO: 278874 - DNA, 25 bp, Rattus norvegicus
cttcccatgtactgctcggtatgat

SEQ ID NO: 278875 - DNA, 25 bp, Rattus norvegicus
cttcccatgtctcttgtgtcaagga

SEQ ID NO: 278876 - DNA, 25 bp, Rattus norvegicus
cttcccatgtctgttgtgtcaagga

SEQ ID NO: 278877 - DNA, 25 bp, Rattus norvegicus
cttcccattcaaaatttagtgtcag

SEQ ID NO: 278878 - DNA, 25 bp, Rattus norvegicus
cttcccattcaatatttagtgtcag

SEQ ID NO: 278879 - DNA, 25 bp, Rattus norvegicus
cttcccattcctactgtggatgaag

SEQ ID NO: 278880 - DNA, 25 bp, Rattus norvegicus
cttcccattccttctgtggatgaag

SEQ ID NO: 278881 - DNA, 25 bp, Rattus norvegicus
cttccccaacaacagtttcatggat

SEQ ID NO: 278882 - DNA, 25 bp, Rattus norvegicus
cttccccaacaagagtttcatggat

SEQ ID NO: 278883 - DNA, 25 bp, Rattus norvegicus
cttccccaagtgacggagactgtat

SEQ ID NO: 278884 - DNA, 25 bp, Rattus norvegicus
cttccccaagtgtcggagactgtat

SEQ ID NO: 278885 - DNA, 25 bp, Rattus norvegicus
cttccccacacacagatcagttatt

SEQ ID NO: 278886 - DNA, 25 bp, Rattus norvegicus
cttccccacacagagatcagttatt

SEQ ID NO: 278887 - DNA, 25 bp, Rattus norvegicus
cttccccacttaactattgtgtggt

SEQ ID NO: 278888 - DNA, 25 bp, Rattus norvegicus
cttccccacttatctattgtgtggt

SEQ ID NO: 278889 - DNA, 25 bp, Rattus norvegicus
cttccccatgacattgtacgtcagg

SEQ ID NO: 278890 - DNA, 25 bp, Rattus norvegicus
cttccccatgactttgtacgtcagg

SEQ ID NO: 278891 - DNA, 25 bp, Rattus norvegicus
cttccccattgtccagctgaggttt

SEQ ID NO: 278892 - DNA, 25 bp, Rattus norvegicus
cttccccattgtgcagctgaggttt

SEQ ID NO: 278893 - DNA, 25 bp, Rattus norvegicus
cttcccccagctaaagagactttga

SEQ ID NO: 278894 - DNA, 25 bp, Rattus norvegicus
cttcccccagcttaagagactttga

SEQ ID NO: 278895 - DNA, 25 bp, Rattus norvegicus
cttccccgcacaagtcaacaataaa

SEQ ID NO: 278896 - DNA, 25 bp, Rattus norvegicus
cttccccgcacatgtcaacaataaa

SEQ ID NO: 278897 - DNA, 25 bp, Rattus norvegicus
cttccccgtggtaaatgtttgcgat

SEQ ID NO: 278898 - DNA, 25 bp, Rattus norvegicus
cttccccgtggttaatgtttgcgat

SEQ ID NO: 278899 - DNA, 25 bp, Rattus norvegicus
cttccccgtgtgagtgcaaggagga

SEQ ID NO: 278900 - DNA, 25 bp, Rattus norvegicus
cttccccgtgtgtgtgcaaggagga

SEQ ID NO: 278901 - DNA, 25 bp, Rattus norvegicus
cttcccctaaggatgtccagacaag

SEQ ID NO: 278902 - DNA, 25 bp, Rattus norvegicus
cttcccctaaggttgtccagacaag

SEQ ID NO: 278903 - DNA, 25 bp, Rattus norvegicus
cttcccctgagaaatcaccttttaa

SEQ ID NO: 278904 - DNA, 25 bp, Rattus norvegicus
cttcccctgagatatcaccttttaa

SEQ ID NO: 278905 - DNA, 25 bp, Rattus norvegicus
cttcccctgtccatttactaagatt

SEQ ID NO: 278906 - DNA, 25 bp, Rattus norvegicus
cttcccctgtccttttactaagatt

SEQ ID NO: 278907 - DNA, 25 bp, Rattus norvegicus
cttccccttctgagaaatgtcagca

SEQ ID NO: 278908 - DNA, 25 bp, Rattus norvegicus
cttccccttctgtgaaatgtcagca

SEQ ID NO: 278909 - DNA, 25 bp, Rattus norvegicus
cttccccttttacatggtttctatg

SEQ ID NO: 278910 - DNA, 25 bp, Rattus norvegicus
cttccccttttagatggtttctatg

SEQ ID NO: 278911 - DNA, 25 bp, Rattus norvegicus
cttcccgaaagcatgtgaccagttt

SEQ ID NO: 278912 - DNA, 25 bp, Rattus norvegicus
cttcccgaaagcttgtgaccagttt

SEQ ID NO: 278913 - DNA, 25 bp, Rattus norvegicus
cttcccgaatatctaatgtgtgcct

SEQ ID NO: 278914 - DNA, 25 bp, Rattus norvegicus
cttcccgaatatgtaatgtgtgcct

SEQ ID NO: 278915 - DNA, 25 bp, Rattus norvegicus
cttcccgcaagacgcaggcgtcaga

SEQ ID NO: 278916 - DNA, 25 bp, Rattus norvegicus
cttcccgcaagaggcaggcgtcaga

SEQ ID NO: 278917 - DNA, 25 bp, Rattus norvegicus
cttcccggcaaacacagtaatctga

SEQ ID NO: 278918 - DNA, 25 bp, Rattus norvegicus
cttcccggcaaagacagtaatctga

SEQ ID NO: 278919 - DNA, 25 bp, Rattus norvegicus
cttcccggctgcacgagtcagtttc

SEQ ID NO: 278920 - DNA, 25 bp, Rattus norvegicus
cttcccggctgctcgagtcagtttc

SEQ ID NO: 278921 - DNA, 25 bp, Rattus norvegicus
cttcccgggactccatggtggagat

SEQ ID NO: 278922 - DNA, 25 bp, Rattus norvegicus
cttcccgggactgcatggtggagat

SEQ ID NO: 278923 - DNA, 25 bp, Rattus norvegicus
cttcccgtggtgcacttttatgtca

SEQ ID NO: 278924 - DNA, 25 bp, Rattus norvegicus
cttcccgtggtggacttttatgtca

SEQ ID NO: 278925 - DNA, 25 bp, Rattus norvegicus
cttccctaaggaacatggtggcaca

SEQ ID NO: 278926 - DNA, 25 bp, Rattus norvegicus
cttccctaaggaaggtggcctcaat

SEQ ID NO: 278927 - DNA, 25 bp, Rattus norvegicus
cttccctaaggatcatggtggcaca

SEQ ID NO: 278928 - DNA, 25 bp, Rattus norvegicus
cttccctaaggatggtggcctcaat

SEQ ID NO: 278929 - DNA, 25 bp, Rattus norvegicus
cttccctaagtgagctccagcagtg

SEQ ID NO: 278930 - DNA, 25 bp, Rattus norvegicus
cttccctaagtgtgctccagcagtg

SEQ ID NO: 278931 - DNA, 25 bp, Rattus norvegicus
cttccctactaaacccatgacaata

SEQ ID NO: 278932 - DNA, 25 bp, Rattus norvegicus
cttccctactaatcccatgacaata

SEQ ID NO: 278933 - DNA, 25 bp, Rattus norvegicus
cttccctagaggcagagggctcaga

SEQ ID NO: 278934 - DNA, 25 bp, Rattus norvegicus
cttccctagagggagagggctcaga

SEQ ID NO: 278935 - DNA, 25 bp, Rattus norvegicus
cttccctatccaccaagatgtagaa

SEQ ID NO: 278936 - DNA, 25 bp, Rattus norvegicus
cttccctatccagcaagatgtagaa

SEQ ID NO: 278937 - DNA, 25 bp, Rattus norvegicus
cttccctcaacacattgtctttggg

SEQ ID NO: 278938 - DNA, 25 bp, Rattus norvegicus
cttccctcaacagattgtctttggg

SEQ ID NO: 278939 - DNA, 25 bp, Rattus norvegicus
cttccctccaacaagaggcgagatt

SEQ ID NO: 278940 - DNA, 25 bp, Rattus norvegicus
cttccctccaactagaggcgagatt

SEQ ID NO: 278941 - DNA, 25 bp, Rattus norvegicus
cttccctcttctattatatgcaggc

SEQ ID NO: 278942 - DNA, 25 bp, Rattus norvegicus
cttccctcttcttttatatgcaggc

SEQ ID NO: 278943 - DNA, 25 bp, Rattus norvegicus
cttccctctttgagtgttcatagga

SEQ ID NO: 278944 - DNA, 25 bp, Rattus norvegicus
cttccctctttgtgtgttcatagga

SEQ ID NO: 278945 - DNA, 25 bp, Rattus norvegicus
cttccctcttttacacacaggatga

SEQ ID NO: 278946 - DNA, 25 bp, Rattus norvegicus
cttccctcttttcgtcttcatgaat

SEQ ID NO: 278947 - DNA, 25 bp, Rattus norvegicus
cttccctcttttggtcttcatgaat

SEQ ID NO: 278948 - DNA, 25 bp, Rattus norvegicus
cttccctctttttcacacaggatga

SEQ ID NO: 278949 - DNA, 25 bp, Rattus norvegicus
cttccctgatgacttgctatcaatc

SEQ ID NO: 278950 - DNA, 25 bp, Rattus norvegicus
cttccctgatgagttgctatcaatc

SEQ ID NO: 278951 - DNA, 25 bp, Rattus norvegicus
cttccctgcgaaagcactacattaa

SEQ ID NO: 278952 - DNA, 25 bp, Rattus norvegicus
cttccctgcgaatgcactacattaa

SEQ ID NO: 278953 - DNA, 25 bp, Rattus norvegicus
cttccctggagtattacacacactg

SEQ ID NO: 278954 - DNA, 25 bp, Rattus norvegicus
cttccctggagttttacacacactg

SEQ ID NO: 278955 - DNA, 25 bp, Rattus norvegicus
cttccctgggaaccctttaacactg

SEQ ID NO: 278956 - DNA, 25 bp, Rattus norvegicus
cttccctgggaagcctttaacactg

SEQ ID NO: 278957 - DNA, 25 bp, Rattus norvegicus
cttccctgggatcttttctgatact

SEQ ID NO: 278958 - DNA, 25 bp, Rattus norvegicus
cttccctgggatgttttctgatact

SEQ ID NO: 278959 - DNA, 25 bp, Rattus norvegicus
cttccctgtggtcacttttgtttga

SEQ ID NO: 278960 - DNA, 25 bp, Rattus norvegicus
cttccctgtggtgacttttgtttga

SEQ ID NO: 278961 - DNA, 25 bp, Rattus norvegicus
cttcccttacctaacttattctatg

SEQ ID NO: 278962 - DNA, 25 bp, Rattus norvegicus
cttcccttaccttacttattctatg

SEQ ID NO: 278963 - DNA, 25 bp, Rattus norvegicus
cttcccttcaagacttacaaacctg

SEQ ID NO: 278964 - DNA, 25 bp, Rattus norvegicus
cttcccttcaagatggtcagatcta

SEQ ID NO: 278965 - DNA, 25 bp, Rattus norvegicus
cttcccttcaagtcttacaaacctg

SEQ ID NO: 278966 - DNA, 25 bp, Rattus norvegicus
cttcccttcaagttggtcagatcta

SEQ ID NO: 278967 - DNA, 25 bp, Rattus norvegicus
cttcccttcacgcttgattaacagg

SEQ ID NO: 278968 - DNA, 25 bp, Rattus norvegicus
cttcccttcacggttgattaacagg

SEQ ID NO: 278969 - DNA, 25 bp, Rattus norvegicus
cttcccttcagcaggcatcattgaa

SEQ ID NO: 278970 - DNA, 25 bp, Rattus norvegicus
cttcccttcagctggcatcattgaa

SEQ ID NO: 278971 - DNA, 25 bp, Rattus norvegicus
cttcccttcttcagatgttagtcta

SEQ ID NO: 278972 - DNA, 25 bp, Rattus norvegicus
cttcccttcttctgatgttagtcta

SEQ ID NO: 278973 - DNA, 25 bp, Rattus norvegicus
cttcccttggtcagaatctgtctca

SEQ ID NO: 278974 - DNA, 25 bp, Rattus norvegicus
cttcccttggtctgaatctgtctca

SEQ ID NO: 278975 - DNA, 25 bp, Rattus norvegicus
cttcccttggttctgtctctgctaa

SEQ ID NO: 278976 - DNA, 25 bp, Rattus norvegicus
cttcccttggttgtgtctctgctaa

SEQ ID NO: 278977 - DNA, 25 bp, Rattus norvegicus
cttcccttttctctcataaatggca

SEQ ID NO: 278978 - DNA, 25 bp, Rattus norvegicus
cttcccttttctgtcataaatggca

SEQ ID NO: 278979 - DNA, 25 bp, Rattus norvegicus
cttccgaacattcctgtgtcattta

SEQ ID NO: 278980 - DNA, 25 bp, Rattus norvegicus
cttccgaacattgctgtgtcattta

SEQ ID NO: 278981 - DNA, 25 bp, Rattus norvegicus
cttccgaagatgctttgcgagttct

SEQ ID NO: 278982 - DNA, 25 bp, Rattus norvegicus
cttccgaagatggtttgcgagttct

SEQ ID NO: 278983 - DNA, 25 bp, Rattus norvegicus
cttccgaatccgcaagactgtcagg

SEQ ID NO: 278984 - DNA, 25 bp, Rattus norvegicus
cttccgaatccggaagactgtcagg

SEQ ID NO: 278985 - DNA, 25 bp, Rattus norvegicus
cttccgagagggactagtcaccaag

SEQ ID NO: 278986 - DNA, 25 bp, Rattus norvegicus
cttccgagagggtctagtcaccaag

SEQ ID NO: 278987 - DNA, 25 bp, Rattus norvegicus
cttccgcacgagctgaaccaataaa

SEQ ID NO: 278988 - DNA, 25 bp, Rattus norvegicus
cttccgcacgaggtgaaccaataaa

SEQ ID NO: 278989 - DNA, 25 bp, Rattus norvegicus
cttccggaattactctctggatgaa

SEQ ID NO: 278990 - DNA, 25 bp, Rattus norvegicus
cttccggaattagtctctggatgaa

SEQ ID NO: 278991 - DNA, 25 bp, Rattus norvegicus
cttccggaccggatcttgagtggga

SEQ ID NO: 278992 - DNA, 25 bp, Rattus norvegicus
cttccggaccggttcttgagtggga

SEQ ID NO: 278993 - DNA, 25 bp, Rattus norvegicus
cttccggatcgcaggttccagaaga

SEQ ID NO: 278994 - DNA, 25 bp, Rattus norvegicus
cttccggatcgctggttccagaaga

SEQ ID NO: 278995 - DNA, 25 bp, Rattus norvegicus
cttccggcctggagcactgggatga

SEQ ID NO: 278996 - DNA, 25 bp, Rattus norvegicus
cttccggcctggtgcactgggatga

SEQ ID NO: 278997 - DNA, 25 bp, Rattus norvegicus
cttccggctgcacccctggttgagg

SEQ ID NO: 278998 - DNA, 25 bp, Rattus norvegicus
cttccggctgcagccctggttgagg

SEQ ID NO: 278999 - DNA, 25 bp, Rattus norvegicus
cttccggcttgtagaggtggctcag

SEQ ID NO: 279000 - DNA, 25 bp, Rattus norvegicus
cttccggcttgttgaggtggctcag

SEQ ID NO: 279001 - DNA, 25 bp, Rattus norvegicus
cttccggctttacttccagttgaag

SEQ ID NO: 279002 - DNA, 25 bp, Rattus norvegicus
cttccggctttagttccagttgaag

SEQ ID NO: 279003 - DNA, 25 bp, Rattus norvegicus
cttccgggagaaccagctagcactg

SEQ ID NO: 279004 - DNA, 25 bp, Rattus norvegicus
cttccgggagaagcagctagcactg

SEQ ID NO: 279005 - DNA, 25 bp, Rattus norvegicus
cttccggtcaggctctttgaaactg

SEQ ID NO: 279006 - DNA, 25 bp, Rattus norvegicus
cttccggtcagggtctttgaaactg

SEQ ID NO: 279007 - DNA, 25 bp, Rattus norvegicus
cttccggtccaacgaggtacagctc

SEQ ID NO: 279008 - DNA, 25 bp, Rattus norvegicus
cttccggtccaaggaggtacagctc

SEQ ID NO: 279009 - DNA, 25 bp, Rattus norvegicus
cttccggttctgatgattgtgacta

SEQ ID NO: 279010 - DNA, 25 bp, Rattus norvegicus
cttccggttctgttgattgtgacta

SEQ ID NO: 279011 - DNA, 25 bp, Rattus norvegicus
cttccgtctgctcagtattttgatt

SEQ ID NO: 279012 - DNA, 25 bp, Rattus norvegicus
cttccgtctgctgagtattttgatt

SEQ ID NO: 279013 - DNA, 25 bp, Rattus norvegicus
cttccgtgagacattacgtccagga

SEQ ID NO: 279014 - DNA, 25 bp, Rattus norvegicus
cttccgtgagactttacgtccagga

SEQ ID NO: 279015 - DNA, 25 bp, Rattus norvegicus
cttccgtgaggtagtccaggctgtg

SEQ ID NO: 279016 - DNA, 25 bp, Rattus norvegicus
cttccgtgaggttgtccaggctgtg

SEQ ID NO: 279017 - DNA, 25 bp, Rattus norvegicus
cttccgttattcaccattctacata

SEQ ID NO: 279018 - DNA, 25 bp, Rattus norvegicus
cttccgttattctccattctacata

SEQ ID NO: 279019 - DNA, 25 bp, Rattus norvegicus
cttccgttctatccttacctgtaaa

SEQ ID NO: 279020 - DNA, 25 bp, Rattus norvegicus
cttccgttctatgcttacctgtaaa

SEQ ID NO: 279021 - DNA, 25 bp, Rattus norvegicus
cttccgttctgtcgacatgtctgat

SEQ ID NO: 279022 - DNA, 25 bp, Rattus norvegicus
cttccgttctgtggacatgtctgat

SEQ ID NO: 279023 - DNA, 25 bp, Rattus norvegicus
cttcctaccctgaaggagcaaaata

SEQ ID NO: 279024 - DNA, 25 bp, Rattus norvegicus
cttcctaccctgtaggagcaaaata

SEQ ID NO: 279025 - DNA, 25 bp, Rattus norvegicus
cttcctacctcacatgatcaagatt

SEQ ID NO: 279026 - DNA, 25 bp, Rattus norvegicus
cttcctacctcagatgatcaagatt

SEQ ID NO: 279027 - DNA, 25 bp, Rattus norvegicus
cttcctactattcctgtcatgctga

SEQ ID NO: 279028 - DNA, 25 bp, Rattus norvegicus
cttcctactattgctgtcatgctga

SEQ ID NO: 279029 - DNA, 25 bp, Rattus norvegicus
cttcctactgaaatgtgagctatta

SEQ ID NO: 279030 - DNA, 25 bp, Rattus norvegicus
cttcctactgaattgtgagctatta

SEQ ID NO: 279031 - DNA, 25 bp, Rattus norvegicus
cttcctactgcacaaaggccgggca

SEQ ID NO: 279032 - DNA, 25 bp, Rattus norvegicus
cttcctactgcagaaaggccgggca

SEQ ID NO: 279033 - DNA, 25 bp, Rattus norvegicus
cttcctagaggacctgaccagagtg

SEQ ID NO: 279034 - DNA, 25 bp, Rattus norvegicus
cttcctagaggagctgaccagagtg

SEQ ID NO: 279035 - DNA, 25 bp, Rattus norvegicus
cttcctagcttgctcttgcaaatgc

SEQ ID NO: 279036 - DNA, 25 bp, Rattus norvegicus
cttcctagcttggtcttgcaaatgc

SEQ ID NO: 279037 - DNA, 25 bp, Rattus norvegicus
cttcctaggcatcacggacgaggtg

SEQ ID NO: 279038 - DNA, 25 bp, Rattus norvegicus
cttcctaggcatgacggacgaggtg

SEQ ID NO: 279039 - DNA, 25 bp, Rattus norvegicus
cttcctatagttccggcactctggg

SEQ ID NO: 279040 - DNA, 25 bp, Rattus norvegicus
cttcctatagttgcggcactctggg

SEQ ID NO: 279041 - DNA, 25 bp, Rattus norvegicus
cttcctatccgcacaaagatgtcat

SEQ ID NO: 279042 - DNA, 25 bp, Rattus norvegicus
cttcctatccgctcaaagatgtcat

SEQ ID NO: 279043 - DNA, 25 bp, Rattus norvegicus
cttcctatctccagatcttttgatt

SEQ ID NO: 279044 - DNA, 25 bp, Rattus norvegicus
cttcctatctcctgatcttttgatt

SEQ ID NO: 279045 - DNA, 25 bp, Rattus norvegicus
cttcctatcttccaagtctcatgaa

SEQ ID NO: 279046 - DNA, 25 bp, Rattus norvegicus
cttcctatcttcgaagtctcatgaa

SEQ ID NO: 279047 - DNA, 25 bp, Rattus norvegicus
cttcctatgctccatagcttggatt

SEQ ID NO: 279048 - DNA, 25 bp, Rattus norvegicus
cttcctatgctcgatagcttggatt

SEQ ID NO: 279049 - DNA, 25 bp, Rattus norvegicus
cttcctatggtaacttcgtctttcg

SEQ ID NO: 279050 - DNA, 25 bp, Rattus norvegicus
cttcctatggtatcttcgtctttcg

SEQ ID NO: 279051 - DNA, 25 bp, Rattus norvegicus
cttcctcaagaaatagtggtcgctc

SEQ ID NO: 279052 - DNA, 25 bp, Rattus norvegicus
cttcctcaagaattagtggtcgctc

SEQ ID NO: 279053 - DNA, 25 bp, Rattus norvegicus
cttcctcaagagaactagccagcag

SEQ ID NO: 279054 - DNA, 25 bp, Rattus norvegicus
cttcctcaagagtactagccagcag

SEQ ID NO: 279055 - DNA, 25 bp, Rattus norvegicus
cttcctcaagatcgccgaggtgggc

SEQ ID NO: 279056 - DNA, 25 bp, Rattus norvegicus
cttcctcaagatggccgaggtgggc

SEQ ID NO: 279057 - DNA, 25 bp, Rattus norvegicus
cttcctcacctgcaagtggtgacca

SEQ ID NO: 279058 - DNA, 25 bp, Rattus norvegicus
cttcctcacctggaagtggtgacca

SEQ ID NO: 279059 - DNA, 25 bp, Rattus norvegicus
cttcctcagaatcgagatccggcta

SEQ ID NO: 279060 - DNA, 25 bp, Rattus norvegicus
cttcctcagaatggagatccggcta

SEQ ID NO: 279061 - DNA, 25 bp, Rattus norvegicus
cttcctcagggcacttactaaaaga

SEQ ID NO: 279062 - DNA, 25 bp, Rattus norvegicus
cttcctcagggctcttactaaaaga

SEQ ID NO: 279063 - DNA, 25 bp, Rattus norvegicus
cttcctcagtgccaggattcaggga

SEQ ID NO: 279064 - DNA, 25 bp, Rattus norvegicus
cttcctcagtgcgaggattcaggga

SEQ ID NO: 279065 - DNA, 25 bp, Rattus norvegicus
cttcctcatgctatagccctttaat

SEQ ID NO: 279066 - DNA, 25 bp, Rattus norvegicus
cttcctcatgctttagccctttaat

SEQ ID NO: 279067 - DNA, 25 bp, Rattus norvegicus
cttcctcatgtaaccataccagtga

SEQ ID NO: 279068 - DNA, 25 bp, Rattus norvegicus
cttcctcatgtatccataccagtga

SEQ ID NO: 279069 - DNA, 25 bp, Rattus norvegicus
cttcctcatttgcttcccaaagaga

SEQ ID NO: 279070 - DNA, 25 bp, Rattus norvegicus
cttcctcatttggttcccaaagaga

SEQ ID NO: 279071 - DNA, 25 bp, Rattus norvegicus
cttcctcattttcctgcaatggatg

SEQ ID NO: 279072 - DNA, 25 bp, Rattus norvegicus
cttcctcattttgctgcaatggatg

SEQ ID NO: 279073 - DNA, 25 bp, Rattus norvegicus
cttcctccaatcatcagtacaaatc

SEQ ID NO: 279074 - DNA, 25 bp, Rattus norvegicus
cttcctccaatcttcagtacaaatc

SEQ ID NO: 279075 - DNA, 25 bp, Rattus norvegicus
cttcctccatttagtgttctttgta

SEQ ID NO: 279076 - DNA, 25 bp, Rattus norvegicus
cttcctccattttgtgttctttgta

SEQ ID NO: 279077 - DNA, 25 bp, Rattus norvegicus
cttcctcccacactggcagaatcag

SEQ ID NO: 279078 - DNA, 25 bp, Rattus norvegicus
cttcctcccacagtggcagaatcag

SEQ ID NO: 279079 - DNA, 25 bp, Rattus norvegicus
cttcctccctgaagtacagttggga

SEQ ID NO: 279080 - DNA, 25 bp, Rattus norvegicus
cttcctccctgatgtacagttggga

SEQ ID NO: 279081 - DNA, 25 bp, Rattus norvegicus
cttcctcccttaaggctttgttatg

SEQ ID NO: 279082 - DNA, 25 bp, Rattus norvegicus
cttcctcccttatggctttgttatg

SEQ ID NO: 279083 - DNA, 25 bp, Rattus norvegicus
cttcctcccttcatgcaataataat

SEQ ID NO: 279084 - DNA, 25 bp, Rattus norvegicus
cttcctcccttcttgcaataataat

SEQ ID NO: 279085 - DNA, 25 bp, Rattus norvegicus
cttcctcgcctgataatggagcagt

SEQ ID NO: 279086 - DNA, 25 bp, Rattus norvegicus
cttcctcgcctgttaatggagcagt

SEQ ID NO: 279087 - DNA, 25 bp, Rattus norvegicus
cttcctcggacactgacattaatga

SEQ ID NO: 279088 - DNA, 25 bp, Rattus norvegicus
cttcctcggacagtgacattaatga

SEQ ID NO: 279089 - DNA, 25 bp, Rattus norvegicus
cttcctcgggttcaaagctggattt

SEQ ID NO: 279090 - DNA, 25 bp, Rattus norvegicus
cttcctcgggttcttctgatgatga

SEQ ID NO: 279091 - DNA, 25 bp, Rattus norvegicus
cttcctcgggttgaaagctggattt

SEQ ID NO: 279092 - DNA, 25 bp, Rattus norvegicus
cttcctcgggttgttctgatgatga

SEQ ID NO: 279093 - DNA, 25 bp, Rattus norvegicus
cttcctcggtaaacagacttaacat

SEQ ID NO: 279094 - DNA, 25 bp, Rattus norvegicus
cttcctcggtaatcagacttaacat

SEQ ID NO: 279095 - DNA, 25 bp, Rattus norvegicus
cttcctcgtctaatccatgtaaatg

SEQ ID NO: 279096 - DNA, 25 bp, Rattus norvegicus
cttcctcgtctattccatgtaaatg

SEQ ID NO: 279097 - DNA, 25 bp, Rattus norvegicus
cttcctcgttctaccagtatttgta

SEQ ID NO: 279098 - DNA, 25 bp, Rattus norvegicus
cttcctcgttcttccagtatttgta

SEQ ID NO: 279099 - DNA, 25 bp, Rattus norvegicus
cttcctctacatacttcctcatagt

SEQ ID NO: 279100 - DNA, 25 bp, Rattus norvegicus
cttcctctacattcttcctcatagt

SEQ ID NO: 279101 - DNA, 25 bp, Rattus norvegicus
cttcctctcatcctcagacattaga

SEQ ID NO: 279102 - DNA, 25 bp, Rattus norvegicus
cttcctctcatcgtcagacattaga

SEQ ID NO: 279103 - DNA, 25 bp, Rattus norvegicus
cttcctctcattctatgggatccaa

SEQ ID NO: 279104 - DNA, 25 bp, Rattus norvegicus
cttcctctcattgtatgggatccaa

SEQ ID NO: 279105 - DNA, 25 bp, Rattus norvegicus
cttcctctctaacaccagggtggta

SEQ ID NO: 279106 - DNA, 25 bp, Rattus norvegicus
cttcctctctaagaccagggtggta

SEQ ID NO: 279107 - DNA, 25 bp, Rattus norvegicus
cttcctctctagacctttatcataa

SEQ ID NO: 279108 - DNA, 25 bp, Rattus norvegicus
cttcctctctagtcctttatcataa

SEQ ID NO: 279109 - DNA, 25 bp, Rattus norvegicus
cttcctctgaatatgggcacactga

SEQ ID NO: 279110 - DNA, 25 bp, Rattus norvegicus
cttcctctgaatttgggcacactga

SEQ ID NO: 279111 - DNA, 25 bp, Rattus norvegicus
cttcctctgagcagtgttagtgttt

SEQ ID NO: 279112 - DNA, 25 bp, Rattus norvegicus
cttcctctgagctgtgttagtgttt

SEQ ID NO: 279113 - DNA, 25 bp, Rattus norvegicus
cttcctctgcctacttttgtttttg

SEQ ID NO: 279114 - DNA, 25 bp, Rattus norvegicus
cttcctctgccttcttttgtttttg

SEQ ID NO: 279115 - DNA, 25 bp, Rattus norvegicus
cttcctctgggtatttcatatcaca

SEQ ID NO: 279116 - DNA, 25 bp, Rattus norvegicus
cttcctctgggtctttataatcgtc

SEQ ID NO: 279117 - DNA, 25 bp, Rattus norvegicus
cttcctctgggtgtttataatcgtc

SEQ ID NO: 279118 - DNA, 25 bp, Rattus norvegicus
cttcctctgggtttttcatatcaca

SEQ ID NO: 279119 - DNA, 25 bp, Rattus norvegicus
cttcctctgtaacttgggtttcaat

SEQ ID NO: 279120 - DNA, 25 bp, Rattus norvegicus
cttcctctgtaagttgggtttcaat

SEQ ID NO: 279121 - DNA, 25 bp, Rattus norvegicus
cttcctctgtgtccttcgttttaaa

SEQ ID NO: 279122 - DNA, 25 bp, Rattus norvegicus
cttcctctgtgtgcttcgttttaaa

SEQ ID NO: 279123 - DNA, 25 bp, Rattus norvegicus
cttcctcttcataggtgtctattga

SEQ ID NO: 279124 - DNA, 25 bp, Rattus norvegicus
cttcctcttcattggtgtctattga

SEQ ID NO: 279125 - DNA, 25 bp, Rattus norvegicus
cttcctcttctacagccttattata

SEQ ID NO: 279126 - DNA, 25 bp, Rattus norvegicus
cttcctcttctagagccttattata

SEQ ID NO: 279127 - DNA, 25 bp, Rattus norvegicus
cttcctctttcccacaacagaagat

SEQ ID NO: 279128 - DNA, 25 bp, Rattus norvegicus
cttcctctttccgacaacagaagat

SEQ ID NO: 279129 - DNA, 25 bp, Rattus norvegicus
cttcctctttctccttgacaataaa

SEQ ID NO: 279130 - DNA, 25 bp, Rattus norvegicus
cttcctctttctgcttgacaataaa

SEQ ID NO: 279131 - DNA, 25 bp, Rattus norvegicus
cttcctctttgcaatggtggctaaa

SEQ ID NO: 279132 - DNA, 25 bp, Rattus norvegicus
cttcctctttgctatggtggctaaa

SEQ ID NO: 279133 - DNA, 25 bp, Rattus norvegicus
cttcctgaaacccagcatccaatat

SEQ ID NO: 279134 - DNA, 25 bp, Rattus norvegicus
cttcctgaaaccgagcatccaatat

SEQ ID NO: 279135 - DNA, 25 bp, Rattus norvegicus
cttcctgaagtcagtcccctaatga

SEQ ID NO: 279136 - DNA, 25 bp, Rattus norvegicus
cttcctgaagtcagttagtggttag

SEQ ID NO: 279137 - DNA, 25 bp, Rattus norvegicus
cttcctgaagtctgtcccctaatga

SEQ ID NO: 279138 - DNA, 25 bp, Rattus norvegicus
cttcctgaagtctgttagtggttag

SEQ ID NO: 279139 - DNA, 25 bp, Rattus norvegicus
cttcctgaatgtatggcccggtgtc

SEQ ID NO: 279140 - DNA, 25 bp, Rattus norvegicus
cttcctgaatgtttggcccggtgtc

SEQ ID NO: 279141 - DNA, 25 bp, Rattus norvegicus
cttcctgaccctctttttgaattga

SEQ ID NO: 279142 - DNA, 25 bp, Rattus norvegicus
cttcctgaccctgtttttgaattga

SEQ ID NO: 279143 - DNA, 25 bp, Rattus norvegicus
cttcctgactacagttgaccaacta

SEQ ID NO: 279144 - DNA, 25 bp, Rattus norvegicus
cttcctgactactgttgaccaacta

SEQ ID NO: 279145 - DNA, 25 bp, Rattus norvegicus
cttcctgaggttcctatgtgtgtga

SEQ ID NO: 279146 - DNA, 25 bp, Rattus norvegicus
cttcctgaggttgctatgtgtgtga

SEQ ID NO: 279147 - DNA, 25 bp, Rattus norvegicus
cttcctgatccaacaactttttctt

SEQ ID NO: 279148 - DNA, 25 bp, Rattus norvegicus
cttcctgatccatcaactttttctt

SEQ ID NO: 279149 - DNA, 25 bp, Rattus norvegicus
cttcctgcagtactagacatcttag

SEQ ID NO: 279150 - DNA, 25 bp, Rattus norvegicus
cttcctgcagtagtagacatcttag

SEQ ID NO: 279151 - DNA, 25 bp, Rattus norvegicus
cttcctgccagcagggtagggtctt

SEQ ID NO: 279152 - DNA, 25 bp, Rattus norvegicus
cttcctgccagctgggtagggtctt

SEQ ID NO: 279153 - DNA, 25 bp, Rattus norvegicus
cttcctgccattagttcccaataaa

SEQ ID NO: 279154 - DNA, 25 bp, Rattus norvegicus
cttcctgccatttgttcccaataaa

SEQ ID NO: 279155 - DNA, 25 bp, Rattus norvegicus
cttcctgcccttagtaacttactat

SEQ ID NO: 279156 - DNA, 25 bp, Rattus norvegicus
cttcctgccctttgtaacttactat

SEQ ID NO: 279157 - DNA, 25 bp, Rattus norvegicus
cttcctgcctacagagctgtccttg

SEQ ID NO: 279158 - DNA, 25 bp, Rattus norvegicus
cttcctgcctactgagctgtccttg

SEQ ID NO: 279159 - DNA, 25 bp, Rattus norvegicus
cttcctgcgaataggcctggtgtat

SEQ ID NO: 279160 - DNA, 25 bp, Rattus norvegicus
cttcctgcgaattggcctggtgtat

SEQ ID NO: 279161 - DNA, 25 bp, Rattus norvegicus
cttcctgctgagattgcactgtagg

SEQ ID NO: 279162 - DNA, 25 bp, Rattus norvegicus
cttcctgctgagtttgcactgtagg

SEQ ID NO: 279163 - DNA, 25 bp, Rattus norvegicus
cttcctgctggaatatttggcctat

SEQ ID NO: 279164 - DNA, 25 bp, Rattus norvegicus
cttcctgctggattatttggcctat

SEQ ID NO: 279165 - DNA, 25 bp, Rattus norvegicus
cttcctgcttcccaaggtagagatt

SEQ ID NO: 279166 - DNA, 25 bp, Rattus norvegicus
cttcctgcttccgaaggtagagatt

SEQ ID NO: 279167 - DNA, 25 bp, Rattus norvegicus
cttcctgcttgtctatcctgtaaat

SEQ ID NO: 279168 - DNA, 25 bp, Rattus norvegicus
cttcctgcttgtgtatcctgtaaat

SEQ ID NO: 279169 - DNA, 25 bp, Rattus norvegicus
cttcctgctttccagtaggtgacaa

SEQ ID NO: 279170 - DNA, 25 bp, Rattus norvegicus
cttcctgctttcgagtaggtgacaa

SEQ ID NO: 279171 - DNA, 25 bp, Rattus norvegicus
cttcctggaaccagtctcaatggag

SEQ ID NO: 279172 - DNA, 25 bp, Rattus norvegicus
cttcctggaacctgtctcaatggag

SEQ ID NO: 279173 - DNA, 25 bp, Rattus norvegicus
cttcctggactgatggctctgctta

SEQ ID NO: 279174 - DNA, 25 bp, Rattus norvegicus
cttcctggactgttggctctgctta

SEQ ID NO: 279175 - DNA, 25 bp, Rattus norvegicus
cttcctggaggacatttaggtgtac

SEQ ID NO: 279176 - DNA, 25 bp, Rattus norvegicus
cttcctggaggagatttaggtgtac

SEQ ID NO: 279177 - DNA, 25 bp, Rattus norvegicus
cttcctggagtcatctggctgtaga

SEQ ID NO: 279178 - DNA, 25 bp, Rattus norvegicus
cttcctggagtcttctggctgtaga

SEQ ID NO: 279179 - DNA, 25 bp, Rattus norvegicus
cttcctggccagaaatgaaacattt

SEQ ID NO: 279180 - DNA, 25 bp, Rattus norvegicus
cttcctggccagtaatgaaacattt

SEQ ID NO: 279181 - DNA, 25 bp, Rattus norvegicus
cttcctggcctgctaggtggattga

SEQ ID NO: 279182 - DNA, 25 bp, Rattus norvegicus
cttcctggcctggtaggtggattga

SEQ ID NO: 279183 - DNA, 25 bp, Rattus norvegicus
cttcctggctgtcaggctagggatc

SEQ ID NO: 279184 - DNA, 25 bp, Rattus norvegicus
cttcctggctgtgaggctagggatc

SEQ ID NO: 279185 - DNA, 25 bp, Rattus norvegicus
cttcctggtggcatagttatctgtg

SEQ ID NO: 279186 - DNA, 25 bp, Rattus norvegicus
cttcctggtggcttagttatctgtg

SEQ ID NO: 279187 - DNA, 25 bp, Rattus norvegicus
cttcctggttctcgttgagagctga

SEQ ID NO: 279188 - DNA, 25 bp, Rattus norvegicus
cttcctggttctggttgagagctga

SEQ ID NO: 279189 - DNA, 25 bp, Rattus norvegicus
cttcctgtacatagcctaagatctg

SEQ ID NO: 279190 - DNA, 25 bp, Rattus norvegicus
cttcctgtacattgcctaagatctg

SEQ ID NO: 279191 - DNA, 25 bp, Rattus norvegicus
cttcctgtctccaaggaggtcttca

SEQ ID NO: 279192 - DNA, 25 bp, Rattus norvegicus
cttcctgtctcctaggaggtcttca

SEQ ID NO: 279193 - DNA, 25 bp, Rattus norvegicus
cttcctgtcttcaaggcatctacac

SEQ ID NO: 279194 - DNA, 25 bp, Rattus norvegicus
cttcctgtcttctaggcatctacac

SEQ ID NO: 279195 - DNA, 25 bp, Rattus norvegicus
cttcctgtgcatcacaaagacctga

SEQ ID NO: 279196 - DNA, 25 bp, Rattus norvegicus
cttcctgtgcatgacaaagacctga

SEQ ID NO: 279197 - DNA, 25 bp, Rattus norvegicus
cttcctgtggagacccattgcctat

SEQ ID NO: 279198 - DNA, 25 bp, Rattus norvegicus
cttcctgtggagtcccattgcctat

SEQ ID NO: 279199 - DNA, 25 bp, Rattus norvegicus
cttcctgtggctcttaggtcgacct

SEQ ID NO: 279200 - DNA, 25 bp, Rattus norvegicus
cttcctgtggctgttaggtcgacct

SEQ ID NO: 279201 - DNA, 25 bp, Rattus norvegicus
cttcctgtgtctctgatttaaactc

SEQ ID NO: 279202 - DNA, 25 bp, Rattus norvegicus
cttcctgtgtctgtgatttaaactc

SEQ ID NO: 279203 - DNA, 25 bp, Rattus norvegicus
cttcctgttaatcatgcggcctgag

SEQ ID NO: 279204 - DNA, 25 bp, Rattus norvegicus
cttcctgttaatgatgcggcctgag

SEQ ID NO: 279205 - DNA, 25 bp, Rattus norvegicus
cttcctgttaccaacttctaagtga

SEQ ID NO: 279206 - DNA, 25 bp, Rattus norvegicus
cttcctgttacctacttctaagtga

SEQ ID NO: 279207 - DNA, 25 bp, Rattus norvegicus
cttcctgtttctagtttctcaagca

SEQ ID NO: 279208 - DNA, 25 bp, Rattus norvegicus
cttcctgtttcttgtttctcaagca

SEQ ID NO: 279209 - DNA, 25 bp, Rattus norvegicus
cttcctgtttgtatgcacctgaact

SEQ ID NO: 279210 - DNA, 25 bp, Rattus norvegicus
cttcctgtttgtttgcacctgaact

SEQ ID NO: 279211 - DNA, 25 bp, Rattus norvegicus
cttccttaacagaattttttggcat

SEQ ID NO: 279212 - DNA, 25 bp, Rattus norvegicus
cttccttaacagtattttttggcat

SEQ ID NO: 279213 - DNA, 25 bp, Rattus norvegicus
cttccttacagacagagccgttcac

SEQ ID NO: 279214 - DNA, 25 bp, Rattus norvegicus
cttccttacagagagagccgttcac

SEQ ID NO: 279215 - DNA, 25 bp, Rattus norvegicus
cttccttattacatttatctgcctc

SEQ ID NO: 279216 - DNA, 25 bp, Rattus norvegicus
cttccttattacttttatctgcctc

SEQ ID NO: 279217 - DNA, 25 bp, Rattus norvegicus
cttccttcacagcttttagaccaaa

SEQ ID NO: 279218 - DNA, 25 bp, Rattus norvegicus
cttccttcacaggttttagaccaaa

SEQ ID NO: 279219 - DNA, 25 bp, Rattus norvegicus
cttccttcactcatcctggattaaa

SEQ ID NO: 279220 - DNA, 25 bp, Rattus norvegicus
cttccttcactcttcctggattaaa

SEQ ID NO: 279221 - DNA, 25 bp, Rattus norvegicus
cttccttcatgcagaaaagttccaa

SEQ ID NO: 279222 - DNA, 25 bp, Rattus norvegicus
cttccttcatgctgaaaagttccaa

SEQ ID NO: 279223 - DNA, 25 bp, Rattus norvegicus
cttccttcatggcagggcagcagaa

SEQ ID NO: 279224 - DNA, 25 bp, Rattus norvegicus
cttccttcatgggagggcagcagaa

SEQ ID NO: 279225 - DNA, 25 bp, Rattus norvegicus
cttccttcccttagtggccatttga

SEQ ID NO: 279226 - DNA, 25 bp, Rattus norvegicus
cttccttccctttgtggccatttga

SEQ ID NO: 279227 - DNA, 25 bp, Rattus norvegicus
cttccttcctgtatcattgttgtga

SEQ ID NO: 279228 - DNA, 25 bp, Rattus norvegicus
cttccttcctgtttcattgttgtga

SEQ ID NO: 279229 - DNA, 25 bp, Rattus norvegicus
cttccttcctttcgcatatgtatgt

SEQ ID NO: 279230 - DNA, 25 bp, Rattus norvegicus
cttccttcctttggcatatgtatgt

SEQ ID NO: 279231 - DNA, 25 bp, Rattus norvegicus
cttccttctctcatgtggtacacaa

SEQ ID NO: 279232 - DNA, 25 bp, Rattus norvegicus
cttccttctctcttgtggtacacaa

SEQ ID NO: 279233 - DNA, 25 bp, Rattus norvegicus
cttccttgattcatcccttagtaag

SEQ ID NO: 279234 - DNA, 25 bp, Rattus norvegicus
cttccttgattcttcccttagtaag

SEQ ID NO: 279235 - DNA, 25 bp, Rattus norvegicus
cttccttgcacacacactaggcagg

SEQ ID NO: 279236 - DNA, 25 bp, Rattus norvegicus
cttccttgcacagacactaggcagg

SEQ ID NO: 279237 - DNA, 25 bp, Rattus norvegicus
cttccttgcctaacttggactaaga

SEQ ID NO: 279238 - DNA, 25 bp, Rattus norvegicus
cttccttgcctatcttggactaaga

SEQ ID NO: 279239 - DNA, 25 bp, Rattus norvegicus
cttccttgccttccctttgctgttt

SEQ ID NO: 279240 - DNA, 25 bp, Rattus norvegicus
cttccttgccttctggagagtgagg

SEQ ID NO: 279241 - DNA, 25 bp, Rattus norvegicus
cttccttgccttgcctttgctgttt

SEQ ID NO: 279242 - DNA, 25 bp, Rattus norvegicus
cttccttgccttgtggagagtgagg

SEQ ID NO: 279243 - DNA, 25 bp, Rattus norvegicus
cttccttggctccttttctgattat

SEQ ID NO: 279244 - DNA, 25 bp, Rattus norvegicus
cttccttggctcgttttctgattat

SEQ ID NO: 279245 - DNA, 25 bp, Rattus norvegicus
cttccttgggatctttatcagttgt

SEQ ID NO: 279246 - DNA, 25 bp, Rattus norvegicus
cttccttgggatgtttatcagttgt

SEQ ID NO: 279247 - DNA, 25 bp, Rattus norvegicus
cttccttgggctcagacttgttggg

SEQ ID NO: 279248 - DNA, 25 bp, Rattus norvegicus
cttccttgggctgagacttgttggg

SEQ ID NO: 279249 - DNA, 25 bp, Rattus norvegicus
cttccttgtgtgacttattgttttg

SEQ ID NO: 279250 - DNA, 25 bp, Rattus norvegicus
cttccttgtgtgtcttattgttttg

SEQ ID NO: 279251 - DNA, 25 bp, Rattus norvegicus
cttccttgtttacaccagtttatga

SEQ ID NO: 279252 - DNA, 25 bp, Rattus norvegicus
cttccttgtttagaccagtttatga

SEQ ID NO: 279253 - DNA, 25 bp, Rattus norvegicus
cttcctttcaagcttggactgaaga

SEQ ID NO: 279254 - DNA, 25 bp, Rattus norvegicus
cttcctttcaaggttggactgaaga

SEQ ID NO: 279255 - DNA, 25 bp, Rattus norvegicus
cttcctttccttagcaatgctatga

SEQ ID NO: 279256 - DNA, 25 bp, Rattus norvegicus
cttcctttccttcagagactgtgac

SEQ ID NO: 279257 - DNA, 25 bp, Rattus norvegicus
cttcctttccttgagagactgtgac

SEQ ID NO: 279258 - DNA, 25 bp, Rattus norvegicus
cttcctttcctttgcaatgctatga

SEQ ID NO: 279259 - DNA, 25 bp, Rattus norvegicus
cttcctttcgtgagttgccatggtg

SEQ ID NO: 279260 - DNA, 25 bp, Rattus norvegicus
cttcctttcgtgtgttgccatggtg

SEQ ID NO: 279261 - DNA, 25 bp, Rattus norvegicus
cttcctttctctctaattcaatcag

SEQ ID NO: 279262 - DNA, 25 bp, Rattus norvegicus
cttcctttctctgtaattcaatcag

SEQ ID NO: 279263 - DNA, 25 bp, Rattus norvegicus
cttcctttgatgatagtctatgatg

SEQ ID NO: 279264 - DNA, 25 bp, Rattus norvegicus
cttcctttgatgttagtctatgatg

SEQ ID NO: 279265 - DNA, 25 bp, Rattus norvegicus
cttcctttgtgaatcggtgtctatt

SEQ ID NO: 279266 - DNA, 25 bp, Rattus norvegicus
cttcctttgtgattcggtgtctatt

SEQ ID NO: 279267 - DNA, 25 bp, Rattus norvegicus
cttccttttgccagtgtacatattc

SEQ ID NO: 279268 - DNA, 25 bp, Rattus norvegicus
cttccttttgcctgtgtacatattc

SEQ ID NO: 279269 - DNA, 25 bp, Rattus norvegicus
cttcgaaaggcaccatgggcaggaa

SEQ ID NO: 279270 - DNA, 25 bp, Rattus norvegicus
cttcgaaaggcagcatgggcaggaa

SEQ ID NO: 279271 - DNA, 25 bp, Rattus norvegicus
cttcgaactaacagagatccacctg

SEQ ID NO: 279272 - DNA, 25 bp, Rattus norvegicus
cttcgaactaactgagatccacctg

SEQ ID NO: 279273 - DNA, 25 bp, Rattus norvegicus
cttcgacacggaccgctactggaaa

SEQ ID NO: 279274 - DNA, 25 bp, Rattus norvegicus
cttcgacacggagcgctactggaaa

SEQ ID NO: 279275 - DNA, 25 bp, Rattus norvegicus
cttcgaccttatcctgtgacttcag

SEQ ID NO: 279276 - DNA, 25 bp, Rattus norvegicus
cttcgaccttatgctgtgacttcag

SEQ ID NO: 279277 - DNA, 25 bp, Rattus norvegicus
cttcgactccttcctgaatctgaat

SEQ ID NO: 279278 - DNA, 25 bp, Rattus norvegicus
cttcgactccttgctgaatctgaat

SEQ ID NO: 279279 - DNA, 25 bp, Rattus norvegicus
cttcgactggaaccgttcttacacg

SEQ ID NO: 279280 - DNA, 25 bp, Rattus norvegicus
cttcgactggaagcgttcttacacg

SEQ ID NO: 279281 - DNA, 25 bp, Rattus norvegicus
cttcgacttggccaggttctatgga

SEQ ID NO: 279282 - DNA, 25 bp, Rattus norvegicus
cttcgacttggcgaggttctatgga

SEQ ID NO: 279283 - DNA, 25 bp, Rattus norvegicus
cttcgagatcctagactgcttttgt

SEQ ID NO: 279284 - DNA, 25 bp, Rattus norvegicus
cttcgagatccttgactgcttttgt

SEQ ID NO: 279285 - DNA, 25 bp, Rattus norvegicus
cttcgagcagctcgagcacgttcgg

SEQ ID NO: 279286 - DNA, 25 bp, Rattus norvegicus
cttcgagcagctggagcacgttcgg

SEQ ID NO: 279287 - DNA, 25 bp, Rattus norvegicus
cttcgagggcatcggtggtactttc

SEQ ID NO: 279288 - DNA, 25 bp, Rattus norvegicus
cttcgagggcatgggtggtactttc

SEQ ID NO: 279289 - DNA, 25 bp, Rattus norvegicus
cttcgaggtgcgaacaggcacgctg

SEQ ID NO: 279290 - DNA, 25 bp, Rattus norvegicus
cttcgaggtgcgtacaggcacgctg

SEQ ID NO: 279291 - DNA, 25 bp, Rattus norvegicus
cttcgagtatcgacaccgcaagatg

SEQ ID NO: 279292 - DNA, 25 bp, Rattus norvegicus
cttcgagtatcgtcaccgcaagatg

SEQ ID NO: 279293 - DNA, 25 bp, Rattus norvegicus
cttcgataggaacaccctgaacaat

SEQ ID NO: 279294 - DNA, 25 bp, Rattus norvegicus
cttcgataggaagaccctgaacaat

SEQ ID NO: 279295 - DNA, 25 bp, Rattus norvegicus
cttcgatatcttctttgccggcggc

SEQ ID NO: 279296 - DNA, 25 bp, Rattus norvegicus
cttcgatatcttgtttgccggcggc

SEQ ID NO: 279297 - DNA, 25 bp, Rattus norvegicus
cttcgatgtatgcgctcgttgccct

SEQ ID NO: 279298 - DNA, 25 bp, Rattus norvegicus
cttcgatgtatgggctcgttgccct

SEQ ID NO: 279299 - DNA, 25 bp, Rattus norvegicus
cttcgatttaatactgggtgaggct

SEQ ID NO: 279300 - DNA, 25 bp, Rattus norvegicus
cttcgatttaattctgggtgaggct

SEQ ID NO: 279301 - DNA, 25 bp, Rattus norvegicus
cttcgcaactttccagctaggtagt

SEQ ID NO: 279302 - DNA, 25 bp, Rattus norvegicus
cttcgcaactttgcagctaggtagt

SEQ ID NO: 279303 - DNA, 25 bp, Rattus norvegicus
cttcgcaagaatcagctggagacag

SEQ ID NO: 279304 - DNA, 25 bp, Rattus norvegicus
cttcgcaagaatgagctggagacag

SEQ ID NO: 279305 - DNA, 25 bp, Rattus norvegicus
cttcgcaagtctaactgtcacaagc

SEQ ID NO: 279306 - DNA, 25 bp, Rattus norvegicus
cttcgcaagtcttactgtcacaagc

SEQ ID NO: 279307 - DNA, 25 bp, Rattus norvegicus
cttcgcacctgtcgctgcggcgggt

SEQ ID NO: 279308 - DNA, 25 bp, Rattus norvegicus
cttcgcacctgtggctgcggcgggt

SEQ ID NO: 279309 - DNA, 25 bp, Rattus norvegicus
cttcgcactcacaacactttaaatg

SEQ ID NO: 279310 - DNA, 25 bp, Rattus norvegicus
cttcgcactcactacactttaaatg

SEQ ID NO: 279311 - DNA, 25 bp, Rattus norvegicus
cttcgccaatctcctactatgatta

SEQ ID NO: 279312 - DNA, 25 bp, Rattus norvegicus
cttcgccaatctgctactatgatta

SEQ ID NO: 279313 - DNA, 25 bp, Rattus norvegicus
cttcgccccttaattttgtattgtg

SEQ ID NO: 279314 - DNA, 25 bp, Rattus norvegicus
cttcgccccttatttttgtattgtg

SEQ ID NO: 279315 - DNA, 25 bp, Rattus norvegicus
cttcgccctcttaacattgatttta

SEQ ID NO: 279316 - DNA, 25 bp, Rattus norvegicus
cttcgccctctttacattgatttta

SEQ ID NO: 279317 - DNA, 25 bp, Rattus norvegicus
cttcgccgagccactgatgagatga

SEQ ID NO: 279318 - DNA, 25 bp, Rattus norvegicus
cttcgccgagcctctgatgagatga

SEQ ID NO: 279319 - DNA, 25 bp, Rattus norvegicus
cttcgccgttaactgtggacagtga

SEQ ID NO: 279320 - DNA, 25 bp, Rattus norvegicus
cttcgccgttaagtgtggacagtga

SEQ ID NO: 279321 - DNA, 25 bp, Rattus norvegicus
cttcgccttcacagtggacagtgac

SEQ ID NO: 279322 - DNA, 25 bp, Rattus norvegicus
cttcgccttcactgtggacagtgac

SEQ ID NO: 279323 - DNA, 25 bp, Rattus norvegicus
cttcgcgccgtgagtagtatattat

SEQ ID NO: 279324 - DNA, 25 bp, Rattus norvegicus
cttcgcgccgtgtgtagtatattat

SEQ ID NO: 279325 - DNA, 25 bp, Rattus norvegicus
cttcgcggaataatggtctgcacta

SEQ ID NO: 279326 - DNA, 25 bp, Rattus norvegicus
cttcgcggaatattggtctgcacta

SEQ ID NO: 279327 - DNA, 25 bp, Rattus norvegicus
cttcgcgtggctacggtacggagtt

SEQ ID NO: 279328 - DNA, 25 bp, Rattus norvegicus
cttcgcgtggcttcggtacggagtt

SEQ ID NO: 279329 - DNA, 25 bp, Rattus norvegicus
cttcgctaaagcaatacactgtata

SEQ ID NO: 279330 - DNA, 25 bp, Rattus norvegicus
cttcgctaaagctatacactgtata

SEQ ID NO: 279331 - DNA, 25 bp, Rattus norvegicus
cttcgctaccaacttcaacgtggaa

SEQ ID NO: 279332 - DNA, 25 bp, Rattus norvegicus
cttcgctaccaagttcaacgtggaa

SEQ ID NO: 279333 - DNA, 25 bp, Rattus norvegicus
cttcgctatcacagccattaagggt

SEQ ID NO: 279334 - DNA, 25 bp, Rattus norvegicus
cttcgctatcactgccattaagggt

SEQ ID NO: 279335 - DNA, 25 bp, Rattus norvegicus
cttcgctctgccaataatgggtgat

SEQ ID NO: 279336 - DNA, 25 bp, Rattus norvegicus
cttcgctctgcctataatgggtgat

SEQ ID NO: 279337 - DNA, 25 bp, Rattus norvegicus
cttcgctgagagaaatggttgatgt

SEQ ID NO: 279338 - DNA, 25 bp, Rattus norvegicus
cttcgctgagagtaatggttgatgt

SEQ ID NO: 279339 - DNA, 25 bp, Rattus norvegicus
cttcgctgcagccaattattgaggg

SEQ ID NO: 279340 - DNA, 25 bp, Rattus norvegicus
cttcgctgcagcgaattattgaggg

SEQ ID NO: 279341 - DNA, 25 bp, Rattus norvegicus
cttcgcttctggctagacaggcaaa

SEQ ID NO: 279342 - DNA, 25 bp, Rattus norvegicus
cttcgcttctgggtagacaggcaaa

SEQ ID NO: 279343 - DNA, 25 bp, Rattus norvegicus
cttcggacgagcaccggtccggcgt

SEQ ID NO: 279344 - DNA, 25 bp, Rattus norvegicus
cttcggacgagctccggtccggcgt

SEQ ID NO: 279345 - DNA, 25 bp, Rattus norvegicus
cttcggagatccagcctttattttg

SEQ ID NO: 279346 - DNA, 25 bp, Rattus norvegicus
cttcggagatcctgcctttattttg

SEQ ID NO: 279347 - DNA, 25 bp, Rattus norvegicus
cttcggaggactaccagaccggtga

SEQ ID NO: 279348 - DNA, 25 bp, Rattus norvegicus
cttcggaggacttccagaccggtga

SEQ ID NO: 279349 - DNA, 25 bp, Rattus norvegicus
cttcggatcacgcccggagtagaag

SEQ ID NO: 279350 - DNA, 25 bp, Rattus norvegicus
cttcggatcacggccggagtagaag

SEQ ID NO: 279351 - DNA, 25 bp, Rattus norvegicus
cttcggcatcgaacagatactgagc

SEQ ID NO: 279352 - DNA, 25 bp, Rattus norvegicus
cttcggcatcgatcagatactgagc

SEQ ID NO: 279353 - DNA, 25 bp, Rattus norvegicus
cttcggcctttcattgagaagccca

SEQ ID NO: 279354 - DNA, 25 bp, Rattus norvegicus
cttcggcctttctttgagaagccca

SEQ ID NO: 279355 - DNA, 25 bp, Rattus norvegicus
cttcggcgtttactgttgtgtctta

SEQ ID NO: 279356 - DNA, 25 bp, Rattus norvegicus
cttcggcgtttagtgttgtgtctta

SEQ ID NO: 279357 - DNA, 25 bp, Rattus norvegicus
cttcggctccatcggtcaacagtag

SEQ ID NO: 279358 - DNA, 25 bp, Rattus norvegicus
cttcggctccatgggtcaacagtag

SEQ ID NO: 279359 - DNA, 25 bp, Rattus norvegicus
cttcggctctttatccacagaaatg

SEQ ID NO: 279360 - DNA, 25 bp, Rattus norvegicus
cttcggctctttttccacagaaatg

SEQ ID NO: 279361 - DNA, 25 bp, Rattus norvegicus
cttcggctgccacatggtacttgta

SEQ ID NO: 279362 - DNA, 25 bp, Rattus norvegicus
cttcggctgccagatggtacttgta

SEQ ID NO: 279363 - DNA, 25 bp, Rattus norvegicus
cttcggctgtatccgcccattaaaa

SEQ ID NO: 279364 - DNA, 25 bp, Rattus norvegicus
cttcggctgtatgcgcccattaaaa

SEQ ID NO: 279365 - DNA, 25 bp, Rattus norvegicus
cttcggctttatagctactagcact

SEQ ID NO: 279366 - DNA, 25 bp, Rattus norvegicus
cttcggctttattgctactagcact

SEQ ID NO: 279367 - DNA, 25 bp, Rattus norvegicus
cttcgggatgaaactggcaacagtt

SEQ ID NO: 279368 - DNA, 25 bp, Rattus norvegicus
cttcgggatgaatctggcaacagtt

SEQ ID NO: 279369 - DNA, 25 bp, Rattus norvegicus
cttcgggcaaaccatcagaaccatg

SEQ ID NO: 279370 - DNA, 25 bp, Rattus norvegicus
cttcgggcaaacgatcagaaccatg

SEQ ID NO: 279371 - DNA, 25 bp, Rattus norvegicus
cttcgggcttctcaggaacacctga

SEQ ID NO: 279372 - DNA, 25 bp, Rattus norvegicus
cttcgggcttctgaggaacacctga

SEQ ID NO: 279373 - DNA, 25 bp, Rattus norvegicus
cttcgggtcattcaaaaggctttga

SEQ ID NO: 279374 - DNA, 25 bp, Rattus norvegicus
cttcgggtcattgaaaaggctttga

SEQ ID NO: 279375 - DNA, 25 bp, Rattus norvegicus
cttcggtcctgcagcactgattttc

SEQ ID NO: 279376 - DNA, 25 bp, Rattus norvegicus
cttcggtcctgctgcactgattttc

SEQ ID NO: 279377 - DNA, 25 bp, Rattus norvegicus
cttcggtgacttacaggagctctga

SEQ ID NO: 279378 - DNA, 25 bp, Rattus norvegicus
cttcggtgactttcaggagctctga

SEQ ID NO: 279379 - DNA, 25 bp, Rattus norvegicus
cttcgtaccgctactgtaattttat

SEQ ID NO: 279380 - DNA, 25 bp, Rattus norvegicus
cttcgtaccgcttctgtaattttat

SEQ ID NO: 279381 - DNA, 25 bp, Rattus norvegicus
cttcgtagactgcagggtgatgcat

SEQ ID NO: 279382 - DNA, 25 bp, Rattus norvegicus
cttcgtagactggagggtgatgcat

SEQ ID NO: 279383 - DNA, 25 bp, Rattus norvegicus
cttcgtagctctcgtattcacttta

SEQ ID NO: 279384 - DNA, 25 bp, Rattus norvegicus
cttcgtagctctggtattcacttta

SEQ ID NO: 279385 - DNA, 25 bp, Rattus norvegicus
cttcgtaggcgaagccgatgccgag

SEQ ID NO: 279386 - DNA, 25 bp, Rattus norvegicus
cttcgtaggcgatgccgatgccgag

SEQ ID NO: 279387 - DNA, 25 bp, Rattus norvegicus
cttcgtcgccttaatgtgtagagat

SEQ ID NO: 279388 - DNA, 25 bp, Rattus norvegicus
cttcgtcgcctttatgtgtagagat

SEQ ID NO: 279389 - DNA, 25 bp, Rattus norvegicus
cttcgtcgcgctaggaatgtgggtc

SEQ ID NO: 279390 - DNA, 25 bp, Rattus norvegicus
cttcgtcgcgcttggaatgtgggtc

SEQ ID NO: 279391 - DNA, 25 bp, Rattus norvegicus
cttcgtctgggcactgagtagatta

SEQ ID NO: 279392 - DNA, 25 bp, Rattus norvegicus
cttcgtctgggctctgagtagatta

SEQ ID NO: 279393 - DNA, 25 bp, Rattus norvegicus
cttcgtcttctactgaagcggtcca

SEQ ID NO: 279394 - DNA, 25 bp, Rattus norvegicus
cttcgtcttctagtgaagcggtcca

SEQ ID NO: 279395 - DNA, 25 bp, Rattus norvegicus
cttcgtgaaggtcccgcgcgatgac

SEQ ID NO: 279396 - DNA, 25 bp, Rattus norvegicus
cttcgtgaaggtgccgcgcgatgac

SEQ ID NO: 279397 - DNA, 25 bp, Rattus norvegicus
cttcgtgaatggagtagccggcata

SEQ ID NO: 279398 - DNA, 25 bp, Rattus norvegicus
cttcgtgaatggtgtagccggcata

SEQ ID NO: 279399 - DNA, 25 bp, Rattus norvegicus
cttcgtgacactccccttctggagg

SEQ ID NO: 279400 - DNA, 25 bp, Rattus norvegicus
cttcgtgacactgcccttctggagg

SEQ ID NO: 279401 - DNA, 25 bp, Rattus norvegicus
cttcgtgacagacatcttcgagcgc

SEQ ID NO: 279402 - DNA, 25 bp, Rattus norvegicus
cttcgtgacagagatcttcgagcgc

SEQ ID NO: 279403 - DNA, 25 bp, Rattus norvegicus
cttcgtgattgtattctttaggatg

SEQ ID NO: 279404 - DNA, 25 bp, Rattus norvegicus
cttcgtgattgttttctttaggatg

SEQ ID NO: 279405 - DNA, 25 bp, Rattus norvegicus
cttcgtgcagaccaggagctcatga

SEQ ID NO: 279406 - DNA, 25 bp, Rattus norvegicus
cttcgtgcagacgaggagctcatga

SEQ ID NO: 279407 - DNA, 25 bp, Rattus norvegicus
cttcgtgtcctgagagcagcatgat

SEQ ID NO: 279408 - DNA, 25 bp, Rattus norvegicus
cttcgtgtcctgtgagcagcatgat

SEQ ID NO: 279409 - DNA, 25 bp, Rattus norvegicus
cttcgtgtgattcccagcagagtga

SEQ ID NO: 279410 - DNA, 25 bp, Rattus norvegicus
cttcgtgtgattgccagcagagtga

SEQ ID NO: 279411 - DNA, 25 bp, Rattus norvegicus
cttcgtgttttcagtaccttgtgat

SEQ ID NO: 279412 - DNA, 25 bp, Rattus norvegicus
cttcgtgttttctgtaccttgtgat

SEQ ID NO: 279413 - DNA, 25 bp, Rattus norvegicus
cttcgttacttccaaattagtcaag

SEQ ID NO: 279414 - DNA, 25 bp, Rattus norvegicus
cttcgttacttcgaaattagtcaag

SEQ ID NO: 279415 - DNA, 25 bp, Rattus norvegicus
cttcgttcagttattgttgcagtct

SEQ ID NO: 279416 - DNA, 25 bp, Rattus norvegicus
cttcgttcagtttttgttgcagtct

SEQ ID NO: 279417 - DNA, 25 bp, Rattus norvegicus
cttcgttctgtaataatagcgtgta

SEQ ID NO: 279418 - DNA, 25 bp, Rattus norvegicus
cttcgttctgtattaatagcgtgta

SEQ ID NO: 279419 - DNA, 25 bp, Rattus norvegicus
cttcgttgccatctacagtgagtga

SEQ ID NO: 279420 - DNA, 25 bp, Rattus norvegicus
cttcgttgccatgtacagtgagtga

SEQ ID NO: 279421 - DNA, 25 bp, Rattus norvegicus
cttcgtttacggctgactaagagga

SEQ ID NO: 279422 - DNA, 25 bp, Rattus norvegicus
cttcgtttacgggtgactaagagga

SEQ ID NO: 279423 - DNA, 25 bp, Rattus norvegicus
cttcgtttctctcctgtgtggagaa

SEQ ID NO: 279424 - DNA, 25 bp, Rattus norvegicus
cttcgtttctctgctgtgtggagaa

SEQ ID NO: 279425 - DNA, 25 bp, Rattus norvegicus
cttctaacaccaatatccagctttt

SEQ ID NO: 279426 - DNA, 25 bp, Rattus norvegicus
cttctaacaccattatccagctttt

SEQ ID NO: 279427 - DNA, 25 bp, Rattus norvegicus
cttctaacttcacgcctagggaaag

SEQ ID NO: 279428 - DNA, 25 bp, Rattus norvegicus
cttctaacttcaggcctagggaaag

SEQ ID NO: 279429 - DNA, 25 bp, Rattus norvegicus
cttctaagggccctggagcctaata

SEQ ID NO: 279430 - DNA, 25 bp, Rattus norvegicus
cttctaagggccgtggagcctaata

SEQ ID NO: 279431 - DNA, 25 bp, Rattus norvegicus
cttctaatggctattgatttcctga

SEQ ID NO: 279432 - DNA, 25 bp, Rattus norvegicus
cttctaatggcttttgatttcctga

SEQ ID NO: 279433 - DNA, 25 bp, Rattus norvegicus
cttctacattttactgtgctctggg

SEQ ID NO: 279434 - DNA, 25 bp, Rattus norvegicus
cttctacatttttctgtgctctggg

SEQ ID NO: 279435 - DNA, 25 bp, Rattus norvegicus
cttctaccagaaatctcttcacagg

SEQ ID NO: 279436 - DNA, 25 bp, Rattus norvegicus
cttctaccagaattctcttcacagg

SEQ ID NO: 279437 - DNA, 25 bp, Rattus norvegicus
cttctaccatgtcgactttgggatt

SEQ ID NO: 279438 - DNA, 25 bp, Rattus norvegicus
cttctaccatgtggactttgggatt

SEQ ID NO: 279439 - DNA, 25 bp, Rattus norvegicus
cttctacccacaaattattgctcac

SEQ ID NO: 279440 - DNA, 25 bp, Rattus norvegicus
cttctacccacatattattgctcac

SEQ ID NO: 279441 - DNA, 25 bp, Rattus norvegicus
cttctacggccaatctgagtttgaa

SEQ ID NO: 279442 - DNA, 25 bp, Rattus norvegicus
cttctacggccattctgagtttgaa

SEQ ID NO: 279443 - DNA, 25 bp, Rattus norvegicus
cttctactagccctgaggccactta

SEQ ID NO: 279444 - DNA, 25 bp, Rattus norvegicus
cttctactagccgtgaggccactta

SEQ ID NO: 279445 - DNA, 25 bp, Rattus norvegicus
cttctactgaagctggcaatgtctg

SEQ ID NO: 279446 - DNA, 25 bp, Rattus norvegicus
cttctactgaaggtggcaatgtctg

SEQ ID NO: 279447 - DNA, 25 bp, Rattus norvegicus
cttctactgcaacatggtcatcatc

SEQ ID NO: 279448 - DNA, 25 bp, Rattus norvegicus
cttctactgcaagatggtcatcatc

SEQ ID NO: 279449 - DNA, 25 bp, Rattus norvegicus
cttctactgtgaatactgaggttta

SEQ ID NO: 279450 - DNA, 25 bp, Rattus norvegicus
cttctactgtgattactgaggttta

SEQ ID NO: 279451 - DNA, 25 bp, Rattus norvegicus
cttctacttgtgactgtacttccag

SEQ ID NO: 279452 - DNA, 25 bp, Rattus norvegicus
cttctacttgtgtctgtacttccag

SEQ ID NO: 279453 - DNA, 25 bp, Rattus norvegicus
cttctactttggcatgtgtctggtt

SEQ ID NO: 279454 - DNA, 25 bp, Rattus norvegicus
cttctactttgggatgtgtctggtt

SEQ ID NO: 279455 - DNA, 25 bp, Rattus norvegicus
cttctagaataaatccacctccatc

SEQ ID NO: 279456 - DNA, 25 bp, Rattus norvegicus
cttctagaataattccacctccatc

SEQ ID NO: 279457 - DNA, 25 bp, Rattus norvegicus
cttctagaatcaacagtggtgctta

SEQ ID NO: 279458 - DNA, 25 bp, Rattus norvegicus
cttctagaatcatcagtggtgctta

SEQ ID NO: 279459 - DNA, 25 bp, Rattus norvegicus
cttctagacgctcactttgtttcta

SEQ ID NO: 279460 - DNA, 25 bp, Rattus norvegicus
cttctagacgctgactttgtttcta

SEQ ID NO: 279461 - DNA, 25 bp, Rattus norvegicus
cttctagagagtacctgattcccta

SEQ ID NO: 279462 - DNA, 25 bp, Rattus norvegicus
cttctagagagttcctgattcccta

SEQ ID NO: 279463 - DNA, 25 bp, Rattus norvegicus
cttctagcactccaggctgtacgtt

SEQ ID NO: 279464 - DNA, 25 bp, Rattus norvegicus
cttctagcactcgaggctgtacgtt

SEQ ID NO: 279465 - DNA, 25 bp, Rattus norvegicus
cttctagctgccaccttgggcagat

SEQ ID NO: 279466 - DNA, 25 bp, Rattus norvegicus
cttctagctgcctccttgggcagat

SEQ ID NO: 279467 - DNA, 25 bp, Rattus norvegicus
cttctagctgctctgaggattctgg

SEQ ID NO: 279468 - DNA, 25 bp, Rattus norvegicus
cttctagctgctgtgaggattctgg

SEQ ID NO: 279469 - DNA, 25 bp, Rattus norvegicus
cttctagcttctcaactgtgttttc

SEQ ID NO: 279470 - DNA, 25 bp, Rattus norvegicus
cttctagcttctgaactgtgttttc

SEQ ID NO: 279471 - DNA, 25 bp, Rattus norvegicus
cttctaggagagactgctgttggca

SEQ ID NO: 279472 - DNA, 25 bp, Rattus norvegicus
cttctaggagagtctgctgttggca

SEQ ID NO: 279473 - DNA, 25 bp, Rattus norvegicus
cttctaggcggactgttactgagct

SEQ ID NO: 279474 - DNA, 25 bp, Rattus norvegicus
cttctaggcggagtgttactgagct

SEQ ID NO: 279475 - DNA, 25 bp, Rattus norvegicus
cttctagggactaaatgctttacca

SEQ ID NO: 279476 - DNA, 25 bp, Rattus norvegicus
cttctagggacttaatgctttacca

SEQ ID NO: 279477 - DNA, 25 bp, Rattus norvegicus
cttctagtatctagttccccaggta

SEQ ID NO: 279478 - DNA, 25 bp, Rattus norvegicus
cttctagtatcttgttccccaggta

SEQ ID NO: 279479 - DNA, 25 bp, Rattus norvegicus
cttctagtcccaagcatttcagatc

SEQ ID NO: 279480 - DNA, 25 bp, Rattus norvegicus
cttctagtcccatgcatttcagatc

SEQ ID NO: 279481 - DNA, 25 bp, Rattus norvegicus
cttctagtgacacgagccattggga

SEQ ID NO: 279482 - DNA, 25 bp, Rattus norvegicus
cttctagtgacaggagccattggga

SEQ ID NO: 279483 - DNA, 25 bp, Rattus norvegicus
cttctagtgcttagggacagtccca

SEQ ID NO: 279484 - DNA, 25 bp, Rattus norvegicus
cttctagtgctttgggacagtccca

SEQ ID NO: 279485 - DNA, 25 bp, Rattus norvegicus
cttctatccctaaacctgagcagat

SEQ ID NO: 279486 - DNA, 25 bp, Rattus norvegicus
cttctatccctatacctgagcagat

SEQ ID NO: 279487 - DNA, 25 bp, Rattus norvegicus
cttctatctaacaaccaccaatgca

SEQ ID NO: 279488 - DNA, 25 bp, Rattus norvegicus
cttctatctaactaccaccaatgca

SEQ ID NO: 279489 - DNA, 25 bp, Rattus norvegicus
cttctattctggacaactcacaacc

SEQ ID NO: 279490 - DNA, 25 bp, Rattus norvegicus
cttctattctggtcaactcacaacc

SEQ ID NO: 279491 - DNA, 25 bp, Rattus norvegicus
cttctatttcccatcctaatttcat

SEQ ID NO: 279492 - DNA, 25 bp, Rattus norvegicus
cttctatttcccttcctaatttcat

SEQ ID NO: 279493 - DNA, 25 bp, Rattus norvegicus
cttctcaagatgatgtctgttcccc

SEQ ID NO: 279494 - DNA, 25 bp, Rattus norvegicus
cttctcaagatgttgtctgttcccc

SEQ ID NO: 279495 - DNA, 25 bp, Rattus norvegicus
cttctcaagtgcaggtactaccaag

SEQ ID NO: 279496 - DNA, 25 bp, Rattus norvegicus
cttctcaagtgctggtactaccaag

SEQ ID NO: 279497 - DNA, 25 bp, Rattus norvegicus
cttctcaagttaatccttccagtgg

SEQ ID NO: 279498 - DNA, 25 bp, Rattus norvegicus
cttctcaagttattccttccagtgg

SEQ ID NO: 279499 - DNA, 25 bp, Rattus norvegicus
cttctcaatgtgcttctatttttta

SEQ ID NO: 279500 - DNA, 25 bp, Rattus norvegicus
cttctcaatgtggttctatttttta

SEQ ID NO: 279501 - DNA, 25 bp, Rattus norvegicus
cttctcaccatacctagagttttag

SEQ ID NO: 279502 - DNA, 25 bp, Rattus norvegicus
cttctcaccatagctagagttttag

SEQ ID NO: 279503 - DNA, 25 bp, Rattus norvegicus
cttctcaccccaattaaactaacat

SEQ ID NO: 279504 - DNA, 25 bp, Rattus norvegicus
cttctcaccccatttaaactaacat

SEQ ID NO: 279505 - DNA, 25 bp, Rattus norvegicus
cttctcactgttacatcaagtctag

SEQ ID NO: 279506 - DNA, 25 bp, Rattus norvegicus
cttctcactgtttcatcaagtctag

SEQ ID NO: 279507 - DNA, 25 bp, Rattus norvegicus
cttctcagcccaccaaagtttgcag

SEQ ID NO: 279508 - DNA, 25 bp, Rattus norvegicus
cttctcagcccagcaaagtttgcag

SEQ ID NO: 279509 - DNA, 25 bp, Rattus norvegicus
cttctcagcgttagggtgtttagcc

SEQ ID NO: 279510 - DNA, 25 bp, Rattus norvegicus
cttctcagcgtttgggtgtttagcc

SEQ ID NO: 279511 - DNA, 25 bp, Rattus norvegicus
cttctcagctccatgtacttaacaa

SEQ ID NO: 279512 - DNA, 25 bp, Rattus norvegicus
cttctcagctccttgtacttaacaa

SEQ ID NO: 279513 - DNA, 25 bp, Rattus norvegicus
cttctcagcttcacgggtatcatca

SEQ ID NO: 279514 - DNA, 25 bp, Rattus norvegicus
cttctcagcttctcgggtatcatca

SEQ ID NO: 279515 - DNA, 25 bp, Rattus norvegicus
cttctcatcccgaatgtgttcatga

SEQ ID NO: 279516 - DNA, 25 bp, Rattus norvegicus
cttctcatcccgtatgtgttcatga

SEQ ID NO: 279517 - DNA, 25 bp, Rattus norvegicus
cttctcattgctccctaacgaggaa

SEQ ID NO: 279518 - DNA, 25 bp, Rattus norvegicus
cttctcattgctgcctaacgaggaa

SEQ ID NO: 279519 - DNA, 25 bp, Rattus norvegicus
cttctcatttttctcaacattgtgg

SEQ ID NO: 279520 - DNA, 25 bp, Rattus norvegicus
cttctcatttttgtcaacattgtgg

SEQ ID NO: 279521 - DNA, 25 bp, Rattus norvegicus
cttctccaatacattcacacactta

SEQ ID NO: 279522 - DNA, 25 bp, Rattus norvegicus
cttctccaatactttcacacactta

SEQ ID NO: 279523 - DNA, 25 bp, Rattus norvegicus
cttctccagggcagtgcaagtgtat

SEQ ID NO: 279524 - DNA, 25 bp, Rattus norvegicus
cttctccagggctgtgcaagtgtat

SEQ ID NO: 279525 - DNA, 25 bp, Rattus norvegicus
cttctccagtcccaaagtattgtac

SEQ ID NO: 279526 - DNA, 25 bp, Rattus norvegicus
cttctccagtccgaaagtattgtac

SEQ ID NO: 279527 - DNA, 25 bp, Rattus norvegicus
cttctccatcagctatgaccatggg

SEQ ID NO: 279528 - DNA, 25 bp, Rattus norvegicus
cttctccatcaggtatgaccatggg

SEQ ID NO: 279529 - DNA, 25 bp, Rattus norvegicus
cttctccccgggagcggagaggcac

SEQ ID NO: 279530 - DNA, 25 bp, Rattus norvegicus
cttctccccgggtgcggagaggcac

SEQ ID NO: 279531 - DNA, 25 bp, Rattus norvegicus
cttctccccgtaatattcaggaggg

SEQ ID NO: 279532 - DNA, 25 bp, Rattus norvegicus
cttctccccgtattattcaggaggg

SEQ ID NO: 279533 - DNA, 25 bp, Rattus norvegicus
cttctccctattctcaaaatgcaca

SEQ ID NO: 279534 - DNA, 25 bp, Rattus norvegicus
cttctccctattgtcaaaatgcaca

SEQ ID NO: 279535 - DNA, 25 bp, Rattus norvegicus
cttctcccttgtacagtctttattt

SEQ ID NO: 279536 - DNA, 25 bp, Rattus norvegicus
cttctcccttgttcagtctttattt

SEQ ID NO: 279537 - DNA, 25 bp, Rattus norvegicus
cttctcccttttacttattcaatgt

SEQ ID NO: 279538 - DNA, 25 bp, Rattus norvegicus
cttctccctttttcttattcaatgt

SEQ ID NO: 279539 - DNA, 25 bp, Rattus norvegicus
cttctccgccatcggcatgggtcat

SEQ ID NO: 279540 - DNA, 25 bp, Rattus norvegicus
cttctccgccatgggcatgggtcat

SEQ ID NO: 279541 - DNA, 25 bp, Rattus norvegicus
cttctccgctttccaaagaactgag

SEQ ID NO: 279542 - DNA, 25 bp, Rattus norvegicus
cttctccgctttgcaaagaactgag

SEQ ID NO: 279543 - DNA, 25 bp, Rattus norvegicus
cttctccggtgactgggccatggca

SEQ ID NO: 279544 - DNA, 25 bp, Rattus norvegicus
cttctccggtgagtgggccatggca

SEQ ID NO: 279545 - DNA, 25 bp, Rattus norvegicus
cttctccgttgcaggcttatagaca

SEQ ID NO: 279546 - DNA, 25 bp, Rattus norvegicus
cttctccgttgctggcttatagaca

SEQ ID NO: 279547 - DNA, 25 bp, Rattus norvegicus
cttctcctacttagtttttatacat

SEQ ID NO: 279548 - DNA, 25 bp, Rattus norvegicus
cttctcctactttgtttttatacat

SEQ ID NO: 279549 - DNA, 25 bp, Rattus norvegicus
cttctcctagaaatccctggcattt

SEQ ID NO: 279550 - DNA, 25 bp, Rattus norvegicus
cttctcctagaattccctggcattt

SEQ ID NO: 279551 - DNA, 25 bp, Rattus norvegicus
cttctcctccgactccaaggtgtag

SEQ ID NO: 279552 - DNA, 25 bp, Rattus norvegicus
cttctcctccgagtccaaggtgtag

SEQ ID NO: 279553 - DNA, 25 bp, Rattus norvegicus
cttctcctgacaaccatgtctgaaa

SEQ ID NO: 279554 - DNA, 25 bp, Rattus norvegicus
cttctcctgacatccatgtctgaaa

SEQ ID NO: 279555 - DNA, 25 bp, Rattus norvegicus
cttctcctgaggctgtacatgtaca

SEQ ID NO: 279556 - DNA, 25 bp, Rattus norvegicus
cttctcctgagggtgtacatgtaca

SEQ ID NO: 279557 - DNA, 25 bp, Rattus norvegicus
cttctcctgggcatagcgttggtga

SEQ ID NO: 279558 - DNA, 25 bp, Rattus norvegicus
cttctcctgggcttagcgttggtga

SEQ ID NO: 279559 - DNA, 25 bp, Rattus norvegicus
cttctcctgggtactgtaagactta

SEQ ID NO: 279560 - DNA, 25 bp, Rattus norvegicus
cttctcctgggttctgtaagactta

SEQ ID NO: 279561 - DNA, 25 bp, Rattus norvegicus
cttctcctgtccagataaatctttt

SEQ ID NO: 279562 - DNA, 25 bp, Rattus norvegicus
cttctcctgtcctgataaatctttt

SEQ ID NO: 279563 - DNA, 25 bp, Rattus norvegicus
cttctccttgccaattttttcattg

SEQ ID NO: 279564 - DNA, 25 bp, Rattus norvegicus
cttctccttgcctattttttcattg

SEQ ID NO: 279565 - DNA, 25 bp, Rattus norvegicus
cttctccttgttcattgtcactgac

SEQ ID NO: 279566 - DNA, 25 bp, Rattus norvegicus
cttctccttgttgattgtcactgac

SEQ ID NO: 279567 - DNA, 25 bp, Rattus norvegicus
cttctcctttttctcatttacctga

SEQ ID NO: 279568 - DNA, 25 bp, Rattus norvegicus
cttctcctttttgtcatttacctga

SEQ ID NO: 279569 - DNA, 25 bp, Rattus norvegicus
cttctcgaaggaacatgacgctgtt

SEQ ID NO: 279570 - DNA, 25 bp, Rattus norvegicus
cttctcgaaggatcatgacgctgtt

SEQ ID NO: 279571 - DNA, 25 bp, Rattus norvegicus
cttctcgcgattatcatggaccaat

SEQ ID NO: 279572 - DNA, 25 bp, Rattus norvegicus
cttctcgcgattttcatggaccaat

SEQ ID NO: 279573 - DNA, 25 bp, Rattus norvegicus
cttctcggagtccttcaactgatgt

SEQ ID NO: 279574 - DNA, 25 bp, Rattus norvegicus
cttctcggagtcgttcaactgatgt

SEQ ID NO: 279575 - DNA, 25 bp, Rattus norvegicus
cttctcgggaacacggttgatgctt

SEQ ID NO: 279576 - DNA, 25 bp, Rattus norvegicus
cttctcgggaactcggttgatgctt

SEQ ID NO: 279577 - DNA, 25 bp, Rattus norvegicus
cttctcgggctcatttgatactaaa

SEQ ID NO: 279578 - DNA, 25 bp, Rattus norvegicus
cttctcgggctcttttgatactaaa

SEQ ID NO: 279579 - DNA, 25 bp, Rattus norvegicus
cttctcggtactctgtgctggttgc

SEQ ID NO: 279580 - DNA, 25 bp, Rattus norvegicus
cttctcggtactgtgtgctggttgc

SEQ ID NO: 279581 - DNA, 25 bp, Rattus norvegicus
cttctcgtgggacttgtctgagcct

SEQ ID NO: 279582 - DNA, 25 bp, Rattus norvegicus
cttctcgtgggagttgtctgagcct

SEQ ID NO: 279583 - DNA, 25 bp, Rattus norvegicus
cttctcgttggaaatctgcgttgga

SEQ ID NO: 279584 - DNA, 25 bp, Rattus norvegicus
cttctcgttggatatctgcgttgga

SEQ ID NO: 279585 - DNA, 25 bp, Rattus norvegicus
cttctctaaaacacctgtattcctg

SEQ ID NO: 279586 - DNA, 25 bp, Rattus norvegicus
cttctctaaaactcctgtattcctg

SEQ ID NO: 279587 - DNA, 25 bp, Rattus norvegicus
cttctctagactaatcttcctgctt

SEQ ID NO: 279588 - DNA, 25 bp, Rattus norvegicus
cttctctagacttatcttcctgctt

SEQ ID NO: 279589 - DNA, 25 bp, Rattus norvegicus
cttctctaggcgaactgctgatgat

SEQ ID NO: 279590 - DNA, 25 bp, Rattus norvegicus
cttctctaggcgtactgctgatgat

SEQ ID NO: 279591 - DNA, 25 bp, Rattus norvegicus
cttctctcacccagaacaaaactgt

SEQ ID NO: 279592 - DNA, 25 bp, Rattus norvegicus
cttctctcaccctgaacaaaactgt

SEQ ID NO: 279593 - DNA, 25 bp, Rattus norvegicus
cttctctcaggtctggcatgtcggt

SEQ ID NO: 279594 - DNA, 25 bp, Rattus norvegicus
cttctctcaggtgtggcatgtcggt

SEQ ID NO: 279595 - DNA, 25 bp, Rattus norvegicus
cttctctccacactgaatctctagt

SEQ ID NO: 279596 - DNA, 25 bp, Rattus norvegicus
cttctctccacagtgaatctctagt

SEQ ID NO: 279597 - DNA, 25 bp, Rattus norvegicus
cttctctcctatcccatatggctgg

SEQ ID NO: 279598 - DNA, 25 bp, Rattus norvegicus
cttctctcctatgccatatggctgg

SEQ ID NO: 279599 - DNA, 25 bp, Rattus norvegicus
cttctctccttccagttgaaacaag

SEQ ID NO: 279600 - DNA, 25 bp, Rattus norvegicus
cttctctccttcgagttgaaacaag

SEQ ID NO: 279601 - DNA, 25 bp, Rattus norvegicus
cttctctctcttctataaaacccaa

SEQ ID NO: 279602 - DNA, 25 bp, Rattus norvegicus
cttctctctcttgtataaaacccaa

SEQ ID NO: 279603 - DNA, 25 bp, Rattus norvegicus
cttctctctgctcccaagagcagta

SEQ ID NO: 279604 - DNA, 25 bp, Rattus norvegicus
cttctctctgctgccaagagcagta

SEQ ID NO: 279605 - DNA, 25 bp, Rattus norvegicus
cttctctctggcatttgtgaggttg

SEQ ID NO: 279606 - DNA, 25 bp, Rattus norvegicus
cttctctctggcttttgtgaggttg

SEQ ID NO: 279607 - DNA, 25 bp, Rattus norvegicus
cttctctctgtactctgcaaagtga

SEQ ID NO: 279608 - DNA, 25 bp, Rattus norvegicus
cttctctctgtagtctgcaaagtga

SEQ ID NO: 279609 - DNA, 25 bp, Rattus norvegicus
cttctctcttctacctgggctagga

SEQ ID NO: 279610 - DNA, 25 bp, Rattus norvegicus
cttctctcttcttcctgggctagga

SEQ ID NO: 279611 - DNA, 25 bp, Rattus norvegicus
cttctctgacacataattcgcactc

SEQ ID NO: 279612 - DNA, 25 bp, Rattus norvegicus
cttctctgacacttaattcgcactc

SEQ ID NO: 279613 - DNA, 25 bp, Rattus norvegicus
cttctctgagatactgccttcctgc

SEQ ID NO: 279614 - DNA, 25 bp, Rattus norvegicus
cttctctgagattctgccttcctgc

SEQ ID NO: 279615 - DNA, 25 bp, Rattus norvegicus
cttctctgctctcatggtggcataa

SEQ ID NO: 279616 - DNA, 25 bp, Rattus norvegicus
cttctctgctctgatggtggcataa

SEQ ID NO: 279617 - DNA, 25 bp, Rattus norvegicus
cttctctgctgaattctggtttgaa

SEQ ID NO: 279618 - DNA, 25 bp, Rattus norvegicus
cttctctgctgatttctggtttgaa

SEQ ID NO: 279619 - DNA, 25 bp, Rattus norvegicus
cttctctggtagcagtgcctatgta

SEQ ID NO: 279620 - DNA, 25 bp, Rattus norvegicus
cttctctggtaggagtgcctatgta

SEQ ID NO: 279621 - DNA, 25 bp, Rattus norvegicus
cttctctggtcaagcatgtgtggaa

SEQ ID NO: 279622 - DNA, 25 bp, Rattus norvegicus
cttctctggtcatgcatgtgtggaa

SEQ ID NO: 279623 - DNA, 25 bp, Rattus norvegicus
cttctctgtctcagatgtgtttgtt

SEQ ID NO: 279624 - DNA, 25 bp, Rattus norvegicus
cttctctgtctctgatgtgtttgtt

SEQ ID NO: 279625 - DNA, 25 bp, Rattus norvegicus
cttctctgtggtactttttgctgaa

SEQ ID NO: 279626 - DNA, 25 bp, Rattus norvegicus
cttctctgtggttctttttgctgaa

SEQ ID NO: 279627 - DNA, 25 bp, Rattus norvegicus
cttctcttcggcagtctttagataa

SEQ ID NO: 279628 - DNA, 25 bp, Rattus norvegicus
cttctcttcggctgtctttagataa

SEQ ID NO: 279629 - DNA, 25 bp, Rattus norvegicus
cttctcttcggtattatctactttg

SEQ ID NO: 279630 - DNA, 25 bp, Rattus norvegicus
cttctcttcggttttatctactttg

SEQ ID NO: 279631 - DNA, 25 bp, Rattus norvegicus
cttctcttcttgagttggatacata

SEQ ID NO: 279632 - DNA, 25 bp, Rattus norvegicus
cttctcttcttgtgttggatacata

SEQ ID NO: 279633 - DNA, 25 bp, Rattus norvegicus
cttctcttgctaaaatctggccttt

SEQ ID NO: 279634 - DNA, 25 bp, Rattus norvegicus
cttctcttgctataatctggccttt

SEQ ID NO: 279635 - DNA, 25 bp, Rattus norvegicus
cttctcttggacattaggactgtac

SEQ ID NO: 279636 - DNA, 25 bp, Rattus norvegicus
cttctcttggactttaggactgtac

SEQ ID NO: 279637 - DNA, 25 bp, Rattus norvegicus
cttctcttggcgcgctccaatactt

SEQ ID NO: 279638 - DNA, 25 bp, Rattus norvegicus
cttctcttggcgggctccaatactt

SEQ ID NO: 279639 - DNA, 25 bp, Rattus norvegicus
cttctcttgggtcgcatctgcaaat

SEQ ID NO: 279640 - DNA, 25 bp, Rattus norvegicus
cttctcttgggtggcatctgcaaat

SEQ ID NO: 279641 - DNA, 25 bp, Rattus norvegicus
cttctcttggttacttcctggtgtg

SEQ ID NO: 279642 - DNA, 25 bp, Rattus norvegicus
cttctcttggtttcttcctggtgtg

SEQ ID NO: 279643 - DNA, 25 bp, Rattus norvegicus
cttctcttgtctaacacggttcaaa

SEQ ID NO: 279644 - DNA, 25 bp, Rattus norvegicus
cttctcttgtcttacacggttcaaa

SEQ ID NO: 279645 - DNA, 25 bp, Rattus norvegicus
cttctcttgtgacaaagtggacatt

SEQ ID NO: 279646 - DNA, 25 bp, Rattus norvegicus
cttctcttgtgagaaagtggacatt

SEQ ID NO: 279647 - DNA, 25 bp, Rattus norvegicus
cttctcttgtgtactttgctttgaa

SEQ ID NO: 279648 - DNA, 25 bp, Rattus norvegicus
cttctcttgtgttctttgctttgaa

SEQ ID NO: 279649 - DNA, 25 bp, Rattus norvegicus
cttctctttgccacttacttgaaag

SEQ ID NO: 279650 - DNA, 25 bp, Rattus norvegicus
cttctctttgcctcttacttgaaag

SEQ ID NO: 279651 - DNA, 25 bp, Rattus norvegicus
cttctctttttcatctttacatctg

SEQ ID NO: 279652 - DNA, 25 bp, Rattus norvegicus
cttctctttttcttctttacatctg

SEQ ID NO: 279653 - DNA, 25 bp, Rattus norvegicus
cttctgaaacctctcattggctagc

SEQ ID NO: 279654 - DNA, 25 bp, Rattus norvegicus
cttctgaaacctgtcattggctagc

SEQ ID NO: 279655 - DNA, 25 bp, Rattus norvegicus
cttctgaaagtgaaacgccctggtc

SEQ ID NO: 279656 - DNA, 25 bp, Rattus norvegicus
cttctgaaagtgtaacgccctggtc

SEQ ID NO: 279657 - DNA, 25 bp, Rattus norvegicus
cttctgaattcactactccagtaac

SEQ ID NO: 279658 - DNA, 25 bp, Rattus norvegicus
cttctgaattcagtactccagtaac

SEQ ID NO: 279659 - DNA, 25 bp, Rattus norvegicus
cttctgacctccattgtggttaatg

SEQ ID NO: 279660 - DNA, 25 bp, Rattus norvegicus
cttctgacctcctttgtggttaatg

SEQ ID NO: 279661 - DNA, 25 bp, Rattus norvegicus
cttctgacctctctgaataactgca

SEQ ID NO: 279662 - DNA, 25 bp, Rattus norvegicus
cttctgacctctgtgaataactgca

SEQ ID NO: 279663 - DNA, 25 bp, Rattus norvegicus
cttctgactctgaatacactctttc

SEQ ID NO: 279664 - DNA, 25 bp, Rattus norvegicus
cttctgactctgtatacactctttc

SEQ ID NO: 279665 - DNA, 25 bp, Rattus norvegicus
cttctgagcttgctctcaagagaga

SEQ ID NO: 279666 - DNA, 25 bp, Rattus norvegicus
cttctgagcttggtctcaagagaga

SEQ ID NO: 279667 - DNA, 25 bp, Rattus norvegicus
cttctgaggacccagcactcatgtg

SEQ ID NO: 279668 - DNA, 25 bp, Rattus norvegicus
cttctgaggaccgagcactcatgtg

SEQ ID NO: 279669 - DNA, 25 bp, Rattus norvegicus
cttctgagttctagtttttgagcaa

SEQ ID NO: 279670 - DNA, 25 bp, Rattus norvegicus
cttctgagttcttgtttttgagcaa

SEQ ID NO: 279671 - DNA, 25 bp, Rattus norvegicus
cttctgatgggtcgtgtttggctta

SEQ ID NO: 279672 - DNA, 25 bp, Rattus norvegicus
cttctgatgggtggtgtttggctta

SEQ ID NO: 279673 - DNA, 25 bp, Rattus norvegicus
cttctgatgtgtctctgtttgctat

SEQ ID NO: 279674 - DNA, 25 bp, Rattus norvegicus
cttctgatgtgtgtctgtttgctat

SEQ ID NO: 279675 - DNA, 25 bp, Rattus norvegicus
cttctgattcagaccctaggtgtca

SEQ ID NO: 279676 - DNA, 25 bp, Rattus norvegicus
cttctgattcagtccctaggtgtca

SEQ ID NO: 279677 - DNA, 25 bp, Rattus norvegicus
cttctgcagctactcatcaagacga

SEQ ID NO: 279678 - DNA, 25 bp, Rattus norvegicus
cttctgcagctagtcatcaagacga

SEQ ID NO: 279679 - DNA, 25 bp, Rattus norvegicus
cttctgccccagagatggttcttaa

SEQ ID NO: 279680 - DNA, 25 bp, Rattus norvegicus
cttctgccccagtgatggttcttaa

SEQ ID NO: 279681 - DNA, 25 bp, Rattus norvegicus
cttctgccgggtatttgtacatgta

SEQ ID NO: 279682 - DNA, 25 bp, Rattus norvegicus
cttctgccgggtttttgtacatgta

SEQ ID NO: 279683 - DNA, 25 bp, Rattus norvegicus
cttctgcctcctaatccaaatatgg

SEQ ID NO: 279684 - DNA, 25 bp, Rattus norvegicus
cttctgcctccttatccaaatatgg

SEQ ID NO: 279685 - DNA, 25 bp, Rattus norvegicus
cttctgcctttcatgagatctgtgt

SEQ ID NO: 279686 - DNA, 25 bp, Rattus norvegicus
cttctgcctttcttgagatctgtgt

SEQ ID NO: 279687 - DNA, 25 bp, Rattus norvegicus
cttctgcgtagactgtctgctgtga

SEQ ID NO: 279688 - DNA, 25 bp, Rattus norvegicus
cttctgcgtagagtgtctgctgtga

SEQ ID NO: 279689 - DNA, 25 bp, Rattus norvegicus
cttctgcgtgtaactgatgctgtta

SEQ ID NO: 279690 - DNA, 25 bp, Rattus norvegicus
cttctgcgtgtatctgatgctgtta

SEQ ID NO: 279691 - DNA, 25 bp, Rattus norvegicus
cttctgctattcacctagaggacag

SEQ ID NO: 279692 - DNA, 25 bp, Rattus norvegicus
cttctgctattctcctagaggacag

SEQ ID NO: 279693 - DNA, 25 bp, Rattus norvegicus
cttctgctctctatgcgatatagga

SEQ ID NO: 279694 - DNA, 25 bp, Rattus norvegicus
cttctgctctctttgcgatatagga

SEQ ID NO: 279695 - DNA, 25 bp, Rattus norvegicus
cttctgctcttaacatgccatgatg

SEQ ID NO: 279696 - DNA, 25 bp, Rattus norvegicus
cttctgctcttatcatgccatgatg

SEQ ID NO: 279697 - DNA, 25 bp, Rattus norvegicus
cttctgctgtataccactatcgtat

SEQ ID NO: 279698 - DNA, 25 bp, Rattus norvegicus
cttctgctgtattccactatcgtat

SEQ ID NO: 279699 - DNA, 25 bp, Rattus norvegicus
cttctgcttatgagtggactgagca

SEQ ID NO: 279700 - DNA, 25 bp, Rattus norvegicus
cttctgcttatgtgtggactgagca

SEQ ID NO: 279701 - DNA, 25 bp, Rattus norvegicus
cttctgcttgaaatgtgtctcttaa

SEQ ID NO: 279702 - DNA, 25 bp, Rattus norvegicus
cttctgcttgaattgtgtctcttaa

SEQ ID NO: 279703 - DNA, 25 bp, Rattus norvegicus
cttctgctttatcctcttgtgggag

SEQ ID NO: 279704 - DNA, 25 bp, Rattus norvegicus
cttctgctttatgctcttgtgggag

SEQ ID NO: 279705 - DNA, 25 bp, Rattus norvegicus
cttctggaaactctgaggaccttgt

SEQ ID NO: 279706 - DNA, 25 bp, Rattus norvegicus
cttctggaaactgtgaggaccttgt

SEQ ID NO: 279707 - DNA, 25 bp, Rattus norvegicus
cttctggaaagtcatctctgtctga

SEQ ID NO: 279708 - DNA, 25 bp, Rattus norvegicus
cttctggaaagtgatctctgtctga

SEQ ID NO: 279709 - DNA, 25 bp, Rattus norvegicus
cttctggaactgaatctcacaaagt

SEQ ID NO: 279710 - DNA, 25 bp, Rattus norvegicus
cttctggaactgtatctcacaaagt

SEQ ID NO: 279711 - DNA, 25 bp, Rattus norvegicus
cttctggacatgattgtgagtacct

SEQ ID NO: 279712 - DNA, 25 bp, Rattus norvegicus
cttctggacatgtttgtgagtacct

SEQ ID NO: 279713 - DNA, 25 bp, Rattus norvegicus
cttctggagcaccttttaaagccta

SEQ ID NO: 279714 - DNA, 25 bp, Rattus norvegicus
cttctggagcacgttttaaagccta

SEQ ID NO: 279715 - DNA, 25 bp, Rattus norvegicus
cttctggagccaccaggtgttctaa

SEQ ID NO: 279716 - DNA, 25 bp, Rattus norvegicus
cttctggagccagcaggtgttctaa

SEQ ID NO: 279717 - DNA, 25 bp, Rattus norvegicus
cttctggcacgcaggtgtatctgca

SEQ ID NO: 279718 - DNA, 25 bp, Rattus norvegicus
cttctggcacgctggtgtatctgca

SEQ ID NO: 279719 - DNA, 25 bp, Rattus norvegicus
cttctggcagaaaagctcttgctgt

SEQ ID NO: 279720 - DNA, 25 bp, Rattus norvegicus
cttctggcagaatagctcttgctgt

SEQ ID NO: 279721 - DNA, 25 bp, Rattus norvegicus
cttctggcatgcaggtgcacattgc

SEQ ID NO: 279722 - DNA, 25 bp, Rattus norvegicus
cttctggcatgctggtgcacattgc

SEQ ID NO: 279723 - DNA, 25 bp, Rattus norvegicus
cttctgggattgctgtccactctgc

SEQ ID NO: 279724 - DNA, 25 bp, Rattus norvegicus
cttctgggattggtgtccactctgc

SEQ ID NO: 279725 - DNA, 25 bp, Rattus norvegicus
cttctgggcagcagatgactagtca

SEQ ID NO: 279726 - DNA, 25 bp, Rattus norvegicus
cttctgggcagctgatgactagtca

SEQ ID NO: 279727 - DNA, 25 bp, Rattus norvegicus
cttctgggccacaaattcacattta

SEQ ID NO: 279728 - DNA, 25 bp, Rattus norvegicus
cttctgggccactaattcacattta

SEQ ID NO: 279729 - DNA, 25 bp, Rattus norvegicus
cttctgggcctgatatttgcattac

SEQ ID NO: 279730 - DNA, 25 bp, Rattus norvegicus
cttctgggcctgttatttgcattac

SEQ ID NO: 279731 - DNA, 25 bp, Rattus norvegicus
cttctgggtcttatgcagggtttga

SEQ ID NO: 279732 - DNA, 25 bp, Rattus norvegicus
cttctgggtcttttgcagggtttga

SEQ ID NO: 279733 - DNA, 25 bp, Rattus norvegicus
cttctgggtgcaaaccagtcttacc

SEQ ID NO: 279734 - DNA, 25 bp, Rattus norvegicus
cttctgggtgcataccagtcttacc

SEQ ID NO: 279735 - DNA, 25 bp, Rattus norvegicus
cttctgggtgctcagatgaaaggaa

SEQ ID NO: 279736 - DNA, 25 bp, Rattus norvegicus
cttctgggtgctgagatgaaaggaa

SEQ ID NO: 279737 - DNA, 25 bp, Rattus norvegicus
cttctggtcacaaagttccctgaga

SEQ ID NO: 279738 - DNA, 25 bp, Rattus norvegicus
cttctggtcacatagttccctgaga

SEQ ID NO: 279739 - DNA, 25 bp, Rattus norvegicus
cttctggtcaccagatcttatgatg

SEQ ID NO: 279740 - DNA, 25 bp, Rattus norvegicus
cttctggtcacctgatcttatgatg

SEQ ID NO: 279741 - DNA, 25 bp, Rattus norvegicus
cttctggtcctcaagggcactgcat

SEQ ID NO: 279742 - DNA, 25 bp, Rattus norvegicus
cttctggtcctctagggcactgcat

SEQ ID NO: 279743 - DNA, 25 bp, Rattus norvegicus
cttctggtctgtactttgagccgat

SEQ ID NO: 279744 - DNA, 25 bp, Rattus norvegicus
cttctggtctgttctttgagccgat

SEQ ID NO: 279745 - DNA, 25 bp, Rattus norvegicus
cttctggtgtctactgttcattaga

SEQ ID NO: 279746 - DNA, 25 bp, Rattus norvegicus
cttctggtgtcttctgttcattaga

SEQ ID NO: 279747 - DNA, 25 bp, Rattus norvegicus
cttctggttccaaatagagttcgaa

SEQ ID NO: 279748 - DNA, 25 bp, Rattus norvegicus
cttctggttccatatagagttcgaa

SEQ ID NO: 279749 - DNA, 25 bp, Rattus norvegicus
cttctggtttctcggctaaggactg

SEQ ID NO: 279750 - DNA, 25 bp, Rattus norvegicus
cttctggtttctgggctaaggactg

SEQ ID NO: 279751 - DNA, 25 bp, Rattus norvegicus
cttctgtaaagaatgactgctaggg

SEQ ID NO: 279752 - DNA, 25 bp, Rattus norvegicus
cttctgtaaagattgactgctaggg

SEQ ID NO: 279753 - DNA, 25 bp, Rattus norvegicus
cttctgtactagacagactcctgac

SEQ ID NO: 279754 - DNA, 25 bp, Rattus norvegicus
cttctgtactagtcagactcctgac

SEQ ID NO: 279755 - DNA, 25 bp, Rattus norvegicus
cttctgtatctgaaatcggttagca

SEQ ID NO: 279756 - DNA, 25 bp, Rattus norvegicus
cttctgtatctgctctcttggatta

SEQ ID NO: 279757 - DNA, 25 bp, Rattus norvegicus
cttctgtatctggtctcttggatta

SEQ ID NO: 279758 - DNA, 25 bp, Rattus norvegicus
cttctgtatctgtaatcggttagca

SEQ ID NO: 279759 - DNA, 25 bp, Rattus norvegicus
cttctgtatggccagagcgcaggcc

SEQ ID NO: 279760 - DNA, 25 bp, Rattus norvegicus
cttctgtatggcgagagcgcaggcc

SEQ ID NO: 279761 - DNA, 25 bp, Rattus norvegicus
cttctgtcacagaggctcagagcag

SEQ ID NO: 279762 - DNA, 25 bp, Rattus norvegicus
cttctgtcacagtggctcagagcag

SEQ ID NO: 279763 - DNA, 25 bp, Rattus norvegicus
cttctgtcttctactgtgcagtgac

SEQ ID NO: 279764 - DNA, 25 bp, Rattus norvegicus
cttctgtcttcttctgtgcagtgac

SEQ ID NO: 279765 - DNA, 25 bp, Rattus norvegicus
cttctgtgattaattatgctgcctc

SEQ ID NO: 279766 - DNA, 25 bp, Rattus norvegicus
cttctgtgattatttatgctgcctc

SEQ ID NO: 279767 - DNA, 25 bp, Rattus norvegicus
cttctgtgctcacccttgagttaaa

SEQ ID NO: 279768 - DNA, 25 bp, Rattus norvegicus
cttctgtgctcagccttgagttaaa

SEQ ID NO: 279769 - DNA, 25 bp, Rattus norvegicus
cttctgtggatactatgggcctgcc

SEQ ID NO: 279770 - DNA, 25 bp, Rattus norvegicus
cttctgtggatagtatgggcctgcc

SEQ ID NO: 279771 - DNA, 25 bp, Rattus norvegicus
cttctgtggcagagctggtagcctt

SEQ ID NO: 279772 - DNA, 25 bp, Rattus norvegicus
cttctgtggcagtgctggtagcctt

SEQ ID NO: 279773 - DNA, 25 bp, Rattus norvegicus
cttctgtgtgccctttgtctttttg

SEQ ID NO: 279774 - DNA, 25 bp, Rattus norvegicus
cttctgtgtgccgtttgtctttttg

SEQ ID NO: 279775 - DNA, 25 bp, Rattus norvegicus
cttctgtgtttgagctagccatact

SEQ ID NO: 279776 - DNA, 25 bp, Rattus norvegicus
cttctgtgtttgtgctagccatact

SEQ ID NO: 279777 - DNA, 25 bp, Rattus norvegicus
cttctgttataccatctttgcctga

SEQ ID NO: 279778 - DNA, 25 bp, Rattus norvegicus
cttctgttatacgatctttgcctga

SEQ ID NO: 279779 - DNA, 25 bp, Rattus norvegicus
cttctgttatgtcccttcttatagg

SEQ ID NO: 279780 - DNA, 25 bp, Rattus norvegicus
cttctgttatgtgccttcttatagg

SEQ ID NO: 279781 - DNA, 25 bp, Rattus norvegicus
cttctgttcaccaggtttccattta

SEQ ID NO: 279782 - DNA, 25 bp, Rattus norvegicus
cttctgttcacctggtttccattta

SEQ ID NO: 279783 - DNA, 25 bp, Rattus norvegicus
cttctgttcactctcacttaatttt

SEQ ID NO: 279784 - DNA, 25 bp, Rattus norvegicus
cttctgttcactgtcacttaatttt

SEQ ID NO: 279785 - DNA, 25 bp, Rattus norvegicus
cttctgttcaggaggcatctggttg

SEQ ID NO: 279786 - DNA, 25 bp, Rattus norvegicus
cttctgttcaggtggcatctggttg

SEQ ID NO: 279787 - DNA, 25 bp, Rattus norvegicus
cttctgttctgcaactttttcttca

SEQ ID NO: 279788 - DNA, 25 bp, Rattus norvegicus
cttctgttctgctactttttcttca

SEQ ID NO: 279789 - DNA, 25 bp, Rattus norvegicus
cttctgtttaggatctggtgatcaa

SEQ ID NO: 279790 - DNA, 25 bp, Rattus norvegicus
cttctgtttaggttctggtgatcaa

SEQ ID NO: 279791 - DNA, 25 bp, Rattus norvegicus
cttcttaactcaaacctcattcaat

SEQ ID NO: 279792 - DNA, 25 bp, Rattus norvegicus
cttcttaactcatacctcattcaat

SEQ ID NO: 279793 - DNA, 25 bp, Rattus norvegicus
cttcttacagtcaaaccccattaat

SEQ ID NO: 279794 - DNA, 25 bp, Rattus norvegicus
cttcttacagtctaaccccattaat

SEQ ID NO: 279795 - DNA, 25 bp, Rattus norvegicus
cttcttacctttccacacacttttt

SEQ ID NO: 279796 - DNA, 25 bp, Rattus norvegicus
cttcttacctttgcacacacttttt

SEQ ID NO: 279797 - DNA, 25 bp, Rattus norvegicus
cttcttagctagattcttcctgagt

SEQ ID NO: 279798 - DNA, 25 bp, Rattus norvegicus
cttcttagctagtttcttcctgagt

SEQ ID NO: 279799 - DNA, 25 bp, Rattus norvegicus
cttcttagggtaacctgggtctgct

SEQ ID NO: 279800 - DNA, 25 bp, Rattus norvegicus
cttcttagggtatcctgggtctgct

SEQ ID NO: 279801 - DNA, 25 bp, Rattus norvegicus
cttcttagtaacctggtgttttgat

SEQ ID NO: 279802 - DNA, 25 bp, Rattus norvegicus
cttcttagtaacgtggtgttttgat

SEQ ID NO: 279803 - DNA, 25 bp, Rattus norvegicus
cttcttagtcatcagctgcctatga

SEQ ID NO: 279804 - DNA, 25 bp, Rattus norvegicus
cttcttagtcatgagctgcctatga

SEQ ID NO: 279805 - DNA, 25 bp, Rattus norvegicus
cttcttatctacagcgtcctttaat

SEQ ID NO: 279806 - DNA, 25 bp, Rattus norvegicus
cttcttatctactgcgtcctttaat

SEQ ID NO: 279807 - DNA, 25 bp, Rattus norvegicus
cttcttatctgtaagccatcttggg

SEQ ID NO: 279808 - DNA, 25 bp, Rattus norvegicus
cttcttatctgttagccatcttggg

SEQ ID NO: 279809 - DNA, 25 bp, Rattus norvegicus
cttcttatgtggagtctctgtgcta

SEQ ID NO: 279810 - DNA, 25 bp, Rattus norvegicus
cttcttatgtggtgtctctgtgcta

SEQ ID NO: 279811 - DNA, 25 bp, Rattus norvegicus
cttcttatttgcagggtgctgatct

SEQ ID NO: 279812 - DNA, 25 bp, Rattus norvegicus
cttcttatttgctgggtgctgatct

SEQ ID NO: 279813 - DNA, 25 bp, Rattus norvegicus
cttcttcaaattaaactcgccacag

SEQ ID NO: 279814 - DNA, 25 bp, Rattus norvegicus
cttcttcaaatttaactcgccacag

SEQ ID NO: 279815 - DNA, 25 bp, Rattus norvegicus
cttcttcaccagctgttcgcaaaaa

SEQ ID NO: 279816 - DNA, 25 bp, Rattus norvegicus
cttcttcaccaggtgttcgcaaaaa

SEQ ID NO: 279817 - DNA, 25 bp, Rattus norvegicus
cttcttcactaacctttacttcctt

SEQ ID NO: 279818 - DNA, 25 bp, Rattus norvegicus
cttcttcactaagctttacttcctt

SEQ ID NO: 279819 - DNA, 25 bp, Rattus norvegicus
cttcttcagacgcagcatccagaaa

SEQ ID NO: 279820 - DNA, 25 bp, Rattus norvegicus
cttcttcagacggagcatccagaaa

SEQ ID NO: 279821 - DNA, 25 bp, Rattus norvegicus
cttcttcaggcgagctctgatacaa

SEQ ID NO: 279822 - DNA, 25 bp, Rattus norvegicus
cttcttcaggcgtgctctgatacaa

SEQ ID NO: 279823 - DNA, 25 bp, Rattus norvegicus
cttcttcagttcatgctcagactta

SEQ ID NO: 279824 - DNA, 25 bp, Rattus norvegicus
cttcttcagttcttgctcagactta

SEQ ID NO: 279825 - DNA, 25 bp, Rattus norvegicus
cttcttcatgttccgtgtaattgtc

SEQ ID NO: 279826 - DNA, 25 bp, Rattus norvegicus
cttcttcatgttgcgtgtaattgtc

SEQ ID NO: 279827 - DNA, 25 bp, Rattus norvegicus
cttcttccaactacactgtgtgatt

SEQ ID NO: 279828 - DNA, 25 bp, Rattus norvegicus
cttcttccaacttcactgtgtgatt

SEQ ID NO: 279829 - DNA, 25 bp, Rattus norvegicus
cttcttccaggaaggcatggtgact

SEQ ID NO: 279830 - DNA, 25 bp, Rattus norvegicus
cttcttccaggatggcatggtgact

SEQ ID NO: 279831 - DNA, 25 bp, Rattus norvegicus
cttcttcccattcctgtgtttgtaa

SEQ ID NO: 279832 - DNA, 25 bp, Rattus norvegicus
cttcttcccattgctgtgtttgtaa

SEQ ID NO: 279833 - DNA, 25 bp, Rattus norvegicus
cttcttcctccccggatcagaaggg

SEQ ID NO: 279834 - DNA, 25 bp, Rattus norvegicus
cttcttcctcccgggatcagaaggg

SEQ ID NO: 279835 - DNA, 25 bp, Rattus norvegicus
cttcttcctgggagtgttctggaga

SEQ ID NO: 279836 - DNA, 25 bp, Rattus norvegicus
cttcttcctgggtgtgttctggaga

SEQ ID NO: 279837 - DNA, 25 bp, Rattus norvegicus
cttcttcctggtcgaaactctgtgt

SEQ ID NO: 279838 - DNA, 25 bp, Rattus norvegicus
cttcttcctggtggaaactctgtgt

SEQ ID NO: 279839 - DNA, 25 bp, Rattus norvegicus
cttcttcgagtgactgactgcagca

SEQ ID NO: 279840 - DNA, 25 bp, Rattus norvegicus
cttcttcgagtgtctgactgcagca

SEQ ID NO: 279841 - DNA, 25 bp, Rattus norvegicus
cttcttcggtctaaagggctcagga

SEQ ID NO: 279842 - DNA, 25 bp, Rattus norvegicus
cttcttcggtcttaagggctcagga

SEQ ID NO: 279843 - DNA, 25 bp, Rattus norvegicus
cttcttcgtcatcaacttgctggag

SEQ ID NO: 279844 - DNA, 25 bp, Rattus norvegicus
cttcttcgtcatgaacttgctggag

SEQ ID NO: 279845 - DNA, 25 bp, Rattus norvegicus
cttcttctctgtcgaccaactagaa

SEQ ID NO: 279846 - DNA, 25 bp, Rattus norvegicus
cttcttctctgtggaccaactagaa

SEQ ID NO: 279847 - DNA, 25 bp, Rattus norvegicus
cttcttctggttcgtgggtttctgc

SEQ ID NO: 279848 - DNA, 25 bp, Rattus norvegicus
cttcttctggttggtgggtttctgc

SEQ ID NO: 279849 - DNA, 25 bp, Rattus norvegicus
cttcttctgtggcttgatgtggact

SEQ ID NO: 279850 - DNA, 25 bp, Rattus norvegicus
cttcttctgtgggttgatgtggact

SEQ ID NO: 279851 - DNA, 25 bp, Rattus norvegicus
cttcttcttcgacaactacaccggg

SEQ ID NO: 279852 - DNA, 25 bp, Rattus norvegicus
cttcttcttcgagaactacaccggg

SEQ ID NO: 279853 - DNA, 25 bp, Rattus norvegicus
cttcttgactagctactatcctttg

SEQ ID NO: 279854 - DNA, 25 bp, Rattus norvegicus
cttcttgactaggtactatcctttg

SEQ ID NO: 279855 - DNA, 25 bp, Rattus norvegicus
cttcttgcggaacccgaacgtggcg

SEQ ID NO: 279856 - DNA, 25 bp, Rattus norvegicus
cttcttgcggaagccgaacgtggcg

SEQ ID NO: 279857 - DNA, 25 bp, Rattus norvegicus
cttcttgcgtctactgtatgtttaa

SEQ ID NO: 279858 - DNA, 25 bp, Rattus norvegicus
cttcttgcgtcttctgtatgtttaa

SEQ ID NO: 279859 - DNA, 25 bp, Rattus norvegicus
cttcttgctaaacctgagcagttag

SEQ ID NO: 279860 - DNA, 25 bp, Rattus norvegicus
cttcttgctaaagctgagcagttag

SEQ ID NO: 279861 - DNA, 25 bp, Rattus norvegicus
cttcttgctatgaaactgctaacgt

SEQ ID NO: 279862 - DNA, 25 bp, Rattus norvegicus
cttcttgctatgtaactgctaacgt

SEQ ID NO: 279863 - DNA, 25 bp, Rattus norvegicus
cttcttgcttccattcttatcgaaa

SEQ ID NO: 279864 - DNA, 25 bp, Rattus norvegicus
cttcttgcttcctttcttatcgaaa

SEQ ID NO: 279865 - DNA, 25 bp, Rattus norvegicus
cttcttggaaggctggctaaggcct

SEQ ID NO: 279866 - DNA, 25 bp, Rattus norvegicus
cttcttggaagggtggctaaggcct

SEQ ID NO: 279867 - DNA, 25 bp, Rattus norvegicus
cttcttggatcgctgtcatacctgg

SEQ ID NO: 279868 - DNA, 25 bp, Rattus norvegicus
cttcttggatcggtgtcatacctgg

SEQ ID NO: 279869 - DNA, 25 bp, Rattus norvegicus
cttcttggattgactctaacggctc

SEQ ID NO: 279870 - DNA, 25 bp, Rattus norvegicus
cttcttggattgtctctaacggctc

SEQ ID NO: 279871 - DNA, 25 bp, Rattus norvegicus
cttcttggcaagcatttataaccct

SEQ ID NO: 279872 - DNA, 25 bp, Rattus norvegicus
cttcttggcaaggatttataaccct

SEQ ID NO: 279873 - DNA, 25 bp, Rattus norvegicus
cttcttggccctcgcagtttgcaac

SEQ ID NO: 279874 - DNA, 25 bp, Rattus norvegicus
cttcttggccctggcagtttgcaac

SEQ ID NO: 279875 - DNA, 25 bp, Rattus norvegicus
cttcttggttgcacacagcctaata

SEQ ID NO: 279876 - DNA, 25 bp, Rattus norvegicus
cttcttggttgctcacagcctaata

SEQ ID NO: 279877 - DNA, 25 bp, Rattus norvegicus
cttcttgtgctcagaagatgccagt

SEQ ID NO: 279878 - DNA, 25 bp, Rattus norvegicus
cttcttgtgctctgaagatgccagt

SEQ ID NO: 279879 - DNA, 25 bp, Rattus norvegicus
cttcttgtggatagtcgagtggcat

SEQ ID NO: 279880 - DNA, 25 bp, Rattus norvegicus
cttcttgtggattgtcgagtggcat

SEQ ID NO: 279881 - DNA, 25 bp, Rattus norvegicus
cttcttgtttaacgagcttctctga

SEQ ID NO: 279882 - DNA, 25 bp, Rattus norvegicus
cttcttgtttaaggagcttctctga

SEQ ID NO: 279883 - DNA, 25 bp, Rattus norvegicus
cttctttaaagcagcattcccatgc

SEQ ID NO: 279884 - DNA, 25 bp, Rattus norvegicus
cttctttaaagctgcattcccatgc

SEQ ID NO: 279885 - DNA, 25 bp, Rattus norvegicus
cttctttcaaaacgctcattcccat

SEQ ID NO: 279886 - DNA, 25 bp, Rattus norvegicus
cttctttcaaaaggctcattcccat

SEQ ID NO: 279887 - DNA, 25 bp, Rattus norvegicus
cttctttcacttctagttgggagaa

SEQ ID NO: 279888 - DNA, 25 bp, Rattus norvegicus
cttctttcacttgtagttgggagaa

SEQ ID NO: 279889 - DNA, 25 bp, Rattus norvegicus
cttctttccactcctctaaataaat

SEQ ID NO: 279890 - DNA, 25 bp, Rattus norvegicus
cttctttccactgctctaaataaat

SEQ ID NO: 279891 - DNA, 25 bp, Rattus norvegicus
cttctttccgtccagtgacaacaaa

SEQ ID NO: 279892 - DNA, 25 bp, Rattus norvegicus
cttctttccgtcgagtgacaacaaa

SEQ ID NO: 279893 - DNA, 25 bp, Rattus norvegicus
cttctttcctctcagttatatcatt

SEQ ID NO: 279894 - DNA, 25 bp, Rattus norvegicus
cttctttcctctgagttatatcatt

SEQ ID NO: 279895 - DNA, 25 bp, Rattus norvegicus
cttctttcgagtacttatctgtggg

SEQ ID NO: 279896 - DNA, 25 bp, Rattus norvegicus
cttctttcgagttcttatctgtggg

SEQ ID NO: 279897 - DNA, 25 bp, Rattus norvegicus
cttctttctccgcaaaatgttgagg

SEQ ID NO: 279898 - DNA, 25 bp, Rattus norvegicus
cttctttctccggaaaatgttgagg

SEQ ID NO: 279899 - DNA, 25 bp, Rattus norvegicus
cttctttgaggcagtgacttagggc

SEQ ID NO: 279900 - DNA, 25 bp, Rattus norvegicus
cttctttgaggctgtgacttagggc

SEQ ID NO: 279901 - DNA, 25 bp, Rattus norvegicus
cttctttgattgaagctctgtgctg

SEQ ID NO: 279902 - DNA, 25 bp, Rattus norvegicus
cttctttgattgtagctctgtgctg

SEQ ID NO: 279903 - DNA, 25 bp, Rattus norvegicus
cttctttggcaaacacctggacagt

SEQ ID NO: 279904 - DNA, 25 bp, Rattus norvegicus
cttctttggcaatcacctggacagt

SEQ ID NO: 279905 - DNA, 25 bp, Rattus norvegicus
cttctttgggatcctatttcagcca

SEQ ID NO: 279906 - DNA, 25 bp, Rattus norvegicus
cttctttgggatgctatttcagcca

SEQ ID NO: 279907 - DNA, 25 bp, Rattus norvegicus
cttctttgtgctctggtccagtaaa

SEQ ID NO: 279908 - DNA, 25 bp, Rattus norvegicus
cttctttgtgctgtggtccagtaaa

SEQ ID NO: 279909 - DNA, 25 bp, Rattus norvegicus
cttcttttcttgacttctcggatgc

SEQ ID NO: 279910 - DNA, 25 bp, Rattus norvegicus
cttcttttcttgtcttctcggatgc

SEQ ID NO: 279911 - DNA, 25 bp, Rattus norvegicus
cttcttttgctcctcaagttctagg

SEQ ID NO: 279912 - DNA, 25 bp, Rattus norvegicus
cttcttttgctcgtcaagttctagg

SEQ ID NO: 279913 - DNA, 25 bp, Rattus norvegicus
cttctttttactatggtggcacttt

SEQ ID NO: 279914 - DNA, 25 bp, Rattus norvegicus
cttctttttactttggtggcacttt

SEQ ID NO: 279915 - DNA, 25 bp, Rattus norvegicus
cttctttttccaaatcatctctcta

SEQ ID NO: 279916 - DNA, 25 bp, Rattus norvegicus
cttctttttccatatcatctctcta

SEQ ID NO: 279917 - DNA, 25 bp, Rattus norvegicus
cttgaaaacaacatatggctggact

SEQ ID NO: 279918 - DNA, 25 bp, Rattus norvegicus
cttgaaaacaacttatggctggact

SEQ ID NO: 279919 - DNA, 25 bp, Rattus norvegicus
cttgaaaccgttagcactgacttgc

SEQ ID NO: 279920 - DNA, 25 bp, Rattus norvegicus
cttgaaaccgtttgcactgacttgc

SEQ ID NO: 279921 - DNA, 25 bp, Rattus norvegicus
cttgaaacctatccagaggacccta

SEQ ID NO: 279922 - DNA, 25 bp, Rattus norvegicus
cttgaaacctatgcagaggacccta

SEQ ID NO: 279923 - DNA, 25 bp, Rattus norvegicus
cttgaaactaggatggtgggctgaa

SEQ ID NO: 279924 - DNA, 25 bp, Rattus norvegicus
cttgaaactaggttggtgggctgaa

SEQ ID NO: 279925 - DNA, 25 bp, Rattus norvegicus
cttgaaaggcttagtttgttcttct

SEQ ID NO: 279926 - DNA, 25 bp, Rattus norvegicus
cttgaaaggctttgtttgttcttct

SEQ ID NO: 279927 - DNA, 25 bp, Rattus norvegicus
cttgaaatggctctagtctggttgc

SEQ ID NO: 279928 - DNA, 25 bp, Rattus norvegicus
cttgaaatggctgtagtctggttgc

SEQ ID NO: 279929 - DNA, 25 bp, Rattus norvegicus
cttgaaattccacgatggcacaggt

SEQ ID NO: 279930 - DNA, 25 bp, Rattus norvegicus
cttgaaattccaggatggcacaggt

SEQ ID NO: 279931 - DNA, 25 bp, Rattus norvegicus
cttgaacaaattccggcctgctgtg

SEQ ID NO: 279932 - DNA, 25 bp, Rattus norvegicus
cttgaacaaattgcggcctgctgtg

SEQ ID NO: 279933 - DNA, 25 bp, Rattus norvegicus
cttgaacccagtatagagccttggt

SEQ ID NO: 279934 - DNA, 25 bp, Rattus norvegicus
cttgaacccagtttagagccttggt

SEQ ID NO: 279935 - DNA, 25 bp, Rattus norvegicus
cttgaacccttgagcccagaatggt

SEQ ID NO: 279936 - DNA, 25 bp, Rattus norvegicus
cttgaacccttgtgcccagaatggt

SEQ ID NO: 279937 - DNA, 25 bp, Rattus norvegicus
cttgaacctcaaccgggctgactgg

SEQ ID NO: 279938 - DNA, 25 bp, Rattus norvegicus
cttgaacctcaagcgggctgactgg

SEQ ID NO: 279939 - DNA, 25 bp, Rattus norvegicus
cttgaaccttgcatgggtcagtaat

SEQ ID NO: 279940 - DNA, 25 bp, Rattus norvegicus
cttgaaccttgcttgggtcagtaat

SEQ ID NO: 279941 - DNA, 25 bp, Rattus norvegicus
cttgaacgacctacagtggagaaat

SEQ ID NO: 279942 - DNA, 25 bp, Rattus norvegicus
cttgaacgaccttcagtggagaaat

SEQ ID NO: 279943 - DNA, 25 bp, Rattus norvegicus
cttgaacttagcctactctgtgaat

SEQ ID NO: 279944 - DNA, 25 bp, Rattus norvegicus
cttgaacttagcgtactctgtgaat

SEQ ID NO: 279945 - DNA, 25 bp, Rattus norvegicus
cttgaacttcctatcgttgtcatta

SEQ ID NO: 279946 - DNA, 25 bp, Rattus norvegicus
cttgaacttcctttcgttgtcatta

SEQ ID NO: 279947 - DNA, 25 bp, Rattus norvegicus
cttgaacttggtatatagcagagga

SEQ ID NO: 279948 - DNA, 25 bp, Rattus norvegicus
cttgaacttggtttatagcagagga

SEQ ID NO: 279949 - DNA, 25 bp, Rattus norvegicus
cttgaacttgtacctgaggttggac

SEQ ID NO: 279950 - DNA, 25 bp, Rattus norvegicus
cttgaacttgtagctgaggttggac

SEQ ID NO: 279951 - DNA, 25 bp, Rattus norvegicus
cttgaagaaagcagtctttctccct

SEQ ID NO: 279952 - DNA, 25 bp, Rattus norvegicus
cttgaagaaagctgtctttctccct

SEQ ID NO: 279953 - DNA, 25 bp, Rattus norvegicus
cttgaagaagctctcagaggtggaa

SEQ ID NO: 279954 - DNA, 25 bp, Rattus norvegicus
cttgaagaagctgtcagaggtggaa

SEQ ID NO: 279955 - DNA, 25 bp, Rattus norvegicus
cttgaagacatcacattctctctgt

SEQ ID NO: 279956 - DNA, 25 bp, Rattus norvegicus
cttgaagacatctcattctctctgt

SEQ ID NO: 279957 - DNA, 25 bp, Rattus norvegicus
cttgaagacttaagtacccatgtga

SEQ ID NO: 279958 - DNA, 25 bp, Rattus norvegicus
cttgaagacttatgtacccatgtga

SEQ ID NO: 279959 - DNA, 25 bp, Rattus norvegicus
cttgaagctgctcatgcctggatat

SEQ ID NO: 279960 - DNA, 25 bp, Rattus norvegicus
cttgaagctgctgatgcctggatat

SEQ ID NO: 279961 - DNA, 25 bp, Rattus norvegicus
cttgaagggctgcacctccatgaat

SEQ ID NO: 279962 - DNA, 25 bp, Rattus norvegicus
cttgaagggctggacctccatgaat

SEQ ID NO: 279963 - DNA, 25 bp, Rattus norvegicus
cttgaagtatttccagccactgact

SEQ ID NO: 279964 - DNA, 25 bp, Rattus norvegicus
cttgaagtatttgcagccactgact

SEQ ID NO: 279965 - DNA, 25 bp, Rattus norvegicus
cttgaagtccagatgccagcagagc

SEQ ID NO: 279966 - DNA, 25 bp, Rattus norvegicus
cttgaagtccagttgccagcagagc

SEQ ID NO: 279967 - DNA, 25 bp, Rattus norvegicus
cttgaataaaacacactcctctctc

SEQ ID NO: 279968 - DNA, 25 bp, Rattus norvegicus
cttgaataaaactcactcctctctc

SEQ ID NO: 279969 - DNA, 25 bp, Rattus norvegicus
cttgaataggtacctgcttctgtca

SEQ ID NO: 279970 - DNA, 25 bp, Rattus norvegicus
cttgaataggtagctgcttctgtca

SEQ ID NO: 279971 - DNA, 25 bp, Rattus norvegicus
cttgaatctgttaccacctggaact

SEQ ID NO: 279972 - DNA, 25 bp, Rattus norvegicus
cttgaatctgtttccacctggaact

SEQ ID NO: 279973 - DNA, 25 bp, Rattus norvegicus
cttgaattacaacagggcgcccgga

SEQ ID NO: 279974 - DNA, 25 bp, Rattus norvegicus
cttgaattacaagagggcgcccgga

SEQ ID NO: 279975 - DNA, 25 bp, Rattus norvegicus
cttgaattggctcatgtcgttggca

SEQ ID NO: 279976 - DNA, 25 bp, Rattus norvegicus
cttgaattggctgatgtcgttggca

SEQ ID NO: 279977 - DNA, 25 bp, Rattus norvegicus
cttgaatttttccttctgaagagct

SEQ ID NO: 279978 - DNA, 25 bp, Rattus norvegicus
cttgaatttttcgttctgaagagct

SEQ ID NO: 279979 - DNA, 25 bp, Rattus norvegicus
cttgacacagaaatggagttgccga

SEQ ID NO: 279980 - DNA, 25 bp, Rattus norvegicus
cttgacacagaattggagttgccga

SEQ ID NO: 279981 - DNA, 25 bp, Rattus norvegicus
cttgacaggcttcataacttattaa

SEQ ID NO: 279982 - DNA, 25 bp, Rattus norvegicus
cttgacaggcttgataacttattaa

SEQ ID NO: 279983 - DNA, 25 bp, Rattus norvegicus
cttgacatttcaaaggctgcctgaa

SEQ ID NO: 279984 - DNA, 25 bp, Rattus norvegicus
cttgacatttcataggctgcctgaa

SEQ ID NO: 279985 - DNA, 25 bp, Rattus norvegicus
cttgaccacccactcagacttaata

SEQ ID NO: 279986 - DNA, 25 bp, Rattus norvegicus
cttgaccacccagtcagacttaata

SEQ ID NO: 279987 - DNA, 25 bp, Rattus norvegicus
cttgacccaaggctgtgataccatg

SEQ ID NO: 279988 - DNA, 25 bp, Rattus norvegicus
cttgacccaagggtgtgataccatg

SEQ ID NO: 279989 - DNA, 25 bp, Rattus norvegicus
cttgacccacccagatttgacagtt

SEQ ID NO: 279990 - DNA, 25 bp, Rattus norvegicus
cttgacccaccctgatttgacagtt

SEQ ID NO: 279991 - DNA, 25 bp, Rattus norvegicus
cttgacccagatcagcctgaaagga

SEQ ID NO: 279992 - DNA, 25 bp, Rattus norvegicus
cttgacccagatgagcctgaaagga

SEQ ID NO: 279993 - DNA, 25 bp, Rattus norvegicus
cttgacccatgcagctagttttgta

SEQ ID NO: 279994 - DNA, 25 bp, Rattus norvegicus
cttgacccatgctgctagttttgta

SEQ ID NO: 279995 - DNA, 25 bp, Rattus norvegicus
cttgaccccactagagtacactgca

SEQ ID NO: 279996 - DNA, 25 bp, Rattus norvegicus
cttgaccccacttgagtacactgca

SEQ ID NO: 279997 - DNA, 25 bp, Rattus norvegicus
cttgacccctgaagtgaggttgcaa

SEQ ID NO: 279998 - DNA, 25 bp, Rattus norvegicus
cttgacccctgatgtgaggttgcaa

SEQ ID NO: 279999 - DNA, 25 bp, Rattus norvegicus
cttgaccctggacgccgactgggca

SEQ ID NO: 280000 - DNA, 25 bp, Rattus norvegicus
cttgaccctggaggccgactgggca

SEQ ID NO: 280001 - DNA, 25 bp, Rattus norvegicus
cttgacctcctcagaggctgatgga

SEQ ID NO: 280002 - DNA, 25 bp, Rattus norvegicus
cttgacctcctctgaggctgatgga

SEQ ID NO: 280003 - DNA, 25 bp, Rattus norvegicus
cttgacctgcctctctttgggacac

SEQ ID NO: 280004 - DNA, 25 bp, Rattus norvegicus
cttgacctgcctgtctttgggacac

SEQ ID NO: 280005 - DNA, 25 bp, Rattus norvegicus
cttgacctttatctgggtcctgaac

SEQ ID NO: 280006 - DNA, 25 bp, Rattus norvegicus
cttgacctttatgtgggtcctgaac

SEQ ID NO: 280007 - DNA, 25 bp, Rattus norvegicus
cttgacctttcgaagctgtactgta

SEQ ID NO: 280008 - DNA, 25 bp, Rattus norvegicus
cttgacctttcgtagctgtactgta

SEQ ID NO: 280009 - DNA, 25 bp, Rattus norvegicus
cttgacgcacctaccctagcgaggg

SEQ ID NO: 280010 - DNA, 25 bp, Rattus norvegicus
cttgacgcaccttccctagcgaggg

SEQ ID NO: 280011 - DNA, 25 bp, Rattus norvegicus
cttgacgggtgcagcattaaacctt

SEQ ID NO: 280012 - DNA, 25 bp, Rattus norvegicus
cttgacgggtgctgcattaaacctt

SEQ ID NO: 280013 - DNA, 25 bp, Rattus norvegicus
cttgacgtcagaaggcggttgccac

SEQ ID NO: 280014 - DNA, 25 bp, Rattus norvegicus
cttgacgtcagatggcggttgccac

SEQ ID NO: 280015 - DNA, 25 bp, Rattus norvegicus
cttgactagcacaattttggtcggg

SEQ ID NO: 280016 - DNA, 25 bp, Rattus norvegicus
cttgactagcactattttggtcggg

SEQ ID NO: 280017 - DNA, 25 bp, Rattus norvegicus
cttgactccttcagggtctgtaagt

SEQ ID NO: 280018 - DNA, 25 bp, Rattus norvegicus
cttgactccttctgggtctgtaagt

SEQ ID NO: 280019 - DNA, 25 bp, Rattus norvegicus
cttgacttatctatctaggtgccat

SEQ ID NO: 280020 - DNA, 25 bp, Rattus norvegicus
cttgacttatctttctaggtgccat

SEQ ID NO: 280021 - DNA, 25 bp, Rattus norvegicus
cttgacttcctcaaccaaaacggat

SEQ ID NO: 280022 - DNA, 25 bp, Rattus norvegicus
cttgacttcctctaccaaaacggat

SEQ ID NO: 280023 - DNA, 25 bp, Rattus norvegicus
cttgacttcttcactgcacatattt

SEQ ID NO: 280024 - DNA, 25 bp, Rattus norvegicus
cttgacttcttctctgcacatattt

SEQ ID NO: 280025 - DNA, 25 bp, Rattus norvegicus
cttgagactctgcttgggtgactta

SEQ ID NO: 280026 - DNA, 25 bp, Rattus norvegicus
cttgagactctggttgggtgactta

SEQ ID NO: 280027 - DNA, 25 bp, Rattus norvegicus
cttgagactgataatatgagaactg

SEQ ID NO: 280028 - DNA, 25 bp, Rattus norvegicus
cttgagactgattatatgagaactg

SEQ ID NO: 280029 - DNA, 25 bp, Rattus norvegicus
cttgagatccttcctgggtgcctac

SEQ ID NO: 280030 - DNA, 25 bp, Rattus norvegicus
cttgagatccttgctgggtgcctac

SEQ ID NO: 280031 - DNA, 25 bp, Rattus norvegicus
cttgagatttacagacaggaacggg

SEQ ID NO: 280032 - DNA, 25 bp, Rattus norvegicus
cttgagatttactgacaggaacggg

SEQ ID NO: 280033 - DNA, 25 bp, Rattus norvegicus
cttgagcaagataatggtacctgga

SEQ ID NO: 280034 - DNA, 25 bp, Rattus norvegicus
cttgagcaagattatggtacctgga

SEQ ID NO: 280035 - DNA, 25 bp, Rattus norvegicus
cttgagcaatttaacagtttggaac

SEQ ID NO: 280036 - DNA, 25 bp, Rattus norvegicus
cttgagcaattttacagtttggaac

SEQ ID NO: 280037 - DNA, 25 bp, Rattus norvegicus
cttgagcacaggcaactccatgtac

SEQ ID NO: 280038 - DNA, 25 bp, Rattus norvegicus
cttgagcacagggaactccatgtac

SEQ ID NO: 280039 - DNA, 25 bp, Rattus norvegicus
cttgagcagcttctttcggaaggct

SEQ ID NO: 280040 - DNA, 25 bp, Rattus norvegicus
cttgagcagcttgtttcggaaggct

SEQ ID NO: 280041 - DNA, 25 bp, Rattus norvegicus
cttgagcaggagattcttagatcta

SEQ ID NO: 280042 - DNA, 25 bp, Rattus norvegicus
cttgagcaggagtttcttagatcta

SEQ ID NO: 280043 - DNA, 25 bp, Rattus norvegicus
cttgagccactaactgtttttcttt

SEQ ID NO: 280044 - DNA, 25 bp, Rattus norvegicus
cttgagccactatctgtttttcttt

SEQ ID NO: 280045 - DNA, 25 bp, Rattus norvegicus
cttgagccactgctgtggtggccaa

SEQ ID NO: 280046 - DNA, 25 bp, Rattus norvegicus
cttgagccactggtgtggtggccaa

SEQ ID NO: 280047 - DNA, 25 bp, Rattus norvegicus
cttgagcctgacactgtaaaagtaa

SEQ ID NO: 280048 - DNA, 25 bp, Rattus norvegicus
cttgagcctgactctgtaaaagtaa

SEQ ID NO: 280049 - DNA, 25 bp, Rattus norvegicus
cttgagcgctatcagactgggacgt

SEQ ID NO: 280050 - DNA, 25 bp, Rattus norvegicus
cttgagcgctatgagactgggacgt

SEQ ID NO: 280051 - DNA, 25 bp, Rattus norvegicus
cttgagcttgtgctgagcctttgca

SEQ ID NO: 280052 - DNA, 25 bp, Rattus norvegicus
cttgagcttgtggtgagcctttgca

SEQ ID NO: 280053 - DNA, 25 bp, Rattus norvegicus
cttgaggcccagaagcaggagtatc

SEQ ID NO: 280054 - DNA, 25 bp, Rattus norvegicus
cttgaggcccagtagcaggagtatc

SEQ ID NO: 280055 - DNA, 25 bp, Rattus norvegicus
cttgaggcctttatgtcagatggga

SEQ ID NO: 280056 - DNA, 25 bp, Rattus norvegicus
cttgaggcctttttgtcagatggga

SEQ ID NO: 280057 - DNA, 25 bp, Rattus norvegicus
cttgaggctgctattgactttgttc

SEQ ID NO: 280058 - DNA, 25 bp, Rattus norvegicus
cttgaggctgcttttgactttgttc

SEQ ID NO: 280059 - DNA, 25 bp, Rattus norvegicus
cttgagggacgaattttccatggct

SEQ ID NO: 280060 - DNA, 25 bp, Rattus norvegicus
cttgagggacgatttttccatggct

SEQ ID NO: 280061 - DNA, 25 bp, Rattus norvegicus
cttgagggcgtgagagttccctgtc

SEQ ID NO: 280062 - DNA, 25 bp, Rattus norvegicus
cttgagggcgtgtgagttccctgtc

SEQ ID NO: 280063 - DNA, 25 bp, Rattus norvegicus
cttgaggtatgtaccatttgtatac

SEQ ID NO: 280064 - DNA, 25 bp, Rattus norvegicus
cttgaggtatgttccatttgtatac

SEQ ID NO: 280065 - DNA, 25 bp, Rattus norvegicus
cttgaggtcatcctcctgtggagaa

SEQ ID NO: 280066 - DNA, 25 bp, Rattus norvegicus
cttgaggtcatcgtcctgtggagaa

SEQ ID NO: 280067 - DNA, 25 bp, Rattus norvegicus
cttgaggtgaggctgcacagctcca

SEQ ID NO: 280068 - DNA, 25 bp, Rattus norvegicus
cttgaggtgagggtgcacagctcca

SEQ ID NO: 280069 - DNA, 25 bp, Rattus norvegicus
cttgagtaacccattcctgatgata

SEQ ID NO: 280070 - DNA, 25 bp, Rattus norvegicus
cttgagtaaccctttcctgatgata

SEQ ID NO: 280071 - DNA, 25 bp, Rattus norvegicus
cttgagtaaccgatcattatgaact

SEQ ID NO: 280072 - DNA, 25 bp, Rattus norvegicus
cttgagtaaccgttcattatgaact

SEQ ID NO: 280073 - DNA, 25 bp, Rattus norvegicus
cttgagtccagcagtgggaggccat

SEQ ID NO: 280074 - DNA, 25 bp, Rattus norvegicus
cttgagtccagctgtgggaggccat

SEQ ID NO: 280075 - DNA, 25 bp, Rattus norvegicus
cttgagtccttgaacatatttctgt

SEQ ID NO: 280076 - DNA, 25 bp, Rattus norvegicus
cttgagtccttgtacatatttctgt

SEQ ID NO: 280077 - DNA, 25 bp, Rattus norvegicus
cttgagtctgttatgtctttcttct

SEQ ID NO: 280078 - DNA, 25 bp, Rattus norvegicus
cttgagtctgttttgtctttcttct

SEQ ID NO: 280079 - DNA, 25 bp, Rattus norvegicus
cttgagtgccaacgcctgtcccaga

SEQ ID NO: 280080 - DNA, 25 bp, Rattus norvegicus
cttgagtgccaaggcctgtcccaga

SEQ ID NO: 280081 - DNA, 25 bp, Rattus norvegicus
cttgagtgctcaccctgtctttggg

SEQ ID NO: 280082 - DNA, 25 bp, Rattus norvegicus
cttgagtgctcagcctgtctttggg

SEQ ID NO: 280083 - DNA, 25 bp, Rattus norvegicus
cttgagttcattaccatgttggcaa

SEQ ID NO: 280084 - DNA, 25 bp, Rattus norvegicus
cttgagttcatttccatgttggcaa

SEQ ID NO: 280085 - DNA, 25 bp, Rattus norvegicus
cttgagttcctcaagcggcgacagg

SEQ ID NO: 280086 - DNA, 25 bp, Rattus norvegicus
cttgagttcctctagcggcgacagg

SEQ ID NO: 280087 - DNA, 25 bp, Rattus norvegicus
cttgagttttctcgccagcacttca

SEQ ID NO: 280088 - DNA, 25 bp, Rattus norvegicus
cttgagttttctggccagcacttca

SEQ ID NO: 280089 - DNA, 25 bp, Rattus norvegicus
cttgagtttttcaatctgccatagt

SEQ ID NO: 280090 - DNA, 25 bp, Rattus norvegicus
cttgagtttttctatctgccatagt

SEQ ID NO: 280091 - DNA, 25 bp, Rattus norvegicus
cttgataccttgagttcatctttcc

SEQ ID NO: 280092 - DNA, 25 bp, Rattus norvegicus
cttgataccttgtgttcatctttcc

SEQ ID NO: 280093 - DNA, 25 bp, Rattus norvegicus
cttgatatcggtcgccctcataaaa

SEQ ID NO: 280094 - DNA, 25 bp, Rattus norvegicus
cttgatatcggtggccctcataaaa

SEQ ID NO: 280095 - DNA, 25 bp, Rattus norvegicus
cttgatatgtatcccacagtgcctt

SEQ ID NO: 280096 - DNA, 25 bp, Rattus norvegicus
cttgatatgtatgccacagtgcctt

SEQ ID NO: 280097 - DNA, 25 bp, Rattus norvegicus
cttgatattgtgaattgtccccttt

SEQ ID NO: 280098 - DNA, 25 bp, Rattus norvegicus
cttgatattgtgtattgtccccttt

SEQ ID NO: 280099 - DNA, 25 bp, Rattus norvegicus
cttgatccctttcacacattcatgc

SEQ ID NO: 280100 - DNA, 25 bp, Rattus norvegicus
cttgatccctttgacacattcatgc

SEQ ID NO: 280101 - DNA, 25 bp, Rattus norvegicus
cttgatcctctcctggcatgaaaat

SEQ ID NO: 280102 - DNA, 25 bp, Rattus norvegicus
cttgatcctctcgtggcatgaaaat

SEQ ID NO: 280103 - DNA, 25 bp, Rattus norvegicus
cttgatcctgagattcttgagttct

SEQ ID NO: 280104 - DNA, 25 bp, Rattus norvegicus
cttgatcctgagtttcttgagttct

SEQ ID NO: 280105 - DNA, 25 bp, Rattus norvegicus
cttgatcctgggagacgtctacaga

SEQ ID NO: 280106 - DNA, 25 bp, Rattus norvegicus
cttgatcctgggtgacgtctacaga

SEQ ID NO: 280107 - DNA, 25 bp, Rattus norvegicus
cttgatccttctctgctatatataa

SEQ ID NO: 280108 - DNA, 25 bp, Rattus norvegicus
cttgatccttctgtgctatatataa

SEQ ID NO: 280109 - DNA, 25 bp, Rattus norvegicus
cttgatcgagccctccaaatgtaat

SEQ ID NO: 280110 - DNA, 25 bp, Rattus norvegicus
cttgatcgagccgtccaaatgtaat

SEQ ID NO: 280111 - DNA, 25 bp, Rattus norvegicus
cttgatcttgatataactgtggcca

SEQ ID NO: 280112 - DNA, 25 bp, Rattus norvegicus
cttgatcttgatttaactgtggcca

SEQ ID NO: 280113 - DNA, 25 bp, Rattus norvegicus
cttgatcttgctacgattccatgag

SEQ ID NO: 280114 - DNA, 25 bp, Rattus norvegicus
cttgatcttgcttcgattccatgag

SEQ ID NO: 280115 - DNA, 25 bp, Rattus norvegicus
cttgatgaatgtccgccaggctccg

SEQ ID NO: 280116 - DNA, 25 bp, Rattus norvegicus
cttgatgaatgtgcgccaggctccg

SEQ ID NO: 280117 - DNA, 25 bp, Rattus norvegicus
cttgatgaggttagcttctgtctta

SEQ ID NO: 280118 - DNA, 25 bp, Rattus norvegicus
cttgatgaggtttgcttctgtctta

SEQ ID NO: 280119 - DNA, 25 bp, Rattus norvegicus
cttgatgctgtgaagcagtccacta

SEQ ID NO: 280120 - DNA, 25 bp, Rattus norvegicus
cttgatgctgtgtagcagtccacta

SEQ ID NO: 280121 - DNA, 25 bp, Rattus norvegicus
cttgatggccagctgctccatatat

SEQ ID NO: 280122 - DNA, 25 bp, Rattus norvegicus
cttgatggccaggtgctccatatat

SEQ ID NO: 280123 - DNA, 25 bp, Rattus norvegicus
cttgatgtaaatacctccttttcct

SEQ ID NO: 280124 - DNA, 25 bp, Rattus norvegicus
cttgatgtaaattcctccttttcct

SEQ ID NO: 280125 - DNA, 25 bp, Rattus norvegicus
cttgatgtccccagaacagacacac

SEQ ID NO: 280126 - DNA, 25 bp, Rattus norvegicus
cttgatgtcccctgaacagacacac

SEQ ID NO: 280127 - DNA, 25 bp, Rattus norvegicus
cttgatgttgcactatttccagatt

SEQ ID NO: 280128 - DNA, 25 bp, Rattus norvegicus
cttgatgttgcagtatttccagatt

SEQ ID NO: 280129 - DNA, 25 bp, Rattus norvegicus
cttgattaactaccagtcctactgt

SEQ ID NO: 280130 - DNA, 25 bp, Rattus norvegicus
cttgattaactagcagtcctactgt

SEQ ID NO: 280131 - DNA, 25 bp, Rattus norvegicus
cttgattactgtaggttctgactgt

SEQ ID NO: 280132 - DNA, 25 bp, Rattus norvegicus
cttgattactgttggttctgactgt

SEQ ID NO: 280133 - DNA, 25 bp, Rattus norvegicus
cttgattgccttacgattcagccaa

SEQ ID NO: 280134 - DNA, 25 bp, Rattus norvegicus
cttgattgcctttcgattcagccaa

SEQ ID NO: 280135 - DNA, 25 bp, Rattus norvegicus
cttgattttaggcttttgacaccat

SEQ ID NO: 280136 - DNA, 25 bp, Rattus norvegicus
cttgattttagggttttgacaccat

SEQ ID NO: 280137 - DNA, 25 bp, Rattus norvegicus
cttgattttgtgctgcttttctctg

SEQ ID NO: 280138 - DNA, 25 bp, Rattus norvegicus
cttgattttgtggtgcttttctctg

SEQ ID NO: 280139 - DNA, 25 bp, Rattus norvegicus
cttgcaacacagactcagcctagag

SEQ ID NO: 280140 - DNA, 25 bp, Rattus norvegicus
cttgcaacacagtctcagcctagag

SEQ ID NO: 280141 - DNA, 25 bp, Rattus norvegicus
cttgcaaccttgcttgttatcagaa

SEQ ID NO: 280142 - DNA, 25 bp, Rattus norvegicus
cttgcaaccttggttgttatcagaa

SEQ ID NO: 280143 - DNA, 25 bp, Rattus norvegicus
cttgcaactgttccctttggtgtca

SEQ ID NO: 280144 - DNA, 25 bp, Rattus norvegicus
cttgcaactgttgcctttggtgtca

SEQ ID NO: 280145 - DNA, 25 bp, Rattus norvegicus
cttgcaagacttctcactcttacaa

SEQ ID NO: 280146 - DNA, 25 bp, Rattus norvegicus
cttgcaagacttgtcactcttacaa

SEQ ID NO: 280147 - DNA, 25 bp, Rattus norvegicus
cttgcaagccgccattgaggatgag

SEQ ID NO: 280148 - DNA, 25 bp, Rattus norvegicus
cttgcaagccgcgattgaggatgag

SEQ ID NO: 280149 - DNA, 25 bp, Rattus norvegicus
cttgcaagctggattcacacaagaa

SEQ ID NO: 280150 - DNA, 25 bp, Rattus norvegicus
cttgcaagctggtttcacacaagaa

SEQ ID NO: 280151 - DNA, 25 bp, Rattus norvegicus
cttgcaagtgtcctgtgtctctgca

SEQ ID NO: 280152 - DNA, 25 bp, Rattus norvegicus
cttgcaagtgtcgtgtgtctctgca

SEQ ID NO: 280153 - DNA, 25 bp, Rattus norvegicus
cttgcaagttgcaaacgggtcacta

SEQ ID NO: 280154 - DNA, 25 bp, Rattus norvegicus
cttgcaagttgctaacgggtcacta

SEQ ID NO: 280155 - DNA, 25 bp, Rattus norvegicus
cttgcacaaaccctcactgatgtaa

SEQ ID NO: 280156 - DNA, 25 bp, Rattus norvegicus
cttgcacaaaccgtcactgatgtaa

SEQ ID NO: 280157 - DNA, 25 bp, Rattus norvegicus
cttgcacaccaacgcctaatatcaa

SEQ ID NO: 280158 - DNA, 25 bp, Rattus norvegicus
cttgcacaccaaggcctaatatcaa

SEQ ID NO: 280159 - DNA, 25 bp, Rattus norvegicus
cttgcacatcttacagttacctcat

SEQ ID NO: 280160 - DNA, 25 bp, Rattus norvegicus
cttgcacatctttcagttacctcat

SEQ ID NO: 280161 - DNA, 25 bp, Rattus norvegicus
cttgcacgggttattggagaagcta

SEQ ID NO: 280162 - DNA, 25 bp, Rattus norvegicus
cttgcacgggtttttggagaagcta

SEQ ID NO: 280163 - DNA, 25 bp, Rattus norvegicus
cttgcactggtacttctcaaatgga

SEQ ID NO: 280164 - DNA, 25 bp, Rattus norvegicus
cttgcactggtagttctcaaatgga

SEQ ID NO: 280165 - DNA, 25 bp, Rattus norvegicus
cttgcacttgagactgaagcagcac

SEQ ID NO: 280166 - DNA, 25 bp, Rattus norvegicus
cttgcacttgagtctgaagcagcac

SEQ ID NO: 280167 - DNA, 25 bp, Rattus norvegicus
cttgcacttgctagtcgccaaataa

SEQ ID NO: 280168 - DNA, 25 bp, Rattus norvegicus
cttgcacttgcttgtcgccaaataa

SEQ ID NO: 280169 - DNA, 25 bp, Rattus norvegicus
cttgcagagagcaggctggaatcca

SEQ ID NO: 280170 - DNA, 25 bp, Rattus norvegicus
cttgcagagagctggctggaatcca

SEQ ID NO: 280171 - DNA, 25 bp, Rattus norvegicus
cttgcagcactgagacccatttgaa

SEQ ID NO: 280172 - DNA, 25 bp, Rattus norvegicus
cttgcagcactgtgacccatttgaa

SEQ ID NO: 280173 - DNA, 25 bp, Rattus norvegicus
cttgcagccaagatcacggctggaa

SEQ ID NO: 280174 - DNA, 25 bp, Rattus norvegicus
cttgcagccaagttcacggctggaa

SEQ ID NO: 280175 - DNA, 25 bp, Rattus norvegicus
cttgcagccggaagttacaacgagg

SEQ ID NO: 280176 - DNA, 25 bp, Rattus norvegicus
cttgcagccggatgttacaacgagg

SEQ ID NO: 280177 - DNA, 25 bp, Rattus norvegicus
cttgcagctctaattctcgggaaaa

SEQ ID NO: 280178 - DNA, 25 bp, Rattus norvegicus
cttgcagctctatttctcgggaaaa

SEQ ID NO: 280179 - DNA, 25 bp, Rattus norvegicus
cttgcagcttttaccgtttgatact

SEQ ID NO: 280180 - DNA, 25 bp, Rattus norvegicus
cttgcagctttttccgtttgatact

SEQ ID NO: 280181 - DNA, 25 bp, Rattus norvegicus
cttgcaggcacaaaatatggcagtg

SEQ ID NO: 280182 - DNA, 25 bp, Rattus norvegicus
cttgcaggcacataatatggcagtg

SEQ ID NO: 280183 - DNA, 25 bp, Rattus norvegicus
cttgcagggctaccaggctagagaa

SEQ ID NO: 280184 - DNA, 25 bp, Rattus norvegicus
cttgcagggctagcaggctagagaa

SEQ ID NO: 280185 - DNA, 25 bp, Rattus norvegicus
cttgcagggctcaggtggatgaatt

SEQ ID NO: 280186 - DNA, 25 bp, Rattus norvegicus
cttgcagggctctggtggatgaatt

SEQ ID NO: 280187 - DNA, 25 bp, Rattus norvegicus
cttgcagtatgtatcctgatcgtgc

SEQ ID NO: 280188 - DNA, 25 bp, Rattus norvegicus
cttgcagtatgtttcctgatcgtgc

SEQ ID NO: 280189 - DNA, 25 bp, Rattus norvegicus
cttgcagtcctgcttacagttatga

SEQ ID NO: 280190 - DNA, 25 bp, Rattus norvegicus
cttgcagtcctggttacagttatga

SEQ ID NO: 280191 - DNA, 25 bp, Rattus norvegicus
cttgcagtgaacagccgggcagatc

SEQ ID NO: 280192 - DNA, 25 bp, Rattus norvegicus
cttgcagtgaactgccgggcagatc

SEQ ID NO: 280193 - DNA, 25 bp, Rattus norvegicus
cttgcagtgcaaagccaggccagtg

SEQ ID NO: 280194 - DNA, 25 bp, Rattus norvegicus
cttgcagtgcaatgccaggccagtg

SEQ ID NO: 280195 - DNA, 25 bp, Rattus norvegicus
cttgcagtggagcatgttctggacc

SEQ ID NO: 280196 - DNA, 25 bp, Rattus norvegicus
cttgcagtggaggatgttctggacc

SEQ ID NO: 280197 - DNA, 25 bp, Rattus norvegicus
cttgcagtgtgacaggtagcctcgc

SEQ ID NO: 280198 - DNA, 25 bp, Rattus norvegicus
cttgcagtgtgagaggtagcctcgc

SEQ ID NO: 280199 - DNA, 25 bp, Rattus norvegicus
cttgcagttttgacatggccatgtg

SEQ ID NO: 280200 - DNA, 25 bp, Rattus norvegicus
cttgcagttttgtcatggccatgtg

SEQ ID NO: 280201 - DNA, 25 bp, Rattus norvegicus
cttgcatcgcctaaatcatgtgtat

SEQ ID NO: 280202 - DNA, 25 bp, Rattus norvegicus
cttgcatcgccttaatcatgtgtat

SEQ ID NO: 280203 - DNA, 25 bp, Rattus norvegicus
cttgcatctaaacgccttgtggttt

SEQ ID NO: 280204 - DNA, 25 bp, Rattus norvegicus
cttgcatctaaaggccttgtggttt

SEQ ID NO: 280205 - DNA, 25 bp, Rattus norvegicus
cttgcatctctgagggtaattcccc

SEQ ID NO: 280206 - DNA, 25 bp, Rattus norvegicus
cttgcatctctgtgggtaattcccc

SEQ ID NO: 280207 - DNA, 25 bp, Rattus norvegicus
cttgcatgaacaattgatccttttg

SEQ ID NO: 280208 - DNA, 25 bp, Rattus norvegicus
cttgcatgaacatttgatccttttg

SEQ ID NO: 280209 - DNA, 25 bp, Rattus norvegicus
cttgcattctgcattccacacatat

SEQ ID NO: 280210 - DNA, 25 bp, Rattus norvegicus
cttgcattctgctttccacacatat

SEQ ID NO: 280211 - DNA, 25 bp, Rattus norvegicus
cttgcatttagcactctgggttatt

SEQ ID NO: 280212 - DNA, 25 bp, Rattus norvegicus
cttgcatttagctctctgggttatt

SEQ ID NO: 280213 - DNA, 25 bp, Rattus norvegicus
cttgcatttctcagctggaacaaag

SEQ ID NO: 280214 - DNA, 25 bp, Rattus norvegicus
cttgcatttctctgctggaacaaag

SEQ ID NO: 280215 - DNA, 25 bp, Rattus norvegicus
cttgccaaaatgagactcttcacga

SEQ ID NO: 280216 - DNA, 25 bp, Rattus norvegicus
cttgccaaaatgtgactcttcacga

SEQ ID NO: 280217 - DNA, 25 bp, Rattus norvegicus
cttgccaaacaacatgctgctctta

SEQ ID NO: 280218 - DNA, 25 bp, Rattus norvegicus
cttgccaaacaagatgctgctctta

SEQ ID NO: 280219 - DNA, 25 bp, Rattus norvegicus
cttgccaaccttacattgttatttt

SEQ ID NO: 280220 - DNA, 25 bp, Rattus norvegicus
cttgccaacctttcattgttatttt

SEQ ID NO: 280221 - DNA, 25 bp, Rattus norvegicus
cttgccaagtatactagaattcctt

SEQ ID NO: 280222 - DNA, 25 bp, Rattus norvegicus
cttgccaagtattctagaattcctt

SEQ ID NO: 280223 - DNA, 25 bp, Rattus norvegicus
cttgccaagttaatctgcatgcggg

SEQ ID NO: 280224 - DNA, 25 bp, Rattus norvegicus
cttgccaagttattctgcatgcggg

SEQ ID NO: 280225 - DNA, 25 bp, Rattus norvegicus
cttgccaatgacaccatattccaga

SEQ ID NO: 280226 - DNA, 25 bp, Rattus norvegicus
cttgccaatgactccatattccaga

SEQ ID NO: 280227 - DNA, 25 bp, Rattus norvegicus
cttgccacagttctgacctaggagg

SEQ ID NO: 280228 - DNA, 25 bp, Rattus norvegicus
cttgccacagttgtgacctaggagg

SEQ ID NO: 280229 - DNA, 25 bp, Rattus norvegicus
cttgccaccttccagtaaagtcatt

SEQ ID NO: 280230 - DNA, 25 bp, Rattus norvegicus
cttgccaccttcgagtaaagtcatt

SEQ ID NO: 280231 - DNA, 25 bp, Rattus norvegicus
cttgccacctttaagtctgctgaag

SEQ ID NO: 280232 - DNA, 25 bp, Rattus norvegicus
cttgccaccttttagtctgctgaag

SEQ ID NO: 280233 - DNA, 25 bp, Rattus norvegicus
cttgccacggatacactttaatctc

SEQ ID NO: 280234 - DNA, 25 bp, Rattus norvegicus
cttgccacggattcactttaatctc

SEQ ID NO: 280235 - DNA, 25 bp, Rattus norvegicus
cttgccacggccatctgaggagaag

SEQ ID NO: 280236 - DNA, 25 bp, Rattus norvegicus
cttgccacggccttctgaggagaag

SEQ ID NO: 280237 - DNA, 25 bp, Rattus norvegicus
cttgccactattctatgccagagga

SEQ ID NO: 280238 - DNA, 25 bp, Rattus norvegicus
cttgccactattgtatgccagagga

SEQ ID NO: 280239 - DNA, 25 bp, Rattus norvegicus
cttgccagagacaggtaccttcgat

SEQ ID NO: 280240 - DNA, 25 bp, Rattus norvegicus
cttgccagagactggtaccttcgat

SEQ ID NO: 280241 - DNA, 25 bp, Rattus norvegicus
cttgccagagttagtcatcgggttc

SEQ ID NO: 280242 - DNA, 25 bp, Rattus norvegicus
cttgccagagtttgtcatcgggttc

SEQ ID NO: 280243 - DNA, 25 bp, Rattus norvegicus
cttgccaggaagcaagctgaggcta

SEQ ID NO: 280244 - DNA, 25 bp, Rattus norvegicus
cttgccaggaaggaagctgaggcta

SEQ ID NO: 280245 - DNA, 25 bp, Rattus norvegicus
cttgccagggcccagaccagagaat

SEQ ID NO: 280246 - DNA, 25 bp, Rattus norvegicus
cttgccagggccgagaccagagaat

SEQ ID NO: 280247 - DNA, 25 bp, Rattus norvegicus
cttgccatctggcttatgggttgat

SEQ ID NO: 280248 - DNA, 25 bp, Rattus norvegicus
cttgccatctgggttatgggttgat

SEQ ID NO: 280249 - DNA, 25 bp, Rattus norvegicus
cttgcccaccaacttttaacaactg

SEQ ID NO: 280250 - DNA, 25 bp, Rattus norvegicus
cttgcccaccaagttttaacaactg

SEQ ID NO: 280251 - DNA, 25 bp, Rattus norvegicus
cttgcccaggccagtcctataccga

SEQ ID NO: 280252 - DNA, 25 bp, Rattus norvegicus
cttgcccaggcctgtcctataccga

SEQ ID NO: 280253 - DNA, 25 bp, Rattus norvegicus
cttgcccatatgcacactggtgaga

SEQ ID NO: 280254 - DNA, 25 bp, Rattus norvegicus
cttgcccatatggacactggtgaga

SEQ ID NO: 280255 - DNA, 25 bp, Rattus norvegicus
cttgcccatcacattgatcttcaat

SEQ ID NO: 280256 - DNA, 25 bp, Rattus norvegicus
cttgcccatcactttgatcttcaat

SEQ ID NO: 280257 - DNA, 25 bp, Rattus norvegicus
cttgccctaccacggaaaggctgct

SEQ ID NO: 280258 - DNA, 25 bp, Rattus norvegicus
cttgccctaccagggaaaggctgct

SEQ ID NO: 280259 - DNA, 25 bp, Rattus norvegicus
cttgccctcacacatcttgtattaa

SEQ ID NO: 280260 - DNA, 25 bp, Rattus norvegicus
cttgccctcacagatcttgtattaa

SEQ ID NO: 280261 - DNA, 25 bp, Rattus norvegicus
cttgccctcctgagagctgcatggc

SEQ ID NO: 280262 - DNA, 25 bp, Rattus norvegicus
cttgccctcctgtgagctgcatggc

SEQ ID NO: 280263 - DNA, 25 bp, Rattus norvegicus
cttgccctctacagcaaacatgtag

SEQ ID NO: 280264 - DNA, 25 bp, Rattus norvegicus
cttgccctctactgcaaacatgtag

SEQ ID NO: 280265 - DNA, 25 bp, Rattus norvegicus
cttgccctgttaatgcatccttgaa

SEQ ID NO: 280266 - DNA, 25 bp, Rattus norvegicus
cttgccctgttattgcatccttgaa

SEQ ID NO: 280267 - DNA, 25 bp, Rattus norvegicus
cttgcccttcctcggtttgtataat

SEQ ID NO: 280268 - DNA, 25 bp, Rattus norvegicus
cttgcccttcctgggtttgtataat

SEQ ID NO: 280269 - DNA, 25 bp, Rattus norvegicus
cttgccgcagccaatgtcggagaaa

SEQ ID NO: 280270 - DNA, 25 bp, Rattus norvegicus
cttgccgcagcctatgtcggagaaa

SEQ ID NO: 280271 - DNA, 25 bp, Rattus norvegicus
cttgccgcttggactgagcaggaat

SEQ ID NO: 280272 - DNA, 25 bp, Rattus norvegicus
cttgccgcttggtctgagcaggaat

SEQ ID NO: 280273 - DNA, 25 bp, Rattus norvegicus
cttgcctaacgccttgaacttgtgg

SEQ ID NO: 280274 - DNA, 25 bp, Rattus norvegicus
cttgcctaacgcgttgaacttgtgg

SEQ ID NO: 280275 - DNA, 25 bp, Rattus norvegicus
cttgcctacagccttatcttattga

SEQ ID NO: 280276 - DNA, 25 bp, Rattus norvegicus
cttgcctacagcgttatcttattga

SEQ ID NO: 280277 - DNA, 25 bp, Rattus norvegicus
cttgcctagggtcattcgggctgaa

SEQ ID NO: 280278 - DNA, 25 bp, Rattus norvegicus
cttgcctagggtgattcgggctgaa

SEQ ID NO: 280279 - DNA, 25 bp, Rattus norvegicus
cttgcctcagttccgtgcagatggg

SEQ ID NO: 280280 - DNA, 25 bp, Rattus norvegicus
cttgcctcagttgcgtgcagatggg

SEQ ID NO: 280281 - DNA, 25 bp, Rattus norvegicus
cttgcctcctataaaaacagacttt

SEQ ID NO: 280282 - DNA, 25 bp, Rattus norvegicus
cttgcctcctattaaaacagacttt

SEQ ID NO: 280283 - DNA, 25 bp, Rattus norvegicus
cttgcctctgcaacaaagattaaat

SEQ ID NO: 280284 - DNA, 25 bp, Rattus norvegicus
cttgcctctgcatcaaagattaaat

SEQ ID NO: 280285 - DNA, 25 bp, Rattus norvegicus
cttgcctcttggacagatgtctgta

SEQ ID NO: 280286 - DNA, 25 bp, Rattus norvegicus
cttgcctcttggtcagatgtctgta

SEQ ID NO: 280287 - DNA, 25 bp, Rattus norvegicus
cttgcctgaaatattatccgtgaga

SEQ ID NO: 280288 - DNA, 25 bp, Rattus norvegicus
cttgcctgaaattttatccgtgaga

SEQ ID NO: 280289 - DNA, 25 bp, Rattus norvegicus
cttgcctgacaaacactctaagctt

SEQ ID NO: 280290 - DNA, 25 bp, Rattus norvegicus
cttgcctgacaatcactctaagctt

SEQ ID NO: 280291 - DNA, 25 bp, Rattus norvegicus
cttgcctgactgaatgccttgagaa

SEQ ID NO: 280292 - DNA, 25 bp, Rattus norvegicus
cttgcctgactgtatgccttgagaa

SEQ ID NO: 280293 - DNA, 25 bp, Rattus norvegicus
cttgcctgagcaagggtgttacttt

SEQ ID NO: 280294 - DNA, 25 bp, Rattus norvegicus
cttgcctgagcatgggtgttacttt

SEQ ID NO: 280295 - DNA, 25 bp, Rattus norvegicus
cttgcctgctggaaacccatttggg

SEQ ID NO: 280296 - DNA, 25 bp, Rattus norvegicus
cttgcctgctggtaacccatttggg

SEQ ID NO: 280297 - DNA, 25 bp, Rattus norvegicus
cttgcctggatgcaggcatttccct

SEQ ID NO: 280298 - DNA, 25 bp, Rattus norvegicus
cttgcctggatggaggcatttccct

SEQ ID NO: 280299 - DNA, 25 bp, Rattus norvegicus
cttgcctggcaactatatcctttga

SEQ ID NO: 280300 - DNA, 25 bp, Rattus norvegicus
cttgcctggcaagtatatcctttga

SEQ ID NO: 280301 - DNA, 25 bp, Rattus norvegicus
cttgcctgggtcctacgtgataaat

SEQ ID NO: 280302 - DNA, 25 bp, Rattus norvegicus
cttgcctgggtcgtacgtgataaat

SEQ ID NO: 280303 - DNA, 25 bp, Rattus norvegicus
cttgccttaagtagaatccctgtga

SEQ ID NO: 280304 - DNA, 25 bp, Rattus norvegicus
cttgccttaagttgaatccctgtga

SEQ ID NO: 280305 - DNA, 25 bp, Rattus norvegicus
cttgccttaggaccctggtgcaggt

SEQ ID NO: 280306 - DNA, 25 bp, Rattus norvegicus
cttgccttaggagcctggtgcaggt

SEQ ID NO: 280307 - DNA, 25 bp, Rattus norvegicus
cttgccttattgaccaccagagaat

SEQ ID NO: 280308 - DNA, 25 bp, Rattus norvegicus
cttgccttattgtccaccagagaat

SEQ ID NO: 280309 - DNA, 25 bp, Rattus norvegicus
cttgccttcagaccttcgagacgag

SEQ ID NO: 280310 - DNA, 25 bp, Rattus norvegicus
cttgccttcagagcttcgagacgag

SEQ ID NO: 280311 - DNA, 25 bp, Rattus norvegicus
cttgccttccagatcttgttgattt

SEQ ID NO: 280312 - DNA, 25 bp, Rattus norvegicus
cttgccttccagttcttgttgattt

SEQ ID NO: 280313 - DNA, 25 bp, Rattus norvegicus
cttgccttctctctggtttcttgtt

SEQ ID NO: 280314 - DNA, 25 bp, Rattus norvegicus
cttgccttctctgtggtttcttgtt

SEQ ID NO: 280315 - DNA, 25 bp, Rattus norvegicus
cttgccttgggaatcacggtgggaa

SEQ ID NO: 280316 - DNA, 25 bp, Rattus norvegicus
cttgccttgggattcacggtgggaa

SEQ ID NO: 280317 - DNA, 25 bp, Rattus norvegicus
cttgcctttactcgtcaaatcttaa

SEQ ID NO: 280318 - DNA, 25 bp, Rattus norvegicus
cttgcctttactggtcaaatcttaa

SEQ ID NO: 280319 - DNA, 25 bp, Rattus norvegicus
cttgcctttagtagggcccaagtga

SEQ ID NO: 280320 - DNA, 25 bp, Rattus norvegicus
cttgcctttagttgggcccaagtga

SEQ ID NO: 280321 - DNA, 25 bp, Rattus norvegicus
cttgcctttttacagctagtggtga

SEQ ID NO: 280322 - DNA, 25 bp, Rattus norvegicus
cttgcctttttagagctagtggtga

SEQ ID NO: 280323 - DNA, 25 bp, Rattus norvegicus
cttgccttttttcctgcagttggag

SEQ ID NO: 280324 - DNA, 25 bp, Rattus norvegicus
cttgccttttttgctgcagttggag

SEQ ID NO: 280325 - DNA, 25 bp, Rattus norvegicus
cttgcgaccattagaaccagttgat

SEQ ID NO: 280326 - DNA, 25 bp, Rattus norvegicus
cttgcgaccatttgaaccagttgat

SEQ ID NO: 280327 - DNA, 25 bp, Rattus norvegicus
cttgcgagtctgagaaaggccactg

SEQ ID NO: 280328 - DNA, 25 bp, Rattus norvegicus
cttgcgagtctgtgaaaggccactg

SEQ ID NO: 280329 - DNA, 25 bp, Rattus norvegicus
cttgcgcctctgaaggcaatgcata

SEQ ID NO: 280330 - DNA, 25 bp, Rattus norvegicus
cttgcgcctctgtaggcaatgcata

SEQ ID NO: 280331 - DNA, 25 bp, Rattus norvegicus
cttgcgctcggtcccaaatgtaaaa

SEQ ID NO: 280332 - DNA, 25 bp, Rattus norvegicus
cttgcgctcggtgccaaatgtaaaa

SEQ ID NO: 280333 - DNA, 25 bp, Rattus norvegicus
cttgcggaagcacatgaaggtccat

SEQ ID NO: 280334 - DNA, 25 bp, Rattus norvegicus
cttgcggaagcagatgaaggtccat

SEQ ID NO: 280335 - DNA, 25 bp, Rattus norvegicus
cttgcggagaagatgggccaccttt

SEQ ID NO: 280336 - DNA, 25 bp, Rattus norvegicus
cttgcggagaagttgggccaccttt

SEQ ID NO: 280337 - DNA, 25 bp, Rattus norvegicus
cttgcggaggaacccacagctataa

SEQ ID NO: 280338 - DNA, 25 bp, Rattus norvegicus
cttgcggaggaagccacagctataa

SEQ ID NO: 280339 - DNA, 25 bp, Rattus norvegicus
cttgcggatcttctcacaccagaaa

SEQ ID NO: 280340 - DNA, 25 bp, Rattus norvegicus
cttgcggatcttgtcacaccagaaa

SEQ ID NO: 280341 - DNA, 25 bp, Rattus norvegicus
cttgcggctaatccggcgagggaca

SEQ ID NO: 280342 - DNA, 25 bp, Rattus norvegicus
cttgcggctaatgcggcgagggaca

SEQ ID NO: 280343 - DNA, 25 bp, Rattus norvegicus
cttgcgttaggtcgttgctatttct

SEQ ID NO: 280344 - DNA, 25 bp, Rattus norvegicus
cttgcgttaggtggttgctatttct

SEQ ID NO: 280345 - DNA, 25 bp, Rattus norvegicus
cttgcgtttgagacctttagcgtgt

SEQ ID NO: 280346 - DNA, 25 bp, Rattus norvegicus
cttgcgtttgagtcctttagcgtgt

SEQ ID NO: 280347 - DNA, 25 bp, Rattus norvegicus
cttgcgttttggatgtttctgtcag

SEQ ID NO: 280348 - DNA, 25 bp, Rattus norvegicus
cttgcgttttggttgtttctgtcag

SEQ ID NO: 280349 - DNA, 25 bp, Rattus norvegicus
cttgctaactttccgtctgtataca

SEQ ID NO: 280350 - DNA, 25 bp, Rattus norvegicus
cttgctaactttgcgtctgtataca

SEQ ID NO: 280351 - DNA, 25 bp, Rattus norvegicus
cttgctaattatcggccttctggat

SEQ ID NO: 280352 - DNA, 25 bp, Rattus norvegicus
cttgctaattatgggccttctggat

SEQ ID NO: 280353 - DNA, 25 bp, Rattus norvegicus
cttgctacagacaaggctggcctga

SEQ ID NO: 280354 - DNA, 25 bp, Rattus norvegicus
cttgctacagactaggctggcctga

SEQ ID NO: 280355 - DNA, 25 bp, Rattus norvegicus
cttgctacggcaagttctgtgtgga

SEQ ID NO: 280356 - DNA, 25 bp, Rattus norvegicus
cttgctacggcatgttctgtgtgga

SEQ ID NO: 280357 - DNA, 25 bp, Rattus norvegicus
cttgctacttaccagctgggtttga

SEQ ID NO: 280358 - DNA, 25 bp, Rattus norvegicus
cttgctacttacgagctgggtttga

SEQ ID NO: 280359 - DNA, 25 bp, Rattus norvegicus
cttgctagccagatccagctgagaa

SEQ ID NO: 280360 - DNA, 25 bp, Rattus norvegicus
cttgctagccagttccagctgagaa

SEQ ID NO: 280361 - DNA, 25 bp, Rattus norvegicus
cttgctagcttgcttgttttggtct

SEQ ID NO: 280362 - DNA, 25 bp, Rattus norvegicus
cttgctagcttggttgttttggtct

SEQ ID NO: 280363 - DNA, 25 bp, Rattus norvegicus
cttgctagtctccatcaaacctaag

SEQ ID NO: 280364 - DNA, 25 bp, Rattus norvegicus
cttgctagtctcgatcaaacctaag

SEQ ID NO: 280365 - DNA, 25 bp, Rattus norvegicus
cttgctatagcacaatcttccttag

SEQ ID NO: 280366 - DNA, 25 bp, Rattus norvegicus
cttgctatagcagaatcttccttag

SEQ ID NO: 280367 - DNA, 25 bp, Rattus norvegicus
cttgctatatccatgtctagtcttg

SEQ ID NO: 280368 - DNA, 25 bp, Rattus norvegicus
cttgctatatccttgtctagtcttg

SEQ ID NO: 280369 - DNA, 25 bp, Rattus norvegicus
cttgctatccacatgaactgggtta

SEQ ID NO: 280370 - DNA, 25 bp, Rattus norvegicus
cttgctatccacttgaactgggtta

SEQ ID NO: 280371 - DNA, 25 bp, Rattus norvegicus
cttgctattatacaggtttctctct

SEQ ID NO: 280372 - DNA, 25 bp, Rattus norvegicus
cttgctattatagaggtttctctct

SEQ ID NO: 280373 - DNA, 25 bp, Rattus norvegicus
cttgctcaaacccaacagtgtatgt

SEQ ID NO: 280374 - DNA, 25 bp, Rattus norvegicus
cttgctcaaaccgaacagtgtatgt

SEQ ID NO: 280375 - DNA, 25 bp, Rattus norvegicus
cttgctcacattccactttaagtgg

SEQ ID NO: 280376 - DNA, 25 bp, Rattus norvegicus
cttgctcacattgcactttaagtgg

SEQ ID NO: 280377 - DNA, 25 bp, Rattus norvegicus
cttgctcacgaacttcctgttgtaa

SEQ ID NO: 280378 - DNA, 25 bp, Rattus norvegicus
cttgctcacgaagttcctgttgtaa

SEQ ID NO: 280379 - DNA, 25 bp, Rattus norvegicus
cttgctcacgttaaaggctgaccat

SEQ ID NO: 280380 - DNA, 25 bp, Rattus norvegicus
cttgctcacgtttaaggctgaccat

SEQ ID NO: 280381 - DNA, 25 bp, Rattus norvegicus
cttgctcaggaaatagtcggtatct

SEQ ID NO: 280382 - DNA, 25 bp, Rattus norvegicus
cttgctcaggaattagtcggtatct

SEQ ID NO: 280383 - DNA, 25 bp, Rattus norvegicus
cttgctcagtgaacctcctaggaat

SEQ ID NO: 280384 - DNA, 25 bp, Rattus norvegicus
cttgctcagtgatcctcctaggaat

SEQ ID NO: 280385 - DNA, 25 bp, Rattus norvegicus
cttgctccctagagactggttttat

SEQ ID NO: 280386 - DNA, 25 bp, Rattus norvegicus
cttgctccctagtgactggttttat

SEQ ID NO: 280387 - DNA, 25 bp, Rattus norvegicus
cttgctctagaaagcccctgtaatt

SEQ ID NO: 280388 - DNA, 25 bp, Rattus norvegicus
cttgctctagaatgcccctgtaatt

SEQ ID NO: 280389 - DNA, 25 bp, Rattus norvegicus
cttgctctaggaaatcttttccgga

SEQ ID NO: 280390 - DNA, 25 bp, Rattus norvegicus
cttgctctaggatatcttttccgga

SEQ ID NO: 280391 - DNA, 25 bp, Rattus norvegicus
cttgctctatcaccaaaaggactta

SEQ ID NO: 280392 - DNA, 25 bp, Rattus norvegicus
cttgctctatcagcaaaaggactta

SEQ ID NO: 280393 - DNA, 25 bp, Rattus norvegicus
cttgctctatttatctcacctataa

SEQ ID NO: 280394 - DNA, 25 bp, Rattus norvegicus
cttgctctatttttctcacctataa

SEQ ID NO: 280395 - DNA, 25 bp, Rattus norvegicus
cttgctctcaaacccaagtgcatta

SEQ ID NO: 280396 - DNA, 25 bp, Rattus norvegicus
cttgctctcaaagccaagtgcatta

SEQ ID NO: 280397 - DNA, 25 bp, Rattus norvegicus
cttgctctgaagactaggttggcct

SEQ ID NO: 280398 - DNA, 25 bp, Rattus norvegicus
cttgctctgaagtctaggttggcct

SEQ ID NO: 280399 - DNA, 25 bp, Rattus norvegicus
cttgctctgcaaatgtttttatcca

SEQ ID NO: 280400 - DNA, 25 bp, Rattus norvegicus
cttgctctgcaattgtttttatcca

SEQ ID NO: 280401 - DNA, 25 bp, Rattus norvegicus
cttgctctgcccactgatgtcctga

SEQ ID NO: 280402 - DNA, 25 bp, Rattus norvegicus
cttgctctgccctctgatgtcctga

SEQ ID NO: 280403 - DNA, 25 bp, Rattus norvegicus
cttgctctggatacacaaagaccta

SEQ ID NO: 280404 - DNA, 25 bp, Rattus norvegicus
cttgctctggattcacaaagaccta

SEQ ID NO: 280405 - DNA, 25 bp, Rattus norvegicus
cttgctcttgtaccccttggctgga

SEQ ID NO: 280406 - DNA, 25 bp, Rattus norvegicus
cttgctcttgtagcccttggctgga

SEQ ID NO: 280407 - DNA, 25 bp, Rattus norvegicus
cttgctctttatagtattcttggga

SEQ ID NO: 280408 - DNA, 25 bp, Rattus norvegicus
cttgctctttattgtattcttggga

SEQ ID NO: 280409 - DNA, 25 bp, Rattus norvegicus
cttgctctttctaatttgtactgtt

SEQ ID NO: 280410 - DNA, 25 bp, Rattus norvegicus
cttgctctttcttatttgtactgtt

SEQ ID NO: 280411 - DNA, 25 bp, Rattus norvegicus
cttgctgagtggctgaaacatttga

SEQ ID NO: 280412 - DNA, 25 bp, Rattus norvegicus
cttgctgagtgggtgaaacatttga

SEQ ID NO: 280413 - DNA, 25 bp, Rattus norvegicus
cttgctgatcttctctgtgtgtcat

SEQ ID NO: 280414 - DNA, 25 bp, Rattus norvegicus
cttgctgatcttgtctgtgtgtcat

SEQ ID NO: 280415 - DNA, 25 bp, Rattus norvegicus
cttgctgcccacaaagacttgggtg

SEQ ID NO: 280416 - DNA, 25 bp, Rattus norvegicus
cttgctgcccactaagacttgggtg

SEQ ID NO: 280417 - DNA, 25 bp, Rattus norvegicus
cttgctgccctcagaagtgggatat

SEQ ID NO: 280418 - DNA, 25 bp, Rattus norvegicus
cttgctgccctctgaagtgggatat

SEQ ID NO: 280419 - DNA, 25 bp, Rattus norvegicus
cttgctgcgtttctctttctatata

SEQ ID NO: 280420 - DNA, 25 bp, Rattus norvegicus
cttgctgcgtttgtctttctatata

SEQ ID NO: 280421 - DNA, 25 bp, Rattus norvegicus
cttgctgctctcatagaggaccaaa

SEQ ID NO: 280422 - DNA, 25 bp, Rattus norvegicus
cttgctgctctcttagaggaccaaa

SEQ ID NO: 280423 - DNA, 25 bp, Rattus norvegicus
cttgctgctcttctaagggatcaaa

SEQ ID NO: 280424 - DNA, 25 bp, Rattus norvegicus
cttgctgctcttgtaagggatcaaa

SEQ ID NO: 280425 - DNA, 25 bp, Rattus norvegicus
cttgctgctgagaacataccttgta

SEQ ID NO: 280426 - DNA, 25 bp, Rattus norvegicus
cttgctgctgagtacataccttgta

SEQ ID NO: 280427 - DNA, 25 bp, Rattus norvegicus
cttgctgctgctcgaactacggttg

SEQ ID NO: 280428 - DNA, 25 bp, Rattus norvegicus
cttgctgctgctggaactacggttg

SEQ ID NO: 280429 - DNA, 25 bp, Rattus norvegicus
cttgctgctggcctagttcataatg

SEQ ID NO: 280430 - DNA, 25 bp, Rattus norvegicus
cttgctgctggcgtagttcataatg

SEQ ID NO: 280431 - DNA, 25 bp, Rattus norvegicus
cttgctgcttccaggagctgaagag

SEQ ID NO: 280432 - DNA, 25 bp, Rattus norvegicus
cttgctgcttcctggagctgaagag

SEQ ID NO: 280433 - DNA, 25 bp, Rattus norvegicus
cttgctgcttgaatcctgagtggtt

SEQ ID NO: 280434 - DNA, 25 bp, Rattus norvegicus
cttgctgcttgattcctgagtggtt

SEQ ID NO: 280435 - DNA, 25 bp, Rattus norvegicus
cttgctgctttacaccctatagggt

SEQ ID NO: 280436 - DNA, 25 bp, Rattus norvegicus
cttgctgctttagaccctatagggt

SEQ ID NO: 280437 - DNA, 25 bp, Rattus norvegicus
cttgctggaagcatttggtcacgat

SEQ ID NO: 280438 - DNA, 25 bp, Rattus norvegicus
cttgctggaagcttttggtcacgat

SEQ ID NO: 280439 - DNA, 25 bp, Rattus norvegicus
cttgctggccctataagaactctta

SEQ ID NO: 280440 - DNA, 25 bp, Rattus norvegicus
cttgctggccctttaagaactctta

SEQ ID NO: 280441 - DNA, 25 bp, Rattus norvegicus
cttgctggctctaaaaaatatgatt

SEQ ID NO: 280442 - DNA, 25 bp, Rattus norvegicus
cttgctggctcttaaaaatatgatt

SEQ ID NO: 280443 - DNA, 25 bp, Rattus norvegicus
cttgctgggtgcagtgactcagagt

SEQ ID NO: 280444 - DNA, 25 bp, Rattus norvegicus
cttgctgggtgctgtgactcagagt

SEQ ID NO: 280445 - DNA, 25 bp, Rattus norvegicus
cttgctggtgacctctcagtctgag

SEQ ID NO: 280446 - DNA, 25 bp, Rattus norvegicus
cttgctggtgacgtctcagtctgag

SEQ ID NO: 280447 - DNA, 25 bp, Rattus norvegicus
cttgctgtaacaattgaactttcac

SEQ ID NO: 280448 - DNA, 25 bp, Rattus norvegicus
cttgctgtaacatttgaactttcac

SEQ ID NO: 280449 - DNA, 25 bp, Rattus norvegicus
cttgctgtatatagaatagctactt

SEQ ID NO: 280450 - DNA, 25 bp, Rattus norvegicus
cttgctgtatattgaatagctactt

SEQ ID NO: 280451 - DNA, 25 bp, Rattus norvegicus
cttgctgtatttacatgtctagtag

SEQ ID NO: 280452 - DNA, 25 bp, Rattus norvegicus
cttgctgtattttcatgtctagtag

SEQ ID NO: 280453 - DNA, 25 bp, Rattus norvegicus
cttgctgtcctgaaactagctacgt

SEQ ID NO: 280454 - DNA, 25 bp, Rattus norvegicus
cttgctgtcctgtaactagctacgt

SEQ ID NO: 280455 - DNA, 25 bp, Rattus norvegicus
cttgctgtctaaccgaaatcctaga

SEQ ID NO: 280456 - DNA, 25 bp, Rattus norvegicus
cttgctgtctaagcgaaatcctaga

SEQ ID NO: 280457 - DNA, 25 bp, Rattus norvegicus
cttgctgtgacgcttcttcatctca

SEQ ID NO: 280458 - DNA, 25 bp, Rattus norvegicus
cttgctgtgacggttcttcatctca

SEQ ID NO: 280459 - DNA, 25 bp, Rattus norvegicus
cttgctgtgcctcaaactgtcagaa

SEQ ID NO: 280460 - DNA, 25 bp, Rattus norvegicus
cttgctgtgcctgaaactgtcagaa

SEQ ID NO: 280461 - DNA, 25 bp, Rattus norvegicus
cttgctgtgtgtcccaacttgacac

SEQ ID NO: 280462 - DNA, 25 bp, Rattus norvegicus
cttgctgtgtgtgccaacttgacac

SEQ ID NO: 280463 - DNA, 25 bp, Rattus norvegicus
cttgctgttcagatggagtccttca

SEQ ID NO: 280464 - DNA, 25 bp, Rattus norvegicus
cttgctgttcagttggagtccttca

SEQ ID NO: 280465 - DNA, 25 bp, Rattus norvegicus
cttgctgttcccaaggcagtataaa

SEQ ID NO: 280466 - DNA, 25 bp, Rattus norvegicus
cttgctgttccctaggcagtataaa

SEQ ID NO: 280467 - DNA, 25 bp, Rattus norvegicus
cttgctgttctaaatgagcgagctc

SEQ ID NO: 280468 - DNA, 25 bp, Rattus norvegicus
cttgctgttctatatgagcgagctc

SEQ ID NO: 280469 - DNA, 25 bp, Rattus norvegicus
cttgctgttcttcggtttcagggag

SEQ ID NO: 280470 - DNA, 25 bp, Rattus norvegicus
cttgctgttcttgggtttcagggag

SEQ ID NO: 280471 - DNA, 25 bp, Rattus norvegicus
cttgctgttgacaagtaggccaaag

SEQ ID NO: 280472 - DNA, 25 bp, Rattus norvegicus
cttgctgttgactagtaggccaaag

SEQ ID NO: 280473 - DNA, 25 bp, Rattus norvegicus
cttgcttagcagctgagactggcct

SEQ ID NO: 280474 - DNA, 25 bp, Rattus norvegicus
cttgcttagcaggtgagactggcct

SEQ ID NO: 280475 - DNA, 25 bp, Rattus norvegicus
cttgcttatcataccagtctgttac

SEQ ID NO: 280476 - DNA, 25 bp, Rattus norvegicus
cttgcttatcattccagtctgttac

SEQ ID NO: 280477 - DNA, 25 bp, Rattus norvegicus
cttgcttatcggaatctgatgcttc

SEQ ID NO: 280478 - DNA, 25 bp, Rattus norvegicus
cttgcttatcggtatctgatgcttc

SEQ ID NO: 280479 - DNA, 25 bp, Rattus norvegicus
cttgcttcagttaggacagattgtt

SEQ ID NO: 280480 - DNA, 25 bp, Rattus norvegicus
cttgcttcagtttggacagattgtt

SEQ ID NO: 280481 - DNA, 25 bp, Rattus norvegicus
cttgcttcctaacttcatcagtaga

SEQ ID NO: 280482 - DNA, 25 bp, Rattus norvegicus
cttgcttcctaagttcatcagtaga

SEQ ID NO: 280483 - DNA, 25 bp, Rattus norvegicus
cttgcttcctctctattccaatata

SEQ ID NO: 280484 - DNA, 25 bp, Rattus norvegicus
cttgcttcctctgtattccaatata

SEQ ID NO: 280485 - DNA, 25 bp, Rattus norvegicus
cttgcttcgcaaattctacttctat

SEQ ID NO: 280486 - DNA, 25 bp, Rattus norvegicus
cttgcttcgcaatttctacttctat

SEQ ID NO: 280487 - DNA, 25 bp, Rattus norvegicus
cttgcttctcaactgaccctggagt

SEQ ID NO: 280488 - DNA, 25 bp, Rattus norvegicus
cttgcttctcaagtgaccctggagt

SEQ ID NO: 280489 - DNA, 25 bp, Rattus norvegicus
cttgcttcttggctggttcaagtgt

SEQ ID NO: 280490 - DNA, 25 bp, Rattus norvegicus
cttgcttcttgggtggttcaagtgt

SEQ ID NO: 280491 - DNA, 25 bp, Rattus norvegicus
cttgcttgccatcttgagcgcagta

SEQ ID NO: 280492 - DNA, 25 bp, Rattus norvegicus
cttgcttgccatgttgagcgcagta

SEQ ID NO: 280493 - DNA, 25 bp, Rattus norvegicus
cttgcttgcttccactatgagatgc

SEQ ID NO: 280494 - DNA, 25 bp, Rattus norvegicus
cttgcttgcttcgactatgagatgc

SEQ ID NO: 280495 - DNA, 25 bp, Rattus norvegicus
cttgcttgggagagttttattccta

SEQ ID NO: 280496 - DNA, 25 bp, Rattus norvegicus
cttgcttgggagtgttttattccta

SEQ ID NO: 280497 - DNA, 25 bp, Rattus norvegicus
cttgctttagcccaagcttacattc

SEQ ID NO: 280498 - DNA, 25 bp, Rattus norvegicus
cttgctttagccgaagcttacattc

SEQ ID NO: 280499 - DNA, 25 bp, Rattus norvegicus
cttgctttattgagaatgtccagta

SEQ ID NO: 280500 - DNA, 25 bp, Rattus norvegicus
cttgctttattgtgaatgtccagta

SEQ ID NO: 280501 - DNA, 25 bp, Rattus norvegicus
cttgctttccagctcttgagagtct

SEQ ID NO: 280502 - DNA, 25 bp, Rattus norvegicus
cttgctttccaggtcttgagagtct

SEQ ID NO: 280503 - DNA, 25 bp, Rattus norvegicus
cttgctttctgtaatttcttccatt

SEQ ID NO: 280504 - DNA, 25 bp, Rattus norvegicus
cttgctttctgttatttcttccatt

SEQ ID NO: 280505 - DNA, 25 bp, Rattus norvegicus
cttgctttcttcactatcagtggag

SEQ ID NO: 280506 - DNA, 25 bp, Rattus norvegicus
cttgctttcttctctatcagtggag

SEQ ID NO: 280507 - DNA, 25 bp, Rattus norvegicus
cttgctttgcaaaccgtctggttat

SEQ ID NO: 280508 - DNA, 25 bp, Rattus norvegicus
cttgctttgcaatccgtctggttat

SEQ ID NO: 280509 - DNA, 25 bp, Rattus norvegicus
cttgcttttcatatagttacctaga

SEQ ID NO: 280510 - DNA, 25 bp, Rattus norvegicus
cttgcttttcatttagttacctaga

SEQ ID NO: 280511 - DNA, 25 bp, Rattus norvegicus
cttgcttttgaccttgtgttgggac

SEQ ID NO: 280512 - DNA, 25 bp, Rattus norvegicus
cttgcttttgacgttgtgttgggac

SEQ ID NO: 280513 - DNA, 25 bp, Rattus norvegicus
cttgctttttcacgtccaactcaaa

SEQ ID NO: 280514 - DNA, 25 bp, Rattus norvegicus
cttgctttttcaggtccaactcaaa

SEQ ID NO: 280515 - DNA, 25 bp, Rattus norvegicus
cttgctttttcccaacttagtgaca

SEQ ID NO: 280516 - DNA, 25 bp, Rattus norvegicus
cttgctttttccgaacttagtgaca

SEQ ID NO: 280517 - DNA, 25 bp, Rattus norvegicus
cttggaaacaccagcttttgccata

SEQ ID NO: 280518 - DNA, 25 bp, Rattus norvegicus
cttggaaacacctgcttttgccata

SEQ ID NO: 280519 - DNA, 25 bp, Rattus norvegicus
cttggaaaccctaccattgttgaag

SEQ ID NO: 280520 - DNA, 25 bp, Rattus norvegicus
cttggaaacccttccattgttgaag

SEQ ID NO: 280521 - DNA, 25 bp, Rattus norvegicus
cttggaaagtgtctgcagtgctaaa

SEQ ID NO: 280522 - DNA, 25 bp, Rattus norvegicus
cttggaaagtgtgtgcagtgctaaa

SEQ ID NO: 280523 - DNA, 25 bp, Rattus norvegicus
cttggaacagtacagcccatgatgt

SEQ ID NO: 280524 - DNA, 25 bp, Rattus norvegicus
cttggaacagtagagcccatgatgt

SEQ ID NO: 280525 - DNA, 25 bp, Rattus norvegicus
cttggaagacggctctttttctctt

SEQ ID NO: 280526 - DNA, 25 bp, Rattus norvegicus
cttggaagacgggtctttttctctt

SEQ ID NO: 280527 - DNA, 25 bp, Rattus norvegicus
cttggaattctcctttccatgctca

SEQ ID NO: 280528 - DNA, 25 bp, Rattus norvegicus
cttggaattctcgtttccatgctca

SEQ ID NO: 280529 - DNA, 25 bp, Rattus norvegicus
cttggaattggtatgtctttgacac

SEQ ID NO: 280530 - DNA, 25 bp, Rattus norvegicus
cttggaattggtttgtctttgacac

SEQ ID NO: 280531 - DNA, 25 bp, Rattus norvegicus
cttggacatgggatgtgactgcttt

SEQ ID NO: 280532 - DNA, 25 bp, Rattus norvegicus
cttggacatgggttgtgactgcttt

SEQ ID NO: 280533 - DNA, 25 bp, Rattus norvegicus
cttggaccaccaagccttgaatggt

SEQ ID NO: 280534 - DNA, 25 bp, Rattus norvegicus
cttggaccaccatgccttgaatggt

SEQ ID NO: 280535 - DNA, 25 bp, Rattus norvegicus
cttggaccacgtatgagacttagaa

SEQ ID NO: 280536 - DNA, 25 bp, Rattus norvegicus
cttggaccacgtcgctcagggtaaa

SEQ ID NO: 280537 - DNA, 25 bp, Rattus norvegicus
cttggaccacgtggctcagggtaaa

SEQ ID NO: 280538 - DNA, 25 bp, Rattus norvegicus
cttggaccacgtttgagacttagaa

SEQ ID NO: 280539 - DNA, 25 bp, Rattus norvegicus
cttggaccgagaaagccagacccat

SEQ ID NO: 280540 - DNA, 25 bp, Rattus norvegicus
cttggaccgagatagccagacccat

SEQ ID NO: 280541 - DNA, 25 bp, Rattus norvegicus
cttggaccgctacggattcccaggg

SEQ ID NO: 280542 - DNA, 25 bp, Rattus norvegicus
cttggaccgctagggattcccaggg

SEQ ID NO: 280543 - DNA, 25 bp, Rattus norvegicus
cttggacctttgaggacttgggaga

SEQ ID NO: 280544 - DNA, 25 bp, Rattus norvegicus
cttggacctttgtggacttgggaga

SEQ ID NO: 280545 - DNA, 25 bp, Rattus norvegicus
cttggactgcccatggagacccagc

SEQ ID NO: 280546 - DNA, 25 bp, Rattus norvegicus
cttggactgcccttggagacccagc

SEQ ID NO: 280547 - DNA, 25 bp, Rattus norvegicus
cttggactggcaacagagggttcat

SEQ ID NO: 280548 - DNA, 25 bp, Rattus norvegicus
cttggactggcatcagagggttcat

SEQ ID NO: 280549 - DNA, 25 bp, Rattus norvegicus
cttggactgtcgctggaactctgga

SEQ ID NO: 280550 - DNA, 25 bp, Rattus norvegicus
cttggactgtcggtggaactctgga

SEQ ID NO: 280551 - DNA, 25 bp, Rattus norvegicus
cttggacttctgctgctattttggc

SEQ ID NO: 280552 - DNA, 25 bp, Rattus norvegicus
cttggacttctggtgctattttggc

SEQ ID NO: 280553 - DNA, 25 bp, Rattus norvegicus
cttggacttggtagtggctttattc

SEQ ID NO: 280554 - DNA, 25 bp, Rattus norvegicus
cttggacttggttgtggctttattc

SEQ ID NO: 280555 - DNA, 25 bp, Rattus norvegicus
cttggactttaaactgggaatgaga

SEQ ID NO: 280556 - DNA, 25 bp, Rattus norvegicus
cttggactttaatctgggaatgaga

SEQ ID NO: 280557 - DNA, 25 bp, Rattus norvegicus
cttggagacgacacagcagatgatg

SEQ ID NO: 280558 - DNA, 25 bp, Rattus norvegicus
cttggagacgactcagcagatgatg

SEQ ID NO: 280559 - DNA, 25 bp, Rattus norvegicus
cttggagatcctagagatgactttc

SEQ ID NO: 280560 - DNA, 25 bp, Rattus norvegicus
cttggagatccttgagatgactttc

SEQ ID NO: 280561 - DNA, 25 bp, Rattus norvegicus
cttggagattttaagaaagctggtt

SEQ ID NO: 280562 - DNA, 25 bp, Rattus norvegicus
cttggagatttttagaaagctggtt

SEQ ID NO: 280563 - DNA, 25 bp, Rattus norvegicus
cttggagccatcattggaactctgg

SEQ ID NO: 280564 - DNA, 25 bp, Rattus norvegicus
cttggagccatctttggaactctgg

SEQ ID NO: 280565 - DNA, 25 bp, Rattus norvegicus
cttggagcgagaagaaactgacttt

SEQ ID NO: 280566 - DNA, 25 bp, Rattus norvegicus
cttggagcgagatgaaactgacttt

SEQ ID NO: 280567 - DNA, 25 bp, Rattus norvegicus
cttggaggaatcagaggtctctcta

SEQ ID NO: 280568 - DNA, 25 bp, Rattus norvegicus
cttggaggaatctgaggtctctcta

SEQ ID NO: 280569 - DNA, 25 bp, Rattus norvegicus
cttggaggagaaccctaccagcctt

SEQ ID NO: 280570 - DNA, 25 bp, Rattus norvegicus
cttggaggagaagcctaccagcctt

SEQ ID NO: 280571 - DNA, 25 bp, Rattus norvegicus
cttggaggagacatactggctgaca

SEQ ID NO: 280572 - DNA, 25 bp, Rattus norvegicus
cttggaggagacttactggctgaca

SEQ ID NO: 280573 - DNA, 25 bp, Rattus norvegicus
cttggaggctggagcagcccatttc

SEQ ID NO: 280574 - DNA, 25 bp, Rattus norvegicus
cttggaggctggtgcagcccatttc

SEQ ID NO: 280575 - DNA, 25 bp, Rattus norvegicus
cttggagggtaaatgtgcttcactg

SEQ ID NO: 280576 - DNA, 25 bp, Rattus norvegicus
cttggagggtaattgtgcttcactg

SEQ ID NO: 280577 - DNA, 25 bp, Rattus norvegicus
cttggagtatgtcaggccccggcca

SEQ ID NO: 280578 - DNA, 25 bp, Rattus norvegicus
cttggagtatgtgaggccccggcca

SEQ ID NO: 280579 - DNA, 25 bp, Rattus norvegicus
cttggagtcagaagccaggcagcct

SEQ ID NO: 280580 - DNA, 25 bp, Rattus norvegicus
cttggagtcagatgccaggcagcct

SEQ ID NO: 280581 - DNA, 25 bp, Rattus norvegicus
cttggagtcaggacccaggagctga

SEQ ID NO: 280582 - DNA, 25 bp, Rattus norvegicus
cttggagtcaggtcccaggagctga

SEQ ID NO: 280583 - DNA, 25 bp, Rattus norvegicus
cttggagtcccaaacacttcagaga

SEQ ID NO: 280584 - DNA, 25 bp, Rattus norvegicus
cttggagtcccatacacttcagaga

SEQ ID NO: 280585 - DNA, 25 bp, Rattus norvegicus
cttggagtgctccatgcaggaacca

SEQ ID NO: 280586 - DNA, 25 bp, Rattus norvegicus
cttggagtgctcgatgcaggaacca

SEQ ID NO: 280587 - DNA, 25 bp, Rattus norvegicus
cttggagtgtcaaactgtggaggca

SEQ ID NO: 280588 - DNA, 25 bp, Rattus norvegicus
cttggagtgtcatactgtggaggca

SEQ ID NO: 280589 - DNA, 25 bp, Rattus norvegicus
cttggagttgaacctagcagcggat

SEQ ID NO: 280590 - DNA, 25 bp, Rattus norvegicus
cttggagttgaagctagcagcggat

SEQ ID NO: 280591 - DNA, 25 bp, Rattus norvegicus
cttggagttgacaggtggctagaca

SEQ ID NO: 280592 - DNA, 25 bp, Rattus norvegicus
cttggagttgactggtggctagaca

SEQ ID NO: 280593 - DNA, 25 bp, Rattus norvegicus
cttggatccttacggctcccagaga

SEQ ID NO: 280594 - DNA, 25 bp, Rattus norvegicus
cttggatccttagggctcccagaga

SEQ ID NO: 280595 - DNA, 25 bp, Rattus norvegicus
cttggatggcatctactttgtgaat

SEQ ID NO: 280596 - DNA, 25 bp, Rattus norvegicus
cttggatggcatgtactttgtgaat

SEQ ID NO: 280597 - DNA, 25 bp, Rattus norvegicus
cttggatgggagaccgcctgggaat

SEQ ID NO: 280598 - DNA, 25 bp, Rattus norvegicus
cttggatgggagtccgcctgggaat

SEQ ID NO: 280599 - DNA, 25 bp, Rattus norvegicus
cttggatgtccacgcttgcctctaa

SEQ ID NO: 280600 - DNA, 25 bp, Rattus norvegicus
cttggatgtccaggcttgcctctaa

SEQ ID NO: 280601 - DNA, 25 bp, Rattus norvegicus
cttggatgtgatcccagctcactgc

SEQ ID NO: 280602 - DNA, 25 bp, Rattus norvegicus
cttggatgtgatgccagctcactgc

SEQ ID NO: 280603 - DNA, 25 bp, Rattus norvegicus
cttggattcaacatacgcctacata

SEQ ID NO: 280604 - DNA, 25 bp, Rattus norvegicus
cttggattcaacttacgcctacata

SEQ ID NO: 280605 - DNA, 25 bp, Rattus norvegicus
cttggattcctgatcttgggtgtaa

SEQ ID NO: 280606 - DNA, 25 bp, Rattus norvegicus
cttggattcctgttcttgggtgtaa

SEQ ID NO: 280607 - DNA, 25 bp, Rattus norvegicus
cttggattctgtacctccataggaa

SEQ ID NO: 280608 - DNA, 25 bp, Rattus norvegicus
cttggattctgttcctccataggaa

SEQ ID NO: 280609 - DNA, 25 bp, Rattus norvegicus
cttggattgagacaaccgcaacttt

SEQ ID NO: 280610 - DNA, 25 bp, Rattus norvegicus
cttggattgagagaaccgcaacttt

SEQ ID NO: 280611 - DNA, 25 bp, Rattus norvegicus
cttggatttagtatgcaattatttt

SEQ ID NO: 280612 - DNA, 25 bp, Rattus norvegicus
cttggatttagtttgcaattatttt

SEQ ID NO: 280613 - DNA, 25 bp, Rattus norvegicus
cttggatttgtgatgtttttggtgt

SEQ ID NO: 280614 - DNA, 25 bp, Rattus norvegicus
cttggatttgtgttgtttttggtgt

SEQ ID NO: 280615 - DNA, 25 bp, Rattus norvegicus
cttggcaagtctccgccattgcgga

SEQ ID NO: 280616 - DNA, 25 bp, Rattus norvegicus
cttggcaagtctgcgccattgcgga

SEQ ID NO: 280617 - DNA, 25 bp, Rattus norvegicus
cttggcaatgccacagtacggagca

SEQ ID NO: 280618 - DNA, 25 bp, Rattus norvegicus
cttggcaatgcctcagtacggagca

SEQ ID NO: 280619 - DNA, 25 bp, Rattus norvegicus
cttggcaatggcagttagcagattc

SEQ ID NO: 280620 - DNA, 25 bp, Rattus norvegicus
cttggcaatggctgttagcagattc

SEQ ID NO: 280621 - DNA, 25 bp, Rattus norvegicus
cttggcacagttcttctgttgtgga

SEQ ID NO: 280622 - DNA, 25 bp, Rattus norvegicus
cttggcacagttgttctgttgtgga

SEQ ID NO: 280623 - DNA, 25 bp, Rattus norvegicus
cttggcacctctagatccatccaga

SEQ ID NO: 280624 - DNA, 25 bp, Rattus norvegicus
cttggcacctcttgatccatccaga

SEQ ID NO: 280625 - DNA, 25 bp, Rattus norvegicus
cttggcacgactaattgattttggt

SEQ ID NO: 280626 - DNA, 25 bp, Rattus norvegicus
cttggcacgacttattgattttggt

SEQ ID NO: 280627 - DNA, 25 bp, Rattus norvegicus
cttggcagagaaattcatgacactt

SEQ ID NO: 280628 - DNA, 25 bp, Rattus norvegicus
cttggcagagaatttcatgacactt

SEQ ID NO: 280629 - DNA, 25 bp, Rattus norvegicus
cttggcagcaaaaacccgagtcttc

SEQ ID NO: 280630 - DNA, 25 bp, Rattus norvegicus
cttggcagcaaatacccgagtcttc

SEQ ID NO: 280631 - DNA, 25 bp, Rattus norvegicus
cttggcagccgcatcatgacaggaa

SEQ ID NO: 280632 - DNA, 25 bp, Rattus norvegicus
cttggcagccgcttcatgacaggaa

SEQ ID NO: 280633 - DNA, 25 bp, Rattus norvegicus
cttggcaggcaccacagaagttgct

SEQ ID NO: 280634 - DNA, 25 bp, Rattus norvegicus
cttggcaggcacgacagaagttgct

SEQ ID NO: 280635 - DNA, 25 bp, Rattus norvegicus
cttggcagtggcacaggttaacctt

SEQ ID NO: 280636 - DNA, 25 bp, Rattus norvegicus
cttggcagtggctcaggttaacctt

SEQ ID NO: 280637 - DNA, 25 bp, Rattus norvegicus
cttggcagttacagggtggatatta

SEQ ID NO: 280638 - DNA, 25 bp, Rattus norvegicus
cttggcagttactgggtggatatta

SEQ ID NO: 280639 - DNA, 25 bp, Rattus norvegicus
cttggcagtttcaggactggcgcaa

SEQ ID NO: 280640 - DNA, 25 bp, Rattus norvegicus
cttggcagtttctggactggcgcaa

SEQ ID NO: 280641 - DNA, 25 bp, Rattus norvegicus
cttggcatctataaggctggcattc

SEQ ID NO: 280642 - DNA, 25 bp, Rattus norvegicus
cttggcatctattaggctggcattc

SEQ ID NO: 280643 - DNA, 25 bp, Rattus norvegicus
cttggcatgattacttgtagtctgt

SEQ ID NO: 280644 - DNA, 25 bp, Rattus norvegicus
cttggcatgatttcttgtagtctgt

SEQ ID NO: 280645 - DNA, 25 bp, Rattus norvegicus
cttggcattcctactatttatcact

SEQ ID NO: 280646 - DNA, 25 bp, Rattus norvegicus
cttggcattccttctatttatcact

SEQ ID NO: 280647 - DNA, 25 bp, Rattus norvegicus
cttggcattgcactgttagcattta

SEQ ID NO: 280648 - DNA, 25 bp, Rattus norvegicus
cttggcattgcagtgttagcattta

SEQ ID NO: 280649 - DNA, 25 bp, Rattus norvegicus
cttggcatttacactttaccccttg

SEQ ID NO: 280650 - DNA, 25 bp, Rattus norvegicus
cttggcatttactctttaccccttg

SEQ ID NO: 280651 - DNA, 25 bp, Rattus norvegicus
cttggcatttctcagttcctaggtg

SEQ ID NO: 280652 - DNA, 25 bp, Rattus norvegicus
cttggcatttctgagttcctaggtg

SEQ ID NO: 280653 - DNA, 25 bp, Rattus norvegicus
cttggccagccaacagtgtttacaa

SEQ ID NO: 280654 - DNA, 25 bp, Rattus norvegicus
cttggccagccatcagtgtttacaa

SEQ ID NO: 280655 - DNA, 25 bp, Rattus norvegicus
cttggccagcttagaccttatgtct

SEQ ID NO: 280656 - DNA, 25 bp, Rattus norvegicus
cttggccagctttgaccttatgtct

SEQ ID NO: 280657 - DNA, 25 bp, Rattus norvegicus
cttggccagtttctacagctatgta

SEQ ID NO: 280658 - DNA, 25 bp, Rattus norvegicus
cttggccagtttgtacagctatgta

SEQ ID NO: 280659 - DNA, 25 bp, Rattus norvegicus
cttggccatagcatgaggagtctac

SEQ ID NO: 280660 - DNA, 25 bp, Rattus norvegicus
cttggccatagcttgaggagtctac

SEQ ID NO: 280661 - DNA, 25 bp, Rattus norvegicus
cttggcccagagctcagaggacaaa

SEQ ID NO: 280662 - DNA, 25 bp, Rattus norvegicus
cttggcccagaggtcagaggacaaa

SEQ ID NO: 280663 - DNA, 25 bp, Rattus norvegicus
cttggcccaggtccgcaaggagtat

SEQ ID NO: 280664 - DNA, 25 bp, Rattus norvegicus
cttggcccaggtgcgcaaggagtat

SEQ ID NO: 280665 - DNA, 25 bp, Rattus norvegicus
cttggccctctgaattctacaacaa

SEQ ID NO: 280666 - DNA, 25 bp, Rattus norvegicus
cttggccctctgtattctacaacaa

SEQ ID NO: 280667 - DNA, 25 bp, Rattus norvegicus
cttggccctgccagaatgaagtgta

SEQ ID NO: 280668 - DNA, 25 bp, Rattus norvegicus
cttggccctgcctgaatgaagtgta

SEQ ID NO: 280669 - DNA, 25 bp, Rattus norvegicus
cttggcctaagcaacgaatgaacac

SEQ ID NO: 280670 - DNA, 25 bp, Rattus norvegicus
cttggcctaagctacgaatgaacac

SEQ ID NO: 280671 - DNA, 25 bp, Rattus norvegicus
cttggcctactcagtcatgttaaga

SEQ ID NO: 280672 - DNA, 25 bp, Rattus norvegicus
cttggcctactctgtcatgttaaga

SEQ ID NO: 280673 - DNA, 25 bp, Rattus norvegicus
cttggcctatttccttcgatatgat

SEQ ID NO: 280674 - DNA, 25 bp, Rattus norvegicus
cttggcctatttgcttcgatatgat

SEQ ID NO: 280675 - DNA, 25 bp, Rattus norvegicus
cttggcctcagtcgctgaactgaaa

SEQ ID NO: 280676 - DNA, 25 bp, Rattus norvegicus
cttggcctcagtggctgaactgaaa

SEQ ID NO: 280677 - DNA, 25 bp, Rattus norvegicus
cttggcctctttacataatggacta

SEQ ID NO: 280678 - DNA, 25 bp, Rattus norvegicus
cttggcctcttttcataatggacta

SEQ ID NO: 280679 - DNA, 25 bp, Rattus norvegicus
cttggcctgctcctgagaagctagg

SEQ ID NO: 280680 - DNA, 25 bp, Rattus norvegicus
cttggcctgctcgtgagaagctagg

SEQ ID NO: 280681 - DNA, 25 bp, Rattus norvegicus
cttggcctggagcttttgctataga

SEQ ID NO: 280682 - DNA, 25 bp, Rattus norvegicus
cttggcctggaggttttgctataga

SEQ ID NO: 280683 - DNA, 25 bp, Rattus norvegicus
cttggccttcagattttatttcaga

SEQ ID NO: 280684 - DNA, 25 bp, Rattus norvegicus
cttggccttcagtttttatttcaga

SEQ ID NO: 280685 - DNA, 25 bp, Rattus norvegicus
cttggcgcgcctaagttcgagtgga

SEQ ID NO: 280686 - DNA, 25 bp, Rattus norvegicus
cttggcgcgccttagttcgagtgga

SEQ ID NO: 280687 - DNA, 25 bp, Rattus norvegicus
cttggcgctgctctagctcctgtgg

SEQ ID NO: 280688 - DNA, 25 bp, Rattus norvegicus
cttggcgctgctgtagctcctgtgg

SEQ ID NO: 280689 - DNA, 25 bp, Rattus norvegicus
cttggcgggctcaggttacaaaact

SEQ ID NO: 280690 - DNA, 25 bp, Rattus norvegicus
cttggcgggctctggttacaaaact

SEQ ID NO: 280691 - DNA, 25 bp, Rattus norvegicus
cttggcggtcgtcgagcttagttat

SEQ ID NO: 280692 - DNA, 25 bp, Rattus norvegicus
cttggcggtcgtggagcttagttat

SEQ ID NO: 280693 - DNA, 25 bp, Rattus norvegicus
cttggcgttcatctttgtaaccaga

SEQ ID NO: 280694 - DNA, 25 bp, Rattus norvegicus
cttggcgttcatgtttgtaaccaga

SEQ ID NO: 280695 - DNA, 25 bp, Rattus norvegicus
cttggctagactacagacaggtaca

SEQ ID NO: 280696 - DNA, 25 bp, Rattus norvegicus
cttggctagacttcagacaggtaca

SEQ ID NO: 280697 - DNA, 25 bp, Rattus norvegicus
cttggctatgatctacctgatggca

SEQ ID NO: 280698 - DNA, 25 bp, Rattus norvegicus
cttggctatgatgtacctgatggca

SEQ ID NO: 280699 - DNA, 25 bp, Rattus norvegicus
cttggctcagagatgtgtgttccgt

SEQ ID NO: 280700 - DNA, 25 bp, Rattus norvegicus
cttggctcagagttgtgtgttccgt

SEQ ID NO: 280701 - DNA, 25 bp, Rattus norvegicus
cttggctcctttactgattatggta

SEQ ID NO: 280702 - DNA, 25 bp, Rattus norvegicus
cttggctccttttctgattatggta

SEQ ID NO: 280703 - DNA, 25 bp, Rattus norvegicus
cttggctcggtcaaaactctctgaa

SEQ ID NO: 280704 - DNA, 25 bp, Rattus norvegicus
cttggctcggtctaaactctctgaa

SEQ ID NO: 280705 - DNA, 25 bp, Rattus norvegicus
cttggctgagacatgacccgactaa

SEQ ID NO: 280706 - DNA, 25 bp, Rattus norvegicus
cttggctgagacttgacccgactaa

SEQ ID NO: 280707 - DNA, 25 bp, Rattus norvegicus
cttggctgagccaagaactgcatta

SEQ ID NO: 280708 - DNA, 25 bp, Rattus norvegicus
cttggctgagcctagaactgcatta

SEQ ID NO: 280709 - DNA, 25 bp, Rattus norvegicus
cttggctgaggcaaccggcggtctc

SEQ ID NO: 280710 - DNA, 25 bp, Rattus norvegicus
cttggctgaggctaccggcggtctc

SEQ ID NO: 280711 - DNA, 25 bp, Rattus norvegicus
cttggctgcagtcaggaacttctta

SEQ ID NO: 280712 - DNA, 25 bp, Rattus norvegicus
cttggctgcagtgaggaacttctta

SEQ ID NO: 280713 - DNA, 25 bp, Rattus norvegicus
cttggctggcatctcactcatatac

SEQ ID NO: 280714 - DNA, 25 bp, Rattus norvegicus
cttggctggcatgtcactcatatac

SEQ ID NO: 280715 - DNA, 25 bp, Rattus norvegicus
cttggctgggctaggtctctccatc

SEQ ID NO: 280716 - DNA, 25 bp, Rattus norvegicus
cttggctgggcttggtctctccatc

SEQ ID NO: 280717 - DNA, 25 bp, Rattus norvegicus
cttggctgtgttccttagttggttg

SEQ ID NO: 280718 - DNA, 25 bp, Rattus norvegicus
cttggctgtgttgcttagttggttg

SEQ ID NO: 280719 - DNA, 25 bp, Rattus norvegicus
cttggcttagcaaggcatccttttc

SEQ ID NO: 280720 - DNA, 25 bp, Rattus norvegicus
cttggcttagcatggcatccttttc

SEQ ID NO: 280721 - DNA, 25 bp, Rattus norvegicus
cttggcttagtgattgcatctcgtt

SEQ ID NO: 280722 - DNA, 25 bp, Rattus norvegicus
cttggcttagtgtttgcatctcgtt

SEQ ID NO: 280723 - DNA, 25 bp, Rattus norvegicus
cttggcttccttctttaacatttgt

SEQ ID NO: 280724 - DNA, 25 bp, Rattus norvegicus
cttggcttccttgtttaacatttgt

SEQ ID NO: 280725 - DNA, 25 bp, Rattus norvegicus
cttggcttgcatagatgtttcccac

SEQ ID NO: 280726 - DNA, 25 bp, Rattus norvegicus
cttggcttgcattgatgtttcccac

SEQ ID NO: 280727 - DNA, 25 bp, Rattus norvegicus
cttggcttggaaatgcctacaaact

SEQ ID NO: 280728 - DNA, 25 bp, Rattus norvegicus
cttggcttggaattgcctacaaact

SEQ ID NO: 280729 - DNA, 25 bp, Rattus norvegicus
cttggcttgtctcgcggtggaccct

SEQ ID NO: 280730 - DNA, 25 bp, Rattus norvegicus
cttggcttgtctggcggtggaccct

SEQ ID NO: 280731 - DNA, 25 bp, Rattus norvegicus
cttggcttgtgtctctttatgttaa

SEQ ID NO: 280732 - DNA, 25 bp, Rattus norvegicus
cttggcttgtgtgtctttatgttaa

SEQ ID NO: 280733 - DNA, 25 bp, Rattus norvegicus
cttggctttgcacgttagacgttct

SEQ ID NO: 280734 - DNA, 25 bp, Rattus norvegicus
cttggctttgcaggttagacgttct

SEQ ID NO: 280735 - DNA, 25 bp, Rattus norvegicus
cttggctttggcctttagagagcag

SEQ ID NO: 280736 - DNA, 25 bp, Rattus norvegicus
cttggctttggcgtttagagagcag

SEQ ID NO: 280737 - DNA, 25 bp, Rattus norvegicus
cttggctttgtcagctgtgtaggct

SEQ ID NO: 280738 - DNA, 25 bp, Rattus norvegicus
cttggctttgtctgctgtgtaggct

SEQ ID NO: 280739 - DNA, 25 bp, Rattus norvegicus
cttggcttttccaggtatgtaccgt

SEQ ID NO: 280740 - DNA, 25 bp, Rattus norvegicus
cttggcttttcctggtatgtaccgt

SEQ ID NO: 280741 - DNA, 25 bp, Rattus norvegicus
cttgggaactccatacattttatgc

SEQ ID NO: 280742 - DNA, 25 bp, Rattus norvegicus
cttgggaactccttacattttatgc

SEQ ID NO: 280743 - DNA, 25 bp, Rattus norvegicus
cttgggaagcaaacttggccacatt

SEQ ID NO: 280744 - DNA, 25 bp, Rattus norvegicus
cttgggaagcaatcttggccacatt

SEQ ID NO: 280745 - DNA, 25 bp, Rattus norvegicus
cttgggaatgctccgctctctgtat

SEQ ID NO: 280746 - DNA, 25 bp, Rattus norvegicus
cttgggaatgctgcgctctctgtat

SEQ ID NO: 280747 - DNA, 25 bp, Rattus norvegicus
cttgggacaatacccagcctgggaa

SEQ ID NO: 280748 - DNA, 25 bp, Rattus norvegicus
cttgggacaatagccagcctgggaa

SEQ ID NO: 280749 - DNA, 25 bp, Rattus norvegicus
cttgggaccagcacccctagggaga

SEQ ID NO: 280750 - DNA, 25 bp, Rattus norvegicus
cttgggaccagctcccctagggaga

SEQ ID NO: 280751 - DNA, 25 bp, Rattus norvegicus
cttgggacctatctgattatagtac

SEQ ID NO: 280752 - DNA, 25 bp, Rattus norvegicus
cttgggacctatgtgattatagtac

SEQ ID NO: 280753 - DNA, 25 bp, Rattus norvegicus
cttgggacttggctgtgttaatgaa

SEQ ID NO: 280754 - DNA, 25 bp, Rattus norvegicus
cttgggacttgggtgtgttaatgaa

SEQ ID NO: 280755 - DNA, 25 bp, Rattus norvegicus
cttgggagccgacgacttggacttt

SEQ ID NO: 280756 - DNA, 25 bp, Rattus norvegicus
cttgggagccgaggacttggacttt

SEQ ID NO: 280757 - DNA, 25 bp, Rattus norvegicus
cttgggagcctcagttcttgaaagg

SEQ ID NO: 280758 - DNA, 25 bp, Rattus norvegicus
cttgggagcctctgttcttgaaagg

SEQ ID NO: 280759 - DNA, 25 bp, Rattus norvegicus
cttgggaggcagaattcaggacagc

SEQ ID NO: 280760 - DNA, 25 bp, Rattus norvegicus
cttgggaggcagtattcaggacagc

SEQ ID NO: 280761 - DNA, 25 bp, Rattus norvegicus
cttgggagtctgaggcttctttaaa

SEQ ID NO: 280762 - DNA, 25 bp, Rattus norvegicus
cttgggagtctgtggcttctttaaa

SEQ ID NO: 280763 - DNA, 25 bp, Rattus norvegicus
cttgggatcagcacttggccaagag

SEQ ID NO: 280764 - DNA, 25 bp, Rattus norvegicus
cttgggatcagctcttggccaagag

SEQ ID NO: 280765 - DNA, 25 bp, Rattus norvegicus
cttgggatcgggatcagattctgga

SEQ ID NO: 280766 - DNA, 25 bp, Rattus norvegicus
cttgggatcgggttcagattctgga

SEQ ID NO: 280767 - DNA, 25 bp, Rattus norvegicus
cttgggattgtgatttcttgtacat

SEQ ID NO: 280768 - DNA, 25 bp, Rattus norvegicus
cttgggattgtgttttcttgtacat

SEQ ID NO: 280769 - DNA, 25 bp, Rattus norvegicus
cttgggatttgaaggaccagagtct

SEQ ID NO: 280770 - DNA, 25 bp, Rattus norvegicus
cttgggatttgatggaccagagtct

SEQ ID NO: 280771 - DNA, 25 bp, Rattus norvegicus
cttgggatttgtctcttgtgtctat

SEQ ID NO: 280772 - DNA, 25 bp, Rattus norvegicus
cttgggatttgtgtcttgtgtctat

SEQ ID NO: 280773 - DNA, 25 bp, Rattus norvegicus
cttgggcaagtcatttgacctctgt

SEQ ID NO: 280774 - DNA, 25 bp, Rattus norvegicus
cttgggcaagtcttttgacctctgt

SEQ ID NO: 280775 - DNA, 25 bp, Rattus norvegicus
cttgggcacgaacgacaaacagtta

SEQ ID NO: 280776 - DNA, 25 bp, Rattus norvegicus
cttgggcacgaaggacaaacagtta

SEQ ID NO: 280777 - DNA, 25 bp, Rattus norvegicus
cttgggcactttcctaacgggagga

SEQ ID NO: 280778 - DNA, 25 bp, Rattus norvegicus
cttgggcactttgctaacgggagga

SEQ ID NO: 280779 - DNA, 25 bp, Rattus norvegicus
cttgggcagcagatgtcctgactaa

SEQ ID NO: 280780 - DNA, 25 bp, Rattus norvegicus
cttgggcagcagttgtcctgactaa

SEQ ID NO: 280781 - DNA, 25 bp, Rattus norvegicus
cttgggcagcctatcctgaagcaga

SEQ ID NO: 280782 - DNA, 25 bp, Rattus norvegicus
cttgggcagcctttcctgaagcaga

SEQ ID NO: 280783 - DNA, 25 bp, Rattus norvegicus
cttgggcattctcaggtaacctctt

SEQ ID NO: 280784 - DNA, 25 bp, Rattus norvegicus
cttgggcattctgaggtaacctctt

SEQ ID NO: 280785 - DNA, 25 bp, Rattus norvegicus
cttgggcattgcatctcataataaa

SEQ ID NO: 280786 - DNA, 25 bp, Rattus norvegicus
cttgggcattgcttctcataataaa

SEQ ID NO: 280787 - DNA, 25 bp, Rattus norvegicus
cttgggcatttgatgattgttggca

SEQ ID NO: 280788 - DNA, 25 bp, Rattus norvegicus
cttgggcatttgttgattgttggca

SEQ ID NO: 280789 - DNA, 25 bp, Rattus norvegicus
cttgggccaggaattgtgtttgcat

SEQ ID NO: 280790 - DNA, 25 bp, Rattus norvegicus
cttgggccaggatttgtgtttgcat

SEQ ID NO: 280791 - DNA, 25 bp, Rattus norvegicus
cttgggccaggcagaacaggagcct

SEQ ID NO: 280792 - DNA, 25 bp, Rattus norvegicus
cttgggccaggctgaacaggagcct

SEQ ID NO: 280793 - DNA, 25 bp, Rattus norvegicus
cttgggcccataactcagaagcaca

SEQ ID NO: 280794 - DNA, 25 bp, Rattus norvegicus
cttgggcccatatctcagaagcaca

SEQ ID NO: 280795 - DNA, 25 bp, Rattus norvegicus
cttgggccctttaataactctatga

SEQ ID NO: 280796 - DNA, 25 bp, Rattus norvegicus
cttgggcccttttataactctatga

SEQ ID NO: 280797 - DNA, 25 bp, Rattus norvegicus
cttgggccgaagatcaggtttccat

SEQ ID NO: 280798 - DNA, 25 bp, Rattus norvegicus
cttgggccgaagttcaggtttccat

SEQ ID NO: 280799 - DNA, 25 bp, Rattus norvegicus
cttgggctcagcacgaaagggcttt

SEQ ID NO: 280800 - DNA, 25 bp, Rattus norvegicus
cttgggctcagctcgaaagggcttt

SEQ ID NO: 280801 - DNA, 25 bp, Rattus norvegicus
cttgggctcataacccagcaggaaa

SEQ ID NO: 280802 - DNA, 25 bp, Rattus norvegicus
cttgggctcatatcccagcaggaaa

SEQ ID NO: 280803 - DNA, 25 bp, Rattus norvegicus
cttgggctcccacagaacttgagga

SEQ ID NO: 280804 - DNA, 25 bp, Rattus norvegicus
cttgggctcccagagaacttgagga

SEQ ID NO: 280805 - DNA, 25 bp, Rattus norvegicus
cttgggctgactagtgcatggtacc

SEQ ID NO: 280806 - DNA, 25 bp, Rattus norvegicus
cttgggctgacttgtgcatggtacc

SEQ ID NO: 280807 - DNA, 25 bp, Rattus norvegicus
cttgggctgaggagttcttactagt

SEQ ID NO: 280808 - DNA, 25 bp, Rattus norvegicus
cttgggctgaggtgttcttactagt

SEQ ID NO: 280809 - DNA, 25 bp, Rattus norvegicus
cttgggcttcatagacttcatccta

SEQ ID NO: 280810 - DNA, 25 bp, Rattus norvegicus
cttgggcttcattgacttcatccta

SEQ ID NO: 280811 - DNA, 25 bp, Rattus norvegicus
cttgggcttgttatccactgggcaa

SEQ ID NO: 280812 - DNA, 25 bp, Rattus norvegicus
cttgggcttgttttccactgggcaa

SEQ ID NO: 280813 - DNA, 25 bp, Rattus norvegicus
cttgggcttttaaatggtccggcct

SEQ ID NO: 280814 - DNA, 25 bp, Rattus norvegicus
cttgggcttttatatggtccggcct

SEQ ID NO: 280815 - DNA, 25 bp, Rattus norvegicus
cttggggcatctctcattaacaatt

SEQ ID NO: 280816 - DNA, 25 bp, Rattus norvegicus
cttggggcatctgtcattaacaatt

SEQ ID NO: 280817 - DNA, 25 bp, Rattus norvegicus
cttgggtaaacaaagagttcatctt

SEQ ID NO: 280818 - DNA, 25 bp, Rattus norvegicus
cttgggtaaacatagagttcatctt

SEQ ID NO: 280819 - DNA, 25 bp, Rattus norvegicus
cttgggtcacctcatggtagccagt

SEQ ID NO: 280820 - DNA, 25 bp, Rattus norvegicus
cttgggtcacctgatggtagccagt

SEQ ID NO: 280821 - DNA, 25 bp, Rattus norvegicus
cttgggtcccatcggcacaggtgca

SEQ ID NO: 280822 - DNA, 25 bp, Rattus norvegicus
cttgggtcccatgggcacaggtgca

SEQ ID NO: 280823 - DNA, 25 bp, Rattus norvegicus
cttgggtctgacctcttagaataac

SEQ ID NO: 280824 - DNA, 25 bp, Rattus norvegicus
cttgggtctgacgtcttagaataac

SEQ ID NO: 280825 - DNA, 25 bp, Rattus norvegicus
cttgggtctgctcctaggtgcaaaa

SEQ ID NO: 280826 - DNA, 25 bp, Rattus norvegicus
cttgggtctgctgctaggtgcaaaa

SEQ ID NO: 280827 - DNA, 25 bp, Rattus norvegicus
cttgggtgccccatctgagtcatcc

SEQ ID NO: 280828 - DNA, 25 bp, Rattus norvegicus
cttgggtgccccttctgagtcatcc

SEQ ID NO: 280829 - DNA, 25 bp, Rattus norvegicus
cttgggtggagccatcacattgctg

SEQ ID NO: 280830 - DNA, 25 bp, Rattus norvegicus
cttgggtggagcgatcacattgctg

SEQ ID NO: 280831 - DNA, 25 bp, Rattus norvegicus
cttgggtggccaatgtctgacatct

SEQ ID NO: 280832 - DNA, 25 bp, Rattus norvegicus
cttgggtggccattgtctgacatct

SEQ ID NO: 280833 - DNA, 25 bp, Rattus norvegicus
cttgggtgggtaactacaggagcta

SEQ ID NO: 280834 - DNA, 25 bp, Rattus norvegicus
cttgggtgggtatctacaggagcta

SEQ ID NO: 280835 - DNA, 25 bp, Rattus norvegicus
cttgggtgtaatccttttcctgcgc

SEQ ID NO: 280836 - DNA, 25 bp, Rattus norvegicus
cttgggtgtaatgcttttcctgcgc

SEQ ID NO: 280837 - DNA, 25 bp, Rattus norvegicus
cttgggttccatcagcacagcataa

SEQ ID NO: 280838 - DNA, 25 bp, Rattus norvegicus
cttgggttccatgagcacagcataa

SEQ ID NO: 280839 - DNA, 25 bp, Rattus norvegicus
cttgggttgccaagccttgtcagaa

SEQ ID NO: 280840 - DNA, 25 bp, Rattus norvegicus
cttgggttgccatgccttgtcagaa

SEQ ID NO: 280841 - DNA, 25 bp, Rattus norvegicus
cttgggttggacaggccagtgtaca

SEQ ID NO: 280842 - DNA, 25 bp, Rattus norvegicus
cttgggttggactggccagtgtaca

SEQ ID NO: 280843 - DNA, 25 bp, Rattus norvegicus
cttgggttgtttctagatggctctt

SEQ ID NO: 280844 - DNA, 25 bp, Rattus norvegicus
cttgggttgtttgtagatggctctt

SEQ ID NO: 280845 - DNA, 25 bp, Rattus norvegicus
cttgggtttaatacacttagcattg

SEQ ID NO: 280846 - DNA, 25 bp, Rattus norvegicus
cttgggtttaattcacttagcattg

SEQ ID NO: 280847 - DNA, 25 bp, Rattus norvegicus
cttgggtttcaaaaattaatggatt

SEQ ID NO: 280848 - DNA, 25 bp, Rattus norvegicus
cttgggtttcaataattaatggatt

SEQ ID NO: 280849 - DNA, 25 bp, Rattus norvegicus
cttgggtttcctactattctcagta

SEQ ID NO: 280850 - DNA, 25 bp, Rattus norvegicus
cttgggtttccttctattctcagta

SEQ ID NO: 280851 - DNA, 25 bp, Rattus norvegicus
cttgggtttgtaaataaggacacga

SEQ ID NO: 280852 - DNA, 25 bp, Rattus norvegicus
cttgggtttgtatataaggacacga

SEQ ID NO: 280853 - DNA, 25 bp, Rattus norvegicus
cttggtaacttacaacccatctgtt

SEQ ID NO: 280854 - DNA, 25 bp, Rattus norvegicus
cttggtaacttagaacccatctgtt

SEQ ID NO: 280855 - DNA, 25 bp, Rattus norvegicus
cttggtacctttcggaagggctgca

SEQ ID NO: 280856 - DNA, 25 bp, Rattus norvegicus
cttggtacctttgggaagggctgca

SEQ ID NO: 280857 - DNA, 25 bp, Rattus norvegicus
cttggtactagcctagtgacttttt

SEQ ID NO: 280858 - DNA, 25 bp, Rattus norvegicus
cttggtactagcgtagtgacttttt

SEQ ID NO: 280859 - DNA, 25 bp, Rattus norvegicus
cttggtataacacatggcgcggctg

SEQ ID NO: 280860 - DNA, 25 bp, Rattus norvegicus
cttggtataacagatggcgcggctg

SEQ ID NO: 280861 - DNA, 25 bp, Rattus norvegicus
cttggtatctaaatccaggatgtga

SEQ ID NO: 280862 - DNA, 25 bp, Rattus norvegicus
cttggtatctaattccaggatgtga

SEQ ID NO: 280863 - DNA, 25 bp, Rattus norvegicus
cttggtatttcgcagcagcctgggc

SEQ ID NO: 280864 - DNA, 25 bp, Rattus norvegicus
cttggtatttcggagcagcctgggc

SEQ ID NO: 280865 - DNA, 25 bp, Rattus norvegicus
cttggtcagtagcttgtagttttgt

SEQ ID NO: 280866 - DNA, 25 bp, Rattus norvegicus
cttggtcagtaggttgtagttttgt

SEQ ID NO: 280867 - DNA, 25 bp, Rattus norvegicus
cttggtcatagtaggtggccatcct

SEQ ID NO: 280868 - DNA, 25 bp, Rattus norvegicus
cttggtcatagttggtggccatcct

SEQ ID NO: 280869 - DNA, 25 bp, Rattus norvegicus
cttggtcatatcaggcaggtgcttg

SEQ ID NO: 280870 - DNA, 25 bp, Rattus norvegicus
cttggtcatatctggcaggtgcttg

SEQ ID NO: 280871 - DNA, 25 bp, Rattus norvegicus
cttggtcatctgctcatggaactga

SEQ ID NO: 280872 - DNA, 25 bp, Rattus norvegicus
cttggtcatctggtcatggaactga

SEQ ID NO: 280873 - DNA, 25 bp, Rattus norvegicus
cttggtcatcttcccgtggcctaca

SEQ ID NO: 280874 - DNA, 25 bp, Rattus norvegicus
cttggtcatcttgccgtggcctaca

SEQ ID NO: 280875 - DNA, 25 bp, Rattus norvegicus
cttggtcccaggatagtggtgcgat

SEQ ID NO: 280876 - DNA, 25 bp, Rattus norvegicus
cttggtcccaggttagtggtgcgat

SEQ ID NO: 280877 - DNA, 25 bp, Rattus norvegicus
cttggtccttcacaaagtgctttga

SEQ ID NO: 280878 - DNA, 25 bp, Rattus norvegicus
cttggtccttcagaaagtgctttga

SEQ ID NO: 280879 - DNA, 25 bp, Rattus norvegicus
cttggtctcagtatgcacagtggtg

SEQ ID NO: 280880 - DNA, 25 bp, Rattus norvegicus
cttggtctcagtttgcacagtggtg

SEQ ID NO: 280881 - DNA, 25 bp, Rattus norvegicus
cttggtctctatccctctggagaaa

SEQ ID NO: 280882 - DNA, 25 bp, Rattus norvegicus
cttggtctctatgcctctggagaaa

SEQ ID NO: 280883 - DNA, 25 bp, Rattus norvegicus
cttggtctctctatttcctaacaaa

SEQ ID NO: 280884 - DNA, 25 bp, Rattus norvegicus
cttggtctctctttttcctaacaaa

SEQ ID NO: 280885 - DNA, 25 bp, Rattus norvegicus
cttggtctgggaagtgcttgcttta

SEQ ID NO: 280886 - DNA, 25 bp, Rattus norvegicus
cttggtctgggatgtgcttgcttta

SEQ ID NO: 280887 - DNA, 25 bp, Rattus norvegicus
cttggtctgtgtagtctatgatgca

SEQ ID NO: 280888 - DNA, 25 bp, Rattus norvegicus
cttggtctgtgttgtctatgatgca

SEQ ID NO: 280889 - DNA, 25 bp, Rattus norvegicus
cttggtcttccacagtatgcagaga

SEQ ID NO: 280890 - DNA, 25 bp, Rattus norvegicus
cttggtcttccagagtatgcagaga

SEQ ID NO: 280891 - DNA, 25 bp, Rattus norvegicus
cttggtcttggaaccattgtactga

SEQ ID NO: 280892 - DNA, 25 bp, Rattus norvegicus
cttggtcttggatccattgtactga

SEQ ID NO: 280893 - DNA, 25 bp, Rattus norvegicus
cttggtgaagctacctgcctcttct

SEQ ID NO: 280894 - DNA, 25 bp, Rattus norvegicus
cttggtgaagcttcctgcctcttct

SEQ ID NO: 280895 - DNA, 25 bp, Rattus norvegicus
cttggtgaccttcccaatgacagtt

SEQ ID NO: 280896 - DNA, 25 bp, Rattus norvegicus
cttggtgaccttcgactttggcatg

SEQ ID NO: 280897 - DNA, 25 bp, Rattus norvegicus
cttggtgaccttgccaatgacagtt

SEQ ID NO: 280898 - DNA, 25 bp, Rattus norvegicus
cttggtgaccttggactttggcatg

SEQ ID NO: 280899 - DNA, 25 bp, Rattus norvegicus
cttggtgcacacatggtgacggcga

SEQ ID NO: 280900 - DNA, 25 bp, Rattus norvegicus
cttggtgcacacttggtgacggcga

SEQ ID NO: 280901 - DNA, 25 bp, Rattus norvegicus
cttggtgcacagatcgtttaagccc

SEQ ID NO: 280902 - DNA, 25 bp, Rattus norvegicus
cttggtgcacagttcgtttaagccc

SEQ ID NO: 280903 - DNA, 25 bp, Rattus norvegicus
cttggtgctctcactgagtgcgaag

SEQ ID NO: 280904 - DNA, 25 bp, Rattus norvegicus
cttggtgctctctctgagtgcgaag

SEQ ID NO: 280905 - DNA, 25 bp, Rattus norvegicus
cttggtgctcttagtttccttatat

SEQ ID NO: 280906 - DNA, 25 bp, Rattus norvegicus
cttggtgctctttgtttccttatat

SEQ ID NO: 280907 - DNA, 25 bp, Rattus norvegicus
cttggtgctgacagttaactgtggt

SEQ ID NO: 280908 - DNA, 25 bp, Rattus norvegicus
cttggtgctgactgttaactgtggt

SEQ ID NO: 280909 - DNA, 25 bp, Rattus norvegicus
cttggtggctctattaatccgatca

SEQ ID NO: 280910 - DNA, 25 bp, Rattus norvegicus
cttggtggctcttttaatccgatca

SEQ ID NO: 280911 - DNA, 25 bp, Rattus norvegicus
cttggtggctttattctctttgtga

SEQ ID NO: 280912 - DNA, 25 bp, Rattus norvegicus
cttggtggcttttttctctttgtga

SEQ ID NO: 280913 - DNA, 25 bp, Rattus norvegicus
cttggtgtactcagaagacccgtga

SEQ ID NO: 280914 - DNA, 25 bp, Rattus norvegicus
cttggtgtactctgaagacccgtga

SEQ ID NO: 280915 - DNA, 25 bp, Rattus norvegicus
cttggtgtatgtcaatccctatctc

SEQ ID NO: 280916 - DNA, 25 bp, Rattus norvegicus
cttggtgtatgtgaatccctatctc

SEQ ID NO: 280917 - DNA, 25 bp, Rattus norvegicus
cttggtgtcaatctttttcactgga

SEQ ID NO: 280918 - DNA, 25 bp, Rattus norvegicus
cttggtgtcaatgtttttcactgga

SEQ ID NO: 280919 - DNA, 25 bp, Rattus norvegicus
cttggtgtcactaatgtatcatatc

SEQ ID NO: 280920 - DNA, 25 bp, Rattus norvegicus
cttggtgtcacttatgtatcatatc

SEQ ID NO: 280921 - DNA, 25 bp, Rattus norvegicus
cttggtgtccagatgctgctgctgc

SEQ ID NO: 280922 - DNA, 25 bp, Rattus norvegicus
cttggtgtccagttgctgctgctgc

SEQ ID NO: 280923 - DNA, 25 bp, Rattus norvegicus
cttggtgtgaacagatctctggcat

SEQ ID NO: 280924 - DNA, 25 bp, Rattus norvegicus
cttggtgtgaactgatctctggcat

SEQ ID NO: 280925 - DNA, 25 bp, Rattus norvegicus
cttggtgttctactccatgggtgga

SEQ ID NO: 280926 - DNA, 25 bp, Rattus norvegicus
cttggtgttctagtccatgggtgga

SEQ ID NO: 280927 - DNA, 25 bp, Rattus norvegicus
cttggtgttcttaccatgttgctaa

SEQ ID NO: 280928 - DNA, 25 bp, Rattus norvegicus
cttggtgttctttccatgttgctaa

SEQ ID NO: 280929 - DNA, 25 bp, Rattus norvegicus
cttggttacaaacgtggtcacacca

SEQ ID NO: 280930 - DNA, 25 bp, Rattus norvegicus
cttggttacaaaggtggtcacacca

SEQ ID NO: 280931 - DNA, 25 bp, Rattus norvegicus
cttggttacgctagcagcagccaat

SEQ ID NO: 280932 - DNA, 25 bp, Rattus norvegicus
cttggttacgcttgcagcagccaat

SEQ ID NO: 280933 - DNA, 25 bp, Rattus norvegicus
cttggttaggttcttctcctgcata

SEQ ID NO: 280934 - DNA, 25 bp, Rattus norvegicus
cttggttaggttgttctcctgcata

SEQ ID NO: 280935 - DNA, 25 bp, Rattus norvegicus
cttggttcagtaataggttcgcttt

SEQ ID NO: 280936 - DNA, 25 bp, Rattus norvegicus
cttggttcagtattaggttcgcttt

SEQ ID NO: 280937 - DNA, 25 bp, Rattus norvegicus
cttggttccagaccgtctctatttt

SEQ ID NO: 280938 - DNA, 25 bp, Rattus norvegicus
cttggttccagagcgtctctatttt

SEQ ID NO: 280939 - DNA, 25 bp, Rattus norvegicus
cttggttctcagatggttggcggca

SEQ ID NO: 280940 - DNA, 25 bp, Rattus norvegicus
cttggttctcagttggttggcggca

SEQ ID NO: 280941 - DNA, 25 bp, Rattus norvegicus
cttggttctgaacatagctgggaat

SEQ ID NO: 280942 - DNA, 25 bp, Rattus norvegicus
cttggttctgaagatagctgggaat

SEQ ID NO: 280943 - DNA, 25 bp, Rattus norvegicus
cttggttgtcttatcccatgtaact

SEQ ID NO: 280944 - DNA, 25 bp, Rattus norvegicus
cttggttgtcttttcccatgtaact

SEQ ID NO: 280945 - DNA, 25 bp, Rattus norvegicus
cttggtttacataacatagctggga

SEQ ID NO: 280946 - DNA, 25 bp, Rattus norvegicus
cttggtttacattacatagctggga

SEQ ID NO: 280947 - DNA, 25 bp, Rattus norvegicus
cttggtttccaactcgaattctctt

SEQ ID NO: 280948 - DNA, 25 bp, Rattus norvegicus
cttggtttccaagtcgaattctctt

SEQ ID NO: 280949 - DNA, 25 bp, Rattus norvegicus
cttggtttcctgaaccagaaactat

SEQ ID NO: 280950 - DNA, 25 bp, Rattus norvegicus
cttggtttcctgtaccagaaactat

SEQ ID NO: 280951 - DNA, 25 bp, Rattus norvegicus
cttggtttccttcgcgccagaggca

SEQ ID NO: 280952 - DNA, 25 bp, Rattus norvegicus
cttggtttccttggcgccagaggca

SEQ ID NO: 280953 - DNA, 25 bp, Rattus norvegicus
cttggtttggcgatcgacattttct

SEQ ID NO: 280954 - DNA, 25 bp, Rattus norvegicus
cttggtttggcgttcgacattttct

SEQ ID NO: 280955 - DNA, 25 bp, Rattus norvegicus
cttggttttataacagtggttctca

SEQ ID NO: 280956 - DNA, 25 bp, Rattus norvegicus
cttggttttatatcagtggttctca

SEQ ID NO: 280957 - DNA, 25 bp, Rattus norvegicus
cttggttttggcctccagactaaag

SEQ ID NO: 280958 - DNA, 25 bp, Rattus norvegicus
cttggttttggcgtccagactaaag

SEQ ID NO: 280959 - DNA, 25 bp, Rattus norvegicus
cttggttttggtatcgaaatgctga

SEQ ID NO: 280960 - DNA, 25 bp, Rattus norvegicus
cttggttttggtttcgaaatgctga

SEQ ID NO: 280961 - DNA, 25 bp, Rattus norvegicus
cttgtaacgcaaatcagggatatta

SEQ ID NO: 280962 - DNA, 25 bp, Rattus norvegicus
cttgtaacgcaattcagggatatta

SEQ ID NO: 280963 - DNA, 25 bp, Rattus norvegicus
cttgtaactgccacttcaaacttat

SEQ ID NO: 280964 - DNA, 25 bp, Rattus norvegicus
cttgtaactgcctcttcaaacttat

SEQ ID NO: 280965 - DNA, 25 bp, Rattus norvegicus
cttgtaatggatatgcagttctgcc

SEQ ID NO: 280966 - DNA, 25 bp, Rattus norvegicus
cttgtaatggatttgcagttctgcc

SEQ ID NO: 280967 - DNA, 25 bp, Rattus norvegicus
cttgtaatgtcacttcccgggaatt

SEQ ID NO: 280968 - DNA, 25 bp, Rattus norvegicus
cttgtaatgtcagttcccgggaatt

SEQ ID NO: 280969 - DNA, 25 bp, Rattus norvegicus
cttgtaatttaaacaggcctggcat

SEQ ID NO: 280970 - DNA, 25 bp, Rattus norvegicus
cttgtaatttaatcaggcctggcat

SEQ ID NO: 280971 - DNA, 25 bp, Rattus norvegicus
cttgtacaaacaactctccatcttt

SEQ ID NO: 280972 - DNA, 25 bp, Rattus norvegicus
cttgtacaaacatctctccatcttt

SEQ ID NO: 280973 - DNA, 25 bp, Rattus norvegicus
cttgtacacactaggaatactcccc

SEQ ID NO: 280974 - DNA, 25 bp, Rattus norvegicus
cttgtacacacttggaatactcccc

SEQ ID NO: 280975 - DNA, 25 bp, Rattus norvegicus
cttgtacagataatttgggtggctt

SEQ ID NO: 280976 - DNA, 25 bp, Rattus norvegicus
cttgtacagatattttgggtggctt

SEQ ID NO: 280977 - DNA, 25 bp, Rattus norvegicus
cttgtacatttgatttgttggtagc

SEQ ID NO: 280978 - DNA, 25 bp, Rattus norvegicus
cttgtacatttgttttgttggtagc

SEQ ID NO: 280979 - DNA, 25 bp, Rattus norvegicus
cttgtacccgtgaaagagcagtttc

SEQ ID NO: 280980 - DNA, 25 bp, Rattus norvegicus
cttgtacccgtgtaagagcagtttc

SEQ ID NO: 280981 - DNA, 25 bp, Rattus norvegicus
cttgtacgccacagccgaattatat

SEQ ID NO: 280982 - DNA, 25 bp, Rattus norvegicus
cttgtacgccactgccgaattatat

SEQ ID NO: 280983 - DNA, 25 bp, Rattus norvegicus
cttgtactcgtacacttccttttga

SEQ ID NO: 280984 - DNA, 25 bp, Rattus norvegicus
cttgtactcgtagacttccttttga

SEQ ID NO: 280985 - DNA, 25 bp, Rattus norvegicus
cttgtacttcccaaagcaacctgga

SEQ ID NO: 280986 - DNA, 25 bp, Rattus norvegicus
cttgtacttccctaagcaacctgga

SEQ ID NO: 280987 - DNA, 25 bp, Rattus norvegicus
cttgtacttcgcatttccaggaaag

SEQ ID NO: 280988 - DNA, 25 bp, Rattus norvegicus
cttgtacttcgcttttccaggaaag

SEQ ID NO: 280989 - DNA, 25 bp, Rattus norvegicus
cttgtagaaatcagtccaccgtaga

SEQ ID NO: 280990 - DNA, 25 bp, Rattus norvegicus
cttgtagaaatctgtccaccgtaga

SEQ ID NO: 280991 - DNA, 25 bp, Rattus norvegicus
cttgtagcccttcgctggacttgaa

SEQ ID NO: 280992 - DNA, 25 bp, Rattus norvegicus
cttgtagcccttggctggacttgaa

SEQ ID NO: 280993 - DNA, 25 bp, Rattus norvegicus
cttgtagcgatgcttctggaaccag

SEQ ID NO: 280994 - DNA, 25 bp, Rattus norvegicus
cttgtagcgatggttctggaaccag

SEQ ID NO: 280995 - DNA, 25 bp, Rattus norvegicus
cttgtagctgctccgtgaaacactg

SEQ ID NO: 280996 - DNA, 25 bp, Rattus norvegicus
cttgtagctgctgcgtgaaacactg

SEQ ID NO: 280997 - DNA, 25 bp, Rattus norvegicus
cttgtaggtggcagttccttcaata

SEQ ID NO: 280998 - DNA, 25 bp, Rattus norvegicus
cttgtaggtggctgttccttcaata

SEQ ID NO: 280999 - DNA, 25 bp, Rattus norvegicus
cttgtagtgttaagtagcctgtgga

SEQ ID NO: 281000 - DNA, 25 bp, Rattus norvegicus
cttgtagtgttatgtagcctgtgga

SEQ ID NO: 281001 - DNA, 25 bp, Rattus norvegicus
cttgtataatgtacttgtgcttttt

SEQ ID NO: 281002 - DNA, 25 bp, Rattus norvegicus
cttgtataatgttcttgtgcttttt

SEQ ID NO: 281003 - DNA, 25 bp, Rattus norvegicus
cttgtatccccacagcaatactgaa

SEQ ID NO: 281004 - DNA, 25 bp, Rattus norvegicus
cttgtatccccagagcaatactgaa

SEQ ID NO: 281005 - DNA, 25 bp, Rattus norvegicus
cttgtattacgaatcgcacgatgag

SEQ ID NO: 281006 - DNA, 25 bp, Rattus norvegicus
cttgtattacgattcgcacgatgag

SEQ ID NO: 281007 - DNA, 25 bp, Rattus norvegicus
cttgtattctgtaggatacattaaa

SEQ ID NO: 281008 - DNA, 25 bp, Rattus norvegicus
cttgtattctgttggatacattaaa

SEQ ID NO: 281009 - DNA, 25 bp, Rattus norvegicus
cttgtattgcttctcattgctctca

SEQ ID NO: 281010 - DNA, 25 bp, Rattus norvegicus
cttgtattgcttgtcattgctctca

SEQ ID NO: 281011 - DNA, 25 bp, Rattus norvegicus
cttgtcaacacaaccagtctgataa

SEQ ID NO: 281012 - DNA, 25 bp, Rattus norvegicus
cttgtcaacacatccagtctgataa

SEQ ID NO: 281013 - DNA, 25 bp, Rattus norvegicus
cttgtcaacgtaccacttgtgtgta

SEQ ID NO: 281014 - DNA, 25 bp, Rattus norvegicus
cttgtcaacgtagcacttgtgtgta

SEQ ID NO: 281015 - DNA, 25 bp, Rattus norvegicus
cttgtcaactccagtctgctgggaa

SEQ ID NO: 281016 - DNA, 25 bp, Rattus norvegicus
cttgtcaactcctgtctgctgggaa

SEQ ID NO: 281017 - DNA, 25 bp, Rattus norvegicus
cttgtcaagctgagattctgtccca

SEQ ID NO: 281018 - DNA, 25 bp, Rattus norvegicus
cttgtcaagctgtgattctgtccca

SEQ ID NO: 281019 - DNA, 25 bp, Rattus norvegicus
cttgtcaagttcagggctgacctca

SEQ ID NO: 281020 - DNA, 25 bp, Rattus norvegicus
cttgtcaagttctgggctgacctca

SEQ ID NO: 281021 - DNA, 25 bp, Rattus norvegicus
cttgtcaatgggaagagaggccctt

SEQ ID NO: 281022 - DNA, 25 bp, Rattus norvegicus
cttgtcaatgggtagagaggccctt

SEQ ID NO: 281023 - DNA, 25 bp, Rattus norvegicus
cttgtcacactgacgtgggttctgt

SEQ ID NO: 281024 - DNA, 25 bp, Rattus norvegicus
cttgtcacactgtcgtgggttctgt

SEQ ID NO: 281025 - DNA, 25 bp, Rattus norvegicus
cttgtcacacttaagagccatcgaa

SEQ ID NO: 281026 - DNA, 25 bp, Rattus norvegicus
cttgtcacactttagagccatcgaa

SEQ ID NO: 281027 - DNA, 25 bp, Rattus norvegicus
cttgtcactgaacttttccctgaaa

SEQ ID NO: 281028 - DNA, 25 bp, Rattus norvegicus
cttgtcactgaagttttccctgaaa

SEQ ID NO: 281029 - DNA, 25 bp, Rattus norvegicus
cttgtcacttttcctctcttttaag

SEQ ID NO: 281030 - DNA, 25 bp, Rattus norvegicus
cttgtcacttttgctctcttttaag

SEQ ID NO: 281031 - DNA, 25 bp, Rattus norvegicus
cttgtcagaaacctgcttagcgttt

SEQ ID NO: 281032 - DNA, 25 bp, Rattus norvegicus
cttgtcagaaacgtgcttagcgttt

SEQ ID NO: 281033 - DNA, 25 bp, Rattus norvegicus
cttgtcagactccattttcgtgtac

SEQ ID NO: 281034 - DNA, 25 bp, Rattus norvegicus
cttgtcagactcgattttcgtgtac

SEQ ID NO: 281035 - DNA, 25 bp, Rattus norvegicus
cttgtcataggacccaggcaggaat

SEQ ID NO: 281036 - DNA, 25 bp, Rattus norvegicus
cttgtcataggagccaggcaggaat

SEQ ID NO: 281037 - DNA, 25 bp, Rattus norvegicus
cttgtcatccttcgttgggtcgcag

SEQ ID NO: 281038 - DNA, 25 bp, Rattus norvegicus
cttgtcatccttggttgggtcgcag

SEQ ID NO: 281039 - DNA, 25 bp, Rattus norvegicus
cttgtcatctcacaggcataggtat

SEQ ID NO: 281040 - DNA, 25 bp, Rattus norvegicus
cttgtcatctcagaggcataggtat

SEQ ID NO: 281041 - DNA, 25 bp, Rattus norvegicus
cttgtcatttacatgtgacccatat

SEQ ID NO: 281042 - DNA, 25 bp, Rattus norvegicus
cttgtcatttacttgtgacccatat

SEQ ID NO: 281043 - DNA, 25 bp, Rattus norvegicus
cttgtccatacccacatgaacatgt

SEQ ID NO: 281044 - DNA, 25 bp, Rattus norvegicus
cttgtccataccgacatgaacatgt

SEQ ID NO: 281045 - DNA, 25 bp, Rattus norvegicus
cttgtccatcccaatgaggttttgg

SEQ ID NO: 281046 - DNA, 25 bp, Rattus norvegicus
cttgtccatccctatgaggttttgg

SEQ ID NO: 281047 - DNA, 25 bp, Rattus norvegicus
cttgtccctccaacagtagcatgtc

SEQ ID NO: 281048 - DNA, 25 bp, Rattus norvegicus
cttgtccctccatcagtagcatgtc

SEQ ID NO: 281049 - DNA, 25 bp, Rattus norvegicus
cttgtcccttggagttagctagtga

SEQ ID NO: 281050 - DNA, 25 bp, Rattus norvegicus
cttgtcccttggtgttagctagtga

SEQ ID NO: 281051 - DNA, 25 bp, Rattus norvegicus
cttgtcccttttagatttttctgag

SEQ ID NO: 281052 - DNA, 25 bp, Rattus norvegicus
cttgtccctttttgatttttctgag

SEQ ID NO: 281053 - DNA, 25 bp, Rattus norvegicus
cttgtccgacatcggtcttcatgag

SEQ ID NO: 281054 - DNA, 25 bp, Rattus norvegicus
cttgtccgacatgggtcttcatgag

SEQ ID NO: 281055 - DNA, 25 bp, Rattus norvegicus
cttgtcctaagactaccagtgttaa

SEQ ID NO: 281056 - DNA, 25 bp, Rattus norvegicus
cttgtcctaagagtaccagtgttaa

SEQ ID NO: 281057 - DNA, 25 bp, Rattus norvegicus
cttgtcctcatgctgactctggcat

SEQ ID NO: 281058 - DNA, 25 bp, Rattus norvegicus
cttgtcctcatggtgactctggcat

SEQ ID NO: 281059 - DNA, 25 bp, Rattus norvegicus
cttgtcctcttaccacaattatcta

SEQ ID NO: 281060 - DNA, 25 bp, Rattus norvegicus
cttgtcctcttagcacaattatcta

SEQ ID NO: 281061 - DNA, 25 bp, Rattus norvegicus
cttgtcctgatactcctggagttat

SEQ ID NO: 281062 - DNA, 25 bp, Rattus norvegicus
cttgtcctgatagtcctggagttat

SEQ ID NO: 281063 - DNA, 25 bp, Rattus norvegicus
cttgtccttggcacatgggtcttag

SEQ ID NO: 281064 - DNA, 25 bp, Rattus norvegicus
cttgtccttggctcatgggtcttag

SEQ ID NO: 281065 - DNA, 25 bp, Rattus norvegicus
cttgtcgtaactatggtgcctgaga

SEQ ID NO: 281066 - DNA, 25 bp, Rattus norvegicus
cttgtcgtaactttggtgcctgaga

SEQ ID NO: 281067 - DNA, 25 bp, Rattus norvegicus
cttgtctaagaaccgcctggcacag

SEQ ID NO: 281068 - DNA, 25 bp, Rattus norvegicus
cttgtctaagaagcgcctggcacag

SEQ ID NO: 281069 - DNA, 25 bp, Rattus norvegicus
cttgtctaagccactggagtccaga

SEQ ID NO: 281070 - DNA, 25 bp, Rattus norvegicus
cttgtctaagcctctggagtccaga

SEQ ID NO: 281071 - DNA, 25 bp, Rattus norvegicus
cttgtctcagcgacatatcttgtct

SEQ ID NO: 281072 - DNA, 25 bp, Rattus norvegicus
cttgtctcagcgtcatatcttgtct

SEQ ID NO: 281073 - DNA, 25 bp, Rattus norvegicus
cttgtctcctgcaggtattttggat

SEQ ID NO: 281074 - DNA, 25 bp, Rattus norvegicus
cttgtctcctgctggtattttggat

SEQ ID NO: 281075 - DNA, 25 bp, Rattus norvegicus
cttgtctcttggaagcatgcttaac

SEQ ID NO: 281076 - DNA, 25 bp, Rattus norvegicus
cttgtctcttggtagcatgcttaac

SEQ ID NO: 281077 - DNA, 25 bp, Rattus norvegicus
cttgtctgaagcaatgggtctcttt

SEQ ID NO: 281078 - DNA, 25 bp, Rattus norvegicus
cttgtctgaagctatgggtctcttt

SEQ ID NO: 281079 - DNA, 25 bp, Rattus norvegicus
cttgtctgatttccggccctgggaa

SEQ ID NO: 281080 - DNA, 25 bp, Rattus norvegicus
cttgtctgatttgcggccctgggaa

SEQ ID NO: 281081 - DNA, 25 bp, Rattus norvegicus
cttgtctgcattcattagcggtaat

SEQ ID NO: 281082 - DNA, 25 bp, Rattus norvegicus
cttgtctgcattgattagcggtaat

SEQ ID NO: 281083 - DNA, 25 bp, Rattus norvegicus
cttgtctgcctgctttgtgtgaatg

SEQ ID NO: 281084 - DNA, 25 bp, Rattus norvegicus
cttgtctgcctggtttgtgtgaatg

SEQ ID NO: 281085 - DNA, 25 bp, Rattus norvegicus
cttgtctgtaccacgtgtgtatctg

SEQ ID NO: 281086 - DNA, 25 bp, Rattus norvegicus
cttgtctgtacctcgtgtgtatctg

SEQ ID NO: 281087 - DNA, 25 bp, Rattus norvegicus
cttgtctgtcaaatatttccttaaa

SEQ ID NO: 281088 - DNA, 25 bp, Rattus norvegicus
cttgtctgtcaattatttccttaaa

SEQ ID NO: 281089 - DNA, 25 bp, Rattus norvegicus
cttgtctgttgtcaggtgtgcatct

SEQ ID NO: 281090 - DNA, 25 bp, Rattus norvegicus
cttgtctgttgtgaggtgtgcatct

SEQ ID NO: 281091 - DNA, 25 bp, Rattus norvegicus
cttgtcttaggtcccggtccaaaga

SEQ ID NO: 281092 - DNA, 25 bp, Rattus norvegicus
cttgtcttaggtgccggtccaaaga

SEQ ID NO: 281093 - DNA, 25 bp, Rattus norvegicus
cttgtcttcacacctattaactgtc

SEQ ID NO: 281094 - DNA, 25 bp, Rattus norvegicus
cttgtcttcacagctattaactgtc

SEQ ID NO: 281095 - DNA, 25 bp, Rattus norvegicus
cttgtcttcaccacccaagtgttgg

SEQ ID NO: 281096 - DNA, 25 bp, Rattus norvegicus
cttgtcttcacctcccaagtgttgg

SEQ ID NO: 281097 - DNA, 25 bp, Rattus norvegicus
cttgtcttcccgaaagcaaaaatga

SEQ ID NO: 281098 - DNA, 25 bp, Rattus norvegicus
cttgtcttcccgtaagcaaaaatga

SEQ ID NO: 281099 - DNA, 25 bp, Rattus norvegicus
cttgtcttctgtatccgtagatgga

SEQ ID NO: 281100 - DNA, 25 bp, Rattus norvegicus
cttgtcttctgtttccgtagatgga

SEQ ID NO: 281101 - DNA, 25 bp, Rattus norvegicus
cttgtcttgaccctttggagagtgg

SEQ ID NO: 281102 - DNA, 25 bp, Rattus norvegicus
cttgtcttgaccgtttggagagtgg

SEQ ID NO: 281103 - DNA, 25 bp, Rattus norvegicus
cttgtcttggagcagctcttgcatt

SEQ ID NO: 281104 - DNA, 25 bp, Rattus norvegicus
cttgtcttggaggagctcttgcatt

SEQ ID NO: 281105 - DNA, 25 bp, Rattus norvegicus
cttgtcttgttcctgattggcatga

SEQ ID NO: 281106 - DNA, 25 bp, Rattus norvegicus
cttgtcttgttcgtgattggcatga

SEQ ID NO: 281107 - DNA, 25 bp, Rattus norvegicus
cttgtcttttacatcttttctgtga

SEQ ID NO: 281108 - DNA, 25 bp, Rattus norvegicus
cttgtcttttacttcttttctgtga

SEQ ID NO: 281109 - DNA, 25 bp, Rattus norvegicus
cttgtgaaacacctgagcctggata

SEQ ID NO: 281110 - DNA, 25 bp, Rattus norvegicus
cttgtgaaacacgtgagcctggata

SEQ ID NO: 281111 - DNA, 25 bp, Rattus norvegicus
cttgtgaaaccacccgacctaatta

SEQ ID NO: 281112 - DNA, 25 bp, Rattus norvegicus
cttgtgaaaccagccgacctaatta

SEQ ID NO: 281113 - DNA, 25 bp, Rattus norvegicus
cttgtgaacaagataccggtggctg

SEQ ID NO: 281114 - DNA, 25 bp, Rattus norvegicus
cttgtgaacaagttaccggtggctg

SEQ ID NO: 281115 - DNA, 25 bp, Rattus norvegicus
cttgtgacaagcctacttaccttta

SEQ ID NO: 281116 - DNA, 25 bp, Rattus norvegicus
cttgtgacaagcgtacttaccttta

SEQ ID NO: 281117 - DNA, 25 bp, Rattus norvegicus
cttgtgacacagagcgcatggacct

SEQ ID NO: 281118 - DNA, 25 bp, Rattus norvegicus
cttgtgacacagtgcgcatggacct

SEQ ID NO: 281119 - DNA, 25 bp, Rattus norvegicus
cttgtgacacatattgttaacctgt

SEQ ID NO: 281120 - DNA, 25 bp, Rattus norvegicus
cttgtgacacattttgttaacctgt

SEQ ID NO: 281121 - DNA, 25 bp, Rattus norvegicus
cttgtgacctaaaccatactgtacc

SEQ ID NO: 281122 - DNA, 25 bp, Rattus norvegicus
cttgtgacctaatccatactgtacc

SEQ ID NO: 281123 - DNA, 25 bp, Rattus norvegicus
cttgtgacctcaattcctggttgga

SEQ ID NO: 281124 - DNA, 25 bp, Rattus norvegicus
cttgtgacctcatttcctggttgga

SEQ ID NO: 281125 - DNA, 25 bp, Rattus norvegicus
cttgtgactggccttttgcagcaag

SEQ ID NO: 281126 - DNA, 25 bp, Rattus norvegicus
cttgtgactggcgttttgcagcaag

SEQ ID NO: 281127 - DNA, 25 bp, Rattus norvegicus
cttgtgactgtgcttcatgctcgaa

SEQ ID NO: 281128 - DNA, 25 bp, Rattus norvegicus
cttgtgactgtggttcatgctcgaa

SEQ ID NO: 281129 - DNA, 25 bp, Rattus norvegicus
cttgtgagtcccaccctgggaaaga

SEQ ID NO: 281130 - DNA, 25 bp, Rattus norvegicus
cttgtgagtccctccctgggaaaga

SEQ ID NO: 281131 - DNA, 25 bp, Rattus norvegicus
cttgtgatccttatctagactttga

SEQ ID NO: 281132 - DNA, 25 bp, Rattus norvegicus
cttgtgatccttttctagactttga

SEQ ID NO: 281133 - DNA, 25 bp, Rattus norvegicus
cttgtgatcttcctgagtagctgag

SEQ ID NO: 281134 - DNA, 25 bp, Rattus norvegicus
cttgtgatcttcgtgagtagctgag

SEQ ID NO: 281135 - DNA, 25 bp, Rattus norvegicus
cttgtgcagcacatggtcttatgta

SEQ ID NO: 281136 - DNA, 25 bp, Rattus norvegicus
cttgtgcagcacttggtcttatgta

SEQ ID NO: 281137 - DNA, 25 bp, Rattus norvegicus
cttgtgcctcttactctcaaattaa

SEQ ID NO: 281138 - DNA, 25 bp, Rattus norvegicus
cttgtgcctctttctctcaaattaa

SEQ ID NO: 281139 - DNA, 25 bp, Rattus norvegicus
cttgtgcctgttctctgtagatcag

SEQ ID NO: 281140 - DNA, 25 bp, Rattus norvegicus
cttgtgcctgttgtctgtagatcag

SEQ ID NO: 281141 - DNA, 25 bp, Rattus norvegicus
cttgtgctactcaccagtaaacact

SEQ ID NO: 281142 - DNA, 25 bp, Rattus norvegicus
cttgtgctactctccagtaaacact

SEQ ID NO: 281143 - DNA, 25 bp, Rattus norvegicus
cttgtgctgagtagtgctgtgccca

SEQ ID NO: 281144 - DNA, 25 bp, Rattus norvegicus
cttgtgctgagttgtgctgtgccca

SEQ ID NO: 281145 - DNA, 25 bp, Rattus norvegicus
cttgtgctgctgaacttagacattc

SEQ ID NO: 281146 - DNA, 25 bp, Rattus norvegicus
cttgtgctgctgtacttagacattc

SEQ ID NO: 281147 - DNA, 25 bp, Rattus norvegicus
cttgtgctggctctgataggatcta

SEQ ID NO: 281148 - DNA, 25 bp, Rattus norvegicus
cttgtgctggctgtgataggatcta

SEQ ID NO: 281149 - DNA, 25 bp, Rattus norvegicus
cttgtgctgtaaatgtacctgctga

SEQ ID NO: 281150 - DNA, 25 bp, Rattus norvegicus
cttgtgctgtaattgtacctgctga

SEQ ID NO: 281151 - DNA, 25 bp, Rattus norvegicus
cttgtgctgtctcggactcactgat

SEQ ID NO: 281152 - DNA, 25 bp, Rattus norvegicus
cttgtgctgtctgggactcactgat

SEQ ID NO: 281153 - DNA, 25 bp, Rattus norvegicus
cttgtgcttacaaaccagggtcctt

SEQ ID NO: 281154 - DNA, 25 bp, Rattus norvegicus
cttgtgcttacataccagggtcctt

SEQ ID NO: 281155 - DNA, 25 bp, Rattus norvegicus
cttgtggagcacagtctggatcctt

SEQ ID NO: 281156 - DNA, 25 bp, Rattus norvegicus
cttgtggagcactgtctggatcctt

SEQ ID NO: 281157 - DNA, 25 bp, Rattus norvegicus
cttgtggcacacagttgggtaatgt

SEQ ID NO: 281158 - DNA, 25 bp, Rattus norvegicus
cttgtggcacactgttgggtaatgt

SEQ ID NO: 281159 - DNA, 25 bp, Rattus norvegicus
cttgtggcatttcccatgtggtgtc

SEQ ID NO: 281160 - DNA, 25 bp, Rattus norvegicus
cttgtggcatttgccatgtggtgtc

SEQ ID NO: 281161 - DNA, 25 bp, Rattus norvegicus
cttgtggccctcctacataaaggga

SEQ ID NO: 281162 - DNA, 25 bp, Rattus norvegicus
cttgtggccctcgtacataaaggga

SEQ ID NO: 281163 - DNA, 25 bp, Rattus norvegicus
cttgtggcctaacttctggacttgg

SEQ ID NO: 281164 - DNA, 25 bp, Rattus norvegicus
cttgtggcctaagttctggacttgg

SEQ ID NO: 281165 - DNA, 25 bp, Rattus norvegicus
cttgtgggaaatcatgtattcatac

SEQ ID NO: 281166 - DNA, 25 bp, Rattus norvegicus
cttgtgggaaatgatgtattcatac

SEQ ID NO: 281167 - DNA, 25 bp, Rattus norvegicus
cttgtgggcactattgtggactgct

SEQ ID NO: 281168 - DNA, 25 bp, Rattus norvegicus
cttgtgggcacttttgtggactgct

SEQ ID NO: 281169 - DNA, 25 bp, Rattus norvegicus
cttgtgggccagaattaacattaca

SEQ ID NO: 281170 - DNA, 25 bp, Rattus norvegicus
cttgtgggccagtattaacattaca

SEQ ID NO: 281171 - DNA, 25 bp, Rattus norvegicus
cttgtggtatagcatgctctctgca

SEQ ID NO: 281172 - DNA, 25 bp, Rattus norvegicus
cttgtggtataggatgctctctgca

SEQ ID NO: 281173 - DNA, 25 bp, Rattus norvegicus
cttgtggtcccaatactcattttaa

SEQ ID NO: 281174 - DNA, 25 bp, Rattus norvegicus
cttgtggtcccattactcattttaa

SEQ ID NO: 281175 - DNA, 25 bp, Rattus norvegicus
cttgtggtgtgaagtttatggcctg

SEQ ID NO: 281176 - DNA, 25 bp, Rattus norvegicus
cttgtggtgtgatgtttatggcctg

SEQ ID NO: 281177 - DNA, 25 bp, Rattus norvegicus
cttgtggttcgaacatattggctgc

SEQ ID NO: 281178 - DNA, 25 bp, Rattus norvegicus
cttgtggttcgatcatattggctgc

SEQ ID NO: 281179 - DNA, 25 bp, Rattus norvegicus
cttgtgtaaatgacttccggtgtgg

SEQ ID NO: 281180 - DNA, 25 bp, Rattus norvegicus
cttgtgtaaatgtcttccggtgtgg

SEQ ID NO: 281181 - DNA, 25 bp, Rattus norvegicus
cttgtgtaaggcatccctgcacagc

SEQ ID NO: 281182 - DNA, 25 bp, Rattus norvegicus
cttgtgtaaggcttccctgcacagc

SEQ ID NO: 281183 - DNA, 25 bp, Rattus norvegicus
cttgtgtagtaaagcgcgcccttcg

SEQ ID NO: 281184 - DNA, 25 bp, Rattus norvegicus
cttgtgtagtaatgcgcgcccttcg

SEQ ID NO: 281185 - DNA, 25 bp, Rattus norvegicus
cttgtgtatatgagtgacgttccgg

SEQ ID NO: 281186 - DNA, 25 bp, Rattus norvegicus
cttgtgtatatgtgtgacgttccgg

SEQ ID NO: 281187 - DNA, 25 bp, Rattus norvegicus
cttgtgtccaacctttccttctgat

SEQ ID NO: 281188 - DNA, 25 bp, Rattus norvegicus
cttgtgtccaacgtttccttctgat

SEQ ID NO: 281189 - DNA, 25 bp, Rattus norvegicus
cttgtgtgcaccagtgacagcgagt

SEQ ID NO: 281190 - DNA, 25 bp, Rattus norvegicus
cttgtgtgcacctgtgacagcgagt

SEQ ID NO: 281191 - DNA, 25 bp, Rattus norvegicus
cttgtgtgcactagacaggcttgat

SEQ ID NO: 281192 - DNA, 25 bp, Rattus norvegicus
cttgtgtgcacttgacaggcttgat

SEQ ID NO: 281193 - DNA, 25 bp, Rattus norvegicus
cttgtgtgccaacgctccaacattg

SEQ ID NO: 281194 - DNA, 25 bp, Rattus norvegicus
cttgtgtgccaaggctccaacattg

SEQ ID NO: 281195 - DNA, 25 bp, Rattus norvegicus
cttgtgtgtgcaatactgtctgttg

SEQ ID NO: 281196 - DNA, 25 bp, Rattus norvegicus
cttgtgtgtgcattactgtctgttg

SEQ ID NO: 281197 - DNA, 25 bp, Rattus norvegicus
cttgtgttatttccatgtcccaggc

SEQ ID NO: 281198 - DNA, 25 bp, Rattus norvegicus
cttgtgttatttgcatgtcccaggc

SEQ ID NO: 281199 - DNA, 25 bp, Rattus norvegicus
cttgtgttcaaaacttagcttctga

SEQ ID NO: 281200 - DNA, 25 bp, Rattus norvegicus
cttgtgttcaaatcttagcttctga

SEQ ID NO: 281201 - DNA, 25 bp, Rattus norvegicus
cttgtgttctgtcggactagtttac

SEQ ID NO: 281202 - DNA, 25 bp, Rattus norvegicus
cttgtgttctgtgggactagtttac

SEQ ID NO: 281203 - DNA, 25 bp, Rattus norvegicus
cttgtgtttctacgtgaggagtttc

SEQ ID NO: 281204 - DNA, 25 bp, Rattus norvegicus
cttgtgtttctaggtgaggagtttc

SEQ ID NO: 281205 - DNA, 25 bp, Rattus norvegicus
cttgtgtttgtactgctgtgtccaa

SEQ ID NO: 281206 - DNA, 25 bp, Rattus norvegicus
cttgtgtttgtagtgctgtgtccaa

SEQ ID NO: 281207 - DNA, 25 bp, Rattus norvegicus
cttgtgttttgtatgctctggattc

SEQ ID NO: 281208 - DNA, 25 bp, Rattus norvegicus
cttgtgttttgtttgctctggattc

SEQ ID NO: 281209 - DNA, 25 bp, Rattus norvegicus
cttgttaaggaaccgctttaccact

SEQ ID NO: 281210 - DNA, 25 bp, Rattus norvegicus
cttgttaaggaagcgctttaccact

SEQ ID NO: 281211 - DNA, 25 bp, Rattus norvegicus
cttgttaattttaggcacttcctat

SEQ ID NO: 281212 - DNA, 25 bp, Rattus norvegicus
cttgttaatttttggcacttcctat

SEQ ID NO: 281213 - DNA, 25 bp, Rattus norvegicus
cttgttacttcccaatgctgcacat

SEQ ID NO: 281214 - DNA, 25 bp, Rattus norvegicus
cttgttacttccgaatgctgcacat

SEQ ID NO: 281215 - DNA, 25 bp, Rattus norvegicus
cttgttagggctccttgtttgttgc

SEQ ID NO: 281216 - DNA, 25 bp, Rattus norvegicus
cttgttagggctgcttgtttgttgc

SEQ ID NO: 281217 - DNA, 25 bp, Rattus norvegicus
cttgttatctacattcgatcctcag

SEQ ID NO: 281218 - DNA, 25 bp, Rattus norvegicus
cttgttatctactttcgatcctcag

SEQ ID NO: 281219 - DNA, 25 bp, Rattus norvegicus
cttgttatctgtcctgtcctttgtg

SEQ ID NO: 281220 - DNA, 25 bp, Rattus norvegicus
cttgttatctgtgctgtcctttgtg

SEQ ID NO: 281221 - DNA, 25 bp, Rattus norvegicus
cttgttcattgcacagtgtgctgta

SEQ ID NO: 281222 - DNA, 25 bp, Rattus norvegicus
cttgttcattgctcagtgtgctgta

SEQ ID NO: 281223 - DNA, 25 bp, Rattus norvegicus
cttgttcccattacagattgctgat

SEQ ID NO: 281224 - DNA, 25 bp, Rattus norvegicus
cttgttcccatttcagattgctgat

SEQ ID NO: 281225 - DNA, 25 bp, Rattus norvegicus
cttgttcctcacattgtagactcac

SEQ ID NO: 281226 - DNA, 25 bp, Rattus norvegicus
cttgttcctcactttgtagactcac

SEQ ID NO: 281227 - DNA, 25 bp, Rattus norvegicus
cttgttcggcctattctgtaattga

SEQ ID NO: 281228 - DNA, 25 bp, Rattus norvegicus
cttgttcggccttttctgtaattga

SEQ ID NO: 281229 - DNA, 25 bp, Rattus norvegicus
cttgttctaactagggcgaccctca

SEQ ID NO: 281230 - DNA, 25 bp, Rattus norvegicus
cttgttctaacttgggcgaccctca

SEQ ID NO: 281231 - DNA, 25 bp, Rattus norvegicus
cttgttctagtaaggcctgcgctaa

SEQ ID NO: 281232 - DNA, 25 bp, Rattus norvegicus
cttgttctagtatggcctgcgctaa

SEQ ID NO: 281233 - DNA, 25 bp, Rattus norvegicus
cttgttctcataatgtaggtgaatc

SEQ ID NO: 281234 - DNA, 25 bp, Rattus norvegicus
cttgttctcatattgtaggtgaatc

SEQ ID NO: 281235 - DNA, 25 bp, Rattus norvegicus
cttgttctgtagactgtgtctctct

SEQ ID NO: 281236 - DNA, 25 bp, Rattus norvegicus
cttgttctgtagtctgtgtctctct

SEQ ID NO: 281237 - DNA, 25 bp, Rattus norvegicus
cttgttcttcctctataatcttgtg

SEQ ID NO: 281238 - DNA, 25 bp, Rattus norvegicus
cttgttcttcctgtataatcttgtg

SEQ ID NO: 281239 - DNA, 25 bp, Rattus norvegicus
cttgttcttgtgcaatccacctgcc

SEQ ID NO: 281240 - DNA, 25 bp, Rattus norvegicus
cttgttcttgtggaatccacctgcc

SEQ ID NO: 281241 - DNA, 25 bp, Rattus norvegicus
cttgttctttccattagaccattct

SEQ ID NO: 281242 - DNA, 25 bp, Rattus norvegicus
cttgttctttcctttagaccattct

SEQ ID NO: 281243 - DNA, 25 bp, Rattus norvegicus
cttgttgaaagcatccaccacagaa

SEQ ID NO: 281244 - DNA, 25 bp, Rattus norvegicus
cttgttgaaagcttccaccacagaa

SEQ ID NO: 281245 - DNA, 25 bp, Rattus norvegicus
cttgttgaccaacagcactgctata

SEQ ID NO: 281246 - DNA, 25 bp, Rattus norvegicus
cttgttgaccaagagcactgctata

SEQ ID NO: 281247 - DNA, 25 bp, Rattus norvegicus
cttgttgcacttatgtacatggctg

SEQ ID NO: 281248 - DNA, 25 bp, Rattus norvegicus
cttgttgcacttttgtacatggctg

SEQ ID NO: 281249 - DNA, 25 bp, Rattus norvegicus
cttgttgccaagatcagtcctttga

SEQ ID NO: 281250 - DNA, 25 bp, Rattus norvegicus
cttgttgccaagttcagtcctttga

SEQ ID NO: 281251 - DNA, 25 bp, Rattus norvegicus
cttgttgcctctccaaagtcaggga

SEQ ID NO: 281252 - DNA, 25 bp, Rattus norvegicus
cttgttgcctctgcaaagtcaggga

SEQ ID NO: 281253 - DNA, 25 bp, Rattus norvegicus
cttgttgccttgcagttttctggat

SEQ ID NO: 281254 - DNA, 25 bp, Rattus norvegicus
cttgttgccttggagttttctggat

SEQ ID NO: 281255 - DNA, 25 bp, Rattus norvegicus
cttgttgctggcctgcgcttgtgaa

SEQ ID NO: 281256 - DNA, 25 bp, Rattus norvegicus
cttgttgctggcgtgcgcttgtgaa

SEQ ID NO: 281257 - DNA, 25 bp, Rattus norvegicus
cttgttgcttttcactgacggttga

SEQ ID NO: 281258 - DNA, 25 bp, Rattus norvegicus
cttgttgcttttgactgacggttga

SEQ ID NO: 281259 - DNA, 25 bp, Rattus norvegicus
cttgttggctggatcattaagttga

SEQ ID NO: 281260 - DNA, 25 bp, Rattus norvegicus
cttgttggctggttcattaagttga

SEQ ID NO: 281261 - DNA, 25 bp, Rattus norvegicus
cttgttgggctgaccctcagaaatg

SEQ ID NO: 281262 - DNA, 25 bp, Rattus norvegicus
cttgttgggctgtccctcagaaatg

SEQ ID NO: 281263 - DNA, 25 bp, Rattus norvegicus
cttgttggtcttctgtcagtcaggt

SEQ ID NO: 281264 - DNA, 25 bp, Rattus norvegicus
cttgttggtcttgtgtcagtcaggt

SEQ ID NO: 281265 - DNA, 25 bp, Rattus norvegicus
cttgttggttctcagggaggccttc

SEQ ID NO: 281266 - DNA, 25 bp, Rattus norvegicus
cttgttggttctgagggaggccttc

SEQ ID NO: 281267 - DNA, 25 bp, Rattus norvegicus
cttgttgtaaatccagttgtctaat

SEQ ID NO: 281268 - DNA, 25 bp, Rattus norvegicus
cttgttgtaaatgcagttgtctaat

SEQ ID NO: 281269 - DNA, 25 bp, Rattus norvegicus
cttgttgtacaacaaccaggtccaa

SEQ ID NO: 281270 - DNA, 25 bp, Rattus norvegicus
cttgttgtacaagaaccaggtccaa

SEQ ID NO: 281271 - DNA, 25 bp, Rattus norvegicus
cttgttgtccacagggctcttgagt

SEQ ID NO: 281272 - DNA, 25 bp, Rattus norvegicus
cttgttgtccactgggctcttgagt

SEQ ID NO: 281273 - DNA, 25 bp, Rattus norvegicus
cttgttgtcggtactcaccttagaa

SEQ ID NO: 281274 - DNA, 25 bp, Rattus norvegicus
cttgttgtcggttctcaccttagaa

SEQ ID NO: 281275 - DNA, 25 bp, Rattus norvegicus
cttgttgtcttgatggctttcctac

SEQ ID NO: 281276 - DNA, 25 bp, Rattus norvegicus
cttgttgtcttgttggctttcctac

SEQ ID NO: 281277 - DNA, 25 bp, Rattus norvegicus
cttgttgtggctcaggtgaccttga

SEQ ID NO: 281278 - DNA, 25 bp, Rattus norvegicus
cttgttgtggctgaggtgaccttga

SEQ ID NO: 281279 - DNA, 25 bp, Rattus norvegicus
cttgttgttctaattgtctggctgt

SEQ ID NO: 281280 - DNA, 25 bp, Rattus norvegicus
cttgttgttctatttgtctggctgt

SEQ ID NO: 281281 - DNA, 25 bp, Rattus norvegicus
cttgtttcacctcggctctgagtct

SEQ ID NO: 281282 - DNA, 25 bp, Rattus norvegicus
cttgtttcacctgggctctgagtct

SEQ ID NO: 281283 - DNA, 25 bp, Rattus norvegicus
cttgtttccactaagcatccataga

SEQ ID NO: 281284 - DNA, 25 bp, Rattus norvegicus
cttgtttccacttagcatccataga

SEQ ID NO: 281285 - DNA, 25 bp, Rattus norvegicus
cttgtttctgctaattttttctgga

SEQ ID NO: 281286 - DNA, 25 bp, Rattus norvegicus
cttgtttctgcttattttttctgga

SEQ ID NO: 281287 - DNA, 25 bp, Rattus norvegicus
cttgtttgatgcagtgtgcttcaaa

SEQ ID NO: 281288 - DNA, 25 bp, Rattus norvegicus
cttgtttgatgctgtgtgcttcaaa

SEQ ID NO: 281289 - DNA, 25 bp, Rattus norvegicus
cttgtttggattagccgtaggcctc

SEQ ID NO: 281290 - DNA, 25 bp, Rattus norvegicus
cttgtttggatttgccgtaggcctc

SEQ ID NO: 281291 - DNA, 25 bp, Rattus norvegicus
cttgtttgtcacctactgtggtgtc

SEQ ID NO: 281292 - DNA, 25 bp, Rattus norvegicus
cttgtttgtcacgtactgtggtgtc

SEQ ID NO: 281293 - DNA, 25 bp, Rattus norvegicus
cttgtttgtctacaccgtcggtaat

SEQ ID NO: 281294 - DNA, 25 bp, Rattus norvegicus
cttgtttgtctagaccgtcggtaat

SEQ ID NO: 281295 - DNA, 25 bp, Rattus norvegicus
cttgttttcactatgcacttgcaga

SEQ ID NO: 281296 - DNA, 25 bp, Rattus norvegicus
cttgttttcactttgcacttgcaga

SEQ ID NO: 281297 - DNA, 25 bp, Rattus norvegicus
cttgttttccaactagattgtgagc

SEQ ID NO: 281298 - DNA, 25 bp, Rattus norvegicus
cttgttttccaagtagattgtgagc

SEQ ID NO: 281299 - DNA, 25 bp, Rattus norvegicus
cttgttttcctccttagatgttgtt

SEQ ID NO: 281300 - DNA, 25 bp, Rattus norvegicus
cttgttttcctcgttagatgttgtt

SEQ ID NO: 281301 - DNA, 25 bp, Rattus norvegicus
cttgttttctttctgcttgcaggga

SEQ ID NO: 281302 - DNA, 25 bp, Rattus norvegicus
cttgttttctttgtgcttgcaggga

SEQ ID NO: 281303 - DNA, 25 bp, Rattus norvegicus
cttgtttttgctcggtggacctcaa

SEQ ID NO: 281304 - DNA, 25 bp, Rattus norvegicus
cttgtttttgctgggtggacctcaa

SEQ ID NO: 281305 - DNA, 25 bp, Rattus norvegicus
cttgttttttggagatatggtccta

SEQ ID NO: 281306 - DNA, 25 bp, Rattus norvegicus
cttgttttttggtgatatggtccta

SEQ ID NO: 281307 - DNA, 25 bp, Rattus norvegicus
ctttaaacagtaagcatgccgtgga

SEQ ID NO: 281308 - DNA, 25 bp, Rattus norvegicus
ctttaaacagtatgcatgccgtgga

SEQ ID NO: 281309 - DNA, 25 bp, Rattus norvegicus
ctttaaacctccatctcagggtaga

SEQ ID NO: 281310 - DNA, 25 bp, Rattus norvegicus
ctttaaacctccttctcagggtaga

SEQ ID NO: 281311 - DNA, 25 bp, Rattus norvegicus
ctttaaaccttaacaccatgctggc

SEQ ID NO: 281312 - DNA, 25 bp, Rattus norvegicus
ctttaaaccttatcaccatgctggc

SEQ ID NO: 281313 - DNA, 25 bp, Rattus norvegicus
ctttaaactatgaaactgccccgct

SEQ ID NO: 281314 - DNA, 25 bp, Rattus norvegicus
ctttaaactatgtaactgccccgct

SEQ ID NO: 281315 - DNA, 25 bp, Rattus norvegicus
ctttaaagatcgaatgtggagcccc

SEQ ID NO: 281316 - DNA, 25 bp, Rattus norvegicus
ctttaaagatcgtatgtggagcccc

SEQ ID NO: 281317 - DNA, 25 bp, Rattus norvegicus
ctttaaagcagaacggcccttcatt

SEQ ID NO: 281318 - DNA, 25 bp, Rattus norvegicus
ctttaaagcagatcggcccttcatt

SEQ ID NO: 281319 - DNA, 25 bp, Rattus norvegicus
ctttaaagggttctcgccgtgtgca

SEQ ID NO: 281320 - DNA, 25 bp, Rattus norvegicus
ctttaaagggttgtcgccgtgtgca

SEQ ID NO: 281321 - DNA, 25 bp, Rattus norvegicus
ctttaaaggtcaacctgtctctgcc

SEQ ID NO: 281322 - DNA, 25 bp, Rattus norvegicus
ctttaaaggtcatcctgtctctgcc

SEQ ID NO: 281323 - DNA, 25 bp, Rattus norvegicus
ctttaaagtacacagccttctgcct

SEQ ID NO: 281324 - DNA, 25 bp, Rattus norvegicus
ctttaaagtacagagccttctgcct

SEQ ID NO: 281325 - DNA, 25 bp, Rattus norvegicus
ctttaaatcgttacccttgacatgc

SEQ ID NO: 281326 - DNA, 25 bp, Rattus norvegicus
ctttaaatcgtttcccttgacatgc

SEQ ID NO: 281327 - DNA, 25 bp, Rattus norvegicus
ctttaacacagccattctcattgac

SEQ ID NO: 281328 - DNA, 25 bp, Rattus norvegicus
ctttaacacagcgattctcattgac

SEQ ID NO: 281329 - DNA, 25 bp, Rattus norvegicus
ctttaaccctggcactctgggaggc

SEQ ID NO: 281330 - DNA, 25 bp, Rattus norvegicus
ctttaaccctgggactctgggaggc

SEQ ID NO: 281331 - DNA, 25 bp, Rattus norvegicus
ctttaacctatccacatacacaaca

SEQ ID NO: 281332 - DNA, 25 bp, Rattus norvegicus
ctttaacctatcgacatacacaaca

SEQ ID NO: 281333 - DNA, 25 bp, Rattus norvegicus
ctttaactcctcagggtcatggtac

SEQ ID NO: 281334 - DNA, 25 bp, Rattus norvegicus
ctttaactcctctgggtcatggtac

SEQ ID NO: 281335 - DNA, 25 bp, Rattus norvegicus
ctttaactcgtcacgcagcggaaga

SEQ ID NO: 281336 - DNA, 25 bp, Rattus norvegicus
ctttaactcgtctcgcagcggaaga

SEQ ID NO: 281337 - DNA, 25 bp, Rattus norvegicus
ctttaacttacaacttcaggcctgg

SEQ ID NO: 281338 - DNA, 25 bp, Rattus norvegicus
ctttaacttacatcttcaggcctgg

SEQ ID NO: 281339 - DNA, 25 bp, Rattus norvegicus
ctttaacttcatcctcaatttccaa

SEQ ID NO: 281340 - DNA, 25 bp, Rattus norvegicus
ctttaacttcatgctcaatttccaa

SEQ ID NO: 281341 - DNA, 25 bp, Rattus norvegicus
ctttaacttgtaaccactgcactgt

SEQ ID NO: 281342 - DNA, 25 bp, Rattus norvegicus
ctttaacttgtatccactgcactgt

SEQ ID NO: 281343 - DNA, 25 bp, Rattus norvegicus
ctttaagaagccagcagattgaagt

SEQ ID NO: 281344 - DNA, 25 bp, Rattus norvegicus
ctttaagaagcctgcagattgaagt

SEQ ID NO: 281345 - DNA, 25 bp, Rattus norvegicus
ctttaagagcagaggacaggttgga

SEQ ID NO: 281346 - DNA, 25 bp, Rattus norvegicus
ctttaagagcagtggacaggttgga

SEQ ID NO: 281347 - DNA, 25 bp, Rattus norvegicus
ctttaagatgtgcattccctctctg

SEQ ID NO: 281348 - DNA, 25 bp, Rattus norvegicus
ctttaagatgtggattccctctctg

SEQ ID NO: 281349 - DNA, 25 bp, Rattus norvegicus
ctttaagctgtaaatagggcccgca

SEQ ID NO: 281350 - DNA, 25 bp, Rattus norvegicus
ctttaagctgtatatagggcccgca

SEQ ID NO: 281351 - DNA, 25 bp, Rattus norvegicus
ctttaagcttgtccgatgttaccca

SEQ ID NO: 281352 - DNA, 25 bp, Rattus norvegicus
ctttaagcttgtgcgatgttaccca

SEQ ID NO: 281353 - DNA, 25 bp, Rattus norvegicus
ctttaaggagctcggccgcatgtgc

SEQ ID NO: 281354 - DNA, 25 bp, Rattus norvegicus
ctttaaggagctgggccgcatgtgc

SEQ ID NO: 281355 - DNA, 25 bp, Rattus norvegicus
ctttaaggttctcgtgaggtcctca

SEQ ID NO: 281356 - DNA, 25 bp, Rattus norvegicus
ctttaaggttctggtgaggtcctca

SEQ ID NO: 281357 - DNA, 25 bp, Rattus norvegicus
ctttaagtcggcactggcttgggat

SEQ ID NO: 281358 - DNA, 25 bp, Rattus norvegicus
ctttaagtcggctctggcttgggat

SEQ ID NO: 281359 - DNA, 25 bp, Rattus norvegicus
ctttaagttgctcctttaggtgaac

SEQ ID NO: 281360 - DNA, 25 bp, Rattus norvegicus
ctttaagttgctgctttaggtgaac

SEQ ID NO: 281361 - DNA, 25 bp, Rattus norvegicus
ctttaatacaagagagggctccgac

SEQ ID NO: 281362 - DNA, 25 bp, Rattus norvegicus
ctttaatacaagtgagggctccgac

SEQ ID NO: 281363 - DNA, 25 bp, Rattus norvegicus
ctttaatcagggagccacggtaact

SEQ ID NO: 281364 - DNA, 25 bp, Rattus norvegicus
ctttaatcagggtgccacggtaact

SEQ ID NO: 281365 - DNA, 25 bp, Rattus norvegicus
ctttaatcccagagagtttgaggtc

SEQ ID NO: 281366 - DNA, 25 bp, Rattus norvegicus
ctttaatcccagtgagtttgaggtc

SEQ ID NO: 281367 - DNA, 25 bp, Rattus norvegicus
ctttaatctcagaaccctggatgga

SEQ ID NO: 281368 - DNA, 25 bp, Rattus norvegicus
ctttaatctcagtaccctggatgga

SEQ ID NO: 281369 - DNA, 25 bp, Rattus norvegicus
ctttaatgccaactccttatgttat

SEQ ID NO: 281370 - DNA, 25 bp, Rattus norvegicus
ctttaatgccaagtccttatgttat

SEQ ID NO: 281371 - DNA, 25 bp, Rattus norvegicus
ctttaatggtgcagtttggttttct

SEQ ID NO: 281372 - DNA, 25 bp, Rattus norvegicus
ctttaatggtgctgtttggttttct

SEQ ID NO: 281373 - DNA, 25 bp, Rattus norvegicus
ctttaatgtcagcattcaggaacaa

SEQ ID NO: 281374 - DNA, 25 bp, Rattus norvegicus
ctttaatgtcaggattcaggaacaa

SEQ ID NO: 281375 - DNA, 25 bp, Rattus norvegicus
ctttaattctagcagttggaggcaa

SEQ ID NO: 281376 - DNA, 25 bp, Rattus norvegicus
ctttaattctaggagttggaggcaa

SEQ ID NO: 281377 - DNA, 25 bp, Rattus norvegicus
ctttacaaaggcacaatggcctctt

SEQ ID NO: 281378 - DNA, 25 bp, Rattus norvegicus
ctttacaaaggctcaatggcctctt

SEQ ID NO: 281379 - DNA, 25 bp, Rattus norvegicus
ctttacaagggcaactactcggaga

SEQ ID NO: 281380 - DNA, 25 bp, Rattus norvegicus
ctttacaagggctactactcggaga

SEQ ID NO: 281381 - DNA, 25 bp, Rattus norvegicus
ctttacaatgaaaagccgggtgatg

SEQ ID NO: 281382 - DNA, 25 bp, Rattus norvegicus
ctttacaatgaatagccgggtgatg

SEQ ID NO: 281383 - DNA, 25 bp, Rattus norvegicus
ctttacacagacacaggtccacgtc

SEQ ID NO: 281384 - DNA, 25 bp, Rattus norvegicus
ctttacacagactcaggtccacgtc

SEQ ID NO: 281385 - DNA, 25 bp, Rattus norvegicus
ctttacaggctgaggacaggctgga

SEQ ID NO: 281386 - DNA, 25 bp, Rattus norvegicus
ctttacaggctgtggacaggctgga

SEQ ID NO: 281387 - DNA, 25 bp, Rattus norvegicus
ctttacagtggcaaagtgtgcataa

SEQ ID NO: 281388 - DNA, 25 bp, Rattus norvegicus
ctttacagtggctaagtgtgcataa

SEQ ID NO: 281389 - DNA, 25 bp, Rattus norvegicus
ctttacataccaccagacttttttg

SEQ ID NO: 281390 - DNA, 25 bp, Rattus norvegicus
ctttacataccagcagacttttttg

SEQ ID NO: 281391 - DNA, 25 bp, Rattus norvegicus
ctttacatacggactctgattcttt

SEQ ID NO: 281392 - DNA, 25 bp, Rattus norvegicus
ctttacatacggtctctgattcttt

SEQ ID NO: 281393 - DNA, 25 bp, Rattus norvegicus
ctttacattattattcctctccagg

SEQ ID NO: 281394 - DNA, 25 bp, Rattus norvegicus
ctttacattatttttcctctccagg

SEQ ID NO: 281395 - DNA, 25 bp, Rattus norvegicus
ctttaccatctacctctgtaggagg

SEQ ID NO: 281396 - DNA, 25 bp, Rattus norvegicus
ctttaccatctagctctgtaggagg

SEQ ID NO: 281397 - DNA, 25 bp, Rattus norvegicus
ctttacccagaaataatccagctga

SEQ ID NO: 281398 - DNA, 25 bp, Rattus norvegicus
ctttacccagaattaatccagctga

SEQ ID NO: 281399 - DNA, 25 bp, Rattus norvegicus
ctttaccctgcacccgagatttgag

SEQ ID NO: 281400 - DNA, 25 bp, Rattus norvegicus
ctttaccctgcagccgagatttgag

SEQ ID NO: 281401 - DNA, 25 bp, Rattus norvegicus
ctttacctatgaccgccggccaaag

SEQ ID NO: 281402 - DNA, 25 bp, Rattus norvegicus
ctttacctatgagcgccggccaaag

SEQ ID NO: 281403 - DNA, 25 bp, Rattus norvegicus
ctttacctccctcctatggaaaagc

SEQ ID NO: 281404 - DNA, 25 bp, Rattus norvegicus
ctttacctccctgctatggaaaagc

SEQ ID NO: 281405 - DNA, 25 bp, Rattus norvegicus
ctttacctggtgaccgtgtcaataa

SEQ ID NO: 281406 - DNA, 25 bp, Rattus norvegicus
ctttacctggtgtccgtgtcaataa

SEQ ID NO: 281407 - DNA, 25 bp, Rattus norvegicus
ctttacctttatcttcatcatctac

SEQ ID NO: 281408 - DNA, 25 bp, Rattus norvegicus
ctttacctttatgttcatcatctac

SEQ ID NO: 281409 - DNA, 25 bp, Rattus norvegicus
ctttacgattgtctgatgttgccca

SEQ ID NO: 281410 - DNA, 25 bp, Rattus norvegicus
ctttacgattgtgtgatgttgccca

SEQ ID NO: 281411 - DNA, 25 bp, Rattus norvegicus
ctttactaaattcctttcagattgt

SEQ ID NO: 281412 - DNA, 25 bp, Rattus norvegicus
ctttactaaattgctttcagattgt

SEQ ID NO: 281413 - DNA, 25 bp, Rattus norvegicus
ctttactaccttacgccttgggcag

SEQ ID NO: 281414 - DNA, 25 bp, Rattus norvegicus
ctttactacctttcgccttgggcag

SEQ ID NO: 281415 - DNA, 25 bp, Rattus norvegicus
ctttactcccatcctctggaaaggg

SEQ ID NO: 281416 - DNA, 25 bp, Rattus norvegicus
ctttactcccatgctctggaaaggg

SEQ ID NO: 281417 - DNA, 25 bp, Rattus norvegicus
ctttactctcctattttcatgctat

SEQ ID NO: 281418 - DNA, 25 bp, Rattus norvegicus
ctttactctccttttttcatgctat

SEQ ID NO: 281419 - DNA, 25 bp, Rattus norvegicus
ctttactgcaatctcactgggagat

SEQ ID NO: 281420 - DNA, 25 bp, Rattus norvegicus
ctttactgcaatgtcactgggagat

SEQ ID NO: 281421 - DNA, 25 bp, Rattus norvegicus
ctttactgtcttactcacaagttgg

SEQ ID NO: 281422 - DNA, 25 bp, Rattus norvegicus
ctttactgtctttctcacaagttgg

SEQ ID NO: 281423 - DNA, 25 bp, Rattus norvegicus
ctttactgttgcaatctctgtggag

SEQ ID NO: 281424 - DNA, 25 bp, Rattus norvegicus
ctttactgttgctatctctgtggag

SEQ ID NO: 281425 - DNA, 25 bp, Rattus norvegicus
ctttacttatctaattgttcgaggt

SEQ ID NO: 281426 - DNA, 25 bp, Rattus norvegicus
ctttacttatcttattgttcgaggt

SEQ ID NO: 281427 - DNA, 25 bp, Rattus norvegicus
ctttagactaagaactctgtgctga

SEQ ID NO: 281428 - DNA, 25 bp, Rattus norvegicus
ctttagactaagtactctgtgctga

SEQ ID NO: 281429 - DNA, 25 bp, Rattus norvegicus
ctttagatccgtctgcttggtttac

SEQ ID NO: 281430 - DNA, 25 bp, Rattus norvegicus
ctttagatccgtgtgcttggtttac

SEQ ID NO: 281431 - DNA, 25 bp, Rattus norvegicus
ctttagcaggaacacctccaggtca

SEQ ID NO: 281432 - DNA, 25 bp, Rattus norvegicus
ctttagcaggaagacctccaggtca

SEQ ID NO: 281433 - DNA, 25 bp, Rattus norvegicus
ctttagccccatcagaggtcaggag

SEQ ID NO: 281434 - DNA, 25 bp, Rattus norvegicus
ctttagccccatgagaggtcaggag

SEQ ID NO: 281435 - DNA, 25 bp, Rattus norvegicus
ctttagcctttacccagtggtgcaa

SEQ ID NO: 281436 - DNA, 25 bp, Rattus norvegicus
ctttagcctttagccagtggtgcaa

SEQ ID NO: 281437 - DNA, 25 bp, Rattus norvegicus
ctttagctcccaagactcttttgta

SEQ ID NO: 281438 - DNA, 25 bp, Rattus norvegicus
ctttagctcccatgactcttttgta

SEQ ID NO: 281439 - DNA, 25 bp, Rattus norvegicus
ctttagctctgtaggttctttgtgc

SEQ ID NO: 281440 - DNA, 25 bp, Rattus norvegicus
ctttagctctgttggttctttgtgc

SEQ ID NO: 281441 - DNA, 25 bp, Rattus norvegicus
ctttagctgctgctgtcaagggtgc

SEQ ID NO: 281442 - DNA, 25 bp, Rattus norvegicus
ctttagctgctggtgtcaagggtgc

SEQ ID NO: 281443 - DNA, 25 bp, Rattus norvegicus
ctttagctgggtcggttagcacata

SEQ ID NO: 281444 - DNA, 25 bp, Rattus norvegicus
ctttagctgggtgggttagcacata

SEQ ID NO: 281445 - DNA, 25 bp, Rattus norvegicus
ctttagcttcttcccacagtaaaat

SEQ ID NO: 281446 - DNA, 25 bp, Rattus norvegicus
ctttagcttcttgccacagtaaaat

SEQ ID NO: 281447 - DNA, 25 bp, Rattus norvegicus
ctttaggcacatacaagtcaacagt

SEQ ID NO: 281448 - DNA, 25 bp, Rattus norvegicus
ctttaggcacattcaagtcaacagt

SEQ ID NO: 281449 - DNA, 25 bp, Rattus norvegicus
ctttaggctggacacatttacatta

SEQ ID NO: 281450 - DNA, 25 bp, Rattus norvegicus
ctttaggctggagacatttacatta

SEQ ID NO: 281451 - DNA, 25 bp, Rattus norvegicus
ctttaggtatcactgtccttaccag

SEQ ID NO: 281452 - DNA, 25 bp, Rattus norvegicus
ctttaggtatcagtgtccttaccag

SEQ ID NO: 281453 - DNA, 25 bp, Rattus norvegicus
ctttaggtcatcagtattggccaac

SEQ ID NO: 281454 - DNA, 25 bp, Rattus norvegicus
ctttaggtcatctgtattggccaac

SEQ ID NO: 281455 - DNA, 25 bp, Rattus norvegicus
ctttagtaccgtcccctcaaatctg

SEQ ID NO: 281456 - DNA, 25 bp, Rattus norvegicus
ctttagtaccgtgccctcaaatctg

SEQ ID NO: 281457 - DNA, 25 bp, Rattus norvegicus
ctttagtcctacacagtttcacaga

SEQ ID NO: 281458 - DNA, 25 bp, Rattus norvegicus
ctttagtcctactcagtttcacaga

SEQ ID NO: 281459 - DNA, 25 bp, Rattus norvegicus
ctttagtcggcacaggtctttctgc

SEQ ID NO: 281460 - DNA, 25 bp, Rattus norvegicus
ctttagtcggcagaggtctttctgc

SEQ ID NO: 281461 - DNA, 25 bp, Rattus norvegicus
ctttagtcttttcagttgaggtcct

SEQ ID NO: 281462 - DNA, 25 bp, Rattus norvegicus
ctttagtcttttgagttgaggtcct

SEQ ID NO: 281463 - DNA, 25 bp, Rattus norvegicus
ctttagtgatttagagaacgttcca

SEQ ID NO: 281464 - DNA, 25 bp, Rattus norvegicus
ctttagtgattttgagaacgttcca

SEQ ID NO: 281465 - DNA, 25 bp, Rattus norvegicus
ctttagtgccctcgatggatggtca

SEQ ID NO: 281466 - DNA, 25 bp, Rattus norvegicus
ctttagtgccctggatggatggtca

SEQ ID NO: 281467 - DNA, 25 bp, Rattus norvegicus
ctttagttccctcctcagatgtgac

SEQ ID NO: 281468 - DNA, 25 bp, Rattus norvegicus
ctttagttccctgctcagatgtgac

SEQ ID NO: 281469 - DNA, 25 bp, Rattus norvegicus
ctttagttccttccattgccattca

SEQ ID NO: 281470 - DNA, 25 bp, Rattus norvegicus
ctttagttccttgcattgccattca

SEQ ID NO: 281471 - DNA, 25 bp, Rattus norvegicus
ctttataaacttaccagatggctgg

SEQ ID NO: 281472 - DNA, 25 bp, Rattus norvegicus
ctttataaactttccagatggctgg

SEQ ID NO: 281473 - DNA, 25 bp, Rattus norvegicus
ctttataccaggctctaatgctaga

SEQ ID NO: 281474 - DNA, 25 bp, Rattus norvegicus
ctttataccagggtctaatgctaga

SEQ ID NO: 281475 - DNA, 25 bp, Rattus norvegicus
ctttatactgctaaatagggcccaa

SEQ ID NO: 281476 - DNA, 25 bp, Rattus norvegicus
ctttatactgcttaatagggcccaa

SEQ ID NO: 281477 - DNA, 25 bp, Rattus norvegicus
ctttatagagatcctgtgcccacag

SEQ ID NO: 281478 - DNA, 25 bp, Rattus norvegicus
ctttatagagatgctgtgcccacag

SEQ ID NO: 281479 - DNA, 25 bp, Rattus norvegicus
ctttataggttcagctcttactcac

SEQ ID NO: 281480 - DNA, 25 bp, Rattus norvegicus
ctttataggttctgctcttactcac

SEQ ID NO: 281481 - DNA, 25 bp, Rattus norvegicus
ctttatcaaatgacagtgctaggga

SEQ ID NO: 281482 - DNA, 25 bp, Rattus norvegicus
ctttatcaaatgtcagtgctaggga

SEQ ID NO: 281483 - DNA, 25 bp, Rattus norvegicus
ctttatcagagaattggcagtccca

SEQ ID NO: 281484 - DNA, 25 bp, Rattus norvegicus
ctttatcagagatttggcagtccca

SEQ ID NO: 281485 - DNA, 25 bp, Rattus norvegicus
ctttatcatggaagcttaaatggat

SEQ ID NO: 281486 - DNA, 25 bp, Rattus norvegicus
ctttatcatggatgcttaaatggat

SEQ ID NO: 281487 - DNA, 25 bp, Rattus norvegicus
ctttatccaaggctgtgaattgcct

SEQ ID NO: 281488 - DNA, 25 bp, Rattus norvegicus
ctttatccaagggtgtgaattgcct

SEQ ID NO: 281489 - DNA, 25 bp, Rattus norvegicus
ctttatctccaccatcggaattgat

SEQ ID NO: 281490 - DNA, 25 bp, Rattus norvegicus
ctttatctccacgatcggaattgat

SEQ ID NO: 281491 - DNA, 25 bp, Rattus norvegicus
ctttatgaacggagggcttggagcc

SEQ ID NO: 281492 - DNA, 25 bp, Rattus norvegicus
ctttatgaacggtgggcttggagcc

SEQ ID NO: 281493 - DNA, 25 bp, Rattus norvegicus
ctttatgactaactcggtgcctgga

SEQ ID NO: 281494 - DNA, 25 bp, Rattus norvegicus
ctttatgactaagtcggtgcctgga

SEQ ID NO: 281495 - DNA, 25 bp, Rattus norvegicus
ctttatgagaccacaacggccagct

SEQ ID NO: 281496 - DNA, 25 bp, Rattus norvegicus
ctttatgagacctcaacggccagct

SEQ ID NO: 281497 - DNA, 25 bp, Rattus norvegicus
ctttatgagtacctgtgccgggtgc

SEQ ID NO: 281498 - DNA, 25 bp, Rattus norvegicus
ctttatgagtacgtgtgccgggtgc

SEQ ID NO: 281499 - DNA, 25 bp, Rattus norvegicus
ctttatgctgttagtcttatgtctt

SEQ ID NO: 281500 - DNA, 25 bp, Rattus norvegicus
ctttatgctgtttgtcttatgtctt

SEQ ID NO: 281501 - DNA, 25 bp, Rattus norvegicus
ctttatggaccgagatttcttgcaa

SEQ ID NO: 281502 - DNA, 25 bp, Rattus norvegicus
ctttatggaccgtgatttcttgcaa

SEQ ID NO: 281503 - DNA, 25 bp, Rattus norvegicus
ctttatgtcagtattgtcctctttg

SEQ ID NO: 281504 - DNA, 25 bp, Rattus norvegicus
ctttatgtcagttttgtcctctttg

SEQ ID NO: 281505 - DNA, 25 bp, Rattus norvegicus
ctttatgtctggcttttgccatcaa

SEQ ID NO: 281506 - DNA, 25 bp, Rattus norvegicus
ctttatgtctgggttttgccatcaa

SEQ ID NO: 281507 - DNA, 25 bp, Rattus norvegicus
ctttattaaacgcaacactccactc

SEQ ID NO: 281508 - DNA, 25 bp, Rattus norvegicus
ctttattaaacggaacactccactc

SEQ ID NO: 281509 - DNA, 25 bp, Rattus norvegicus
ctttattactttactgagacgctga

SEQ ID NO: 281510 - DNA, 25 bp, Rattus norvegicus
ctttattacttttctgagacgctga

SEQ ID NO: 281511 - DNA, 25 bp, Rattus norvegicus
ctttattcctctctggaccaggatg

SEQ ID NO: 281512 - DNA, 25 bp, Rattus norvegicus
ctttattcctctgtggaccaggatg

SEQ ID NO: 281513 - DNA, 25 bp, Rattus norvegicus
ctttattctcgaagatgctgctgca

SEQ ID NO: 281514 - DNA, 25 bp, Rattus norvegicus
ctttattctcgatgatgctgctgca

SEQ ID NO: 281515 - DNA, 25 bp, Rattus norvegicus
ctttattgacctaggagggcaacgg

SEQ ID NO: 281516 - DNA, 25 bp, Rattus norvegicus
ctttattgaccttggagggcaacgg

SEQ ID NO: 281517 - DNA, 25 bp, Rattus norvegicus
ctttatttatgcagtttgtcctgta

SEQ ID NO: 281518 - DNA, 25 bp, Rattus norvegicus
ctttatttatgctgtttgtcctgta

SEQ ID NO: 281519 - DNA, 25 bp, Rattus norvegicus
ctttatttatttcagctgcagtggt

SEQ ID NO: 281520 - DNA, 25 bp, Rattus norvegicus
ctttatttatttgagctgcagtggt

SEQ ID NO: 281521 - DNA, 25 bp, Rattus norvegicus
ctttatttgttacgcaagcgtgagc

SEQ ID NO: 281522 - DNA, 25 bp, Rattus norvegicus
ctttatttgttaggcaagcgtgagc

SEQ ID NO: 281523 - DNA, 25 bp, Rattus norvegicus
ctttattttcccactactgtcaatg

SEQ ID NO: 281524 - DNA, 25 bp, Rattus norvegicus
ctttattttccctctactgtcaatg

SEQ ID NO: 281525 - DNA, 25 bp, Rattus norvegicus
ctttattttctcagtaacttatact

SEQ ID NO: 281526 - DNA, 25 bp, Rattus norvegicus
ctttattttctctgtaacttatact

SEQ ID NO: 281527 - DNA, 25 bp, Rattus norvegicus
ctttcaaatgttcgccagcaccttt

SEQ ID NO: 281528 - DNA, 25 bp, Rattus norvegicus
ctttcaaatgttggccagcaccttt

SEQ ID NO: 281529 - DNA, 25 bp, Rattus norvegicus
ctttcaagcgccagtctgtggtctt

SEQ ID NO: 281530 - DNA, 25 bp, Rattus norvegicus
ctttcaagcgcctgtctgtggtctt

SEQ ID NO: 281531 - DNA, 25 bp, Rattus norvegicus
ctttcaataaccactctctgcttat

SEQ ID NO: 281532 - DNA, 25 bp, Rattus norvegicus
ctttcaataacctctctctgcttat

SEQ ID NO: 281533 - DNA, 25 bp, Rattus norvegicus
ctttcaatatgaagtggattacctg

SEQ ID NO: 281534 - DNA, 25 bp, Rattus norvegicus
ctttcaatatgatgtggattacctg

SEQ ID NO: 281535 - DNA, 25 bp, Rattus norvegicus
ctttcaatctctatccatggtccaa

SEQ ID NO: 281536 - DNA, 25 bp, Rattus norvegicus
ctttcaatctctttccatggtccaa

SEQ ID NO: 281537 - DNA, 25 bp, Rattus norvegicus
ctttcaatttttacatgtacggcat

SEQ ID NO: 281538 - DNA, 25 bp, Rattus norvegicus
ctttcaattttttcatgtacggcat

SEQ ID NO: 281539 - DNA, 25 bp, Rattus norvegicus
ctttcacactggagagaggtcttat

SEQ ID NO: 281540 - DNA, 25 bp, Rattus norvegicus
ctttcacactggtgagaggtcttat

SEQ ID NO: 281541 - DNA, 25 bp, Rattus norvegicus
ctttcaccttacatgctcacaaaat

SEQ ID NO: 281542 - DNA, 25 bp, Rattus norvegicus
ctttcaccttacttgctcacaaaat

SEQ ID NO: 281543 - DNA, 25 bp, Rattus norvegicus
ctttcacgacagcattccagagttg

SEQ ID NO: 281544 - DNA, 25 bp, Rattus norvegicus
ctttcacgacaggattccagagttg

SEQ ID NO: 281545 - DNA, 25 bp, Rattus norvegicus
ctttcacgctcacggataccaagaa

SEQ ID NO: 281546 - DNA, 25 bp, Rattus norvegicus
ctttcacgctcagggataccaagaa

SEQ ID NO: 281547 - DNA, 25 bp, Rattus norvegicus
ctttcacgtgggacagaggcttgca

SEQ ID NO: 281548 - DNA, 25 bp, Rattus norvegicus
ctttcacgtgggtcagaggcttgca

SEQ ID NO: 281549 - DNA, 25 bp, Rattus norvegicus
ctttcactccagagtgccgtagagt

SEQ ID NO: 281550 - DNA, 25 bp, Rattus norvegicus
ctttcactccagtgtgccgtagagt

SEQ ID NO: 281551 - DNA, 25 bp, Rattus norvegicus
ctttcactgacaaaactctcgcaaa

SEQ ID NO: 281552 - DNA, 25 bp, Rattus norvegicus
ctttcactgacataactctcgcaaa

SEQ ID NO: 281553 - DNA, 25 bp, Rattus norvegicus
ctttcactgatgatttatgggctta

SEQ ID NO: 281554 - DNA, 25 bp, Rattus norvegicus
ctttcactgatgttttatgggctta

SEQ ID NO: 281555 - DNA, 25 bp, Rattus norvegicus
ctttcactgtcaccagcgcggatga

SEQ ID NO: 281556 - DNA, 25 bp, Rattus norvegicus
ctttcactgtcagcagcgcggatga

SEQ ID NO: 281557 - DNA, 25 bp, Rattus norvegicus
ctttcactgtctccatacgatggat

SEQ ID NO: 281558 - DNA, 25 bp, Rattus norvegicus
ctttcactgtctgcatacgatggat

SEQ ID NO: 281559 - DNA, 25 bp, Rattus norvegicus
ctttcacttccacaccaaacataga

SEQ ID NO: 281560 - DNA, 25 bp, Rattus norvegicus
ctttcacttccagaccaaacataga

SEQ ID NO: 281561 - DNA, 25 bp, Rattus norvegicus
ctttcactttcgaatgcactactgt

SEQ ID NO: 281562 - DNA, 25 bp, Rattus norvegicus
ctttcactttcgtatgcactactgt

SEQ ID NO: 281563 - DNA, 25 bp, Rattus norvegicus
ctttcagaacatccccatggtgctt

SEQ ID NO: 281564 - DNA, 25 bp, Rattus norvegicus
ctttcagaacatgcccatggtgctt

SEQ ID NO: 281565 - DNA, 25 bp, Rattus norvegicus
ctttcagaactcacccaaggacagt

SEQ ID NO: 281566 - DNA, 25 bp, Rattus norvegicus
ctttcagaactctcccaaggacagt

SEQ ID NO: 281567 - DNA, 25 bp, Rattus norvegicus
ctttcagacctgatgatgatggtat

SEQ ID NO: 281568 - DNA, 25 bp, Rattus norvegicus
ctttcagacctgttgatgatggtat

SEQ ID NO: 281569 - DNA, 25 bp, Rattus norvegicus
ctttcagagcagagtgtgctgggca

SEQ ID NO: 281570 - DNA, 25 bp, Rattus norvegicus
ctttcagagcagtgtgtgctgggca

SEQ ID NO: 281571 - DNA, 25 bp, Rattus norvegicus
ctttcagagcctcaggaagcttgga

SEQ ID NO: 281572 - DNA, 25 bp, Rattus norvegicus
ctttcagagcctgaggaagcttgga

SEQ ID NO: 281573 - DNA, 25 bp, Rattus norvegicus
ctttcagatattactatctcactga

SEQ ID NO: 281574 - DNA, 25 bp, Rattus norvegicus
ctttcagatatttctatctcactga

SEQ ID NO: 281575 - DNA, 25 bp, Rattus norvegicus
ctttcagccccaattatacactttt

SEQ ID NO: 281576 - DNA, 25 bp, Rattus norvegicus
ctttcagccccatttatacactttt

SEQ ID NO: 281577 - DNA, 25 bp, Rattus norvegicus
ctttcaggccatcgatccggaggag

SEQ ID NO: 281578 - DNA, 25 bp, Rattus norvegicus
ctttcaggccatggatccggaggag

SEQ ID NO: 281579 - DNA, 25 bp, Rattus norvegicus
ctttcaggcctgactgggtacaatt

SEQ ID NO: 281580 - DNA, 25 bp, Rattus norvegicus
ctttcaggcctgtctgggtacaatt

SEQ ID NO: 281581 - DNA, 25 bp, Rattus norvegicus
ctttcagtcaaaaagtctgttgcac

SEQ ID NO: 281582 - DNA, 25 bp, Rattus norvegicus
ctttcagtcaaatagtctgttgcac

SEQ ID NO: 281583 - DNA, 25 bp, Rattus norvegicus
ctttcagtgggacagcctacagtga

SEQ ID NO: 281584 - DNA, 25 bp, Rattus norvegicus
ctttcagtgggagagcctacagtga

SEQ ID NO: 281585 - DNA, 25 bp, Rattus norvegicus
ctttcagttcagagaggcagtctat

SEQ ID NO: 281586 - DNA, 25 bp, Rattus norvegicus
ctttcagttcagtgaggcagtctat

SEQ ID NO: 281587 - DNA, 25 bp, Rattus norvegicus
ctttcatagcttacctactgttcta

SEQ ID NO: 281588 - DNA, 25 bp, Rattus norvegicus
ctttcatagctttcctactgttcta

SEQ ID NO: 281589 - DNA, 25 bp, Rattus norvegicus
ctttcatcgcgacccggtggccagg

SEQ ID NO: 281590 - DNA, 25 bp, Rattus norvegicus
ctttcatcgcgagccggtggccagg

SEQ ID NO: 281591 - DNA, 25 bp, Rattus norvegicus
ctttcatcttaacacaagtgcgtga

SEQ ID NO: 281592 - DNA, 25 bp, Rattus norvegicus
ctttcatcttaagacaagtgcgtga

SEQ ID NO: 281593 - DNA, 25 bp, Rattus norvegicus
ctttcatgagaaacggcactactgg

SEQ ID NO: 281594 - DNA, 25 bp, Rattus norvegicus
ctttcatgagaatcggcactactgg

SEQ ID NO: 281595 - DNA, 25 bp, Rattus norvegicus
ctttcattccacctcaggattcata

SEQ ID NO: 281596 - DNA, 25 bp, Rattus norvegicus
ctttcattccacgtcaggattcata

SEQ ID NO: 281597 - DNA, 25 bp, Rattus norvegicus
ctttcattccataagtgtcctcatc

SEQ ID NO: 281598 - DNA, 25 bp, Rattus norvegicus
ctttcattccattagtgtcctcatc

SEQ ID NO: 281599 - DNA, 25 bp, Rattus norvegicus
ctttcattccgcctgattggattgt

SEQ ID NO: 281600 - DNA, 25 bp, Rattus norvegicus
ctttcattccgcgtgattggattgt

SEQ ID NO: 281601 - DNA, 25 bp, Rattus norvegicus
ctttcatttacactgggagctcttc

SEQ ID NO: 281602 - DNA, 25 bp, Rattus norvegicus
ctttcatttacagtgggagctcttc

SEQ ID NO: 281603 - DNA, 25 bp, Rattus norvegicus
ctttccaaaggtaatgacagtcaca

SEQ ID NO: 281604 - DNA, 25 bp, Rattus norvegicus
ctttccaaaggttatgacagtcaca

SEQ ID NO: 281605 - DNA, 25 bp, Rattus norvegicus
ctttccaacactaatcaagcctctg

SEQ ID NO: 281606 - DNA, 25 bp, Rattus norvegicus
ctttccaacacttatcaagcctctg

SEQ ID NO: 281607 - DNA, 25 bp, Rattus norvegicus
ctttccaacgttatccctgtagaga

SEQ ID NO: 281608 - DNA, 25 bp, Rattus norvegicus
ctttccaacgttttccctgtagaga

SEQ ID NO: 281609 - DNA, 25 bp, Rattus norvegicus
ctttccaactgtaggagcgggttca

SEQ ID NO: 281610 - DNA, 25 bp, Rattus norvegicus
ctttccaactgttggagcgggttca

SEQ ID NO: 281611 - DNA, 25 bp, Rattus norvegicus
ctttccacccagagaggagggccat

SEQ ID NO: 281612 - DNA, 25 bp, Rattus norvegicus
ctttccacccagtgaggagggccat

SEQ ID NO: 281613 - DNA, 25 bp, Rattus norvegicus
ctttccacctaaagggcagccatta

SEQ ID NO: 281614 - DNA, 25 bp, Rattus norvegicus
ctttccacctaatgggcagccatta

SEQ ID NO: 281615 - DNA, 25 bp, Rattus norvegicus
ctttccagagtccaagccggttttg

SEQ ID NO: 281616 - DNA, 25 bp, Rattus norvegicus
ctttccagagtcgaagccggttttg

SEQ ID NO: 281617 - DNA, 25 bp, Rattus norvegicus
ctttccagattgacaaggtatccat

SEQ ID NO: 281618 - DNA, 25 bp, Rattus norvegicus
ctttccagattgtcaaggtatccat

SEQ ID NO: 281619 - DNA, 25 bp, Rattus norvegicus
ctttccaggcatccgcacatagaga

SEQ ID NO: 281620 - DNA, 25 bp, Rattus norvegicus
ctttccaggcatgcgcacatagaga

SEQ ID NO: 281621 - DNA, 25 bp, Rattus norvegicus
ctttccaggctcacttctaagattt

SEQ ID NO: 281622 - DNA, 25 bp, Rattus norvegicus
ctttccaggctctcttctaagattt

SEQ ID NO: 281623 - DNA, 25 bp, Rattus norvegicus
ctttccagggacacctagattttag

SEQ ID NO: 281624 - DNA, 25 bp, Rattus norvegicus
ctttccagggactcctagattttag

SEQ ID NO: 281625 - DNA, 25 bp, Rattus norvegicus
ctttccagtatcatgtaacttctga

SEQ ID NO: 281626 - DNA, 25 bp, Rattus norvegicus
ctttccagtatcttgtaacttctga

SEQ ID NO: 281627 - DNA, 25 bp, Rattus norvegicus
ctttccagttgtaaccttgcagtga

SEQ ID NO: 281628 - DNA, 25 bp, Rattus norvegicus
ctttccagttgttaccttgcagtga

SEQ ID NO: 281629 - DNA, 25 bp, Rattus norvegicus
ctttccatccctatatgactgagac

SEQ ID NO: 281630 - DNA, 25 bp, Rattus norvegicus
ctttccatccctttatgactgagac

SEQ ID NO: 281631 - DNA, 25 bp, Rattus norvegicus
ctttccatcctcattaatctcagtg

SEQ ID NO: 281632 - DNA, 25 bp, Rattus norvegicus
ctttccatcctctttaatctcagtg

SEQ ID NO: 281633 - DNA, 25 bp, Rattus norvegicus
ctttccatctgtcgctgggcagagc

SEQ ID NO: 281634 - DNA, 25 bp, Rattus norvegicus
ctttccatctgtggctgggcagagc

SEQ ID NO: 281635 - DNA, 25 bp, Rattus norvegicus
ctttccatgagtcagctgtttccta

SEQ ID NO: 281636 - DNA, 25 bp, Rattus norvegicus
ctttccatgagtgagctgtttccta

SEQ ID NO: 281637 - DNA, 25 bp, Rattus norvegicus
ctttccatgtcaaccgtatcaacaa

SEQ ID NO: 281638 - DNA, 25 bp, Rattus norvegicus
ctttccatgtcatccgtatcaacaa

SEQ ID NO: 281639 - DNA, 25 bp, Rattus norvegicus
ctttccatttttcctctcttgagat

SEQ ID NO: 281640 - DNA, 25 bp, Rattus norvegicus
ctttccatttttgctctcttgagat

SEQ ID NO: 281641 - DNA, 25 bp, Rattus norvegicus
ctttcccaaattcttctgcacttac

SEQ ID NO: 281642 - DNA, 25 bp, Rattus norvegicus
ctttcccaaattgttctgcacttac

SEQ ID NO: 281643 - DNA, 25 bp, Rattus norvegicus
ctttcccaactactgagtgctctaa

SEQ ID NO: 281644 - DNA, 25 bp, Rattus norvegicus
ctttcccaactagtgagtgctctaa

SEQ ID NO: 281645 - DNA, 25 bp, Rattus norvegicus
ctttcccaagcacgctttcgagtaa

SEQ ID NO: 281646 - DNA, 25 bp, Rattus norvegicus
ctttcccaagcaggctttcgagtaa

SEQ ID NO: 281647 - DNA, 25 bp, Rattus norvegicus
ctttcccactaccaattgcaacaag

SEQ ID NO: 281648 - DNA, 25 bp, Rattus norvegicus
ctttcccactacgaattgcaacaag

SEQ ID NO: 281649 - DNA, 25 bp, Rattus norvegicus
ctttcccactcactggattcaatta

SEQ ID NO: 281650 - DNA, 25 bp, Rattus norvegicus
ctttcccactcagtggattcaatta

SEQ ID NO: 281651 - DNA, 25 bp, Rattus norvegicus
ctttcccactgactgtgaatgtcgt

SEQ ID NO: 281652 - DNA, 25 bp, Rattus norvegicus
ctttcccactgagtgtgaatgtcgt

SEQ ID NO: 281653 - DNA, 25 bp, Rattus norvegicus
ctttcccagcatcgcaaggttgtgt

SEQ ID NO: 281654 - DNA, 25 bp, Rattus norvegicus
ctttcccagcatggcaaggttgtgt

SEQ ID NO: 281655 - DNA, 25 bp, Rattus norvegicus
ctttcccagtcaatccagtctgaaa

SEQ ID NO: 281656 - DNA, 25 bp, Rattus norvegicus
ctttcccagtcattccagtctgaaa

SEQ ID NO: 281657 - DNA, 25 bp, Rattus norvegicus
ctttcccatgataatctccagttct

SEQ ID NO: 281658 - DNA, 25 bp, Rattus norvegicus
ctttcccatgattatctccagttct

SEQ ID NO: 281659 - DNA, 25 bp, Rattus norvegicus
ctttccccaaggacatagcttagaa

SEQ ID NO: 281660 - DNA, 25 bp, Rattus norvegicus
ctttccccaaggtcatagcttagaa

SEQ ID NO: 281661 - DNA, 25 bp, Rattus norvegicus
ctttccccaccaacaataagcagta

SEQ ID NO: 281662 - DNA, 25 bp, Rattus norvegicus
ctttccccaccatcaataagcagta

SEQ ID NO: 281663 - DNA, 25 bp, Rattus norvegicus
ctttccccatgaaccttagagctgg

SEQ ID NO: 281664 - DNA, 25 bp, Rattus norvegicus
ctttccccatgatccttagagctgg

SEQ ID NO: 281665 - DNA, 25 bp, Rattus norvegicus
ctttcccctgccactaataaaatgt

SEQ ID NO: 281666 - DNA, 25 bp, Rattus norvegicus
ctttcccctgcctctaataaaatgt

SEQ ID NO: 281667 - DNA, 25 bp, Rattus norvegicus
ctttcccgactgagccatatattat

SEQ ID NO: 281668 - DNA, 25 bp, Rattus norvegicus
ctttcccgactgtgccatatattat

SEQ ID NO: 281669 - DNA, 25 bp, Rattus norvegicus
ctttcccgtgctatagaacaatgaa

SEQ ID NO: 281670 - DNA, 25 bp, Rattus norvegicus
ctttcccgtgctttagaacaatgaa

SEQ ID NO: 281671 - DNA, 25 bp, Rattus norvegicus
ctttcccgtgtcaaagatgtcggac

SEQ ID NO: 281672 - DNA, 25 bp, Rattus norvegicus
ctttcccgtgtctaagatgtcggac

SEQ ID NO: 281673 - DNA, 25 bp, Rattus norvegicus
ctttccctaaatatcagtctcctga

SEQ ID NO: 281674 - DNA, 25 bp, Rattus norvegicus
ctttccctaaatttcagtctcctga

SEQ ID NO: 281675 - DNA, 25 bp, Rattus norvegicus
ctttccctataacggcatgtccagc

SEQ ID NO: 281676 - DNA, 25 bp, Rattus norvegicus
ctttccctataagggcatgtccagc

SEQ ID NO: 281677 - DNA, 25 bp, Rattus norvegicus
ctttccctcaggactgacaggtaga

SEQ ID NO: 281678 - DNA, 25 bp, Rattus norvegicus
ctttccctcaggtctgacaggtaga

SEQ ID NO: 281679 - DNA, 25 bp, Rattus norvegicus
ctttccctctggactcaataaaatg

SEQ ID NO: 281680 - DNA, 25 bp, Rattus norvegicus
ctttccctctggtctcaataaaatg

SEQ ID NO: 281681 - DNA, 25 bp, Rattus norvegicus
ctttccctgccaacaactaagagag

SEQ ID NO: 281682 - DNA, 25 bp, Rattus norvegicus
ctttccctgccatcaactaagagag

SEQ ID NO: 281683 - DNA, 25 bp, Rattus norvegicus
ctttccctgctgctagccgagagag

SEQ ID NO: 281684 - DNA, 25 bp, Rattus norvegicus
ctttccctgctggtagccgagagag

SEQ ID NO: 281685 - DNA, 25 bp, Rattus norvegicus
ctttccctggctagttctgttttct

SEQ ID NO: 281686 - DNA, 25 bp, Rattus norvegicus
ctttccctggcttgttctgttttct

SEQ ID NO: 281687 - DNA, 25 bp, Rattus norvegicus
ctttcccttgtaaaaagtgtggcag

SEQ ID NO: 281688 - DNA, 25 bp, Rattus norvegicus
ctttcccttgtataaagtgtggcag

SEQ ID NO: 281689 - DNA, 25 bp, Rattus norvegicus
ctttcccttgtcatctgcacagaaa

SEQ ID NO: 281690 - DNA, 25 bp, Rattus norvegicus
ctttcccttgtcttctgcacagaaa

SEQ ID NO: 281691 - DNA, 25 bp, Rattus norvegicus
ctttccctttagatgttcgatgcat

SEQ ID NO: 281692 - DNA, 25 bp, Rattus norvegicus
ctttccctttagttgttcgatgcat

SEQ ID NO: 281693 - DNA, 25 bp, Rattus norvegicus
ctttccctttatatatgtctctgag

SEQ ID NO: 281694 - DNA, 25 bp, Rattus norvegicus
ctttccctttatttatgtctctgag

SEQ ID NO: 281695 - DNA, 25 bp, Rattus norvegicus
ctttccgagggcatttgtgttctgt

SEQ ID NO: 281696 - DNA, 25 bp, Rattus norvegicus
ctttccgagggcttttgtgttctgt

SEQ ID NO: 281697 - DNA, 25 bp, Rattus norvegicus
ctttccgcaggaattgccgtctgta

SEQ ID NO: 281698 - DNA, 25 bp, Rattus norvegicus
ctttccgcaggatttgccgtctgta

SEQ ID NO: 281699 - DNA, 25 bp, Rattus norvegicus
ctttccggacgcacaagatgtcgaa

SEQ ID NO: 281700 - DNA, 25 bp, Rattus norvegicus
ctttccggacgctcaagatgtcgaa

SEQ ID NO: 281701 - DNA, 25 bp, Rattus norvegicus
ctttccggagctccggaggcacgaa

SEQ ID NO: 281702 - DNA, 25 bp, Rattus norvegicus
ctttccggagctgcggaggcacgaa

SEQ ID NO: 281703 - DNA, 25 bp, Rattus norvegicus
ctttccgtatagatgggcttctgta

SEQ ID NO: 281704 - DNA, 25 bp, Rattus norvegicus
ctttccgtatagttgggcttctgta

SEQ ID NO: 281705 - DNA, 25 bp, Rattus norvegicus
ctttccgtcctaccttttgtgtggc

SEQ ID NO: 281706 - DNA, 25 bp, Rattus norvegicus
ctttccgtcctagcttttgtgtggc

SEQ ID NO: 281707 - DNA, 25 bp, Rattus norvegicus
ctttcctaaccaattatcaacgctg

SEQ ID NO: 281708 - DNA, 25 bp, Rattus norvegicus
ctttcctaaccatttatcaacgctg

SEQ ID NO: 281709 - DNA, 25 bp, Rattus norvegicus
ctttcctatctgacacctcaagaaa

SEQ ID NO: 281710 - DNA, 25 bp, Rattus norvegicus
ctttcctatctgtcacctcaagaaa

SEQ ID NO: 281711 - DNA, 25 bp, Rattus norvegicus
ctttcctatttccaccatattactt

SEQ ID NO: 281712 - DNA, 25 bp, Rattus norvegicus
ctttcctatttcgaccatattactt

SEQ ID NO: 281713 - DNA, 25 bp, Rattus norvegicus
ctttcctcaggaaatgaatcacagg

SEQ ID NO: 281714 - DNA, 25 bp, Rattus norvegicus
ctttcctcaggatatgaatcacagg

SEQ ID NO: 281715 - DNA, 25 bp, Rattus norvegicus
ctttcctcatgcagcaggctaggca

SEQ ID NO: 281716 - DNA, 25 bp, Rattus norvegicus
ctttcctcatgctgcaggctaggca

SEQ ID NO: 281717 - DNA, 25 bp, Rattus norvegicus
ctttcctccagcaacgaatacatga

SEQ ID NO: 281718 - DNA, 25 bp, Rattus norvegicus
ctttcctccagctacgaatacatga

SEQ ID NO: 281719 - DNA, 25 bp, Rattus norvegicus
ctttcctccatcctgtatactaaat

SEQ ID NO: 281720 - DNA, 25 bp, Rattus norvegicus
ctttcctccatcgtgtatactaaat

SEQ ID NO: 281721 - DNA, 25 bp, Rattus norvegicus
ctttcctccccaagatctgatggaa

SEQ ID NO: 281722 - DNA, 25 bp, Rattus norvegicus
ctttcctccccatgatctgatggaa

SEQ ID NO: 281723 - DNA, 25 bp, Rattus norvegicus
ctttcctccttccagttagtgtgta

SEQ ID NO: 281724 - DNA, 25 bp, Rattus norvegicus
ctttcctccttcgagttagtgtgta

SEQ ID NO: 281725 - DNA, 25 bp, Rattus norvegicus
ctttcctcctttctgatggcagcaa

SEQ ID NO: 281726 - DNA, 25 bp, Rattus norvegicus
ctttcctcctttgtgatggcagcaa

SEQ ID NO: 281727 - DNA, 25 bp, Rattus norvegicus
ctttcctcgatgctagttgtctgta

SEQ ID NO: 281728 - DNA, 25 bp, Rattus norvegicus
ctttcctcgatggtagttgtctgta

SEQ ID NO: 281729 - DNA, 25 bp, Rattus norvegicus
ctttcctcgccccaactaaagatga

SEQ ID NO: 281730 - DNA, 25 bp, Rattus norvegicus
ctttcctcgcccgaactaaagatga

SEQ ID NO: 281731 - DNA, 25 bp, Rattus norvegicus
ctttcctctcagattacatctctta

SEQ ID NO: 281732 - DNA, 25 bp, Rattus norvegicus
ctttcctctcagtttacatctctta

SEQ ID NO: 281733 - DNA, 25 bp, Rattus norvegicus
ctttcctctgatatttatatgctgc

SEQ ID NO: 281734 - DNA, 25 bp, Rattus norvegicus
ctttcctctgatttttatatgctgc

SEQ ID NO: 281735 - DNA, 25 bp, Rattus norvegicus
ctttcctgaaagattttgtgctgtc

SEQ ID NO: 281736 - DNA, 25 bp, Rattus norvegicus
ctttcctgaaagtttttgtgctgtc

SEQ ID NO: 281737 - DNA, 25 bp, Rattus norvegicus
ctttcctgctttcgtgtcagattta

SEQ ID NO: 281738 - DNA, 25 bp, Rattus norvegicus
ctttcctgctttggtgtcagattta

SEQ ID NO: 281739 - DNA, 25 bp, Rattus norvegicus
ctttcctggcacattctatatctag

SEQ ID NO: 281740 - DNA, 25 bp, Rattus norvegicus
ctttcctggcactttctatatctag

SEQ ID NO: 281741 - DNA, 25 bp, Rattus norvegicus
ctttcctggccaaataccttggatt

SEQ ID NO: 281742 - DNA, 25 bp, Rattus norvegicus
ctttcctggccacaagagactgatc

SEQ ID NO: 281743 - DNA, 25 bp, Rattus norvegicus
ctttcctggccagaagagactgatc

SEQ ID NO: 281744 - DNA, 25 bp, Rattus norvegicus
ctttcctggccatataccttggatt

SEQ ID NO: 281745 - DNA, 25 bp, Rattus norvegicus
ctttcctgggaaaattgttcaactg

SEQ ID NO: 281746 - DNA, 25 bp, Rattus norvegicus
ctttcctgggaatattgttcaactg

SEQ ID NO: 281747 - DNA, 25 bp, Rattus norvegicus
ctttcctggtctctgtctggcgtgt

SEQ ID NO: 281748 - DNA, 25 bp, Rattus norvegicus
ctttcctggtctgtgtctggcgtgt

SEQ ID NO: 281749 - DNA, 25 bp, Rattus norvegicus
ctttcctgtaacatgcagtctggaa

SEQ ID NO: 281750 - DNA, 25 bp, Rattus norvegicus
ctttcctgtaacttgcagtctggaa

SEQ ID NO: 281751 - DNA, 25 bp, Rattus norvegicus
ctttcctgtcctcaatttgtcttca

SEQ ID NO: 281752 - DNA, 25 bp, Rattus norvegicus
ctttcctgtcctgaatttgtcttca

SEQ ID NO: 281753 - DNA, 25 bp, Rattus norvegicus
ctttcctgtgaaccaagagaacgtt

SEQ ID NO: 281754 - DNA, 25 bp, Rattus norvegicus
ctttcctgtgaagcaagagaacgtt

SEQ ID NO: 281755 - DNA, 25 bp, Rattus norvegicus
ctttcctgtgaccatcttctttgtg

SEQ ID NO: 281756 - DNA, 25 bp, Rattus norvegicus
ctttcctgtgacgatcttctttgtg

SEQ ID NO: 281757 - DNA, 25 bp, Rattus norvegicus
ctttcctgtggaacctgaagcattg

SEQ ID NO: 281758 - DNA, 25 bp, Rattus norvegicus
ctttcctgtggatcctgaagcattg

SEQ ID NO: 281759 - DNA, 25 bp, Rattus norvegicus
ctttcctgtgtaccatctcattttc

SEQ ID NO: 281760 - DNA, 25 bp, Rattus norvegicus
ctttcctgtgtagcatctcattttc

SEQ ID NO: 281761 - DNA, 25 bp, Rattus norvegicus
ctttcctgttttaagatgctctctg

SEQ ID NO: 281762 - DNA, 25 bp, Rattus norvegicus
ctttcctgtttttagatgctctctg

SEQ ID NO: 281763 - DNA, 25 bp, Rattus norvegicus
ctttccttaggaaggcactgctcac

SEQ ID NO: 281764 - DNA, 25 bp, Rattus norvegicus
ctttccttaggatggcactgctcac

SEQ ID NO: 281765 - DNA, 25 bp, Rattus norvegicus
ctttccttccagagggacttgtttg

SEQ ID NO: 281766 - DNA, 25 bp, Rattus norvegicus
ctttccttccagtgggacttgtttg

SEQ ID NO: 281767 - DNA, 25 bp, Rattus norvegicus
ctttccttcctcatgtagactttat

SEQ ID NO: 281768 - DNA, 25 bp, Rattus norvegicus
ctttccttcctcttgtagactttat

SEQ ID NO: 281769 - DNA, 25 bp, Rattus norvegicus
ctttccttcctgacatcagagatca

SEQ ID NO: 281770 - DNA, 25 bp, Rattus norvegicus
ctttccttcctgtcatcagagatca

SEQ ID NO: 281771 - DNA, 25 bp, Rattus norvegicus
ctttccttctgtccggttctaactg

SEQ ID NO: 281772 - DNA, 25 bp, Rattus norvegicus
ctttccttctgtgcggttctaactg

SEQ ID NO: 281773 - DNA, 25 bp, Rattus norvegicus
ctttccttgcttattcagagatcag

SEQ ID NO: 281774 - DNA, 25 bp, Rattus norvegicus
ctttccttgctttttcagagatcag

SEQ ID NO: 281775 - DNA, 25 bp, Rattus norvegicus
ctttccttggatctgttaccttggc

SEQ ID NO: 281776 - DNA, 25 bp, Rattus norvegicus
ctttccttggatgtgttaccttggc

SEQ ID NO: 281777 - DNA, 25 bp, Rattus norvegicus
ctttccttggctatgatcatgctaa

SEQ ID NO: 281778 - DNA, 25 bp, Rattus norvegicus
ctttccttggctttgatcatgctaa

SEQ ID NO: 281779 - DNA, 25 bp, Rattus norvegicus
ctttcctttcacctgagtataagta

SEQ ID NO: 281780 - DNA, 25 bp, Rattus norvegicus
ctttcctttcacgtgagtataagta

SEQ ID NO: 281781 - DNA, 25 bp, Rattus norvegicus
ctttcctttcagatagtcatgtata

SEQ ID NO: 281782 - DNA, 25 bp, Rattus norvegicus
ctttcctttcagttagtcatgtata

SEQ ID NO: 281783 - DNA, 25 bp, Rattus norvegicus
ctttcctttgctagaacagagtgct

SEQ ID NO: 281784 - DNA, 25 bp, Rattus norvegicus
ctttcctttgcttgaacagagtgct

SEQ ID NO: 281785 - DNA, 25 bp, Rattus norvegicus
ctttcctttggtcccagctttgctg

SEQ ID NO: 281786 - DNA, 25 bp, Rattus norvegicus
ctttcctttggtgccagctttgctg

SEQ ID NO: 281787 - DNA, 25 bp, Rattus norvegicus
ctttccttttagaggttggagacat

SEQ ID NO: 281788 - DNA, 25 bp, Rattus norvegicus
ctttccttttagtggttggagacat

SEQ ID NO: 281789 - DNA, 25 bp, Rattus norvegicus
ctttcctttttgagtagcctgatgg

SEQ ID NO: 281790 - DNA, 25 bp, Rattus norvegicus
ctttcctttttgtgtagcctgatgg

SEQ ID NO: 281791 - DNA, 25 bp, Rattus norvegicus
ctttcgaacatgaacctgagattga

SEQ ID NO: 281792 - DNA, 25 bp, Rattus norvegicus
ctttcgaacatgtacctgagattga

SEQ ID NO: 281793 - DNA, 25 bp, Rattus norvegicus
ctttcgagccgtagagccagggctg

SEQ ID NO: 281794 - DNA, 25 bp, Rattus norvegicus
ctttcgagccgttgagccagggctg

SEQ ID NO: 281795 - DNA, 25 bp, Rattus norvegicus
ctttcgaggaaacgactggcttata

SEQ ID NO: 281796 - DNA, 25 bp, Rattus norvegicus
ctttcgaggaaaggactggcttata

SEQ ID NO: 281797 - DNA, 25 bp, Rattus norvegicus
ctttcgatattgaagcggttcctgt

SEQ ID NO: 281798 - DNA, 25 bp, Rattus norvegicus
ctttcgatattgtagcggttcctgt

SEQ ID NO: 281799 - DNA, 25 bp, Rattus norvegicus
ctttcgcagtgtcttcagggcaaac

SEQ ID NO: 281800 - DNA, 25 bp, Rattus norvegicus
ctttcgcagtgtgttcagggcaaac

SEQ ID NO: 281801 - DNA, 25 bp, Rattus norvegicus
ctttcgccatgtccagaggcatgaa

SEQ ID NO: 281802 - DNA, 25 bp, Rattus norvegicus
ctttcgccatgtgcagaggcatgaa

SEQ ID NO: 281803 - DNA, 25 bp, Rattus norvegicus
ctttcgcttgtacgcttaggcatct

SEQ ID NO: 281804 - DNA, 25 bp, Rattus norvegicus
ctttcgcttgtaggcttaggcatct

SEQ ID NO: 281805 - DNA, 25 bp, Rattus norvegicus
ctttcggacaccatattaatgcgga

SEQ ID NO: 281806 - DNA, 25 bp, Rattus norvegicus
ctttcggacaccttattaatgcgga

SEQ ID NO: 281807 - DNA, 25 bp, Rattus norvegicus
ctttcggatgccctaatctactggg

SEQ ID NO: 281808 - DNA, 25 bp, Rattus norvegicus
ctttcggatgccgtaatctactggg

SEQ ID NO: 281809 - DNA, 25 bp, Rattus norvegicus
ctttcggcccaaaggatttgacgac

SEQ ID NO: 281810 - DNA, 25 bp, Rattus norvegicus
ctttcggcccaatggatttgacgac

SEQ ID NO: 281811 - DNA, 25 bp, Rattus norvegicus
ctttcggctcagctgattaacccag

SEQ ID NO: 281812 - DNA, 25 bp, Rattus norvegicus
ctttcggctcaggtgattaacccag

SEQ ID NO: 281813 - DNA, 25 bp, Rattus norvegicus
ctttcggctgagctcggatgcactg

SEQ ID NO: 281814 - DNA, 25 bp, Rattus norvegicus
ctttcggctgaggtcggatgcactg

SEQ ID NO: 281815 - DNA, 25 bp, Rattus norvegicus
ctttcggtatctacttacaccttgt

SEQ ID NO: 281816 - DNA, 25 bp, Rattus norvegicus
ctttcggtatcttcttacaccttgt

SEQ ID NO: 281817 - DNA, 25 bp, Rattus norvegicus
ctttcggtcaaacagtcaacctctt

SEQ ID NO: 281818 - DNA, 25 bp, Rattus norvegicus
ctttcggtcaaagagtcaacctctt

SEQ ID NO: 281819 - DNA, 25 bp, Rattus norvegicus
ctttcggtctggagagtagcggcat

SEQ ID NO: 281820 - DNA, 25 bp, Rattus norvegicus
ctttcggtctggtgagtagcggcat

SEQ ID NO: 281821 - DNA, 25 bp, Rattus norvegicus
ctttcgtagtagctaagatctgtga

SEQ ID NO: 281822 - DNA, 25 bp, Rattus norvegicus
ctttcgtagtaggtaagatctgtga

SEQ ID NO: 281823 - DNA, 25 bp, Rattus norvegicus
ctttcgtctcaaaatcgggtccata

SEQ ID NO: 281824 - DNA, 25 bp, Rattus norvegicus
ctttcgtctcaatatcgggtccata

SEQ ID NO: 281825 - DNA, 25 bp, Rattus norvegicus
ctttcgtggtgacagctgtggacaa

SEQ ID NO: 281826 - DNA, 25 bp, Rattus norvegicus
ctttcgtggtgagagctgtggacaa

SEQ ID NO: 281827 - DNA, 25 bp, Rattus norvegicus
ctttcgtgtcatagttttgtgttca

SEQ ID NO: 281828 - DNA, 25 bp, Rattus norvegicus
ctttcgtgtcattgttttgtgttca

SEQ ID NO: 281829 - DNA, 25 bp, Rattus norvegicus
ctttcgttattgaagcttctctctt

SEQ ID NO: 281830 - DNA, 25 bp, Rattus norvegicus
ctttcgttattgtagcttctctctt

SEQ ID NO: 281831 - DNA, 25 bp, Rattus norvegicus
ctttcgttgacgattgagccaggga

SEQ ID NO: 281832 - DNA, 25 bp, Rattus norvegicus
ctttcgttgacgtttgagccaggga

SEQ ID NO: 281833 - DNA, 25 bp, Rattus norvegicus
ctttctaatttcctacgtcacgttg

SEQ ID NO: 281834 - DNA, 25 bp, Rattus norvegicus
ctttctaatttcgtacgtcacgttg

SEQ ID NO: 281835 - DNA, 25 bp, Rattus norvegicus
ctttctacccaaagtgttgtcctta

SEQ ID NO: 281836 - DNA, 25 bp, Rattus norvegicus
ctttctacccaatgtgttgtcctta

SEQ ID NO: 281837 - DNA, 25 bp, Rattus norvegicus
ctttctactactaatggcaggacaa

SEQ ID NO: 281838 - DNA, 25 bp, Rattus norvegicus
ctttctactacttatggcaggacaa

SEQ ID NO: 281839 - DNA, 25 bp, Rattus norvegicus
ctttctactcagacccaggtctttt

SEQ ID NO: 281840 - DNA, 25 bp, Rattus norvegicus
ctttctactcagtcccaggtctttt

SEQ ID NO: 281841 - DNA, 25 bp, Rattus norvegicus
ctttctacttgtccatgggcttggt

SEQ ID NO: 281842 - DNA, 25 bp, Rattus norvegicus
ctttctacttgtgcatgggcttggt

SEQ ID NO: 281843 - DNA, 25 bp, Rattus norvegicus
ctttctagggccatgcagtgtagat

SEQ ID NO: 281844 - DNA, 25 bp, Rattus norvegicus
ctttctagggccttgcagtgtagat

SEQ ID NO: 281845 - DNA, 25 bp, Rattus norvegicus
ctttctaggtggagtcaaagcccaa

SEQ ID NO: 281846 - DNA, 25 bp, Rattus norvegicus
ctttctaggtggtgtcaaagcccaa

SEQ ID NO: 281847 - DNA, 25 bp, Rattus norvegicus
ctttctatatctcttgcttgtgcat

SEQ ID NO: 281848 - DNA, 25 bp, Rattus norvegicus
ctttctatatctgttgcttgtgcat

SEQ ID NO: 281849 - DNA, 25 bp, Rattus norvegicus
ctttctcacattcctggcatgctga

SEQ ID NO: 281850 - DNA, 25 bp, Rattus norvegicus
ctttctcacattgctggcatgctga

SEQ ID NO: 281851 - DNA, 25 bp, Rattus norvegicus
ctttctcagctaccttacttactag

SEQ ID NO: 281852 - DNA, 25 bp, Rattus norvegicus
ctttctcagctagcttacttactag

SEQ ID NO: 281853 - DNA, 25 bp, Rattus norvegicus
ctttctcagggacacaccctgatag

SEQ ID NO: 281854 - DNA, 25 bp, Rattus norvegicus
ctttctcagggactttctgaggcca

SEQ ID NO: 281855 - DNA, 25 bp, Rattus norvegicus
ctttctcagggagacaccctgatag

SEQ ID NO: 281856 - DNA, 25 bp, Rattus norvegicus
ctttctcagggagtttctgaggcca

SEQ ID NO: 281857 - DNA, 25 bp, Rattus norvegicus
ctttctcagggcatcatccagaatg

SEQ ID NO: 281858 - DNA, 25 bp, Rattus norvegicus
ctttctcagggcttcatccagaatg

SEQ ID NO: 281859 - DNA, 25 bp, Rattus norvegicus
ctttctcaggttactggcattggac

SEQ ID NO: 281860 - DNA, 25 bp, Rattus norvegicus
ctttctcaggtttctggcattggac

SEQ ID NO: 281861 - DNA, 25 bp, Rattus norvegicus
ctttctcagtcaagttagccattta

SEQ ID NO: 281862 - DNA, 25 bp, Rattus norvegicus
ctttctcagtcatgttagccattta

SEQ ID NO: 281863 - DNA, 25 bp, Rattus norvegicus
ctttctcatcatcgtgtcagacaca

SEQ ID NO: 281864 - DNA, 25 bp, Rattus norvegicus
ctttctcatcatggtgtcagacaca

SEQ ID NO: 281865 - DNA, 25 bp, Rattus norvegicus
ctttctcatccacaggcaaggagta

SEQ ID NO: 281866 - DNA, 25 bp, Rattus norvegicus
ctttctcatccactaattccacatg

SEQ ID NO: 281867 - DNA, 25 bp, Rattus norvegicus
ctttctcatccagaggcaaggagta

SEQ ID NO: 281868 - DNA, 25 bp, Rattus norvegicus
ctttctcatccagtaattccacatg

SEQ ID NO: 281869 - DNA, 25 bp, Rattus norvegicus
ctttctcatggacagggacagcgtg

SEQ ID NO: 281870 - DNA, 25 bp, Rattus norvegicus
ctttctcatggagagggacagcgtg

SEQ ID NO: 281871 - DNA, 25 bp, Rattus norvegicus
ctttctcattttaggtctcttgctg

SEQ ID NO: 281872 - DNA, 25 bp, Rattus norvegicus
ctttctcatttttggtctcttgctg

SEQ ID NO: 281873 - DNA, 25 bp, Rattus norvegicus
ctttctccacagagaggctttcttc

SEQ ID NO: 281874 - DNA, 25 bp, Rattus norvegicus
ctttctccacagtgaggctttcttc

SEQ ID NO: 281875 - DNA, 25 bp, Rattus norvegicus
ctttctccagctaagccctaaataa

SEQ ID NO: 281876 - DNA, 25 bp, Rattus norvegicus
ctttctccagcttagccctaaataa

SEQ ID NO: 281877 - DNA, 25 bp, Rattus norvegicus
ctttctccattcagagccagtggga

SEQ ID NO: 281878 - DNA, 25 bp, Rattus norvegicus
ctttctccattctgagccagtggga

SEQ ID NO: 281879 - DNA, 25 bp, Rattus norvegicus
ctttctcctcagataagttgttgac

SEQ ID NO: 281880 - DNA, 25 bp, Rattus norvegicus
ctttctcctcagttaagttgttgac

SEQ ID NO: 281881 - DNA, 25 bp, Rattus norvegicus
ctttctcctgaaatgcaactggcaa

SEQ ID NO: 281882 - DNA, 25 bp, Rattus norvegicus
ctttctcctgaaattgtgccttagc

SEQ ID NO: 281883 - DNA, 25 bp, Rattus norvegicus
ctttctcctgaattgcaactggcaa

SEQ ID NO: 281884 - DNA, 25 bp, Rattus norvegicus
ctttctcctgaatttgtgccttagc

SEQ ID NO: 281885 - DNA, 25 bp, Rattus norvegicus
ctttctcctgggaatgagatgggac

SEQ ID NO: 281886 - DNA, 25 bp, Rattus norvegicus
ctttctcctgggtatgagatgggac

SEQ ID NO: 281887 - DNA, 25 bp, Rattus norvegicus
ctttctcctgttcacttactgtata

SEQ ID NO: 281888 - DNA, 25 bp, Rattus norvegicus
ctttctcctgttgacttactgtata

SEQ ID NO: 281889 - DNA, 25 bp, Rattus norvegicus
ctttctccttgcaagctggattcac

SEQ ID NO: 281890 - DNA, 25 bp, Rattus norvegicus
ctttctccttgctagctggattcac

SEQ ID NO: 281891 - DNA, 25 bp, Rattus norvegicus
ctttctcgcctgcttatcctaaagg

SEQ ID NO: 281892 - DNA, 25 bp, Rattus norvegicus
ctttctcgcctggttatcctaaagg

SEQ ID NO: 281893 - DNA, 25 bp, Rattus norvegicus
ctttctcgtccgcagcatttaaaga

SEQ ID NO: 281894 - DNA, 25 bp, Rattus norvegicus
ctttctcgtccggagcatttaaaga

SEQ ID NO: 281895 - DNA, 25 bp, Rattus norvegicus
ctttctctcataccctaaggtcatg

SEQ ID NO: 281896 - DNA, 25 bp, Rattus norvegicus
ctttctctcatagcctaaggtcatg

SEQ ID NO: 281897 - DNA, 25 bp, Rattus norvegicus
ctttctctctctcttatttgttaaa

SEQ ID NO: 281898 - DNA, 25 bp, Rattus norvegicus
ctttctctctctgttatttgttaaa

SEQ ID NO: 281899 - DNA, 25 bp, Rattus norvegicus
ctttctctctgcacttaggattggt

SEQ ID NO: 281900 - DNA, 25 bp, Rattus norvegicus
ctttctctctgctcttaggattggt

SEQ ID NO: 281901 - DNA, 25 bp, Rattus norvegicus
ctttctctctttagtcaagtctaga

SEQ ID NO: 281902 - DNA, 25 bp, Rattus norvegicus
ctttctctcttttgtcaagtctaga

SEQ ID NO: 281903 - DNA, 25 bp, Rattus norvegicus
ctttctctgggtccgttgaatacat

SEQ ID NO: 281904 - DNA, 25 bp, Rattus norvegicus
ctttctctgggtgcgttgaatacat

SEQ ID NO: 281905 - DNA, 25 bp, Rattus norvegicus
ctttctcttagtaggctcagtgaca

SEQ ID NO: 281906 - DNA, 25 bp, Rattus norvegicus
ctttctcttagttggctcagtgaca

SEQ ID NO: 281907 - DNA, 25 bp, Rattus norvegicus
ctttctcttctcctatctctagaaa

SEQ ID NO: 281908 - DNA, 25 bp, Rattus norvegicus
ctttctcttctcgtatctctagaaa

SEQ ID NO: 281909 - DNA, 25 bp, Rattus norvegicus
ctttctcttcttccagtttctagaa

SEQ ID NO: 281910 - DNA, 25 bp, Rattus norvegicus
ctttctcttcttgcagtttctagaa

SEQ ID NO: 281911 - DNA, 25 bp, Rattus norvegicus
ctttctcttgctattgagctcctaa

SEQ ID NO: 281912 - DNA, 25 bp, Rattus norvegicus
ctttctcttgcttttgagctcctaa

SEQ ID NO: 281913 - DNA, 25 bp, Rattus norvegicus
ctttctcttgttaactaagtgcaaa

SEQ ID NO: 281914 - DNA, 25 bp, Rattus norvegicus
ctttctcttgtttactaagtgcaaa

SEQ ID NO: 281915 - DNA, 25 bp, Rattus norvegicus
ctttctctttatatccagttgcttg

SEQ ID NO: 281916 - DNA, 25 bp, Rattus norvegicus
ctttctctttatttccagttgcttg

SEQ ID NO: 281917 - DNA, 25 bp, Rattus norvegicus
ctttctcttttaccttcttttgcat

SEQ ID NO: 281918 - DNA, 25 bp, Rattus norvegicus
ctttctcttttagcttcttttgcat

SEQ ID NO: 281919 - DNA, 25 bp, Rattus norvegicus
ctttctgaacagctccaagggactt

SEQ ID NO: 281920 - DNA, 25 bp, Rattus norvegicus
ctttctgaacaggtccaagggactt

SEQ ID NO: 281921 - DNA, 25 bp, Rattus norvegicus
ctttctgaagaaagctctcgagcat

SEQ ID NO: 281922 - DNA, 25 bp, Rattus norvegicus
ctttctgaagaatgctctcgagcat

SEQ ID NO: 281923 - DNA, 25 bp, Rattus norvegicus
ctttctgaagttcatgctgcctgac

SEQ ID NO: 281924 - DNA, 25 bp, Rattus norvegicus
ctttctgaagttgatgctgcctgac

SEQ ID NO: 281925 - DNA, 25 bp, Rattus norvegicus
ctttctgacactatcacttttgcag

SEQ ID NO: 281926 - DNA, 25 bp, Rattus norvegicus
ctttctgacactttcacttttgcag

SEQ ID NO: 281927 - DNA, 25 bp, Rattus norvegicus
ctttctgactccctgaggaagcttc

SEQ ID NO: 281928 - DNA, 25 bp, Rattus norvegicus
ctttctgactccgtgaggaagcttc

SEQ ID NO: 281929 - DNA, 25 bp, Rattus norvegicus
ctttctgagaggcagtagggccatt

SEQ ID NO: 281930 - DNA, 25 bp, Rattus norvegicus
ctttctgagagggagtagggccatt

SEQ ID NO: 281931 - DNA, 25 bp, Rattus norvegicus
ctttctgagattctacttcttaaga

SEQ ID NO: 281932 - DNA, 25 bp, Rattus norvegicus
ctttctgagattgtacttcttaaga

SEQ ID NO: 281933 - DNA, 25 bp, Rattus norvegicus
ctttctgagtttcagccctgtaaaa

SEQ ID NO: 281934 - DNA, 25 bp, Rattus norvegicus
ctttctgagtttgagccctgtaaaa

SEQ ID NO: 281935 - DNA, 25 bp, Rattus norvegicus
ctttctgataacacgatggtgctga

SEQ ID NO: 281936 - DNA, 25 bp, Rattus norvegicus
ctttctgataactcgatggtgctga

SEQ ID NO: 281937 - DNA, 25 bp, Rattus norvegicus
ctttctgatatacttttgccctttg

SEQ ID NO: 281938 - DNA, 25 bp, Rattus norvegicus
ctttctgatatagttttgccctttg

SEQ ID NO: 281939 - DNA, 25 bp, Rattus norvegicus
ctttctgatcggaagaagaacctat

SEQ ID NO: 281940 - DNA, 25 bp, Rattus norvegicus
ctttctgatcggtagaagaacctat

SEQ ID NO: 281941 - DNA, 25 bp, Rattus norvegicus
ctttctgatcttatccattttgtgt

SEQ ID NO: 281942 - DNA, 25 bp, Rattus norvegicus
ctttctgatcttttccattttgtgt

SEQ ID NO: 281943 - DNA, 25 bp, Rattus norvegicus
ctttctgcagtcctcggatgacaat

SEQ ID NO: 281944 - DNA, 25 bp, Rattus norvegicus
ctttctgcagtcgtcggatgacaat

SEQ ID NO: 281945 - DNA, 25 bp, Rattus norvegicus
ctttctgccactaagcatgtgtata

SEQ ID NO: 281946 - DNA, 25 bp, Rattus norvegicus
ctttctgccacttagcatgtgtata

SEQ ID NO: 281947 - DNA, 25 bp, Rattus norvegicus
ctttctgcgttcagattgagctcaa

SEQ ID NO: 281948 - DNA, 25 bp, Rattus norvegicus
ctttctgcgttctgattgagctcaa

SEQ ID NO: 281949 - DNA, 25 bp, Rattus norvegicus
ctttctgctggcagatttctgagga

SEQ ID NO: 281950 - DNA, 25 bp, Rattus norvegicus
ctttctgctggctgatttctgagga

SEQ ID NO: 281951 - DNA, 25 bp, Rattus norvegicus
ctttctgctttaaagtgacgttcgt

SEQ ID NO: 281952 - DNA, 25 bp, Rattus norvegicus
ctttctgctttatagtgacgttcgt

SEQ ID NO: 281953 - DNA, 25 bp, Rattus norvegicus
ctttctgcttttctgtgtcgtacaa

SEQ ID NO: 281954 - DNA, 25 bp, Rattus norvegicus
ctttctgcttttgtgtgtcgtacaa

SEQ ID NO: 281955 - DNA, 25 bp, Rattus norvegicus
ctttctggacttacacacaagtggt

SEQ ID NO: 281956 - DNA, 25 bp, Rattus norvegicus
ctttctggactttcacacaagtggt

SEQ ID NO: 281957 - DNA, 25 bp, Rattus norvegicus
ctttctggaggaccttctgttaatc

SEQ ID NO: 281958 - DNA, 25 bp, Rattus norvegicus
ctttctggaggagcttctgttaatc

SEQ ID NO: 281959 - DNA, 25 bp, Rattus norvegicus
ctttctggcagactggagtattgtg

SEQ ID NO: 281960 - DNA, 25 bp, Rattus norvegicus
ctttctggcagagtggagtattgtg

SEQ ID NO: 281961 - DNA, 25 bp, Rattus norvegicus
ctttctggccctcagtaggaagcag

SEQ ID NO: 281962 - DNA, 25 bp, Rattus norvegicus
ctttctggccctgagtaggaagcag

SEQ ID NO: 281963 - DNA, 25 bp, Rattus norvegicus
ctttctgggctgaccctaaagagat

SEQ ID NO: 281964 - DNA, 25 bp, Rattus norvegicus
ctttctgggctgtccctaaagagat

SEQ ID NO: 281965 - DNA, 25 bp, Rattus norvegicus
ctttctggtggtcttcttgatcgga

SEQ ID NO: 281966 - DNA, 25 bp, Rattus norvegicus
ctttctggtggtgttcttgatcgga

SEQ ID NO: 281967 - DNA, 25 bp, Rattus norvegicus
ctttctggtttcacaacaagctaga

SEQ ID NO: 281968 - DNA, 25 bp, Rattus norvegicus
ctttctggtttctcaacaagctaga

SEQ ID NO: 281969 - DNA, 25 bp, Rattus norvegicus
ctttctgtagtgcagcaaacgtctt

SEQ ID NO: 281970 - DNA, 25 bp, Rattus norvegicus
ctttctgtagtggagcaaacgtctt

SEQ ID NO: 281971 - DNA, 25 bp, Rattus norvegicus
ctttctgtcaggaagggatgtgctc

SEQ ID NO: 281972 - DNA, 25 bp, Rattus norvegicus
ctttctgtcaggtagggatgtgctc

SEQ ID NO: 281973 - DNA, 25 bp, Rattus norvegicus
ctttctgtctgtccctgttttaaag

SEQ ID NO: 281974 - DNA, 25 bp, Rattus norvegicus
ctttctgtctgtgcctgttttaaag

SEQ ID NO: 281975 - DNA, 25 bp, Rattus norvegicus
ctttctgtgaatattgcctttgttt

SEQ ID NO: 281976 - DNA, 25 bp, Rattus norvegicus
ctttctgtgaattttgcctttgttt

SEQ ID NO: 281977 - DNA, 25 bp, Rattus norvegicus
ctttctgtgctgaacggtgatgctt

SEQ ID NO: 281978 - DNA, 25 bp, Rattus norvegicus
ctttctgtgctgtacggtgatgctt

SEQ ID NO: 281979 - DNA, 25 bp, Rattus norvegicus
ctttctgtgtttcttctgccttcta

SEQ ID NO: 281980 - DNA, 25 bp, Rattus norvegicus
ctttctgtgtttgttctgccttcta

SEQ ID NO: 281981 - DNA, 25 bp, Rattus norvegicus
ctttctgttaggacttcatattggc

SEQ ID NO: 281982 - DNA, 25 bp, Rattus norvegicus
ctttctgttaggtcttcatattggc

SEQ ID NO: 281983 - DNA, 25 bp, Rattus norvegicus
ctttctgttcagctggactattgca

SEQ ID NO: 281984 - DNA, 25 bp, Rattus norvegicus
ctttctgttcaggtggactattgca

SEQ ID NO: 281985 - DNA, 25 bp, Rattus norvegicus
ctttctgttgtgatacaatgtgact

SEQ ID NO: 281986 - DNA, 25 bp, Rattus norvegicus
ctttctgttgtgttacaatgtgact

SEQ ID NO: 281987 - DNA, 25 bp, Rattus norvegicus
ctttctgtttagattatttgacatc

SEQ ID NO: 281988 - DNA, 25 bp, Rattus norvegicus
ctttctgtttagtttatttgacatc

SEQ ID NO: 281989 - DNA, 25 bp, Rattus norvegicus
ctttctgtttctcctgatactttac

SEQ ID NO: 281990 - DNA, 25 bp, Rattus norvegicus
ctttctgtttctgctgatactttac

SEQ ID NO: 281991 - DNA, 25 bp, Rattus norvegicus
ctttctgtttgaccctagctttcca

SEQ ID NO: 281992 - DNA, 25 bp, Rattus norvegicus
ctttctgtttgagcctagctttcca

SEQ ID NO: 281993 - DNA, 25 bp, Rattus norvegicus
ctttctgttttgcttcatttcgttc

SEQ ID NO: 281994 - DNA, 25 bp, Rattus norvegicus
ctttctgttttggttcatttcgttc

SEQ ID NO: 281995 - DNA, 25 bp, Rattus norvegicus
ctttcttaaaggctggcgcgtgtgt

SEQ ID NO: 281996 - DNA, 25 bp, Rattus norvegicus
ctttcttaaagggtggcgcgtgtgt

SEQ ID NO: 281997 - DNA, 25 bp, Rattus norvegicus
ctttcttagtttcaggtcatcccaa

SEQ ID NO: 281998 - DNA, 25 bp, Rattus norvegicus
ctttcttagtttgaggtcatcccaa

SEQ ID NO: 281999 - DNA, 25 bp, Rattus norvegicus
ctttcttatcaaatggacctctcgc

SEQ ID NO: 282000 - DNA, 25 bp, Rattus norvegicus
ctttcttatcaattggacctctcgc

SEQ ID NO: 282001 - DNA, 25 bp, Rattus norvegicus
ctttcttatttgatctagtgttcta

SEQ ID NO: 282002 - DNA, 25 bp, Rattus norvegicus
ctttcttatttgttctagtgttcta

SEQ ID NO: 282003 - DNA, 25 bp, Rattus norvegicus
ctttcttcaaaactgtccccagagc

SEQ ID NO: 282004 - DNA, 25 bp, Rattus norvegicus
ctttcttcaaaagtgtccccagagc

SEQ ID NO: 282005 - DNA, 25 bp, Rattus norvegicus
ctttcttcagagactagctgggctc

SEQ ID NO: 282006 - DNA, 25 bp, Rattus norvegicus
ctttcttcagagtctagctgggctc

SEQ ID NO: 282007 - DNA, 25 bp, Rattus norvegicus
ctttcttcaggactctggactggga

SEQ ID NO: 282008 - DNA, 25 bp, Rattus norvegicus
ctttcttcaggagtctggactggga

SEQ ID NO: 282009 - DNA, 25 bp, Rattus norvegicus
ctttcttccaaacctccagagggag

SEQ ID NO: 282010 - DNA, 25 bp, Rattus norvegicus
ctttcttccaaagctccagagggag

SEQ ID NO: 282011 - DNA, 25 bp, Rattus norvegicus
ctttcttccagaatgttccagtcgg

SEQ ID NO: 282012 - DNA, 25 bp, Rattus norvegicus
ctttcttccagattgttccagtcgg

SEQ ID NO: 282013 - DNA, 25 bp, Rattus norvegicus
ctttcttcccacaaatcaactggtt

SEQ ID NO: 282014 - DNA, 25 bp, Rattus norvegicus
ctttcttcccactaatcaactggtt

SEQ ID NO: 282015 - DNA, 25 bp, Rattus norvegicus
ctttcttcctgtaaagcctgaggga

SEQ ID NO: 282016 - DNA, 25 bp, Rattus norvegicus
ctttcttcctgttaagcctgaggga

SEQ ID NO: 282017 - DNA, 25 bp, Rattus norvegicus
ctttcttctcacacgtggttttgtg

SEQ ID NO: 282018 - DNA, 25 bp, Rattus norvegicus
ctttcttctcactcgtggttttgtg

SEQ ID NO: 282019 - DNA, 25 bp, Rattus norvegicus
ctttcttctgttcagtcttctgtaa

SEQ ID NO: 282020 - DNA, 25 bp, Rattus norvegicus
ctttcttctgttgagtcttctgtaa

SEQ ID NO: 282021 - DNA, 25 bp, Rattus norvegicus
ctttcttcttccaagtccttatata

SEQ ID NO: 282022 - DNA, 25 bp, Rattus norvegicus
ctttcttcttcctagtccttatata

SEQ ID NO: 282023 - DNA, 25 bp, Rattus norvegicus
ctttcttctttcattgtgctcaaag

SEQ ID NO: 282024 - DNA, 25 bp, Rattus norvegicus
ctttcttctttctttgtgctcaaag

SEQ ID NO: 282025 - DNA, 25 bp, Rattus norvegicus
ctttcttgacttccccttccatagt

SEQ ID NO: 282026 - DNA, 25 bp, Rattus norvegicus
ctttcttgacttgcccttccatagt

SEQ ID NO: 282027 - DNA, 25 bp, Rattus norvegicus
ctttcttgccaacttgcgtgaaaag

SEQ ID NO: 282028 - DNA, 25 bp, Rattus norvegicus
ctttcttgccaagttgcgtgaaaag

SEQ ID NO: 282029 - DNA, 25 bp, Rattus norvegicus
ctttcttggtttagcaacatcactg

SEQ ID NO: 282030 - DNA, 25 bp, Rattus norvegicus
ctttcttggttttgcaacatcactg

SEQ ID NO: 282031 - DNA, 25 bp, Rattus norvegicus
ctttcttgtttcattcatggactct

SEQ ID NO: 282032 - DNA, 25 bp, Rattus norvegicus
ctttcttgtttctttcatggactct

SEQ ID NO: 282033 - DNA, 25 bp, Rattus norvegicus
ctttctttacctatatcttcatcat

SEQ ID NO: 282034 - DNA, 25 bp, Rattus norvegicus
ctttctttacctttatcttcatcat

SEQ ID NO: 282035 - DNA, 25 bp, Rattus norvegicus
ctttctttagttcctgtactctaca

SEQ ID NO: 282036 - DNA, 25 bp, Rattus norvegicus
ctttctttagttgctgtactctaca

SEQ ID NO: 282037 - DNA, 25 bp, Rattus norvegicus
ctttctttatgtcctctatgtgtat

SEQ ID NO: 282038 - DNA, 25 bp, Rattus norvegicus
ctttctttatgtgctctatgtgtat

SEQ ID NO: 282039 - DNA, 25 bp, Rattus norvegicus
ctttctttcctgaccagtgcatgat

SEQ ID NO: 282040 - DNA, 25 bp, Rattus norvegicus
ctttctttcctgtccagtgcatgat

SEQ ID NO: 282041 - DNA, 25 bp, Rattus norvegicus
ctttctttctcgaggttgtgtacat

SEQ ID NO: 282042 - DNA, 25 bp, Rattus norvegicus
ctttctttctcgtggttgtgtacat

SEQ ID NO: 282043 - DNA, 25 bp, Rattus norvegicus
ctttctttctctaagcatttttctg

SEQ ID NO: 282044 - DNA, 25 bp, Rattus norvegicus
ctttctttctcttagcatttttctg

SEQ ID NO: 282045 - DNA, 25 bp, Rattus norvegicus
ctttctttctgactcagggtcgcat

SEQ ID NO: 282046 - DNA, 25 bp, Rattus norvegicus
ctttctttctgagtcagggtcgcat

SEQ ID NO: 282047 - DNA, 25 bp, Rattus norvegicus
ctttctttgcttagccatgacagga

SEQ ID NO: 282048 - DNA, 25 bp, Rattus norvegicus
ctttctttgctttgccatgacagga

SEQ ID NO: 282049 - DNA, 25 bp, Rattus norvegicus
ctttctttgtgccttgatgttcgag

SEQ ID NO: 282050 - DNA, 25 bp, Rattus norvegicus
ctttctttgtgcgttgatgttcgag

SEQ ID NO: 282051 - DNA, 25 bp, Rattus norvegicus
ctttctttgttcacagacacagctt

SEQ ID NO: 282052 - DNA, 25 bp, Rattus norvegicus
ctttctttgttctcagacacagctt

SEQ ID NO: 282053 - DNA, 25 bp, Rattus norvegicus
ctttcttttgatcagtaggttacca

SEQ ID NO: 282054 - DNA, 25 bp, Rattus norvegicus
ctttcttttgatgagtaggttacca

SEQ ID NO: 282055 - DNA, 25 bp, Rattus norvegicus
ctttcttttgctcttgtgttatttc

SEQ ID NO: 282056 - DNA, 25 bp, Rattus norvegicus
ctttcttttgctgttgtgttatttc

SEQ ID NO: 282057 - DNA, 25 bp, Rattus norvegicus
ctttctttttaaaggagtcgatgtc

SEQ ID NO: 282058 - DNA, 25 bp, Rattus norvegicus
ctttctttttaatggagtcgatgtc

SEQ ID NO: 282059 - DNA, 25 bp, Rattus norvegicus
ctttgaaagtttctgctgttgccct

SEQ ID NO: 282060 - DNA, 25 bp, Rattus norvegicus
ctttgaaagtttgtgctgttgccct

SEQ ID NO: 282061 - DNA, 25 bp, Rattus norvegicus
ctttgaaccagcacgggatctacaa

SEQ ID NO: 282062 - DNA, 25 bp, Rattus norvegicus
ctttgaaccagctcgggatctacaa

SEQ ID NO: 282063 - DNA, 25 bp, Rattus norvegicus
ctttgaacggccacaggaagcagga

SEQ ID NO: 282064 - DNA, 25 bp, Rattus norvegicus
ctttgaacggcctcaggaagcagga

SEQ ID NO: 282065 - DNA, 25 bp, Rattus norvegicus
ctttgaacttcacagcatcagccag

SEQ ID NO: 282066 - DNA, 25 bp, Rattus norvegicus
ctttgaacttcagagcatcagccag

SEQ ID NO: 282067 - DNA, 25 bp, Rattus norvegicus
ctttgaagcagaagcctccagccct

SEQ ID NO: 282068 - DNA, 25 bp, Rattus norvegicus
ctttgaagcagatgcctccagccct

SEQ ID NO: 282069 - DNA, 25 bp, Rattus norvegicus
ctttgaattgccatggacagtggcc

SEQ ID NO: 282070 - DNA, 25 bp, Rattus norvegicus
ctttgaattgccttggacagtggcc

SEQ ID NO: 282071 - DNA, 25 bp, Rattus norvegicus
ctttgaattgggaggcgctctcttc

SEQ ID NO: 282072 - DNA, 25 bp, Rattus norvegicus
ctttgaattgggtggcgctctcttc

SEQ ID NO: 282073 - DNA, 25 bp, Rattus norvegicus
ctttgaattttaagtagcctctttg

SEQ ID NO: 282074 - DNA, 25 bp, Rattus norvegicus
ctttgaattttatgtagcctctttg

SEQ ID NO: 282075 - DNA, 25 bp, Rattus norvegicus
ctttgacaaactcgcctgggctttt

SEQ ID NO: 282076 - DNA, 25 bp, Rattus norvegicus
ctttgacaaactggcctgggctttt

SEQ ID NO: 282077 - DNA, 25 bp, Rattus norvegicus
ctttgacaaattccgcagcgtgctg

SEQ ID NO: 282078 - DNA, 25 bp, Rattus norvegicus
ctttgacaaattgcgcagcgtgctg

SEQ ID NO: 282079 - DNA, 25 bp, Rattus norvegicus
ctttgacaccgtagattatggagac

SEQ ID NO: 282080 - DNA, 25 bp, Rattus norvegicus
ctttgacaccgttgattatggagac

SEQ ID NO: 282081 - DNA, 25 bp, Rattus norvegicus
ctttgaccactgagtctcaactgaa

SEQ ID NO: 282082 - DNA, 25 bp, Rattus norvegicus
ctttgaccactgtgtctcaactgaa

SEQ ID NO: 282083 - DNA, 25 bp, Rattus norvegicus
ctttgaccagatagggattctcaat

SEQ ID NO: 282084 - DNA, 25 bp, Rattus norvegicus
ctttgaccagattgggattctcaat

SEQ ID NO: 282085 - DNA, 25 bp, Rattus norvegicus
ctttgacccattatcttaaagcaat

SEQ ID NO: 282086 - DNA, 25 bp, Rattus norvegicus
ctttgacccattttcttaaagcaat

SEQ ID NO: 282087 - DNA, 25 bp, Rattus norvegicus
ctttgaccccaaagtcagcatggta

SEQ ID NO: 282088 - DNA, 25 bp, Rattus norvegicus
ctttgaccccaatgtcagcatggta

SEQ ID NO: 282089 - DNA, 25 bp, Rattus norvegicus
ctttgacctgagctatacctggaaa

SEQ ID NO: 282090 - DNA, 25 bp, Rattus norvegicus
ctttgacctgaggtatacctggaaa

SEQ ID NO: 282091 - DNA, 25 bp, Rattus norvegicus
ctttgacggaagcttgaagatgttc

SEQ ID NO: 282092 - DNA, 25 bp, Rattus norvegicus
ctttgacggaaggttgaagatgttc

SEQ ID NO: 282093 - DNA, 25 bp, Rattus norvegicus
ctttgacggctaaacttacccatat

SEQ ID NO: 282094 - DNA, 25 bp, Rattus norvegicus
ctttgacggctatacttacccatat

SEQ ID NO: 282095 - DNA, 25 bp, Rattus norvegicus
ctttgactacttaatctgaggccaa

SEQ ID NO: 282096 - DNA, 25 bp, Rattus norvegicus
ctttgactactttatctgaggccaa

SEQ ID NO: 282097 - DNA, 25 bp, Rattus norvegicus
ctttgactgagtactgtgtgtgcct

SEQ ID NO: 282098 - DNA, 25 bp, Rattus norvegicus
ctttgactgagttctgtgtgtgcct

SEQ ID NO: 282099 - DNA, 25 bp, Rattus norvegicus
ctttgactgtgcacatccagggaca

SEQ ID NO: 282100 - DNA, 25 bp, Rattus norvegicus
ctttgactgtgctcatccagggaca

SEQ ID NO: 282101 - DNA, 25 bp, Rattus norvegicus
ctttgacttcgaccgcaggtgccat

SEQ ID NO: 282102 - DNA, 25 bp, Rattus norvegicus
ctttgacttcgagcgcaggtgccat

SEQ ID NO: 282103 - DNA, 25 bp, Rattus norvegicus
ctttgactttcgactgtgctttgta

SEQ ID NO: 282104 - DNA, 25 bp, Rattus norvegicus
ctttgactttcgtctgtgctttgta

SEQ ID NO: 282105 - DNA, 25 bp, Rattus norvegicus
ctttgactttctactgtttgaccag

SEQ ID NO: 282106 - DNA, 25 bp, Rattus norvegicus
ctttgactttctctcgtctatatct

SEQ ID NO: 282107 - DNA, 25 bp, Rattus norvegicus
ctttgactttctgtcgtctatatct

SEQ ID NO: 282108 - DNA, 25 bp, Rattus norvegicus
ctttgactttcttctgtttgaccag

SEQ ID NO: 282109 - DNA, 25 bp, Rattus norvegicus
ctttgagaagctccgccacatgcta

SEQ ID NO: 282110 - DNA, 25 bp, Rattus norvegicus
ctttgagaagctgcgccacatgcta

SEQ ID NO: 282111 - DNA, 25 bp, Rattus norvegicus
ctttgagacagtcctttctttgtaa

SEQ ID NO: 282112 - DNA, 25 bp, Rattus norvegicus
ctttgagacagtgctttctttgtaa

SEQ ID NO: 282113 - DNA, 25 bp, Rattus norvegicus
ctttgagccgatcttctttgggagg

SEQ ID NO: 282114 - DNA, 25 bp, Rattus norvegicus
ctttgagccgatgttctttgggagg

SEQ ID NO: 282115 - DNA, 25 bp, Rattus norvegicus
ctttgagcttgacattgcccgtaaa

SEQ ID NO: 282116 - DNA, 25 bp, Rattus norvegicus
ctttgagcttgagattgcccgtaaa

SEQ ID NO: 282117 - DNA, 25 bp, Rattus norvegicus
ctttgaggatctccatattggcatt

SEQ ID NO: 282118 - DNA, 25 bp, Rattus norvegicus
ctttgaggatctgcatattggcatt

SEQ ID NO: 282119 - DNA, 25 bp, Rattus norvegicus
ctttgaggatttctgctgttggcgc

SEQ ID NO: 282120 - DNA, 25 bp, Rattus norvegicus
ctttgaggatttgtgctgttggcgc

SEQ ID NO: 282121 - DNA, 25 bp, Rattus norvegicus
ctttgaggcctccactgttgtataa

SEQ ID NO: 282122 - DNA, 25 bp, Rattus norvegicus
ctttgaggcctcgactgttgtataa

SEQ ID NO: 282123 - DNA, 25 bp, Rattus norvegicus
ctttgagggcaaaaagcagtttgtc

SEQ ID NO: 282124 - DNA, 25 bp, Rattus norvegicus
ctttgagggcaataagcagtttgtc

SEQ ID NO: 282125 - DNA, 25 bp, Rattus norvegicus
ctttgagggttgaccatctcccaga

SEQ ID NO: 282126 - DNA, 25 bp, Rattus norvegicus
ctttgagggttgtccatctcccaga

SEQ ID NO: 282127 - DNA, 25 bp, Rattus norvegicus
ctttgaggtaccagcagtggcaggc

SEQ ID NO: 282128 - DNA, 25 bp, Rattus norvegicus
ctttgaggtacctgcagtggcaggc

SEQ ID NO: 282129 - DNA, 25 bp, Rattus norvegicus
ctttgagtcacaccctgggaaagaa

SEQ ID NO: 282130 - DNA, 25 bp, Rattus norvegicus
ctttgagtcacagcctgggaaagaa

SEQ ID NO: 282131 - DNA, 25 bp, Rattus norvegicus
ctttgagtgtggatgcctggcctac

SEQ ID NO: 282132 - DNA, 25 bp, Rattus norvegicus
ctttgagtgtggttgcctggcctac

SEQ ID NO: 282133 - DNA, 25 bp, Rattus norvegicus
ctttgagtgttccaggttctcctta

SEQ ID NO: 282134 - DNA, 25 bp, Rattus norvegicus
ctttgagtgttcgaggttctcctta

SEQ ID NO: 282135 - DNA, 25 bp, Rattus norvegicus
ctttgagtgtttcgtctgtgaccat

SEQ ID NO: 282136 - DNA, 25 bp, Rattus norvegicus
ctttgagtgtttggtctgtgaccat

SEQ ID NO: 282137 - DNA, 25 bp, Rattus norvegicus
ctttgagtttaacccacactgggaa

SEQ ID NO: 282138 - DNA, 25 bp, Rattus norvegicus
ctttgagtttaagccacactgggaa

SEQ ID NO: 282139 - DNA, 25 bp, Rattus norvegicus
ctttgagtttgtccctgtggtttct

SEQ ID NO: 282140 - DNA, 25 bp, Rattus norvegicus
ctttgagtttgtgcctgtggtttct

SEQ ID NO: 282141 - DNA, 25 bp, Rattus norvegicus
ctttgataagctctttctctcccag

SEQ ID NO: 282142 - DNA, 25 bp, Rattus norvegicus
ctttgataagctgtttctctcccag

SEQ ID NO: 282143 - DNA, 25 bp, Rattus norvegicus
ctttgatagatcatttcggctccct

SEQ ID NO: 282144 - DNA, 25 bp, Rattus norvegicus
ctttgatagatcttttcggctccct

SEQ ID NO: 282145 - DNA, 25 bp, Rattus norvegicus
ctttgatatttaatgttcttgcaca

SEQ ID NO: 282146 - DNA, 25 bp, Rattus norvegicus
ctttgatatttattgttcttgcaca

SEQ ID NO: 282147 - DNA, 25 bp, Rattus norvegicus
ctttgatcagttcgtcatcacccac

SEQ ID NO: 282148 - DNA, 25 bp, Rattus norvegicus
ctttgatcagttggtcatcacccac

SEQ ID NO: 282149 - DNA, 25 bp, Rattus norvegicus
ctttgatcccgacattagtgttagg

SEQ ID NO: 282150 - DNA, 25 bp, Rattus norvegicus
ctttgatcccgagattagtgttagg

SEQ ID NO: 282151 - DNA, 25 bp, Rattus norvegicus
ctttgatccctcacatcacaaaaac

SEQ ID NO: 282152 - DNA, 25 bp, Rattus norvegicus
ctttgatccctctcatcacaaaaac

SEQ ID NO: 282153 - DNA, 25 bp, Rattus norvegicus
ctttgatcgatactaacctgtggtt

SEQ ID NO: 282154 - DNA, 25 bp, Rattus norvegicus
ctttgatcgatagtaacctgtggtt

SEQ ID NO: 282155 - DNA, 25 bp, Rattus norvegicus
ctttgatcttgaatggacccagcca

SEQ ID NO: 282156 - DNA, 25 bp, Rattus norvegicus
ctttgatcttgattggacccagcca

SEQ ID NO: 282157 - DNA, 25 bp, Rattus norvegicus
ctttgattacagatacagccaggct

SEQ ID NO: 282158 - DNA, 25 bp, Rattus norvegicus
ctttgattacagttacagccaggct

SEQ ID NO: 282159 - DNA, 25 bp, Rattus norvegicus
ctttgattatggctaggcatggtca

SEQ ID NO: 282160 - DNA, 25 bp, Rattus norvegicus
ctttgattatgggtaggcatggtca

SEQ ID NO: 282161 - DNA, 25 bp, Rattus norvegicus
ctttgattccagctgaactttttgt

SEQ ID NO: 282162 - DNA, 25 bp, Rattus norvegicus
ctttgattccaggtgaactttttgt

SEQ ID NO: 282163 - DNA, 25 bp, Rattus norvegicus
ctttgattgaaacgcccatctgtcc

SEQ ID NO: 282164 - DNA, 25 bp, Rattus norvegicus
ctttgattgaaaggcccatctgtcc

SEQ ID NO: 282165 - DNA, 25 bp, Rattus norvegicus
ctttgattgaatcggtgctgcggat

SEQ ID NO: 282166 - DNA, 25 bp, Rattus norvegicus
ctttgattgaatgggtgctgcggat

SEQ ID NO: 282167 - DNA, 25 bp, Rattus norvegicus
ctttgatttatgctgggacctctat

SEQ ID NO: 282168 - DNA, 25 bp, Rattus norvegicus
ctttgatttatggtgggacctctat

SEQ ID NO: 282169 - DNA, 25 bp, Rattus norvegicus
ctttgatttttcaccacatatttaa

SEQ ID NO: 282170 - DNA, 25 bp, Rattus norvegicus
ctttgatttttctccacatatttaa

SEQ ID NO: 282171 - DNA, 25 bp, Rattus norvegicus
ctttgcaacacgagcgcttctctga

SEQ ID NO: 282172 - DNA, 25 bp, Rattus norvegicus
ctttgcaacacgtgcgcttctctga

SEQ ID NO: 282173 - DNA, 25 bp, Rattus norvegicus
ctttgcaacggccatcttttatatc

SEQ ID NO: 282174 - DNA, 25 bp, Rattus norvegicus
ctttgcaacggcgatcttttatatc

SEQ ID NO: 282175 - DNA, 25 bp, Rattus norvegicus
ctttgcacatatactctccagagtc

SEQ ID NO: 282176 - DNA, 25 bp, Rattus norvegicus
ctttgcacatattctctccagagtc

SEQ ID NO: 282177 - DNA, 25 bp, Rattus norvegicus
ctttgcacctagattacacacattc

SEQ ID NO: 282178 - DNA, 25 bp, Rattus norvegicus
ctttgcacctagtttacacacattc

SEQ ID NO: 282179 - DNA, 25 bp, Rattus norvegicus
ctttgcactgtgcatccggattgga

SEQ ID NO: 282180 - DNA, 25 bp, Rattus norvegicus
ctttgcactgtggatccggattgga

SEQ ID NO: 282181 - DNA, 25 bp, Rattus norvegicus
ctttgcagacatagtcccaatgaat

SEQ ID NO: 282182 - DNA, 25 bp, Rattus norvegicus
ctttgcagacattgtcccaatgaat

SEQ ID NO: 282183 - DNA, 25 bp, Rattus norvegicus
ctttgcagctgtcacctcgagggag

SEQ ID NO: 282184 - DNA, 25 bp, Rattus norvegicus
ctttgcagctgtgacctcgagggag

SEQ ID NO: 282185 - DNA, 25 bp, Rattus norvegicus
ctttgcagtttaattttcttggcca

SEQ ID NO: 282186 - DNA, 25 bp, Rattus norvegicus
ctttgcagtttatttttcttggcca

SEQ ID NO: 282187 - DNA, 25 bp, Rattus norvegicus
ctttgcatgttgattttccttcacc

SEQ ID NO: 282188 - DNA, 25 bp, Rattus norvegicus
ctttgcatgttgtttttccttcacc

SEQ ID NO: 282189 - DNA, 25 bp, Rattus norvegicus
ctttgccaatgccagctaaggtgct

SEQ ID NO: 282190 - DNA, 25 bp, Rattus norvegicus
ctttgccaatgcgagctaaggtgct

SEQ ID NO: 282191 - DNA, 25 bp, Rattus norvegicus
ctttgccactttaacattctctttt

SEQ ID NO: 282192 - DNA, 25 bp, Rattus norvegicus
ctttgccacttttacattctctttt

SEQ ID NO: 282193 - DNA, 25 bp, Rattus norvegicus
ctttgccatactctgtacagcttgt

SEQ ID NO: 282194 - DNA, 25 bp, Rattus norvegicus
ctttgccatactgtgtacagcttgt

SEQ ID NO: 282195 - DNA, 25 bp, Rattus norvegicus
ctttgccatagaaaatccctgacaa

SEQ ID NO: 282196 - DNA, 25 bp, Rattus norvegicus
ctttgccatagataatccctgacaa

SEQ ID NO: 282197 - DNA, 25 bp, Rattus norvegicus
ctttgccatgatccaacacctgaaa

SEQ ID NO: 282198 - DNA, 25 bp, Rattus norvegicus
ctttgccatgatgcaacacctgaaa

SEQ ID NO: 282199 - DNA, 25 bp, Rattus norvegicus
ctttgccattgacgccttagccaag

SEQ ID NO: 282200 - DNA, 25 bp, Rattus norvegicus
ctttgccattgaggccttagccaag

SEQ ID NO: 282201 - DNA, 25 bp, Rattus norvegicus
ctttgcccaagaccctcagtgatga

SEQ ID NO: 282202 - DNA, 25 bp, Rattus norvegicus
ctttgcccaagagcctcagtgatga

SEQ ID NO: 282203 - DNA, 25 bp, Rattus norvegicus
ctttgcccacacacaggtaatgact

SEQ ID NO: 282204 - DNA, 25 bp, Rattus norvegicus
ctttgcccacactcaggtaatgact

SEQ ID NO: 282205 - DNA, 25 bp, Rattus norvegicus
ctttgcccacatcctgagtagaaat

SEQ ID NO: 282206 - DNA, 25 bp, Rattus norvegicus
ctttgcccacatgctgagtagaaat

SEQ ID NO: 282207 - DNA, 25 bp, Rattus norvegicus
ctttgcccactcaggtgaagctgaa

SEQ ID NO: 282208 - DNA, 25 bp, Rattus norvegicus
ctttgcccactctggtgaagctgaa

SEQ ID NO: 282209 - DNA, 25 bp, Rattus norvegicus
ctttgcccaggaattgactatttag

SEQ ID NO: 282210 - DNA, 25 bp, Rattus norvegicus
ctttgcccaggatttgactatttag

SEQ ID NO: 282211 - DNA, 25 bp, Rattus norvegicus
ctttgcccatggaccatagtacatg

SEQ ID NO: 282212 - DNA, 25 bp, Rattus norvegicus
ctttgcccatggtccatagtacatg

SEQ ID NO: 282213 - DNA, 25 bp, Rattus norvegicus
ctttgccccaaacgcttgattcttt

SEQ ID NO: 282214 - DNA, 25 bp, Rattus norvegicus
ctttgccccaaaggcttgattcttt

SEQ ID NO: 282215 - DNA, 25 bp, Rattus norvegicus
ctttgccccaacacttaaaacatag

SEQ ID NO: 282216 - DNA, 25 bp, Rattus norvegicus
ctttgccccaactcttaaaacatag

SEQ ID NO: 282217 - DNA, 25 bp, Rattus norvegicus
ctttgccccaccaatcaatagatgt

SEQ ID NO: 282218 - DNA, 25 bp, Rattus norvegicus
ctttgccccacctatcaatagatgt

SEQ ID NO: 282219 - DNA, 25 bp, Rattus norvegicus
ctttgccccgtgcagttggtgagaa

SEQ ID NO: 282220 - DNA, 25 bp, Rattus norvegicus
ctttgccccgtggagttggtgagaa

SEQ ID NO: 282221 - DNA, 25 bp, Rattus norvegicus
ctttgccctgtgacttatttcagat

SEQ ID NO: 282222 - DNA, 25 bp, Rattus norvegicus
ctttgccctgtgtcttatttcagat

SEQ ID NO: 282223 - DNA, 25 bp, Rattus norvegicus
ctttgccgatctccgtctataagaa

SEQ ID NO: 282224 - DNA, 25 bp, Rattus norvegicus
ctttgccgatctgcgtctataagaa

SEQ ID NO: 282225 - DNA, 25 bp, Rattus norvegicus
ctttgccgtctcacttcaggaaaag

SEQ ID NO: 282226 - DNA, 25 bp, Rattus norvegicus
ctttgccgtctctcttcaggaaaag

SEQ ID NO: 282227 - DNA, 25 bp, Rattus norvegicus
ctttgcctataacccaagtgacctt

SEQ ID NO: 282228 - DNA, 25 bp, Rattus norvegicus
ctttgcctataagccaagtgacctt

SEQ ID NO: 282229 - DNA, 25 bp, Rattus norvegicus
ctttgcctcacaataaaactcatcc

SEQ ID NO: 282230 - DNA, 25 bp, Rattus norvegicus
ctttgcctcacattaaaactcatcc

SEQ ID NO: 282231 - DNA, 25 bp, Rattus norvegicus
ctttgcctcattccgtactgatcat

SEQ ID NO: 282232 - DNA, 25 bp, Rattus norvegicus
ctttgcctcattgcgtactgatcat

SEQ ID NO: 282233 - DNA, 25 bp, Rattus norvegicus
ctttgcctctgtatttggagctttt

SEQ ID NO: 282234 - DNA, 25 bp, Rattus norvegicus
ctttgcctctgtttttggagctttt

SEQ ID NO: 282235 - DNA, 25 bp, Rattus norvegicus
ctttgcctctttacatcgtggatgc

SEQ ID NO: 282236 - DNA, 25 bp, Rattus norvegicus
ctttgcctctttactgtggcatgaa

SEQ ID NO: 282237 - DNA, 25 bp, Rattus norvegicus
ctttgcctcttttcatcgtggatgc

SEQ ID NO: 282238 - DNA, 25 bp, Rattus norvegicus
ctttgcctcttttctgtggcatgaa

SEQ ID NO: 282239 - DNA, 25 bp, Rattus norvegicus
ctttgccttaaacccttgggtcctg

SEQ ID NO: 282240 - DNA, 25 bp, Rattus norvegicus
ctttgccttaaagccttgggtcctg

SEQ ID NO: 282241 - DNA, 25 bp, Rattus norvegicus
ctttgccttaatccactcatattca

SEQ ID NO: 282242 - DNA, 25 bp, Rattus norvegicus
ctttgccttaatgcactcatattca

SEQ ID NO: 282243 - DNA, 25 bp, Rattus norvegicus
ctttgccttaggaagagctttctgc

SEQ ID NO: 282244 - DNA, 25 bp, Rattus norvegicus
ctttgccttaggtagagctttctgc

SEQ ID NO: 282245 - DNA, 25 bp, Rattus norvegicus
ctttgccttgcaacgagtgtacaca

SEQ ID NO: 282246 - DNA, 25 bp, Rattus norvegicus
ctttgccttgcatcgagtgtacaca

SEQ ID NO: 282247 - DNA, 25 bp, Rattus norvegicus
ctttgcctttgtcgagtttgagtct

SEQ ID NO: 282248 - DNA, 25 bp, Rattus norvegicus
ctttgcctttgtggagtttgagtct

SEQ ID NO: 282249 - DNA, 25 bp, Rattus norvegicus
ctttgcgcaattcctaggctgtgat

SEQ ID NO: 282250 - DNA, 25 bp, Rattus norvegicus
ctttgcgcaattgctaggctgtgat

SEQ ID NO: 282251 - DNA, 25 bp, Rattus norvegicus
ctttgcgggtctaattgggtcttca

SEQ ID NO: 282252 - DNA, 25 bp, Rattus norvegicus
ctttgcgggtcttattgggtcttca

SEQ ID NO: 282253 - DNA, 25 bp, Rattus norvegicus
ctttgcgtcgctcgctgtgaagtat

SEQ ID NO: 282254 - DNA, 25 bp, Rattus norvegicus
ctttgcgtcgctggctgtgaagtat

SEQ ID NO: 282255 - DNA, 25 bp, Rattus norvegicus
ctttgcgtgtatacatgagtgtgga

SEQ ID NO: 282256 - DNA, 25 bp, Rattus norvegicus
ctttgcgtgtattcatgagtgtgga

SEQ ID NO: 282257 - DNA, 25 bp, Rattus norvegicus
ctttgctaaagtcgacaggttggct

SEQ ID NO: 282258 - DNA, 25 bp, Rattus norvegicus
ctttgctaaagtggacaggttggct

SEQ ID NO: 282259 - DNA, 25 bp, Rattus norvegicus
ctttgctaacttccattacccaggg

SEQ ID NO: 282260 - DNA, 25 bp, Rattus norvegicus
ctttgctaacttgcattacccaggg

SEQ ID NO: 282261 - DNA, 25 bp, Rattus norvegicus
ctttgctaaggtactgtggtgctga

SEQ ID NO: 282262 - DNA, 25 bp, Rattus norvegicus
ctttgctaaggttctgtggtgctga

SEQ ID NO: 282263 - DNA, 25 bp, Rattus norvegicus
ctttgctacagcagataggccggga

SEQ ID NO: 282264 - DNA, 25 bp, Rattus norvegicus
ctttgctacagctgataggccggga

SEQ ID NO: 282265 - DNA, 25 bp, Rattus norvegicus
ctttgctaccctaggtcatggagta

SEQ ID NO: 282266 - DNA, 25 bp, Rattus norvegicus
ctttgctacccttggtcatggagta

SEQ ID NO: 282267 - DNA, 25 bp, Rattus norvegicus
ctttgctccagcatggctgccttag

SEQ ID NO: 282268 - DNA, 25 bp, Rattus norvegicus
ctttgctccagcttggctgccttag

SEQ ID NO: 282269 - DNA, 25 bp, Rattus norvegicus
ctttgctccagtatgtgcaggacat

SEQ ID NO: 282270 - DNA, 25 bp, Rattus norvegicus
ctttgctccagtttgtgcaggacat

SEQ ID NO: 282271 - DNA, 25 bp, Rattus norvegicus
ctttgctcccggctgctgagattag

SEQ ID NO: 282272 - DNA, 25 bp, Rattus norvegicus
ctttgctcccgggtgctgagattag

SEQ ID NO: 282273 - DNA, 25 bp, Rattus norvegicus
ctttgctccctaagaaagccttcag

SEQ ID NO: 282274 - DNA, 25 bp, Rattus norvegicus
ctttgctccctatgaaagccttcag

SEQ ID NO: 282275 - DNA, 25 bp, Rattus norvegicus
ctttgctccgccagtatttatacat

SEQ ID NO: 282276 - DNA, 25 bp, Rattus norvegicus
ctttgctccgcctgtatttatacat

SEQ ID NO: 282277 - DNA, 25 bp, Rattus norvegicus
ctttgctccgtgagtgaatctcaag

SEQ ID NO: 282278 - DNA, 25 bp, Rattus norvegicus
ctttgctccgtgtgtgaatctcaag

SEQ ID NO: 282279 - DNA, 25 bp, Rattus norvegicus
ctttgctctatgctgctttttcaag

SEQ ID NO: 282280 - DNA, 25 bp, Rattus norvegicus
ctttgctctatggtgctttttcaag

SEQ ID NO: 282281 - DNA, 25 bp, Rattus norvegicus
ctttgctctggcattgacaggttga

SEQ ID NO: 282282 - DNA, 25 bp, Rattus norvegicus
ctttgctctggctttgacaggttga

SEQ ID NO: 282283 - DNA, 25 bp, Rattus norvegicus
ctttgctctggtcgatcatggtgac

SEQ ID NO: 282284 - DNA, 25 bp, Rattus norvegicus
ctttgctctggtggatcatggtgac

SEQ ID NO: 282285 - DNA, 25 bp, Rattus norvegicus
ctttgctctgtgacccagatttatt

SEQ ID NO: 282286 - DNA, 25 bp, Rattus norvegicus
ctttgctctgtgtcccagatttatt

SEQ ID NO: 282287 - DNA, 25 bp, Rattus norvegicus
ctttgctcttgtacttcgtggtata

SEQ ID NO: 282288 - DNA, 25 bp, Rattus norvegicus
ctttgctcttgttcttcgtggtata

SEQ ID NO: 282289 - DNA, 25 bp, Rattus norvegicus
ctttgctgaaatcgcagccctgcgt

SEQ ID NO: 282290 - DNA, 25 bp, Rattus norvegicus
ctttgctgaaatggcagccctgcgt

SEQ ID NO: 282291 - DNA, 25 bp, Rattus norvegicus
ctttgctgcttaaactttgtgcctt

SEQ ID NO: 282292 - DNA, 25 bp, Rattus norvegicus
ctttgctgcttatactttgtgcctt

SEQ ID NO: 282293 - DNA, 25 bp, Rattus norvegicus
ctttgctggcaaacagctggaggat

SEQ ID NO: 282294 - DNA, 25 bp, Rattus norvegicus
ctttgctggcaatcagctggaggat

SEQ ID NO: 282295 - DNA, 25 bp, Rattus norvegicus
ctttgctggttaaagtacggagtct

SEQ ID NO: 282296 - DNA, 25 bp, Rattus norvegicus
ctttgctggttatagtacggagtct

SEQ ID NO: 282297 - DNA, 25 bp, Rattus norvegicus
ctttgctgtgtcctttacaggtaca

SEQ ID NO: 282298 - DNA, 25 bp, Rattus norvegicus
ctttgctgtgtcgtttacaggtaca

SEQ ID NO: 282299 - DNA, 25 bp, Rattus norvegicus
ctttgcttatttagtatccactata

SEQ ID NO: 282300 - DNA, 25 bp, Rattus norvegicus
ctttgcttattttgtatccactata

SEQ ID NO: 282301 - DNA, 25 bp, Rattus norvegicus
ctttgcttcaagattggacctactg

SEQ ID NO: 282302 - DNA, 25 bp, Rattus norvegicus
ctttgcttcaagtttggacctactg

SEQ ID NO: 282303 - DNA, 25 bp, Rattus norvegicus
ctttgcttcctgcagaccaaggaga

SEQ ID NO: 282304 - DNA, 25 bp, Rattus norvegicus
ctttgcttcctggagaccaaggaga

SEQ ID NO: 282305 - DNA, 25 bp, Rattus norvegicus
ctttgcttctgcatttaacaccatg

SEQ ID NO: 282306 - DNA, 25 bp, Rattus norvegicus
ctttgcttctgcttttaacaccatg

SEQ ID NO: 282307 - DNA, 25 bp, Rattus norvegicus
ctttgcttctttaaactgttataga

SEQ ID NO: 282308 - DNA, 25 bp, Rattus norvegicus
ctttgcttcttttaactgttataga

SEQ ID NO: 282309 - DNA, 25 bp, Rattus norvegicus
ctttgcttgactatcatgaccttaa

SEQ ID NO: 282310 - DNA, 25 bp, Rattus norvegicus
ctttgcttgactttcatgaccttaa

SEQ ID NO: 282311 - DNA, 25 bp, Rattus norvegicus
ctttgcttgtaaagtggctggccca

SEQ ID NO: 282312 - DNA, 25 bp, Rattus norvegicus
ctttgcttgtaatgtggctggccca

SEQ ID NO: 282313 - DNA, 25 bp, Rattus norvegicus
ctttgctttggcatcagttgtattg

SEQ ID NO: 282314 - DNA, 25 bp, Rattus norvegicus
ctttgctttggcttcagttgtattg

SEQ ID NO: 282315 - DNA, 25 bp, Rattus norvegicus
ctttgcttttctcttgaaccatgat

SEQ ID NO: 282316 - DNA, 25 bp, Rattus norvegicus
ctttgcttttctgttgaaccatgat

SEQ ID NO: 282317 - DNA, 25 bp, Rattus norvegicus
ctttggaaaagaatctgcagctgaa

SEQ ID NO: 282318 - DNA, 25 bp, Rattus norvegicus
ctttggaaaagattctgcagctgaa

SEQ ID NO: 282319 - DNA, 25 bp, Rattus norvegicus
ctttggaaagctcaggacctagtat

SEQ ID NO: 282320 - DNA, 25 bp, Rattus norvegicus
ctttggaaagctgaggacctagtat

SEQ ID NO: 282321 - DNA, 25 bp, Rattus norvegicus
ctttggacaaacaagctgcatgtgt

SEQ ID NO: 282322 - DNA, 25 bp, Rattus norvegicus
ctttggacaaactagctgcatgtgt

SEQ ID NO: 282323 - DNA, 25 bp, Rattus norvegicus
ctttggacgcagacagagtggacta

SEQ ID NO: 282324 - DNA, 25 bp, Rattus norvegicus
ctttggacgcagtcagagtggacta

SEQ ID NO: 282325 - DNA, 25 bp, Rattus norvegicus
ctttggactctcctctgggaagtta

SEQ ID NO: 282326 - DNA, 25 bp, Rattus norvegicus
ctttggactctcgtctgggaagtta

SEQ ID NO: 282327 - DNA, 25 bp, Rattus norvegicus
ctttggagagaaacgtagactcaga

SEQ ID NO: 282328 - DNA, 25 bp, Rattus norvegicus
ctttggagagaatcgtagactcaga

SEQ ID NO: 282329 - DNA, 25 bp, Rattus norvegicus
ctttggagagagaacttcaagtgca

SEQ ID NO: 282330 - DNA, 25 bp, Rattus norvegicus
ctttggagagagtacttcaagtgca

SEQ ID NO: 282331 - DNA, 25 bp, Rattus norvegicus
ctttggagctttcccctcagagcaa

SEQ ID NO: 282332 - DNA, 25 bp, Rattus norvegicus
ctttggagctttgccctcagagcaa

SEQ ID NO: 282333 - DNA, 25 bp, Rattus norvegicus
ctttggaggcgcacgctttcctggc

SEQ ID NO: 282334 - DNA, 25 bp, Rattus norvegicus
ctttggaggcgctcgctttcctggc

SEQ ID NO: 282335 - DNA, 25 bp, Rattus norvegicus
ctttggagtttactacattggctgt

SEQ ID NO: 282336 - DNA, 25 bp, Rattus norvegicus
ctttggagtttagtacattggctgt

SEQ ID NO: 282337 - DNA, 25 bp, Rattus norvegicus
ctttggataaaaatgctcactgatt

SEQ ID NO: 282338 - DNA, 25 bp, Rattus norvegicus
ctttggataaaattgctcactgatt

SEQ ID NO: 282339 - DNA, 25 bp, Rattus norvegicus
ctttggatagaacctttgtacttgt

SEQ ID NO: 282340 - DNA, 25 bp, Rattus norvegicus
ctttggatagaagctttgtacttgt

SEQ ID NO: 282341 - DNA, 25 bp, Rattus norvegicus
ctttggatgcctcgttagcactgaa

SEQ ID NO: 282342 - DNA, 25 bp, Rattus norvegicus
ctttggatgcctggttagcactgaa

SEQ ID NO: 282343 - DNA, 25 bp, Rattus norvegicus
ctttggatggccacacatgtggatt

SEQ ID NO: 282344 - DNA, 25 bp, Rattus norvegicus
ctttggatggcctcacatgtggatt

SEQ ID NO: 282345 - DNA, 25 bp, Rattus norvegicus
ctttggattgtcagtgtgcaggcac

SEQ ID NO: 282346 - DNA, 25 bp, Rattus norvegicus
ctttggattgtctgtgtgcaggcac

SEQ ID NO: 282347 - DNA, 25 bp, Rattus norvegicus
ctttggatttccagcttgccacaga

SEQ ID NO: 282348 - DNA, 25 bp, Rattus norvegicus
ctttggatttcctgcttgccacaga

SEQ ID NO: 282349 - DNA, 25 bp, Rattus norvegicus
ctttggattttgacaggctcttgga

SEQ ID NO: 282350 - DNA, 25 bp, Rattus norvegicus
ctttggattttgtcaggctcttgga

SEQ ID NO: 282351 - DNA, 25 bp, Rattus norvegicus
ctttggcaagctctggtctgattct

SEQ ID NO: 282352 - DNA, 25 bp, Rattus norvegicus
ctttggcaagctgtggtctgattct

SEQ ID NO: 282353 - DNA, 25 bp, Rattus norvegicus
ctttggcactgaagtcttgctggag

SEQ ID NO: 282354 - DNA, 25 bp, Rattus norvegicus
ctttggcactgatgtcttgctggag

SEQ ID NO: 282355 - DNA, 25 bp, Rattus norvegicus
ctttggcagaagacaacactttgga

SEQ ID NO: 282356 - DNA, 25 bp, Rattus norvegicus
ctttggcagaagtcaacactttgga

SEQ ID NO: 282357 - DNA, 25 bp, Rattus norvegicus
ctttggcagctaaggaagaaccaaa

SEQ ID NO: 282358 - DNA, 25 bp, Rattus norvegicus
ctttggcagctatggaagaaccaaa

SEQ ID NO: 282359 - DNA, 25 bp, Rattus norvegicus
ctttggccacaaaggcggatattct

SEQ ID NO: 282360 - DNA, 25 bp, Rattus norvegicus
ctttggccacaatggcggatattct

SEQ ID NO: 282361 - DNA, 25 bp, Rattus norvegicus
ctttggccacttcattgaattcgat

SEQ ID NO: 282362 - DNA, 25 bp, Rattus norvegicus
ctttggccacttgattgaattcgat

SEQ ID NO: 282363 - DNA, 25 bp, Rattus norvegicus
ctttggccaggtattataggttgct

SEQ ID NO: 282364 - DNA, 25 bp, Rattus norvegicus
ctttggccaggttttataggttgct

SEQ ID NO: 282365 - DNA, 25 bp, Rattus norvegicus
ctttggcccagccagatgttgacac

SEQ ID NO: 282366 - DNA, 25 bp, Rattus norvegicus
ctttggcccagcgagatgttgacac

SEQ ID NO: 282367 - DNA, 25 bp, Rattus norvegicus
ctttggcctagcaaaggcagagctt

SEQ ID NO: 282368 - DNA, 25 bp, Rattus norvegicus
ctttggcctagctaaggcagagctt

SEQ ID NO: 282369 - DNA, 25 bp, Rattus norvegicus
ctttggcctataccacctgagtggg

SEQ ID NO: 282370 - DNA, 25 bp, Rattus norvegicus
ctttggcctatagcacctgagtggg

SEQ ID NO: 282371 - DNA, 25 bp, Rattus norvegicus
ctttggcctgatccagccggaggaa

SEQ ID NO: 282372 - DNA, 25 bp, Rattus norvegicus
ctttggcctgatgcagccggaggaa

SEQ ID NO: 282373 - DNA, 25 bp, Rattus norvegicus
ctttggcctttgcttgtaattgaga

SEQ ID NO: 282374 - DNA, 25 bp, Rattus norvegicus
ctttggcctttggttgtaattgaga

SEQ ID NO: 282375 - DNA, 25 bp, Rattus norvegicus
ctttggcgaggacttggactgcttc

SEQ ID NO: 282376 - DNA, 25 bp, Rattus norvegicus
ctttggcgaggagttggactgcttc

SEQ ID NO: 282377 - DNA, 25 bp, Rattus norvegicus
ctttggcgctccagttggattaaca

SEQ ID NO: 282378 - DNA, 25 bp, Rattus norvegicus
ctttggcgctcctgttggattaaca

SEQ ID NO: 282379 - DNA, 25 bp, Rattus norvegicus
ctttggcggtcacgaacactacact

SEQ ID NO: 282380 - DNA, 25 bp, Rattus norvegicus
ctttggcggtcaggaacactacact

SEQ ID NO: 282381 - DNA, 25 bp, Rattus norvegicus
ctttggctcatgctgacggacaata

SEQ ID NO: 282382 - DNA, 25 bp, Rattus norvegicus
ctttggctcatggtgacggacaata

SEQ ID NO: 282383 - DNA, 25 bp, Rattus norvegicus
ctttggctcctgagtaaagctgtaa

SEQ ID NO: 282384 - DNA, 25 bp, Rattus norvegicus
ctttggctcctgtgtaaagctgtaa

SEQ ID NO: 282385 - DNA, 25 bp, Rattus norvegicus
ctttggctcgttattggtccatcag

SEQ ID NO: 282386 - DNA, 25 bp, Rattus norvegicus
ctttggctcgtttttggtccatcag

SEQ ID NO: 282387 - DNA, 25 bp, Rattus norvegicus
ctttggctctatagtccttgaccga

SEQ ID NO: 282388 - DNA, 25 bp, Rattus norvegicus
ctttggctctattgtccttgaccga

SEQ ID NO: 282389 - DNA, 25 bp, Rattus norvegicus
ctttggctgaagaaaacatgttttt

SEQ ID NO: 282390 - DNA, 25 bp, Rattus norvegicus
ctttggctgaagactgcatctgttg

SEQ ID NO: 282391 - DNA, 25 bp, Rattus norvegicus
ctttggctgaagtaaacatgttttt

SEQ ID NO: 282392 - DNA, 25 bp, Rattus norvegicus
ctttggctgaagtctgcatctgttg

SEQ ID NO: 282393 - DNA, 25 bp, Rattus norvegicus
ctttggctgactcaaggtgggattc

SEQ ID NO: 282394 - DNA, 25 bp, Rattus norvegicus
ctttggctgactgaaggtgggattc

SEQ ID NO: 282395 - DNA, 25 bp, Rattus norvegicus
ctttggctgggaactgctatacata

SEQ ID NO: 282396 - DNA, 25 bp, Rattus norvegicus
ctttggctgggatctgctatacata

SEQ ID NO: 282397 - DNA, 25 bp, Rattus norvegicus
ctttggcttattaatagtggtgtaa

SEQ ID NO: 282398 - DNA, 25 bp, Rattus norvegicus
ctttggcttatttatagtggtgtaa

SEQ ID NO: 282399 - DNA, 25 bp, Rattus norvegicus
ctttggcttctccatattcacatgt

SEQ ID NO: 282400 - DNA, 25 bp, Rattus norvegicus
ctttggcttctcgatattcacatgt

SEQ ID NO: 282401 - DNA, 25 bp, Rattus norvegicus
ctttggcttgccctagatggatcag

SEQ ID NO: 282402 - DNA, 25 bp, Rattus norvegicus
ctttggcttgccgtagatggatcag

SEQ ID NO: 282403 - DNA, 25 bp, Rattus norvegicus
ctttgggagatcattacctatggga

SEQ ID NO: 282404 - DNA, 25 bp, Rattus norvegicus
ctttgggagatctttacctatggga

SEQ ID NO: 282405 - DNA, 25 bp, Rattus norvegicus
ctttgggagtctacataccctcagg

SEQ ID NO: 282406 - DNA, 25 bp, Rattus norvegicus
ctttgggagtcttcataccctcagg

SEQ ID NO: 282407 - DNA, 25 bp, Rattus norvegicus
ctttgggcagctagcttctatctaa

SEQ ID NO: 282408 - DNA, 25 bp, Rattus norvegicus
ctttgggcagcttgcttctatctaa

SEQ ID NO: 282409 - DNA, 25 bp, Rattus norvegicus
ctttgggcattcatcctggagtgtg

SEQ ID NO: 282410 - DNA, 25 bp, Rattus norvegicus
ctttgggcattcttcctggagtgtg

SEQ ID NO: 282411 - DNA, 25 bp, Rattus norvegicus
ctttgggccattctaattcgcggaa

SEQ ID NO: 282412 - DNA, 25 bp, Rattus norvegicus
ctttgggccattgtaattcgcggaa

SEQ ID NO: 282413 - DNA, 25 bp, Rattus norvegicus
ctttgggcccaacggattcggctat

SEQ ID NO: 282414 - DNA, 25 bp, Rattus norvegicus
ctttgggcccaagggattcggctat

SEQ ID NO: 282415 - DNA, 25 bp, Rattus norvegicus
ctttgggcccttaaacagagactat

SEQ ID NO: 282416 - DNA, 25 bp, Rattus norvegicus
ctttgggccctttaacagagactat

SEQ ID NO: 282417 - DNA, 25 bp, Rattus norvegicus
ctttgggctcacatttccaggaaga

SEQ ID NO: 282418 - DNA, 25 bp, Rattus norvegicus
ctttgggctcacttttccaggaaga

SEQ ID NO: 282419 - DNA, 25 bp, Rattus norvegicus
ctttgggctcatcagtgcgttgaat

SEQ ID NO: 282420 - DNA, 25 bp, Rattus norvegicus
ctttgggctcatgagtgcgttgaat

SEQ ID NO: 282421 - DNA, 25 bp, Rattus norvegicus
ctttgggctcccactgggcagggcc

SEQ ID NO: 282422 - DNA, 25 bp, Rattus norvegicus
ctttgggctccctctgggcagggcc

SEQ ID NO: 282423 - DNA, 25 bp, Rattus norvegicus
ctttgggctgctcccaggcagagtt

SEQ ID NO: 282424 - DNA, 25 bp, Rattus norvegicus
ctttgggctgctgccaggcagagtt

SEQ ID NO: 282425 - DNA, 25 bp, Rattus norvegicus
ctttgggctgtgattagggtagatt

SEQ ID NO: 282426 - DNA, 25 bp, Rattus norvegicus
ctttgggctgtgtttagggtagatt

SEQ ID NO: 282427 - DNA, 25 bp, Rattus norvegicus
ctttgggctttcacttgggcagagg

SEQ ID NO: 282428 - DNA, 25 bp, Rattus norvegicus
ctttgggctttctcttgggcagagg

SEQ ID NO: 282429 - DNA, 25 bp, Rattus norvegicus
ctttgggtgctgatgtcaacgctca

SEQ ID NO: 282430 - DNA, 25 bp, Rattus norvegicus
ctttgggtgctgttgtcaacgctca

SEQ ID NO: 282431 - DNA, 25 bp, Rattus norvegicus
ctttgggttaatatctcatgtcttt

SEQ ID NO: 282432 - DNA, 25 bp, Rattus norvegicus
ctttgggttaatttctcatgtcttt

SEQ ID NO: 282433 - DNA, 25 bp, Rattus norvegicus
ctttgggttgttactggacattact

SEQ ID NO: 282434 - DNA, 25 bp, Rattus norvegicus
ctttgggttgtttctggacattact

SEQ ID NO: 282435 - DNA, 25 bp, Rattus norvegicus
ctttgggttttcagccttattctat

SEQ ID NO: 282436 - DNA, 25 bp, Rattus norvegicus
ctttgggttttctgccttattctat

SEQ ID NO: 282437 - DNA, 25 bp, Rattus norvegicus
ctttggtaaaacacagagctcgctg

SEQ ID NO: 282438 - DNA, 25 bp, Rattus norvegicus
ctttggtaaaactcagagctcgctg

SEQ ID NO: 282439 - DNA, 25 bp, Rattus norvegicus
ctttggtaagttctacagtgttatt

SEQ ID NO: 282440 - DNA, 25 bp, Rattus norvegicus
ctttggtaagttgtacagtgttatt

SEQ ID NO: 282441 - DNA, 25 bp, Rattus norvegicus
ctttggtacttaagcagtcctctgc

SEQ ID NO: 282442 - DNA, 25 bp, Rattus norvegicus
ctttggtacttatgcagtcctctgc

SEQ ID NO: 282443 - DNA, 25 bp, Rattus norvegicus
ctttggtcaagcatacactgtgtta

SEQ ID NO: 282444 - DNA, 25 bp, Rattus norvegicus
ctttggtcaagcttacactgtgtta

SEQ ID NO: 282445 - DNA, 25 bp, Rattus norvegicus
ctttggtccttcagttgtacatgct

SEQ ID NO: 282446 - DNA, 25 bp, Rattus norvegicus
ctttggtccttctgttgtacatgct

SEQ ID NO: 282447 - DNA, 25 bp, Rattus norvegicus
ctttggtgaatgaccctactgtagt

SEQ ID NO: 282448 - DNA, 25 bp, Rattus norvegicus
ctttggtgaatgtccctactgtagt

SEQ ID NO: 282449 - DNA, 25 bp, Rattus norvegicus
ctttggtgggacactttggtctgta

SEQ ID NO: 282450 - DNA, 25 bp, Rattus norvegicus
ctttggtgggactctttggtctgta

SEQ ID NO: 282451 - DNA, 25 bp, Rattus norvegicus
ctttggtgggttcttcagctgtata

SEQ ID NO: 282452 - DNA, 25 bp, Rattus norvegicus
ctttggtgggttgttcagctgtata

SEQ ID NO: 282453 - DNA, 25 bp, Rattus norvegicus
ctttggtgtatgctttgaggccttt

SEQ ID NO: 282454 - DNA, 25 bp, Rattus norvegicus
ctttggtgtatggtttgaggccttt

SEQ ID NO: 282455 - DNA, 25 bp, Rattus norvegicus
ctttggtgtgacagttggccttcct

SEQ ID NO: 282456 - DNA, 25 bp, Rattus norvegicus
ctttggtgtgactgttggccttcct

SEQ ID NO: 282457 - DNA, 25 bp, Rattus norvegicus
ctttggtgtgagcttttcggtttga

SEQ ID NO: 282458 - DNA, 25 bp, Rattus norvegicus
ctttggtgtgaggttttcggtttga

SEQ ID NO: 282459 - DNA, 25 bp, Rattus norvegicus
ctttggttctgccacattcccatgt

SEQ ID NO: 282460 - DNA, 25 bp, Rattus norvegicus
ctttggttctgcgacattcccatgt

SEQ ID NO: 282461 - DNA, 25 bp, Rattus norvegicus
ctttggttgctcagacctagggaat

SEQ ID NO: 282462 - DNA, 25 bp, Rattus norvegicus
ctttggttgctctgacctagggaat

SEQ ID NO: 282463 - DNA, 25 bp, Rattus norvegicus
ctttggtttctcaatgtctctacta

SEQ ID NO: 282464 - DNA, 25 bp, Rattus norvegicus
ctttggtttctctatgtctctacta

SEQ ID NO: 282465 - DNA, 25 bp, Rattus norvegicus
ctttggtttgcaatattttttatag

SEQ ID NO: 282466 - DNA, 25 bp, Rattus norvegicus
ctttggtttgcattattttttatag

SEQ ID NO: 282467 - DNA, 25 bp, Rattus norvegicus
ctttggtttggcaccttgtccagag

SEQ ID NO: 282468 - DNA, 25 bp, Rattus norvegicus
ctttggtttggctccttgtccagag

SEQ ID NO: 282469 - DNA, 25 bp, Rattus norvegicus
ctttggttttgtcgctttgctctat

SEQ ID NO: 282470 - DNA, 25 bp, Rattus norvegicus
ctttggttttgtggctttgctctat

SEQ ID NO: 282471 - DNA, 25 bp, Rattus norvegicus
ctttgtaaaccgctctgggtctgaa

SEQ ID NO: 282472 - DNA, 25 bp, Rattus norvegicus
ctttgtaaaccggtctgggtctgaa

SEQ ID NO: 282473 - DNA, 25 bp, Rattus norvegicus
ctttgtaacagacccatcgcttctc

SEQ ID NO: 282474 - DNA, 25 bp, Rattus norvegicus
ctttgtaacagagccatcgcttctc

SEQ ID NO: 282475 - DNA, 25 bp, Rattus norvegicus
ctttgtaagggcactctgtttaact

SEQ ID NO: 282476 - DNA, 25 bp, Rattus norvegicus
ctttgtaagggctctctgtttaact

SEQ ID NO: 282477 - DNA, 25 bp, Rattus norvegicus
ctttgtacatttacagtctcagagt

SEQ ID NO: 282478 - DNA, 25 bp, Rattus norvegicus
ctttgtacattttcagtctcagagt

SEQ ID NO: 282479 - DNA, 25 bp, Rattus norvegicus
ctttgtacgctacaacctgagggat

SEQ ID NO: 282480 - DNA, 25 bp, Rattus norvegicus
ctttgtacgctagaacctgagggat

SEQ ID NO: 282481 - DNA, 25 bp, Rattus norvegicus
ctttgtactttgatcctggtgactt

SEQ ID NO: 282482 - DNA, 25 bp, Rattus norvegicus
ctttgtactttgttcctggtgactt

SEQ ID NO: 282483 - DNA, 25 bp, Rattus norvegicus
ctttgtagccaacggaaatcccaga

SEQ ID NO: 282484 - DNA, 25 bp, Rattus norvegicus
ctttgtagccaagggaaatcccaga

SEQ ID NO: 282485 - DNA, 25 bp, Rattus norvegicus
ctttgtagtcaaatccaccttcttt

SEQ ID NO: 282486 - DNA, 25 bp, Rattus norvegicus
ctttgtagtcaattccaccttcttt

SEQ ID NO: 282487 - DNA, 25 bp, Rattus norvegicus
ctttgtagtgcacccgcaggttgtt

SEQ ID NO: 282488 - DNA, 25 bp, Rattus norvegicus
ctttgtagtgcagccgcaggttgtt

SEQ ID NO: 282489 - DNA, 25 bp, Rattus norvegicus
ctttgtagttcacctgtcagttaga

SEQ ID NO: 282490 - DNA, 25 bp, Rattus norvegicus
ctttgtagttcagctgtcagttaga

SEQ ID NO: 282491 - DNA, 25 bp, Rattus norvegicus
ctttgtagttttcgccatcattgga

SEQ ID NO: 282492 - DNA, 25 bp, Rattus norvegicus
ctttgtagttttggccatcattgga

SEQ ID NO: 282493 - DNA, 25 bp, Rattus norvegicus
ctttgtataactctgcctctaggat

SEQ ID NO: 282494 - DNA, 25 bp, Rattus norvegicus
ctttgtataactgtgcctctaggat

SEQ ID NO: 282495 - DNA, 25 bp, Rattus norvegicus
ctttgtatgggtatcttcagccctt

SEQ ID NO: 282496 - DNA, 25 bp, Rattus norvegicus
ctttgtatgggtttcttcagccctt

SEQ ID NO: 282497 - DNA, 25 bp, Rattus norvegicus
ctttgtattcttacatacctttgga

SEQ ID NO: 282498 - DNA, 25 bp, Rattus norvegicus
ctttgtattctttcatacctttgga

SEQ ID NO: 282499 - DNA, 25 bp, Rattus norvegicus
ctttgtattttaatcagcgccttat

SEQ ID NO: 282500 - DNA, 25 bp, Rattus norvegicus
ctttgtattttattcagcgccttat

SEQ ID NO: 282501 - DNA, 25 bp, Rattus norvegicus
ctttgtcaaaataaaggcctcgcac

SEQ ID NO: 282502 - DNA, 25 bp, Rattus norvegicus
ctttgtcaaaattaaggcctcgcac

SEQ ID NO: 282503 - DNA, 25 bp, Rattus norvegicus
ctttgtcaaccactgctataatcct

SEQ ID NO: 282504 - DNA, 25 bp, Rattus norvegicus
ctttgtcaaccagtgctataatcct

SEQ ID NO: 282505 - DNA, 25 bp, Rattus norvegicus
ctttgtcaacgtcgctggcagctcc

SEQ ID NO: 282506 - DNA, 25 bp, Rattus norvegicus
ctttgtcaacgtggctggcagctcc

SEQ ID NO: 282507 - DNA, 25 bp, Rattus norvegicus
ctttgtcaccatagttccccagagg

SEQ ID NO: 282508 - DNA, 25 bp, Rattus norvegicus
ctttgtcaccattgttccccagagg

SEQ ID NO: 282509 - DNA, 25 bp, Rattus norvegicus
ctttgtcagcacctgaccaatacag

SEQ ID NO: 282510 - DNA, 25 bp, Rattus norvegicus
ctttgtcagcacgtgaccaatacag

SEQ ID NO: 282511 - DNA, 25 bp, Rattus norvegicus
ctttgtcatgatcagttctagtgta

SEQ ID NO: 282512 - DNA, 25 bp, Rattus norvegicus
ctttgtcatgatgagttctagtgta

SEQ ID NO: 282513 - DNA, 25 bp, Rattus norvegicus
ctttgtcatgggattgtggtactac

SEQ ID NO: 282514 - DNA, 25 bp, Rattus norvegicus
ctttgtcatgggtttgtggtactac

SEQ ID NO: 282515 - DNA, 25 bp, Rattus norvegicus
ctttgtccagagaggcagtgttgct

SEQ ID NO: 282516 - DNA, 25 bp, Rattus norvegicus
ctttgtccagagtggcagtgttgct

SEQ ID NO: 282517 - DNA, 25 bp, Rattus norvegicus
ctttgtcccagaactacgagtggat

SEQ ID NO: 282518 - DNA, 25 bp, Rattus norvegicus
ctttgtcccagatctacgagtggat

SEQ ID NO: 282519 - DNA, 25 bp, Rattus norvegicus
ctttgtcccagcagtagaggcggaa

SEQ ID NO: 282520 - DNA, 25 bp, Rattus norvegicus
ctttgtcccagctgtagaggcggaa

SEQ ID NO: 282521 - DNA, 25 bp, Rattus norvegicus
ctttgtccctgacgaaagcggaggc

SEQ ID NO: 282522 - DNA, 25 bp, Rattus norvegicus
ctttgtccctgaggaaagcggaggc

SEQ ID NO: 282523 - DNA, 25 bp, Rattus norvegicus
ctttgtccctgtcctgaagagtaga

SEQ ID NO: 282524 - DNA, 25 bp, Rattus norvegicus
ctttgtccctgtgctgaagagtaga

SEQ ID NO: 282525 - DNA, 25 bp, Rattus norvegicus
ctttgtcctaagacttgagtgcctt

SEQ ID NO: 282526 - DNA, 25 bp, Rattus norvegicus
ctttgtcctaagtcttgagtgcctt

SEQ ID NO: 282527 - DNA, 25 bp, Rattus norvegicus
ctttgtcctgacacctatgtatatg

SEQ ID NO: 282528 - DNA, 25 bp, Rattus norvegicus
ctttgtcctgactcctatgtatatg

SEQ ID NO: 282529 - DNA, 25 bp, Rattus norvegicus
ctttgtcgtgctatgctggaagcta

SEQ ID NO: 282530 - DNA, 25 bp, Rattus norvegicus
ctttgtcgtgctttgctggaagcta

SEQ ID NO: 282531 - DNA, 25 bp, Rattus norvegicus
ctttgtctagggagctaggttcgta

SEQ ID NO: 282532 - DNA, 25 bp, Rattus norvegicus
ctttgtctagggtgctaggttcgta

SEQ ID NO: 282533 - DNA, 25 bp, Rattus norvegicus
ctttgtctctgacgactccagttta

SEQ ID NO: 282534 - DNA, 25 bp, Rattus norvegicus
ctttgtctctgaggactccagttta

SEQ ID NO: 282535 - DNA, 25 bp, Rattus norvegicus
ctttgtctgtaaaccatcatctgga

SEQ ID NO: 282536 - DNA, 25 bp, Rattus norvegicus
ctttgtctgtaatccatcatctgga

SEQ ID NO: 282537 - DNA, 25 bp, Rattus norvegicus
ctttgtctgttgacactttaagtga

SEQ ID NO: 282538 - DNA, 25 bp, Rattus norvegicus
ctttgtctgttgtcactttaagtga

SEQ ID NO: 282539 - DNA, 25 bp, Rattus norvegicus
ctttgtcttcctacatcagagtgat

SEQ ID NO: 282540 - DNA, 25 bp, Rattus norvegicus
ctttgtcttccttcatcagagtgat

SEQ ID NO: 282541 - DNA, 25 bp, Rattus norvegicus
ctttgtcttctgaaggtcaaggcgt

SEQ ID NO: 282542 - DNA, 25 bp, Rattus norvegicus
ctttgtcttctgtaggtcaaggcgt

SEQ ID NO: 282543 - DNA, 25 bp, Rattus norvegicus
ctttgtcttggtactgttatgcata

SEQ ID NO: 282544 - DNA, 25 bp, Rattus norvegicus
ctttgtcttggttctgttatgcata

SEQ ID NO: 282545 - DNA, 25 bp, Rattus norvegicus
ctttgtctttgccttgtctattatg

SEQ ID NO: 282546 - DNA, 25 bp, Rattus norvegicus
ctttgtctttgcgttgtctattatg

SEQ ID NO: 282547 - DNA, 25 bp, Rattus norvegicus
ctttgtcttttgctattgacccggg

SEQ ID NO: 282548 - DNA, 25 bp, Rattus norvegicus
ctttgtcttttggtattgacccggg

SEQ ID NO: 282549 - DNA, 25 bp, Rattus norvegicus
ctttgtgaacaactcaaatggttat

SEQ ID NO: 282550 - DNA, 25 bp, Rattus norvegicus
ctttgtgaacaagtcaaatggttat

SEQ ID NO: 282551 - DNA, 25 bp, Rattus norvegicus
ctttgtgaacatagcaattgcctta

SEQ ID NO: 282552 - DNA, 25 bp, Rattus norvegicus
ctttgtgaacattgcaattgcctta

SEQ ID NO: 282553 - DNA, 25 bp, Rattus norvegicus
ctttgtgaagcaagttcctgtgtga

SEQ ID NO: 282554 - DNA, 25 bp, Rattus norvegicus
ctttgtgaagcatgttcctgtgtga

SEQ ID NO: 282555 - DNA, 25 bp, Rattus norvegicus
ctttgtgaagtgatttgacatcccc

SEQ ID NO: 282556 - DNA, 25 bp, Rattus norvegicus
ctttgtgaagtgttttgacatcccc

SEQ ID NO: 282557 - DNA, 25 bp, Rattus norvegicus
ctttgtgacatgaactgatactctc

SEQ ID NO: 282558 - DNA, 25 bp, Rattus norvegicus
ctttgtgacatgtactgatactctc

SEQ ID NO: 282559 - DNA, 25 bp, Rattus norvegicus
ctttgtgacctcaggcttagaaggg

SEQ ID NO: 282560 - DNA, 25 bp, Rattus norvegicus
ctttgtgacctctggcttagaaggg

SEQ ID NO: 282561 - DNA, 25 bp, Rattus norvegicus
ctttgtgaggttaccatggcatcat

SEQ ID NO: 282562 - DNA, 25 bp, Rattus norvegicus
ctttgtgaggtttccatggcatcat

SEQ ID NO: 282563 - DNA, 25 bp, Rattus norvegicus
ctttgtgagtcaagctgggttctac

SEQ ID NO: 282564 - DNA, 25 bp, Rattus norvegicus
ctttgtgagtcatgctgggttctac

SEQ ID NO: 282565 - DNA, 25 bp, Rattus norvegicus
ctttgtgatgctatgaccctttcat

SEQ ID NO: 282566 - DNA, 25 bp, Rattus norvegicus
ctttgtgatgctttgaccctttcat

SEQ ID NO: 282567 - DNA, 25 bp, Rattus norvegicus
ctttgtgcacacatgagttacctta

SEQ ID NO: 282568 - DNA, 25 bp, Rattus norvegicus
ctttgtgcacacttgagttacctta

SEQ ID NO: 282569 - DNA, 25 bp, Rattus norvegicus
ctttgtgccgagaacagagatagag

SEQ ID NO: 282570 - DNA, 25 bp, Rattus norvegicus
ctttgtgccgagtacagagatagag

SEQ ID NO: 282571 - DNA, 25 bp, Rattus norvegicus
ctttgtgcgctgagagggtctgaaa

SEQ ID NO: 282572 - DNA, 25 bp, Rattus norvegicus
ctttgtgcgctgtgagggtctgaaa

SEQ ID NO: 282573 - DNA, 25 bp, Rattus norvegicus
ctttgtgctgctacttgctgagaca

SEQ ID NO: 282574 - DNA, 25 bp, Rattus norvegicus
ctttgtgctgcttcttgctgagaca

SEQ ID NO: 282575 - DNA, 25 bp, Rattus norvegicus
ctttgtgctgtcctgtaaggtgaca

SEQ ID NO: 282576 - DNA, 25 bp, Rattus norvegicus
ctttgtgctgtcgtgtaaggtgaca

SEQ ID NO: 282577 - DNA, 25 bp, Rattus norvegicus
ctttgtgcttttacatgttcggtac

SEQ ID NO: 282578 - DNA, 25 bp, Rattus norvegicus
ctttgtgctttttcatgttcggtac

SEQ ID NO: 282579 - DNA, 25 bp, Rattus norvegicus
ctttgtggaataatactgctgccct

SEQ ID NO: 282580 - DNA, 25 bp, Rattus norvegicus
ctttgtggaatattactgctgccct

SEQ ID NO: 282581 - DNA, 25 bp, Rattus norvegicus
ctttgtggaatgagtagccgccatt

SEQ ID NO: 282582 - DNA, 25 bp, Rattus norvegicus
ctttgtggaatgtgtagccgccatt

SEQ ID NO: 282583 - DNA, 25 bp, Rattus norvegicus
ctttgtggacatccagaatttctat

SEQ ID NO: 282584 - DNA, 25 bp, Rattus norvegicus
ctttgtggacatgcagaatttctat

SEQ ID NO: 282585 - DNA, 25 bp, Rattus norvegicus
ctttgtggcacaaagtgaagccaaa

SEQ ID NO: 282586 - DNA, 25 bp, Rattus norvegicus
ctttgtggcacatagtgaagccaaa

SEQ ID NO: 282587 - DNA, 25 bp, Rattus norvegicus
ctttgtgggatacagctgtgctcgc

SEQ ID NO: 282588 - DNA, 25 bp, Rattus norvegicus
ctttgtgggatagagctgtgctcgc

SEQ ID NO: 282589 - DNA, 25 bp, Rattus norvegicus
ctttgtgggcttatacactaaactg

SEQ ID NO: 282590 - DNA, 25 bp, Rattus norvegicus
ctttgtgggcttttacactaaactg

SEQ ID NO: 282591 - DNA, 25 bp, Rattus norvegicus
ctttgtgtcaataggtttcagcatc

SEQ ID NO: 282592 - DNA, 25 bp, Rattus norvegicus
ctttgtgtcaattggtttcagcatc

SEQ ID NO: 282593 - DNA, 25 bp, Rattus norvegicus
ctttgtgtccttaccgacttatgga

SEQ ID NO: 282594 - DNA, 25 bp, Rattus norvegicus
ctttgtgtcctttccgacttatgga

SEQ ID NO: 282595 - DNA, 25 bp, Rattus norvegicus
ctttgtgtctcacgtgtctcttggc

SEQ ID NO: 282596 - DNA, 25 bp, Rattus norvegicus
ctttgtgtctcaggtgtctcttggc

SEQ ID NO: 282597 - DNA, 25 bp, Rattus norvegicus
ctttgtgtcttgatcaggagaaaag

SEQ ID NO: 282598 - DNA, 25 bp, Rattus norvegicus
ctttgtgtcttgttcaggagaaaag

SEQ ID NO: 282599 - DNA, 25 bp, Rattus norvegicus
ctttgtgtgacgaccttacctggga

SEQ ID NO: 282600 - DNA, 25 bp, Rattus norvegicus
ctttgtgtgacgtccttacctggga

SEQ ID NO: 282601 - DNA, 25 bp, Rattus norvegicus
ctttgtgtgcgccttgaagaggcct

SEQ ID NO: 282602 - DNA, 25 bp, Rattus norvegicus
ctttgtgtgcgcgttgaagaggcct

SEQ ID NO: 282603 - DNA, 25 bp, Rattus norvegicus
ctttgtgtgtgacctagacccagaa

SEQ ID NO: 282604 - DNA, 25 bp, Rattus norvegicus
ctttgtgtgtgagctagacccagaa

SEQ ID NO: 282605 - DNA, 25 bp, Rattus norvegicus
ctttgtgttattactgctcctataa

SEQ ID NO: 282606 - DNA, 25 bp, Rattus norvegicus
ctttgtgttatttctgctcctataa

SEQ ID NO: 282607 - DNA, 25 bp, Rattus norvegicus
ctttgtgttctacttgggttggcag

SEQ ID NO: 282608 - DNA, 25 bp, Rattus norvegicus
ctttgtgttctagttgggttggcag

SEQ ID NO: 282609 - DNA, 25 bp, Rattus norvegicus
ctttgtgttctgattagtcctgatc

SEQ ID NO: 282610 - DNA, 25 bp, Rattus norvegicus
ctttgtgttctgtttagtcctgatc

SEQ ID NO: 282611 - DNA, 25 bp, Rattus norvegicus
ctttgtgtttgcatttgttggctac

SEQ ID NO: 282612 - DNA, 25 bp, Rattus norvegicus
ctttgtgtttgcttttgttggctac

SEQ ID NO: 282613 - DNA, 25 bp, Rattus norvegicus
ctttgttaaggcagaccagggacct

SEQ ID NO: 282614 - DNA, 25 bp, Rattus norvegicus
ctttgttaaggctgaccagggacct

SEQ ID NO: 282615 - DNA, 25 bp, Rattus norvegicus
ctttgttcattaatccttagcccac

SEQ ID NO: 282616 - DNA, 25 bp, Rattus norvegicus
ctttgttcattattccttagcccac

SEQ ID NO: 282617 - DNA, 25 bp, Rattus norvegicus
ctttgttccaatcctggctgtcagg

SEQ ID NO: 282618 - DNA, 25 bp, Rattus norvegicus
ctttgttccaatgctggctgtcagg

SEQ ID NO: 282619 - DNA, 25 bp, Rattus norvegicus
ctttgttccatgaagtccgctggga

SEQ ID NO: 282620 - DNA, 25 bp, Rattus norvegicus
ctttgttccatgtagtccgctggga

SEQ ID NO: 282621 - DNA, 25 bp, Rattus norvegicus
ctttgttcccttctaacacactaag

SEQ ID NO: 282622 - DNA, 25 bp, Rattus norvegicus
ctttgttcccttgtaacacactaag

SEQ ID NO: 282623 - DNA, 25 bp, Rattus norvegicus
ctttgtttccttatattcgctaaat

SEQ ID NO: 282624 - DNA, 25 bp, Rattus norvegicus
ctttgtttccttttattcgctaaat

SEQ ID NO: 282625 - DNA, 25 bp, Rattus norvegicus
ctttgtttctctcccaatgtttgga

SEQ ID NO: 282626 - DNA, 25 bp, Rattus norvegicus
ctttgtttctctgccaatgtttgga

SEQ ID NO: 282627 - DNA, 25 bp, Rattus norvegicus
ctttgtttctgtaatactgctttca

SEQ ID NO: 282628 - DNA, 25 bp, Rattus norvegicus
ctttgtttctgttatactgctttca

SEQ ID NO: 282629 - DNA, 25 bp, Rattus norvegicus
ctttgtttcttcagtctgggtctgt

SEQ ID NO: 282630 - DNA, 25 bp, Rattus norvegicus
ctttgtttcttctgtctgggtctgt

SEQ ID NO: 282631 - DNA, 25 bp, Rattus norvegicus
ctttgtttgagaatgatgccttgta

SEQ ID NO: 282632 - DNA, 25 bp, Rattus norvegicus
ctttgtttgagattgatgccttgta

SEQ ID NO: 282633 - DNA, 25 bp, Rattus norvegicus
ctttgtttggtcaacggatggttca

SEQ ID NO: 282634 - DNA, 25 bp, Rattus norvegicus
ctttgtttggtctacggatggttca

SEQ ID NO: 282635 - DNA, 25 bp, Rattus norvegicus
ctttgttttacaacatgcaccccaa

SEQ ID NO: 282636 - DNA, 25 bp, Rattus norvegicus
ctttgttttacatcatgcaccccaa

SEQ ID NO: 282637 - DNA, 25 bp, Rattus norvegicus
ctttgtttttatagtgcttggcgga

SEQ ID NO: 282638 - DNA, 25 bp, Rattus norvegicus
ctttgtttttattgtgcttggcgga

SEQ ID NO: 282639 - DNA, 25 bp, Rattus norvegicus
cttttaaagacacgcatcaccacac

SEQ ID NO: 282640 - DNA, 25 bp, Rattus norvegicus
cttttaaagacaggcatcaccacac

SEQ ID NO: 282641 - DNA, 25 bp, Rattus norvegicus
cttttaaagtatcctctggatcgct

SEQ ID NO: 282642 - DNA, 25 bp, Rattus norvegicus
cttttaaagtatgctctggatcgct

SEQ ID NO: 282643 - DNA, 25 bp, Rattus norvegicus
cttttaacctatatatacacctgag

SEQ ID NO: 282644 - DNA, 25 bp, Rattus norvegicus
cttttaacctatttatacacctgag

SEQ ID NO: 282645 - DNA, 25 bp, Rattus norvegicus
cttttaacgagcagtcaccatgaat

SEQ ID NO: 282646 - DNA, 25 bp, Rattus norvegicus
cttttaacgagctgtcaccatgaat

SEQ ID NO: 282647 - DNA, 25 bp, Rattus norvegicus
cttttaagtctgaggatctgctgat

SEQ ID NO: 282648 - DNA, 25 bp, Rattus norvegicus
cttttaagtctgtggatctgctgat

SEQ ID NO: 282649 - DNA, 25 bp, Rattus norvegicus
cttttaatacctctgactctcatcc

SEQ ID NO: 282650 - DNA, 25 bp, Rattus norvegicus
cttttaatacctgtgactctcatcc

SEQ ID NO: 282651 - DNA, 25 bp, Rattus norvegicus
cttttaatctcactgtgtgtgggag

SEQ ID NO: 282652 - DNA, 25 bp, Rattus norvegicus
cttttaatctcagtgtgtgtgggag

SEQ ID NO: 282653 - DNA, 25 bp, Rattus norvegicus
cttttaattgacctgggacagctta

SEQ ID NO: 282654 - DNA, 25 bp, Rattus norvegicus
cttttaattgacgtgggacagctta

SEQ ID NO: 282655 - DNA, 25 bp, Rattus norvegicus
cttttacatttcagagggctcgccg

SEQ ID NO: 282656 - DNA, 25 bp, Rattus norvegicus
cttttacatttctgagggctcgccg

SEQ ID NO: 282657 - DNA, 25 bp, Rattus norvegicus
cttttacctttgcagatgtttgaga

SEQ ID NO: 282658 - DNA, 25 bp, Rattus norvegicus
cttttacctttggagatgtttgaga

SEQ ID NO: 282659 - DNA, 25 bp, Rattus norvegicus
cttttacgtcatccccgaaggagag

SEQ ID NO: 282660 - DNA, 25 bp, Rattus norvegicus
cttttacgtcatgcccgaaggagag

SEQ ID NO: 282661 - DNA, 25 bp, Rattus norvegicus
cttttactagtcacagggtcctgct

SEQ ID NO: 282662 - DNA, 25 bp, Rattus norvegicus
cttttactagtctcagggtcctgct

SEQ ID NO: 282663 - DNA, 25 bp, Rattus norvegicus
cttttactctcacttctctggtgat

SEQ ID NO: 282664 - DNA, 25 bp, Rattus norvegicus
cttttactctcagttctctggtgat

SEQ ID NO: 282665 - DNA, 25 bp, Rattus norvegicus
cttttactgcttctgctgtgactaa

SEQ ID NO: 282666 - DNA, 25 bp, Rattus norvegicus
cttttactgcttgtgctgtgactaa

SEQ ID NO: 282667 - DNA, 25 bp, Rattus norvegicus
cttttacttttgacgattcaccaag

SEQ ID NO: 282668 - DNA, 25 bp, Rattus norvegicus
cttttacttttgtcgattcaccaag

SEQ ID NO: 282669 - DNA, 25 bp, Rattus norvegicus
cttttagaagctattaccatgtgga

SEQ ID NO: 282670 - DNA, 25 bp, Rattus norvegicus
cttttagaagcttttaccatgtgga

SEQ ID NO: 282671 - DNA, 25 bp, Rattus norvegicus
cttttagctatgagggttgttccct

SEQ ID NO: 282672 - DNA, 25 bp, Rattus norvegicus
cttttagctatgtgggttgttccct

SEQ ID NO: 282673 - DNA, 25 bp, Rattus norvegicus
cttttaggaggccatgtctctttca

SEQ ID NO: 282674 - DNA, 25 bp, Rattus norvegicus
cttttaggaggcgatgtctctttca

SEQ ID NO: 282675 - DNA, 25 bp, Rattus norvegicus
cttttagtaacaatcagacagcaat

SEQ ID NO: 282676 - DNA, 25 bp, Rattus norvegicus
cttttagtaacattcagacagcaat

SEQ ID NO: 282677 - DNA, 25 bp, Rattus norvegicus
cttttataacttcatgtccccttgt

SEQ ID NO: 282678 - DNA, 25 bp, Rattus norvegicus
cttttataacttgatgtccccttgt

SEQ ID NO: 282679 - DNA, 25 bp, Rattus norvegicus
cttttatacatcatggtgtctccat

SEQ ID NO: 282680 - DNA, 25 bp, Rattus norvegicus
cttttatacatcttggtgtctccat

SEQ ID NO: 282681 - DNA, 25 bp, Rattus norvegicus
cttttatccgcacagaaacctgaga

SEQ ID NO: 282682 - DNA, 25 bp, Rattus norvegicus
cttttatccgcagagaaacctgaga

SEQ ID NO: 282683 - DNA, 25 bp, Rattus norvegicus
cttttatcctctagtgtattcactc

SEQ ID NO: 282684 - DNA, 25 bp, Rattus norvegicus
cttttatcctcttgtgtattcactc

SEQ ID NO: 282685 - DNA, 25 bp, Rattus norvegicus
cttttatcgctaatttaataccaga

SEQ ID NO: 282686 - DNA, 25 bp, Rattus norvegicus
cttttatcgctattttaataccaga

SEQ ID NO: 282687 - DNA, 25 bp, Rattus norvegicus
cttttatgacagagctcccagtggg

SEQ ID NO: 282688 - DNA, 25 bp, Rattus norvegicus
cttttatgacagtgctcccagtggg

SEQ ID NO: 282689 - DNA, 25 bp, Rattus norvegicus
cttttatgttcgagtgtttcctgta

SEQ ID NO: 282690 - DNA, 25 bp, Rattus norvegicus
cttttatgttcgtgtgtttcctgta

SEQ ID NO: 282691 - DNA, 25 bp, Rattus norvegicus
cttttattctgcaagagttcttagt

SEQ ID NO: 282692 - DNA, 25 bp, Rattus norvegicus
cttttattctgctagagttcttagt

SEQ ID NO: 282693 - DNA, 25 bp, Rattus norvegicus
cttttatttttaagagtttgctctg

SEQ ID NO: 282694 - DNA, 25 bp, Rattus norvegicus
cttttatttttatgagtttgctctg

SEQ ID NO: 282695 - DNA, 25 bp, Rattus norvegicus
cttttcacgattctcagctggtttt

SEQ ID NO: 282696 - DNA, 25 bp, Rattus norvegicus
cttttcacgattgtcagctggtttt

SEQ ID NO: 282697 - DNA, 25 bp, Rattus norvegicus
cttttcagaagaattcaccacagtg

SEQ ID NO: 282698 - DNA, 25 bp, Rattus norvegicus
cttttcagaagatttcaccacagtg

SEQ ID NO: 282699 - DNA, 25 bp, Rattus norvegicus
cttttcagccaaattctctttcctt

SEQ ID NO: 282700 - DNA, 25 bp, Rattus norvegicus
cttttcagccaatttctctttcctt

SEQ ID NO: 282701 - DNA, 25 bp, Rattus norvegicus
cttttcagtcctccggatggaattt

SEQ ID NO: 282702 - DNA, 25 bp, Rattus norvegicus
cttttcagtcctgcggatggaattt

SEQ ID NO: 282703 - DNA, 25 bp, Rattus norvegicus
cttttcagttagaatacagaacgta

SEQ ID NO: 282704 - DNA, 25 bp, Rattus norvegicus
cttttcagttagtatacagaacgta

SEQ ID NO: 282705 - DNA, 25 bp, Rattus norvegicus
cttttcataacacttcttgggtgga

SEQ ID NO: 282706 - DNA, 25 bp, Rattus norvegicus
cttttcataacagttcttgggtgga

SEQ ID NO: 282707 - DNA, 25 bp, Rattus norvegicus
cttttcatgtaaccgcctgctggaa

SEQ ID NO: 282708 - DNA, 25 bp, Rattus norvegicus
cttttcatgtaagcgcctgctggaa

SEQ ID NO: 282709 - DNA, 25 bp, Rattus norvegicus
cttttcatttaaatgtctttgtctc

SEQ ID NO: 282710 - DNA, 25 bp, Rattus norvegicus
cttttcatttaattgtctttgtctc

SEQ ID NO: 282711 - DNA, 25 bp, Rattus norvegicus
cttttcattttcagacgagtcctga

SEQ ID NO: 282712 - DNA, 25 bp, Rattus norvegicus
cttttcattttctgacgagtcctga

SEQ ID NO: 282713 - DNA, 25 bp, Rattus norvegicus
cttttccacaccaagacatgtacac

SEQ ID NO: 282714 - DNA, 25 bp, Rattus norvegicus
cttttccacacctagacatgtacac

SEQ ID NO: 282715 - DNA, 25 bp, Rattus norvegicus
cttttccagcctctgtaagctattt

SEQ ID NO: 282716 - DNA, 25 bp, Rattus norvegicus
cttttccagcctgtgtaagctattt

SEQ ID NO: 282717 - DNA, 25 bp, Rattus norvegicus
cttttcccaagtattatgccgagtg

SEQ ID NO: 282718 - DNA, 25 bp, Rattus norvegicus
cttttcccaagttttatgccgagtg

SEQ ID NO: 282719 - DNA, 25 bp, Rattus norvegicus
cttttcccagcactgtgggtagaca

SEQ ID NO: 282720 - DNA, 25 bp, Rattus norvegicus
cttttcccagcagtgtgggtagaca

SEQ ID NO: 282721 - DNA, 25 bp, Rattus norvegicus
cttttccctcttacaacaaacagtg

SEQ ID NO: 282722 - DNA, 25 bp, Rattus norvegicus
cttttccctctttcaacaaacagtg

SEQ ID NO: 282723 - DNA, 25 bp, Rattus norvegicus
cttttccctttcagtcttcagacag

SEQ ID NO: 282724 - DNA, 25 bp, Rattus norvegicus
cttttccctttctgtcttcagacag

SEQ ID NO: 282725 - DNA, 25 bp, Rattus norvegicus
cttttccctttgatggtgtcacaca

SEQ ID NO: 282726 - DNA, 25 bp, Rattus norvegicus
cttttccctttgttggtgtcacaca

SEQ ID NO: 282727 - DNA, 25 bp, Rattus norvegicus
cttttccgataaccagaagctgtgg

SEQ ID NO: 282728 - DNA, 25 bp, Rattus norvegicus
cttttccgataagcagaagctgtgg

SEQ ID NO: 282729 - DNA, 25 bp, Rattus norvegicus
cttttccggccactgagggtcagcg

SEQ ID NO: 282730 - DNA, 25 bp, Rattus norvegicus
cttttccggccagtgagggtcagcg

SEQ ID NO: 282731 - DNA, 25 bp, Rattus norvegicus
cttttcctccctactagtctggcaa

SEQ ID NO: 282732 - DNA, 25 bp, Rattus norvegicus
cttttcctcccttctagtctggcaa

SEQ ID NO: 282733 - DNA, 25 bp, Rattus norvegicus
cttttcctctttcgtggacttgtga

SEQ ID NO: 282734 - DNA, 25 bp, Rattus norvegicus
cttttcctctttggtggacttgtga

SEQ ID NO: 282735 - DNA, 25 bp, Rattus norvegicus
cttttcctgctccatcagaagctga

SEQ ID NO: 282736 - DNA, 25 bp, Rattus norvegicus
cttttcctgctcgatcagaagctga

SEQ ID NO: 282737 - DNA, 25 bp, Rattus norvegicus
cttttcctggagcatctggctgcaa

SEQ ID NO: 282738 - DNA, 25 bp, Rattus norvegicus
cttttcctggaggatctggctgcaa

SEQ ID NO: 282739 - DNA, 25 bp, Rattus norvegicus
cttttccttcaacaatgggcaatat

SEQ ID NO: 282740 - DNA, 25 bp, Rattus norvegicus
cttttccttcaagaatgggcaatat

SEQ ID NO: 282741 - DNA, 25 bp, Rattus norvegicus
cttttccttggtactatattgcttg

SEQ ID NO: 282742 - DNA, 25 bp, Rattus norvegicus
cttttccttggttctatattgcttg

SEQ ID NO: 282743 - DNA, 25 bp, Rattus norvegicus
cttttcctttccaatcttctgtata

SEQ ID NO: 282744 - DNA, 25 bp, Rattus norvegicus
cttttcctttcctatcttctgtata

SEQ ID NO: 282745 - DNA, 25 bp, Rattus norvegicus
cttttcgtggatcaagcttgtgtac

SEQ ID NO: 282746 - DNA, 25 bp, Rattus norvegicus
cttttcgtggatgaagcttgtgtac

SEQ ID NO: 282747 - DNA, 25 bp, Rattus norvegicus
cttttcgttattatgttctgcagga

SEQ ID NO: 282748 - DNA, 25 bp, Rattus norvegicus
cttttcgttattttgttctgcagga

SEQ ID NO: 282749 - DNA, 25 bp, Rattus norvegicus
cttttctaacttctctgacactgga

SEQ ID NO: 282750 - DNA, 25 bp, Rattus norvegicus
cttttctaacttgtctgacactgga

SEQ ID NO: 282751 - DNA, 25 bp, Rattus norvegicus
cttttctacgttaatgcctcatgga

SEQ ID NO: 282752 - DNA, 25 bp, Rattus norvegicus
cttttctacgtttatgcctcatgga

SEQ ID NO: 282753 - DNA, 25 bp, Rattus norvegicus
cttttctactagcatttcctcggtg

SEQ ID NO: 282754 - DNA, 25 bp, Rattus norvegicus
cttttctactaggatttcctcggtg

SEQ ID NO: 282755 - DNA, 25 bp, Rattus norvegicus
cttttctatgttcaggatgtctcca

SEQ ID NO: 282756 - DNA, 25 bp, Rattus norvegicus
cttttctatgttgaggatgtctcca

SEQ ID NO: 282757 - DNA, 25 bp, Rattus norvegicus
cttttctccctaaactggtgcaaat

SEQ ID NO: 282758 - DNA, 25 bp, Rattus norvegicus
cttttctccctatactggtgcaaat

SEQ ID NO: 282759 - DNA, 25 bp, Rattus norvegicus
cttttctcgctgcatagggctgtga

SEQ ID NO: 282760 - DNA, 25 bp, Rattus norvegicus
cttttctcgctggatagggctgtga

SEQ ID NO: 282761 - DNA, 25 bp, Rattus norvegicus
cttttctctcagaccagtacatttt

SEQ ID NO: 282762 - DNA, 25 bp, Rattus norvegicus
cttttctctcagtccagtacatttt

SEQ ID NO: 282763 - DNA, 25 bp, Rattus norvegicus
cttttctctcggattgttttaattg

SEQ ID NO: 282764 - DNA, 25 bp, Rattus norvegicus
cttttctctcggtttgttttaattg

SEQ ID NO: 282765 - DNA, 25 bp, Rattus norvegicus
cttttctctggcacttttcatattg

SEQ ID NO: 282766 - DNA, 25 bp, Rattus norvegicus
cttttctctggctcttttcatattg

SEQ ID NO: 282767 - DNA, 25 bp, Rattus norvegicus
cttttctcttcactcaaggtgcaaa

SEQ ID NO: 282768 - DNA, 25 bp, Rattus norvegicus
cttttctcttcagtcaaggtgcaaa

SEQ ID NO: 282769 - DNA, 25 bp, Rattus norvegicus
cttttctcttgaaagtcacctgtga

SEQ ID NO: 282770 - DNA, 25 bp, Rattus norvegicus
cttttctcttgatagtcacctgtga

SEQ ID NO: 282771 - DNA, 25 bp, Rattus norvegicus
cttttctgatcgagtgggcattgca

SEQ ID NO: 282772 - DNA, 25 bp, Rattus norvegicus
cttttctgatcgtgtgggcattgca

SEQ ID NO: 282773 - DNA, 25 bp, Rattus norvegicus
cttttctgcctcctaaccaaggaat

SEQ ID NO: 282774 - DNA, 25 bp, Rattus norvegicus
cttttctgcctcgtaaccaaggaat

SEQ ID NO: 282775 - DNA, 25 bp, Rattus norvegicus
cttttctgctccaagaagtgacaca

SEQ ID NO: 282776 - DNA, 25 bp, Rattus norvegicus
cttttctgctcctagaagtgacaca

SEQ ID NO: 282777 - DNA, 25 bp, Rattus norvegicus
cttttctgtatgacaccacacatca

SEQ ID NO: 282778 - DNA, 25 bp, Rattus norvegicus
cttttctgtatgtcaccacacatca

SEQ ID NO: 282779 - DNA, 25 bp, Rattus norvegicus
cttttctgtcagacacgtgcatgga

SEQ ID NO: 282780 - DNA, 25 bp, Rattus norvegicus
cttttctgtcagtcacgtgcatgga

SEQ ID NO: 282781 - DNA, 25 bp, Rattus norvegicus
cttttctgtttcacagacacaaggt

SEQ ID NO: 282782 - DNA, 25 bp, Rattus norvegicus
cttttctgtttctcagacacaaggt

SEQ ID NO: 282783 - DNA, 25 bp, Rattus norvegicus
cttttcttatcaccttgacctcttg

SEQ ID NO: 282784 - DNA, 25 bp, Rattus norvegicus
cttttcttatcagcttgacctcttg

SEQ ID NO: 282785 - DNA, 25 bp, Rattus norvegicus
cttttcttatgcattacaacccctc

SEQ ID NO: 282786 - DNA, 25 bp, Rattus norvegicus
cttttcttatgctttacaacccctc

SEQ ID NO: 282787 - DNA, 25 bp, Rattus norvegicus
cttttcttcactaagcacacctaga

SEQ ID NO: 282788 - DNA, 25 bp, Rattus norvegicus
cttttcttcacttagcacacctaga

SEQ ID NO: 282789 - DNA, 25 bp, Rattus norvegicus
cttttcttccaccaactgtgggtca

SEQ ID NO: 282790 - DNA, 25 bp, Rattus norvegicus
cttttcttccacgaactgtgggtca

SEQ ID NO: 282791 - DNA, 25 bp, Rattus norvegicus
cttttcttctagctgctcagggaga

SEQ ID NO: 282792 - DNA, 25 bp, Rattus norvegicus
cttttcttctaggtgctcagggaga

SEQ ID NO: 282793 - DNA, 25 bp, Rattus norvegicus
cttttcttggtgctagggcatgcta

SEQ ID NO: 282794 - DNA, 25 bp, Rattus norvegicus
cttttcttggtggtagggcatgcta

SEQ ID NO: 282795 - DNA, 25 bp, Rattus norvegicus
cttttctttgtcattgctgactttg

SEQ ID NO: 282796 - DNA, 25 bp, Rattus norvegicus
cttttctttgtctttgctgactttg

SEQ ID NO: 282797 - DNA, 25 bp, Rattus norvegicus
cttttcttttatccacagctcggtg

SEQ ID NO: 282798 - DNA, 25 bp, Rattus norvegicus
cttttcttttatgcacagctcggtg

SEQ ID NO: 282799 - DNA, 25 bp, Rattus norvegicus
cttttgaaagagcagcaaccagtgc

SEQ ID NO: 282800 - DNA, 25 bp, Rattus norvegicus
cttttgaaagaggagcaaccagtgc

SEQ ID NO: 282801 - DNA, 25 bp, Rattus norvegicus
cttttgacacagacaggagcccggc

SEQ ID NO: 282802 - DNA, 25 bp, Rattus norvegicus
cttttgacacagtcaggagcccggc

SEQ ID NO: 282803 - DNA, 25 bp, Rattus norvegicus
cttttgaccttccttggccactgca

SEQ ID NO: 282804 - DNA, 25 bp, Rattus norvegicus
cttttgaccttcgttggccactgca

SEQ ID NO: 282805 - DNA, 25 bp, Rattus norvegicus
cttttgaggcataaactgtctttga

SEQ ID NO: 282806 - DNA, 25 bp, Rattus norvegicus
cttttgaggcattaactgtctttga

SEQ ID NO: 282807 - DNA, 25 bp, Rattus norvegicus
cttttgcacatgaggaaaacaccaa

SEQ ID NO: 282808 - DNA, 25 bp, Rattus norvegicus
cttttgcacatgtggaaaacaccaa

SEQ ID NO: 282809 - DNA, 25 bp, Rattus norvegicus
cttttgcaccttctcctaattggga

SEQ ID NO: 282810 - DNA, 25 bp, Rattus norvegicus
cttttgcaccttgtcctaattggga

SEQ ID NO: 282811 - DNA, 25 bp, Rattus norvegicus
cttttgcagaggaatcagcagcatc

SEQ ID NO: 282812 - DNA, 25 bp, Rattus norvegicus
cttttgcagaggtatcagcagcatc

SEQ ID NO: 282813 - DNA, 25 bp, Rattus norvegicus
cttttgcagtgcacatgatgtgtgg

SEQ ID NO: 282814 - DNA, 25 bp, Rattus norvegicus
cttttgcagtgctcatgatgtgtgg

SEQ ID NO: 282815 - DNA, 25 bp, Rattus norvegicus
cttttgccaccgcagcttggaaatt

SEQ ID NO: 282816 - DNA, 25 bp, Rattus norvegicus
cttttgccaccggagcttggaaatt

SEQ ID NO: 282817 - DNA, 25 bp, Rattus norvegicus
cttttgcccattatatctgttgtgc

SEQ ID NO: 282818 - DNA, 25 bp, Rattus norvegicus
cttttgcccattttatctgttgtgc

SEQ ID NO: 282819 - DNA, 25 bp, Rattus norvegicus
cttttgccccgtctgttaaatatat

SEQ ID NO: 282820 - DNA, 25 bp, Rattus norvegicus
cttttgccccgtgtgttaaatatat

SEQ ID NO: 282821 - DNA, 25 bp, Rattus norvegicus
cttttgccctaaccttgggtgcaga

SEQ ID NO: 282822 - DNA, 25 bp, Rattus norvegicus
cttttgccctaagcttgggtgcaga

SEQ ID NO: 282823 - DNA, 25 bp, Rattus norvegicus
cttttgccctgaacatccgaagaga

SEQ ID NO: 282824 - DNA, 25 bp, Rattus norvegicus
cttttgccctgatcatccgaagaga

SEQ ID NO: 282825 - DNA, 25 bp, Rattus norvegicus
cttttgccggtgcagacctagaatt

SEQ ID NO: 282826 - DNA, 25 bp, Rattus norvegicus
cttttgccggtggagacctagaatt

SEQ ID NO: 282827 - DNA, 25 bp, Rattus norvegicus
cttttgccgttgctttgtcaagtca

SEQ ID NO: 282828 - DNA, 25 bp, Rattus norvegicus
cttttgccgttggtttgtcaagtca

SEQ ID NO: 282829 - DNA, 25 bp, Rattus norvegicus
cttttgcctggacaccttgcctcag

SEQ ID NO: 282830 - DNA, 25 bp, Rattus norvegicus
cttttgcctggagaccttgcctcag

SEQ ID NO: 282831 - DNA, 25 bp, Rattus norvegicus
cttttgctctgtcttctctactgat

SEQ ID NO: 282832 - DNA, 25 bp, Rattus norvegicus
cttttgctctgtgttctctactgat

SEQ ID NO: 282833 - DNA, 25 bp, Rattus norvegicus
cttttgctgactaggtgtgtgtaca

SEQ ID NO: 282834 - DNA, 25 bp, Rattus norvegicus
cttttgctgacttggtgtgtgtaca

SEQ ID NO: 282835 - DNA, 25 bp, Rattus norvegicus
cttttgctgaggctcacacacatca

SEQ ID NO: 282836 - DNA, 25 bp, Rattus norvegicus
cttttgctgagggtcacacacatca

SEQ ID NO: 282837 - DNA, 25 bp, Rattus norvegicus
cttttgctttccagcttctagtaaa

SEQ ID NO: 282838 - DNA, 25 bp, Rattus norvegicus
cttttgctttcctgcttctagtaaa

SEQ ID NO: 282839 - DNA, 25 bp, Rattus norvegicus
cttttggaccaacctgtactagagc

SEQ ID NO: 282840 - DNA, 25 bp, Rattus norvegicus
cttttggaccaagctgtactagagc

SEQ ID NO: 282841 - DNA, 25 bp, Rattus norvegicus
cttttggactaccatcacttctgca

SEQ ID NO: 282842 - DNA, 25 bp, Rattus norvegicus
cttttggactacgatcacttctgca

SEQ ID NO: 282843 - DNA, 25 bp, Rattus norvegicus
cttttggagttgcttgctttcagct

SEQ ID NO: 282844 - DNA, 25 bp, Rattus norvegicus
cttttggagttggttgctttcagct

SEQ ID NO: 282845 - DNA, 25 bp, Rattus norvegicus
cttttggcacataacttccctgaaa

SEQ ID NO: 282846 - DNA, 25 bp, Rattus norvegicus
cttttggcacattacttccctgaaa

SEQ ID NO: 282847 - DNA, 25 bp, Rattus norvegicus
cttttggcaccaaatgtgggactgg

SEQ ID NO: 282848 - DNA, 25 bp, Rattus norvegicus
cttttggcaccatatgtgggactgg

SEQ ID NO: 282849 - DNA, 25 bp, Rattus norvegicus
cttttggctccaatgctgttagcat

SEQ ID NO: 282850 - DNA, 25 bp, Rattus norvegicus
cttttggctccattgctgttagcat

SEQ ID NO: 282851 - DNA, 25 bp, Rattus norvegicus
cttttggctctacgattaggtataa

SEQ ID NO: 282852 - DNA, 25 bp, Rattus norvegicus
cttttggctctaggattaggtataa

SEQ ID NO: 282853 - DNA, 25 bp, Rattus norvegicus
cttttggcttcgaatgctgttcaag

SEQ ID NO: 282854 - DNA, 25 bp, Rattus norvegicus
cttttggcttcgtatgctgttcaag

SEQ ID NO: 282855 - DNA, 25 bp, Rattus norvegicus
cttttgggactacgctcaggttagc

SEQ ID NO: 282856 - DNA, 25 bp, Rattus norvegicus
cttttgggactaggctcaggttagc

SEQ ID NO: 282857 - DNA, 25 bp, Rattus norvegicus
cttttgggctggatgtcattttcta

SEQ ID NO: 282858 - DNA, 25 bp, Rattus norvegicus
cttttgggctggttgtcattttcta

SEQ ID NO: 282859 - DNA, 25 bp, Rattus norvegicus
cttttggtcatcacaacttgcgtgt

SEQ ID NO: 282860 - DNA, 25 bp, Rattus norvegicus
cttttggtcatctcaacttgcgtgt

SEQ ID NO: 282861 - DNA, 25 bp, Rattus norvegicus
cttttggtcgatcaggatatcccta

SEQ ID NO: 282862 - DNA, 25 bp, Rattus norvegicus
cttttggtcgatgaggatatcccta

SEQ ID NO: 282863 - DNA, 25 bp, Rattus norvegicus
cttttggtgatgatcgtgctgggct

SEQ ID NO: 282864 - DNA, 25 bp, Rattus norvegicus
cttttggtgatgttcgtgctgggct

SEQ ID NO: 282865 - DNA, 25 bp, Rattus norvegicus
cttttggtttagctgcagggttgca

SEQ ID NO: 282866 - DNA, 25 bp, Rattus norvegicus
cttttggtttaggtgcagggttgca

SEQ ID NO: 282867 - DNA, 25 bp, Rattus norvegicus
cttttgtaatctatccactgctgga

SEQ ID NO: 282868 - DNA, 25 bp, Rattus norvegicus
cttttgtaatctttccactgctgga

SEQ ID NO: 282869 - DNA, 25 bp, Rattus norvegicus
cttttgtccatgatgatgatgtcct

SEQ ID NO: 282870 - DNA, 25 bp, Rattus norvegicus
cttttgtccatgttgatgatgtcct

SEQ ID NO: 282871 - DNA, 25 bp, Rattus norvegicus
cttttgtctcttctgcatgctttca

SEQ ID NO: 282872 - DNA, 25 bp, Rattus norvegicus
cttttgtctcttgtgcatgctttca

SEQ ID NO: 282873 - DNA, 25 bp, Rattus norvegicus
cttttgtgatgcagtagagtctcta

SEQ ID NO: 282874 - DNA, 25 bp, Rattus norvegicus
cttttgtgatgctgtagagtctcta

SEQ ID NO: 282875 - DNA, 25 bp, Rattus norvegicus
cttttgtgattacgcgagctctggg

SEQ ID NO: 282876 - DNA, 25 bp, Rattus norvegicus
cttttgtgattaggcgagctctggg

SEQ ID NO: 282877 - DNA, 25 bp, Rattus norvegicus
cttttgtggaagagctgatctcaga

SEQ ID NO: 282878 - DNA, 25 bp, Rattus norvegicus
cttttgtggaagtgctgatctcaga

SEQ ID NO: 282879 - DNA, 25 bp, Rattus norvegicus
cttttgtgtcatcttgcagcagagt

SEQ ID NO: 282880 - DNA, 25 bp, Rattus norvegicus
cttttgtgtcatgttgcagcagagt

SEQ ID NO: 282881 - DNA, 25 bp, Rattus norvegicus
cttttgtgtctccattttctatcca

SEQ ID NO: 282882 - DNA, 25 bp, Rattus norvegicus
cttttgtgtctcgattttctatcca

SEQ ID NO: 282883 - DNA, 25 bp, Rattus norvegicus
cttttgtgtgtaaatgcggttttgt

SEQ ID NO: 282884 - DNA, 25 bp, Rattus norvegicus
cttttgtgtgtatatgcggttttgt

SEQ ID NO: 282885 - DNA, 25 bp, Rattus norvegicus
cttttgtgttctaagactttcgtga

SEQ ID NO: 282886 - DNA, 25 bp, Rattus norvegicus
cttttgtgttcttagactttcgtga

SEQ ID NO: 282887 - DNA, 25 bp, Rattus norvegicus
cttttgttaaggctcattggccgaa

SEQ ID NO: 282888 - DNA, 25 bp, Rattus norvegicus
cttttgttaagggtcattggccgaa

SEQ ID NO: 282889 - DNA, 25 bp, Rattus norvegicus
cttttgttatatcccagctcttggg

SEQ ID NO: 282890 - DNA, 25 bp, Rattus norvegicus
cttttgttatatgccagctcttggg

SEQ ID NO: 282891 - DNA, 25 bp, Rattus norvegicus
cttttgttccaaagattgtgctttt

SEQ ID NO: 282892 - DNA, 25 bp, Rattus norvegicus
cttttgttccaatgattgtgctttt

SEQ ID NO: 282893 - DNA, 25 bp, Rattus norvegicus
cttttgttctctcttattacctaat

SEQ ID NO: 282894 - DNA, 25 bp, Rattus norvegicus
cttttgttctctgttattacctaat

SEQ ID NO: 282895 - DNA, 25 bp, Rattus norvegicus
cttttgttgagtactgaggcccatc

SEQ ID NO: 282896 - DNA, 25 bp, Rattus norvegicus
cttttgttgagttctgaggcccatc

SEQ ID NO: 282897 - DNA, 25 bp, Rattus norvegicus
cttttgttgttacgttctgattcac

SEQ ID NO: 282898 - DNA, 25 bp, Rattus norvegicus
cttttgttgttaggttctgattcac

SEQ ID NO: 282899 - DNA, 25 bp, Rattus norvegicus
cttttgtttaaaagtgtcccacttg

SEQ ID NO: 282900 - DNA, 25 bp, Rattus norvegicus
cttttgtttaaatgtgtcccacttg

SEQ ID NO: 282901 - DNA, 25 bp, Rattus norvegicus
cttttgtttgccagaatgtacaaga

SEQ ID NO: 282902 - DNA, 25 bp, Rattus norvegicus
cttttgtttgcctgaatgtacaaga

SEQ ID NO: 282903 - DNA, 25 bp, Rattus norvegicus
cttttgtttgtcaacttcaatgtga

SEQ ID NO: 282904 - DNA, 25 bp, Rattus norvegicus
cttttgtttgtctacttcaatgtga

SEQ ID NO: 282905 - DNA, 25 bp, Rattus norvegicus
ctttttacccacaccttagaatctg

SEQ ID NO: 282906 - DNA, 25 bp, Rattus norvegicus
ctttttacccactccttagaatctg

SEQ ID NO: 282907 - DNA, 25 bp, Rattus norvegicus
ctttttacgactaggccatgctgaa

SEQ ID NO: 282908 - DNA, 25 bp, Rattus norvegicus
ctttttacgacttggccatgctgaa

SEQ ID NO: 282909 - DNA, 25 bp, Rattus norvegicus
ctttttactttccagaactcgtgtg

SEQ ID NO: 282910 - DNA, 25 bp, Rattus norvegicus
ctttttactttcgagaactcgtgtg

SEQ ID NO: 282911 - DNA, 25 bp, Rattus norvegicus
ctttttagggttctctgtgtgtgta

SEQ ID NO: 282912 - DNA, 25 bp, Rattus norvegicus
ctttttagggttgtctgtgtgtgta

SEQ ID NO: 282913 - DNA, 25 bp, Rattus norvegicus
ctttttataaacactgaccacagcc

SEQ ID NO: 282914 - DNA, 25 bp, Rattus norvegicus
ctttttataaactctgaccacagcc

SEQ ID NO: 282915 - DNA, 25 bp, Rattus norvegicus
ctttttcaagcacccatgtctgtaa

SEQ ID NO: 282916 - DNA, 25 bp, Rattus norvegicus
ctttttcaagcagccatgtctgtaa

SEQ ID NO: 282917 - DNA, 25 bp, Rattus norvegicus
ctttttcacctcattgaccacacag

SEQ ID NO: 282918 - DNA, 25 bp, Rattus norvegicus
ctttttcacctctttgaccacacag

SEQ ID NO: 282919 - DNA, 25 bp, Rattus norvegicus
ctttttcactacctctggtggatga

SEQ ID NO: 282920 - DNA, 25 bp, Rattus norvegicus
ctttttcactacgtctggtggatga

SEQ ID NO: 282921 - DNA, 25 bp, Rattus norvegicus
ctttttccacgtacttcgcatatat

SEQ ID NO: 282922 - DNA, 25 bp, Rattus norvegicus
ctttttccacgttcttcgcatatat

SEQ ID NO: 282923 - DNA, 25 bp, Rattus norvegicus
ctttttccctccagacaaatattct

SEQ ID NO: 282924 - DNA, 25 bp, Rattus norvegicus
ctttttccctcctgacaaatattct

SEQ ID NO: 282925 - DNA, 25 bp, Rattus norvegicus
ctttttcctcctagggcgtctgaag

SEQ ID NO: 282926 - DNA, 25 bp, Rattus norvegicus
ctttttcctccttgggcgtctgaag

SEQ ID NO: 282927 - DNA, 25 bp, Rattus norvegicus
ctttttcctgccacgagggacaaga

SEQ ID NO: 282928 - DNA, 25 bp, Rattus norvegicus
ctttttcctgcctcgagggacaaga

SEQ ID NO: 282929 - DNA, 25 bp, Rattus norvegicus
ctttttcctgtgaataataatgaaa

SEQ ID NO: 282930 - DNA, 25 bp, Rattus norvegicus
ctttttcctgtgtataataatgaaa

SEQ ID NO: 282931 - DNA, 25 bp, Rattus norvegicus
ctttttctaagactggttgctggta

SEQ ID NO: 282932 - DNA, 25 bp, Rattus norvegicus
ctttttctaagagtggttgctggta

SEQ ID NO: 282933 - DNA, 25 bp, Rattus norvegicus
ctttttctagctcccaaaggccatg

SEQ ID NO: 282934 - DNA, 25 bp, Rattus norvegicus
ctttttctagctgccaaaggccatg

SEQ ID NO: 282935 - DNA, 25 bp, Rattus norvegicus
ctttttctatcaatccaaccacttg

SEQ ID NO: 282936 - DNA, 25 bp, Rattus norvegicus
ctttttctatcattccaaccacttg

SEQ ID NO: 282937 - DNA, 25 bp, Rattus norvegicus
ctttttctcttacatcgtcctcaga

SEQ ID NO: 282938 - DNA, 25 bp, Rattus norvegicus
ctttttctcttagatcgtcctcaga

SEQ ID NO: 282939 - DNA, 25 bp, Rattus norvegicus
ctttttctgcaccactatgtgctaa

SEQ ID NO: 282940 - DNA, 25 bp, Rattus norvegicus
ctttttctgcacgactatgtgctaa

SEQ ID NO: 282941 - DNA, 25 bp, Rattus norvegicus
ctttttctgcagaggcaattatcta

SEQ ID NO: 282942 - DNA, 25 bp, Rattus norvegicus
ctttttctgcagtggcaattatcta

SEQ ID NO: 282943 - DNA, 25 bp, Rattus norvegicus
ctttttcttattaggaggcataatt

SEQ ID NO: 282944 - DNA, 25 bp, Rattus norvegicus
ctttttcttatttggaggcataatt

SEQ ID NO: 282945 - DNA, 25 bp, Rattus norvegicus
ctttttcttggactccattgatttt

SEQ ID NO: 282946 - DNA, 25 bp, Rattus norvegicus
ctttttcttggagtccattgatttt

SEQ ID NO: 282947 - DNA, 25 bp, Rattus norvegicus
ctttttctttcaccacaattccaac

SEQ ID NO: 282948 - DNA, 25 bp, Rattus norvegicus
ctttttctttcagcacaattccaac

SEQ ID NO: 282949 - DNA, 25 bp, Rattus norvegicus
ctttttctttggatctgcattatga

SEQ ID NO: 282950 - DNA, 25 bp, Rattus norvegicus
ctttttctttggttctgcattatga

SEQ ID NO: 282951 - DNA, 25 bp, Rattus norvegicus
ctttttgaacctccgtgccttctct

SEQ ID NO: 282952 - DNA, 25 bp, Rattus norvegicus
ctttttgaacctgcgtgccttctct

SEQ ID NO: 282953 - DNA, 25 bp, Rattus norvegicus
ctttttgaccatcttcttactctga

SEQ ID NO: 282954 - DNA, 25 bp, Rattus norvegicus
ctttttgaccatgttcttactctga

SEQ ID NO: 282955 - DNA, 25 bp, Rattus norvegicus
ctttttgagcatatggccgtttgaa

SEQ ID NO: 282956 - DNA, 25 bp, Rattus norvegicus
ctttttgagcatttggccgtttgaa

SEQ ID NO: 282957 - DNA, 25 bp, Rattus norvegicus
ctttttgatactctgcatgcacttt

SEQ ID NO: 282958 - DNA, 25 bp, Rattus norvegicus
ctttttgatactgtgcatgcacttt

SEQ ID NO: 282959 - DNA, 25 bp, Rattus norvegicus
ctttttgatgttctggctagtccct

SEQ ID NO: 282960 - DNA, 25 bp, Rattus norvegicus
ctttttgatgttgtggctagtccct

SEQ ID NO: 282961 - DNA, 25 bp, Rattus norvegicus
ctttttgcggccataagttttgatg

SEQ ID NO: 282962 - DNA, 25 bp, Rattus norvegicus
ctttttgcggccttaagttttgatg

SEQ ID NO: 282963 - DNA, 25 bp, Rattus norvegicus
ctttttgcttctactttcatcctaa

SEQ ID NO: 282964 - DNA, 25 bp, Rattus norvegicus
ctttttgcttcttctttcatcctaa

SEQ ID NO: 282965 - DNA, 25 bp, Rattus norvegicus
ctttttgtaaacagcaggccgcttt

SEQ ID NO: 282966 - DNA, 25 bp, Rattus norvegicus
ctttttgtaaactgcaggccgcttt

SEQ ID NO: 282967 - DNA, 25 bp, Rattus norvegicus
ctttttgtcagcattatgtacgtga

SEQ ID NO: 282968 - DNA, 25 bp, Rattus norvegicus
ctttttgtcagctttatgtacgtga

SEQ ID NO: 282969 - DNA, 25 bp, Rattus norvegicus
ctttttgtccgcagagcaccttcca

SEQ ID NO: 282970 - DNA, 25 bp, Rattus norvegicus
ctttttgtccgctgagcaccttcca

SEQ ID NO: 282971 - DNA, 25 bp, Rattus norvegicus
cttttttccagtctttcgcagtaga

SEQ ID NO: 282972 - DNA, 25 bp, Rattus norvegicus
cttttttccagtgtttcgcagtaga

SEQ ID NO: 282973 - DNA, 25 bp, Rattus norvegicus
cttttttccctcatagcagtcatct

SEQ ID NO: 282974 - DNA, 25 bp, Rattus norvegicus
cttttttccctcttagcagtcatct

SEQ ID NO: 282975 - DNA, 25 bp, Rattus norvegicus
cttttttccctgaggctcgaggcct

SEQ ID NO: 282976 - DNA, 25 bp, Rattus norvegicus
cttttttccctgatgatcgtcatga

SEQ ID NO: 282977 - DNA, 25 bp, Rattus norvegicus
cttttttccctgtggctcgaggcct

SEQ ID NO: 282978 - DNA, 25 bp, Rattus norvegicus
cttttttccctgttgatcgtcatga

SEQ ID NO: 282979 - DNA, 25 bp, Rattus norvegicus
cttttttcctttcccatgcacaatg

SEQ ID NO: 282980 - DNA, 25 bp, Rattus norvegicus
cttttttcctttgccatgcacaatg

SEQ ID NO: 282981 - DNA, 25 bp, Rattus norvegicus
cttttttctctgagtatagtgtgtg

SEQ ID NO: 282982 - DNA, 25 bp, Rattus norvegicus
cttttttctctgtgtatagtgtgtg

SEQ ID NO: 282983 - DNA, 25 bp, Rattus norvegicus
cttttttgcattctatcccatgtga

SEQ ID NO: 282984 - DNA, 25 bp, Rattus norvegicus
cttttttgcattgtatcccatgtga

SEQ ID NO: 282985 - DNA, 25 bp, Rattus norvegicus
cttttttgccatccggagagcttga

SEQ ID NO: 282986 - DNA, 25 bp, Rattus norvegicus
cttttttgccatgcggagagcttga

SEQ ID NO: 282987 - DNA, 25 bp, Rattus norvegicus
cttttttggccgagtagtcatctac

SEQ ID NO: 282988 - DNA, 25 bp, Rattus norvegicus
cttttttggccgtgtagtcatctac

SEQ ID NO: 282989 - DNA, 25 bp, Rattus norvegicus
cttttttggtacagcccagtcagca

SEQ ID NO: 282990 - DNA, 25 bp, Rattus norvegicus
cttttttggtactgcccagtcagca

SEQ ID NO: 282991 - DNA, 25 bp, Rattus norvegicus
gaaaaaaacatccaaagccctggca

SEQ ID NO: 282992 - DNA, 25 bp, Rattus norvegicus
gaaaaaaacatcgaaagccctggca

SEQ ID NO: 282993 - DNA, 25 bp, Rattus norvegicus
gaaaaaacacagaccccatctgtct

SEQ ID NO: 282994 - DNA, 25 bp, Rattus norvegicus
gaaaaaacacagtccccatctgtct

SEQ ID NO: 282995 - DNA, 25 bp, Rattus norvegicus
gaaaaaaccatcaggaactctcgtt

SEQ ID NO: 282996 - DNA, 25 bp, Rattus norvegicus
gaaaaaaccatctggaactctcgtt

SEQ ID NO: 282997 - DNA, 25 bp, Rattus norvegicus
gaaaaaaccattctcctacagcggg

SEQ ID NO: 282998 - DNA, 25 bp, Rattus norvegicus
gaaaaaaccattgtcctacagcggg

SEQ ID NO: 282999 - DNA, 25 bp, Rattus norvegicus
gaaaaaacccagctcatcgctgttg

SEQ ID NO: 283000 - DNA, 25 bp, Rattus norvegicus
gaaaaaacccaggtcatcgctgttg

SEQ ID NO: 283001 - DNA, 25 bp, Rattus norvegicus
gaaaaaacgcctacagcagcatctc

SEQ ID NO: 283002 - DNA, 25 bp, Rattus norvegicus
gaaaaaacgccttcagcagcatctc

SEQ ID NO: 283003 - DNA, 25 bp, Rattus norvegicus
gaaaaaacgtgcacatattctctat

SEQ ID NO: 283004 - DNA, 25 bp, Rattus norvegicus
gaaaaaacgtgctcatattctctat

SEQ ID NO: 283005 - DNA, 25 bp, Rattus norvegicus
gaaaaaactccacagtatgcccact

SEQ ID NO: 283006 - DNA, 25 bp, Rattus norvegicus
gaaaaaactccagagtatgcccact

SEQ ID NO: 283007 - DNA, 25 bp, Rattus norvegicus
gaaaaaactgcgatcacctgctgca

SEQ ID NO: 283008 - DNA, 25 bp, Rattus norvegicus
gaaaaaactgcgttcacctgctgca

SEQ ID NO: 283009 - DNA, 25 bp, Rattus norvegicus
gaaaaaagccagaataggaagcctt

SEQ ID NO: 283010 - DNA, 25 bp, Rattus norvegicus
gaaaaaagccagtataggaagcctt

SEQ ID NO: 283011 - DNA, 25 bp, Rattus norvegicus
gaaaaaagccttagatatacatctc

SEQ ID NO: 283012 - DNA, 25 bp, Rattus norvegicus
gaaaaaagcctttgatatacatctc

SEQ ID NO: 283013 - DNA, 25 bp, Rattus norvegicus
gaaaaaaggcgtcaggatcccctgg

SEQ ID NO: 283014 - DNA, 25 bp, Rattus norvegicus
gaaaaaaggcgtgaggatcccctgg

SEQ ID NO: 283015 - DNA, 25 bp, Rattus norvegicus
gaaaaaagtaaaagcattcaaacag

SEQ ID NO: 283016 - DNA, 25 bp, Rattus norvegicus
gaaaaaagtaaatgcattcaaacag

SEQ ID NO: 283017 - DNA, 25 bp, Rattus norvegicus
gaaaaaagtcataagcctgctgttt

SEQ ID NO: 283018 - DNA, 25 bp, Rattus norvegicus
gaaaaaagtcattagcctgctgttt

SEQ ID NO: 283019 - DNA, 25 bp, Rattus norvegicus
gaaaaaagtgctatccttcctgcca

SEQ ID NO: 283020 - DNA, 25 bp, Rattus norvegicus
gaaaaaagtgctttccttcctgcca

SEQ ID NO: 283021 - DNA, 25 bp, Rattus norvegicus
gaaaaaatacctaggtgccgccaat

SEQ ID NO: 283022 - DNA, 25 bp, Rattus norvegicus
gaaaaaataccttggtgccgccaat

SEQ ID NO: 283023 - DNA, 25 bp, Rattus norvegicus
gaaaaaatcctcctctgtctgggaa

SEQ ID NO: 283024 - DNA, 25 bp, Rattus norvegicus
gaaaaaatcctcgtctgtctgggaa

SEQ ID NO: 283025 - DNA, 25 bp, Rattus norvegicus
gaaaaacaaaacacacgctgtagtc

SEQ ID NO: 283026 - DNA, 25 bp, Rattus norvegicus
gaaaaacaaaactcacgctgtagtc

SEQ ID NO: 283027 - DNA, 25 bp, Rattus norvegicus
gaaaaacaaaagcagctcgttccaa

SEQ ID NO: 283028 - DNA, 25 bp, Rattus norvegicus
gaaaaacaaaaggagctcgttccaa

SEQ ID NO: 283029 - DNA, 25 bp, Rattus norvegicus
gaaaaacaaccacatcgctgcaggg

SEQ ID NO: 283030 - DNA, 25 bp, Rattus norvegicus
gaaaaacaaccagatcgctgcaggg

SEQ ID NO: 283031 - DNA, 25 bp, Rattus norvegicus
gaaaaacaagatactcctcctccaa

SEQ ID NO: 283032 - DNA, 25 bp, Rattus norvegicus
gaaaaacaagattctcctcctccaa

SEQ ID NO: 283033 - DNA, 25 bp, Rattus norvegicus
gaaaaacaagctatccaagagggag

SEQ ID NO: 283034 - DNA, 25 bp, Rattus norvegicus
gaaaaacaagctttccaagagggag

SEQ ID NO: 283035 - DNA, 25 bp, Rattus norvegicus
gaaaaacaccctagcctttatacat

SEQ ID NO: 283036 - DNA, 25 bp, Rattus norvegicus
gaaaaacacccttgcctttatacat

SEQ ID NO: 283037 - DNA, 25 bp, Rattus norvegicus
gaaaaacacctgcatcaactggcaa

SEQ ID NO: 283038 - DNA, 25 bp, Rattus norvegicus
gaaaaacacctggatcaactggcaa

SEQ ID NO: 283039 - DNA, 25 bp, Rattus norvegicus
gaaaaacaccttcaagcctctccag

SEQ ID NO: 283040 - DNA, 25 bp, Rattus norvegicus
gaaaaacaccttgaagcctctccag

SEQ ID NO: 283041 - DNA, 25 bp, Rattus norvegicus
gaaaaacactagaacccacaacctg

SEQ ID NO: 283042 - DNA, 25 bp, Rattus norvegicus
gaaaaacactagtacccacaacctg

SEQ ID NO: 283043 - DNA, 25 bp, Rattus norvegicus
gaaaaacactgactctgccgtgcct

SEQ ID NO: 283044 - DNA, 25 bp, Rattus norvegicus
gaaaaacactgagtctgccgtgcct

SEQ ID NO: 283045 - DNA, 25 bp, Rattus norvegicus
gaaaaacacttcatgtgggcatcac

SEQ ID NO: 283046 - DNA, 25 bp, Rattus norvegicus
gaaaaacacttcttgtgggcatcac

SEQ ID NO: 283047 - DNA, 25 bp, Rattus norvegicus
gaaaaacagctgaccttgtctccat

SEQ ID NO: 283048 - DNA, 25 bp, Rattus norvegicus
gaaaaacagctgtccttgtctccat

SEQ ID NO: 283049 - DNA, 25 bp, Rattus norvegicus
gaaaaacaggcaagaacttctcact

SEQ ID NO: 283050 - DNA, 25 bp, Rattus norvegicus
gaaaaacaggcatgaacttctcact

SEQ ID NO: 283051 - DNA, 25 bp, Rattus norvegicus
gaaaaacagggtcctgtgttcccct

SEQ ID NO: 283052 - DNA, 25 bp, Rattus norvegicus
gaaaaacagggtgctgtgttcccct

SEQ ID NO: 283053 - DNA, 25 bp, Rattus norvegicus
gaaaaacatatgctccgtgcttgta

SEQ ID NO: 283054 - DNA, 25 bp, Rattus norvegicus
gaaaaacatatggtccgtgcttgta

SEQ ID NO: 283055 - DNA, 25 bp, Rattus norvegicus
gaaaaacatgctcgctggttctgga

SEQ ID NO: 283056 - DNA, 25 bp, Rattus norvegicus
gaaaaacatgctggctggttctgga

SEQ ID NO: 283057 - DNA, 25 bp, Rattus norvegicus
gaaaaacattctactgcggctgctc

SEQ ID NO: 283058 - DNA, 25 bp, Rattus norvegicus
gaaaaacattcttctgcggctgctc

SEQ ID NO: 283059 - DNA, 25 bp, Rattus norvegicus
gaaaaaccagctccagttcacaaga

SEQ ID NO: 283060 - DNA, 25 bp, Rattus norvegicus
gaaaaaccagctgcagttcacaaga

SEQ ID NO: 283061 - DNA, 25 bp, Rattus norvegicus
gaaaaaccatatcctaggccccaag

SEQ ID NO: 283062 - DNA, 25 bp, Rattus norvegicus
gaaaaaccatatgctaggccccaag

SEQ ID NO: 283063 - DNA, 25 bp, Rattus norvegicus
gaaaaacccacacgtgcagcaggct

SEQ ID NO: 283064 - DNA, 25 bp, Rattus norvegicus
gaaaaacccacaggtgcagcaggct

SEQ ID NO: 283065 - DNA, 25 bp, Rattus norvegicus
gaaaaacccagacaccagaagccag

SEQ ID NO: 283066 - DNA, 25 bp, Rattus norvegicus
gaaaaacccagagaccagaagccag

SEQ ID NO: 283067 - DNA, 25 bp, Rattus norvegicus
gaaaaacccagcctgtgtggatttt

SEQ ID NO: 283068 - DNA, 25 bp, Rattus norvegicus
gaaaaacccagcgtgtgtggatttt

SEQ ID NO: 283069 - DNA, 25 bp, Rattus norvegicus
gaaaaacccatcagttcagttccac

SEQ ID NO: 283070 - DNA, 25 bp, Rattus norvegicus
gaaaaacccatctgttcagttccac

SEQ ID NO: 283071 - DNA, 25 bp, Rattus norvegicus
gaaaaaccccagatgtgtacagcac

SEQ ID NO: 283072 - DNA, 25 bp, Rattus norvegicus
gaaaaaccccagttgtgtacagcac

SEQ ID NO: 283073 - DNA, 25 bp, Rattus norvegicus
gaaaaacccgtgagacagtgtgcct

SEQ ID NO: 283074 - DNA, 25 bp, Rattus norvegicus
gaaaaacccgtgtgacagtgtgcct

SEQ ID NO: 283075 - DNA, 25 bp, Rattus norvegicus
gaaaaaccctcaccagtttgcctta

SEQ ID NO: 283076 - DNA, 25 bp, Rattus norvegicus
gaaaaaccctcagcagtttgcctta

SEQ ID NO: 283077 - DNA, 25 bp, Rattus norvegicus
gaaaaacctacaatctcctagtctc

SEQ ID NO: 283078 - DNA, 25 bp, Rattus norvegicus
gaaaaacctacattctcctagtctc

SEQ ID NO: 283079 - DNA, 25 bp, Rattus norvegicus
gaaaaacctccccaacacatctata

SEQ ID NO: 283080 - DNA, 25 bp, Rattus norvegicus
gaaaaacctcccgaacacatctata

SEQ ID NO: 283081 - DNA, 25 bp, Rattus norvegicus
gaaaaacctctcagtacatacaagt

SEQ ID NO: 283082 - DNA, 25 bp, Rattus norvegicus
gaaaaacctctctgtacatacaagt

SEQ ID NO: 283083 - DNA, 25 bp, Rattus norvegicus
gaaaaacctgaccaaagaagccatc

SEQ ID NO: 283084 - DNA, 25 bp, Rattus norvegicus
gaaaaacctgacgaaagaagccatc

SEQ ID NO: 283085 - DNA, 25 bp, Rattus norvegicus
gaaaaaccttctagtaccattgtag

SEQ ID NO: 283086 - DNA, 25 bp, Rattus norvegicus
gaaaaaccttcttgtaccattgtag

SEQ ID NO: 283087 - DNA, 25 bp, Rattus norvegicus
gaaaaacctttcactcaggactgga

SEQ ID NO: 283088 - DNA, 25 bp, Rattus norvegicus
gaaaaacctttctctcaggactgga

SEQ ID NO: 283089 - DNA, 25 bp, Rattus norvegicus
gaaaaacgcagtactggccgtgaga

SEQ ID NO: 283090 - DNA, 25 bp, Rattus norvegicus
gaaaaacgcagttctggccgtgaga

SEQ ID NO: 283091 - DNA, 25 bp, Rattus norvegicus
gaaaaacgcctaattgccctaagca

SEQ ID NO: 283092 - DNA, 25 bp, Rattus norvegicus
gaaaaacgcctatttgccctaagca

SEQ ID NO: 283093 - DNA, 25 bp, Rattus norvegicus
gaaaaacgtgtcaaggtcctctctc

SEQ ID NO: 283094 - DNA, 25 bp, Rattus norvegicus
gaaaaacgtgtctaggtcctctctc

SEQ ID NO: 283095 - DNA, 25 bp, Rattus norvegicus
gaaaaactaaccattccacagccag

SEQ ID NO: 283096 - DNA, 25 bp, Rattus norvegicus
gaaaaactaacctttccacagccag

SEQ ID NO: 283097 - DNA, 25 bp, Rattus norvegicus
gaaaaactacccaatgcatgttaaa

SEQ ID NO: 283098 - DNA, 25 bp, Rattus norvegicus
gaaaaactaccctatgcatgttaaa

SEQ ID NO: 283099 - DNA, 25 bp, Rattus norvegicus
gaaaaactcacaaaaatctccgaag

SEQ ID NO: 283100 - DNA, 25 bp, Rattus norvegicus
gaaaaactcacataaatctccgaag

SEQ ID NO: 283101 - DNA, 25 bp, Rattus norvegicus
gaaaaactcagtcacttccatgcca

SEQ ID NO: 283102 - DNA, 25 bp, Rattus norvegicus
gaaaaactcagtgacttccatgcca

SEQ ID NO: 283103 - DNA, 25 bp, Rattus norvegicus
gaaaaactcgcacacgccaaaagtg

SEQ ID NO: 283104 - DNA, 25 bp, Rattus norvegicus
gaaaaactcgcagacgccaaaagtg

SEQ ID NO: 283105 - DNA, 25 bp, Rattus norvegicus
gaaaaactctggctggaagctcact

SEQ ID NO: 283106 - DNA, 25 bp, Rattus norvegicus
gaaaaactctgggtggaagctcact

SEQ ID NO: 283107 - DNA, 25 bp, Rattus norvegicus
gaaaaactcttaccaggtcctgcac

SEQ ID NO: 283108 - DNA, 25 bp, Rattus norvegicus
gaaaaactcttagcaggtcctgcac

SEQ ID NO: 283109 - DNA, 25 bp, Rattus norvegicus
gaaaaactgcatccccaatgttatg

SEQ ID NO: 283110 - DNA, 25 bp, Rattus norvegicus
gaaaaactgcatgcccaatgttatg

SEQ ID NO: 283111 - DNA, 25 bp, Rattus norvegicus
gaaaaactgtgtatcctaccgagat

SEQ ID NO: 283112 - DNA, 25 bp, Rattus norvegicus
gaaaaactgtgtttcctaccgagat

SEQ ID NO: 283113 - DNA, 25 bp, Rattus norvegicus
gaaaaacttagacaacagcattatt

SEQ ID NO: 283114 - DNA, 25 bp, Rattus norvegicus
gaaaaacttagagaacagcattatt

SEQ ID NO: 283115 - DNA, 25 bp, Rattus norvegicus
gaaaaacttcagaggcttctagacc

SEQ ID NO: 283116 - DNA, 25 bp, Rattus norvegicus
gaaaaacttcagtggcttctagacc

SEQ ID NO: 283117 - DNA, 25 bp, Rattus norvegicus
gaaaaacttgctattggcgccatca

SEQ ID NO: 283118 - DNA, 25 bp, Rattus norvegicus
gaaaaacttgcttttggcgccatca

SEQ ID NO: 283119 - DNA, 25 bp, Rattus norvegicus
gaaaaacttgtacactggcactgtc

SEQ ID NO: 283120 - DNA, 25 bp, Rattus norvegicus
gaaaaacttgtagactggcactgtc

SEQ ID NO: 283121 - DNA, 25 bp, Rattus norvegicus
gaaaaacttttaccccagcacagtg

SEQ ID NO: 283122 - DNA, 25 bp, Rattus norvegicus
gaaaaacttttagcccagcacagtg

SEQ ID NO: 283123 - DNA, 25 bp, Rattus norvegicus
gaaaaagaaccacctaacgttgatg

SEQ ID NO: 283124 - DNA, 25 bp, Rattus norvegicus
gaaaaagaaccagctaacgttgatg

SEQ ID NO: 283125 - DNA, 25 bp, Rattus norvegicus
gaaaaagaacctagcaagtctgcag

SEQ ID NO: 283126 - DNA, 25 bp, Rattus norvegicus
gaaaaagaaccttgcaagtctgcag

SEQ ID NO: 283127 - DNA, 25 bp, Rattus norvegicus
gaaaaagaacttcagactttgaaag

SEQ ID NO: 283128 - DNA, 25 bp, Rattus norvegicus
gaaaaagaacttgagactttgaaag

SEQ ID NO: 283129 - DNA, 25 bp, Rattus norvegicus
gaaaaagaccaacccacaggaattt

SEQ ID NO: 283130 - DNA, 25 bp, Rattus norvegicus
gaaaaagaccaagccacaggaattt

SEQ ID NO: 283131 - DNA, 25 bp, Rattus norvegicus
gaaaaagacctcaggttcctgcatc

SEQ ID NO: 283132 - DNA, 25 bp, Rattus norvegicus
gaaaaagacctctggttcctgcatc

SEQ ID NO: 283133 - DNA, 25 bp, Rattus norvegicus
gaaaaagacctgatgggccatagcg

SEQ ID NO: 283134 - DNA, 25 bp, Rattus norvegicus
gaaaaagacctgttgggccatagcg

SEQ ID NO: 283135 - DNA, 25 bp, Rattus norvegicus
gaaaaagactgaaggccaagagaga

SEQ ID NO: 283136 - DNA, 25 bp, Rattus norvegicus
gaaaaagactgatggccaagagaga

SEQ ID NO: 283137 - DNA, 25 bp, Rattus norvegicus
gaaaaagagccgacttccaagacct

SEQ ID NO: 283138 - DNA, 25 bp, Rattus norvegicus
gaaaaagagccgtcttccaagacct

SEQ ID NO: 283139 - DNA, 25 bp, Rattus norvegicus
gaaaaagattgtaccccacatttgc

SEQ ID NO: 283140 - DNA, 25 bp, Rattus norvegicus
gaaaaagattgttccccacatttgc

SEQ ID NO: 283141 - DNA, 25 bp, Rattus norvegicus
gaaaaagcaaagatcctcgggtaca

SEQ ID NO: 283142 - DNA, 25 bp, Rattus norvegicus
gaaaaagcaaagttcctcgggtaca

SEQ ID NO: 283143 - DNA, 25 bp, Rattus norvegicus
gaaaaagcaacgagcctcagtcacc

SEQ ID NO: 283144 - DNA, 25 bp, Rattus norvegicus
gaaaaagcaacgtgcctcagtcacc

SEQ ID NO: 283145 - DNA, 25 bp, Rattus norvegicus
gaaaaagcacagaatgtaccaaatg

SEQ ID NO: 283146 - DNA, 25 bp, Rattus norvegicus
gaaaaagcacagtatgtaccaaatg

SEQ ID NO: 283147 - DNA, 25 bp, Rattus norvegicus
gaaaaagcacggctctcccagcagt

SEQ ID NO: 283148 - DNA, 25 bp, Rattus norvegicus
gaaaaagcacgggtctcccagcagt

SEQ ID NO: 283149 - DNA, 25 bp, Rattus norvegicus
gaaaaagccagtcggccctgggcta

SEQ ID NO: 283150 - DNA, 25 bp, Rattus norvegicus
gaaaaagccagtgggccctgggcta

SEQ ID NO: 283151 - DNA, 25 bp, Rattus norvegicus
gaaaaagccatgactgccctagcga

SEQ ID NO: 283152 - DNA, 25 bp, Rattus norvegicus
gaaaaagccatgtctgccctagcga

SEQ ID NO: 283153 - DNA, 25 bp, Rattus norvegicus
gaaaaagccattccacacttaaagg

SEQ ID NO: 283154 - DNA, 25 bp, Rattus norvegicus
gaaaaagccattgcacacttaaagg

SEQ ID NO: 283155 - DNA, 25 bp, Rattus norvegicus
gaaaaagccgttcgtgcactgcgtt

SEQ ID NO: 283156 - DNA, 25 bp, Rattus norvegicus
gaaaaagccgttggtgcactgcgtt

SEQ ID NO: 283157 - DNA, 25 bp, Rattus norvegicus
gaaaaagcctcacacctggtgcctt

SEQ ID NO: 283158 - DNA, 25 bp, Rattus norvegicus
gaaaaagcctcagacctggtgcctt

SEQ ID NO: 283159 - DNA, 25 bp, Rattus norvegicus
gaaaaagcctgcatagcgccagttc

SEQ ID NO: 283160 - DNA, 25 bp, Rattus norvegicus
gaaaaagcctgcttagcgccagttc

SEQ ID NO: 283161 - DNA, 25 bp, Rattus norvegicus
gaaaaagccttactgcgcacgcgtc

SEQ ID NO: 283162 - DNA, 25 bp, Rattus norvegicus
gaaaaagccttagtgcgcacgcgtc

SEQ ID NO: 283163 - DNA, 25 bp, Rattus norvegicus
gaaaaagctctactttccacacgaa

SEQ ID NO: 283164 - DNA, 25 bp, Rattus norvegicus
gaaaaagctctagtttccacacgaa

SEQ ID NO: 283165 - DNA, 25 bp, Rattus norvegicus
gaaaaagctgggaatccgctctgcc

SEQ ID NO: 283166 - DNA, 25 bp, Rattus norvegicus
gaaaaagctgggtatccgctctgcc

SEQ ID NO: 283167 - DNA, 25 bp, Rattus norvegicus
gaaaaagcttccagagctgcgccgc

SEQ ID NO: 283168 - DNA, 25 bp, Rattus norvegicus
gaaaaagcttcctgagctgcgccgc

SEQ ID NO: 283169 - DNA, 25 bp, Rattus norvegicus
gaaaaaggactacaacacgttactg

SEQ ID NO: 283170 - DNA, 25 bp, Rattus norvegicus
gaaaaaggactagaacacgttactg

SEQ ID NO: 283171 - DNA, 25 bp, Rattus norvegicus
gaaaaaggagctcacgtcccacctg

SEQ ID NO: 283172 - DNA, 25 bp, Rattus norvegicus
gaaaaaggagctgacgtcccacctg

SEQ ID NO: 283173 - DNA, 25 bp, Rattus norvegicus
gaaaaaggccttagctgcagccctt

SEQ ID NO: 283174 - DNA, 25 bp, Rattus norvegicus
gaaaaaggcctttgctgcagccctt

SEQ ID NO: 283175 - DNA, 25 bp, Rattus norvegicus
gaaaaaggctttaatgcaccagtta

SEQ ID NO: 283176 - DNA, 25 bp, Rattus norvegicus
gaaaaaggcttttatgcaccagtta

SEQ ID NO: 283177 - DNA, 25 bp, Rattus norvegicus
gaaaaagggatccgagccatcatcg

SEQ ID NO: 283178 - DNA, 25 bp, Rattus norvegicus
gaaaaagggatcggagccatcatcg

SEQ ID NO: 283179 - DNA, 25 bp, Rattus norvegicus
gaaaaaggtaggctcaagtctctga

SEQ ID NO: 283180 - DNA, 25 bp, Rattus norvegicus
gaaaaaggtagggtcaagtctctga

SEQ ID NO: 283181 - DNA, 25 bp, Rattus norvegicus
gaaaaaggtgttcgattctctggac

SEQ ID NO: 283182 - DNA, 25 bp, Rattus norvegicus
gaaaaaggtgttggattctctggac

SEQ ID NO: 283183 - DNA, 25 bp, Rattus norvegicus
gaaaaagtagatctcatatgacagc

SEQ ID NO: 283184 - DNA, 25 bp, Rattus norvegicus
gaaaaagtagatgtcatatgacagc

SEQ ID NO: 283185 - DNA, 25 bp, Rattus norvegicus
gaaaaagtccagaccctgcatctag

SEQ ID NO: 283186 - DNA, 25 bp, Rattus norvegicus
gaaaaagtccagtccctgcatctag

SEQ ID NO: 283187 - DNA, 25 bp, Rattus norvegicus
gaaaaagtcgctccttttcaccttt

SEQ ID NO: 283188 - DNA, 25 bp, Rattus norvegicus
gaaaaagtcgctgcttttcaccttt

SEQ ID NO: 283189 - DNA, 25 bp, Rattus norvegicus
gaaaaagtctaacatctccgcctcc

SEQ ID NO: 283190 - DNA, 25 bp, Rattus norvegicus
gaaaaagtctaagatctccgcctcc

SEQ ID NO: 283191 - DNA, 25 bp, Rattus norvegicus
gaaaaagtctctctttgtacccatt

SEQ ID NO: 283192 - DNA, 25 bp, Rattus norvegicus
gaaaaagtctctgtttgtacccatt

SEQ ID NO: 283193 - DNA, 25 bp, Rattus norvegicus
gaaaaagtgcacacccaacgcagtg

SEQ ID NO: 283194 - DNA, 25 bp, Rattus norvegicus
gaaaaagtgcactcccaacgcagtg

SEQ ID NO: 283195 - DNA, 25 bp, Rattus norvegicus
gaaaaagtgtctaccgtgcgcgtgc

SEQ ID NO: 283196 - DNA, 25 bp, Rattus norvegicus
gaaaaagtgtcttccgtgcgcgtgc

SEQ ID NO: 283197 - DNA, 25 bp, Rattus norvegicus
gaaaaagttgttcgatcaggaagcc

SEQ ID NO: 283198 - DNA, 25 bp, Rattus norvegicus
gaaaaagttgttggatcaggaagcc

SEQ ID NO: 283199 - DNA, 25 bp, Rattus norvegicus
gaaaaataccagatcaccttgaaat

SEQ ID NO: 283200 - DNA, 25 bp, Rattus norvegicus
gaaaaataccagttcaccttgaaat

SEQ ID NO: 283201 - DNA, 25 bp, Rattus norvegicus
gaaaaataccttcactgtagcccag

SEQ ID NO: 283202 - DNA, 25 bp, Rattus norvegicus
gaaaaataccttgactgtagcccag

SEQ ID NO: 283203 - DNA, 25 bp, Rattus norvegicus
gaaaaatactctatccacgtgctcc

SEQ ID NO: 283204 - DNA, 25 bp, Rattus norvegicus
gaaaaatactctttccacgtgctcc

SEQ ID NO: 283205 - DNA, 25 bp, Rattus norvegicus
gaaaaatacttcagcaattcctcgc

SEQ ID NO: 283206 - DNA, 25 bp, Rattus norvegicus
gaaaaatacttctgcaattcctcgc

SEQ ID NO: 283207 - DNA, 25 bp, Rattus norvegicus
gaaaaataggagctttcccctgcgg

SEQ ID NO: 283208 - DNA, 25 bp, Rattus norvegicus
gaaaaataggaggtttcccctgcgg

SEQ ID NO: 283209 - DNA, 25 bp, Rattus norvegicus
gaaaaatatccacatctcaccgcca

SEQ ID NO: 283210 - DNA, 25 bp, Rattus norvegicus
gaaaaatatccagatctcaccgcca

SEQ ID NO: 283211 - DNA, 25 bp, Rattus norvegicus
gaaaaatattcccatcccacatgtt

SEQ ID NO: 283212 - DNA, 25 bp, Rattus norvegicus
gaaaaatattccgatcccacatgtt

SEQ ID NO: 283213 - DNA, 25 bp, Rattus norvegicus
gaaaaatcaaatacccactttctgg

SEQ ID NO: 283214 - DNA, 25 bp, Rattus norvegicus
gaaaaatcaaattcccactttctgg

SEQ ID NO: 283215 - DNA, 25 bp, Rattus norvegicus
gaaaaatcatctagaactttttggt

SEQ ID NO: 283216 - DNA, 25 bp, Rattus norvegicus
gaaaaatcatctatttgcaagacta

SEQ ID NO: 283217 - DNA, 25 bp, Rattus norvegicus
gaaaaatcatcttgaactttttggt

SEQ ID NO: 283218 - DNA, 25 bp, Rattus norvegicus
gaaaaatcatctttttgcaagacta

SEQ ID NO: 283219 - DNA, 25 bp, Rattus norvegicus
gaaaaatcatgcatggaattctcct

SEQ ID NO: 283220 - DNA, 25 bp, Rattus norvegicus
gaaaaatcatgcttggaattctcct

SEQ ID NO: 283221 - DNA, 25 bp, Rattus norvegicus
gaaaaatcatgtacaacccctcact

SEQ ID NO: 283222 - DNA, 25 bp, Rattus norvegicus
gaaaaatcatgttcaacccctcact

SEQ ID NO: 283223 - DNA, 25 bp, Rattus norvegicus
gaaaaatccgcgctgcaaaccgaaa

SEQ ID NO: 283224 - DNA, 25 bp, Rattus norvegicus
gaaaaatccgcggtgcaaaccgaaa

SEQ ID NO: 283225 - DNA, 25 bp, Rattus norvegicus
gaaaaatccttaactgatccatcaa

SEQ ID NO: 283226 - DNA, 25 bp, Rattus norvegicus
gaaaaatccttatctgatccatcaa

SEQ ID NO: 283227 - DNA, 25 bp, Rattus norvegicus
gaaaaatctctcagaccttttgggt

SEQ ID NO: 283228 - DNA, 25 bp, Rattus norvegicus
gaaaaatctctctgaccttttgggt

SEQ ID NO: 283229 - DNA, 25 bp, Rattus norvegicus
gaaaaatctcttatccactgtcaca

SEQ ID NO: 283230 - DNA, 25 bp, Rattus norvegicus
gaaaaatctcttttccactgtcaca

SEQ ID NO: 283231 - DNA, 25 bp, Rattus norvegicus
gaaaaatctggactctgttctcgct

SEQ ID NO: 283232 - DNA, 25 bp, Rattus norvegicus
gaaaaatctggagtctgttctcgct

SEQ ID NO: 283233 - DNA, 25 bp, Rattus norvegicus
gaaaaatctgtcctcgtgagctcac

SEQ ID NO: 283234 - DNA, 25 bp, Rattus norvegicus
gaaaaatctgtcgtcgtgagctcac

SEQ ID NO: 283235 - DNA, 25 bp, Rattus norvegicus
gaaaaatcttttcctgttgtcgaaa

SEQ ID NO: 283236 - DNA, 25 bp, Rattus norvegicus
gaaaaatcttttcttcagattgaga

SEQ ID NO: 283237 - DNA, 25 bp, Rattus norvegicus
gaaaaatcttttgctgttgtcgaaa

SEQ ID NO: 283238 - DNA, 25 bp, Rattus norvegicus
gaaaaatcttttgttcagattgaga

SEQ ID NO: 283239 - DNA, 25 bp, Rattus norvegicus
gaaaaatgacgactccacactgctt

SEQ ID NO: 283240 - DNA, 25 bp, Rattus norvegicus
gaaaaatgacgagtccacactgctt

SEQ ID NO: 283241 - DNA, 25 bp, Rattus norvegicus
gaaaaatgccaaaccaacttcccat

SEQ ID NO: 283242 - DNA, 25 bp, Rattus norvegicus
gaaaaatgccaatccaacttcccat

SEQ ID NO: 283243 - DNA, 25 bp, Rattus norvegicus
gaaaaatgccatacctcaaacagga

SEQ ID NO: 283244 - DNA, 25 bp, Rattus norvegicus
gaaaaatgccattcctcaaacagga

SEQ ID NO: 283245 - DNA, 25 bp, Rattus norvegicus
gaaaaatgctaaaaattacccaagg

SEQ ID NO: 283246 - DNA, 25 bp, Rattus norvegicus
gaaaaatgctaataattacccaagg

SEQ ID NO: 283247 - DNA, 25 bp, Rattus norvegicus
gaaaaatgctccatctctactgttc

SEQ ID NO: 283248 - DNA, 25 bp, Rattus norvegicus
gaaaaatgctccttctctactgttc

SEQ ID NO: 283249 - DNA, 25 bp, Rattus norvegicus
gaaaaatgctgcattcctccctttc

SEQ ID NO: 283250 - DNA, 25 bp, Rattus norvegicus
gaaaaatgctgctttcctccctttc

SEQ ID NO: 283251 - DNA, 25 bp, Rattus norvegicus
gaaaaatgctgtctgctggcttgct

SEQ ID NO: 283252 - DNA, 25 bp, Rattus norvegicus
gaaaaatgctgtgtgctggcttgct

SEQ ID NO: 283253 - DNA, 25 bp, Rattus norvegicus
gaaaaatgcttgactctgccggagg

SEQ ID NO: 283254 - DNA, 25 bp, Rattus norvegicus
gaaaaatgcttgtctctgccggagg

SEQ ID NO: 283255 - DNA, 25 bp, Rattus norvegicus
gaaaaatgctttctgctgaaacaaa

SEQ ID NO: 283256 - DNA, 25 bp, Rattus norvegicus
gaaaaatgctttgtgctgaaacaaa

SEQ ID NO: 283257 - DNA, 25 bp, Rattus norvegicus
gaaaaatgggaacctcaactacaat

SEQ ID NO: 283258 - DNA, 25 bp, Rattus norvegicus
gaaaaatgggaagctcaactacaat

SEQ ID NO: 283259 - DNA, 25 bp, Rattus norvegicus
gaaaaatgtgacactctccttggga

SEQ ID NO: 283260 - DNA, 25 bp, Rattus norvegicus
gaaaaatgtgactctctccttggga

SEQ ID NO: 283261 - DNA, 25 bp, Rattus norvegicus
gaaaaattacttactcagcgcccct

SEQ ID NO: 283262 - DNA, 25 bp, Rattus norvegicus
gaaaaattactttctcagcgcccct

SEQ ID NO: 283263 - DNA, 25 bp, Rattus norvegicus
gaaaaattcaagctcgtcgagtata

SEQ ID NO: 283264 - DNA, 25 bp, Rattus norvegicus
gaaaaattcaaggtcgtcgagtata

SEQ ID NO: 283265 - DNA, 25 bp, Rattus norvegicus
gaaaaattcaggcactcctatgaat

SEQ ID NO: 283266 - DNA, 25 bp, Rattus norvegicus
gaaaaattcaggcatggaccctcat

SEQ ID NO: 283267 - DNA, 25 bp, Rattus norvegicus
gaaaaattcagggactcctatgaat

SEQ ID NO: 283268 - DNA, 25 bp, Rattus norvegicus
gaaaaattcagggatggaccctcat

SEQ ID NO: 283269 - DNA, 25 bp, Rattus norvegicus
gaaaaattcatgctcgtcctctatg

SEQ ID NO: 283270 - DNA, 25 bp, Rattus norvegicus
gaaaaattcatggtcgtcctctatg

SEQ ID NO: 283271 - DNA, 25 bp, Rattus norvegicus
gaaaaattcctaagtcccttggcag

SEQ ID NO: 283272 - DNA, 25 bp, Rattus norvegicus
gaaaaattcctatgtcccttggcag

SEQ ID NO: 283273 - DNA, 25 bp, Rattus norvegicus
gaaaaattgattatcgcagcatggg

SEQ ID NO: 283274 - DNA, 25 bp, Rattus norvegicus
gaaaaattgattttcgcagcatggg

SEQ ID NO: 283275 - DNA, 25 bp, Rattus norvegicus
gaaaaattgccactccaagtaggag

SEQ ID NO: 283276 - DNA, 25 bp, Rattus norvegicus
gaaaaattgccagtccaagtaggag

SEQ ID NO: 283277 - DNA, 25 bp, Rattus norvegicus
gaaaaattgctgatcttgtactata

SEQ ID NO: 283278 - DNA, 25 bp, Rattus norvegicus
gaaaaattgctgttcttgtactata

SEQ ID NO: 283279 - DNA, 25 bp, Rattus norvegicus
gaaaaatttcctacactctgccttt

SEQ ID NO: 283280 - DNA, 25 bp, Rattus norvegicus
gaaaaatttccttcactctgccttt

SEQ ID NO: 283281 - DNA, 25 bp, Rattus norvegicus
gaaaaatttttgaaccaccagatgg

SEQ ID NO: 283282 - DNA, 25 bp, Rattus norvegicus
gaaaaatttttgtaccaccagatgg

SEQ ID NO: 283283 - DNA, 25 bp, Rattus norvegicus
gaaaacaaaaatcccattcaggccc

SEQ ID NO: 283284 - DNA, 25 bp, Rattus norvegicus
gaaaacaaaaatgccattcaggccc

SEQ ID NO: 283285 - DNA, 25 bp, Rattus norvegicus
gaaaacaaaaggctgcgggcccatt

SEQ ID NO: 283286 - DNA, 25 bp, Rattus norvegicus
gaaaacaaaagggtgcgggcccatt

SEQ ID NO: 283287 - DNA, 25 bp, Rattus norvegicus
gaaaacaaattaccactcagctatt

SEQ ID NO: 283288 - DNA, 25 bp, Rattus norvegicus
gaaaacaaattagcactcagctatt

SEQ ID NO: 283289 - DNA, 25 bp, Rattus norvegicus
gaaaacaacacccaaagccagagag

SEQ ID NO: 283290 - DNA, 25 bp, Rattus norvegicus
gaaaacaacaccgaaagccagagag

SEQ ID NO: 283291 - DNA, 25 bp, Rattus norvegicus
gaaaacaacatgactcccacaaacc

SEQ ID NO: 283292 - DNA, 25 bp, Rattus norvegicus
gaaaacaacatgtctcccacaaacc

SEQ ID NO: 283293 - DNA, 25 bp, Rattus norvegicus
gaaaacaacccacacacgctcttgg

SEQ ID NO: 283294 - DNA, 25 bp, Rattus norvegicus
gaaaacaacccacaggtccagtgtc

SEQ ID NO: 283295 - DNA, 25 bp, Rattus norvegicus
gaaaacaacccagacacgctcttgg

SEQ ID NO: 283296 - DNA, 25 bp, Rattus norvegicus
gaaaacaacccagaggtccagtgtc

SEQ ID NO: 283297 - DNA, 25 bp, Rattus norvegicus
gaaaacaaccggactgaaggcacaa

SEQ ID NO: 283298 - DNA, 25 bp, Rattus norvegicus
gaaaacaaccggtctgaaggcacaa

SEQ ID NO: 283299 - DNA, 25 bp, Rattus norvegicus
gaaaacaactctaacttactcactt

SEQ ID NO: 283300 - DNA, 25 bp, Rattus norvegicus
gaaaacaactcttacttactcactt

SEQ ID NO: 283301 - DNA, 25 bp, Rattus norvegicus
gaaaacaacttaagtatattctgta

SEQ ID NO: 283302 - DNA, 25 bp, Rattus norvegicus
gaaaacaacttatgtatattctgta

SEQ ID NO: 283303 - DNA, 25 bp, Rattus norvegicus
gaaaacaagcagaacctccctgaac

SEQ ID NO: 283304 - DNA, 25 bp, Rattus norvegicus
gaaaacaagcagtacctccctgaac

SEQ ID NO: 283305 - DNA, 25 bp, Rattus norvegicus
gaaaacaagcctcgtgggccagctt

SEQ ID NO: 283306 - DNA, 25 bp, Rattus norvegicus
gaaaacaagcctggtgggccagctt

SEQ ID NO: 283307 - DNA, 25 bp, Rattus norvegicus
gaaaacaagctcagtcgccggcaga

SEQ ID NO: 283308 - DNA, 25 bp, Rattus norvegicus
gaaaacaagctctgtcgccggcaga

SEQ ID NO: 283309 - DNA, 25 bp, Rattus norvegicus
gaaaacaatgaccttccctgcggac

SEQ ID NO: 283310 - DNA, 25 bp, Rattus norvegicus
gaaaacaatgacgttccctgcggac

SEQ ID NO: 283311 - DNA, 25 bp, Rattus norvegicus
gaaaacaattacaggccaagcagaa

SEQ ID NO: 283312 - DNA, 25 bp, Rattus norvegicus
gaaaacaattactggccaagcagaa

SEQ ID NO: 283313 - DNA, 25 bp, Rattus norvegicus
gaaaacaattttctgggctccagcc

SEQ ID NO: 283314 - DNA, 25 bp, Rattus norvegicus
gaaaacaattttgtgggctccagcc

SEQ ID NO: 283315 - DNA, 25 bp, Rattus norvegicus
gaaaacacaacacacgccactttgg

SEQ ID NO: 283316 - DNA, 25 bp, Rattus norvegicus
gaaaacacaacagacgccactttgg

SEQ ID NO: 283317 - DNA, 25 bp, Rattus norvegicus
gaaaacacacaactggttgcccaat

SEQ ID NO: 283318 - DNA, 25 bp, Rattus norvegicus
gaaaacacacaagtggttgcccaat

SEQ ID NO: 283319 - DNA, 25 bp, Rattus norvegicus
gaaaacacacagatcaagtacttaa

SEQ ID NO: 283320 - DNA, 25 bp, Rattus norvegicus
gaaaacacacagttcaagtacttaa

SEQ ID NO: 283321 - DNA, 25 bp, Rattus norvegicus
gaaaacacagttacagttctgcccc

SEQ ID NO: 283322 - DNA, 25 bp, Rattus norvegicus
gaaaacacagtttcagttctgcccc

SEQ ID NO: 283323 - DNA, 25 bp, Rattus norvegicus
gaaaacaccatgagcgtggtccatg

SEQ ID NO: 283324 - DNA, 25 bp, Rattus norvegicus
gaaaacaccatgtgcgtggtccatg

SEQ ID NO: 283325 - DNA, 25 bp, Rattus norvegicus
gaaaacaccccaagactaaggccag

SEQ ID NO: 283326 - DNA, 25 bp, Rattus norvegicus
gaaaacaccccatgactaaggccag

SEQ ID NO: 283327 - DNA, 25 bp, Rattus norvegicus
gaaaacacctctctgaactgttcac

SEQ ID NO: 283328 - DNA, 25 bp, Rattus norvegicus
gaaaacacctctgtgaactgttcac

SEQ ID NO: 283329 - DNA, 25 bp, Rattus norvegicus
gaaaacacctttaactccagatgta

SEQ ID NO: 283330 - DNA, 25 bp, Rattus norvegicus
gaaaacaccttttactccagatgta

SEQ ID NO: 283331 - DNA, 25 bp, Rattus norvegicus
gaaaacacgtgtcacctcatgtctg

SEQ ID NO: 283332 - DNA, 25 bp, Rattus norvegicus
gaaaacacgtgtgacctcatgtctg

SEQ ID NO: 283333 - DNA, 25 bp, Rattus norvegicus
gaaaacactctcatgctagtatcgc

SEQ ID NO: 283334 - DNA, 25 bp, Rattus norvegicus
gaaaacactctcttgctagtatcgc

SEQ ID NO: 283335 - DNA, 25 bp, Rattus norvegicus
gaaaacactgctacgtgtacacctg

SEQ ID NO: 283336 - DNA, 25 bp, Rattus norvegicus
gaaaacactgcttcgtgtacacctg

SEQ ID NO: 283337 - DNA, 25 bp, Rattus norvegicus
gaaaacactgtaatttcgactgaaa

SEQ ID NO: 283338 - DNA, 25 bp, Rattus norvegicus
gaaaacactgtattttcgactgaaa

SEQ ID NO: 283339 - DNA, 25 bp, Rattus norvegicus
gaaaacactgtgacacgtacaattg

SEQ ID NO: 283340 - DNA, 25 bp, Rattus norvegicus
gaaaacactgtgtcacgtacaattg

SEQ ID NO: 283341 - DNA, 25 bp, Rattus norvegicus
gaaaacacttacaagaatagtcagt

SEQ ID NO: 283342 - DNA, 25 bp, Rattus norvegicus
gaaaacacttactagaatagtcagt

SEQ ID NO: 283343 - DNA, 25 bp, Rattus norvegicus
gaaaacacttcgcagtttgctcgtc

SEQ ID NO: 283344 - DNA, 25 bp, Rattus norvegicus
gaaaacacttcggagtttgctcgtc

SEQ ID NO: 283345 - DNA, 25 bp, Rattus norvegicus
gaaaacagacatcgacgggccctct

SEQ ID NO: 283346 - DNA, 25 bp, Rattus norvegicus
gaaaacagacatggacgggccctct

SEQ ID NO: 283347 - DNA, 25 bp, Rattus norvegicus
gaaaacagaccacccatgcacaagg

SEQ ID NO: 283348 - DNA, 25 bp, Rattus norvegicus
gaaaacagaccagccatgcacaagg

SEQ ID NO: 283349 - DNA, 25 bp, Rattus norvegicus
gaaaacagactgagcgatgcgcgca

SEQ ID NO: 283350 - DNA, 25 bp, Rattus norvegicus
gaaaacagactgtgcgatgcgcgca

SEQ ID NO: 283351 - DNA, 25 bp, Rattus norvegicus
gaaaacagacttaaaagctcaccat

SEQ ID NO: 283352 - DNA, 25 bp, Rattus norvegicus
gaaaacagactttaaagctcaccat

SEQ ID NO: 283353 - DNA, 25 bp, Rattus norvegicus
gaaaacagagctcaggtggccatga

SEQ ID NO: 283354 - DNA, 25 bp, Rattus norvegicus
gaaaacagagctgaggtggccatga

SEQ ID NO: 283355 - DNA, 25 bp, Rattus norvegicus
gaaaacagccccatcgaggaattgg

SEQ ID NO: 283356 - DNA, 25 bp, Rattus norvegicus
gaaaacagccccttcgaggaattgg

SEQ ID NO: 283357 - DNA, 25 bp, Rattus norvegicus
gaaaacagcctacaggtctcccaag

SEQ ID NO: 283358 - DNA, 25 bp, Rattus norvegicus
gaaaacagcctagaggtctcccaag

SEQ ID NO: 283359 - DNA, 25 bp, Rattus norvegicus
gaaaacagctcacagccatatctgc

SEQ ID NO: 283360 - DNA, 25 bp, Rattus norvegicus
gaaaacagctcagagccatatctgc

SEQ ID NO: 283361 - DNA, 25 bp, Rattus norvegicus
gaaaacagctccctcaaagccagag

SEQ ID NO: 283362 - DNA, 25 bp, Rattus norvegicus
gaaaacagctccgtcaaagccagag

SEQ ID NO: 283363 - DNA, 25 bp, Rattus norvegicus
gaaaacagctctagacatgataggt

SEQ ID NO: 283364 - DNA, 25 bp, Rattus norvegicus
gaaaacagctctataaattgccttt

SEQ ID NO: 283365 - DNA, 25 bp, Rattus norvegicus
gaaaacagctcttgacatgataggt

SEQ ID NO: 283366 - DNA, 25 bp, Rattus norvegicus
gaaaacagctctttaaattgccttt

SEQ ID NO: 283367 - DNA, 25 bp, Rattus norvegicus
gaaaacagctgaactcttgggaagg

SEQ ID NO: 283368 - DNA, 25 bp, Rattus norvegicus
gaaaacagctgatctcttgggaagg

SEQ ID NO: 283369 - DNA, 25 bp, Rattus norvegicus
gaaaacagcttcaactctacgaggg

SEQ ID NO: 283370 - DNA, 25 bp, Rattus norvegicus
gaaaacagcttctactctacgaggg

SEQ ID NO: 283371 - DNA, 25 bp, Rattus norvegicus
gaaaacaggcccctaggctttgcac

SEQ ID NO: 283372 - DNA, 25 bp, Rattus norvegicus
gaaaacaggcccgtaggctttgcac

SEQ ID NO: 283373 - DNA, 25 bp, Rattus norvegicus
gaaaacaggctcaaccatcaacagt

SEQ ID NO: 283374 - DNA, 25 bp, Rattus norvegicus
gaaaacaggctctaccatcaacagt

SEQ ID NO: 283375 - DNA, 25 bp, Rattus norvegicus
gaaaacagtattcctcagcttctcc

SEQ ID NO: 283376 - DNA, 25 bp, Rattus norvegicus
gaaaacagtattgctcagcttctcc

SEQ ID NO: 283377 - DNA, 25 bp, Rattus norvegicus
gaaaacagtgacacatcgccaaact

SEQ ID NO: 283378 - DNA, 25 bp, Rattus norvegicus
gaaaacagtgactcatcgccaaact

SEQ ID NO: 283379 - DNA, 25 bp, Rattus norvegicus
gaaaacataactatcccctgagcag

SEQ ID NO: 283380 - DNA, 25 bp, Rattus norvegicus
gaaaacataactttcccctgagcag

SEQ ID NO: 283381 - DNA, 25 bp, Rattus norvegicus
gaaaacatcattccttgggtcaaga

SEQ ID NO: 283382 - DNA, 25 bp, Rattus norvegicus
gaaaacatcattgcttgggtcaaga

SEQ ID NO: 283383 - DNA, 25 bp, Rattus norvegicus
gaaaacatccaaaagccagcaacat

SEQ ID NO: 283384 - DNA, 25 bp, Rattus norvegicus
gaaaacatccaatagccagcaacat

SEQ ID NO: 283385 - DNA, 25 bp, Rattus norvegicus
gaaaacatccagactgttaaactga

SEQ ID NO: 283386 - DNA, 25 bp, Rattus norvegicus
gaaaacatccagtctgttaaactga

SEQ ID NO: 283387 - DNA, 25 bp, Rattus norvegicus
gaaaacatcccgctgtgcatggtgg

SEQ ID NO: 283388 - DNA, 25 bp, Rattus norvegicus
gaaaacatcccggtgtgcatggtgg

SEQ ID NO: 283389 - DNA, 25 bp, Rattus norvegicus
gaaaacatccgccaagacttctgag

SEQ ID NO: 283390 - DNA, 25 bp, Rattus norvegicus
gaaaacatccgcgaagacttctgag

SEQ ID NO: 283391 - DNA, 25 bp, Rattus norvegicus
gaaaacatcctgaaaacttcgtaca

SEQ ID NO: 283392 - DNA, 25 bp, Rattus norvegicus
gaaaacatcctgtaaacttcgtaca

SEQ ID NO: 283393 - DNA, 25 bp, Rattus norvegicus
gaaaacatccttcatcctgacagct

SEQ ID NO: 283394 - DNA, 25 bp, Rattus norvegicus
gaaaacatccttcgcagtctgaact

SEQ ID NO: 283395 - DNA, 25 bp, Rattus norvegicus
gaaaacatccttgatcctgacagct

SEQ ID NO: 283396 - DNA, 25 bp, Rattus norvegicus
gaaaacatccttggcagtctgaact

SEQ ID NO: 283397 - DNA, 25 bp, Rattus norvegicus
gaaaacatcgcacaccctggaagaa

SEQ ID NO: 283398 - DNA, 25 bp, Rattus norvegicus
gaaaacatcgcagaccctggaagaa

SEQ ID NO: 283399 - DNA, 25 bp, Rattus norvegicus
gaaaacatcttaaacctgagcctga

SEQ ID NO: 283400 - DNA, 25 bp, Rattus norvegicus
gaaaacatcttatacctgagcctga

SEQ ID NO: 283401 - DNA, 25 bp, Rattus norvegicus
gaaaacatcttcagggcacggcagt

SEQ ID NO: 283402 - DNA, 25 bp, Rattus norvegicus
gaaaacatcttctgggcacggcagt

SEQ ID NO: 283403 - DNA, 25 bp, Rattus norvegicus
gaaaacatcttgcatcaaggcatac

SEQ ID NO: 283404 - DNA, 25 bp, Rattus norvegicus
gaaaacatcttggatcaaggcatac

SEQ ID NO: 283405 - DNA, 25 bp, Rattus norvegicus
gaaaacatgcagacaggcagatcaa

SEQ ID NO: 283406 - DNA, 25 bp, Rattus norvegicus
gaaaacatgcagtcaggcagatcaa

SEQ ID NO: 283407 - DNA, 25 bp, Rattus norvegicus
gaaaacatggaacccggagccgaga

SEQ ID NO: 283408 - DNA, 25 bp, Rattus norvegicus
gaaaacatggaagccggagccgaga

SEQ ID NO: 283409 - DNA, 25 bp, Rattus norvegicus
gaaaacatggctaaacccaacccag

SEQ ID NO: 283410 - DNA, 25 bp, Rattus norvegicus
gaaaacatggcttaacccaacccag

SEQ ID NO: 283411 - DNA, 25 bp, Rattus norvegicus
gaaaacatgtaactgggtaactgac

SEQ ID NO: 283412 - DNA, 25 bp, Rattus norvegicus
gaaaacatgtaagtgggtaactgac

SEQ ID NO: 283413 - DNA, 25 bp, Rattus norvegicus
gaaaacatgtttctactgagtactg

SEQ ID NO: 283414 - DNA, 25 bp, Rattus norvegicus
gaaaacatgtttgtactgagtactg

SEQ ID NO: 283415 - DNA, 25 bp, Rattus norvegicus
gaaaacattaacatgctcactgtag

SEQ ID NO: 283416 - DNA, 25 bp, Rattus norvegicus
gaaaacattaacttgctcactgtag

SEQ ID NO: 283417 - DNA, 25 bp, Rattus norvegicus
gaaaacattaagctggcccaatggt

SEQ ID NO: 283418 - DNA, 25 bp, Rattus norvegicus
gaaaacattaaggtggcccaatggt

SEQ ID NO: 283419 - DNA, 25 bp, Rattus norvegicus
gaaaacattactctccctgagctgt

SEQ ID NO: 283420 - DNA, 25 bp, Rattus norvegicus
gaaaacattactgtccctgagctgt

SEQ ID NO: 283421 - DNA, 25 bp, Rattus norvegicus
gaaaacattatcaattgtcaccctg

SEQ ID NO: 283422 - DNA, 25 bp, Rattus norvegicus
gaaaacattatctattgtcaccctg

SEQ ID NO: 283423 - DNA, 25 bp, Rattus norvegicus
gaaaacattcacagtccggtgcata

SEQ ID NO: 283424 - DNA, 25 bp, Rattus norvegicus
gaaaacattcactgtccggtgcata

SEQ ID NO: 283425 - DNA, 25 bp, Rattus norvegicus
gaaaacattcctattgcactgtaaa

SEQ ID NO: 283426 - DNA, 25 bp, Rattus norvegicus
gaaaacattccttttgcactgtaaa

SEQ ID NO: 283427 - DNA, 25 bp, Rattus norvegicus
gaaaacattcttcatcagccatctc

SEQ ID NO: 283428 - DNA, 25 bp, Rattus norvegicus
gaaaacattcttgatcagccatctc

SEQ ID NO: 283429 - DNA, 25 bp, Rattus norvegicus
gaaaacatttcaaacctcttagaga

SEQ ID NO: 283430 - DNA, 25 bp, Rattus norvegicus
gaaaacatttcatacctcttagaga

SEQ ID NO: 283431 - DNA, 25 bp, Rattus norvegicus
gaaaacatttccagtgaggccgcct

SEQ ID NO: 283432 - DNA, 25 bp, Rattus norvegicus
gaaaacatttcctgtgaggccgcct

SEQ ID NO: 283433 - DNA, 25 bp, Rattus norvegicus
gaaaacatttctcacttggaaccca

SEQ ID NO: 283434 - DNA, 25 bp, Rattus norvegicus
gaaaacatttctgacttggaaccca

SEQ ID NO: 283435 - DNA, 25 bp, Rattus norvegicus
gaaaacatttgcacctggcaggtcc

SEQ ID NO: 283436 - DNA, 25 bp, Rattus norvegicus
gaaaacatttgctcctggcaggtcc

SEQ ID NO: 283437 - DNA, 25 bp, Rattus norvegicus
gaaaacatttgtatgggcccagcct

SEQ ID NO: 283438 - DNA, 25 bp, Rattus norvegicus
gaaaacatttgtttgggcccagcct

SEQ ID NO: 283439 - DNA, 25 bp, Rattus norvegicus
gaaaaccaaacacccagtcagctgt

SEQ ID NO: 283440 - DNA, 25 bp, Rattus norvegicus
gaaaaccaaacagccagtcagctgt

SEQ ID NO: 283441 - DNA, 25 bp, Rattus norvegicus
gaaaaccaaagacctaatgacaaaa

SEQ ID NO: 283442 - DNA, 25 bp, Rattus norvegicus
gaaaaccaaagagctaatgacaaaa

SEQ ID NO: 283443 - DNA, 25 bp, Rattus norvegicus
gaaaaccaacctcaaccacacagtg

SEQ ID NO: 283444 - DNA, 25 bp, Rattus norvegicus
gaaaaccaacctcgtagagcgctta

SEQ ID NO: 283445 - DNA, 25 bp, Rattus norvegicus
gaaaaccaacctgaaccacacagtg

SEQ ID NO: 283446 - DNA, 25 bp, Rattus norvegicus
gaaaaccaacctggtagagcgctta

SEQ ID NO: 283447 - DNA, 25 bp, Rattus norvegicus
gaaaaccaactgctcttgtaatgct

SEQ ID NO: 283448 - DNA, 25 bp, Rattus norvegicus
gaaaaccaactggtcttgtaatgct

SEQ ID NO: 283449 - DNA, 25 bp, Rattus norvegicus
gaaaaccaacttacactgttaggag

SEQ ID NO: 283450 - DNA, 25 bp, Rattus norvegicus
gaaaaccaactttcactgttaggag

SEQ ID NO: 283451 - DNA, 25 bp, Rattus norvegicus
gaaaaccaagaactatgctccgaat

SEQ ID NO: 283452 - DNA, 25 bp, Rattus norvegicus
gaaaaccaagaagtatgctccgaat

SEQ ID NO: 283453 - DNA, 25 bp, Rattus norvegicus
gaaaaccaatctccatgatcatcag

SEQ ID NO: 283454 - DNA, 25 bp, Rattus norvegicus
gaaaaccaatctgcatgatcatcag

SEQ ID NO: 283455 - DNA, 25 bp, Rattus norvegicus
gaaaaccacaatcctgactctatga

SEQ ID NO: 283456 - DNA, 25 bp, Rattus norvegicus
gaaaaccacaatgctgactctatga

SEQ ID NO: 283457 - DNA, 25 bp, Rattus norvegicus
gaaaaccacagaatccagtgcttct

SEQ ID NO: 283458 - DNA, 25 bp, Rattus norvegicus
gaaaaccacagattccagtgcttct

SEQ ID NO: 283459 - DNA, 25 bp, Rattus norvegicus
gaaaaccacccactgatgggccata

SEQ ID NO: 283460 - DNA, 25 bp, Rattus norvegicus
gaaaaccacccagtgatgggccata

SEQ ID NO: 283461 - DNA, 25 bp, Rattus norvegicus
gaaaaccaccggcttcagaaggcgc

SEQ ID NO: 283462 - DNA, 25 bp, Rattus norvegicus
gaaaaccaccgggttcagaaggcgc

SEQ ID NO: 283463 - DNA, 25 bp, Rattus norvegicus
gaaaaccacctacgaatgtccagac

SEQ ID NO: 283464 - DNA, 25 bp, Rattus norvegicus
gaaaaccacctaggaatgtccagac

SEQ ID NO: 283465 - DNA, 25 bp, Rattus norvegicus
gaaaaccaccttaaggattttgcat

SEQ ID NO: 283466 - DNA, 25 bp, Rattus norvegicus
gaaaaccacctttaggattttgcat

SEQ ID NO: 283467 - DNA, 25 bp, Rattus norvegicus
gaaaaccactcacaattttctctgg

SEQ ID NO: 283468 - DNA, 25 bp, Rattus norvegicus
gaaaaccactcagaattttctctgg

SEQ ID NO: 283469 - DNA, 25 bp, Rattus norvegicus
gaaaaccactgcagaagagcctcaa

SEQ ID NO: 283470 - DNA, 25 bp, Rattus norvegicus
gaaaaccactgctgaagagcctcaa

SEQ ID NO: 283471 - DNA, 25 bp, Rattus norvegicus
gaaaaccacttactgatccaatcca

SEQ ID NO: 283472 - DNA, 25 bp, Rattus norvegicus
gaaaaccacttagtgatccaatcca

SEQ ID NO: 283473 - DNA, 25 bp, Rattus norvegicus
gaaaaccagcatagccagctaggca

SEQ ID NO: 283474 - DNA, 25 bp, Rattus norvegicus
gaaaaccagcattgccagctaggca

SEQ ID NO: 283475 - DNA, 25 bp, Rattus norvegicus
gaaaaccagccaccacttcaatgag

SEQ ID NO: 283476 - DNA, 25 bp, Rattus norvegicus
gaaaaccagccagcacttcaatgag

SEQ ID NO: 283477 - DNA, 25 bp, Rattus norvegicus
gaaaaccagcgacttcggcaggaga

SEQ ID NO: 283478 - DNA, 25 bp, Rattus norvegicus
gaaaaccagcgagttcggcaggaga

SEQ ID NO: 283479 - DNA, 25 bp, Rattus norvegicus
gaaaaccagtaactcaaggaccaga

SEQ ID NO: 283480 - DNA, 25 bp, Rattus norvegicus
gaaaaccagtaagtcaaggaccaga

SEQ ID NO: 283481 - DNA, 25 bp, Rattus norvegicus
gaaaaccatcacctacgagtcttct

SEQ ID NO: 283482 - DNA, 25 bp, Rattus norvegicus
gaaaaccatcacgtacgagtcttct

SEQ ID NO: 283483 - DNA, 25 bp, Rattus norvegicus
gaaaaccatgagagaacgcctcagg

SEQ ID NO: 283484 - DNA, 25 bp, Rattus norvegicus
gaaaaccatgagtgaacgcctcagg

SEQ ID NO: 283485 - DNA, 25 bp, Rattus norvegicus
gaaaaccatggtataagtcaccaca

SEQ ID NO: 283486 - DNA, 25 bp, Rattus norvegicus
gaaaaccatggtttaagtcaccaca

SEQ ID NO: 283487 - DNA, 25 bp, Rattus norvegicus
gaaaaccatgttcgctggctggtat

SEQ ID NO: 283488 - DNA, 25 bp, Rattus norvegicus
gaaaaccatgttggctggctggtat

SEQ ID NO: 283489 - DNA, 25 bp, Rattus norvegicus
gaaaaccattaaatagctatcaaat

SEQ ID NO: 283490 - DNA, 25 bp, Rattus norvegicus
gaaaaccattaattagctatcaaat

SEQ ID NO: 283491 - DNA, 25 bp, Rattus norvegicus
gaaaaccattcaactactccataga

SEQ ID NO: 283492 - DNA, 25 bp, Rattus norvegicus
gaaaaccattcatctactccataga

SEQ ID NO: 283493 - DNA, 25 bp, Rattus norvegicus
gaaaaccattctcttgaaatacaga

SEQ ID NO: 283494 - DNA, 25 bp, Rattus norvegicus
gaaaaccattctgttgaaatacaga

SEQ ID NO: 283495 - DNA, 25 bp, Rattus norvegicus
gaaaaccattgcagcttgtctctag

SEQ ID NO: 283496 - DNA, 25 bp, Rattus norvegicus
gaaaaccattgctgcttgtctctag

SEQ ID NO: 283497 - DNA, 25 bp, Rattus norvegicus
gaaaacccaaaaccagcttccctga

SEQ ID NO: 283498 - DNA, 25 bp, Rattus norvegicus
gaaaacccaaaagcagcttccctga

SEQ ID NO: 283499 - DNA, 25 bp, Rattus norvegicus
gaaaacccaaggagtcctctgcctt

SEQ ID NO: 283500 - DNA, 25 bp, Rattus norvegicus
gaaaacccaaggtgtcctctgcctt

SEQ ID NO: 283501 - DNA, 25 bp, Rattus norvegicus
gaaaacccagatcacttcttaccat

SEQ ID NO: 283502 - DNA, 25 bp, Rattus norvegicus
gaaaacccagatcctgacagtgatt

SEQ ID NO: 283503 - DNA, 25 bp, Rattus norvegicus
gaaaacccagatgacttcttaccat

SEQ ID NO: 283504 - DNA, 25 bp, Rattus norvegicus
gaaaacccagatgctgacagtgatt

SEQ ID NO: 283505 - DNA, 25 bp, Rattus norvegicus
gaaaacccagccatcacaaaaacaa

SEQ ID NO: 283506 - DNA, 25 bp, Rattus norvegicus
gaaaacccagccattgaagtcttgt

SEQ ID NO: 283507 - DNA, 25 bp, Rattus norvegicus
gaaaacccagccttcacaaaaacaa

SEQ ID NO: 283508 - DNA, 25 bp, Rattus norvegicus
gaaaacccagcctttgaagtcttgt

SEQ ID NO: 283509 - DNA, 25 bp, Rattus norvegicus
gaaaacccatctactcagtattgga

SEQ ID NO: 283510 - DNA, 25 bp, Rattus norvegicus
gaaaacccatcttctcagtattgga

SEQ ID NO: 283511 - DNA, 25 bp, Rattus norvegicus
gaaaaccccacgaaatcatgcaagt

SEQ ID NO: 283512 - DNA, 25 bp, Rattus norvegicus
gaaaaccccacgtaatcatgcaagt

SEQ ID NO: 283513 - DNA, 25 bp, Rattus norvegicus
gaaaaccccagaatatcctcgtcaa

SEQ ID NO: 283514 - DNA, 25 bp, Rattus norvegicus
gaaaaccccagattatcctcgtcaa

SEQ ID NO: 283515 - DNA, 25 bp, Rattus norvegicus
gaaaaccccagccatgattggaggt

SEQ ID NO: 283516 - DNA, 25 bp, Rattus norvegicus
gaaaaccccagcgatgattggaggt

SEQ ID NO: 283517 - DNA, 25 bp, Rattus norvegicus
gaaaaccccaggagtggatgccccg

SEQ ID NO: 283518 - DNA, 25 bp, Rattus norvegicus
gaaaaccccaggtgtggatgccccg

SEQ ID NO: 283519 - DNA, 25 bp, Rattus norvegicus
gaaaaccccattcgtcgaggaacag

SEQ ID NO: 283520 - DNA, 25 bp, Rattus norvegicus
gaaaaccccattggtcgaggaacag

SEQ ID NO: 283521 - DNA, 25 bp, Rattus norvegicus
gaaaacccctagatggccaaatatg

SEQ ID NO: 283522 - DNA, 25 bp, Rattus norvegicus
gaaaacccctagttggccaaatatg

SEQ ID NO: 283523 - DNA, 25 bp, Rattus norvegicus
gaaaacccctgacgatccctgaact

SEQ ID NO: 283524 - DNA, 25 bp, Rattus norvegicus
gaaaacccctgaggatccctgaact

SEQ ID NO: 283525 - DNA, 25 bp, Rattus norvegicus
gaaaacccgaagacagtgagcttga

SEQ ID NO: 283526 - DNA, 25 bp, Rattus norvegicus
gaaaacccgaagtcagtgagcttga

SEQ ID NO: 283527 - DNA, 25 bp, Rattus norvegicus
gaaaacccgataagttaatccatgt

SEQ ID NO: 283528 - DNA, 25 bp, Rattus norvegicus
gaaaacccgatatgttaatccatgt

SEQ ID NO: 283529 - DNA, 25 bp, Rattus norvegicus
gaaaacccgctgctattccatgaag

SEQ ID NO: 283530 - DNA, 25 bp, Rattus norvegicus
gaaaacccgctggtattccatgaag

SEQ ID NO: 283531 - DNA, 25 bp, Rattus norvegicus
gaaaaccctaggagactgtcagaga

SEQ ID NO: 283532 - DNA, 25 bp, Rattus norvegicus
gaaaaccctaggtgactgtcagaga

SEQ ID NO: 283533 - DNA, 25 bp, Rattus norvegicus
gaaaaccctcaaccggcatactaga

SEQ ID NO: 283534 - DNA, 25 bp, Rattus norvegicus
gaaaaccctcaagcggcatactaga

SEQ ID NO: 283535 - DNA, 25 bp, Rattus norvegicus
gaaaaccctggacccggtctggaag

SEQ ID NO: 283536 - DNA, 25 bp, Rattus norvegicus
gaaaaccctggagccggtctggaag

SEQ ID NO: 283537 - DNA, 25 bp, Rattus norvegicus
gaaaacccttcacatctttgatata

SEQ ID NO: 283538 - DNA, 25 bp, Rattus norvegicus
gaaaacccttcagatctttgatata

SEQ ID NO: 283539 - DNA, 25 bp, Rattus norvegicus
gaaaaccgaactaattccatcagca

SEQ ID NO: 283540 - DNA, 25 bp, Rattus norvegicus
gaaaaccgaacttattccatcagca

SEQ ID NO: 283541 - DNA, 25 bp, Rattus norvegicus
gaaaaccgagctctcttgaagatgt

SEQ ID NO: 283542 - DNA, 25 bp, Rattus norvegicus
gaaaaccgagctgtcttgaagatgt

SEQ ID NO: 283543 - DNA, 25 bp, Rattus norvegicus
gaaaaccgagtgacccagagaactg

SEQ ID NO: 283544 - DNA, 25 bp, Rattus norvegicus
gaaaaccgagtgtcccagagaactg

SEQ ID NO: 283545 - DNA, 25 bp, Rattus norvegicus
gaaaaccgagttccgtctgaagaca

SEQ ID NO: 283546 - DNA, 25 bp, Rattus norvegicus
gaaaaccgagttgcgtctgaagaca

SEQ ID NO: 283547 - DNA, 25 bp, Rattus norvegicus
gaaaaccgccaacctctggaagcct

SEQ ID NO: 283548 - DNA, 25 bp, Rattus norvegicus
gaaaaccgccaagctctggaagcct

SEQ ID NO: 283549 - DNA, 25 bp, Rattus norvegicus
gaaaaccgtggacttgcacatctcc

SEQ ID NO: 283550 - DNA, 25 bp, Rattus norvegicus
gaaaaccgtggagttgcacatctcc

SEQ ID NO: 283551 - DNA, 25 bp, Rattus norvegicus
gaaaaccgtggcacattctggtcaa

SEQ ID NO: 283552 - DNA, 25 bp, Rattus norvegicus
gaaaaccgtggctcattctggtcaa

SEQ ID NO: 283553 - DNA, 25 bp, Rattus norvegicus
gaaaaccgtgttcttcctagcagtc

SEQ ID NO: 283554 - DNA, 25 bp, Rattus norvegicus
gaaaaccgtgttgttcctagcagtc

SEQ ID NO: 283555 - DNA, 25 bp, Rattus norvegicus
gaaaaccgttaaagattccgcagga

SEQ ID NO: 283556 - DNA, 25 bp, Rattus norvegicus
gaaaaccgttaatgattccgcagga

SEQ ID NO: 283557 - DNA, 25 bp, Rattus norvegicus
gaaaacctaagcagccctacaagag

SEQ ID NO: 283558 - DNA, 25 bp, Rattus norvegicus
gaaaacctaagcattttgctctcct

SEQ ID NO: 283559 - DNA, 25 bp, Rattus norvegicus
gaaaacctaagctgccctacaagag

SEQ ID NO: 283560 - DNA, 25 bp, Rattus norvegicus
gaaaacctaagctttttgctctcct

SEQ ID NO: 283561 - DNA, 25 bp, Rattus norvegicus
gaaaacctaatcaaagcggcgctat

SEQ ID NO: 283562 - DNA, 25 bp, Rattus norvegicus
gaaaacctaatctaagcggcgctat

SEQ ID NO: 283563 - DNA, 25 bp, Rattus norvegicus
gaaaacctacataaaaattggccag

SEQ ID NO: 283564 - DNA, 25 bp, Rattus norvegicus
gaaaacctacatctagccacaggct

SEQ ID NO: 283565 - DNA, 25 bp, Rattus norvegicus
gaaaacctacatgtagccacaggct

SEQ ID NO: 283566 - DNA, 25 bp, Rattus norvegicus
gaaaacctacattaaaattggccag

SEQ ID NO: 283567 - DNA, 25 bp, Rattus norvegicus
gaaaacctaggtctgatccgtctgt

SEQ ID NO: 283568 - DNA, 25 bp, Rattus norvegicus
gaaaacctaggtgtgatccgtctgt

SEQ ID NO: 283569 - DNA, 25 bp, Rattus norvegicus
gaaaacctatggcaacggctactct

SEQ ID NO: 283570 - DNA, 25 bp, Rattus norvegicus
gaaaacctatgggaacggctactct

SEQ ID NO: 283571 - DNA, 25 bp, Rattus norvegicus
gaaaacctccacagaggatccggga

SEQ ID NO: 283572 - DNA, 25 bp, Rattus norvegicus
gaaaacctccactgaggatccggga

SEQ ID NO: 283573 - DNA, 25 bp, Rattus norvegicus
gaaaacctcctgagtttgcagttta

SEQ ID NO: 283574 - DNA, 25 bp, Rattus norvegicus
gaaaacctcctgtgtttgcagttta

SEQ ID NO: 283575 - DNA, 25 bp, Rattus norvegicus
gaaaacctccttcgcagacttagac

SEQ ID NO: 283576 - DNA, 25 bp, Rattus norvegicus
gaaaacctccttggcagacttagac

SEQ ID NO: 283577 - DNA, 25 bp, Rattus norvegicus
gaaaacctcgccctcaacatgtata

SEQ ID NO: 283578 - DNA, 25 bp, Rattus norvegicus
gaaaacctcgccgtcaacatgtata

SEQ ID NO: 283579 - DNA, 25 bp, Rattus norvegicus
gaaaacctctccacactgaagatat

SEQ ID NO: 283580 - DNA, 25 bp, Rattus norvegicus
gaaaacctctcctcactgaagatat

SEQ ID NO: 283581 - DNA, 25 bp, Rattus norvegicus
gaaaacctgaaacacctgctctgag

SEQ ID NO: 283582 - DNA, 25 bp, Rattus norvegicus
gaaaacctgaaagacctgctctgag

SEQ ID NO: 283583 - DNA, 25 bp, Rattus norvegicus
gaaaacctgagacatcgactgaaaa

SEQ ID NO: 283584 - DNA, 25 bp, Rattus norvegicus
gaaaacctgagagatcgactgaaaa

SEQ ID NO: 283585 - DNA, 25 bp, Rattus norvegicus
gaaaacctgccacatgctcactttt

SEQ ID NO: 283586 - DNA, 25 bp, Rattus norvegicus
gaaaacctgccagatgctcactttt

SEQ ID NO: 283587 - DNA, 25 bp, Rattus norvegicus
gaaaacctgcctcctttaagaaaca

SEQ ID NO: 283588 - DNA, 25 bp, Rattus norvegicus
gaaaacctgcctgctttaagaaaca

SEQ ID NO: 283589 - DNA, 25 bp, Rattus norvegicus
gaaaacctgctgacgcagtagtgga

SEQ ID NO: 283590 - DNA, 25 bp, Rattus norvegicus
gaaaacctgctgtcgcagtagtgga

SEQ ID NO: 283591 - DNA, 25 bp, Rattus norvegicus
gaaaacctgcttaagtttgcagcta

SEQ ID NO: 283592 - DNA, 25 bp, Rattus norvegicus
gaaaacctgctttagtttgcagcta

SEQ ID NO: 283593 - DNA, 25 bp, Rattus norvegicus
gaaaacctggcgatgaccacagcaa

SEQ ID NO: 283594 - DNA, 25 bp, Rattus norvegicus
gaaaacctggcgttgaccacagcaa

SEQ ID NO: 283595 - DNA, 25 bp, Rattus norvegicus
gaaaacctggtgatcacttgacaca

SEQ ID NO: 283596 - DNA, 25 bp, Rattus norvegicus
gaaaacctggtgttcacttgacaca

SEQ ID NO: 283597 - DNA, 25 bp, Rattus norvegicus
gaaaacctgtatatgattcgacatt

SEQ ID NO: 283598 - DNA, 25 bp, Rattus norvegicus
gaaaacctgtatttgattcgacatt

SEQ ID NO: 283599 - DNA, 25 bp, Rattus norvegicus
gaaaacctgtctcggcagggttgct

SEQ ID NO: 283600 - DNA, 25 bp, Rattus norvegicus
gaaaacctgtctgggcagggttgct

SEQ ID NO: 283601 - DNA, 25 bp, Rattus norvegicus
gaaaacctgtgactcttggcactga

SEQ ID NO: 283602 - DNA, 25 bp, Rattus norvegicus
gaaaacctgtgagtcttggcactga

SEQ ID NO: 283603 - DNA, 25 bp, Rattus norvegicus
gaaaacctgtggacccggaacagca

SEQ ID NO: 283604 - DNA, 25 bp, Rattus norvegicus
gaaaacctgtggtcccggaacagca

SEQ ID NO: 283605 - DNA, 25 bp, Rattus norvegicus
gaaaacctgttgctatccacatcat

SEQ ID NO: 283606 - DNA, 25 bp, Rattus norvegicus
gaaaacctgttggtatccacatcat

SEQ ID NO: 283607 - DNA, 25 bp, Rattus norvegicus
gaaaacctgtttaaggccctatgca

SEQ ID NO: 283608 - DNA, 25 bp, Rattus norvegicus
gaaaacctgtttccaaccactggat

SEQ ID NO: 283609 - DNA, 25 bp, Rattus norvegicus
gaaaacctgtttgcaaccactggat

SEQ ID NO: 283610 - DNA, 25 bp, Rattus norvegicus
gaaaacctgttttaggccctatgca

SEQ ID NO: 283611 - DNA, 25 bp, Rattus norvegicus
gaaaaccttattcgcttctgctggt

SEQ ID NO: 283612 - DNA, 25 bp, Rattus norvegicus
gaaaaccttattggcttctgctggt

SEQ ID NO: 283613 - DNA, 25 bp, Rattus norvegicus
gaaaaccttctcctcgtgcaagtag

SEQ ID NO: 283614 - DNA, 25 bp, Rattus norvegicus
gaaaaccttctcgtcgtgcaagtag

SEQ ID NO: 283615 - DNA, 25 bp, Rattus norvegicus
gaaaaccttgagatattccacagaa

SEQ ID NO: 283616 - DNA, 25 bp, Rattus norvegicus
gaaaaccttgagttattccacagaa

SEQ ID NO: 283617 - DNA, 25 bp, Rattus norvegicus
gaaaaccttggcattcctgaagaag

SEQ ID NO: 283618 - DNA, 25 bp, Rattus norvegicus
gaaaaccttggctttcctgaagaag

SEQ ID NO: 283619 - DNA, 25 bp, Rattus norvegicus
gaaaaccttgtgaagcagtggcgac

SEQ ID NO: 283620 - DNA, 25 bp, Rattus norvegicus
gaaaaccttgtgtagcagtggcgac

SEQ ID NO: 283621 - DNA, 25 bp, Rattus norvegicus
gaaaacctttaaaacattggcatgt

SEQ ID NO: 283622 - DNA, 25 bp, Rattus norvegicus
gaaaacctttaatacattggcatgt

SEQ ID NO: 283623 - DNA, 25 bp, Rattus norvegicus
gaaaaccttttcagggctgtgtgaa

SEQ ID NO: 283624 - DNA, 25 bp, Rattus norvegicus
gaaaaccttttctgggctgtgtgaa

SEQ ID NO: 283625 - DNA, 25 bp, Rattus norvegicus
gaaaacgaagccattctgcatctgc

SEQ ID NO: 283626 - DNA, 25 bp, Rattus norvegicus
gaaaacgaagcctttctgcatctgc

SEQ ID NO: 283627 - DNA, 25 bp, Rattus norvegicus
gaaaacgacaggactcaggcacagc

SEQ ID NO: 283628 - DNA, 25 bp, Rattus norvegicus
gaaaacgacaggtctcaggcacagc

SEQ ID NO: 283629 - DNA, 25 bp, Rattus norvegicus
gaaaacgatgagatcgctcccagtt

SEQ ID NO: 283630 - DNA, 25 bp, Rattus norvegicus
gaaaacgatgagttcgctcccagtt

SEQ ID NO: 283631 - DNA, 25 bp, Rattus norvegicus
gaaaacgattcaaattgcagaagac

SEQ ID NO: 283632 - DNA, 25 bp, Rattus norvegicus
gaaaacgattcatattgcagaagac

SEQ ID NO: 283633 - DNA, 25 bp, Rattus norvegicus
gaaaacgcaatcagcttccacatct

SEQ ID NO: 283634 - DNA, 25 bp, Rattus norvegicus
gaaaacgcaatctgcttccacatct

SEQ ID NO: 283635 - DNA, 25 bp, Rattus norvegicus
gaaaacgcacaaagccaagctcctg

SEQ ID NO: 283636 - DNA, 25 bp, Rattus norvegicus
gaaaacgcacaatgccaagctcctg

SEQ ID NO: 283637 - DNA, 25 bp, Rattus norvegicus
gaaaacgccgatcggcatcatcctg

SEQ ID NO: 283638 - DNA, 25 bp, Rattus norvegicus
gaaaacgccgatgggcatcatcctg

SEQ ID NO: 283639 - DNA, 25 bp, Rattus norvegicus
gaaaacgctagaacttcctctacat

SEQ ID NO: 283640 - DNA, 25 bp, Rattus norvegicus
gaaaacgctagatcttcctctacat

SEQ ID NO: 283641 - DNA, 25 bp, Rattus norvegicus
gaaaacgctattcggctactgtaga

SEQ ID NO: 283642 - DNA, 25 bp, Rattus norvegicus
gaaaacgctattgggctactgtaga

SEQ ID NO: 283643 - DNA, 25 bp, Rattus norvegicus
gaaaacgctcacagtcagtctctga

SEQ ID NO: 283644 - DNA, 25 bp, Rattus norvegicus
gaaaacgctcactgtcagtctctga

SEQ ID NO: 283645 - DNA, 25 bp, Rattus norvegicus
gaaaacgctgagaagcacaatctaa

SEQ ID NO: 283646 - DNA, 25 bp, Rattus norvegicus
gaaaacgctgagtagcacaatctaa

SEQ ID NO: 283647 - DNA, 25 bp, Rattus norvegicus
gaaaacgctggaagaacccgtgtct

SEQ ID NO: 283648 - DNA, 25 bp, Rattus norvegicus
gaaaacgctggatgaacccgtgtct

SEQ ID NO: 283649 - DNA, 25 bp, Rattus norvegicus
gaaaacgctgtacatgctttgccca

SEQ ID NO: 283650 - DNA, 25 bp, Rattus norvegicus
gaaaacgctgtacccaggtatcaag

SEQ ID NO: 283651 - DNA, 25 bp, Rattus norvegicus
gaaaacgctgtagatgctttgccca

SEQ ID NO: 283652 - DNA, 25 bp, Rattus norvegicus
gaaaacgctgtagccaggtatcaag

SEQ ID NO: 283653 - DNA, 25 bp, Rattus norvegicus
gaaaacgctgtcaatacctcttgag

SEQ ID NO: 283654 - DNA, 25 bp, Rattus norvegicus
gaaaacgctgtctatacctcttgag

SEQ ID NO: 283655 - DNA, 25 bp, Rattus norvegicus
gaaaacggagccacactgagccaga

SEQ ID NO: 283656 - DNA, 25 bp, Rattus norvegicus
gaaaacggagcctcactgagccaga

SEQ ID NO: 283657 - DNA, 25 bp, Rattus norvegicus
gaaaacggcacccagatctacattg

SEQ ID NO: 283658 - DNA, 25 bp, Rattus norvegicus
gaaaacggcaccgagatctacattg

SEQ ID NO: 283659 - DNA, 25 bp, Rattus norvegicus
gaaaacggccttattgccgtgcatg

SEQ ID NO: 283660 - DNA, 25 bp, Rattus norvegicus
gaaaacggcctttttgccgtgcatg

SEQ ID NO: 283661 - DNA, 25 bp, Rattus norvegicus
gaaaacggcttaatgttccttgaag

SEQ ID NO: 283662 - DNA, 25 bp, Rattus norvegicus
gaaaacggcttattgttccttgaag

SEQ ID NO: 283663 - DNA, 25 bp, Rattus norvegicus
gaaaacgggaaacatacctgtccag

SEQ ID NO: 283664 - DNA, 25 bp, Rattus norvegicus
gaaaacgggaaagatacctgtccag

SEQ ID NO: 283665 - DNA, 25 bp, Rattus norvegicus
gaaaacggtgtgcagcaccagcccc

SEQ ID NO: 283666 - DNA, 25 bp, Rattus norvegicus
gaaaacggtgtggagcaccagcccc

SEQ ID NO: 283667 - DNA, 25 bp, Rattus norvegicus
gaaaacggttgcaattcctatcctg

SEQ ID NO: 283668 - DNA, 25 bp, Rattus norvegicus
gaaaacggttgctattcctatcctg

SEQ ID NO: 283669 - DNA, 25 bp, Rattus norvegicus
gaaaacgtcacgctgaatatatgac

SEQ ID NO: 283670 - DNA, 25 bp, Rattus norvegicus
gaaaacgtcacggtgaatatatgac

SEQ ID NO: 283671 - DNA, 25 bp, Rattus norvegicus
gaaaacgtcatcagcaaaagatctt

SEQ ID NO: 283672 - DNA, 25 bp, Rattus norvegicus
gaaaacgtcatctgcaaaagatctt

SEQ ID NO: 283673 - DNA, 25 bp, Rattus norvegicus
gaaaacgtcctgctacagtcacaga

SEQ ID NO: 283674 - DNA, 25 bp, Rattus norvegicus
gaaaacgtcctggtacagtcacaga

SEQ ID NO: 283675 - DNA, 25 bp, Rattus norvegicus
gaaaacgtccttcaaagagctatct

SEQ ID NO: 283676 - DNA, 25 bp, Rattus norvegicus
gaaaacgtccttgaaagagctatct

SEQ ID NO: 283677 - DNA, 25 bp, Rattus norvegicus
gaaaacgtcgatacacaccatccaa

SEQ ID NO: 283678 - DNA, 25 bp, Rattus norvegicus
gaaaacgtcgattcacaccatccaa

SEQ ID NO: 283679 - DNA, 25 bp, Rattus norvegicus
gaaaacgtggtcaccagcatctcat

SEQ ID NO: 283680 - DNA, 25 bp, Rattus norvegicus
gaaaacgtggtctccagcatctcat

SEQ ID NO: 283681 - DNA, 25 bp, Rattus norvegicus
gaaaacgtgtcaccattctggcttt

SEQ ID NO: 283682 - DNA, 25 bp, Rattus norvegicus
gaaaacgtgtcagcattctggcttt

SEQ ID NO: 283683 - DNA, 25 bp, Rattus norvegicus
gaaaacgttcaaagttctgcttagt

SEQ ID NO: 283684 - DNA, 25 bp, Rattus norvegicus
gaaaacgttcaatgttctgcttagt

SEQ ID NO: 283685 - DNA, 25 bp, Rattus norvegicus
gaaaacgttgctatcaagaccacaa

SEQ ID NO: 283686 - DNA, 25 bp, Rattus norvegicus
gaaaacgttgctttcaagaccacaa

SEQ ID NO: 283687 - DNA, 25 bp, Rattus norvegicus
gaaaacgtttttcaggacctgacag

SEQ ID NO: 283688 - DNA, 25 bp, Rattus norvegicus
gaaaacgtttttgaggacctgacag

SEQ ID NO: 283689 - DNA, 25 bp, Rattus norvegicus
gaaaactaaaatcacaggcccttcg

SEQ ID NO: 283690 - DNA, 25 bp, Rattus norvegicus
gaaaactaaaatgacaggcccttcg

SEQ ID NO: 283691 - DNA, 25 bp, Rattus norvegicus
gaaaactaaataccacacagagcaa

SEQ ID NO: 283692 - DNA, 25 bp, Rattus norvegicus
gaaaactaaatagcacacagagcaa

SEQ ID NO: 283693 - DNA, 25 bp, Rattus norvegicus
gaaaactaacatctaggcttggata

SEQ ID NO: 283694 - DNA, 25 bp, Rattus norvegicus
gaaaactaacatgtaggcttggata

SEQ ID NO: 283695 - DNA, 25 bp, Rattus norvegicus
gaaaactaacttctccttgcttgac

SEQ ID NO: 283696 - DNA, 25 bp, Rattus norvegicus
gaaaactaacttgtccttgcttgac

SEQ ID NO: 283697 - DNA, 25 bp, Rattus norvegicus
gaaaactacagacttccccacaagg

SEQ ID NO: 283698 - DNA, 25 bp, Rattus norvegicus
gaaaactacagagttccccacaagg

SEQ ID NO: 283699 - DNA, 25 bp, Rattus norvegicus
gaaaactacgagcaggcccggaagt

SEQ ID NO: 283700 - DNA, 25 bp, Rattus norvegicus
gaaaactacgaggaggcccggaagt

SEQ ID NO: 283701 - DNA, 25 bp, Rattus norvegicus
gaaaactactcactaggagagccaa

SEQ ID NO: 283702 - DNA, 25 bp, Rattus norvegicus
gaaaactactcagtaggagagccaa

SEQ ID NO: 283703 - DNA, 25 bp, Rattus norvegicus
gaaaactactctagtatgcacagaa

SEQ ID NO: 283704 - DNA, 25 bp, Rattus norvegicus
gaaaactactcttgtatgcacagaa

SEQ ID NO: 283705 - DNA, 25 bp, Rattus norvegicus
gaaaactactgtcttattgctcatg

SEQ ID NO: 283706 - DNA, 25 bp, Rattus norvegicus
gaaaactactgtgttattgctcatg

SEQ ID NO: 283707 - DNA, 25 bp, Rattus norvegicus
gaaaactagactccaaggccctgga

SEQ ID NO: 283708 - DNA, 25 bp, Rattus norvegicus
gaaaactagactgcaaggccctgga

SEQ ID NO: 283709 - DNA, 25 bp, Rattus norvegicus
gaaaactagcgacttcctgggactg

SEQ ID NO: 283710 - DNA, 25 bp, Rattus norvegicus
gaaaactagcgagttcctgggactg

SEQ ID NO: 283711 - DNA, 25 bp, Rattus norvegicus
gaaaactaggccagggagcccctgg

SEQ ID NO: 283712 - DNA, 25 bp, Rattus norvegicus
gaaaactaggcctgggagcccctgg

SEQ ID NO: 283713 - DNA, 25 bp, Rattus norvegicus
gaaaactatgctccactatcaagaa

SEQ ID NO: 283714 - DNA, 25 bp, Rattus norvegicus
gaaaactatgctgcactatcaagaa

SEQ ID NO: 283715 - DNA, 25 bp, Rattus norvegicus
gaaaactattctacagcttttgtaa

SEQ ID NO: 283716 - DNA, 25 bp, Rattus norvegicus
gaaaactattcttcagcttttgtaa

SEQ ID NO: 283717 - DNA, 25 bp, Rattus norvegicus
gaaaactcaattcgaagctctcaga

SEQ ID NO: 283718 - DNA, 25 bp, Rattus norvegicus
gaaaactcaattggaagctctcaga

SEQ ID NO: 283719 - DNA, 25 bp, Rattus norvegicus
gaaaactcacgcagcaagtaaatat

SEQ ID NO: 283720 - DNA, 25 bp, Rattus norvegicus
gaaaactcacgctgcaagtaaatat

SEQ ID NO: 283721 - DNA, 25 bp, Rattus norvegicus
gaaaactcatggactcttgaacaca

SEQ ID NO: 283722 - DNA, 25 bp, Rattus norvegicus
gaaaactcatggtctcttgaacaca

SEQ ID NO: 283723 - DNA, 25 bp, Rattus norvegicus
gaaaactccacacctgattgttgcc

SEQ ID NO: 283724 - DNA, 25 bp, Rattus norvegicus
gaaaactccacagctgattgttgcc

SEQ ID NO: 283725 - DNA, 25 bp, Rattus norvegicus
gaaaactccactacagaacgacttt

SEQ ID NO: 283726 - DNA, 25 bp, Rattus norvegicus
gaaaactccacttcagaacgacttt

SEQ ID NO: 283727 - DNA, 25 bp, Rattus norvegicus
gaaaactccagaagtctcttcagcc

SEQ ID NO: 283728 - DNA, 25 bp, Rattus norvegicus
gaaaactccagatgtctcttcagcc

SEQ ID NO: 283729 - DNA, 25 bp, Rattus norvegicus
gaaaactcccaacagcatcagcatg

SEQ ID NO: 283730 - DNA, 25 bp, Rattus norvegicus
gaaaactcccaagagcatcagcatg

SEQ ID NO: 283731 - DNA, 25 bp, Rattus norvegicus
gaaaactcccctcatttaggcagat

SEQ ID NO: 283732 - DNA, 25 bp, Rattus norvegicus
gaaaactcccctgatttaggcagat

SEQ ID NO: 283733 - DNA, 25 bp, Rattus norvegicus
gaaaactcctccatgaaacaaattg

SEQ ID NO: 283734 - DNA, 25 bp, Rattus norvegicus
gaaaactcctccttgaaacaaattg

SEQ ID NO: 283735 - DNA, 25 bp, Rattus norvegicus
gaaaactcctctctgttctgtatta

SEQ ID NO: 283736 - DNA, 25 bp, Rattus norvegicus
gaaaactcctctgtgttctgtatta

SEQ ID NO: 283737 - DNA, 25 bp, Rattus norvegicus
gaaaactcctgaaaacacttgctac

SEQ ID NO: 283738 - DNA, 25 bp, Rattus norvegicus
gaaaactcctgataacacttgctac

SEQ ID NO: 283739 - DNA, 25 bp, Rattus norvegicus
gaaaactcctgtagtcactaagcca

SEQ ID NO: 283740 - DNA, 25 bp, Rattus norvegicus
gaaaactcctgttgtcactaagcca

SEQ ID NO: 283741 - DNA, 25 bp, Rattus norvegicus
gaaaactcggaaactcttttgatct

SEQ ID NO: 283742 - DNA, 25 bp, Rattus norvegicus
gaaaactcggaatctcttttgatct

SEQ ID NO: 283743 - DNA, 25 bp, Rattus norvegicus
gaaaactcggacacctcttcttcaa

SEQ ID NO: 283744 - DNA, 25 bp, Rattus norvegicus
gaaaactcggactcctcttcttcaa

SEQ ID NO: 283745 - DNA, 25 bp, Rattus norvegicus
gaaaactctagtcgccttagcagat

SEQ ID NO: 283746 - DNA, 25 bp, Rattus norvegicus
gaaaactctagtggccttagcagat

SEQ ID NO: 283747 - DNA, 25 bp, Rattus norvegicus
gaaaactctcaacagtagctgccaa

SEQ ID NO: 283748 - DNA, 25 bp, Rattus norvegicus
gaaaactctcaagagtagctgccaa

SEQ ID NO: 283749 - DNA, 25 bp, Rattus norvegicus
gaaaactctctcaagtacgtcagat

SEQ ID NO: 283750 - DNA, 25 bp, Rattus norvegicus
gaaaactctctctagtacgtcagat

SEQ ID NO: 283751 - DNA, 25 bp, Rattus norvegicus
gaaaactctgaaacttggtgtcttt

SEQ ID NO: 283752 - DNA, 25 bp, Rattus norvegicus
gaaaactctgaatcttggtgtcttt

SEQ ID NO: 283753 - DNA, 25 bp, Rattus norvegicus
gaaaactctgctcggcttattaata

SEQ ID NO: 283754 - DNA, 25 bp, Rattus norvegicus
gaaaactctgctgggcttattaata

SEQ ID NO: 283755 - DNA, 25 bp, Rattus norvegicus
gaaaactctggcagggattgtgaaa

SEQ ID NO: 283756 - DNA, 25 bp, Rattus norvegicus
gaaaactctggcagtgcccactgga

SEQ ID NO: 283757 - DNA, 25 bp, Rattus norvegicus
gaaaactctggctgggattgtgaaa

SEQ ID NO: 283758 - DNA, 25 bp, Rattus norvegicus
gaaaactctggctgtgcccactgga

SEQ ID NO: 283759 - DNA, 25 bp, Rattus norvegicus
gaaaactctgtccagatcttctctg

SEQ ID NO: 283760 - DNA, 25 bp, Rattus norvegicus
gaaaactctgtcgagatcttctctg

SEQ ID NO: 283761 - DNA, 25 bp, Rattus norvegicus
gaaaactcttgaagcactacgatca

SEQ ID NO: 283762 - DNA, 25 bp, Rattus norvegicus
gaaaactcttgatgcactacgatca

SEQ ID NO: 283763 - DNA, 25 bp, Rattus norvegicus
gaaaactctttgacattcgttacca

SEQ ID NO: 283764 - DNA, 25 bp, Rattus norvegicus
gaaaactctttgtcattcgttacca

SEQ ID NO: 283765 - DNA, 25 bp, Rattus norvegicus
gaaaactgactcaacaaattgcttt

SEQ ID NO: 283766 - DNA, 25 bp, Rattus norvegicus
gaaaactgactctacaaattgcttt

SEQ ID NO: 283767 - DNA, 25 bp, Rattus norvegicus
gaaaactgactgatagccaagaaga

SEQ ID NO: 283768 - DNA, 25 bp, Rattus norvegicus
gaaaactgactgttagccaagaaga

SEQ ID NO: 283769 - DNA, 25 bp, Rattus norvegicus
gaaaactgagagacatgcgttctgt

SEQ ID NO: 283770 - DNA, 25 bp, Rattus norvegicus
gaaaactgagagtcatgcgttctgt

SEQ ID NO: 283771 - DNA, 25 bp, Rattus norvegicus
gaaaactgattgatcctgagtaata

SEQ ID NO: 283772 - DNA, 25 bp, Rattus norvegicus
gaaaactgattgctgttgaaaactg

SEQ ID NO: 283773 - DNA, 25 bp, Rattus norvegicus
gaaaactgattggtgttgaaaactg

SEQ ID NO: 283774 - DNA, 25 bp, Rattus norvegicus
gaaaactgattgttcctgagtaata

SEQ ID NO: 283775 - DNA, 25 bp, Rattus norvegicus
gaaaactgccatcttgcacatgctt

SEQ ID NO: 283776 - DNA, 25 bp, Rattus norvegicus
gaaaactgccatgttgcacatgctt

SEQ ID NO: 283777 - DNA, 25 bp, Rattus norvegicus
gaaaactgcgcaaagattatacatt

SEQ ID NO: 283778 - DNA, 25 bp, Rattus norvegicus
gaaaactgcgcatagattatacatt

SEQ ID NO: 283779 - DNA, 25 bp, Rattus norvegicus
gaaaactgctgcagtccttagcgag

SEQ ID NO: 283780 - DNA, 25 bp, Rattus norvegicus
gaaaactgctgctgtccttagcgag

SEQ ID NO: 283781 - DNA, 25 bp, Rattus norvegicus
gaaaactgctggataatcccaagac

SEQ ID NO: 283782 - DNA, 25 bp, Rattus norvegicus
gaaaactgctggttaatcccaagac

SEQ ID NO: 283783 - DNA, 25 bp, Rattus norvegicus
gaaaactgcttcagttggtcctggg

SEQ ID NO: 283784 - DNA, 25 bp, Rattus norvegicus
gaaaactgcttctgttggtcctggg

SEQ ID NO: 283785 - DNA, 25 bp, Rattus norvegicus
gaaaactgcttgaaacggttactat

SEQ ID NO: 283786 - DNA, 25 bp, Rattus norvegicus
gaaaactgcttgtaacggttactat

SEQ ID NO: 283787 - DNA, 25 bp, Rattus norvegicus
gaaaactggaacaactctgccctac

SEQ ID NO: 283788 - DNA, 25 bp, Rattus norvegicus
gaaaactggaactactctgccctac

SEQ ID NO: 283789 - DNA, 25 bp, Rattus norvegicus
gaaaactggagtactcatccccaga

SEQ ID NO: 283790 - DNA, 25 bp, Rattus norvegicus
gaaaactggagttctcatccccaga

SEQ ID NO: 283791 - DNA, 25 bp, Rattus norvegicus
gaaaactggatcagtaactctaagg

SEQ ID NO: 283792 - DNA, 25 bp, Rattus norvegicus
gaaaactggatctgtaactctaagg

SEQ ID NO: 283793 - DNA, 25 bp, Rattus norvegicus
gaaaactggcagacctcggaaagaa

SEQ ID NO: 283794 - DNA, 25 bp, Rattus norvegicus
gaaaactggcagattgagtcagcca

SEQ ID NO: 283795 - DNA, 25 bp, Rattus norvegicus
gaaaactggcagtcctcggaaagaa

SEQ ID NO: 283796 - DNA, 25 bp, Rattus norvegicus
gaaaactggcagtttgagtcagcca

SEQ ID NO: 283797 - DNA, 25 bp, Rattus norvegicus
gaaaactggctcaacgtccaaggct

SEQ ID NO: 283798 - DNA, 25 bp, Rattus norvegicus
gaaaactggctctacgtccaaggct

SEQ ID NO: 283799 - DNA, 25 bp, Rattus norvegicus
gaaaactgggccctttcagacctgt

SEQ ID NO: 283800 - DNA, 25 bp, Rattus norvegicus
gaaaactgggccgtttcagacctgt

SEQ ID NO: 283801 - DNA, 25 bp, Rattus norvegicus
gaaaactgtatgagtatcctttaaa

SEQ ID NO: 283802 - DNA, 25 bp, Rattus norvegicus
gaaaactgtatgtgtatcctttaaa

SEQ ID NO: 283803 - DNA, 25 bp, Rattus norvegicus
gaaaactgtcatacttaggcccttg

SEQ ID NO: 283804 - DNA, 25 bp, Rattus norvegicus
gaaaactgtcattcttaggcccttg

SEQ ID NO: 283805 - DNA, 25 bp, Rattus norvegicus
gaaaactgtcttatatgagattcag

SEQ ID NO: 283806 - DNA, 25 bp, Rattus norvegicus
gaaaactgtcttttatgagattcag

SEQ ID NO: 283807 - DNA, 25 bp, Rattus norvegicus
gaaaactgtggtattgcccagaaca

SEQ ID NO: 283808 - DNA, 25 bp, Rattus norvegicus
gaaaactgtggttttgcccagaaca

SEQ ID NO: 283809 - DNA, 25 bp, Rattus norvegicus
gaaaactgtgtaaagcttgcccgaa

SEQ ID NO: 283810 - DNA, 25 bp, Rattus norvegicus
gaaaactgtgtatagcttgcccgaa

SEQ ID NO: 283811 - DNA, 25 bp, Rattus norvegicus
gaaaactgtgtgagactaaacctgt

SEQ ID NO: 283812 - DNA, 25 bp, Rattus norvegicus
gaaaactgtgtgctgctcttgacaa

SEQ ID NO: 283813 - DNA, 25 bp, Rattus norvegicus
gaaaactgtgtggtgctcttgacaa

SEQ ID NO: 283814 - DNA, 25 bp, Rattus norvegicus
gaaaactgtgtgtgactaaacctgt

SEQ ID NO: 283815 - DNA, 25 bp, Rattus norvegicus
gaaaactgttcaaggtccccagcct

SEQ ID NO: 283816 - DNA, 25 bp, Rattus norvegicus
gaaaactgttcatggtccccagcct

SEQ ID NO: 283817 - DNA, 25 bp, Rattus norvegicus
gaaaacttagttcatgagtctaaat

SEQ ID NO: 283818 - DNA, 25 bp, Rattus norvegicus
gaaaacttagttgatgagtctaaat

SEQ ID NO: 283819 - DNA, 25 bp, Rattus norvegicus
gaaaacttattacagctgagcctac

SEQ ID NO: 283820 - DNA, 25 bp, Rattus norvegicus
gaaaacttattagagctgagcctac

SEQ ID NO: 283821 - DNA, 25 bp, Rattus norvegicus
gaaaacttcaagcagttgagccaaa

SEQ ID NO: 283822 - DNA, 25 bp, Rattus norvegicus
gaaaacttcaaggagttgagccaaa

SEQ ID NO: 283823 - DNA, 25 bp, Rattus norvegicus
gaaaacttcaccatgaagcacaatg

SEQ ID NO: 283824 - DNA, 25 bp, Rattus norvegicus
gaaaacttcaccttgaagcacaatg

SEQ ID NO: 283825 - DNA, 25 bp, Rattus norvegicus
gaaaacttcagaagcatgttgagaa

SEQ ID NO: 283826 - DNA, 25 bp, Rattus norvegicus
gaaaacttcagatgcatgttgagaa

SEQ ID NO: 283827 - DNA, 25 bp, Rattus norvegicus
gaaaacttcataaagcacaaaacaa

SEQ ID NO: 283828 - DNA, 25 bp, Rattus norvegicus
gaaaacttcatatagcacaaaacaa

SEQ ID NO: 283829 - DNA, 25 bp, Rattus norvegicus
gaaaacttcatcatccatccgagaa

SEQ ID NO: 283830 - DNA, 25 bp, Rattus norvegicus
gaaaacttcatcttccatccgagaa

SEQ ID NO: 283831 - DNA, 25 bp, Rattus norvegicus
gaaaacttccgtactgagaggctga

SEQ ID NO: 283832 - DNA, 25 bp, Rattus norvegicus
gaaaacttccgttctgagaggctga

SEQ ID NO: 283833 - DNA, 25 bp, Rattus norvegicus
gaaaacttcgagaaaagcggcagac

SEQ ID NO: 283834 - DNA, 25 bp, Rattus norvegicus
gaaaacttcgagctcaaactggaat

SEQ ID NO: 283835 - DNA, 25 bp, Rattus norvegicus
gaaaacttcgaggtcaaactggaat

SEQ ID NO: 283836 - DNA, 25 bp, Rattus norvegicus
gaaaacttcgagtaaagcggcagac

SEQ ID NO: 283837 - DNA, 25 bp, Rattus norvegicus
gaaaacttcgtgactctggcaacag

SEQ ID NO: 283838 - DNA, 25 bp, Rattus norvegicus
gaaaacttcgtgagagctctgtctg

SEQ ID NO: 283839 - DNA, 25 bp, Rattus norvegicus
gaaaacttcgtgatctggctgtgag

SEQ ID NO: 283840 - DNA, 25 bp, Rattus norvegicus
gaaaacttcgtgtctctggcaacag

SEQ ID NO: 283841 - DNA, 25 bp, Rattus norvegicus
gaaaacttcgtgtgagctctgtctg

SEQ ID NO: 283842 - DNA, 25 bp, Rattus norvegicus
gaaaacttcgtgttctggctgtgag

SEQ ID NO: 283843 - DNA, 25 bp, Rattus norvegicus
gaaaacttctatagtggccttcacc

SEQ ID NO: 283844 - DNA, 25 bp, Rattus norvegicus
gaaaacttctattgtggccttcacc

SEQ ID NO: 283845 - DNA, 25 bp, Rattus norvegicus
gaaaacttctgcctcctagaaatgg

SEQ ID NO: 283846 - DNA, 25 bp, Rattus norvegicus
gaaaacttctgcgtcctagaaatgg

SEQ ID NO: 283847 - DNA, 25 bp, Rattus norvegicus
gaaaacttgatgactccagcaggct

SEQ ID NO: 283848 - DNA, 25 bp, Rattus norvegicus
gaaaacttgatgtctccagcaggct

SEQ ID NO: 283849 - DNA, 25 bp, Rattus norvegicus
gaaaacttgctaactgctccaattc

SEQ ID NO: 283850 - DNA, 25 bp, Rattus norvegicus
gaaaacttgctatctgctccaattc

SEQ ID NO: 283851 - DNA, 25 bp, Rattus norvegicus
gaaaacttggctaaacctcccagtg

SEQ ID NO: 283852 - DNA, 25 bp, Rattus norvegicus
gaaaacttggctaattggctagtct

SEQ ID NO: 283853 - DNA, 25 bp, Rattus norvegicus
gaaaacttggcttaacctcccagtg

SEQ ID NO: 283854 - DNA, 25 bp, Rattus norvegicus
gaaaacttggcttattggctagtct

SEQ ID NO: 283855 - DNA, 25 bp, Rattus norvegicus
gaaaactttagaactccctttaatg

SEQ ID NO: 283856 - DNA, 25 bp, Rattus norvegicus
gaaaactttagatctccctttaatg

SEQ ID NO: 283857 - DNA, 25 bp, Rattus norvegicus
gaaaactttcatccggccatctccg

SEQ ID NO: 283858 - DNA, 25 bp, Rattus norvegicus
gaaaactttcatgcggccatctccg

SEQ ID NO: 283859 - DNA, 25 bp, Rattus norvegicus
gaaaactttccaagtgtactcgaag

SEQ ID NO: 283860 - DNA, 25 bp, Rattus norvegicus
gaaaactttccatgtgtactcgaag

SEQ ID NO: 283861 - DNA, 25 bp, Rattus norvegicus
gaaaactttcgtcctctgagcactg

SEQ ID NO: 283862 - DNA, 25 bp, Rattus norvegicus
gaaaactttcgtgctctgagcactg

SEQ ID NO: 283863 - DNA, 25 bp, Rattus norvegicus
gaaaactttcttccatgtctttagc

SEQ ID NO: 283864 - DNA, 25 bp, Rattus norvegicus
gaaaactttcttgcatgtctttagc

SEQ ID NO: 283865 - DNA, 25 bp, Rattus norvegicus
gaaaactttgagaacattgacaact

SEQ ID NO: 283866 - DNA, 25 bp, Rattus norvegicus
gaaaactttgagtacattgacaact

SEQ ID NO: 283867 - DNA, 25 bp, Rattus norvegicus
gaaaactttgcacctggctttcagg

SEQ ID NO: 283868 - DNA, 25 bp, Rattus norvegicus
gaaaactttgcagctggctttcagg

SEQ ID NO: 283869 - DNA, 25 bp, Rattus norvegicus
gaaaactttggtcaccactggtctg

SEQ ID NO: 283870 - DNA, 25 bp, Rattus norvegicus
gaaaactttggtgaccactggtctg

SEQ ID NO: 283871 - DNA, 25 bp, Rattus norvegicus
gaaaacttttttcgagactgtccat

SEQ ID NO: 283872 - DNA, 25 bp, Rattus norvegicus
gaaaacttttttggagactgtccat

SEQ ID NO: 283873 - DNA, 25 bp, Rattus norvegicus
gaaaagaacgtcattctcctcgtgt

SEQ ID NO: 283874 - DNA, 25 bp, Rattus norvegicus
gaaaagaacgtctttctcctcgtgt

SEQ ID NO: 283875 - DNA, 25 bp, Rattus norvegicus
gaaaagaagccaatgtccatcctgc

SEQ ID NO: 283876 - DNA, 25 bp, Rattus norvegicus
gaaaagaagccattgtccatcctgc

SEQ ID NO: 283877 - DNA, 25 bp, Rattus norvegicus
gaaaagaagccgctcttcggttaag

SEQ ID NO: 283878 - DNA, 25 bp, Rattus norvegicus
gaaaagaagccggtcttcggttaag

SEQ ID NO: 283879 - DNA, 25 bp, Rattus norvegicus
gaaaagaatactcttccttcgaagg

SEQ ID NO: 283880 - DNA, 25 bp, Rattus norvegicus
gaaaagaatactgttccttcgaagg

SEQ ID NO: 283881 - DNA, 25 bp, Rattus norvegicus
gaaaagaattctccttcatcttccc

SEQ ID NO: 283882 - DNA, 25 bp, Rattus norvegicus
gaaaagaattctgcttcatcttccc

SEQ ID NO: 283883 - DNA, 25 bp, Rattus norvegicus
gaaaagacaaatctcgctgctctgt

SEQ ID NO: 283884 - DNA, 25 bp, Rattus norvegicus
gaaaagacaaatgtcgctgctctgt

SEQ ID NO: 283885 - DNA, 25 bp, Rattus norvegicus
gaaaagacagccatgaccttggcct

SEQ ID NO: 283886 - DNA, 25 bp, Rattus norvegicus
gaaaagacagccttgaccttggcct

SEQ ID NO: 283887 - DNA, 25 bp, Rattus norvegicus
gaaaagacattaccccatcagaaat

SEQ ID NO: 283888 - DNA, 25 bp, Rattus norvegicus
gaaaagacattagcccatcagaaat

SEQ ID NO: 283889 - DNA, 25 bp, Rattus norvegicus
gaaaagaccatgacccactagccag

SEQ ID NO: 283890 - DNA, 25 bp, Rattus norvegicus
gaaaagaccatgtcccactagccag

SEQ ID NO: 283891 - DNA, 25 bp, Rattus norvegicus
gaaaagacccacacgtgcaggcgtt

SEQ ID NO: 283892 - DNA, 25 bp, Rattus norvegicus
gaaaagacccactcgtgcaggcgtt

SEQ ID NO: 283893 - DNA, 25 bp, Rattus norvegicus
gaaaagacctacataaaggcttcat

SEQ ID NO: 283894 - DNA, 25 bp, Rattus norvegicus
gaaaagacctacttaaaggcttcat

SEQ ID NO: 283895 - DNA, 25 bp, Rattus norvegicus
gaaaagacctgtccttcttggagtc

SEQ ID NO: 283896 - DNA, 25 bp, Rattus norvegicus
gaaaagacctgtgcttcttggagtc

SEQ ID NO: 283897 - DNA, 25 bp, Rattus norvegicus
gaaaagacctttcctgtcagttcag

SEQ ID NO: 283898 - DNA, 25 bp, Rattus norvegicus
gaaaagacctttgctgtcagttcag

SEQ ID NO: 283899 - DNA, 25 bp, Rattus norvegicus
gaaaagacgcctctgctggcgactc

SEQ ID NO: 283900 - DNA, 25 bp, Rattus norvegicus
gaaaagacgcctgtgctggcgactc

SEQ ID NO: 283901 - DNA, 25 bp, Rattus norvegicus
gaaaagactcacagttcagtatttt

SEQ ID NO: 283902 - DNA, 25 bp, Rattus norvegicus
gaaaagactcactgttcagtatttt

SEQ ID NO: 283903 - DNA, 25 bp, Rattus norvegicus
gaaaagactcctcgtctgcagtgga

SEQ ID NO: 283904 - DNA, 25 bp, Rattus norvegicus
gaaaagactcctggtctgcagtgga

SEQ ID NO: 283905 - DNA, 25 bp, Rattus norvegicus
gaaaagactggcaccctgtttggag

SEQ ID NO: 283906 - DNA, 25 bp, Rattus norvegicus
gaaaagactggctccctgtttggag

SEQ ID NO: 283907 - DNA, 25 bp, Rattus norvegicus
gaaaagacttagacccttccctcag

SEQ ID NO: 283908 - DNA, 25 bp, Rattus norvegicus
gaaaagacttagtcccttccctcag

SEQ ID NO: 283909 - DNA, 25 bp, Rattus norvegicus
gaaaagagaaagcaccagccagccc

SEQ ID NO: 283910 - DNA, 25 bp, Rattus norvegicus
gaaaagagaaaggaccagccagccc

SEQ ID NO: 283911 - DNA, 25 bp, Rattus norvegicus
gaaaagagccggcaaccccatggaa

SEQ ID NO: 283912 - DNA, 25 bp, Rattus norvegicus
gaaaagagccgggaaccccatggaa

SEQ ID NO: 283913 - DNA, 25 bp, Rattus norvegicus
gaaaagagcctccaaacttctccag

SEQ ID NO: 283914 - DNA, 25 bp, Rattus norvegicus
gaaaagagcctcgaaacttctccag

SEQ ID NO: 283915 - DNA, 25 bp, Rattus norvegicus
gaaaagagctttaagactagtcata

SEQ ID NO: 283916 - DNA, 25 bp, Rattus norvegicus
gaaaagagcttttagactagtcata

SEQ ID NO: 283917 - DNA, 25 bp, Rattus norvegicus
gaaaagagtgatctcccacttcccc

SEQ ID NO: 283918 - DNA, 25 bp, Rattus norvegicus
gaaaagagtgatgtcccacttcccc

SEQ ID NO: 283919 - DNA, 25 bp, Rattus norvegicus
gaaaagatattactccatcccctct

SEQ ID NO: 283920 - DNA, 25 bp, Rattus norvegicus
gaaaagatattagtccatcccctct

SEQ ID NO: 283921 - DNA, 25 bp, Rattus norvegicus
gaaaagatcactaactctagtcaca

SEQ ID NO: 283922 - DNA, 25 bp, Rattus norvegicus
gaaaagatcacttactctagtcaca

SEQ ID NO: 283923 - DNA, 25 bp, Rattus norvegicus
gaaaagatcctaaagcaacctgaat

SEQ ID NO: 283924 - DNA, 25 bp, Rattus norvegicus
gaaaagatcctatagcaacctgaat

SEQ ID NO: 283925 - DNA, 25 bp, Rattus norvegicus
gaaaagatcgcgcaagccgttcctg

SEQ ID NO: 283926 - DNA, 25 bp, Rattus norvegicus
gaaaagatcgcggaagccgttcctg

SEQ ID NO: 283927 - DNA, 25 bp, Rattus norvegicus
gaaaagatctcaccagccttctgtt

SEQ ID NO: 283928 - DNA, 25 bp, Rattus norvegicus
gaaaagatctcagcagccttctgtt

SEQ ID NO: 283929 - DNA, 25 bp, Rattus norvegicus
gaaaagatcttcaccaaccctatat

SEQ ID NO: 283930 - DNA, 25 bp, Rattus norvegicus
gaaaagatcttctccaaccctatat

SEQ ID NO: 283931 - DNA, 25 bp, Rattus norvegicus
gaaaagatgccgctaaacccttcag

SEQ ID NO: 283932 - DNA, 25 bp, Rattus norvegicus
gaaaagatgccggtaaacccttcag

SEQ ID NO: 283933 - DNA, 25 bp, Rattus norvegicus
gaaaagattccaaccaagagcttaa

SEQ ID NO: 283934 - DNA, 25 bp, Rattus norvegicus
gaaaagattccatccaagagcttaa

SEQ ID NO: 283935 - DNA, 25 bp, Rattus norvegicus
gaaaagattcccagcattcctaagg

SEQ ID NO: 283936 - DNA, 25 bp, Rattus norvegicus
gaaaagattccctgcattcctaagg

SEQ ID NO: 283937 - DNA, 25 bp, Rattus norvegicus
gaaaagattcgtcggctctctgtca

SEQ ID NO: 283938 - DNA, 25 bp, Rattus norvegicus
gaaaagattcgtgggctctctgtca

SEQ ID NO: 283939 - DNA, 25 bp, Rattus norvegicus
gaaaagattctccacagccttggga

SEQ ID NO: 283940 - DNA, 25 bp, Rattus norvegicus
gaaaagattctcgacagccttggga

SEQ ID NO: 283941 - DNA, 25 bp, Rattus norvegicus
gaaaagattgctattatcctcataa

SEQ ID NO: 283942 - DNA, 25 bp, Rattus norvegicus
gaaaagattgcttttatcctcataa

SEQ ID NO: 283943 - DNA, 25 bp, Rattus norvegicus
gaaaagatttcacggccactgtgct

SEQ ID NO: 283944 - DNA, 25 bp, Rattus norvegicus
gaaaagatttcagggccactgtgct

SEQ ID NO: 283945 - DNA, 25 bp, Rattus norvegicus
gaaaagcaaagtcaacggcaccgtt

SEQ ID NO: 283946 - DNA, 25 bp, Rattus norvegicus
gaaaagcaaagtgaacggcaccgtt

SEQ ID NO: 283947 - DNA, 25 bp, Rattus norvegicus
gaaaagcaacatatccacaccggaa

SEQ ID NO: 283948 - DNA, 25 bp, Rattus norvegicus
gaaaagcaacatttccacaccggaa

SEQ ID NO: 283949 - DNA, 25 bp, Rattus norvegicus
gaaaagcacagtacctgctgggcct

SEQ ID NO: 283950 - DNA, 25 bp, Rattus norvegicus
gaaaagcacagttcctgctgggcct

SEQ ID NO: 283951 - DNA, 25 bp, Rattus norvegicus
gaaaagcaccatatgtgactcacat

SEQ ID NO: 283952 - DNA, 25 bp, Rattus norvegicus
gaaaagcaccatttgtgactcacat

SEQ ID NO: 283953 - DNA, 25 bp, Rattus norvegicus
gaaaagcaccttatgtgacttggct

SEQ ID NO: 283954 - DNA, 25 bp, Rattus norvegicus
gaaaagcaccttttgtgacttggct

SEQ ID NO: 283955 - DNA, 25 bp, Rattus norvegicus
gaaaagcactcaccttctgagtaga

SEQ ID NO: 283956 - DNA, 25 bp, Rattus norvegicus
gaaaagcactcagcttctgagtaga

SEQ ID NO: 283957 - DNA, 25 bp, Rattus norvegicus
gaaaagcactgcactttccaaagga

SEQ ID NO: 283958 - DNA, 25 bp, Rattus norvegicus
gaaaagcactgctctttccaaagga

SEQ ID NO: 283959 - DNA, 25 bp, Rattus norvegicus
gaaaagcagacacccggttcttccg

SEQ ID NO: 283960 - DNA, 25 bp, Rattus norvegicus
gaaaagcagacagccggttcttccg

SEQ ID NO: 283961 - DNA, 25 bp, Rattus norvegicus
gaaaagcagatgcaccctgaccctg

SEQ ID NO: 283962 - DNA, 25 bp, Rattus norvegicus
gaaaagcagatggaccctgaccctg

SEQ ID NO: 283963 - DNA, 25 bp, Rattus norvegicus
gaaaagcagccacttgtttaccgtt

SEQ ID NO: 283964 - DNA, 25 bp, Rattus norvegicus
gaaaagcagccagttgtttaccgtt

SEQ ID NO: 283965 - DNA, 25 bp, Rattus norvegicus
gaaaagcagctgagctccagatcct

SEQ ID NO: 283966 - DNA, 25 bp, Rattus norvegicus
gaaaagcagctgtgctccagatcct

SEQ ID NO: 283967 - DNA, 25 bp, Rattus norvegicus
gaaaagcagtctctccaagtaatgg

SEQ ID NO: 283968 - DNA, 25 bp, Rattus norvegicus
gaaaagcagtctgtccaagtaatgg

SEQ ID NO: 283969 - DNA, 25 bp, Rattus norvegicus
gaaaagcatcaaaccaccaggattt

SEQ ID NO: 283970 - DNA, 25 bp, Rattus norvegicus
gaaaagcatcaatccaccaggattt

SEQ ID NO: 283971 - DNA, 25 bp, Rattus norvegicus
gaaaagcatctccaaacccgaaggc

SEQ ID NO: 283972 - DNA, 25 bp, Rattus norvegicus
gaaaagcatctcgaaacccgaaggc

SEQ ID NO: 283973 - DNA, 25 bp, Rattus norvegicus
gaaaagccaacacaatccacaagaa

SEQ ID NO: 283974 - DNA, 25 bp, Rattus norvegicus
gaaaagccaacagaatccacaagaa

SEQ ID NO: 283975 - DNA, 25 bp, Rattus norvegicus
gaaaagccaaccagacaaccacgag

SEQ ID NO: 283976 - DNA, 25 bp, Rattus norvegicus
gaaaagccaacctgacaaccacgag

SEQ ID NO: 283977 - DNA, 25 bp, Rattus norvegicus
gaaaagccacaaatgcttccctgaa

SEQ ID NO: 283978 - DNA, 25 bp, Rattus norvegicus
gaaaagccacaattgcttccctgaa

SEQ ID NO: 283979 - DNA, 25 bp, Rattus norvegicus
gaaaagccacacagaattccacaag

SEQ ID NO: 283980 - DNA, 25 bp, Rattus norvegicus
gaaaagccacacctggtttttacat

SEQ ID NO: 283981 - DNA, 25 bp, Rattus norvegicus
gaaaagccacacgtggtttttacat

SEQ ID NO: 283982 - DNA, 25 bp, Rattus norvegicus
gaaaagccacactgaattccacaag

SEQ ID NO: 283983 - DNA, 25 bp, Rattus norvegicus
gaaaagccacagaccactctcaagt

SEQ ID NO: 283984 - DNA, 25 bp, Rattus norvegicus
gaaaagccacagtccactctcaagt

SEQ ID NO: 283985 - DNA, 25 bp, Rattus norvegicus
gaaaagccacgtaacatattttgtt

SEQ ID NO: 283986 - DNA, 25 bp, Rattus norvegicus
gaaaagccacgttacatattttgtt

SEQ ID NO: 283987 - DNA, 25 bp, Rattus norvegicus
gaaaagccagctcctgtggttgctc

SEQ ID NO: 283988 - DNA, 25 bp, Rattus norvegicus
gaaaagccagctgctgtggttgctc

SEQ ID NO: 283989 - DNA, 25 bp, Rattus norvegicus
gaaaagccagttacaaccactagta

SEQ ID NO: 283990 - DNA, 25 bp, Rattus norvegicus
gaaaagccagtttcaaccactagta

SEQ ID NO: 283991 - DNA, 25 bp, Rattus norvegicus
gaaaagccatgccttaaactgtgaa

SEQ ID NO: 283992 - DNA, 25 bp, Rattus norvegicus
gaaaagccatgcgttaaactgtgaa

SEQ ID NO: 283993 - DNA, 25 bp, Rattus norvegicus
gaaaagccattcctgccaaaactgc

SEQ ID NO: 283994 - DNA, 25 bp, Rattus norvegicus
gaaaagccattcgtgccaaaactgc

SEQ ID NO: 283995 - DNA, 25 bp, Rattus norvegicus
gaaaagcccaccacttgggaagcta

SEQ ID NO: 283996 - DNA, 25 bp, Rattus norvegicus
gaaaagcccacctcttgggaagcta

SEQ ID NO: 283997 - DNA, 25 bp, Rattus norvegicus
gaaaagccccaaagttcctagagag

SEQ ID NO: 283998 - DNA, 25 bp, Rattus norvegicus
gaaaagccccaatgttcctagagag

SEQ ID NO: 283999 - DNA, 25 bp, Rattus norvegicus
gaaaagcccctcaaaatgcactcgg

SEQ ID NO: 284000 - DNA, 25 bp, Rattus norvegicus
gaaaagcccctctaaatgcactcgg

SEQ ID NO: 284001 - DNA, 25 bp, Rattus norvegicus
gaaaagcccctgacttcaatggctg

SEQ ID NO: 284002 - DNA, 25 bp, Rattus norvegicus
gaaaagcccctgtcttcaatggctg

SEQ ID NO: 284003 - DNA, 25 bp, Rattus norvegicus
gaaaagcccgacagagccggcccgt

SEQ ID NO: 284004 - DNA, 25 bp, Rattus norvegicus
gaaaagcccgactgagccggcccgt

SEQ ID NO: 284005 - DNA, 25 bp, Rattus norvegicus
gaaaagccctatccttgtaaggaat

SEQ ID NO: 284006 - DNA, 25 bp, Rattus norvegicus
gaaaagccctatgcttgtaaggaat

SEQ ID NO: 284007 - DNA, 25 bp, Rattus norvegicus
gaaaagcccttcatagtttctagga

SEQ ID NO: 284008 - DNA, 25 bp, Rattus norvegicus
gaaaagcccttcttagtttctagga

SEQ ID NO: 284009 - DNA, 25 bp, Rattus norvegicus
gaaaagcctactataattatctgaa

SEQ ID NO: 284010 - DNA, 25 bp, Rattus norvegicus
gaaaagcctactttaattatctgaa

SEQ ID NO: 284011 - DNA, 25 bp, Rattus norvegicus
gaaaagcctcagcagcagccagtca

SEQ ID NO: 284012 - DNA, 25 bp, Rattus norvegicus
gaaaagcctcaggagcagccagtca

SEQ ID NO: 284013 - DNA, 25 bp, Rattus norvegicus
gaaaagcctccaattgtatacattt

SEQ ID NO: 284014 - DNA, 25 bp, Rattus norvegicus
gaaaagcctccatttgtatacattt

SEQ ID NO: 284015 - DNA, 25 bp, Rattus norvegicus
gaaaagcctctcaagggaagccttc

SEQ ID NO: 284016 - DNA, 25 bp, Rattus norvegicus
gaaaagcctctctagggaagccttc

SEQ ID NO: 284017 - DNA, 25 bp, Rattus norvegicus
gaaaagcctgaactccatatggatg

SEQ ID NO: 284018 - DNA, 25 bp, Rattus norvegicus
gaaaagcctgaagtccatatggatg

SEQ ID NO: 284019 - DNA, 25 bp, Rattus norvegicus
gaaaagcctgacctgcttgagacac

SEQ ID NO: 284020 - DNA, 25 bp, Rattus norvegicus
gaaaagcctgacgtgcttgagacac

SEQ ID NO: 284021 - DNA, 25 bp, Rattus norvegicus
gaaaagcctgatcatttcattccac

SEQ ID NO: 284022 - DNA, 25 bp, Rattus norvegicus
gaaaagcctgatgatttcattccac

SEQ ID NO: 284023 - DNA, 25 bp, Rattus norvegicus
gaaaagcctgctcagacgggtctaa

SEQ ID NO: 284024 - DNA, 25 bp, Rattus norvegicus
gaaaagcctgctgagacgggtctaa

SEQ ID NO: 284025 - DNA, 25 bp, Rattus norvegicus
gaaaagcctgtaagtggaacaacct

SEQ ID NO: 284026 - DNA, 25 bp, Rattus norvegicus
gaaaagcctgtatgtggaacaacct

SEQ ID NO: 284027 - DNA, 25 bp, Rattus norvegicus
gaaaagcctgtcacttttctcggtt

SEQ ID NO: 284028 - DNA, 25 bp, Rattus norvegicus
gaaaagcctgtcagaatgcactcca

SEQ ID NO: 284029 - DNA, 25 bp, Rattus norvegicus
gaaaagcctgtctcttttctcggtt

SEQ ID NO: 284030 - DNA, 25 bp, Rattus norvegicus
gaaaagcctgtctgaatgcactcca

SEQ ID NO: 284031 - DNA, 25 bp, Rattus norvegicus
gaaaagccttctagcaaacacagta

SEQ ID NO: 284032 - DNA, 25 bp, Rattus norvegicus
gaaaagccttcttgcaaacacagta

SEQ ID NO: 284033 - DNA, 25 bp, Rattus norvegicus
gaaaagccttggattgccctggttc

SEQ ID NO: 284034 - DNA, 25 bp, Rattus norvegicus
gaaaagccttggtttgccctggttc

SEQ ID NO: 284035 - DNA, 25 bp, Rattus norvegicus
gaaaagcctttcaaggctgtcagag

SEQ ID NO: 284036 - DNA, 25 bp, Rattus norvegicus
gaaaagcctttctaggctgtcagag

SEQ ID NO: 284037 - DNA, 25 bp, Rattus norvegicus
gaaaagcgactaacccatgacagac

SEQ ID NO: 284038 - DNA, 25 bp, Rattus norvegicus
gaaaagcgactatcccatgacagac

SEQ ID NO: 284039 - DNA, 25 bp, Rattus norvegicus
gaaaagcgagctatttctccatcaa

SEQ ID NO: 284040 - DNA, 25 bp, Rattus norvegicus
gaaaagcgagctttttctccatcaa

SEQ ID NO: 284041 - DNA, 25 bp, Rattus norvegicus
gaaaagcggaagctagtgatcccgt

SEQ ID NO: 284042 - DNA, 25 bp, Rattus norvegicus
gaaaagcggaaggtagtgatcccgt

SEQ ID NO: 284043 - DNA, 25 bp, Rattus norvegicus
gaaaagcgggccctggacacactcc

SEQ ID NO: 284044 - DNA, 25 bp, Rattus norvegicus
gaaaagcgggccgtggacacactcc

SEQ ID NO: 284045 - DNA, 25 bp, Rattus norvegicus
gaaaagcgtcttccactgttgaacc

SEQ ID NO: 284046 - DNA, 25 bp, Rattus norvegicus
gaaaagcgtcttgcactgttgaacc

SEQ ID NO: 284047 - DNA, 25 bp, Rattus norvegicus
gaaaagctacaaatgtccacctcca

SEQ ID NO: 284048 - DNA, 25 bp, Rattus norvegicus
gaaaagctacaattgtccacctcca

SEQ ID NO: 284049 - DNA, 25 bp, Rattus norvegicus
gaaaagctacatattctctttggtc

SEQ ID NO: 284050 - DNA, 25 bp, Rattus norvegicus
gaaaagctacattttctctttggtc

SEQ ID NO: 284051 - DNA, 25 bp, Rattus norvegicus
gaaaagctacttcctgaatccacgg

SEQ ID NO: 284052 - DNA, 25 bp, Rattus norvegicus
gaaaagctacttgctgaatccacgg

SEQ ID NO: 284053 - DNA, 25 bp, Rattus norvegicus
gaaaagctcaaacgccagactcatc

SEQ ID NO: 284054 - DNA, 25 bp, Rattus norvegicus
gaaaagctcaaaggccagactcatc

SEQ ID NO: 284055 - DNA, 25 bp, Rattus norvegicus
gaaaagctccatccagttaacgagg

SEQ ID NO: 284056 - DNA, 25 bp, Rattus norvegicus
gaaaagctccatgcagttaacgagg

SEQ ID NO: 284057 - DNA, 25 bp, Rattus norvegicus
gaaaagctgccaccatacgatacaa

SEQ ID NO: 284058 - DNA, 25 bp, Rattus norvegicus
gaaaagctgccagcatacgatacaa

SEQ ID NO: 284059 - DNA, 25 bp, Rattus norvegicus
gaaaagctgctaaatctccttctat

SEQ ID NO: 284060 - DNA, 25 bp, Rattus norvegicus
gaaaagctgctaacctgaaggccca

SEQ ID NO: 284061 - DNA, 25 bp, Rattus norvegicus
gaaaagctgctaattcggtaactta

SEQ ID NO: 284062 - DNA, 25 bp, Rattus norvegicus
gaaaagctgctatatctccttctat

SEQ ID NO: 284063 - DNA, 25 bp, Rattus norvegicus
gaaaagctgctatcctgaaggccca

SEQ ID NO: 284064 - DNA, 25 bp, Rattus norvegicus
gaaaagctgctatttcggtaactta

SEQ ID NO: 284065 - DNA, 25 bp, Rattus norvegicus
gaaaagctgctcatctacctaagtt

SEQ ID NO: 284066 - DNA, 25 bp, Rattus norvegicus
gaaaagctgctcttctacctaagtt

SEQ ID NO: 284067 - DNA, 25 bp, Rattus norvegicus
gaaaagctggatactcttgccttat

SEQ ID NO: 284068 - DNA, 25 bp, Rattus norvegicus
gaaaagctggattctcttgccttat

SEQ ID NO: 284069 - DNA, 25 bp, Rattus norvegicus
gaaaagctggcacaacccaccgtgt

SEQ ID NO: 284070 - DNA, 25 bp, Rattus norvegicus
gaaaagctggcagaacccaccgtgt

SEQ ID NO: 284071 - DNA, 25 bp, Rattus norvegicus
gaaaagctgttcactgtgttcactc

SEQ ID NO: 284072 - DNA, 25 bp, Rattus norvegicus
gaaaagctgttctctgtgttcactc

SEQ ID NO: 284073 - DNA, 25 bp, Rattus norvegicus
gaaaagctgtttccatctcacagaa

SEQ ID NO: 284074 - DNA, 25 bp, Rattus norvegicus
gaaaagctgtttgcatctcacagaa

SEQ ID NO: 284075 - DNA, 25 bp, Rattus norvegicus
gaaaagcttacactaatccctagat

SEQ ID NO: 284076 - DNA, 25 bp, Rattus norvegicus
gaaaagcttacagtaatccctagat

SEQ ID NO: 284077 - DNA, 25 bp, Rattus norvegicus
gaaaagcttatcatttgactcaagt

SEQ ID NO: 284078 - DNA, 25 bp, Rattus norvegicus
gaaaagcttatcttttgactcaagt

SEQ ID NO: 284079 - DNA, 25 bp, Rattus norvegicus
gaaaagcttcaaccagacgaactga

SEQ ID NO: 284080 - DNA, 25 bp, Rattus norvegicus
gaaaagcttcaagcagacgaactga

SEQ ID NO: 284081 - DNA, 25 bp, Rattus norvegicus
gaaaagcttcagatgcaacttcaac

SEQ ID NO: 284082 - DNA, 25 bp, Rattus norvegicus
gaaaagcttcagttgcaacttcaac

SEQ ID NO: 284083 - DNA, 25 bp, Rattus norvegicus
gaaaagcttcttctgtgaggtttaa

SEQ ID NO: 284084 - DNA, 25 bp, Rattus norvegicus
gaaaagcttcttgtgtgaggtttaa

SEQ ID NO: 284085 - DNA, 25 bp, Rattus norvegicus
gaaaagcttgtgatttccatctctg

SEQ ID NO: 284086 - DNA, 25 bp, Rattus norvegicus
gaaaagcttgtgttttccatctctg

SEQ ID NO: 284087 - DNA, 25 bp, Rattus norvegicus
gaaaagctttccctgggtcaggtat

SEQ ID NO: 284088 - DNA, 25 bp, Rattus norvegicus
gaaaagctttccgtgggtcaggtat

SEQ ID NO: 284089 - DNA, 25 bp, Rattus norvegicus
gaaaaggaaacccagccaccatgtc

SEQ ID NO: 284090 - DNA, 25 bp, Rattus norvegicus
gaaaaggaaaccgagccaccatgtc

SEQ ID NO: 284091 - DNA, 25 bp, Rattus norvegicus
gaaaaggaacacctctgtctcacac

SEQ ID NO: 284092 - DNA, 25 bp, Rattus norvegicus
gaaaaggaacacgtctgtctcacac

SEQ ID NO: 284093 - DNA, 25 bp, Rattus norvegicus
gaaaaggaacgcctacatatggaat

SEQ ID NO: 284094 - DNA, 25 bp, Rattus norvegicus
gaaaaggaacgcgtacatatggaat

SEQ ID NO: 284095 - DNA, 25 bp, Rattus norvegicus
gaaaaggaacgtactcagcctacca

SEQ ID NO: 284096 - DNA, 25 bp, Rattus norvegicus
gaaaaggaacgttctcagcctacca

SEQ ID NO: 284097 - DNA, 25 bp, Rattus norvegicus
gaaaaggacctcctggactcctgta

SEQ ID NO: 284098 - DNA, 25 bp, Rattus norvegicus
gaaaaggacctcgtggactcctgta

SEQ ID NO: 284099 - DNA, 25 bp, Rattus norvegicus
gaaaaggacttgctctctgttccca

SEQ ID NO: 284100 - DNA, 25 bp, Rattus norvegicus
gaaaaggacttggtctctgttccca

SEQ ID NO: 284101 - DNA, 25 bp, Rattus norvegicus
gaaaaggagacgacccagacctgaa

SEQ ID NO: 284102 - DNA, 25 bp, Rattus norvegicus
gaaaaggagacgtcccagacctgaa

SEQ ID NO: 284103 - DNA, 25 bp, Rattus norvegicus
gaaaaggagcaacacccagggcaag

SEQ ID NO: 284104 - DNA, 25 bp, Rattus norvegicus
gaaaaggagcaagacccagggcaag

SEQ ID NO: 284105 - DNA, 25 bp, Rattus norvegicus
gaaaaggagtaaacttcgccaatct

SEQ ID NO: 284106 - DNA, 25 bp, Rattus norvegicus
gaaaaggagtaatcttcgccaatct

SEQ ID NO: 284107 - DNA, 25 bp, Rattus norvegicus
gaaaaggagtccactacctgcaatc

SEQ ID NO: 284108 - DNA, 25 bp, Rattus norvegicus
gaaaaggagtcctctacctgcaatc

SEQ ID NO: 284109 - DNA, 25 bp, Rattus norvegicus
gaaaaggagtttccagcatctggcc

SEQ ID NO: 284110 - DNA, 25 bp, Rattus norvegicus
gaaaaggagtttgcagcatctggcc

SEQ ID NO: 284111 - DNA, 25 bp, Rattus norvegicus
gaaaaggatcccataagcaggcaat

SEQ ID NO: 284112 - DNA, 25 bp, Rattus norvegicus
gaaaaggatcccttaagcaggcaat

SEQ ID NO: 284113 - DNA, 25 bp, Rattus norvegicus
gaaaaggatctacgccctgatggag

SEQ ID NO: 284114 - DNA, 25 bp, Rattus norvegicus
gaaaaggatctaggccctgatggag

SEQ ID NO: 284115 - DNA, 25 bp, Rattus norvegicus
gaaaaggatgaaagccacaggactc

SEQ ID NO: 284116 - DNA, 25 bp, Rattus norvegicus
gaaaaggatgaatgccacaggactc

SEQ ID NO: 284117 - DNA, 25 bp, Rattus norvegicus
gaaaaggattttccacctcctcagc

SEQ ID NO: 284118 - DNA, 25 bp, Rattus norvegicus
gaaaaggattttgcacctcctcagc

SEQ ID NO: 284119 - DNA, 25 bp, Rattus norvegicus
gaaaaggcaaagatccattaccgga

SEQ ID NO: 284120 - DNA, 25 bp, Rattus norvegicus
gaaaaggcaaagttccattaccgga

SEQ ID NO: 284121 - DNA, 25 bp, Rattus norvegicus
gaaaaggcaagtctcctgtctagga

SEQ ID NO: 284122 - DNA, 25 bp, Rattus norvegicus
gaaaaggcaagtgtcctgtctagga

SEQ ID NO: 284123 - DNA, 25 bp, Rattus norvegicus
gaaaaggcacaactaatgactggaa

SEQ ID NO: 284124 - DNA, 25 bp, Rattus norvegicus
gaaaaggcacaagtaatgactggaa

SEQ ID NO: 284125 - DNA, 25 bp, Rattus norvegicus
gaaaaggcagcgaacattcccgaat

SEQ ID NO: 284126 - DNA, 25 bp, Rattus norvegicus
gaaaaggcagcgtacattcccgaat

SEQ ID NO: 284127 - DNA, 25 bp, Rattus norvegicus
gaaaaggccatacaatcctccagat

SEQ ID NO: 284128 - DNA, 25 bp, Rattus norvegicus
gaaaaggccatagaatcctccagat

SEQ ID NO: 284129 - DNA, 25 bp, Rattus norvegicus
gaaaaggcctcgacattttacaggg

SEQ ID NO: 284130 - DNA, 25 bp, Rattus norvegicus
gaaaaggcctcgtcattttacaggg

SEQ ID NO: 284131 - DNA, 25 bp, Rattus norvegicus
gaaaaggcctgcattatctccttgc

SEQ ID NO: 284132 - DNA, 25 bp, Rattus norvegicus
gaaaaggcctgctttatctccttgc

SEQ ID NO: 284133 - DNA, 25 bp, Rattus norvegicus
gaaaaggcctttacttatgcataga

SEQ ID NO: 284134 - DNA, 25 bp, Rattus norvegicus
gaaaaggcctttcagcatgtgtgtt

SEQ ID NO: 284135 - DNA, 25 bp, Rattus norvegicus
gaaaaggcctttcagcgggcttccg

SEQ ID NO: 284136 - DNA, 25 bp, Rattus norvegicus
gaaaaggcctttgagcatgtgtgtt

SEQ ID NO: 284137 - DNA, 25 bp, Rattus norvegicus
gaaaaggcctttgagcgggcttccg

SEQ ID NO: 284138 - DNA, 25 bp, Rattus norvegicus
gaaaaggccttttcttatgcataga

SEQ ID NO: 284139 - DNA, 25 bp, Rattus norvegicus
gaaaaggcgagtaggccccacacgt

SEQ ID NO: 284140 - DNA, 25 bp, Rattus norvegicus
gaaaaggcgagttggccccacacgt

SEQ ID NO: 284141 - DNA, 25 bp, Rattus norvegicus
gaaaaggctataaggcattctaact

SEQ ID NO: 284142 - DNA, 25 bp, Rattus norvegicus
gaaaaggctatatggcattctaact

SEQ ID NO: 284143 - DNA, 25 bp, Rattus norvegicus
gaaaaggctcgcattcatgaagaaa

SEQ ID NO: 284144 - DNA, 25 bp, Rattus norvegicus
gaaaaggctcgctttcatgaagaaa

SEQ ID NO: 284145 - DNA, 25 bp, Rattus norvegicus
gaaaaggctcttccgtagttgacta

SEQ ID NO: 284146 - DNA, 25 bp, Rattus norvegicus
gaaaaggctcttcttcagcatttca

SEQ ID NO: 284147 - DNA, 25 bp, Rattus norvegicus
gaaaaggctcttgcgtagttgacta

SEQ ID NO: 284148 - DNA, 25 bp, Rattus norvegicus
gaaaaggctcttgttcagcatttca

SEQ ID NO: 284149 - DNA, 25 bp, Rattus norvegicus
gaaaaggctgatctgtctgttgaaa

SEQ ID NO: 284150 - DNA, 25 bp, Rattus norvegicus
gaaaaggctgatgtgtctgttgaaa

SEQ ID NO: 284151 - DNA, 25 bp, Rattus norvegicus
gaaaaggctttgcatcccttccacg

SEQ ID NO: 284152 - DNA, 25 bp, Rattus norvegicus
gaaaaggctttggatcccttccacg

SEQ ID NO: 284153 - DNA, 25 bp, Rattus norvegicus
gaaaaggcttttcattatgtactat

SEQ ID NO: 284154 - DNA, 25 bp, Rattus norvegicus
gaaaaggcttttccagcccagaaca

SEQ ID NO: 284155 - DNA, 25 bp, Rattus norvegicus
gaaaaggcttttgattatgtactat

SEQ ID NO: 284156 - DNA, 25 bp, Rattus norvegicus
gaaaaggcttttgcagcccagaaca

SEQ ID NO: 284157 - DNA, 25 bp, Rattus norvegicus
gaaaagggaaagcaccctccaggtg

SEQ ID NO: 284158 - DNA, 25 bp, Rattus norvegicus
gaaaagggaaaggaccctccaggtg

SEQ ID NO: 284159 - DNA, 25 bp, Rattus norvegicus
gaaaagggcagcattcctaagtttt

SEQ ID NO: 284160 - DNA, 25 bp, Rattus norvegicus
gaaaagggcagctttcctaagtttt

SEQ ID NO: 284161 - DNA, 25 bp, Rattus norvegicus
gaaaagggcatacccacccacactg

SEQ ID NO: 284162 - DNA, 25 bp, Rattus norvegicus
gaaaagggcatagccacccacactg

SEQ ID NO: 284163 - DNA, 25 bp, Rattus norvegicus
gaaaagggccccaggcaactgcatt

SEQ ID NO: 284164 - DNA, 25 bp, Rattus norvegicus
gaaaagggcccctggcaactgcatt

SEQ ID NO: 284165 - DNA, 25 bp, Rattus norvegicus
gaaaagggcctaccatataacttat

SEQ ID NO: 284166 - DNA, 25 bp, Rattus norvegicus
gaaaagggcctagcatataacttat

SEQ ID NO: 284167 - DNA, 25 bp, Rattus norvegicus
gaaaagggcctgaatcaactctcga

SEQ ID NO: 284168 - DNA, 25 bp, Rattus norvegicus
gaaaagggcctgtatcaactctcga

SEQ ID NO: 284169 - DNA, 25 bp, Rattus norvegicus
gaaaagggtagtcgcctccagcagt

SEQ ID NO: 284170 - DNA, 25 bp, Rattus norvegicus
gaaaagggtagtggcctccagcagt

SEQ ID NO: 284171 - DNA, 25 bp, Rattus norvegicus
gaaaagggtccaatgtgtaaaacat

SEQ ID NO: 284172 - DNA, 25 bp, Rattus norvegicus
gaaaagggtccattgtgtaaaacat

SEQ ID NO: 284173 - DNA, 25 bp, Rattus norvegicus
gaaaaggtactcaagatcatcacat

SEQ ID NO: 284174 - DNA, 25 bp, Rattus norvegicus
gaaaaggtactctagatcatcacat

SEQ ID NO: 284175 - DNA, 25 bp, Rattus norvegicus
gaaaaggtatttagtgtagcgtaat

SEQ ID NO: 284176 - DNA, 25 bp, Rattus norvegicus
gaaaaggtattttgtgtagcgtaat

SEQ ID NO: 284177 - DNA, 25 bp, Rattus norvegicus
gaaaaggtcacaaaccagcagggct

SEQ ID NO: 284178 - DNA, 25 bp, Rattus norvegicus
gaaaaggtcacataccagcagggct

SEQ ID NO: 284179 - DNA, 25 bp, Rattus norvegicus
gaaaaggtcactcaattgaagcatt

SEQ ID NO: 284180 - DNA, 25 bp, Rattus norvegicus
gaaaaggtcactgaattgaagcatt

SEQ ID NO: 284181 - DNA, 25 bp, Rattus norvegicus
gaaaaggtcatcctacagaagcaga

SEQ ID NO: 284182 - DNA, 25 bp, Rattus norvegicus
gaaaaggtcatcgtacagaagcaga

SEQ ID NO: 284183 - DNA, 25 bp, Rattus norvegicus
gaaaaggtcattccacctacaggcc

SEQ ID NO: 284184 - DNA, 25 bp, Rattus norvegicus
gaaaaggtcattgcacctacaggcc

SEQ ID NO: 284185 - DNA, 25 bp, Rattus norvegicus
gaaaaggtctctctcacaacgagat

SEQ ID NO: 284186 - DNA, 25 bp, Rattus norvegicus
gaaaaggtctctgtcacaacgagat

SEQ ID NO: 284187 - DNA, 25 bp, Rattus norvegicus
gaaaaggtcttgaattcggttctct

SEQ ID NO: 284188 - DNA, 25 bp, Rattus norvegicus
gaaaaggtcttgtattcggttctct

SEQ ID NO: 284189 - DNA, 25 bp, Rattus norvegicus
gaaaaggtgcccaccgctgacagca

SEQ ID NO: 284190 - DNA, 25 bp, Rattus norvegicus
gaaaaggtgccctccgctgacagca

SEQ ID NO: 284191 - DNA, 25 bp, Rattus norvegicus
gaaaaggtgcttcgccaataggtaa

SEQ ID NO: 284192 - DNA, 25 bp, Rattus norvegicus
gaaaaggtgcttggccaataggtaa

SEQ ID NO: 284193 - DNA, 25 bp, Rattus norvegicus
gaaaaggttatcatgtcccagattg

SEQ ID NO: 284194 - DNA, 25 bp, Rattus norvegicus
gaaaaggttatcttgtcccagattg

SEQ ID NO: 284195 - DNA, 25 bp, Rattus norvegicus
gaaaaggttcagactcccttgtcac

SEQ ID NO: 284196 - DNA, 25 bp, Rattus norvegicus
gaaaaggttcagtctcccttgtcac

SEQ ID NO: 284197 - DNA, 25 bp, Rattus norvegicus
gaaaaggttggacttgttctacagt

SEQ ID NO: 284198 - DNA, 25 bp, Rattus norvegicus
gaaaaggttggagttgttctacagt

SEQ ID NO: 284199 - DNA, 25 bp, Rattus norvegicus
gaaaaggtttttcacacactccttg

SEQ ID NO: 284200 - DNA, 25 bp, Rattus norvegicus
gaaaaggtttttgacacactccttg

SEQ ID NO: 284201 - DNA, 25 bp, Rattus norvegicus
gaaaagtaacccaggctcaaacaag

SEQ ID NO: 284202 - DNA, 25 bp, Rattus norvegicus
gaaaagtaaccctggctcaaacaag

SEQ ID NO: 284203 - DNA, 25 bp, Rattus norvegicus
gaaaagtacaacactagtgcctaca

SEQ ID NO: 284204 - DNA, 25 bp, Rattus norvegicus
gaaaagtacaactctagtgcctaca

SEQ ID NO: 284205 - DNA, 25 bp, Rattus norvegicus
gaaaagtacctcaccattgagcttc

SEQ ID NO: 284206 - DNA, 25 bp, Rattus norvegicus
gaaaagtacctctccattgagcttc

SEQ ID NO: 284207 - DNA, 25 bp, Rattus norvegicus
gaaaagtagaaaacaccacccagct

SEQ ID NO: 284208 - DNA, 25 bp, Rattus norvegicus
gaaaagtagaaatcaccacccagct

SEQ ID NO: 284209 - DNA, 25 bp, Rattus norvegicus
gaaaagtagcatctcctagtcttat

SEQ ID NO: 284210 - DNA, 25 bp, Rattus norvegicus
gaaaagtagcatgtcctagtcttat

SEQ ID NO: 284211 - DNA, 25 bp, Rattus norvegicus
gaaaagtattgacggccgatgatta

SEQ ID NO: 284212 - DNA, 25 bp, Rattus norvegicus
gaaaagtattgagggccgatgatta

SEQ ID NO: 284213 - DNA, 25 bp, Rattus norvegicus
gaaaagtcactgaggccttctctct

SEQ ID NO: 284214 - DNA, 25 bp, Rattus norvegicus
gaaaagtcactgtggccttctctct

SEQ ID NO: 284215 - DNA, 25 bp, Rattus norvegicus
gaaaagtcagttctcaggtgcttat

SEQ ID NO: 284216 - DNA, 25 bp, Rattus norvegicus
gaaaagtcagttgtcaggtgcttat

SEQ ID NO: 284217 - DNA, 25 bp, Rattus norvegicus
gaaaagtcattcattcctggagaag

SEQ ID NO: 284218 - DNA, 25 bp, Rattus norvegicus
gaaaagtcattctttcctggagaag

SEQ ID NO: 284219 - DNA, 25 bp, Rattus norvegicus
gaaaagtcatttcgtgggttacaat

SEQ ID NO: 284220 - DNA, 25 bp, Rattus norvegicus
gaaaagtcatttggtgggttacaat

SEQ ID NO: 284221 - DNA, 25 bp, Rattus norvegicus
gaaaagtccatcatggtcctacagg

SEQ ID NO: 284222 - DNA, 25 bp, Rattus norvegicus
gaaaagtccatcttggtcctacagg

SEQ ID NO: 284223 - DNA, 25 bp, Rattus norvegicus
gaaaagtcccagacgctgacaaagt

SEQ ID NO: 284224 - DNA, 25 bp, Rattus norvegicus
gaaaagtcccagtcgctgacaaagt

SEQ ID NO: 284225 - DNA, 25 bp, Rattus norvegicus
gaaaagtccgcacaggtactggata

SEQ ID NO: 284226 - DNA, 25 bp, Rattus norvegicus
gaaaagtccgcagaggtactggata

SEQ ID NO: 284227 - DNA, 25 bp, Rattus norvegicus
gaaaagtccgtcaggacctcatggg

SEQ ID NO: 284228 - DNA, 25 bp, Rattus norvegicus
gaaaagtccgtctggacctcatggg

SEQ ID NO: 284229 - DNA, 25 bp, Rattus norvegicus
gaaaagtcctgcattcagcgatgag

SEQ ID NO: 284230 - DNA, 25 bp, Rattus norvegicus
gaaaagtcctgctttcagcgatgag

SEQ ID NO: 284231 - DNA, 25 bp, Rattus norvegicus
gaaaagtctccacatcctaaaggct

SEQ ID NO: 284232 - DNA, 25 bp, Rattus norvegicus
gaaaagtctccagatcctaaaggct

SEQ ID NO: 284233 - DNA, 25 bp, Rattus norvegicus
gaaaagtctcctaatcccaagaggg

SEQ ID NO: 284234 - DNA, 25 bp, Rattus norvegicus
gaaaagtctccttatcccaagaggg

SEQ ID NO: 284235 - DNA, 25 bp, Rattus norvegicus
gaaaagtctctgatgctcctagtcc

SEQ ID NO: 284236 - DNA, 25 bp, Rattus norvegicus
gaaaagtctctgttgctcctagtcc

SEQ ID NO: 284237 - DNA, 25 bp, Rattus norvegicus
gaaaagtctgtcagtccaacatatt

SEQ ID NO: 284238 - DNA, 25 bp, Rattus norvegicus
gaaaagtctgtctgtccaacatatt

SEQ ID NO: 284239 - DNA, 25 bp, Rattus norvegicus
gaaaagtcttgtactcactgctgtc

SEQ ID NO: 284240 - DNA, 25 bp, Rattus norvegicus
gaaaagtcttgttctcactgctgtc

SEQ ID NO: 284241 - DNA, 25 bp, Rattus norvegicus
gaaaagtgatctcctgttgaccaag

SEQ ID NO: 284242 - DNA, 25 bp, Rattus norvegicus
gaaaagtgatctgctgttgaccaag

SEQ ID NO: 284243 - DNA, 25 bp, Rattus norvegicus
gaaaagtgatttccctatttgttgg

SEQ ID NO: 284244 - DNA, 25 bp, Rattus norvegicus
gaaaagtgatttgcctatttgttgg

SEQ ID NO: 284245 - DNA, 25 bp, Rattus norvegicus
gaaaagtgcaaacctgtccttctcc

SEQ ID NO: 284246 - DNA, 25 bp, Rattus norvegicus
gaaaagtgcaaagctgtccttctcc

SEQ ID NO: 284247 - DNA, 25 bp, Rattus norvegicus
gaaaagtgcacaacagcggcgggct

SEQ ID NO: 284248 - DNA, 25 bp, Rattus norvegicus
gaaaagtgcacatcagcggcgggct

SEQ ID NO: 284249 - DNA, 25 bp, Rattus norvegicus
gaaaagtgcattcttttcttgtccc

SEQ ID NO: 284250 - DNA, 25 bp, Rattus norvegicus
gaaaagtgcattgttttcttgtccc

SEQ ID NO: 284251 - DNA, 25 bp, Rattus norvegicus
gaaaagtgctgtaccataactgaca

SEQ ID NO: 284252 - DNA, 25 bp, Rattus norvegicus
gaaaagtgctgttccataactgaca

SEQ ID NO: 284253 - DNA, 25 bp, Rattus norvegicus
gaaaagtgctttcacaagtcacgtg

SEQ ID NO: 284254 - DNA, 25 bp, Rattus norvegicus
gaaaagtgctttgacaagtcacgtg

SEQ ID NO: 284255 - DNA, 25 bp, Rattus norvegicus
gaaaagtggcaccagtctgcttcat

SEQ ID NO: 284256 - DNA, 25 bp, Rattus norvegicus
gaaaagtggcacgagtctgcttcat

SEQ ID NO: 284257 - DNA, 25 bp, Rattus norvegicus
gaaaagtgtcttccttgagcaaatg

SEQ ID NO: 284258 - DNA, 25 bp, Rattus norvegicus
gaaaagtgtcttgcttgagcaaatg

SEQ ID NO: 284259 - DNA, 25 bp, Rattus norvegicus
gaaaagtgttacaatctgcttctaa

SEQ ID NO: 284260 - DNA, 25 bp, Rattus norvegicus
gaaaagtgttactatctgcttctaa

SEQ ID NO: 284261 - DNA, 25 bp, Rattus norvegicus
gaaaagtgtttactcggatcttctt

SEQ ID NO: 284262 - DNA, 25 bp, Rattus norvegicus
gaaaagtgtttagtcggatcttctt

SEQ ID NO: 284263 - DNA, 25 bp, Rattus norvegicus
gaaaagttacctcacaccctagaag

SEQ ID NO: 284264 - DNA, 25 bp, Rattus norvegicus
gaaaagttacctgacaccctagaag

SEQ ID NO: 284265 - DNA, 25 bp, Rattus norvegicus
gaaaagttcaaaccccacgcgtcag

SEQ ID NO: 284266 - DNA, 25 bp, Rattus norvegicus
gaaaagttcaaagcccacgcgtcag

SEQ ID NO: 284267 - DNA, 25 bp, Rattus norvegicus
gaaaagttcacaagcctaccaatat

SEQ ID NO: 284268 - DNA, 25 bp, Rattus norvegicus
gaaaagttcacatgcctaccaatat

SEQ ID NO: 284269 - DNA, 25 bp, Rattus norvegicus
gaaaagttcatcaaaggccagtgta

SEQ ID NO: 284270 - DNA, 25 bp, Rattus norvegicus
gaaaagttcatcatcctccatggag

SEQ ID NO: 284271 - DNA, 25 bp, Rattus norvegicus
gaaaagttcatctaaggccagtgta

SEQ ID NO: 284272 - DNA, 25 bp, Rattus norvegicus
gaaaagttcatcttcctccatggag

SEQ ID NO: 284273 - DNA, 25 bp, Rattus norvegicus
gaaaagttccaaactctgaggtaaa

SEQ ID NO: 284274 - DNA, 25 bp, Rattus norvegicus
gaaaagttccaatctctgaggtaaa

SEQ ID NO: 284275 - DNA, 25 bp, Rattus norvegicus
gaaaagttcctgcaagctttcctct

SEQ ID NO: 284276 - DNA, 25 bp, Rattus norvegicus
gaaaagttcctggaagctttcctct

SEQ ID NO: 284277 - DNA, 25 bp, Rattus norvegicus
gaaaagttcggacgcccaggcacag

SEQ ID NO: 284278 - DNA, 25 bp, Rattus norvegicus
gaaaagttcggaggcccaggcacag

SEQ ID NO: 284279 - DNA, 25 bp, Rattus norvegicus
gaaaagttgccaccactcgaacctc

SEQ ID NO: 284280 - DNA, 25 bp, Rattus norvegicus
gaaaagttgccagcactcgaacctc

SEQ ID NO: 284281 - DNA, 25 bp, Rattus norvegicus
gaaaagtttccgcatactacctcag

SEQ ID NO: 284282 - DNA, 25 bp, Rattus norvegicus
gaaaagtttccggatactacctcag

SEQ ID NO: 284283 - DNA, 25 bp, Rattus norvegicus
gaaaagtttgcaaccaacaagaaga

SEQ ID NO: 284284 - DNA, 25 bp, Rattus norvegicus
gaaaagtttgcatccaacaagaaga

SEQ ID NO: 284285 - DNA, 25 bp, Rattus norvegicus
gaaaagtttggtccagctcagtttt

SEQ ID NO: 284286 - DNA, 25 bp, Rattus norvegicus
gaaaagtttggtgcagctcagtttt

SEQ ID NO: 284287 - DNA, 25 bp, Rattus norvegicus
gaaaagttttccctgcactttgagc

SEQ ID NO: 284288 - DNA, 25 bp, Rattus norvegicus
gaaaagttttccgtgcactttgagc

SEQ ID NO: 284289 - DNA, 25 bp, Rattus norvegicus
gaaaataaagctcctgggcctggtt

SEQ ID NO: 284290 - DNA, 25 bp, Rattus norvegicus
gaaaataaagctgctgggcctggtt

SEQ ID NO: 284291 - DNA, 25 bp, Rattus norvegicus
gaaaataaccagcacctccatgaag

SEQ ID NO: 284292 - DNA, 25 bp, Rattus norvegicus
gaaaataaccaggacctccatgaag

SEQ ID NO: 284293 - DNA, 25 bp, Rattus norvegicus
gaaaataacttaatggccagacatg

SEQ ID NO: 284294 - DNA, 25 bp, Rattus norvegicus
gaaaataacttattggccagacatg

SEQ ID NO: 284295 - DNA, 25 bp, Rattus norvegicus
gaaaataagtcccaatacggtgagt

SEQ ID NO: 284296 - DNA, 25 bp, Rattus norvegicus
gaaaataagtccgaatacggtgagt

SEQ ID NO: 284297 - DNA, 25 bp, Rattus norvegicus
gaaaataatcccaaactgcttatgg

SEQ ID NO: 284298 - DNA, 25 bp, Rattus norvegicus
gaaaataatccctaactgcttatgg

SEQ ID NO: 284299 - DNA, 25 bp, Rattus norvegicus
gaaaataatgaaatcttgtccatct

SEQ ID NO: 284300 - DNA, 25 bp, Rattus norvegicus
gaaaataatgaattcttgtccatct

SEQ ID NO: 284301 - DNA, 25 bp, Rattus norvegicus
gaaaataatgtaaaacctcgcctcg

SEQ ID NO: 284302 - DNA, 25 bp, Rattus norvegicus
gaaaataatgtataacctcgcctcg

SEQ ID NO: 284303 - DNA, 25 bp, Rattus norvegicus
gaaaatacaactccaccgtctgcgg

SEQ ID NO: 284304 - DNA, 25 bp, Rattus norvegicus
gaaaatacaactgcaccgtctgcgg

SEQ ID NO: 284305 - DNA, 25 bp, Rattus norvegicus
gaaaatacactcattattccccgag

SEQ ID NO: 284306 - DNA, 25 bp, Rattus norvegicus
gaaaatacactctttattccccgag

SEQ ID NO: 284307 - DNA, 25 bp, Rattus norvegicus
gaaaatacataaccacacggaaaga

SEQ ID NO: 284308 - DNA, 25 bp, Rattus norvegicus
gaaaatacataagcacacggaaaga

SEQ ID NO: 284309 - DNA, 25 bp, Rattus norvegicus
gaaaatacatccatactgatttcag

SEQ ID NO: 284310 - DNA, 25 bp, Rattus norvegicus
gaaaatacatccttactgatttcag

SEQ ID NO: 284311 - DNA, 25 bp, Rattus norvegicus
gaaaatacatgacgtgttcccatca

SEQ ID NO: 284312 - DNA, 25 bp, Rattus norvegicus
gaaaatacatgaggtgttcccatca

SEQ ID NO: 284313 - DNA, 25 bp, Rattus norvegicus
gaaaataccatcctctactcaagag

SEQ ID NO: 284314 - DNA, 25 bp, Rattus norvegicus
gaaaataccatcgtctactcaagag

SEQ ID NO: 284315 - DNA, 25 bp, Rattus norvegicus
gaaaatacccaaaggagctatctct

SEQ ID NO: 284316 - DNA, 25 bp, Rattus norvegicus
gaaaatacccaatggagctatctct

SEQ ID NO: 284317 - DNA, 25 bp, Rattus norvegicus
gaaaataccggaagagcagcctgaa

SEQ ID NO: 284318 - DNA, 25 bp, Rattus norvegicus
gaaaataccggatgagcagcctgaa

SEQ ID NO: 284319 - DNA, 25 bp, Rattus norvegicus
gaaaatacggcacttccagggaaag

SEQ ID NO: 284320 - DNA, 25 bp, Rattus norvegicus
gaaaatacggcagttccagggaaag

SEQ ID NO: 284321 - DNA, 25 bp, Rattus norvegicus
gaaaatacttgtagcctccttgttt

SEQ ID NO: 284322 - DNA, 25 bp, Rattus norvegicus
gaaaatacttgttgcctccttgttt

SEQ ID NO: 284323 - DNA, 25 bp, Rattus norvegicus
gaaaatactttgagccgtagtccta

SEQ ID NO: 284324 - DNA, 25 bp, Rattus norvegicus
gaaaatactttgtgccgtagtccta

SEQ ID NO: 284325 - DNA, 25 bp, Rattus norvegicus
gaaaatagaagcacgcctacccatc

SEQ ID NO: 284326 - DNA, 25 bp, Rattus norvegicus
gaaaatagaagctcgcctacccatc

SEQ ID NO: 284327 - DNA, 25 bp, Rattus norvegicus
gaaaatagatgtccatcgcccaccg

SEQ ID NO: 284328 - DNA, 25 bp, Rattus norvegicus
gaaaatagatgtgcatcgcccaccg

SEQ ID NO: 284329 - DNA, 25 bp, Rattus norvegicus
gaaaatagctcgagtgtcagtgata

SEQ ID NO: 284330 - DNA, 25 bp, Rattus norvegicus
gaaaatagctcgtgtgtcagtgata

SEQ ID NO: 284331 - DNA, 25 bp, Rattus norvegicus
gaaaatagctgcaaagcctgtggca

SEQ ID NO: 284332 - DNA, 25 bp, Rattus norvegicus
gaaaatagctgctaagcctgtggca

SEQ ID NO: 284333 - DNA, 25 bp, Rattus norvegicus
gaaaatagggccatactctttgaaa

SEQ ID NO: 284334 - DNA, 25 bp, Rattus norvegicus
gaaaatagggccttactctttgaaa

SEQ ID NO: 284335 - DNA, 25 bp, Rattus norvegicus
gaaaatagtctccttcttgtaactt

SEQ ID NO: 284336 - DNA, 25 bp, Rattus norvegicus
gaaaatagtctcgttcttgtaactt

SEQ ID NO: 284337 - DNA, 25 bp, Rattus norvegicus
gaaaatagttttcccctcacgaact

SEQ ID NO: 284338 - DNA, 25 bp, Rattus norvegicus
gaaaatagttttgccctcacgaact

SEQ ID NO: 284339 - DNA, 25 bp, Rattus norvegicus
gaaaatatacctagcttcctattgc

SEQ ID NO: 284340 - DNA, 25 bp, Rattus norvegicus
gaaaatataccttgcttcctattgc

SEQ ID NO: 284341 - DNA, 25 bp, Rattus norvegicus
gaaaatatcgtgacaagctcttggt

SEQ ID NO: 284342 - DNA, 25 bp, Rattus norvegicus
gaaaatatcgtgtcaagctcttggt

SEQ ID NO: 284343 - DNA, 25 bp, Rattus norvegicus
gaaaatatctgcagtgaaacaacgc

SEQ ID NO: 284344 - DNA, 25 bp, Rattus norvegicus
gaaaatatctgctgtgaaacaacgc

SEQ ID NO: 284345 - DNA, 25 bp, Rattus norvegicus
gaaaatatgcaactgaacccctcac

SEQ ID NO: 284346 - DNA, 25 bp, Rattus norvegicus
gaaaatatgcaagtgaacccctcac

SEQ ID NO: 284347 - DNA, 25 bp, Rattus norvegicus
gaaaatatgcacacaccaaggtttt

SEQ ID NO: 284348 - DNA, 25 bp, Rattus norvegicus
gaaaatatgcactcaccaaggtttt

SEQ ID NO: 284349 - DNA, 25 bp, Rattus norvegicus
gaaaatatgtctaaagtccatcagt

SEQ ID NO: 284350 - DNA, 25 bp, Rattus norvegicus
gaaaatatgtcttaagtccatcagt

SEQ ID NO: 284351 - DNA, 25 bp, Rattus norvegicus
gaaaatatgttgacaggcgtcccct

SEQ ID NO: 284352 - DNA, 25 bp, Rattus norvegicus
gaaaatatgttgtcaggcgtcccct

SEQ ID NO: 284353 - DNA, 25 bp, Rattus norvegicus
gaaaatattattcccacaagccaag

SEQ ID NO: 284354 - DNA, 25 bp, Rattus norvegicus
gaaaatattattgccacaagccaag

SEQ ID NO: 284355 - DNA, 25 bp, Rattus norvegicus
gaaaatattcaacaggactcagact

SEQ ID NO: 284356 - DNA, 25 bp, Rattus norvegicus
gaaaatattcaagaggactcagact

SEQ ID NO: 284357 - DNA, 25 bp, Rattus norvegicus
gaaaatattcatcggccttgggatg

SEQ ID NO: 284358 - DNA, 25 bp, Rattus norvegicus
gaaaatattcatgggccttgggatg

SEQ ID NO: 284359 - DNA, 25 bp, Rattus norvegicus
gaaaatattcttctaagcgtgtgaa

SEQ ID NO: 284360 - DNA, 25 bp, Rattus norvegicus
gaaaatattcttgtaagcgtgtgaa

SEQ ID NO: 284361 - DNA, 25 bp, Rattus norvegicus
gaaaatcaacctaccttcctgtact

SEQ ID NO: 284362 - DNA, 25 bp, Rattus norvegicus
gaaaatcaaccttccttcctgtact

SEQ ID NO: 284363 - DNA, 25 bp, Rattus norvegicus
gaaaatcacatgcagctcatctaag

SEQ ID NO: 284364 - DNA, 25 bp, Rattus norvegicus
gaaaatcacatggagctcatctaag

SEQ ID NO: 284365 - DNA, 25 bp, Rattus norvegicus
gaaaatcacgcaccgctgggacgat

SEQ ID NO: 284366 - DNA, 25 bp, Rattus norvegicus
gaaaatcacgcagcgctgggacgat

SEQ ID NO: 284367 - DNA, 25 bp, Rattus norvegicus
gaaaatcactaacagccccttgaga

SEQ ID NO: 284368 - DNA, 25 bp, Rattus norvegicus
gaaaatcactaagagccccttgaga

SEQ ID NO: 284369 - DNA, 25 bp, Rattus norvegicus
gaaaatcactgcagtgcctacacta

SEQ ID NO: 284370 - DNA, 25 bp, Rattus norvegicus
gaaaatcactgctgtgcctacacta

SEQ ID NO: 284371 - DNA, 25 bp, Rattus norvegicus
gaaaatcactttacataatctggag

SEQ ID NO: 284372 - DNA, 25 bp, Rattus norvegicus
gaaaatcacttttcataatctggag

SEQ ID NO: 284373 - DNA, 25 bp, Rattus norvegicus
gaaaatcagcgcacttgcagaaagt

SEQ ID NO: 284374 - DNA, 25 bp, Rattus norvegicus
gaaaatcagcgctcttgcagaaagt

SEQ ID NO: 284375 - DNA, 25 bp, Rattus norvegicus
gaaaatcagtcaccttagagcagaa

SEQ ID NO: 284376 - DNA, 25 bp, Rattus norvegicus
gaaaatcagtcagcttagagcagaa

SEQ ID NO: 284377 - DNA, 25 bp, Rattus norvegicus
gaaaatcagtgtcatctaggccaca

SEQ ID NO: 284378 - DNA, 25 bp, Rattus norvegicus
gaaaatcagtgtgatctaggccaca

SEQ ID NO: 284379 - DNA, 25 bp, Rattus norvegicus
gaaaatcatctccagggaaccagta

SEQ ID NO: 284380 - DNA, 25 bp, Rattus norvegicus
gaaaatcatctcgagggaaccagta

SEQ ID NO: 284381 - DNA, 25 bp, Rattus norvegicus
gaaaatcatgctcaccaacagacag

SEQ ID NO: 284382 - DNA, 25 bp, Rattus norvegicus
gaaaatcatgctgaccaacagacag

SEQ ID NO: 284383 - DNA, 25 bp, Rattus norvegicus
gaaaatcatgtgagacttccgcctg

SEQ ID NO: 284384 - DNA, 25 bp, Rattus norvegicus
gaaaatcatgtgtgacttccgcctg

SEQ ID NO: 284385 - DNA, 25 bp, Rattus norvegicus
gaaaatccaaagagtacctggtgaa

SEQ ID NO: 284386 - DNA, 25 bp, Rattus norvegicus
gaaaatccaaagatgtcccttgaaa

SEQ ID NO: 284387 - DNA, 25 bp, Rattus norvegicus
gaaaatccaaagtgtacctggtgaa

SEQ ID NO: 284388 - DNA, 25 bp, Rattus norvegicus
gaaaatccaaagttgtcccttgaaa

SEQ ID NO: 284389 - DNA, 25 bp, Rattus norvegicus
gaaaatccacacatagtacctgaga

SEQ ID NO: 284390 - DNA, 25 bp, Rattus norvegicus
gaaaatccacacttagtacctgaga

SEQ ID NO: 284391 - DNA, 25 bp, Rattus norvegicus
gaaaatccagttctgcaccacaata

SEQ ID NO: 284392 - DNA, 25 bp, Rattus norvegicus
gaaaatccagttgtgcaccacaata

SEQ ID NO: 284393 - DNA, 25 bp, Rattus norvegicus
gaaaatccattcctgctttagatag

SEQ ID NO: 284394 - DNA, 25 bp, Rattus norvegicus
gaaaatccattcgtgctttagatag

SEQ ID NO: 284395 - DNA, 25 bp, Rattus norvegicus
gaaaatccccaacaagtgctatcct

SEQ ID NO: 284396 - DNA, 25 bp, Rattus norvegicus
gaaaatccccaagaagtgctatcct

SEQ ID NO: 284397 - DNA, 25 bp, Rattus norvegicus
gaaaatccctcacttcttctgtgaa

SEQ ID NO: 284398 - DNA, 25 bp, Rattus norvegicus
gaaaatccctcagttcttctgtgaa

SEQ ID NO: 284399 - DNA, 25 bp, Rattus norvegicus
gaaaatcctaaactgtgtgaacaaa

SEQ ID NO: 284400 - DNA, 25 bp, Rattus norvegicus
gaaaatcctaaagtgtgtgaacaaa

SEQ ID NO: 284401 - DNA, 25 bp, Rattus norvegicus
gaaaatcctatcacacttctactct

SEQ ID NO: 284402 - DNA, 25 bp, Rattus norvegicus
gaaaatcctatctcacttctactct

SEQ ID NO: 284403 - DNA, 25 bp, Rattus norvegicus
gaaaatcctcaacactccaaactgt

SEQ ID NO: 284404 - DNA, 25 bp, Rattus norvegicus
gaaaatcctcaagactccaaactgt

SEQ ID NO: 284405 - DNA, 25 bp, Rattus norvegicus
gaaaatcctcacattcattctattt

SEQ ID NO: 284406 - DNA, 25 bp, Rattus norvegicus
gaaaatcctcactttcattctattt

SEQ ID NO: 284407 - DNA, 25 bp, Rattus norvegicus
gaaaatcctcatcagtgtggccatc

SEQ ID NO: 284408 - DNA, 25 bp, Rattus norvegicus
gaaaatcctcatgagtgtggccatc

SEQ ID NO: 284409 - DNA, 25 bp, Rattus norvegicus
gaaaatcctccaagagctgctcgga

SEQ ID NO: 284410 - DNA, 25 bp, Rattus norvegicus
gaaaatcctccaagcagaatcgacc

SEQ ID NO: 284411 - DNA, 25 bp, Rattus norvegicus
gaaaatcctccatgagctgctcgga

SEQ ID NO: 284412 - DNA, 25 bp, Rattus norvegicus
gaaaatcctccatgcagaatcgacc

SEQ ID NO: 284413 - DNA, 25 bp, Rattus norvegicus
gaaaatcctcttcctgccaagttgc

SEQ ID NO: 284414 - DNA, 25 bp, Rattus norvegicus
gaaaatcctcttgctgccaagttgc

SEQ ID NO: 284415 - DNA, 25 bp, Rattus norvegicus
gaaaatcctgatcgacgccgtctct

SEQ ID NO: 284416 - DNA, 25 bp, Rattus norvegicus
gaaaatcctgatggacgccgtctct

SEQ ID NO: 284417 - DNA, 25 bp, Rattus norvegicus
gaaaatcctgcgcttagggccatct

SEQ ID NO: 284418 - DNA, 25 bp, Rattus norvegicus
gaaaatcctgcggttagggccatct

SEQ ID NO: 284419 - DNA, 25 bp, Rattus norvegicus
gaaaatcctgctagtcctgagctga

SEQ ID NO: 284420 - DNA, 25 bp, Rattus norvegicus
gaaaatcctgcttgtcctgagctga

SEQ ID NO: 284421 - DNA, 25 bp, Rattus norvegicus
gaaaatccttacagagcaacaagaa

SEQ ID NO: 284422 - DNA, 25 bp, Rattus norvegicus
gaaaatccttactgagcaacaagaa

SEQ ID NO: 284423 - DNA, 25 bp, Rattus norvegicus
gaaaatccttcaaacagcctggcat

SEQ ID NO: 284424 - DNA, 25 bp, Rattus norvegicus
gaaaatccttcatacagcctggcat

SEQ ID NO: 284425 - DNA, 25 bp, Rattus norvegicus
gaaaatccttgcagctacttgaagt

SEQ ID NO: 284426 - DNA, 25 bp, Rattus norvegicus
gaaaatccttgctgctacttgaagt

SEQ ID NO: 284427 - DNA, 25 bp, Rattus norvegicus
gaaaatccttgtcattttgcattgt

SEQ ID NO: 284428 - DNA, 25 bp, Rattus norvegicus
gaaaatccttgtgattttgcattgt

SEQ ID NO: 284429 - DNA, 25 bp, Rattus norvegicus
gaaaatcctttgagccttgcagaaa

SEQ ID NO: 284430 - DNA, 25 bp, Rattus norvegicus
gaaaatcctttgtgccttgcagaaa

SEQ ID NO: 284431 - DNA, 25 bp, Rattus norvegicus
gaaaatcgagttcccctctaagaat

SEQ ID NO: 284432 - DNA, 25 bp, Rattus norvegicus
gaaaatcgagttgccctctaagaat

SEQ ID NO: 284433 - DNA, 25 bp, Rattus norvegicus
gaaaatcggagtcagctcccgccag

SEQ ID NO: 284434 - DNA, 25 bp, Rattus norvegicus
gaaaatcggagtgagctcccgccag

SEQ ID NO: 284435 - DNA, 25 bp, Rattus norvegicus
gaaaatcgtctgaatccggagaggg

SEQ ID NO: 284436 - DNA, 25 bp, Rattus norvegicus
gaaaatcgtctgtatccggagaggg

SEQ ID NO: 284437 - DNA, 25 bp, Rattus norvegicus
gaaaatcgtgatacaaccccaggga

SEQ ID NO: 284438 - DNA, 25 bp, Rattus norvegicus
gaaaatcgtgattcaaccccaggga

SEQ ID NO: 284439 - DNA, 25 bp, Rattus norvegicus
gaaaatcgttgactcatccaaatgg

SEQ ID NO: 284440 - DNA, 25 bp, Rattus norvegicus
gaaaatcgttgagtcatccaaatgg

SEQ ID NO: 284441 - DNA, 25 bp, Rattus norvegicus
gaaaatctacacacagcgactccca

SEQ ID NO: 284442 - DNA, 25 bp, Rattus norvegicus
gaaaatctacacacatccccagagc

SEQ ID NO: 284443 - DNA, 25 bp, Rattus norvegicus
gaaaatctacactcagcgactccca

SEQ ID NO: 284444 - DNA, 25 bp, Rattus norvegicus
gaaaatctacactcatccccagagc

SEQ ID NO: 284445 - DNA, 25 bp, Rattus norvegicus
gaaaatctatcaactcctgatggta

SEQ ID NO: 284446 - DNA, 25 bp, Rattus norvegicus
gaaaatctatcatctcctgatggta

SEQ ID NO: 284447 - DNA, 25 bp, Rattus norvegicus
gaaaatctattcagagttcctgggc

SEQ ID NO: 284448 - DNA, 25 bp, Rattus norvegicus
gaaaatctattctgagttcctgggc

SEQ ID NO: 284449 - DNA, 25 bp, Rattus norvegicus
gaaaatctcagactggcctggtgta

SEQ ID NO: 284450 - DNA, 25 bp, Rattus norvegicus
gaaaatctcagagtggcctggtgta

SEQ ID NO: 284451 - DNA, 25 bp, Rattus norvegicus
gaaaatctcatgacagcccttgatg

SEQ ID NO: 284452 - DNA, 25 bp, Rattus norvegicus
gaaaatctcatgtcagcccttgatg

SEQ ID NO: 284453 - DNA, 25 bp, Rattus norvegicus
gaaaatctggagacacccgtgctgt

SEQ ID NO: 284454 - DNA, 25 bp, Rattus norvegicus
gaaaatctggagtcacccgtgctgt

SEQ ID NO: 284455 - DNA, 25 bp, Rattus norvegicus
gaaaatctggtacaggttttaggat

SEQ ID NO: 284456 - DNA, 25 bp, Rattus norvegicus
gaaaatctggtagaggttttaggat

SEQ ID NO: 284457 - DNA, 25 bp, Rattus norvegicus
gaaaatctgtcaagtccaccttgga

SEQ ID NO: 284458 - DNA, 25 bp, Rattus norvegicus
gaaaatctgtcatgtccaccttgga

SEQ ID NO: 284459 - DNA, 25 bp, Rattus norvegicus
gaaaatctgtgcctcgtgaacatct

SEQ ID NO: 284460 - DNA, 25 bp, Rattus norvegicus
gaaaatctgtgcgtcgtgaacatct

SEQ ID NO: 284461 - DNA, 25 bp, Rattus norvegicus
gaaaatctgttcactcctgacagag

SEQ ID NO: 284462 - DNA, 25 bp, Rattus norvegicus
gaaaatctgttctctcctgacagag

SEQ ID NO: 284463 - DNA, 25 bp, Rattus norvegicus
gaaaatctgtttactctcctcagtg

SEQ ID NO: 284464 - DNA, 25 bp, Rattus norvegicus
gaaaatctgtttccagctctcaagt

SEQ ID NO: 284465 - DNA, 25 bp, Rattus norvegicus
gaaaatctgtttgcagctctcaagt

SEQ ID NO: 284466 - DNA, 25 bp, Rattus norvegicus
gaaaatctgttttctctcctcagtg

SEQ ID NO: 284467 - DNA, 25 bp, Rattus norvegicus
gaaaatcttaccatcctagttcagg

SEQ ID NO: 284468 - DNA, 25 bp, Rattus norvegicus
gaaaatcttaccttcctagttcagg

SEQ ID NO: 284469 - DNA, 25 bp, Rattus norvegicus
gaaaatcttcatccatgtgctcttc

SEQ ID NO: 284470 - DNA, 25 bp, Rattus norvegicus
gaaaatcttcatgcatgtgctcttc

SEQ ID NO: 284471 - DNA, 25 bp, Rattus norvegicus
gaaaatcttccgaagcactgctcca

SEQ ID NO: 284472 - DNA, 25 bp, Rattus norvegicus
gaaaatcttccgtagcactgctcca

SEQ ID NO: 284473 - DNA, 25 bp, Rattus norvegicus
gaaaatcttctcatctacagtttgt

SEQ ID NO: 284474 - DNA, 25 bp, Rattus norvegicus
gaaaatcttctcttctacagtttgt

SEQ ID NO: 284475 - DNA, 25 bp, Rattus norvegicus
gaaaatcttctgaacctgtcttttt

SEQ ID NO: 284476 - DNA, 25 bp, Rattus norvegicus
gaaaatcttctgtacctgtcttttt

SEQ ID NO: 284477 - DNA, 25 bp, Rattus norvegicus
gaaaatcttcttcattctaccagga

SEQ ID NO: 284478 - DNA, 25 bp, Rattus norvegicus
gaaaatcttcttgattctaccagga

SEQ ID NO: 284479 - DNA, 25 bp, Rattus norvegicus
gaaaatcttttaattagggctggct

SEQ ID NO: 284480 - DNA, 25 bp, Rattus norvegicus
gaaaatcttttatttagggctggct

SEQ ID NO: 284481 - DNA, 25 bp, Rattus norvegicus
gaaaatgaaacaagcacgcggtttt

SEQ ID NO: 284482 - DNA, 25 bp, Rattus norvegicus
gaaaatgaaacatgcacgcggtttt

SEQ ID NO: 284483 - DNA, 25 bp, Rattus norvegicus
gaaaatgaacccagcatccggatgt

SEQ ID NO: 284484 - DNA, 25 bp, Rattus norvegicus
gaaaatgaaccctgcatccggatgt

SEQ ID NO: 284485 - DNA, 25 bp, Rattus norvegicus
gaaaatgaacctccaatccagaata

SEQ ID NO: 284486 - DNA, 25 bp, Rattus norvegicus
gaaaatgaacctgcaatccagaata

SEQ ID NO: 284487 - DNA, 25 bp, Rattus norvegicus
gaaaatgaacttagctcaacccgga

SEQ ID NO: 284488 - DNA, 25 bp, Rattus norvegicus
gaaaatgaactttgctcaacccgga

SEQ ID NO: 284489 - DNA, 25 bp, Rattus norvegicus
gaaaatgacctgcagccattacagt

SEQ ID NO: 284490 - DNA, 25 bp, Rattus norvegicus
gaaaatgacctggagccattacagt

SEQ ID NO: 284491 - DNA, 25 bp, Rattus norvegicus
gaaaatgactttcacctaggtggtg

SEQ ID NO: 284492 - DNA, 25 bp, Rattus norvegicus
gaaaatgactttcccaccagttccg

SEQ ID NO: 284493 - DNA, 25 bp, Rattus norvegicus
gaaaatgactttgacctaggtggtg

SEQ ID NO: 284494 - DNA, 25 bp, Rattus norvegicus
gaaaatgactttgccaccagttccg

SEQ ID NO: 284495 - DNA, 25 bp, Rattus norvegicus
gaaaatgagatcacccacttccgtg

SEQ ID NO: 284496 - DNA, 25 bp, Rattus norvegicus
gaaaatgagatctcccacttccgtg

SEQ ID NO: 284497 - DNA, 25 bp, Rattus norvegicus
gaaaatgagcatatggtccaaggaa

SEQ ID NO: 284498 - DNA, 25 bp, Rattus norvegicus
gaaaatgagcatttggtccaaggaa

SEQ ID NO: 284499 - DNA, 25 bp, Rattus norvegicus
gaaaatgagctcaccttccgaacgg

SEQ ID NO: 284500 - DNA, 25 bp, Rattus norvegicus
gaaaatgagctctccttccgaacgg

SEQ ID NO: 284501 - DNA, 25 bp, Rattus norvegicus
gaaaatgaggccatgttcccttcac

SEQ ID NO: 284502 - DNA, 25 bp, Rattus norvegicus
gaaaatgaggccttgttcccttcac

SEQ ID NO: 284503 - DNA, 25 bp, Rattus norvegicus
gaaaatgagtgtcccatcactggag

SEQ ID NO: 284504 - DNA, 25 bp, Rattus norvegicus
gaaaatgagtgtgccatcactggag

SEQ ID NO: 284505 - DNA, 25 bp, Rattus norvegicus
gaaaatgatcacagaatccaaggta

SEQ ID NO: 284506 - DNA, 25 bp, Rattus norvegicus
gaaaatgatcacctctaacttgcag

SEQ ID NO: 284507 - DNA, 25 bp, Rattus norvegicus
gaaaatgatcacgtctaacttgcag

SEQ ID NO: 284508 - DNA, 25 bp, Rattus norvegicus
gaaaatgatcactgaatccaaggta

SEQ ID NO: 284509 - DNA, 25 bp, Rattus norvegicus
gaaaatgatgaccacaatcaactgt

SEQ ID NO: 284510 - DNA, 25 bp, Rattus norvegicus
gaaaatgatgacgacaatcaactgt

SEQ ID NO: 284511 - DNA, 25 bp, Rattus norvegicus
gaaaatgattgcaccacagaaatgg

SEQ ID NO: 284512 - DNA, 25 bp, Rattus norvegicus
gaaaatgattgctccacagaaatgg

SEQ ID NO: 284513 - DNA, 25 bp, Rattus norvegicus
gaaaatgcaaatacctgccagcctc

SEQ ID NO: 284514 - DNA, 25 bp, Rattus norvegicus
gaaaatgcaaattcctgccagcctc

SEQ ID NO: 284515 - DNA, 25 bp, Rattus norvegicus
gaaaatgcaattagctgacctcgga

SEQ ID NO: 284516 - DNA, 25 bp, Rattus norvegicus
gaaaatgcaatttgctgacctcgga

SEQ ID NO: 284517 - DNA, 25 bp, Rattus norvegicus
gaaaatgcacgaacccaaagcctta

SEQ ID NO: 284518 - DNA, 25 bp, Rattus norvegicus
gaaaatgcacgatcccaaagcctta

SEQ ID NO: 284519 - DNA, 25 bp, Rattus norvegicus
gaaaatgcacttctcttcttccaaa

SEQ ID NO: 284520 - DNA, 25 bp, Rattus norvegicus
gaaaatgcacttgtcttcttccaaa

SEQ ID NO: 284521 - DNA, 25 bp, Rattus norvegicus
gaaaatgcagacatggtttacccat

SEQ ID NO: 284522 - DNA, 25 bp, Rattus norvegicus
gaaaatgcagacttggtttacccat

SEQ ID NO: 284523 - DNA, 25 bp, Rattus norvegicus
gaaaatgccaaacatatctccaatt

SEQ ID NO: 284524 - DNA, 25 bp, Rattus norvegicus
gaaaatgccaaagatatctccaatt

SEQ ID NO: 284525 - DNA, 25 bp, Rattus norvegicus
gaaaatgccatgcatgccgttacct

SEQ ID NO: 284526 - DNA, 25 bp, Rattus norvegicus
gaaaatgccatggatgccgttacct

SEQ ID NO: 284527 - DNA, 25 bp, Rattus norvegicus
gaaaatgcccaaacccagactaaag

SEQ ID NO: 284528 - DNA, 25 bp, Rattus norvegicus
gaaaatgcccaatcccagactaaag

SEQ ID NO: 284529 - DNA, 25 bp, Rattus norvegicus
gaaaatgccccacgtgaccatatga

SEQ ID NO: 284530 - DNA, 25 bp, Rattus norvegicus
gaaaatgccccaggtgaccatatga

SEQ ID NO: 284531 - DNA, 25 bp, Rattus norvegicus
gaaaatgccctcactcatgagatgg

SEQ ID NO: 284532 - DNA, 25 bp, Rattus norvegicus
gaaaatgccctctctcatgagatgg

SEQ ID NO: 284533 - DNA, 25 bp, Rattus norvegicus
gaaaatgcccttaacaatctgatgt

SEQ ID NO: 284534 - DNA, 25 bp, Rattus norvegicus
gaaaatgccctttacaatctgatgt

SEQ ID NO: 284535 - DNA, 25 bp, Rattus norvegicus
gaaaatgccgtactgaaacactatg

SEQ ID NO: 284536 - DNA, 25 bp, Rattus norvegicus
gaaaatgccgtagtgaaacactatg

SEQ ID NO: 284537 - DNA, 25 bp, Rattus norvegicus
gaaaatgccttcagtctgtgttcca

SEQ ID NO: 284538 - DNA, 25 bp, Rattus norvegicus
gaaaatgccttcataagacgggagt

SEQ ID NO: 284539 - DNA, 25 bp, Rattus norvegicus
gaaaatgccttctgtctgtgttcca

SEQ ID NO: 284540 - DNA, 25 bp, Rattus norvegicus
gaaaatgccttcttaagacgggagt

SEQ ID NO: 284541 - DNA, 25 bp, Rattus norvegicus
gaaaatgcctttccaagacatgaaa

SEQ ID NO: 284542 - DNA, 25 bp, Rattus norvegicus
gaaaatgcctttgcaagacatgaaa

SEQ ID NO: 284543 - DNA, 25 bp, Rattus norvegicus
gaaaatgctagaagctcacccctgt

SEQ ID NO: 284544 - DNA, 25 bp, Rattus norvegicus
gaaaatgctagatgctcacccctgt

SEQ ID NO: 284545 - DNA, 25 bp, Rattus norvegicus
gaaaatgctcccacaagatcggctt

SEQ ID NO: 284546 - DNA, 25 bp, Rattus norvegicus
gaaaatgctcccataaggccaggct

SEQ ID NO: 284547 - DNA, 25 bp, Rattus norvegicus
gaaaatgctccctcaagatcggctt

SEQ ID NO: 284548 - DNA, 25 bp, Rattus norvegicus
gaaaatgctcccttaaggccaggct

SEQ ID NO: 284549 - DNA, 25 bp, Rattus norvegicus
gaaaatgctcctaactggagagttg

SEQ ID NO: 284550 - DNA, 25 bp, Rattus norvegicus
gaaaatgctcctactgtggacaaca

SEQ ID NO: 284551 - DNA, 25 bp, Rattus norvegicus
gaaaatgctccttactggagagttg

SEQ ID NO: 284552 - DNA, 25 bp, Rattus norvegicus
gaaaatgctccttctgtggacaaca

SEQ ID NO: 284553 - DNA, 25 bp, Rattus norvegicus
gaaaatgctctcaccaaagcagctt

SEQ ID NO: 284554 - DNA, 25 bp, Rattus norvegicus
gaaaatgctctctccaaagcagctt

SEQ ID NO: 284555 - DNA, 25 bp, Rattus norvegicus
gaaaatgctctgaaatcttgccaaa

SEQ ID NO: 284556 - DNA, 25 bp, Rattus norvegicus
gaaaatgctctgtaatcttgccaaa

SEQ ID NO: 284557 - DNA, 25 bp, Rattus norvegicus
gaaaatgctgtcacaagcagagaat

SEQ ID NO: 284558 - DNA, 25 bp, Rattus norvegicus
gaaaatgctgtctcaagcagagaat

SEQ ID NO: 284559 - DNA, 25 bp, Rattus norvegicus
gaaaatgctgttacctttaagcttt

SEQ ID NO: 284560 - DNA, 25 bp, Rattus norvegicus
gaaaatgctgttcactctggagccc

SEQ ID NO: 284561 - DNA, 25 bp, Rattus norvegicus
gaaaatgctgttgactctggagccc

SEQ ID NO: 284562 - DNA, 25 bp, Rattus norvegicus
gaaaatgctgtttcctttaagcttt

SEQ ID NO: 284563 - DNA, 25 bp, Rattus norvegicus
gaaaatgcttagaacgggaccacga

SEQ ID NO: 284564 - DNA, 25 bp, Rattus norvegicus
gaaaatgcttagtacgggaccacga

SEQ ID NO: 284565 - DNA, 25 bp, Rattus norvegicus
gaaaatggactaagtatctacctta

SEQ ID NO: 284566 - DNA, 25 bp, Rattus norvegicus
gaaaatggactatgtatctacctta

SEQ ID NO: 284567 - DNA, 25 bp, Rattus norvegicus
gaaaatggagtgacccttctaccac

SEQ ID NO: 284568 - DNA, 25 bp, Rattus norvegicus
gaaaatggagtgtcccttctaccac

SEQ ID NO: 284569 - DNA, 25 bp, Rattus norvegicus
gaaaatggatacctcattcccaaat

SEQ ID NO: 284570 - DNA, 25 bp, Rattus norvegicus
gaaaatggatacgtcattcccaaat

SEQ ID NO: 284571 - DNA, 25 bp, Rattus norvegicus
gaaaatggcacgcaccatcggcatc

SEQ ID NO: 284572 - DNA, 25 bp, Rattus norvegicus
gaaaatggcacggaccatcggcatc

SEQ ID NO: 284573 - DNA, 25 bp, Rattus norvegicus
gaaaatggcagaacgtccacttcca

SEQ ID NO: 284574 - DNA, 25 bp, Rattus norvegicus
gaaaatggcagatcgtccacttcca

SEQ ID NO: 284575 - DNA, 25 bp, Rattus norvegicus
gaaaatggccaacgagctcccacta

SEQ ID NO: 284576 - DNA, 25 bp, Rattus norvegicus
gaaaatggccaaggagctcccacta

SEQ ID NO: 284577 - DNA, 25 bp, Rattus norvegicus
gaaaatggcctcctgctctaggaat

SEQ ID NO: 284578 - DNA, 25 bp, Rattus norvegicus
gaaaatggcctcgtgctctaggaat

SEQ ID NO: 284579 - DNA, 25 bp, Rattus norvegicus
gaaaatggcgtcaccatgtctcagc

SEQ ID NO: 284580 - DNA, 25 bp, Rattus norvegicus
gaaaatggcgtctccatgtctcagc

SEQ ID NO: 284581 - DNA, 25 bp, Rattus norvegicus
gaaaatgggagcctctcatcctggg

SEQ ID NO: 284582 - DNA, 25 bp, Rattus norvegicus
gaaaatgggagcgtctcatcctggg

SEQ ID NO: 284583 - DNA, 25 bp, Rattus norvegicus
gaaaatgggccgcaactcatcctgc

SEQ ID NO: 284584 - DNA, 25 bp, Rattus norvegicus
gaaaatgggccggaactcatcctgc

SEQ ID NO: 284585 - DNA, 25 bp, Rattus norvegicus
gaaaatgggtacacctttccgatct

SEQ ID NO: 284586 - DNA, 25 bp, Rattus norvegicus
gaaaatgggtactcctttccgatct

SEQ ID NO: 284587 - DNA, 25 bp, Rattus norvegicus
gaaaatggtcccaataggttcatat

SEQ ID NO: 284588 - DNA, 25 bp, Rattus norvegicus
gaaaatggtccctataggttcatat

SEQ ID NO: 284589 - DNA, 25 bp, Rattus norvegicus
gaaaatggtgcacccttacctcaga

SEQ ID NO: 284590 - DNA, 25 bp, Rattus norvegicus
gaaaatggtgcagccttacctcaga

SEQ ID NO: 284591 - DNA, 25 bp, Rattus norvegicus
gaaaatggtgttactcttccagact

SEQ ID NO: 284592 - DNA, 25 bp, Rattus norvegicus
gaaaatggtgtttctcttccagact

SEQ ID NO: 284593 - DNA, 25 bp, Rattus norvegicus
gaaaatgtacaaaactctctaaata

SEQ ID NO: 284594 - DNA, 25 bp, Rattus norvegicus
gaaaatgtacaatactctctaaata

SEQ ID NO: 284595 - DNA, 25 bp, Rattus norvegicus
gaaaatgtacatacgtgtgaaccaa

SEQ ID NO: 284596 - DNA, 25 bp, Rattus norvegicus
gaaaatgtacatcggtgcctggcca

SEQ ID NO: 284597 - DNA, 25 bp, Rattus norvegicus
gaaaatgtacatgggtgcctggcca

SEQ ID NO: 284598 - DNA, 25 bp, Rattus norvegicus
gaaaatgtacattcgtgtgaaccaa

SEQ ID NO: 284599 - DNA, 25 bp, Rattus norvegicus
gaaaatgtcaagctgcttaaagaac

SEQ ID NO: 284600 - DNA, 25 bp, Rattus norvegicus
gaaaatgtcaaggtgcttaaagaac

SEQ ID NO: 284601 - DNA, 25 bp, Rattus norvegicus
gaaaatgtcccaaagacttgcctat

SEQ ID NO: 284602 - DNA, 25 bp, Rattus norvegicus
gaaaatgtcccatagacttgcctat

SEQ ID NO: 284603 - DNA, 25 bp, Rattus norvegicus
gaaaatgtcctgaaggcttgttaat

SEQ ID NO: 284604 - DNA, 25 bp, Rattus norvegicus
gaaaatgtcctgtaggcttgttaat

SEQ ID NO: 284605 - DNA, 25 bp, Rattus norvegicus
gaaaatgtctaaccctgtgtgagtg

SEQ ID NO: 284606 - DNA, 25 bp, Rattus norvegicus
gaaaatgtctaagcctgtgtgagtg

SEQ ID NO: 284607 - DNA, 25 bp, Rattus norvegicus
gaaaatgtctcacagacctgcctat

SEQ ID NO: 284608 - DNA, 25 bp, Rattus norvegicus
gaaaatgtctcagagacctgcctat

SEQ ID NO: 284609 - DNA, 25 bp, Rattus norvegicus
gaaaatgtctggaccctgttctgcc

SEQ ID NO: 284610 - DNA, 25 bp, Rattus norvegicus
gaaaatgtctggtccctgttctgcc

SEQ ID NO: 284611 - DNA, 25 bp, Rattus norvegicus
gaaaatgtctgtctccttataaaga

SEQ ID NO: 284612 - DNA, 25 bp, Rattus norvegicus
gaaaatgtctgtgtccttataaaga

SEQ ID NO: 284613 - DNA, 25 bp, Rattus norvegicus
gaaaatgtcttgacctctctgggct

SEQ ID NO: 284614 - DNA, 25 bp, Rattus norvegicus
gaaaatgtcttgtcctctctgggct

SEQ ID NO: 284615 - DNA, 25 bp, Rattus norvegicus
gaaaatgtgacccagcatccacatg

SEQ ID NO: 284616 - DNA, 25 bp, Rattus norvegicus
gaaaatgtgaccgagcatccacatg

SEQ ID NO: 284617 - DNA, 25 bp, Rattus norvegicus
gaaaatgtgcttacaccactgtaca

SEQ ID NO: 284618 - DNA, 25 bp, Rattus norvegicus
gaaaatgtgctttcaccactgtaca

SEQ ID NO: 284619 - DNA, 25 bp, Rattus norvegicus
gaaaatgtggtacctaagcccagtg

SEQ ID NO: 284620 - DNA, 25 bp, Rattus norvegicus
gaaaatgtggtagctaagcccagtg

SEQ ID NO: 284621 - DNA, 25 bp, Rattus norvegicus
gaaaatgtgtaccacgaatttcgtg

SEQ ID NO: 284622 - DNA, 25 bp, Rattus norvegicus
gaaaatgtgtacgacgaatttcgtg

SEQ ID NO: 284623 - DNA, 25 bp, Rattus norvegicus
gaaaatgtgtatatctgtctttaga

SEQ ID NO: 284624 - DNA, 25 bp, Rattus norvegicus
gaaaatgtgtatttctgtctttaga

SEQ ID NO: 284625 - DNA, 25 bp, Rattus norvegicus
gaaaatgttagtcccctgtggaagt

SEQ ID NO: 284626 - DNA, 25 bp, Rattus norvegicus
gaaaatgttagtgccctgtggaagt

SEQ ID NO: 284627 - DNA, 25 bp, Rattus norvegicus
gaaaatgttccacttcacagcagtg

SEQ ID NO: 284628 - DNA, 25 bp, Rattus norvegicus
gaaaatgttccagttcacagcagtg

SEQ ID NO: 284629 - DNA, 25 bp, Rattus norvegicus
gaaaatgttcccatcatcagtgaag

SEQ ID NO: 284630 - DNA, 25 bp, Rattus norvegicus
gaaaatgttcccttcatcagtgaag

SEQ ID NO: 284631 - DNA, 25 bp, Rattus norvegicus
gaaaatgttcgcaaactttgtggtt

SEQ ID NO: 284632 - DNA, 25 bp, Rattus norvegicus
gaaaatgttcgctaactttgtggtt

SEQ ID NO: 284633 - DNA, 25 bp, Rattus norvegicus
gaaaatgttcttaatctactctcaa

SEQ ID NO: 284634 - DNA, 25 bp, Rattus norvegicus
gaaaatgttctttatctactctcaa

SEQ ID NO: 284635 - DNA, 25 bp, Rattus norvegicus
gaaaatgttggaactccttgtcccg

SEQ ID NO: 284636 - DNA, 25 bp, Rattus norvegicus
gaaaatgttggatctccttgtcccg

SEQ ID NO: 284637 - DNA, 25 bp, Rattus norvegicus
gaaaatgttgtgactgatgcagctt

SEQ ID NO: 284638 - DNA, 25 bp, Rattus norvegicus
gaaaatgttgtgtctgatgcagctt

SEQ ID NO: 284639 - DNA, 25 bp, Rattus norvegicus
gaaaatgtttaacccaatggtgcct

SEQ ID NO: 284640 - DNA, 25 bp, Rattus norvegicus
gaaaatgtttaagccaatggtgcct

SEQ ID NO: 284641 - DNA, 25 bp, Rattus norvegicus
gaaaatgtttctaaagatgtcagtc

SEQ ID NO: 284642 - DNA, 25 bp, Rattus norvegicus
gaaaatgtttctccctgtttgctgc

SEQ ID NO: 284643 - DNA, 25 bp, Rattus norvegicus
gaaaatgtttctgcctgtttgctgc

SEQ ID NO: 284644 - DNA, 25 bp, Rattus norvegicus
gaaaatgtttcttaagatgtcagtc

SEQ ID NO: 284645 - DNA, 25 bp, Rattus norvegicus
gaaaatgtttgcaagcctctaactt

SEQ ID NO: 284646 - DNA, 25 bp, Rattus norvegicus
gaaaatgtttgctagcctctaactt

SEQ ID NO: 284647 - DNA, 25 bp, Rattus norvegicus
gaaaatgttttcatggtgtgacaca

SEQ ID NO: 284648 - DNA, 25 bp, Rattus norvegicus
gaaaatgttttcttggtgtgacaca

SEQ ID NO: 284649 - DNA, 25 bp, Rattus norvegicus
gaaaattaatatctcttgccttacc

SEQ ID NO: 284650 - DNA, 25 bp, Rattus norvegicus
gaaaattaatatgtcttgccttacc

SEQ ID NO: 284651 - DNA, 25 bp, Rattus norvegicus
gaaaattactgaatcatacagacaa

SEQ ID NO: 284652 - DNA, 25 bp, Rattus norvegicus
gaaaattactgattcatacagacaa

SEQ ID NO: 284653 - DNA, 25 bp, Rattus norvegicus
gaaaattatactagagtgtgactca

SEQ ID NO: 284654 - DNA, 25 bp, Rattus norvegicus
gaaaattatacttgagtgtgactca

SEQ ID NO: 284655 - DNA, 25 bp, Rattus norvegicus
gaaaattattatattggcgttcaga

SEQ ID NO: 284656 - DNA, 25 bp, Rattus norvegicus
gaaaattattattttggcgttcaga

SEQ ID NO: 284657 - DNA, 25 bp, Rattus norvegicus
gaaaattcacaactgtcttgtatga

SEQ ID NO: 284658 - DNA, 25 bp, Rattus norvegicus
gaaaattcacaagtgtcttgtatga

SEQ ID NO: 284659 - DNA, 25 bp, Rattus norvegicus
gaaaattcaccaccctacacaagag

SEQ ID NO: 284660 - DNA, 25 bp, Rattus norvegicus
gaaaattcaccagcctacacaagag

SEQ ID NO: 284661 - DNA, 25 bp, Rattus norvegicus
gaaaattcactacaggtctttggtt

SEQ ID NO: 284662 - DNA, 25 bp, Rattus norvegicus
gaaaattcactagaggtctttggtt

SEQ ID NO: 284663 - DNA, 25 bp, Rattus norvegicus
gaaaattcactgctgcctttgtgga

SEQ ID NO: 284664 - DNA, 25 bp, Rattus norvegicus
gaaaattcactggtgcctttgtgga

SEQ ID NO: 284665 - DNA, 25 bp, Rattus norvegicus
gaaaattcagcaacatccccacagt

SEQ ID NO: 284666 - DNA, 25 bp, Rattus norvegicus
gaaaattcagcatcatccccacagt

SEQ ID NO: 284667 - DNA, 25 bp, Rattus norvegicus
gaaaattccatgagatccttctcct

SEQ ID NO: 284668 - DNA, 25 bp, Rattus norvegicus
gaaaattccatgtgatccttctcct

SEQ ID NO: 284669 - DNA, 25 bp, Rattus norvegicus
gaaaattccattagaagctcacctt

SEQ ID NO: 284670 - DNA, 25 bp, Rattus norvegicus
gaaaattccatttgaagctcacctt

SEQ ID NO: 284671 - DNA, 25 bp, Rattus norvegicus
gaaaattcctccactatgaatggtt

SEQ ID NO: 284672 - DNA, 25 bp, Rattus norvegicus
gaaaattcctcctctatgaatggtt

SEQ ID NO: 284673 - DNA, 25 bp, Rattus norvegicus
gaaaattcctcgcagggcgctcttt

SEQ ID NO: 284674 - DNA, 25 bp, Rattus norvegicus
gaaaattcctcggagggcgctcttt

SEQ ID NO: 284675 - DNA, 25 bp, Rattus norvegicus
gaaaattcctgtacacgtgtgagac

SEQ ID NO: 284676 - DNA, 25 bp, Rattus norvegicus
gaaaattcctgttcacgtgtgagac

SEQ ID NO: 284677 - DNA, 25 bp, Rattus norvegicus
gaaaattctcctagcacagttttgt

SEQ ID NO: 284678 - DNA, 25 bp, Rattus norvegicus
gaaaattctccttgcacagttttgt

SEQ ID NO: 284679 - DNA, 25 bp, Rattus norvegicus
gaaaattctgacacctgtttttgtt

SEQ ID NO: 284680 - DNA, 25 bp, Rattus norvegicus
gaaaattctgactcctgtttttgtt

SEQ ID NO: 284681 - DNA, 25 bp, Rattus norvegicus
gaaaattctggtccctatgtcttta

SEQ ID NO: 284682 - DNA, 25 bp, Rattus norvegicus
gaaaattctggtctcaaggccaatg

SEQ ID NO: 284683 - DNA, 25 bp, Rattus norvegicus
gaaaattctggtgcctatgtcttta

SEQ ID NO: 284684 - DNA, 25 bp, Rattus norvegicus
gaaaattctggtgtcaaggccaatg

SEQ ID NO: 284685 - DNA, 25 bp, Rattus norvegicus
gaaaattctgtcctgtgtaggcagt

SEQ ID NO: 284686 - DNA, 25 bp, Rattus norvegicus
gaaaattctgtcgtgtgtaggcagt

SEQ ID NO: 284687 - DNA, 25 bp, Rattus norvegicus
gaaaattcttgcattgtagtaccca

SEQ ID NO: 284688 - DNA, 25 bp, Rattus norvegicus
gaaaattcttgctttgtagtaccca

SEQ ID NO: 284689 - DNA, 25 bp, Rattus norvegicus
gaaaattctttcacctggacatgat

SEQ ID NO: 284690 - DNA, 25 bp, Rattus norvegicus
gaaaattctttcaccttggatgctg

SEQ ID NO: 284691 - DNA, 25 bp, Rattus norvegicus
gaaaattctttctcctggacatgat

SEQ ID NO: 284692 - DNA, 25 bp, Rattus norvegicus
gaaaattctttctccttggatgctg

SEQ ID NO: 284693 - DNA, 25 bp, Rattus norvegicus
gaaaattgaaatatggacatgactt

SEQ ID NO: 284694 - DNA, 25 bp, Rattus norvegicus
gaaaattgaaatttggacatgactt

SEQ ID NO: 284695 - DNA, 25 bp, Rattus norvegicus
gaaaattgcttaaccacttacaaat

SEQ ID NO: 284696 - DNA, 25 bp, Rattus norvegicus
gaaaattgcttatccacttacaaat

SEQ ID NO: 284697 - DNA, 25 bp, Rattus norvegicus
gaaaattgctttcatcgcgcatgac

SEQ ID NO: 284698 - DNA, 25 bp, Rattus norvegicus
gaaaattgctttgatcgcgcatgac

SEQ ID NO: 284699 - DNA, 25 bp, Rattus norvegicus
gaaaattgtatgctccttcgtatga

SEQ ID NO: 284700 - DNA, 25 bp, Rattus norvegicus
gaaaattgtatggtccttcgtatga

SEQ ID NO: 284701 - DNA, 25 bp, Rattus norvegicus
gaaaattgtcttccgtgcaactctg

SEQ ID NO: 284702 - DNA, 25 bp, Rattus norvegicus
gaaaattgtcttgcgtgcaactctg

SEQ ID NO: 284703 - DNA, 25 bp, Rattus norvegicus
gaaaattgttaacagttccgcctat

SEQ ID NO: 284704 - DNA, 25 bp, Rattus norvegicus
gaaaattgttaagagttccgcctat

SEQ ID NO: 284705 - DNA, 25 bp, Rattus norvegicus
gaaaattgttgcacagtgtccccat

SEQ ID NO: 284706 - DNA, 25 bp, Rattus norvegicus
gaaaattgttgctcagtgtccccat

SEQ ID NO: 284707 - DNA, 25 bp, Rattus norvegicus
gaaaatttatcaaacttctttattt

SEQ ID NO: 284708 - DNA, 25 bp, Rattus norvegicus
gaaaatttatcatacttctttattt

SEQ ID NO: 284709 - DNA, 25 bp, Rattus norvegicus
gaaaatttatctcccatgtcgtggg

SEQ ID NO: 284710 - DNA, 25 bp, Rattus norvegicus
gaaaatttatctgccatgtcgtggg

SEQ ID NO: 284711 - DNA, 25 bp, Rattus norvegicus
gaaaatttcacacctgtcagtcaca

SEQ ID NO: 284712 - DNA, 25 bp, Rattus norvegicus
gaaaatttcacagctgtcagtcaca

SEQ ID NO: 284713 - DNA, 25 bp, Rattus norvegicus
gaaaatttccatatatccctgttat

SEQ ID NO: 284714 - DNA, 25 bp, Rattus norvegicus
gaaaatttccatttatccctgttat

SEQ ID NO: 284715 - DNA, 25 bp, Rattus norvegicus
gaaaatttcctgacctgtgttatta

SEQ ID NO: 284716 - DNA, 25 bp, Rattus norvegicus
gaaaatttcctgtcctgtgttatta

SEQ ID NO: 284717 - DNA, 25 bp, Rattus norvegicus
gaaaatttcgttctacttcgatgca

SEQ ID NO: 284718 - DNA, 25 bp, Rattus norvegicus
gaaaatttcgttgtacttcgatgca

SEQ ID NO: 284719 - DNA, 25 bp, Rattus norvegicus
gaaaatttgacccagctagagagag

SEQ ID NO: 284720 - DNA, 25 bp, Rattus norvegicus
gaaaatttgaccgagctagagagag

SEQ ID NO: 284721 - DNA, 25 bp, Rattus norvegicus
gaaaatttgatgaactgagtccttt

SEQ ID NO: 284722 - DNA, 25 bp, Rattus norvegicus
gaaaatttgatgtactgagtccttt

SEQ ID NO: 284723 - DNA, 25 bp, Rattus norvegicus
gaaaatttgattaactggccccgct

SEQ ID NO: 284724 - DNA, 25 bp, Rattus norvegicus
gaaaatttgatttactggccccgct

SEQ ID NO: 284725 - DNA, 25 bp, Rattus norvegicus
gaaaatttgcgactgtctgcaacaa

SEQ ID NO: 284726 - DNA, 25 bp, Rattus norvegicus
gaaaatttgcgagtgtctgcaacaa

SEQ ID NO: 284727 - DNA, 25 bp, Rattus norvegicus
gaaaatttggctactcgggttggag

SEQ ID NO: 284728 - DNA, 25 bp, Rattus norvegicus
gaaaatttggcttctcgggttggag

SEQ ID NO: 284729 - DNA, 25 bp, Rattus norvegicus
gaaaattttcagatgggccgggcat

SEQ ID NO: 284730 - DNA, 25 bp, Rattus norvegicus
gaaaattttcagttgggccgggcat

SEQ ID NO: 284731 - DNA, 25 bp, Rattus norvegicus
gaaaattttctgactgtccttaaga

SEQ ID NO: 284732 - DNA, 25 bp, Rattus norvegicus
gaaaattttctgtctgtccttaaga

SEQ ID NO: 284733 - DNA, 25 bp, Rattus norvegicus
gaaacaaaacagcagcgatcacgag

SEQ ID NO: 284734 - DNA, 25 bp, Rattus norvegicus
gaaacaaaacaggagcgatcacgag

SEQ ID NO: 284735 - DNA, 25 bp, Rattus norvegicus
gaaacaaactagacgcatggctgca

SEQ ID NO: 284736 - DNA, 25 bp, Rattus norvegicus
gaaacaaactagtcgcatggctgca

SEQ ID NO: 284737 - DNA, 25 bp, Rattus norvegicus
gaaacaaacttcaactcctggattt

SEQ ID NO: 284738 - DNA, 25 bp, Rattus norvegicus
gaaacaaacttctactcctggattt

SEQ ID NO: 284739 - DNA, 25 bp, Rattus norvegicus
gaaacaaagggaactggagcgacag

SEQ ID NO: 284740 - DNA, 25 bp, Rattus norvegicus
gaaacaaagggatctggagcgacag

SEQ ID NO: 284741 - DNA, 25 bp, Rattus norvegicus
gaaacaaagtaaacaggccccagct

SEQ ID NO: 284742 - DNA, 25 bp, Rattus norvegicus
gaaacaaagtaatcaggccccagct

SEQ ID NO: 284743 - DNA, 25 bp, Rattus norvegicus
gaaacaaatcgacctggactcctga

SEQ ID NO: 284744 - DNA, 25 bp, Rattus norvegicus
gaaacaaatcgagctggactcctga

SEQ ID NO: 284745 - DNA, 25 bp, Rattus norvegicus
gaaacaaatgacctattggctagag

SEQ ID NO: 284746 - DNA, 25 bp, Rattus norvegicus
gaaacaaatgacgtattggctagag

SEQ ID NO: 284747 - DNA, 25 bp, Rattus norvegicus
gaaacaaatgccatggataaaccat

SEQ ID NO: 284748 - DNA, 25 bp, Rattus norvegicus
gaaacaaatgccttggataaaccat

SEQ ID NO: 284749 - DNA, 25 bp, Rattus norvegicus
gaaacaaatgtcctaccttgctggt

SEQ ID NO: 284750 - DNA, 25 bp, Rattus norvegicus
gaaacaaatgtcgtaccttgctggt

SEQ ID NO: 284751 - DNA, 25 bp, Rattus norvegicus
gaaacaaattctacatgaacacatt

SEQ ID NO: 284752 - DNA, 25 bp, Rattus norvegicus
gaaacaaattcttcatgaacacatt

SEQ ID NO: 284753 - DNA, 25 bp, Rattus norvegicus
gaaacaacactgacatcgatgagct

SEQ ID NO: 284754 - DNA, 25 bp, Rattus norvegicus
gaaacaacactgtcatcgatgagct

SEQ ID NO: 284755 - DNA, 25 bp, Rattus norvegicus
gaaacaacacttcctgactgaccac

SEQ ID NO: 284756 - DNA, 25 bp, Rattus norvegicus
gaaacaacacttgctgactgaccac

SEQ ID NO: 284757 - DNA, 25 bp, Rattus norvegicus
gaaacaacaggtatttcttctctct

SEQ ID NO: 284758 - DNA, 25 bp, Rattus norvegicus
gaaacaacaggtttttcttctctct

SEQ ID NO: 284759 - DNA, 25 bp, Rattus norvegicus
gaaacaacagttatctgagtcaggt

SEQ ID NO: 284760 - DNA, 25 bp, Rattus norvegicus
gaaacaacagttatcttcagatgtt

SEQ ID NO: 284761 - DNA, 25 bp, Rattus norvegicus
gaaacaacagttttctgagtcaggt

SEQ ID NO: 284762 - DNA, 25 bp, Rattus norvegicus
gaaacaacagttttcttcagatgtt

SEQ ID NO: 284763 - DNA, 25 bp, Rattus norvegicus
gaaacaacatgcagctgaactccat

SEQ ID NO: 284764 - DNA, 25 bp, Rattus norvegicus
gaaacaacatgctgctgaactccat

SEQ ID NO: 284765 - DNA, 25 bp, Rattus norvegicus
gaaacaaccagcattcagaggtcaa

SEQ ID NO: 284766 - DNA, 25 bp, Rattus norvegicus
gaaacaaccagctttcagaggtcaa

SEQ ID NO: 284767 - DNA, 25 bp, Rattus norvegicus
gaaacaacccacaaggcatggcatc

SEQ ID NO: 284768 - DNA, 25 bp, Rattus norvegicus
gaaacaacccactaggcatggcatc

SEQ ID NO: 284769 - DNA, 25 bp, Rattus norvegicus
gaaacaacctctcagcaaaggctga

SEQ ID NO: 284770 - DNA, 25 bp, Rattus norvegicus
gaaacaacctctgagcaaaggctga

SEQ ID NO: 284771 - DNA, 25 bp, Rattus norvegicus
gaaacaacgcgaaacttcactctct

SEQ ID NO: 284772 - DNA, 25 bp, Rattus norvegicus
gaaacaacgcgatacttcactctct

SEQ ID NO: 284773 - DNA, 25 bp, Rattus norvegicus
gaaacaactcagagctaatttcaga

SEQ ID NO: 284774 - DNA, 25 bp, Rattus norvegicus
gaaacaactcagtgctaatttcaga

SEQ ID NO: 284775 - DNA, 25 bp, Rattus norvegicus
gaaacaacttcgctggagactacag

SEQ ID NO: 284776 - DNA, 25 bp, Rattus norvegicus
gaaacaacttcggtggagactacag

SEQ ID NO: 284777 - DNA, 25 bp, Rattus norvegicus
gaaacaacttgacatcctccacctg

SEQ ID NO: 284778 - DNA, 25 bp, Rattus norvegicus
gaaacaacttgagatcctccacctg

SEQ ID NO: 284779 - DNA, 25 bp, Rattus norvegicus
gaaacaactttgaacacgacatgtg

SEQ ID NO: 284780 - DNA, 25 bp, Rattus norvegicus
gaaacaactttgtacacgacatgtg

SEQ ID NO: 284781 - DNA, 25 bp, Rattus norvegicus
gaaacaagaagactcacccgtgctt

SEQ ID NO: 284782 - DNA, 25 bp, Rattus norvegicus
gaaacaagaagagtcacccgtgctt

SEQ ID NO: 284783 - DNA, 25 bp, Rattus norvegicus
gaaacaagagcgaagttcactggag

SEQ ID NO: 284784 - DNA, 25 bp, Rattus norvegicus
gaaacaagagcgtagttcactggag

SEQ ID NO: 284785 - DNA, 25 bp, Rattus norvegicus
gaaacaagcattatacacacatggc

SEQ ID NO: 284786 - DNA, 25 bp, Rattus norvegicus
gaaacaagcattttacacacatggc

SEQ ID NO: 284787 - DNA, 25 bp, Rattus norvegicus
gaaacaagcgatcctgtcagagaca

SEQ ID NO: 284788 - DNA, 25 bp, Rattus norvegicus
gaaacaagcgatgctgtcagagaca

SEQ ID NO: 284789 - DNA, 25 bp, Rattus norvegicus
gaaacaagctgccatgcctgctata

SEQ ID NO: 284790 - DNA, 25 bp, Rattus norvegicus
gaaacaagctgcgatgcctgctata

SEQ ID NO: 284791 - DNA, 25 bp, Rattus norvegicus
gaaacaagcttgaggattccctaga

SEQ ID NO: 284792 - DNA, 25 bp, Rattus norvegicus
gaaacaagcttgtggattccctaga

SEQ ID NO: 284793 - DNA, 25 bp, Rattus norvegicus
gaaacaagctttcaaccctgaagga

SEQ ID NO: 284794 - DNA, 25 bp, Rattus norvegicus
gaaacaagctttgaaccctgaagga

SEQ ID NO: 284795 - DNA, 25 bp, Rattus norvegicus
gaaacaaggattatcccacacctcg

SEQ ID NO: 284796 - DNA, 25 bp, Rattus norvegicus
gaaacaaggattttcccacacctcg

SEQ ID NO: 284797 - DNA, 25 bp, Rattus norvegicus
gaaacaaggctgacaactgccactt

SEQ ID NO: 284798 - DNA, 25 bp, Rattus norvegicus
gaaacaaggctgtcaactgccactt

SEQ ID NO: 284799 - DNA, 25 bp, Rattus norvegicus
gaaacaagtcagctggaggtcccct

SEQ ID NO: 284800 - DNA, 25 bp, Rattus norvegicus
gaaacaagtcaggtggaggtcccct

SEQ ID NO: 284801 - DNA, 25 bp, Rattus norvegicus
gaaacaagtccaatggccaaggatt

SEQ ID NO: 284802 - DNA, 25 bp, Rattus norvegicus
gaaacaagtccattggccaaggatt

SEQ ID NO: 284803 - DNA, 25 bp, Rattus norvegicus
gaaacaagttttcctagtcacagta

SEQ ID NO: 284804 - DNA, 25 bp, Rattus norvegicus
gaaacaagttttgctagtcacagta

SEQ ID NO: 284805 - DNA, 25 bp, Rattus norvegicus
gaaacaatactaatcatgcctacta

SEQ ID NO: 284806 - DNA, 25 bp, Rattus norvegicus
gaaacaatactattcatgcctacta

SEQ ID NO: 284807 - DNA, 25 bp, Rattus norvegicus
gaaacaatactgaccatgccttgga

SEQ ID NO: 284808 - DNA, 25 bp, Rattus norvegicus
gaaacaatactgtccatgccttgga

SEQ ID NO: 284809 - DNA, 25 bp, Rattus norvegicus
gaaacaatagacactgcctcggtaa

SEQ ID NO: 284810 - DNA, 25 bp, Rattus norvegicus
gaaacaatagactctgcctcggtaa

SEQ ID NO: 284811 - DNA, 25 bp, Rattus norvegicus
gaaacaatatcgcttgttgtcactt

SEQ ID NO: 284812 - DNA, 25 bp, Rattus norvegicus
gaaacaatatcggttgttgtcactt

SEQ ID NO: 284813 - DNA, 25 bp, Rattus norvegicus
gaaacaatcagcctggcactgccag

SEQ ID NO: 284814 - DNA, 25 bp, Rattus norvegicus
gaaacaatcagcgtggcactgccag

SEQ ID NO: 284815 - DNA, 25 bp, Rattus norvegicus
gaaacaatccagaaaggccccacgg

SEQ ID NO: 284816 - DNA, 25 bp, Rattus norvegicus
gaaacaatccagtaaggccccacgg

SEQ ID NO: 284817 - DNA, 25 bp, Rattus norvegicus
gaaacaatcccaagttgccttccat

SEQ ID NO: 284818 - DNA, 25 bp, Rattus norvegicus
gaaacaatcccatgttgccttccat

SEQ ID NO: 284819 - DNA, 25 bp, Rattus norvegicus
gaaacaatcttaagtctcctcctct

SEQ ID NO: 284820 - DNA, 25 bp, Rattus norvegicus
gaaacaatcttatgtctcctcctct

SEQ ID NO: 284821 - DNA, 25 bp, Rattus norvegicus
gaaacaatcttgagctggttcagcc

SEQ ID NO: 284822 - DNA, 25 bp, Rattus norvegicus
gaaacaatcttgtgctggttcagcc

SEQ ID NO: 284823 - DNA, 25 bp, Rattus norvegicus
gaaacaatgaccagttcttctgggt

SEQ ID NO: 284824 - DNA, 25 bp, Rattus norvegicus
gaaacaatgacctgttcttctgggt

SEQ ID NO: 284825 - DNA, 25 bp, Rattus norvegicus
gaaacaatgagcaccaaactggact

SEQ ID NO: 284826 - DNA, 25 bp, Rattus norvegicus
gaaacaatgagctccaaactggact

SEQ ID NO: 284827 - DNA, 25 bp, Rattus norvegicus
gaaacaatgaggagaccccgcccgg

SEQ ID NO: 284828 - DNA, 25 bp, Rattus norvegicus
gaaacaatgaggtgaccccgcccgg

SEQ ID NO: 284829 - DNA, 25 bp, Rattus norvegicus
gaaacaatgcccaggcatcccagtg

SEQ ID NO: 284830 - DNA, 25 bp, Rattus norvegicus
gaaacaatgccctggcatcccagtg

SEQ ID NO: 284831 - DNA, 25 bp, Rattus norvegicus
gaaacaatggacacctcctgagctg

SEQ ID NO: 284832 - DNA, 25 bp, Rattus norvegicus
gaaacaatggactcctcctgagctg

SEQ ID NO: 284833 - DNA, 25 bp, Rattus norvegicus
gaaacaatggctcctgactcaaaat

SEQ ID NO: 284834 - DNA, 25 bp, Rattus norvegicus
gaaacaatggctgctgactcaaaat

SEQ ID NO: 284835 - DNA, 25 bp, Rattus norvegicus
gaaacaatgttccaggtagctttaa

SEQ ID NO: 284836 - DNA, 25 bp, Rattus norvegicus
gaaacaatgttcgaggtagctttaa

SEQ ID NO: 284837 - DNA, 25 bp, Rattus norvegicus
gaaacacaacaacgctaagctccag

SEQ ID NO: 284838 - DNA, 25 bp, Rattus norvegicus
gaaacacaacaaggctaagctccag

SEQ ID NO: 284839 - DNA, 25 bp, Rattus norvegicus
gaaacacaacacagaccatctctaa

SEQ ID NO: 284840 - DNA, 25 bp, Rattus norvegicus
gaaacacaacactgaccatctctaa

SEQ ID NO: 284841 - DNA, 25 bp, Rattus norvegicus
gaaacacaaccaaactccaggccag

SEQ ID NO: 284842 - DNA, 25 bp, Rattus norvegicus
gaaacacaaccatactccaggccag

SEQ ID NO: 284843 - DNA, 25 bp, Rattus norvegicus
gaaacacaatcacaggagcacgcgt

SEQ ID NO: 284844 - DNA, 25 bp, Rattus norvegicus
gaaacacaatcagaggagcacgcgt

SEQ ID NO: 284845 - DNA, 25 bp, Rattus norvegicus
gaaacacaatgcaagacctgaccag

SEQ ID NO: 284846 - DNA, 25 bp, Rattus norvegicus
gaaacacaatgctagacctgaccag

SEQ ID NO: 284847 - DNA, 25 bp, Rattus norvegicus
gaaacacacagcctggagcagtcca

SEQ ID NO: 284848 - DNA, 25 bp, Rattus norvegicus
gaaacacacagcgtggagcagtcca

SEQ ID NO: 284849 - DNA, 25 bp, Rattus norvegicus
gaaacacacaggagcaaagcccttt

SEQ ID NO: 284850 - DNA, 25 bp, Rattus norvegicus
gaaacacacaggtgcaaagcccttt

SEQ ID NO: 284851 - DNA, 25 bp, Rattus norvegicus
gaaacacacagtacagtaaatggtt

SEQ ID NO: 284852 - DNA, 25 bp, Rattus norvegicus
gaaacacacagttcagtaaatggtt

SEQ ID NO: 284853 - DNA, 25 bp, Rattus norvegicus
gaaacacaccttcaggtttcctgct

SEQ ID NO: 284854 - DNA, 25 bp, Rattus norvegicus
gaaacacaccttccatgcaatgaat

SEQ ID NO: 284855 - DNA, 25 bp, Rattus norvegicus
gaaacacaccttgaggtttcctgct

SEQ ID NO: 284856 - DNA, 25 bp, Rattus norvegicus
gaaacacaccttgcatgcaatgaat

SEQ ID NO: 284857 - DNA, 25 bp, Rattus norvegicus
gaaacacacttactagcttctcctc

SEQ ID NO: 284858 - DNA, 25 bp, Rattus norvegicus
gaaacacacttagtagcttctcctc

SEQ ID NO: 284859 - DNA, 25 bp, Rattus norvegicus
gaaacacactttcatccacacaggt

SEQ ID NO: 284860 - DNA, 25 bp, Rattus norvegicus
gaaacacactttgatccacacaggt

SEQ ID NO: 284861 - DNA, 25 bp, Rattus norvegicus
gaaacacagattctttatacacttt

SEQ ID NO: 284862 - DNA, 25 bp, Rattus norvegicus
gaaacacagattgtttatacacttt

SEQ ID NO: 284863 - DNA, 25 bp, Rattus norvegicus
gaaacacagcagcatgccgttcatt

SEQ ID NO: 284864 - DNA, 25 bp, Rattus norvegicus
gaaacacagcaggatgccgttcatt

SEQ ID NO: 284865 - DNA, 25 bp, Rattus norvegicus
gaaacacagccaagctcagcagcat

SEQ ID NO: 284866 - DNA, 25 bp, Rattus norvegicus
gaaacacagccatgctcagcagcat

SEQ ID NO: 284867 - DNA, 25 bp, Rattus norvegicus
gaaacacagccgcactggtgattgc

SEQ ID NO: 284868 - DNA, 25 bp, Rattus norvegicus
gaaacacagccggactggtgattgc

SEQ ID NO: 284869 - DNA, 25 bp, Rattus norvegicus
gaaacacagctgactaggctctgga

SEQ ID NO: 284870 - DNA, 25 bp, Rattus norvegicus
gaaacacagctgtctaggctctgga

SEQ ID NO: 284871 - DNA, 25 bp, Rattus norvegicus
gaaacacaggtgcaaaagtaggagt

SEQ ID NO: 284872 - DNA, 25 bp, Rattus norvegicus
gaaacacaggtggaaaagtaggagt

SEQ ID NO: 284873 - DNA, 25 bp, Rattus norvegicus
gaaacacagtagagcttcagccaga

SEQ ID NO: 284874 - DNA, 25 bp, Rattus norvegicus
gaaacacagtagtgcttcagccaga

SEQ ID NO: 284875 - DNA, 25 bp, Rattus norvegicus
gaaacacagtgtacccaggcacagg

SEQ ID NO: 284876 - DNA, 25 bp, Rattus norvegicus
gaaacacagtgttcccaggcacagg

SEQ ID NO: 284877 - DNA, 25 bp, Rattus norvegicus
gaaacacagtttatgaatgccacag

SEQ ID NO: 284878 - DNA, 25 bp, Rattus norvegicus
gaaacacagtttttgaatgccacag

SEQ ID NO: 284879 - DNA, 25 bp, Rattus norvegicus
gaaacacatacacacttcagtctgt

SEQ ID NO: 284880 - DNA, 25 bp, Rattus norvegicus
gaaacacatacagacttcagtctgt

SEQ ID NO: 284881 - DNA, 25 bp, Rattus norvegicus
gaaacacatccccagtgtgcattta

SEQ ID NO: 284882 - DNA, 25 bp, Rattus norvegicus
gaaacacatcccgagtgtgcattta

SEQ ID NO: 284883 - DNA, 25 bp, Rattus norvegicus
gaaacacatcttctctgttctttag

SEQ ID NO: 284884 - DNA, 25 bp, Rattus norvegicus
gaaacacatcttgtctgttctttag

SEQ ID NO: 284885 - DNA, 25 bp, Rattus norvegicus
gaaacacatggaatattcatcactt

SEQ ID NO: 284886 - DNA, 25 bp, Rattus norvegicus
gaaacacatggattattcatcactt

SEQ ID NO: 284887 - DNA, 25 bp, Rattus norvegicus
gaaacacattctcactggatgctcc

SEQ ID NO: 284888 - DNA, 25 bp, Rattus norvegicus
gaaacacattctgactggatgctcc

SEQ ID NO: 284889 - DNA, 25 bp, Rattus norvegicus
gaaacacattggcatttcccacaaa

SEQ ID NO: 284890 - DNA, 25 bp, Rattus norvegicus
gaaacacattgggatttcccacaaa

SEQ ID NO: 284891 - DNA, 25 bp, Rattus norvegicus
gaaacacatttcatatacctacaaa

SEQ ID NO: 284892 - DNA, 25 bp, Rattus norvegicus
gaaacacatttcttatacctacaaa

SEQ ID NO: 284893 - DNA, 25 bp, Rattus norvegicus
gaaacaccaactacgcaagtgcttt

SEQ ID NO: 284894 - DNA, 25 bp, Rattus norvegicus
gaaacaccaacttcgcaagtgcttt

SEQ ID NO: 284895 - DNA, 25 bp, Rattus norvegicus
gaaacaccaagtcagcacttctcaa

SEQ ID NO: 284896 - DNA, 25 bp, Rattus norvegicus
gaaacaccaagtgagcacttctcaa

SEQ ID NO: 284897 - DNA, 25 bp, Rattus norvegicus
gaaacaccacatcatgaaccactct

SEQ ID NO: 284898 - DNA, 25 bp, Rattus norvegicus
gaaacaccacatgatgaaccactct

SEQ ID NO: 284899 - DNA, 25 bp, Rattus norvegicus
gaaacaccaccaagaaacctgatat

SEQ ID NO: 284900 - DNA, 25 bp, Rattus norvegicus
gaaacaccaccacaccaataggttt

SEQ ID NO: 284901 - DNA, 25 bp, Rattus norvegicus
gaaacaccaccagaccaataggttt

SEQ ID NO: 284902 - DNA, 25 bp, Rattus norvegicus
gaaacaccaccatgaaacctgatat

SEQ ID NO: 284903 - DNA, 25 bp, Rattus norvegicus
gaaacaccagcactctgcatggctt

SEQ ID NO: 284904 - DNA, 25 bp, Rattus norvegicus
gaaacaccagcagtctgcatggctt

SEQ ID NO: 284905 - DNA, 25 bp, Rattus norvegicus
gaaacaccagtaacagcagcgtcgc

SEQ ID NO: 284906 - DNA, 25 bp, Rattus norvegicus
gaaacaccagtatcagcagcgtcgc

SEQ ID NO: 284907 - DNA, 25 bp, Rattus norvegicus
gaaacaccatcaccttgacaaactt

SEQ ID NO: 284908 - DNA, 25 bp, Rattus norvegicus
gaaacaccatcagcttgacaaactt

SEQ ID NO: 284909 - DNA, 25 bp, Rattus norvegicus
gaaacaccatttccatcttgtgcat

SEQ ID NO: 284910 - DNA, 25 bp, Rattus norvegicus
gaaacaccatttgcatcttgtgcat

SEQ ID NO: 284911 - DNA, 25 bp, Rattus norvegicus
gaaacacccaacagacttgagagca

SEQ ID NO: 284912 - DNA, 25 bp, Rattus norvegicus
gaaacacccaactgacttgagagca

SEQ ID NO: 284913 - DNA, 25 bp, Rattus norvegicus
gaaacaccccaaatttagcacatga

SEQ ID NO: 284914 - DNA, 25 bp, Rattus norvegicus
gaaacaccccaattttagcacatga

SEQ ID NO: 284915 - DNA, 25 bp, Rattus norvegicus
gaaacaccccgacggagtccgagat

SEQ ID NO: 284916 - DNA, 25 bp, Rattus norvegicus
gaaacaccccgagggagtccgagat

SEQ ID NO: 284917 - DNA, 25 bp, Rattus norvegicus
gaaacaccctttagccttccaacag

SEQ ID NO: 284918 - DNA, 25 bp, Rattus norvegicus
gaaacacccttttgccttccaacag

SEQ ID NO: 284919 - DNA, 25 bp, Rattus norvegicus
gaaacaccgcctccttaggaaagac

SEQ ID NO: 284920 - DNA, 25 bp, Rattus norvegicus
gaaacaccgcctgcttaggaaagac

SEQ ID NO: 284921 - DNA, 25 bp, Rattus norvegicus
gaaacaccgtgtccatcaagaatcc

SEQ ID NO: 284922 - DNA, 25 bp, Rattus norvegicus
gaaacaccgtgtgcatcaagaatcc

SEQ ID NO: 284923 - DNA, 25 bp, Rattus norvegicus
gaaacacctagacatcaaccctgac

SEQ ID NO: 284924 - DNA, 25 bp, Rattus norvegicus
gaaacacctagagatcaaccctgac

SEQ ID NO: 284925 - DNA, 25 bp, Rattus norvegicus
gaaacacctcccagttgccatgtgg

SEQ ID NO: 284926 - DNA, 25 bp, Rattus norvegicus
gaaacacctccctgttgccatgtgg

SEQ ID NO: 284927 - DNA, 25 bp, Rattus norvegicus
gaaacacctcggacagtgtcaactg

SEQ ID NO: 284928 - DNA, 25 bp, Rattus norvegicus
gaaacacctcggtcagtgtcaactg

SEQ ID NO: 284929 - DNA, 25 bp, Rattus norvegicus
gaaacacctctccagaggcagactg

SEQ ID NO: 284930 - DNA, 25 bp, Rattus norvegicus
gaaacacctctcgagaggcagactg

SEQ ID NO: 284931 - DNA, 25 bp, Rattus norvegicus
gaaacacctgagctaatttggagag

SEQ ID NO: 284932 - DNA, 25 bp, Rattus norvegicus
gaaacacctgaggtaatttggagag

SEQ ID NO: 284933 - DNA, 25 bp, Rattus norvegicus
gaaacacctgcaccaatctaagaaa

SEQ ID NO: 284934 - DNA, 25 bp, Rattus norvegicus
gaaacacctgcagcaatctaagaaa

SEQ ID NO: 284935 - DNA, 25 bp, Rattus norvegicus
gaaacacctgtcaacgaagctgaag

SEQ ID NO: 284936 - DNA, 25 bp, Rattus norvegicus
gaaacacctgtctacgaagctgaag

SEQ ID NO: 284937 - DNA, 25 bp, Rattus norvegicus
gaaacacctgttaaccagtcagagc

SEQ ID NO: 284938 - DNA, 25 bp, Rattus norvegicus
gaaacacctgtttaccagtcagagc

SEQ ID NO: 284939 - DNA, 25 bp, Rattus norvegicus
gaaacaccttccatggagaggcgga

SEQ ID NO: 284940 - DNA, 25 bp, Rattus norvegicus
gaaacaccttccttggagaggcgga

SEQ ID NO: 284941 - DNA, 25 bp, Rattus norvegicus
gaaacacctttgatggccacgttaa

SEQ ID NO: 284942 - DNA, 25 bp, Rattus norvegicus
gaaacacctttgttggccacgttaa

SEQ ID NO: 284943 - DNA, 25 bp, Rattus norvegicus
gaaacacgacagagacaaactcagt

SEQ ID NO: 284944 - DNA, 25 bp, Rattus norvegicus
gaaacacgacagtgacaaactcagt

SEQ ID NO: 284945 - DNA, 25 bp, Rattus norvegicus
gaaacacgagttattcactgggtat

SEQ ID NO: 284946 - DNA, 25 bp, Rattus norvegicus
gaaacacgagtttttcactgggtat

SEQ ID NO: 284947 - DNA, 25 bp, Rattus norvegicus
gaaacacgcactacgtgtctaaagt

SEQ ID NO: 284948 - DNA, 25 bp, Rattus norvegicus
gaaacacgcacttcgtgtctaaagt

SEQ ID NO: 284949 - DNA, 25 bp, Rattus norvegicus
gaaacacgcccacgaggaggactca

SEQ ID NO: 284950 - DNA, 25 bp, Rattus norvegicus
gaaacacgcccaggaggaggactca

SEQ ID NO: 284951 - DNA, 25 bp, Rattus norvegicus
gaaacacgcgccactttgtatgcac

SEQ ID NO: 284952 - DNA, 25 bp, Rattus norvegicus
gaaacacgcgcctctttgtatgcac

SEQ ID NO: 284953 - DNA, 25 bp, Rattus norvegicus
gaaacacggactcgtgcactttgaa

SEQ ID NO: 284954 - DNA, 25 bp, Rattus norvegicus
gaaacacggactggtgcactttgaa

SEQ ID NO: 284955 - DNA, 25 bp, Rattus norvegicus
gaaacacggcccacggatgacccta

SEQ ID NO: 284956 - DNA, 25 bp, Rattus norvegicus
gaaacacggccctcggatgacccta

SEQ ID NO: 284957 - DNA, 25 bp, Rattus norvegicus
gaaacacggtgcaggttactttgat

SEQ ID NO: 284958 - DNA, 25 bp, Rattus norvegicus
gaaacacggtgctggttactttgat

SEQ ID NO: 284959 - DNA, 25 bp, Rattus norvegicus
gaaacacgtagtcgcggttgtgaaa

SEQ ID NO: 284960 - DNA, 25 bp, Rattus norvegicus
gaaacacgtagtggcggttgtgaaa

SEQ ID NO: 284961 - DNA, 25 bp, Rattus norvegicus
gaaacacgtcccagtttccgtctcg

SEQ ID NO: 284962 - DNA, 25 bp, Rattus norvegicus
gaaacacgtccctgtttccgtctcg

SEQ ID NO: 284963 - DNA, 25 bp, Rattus norvegicus
gaaacacgtggtctagcttctggtt

SEQ ID NO: 284964 - DNA, 25 bp, Rattus norvegicus
gaaacacgtggtgtagcttctggtt

SEQ ID NO: 284965 - DNA, 25 bp, Rattus norvegicus
gaaacactagccacaacgctggttt

SEQ ID NO: 284966 - DNA, 25 bp, Rattus norvegicus
gaaacactagcctcaacgctggttt

SEQ ID NO: 284967 - DNA, 25 bp, Rattus norvegicus
gaaacactcaatcagacggacaaaa

SEQ ID NO: 284968 - DNA, 25 bp, Rattus norvegicus
gaaacactcaatgagacggacaaaa

SEQ ID NO: 284969 - DNA, 25 bp, Rattus norvegicus
gaaacactccctatacaatctcagt

SEQ ID NO: 284970 - DNA, 25 bp, Rattus norvegicus
gaaacactccctttacaatctcagt

SEQ ID NO: 284971 - DNA, 25 bp, Rattus norvegicus
gaaacactcctactactctacactt

SEQ ID NO: 284972 - DNA, 25 bp, Rattus norvegicus
gaaacactcctagtactctacactt

SEQ ID NO: 284973 - DNA, 25 bp, Rattus norvegicus
gaaacactcggactgctgttgtaaa

SEQ ID NO: 284974 - DNA, 25 bp, Rattus norvegicus
gaaacactcggagtgctgttgtaaa

SEQ ID NO: 284975 - DNA, 25 bp, Rattus norvegicus
gaaacactcttaaaagctggacatg

SEQ ID NO: 284976 - DNA, 25 bp, Rattus norvegicus
gaaacactcttataagctggacatg

SEQ ID NO: 284977 - DNA, 25 bp, Rattus norvegicus
gaaacactgaataggattcttccag

SEQ ID NO: 284978 - DNA, 25 bp, Rattus norvegicus
gaaacactgaattggattcttccag

SEQ ID NO: 284979 - DNA, 25 bp, Rattus norvegicus
gaaacactgagcaaggcatggacct

SEQ ID NO: 284980 - DNA, 25 bp, Rattus norvegicus
gaaacactgagcatcctacagaaac

SEQ ID NO: 284981 - DNA, 25 bp, Rattus norvegicus
gaaacactgagctaggcatggacct

SEQ ID NO: 284982 - DNA, 25 bp, Rattus norvegicus
gaaacactgagcttcctacagaaac

SEQ ID NO: 284983 - DNA, 25 bp, Rattus norvegicus
gaaacactgcacattcaccaaagca

SEQ ID NO: 284984 - DNA, 25 bp, Rattus norvegicus
gaaacactgcactttcaccaaagca

SEQ ID NO: 284985 - DNA, 25 bp, Rattus norvegicus
gaaacactgcagaacttcagtaccc

SEQ ID NO: 284986 - DNA, 25 bp, Rattus norvegicus
gaaacactgcagtacttcagtaccc

SEQ ID NO: 284987 - DNA, 25 bp, Rattus norvegicus
gaaacactgcctagctgtttgagtg

SEQ ID NO: 284988 - DNA, 25 bp, Rattus norvegicus
gaaacactgccttgctgtttgagtg

SEQ ID NO: 284989 - DNA, 25 bp, Rattus norvegicus
gaaacactggaacttcgggatgaaa

SEQ ID NO: 284990 - DNA, 25 bp, Rattus norvegicus
gaaacactggaagttcgggatgaaa

SEQ ID NO: 284991 - DNA, 25 bp, Rattus norvegicus
gaaacactggacaccttgatctgga

SEQ ID NO: 284992 - DNA, 25 bp, Rattus norvegicus
gaaacactggactccttgatctgga

SEQ ID NO: 284993 - DNA, 25 bp, Rattus norvegicus
gaaacactggagaaggccgtgcgtt

SEQ ID NO: 284994 - DNA, 25 bp, Rattus norvegicus
gaaacactggagagcttctcccctc

SEQ ID NO: 284995 - DNA, 25 bp, Rattus norvegicus
gaaacactggagtaggccgtgcgtt

SEQ ID NO: 284996 - DNA, 25 bp, Rattus norvegicus
gaaacactggagtgcttctcccctc

SEQ ID NO: 284997 - DNA, 25 bp, Rattus norvegicus
gaaacactggccaagaataccgtga

SEQ ID NO: 284998 - DNA, 25 bp, Rattus norvegicus
gaaacactggcctagaataccgtga

SEQ ID NO: 284999 - DNA, 25 bp, Rattus norvegicus
gaaacactggctagcgctttctgac

SEQ ID NO: 285000 - DNA, 25 bp, Rattus norvegicus
gaaacactggcttgcgctttctgac

SEQ ID NO: 285001 - DNA, 25 bp, Rattus norvegicus
gaaacactgtagattatgcttcagc

SEQ ID NO: 285002 - DNA, 25 bp, Rattus norvegicus
gaaacactgtagtttatgcttcagc

SEQ ID NO: 285003 - DNA, 25 bp, Rattus norvegicus
gaaacactgtcacactgaagccact

SEQ ID NO: 285004 - DNA, 25 bp, Rattus norvegicus
gaaacactgtcagactgaagccact

SEQ ID NO: 285005 - DNA, 25 bp, Rattus norvegicus
gaaacactgtccattgggaggcata

SEQ ID NO: 285006 - DNA, 25 bp, Rattus norvegicus
gaaacactgtcctttgggaggcata

SEQ ID NO: 285007 - DNA, 25 bp, Rattus norvegicus
gaaacactgtgaaatctgttaagca

SEQ ID NO: 285008 - DNA, 25 bp, Rattus norvegicus
gaaacactgtgatatctgttaagca

SEQ ID NO: 285009 - DNA, 25 bp, Rattus norvegicus
gaaacactgtgcactagctttactt

SEQ ID NO: 285010 - DNA, 25 bp, Rattus norvegicus
gaaacactgtgctctagctttactt

SEQ ID NO: 285011 - DNA, 25 bp, Rattus norvegicus
gaaacactgttaccctgtggtcggg

SEQ ID NO: 285012 - DNA, 25 bp, Rattus norvegicus
gaaacactgttagcctgtggtcggg

SEQ ID NO: 285013 - DNA, 25 bp, Rattus norvegicus
gaaacacttaccatgtgtcctggtc

SEQ ID NO: 285014 - DNA, 25 bp, Rattus norvegicus
gaaacacttaccttgtgtcctggtc

SEQ ID NO: 285015 - DNA, 25 bp, Rattus norvegicus
gaaacacttcagctttgcaactaaa

SEQ ID NO: 285016 - DNA, 25 bp, Rattus norvegicus
gaaacacttcaggtttgcaactaaa

SEQ ID NO: 285017 - DNA, 25 bp, Rattus norvegicus
gaaacacttctactaagctgcttag

SEQ ID NO: 285018 - DNA, 25 bp, Rattus norvegicus
gaaacacttctagtaagctgcttag

SEQ ID NO: 285019 - DNA, 25 bp, Rattus norvegicus
gaaacacttcttatcattcgtcaga

SEQ ID NO: 285020 - DNA, 25 bp, Rattus norvegicus
gaaacacttcttttcattcgtcaga

SEQ ID NO: 285021 - DNA, 25 bp, Rattus norvegicus
gaaacacttggacctagctgccaga

SEQ ID NO: 285022 - DNA, 25 bp, Rattus norvegicus
gaaacacttggagctagctgccaga

SEQ ID NO: 285023 - DNA, 25 bp, Rattus norvegicus
gaaacactttcgagcaggtgtgcct

SEQ ID NO: 285024 - DNA, 25 bp, Rattus norvegicus
gaaacactttcgtgcaggtgtgcct

SEQ ID NO: 285025 - DNA, 25 bp, Rattus norvegicus
gaaacactttgacactccttctggt

SEQ ID NO: 285026 - DNA, 25 bp, Rattus norvegicus
gaaacactttgagactccttctggt

SEQ ID NO: 285027 - DNA, 25 bp, Rattus norvegicus
gaaacactttgcaaagttttacaat

SEQ ID NO: 285028 - DNA, 25 bp, Rattus norvegicus
gaaacactttgctaagttttacaat

SEQ ID NO: 285029 - DNA, 25 bp, Rattus norvegicus
gaaacactttgtccttggtttttat

SEQ ID NO: 285030 - DNA, 25 bp, Rattus norvegicus
gaaacactttgtgcttggtttttat

SEQ ID NO: 285031 - DNA, 25 bp, Rattus norvegicus
gaaacagaaaagaccaccactacct

SEQ ID NO: 285032 - DNA, 25 bp, Rattus norvegicus
gaaacagaaaagtccaccactacct

SEQ ID NO: 285033 - DNA, 25 bp, Rattus norvegicus
gaaacagaaatgatctagtctagag

SEQ ID NO: 285034 - DNA, 25 bp, Rattus norvegicus
gaaacagaaatgttctagtctagag

SEQ ID NO: 285035 - DNA, 25 bp, Rattus norvegicus
gaaacagaactcacttagccttaag

SEQ ID NO: 285036 - DNA, 25 bp, Rattus norvegicus
gaaacagaactctcttagccttaag

SEQ ID NO: 285037 - DNA, 25 bp, Rattus norvegicus
gaaacagaagccaaggctgagctgc

SEQ ID NO: 285038 - DNA, 25 bp, Rattus norvegicus
gaaacagaagcctaggctgagctgc

SEQ ID NO: 285039 - DNA, 25 bp, Rattus norvegicus
gaaacagaagctacagctcctcagg

SEQ ID NO: 285040 - DNA, 25 bp, Rattus norvegicus
gaaacagaagcttcagctcctcagg

SEQ ID NO: 285041 - DNA, 25 bp, Rattus norvegicus
gaaacagacccacaacttgtcaata

SEQ ID NO: 285042 - DNA, 25 bp, Rattus norvegicus
gaaacagacccagaacttgtcaata

SEQ ID NO: 285043 - DNA, 25 bp, Rattus norvegicus
gaaacagacctcattgttttcccag

SEQ ID NO: 285044 - DNA, 25 bp, Rattus norvegicus
gaaacagacctctttgttttcccag

SEQ ID NO: 285045 - DNA, 25 bp, Rattus norvegicus
gaaacagaccttccattgatctacc

SEQ ID NO: 285046 - DNA, 25 bp, Rattus norvegicus
gaaacagaccttgcattgatctacc

SEQ ID NO: 285047 - DNA, 25 bp, Rattus norvegicus
gaaacagacgctatcagtctcgggc

SEQ ID NO: 285048 - DNA, 25 bp, Rattus norvegicus
gaaacagacgctttcagtctcgggc

SEQ ID NO: 285049 - DNA, 25 bp, Rattus norvegicus
gaaacagagacacctttaaccgatg

SEQ ID NO: 285050 - DNA, 25 bp, Rattus norvegicus
gaaacagagacagctttaaccgatg

SEQ ID NO: 285051 - DNA, 25 bp, Rattus norvegicus
gaaacagagtctcctagctccctgg

SEQ ID NO: 285052 - DNA, 25 bp, Rattus norvegicus
gaaacagagtctgctagctccctgg

SEQ ID NO: 285053 - DNA, 25 bp, Rattus norvegicus
gaaacagatacaatcgctgccagaa

SEQ ID NO: 285054 - DNA, 25 bp, Rattus norvegicus
gaaacagatacattcgctgccagaa

SEQ ID NO: 285055 - DNA, 25 bp, Rattus norvegicus
gaaacagatcgtacagccagtggaa

SEQ ID NO: 285056 - DNA, 25 bp, Rattus norvegicus
gaaacagatcgttcagccagtggaa

SEQ ID NO: 285057 - DNA, 25 bp, Rattus norvegicus
gaaacagatcttagccagactggca

SEQ ID NO: 285058 - DNA, 25 bp, Rattus norvegicus
gaaacagatctttgccagactggca

SEQ ID NO: 285059 - DNA, 25 bp, Rattus norvegicus
gaaacagatggaacctcttgacaag

SEQ ID NO: 285060 - DNA, 25 bp, Rattus norvegicus
gaaacagatggatcctcttgacaag

SEQ ID NO: 285061 - DNA, 25 bp, Rattus norvegicus
gaaacagattacataattcctggga

SEQ ID NO: 285062 - DNA, 25 bp, Rattus norvegicus
gaaacagattacttaattcctggga

SEQ ID NO: 285063 - DNA, 25 bp, Rattus norvegicus
gaaacagatttccaagccttaccct

SEQ ID NO: 285064 - DNA, 25 bp, Rattus norvegicus
gaaacagatttcgaagccttaccct

SEQ ID NO: 285065 - DNA, 25 bp, Rattus norvegicus
gaaacagatttgagcaattccataa

SEQ ID NO: 285066 - DNA, 25 bp, Rattus norvegicus
gaaacagatttgtgcaattccataa

SEQ ID NO: 285067 - DNA, 25 bp, Rattus norvegicus
gaaacagcaatgcaccacgggagtg

SEQ ID NO: 285068 - DNA, 25 bp, Rattus norvegicus
gaaacagcaatggaccacgggagtg

SEQ ID NO: 285069 - DNA, 25 bp, Rattus norvegicus
gaaacagcactcacacaggcaagca

SEQ ID NO: 285070 - DNA, 25 bp, Rattus norvegicus
gaaacagcactctcacaggcaagca

SEQ ID NO: 285071 - DNA, 25 bp, Rattus norvegicus
gaaacagcacttatctgccttagtg

SEQ ID NO: 285072 - DNA, 25 bp, Rattus norvegicus
gaaacagcacttctctattctggct

SEQ ID NO: 285073 - DNA, 25 bp, Rattus norvegicus
gaaacagcacttgtctattctggct

SEQ ID NO: 285074 - DNA, 25 bp, Rattus norvegicus
gaaacagcacttttctgccttagtg

SEQ ID NO: 285075 - DNA, 25 bp, Rattus norvegicus
gaaacagcagcactgccggatcttc

SEQ ID NO: 285076 - DNA, 25 bp, Rattus norvegicus
gaaacagcagcagtgccggatcttc

SEQ ID NO: 285077 - DNA, 25 bp, Rattus norvegicus
gaaacagcaggacatccagtcgact

SEQ ID NO: 285078 - DNA, 25 bp, Rattus norvegicus
gaaacagcaggagatccagtcgact

SEQ ID NO: 285079 - DNA, 25 bp, Rattus norvegicus
gaaacagcatgacaagtccccagag

SEQ ID NO: 285080 - DNA, 25 bp, Rattus norvegicus
gaaacagcatgaccctgcgtagtga

SEQ ID NO: 285081 - DNA, 25 bp, Rattus norvegicus
gaaacagcatgagaagtccccagag

SEQ ID NO: 285082 - DNA, 25 bp, Rattus norvegicus
gaaacagcatgagcctgcgtagtga

SEQ ID NO: 285083 - DNA, 25 bp, Rattus norvegicus
gaaacagcatgtctctggcaggcta

SEQ ID NO: 285084 - DNA, 25 bp, Rattus norvegicus
gaaacagcatgtgtctggcaggcta

SEQ ID NO: 285085 - DNA, 25 bp, Rattus norvegicus
gaaacagcattgagcagccgcacgt

SEQ ID NO: 285086 - DNA, 25 bp, Rattus norvegicus
gaaacagcattgtgcagccgcacgt

SEQ ID NO: 285087 - DNA, 25 bp, Rattus norvegicus
gaaacagccaacacttaagactgga

SEQ ID NO: 285088 - DNA, 25 bp, Rattus norvegicus
gaaacagccaactcttaagactgga

SEQ ID NO: 285089 - DNA, 25 bp, Rattus norvegicus
gaaacagcccaacccactgatgatg

SEQ ID NO: 285090 - DNA, 25 bp, Rattus norvegicus
gaaacagcccaagccactgatgatg

SEQ ID NO: 285091 - DNA, 25 bp, Rattus norvegicus
gaaacagcccagaggttacggcctc

SEQ ID NO: 285092 - DNA, 25 bp, Rattus norvegicus
gaaacagcccagtggttacggcctc

SEQ ID NO: 285093 - DNA, 25 bp, Rattus norvegicus
gaaacagccccgagtttgagctgct

SEQ ID NO: 285094 - DNA, 25 bp, Rattus norvegicus
gaaacagccccgtgtttgagctgct

SEQ ID NO: 285095 - DNA, 25 bp, Rattus norvegicus
gaaacagcccgcaggagagccatgc

SEQ ID NO: 285096 - DNA, 25 bp, Rattus norvegicus
gaaacagcccgctggagagccatgc

SEQ ID NO: 285097 - DNA, 25 bp, Rattus norvegicus
gaaacagccctgcacctcagtgaag

SEQ ID NO: 285098 - DNA, 25 bp, Rattus norvegicus
gaaacagccctggacctcagtgaag

SEQ ID NO: 285099 - DNA, 25 bp, Rattus norvegicus
gaaacagcccttcccaaattgcagt

SEQ ID NO: 285100 - DNA, 25 bp, Rattus norvegicus
gaaacagcccttgccaaattgcagt

SEQ ID NO: 285101 - DNA, 25 bp, Rattus norvegicus
gaaacagcctaaacttttggtgcat

SEQ ID NO: 285102 - DNA, 25 bp, Rattus norvegicus
gaaacagcctaatcttttggtgcat

SEQ ID NO: 285103 - DNA, 25 bp, Rattus norvegicus
gaaacagccttcatcttgcttaaaa

SEQ ID NO: 285104 - DNA, 25 bp, Rattus norvegicus
gaaacagccttcttcttgcttaaaa

SEQ ID NO: 285105 - DNA, 25 bp, Rattus norvegicus
gaaacagcgcttctctgttgagtaa

SEQ ID NO: 285106 - DNA, 25 bp, Rattus norvegicus
gaaacagcgcttgtctgttgagtaa

SEQ ID NO: 285107 - DNA, 25 bp, Rattus norvegicus
gaaacagcgtcaaaaagtattcctt

SEQ ID NO: 285108 - DNA, 25 bp, Rattus norvegicus
gaaacagcgtcataaagtattcctt

SEQ ID NO: 285109 - DNA, 25 bp, Rattus norvegicus
gaaacagctaaaagccacacccaga

SEQ ID NO: 285110 - DNA, 25 bp, Rattus norvegicus
gaaacagctaaatgccacacccaga

SEQ ID NO: 285111 - DNA, 25 bp, Rattus norvegicus
gaaacagctaagagcctctacctga

SEQ ID NO: 285112 - DNA, 25 bp, Rattus norvegicus
gaaacagctaagtgcctctacctga

SEQ ID NO: 285113 - DNA, 25 bp, Rattus norvegicus
gaaacagctcagaccaaatgaacgg

SEQ ID NO: 285114 - DNA, 25 bp, Rattus norvegicus
gaaacagctcagtccaaatgaacgg

SEQ ID NO: 285115 - DNA, 25 bp, Rattus norvegicus
gaaacagctccgagtgcttaggccg

SEQ ID NO: 285116 - DNA, 25 bp, Rattus norvegicus
gaaacagctccgtgtgcttaggccg

SEQ ID NO: 285117 - DNA, 25 bp, Rattus norvegicus
gaaacagctcctcccagaacagttg

SEQ ID NO: 285118 - DNA, 25 bp, Rattus norvegicus
gaaacagctcctgccagaacagttg

SEQ ID NO: 285119 - DNA, 25 bp, Rattus norvegicus
gaaacagctgggagccgctgatctc

SEQ ID NO: 285120 - DNA, 25 bp, Rattus norvegicus
gaaacagctgggtgccgctgatctc

SEQ ID NO: 285121 - DNA, 25 bp, Rattus norvegicus
gaaacagcttctactggctcataaa

SEQ ID NO: 285122 - DNA, 25 bp, Rattus norvegicus
gaaacagcttcttctggctcataaa

SEQ ID NO: 285123 - DNA, 25 bp, Rattus norvegicus
gaaacagcttggataatttggtctt

SEQ ID NO: 285124 - DNA, 25 bp, Rattus norvegicus
gaaacagcttggttaatttggtctt

SEQ ID NO: 285125 - DNA, 25 bp, Rattus norvegicus
gaaacagctttcagaacttcgcctt

SEQ ID NO: 285126 - DNA, 25 bp, Rattus norvegicus
gaaacagctttctgaacttcgcctt

SEQ ID NO: 285127 - DNA, 25 bp, Rattus norvegicus
gaaacaggaacaagtcgtcccgctg

SEQ ID NO: 285128 - DNA, 25 bp, Rattus norvegicus
gaaacaggaacatgtcgtcccgctg

SEQ ID NO: 285129 - DNA, 25 bp, Rattus norvegicus
gaaacaggacagcttagccccaaac

SEQ ID NO: 285130 - DNA, 25 bp, Rattus norvegicus
gaaacaggacaggttagccccaaac

SEQ ID NO: 285131 - DNA, 25 bp, Rattus norvegicus
gaaacaggaccaaatcttcagaacc

SEQ ID NO: 285132 - DNA, 25 bp, Rattus norvegicus
gaaacaggaccatatcttcagaacc

SEQ ID NO: 285133 - DNA, 25 bp, Rattus norvegicus
gaaacaggactgactattgggcagt

SEQ ID NO: 285134 - DNA, 25 bp, Rattus norvegicus
gaaacaggactgtctattgggcagt

SEQ ID NO: 285135 - DNA, 25 bp, Rattus norvegicus
gaaacaggagctactccaaatccaa

SEQ ID NO: 285136 - DNA, 25 bp, Rattus norvegicus
gaaacaggagcttctccaaatccaa

SEQ ID NO: 285137 - DNA, 25 bp, Rattus norvegicus
gaaacaggaggcagactgtcctctc

SEQ ID NO: 285138 - DNA, 25 bp, Rattus norvegicus
gaaacaggaggctgactgtcctctc

SEQ ID NO: 285139 - DNA, 25 bp, Rattus norvegicus
gaaacaggatcaccttctctcctta

SEQ ID NO: 285140 - DNA, 25 bp, Rattus norvegicus
gaaacaggatcagcttctctcctta

SEQ ID NO: 285141 - DNA, 25 bp, Rattus norvegicus
gaaacaggcactcggagtctgccgt

SEQ ID NO: 285142 - DNA, 25 bp, Rattus norvegicus
gaaacaggcactgggagtctgccgt

SEQ ID NO: 285143 - DNA, 25 bp, Rattus norvegicus
gaaacaggctcaaaacgtcttgcat

SEQ ID NO: 285144 - DNA, 25 bp, Rattus norvegicus
gaaacaggctcataacgtcttgcat

SEQ ID NO: 285145 - DNA, 25 bp, Rattus norvegicus
gaaacaggctggctgtctctatcca

SEQ ID NO: 285146 - DNA, 25 bp, Rattus norvegicus
gaaacaggctgggtgtctctatcca

SEQ ID NO: 285147 - DNA, 25 bp, Rattus norvegicus
gaaacaggcttccattatctgccct

SEQ ID NO: 285148 - DNA, 25 bp, Rattus norvegicus
gaaacaggcttcgattatctgccct

SEQ ID NO: 285149 - DNA, 25 bp, Rattus norvegicus
gaaacagggcataccattcctcatg

SEQ ID NO: 285150 - DNA, 25 bp, Rattus norvegicus
gaaacagggcattccattcctcatg

SEQ ID NO: 285151 - DNA, 25 bp, Rattus norvegicus
gaaacagggccactcaatctcattg

SEQ ID NO: 285152 - DNA, 25 bp, Rattus norvegicus
gaaacagggccagtcaatctcattg

SEQ ID NO: 285153 - DNA, 25 bp, Rattus norvegicus
gaaacagggctcaagtgaatctttt

SEQ ID NO: 285154 - DNA, 25 bp, Rattus norvegicus
gaaacagggctctagtgaatctttt

SEQ ID NO: 285155 - DNA, 25 bp, Rattus norvegicus
gaaacagggtagctattatcttaat

SEQ ID NO: 285156 - DNA, 25 bp, Rattus norvegicus
gaaacagggtaggtattatcttaat

SEQ ID NO: 285157 - DNA, 25 bp, Rattus norvegicus
gaaacagggtcactccgtttcagga

SEQ ID NO: 285158 - DNA, 25 bp, Rattus norvegicus
gaaacagggtcagtccgtttcagga

SEQ ID NO: 285159 - DNA, 25 bp, Rattus norvegicus
gaaacagggtctcacttgtagcttt

SEQ ID NO: 285160 - DNA, 25 bp, Rattus norvegicus
gaaacagggtctgacttgtagcttt

SEQ ID NO: 285161 - DNA, 25 bp, Rattus norvegicus
gaaacagggtgaacttgtccaattt

SEQ ID NO: 285162 - DNA, 25 bp, Rattus norvegicus
gaaacagggtgatcttgtccaattt

SEQ ID NO: 285163 - DNA, 25 bp, Rattus norvegicus
gaaacagggttcaactctctgtgga

SEQ ID NO: 285164 - DNA, 25 bp, Rattus norvegicus
gaaacagggttctactctctgtgga

SEQ ID NO: 285165 - DNA, 25 bp, Rattus norvegicus
gaaacaggtctcctatttaggtcaa

SEQ ID NO: 285166 - DNA, 25 bp, Rattus norvegicus
gaaacaggtctcgtatttaggtcaa

SEQ ID NO: 285167 - DNA, 25 bp, Rattus norvegicus
gaaacaggtgtcagacttactctta

SEQ ID NO: 285168 - DNA, 25 bp, Rattus norvegicus
gaaacaggtgtctgacttactctta

SEQ ID NO: 285169 - DNA, 25 bp, Rattus norvegicus
gaaacaggttttatcactggtacat

SEQ ID NO: 285170 - DNA, 25 bp, Rattus norvegicus
gaaacaggttttttcactggtacat

SEQ ID NO: 285171 - DNA, 25 bp, Rattus norvegicus
gaaacagtaaacaccccagcgatat

SEQ ID NO: 285172 - DNA, 25 bp, Rattus norvegicus
gaaacagtaaactccccagcgatat

SEQ ID NO: 285173 - DNA, 25 bp, Rattus norvegicus
gaaacagtaacactcgctttggaat

SEQ ID NO: 285174 - DNA, 25 bp, Rattus norvegicus
gaaacagtaacagtcgctttggaat

SEQ ID NO: 285175 - DNA, 25 bp, Rattus norvegicus
gaaacagtacacatccatccatcat

SEQ ID NO: 285176 - DNA, 25 bp, Rattus norvegicus
gaaacagtacacttccatccatcat

SEQ ID NO: 285177 - DNA, 25 bp, Rattus norvegicus
gaaacagtacctacttcgactccat

SEQ ID NO: 285178 - DNA, 25 bp, Rattus norvegicus
gaaacagtaccttcttcgactccat

SEQ ID NO: 285179 - DNA, 25 bp, Rattus norvegicus
gaaacagtacttaagccagctgctt

SEQ ID NO: 285180 - DNA, 25 bp, Rattus norvegicus
gaaacagtacttccagttactcccc

SEQ ID NO: 285181 - DNA, 25 bp, Rattus norvegicus
gaaacagtacttgcagttactcccc

SEQ ID NO: 285182 - DNA, 25 bp, Rattus norvegicus
gaaacagtactttagccagctgctt

SEQ ID NO: 285183 - DNA, 25 bp, Rattus norvegicus
gaaacagtatgtcgccatcctgcct

SEQ ID NO: 285184 - DNA, 25 bp, Rattus norvegicus
gaaacagtatgtggccatcctgcct

SEQ ID NO: 285185 - DNA, 25 bp, Rattus norvegicus
gaaacagtcagtatagtgcccaaca

SEQ ID NO: 285186 - DNA, 25 bp, Rattus norvegicus
gaaacagtcagtttagtgcccaaca

SEQ ID NO: 285187 - DNA, 25 bp, Rattus norvegicus
gaaacagtcattagcgcacaacttt

SEQ ID NO: 285188 - DNA, 25 bp, Rattus norvegicus
gaaacagtcatttgcgcacaacttt

SEQ ID NO: 285189 - DNA, 25 bp, Rattus norvegicus
gaaacagtcctaagtcactcagtgg

SEQ ID NO: 285190 - DNA, 25 bp, Rattus norvegicus
gaaacagtcctaatttacctccaat

SEQ ID NO: 285191 - DNA, 25 bp, Rattus norvegicus
gaaacagtcctatgtcactcagtgg

SEQ ID NO: 285192 - DNA, 25 bp, Rattus norvegicus
gaaacagtcctattttacctccaat

SEQ ID NO: 285193 - DNA, 25 bp, Rattus norvegicus
gaaacagtcctgagtccttggagca

SEQ ID NO: 285194 - DNA, 25 bp, Rattus norvegicus
gaaacagtcctgtgtccttggagca

SEQ ID NO: 285195 - DNA, 25 bp, Rattus norvegicus
gaaacagtgcacacaagctccattg

SEQ ID NO: 285196 - DNA, 25 bp, Rattus norvegicus
gaaacagtgcactcaagctccattg

SEQ ID NO: 285197 - DNA, 25 bp, Rattus norvegicus
gaaacagtgcataacattgccaaga

SEQ ID NO: 285198 - DNA, 25 bp, Rattus norvegicus
gaaacagtgcattacattgccaaga

SEQ ID NO: 285199 - DNA, 25 bp, Rattus norvegicus
gaaacagtgcccatggtcttctaaa

SEQ ID NO: 285200 - DNA, 25 bp, Rattus norvegicus
gaaacagtgcccttggtcttctaaa

SEQ ID NO: 285201 - DNA, 25 bp, Rattus norvegicus
gaaacagtgcttatatgcctccaat

SEQ ID NO: 285202 - DNA, 25 bp, Rattus norvegicus
gaaacagtgcttttatgcctccaat

SEQ ID NO: 285203 - DNA, 25 bp, Rattus norvegicus
gaaacagtggccctcatgtggacac

SEQ ID NO: 285204 - DNA, 25 bp, Rattus norvegicus
gaaacagtggccgtcatgtggacac

SEQ ID NO: 285205 - DNA, 25 bp, Rattus norvegicus
gaaacagtggtacctctatgaccct

SEQ ID NO: 285206 - DNA, 25 bp, Rattus norvegicus
gaaacagtggtagctctatgaccct

SEQ ID NO: 285207 - DNA, 25 bp, Rattus norvegicus
gaaacagtgtaaccgcttcaaccct

SEQ ID NO: 285208 - DNA, 25 bp, Rattus norvegicus
gaaacagtgtaagcgcttcaaccct

SEQ ID NO: 285209 - DNA, 25 bp, Rattus norvegicus
gaaacagtgtatacgcctgggcctt

SEQ ID NO: 285210 - DNA, 25 bp, Rattus norvegicus
gaaacagtgtattcgcctgggcctt

SEQ ID NO: 285211 - DNA, 25 bp, Rattus norvegicus
gaaacagtgtctcacctttgacgtt

SEQ ID NO: 285212 - DNA, 25 bp, Rattus norvegicus
gaaacagtgtctgacctttgacgtt

SEQ ID NO: 285213 - DNA, 25 bp, Rattus norvegicus
gaaacagtgttaagcctttgaccat

SEQ ID NO: 285214 - DNA, 25 bp, Rattus norvegicus
gaaacagtgttatgcctttgaccat

SEQ ID NO: 285215 - DNA, 25 bp, Rattus norvegicus
gaaacagtgtttccatcaactagta

SEQ ID NO: 285216 - DNA, 25 bp, Rattus norvegicus
gaaacagtgtttgcatcaactagta

SEQ ID NO: 285217 - DNA, 25 bp, Rattus norvegicus
gaaacagttacacagtgccctatat

SEQ ID NO: 285218 - DNA, 25 bp, Rattus norvegicus
gaaacagttacagagtgccctatat

SEQ ID NO: 285219 - DNA, 25 bp, Rattus norvegicus
gaaacagttcatcttggaggacaat

SEQ ID NO: 285220 - DNA, 25 bp, Rattus norvegicus
gaaacagttcatgttggaggacaat

SEQ ID NO: 285221 - DNA, 25 bp, Rattus norvegicus
gaaacagttcccacattccatggag

SEQ ID NO: 285222 - DNA, 25 bp, Rattus norvegicus
gaaacagttccctcattccatggag

SEQ ID NO: 285223 - DNA, 25 bp, Rattus norvegicus
gaaacagttctaaccctgaaccaat

SEQ ID NO: 285224 - DNA, 25 bp, Rattus norvegicus
gaaacagttctatccctgaaccaat

SEQ ID NO: 285225 - DNA, 25 bp, Rattus norvegicus
gaaacagttctcacagtacatcaag

SEQ ID NO: 285226 - DNA, 25 bp, Rattus norvegicus
gaaacagttctctcagtacatcaag

SEQ ID NO: 285227 - DNA, 25 bp, Rattus norvegicus
gaaacagttgcaagtagtaacacta

SEQ ID NO: 285228 - DNA, 25 bp, Rattus norvegicus
gaaacagttgcacccgctatcgaaa

SEQ ID NO: 285229 - DNA, 25 bp, Rattus norvegicus
gaaacagttgcagccgctatcgaaa

SEQ ID NO: 285230 - DNA, 25 bp, Rattus norvegicus
gaaacagttgcatgtagtaacacta

SEQ ID NO: 285231 - DNA, 25 bp, Rattus norvegicus
gaaacagttggaccccattctggcc

SEQ ID NO: 285232 - DNA, 25 bp, Rattus norvegicus
gaaacagttggagcccattctggcc

SEQ ID NO: 285233 - DNA, 25 bp, Rattus norvegicus
gaaacagttggtcacctgctacaga

SEQ ID NO: 285234 - DNA, 25 bp, Rattus norvegicus
gaaacagttggtgacctgctacaga

SEQ ID NO: 285235 - DNA, 25 bp, Rattus norvegicus
gaaacagttgttcccactggccaag

SEQ ID NO: 285236 - DNA, 25 bp, Rattus norvegicus
gaaacagttgttgccactggccaag

SEQ ID NO: 285237 - DNA, 25 bp, Rattus norvegicus
gaaacagtttcacttccggctgtcc

SEQ ID NO: 285238 - DNA, 25 bp, Rattus norvegicus
gaaacagtttcagttccggctgtcc

SEQ ID NO: 285239 - DNA, 25 bp, Rattus norvegicus
gaaacagtttctagccttcttgcca

SEQ ID NO: 285240 - DNA, 25 bp, Rattus norvegicus
gaaacagtttcttgccttcttgcca

SEQ ID NO: 285241 - DNA, 25 bp, Rattus norvegicus
gaaacatacactacttcagctgaac

SEQ ID NO: 285242 - DNA, 25 bp, Rattus norvegicus
gaaacatacacttcttcagctgaac

SEQ ID NO: 285243 - DNA, 25 bp, Rattus norvegicus
gaaacatacaggagctacagttggc

SEQ ID NO: 285244 - DNA, 25 bp, Rattus norvegicus
gaaacatacaggtgctacagttggc

SEQ ID NO: 285245 - DNA, 25 bp, Rattus norvegicus
gaaacatacagtcttatcagctaat

SEQ ID NO: 285246 - DNA, 25 bp, Rattus norvegicus
gaaacatacagtgttatcagctaat

SEQ ID NO: 285247 - DNA, 25 bp, Rattus norvegicus
gaaacatacctgatgtctccttacc

SEQ ID NO: 285248 - DNA, 25 bp, Rattus norvegicus
gaaacatacctgttgtctccttacc

SEQ ID NO: 285249 - DNA, 25 bp, Rattus norvegicus
gaaacataccttaagcagacaccta

SEQ ID NO: 285250 - DNA, 25 bp, Rattus norvegicus
gaaacatacctttagcagacaccta

SEQ ID NO: 285251 - DNA, 25 bp, Rattus norvegicus
gaaacatactggatctgctatggta

SEQ ID NO: 285252 - DNA, 25 bp, Rattus norvegicus
gaaacatactggttctgctatggta

SEQ ID NO: 285253 - DNA, 25 bp, Rattus norvegicus
gaaacatagtctattctctgtgaat

SEQ ID NO: 285254 - DNA, 25 bp, Rattus norvegicus
gaaacatagtcttttctctgtgaat

SEQ ID NO: 285255 - DNA, 25 bp, Rattus norvegicus
gaaacatcaactcagtgacacgcct

SEQ ID NO: 285256 - DNA, 25 bp, Rattus norvegicus
gaaacatcaactgagtgacacgcct

SEQ ID NO: 285257 - DNA, 25 bp, Rattus norvegicus
gaaacatcaataacgtcagacactc

SEQ ID NO: 285258 - DNA, 25 bp, Rattus norvegicus
gaaacatcaatatcgtcagacactc

SEQ ID NO: 285259 - DNA, 25 bp, Rattus norvegicus
gaaacatcactgacttgccagagta

SEQ ID NO: 285260 - DNA, 25 bp, Rattus norvegicus
gaaacatcactgtcttgccagagta

SEQ ID NO: 285261 - DNA, 25 bp, Rattus norvegicus
gaaacatcagcaaaagacaccctag

SEQ ID NO: 285262 - DNA, 25 bp, Rattus norvegicus
gaaacatcagcataagacaccctag

SEQ ID NO: 285263 - DNA, 25 bp, Rattus norvegicus
gaaacatcagggagttcctgcccat

SEQ ID NO: 285264 - DNA, 25 bp, Rattus norvegicus
gaaacatcagggtgttcctgcccat

SEQ ID NO: 285265 - DNA, 25 bp, Rattus norvegicus
gaaacatcagtaactgggcacagta

SEQ ID NO: 285266 - DNA, 25 bp, Rattus norvegicus
gaaacatcagtatctgggcacagta

SEQ ID NO: 285267 - DNA, 25 bp, Rattus norvegicus
gaaacatcatctcgtaaggagtgac

SEQ ID NO: 285268 - DNA, 25 bp, Rattus norvegicus
gaaacatcatctggtaaggagtgac

SEQ ID NO: 285269 - DNA, 25 bp, Rattus norvegicus
gaaacatcatgaccactttagggtg

SEQ ID NO: 285270 - DNA, 25 bp, Rattus norvegicus
gaaacatcatgagcactttagggtg

SEQ ID NO: 285271 - DNA, 25 bp, Rattus norvegicus
gaaacatcattcaaatcctcaggcc

SEQ ID NO: 285272 - DNA, 25 bp, Rattus norvegicus
gaaacatcattctaatcctcaggcc

SEQ ID NO: 285273 - DNA, 25 bp, Rattus norvegicus
gaaacatcatttcttcagagctgtt

SEQ ID NO: 285274 - DNA, 25 bp, Rattus norvegicus
gaaacatcatttgttcagagctgtt

SEQ ID NO: 285275 - DNA, 25 bp, Rattus norvegicus
gaaacatccatcacgggcatacatt

SEQ ID NO: 285276 - DNA, 25 bp, Rattus norvegicus
gaaacatccatctcgggcatacatt

SEQ ID NO: 285277 - DNA, 25 bp, Rattus norvegicus
gaaacatccattacttcctaggaag

SEQ ID NO: 285278 - DNA, 25 bp, Rattus norvegicus
gaaacatccatttcttcctaggaag

SEQ ID NO: 285279 - DNA, 25 bp, Rattus norvegicus
gaaacatcccatatgttgtatcaga

SEQ ID NO: 285280 - DNA, 25 bp, Rattus norvegicus
gaaacatcccatttgttgtatcaga

SEQ ID NO: 285281 - DNA, 25 bp, Rattus norvegicus
gaaacatccccaattgttagcagat

SEQ ID NO: 285282 - DNA, 25 bp, Rattus norvegicus
gaaacatccccatttgttagcagat

SEQ ID NO: 285283 - DNA, 25 bp, Rattus norvegicus
gaaacatcccgacgacttcacctgt

SEQ ID NO: 285284 - DNA, 25 bp, Rattus norvegicus
gaaacatcccgaggacttcacctgt

SEQ ID NO: 285285 - DNA, 25 bp, Rattus norvegicus
gaaacatcctacatactctgtagag

SEQ ID NO: 285286 - DNA, 25 bp, Rattus norvegicus
gaaacatcctacttactctgtagag

SEQ ID NO: 285287 - DNA, 25 bp, Rattus norvegicus
gaaacatcgctgatcctgtaacact

SEQ ID NO: 285288 - DNA, 25 bp, Rattus norvegicus
gaaacatcgctgttcctgtaacact

SEQ ID NO: 285289 - DNA, 25 bp, Rattus norvegicus
gaaacatcggctcttccagtcctgt

SEQ ID NO: 285290 - DNA, 25 bp, Rattus norvegicus
gaaacatcggctgttccagtcctgt

SEQ ID NO: 285291 - DNA, 25 bp, Rattus norvegicus
gaaacatcgttaactcaaacccaga

SEQ ID NO: 285292 - DNA, 25 bp, Rattus norvegicus
gaaacatcgttatctcaaacccaga

SEQ ID NO: 285293 - DNA, 25 bp, Rattus norvegicus
gaaacatctagtccttctaggtgtt

SEQ ID NO: 285294 - DNA, 25 bp, Rattus norvegicus
gaaacatctagtgcttctaggtgtt

SEQ ID NO: 285295 - DNA, 25 bp, Rattus norvegicus
gaaacatctcctctccatagaagct

SEQ ID NO: 285296 - DNA, 25 bp, Rattus norvegicus
gaaacatctcctgtccatagaagct

SEQ ID NO: 285297 - DNA, 25 bp, Rattus norvegicus
gaaacatctcttaagaattccctcc

SEQ ID NO: 285298 - DNA, 25 bp, Rattus norvegicus
gaaacatctctttagaattccctcc

SEQ ID NO: 285299 - DNA, 25 bp, Rattus norvegicus
gaaacatctggcctcagtctgattt

SEQ ID NO: 285300 - DNA, 25 bp, Rattus norvegicus
gaaacatctggcgtcagtctgattt

SEQ ID NO: 285301 - DNA, 25 bp, Rattus norvegicus
gaaacatctgttaacattccaaatt

SEQ ID NO: 285302 - DNA, 25 bp, Rattus norvegicus
gaaacatctgtttacattccaaatt

SEQ ID NO: 285303 - DNA, 25 bp, Rattus norvegicus
gaaacatcttacctaggaagttgca

SEQ ID NO: 285304 - DNA, 25 bp, Rattus norvegicus
gaaacatcttacgtaggaagttgca

SEQ ID NO: 285305 - DNA, 25 bp, Rattus norvegicus
gaaacatcttctattatgcccagca

SEQ ID NO: 285306 - DNA, 25 bp, Rattus norvegicus
gaaacatcttcttttatgcccagca

SEQ ID NO: 285307 - DNA, 25 bp, Rattus norvegicus
gaaacatcttgtctagtgatcctga

SEQ ID NO: 285308 - DNA, 25 bp, Rattus norvegicus
gaaacatcttgtgtagtgatcctga

SEQ ID NO: 285309 - DNA, 25 bp, Rattus norvegicus
gaaacatgaacacaccaggaaattt

SEQ ID NO: 285310 - DNA, 25 bp, Rattus norvegicus
gaaacatgaacagaccaggaaattt

SEQ ID NO: 285311 - DNA, 25 bp, Rattus norvegicus
gaaacatgaactctgggtccggtat

SEQ ID NO: 285312 - DNA, 25 bp, Rattus norvegicus
gaaacatgaactgtgggtccggtat

SEQ ID NO: 285313 - DNA, 25 bp, Rattus norvegicus
gaaacatgacatactgtgctcttag

SEQ ID NO: 285314 - DNA, 25 bp, Rattus norvegicus
gaaacatgacattctgtgctcttag

SEQ ID NO: 285315 - DNA, 25 bp, Rattus norvegicus
gaaacatgacttagatcttccagag

SEQ ID NO: 285316 - DNA, 25 bp, Rattus norvegicus
gaaacatgactttgatcttccagag

SEQ ID NO: 285317 - DNA, 25 bp, Rattus norvegicus
gaaacatgagcaaggactccagcat

SEQ ID NO: 285318 - DNA, 25 bp, Rattus norvegicus
gaaacatgagcatggactccagcat

SEQ ID NO: 285319 - DNA, 25 bp, Rattus norvegicus
gaaacatgagccacttgccacagag

SEQ ID NO: 285320 - DNA, 25 bp, Rattus norvegicus
gaaacatgagcctcttgccacagag

SEQ ID NO: 285321 - DNA, 25 bp, Rattus norvegicus
gaaacatgccccatgctggatggtg

SEQ ID NO: 285322 - DNA, 25 bp, Rattus norvegicus
gaaacatgccccttgctggatggtg

SEQ ID NO: 285323 - DNA, 25 bp, Rattus norvegicus
gaaacatgcctcattccacgaagaa

SEQ ID NO: 285324 - DNA, 25 bp, Rattus norvegicus
gaaacatgcctctttccacgaagaa

SEQ ID NO: 285325 - DNA, 25 bp, Rattus norvegicus
gaaacatgcttgctttttaactgaa

SEQ ID NO: 285326 - DNA, 25 bp, Rattus norvegicus
gaaacatgcttggtttttaactgaa

SEQ ID NO: 285327 - DNA, 25 bp, Rattus norvegicus
gaaacatggcggaccagcggatgaa

SEQ ID NO: 285328 - DNA, 25 bp, Rattus norvegicus
gaaacatggcggtccagcggatgaa

SEQ ID NO: 285329 - DNA, 25 bp, Rattus norvegicus
gaaacatggtggctcccattcatgg

SEQ ID NO: 285330 - DNA, 25 bp, Rattus norvegicus
gaaacatggtgggtcccattcatgg

SEQ ID NO: 285331 - DNA, 25 bp, Rattus norvegicus
gaaacatgtacacatgtctgtctac

SEQ ID NO: 285332 - DNA, 25 bp, Rattus norvegicus
gaaacatgtacagatgtctgtctac

SEQ ID NO: 285333 - DNA, 25 bp, Rattus norvegicus
gaaacatgtaccatcaattttacca

SEQ ID NO: 285334 - DNA, 25 bp, Rattus norvegicus
gaaacatgtaccttcaattttacca

SEQ ID NO: 285335 - DNA, 25 bp, Rattus norvegicus
gaaacatgtcgtcagctggcctgag

SEQ ID NO: 285336 - DNA, 25 bp, Rattus norvegicus
gaaacatgtcgtgagctggcctgag

SEQ ID NO: 285337 - DNA, 25 bp, Rattus norvegicus
gaaacatgtctcctgaggcgagttc

SEQ ID NO: 285338 - DNA, 25 bp, Rattus norvegicus
gaaacatgtctcgtgaggcgagttc

SEQ ID NO: 285339 - DNA, 25 bp, Rattus norvegicus
gaaacatgtgctcccttaactgagg

SEQ ID NO: 285340 - DNA, 25 bp, Rattus norvegicus
gaaacatgtgctgccttaactgagg

SEQ ID NO: 285341 - DNA, 25 bp, Rattus norvegicus
gaaacatgttgacctctgatcagga

SEQ ID NO: 285342 - DNA, 25 bp, Rattus norvegicus
gaaacatgttgagctctgatcagga

SEQ ID NO: 285343 - DNA, 25 bp, Rattus norvegicus
gaaacatgtttcctgttgacgacag

SEQ ID NO: 285344 - DNA, 25 bp, Rattus norvegicus
gaaacatgtttcgtgttgacgacag

SEQ ID NO: 285345 - DNA, 25 bp, Rattus norvegicus
gaaacattaaacaaagccagaactt

SEQ ID NO: 285346 - DNA, 25 bp, Rattus norvegicus
gaaacattaaactaagccagaactt

SEQ ID NO: 285347 - DNA, 25 bp, Rattus norvegicus
gaaacattacttatgatcccaagca

SEQ ID NO: 285348 - DNA, 25 bp, Rattus norvegicus
gaaacattacttctcctttactgac

SEQ ID NO: 285349 - DNA, 25 bp, Rattus norvegicus
gaaacattacttgtcctttactgac

SEQ ID NO: 285350 - DNA, 25 bp, Rattus norvegicus
gaaacattacttttgatcccaagca

SEQ ID NO: 285351 - DNA, 25 bp, Rattus norvegicus
gaaacattatcaacatcaagtcatc

SEQ ID NO: 285352 - DNA, 25 bp, Rattus norvegicus
gaaacattatcatcatcaagtcatc

SEQ ID NO: 285353 - DNA, 25 bp, Rattus norvegicus
gaaacattatccaagtcctaattca

SEQ ID NO: 285354 - DNA, 25 bp, Rattus norvegicus
gaaacattatcctagtcctaattca

SEQ ID NO: 285355 - DNA, 25 bp, Rattus norvegicus
gaaacattcagaaaccatttacggg

SEQ ID NO: 285356 - DNA, 25 bp, Rattus norvegicus
gaaacattcagataccatttacggg

SEQ ID NO: 285357 - DNA, 25 bp, Rattus norvegicus
gaaacattcagcatggaaccatcag

SEQ ID NO: 285358 - DNA, 25 bp, Rattus norvegicus
gaaacattcagcttggaaccatcag

SEQ ID NO: 285359 - DNA, 25 bp, Rattus norvegicus
gaaacattcgttcacttaccagact

SEQ ID NO: 285360 - DNA, 25 bp, Rattus norvegicus
gaaacattcgttgacttaccagact

SEQ ID NO: 285361 - DNA, 25 bp, Rattus norvegicus
gaaacattctacatttcctttccag

SEQ ID NO: 285362 - DNA, 25 bp, Rattus norvegicus
gaaacattctacttttcctttccag

SEQ ID NO: 285363 - DNA, 25 bp, Rattus norvegicus
gaaacattctagaagggcttgcctg

SEQ ID NO: 285364 - DNA, 25 bp, Rattus norvegicus
gaaacattctagtagggcttgcctg

SEQ ID NO: 285365 - DNA, 25 bp, Rattus norvegicus
gaaacattctgcattctgttcagga

SEQ ID NO: 285366 - DNA, 25 bp, Rattus norvegicus
gaaacattctgctttctgttcagga

SEQ ID NO: 285367 - DNA, 25 bp, Rattus norvegicus
gaaacattgagaacttctagtagaa

SEQ ID NO: 285368 - DNA, 25 bp, Rattus norvegicus
gaaacattgagatcttctagtagaa

SEQ ID NO: 285369 - DNA, 25 bp, Rattus norvegicus
gaaacattgattagtaattacctct

SEQ ID NO: 285370 - DNA, 25 bp, Rattus norvegicus
gaaacattgatttgtaattacctct

SEQ ID NO: 285371 - DNA, 25 bp, Rattus norvegicus
gaaacattggagagttcagtcccat

SEQ ID NO: 285372 - DNA, 25 bp, Rattus norvegicus
gaaacattggagtgttcagtcccat

SEQ ID NO: 285373 - DNA, 25 bp, Rattus norvegicus
gaaacattgtccagggatacccttc

SEQ ID NO: 285374 - DNA, 25 bp, Rattus norvegicus
gaaacattgtcctgggatacccttc

SEQ ID NO: 285375 - DNA, 25 bp, Rattus norvegicus
gaaacattgtgtactgtctgacttg

SEQ ID NO: 285376 - DNA, 25 bp, Rattus norvegicus
gaaacattgtgttctgtctgacttg

SEQ ID NO: 285377 - DNA, 25 bp, Rattus norvegicus
gaaacattgttcagtctttgcttga

SEQ ID NO: 285378 - DNA, 25 bp, Rattus norvegicus
gaaacattgttctgtctttgcttga

SEQ ID NO: 285379 - DNA, 25 bp, Rattus norvegicus
gaaacatttaacatgtcctttttga

SEQ ID NO: 285380 - DNA, 25 bp, Rattus norvegicus
gaaacatttaacttgtcctttttga

SEQ ID NO: 285381 - DNA, 25 bp, Rattus norvegicus
gaaacatttactagaagactccgag

SEQ ID NO: 285382 - DNA, 25 bp, Rattus norvegicus
gaaacatttacttgaagactccgag

SEQ ID NO: 285383 - DNA, 25 bp, Rattus norvegicus
gaaacatttcagctgtcagcagatg

SEQ ID NO: 285384 - DNA, 25 bp, Rattus norvegicus
gaaacatttcaggtgtcagcagatg

SEQ ID NO: 285385 - DNA, 25 bp, Rattus norvegicus
gaaacatttccccagggcttactgg

SEQ ID NO: 285386 - DNA, 25 bp, Rattus norvegicus
gaaacatttcccgagggcttactgg

SEQ ID NO: 285387 - DNA, 25 bp, Rattus norvegicus
gaaacatttccgaggatattctgta

SEQ ID NO: 285388 - DNA, 25 bp, Rattus norvegicus
gaaacatttccgtggatattctgta

SEQ ID NO: 285389 - DNA, 25 bp, Rattus norvegicus
gaaacatttcctacttatttactga

SEQ ID NO: 285390 - DNA, 25 bp, Rattus norvegicus
gaaacatttccttcttatttactga

SEQ ID NO: 285391 - DNA, 25 bp, Rattus norvegicus
gaaaccaaacacaacatcctcatgc

SEQ ID NO: 285392 - DNA, 25 bp, Rattus norvegicus
gaaaccaaacactacatcctcatgc

SEQ ID NO: 285393 - DNA, 25 bp, Rattus norvegicus
gaaaccaaacctctcggtgctctgg

SEQ ID NO: 285394 - DNA, 25 bp, Rattus norvegicus
gaaaccaaacctgtcggtgctctgg

SEQ ID NO: 285395 - DNA, 25 bp, Rattus norvegicus
gaaaccaaacttaattctcacagtc

SEQ ID NO: 285396 - DNA, 25 bp, Rattus norvegicus
gaaaccaaactttattctcacagtc

SEQ ID NO: 285397 - DNA, 25 bp, Rattus norvegicus
gaaaccaaagccaaccagttactga

SEQ ID NO: 285398 - DNA, 25 bp, Rattus norvegicus
gaaaccaaagcctaccagttactga

SEQ ID NO: 285399 - DNA, 25 bp, Rattus norvegicus
gaaaccaaatctactgcatgtgcat

SEQ ID NO: 285400 - DNA, 25 bp, Rattus norvegicus
gaaaccaaatcttctgcatgtgcat

SEQ ID NO: 285401 - DNA, 25 bp, Rattus norvegicus
gaaaccaacatgacctaaagcattt

SEQ ID NO: 285402 - DNA, 25 bp, Rattus norvegicus
gaaaccaacatgtcctaaagcattt

SEQ ID NO: 285403 - DNA, 25 bp, Rattus norvegicus
gaaaccaaccacatagttattggca

SEQ ID NO: 285404 - DNA, 25 bp, Rattus norvegicus
gaaaccaaccacttagttattggca

SEQ ID NO: 285405 - DNA, 25 bp, Rattus norvegicus
gaaaccaaccgtccccagtgggaga

SEQ ID NO: 285406 - DNA, 25 bp, Rattus norvegicus
gaaaccaaccgtgcccagtgggaga

SEQ ID NO: 285407 - DNA, 25 bp, Rattus norvegicus
gaaaccaacggtatcactcaggatt

SEQ ID NO: 285408 - DNA, 25 bp, Rattus norvegicus
gaaaccaacggtttcactcaggatt

SEQ ID NO: 285409 - DNA, 25 bp, Rattus norvegicus
gaaaccaacgttccctatctacatt

SEQ ID NO: 285410 - DNA, 25 bp, Rattus norvegicus
gaaaccaacgttgcctatctacatt

SEQ ID NO: 285411 - DNA, 25 bp, Rattus norvegicus
gaaaccaagactatattctgcagaa

SEQ ID NO: 285412 - DNA, 25 bp, Rattus norvegicus
gaaaccaagactttattctgcagaa

SEQ ID NO: 285413 - DNA, 25 bp, Rattus norvegicus
gaaaccaagagcacaactcccatta

SEQ ID NO: 285414 - DNA, 25 bp, Rattus norvegicus
gaaaccaagagcctgtccactgaaa

SEQ ID NO: 285415 - DNA, 25 bp, Rattus norvegicus
gaaaccaagagcgtgtccactgaaa

SEQ ID NO: 285416 - DNA, 25 bp, Rattus norvegicus
gaaaccaagagctcaactcccatta

SEQ ID NO: 285417 - DNA, 25 bp, Rattus norvegicus
gaaaccaagcaacgagtcccggagc

SEQ ID NO: 285418 - DNA, 25 bp, Rattus norvegicus
gaaaccaagcaaggagtcccggagc

SEQ ID NO: 285419 - DNA, 25 bp, Rattus norvegicus
gaaaccaagcctcgtccggattgac

SEQ ID NO: 285420 - DNA, 25 bp, Rattus norvegicus
gaaaccaagcctggtccggattgac

SEQ ID NO: 285421 - DNA, 25 bp, Rattus norvegicus
gaaaccaaggccctcagggaatcag

SEQ ID NO: 285422 - DNA, 25 bp, Rattus norvegicus
gaaaccaaggccgtcagggaatcag

SEQ ID NO: 285423 - DNA, 25 bp, Rattus norvegicus
gaaaccaagttgattcctctgagga

SEQ ID NO: 285424 - DNA, 25 bp, Rattus norvegicus
gaaaccaagttgtttcctctgagga

SEQ ID NO: 285425 - DNA, 25 bp, Rattus norvegicus
gaaaccaatacaatcaagtcctata

SEQ ID NO: 285426 - DNA, 25 bp, Rattus norvegicus
gaaaccaatacattcaagtcctata

SEQ ID NO: 285427 - DNA, 25 bp, Rattus norvegicus
gaaaccaatgcacgaagattgccat

SEQ ID NO: 285428 - DNA, 25 bp, Rattus norvegicus
gaaaccaatgcaggaagattgccat

SEQ ID NO: 285429 - DNA, 25 bp, Rattus norvegicus
gaaaccaatgctaccacatgtatag

SEQ ID NO: 285430 - DNA, 25 bp, Rattus norvegicus
gaaaccaatgcttccacatgtatag

SEQ ID NO: 285431 - DNA, 25 bp, Rattus norvegicus
gaaaccaatggcactctttgtggag

SEQ ID NO: 285432 - DNA, 25 bp, Rattus norvegicus
gaaaccaatggctctctttgtggag

SEQ ID NO: 285433 - DNA, 25 bp, Rattus norvegicus
gaaaccaattacaactgctttaaga

SEQ ID NO: 285434 - DNA, 25 bp, Rattus norvegicus
gaaaccaattactactgctttaaga

SEQ ID NO: 285435 - DNA, 25 bp, Rattus norvegicus
gaaaccacaagcaatcacatgtctg

SEQ ID NO: 285436 - DNA, 25 bp, Rattus norvegicus
gaaaccacaagctatcacatgtctg

SEQ ID NO: 285437 - DNA, 25 bp, Rattus norvegicus
gaaaccacacaaactagtccagcaa

SEQ ID NO: 285438 - DNA, 25 bp, Rattus norvegicus
gaaaccacacaatctagtccagcaa

SEQ ID NO: 285439 - DNA, 25 bp, Rattus norvegicus
gaaaccacactgactatcaggcatt

SEQ ID NO: 285440 - DNA, 25 bp, Rattus norvegicus
gaaaccacactgtctatcaggcatt

SEQ ID NO: 285441 - DNA, 25 bp, Rattus norvegicus
gaaaccacacttctggactctagtc

SEQ ID NO: 285442 - DNA, 25 bp, Rattus norvegicus
gaaaccacacttgtggactctagtc

SEQ ID NO: 285443 - DNA, 25 bp, Rattus norvegicus
gaaaccacagaaaaccattaattag

SEQ ID NO: 285444 - DNA, 25 bp, Rattus norvegicus
gaaaccacagaataccattaattag

SEQ ID NO: 285445 - DNA, 25 bp, Rattus norvegicus
gaaaccacagggactgctgacttca

SEQ ID NO: 285446 - DNA, 25 bp, Rattus norvegicus
gaaaccacagggtctgctgacttca

SEQ ID NO: 285447 - DNA, 25 bp, Rattus norvegicus
gaaaccacatataatccactcagga

SEQ ID NO: 285448 - DNA, 25 bp, Rattus norvegicus
gaaaccacatattatccactcagga

SEQ ID NO: 285449 - DNA, 25 bp, Rattus norvegicus
gaaaccacatttaaaactctggaat

SEQ ID NO: 285450 - DNA, 25 bp, Rattus norvegicus
gaaaccacattttaaactctggaat

SEQ ID NO: 285451 - DNA, 25 bp, Rattus norvegicus
gaaaccaccaaaaaatccacgagac

SEQ ID NO: 285452 - DNA, 25 bp, Rattus norvegicus
gaaaccaccaaataatccacgagac

SEQ ID NO: 285453 - DNA, 25 bp, Rattus norvegicus
gaaaccaccaacagtactgcaatga

SEQ ID NO: 285454 - DNA, 25 bp, Rattus norvegicus
gaaaccaccaactgtactgcaatga

SEQ ID NO: 285455 - DNA, 25 bp, Rattus norvegicus
gaaaccacggacacagatccacagg

SEQ ID NO: 285456 - DNA, 25 bp, Rattus norvegicus
gaaaccacggactcagatccacagg

SEQ ID NO: 285457 - DNA, 25 bp, Rattus norvegicus
gaaaccacggatccagatgctccaa

SEQ ID NO: 285458 - DNA, 25 bp, Rattus norvegicus
gaaaccacggatgcagatgctccaa

SEQ ID NO: 285459 - DNA, 25 bp, Rattus norvegicus
gaaaccacgtacacacaagcaacat

SEQ ID NO: 285460 - DNA, 25 bp, Rattus norvegicus
gaaaccacgtactcacaagcaacat

SEQ ID NO: 285461 - DNA, 25 bp, Rattus norvegicus
gaaaccacgtctcacgcaaaaggat

SEQ ID NO: 285462 - DNA, 25 bp, Rattus norvegicus
gaaaccacgtctgacgcaaaaggat

SEQ ID NO: 285463 - DNA, 25 bp, Rattus norvegicus
gaaaccactgcacccatgtcggaag

SEQ ID NO: 285464 - DNA, 25 bp, Rattus norvegicus
gaaaccactgcagccatgtcggaag

SEQ ID NO: 285465 - DNA, 25 bp, Rattus norvegicus
gaaaccactgctattatccccataa

SEQ ID NO: 285466 - DNA, 25 bp, Rattus norvegicus
gaaaccactgcttttatccccataa

SEQ ID NO: 285467 - DNA, 25 bp, Rattus norvegicus
gaaaccacttagaccaccattgaag

SEQ ID NO: 285468 - DNA, 25 bp, Rattus norvegicus
gaaaccacttagtccaccattgaag

SEQ ID NO: 285469 - DNA, 25 bp, Rattus norvegicus
gaaaccacttcaatggacagttgca

SEQ ID NO: 285470 - DNA, 25 bp, Rattus norvegicus
gaaaccacttcattggacagttgca

SEQ ID NO: 285471 - DNA, 25 bp, Rattus norvegicus
gaaaccagaagtccacgtgaactac

SEQ ID NO: 285472 - DNA, 25 bp, Rattus norvegicus
gaaaccagaagtgcacgtgaactac

SEQ ID NO: 285473 - DNA, 25 bp, Rattus norvegicus
gaaaccagacacagggcagccacga

SEQ ID NO: 285474 - DNA, 25 bp, Rattus norvegicus
gaaaccagacactgggcagccacga

SEQ ID NO: 285475 - DNA, 25 bp, Rattus norvegicus
gaaaccagagaacccctcagagtct

SEQ ID NO: 285476 - DNA, 25 bp, Rattus norvegicus
gaaaccagagaagccctcagagtct

SEQ ID NO: 285477 - DNA, 25 bp, Rattus norvegicus
gaaaccagagacatccttagtaacg

SEQ ID NO: 285478 - DNA, 25 bp, Rattus norvegicus
gaaaccagagacttccttagtaacg

SEQ ID NO: 285479 - DNA, 25 bp, Rattus norvegicus
gaaaccagagcactagacgtagcca

SEQ ID NO: 285480 - DNA, 25 bp, Rattus norvegicus
gaaaccagagcagtagacgtagcca

SEQ ID NO: 285481 - DNA, 25 bp, Rattus norvegicus
gaaaccagagtcctgtgactgtgaa

SEQ ID NO: 285482 - DNA, 25 bp, Rattus norvegicus
gaaaccagagtccttttcagcacta

SEQ ID NO: 285483 - DNA, 25 bp, Rattus norvegicus
gaaaccagagtcgtgtgactgtgaa

SEQ ID NO: 285484 - DNA, 25 bp, Rattus norvegicus
gaaaccagagtcgttttcagcacta

SEQ ID NO: 285485 - DNA, 25 bp, Rattus norvegicus
gaaaccagattcatcacaacaaaag

SEQ ID NO: 285486 - DNA, 25 bp, Rattus norvegicus
gaaaccagattcttcacaacaaaag

SEQ ID NO: 285487 - DNA, 25 bp, Rattus norvegicus
gaaaccagcaagagtatactgtgat

SEQ ID NO: 285488 - DNA, 25 bp, Rattus norvegicus
gaaaccagcaagtgtatactgtgat

SEQ ID NO: 285489 - DNA, 25 bp, Rattus norvegicus
gaaaccagcaccatccatattttat

SEQ ID NO: 285490 - DNA, 25 bp, Rattus norvegicus
gaaaccagcaccttccatattttat

SEQ ID NO: 285491 - DNA, 25 bp, Rattus norvegicus
gaaaccagcaggagaatgatcaaca

SEQ ID NO: 285492 - DNA, 25 bp, Rattus norvegicus
gaaaccagcaggtgaatgatcaaca

SEQ ID NO: 285493 - DNA, 25 bp, Rattus norvegicus
gaaaccagcgctcccaatgggacaa

SEQ ID NO: 285494 - DNA, 25 bp, Rattus norvegicus
gaaaccagcgctgccaatgggacaa

SEQ ID NO: 285495 - DNA, 25 bp, Rattus norvegicus
gaaaccagcggaaaccctgacttta

SEQ ID NO: 285496 - DNA, 25 bp, Rattus norvegicus
gaaaccagcggataccctgacttta

SEQ ID NO: 285497 - DNA, 25 bp, Rattus norvegicus
gaaaccagctaacacagacttcctt

SEQ ID NO: 285498 - DNA, 25 bp, Rattus norvegicus
gaaaccagctaagacagacttcctt

SEQ ID NO: 285499 - DNA, 25 bp, Rattus norvegicus
gaaaccagctacagtgcccagttca

SEQ ID NO: 285500 - DNA, 25 bp, Rattus norvegicus
gaaaccagctactgtgcccagttca

SEQ ID NO: 285501 - DNA, 25 bp, Rattus norvegicus
gaaaccagctgaatcacttctgcaa

SEQ ID NO: 285502 - DNA, 25 bp, Rattus norvegicus
gaaaccagctgattcacttctgcaa

SEQ ID NO: 285503 - DNA, 25 bp, Rattus norvegicus
gaaaccagcttcaatatgacacaat

SEQ ID NO: 285504 - DNA, 25 bp, Rattus norvegicus
gaaaccagcttcacaaaagaggcct

SEQ ID NO: 285505 - DNA, 25 bp, Rattus norvegicus
gaaaccagcttctatatgacacaat

SEQ ID NO: 285506 - DNA, 25 bp, Rattus norvegicus
gaaaccagcttctcaaaagaggcct

SEQ ID NO: 285507 - DNA, 25 bp, Rattus norvegicus
gaaaccagctttccttcatcagtct

SEQ ID NO: 285508 - DNA, 25 bp, Rattus norvegicus
gaaaccagctttgcttcatcagtct

SEQ ID NO: 285509 - DNA, 25 bp, Rattus norvegicus
gaaaccaggactccatgatccagaa

SEQ ID NO: 285510 - DNA, 25 bp, Rattus norvegicus
gaaaccaggactgcatgatccagaa

SEQ ID NO: 285511 - DNA, 25 bp, Rattus norvegicus
gaaaccaggagaatcttgatgacct

SEQ ID NO: 285512 - DNA, 25 bp, Rattus norvegicus
gaaaccaggagattcttgatgacct

SEQ ID NO: 285513 - DNA, 25 bp, Rattus norvegicus
gaaaccaggcagaggcatgggccaa

SEQ ID NO: 285514 - DNA, 25 bp, Rattus norvegicus
gaaaccaggcagtggcatgggccaa

SEQ ID NO: 285515 - DNA, 25 bp, Rattus norvegicus
gaaaccagggatctgtcttctgctt

SEQ ID NO: 285516 - DNA, 25 bp, Rattus norvegicus
gaaaccagggatgtgtcttctgctt

SEQ ID NO: 285517 - DNA, 25 bp, Rattus norvegicus
gaaaccaggtagaggtccttcacat

SEQ ID NO: 285518 - DNA, 25 bp, Rattus norvegicus
gaaaccaggtagtggtccttcacat

SEQ ID NO: 285519 - DNA, 25 bp, Rattus norvegicus
gaaaccaggtgccttcagaggccat

SEQ ID NO: 285520 - DNA, 25 bp, Rattus norvegicus
gaaaccaggtgcgttcagaggccat

SEQ ID NO: 285521 - DNA, 25 bp, Rattus norvegicus
gaaaccaggtgtactaagattgaat

SEQ ID NO: 285522 - DNA, 25 bp, Rattus norvegicus
gaaaccaggtgttctaagattgaat

SEQ ID NO: 285523 - DNA, 25 bp, Rattus norvegicus
gaaaccagtacaaagagaggctgat

SEQ ID NO: 285524 - DNA, 25 bp, Rattus norvegicus
gaaaccagtacatagagaggctgat

SEQ ID NO: 285525 - DNA, 25 bp, Rattus norvegicus
gaaaccagtcctcttgataccaaaa

SEQ ID NO: 285526 - DNA, 25 bp, Rattus norvegicus
gaaaccagtcctgttgataccaaaa

SEQ ID NO: 285527 - DNA, 25 bp, Rattus norvegicus
gaaaccagtcttaattatgccataa

SEQ ID NO: 285528 - DNA, 25 bp, Rattus norvegicus
gaaaccagtcttatggccttacact

SEQ ID NO: 285529 - DNA, 25 bp, Rattus norvegicus
gaaaccagtctttattatgccataa

SEQ ID NO: 285530 - DNA, 25 bp, Rattus norvegicus
gaaaccagtcttttggccttacact

SEQ ID NO: 285531 - DNA, 25 bp, Rattus norvegicus
gaaaccagtgacattcgtggctgtg

SEQ ID NO: 285532 - DNA, 25 bp, Rattus norvegicus
gaaaccagtgactttcgtggctgtg

SEQ ID NO: 285533 - DNA, 25 bp, Rattus norvegicus
gaaaccagtgatatgcaacatacca

SEQ ID NO: 285534 - DNA, 25 bp, Rattus norvegicus
gaaaccagtgatttgcaacatacca

SEQ ID NO: 285535 - DNA, 25 bp, Rattus norvegicus
gaaaccagtgggattttactgcaga

SEQ ID NO: 285536 - DNA, 25 bp, Rattus norvegicus
gaaaccagtgggtttttactgcaga

SEQ ID NO: 285537 - DNA, 25 bp, Rattus norvegicus
gaaaccagtggtagtatacctctgt

SEQ ID NO: 285538 - DNA, 25 bp, Rattus norvegicus
gaaaccagtggttgtatacctctgt

SEQ ID NO: 285539 - DNA, 25 bp, Rattus norvegicus
gaaaccagtgtgaatcccagactat

SEQ ID NO: 285540 - DNA, 25 bp, Rattus norvegicus
gaaaccagtgtgtatcccagactat

SEQ ID NO: 285541 - DNA, 25 bp, Rattus norvegicus
gaaaccagttatcccaatttttatc

SEQ ID NO: 285542 - DNA, 25 bp, Rattus norvegicus
gaaaccagttatgccaatttttatc

SEQ ID NO: 285543 - DNA, 25 bp, Rattus norvegicus
gaaaccatagcaataaggaacccat

SEQ ID NO: 285544 - DNA, 25 bp, Rattus norvegicus
gaaaccatagcattaaggaacccat

SEQ ID NO: 285545 - DNA, 25 bp, Rattus norvegicus
gaaaccatagcgaaaggtccctgac

SEQ ID NO: 285546 - DNA, 25 bp, Rattus norvegicus
gaaaccatagcgtaaggtccctgac

SEQ ID NO: 285547 - DNA, 25 bp, Rattus norvegicus
gaaaccatatttactttgtactgtg

SEQ ID NO: 285548 - DNA, 25 bp, Rattus norvegicus
gaaaccatattttctttgtactgtg

SEQ ID NO: 285549 - DNA, 25 bp, Rattus norvegicus
gaaaccatcaaaactcttactccta

SEQ ID NO: 285550 - DNA, 25 bp, Rattus norvegicus
gaaaccatcaaatctcttactccta

SEQ ID NO: 285551 - DNA, 25 bp, Rattus norvegicus
gaaaccatcagccacactgtgaacg

SEQ ID NO: 285552 - DNA, 25 bp, Rattus norvegicus
gaaaccatcagcgacactgtgaacg

SEQ ID NO: 285553 - DNA, 25 bp, Rattus norvegicus
gaaaccatcattacggaccaggata

SEQ ID NO: 285554 - DNA, 25 bp, Rattus norvegicus
gaaaccatcatttcggaccaggata

SEQ ID NO: 285555 - DNA, 25 bp, Rattus norvegicus
gaaaccatcctgaccagacacgaaa

SEQ ID NO: 285556 - DNA, 25 bp, Rattus norvegicus
gaaaccatcctgtccagacacgaaa

SEQ ID NO: 285557 - DNA, 25 bp, Rattus norvegicus
gaaaccatcgaaatgcggctagtta

SEQ ID NO: 285558 - DNA, 25 bp, Rattus norvegicus
gaaaccatcgaattgcggctagtta

SEQ ID NO: 285559 - DNA, 25 bp, Rattus norvegicus
gaaaccatcgatcaccgggagactg

SEQ ID NO: 285560 - DNA, 25 bp, Rattus norvegicus
gaaaccatcgatgaccgggagactg

SEQ ID NO: 285561 - DNA, 25 bp, Rattus norvegicus
gaaaccatctagacactgggatcca

SEQ ID NO: 285562 - DNA, 25 bp, Rattus norvegicus
gaaaccatctagtcactgggatcca

SEQ ID NO: 285563 - DNA, 25 bp, Rattus norvegicus
gaaaccatctgaagctcacacgtag

SEQ ID NO: 285564 - DNA, 25 bp, Rattus norvegicus
gaaaccatctgatgctcacacgtag

SEQ ID NO: 285565 - DNA, 25 bp, Rattus norvegicus
gaaaccatcttacaggacgacattg

SEQ ID NO: 285566 - DNA, 25 bp, Rattus norvegicus
gaaaccatcttagaggacgacattg

SEQ ID NO: 285567 - DNA, 25 bp, Rattus norvegicus
gaaaccatcttcatactggaatcaa

SEQ ID NO: 285568 - DNA, 25 bp, Rattus norvegicus
gaaaccatcttcttactggaatcaa

SEQ ID NO: 285569 - DNA, 25 bp, Rattus norvegicus
gaaaccatggagctgatactcccct

SEQ ID NO: 285570 - DNA, 25 bp, Rattus norvegicus
gaaaccatggaggtgatactcccct

SEQ ID NO: 285571 - DNA, 25 bp, Rattus norvegicus
gaaaccatggccagtgaccaggacc

SEQ ID NO: 285572 - DNA, 25 bp, Rattus norvegicus
gaaaccatggcccatattctctctc

SEQ ID NO: 285573 - DNA, 25 bp, Rattus norvegicus
gaaaccatggccgatattctctctc

SEQ ID NO: 285574 - DNA, 25 bp, Rattus norvegicus
gaaaccatggcctgtgaccaggacc

SEQ ID NO: 285575 - DNA, 25 bp, Rattus norvegicus
gaaaccatgtctacgtgactgtgac

SEQ ID NO: 285576 - DNA, 25 bp, Rattus norvegicus
gaaaccatgtcttcgtgactgtgac

SEQ ID NO: 285577 - DNA, 25 bp, Rattus norvegicus
gaaaccatgttcacagccaagtcca

SEQ ID NO: 285578 - DNA, 25 bp, Rattus norvegicus
gaaaccatgttctcagccaagtcca

SEQ ID NO: 285579 - DNA, 25 bp, Rattus norvegicus
gaaaccattcctacgacacttactt

SEQ ID NO: 285580 - DNA, 25 bp, Rattus norvegicus
gaaaccattccttcgacacttactt

SEQ ID NO: 285581 - DNA, 25 bp, Rattus norvegicus
gaaaccattgagcttcccagcagag

SEQ ID NO: 285582 - DNA, 25 bp, Rattus norvegicus
gaaaccattgaggttcccagcagag

SEQ ID NO: 285583 - DNA, 25 bp, Rattus norvegicus
gaaaccattgcaatcttatacactg

SEQ ID NO: 285584 - DNA, 25 bp, Rattus norvegicus
gaaaccattgcacagagaacccgac

SEQ ID NO: 285585 - DNA, 25 bp, Rattus norvegicus
gaaaccattgcagagagaacccgac

SEQ ID NO: 285586 - DNA, 25 bp, Rattus norvegicus
gaaaccattgcattcttatacactg

SEQ ID NO: 285587 - DNA, 25 bp, Rattus norvegicus
gaaaccattgctatttgccaagctg

SEQ ID NO: 285588 - DNA, 25 bp, Rattus norvegicus
gaaaccattgctttttgccaagctg

SEQ ID NO: 285589 - DNA, 25 bp, Rattus norvegicus
gaaaccattgttagagttgtcttac

SEQ ID NO: 285590 - DNA, 25 bp, Rattus norvegicus
gaaaccattgtttgagttgtcttac

SEQ ID NO: 285591 - DNA, 25 bp, Rattus norvegicus
gaaaccatttaaccagcaagcagaa

SEQ ID NO: 285592 - DNA, 25 bp, Rattus norvegicus
gaaaccatttaagcagcaagcagaa

SEQ ID NO: 285593 - DNA, 25 bp, Rattus norvegicus
gaaaccatttcaatttgactgccaa

SEQ ID NO: 285594 - DNA, 25 bp, Rattus norvegicus
gaaaccatttcattttgactgccaa

SEQ ID NO: 285595 - DNA, 25 bp, Rattus norvegicus
gaaaccattttgacagtctcttctg

SEQ ID NO: 285596 - DNA, 25 bp, Rattus norvegicus
gaaaccattttgtcagtctcttctg

SEQ ID NO: 285597 - DNA, 25 bp, Rattus norvegicus
gaaacccaaagaatcaatcccctgg

SEQ ID NO: 285598 - DNA, 25 bp, Rattus norvegicus
gaaacccaaagattcaatcccctgg

SEQ ID NO: 285599 - DNA, 25 bp, Rattus norvegicus
gaaacccaacatagcaattctctta

SEQ ID NO: 285600 - DNA, 25 bp, Rattus norvegicus
gaaacccaacattgcaattctctta

SEQ ID NO: 285601 - DNA, 25 bp, Rattus norvegicus
gaaacccaagatagcattgtctcaa

SEQ ID NO: 285602 - DNA, 25 bp, Rattus norvegicus
gaaacccaagatcagttgtcccaag

SEQ ID NO: 285603 - DNA, 25 bp, Rattus norvegicus
gaaacccaagatgagttgtcccaag

SEQ ID NO: 285604 - DNA, 25 bp, Rattus norvegicus
gaaacccaagattgcattgtctcaa

SEQ ID NO: 285605 - DNA, 25 bp, Rattus norvegicus
gaaacccaaggtatccaatgaacag

SEQ ID NO: 285606 - DNA, 25 bp, Rattus norvegicus
gaaacccaaggtcttactgcgcgca

SEQ ID NO: 285607 - DNA, 25 bp, Rattus norvegicus
gaaacccaaggtgttactgcgcgca

SEQ ID NO: 285608 - DNA, 25 bp, Rattus norvegicus
gaaacccaaggtttccaatgaacag

SEQ ID NO: 285609 - DNA, 25 bp, Rattus norvegicus
gaaacccaagtgcagtaggcaacgt

SEQ ID NO: 285610 - DNA, 25 bp, Rattus norvegicus
gaaacccaagtggagtaggcaacgt

SEQ ID NO: 285611 - DNA, 25 bp, Rattus norvegicus
gaaacccaagttctctttcacagat

SEQ ID NO: 285612 - DNA, 25 bp, Rattus norvegicus
gaaacccaagttgtctttcacagat

SEQ ID NO: 285613 - DNA, 25 bp, Rattus norvegicus
gaaacccaatacaactattattttg

SEQ ID NO: 285614 - DNA, 25 bp, Rattus norvegicus
gaaacccaatactactattattttg

SEQ ID NO: 285615 - DNA, 25 bp, Rattus norvegicus
gaaacccaatcactgggcctggaga

SEQ ID NO: 285616 - DNA, 25 bp, Rattus norvegicus
gaaacccaatcagtgggcctggaga

SEQ ID NO: 285617 - DNA, 25 bp, Rattus norvegicus
gaaacccacaatcctgctattataa

SEQ ID NO: 285618 - DNA, 25 bp, Rattus norvegicus
gaaacccacaatgctgctattataa

SEQ ID NO: 285619 - DNA, 25 bp, Rattus norvegicus
gaaacccacagtatacctttcccag

SEQ ID NO: 285620 - DNA, 25 bp, Rattus norvegicus
gaaacccacagtttacctttcccag

SEQ ID NO: 285621 - DNA, 25 bp, Rattus norvegicus
gaaacccacgcaattgtgcttcttt

SEQ ID NO: 285622 - DNA, 25 bp, Rattus norvegicus
gaaacccacgcatttgtgcttcttt

SEQ ID NO: 285623 - DNA, 25 bp, Rattus norvegicus
gaaacccacgcccagaggatgatca

SEQ ID NO: 285624 - DNA, 25 bp, Rattus norvegicus
gaaacccacgccgagaggatgatca

SEQ ID NO: 285625 - DNA, 25 bp, Rattus norvegicus
gaaacccagagaagactcttccaga

SEQ ID NO: 285626 - DNA, 25 bp, Rattus norvegicus
gaaacccagagactggctccattga

SEQ ID NO: 285627 - DNA, 25 bp, Rattus norvegicus
gaaacccagagagtggctccattga

SEQ ID NO: 285628 - DNA, 25 bp, Rattus norvegicus
gaaacccagagatgactcttccaga

SEQ ID NO: 285629 - DNA, 25 bp, Rattus norvegicus
gaaacccagagcacgagtatcacag

SEQ ID NO: 285630 - DNA, 25 bp, Rattus norvegicus
gaaacccagagctcgagtatcacag

SEQ ID NO: 285631 - DNA, 25 bp, Rattus norvegicus
gaaacccagaggcacctctactctt

SEQ ID NO: 285632 - DNA, 25 bp, Rattus norvegicus
gaaacccagagggacctctactctt

SEQ ID NO: 285633 - DNA, 25 bp, Rattus norvegicus
gaaacccagattagtaccctgtgtt

SEQ ID NO: 285634 - DNA, 25 bp, Rattus norvegicus
gaaacccagattctggtctcccttt

SEQ ID NO: 285635 - DNA, 25 bp, Rattus norvegicus
gaaacccagattgtggtctcccttt

SEQ ID NO: 285636 - DNA, 25 bp, Rattus norvegicus
gaaacccagatttgtaccctgtgtt

SEQ ID NO: 285637 - DNA, 25 bp, Rattus norvegicus
gaaacccagcatccaatatgcaaat

SEQ ID NO: 285638 - DNA, 25 bp, Rattus norvegicus
gaaacccagcatgcaatatgcaaat

SEQ ID NO: 285639 - DNA, 25 bp, Rattus norvegicus
gaaacccagccacatgtgactcagt

SEQ ID NO: 285640 - DNA, 25 bp, Rattus norvegicus
gaaacccagccagatgtgactcagt

SEQ ID NO: 285641 - DNA, 25 bp, Rattus norvegicus
gaaacccagcgtacttcaggagatg

SEQ ID NO: 285642 - DNA, 25 bp, Rattus norvegicus
gaaacccagcgttcttcaggagatg

SEQ ID NO: 285643 - DNA, 25 bp, Rattus norvegicus
gaaacccaggacagcagatctgctc

SEQ ID NO: 285644 - DNA, 25 bp, Rattus norvegicus
gaaacccaggactgcagatctgctc

SEQ ID NO: 285645 - DNA, 25 bp, Rattus norvegicus
gaaacccaggctaataccaggcaag

SEQ ID NO: 285646 - DNA, 25 bp, Rattus norvegicus
gaaacccaggcttataccaggcaag

SEQ ID NO: 285647 - DNA, 25 bp, Rattus norvegicus
gaaacccagtcacgtcattgtggag

SEQ ID NO: 285648 - DNA, 25 bp, Rattus norvegicus
gaaacccagtcaggtcattgtggag

SEQ ID NO: 285649 - DNA, 25 bp, Rattus norvegicus
gaaacccagtgcattgagcatgtag

SEQ ID NO: 285650 - DNA, 25 bp, Rattus norvegicus
gaaacccagtgctttgagcatgtag

SEQ ID NO: 285651 - DNA, 25 bp, Rattus norvegicus
gaaacccatagcattccacatttga

SEQ ID NO: 285652 - DNA, 25 bp, Rattus norvegicus
gaaacccatagctttccacatttga

SEQ ID NO: 285653 - DNA, 25 bp, Rattus norvegicus
gaaacccatgaacatttgcaccact

SEQ ID NO: 285654 - DNA, 25 bp, Rattus norvegicus
gaaacccatgaagatttgcaccact

SEQ ID NO: 285655 - DNA, 25 bp, Rattus norvegicus
gaaacccatgctattggatctgatg

SEQ ID NO: 285656 - DNA, 25 bp, Rattus norvegicus
gaaacccatgcttttggatctgatg

SEQ ID NO: 285657 - DNA, 25 bp, Rattus norvegicus
gaaacccatggactttgtcctttgt

SEQ ID NO: 285658 - DNA, 25 bp, Rattus norvegicus
gaaacccatggagtttgtcctttgt

SEQ ID NO: 285659 - DNA, 25 bp, Rattus norvegicus
gaaacccattatcagtggacatcta

SEQ ID NO: 285660 - DNA, 25 bp, Rattus norvegicus
gaaacccattatgagtggacatcta

SEQ ID NO: 285661 - DNA, 25 bp, Rattus norvegicus
gaaacccattgtattcacataaaga

SEQ ID NO: 285662 - DNA, 25 bp, Rattus norvegicus
gaaacccattgttttcacataaaga

SEQ ID NO: 285663 - DNA, 25 bp, Rattus norvegicus
gaaacccatttacttaggactgtgc

SEQ ID NO: 285664 - DNA, 25 bp, Rattus norvegicus
gaaacccatttagttaggactgtgc

SEQ ID NO: 285665 - DNA, 25 bp, Rattus norvegicus
gaaacccatttcatggcctaaatat

SEQ ID NO: 285666 - DNA, 25 bp, Rattus norvegicus
gaaacccatttcttggcctaaatat

SEQ ID NO: 285667 - DNA, 25 bp, Rattus norvegicus
gaaaccccaaatcaggtgctcttga

SEQ ID NO: 285668 - DNA, 25 bp, Rattus norvegicus
gaaaccccaaatgaggtgctcttga

SEQ ID NO: 285669 - DNA, 25 bp, Rattus norvegicus
gaaaccccaatactgtgcatgatgc

SEQ ID NO: 285670 - DNA, 25 bp, Rattus norvegicus
gaaaccccaatagtgtgcatgatgc

SEQ ID NO: 285671 - DNA, 25 bp, Rattus norvegicus
gaaaccccaatgcacttcctgtctt

SEQ ID NO: 285672 - DNA, 25 bp, Rattus norvegicus
gaaaccccaatggacttcctgtctt

SEQ ID NO: 285673 - DNA, 25 bp, Rattus norvegicus
gaaaccccactgcagaggcactggt

SEQ ID NO: 285674 - DNA, 25 bp, Rattus norvegicus
gaaaccccactggagaggcactggt

SEQ ID NO: 285675 - DNA, 25 bp, Rattus norvegicus
gaaaccccagccatactatgatgtt

SEQ ID NO: 285676 - DNA, 25 bp, Rattus norvegicus
gaaaccccagccttactatgatgtt

SEQ ID NO: 285677 - DNA, 25 bp, Rattus norvegicus
gaaaccccaggacctcttaatagag

SEQ ID NO: 285678 - DNA, 25 bp, Rattus norvegicus
gaaaccccaggagctcttaatagag

SEQ ID NO: 285679 - DNA, 25 bp, Rattus norvegicus
gaaaccccagggactgctgctgaga

SEQ ID NO: 285680 - DNA, 25 bp, Rattus norvegicus
gaaaccccagggtctgctgctgaga

SEQ ID NO: 285681 - DNA, 25 bp, Rattus norvegicus
gaaaccccatacattccatgtgtat

SEQ ID NO: 285682 - DNA, 25 bp, Rattus norvegicus
gaaaccccatactttccatgtgtat

SEQ ID NO: 285683 - DNA, 25 bp, Rattus norvegicus
gaaacccctactctgcatattgcaa

SEQ ID NO: 285684 - DNA, 25 bp, Rattus norvegicus
gaaacccctactgtgcatattgcaa

SEQ ID NO: 285685 - DNA, 25 bp, Rattus norvegicus
gaaacccctcatacttcaaaatata

SEQ ID NO: 285686 - DNA, 25 bp, Rattus norvegicus
gaaacccctcatctaaaccaggctg

SEQ ID NO: 285687 - DNA, 25 bp, Rattus norvegicus
gaaacccctcatgtaaaccaggctg

SEQ ID NO: 285688 - DNA, 25 bp, Rattus norvegicus
gaaacccctcattcttcaaaatata

SEQ ID NO: 285689 - DNA, 25 bp, Rattus norvegicus
gaaacccctgctatgctcttagtca

SEQ ID NO: 285690 - DNA, 25 bp, Rattus norvegicus
gaaacccctgctttgctcttagtca

SEQ ID NO: 285691 - DNA, 25 bp, Rattus norvegicus
gaaaccccttctcagaccaaagtat

SEQ ID NO: 285692 - DNA, 25 bp, Rattus norvegicus
gaaaccccttctgagaccaaagtat

SEQ ID NO: 285693 - DNA, 25 bp, Rattus norvegicus
gaaaccccttgcagaaattcctatt

SEQ ID NO: 285694 - DNA, 25 bp, Rattus norvegicus
gaaaccccttgctgaaattcctatt

SEQ ID NO: 285695 - DNA, 25 bp, Rattus norvegicus
gaaacccgagcccttggacgagagt

SEQ ID NO: 285696 - DNA, 25 bp, Rattus norvegicus
gaaacccgagccgttggacgagagt

SEQ ID NO: 285697 - DNA, 25 bp, Rattus norvegicus
gaaacccgaggacgtgccatacagt

SEQ ID NO: 285698 - DNA, 25 bp, Rattus norvegicus
gaaacccgaggaggtgccatacagt

SEQ ID NO: 285699 - DNA, 25 bp, Rattus norvegicus
gaaacccgagtcatctttatgcact

SEQ ID NO: 285700 - DNA, 25 bp, Rattus norvegicus
gaaacccgagtcttctttatgcact

SEQ ID NO: 285701 - DNA, 25 bp, Rattus norvegicus
gaaacccggagccactttgtaatga

SEQ ID NO: 285702 - DNA, 25 bp, Rattus norvegicus
gaaacccggagcgactttgtaatga

SEQ ID NO: 285703 - DNA, 25 bp, Rattus norvegicus
gaaacccggcctccacggatctggg

SEQ ID NO: 285704 - DNA, 25 bp, Rattus norvegicus
gaaacccggcctgcacggatctggg

SEQ ID NO: 285705 - DNA, 25 bp, Rattus norvegicus
gaaacccgtaagagaaggcactcag

SEQ ID NO: 285706 - DNA, 25 bp, Rattus norvegicus
gaaacccgtaagtgaaggcactcag

SEQ ID NO: 285707 - DNA, 25 bp, Rattus norvegicus
gaaacccgtcttagagatgtgccac

SEQ ID NO: 285708 - DNA, 25 bp, Rattus norvegicus
gaaacccgtctttgagatgtgccac

SEQ ID NO: 285709 - DNA, 25 bp, Rattus norvegicus
gaaacccgtggcagacagcgaaacc

SEQ ID NO: 285710 - DNA, 25 bp, Rattus norvegicus
gaaacccgtggctgacagcgaaacc

SEQ ID NO: 285711 - DNA, 25 bp, Rattus norvegicus
gaaaccctaaggagacactgtcatc

SEQ ID NO: 285712 - DNA, 25 bp, Rattus norvegicus
gaaaccctaaggatacagcttgaga

SEQ ID NO: 285713 - DNA, 25 bp, Rattus norvegicus
gaaaccctaaggtgacactgtcatc

SEQ ID NO: 285714 - DNA, 25 bp, Rattus norvegicus
gaaaccctaaggttacagcttgaga

SEQ ID NO: 285715 - DNA, 25 bp, Rattus norvegicus
gaaaccctacaactgcacagaatgt

SEQ ID NO: 285716 - DNA, 25 bp, Rattus norvegicus
gaaaccctacaagtgcacagaatgt

SEQ ID NO: 285717 - DNA, 25 bp, Rattus norvegicus
gaaaccctacctctatctagaaaag

SEQ ID NO: 285718 - DNA, 25 bp, Rattus norvegicus
gaaaccctacctgtatctagaaaag

SEQ ID NO: 285719 - DNA, 25 bp, Rattus norvegicus
gaaaccctacgaagtaaactgatcc

SEQ ID NO: 285720 - DNA, 25 bp, Rattus norvegicus
gaaaccctacgatgtaaactgatcc

SEQ ID NO: 285721 - DNA, 25 bp, Rattus norvegicus
gaaaccctagaactttgggcacgct

SEQ ID NO: 285722 - DNA, 25 bp, Rattus norvegicus
gaaaccctagaagtttgggcacgct

SEQ ID NO: 285723 - DNA, 25 bp, Rattus norvegicus
gaaaccctagtaccctagtgcaatt

SEQ ID NO: 285724 - DNA, 25 bp, Rattus norvegicus
gaaaccctagtagcctagtgcaatt

SEQ ID NO: 285725 - DNA, 25 bp, Rattus norvegicus
gaaaccctataaatgcgtggactgc

SEQ ID NO: 285726 - DNA, 25 bp, Rattus norvegicus
gaaaccctataattgcgtggactgc

SEQ ID NO: 285727 - DNA, 25 bp, Rattus norvegicus
gaaaccctcaagaaccaatatgcac

SEQ ID NO: 285728 - DNA, 25 bp, Rattus norvegicus
gaaaccctcaagtaccaatatgcac

SEQ ID NO: 285729 - DNA, 25 bp, Rattus norvegicus
gaaaccctcacaaaccaagtagcat

SEQ ID NO: 285730 - DNA, 25 bp, Rattus norvegicus
gaaaccctcacataccaagtagcat

SEQ ID NO: 285731 - DNA, 25 bp, Rattus norvegicus
gaaaccctcagacgtgtgagattta

SEQ ID NO: 285732 - DNA, 25 bp, Rattus norvegicus
gaaaccctcagaggtgtgagattta

SEQ ID NO: 285733 - DNA, 25 bp, Rattus norvegicus
gaaaccctcatgatgattcctaagt

SEQ ID NO: 285734 - DNA, 25 bp, Rattus norvegicus
gaaaccctcatgttgattcctaagt

SEQ ID NO: 285735 - DNA, 25 bp, Rattus norvegicus
gaaaccctccagacttcggaaggat

SEQ ID NO: 285736 - DNA, 25 bp, Rattus norvegicus
gaaaccctccagtcttcggaaggat

SEQ ID NO: 285737 - DNA, 25 bp, Rattus norvegicus
gaaaccctgattaagcccttggaga

SEQ ID NO: 285738 - DNA, 25 bp, Rattus norvegicus
gaaaccctgatttagcccttggaga

SEQ ID NO: 285739 - DNA, 25 bp, Rattus norvegicus
gaaaccctgcagcacagctgtaaca

SEQ ID NO: 285740 - DNA, 25 bp, Rattus norvegicus
gaaaccctgcaggacagctgtaaca

SEQ ID NO: 285741 - DNA, 25 bp, Rattus norvegicus
gaaaccctggagaagcccatggctg

SEQ ID NO: 285742 - DNA, 25 bp, Rattus norvegicus
gaaaccctggagtagcccatggctg

SEQ ID NO: 285743 - DNA, 25 bp, Rattus norvegicus
gaaaccctgtgcattggtctggagc

SEQ ID NO: 285744 - DNA, 25 bp, Rattus norvegicus
gaaaccctgtgctttggtctggagc

SEQ ID NO: 285745 - DNA, 25 bp, Rattus norvegicus
gaaaccctgtttatagcacttcaat

SEQ ID NO: 285746 - DNA, 25 bp, Rattus norvegicus
gaaaccctgtttttagcacttcaat

SEQ ID NO: 285747 - DNA, 25 bp, Rattus norvegicus
gaaacccttactctttaagtatcat

SEQ ID NO: 285748 - DNA, 25 bp, Rattus norvegicus
gaaacccttactgtttaagtatcat

SEQ ID NO: 285749 - DNA, 25 bp, Rattus norvegicus
gaaacccttatcactactgtcgagt

SEQ ID NO: 285750 - DNA, 25 bp, Rattus norvegicus
gaaacccttatctctactgtcgagt

SEQ ID NO: 285751 - DNA, 25 bp, Rattus norvegicus
gaaacccttcaactacaatctttgc

SEQ ID NO: 285752 - DNA, 25 bp, Rattus norvegicus
gaaacccttcaagtacaatctttgc

SEQ ID NO: 285753 - DNA, 25 bp, Rattus norvegicus
gaaacccttgacacatgtatgccaa

SEQ ID NO: 285754 - DNA, 25 bp, Rattus norvegicus
gaaacccttgactcatgtatgccaa

SEQ ID NO: 285755 - DNA, 25 bp, Rattus norvegicus
gaaacccttgatcaataggatgcct

SEQ ID NO: 285756 - DNA, 25 bp, Rattus norvegicus
gaaacccttgatgaataggatgcct

SEQ ID NO: 285757 - DNA, 25 bp, Rattus norvegicus
gaaacccttgttctcagatcatagc

SEQ ID NO: 285758 - DNA, 25 bp, Rattus norvegicus
gaaacccttgttgtcagatcatagc

SEQ ID NO: 285759 - DNA, 25 bp, Rattus norvegicus
gaaaccctttcacgttgtgaggata

SEQ ID NO: 285760 - DNA, 25 bp, Rattus norvegicus
gaaaccctttcaggttgtgaggata

SEQ ID NO: 285761 - DNA, 25 bp, Rattus norvegicus
gaaaccctttccatatgatttgaag

SEQ ID NO: 285762 - DNA, 25 bp, Rattus norvegicus
gaaaccctttccttatgatttgaag

SEQ ID NO: 285763 - DNA, 25 bp, Rattus norvegicus
gaaaccgaatgaaacctgtcgttat

SEQ ID NO: 285764 - DNA, 25 bp, Rattus norvegicus
gaaaccgaatgatacctgtcgttat

SEQ ID NO: 285765 - DNA, 25 bp, Rattus norvegicus
gaaaccgacgtcctgtgatgctaac

SEQ ID NO: 285766 - DNA, 25 bp, Rattus norvegicus
gaaaccgacgtcgtgtgatgctaac

SEQ ID NO: 285767 - DNA, 25 bp, Rattus norvegicus
gaaaccgactctctagtgctgatag

SEQ ID NO: 285768 - DNA, 25 bp, Rattus norvegicus
gaaaccgactctgtagtgctgatag

SEQ ID NO: 285769 - DNA, 25 bp, Rattus norvegicus
gaaaccgagcataacgagaaactat

SEQ ID NO: 285770 - DNA, 25 bp, Rattus norvegicus
gaaaccgagcattacgagaaactat

SEQ ID NO: 285771 - DNA, 25 bp, Rattus norvegicus
gaaaccgaggctcctggacattgaa

SEQ ID NO: 285772 - DNA, 25 bp, Rattus norvegicus
gaaaccgaggctgctggacattgaa

SEQ ID NO: 285773 - DNA, 25 bp, Rattus norvegicus
gaaaccgagggcagccatagcaact

SEQ ID NO: 285774 - DNA, 25 bp, Rattus norvegicus
gaaaccgagggctgccatagcaact

SEQ ID NO: 285775 - DNA, 25 bp, Rattus norvegicus
gaaaccgaggtcacagcagaagcag

SEQ ID NO: 285776 - DNA, 25 bp, Rattus norvegicus
gaaaccgaggtcctaaggctcttag

SEQ ID NO: 285777 - DNA, 25 bp, Rattus norvegicus
gaaaccgaggtcgtaaggctcttag

SEQ ID NO: 285778 - DNA, 25 bp, Rattus norvegicus
gaaaccgaggtctcagcagaagcag

SEQ ID NO: 285779 - DNA, 25 bp, Rattus norvegicus
gaaaccgaggttcagcggcctcctc

SEQ ID NO: 285780 - DNA, 25 bp, Rattus norvegicus
gaaaccgaggttgagcggcctcctc

SEQ ID NO: 285781 - DNA, 25 bp, Rattus norvegicus
gaaaccgagtctctgtggatctcaa

SEQ ID NO: 285782 - DNA, 25 bp, Rattus norvegicus
gaaaccgagtctgtgtggatctcaa

SEQ ID NO: 285783 - DNA, 25 bp, Rattus norvegicus
gaaaccgattcaaaggcctccagtt

SEQ ID NO: 285784 - DNA, 25 bp, Rattus norvegicus
gaaaccgattcataggcctccagtt

SEQ ID NO: 285785 - DNA, 25 bp, Rattus norvegicus
gaaaccgcagcaatacttaagcatc

SEQ ID NO: 285786 - DNA, 25 bp, Rattus norvegicus
gaaaccgcagcattacttaagcatc

SEQ ID NO: 285787 - DNA, 25 bp, Rattus norvegicus
gaaaccgcagctaacccaagaggag

SEQ ID NO: 285788 - DNA, 25 bp, Rattus norvegicus
gaaaccgcagcttacccaagaggag

SEQ ID NO: 285789 - DNA, 25 bp, Rattus norvegicus
gaaaccgcatgaacatgaccaaccc

SEQ ID NO: 285790 - DNA, 25 bp, Rattus norvegicus
gaaaccgcatgatcatgaccaaccc

SEQ ID NO: 285791 - DNA, 25 bp, Rattus norvegicus
gaaaccgccaggagttcaggtctca

SEQ ID NO: 285792 - DNA, 25 bp, Rattus norvegicus
gaaaccgccaggtgttcaggtctca

SEQ ID NO: 285793 - DNA, 25 bp, Rattus norvegicus
gaaaccgccatcaaatctggcatcc

SEQ ID NO: 285794 - DNA, 25 bp, Rattus norvegicus
gaaaccgccatctaatctggcatcc

SEQ ID NO: 285795 - DNA, 25 bp, Rattus norvegicus
gaaaccgcctgcattctaatgagct

SEQ ID NO: 285796 - DNA, 25 bp, Rattus norvegicus
gaaaccgcctgctttctaatgagct

SEQ ID NO: 285797 - DNA, 25 bp, Rattus norvegicus
gaaaccgcgtgtatggaccttgtgc

SEQ ID NO: 285798 - DNA, 25 bp, Rattus norvegicus
gaaaccgcgtgtttggaccttgtgc

SEQ ID NO: 285799 - DNA, 25 bp, Rattus norvegicus
gaaaccgctggtagaagcccatgct

SEQ ID NO: 285800 - DNA, 25 bp, Rattus norvegicus
gaaaccgctggttgaagcccatgct

SEQ ID NO: 285801 - DNA, 25 bp, Rattus norvegicus
gaaaccgcttccaggagcgccagag

SEQ ID NO: 285802 - DNA, 25 bp, Rattus norvegicus
gaaaccgcttcctggagcgccagag

SEQ ID NO: 285803 - DNA, 25 bp, Rattus norvegicus
gaaaccggacagacacctctggaaa

SEQ ID NO: 285804 - DNA, 25 bp, Rattus norvegicus
gaaaccggacagtcacctctggaaa

SEQ ID NO: 285805 - DNA, 25 bp, Rattus norvegicus
gaaaccggaggtcccaaagaccagc

SEQ ID NO: 285806 - DNA, 25 bp, Rattus norvegicus
gaaaccggaggtgccaaagaccagc

SEQ ID NO: 285807 - DNA, 25 bp, Rattus norvegicus
gaaaccggcccacctagagaaactg

SEQ ID NO: 285808 - DNA, 25 bp, Rattus norvegicus
gaaaccggcccagctagagaaactg

SEQ ID NO: 285809 - DNA, 25 bp, Rattus norvegicus
gaaaccgggagccttatgggtacat

SEQ ID NO: 285810 - DNA, 25 bp, Rattus norvegicus
gaaaccgggagcgttatgggtacat

SEQ ID NO: 285811 - DNA, 25 bp, Rattus norvegicus
gaaaccggtagtcttcacccgagtg

SEQ ID NO: 285812 - DNA, 25 bp, Rattus norvegicus
gaaaccggtagtgttcacccgagtg

SEQ ID NO: 285813 - DNA, 25 bp, Rattus norvegicus
gaaaccggttagacaatgttgtctt

SEQ ID NO: 285814 - DNA, 25 bp, Rattus norvegicus
gaaaccggttagtcaatgttgtctt

SEQ ID NO: 285815 - DNA, 25 bp, Rattus norvegicus
gaaaccgtaataagtcctggaagtt

SEQ ID NO: 285816 - DNA, 25 bp, Rattus norvegicus
gaaaccgtaatatgtcctggaagtt

SEQ ID NO: 285817 - DNA, 25 bp, Rattus norvegicus
gaaaccgtagtcattacagcaagca

SEQ ID NO: 285818 - DNA, 25 bp, Rattus norvegicus
gaaaccgtagtctttacagcaagca

SEQ ID NO: 285819 - DNA, 25 bp, Rattus norvegicus
gaaaccgtccagaagatcgatgcag

SEQ ID NO: 285820 - DNA, 25 bp, Rattus norvegicus
gaaaccgtccagtagatcgatgcag

SEQ ID NO: 285821 - DNA, 25 bp, Rattus norvegicus
gaaaccgtcttaatgttacttcgct

SEQ ID NO: 285822 - DNA, 25 bp, Rattus norvegicus
gaaaccgtcttattgttacttcgct

SEQ ID NO: 285823 - DNA, 25 bp, Rattus norvegicus
gaaaccgtcttcaagtacgcctggt

SEQ ID NO: 285824 - DNA, 25 bp, Rattus norvegicus
gaaaccgtcttctagtacgcctggt

SEQ ID NO: 285825 - DNA, 25 bp, Rattus norvegicus
gaaaccgtgactatcctatcacatg

SEQ ID NO: 285826 - DNA, 25 bp, Rattus norvegicus
gaaaccgtgactttcctatcacatg

SEQ ID NO: 285827 - DNA, 25 bp, Rattus norvegicus
gaaaccgtgcagatggtaacaggta

SEQ ID NO: 285828 - DNA, 25 bp, Rattus norvegicus
gaaaccgtgcagttggtaacaggta

SEQ ID NO: 285829 - DNA, 25 bp, Rattus norvegicus
gaaaccgtgtctatagcatgtgtat

SEQ ID NO: 285830 - DNA, 25 bp, Rattus norvegicus
gaaaccgtgtctttagcatgtgtat

SEQ ID NO: 285831 - DNA, 25 bp, Rattus norvegicus
gaaaccgttaaactggccatgtatt

SEQ ID NO: 285832 - DNA, 25 bp, Rattus norvegicus
gaaaccgttaaagtggccatgtatt

SEQ ID NO: 285833 - DNA, 25 bp, Rattus norvegicus
gaaaccgttggcattcctcttggtg

SEQ ID NO: 285834 - DNA, 25 bp, Rattus norvegicus
gaaaccgttggctttcctcttggtg

SEQ ID NO: 285835 - DNA, 25 bp, Rattus norvegicus
gaaaccgttgtaacagattacttat

SEQ ID NO: 285836 - DNA, 25 bp, Rattus norvegicus
gaaaccgttgtatcagattacttat

SEQ ID NO: 285837 - DNA, 25 bp, Rattus norvegicus
gaaacctaagacagcttcagcctag

SEQ ID NO: 285838 - DNA, 25 bp, Rattus norvegicus
gaaacctaagactgcttcagcctag

SEQ ID NO: 285839 - DNA, 25 bp, Rattus norvegicus
gaaacctaagccaggtctctgcatt

SEQ ID NO: 285840 - DNA, 25 bp, Rattus norvegicus
gaaacctaagcctggtctctgcatt

SEQ ID NO: 285841 - DNA, 25 bp, Rattus norvegicus
gaaacctaaggtctgcggagctact

SEQ ID NO: 285842 - DNA, 25 bp, Rattus norvegicus
gaaacctaaggtgtgcggagctact

SEQ ID NO: 285843 - DNA, 25 bp, Rattus norvegicus
gaaacctaagtccagtggcttctga

SEQ ID NO: 285844 - DNA, 25 bp, Rattus norvegicus
gaaacctaagtcgagtggcttctga

SEQ ID NO: 285845 - DNA, 25 bp, Rattus norvegicus
gaaacctacaaaaacattgagacag

SEQ ID NO: 285846 - DNA, 25 bp, Rattus norvegicus
gaaacctacaaacccatgcacctgg

SEQ ID NO: 285847 - DNA, 25 bp, Rattus norvegicus
gaaacctacaaagccatgcacctgg

SEQ ID NO: 285848 - DNA, 25 bp, Rattus norvegicus
gaaacctacaaatacattgagacag

SEQ ID NO: 285849 - DNA, 25 bp, Rattus norvegicus
gaaacctacactctgcacaagcgct

SEQ ID NO: 285850 - DNA, 25 bp, Rattus norvegicus
gaaacctacactgtgcacaagcgct

SEQ ID NO: 285851 - DNA, 25 bp, Rattus norvegicus
gaaacctactgtagaggccaggctt

SEQ ID NO: 285852 - DNA, 25 bp, Rattus norvegicus
gaaacctactgttgaggccaggctt

SEQ ID NO: 285853 - DNA, 25 bp, Rattus norvegicus
gaaacctagactcttgtccaagtgg

SEQ ID NO: 285854 - DNA, 25 bp, Rattus norvegicus
gaaacctagactgttgtccaagtgg

SEQ ID NO: 285855 - DNA, 25 bp, Rattus norvegicus
gaaacctagtcaatttggctatcct

SEQ ID NO: 285856 - DNA, 25 bp, Rattus norvegicus
gaaacctagtcattttggctatcct

SEQ ID NO: 285857 - DNA, 25 bp, Rattus norvegicus
gaaacctatatgcaatcttgcacaa

SEQ ID NO: 285858 - DNA, 25 bp, Rattus norvegicus
gaaacctatatggaatcttgcacaa

SEQ ID NO: 285859 - DNA, 25 bp, Rattus norvegicus
gaaacctatcatcgcagaatactat

SEQ ID NO: 285860 - DNA, 25 bp, Rattus norvegicus
gaaacctatcatggcagaatactat

SEQ ID NO: 285861 - DNA, 25 bp, Rattus norvegicus
gaaacctatctcagagctggacaga

SEQ ID NO: 285862 - DNA, 25 bp, Rattus norvegicus
gaaacctatctctgagctggacaga

SEQ ID NO: 285863 - DNA, 25 bp, Rattus norvegicus
gaaacctatgtcaacctggctggag

SEQ ID NO: 285864 - DNA, 25 bp, Rattus norvegicus
gaaacctatgtcatttatgtcgtcc

SEQ ID NO: 285865 - DNA, 25 bp, Rattus norvegicus
gaaacctatgtctacctggctggag

SEQ ID NO: 285866 - DNA, 25 bp, Rattus norvegicus
gaaacctatgtcttttatgtcgtcc

SEQ ID NO: 285867 - DNA, 25 bp, Rattus norvegicus
gaaacctcaaaaaacagctgtgcaa

SEQ ID NO: 285868 - DNA, 25 bp, Rattus norvegicus
gaaacctcaaaactactgcataatg

SEQ ID NO: 285869 - DNA, 25 bp, Rattus norvegicus
gaaacctcaaaagtactgcataatg

SEQ ID NO: 285870 - DNA, 25 bp, Rattus norvegicus
gaaacctcaaaatacagctgtgcaa

SEQ ID NO: 285871 - DNA, 25 bp, Rattus norvegicus
gaaacctcaacacaattcctaatgt

SEQ ID NO: 285872 - DNA, 25 bp, Rattus norvegicus
gaaacctcaacagaattcctaatgt

SEQ ID NO: 285873 - DNA, 25 bp, Rattus norvegicus
gaaacctcaatcagctgtgtctagt

SEQ ID NO: 285874 - DNA, 25 bp, Rattus norvegicus
gaaacctcaatcagtccattcttat

SEQ ID NO: 285875 - DNA, 25 bp, Rattus norvegicus
gaaacctcaatctgctgtgtctagt

SEQ ID NO: 285876 - DNA, 25 bp, Rattus norvegicus
gaaacctcaatctgtccattcttat

SEQ ID NO: 285877 - DNA, 25 bp, Rattus norvegicus
gaaacctcagaaactcctctctgaa

SEQ ID NO: 285878 - DNA, 25 bp, Rattus norvegicus
gaaacctcagaatctcctctctgaa

SEQ ID NO: 285879 - DNA, 25 bp, Rattus norvegicus
gaaacctcagacaaatagaactctt

SEQ ID NO: 285880 - DNA, 25 bp, Rattus norvegicus
gaaacctcagactaatagaactctt

SEQ ID NO: 285881 - DNA, 25 bp, Rattus norvegicus
gaaacctcagataaactaccgaaag

SEQ ID NO: 285882 - DNA, 25 bp, Rattus norvegicus
gaaacctcagattaactaccgaaag

SEQ ID NO: 285883 - DNA, 25 bp, Rattus norvegicus
gaaacctcagcaaggtctcctgaaa

SEQ ID NO: 285884 - DNA, 25 bp, Rattus norvegicus
gaaacctcagcatggtctcctgaaa

SEQ ID NO: 285885 - DNA, 25 bp, Rattus norvegicus
gaaacctcatcaatatctacatgtg

SEQ ID NO: 285886 - DNA, 25 bp, Rattus norvegicus
gaaacctcatcattatctacatgtg

SEQ ID NO: 285887 - DNA, 25 bp, Rattus norvegicus
gaaacctcattcacattacgacact

SEQ ID NO: 285888 - DNA, 25 bp, Rattus norvegicus
gaaacctcattctcattacgacact

SEQ ID NO: 285889 - DNA, 25 bp, Rattus norvegicus
gaaacctccaacatcaacgactttt

SEQ ID NO: 285890 - DNA, 25 bp, Rattus norvegicus
gaaacctccaacttcaacgactttt

SEQ ID NO: 285891 - DNA, 25 bp, Rattus norvegicus
gaaacctccagccttttccatgggt

SEQ ID NO: 285892 - DNA, 25 bp, Rattus norvegicus
gaaacctccagcgttttccatgggt

SEQ ID NO: 285893 - DNA, 25 bp, Rattus norvegicus
gaaacctccatgcacccagagttga

SEQ ID NO: 285894 - DNA, 25 bp, Rattus norvegicus
gaaacctccatggacccagagttga

SEQ ID NO: 285895 - DNA, 25 bp, Rattus norvegicus
gaaacctcccaaatggagcctgaga

SEQ ID NO: 285896 - DNA, 25 bp, Rattus norvegicus
gaaacctcccaattggagcctgaga

SEQ ID NO: 285897 - DNA, 25 bp, Rattus norvegicus
gaaacctcctcccagaagaacattt

SEQ ID NO: 285898 - DNA, 25 bp, Rattus norvegicus
gaaacctcctccgagaagaacattt

SEQ ID NO: 285899 - DNA, 25 bp, Rattus norvegicus
gaaacctcgctcctgattggcatat

SEQ ID NO: 285900 - DNA, 25 bp, Rattus norvegicus
gaaacctcgctcgtgattggcatat

SEQ ID NO: 285901 - DNA, 25 bp, Rattus norvegicus
gaaacctcgtgcattgagctaattg

SEQ ID NO: 285902 - DNA, 25 bp, Rattus norvegicus
gaaacctcgtgctttgagctaattg

SEQ ID NO: 285903 - DNA, 25 bp, Rattus norvegicus
gaaacctctacacagtgggtggctc

SEQ ID NO: 285904 - DNA, 25 bp, Rattus norvegicus
gaaacctctacagagtgggtggctc

SEQ ID NO: 285905 - DNA, 25 bp, Rattus norvegicus
gaaacctctaggcttgctgcttgct

SEQ ID NO: 285906 - DNA, 25 bp, Rattus norvegicus
gaaacctctagggttgctgcttgct

SEQ ID NO: 285907 - DNA, 25 bp, Rattus norvegicus
gaaacctctcaacccgctattgttt

SEQ ID NO: 285908 - DNA, 25 bp, Rattus norvegicus
gaaacctctcaagccgctattgttt

SEQ ID NO: 285909 - DNA, 25 bp, Rattus norvegicus
gaaacctctcccattaacaagatgc

SEQ ID NO: 285910 - DNA, 25 bp, Rattus norvegicus
gaaacctctccctttaacaagatgc

SEQ ID NO: 285911 - DNA, 25 bp, Rattus norvegicus
gaaacctctgaacccatgaggcaaa

SEQ ID NO: 285912 - DNA, 25 bp, Rattus norvegicus
gaaacctctgaagccatgaggcaaa

SEQ ID NO: 285913 - DNA, 25 bp, Rattus norvegicus
gaaacctctggaactgcggaagcat

SEQ ID NO: 285914 - DNA, 25 bp, Rattus norvegicus
gaaacctctggatctgcggaagcat

SEQ ID NO: 285915 - DNA, 25 bp, Rattus norvegicus
gaaacctctggtaactgtgcatcac

SEQ ID NO: 285916 - DNA, 25 bp, Rattus norvegicus
gaaacctctggtctctaggagattc

SEQ ID NO: 285917 - DNA, 25 bp, Rattus norvegicus
gaaacctctggtgtctaggagattc

SEQ ID NO: 285918 - DNA, 25 bp, Rattus norvegicus
gaaacctctggttactgtgcatcac

SEQ ID NO: 285919 - DNA, 25 bp, Rattus norvegicus
gaaacctctgtcataggcagctcaa

SEQ ID NO: 285920 - DNA, 25 bp, Rattus norvegicus
gaaacctctgtcttaggcagctcaa

SEQ ID NO: 285921 - DNA, 25 bp, Rattus norvegicus
gaaacctcttagcacaggccaggga

SEQ ID NO: 285922 - DNA, 25 bp, Rattus norvegicus
gaaacctcttaggacaggccaggga

SEQ ID NO: 285923 - DNA, 25 bp, Rattus norvegicus
gaaacctcttcaagttccttattgt

SEQ ID NO: 285924 - DNA, 25 bp, Rattus norvegicus
gaaacctcttcatgttccttattgt

SEQ ID NO: 285925 - DNA, 25 bp, Rattus norvegicus
gaaacctgaaaacattccatccaag

SEQ ID NO: 285926 - DNA, 25 bp, Rattus norvegicus
gaaacctgaaaagattccatccaag

SEQ ID NO: 285927 - DNA, 25 bp, Rattus norvegicus
gaaacctgaacgagaagtctctgtc

SEQ ID NO: 285928 - DNA, 25 bp, Rattus norvegicus
gaaacctgaacgtgaagtctctgtc

SEQ ID NO: 285929 - DNA, 25 bp, Rattus norvegicus
gaaacctgagaaaagatccctggaa

SEQ ID NO: 285930 - DNA, 25 bp, Rattus norvegicus
gaaacctgagaacaaaatacaaact

SEQ ID NO: 285931 - DNA, 25 bp, Rattus norvegicus
gaaacctgagaagaaaatacaaact

SEQ ID NO: 285932 - DNA, 25 bp, Rattus norvegicus
gaaacctgagaatagatccctggaa

SEQ ID NO: 285933 - DNA, 25 bp, Rattus norvegicus
gaaacctgatatattgtacactaat

SEQ ID NO: 285934 - DNA, 25 bp, Rattus norvegicus
gaaacctgatattttgtacactaat

SEQ ID NO: 285935 - DNA, 25 bp, Rattus norvegicus
gaaacctgatcgctgagtcctgtgt

SEQ ID NO: 285936 - DNA, 25 bp, Rattus norvegicus
gaaacctgatcggtgagtcctgtgt

SEQ ID NO: 285937 - DNA, 25 bp, Rattus norvegicus
gaaacctgatgactctgctaactac

SEQ ID NO: 285938 - DNA, 25 bp, Rattus norvegicus
gaaacctgatgagtctgctaactac

SEQ ID NO: 285939 - DNA, 25 bp, Rattus norvegicus
gaaacctgattgacatctgtgtgtt

SEQ ID NO: 285940 - DNA, 25 bp, Rattus norvegicus
gaaacctgattgtcatctgtgtgtt

SEQ ID NO: 285941 - DNA, 25 bp, Rattus norvegicus
gaaacctgatttacacacaccaaaa

SEQ ID NO: 285942 - DNA, 25 bp, Rattus norvegicus
gaaacctgattttcacacaccaaaa

SEQ ID NO: 285943 - DNA, 25 bp, Rattus norvegicus
gaaacctgcagcacagagtggaaat

SEQ ID NO: 285944 - DNA, 25 bp, Rattus norvegicus
gaaacctgcagctcagagtggaaat

SEQ ID NO: 285945 - DNA, 25 bp, Rattus norvegicus
gaaacctgccaactatgatgacatc

SEQ ID NO: 285946 - DNA, 25 bp, Rattus norvegicus
gaaacctgccaagtatgatgacatc

SEQ ID NO: 285947 - DNA, 25 bp, Rattus norvegicus
gaaacctgccttatattactatggg

SEQ ID NO: 285948 - DNA, 25 bp, Rattus norvegicus
gaaacctgccttttattactatggg

SEQ ID NO: 285949 - DNA, 25 bp, Rattus norvegicus
gaaacctgctcccagactcagtctt

SEQ ID NO: 285950 - DNA, 25 bp, Rattus norvegicus
gaaacctgctccgagactcagtctt

SEQ ID NO: 285951 - DNA, 25 bp, Rattus norvegicus
gaaacctgctgaactccattgctgt

SEQ ID NO: 285952 - DNA, 25 bp, Rattus norvegicus
gaaacctgctgatctccattgctgt

SEQ ID NO: 285953 - DNA, 25 bp, Rattus norvegicus
gaaacctggagaacctcagcttggc

SEQ ID NO: 285954 - DNA, 25 bp, Rattus norvegicus
gaaacctggagatcctcagcttggc

SEQ ID NO: 285955 - DNA, 25 bp, Rattus norvegicus
gaaacctggagtattcagatgctgc

SEQ ID NO: 285956 - DNA, 25 bp, Rattus norvegicus
gaaacctggagttttcagatgctgc

SEQ ID NO: 285957 - DNA, 25 bp, Rattus norvegicus
gaaacctggccgactgtcttcggag

SEQ ID NO: 285958 - DNA, 25 bp, Rattus norvegicus
gaaacctggccgtctgtcttcggag

SEQ ID NO: 285959 - DNA, 25 bp, Rattus norvegicus
gaaacctggctcagatgtttgtagg

SEQ ID NO: 285960 - DNA, 25 bp, Rattus norvegicus
gaaacctggctctgatgtttgtagg

SEQ ID NO: 285961 - DNA, 25 bp, Rattus norvegicus
gaaacctgggtacatctgggattct

SEQ ID NO: 285962 - DNA, 25 bp, Rattus norvegicus
gaaacctgggtagatctgggattct

SEQ ID NO: 285963 - DNA, 25 bp, Rattus norvegicus
gaaacctggtggcagcctccaggac

SEQ ID NO: 285964 - DNA, 25 bp, Rattus norvegicus
gaaacctggtgggagcctccaggac

SEQ ID NO: 285965 - DNA, 25 bp, Rattus norvegicus
gaaacctggttcaatccattgggaa

SEQ ID NO: 285966 - DNA, 25 bp, Rattus norvegicus
gaaacctggttcaggtagatgtccc

SEQ ID NO: 285967 - DNA, 25 bp, Rattus norvegicus
gaaacctggttctatccattgggaa

SEQ ID NO: 285968 - DNA, 25 bp, Rattus norvegicus
gaaacctggttctggtagatgtccc

SEQ ID NO: 285969 - DNA, 25 bp, Rattus norvegicus
gaaacctgtccaaatagatgccaaa

SEQ ID NO: 285970 - DNA, 25 bp, Rattus norvegicus
gaaacctgtccatatagatgccaaa

SEQ ID NO: 285971 - DNA, 25 bp, Rattus norvegicus
gaaacctgtctgaacagcgagtgta

SEQ ID NO: 285972 - DNA, 25 bp, Rattus norvegicus
gaaacctgtctgcaaaattagcttt

SEQ ID NO: 285973 - DNA, 25 bp, Rattus norvegicus
gaaacctgtctggaaaattagcttt

SEQ ID NO: 285974 - DNA, 25 bp, Rattus norvegicus
gaaacctgtctgtacagcgagtgta

SEQ ID NO: 285975 - DNA, 25 bp, Rattus norvegicus
gaaacctgtgctctcagatgttcat

SEQ ID NO: 285976 - DNA, 25 bp, Rattus norvegicus
gaaacctgtgctgtcagatgttcat

SEQ ID NO: 285977 - DNA, 25 bp, Rattus norvegicus
gaaacctgtggcatggatgcatctc

SEQ ID NO: 285978 - DNA, 25 bp, Rattus norvegicus
gaaacctgtggcttggatgcatctc

SEQ ID NO: 285979 - DNA, 25 bp, Rattus norvegicus
gaaacctgttacacgtgaatgctct

SEQ ID NO: 285980 - DNA, 25 bp, Rattus norvegicus
gaaacctgttactcgtgaatgctct

SEQ ID NO: 285981 - DNA, 25 bp, Rattus norvegicus
gaaacctgttctaacatcataatgc

SEQ ID NO: 285982 - DNA, 25 bp, Rattus norvegicus
gaaacctgttcttacatcataatgc

SEQ ID NO: 285983 - DNA, 25 bp, Rattus norvegicus
gaaacctgtttccaaatcttgacac

SEQ ID NO: 285984 - DNA, 25 bp, Rattus norvegicus
gaaacctgtttcgaaatcttgacac

SEQ ID NO: 285985 - DNA, 25 bp, Rattus norvegicus
gaaaccttacatcctcagggagcca

SEQ ID NO: 285986 - DNA, 25 bp, Rattus norvegicus
gaaaccttacatgctcagggagcca

SEQ ID NO: 285987 - DNA, 25 bp, Rattus norvegicus
gaaaccttaggcacttagttggaga

SEQ ID NO: 285988 - DNA, 25 bp, Rattus norvegicus
gaaaccttaggctcttagttggaga

SEQ ID NO: 285989 - DNA, 25 bp, Rattus norvegicus
gaaaccttagttatgatattggatg

SEQ ID NO: 285990 - DNA, 25 bp, Rattus norvegicus
gaaaccttagttttgatattggatg

SEQ ID NO: 285991 - DNA, 25 bp, Rattus norvegicus
gaaaccttcagaatctattgggcat

SEQ ID NO: 285992 - DNA, 25 bp, Rattus norvegicus
gaaaccttcagattctattgggcat

SEQ ID NO: 285993 - DNA, 25 bp, Rattus norvegicus
gaaaccttcataagcacctaattta

SEQ ID NO: 285994 - DNA, 25 bp, Rattus norvegicus
gaaaccttcatatgcacctaattta

SEQ ID NO: 285995 - DNA, 25 bp, Rattus norvegicus
gaaaccttccccattgatcagagta

SEQ ID NO: 285996 - DNA, 25 bp, Rattus norvegicus
gaaaccttcccctttgatcagagta

SEQ ID NO: 285997 - DNA, 25 bp, Rattus norvegicus
gaaaccttcctactcttgactagga

SEQ ID NO: 285998 - DNA, 25 bp, Rattus norvegicus
gaaaccttcctagtcttgactagga

SEQ ID NO: 285999 - DNA, 25 bp, Rattus norvegicus
gaaaccttccttctgcttcaagtaa

SEQ ID NO: 286000 - DNA, 25 bp, Rattus norvegicus
gaaaccttccttgtgcttcaagtaa

SEQ ID NO: 286001 - DNA, 25 bp, Rattus norvegicus
gaaaccttcggtagcacttagtgct

SEQ ID NO: 286002 - DNA, 25 bp, Rattus norvegicus
gaaaccttcggttgcacttagtgct

SEQ ID NO: 286003 - DNA, 25 bp, Rattus norvegicus
gaaaccttgaaacctccctattgtt

SEQ ID NO: 286004 - DNA, 25 bp, Rattus norvegicus
gaaaccttgaaagctccctattgtt

SEQ ID NO: 286005 - DNA, 25 bp, Rattus norvegicus
gaaaccttgacaagacagccagcta

SEQ ID NO: 286006 - DNA, 25 bp, Rattus norvegicus
gaaaccttgacatgacagccagcta

SEQ ID NO: 286007 - DNA, 25 bp, Rattus norvegicus
gaaaccttgaggaaaacccatgtga

SEQ ID NO: 286008 - DNA, 25 bp, Rattus norvegicus
gaaaccttgaggtaaacccatgtga

SEQ ID NO: 286009 - DNA, 25 bp, Rattus norvegicus
gaaaccttgcagctactgccggaga

SEQ ID NO: 286010 - DNA, 25 bp, Rattus norvegicus
gaaaccttgcaggtactgccggaga

SEQ ID NO: 286011 - DNA, 25 bp, Rattus norvegicus
gaaaccttggtcctgatgatagagt

SEQ ID NO: 286012 - DNA, 25 bp, Rattus norvegicus
gaaaccttggtcgtgatgatagagt

SEQ ID NO: 286013 - DNA, 25 bp, Rattus norvegicus
gaaaccttggtgcacagttcgttta

SEQ ID NO: 286014 - DNA, 25 bp, Rattus norvegicus
gaaaccttggtggacagttcgttta

SEQ ID NO: 286015 - DNA, 25 bp, Rattus norvegicus
gaaaccttgtttccttggacagaga

SEQ ID NO: 286016 - DNA, 25 bp, Rattus norvegicus
gaaaccttgtttgcttggacagaga

SEQ ID NO: 286017 - DNA, 25 bp, Rattus norvegicus
gaaacctttacaccttattgagatt

SEQ ID NO: 286018 - DNA, 25 bp, Rattus norvegicus
gaaacctttacagcttattgagatt

SEQ ID NO: 286019 - DNA, 25 bp, Rattus norvegicus
gaaacctttctgagaaccaaccagg

SEQ ID NO: 286020 - DNA, 25 bp, Rattus norvegicus
gaaacctttctgtgaaccaaccagg

SEQ ID NO: 286021 - DNA, 25 bp, Rattus norvegicus
gaaacctttcttctctaagcagact

SEQ ID NO: 286022 - DNA, 25 bp, Rattus norvegicus
gaaacctttcttgtctaagcagact

SEQ ID NO: 286023 - DNA, 25 bp, Rattus norvegicus
gaaacctttgttccaaacacacagt

SEQ ID NO: 286024 - DNA, 25 bp, Rattus norvegicus
gaaacctttgttgcaaacacacagt

SEQ ID NO: 286025 - DNA, 25 bp, Rattus norvegicus
gaaaccttttagcttgtattctgct

SEQ ID NO: 286026 - DNA, 25 bp, Rattus norvegicus
gaaaccttttaggttgtattctgct

SEQ ID NO: 286027 - DNA, 25 bp, Rattus norvegicus
gaaaccttttctctgaatggccttg

SEQ ID NO: 286028 - DNA, 25 bp, Rattus norvegicus
gaaaccttttctgtgaatggccttg

SEQ ID NO: 286029 - DNA, 25 bp, Rattus norvegicus
gaaacgaaatggaccacgtggtgac

SEQ ID NO: 286030 - DNA, 25 bp, Rattus norvegicus
gaaacgaaatggtccacgtggtgac

SEQ ID NO: 286031 - DNA, 25 bp, Rattus norvegicus
gaaacgaacactacttaccactcag

SEQ ID NO: 286032 - DNA, 25 bp, Rattus norvegicus
gaaacgaacacttcttaccactcag

SEQ ID NO: 286033 - DNA, 25 bp, Rattus norvegicus
gaaacgaatctccaattactaccga

SEQ ID NO: 286034 - DNA, 25 bp, Rattus norvegicus
gaaacgaatctcgaattactaccga

SEQ ID NO: 286035 - DNA, 25 bp, Rattus norvegicus
gaaacgaatgcacccattgaaggga

SEQ ID NO: 286036 - DNA, 25 bp, Rattus norvegicus
gaaacgaatgcagccattgaaggga

SEQ ID NO: 286037 - DNA, 25 bp, Rattus norvegicus
gaaacgacagagcttgctgggcctc

SEQ ID NO: 286038 - DNA, 25 bp, Rattus norvegicus
gaaacgacagaggttgctgggcctc

SEQ ID NO: 286039 - DNA, 25 bp, Rattus norvegicus
gaaacgaccgcgaacaagcagtaaa

SEQ ID NO: 286040 - DNA, 25 bp, Rattus norvegicus
gaaacgaccgcgactcgtagagaac

SEQ ID NO: 286041 - DNA, 25 bp, Rattus norvegicus
gaaacgaccgcgtacaagcagtaaa

SEQ ID NO: 286042 - DNA, 25 bp, Rattus norvegicus
gaaacgaccgcgtctcgtagagaac

SEQ ID NO: 286043 - DNA, 25 bp, Rattus norvegicus
gaaacgacggcacgagcttgctcgt

SEQ ID NO: 286044 - DNA, 25 bp, Rattus norvegicus
gaaacgacggcaggagcttgctcgt

SEQ ID NO: 286045 - DNA, 25 bp, Rattus norvegicus
gaaacgacttgtagccctgttgtta

SEQ ID NO: 286046 - DNA, 25 bp, Rattus norvegicus
gaaacgacttgttgccctgttgtta

SEQ ID NO: 286047 - DNA, 25 bp, Rattus norvegicus
gaaacgagaaccatagaccccagaa

SEQ ID NO: 286048 - DNA, 25 bp, Rattus norvegicus
gaaacgagaaccttagaccccagaa

SEQ ID NO: 286049 - DNA, 25 bp, Rattus norvegicus
gaaacgagaggccttgatccacgtc

SEQ ID NO: 286050 - DNA, 25 bp, Rattus norvegicus
gaaacgagaggcgttgatccacgtc

SEQ ID NO: 286051 - DNA, 25 bp, Rattus norvegicus
gaaacgagattcctgtggttatcta

SEQ ID NO: 286052 - DNA, 25 bp, Rattus norvegicus
gaaacgagattcgtgtggttatcta

SEQ ID NO: 286053 - DNA, 25 bp, Rattus norvegicus
gaaacgagccttatgtgtgtcgcta

SEQ ID NO: 286054 - DNA, 25 bp, Rattus norvegicus
gaaacgagccttttgtgtgtcgcta

SEQ ID NO: 286055 - DNA, 25 bp, Rattus norvegicus
gaaacgagctttcgtttttcactga

SEQ ID NO: 286056 - DNA, 25 bp, Rattus norvegicus
gaaacgagctttggtttttcactga

SEQ ID NO: 286057 - DNA, 25 bp, Rattus norvegicus
gaaacgaggctgactgatcctagaa

SEQ ID NO: 286058 - DNA, 25 bp, Rattus norvegicus
gaaacgaggctgtctgatcctagaa

SEQ ID NO: 286059 - DNA, 25 bp, Rattus norvegicus
gaaacgatgagaatccacagacccc

SEQ ID NO: 286060 - DNA, 25 bp, Rattus norvegicus
gaaacgatgagattccacagacccc

SEQ ID NO: 286061 - DNA, 25 bp, Rattus norvegicus
gaaacgatgcctctaacgtgttatt

SEQ ID NO: 286062 - DNA, 25 bp, Rattus norvegicus
gaaacgatgcctgtaacgtgttatt

SEQ ID NO: 286063 - DNA, 25 bp, Rattus norvegicus
gaaacgatgctaaacctatccgctg

SEQ ID NO: 286064 - DNA, 25 bp, Rattus norvegicus
gaaacgatgctatacctatccgctg

SEQ ID NO: 286065 - DNA, 25 bp, Rattus norvegicus
gaaacgattcatctgtagccaactg

SEQ ID NO: 286066 - DNA, 25 bp, Rattus norvegicus
gaaacgattcatgtgtagccaactg

SEQ ID NO: 286067 - DNA, 25 bp, Rattus norvegicus
gaaacgattctgagtctaccaaatt

SEQ ID NO: 286068 - DNA, 25 bp, Rattus norvegicus
gaaacgattctgtgtctaccaaatt

SEQ ID NO: 286069 - DNA, 25 bp, Rattus norvegicus
gaaacgattgacacagctgcctgca

SEQ ID NO: 286070 - DNA, 25 bp, Rattus norvegicus
gaaacgattgactcagctgcctgca

SEQ ID NO: 286071 - DNA, 25 bp, Rattus norvegicus
gaaacgcaattcattgttatgaaca

SEQ ID NO: 286072 - DNA, 25 bp, Rattus norvegicus
gaaacgcaattctttgttatgaaca

SEQ ID NO: 286073 - DNA, 25 bp, Rattus norvegicus
gaaacgcacatacttccatcacgat

SEQ ID NO: 286074 - DNA, 25 bp, Rattus norvegicus
gaaacgcacatagttccatcacgat

SEQ ID NO: 286075 - DNA, 25 bp, Rattus norvegicus
gaaacgcaccacatacacagcttag

SEQ ID NO: 286076 - DNA, 25 bp, Rattus norvegicus
gaaacgcaccacttacacagcttag

SEQ ID NO: 286077 - DNA, 25 bp, Rattus norvegicus
gaaacgcacgctaaggatgacccac

SEQ ID NO: 286078 - DNA, 25 bp, Rattus norvegicus
gaaacgcacgcttaggatgacccac

SEQ ID NO: 286079 - DNA, 25 bp, Rattus norvegicus
gaaacgcactgcacggagtactttt

SEQ ID NO: 286080 - DNA, 25 bp, Rattus norvegicus
gaaacgcactgctcggagtactttt

SEQ ID NO: 286081 - DNA, 25 bp, Rattus norvegicus
gaaacgcagaacctgcaggtgcctt

SEQ ID NO: 286082 - DNA, 25 bp, Rattus norvegicus
gaaacgcagaacgtgcaggtgcctt

SEQ ID NO: 286083 - DNA, 25 bp, Rattus norvegicus
gaaacgcagccactcaccattctgg

SEQ ID NO: 286084 - DNA, 25 bp, Rattus norvegicus
gaaacgcagccagtcaccattctgg

SEQ ID NO: 286085 - DNA, 25 bp, Rattus norvegicus
gaaacgcaggcacccaatgtgagca

SEQ ID NO: 286086 - DNA, 25 bp, Rattus norvegicus
gaaacgcaggcagccaatgtgagca

SEQ ID NO: 286087 - DNA, 25 bp, Rattus norvegicus
gaaacgcagtatatacgagtatctc

SEQ ID NO: 286088 - DNA, 25 bp, Rattus norvegicus
gaaacgcagtatttacgagtatctc

SEQ ID NO: 286089 - DNA, 25 bp, Rattus norvegicus
gaaacgcagtctctgcttctccagc

SEQ ID NO: 286090 - DNA, 25 bp, Rattus norvegicus
gaaacgcagtctgtgcttctccagc

SEQ ID NO: 286091 - DNA, 25 bp, Rattus norvegicus
gaaacgcatttcctcaagtgtccca

SEQ ID NO: 286092 - DNA, 25 bp, Rattus norvegicus
gaaacgcatttcgtcaagtgtccca

SEQ ID NO: 286093 - DNA, 25 bp, Rattus norvegicus
gaaacgccacacataggacatgctt

SEQ ID NO: 286094 - DNA, 25 bp, Rattus norvegicus
gaaacgccacacttaggacatgctt

SEQ ID NO: 286095 - DNA, 25 bp, Rattus norvegicus
gaaacgccactgaggtgtccatgtg

SEQ ID NO: 286096 - DNA, 25 bp, Rattus norvegicus
gaaacgccactgtggtgtccatgtg

SEQ ID NO: 286097 - DNA, 25 bp, Rattus norvegicus
gaaacgccagaacacccacaaaggt

SEQ ID NO: 286098 - DNA, 25 bp, Rattus norvegicus
gaaacgccagaagacccacaaaggt

SEQ ID NO: 286099 - DNA, 25 bp, Rattus norvegicus
gaaacgccaggtcaatcccagagaa

SEQ ID NO: 286100 - DNA, 25 bp, Rattus norvegicus
gaaacgccaggtgaatcccagagaa

SEQ ID NO: 286101 - DNA, 25 bp, Rattus norvegicus
gaaacgccatgtcagggtctttttt

SEQ ID NO: 286102 - DNA, 25 bp, Rattus norvegicus
gaaacgccatgtgagggtctttttt

SEQ ID NO: 286103 - DNA, 25 bp, Rattus norvegicus
gaaacgcccctgcttatatctgtag

SEQ ID NO: 286104 - DNA, 25 bp, Rattus norvegicus
gaaacgcccctggttatatctgtag

SEQ ID NO: 286105 - DNA, 25 bp, Rattus norvegicus
gaaacgcctgtgaggaccagttcac

SEQ ID NO: 286106 - DNA, 25 bp, Rattus norvegicus
gaaacgcctgtgtggaccagttcac

SEQ ID NO: 286107 - DNA, 25 bp, Rattus norvegicus
gaaacgcctttcagttggataactt

SEQ ID NO: 286108 - DNA, 25 bp, Rattus norvegicus
gaaacgcctttctgttggataactt

SEQ ID NO: 286109 - DNA, 25 bp, Rattus norvegicus
gaaacgcgcagaagtccaaaagtct

SEQ ID NO: 286110 - DNA, 25 bp, Rattus norvegicus
gaaacgcgcagatgtccaaaagtct

SEQ ID NO: 286111 - DNA, 25 bp, Rattus norvegicus
gaaacgcgcagtacaagccacatac

SEQ ID NO: 286112 - DNA, 25 bp, Rattus norvegicus
gaaacgcgcagttcaagccacatac

SEQ ID NO: 286113 - DNA, 25 bp, Rattus norvegicus
gaaacgcgccaaccaaccggaagga

SEQ ID NO: 286114 - DNA, 25 bp, Rattus norvegicus
gaaacgcgccaagcaaccggaagga

SEQ ID NO: 286115 - DNA, 25 bp, Rattus norvegicus
gaaacgcgccatcaacaagtcattt

SEQ ID NO: 286116 - DNA, 25 bp, Rattus norvegicus
gaaacgcgccatgaacaagtcattt

SEQ ID NO: 286117 - DNA, 25 bp, Rattus norvegicus
gaaacgcgggccacagagtttccga

SEQ ID NO: 286118 - DNA, 25 bp, Rattus norvegicus
gaaacgcgggcctcagagtttccga

SEQ ID NO: 286119 - DNA, 25 bp, Rattus norvegicus
gaaacgctaccccaagaattgcctg

SEQ ID NO: 286120 - DNA, 25 bp, Rattus norvegicus
gaaacgctacccgaagaattgcctg

SEQ ID NO: 286121 - DNA, 25 bp, Rattus norvegicus
gaaacgctctcaataagtggtccag

SEQ ID NO: 286122 - DNA, 25 bp, Rattus norvegicus
gaaacgctctcattaagtggtccag

SEQ ID NO: 286123 - DNA, 25 bp, Rattus norvegicus
gaaacgctctgaagtcctggaatga

SEQ ID NO: 286124 - DNA, 25 bp, Rattus norvegicus
gaaacgctctgatgtcctggaatga

SEQ ID NO: 286125 - DNA, 25 bp, Rattus norvegicus
gaaacgctggaaatctctgcaacgg

SEQ ID NO: 286126 - DNA, 25 bp, Rattus norvegicus
gaaacgctggaattctctgcaacgg

SEQ ID NO: 286127 - DNA, 25 bp, Rattus norvegicus
gaaacgctggcgaagacttacctgc

SEQ ID NO: 286128 - DNA, 25 bp, Rattus norvegicus
gaaacgctggcgtagacttacctgc

SEQ ID NO: 286129 - DNA, 25 bp, Rattus norvegicus
gaaacgctgttcagttctgattctc

SEQ ID NO: 286130 - DNA, 25 bp, Rattus norvegicus
gaaacgctgttctgttctgattctc

SEQ ID NO: 286131 - DNA, 25 bp, Rattus norvegicus
gaaacgcttaagcagttgccttttt

SEQ ID NO: 286132 - DNA, 25 bp, Rattus norvegicus
gaaacgcttaaggagttgccttttt

SEQ ID NO: 286133 - DNA, 25 bp, Rattus norvegicus
gaaacgcttctcactacagagctat

SEQ ID NO: 286134 - DNA, 25 bp, Rattus norvegicus
gaaacgcttctctctacagagctat

SEQ ID NO: 286135 - DNA, 25 bp, Rattus norvegicus
gaaacggaaaccagtggcctcagca

SEQ ID NO: 286136 - DNA, 25 bp, Rattus norvegicus
gaaacggaaacctgtggcctcagca

SEQ ID NO: 286137 - DNA, 25 bp, Rattus norvegicus
gaaacggaccagcatcgagaccaac

SEQ ID NO: 286138 - DNA, 25 bp, Rattus norvegicus
gaaacggaccaggatcgagaccaac

SEQ ID NO: 286139 - DNA, 25 bp, Rattus norvegicus
gaaacggacttgattgactgcacaa

SEQ ID NO: 286140 - DNA, 25 bp, Rattus norvegicus
gaaacggacttgtttgactgcacaa

SEQ ID NO: 286141 - DNA, 25 bp, Rattus norvegicus
gaaacggagcttccaagacccctat

SEQ ID NO: 286142 - DNA, 25 bp, Rattus norvegicus
gaaacggagcttgcaagacccctat

SEQ ID NO: 286143 - DNA, 25 bp, Rattus norvegicus
gaaacggagtcaccactttttctag

SEQ ID NO: 286144 - DNA, 25 bp, Rattus norvegicus
gaaacggagtcagcactttttctag

SEQ ID NO: 286145 - DNA, 25 bp, Rattus norvegicus
gaaacggagtcccaaatatctgtgt

SEQ ID NO: 286146 - DNA, 25 bp, Rattus norvegicus
gaaacggagtccgaaatatctgtgt

SEQ ID NO: 286147 - DNA, 25 bp, Rattus norvegicus
gaaacggagttgaccctctgagagt

SEQ ID NO: 286148 - DNA, 25 bp, Rattus norvegicus
gaaacggagttgtccctctgagagt

SEQ ID NO: 286149 - DNA, 25 bp, Rattus norvegicus
gaaacggatccccaagggctacaga

SEQ ID NO: 286150 - DNA, 25 bp, Rattus norvegicus
gaaacggatcccgaagggctacaga

SEQ ID NO: 286151 - DNA, 25 bp, Rattus norvegicus
gaaacggatttcactaggcattaaa

SEQ ID NO: 286152 - DNA, 25 bp, Rattus norvegicus
gaaacggatttctctaggcattaaa

SEQ ID NO: 286153 - DNA, 25 bp, Rattus norvegicus
gaaacggatttgacgagggccacca

SEQ ID NO: 286154 - DNA, 25 bp, Rattus norvegicus
gaaacggatttgtcgagggccacca

SEQ ID NO: 286155 - DNA, 25 bp, Rattus norvegicus
gaaacggcaagtatggtgtccaaca

SEQ ID NO: 286156 - DNA, 25 bp, Rattus norvegicus
gaaacggcaagtttggtgtccaaca

SEQ ID NO: 286157 - DNA, 25 bp, Rattus norvegicus
gaaacggcaatccaaacgggcaatc

SEQ ID NO: 286158 - DNA, 25 bp, Rattus norvegicus
gaaacggcaatcgaaacgggcaatc

SEQ ID NO: 286159 - DNA, 25 bp, Rattus norvegicus
gaaacggccatcatgtgtgtgtgac

SEQ ID NO: 286160 - DNA, 25 bp, Rattus norvegicus
gaaacggccatcttgtgtgtgtgac

SEQ ID NO: 286161 - DNA, 25 bp, Rattus norvegicus
gaaacggccatgagcactgcagcga

SEQ ID NO: 286162 - DNA, 25 bp, Rattus norvegicus
gaaacggccatgatctcttggacag

SEQ ID NO: 286163 - DNA, 25 bp, Rattus norvegicus
gaaacggccatgtgcactgcagcga

SEQ ID NO: 286164 - DNA, 25 bp, Rattus norvegicus
gaaacggccatgttctcttggacag

SEQ ID NO: 286165 - DNA, 25 bp, Rattus norvegicus
gaaacggccgacattatggtctgaa

SEQ ID NO: 286166 - DNA, 25 bp, Rattus norvegicus
gaaacggccgactttatggtctgaa

SEQ ID NO: 286167 - DNA, 25 bp, Rattus norvegicus
gaaacggctctgaccttagggttat

SEQ ID NO: 286168 - DNA, 25 bp, Rattus norvegicus
gaaacggctctgtccttagggttat

SEQ ID NO: 286169 - DNA, 25 bp, Rattus norvegicus
gaaacggctgacactaaggcctctg

SEQ ID NO: 286170 - DNA, 25 bp, Rattus norvegicus
gaaacggctgactctaaggcctctg

SEQ ID NO: 286171 - DNA, 25 bp, Rattus norvegicus
gaaacggcttctcaatgtgcccagc

SEQ ID NO: 286172 - DNA, 25 bp, Rattus norvegicus
gaaacggcttctgaatgtgcccagc

SEQ ID NO: 286173 - DNA, 25 bp, Rattus norvegicus
gaaacgggacctagggctgagtaca

SEQ ID NO: 286174 - DNA, 25 bp, Rattus norvegicus
gaaacgggaccttgggctgagtaca

SEQ ID NO: 286175 - DNA, 25 bp, Rattus norvegicus
gaaacgggtccaagttgatccacaa

SEQ ID NO: 286176 - DNA, 25 bp, Rattus norvegicus
gaaacgggtccatgttgatccacaa

SEQ ID NO: 286177 - DNA, 25 bp, Rattus norvegicus
gaaacgggtcttagggagcctgtct

SEQ ID NO: 286178 - DNA, 25 bp, Rattus norvegicus
gaaacgggtctttgggagcctgtct

SEQ ID NO: 286179 - DNA, 25 bp, Rattus norvegicus
gaaacgggttgcaagctcaaccacc

SEQ ID NO: 286180 - DNA, 25 bp, Rattus norvegicus
gaaacgggttgctagctcaaccacc

SEQ ID NO: 286181 - DNA, 25 bp, Rattus norvegicus
gaaacggtacctcattcctggaaat

SEQ ID NO: 286182 - DNA, 25 bp, Rattus norvegicus
gaaacggtacctgattcctggaaat

SEQ ID NO: 286183 - DNA, 25 bp, Rattus norvegicus
gaaacggtatctccaggtgtccaaa

SEQ ID NO: 286184 - DNA, 25 bp, Rattus norvegicus
gaaacggtatctgcaggtgtccaaa

SEQ ID NO: 286185 - DNA, 25 bp, Rattus norvegicus
gaaacggtcatgagaattgcaagca

SEQ ID NO: 286186 - DNA, 25 bp, Rattus norvegicus
gaaacggtcatgtgaattgcaagca

SEQ ID NO: 286187 - DNA, 25 bp, Rattus norvegicus
gaaacggttataaagctgcctggct

SEQ ID NO: 286188 - DNA, 25 bp, Rattus norvegicus
gaaacggttatatagctgcctggct

SEQ ID NO: 286189 - DNA, 25 bp, Rattus norvegicus
gaaacggttattactgcctaggaga

SEQ ID NO: 286190 - DNA, 25 bp, Rattus norvegicus
gaaacggttatttctgcctaggaga

SEQ ID NO: 286191 - DNA, 25 bp, Rattus norvegicus
gaaacgtagatgctggtgtgtatca

SEQ ID NO: 286192 - DNA, 25 bp, Rattus norvegicus
gaaacgtagatggtggtgtgtatca

SEQ ID NO: 286193 - DNA, 25 bp, Rattus norvegicus
gaaacgtatactactatctttccaa

SEQ ID NO: 286194 - DNA, 25 bp, Rattus norvegicus
gaaacgtatacttctatctttccaa

SEQ ID NO: 286195 - DNA, 25 bp, Rattus norvegicus
gaaacgtcagaacttgtctacttag

SEQ ID NO: 286196 - DNA, 25 bp, Rattus norvegicus
gaaacgtcagaagttgtctacttag

SEQ ID NO: 286197 - DNA, 25 bp, Rattus norvegicus
gaaacgtcagccactgccatggaga

SEQ ID NO: 286198 - DNA, 25 bp, Rattus norvegicus
gaaacgtcagcctctgccatggaga

SEQ ID NO: 286199 - DNA, 25 bp, Rattus norvegicus
gaaacgtcaggtagtgcttacatct

SEQ ID NO: 286200 - DNA, 25 bp, Rattus norvegicus
gaaacgtcaggttgtgcttacatct

SEQ ID NO: 286201 - DNA, 25 bp, Rattus norvegicus
gaaacgtcccacatgtgtgatcatg

SEQ ID NO: 286202 - DNA, 25 bp, Rattus norvegicus
gaaacgtcccacttgtgtgatcatg

SEQ ID NO: 286203 - DNA, 25 bp, Rattus norvegicus
gaaacgtccgagaacatccttttgg

SEQ ID NO: 286204 - DNA, 25 bp, Rattus norvegicus
gaaacgtccgagtacatccttttgg

SEQ ID NO: 286205 - DNA, 25 bp, Rattus norvegicus
gaaacgtctgtgaggcgacacgcca

SEQ ID NO: 286206 - DNA, 25 bp, Rattus norvegicus
gaaacgtctgtgtggcgacacgcca

SEQ ID NO: 286207 - DNA, 25 bp, Rattus norvegicus
gaaacgtgactgctgcatcctcagt

SEQ ID NO: 286208 - DNA, 25 bp, Rattus norvegicus
gaaacgtgactggtgcatcctcagt

SEQ ID NO: 286209 - DNA, 25 bp, Rattus norvegicus
gaaacgtgctctaccttgcaaacag

SEQ ID NO: 286210 - DNA, 25 bp, Rattus norvegicus
gaaacgtgctcttccttgcaaacag

SEQ ID NO: 286211 - DNA, 25 bp, Rattus norvegicus
gaaacgtgctgaatgtaactttatt

SEQ ID NO: 286212 - DNA, 25 bp, Rattus norvegicus
gaaacgtgctgattgtaactttatt

SEQ ID NO: 286213 - DNA, 25 bp, Rattus norvegicus
gaaacgtgggttaagctcttcctgc

SEQ ID NO: 286214 - DNA, 25 bp, Rattus norvegicus
gaaacgtgggtttagctcttcctgc

SEQ ID NO: 286215 - DNA, 25 bp, Rattus norvegicus
gaaacgtggtgtagcccttgtggta

SEQ ID NO: 286216 - DNA, 25 bp, Rattus norvegicus
gaaacgtggtgttgcccttgtggta

SEQ ID NO: 286217 - DNA, 25 bp, Rattus norvegicus
gaaacgtgtgctacttttgttgtta

SEQ ID NO: 286218 - DNA, 25 bp, Rattus norvegicus
gaaacgtgtgcttcttttgttgtta

SEQ ID NO: 286219 - DNA, 25 bp, Rattus norvegicus
gaaacgttctccatactagaaagtg

SEQ ID NO: 286220 - DNA, 25 bp, Rattus norvegicus
gaaacgttctccttactagaaagtg

SEQ ID NO: 286221 - DNA, 25 bp, Rattus norvegicus
gaaacgttctgtcacaggacttgta

SEQ ID NO: 286222 - DNA, 25 bp, Rattus norvegicus
gaaacgttctgtgacaggacttgta

SEQ ID NO: 286223 - DNA, 25 bp, Rattus norvegicus
gaaacgttgacgcacaccacattgc

SEQ ID NO: 286224 - DNA, 25 bp, Rattus norvegicus
gaaacgttgacggacaccacattgc

SEQ ID NO: 286225 - DNA, 25 bp, Rattus norvegicus
gaaacgttgcttactgacccaaaat

SEQ ID NO: 286226 - DNA, 25 bp, Rattus norvegicus
gaaacgttgctttctgacccaaaat

SEQ ID NO: 286227 - DNA, 25 bp, Rattus norvegicus
gaaacgttggtactgacaaaagtgt

SEQ ID NO: 286228 - DNA, 25 bp, Rattus norvegicus
gaaacgttggtagtgacaaaagtgt

SEQ ID NO: 286229 - DNA, 25 bp, Rattus norvegicus
gaaacgtttacccagatacatatta

SEQ ID NO: 286230 - DNA, 25 bp, Rattus norvegicus
gaaacgtttaccgagatacatatta

SEQ ID NO: 286231 - DNA, 25 bp, Rattus norvegicus
gaaacgtttctgatcactctgtact

SEQ ID NO: 286232 - DNA, 25 bp, Rattus norvegicus
gaaacgtttctgttcactctgtact

SEQ ID NO: 286233 - DNA, 25 bp, Rattus norvegicus
gaaacgtttgagaagcactgggcta

SEQ ID NO: 286234 - DNA, 25 bp, Rattus norvegicus
gaaacgtttgagtagcactgggcta

SEQ ID NO: 286235 - DNA, 25 bp, Rattus norvegicus
gaaacgttttatatgctcctttgaa

SEQ ID NO: 286236 - DNA, 25 bp, Rattus norvegicus
gaaacgttttatttgctcctttgaa

SEQ ID NO: 286237 - DNA, 25 bp, Rattus norvegicus
gaaactaaaactctccatcctctac

SEQ ID NO: 286238 - DNA, 25 bp, Rattus norvegicus
gaaactaaaactgtccatcctctac

SEQ ID NO: 286239 - DNA, 25 bp, Rattus norvegicus
gaaactaaattcattcaatgcatgt

SEQ ID NO: 286240 - DNA, 25 bp, Rattus norvegicus
gaaactaaattctttcaatgcatgt

SEQ ID NO: 286241 - DNA, 25 bp, Rattus norvegicus
gaaactaacaagagctctgtcactg

SEQ ID NO: 286242 - DNA, 25 bp, Rattus norvegicus
gaaactaacaagtgctctgtcactg

SEQ ID NO: 286243 - DNA, 25 bp, Rattus norvegicus
gaaactaacattcagcaagaaacga

SEQ ID NO: 286244 - DNA, 25 bp, Rattus norvegicus
gaaactaacattgagcaagaaacga

SEQ ID NO: 286245 - DNA, 25 bp, Rattus norvegicus
gaaactaacccgctctatgtagtga

SEQ ID NO: 286246 - DNA, 25 bp, Rattus norvegicus
gaaactaacccggtctatgtagtga

SEQ ID NO: 286247 - DNA, 25 bp, Rattus norvegicus
gaaactaacctcagttatcctgggt

SEQ ID NO: 286248 - DNA, 25 bp, Rattus norvegicus
gaaactaacctctgttatcctgggt

SEQ ID NO: 286249 - DNA, 25 bp, Rattus norvegicus
gaaactaacctgcaaactgctccta

SEQ ID NO: 286250 - DNA, 25 bp, Rattus norvegicus
gaaactaacctgcagtcacttcctc

SEQ ID NO: 286251 - DNA, 25 bp, Rattus norvegicus
gaaactaacctggaaactgctccta

SEQ ID NO: 286252 - DNA, 25 bp, Rattus norvegicus
gaaactaacctggagtcacttcctc

SEQ ID NO: 286253 - DNA, 25 bp, Rattus norvegicus
gaaactaagccaccgcataagcgtc

SEQ ID NO: 286254 - DNA, 25 bp, Rattus norvegicus
gaaactaagccagcgcataagcgtc

SEQ ID NO: 286255 - DNA, 25 bp, Rattus norvegicus
gaaactaatgacatcgcaggctggt

SEQ ID NO: 286256 - DNA, 25 bp, Rattus norvegicus
gaaactaatgacttcgcaggctggt

SEQ ID NO: 286257 - DNA, 25 bp, Rattus norvegicus
gaaactaattagatacactgagaca

SEQ ID NO: 286258 - DNA, 25 bp, Rattus norvegicus
gaaactaattagttacactgagaca

SEQ ID NO: 286259 - DNA, 25 bp, Rattus norvegicus
gaaactaatttgactgctgactgca

SEQ ID NO: 286260 - DNA, 25 bp, Rattus norvegicus
gaaactaatttgtctgctgactgca

SEQ ID NO: 286261 - DNA, 25 bp, Rattus norvegicus
gaaactacagtcaaacccaaggtca

SEQ ID NO: 286262 - DNA, 25 bp, Rattus norvegicus
gaaactacagtctaacccaaggtca

SEQ ID NO: 286263 - DNA, 25 bp, Rattus norvegicus
gaaactacatctagcaatgtggaag

SEQ ID NO: 286264 - DNA, 25 bp, Rattus norvegicus
gaaactacatcttgcaatgtggaag

SEQ ID NO: 286265 - DNA, 25 bp, Rattus norvegicus
gaaactacattcaattccatcatga

SEQ ID NO: 286266 - DNA, 25 bp, Rattus norvegicus
gaaactacattctattccatcatga

SEQ ID NO: 286267 - DNA, 25 bp, Rattus norvegicus
gaaactaccagcacgtgattgccat

SEQ ID NO: 286268 - DNA, 25 bp, Rattus norvegicus
gaaactaccagctcgtgattgccat

SEQ ID NO: 286269 - DNA, 25 bp, Rattus norvegicus
gaaactacctctctaagattggact

SEQ ID NO: 286270 - DNA, 25 bp, Rattus norvegicus
gaaactacctctgtaagattggact

SEQ ID NO: 286271 - DNA, 25 bp, Rattus norvegicus
gaaactacgtcgctttccactcgga

SEQ ID NO: 286272 - DNA, 25 bp, Rattus norvegicus
gaaactacgtcggtttccactcgga

SEQ ID NO: 286273 - DNA, 25 bp, Rattus norvegicus
gaaactactataaagcggagcccct

SEQ ID NO: 286274 - DNA, 25 bp, Rattus norvegicus
gaaactactatatagcggagcccct

SEQ ID NO: 286275 - DNA, 25 bp, Rattus norvegicus
gaaactactgtcaaggctgtctggt

SEQ ID NO: 286276 - DNA, 25 bp, Rattus norvegicus
gaaactactgtctaggctgtctggt

SEQ ID NO: 286277 - DNA, 25 bp, Rattus norvegicus
gaaactagaaccagagagccttggg

SEQ ID NO: 286278 - DNA, 25 bp, Rattus norvegicus
gaaactagaacctgagagccttggg

SEQ ID NO: 286279 - DNA, 25 bp, Rattus norvegicus
gaaactagaagcctccgacttccat

SEQ ID NO: 286280 - DNA, 25 bp, Rattus norvegicus
gaaactagaagcgtccgacttccat

SEQ ID NO: 286281 - DNA, 25 bp, Rattus norvegicus
gaaactagatcactgcctgcgaagg

SEQ ID NO: 286282 - DNA, 25 bp, Rattus norvegicus
gaaactagatcagtgcctgcgaagg

SEQ ID NO: 286283 - DNA, 25 bp, Rattus norvegicus
gaaactagatggagcagcagcccct

SEQ ID NO: 286284 - DNA, 25 bp, Rattus norvegicus
gaaactagatggtgcagcagcccct

SEQ ID NO: 286285 - DNA, 25 bp, Rattus norvegicus
gaaactagatttctcctcagcaggc

SEQ ID NO: 286286 - DNA, 25 bp, Rattus norvegicus
gaaactagatttgtcctcagcaggc

SEQ ID NO: 286287 - DNA, 25 bp, Rattus norvegicus
gaaactagcaagcaattggagccag

SEQ ID NO: 286288 - DNA, 25 bp, Rattus norvegicus
gaaactagcaaggaattggagccag

SEQ ID NO: 286289 - DNA, 25 bp, Rattus norvegicus
gaaactagcagcagtgttgctcagt

SEQ ID NO: 286290 - DNA, 25 bp, Rattus norvegicus
gaaactagcagctgtgttgctcagt

SEQ ID NO: 286291 - DNA, 25 bp, Rattus norvegicus
gaaactagcataagcagacccagaa

SEQ ID NO: 286292 - DNA, 25 bp, Rattus norvegicus
gaaactagcatatgcagacccagaa

SEQ ID NO: 286293 - DNA, 25 bp, Rattus norvegicus
gaaactagcattaccgtggtcctgc

SEQ ID NO: 286294 - DNA, 25 bp, Rattus norvegicus
gaaactagcatttccgtggtcctgc

SEQ ID NO: 286295 - DNA, 25 bp, Rattus norvegicus
gaaactagctcaactggagcttgaa

SEQ ID NO: 286296 - DNA, 25 bp, Rattus norvegicus
gaaactagctcatctggagcttgaa

SEQ ID NO: 286297 - DNA, 25 bp, Rattus norvegicus
gaaactagcttcatctgcatggcca

SEQ ID NO: 286298 - DNA, 25 bp, Rattus norvegicus
gaaactagcttcttctgcatggcca

SEQ ID NO: 286299 - DNA, 25 bp, Rattus norvegicus
gaaactaggttcagcttttgtgtcc

SEQ ID NO: 286300 - DNA, 25 bp, Rattus norvegicus
gaaactaggttctgcttttgtgtcc

SEQ ID NO: 286301 - DNA, 25 bp, Rattus norvegicus
gaaactagtaacatcctctgggatc

SEQ ID NO: 286302 - DNA, 25 bp, Rattus norvegicus
gaaactagtaacttcctctgggatc

SEQ ID NO: 286303 - DNA, 25 bp, Rattus norvegicus
gaaactagtactaccagcttacgga

SEQ ID NO: 286304 - DNA, 25 bp, Rattus norvegicus
gaaactagtacttccagcttacgga

SEQ ID NO: 286305 - DNA, 25 bp, Rattus norvegicus
gaaactagttgcaaaacccactatt

SEQ ID NO: 286306 - DNA, 25 bp, Rattus norvegicus
gaaactagttgctaaacccactatt

SEQ ID NO: 286307 - DNA, 25 bp, Rattus norvegicus
gaaactataaccatcagtccttgag

SEQ ID NO: 286308 - DNA, 25 bp, Rattus norvegicus
gaaactataaccttcagtccttgag

SEQ ID NO: 286309 - DNA, 25 bp, Rattus norvegicus
gaaactataaggctgaagtgcgctt

SEQ ID NO: 286310 - DNA, 25 bp, Rattus norvegicus
gaaactataagggtgaagtgcgctt

SEQ ID NO: 286311 - DNA, 25 bp, Rattus norvegicus
gaaactatacatagggagcatcagg

SEQ ID NO: 286312 - DNA, 25 bp, Rattus norvegicus
gaaactatacattgggagcatcagg

SEQ ID NO: 286313 - DNA, 25 bp, Rattus norvegicus
gaaactatcacgattcttctagagc

SEQ ID NO: 286314 - DNA, 25 bp, Rattus norvegicus
gaaactatcacgtttcttctagagc

SEQ ID NO: 286315 - DNA, 25 bp, Rattus norvegicus
gaaactatcataacccaagatctca

SEQ ID NO: 286316 - DNA, 25 bp, Rattus norvegicus
gaaactatcatatcccaagatctca

SEQ ID NO: 286317 - DNA, 25 bp, Rattus norvegicus
gaaactatccagaccaggaaccact

SEQ ID NO: 286318 - DNA, 25 bp, Rattus norvegicus
gaaactatccagtccaggaaccact

SEQ ID NO: 286319 - DNA, 25 bp, Rattus norvegicus
gaaactatcctcacaaaagccaaag

SEQ ID NO: 286320 - DNA, 25 bp, Rattus norvegicus
gaaactatcctctcaaaagccaaag

SEQ ID NO: 286321 - DNA, 25 bp, Rattus norvegicus
gaaactatccttatttctaccctgg

SEQ ID NO: 286322 - DNA, 25 bp, Rattus norvegicus
gaaactatccttttttctaccctgg

SEQ ID NO: 286323 - DNA, 25 bp, Rattus norvegicus
gaaactatctagaatcaatccacaa

SEQ ID NO: 286324 - DNA, 25 bp, Rattus norvegicus
gaaactatctagtatcaatccacaa

SEQ ID NO: 286325 - DNA, 25 bp, Rattus norvegicus
gaaactatgagaacagaccaccttt

SEQ ID NO: 286326 - DNA, 25 bp, Rattus norvegicus
gaaactatgagatcagaccaccttt

SEQ ID NO: 286327 - DNA, 25 bp, Rattus norvegicus
gaaactatgatcaaggattaaccga

SEQ ID NO: 286328 - DNA, 25 bp, Rattus norvegicus
gaaactatgatctaggattaaccga

SEQ ID NO: 286329 - DNA, 25 bp, Rattus norvegicus
gaaactatgcacctgggagctctct

SEQ ID NO: 286330 - DNA, 25 bp, Rattus norvegicus
gaaactatgcacgtgggagctctct

SEQ ID NO: 286331 - DNA, 25 bp, Rattus norvegicus
gaaactatgcttcaacacgaatgta

SEQ ID NO: 286332 - DNA, 25 bp, Rattus norvegicus
gaaactatgcttgaacacgaatgta

SEQ ID NO: 286333 - DNA, 25 bp, Rattus norvegicus
gaaactatgtttcaattctttggct

SEQ ID NO: 286334 - DNA, 25 bp, Rattus norvegicus
gaaactatgtttgaattctttggct

SEQ ID NO: 286335 - DNA, 25 bp, Rattus norvegicus
gaaactattaatagtccagcagaaa

SEQ ID NO: 286336 - DNA, 25 bp, Rattus norvegicus
gaaactattaattgtccagcagaaa

SEQ ID NO: 286337 - DNA, 25 bp, Rattus norvegicus
gaaactattgtgacctttgcttggg

SEQ ID NO: 286338 - DNA, 25 bp, Rattus norvegicus
gaaactattgtgtcctttgcttggg

SEQ ID NO: 286339 - DNA, 25 bp, Rattus norvegicus
gaaactatttagaattcctaagtct

SEQ ID NO: 286340 - DNA, 25 bp, Rattus norvegicus
gaaactatttagtattcctaagtct

SEQ ID NO: 286341 - DNA, 25 bp, Rattus norvegicus
gaaactatttcacgcattctggagc

SEQ ID NO: 286342 - DNA, 25 bp, Rattus norvegicus
gaaactatttcaggcattctggagc

SEQ ID NO: 286343 - DNA, 25 bp, Rattus norvegicus
gaaactcaagctatatgcatccgta

SEQ ID NO: 286344 - DNA, 25 bp, Rattus norvegicus
gaaactcaagctttatgcatccgta

SEQ ID NO: 286345 - DNA, 25 bp, Rattus norvegicus
gaaactcaaggccagaatgggtcat

SEQ ID NO: 286346 - DNA, 25 bp, Rattus norvegicus
gaaactcaaggcctgtttcatcctc

SEQ ID NO: 286347 - DNA, 25 bp, Rattus norvegicus
gaaactcaaggcgagaatgggtcat

SEQ ID NO: 286348 - DNA, 25 bp, Rattus norvegicus
gaaactcaaggcgtgtttcatcctc

SEQ ID NO: 286349 - DNA, 25 bp, Rattus norvegicus
gaaactcaagtaccaggtcctgtag

SEQ ID NO: 286350 - DNA, 25 bp, Rattus norvegicus
gaaactcaagtagcaggtcctgtag

SEQ ID NO: 286351 - DNA, 25 bp, Rattus norvegicus
gaaactcacacacatgataaaccac

SEQ ID NO: 286352 - DNA, 25 bp, Rattus norvegicus
gaaactcacacagatgataaaccac

SEQ ID NO: 286353 - DNA, 25 bp, Rattus norvegicus
gaaactcacagtcctggtagctttc

SEQ ID NO: 286354 - DNA, 25 bp, Rattus norvegicus
gaaactcacagtgctggtagctttc

SEQ ID NO: 286355 - DNA, 25 bp, Rattus norvegicus
gaaactcacatgaggtgcaggaggt

SEQ ID NO: 286356 - DNA, 25 bp, Rattus norvegicus
gaaactcacatgtggtgcaggaggt

SEQ ID NO: 286357 - DNA, 25 bp, Rattus norvegicus
gaaactcaccagagatcagcaggga

SEQ ID NO: 286358 - DNA, 25 bp, Rattus norvegicus
gaaactcaccagtgatcagcaggga

SEQ ID NO: 286359 - DNA, 25 bp, Rattus norvegicus
gaaactcaccatctttgctgtagac

SEQ ID NO: 286360 - DNA, 25 bp, Rattus norvegicus
gaaactcaccatgtttgctgtagac

SEQ ID NO: 286361 - DNA, 25 bp, Rattus norvegicus
gaaactcaccccattaggtcacata

SEQ ID NO: 286362 - DNA, 25 bp, Rattus norvegicus
gaaactcacccctttaggtcacata

SEQ ID NO: 286363 - DNA, 25 bp, Rattus norvegicus
gaaactcactgacgttccttaacaa

SEQ ID NO: 286364 - DNA, 25 bp, Rattus norvegicus
gaaactcactgaggttccttaacaa

SEQ ID NO: 286365 - DNA, 25 bp, Rattus norvegicus
gaaactcactgcatatttggacctt

SEQ ID NO: 286366 - DNA, 25 bp, Rattus norvegicus
gaaactcactgcttatttggacctt

SEQ ID NO: 286367 - DNA, 25 bp, Rattus norvegicus
gaaactcagaacatagggcattcag

SEQ ID NO: 286368 - DNA, 25 bp, Rattus norvegicus
gaaactcagaacttagggcattcag

SEQ ID NO: 286369 - DNA, 25 bp, Rattus norvegicus
gaaactcagaagctcgcttcctcag

SEQ ID NO: 286370 - DNA, 25 bp, Rattus norvegicus
gaaactcagaaggtcgcttcctcag

SEQ ID NO: 286371 - DNA, 25 bp, Rattus norvegicus
gaaactcagagacctcgatgataga

SEQ ID NO: 286372 - DNA, 25 bp, Rattus norvegicus
gaaactcagagagctcgatgataga

SEQ ID NO: 286373 - DNA, 25 bp, Rattus norvegicus
gaaactcatcatatatggtacttct

SEQ ID NO: 286374 - DNA, 25 bp, Rattus norvegicus
gaaactcatcatttatggtacttct

SEQ ID NO: 286375 - DNA, 25 bp, Rattus norvegicus
gaaactcatctaactctcttacata

SEQ ID NO: 286376 - DNA, 25 bp, Rattus norvegicus
gaaactcatctatctctcttacata

SEQ ID NO: 286377 - DNA, 25 bp, Rattus norvegicus
gaaactcattgacttttcagctcag

SEQ ID NO: 286378 - DNA, 25 bp, Rattus norvegicus
gaaactcattgagttttcagctcag

SEQ ID NO: 286379 - DNA, 25 bp, Rattus norvegicus
gaaactccaatgatgtcttacggtt

SEQ ID NO: 286380 - DNA, 25 bp, Rattus norvegicus
gaaactccaatgttgtcttacggtt

SEQ ID NO: 286381 - DNA, 25 bp, Rattus norvegicus
gaaactccacgcactttactcagaa

SEQ ID NO: 286382 - DNA, 25 bp, Rattus norvegicus
gaaactccacgctctttactcagaa

SEQ ID NO: 286383 - DNA, 25 bp, Rattus norvegicus
gaaactccagagcagccaaatgtct

SEQ ID NO: 286384 - DNA, 25 bp, Rattus norvegicus
gaaactccagaggagccaaatgtct

SEQ ID NO: 286385 - DNA, 25 bp, Rattus norvegicus
gaaactccatgccttcttgagactc

SEQ ID NO: 286386 - DNA, 25 bp, Rattus norvegicus
gaaactccatgcgttcttgagactc

SEQ ID NO: 286387 - DNA, 25 bp, Rattus norvegicus
gaaactcccaaccagcttgtaaaga

SEQ ID NO: 286388 - DNA, 25 bp, Rattus norvegicus
gaaactcccaacgagcttgtaaaga

SEQ ID NO: 286389 - DNA, 25 bp, Rattus norvegicus
gaaactcccagtattcttcctggtg

SEQ ID NO: 286390 - DNA, 25 bp, Rattus norvegicus
gaaactcccagttttcttcctggtg

SEQ ID NO: 286391 - DNA, 25 bp, Rattus norvegicus
gaaactcccatcagatgttctagaa

SEQ ID NO: 286392 - DNA, 25 bp, Rattus norvegicus
gaaactcccatctgatgttctagaa

SEQ ID NO: 286393 - DNA, 25 bp, Rattus norvegicus
gaaactcccttcagttggattgtat

SEQ ID NO: 286394 - DNA, 25 bp, Rattus norvegicus
gaaactcccttctgttggattgtat

SEQ ID NO: 286395 - DNA, 25 bp, Rattus norvegicus
gaaactccgagacgtgctgtggtct

SEQ ID NO: 286396 - DNA, 25 bp, Rattus norvegicus
gaaactccgagaggtgctgtggtct

SEQ ID NO: 286397 - DNA, 25 bp, Rattus norvegicus
gaaactccgtctcgtcatttctgac

SEQ ID NO: 286398 - DNA, 25 bp, Rattus norvegicus
gaaactccgtctggtcatttctgac

SEQ ID NO: 286399 - DNA, 25 bp, Rattus norvegicus
gaaactccgttcactaagatgggac

SEQ ID NO: 286400 - DNA, 25 bp, Rattus norvegicus
gaaactccgttctctaagatgggac

SEQ ID NO: 286401 - DNA, 25 bp, Rattus norvegicus
gaaactcctgacctcaacaatgttg

SEQ ID NO: 286402 - DNA, 25 bp, Rattus norvegicus
gaaactcctgacgtcaacaatgttg

SEQ ID NO: 286403 - DNA, 25 bp, Rattus norvegicus
gaaactccttataccctcaacagtg

SEQ ID NO: 286404 - DNA, 25 bp, Rattus norvegicus
gaaactccttattccctcaacagtg

SEQ ID NO: 286405 - DNA, 25 bp, Rattus norvegicus
gaaactccttctcttactattcaaa

SEQ ID NO: 286406 - DNA, 25 bp, Rattus norvegicus
gaaactccttctgttactattcaaa

SEQ ID NO: 286407 - DNA, 25 bp, Rattus norvegicus
gaaactccttgcaagtgttcgggct

SEQ ID NO: 286408 - DNA, 25 bp, Rattus norvegicus
gaaactccttgctagtgttcgggct

SEQ ID NO: 286409 - DNA, 25 bp, Rattus norvegicus
gaaactccttggcagtctttgttag

SEQ ID NO: 286410 - DNA, 25 bp, Rattus norvegicus
gaaactccttgggagtctttgttag

SEQ ID NO: 286411 - DNA, 25 bp, Rattus norvegicus
gaaactcctttcatcaggatgcctg

SEQ ID NO: 286412 - DNA, 25 bp, Rattus norvegicus
gaaactcctttcttcaggatgcctg

SEQ ID NO: 286413 - DNA, 25 bp, Rattus norvegicus
gaaactcctttgacaccagatagca

SEQ ID NO: 286414 - DNA, 25 bp, Rattus norvegicus
gaaactcctttgtcaccagatagca

SEQ ID NO: 286415 - DNA, 25 bp, Rattus norvegicus
gaaactcgaagtactgatgcctcct

SEQ ID NO: 286416 - DNA, 25 bp, Rattus norvegicus
gaaactcgaagtagctatcctgaaa

SEQ ID NO: 286417 - DNA, 25 bp, Rattus norvegicus
gaaactcgaagttctgatgcctcct

SEQ ID NO: 286418 - DNA, 25 bp, Rattus norvegicus
gaaactcgaagttgctatcctgaaa

SEQ ID NO: 286419 - DNA, 25 bp, Rattus norvegicus
gaaactcggaccagacgtgactcgg

SEQ ID NO: 286420 - DNA, 25 bp, Rattus norvegicus
gaaactcggacctgacgtgactcgg

SEQ ID NO: 286421 - DNA, 25 bp, Rattus norvegicus
gaaactcggaggcttcagcagcttc

SEQ ID NO: 286422 - DNA, 25 bp, Rattus norvegicus
gaaactcggagggttcagcagcttc

SEQ ID NO: 286423 - DNA, 25 bp, Rattus norvegicus
gaaactcggtgtcactgttcgataa

SEQ ID NO: 286424 - DNA, 25 bp, Rattus norvegicus
gaaactcggtgtgactgttcgataa

SEQ ID NO: 286425 - DNA, 25 bp, Rattus norvegicus
gaaactcgttaccagatcctacagt

SEQ ID NO: 286426 - DNA, 25 bp, Rattus norvegicus
gaaactcgttacgagatcctacagt

SEQ ID NO: 286427 - DNA, 25 bp, Rattus norvegicus
gaaactcgttagctgagctccagtc

SEQ ID NO: 286428 - DNA, 25 bp, Rattus norvegicus
gaaactcgttaggtgagctccagtc

SEQ ID NO: 286429 - DNA, 25 bp, Rattus norvegicus
gaaactctaaccacagattgccaag

SEQ ID NO: 286430 - DNA, 25 bp, Rattus norvegicus
gaaactctaacctcagattgccaag

SEQ ID NO: 286431 - DNA, 25 bp, Rattus norvegicus
gaaactctactaacctgtgtctgta

SEQ ID NO: 286432 - DNA, 25 bp, Rattus norvegicus
gaaactctactatcctgtgtctgta

SEQ ID NO: 286433 - DNA, 25 bp, Rattus norvegicus
gaaactctagatcgttctgatcact

SEQ ID NO: 286434 - DNA, 25 bp, Rattus norvegicus
gaaactctagatggttctgatcact

SEQ ID NO: 286435 - DNA, 25 bp, Rattus norvegicus
gaaactctagctcttgccctggaaa

SEQ ID NO: 286436 - DNA, 25 bp, Rattus norvegicus
gaaactctagctgttgccctggaaa

SEQ ID NO: 286437 - DNA, 25 bp, Rattus norvegicus
gaaactctatcaaaccgcactgaat

SEQ ID NO: 286438 - DNA, 25 bp, Rattus norvegicus
gaaactctatcataccgcactgaat

SEQ ID NO: 286439 - DNA, 25 bp, Rattus norvegicus
gaaactctctgtctacattgacatg

SEQ ID NO: 286440 - DNA, 25 bp, Rattus norvegicus
gaaactctctgtgtacattgacatg

SEQ ID NO: 286441 - DNA, 25 bp, Rattus norvegicus
gaaactctgcagacacctgtgaaat

SEQ ID NO: 286442 - DNA, 25 bp, Rattus norvegicus
gaaactctgcagtcacctgtgaaat

SEQ ID NO: 286443 - DNA, 25 bp, Rattus norvegicus
gaaactctggaacctccttgagaaa

SEQ ID NO: 286444 - DNA, 25 bp, Rattus norvegicus
gaaactctggaagctccttgagaaa

SEQ ID NO: 286445 - DNA, 25 bp, Rattus norvegicus
gaaactctggccatccataatgaca

SEQ ID NO: 286446 - DNA, 25 bp, Rattus norvegicus
gaaactctggcccactgcagattat

SEQ ID NO: 286447 - DNA, 25 bp, Rattus norvegicus
gaaactctggccgactgcagattat

SEQ ID NO: 286448 - DNA, 25 bp, Rattus norvegicus
gaaactctggccttccataatgaca

SEQ ID NO: 286449 - DNA, 25 bp, Rattus norvegicus
gaaactctgggtacaccaaccgaag

SEQ ID NO: 286450 - DNA, 25 bp, Rattus norvegicus
gaaactctgggttcaccaaccgaag

SEQ ID NO: 286451 - DNA, 25 bp, Rattus norvegicus
gaaactctgtagacccataataata

SEQ ID NO: 286452 - DNA, 25 bp, Rattus norvegicus
gaaactctgtagtcccataataata

SEQ ID NO: 286453 - DNA, 25 bp, Rattus norvegicus
gaaactctgtcgaatgatcctcacg

SEQ ID NO: 286454 - DNA, 25 bp, Rattus norvegicus
gaaactctgtcgtatgatcctcacg

SEQ ID NO: 286455 - DNA, 25 bp, Rattus norvegicus
gaaactctgtgtatcgtctggttca

SEQ ID NO: 286456 - DNA, 25 bp, Rattus norvegicus
gaaactctgtgtttcgtctggttca

SEQ ID NO: 286457 - DNA, 25 bp, Rattus norvegicus
gaaactctgttaaactgtccttaat

SEQ ID NO: 286458 - DNA, 25 bp, Rattus norvegicus
gaaactctgttatactgtccttaat

SEQ ID NO: 286459 - DNA, 25 bp, Rattus norvegicus
gaaactcttcatcgagatgaaccaa

SEQ ID NO: 286460 - DNA, 25 bp, Rattus norvegicus
gaaactcttcatggagatgaaccaa

SEQ ID NO: 286461 - DNA, 25 bp, Rattus norvegicus
gaaactcttcctcatttccaggtct

SEQ ID NO: 286462 - DNA, 25 bp, Rattus norvegicus
gaaactcttcctgatttccaggtct

SEQ ID NO: 286463 - DNA, 25 bp, Rattus norvegicus
gaaactcttctcatgaaaacttgga

SEQ ID NO: 286464 - DNA, 25 bp, Rattus norvegicus
gaaactcttctcttgaaaacttgga

SEQ ID NO: 286465 - DNA, 25 bp, Rattus norvegicus
gaaactcttgaaaattattccacag

SEQ ID NO: 286466 - DNA, 25 bp, Rattus norvegicus
gaaactcttgaaatactctctagaa

SEQ ID NO: 286467 - DNA, 25 bp, Rattus norvegicus
gaaactcttgaatattattccacag

SEQ ID NO: 286468 - DNA, 25 bp, Rattus norvegicus
gaaactcttgaattactctctagaa

SEQ ID NO: 286469 - DNA, 25 bp, Rattus norvegicus
gaaactcttgcaccagatccgactt

SEQ ID NO: 286470 - DNA, 25 bp, Rattus norvegicus
gaaactcttgcagcagatccgactt

SEQ ID NO: 286471 - DNA, 25 bp, Rattus norvegicus
gaaactcttgccacacaaggtcttt

SEQ ID NO: 286472 - DNA, 25 bp, Rattus norvegicus
gaaactcttgcctcacaaggtcttt

SEQ ID NO: 286473 - DNA, 25 bp, Rattus norvegicus
gaaactcttgtaatggctgccgctc

SEQ ID NO: 286474 - DNA, 25 bp, Rattus norvegicus
gaaactcttgtattggctgccgctc

SEQ ID NO: 286475 - DNA, 25 bp, Rattus norvegicus
gaaactcttgttcctaacgacaacg

SEQ ID NO: 286476 - DNA, 25 bp, Rattus norvegicus
gaaactcttgttgctaacgacaacg

SEQ ID NO: 286477 - DNA, 25 bp, Rattus norvegicus
gaaactctttctccttgaacatcaa

SEQ ID NO: 286478 - DNA, 25 bp, Rattus norvegicus
gaaactctttctgcttgaacatcaa

SEQ ID NO: 286479 - DNA, 25 bp, Rattus norvegicus
gaaactctttgtcctctcaactttg

SEQ ID NO: 286480 - DNA, 25 bp, Rattus norvegicus
gaaactctttgtgctctcaactttg

SEQ ID NO: 286481 - DNA, 25 bp, Rattus norvegicus
gaaactcttttcatgtgtctgacat

SEQ ID NO: 286482 - DNA, 25 bp, Rattus norvegicus
gaaactcttttcttgtgtctgacat

SEQ ID NO: 286483 - DNA, 25 bp, Rattus norvegicus
gaaactctttttaactgggctatgg

SEQ ID NO: 286484 - DNA, 25 bp, Rattus norvegicus
gaaactcttttttactgggctatgg

SEQ ID NO: 286485 - DNA, 25 bp, Rattus norvegicus
gaaactgaaaaaagtctctgtctct

SEQ ID NO: 286486 - DNA, 25 bp, Rattus norvegicus
gaaactgaaaaatgtctctgtctct

SEQ ID NO: 286487 - DNA, 25 bp, Rattus norvegicus
gaaactgaaaacacgaggcatgcct

SEQ ID NO: 286488 - DNA, 25 bp, Rattus norvegicus
gaaactgaaaactcgaggcatgcct

SEQ ID NO: 286489 - DNA, 25 bp, Rattus norvegicus
gaaactgaaagaacgaccacccctg

SEQ ID NO: 286490 - DNA, 25 bp, Rattus norvegicus
gaaactgaaagatcgaccacccctg

SEQ ID NO: 286491 - DNA, 25 bp, Rattus norvegicus
gaaactgaacatctagcacactgcc

SEQ ID NO: 286492 - DNA, 25 bp, Rattus norvegicus
gaaactgaacatgtagcacactgcc

SEQ ID NO: 286493 - DNA, 25 bp, Rattus norvegicus
gaaactgaagggatgcttttcttgt

SEQ ID NO: 286494 - DNA, 25 bp, Rattus norvegicus
gaaactgaagggttgcttttcttgt

SEQ ID NO: 286495 - DNA, 25 bp, Rattus norvegicus
gaaactgaatccctcgtatcactga

SEQ ID NO: 286496 - DNA, 25 bp, Rattus norvegicus
gaaactgaatccgtcgtatcactga

SEQ ID NO: 286497 - DNA, 25 bp, Rattus norvegicus
gaaactgacaggcatcaaagacact

SEQ ID NO: 286498 - DNA, 25 bp, Rattus norvegicus
gaaactgacagggatcaaagacact

SEQ ID NO: 286499 - DNA, 25 bp, Rattus norvegicus
gaaactgaccacacattagtacctt

SEQ ID NO: 286500 - DNA, 25 bp, Rattus norvegicus
gaaactgaccactcattagtacctt

SEQ ID NO: 286501 - DNA, 25 bp, Rattus norvegicus
gaaactgaccagatgggccctagat

SEQ ID NO: 286502 - DNA, 25 bp, Rattus norvegicus
gaaactgaccagttgggccctagat

SEQ ID NO: 286503 - DNA, 25 bp, Rattus norvegicus
gaaactgacctcattcctcatttgt

SEQ ID NO: 286504 - DNA, 25 bp, Rattus norvegicus
gaaactgacctctttcctcatttgt

SEQ ID NO: 286505 - DNA, 25 bp, Rattus norvegicus
gaaactgacggcatcaagtagagga

SEQ ID NO: 286506 - DNA, 25 bp, Rattus norvegicus
gaaactgacggcttcaagtagagga

SEQ ID NO: 286507 - DNA, 25 bp, Rattus norvegicus
gaaactgactgcattgcgtctgaag

SEQ ID NO: 286508 - DNA, 25 bp, Rattus norvegicus
gaaactgactgctttgcgtctgaag

SEQ ID NO: 286509 - DNA, 25 bp, Rattus norvegicus
gaaactgactgtcggccagtgtgac

SEQ ID NO: 286510 - DNA, 25 bp, Rattus norvegicus
gaaactgactgtgggccagtgtgac

SEQ ID NO: 286511 - DNA, 25 bp, Rattus norvegicus
gaaactgacttccagctgtactttt

SEQ ID NO: 286512 - DNA, 25 bp, Rattus norvegicus
gaaactgacttcgagctgtactttt

SEQ ID NO: 286513 - DNA, 25 bp, Rattus norvegicus
gaaactgagaacagtctcacctgga

SEQ ID NO: 286514 - DNA, 25 bp, Rattus norvegicus
gaaactgagaactgtctcacctgga

SEQ ID NO: 286515 - DNA, 25 bp, Rattus norvegicus
gaaactgagaagagccagcctccgg

SEQ ID NO: 286516 - DNA, 25 bp, Rattus norvegicus
gaaactgagaagctcatccgggaga

SEQ ID NO: 286517 - DNA, 25 bp, Rattus norvegicus
gaaactgagaaggtcatccgggaga

SEQ ID NO: 286518 - DNA, 25 bp, Rattus norvegicus
gaaactgagaagtgccagcctccgg

SEQ ID NO: 286519 - DNA, 25 bp, Rattus norvegicus
gaaactgagatgctcctttgagaat

SEQ ID NO: 286520 - DNA, 25 bp, Rattus norvegicus
gaaactgagatggtcctttgagaat

SEQ ID NO: 286521 - DNA, 25 bp, Rattus norvegicus
gaaactgagattctacgtgatccat

SEQ ID NO: 286522 - DNA, 25 bp, Rattus norvegicus
gaaactgagattgtacgtgatccat

SEQ ID NO: 286523 - DNA, 25 bp, Rattus norvegicus
gaaactgagcaaactgtcccaggat

SEQ ID NO: 286524 - DNA, 25 bp, Rattus norvegicus
gaaactgagcaatctgtcccaggat

SEQ ID NO: 286525 - DNA, 25 bp, Rattus norvegicus
gaaactgagcctactttgtaatgta

SEQ ID NO: 286526 - DNA, 25 bp, Rattus norvegicus
gaaactgagccttctttgtaatgta

SEQ ID NO: 286527 - DNA, 25 bp, Rattus norvegicus
gaaactgagcgaacgggccaacccg

SEQ ID NO: 286528 - DNA, 25 bp, Rattus norvegicus
gaaactgagcgatcgggccaacccg

SEQ ID NO: 286529 - DNA, 25 bp, Rattus norvegicus
gaaactgagctgagcctcgttttgt

SEQ ID NO: 286530 - DNA, 25 bp, Rattus norvegicus
gaaactgagctgtgcctcgttttgt

SEQ ID NO: 286531 - DNA, 25 bp, Rattus norvegicus
gaaactgaggcaaaccccagtacct

SEQ ID NO: 286532 - DNA, 25 bp, Rattus norvegicus
gaaactgaggcataccccagtacct

SEQ ID NO: 286533 - DNA, 25 bp, Rattus norvegicus
gaaactgaggtgcacacgaggcctt

SEQ ID NO: 286534 - DNA, 25 bp, Rattus norvegicus
gaaactgaggtggacacgaggcctt

SEQ ID NO: 286535 - DNA, 25 bp, Rattus norvegicus
gaaactgagtccaatgaacctgaac

SEQ ID NO: 286536 - DNA, 25 bp, Rattus norvegicus
gaaactgagtcctatgaacctgaac

SEQ ID NO: 286537 - DNA, 25 bp, Rattus norvegicus
gaaactgagtgtctgttgtaaggca

SEQ ID NO: 286538 - DNA, 25 bp, Rattus norvegicus
gaaactgagtgtgtgttgtaaggca

SEQ ID NO: 286539 - DNA, 25 bp, Rattus norvegicus
gaaactgagttcaacttaggcaaga

SEQ ID NO: 286540 - DNA, 25 bp, Rattus norvegicus
gaaactgagttctacttaggcaaga

SEQ ID NO: 286541 - DNA, 25 bp, Rattus norvegicus
gaaactgagtttcctcatgagcact

SEQ ID NO: 286542 - DNA, 25 bp, Rattus norvegicus
gaaactgagtttgctcatgagcact

SEQ ID NO: 286543 - DNA, 25 bp, Rattus norvegicus
gaaactgatactccagcctgagaga

SEQ ID NO: 286544 - DNA, 25 bp, Rattus norvegicus
gaaactgatactgcagcctgagaga

SEQ ID NO: 286545 - DNA, 25 bp, Rattus norvegicus
gaaactgatagaacttgatctactt

SEQ ID NO: 286546 - DNA, 25 bp, Rattus norvegicus
gaaactgatagatcttgatctactt

SEQ ID NO: 286547 - DNA, 25 bp, Rattus norvegicus
gaaactgatctcatttagcctgaat

SEQ ID NO: 286548 - DNA, 25 bp, Rattus norvegicus
gaaactgatctcttttagcctgaat

SEQ ID NO: 286549 - DNA, 25 bp, Rattus norvegicus
gaaactgatgacaactgtttgagta

SEQ ID NO: 286550 - DNA, 25 bp, Rattus norvegicus
gaaactgatgactactgtttgagta

SEQ ID NO: 286551 - DNA, 25 bp, Rattus norvegicus
gaaactgatgatcgaaatggctatg

SEQ ID NO: 286552 - DNA, 25 bp, Rattus norvegicus
gaaactgatgatggaaatggctatg

SEQ ID NO: 286553 - DNA, 25 bp, Rattus norvegicus
gaaactgatggcacttattccttta

SEQ ID NO: 286554 - DNA, 25 bp, Rattus norvegicus
gaaactgatggctcttattccttta

SEQ ID NO: 286555 - DNA, 25 bp, Rattus norvegicus
gaaactgatgttccctacgaggatc

SEQ ID NO: 286556 - DNA, 25 bp, Rattus norvegicus
gaaactgatgttgcctacgaggatc

SEQ ID NO: 286557 - DNA, 25 bp, Rattus norvegicus
gaaactgattacacttctggaacaa

SEQ ID NO: 286558 - DNA, 25 bp, Rattus norvegicus
gaaactgattactcttctggaacaa

SEQ ID NO: 286559 - DNA, 25 bp, Rattus norvegicus
gaaactgcaatcacatgcctgtcta

SEQ ID NO: 286560 - DNA, 25 bp, Rattus norvegicus
gaaactgcaatctcatgcctgtcta

SEQ ID NO: 286561 - DNA, 25 bp, Rattus norvegicus
gaaactgcaatgatcactggtttaa

SEQ ID NO: 286562 - DNA, 25 bp, Rattus norvegicus
gaaactgcaatgttcactggtttaa

SEQ ID NO: 286563 - DNA, 25 bp, Rattus norvegicus
gaaactgcaattagttgccccatat

SEQ ID NO: 286564 - DNA, 25 bp, Rattus norvegicus
gaaactgcaatttgttgccccatat

SEQ ID NO: 286565 - DNA, 25 bp, Rattus norvegicus
gaaactgcaccaagtaatgtccaat

SEQ ID NO: 286566 - DNA, 25 bp, Rattus norvegicus
gaaactgcaccatgtaatgtccaat

SEQ ID NO: 286567 - DNA, 25 bp, Rattus norvegicus
gaaactgcacttcgaggttactcac

SEQ ID NO: 286568 - DNA, 25 bp, Rattus norvegicus
gaaactgcacttggaggttactcac

SEQ ID NO: 286569 - DNA, 25 bp, Rattus norvegicus
gaaactgcaggacttcaggagctct

SEQ ID NO: 286570 - DNA, 25 bp, Rattus norvegicus
gaaactgcaggagttcaggagctct

SEQ ID NO: 286571 - DNA, 25 bp, Rattus norvegicus
gaaactgcagtaaacaaggccattg

SEQ ID NO: 286572 - DNA, 25 bp, Rattus norvegicus
gaaactgcagtatacaaggccattg

SEQ ID NO: 286573 - DNA, 25 bp, Rattus norvegicus
gaaactgcattcactatttgtcatt

SEQ ID NO: 286574 - DNA, 25 bp, Rattus norvegicus
gaaactgcattctctatttgtcatt

SEQ ID NO: 286575 - DNA, 25 bp, Rattus norvegicus
gaaactgccaagaagtatgcccgct

SEQ ID NO: 286576 - DNA, 25 bp, Rattus norvegicus
gaaactgccaagtagtatgcccgct

SEQ ID NO: 286577 - DNA, 25 bp, Rattus norvegicus
gaaactgccactccaacatgagctg

SEQ ID NO: 286578 - DNA, 25 bp, Rattus norvegicus
gaaactgccactgcaacatgagctg

SEQ ID NO: 286579 - DNA, 25 bp, Rattus norvegicus
gaaactgccaggcactgtcgacaga

SEQ ID NO: 286580 - DNA, 25 bp, Rattus norvegicus
gaaactgccagggactgtcgacaga

SEQ ID NO: 286581 - DNA, 25 bp, Rattus norvegicus
gaaactgccattcgctcttgttcat

SEQ ID NO: 286582 - DNA, 25 bp, Rattus norvegicus
gaaactgccattggctcttgttcat

SEQ ID NO: 286583 - DNA, 25 bp, Rattus norvegicus
gaaactgcccagagagaatcgtcac

SEQ ID NO: 286584 - DNA, 25 bp, Rattus norvegicus
gaaactgcccagtgagaatcgtcac

SEQ ID NO: 286585 - DNA, 25 bp, Rattus norvegicus
gaaactgccccgctccagggaaact

SEQ ID NO: 286586 - DNA, 25 bp, Rattus norvegicus
gaaactgccccggtccagggaaact

SEQ ID NO: 286587 - DNA, 25 bp, Rattus norvegicus
gaaactgcctacagacatcagcaca

SEQ ID NO: 286588 - DNA, 25 bp, Rattus norvegicus
gaaactgcctactgacatcagcaca

SEQ ID NO: 286589 - DNA, 25 bp, Rattus norvegicus
gaaactgcctccagcttaggaccag

SEQ ID NO: 286590 - DNA, 25 bp, Rattus norvegicus
gaaactgcctcctgcttaggaccag

SEQ ID NO: 286591 - DNA, 25 bp, Rattus norvegicus
gaaactgcctgacctatagtatgtt

SEQ ID NO: 286592 - DNA, 25 bp, Rattus norvegicus
gaaactgcctgagctatagtatgtt

SEQ ID NO: 286593 - DNA, 25 bp, Rattus norvegicus
gaaactgcctgcattttcttggctt

SEQ ID NO: 286594 - DNA, 25 bp, Rattus norvegicus
gaaactgcctgctttttcttggctt

SEQ ID NO: 286595 - DNA, 25 bp, Rattus norvegicus
gaaactgcctttctgtcatctgaac

SEQ ID NO: 286596 - DNA, 25 bp, Rattus norvegicus
gaaactgcctttgtgtcatctgaac

SEQ ID NO: 286597 - DNA, 25 bp, Rattus norvegicus
gaaactgcgaataccttaaagctct

SEQ ID NO: 286598 - DNA, 25 bp, Rattus norvegicus
gaaactgcgaattccttaaagctct

SEQ ID NO: 286599 - DNA, 25 bp, Rattus norvegicus
gaaactgcgctcattgtcaaatgct

SEQ ID NO: 286600 - DNA, 25 bp, Rattus norvegicus
gaaactgcgctctttgtcaaatgct

SEQ ID NO: 286601 - DNA, 25 bp, Rattus norvegicus
gaaactgcggatcgaggccagctaa

SEQ ID NO: 286602 - DNA, 25 bp, Rattus norvegicus
gaaactgcggatggaggccagctaa

SEQ ID NO: 286603 - DNA, 25 bp, Rattus norvegicus
gaaactgcgtcaagcttctgtgtga

SEQ ID NO: 286604 - DNA, 25 bp, Rattus norvegicus
gaaactgcgtcatgcttctgtgtga

SEQ ID NO: 286605 - DNA, 25 bp, Rattus norvegicus
gaaactgcgttaatcatcgctgtct

SEQ ID NO: 286606 - DNA, 25 bp, Rattus norvegicus
gaaactgcgttattcatcgctgtct

SEQ ID NO: 286607 - DNA, 25 bp, Rattus norvegicus
gaaactgctaaaattattcctgaca

SEQ ID NO: 286608 - DNA, 25 bp, Rattus norvegicus
gaaactgctaaatttattcctgaca

SEQ ID NO: 286609 - DNA, 25 bp, Rattus norvegicus
gaaactgctaggacaacctggccgg

SEQ ID NO: 286610 - DNA, 25 bp, Rattus norvegicus
gaaactgctaggtcaacctggccgg

SEQ ID NO: 286611 - DNA, 25 bp, Rattus norvegicus
gaaactgctatcaagccaactgctg

SEQ ID NO: 286612 - DNA, 25 bp, Rattus norvegicus
gaaactgctatctagccaactgctg

SEQ ID NO: 286613 - DNA, 25 bp, Rattus norvegicus
gaaactgctcagacactacttagtg

SEQ ID NO: 286614 - DNA, 25 bp, Rattus norvegicus
gaaactgctcagtcactacttagtg

SEQ ID NO: 286615 - DNA, 25 bp, Rattus norvegicus
gaaactgctgagcttgctgcaaagg

SEQ ID NO: 286616 - DNA, 25 bp, Rattus norvegicus
gaaactgctgaggttgctgcaaagg

SEQ ID NO: 286617 - DNA, 25 bp, Rattus norvegicus
gaaactgctgatccttgacatgaaa

SEQ ID NO: 286618 - DNA, 25 bp, Rattus norvegicus
gaaactgctgatgcttgacatgaaa

SEQ ID NO: 286619 - DNA, 25 bp, Rattus norvegicus
gaaactgctggacacgctgaagaag

SEQ ID NO: 286620 - DNA, 25 bp, Rattus norvegicus
gaaactgctggagacgctgaagaag

SEQ ID NO: 286621 - DNA, 25 bp, Rattus norvegicus
gaaactgctgtcactctgttgaggg

SEQ ID NO: 286622 - DNA, 25 bp, Rattus norvegicus
gaaactgctgtctctctgttgaggg

SEQ ID NO: 286623 - DNA, 25 bp, Rattus norvegicus
gaaactgcttctcgtgtggtgcgcc

SEQ ID NO: 286624 - DNA, 25 bp, Rattus norvegicus
gaaactgcttctggtgtggtgcgcc

SEQ ID NO: 286625 - DNA, 25 bp, Rattus norvegicus
gaaactgcttgtagtcctggttgcc

SEQ ID NO: 286626 - DNA, 25 bp, Rattus norvegicus
gaaactgcttgtatactttcaacaa

SEQ ID NO: 286627 - DNA, 25 bp, Rattus norvegicus
gaaactgcttgttgtcctggttgcc

SEQ ID NO: 286628 - DNA, 25 bp, Rattus norvegicus
gaaactgcttgtttactttcaacaa

SEQ ID NO: 286629 - DNA, 25 bp, Rattus norvegicus
gaaactggaagaactttgccctggt

SEQ ID NO: 286630 - DNA, 25 bp, Rattus norvegicus
gaaactggaagatctttgccctggt

SEQ ID NO: 286631 - DNA, 25 bp, Rattus norvegicus
gaaactggaagccactgtactccga

SEQ ID NO: 286632 - DNA, 25 bp, Rattus norvegicus
gaaactggaagcgactgtactccga

SEQ ID NO: 286633 - DNA, 25 bp, Rattus norvegicus
gaaactggaccaaaggcttcaccct

SEQ ID NO: 286634 - DNA, 25 bp, Rattus norvegicus
gaaactggaccaacaggcaccacgt

SEQ ID NO: 286635 - DNA, 25 bp, Rattus norvegicus
gaaactggaccacacagaaaagcca

SEQ ID NO: 286636 - DNA, 25 bp, Rattus norvegicus
gaaactggaccagacagaaaagcca

SEQ ID NO: 286637 - DNA, 25 bp, Rattus norvegicus
gaaactggaccataggcttcaccct

SEQ ID NO: 286638 - DNA, 25 bp, Rattus norvegicus
gaaactggaccatcaggcaccacgt

SEQ ID NO: 286639 - DNA, 25 bp, Rattus norvegicus
gaaactggacctacagcggatttag

SEQ ID NO: 286640 - DNA, 25 bp, Rattus norvegicus
gaaactggacctactgaaacctaga

SEQ ID NO: 286641 - DNA, 25 bp, Rattus norvegicus
gaaactggaccttcagcggatttag

SEQ ID NO: 286642 - DNA, 25 bp, Rattus norvegicus
gaaactggaccttctgaaacctaga

SEQ ID NO: 286643 - DNA, 25 bp, Rattus norvegicus
gaaactggagctctgatccgtgtgt

SEQ ID NO: 286644 - DNA, 25 bp, Rattus norvegicus
gaaactggagctgtgatccgtgtgt

SEQ ID NO: 286645 - DNA, 25 bp, Rattus norvegicus
gaaactggatcaccccgtttatgtt

SEQ ID NO: 286646 - DNA, 25 bp, Rattus norvegicus
gaaactggatcagcccgtttatgtt

SEQ ID NO: 286647 - DNA, 25 bp, Rattus norvegicus
gaaactggatggcagccggctcata

SEQ ID NO: 286648 - DNA, 25 bp, Rattus norvegicus
gaaactggatgggagccggctcata

SEQ ID NO: 286649 - DNA, 25 bp, Rattus norvegicus
gaaactggcaccatctttcctaaag

SEQ ID NO: 286650 - DNA, 25 bp, Rattus norvegicus
gaaactggcaccttctttcctaaag

SEQ ID NO: 286651 - DNA, 25 bp, Rattus norvegicus
gaaactggcagcaaattgctcctgt

SEQ ID NO: 286652 - DNA, 25 bp, Rattus norvegicus
gaaactggcagctaattgctcctgt

SEQ ID NO: 286653 - DNA, 25 bp, Rattus norvegicus
gaaactggcatcagtgtcgtgcctg

SEQ ID NO: 286654 - DNA, 25 bp, Rattus norvegicus
gaaactggcatccttatgctggcct

SEQ ID NO: 286655 - DNA, 25 bp, Rattus norvegicus
gaaactggcatcgttatgctggcct

SEQ ID NO: 286656 - DNA, 25 bp, Rattus norvegicus
gaaactggcatctgtgtcgtgcctg

SEQ ID NO: 286657 - DNA, 25 bp, Rattus norvegicus
gaaactggcatgatttcctttccaa

SEQ ID NO: 286658 - DNA, 25 bp, Rattus norvegicus
gaaactggcatgttttcctttccaa

SEQ ID NO: 286659 - DNA, 25 bp, Rattus norvegicus
gaaactggccttcgcactagtctat

SEQ ID NO: 286660 - DNA, 25 bp, Rattus norvegicus
gaaactggccttggcactagtctat

SEQ ID NO: 286661 - DNA, 25 bp, Rattus norvegicus
gaaactggcgacactgggcggactt

SEQ ID NO: 286662 - DNA, 25 bp, Rattus norvegicus
gaaactggcgactctgggcggactt

SEQ ID NO: 286663 - DNA, 25 bp, Rattus norvegicus
gaaactggctaacctctgggacagg

SEQ ID NO: 286664 - DNA, 25 bp, Rattus norvegicus
gaaactggctaagctctgggacagg

SEQ ID NO: 286665 - DNA, 25 bp, Rattus norvegicus
gaaactggctatcccgttctcagga

SEQ ID NO: 286666 - DNA, 25 bp, Rattus norvegicus
gaaactggctatgccgttctcagga

SEQ ID NO: 286667 - DNA, 25 bp, Rattus norvegicus
gaaactggctgaactgggctctgca

SEQ ID NO: 286668 - DNA, 25 bp, Rattus norvegicus
gaaactggctgatctgggctctgca

SEQ ID NO: 286669 - DNA, 25 bp, Rattus norvegicus
gaaactgggacgctgcattttacgg

SEQ ID NO: 286670 - DNA, 25 bp, Rattus norvegicus
gaaactgggacggtgcattttacgg

SEQ ID NO: 286671 - DNA, 25 bp, Rattus norvegicus
gaaactgggactatgccctgcctgt

SEQ ID NO: 286672 - DNA, 25 bp, Rattus norvegicus
gaaactgggactttgccctgcctgt

SEQ ID NO: 286673 - DNA, 25 bp, Rattus norvegicus
gaaactggtactagtcgcccctgca

SEQ ID NO: 286674 - DNA, 25 bp, Rattus norvegicus
gaaactggtacttgtcgcccctgca

SEQ ID NO: 286675 - DNA, 25 bp, Rattus norvegicus
gaaactggtagtcgtcatctcgaat

SEQ ID NO: 286676 - DNA, 25 bp, Rattus norvegicus
gaaactggtagtggtcatctcgaat

SEQ ID NO: 286677 - DNA, 25 bp, Rattus norvegicus
gaaactggtgatacctgtggttgaa

SEQ ID NO: 286678 - DNA, 25 bp, Rattus norvegicus
gaaactggtgattcctgtggttgaa

SEQ ID NO: 286679 - DNA, 25 bp, Rattus norvegicus
gaaactggtgcaaggtgaaactcaa

SEQ ID NO: 286680 - DNA, 25 bp, Rattus norvegicus
gaaactggtgcatggtgaaactcaa

SEQ ID NO: 286681 - DNA, 25 bp, Rattus norvegicus
gaaactggtgctaagcgccggcttg

SEQ ID NO: 286682 - DNA, 25 bp, Rattus norvegicus
gaaactggtgcttagcgccggcttg

SEQ ID NO: 286683 - DNA, 25 bp, Rattus norvegicus
gaaactggtggactccttcagaaaa

SEQ ID NO: 286684 - DNA, 25 bp, Rattus norvegicus
gaaactggtggagtccttcagaaaa

SEQ ID NO: 286685 - DNA, 25 bp, Rattus norvegicus
gaaactggttctatagccagattct

SEQ ID NO: 286686 - DNA, 25 bp, Rattus norvegicus
gaaactggttctctggttgctattg

SEQ ID NO: 286687 - DNA, 25 bp, Rattus norvegicus
gaaactggttctgtggttgctattg

SEQ ID NO: 286688 - DNA, 25 bp, Rattus norvegicus
gaaactggttctttagccagattct

SEQ ID NO: 286689 - DNA, 25 bp, Rattus norvegicus
gaaactgtaaacattgggctcaatt

SEQ ID NO: 286690 - DNA, 25 bp, Rattus norvegicus
gaaactgtaaactttgggctcaatt

SEQ ID NO: 286691 - DNA, 25 bp, Rattus norvegicus
gaaactgtaagaaacctctggatat

SEQ ID NO: 286692 - DNA, 25 bp, Rattus norvegicus
gaaactgtaagatacctctggatat

SEQ ID NO: 286693 - DNA, 25 bp, Rattus norvegicus
gaaactgtaagccacaaacacaaat

SEQ ID NO: 286694 - DNA, 25 bp, Rattus norvegicus
gaaactgtaagcgacaaacacaaat

SEQ ID NO: 286695 - DNA, 25 bp, Rattus norvegicus
gaaactgtaaggaaaccagctgaat

SEQ ID NO: 286696 - DNA, 25 bp, Rattus norvegicus
gaaactgtaaggtaaccagctgaat

SEQ ID NO: 286697 - DNA, 25 bp, Rattus norvegicus
gaaactgtaatcacctagaccttgg

SEQ ID NO: 286698 - DNA, 25 bp, Rattus norvegicus
gaaactgtaatctcctagaccttgg

SEQ ID NO: 286699 - DNA, 25 bp, Rattus norvegicus
gaaactgtagaactggtgttttgct

SEQ ID NO: 286700 - DNA, 25 bp, Rattus norvegicus
gaaactgtagaagtggtgttttgct

SEQ ID NO: 286701 - DNA, 25 bp, Rattus norvegicus
gaaactgtagccagggttgacctct

SEQ ID NO: 286702 - DNA, 25 bp, Rattus norvegicus
gaaactgtagcctgggttgacctct

SEQ ID NO: 286703 - DNA, 25 bp, Rattus norvegicus
gaaactgtagctatccacgtgaaaa

SEQ ID NO: 286704 - DNA, 25 bp, Rattus norvegicus
gaaactgtagctcaaccagctgaaa

SEQ ID NO: 286705 - DNA, 25 bp, Rattus norvegicus
gaaactgtagctgaaccagctgaaa

SEQ ID NO: 286706 - DNA, 25 bp, Rattus norvegicus
gaaactgtagctttccacgtgaaaa

SEQ ID NO: 286707 - DNA, 25 bp, Rattus norvegicus
gaaactgtatagagtgtccccttct

SEQ ID NO: 286708 - DNA, 25 bp, Rattus norvegicus
gaaactgtatagtgtgtccccttct

SEQ ID NO: 286709 - DNA, 25 bp, Rattus norvegicus
gaaactgtatgacgttgctgtatca

SEQ ID NO: 286710 - DNA, 25 bp, Rattus norvegicus
gaaactgtatgaggttgctgtatca

SEQ ID NO: 286711 - DNA, 25 bp, Rattus norvegicus
gaaactgtatggctgcatgtagaaa

SEQ ID NO: 286712 - DNA, 25 bp, Rattus norvegicus
gaaactgtatgggtgcatgtagaaa

SEQ ID NO: 286713 - DNA, 25 bp, Rattus norvegicus
gaaactgtcagcagccaagcacgtt

SEQ ID NO: 286714 - DNA, 25 bp, Rattus norvegicus
gaaactgtcagctgccaagcacgtt

SEQ ID NO: 286715 - DNA, 25 bp, Rattus norvegicus
gaaactgtcaggaggtcgaagctcc

SEQ ID NO: 286716 - DNA, 25 bp, Rattus norvegicus
gaaactgtcaggtggtcgaagctcc

SEQ ID NO: 286717 - DNA, 25 bp, Rattus norvegicus
gaaactgtcataatgttacctagct

SEQ ID NO: 286718 - DNA, 25 bp, Rattus norvegicus
gaaactgtcatattgttacctagct

SEQ ID NO: 286719 - DNA, 25 bp, Rattus norvegicus
gaaactgtcattcttgatgatacaa

SEQ ID NO: 286720 - DNA, 25 bp, Rattus norvegicus
gaaactgtcattgttgatgatacaa

SEQ ID NO: 286721 - DNA, 25 bp, Rattus norvegicus
gaaactgtcccaaatgactctagga

SEQ ID NO: 286722 - DNA, 25 bp, Rattus norvegicus
gaaactgtcccatatgactctagga

SEQ ID NO: 286723 - DNA, 25 bp, Rattus norvegicus
gaaactgtccccaaacaaccatgct

SEQ ID NO: 286724 - DNA, 25 bp, Rattus norvegicus
gaaactgtcccctaacaaccatgct

SEQ ID NO: 286725 - DNA, 25 bp, Rattus norvegicus
gaaactgtccttaagtcactatgaa

SEQ ID NO: 286726 - DNA, 25 bp, Rattus norvegicus
gaaactgtcctttagtcactatgaa

SEQ ID NO: 286727 - DNA, 25 bp, Rattus norvegicus
gaaactgtctgcctacttccgttac

SEQ ID NO: 286728 - DNA, 25 bp, Rattus norvegicus
gaaactgtctgcgtacttccgttac

SEQ ID NO: 286729 - DNA, 25 bp, Rattus norvegicus
gaaactgtcttgcagtgagactgaa

SEQ ID NO: 286730 - DNA, 25 bp, Rattus norvegicus
gaaactgtcttggagtgagactgaa

SEQ ID NO: 286731 - DNA, 25 bp, Rattus norvegicus
gaaactgtgaggatttcctttgtgg

SEQ ID NO: 286732 - DNA, 25 bp, Rattus norvegicus
gaaactgtgaggttttcctttgtgg

SEQ ID NO: 286733 - DNA, 25 bp, Rattus norvegicus
gaaactgtgatcattcaacttatga

SEQ ID NO: 286734 - DNA, 25 bp, Rattus norvegicus
gaaactgtgatctttcaacttatga

SEQ ID NO: 286735 - DNA, 25 bp, Rattus norvegicus
gaaactgtgattcccgtggctagta

SEQ ID NO: 286736 - DNA, 25 bp, Rattus norvegicus
gaaactgtgattgccgtggctagta

SEQ ID NO: 286737 - DNA, 25 bp, Rattus norvegicus
gaaactgtgcatatatcccatgcat

SEQ ID NO: 286738 - DNA, 25 bp, Rattus norvegicus
gaaactgtgcatttatcccatgcat

SEQ ID NO: 286739 - DNA, 25 bp, Rattus norvegicus
gaaactgtgcgcatggcagccatca

SEQ ID NO: 286740 - DNA, 25 bp, Rattus norvegicus
gaaactgtgcgcttggcagccatca

SEQ ID NO: 286741 - DNA, 25 bp, Rattus norvegicus
gaaactgtgctcaatgtccggactc

SEQ ID NO: 286742 - DNA, 25 bp, Rattus norvegicus
gaaactgtgctcatattcatgtgtt

SEQ ID NO: 286743 - DNA, 25 bp, Rattus norvegicus
gaaactgtgctctatgtccggactc

SEQ ID NO: 286744 - DNA, 25 bp, Rattus norvegicus
gaaactgtgctcttattcatgtgtt

SEQ ID NO: 286745 - DNA, 25 bp, Rattus norvegicus
gaaactgtgggactcttaactatct

SEQ ID NO: 286746 - DNA, 25 bp, Rattus norvegicus
gaaactgtgggagtcttaactatct

SEQ ID NO: 286747 - DNA, 25 bp, Rattus norvegicus
gaaactgtgggtaatccactgtgta

SEQ ID NO: 286748 - DNA, 25 bp, Rattus norvegicus
gaaactgtgggttatccactgtgta

SEQ ID NO: 286749 - DNA, 25 bp, Rattus norvegicus
gaaactgtgtccacagttgacccag

SEQ ID NO: 286750 - DNA, 25 bp, Rattus norvegicus
gaaactgtgtcctcagttgacccag

SEQ ID NO: 286751 - DNA, 25 bp, Rattus norvegicus
gaaactgtgtctcgagtaaacgaat

SEQ ID NO: 286752 - DNA, 25 bp, Rattus norvegicus
gaaactgtgtctggagtaaacgaat

SEQ ID NO: 286753 - DNA, 25 bp, Rattus norvegicus
gaaactgtgtgtatttgtggtaaaa

SEQ ID NO: 286754 - DNA, 25 bp, Rattus norvegicus
gaaactgtgtgtttttgtggtaaaa

SEQ ID NO: 286755 - DNA, 25 bp, Rattus norvegicus
gaaactgttaatactgtccattgta

SEQ ID NO: 286756 - DNA, 25 bp, Rattus norvegicus
gaaactgttaattctgtccattgta

SEQ ID NO: 286757 - DNA, 25 bp, Rattus norvegicus
gaaactgttccgacgtcccacagaa

SEQ ID NO: 286758 - DNA, 25 bp, Rattus norvegicus
gaaactgttccgtcgtcccacagaa

SEQ ID NO: 286759 - DNA, 25 bp, Rattus norvegicus
gaaactgttcctactgttttgtctc

SEQ ID NO: 286760 - DNA, 25 bp, Rattus norvegicus
gaaactgttccttctgttttgtctc

SEQ ID NO: 286761 - DNA, 25 bp, Rattus norvegicus
gaaactgttcttatgatttttctca

SEQ ID NO: 286762 - DNA, 25 bp, Rattus norvegicus
gaaactgttcttcatgttgccaatt

SEQ ID NO: 286763 - DNA, 25 bp, Rattus norvegicus
gaaactgttcttgatgttgccaatt

SEQ ID NO: 286764 - DNA, 25 bp, Rattus norvegicus
gaaactgttcttttgatttttctca

SEQ ID NO: 286765 - DNA, 25 bp, Rattus norvegicus
gaaactgttgatctacttgtccaaa

SEQ ID NO: 286766 - DNA, 25 bp, Rattus norvegicus
gaaactgttgatgtacttgtccaaa

SEQ ID NO: 286767 - DNA, 25 bp, Rattus norvegicus
gaaactgttgctaatactgcttcct

SEQ ID NO: 286768 - DNA, 25 bp, Rattus norvegicus
gaaactgttgctcacccatagccct

SEQ ID NO: 286769 - DNA, 25 bp, Rattus norvegicus
gaaactgttgctgacccatagccct

SEQ ID NO: 286770 - DNA, 25 bp, Rattus norvegicus
gaaactgttgcttatactgcttcct

SEQ ID NO: 286771 - DNA, 25 bp, Rattus norvegicus
gaaactgtttccatcaggagtactg

SEQ ID NO: 286772 - DNA, 25 bp, Rattus norvegicus
gaaactgtttccttcaggagtactg

SEQ ID NO: 286773 - DNA, 25 bp, Rattus norvegicus
gaaactgtttctatggagcaagact

SEQ ID NO: 286774 - DNA, 25 bp, Rattus norvegicus
gaaactgtttctttggagcaagact

SEQ ID NO: 286775 - DNA, 25 bp, Rattus norvegicus
gaaactgtttggaaactgagaggct

SEQ ID NO: 286776 - DNA, 25 bp, Rattus norvegicus
gaaactgtttggtaactgagaggct

SEQ ID NO: 286777 - DNA, 25 bp, Rattus norvegicus
gaaactgttttcctcagcgcagttt

SEQ ID NO: 286778 - DNA, 25 bp, Rattus norvegicus
gaaactgttttcgtcagcgcagttt

SEQ ID NO: 286779 - DNA, 25 bp, Rattus norvegicus
gaaacttaaaggagctgacccggag

SEQ ID NO: 286780 - DNA, 25 bp, Rattus norvegicus
gaaacttaaaggtgctgacccggag

SEQ ID NO: 286781 - DNA, 25 bp, Rattus norvegicus
gaaacttacgcaacagcttcttagt

SEQ ID NO: 286782 - DNA, 25 bp, Rattus norvegicus
gaaacttacgcatcagcttcttagt

SEQ ID NO: 286783 - DNA, 25 bp, Rattus norvegicus
gaaacttactaaatctattcgagga

SEQ ID NO: 286784 - DNA, 25 bp, Rattus norvegicus
gaaacttactaattctattcgagga

SEQ ID NO: 286785 - DNA, 25 bp, Rattus norvegicus
gaaacttactgactacttttcacaa

SEQ ID NO: 286786 - DNA, 25 bp, Rattus norvegicus
gaaacttactgagtacttttcacaa

SEQ ID NO: 286787 - DNA, 25 bp, Rattus norvegicus
gaaacttacttgagccagaggcagc

SEQ ID NO: 286788 - DNA, 25 bp, Rattus norvegicus
gaaacttacttgtgccagaggcagc

SEQ ID NO: 286789 - DNA, 25 bp, Rattus norvegicus
gaaacttagactcgcgtggtggcac

SEQ ID NO: 286790 - DNA, 25 bp, Rattus norvegicus
gaaacttagactggcgtggtggcac

SEQ ID NO: 286791 - DNA, 25 bp, Rattus norvegicus
gaaacttagagccaccgtctgaacg

SEQ ID NO: 286792 - DNA, 25 bp, Rattus norvegicus
gaaacttagagcgaccgtctgaacg

SEQ ID NO: 286793 - DNA, 25 bp, Rattus norvegicus
gaaacttagccaacagtgtggctca

SEQ ID NO: 286794 - DNA, 25 bp, Rattus norvegicus
gaaacttagccatcagtgtggctca

SEQ ID NO: 286795 - DNA, 25 bp, Rattus norvegicus
gaaacttagctcagactggctgctg

SEQ ID NO: 286796 - DNA, 25 bp, Rattus norvegicus
gaaacttagctctgactggctgctg

SEQ ID NO: 286797 - DNA, 25 bp, Rattus norvegicus
gaaacttagtacacatcctcactca

SEQ ID NO: 286798 - DNA, 25 bp, Rattus norvegicus
gaaacttagtactcatcctcactca

SEQ ID NO: 286799 - DNA, 25 bp, Rattus norvegicus
gaaacttatgtacctttctgtaaat

SEQ ID NO: 286800 - DNA, 25 bp, Rattus norvegicus
gaaacttatgtagctttctgtaaat

SEQ ID NO: 286801 - DNA, 25 bp, Rattus norvegicus
gaaacttattttctcatccatggac

SEQ ID NO: 286802 - DNA, 25 bp, Rattus norvegicus
gaaacttattttgtcatccatggac

SEQ ID NO: 286803 - DNA, 25 bp, Rattus norvegicus
gaaacttcagctaggtcctgatgat

SEQ ID NO: 286804 - DNA, 25 bp, Rattus norvegicus
gaaacttcagcttggtcctgatgat

SEQ ID NO: 286805 - DNA, 25 bp, Rattus norvegicus
gaaacttcaggtattttcctgtgaa

SEQ ID NO: 286806 - DNA, 25 bp, Rattus norvegicus
gaaacttcaggttttttcctgtgaa

SEQ ID NO: 286807 - DNA, 25 bp, Rattus norvegicus
gaaacttcagttattagatcatatc

SEQ ID NO: 286808 - DNA, 25 bp, Rattus norvegicus
gaaacttcagtttttagatcatatc

SEQ ID NO: 286809 - DNA, 25 bp, Rattus norvegicus
gaaacttcatatcacggatgcaata

SEQ ID NO: 286810 - DNA, 25 bp, Rattus norvegicus
gaaacttcatatgacggatgcaata

SEQ ID NO: 286811 - DNA, 25 bp, Rattus norvegicus
gaaacttcattcatttggcatctct

SEQ ID NO: 286812 - DNA, 25 bp, Rattus norvegicus
gaaacttcattcttttggcatctct

SEQ ID NO: 286813 - DNA, 25 bp, Rattus norvegicus
gaaacttcatttatgtgcctgacta

SEQ ID NO: 286814 - DNA, 25 bp, Rattus norvegicus
gaaacttcatttttgtgcctgacta

SEQ ID NO: 286815 - DNA, 25 bp, Rattus norvegicus
gaaacttccaacatgttgtgagaaa

SEQ ID NO: 286816 - DNA, 25 bp, Rattus norvegicus
gaaacttccaacttgttgtgagaaa

SEQ ID NO: 286817 - DNA, 25 bp, Rattus norvegicus
gaaacttccaagacagatctgcccc

SEQ ID NO: 286818 - DNA, 25 bp, Rattus norvegicus
gaaacttccaagtcagatctgcccc

SEQ ID NO: 286819 - DNA, 25 bp, Rattus norvegicus
gaaacttccatcatcctcaagtcaa

SEQ ID NO: 286820 - DNA, 25 bp, Rattus norvegicus
gaaacttccatcttcctcaagtcaa

SEQ ID NO: 286821 - DNA, 25 bp, Rattus norvegicus
gaaacttccccaaagcactcaagaa

SEQ ID NO: 286822 - DNA, 25 bp, Rattus norvegicus
gaaacttccccatagcactcaagaa

SEQ ID NO: 286823 - DNA, 25 bp, Rattus norvegicus
gaaacttcccttctgatgtatagag

SEQ ID NO: 286824 - DNA, 25 bp, Rattus norvegicus
gaaacttcccttgtgatgtatagag

SEQ ID NO: 286825 - DNA, 25 bp, Rattus norvegicus
gaaacttcctgtcaaacactttgac

SEQ ID NO: 286826 - DNA, 25 bp, Rattus norvegicus
gaaacttcctgtgaaacactttgac

SEQ ID NO: 286827 - DNA, 25 bp, Rattus norvegicus
gaaacttcctttctgttagctcgga

SEQ ID NO: 286828 - DNA, 25 bp, Rattus norvegicus
gaaacttcctttgtgttagctcgga

SEQ ID NO: 286829 - DNA, 25 bp, Rattus norvegicus
gaaacttcgtgcatgacatacctac

SEQ ID NO: 286830 - DNA, 25 bp, Rattus norvegicus
gaaacttcgtgcttgacatacctac

SEQ ID NO: 286831 - DNA, 25 bp, Rattus norvegicus
gaaacttcgttgcaacttcgagctc

SEQ ID NO: 286832 - DNA, 25 bp, Rattus norvegicus
gaaacttcgttggaacttcgagctc

SEQ ID NO: 286833 - DNA, 25 bp, Rattus norvegicus
gaaacttctagaacgtgttcactaa

SEQ ID NO: 286834 - DNA, 25 bp, Rattus norvegicus
gaaacttctagatcgtgttcactaa

SEQ ID NO: 286835 - DNA, 25 bp, Rattus norvegicus
gaaacttctatgactaattctgaaa

SEQ ID NO: 286836 - DNA, 25 bp, Rattus norvegicus
gaaacttctatgtctaattctgaaa

SEQ ID NO: 286837 - DNA, 25 bp, Rattus norvegicus
gaaacttctcaaatggacccgtctg

SEQ ID NO: 286838 - DNA, 25 bp, Rattus norvegicus
gaaacttctcaattggacccgtctg

SEQ ID NO: 286839 - DNA, 25 bp, Rattus norvegicus
gaaacttctccaattaccgaatcac

SEQ ID NO: 286840 - DNA, 25 bp, Rattus norvegicus
gaaacttctccatttaccgaatcac

SEQ ID NO: 286841 - DNA, 25 bp, Rattus norvegicus
gaaacttctcttagccaaaatcctg

SEQ ID NO: 286842 - DNA, 25 bp, Rattus norvegicus
gaaacttctctttgccaaaatcctg

SEQ ID NO: 286843 - DNA, 25 bp, Rattus norvegicus
gaaacttctgaaatctattatcttt

SEQ ID NO: 286844 - DNA, 25 bp, Rattus norvegicus
gaaacttctgaattctattatcttt

SEQ ID NO: 286845 - DNA, 25 bp, Rattus norvegicus
gaaacttctgccaagactgcttcta

SEQ ID NO: 286846 - DNA, 25 bp, Rattus norvegicus
gaaacttctgcctagactgcttcta

SEQ ID NO: 286847 - DNA, 25 bp, Rattus norvegicus
gaaacttctgtgctcattgttcctg

SEQ ID NO: 286848 - DNA, 25 bp, Rattus norvegicus
gaaacttctgtggtcattgttcctg

SEQ ID NO: 286849 - DNA, 25 bp, Rattus norvegicus
gaaacttcttcacagttggttccaa

SEQ ID NO: 286850 - DNA, 25 bp, Rattus norvegicus
gaaacttcttcagagttggttccaa

SEQ ID NO: 286851 - DNA, 25 bp, Rattus norvegicus
gaaacttcttccatagactcttcag

SEQ ID NO: 286852 - DNA, 25 bp, Rattus norvegicus
gaaacttcttccttagactcttcag

SEQ ID NO: 286853 - DNA, 25 bp, Rattus norvegicus
gaaacttcttgcagacttaacagga

SEQ ID NO: 286854 - DNA, 25 bp, Rattus norvegicus
gaaacttcttgcagtgtaattccac

SEQ ID NO: 286855 - DNA, 25 bp, Rattus norvegicus
gaaacttcttgctgacttaacagga

SEQ ID NO: 286856 - DNA, 25 bp, Rattus norvegicus
gaaacttcttgctgtgtaattccac

SEQ ID NO: 286857 - DNA, 25 bp, Rattus norvegicus
gaaacttcttgtccagaaaggcaaa

SEQ ID NO: 286858 - DNA, 25 bp, Rattus norvegicus
gaaacttcttgtgcagaaaggcaaa

SEQ ID NO: 286859 - DNA, 25 bp, Rattus norvegicus
gaaacttgaaatacagcccatccct

SEQ ID NO: 286860 - DNA, 25 bp, Rattus norvegicus
gaaacttgaaattcagcccatccct

SEQ ID NO: 286861 - DNA, 25 bp, Rattus norvegicus
gaaacttgacatcagcccaggcact

SEQ ID NO: 286862 - DNA, 25 bp, Rattus norvegicus
gaaacttgacatgagcccaggcact

SEQ ID NO: 286863 - DNA, 25 bp, Rattus norvegicus
gaaacttgacttaccagagttgcag

SEQ ID NO: 286864 - DNA, 25 bp, Rattus norvegicus
gaaacttgactttccagagttgcag

SEQ ID NO: 286865 - DNA, 25 bp, Rattus norvegicus
gaaacttgcaagacaggttgatcat

SEQ ID NO: 286866 - DNA, 25 bp, Rattus norvegicus
gaaacttgcaagaggcgggctccaa

SEQ ID NO: 286867 - DNA, 25 bp, Rattus norvegicus
gaaacttgcaagtcaggttgatcat

SEQ ID NO: 286868 - DNA, 25 bp, Rattus norvegicus
gaaacttgcaagtggcgggctccaa

SEQ ID NO: 286869 - DNA, 25 bp, Rattus norvegicus
gaaacttgcagaatcacatcctaaa

SEQ ID NO: 286870 - DNA, 25 bp, Rattus norvegicus
gaaacttgcagattcacatcctaaa

SEQ ID NO: 286871 - DNA, 25 bp, Rattus norvegicus
gaaacttgcagcaatacacttcccc

SEQ ID NO: 286872 - DNA, 25 bp, Rattus norvegicus
gaaacttgcagctatacacttcccc

SEQ ID NO: 286873 - DNA, 25 bp, Rattus norvegicus
gaaacttgccaacatcggccaaggc

SEQ ID NO: 286874 - DNA, 25 bp, Rattus norvegicus
gaaacttgccaagatcggccaaggc

SEQ ID NO: 286875 - DNA, 25 bp, Rattus norvegicus
gaaacttgcccgcaatcaggtattt

SEQ ID NO: 286876 - DNA, 25 bp, Rattus norvegicus
gaaacttgcccggaatcaggtattt

SEQ ID NO: 286877 - DNA, 25 bp, Rattus norvegicus
gaaacttgctagcaaacataactgt

SEQ ID NO: 286878 - DNA, 25 bp, Rattus norvegicus
gaaacttgctaggaaacataactgt

SEQ ID NO: 286879 - DNA, 25 bp, Rattus norvegicus
gaaacttgctctaagctttgtgacc

SEQ ID NO: 286880 - DNA, 25 bp, Rattus norvegicus
gaaacttgctcttagctttgtgacc

SEQ ID NO: 286881 - DNA, 25 bp, Rattus norvegicus
gaaacttgcttcatgtttgtttaga

SEQ ID NO: 286882 - DNA, 25 bp, Rattus norvegicus
gaaacttgcttcttgtttgtttaga

SEQ ID NO: 286883 - DNA, 25 bp, Rattus norvegicus
gaaacttggagtacgctgttgccca

SEQ ID NO: 286884 - DNA, 25 bp, Rattus norvegicus
gaaacttggagttcgctgttgccca

SEQ ID NO: 286885 - DNA, 25 bp, Rattus norvegicus
gaaacttggcatcctagagcactca

SEQ ID NO: 286886 - DNA, 25 bp, Rattus norvegicus
gaaacttggcatgctagagcactca

SEQ ID NO: 286887 - DNA, 25 bp, Rattus norvegicus
gaaacttggtcactgctggcaacat

SEQ ID NO: 286888 - DNA, 25 bp, Rattus norvegicus
gaaacttggtcagtgctggcaacat

SEQ ID NO: 286889 - DNA, 25 bp, Rattus norvegicus
gaaacttggtccactgagtcacaaa

SEQ ID NO: 286890 - DNA, 25 bp, Rattus norvegicus
gaaacttggtcctctgagtcacaaa

SEQ ID NO: 286891 - DNA, 25 bp, Rattus norvegicus
gaaacttgtcatactcgatgctctg

SEQ ID NO: 286892 - DNA, 25 bp, Rattus norvegicus
gaaacttgtcattctcgatgctctg

SEQ ID NO: 286893 - DNA, 25 bp, Rattus norvegicus
gaaacttgtgcactgggctgcccat

SEQ ID NO: 286894 - DNA, 25 bp, Rattus norvegicus
gaaacttgtgcagtgggctgcccat

SEQ ID NO: 286895 - DNA, 25 bp, Rattus norvegicus
gaaacttgtgccaccaaatcagagt

SEQ ID NO: 286896 - DNA, 25 bp, Rattus norvegicus
gaaacttgtgcctccaaatcagagt

SEQ ID NO: 286897 - DNA, 25 bp, Rattus norvegicus
gaaacttgtggcacaaatcctgata

SEQ ID NO: 286898 - DNA, 25 bp, Rattus norvegicus
gaaacttgtggctcaaatcctgata

SEQ ID NO: 286899 - DNA, 25 bp, Rattus norvegicus
gaaactttaccacgcatctggttct

SEQ ID NO: 286900 - DNA, 25 bp, Rattus norvegicus
gaaactttaccaggcatctggttct

SEQ ID NO: 286901 - DNA, 25 bp, Rattus norvegicus
gaaactttagaaccatgcatacctt

SEQ ID NO: 286902 - DNA, 25 bp, Rattus norvegicus
gaaactttagaagcatgcatacctt

SEQ ID NO: 286903 - DNA, 25 bp, Rattus norvegicus
gaaactttatgtcaatcgccctccc

SEQ ID NO: 286904 - DNA, 25 bp, Rattus norvegicus
gaaactttatgtgaatcgccctccc

SEQ ID NO: 286905 - DNA, 25 bp, Rattus norvegicus
gaaactttattcctccttgagaaca

SEQ ID NO: 286906 - DNA, 25 bp, Rattus norvegicus
gaaactttattcgtccttgagaaca

SEQ ID NO: 286907 - DNA, 25 bp, Rattus norvegicus
gaaactttcacccaagatcttccaa

SEQ ID NO: 286908 - DNA, 25 bp, Rattus norvegicus
gaaactttcaccgaagatcttccaa

SEQ ID NO: 286909 - DNA, 25 bp, Rattus norvegicus
gaaactttcactacaggatctgtcg

SEQ ID NO: 286910 - DNA, 25 bp, Rattus norvegicus
gaaactttcacttcaggatctgtcg

SEQ ID NO: 286911 - DNA, 25 bp, Rattus norvegicus
gaaactttcagcatccagtggagcc

SEQ ID NO: 286912 - DNA, 25 bp, Rattus norvegicus
gaaactttcagcttccagtggagcc

SEQ ID NO: 286913 - DNA, 25 bp, Rattus norvegicus
gaaactttcatcactatcttgcggt

SEQ ID NO: 286914 - DNA, 25 bp, Rattus norvegicus
gaaactttcatctctatcttgcggt

SEQ ID NO: 286915 - DNA, 25 bp, Rattus norvegicus
gaaactttcctgaattctgtatata

SEQ ID NO: 286916 - DNA, 25 bp, Rattus norvegicus
gaaactttcctgtattctgtatata

SEQ ID NO: 286917 - DNA, 25 bp, Rattus norvegicus
gaaactttctaaagctgagattgat

SEQ ID NO: 286918 - DNA, 25 bp, Rattus norvegicus
gaaactttctaatgctgagattgat

SEQ ID NO: 286919 - DNA, 25 bp, Rattus norvegicus
gaaactttctctagtagtgcctctt

SEQ ID NO: 286920 - DNA, 25 bp, Rattus norvegicus
gaaactttctctattcactcctgtc

SEQ ID NO: 286921 - DNA, 25 bp, Rattus norvegicus
gaaactttctcttgtagtgcctctt

SEQ ID NO: 286922 - DNA, 25 bp, Rattus norvegicus
gaaactttctcttttcactcctgtc

SEQ ID NO: 286923 - DNA, 25 bp, Rattus norvegicus
gaaactttctgcaagaggctcccaa

SEQ ID NO: 286924 - DNA, 25 bp, Rattus norvegicus
gaaactttctgcatatgtgccattt

SEQ ID NO: 286925 - DNA, 25 bp, Rattus norvegicus
gaaactttctgctagaggctcccaa

SEQ ID NO: 286926 - DNA, 25 bp, Rattus norvegicus
gaaactttctgcttatgtgccattt

SEQ ID NO: 286927 - DNA, 25 bp, Rattus norvegicus
gaaactttcttactacatcctcaat

SEQ ID NO: 286928 - DNA, 25 bp, Rattus norvegicus
gaaactttcttactggcttccttgt

SEQ ID NO: 286929 - DNA, 25 bp, Rattus norvegicus
gaaactttcttagtacatcctcaat

SEQ ID NO: 286930 - DNA, 25 bp, Rattus norvegicus
gaaactttcttagtggcttccttgt

SEQ ID NO: 286931 - DNA, 25 bp, Rattus norvegicus
gaaactttcttcactttgctgtgca

SEQ ID NO: 286932 - DNA, 25 bp, Rattus norvegicus
gaaactttcttctctttgctgtgca

SEQ ID NO: 286933 - DNA, 25 bp, Rattus norvegicus
gaaactttgaaaactgaggcttttg

SEQ ID NO: 286934 - DNA, 25 bp, Rattus norvegicus
gaaactttgaaatctgaggcttttg

SEQ ID NO: 286935 - DNA, 25 bp, Rattus norvegicus
gaaactttgataacaggacttactc

SEQ ID NO: 286936 - DNA, 25 bp, Rattus norvegicus
gaaactttgatatcaggacttactc

SEQ ID NO: 286937 - DNA, 25 bp, Rattus norvegicus
gaaactttgatcaactcctgacctg

SEQ ID NO: 286938 - DNA, 25 bp, Rattus norvegicus
gaaactttgatctactcctgacctg

SEQ ID NO: 286939 - DNA, 25 bp, Rattus norvegicus
gaaactttgcacaccataagcttat

SEQ ID NO: 286940 - DNA, 25 bp, Rattus norvegicus
gaaactttgcactccataagcttat

SEQ ID NO: 286941 - DNA, 25 bp, Rattus norvegicus
gaaactttgcctcttctgttcagtt

SEQ ID NO: 286942 - DNA, 25 bp, Rattus norvegicus
gaaactttgcctgttctgttcagtt

SEQ ID NO: 286943 - DNA, 25 bp, Rattus norvegicus
gaaactttgctaagcagtatttaga

SEQ ID NO: 286944 - DNA, 25 bp, Rattus norvegicus
gaaactttgctatgcagtatttaga

SEQ ID NO: 286945 - DNA, 25 bp, Rattus norvegicus
gaaactttgctgcatttactccctt

SEQ ID NO: 286946 - DNA, 25 bp, Rattus norvegicus
gaaactttgctggatttactccctt

SEQ ID NO: 286947 - DNA, 25 bp, Rattus norvegicus
gaaactttgggacaagcacttcaag

SEQ ID NO: 286948 - DNA, 25 bp, Rattus norvegicus
gaaactttgggagaagcacttcaag

SEQ ID NO: 286949 - DNA, 25 bp, Rattus norvegicus
gaaactttgtatccatacggtatca

SEQ ID NO: 286950 - DNA, 25 bp, Rattus norvegicus
gaaactttgtatgcatacggtatca

SEQ ID NO: 286951 - DNA, 25 bp, Rattus norvegicus
gaaacttttagaccttgttggacag

SEQ ID NO: 286952 - DNA, 25 bp, Rattus norvegicus
gaaacttttagagcttgttggacag

SEQ ID NO: 286953 - DNA, 25 bp, Rattus norvegicus
gaaacttttaggactgtctggcttt

SEQ ID NO: 286954 - DNA, 25 bp, Rattus norvegicus
gaaacttttaggtctgtctggcttt

SEQ ID NO: 286955 - DNA, 25 bp, Rattus norvegicus
gaaacttttcctatgtgtcaccaga

SEQ ID NO: 286956 - DNA, 25 bp, Rattus norvegicus
gaaacttttcctttgtgtcaccaga

SEQ ID NO: 286957 - DNA, 25 bp, Rattus norvegicus
gaaacttttctcattcacaaattgt

SEQ ID NO: 286958 - DNA, 25 bp, Rattus norvegicus
gaaacttttctctttcacaaattgt

SEQ ID NO: 286959 - DNA, 25 bp, Rattus norvegicus
gaaacttttggcatactcagttcat

SEQ ID NO: 286960 - DNA, 25 bp, Rattus norvegicus
gaaacttttggcttactcagttcat

SEQ ID NO: 286961 - DNA, 25 bp, Rattus norvegicus
gaaacttttgtcaggccaaggcaca

SEQ ID NO: 286962 - DNA, 25 bp, Rattus norvegicus
gaaacttttgtctggccaaggcaca

SEQ ID NO: 286963 - DNA, 25 bp, Rattus norvegicus
gaaactttttacatccacattcagc

SEQ ID NO: 286964 - DNA, 25 bp, Rattus norvegicus
gaaactttttacttccacattcagc

SEQ ID NO: 286965 - DNA, 25 bp, Rattus norvegicus
gaaagaaaacccagatttgccaccg

SEQ ID NO: 286966 - DNA, 25 bp, Rattus norvegicus
gaaagaaaaccctgatttgccaccg

SEQ ID NO: 286967 - DNA, 25 bp, Rattus norvegicus
gaaagaaaactgactcccgcgggtg

SEQ ID NO: 286968 - DNA, 25 bp, Rattus norvegicus
gaaagaaaactgtctcccgcgggtg

SEQ ID NO: 286969 - DNA, 25 bp, Rattus norvegicus
gaaagaaaacttctctggtgcctaa

SEQ ID NO: 286970 - DNA, 25 bp, Rattus norvegicus
gaaagaaaacttgtctggtgcctaa

SEQ ID NO: 286971 - DNA, 25 bp, Rattus norvegicus
gaaagaaaagctctccttgtcactg

SEQ ID NO: 286972 - DNA, 25 bp, Rattus norvegicus
gaaagaaaagctgtccttgtcactg

SEQ ID NO: 286973 - DNA, 25 bp, Rattus norvegicus
gaaagaaacgctcaacctgcatttt

SEQ ID NO: 286974 - DNA, 25 bp, Rattus norvegicus
gaaagaaacgctgaacctgcatttt

SEQ ID NO: 286975 - DNA, 25 bp, Rattus norvegicus
gaaagaaactctaccgctctgaagg

SEQ ID NO: 286976 - DNA, 25 bp, Rattus norvegicus
gaaagaaactcttccgctctgaagg

SEQ ID NO: 286977 - DNA, 25 bp, Rattus norvegicus
gaaagaaactgcacacccataggga

SEQ ID NO: 286978 - DNA, 25 bp, Rattus norvegicus
gaaagaaactgctcacccataggga

SEQ ID NO: 286979 - DNA, 25 bp, Rattus norvegicus
gaaagaaagctcaccatgacctcgg

SEQ ID NO: 286980 - DNA, 25 bp, Rattus norvegicus
gaaagaaagctctccatgacctcgg

SEQ ID NO: 286981 - DNA, 25 bp, Rattus norvegicus
gaaagaaagcttccaacactcccag

SEQ ID NO: 286982 - DNA, 25 bp, Rattus norvegicus
gaaagaaagcttgcaacactcccag

SEQ ID NO: 286983 - DNA, 25 bp, Rattus norvegicus
gaaagaaaggacagccggacgccaa

SEQ ID NO: 286984 - DNA, 25 bp, Rattus norvegicus
gaaagaaaggactgccggacgccaa

SEQ ID NO: 286985 - DNA, 25 bp, Rattus norvegicus
gaaagaaaggccaaccatctctcca

SEQ ID NO: 286986 - DNA, 25 bp, Rattus norvegicus
gaaagaaaggcctaccatctctcca

SEQ ID NO: 286987 - DNA, 25 bp, Rattus norvegicus
gaaagaaagtctacactctcatcct

SEQ ID NO: 286988 - DNA, 25 bp, Rattus norvegicus
gaaagaaagtcttcactctcatcct

SEQ ID NO: 286989 - DNA, 25 bp, Rattus norvegicus
gaaagaaataccaagagactgagaa

SEQ ID NO: 286990 - DNA, 25 bp, Rattus norvegicus
gaaagaaatacctagagactgagaa

SEQ ID NO: 286991 - DNA, 25 bp, Rattus norvegicus
gaaagaaatctgacaggcctctgtt

SEQ ID NO: 286992 - DNA, 25 bp, Rattus norvegicus
gaaagaaatctgtcaggcctctgtt

SEQ ID NO: 286993 - DNA, 25 bp, Rattus norvegicus
gaaagaaatgctacccaagccactt

SEQ ID NO: 286994 - DNA, 25 bp, Rattus norvegicus
gaaagaaatgcttcccaagccactt

SEQ ID NO: 286995 - DNA, 25 bp, Rattus norvegicus
gaaagaaatggtagtcctggcccca

SEQ ID NO: 286996 - DNA, 25 bp, Rattus norvegicus
gaaagaaatggttgtcctggcccca

SEQ ID NO: 286997 - DNA, 25 bp, Rattus norvegicus
gaaagaacaagcacccacaagttgt

SEQ ID NO: 286998 - DNA, 25 bp, Rattus norvegicus
gaaagaacaagcctcttggaccagt

SEQ ID NO: 286999 - DNA, 25 bp, Rattus norvegicus
gaaagaacaagcgtcttggaccagt

SEQ ID NO: 287000 - DNA, 25 bp, Rattus norvegicus
gaaagaacaagctcccacaagttgt

SEQ ID NO: 287001 - DNA, 25 bp, Rattus norvegicus
gaaagaacagccaagctcacctgag

SEQ ID NO: 287002 - DNA, 25 bp, Rattus norvegicus
gaaagaacagcctagctcacctgag

SEQ ID NO: 287003 - DNA, 25 bp, Rattus norvegicus
gaaagaacatacacgctgcatcctc

SEQ ID NO: 287004 - DNA, 25 bp, Rattus norvegicus
gaaagaacatactcgctgcatcctc

SEQ ID NO: 287005 - DNA, 25 bp, Rattus norvegicus
gaaagaacatttaatctcagcttag

SEQ ID NO: 287006 - DNA, 25 bp, Rattus norvegicus
gaaagaacattttatctcagcttag

SEQ ID NO: 287007 - DNA, 25 bp, Rattus norvegicus
gaaagaaccacacctaactactcat

SEQ ID NO: 287008 - DNA, 25 bp, Rattus norvegicus
gaaagaaccacagctaactactcat

SEQ ID NO: 287009 - DNA, 25 bp, Rattus norvegicus
gaaagaaccaccaggtgcgggtaca

SEQ ID NO: 287010 - DNA, 25 bp, Rattus norvegicus
gaaagaaccacctggtgcgggtaca

SEQ ID NO: 287011 - DNA, 25 bp, Rattus norvegicus
gaaagaaccacgagcttccttcaaa

SEQ ID NO: 287012 - DNA, 25 bp, Rattus norvegicus
gaaagaaccacgtgcttccttcaaa

SEQ ID NO: 287013 - DNA, 25 bp, Rattus norvegicus
gaaagaaccatgcacaatcccctgg

SEQ ID NO: 287014 - DNA, 25 bp, Rattus norvegicus
gaaagaaccatgcattcccttgtct

SEQ ID NO: 287015 - DNA, 25 bp, Rattus norvegicus
gaaagaaccatggacaatcccctgg

SEQ ID NO: 287016 - DNA, 25 bp, Rattus norvegicus
gaaagaaccatggattcccttgtct

SEQ ID NO: 287017 - DNA, 25 bp, Rattus norvegicus
gaaagaaccgaaaagctgggtcatt

SEQ ID NO: 287018 - DNA, 25 bp, Rattus norvegicus
gaaagaaccgaactcaaatacactg

SEQ ID NO: 287019 - DNA, 25 bp, Rattus norvegicus
gaaagaaccgaagtcaaatacactg

SEQ ID NO: 287020 - DNA, 25 bp, Rattus norvegicus
gaaagaaccgaatagctgggtcatt

SEQ ID NO: 287021 - DNA, 25 bp, Rattus norvegicus
gaaagaacctcacggcacacttgtt

SEQ ID NO: 287022 - DNA, 25 bp, Rattus norvegicus
gaaagaacctcagggcacacttgtt

SEQ ID NO: 287023 - DNA, 25 bp, Rattus norvegicus
gaaagaacgagaccggtcatccagc

SEQ ID NO: 287024 - DNA, 25 bp, Rattus norvegicus
gaaagaacgagagcggtcatccagc

SEQ ID NO: 287025 - DNA, 25 bp, Rattus norvegicus
gaaagaacgccacctccgagcgagg

SEQ ID NO: 287026 - DNA, 25 bp, Rattus norvegicus
gaaagaacgccagctccgagcgagg

SEQ ID NO: 287027 - DNA, 25 bp, Rattus norvegicus
gaaagaacgcctatcagtctgtccc

SEQ ID NO: 287028 - DNA, 25 bp, Rattus norvegicus
gaaagaacgcctttcagtctgtccc

SEQ ID NO: 287029 - DNA, 25 bp, Rattus norvegicus
gaaagaactaacacccacgcacata

SEQ ID NO: 287030 - DNA, 25 bp, Rattus norvegicus
gaaagaactaactcccacgcacata

SEQ ID NO: 287031 - DNA, 25 bp, Rattus norvegicus
gaaagaactctcaacttcagaggat

SEQ ID NO: 287032 - DNA, 25 bp, Rattus norvegicus
gaaagaactctctacttcagaggat

SEQ ID NO: 287033 - DNA, 25 bp, Rattus norvegicus
gaaagaactgcgacatgtctgagct

SEQ ID NO: 287034 - DNA, 25 bp, Rattus norvegicus
gaaagaactgcgtcatgtctgagct

SEQ ID NO: 287035 - DNA, 25 bp, Rattus norvegicus
gaaagaactgttagccaccgaacct

SEQ ID NO: 287036 - DNA, 25 bp, Rattus norvegicus
gaaagaactgttcctctccaaagct

SEQ ID NO: 287037 - DNA, 25 bp, Rattus norvegicus
gaaagaactgttctcacccatggcc

SEQ ID NO: 287038 - DNA, 25 bp, Rattus norvegicus
gaaagaactgttgctctccaaagct

SEQ ID NO: 287039 - DNA, 25 bp, Rattus norvegicus
gaaagaactgttgtcacccatggcc

SEQ ID NO: 287040 - DNA, 25 bp, Rattus norvegicus
gaaagaactgtttgccaccgaacct

SEQ ID NO: 287041 - DNA, 25 bp, Rattus norvegicus
gaaagaagaatcctctcttactcag

SEQ ID NO: 287042 - DNA, 25 bp, Rattus norvegicus
gaaagaagaatcgtctcttactcag

SEQ ID NO: 287043 - DNA, 25 bp, Rattus norvegicus
gaaagaagacccaggagccactcgt

SEQ ID NO: 287044 - DNA, 25 bp, Rattus norvegicus
gaaagaagaccctggagccactcgt

SEQ ID NO: 287045 - DNA, 25 bp, Rattus norvegicus
gaaagaagacggcatgctcagcaat

SEQ ID NO: 287046 - DNA, 25 bp, Rattus norvegicus
gaaagaagacgggatgctcagcaat

SEQ ID NO: 287047 - DNA, 25 bp, Rattus norvegicus
gaaagaagactcactcactacaaag

SEQ ID NO: 287048 - DNA, 25 bp, Rattus norvegicus
gaaagaagactctctcactacaaag

SEQ ID NO: 287049 - DNA, 25 bp, Rattus norvegicus
gaaagaagatgaatctgtcctccct

SEQ ID NO: 287050 - DNA, 25 bp, Rattus norvegicus
gaaagaagatgattctgtcctccct

SEQ ID NO: 287051 - DNA, 25 bp, Rattus norvegicus
gaaagaagcccaacacagtcatctg

SEQ ID NO: 287052 - DNA, 25 bp, Rattus norvegicus
gaaagaagcccatcacagtcatctg

SEQ ID NO: 287053 - DNA, 25 bp, Rattus norvegicus
gaaagaagccctcgcgatcattggc

SEQ ID NO: 287054 - DNA, 25 bp, Rattus norvegicus
gaaagaagccctggcgatcattggc

SEQ ID NO: 287055 - DNA, 25 bp, Rattus norvegicus
gaaagaagcggcagtgcccaggtat

SEQ ID NO: 287056 - DNA, 25 bp, Rattus norvegicus
gaaagaagcggctgtgcccaggtat

SEQ ID NO: 287057 - DNA, 25 bp, Rattus norvegicus
gaaagaagctggatcatgtcctcat

SEQ ID NO: 287058 - DNA, 25 bp, Rattus norvegicus
gaaagaagctggttcatgtcctcat

SEQ ID NO: 287059 - DNA, 25 bp, Rattus norvegicus
gaaagaagtcacaccgtcagggaac

SEQ ID NO: 287060 - DNA, 25 bp, Rattus norvegicus
gaaagaagtcactccgtcagggaac

SEQ ID NO: 287061 - DNA, 25 bp, Rattus norvegicus
gaaagaagtcatctaccaacccacc

SEQ ID NO: 287062 - DNA, 25 bp, Rattus norvegicus
gaaagaagtcatgtaccaacccacc

SEQ ID NO: 287063 - DNA, 25 bp, Rattus norvegicus
gaaagaagtcctatggcatgtccaa

SEQ ID NO: 287064 - DNA, 25 bp, Rattus norvegicus
gaaagaagtcctttggcatgtccaa

SEQ ID NO: 287065 - DNA, 25 bp, Rattus norvegicus
gaaagaagtctcctctgtgtcagat

SEQ ID NO: 287066 - DNA, 25 bp, Rattus norvegicus
gaaagaagtctcgtctgtgtcagat

SEQ ID NO: 287067 - DNA, 25 bp, Rattus norvegicus
gaaagaagtgccagtgtctcctcat

SEQ ID NO: 287068 - DNA, 25 bp, Rattus norvegicus
gaaagaagtgcctgtgtctcctcat

SEQ ID NO: 287069 - DNA, 25 bp, Rattus norvegicus
gaaagaagttagagtgctctctgta

SEQ ID NO: 287070 - DNA, 25 bp, Rattus norvegicus
gaaagaagttagtgtgctctctgta

SEQ ID NO: 287071 - DNA, 25 bp, Rattus norvegicus
gaaagaatacctcccgtactgtttg

SEQ ID NO: 287072 - DNA, 25 bp, Rattus norvegicus
gaaagaatacctgccgtactgtttg

SEQ ID NO: 287073 - DNA, 25 bp, Rattus norvegicus
gaaagaatatgcagctggccaccaa

SEQ ID NO: 287074 - DNA, 25 bp, Rattus norvegicus
gaaagaatatgctgctggccaccaa

SEQ ID NO: 287075 - DNA, 25 bp, Rattus norvegicus
gaaagaatccacctagactgtacat

SEQ ID NO: 287076 - DNA, 25 bp, Rattus norvegicus
gaaagaatccacgtagactgtacat

SEQ ID NO: 287077 - DNA, 25 bp, Rattus norvegicus
gaaagaatcctgaagaaggcatcaa

SEQ ID NO: 287078 - DNA, 25 bp, Rattus norvegicus
gaaagaatcctgtagaaggcatcaa

SEQ ID NO: 287079 - DNA, 25 bp, Rattus norvegicus
gaaagaatccttctgaccccagtgt

SEQ ID NO: 287080 - DNA, 25 bp, Rattus norvegicus
gaaagaatccttgtgaccccagtgt

SEQ ID NO: 287081 - DNA, 25 bp, Rattus norvegicus
gaaagaatcggtctcattccgcccc

SEQ ID NO: 287082 - DNA, 25 bp, Rattus norvegicus
gaaagaatcggtgtcattccgcccc

SEQ ID NO: 287083 - DNA, 25 bp, Rattus norvegicus
gaaagaatcgtcaaaacaacccaat

SEQ ID NO: 287084 - DNA, 25 bp, Rattus norvegicus
gaaagaatcgtctaaacaacccaat

SEQ ID NO: 287085 - DNA, 25 bp, Rattus norvegicus
gaaagaatctgcctttctttgcccc

SEQ ID NO: 287086 - DNA, 25 bp, Rattus norvegicus
gaaagaatctgcgtttctttgcccc

SEQ ID NO: 287087 - DNA, 25 bp, Rattus norvegicus
gaaagaatctgtctcccttgagctg

SEQ ID NO: 287088 - DNA, 25 bp, Rattus norvegicus
gaaagaatctgtgtcccttgagctg

SEQ ID NO: 287089 - DNA, 25 bp, Rattus norvegicus
gaaagaatcttcaacctccaaagtt

SEQ ID NO: 287090 - DNA, 25 bp, Rattus norvegicus
gaaagaatcttctacctccaaagtt

SEQ ID NO: 287091 - DNA, 25 bp, Rattus norvegicus
gaaagaatgcggacccttttaccag

SEQ ID NO: 287092 - DNA, 25 bp, Rattus norvegicus
gaaagaatgcggtcccttttaccag

SEQ ID NO: 287093 - DNA, 25 bp, Rattus norvegicus
gaaagaatgtccattgttctgttcc

SEQ ID NO: 287094 - DNA, 25 bp, Rattus norvegicus
gaaagaatgtcctttgttctgttcc

SEQ ID NO: 287095 - DNA, 25 bp, Rattus norvegicus
gaaagaatgtgtcttcttcctccgg

SEQ ID NO: 287096 - DNA, 25 bp, Rattus norvegicus
gaaagaatgtgtgttcttcctccgg

SEQ ID NO: 287097 - DNA, 25 bp, Rattus norvegicus
gaaagaatgttccttcgagcagctg

SEQ ID NO: 287098 - DNA, 25 bp, Rattus norvegicus
gaaagaatgttcgttcgagcagctg

SEQ ID NO: 287099 - DNA, 25 bp, Rattus norvegicus
gaaagaatgttgactgaggccatac

SEQ ID NO: 287100 - DNA, 25 bp, Rattus norvegicus
gaaagaatgttgtctgaggccatac

SEQ ID NO: 287101 - DNA, 25 bp, Rattus norvegicus
gaaagaatttccatccagggagagg

SEQ ID NO: 287102 - DNA, 25 bp, Rattus norvegicus
gaaagaatttccttccagggagagg

SEQ ID NO: 287103 - DNA, 25 bp, Rattus norvegicus
gaaagacaaagcactgcctacatag

SEQ ID NO: 287104 - DNA, 25 bp, Rattus norvegicus
gaaagacaaagctctgcctacatag

SEQ ID NO: 287105 - DNA, 25 bp, Rattus norvegicus
gaaagacaaatcagctcatggagag

SEQ ID NO: 287106 - DNA, 25 bp, Rattus norvegicus
gaaagacaaatctgctcatggagag

SEQ ID NO: 287107 - DNA, 25 bp, Rattus norvegicus
gaaagacaacagacttttgtcccct

SEQ ID NO: 287108 - DNA, 25 bp, Rattus norvegicus
gaaagacaacagtcttttgtcccct

SEQ ID NO: 287109 - DNA, 25 bp, Rattus norvegicus
gaaagacaacgtacatccagggaca

SEQ ID NO: 287110 - DNA, 25 bp, Rattus norvegicus
gaaagacaacgttcatccagggaca

SEQ ID NO: 287111 - DNA, 25 bp, Rattus norvegicus
gaaagacaagagagtggcccacacc

SEQ ID NO: 287112 - DNA, 25 bp, Rattus norvegicus
gaaagacaagagtgtggcccacacc

SEQ ID NO: 287113 - DNA, 25 bp, Rattus norvegicus
gaaagacaagccagaccctttaggg

SEQ ID NO: 287114 - DNA, 25 bp, Rattus norvegicus
gaaagacaagcctgaccctttaggg

SEQ ID NO: 287115 - DNA, 25 bp, Rattus norvegicus
gaaagacaagttaaccaggcagtgg

SEQ ID NO: 287116 - DNA, 25 bp, Rattus norvegicus
gaaagacaagtttaccaggcagtgg

SEQ ID NO: 287117 - DNA, 25 bp, Rattus norvegicus
gaaagacaatgtccgctactccaga

SEQ ID NO: 287118 - DNA, 25 bp, Rattus norvegicus
gaaagacaatgtgcgctactccaga

SEQ ID NO: 287119 - DNA, 25 bp, Rattus norvegicus
gaaagacaccacaaccaacacgaaa

SEQ ID NO: 287120 - DNA, 25 bp, Rattus norvegicus
gaaagacaccactaccaacacgaaa

SEQ ID NO: 287121 - DNA, 25 bp, Rattus norvegicus
gaaagacaccagacgactccaatga

SEQ ID NO: 287122 - DNA, 25 bp, Rattus norvegicus
gaaagacaccagtcgactccaatga

SEQ ID NO: 287123 - DNA, 25 bp, Rattus norvegicus
gaaagacacgctcagtctctctggt

SEQ ID NO: 287124 - DNA, 25 bp, Rattus norvegicus
gaaagacacgctgagtctctctggt

SEQ ID NO: 287125 - DNA, 25 bp, Rattus norvegicus
gaaagacactcaatcacactgatgt

SEQ ID NO: 287126 - DNA, 25 bp, Rattus norvegicus
gaaagacactcattcacactgatgt

SEQ ID NO: 287127 - DNA, 25 bp, Rattus norvegicus
gaaagacagagacatacagagggat

SEQ ID NO: 287128 - DNA, 25 bp, Rattus norvegicus
gaaagacagagagatacagagggat

SEQ ID NO: 287129 - DNA, 25 bp, Rattus norvegicus
gaaagacagctgatttcccgcaacc

SEQ ID NO: 287130 - DNA, 25 bp, Rattus norvegicus
gaaagacagctgttttcccgcaacc

SEQ ID NO: 287131 - DNA, 25 bp, Rattus norvegicus
gaaagacatatgctcttagccacta

SEQ ID NO: 287132 - DNA, 25 bp, Rattus norvegicus
gaaagacatatggtcttagccacta

SEQ ID NO: 287133 - DNA, 25 bp, Rattus norvegicus
gaaagacatcagagcgtgacccttc

SEQ ID NO: 287134 - DNA, 25 bp, Rattus norvegicus
gaaagacatcagtgcgtgacccttc

SEQ ID NO: 287135 - DNA, 25 bp, Rattus norvegicus
gaaagacatgccctctgccaagcag

SEQ ID NO: 287136 - DNA, 25 bp, Rattus norvegicus
gaaagacatgccgtctgccaagcag

SEQ ID NO: 287137 - DNA, 25 bp, Rattus norvegicus
gaaagacattctcatgctggctgct

SEQ ID NO: 287138 - DNA, 25 bp, Rattus norvegicus
gaaagacattctccttccatggacg

SEQ ID NO: 287139 - DNA, 25 bp, Rattus norvegicus
gaaagacattctgatgctggctgct

SEQ ID NO: 287140 - DNA, 25 bp, Rattus norvegicus
gaaagacattctgcttccatggacg

SEQ ID NO: 287141 - DNA, 25 bp, Rattus norvegicus
gaaagacattgcaaaaatcacccat

SEQ ID NO: 287142 - DNA, 25 bp, Rattus norvegicus
gaaagacattgctaaaatcacccat

SEQ ID NO: 287143 - DNA, 25 bp, Rattus norvegicus
gaaagaccaacaacagatacccaga

SEQ ID NO: 287144 - DNA, 25 bp, Rattus norvegicus
gaaagaccaacatcagatacccaga

SEQ ID NO: 287145 - DNA, 25 bp, Rattus norvegicus
gaaagaccaattccctgatatttaa

SEQ ID NO: 287146 - DNA, 25 bp, Rattus norvegicus
gaaagaccaattgcctgatatttaa

SEQ ID NO: 287147 - DNA, 25 bp, Rattus norvegicus
gaaagaccactccaactacaggtgt

SEQ ID NO: 287148 - DNA, 25 bp, Rattus norvegicus
gaaagaccactcgaactacaggtgt

SEQ ID NO: 287149 - DNA, 25 bp, Rattus norvegicus
gaaagaccactgactttcctgggct

SEQ ID NO: 287150 - DNA, 25 bp, Rattus norvegicus
gaaagaccactgtctttcctgggct

SEQ ID NO: 287151 - DNA, 25 bp, Rattus norvegicus
gaaagaccagcacttaagtgaccct

SEQ ID NO: 287152 - DNA, 25 bp, Rattus norvegicus
gaaagaccagcagttaagtgaccct

SEQ ID NO: 287153 - DNA, 25 bp, Rattus norvegicus
gaaagaccatcgagtctaccagtaa

SEQ ID NO: 287154 - DNA, 25 bp, Rattus norvegicus
gaaagaccatcgtgtctaccagtaa

SEQ ID NO: 287155 - DNA, 25 bp, Rattus norvegicus
gaaagaccattgctgcatggaatta

SEQ ID NO: 287156 - DNA, 25 bp, Rattus norvegicus
gaaagaccattggtgcatggaatta

SEQ ID NO: 287157 - DNA, 25 bp, Rattus norvegicus
gaaagacccactacgtagctgaatt

SEQ ID NO: 287158 - DNA, 25 bp, Rattus norvegicus
gaaagacccacttcgtagctgaatt

SEQ ID NO: 287159 - DNA, 25 bp, Rattus norvegicus
gaaagacccagcaaacgcagctgct

SEQ ID NO: 287160 - DNA, 25 bp, Rattus norvegicus
gaaagacccagctaacgcagctgct

SEQ ID NO: 287161 - DNA, 25 bp, Rattus norvegicus
gaaagacccaggagcagaccttcta

SEQ ID NO: 287162 - DNA, 25 bp, Rattus norvegicus
gaaagacccaggtgcagaccttcta

SEQ ID NO: 287163 - DNA, 25 bp, Rattus norvegicus
gaaagaccctgcaggtgaaacgcct

SEQ ID NO: 287164 - DNA, 25 bp, Rattus norvegicus
gaaagaccctgctggtgaaacgcct

SEQ ID NO: 287165 - DNA, 25 bp, Rattus norvegicus
gaaagaccctgtagtctctgtgttt

SEQ ID NO: 287166 - DNA, 25 bp, Rattus norvegicus
gaaagaccctgttgtctctgtgttt

SEQ ID NO: 287167 - DNA, 25 bp, Rattus norvegicus
gaaagaccgataaaccccagaagca

SEQ ID NO: 287168 - DNA, 25 bp, Rattus norvegicus
gaaagaccgatataccccagaagca

SEQ ID NO: 287169 - DNA, 25 bp, Rattus norvegicus
gaaagacctcctcttctttgtgttg

SEQ ID NO: 287170 - DNA, 25 bp, Rattus norvegicus
gaaagacctcctgttctttgtgttg

SEQ ID NO: 287171 - DNA, 25 bp, Rattus norvegicus
gaaagacctctcaccaattgctgaa

SEQ ID NO: 287172 - DNA, 25 bp, Rattus norvegicus
gaaagacctctctccaattgctgaa

SEQ ID NO: 287173 - DNA, 25 bp, Rattus norvegicus
gaaagacctcttaaattgtaccatt

SEQ ID NO: 287174 - DNA, 25 bp, Rattus norvegicus
gaaagacctcttacagattgccgtt

SEQ ID NO: 287175 - DNA, 25 bp, Rattus norvegicus
gaaagacctcttaggcgagaagatt

SEQ ID NO: 287176 - DNA, 25 bp, Rattus norvegicus
gaaagacctctttaattgtaccatt

SEQ ID NO: 287177 - DNA, 25 bp, Rattus norvegicus
gaaagacctctttcagattgccgtt

SEQ ID NO: 287178 - DNA, 25 bp, Rattus norvegicus
gaaagacctctttggcgagaagatt

SEQ ID NO: 287179 - DNA, 25 bp, Rattus norvegicus
gaaagacctgaaagccttgtctgcc

SEQ ID NO: 287180 - DNA, 25 bp, Rattus norvegicus
gaaagacctgaatgccttgtctgcc

SEQ ID NO: 287181 - DNA, 25 bp, Rattus norvegicus
gaaagacctgatcctacttttggcc

SEQ ID NO: 287182 - DNA, 25 bp, Rattus norvegicus
gaaagacctgatgctacttttggcc

SEQ ID NO: 287183 - DNA, 25 bp, Rattus norvegicus
gaaagacctgggaccccgaactcag

SEQ ID NO: 287184 - DNA, 25 bp, Rattus norvegicus
gaaagacctgggtccccgaactcag

SEQ ID NO: 287185 - DNA, 25 bp, Rattus norvegicus
gaaagacctgtccagtcaatggctg

SEQ ID NO: 287186 - DNA, 25 bp, Rattus norvegicus
gaaagacctgtcgagtcaatggctg

SEQ ID NO: 287187 - DNA, 25 bp, Rattus norvegicus
gaaagacctgttctgtgatggaaac

SEQ ID NO: 287188 - DNA, 25 bp, Rattus norvegicus
gaaagacctgttgtgtgatggaaac

SEQ ID NO: 287189 - DNA, 25 bp, Rattus norvegicus
gaaagaccttacatgcagactgtgg

SEQ ID NO: 287190 - DNA, 25 bp, Rattus norvegicus
gaaagaccttacttgcagactgtgg

SEQ ID NO: 287191 - DNA, 25 bp, Rattus norvegicus
gaaagaccttgcagagcagtcaaga

SEQ ID NO: 287192 - DNA, 25 bp, Rattus norvegicus
gaaagaccttgctgagcagtcaaga

SEQ ID NO: 287193 - DNA, 25 bp, Rattus norvegicus
gaaagaccttttctacagattgaaa

SEQ ID NO: 287194 - DNA, 25 bp, Rattus norvegicus
gaaagaccttttgtacagattgaaa

SEQ ID NO: 287195 - DNA, 25 bp, Rattus norvegicus
gaaagacgaagactccgatccctat

SEQ ID NO: 287196 - DNA, 25 bp, Rattus norvegicus
gaaagacgaagagtccgatccctat

SEQ ID NO: 287197 - DNA, 25 bp, Rattus norvegicus
gaaagacgaattaccctgtggctaa

SEQ ID NO: 287198 - DNA, 25 bp, Rattus norvegicus
gaaagacgaatttccctgtggctaa

SEQ ID NO: 287199 - DNA, 25 bp, Rattus norvegicus
gaaagacgacaaaagcctggctcct

SEQ ID NO: 287200 - DNA, 25 bp, Rattus norvegicus
gaaagacgacaatagcctggctcct

SEQ ID NO: 287201 - DNA, 25 bp, Rattus norvegicus
gaaagacgcaagcatgcaggactca

SEQ ID NO: 287202 - DNA, 25 bp, Rattus norvegicus
gaaagacgcaaggatgcaggactca

SEQ ID NO: 287203 - DNA, 25 bp, Rattus norvegicus
gaaagacgcaggactgacacaggat

SEQ ID NO: 287204 - DNA, 25 bp, Rattus norvegicus
gaaagacgcaggtctgacacaggat

SEQ ID NO: 287205 - DNA, 25 bp, Rattus norvegicus
gaaagacgcagtcagccttgtcact

SEQ ID NO: 287206 - DNA, 25 bp, Rattus norvegicus
gaaagacgcagtgagccttgtcact

SEQ ID NO: 287207 - DNA, 25 bp, Rattus norvegicus
gaaagacgccggagtgaaccagtcc

SEQ ID NO: 287208 - DNA, 25 bp, Rattus norvegicus
gaaagacgccggtgtgaaccagtcc

SEQ ID NO: 287209 - DNA, 25 bp, Rattus norvegicus
gaaagacgcgtgaaccagaaggaaa

SEQ ID NO: 287210 - DNA, 25 bp, Rattus norvegicus
gaaagacgcgtgtaccagaaggaaa

SEQ ID NO: 287211 - DNA, 25 bp, Rattus norvegicus
gaaagacgctgtatatgtttggttt

SEQ ID NO: 287212 - DNA, 25 bp, Rattus norvegicus
gaaagacgctgtttatgtttggttt

SEQ ID NO: 287213 - DNA, 25 bp, Rattus norvegicus
gaaagacgtcggcagaggacccttt

SEQ ID NO: 287214 - DNA, 25 bp, Rattus norvegicus
gaaagacgtcgggagaggacccttt

SEQ ID NO: 287215 - DNA, 25 bp, Rattus norvegicus
gaaagacgtgctcctgtgatacaga

SEQ ID NO: 287216 - DNA, 25 bp, Rattus norvegicus
gaaagacgtgctgctgtgatacaga

SEQ ID NO: 287217 - DNA, 25 bp, Rattus norvegicus
gaaagactagaaaggtccctgaagt

SEQ ID NO: 287218 - DNA, 25 bp, Rattus norvegicus
gaaagactagaatggtccctgaagt

SEQ ID NO: 287219 - DNA, 25 bp, Rattus norvegicus
gaaagactcattcaagactccttga

SEQ ID NO: 287220 - DNA, 25 bp, Rattus norvegicus
gaaagactcattgaagactccttga

SEQ ID NO: 287221 - DNA, 25 bp, Rattus norvegicus
gaaagactcctcctttggcagggtg

SEQ ID NO: 287222 - DNA, 25 bp, Rattus norvegicus
gaaagactcctcgtttggcagggtg

SEQ ID NO: 287223 - DNA, 25 bp, Rattus norvegicus
gaaagactctatcgtatgattactg

SEQ ID NO: 287224 - DNA, 25 bp, Rattus norvegicus
gaaagactctatggtatgattactg

SEQ ID NO: 287225 - DNA, 25 bp, Rattus norvegicus
gaaagactcttcaaaaagccaaggc

SEQ ID NO: 287226 - DNA, 25 bp, Rattus norvegicus
gaaagactcttctaaaagccaaggc

SEQ ID NO: 287227 - DNA, 25 bp, Rattus norvegicus
gaaagactctttcatggctctgagt

SEQ ID NO: 287228 - DNA, 25 bp, Rattus norvegicus
gaaagactctttgatggctctgagt

SEQ ID NO: 287229 - DNA, 25 bp, Rattus norvegicus
gaaagactgcctagagaatcagcaa

SEQ ID NO: 287230 - DNA, 25 bp, Rattus norvegicus
gaaagactgccttgagaatcagcaa

SEQ ID NO: 287231 - DNA, 25 bp, Rattus norvegicus
gaaagactgggcattgcctgtttga

SEQ ID NO: 287232 - DNA, 25 bp, Rattus norvegicus
gaaagactgggctttgcctgtttga

SEQ ID NO: 287233 - DNA, 25 bp, Rattus norvegicus
gaaagactggttccatgtgccacgt

SEQ ID NO: 287234 - DNA, 25 bp, Rattus norvegicus
gaaagactggttgcatgtgccacgt

SEQ ID NO: 287235 - DNA, 25 bp, Rattus norvegicus
gaaagactgtaaatgttgctggaaa

SEQ ID NO: 287236 - DNA, 25 bp, Rattus norvegicus
gaaagactgtaattgttgctggaaa

SEQ ID NO: 287237 - DNA, 25 bp, Rattus norvegicus
gaaagactgtcaagtttgcaaccca

SEQ ID NO: 287238 - DNA, 25 bp, Rattus norvegicus
gaaagactgtcatgtttgcaaccca

SEQ ID NO: 287239 - DNA, 25 bp, Rattus norvegicus
gaaagacttattcctgtgacccaac

SEQ ID NO: 287240 - DNA, 25 bp, Rattus norvegicus
gaaagacttattgctgtgacccaac

SEQ ID NO: 287241 - DNA, 25 bp, Rattus norvegicus
gaaagacttcacatggttgcctagg

SEQ ID NO: 287242 - DNA, 25 bp, Rattus norvegicus
gaaagacttcacttggttgcctagg

SEQ ID NO: 287243 - DNA, 25 bp, Rattus norvegicus
gaaagacttcctcacgtacaggact

SEQ ID NO: 287244 - DNA, 25 bp, Rattus norvegicus
gaaagacttcctgacgtacaggact

SEQ ID NO: 287245 - DNA, 25 bp, Rattus norvegicus
gaaagacttctacctctgagactca

SEQ ID NO: 287246 - DNA, 25 bp, Rattus norvegicus
gaaagacttctagctctgagactca

SEQ ID NO: 287247 - DNA, 25 bp, Rattus norvegicus
gaaagacttcttcggtatttcccag

SEQ ID NO: 287248 - DNA, 25 bp, Rattus norvegicus
gaaagacttcttgggtatttcccag

SEQ ID NO: 287249 - DNA, 25 bp, Rattus norvegicus
gaaagacttggaacaggccctggct

SEQ ID NO: 287250 - DNA, 25 bp, Rattus norvegicus
gaaagacttggatcaggccctggct

SEQ ID NO: 287251 - DNA, 25 bp, Rattus norvegicus
gaaagacttggtcgcatctgtgcct

SEQ ID NO: 287252 - DNA, 25 bp, Rattus norvegicus
gaaagacttggtggcatctgtgcct

SEQ ID NO: 287253 - DNA, 25 bp, Rattus norvegicus
gaaagacttgtgcttgccagctgta

SEQ ID NO: 287254 - DNA, 25 bp, Rattus norvegicus
gaaagacttgtggttgccagctgta

SEQ ID NO: 287255 - DNA, 25 bp, Rattus norvegicus
gaaagactttaaaggattcccttgc

SEQ ID NO: 287256 - DNA, 25 bp, Rattus norvegicus
gaaagactttaatggattcccttgc

SEQ ID NO: 287257 - DNA, 25 bp, Rattus norvegicus
gaaagactttggacttgggccaaga

SEQ ID NO: 287258 - DNA, 25 bp, Rattus norvegicus
gaaagactttggtcttgggccaaga

SEQ ID NO: 287259 - DNA, 25 bp, Rattus norvegicus
gaaagagaagccaggagtttattta

SEQ ID NO: 287260 - DNA, 25 bp, Rattus norvegicus
gaaagagaagcctggagtttattta

SEQ ID NO: 287261 - DNA, 25 bp, Rattus norvegicus
gaaagagaccctagcatggcactaa

SEQ ID NO: 287262 - DNA, 25 bp, Rattus norvegicus
gaaagagacccttgcatggcactaa

SEQ ID NO: 287263 - DNA, 25 bp, Rattus norvegicus
gaaagagacctcacactaaggcccc

SEQ ID NO: 287264 - DNA, 25 bp, Rattus norvegicus
gaaagagacctccagactatgcacc

SEQ ID NO: 287265 - DNA, 25 bp, Rattus norvegicus
gaaagagacctcgagactatgcacc

SEQ ID NO: 287266 - DNA, 25 bp, Rattus norvegicus
gaaagagacctctcactaaggcccc

SEQ ID NO: 287267 - DNA, 25 bp, Rattus norvegicus
gaaagagaccttagccgataccgca

SEQ ID NO: 287268 - DNA, 25 bp, Rattus norvegicus
gaaagagaccttctttggctacccg

SEQ ID NO: 287269 - DNA, 25 bp, Rattus norvegicus
gaaagagaccttgtttggctacccg

SEQ ID NO: 287270 - DNA, 25 bp, Rattus norvegicus
gaaagagacctttgccgataccgca

SEQ ID NO: 287271 - DNA, 25 bp, Rattus norvegicus
gaaagagacggtcgacaccgctgtc

SEQ ID NO: 287272 - DNA, 25 bp, Rattus norvegicus
gaaagagacggtggacaccgctgtc

SEQ ID NO: 287273 - DNA, 25 bp, Rattus norvegicus
gaaagagacgtcacccaacaggcaa

SEQ ID NO: 287274 - DNA, 25 bp, Rattus norvegicus
gaaagagacgtctcccaacaggcaa

SEQ ID NO: 287275 - DNA, 25 bp, Rattus norvegicus
gaaagagagaacatcactgcctgaa

SEQ ID NO: 287276 - DNA, 25 bp, Rattus norvegicus
gaaagagagaaccatgtctgtttct

SEQ ID NO: 287277 - DNA, 25 bp, Rattus norvegicus
gaaagagagaacgatgtctgtttct

SEQ ID NO: 287278 - DNA, 25 bp, Rattus norvegicus
gaaagagagaacttcactgcctgaa

SEQ ID NO: 287279 - DNA, 25 bp, Rattus norvegicus
gaaagagaggccctgcagttctcct

SEQ ID NO: 287280 - DNA, 25 bp, Rattus norvegicus
gaaagagaggccgtgcagttctcct

SEQ ID NO: 287281 - DNA, 25 bp, Rattus norvegicus
gaaagagatcaaatgcaatgcttat

SEQ ID NO: 287282 - DNA, 25 bp, Rattus norvegicus
gaaagagatcaattgcaatgcttat

SEQ ID NO: 287283 - DNA, 25 bp, Rattus norvegicus
gaaagagatcctctatactgcaaat

SEQ ID NO: 287284 - DNA, 25 bp, Rattus norvegicus
gaaagagatcctgtatactgcaaat

SEQ ID NO: 287285 - DNA, 25 bp, Rattus norvegicus
gaaagagatctgaccgaggtcatgc

SEQ ID NO: 287286 - DNA, 25 bp, Rattus norvegicus
gaaagagatctgtccgaggtcatgc

SEQ ID NO: 287287 - DNA, 25 bp, Rattus norvegicus
gaaagagatgagagcccacacccac

SEQ ID NO: 287288 - DNA, 25 bp, Rattus norvegicus
gaaagagatgagtgcccacacccac

SEQ ID NO: 287289 - DNA, 25 bp, Rattus norvegicus
gaaagagattccacgctggatcaac

SEQ ID NO: 287290 - DNA, 25 bp, Rattus norvegicus
gaaagagattcctcgctggatcaac

SEQ ID NO: 287291 - DNA, 25 bp, Rattus norvegicus
gaaagagcaaccacgatcagtccca

SEQ ID NO: 287292 - DNA, 25 bp, Rattus norvegicus
gaaagagcaacctcgatcagtccca

SEQ ID NO: 287293 - DNA, 25 bp, Rattus norvegicus
gaaagagcacaccaaaccaacagca

SEQ ID NO: 287294 - DNA, 25 bp, Rattus norvegicus
gaaagagcacacgaaaccaacagca

SEQ ID NO: 287295 - DNA, 25 bp, Rattus norvegicus
gaaagagcaccacatgcttcgctgg

SEQ ID NO: 287296 - DNA, 25 bp, Rattus norvegicus
gaaagagcaccagatgcttcgctgg

SEQ ID NO: 287297 - DNA, 25 bp, Rattus norvegicus
gaaagagcacccattgctaagctca

SEQ ID NO: 287298 - DNA, 25 bp, Rattus norvegicus
gaaagagcaccctttgctaagctca

SEQ ID NO: 287299 - DNA, 25 bp, Rattus norvegicus
gaaagagccaagatcccaggtgtct

SEQ ID NO: 287300 - DNA, 25 bp, Rattus norvegicus
gaaagagccaagttcccaggtgtct

SEQ ID NO: 287301 - DNA, 25 bp, Rattus norvegicus
gaaagagccaggcacaggcgacctt

SEQ ID NO: 287302 - DNA, 25 bp, Rattus norvegicus
gaaagagccagggacaggcgacctt

SEQ ID NO: 287303 - DNA, 25 bp, Rattus norvegicus
gaaagagccatgagtcaggatgcaa

SEQ ID NO: 287304 - DNA, 25 bp, Rattus norvegicus
gaaagagccatgtgtcaggatgcaa

SEQ ID NO: 287305 - DNA, 25 bp, Rattus norvegicus
gaaagagcccacaggttaggcatca

SEQ ID NO: 287306 - DNA, 25 bp, Rattus norvegicus
gaaagagcccactggttaggcatca

SEQ ID NO: 287307 - DNA, 25 bp, Rattus norvegicus
gaaagagcccttcttgtgcttgttc

SEQ ID NO: 287308 - DNA, 25 bp, Rattus norvegicus
gaaagagcccttgttgtgcttgttc

SEQ ID NO: 287309 - DNA, 25 bp, Rattus norvegicus
gaaagagcctcccaagaactggttc

SEQ ID NO: 287310 - DNA, 25 bp, Rattus norvegicus
gaaagagcctccgaagaactggttc

SEQ ID NO: 287311 - DNA, 25 bp, Rattus norvegicus
gaaagagcctctacctcaggattga

SEQ ID NO: 287312 - DNA, 25 bp, Rattus norvegicus
gaaagagcctctagggccagcactg

SEQ ID NO: 287313 - DNA, 25 bp, Rattus norvegicus
gaaagagcctcttcctcaggattga

SEQ ID NO: 287314 - DNA, 25 bp, Rattus norvegicus
gaaagagcctcttgggccagcactg

SEQ ID NO: 287315 - DNA, 25 bp, Rattus norvegicus
gaaagagcctgcctggtagtatttt

SEQ ID NO: 287316 - DNA, 25 bp, Rattus norvegicus
gaaagagcctgcgtggtagtatttt

SEQ ID NO: 287317 - DNA, 25 bp, Rattus norvegicus
gaaagagccttaccctggcctctca

SEQ ID NO: 287318 - DNA, 25 bp, Rattus norvegicus
gaaagagccttagcctggcctctca

SEQ ID NO: 287319 - DNA, 25 bp, Rattus norvegicus
gaaagagcggcaacaaagcctcgcc

SEQ ID NO: 287320 - DNA, 25 bp, Rattus norvegicus
gaaagagcggcatcaaagcctcgcc

SEQ ID NO: 287321 - DNA, 25 bp, Rattus norvegicus
gaaagagcggttaagcccacccact

SEQ ID NO: 287322 - DNA, 25 bp, Rattus norvegicus
gaaagagcggtttagcccacccact

SEQ ID NO: 287323 - DNA, 25 bp, Rattus norvegicus
gaaagagctccaacattccattgtg

SEQ ID NO: 287324 - DNA, 25 bp, Rattus norvegicus
gaaagagctccatcattccattgtg

SEQ ID NO: 287325 - DNA, 25 bp, Rattus norvegicus
gaaagagctgacctgcaccttcaac

SEQ ID NO: 287326 - DNA, 25 bp, Rattus norvegicus
gaaagagctgacgtgcaccttcaac

SEQ ID NO: 287327 - DNA, 25 bp, Rattus norvegicus
gaaagagctgcgaggacatggtcat

SEQ ID NO: 287328 - DNA, 25 bp, Rattus norvegicus
gaaagagctgcgtggacatggtcat

SEQ ID NO: 287329 - DNA, 25 bp, Rattus norvegicus
gaaagagctggcagtcacagtgccc

SEQ ID NO: 287330 - DNA, 25 bp, Rattus norvegicus
gaaagagctggctgtcacagtgccc

SEQ ID NO: 287331 - DNA, 25 bp, Rattus norvegicus
gaaagaggaacaatcggccttgttt

SEQ ID NO: 287332 - DNA, 25 bp, Rattus norvegicus
gaaagaggaacattcggccttgttt

SEQ ID NO: 287333 - DNA, 25 bp, Rattus norvegicus
gaaagaggaaccattatttacattt

SEQ ID NO: 287334 - DNA, 25 bp, Rattus norvegicus
gaaagaggaacctttatttacattt

SEQ ID NO: 287335 - DNA, 25 bp, Rattus norvegicus
gaaagaggactcaccgtacctgctg

SEQ ID NO: 287336 - DNA, 25 bp, Rattus norvegicus
gaaagaggactctccgtacctgctg

SEQ ID NO: 287337 - DNA, 25 bp, Rattus norvegicus
gaaagaggactgacccctgcagctt

SEQ ID NO: 287338 - DNA, 25 bp, Rattus norvegicus
gaaagaggactgtcccctgcagctt

SEQ ID NO: 287339 - DNA, 25 bp, Rattus norvegicus
gaaagaggagccatgtgtcttctct

SEQ ID NO: 287340 - DNA, 25 bp, Rattus norvegicus
gaaagaggagccttgtgtcttctct

SEQ ID NO: 287341 - DNA, 25 bp, Rattus norvegicus
gaaagaggaggtccctacccttcac

SEQ ID NO: 287342 - DNA, 25 bp, Rattus norvegicus
gaaagaggaggtgcctacccttcac

SEQ ID NO: 287343 - DNA, 25 bp, Rattus norvegicus
gaaagaggccatcgcgctgctacag

SEQ ID NO: 287344 - DNA, 25 bp, Rattus norvegicus
gaaagaggccatggcgctgctacag

SEQ ID NO: 287345 - DNA, 25 bp, Rattus norvegicus
gaaagaggcctgaaattggaccaga

SEQ ID NO: 287346 - DNA, 25 bp, Rattus norvegicus
gaaagaggcctgtaattggaccaga

SEQ ID NO: 287347 - DNA, 25 bp, Rattus norvegicus
gaaagaggcgcccaacattgtgact

SEQ ID NO: 287348 - DNA, 25 bp, Rattus norvegicus
gaaagaggcgccgaacattgtgact

SEQ ID NO: 287349 - DNA, 25 bp, Rattus norvegicus
gaaagaggcggtatgtatcccttct

SEQ ID NO: 287350 - DNA, 25 bp, Rattus norvegicus
gaaagaggcggtttgtatcccttct

SEQ ID NO: 287351 - DNA, 25 bp, Rattus norvegicus
gaaagaggctctatactcttccagt

SEQ ID NO: 287352 - DNA, 25 bp, Rattus norvegicus
gaaagaggctctctaccaccagtgt

SEQ ID NO: 287353 - DNA, 25 bp, Rattus norvegicus
gaaagaggctctgtaccaccagtgt

SEQ ID NO: 287354 - DNA, 25 bp, Rattus norvegicus
gaaagaggctctttactcttccagt

SEQ ID NO: 287355 - DNA, 25 bp, Rattus norvegicus
gaaagaggcttgacactctaggaaa

SEQ ID NO: 287356 - DNA, 25 bp, Rattus norvegicus
gaaagaggcttgtcactctaggaaa

SEQ ID NO: 287357 - DNA, 25 bp, Rattus norvegicus
gaaagaggctttatcctcccttcag

SEQ ID NO: 287358 - DNA, 25 bp, Rattus norvegicus
gaaagaggctttcatcccaaggaca

SEQ ID NO: 287359 - DNA, 25 bp, Rattus norvegicus
gaaagaggctttgatcccaaggaca

SEQ ID NO: 287360 - DNA, 25 bp, Rattus norvegicus
gaaagaggctttttcctcccttcag

SEQ ID NO: 287361 - DNA, 25 bp, Rattus norvegicus
gaaagagggcagcacccctcagctg

SEQ ID NO: 287362 - DNA, 25 bp, Rattus norvegicus
gaaagagggcaggacccctcagctg

SEQ ID NO: 287363 - DNA, 25 bp, Rattus norvegicus
gaaagagggtcaactctcatggttg

SEQ ID NO: 287364 - DNA, 25 bp, Rattus norvegicus
gaaagagggtcatctctcatggttg

SEQ ID NO: 287365 - DNA, 25 bp, Rattus norvegicus
gaaagagtatccctaccgtcctgac

SEQ ID NO: 287366 - DNA, 25 bp, Rattus norvegicus
gaaagagtatccgtaccgtcctgac

SEQ ID NO: 287367 - DNA, 25 bp, Rattus norvegicus
gaaagagtattacccactgccacgt

SEQ ID NO: 287368 - DNA, 25 bp, Rattus norvegicus
gaaagagtattagccactgccacgt

SEQ ID NO: 287369 - DNA, 25 bp, Rattus norvegicus
gaaagagtcagcctctgattcagta

SEQ ID NO: 287370 - DNA, 25 bp, Rattus norvegicus
gaaagagtcagcgtctgattcagta

SEQ ID NO: 287371 - DNA, 25 bp, Rattus norvegicus
gaaagagtccccactcttggacagt

SEQ ID NO: 287372 - DNA, 25 bp, Rattus norvegicus
gaaagagtcccctctcttggacagt

SEQ ID NO: 287373 - DNA, 25 bp, Rattus norvegicus
gaaagagtccctctactcagaattt

SEQ ID NO: 287374 - DNA, 25 bp, Rattus norvegicus
gaaagagtccctgtactcagaattt

SEQ ID NO: 287375 - DNA, 25 bp, Rattus norvegicus
gaaagagtcctgactggcgttgcta

SEQ ID NO: 287376 - DNA, 25 bp, Rattus norvegicus
gaaagagtcctgtctggcgttgcta

SEQ ID NO: 287377 - DNA, 25 bp, Rattus norvegicus
gaaagagtcggcaccagacccgggt

SEQ ID NO: 287378 - DNA, 25 bp, Rattus norvegicus
gaaagagtcggctccagacccgggt

SEQ ID NO: 287379 - DNA, 25 bp, Rattus norvegicus
gaaagagtctccctgaatgccttac

SEQ ID NO: 287380 - DNA, 25 bp, Rattus norvegicus
gaaagagtctccgtgaatgccttac

SEQ ID NO: 287381 - DNA, 25 bp, Rattus norvegicus
gaaagagtctttctccttcgaagat

SEQ ID NO: 287382 - DNA, 25 bp, Rattus norvegicus
gaaagagtctttgtccttcgaagat

SEQ ID NO: 287383 - DNA, 25 bp, Rattus norvegicus
gaaagagtgcgaccccgagaatcat

SEQ ID NO: 287384 - DNA, 25 bp, Rattus norvegicus
gaaagagtgcgagcccgagaatcat

SEQ ID NO: 287385 - DNA, 25 bp, Rattus norvegicus
gaaagagtgctaagctgccgactcc

SEQ ID NO: 287386 - DNA, 25 bp, Rattus norvegicus
gaaagagtgctatgctgccgactcc

SEQ ID NO: 287387 - DNA, 25 bp, Rattus norvegicus
gaaagagtgtccatgacctcagtgt

SEQ ID NO: 287388 - DNA, 25 bp, Rattus norvegicus
gaaagagtgtccttgacctcagtgt

SEQ ID NO: 287389 - DNA, 25 bp, Rattus norvegicus
gaaagagtgtgtatcttttcctgct

SEQ ID NO: 287390 - DNA, 25 bp, Rattus norvegicus
gaaagagtgtgtttcttttcctgct

SEQ ID NO: 287391 - DNA, 25 bp, Rattus norvegicus
gaaagagttactaatctctcagagt

SEQ ID NO: 287392 - DNA, 25 bp, Rattus norvegicus
gaaagagttacttatctctcagagt

SEQ ID NO: 287393 - DNA, 25 bp, Rattus norvegicus
gaaagagttcacatggcacacgctg

SEQ ID NO: 287394 - DNA, 25 bp, Rattus norvegicus
gaaagagttcacttggcacacgctg

SEQ ID NO: 287395 - DNA, 25 bp, Rattus norvegicus
gaaagagttcttcagatcctccagt

SEQ ID NO: 287396 - DNA, 25 bp, Rattus norvegicus
gaaagagttcttgagatcctccagt

SEQ ID NO: 287397 - DNA, 25 bp, Rattus norvegicus
gaaagagtttgtctgtgtttagatt

SEQ ID NO: 287398 - DNA, 25 bp, Rattus norvegicus
gaaagagtttgtgtgtgtttagatt

SEQ ID NO: 287399 - DNA, 25 bp, Rattus norvegicus
gaaagataccacatcctcagcaaga

SEQ ID NO: 287400 - DNA, 25 bp, Rattus norvegicus
gaaagataccacttcctcagcaaga

SEQ ID NO: 287401 - DNA, 25 bp, Rattus norvegicus
gaaagatatcacacccaccaaaact

SEQ ID NO: 287402 - DNA, 25 bp, Rattus norvegicus
gaaagatatcactcccaccaaaact

SEQ ID NO: 287403 - DNA, 25 bp, Rattus norvegicus
gaaagatcacaaaacaacagggcag

SEQ ID NO: 287404 - DNA, 25 bp, Rattus norvegicus
gaaagatcacaatacaacagggcag

SEQ ID NO: 287405 - DNA, 25 bp, Rattus norvegicus
gaaagatcacacctaggcttcatgt

SEQ ID NO: 287406 - DNA, 25 bp, Rattus norvegicus
gaaagatcacacgtaggcttcatgt

SEQ ID NO: 287407 - DNA, 25 bp, Rattus norvegicus
gaaagatcagccatggctacaagat

SEQ ID NO: 287408 - DNA, 25 bp, Rattus norvegicus
gaaagatcagccttggctacaagat

SEQ ID NO: 287409 - DNA, 25 bp, Rattus norvegicus
gaaagatcagctacgccagcattga

SEQ ID NO: 287410 - DNA, 25 bp, Rattus norvegicus
gaaagatcagcttcgccagcattga

SEQ ID NO: 287411 - DNA, 25 bp, Rattus norvegicus
gaaagatcataacctgaagcccagc

SEQ ID NO: 287412 - DNA, 25 bp, Rattus norvegicus
gaaagatcataagctgaagcccagc

SEQ ID NO: 287413 - DNA, 25 bp, Rattus norvegicus
gaaagatccaagacgcagcagtact

SEQ ID NO: 287414 - DNA, 25 bp, Rattus norvegicus
gaaagatccaagtcgcagcagtact

SEQ ID NO: 287415 - DNA, 25 bp, Rattus norvegicus
gaaagatcccaactccaacagtgtg

SEQ ID NO: 287416 - DNA, 25 bp, Rattus norvegicus
gaaagatcccaagtccaacagtgtg

SEQ ID NO: 287417 - DNA, 25 bp, Rattus norvegicus
gaaagatcccttcagttctgcagtc

SEQ ID NO: 287418 - DNA, 25 bp, Rattus norvegicus
gaaagatcccttgagttctgcagtc

SEQ ID NO: 287419 - DNA, 25 bp, Rattus norvegicus
gaaagatcggttcttgctccttctc

SEQ ID NO: 287420 - DNA, 25 bp, Rattus norvegicus
gaaagatcggttgttgctccttctc

SEQ ID NO: 287421 - DNA, 25 bp, Rattus norvegicus
gaaagatcgttaatgtcacacatgc

SEQ ID NO: 287422 - DNA, 25 bp, Rattus norvegicus
gaaagatcgttattgtcacacatgc

SEQ ID NO: 287423 - DNA, 25 bp, Rattus norvegicus
gaaagatctatccatgtcccttcaa

SEQ ID NO: 287424 - DNA, 25 bp, Rattus norvegicus
gaaagatctatcgatgtcccttcaa

SEQ ID NO: 287425 - DNA, 25 bp, Rattus norvegicus
gaaagatctccgactggtcagggaa

SEQ ID NO: 287426 - DNA, 25 bp, Rattus norvegicus
gaaagatctccgtctggtcagggaa

SEQ ID NO: 287427 - DNA, 25 bp, Rattus norvegicus
gaaagatctgctcctattagtgaag

SEQ ID NO: 287428 - DNA, 25 bp, Rattus norvegicus
gaaagatctgctgctattagtgaag

SEQ ID NO: 287429 - DNA, 25 bp, Rattus norvegicus
gaaagatctggccagcttcactgca

SEQ ID NO: 287430 - DNA, 25 bp, Rattus norvegicus
gaaagatctggcgagcttcactgca

SEQ ID NO: 287431 - DNA, 25 bp, Rattus norvegicus
gaaagatctgtaaatcgctcgttat

SEQ ID NO: 287432 - DNA, 25 bp, Rattus norvegicus
gaaagatctgtaacaccttctctcc

SEQ ID NO: 287433 - DNA, 25 bp, Rattus norvegicus
gaaagatctgtatatcgctcgttat

SEQ ID NO: 287434 - DNA, 25 bp, Rattus norvegicus
gaaagatctgtatcaccttctctcc

SEQ ID NO: 287435 - DNA, 25 bp, Rattus norvegicus
gaaagatcttcaccacagcagagga

SEQ ID NO: 287436 - DNA, 25 bp, Rattus norvegicus
gaaagatcttcagcacagcagagga

SEQ ID NO: 287437 - DNA, 25 bp, Rattus norvegicus
gaaagatctttgaaactactctgaa

SEQ ID NO: 287438 - DNA, 25 bp, Rattus norvegicus
gaaagatctttgtaactactctgaa

SEQ ID NO: 287439 - DNA, 25 bp, Rattus norvegicus
gaaagatgaactcggtcctcaaaat

SEQ ID NO: 287440 - DNA, 25 bp, Rattus norvegicus
gaaagatgaactgggtcctcaaaat

SEQ ID NO: 287441 - DNA, 25 bp, Rattus norvegicus
gaaagatgactcagtcctcagtgtc

SEQ ID NO: 287442 - DNA, 25 bp, Rattus norvegicus
gaaagatgactctgtcctcagtgtc

SEQ ID NO: 287443 - DNA, 25 bp, Rattus norvegicus
gaaagatgattaaccactgtggtaa

SEQ ID NO: 287444 - DNA, 25 bp, Rattus norvegicus
gaaagatgattatccactgtggtaa

SEQ ID NO: 287445 - DNA, 25 bp, Rattus norvegicus
gaaagatgccaaatctgtcacctct

SEQ ID NO: 287446 - DNA, 25 bp, Rattus norvegicus
gaaagatgccaattctgtcacctct

SEQ ID NO: 287447 - DNA, 25 bp, Rattus norvegicus
gaaagatgccctactctagaaaggc

SEQ ID NO: 287448 - DNA, 25 bp, Rattus norvegicus
gaaagatgcccttctctagaaaggc

SEQ ID NO: 287449 - DNA, 25 bp, Rattus norvegicus
gaaagatgccggcttctttgtttaa

SEQ ID NO: 287450 - DNA, 25 bp, Rattus norvegicus
gaaagatgccgggttctttgtttaa

SEQ ID NO: 287451 - DNA, 25 bp, Rattus norvegicus
gaaagatgctcactggctccggaga

SEQ ID NO: 287452 - DNA, 25 bp, Rattus norvegicus
gaaagatgctcagtggctccggaga

SEQ ID NO: 287453 - DNA, 25 bp, Rattus norvegicus
gaaagatgctggagccttgacctca

SEQ ID NO: 287454 - DNA, 25 bp, Rattus norvegicus
gaaagatgctggctctgcacttgag

SEQ ID NO: 287455 - DNA, 25 bp, Rattus norvegicus
gaaagatgctgggtctgcacttgag

SEQ ID NO: 287456 - DNA, 25 bp, Rattus norvegicus
gaaagatgctggtgccttgacctca

SEQ ID NO: 287457 - DNA, 25 bp, Rattus norvegicus
gaaagatggccgactacaacaagga

SEQ ID NO: 287458 - DNA, 25 bp, Rattus norvegicus
gaaagatggccgtctacaacaagga

SEQ ID NO: 287459 - DNA, 25 bp, Rattus norvegicus
gaaagatggcgtaccttctcattga

SEQ ID NO: 287460 - DNA, 25 bp, Rattus norvegicus
gaaagatggcgttccttctcattga

SEQ ID NO: 287461 - DNA, 25 bp, Rattus norvegicus
gaaagatggctcacagcagacccca

SEQ ID NO: 287462 - DNA, 25 bp, Rattus norvegicus
gaaagatggctctcagcagacccca

SEQ ID NO: 287463 - DNA, 25 bp, Rattus norvegicus
gaaagatggtagactcttgcccttt

SEQ ID NO: 287464 - DNA, 25 bp, Rattus norvegicus
gaaagatggtagtctcttgcccttt

SEQ ID NO: 287465 - DNA, 25 bp, Rattus norvegicus
gaaagatggtccaggcagacaccat

SEQ ID NO: 287466 - DNA, 25 bp, Rattus norvegicus
gaaagatggtcctggcagacaccat

SEQ ID NO: 287467 - DNA, 25 bp, Rattus norvegicus
gaaagatgtattatagagggaaact

SEQ ID NO: 287468 - DNA, 25 bp, Rattus norvegicus
gaaagatgtattttagagggaaact

SEQ ID NO: 287469 - DNA, 25 bp, Rattus norvegicus
gaaagatgtcatccttctctgtcac

SEQ ID NO: 287470 - DNA, 25 bp, Rattus norvegicus
gaaagatgtcatgcttctctgtcac

SEQ ID NO: 287471 - DNA, 25 bp, Rattus norvegicus
gaaagatgtcctcatcccaaagata

SEQ ID NO: 287472 - DNA, 25 bp, Rattus norvegicus
gaaagatgtcctgatcccaaagata

SEQ ID NO: 287473 - DNA, 25 bp, Rattus norvegicus
gaaagatgtgtcacctagctgaccc

SEQ ID NO: 287474 - DNA, 25 bp, Rattus norvegicus
gaaagatgtgtctcctagctgaccc

SEQ ID NO: 287475 - DNA, 25 bp, Rattus norvegicus
gaaagatgttctacacagcctcatg

SEQ ID NO: 287476 - DNA, 25 bp, Rattus norvegicus
gaaagatgttcttcacagcctcatg

SEQ ID NO: 287477 - DNA, 25 bp, Rattus norvegicus
gaaagatgtttgaagttctcccctt

SEQ ID NO: 287478 - DNA, 25 bp, Rattus norvegicus
gaaagatgtttgtagttctcccctt

SEQ ID NO: 287479 - DNA, 25 bp, Rattus norvegicus
gaaagatgttttccccagtgacttt

SEQ ID NO: 287480 - DNA, 25 bp, Rattus norvegicus
gaaagatgttttctcaccctgaatt

SEQ ID NO: 287481 - DNA, 25 bp, Rattus norvegicus
gaaagatgttttgcccagtgacttt

SEQ ID NO: 287482 - DNA, 25 bp, Rattus norvegicus
gaaagatgttttgtcaccctgaatt

SEQ ID NO: 287483 - DNA, 25 bp, Rattus norvegicus
gaaagattaaacatcccactgccct

SEQ ID NO: 287484 - DNA, 25 bp, Rattus norvegicus
gaaagattaaacttcccactgccct

SEQ ID NO: 287485 - DNA, 25 bp, Rattus norvegicus
gaaagattcattcccatcatctggg

SEQ ID NO: 287486 - DNA, 25 bp, Rattus norvegicus
gaaagattcattgccatcatctggg

SEQ ID NO: 287487 - DNA, 25 bp, Rattus norvegicus
gaaagattccgtcactgcagttgtg

SEQ ID NO: 287488 - DNA, 25 bp, Rattus norvegicus
gaaagattccgtgactgcagttgtg

SEQ ID NO: 287489 - DNA, 25 bp, Rattus norvegicus
gaaagattcctcatctacaggagaa

SEQ ID NO: 287490 - DNA, 25 bp, Rattus norvegicus
gaaagattcctcttctacaggagaa

SEQ ID NO: 287491 - DNA, 25 bp, Rattus norvegicus
gaaagattctgcctatcactctata

SEQ ID NO: 287492 - DNA, 25 bp, Rattus norvegicus
gaaagattctgcgtatcactctata

SEQ ID NO: 287493 - DNA, 25 bp, Rattus norvegicus
gaaagattcttcctccactaacttg

SEQ ID NO: 287494 - DNA, 25 bp, Rattus norvegicus
gaaagattcttcgtccactaacttg

SEQ ID NO: 287495 - DNA, 25 bp, Rattus norvegicus
gaaagattgccaagcatctcttccg

SEQ ID NO: 287496 - DNA, 25 bp, Rattus norvegicus
gaaagattgccatgcatctcttccg

SEQ ID NO: 287497 - DNA, 25 bp, Rattus norvegicus
gaaagattgtagactgagctggtca

SEQ ID NO: 287498 - DNA, 25 bp, Rattus norvegicus
gaaagattgtagtctgagctggtca

SEQ ID NO: 287499 - DNA, 25 bp, Rattus norvegicus
gaaagattgtctacctcagtgttta

SEQ ID NO: 287500 - DNA, 25 bp, Rattus norvegicus
gaaagattgtcttcctcagtgttta

SEQ ID NO: 287501 - DNA, 25 bp, Rattus norvegicus
gaaagattgttcagttaccctaaag

SEQ ID NO: 287502 - DNA, 25 bp, Rattus norvegicus
gaaagattgttctgttaccctaaag

SEQ ID NO: 287503 - DNA, 25 bp, Rattus norvegicus
gaaagatttacaccgccagcacagg

SEQ ID NO: 287504 - DNA, 25 bp, Rattus norvegicus
gaaagatttacagcgccagcacagg

SEQ ID NO: 287505 - DNA, 25 bp, Rattus norvegicus
gaaagattttctactgactattgta

SEQ ID NO: 287506 - DNA, 25 bp, Rattus norvegicus
gaaagattttcttctgactattgta

SEQ ID NO: 287507 - DNA, 25 bp, Rattus norvegicus
gaaagatttttcaaacaagcccaag

SEQ ID NO: 287508 - DNA, 25 bp, Rattus norvegicus
gaaagatttttctaacaagcccaag

SEQ ID NO: 287509 - DNA, 25 bp, Rattus norvegicus
gaaagcaaaaaccataagcaccatt

SEQ ID NO: 287510 - DNA, 25 bp, Rattus norvegicus
gaaagcaaaaacgataagcaccatt

SEQ ID NO: 287511 - DNA, 25 bp, Rattus norvegicus
gaaagcaaaacaaactcacccaatt

SEQ ID NO: 287512 - DNA, 25 bp, Rattus norvegicus
gaaagcaaaacatactcacccaatt

SEQ ID NO: 287513 - DNA, 25 bp, Rattus norvegicus
gaaagcaaacatcagttccctacca

SEQ ID NO: 287514 - DNA, 25 bp, Rattus norvegicus
gaaagcaaacatgagttccctacca

SEQ ID NO: 287515 - DNA, 25 bp, Rattus norvegicus
gaaagcaaagaaaccctactgtgaa

SEQ ID NO: 287516 - DNA, 25 bp, Rattus norvegicus
gaaagcaaagaatccctactgtgaa

SEQ ID NO: 287517 - DNA, 25 bp, Rattus norvegicus
gaaagcaaagcccagatcactccag

SEQ ID NO: 287518 - DNA, 25 bp, Rattus norvegicus
gaaagcaaagccgagatcactccag

SEQ ID NO: 287519 - DNA, 25 bp, Rattus norvegicus
gaaagcaaagctagttcagtatgaa

SEQ ID NO: 287520 - DNA, 25 bp, Rattus norvegicus
gaaagcaaagcttgttcagtatgaa

SEQ ID NO: 287521 - DNA, 25 bp, Rattus norvegicus
gaaagcaacatcacagtggattcaa

SEQ ID NO: 287522 - DNA, 25 bp, Rattus norvegicus
gaaagcaacatctcagtggattcaa

SEQ ID NO: 287523 - DNA, 25 bp, Rattus norvegicus
gaaagcaaccagaactctacaccag

SEQ ID NO: 287524 - DNA, 25 bp, Rattus norvegicus
gaaagcaaccagtactctacaccag

SEQ ID NO: 287525 - DNA, 25 bp, Rattus norvegicus
gaaagcaactcacaaggagaaactt

SEQ ID NO: 287526 - DNA, 25 bp, Rattus norvegicus
gaaagcaactcagaaggagaaactt

SEQ ID NO: 287527 - DNA, 25 bp, Rattus norvegicus
gaaagcaactgaagtgccttcctga

SEQ ID NO: 287528 - DNA, 25 bp, Rattus norvegicus
gaaagcaactgatgtgccttcctga

SEQ ID NO: 287529 - DNA, 25 bp, Rattus norvegicus
gaaagcaactgccaattctccttac

SEQ ID NO: 287530 - DNA, 25 bp, Rattus norvegicus
gaaagcaactgcgaattctccttac

SEQ ID NO: 287531 - DNA, 25 bp, Rattus norvegicus
gaaagcaacttcctttcagcaagtt

SEQ ID NO: 287532 - DNA, 25 bp, Rattus norvegicus
gaaagcaacttcgtttcagcaagtt

SEQ ID NO: 287533 - DNA, 25 bp, Rattus norvegicus
gaaagcaagatcaggagctgccacc

SEQ ID NO: 287534 - DNA, 25 bp, Rattus norvegicus
gaaagcaagatctggagctgccacc

SEQ ID NO: 287535 - DNA, 25 bp, Rattus norvegicus
gaaagcaagtggagcaagccagtaa

SEQ ID NO: 287536 - DNA, 25 bp, Rattus norvegicus
gaaagcaagtggtgcaagccagtaa

SEQ ID NO: 287537 - DNA, 25 bp, Rattus norvegicus
gaaagcaatcctccgagtggacatt

SEQ ID NO: 287538 - DNA, 25 bp, Rattus norvegicus
gaaagcaatcctgcgagtggacatt

SEQ ID NO: 287539 - DNA, 25 bp, Rattus norvegicus
gaaagcaatgggacattctggtatt

SEQ ID NO: 287540 - DNA, 25 bp, Rattus norvegicus
gaaagcaatgggtcattctggtatt

SEQ ID NO: 287541 - DNA, 25 bp, Rattus norvegicus
gaaagcaatgtcacggtagttaaga

SEQ ID NO: 287542 - DNA, 25 bp, Rattus norvegicus
gaaagcaatgtctcggtagttaaga

SEQ ID NO: 287543 - DNA, 25 bp, Rattus norvegicus
gaaagcaattccacatcctcagatg

SEQ ID NO: 287544 - DNA, 25 bp, Rattus norvegicus
gaaagcaattcctcatcctcagatg

SEQ ID NO: 287545 - DNA, 25 bp, Rattus norvegicus
gaaagcaatttcaaccctgaccaat

SEQ ID NO: 287546 - DNA, 25 bp, Rattus norvegicus
gaaagcaatttctaccctgaccaat

SEQ ID NO: 287547 - DNA, 25 bp, Rattus norvegicus
gaaagcacaagtcaagccaaaaata

SEQ ID NO: 287548 - DNA, 25 bp, Rattus norvegicus
gaaagcacaagtgaagccaaaaata

SEQ ID NO: 287549 - DNA, 25 bp, Rattus norvegicus
gaaagcacacatccagtccatagca

SEQ ID NO: 287550 - DNA, 25 bp, Rattus norvegicus
gaaagcacacatgcagtccatagca

SEQ ID NO: 287551 - DNA, 25 bp, Rattus norvegicus
gaaagcacaccaatattatcgcaca

SEQ ID NO: 287552 - DNA, 25 bp, Rattus norvegicus
gaaagcacaccattattatcgcaca

SEQ ID NO: 287553 - DNA, 25 bp, Rattus norvegicus
gaaagcacagccaaaagcagccaat

SEQ ID NO: 287554 - DNA, 25 bp, Rattus norvegicus
gaaagcacagccaaaccaagttctc

SEQ ID NO: 287555 - DNA, 25 bp, Rattus norvegicus
gaaagcacagcctaaagcagccaat

SEQ ID NO: 287556 - DNA, 25 bp, Rattus norvegicus
gaaagcacagcctaaccaagttctc

SEQ ID NO: 287557 - DNA, 25 bp, Rattus norvegicus
gaaagcacagcgacttcaaagagta

SEQ ID NO: 287558 - DNA, 25 bp, Rattus norvegicus
gaaagcacagcgtcttcaaagagta

SEQ ID NO: 287559 - DNA, 25 bp, Rattus norvegicus
gaaagcacatgcagtttctggagtt

SEQ ID NO: 287560 - DNA, 25 bp, Rattus norvegicus
gaaagcacatgctgtttctggagtt

SEQ ID NO: 287561 - DNA, 25 bp, Rattus norvegicus
gaaagcacattgatctgggtagaat

SEQ ID NO: 287562 - DNA, 25 bp, Rattus norvegicus
gaaagcacattgttctgggtagaat

SEQ ID NO: 287563 - DNA, 25 bp, Rattus norvegicus
gaaagcaccacacggtacccagagg

SEQ ID NO: 287564 - DNA, 25 bp, Rattus norvegicus
gaaagcaccacagggtacccagagg

SEQ ID NO: 287565 - DNA, 25 bp, Rattus norvegicus
gaaagcaccactaaattgtacatat

SEQ ID NO: 287566 - DNA, 25 bp, Rattus norvegicus
gaaagcaccacttaattgtacatat

SEQ ID NO: 287567 - DNA, 25 bp, Rattus norvegicus
gaaagcaccaggactaggctctgta

SEQ ID NO: 287568 - DNA, 25 bp, Rattus norvegicus
gaaagcaccaggtctaggctctgta

SEQ ID NO: 287569 - DNA, 25 bp, Rattus norvegicus
gaaagcaccagtacttaccttgggc

SEQ ID NO: 287570 - DNA, 25 bp, Rattus norvegicus
gaaagcaccagttcttaccttgggc

SEQ ID NO: 287571 - DNA, 25 bp, Rattus norvegicus
gaaagcaccatccagtcgggtttat

SEQ ID NO: 287572 - DNA, 25 bp, Rattus norvegicus
gaaagcaccatcgagtcgggtttat

SEQ ID NO: 287573 - DNA, 25 bp, Rattus norvegicus
gaaagcaccgctatatcaagcatgg

SEQ ID NO: 287574 - DNA, 25 bp, Rattus norvegicus
gaaagcaccgctttatcaagcatgg

SEQ ID NO: 287575 - DNA, 25 bp, Rattus norvegicus
gaaagcacctagcactgcatgaaca

SEQ ID NO: 287576 - DNA, 25 bp, Rattus norvegicus
gaaagcacctaggactgcatgaaca

SEQ ID NO: 287577 - DNA, 25 bp, Rattus norvegicus
gaaagcacctgacagcctcgggtag

SEQ ID NO: 287578 - DNA, 25 bp, Rattus norvegicus
gaaagcacctgagagcctcgggtag

SEQ ID NO: 287579 - DNA, 25 bp, Rattus norvegicus
gaaagcaccttacagtccggatgga

SEQ ID NO: 287580 - DNA, 25 bp, Rattus norvegicus
gaaagcaccttagagtccggatgga

SEQ ID NO: 287581 - DNA, 25 bp, Rattus norvegicus
gaaagcaccttcaatgattaagcct

SEQ ID NO: 287582 - DNA, 25 bp, Rattus norvegicus
gaaagcaccttctatgattaagcct

SEQ ID NO: 287583 - DNA, 25 bp, Rattus norvegicus
gaaagcacgataattatctttggta

SEQ ID NO: 287584 - DNA, 25 bp, Rattus norvegicus
gaaagcacgatatttatctttggta

SEQ ID NO: 287585 - DNA, 25 bp, Rattus norvegicus
gaaagcacgcgtcatcactgactta

SEQ ID NO: 287586 - DNA, 25 bp, Rattus norvegicus
gaaagcacgcgtgatcactgactta

SEQ ID NO: 287587 - DNA, 25 bp, Rattus norvegicus
gaaagcacgtggcacgggactccat

SEQ ID NO: 287588 - DNA, 25 bp, Rattus norvegicus
gaaagcacgtggcatgacactccat

SEQ ID NO: 287589 - DNA, 25 bp, Rattus norvegicus
gaaagcacgtgggacgggactccat

SEQ ID NO: 287590 - DNA, 25 bp, Rattus norvegicus
gaaagcacgtgggatgacactccat

SEQ ID NO: 287591 - DNA, 25 bp, Rattus norvegicus
gaaagcactatgatgtcaccctcag

SEQ ID NO: 287592 - DNA, 25 bp, Rattus norvegicus
gaaagcactatgttgtcaccctcag

SEQ ID NO: 287593 - DNA, 25 bp, Rattus norvegicus
gaaagcactcaacatctacctggat

SEQ ID NO: 287594 - DNA, 25 bp, Rattus norvegicus
gaaagcactcaagatctacctggat

SEQ ID NO: 287595 - DNA, 25 bp, Rattus norvegicus
gaaagcactcgaaattcttcaggag

SEQ ID NO: 287596 - DNA, 25 bp, Rattus norvegicus
gaaagcactcgatattcttcaggag

SEQ ID NO: 287597 - DNA, 25 bp, Rattus norvegicus
gaaagcactgcaaggttcatcccta

SEQ ID NO: 287598 - DNA, 25 bp, Rattus norvegicus
gaaagcactgcatggttcatcccta

SEQ ID NO: 287599 - DNA, 25 bp, Rattus norvegicus
gaaagcactgtgactgtagttctgt

SEQ ID NO: 287600 - DNA, 25 bp, Rattus norvegicus
gaaagcactgtgtctgtagttctgt

SEQ ID NO: 287601 - DNA, 25 bp, Rattus norvegicus
gaaagcacttggagtcaggaacctt

SEQ ID NO: 287602 - DNA, 25 bp, Rattus norvegicus
gaaagcacttggtgtcaggaacctt

SEQ ID NO: 287603 - DNA, 25 bp, Rattus norvegicus
gaaagcagacatagacctcaccaag

SEQ ID NO: 287604 - DNA, 25 bp, Rattus norvegicus
gaaagcagacattgacctcaccaag

SEQ ID NO: 287605 - DNA, 25 bp, Rattus norvegicus
gaaagcagaccaccaggccaggatt

SEQ ID NO: 287606 - DNA, 25 bp, Rattus norvegicus
gaaagcagaccagcaggccaggatt

SEQ ID NO: 287607 - DNA, 25 bp, Rattus norvegicus
gaaagcagaccccattcacaccttt

SEQ ID NO: 287608 - DNA, 25 bp, Rattus norvegicus
gaaagcagacccgattcacaccttt

SEQ ID NO: 287609 - DNA, 25 bp, Rattus norvegicus
gaaagcagactaaaggtggttaccc

SEQ ID NO: 287610 - DNA, 25 bp, Rattus norvegicus
gaaagcagactataggtggttaccc

SEQ ID NO: 287611 - DNA, 25 bp, Rattus norvegicus
gaaagcagacttacggccaagacac

SEQ ID NO: 287612 - DNA, 25 bp, Rattus norvegicus
gaaagcagactttcggccaagacac

SEQ ID NO: 287613 - DNA, 25 bp, Rattus norvegicus
gaaagcagagcacctcatgtcggat

SEQ ID NO: 287614 - DNA, 25 bp, Rattus norvegicus
gaaagcagagcagctcatgtcggat

SEQ ID NO: 287615 - DNA, 25 bp, Rattus norvegicus
gaaagcagatatcacccaaggacac

SEQ ID NO: 287616 - DNA, 25 bp, Rattus norvegicus
gaaagcagatatgacccaaggacac

SEQ ID NO: 287617 - DNA, 25 bp, Rattus norvegicus
gaaagcagatgcagcccaccaaaga

SEQ ID NO: 287618 - DNA, 25 bp, Rattus norvegicus
gaaagcagatgctgcccaccaaaga

SEQ ID NO: 287619 - DNA, 25 bp, Rattus norvegicus
gaaagcagcagccaagggacctatg

SEQ ID NO: 287620 - DNA, 25 bp, Rattus norvegicus
gaaagcagcagcgaagggacctatg

SEQ ID NO: 287621 - DNA, 25 bp, Rattus norvegicus
gaaagcagcagtatgcctctccgga

SEQ ID NO: 287622 - DNA, 25 bp, Rattus norvegicus
gaaagcagcagtttgcctctccgga

SEQ ID NO: 287623 - DNA, 25 bp, Rattus norvegicus
gaaagcagcatcagcagtgaggtgt

SEQ ID NO: 287624 - DNA, 25 bp, Rattus norvegicus
gaaagcagcatctgcagtgaggtgt

SEQ ID NO: 287625 - DNA, 25 bp, Rattus norvegicus
gaaagcagccatcatatatttgata

SEQ ID NO: 287626 - DNA, 25 bp, Rattus norvegicus
gaaagcagccatgatatatttgata

SEQ ID NO: 287627 - DNA, 25 bp, Rattus norvegicus
gaaagcagcccacgcatggccactc

SEQ ID NO: 287628 - DNA, 25 bp, Rattus norvegicus
gaaagcagcccaggcatggccactc

SEQ ID NO: 287629 - DNA, 25 bp, Rattus norvegicus
gaaagcagcctacaagggtccttta

SEQ ID NO: 287630 - DNA, 25 bp, Rattus norvegicus
gaaagcagcctagaagggtccttta

SEQ ID NO: 287631 - DNA, 25 bp, Rattus norvegicus
gaaagcagcctcatttctgcactgt

SEQ ID NO: 287632 - DNA, 25 bp, Rattus norvegicus
gaaagcagcctcttttctgcactgt

SEQ ID NO: 287633 - DNA, 25 bp, Rattus norvegicus
gaaagcagccttctacattgcaatg

SEQ ID NO: 287634 - DNA, 25 bp, Rattus norvegicus
gaaagcagccttgtacattgcaatg

SEQ ID NO: 287635 - DNA, 25 bp, Rattus norvegicus
gaaagcagcgctctgtcttcagaga

SEQ ID NO: 287636 - DNA, 25 bp, Rattus norvegicus
gaaagcagcgctgtgtcttcagaga

SEQ ID NO: 287637 - DNA, 25 bp, Rattus norvegicus
gaaagcagcttcagagggccatttc

SEQ ID NO: 287638 - DNA, 25 bp, Rattus norvegicus
gaaagcagcttctgagggccatttc

SEQ ID NO: 287639 - DNA, 25 bp, Rattus norvegicus
gaaagcagctttctcatctcagcag

SEQ ID NO: 287640 - DNA, 25 bp, Rattus norvegicus
gaaagcagctttgtcatctcagcag

SEQ ID NO: 287641 - DNA, 25 bp, Rattus norvegicus
gaaagcaggagcctgctctccgcac

SEQ ID NO: 287642 - DNA, 25 bp, Rattus norvegicus
gaaagcaggagcgtgctctccgcac

SEQ ID NO: 287643 - DNA, 25 bp, Rattus norvegicus
gaaagcaggcatactgggtagagat

SEQ ID NO: 287644 - DNA, 25 bp, Rattus norvegicus
gaaagcaggcattctgggtagagat

SEQ ID NO: 287645 - DNA, 25 bp, Rattus norvegicus
gaaagcaggcctcatgtgctagaga

SEQ ID NO: 287646 - DNA, 25 bp, Rattus norvegicus
gaaagcaggcctgatgtgctagaga

SEQ ID NO: 287647 - DNA, 25 bp, Rattus norvegicus
gaaagcaggctgactaagacaccag

SEQ ID NO: 287648 - DNA, 25 bp, Rattus norvegicus
gaaagcaggctgtctaagacaccag

SEQ ID NO: 287649 - DNA, 25 bp, Rattus norvegicus
gaaagcagggtgactctgtcccctt

SEQ ID NO: 287650 - DNA, 25 bp, Rattus norvegicus
gaaagcagggtgtctctgtcccctt

SEQ ID NO: 287651 - DNA, 25 bp, Rattus norvegicus
gaaagcaggtcactggcacatgcct

SEQ ID NO: 287652 - DNA, 25 bp, Rattus norvegicus
gaaagcaggtcagtggcacatgcct

SEQ ID NO: 287653 - DNA, 25 bp, Rattus norvegicus
gaaagcaggtcgatccattctccag

SEQ ID NO: 287654 - DNA, 25 bp, Rattus norvegicus
gaaagcaggtcgttccattctccag

SEQ ID NO: 287655 - DNA, 25 bp, Rattus norvegicus
gaaagcagtatgctctggccaactg

SEQ ID NO: 287656 - DNA, 25 bp, Rattus norvegicus
gaaagcagtatggtctggccaactg

SEQ ID NO: 287657 - DNA, 25 bp, Rattus norvegicus
gaaagcagtcagatgtcttccctcc

SEQ ID NO: 287658 - DNA, 25 bp, Rattus norvegicus
gaaagcagtcagttgtcttccctcc

SEQ ID NO: 287659 - DNA, 25 bp, Rattus norvegicus
gaaagcagtcctaggtctgctcagt

SEQ ID NO: 287660 - DNA, 25 bp, Rattus norvegicus
gaaagcagtccttggtctgctcagt

SEQ ID NO: 287661 - DNA, 25 bp, Rattus norvegicus
gaaagcagtcttatccttgctgtct

SEQ ID NO: 287662 - DNA, 25 bp, Rattus norvegicus
gaaagcagtcttttccttgctgtct

SEQ ID NO: 287663 - DNA, 25 bp, Rattus norvegicus
gaaagcagtgcaagccttctcgtgg

SEQ ID NO: 287664 - DNA, 25 bp, Rattus norvegicus
gaaagcagtgcatgccttctcgtgg

SEQ ID NO: 287665 - DNA, 25 bp, Rattus norvegicus
gaaagcagtggaacgagcctcggaa

SEQ ID NO: 287666 - DNA, 25 bp, Rattus norvegicus
gaaagcagtggatcgagcctcggaa

SEQ ID NO: 287667 - DNA, 25 bp, Rattus norvegicus
gaaagcagtgttacacggccttcct

SEQ ID NO: 287668 - DNA, 25 bp, Rattus norvegicus
gaaagcagtgtttcacggccttcct

SEQ ID NO: 287669 - DNA, 25 bp, Rattus norvegicus
gaaagcagtttcaatgtccaaggaa

SEQ ID NO: 287670 - DNA, 25 bp, Rattus norvegicus
gaaagcagtttctatgtccaaggaa

SEQ ID NO: 287671 - DNA, 25 bp, Rattus norvegicus
gaaagcataagaaacctggtaacaa

SEQ ID NO: 287672 - DNA, 25 bp, Rattus norvegicus
gaaagcataagatacctggtaacaa

SEQ ID NO: 287673 - DNA, 25 bp, Rattus norvegicus
gaaagcatacccacaacaatggagt

SEQ ID NO: 287674 - DNA, 25 bp, Rattus norvegicus
gaaagcataccctcaacaatggagt

SEQ ID NO: 287675 - DNA, 25 bp, Rattus norvegicus
gaaagcatcagtcgcagacttcccc

SEQ ID NO: 287676 - DNA, 25 bp, Rattus norvegicus
gaaagcatcagtggcagacttcccc

SEQ ID NO: 287677 - DNA, 25 bp, Rattus norvegicus
gaaagcatcatgaaccggaagttta

SEQ ID NO: 287678 - DNA, 25 bp, Rattus norvegicus
gaaagcatcatgtaccggaagttta

SEQ ID NO: 287679 - DNA, 25 bp, Rattus norvegicus
gaaagcatccacagtatcaatagga

SEQ ID NO: 287680 - DNA, 25 bp, Rattus norvegicus
gaaagcatccactgtatcaatagga

SEQ ID NO: 287681 - DNA, 25 bp, Rattus norvegicus
gaaagcatccagcaataggccctgc

SEQ ID NO: 287682 - DNA, 25 bp, Rattus norvegicus
gaaagcatccaggaataggccctgc

SEQ ID NO: 287683 - DNA, 25 bp, Rattus norvegicus
gaaagcatccttaggctggaacggc

SEQ ID NO: 287684 - DNA, 25 bp, Rattus norvegicus
gaaagcatcctttggctggaacggc

SEQ ID NO: 287685 - DNA, 25 bp, Rattus norvegicus
gaaagcatctgcatggagttccctg

SEQ ID NO: 287686 - DNA, 25 bp, Rattus norvegicus
gaaagcatctgcttggagttccctg

SEQ ID NO: 287687 - DNA, 25 bp, Rattus norvegicus
gaaagcatgcaaccatagacttctg

SEQ ID NO: 287688 - DNA, 25 bp, Rattus norvegicus
gaaagcatgcaagcatagacttctg

SEQ ID NO: 287689 - DNA, 25 bp, Rattus norvegicus
gaaagcatggctattccgataacca

SEQ ID NO: 287690 - DNA, 25 bp, Rattus norvegicus
gaaagcatggcttttccgataacca

SEQ ID NO: 287691 - DNA, 25 bp, Rattus norvegicus
gaaagcatgggccattgtcacccac

SEQ ID NO: 287692 - DNA, 25 bp, Rattus norvegicus
gaaagcatgggcgattgtcacccac

SEQ ID NO: 287693 - DNA, 25 bp, Rattus norvegicus
gaaagcatggttctgcccacattta

SEQ ID NO: 287694 - DNA, 25 bp, Rattus norvegicus
gaaagcatggttgtgcccacattta

SEQ ID NO: 287695 - DNA, 25 bp, Rattus norvegicus
gaaagcatgtaacatcccaacccag

SEQ ID NO: 287696 - DNA, 25 bp, Rattus norvegicus
gaaagcatgtaagatcccaacccag

SEQ ID NO: 287697 - DNA, 25 bp, Rattus norvegicus
gaaagcatgtgccatgagactccat

SEQ ID NO: 287698 - DNA, 25 bp, Rattus norvegicus
gaaagcatgtgcgatgagactccat

SEQ ID NO: 287699 - DNA, 25 bp, Rattus norvegicus
gaaagcattcacagagggcctcaga

SEQ ID NO: 287700 - DNA, 25 bp, Rattus norvegicus
gaaagcattcactgagggcctcaga

SEQ ID NO: 287701 - DNA, 25 bp, Rattus norvegicus
gaaagcattcctcaaactgccacac

SEQ ID NO: 287702 - DNA, 25 bp, Rattus norvegicus
gaaagcattcctgaaactgccacac

SEQ ID NO: 287703 - DNA, 25 bp, Rattus norvegicus
gaaagcattcgcactgcatttgatt

SEQ ID NO: 287704 - DNA, 25 bp, Rattus norvegicus
gaaagcattcgctctgcatttgatt

SEQ ID NO: 287705 - DNA, 25 bp, Rattus norvegicus
gaaagcattcttagtccagtatgac

SEQ ID NO: 287706 - DNA, 25 bp, Rattus norvegicus
gaaagcattctttgtccagtatgac

SEQ ID NO: 287707 - DNA, 25 bp, Rattus norvegicus
gaaagcattgagctcctctgagtat

SEQ ID NO: 287708 - DNA, 25 bp, Rattus norvegicus
gaaagcattgaggtcctctgagtat

SEQ ID NO: 287709 - DNA, 25 bp, Rattus norvegicus
gaaagcattgccatgattccttgtg

SEQ ID NO: 287710 - DNA, 25 bp, Rattus norvegicus
gaaagcattgccttgattccttgtg

SEQ ID NO: 287711 - DNA, 25 bp, Rattus norvegicus
gaaagcattgctaagctgtaaccga

SEQ ID NO: 287712 - DNA, 25 bp, Rattus norvegicus
gaaagcattgcttagctgtaaccga

SEQ ID NO: 287713 - DNA, 25 bp, Rattus norvegicus
gaaagcattgtacacaacacctcct

SEQ ID NO: 287714 - DNA, 25 bp, Rattus norvegicus
gaaagcattgtagacaacacctcct

SEQ ID NO: 287715 - DNA, 25 bp, Rattus norvegicus
gaaagcattgttactggtccactcc

SEQ ID NO: 287716 - DNA, 25 bp, Rattus norvegicus
gaaagcattgtttctggtccactcc

SEQ ID NO: 287717 - DNA, 25 bp, Rattus norvegicus
gaaagcatttaaatacaagggaaag

SEQ ID NO: 287718 - DNA, 25 bp, Rattus norvegicus
gaaagcatttaattacaagggaaag

SEQ ID NO: 287719 - DNA, 25 bp, Rattus norvegicus
gaaagcatttctaaagtctctgctt

SEQ ID NO: 287720 - DNA, 25 bp, Rattus norvegicus
gaaagcatttcttaagtctctgctt

SEQ ID NO: 287721 - DNA, 25 bp, Rattus norvegicus
gaaagcatttgacaaccccgactac

SEQ ID NO: 287722 - DNA, 25 bp, Rattus norvegicus
gaaagcatttgagaaccccgactac

SEQ ID NO: 287723 - DNA, 25 bp, Rattus norvegicus
gaaagcatttgcacatggctgtccc

SEQ ID NO: 287724 - DNA, 25 bp, Rattus norvegicus
gaaagcatttgcacccattcaggag

SEQ ID NO: 287725 - DNA, 25 bp, Rattus norvegicus
gaaagcatttgctcatggctgtccc

SEQ ID NO: 287726 - DNA, 25 bp, Rattus norvegicus
gaaagcatttgctcccattcaggag

SEQ ID NO: 287727 - DNA, 25 bp, Rattus norvegicus
gaaagcattttcaacccagggcgtt

SEQ ID NO: 287728 - DNA, 25 bp, Rattus norvegicus
gaaagcattttcaaggtgtgtttag

SEQ ID NO: 287729 - DNA, 25 bp, Rattus norvegicus
gaaagcattttcaggttttctccca

SEQ ID NO: 287730 - DNA, 25 bp, Rattus norvegicus
gaaagcattttctacccagggcgtt

SEQ ID NO: 287731 - DNA, 25 bp, Rattus norvegicus
gaaagcattttctaggtgtgtttag

SEQ ID NO: 287732 - DNA, 25 bp, Rattus norvegicus
gaaagcattttctggttttctccca

SEQ ID NO: 287733 - DNA, 25 bp, Rattus norvegicus
gaaagcatttttagcctgcgattga

SEQ ID NO: 287734 - DNA, 25 bp, Rattus norvegicus
gaaagcattttttgcctgcgattga

SEQ ID NO: 287735 - DNA, 25 bp, Rattus norvegicus
gaaagccaacaacctccgataagca

SEQ ID NO: 287736 - DNA, 25 bp, Rattus norvegicus
gaaagccaacaagctccgataagca

SEQ ID NO: 287737 - DNA, 25 bp, Rattus norvegicus
gaaagccaacatactgatctaccaa

SEQ ID NO: 287738 - DNA, 25 bp, Rattus norvegicus
gaaagccaacattctgatctaccaa

SEQ ID NO: 287739 - DNA, 25 bp, Rattus norvegicus
gaaagccaacctactagctgggcat

SEQ ID NO: 287740 - DNA, 25 bp, Rattus norvegicus
gaaagccaaccttctagctgggcat

SEQ ID NO: 287741 - DNA, 25 bp, Rattus norvegicus
gaaagccaagacagcgttctgcacc

SEQ ID NO: 287742 - DNA, 25 bp, Rattus norvegicus
gaaagccaagactgcgttctgcacc

SEQ ID NO: 287743 - DNA, 25 bp, Rattus norvegicus
gaaagccaagtcaattcacgggaag

SEQ ID NO: 287744 - DNA, 25 bp, Rattus norvegicus
gaaagccaagtctattcacgggaag

SEQ ID NO: 287745 - DNA, 25 bp, Rattus norvegicus
gaaagccaatacataccctgtgagg

SEQ ID NO: 287746 - DNA, 25 bp, Rattus norvegicus
gaaagccaatacttaccctgtgagg

SEQ ID NO: 287747 - DNA, 25 bp, Rattus norvegicus
gaaagccacacacatgcctttgctg

SEQ ID NO: 287748 - DNA, 25 bp, Rattus norvegicus
gaaagccacacagatgcctttgctg

SEQ ID NO: 287749 - DNA, 25 bp, Rattus norvegicus
gaaagccacaggagtgccctcagat

SEQ ID NO: 287750 - DNA, 25 bp, Rattus norvegicus
gaaagccacaggtgtgccctcagat

SEQ ID NO: 287751 - DNA, 25 bp, Rattus norvegicus
gaaagccacatacttttctgtgtta

SEQ ID NO: 287752 - DNA, 25 bp, Rattus norvegicus
gaaagccacatagttttctgtgtta

SEQ ID NO: 287753 - DNA, 25 bp, Rattus norvegicus
gaaagccacattctctgacttctca

SEQ ID NO: 287754 - DNA, 25 bp, Rattus norvegicus
gaaagccacattgtctgacttctca

SEQ ID NO: 287755 - DNA, 25 bp, Rattus norvegicus
gaaagccacctcagagcctttactg

SEQ ID NO: 287756 - DNA, 25 bp, Rattus norvegicus
gaaagccacctctgagcctttactg

SEQ ID NO: 287757 - DNA, 25 bp, Rattus norvegicus
gaaagccacggtcctgtccacactg

SEQ ID NO: 287758 - DNA, 25 bp, Rattus norvegicus
gaaagccacggtgctgtccacactg

SEQ ID NO: 287759 - DNA, 25 bp, Rattus norvegicus
gaaagccactagatcctttgctgtt

SEQ ID NO: 287760 - DNA, 25 bp, Rattus norvegicus
gaaagccactagttcctttgctgtt

SEQ ID NO: 287761 - DNA, 25 bp, Rattus norvegicus
gaaagccacttgagagctcaatggt

SEQ ID NO: 287762 - DNA, 25 bp, Rattus norvegicus
gaaagccacttgagcttcctggaga

SEQ ID NO: 287763 - DNA, 25 bp, Rattus norvegicus
gaaagccacttgtgagctcaatggt

SEQ ID NO: 287764 - DNA, 25 bp, Rattus norvegicus
gaaagccacttgtgcttcctggaga

SEQ ID NO: 287765 - DNA, 25 bp, Rattus norvegicus
gaaagccagacacatctatacagat

SEQ ID NO: 287766 - DNA, 25 bp, Rattus norvegicus
gaaagccagacagatctatacagat

SEQ ID NO: 287767 - DNA, 25 bp, Rattus norvegicus
gaaagccagaccagcgctggaggac

SEQ ID NO: 287768 - DNA, 25 bp, Rattus norvegicus
gaaagccagacccaccaagaaacag

SEQ ID NO: 287769 - DNA, 25 bp, Rattus norvegicus
gaaagccagacccataagccacaga

SEQ ID NO: 287770 - DNA, 25 bp, Rattus norvegicus
gaaagccagaccgaccaagaaacag

SEQ ID NO: 287771 - DNA, 25 bp, Rattus norvegicus
gaaagccagaccgataagccacaga

SEQ ID NO: 287772 - DNA, 25 bp, Rattus norvegicus
gaaagccagacctgcgctggaggac

SEQ ID NO: 287773 - DNA, 25 bp, Rattus norvegicus
gaaagccagagccagtcagtacgga

SEQ ID NO: 287774 - DNA, 25 bp, Rattus norvegicus
gaaagccagagcgagtcagtacgga

SEQ ID NO: 287775 - DNA, 25 bp, Rattus norvegicus
gaaagccagcaacgtctgaagacag

SEQ ID NO: 287776 - DNA, 25 bp, Rattus norvegicus
gaaagccagcaaggtctgaagacag

SEQ ID NO: 287777 - DNA, 25 bp, Rattus norvegicus
gaaagccagccaagcactgtgggtg

SEQ ID NO: 287778 - DNA, 25 bp, Rattus norvegicus
gaaagccagccaccggtgatgcaca

SEQ ID NO: 287779 - DNA, 25 bp, Rattus norvegicus
gaaagccagccagcggtgatgcaca

SEQ ID NO: 287780 - DNA, 25 bp, Rattus norvegicus
gaaagccagccatgcactgtgggtg

SEQ ID NO: 287781 - DNA, 25 bp, Rattus norvegicus
gaaagccagctgatcaggatatgat

SEQ ID NO: 287782 - DNA, 25 bp, Rattus norvegicus
gaaagccagctgttcaggatatgat

SEQ ID NO: 287783 - DNA, 25 bp, Rattus norvegicus
gaaagccaggatcccgtcgtgagcc

SEQ ID NO: 287784 - DNA, 25 bp, Rattus norvegicus
gaaagccaggatgccgtcgtgagcc

SEQ ID NO: 287785 - DNA, 25 bp, Rattus norvegicus
gaaagccaggctccccagggccatg

SEQ ID NO: 287786 - DNA, 25 bp, Rattus norvegicus
gaaagccaggctgcccagggccatg

SEQ ID NO: 287787 - DNA, 25 bp, Rattus norvegicus
gaaagccagtgcagtgggaaccact

SEQ ID NO: 287788 - DNA, 25 bp, Rattus norvegicus
gaaagccagtgctgtgggaaccact

SEQ ID NO: 287789 - DNA, 25 bp, Rattus norvegicus
gaaagccagtgtctagctctccgac

SEQ ID NO: 287790 - DNA, 25 bp, Rattus norvegicus
gaaagccagtgtgtagctctccgac

SEQ ID NO: 287791 - DNA, 25 bp, Rattus norvegicus
gaaagccagtttaacttcatgccct

SEQ ID NO: 287792 - DNA, 25 bp, Rattus norvegicus
gaaagccagtttcctgtcatggacc

SEQ ID NO: 287793 - DNA, 25 bp, Rattus norvegicus
gaaagccagtttgctgtcatggacc

SEQ ID NO: 287794 - DNA, 25 bp, Rattus norvegicus
gaaagccagttttacttcatgccct

SEQ ID NO: 287795 - DNA, 25 bp, Rattus norvegicus
gaaagccataggaaattgtcccata

SEQ ID NO: 287796 - DNA, 25 bp, Rattus norvegicus
gaaagccataggtaattgtcccata

SEQ ID NO: 287797 - DNA, 25 bp, Rattus norvegicus
gaaagccatatgaccaggacctcgt

SEQ ID NO: 287798 - DNA, 25 bp, Rattus norvegicus
gaaagccatatgtccaggacctcgt

SEQ ID NO: 287799 - DNA, 25 bp, Rattus norvegicus
gaaagccatcaacgacctagacaga

SEQ ID NO: 287800 - DNA, 25 bp, Rattus norvegicus
gaaagccatcaaggacctagacaga

SEQ ID NO: 287801 - DNA, 25 bp, Rattus norvegicus
gaaagccatcatatatcactgcaaa

SEQ ID NO: 287802 - DNA, 25 bp, Rattus norvegicus
gaaagccatcatttatcactgcaaa

SEQ ID NO: 287803 - DNA, 25 bp, Rattus norvegicus
gaaagccatctgagaaaacccatta

SEQ ID NO: 287804 - DNA, 25 bp, Rattus norvegicus
gaaagccatctgtgaaaacccatta

SEQ ID NO: 287805 - DNA, 25 bp, Rattus norvegicus
gaaagccatcttagaaacggactca

SEQ ID NO: 287806 - DNA, 25 bp, Rattus norvegicus
gaaagccatcttagagctactgtaa

SEQ ID NO: 287807 - DNA, 25 bp, Rattus norvegicus
gaaagccatctttgaaacggactca

SEQ ID NO: 287808 - DNA, 25 bp, Rattus norvegicus
gaaagccatctttgagctactgtaa

SEQ ID NO: 287809 - DNA, 25 bp, Rattus norvegicus
gaaagccatgatatgtgacgggaga

SEQ ID NO: 287810 - DNA, 25 bp, Rattus norvegicus
gaaagccatgatttgtgacgggaga

SEQ ID NO: 287811 - DNA, 25 bp, Rattus norvegicus
gaaagccatgcgagtccgtgtatat

SEQ ID NO: 287812 - DNA, 25 bp, Rattus norvegicus
gaaagccatgcgtgtccgtgtatat

SEQ ID NO: 287813 - DNA, 25 bp, Rattus norvegicus
gaaagccattgacctgttctcagtg

SEQ ID NO: 287814 - DNA, 25 bp, Rattus norvegicus
gaaagccattgagctgttctcagtg

SEQ ID NO: 287815 - DNA, 25 bp, Rattus norvegicus
gaaagccattggacagagccacgga

SEQ ID NO: 287816 - DNA, 25 bp, Rattus norvegicus
gaaagccattggtcagagccacgga

SEQ ID NO: 287817 - DNA, 25 bp, Rattus norvegicus
gaaagccattgtcatctgaggaagc

SEQ ID NO: 287818 - DNA, 25 bp, Rattus norvegicus
gaaagccattgtgatctgaggaagc

SEQ ID NO: 287819 - DNA, 25 bp, Rattus norvegicus
gaaagcccactgatactagctgtgt

SEQ ID NO: 287820 - DNA, 25 bp, Rattus norvegicus
gaaagcccactgatcagtatcatag

SEQ ID NO: 287821 - DNA, 25 bp, Rattus norvegicus
gaaagcccactgttactagctgtgt

SEQ ID NO: 287822 - DNA, 25 bp, Rattus norvegicus
gaaagcccactgttcagtatcatag

SEQ ID NO: 287823 - DNA, 25 bp, Rattus norvegicus
gaaagcccagatattgaaatggact

SEQ ID NO: 287824 - DNA, 25 bp, Rattus norvegicus
gaaagcccagattttgaaatggact

SEQ ID NO: 287825 - DNA, 25 bp, Rattus norvegicus
gaaagcccagcacgtgaagcgatcc

SEQ ID NO: 287826 - DNA, 25 bp, Rattus norvegicus
gaaagcccagcaggtgaagcgatcc

SEQ ID NO: 287827 - DNA, 25 bp, Rattus norvegicus
gaaagcccagcccattgccagttgc

SEQ ID NO: 287828 - DNA, 25 bp, Rattus norvegicus
gaaagcccagccgattgccagttgc

SEQ ID NO: 287829 - DNA, 25 bp, Rattus norvegicus
gaaagcccaggacagctcaggccta

SEQ ID NO: 287830 - DNA, 25 bp, Rattus norvegicus
gaaagcccaggagagctcaggccta

SEQ ID NO: 287831 - DNA, 25 bp, Rattus norvegicus
gaaagcccagggatattctgtcgag

SEQ ID NO: 287832 - DNA, 25 bp, Rattus norvegicus
gaaagcccagggttattctgtcgag

SEQ ID NO: 287833 - DNA, 25 bp, Rattus norvegicus
gaaagcccattcctcgaattagcca

SEQ ID NO: 287834 - DNA, 25 bp, Rattus norvegicus
gaaagcccattcgtcgaattagcca

SEQ ID NO: 287835 - DNA, 25 bp, Rattus norvegicus
gaaagccccaccatgtcacagaagg

SEQ ID NO: 287836 - DNA, 25 bp, Rattus norvegicus
gaaagccccaccttgtcacagaagg

SEQ ID NO: 287837 - DNA, 25 bp, Rattus norvegicus
gaaagccccgagacaagcctgcaga

SEQ ID NO: 287838 - DNA, 25 bp, Rattus norvegicus
gaaagccccgagtcaagcctgcaga

SEQ ID NO: 287839 - DNA, 25 bp, Rattus norvegicus
gaaagccccttacagatatggcaga

SEQ ID NO: 287840 - DNA, 25 bp, Rattus norvegicus
gaaagccccttagagatatggcaga

SEQ ID NO: 287841 - DNA, 25 bp, Rattus norvegicus
gaaagccccttcattctcagagctt

SEQ ID NO: 287842 - DNA, 25 bp, Rattus norvegicus
gaaagccccttctttctcagagctt

SEQ ID NO: 287843 - DNA, 25 bp, Rattus norvegicus
gaaagcccgaggctctaaaagccaa

SEQ ID NO: 287844 - DNA, 25 bp, Rattus norvegicus
gaaagcccgagggtctaaaagccaa

SEQ ID NO: 287845 - DNA, 25 bp, Rattus norvegicus
gaaagcccgcacagttggagattta

SEQ ID NO: 287846 - DNA, 25 bp, Rattus norvegicus
gaaagcccgcactgttggagattta

SEQ ID NO: 287847 - DNA, 25 bp, Rattus norvegicus
gaaagcccggagagtccagtgctaa

SEQ ID NO: 287848 - DNA, 25 bp, Rattus norvegicus
gaaagcccggagtgtccagtgctaa

SEQ ID NO: 287849 - DNA, 25 bp, Rattus norvegicus
gaaagcccgggtactgttgctagca

SEQ ID NO: 287850 - DNA, 25 bp, Rattus norvegicus
gaaagcccgggttctgttgctagca

SEQ ID NO: 287851 - DNA, 25 bp, Rattus norvegicus
gaaagccctaaaaacctgtgtctat

SEQ ID NO: 287852 - DNA, 25 bp, Rattus norvegicus
gaaagccctaaatacctgtgtctat

SEQ ID NO: 287853 - DNA, 25 bp, Rattus norvegicus
gaaagccctaccacttggtgctaag

SEQ ID NO: 287854 - DNA, 25 bp, Rattus norvegicus
gaaagccctacctcttggtgctaag

SEQ ID NO: 287855 - DNA, 25 bp, Rattus norvegicus
gaaagccctagtattgtacttgata

SEQ ID NO: 287856 - DNA, 25 bp, Rattus norvegicus
gaaagccctagttttgtacttgata

SEQ ID NO: 287857 - DNA, 25 bp, Rattus norvegicus
gaaagccctccaagtatatccagtt

SEQ ID NO: 287858 - DNA, 25 bp, Rattus norvegicus
gaaagccctccatgtatatccagtt

SEQ ID NO: 287859 - DNA, 25 bp, Rattus norvegicus
gaaagccctgaaatcttgactggtt

SEQ ID NO: 287860 - DNA, 25 bp, Rattus norvegicus
gaaagccctgaaccatatgctgctg

SEQ ID NO: 287861 - DNA, 25 bp, Rattus norvegicus
gaaagccctgaagcatatgctgctg

SEQ ID NO: 287862 - DNA, 25 bp, Rattus norvegicus
gaaagccctgaattcttgactggtt

SEQ ID NO: 287863 - DNA, 25 bp, Rattus norvegicus
gaaagccctgagacttgtttatcta

SEQ ID NO: 287864 - DNA, 25 bp, Rattus norvegicus
gaaagccctgagcatgatcttcgca

SEQ ID NO: 287865 - DNA, 25 bp, Rattus norvegicus
gaaagccctgaggatgatcttcgca

SEQ ID NO: 287866 - DNA, 25 bp, Rattus norvegicus
gaaagccctgagtcttgtttatcta

SEQ ID NO: 287867 - DNA, 25 bp, Rattus norvegicus
gaaagccctggcacaaaaactgttt

SEQ ID NO: 287868 - DNA, 25 bp, Rattus norvegicus
gaaagccctggctcaaaaactgttt

SEQ ID NO: 287869 - DNA, 25 bp, Rattus norvegicus
gaaagccctgtccattgaggcagat

SEQ ID NO: 287870 - DNA, 25 bp, Rattus norvegicus
gaaagccctgtcgattgaggcagat

SEQ ID NO: 287871 - DNA, 25 bp, Rattus norvegicus
gaaagcccttcaacatttatcataa

SEQ ID NO: 287872 - DNA, 25 bp, Rattus norvegicus
gaaagcccttcaagaccaagtgtac

SEQ ID NO: 287873 - DNA, 25 bp, Rattus norvegicus
gaaagcccttcatcatttatcataa

SEQ ID NO: 287874 - DNA, 25 bp, Rattus norvegicus
gaaagcccttcatgaccaagtgtac

SEQ ID NO: 287875 - DNA, 25 bp, Rattus norvegicus
gaaagcccttgtcagtggtacaact

SEQ ID NO: 287876 - DNA, 25 bp, Rattus norvegicus
gaaagcccttgtgagtggtacaact

SEQ ID NO: 287877 - DNA, 25 bp, Rattus norvegicus
gaaagccctttgacacttaatgata

SEQ ID NO: 287878 - DNA, 25 bp, Rattus norvegicus
gaaagccctttgtcacttaatgata

SEQ ID NO: 287879 - DNA, 25 bp, Rattus norvegicus
gaaagcccttttctttagaagtctg

SEQ ID NO: 287880 - DNA, 25 bp, Rattus norvegicus
gaaagcccttttgtttagaagtctg

SEQ ID NO: 287881 - DNA, 25 bp, Rattus norvegicus
gaaagccgaatacggtcgtttctga

SEQ ID NO: 287882 - DNA, 25 bp, Rattus norvegicus
gaaagccgaatagggtcgtttctga

SEQ ID NO: 287883 - DNA, 25 bp, Rattus norvegicus
gaaagccgacagataagtttctcca

SEQ ID NO: 287884 - DNA, 25 bp, Rattus norvegicus
gaaagccgacagttaagtttctcca

SEQ ID NO: 287885 - DNA, 25 bp, Rattus norvegicus
gaaagccgactgcacctaatagccc

SEQ ID NO: 287886 - DNA, 25 bp, Rattus norvegicus
gaaagccgactggacctaatagccc

SEQ ID NO: 287887 - DNA, 25 bp, Rattus norvegicus
gaaagccgagcccaaaaagatgaag

SEQ ID NO: 287888 - DNA, 25 bp, Rattus norvegicus
gaaagccgagccgaaaaagatgaag

SEQ ID NO: 287889 - DNA, 25 bp, Rattus norvegicus
gaaagccgatttatcatggtgagaa

SEQ ID NO: 287890 - DNA, 25 bp, Rattus norvegicus
gaaagccgatttttcatggtgagaa

SEQ ID NO: 287891 - DNA, 25 bp, Rattus norvegicus
gaaagccgctgaactacaagcccga

SEQ ID NO: 287892 - DNA, 25 bp, Rattus norvegicus
gaaagccgctgatctacaagcccga

SEQ ID NO: 287893 - DNA, 25 bp, Rattus norvegicus
gaaagccgctgtcaactgagatgca

SEQ ID NO: 287894 - DNA, 25 bp, Rattus norvegicus
gaaagccgctgtgaactgagatgca

SEQ ID NO: 287895 - DNA, 25 bp, Rattus norvegicus
gaaagccggatgctcagacactgca

SEQ ID NO: 287896 - DNA, 25 bp, Rattus norvegicus
gaaagccggatggtcagacactgca

SEQ ID NO: 287897 - DNA, 25 bp, Rattus norvegicus
gaaagccggcctcgaaagtaccttg

SEQ ID NO: 287898 - DNA, 25 bp, Rattus norvegicus
gaaagccggcctggaaagtaccttg

SEQ ID NO: 287899 - DNA, 25 bp, Rattus norvegicus
gaaagccggctcagtgaccaagtgg

SEQ ID NO: 287900 - DNA, 25 bp, Rattus norvegicus
gaaagccggctctgtgaccaagtgg

SEQ ID NO: 287901 - DNA, 25 bp, Rattus norvegicus
gaaagccgtcggctgacaactaggt

SEQ ID NO: 287902 - DNA, 25 bp, Rattus norvegicus
gaaagccgtcgggtgacaactaggt

SEQ ID NO: 287903 - DNA, 25 bp, Rattus norvegicus
gaaagccgtgatcgaacagtcagga

SEQ ID NO: 287904 - DNA, 25 bp, Rattus norvegicus
gaaagccgtgatggaacagtcagga

SEQ ID NO: 287905 - DNA, 25 bp, Rattus norvegicus
gaaagccgtggaaagcagctcagag

SEQ ID NO: 287906 - DNA, 25 bp, Rattus norvegicus
gaaagccgtggatagcagctcagag

SEQ ID NO: 287907 - DNA, 25 bp, Rattus norvegicus
gaaagcctacagctgtccacagaat

SEQ ID NO: 287908 - DNA, 25 bp, Rattus norvegicus
gaaagcctacaggtgtccacagaat

SEQ ID NO: 287909 - DNA, 25 bp, Rattus norvegicus
gaaagcctaccgcaggtacaatctg

SEQ ID NO: 287910 - DNA, 25 bp, Rattus norvegicus
gaaagcctaccggaggtacaatctg

SEQ ID NO: 287911 - DNA, 25 bp, Rattus norvegicus
gaaagcctacggaaacactcggaca

SEQ ID NO: 287912 - DNA, 25 bp, Rattus norvegicus
gaaagcctacggtaacactcggaca

SEQ ID NO: 287913 - DNA, 25 bp, Rattus norvegicus
gaaagcctatacacccatttaaaga

SEQ ID NO: 287914 - DNA, 25 bp, Rattus norvegicus
gaaagcctatactcccatttaaaga

SEQ ID NO: 287915 - DNA, 25 bp, Rattus norvegicus
gaaagcctattaatcatggagaact

SEQ ID NO: 287916 - DNA, 25 bp, Rattus norvegicus
gaaagcctattattcatggagaact

SEQ ID NO: 287917 - DNA, 25 bp, Rattus norvegicus
gaaagcctatttcctgtacatgtat

SEQ ID NO: 287918 - DNA, 25 bp, Rattus norvegicus
gaaagcctatttgctgtacatgtat

SEQ ID NO: 287919 - DNA, 25 bp, Rattus norvegicus
gaaagcctcaaaccctttgttcgct

SEQ ID NO: 287920 - DNA, 25 bp, Rattus norvegicus
gaaagcctcaaagcctttgttcgct

SEQ ID NO: 287921 - DNA, 25 bp, Rattus norvegicus
gaaagcctccctctggaagctggac

SEQ ID NO: 287922 - DNA, 25 bp, Rattus norvegicus
gaaagcctccctgtggaagctggac

SEQ ID NO: 287923 - DNA, 25 bp, Rattus norvegicus
gaaagcctccttctttgggtttgca

SEQ ID NO: 287924 - DNA, 25 bp, Rattus norvegicus
gaaagcctccttgtttgggtttgca

SEQ ID NO: 287925 - DNA, 25 bp, Rattus norvegicus
gaaagcctcgatactacaggacttt

SEQ ID NO: 287926 - DNA, 25 bp, Rattus norvegicus
gaaagcctcgattctacaggacttt

SEQ ID NO: 287927 - DNA, 25 bp, Rattus norvegicus
gaaagcctgactaacactgacttct

SEQ ID NO: 287928 - DNA, 25 bp, Rattus norvegicus
gaaagcctgactaacttctggctaa

SEQ ID NO: 287929 - DNA, 25 bp, Rattus norvegicus
gaaagcctgacttacactgacttct

SEQ ID NO: 287930 - DNA, 25 bp, Rattus norvegicus
gaaagcctgacttacttctggctaa

SEQ ID NO: 287931 - DNA, 25 bp, Rattus norvegicus
gaaagcctgcagattgtcactggga

SEQ ID NO: 287932 - DNA, 25 bp, Rattus norvegicus
gaaagcctgcagtttgtcactggga

SEQ ID NO: 287933 - DNA, 25 bp, Rattus norvegicus
gaaagcctgctaccagttcctggac

SEQ ID NO: 287934 - DNA, 25 bp, Rattus norvegicus
gaaagcctgctagcagttcctggac

SEQ ID NO: 287935 - DNA, 25 bp, Rattus norvegicus
gaaagcctgggacttccgaagacag

SEQ ID NO: 287936 - DNA, 25 bp, Rattus norvegicus
gaaagcctgggagttccgaagacag

SEQ ID NO: 287937 - DNA, 25 bp, Rattus norvegicus
gaaagcctgtaactggtccttggaa

SEQ ID NO: 287938 - DNA, 25 bp, Rattus norvegicus
gaaagcctgtaagtggtccttggaa

SEQ ID NO: 287939 - DNA, 25 bp, Rattus norvegicus
gaaagcctgtacaacttaaacttga

SEQ ID NO: 287940 - DNA, 25 bp, Rattus norvegicus
gaaagcctgtactacttaaacttga

SEQ ID NO: 287941 - DNA, 25 bp, Rattus norvegicus
gaaagcctgtggaccaacaggagtg

SEQ ID NO: 287942 - DNA, 25 bp, Rattus norvegicus
gaaagcctgtggtccaacaggagtg

SEQ ID NO: 287943 - DNA, 25 bp, Rattus norvegicus
gaaagcctgtgtacttactctctag

SEQ ID NO: 287944 - DNA, 25 bp, Rattus norvegicus
gaaagcctgtgttcttactctctag

SEQ ID NO: 287945 - DNA, 25 bp, Rattus norvegicus
gaaagcctgttaccagtgtctggcc

SEQ ID NO: 287946 - DNA, 25 bp, Rattus norvegicus
gaaagcctgttagcagtgtctggcc

SEQ ID NO: 287947 - DNA, 25 bp, Rattus norvegicus
gaaagcctgtttaacatttctgtat

SEQ ID NO: 287948 - DNA, 25 bp, Rattus norvegicus
gaaagcctgttttacatttctgtat

SEQ ID NO: 287949 - DNA, 25 bp, Rattus norvegicus
gaaagccttagaaacatcataatgc

SEQ ID NO: 287950 - DNA, 25 bp, Rattus norvegicus
gaaagccttagatacatcataatgc

SEQ ID NO: 287951 - DNA, 25 bp, Rattus norvegicus
gaaagccttatgaacactctgtgtt

SEQ ID NO: 287952 - DNA, 25 bp, Rattus norvegicus
gaaagccttatgtacactctgtgtt

SEQ ID NO: 287953 - DNA, 25 bp, Rattus norvegicus
gaaagccttcagatttaatggatgt

SEQ ID NO: 287954 - DNA, 25 bp, Rattus norvegicus
gaaagccttcagttttaatggatgt

SEQ ID NO: 287955 - DNA, 25 bp, Rattus norvegicus
gaaagccttccgcacttccagtggc

SEQ ID NO: 287956 - DNA, 25 bp, Rattus norvegicus
gaaagccttccggacttccagtggc

SEQ ID NO: 287957 - DNA, 25 bp, Rattus norvegicus
gaaagccttcctaaatgagacaata

SEQ ID NO: 287958 - DNA, 25 bp, Rattus norvegicus
gaaagccttccttaatgagacaata

SEQ ID NO: 287959 - DNA, 25 bp, Rattus norvegicus
gaaagccttcgaagtcagaccttaa

SEQ ID NO: 287960 - DNA, 25 bp, Rattus norvegicus
gaaagccttcgatgtcagaccttaa

SEQ ID NO: 287961 - DNA, 25 bp, Rattus norvegicus
gaaagccttcggaaacaagttgatc

SEQ ID NO: 287962 - DNA, 25 bp, Rattus norvegicus
gaaagccttcggtaacaagttgatc

SEQ ID NO: 287963 - DNA, 25 bp, Rattus norvegicus
gaaagccttctaaccattccaaagt

SEQ ID NO: 287964 - DNA, 25 bp, Rattus norvegicus
gaaagccttctatccattccaaagt

SEQ ID NO: 287965 - DNA, 25 bp, Rattus norvegicus
gaaagccttctgaaagtaaccatcc

SEQ ID NO: 287966 - DNA, 25 bp, Rattus norvegicus
gaaagccttctgtaagtaaccatcc

SEQ ID NO: 287967 - DNA, 25 bp, Rattus norvegicus
gaaagccttgacatgtgctctgtag

SEQ ID NO: 287968 - DNA, 25 bp, Rattus norvegicus
gaaagccttgacttgtgctctgtag

SEQ ID NO: 287969 - DNA, 25 bp, Rattus norvegicus
gaaagccttgataccaaaattggga

SEQ ID NO: 287970 - DNA, 25 bp, Rattus norvegicus
gaaagccttgattccaaaattggga

SEQ ID NO: 287971 - DNA, 25 bp, Rattus norvegicus
gaaagccttgccaatcacttgagga

SEQ ID NO: 287972 - DNA, 25 bp, Rattus norvegicus
gaaagccttgccatagtttctgtac

SEQ ID NO: 287973 - DNA, 25 bp, Rattus norvegicus
gaaagccttgccatggtcaggtcac

SEQ ID NO: 287974 - DNA, 25 bp, Rattus norvegicus
gaaagccttgcctatcacttgagga

SEQ ID NO: 287975 - DNA, 25 bp, Rattus norvegicus
gaaagccttgccttagtttctgtac

SEQ ID NO: 287976 - DNA, 25 bp, Rattus norvegicus
gaaagccttgccttggtcaggtcac

SEQ ID NO: 287977 - DNA, 25 bp, Rattus norvegicus
gaaagcctttacatgcagattgtgt

SEQ ID NO: 287978 - DNA, 25 bp, Rattus norvegicus
gaaagcctttacttgcagattgtgt

SEQ ID NO: 287979 - DNA, 25 bp, Rattus norvegicus
gaaagcctttagctagcgcagcgca

SEQ ID NO: 287980 - DNA, 25 bp, Rattus norvegicus
gaaagcctttaggtagcgcagcgca

SEQ ID NO: 287981 - DNA, 25 bp, Rattus norvegicus
gaaagccttttcacattcaaaattc

SEQ ID NO: 287982 - DNA, 25 bp, Rattus norvegicus
gaaagccttttctcattcaaaattc

SEQ ID NO: 287983 - DNA, 25 bp, Rattus norvegicus
gaaagcctttttaactatagtggtg

SEQ ID NO: 287984 - DNA, 25 bp, Rattus norvegicus
gaaagccttttttactatagtggtg

SEQ ID NO: 287985 - DNA, 25 bp, Rattus norvegicus
gaaagcgaactcacaaagctgtttg

SEQ ID NO: 287986 - DNA, 25 bp, Rattus norvegicus
gaaagcgaactctcaaagctgtttg

SEQ ID NO: 287987 - DNA, 25 bp, Rattus norvegicus
gaaagcgacatgactgtttcacctc

SEQ ID NO: 287988 - DNA, 25 bp, Rattus norvegicus
gaaagcgacatgtctgtttcacctc

SEQ ID NO: 287989 - DNA, 25 bp, Rattus norvegicus
gaaagcgaccaacgacgagtccgaa

SEQ ID NO: 287990 - DNA, 25 bp, Rattus norvegicus
gaaagcgaccaaggacgagtccgaa

SEQ ID NO: 287991 - DNA, 25 bp, Rattus norvegicus
gaaagcgaccagcacacactattca

SEQ ID NO: 287992 - DNA, 25 bp, Rattus norvegicus
gaaagcgaccaggacacactattca

SEQ ID NO: 287993 - DNA, 25 bp, Rattus norvegicus
gaaagcgacccaattttgatgagcg

SEQ ID NO: 287994 - DNA, 25 bp, Rattus norvegicus
gaaagcgacccatttttgatgagcg

SEQ ID NO: 287995 - DNA, 25 bp, Rattus norvegicus
gaaagcgagtccaaaaggagaggaa

SEQ ID NO: 287996 - DNA, 25 bp, Rattus norvegicus
gaaagcgagtccagcagtagtctga

SEQ ID NO: 287997 - DNA, 25 bp, Rattus norvegicus
gaaagcgagtcctaaaggagaggaa

SEQ ID NO: 287998 - DNA, 25 bp, Rattus norvegicus
gaaagcgagtcctgcagtagtctga

SEQ ID NO: 287999 - DNA, 25 bp, Rattus norvegicus
gaaagcgatttcattcattttttag

SEQ ID NO: 288000 - DNA, 25 bp, Rattus norvegicus
gaaagcgatttctttcattttttag

SEQ ID NO: 288001 - DNA, 25 bp, Rattus norvegicus
gaaagcgcacctacagggtacttta

SEQ ID NO: 288002 - DNA, 25 bp, Rattus norvegicus
gaaagcgcaccttcagggtacttta

SEQ ID NO: 288003 - DNA, 25 bp, Rattus norvegicus
gaaagcgccatgcaggcagacccta

SEQ ID NO: 288004 - DNA, 25 bp, Rattus norvegicus
gaaagcgccatggaggcagacccta

SEQ ID NO: 288005 - DNA, 25 bp, Rattus norvegicus
gaaagcgccggaacgaagtctctca

SEQ ID NO: 288006 - DNA, 25 bp, Rattus norvegicus
gaaagcgccggatcgaagtctctca

SEQ ID NO: 288007 - DNA, 25 bp, Rattus norvegicus
gaaagcgcctgaacacggcttcaga

SEQ ID NO: 288008 - DNA, 25 bp, Rattus norvegicus
gaaagcgcctgatcacggcttcaga

SEQ ID NO: 288009 - DNA, 25 bp, Rattus norvegicus
gaaagcgccttccatacagggagca

SEQ ID NO: 288010 - DNA, 25 bp, Rattus norvegicus
gaaagcgccttcgatacagggagca

SEQ ID NO: 288011 - DNA, 25 bp, Rattus norvegicus
gaaagcgctaacacgagtatggcag

SEQ ID NO: 288012 - DNA, 25 bp, Rattus norvegicus
gaaagcgctaactcgagtatggcag

SEQ ID NO: 288013 - DNA, 25 bp, Rattus norvegicus
gaaagcgcttaaagcatccgggctt

SEQ ID NO: 288014 - DNA, 25 bp, Rattus norvegicus
gaaagcgcttaatgcatccgggctt

SEQ ID NO: 288015 - DNA, 25 bp, Rattus norvegicus
gaaagcgcttgcagactacatcagg

SEQ ID NO: 288016 - DNA, 25 bp, Rattus norvegicus
gaaagcgcttgctgactacatcagg

SEQ ID NO: 288017 - DNA, 25 bp, Rattus norvegicus
gaaagcgctttgcaggttcctggta

SEQ ID NO: 288018 - DNA, 25 bp, Rattus norvegicus
gaaagcgctttggaggttcctggta

SEQ ID NO: 288019 - DNA, 25 bp, Rattus norvegicus
gaaagcggccatccatgccatggtt

SEQ ID NO: 288020 - DNA, 25 bp, Rattus norvegicus
gaaagcggccatgcatgccatggtt

SEQ ID NO: 288021 - DNA, 25 bp, Rattus norvegicus
gaaagcggcgctacgaccggaagca

SEQ ID NO: 288022 - DNA, 25 bp, Rattus norvegicus
gaaagcggcgcttcgaccggaagca

SEQ ID NO: 288023 - DNA, 25 bp, Rattus norvegicus
gaaagcggcgttatgacaggaaaca

SEQ ID NO: 288024 - DNA, 25 bp, Rattus norvegicus
gaaagcggcgttttgacaggaaaca

SEQ ID NO: 288025 - DNA, 25 bp, Rattus norvegicus
gaaagcgggcatatgtttcccagtc

SEQ ID NO: 288026 - DNA, 25 bp, Rattus norvegicus
gaaagcgggcatttgtttcccagtc

SEQ ID NO: 288027 - DNA, 25 bp, Rattus norvegicus
gaaagcgggtccacacgtgattcaa

SEQ ID NO: 288028 - DNA, 25 bp, Rattus norvegicus
gaaagcgggtcctcacgtgattcaa

SEQ ID NO: 288029 - DNA, 25 bp, Rattus norvegicus
gaaagcggtagcatcgagtctcagt

SEQ ID NO: 288030 - DNA, 25 bp, Rattus norvegicus
gaaagcggtagcttcgagtctcagt

SEQ ID NO: 288031 - DNA, 25 bp, Rattus norvegicus
gaaagcggtctcaggttgcaccgaa

SEQ ID NO: 288032 - DNA, 25 bp, Rattus norvegicus
gaaagcggtctctggttgcaccgaa

SEQ ID NO: 288033 - DNA, 25 bp, Rattus norvegicus
gaaagcgtccgcagagcagatcgag

SEQ ID NO: 288034 - DNA, 25 bp, Rattus norvegicus
gaaagcgtccgctgagcagatcgag

SEQ ID NO: 288035 - DNA, 25 bp, Rattus norvegicus
gaaagcgtcctgaccttggagttta

SEQ ID NO: 288036 - DNA, 25 bp, Rattus norvegicus
gaaagcgtcctgtccttggagttta

SEQ ID NO: 288037 - DNA, 25 bp, Rattus norvegicus
gaaagcgttcacaagcaccatggtt

SEQ ID NO: 288038 - DNA, 25 bp, Rattus norvegicus
gaaagcgttcactagcaccatggtt

SEQ ID NO: 288039 - DNA, 25 bp, Rattus norvegicus
gaaagcgttctcctattgcattatg

SEQ ID NO: 288040 - DNA, 25 bp, Rattus norvegicus
gaaagcgttctcgtattgcattatg

SEQ ID NO: 288041 - DNA, 25 bp, Rattus norvegicus
gaaagctaacgaatgactgcctggg

SEQ ID NO: 288042 - DNA, 25 bp, Rattus norvegicus
gaaagctaacgattgactgcctggg

SEQ ID NO: 288043 - DNA, 25 bp, Rattus norvegicus
gaaagctaacggactggaccaccat

SEQ ID NO: 288044 - DNA, 25 bp, Rattus norvegicus
gaaagctaacggtctggaccaccat

SEQ ID NO: 288045 - DNA, 25 bp, Rattus norvegicus
gaaagctaagctcgtggccttcccc

SEQ ID NO: 288046 - DNA, 25 bp, Rattus norvegicus
gaaagctaagctggtggccttcccc

SEQ ID NO: 288047 - DNA, 25 bp, Rattus norvegicus
gaaagctacatacttgggctcccaa

SEQ ID NO: 288048 - DNA, 25 bp, Rattus norvegicus
gaaagctacatagttgggctcccaa

SEQ ID NO: 288049 - DNA, 25 bp, Rattus norvegicus
gaaagctacatcaccaggcagacca

SEQ ID NO: 288050 - DNA, 25 bp, Rattus norvegicus
gaaagctacatctccaggcagacca

SEQ ID NO: 288051 - DNA, 25 bp, Rattus norvegicus
gaaagctacctgatcatcagacgtt

SEQ ID NO: 288052 - DNA, 25 bp, Rattus norvegicus
gaaagctacctgttcatcagacgtt

SEQ ID NO: 288053 - DNA, 25 bp, Rattus norvegicus
gaaagctaccttattatggatgtta

SEQ ID NO: 288054 - DNA, 25 bp, Rattus norvegicus
gaaagctacctttttatggatgtta

SEQ ID NO: 288055 - DNA, 25 bp, Rattus norvegicus
gaaagctactgcctttgttcttaga

SEQ ID NO: 288056 - DNA, 25 bp, Rattus norvegicus
gaaagctactgcgtttgttcttaga

SEQ ID NO: 288057 - DNA, 25 bp, Rattus norvegicus
gaaagctagggccactacagcagga

SEQ ID NO: 288058 - DNA, 25 bp, Rattus norvegicus
gaaagctagggcgactacagcagga

SEQ ID NO: 288059 - DNA, 25 bp, Rattus norvegicus
gaaagctagttgcactttgttttct

SEQ ID NO: 288060 - DNA, 25 bp, Rattus norvegicus
gaaagctagttggactttgttttct

SEQ ID NO: 288061 - DNA, 25 bp, Rattus norvegicus
gaaagctatataagccatggtcgaa

SEQ ID NO: 288062 - DNA, 25 bp, Rattus norvegicus
gaaagctatatatgccatggtcgaa

SEQ ID NO: 288063 - DNA, 25 bp, Rattus norvegicus
gaaagctatcaacggccacaccaaa

SEQ ID NO: 288064 - DNA, 25 bp, Rattus norvegicus
gaaagctatcaagggccacaccaaa

SEQ ID NO: 288065 - DNA, 25 bp, Rattus norvegicus
gaaagctatcagcagacctcacctt

SEQ ID NO: 288066 - DNA, 25 bp, Rattus norvegicus
gaaagctatcaggagacctcacctt

SEQ ID NO: 288067 - DNA, 25 bp, Rattus norvegicus
gaaagctatgtgaccccaacttcat

SEQ ID NO: 288068 - DNA, 25 bp, Rattus norvegicus
gaaagctatgtgtccccaacttcat

SEQ ID NO: 288069 - DNA, 25 bp, Rattus norvegicus
gaaagctattatatctgaaaatgac

SEQ ID NO: 288070 - DNA, 25 bp, Rattus norvegicus
gaaagctattatttctgaaaatgac

SEQ ID NO: 288071 - DNA, 25 bp, Rattus norvegicus
gaaagctattggctccagattgtga

SEQ ID NO: 288072 - DNA, 25 bp, Rattus norvegicus
gaaagctattgggtccagattgtga

SEQ ID NO: 288073 - DNA, 25 bp, Rattus norvegicus
gaaagctatttcagagttgccctaa

SEQ ID NO: 288074 - DNA, 25 bp, Rattus norvegicus
gaaagctatttctgagttgccctaa

SEQ ID NO: 288075 - DNA, 25 bp, Rattus norvegicus
gaaagctcacagagtttcaggttgt

SEQ ID NO: 288076 - DNA, 25 bp, Rattus norvegicus
gaaagctcacagtgtttcaggttgt

SEQ ID NO: 288077 - DNA, 25 bp, Rattus norvegicus
gaaagctcactcagtaccaatcgaa

SEQ ID NO: 288078 - DNA, 25 bp, Rattus norvegicus
gaaagctcactcatcctaacttaaa

SEQ ID NO: 288079 - DNA, 25 bp, Rattus norvegicus
gaaagctcactctgtaccaatcgaa

SEQ ID NO: 288080 - DNA, 25 bp, Rattus norvegicus
gaaagctcactcttcctaacttaaa

SEQ ID NO: 288081 - DNA, 25 bp, Rattus norvegicus
gaaagctcacttctgtttgtttgat

SEQ ID NO: 288082 - DNA, 25 bp, Rattus norvegicus
gaaagctcacttgtgtttgtttgat

SEQ ID NO: 288083 - DNA, 25 bp, Rattus norvegicus
gaaagctcagagatttcttcctcct

SEQ ID NO: 288084 - DNA, 25 bp, Rattus norvegicus
gaaagctcagagttttcttcctcct

SEQ ID NO: 288085 - DNA, 25 bp, Rattus norvegicus
gaaagctcagcccaaagaagtcatg

SEQ ID NO: 288086 - DNA, 25 bp, Rattus norvegicus
gaaagctcagccgaaagaagtcatg

SEQ ID NO: 288087 - DNA, 25 bp, Rattus norvegicus
gaaagctcagttaggagactcctcc

SEQ ID NO: 288088 - DNA, 25 bp, Rattus norvegicus
gaaagctcagtttggagactcctcc

SEQ ID NO: 288089 - DNA, 25 bp, Rattus norvegicus
gaaagctcatgcagctatccgagag

SEQ ID NO: 288090 - DNA, 25 bp, Rattus norvegicus
gaaagctcatgctgctatccgagag

SEQ ID NO: 288091 - DNA, 25 bp, Rattus norvegicus
gaaagctcatttctgtgagacccat

SEQ ID NO: 288092 - DNA, 25 bp, Rattus norvegicus
gaaagctcatttgtgtgagacccat

SEQ ID NO: 288093 - DNA, 25 bp, Rattus norvegicus
gaaagctccaagactcaaattcctt

SEQ ID NO: 288094 - DNA, 25 bp, Rattus norvegicus
gaaagctccaagtctcaaattcctt

SEQ ID NO: 288095 - DNA, 25 bp, Rattus norvegicus
gaaagctccatgagttctttaaaca

SEQ ID NO: 288096 - DNA, 25 bp, Rattus norvegicus
gaaagctccatgtgttctttaaaca

SEQ ID NO: 288097 - DNA, 25 bp, Rattus norvegicus
gaaagctcccctaacgtggacgttg

SEQ ID NO: 288098 - DNA, 25 bp, Rattus norvegicus
gaaagctccccttacgtggacgttg

SEQ ID NO: 288099 - DNA, 25 bp, Rattus norvegicus
gaaagctccctgatttggaccagaa

SEQ ID NO: 288100 - DNA, 25 bp, Rattus norvegicus
gaaagctccctgttttggaccagaa

SEQ ID NO: 288101 - DNA, 25 bp, Rattus norvegicus
gaaagctccggaactgacagacgaa

SEQ ID NO: 288102 - DNA, 25 bp, Rattus norvegicus
gaaagctccggatctgacagacgaa

SEQ ID NO: 288103 - DNA, 25 bp, Rattus norvegicus
gaaagctccgtgcattttgaaaccc

SEQ ID NO: 288104 - DNA, 25 bp, Rattus norvegicus
gaaagctccgtggattttgaaaccc

SEQ ID NO: 288105 - DNA, 25 bp, Rattus norvegicus
gaaagctcgcaaatacttgtaatgt

SEQ ID NO: 288106 - DNA, 25 bp, Rattus norvegicus
gaaagctcgcaattacttgtaatgt

SEQ ID NO: 288107 - DNA, 25 bp, Rattus norvegicus
gaaagctcgtgaatcttcactgcaa

SEQ ID NO: 288108 - DNA, 25 bp, Rattus norvegicus
gaaagctcgtgattcttcactgcaa

SEQ ID NO: 288109 - DNA, 25 bp, Rattus norvegicus
gaaagctctaccatagttgtctcaa

SEQ ID NO: 288110 - DNA, 25 bp, Rattus norvegicus
gaaagctctaccttagttgtctcaa

SEQ ID NO: 288111 - DNA, 25 bp, Rattus norvegicus
gaaagctctaggaaacaccagtgtt

SEQ ID NO: 288112 - DNA, 25 bp, Rattus norvegicus
gaaagctctaggtaacaccagtgtt

SEQ ID NO: 288113 - DNA, 25 bp, Rattus norvegicus
gaaagctctcaacttgctgaagaca

SEQ ID NO: 288114 - DNA, 25 bp, Rattus norvegicus
gaaagctctcaagttgctgaagaca

SEQ ID NO: 288115 - DNA, 25 bp, Rattus norvegicus
gaaagctctctgaacttagtctctc

SEQ ID NO: 288116 - DNA, 25 bp, Rattus norvegicus
gaaagctctctgtacttagtctctc

SEQ ID NO: 288117 - DNA, 25 bp, Rattus norvegicus
gaaagctctgaaaattccttacatt

SEQ ID NO: 288118 - DNA, 25 bp, Rattus norvegicus
gaaagctctgaatattccttacatt

SEQ ID NO: 288119 - DNA, 25 bp, Rattus norvegicus
gaaagctctgagcaagactccctga

SEQ ID NO: 288120 - DNA, 25 bp, Rattus norvegicus
gaaagctctgaggaagactccctga

SEQ ID NO: 288121 - DNA, 25 bp, Rattus norvegicus
gaaagctctgtgatcaatccatgtg

SEQ ID NO: 288122 - DNA, 25 bp, Rattus norvegicus
gaaagctctgtgttcaatccatgtg

SEQ ID NO: 288123 - DNA, 25 bp, Rattus norvegicus
gaaagctctgttatggagacaatac

SEQ ID NO: 288124 - DNA, 25 bp, Rattus norvegicus
gaaagctctgttcctggtccaagta

SEQ ID NO: 288125 - DNA, 25 bp, Rattus norvegicus
gaaagctctgttgctggtccaagta

SEQ ID NO: 288126 - DNA, 25 bp, Rattus norvegicus
gaaagctctgttttggagacaatac

SEQ ID NO: 288127 - DNA, 25 bp, Rattus norvegicus
gaaagctcttttctcaaagctccac

SEQ ID NO: 288128 - DNA, 25 bp, Rattus norvegicus
gaaagctcttttgtcaaagctccac

SEQ ID NO: 288129 - DNA, 25 bp, Rattus norvegicus
gaaagctgaaaacgactctgggaag

SEQ ID NO: 288130 - DNA, 25 bp, Rattus norvegicus
gaaagctgaaaaggactctgggaag

SEQ ID NO: 288131 - DNA, 25 bp, Rattus norvegicus
gaaagctgaacaataccgataaggc

SEQ ID NO: 288132 - DNA, 25 bp, Rattus norvegicus
gaaagctgaacattaccgataaggc

SEQ ID NO: 288133 - DNA, 25 bp, Rattus norvegicus
gaaagctgaagtaaacgctcattgg

SEQ ID NO: 288134 - DNA, 25 bp, Rattus norvegicus
gaaagctgaagttaacgctcattgg

SEQ ID NO: 288135 - DNA, 25 bp, Rattus norvegicus
gaaagctgacttagaccgttagatg

SEQ ID NO: 288136 - DNA, 25 bp, Rattus norvegicus
gaaagctgactttgaccgttagatg

SEQ ID NO: 288137 - DNA, 25 bp, Rattus norvegicus
gaaagctgatctctaagcagacaat

SEQ ID NO: 288138 - DNA, 25 bp, Rattus norvegicus
gaaagctgatctgtaagcagacaat

SEQ ID NO: 288139 - DNA, 25 bp, Rattus norvegicus
gaaagctgatggagcgtctgttatg

SEQ ID NO: 288140 - DNA, 25 bp, Rattus norvegicus
gaaagctgatggtgcgtctgttatg

SEQ ID NO: 288141 - DNA, 25 bp, Rattus norvegicus
gaaagctgatttccttgaagcagtt

SEQ ID NO: 288142 - DNA, 25 bp, Rattus norvegicus
gaaagctgatttgcttgaagcagtt

SEQ ID NO: 288143 - DNA, 25 bp, Rattus norvegicus
gaaagctgcaggatactttgagaca

SEQ ID NO: 288144 - DNA, 25 bp, Rattus norvegicus
gaaagctgcaggttactttgagaca

SEQ ID NO: 288145 - DNA, 25 bp, Rattus norvegicus
gaaagctgcatgcatcaacttccac

SEQ ID NO: 288146 - DNA, 25 bp, Rattus norvegicus
gaaagctgcatggatcaacttccac

SEQ ID NO: 288147 - DNA, 25 bp, Rattus norvegicus
gaaagctgccagataccacaaatgt

SEQ ID NO: 288148 - DNA, 25 bp, Rattus norvegicus
gaaagctgccagttaccacaaatgt

SEQ ID NO: 288149 - DNA, 25 bp, Rattus norvegicus
gaaagctgccatacatgtctctggg

SEQ ID NO: 288150 - DNA, 25 bp, Rattus norvegicus
gaaagctgccattcatgtctctggg

SEQ ID NO: 288151 - DNA, 25 bp, Rattus norvegicus
gaaagctgcctgctactgtgctcca

SEQ ID NO: 288152 - DNA, 25 bp, Rattus norvegicus
gaaagctgcctggtactgtgctcca

SEQ ID NO: 288153 - DNA, 25 bp, Rattus norvegicus
gaaagctgcgagctagccgcgcaca

SEQ ID NO: 288154 - DNA, 25 bp, Rattus norvegicus
gaaagctgcgaggtagccgcgcaca

SEQ ID NO: 288155 - DNA, 25 bp, Rattus norvegicus
gaaagctgctacaccaatgactgcc

SEQ ID NO: 288156 - DNA, 25 bp, Rattus norvegicus
gaaagctgctactccaatgactgcc

SEQ ID NO: 288157 - DNA, 25 bp, Rattus norvegicus
gaaagctgctagactgtgccacatt

SEQ ID NO: 288158 - DNA, 25 bp, Rattus norvegicus
gaaagctgctagtctgtgccacatt

SEQ ID NO: 288159 - DNA, 25 bp, Rattus norvegicus
gaaagctgctgcattgaacaccagc

SEQ ID NO: 288160 - DNA, 25 bp, Rattus norvegicus
gaaagctgctgctttgaacaccagc

SEQ ID NO: 288161 - DNA, 25 bp, Rattus norvegicus
gaaagctgcttgcaaactgcactgt

SEQ ID NO: 288162 - DNA, 25 bp, Rattus norvegicus
gaaagctgcttggaaactgcactgt

SEQ ID NO: 288163 - DNA, 25 bp, Rattus norvegicus
gaaagctggaacacaccactggcca

SEQ ID NO: 288164 - DNA, 25 bp, Rattus norvegicus
gaaagctggaactcaccactggcca

SEQ ID NO: 288165 - DNA, 25 bp, Rattus norvegicus
gaaagctggagaaggccgatatcct

SEQ ID NO: 288166 - DNA, 25 bp, Rattus norvegicus
gaaagctggagatggccgatatcct

SEQ ID NO: 288167 - DNA, 25 bp, Rattus norvegicus
gaaagctggatcatctattcacctc

SEQ ID NO: 288168 - DNA, 25 bp, Rattus norvegicus
gaaagctggatcttctattcacctc

SEQ ID NO: 288169 - DNA, 25 bp, Rattus norvegicus
gaaagctgggctaccaaagcactgt

SEQ ID NO: 288170 - DNA, 25 bp, Rattus norvegicus
gaaagctgggcttccaaagcactgt

SEQ ID NO: 288171 - DNA, 25 bp, Rattus norvegicus
gaaagctggttgagcaaagccatta

SEQ ID NO: 288172 - DNA, 25 bp, Rattus norvegicus
gaaagctggttgagtaaccccgtca

SEQ ID NO: 288173 - DNA, 25 bp, Rattus norvegicus
gaaagctggttgtgcaaagccatta

SEQ ID NO: 288174 - DNA, 25 bp, Rattus norvegicus
gaaagctggttgtgtaaccccgtca

SEQ ID NO: 288175 - DNA, 25 bp, Rattus norvegicus
gaaagctgtatgcacccgagcgtat

SEQ ID NO: 288176 - DNA, 25 bp, Rattus norvegicus
gaaagctgtatggacccgagcgtat

SEQ ID NO: 288177 - DNA, 25 bp, Rattus norvegicus
gaaagctgtcatcacacctgatttt

SEQ ID NO: 288178 - DNA, 25 bp, Rattus norvegicus
gaaagctgtcatgacacctgatttt

SEQ ID NO: 288179 - DNA, 25 bp, Rattus norvegicus
gaaagctgtccaacacttgcaaaca

SEQ ID NO: 288180 - DNA, 25 bp, Rattus norvegicus
gaaagctgtccatcacttgcaaaca

SEQ ID NO: 288181 - DNA, 25 bp, Rattus norvegicus
gaaagctgtctacctaccagcctaa

SEQ ID NO: 288182 - DNA, 25 bp, Rattus norvegicus
gaaagctgtctagctaccagcctaa

SEQ ID NO: 288183 - DNA, 25 bp, Rattus norvegicus
gaaagctgtggtacttaaagggtca

SEQ ID NO: 288184 - DNA, 25 bp, Rattus norvegicus
gaaagctgtggttcttaaagggtca

SEQ ID NO: 288185 - DNA, 25 bp, Rattus norvegicus
gaaagctgtgttccgatgactccta

SEQ ID NO: 288186 - DNA, 25 bp, Rattus norvegicus
gaaagctgtgttgcgatgactccta

SEQ ID NO: 288187 - DNA, 25 bp, Rattus norvegicus
gaaagctgttctccttcaccaagta

SEQ ID NO: 288188 - DNA, 25 bp, Rattus norvegicus
gaaagctgttctgcttcaccaagta

SEQ ID NO: 288189 - DNA, 25 bp, Rattus norvegicus
gaaagctgtttcatggacaacccat

SEQ ID NO: 288190 - DNA, 25 bp, Rattus norvegicus
gaaagctgtttcttggacaacccat

SEQ ID NO: 288191 - DNA, 25 bp, Rattus norvegicus
gaaagctgttttcatcgctcttaca

SEQ ID NO: 288192 - DNA, 25 bp, Rattus norvegicus
gaaagctgttttgatcgctcttaca

SEQ ID NO: 288193 - DNA, 25 bp, Rattus norvegicus
gaaagcttacatcgctcaagtcact

SEQ ID NO: 288194 - DNA, 25 bp, Rattus norvegicus
gaaagcttacatggctcaagtcact

SEQ ID NO: 288195 - DNA, 25 bp, Rattus norvegicus
gaaagcttactcaattgcttatgta

SEQ ID NO: 288196 - DNA, 25 bp, Rattus norvegicus
gaaagcttactctattgcttatgta

SEQ ID NO: 288197 - DNA, 25 bp, Rattus norvegicus
gaaagcttagtcctcagtcaacagg

SEQ ID NO: 288198 - DNA, 25 bp, Rattus norvegicus
gaaagcttagtcgtcagtcaacagg

SEQ ID NO: 288199 - DNA, 25 bp, Rattus norvegicus
gaaagcttcaaaccatcttcccacg

SEQ ID NO: 288200 - DNA, 25 bp, Rattus norvegicus
gaaagcttcaaagcatcttcccacg

SEQ ID NO: 288201 - DNA, 25 bp, Rattus norvegicus
gaaagcttcaagctcctttccctca

SEQ ID NO: 288202 - DNA, 25 bp, Rattus norvegicus
gaaagcttcaaggtcctttccctca

SEQ ID NO: 288203 - DNA, 25 bp, Rattus norvegicus
gaaagcttcactaactgcacggaga

SEQ ID NO: 288204 - DNA, 25 bp, Rattus norvegicus
gaaagcttcacttactgcacggaga

SEQ ID NO: 288205 - DNA, 25 bp, Rattus norvegicus
gaaagcttcaggaactagccacatt

SEQ ID NO: 288206 - DNA, 25 bp, Rattus norvegicus
gaaagcttcaggtactagccacatt

SEQ ID NO: 288207 - DNA, 25 bp, Rattus norvegicus
gaaagcttccgtatgctacatgctg

SEQ ID NO: 288208 - DNA, 25 bp, Rattus norvegicus
gaaagcttccgtcttctgatgagag

SEQ ID NO: 288209 - DNA, 25 bp, Rattus norvegicus
gaaagcttccgtgttctgatgagag

SEQ ID NO: 288210 - DNA, 25 bp, Rattus norvegicus
gaaagcttccgtttgctacatgctg

SEQ ID NO: 288211 - DNA, 25 bp, Rattus norvegicus
gaaagcttccttactctgtcccgcg

SEQ ID NO: 288212 - DNA, 25 bp, Rattus norvegicus
gaaagcttcctttctctgtcccgcg

SEQ ID NO: 288213 - DNA, 25 bp, Rattus norvegicus
gaaagcttcgaaatggtactcctga

SEQ ID NO: 288214 - DNA, 25 bp, Rattus norvegicus
gaaagcttcgaactgctgcctttaa

SEQ ID NO: 288215 - DNA, 25 bp, Rattus norvegicus
gaaagcttcgaagtgctgcctttaa

SEQ ID NO: 288216 - DNA, 25 bp, Rattus norvegicus
gaaagcttcgaattggtactcctga

SEQ ID NO: 288217 - DNA, 25 bp, Rattus norvegicus
gaaagcttctcgctacactaggtga

SEQ ID NO: 288218 - DNA, 25 bp, Rattus norvegicus
gaaagcttctcggtacactaggtga

SEQ ID NO: 288219 - DNA, 25 bp, Rattus norvegicus
gaaagcttctgaacaaggtcctgaa

SEQ ID NO: 288220 - DNA, 25 bp, Rattus norvegicus
gaaagcttctgatcaaggtcctgaa

SEQ ID NO: 288221 - DNA, 25 bp, Rattus norvegicus
gaaagcttgagacaagtcccgcccc

SEQ ID NO: 288222 - DNA, 25 bp, Rattus norvegicus
gaaagcttgagagaagtcccgcccc

SEQ ID NO: 288223 - DNA, 25 bp, Rattus norvegicus
gaaagcttgctaacaaaaaccgata

SEQ ID NO: 288224 - DNA, 25 bp, Rattus norvegicus
gaaagcttgctatcaaaaaccgata

SEQ ID NO: 288225 - DNA, 25 bp, Rattus norvegicus
gaaagcttgctgagcgtcattattc

SEQ ID NO: 288226 - DNA, 25 bp, Rattus norvegicus
gaaagcttgctgtgcgtcattattc

SEQ ID NO: 288227 - DNA, 25 bp, Rattus norvegicus
gaaagcttgcttcataagttgaata

SEQ ID NO: 288228 - DNA, 25 bp, Rattus norvegicus
gaaagcttgcttgataagttgaata

SEQ ID NO: 288229 - DNA, 25 bp, Rattus norvegicus
gaaagcttggccagtccagtaaaac

SEQ ID NO: 288230 - DNA, 25 bp, Rattus norvegicus
gaaagcttggcctgtccagtaaaac

SEQ ID NO: 288231 - DNA, 25 bp, Rattus norvegicus
gaaagcttggtgaccaggctacatc

SEQ ID NO: 288232 - DNA, 25 bp, Rattus norvegicus
gaaagcttggtgtccaggctacatc

SEQ ID NO: 288233 - DNA, 25 bp, Rattus norvegicus
gaaagctttatgaaaatgtgcgatt

SEQ ID NO: 288234 - DNA, 25 bp, Rattus norvegicus
gaaagctttatgacttctgagggtt

SEQ ID NO: 288235 - DNA, 25 bp, Rattus norvegicus
gaaagctttatgtaaatgtgcgatt

SEQ ID NO: 288236 - DNA, 25 bp, Rattus norvegicus
gaaagctttatgtcttctgagggtt

SEQ ID NO: 288237 - DNA, 25 bp, Rattus norvegicus
gaaagctttattctccaggctgtga

SEQ ID NO: 288238 - DNA, 25 bp, Rattus norvegicus
gaaagctttattgtccaggctgtga

SEQ ID NO: 288239 - DNA, 25 bp, Rattus norvegicus
gaaagctttcacacttctgcagaaa

SEQ ID NO: 288240 - DNA, 25 bp, Rattus norvegicus
gaaagctttcactcttctgcagaaa

SEQ ID NO: 288241 - DNA, 25 bp, Rattus norvegicus
gaaagctttcagcatcggaacccca

SEQ ID NO: 288242 - DNA, 25 bp, Rattus norvegicus
gaaagctttcaggatcggaacccca

SEQ ID NO: 288243 - DNA, 25 bp, Rattus norvegicus
gaaagctttcccacatggtcactgc

SEQ ID NO: 288244 - DNA, 25 bp, Rattus norvegicus
gaaagctttccctcatggtcactgc

SEQ ID NO: 288245 - DNA, 25 bp, Rattus norvegicus
gaaagctttctacgataagtcaaat

SEQ ID NO: 288246 - DNA, 25 bp, Rattus norvegicus
gaaagctttctaggataagtcaaat

SEQ ID NO: 288247 - DNA, 25 bp, Rattus norvegicus
gaaagctttgacagaacctactggt

SEQ ID NO: 288248 - DNA, 25 bp, Rattus norvegicus
gaaagctttgactgaacctactggt

SEQ ID NO: 288249 - DNA, 25 bp, Rattus norvegicus
gaaagctttgagacccttagcgggt

SEQ ID NO: 288250 - DNA, 25 bp, Rattus norvegicus
gaaagctttgagtcccttagcgggt

SEQ ID NO: 288251 - DNA, 25 bp, Rattus norvegicus
gaaagctttgccaaatgcggccctg

SEQ ID NO: 288252 - DNA, 25 bp, Rattus norvegicus
gaaagctttgcctaatgcggccctg

SEQ ID NO: 288253 - DNA, 25 bp, Rattus norvegicus
gaaagctttgcgagattcttccata

SEQ ID NO: 288254 - DNA, 25 bp, Rattus norvegicus
gaaagctttgcgtgattcttccata

SEQ ID NO: 288255 - DNA, 25 bp, Rattus norvegicus
gaaagctttggcaccatgctggaac

SEQ ID NO: 288256 - DNA, 25 bp, Rattus norvegicus
gaaagctttggctccatgctggaac

SEQ ID NO: 288257 - DNA, 25 bp, Rattus norvegicus
gaaagctttggtagcgatcacctgc

SEQ ID NO: 288258 - DNA, 25 bp, Rattus norvegicus
gaaagctttggtcttcttcctaagg

SEQ ID NO: 288259 - DNA, 25 bp, Rattus norvegicus
gaaagctttggtgttcttcctaagg

SEQ ID NO: 288260 - DNA, 25 bp, Rattus norvegicus
gaaagctttggttgcgatcacctgc

SEQ ID NO: 288261 - DNA, 25 bp, Rattus norvegicus
gaaagctttgtaatattttcaaggg

SEQ ID NO: 288262 - DNA, 25 bp, Rattus norvegicus
gaaagctttgtacagagcactccag

SEQ ID NO: 288263 - DNA, 25 bp, Rattus norvegicus
gaaagctttgtagagagcactccag

SEQ ID NO: 288264 - DNA, 25 bp, Rattus norvegicus
gaaagctttgtattattttcaaggg

SEQ ID NO: 288265 - DNA, 25 bp, Rattus norvegicus
gaaagcttttcaacagtctagaagg

SEQ ID NO: 288266 - DNA, 25 bp, Rattus norvegicus
gaaagcttttcatcagtctagaagg

SEQ ID NO: 288267 - DNA, 25 bp, Rattus norvegicus
gaaagcttttctagcctcttaaatg

SEQ ID NO: 288268 - DNA, 25 bp, Rattus norvegicus
gaaagcttttcttgcctcttaaatg

SEQ ID NO: 288269 - DNA, 25 bp, Rattus norvegicus
gaaagctttttcagatggacattgt

SEQ ID NO: 288270 - DNA, 25 bp, Rattus norvegicus
gaaagctttttctgatggacattgt

SEQ ID NO: 288271 - DNA, 25 bp, Rattus norvegicus
gaaaggaaacctcattgccaccatg

SEQ ID NO: 288272 - DNA, 25 bp, Rattus norvegicus
gaaaggaaacctgattgccaccatg

SEQ ID NO: 288273 - DNA, 25 bp, Rattus norvegicus
gaaaggaacatcaacctcttttgga

SEQ ID NO: 288274 - DNA, 25 bp, Rattus norvegicus
gaaaggaacatctacctcttttgga

SEQ ID NO: 288275 - DNA, 25 bp, Rattus norvegicus
gaaaggaaccaactgctattctctt

SEQ ID NO: 288276 - DNA, 25 bp, Rattus norvegicus
gaaaggaaccaagtgctattctctt

SEQ ID NO: 288277 - DNA, 25 bp, Rattus norvegicus
gaaaggaaccggctgtctcatgtga

SEQ ID NO: 288278 - DNA, 25 bp, Rattus norvegicus
gaaaggaaccgggtgtctcatgtga

SEQ ID NO: 288279 - DNA, 25 bp, Rattus norvegicus
gaaaggaacgtcagggtgccatccc

SEQ ID NO: 288280 - DNA, 25 bp, Rattus norvegicus
gaaaggaacgtctgggtgccatccc

SEQ ID NO: 288281 - DNA, 25 bp, Rattus norvegicus
gaaaggaagaggctcctccagccat

SEQ ID NO: 288282 - DNA, 25 bp, Rattus norvegicus
gaaaggaagagggtcctccagccat

SEQ ID NO: 288283 - DNA, 25 bp, Rattus norvegicus
gaaaggaagatcactggtcccaggg

SEQ ID NO: 288284 - DNA, 25 bp, Rattus norvegicus
gaaaggaagatctctggtcccaggg

SEQ ID NO: 288285 - DNA, 25 bp, Rattus norvegicus
gaaaggaagccgagttcgcccagta

SEQ ID NO: 288286 - DNA, 25 bp, Rattus norvegicus
gaaaggaagccgtgttcgcccagta

SEQ ID NO: 288287 - DNA, 25 bp, Rattus norvegicus
gaaaggaagcttcaactgtttgttc

SEQ ID NO: 288288 - DNA, 25 bp, Rattus norvegicus
gaaaggaagcttgaactgtttgttc

SEQ ID NO: 288289 - DNA, 25 bp, Rattus norvegicus
gaaaggaaggcaccccaagctctcc

SEQ ID NO: 288290 - DNA, 25 bp, Rattus norvegicus
gaaaggaaggcagcccaagctctcc

SEQ ID NO: 288291 - DNA, 25 bp, Rattus norvegicus
gaaaggaagtctccagtccactccc

SEQ ID NO: 288292 - DNA, 25 bp, Rattus norvegicus
gaaaggaagtctgcagtccactccc

SEQ ID NO: 288293 - DNA, 25 bp, Rattus norvegicus
gaaaggaatgtaaattggaccaccg

SEQ ID NO: 288294 - DNA, 25 bp, Rattus norvegicus
gaaaggaatgtatattggaccaccg

SEQ ID NO: 288295 - DNA, 25 bp, Rattus norvegicus
gaaaggaattgtccctccttgtgct

SEQ ID NO: 288296 - DNA, 25 bp, Rattus norvegicus
gaaaggaattgtctgagtctcattt

SEQ ID NO: 288297 - DNA, 25 bp, Rattus norvegicus
gaaaggaattgtgcctccttgtgct

SEQ ID NO: 288298 - DNA, 25 bp, Rattus norvegicus
gaaaggaattgtgtgagtctcattt

SEQ ID NO: 288299 - DNA, 25 bp, Rattus norvegicus
gaaaggacaaccctgaaatcatgtg

SEQ ID NO: 288300 - DNA, 25 bp, Rattus norvegicus
gaaaggacaaccgtgaaatcatgtg

SEQ ID NO: 288301 - DNA, 25 bp, Rattus norvegicus
gaaaggacagtcaggacttcagcca

SEQ ID NO: 288302 - DNA, 25 bp, Rattus norvegicus
gaaaggacagtctggacttcagcca

SEQ ID NO: 288303 - DNA, 25 bp, Rattus norvegicus
gaaaggacatccacatctcatgctg

SEQ ID NO: 288304 - DNA, 25 bp, Rattus norvegicus
gaaaggacatcctcatctcatgctg

SEQ ID NO: 288305 - DNA, 25 bp, Rattus norvegicus
gaaaggacattcactgacctgttga

SEQ ID NO: 288306 - DNA, 25 bp, Rattus norvegicus
gaaaggacattctctgacctgttga

SEQ ID NO: 288307 - DNA, 25 bp, Rattus norvegicus
gaaaggacattgcagagttaacaca

SEQ ID NO: 288308 - DNA, 25 bp, Rattus norvegicus
gaaaggacattggagagttaacaca

SEQ ID NO: 288309 - DNA, 25 bp, Rattus norvegicus
gaaaggaccacccttgggtatgtct

SEQ ID NO: 288310 - DNA, 25 bp, Rattus norvegicus
gaaaggaccaccgttgggtatgtct

SEQ ID NO: 288311 - DNA, 25 bp, Rattus norvegicus
gaaaggaccagtaccttaactccat

SEQ ID NO: 288312 - DNA, 25 bp, Rattus norvegicus
gaaaggaccagttccttaactccat

SEQ ID NO: 288313 - DNA, 25 bp, Rattus norvegicus
gaaaggacccgaacacgtctgtaga

SEQ ID NO: 288314 - DNA, 25 bp, Rattus norvegicus
gaaaggacccgatcacgtctgtaga

SEQ ID NO: 288315 - DNA, 25 bp, Rattus norvegicus
gaaaggacccttagtctacacaggt

SEQ ID NO: 288316 - DNA, 25 bp, Rattus norvegicus
gaaaggaccctttgtctacacaggt

SEQ ID NO: 288317 - DNA, 25 bp, Rattus norvegicus
gaaaggaccgagcttgttcgtcgtt

SEQ ID NO: 288318 - DNA, 25 bp, Rattus norvegicus
gaaaggaccgaggttgttcgtcgtt

SEQ ID NO: 288319 - DNA, 25 bp, Rattus norvegicus
gaaaggaccgttcacttgcttgggc

SEQ ID NO: 288320 - DNA, 25 bp, Rattus norvegicus
gaaaggaccgttgacttgcttgggc

SEQ ID NO: 288321 - DNA, 25 bp, Rattus norvegicus
gaaaggacctgaagatgcccctgct

SEQ ID NO: 288322 - DNA, 25 bp, Rattus norvegicus
gaaaggacctgaagtcacacttgat

SEQ ID NO: 288323 - DNA, 25 bp, Rattus norvegicus
gaaaggacctgatgatgcccctgct

SEQ ID NO: 288324 - DNA, 25 bp, Rattus norvegicus
gaaaggacctgatgtcacacttgat

SEQ ID NO: 288325 - DNA, 25 bp, Rattus norvegicus
gaaaggacggctactcccaaaacag

SEQ ID NO: 288326 - DNA, 25 bp, Rattus norvegicus
gaaaggacggcttctcccaaaacag

SEQ ID NO: 288327 - DNA, 25 bp, Rattus norvegicus
gaaaggacgtgcctcggctagacta

SEQ ID NO: 288328 - DNA, 25 bp, Rattus norvegicus
gaaaggacgtgcgtcggctagacta

SEQ ID NO: 288329 - DNA, 25 bp, Rattus norvegicus
gaaaggacgttcatgtccctgattc

SEQ ID NO: 288330 - DNA, 25 bp, Rattus norvegicus
gaaaggacgttcttgtccctgattc

SEQ ID NO: 288331 - DNA, 25 bp, Rattus norvegicus
gaaaggactctgcagtttttactct

SEQ ID NO: 288332 - DNA, 25 bp, Rattus norvegicus
gaaaggactctggagtttttactct

SEQ ID NO: 288333 - DNA, 25 bp, Rattus norvegicus
gaaaggactcttcccagtatgactc

SEQ ID NO: 288334 - DNA, 25 bp, Rattus norvegicus
gaaaggactcttctgaccctgggaa

SEQ ID NO: 288335 - DNA, 25 bp, Rattus norvegicus
gaaaggactcttgccagtatgactc

SEQ ID NO: 288336 - DNA, 25 bp, Rattus norvegicus
gaaaggactcttgtgaccctgggaa

SEQ ID NO: 288337 - DNA, 25 bp, Rattus norvegicus
gaaaggactgaaccccaagcccagc

SEQ ID NO: 288338 - DNA, 25 bp, Rattus norvegicus
gaaaggactgaagcccaagcccagc

SEQ ID NO: 288339 - DNA, 25 bp, Rattus norvegicus
gaaaggactgagaagcgcagttcct

SEQ ID NO: 288340 - DNA, 25 bp, Rattus norvegicus
gaaaggactgagtagcgcagttcct

SEQ ID NO: 288341 - DNA, 25 bp, Rattus norvegicus
gaaaggactgtgcaccacttggtgt

SEQ ID NO: 288342 - DNA, 25 bp, Rattus norvegicus
gaaaggactgtggaccacttggtgt

SEQ ID NO: 288343 - DNA, 25 bp, Rattus norvegicus
gaaaggacttagcattgacagaact

SEQ ID NO: 288344 - DNA, 25 bp, Rattus norvegicus
gaaaggacttaggattgacagaact

SEQ ID NO: 288345 - DNA, 25 bp, Rattus norvegicus
gaaaggacttctatcaccctgggta

SEQ ID NO: 288346 - DNA, 25 bp, Rattus norvegicus
gaaaggacttctttcaccctgggta

SEQ ID NO: 288347 - DNA, 25 bp, Rattus norvegicus
gaaaggagagcccattctgtcccta

SEQ ID NO: 288348 - DNA, 25 bp, Rattus norvegicus
gaaaggagagccgattctgtcccta

SEQ ID NO: 288349 - DNA, 25 bp, Rattus norvegicus
gaaaggagctcccaggcaagcccag

SEQ ID NO: 288350 - DNA, 25 bp, Rattus norvegicus
gaaaggagctccgaggcaagcccag

SEQ ID NO: 288351 - DNA, 25 bp, Rattus norvegicus
gaaaggagctctctcccacataata

SEQ ID NO: 288352 - DNA, 25 bp, Rattus norvegicus
gaaaggagctctgtcccacataata

SEQ ID NO: 288353 - DNA, 25 bp, Rattus norvegicus
gaaaggaggacccatgcacaccatc

SEQ ID NO: 288354 - DNA, 25 bp, Rattus norvegicus
gaaaggaggaccgatgcacaccatc

SEQ ID NO: 288355 - DNA, 25 bp, Rattus norvegicus
gaaaggagtggaaccgcgtccgcac

SEQ ID NO: 288356 - DNA, 25 bp, Rattus norvegicus
gaaaggagtggatccgcgtccgcac

SEQ ID NO: 288357 - DNA, 25 bp, Rattus norvegicus
gaaaggagttgcatcccgcctcgat

SEQ ID NO: 288358 - DNA, 25 bp, Rattus norvegicus
gaaaggagttgcttcccgcctcgat

SEQ ID NO: 288359 - DNA, 25 bp, Rattus norvegicus
gaaaggatacccctgtacagtgagc

SEQ ID NO: 288360 - DNA, 25 bp, Rattus norvegicus
gaaaggatacccgtgtacagtgagc

SEQ ID NO: 288361 - DNA, 25 bp, Rattus norvegicus
gaaaggatcagtagcctcttattta

SEQ ID NO: 288362 - DNA, 25 bp, Rattus norvegicus
gaaaggatcagttgcctcttattta

SEQ ID NO: 288363 - DNA, 25 bp, Rattus norvegicus
gaaaggatccacacaagtcctacca

SEQ ID NO: 288364 - DNA, 25 bp, Rattus norvegicus
gaaaggatccactcaagtcctacca

SEQ ID NO: 288365 - DNA, 25 bp, Rattus norvegicus
gaaaggatcggtacactgcagggct

SEQ ID NO: 288366 - DNA, 25 bp, Rattus norvegicus
gaaaggatcggttcactgcagggct

SEQ ID NO: 288367 - DNA, 25 bp, Rattus norvegicus
gaaaggatcgtcatgtcgggatgat

SEQ ID NO: 288368 - DNA, 25 bp, Rattus norvegicus
gaaaggatcgtcttgtcgggatgat

SEQ ID NO: 288369 - DNA, 25 bp, Rattus norvegicus
gaaaggatgagccacaactacactg

SEQ ID NO: 288370 - DNA, 25 bp, Rattus norvegicus
gaaaggatgagcgacaactacactg

SEQ ID NO: 288371 - DNA, 25 bp, Rattus norvegicus
gaaaggatgcagcttgtcccttgtc

SEQ ID NO: 288372 - DNA, 25 bp, Rattus norvegicus
gaaaggatgcaggttgtcccttgtc

SEQ ID NO: 288373 - DNA, 25 bp, Rattus norvegicus
gaaaggatgcggcttcagtgctctc

SEQ ID NO: 288374 - DNA, 25 bp, Rattus norvegicus
gaaaggatgcgggttcagtgctctc

SEQ ID NO: 288375 - DNA, 25 bp, Rattus norvegicus
gaaaggatgcttagacgtcccctga

SEQ ID NO: 288376 - DNA, 25 bp, Rattus norvegicus
gaaaggatgctttgacgtcccctga

SEQ ID NO: 288377 - DNA, 25 bp, Rattus norvegicus
gaaaggatggtcacgctggtgcctc

SEQ ID NO: 288378 - DNA, 25 bp, Rattus norvegicus
gaaaggatggtctcgctggtgcctc

SEQ ID NO: 288379 - DNA, 25 bp, Rattus norvegicus
gaaaggatggtgaccctcgcatgct

SEQ ID NO: 288380 - DNA, 25 bp, Rattus norvegicus
gaaaggatggtgtccctcgcatgct

SEQ ID NO: 288381 - DNA, 25 bp, Rattus norvegicus
gaaaggatgtggatcttttcattta

SEQ ID NO: 288382 - DNA, 25 bp, Rattus norvegicus
gaaaggatgtggttcttttcattta

SEQ ID NO: 288383 - DNA, 25 bp, Rattus norvegicus
gaaaggattgaaatgtccccattcc

SEQ ID NO: 288384 - DNA, 25 bp, Rattus norvegicus
gaaaggattgaattgtccccattcc

SEQ ID NO: 288385 - DNA, 25 bp, Rattus norvegicus
gaaaggattgcaccctcccagagga

SEQ ID NO: 288386 - DNA, 25 bp, Rattus norvegicus
gaaaggattgcagcctcccagagga

SEQ ID NO: 288387 - DNA, 25 bp, Rattus norvegicus
gaaaggatttcccacattcctcctt

SEQ ID NO: 288388 - DNA, 25 bp, Rattus norvegicus
gaaaggatttccgacattcctcctt

SEQ ID NO: 288389 - DNA, 25 bp, Rattus norvegicus
gaaaggatttctaccagctcgtgtg

SEQ ID NO: 288390 - DNA, 25 bp, Rattus norvegicus
gaaaggatttcttccagctcgtgtg

SEQ ID NO: 288391 - DNA, 25 bp, Rattus norvegicus
gaaaggatttggagctcttgagaat

SEQ ID NO: 288392 - DNA, 25 bp, Rattus norvegicus
gaaaggatttggtgctcttgagaat

SEQ ID NO: 288393 - DNA, 25 bp, Rattus norvegicus
gaaaggcaacatagtatactgacat

SEQ ID NO: 288394 - DNA, 25 bp, Rattus norvegicus
gaaaggcaacattgtatactgacat

SEQ ID NO: 288395 - DNA, 25 bp, Rattus norvegicus
gaaaggcaactgcaccaagagatgt

SEQ ID NO: 288396 - DNA, 25 bp, Rattus norvegicus
gaaaggcaactggaccaagagatgt

SEQ ID NO: 288397 - DNA, 25 bp, Rattus norvegicus
gaaaggcaagatcaggtcgcgacat

SEQ ID NO: 288398 - DNA, 25 bp, Rattus norvegicus
gaaaggcaagatgaggtcgcgacat

SEQ ID NO: 288399 - DNA, 25 bp, Rattus norvegicus
gaaaggcaaggaatgactctcacag

SEQ ID NO: 288400 - DNA, 25 bp, Rattus norvegicus
gaaaggcaaggattgactctcacag

SEQ ID NO: 288401 - DNA, 25 bp, Rattus norvegicus
gaaaggcaaggtacctctgggccat

SEQ ID NO: 288402 - DNA, 25 bp, Rattus norvegicus
gaaaggcaaggttcctctgggccat

SEQ ID NO: 288403 - DNA, 25 bp, Rattus norvegicus
gaaaggcaatatcccactctggtct

SEQ ID NO: 288404 - DNA, 25 bp, Rattus norvegicus
gaaaggcaatatgccactctggtct

SEQ ID NO: 288405 - DNA, 25 bp, Rattus norvegicus
gaaaggcacagcagagaacgtctct

SEQ ID NO: 288406 - DNA, 25 bp, Rattus norvegicus
gaaaggcacagctgagaacgtctct

SEQ ID NO: 288407 - DNA, 25 bp, Rattus norvegicus
gaaaggcaccacaataagtacctgt

SEQ ID NO: 288408 - DNA, 25 bp, Rattus norvegicus
gaaaggcaccactataagtacctgt

SEQ ID NO: 288409 - DNA, 25 bp, Rattus norvegicus
gaaaggcaccatctttcctctgtaa

SEQ ID NO: 288410 - DNA, 25 bp, Rattus norvegicus
gaaaggcaccatgtttcctctgtaa

SEQ ID NO: 288411 - DNA, 25 bp, Rattus norvegicus
gaaaggcactgcattatctgcccta

SEQ ID NO: 288412 - DNA, 25 bp, Rattus norvegicus
gaaaggcactgctttatctgcccta

SEQ ID NO: 288413 - DNA, 25 bp, Rattus norvegicus
gaaaggcacttgctgggactcactt

SEQ ID NO: 288414 - DNA, 25 bp, Rattus norvegicus
gaaaggcacttggtgggactcactt

SEQ ID NO: 288415 - DNA, 25 bp, Rattus norvegicus
gaaaggcagagcacatcttccctat

SEQ ID NO: 288416 - DNA, 25 bp, Rattus norvegicus
gaaaggcagagctcatcttccctat

SEQ ID NO: 288417 - DNA, 25 bp, Rattus norvegicus
gaaaggcagattaggcttcctccca

SEQ ID NO: 288418 - DNA, 25 bp, Rattus norvegicus
gaaaggcagatttggcttcctccca

SEQ ID NO: 288419 - DNA, 25 bp, Rattus norvegicus
gaaaggcagcctattcacgtcacct

SEQ ID NO: 288420 - DNA, 25 bp, Rattus norvegicus
gaaaggcagccttttcacgtcacct

SEQ ID NO: 288421 - DNA, 25 bp, Rattus norvegicus
gaaaggcagcggcttcgacgtcaat

SEQ ID NO: 288422 - DNA, 25 bp, Rattus norvegicus
gaaaggcagcgggttcgacgtcaat

SEQ ID NO: 288423 - DNA, 25 bp, Rattus norvegicus
gaaaggcaggagatgctgtgacaat

SEQ ID NO: 288424 - DNA, 25 bp, Rattus norvegicus
gaaaggcaggagttgctgtgacaat

SEQ ID NO: 288425 - DNA, 25 bp, Rattus norvegicus
gaaaggcatcagctgctctgtgacc

SEQ ID NO: 288426 - DNA, 25 bp, Rattus norvegicus
gaaaggcatcaggtgctctgtgacc

SEQ ID NO: 288427 - DNA, 25 bp, Rattus norvegicus
gaaaggcatcatctcgggctctgtc

SEQ ID NO: 288428 - DNA, 25 bp, Rattus norvegicus
gaaaggcatcatgtcgggctctgtc

SEQ ID NO: 288429 - DNA, 25 bp, Rattus norvegicus
gaaaggcatgttcagacccattttg

SEQ ID NO: 288430 - DNA, 25 bp, Rattus norvegicus
gaaaggcatgttgagacccattttg

SEQ ID NO: 288431 - DNA, 25 bp, Rattus norvegicus
gaaaggccaacgatcctactccagg

SEQ ID NO: 288432 - DNA, 25 bp, Rattus norvegicus
gaaaggccaacgttcctactccagg

SEQ ID NO: 288433 - DNA, 25 bp, Rattus norvegicus
gaaaggccaagtactgtctctgtag

SEQ ID NO: 288434 - DNA, 25 bp, Rattus norvegicus
gaaaggccaagttctgtctctgtag

SEQ ID NO: 288435 - DNA, 25 bp, Rattus norvegicus
gaaaggccacacactgtacgtttgt

SEQ ID NO: 288436 - DNA, 25 bp, Rattus norvegicus
gaaaggccacactctgtacgtttgt

SEQ ID NO: 288437 - DNA, 25 bp, Rattus norvegicus
gaaaggccacagcttaatgtcacaa

SEQ ID NO: 288438 - DNA, 25 bp, Rattus norvegicus
gaaaggccacaggttaatgtcacaa

SEQ ID NO: 288439 - DNA, 25 bp, Rattus norvegicus
gaaaggccacttagcatcatttaat

SEQ ID NO: 288440 - DNA, 25 bp, Rattus norvegicus
gaaaggccactttgcatcatttaat

SEQ ID NO: 288441 - DNA, 25 bp, Rattus norvegicus
gaaaggccatctagacccagtggga

SEQ ID NO: 288442 - DNA, 25 bp, Rattus norvegicus
gaaaggccatcttgacccagtggga

SEQ ID NO: 288443 - DNA, 25 bp, Rattus norvegicus
gaaaggccatttccttggaactgct

SEQ ID NO: 288444 - DNA, 25 bp, Rattus norvegicus
gaaaggccatttgcttggaactgct

SEQ ID NO: 288445 - DNA, 25 bp, Rattus norvegicus
gaaaggcccagactgcctgttatgt

SEQ ID NO: 288446 - DNA, 25 bp, Rattus norvegicus
gaaaggcccagagtgcctgttatgt

SEQ ID NO: 288447 - DNA, 25 bp, Rattus norvegicus
gaaaggcccagtaagcagttattaa

SEQ ID NO: 288448 - DNA, 25 bp, Rattus norvegicus
gaaaggcccagttagcagttattaa

SEQ ID NO: 288449 - DNA, 25 bp, Rattus norvegicus
gaaaggcccattctgtttataactt

SEQ ID NO: 288450 - DNA, 25 bp, Rattus norvegicus
gaaaggcccattgtgtttataactt

SEQ ID NO: 288451 - DNA, 25 bp, Rattus norvegicus
gaaaggccccatattgtacatagtt

SEQ ID NO: 288452 - DNA, 25 bp, Rattus norvegicus
gaaaggccccattttgtacatagtt

SEQ ID NO: 288453 - DNA, 25 bp, Rattus norvegicus
gaaaggccccgcaacggtagaagat

SEQ ID NO: 288454 - DNA, 25 bp, Rattus norvegicus
gaaaggccccgctacggtagaagat

SEQ ID NO: 288455 - DNA, 25 bp, Rattus norvegicus
gaaaggccccgtccagctgatccaa

SEQ ID NO: 288456 - DNA, 25 bp, Rattus norvegicus
gaaaggccccgtgcagctgatccaa

SEQ ID NO: 288457 - DNA, 25 bp, Rattus norvegicus
gaaaggccctttcttcttaagccag

SEQ ID NO: 288458 - DNA, 25 bp, Rattus norvegicus
gaaaggccctttgttcttaagccag

SEQ ID NO: 288459 - DNA, 25 bp, Rattus norvegicus
gaaaggccgcttagggatgtctccc

SEQ ID NO: 288460 - DNA, 25 bp, Rattus norvegicus
gaaaggccgctttgggatgtctccc

SEQ ID NO: 288461 - DNA, 25 bp, Rattus norvegicus
gaaaggcctcaactgcttagcttct

SEQ ID NO: 288462 - DNA, 25 bp, Rattus norvegicus
gaaaggcctcaagtgcttagcttct

SEQ ID NO: 288463 - DNA, 25 bp, Rattus norvegicus
gaaaggcctccactttgtctgcaac

SEQ ID NO: 288464 - DNA, 25 bp, Rattus norvegicus
gaaaggcctccagtttgtctgcaac

SEQ ID NO: 288465 - DNA, 25 bp, Rattus norvegicus
gaaaggcctcttagtcgaatttggg

SEQ ID NO: 288466 - DNA, 25 bp, Rattus norvegicus
gaaaggcctctttgtcgaatttggg

SEQ ID NO: 288467 - DNA, 25 bp, Rattus norvegicus
gaaaggcctgtgaccattcgggaca

SEQ ID NO: 288468 - DNA, 25 bp, Rattus norvegicus
gaaaggcctgtgtccattcgggaca

SEQ ID NO: 288469 - DNA, 25 bp, Rattus norvegicus
gaaaggcctttacccaatgttcaag

SEQ ID NO: 288470 - DNA, 25 bp, Rattus norvegicus
gaaaggcctttagccaatgttcaag

SEQ ID NO: 288471 - DNA, 25 bp, Rattus norvegicus
gaaaggcctttgatcctttggcaat

SEQ ID NO: 288472 - DNA, 25 bp, Rattus norvegicus
gaaaggcctttgttcctttggcaat

SEQ ID NO: 288473 - DNA, 25 bp, Rattus norvegicus
gaaaggccttttctcgaatcacgtc

SEQ ID NO: 288474 - DNA, 25 bp, Rattus norvegicus
gaaaggccttttgtcgaatcacgtc

SEQ ID NO: 288475 - DNA, 25 bp, Rattus norvegicus
gaaaggcgagttccagattctcctt

SEQ ID NO: 288476 - DNA, 25 bp, Rattus norvegicus
gaaaggcgagttgcagattctcctt

SEQ ID NO: 288477 - DNA, 25 bp, Rattus norvegicus
gaaaggcgcatcaagtttctcctgc

SEQ ID NO: 288478 - DNA, 25 bp, Rattus norvegicus
gaaaggcgcatctagtttctcctgc

SEQ ID NO: 288479 - DNA, 25 bp, Rattus norvegicus
gaaaggcggacccaccaggctaaca

SEQ ID NO: 288480 - DNA, 25 bp, Rattus norvegicus
gaaaggcggaccgaccaggctaaca

SEQ ID NO: 288481 - DNA, 25 bp, Rattus norvegicus
gaaaggcggtttcaccactaagaat

SEQ ID NO: 288482 - DNA, 25 bp, Rattus norvegicus
gaaaggcggtttgaccactaagaat

SEQ ID NO: 288483 - DNA, 25 bp, Rattus norvegicus
gaaaggcgtggaagacctagacttc

SEQ ID NO: 288484 - DNA, 25 bp, Rattus norvegicus
gaaaggcgtggatgacctagacttc

SEQ ID NO: 288485 - DNA, 25 bp, Rattus norvegicus
gaaaggctacacatgtccaaccgga

SEQ ID NO: 288486 - DNA, 25 bp, Rattus norvegicus
gaaaggctacacttgtccaaccgga

SEQ ID NO: 288487 - DNA, 25 bp, Rattus norvegicus
gaaaggctacagcattcgcccttct

SEQ ID NO: 288488 - DNA, 25 bp, Rattus norvegicus
gaaaggctacaggattcgcccttct

SEQ ID NO: 288489 - DNA, 25 bp, Rattus norvegicus
gaaaggctacatcttgctcttgcag

SEQ ID NO: 288490 - DNA, 25 bp, Rattus norvegicus
gaaaggctacatgttgctcttgcag

SEQ ID NO: 288491 - DNA, 25 bp, Rattus norvegicus
gaaaggctaccaagcagcacatgct

SEQ ID NO: 288492 - DNA, 25 bp, Rattus norvegicus
gaaaggctaccatgcagcacatgct

SEQ ID NO: 288493 - DNA, 25 bp, Rattus norvegicus
gaaaggctacttacattcagcccat

SEQ ID NO: 288494 - DNA, 25 bp, Rattus norvegicus
gaaaggctactttcattcagcccat

SEQ ID NO: 288495 - DNA, 25 bp, Rattus norvegicus
gaaaggctagttaactgtccagctt

SEQ ID NO: 288496 - DNA, 25 bp, Rattus norvegicus
gaaaggctagtttactgtccagctt

SEQ ID NO: 288497 - DNA, 25 bp, Rattus norvegicus
gaaaggctattaaaccgtaccatgt

SEQ ID NO: 288498 - DNA, 25 bp, Rattus norvegicus
gaaaggctattataccgtaccatgt

SEQ ID NO: 288499 - DNA, 25 bp, Rattus norvegicus
gaaaggctcaataactgtgactgtg

SEQ ID NO: 288500 - DNA, 25 bp, Rattus norvegicus
gaaaggctcaattactgtgactgtg

SEQ ID NO: 288501 - DNA, 25 bp, Rattus norvegicus
gaaaggctcatcacttgcacaaagg

SEQ ID NO: 288502 - DNA, 25 bp, Rattus norvegicus
gaaaggctcatctcttgcacaaagg

SEQ ID NO: 288503 - DNA, 25 bp, Rattus norvegicus
gaaaggctcccaattgaggccatcc

SEQ ID NO: 288504 - DNA, 25 bp, Rattus norvegicus
gaaaggctcccatttgaggccatcc

SEQ ID NO: 288505 - DNA, 25 bp, Rattus norvegicus
gaaaggctccgacgacctcctagag

SEQ ID NO: 288506 - DNA, 25 bp, Rattus norvegicus
gaaaggctccgaggacctcctagag

SEQ ID NO: 288507 - DNA, 25 bp, Rattus norvegicus
gaaaggctcggcagaaaaccacagc

SEQ ID NO: 288508 - DNA, 25 bp, Rattus norvegicus
gaaaggctcggctgaaaaccacagc

SEQ ID NO: 288509 - DNA, 25 bp, Rattus norvegicus
gaaaggctcgtcacatgttttggga

SEQ ID NO: 288510 - DNA, 25 bp, Rattus norvegicus
gaaaggctcgtctcatgttttggga

SEQ ID NO: 288511 - DNA, 25 bp, Rattus norvegicus
gaaaggctctcgagtgtgttagttt

SEQ ID NO: 288512 - DNA, 25 bp, Rattus norvegicus
gaaaggctctcgtgtgtgttagttt

SEQ ID NO: 288513 - DNA, 25 bp, Rattus norvegicus
gaaaggctgagtcgcttgctatgca

SEQ ID NO: 288514 - DNA, 25 bp, Rattus norvegicus
gaaaggctgagtggcttgctatgca

SEQ ID NO: 288515 - DNA, 25 bp, Rattus norvegicus
gaaaggctgctgaactagacttgga

SEQ ID NO: 288516 - DNA, 25 bp, Rattus norvegicus
gaaaggctgctgtactagacttgga

SEQ ID NO: 288517 - DNA, 25 bp, Rattus norvegicus
gaaaggctggtaaggtccccgtgtc

SEQ ID NO: 288518 - DNA, 25 bp, Rattus norvegicus
gaaaggctggtatggtccccgtgtc

SEQ ID NO: 288519 - DNA, 25 bp, Rattus norvegicus
gaaaggctggtcattttcagagcaa

SEQ ID NO: 288520 - DNA, 25 bp, Rattus norvegicus
gaaaggctggtctttttcagagcaa

SEQ ID NO: 288521 - DNA, 25 bp, Rattus norvegicus
gaaaggcttaacattcctacctcca

SEQ ID NO: 288522 - DNA, 25 bp, Rattus norvegicus
gaaaggcttaactttcctacctcca

SEQ ID NO: 288523 - DNA, 25 bp, Rattus norvegicus
gaaaggcttcaacaacagtattgca

SEQ ID NO: 288524 - DNA, 25 bp, Rattus norvegicus
gaaaggcttcaagaacagtattgca

SEQ ID NO: 288525 - DNA, 25 bp, Rattus norvegicus
gaaaggcttcagacggagctccaac

SEQ ID NO: 288526 - DNA, 25 bp, Rattus norvegicus
gaaaggcttcagtcggagctccaac

SEQ ID NO: 288527 - DNA, 25 bp, Rattus norvegicus
gaaaggcttctcaccagtatgcaca

SEQ ID NO: 288528 - DNA, 25 bp, Rattus norvegicus
gaaaggcttctcagataagctggat

SEQ ID NO: 288529 - DNA, 25 bp, Rattus norvegicus
gaaaggcttctctccagtatgcaca

SEQ ID NO: 288530 - DNA, 25 bp, Rattus norvegicus
gaaaggcttctctgataagctggat

SEQ ID NO: 288531 - DNA, 25 bp, Rattus norvegicus
gaaaggcttcttatggcttcaccgc

SEQ ID NO: 288532 - DNA, 25 bp, Rattus norvegicus
gaaaggcttcttttggcttcaccgc

SEQ ID NO: 288533 - DNA, 25 bp, Rattus norvegicus
gaaaggctttgtctctgttttgaaa

SEQ ID NO: 288534 - DNA, 25 bp, Rattus norvegicus
gaaaggctttgtgtctgttttgaaa

SEQ ID NO: 288535 - DNA, 25 bp, Rattus norvegicus
gaaagggaaatcagcaccagtgacc

SEQ ID NO: 288536 - DNA, 25 bp, Rattus norvegicus
gaaagggaaatctgcaccagtgacc

SEQ ID NO: 288537 - DNA, 25 bp, Rattus norvegicus
gaaagggaaatgcaaacctgtctgt

SEQ ID NO: 288538 - DNA, 25 bp, Rattus norvegicus
gaaagggaaatggaaacctgtctgt

SEQ ID NO: 288539 - DNA, 25 bp, Rattus norvegicus
gaaagggaacccacgtcacaggcct

SEQ ID NO: 288540 - DNA, 25 bp, Rattus norvegicus
gaaagggaaccctcgtcacaggcct

SEQ ID NO: 288541 - DNA, 25 bp, Rattus norvegicus
gaaagggaacttcactccccataga

SEQ ID NO: 288542 - DNA, 25 bp, Rattus norvegicus
gaaagggaacttgactccccataga

SEQ ID NO: 288543 - DNA, 25 bp, Rattus norvegicus
gaaagggaagtgactacccagccaa

SEQ ID NO: 288544 - DNA, 25 bp, Rattus norvegicus
gaaagggaagtgtctacccagccaa

SEQ ID NO: 288545 - DNA, 25 bp, Rattus norvegicus
gaaagggaatccatctgccacagct

SEQ ID NO: 288546 - DNA, 25 bp, Rattus norvegicus
gaaagggaatccttctgccacagct

SEQ ID NO: 288547 - DNA, 25 bp, Rattus norvegicus
gaaagggacaatctcagggcagcct

SEQ ID NO: 288548 - DNA, 25 bp, Rattus norvegicus
gaaagggacaatgtcagggcagcct

SEQ ID NO: 288549 - DNA, 25 bp, Rattus norvegicus
gaaagggacctcctgagaactcgct

SEQ ID NO: 288550 - DNA, 25 bp, Rattus norvegicus
gaaagggacctcgtgagaactcgct

SEQ ID NO: 288551 - DNA, 25 bp, Rattus norvegicus
gaaagggactgtcggttcctgtcaa

SEQ ID NO: 288552 - DNA, 25 bp, Rattus norvegicus
gaaagggactgtgggttcctgtcaa

SEQ ID NO: 288553 - DNA, 25 bp, Rattus norvegicus
gaaagggagaagatcaaactaccat

SEQ ID NO: 288554 - DNA, 25 bp, Rattus norvegicus
gaaagggagaagttcaaactaccat

SEQ ID NO: 288555 - DNA, 25 bp, Rattus norvegicus
gaaagggagaccacactgttccatt

SEQ ID NO: 288556 - DNA, 25 bp, Rattus norvegicus
gaaagggagacctcactgttccatt

SEQ ID NO: 288557 - DNA, 25 bp, Rattus norvegicus
gaaagggagcacaccatcgaagaat

SEQ ID NO: 288558 - DNA, 25 bp, Rattus norvegicus
gaaagggagcactccatcgaagaat

SEQ ID NO: 288559 - DNA, 25 bp, Rattus norvegicus
gaaagggagcctagcatctcacaca

SEQ ID NO: 288560 - DNA, 25 bp, Rattus norvegicus
gaaagggagccttgcatctcacaca

SEQ ID NO: 288561 - DNA, 25 bp, Rattus norvegicus
gaaagggcacctctggagccccaaa

SEQ ID NO: 288562 - DNA, 25 bp, Rattus norvegicus
gaaagggcacctgtggagccccaaa

SEQ ID NO: 288563 - DNA, 25 bp, Rattus norvegicus
gaaagggcactcaattattggaata

SEQ ID NO: 288564 - DNA, 25 bp, Rattus norvegicus
gaaagggcactctattattggaata

SEQ ID NO: 288565 - DNA, 25 bp, Rattus norvegicus
gaaagggcagctactctgagcgcgt

SEQ ID NO: 288566 - DNA, 25 bp, Rattus norvegicus
gaaagggcagcttctctgagcgcgt

SEQ ID NO: 288567 - DNA, 25 bp, Rattus norvegicus
gaaagggcatagagtctctgctcat

SEQ ID NO: 288568 - DNA, 25 bp, Rattus norvegicus
gaaagggcatagtgtctctgctcat

SEQ ID NO: 288569 - DNA, 25 bp, Rattus norvegicus
gaaagggccaaaatgcctacagata

SEQ ID NO: 288570 - DNA, 25 bp, Rattus norvegicus
gaaagggccaaacgctcttgctgga

SEQ ID NO: 288571 - DNA, 25 bp, Rattus norvegicus
gaaagggccaaaggctcttgctgga

SEQ ID NO: 288572 - DNA, 25 bp, Rattus norvegicus
gaaagggccaaattgcctacagata

SEQ ID NO: 288573 - DNA, 25 bp, Rattus norvegicus
gaaagggccagtctgaaagtctttt

SEQ ID NO: 288574 - DNA, 25 bp, Rattus norvegicus
gaaagggccagtgtgaaagtctttt

SEQ ID NO: 288575 - DNA, 25 bp, Rattus norvegicus
gaaagggccattccaacacacaggg

SEQ ID NO: 288576 - DNA, 25 bp, Rattus norvegicus
gaaagggccattgcaacacacaggg

SEQ ID NO: 288577 - DNA, 25 bp, Rattus norvegicus
gaaagggcccacacagaccagagga

SEQ ID NO: 288578 - DNA, 25 bp, Rattus norvegicus
gaaagggcccactcagaccagagga

SEQ ID NO: 288579 - DNA, 25 bp, Rattus norvegicus
gaaagggcccggagtcctcacgaag

SEQ ID NO: 288580 - DNA, 25 bp, Rattus norvegicus
gaaagggcccggtgtcctcacgaag

SEQ ID NO: 288581 - DNA, 25 bp, Rattus norvegicus
gaaagggcctaactcttatctgtgt

SEQ ID NO: 288582 - DNA, 25 bp, Rattus norvegicus
gaaagggcctaagtcttatctgtgt

SEQ ID NO: 288583 - DNA, 25 bp, Rattus norvegicus
gaaagggcctctctactcgagcgcc

SEQ ID NO: 288584 - DNA, 25 bp, Rattus norvegicus
gaaagggcctctgtactcgagcgcc

SEQ ID NO: 288585 - DNA, 25 bp, Rattus norvegicus
gaaagggcctggaaaatttggatca

SEQ ID NO: 288586 - DNA, 25 bp, Rattus norvegicus
gaaagggcctggtaaatttggatca

SEQ ID NO: 288587 - DNA, 25 bp, Rattus norvegicus
gaaagggcgtacaatctccactttg

SEQ ID NO: 288588 - DNA, 25 bp, Rattus norvegicus
gaaagggcgtactatctccactttg

SEQ ID NO: 288589 - DNA, 25 bp, Rattus norvegicus
gaaagggctaccatcccaaagagag

SEQ ID NO: 288590 - DNA, 25 bp, Rattus norvegicus
gaaagggctaccttcccaaagagag

SEQ ID NO: 288591 - DNA, 25 bp, Rattus norvegicus
gaaagggctcacactctggttctgg

SEQ ID NO: 288592 - DNA, 25 bp, Rattus norvegicus
gaaagggctcactctctggttctgg

SEQ ID NO: 288593 - DNA, 25 bp, Rattus norvegicus
gaaagggctgcaaaacaagacaccg

SEQ ID NO: 288594 - DNA, 25 bp, Rattus norvegicus
gaaagggctgcataacaagacaccg

SEQ ID NO: 288595 - DNA, 25 bp, Rattus norvegicus
gaaagggctggacacttacttccca

SEQ ID NO: 288596 - DNA, 25 bp, Rattus norvegicus
gaaagggctggagacttacttccca

SEQ ID NO: 288597 - DNA, 25 bp, Rattus norvegicus
gaaagggctgtcattgtttcctctt

SEQ ID NO: 288598 - DNA, 25 bp, Rattus norvegicus
gaaagggctgtctttgtttcctctt

SEQ ID NO: 288599 - DNA, 25 bp, Rattus norvegicus
gaaagggcttccacagtgcacaggg

SEQ ID NO: 288600 - DNA, 25 bp, Rattus norvegicus
gaaagggcttcctcagtgcacaggg

SEQ ID NO: 288601 - DNA, 25 bp, Rattus norvegicus
gaaagggtacacatctacatgggaa

SEQ ID NO: 288602 - DNA, 25 bp, Rattus norvegicus
gaaagggtacacttctacatgggaa

SEQ ID NO: 288603 - DNA, 25 bp, Rattus norvegicus
gaaagggtagcactacatcgggcat

SEQ ID NO: 288604 - DNA, 25 bp, Rattus norvegicus
gaaagggtagcagtacatcgggcat

SEQ ID NO: 288605 - DNA, 25 bp, Rattus norvegicus
gaaagggtcacaaagctctgccaat

SEQ ID NO: 288606 - DNA, 25 bp, Rattus norvegicus
gaaagggtcacaaggcgccgtttgc

SEQ ID NO: 288607 - DNA, 25 bp, Rattus norvegicus
gaaagggtcacatagctctgccaat

SEQ ID NO: 288608 - DNA, 25 bp, Rattus norvegicus
gaaagggtcacatggcgccgtttgc

SEQ ID NO: 288609 - DNA, 25 bp, Rattus norvegicus
gaaagggtcacgaagcttgcgccgc

SEQ ID NO: 288610 - DNA, 25 bp, Rattus norvegicus
gaaagggtcacgtagcttgcgccgc

SEQ ID NO: 288611 - DNA, 25 bp, Rattus norvegicus
gaaagggtccatactctgttatcaa

SEQ ID NO: 288612 - DNA, 25 bp, Rattus norvegicus
gaaagggtccattctctgttatcaa

SEQ ID NO: 288613 - DNA, 25 bp, Rattus norvegicus
gaaagggtctgtactttaacagtct

SEQ ID NO: 288614 - DNA, 25 bp, Rattus norvegicus
gaaagggtctgttctttaacagtct

SEQ ID NO: 288615 - DNA, 25 bp, Rattus norvegicus
gaaagggtgcatagctgttttagcc

SEQ ID NO: 288616 - DNA, 25 bp, Rattus norvegicus
gaaagggtgcattgctgttttagcc

SEQ ID NO: 288617 - DNA, 25 bp, Rattus norvegicus
gaaagggtgccacagaacccttcaa

SEQ ID NO: 288618 - DNA, 25 bp, Rattus norvegicus
gaaagggtgccagagaacccttcaa

SEQ ID NO: 288619 - DNA, 25 bp, Rattus norvegicus
gaaagggtggtcattcacagcagcc

SEQ ID NO: 288620 - DNA, 25 bp, Rattus norvegicus
gaaagggtggtcctctctgtttgat

SEQ ID NO: 288621 - DNA, 25 bp, Rattus norvegicus
gaaagggtggtcgtctctgtttgat

SEQ ID NO: 288622 - DNA, 25 bp, Rattus norvegicus
gaaagggtggtctttcacagcagcc

SEQ ID NO: 288623 - DNA, 25 bp, Rattus norvegicus
gaaagggtgtctacatcatcataga

SEQ ID NO: 288624 - DNA, 25 bp, Rattus norvegicus
gaaagggtgtctctgtcattttaat

SEQ ID NO: 288625 - DNA, 25 bp, Rattus norvegicus
gaaagggtgtctgtgtcattttaat

SEQ ID NO: 288626 - DNA, 25 bp, Rattus norvegicus
gaaagggtgtcttcatcatcataga

SEQ ID NO: 288627 - DNA, 25 bp, Rattus norvegicus
gaaagggttactcagtcaagcctgt

SEQ ID NO: 288628 - DNA, 25 bp, Rattus norvegicus
gaaagggttactgagtcaagcctgt

SEQ ID NO: 288629 - DNA, 25 bp, Rattus norvegicus
gaaagggttcagacagcccctggag

SEQ ID NO: 288630 - DNA, 25 bp, Rattus norvegicus
gaaagggttcagtcagcccctggag

SEQ ID NO: 288631 - DNA, 25 bp, Rattus norvegicus
gaaagggtttctccaaagcaacaca

SEQ ID NO: 288632 - DNA, 25 bp, Rattus norvegicus
gaaagggtttctgcaaagcaacaca

SEQ ID NO: 288633 - DNA, 25 bp, Rattus norvegicus
gaaagggttttcatggcatgccagt

SEQ ID NO: 288634 - DNA, 25 bp, Rattus norvegicus
gaaagggttttcttggcatgccagt

SEQ ID NO: 288635 - DNA, 25 bp, Rattus norvegicus
gaaaggtaatatcgctatctctgga

SEQ ID NO: 288636 - DNA, 25 bp, Rattus norvegicus
gaaaggtaatatggctatctctgga

SEQ ID NO: 288637 - DNA, 25 bp, Rattus norvegicus
gaaaggtaccaaaggcttcttatgt

SEQ ID NO: 288638 - DNA, 25 bp, Rattus norvegicus
gaaaggtaccaatggcttcttatgt

SEQ ID NO: 288639 - DNA, 25 bp, Rattus norvegicus
gaaaggtagactacctaacagtggc

SEQ ID NO: 288640 - DNA, 25 bp, Rattus norvegicus
gaaaggtagacttcctaacagtggc

SEQ ID NO: 288641 - DNA, 25 bp, Rattus norvegicus
gaaaggtaggagacgtcctgcctct

SEQ ID NO: 288642 - DNA, 25 bp, Rattus norvegicus
gaaaggtaggagtcgtcctgcctct

SEQ ID NO: 288643 - DNA, 25 bp, Rattus norvegicus
gaaaggtcaatgagagtgacgcaga

SEQ ID NO: 288644 - DNA, 25 bp, Rattus norvegicus
gaaaggtcaatgtgagtgacgcaga

SEQ ID NO: 288645 - DNA, 25 bp, Rattus norvegicus
gaaaggtcacccacaagacttacag

SEQ ID NO: 288646 - DNA, 25 bp, Rattus norvegicus
gaaaggtcacccactctaggagcgg

SEQ ID NO: 288647 - DNA, 25 bp, Rattus norvegicus
gaaaggtcaccccacatctttaaca

SEQ ID NO: 288648 - DNA, 25 bp, Rattus norvegicus
gaaaggtcacccgacatctttaaca

SEQ ID NO: 288649 - DNA, 25 bp, Rattus norvegicus
gaaaggtcaccctcaagacttacag

SEQ ID NO: 288650 - DNA, 25 bp, Rattus norvegicus
gaaaggtcaccctctctaggagcgg

SEQ ID NO: 288651 - DNA, 25 bp, Rattus norvegicus
gaaaggtcacctcccaatcgaaagc

SEQ ID NO: 288652 - DNA, 25 bp, Rattus norvegicus
gaaaggtcacctgccaatcgaaagc

SEQ ID NO: 288653 - DNA, 25 bp, Rattus norvegicus
gaaaggtcactcatccttagtccag

SEQ ID NO: 288654 - DNA, 25 bp, Rattus norvegicus
gaaaggtcactcttccttagtccag

SEQ ID NO: 288655 - DNA, 25 bp, Rattus norvegicus
gaaaggtcaggactcctttgcgtgt

SEQ ID NO: 288656 - DNA, 25 bp, Rattus norvegicus
gaaaggtcaggagtcctttgcgtgt

SEQ ID NO: 288657 - DNA, 25 bp, Rattus norvegicus
gaaaggtcatctccagcagaagtga

SEQ ID NO: 288658 - DNA, 25 bp, Rattus norvegicus
gaaaggtcatctgcagcagaagtga

SEQ ID NO: 288659 - DNA, 25 bp, Rattus norvegicus
gaaaggtcattcacaatacttcaca

SEQ ID NO: 288660 - DNA, 25 bp, Rattus norvegicus
gaaaggtcattctcaatacttcaca

SEQ ID NO: 288661 - DNA, 25 bp, Rattus norvegicus
gaaaggtccaagaagcccatgagca

SEQ ID NO: 288662 - DNA, 25 bp, Rattus norvegicus
gaaaggtccaagtagcccatgagca

SEQ ID NO: 288663 - DNA, 25 bp, Rattus norvegicus
gaaaggtccagaccactccatgaag

SEQ ID NO: 288664 - DNA, 25 bp, Rattus norvegicus
gaaaggtccagagcactccatgaag

SEQ ID NO: 288665 - DNA, 25 bp, Rattus norvegicus
gaaaggtccagcaagtccagcagcg

SEQ ID NO: 288666 - DNA, 25 bp, Rattus norvegicus
gaaaggtccagctagtccagcagcg

SEQ ID NO: 288667 - DNA, 25 bp, Rattus norvegicus
gaaaggtccagtacttcatcttgga

SEQ ID NO: 288668 - DNA, 25 bp, Rattus norvegicus
gaaaggtccagttcttcatcttgga

SEQ ID NO: 288669 - DNA, 25 bp, Rattus norvegicus
gaaaggtcccacacgggtgagcgcc

SEQ ID NO: 288670 - DNA, 25 bp, Rattus norvegicus
gaaaggtcccactcgggtgagcgcc

SEQ ID NO: 288671 - DNA, 25 bp, Rattus norvegicus
gaaaggtcgttccagactgctggct

SEQ ID NO: 288672 - DNA, 25 bp, Rattus norvegicus
gaaaggtcgttcgagactgctggct

SEQ ID NO: 288673 - DNA, 25 bp, Rattus norvegicus
gaaaggtctcccctggcacagagga

SEQ ID NO: 288674 - DNA, 25 bp, Rattus norvegicus
gaaaggtctcccgtggcacagagga

SEQ ID NO: 288675 - DNA, 25 bp, Rattus norvegicus
gaaaggtctcttattgacatcagca

SEQ ID NO: 288676 - DNA, 25 bp, Rattus norvegicus
gaaaggtctctttttgacatcagca

SEQ ID NO: 288677 - DNA, 25 bp, Rattus norvegicus
gaaaggtctgctccctggagtttct

SEQ ID NO: 288678 - DNA, 25 bp, Rattus norvegicus
gaaaggtctgctgcctggagtttct

SEQ ID NO: 288679 - DNA, 25 bp, Rattus norvegicus
gaaaggtcttctatagccaatcatt

SEQ ID NO: 288680 - DNA, 25 bp, Rattus norvegicus
gaaaggtcttctttagccaatcatt

SEQ ID NO: 288681 - DNA, 25 bp, Rattus norvegicus
gaaaggtctttcaggctactgttca

SEQ ID NO: 288682 - DNA, 25 bp, Rattus norvegicus
gaaaggtctttctggctactgttca

SEQ ID NO: 288683 - DNA, 25 bp, Rattus norvegicus
gaaaggtgaaccacctccagggagg

SEQ ID NO: 288684 - DNA, 25 bp, Rattus norvegicus
gaaaggtgaaccagctgcctccaga

SEQ ID NO: 288685 - DNA, 25 bp, Rattus norvegicus
gaaaggtgaaccctactcagtgtga

SEQ ID NO: 288686 - DNA, 25 bp, Rattus norvegicus
gaaaggtgaaccgtactcagtgtga

SEQ ID NO: 288687 - DNA, 25 bp, Rattus norvegicus
gaaaggtgaacctcctccagggagg

SEQ ID NO: 288688 - DNA, 25 bp, Rattus norvegicus
gaaaggtgaacctgctgcctccaga

SEQ ID NO: 288689 - DNA, 25 bp, Rattus norvegicus
gaaaggtgaaggactccccaggctg

SEQ ID NO: 288690 - DNA, 25 bp, Rattus norvegicus
gaaaggtgaaggtctccccaggctg

SEQ ID NO: 288691 - DNA, 25 bp, Rattus norvegicus
gaaaggtgacccatgttatctcgtt

SEQ ID NO: 288692 - DNA, 25 bp, Rattus norvegicus
gaaaggtgacccctaactgttgact

SEQ ID NO: 288693 - DNA, 25 bp, Rattus norvegicus
gaaaggtgacccgtaactgttgact

SEQ ID NO: 288694 - DNA, 25 bp, Rattus norvegicus
gaaaggtgacccttgttatctcgtt

SEQ ID NO: 288695 - DNA, 25 bp, Rattus norvegicus
gaaaggtgcaacaacttagtttagt

SEQ ID NO: 288696 - DNA, 25 bp, Rattus norvegicus
gaaaggtgcaactacttagtttagt

SEQ ID NO: 288697 - DNA, 25 bp, Rattus norvegicus
gaaaggtgcactactctgagaaagt

SEQ ID NO: 288698 - DNA, 25 bp, Rattus norvegicus
gaaaggtgcacttctctgagaaagt

SEQ ID NO: 288699 - DNA, 25 bp, Rattus norvegicus
gaaaggtgccatacattttagactg

SEQ ID NO: 288700 - DNA, 25 bp, Rattus norvegicus
gaaaggtgccattcattttagactg

SEQ ID NO: 288701 - DNA, 25 bp, Rattus norvegicus
gaaaggtgcgctatcccttttgatt

SEQ ID NO: 288702 - DNA, 25 bp, Rattus norvegicus
gaaaggtgcgctttcccttttgatt

SEQ ID NO: 288703 - DNA, 25 bp, Rattus norvegicus
gaaaggtgctgccttcgagaaagca

SEQ ID NO: 288704 - DNA, 25 bp, Rattus norvegicus
gaaaggtgctgcgttcgagaaagca

SEQ ID NO: 288705 - DNA, 25 bp, Rattus norvegicus
gaaaggtggaatccagcccagccag

SEQ ID NO: 288706 - DNA, 25 bp, Rattus norvegicus
gaaaggtggaatgcagcccagccag

SEQ ID NO: 288707 - DNA, 25 bp, Rattus norvegicus
gaaaggtggcacacaataagtcaaa

SEQ ID NO: 288708 - DNA, 25 bp, Rattus norvegicus
gaaaggtggcactcaataagtcaaa

SEQ ID NO: 288709 - DNA, 25 bp, Rattus norvegicus
gaaaggtggcccatgaagtgtgcat

SEQ ID NO: 288710 - DNA, 25 bp, Rattus norvegicus
gaaaggtggcccttgaagtgtgcat

SEQ ID NO: 288711 - DNA, 25 bp, Rattus norvegicus
gaaaggtggcctaccagttccagtg

SEQ ID NO: 288712 - DNA, 25 bp, Rattus norvegicus
gaaaggtggccttccagttccagtg

SEQ ID NO: 288713 - DNA, 25 bp, Rattus norvegicus
gaaaggtgggacatcttctgcgtcg

SEQ ID NO: 288714 - DNA, 25 bp, Rattus norvegicus
gaaaggtgggacttcttctgcgtcg

SEQ ID NO: 288715 - DNA, 25 bp, Rattus norvegicus
gaaaggtgtccaaattgtatacatg

SEQ ID NO: 288716 - DNA, 25 bp, Rattus norvegicus
gaaaggtgtccatattgtatacatg

SEQ ID NO: 288717 - DNA, 25 bp, Rattus norvegicus
gaaaggtgtctactttgtcggacaa

SEQ ID NO: 288718 - DNA, 25 bp, Rattus norvegicus
gaaaggtgtctagtttgtcggacaa

SEQ ID NO: 288719 - DNA, 25 bp, Rattus norvegicus
gaaaggtgtcttcacgcaaatccct

SEQ ID NO: 288720 - DNA, 25 bp, Rattus norvegicus
gaaaggtgtcttgacgcaaatccct

SEQ ID NO: 288721 - DNA, 25 bp, Rattus norvegicus
gaaaggtgtgcaccgttactcctgg

SEQ ID NO: 288722 - DNA, 25 bp, Rattus norvegicus
gaaaggtgtgcagcgttactcctgg

SEQ ID NO: 288723 - DNA, 25 bp, Rattus norvegicus
gaaaggtgtgctcttactgcgttct

SEQ ID NO: 288724 - DNA, 25 bp, Rattus norvegicus
gaaaggtgtgctgttactgcgttct

SEQ ID NO: 288725 - DNA, 25 bp, Rattus norvegicus
gaaaggtgtttcaagctctgcttct

SEQ ID NO: 288726 - DNA, 25 bp, Rattus norvegicus
gaaaggtgtttctagctctgcttct

SEQ ID NO: 288727 - DNA, 25 bp, Rattus norvegicus
gaaaggtgttttcgtagagccccag

SEQ ID NO: 288728 - DNA, 25 bp, Rattus norvegicus
gaaaggtgttttggtagagccccag

SEQ ID NO: 288729 - DNA, 25 bp, Rattus norvegicus
gaaaggttaccccagtctcagacag

SEQ ID NO: 288730 - DNA, 25 bp, Rattus norvegicus
gaaaggttacccgagtctcagacag

SEQ ID NO: 288731 - DNA, 25 bp, Rattus norvegicus
gaaaggttacctccctaatgacaga

SEQ ID NO: 288732 - DNA, 25 bp, Rattus norvegicus
gaaaggttacctgcctaatgacaga

SEQ ID NO: 288733 - DNA, 25 bp, Rattus norvegicus
gaaaggttagccagcagcctggatt

SEQ ID NO: 288734 - DNA, 25 bp, Rattus norvegicus
gaaaggttagcctgcagcctggatt

SEQ ID NO: 288735 - DNA, 25 bp, Rattus norvegicus
gaaaggttaggtcgctcctgactga

SEQ ID NO: 288736 - DNA, 25 bp, Rattus norvegicus
gaaaggttaggtggctcctgactga

SEQ ID NO: 288737 - DNA, 25 bp, Rattus norvegicus
gaaaggttatctcttcctggaattt

SEQ ID NO: 288738 - DNA, 25 bp, Rattus norvegicus
gaaaggttatctgttcctggaattt

SEQ ID NO: 288739 - DNA, 25 bp, Rattus norvegicus
gaaaggttccagagcccatttgttc

SEQ ID NO: 288740 - DNA, 25 bp, Rattus norvegicus
gaaaggttccagtgcccatttgttc

SEQ ID NO: 288741 - DNA, 25 bp, Rattus norvegicus
gaaaggttcccacaaggccgcgcgc

SEQ ID NO: 288742 - DNA, 25 bp, Rattus norvegicus
gaaaggttcccagaaggccgcgcgc

SEQ ID NO: 288743 - DNA, 25 bp, Rattus norvegicus
gaaaggttcgacacctgcaggtggt

SEQ ID NO: 288744 - DNA, 25 bp, Rattus norvegicus
gaaaggttcgactcctgcaggtggt

SEQ ID NO: 288745 - DNA, 25 bp, Rattus norvegicus
gaaaggttcgtccttgtcttgagtt

SEQ ID NO: 288746 - DNA, 25 bp, Rattus norvegicus
gaaaggttcgtcgttgtcttgagtt

SEQ ID NO: 288747 - DNA, 25 bp, Rattus norvegicus
gaaaggttctccagaacgactgaag

SEQ ID NO: 288748 - DNA, 25 bp, Rattus norvegicus
gaaaggttctcctgaacgactgaag

SEQ ID NO: 288749 - DNA, 25 bp, Rattus norvegicus
gaaaggttgctcactttaaatagcc

SEQ ID NO: 288750 - DNA, 25 bp, Rattus norvegicus
gaaaggttgctctctttaaatagcc

SEQ ID NO: 288751 - DNA, 25 bp, Rattus norvegicus
gaaaggttggcaccttctcagccca

SEQ ID NO: 288752 - DNA, 25 bp, Rattus norvegicus
gaaaggttggcagcttctcagccca

SEQ ID NO: 288753 - DNA, 25 bp, Rattus norvegicus
gaaaggttgtcaactgcttccttat

SEQ ID NO: 288754 - DNA, 25 bp, Rattus norvegicus
gaaaggttgtcatctgcttccttat

SEQ ID NO: 288755 - DNA, 25 bp, Rattus norvegicus
gaaaggtttacaatctccacgtgat

SEQ ID NO: 288756 - DNA, 25 bp, Rattus norvegicus
gaaaggtttacattctccacgtgat

SEQ ID NO: 288757 - DNA, 25 bp, Rattus norvegicus
gaaaggtttattacgcaggagcgat

SEQ ID NO: 288758 - DNA, 25 bp, Rattus norvegicus
gaaaggtttattctggcttctgatt

SEQ ID NO: 288759 - DNA, 25 bp, Rattus norvegicus
gaaaggtttattgtggcttctgatt

SEQ ID NO: 288760 - DNA, 25 bp, Rattus norvegicus
gaaaggtttatttcgcaggagcgat

SEQ ID NO: 288761 - DNA, 25 bp, Rattus norvegicus
gaaaggttttgccttatctctctct

SEQ ID NO: 288762 - DNA, 25 bp, Rattus norvegicus
gaaaggttttgcgttatctctctct

SEQ ID NO: 288763 - DNA, 25 bp, Rattus norvegicus
gaaagtaacactaccttaggcatta

SEQ ID NO: 288764 - DNA, 25 bp, Rattus norvegicus
gaaagtaacacttccttaggcatta

SEQ ID NO: 288765 - DNA, 25 bp, Rattus norvegicus
gaaagtaagaatctcccaccttctg

SEQ ID NO: 288766 - DNA, 25 bp, Rattus norvegicus
gaaagtaagaatgtcccaccttctg

SEQ ID NO: 288767 - DNA, 25 bp, Rattus norvegicus
gaaagtaagcaccaccacgagcagt

SEQ ID NO: 288768 - DNA, 25 bp, Rattus norvegicus
gaaagtaagcacgaccacgagcagt

SEQ ID NO: 288769 - DNA, 25 bp, Rattus norvegicus
gaaagtaagccaaagtagccataaa

SEQ ID NO: 288770 - DNA, 25 bp, Rattus norvegicus
gaaagtaagccatagtagccataaa

SEQ ID NO: 288771 - DNA, 25 bp, Rattus norvegicus
gaaagtaagctcacggctgcgttgc

SEQ ID NO: 288772 - DNA, 25 bp, Rattus norvegicus
gaaagtaagctctcggctgcgttgc

SEQ ID NO: 288773 - DNA, 25 bp, Rattus norvegicus
gaaagtaagtttcattcagatttgt

SEQ ID NO: 288774 - DNA, 25 bp, Rattus norvegicus
gaaagtaagtttgattcagatttgt

SEQ ID NO: 288775 - DNA, 25 bp, Rattus norvegicus
gaaagtaatagtccacatgtccctg

SEQ ID NO: 288776 - DNA, 25 bp, Rattus norvegicus
gaaagtaatagtgcacatgtccctg

SEQ ID NO: 288777 - DNA, 25 bp, Rattus norvegicus
gaaagtacaaccaatccaccatgaa

SEQ ID NO: 288778 - DNA, 25 bp, Rattus norvegicus
gaaagtacaacctatccaccatgaa

SEQ ID NO: 288779 - DNA, 25 bp, Rattus norvegicus
gaaagtacaaggctccacaggacaa

SEQ ID NO: 288780 - DNA, 25 bp, Rattus norvegicus
gaaagtacaagggtccacaggacaa

SEQ ID NO: 288781 - DNA, 25 bp, Rattus norvegicus
gaaagtacacataccgacgacgaat

SEQ ID NO: 288782 - DNA, 25 bp, Rattus norvegicus
gaaagtacacattccgacgacgaat

SEQ ID NO: 288783 - DNA, 25 bp, Rattus norvegicus
gaaagtacagataacccaatggtca

SEQ ID NO: 288784 - DNA, 25 bp, Rattus norvegicus
gaaagtacagattacccaatggtca

SEQ ID NO: 288785 - DNA, 25 bp, Rattus norvegicus
gaaagtacagcccagatgcagtaga

SEQ ID NO: 288786 - DNA, 25 bp, Rattus norvegicus
gaaagtacagccgagatgcagtaga

SEQ ID NO: 288787 - DNA, 25 bp, Rattus norvegicus
gaaagtacatttactgcctgttcag

SEQ ID NO: 288788 - DNA, 25 bp, Rattus norvegicus
gaaagtacattttctgcctgttcag

SEQ ID NO: 288789 - DNA, 25 bp, Rattus norvegicus
gaaagtaccaagctcgttaaaatgt

SEQ ID NO: 288790 - DNA, 25 bp, Rattus norvegicus
gaaagtaccaaggtcgttaaaatgt

SEQ ID NO: 288791 - DNA, 25 bp, Rattus norvegicus
gaaagtaccacaatgcattgagctg

SEQ ID NO: 288792 - DNA, 25 bp, Rattus norvegicus
gaaagtaccacattgcattgagctg

SEQ ID NO: 288793 - DNA, 25 bp, Rattus norvegicus
gaaagtaccagtcttcagatttgaa

SEQ ID NO: 288794 - DNA, 25 bp, Rattus norvegicus
gaaagtaccagtgttcagatttgaa

SEQ ID NO: 288795 - DNA, 25 bp, Rattus norvegicus
gaaagtaccccaatttcctgcaggg

SEQ ID NO: 288796 - DNA, 25 bp, Rattus norvegicus
gaaagtaccccattttcctgcaggg

SEQ ID NO: 288797 - DNA, 25 bp, Rattus norvegicus
gaaagtacccgccagaggctgcagc

SEQ ID NO: 288798 - DNA, 25 bp, Rattus norvegicus
gaaagtacccgcgagaggctgcagc

SEQ ID NO: 288799 - DNA, 25 bp, Rattus norvegicus
gaaagtacgctaagcacccaacaaa

SEQ ID NO: 288800 - DNA, 25 bp, Rattus norvegicus
gaaagtacgctatgcacccaacaaa

SEQ ID NO: 288801 - DNA, 25 bp, Rattus norvegicus
gaaagtacggaaccagagatcctta

SEQ ID NO: 288802 - DNA, 25 bp, Rattus norvegicus
gaaagtacggaagcagagatcctta

SEQ ID NO: 288803 - DNA, 25 bp, Rattus norvegicus
gaaagtactccccatgagttgtgac

SEQ ID NO: 288804 - DNA, 25 bp, Rattus norvegicus
gaaagtactcccgatgagttgtgac

SEQ ID NO: 288805 - DNA, 25 bp, Rattus norvegicus
gaaagtacttgtaccagggctgagg

SEQ ID NO: 288806 - DNA, 25 bp, Rattus norvegicus
gaaagtacttgttccagggctgagg

SEQ ID NO: 288807 - DNA, 25 bp, Rattus norvegicus
gaaagtactttgagccgcttctgtt

SEQ ID NO: 288808 - DNA, 25 bp, Rattus norvegicus
gaaagtactttgtgccgcttctgtt

SEQ ID NO: 288809 - DNA, 25 bp, Rattus norvegicus
gaaagtagacagattccacttcctt

SEQ ID NO: 288810 - DNA, 25 bp, Rattus norvegicus
gaaagtagacagtttccacttcctt

SEQ ID NO: 288811 - DNA, 25 bp, Rattus norvegicus
gaaagtagagctcgccaatccccaa

SEQ ID NO: 288812 - DNA, 25 bp, Rattus norvegicus
gaaagtagagctggccaatccccaa

SEQ ID NO: 288813 - DNA, 25 bp, Rattus norvegicus
gaaagtagccatcgcgggacaatgt

SEQ ID NO: 288814 - DNA, 25 bp, Rattus norvegicus
gaaagtagccatggcgggacaatgt

SEQ ID NO: 288815 - DNA, 25 bp, Rattus norvegicus
gaaagtagcgttccgttcctttctc

SEQ ID NO: 288816 - DNA, 25 bp, Rattus norvegicus
gaaagtagcgttgcgttcctttctc

SEQ ID NO: 288817 - DNA, 25 bp, Rattus norvegicus
gaaagtagctgtagctgttttttgt

SEQ ID NO: 288818 - DNA, 25 bp, Rattus norvegicus
gaaagtagctgttgctgttttttgt

SEQ ID NO: 288819 - DNA, 25 bp, Rattus norvegicus
gaaagtaggcaacttcttccactct

SEQ ID NO: 288820 - DNA, 25 bp, Rattus norvegicus
gaaagtaggcaagttcttccactct

SEQ ID NO: 288821 - DNA, 25 bp, Rattus norvegicus
gaaagtagggcccagctcccttagt

SEQ ID NO: 288822 - DNA, 25 bp, Rattus norvegicus
gaaagtagggccgagctcccttagt

SEQ ID NO: 288823 - DNA, 25 bp, Rattus norvegicus
gaaagtagtagaaccagcctgggat

SEQ ID NO: 288824 - DNA, 25 bp, Rattus norvegicus
gaaagtagtagatccagcctgggat

SEQ ID NO: 288825 - DNA, 25 bp, Rattus norvegicus
gaaagtagttccaaggctgcctcta

SEQ ID NO: 288826 - DNA, 25 bp, Rattus norvegicus
gaaagtagttcctaggctgcctcta

SEQ ID NO: 288827 - DNA, 25 bp, Rattus norvegicus
gaaagtatagaaccttcagaaaatg

SEQ ID NO: 288828 - DNA, 25 bp, Rattus norvegicus
gaaagtatagaagcttcagaaaatg

SEQ ID NO: 288829 - DNA, 25 bp, Rattus norvegicus
gaaagtatagacctctactcggccg

SEQ ID NO: 288830 - DNA, 25 bp, Rattus norvegicus
gaaagtatagacgtctactcggccg

SEQ ID NO: 288831 - DNA, 25 bp, Rattus norvegicus
gaaagtatcaaaccagcttgcaaaa

SEQ ID NO: 288832 - DNA, 25 bp, Rattus norvegicus
gaaagtatcaaagcagcttgcaaaa

SEQ ID NO: 288833 - DNA, 25 bp, Rattus norvegicus
gaaagtatcaagcatcccaagtggg

SEQ ID NO: 288834 - DNA, 25 bp, Rattus norvegicus
gaaagtatcaaggatcccaagtggg

SEQ ID NO: 288835 - DNA, 25 bp, Rattus norvegicus
gaaagtatcatccttgaggctcacc

SEQ ID NO: 288836 - DNA, 25 bp, Rattus norvegicus
gaaagtatcatcgttgaggctcacc

SEQ ID NO: 288837 - DNA, 25 bp, Rattus norvegicus
gaaagtatccaccttgggccagtga

SEQ ID NO: 288838 - DNA, 25 bp, Rattus norvegicus
gaaagtatccacgttgggccagtga

SEQ ID NO: 288839 - DNA, 25 bp, Rattus norvegicus
gaaagtatccatcctcatacgcagg

SEQ ID NO: 288840 - DNA, 25 bp, Rattus norvegicus
gaaagtatccatgctcatacgcagg

SEQ ID NO: 288841 - DNA, 25 bp, Rattus norvegicus
gaaagtatcctgcagaccgatgatg

SEQ ID NO: 288842 - DNA, 25 bp, Rattus norvegicus
gaaagtatcctggagaccgatgatg

SEQ ID NO: 288843 - DNA, 25 bp, Rattus norvegicus
gaaagtatctgactgtccacacagc

SEQ ID NO: 288844 - DNA, 25 bp, Rattus norvegicus
gaaagtatctgagtgtccacacagc

SEQ ID NO: 288845 - DNA, 25 bp, Rattus norvegicus
gaaagtatgactcgcttctcaccct

SEQ ID NO: 288846 - DNA, 25 bp, Rattus norvegicus
gaaagtatgactggcttctcaccct

SEQ ID NO: 288847 - DNA, 25 bp, Rattus norvegicus
gaaagtatggaaaccagcttctctc

SEQ ID NO: 288848 - DNA, 25 bp, Rattus norvegicus
gaaagtatggaatccagcttctctc

SEQ ID NO: 288849 - DNA, 25 bp, Rattus norvegicus
gaaagtattaacacagcctggcgtc

SEQ ID NO: 288850 - DNA, 25 bp, Rattus norvegicus
gaaagtattaactcagcctggcgtc

SEQ ID NO: 288851 - DNA, 25 bp, Rattus norvegicus
gaaagtattctcagagtcccagctt

SEQ ID NO: 288852 - DNA, 25 bp, Rattus norvegicus
gaaagtattctccatcagttctcag

SEQ ID NO: 288853 - DNA, 25 bp, Rattus norvegicus
gaaagtattctcgatcagttctcag

SEQ ID NO: 288854 - DNA, 25 bp, Rattus norvegicus
gaaagtattctctgagtcccagctt

SEQ ID NO: 288855 - DNA, 25 bp, Rattus norvegicus
gaaagtatttctactcatctgaggt

SEQ ID NO: 288856 - DNA, 25 bp, Rattus norvegicus
gaaagtatttcttctcatctgaggt

SEQ ID NO: 288857 - DNA, 25 bp, Rattus norvegicus
gaaagtcaaacaagccctcggcctc

SEQ ID NO: 288858 - DNA, 25 bp, Rattus norvegicus
gaaagtcaaacatgccctcggcctc

SEQ ID NO: 288859 - DNA, 25 bp, Rattus norvegicus
gaaagtcaaactcaccatcacctat

SEQ ID NO: 288860 - DNA, 25 bp, Rattus norvegicus
gaaagtcaaactgaccatcacctat

SEQ ID NO: 288861 - DNA, 25 bp, Rattus norvegicus
gaaagtcaaccaacagctgctcagg

SEQ ID NO: 288862 - DNA, 25 bp, Rattus norvegicus
gaaagtcaaccatcagctgctcagg

SEQ ID NO: 288863 - DNA, 25 bp, Rattus norvegicus
gaaagtcaagcccatctatttccac

SEQ ID NO: 288864 - DNA, 25 bp, Rattus norvegicus
gaaagtcaagccgatctatttccac

SEQ ID NO: 288865 - DNA, 25 bp, Rattus norvegicus
gaaagtcaatttccaggctcctaga

SEQ ID NO: 288866 - DNA, 25 bp, Rattus norvegicus
gaaagtcaatttgcaggctcctaga

SEQ ID NO: 288867 - DNA, 25 bp, Rattus norvegicus
gaaagtcacacaagatacctgaaaa

SEQ ID NO: 288868 - DNA, 25 bp, Rattus norvegicus
gaaagtcacacatgatacctgaaaa

SEQ ID NO: 288869 - DNA, 25 bp, Rattus norvegicus
gaaagtcacactagtaacagctccg

SEQ ID NO: 288870 - DNA, 25 bp, Rattus norvegicus
gaaagtcacacttgtaacagctccg

SEQ ID NO: 288871 - DNA, 25 bp, Rattus norvegicus
gaaagtcacagaccaatccccaaga

SEQ ID NO: 288872 - DNA, 25 bp, Rattus norvegicus
gaaagtcacagagcaatccccaaga

SEQ ID NO: 288873 - DNA, 25 bp, Rattus norvegicus
gaaagtcacagccaagtccatgttt

SEQ ID NO: 288874 - DNA, 25 bp, Rattus norvegicus
gaaagtcacagcgaagtccatgttt

SEQ ID NO: 288875 - DNA, 25 bp, Rattus norvegicus
gaaagtcaccaaaagccggcgggcc

SEQ ID NO: 288876 - DNA, 25 bp, Rattus norvegicus
gaaagtcaccaatagccggcgggcc

SEQ ID NO: 288877 - DNA, 25 bp, Rattus norvegicus
gaaagtcaccataccttggtcttat

SEQ ID NO: 288878 - DNA, 25 bp, Rattus norvegicus
gaaagtcaccattccttggtcttat

SEQ ID NO: 288879 - DNA, 25 bp, Rattus norvegicus
gaaagtcacctcaaaataaatgcag

SEQ ID NO: 288880 - DNA, 25 bp, Rattus norvegicus
gaaagtcacctctaaataaatgcag

SEQ ID NO: 288881 - DNA, 25 bp, Rattus norvegicus
gaaagtcacggtcccaacatgaagc

SEQ ID NO: 288882 - DNA, 25 bp, Rattus norvegicus
gaaagtcacggtgccaacatgaagc

SEQ ID NO: 288883 - DNA, 25 bp, Rattus norvegicus
gaaagtcactttcttctgtgggcct

SEQ ID NO: 288884 - DNA, 25 bp, Rattus norvegicus
gaaagtcactttgttctgtgggcct

SEQ ID NO: 288885 - DNA, 25 bp, Rattus norvegicus
gaaagtcagacaccgggcactacca

SEQ ID NO: 288886 - DNA, 25 bp, Rattus norvegicus
gaaagtcagacagcgggcactacca

SEQ ID NO: 288887 - DNA, 25 bp, Rattus norvegicus
gaaagtcagctcatcgtgcactcaa

SEQ ID NO: 288888 - DNA, 25 bp, Rattus norvegicus
gaaagtcagctcttcgtgcactcaa

SEQ ID NO: 288889 - DNA, 25 bp, Rattus norvegicus
gaaagtcagcttcccttgtttttgt

SEQ ID NO: 288890 - DNA, 25 bp, Rattus norvegicus
gaaagtcagcttcctgtgggatgat

SEQ ID NO: 288891 - DNA, 25 bp, Rattus norvegicus
gaaagtcagcttgccttgtttttgt

SEQ ID NO: 288892 - DNA, 25 bp, Rattus norvegicus
gaaagtcagcttgctgtgggatgat

SEQ ID NO: 288893 - DNA, 25 bp, Rattus norvegicus
gaaagtcaggacacaaggctacaac

SEQ ID NO: 288894 - DNA, 25 bp, Rattus norvegicus
gaaagtcaggactcaaggctacaac

SEQ ID NO: 288895 - DNA, 25 bp, Rattus norvegicus
gaaagtcaggttcgtggcctacacg

SEQ ID NO: 288896 - DNA, 25 bp, Rattus norvegicus
gaaagtcaggttggtggcctacacg

SEQ ID NO: 288897 - DNA, 25 bp, Rattus norvegicus
gaaagtcagtatactttaagaccct

SEQ ID NO: 288898 - DNA, 25 bp, Rattus norvegicus
gaaagtcagtattctttaagaccct

SEQ ID NO: 288899 - DNA, 25 bp, Rattus norvegicus
gaaagtcatctcaagaccacttgca

SEQ ID NO: 288900 - DNA, 25 bp, Rattus norvegicus
gaaagtcatctcaaggatctccaag

SEQ ID NO: 288901 - DNA, 25 bp, Rattus norvegicus
gaaagtcatctcctatctgtgacct

SEQ ID NO: 288902 - DNA, 25 bp, Rattus norvegicus
gaaagtcatctcgtatctgtgacct

SEQ ID NO: 288903 - DNA, 25 bp, Rattus norvegicus
gaaagtcatctctagaccacttgca

SEQ ID NO: 288904 - DNA, 25 bp, Rattus norvegicus
gaaagtcatctctaggatctccaag

SEQ ID NO: 288905 - DNA, 25 bp, Rattus norvegicus
gaaagtcatctgatagcctatgtgt

SEQ ID NO: 288906 - DNA, 25 bp, Rattus norvegicus
gaaagtcatctgttagcctatgtgt

SEQ ID NO: 288907 - DNA, 25 bp, Rattus norvegicus
gaaagtcatgtccaaatttcaattt

SEQ ID NO: 288908 - DNA, 25 bp, Rattus norvegicus
gaaagtcatgtcgaaatttcaattt

SEQ ID NO: 288909 - DNA, 25 bp, Rattus norvegicus
gaaagtcattaaccttgagtaacaa

SEQ ID NO: 288910 - DNA, 25 bp, Rattus norvegicus
gaaagtcattaagcttgagtaacaa

SEQ ID NO: 288911 - DNA, 25 bp, Rattus norvegicus
gaaagtcattgaaagccgagcccaa

SEQ ID NO: 288912 - DNA, 25 bp, Rattus norvegicus
gaaagtcattgacattcctgtaata

SEQ ID NO: 288913 - DNA, 25 bp, Rattus norvegicus
gaaagtcattgagattcctgtaata

SEQ ID NO: 288914 - DNA, 25 bp, Rattus norvegicus
gaaagtcattgatagccgagcccaa

SEQ ID NO: 288915 - DNA, 25 bp, Rattus norvegicus
gaaagtcatttgcattctgttctta

SEQ ID NO: 288916 - DNA, 25 bp, Rattus norvegicus
gaaagtcatttggattctgttctta

SEQ ID NO: 288917 - DNA, 25 bp, Rattus norvegicus
gaaagtccaccaccataacaatcaa

SEQ ID NO: 288918 - DNA, 25 bp, Rattus norvegicus
gaaagtccaccagcataacaatcaa

SEQ ID NO: 288919 - DNA, 25 bp, Rattus norvegicus
gaaagtccaccccaggtgtcagtga

SEQ ID NO: 288920 - DNA, 25 bp, Rattus norvegicus
gaaagtccacccgaggtgtcagtga

SEQ ID NO: 288921 - DNA, 25 bp, Rattus norvegicus
gaaagtccaggacataccgtcatct

SEQ ID NO: 288922 - DNA, 25 bp, Rattus norvegicus
gaaagtccaggagataccgtcatct

SEQ ID NO: 288923 - DNA, 25 bp, Rattus norvegicus
gaaagtccatgcagtacaagccaaa

SEQ ID NO: 288924 - DNA, 25 bp, Rattus norvegicus
gaaagtccatgctgtacaagccaaa

SEQ ID NO: 288925 - DNA, 25 bp, Rattus norvegicus
gaaagtcccatcactgtatggataa

SEQ ID NO: 288926 - DNA, 25 bp, Rattus norvegicus
gaaagtcccatctctgtatggataa

SEQ ID NO: 288927 - DNA, 25 bp, Rattus norvegicus
gaaagtcccattactgtgacgtcct

SEQ ID NO: 288928 - DNA, 25 bp, Rattus norvegicus
gaaagtcccatttctgtgacgtcct

SEQ ID NO: 288929 - DNA, 25 bp, Rattus norvegicus
gaaagtcccgaaaagaccttgcagt

SEQ ID NO: 288930 - DNA, 25 bp, Rattus norvegicus
gaaagtcccgaatagaccttgcagt

SEQ ID NO: 288931 - DNA, 25 bp, Rattus norvegicus
gaaagtcccggaagcaacatagaat

SEQ ID NO: 288932 - DNA, 25 bp, Rattus norvegicus
gaaagtcccggatgcaacatagaat

SEQ ID NO: 288933 - DNA, 25 bp, Rattus norvegicus
gaaagtccctatataatctaatccc

SEQ ID NO: 288934 - DNA, 25 bp, Rattus norvegicus
gaaagtccctatttaatctaatccc

SEQ ID NO: 288935 - DNA, 25 bp, Rattus norvegicus
gaaagtcccttaagcaaagcccatt

SEQ ID NO: 288936 - DNA, 25 bp, Rattus norvegicus
gaaagtcccttatgcaaagcccatt

SEQ ID NO: 288937 - DNA, 25 bp, Rattus norvegicus
gaaagtccgaaacactctgatccca

SEQ ID NO: 288938 - DNA, 25 bp, Rattus norvegicus
gaaagtccgaaagactctgatccca

SEQ ID NO: 288939 - DNA, 25 bp, Rattus norvegicus
gaaagtccgcttccgttaggcataa

SEQ ID NO: 288940 - DNA, 25 bp, Rattus norvegicus
gaaagtccgcttgcgttaggcataa

SEQ ID NO: 288941 - DNA, 25 bp, Rattus norvegicus
gaaagtcctatcatacccacatatt

SEQ ID NO: 288942 - DNA, 25 bp, Rattus norvegicus
gaaagtcctatcttacccacatatt

SEQ ID NO: 288943 - DNA, 25 bp, Rattus norvegicus
gaaagtcctcagaagagctattcta

SEQ ID NO: 288944 - DNA, 25 bp, Rattus norvegicus
gaaagtcctcagtagagctattcta

SEQ ID NO: 288945 - DNA, 25 bp, Rattus norvegicus
gaaagtcctgaaaggttcgctaacc

SEQ ID NO: 288946 - DNA, 25 bp, Rattus norvegicus
gaaagtcctgaaatttgtagctaaa

SEQ ID NO: 288947 - DNA, 25 bp, Rattus norvegicus
gaaagtcctgaatggttcgctaacc

SEQ ID NO: 288948 - DNA, 25 bp, Rattus norvegicus
gaaagtcctgaattttgtagctaaa

SEQ ID NO: 288949 - DNA, 25 bp, Rattus norvegicus
gaaagtcctgctagtattcagtttc

SEQ ID NO: 288950 - DNA, 25 bp, Rattus norvegicus
gaaagtcctgcttgtattcagtttc

SEQ ID NO: 288951 - DNA, 25 bp, Rattus norvegicus
gaaagtcctgttatctgattccgct

SEQ ID NO: 288952 - DNA, 25 bp, Rattus norvegicus
gaaagtcctgttttctgattccgct

SEQ ID NO: 288953 - DNA, 25 bp, Rattus norvegicus
gaaagtccttaccagtttcaccgat

SEQ ID NO: 288954 - DNA, 25 bp, Rattus norvegicus
gaaagtccttacgagtttcaccgat

SEQ ID NO: 288955 - DNA, 25 bp, Rattus norvegicus
gaaagtccttcgatggcttctaagt

SEQ ID NO: 288956 - DNA, 25 bp, Rattus norvegicus
gaaagtccttcgttggcttctaagt

SEQ ID NO: 288957 - DNA, 25 bp, Rattus norvegicus
gaaagtcgacacaggcacagccgaa

SEQ ID NO: 288958 - DNA, 25 bp, Rattus norvegicus
gaaagtcgacactggcacagccgaa

SEQ ID NO: 288959 - DNA, 25 bp, Rattus norvegicus
gaaagtcgagctcttagttccaaag

SEQ ID NO: 288960 - DNA, 25 bp, Rattus norvegicus
gaaagtcgagctgttagttccaaag

SEQ ID NO: 288961 - DNA, 25 bp, Rattus norvegicus
gaaagtcgctcaagcagaccaggaa

SEQ ID NO: 288962 - DNA, 25 bp, Rattus norvegicus
gaaagtcgctcatgcagaccaggaa

SEQ ID NO: 288963 - DNA, 25 bp, Rattus norvegicus
gaaagtcggcatcatgtctgtccgt

SEQ ID NO: 288964 - DNA, 25 bp, Rattus norvegicus
gaaagtcggcatgatgtctgtccgt

SEQ ID NO: 288965 - DNA, 25 bp, Rattus norvegicus
gaaagtcggtatatgctgctgagaa

SEQ ID NO: 288966 - DNA, 25 bp, Rattus norvegicus
gaaagtcggtatttgctgctgagaa

SEQ ID NO: 288967 - DNA, 25 bp, Rattus norvegicus
gaaagtctacagcacgtcacatctt

SEQ ID NO: 288968 - DNA, 25 bp, Rattus norvegicus
gaaagtctacaggacgtcacatctt

SEQ ID NO: 288969 - DNA, 25 bp, Rattus norvegicus
gaaagtctacatcgagccgggagat

SEQ ID NO: 288970 - DNA, 25 bp, Rattus norvegicus
gaaagtctacatggagccgggagat

SEQ ID NO: 288971 - DNA, 25 bp, Rattus norvegicus
gaaagtctaccacccattggtgcta

SEQ ID NO: 288972 - DNA, 25 bp, Rattus norvegicus
gaaagtctaccagccattggtgcta

SEQ ID NO: 288973 - DNA, 25 bp, Rattus norvegicus
gaaagtctacttcgtgctccagaag

SEQ ID NO: 288974 - DNA, 25 bp, Rattus norvegicus
gaaagtctacttggtgctccagaag

SEQ ID NO: 288975 - DNA, 25 bp, Rattus norvegicus
gaaagtctagccatgttcctggatg

SEQ ID NO: 288976 - DNA, 25 bp, Rattus norvegicus
gaaagtctagccttgttcctggatg

SEQ ID NO: 288977 - DNA, 25 bp, Rattus norvegicus
gaaagtctatgcataggccagtcag

SEQ ID NO: 288978 - DNA, 25 bp, Rattus norvegicus
gaaagtctatgcttaggccagtcag

SEQ ID NO: 288979 - DNA, 25 bp, Rattus norvegicus
gaaagtctccaaaactcgtgggaag

SEQ ID NO: 288980 - DNA, 25 bp, Rattus norvegicus
gaaagtctccaatactcgtgggaag

SEQ ID NO: 288981 - DNA, 25 bp, Rattus norvegicus
gaaagtctccagaataactaccgtg

SEQ ID NO: 288982 - DNA, 25 bp, Rattus norvegicus
gaaagtctccagtataactaccgtg

SEQ ID NO: 288983 - DNA, 25 bp, Rattus norvegicus
gaaagtctcccaaatctattcagtg

SEQ ID NO: 288984 - DNA, 25 bp, Rattus norvegicus
gaaagtctcccatatctattcagtg

SEQ ID NO: 288985 - DNA, 25 bp, Rattus norvegicus
gaaagtctcctcacgactggtgctt

SEQ ID NO: 288986 - DNA, 25 bp, Rattus norvegicus
gaaagtctcctctcgactggtgctt

SEQ ID NO: 288987 - DNA, 25 bp, Rattus norvegicus
gaaagtctcctgctttcactgcggt

SEQ ID NO: 288988 - DNA, 25 bp, Rattus norvegicus
gaaagtctcctggtttcactgcggt

SEQ ID NO: 288989 - DNA, 25 bp, Rattus norvegicus
gaaagtctctagagttggccatccc

SEQ ID NO: 288990 - DNA, 25 bp, Rattus norvegicus
gaaagtctctagtgttggccatccc

SEQ ID NO: 288991 - DNA, 25 bp, Rattus norvegicus
gaaagtctctatcggttcctgttct

SEQ ID NO: 288992 - DNA, 25 bp, Rattus norvegicus
gaaagtctctatgggttcctgttct

SEQ ID NO: 288993 - DNA, 25 bp, Rattus norvegicus
gaaagtctctccaggttgaaatagt

SEQ ID NO: 288994 - DNA, 25 bp, Rattus norvegicus
gaaagtctctcctggttgaaatagt

SEQ ID NO: 288995 - DNA, 25 bp, Rattus norvegicus
gaaagtctctgtcgccttaagctag

SEQ ID NO: 288996 - DNA, 25 bp, Rattus norvegicus
gaaagtctctgtggccttaagctag

SEQ ID NO: 288997 - DNA, 25 bp, Rattus norvegicus
gaaagtctcttcaaaacagtcctgt

SEQ ID NO: 288998 - DNA, 25 bp, Rattus norvegicus
gaaagtctcttcaatccatgttatt

SEQ ID NO: 288999 - DNA, 25 bp, Rattus norvegicus
gaaagtctcttctaaacagtcctgt

SEQ ID NO: 289000 - DNA, 25 bp, Rattus norvegicus
gaaagtctcttctatccatgttatt

SEQ ID NO: 289001 - DNA, 25 bp, Rattus norvegicus
gaaagtctgcaactacccaatctct

SEQ ID NO: 289002 - DNA, 25 bp, Rattus norvegicus
gaaagtctgcaagtacccaatctct

SEQ ID NO: 289003 - DNA, 25 bp, Rattus norvegicus
gaaagtctgcacaacattttactgt

SEQ ID NO: 289004 - DNA, 25 bp, Rattus norvegicus
gaaagtctgcacagaagctgcgaat

SEQ ID NO: 289005 - DNA, 25 bp, Rattus norvegicus
gaaagtctgcactacattttactgt

SEQ ID NO: 289006 - DNA, 25 bp, Rattus norvegicus
gaaagtctgcactgaagctgcgaat

SEQ ID NO: 289007 - DNA, 25 bp, Rattus norvegicus
gaaagtctgcccaagctttccaaga

SEQ ID NO: 289008 - DNA, 25 bp, Rattus norvegicus
gaaagtctgccctagctttccaaga

SEQ ID NO: 289009 - DNA, 25 bp, Rattus norvegicus
gaaagtctgcttagagccatggagt

SEQ ID NO: 289010 - DNA, 25 bp, Rattus norvegicus
gaaagtctgctttgagccatggagt

SEQ ID NO: 289011 - DNA, 25 bp, Rattus norvegicus
gaaagtctgtaacttgggtgcaaat

SEQ ID NO: 289012 - DNA, 25 bp, Rattus norvegicus
gaaagtctgtaagttgggtgcaaat

SEQ ID NO: 289013 - DNA, 25 bp, Rattus norvegicus
gaaagtctgtgtcttctcttaatta

SEQ ID NO: 289014 - DNA, 25 bp, Rattus norvegicus
gaaagtctgtgtgttctcttaatta

SEQ ID NO: 289015 - DNA, 25 bp, Rattus norvegicus
gaaagtcttaatagtattggctttt

SEQ ID NO: 289016 - DNA, 25 bp, Rattus norvegicus
gaaagtcttaattgtattggctttt

SEQ ID NO: 289017 - DNA, 25 bp, Rattus norvegicus
gaaagtcttccaaatgagtttacct

SEQ ID NO: 289018 - DNA, 25 bp, Rattus norvegicus
gaaagtcttccatatgagtttacct

SEQ ID NO: 289019 - DNA, 25 bp, Rattus norvegicus
gaaagtcttcctcataagtgctaca

SEQ ID NO: 289020 - DNA, 25 bp, Rattus norvegicus
gaaagtcttcctgataagtgctaca

SEQ ID NO: 289021 - DNA, 25 bp, Rattus norvegicus
gaaagtcttctgatcaccgtgctgt

SEQ ID NO: 289022 - DNA, 25 bp, Rattus norvegicus
gaaagtcttctgttcaccgtgctgt

SEQ ID NO: 289023 - DNA, 25 bp, Rattus norvegicus
gaaagtcttcttcggcatttgatga

SEQ ID NO: 289024 - DNA, 25 bp, Rattus norvegicus
gaaagtcttcttgggcatttgatga

SEQ ID NO: 289025 - DNA, 25 bp, Rattus norvegicus
gaaagtcttgagataaactcttaga

SEQ ID NO: 289026 - DNA, 25 bp, Rattus norvegicus
gaaagtcttgagttaaactcttaga

SEQ ID NO: 289027 - DNA, 25 bp, Rattus norvegicus
gaaagtcttgtgaccagagcaatgg

SEQ ID NO: 289028 - DNA, 25 bp, Rattus norvegicus
gaaagtcttgtgtccagagcaatgg

SEQ ID NO: 289029 - DNA, 25 bp, Rattus norvegicus
gaaagtctttaaatctgtccggcag

SEQ ID NO: 289030 - DNA, 25 bp, Rattus norvegicus
gaaagtctttaattctgtccggcag

SEQ ID NO: 289031 - DNA, 25 bp, Rattus norvegicus
gaaagtctttatacatggtgccaaa

SEQ ID NO: 289032 - DNA, 25 bp, Rattus norvegicus
gaaagtctttattcatggtgccaaa

SEQ ID NO: 289033 - DNA, 25 bp, Rattus norvegicus
gaaagtctttgaaatgtgttcatat

SEQ ID NO: 289034 - DNA, 25 bp, Rattus norvegicus
gaaagtctttgatatgtgttcatat

SEQ ID NO: 289035 - DNA, 25 bp, Rattus norvegicus
gaaagtctttgtccctgatgagcag

SEQ ID NO: 289036 - DNA, 25 bp, Rattus norvegicus
gaaagtctttgtgcctgatgagcag

SEQ ID NO: 289037 - DNA, 25 bp, Rattus norvegicus
gaaagtgaaccgatccgtctacgct

SEQ ID NO: 289038 - DNA, 25 bp, Rattus norvegicus
gaaagtgaaccgttccgtctacgct

SEQ ID NO: 289039 - DNA, 25 bp, Rattus norvegicus
gaaagtgaactacaggccaggacct

SEQ ID NO: 289040 - DNA, 25 bp, Rattus norvegicus
gaaagtgaactagaggccaggacct

SEQ ID NO: 289041 - DNA, 25 bp, Rattus norvegicus
gaaagtgaagccctacaccttggct

SEQ ID NO: 289042 - DNA, 25 bp, Rattus norvegicus
gaaagtgaagccgtacaccttggct

SEQ ID NO: 289043 - DNA, 25 bp, Rattus norvegicus
gaaagtgaatggctccagtccttcc

SEQ ID NO: 289044 - DNA, 25 bp, Rattus norvegicus
gaaagtgaatgggtccagtccttcc

SEQ ID NO: 289045 - DNA, 25 bp, Rattus norvegicus
gaaagtgacagcatcctctaccaga

SEQ ID NO: 289046 - DNA, 25 bp, Rattus norvegicus
gaaagtgacagcttcctctaccaga

SEQ ID NO: 289047 - DNA, 25 bp, Rattus norvegicus
gaaagtgaccatctataacccatca

SEQ ID NO: 289048 - DNA, 25 bp, Rattus norvegicus
gaaagtgaccatgtataacccatca

SEQ ID NO: 289049 - DNA, 25 bp, Rattus norvegicus
gaaagtgaccccaatacatcttgct

SEQ ID NO: 289050 - DNA, 25 bp, Rattus norvegicus
gaaagtgacccctatacatcttgct

SEQ ID NO: 289051 - DNA, 25 bp, Rattus norvegicus
gaaagtgacctcagtacatcgtgac

SEQ ID NO: 289052 - DNA, 25 bp, Rattus norvegicus
gaaagtgacctctgtacatcgtgac

SEQ ID NO: 289053 - DNA, 25 bp, Rattus norvegicus
gaaagtgacgcgagcacatgcctgc

SEQ ID NO: 289054 - DNA, 25 bp, Rattus norvegicus
gaaagtgacgcgtgcacatgcctgc

SEQ ID NO: 289055 - DNA, 25 bp, Rattus norvegicus
gaaagtgacgctagtccagcagttt

SEQ ID NO: 289056 - DNA, 25 bp, Rattus norvegicus
gaaagtgacgctcggttgtttcttt

SEQ ID NO: 289057 - DNA, 25 bp, Rattus norvegicus
gaaagtgacgctgggttgtttcttt

SEQ ID NO: 289058 - DNA, 25 bp, Rattus norvegicus
gaaagtgacgcttgtccagcagttt

SEQ ID NO: 289059 - DNA, 25 bp, Rattus norvegicus
gaaagtgactacacaggtttgttat

SEQ ID NO: 289060 - DNA, 25 bp, Rattus norvegicus
gaaagtgactactcaggtttgttat

SEQ ID NO: 289061 - DNA, 25 bp, Rattus norvegicus
gaaagtgactccatgttgtccgaat

SEQ ID NO: 289062 - DNA, 25 bp, Rattus norvegicus
gaaagtgactccttgttgtccgaat

SEQ ID NO: 289063 - DNA, 25 bp, Rattus norvegicus
gaaagtgactgcctgaatgacatga

SEQ ID NO: 289064 - DNA, 25 bp, Rattus norvegicus
gaaagtgactgcgtgaatgacatga

SEQ ID NO: 289065 - DNA, 25 bp, Rattus norvegicus
gaaagtgactgtcatcaccaagcat

SEQ ID NO: 289066 - DNA, 25 bp, Rattus norvegicus
gaaagtgactgtgatcaccaagcat

SEQ ID NO: 289067 - DNA, 25 bp, Rattus norvegicus
gaaagtgagactcgttcagactttt

SEQ ID NO: 289068 - DNA, 25 bp, Rattus norvegicus
gaaagtgagactggttcagactttt

SEQ ID NO: 289069 - DNA, 25 bp, Rattus norvegicus
gaaagtgaggacagcctatccatca

SEQ ID NO: 289070 - DNA, 25 bp, Rattus norvegicus
gaaagtgaggactgcctatccatca

SEQ ID NO: 289071 - DNA, 25 bp, Rattus norvegicus
gaaagtgaggcaacctgcaggctcc

SEQ ID NO: 289072 - DNA, 25 bp, Rattus norvegicus
gaaagtgaggcatcctgcaggctcc

SEQ ID NO: 289073 - DNA, 25 bp, Rattus norvegicus
gaaagtgagtatccggctgcaccgt

SEQ ID NO: 289074 - DNA, 25 bp, Rattus norvegicus
gaaagtgagtatgcggctgcaccgt

SEQ ID NO: 289075 - DNA, 25 bp, Rattus norvegicus
gaaagtgcaaccagtaagtgaaaac

SEQ ID NO: 289076 - DNA, 25 bp, Rattus norvegicus
gaaagtgcaacctgtaagtgaaaac

SEQ ID NO: 289077 - DNA, 25 bp, Rattus norvegicus
gaaagtgcaactctagtatcccttg

SEQ ID NO: 289078 - DNA, 25 bp, Rattus norvegicus
gaaagtgcaactgtagtatcccttg

SEQ ID NO: 289079 - DNA, 25 bp, Rattus norvegicus
gaaagtgcaagtcttcagtctccca

SEQ ID NO: 289080 - DNA, 25 bp, Rattus norvegicus
gaaagtgcaagtgttcagtctccca

SEQ ID NO: 289081 - DNA, 25 bp, Rattus norvegicus
gaaagtgcaccactgaccaaacctt

SEQ ID NO: 289082 - DNA, 25 bp, Rattus norvegicus
gaaagtgcaccagtgaccaaacctt

SEQ ID NO: 289083 - DNA, 25 bp, Rattus norvegicus
gaaagtgcagccacaatggcagtgg

SEQ ID NO: 289084 - DNA, 25 bp, Rattus norvegicus
gaaagtgcagcctcaatggcagtgg

SEQ ID NO: 289085 - DNA, 25 bp, Rattus norvegicus
gaaagtgcattacaccaccagtagg

SEQ ID NO: 289086 - DNA, 25 bp, Rattus norvegicus
gaaagtgcattagaccaccagtagg

SEQ ID NO: 289087 - DNA, 25 bp, Rattus norvegicus
gaaagtgcattccagatcctatttt

SEQ ID NO: 289088 - DNA, 25 bp, Rattus norvegicus
gaaagtgcattcgagatcctatttt

SEQ ID NO: 289089 - DNA, 25 bp, Rattus norvegicus
gaaagtgcatttcctcgggtgagaa

SEQ ID NO: 289090 - DNA, 25 bp, Rattus norvegicus
gaaagtgcatttgctcgggtgagaa

SEQ ID NO: 289091 - DNA, 25 bp, Rattus norvegicus
gaaagtgccagccaatgagcagtca

SEQ ID NO: 289092 - DNA, 25 bp, Rattus norvegicus
gaaagtgccagcgaatgagcagtca

SEQ ID NO: 289093 - DNA, 25 bp, Rattus norvegicus
gaaagtgcccggattcagagagcat

SEQ ID NO: 289094 - DNA, 25 bp, Rattus norvegicus
gaaagtgcccggtttcagagagcat

SEQ ID NO: 289095 - DNA, 25 bp, Rattus norvegicus
gaaagtgcccgtcgaagccaataga

SEQ ID NO: 289096 - DNA, 25 bp, Rattus norvegicus
gaaagtgcccgtggaagccaataga

SEQ ID NO: 289097 - DNA, 25 bp, Rattus norvegicus
gaaagtgctcctctcacagttaagg

SEQ ID NO: 289098 - DNA, 25 bp, Rattus norvegicus
gaaagtgctcctgtcacagttaagg

SEQ ID NO: 289099 - DNA, 25 bp, Rattus norvegicus
gaaagtgctgccaacaatctgagat

SEQ ID NO: 289100 - DNA, 25 bp, Rattus norvegicus
gaaagtgctgcctacaatctgagat

SEQ ID NO: 289101 - DNA, 25 bp, Rattus norvegicus
gaaagtgcttaccacatgaacatga

SEQ ID NO: 289102 - DNA, 25 bp, Rattus norvegicus
gaaagtgcttacgacatgaacatga

SEQ ID NO: 289103 - DNA, 25 bp, Rattus norvegicus
gaaagtgcttagatcgctccgaggt

SEQ ID NO: 289104 - DNA, 25 bp, Rattus norvegicus
gaaagtgcttagttcgctccgaggt

SEQ ID NO: 289105 - DNA, 25 bp, Rattus norvegicus
gaaagtggaccacttcctttgggag

SEQ ID NO: 289106 - DNA, 25 bp, Rattus norvegicus
gaaagtggaccagttcctttgggag

SEQ ID NO: 289107 - DNA, 25 bp, Rattus norvegicus
gaaagtggaccccaaggttgcattt

SEQ ID NO: 289108 - DNA, 25 bp, Rattus norvegicus
gaaagtggacccgaaggttgcattt

SEQ ID NO: 289109 - DNA, 25 bp, Rattus norvegicus
gaaagtggcacaaccccagaatgaa

SEQ ID NO: 289110 - DNA, 25 bp, Rattus norvegicus
gaaagtggcacaagccaaagaagaa

SEQ ID NO: 289111 - DNA, 25 bp, Rattus norvegicus
gaaagtggcacatccccagaatgaa

SEQ ID NO: 289112 - DNA, 25 bp, Rattus norvegicus
gaaagtggcacatgccaaagaagaa

SEQ ID NO: 289113 - DNA, 25 bp, Rattus norvegicus
gaaagtggcactaccaaatccatag

SEQ ID NO: 289114 - DNA, 25 bp, Rattus norvegicus
gaaagtggcacttccaaatccatag

SEQ ID NO: 289115 - DNA, 25 bp, Rattus norvegicus
gaaagtggcatcatccctaagttcc

SEQ ID NO: 289116 - DNA, 25 bp, Rattus norvegicus
gaaagtggcatccagctctgctcca

SEQ ID NO: 289117 - DNA, 25 bp, Rattus norvegicus
gaaagtggcatcgagctctgctcca

SEQ ID NO: 289118 - DNA, 25 bp, Rattus norvegicus
gaaagtggcatcttccctaagttcc

SEQ ID NO: 289119 - DNA, 25 bp, Rattus norvegicus
gaaagtggcctgatgtcagctgcaa

SEQ ID NO: 289120 - DNA, 25 bp, Rattus norvegicus
gaaagtggcctgttgtcagctgcaa

SEQ ID NO: 289121 - DNA, 25 bp, Rattus norvegicus
gaaagtggcttaatgtccctctttt

SEQ ID NO: 289122 - DNA, 25 bp, Rattus norvegicus
gaaagtggcttattgtccctctttt

SEQ ID NO: 289123 - DNA, 25 bp, Rattus norvegicus
gaaagtgggagtcccctccctacat

SEQ ID NO: 289124 - DNA, 25 bp, Rattus norvegicus
gaaagtgggagtgccctccctacat

SEQ ID NO: 289125 - DNA, 25 bp, Rattus norvegicus
gaaagtgggctcatttgacgacagc

SEQ ID NO: 289126 - DNA, 25 bp, Rattus norvegicus
gaaagtgggctcttttgacgacagc

SEQ ID NO: 289127 - DNA, 25 bp, Rattus norvegicus
gaaagtgggtaccattctctcaggc

SEQ ID NO: 289128 - DNA, 25 bp, Rattus norvegicus
gaaagtgggtacgattctctcaggc

SEQ ID NO: 289129 - DNA, 25 bp, Rattus norvegicus
gaaagtggtacgatgccttcctgac

SEQ ID NO: 289130 - DNA, 25 bp, Rattus norvegicus
gaaagtggtacgttgccttcctgac

SEQ ID NO: 289131 - DNA, 25 bp, Rattus norvegicus
gaaagtggttctcatcaaaattgtt

SEQ ID NO: 289132 - DNA, 25 bp, Rattus norvegicus
gaaagtggttctgatcaaaattgtt

SEQ ID NO: 289133 - DNA, 25 bp, Rattus norvegicus
gaaagtggttgtagtcccttaacat

SEQ ID NO: 289134 - DNA, 25 bp, Rattus norvegicus
gaaagtggttgttgtcccttaacat

SEQ ID NO: 289135 - DNA, 25 bp, Rattus norvegicus
gaaagtggttttccgtgagttcacg

SEQ ID NO: 289136 - DNA, 25 bp, Rattus norvegicus
gaaagtggttttgcgtgagttcacg

SEQ ID NO: 289137 - DNA, 25 bp, Rattus norvegicus
gaaagtgtaaccatttgtgacgtgt

SEQ ID NO: 289138 - DNA, 25 bp, Rattus norvegicus
gaaagtgtaaccttttgtgacgtgt

SEQ ID NO: 289139 - DNA, 25 bp, Rattus norvegicus
gaaagtgtacagagccacctggctg

SEQ ID NO: 289140 - DNA, 25 bp, Rattus norvegicus
gaaagtgtacagtgccacctggctg

SEQ ID NO: 289141 - DNA, 25 bp, Rattus norvegicus
gaaagtgtatgtcagggcaagccta

SEQ ID NO: 289142 - DNA, 25 bp, Rattus norvegicus
gaaagtgtatgtgagggcaagccta

SEQ ID NO: 289143 - DNA, 25 bp, Rattus norvegicus
gaaagtgtcagtcccagacctgtat

SEQ ID NO: 289144 - DNA, 25 bp, Rattus norvegicus
gaaagtgtcagtgccagacctgtat

SEQ ID NO: 289145 - DNA, 25 bp, Rattus norvegicus
gaaagtgtcctcagtgttttatacc

SEQ ID NO: 289146 - DNA, 25 bp, Rattus norvegicus
gaaagtgtcctctgtgttttatacc

SEQ ID NO: 289147 - DNA, 25 bp, Rattus norvegicus
gaaagtgtccttcctggtaatacct

SEQ ID NO: 289148 - DNA, 25 bp, Rattus norvegicus
gaaagtgtccttgctggtaatacct

SEQ ID NO: 289149 - DNA, 25 bp, Rattus norvegicus
gaaagtgtgagcatgcaagacaagc

SEQ ID NO: 289150 - DNA, 25 bp, Rattus norvegicus
gaaagtgtgagcttgcaagacaagc

SEQ ID NO: 289151 - DNA, 25 bp, Rattus norvegicus
gaaagtgtgcagcagctagaaaaca

SEQ ID NO: 289152 - DNA, 25 bp, Rattus norvegicus
gaaagtgtgcaggagctagaaaaca

SEQ ID NO: 289153 - DNA, 25 bp, Rattus norvegicus
gaaagtgtgccacggtaactgacca

SEQ ID NO: 289154 - DNA, 25 bp, Rattus norvegicus
gaaagtgtgccagggtaactgacca

SEQ ID NO: 289155 - DNA, 25 bp, Rattus norvegicus
gaaagtgtgctaagtgaccttccag

SEQ ID NO: 289156 - DNA, 25 bp, Rattus norvegicus
gaaagtgtgctatgtgaccttccag

SEQ ID NO: 289157 - DNA, 25 bp, Rattus norvegicus
gaaagtgtgggaccttttccctgag

SEQ ID NO: 289158 - DNA, 25 bp, Rattus norvegicus
gaaagtgtgggagcttttccctgag

SEQ ID NO: 289159 - DNA, 25 bp, Rattus norvegicus
gaaagtgttacaaatgcttttcaac

SEQ ID NO: 289160 - DNA, 25 bp, Rattus norvegicus
gaaagtgttacatatgcttttcaac

SEQ ID NO: 289161 - DNA, 25 bp, Rattus norvegicus
gaaagtgttaccactcattctcttt

SEQ ID NO: 289162 - DNA, 25 bp, Rattus norvegicus
gaaagtgttaccatcgcagtcaaat

SEQ ID NO: 289163 - DNA, 25 bp, Rattus norvegicus
gaaagtgttacctctcattctcttt

SEQ ID NO: 289164 - DNA, 25 bp, Rattus norvegicus
gaaagtgttaccttcgcagtcaaat

SEQ ID NO: 289165 - DNA, 25 bp, Rattus norvegicus
gaaagtgttattcgtcagctggcta

SEQ ID NO: 289166 - DNA, 25 bp, Rattus norvegicus
gaaagtgttattggtcagctggcta

SEQ ID NO: 289167 - DNA, 25 bp, Rattus norvegicus
gaaagtgttcatctatattcccatt

SEQ ID NO: 289168 - DNA, 25 bp, Rattus norvegicus
gaaagtgttcatgtatattcccatt

SEQ ID NO: 289169 - DNA, 25 bp, Rattus norvegicus
gaaagtgttccaccaacttccagga

SEQ ID NO: 289170 - DNA, 25 bp, Rattus norvegicus
gaaagtgttccagcaacttccagga

SEQ ID NO: 289171 - DNA, 25 bp, Rattus norvegicus
gaaagtgttcccatttggccacctt

SEQ ID NO: 289172 - DNA, 25 bp, Rattus norvegicus
gaaagtgttcccttttggccacctt

SEQ ID NO: 289173 - DNA, 25 bp, Rattus norvegicus
gaaagtgttctcatagccgtcctct

SEQ ID NO: 289174 - DNA, 25 bp, Rattus norvegicus
gaaagtgttctcttagccgtcctct

SEQ ID NO: 289175 - DNA, 25 bp, Rattus norvegicus
gaaagtgttgttcgaagtggacatt

SEQ ID NO: 289176 - DNA, 25 bp, Rattus norvegicus
gaaagtgttgttggaagtggacatt

SEQ ID NO: 289177 - DNA, 25 bp, Rattus norvegicus
gaaagtgtttttaatgctaagcaac

SEQ ID NO: 289178 - DNA, 25 bp, Rattus norvegicus
gaaagtgttttttatgctaagcaac

SEQ ID NO: 289179 - DNA, 25 bp, Rattus norvegicus
gaaagttaatggagccctgggccga

SEQ ID NO: 289180 - DNA, 25 bp, Rattus norvegicus
gaaagttaatggtgccctgggccga

SEQ ID NO: 289181 - DNA, 25 bp, Rattus norvegicus
gaaagttaatgtagccctgtggtta

SEQ ID NO: 289182 - DNA, 25 bp, Rattus norvegicus
gaaagttaatgttgccctgtggtta

SEQ ID NO: 289183 - DNA, 25 bp, Rattus norvegicus
gaaagttacagtccatttccttgct

SEQ ID NO: 289184 - DNA, 25 bp, Rattus norvegicus
gaaagttacagtgcatttccttgct

SEQ ID NO: 289185 - DNA, 25 bp, Rattus norvegicus
gaaagttacctcagttttcactcct

SEQ ID NO: 289186 - DNA, 25 bp, Rattus norvegicus
gaaagttacctctgttttcactcct

SEQ ID NO: 289187 - DNA, 25 bp, Rattus norvegicus
gaaagttacgagcactcaccccagg

SEQ ID NO: 289188 - DNA, 25 bp, Rattus norvegicus
gaaagttacgaggactcaccccagg

SEQ ID NO: 289189 - DNA, 25 bp, Rattus norvegicus
gaaagttactgtcatgagcaccatt

SEQ ID NO: 289190 - DNA, 25 bp, Rattus norvegicus
gaaagttactgtgatgagcaccatt

SEQ ID NO: 289191 - DNA, 25 bp, Rattus norvegicus
gaaagttacttgagtgtgagccaaa

SEQ ID NO: 289192 - DNA, 25 bp, Rattus norvegicus
gaaagttacttgtgtgtgagccaaa

SEQ ID NO: 289193 - DNA, 25 bp, Rattus norvegicus
gaaagttagtgtagagcctctctga

SEQ ID NO: 289194 - DNA, 25 bp, Rattus norvegicus
gaaagttagtgttgagcctctctga

SEQ ID NO: 289195 - DNA, 25 bp, Rattus norvegicus
gaaagttcaagcaggaggcctctgt

SEQ ID NO: 289196 - DNA, 25 bp, Rattus norvegicus
gaaagttcaagctggaggcctctgt

SEQ ID NO: 289197 - DNA, 25 bp, Rattus norvegicus
gaaagttcactgcactccatgtaca

SEQ ID NO: 289198 - DNA, 25 bp, Rattus norvegicus
gaaagttcactggactccatgtaca

SEQ ID NO: 289199 - DNA, 25 bp, Rattus norvegicus
gaaagttcagacaggactgcccact

SEQ ID NO: 289200 - DNA, 25 bp, Rattus norvegicus
gaaagttcagactggactgcccact

SEQ ID NO: 289201 - DNA, 25 bp, Rattus norvegicus
gaaagttcagtcactttcgctacca

SEQ ID NO: 289202 - DNA, 25 bp, Rattus norvegicus
gaaagttcagtctctttcgctacca

SEQ ID NO: 289203 - DNA, 25 bp, Rattus norvegicus
gaaagttcatatacttccatctctg

SEQ ID NO: 289204 - DNA, 25 bp, Rattus norvegicus
gaaagttcatattcttccatctctg

SEQ ID NO: 289205 - DNA, 25 bp, Rattus norvegicus
gaaagttcatggaaatggtcccaat

SEQ ID NO: 289206 - DNA, 25 bp, Rattus norvegicus
gaaagttcatggtaatggtcccaat

SEQ ID NO: 289207 - DNA, 25 bp, Rattus norvegicus
gaaagttcatttaggccagctcata

SEQ ID NO: 289208 - DNA, 25 bp, Rattus norvegicus
gaaagttcattttggccagctcata

SEQ ID NO: 289209 - DNA, 25 bp, Rattus norvegicus
gaaagttccaagatgccgggcagag

SEQ ID NO: 289210 - DNA, 25 bp, Rattus norvegicus
gaaagttccaagattgccagggata

SEQ ID NO: 289211 - DNA, 25 bp, Rattus norvegicus
gaaagttccaagttgccgggcagag

SEQ ID NO: 289212 - DNA, 25 bp, Rattus norvegicus
gaaagttccaagtttgccagggata

SEQ ID NO: 289213 - DNA, 25 bp, Rattus norvegicus
gaaagttccacacgtaacttcactt

SEQ ID NO: 289214 - DNA, 25 bp, Rattus norvegicus
gaaagttccacaggtaacttcactt

SEQ ID NO: 289215 - DNA, 25 bp, Rattus norvegicus
gaaagttccaccatgtgttctcaac

SEQ ID NO: 289216 - DNA, 25 bp, Rattus norvegicus
gaaagttccaccttgtgttctcaac

SEQ ID NO: 289217 - DNA, 25 bp, Rattus norvegicus
gaaagttccagaaccacatcaacgt

SEQ ID NO: 289218 - DNA, 25 bp, Rattus norvegicus
gaaagttccagatccacatcaacgt

SEQ ID NO: 289219 - DNA, 25 bp, Rattus norvegicus
gaaagttcccttaaagaggtgcaga

SEQ ID NO: 289220 - DNA, 25 bp, Rattus norvegicus
gaaagttccctttaagaggtgcaga

SEQ ID NO: 289221 - DNA, 25 bp, Rattus norvegicus
gaaagttcctaaccataaaaccaag

SEQ ID NO: 289222 - DNA, 25 bp, Rattus norvegicus
gaaagttcctaagcataaaaccaag

SEQ ID NO: 289223 - DNA, 25 bp, Rattus norvegicus
gaaagttcctgtactttgcactttt

SEQ ID NO: 289224 - DNA, 25 bp, Rattus norvegicus
gaaagttcctgtcgatttcagcagc

SEQ ID NO: 289225 - DNA, 25 bp, Rattus norvegicus
gaaagttcctgtggatttcagcagc

SEQ ID NO: 289226 - DNA, 25 bp, Rattus norvegicus
gaaagttcctgttctttgcactttt

SEQ ID NO: 289227 - DNA, 25 bp, Rattus norvegicus
gaaagttcctttcagtattacttgg

SEQ ID NO: 289228 - DNA, 25 bp, Rattus norvegicus
gaaagttcctttgagtattacttgg

SEQ ID NO: 289229 - DNA, 25 bp, Rattus norvegicus
gaaagttcggtcagcttctgaacaa

SEQ ID NO: 289230 - DNA, 25 bp, Rattus norvegicus
gaaagttcggtctgcttctgaacaa

SEQ ID NO: 289231 - DNA, 25 bp, Rattus norvegicus
gaaagttctaatcttcatcagcagt

SEQ ID NO: 289232 - DNA, 25 bp, Rattus norvegicus
gaaagttctaatgttcatcagcagt

SEQ ID NO: 289233 - DNA, 25 bp, Rattus norvegicus
gaaagttctacaacaactgtgctgc

SEQ ID NO: 289234 - DNA, 25 bp, Rattus norvegicus
gaaagttctacatcaactgtgctgc

SEQ ID NO: 289235 - DNA, 25 bp, Rattus norvegicus
gaaagttctactatgcgcaatagtt

SEQ ID NO: 289236 - DNA, 25 bp, Rattus norvegicus
gaaagttctactttgcgcaatagtt

SEQ ID NO: 289237 - DNA, 25 bp, Rattus norvegicus
gaaagttctccacaatgaggtgcat

SEQ ID NO: 289238 - DNA, 25 bp, Rattus norvegicus
gaaagttctccagaatgaggtgcat

SEQ ID NO: 289239 - DNA, 25 bp, Rattus norvegicus
gaaagttctgcccagagtcttcctt

SEQ ID NO: 289240 - DNA, 25 bp, Rattus norvegicus
gaaagttctgccgagagtcttcctt

SEQ ID NO: 289241 - DNA, 25 bp, Rattus norvegicus
gaaagttctgctctgcttcatccct

SEQ ID NO: 289242 - DNA, 25 bp, Rattus norvegicus
gaaagttctgctgtgcttcatccct

SEQ ID NO: 289243 - DNA, 25 bp, Rattus norvegicus
gaaagttctggcaacccacacaggg

SEQ ID NO: 289244 - DNA, 25 bp, Rattus norvegicus
gaaagttctggctacccacacaggg

SEQ ID NO: 289245 - DNA, 25 bp, Rattus norvegicus
gaaagttcttagcatcgagatggga

SEQ ID NO: 289246 - DNA, 25 bp, Rattus norvegicus
gaaagttcttaggatcgagatggga

SEQ ID NO: 289247 - DNA, 25 bp, Rattus norvegicus
gaaagttcttcccattgtacgttgt

SEQ ID NO: 289248 - DNA, 25 bp, Rattus norvegicus
gaaagttcttccgattgtacgttgt

SEQ ID NO: 289249 - DNA, 25 bp, Rattus norvegicus
gaaagttcttgacctgggtggcctt

SEQ ID NO: 289250 - DNA, 25 bp, Rattus norvegicus
gaaagttcttgagctgggtggcctt

SEQ ID NO: 289251 - DNA, 25 bp, Rattus norvegicus
gaaagttctttgcatcccaagggca

SEQ ID NO: 289252 - DNA, 25 bp, Rattus norvegicus
gaaagttctttggatcccaagggca

SEQ ID NO: 289253 - DNA, 25 bp, Rattus norvegicus
gaaagttgaccaatcatgtgtttgt

SEQ ID NO: 289254 - DNA, 25 bp, Rattus norvegicus
gaaagttgaccattcatgtgtttgt

SEQ ID NO: 289255 - DNA, 25 bp, Rattus norvegicus
gaaagttgcattagctcttctctaa

SEQ ID NO: 289256 - DNA, 25 bp, Rattus norvegicus
gaaagttgcatttgctcttctctaa

SEQ ID NO: 289257 - DNA, 25 bp, Rattus norvegicus
gaaagttgccagacgcaggatctat

SEQ ID NO: 289258 - DNA, 25 bp, Rattus norvegicus
gaaagttgccagtcgcaggatctat

SEQ ID NO: 289259 - DNA, 25 bp, Rattus norvegicus
gaaagttgccccaggacatgtgccc

SEQ ID NO: 289260 - DNA, 25 bp, Rattus norvegicus
gaaagttgcccctggacatgtgccc

SEQ ID NO: 289261 - DNA, 25 bp, Rattus norvegicus
gaaagttgcccgctgtgtaagaaaa

SEQ ID NO: 289262 - DNA, 25 bp, Rattus norvegicus
gaaagttgcccggtgtgtaagaaaa

SEQ ID NO: 289263 - DNA, 25 bp, Rattus norvegicus
gaaagttgccgtatacagcacctgc

SEQ ID NO: 289264 - DNA, 25 bp, Rattus norvegicus
gaaagttgccgtttacagcacctgc

SEQ ID NO: 289265 - DNA, 25 bp, Rattus norvegicus
gaaagttgcctccatatctctagtt

SEQ ID NO: 289266 - DNA, 25 bp, Rattus norvegicus
gaaagttgcctcgatatctctagtt

SEQ ID NO: 289267 - DNA, 25 bp, Rattus norvegicus
gaaagttgcctgagcgtgagacagt

SEQ ID NO: 289268 - DNA, 25 bp, Rattus norvegicus
gaaagttgcctgtgcgtgagacagt

SEQ ID NO: 289269 - DNA, 25 bp, Rattus norvegicus
gaaagttgctagagtctacccttaa

SEQ ID NO: 289270 - DNA, 25 bp, Rattus norvegicus
gaaagttgctagtgtctacccttaa

SEQ ID NO: 289271 - DNA, 25 bp, Rattus norvegicus
gaaagttgcttaatgcttggctgct

SEQ ID NO: 289272 - DNA, 25 bp, Rattus norvegicus
gaaagttgcttattgcttggctgct

SEQ ID NO: 289273 - DNA, 25 bp, Rattus norvegicus
gaaagttggaccctgcttgtgattt

SEQ ID NO: 289274 - DNA, 25 bp, Rattus norvegicus
gaaagttggaccgtgcttgtgattt

SEQ ID NO: 289275 - DNA, 25 bp, Rattus norvegicus
gaaagttggactcacagctggcctg

SEQ ID NO: 289276 - DNA, 25 bp, Rattus norvegicus
gaaagttggactgacagctggcctg

SEQ ID NO: 289277 - DNA, 25 bp, Rattus norvegicus
gaaagttggcaaaagcagccttcta

SEQ ID NO: 289278 - DNA, 25 bp, Rattus norvegicus
gaaagttggcaatagcagccttcta

SEQ ID NO: 289279 - DNA, 25 bp, Rattus norvegicus
gaaagttggccaatttaagattttg

SEQ ID NO: 289280 - DNA, 25 bp, Rattus norvegicus
gaaagttggccattttaagattttg

SEQ ID NO: 289281 - DNA, 25 bp, Rattus norvegicus
gaaagttggcctcagaagataagaa

SEQ ID NO: 289282 - DNA, 25 bp, Rattus norvegicus
gaaagttggcctgagaagataagaa

SEQ ID NO: 289283 - DNA, 25 bp, Rattus norvegicus
gaaagttgggctcaccttgggcacc

SEQ ID NO: 289284 - DNA, 25 bp, Rattus norvegicus
gaaagttgggctgaccttgggcacc

SEQ ID NO: 289285 - DNA, 25 bp, Rattus norvegicus
gaaagttggtagcttagttcctcaa

SEQ ID NO: 289286 - DNA, 25 bp, Rattus norvegicus
gaaagttggtaggttagttcctcaa

SEQ ID NO: 289287 - DNA, 25 bp, Rattus norvegicus
gaaagttggtgactctctgctagat

SEQ ID NO: 289288 - DNA, 25 bp, Rattus norvegicus
gaaagttggtgagtctctgctagat

SEQ ID NO: 289289 - DNA, 25 bp, Rattus norvegicus
gaaagttggttgagcctatgtaata

SEQ ID NO: 289290 - DNA, 25 bp, Rattus norvegicus
gaaagttggttgtgcctatgtaata

SEQ ID NO: 289291 - DNA, 25 bp, Rattus norvegicus
gaaagttgtcagaccctagaccaaa

SEQ ID NO: 289292 - DNA, 25 bp, Rattus norvegicus
gaaagttgtcagtccctagaccaaa

SEQ ID NO: 289293 - DNA, 25 bp, Rattus norvegicus
gaaagttgtgtcattgactcagtct

SEQ ID NO: 289294 - DNA, 25 bp, Rattus norvegicus
gaaagttgtgtctttgactcagtct

SEQ ID NO: 289295 - DNA, 25 bp, Rattus norvegicus
gaaagttgttcaacaggctctaccc

SEQ ID NO: 289296 - DNA, 25 bp, Rattus norvegicus
gaaagttgttcatcaggctctaccc

SEQ ID NO: 289297 - DNA, 25 bp, Rattus norvegicus
gaaagtttagtcctctgatccacgt

SEQ ID NO: 289298 - DNA, 25 bp, Rattus norvegicus
gaaagtttagtcgtctgatccacgt

SEQ ID NO: 289299 - DNA, 25 bp, Rattus norvegicus
gaaagtttatcaacctcactagaaa

SEQ ID NO: 289300 - DNA, 25 bp, Rattus norvegicus
gaaagtttatcatcctcactagaaa

SEQ ID NO: 289301 - DNA, 25 bp, Rattus norvegicus
gaaagtttatctctgcacaattgac

SEQ ID NO: 289302 - DNA, 25 bp, Rattus norvegicus
gaaagtttatctgtgcacaattgac

SEQ ID NO: 289303 - DNA, 25 bp, Rattus norvegicus
gaaagtttatttatgcagggaagag

SEQ ID NO: 289304 - DNA, 25 bp, Rattus norvegicus
gaaagtttatttttgcagggaagag

SEQ ID NO: 289305 - DNA, 25 bp, Rattus norvegicus
gaaagtttccagatagcgtgtggct

SEQ ID NO: 289306 - DNA, 25 bp, Rattus norvegicus
gaaagtttccagcacccgtgttcag

SEQ ID NO: 289307 - DNA, 25 bp, Rattus norvegicus
gaaagtttccaggacccgtgttcag

SEQ ID NO: 289308 - DNA, 25 bp, Rattus norvegicus
gaaagtttccagttagcgtgtggct

SEQ ID NO: 289309 - DNA, 25 bp, Rattus norvegicus
gaaagtttctcgacaccaaggatta

SEQ ID NO: 289310 - DNA, 25 bp, Rattus norvegicus
gaaagtttctcgtcaccaaggatta

SEQ ID NO: 289311 - DNA, 25 bp, Rattus norvegicus
gaaagtttgccaacccatgatctaa

SEQ ID NO: 289312 - DNA, 25 bp, Rattus norvegicus
gaaagtttgccatcccatgatctaa

SEQ ID NO: 289313 - DNA, 25 bp, Rattus norvegicus
gaaagtttgcctctatagacccaca

SEQ ID NO: 289314 - DNA, 25 bp, Rattus norvegicus
gaaagtttgcctgtatagacccaca

SEQ ID NO: 289315 - DNA, 25 bp, Rattus norvegicus
gaaagtttgcttcatccgaaatgga

SEQ ID NO: 289316 - DNA, 25 bp, Rattus norvegicus
gaaagtttgcttctccatagacaga

SEQ ID NO: 289317 - DNA, 25 bp, Rattus norvegicus
gaaagtttgcttgatccgaaatgga

SEQ ID NO: 289318 - DNA, 25 bp, Rattus norvegicus
gaaagtttgcttgtccatagacaga

SEQ ID NO: 289319 - DNA, 25 bp, Rattus norvegicus
gaaagtttgtcacccgaagctagcg

SEQ ID NO: 289320 - DNA, 25 bp, Rattus norvegicus
gaaagtttgtcagccgaagctagcg

SEQ ID NO: 289321 - DNA, 25 bp, Rattus norvegicus
gaaagtttgtctctctgtgattttg

SEQ ID NO: 289322 - DNA, 25 bp, Rattus norvegicus
gaaagtttgtctgtctgtgattttg

SEQ ID NO: 289323 - DNA, 25 bp, Rattus norvegicus
gaaagtttgttccttcatctgccgt

SEQ ID NO: 289324 - DNA, 25 bp, Rattus norvegicus
gaaagtttgttcgttcatctgccgt

SEQ ID NO: 289325 - DNA, 25 bp, Rattus norvegicus
gaaagttttcccagacagagtcagc

SEQ ID NO: 289326 - DNA, 25 bp, Rattus norvegicus
gaaagttttccctgacagagtcagc

SEQ ID NO: 289327 - DNA, 25 bp, Rattus norvegicus
gaaagttttggtactgtgcttatat

SEQ ID NO: 289328 - DNA, 25 bp, Rattus norvegicus
gaaagttttggttctgtgcttatat

SEQ ID NO: 289329 - DNA, 25 bp, Rattus norvegicus
gaaagtttttctagatgcatgcatg

SEQ ID NO: 289330 - DNA, 25 bp, Rattus norvegicus
gaaagtttttcttgatgcatgcatg

SEQ ID NO: 289331 - DNA, 25 bp, Rattus norvegicus
gaaataaaagccacaccgattttct

SEQ ID NO: 289332 - DNA, 25 bp, Rattus norvegicus
gaaataaaagcctcaccgattttct

SEQ ID NO: 289333 - DNA, 25 bp, Rattus norvegicus
gaaataaaccctacctagtcctcag

SEQ ID NO: 289334 - DNA, 25 bp, Rattus norvegicus
gaaataaacccttcctagtcctcag

SEQ ID NO: 289335 - DNA, 25 bp, Rattus norvegicus
gaaataaacctacatcctgcccagt

SEQ ID NO: 289336 - DNA, 25 bp, Rattus norvegicus
gaaataaacctagatcctgcccagt

SEQ ID NO: 289337 - DNA, 25 bp, Rattus norvegicus
gaaataaacttgactcagtcttgct

SEQ ID NO: 289338 - DNA, 25 bp, Rattus norvegicus
gaaataaacttgtctcagtcttgct

SEQ ID NO: 289339 - DNA, 25 bp, Rattus norvegicus
gaaataaagcttacccaggacaccg

SEQ ID NO: 289340 - DNA, 25 bp, Rattus norvegicus
gaaataaagctttcccaggacaccg

SEQ ID NO: 289341 - DNA, 25 bp, Rattus norvegicus
gaaataaaggcaactttcctggtgg

SEQ ID NO: 289342 - DNA, 25 bp, Rattus norvegicus
gaaataaaggcatctttcctggtgg

SEQ ID NO: 289343 - DNA, 25 bp, Rattus norvegicus
gaaataaagtatacctcctcagtca

SEQ ID NO: 289344 - DNA, 25 bp, Rattus norvegicus
gaaataaagtattcctcctcagtca

SEQ ID NO: 289345 - DNA, 25 bp, Rattus norvegicus
gaaataaagtcaccagccccagtgg

SEQ ID NO: 289346 - DNA, 25 bp, Rattus norvegicus
gaaataaagtcagcagccccagtgg

SEQ ID NO: 289347 - DNA, 25 bp, Rattus norvegicus
gaaataaagtgtccttccaaagaag

SEQ ID NO: 289348 - DNA, 25 bp, Rattus norvegicus
gaaataaagtgtgcttccaaagaag

SEQ ID NO: 289349 - DNA, 25 bp, Rattus norvegicus
gaaataacacgtccttttggtctga

SEQ ID NO: 289350 - DNA, 25 bp, Rattus norvegicus
gaaataacacgtgcttttggtctga

SEQ ID NO: 289351 - DNA, 25 bp, Rattus norvegicus
gaaataacacttcctaaactacaca

SEQ ID NO: 289352 - DNA, 25 bp, Rattus norvegicus
gaaataacacttgctaaactacaca

SEQ ID NO: 289353 - DNA, 25 bp, Rattus norvegicus
gaaataacatctacaggtgcagctt

SEQ ID NO: 289354 - DNA, 25 bp, Rattus norvegicus
gaaataacatcttcaggtgcagctt

SEQ ID NO: 289355 - DNA, 25 bp, Rattus norvegicus
gaaataaccacgacacctgagagac

SEQ ID NO: 289356 - DNA, 25 bp, Rattus norvegicus
gaaataaccacgtcacctgagagac

SEQ ID NO: 289357 - DNA, 25 bp, Rattus norvegicus
gaaataaccttcatatcacatcatg

SEQ ID NO: 289358 - DNA, 25 bp, Rattus norvegicus
gaaataaccttcttatcacatcatg

SEQ ID NO: 289359 - DNA, 25 bp, Rattus norvegicus
gaaataacgatgaggattccagctg

SEQ ID NO: 289360 - DNA, 25 bp, Rattus norvegicus
gaaataacgatgtggattccagctg

SEQ ID NO: 289361 - DNA, 25 bp, Rattus norvegicus
gaaataacggttatctgcgctgccc

SEQ ID NO: 289362 - DNA, 25 bp, Rattus norvegicus
gaaataacggttttctgcgctgccc

SEQ ID NO: 289363 - DNA, 25 bp, Rattus norvegicus
gaaataacgtctcattacctccggc

SEQ ID NO: 289364 - DNA, 25 bp, Rattus norvegicus
gaaataacgtctgattacctccggc

SEQ ID NO: 289365 - DNA, 25 bp, Rattus norvegicus
gaaataactcttaacatagctcttg

SEQ ID NO: 289366 - DNA, 25 bp, Rattus norvegicus
gaaataactctttacatagctcttg

SEQ ID NO: 289367 - DNA, 25 bp, Rattus norvegicus
gaaataacttggctcttctctctgc

SEQ ID NO: 289368 - DNA, 25 bp, Rattus norvegicus
gaaataacttgggtcttctctctgc

SEQ ID NO: 289369 - DNA, 25 bp, Rattus norvegicus
gaaataagaagaaaccctgctaggg

SEQ ID NO: 289370 - DNA, 25 bp, Rattus norvegicus
gaaataagaagataccctgctaggg

SEQ ID NO: 289371 - DNA, 25 bp, Rattus norvegicus
gaaataagagcgatcccatgagaag

SEQ ID NO: 289372 - DNA, 25 bp, Rattus norvegicus
gaaataagagcgttcccatgagaag

SEQ ID NO: 289373 - DNA, 25 bp, Rattus norvegicus
gaaataagtccaacaccatgctaga

SEQ ID NO: 289374 - DNA, 25 bp, Rattus norvegicus
gaaataagtccatcaccatgctaga

SEQ ID NO: 289375 - DNA, 25 bp, Rattus norvegicus
gaaataagtcttactattcagttct

SEQ ID NO: 289376 - DNA, 25 bp, Rattus norvegicus
gaaataagtctttctattcagttct

SEQ ID NO: 289377 - DNA, 25 bp, Rattus norvegicus
gaaataagtgttattgctgagccaa

SEQ ID NO: 289378 - DNA, 25 bp, Rattus norvegicus
gaaataagtgtttttgctgagccaa

SEQ ID NO: 289379 - DNA, 25 bp, Rattus norvegicus
gaaataagtttcactggacctctgt

SEQ ID NO: 289380 - DNA, 25 bp, Rattus norvegicus
gaaataagtttctctggacctctgt

SEQ ID NO: 289381 - DNA, 25 bp, Rattus norvegicus
gaaataataataaccaggtcaacag

SEQ ID NO: 289382 - DNA, 25 bp, Rattus norvegicus
gaaataataatatccaggtcaacag

SEQ ID NO: 289383 - DNA, 25 bp, Rattus norvegicus
gaaataatccgcagacaggtcctta

SEQ ID NO: 289384 - DNA, 25 bp, Rattus norvegicus
gaaataatccgctgacaggtcctta

SEQ ID NO: 289385 - DNA, 25 bp, Rattus norvegicus
gaaataatcgatcgcgtcctcaggg

SEQ ID NO: 289386 - DNA, 25 bp, Rattus norvegicus
gaaataatcgatggcgtcctcaggg

SEQ ID NO: 289387 - DNA, 25 bp, Rattus norvegicus
gaaataatctcaagcatcctatcaa

SEQ ID NO: 289388 - DNA, 25 bp, Rattus norvegicus
gaaataatctcatgcatcctatcaa

SEQ ID NO: 289389 - DNA, 25 bp, Rattus norvegicus
gaaataattataccatagccctggc

SEQ ID NO: 289390 - DNA, 25 bp, Rattus norvegicus
gaaataattatagcatagccctggc

SEQ ID NO: 289391 - DNA, 25 bp, Rattus norvegicus
gaaataattgctaataaggcctctg

SEQ ID NO: 289392 - DNA, 25 bp, Rattus norvegicus
gaaataattgcttataaggcctctg

SEQ ID NO: 289393 - DNA, 25 bp, Rattus norvegicus
gaaatacaaccccacagactgcgag

SEQ ID NO: 289394 - DNA, 25 bp, Rattus norvegicus
gaaatacaacccgacagactgcgag

SEQ ID NO: 289395 - DNA, 25 bp, Rattus norvegicus
gaaatacaagaactcccaaacagct

SEQ ID NO: 289396 - DNA, 25 bp, Rattus norvegicus
gaaatacaagaagtcccaaacagct

SEQ ID NO: 289397 - DNA, 25 bp, Rattus norvegicus
gaaatacaagggacactaactagag

SEQ ID NO: 289398 - DNA, 25 bp, Rattus norvegicus
gaaatacaagggtcactaactagag

SEQ ID NO: 289399 - DNA, 25 bp, Rattus norvegicus
gaaatacaagttctttgggctgtgt

SEQ ID NO: 289400 - DNA, 25 bp, Rattus norvegicus
gaaatacaagttgtttgggctgtgt

SEQ ID NO: 289401 - DNA, 25 bp, Rattus norvegicus
gaaatacacaatcttgtaatgtcaa

SEQ ID NO: 289402 - DNA, 25 bp, Rattus norvegicus
gaaatacacaatgttgtaatgtcaa

SEQ ID NO: 289403 - DNA, 25 bp, Rattus norvegicus
gaaatacaccatatggttgcctgaa

SEQ ID NO: 289404 - DNA, 25 bp, Rattus norvegicus
gaaatacaccatttggttgcctgaa

SEQ ID NO: 289405 - DNA, 25 bp, Rattus norvegicus
gaaatacacgcacatcctgatcggg

SEQ ID NO: 289406 - DNA, 25 bp, Rattus norvegicus
gaaatacacgcagatcctgatcggg

SEQ ID NO: 289407 - DNA, 25 bp, Rattus norvegicus
gaaatacactgtacccttgtcatgg

SEQ ID NO: 289408 - DNA, 25 bp, Rattus norvegicus
gaaatacactgttcccttgtcatgg

SEQ ID NO: 289409 - DNA, 25 bp, Rattus norvegicus
gaaatacactttcgagcccattcac

SEQ ID NO: 289410 - DNA, 25 bp, Rattus norvegicus
gaaatacactttggagcccattcac

SEQ ID NO: 289411 - DNA, 25 bp, Rattus norvegicus
gaaatacagatcatcacgaacatga

SEQ ID NO: 289412 - DNA, 25 bp, Rattus norvegicus
gaaatacagatcttcacgaacatga

SEQ ID NO: 289413 - DNA, 25 bp, Rattus norvegicus
gaaatacatatcatcagtgcttagc

SEQ ID NO: 289414 - DNA, 25 bp, Rattus norvegicus
gaaatacatatcttcagtgcttagc

SEQ ID NO: 289415 - DNA, 25 bp, Rattus norvegicus
gaaatacatctaccaaacgctgttt

SEQ ID NO: 289416 - DNA, 25 bp, Rattus norvegicus
gaaatacatctagcaaacgctgttt

SEQ ID NO: 289417 - DNA, 25 bp, Rattus norvegicus
gaaatacatctgactggctcagtgg

SEQ ID NO: 289418 - DNA, 25 bp, Rattus norvegicus
gaaatacatctgtctggctcagtgg

SEQ ID NO: 289419 - DNA, 25 bp, Rattus norvegicus
gaaatacatgccacaaacttgctaa

SEQ ID NO: 289420 - DNA, 25 bp, Rattus norvegicus
gaaatacatgcctcaaacttgctaa

SEQ ID NO: 289421 - DNA, 25 bp, Rattus norvegicus
gaaatacattcacggtctttgttaa

SEQ ID NO: 289422 - DNA, 25 bp, Rattus norvegicus
gaaatacattcagggtctttgttaa

SEQ ID NO: 289423 - DNA, 25 bp, Rattus norvegicus
gaaatacatttcatctatctaatgg

SEQ ID NO: 289424 - DNA, 25 bp, Rattus norvegicus
gaaatacatttcttctatctaatgg

SEQ ID NO: 289425 - DNA, 25 bp, Rattus norvegicus
gaaataccaactcattttaatctac

SEQ ID NO: 289426 - DNA, 25 bp, Rattus norvegicus
gaaataccaactgattttaatctac

SEQ ID NO: 289427 - DNA, 25 bp, Rattus norvegicus
gaaataccagacactcactactgct

SEQ ID NO: 289428 - DNA, 25 bp, Rattus norvegicus
gaaataccagactctcactactgct

SEQ ID NO: 289429 - DNA, 25 bp, Rattus norvegicus
gaaataccatagaactccactgtca

SEQ ID NO: 289430 - DNA, 25 bp, Rattus norvegicus
gaaataccatagtactccactgtca

SEQ ID NO: 289431 - DNA, 25 bp, Rattus norvegicus
gaaataccatatcattgtccagctg

SEQ ID NO: 289432 - DNA, 25 bp, Rattus norvegicus
gaaataccatatgattgtccagctg

SEQ ID NO: 289433 - DNA, 25 bp, Rattus norvegicus
gaaataccatgcctattccaaggtt

SEQ ID NO: 289434 - DNA, 25 bp, Rattus norvegicus
gaaataccatgcgtattccaaggtt

SEQ ID NO: 289435 - DNA, 25 bp, Rattus norvegicus
gaaatacccaatcagcaggctgatt

SEQ ID NO: 289436 - DNA, 25 bp, Rattus norvegicus
gaaatacccaatgagcaggctgatt

SEQ ID NO: 289437 - DNA, 25 bp, Rattus norvegicus
gaaatacccggcagaatcatccaaa

SEQ ID NO: 289438 - DNA, 25 bp, Rattus norvegicus
gaaatacccggctgaatcatccaaa

SEQ ID NO: 289439 - DNA, 25 bp, Rattus norvegicus
gaaataccctagcttctgataacgg

SEQ ID NO: 289440 - DNA, 25 bp, Rattus norvegicus
gaaataccctaggttctgataacgg

SEQ ID NO: 289441 - DNA, 25 bp, Rattus norvegicus
gaaataccgatcagatcctgctgcg

SEQ ID NO: 289442 - DNA, 25 bp, Rattus norvegicus
gaaataccgatctgatcctgctgcg

SEQ ID NO: 289443 - DNA, 25 bp, Rattus norvegicus
gaaatacctcagatgtagacagtga

SEQ ID NO: 289444 - DNA, 25 bp, Rattus norvegicus
gaaatacctcagttgtagacagtga

SEQ ID NO: 289445 - DNA, 25 bp, Rattus norvegicus
gaaatacctcatatgccttgggtgt

SEQ ID NO: 289446 - DNA, 25 bp, Rattus norvegicus
gaaatacctcatttgccttgggtgt

SEQ ID NO: 289447 - DNA, 25 bp, Rattus norvegicus
gaaatacctctaaggcccagttcta

SEQ ID NO: 289448 - DNA, 25 bp, Rattus norvegicus
gaaatacctctatggcccagttcta

SEQ ID NO: 289449 - DNA, 25 bp, Rattus norvegicus
gaaataccttccaactcaaacgata

SEQ ID NO: 289450 - DNA, 25 bp, Rattus norvegicus
gaaataccttcctactcaaacgata

SEQ ID NO: 289451 - DNA, 25 bp, Rattus norvegicus
gaaatacgatctataatgccagttt

SEQ ID NO: 289452 - DNA, 25 bp, Rattus norvegicus
gaaatacgatctttaatgccagttt

SEQ ID NO: 289453 - DNA, 25 bp, Rattus norvegicus
gaaatacgctgacatccgcaacatt

SEQ ID NO: 289454 - DNA, 25 bp, Rattus norvegicus
gaaatacgctgagatccgcaacatt

SEQ ID NO: 289455 - DNA, 25 bp, Rattus norvegicus
gaaatacggtttacatcacctgcca

SEQ ID NO: 289456 - DNA, 25 bp, Rattus norvegicus
gaaatacggttttcatcacctgcca

SEQ ID NO: 289457 - DNA, 25 bp, Rattus norvegicus
gaaatacgtcgtctgaggccatctg

SEQ ID NO: 289458 - DNA, 25 bp, Rattus norvegicus
gaaatacgtcgtgtgaggccatctg

SEQ ID NO: 289459 - DNA, 25 bp, Rattus norvegicus
gaaatacgtcttccagtgcactgac

SEQ ID NO: 289460 - DNA, 25 bp, Rattus norvegicus
gaaatacgtcttgcagtgcactgac

SEQ ID NO: 289461 - DNA, 25 bp, Rattus norvegicus
gaaatacgtgaccttgtccagcaat

SEQ ID NO: 289462 - DNA, 25 bp, Rattus norvegicus
gaaatacgtgacgttgtccagcaat

SEQ ID NO: 289463 - DNA, 25 bp, Rattus norvegicus
gaaatacgtgttagttcctgcaaca

SEQ ID NO: 289464 - DNA, 25 bp, Rattus norvegicus
gaaatacgtgtttgttcctgcaaca

SEQ ID NO: 289465 - DNA, 25 bp, Rattus norvegicus
gaaatacgttcacagccagcacaga

SEQ ID NO: 289466 - DNA, 25 bp, Rattus norvegicus
gaaatacgttcagagccagcacaga

SEQ ID NO: 289467 - DNA, 25 bp, Rattus norvegicus
gaaatactacccatttgttatgctt

SEQ ID NO: 289468 - DNA, 25 bp, Rattus norvegicus
gaaatactacccttttgttatgctt

SEQ ID NO: 289469 - DNA, 25 bp, Rattus norvegicus
gaaatactacctctttaatctactg

SEQ ID NO: 289470 - DNA, 25 bp, Rattus norvegicus
gaaatactacctgtttaatctactg

SEQ ID NO: 289471 - DNA, 25 bp, Rattus norvegicus
gaaatactactcagctcaagacttg

SEQ ID NO: 289472 - DNA, 25 bp, Rattus norvegicus
gaaatactactctgctcaagacttg

SEQ ID NO: 289473 - DNA, 25 bp, Rattus norvegicus
gaaatactatttccccattatgtgt

SEQ ID NO: 289474 - DNA, 25 bp, Rattus norvegicus
gaaatactatttgcccattatgtgt

SEQ ID NO: 289475 - DNA, 25 bp, Rattus norvegicus
gaaatactccgtcttcaaatctggt

SEQ ID NO: 289476 - DNA, 25 bp, Rattus norvegicus
gaaatactccgtgttcaaatctggt

SEQ ID NO: 289477 - DNA, 25 bp, Rattus norvegicus
gaaatactgcaacccttcaaggatc

SEQ ID NO: 289478 - DNA, 25 bp, Rattus norvegicus
gaaatactgcaagccttcaaggatc

SEQ ID NO: 289479 - DNA, 25 bp, Rattus norvegicus
gaaatactgcctctaacttcacaga

SEQ ID NO: 289480 - DNA, 25 bp, Rattus norvegicus
gaaatactgcctgtaacttcacaga

SEQ ID NO: 289481 - DNA, 25 bp, Rattus norvegicus
gaaatactgctgctgccctagcatg

SEQ ID NO: 289482 - DNA, 25 bp, Rattus norvegicus
gaaatactgctggtgccctagcatg

SEQ ID NO: 289483 - DNA, 25 bp, Rattus norvegicus
gaaatactgggcagagcgaccttca

SEQ ID NO: 289484 - DNA, 25 bp, Rattus norvegicus
gaaatactgggctgagcgaccttca

SEQ ID NO: 289485 - DNA, 25 bp, Rattus norvegicus
gaaatacttaagcatgcagctccta

SEQ ID NO: 289486 - DNA, 25 bp, Rattus norvegicus
gaaatacttaaggatgcagctccta

SEQ ID NO: 289487 - DNA, 25 bp, Rattus norvegicus
gaaatacttaatcgagcacttacat

SEQ ID NO: 289488 - DNA, 25 bp, Rattus norvegicus
gaaatacttaatggagcacttacat

SEQ ID NO: 289489 - DNA, 25 bp, Rattus norvegicus
gaaatactttgtcttggaaatcaaa

SEQ ID NO: 289490 - DNA, 25 bp, Rattus norvegicus
gaaatactttgtgttggaaatcaaa

SEQ ID NO: 289491 - DNA, 25 bp, Rattus norvegicus
gaaatacttttgatcagtgcttagc

SEQ ID NO: 289492 - DNA, 25 bp, Rattus norvegicus
gaaatacttttgttcagtgcttagc

SEQ ID NO: 289493 - DNA, 25 bp, Rattus norvegicus
gaaatagaaatgctctgggcccagc

SEQ ID NO: 289494 - DNA, 25 bp, Rattus norvegicus
gaaatagaaatggtctgggcccagc

SEQ ID NO: 289495 - DNA, 25 bp, Rattus norvegicus
gaaatagaaggacctggtgctgcca

SEQ ID NO: 289496 - DNA, 25 bp, Rattus norvegicus
gaaatagaaggagctggtgctgcca

SEQ ID NO: 289497 - DNA, 25 bp, Rattus norvegicus
gaaatagacctcctagccatgcgat

SEQ ID NO: 289498 - DNA, 25 bp, Rattus norvegicus
gaaatagacctcgtagccatgcgat

SEQ ID NO: 289499 - DNA, 25 bp, Rattus norvegicus
gaaatagactcaaacccagatcccg

SEQ ID NO: 289500 - DNA, 25 bp, Rattus norvegicus
gaaatagactcatacccagatcccg

SEQ ID NO: 289501 - DNA, 25 bp, Rattus norvegicus
gaaatagactctcatgaccacacgg

SEQ ID NO: 289502 - DNA, 25 bp, Rattus norvegicus
gaaatagactctgatgaccacacgg

SEQ ID NO: 289503 - DNA, 25 bp, Rattus norvegicus
gaaatagagattatgagtccaagac

SEQ ID NO: 289504 - DNA, 25 bp, Rattus norvegicus
gaaatagagattttgagtccaagac

SEQ ID NO: 289505 - DNA, 25 bp, Rattus norvegicus
gaaatagagggacctattttcctct

SEQ ID NO: 289506 - DNA, 25 bp, Rattus norvegicus
gaaatagagggagctattttcctct

SEQ ID NO: 289507 - DNA, 25 bp, Rattus norvegicus
gaaatagagtctctgtcccgtggtc

SEQ ID NO: 289508 - DNA, 25 bp, Rattus norvegicus
gaaatagagtctgtgtcccgtggtc

SEQ ID NO: 289509 - DNA, 25 bp, Rattus norvegicus
gaaatagatcatattagtctccaag

SEQ ID NO: 289510 - DNA, 25 bp, Rattus norvegicus
gaaatagatcattttagtctccaag

SEQ ID NO: 289511 - DNA, 25 bp, Rattus norvegicus
gaaatagatttacatcagcctgatt

SEQ ID NO: 289512 - DNA, 25 bp, Rattus norvegicus
gaaatagatttagatcagcctgatt

SEQ ID NO: 289513 - DNA, 25 bp, Rattus norvegicus
gaaatagcaacaagcagagagcatt

SEQ ID NO: 289514 - DNA, 25 bp, Rattus norvegicus
gaaatagcaacatgcagagagcatt

SEQ ID NO: 289515 - DNA, 25 bp, Rattus norvegicus
gaaatagcactgactctccagtgtc

SEQ ID NO: 289516 - DNA, 25 bp, Rattus norvegicus
gaaatagcactgtctctccagtgtc

SEQ ID NO: 289517 - DNA, 25 bp, Rattus norvegicus
gaaatagcaggtcttgttcaaatgc

SEQ ID NO: 289518 - DNA, 25 bp, Rattus norvegicus
gaaatagcaggtgttgttcaaatgc

SEQ ID NO: 289519 - DNA, 25 bp, Rattus norvegicus
gaaatagccaccagaaggtcctgtg

SEQ ID NO: 289520 - DNA, 25 bp, Rattus norvegicus
gaaatagccacctgaaggtcctgtg

SEQ ID NO: 289521 - DNA, 25 bp, Rattus norvegicus
gaaatagccagacaggcagcacaaa

SEQ ID NO: 289522 - DNA, 25 bp, Rattus norvegicus
gaaatagccagagaggcagcacaaa

SEQ ID NO: 289523 - DNA, 25 bp, Rattus norvegicus
gaaatagccatcctcatccatatag

SEQ ID NO: 289524 - DNA, 25 bp, Rattus norvegicus
gaaatagccatcgtcatccatatag

SEQ ID NO: 289525 - DNA, 25 bp, Rattus norvegicus
gaaatagccctcatcttggctcaag

SEQ ID NO: 289526 - DNA, 25 bp, Rattus norvegicus
gaaatagccctcttcttggctcaag

SEQ ID NO: 289527 - DNA, 25 bp, Rattus norvegicus
gaaatagcctctacttcataacatc

SEQ ID NO: 289528 - DNA, 25 bp, Rattus norvegicus
gaaatagcctcttcttcataacatc

SEQ ID NO: 289529 - DNA, 25 bp, Rattus norvegicus
gaaatagcctgcaccgtgtttgtag

SEQ ID NO: 289530 - DNA, 25 bp, Rattus norvegicus
gaaatagcctgctccgtgtttgtag

SEQ ID NO: 289531 - DNA, 25 bp, Rattus norvegicus
gaaatagctattacgttcttgaaaa

SEQ ID NO: 289532 - DNA, 25 bp, Rattus norvegicus
gaaatagctatttcgttcttgaaaa

SEQ ID NO: 289533 - DNA, 25 bp, Rattus norvegicus
gaaatagctgctctactcttcacgt

SEQ ID NO: 289534 - DNA, 25 bp, Rattus norvegicus
gaaatagctgctgtactcttcacgt

SEQ ID NO: 289535 - DNA, 25 bp, Rattus norvegicus
gaaatagctgtcatatccttgtcaa

SEQ ID NO: 289536 - DNA, 25 bp, Rattus norvegicus
gaaatagctgtcatctctccaaaac

SEQ ID NO: 289537 - DNA, 25 bp, Rattus norvegicus
gaaatagctgtcttatccttgtcaa

SEQ ID NO: 289538 - DNA, 25 bp, Rattus norvegicus
gaaatagctgtcttctctccaaaac

SEQ ID NO: 289539 - DNA, 25 bp, Rattus norvegicus
gaaatagcttcaattgtgcctggta

SEQ ID NO: 289540 - DNA, 25 bp, Rattus norvegicus
gaaatagcttcatttgtgcctggta

SEQ ID NO: 289541 - DNA, 25 bp, Rattus norvegicus
gaaataggcccaacaggaccgcagg

SEQ ID NO: 289542 - DNA, 25 bp, Rattus norvegicus
gaaataggcccatcaggaccgcagg

SEQ ID NO: 289543 - DNA, 25 bp, Rattus norvegicus
gaaataggctttacccactcacttt

SEQ ID NO: 289544 - DNA, 25 bp, Rattus norvegicus
gaaataggcttttcccactcacttt

SEQ ID NO: 289545 - DNA, 25 bp, Rattus norvegicus
gaaatagggcagatgccttacataa

SEQ ID NO: 289546 - DNA, 25 bp, Rattus norvegicus
gaaatagggcagttgccttacataa

SEQ ID NO: 289547 - DNA, 25 bp, Rattus norvegicus
gaaataggtactatatcaataagac

SEQ ID NO: 289548 - DNA, 25 bp, Rattus norvegicus
gaaataggtactttatcaataagac

SEQ ID NO: 289549 - DNA, 25 bp, Rattus norvegicus
gaaataggttttctctggttgcata

SEQ ID NO: 289550 - DNA, 25 bp, Rattus norvegicus
gaaataggttttgtctggttgcata

SEQ ID NO: 289551 - DNA, 25 bp, Rattus norvegicus
gaaatagtaacccaacctcagttgc

SEQ ID NO: 289552 - DNA, 25 bp, Rattus norvegicus
gaaatagtaaccgaacctcagttgc

SEQ ID NO: 289553 - DNA, 25 bp, Rattus norvegicus
gaaatagtacagagattcgcccttt

SEQ ID NO: 289554 - DNA, 25 bp, Rattus norvegicus
gaaatagtacagtgattcgcccttt

SEQ ID NO: 289555 - DNA, 25 bp, Rattus norvegicus
gaaatagtaggcacccactttagtg

SEQ ID NO: 289556 - DNA, 25 bp, Rattus norvegicus
gaaatagtaggctcccactttagtg

SEQ ID NO: 289557 - DNA, 25 bp, Rattus norvegicus
gaaatagtctctacttaccatcact

SEQ ID NO: 289558 - DNA, 25 bp, Rattus norvegicus
gaaatagtctctcgcttcctcctgt

SEQ ID NO: 289559 - DNA, 25 bp, Rattus norvegicus
gaaatagtctctggcttcctcctgt

SEQ ID NO: 289560 - DNA, 25 bp, Rattus norvegicus
gaaatagtctcttcttaccatcact

SEQ ID NO: 289561 - DNA, 25 bp, Rattus norvegicus
gaaatagtctgactgtccccaggtc

SEQ ID NO: 289562 - DNA, 25 bp, Rattus norvegicus
gaaatagtctgagtgtccccaggtc

SEQ ID NO: 289563 - DNA, 25 bp, Rattus norvegicus
gaaatagtctgcctcataaaatgtg

SEQ ID NO: 289564 - DNA, 25 bp, Rattus norvegicus
gaaatagtctgcgtcataaaatgtg

SEQ ID NO: 289565 - DNA, 25 bp, Rattus norvegicus
gaaatagtcttcattttatctgaga

SEQ ID NO: 289566 - DNA, 25 bp, Rattus norvegicus
gaaatagtcttctttttatctgaga

SEQ ID NO: 289567 - DNA, 25 bp, Rattus norvegicus
gaaatagttgcacatctcgatagaa

SEQ ID NO: 289568 - DNA, 25 bp, Rattus norvegicus
gaaatagttgcagatctcgatagaa

SEQ ID NO: 289569 - DNA, 25 bp, Rattus norvegicus
gaaatagttgccactccatgtaaag

SEQ ID NO: 289570 - DNA, 25 bp, Rattus norvegicus
gaaatagttgcctctccatgtaaag

SEQ ID NO: 289571 - DNA, 25 bp, Rattus norvegicus
gaaatagttgtcaccaaaagcgaat

SEQ ID NO: 289572 - DNA, 25 bp, Rattus norvegicus
gaaatagttgtctccaaaagcgaat

SEQ ID NO: 289573 - DNA, 25 bp, Rattus norvegicus
gaaatagttgttatacatatcctaa

SEQ ID NO: 289574 - DNA, 25 bp, Rattus norvegicus
gaaatagttgttttacatatcctaa

SEQ ID NO: 289575 - DNA, 25 bp, Rattus norvegicus
gaaatagtttggaattctctgcttt

SEQ ID NO: 289576 - DNA, 25 bp, Rattus norvegicus
gaaatagtttggtattctctgcttt

SEQ ID NO: 289577 - DNA, 25 bp, Rattus norvegicus
gaaatataaccactccatgcaggcc

SEQ ID NO: 289578 - DNA, 25 bp, Rattus norvegicus
gaaatataaccagtccatgcaggcc

SEQ ID NO: 289579 - DNA, 25 bp, Rattus norvegicus
gaaatataacccaacctggcattgt

SEQ ID NO: 289580 - DNA, 25 bp, Rattus norvegicus
gaaatataacccatgtgcaacccac

SEQ ID NO: 289581 - DNA, 25 bp, Rattus norvegicus
gaaatataaccctacctggcattgt

SEQ ID NO: 289582 - DNA, 25 bp, Rattus norvegicus
gaaatataacccttgtgcaacccac

SEQ ID NO: 289583 - DNA, 25 bp, Rattus norvegicus
gaaatataacgcctctctgaaagtg

SEQ ID NO: 289584 - DNA, 25 bp, Rattus norvegicus
gaaatataacgcgtctctgaaagtg

SEQ ID NO: 289585 - DNA, 25 bp, Rattus norvegicus
gaaatatactcaccctgctacagag

SEQ ID NO: 289586 - DNA, 25 bp, Rattus norvegicus
gaaatatactcagcctgctacagag

SEQ ID NO: 289587 - DNA, 25 bp, Rattus norvegicus
gaaatatagcgtacttccaccgtat

SEQ ID NO: 289588 - DNA, 25 bp, Rattus norvegicus
gaaatatagcgttcttccaccgtat

SEQ ID NO: 289589 - DNA, 25 bp, Rattus norvegicus
gaaatatatctcctttcactctctc

SEQ ID NO: 289590 - DNA, 25 bp, Rattus norvegicus
gaaatatatctcgtttcactctctc

SEQ ID NO: 289591 - DNA, 25 bp, Rattus norvegicus
gaaatatatgacacccagctttaaa

SEQ ID NO: 289592 - DNA, 25 bp, Rattus norvegicus
gaaatatatgactcccagctttaaa

SEQ ID NO: 289593 - DNA, 25 bp, Rattus norvegicus
gaaatatcacccattcttcaggaag

SEQ ID NO: 289594 - DNA, 25 bp, Rattus norvegicus
gaaatatcaccctttcttcaggaag

SEQ ID NO: 289595 - DNA, 25 bp, Rattus norvegicus
gaaatatcagtgatctttctcccca

SEQ ID NO: 289596 - DNA, 25 bp, Rattus norvegicus
gaaatatcagtgttctttctcccca

SEQ ID NO: 289597 - DNA, 25 bp, Rattus norvegicus
gaaatatcatatccagcctcaaagc

SEQ ID NO: 289598 - DNA, 25 bp, Rattus norvegicus
gaaatatcatatgcagcctcaaagc

SEQ ID NO: 289599 - DNA, 25 bp, Rattus norvegicus
gaaatatccaacattcttggctccc

SEQ ID NO: 289600 - DNA, 25 bp, Rattus norvegicus
gaaatatccaactttcttggctccc

SEQ ID NO: 289601 - DNA, 25 bp, Rattus norvegicus
gaaatatcgacactgaactctgagt

SEQ ID NO: 289602 - DNA, 25 bp, Rattus norvegicus
gaaatatcgacagtgaactctgagt

SEQ ID NO: 289603 - DNA, 25 bp, Rattus norvegicus
gaaatatcttgcctcaaatgggtaa

SEQ ID NO: 289604 - DNA, 25 bp, Rattus norvegicus
gaaatatcttgcgtcaaatgggtaa

SEQ ID NO: 289605 - DNA, 25 bp, Rattus norvegicus
gaaatatctttcacttacctgttat

SEQ ID NO: 289606 - DNA, 25 bp, Rattus norvegicus
gaaatatctttctcttacctgttat

SEQ ID NO: 289607 - DNA, 25 bp, Rattus norvegicus
gaaatatgagctcggcttctgtggc

SEQ ID NO: 289608 - DNA, 25 bp, Rattus norvegicus
gaaatatgagctgggcttctgtggc

SEQ ID NO: 289609 - DNA, 25 bp, Rattus norvegicus
gaaatatgattgagccccgggaacg

SEQ ID NO: 289610 - DNA, 25 bp, Rattus norvegicus
gaaatatgattgtgccccgggaacg

SEQ ID NO: 289611 - DNA, 25 bp, Rattus norvegicus
gaaatatgcaccatttgtcctataa

SEQ ID NO: 289612 - DNA, 25 bp, Rattus norvegicus
gaaatatgcaccttttgtcctataa

SEQ ID NO: 289613 - DNA, 25 bp, Rattus norvegicus
gaaatatgcctcagtccagacactg

SEQ ID NO: 289614 - DNA, 25 bp, Rattus norvegicus
gaaatatgcctctgtccagacactg

SEQ ID NO: 289615 - DNA, 25 bp, Rattus norvegicus
gaaatatgccttattattgacacaa

SEQ ID NO: 289616 - DNA, 25 bp, Rattus norvegicus
gaaatatgccttattgtccatcttt

SEQ ID NO: 289617 - DNA, 25 bp, Rattus norvegicus
gaaatatgcctttttattgacacaa

SEQ ID NO: 289618 - DNA, 25 bp, Rattus norvegicus
gaaatatgcctttttgtccatcttt

SEQ ID NO: 289619 - DNA, 25 bp, Rattus norvegicus
gaaatatgcgaacgaccgccccgct

SEQ ID NO: 289620 - DNA, 25 bp, Rattus norvegicus
gaaatatgcgaaggaccgccccgct

SEQ ID NO: 289621 - DNA, 25 bp, Rattus norvegicus
gaaatatgctctattgattttcaca

SEQ ID NO: 289622 - DNA, 25 bp, Rattus norvegicus
gaaatatgctcttttgattttcaca

SEQ ID NO: 289623 - DNA, 25 bp, Rattus norvegicus
gaaatatggcgtcactccctagcaa

SEQ ID NO: 289624 - DNA, 25 bp, Rattus norvegicus
gaaatatggcgtgactccctagcaa

SEQ ID NO: 289625 - DNA, 25 bp, Rattus norvegicus
gaaatatggcttctacacgcacgtg

SEQ ID NO: 289626 - DNA, 25 bp, Rattus norvegicus
gaaatatggcttgtacacgcacgtg

SEQ ID NO: 289627 - DNA, 25 bp, Rattus norvegicus
gaaatatgtttcatgtagcctctgt

SEQ ID NO: 289628 - DNA, 25 bp, Rattus norvegicus
gaaatatgtttcttgtagcctctgt

SEQ ID NO: 289629 - DNA, 25 bp, Rattus norvegicus
gaaatattaggtacaggtgcataag

SEQ ID NO: 289630 - DNA, 25 bp, Rattus norvegicus
gaaatattaggttcaggtgcataag

SEQ ID NO: 289631 - DNA, 25 bp, Rattus norvegicus
gaaatattatgcaaattcccagatt

SEQ ID NO: 289632 - DNA, 25 bp, Rattus norvegicus
gaaatattatgctaattcccagatt

SEQ ID NO: 289633 - DNA, 25 bp, Rattus norvegicus
gaaatattctgtccaattttcccct

SEQ ID NO: 289634 - DNA, 25 bp, Rattus norvegicus
gaaatattctgtgcaattttcccct

SEQ ID NO: 289635 - DNA, 25 bp, Rattus norvegicus
gaaatattgatacttccctggagcc

SEQ ID NO: 289636 - DNA, 25 bp, Rattus norvegicus
gaaatattgatagttccctggagcc

SEQ ID NO: 289637 - DNA, 25 bp, Rattus norvegicus
gaaatatttcacacccatctcaggg

SEQ ID NO: 289638 - DNA, 25 bp, Rattus norvegicus
gaaatatttcactcccatctcaggg

SEQ ID NO: 289639 - DNA, 25 bp, Rattus norvegicus
gaaatatttcatcagccagccaggc

SEQ ID NO: 289640 - DNA, 25 bp, Rattus norvegicus
gaaatatttcatgagccagccaggc

SEQ ID NO: 289641 - DNA, 25 bp, Rattus norvegicus
gaaatatttctgattactctaggca

SEQ ID NO: 289642 - DNA, 25 bp, Rattus norvegicus
gaaatatttctgtttactctaggca

SEQ ID NO: 289643 - DNA, 25 bp, Rattus norvegicus
gaaatatttcttccttccaagcgac

SEQ ID NO: 289644 - DNA, 25 bp, Rattus norvegicus
gaaatatttcttgcttccaagcgac

SEQ ID NO: 289645 - DNA, 25 bp, Rattus norvegicus
gaaatatttgacacccaatacaagt

SEQ ID NO: 289646 - DNA, 25 bp, Rattus norvegicus
gaaatatttgactcccaatacaagt

SEQ ID NO: 289647 - DNA, 25 bp, Rattus norvegicus
gaaatatttgccaactccttcatta

SEQ ID NO: 289648 - DNA, 25 bp, Rattus norvegicus
gaaatatttgcctactccttcatta

SEQ ID NO: 289649 - DNA, 25 bp, Rattus norvegicus
gaaatatttgctcaggatcccaact

SEQ ID NO: 289650 - DNA, 25 bp, Rattus norvegicus
gaaatatttgctgaggatcccaact

SEQ ID NO: 289651 - DNA, 25 bp, Rattus norvegicus
gaaatatttttcagccttctgtggg

SEQ ID NO: 289652 - DNA, 25 bp, Rattus norvegicus
gaaatatttttctgccttctgtggg

SEQ ID NO: 289653 - DNA, 25 bp, Rattus norvegicus
gaaatcaaaagtaacctctctgcaa

SEQ ID NO: 289654 - DNA, 25 bp, Rattus norvegicus
gaaatcaaaagttacctctctgcaa

SEQ ID NO: 289655 - DNA, 25 bp, Rattus norvegicus
gaaatcaaagctagtcctatgtctt

SEQ ID NO: 289656 - DNA, 25 bp, Rattus norvegicus
gaaatcaaagcttgtcctatgtctt

SEQ ID NO: 289657 - DNA, 25 bp, Rattus norvegicus
gaaatcaaatgcagtggccctctta

SEQ ID NO: 289658 - DNA, 25 bp, Rattus norvegicus
gaaatcaaatgctgtggccctctta

SEQ ID NO: 289659 - DNA, 25 bp, Rattus norvegicus
gaaatcaaatttcgtttccggctgg

SEQ ID NO: 289660 - DNA, 25 bp, Rattus norvegicus
gaaatcaaatttggtttccggctgg

SEQ ID NO: 289661 - DNA, 25 bp, Rattus norvegicus
gaaatcaacaaacaccaacaccttc

SEQ ID NO: 289662 - DNA, 25 bp, Rattus norvegicus
gaaatcaacaaagaccaacaccttc

SEQ ID NO: 289663 - DNA, 25 bp, Rattus norvegicus
gaaatcaaccacctgcagaagctgt

SEQ ID NO: 289664 - DNA, 25 bp, Rattus norvegicus
gaaatcaaccacgtgcagaagctgt

SEQ ID NO: 289665 - DNA, 25 bp, Rattus norvegicus
gaaatcaacccaacgagagcacttt

SEQ ID NO: 289666 - DNA, 25 bp, Rattus norvegicus
gaaatcaacccatcgagagcacttt

SEQ ID NO: 289667 - DNA, 25 bp, Rattus norvegicus
gaaatcaaccccagaatcctggaaa

SEQ ID NO: 289668 - DNA, 25 bp, Rattus norvegicus
gaaatcaacccctgaatcctggaaa

SEQ ID NO: 289669 - DNA, 25 bp, Rattus norvegicus
gaaatcaaccctccttgtggtgaaa

SEQ ID NO: 289670 - DNA, 25 bp, Rattus norvegicus
gaaatcaaccctgcttgtggtgaaa

SEQ ID NO: 289671 - DNA, 25 bp, Rattus norvegicus
gaaatcaacctgatcttactagaaa

SEQ ID NO: 289672 - DNA, 25 bp, Rattus norvegicus
gaaatcaacctgttcttactagaaa

SEQ ID NO: 289673 - DNA, 25 bp, Rattus norvegicus
gaaatcaacttcactctctaacaaa

SEQ ID NO: 289674 - DNA, 25 bp, Rattus norvegicus
gaaatcaacttcctaaccttgctaa

SEQ ID NO: 289675 - DNA, 25 bp, Rattus norvegicus
gaaatcaacttcgtaaccttgctaa

SEQ ID NO: 289676 - DNA, 25 bp, Rattus norvegicus
gaaatcaacttctctctctaacaaa

SEQ ID NO: 289677 - DNA, 25 bp, Rattus norvegicus
gaaatcaagagaccaccccaaagtt

SEQ ID NO: 289678 - DNA, 25 bp, Rattus norvegicus
gaaatcaagagagcaccccaaagtt

SEQ ID NO: 289679 - DNA, 25 bp, Rattus norvegicus
gaaatcaagattctacagctcctaa

SEQ ID NO: 289680 - DNA, 25 bp, Rattus norvegicus
gaaatcaagattgtacagctcctaa

SEQ ID NO: 289681 - DNA, 25 bp, Rattus norvegicus
gaaatcaagcacatcataacaactg

SEQ ID NO: 289682 - DNA, 25 bp, Rattus norvegicus
gaaatcaagcacttcataacaactg

SEQ ID NO: 289683 - DNA, 25 bp, Rattus norvegicus
gaaatcaagcctcatcagacaccag

SEQ ID NO: 289684 - DNA, 25 bp, Rattus norvegicus
gaaatcaagcctgatcagacaccag

SEQ ID NO: 289685 - DNA, 25 bp, Rattus norvegicus
gaaatcaagcttctgtctgacaaac

SEQ ID NO: 289686 - DNA, 25 bp, Rattus norvegicus
gaaatcaagcttgtgtctgacaaac

SEQ ID NO: 289687 - DNA, 25 bp, Rattus norvegicus
gaaatcaagttcagtgttcccctca

SEQ ID NO: 289688 - DNA, 25 bp, Rattus norvegicus
gaaatcaagttctgtgttcccctca

SEQ ID NO: 289689 - DNA, 25 bp, Rattus norvegicus
gaaatcaatcacatgccaccagggt

SEQ ID NO: 289690 - DNA, 25 bp, Rattus norvegicus
gaaatcaatcacttgccaccagggt

SEQ ID NO: 289691 - DNA, 25 bp, Rattus norvegicus
gaaatcaatgccagtacaaacctat

SEQ ID NO: 289692 - DNA, 25 bp, Rattus norvegicus
gaaatcaatgcctgtacaaacctat

SEQ ID NO: 289693 - DNA, 25 bp, Rattus norvegicus
gaaatcacacagacggagagcaccg

SEQ ID NO: 289694 - DNA, 25 bp, Rattus norvegicus
gaaatcacacagtcggagagcaccg

SEQ ID NO: 289695 - DNA, 25 bp, Rattus norvegicus
gaaatcacatccataaaccagccaa

SEQ ID NO: 289696 - DNA, 25 bp, Rattus norvegicus
gaaatcacatccttaaaccagccaa

SEQ ID NO: 289697 - DNA, 25 bp, Rattus norvegicus
gaaatcacattccagacactaggca

SEQ ID NO: 289698 - DNA, 25 bp, Rattus norvegicus
gaaatcacattcgagacactaggca

SEQ ID NO: 289699 - DNA, 25 bp, Rattus norvegicus
gaaatcaccacccagctgtacatga

SEQ ID NO: 289700 - DNA, 25 bp, Rattus norvegicus
gaaatcaccaccgagctgtacatga

SEQ ID NO: 289701 - DNA, 25 bp, Rattus norvegicus
gaaatcaccagcctgtggcagggta

SEQ ID NO: 289702 - DNA, 25 bp, Rattus norvegicus
gaaatcaccagcgtgtggcagggta

SEQ ID NO: 289703 - DNA, 25 bp, Rattus norvegicus
gaaatcacccagcttcagagcggac

SEQ ID NO: 289704 - DNA, 25 bp, Rattus norvegicus
gaaatcacccaggttcagagcggac

SEQ ID NO: 289705 - DNA, 25 bp, Rattus norvegicus
gaaatcaccgggaccattgctgaaa

SEQ ID NO: 289706 - DNA, 25 bp, Rattus norvegicus
gaaatcaccgggtccattgctgaaa

SEQ ID NO: 289707 - DNA, 25 bp, Rattus norvegicus
gaaatcaccgtgactctgacttgat

SEQ ID NO: 289708 - DNA, 25 bp, Rattus norvegicus
gaaatcaccgtgtctctgacttgat

SEQ ID NO: 289709 - DNA, 25 bp, Rattus norvegicus
gaaatcacctgaacattgcaaaata

SEQ ID NO: 289710 - DNA, 25 bp, Rattus norvegicus
gaaatcacctgatcattgcaaaata

SEQ ID NO: 289711 - DNA, 25 bp, Rattus norvegicus
gaaatcaccttacaattgcacagca

SEQ ID NO: 289712 - DNA, 25 bp, Rattus norvegicus
gaaatcaccttagaattgcacagca

SEQ ID NO: 289713 - DNA, 25 bp, Rattus norvegicus
gaaatcaccttcagaatccacacaa

SEQ ID NO: 289714 - DNA, 25 bp, Rattus norvegicus
gaaatcaccttctgaatccacacaa

SEQ ID NO: 289715 - DNA, 25 bp, Rattus norvegicus
gaaatcactaagctgttcggcaaag

SEQ ID NO: 289716 - DNA, 25 bp, Rattus norvegicus
gaaatcactaaggtgttcggcaaag

SEQ ID NO: 289717 - DNA, 25 bp, Rattus norvegicus
gaaatcactactaccttgaatctcc

SEQ ID NO: 289718 - DNA, 25 bp, Rattus norvegicus
gaaatcactactcagactcttctgc

SEQ ID NO: 289719 - DNA, 25 bp, Rattus norvegicus
gaaatcactactgagactcttctgc

SEQ ID NO: 289720 - DNA, 25 bp, Rattus norvegicus
gaaatcactacttccttgaatctcc

SEQ ID NO: 289721 - DNA, 25 bp, Rattus norvegicus
gaaatcactcctaatacagatgcaa

SEQ ID NO: 289722 - DNA, 25 bp, Rattus norvegicus
gaaatcactccttatacagatgcaa

SEQ ID NO: 289723 - DNA, 25 bp, Rattus norvegicus
gaaatcactggacgctgcttctgaa

SEQ ID NO: 289724 - DNA, 25 bp, Rattus norvegicus
gaaatcactggaggctgcttctgaa

SEQ ID NO: 289725 - DNA, 25 bp, Rattus norvegicus
gaaatcactggtcgttctcagagat

SEQ ID NO: 289726 - DNA, 25 bp, Rattus norvegicus
gaaatcactggtggttctcagagat

SEQ ID NO: 289727 - DNA, 25 bp, Rattus norvegicus
gaaatcactgtgagttctgatcaga

SEQ ID NO: 289728 - DNA, 25 bp, Rattus norvegicus
gaaatcactgtgtgttctgatcaga

SEQ ID NO: 289729 - DNA, 25 bp, Rattus norvegicus
gaaatcacttcaagcttccaggctt

SEQ ID NO: 289730 - DNA, 25 bp, Rattus norvegicus
gaaatcacttcatgcttccaggctt

SEQ ID NO: 289731 - DNA, 25 bp, Rattus norvegicus
gaaatcacttgcaatgggtttccat

SEQ ID NO: 289732 - DNA, 25 bp, Rattus norvegicus
gaaatcacttgctatgggtttccat

SEQ ID NO: 289733 - DNA, 25 bp, Rattus norvegicus
gaaatcacttttaacagtcctcaaa

SEQ ID NO: 289734 - DNA, 25 bp, Rattus norvegicus
gaaatcactttttacagtcctcaaa

SEQ ID NO: 289735 - DNA, 25 bp, Rattus norvegicus
gaaatcagaaaccttgccacacatg

SEQ ID NO: 289736 - DNA, 25 bp, Rattus norvegicus
gaaatcagaaacgttgccacacatg

SEQ ID NO: 289737 - DNA, 25 bp, Rattus norvegicus
gaaatcagaaagcatagtcaactag

SEQ ID NO: 289738 - DNA, 25 bp, Rattus norvegicus
gaaatcagaaaggatagtcaactag

SEQ ID NO: 289739 - DNA, 25 bp, Rattus norvegicus
gaaatcagaatacctagccaaccta

SEQ ID NO: 289740 - DNA, 25 bp, Rattus norvegicus
gaaatcagaatagctagccaaccta

SEQ ID NO: 289741 - DNA, 25 bp, Rattus norvegicus
gaaatcagacatcactagtcactga

SEQ ID NO: 289742 - DNA, 25 bp, Rattus norvegicus
gaaatcagacatgactagtcactga

SEQ ID NO: 289743 - DNA, 25 bp, Rattus norvegicus
gaaatcagactgcagcagcctctct

SEQ ID NO: 289744 - DNA, 25 bp, Rattus norvegicus
gaaatcagactggagcagcctctct

SEQ ID NO: 289745 - DNA, 25 bp, Rattus norvegicus
gaaatcagatcaatcccctgcaaaa

SEQ ID NO: 289746 - DNA, 25 bp, Rattus norvegicus
gaaatcagatcattcccctgcaaaa

SEQ ID NO: 289747 - DNA, 25 bp, Rattus norvegicus
gaaatcagccagagtcacaaaccaa

SEQ ID NO: 289748 - DNA, 25 bp, Rattus norvegicus
gaaatcagccagtgtcacaaaccaa

SEQ ID NO: 289749 - DNA, 25 bp, Rattus norvegicus
gaaatcagccatattctaactctgg

SEQ ID NO: 289750 - DNA, 25 bp, Rattus norvegicus
gaaatcagccattttctaactctgg

SEQ ID NO: 289751 - DNA, 25 bp, Rattus norvegicus
gaaatcagcctccaaacattgtggg

SEQ ID NO: 289752 - DNA, 25 bp, Rattus norvegicus
gaaatcagcctcgaaacattgtggg

SEQ ID NO: 289753 - DNA, 25 bp, Rattus norvegicus
gaaatcagctacataggcctccttt

SEQ ID NO: 289754 - DNA, 25 bp, Rattus norvegicus
gaaatcagctacttaggcctccttt

SEQ ID NO: 289755 - DNA, 25 bp, Rattus norvegicus
gaaatcagctgaatgtcaccgccac

SEQ ID NO: 289756 - DNA, 25 bp, Rattus norvegicus
gaaatcagctgattgtcaccgccac

SEQ ID NO: 289757 - DNA, 25 bp, Rattus norvegicus
gaaatcagctgcatgtttttacaaa

SEQ ID NO: 289758 - DNA, 25 bp, Rattus norvegicus
gaaatcagctgcttgtttttacaaa

SEQ ID NO: 289759 - DNA, 25 bp, Rattus norvegicus
gaaatcaggatacacagccacacac

SEQ ID NO: 289760 - DNA, 25 bp, Rattus norvegicus
gaaatcaggatagacagccacacac

SEQ ID NO: 289761 - DNA, 25 bp, Rattus norvegicus
gaaatcagggttccaacaaggtata

SEQ ID NO: 289762 - DNA, 25 bp, Rattus norvegicus
gaaatcagggttgcaacaaggtata

SEQ ID NO: 289763 - DNA, 25 bp, Rattus norvegicus
gaaatcaggttcaatgctcccttcg

SEQ ID NO: 289764 - DNA, 25 bp, Rattus norvegicus
gaaatcaggttctatgctcccttcg

SEQ ID NO: 289765 - DNA, 25 bp, Rattus norvegicus
gaaatcagtccccacaatttgagat

SEQ ID NO: 289766 - DNA, 25 bp, Rattus norvegicus
gaaatcagtcccgacaatttgagat

SEQ ID NO: 289767 - DNA, 25 bp, Rattus norvegicus
gaaatcagtggaacttttgtactat

SEQ ID NO: 289768 - DNA, 25 bp, Rattus norvegicus
gaaatcagtggatcttttgtactat

SEQ ID NO: 289769 - DNA, 25 bp, Rattus norvegicus
gaaatcagtgtcagcttgtgcccag

SEQ ID NO: 289770 - DNA, 25 bp, Rattus norvegicus
gaaatcagtgtctgcttgtgcccag

SEQ ID NO: 289771 - DNA, 25 bp, Rattus norvegicus
gaaatcagttttccttacctgcaaa

SEQ ID NO: 289772 - DNA, 25 bp, Rattus norvegicus
gaaatcagttttgcttacctgcaaa

SEQ ID NO: 289773 - DNA, 25 bp, Rattus norvegicus
gaaatcatatgacctagaaattcca

SEQ ID NO: 289774 - DNA, 25 bp, Rattus norvegicus
gaaatcatatgagctagaaattcca

SEQ ID NO: 289775 - DNA, 25 bp, Rattus norvegicus
gaaatcatcactcggtgtcttcctc

SEQ ID NO: 289776 - DNA, 25 bp, Rattus norvegicus
gaaatcatcactgggtgtcttcctc

SEQ ID NO: 289777 - DNA, 25 bp, Rattus norvegicus
gaaatcatccccatgagcatcagaa

SEQ ID NO: 289778 - DNA, 25 bp, Rattus norvegicus
gaaatcatccccttgagcatcagaa

SEQ ID NO: 289779 - DNA, 25 bp, Rattus norvegicus
gaaatcatcgctacactgaagaacg

SEQ ID NO: 289780 - DNA, 25 bp, Rattus norvegicus
gaaatcatcgcttcactgaagaacg

SEQ ID NO: 289781 - DNA, 25 bp, Rattus norvegicus
gaaatcatcgtcatcaccagagctc

SEQ ID NO: 289782 - DNA, 25 bp, Rattus norvegicus
gaaatcatcgtcttcaccagagctc

SEQ ID NO: 289783 - DNA, 25 bp, Rattus norvegicus
gaaatcatcgttctcaacagtgttg

SEQ ID NO: 289784 - DNA, 25 bp, Rattus norvegicus
gaaatcatcgttgtcaacagtgttg

SEQ ID NO: 289785 - DNA, 25 bp, Rattus norvegicus
gaaatcatctccctagtatcaggct

SEQ ID NO: 289786 - DNA, 25 bp, Rattus norvegicus
gaaatcatctccgtagtatcaggct

SEQ ID NO: 289787 - DNA, 25 bp, Rattus norvegicus
gaaatcatctctatacctgtgcttt

SEQ ID NO: 289788 - DNA, 25 bp, Rattus norvegicus
gaaatcatctctttacctgtgcttt

SEQ ID NO: 289789 - DNA, 25 bp, Rattus norvegicus
gaaatcatctgcatgtttatcccag

SEQ ID NO: 289790 - DNA, 25 bp, Rattus norvegicus
gaaatcatctgcttgtttatcccag

SEQ ID NO: 289791 - DNA, 25 bp, Rattus norvegicus
gaaatcatgaacagcatcccctata

SEQ ID NO: 289792 - DNA, 25 bp, Rattus norvegicus
gaaatcatgaactgcatcccctata

SEQ ID NO: 289793 - DNA, 25 bp, Rattus norvegicus
gaaatcatgatcacttcctcagata

SEQ ID NO: 289794 - DNA, 25 bp, Rattus norvegicus
gaaatcatgatctcttcctcagata

SEQ ID NO: 289795 - DNA, 25 bp, Rattus norvegicus
gaaatcatggccagacctccaagag

SEQ ID NO: 289796 - DNA, 25 bp, Rattus norvegicus
gaaatcatggcctgacctccaagag

SEQ ID NO: 289797 - DNA, 25 bp, Rattus norvegicus
gaaatcatggtacagtcactgccca

SEQ ID NO: 289798 - DNA, 25 bp, Rattus norvegicus
gaaatcatggtagagtcactgccca

SEQ ID NO: 289799 - DNA, 25 bp, Rattus norvegicus
gaaatcatgtttcctgagcaatttt

SEQ ID NO: 289800 - DNA, 25 bp, Rattus norvegicus
gaaatcatgtttgctgagcaatttt

SEQ ID NO: 289801 - DNA, 25 bp, Rattus norvegicus
gaaatcattactaagtggccctgta

SEQ ID NO: 289802 - DNA, 25 bp, Rattus norvegicus
gaaatcattacttagtggccctgta

SEQ ID NO: 289803 - DNA, 25 bp, Rattus norvegicus
gaaatcattagaccccttctctgca

SEQ ID NO: 289804 - DNA, 25 bp, Rattus norvegicus
gaaatcattagagcccttctctgca

SEQ ID NO: 289805 - DNA, 25 bp, Rattus norvegicus
gaaatcattctaccattgcagctgc

SEQ ID NO: 289806 - DNA, 25 bp, Rattus norvegicus
gaaatcattctagcattgcagctgc

SEQ ID NO: 289807 - DNA, 25 bp, Rattus norvegicus
gaaatcattgtgacggcattggtca

SEQ ID NO: 289808 - DNA, 25 bp, Rattus norvegicus
gaaatcattgtgtcggcattggtca

SEQ ID NO: 289809 - DNA, 25 bp, Rattus norvegicus
gaaatcatttaccttctccgcaaat

SEQ ID NO: 289810 - DNA, 25 bp, Rattus norvegicus
gaaatcatttacgttctccgcaaat

SEQ ID NO: 289811 - DNA, 25 bp, Rattus norvegicus
gaaatcatttgcattcttccttcat

SEQ ID NO: 289812 - DNA, 25 bp, Rattus norvegicus
gaaatcatttgctttcttccttcat

SEQ ID NO: 289813 - DNA, 25 bp, Rattus norvegicus
gaaatcattttcacaccagcttttg

SEQ ID NO: 289814 - DNA, 25 bp, Rattus norvegicus
gaaatcattttctcaccagcttttg

SEQ ID NO: 289815 - DNA, 25 bp, Rattus norvegicus
gaaatccaaacaccaaggcgtacgg

SEQ ID NO: 289816 - DNA, 25 bp, Rattus norvegicus
gaaatccaaacagcaaggcgtacgg

SEQ ID NO: 289817 - DNA, 25 bp, Rattus norvegicus
gaaatccaacacatctctgtaacgt

SEQ ID NO: 289818 - DNA, 25 bp, Rattus norvegicus
gaaatccaacacttctctgtaacgt

SEQ ID NO: 289819 - DNA, 25 bp, Rattus norvegicus
gaaatccaacatcctttaagactca

SEQ ID NO: 289820 - DNA, 25 bp, Rattus norvegicus
gaaatccaacatgctttaagactca

SEQ ID NO: 289821 - DNA, 25 bp, Rattus norvegicus
gaaatccaacgtcaagctctgccgt

SEQ ID NO: 289822 - DNA, 25 bp, Rattus norvegicus
gaaatccaacgtgaagctctgccgt

SEQ ID NO: 289823 - DNA, 25 bp, Rattus norvegicus
gaaatccaagacacacaccagcctg

SEQ ID NO: 289824 - DNA, 25 bp, Rattus norvegicus
gaaatccaagactcacaccagcctg

SEQ ID NO: 289825 - DNA, 25 bp, Rattus norvegicus
gaaatccaagtaacctcagggcagg

SEQ ID NO: 289826 - DNA, 25 bp, Rattus norvegicus
gaaatccaagtatcctcagggcagg

SEQ ID NO: 289827 - DNA, 25 bp, Rattus norvegicus
gaaatccaagttcgcgtcgcacgtt

SEQ ID NO: 289828 - DNA, 25 bp, Rattus norvegicus
gaaatccaagttggcgtcgcacgtt

SEQ ID NO: 289829 - DNA, 25 bp, Rattus norvegicus
gaaatccaattactcagaatctttg

SEQ ID NO: 289830 - DNA, 25 bp, Rattus norvegicus
gaaatccaattagtcagaatctttg

SEQ ID NO: 289831 - DNA, 25 bp, Rattus norvegicus
gaaatccacaggcagccacaggagt

SEQ ID NO: 289832 - DNA, 25 bp, Rattus norvegicus
gaaatccacagggagccacaggagt

SEQ ID NO: 289833 - DNA, 25 bp, Rattus norvegicus
gaaatccacatcaagaccatgccag

SEQ ID NO: 289834 - DNA, 25 bp, Rattus norvegicus
gaaatccacatctagaccatgccag

SEQ ID NO: 289835 - DNA, 25 bp, Rattus norvegicus
gaaatccacctgcatgcttttccca

SEQ ID NO: 289836 - DNA, 25 bp, Rattus norvegicus
gaaatccacctggatgcttttccca

SEQ ID NO: 289837 - DNA, 25 bp, Rattus norvegicus
gaaatccactcaaaacgttccatgt

SEQ ID NO: 289838 - DNA, 25 bp, Rattus norvegicus
gaaatccactcactgtacaaactat

SEQ ID NO: 289839 - DNA, 25 bp, Rattus norvegicus
gaaatccactcagtgtacaaactat

SEQ ID NO: 289840 - DNA, 25 bp, Rattus norvegicus
gaaatccactcataacgttccatgt

SEQ ID NO: 289841 - DNA, 25 bp, Rattus norvegicus
gaaatccactccattcatctgagac

SEQ ID NO: 289842 - DNA, 25 bp, Rattus norvegicus
gaaatccactcctttcatctgagac

SEQ ID NO: 289843 - DNA, 25 bp, Rattus norvegicus
gaaatccacttactgtcagccgcac

SEQ ID NO: 289844 - DNA, 25 bp, Rattus norvegicus
gaaatccacttagtgtcagccgcac

SEQ ID NO: 289845 - DNA, 25 bp, Rattus norvegicus
gaaatccagaacaccccaacagggt

SEQ ID NO: 289846 - DNA, 25 bp, Rattus norvegicus
gaaatccagaactccccaacagggt

SEQ ID NO: 289847 - DNA, 25 bp, Rattus norvegicus
gaaatccagattatcaccacctgtg

SEQ ID NO: 289848 - DNA, 25 bp, Rattus norvegicus
gaaatccagattttcaccacctgtg

SEQ ID NO: 289849 - DNA, 25 bp, Rattus norvegicus
gaaatccaggttagccactcttcag

SEQ ID NO: 289850 - DNA, 25 bp, Rattus norvegicus
gaaatccaggtttgccactcttcag

SEQ ID NO: 289851 - DNA, 25 bp, Rattus norvegicus
gaaatccagtgtaaggtcactccct

SEQ ID NO: 289852 - DNA, 25 bp, Rattus norvegicus
gaaatccagtgttaggtcactccct

SEQ ID NO: 289853 - DNA, 25 bp, Rattus norvegicus
gaaatccataggagacgctccggtt

SEQ ID NO: 289854 - DNA, 25 bp, Rattus norvegicus
gaaatccataggtgacgctccggtt

SEQ ID NO: 289855 - DNA, 25 bp, Rattus norvegicus
gaaatccatcctctgctgatgttta

SEQ ID NO: 289856 - DNA, 25 bp, Rattus norvegicus
gaaatccatcctgtgctgatgttta

SEQ ID NO: 289857 - DNA, 25 bp, Rattus norvegicus
gaaatccatcttcatacaaagccag

SEQ ID NO: 289858 - DNA, 25 bp, Rattus norvegicus
gaaatccatcttgatacaaagccag

SEQ ID NO: 289859 - DNA, 25 bp, Rattus norvegicus
gaaatccatttgcttgtcagctgcc

SEQ ID NO: 289860 - DNA, 25 bp, Rattus norvegicus
gaaatccatttggttgtcagctgcc

SEQ ID NO: 289861 - DNA, 25 bp, Rattus norvegicus
gaaatcccaagtctgagctccagtc

SEQ ID NO: 289862 - DNA, 25 bp, Rattus norvegicus
gaaatcccaagtgtgagctccagtc

SEQ ID NO: 289863 - DNA, 25 bp, Rattus norvegicus
gaaatcccaccaacagtgaaggagt

SEQ ID NO: 289864 - DNA, 25 bp, Rattus norvegicus
gaaatcccaccatcagtgaaggagt

SEQ ID NO: 289865 - DNA, 25 bp, Rattus norvegicus
gaaatcccagatccgtttctgttgg

SEQ ID NO: 289866 - DNA, 25 bp, Rattus norvegicus
gaaatcccagatgcgtttctgttgg

SEQ ID NO: 289867 - DNA, 25 bp, Rattus norvegicus
gaaatcccattaacatcaacttgat

SEQ ID NO: 289868 - DNA, 25 bp, Rattus norvegicus
gaaatcccattatcatcaacttgat

SEQ ID NO: 289869 - DNA, 25 bp, Rattus norvegicus
gaaatccccagacaggcatctgaga

SEQ ID NO: 289870 - DNA, 25 bp, Rattus norvegicus
gaaatccccagagaggcatctgaga

SEQ ID NO: 289871 - DNA, 25 bp, Rattus norvegicus
gaaatccccttacattttttggctg

SEQ ID NO: 289872 - DNA, 25 bp, Rattus norvegicus
gaaatccccttagattttttggctg

SEQ ID NO: 289873 - DNA, 25 bp, Rattus norvegicus
gaaatccccttgcacttctcttttg

SEQ ID NO: 289874 - DNA, 25 bp, Rattus norvegicus
gaaatccccttggacttctcttttg

SEQ ID NO: 289875 - DNA, 25 bp, Rattus norvegicus
gaaatcccgcaaacactacgactag

SEQ ID NO: 289876 - DNA, 25 bp, Rattus norvegicus
gaaatcccgcaatcactacgactag

SEQ ID NO: 289877 - DNA, 25 bp, Rattus norvegicus
gaaatccctaggatgctgcttgcaa

SEQ ID NO: 289878 - DNA, 25 bp, Rattus norvegicus
gaaatccctaggttgctgcttgcaa

SEQ ID NO: 289879 - DNA, 25 bp, Rattus norvegicus
gaaatccctcaacggtagcccagga

SEQ ID NO: 289880 - DNA, 25 bp, Rattus norvegicus
gaaatccctcaagggtagcccagga

SEQ ID NO: 289881 - DNA, 25 bp, Rattus norvegicus
gaaatccctcatatgatgtatcaga

SEQ ID NO: 289882 - DNA, 25 bp, Rattus norvegicus
gaaatccctcatttgatgtatcaga

SEQ ID NO: 289883 - DNA, 25 bp, Rattus norvegicus
gaaatccctcctctggatggcatag

SEQ ID NO: 289884 - DNA, 25 bp, Rattus norvegicus
gaaatccctcctgtggatggcatag

SEQ ID NO: 289885 - DNA, 25 bp, Rattus norvegicus
gaaatccctgaaaagtctccactcc

SEQ ID NO: 289886 - DNA, 25 bp, Rattus norvegicus
gaaatccctgaaaatcaggccttgt

SEQ ID NO: 289887 - DNA, 25 bp, Rattus norvegicus
gaaatccctgaatagtctccactcc

SEQ ID NO: 289888 - DNA, 25 bp, Rattus norvegicus
gaaatccctgaatatcaggccttgt

SEQ ID NO: 289889 - DNA, 25 bp, Rattus norvegicus
gaaatccctgctccttgtgctggtg

SEQ ID NO: 289890 - DNA, 25 bp, Rattus norvegicus
gaaatccctgctgcttgtgctggtg

SEQ ID NO: 289891 - DNA, 25 bp, Rattus norvegicus
gaaatccctgggagactgcaccatg

SEQ ID NO: 289892 - DNA, 25 bp, Rattus norvegicus
gaaatccctgggtgactgcaccatg

SEQ ID NO: 289893 - DNA, 25 bp, Rattus norvegicus
gaaatcccttagcagacatgtccag

SEQ ID NO: 289894 - DNA, 25 bp, Rattus norvegicus
gaaatcccttaggagacatgtccag

SEQ ID NO: 289895 - DNA, 25 bp, Rattus norvegicus
gaaatcccttcacggccgtttgcca

SEQ ID NO: 289896 - DNA, 25 bp, Rattus norvegicus
gaaatcccttcagggccgtttgcca

SEQ ID NO: 289897 - DNA, 25 bp, Rattus norvegicus
gaaatccctttcactgatgaactcc

SEQ ID NO: 289898 - DNA, 25 bp, Rattus norvegicus
gaaatccctttctctgatgaactcc

SEQ ID NO: 289899 - DNA, 25 bp, Rattus norvegicus
gaaatccgatttacgacgtgatggt

SEQ ID NO: 289900 - DNA, 25 bp, Rattus norvegicus
gaaatccgattttcgacgtgatggt

SEQ ID NO: 289901 - DNA, 25 bp, Rattus norvegicus
gaaatccgctcgcagctgaacacag

SEQ ID NO: 289902 - DNA, 25 bp, Rattus norvegicus
gaaatccgctcggagctgaacacag

SEQ ID NO: 289903 - DNA, 25 bp, Rattus norvegicus
gaaatccgggataactcggactggg

SEQ ID NO: 289904 - DNA, 25 bp, Rattus norvegicus
gaaatccgggattactcggactggg

SEQ ID NO: 289905 - DNA, 25 bp, Rattus norvegicus
gaaatccgtgctccaaggtattttt

SEQ ID NO: 289906 - DNA, 25 bp, Rattus norvegicus
gaaatccgtgctgcaaggtattttt

SEQ ID NO: 289907 - DNA, 25 bp, Rattus norvegicus
gaaatcctacagcagttccaatcca

SEQ ID NO: 289908 - DNA, 25 bp, Rattus norvegicus
gaaatcctacaggagttccaatcca

SEQ ID NO: 289909 - DNA, 25 bp, Rattus norvegicus
gaaatcctactacatcacagctaat

SEQ ID NO: 289910 - DNA, 25 bp, Rattus norvegicus
gaaatcctactagatcacagctaat

SEQ ID NO: 289911 - DNA, 25 bp, Rattus norvegicus
gaaatcctagaaaagcctctcttgt

SEQ ID NO: 289912 - DNA, 25 bp, Rattus norvegicus
gaaatcctagaatagcctctcttgt

SEQ ID NO: 289913 - DNA, 25 bp, Rattus norvegicus
gaaatcctcagtcttcaatccagac

SEQ ID NO: 289914 - DNA, 25 bp, Rattus norvegicus
gaaatcctcagtcttttgcctatgg

SEQ ID NO: 289915 - DNA, 25 bp, Rattus norvegicus
gaaatcctcagtgttcaatccagac

SEQ ID NO: 289916 - DNA, 25 bp, Rattus norvegicus
gaaatcctcagtgttttgcctatgg

SEQ ID NO: 289917 - DNA, 25 bp, Rattus norvegicus
gaaatcctccataaagaacttgctg

SEQ ID NO: 289918 - DNA, 25 bp, Rattus norvegicus
gaaatcctccattaagaacttgctg

SEQ ID NO: 289919 - DNA, 25 bp, Rattus norvegicus
gaaatcctcttacgtaactcttaat

SEQ ID NO: 289920 - DNA, 25 bp, Rattus norvegicus
gaaatcctcttaggtaactcttaat

SEQ ID NO: 289921 - DNA, 25 bp, Rattus norvegicus
gaaatcctgaggcaaagtggctatg

SEQ ID NO: 289922 - DNA, 25 bp, Rattus norvegicus
gaaatcctgagggaaagtggctatg

SEQ ID NO: 289923 - DNA, 25 bp, Rattus norvegicus
gaaatcctgcatatcaagatgctgt

SEQ ID NO: 289924 - DNA, 25 bp, Rattus norvegicus
gaaatcctgcatttcaagatgctgt

SEQ ID NO: 289925 - DNA, 25 bp, Rattus norvegicus
gaaatcctgcccaactttgaagtcc

SEQ ID NO: 289926 - DNA, 25 bp, Rattus norvegicus
gaaatcctgccctactttgaagtcc

SEQ ID NO: 289927 - DNA, 25 bp, Rattus norvegicus
gaaatcctgcctcggtgtgcatgca

SEQ ID NO: 289928 - DNA, 25 bp, Rattus norvegicus
gaaatcctgcctgggtgtgcatgca

SEQ ID NO: 289929 - DNA, 25 bp, Rattus norvegicus
gaaatcctggttagagcagttaatc

SEQ ID NO: 289930 - DNA, 25 bp, Rattus norvegicus
gaaatcctggtttgagcagttaatc

SEQ ID NO: 289931 - DNA, 25 bp, Rattus norvegicus
gaaatcctgtcacagggccctggag

SEQ ID NO: 289932 - DNA, 25 bp, Rattus norvegicus
gaaatcctgtcagagggccctggag

SEQ ID NO: 289933 - DNA, 25 bp, Rattus norvegicus
gaaatcctgtgacgctggatcagtt

SEQ ID NO: 289934 - DNA, 25 bp, Rattus norvegicus
gaaatcctgtgaggctggatcagtt

SEQ ID NO: 289935 - DNA, 25 bp, Rattus norvegicus
gaaatcctgtggatttctcataccc

SEQ ID NO: 289936 - DNA, 25 bp, Rattus norvegicus
gaaatcctgtggcattctttaaagc

SEQ ID NO: 289937 - DNA, 25 bp, Rattus norvegicus
gaaatcctgtgggattctttaaagc

SEQ ID NO: 289938 - DNA, 25 bp, Rattus norvegicus
gaaatcctgtggttttctcataccc

SEQ ID NO: 289939 - DNA, 25 bp, Rattus norvegicus
gaaatcctgttcaccgttgctgagc

SEQ ID NO: 289940 - DNA, 25 bp, Rattus norvegicus
gaaatcctgttctccgttgctgagc

SEQ ID NO: 289941 - DNA, 25 bp, Rattus norvegicus
gaaatccttaagaccccaggacttg

SEQ ID NO: 289942 - DNA, 25 bp, Rattus norvegicus
gaaatccttaagtccccaggacttg

SEQ ID NO: 289943 - DNA, 25 bp, Rattus norvegicus
gaaatccttcaaacacgcacagaca

SEQ ID NO: 289944 - DNA, 25 bp, Rattus norvegicus
gaaatccttcaatcacgcacagaca

SEQ ID NO: 289945 - DNA, 25 bp, Rattus norvegicus
gaaatccttcatatgcttgtctgac

SEQ ID NO: 289946 - DNA, 25 bp, Rattus norvegicus
gaaatccttcatttgcttgtctgac

SEQ ID NO: 289947 - DNA, 25 bp, Rattus norvegicus
gaaatccttctgcagacatcagcaa

SEQ ID NO: 289948 - DNA, 25 bp, Rattus norvegicus
gaaatccttctggagacatcagcaa

SEQ ID NO: 289949 - DNA, 25 bp, Rattus norvegicus
gaaatccttgaaatggccttttatt

SEQ ID NO: 289950 - DNA, 25 bp, Rattus norvegicus
gaaatccttgaattggccttttatt

SEQ ID NO: 289951 - DNA, 25 bp, Rattus norvegicus
gaaatccttgtacaactgggagaaa

SEQ ID NO: 289952 - DNA, 25 bp, Rattus norvegicus
gaaatccttgtagaactgggagaaa

SEQ ID NO: 289953 - DNA, 25 bp, Rattus norvegicus
gaaatccttgttcctaagctacaga

SEQ ID NO: 289954 - DNA, 25 bp, Rattus norvegicus
gaaatccttgttcctgtctcatagt

SEQ ID NO: 289955 - DNA, 25 bp, Rattus norvegicus
gaaatccttgttgctaagctacaga

SEQ ID NO: 289956 - DNA, 25 bp, Rattus norvegicus
gaaatccttgttgctgtctcatagt

SEQ ID NO: 289957 - DNA, 25 bp, Rattus norvegicus
gaaatcctttaactctagttcctat

SEQ ID NO: 289958 - DNA, 25 bp, Rattus norvegicus
gaaatcctttaagtctagttcctat

SEQ ID NO: 289959 - DNA, 25 bp, Rattus norvegicus
gaaatcctttcacagtacttcctgc

SEQ ID NO: 289960 - DNA, 25 bp, Rattus norvegicus
gaaatcctttcactaactccatgaa

SEQ ID NO: 289961 - DNA, 25 bp, Rattus norvegicus
gaaatcctttcagagtacttcctgc

SEQ ID NO: 289962 - DNA, 25 bp, Rattus norvegicus
gaaatcctttcagtaactccatgaa

SEQ ID NO: 289963 - DNA, 25 bp, Rattus norvegicus
gaaatcctttccaaaaagctgtgca

SEQ ID NO: 289964 - DNA, 25 bp, Rattus norvegicus
gaaatcctttcctaaaagctgtgca

SEQ ID NO: 289965 - DNA, 25 bp, Rattus norvegicus
gaaatcctttttactcatcaccttt

SEQ ID NO: 289966 - DNA, 25 bp, Rattus norvegicus
gaaatcctttttctactgtgagggt

SEQ ID NO: 289967 - DNA, 25 bp, Rattus norvegicus
gaaatcctttttgtactgtgagggt

SEQ ID NO: 289968 - DNA, 25 bp, Rattus norvegicus
gaaatccttttttctcatcaccttt

SEQ ID NO: 289969 - DNA, 25 bp, Rattus norvegicus
gaaatcgaaatcagtccgaaagtca

SEQ ID NO: 289970 - DNA, 25 bp, Rattus norvegicus
gaaatcgaaatctgtccgaaagtca

SEQ ID NO: 289971 - DNA, 25 bp, Rattus norvegicus
gaaatcgaaattcgcctttctaaat

SEQ ID NO: 289972 - DNA, 25 bp, Rattus norvegicus
gaaatcgaaattggcctttctaaat

SEQ ID NO: 289973 - DNA, 25 bp, Rattus norvegicus
gaaatcgaacccagggtctcggtct

SEQ ID NO: 289974 - DNA, 25 bp, Rattus norvegicus
gaaatcgaaccctgggtctcggtct

SEQ ID NO: 289975 - DNA, 25 bp, Rattus norvegicus
gaaatcgacaacactgagctgctcc

SEQ ID NO: 289976 - DNA, 25 bp, Rattus norvegicus
gaaatcgacaactctgagctgctcc

SEQ ID NO: 289977 - DNA, 25 bp, Rattus norvegicus
gaaatcgagcttcgtctctcttcaa

SEQ ID NO: 289978 - DNA, 25 bp, Rattus norvegicus
gaaatcgagcttggtctctcttcaa

SEQ ID NO: 289979 - DNA, 25 bp, Rattus norvegicus
gaaatcgaggatcctgcccagtttg

SEQ ID NO: 289980 - DNA, 25 bp, Rattus norvegicus
gaaatcgaggatgctgcccagtttg

SEQ ID NO: 289981 - DNA, 25 bp, Rattus norvegicus
gaaatcgagggcagctgttctcctg

SEQ ID NO: 289982 - DNA, 25 bp, Rattus norvegicus
gaaatcgagggctgctgttctcctg

SEQ ID NO: 289983 - DNA, 25 bp, Rattus norvegicus
gaaatcgatgggagcctttacctgt

SEQ ID NO: 289984 - DNA, 25 bp, Rattus norvegicus
gaaatcgatgggtgcctttacctgt

SEQ ID NO: 289985 - DNA, 25 bp, Rattus norvegicus
gaaatcgatttcaacttggtctgat

SEQ ID NO: 289986 - DNA, 25 bp, Rattus norvegicus
gaaatcgatttctacttggtctgat

SEQ ID NO: 289987 - DNA, 25 bp, Rattus norvegicus
gaaatcgcaatgacttgaatctatt

SEQ ID NO: 289988 - DNA, 25 bp, Rattus norvegicus
gaaatcgcaatgtcttgaatctatt

SEQ ID NO: 289989 - DNA, 25 bp, Rattus norvegicus
gaaatcgcattgatttctgcatttg

SEQ ID NO: 289990 - DNA, 25 bp, Rattus norvegicus
gaaatcgcattgttttctgcatttg

SEQ ID NO: 289991 - DNA, 25 bp, Rattus norvegicus
gaaatcgctaacaactgctccgaat

SEQ ID NO: 289992 - DNA, 25 bp, Rattus norvegicus
gaaatcgctaactactgctccgaat

SEQ ID NO: 289993 - DNA, 25 bp, Rattus norvegicus
gaaatcgctaccagagagcctggag

SEQ ID NO: 289994 - DNA, 25 bp, Rattus norvegicus
gaaatcgctacctgagagcctggag

SEQ ID NO: 289995 - DNA, 25 bp, Rattus norvegicus
gaaatcgctcagagttcatgctgta

SEQ ID NO: 289996 - DNA, 25 bp, Rattus norvegicus
gaaatcgctcagtgttcatgctgta

SEQ ID NO: 289997 - DNA, 25 bp, Rattus norvegicus
gaaatcgctgacacatcacacagta

SEQ ID NO: 289998 - DNA, 25 bp, Rattus norvegicus
gaaatcgctgactcatcacacagta

SEQ ID NO: 289999 - DNA, 25 bp, Rattus norvegicus
gaaatcggacacattggttacaact

SEQ ID NO: 290000 - DNA, 25 bp, Rattus norvegicus
gaaatcggacactttggttacaact

SEQ ID NO: 290001 - DNA, 25 bp, Rattus norvegicus
gaaatcggacctcagacttctagca

SEQ ID NO: 290002 - DNA, 25 bp, Rattus norvegicus
gaaatcggacctgagacttctagca

SEQ ID NO: 290003 - DNA, 25 bp, Rattus norvegicus
gaaatcggagacatcctcactaaag

SEQ ID NO: 290004 - DNA, 25 bp, Rattus norvegicus
gaaatcggagacttcctcactaaag

SEQ ID NO: 290005 - DNA, 25 bp, Rattus norvegicus
gaaatcggccttcaccaagagtgat

SEQ ID NO: 290006 - DNA, 25 bp, Rattus norvegicus
gaaatcggccttgaccaagagtgat

SEQ ID NO: 290007 - DNA, 25 bp, Rattus norvegicus
gaaatcggcttcagaccaaccatgt

SEQ ID NO: 290008 - DNA, 25 bp, Rattus norvegicus
gaaatcggcttctgaccaaccatgt

SEQ ID NO: 290009 - DNA, 25 bp, Rattus norvegicus
gaaatcgggatcacggcacattggg

SEQ ID NO: 290010 - DNA, 25 bp, Rattus norvegicus
gaaatcgggatctcggcacattggg

SEQ ID NO: 290011 - DNA, 25 bp, Rattus norvegicus
gaaatcggtaccagtactggcttaa

SEQ ID NO: 290012 - DNA, 25 bp, Rattus norvegicus
gaaatcggtacctgtactggcttaa

SEQ ID NO: 290013 - DNA, 25 bp, Rattus norvegicus
gaaatcgtagccatttagaacttga

SEQ ID NO: 290014 - DNA, 25 bp, Rattus norvegicus
gaaatcgtagccttttagaacttga

SEQ ID NO: 290015 - DNA, 25 bp, Rattus norvegicus
gaaatcgtatttagctcacagagca

SEQ ID NO: 290016 - DNA, 25 bp, Rattus norvegicus
gaaatcgtattttgctcacagagca

SEQ ID NO: 290017 - DNA, 25 bp, Rattus norvegicus
gaaatcgtccttcctatggcaggag

SEQ ID NO: 290018 - DNA, 25 bp, Rattus norvegicus
gaaatcgtccttgctatggcaggag

SEQ ID NO: 290019 - DNA, 25 bp, Rattus norvegicus
gaaatcgtctgtcgatctcttttga

SEQ ID NO: 290020 - DNA, 25 bp, Rattus norvegicus
gaaatcgtctgtggatctcttttga

SEQ ID NO: 290021 - DNA, 25 bp, Rattus norvegicus
gaaatcgtgagaagcccatgtgaga

SEQ ID NO: 290022 - DNA, 25 bp, Rattus norvegicus
gaaatcgtgagatgcccatgtgaga

SEQ ID NO: 290023 - DNA, 25 bp, Rattus norvegicus
gaaatcgtgattagttctctccagc

SEQ ID NO: 290024 - DNA, 25 bp, Rattus norvegicus
gaaatcgtgatttgttctctccagc

SEQ ID NO: 290025 - DNA, 25 bp, Rattus norvegicus
gaaatcgtggacctcacctgtgaat

SEQ ID NO: 290026 - DNA, 25 bp, Rattus norvegicus
gaaatcgtggacgtcacctgtgaat

SEQ ID NO: 290027 - DNA, 25 bp, Rattus norvegicus
gaaatcgtgggtacacttctaggat

SEQ ID NO: 290028 - DNA, 25 bp, Rattus norvegicus
gaaatcgtgggttcacttctaggat

SEQ ID NO: 290029 - DNA, 25 bp, Rattus norvegicus
gaaatcgtggtgaatctgttccacc

SEQ ID NO: 290030 - DNA, 25 bp, Rattus norvegicus
gaaatcgtggtgtatctgttccacc

SEQ ID NO: 290031 - DNA, 25 bp, Rattus norvegicus
gaaatcgtgtcaattccactagccc

SEQ ID NO: 290032 - DNA, 25 bp, Rattus norvegicus
gaaatcgtgtcatttccactagccc

SEQ ID NO: 290033 - DNA, 25 bp, Rattus norvegicus
gaaatcgttggaactcttcctctgg

SEQ ID NO: 290034 - DNA, 25 bp, Rattus norvegicus
gaaatcgttggatctcttcctctgg

SEQ ID NO: 290035 - DNA, 25 bp, Rattus norvegicus
gaaatcgtttcacactcgttgggat

SEQ ID NO: 290036 - DNA, 25 bp, Rattus norvegicus
gaaatcgtttcagactcgttgggat

SEQ ID NO: 290037 - DNA, 25 bp, Rattus norvegicus
gaaatctaagtcagggtatcaggtt

SEQ ID NO: 290038 - DNA, 25 bp, Rattus norvegicus
gaaatctaagtctgggtatcaggtt

SEQ ID NO: 290039 - DNA, 25 bp, Rattus norvegicus
gaaatctaatacacccttcccaaat

SEQ ID NO: 290040 - DNA, 25 bp, Rattus norvegicus
gaaatctaatactcccttcccaaat

SEQ ID NO: 290041 - DNA, 25 bp, Rattus norvegicus
gaaatctacagcatttcttctctct

SEQ ID NO: 290042 - DNA, 25 bp, Rattus norvegicus
gaaatctacagcttttcttctctct

SEQ ID NO: 290043 - DNA, 25 bp, Rattus norvegicus
gaaatctaccatctgtcagatgatt

SEQ ID NO: 290044 - DNA, 25 bp, Rattus norvegicus
gaaatctaccatgtgtcagatgatt

SEQ ID NO: 290045 - DNA, 25 bp, Rattus norvegicus
gaaatctaccgtattgtgtcacaga

SEQ ID NO: 290046 - DNA, 25 bp, Rattus norvegicus
gaaatctaccgttttgtgtcacaga

SEQ ID NO: 290047 - DNA, 25 bp, Rattus norvegicus
gaaatctacttcagcatggccaaca

SEQ ID NO: 290048 - DNA, 25 bp, Rattus norvegicus
gaaatctacttctgcatggccaaca

SEQ ID NO: 290049 - DNA, 25 bp, Rattus norvegicus
gaaatctactttctaatatctcgta

SEQ ID NO: 290050 - DNA, 25 bp, Rattus norvegicus
gaaatctactttgtaatatctcgta

SEQ ID NO: 290051 - DNA, 25 bp, Rattus norvegicus
gaaatctagcaccacattaaacctg

SEQ ID NO: 290052 - DNA, 25 bp, Rattus norvegicus
gaaatctagcacgacattaaacctg

SEQ ID NO: 290053 - DNA, 25 bp, Rattus norvegicus
gaaatctagcatagtctttctgaca

SEQ ID NO: 290054 - DNA, 25 bp, Rattus norvegicus
gaaatctagcattgtctttctgaca

SEQ ID NO: 290055 - DNA, 25 bp, Rattus norvegicus
gaaatctagcccatgtactggaccc

SEQ ID NO: 290056 - DNA, 25 bp, Rattus norvegicus
gaaatctagcccttgtactggaccc

SEQ ID NO: 290057 - DNA, 25 bp, Rattus norvegicus
gaaatctatgaacccctgagagcat

SEQ ID NO: 290058 - DNA, 25 bp, Rattus norvegicus
gaaatctatgaagccctgagagcat

SEQ ID NO: 290059 - DNA, 25 bp, Rattus norvegicus
gaaatctatgttcatcctgagagag

SEQ ID NO: 290060 - DNA, 25 bp, Rattus norvegicus
gaaatctatgttgatcctgagagag

SEQ ID NO: 290061 - DNA, 25 bp, Rattus norvegicus
gaaatctattatctccaggccatgg

SEQ ID NO: 290062 - DNA, 25 bp, Rattus norvegicus
gaaatctattatgtccaggccatgg

SEQ ID NO: 290063 - DNA, 25 bp, Rattus norvegicus
gaaatctcaaccatcccattcctta

SEQ ID NO: 290064 - DNA, 25 bp, Rattus norvegicus
gaaatctcaaccttcccattcctta

SEQ ID NO: 290065 - DNA, 25 bp, Rattus norvegicus
gaaatctcacaaacaggccacgaag

SEQ ID NO: 290066 - DNA, 25 bp, Rattus norvegicus
gaaatctcacaatcaggccacgaag

SEQ ID NO: 290067 - DNA, 25 bp, Rattus norvegicus
gaaatctcacttccaacttgtgcaa

SEQ ID NO: 290068 - DNA, 25 bp, Rattus norvegicus
gaaatctcacttcttttgtgtcact

SEQ ID NO: 290069 - DNA, 25 bp, Rattus norvegicus
gaaatctcacttgcaacttgtgcaa

SEQ ID NO: 290070 - DNA, 25 bp, Rattus norvegicus
gaaatctcacttgttttgtgtcact

SEQ ID NO: 290071 - DNA, 25 bp, Rattus norvegicus
gaaatctcagatcacagagccaggc

SEQ ID NO: 290072 - DNA, 25 bp, Rattus norvegicus
gaaatctcagatgacagagccaggc

SEQ ID NO: 290073 - DNA, 25 bp, Rattus norvegicus
gaaatctcaggcacctatagatctg

SEQ ID NO: 290074 - DNA, 25 bp, Rattus norvegicus
gaaatctcaggctcctatagatctg

SEQ ID NO: 290075 - DNA, 25 bp, Rattus norvegicus
gaaatctcagtacatagtgagttca

SEQ ID NO: 290076 - DNA, 25 bp, Rattus norvegicus
gaaatctcagtagatagtgagttca

SEQ ID NO: 290077 - DNA, 25 bp, Rattus norvegicus
gaaatctcagtgagctctctcatgt

SEQ ID NO: 290078 - DNA, 25 bp, Rattus norvegicus
gaaatctcagtgtgctctctcatgt

SEQ ID NO: 290079 - DNA, 25 bp, Rattus norvegicus
gaaatctcatctacttcatgcatgt

SEQ ID NO: 290080 - DNA, 25 bp, Rattus norvegicus
gaaatctcatcttcttcatgcatgt

SEQ ID NO: 290081 - DNA, 25 bp, Rattus norvegicus
gaaatctcccatatgtgactgcata

SEQ ID NO: 290082 - DNA, 25 bp, Rattus norvegicus
gaaatctcccatttgtgactgcata

SEQ ID NO: 290083 - DNA, 25 bp, Rattus norvegicus
gaaatctccctacaatgggctcgct

SEQ ID NO: 290084 - DNA, 25 bp, Rattus norvegicus
gaaatctccctagaatgggctcgct

SEQ ID NO: 290085 - DNA, 25 bp, Rattus norvegicus
gaaatctccgatcgtgttcaaacct

SEQ ID NO: 290086 - DNA, 25 bp, Rattus norvegicus
gaaatctccgatggtgttcaaacct

SEQ ID NO: 290087 - DNA, 25 bp, Rattus norvegicus
gaaatctccttgatggcaatcttcc

SEQ ID NO: 290088 - DNA, 25 bp, Rattus norvegicus
gaaatctccttgttggcaatcttcc

SEQ ID NO: 290089 - DNA, 25 bp, Rattus norvegicus
gaaatctcctttcacagtccagtat

SEQ ID NO: 290090 - DNA, 25 bp, Rattus norvegicus
gaaatctcctttgacagtccagtat

SEQ ID NO: 290091 - DNA, 25 bp, Rattus norvegicus
gaaatctcgataaagacccagcaag

SEQ ID NO: 290092 - DNA, 25 bp, Rattus norvegicus
gaaatctcgatatagacccagcaag

SEQ ID NO: 290093 - DNA, 25 bp, Rattus norvegicus
gaaatctcggccctttgctatgacg

SEQ ID NO: 290094 - DNA, 25 bp, Rattus norvegicus
gaaatctcggccgtttgctatgacg

SEQ ID NO: 290095 - DNA, 25 bp, Rattus norvegicus
gaaatctcggtgatcagcagagtca

SEQ ID NO: 290096 - DNA, 25 bp, Rattus norvegicus
gaaatctcggtgttcagcagagtca

SEQ ID NO: 290097 - DNA, 25 bp, Rattus norvegicus
gaaatctctaaaagctgaacagggt

SEQ ID NO: 290098 - DNA, 25 bp, Rattus norvegicus
gaaatctctaaatgctgaacagggt

SEQ ID NO: 290099 - DNA, 25 bp, Rattus norvegicus
gaaatctctaatcaagctgctgtgt

SEQ ID NO: 290100 - DNA, 25 bp, Rattus norvegicus
gaaatctctaatgaagctgctgtgt

SEQ ID NO: 290101 - DNA, 25 bp, Rattus norvegicus
gaaatctctagtaattaaggtcctt

SEQ ID NO: 290102 - DNA, 25 bp, Rattus norvegicus
gaaatctctagttattaaggtcctt

SEQ ID NO: 290103 - DNA, 25 bp, Rattus norvegicus
gaaatctctccaacctgggagttgt

SEQ ID NO: 290104 - DNA, 25 bp, Rattus norvegicus
gaaatctctccatcctgggagttgt

SEQ ID NO: 290105 - DNA, 25 bp, Rattus norvegicus
gaaatctctgtcaagccacggttat

SEQ ID NO: 290106 - DNA, 25 bp, Rattus norvegicus
gaaatctctgtctagccacggttat

SEQ ID NO: 290107 - DNA, 25 bp, Rattus norvegicus
gaaatctcttgacagtttgcccagt

SEQ ID NO: 290108 - DNA, 25 bp, Rattus norvegicus
gaaatctcttgagagtttgcccagt

SEQ ID NO: 290109 - DNA, 25 bp, Rattus norvegicus
gaaatctctttgaacaacacttgtt

SEQ ID NO: 290110 - DNA, 25 bp, Rattus norvegicus
gaaatctctttgtacaacacttgtt

SEQ ID NO: 290111 - DNA, 25 bp, Rattus norvegicus
gaaatctcttttacctcaaatagtt

SEQ ID NO: 290112 - DNA, 25 bp, Rattus norvegicus
gaaatctctttttcctcaaatagtt

SEQ ID NO: 290113 - DNA, 25 bp, Rattus norvegicus
gaaatctgacatagcatggttgagt

SEQ ID NO: 290114 - DNA, 25 bp, Rattus norvegicus
gaaatctgacattgcatggttgagt

SEQ ID NO: 290115 - DNA, 25 bp, Rattus norvegicus
gaaatctgactcatgcgcatttgat

SEQ ID NO: 290116 - DNA, 25 bp, Rattus norvegicus
gaaatctgactcttgcgcatttgat

SEQ ID NO: 290117 - DNA, 25 bp, Rattus norvegicus
gaaatctgagatagctgttgaccaa

SEQ ID NO: 290118 - DNA, 25 bp, Rattus norvegicus
gaaatctgagattgctgttgaccaa

SEQ ID NO: 290119 - DNA, 25 bp, Rattus norvegicus
gaaatctgcaagaggctagccccag

SEQ ID NO: 290120 - DNA, 25 bp, Rattus norvegicus
gaaatctgcaagtggctagccccag

SEQ ID NO: 290121 - DNA, 25 bp, Rattus norvegicus
gaaatctgcaccacacagtgctggc

SEQ ID NO: 290122 - DNA, 25 bp, Rattus norvegicus
gaaatctgcacctcacagtgctggc

SEQ ID NO: 290123 - DNA, 25 bp, Rattus norvegicus
gaaatctgccaaagacttgcctcct

SEQ ID NO: 290124 - DNA, 25 bp, Rattus norvegicus
gaaatctgccaatgacttgcctcct

SEQ ID NO: 290125 - DNA, 25 bp, Rattus norvegicus
gaaatctgccatctgaaagcctcac

SEQ ID NO: 290126 - DNA, 25 bp, Rattus norvegicus
gaaatctgccatgtgaaagcctcac

SEQ ID NO: 290127 - DNA, 25 bp, Rattus norvegicus
gaaatctgcccaccaggagctgaag

SEQ ID NO: 290128 - DNA, 25 bp, Rattus norvegicus
gaaatctgcccagcaggagctgaag

SEQ ID NO: 290129 - DNA, 25 bp, Rattus norvegicus
gaaatctgccttcatcataattgtg

SEQ ID NO: 290130 - DNA, 25 bp, Rattus norvegicus
gaaatctgccttgatcataattgtg

SEQ ID NO: 290131 - DNA, 25 bp, Rattus norvegicus
gaaatctgctaaattcctcctaatt

SEQ ID NO: 290132 - DNA, 25 bp, Rattus norvegicus
gaaatctgctaatttcctcctaatt

SEQ ID NO: 290133 - DNA, 25 bp, Rattus norvegicus
gaaatctgcttacagtcggattaaa

SEQ ID NO: 290134 - DNA, 25 bp, Rattus norvegicus
gaaatctgcttagagtcggattaaa

SEQ ID NO: 290135 - DNA, 25 bp, Rattus norvegicus
gaaatctgcttcagccaaggctaag

SEQ ID NO: 290136 - DNA, 25 bp, Rattus norvegicus
gaaatctgcttctgccaaggctaag

SEQ ID NO: 290137 - DNA, 25 bp, Rattus norvegicus
gaaatctggagtctttcacaacatg

SEQ ID NO: 290138 - DNA, 25 bp, Rattus norvegicus
gaaatctggagtgtttcacaacatg

SEQ ID NO: 290139 - DNA, 25 bp, Rattus norvegicus
gaaatctggctgcatatttggtcct

SEQ ID NO: 290140 - DNA, 25 bp, Rattus norvegicus
gaaatctggctggatatttggtcct

SEQ ID NO: 290141 - DNA, 25 bp, Rattus norvegicus
gaaatctggttcaggtggcaaccaa

SEQ ID NO: 290142 - DNA, 25 bp, Rattus norvegicus
gaaatctggttctggtggcaaccaa

SEQ ID NO: 290143 - DNA, 25 bp, Rattus norvegicus
gaaatctgtccgaaagtcacccaga

SEQ ID NO: 290144 - DNA, 25 bp, Rattus norvegicus
gaaatctgtccgtaagtcacccaga

SEQ ID NO: 290145 - DNA, 25 bp, Rattus norvegicus
gaaatctgtggcacctgaatccttt

SEQ ID NO: 290146 - DNA, 25 bp, Rattus norvegicus
gaaatctgtggctcctgaatccttt

SEQ ID NO: 290147 - DNA, 25 bp, Rattus norvegicus
gaaatctgttcactattcactcacc

SEQ ID NO: 290148 - DNA, 25 bp, Rattus norvegicus
gaaatctgttcagtattcactcacc

SEQ ID NO: 290149 - DNA, 25 bp, Rattus norvegicus
gaaatctgttctagtgactcattag

SEQ ID NO: 290150 - DNA, 25 bp, Rattus norvegicus
gaaatctgttctcaggactcgcatc

SEQ ID NO: 290151 - DNA, 25 bp, Rattus norvegicus
gaaatctgttctgaggactcgcatc

SEQ ID NO: 290152 - DNA, 25 bp, Rattus norvegicus
gaaatctgttcttgtgactcattag

SEQ ID NO: 290153 - DNA, 25 bp, Rattus norvegicus
gaaatctgtttaaatgtggatgaca

SEQ ID NO: 290154 - DNA, 25 bp, Rattus norvegicus
gaaatctgtttatatgtggatgaca

SEQ ID NO: 290155 - DNA, 25 bp, Rattus norvegicus
gaaatctgtttcaactggcctgaga

SEQ ID NO: 290156 - DNA, 25 bp, Rattus norvegicus
gaaatctgtttctactggcctgaga

SEQ ID NO: 290157 - DNA, 25 bp, Rattus norvegicus
gaaatctgttttcccgtgtgacttt

SEQ ID NO: 290158 - DNA, 25 bp, Rattus norvegicus
gaaatctgttttcttgctcaaataa

SEQ ID NO: 290159 - DNA, 25 bp, Rattus norvegicus
gaaatctgttttgccgtgtgacttt

SEQ ID NO: 290160 - DNA, 25 bp, Rattus norvegicus
gaaatctgttttgttgctcaaataa

SEQ ID NO: 290161 - DNA, 25 bp, Rattus norvegicus
gaaatcttacctactgtgaatatgt

SEQ ID NO: 290162 - DNA, 25 bp, Rattus norvegicus
gaaatcttaccttctgtgaatatgt

SEQ ID NO: 290163 - DNA, 25 bp, Rattus norvegicus
gaaatcttactccttctggttttgg

SEQ ID NO: 290164 - DNA, 25 bp, Rattus norvegicus
gaaatcttactcgttctggttttgg

SEQ ID NO: 290165 - DNA, 25 bp, Rattus norvegicus
gaaatcttagtaagtaatagcgaag

SEQ ID NO: 290166 - DNA, 25 bp, Rattus norvegicus
gaaatcttagtatgtaatagcgaag

SEQ ID NO: 290167 - DNA, 25 bp, Rattus norvegicus
gaaatcttattgagaaagcgctaac

SEQ ID NO: 290168 - DNA, 25 bp, Rattus norvegicus
gaaatcttattgtgaaagcgctaac

SEQ ID NO: 290169 - DNA, 25 bp, Rattus norvegicus
gaaatcttccctcctgaagacaaga

SEQ ID NO: 290170 - DNA, 25 bp, Rattus norvegicus
gaaatcttccctgctgaagacaaga

SEQ ID NO: 290171 - DNA, 25 bp, Rattus norvegicus
gaaatcttcctgcaacagtaaatga

SEQ ID NO: 290172 - DNA, 25 bp, Rattus norvegicus
gaaatcttcctggaacagtaaatga

SEQ ID NO: 290173 - DNA, 25 bp, Rattus norvegicus
gaaatcttctctctgctctgatttg

SEQ ID NO: 290174 - DNA, 25 bp, Rattus norvegicus
gaaatcttctctgtgctctgatttg

SEQ ID NO: 290175 - DNA, 25 bp, Rattus norvegicus
gaaatcttctgaaccactaatttta

SEQ ID NO: 290176 - DNA, 25 bp, Rattus norvegicus
gaaatcttctgatccactaatttta

SEQ ID NO: 290177 - DNA, 25 bp, Rattus norvegicus
gaaatcttgaatcccatactacccc

SEQ ID NO: 290178 - DNA, 25 bp, Rattus norvegicus
gaaatcttgaatgccatactacccc

SEQ ID NO: 290179 - DNA, 25 bp, Rattus norvegicus
gaaatcttgactaggttaattctac

SEQ ID NO: 290180 - DNA, 25 bp, Rattus norvegicus
gaaatcttgacttggttaattctac

SEQ ID NO: 290181 - DNA, 25 bp, Rattus norvegicus
gaaatcttggaaatgttgttcacat

SEQ ID NO: 290182 - DNA, 25 bp, Rattus norvegicus
gaaatcttggaattgttgttcacat

SEQ ID NO: 290183 - DNA, 25 bp, Rattus norvegicus
gaaatcttggacattgcacctttat

SEQ ID NO: 290184 - DNA, 25 bp, Rattus norvegicus
gaaatcttggactttgcacctttat

SEQ ID NO: 290185 - DNA, 25 bp, Rattus norvegicus
gaaatcttggtactactaagttatt

SEQ ID NO: 290186 - DNA, 25 bp, Rattus norvegicus
gaaatcttggtagtactaagttatt

SEQ ID NO: 290187 - DNA, 25 bp, Rattus norvegicus
gaaatcttgtctaaccactgtggat

SEQ ID NO: 290188 - DNA, 25 bp, Rattus norvegicus
gaaatcttgtcttaccactgtggat

SEQ ID NO: 290189 - DNA, 25 bp, Rattus norvegicus
gaaatctttaacaggcctttactcg

SEQ ID NO: 290190 - DNA, 25 bp, Rattus norvegicus
gaaatctttaactggcctttactcg

SEQ ID NO: 290191 - DNA, 25 bp, Rattus norvegicus
gaaatctttatgcttcccggaccat

SEQ ID NO: 290192 - DNA, 25 bp, Rattus norvegicus
gaaatctttatggttcccggaccat

SEQ ID NO: 290193 - DNA, 25 bp, Rattus norvegicus
gaaatctttctcaattaaattgcac

SEQ ID NO: 290194 - DNA, 25 bp, Rattus norvegicus
gaaatctttctctattaaattgcac

SEQ ID NO: 290195 - DNA, 25 bp, Rattus norvegicus
gaaatctttctgagggtccttgctc

SEQ ID NO: 290196 - DNA, 25 bp, Rattus norvegicus
gaaatctttctgtgggtccttgctc

SEQ ID NO: 290197 - DNA, 25 bp, Rattus norvegicus
gaaatctttgagctaaactccttcg

SEQ ID NO: 290198 - DNA, 25 bp, Rattus norvegicus
gaaatctttgaggtaaactccttcg

SEQ ID NO: 290199 - DNA, 25 bp, Rattus norvegicus
gaaatctttgccaagagatggcaga

SEQ ID NO: 290200 - DNA, 25 bp, Rattus norvegicus
gaaatctttgcctagagatggcaga

SEQ ID NO: 290201 - DNA, 25 bp, Rattus norvegicus
gaaatctttgttcattctctggaaa

SEQ ID NO: 290202 - DNA, 25 bp, Rattus norvegicus
gaaatctttgttgattctctggaaa

SEQ ID NO: 290203 - DNA, 25 bp, Rattus norvegicus
gaaatcttttcgagcagcgctacaa

SEQ ID NO: 290204 - DNA, 25 bp, Rattus norvegicus
gaaatcttttcgtgcagcgctacaa

SEQ ID NO: 290205 - DNA, 25 bp, Rattus norvegicus
gaaatctttttcagacctcattgga

SEQ ID NO: 290206 - DNA, 25 bp, Rattus norvegicus
gaaatctttttctgacctcattgga

SEQ ID NO: 290207 - DNA, 25 bp, Rattus norvegicus
gaaatctttttgacctatccagtat

SEQ ID NO: 290208 - DNA, 25 bp, Rattus norvegicus
gaaatctttttgtcctatccagtat

SEQ ID NO: 290209 - DNA, 25 bp, Rattus norvegicus
gaaatgaaaaatctggcctttgcag

SEQ ID NO: 290210 - DNA, 25 bp, Rattus norvegicus
gaaatgaaaaatgtggcctttgcag

SEQ ID NO: 290211 - DNA, 25 bp, Rattus norvegicus
gaaatgaaacttcctctcctgactt

SEQ ID NO: 290212 - DNA, 25 bp, Rattus norvegicus
gaaatgaaacttgctctcctgactt

SEQ ID NO: 290213 - DNA, 25 bp, Rattus norvegicus
gaaatgaaagctacctttgtgggct

SEQ ID NO: 290214 - DNA, 25 bp, Rattus norvegicus
gaaatgaaagcttcctttgtgggct

SEQ ID NO: 290215 - DNA, 25 bp, Rattus norvegicus
gaaatgaacactcagctggctagat

SEQ ID NO: 290216 - DNA, 25 bp, Rattus norvegicus
gaaatgaacactgagctggctagat

SEQ ID NO: 290217 - DNA, 25 bp, Rattus norvegicus
gaaatgaacctcatagactccatgt

SEQ ID NO: 290218 - DNA, 25 bp, Rattus norvegicus
gaaatgaacctcttagactccatgt

SEQ ID NO: 290219 - DNA, 25 bp, Rattus norvegicus
gaaatgaactcaaatgttagcactt

SEQ ID NO: 290220 - DNA, 25 bp, Rattus norvegicus
gaaatgaactcatatgttagcactt

SEQ ID NO: 290221 - DNA, 25 bp, Rattus norvegicus
gaaatgaagccaagttagccccaaa

SEQ ID NO: 290222 - DNA, 25 bp, Rattus norvegicus
gaaatgaagccatgttagccccaaa

SEQ ID NO: 290223 - DNA, 25 bp, Rattus norvegicus
gaaatgaatcatatcctgccctgtg

SEQ ID NO: 290224 - DNA, 25 bp, Rattus norvegicus
gaaatgaatcatttcctgccctgtg

SEQ ID NO: 290225 - DNA, 25 bp, Rattus norvegicus
gaaatgaattagatccctgagcctg

SEQ ID NO: 290226 - DNA, 25 bp, Rattus norvegicus
gaaatgaattagttccctgagcctg

SEQ ID NO: 290227 - DNA, 25 bp, Rattus norvegicus
gaaatgacaacgacaaccctccaga

SEQ ID NO: 290228 - DNA, 25 bp, Rattus norvegicus
gaaatgacaacgtcaaccctccaga

SEQ ID NO: 290229 - DNA, 25 bp, Rattus norvegicus
gaaatgacaatcacgctgttgcttg

SEQ ID NO: 290230 - DNA, 25 bp, Rattus norvegicus
gaaatgacaatctcgctgttgcttg

SEQ ID NO: 290231 - DNA, 25 bp, Rattus norvegicus
gaaatgacagtcatggcacctcagt

SEQ ID NO: 290232 - DNA, 25 bp, Rattus norvegicus
gaaatgacagtcatgttgtgttact

SEQ ID NO: 290233 - DNA, 25 bp, Rattus norvegicus
gaaatgacagtcttggcacctcagt

SEQ ID NO: 290234 - DNA, 25 bp, Rattus norvegicus
gaaatgacagtcttgttgtgttact

SEQ ID NO: 290235 - DNA, 25 bp, Rattus norvegicus
gaaatgacatccatagcactctgta

SEQ ID NO: 290236 - DNA, 25 bp, Rattus norvegicus
gaaatgacatccttagcactctgta

SEQ ID NO: 290237 - DNA, 25 bp, Rattus norvegicus
gaaatgaccacaccctatgtacttt

SEQ ID NO: 290238 - DNA, 25 bp, Rattus norvegicus
gaaatgaccacagcctatgtacttt

SEQ ID NO: 290239 - DNA, 25 bp, Rattus norvegicus
gaaatgaccccgctcaaaacaacgt

SEQ ID NO: 290240 - DNA, 25 bp, Rattus norvegicus
gaaatgaccccggtcaaaacaacgt

SEQ ID NO: 290241 - DNA, 25 bp, Rattus norvegicus
gaaatgaccttcaccttagtgctgg

SEQ ID NO: 290242 - DNA, 25 bp, Rattus norvegicus
gaaatgaccttctccttagtgctgg

SEQ ID NO: 290243 - DNA, 25 bp, Rattus norvegicus
gaaatgacgcccatcaggtagaaat

SEQ ID NO: 290244 - DNA, 25 bp, Rattus norvegicus
gaaatgacgcccttcaggtagaaat

SEQ ID NO: 290245 - DNA, 25 bp, Rattus norvegicus
gaaatgactacccttactacctaga

SEQ ID NO: 290246 - DNA, 25 bp, Rattus norvegicus
gaaatgactaccgttactacctaga

SEQ ID NO: 290247 - DNA, 25 bp, Rattus norvegicus
gaaatgactccaagtactaccctag

SEQ ID NO: 290248 - DNA, 25 bp, Rattus norvegicus
gaaatgactccatgtactaccctag

SEQ ID NO: 290249 - DNA, 25 bp, Rattus norvegicus
gaaatgactctgaggaccttaaatt

SEQ ID NO: 290250 - DNA, 25 bp, Rattus norvegicus
gaaatgactctgtggaccttaaatt

SEQ ID NO: 290251 - DNA, 25 bp, Rattus norvegicus
gaaatgactgtgctggtggtcccac

SEQ ID NO: 290252 - DNA, 25 bp, Rattus norvegicus
gaaatgactgtggtggtggtcccac

SEQ ID NO: 290253 - DNA, 25 bp, Rattus norvegicus
gaaatgactgttattgcacctcttg

SEQ ID NO: 290254 - DNA, 25 bp, Rattus norvegicus
gaaatgactgtttttgcacctcttg

SEQ ID NO: 290255 - DNA, 25 bp, Rattus norvegicus
gaaatgacttagcaggcccaccttc

SEQ ID NO: 290256 - DNA, 25 bp, Rattus norvegicus
gaaatgacttaggaggcccaccttc

SEQ ID NO: 290257 - DNA, 25 bp, Rattus norvegicus
gaaatgacttcaacctaccaacagg

SEQ ID NO: 290258 - DNA, 25 bp, Rattus norvegicus
gaaatgacttcatcctaccaacagg

SEQ ID NO: 290259 - DNA, 25 bp, Rattus norvegicus
gaaatgactttgcactactttgtaa

SEQ ID NO: 290260 - DNA, 25 bp, Rattus norvegicus
gaaatgactttggactactttgtaa

SEQ ID NO: 290261 - DNA, 25 bp, Rattus norvegicus
gaaatgagccccacaggaactgcgt

SEQ ID NO: 290262 - DNA, 25 bp, Rattus norvegicus
gaaatgagcccctcaggaactgcgt

SEQ ID NO: 290263 - DNA, 25 bp, Rattus norvegicus
gaaatgagcttgatcacagctgttg

SEQ ID NO: 290264 - DNA, 25 bp, Rattus norvegicus
gaaatgagcttgttcacagctgttg

SEQ ID NO: 290265 - DNA, 25 bp, Rattus norvegicus
gaaatgaggactacaggccctggag

SEQ ID NO: 290266 - DNA, 25 bp, Rattus norvegicus
gaaatgaggacttcaggccctggag

SEQ ID NO: 290267 - DNA, 25 bp, Rattus norvegicus
gaaatgaggattaacaacccctggg

SEQ ID NO: 290268 - DNA, 25 bp, Rattus norvegicus
gaaatgaggatttacaacccctggg

SEQ ID NO: 290269 - DNA, 25 bp, Rattus norvegicus
gaaatgaggcagaagcccagcagat

SEQ ID NO: 290270 - DNA, 25 bp, Rattus norvegicus
gaaatgaggcagtagcccagcagat

SEQ ID NO: 290271 - DNA, 25 bp, Rattus norvegicus
gaaatgagggcactagcttttgaaa

SEQ ID NO: 290272 - DNA, 25 bp, Rattus norvegicus
gaaatgagggcagtagcttttgaaa

SEQ ID NO: 290273 - DNA, 25 bp, Rattus norvegicus
gaaatgagggcgcttccagtttgtt

SEQ ID NO: 290274 - DNA, 25 bp, Rattus norvegicus
gaaatgagggcggttccagtttgtt

SEQ ID NO: 290275 - DNA, 25 bp, Rattus norvegicus
gaaatgagggtcacttccagttcct

SEQ ID NO: 290276 - DNA, 25 bp, Rattus norvegicus
gaaatgagggtctcttccagttcct

SEQ ID NO: 290277 - DNA, 25 bp, Rattus norvegicus
gaaatgagtagtactttgcacacaa

SEQ ID NO: 290278 - DNA, 25 bp, Rattus norvegicus
gaaatgagtagttctttgcacacaa

SEQ ID NO: 290279 - DNA, 25 bp, Rattus norvegicus
gaaatgagtcagagtacccttccca

SEQ ID NO: 290280 - DNA, 25 bp, Rattus norvegicus
gaaatgagtcagtgtacccttccca

SEQ ID NO: 290281 - DNA, 25 bp, Rattus norvegicus
gaaatgagtcatatggaggaacccc

SEQ ID NO: 290282 - DNA, 25 bp, Rattus norvegicus
gaaatgagtcatttggaggaacccc

SEQ ID NO: 290283 - DNA, 25 bp, Rattus norvegicus
gaaatgagtcttagggcctttgctg

SEQ ID NO: 290284 - DNA, 25 bp, Rattus norvegicus
gaaatgagtctttgggcctttgctg

SEQ ID NO: 290285 - DNA, 25 bp, Rattus norvegicus
gaaatgataaatcccctaatgccaa

SEQ ID NO: 290286 - DNA, 25 bp, Rattus norvegicus
gaaatgataaatgccctaatgccaa

SEQ ID NO: 290287 - DNA, 25 bp, Rattus norvegicus
gaaatgatatgaagttggtccttga

SEQ ID NO: 290288 - DNA, 25 bp, Rattus norvegicus
gaaatgatatgatgttggtccttga

SEQ ID NO: 290289 - DNA, 25 bp, Rattus norvegicus
gaaatgatattcaggcttcgtacca

SEQ ID NO: 290290 - DNA, 25 bp, Rattus norvegicus
gaaatgatattctggcttcgtacca

SEQ ID NO: 290291 - DNA, 25 bp, Rattus norvegicus
gaaatgatctgaaagttcacctcaa

SEQ ID NO: 290292 - DNA, 25 bp, Rattus norvegicus
gaaatgatctgatagttcacctcaa

SEQ ID NO: 290293 - DNA, 25 bp, Rattus norvegicus
gaaatgatctgtatctgagctgaga

SEQ ID NO: 290294 - DNA, 25 bp, Rattus norvegicus
gaaatgatctgtttctgagctgaga

SEQ ID NO: 290295 - DNA, 25 bp, Rattus norvegicus
gaaatgatcttcctgcggttcaaaa

SEQ ID NO: 290296 - DNA, 25 bp, Rattus norvegicus
gaaatgatcttcgtgcggttcaaaa

SEQ ID NO: 290297 - DNA, 25 bp, Rattus norvegicus
gaaatgattatcacagttcagaact

SEQ ID NO: 290298 - DNA, 25 bp, Rattus norvegicus
gaaatgattatctcagttcagaact

SEQ ID NO: 290299 - DNA, 25 bp, Rattus norvegicus
gaaatgattcctcctaagtctagct

SEQ ID NO: 290300 - DNA, 25 bp, Rattus norvegicus
gaaatgattcctgctaagtctagct

SEQ ID NO: 290301 - DNA, 25 bp, Rattus norvegicus
gaaatgattcttcaagcatctgaat

SEQ ID NO: 290302 - DNA, 25 bp, Rattus norvegicus
gaaatgattcttgaagcatctgaat

SEQ ID NO: 290303 - DNA, 25 bp, Rattus norvegicus
gaaatgattgtcagacttctccctt

SEQ ID NO: 290304 - DNA, 25 bp, Rattus norvegicus
gaaatgattgtctgacttctccctt

SEQ ID NO: 290305 - DNA, 25 bp, Rattus norvegicus
gaaatgcaacatagtccctagcctg

SEQ ID NO: 290306 - DNA, 25 bp, Rattus norvegicus
gaaatgcaacattgtccctagcctg

SEQ ID NO: 290307 - DNA, 25 bp, Rattus norvegicus
gaaatgcaacctcaacttgtagaag

SEQ ID NO: 290308 - DNA, 25 bp, Rattus norvegicus
gaaatgcaacctgaacttgtagaag

SEQ ID NO: 290309 - DNA, 25 bp, Rattus norvegicus
gaaatgcaacgtagttcccgtgtgt

SEQ ID NO: 290310 - DNA, 25 bp, Rattus norvegicus
gaaatgcaacgttgttcccgtgtgt

SEQ ID NO: 290311 - DNA, 25 bp, Rattus norvegicus
gaaatgcaatttacatgtctttggt

SEQ ID NO: 290312 - DNA, 25 bp, Rattus norvegicus
gaaatgcaattttcatgtctttggt

SEQ ID NO: 290313 - DNA, 25 bp, Rattus norvegicus
gaaatgcacatacccaagtcttgac

SEQ ID NO: 290314 - DNA, 25 bp, Rattus norvegicus
gaaatgcacataccctgtcctcaag

SEQ ID NO: 290315 - DNA, 25 bp, Rattus norvegicus
gaaatgcacatagccaagtcttgac

SEQ ID NO: 290316 - DNA, 25 bp, Rattus norvegicus
gaaatgcacatagcctgtcctcaag

SEQ ID NO: 290317 - DNA, 25 bp, Rattus norvegicus
gaaatgcaccatcaccaaccatatg

SEQ ID NO: 290318 - DNA, 25 bp, Rattus norvegicus
gaaatgcaccatgaccaaccatatg

SEQ ID NO: 290319 - DNA, 25 bp, Rattus norvegicus
gaaatgcactacaaggccgtccaca

SEQ ID NO: 290320 - DNA, 25 bp, Rattus norvegicus
gaaatgcactactaggccgtccaca

SEQ ID NO: 290321 - DNA, 25 bp, Rattus norvegicus
gaaatgcactttagggtactaccct

SEQ ID NO: 290322 - DNA, 25 bp, Rattus norvegicus
gaaatgcactttctggccttttgaa

SEQ ID NO: 290323 - DNA, 25 bp, Rattus norvegicus
gaaatgcactttgtggccttttgaa

SEQ ID NO: 290324 - DNA, 25 bp, Rattus norvegicus
gaaatgcacttttgggtactaccct

SEQ ID NO: 290325 - DNA, 25 bp, Rattus norvegicus
gaaatgcagaggactgtccctcagg

SEQ ID NO: 290326 - DNA, 25 bp, Rattus norvegicus
gaaatgcagaggtctgtccctcagg

SEQ ID NO: 290327 - DNA, 25 bp, Rattus norvegicus
gaaatgcagcaccaaatcctcaggt

SEQ ID NO: 290328 - DNA, 25 bp, Rattus norvegicus
gaaatgcagcaccttactttgaatg

SEQ ID NO: 290329 - DNA, 25 bp, Rattus norvegicus
gaaatgcagcacgaaatcctcaggt

SEQ ID NO: 290330 - DNA, 25 bp, Rattus norvegicus
gaaatgcagcacgttactttgaatg

SEQ ID NO: 290331 - DNA, 25 bp, Rattus norvegicus
gaaatgcagccaatgctattgcaat

SEQ ID NO: 290332 - DNA, 25 bp, Rattus norvegicus
gaaatgcagccattgctattgcaat

SEQ ID NO: 290333 - DNA, 25 bp, Rattus norvegicus
gaaatgcagctactttctgagatag

SEQ ID NO: 290334 - DNA, 25 bp, Rattus norvegicus
gaaatgcagctagtttctgagatag

SEQ ID NO: 290335 - DNA, 25 bp, Rattus norvegicus
gaaatgcaggagctgaggctcccaa

SEQ ID NO: 290336 - DNA, 25 bp, Rattus norvegicus
gaaatgcaggagcttcggatcttcc

SEQ ID NO: 290337 - DNA, 25 bp, Rattus norvegicus
gaaatgcaggaggtgaggctcccaa

SEQ ID NO: 290338 - DNA, 25 bp, Rattus norvegicus
gaaatgcaggaggttcggatcttcc

SEQ ID NO: 290339 - DNA, 25 bp, Rattus norvegicus
gaaatgcagtgccagtcccagggta

SEQ ID NO: 290340 - DNA, 25 bp, Rattus norvegicus
gaaatgcagtgcgagtcccagggta

SEQ ID NO: 290341 - DNA, 25 bp, Rattus norvegicus
gaaatgcataccacgctgtctacaa

SEQ ID NO: 290342 - DNA, 25 bp, Rattus norvegicus
gaaatgcatacctcgctgtctacaa

SEQ ID NO: 290343 - DNA, 25 bp, Rattus norvegicus
gaaatgcatgctcttcttacacaca

SEQ ID NO: 290344 - DNA, 25 bp, Rattus norvegicus
gaaatgcatgctgttcttacacaca

SEQ ID NO: 290345 - DNA, 25 bp, Rattus norvegicus
gaaatgcattgtcatcatcccgaac

SEQ ID NO: 290346 - DNA, 25 bp, Rattus norvegicus
gaaatgcattgtgatcatcccgaac

SEQ ID NO: 290347 - DNA, 25 bp, Rattus norvegicus
gaaatgccacagctttccggttcgc

SEQ ID NO: 290348 - DNA, 25 bp, Rattus norvegicus
gaaatgccacaggtttccggttcgc

SEQ ID NO: 290349 - DNA, 25 bp, Rattus norvegicus
gaaatgccactgagtttgcacccag

SEQ ID NO: 290350 - DNA, 25 bp, Rattus norvegicus
gaaatgccactgtgtttgcacccag

SEQ ID NO: 290351 - DNA, 25 bp, Rattus norvegicus
gaaatgccagaacattccttctcta

SEQ ID NO: 290352 - DNA, 25 bp, Rattus norvegicus
gaaatgccagaagattccttctcta

SEQ ID NO: 290353 - DNA, 25 bp, Rattus norvegicus
gaaatgccagagacttccgttatta

SEQ ID NO: 290354 - DNA, 25 bp, Rattus norvegicus
gaaatgccagagtcttccgttatta

SEQ ID NO: 290355 - DNA, 25 bp, Rattus norvegicus
gaaatgccagtcacaaatctcagga

SEQ ID NO: 290356 - DNA, 25 bp, Rattus norvegicus
gaaatgccagtctcaaatctcagga

SEQ ID NO: 290357 - DNA, 25 bp, Rattus norvegicus
gaaatgccatgtctcattagattta

SEQ ID NO: 290358 - DNA, 25 bp, Rattus norvegicus
gaaatgccatgtgtcattagattta

SEQ ID NO: 290359 - DNA, 25 bp, Rattus norvegicus
gaaatgccattaagttttgaaccac

SEQ ID NO: 290360 - DNA, 25 bp, Rattus norvegicus
gaaatgccattatgttttgaaccac

SEQ ID NO: 290361 - DNA, 25 bp, Rattus norvegicus
gaaatgcccaagagtccgaactttg

SEQ ID NO: 290362 - DNA, 25 bp, Rattus norvegicus
gaaatgcccaagtgtccgaactttg

SEQ ID NO: 290363 - DNA, 25 bp, Rattus norvegicus
gaaatgcccacaccttttaacttca

SEQ ID NO: 290364 - DNA, 25 bp, Rattus norvegicus
gaaatgcccacagcttttaacttca

SEQ ID NO: 290365 - DNA, 25 bp, Rattus norvegicus
gaaatgcccattctcaaggtctatt

SEQ ID NO: 290366 - DNA, 25 bp, Rattus norvegicus
gaaatgcccattgtcaaggtctatt

SEQ ID NO: 290367 - DNA, 25 bp, Rattus norvegicus
gaaatgccccttataatatccacag

SEQ ID NO: 290368 - DNA, 25 bp, Rattus norvegicus
gaaatgccccttttaatatccacag

SEQ ID NO: 290369 - DNA, 25 bp, Rattus norvegicus
gaaatgcccgtacttccaacaagta

SEQ ID NO: 290370 - DNA, 25 bp, Rattus norvegicus
gaaatgcccgtagttccaacaagta

SEQ ID NO: 290371 - DNA, 25 bp, Rattus norvegicus
gaaatgccgcacacgacactcagaa

SEQ ID NO: 290372 - DNA, 25 bp, Rattus norvegicus
gaaatgccgcactcgacactcagaa

SEQ ID NO: 290373 - DNA, 25 bp, Rattus norvegicus
gaaatgccgtaaccgccgtcgtgaa

SEQ ID NO: 290374 - DNA, 25 bp, Rattus norvegicus
gaaatgccgtaagcgccgtcgtgaa

SEQ ID NO: 290375 - DNA, 25 bp, Rattus norvegicus
gaaatgccgttcattattctcactg

SEQ ID NO: 290376 - DNA, 25 bp, Rattus norvegicus
gaaatgccgttctttattctcactg

SEQ ID NO: 290377 - DNA, 25 bp, Rattus norvegicus
gaaatgcctacgcacagtgggccct

SEQ ID NO: 290378 - DNA, 25 bp, Rattus norvegicus
gaaatgcctacggacagtgggccct

SEQ ID NO: 290379 - DNA, 25 bp, Rattus norvegicus
gaaatgcctagacacagctggacaa

SEQ ID NO: 290380 - DNA, 25 bp, Rattus norvegicus
gaaatgcctagagacagctggacaa

SEQ ID NO: 290381 - DNA, 25 bp, Rattus norvegicus
gaaatgcctatgatctaaggactgt

SEQ ID NO: 290382 - DNA, 25 bp, Rattus norvegicus
gaaatgcctatgttctaaggactgt

SEQ ID NO: 290383 - DNA, 25 bp, Rattus norvegicus
gaaatgcctcttcctggagtctgcc

SEQ ID NO: 290384 - DNA, 25 bp, Rattus norvegicus
gaaatgcctcttgctggagtctgcc

SEQ ID NO: 290385 - DNA, 25 bp, Rattus norvegicus
gaaatgcctggtagtatctggtgac

SEQ ID NO: 290386 - DNA, 25 bp, Rattus norvegicus
gaaatgcctggttgtatctggtgac

SEQ ID NO: 290387 - DNA, 25 bp, Rattus norvegicus
gaaatgccttaactgactcggacaa

SEQ ID NO: 290388 - DNA, 25 bp, Rattus norvegicus
gaaatgccttaagtgactcggacaa

SEQ ID NO: 290389 - DNA, 25 bp, Rattus norvegicus
gaaatgccttccaaatttgtctgag

SEQ ID NO: 290390 - DNA, 25 bp, Rattus norvegicus
gaaatgccttcctaatttgtctgag

SEQ ID NO: 290391 - DNA, 25 bp, Rattus norvegicus
gaaatgcctttccaaggtgtgagaa

SEQ ID NO: 290392 - DNA, 25 bp, Rattus norvegicus
gaaatgcctttcgaaggtgtgagaa

SEQ ID NO: 290393 - DNA, 25 bp, Rattus norvegicus
gaaatgccttttactacaagtgaag

SEQ ID NO: 290394 - DNA, 25 bp, Rattus norvegicus
gaaatgcctttttctacaagtgaag

SEQ ID NO: 290395 - DNA, 25 bp, Rattus norvegicus
gaaatgcgatgacaggtttctggaa

SEQ ID NO: 290396 - DNA, 25 bp, Rattus norvegicus
gaaatgcgatgagaggtttctggaa

SEQ ID NO: 290397 - DNA, 25 bp, Rattus norvegicus
gaaatgcgatttatctctccttctc

SEQ ID NO: 290398 - DNA, 25 bp, Rattus norvegicus
gaaatgcgatttttctctccttctc

SEQ ID NO: 290399 - DNA, 25 bp, Rattus norvegicus
gaaatgcggataagggactgagacc

SEQ ID NO: 290400 - DNA, 25 bp, Rattus norvegicus
gaaatgcggatatgggactgagacc

SEQ ID NO: 290401 - DNA, 25 bp, Rattus norvegicus
gaaatgcgtctactgcttaaactgt

SEQ ID NO: 290402 - DNA, 25 bp, Rattus norvegicus
gaaatgcgtctagtgcttaaactgt

SEQ ID NO: 290403 - DNA, 25 bp, Rattus norvegicus
gaaatgctagatatgacctcctccc

SEQ ID NO: 290404 - DNA, 25 bp, Rattus norvegicus
gaaatgctagatttgacctcctccc

SEQ ID NO: 290405 - DNA, 25 bp, Rattus norvegicus
gaaatgctagcaatcctcaaagagg

SEQ ID NO: 290406 - DNA, 25 bp, Rattus norvegicus
gaaatgctagcattcctcaaagagg

SEQ ID NO: 290407 - DNA, 25 bp, Rattus norvegicus
gaaatgctaggccacttcctatggt

SEQ ID NO: 290408 - DNA, 25 bp, Rattus norvegicus
gaaatgctaggcgacttcctatggt

SEQ ID NO: 290409 - DNA, 25 bp, Rattus norvegicus
gaaatgctagtcacaaccctggagt

SEQ ID NO: 290410 - DNA, 25 bp, Rattus norvegicus
gaaatgctagtctcaaccctggagt

SEQ ID NO: 290411 - DNA, 25 bp, Rattus norvegicus
gaaatgctatgtactccgaagtgaa

SEQ ID NO: 290412 - DNA, 25 bp, Rattus norvegicus
gaaatgctatgttctccgaagtgaa

SEQ ID NO: 290413 - DNA, 25 bp, Rattus norvegicus
gaaatgctcagacagcacgctgtgg

SEQ ID NO: 290414 - DNA, 25 bp, Rattus norvegicus
gaaatgctcagagagcacgctgtgg

SEQ ID NO: 290415 - DNA, 25 bp, Rattus norvegicus
gaaatgctcatcacaagtgtactca

SEQ ID NO: 290416 - DNA, 25 bp, Rattus norvegicus
gaaatgctcatctcaagtgtactca

SEQ ID NO: 290417 - DNA, 25 bp, Rattus norvegicus
gaaatgctccagaagttgggctgta

SEQ ID NO: 290418 - DNA, 25 bp, Rattus norvegicus
gaaatgctccagacgctaattgtag

SEQ ID NO: 290419 - DNA, 25 bp, Rattus norvegicus
gaaatgctccagtagttgggctgta

SEQ ID NO: 290420 - DNA, 25 bp, Rattus norvegicus
gaaatgctccagtcgctaattgtag

SEQ ID NO: 290421 - DNA, 25 bp, Rattus norvegicus
gaaatgctctcgattccttgtgaaa

SEQ ID NO: 290422 - DNA, 25 bp, Rattus norvegicus
gaaatgctctcgtttccttgtgaaa

SEQ ID NO: 290423 - DNA, 25 bp, Rattus norvegicus
gaaatgctgaaaatcgcttctgtga

SEQ ID NO: 290424 - DNA, 25 bp, Rattus norvegicus
gaaatgctgaaattcgcttctgtga

SEQ ID NO: 290425 - DNA, 25 bp, Rattus norvegicus
gaaatgctgaatcctggctactggc

SEQ ID NO: 290426 - DNA, 25 bp, Rattus norvegicus
gaaatgctgaatgctggctactggc

SEQ ID NO: 290427 - DNA, 25 bp, Rattus norvegicus
gaaatgctgatcatctcctttgcaa

SEQ ID NO: 290428 - DNA, 25 bp, Rattus norvegicus
gaaatgctgatcttctcctttgcaa

SEQ ID NO: 290429 - DNA, 25 bp, Rattus norvegicus
gaaatgctgcacactggacatgaca

SEQ ID NO: 290430 - DNA, 25 bp, Rattus norvegicus
gaaatgctgcacagaggccactgga

SEQ ID NO: 290431 - DNA, 25 bp, Rattus norvegicus
gaaatgctgcacattcagtccatgt

SEQ ID NO: 290432 - DNA, 25 bp, Rattus norvegicus
gaaatgctgcactctggacatgaca

SEQ ID NO: 290433 - DNA, 25 bp, Rattus norvegicus
gaaatgctgcactgaggccactgga

SEQ ID NO: 290434 - DNA, 25 bp, Rattus norvegicus
gaaatgctgcactttcagtccatgt

SEQ ID NO: 290435 - DNA, 25 bp, Rattus norvegicus
gaaatgctgcccagacaagagtgga

SEQ ID NO: 290436 - DNA, 25 bp, Rattus norvegicus
gaaatgctgcccaggtcctaaggaa

SEQ ID NO: 290437 - DNA, 25 bp, Rattus norvegicus
gaaatgctgccctgacaagagtgga

SEQ ID NO: 290438 - DNA, 25 bp, Rattus norvegicus
gaaatgctgccctggtcctaaggaa

SEQ ID NO: 290439 - DNA, 25 bp, Rattus norvegicus
gaaatgctggccctgaagcagaact

SEQ ID NO: 290440 - DNA, 25 bp, Rattus norvegicus
gaaatgctggccgtgaagcagaact

SEQ ID NO: 290441 - DNA, 25 bp, Rattus norvegicus
gaaatgctgtaacttttataccctg

SEQ ID NO: 290442 - DNA, 25 bp, Rattus norvegicus
gaaatgctgtaagttttataccctg

SEQ ID NO: 290443 - DNA, 25 bp, Rattus norvegicus
gaaatgcttatgaagtcctttgtca

SEQ ID NO: 290444 - DNA, 25 bp, Rattus norvegicus
gaaatgcttatgtagtcctttgtca

SEQ ID NO: 290445 - DNA, 25 bp, Rattus norvegicus
gaaatgcttcagactgtctctggag

SEQ ID NO: 290446 - DNA, 25 bp, Rattus norvegicus
gaaatgcttcagtctgtctctggag

SEQ ID NO: 290447 - DNA, 25 bp, Rattus norvegicus
gaaatgcttccgctgaaggtccgga

SEQ ID NO: 290448 - DNA, 25 bp, Rattus norvegicus
gaaatgcttccggtgaaggtccgga

SEQ ID NO: 290449 - DNA, 25 bp, Rattus norvegicus
gaaatgcttgataccgctgctgctg

SEQ ID NO: 290450 - DNA, 25 bp, Rattus norvegicus
gaaatgcttgattccgctgctgctg

SEQ ID NO: 290451 - DNA, 25 bp, Rattus norvegicus
gaaatgcttgtcaacaaagatgtac

SEQ ID NO: 290452 - DNA, 25 bp, Rattus norvegicus
gaaatgcttgtctacaaagatgtac

SEQ ID NO: 290453 - DNA, 25 bp, Rattus norvegicus
gaaatgctttccatcttgtctaacc

SEQ ID NO: 290454 - DNA, 25 bp, Rattus norvegicus
gaaatgctttccatgtttacacgtt

SEQ ID NO: 290455 - DNA, 25 bp, Rattus norvegicus
gaaatgctttccctgttcatacagt

SEQ ID NO: 290456 - DNA, 25 bp, Rattus norvegicus
gaaatgctttccgtgttcatacagt

SEQ ID NO: 290457 - DNA, 25 bp, Rattus norvegicus
gaaatgctttccttcttgtctaacc

SEQ ID NO: 290458 - DNA, 25 bp, Rattus norvegicus
gaaatgctttccttgtttacacgtt

SEQ ID NO: 290459 - DNA, 25 bp, Rattus norvegicus
gaaatgctttctcgcactgcatcaa

SEQ ID NO: 290460 - DNA, 25 bp, Rattus norvegicus
gaaatgctttctctactggaataat

SEQ ID NO: 290461 - DNA, 25 bp, Rattus norvegicus
gaaatgctttctggcactgcatcaa

SEQ ID NO: 290462 - DNA, 25 bp, Rattus norvegicus
gaaatgctttctgtactggaataat

SEQ ID NO: 290463 - DNA, 25 bp, Rattus norvegicus
gaaatgctttgcataacaatcttaa

SEQ ID NO: 290464 - DNA, 25 bp, Rattus norvegicus
gaaatgctttgcttaacaatcttaa

SEQ ID NO: 290465 - DNA, 25 bp, Rattus norvegicus
gaaatgctttgtacattcctacaac

SEQ ID NO: 290466 - DNA, 25 bp, Rattus norvegicus
gaaatgctttgttcattcctacaac

SEQ ID NO: 290467 - DNA, 25 bp, Rattus norvegicus
gaaatgcttttcatcagagaagctg

SEQ ID NO: 290468 - DNA, 25 bp, Rattus norvegicus
gaaatgcttttcttcagagaagctg

SEQ ID NO: 290469 - DNA, 25 bp, Rattus norvegicus
gaaatggaacatcacgttgcttttc

SEQ ID NO: 290470 - DNA, 25 bp, Rattus norvegicus
gaaatggaacatgacgttgcttttc

SEQ ID NO: 290471 - DNA, 25 bp, Rattus norvegicus
gaaatggaaccaccatcatccaggg

SEQ ID NO: 290472 - DNA, 25 bp, Rattus norvegicus
gaaatggaaccagcatcatccaggg

SEQ ID NO: 290473 - DNA, 25 bp, Rattus norvegicus
gaaatggaactgaggccactgcgct

SEQ ID NO: 290474 - DNA, 25 bp, Rattus norvegicus
gaaatggaactgtggccactgcgct

SEQ ID NO: 290475 - DNA, 25 bp, Rattus norvegicus
gaaatggacaccaccggccatgaac

SEQ ID NO: 290476 - DNA, 25 bp, Rattus norvegicus
gaaatggacacctccggccatgaac

SEQ ID NO: 290477 - DNA, 25 bp, Rattus norvegicus
gaaatggaccaccatcttctgaaga

SEQ ID NO: 290478 - DNA, 25 bp, Rattus norvegicus
gaaatggaccacgatcttctgaaga

SEQ ID NO: 290479 - DNA, 25 bp, Rattus norvegicus
gaaatggactgtatgggctacaacc

SEQ ID NO: 290480 - DNA, 25 bp, Rattus norvegicus
gaaatggactgtttgggctacaacc

SEQ ID NO: 290481 - DNA, 25 bp, Rattus norvegicus
gaaatggagaggcttcctgcactct

SEQ ID NO: 290482 - DNA, 25 bp, Rattus norvegicus
gaaatggagagggttcctgcactct

SEQ ID NO: 290483 - DNA, 25 bp, Rattus norvegicus
gaaatggagttcctatcctcccaag

SEQ ID NO: 290484 - DNA, 25 bp, Rattus norvegicus
gaaatggagttcgtatcctcccaag

SEQ ID NO: 290485 - DNA, 25 bp, Rattus norvegicus
gaaatggatctcagttcttcctctg

SEQ ID NO: 290486 - DNA, 25 bp, Rattus norvegicus
gaaatggatctctgttcttcctctg

SEQ ID NO: 290487 - DNA, 25 bp, Rattus norvegicus
gaaatggatgtacacaccttgacac

SEQ ID NO: 290488 - DNA, 25 bp, Rattus norvegicus
gaaatggatgtagacaccttgacac

SEQ ID NO: 290489 - DNA, 25 bp, Rattus norvegicus
gaaatggattgcagctagttaccag

SEQ ID NO: 290490 - DNA, 25 bp, Rattus norvegicus
gaaatggattgcatcatgcctgaac

SEQ ID NO: 290491 - DNA, 25 bp, Rattus norvegicus
gaaatggattgctgctagttaccag

SEQ ID NO: 290492 - DNA, 25 bp, Rattus norvegicus
gaaatggattgcttcatgcctgaac

SEQ ID NO: 290493 - DNA, 25 bp, Rattus norvegicus
gaaatggcaatcacacctgagctct

SEQ ID NO: 290494 - DNA, 25 bp, Rattus norvegicus
gaaatggcaatctcacctgagctct

SEQ ID NO: 290495 - DNA, 25 bp, Rattus norvegicus
gaaatggcaatgatcccagggttat

SEQ ID NO: 290496 - DNA, 25 bp, Rattus norvegicus
gaaatggcaatgttcccagggttat

SEQ ID NO: 290497 - DNA, 25 bp, Rattus norvegicus
gaaatggcacacctgggtctcggca

SEQ ID NO: 290498 - DNA, 25 bp, Rattus norvegicus
gaaatggcacacgtgggtctcggca

SEQ ID NO: 290499 - DNA, 25 bp, Rattus norvegicus
gaaatggcacatatgtaaacatgac

SEQ ID NO: 290500 - DNA, 25 bp, Rattus norvegicus
gaaatggcacatttgtaaacatgac

SEQ ID NO: 290501 - DNA, 25 bp, Rattus norvegicus
gaaatggcactaaccgtgtacgaat

SEQ ID NO: 290502 - DNA, 25 bp, Rattus norvegicus
gaaatggcactatccgtgtacgaat

SEQ ID NO: 290503 - DNA, 25 bp, Rattus norvegicus
gaaatggcactccacttggacaatg

SEQ ID NO: 290504 - DNA, 25 bp, Rattus norvegicus
gaaatggcactcgacttggacaatg

SEQ ID NO: 290505 - DNA, 25 bp, Rattus norvegicus
gaaatggcaggcactcatgttaacc

SEQ ID NO: 290506 - DNA, 25 bp, Rattus norvegicus
gaaatggcaggctctcatgttaacc

SEQ ID NO: 290507 - DNA, 25 bp, Rattus norvegicus
gaaatggcagtgctccacatcagtt

SEQ ID NO: 290508 - DNA, 25 bp, Rattus norvegicus
gaaatggcagtggtccacatcagtt

SEQ ID NO: 290509 - DNA, 25 bp, Rattus norvegicus
gaaatggcatcgctactaacttggt

SEQ ID NO: 290510 - DNA, 25 bp, Rattus norvegicus
gaaatggcatcggtactaacttggt

SEQ ID NO: 290511 - DNA, 25 bp, Rattus norvegicus
gaaatggcatctacccactaagaac

SEQ ID NO: 290512 - DNA, 25 bp, Rattus norvegicus
gaaatggcatcttcccactaagaac

SEQ ID NO: 290513 - DNA, 25 bp, Rattus norvegicus
gaaatggcatgtagaatgtgtcccc

SEQ ID NO: 290514 - DNA, 25 bp, Rattus norvegicus
gaaatggcatgttgaatgtgtcccc

SEQ ID NO: 290515 - DNA, 25 bp, Rattus norvegicus
gaaatggcattcactttctcgaccc

SEQ ID NO: 290516 - DNA, 25 bp, Rattus norvegicus
gaaatggcattcatctacagaagta

SEQ ID NO: 290517 - DNA, 25 bp, Rattus norvegicus
gaaatggcattctctttctcgaccc

SEQ ID NO: 290518 - DNA, 25 bp, Rattus norvegicus
gaaatggcattcttctacagaagta

SEQ ID NO: 290519 - DNA, 25 bp, Rattus norvegicus
gaaatggccaatccgcttgggttac

SEQ ID NO: 290520 - DNA, 25 bp, Rattus norvegicus
gaaatggccaatgcgcttgggttac

SEQ ID NO: 290521 - DNA, 25 bp, Rattus norvegicus
gaaatggccactcagactgtccagc

SEQ ID NO: 290522 - DNA, 25 bp, Rattus norvegicus
gaaatggccactgagactgtccagc

SEQ ID NO: 290523 - DNA, 25 bp, Rattus norvegicus
gaaatggccctacctgaggagcagc

SEQ ID NO: 290524 - DNA, 25 bp, Rattus norvegicus
gaaatggccctagctgaggagcagc

SEQ ID NO: 290525 - DNA, 25 bp, Rattus norvegicus
gaaatggcctgtccaaaaccaccct

SEQ ID NO: 290526 - DNA, 25 bp, Rattus norvegicus
gaaatggcctgtgcaaaaccaccct

SEQ ID NO: 290527 - DNA, 25 bp, Rattus norvegicus
gaaatggccttaaccggtatggatt

SEQ ID NO: 290528 - DNA, 25 bp, Rattus norvegicus
gaaatggccttatccggtatggatt

SEQ ID NO: 290529 - DNA, 25 bp, Rattus norvegicus
gaaatggccttgaacatggacccag

SEQ ID NO: 290530 - DNA, 25 bp, Rattus norvegicus
gaaatggccttgtacatggacccag

SEQ ID NO: 290531 - DNA, 25 bp, Rattus norvegicus
gaaatggctcaaccagaacacgctt

SEQ ID NO: 290532 - DNA, 25 bp, Rattus norvegicus
gaaatggctcaagcagaacacgctt

SEQ ID NO: 290533 - DNA, 25 bp, Rattus norvegicus
gaaatggctcatatgtttctaagca

SEQ ID NO: 290534 - DNA, 25 bp, Rattus norvegicus
gaaatggctcatttgtttctaagca

SEQ ID NO: 290535 - DNA, 25 bp, Rattus norvegicus
gaaatggctcccagtattactgtac

SEQ ID NO: 290536 - DNA, 25 bp, Rattus norvegicus
gaaatggctccctgtattactgtac

SEQ ID NO: 290537 - DNA, 25 bp, Rattus norvegicus
gaaatggctcggaaagcttagggaa

SEQ ID NO: 290538 - DNA, 25 bp, Rattus norvegicus
gaaatggctcggtaagcttagggaa

SEQ ID NO: 290539 - DNA, 25 bp, Rattus norvegicus
gaaatggctctgatggtagttatta

SEQ ID NO: 290540 - DNA, 25 bp, Rattus norvegicus
gaaatggctctgttggtagttatta

SEQ ID NO: 290541 - DNA, 25 bp, Rattus norvegicus
gaaatggctgtgatcctaatagtaa

SEQ ID NO: 290542 - DNA, 25 bp, Rattus norvegicus
gaaatggctgtgttcctaatagtaa

SEQ ID NO: 290543 - DNA, 25 bp, Rattus norvegicus
gaaatggcttagactgttttgagct

SEQ ID NO: 290544 - DNA, 25 bp, Rattus norvegicus
gaaatggcttagtctgttttgagct

SEQ ID NO: 290545 - DNA, 25 bp, Rattus norvegicus
gaaatggcttcgaaataccacgtta

SEQ ID NO: 290546 - DNA, 25 bp, Rattus norvegicus
gaaatggcttcgtaataccacgtta

SEQ ID NO: 290547 - DNA, 25 bp, Rattus norvegicus
gaaatggcttgacatcggcagaact

SEQ ID NO: 290548 - DNA, 25 bp, Rattus norvegicus
gaaatggcttgagatcggcagaact

SEQ ID NO: 290549 - DNA, 25 bp, Rattus norvegicus
gaaatggcttgcacagggtaactgg

SEQ ID NO: 290550 - DNA, 25 bp, Rattus norvegicus
gaaatggcttgctcagggtaactgg

SEQ ID NO: 290551 - DNA, 25 bp, Rattus norvegicus
gaaatggcttttcaattgcgtttga

SEQ ID NO: 290552 - DNA, 25 bp, Rattus norvegicus
gaaatggcttttcttcctaaccagg

SEQ ID NO: 290553 - DNA, 25 bp, Rattus norvegicus
gaaatggcttttgaattgcgtttga

SEQ ID NO: 290554 - DNA, 25 bp, Rattus norvegicus
gaaatggcttttgttcctaaccagg

SEQ ID NO: 290555 - DNA, 25 bp, Rattus norvegicus
gaaatgggaacgcagctcttttgct

SEQ ID NO: 290556 - DNA, 25 bp, Rattus norvegicus
gaaatgggaacggagctcttttgct

SEQ ID NO: 290557 - DNA, 25 bp, Rattus norvegicus
gaaatgggaccaaccttgtcaaatt

SEQ ID NO: 290558 - DNA, 25 bp, Rattus norvegicus
gaaatgggaccatccttgtcaaatt

SEQ ID NO: 290559 - DNA, 25 bp, Rattus norvegicus
gaaatgggagatcggcaatgcctaa

SEQ ID NO: 290560 - DNA, 25 bp, Rattus norvegicus
gaaatgggagatgggcaatgcctaa

SEQ ID NO: 290561 - DNA, 25 bp, Rattus norvegicus
gaaatgggagttcccacttgtcctt

SEQ ID NO: 290562 - DNA, 25 bp, Rattus norvegicus
gaaatgggagttgccacttgtcctt

SEQ ID NO: 290563 - DNA, 25 bp, Rattus norvegicus
gaaatgggatacacgtgtggctact

SEQ ID NO: 290564 - DNA, 25 bp, Rattus norvegicus
gaaatgggatactcgtgtggctact

SEQ ID NO: 290565 - DNA, 25 bp, Rattus norvegicus
gaaatgggatgtagctttttgggtc

SEQ ID NO: 290566 - DNA, 25 bp, Rattus norvegicus
gaaatgggatgttgctttttgggtc

SEQ ID NO: 290567 - DNA, 25 bp, Rattus norvegicus
gaaatgggcagcactatcctgtcat

SEQ ID NO: 290568 - DNA, 25 bp, Rattus norvegicus
gaaatgggcagctctatcctgtcat

SEQ ID NO: 290569 - DNA, 25 bp, Rattus norvegicus
gaaatgggtcacctattacacctaa

SEQ ID NO: 290570 - DNA, 25 bp, Rattus norvegicus
gaaatgggtcacgtattacacctaa

SEQ ID NO: 290571 - DNA, 25 bp, Rattus norvegicus
gaaatggtacgtaatcccaaccctg

SEQ ID NO: 290572 - DNA, 25 bp, Rattus norvegicus
gaaatggtacgttatcccaaccctg

SEQ ID NO: 290573 - DNA, 25 bp, Rattus norvegicus
gaaatggtcattctcgttccaatgt

SEQ ID NO: 290574 - DNA, 25 bp, Rattus norvegicus
gaaatggtcattgtcgttccaatgt

SEQ ID NO: 290575 - DNA, 25 bp, Rattus norvegicus
gaaatggtcctgaaggctgtcctca

SEQ ID NO: 290576 - DNA, 25 bp, Rattus norvegicus
gaaatggtcctgtaggctgtcctca

SEQ ID NO: 290577 - DNA, 25 bp, Rattus norvegicus
gaaatggtctggactgggtactcgt

SEQ ID NO: 290578 - DNA, 25 bp, Rattus norvegicus
gaaatggtctggtctgggtactcgt

SEQ ID NO: 290579 - DNA, 25 bp, Rattus norvegicus
gaaatggtgcacacttaaggcccaa

SEQ ID NO: 290580 - DNA, 25 bp, Rattus norvegicus
gaaatggtgcactcttaaggcccaa

SEQ ID NO: 290581 - DNA, 25 bp, Rattus norvegicus
gaaatggtgcgcattatatgctctt

SEQ ID NO: 290582 - DNA, 25 bp, Rattus norvegicus
gaaatggtgcgctttatatgctctt

SEQ ID NO: 290583 - DNA, 25 bp, Rattus norvegicus
gaaatggtggttcctcttgaaaatc

SEQ ID NO: 290584 - DNA, 25 bp, Rattus norvegicus
gaaatggtggttgctcttgaaaatc

SEQ ID NO: 290585 - DNA, 25 bp, Rattus norvegicus
gaaatggttaggctaccaaccctga

SEQ ID NO: 290586 - DNA, 25 bp, Rattus norvegicus
gaaatggttagggtaccaaccctga

SEQ ID NO: 290587 - DNA, 25 bp, Rattus norvegicus
gaaatggttattcttcctgtccagc

SEQ ID NO: 290588 - DNA, 25 bp, Rattus norvegicus
gaaatggttattgttcctgtccagc

SEQ ID NO: 290589 - DNA, 25 bp, Rattus norvegicus
gaaatggttcgtcttataccaggat

SEQ ID NO: 290590 - DNA, 25 bp, Rattus norvegicus
gaaatggttcgtgttataccaggat

SEQ ID NO: 290591 - DNA, 25 bp, Rattus norvegicus
gaaatggttctcagagctgcatgaa

SEQ ID NO: 290592 - DNA, 25 bp, Rattus norvegicus
gaaatggttctctgagctgcatgaa

SEQ ID NO: 290593 - DNA, 25 bp, Rattus norvegicus
gaaatggttgtcaagaccctgcaaa

SEQ ID NO: 290594 - DNA, 25 bp, Rattus norvegicus
gaaatggttgtctagaccctgcaaa

SEQ ID NO: 290595 - DNA, 25 bp, Rattus norvegicus
gaaatggttgtgaacaccgcctgta

SEQ ID NO: 290596 - DNA, 25 bp, Rattus norvegicus
gaaatggttgtgaagttccctatta

SEQ ID NO: 290597 - DNA, 25 bp, Rattus norvegicus
gaaatggttgtgtacaccgcctgta

SEQ ID NO: 290598 - DNA, 25 bp, Rattus norvegicus
gaaatggttgtgtagttccctatta

SEQ ID NO: 290599 - DNA, 25 bp, Rattus norvegicus
gaaatggtttgacaagtctttctct

SEQ ID NO: 290600 - DNA, 25 bp, Rattus norvegicus
gaaatggtttgagaagtctttctct

SEQ ID NO: 290601 - DNA, 25 bp, Rattus norvegicus
gaaatgtaagatacgccctgctcag

SEQ ID NO: 290602 - DNA, 25 bp, Rattus norvegicus
gaaatgtaagattcgccctgctcag

SEQ ID NO: 290603 - DNA, 25 bp, Rattus norvegicus
gaaatgtaagcaactgatcactgat

SEQ ID NO: 290604 - DNA, 25 bp, Rattus norvegicus
gaaatgtaagcatctgatcactgat

SEQ ID NO: 290605 - DNA, 25 bp, Rattus norvegicus
gaaatgtaccctaccctatagaaag

SEQ ID NO: 290606 - DNA, 25 bp, Rattus norvegicus
gaaatgtacccttccctatagaaag

SEQ ID NO: 290607 - DNA, 25 bp, Rattus norvegicus
gaaatgtacttcatgggtctcttta

SEQ ID NO: 290608 - DNA, 25 bp, Rattus norvegicus
gaaatgtacttcttgggtctcttta

SEQ ID NO: 290609 - DNA, 25 bp, Rattus norvegicus
gaaatgtagtctatccctctcaggg

SEQ ID NO: 290610 - DNA, 25 bp, Rattus norvegicus
gaaatgtagtctttccctctcaggg

SEQ ID NO: 290611 - DNA, 25 bp, Rattus norvegicus
gaaatgtagttcacacaacctcctg

SEQ ID NO: 290612 - DNA, 25 bp, Rattus norvegicus
gaaatgtagttctcacaacctcctg

SEQ ID NO: 290613 - DNA, 25 bp, Rattus norvegicus
gaaatgtatagtcagcatccaaaaa

SEQ ID NO: 290614 - DNA, 25 bp, Rattus norvegicus
gaaatgtatagtgagcatccaaaaa

SEQ ID NO: 290615 - DNA, 25 bp, Rattus norvegicus
gaaatgtatcacatgtgtgtgctag

SEQ ID NO: 290616 - DNA, 25 bp, Rattus norvegicus
gaaatgtatcacttgtgtgtgctag

SEQ ID NO: 290617 - DNA, 25 bp, Rattus norvegicus
gaaatgtatccaaaaatgtcccagg

SEQ ID NO: 290618 - DNA, 25 bp, Rattus norvegicus
gaaatgtatccataaatgtcccagg

SEQ ID NO: 290619 - DNA, 25 bp, Rattus norvegicus
gaaatgtattccaagactgttctca

SEQ ID NO: 290620 - DNA, 25 bp, Rattus norvegicus
gaaatgtattccacatcatattaga

SEQ ID NO: 290621 - DNA, 25 bp, Rattus norvegicus
gaaatgtattcctagactgttctca

SEQ ID NO: 290622 - DNA, 25 bp, Rattus norvegicus
gaaatgtattcctcatcatattaga

SEQ ID NO: 290623 - DNA, 25 bp, Rattus norvegicus
gaaatgtatttcagcttctatagac

SEQ ID NO: 290624 - DNA, 25 bp, Rattus norvegicus
gaaatgtatttctgcttctatagac

SEQ ID NO: 290625 - DNA, 25 bp, Rattus norvegicus
gaaatgtatttgaagggctggcaag

SEQ ID NO: 290626 - DNA, 25 bp, Rattus norvegicus
gaaatgtatttgtagggctggcaag

SEQ ID NO: 290627 - DNA, 25 bp, Rattus norvegicus
gaaatgtcaaccatttggcttcgct

SEQ ID NO: 290628 - DNA, 25 bp, Rattus norvegicus
gaaatgtcaaccttttggcttcgct

SEQ ID NO: 290629 - DNA, 25 bp, Rattus norvegicus
gaaatgtcacccatccagaaatatt

SEQ ID NO: 290630 - DNA, 25 bp, Rattus norvegicus
gaaatgtcacccttccagaaatatt

SEQ ID NO: 290631 - DNA, 25 bp, Rattus norvegicus
gaaatgtcactaatcccaaagcaat

SEQ ID NO: 290632 - DNA, 25 bp, Rattus norvegicus
gaaatgtcactacaggtccttgtct

SEQ ID NO: 290633 - DNA, 25 bp, Rattus norvegicus
gaaatgtcactagaggtccttgtct

SEQ ID NO: 290634 - DNA, 25 bp, Rattus norvegicus
gaaatgtcactattcccaaagcaat

SEQ ID NO: 290635 - DNA, 25 bp, Rattus norvegicus
gaaatgtcactcacttatctgtaca

SEQ ID NO: 290636 - DNA, 25 bp, Rattus norvegicus
gaaatgtcactcctctcatttggaa

SEQ ID NO: 290637 - DNA, 25 bp, Rattus norvegicus
gaaatgtcactcgtctcatttggaa

SEQ ID NO: 290638 - DNA, 25 bp, Rattus norvegicus
gaaatgtcactctcttatctgtaca

SEQ ID NO: 290639 - DNA, 25 bp, Rattus norvegicus
gaaatgtcagagaagccagaagaat

SEQ ID NO: 290640 - DNA, 25 bp, Rattus norvegicus
gaaatgtcagagtagccagaagaat

SEQ ID NO: 290641 - DNA, 25 bp, Rattus norvegicus
gaaatgtcagataagctattccttt

SEQ ID NO: 290642 - DNA, 25 bp, Rattus norvegicus
gaaatgtcagattagctattccttt

SEQ ID NO: 290643 - DNA, 25 bp, Rattus norvegicus
gaaatgtcaggtacccaacactact

SEQ ID NO: 290644 - DNA, 25 bp, Rattus norvegicus
gaaatgtcaggttcccaacactact

SEQ ID NO: 290645 - DNA, 25 bp, Rattus norvegicus
gaaatgtcatctacactttgtatat

SEQ ID NO: 290646 - DNA, 25 bp, Rattus norvegicus
gaaatgtcatcttcactttgtatat

SEQ ID NO: 290647 - DNA, 25 bp, Rattus norvegicus
gaaatgtccaacattaattccctgg

SEQ ID NO: 290648 - DNA, 25 bp, Rattus norvegicus
gaaatgtccaactttaattccctgg

SEQ ID NO: 290649 - DNA, 25 bp, Rattus norvegicus
gaaatgtccatgcatcactcagtga

SEQ ID NO: 290650 - DNA, 25 bp, Rattus norvegicus
gaaatgtccatggatcactcagtga

SEQ ID NO: 290651 - DNA, 25 bp, Rattus norvegicus
gaaatgtcccaaaccgatacacctt

SEQ ID NO: 290652 - DNA, 25 bp, Rattus norvegicus
gaaatgtcccaatccgatacacctt

SEQ ID NO: 290653 - DNA, 25 bp, Rattus norvegicus
gaaatgtcccaccacaggtttgttt

SEQ ID NO: 290654 - DNA, 25 bp, Rattus norvegicus
gaaatgtcccacgacaggtttgttt

SEQ ID NO: 290655 - DNA, 25 bp, Rattus norvegicus
gaaatgtcccctctagctagagtta

SEQ ID NO: 290656 - DNA, 25 bp, Rattus norvegicus
gaaatgtcccctgtagctagagtta

SEQ ID NO: 290657 - DNA, 25 bp, Rattus norvegicus
gaaatgtcctagagtagctggctta

SEQ ID NO: 290658 - DNA, 25 bp, Rattus norvegicus
gaaatgtcctagtgtagctggctta

SEQ ID NO: 290659 - DNA, 25 bp, Rattus norvegicus
gaaatgtcctcacaacctggaagtg

SEQ ID NO: 290660 - DNA, 25 bp, Rattus norvegicus
gaaatgtcctcagaacctggaagtg

SEQ ID NO: 290661 - DNA, 25 bp, Rattus norvegicus
gaaatgtcctctactaatcaatgct

SEQ ID NO: 290662 - DNA, 25 bp, Rattus norvegicus
gaaatgtcctcttctaatcaatgct

SEQ ID NO: 290663 - DNA, 25 bp, Rattus norvegicus
gaaatgtcctgactccattcaaagt

SEQ ID NO: 290664 - DNA, 25 bp, Rattus norvegicus
gaaatgtcctgagtccattcaaagt

SEQ ID NO: 290665 - DNA, 25 bp, Rattus norvegicus
gaaatgtcgatgcttctctcatcag

SEQ ID NO: 290666 - DNA, 25 bp, Rattus norvegicus
gaaatgtcgatggttctctcatcag

SEQ ID NO: 290667 - DNA, 25 bp, Rattus norvegicus
gaaatgtcggtgattggctgattac

SEQ ID NO: 290668 - DNA, 25 bp, Rattus norvegicus
gaaatgtcggtgtttggctgattac

SEQ ID NO: 290669 - DNA, 25 bp, Rattus norvegicus
gaaatgtctcaaatggtctctctag

SEQ ID NO: 290670 - DNA, 25 bp, Rattus norvegicus
gaaatgtctcaattggtctctctag

SEQ ID NO: 290671 - DNA, 25 bp, Rattus norvegicus
gaaatgtctcccacaaatgtctctc

SEQ ID NO: 290672 - DNA, 25 bp, Rattus norvegicus
gaaatgtctccctcaaatgtctctc

SEQ ID NO: 290673 - DNA, 25 bp, Rattus norvegicus
gaaatgtctctgacttgtgattggg

SEQ ID NO: 290674 - DNA, 25 bp, Rattus norvegicus
gaaatgtctctgtcttgtgattggg

SEQ ID NO: 290675 - DNA, 25 bp, Rattus norvegicus
gaaatgtctcttattatctcaatta

SEQ ID NO: 290676 - DNA, 25 bp, Rattus norvegicus
gaaatgtctcttattgacctcagag

SEQ ID NO: 290677 - DNA, 25 bp, Rattus norvegicus
gaaatgtctctttttatctcaatta

SEQ ID NO: 290678 - DNA, 25 bp, Rattus norvegicus
gaaatgtctctttttgacctcagag

SEQ ID NO: 290679 - DNA, 25 bp, Rattus norvegicus
gaaatgtctgacactgtgcacagtt

SEQ ID NO: 290680 - DNA, 25 bp, Rattus norvegicus
gaaatgtctgacctctttttcaaag

SEQ ID NO: 290681 - DNA, 25 bp, Rattus norvegicus
gaaatgtctgacgtctttttcaaag

SEQ ID NO: 290682 - DNA, 25 bp, Rattus norvegicus
gaaatgtctgactctgtgcacagtt

SEQ ID NO: 290683 - DNA, 25 bp, Rattus norvegicus
gaaatgtctggaccgttcttctcta

SEQ ID NO: 290684 - DNA, 25 bp, Rattus norvegicus
gaaatgtctggagcgttcttctcta

SEQ ID NO: 290685 - DNA, 25 bp, Rattus norvegicus
gaaatgtcttttataatcttgccgt

SEQ ID NO: 290686 - DNA, 25 bp, Rattus norvegicus
gaaatgtcttttttaatcttgccgt

SEQ ID NO: 290687 - DNA, 25 bp, Rattus norvegicus
gaaatgtgaaacacgccacggccgc

SEQ ID NO: 290688 - DNA, 25 bp, Rattus norvegicus
gaaatgtgaaactcgccacggccgc

SEQ ID NO: 290689 - DNA, 25 bp, Rattus norvegicus
gaaatgtgaagcagtccgtggcctc

SEQ ID NO: 290690 - DNA, 25 bp, Rattus norvegicus
gaaatgtgaagctgtccgtggcctc

SEQ ID NO: 290691 - DNA, 25 bp, Rattus norvegicus
gaaatgtgacatatttgctcctccc

SEQ ID NO: 290692 - DNA, 25 bp, Rattus norvegicus
gaaatgtgacatttttgctcctccc

SEQ ID NO: 290693 - DNA, 25 bp, Rattus norvegicus
gaaatgtgaccaaaccaacggtgat

SEQ ID NO: 290694 - DNA, 25 bp, Rattus norvegicus
gaaatgtgaccaaaggccagactta

SEQ ID NO: 290695 - DNA, 25 bp, Rattus norvegicus
gaaatgtgaccataccaacggtgat

SEQ ID NO: 290696 - DNA, 25 bp, Rattus norvegicus
gaaatgtgaccataggccagactta

SEQ ID NO: 290697 - DNA, 25 bp, Rattus norvegicus
gaaatgtgagcccattctgtacctc

SEQ ID NO: 290698 - DNA, 25 bp, Rattus norvegicus
gaaatgtgagccgattctgtacctc

SEQ ID NO: 290699 - DNA, 25 bp, Rattus norvegicus
gaaatgtgatcccagggcctgtctc

SEQ ID NO: 290700 - DNA, 25 bp, Rattus norvegicus
gaaatgtgatccgagggcctgtctc

SEQ ID NO: 290701 - DNA, 25 bp, Rattus norvegicus
gaaatgtgccatcttaaactgtcaa

SEQ ID NO: 290702 - DNA, 25 bp, Rattus norvegicus
gaaatgtgccatgttaaactgtcaa

SEQ ID NO: 290703 - DNA, 25 bp, Rattus norvegicus
gaaatgtgctgtagtgcctggcagt

SEQ ID NO: 290704 - DNA, 25 bp, Rattus norvegicus
gaaatgtgctgttgtgcctggcagt

SEQ ID NO: 290705 - DNA, 25 bp, Rattus norvegicus
gaaatgtggattaggttgcccttta

SEQ ID NO: 290706 - DNA, 25 bp, Rattus norvegicus
gaaatgtggatttggttgcccttta

SEQ ID NO: 290707 - DNA, 25 bp, Rattus norvegicus
gaaatgtggcaaccaccagcctcac

SEQ ID NO: 290708 - DNA, 25 bp, Rattus norvegicus
gaaatgtggcaagcaccagcctcac

SEQ ID NO: 290709 - DNA, 25 bp, Rattus norvegicus
gaaatgtgggccctgaggactttta

SEQ ID NO: 290710 - DNA, 25 bp, Rattus norvegicus
gaaatgtgggccctttccttaatca

SEQ ID NO: 290711 - DNA, 25 bp, Rattus norvegicus
gaaatgtgggccgtgaggactttta

SEQ ID NO: 290712 - DNA, 25 bp, Rattus norvegicus
gaaatgtgggccgtttccttaatca

SEQ ID NO: 290713 - DNA, 25 bp, Rattus norvegicus
gaaatgtggtctctcagctgcctgc

SEQ ID NO: 290714 - DNA, 25 bp, Rattus norvegicus
gaaatgtggtctgtcagctgcctgc

SEQ ID NO: 290715 - DNA, 25 bp, Rattus norvegicus
gaaatgtgtccacctaatttgatct

SEQ ID NO: 290716 - DNA, 25 bp, Rattus norvegicus
gaaatgtgtccagctaatttgatct

SEQ ID NO: 290717 - DNA, 25 bp, Rattus norvegicus
gaaatgtgtggcatctgttttgtat

SEQ ID NO: 290718 - DNA, 25 bp, Rattus norvegicus
gaaatgtgtggcttctgttttgtat

SEQ ID NO: 290719 - DNA, 25 bp, Rattus norvegicus
gaaatgtgtggtcattgatctagac

SEQ ID NO: 290720 - DNA, 25 bp, Rattus norvegicus
gaaatgtgtggtgattgatctagac

SEQ ID NO: 290721 - DNA, 25 bp, Rattus norvegicus
gaaatgtgtttgagtcgtagatggt

SEQ ID NO: 290722 - DNA, 25 bp, Rattus norvegicus
gaaatgtgtttgtgtcgtagatggt

SEQ ID NO: 290723 - DNA, 25 bp, Rattus norvegicus
gaaatgttaagtcccttggcctccc

SEQ ID NO: 290724 - DNA, 25 bp, Rattus norvegicus
gaaatgttaagtgccttggcctccc

SEQ ID NO: 290725 - DNA, 25 bp, Rattus norvegicus
gaaatgttaatgactatcatctcta

SEQ ID NO: 290726 - DNA, 25 bp, Rattus norvegicus
gaaatgttaatgtctatcatctcta

SEQ ID NO: 290727 - DNA, 25 bp, Rattus norvegicus
gaaatgttaccacatactagagtag

SEQ ID NO: 290728 - DNA, 25 bp, Rattus norvegicus
gaaatgttaccagatactagagtag

SEQ ID NO: 290729 - DNA, 25 bp, Rattus norvegicus
gaaatgttacttctatccttcccaa

SEQ ID NO: 290730 - DNA, 25 bp, Rattus norvegicus
gaaatgttacttgtatccttcccaa

SEQ ID NO: 290731 - DNA, 25 bp, Rattus norvegicus
gaaatgttattcacccaaagggctt

SEQ ID NO: 290732 - DNA, 25 bp, Rattus norvegicus
gaaatgttattcatgcagccttgat

SEQ ID NO: 290733 - DNA, 25 bp, Rattus norvegicus
gaaatgttattctcccaaagggctt

SEQ ID NO: 290734 - DNA, 25 bp, Rattus norvegicus
gaaatgttattcttgcagccttgat

SEQ ID NO: 290735 - DNA, 25 bp, Rattus norvegicus
gaaatgttcaaaatccttagtgatc

SEQ ID NO: 290736 - DNA, 25 bp, Rattus norvegicus
gaaatgttcaaattccttagtgatc

SEQ ID NO: 290737 - DNA, 25 bp, Rattus norvegicus
gaaatgttcaccacatgttccaaaa

SEQ ID NO: 290738 - DNA, 25 bp, Rattus norvegicus
gaaatgttcacctcatgttccaaaa

SEQ ID NO: 290739 - DNA, 25 bp, Rattus norvegicus
gaaatgttccacaatgttgacactt

SEQ ID NO: 290740 - DNA, 25 bp, Rattus norvegicus
gaaatgttccacaggccaagggcag

SEQ ID NO: 290741 - DNA, 25 bp, Rattus norvegicus
gaaatgttccactatgttgacactt

SEQ ID NO: 290742 - DNA, 25 bp, Rattus norvegicus
gaaatgttccactggccaagggcag

SEQ ID NO: 290743 - DNA, 25 bp, Rattus norvegicus
gaaatgttcgtgcattggagctgta

SEQ ID NO: 290744 - DNA, 25 bp, Rattus norvegicus
gaaatgttcgtggattggagctgta

SEQ ID NO: 290745 - DNA, 25 bp, Rattus norvegicus
gaaatgttcgttattgaccggtcca

SEQ ID NO: 290746 - DNA, 25 bp, Rattus norvegicus
gaaatgttcgtttttgaccggtcca

SEQ ID NO: 290747 - DNA, 25 bp, Rattus norvegicus
gaaatgttctagatctgtactgtgt

SEQ ID NO: 290748 - DNA, 25 bp, Rattus norvegicus
gaaatgttctagttctgtactgtgt

SEQ ID NO: 290749 - DNA, 25 bp, Rattus norvegicus
gaaatgttctctacatgccagtata

SEQ ID NO: 290750 - DNA, 25 bp, Rattus norvegicus
gaaatgttctcttcatgccagtata

SEQ ID NO: 290751 - DNA, 25 bp, Rattus norvegicus
gaaatgttgctgcttctgaacctgc

SEQ ID NO: 290752 - DNA, 25 bp, Rattus norvegicus
gaaatgttgctggttctgaacctgc

SEQ ID NO: 290753 - DNA, 25 bp, Rattus norvegicus
gaaatgttgtttcatgtcctgtcaa

SEQ ID NO: 290754 - DNA, 25 bp, Rattus norvegicus
gaaatgttgtttgatgtcctgtcaa

SEQ ID NO: 290755 - DNA, 25 bp, Rattus norvegicus
gaaatgtttatacctcagtcctgtg

SEQ ID NO: 290756 - DNA, 25 bp, Rattus norvegicus
gaaatgtttatagctcagtcctgtg

SEQ ID NO: 290757 - DNA, 25 bp, Rattus norvegicus
gaaatgtttatcatgggacccagaa

SEQ ID NO: 290758 - DNA, 25 bp, Rattus norvegicus
gaaatgtttatcttgggacccagaa

SEQ ID NO: 290759 - DNA, 25 bp, Rattus norvegicus
gaaatgtttccgacttccagtacca

SEQ ID NO: 290760 - DNA, 25 bp, Rattus norvegicus
gaaatgtttccgtcttccagtacca

SEQ ID NO: 290761 - DNA, 25 bp, Rattus norvegicus
gaaatgtttgaacccgacctcgaga

SEQ ID NO: 290762 - DNA, 25 bp, Rattus norvegicus
gaaatgtttgaacttgtgtattttt

SEQ ID NO: 290763 - DNA, 25 bp, Rattus norvegicus
gaaatgtttgaagccgacctcgaga

SEQ ID NO: 290764 - DNA, 25 bp, Rattus norvegicus
gaaatgtttgaagttgtgtattttt

SEQ ID NO: 290765 - DNA, 25 bp, Rattus norvegicus
gaaatgtttgcccagacactgcagc

SEQ ID NO: 290766 - DNA, 25 bp, Rattus norvegicus
gaaatgtttgccgagacactgcagc

SEQ ID NO: 290767 - DNA, 25 bp, Rattus norvegicus
gaaatgtttgttcattccttcccat

SEQ ID NO: 290768 - DNA, 25 bp, Rattus norvegicus
gaaatgtttgttctctgcactgtcc

SEQ ID NO: 290769 - DNA, 25 bp, Rattus norvegicus
gaaatgtttgttgattccttcccat

SEQ ID NO: 290770 - DNA, 25 bp, Rattus norvegicus
gaaatgtttgttgtctgcactgtcc

SEQ ID NO: 290771 - DNA, 25 bp, Rattus norvegicus
gaaatgttttacacagtcatccaaa

SEQ ID NO: 290772 - DNA, 25 bp, Rattus norvegicus
gaaatgttttactcagtcatccaaa

SEQ ID NO: 290773 - DNA, 25 bp, Rattus norvegicus
gaaatgttttccattcgtgggcaaa

SEQ ID NO: 290774 - DNA, 25 bp, Rattus norvegicus
gaaatgttttcctttcgtgggcaaa

SEQ ID NO: 290775 - DNA, 25 bp, Rattus norvegicus
gaaatgttttctattgtactaaagt

SEQ ID NO: 290776 - DNA, 25 bp, Rattus norvegicus
gaaatgttttcttttgtactaaagt

SEQ ID NO: 290777 - DNA, 25 bp, Rattus norvegicus
gaaatgttttggaaggcgcgaatgt

SEQ ID NO: 290778 - DNA, 25 bp, Rattus norvegicus
gaaatgttttggtaggcgcgaatgt

SEQ ID NO: 290779 - DNA, 25 bp, Rattus norvegicus
gaaatgtttttcactgcccttggaa

SEQ ID NO: 290780 - DNA, 25 bp, Rattus norvegicus
gaaatgtttttctctgcccttggaa

SEQ ID NO: 290781 - DNA, 25 bp, Rattus norvegicus
gaaatgttttttcctgaacgtgtct

SEQ ID NO: 290782 - DNA, 25 bp, Rattus norvegicus
gaaatgttttttgctgaacgtgtct

SEQ ID NO: 290783 - DNA, 25 bp, Rattus norvegicus
gaaattaacacaagtatcactcagt

SEQ ID NO: 290784 - DNA, 25 bp, Rattus norvegicus
gaaattaacacatgtatcactcagt

SEQ ID NO: 290785 - DNA, 25 bp, Rattus norvegicus
gaaattaagagaagttgcccactga

SEQ ID NO: 290786 - DNA, 25 bp, Rattus norvegicus
gaaattaagagatgttgcccactga

SEQ ID NO: 290787 - DNA, 25 bp, Rattus norvegicus
gaaattaagtccatgtgcccaggaa

SEQ ID NO: 290788 - DNA, 25 bp, Rattus norvegicus
gaaattaagtccttgtgcccaggaa

SEQ ID NO: 290789 - DNA, 25 bp, Rattus norvegicus
gaaattaatcttagatccctgggct

SEQ ID NO: 290790 - DNA, 25 bp, Rattus norvegicus
gaaattaatctttgatccctgggct

SEQ ID NO: 290791 - DNA, 25 bp, Rattus norvegicus
gaaattaatgtaagcctcatctttt

SEQ ID NO: 290792 - DNA, 25 bp, Rattus norvegicus
gaaattaatgtatgcctcatctttt

SEQ ID NO: 290793 - DNA, 25 bp, Rattus norvegicus
gaaattaatttcacagcttatcagt

SEQ ID NO: 290794 - DNA, 25 bp, Rattus norvegicus
gaaattaatttctcagcttatcagt

SEQ ID NO: 290795 - DNA, 25 bp, Rattus norvegicus
gaaattacatagctattccaagtga

SEQ ID NO: 290796 - DNA, 25 bp, Rattus norvegicus
gaaattacataggtattccaagtga

SEQ ID NO: 290797 - DNA, 25 bp, Rattus norvegicus
gaaattaccaatcctttaaggcttc

SEQ ID NO: 290798 - DNA, 25 bp, Rattus norvegicus
gaaattaccaatgctttaaggcttc

SEQ ID NO: 290799 - DNA, 25 bp, Rattus norvegicus
gaaattaccaggatctgccagatcg

SEQ ID NO: 290800 - DNA, 25 bp, Rattus norvegicus
gaaattaccaggttctgccagatcg

SEQ ID NO: 290801 - DNA, 25 bp, Rattus norvegicus
gaaattacctccaagtcacacactg

SEQ ID NO: 290802 - DNA, 25 bp, Rattus norvegicus
gaaattacctcctagtcacacactg

SEQ ID NO: 290803 - DNA, 25 bp, Rattus norvegicus
gaaattacggccaccttcacactcc

SEQ ID NO: 290804 - DNA, 25 bp, Rattus norvegicus
gaaattacggcctccttcacactcc

SEQ ID NO: 290805 - DNA, 25 bp, Rattus norvegicus
gaaattactacgaccgggctgtcct

SEQ ID NO: 290806 - DNA, 25 bp, Rattus norvegicus
gaaattactacgtccgggctgtcct

SEQ ID NO: 290807 - DNA, 25 bp, Rattus norvegicus
gaaattactcgtcaacaggcggcag

SEQ ID NO: 290808 - DNA, 25 bp, Rattus norvegicus
gaaattactcgtgaacaggcggcag

SEQ ID NO: 290809 - DNA, 25 bp, Rattus norvegicus
gaaattactcttcagaccaggcagg

SEQ ID NO: 290810 - DNA, 25 bp, Rattus norvegicus
gaaattactcttgagaccaggcagg

SEQ ID NO: 290811 - DNA, 25 bp, Rattus norvegicus
gaaattacttagaatggcaccaact

SEQ ID NO: 290812 - DNA, 25 bp, Rattus norvegicus
gaaattacttagtatggcaccaact

SEQ ID NO: 290813 - DNA, 25 bp, Rattus norvegicus
gaaattacttctcttgagtaaactt

SEQ ID NO: 290814 - DNA, 25 bp, Rattus norvegicus
gaaattacttctgttgagtaaactt

SEQ ID NO: 290815 - DNA, 25 bp, Rattus norvegicus
gaaattagattcactctcgcttaag

SEQ ID NO: 290816 - DNA, 25 bp, Rattus norvegicus
gaaattagattctctctcgcttaag

SEQ ID NO: 290817 - DNA, 25 bp, Rattus norvegicus
gaaattagcaccatccttggatcct

SEQ ID NO: 290818 - DNA, 25 bp, Rattus norvegicus
gaaattagcaccttccttggatcct

SEQ ID NO: 290819 - DNA, 25 bp, Rattus norvegicus
gaaattagcgtccaggtgtccaacc

SEQ ID NO: 290820 - DNA, 25 bp, Rattus norvegicus
gaaattagcgtcgaggtgtccaacc

SEQ ID NO: 290821 - DNA, 25 bp, Rattus norvegicus
gaaattagcttcactacagtcataa

SEQ ID NO: 290822 - DNA, 25 bp, Rattus norvegicus
gaaattagcttctctacagtcataa

SEQ ID NO: 290823 - DNA, 25 bp, Rattus norvegicus
gaaattagtcccatttctgtggcaa

SEQ ID NO: 290824 - DNA, 25 bp, Rattus norvegicus
gaaattagtcccttttctgtggcaa

SEQ ID NO: 290825 - DNA, 25 bp, Rattus norvegicus
gaaattatcagaagtcttacacact

SEQ ID NO: 290826 - DNA, 25 bp, Rattus norvegicus
gaaattatcagatgtcttacacact

SEQ ID NO: 290827 - DNA, 25 bp, Rattus norvegicus
gaaattatcattaatacttgaccga

SEQ ID NO: 290828 - DNA, 25 bp, Rattus norvegicus
gaaattatcatttatacttgaccga

SEQ ID NO: 290829 - DNA, 25 bp, Rattus norvegicus
gaaattatcccgcttgtaagtcata

SEQ ID NO: 290830 - DNA, 25 bp, Rattus norvegicus
gaaattatcccggttgtaagtcata

SEQ ID NO: 290831 - DNA, 25 bp, Rattus norvegicus
gaaattatccgacacgtggacctca

SEQ ID NO: 290832 - DNA, 25 bp, Rattus norvegicus
gaaattatccgagacgtggacctca

SEQ ID NO: 290833 - DNA, 25 bp, Rattus norvegicus
gaaattatcgatcaaccaccacagg

SEQ ID NO: 290834 - DNA, 25 bp, Rattus norvegicus
gaaattatcgatgaaccaccacagg

SEQ ID NO: 290835 - DNA, 25 bp, Rattus norvegicus
gaaattatctatccccacagaacgg

SEQ ID NO: 290836 - DNA, 25 bp, Rattus norvegicus
gaaattatctatgcccacagaacgg

SEQ ID NO: 290837 - DNA, 25 bp, Rattus norvegicus
gaaattatcttcatagccattaatg

SEQ ID NO: 290838 - DNA, 25 bp, Rattus norvegicus
gaaattatcttcttagccattaatg

SEQ ID NO: 290839 - DNA, 25 bp, Rattus norvegicus
gaaattatctttagctcaaggctta

SEQ ID NO: 290840 - DNA, 25 bp, Rattus norvegicus
gaaattatcttttgctcaaggctta

SEQ ID NO: 290841 - DNA, 25 bp, Rattus norvegicus
gaaattatgccactgggcgtgacaa

SEQ ID NO: 290842 - DNA, 25 bp, Rattus norvegicus
gaaattatgccagtgggcgtgacaa

SEQ ID NO: 290843 - DNA, 25 bp, Rattus norvegicus
gaaattatgtgtcaccagcctccaa

SEQ ID NO: 290844 - DNA, 25 bp, Rattus norvegicus
gaaattatgtgtgaccagcctccaa

SEQ ID NO: 290845 - DNA, 25 bp, Rattus norvegicus
gaaattatgttactaggtacctcat

SEQ ID NO: 290846 - DNA, 25 bp, Rattus norvegicus
gaaattatgttagtaggtacctcat

SEQ ID NO: 290847 - DNA, 25 bp, Rattus norvegicus
gaaattattctgatgccggagttta

SEQ ID NO: 290848 - DNA, 25 bp, Rattus norvegicus
gaaattattctgttgccggagttta

SEQ ID NO: 290849 - DNA, 25 bp, Rattus norvegicus
gaaattattgctcttcaacctttct

SEQ ID NO: 290850 - DNA, 25 bp, Rattus norvegicus
gaaattattgctgttcaacctttct

SEQ ID NO: 290851 - DNA, 25 bp, Rattus norvegicus
gaaattattggaaaacctctacaaa

SEQ ID NO: 290852 - DNA, 25 bp, Rattus norvegicus
gaaattattggataacctctacaaa

SEQ ID NO: 290853 - DNA, 25 bp, Rattus norvegicus
gaaattatttacacctgagggcagc

SEQ ID NO: 290854 - DNA, 25 bp, Rattus norvegicus
gaaattatttactcctgagggcagc

SEQ ID NO: 290855 - DNA, 25 bp, Rattus norvegicus
gaaattcaaagaaccagctgcccct

SEQ ID NO: 290856 - DNA, 25 bp, Rattus norvegicus
gaaattcaaagatccagctgcccct

SEQ ID NO: 290857 - DNA, 25 bp, Rattus norvegicus
gaaattcaaagcactgtaccaacct

SEQ ID NO: 290858 - DNA, 25 bp, Rattus norvegicus
gaaattcaaagctctgtaccaacct

SEQ ID NO: 290859 - DNA, 25 bp, Rattus norvegicus
gaaattcaactgattgcttctctgt

SEQ ID NO: 290860 - DNA, 25 bp, Rattus norvegicus
gaaattcaactgcaagcctcatgtg

SEQ ID NO: 290861 - DNA, 25 bp, Rattus norvegicus
gaaattcaactggaagcctcatgtg

SEQ ID NO: 290862 - DNA, 25 bp, Rattus norvegicus
gaaattcaactgtttgcttctctgt

SEQ ID NO: 290863 - DNA, 25 bp, Rattus norvegicus
gaaattcaagatctcaggccctagg

SEQ ID NO: 290864 - DNA, 25 bp, Rattus norvegicus
gaaattcaagatgtcaggccctagg

SEQ ID NO: 290865 - DNA, 25 bp, Rattus norvegicus
gaaattcaagccattttactgtgta

SEQ ID NO: 290866 - DNA, 25 bp, Rattus norvegicus
gaaattcaagcctttttactgtgta

SEQ ID NO: 290867 - DNA, 25 bp, Rattus norvegicus
gaaattcaagtgaacctgccataac

SEQ ID NO: 290868 - DNA, 25 bp, Rattus norvegicus
gaaattcaagtgtacctgccataac

SEQ ID NO: 290869 - DNA, 25 bp, Rattus norvegicus
gaaattcaatgcattgttccttaac

SEQ ID NO: 290870 - DNA, 25 bp, Rattus norvegicus
gaaattcaatgctttgttccttaac

SEQ ID NO: 290871 - DNA, 25 bp, Rattus norvegicus
gaaattcacaaacactacccgactt

SEQ ID NO: 290872 - DNA, 25 bp, Rattus norvegicus
gaaattcacaaagactacccgactt

SEQ ID NO: 290873 - DNA, 25 bp, Rattus norvegicus
gaaattcacaggacccagatctgcc

SEQ ID NO: 290874 - DNA, 25 bp, Rattus norvegicus
gaaattcacaggtcccagatctgcc

SEQ ID NO: 290875 - DNA, 25 bp, Rattus norvegicus
gaaattcacatcaagacttttttaa

SEQ ID NO: 290876 - DNA, 25 bp, Rattus norvegicus
gaaattcacatcacgaaacccattg

SEQ ID NO: 290877 - DNA, 25 bp, Rattus norvegicus
gaaattcacatctagacttttttaa

SEQ ID NO: 290878 - DNA, 25 bp, Rattus norvegicus
gaaattcacatctcgaaacccattg

SEQ ID NO: 290879 - DNA, 25 bp, Rattus norvegicus
gaaattcacattctacaccgtaggt

SEQ ID NO: 290880 - DNA, 25 bp, Rattus norvegicus
gaaattcacattgtacaccgtaggt

SEQ ID NO: 290881 - DNA, 25 bp, Rattus norvegicus
gaaattcaccaactcaccatgtgtg

SEQ ID NO: 290882 - DNA, 25 bp, Rattus norvegicus
gaaattcaccaagtcaccatgtgtg

SEQ ID NO: 290883 - DNA, 25 bp, Rattus norvegicus
gaaattcaccagctacactttggat

SEQ ID NO: 290884 - DNA, 25 bp, Rattus norvegicus
gaaattcaccaggtacactttggat

SEQ ID NO: 290885 - DNA, 25 bp, Rattus norvegicus
gaaattcacccactatgtcctgagg

SEQ ID NO: 290886 - DNA, 25 bp, Rattus norvegicus
gaaattcacccagtatgtcctgagg

SEQ ID NO: 290887 - DNA, 25 bp, Rattus norvegicus
gaaattcaccctaactgggcatgac

SEQ ID NO: 290888 - DNA, 25 bp, Rattus norvegicus
gaaattcacccttactgggcatgac

SEQ ID NO: 290889 - DNA, 25 bp, Rattus norvegicus
gaaattcacctacaatcccatggac

SEQ ID NO: 290890 - DNA, 25 bp, Rattus norvegicus
gaaattcacctagaatcccatggac

SEQ ID NO: 290891 - DNA, 25 bp, Rattus norvegicus
gaaattcacgtgctgcccatggtct

SEQ ID NO: 290892 - DNA, 25 bp, Rattus norvegicus
gaaattcacgtggtgcccatggtct

SEQ ID NO: 290893 - DNA, 25 bp, Rattus norvegicus
gaaattcacttaaacacttcaccta

SEQ ID NO: 290894 - DNA, 25 bp, Rattus norvegicus
gaaattcacttatacacttcaccta

SEQ ID NO: 290895 - DNA, 25 bp, Rattus norvegicus
gaaattcagatgatgtcttgcgatc

SEQ ID NO: 290896 - DNA, 25 bp, Rattus norvegicus
gaaattcagatgttgtcttgcgatc

SEQ ID NO: 290897 - DNA, 25 bp, Rattus norvegicus
gaaattcagcatatggtcaccaaga

SEQ ID NO: 290898 - DNA, 25 bp, Rattus norvegicus
gaaattcagcatttggtcaccaaga

SEQ ID NO: 290899 - DNA, 25 bp, Rattus norvegicus
gaaattcagcttacccagtgatgtt

SEQ ID NO: 290900 - DNA, 25 bp, Rattus norvegicus
gaaattcagctttcccagtgatgtt

SEQ ID NO: 290901 - DNA, 25 bp, Rattus norvegicus
gaaattcaggcccttctttacacgc

SEQ ID NO: 290902 - DNA, 25 bp, Rattus norvegicus
gaaattcaggccgttctttacacgc

SEQ ID NO: 290903 - DNA, 25 bp, Rattus norvegicus
gaaattcatattaggtgtggcttaa

SEQ ID NO: 290904 - DNA, 25 bp, Rattus norvegicus
gaaattcatatttggtgtggcttaa

SEQ ID NO: 290905 - DNA, 25 bp, Rattus norvegicus
gaaattcatcaaatgcttcacgtgc

SEQ ID NO: 290906 - DNA, 25 bp, Rattus norvegicus
gaaattcatcaattgcttcacgtgc

SEQ ID NO: 290907 - DNA, 25 bp, Rattus norvegicus
gaaattcatctaatcaagccctgtg

SEQ ID NO: 290908 - DNA, 25 bp, Rattus norvegicus
gaaattcatctattcaagccctgtg

SEQ ID NO: 290909 - DNA, 25 bp, Rattus norvegicus
gaaattcattcccaacactcaaaat

SEQ ID NO: 290910 - DNA, 25 bp, Rattus norvegicus
gaaattcattccgaacactcaaaat

SEQ ID NO: 290911 - DNA, 25 bp, Rattus norvegicus
gaaattcattctcgcacagatgatg

SEQ ID NO: 290912 - DNA, 25 bp, Rattus norvegicus
gaaattcattctggcacagatgatg

SEQ ID NO: 290913 - DNA, 25 bp, Rattus norvegicus
gaaattcattgaacagccacggcat

SEQ ID NO: 290914 - DNA, 25 bp, Rattus norvegicus
gaaattcattgatcagccacggcat

SEQ ID NO: 290915 - DNA, 25 bp, Rattus norvegicus
gaaattcatttcaggtgtggctttt

SEQ ID NO: 290916 - DNA, 25 bp, Rattus norvegicus
gaaattcatttctggtgtggctttt

SEQ ID NO: 290917 - DNA, 25 bp, Rattus norvegicus
gaaattcattttatctagtgccttt

SEQ ID NO: 290918 - DNA, 25 bp, Rattus norvegicus
gaaattcattttttctagtgccttt

SEQ ID NO: 290919 - DNA, 25 bp, Rattus norvegicus
gaaattccaacacagttggccttca

SEQ ID NO: 290920 - DNA, 25 bp, Rattus norvegicus
gaaattccaacagagttggccttca

SEQ ID NO: 290921 - DNA, 25 bp, Rattus norvegicus
gaaattccaacgaacgtgcagctca

SEQ ID NO: 290922 - DNA, 25 bp, Rattus norvegicus
gaaattccaacgtacgtgcagctca

SEQ ID NO: 290923 - DNA, 25 bp, Rattus norvegicus
gaaattccacacatcacttaggacc

SEQ ID NO: 290924 - DNA, 25 bp, Rattus norvegicus
gaaattccacacttcacttaggacc

SEQ ID NO: 290925 - DNA, 25 bp, Rattus norvegicus
gaaattccacagacagttaatgcga

SEQ ID NO: 290926 - DNA, 25 bp, Rattus norvegicus
gaaattccacagtcagttaatgcga

SEQ ID NO: 290927 - DNA, 25 bp, Rattus norvegicus
gaaattccagttattctccacttct

SEQ ID NO: 290928 - DNA, 25 bp, Rattus norvegicus
gaaattccagtttttctccacttct

SEQ ID NO: 290929 - DNA, 25 bp, Rattus norvegicus
gaaattccatccaaaaatgttgcct

SEQ ID NO: 290930 - DNA, 25 bp, Rattus norvegicus
gaaattccatcctaaaatgttgcct

SEQ ID NO: 290931 - DNA, 25 bp, Rattus norvegicus
gaaattccatggattctggttgcat

SEQ ID NO: 290932 - DNA, 25 bp, Rattus norvegicus
gaaattccatggtttctggttgcat

SEQ ID NO: 290933 - DNA, 25 bp, Rattus norvegicus
gaaattcccaaaagactaataaagt

SEQ ID NO: 290934 - DNA, 25 bp, Rattus norvegicus
gaaattcccaaatgactaataaagt

SEQ ID NO: 290935 - DNA, 25 bp, Rattus norvegicus
gaaattcccattagtttcatcccac

SEQ ID NO: 290936 - DNA, 25 bp, Rattus norvegicus
gaaattcccatttgtttcatcccac

SEQ ID NO: 290937 - DNA, 25 bp, Rattus norvegicus
gaaattccctcgaagagttgaagct

SEQ ID NO: 290938 - DNA, 25 bp, Rattus norvegicus
gaaattccctcgtagagttgaagct

SEQ ID NO: 290939 - DNA, 25 bp, Rattus norvegicus
gaaattccctctcttactgtactca

SEQ ID NO: 290940 - DNA, 25 bp, Rattus norvegicus
gaaattccctctgttactgtactca

SEQ ID NO: 290941 - DNA, 25 bp, Rattus norvegicus
gaaattccctgacggaggcttcatt

SEQ ID NO: 290942 - DNA, 25 bp, Rattus norvegicus
gaaattccctgagggaggcttcatt

SEQ ID NO: 290943 - DNA, 25 bp, Rattus norvegicus
gaaattccgagcagcggttgtgcat

SEQ ID NO: 290944 - DNA, 25 bp, Rattus norvegicus
gaaattccgagctgcggttgtgcat

SEQ ID NO: 290945 - DNA, 25 bp, Rattus norvegicus
gaaattccggatcaaggcagtgtga

SEQ ID NO: 290946 - DNA, 25 bp, Rattus norvegicus
gaaattccggatgaaggcagtgtga

SEQ ID NO: 290947 - DNA, 25 bp, Rattus norvegicus
gaaattcctattcgcagactctgtt

SEQ ID NO: 290948 - DNA, 25 bp, Rattus norvegicus
gaaattcctattggcagactctgtt

SEQ ID NO: 290949 - DNA, 25 bp, Rattus norvegicus
gaaattcctgagaccaagtcaccaa

SEQ ID NO: 290950 - DNA, 25 bp, Rattus norvegicus
gaaattcctgagtccaagtcaccaa

SEQ ID NO: 290951 - DNA, 25 bp, Rattus norvegicus
gaaattcctgcaacaaaggtccgga

SEQ ID NO: 290952 - DNA, 25 bp, Rattus norvegicus
gaaattcctgcatcaaaggtccgga

SEQ ID NO: 290953 - DNA, 25 bp, Rattus norvegicus
gaaattcctgctccttaccataggg

SEQ ID NO: 290954 - DNA, 25 bp, Rattus norvegicus
gaaattcctgctgcttaccataggg

SEQ ID NO: 290955 - DNA, 25 bp, Rattus norvegicus
gaaattcctgtacaggtggtgctaa

SEQ ID NO: 290956 - DNA, 25 bp, Rattus norvegicus
gaaattcctgtagaggtggtgctaa

SEQ ID NO: 290957 - DNA, 25 bp, Rattus norvegicus
gaaattcctgtgatttggtgtcttc

SEQ ID NO: 290958 - DNA, 25 bp, Rattus norvegicus
gaaattcctgtgttttggtgtcttc

SEQ ID NO: 290959 - DNA, 25 bp, Rattus norvegicus
gaaattcgattcctccagagacaga

SEQ ID NO: 290960 - DNA, 25 bp, Rattus norvegicus
gaaattcgattcgtccagagacaga

SEQ ID NO: 290961 - DNA, 25 bp, Rattus norvegicus
gaaattcgccaacgatgactccgat

SEQ ID NO: 290962 - DNA, 25 bp, Rattus norvegicus
gaaattcgccaaggatgactccgat

SEQ ID NO: 290963 - DNA, 25 bp, Rattus norvegicus
gaaattcgcgcgcagtgaccacctc

SEQ ID NO: 290964 - DNA, 25 bp, Rattus norvegicus
gaaattcgcgcggagtgaccacctc

SEQ ID NO: 290965 - DNA, 25 bp, Rattus norvegicus
gaaattcgctgaagcatttgaagct

SEQ ID NO: 290966 - DNA, 25 bp, Rattus norvegicus
gaaattcgctgatgcatttgaagct

SEQ ID NO: 290967 - DNA, 25 bp, Rattus norvegicus
gaaattcgtagacgatggcagccat

SEQ ID NO: 290968 - DNA, 25 bp, Rattus norvegicus
gaaattcgtagaggatggcagccat

SEQ ID NO: 290969 - DNA, 25 bp, Rattus norvegicus
gaaattcgtcttctccacagaggag

SEQ ID NO: 290970 - DNA, 25 bp, Rattus norvegicus
gaaattcgtcttgtccacagaggag

SEQ ID NO: 290971 - DNA, 25 bp, Rattus norvegicus
gaaattcgttcacttatgtaaggtt

SEQ ID NO: 290972 - DNA, 25 bp, Rattus norvegicus
gaaattcgttcagttatgtaaggtt

SEQ ID NO: 290973 - DNA, 25 bp, Rattus norvegicus
gaaattctactcactgtacacctga

SEQ ID NO: 290974 - DNA, 25 bp, Rattus norvegicus
gaaattctactctctgtacacctga

SEQ ID NO: 290975 - DNA, 25 bp, Rattus norvegicus
gaaattctactgatttagttcacag

SEQ ID NO: 290976 - DNA, 25 bp, Rattus norvegicus
gaaattctactgttttagttcacag

SEQ ID NO: 290977 - DNA, 25 bp, Rattus norvegicus
gaaattctagcccagacctcatatt

SEQ ID NO: 290978 - DNA, 25 bp, Rattus norvegicus
gaaattctagccgagacctcatatt

SEQ ID NO: 290979 - DNA, 25 bp, Rattus norvegicus
gaaattctcactaacttatcatgga

SEQ ID NO: 290980 - DNA, 25 bp, Rattus norvegicus
gaaattctcacttacttatcatgga

SEQ ID NO: 290981 - DNA, 25 bp, Rattus norvegicus
gaaattctcagcaccgacatgacag

SEQ ID NO: 290982 - DNA, 25 bp, Rattus norvegicus
gaaattctcagctccgacatgacag

SEQ ID NO: 290983 - DNA, 25 bp, Rattus norvegicus
gaaattctcaggaaggagcatctgt

SEQ ID NO: 290984 - DNA, 25 bp, Rattus norvegicus
gaaattctcaggtaggagcatctgt

SEQ ID NO: 290985 - DNA, 25 bp, Rattus norvegicus
gaaattctccatctctgatacctat

SEQ ID NO: 290986 - DNA, 25 bp, Rattus norvegicus
gaaattctccatgtctgatacctat

SEQ ID NO: 290987 - DNA, 25 bp, Rattus norvegicus
gaaattctccctccattgatgtaca

SEQ ID NO: 290988 - DNA, 25 bp, Rattus norvegicus
gaaattctccctgcattgatgtaca

SEQ ID NO: 290989 - DNA, 25 bp, Rattus norvegicus
gaaattctcctcctctgttaagtgt

SEQ ID NO: 290990 - DNA, 25 bp, Rattus norvegicus
gaaattctcctcgtctgttaagtgt

SEQ ID NO: 290991 - DNA, 25 bp, Rattus norvegicus
gaaattctctctagtttgcttgggt

SEQ ID NO: 290992 - DNA, 25 bp, Rattus norvegicus
gaaattctctcttgtttgcttgggt

SEQ ID NO: 290993 - DNA, 25 bp, Rattus norvegicus
gaaattctgaaaacctgtatctgct

SEQ ID NO: 290994 - DNA, 25 bp, Rattus norvegicus
gaaattctgaaatcctgtatctgct

SEQ ID NO: 290995 - DNA, 25 bp, Rattus norvegicus
gaaattctgacaccccatgtgagaa

SEQ ID NO: 290996 - DNA, 25 bp, Rattus norvegicus
gaaattctgacagcccatgtgagaa

SEQ ID NO: 290997 - DNA, 25 bp, Rattus norvegicus
gaaattctgaccatccaactgtgtt

SEQ ID NO: 290998 - DNA, 25 bp, Rattus norvegicus
gaaattctgaccttccaactgtgtt

SEQ ID NO: 290999 - DNA, 25 bp, Rattus norvegicus
gaaattctgcacactagtcagtata

SEQ ID NO: 291000 - DNA, 25 bp, Rattus norvegicus
gaaattctgcacactttcaactggc

SEQ ID NO: 291001 - DNA, 25 bp, Rattus norvegicus
gaaattctgcactctagtcagtata

SEQ ID NO: 291002 - DNA, 25 bp, Rattus norvegicus
gaaattctgcactctttcaactggc

SEQ ID NO: 291003 - DNA, 25 bp, Rattus norvegicus
gaaattctgctacgagactagccac

SEQ ID NO: 291004 - DNA, 25 bp, Rattus norvegicus
gaaattctgctaggagactagccac

SEQ ID NO: 291005 - DNA, 25 bp, Rattus norvegicus
gaaattctgcttctctaaatgttag

SEQ ID NO: 291006 - DNA, 25 bp, Rattus norvegicus
gaaattctgcttgtctaaatgttag

SEQ ID NO: 291007 - DNA, 25 bp, Rattus norvegicus
gaaattctggagcaccttaggtgga

SEQ ID NO: 291008 - DNA, 25 bp, Rattus norvegicus
gaaattctggaggaccttaggtgga

SEQ ID NO: 291009 - DNA, 25 bp, Rattus norvegicus
gaaattctggatacgcactggcttg

SEQ ID NO: 291010 - DNA, 25 bp, Rattus norvegicus
gaaattctggattcgcactggcttg

SEQ ID NO: 291011 - DNA, 25 bp, Rattus norvegicus
gaaattctggttagctactggtggg

SEQ ID NO: 291012 - DNA, 25 bp, Rattus norvegicus
gaaattctggtttgctactggtggg

SEQ ID NO: 291013 - DNA, 25 bp, Rattus norvegicus
gaaattctgtaccatctgaaagtag

SEQ ID NO: 291014 - DNA, 25 bp, Rattus norvegicus
gaaattctgtacgatctgaaagtag

SEQ ID NO: 291015 - DNA, 25 bp, Rattus norvegicus
gaaattctgtctattctgcaggcct

SEQ ID NO: 291016 - DNA, 25 bp, Rattus norvegicus
gaaattctgtcttttctgcaggcct

SEQ ID NO: 291017 - DNA, 25 bp, Rattus norvegicus
gaaattctgtgaatactgcaagtgc

SEQ ID NO: 291018 - DNA, 25 bp, Rattus norvegicus
gaaattctgtgattactgcaagtgc

SEQ ID NO: 291019 - DNA, 25 bp, Rattus norvegicus
gaaattctgtgcaagcctgttccat

SEQ ID NO: 291020 - DNA, 25 bp, Rattus norvegicus
gaaattctgtgcattgcattttggt

SEQ ID NO: 291021 - DNA, 25 bp, Rattus norvegicus
gaaattctgtgctagcctgttccat

SEQ ID NO: 291022 - DNA, 25 bp, Rattus norvegicus
gaaattctgtgctttgcattttggt

SEQ ID NO: 291023 - DNA, 25 bp, Rattus norvegicus
gaaattctgtttcttgtttactatg

SEQ ID NO: 291024 - DNA, 25 bp, Rattus norvegicus
gaaattctgtttgttgtttactatg

SEQ ID NO: 291025 - DNA, 25 bp, Rattus norvegicus
gaaattcttcttaagagctagtgca

SEQ ID NO: 291026 - DNA, 25 bp, Rattus norvegicus
gaaattcttctttagagctagtgca

SEQ ID NO: 291027 - DNA, 25 bp, Rattus norvegicus
gaaattcttgcccagactatacgag

SEQ ID NO: 291028 - DNA, 25 bp, Rattus norvegicus
gaaattcttgccgagactatacgag

SEQ ID NO: 291029 - DNA, 25 bp, Rattus norvegicus
gaaattcttgctctgctggcagctg

SEQ ID NO: 291030 - DNA, 25 bp, Rattus norvegicus
gaaattcttgctgtgctggcagctg

SEQ ID NO: 291031 - DNA, 25 bp, Rattus norvegicus
gaaattcttggcagttctatttgac

SEQ ID NO: 291032 - DNA, 25 bp, Rattus norvegicus
gaaattcttggctgttctatttgac

SEQ ID NO: 291033 - DNA, 25 bp, Rattus norvegicus
gaaattcttgtccaaatgttgccaa

SEQ ID NO: 291034 - DNA, 25 bp, Rattus norvegicus
gaaattcttgtcgaaatgttgccaa

SEQ ID NO: 291035 - DNA, 25 bp, Rattus norvegicus
gaaattcttttcaacctatggatct

SEQ ID NO: 291036 - DNA, 25 bp, Rattus norvegicus
gaaattcttttcacccagatgagat

SEQ ID NO: 291037 - DNA, 25 bp, Rattus norvegicus
gaaattcttttctacctatggatct

SEQ ID NO: 291038 - DNA, 25 bp, Rattus norvegicus
gaaattcttttctcccagatgagat

SEQ ID NO: 291039 - DNA, 25 bp, Rattus norvegicus
gaaattcttttgacgtgagctagtt

SEQ ID NO: 291040 - DNA, 25 bp, Rattus norvegicus
gaaattcttttgtcgtgagctagtt

SEQ ID NO: 291041 - DNA, 25 bp, Rattus norvegicus
gaaattgaaacaaactggttctgct

SEQ ID NO: 291042 - DNA, 25 bp, Rattus norvegicus
gaaattgaaacatactggttctgct

SEQ ID NO: 291043 - DNA, 25 bp, Rattus norvegicus
gaaattgaaccacaaactctgtcag

SEQ ID NO: 291044 - DNA, 25 bp, Rattus norvegicus
gaaattgaaccagaaactctgtcag

SEQ ID NO: 291045 - DNA, 25 bp, Rattus norvegicus
gaaattgacaccattttccctgtta

SEQ ID NO: 291046 - DNA, 25 bp, Rattus norvegicus
gaaattgacacctttttccctgtta

SEQ ID NO: 291047 - DNA, 25 bp, Rattus norvegicus
gaaattgaccctcggccctgcgtgg

SEQ ID NO: 291048 - DNA, 25 bp, Rattus norvegicus
gaaattgaccctgggccctgcgtgg

SEQ ID NO: 291049 - DNA, 25 bp, Rattus norvegicus
gaaattgacgccatttactgaaatg

SEQ ID NO: 291050 - DNA, 25 bp, Rattus norvegicus
gaaattgacgccttttactgaaatg

SEQ ID NO: 291051 - DNA, 25 bp, Rattus norvegicus
gaaattgacgctattttctcttgcg

SEQ ID NO: 291052 - DNA, 25 bp, Rattus norvegicus
gaaattgacgcttttttctcttgcg

SEQ ID NO: 291053 - DNA, 25 bp, Rattus norvegicus
gaaattgactagatcccatgtgatt

SEQ ID NO: 291054 - DNA, 25 bp, Rattus norvegicus
gaaattgactagttcccatgtgatt

SEQ ID NO: 291055 - DNA, 25 bp, Rattus norvegicus
gaaattgactgtacccaggtcacct

SEQ ID NO: 291056 - DNA, 25 bp, Rattus norvegicus
gaaattgactgttcccaggtcacct

SEQ ID NO: 291057 - DNA, 25 bp, Rattus norvegicus
gaaattgactttaccagctactgaa

SEQ ID NO: 291058 - DNA, 25 bp, Rattus norvegicus
gaaattgacttttccagctactgaa

SEQ ID NO: 291059 - DNA, 25 bp, Rattus norvegicus
gaaattgaggtgactgtccctcact

SEQ ID NO: 291060 - DNA, 25 bp, Rattus norvegicus
gaaattgaggtgtctgtccctcact

SEQ ID NO: 291061 - DNA, 25 bp, Rattus norvegicus
gaaattgagtcacaggcctttccct

SEQ ID NO: 291062 - DNA, 25 bp, Rattus norvegicus
gaaattgagtcagaggcctttccct

SEQ ID NO: 291063 - DNA, 25 bp, Rattus norvegicus
gaaattgatgataacctaggctaca

SEQ ID NO: 291064 - DNA, 25 bp, Rattus norvegicus
gaaattgatgattacctaggctaca

SEQ ID NO: 291065 - DNA, 25 bp, Rattus norvegicus
gaaattgatggacaagacccctccc

SEQ ID NO: 291066 - DNA, 25 bp, Rattus norvegicus
gaaattgatggagaagacccctccc

SEQ ID NO: 291067 - DNA, 25 bp, Rattus norvegicus
gaaattgatgtcaggctggttacta

SEQ ID NO: 291068 - DNA, 25 bp, Rattus norvegicus
gaaattgatgtctggctggttacta

SEQ ID NO: 291069 - DNA, 25 bp, Rattus norvegicus
gaaattgcaattcccctccggatcg

SEQ ID NO: 291070 - DNA, 25 bp, Rattus norvegicus
gaaattgcaattgccctccggatcg

SEQ ID NO: 291071 - DNA, 25 bp, Rattus norvegicus
gaaattgcacttcctgaaagacact

SEQ ID NO: 291072 - DNA, 25 bp, Rattus norvegicus
gaaattgcacttgctgaaagacact

SEQ ID NO: 291073 - DNA, 25 bp, Rattus norvegicus
gaaattgcagggactcctctgagaa

SEQ ID NO: 291074 - DNA, 25 bp, Rattus norvegicus
gaaattgcagggtctcctctgagaa

SEQ ID NO: 291075 - DNA, 25 bp, Rattus norvegicus
gaaattgcatctaacagctctttgg

SEQ ID NO: 291076 - DNA, 25 bp, Rattus norvegicus
gaaattgcatcttacagctctttgg

SEQ ID NO: 291077 - DNA, 25 bp, Rattus norvegicus
gaaattgcatgacttccctgctgag

SEQ ID NO: 291078 - DNA, 25 bp, Rattus norvegicus
gaaattgcatgagttccctgctgag

SEQ ID NO: 291079 - DNA, 25 bp, Rattus norvegicus
gaaattgcatttctcctttctcaga

SEQ ID NO: 291080 - DNA, 25 bp, Rattus norvegicus
gaaattgcatttgtcctttctcaga

SEQ ID NO: 291081 - DNA, 25 bp, Rattus norvegicus
gaaattgccaagattagcccgagtt

SEQ ID NO: 291082 - DNA, 25 bp, Rattus norvegicus
gaaattgccaagtttagcccgagtt

SEQ ID NO: 291083 - DNA, 25 bp, Rattus norvegicus
gaaattgcccatctcactacatttg

SEQ ID NO: 291084 - DNA, 25 bp, Rattus norvegicus
gaaattgcccatgtcactacatttg

SEQ ID NO: 291085 - DNA, 25 bp, Rattus norvegicus
gaaattgccccaaatttgcctggcc

SEQ ID NO: 291086 - DNA, 25 bp, Rattus norvegicus
gaaattgccccatatttgcctggcc

SEQ ID NO: 291087 - DNA, 25 bp, Rattus norvegicus
gaaattgccctcattggttatctgc

SEQ ID NO: 291088 - DNA, 25 bp, Rattus norvegicus
gaaattgccctctttggttatctgc

SEQ ID NO: 291089 - DNA, 25 bp, Rattus norvegicus
gaaattgcctgtcccgagaacggac

SEQ ID NO: 291090 - DNA, 25 bp, Rattus norvegicus
gaaattgcctgtgccgagaacggac

SEQ ID NO: 291091 - DNA, 25 bp, Rattus norvegicus
gaaattgctcgtaccttttgaacat

SEQ ID NO: 291092 - DNA, 25 bp, Rattus norvegicus
gaaattgctcgttccttttgaacat

SEQ ID NO: 291093 - DNA, 25 bp, Rattus norvegicus
gaaattgctgcgctggatcgtttgc

SEQ ID NO: 291094 - DNA, 25 bp, Rattus norvegicus
gaaattgctgcggtggatcgtttgc

SEQ ID NO: 291095 - DNA, 25 bp, Rattus norvegicus
gaaattggcagaagagtctaggaca

SEQ ID NO: 291096 - DNA, 25 bp, Rattus norvegicus
gaaattggcagatgagtctaggaca

SEQ ID NO: 291097 - DNA, 25 bp, Rattus norvegicus
gaaattggcagccattccacgacga

SEQ ID NO: 291098 - DNA, 25 bp, Rattus norvegicus
gaaattggcagcgattccacgacga

SEQ ID NO: 291099 - DNA, 25 bp, Rattus norvegicus
gaaattggccggcaacctgaagaaa

SEQ ID NO: 291100 - DNA, 25 bp, Rattus norvegicus
gaaattggccgggaacctgaagaaa

SEQ ID NO: 291101 - DNA, 25 bp, Rattus norvegicus
gaaattggcctcactttatcaggct

SEQ ID NO: 291102 - DNA, 25 bp, Rattus norvegicus
gaaattggcctctctttatcaggct

SEQ ID NO: 291103 - DNA, 25 bp, Rattus norvegicus
gaaattggcctgctgtatcaagagt

SEQ ID NO: 291104 - DNA, 25 bp, Rattus norvegicus
gaaattggcctggtgtatcaagagt

SEQ ID NO: 291105 - DNA, 25 bp, Rattus norvegicus
gaaattgggacgcacatgtaagaat

SEQ ID NO: 291106 - DNA, 25 bp, Rattus norvegicus
gaaattgggacggacatgtaagaat

SEQ ID NO: 291107 - DNA, 25 bp, Rattus norvegicus
gaaattgggatcacagtcctgatgc

SEQ ID NO: 291108 - DNA, 25 bp, Rattus norvegicus
gaaattgggatctcagtcctgatgc

SEQ ID NO: 291109 - DNA, 25 bp, Rattus norvegicus
gaaattgggattcgactcactctct

SEQ ID NO: 291110 - DNA, 25 bp, Rattus norvegicus
gaaattgggattggactcactctct

SEQ ID NO: 291111 - DNA, 25 bp, Rattus norvegicus
gaaattgggtctcgtgaatcacata

SEQ ID NO: 291112 - DNA, 25 bp, Rattus norvegicus
gaaattgggtctggtgaatcacata

SEQ ID NO: 291113 - DNA, 25 bp, Rattus norvegicus
gaaattggtgggacctcacgttggt

SEQ ID NO: 291114 - DNA, 25 bp, Rattus norvegicus
gaaattggtgggtcctcacgttggt

SEQ ID NO: 291115 - DNA, 25 bp, Rattus norvegicus
gaaattggttatcctcgccaacaac

SEQ ID NO: 291116 - DNA, 25 bp, Rattus norvegicus
gaaattggttatgctcgccaacaac

SEQ ID NO: 291117 - DNA, 25 bp, Rattus norvegicus
gaaattggttcccttgcaatcttct

SEQ ID NO: 291118 - DNA, 25 bp, Rattus norvegicus
gaaattggttccgttgcaatcttct

SEQ ID NO: 291119 - DNA, 25 bp, Rattus norvegicus
gaaattgtaactatgccacctggtt

SEQ ID NO: 291120 - DNA, 25 bp, Rattus norvegicus
gaaattgtaactttgccacctggtt

SEQ ID NO: 291121 - DNA, 25 bp, Rattus norvegicus
gaaattgtatccatgtgtccggaag

SEQ ID NO: 291122 - DNA, 25 bp, Rattus norvegicus
gaaattgtatccttgtgtccggaag

SEQ ID NO: 291123 - DNA, 25 bp, Rattus norvegicus
gaaattgtatctactcacacagttg

SEQ ID NO: 291124 - DNA, 25 bp, Rattus norvegicus
gaaattgtatcttctcacacagttg

SEQ ID NO: 291125 - DNA, 25 bp, Rattus norvegicus
gaaattgtctctattgcatgaactg

SEQ ID NO: 291126 - DNA, 25 bp, Rattus norvegicus
gaaattgtctcttttgcatgaactg

SEQ ID NO: 291127 - DNA, 25 bp, Rattus norvegicus
gaaattgtctgcaaccagcctaggg

SEQ ID NO: 291128 - DNA, 25 bp, Rattus norvegicus
gaaattgtctgcctattcttatggg

SEQ ID NO: 291129 - DNA, 25 bp, Rattus norvegicus
gaaattgtctgcgtattcttatggg

SEQ ID NO: 291130 - DNA, 25 bp, Rattus norvegicus
gaaattgtctgctaccagcctaggg

SEQ ID NO: 291131 - DNA, 25 bp, Rattus norvegicus
gaaattgtctggcatgtatctctat

SEQ ID NO: 291132 - DNA, 25 bp, Rattus norvegicus
gaaattgtctgggatgtatctctat

SEQ ID NO: 291133 - DNA, 25 bp, Rattus norvegicus
gaaattgtcttcatccatccaaatg

SEQ ID NO: 291134 - DNA, 25 bp, Rattus norvegicus
gaaattgtcttcttccatccaaatg

SEQ ID NO: 291135 - DNA, 25 bp, Rattus norvegicus
gaaattgtgactacttcatgggccc

SEQ ID NO: 291136 - DNA, 25 bp, Rattus norvegicus
gaaattgtgacttcttcatgggccc

SEQ ID NO: 291137 - DNA, 25 bp, Rattus norvegicus
gaaattgtgagcagtcttcatagtt

SEQ ID NO: 291138 - DNA, 25 bp, Rattus norvegicus
gaaattgtgagctgtcttcatagtt

SEQ ID NO: 291139 - DNA, 25 bp, Rattus norvegicus
gaaattgtgcaaccctgcattcctt

SEQ ID NO: 291140 - DNA, 25 bp, Rattus norvegicus
gaaattgtgcaagcctgcattcctt

SEQ ID NO: 291141 - DNA, 25 bp, Rattus norvegicus
gaaattgtgcgacacatcaaggaga

SEQ ID NO: 291142 - DNA, 25 bp, Rattus norvegicus
gaaattgtgcgagacatcaaggaga

SEQ ID NO: 291143 - DNA, 25 bp, Rattus norvegicus
gaaattgtgctcagccattttcatc

SEQ ID NO: 291144 - DNA, 25 bp, Rattus norvegicus
gaaattgtgctctgccattttcatc

SEQ ID NO: 291145 - DNA, 25 bp, Rattus norvegicus
gaaattgtgtttagcttgacttaag

SEQ ID NO: 291146 - DNA, 25 bp, Rattus norvegicus
gaaattgtgttttgcttgacttaag

SEQ ID NO: 291147 - DNA, 25 bp, Rattus norvegicus
gaaattgttatgccgctcccatcca

SEQ ID NO: 291148 - DNA, 25 bp, Rattus norvegicus
gaaattgttatggcgctcccatcca

SEQ ID NO: 291149 - DNA, 25 bp, Rattus norvegicus
gaaattgtttgtatctctcacaggg

SEQ ID NO: 291150 - DNA, 25 bp, Rattus norvegicus
gaaattgtttgtttctctcacaggg

SEQ ID NO: 291151 - DNA, 25 bp, Rattus norvegicus
gaaatttacacgacctctattcaag

SEQ ID NO: 291152 - DNA, 25 bp, Rattus norvegicus
gaaatttacacgtcctctattcaag

SEQ ID NO: 291153 - DNA, 25 bp, Rattus norvegicus
gaaatttacccaccggttgttctgt

SEQ ID NO: 291154 - DNA, 25 bp, Rattus norvegicus
gaaatttacccagcggttgttctgt

SEQ ID NO: 291155 - DNA, 25 bp, Rattus norvegicus
gaaatttaccctaatgtacttaatg

SEQ ID NO: 291156 - DNA, 25 bp, Rattus norvegicus
gaaatttaccctcttcccatttctg

SEQ ID NO: 291157 - DNA, 25 bp, Rattus norvegicus
gaaatttaccctgttcccatttctg

SEQ ID NO: 291158 - DNA, 25 bp, Rattus norvegicus
gaaatttacccttatgtacttaatg

SEQ ID NO: 291159 - DNA, 25 bp, Rattus norvegicus
gaaatttactcacactttgccctca

SEQ ID NO: 291160 - DNA, 25 bp, Rattus norvegicus
gaaatttactcagactttgccctca

SEQ ID NO: 291161 - DNA, 25 bp, Rattus norvegicus
gaaatttaggtgcaacgtcccctgg

SEQ ID NO: 291162 - DNA, 25 bp, Rattus norvegicus
gaaatttaggtggaacgtcccctgg

SEQ ID NO: 291163 - DNA, 25 bp, Rattus norvegicus
gaaatttatttcaaactcccatggg

SEQ ID NO: 291164 - DNA, 25 bp, Rattus norvegicus
gaaatttatttctaactcccatggg

SEQ ID NO: 291165 - DNA, 25 bp, Rattus norvegicus
gaaatttcaatgatgcagtcgccta

SEQ ID NO: 291166 - DNA, 25 bp, Rattus norvegicus
gaaatttcaatgttgcagtcgccta

SEQ ID NO: 291167 - DNA, 25 bp, Rattus norvegicus
gaaatttcagctacacgtttgtgca

SEQ ID NO: 291168 - DNA, 25 bp, Rattus norvegicus
gaaatttcagcttcacgtttgtgca

SEQ ID NO: 291169 - DNA, 25 bp, Rattus norvegicus
gaaatttcatctagactgcttacag

SEQ ID NO: 291170 - DNA, 25 bp, Rattus norvegicus
gaaatttcatctcccatcaacatat

SEQ ID NO: 291171 - DNA, 25 bp, Rattus norvegicus
gaaatttcatctgccatcaacatat

SEQ ID NO: 291172 - DNA, 25 bp, Rattus norvegicus
gaaatttcatcttgactgcttacag

SEQ ID NO: 291173 - DNA, 25 bp, Rattus norvegicus
gaaatttcccagagccaataatcta

SEQ ID NO: 291174 - DNA, 25 bp, Rattus norvegicus
gaaatttcccagtgccaataatcta

SEQ ID NO: 291175 - DNA, 25 bp, Rattus norvegicus
gaaatttcccctaacgaggcttgag

SEQ ID NO: 291176 - DNA, 25 bp, Rattus norvegicus
gaaatttccccttacgaggcttgag

SEQ ID NO: 291177 - DNA, 25 bp, Rattus norvegicus
gaaatttcgccaaggacttctcaag

SEQ ID NO: 291178 - DNA, 25 bp, Rattus norvegicus
gaaatttcgccatggacttctcaag

SEQ ID NO: 291179 - DNA, 25 bp, Rattus norvegicus
gaaatttcgggcaactaagaactgt

SEQ ID NO: 291180 - DNA, 25 bp, Rattus norvegicus
gaaatttcgggctactaagaactgt

SEQ ID NO: 291181 - DNA, 25 bp, Rattus norvegicus
gaaatttcgtcacctttctttctgg

SEQ ID NO: 291182 - DNA, 25 bp, Rattus norvegicus
gaaatttcgtcagctttctttctgg

SEQ ID NO: 291183 - DNA, 25 bp, Rattus norvegicus
gaaatttctattaacaactgtccta

SEQ ID NO: 291184 - DNA, 25 bp, Rattus norvegicus
gaaatttctatttacaactgtccta

SEQ ID NO: 291185 - DNA, 25 bp, Rattus norvegicus
gaaatttctcaaagctaacactctg

SEQ ID NO: 291186 - DNA, 25 bp, Rattus norvegicus
gaaatttctcaatgctaacactctg

SEQ ID NO: 291187 - DNA, 25 bp, Rattus norvegicus
gaaatttctcacacagaatgtcact

SEQ ID NO: 291188 - DNA, 25 bp, Rattus norvegicus
gaaatttctcactcagaatgtcact

SEQ ID NO: 291189 - DNA, 25 bp, Rattus norvegicus
gaaatttctcccatttgtgttcatt

SEQ ID NO: 291190 - DNA, 25 bp, Rattus norvegicus
gaaatttctcccttttgtgttcatt

SEQ ID NO: 291191 - DNA, 25 bp, Rattus norvegicus
gaaatttctcttccagtgacttact

SEQ ID NO: 291192 - DNA, 25 bp, Rattus norvegicus
gaaatttctcttgcagtgacttact

SEQ ID NO: 291193 - DNA, 25 bp, Rattus norvegicus
gaaatttctggaatctggagacact

SEQ ID NO: 291194 - DNA, 25 bp, Rattus norvegicus
gaaatttctggattctggagacact

SEQ ID NO: 291195 - DNA, 25 bp, Rattus norvegicus
gaaatttcttaaccttcttctccct

SEQ ID NO: 291196 - DNA, 25 bp, Rattus norvegicus
gaaatttcttaagcttcttctccct

SEQ ID NO: 291197 - DNA, 25 bp, Rattus norvegicus
gaaatttcttgaaaggtccttgctg

SEQ ID NO: 291198 - DNA, 25 bp, Rattus norvegicus
gaaatttcttgataggtccttgctg

SEQ ID NO: 291199 - DNA, 25 bp, Rattus norvegicus
gaaatttgacatcggttgcgcggtt

SEQ ID NO: 291200 - DNA, 25 bp, Rattus norvegicus
gaaatttgacatgggttgcgcggtt

SEQ ID NO: 291201 - DNA, 25 bp, Rattus norvegicus
gaaatttgagtcacacaccgggaga

SEQ ID NO: 291202 - DNA, 25 bp, Rattus norvegicus
gaaatttgagtctcacaccgggaga

SEQ ID NO: 291203 - DNA, 25 bp, Rattus norvegicus
gaaatttgattccacttttgctcat

SEQ ID NO: 291204 - DNA, 25 bp, Rattus norvegicus
gaaatttgattcgacttttgctcat

SEQ ID NO: 291205 - DNA, 25 bp, Rattus norvegicus
gaaatttgatttctattttccacaa

SEQ ID NO: 291206 - DNA, 25 bp, Rattus norvegicus
gaaatttgatttgtattttccacaa

SEQ ID NO: 291207 - DNA, 25 bp, Rattus norvegicus
gaaatttgcaacatctctagttaga

SEQ ID NO: 291208 - DNA, 25 bp, Rattus norvegicus
gaaatttgcaacttctctagttaga

SEQ ID NO: 291209 - DNA, 25 bp, Rattus norvegicus
gaaatttgcaagctgcaaccccacc

SEQ ID NO: 291210 - DNA, 25 bp, Rattus norvegicus
gaaatttgcaaggtgcaaccccacc

SEQ ID NO: 291211 - DNA, 25 bp, Rattus norvegicus
gaaatttgcacaacactgcctgcag

SEQ ID NO: 291212 - DNA, 25 bp, Rattus norvegicus
gaaatttgcacacttgtctttcaaa

SEQ ID NO: 291213 - DNA, 25 bp, Rattus norvegicus
gaaatttgcacagttgtctttcaaa

SEQ ID NO: 291214 - DNA, 25 bp, Rattus norvegicus
gaaatttgcacatcactgcctgcag

SEQ ID NO: 291215 - DNA, 25 bp, Rattus norvegicus
gaaatttgccaacgtgcttgtaaac

SEQ ID NO: 291216 - DNA, 25 bp, Rattus norvegicus
gaaatttgccaaggtgcttgtaaac

SEQ ID NO: 291217 - DNA, 25 bp, Rattus norvegicus
gaaatttgccctaactaccgagtca

SEQ ID NO: 291218 - DNA, 25 bp, Rattus norvegicus
gaaatttgccctaatgttttatgga

SEQ ID NO: 291219 - DNA, 25 bp, Rattus norvegicus
gaaatttgccctctacttcttagac

SEQ ID NO: 291220 - DNA, 25 bp, Rattus norvegicus
gaaatttgccctgtacttcttagac

SEQ ID NO: 291221 - DNA, 25 bp, Rattus norvegicus
gaaatttgcccttactaccgagtca

SEQ ID NO: 291222 - DNA, 25 bp, Rattus norvegicus
gaaatttgcccttatgttttatgga

SEQ ID NO: 291223 - DNA, 25 bp, Rattus norvegicus
gaaatttgctatccctggtctcagt

SEQ ID NO: 291224 - DNA, 25 bp, Rattus norvegicus
gaaatttgctatgcctggtctcagt

SEQ ID NO: 291225 - DNA, 25 bp, Rattus norvegicus
gaaatttgcttgactctgtgtgcag

SEQ ID NO: 291226 - DNA, 25 bp, Rattus norvegicus
gaaatttgcttgtctctgtgtgcag

SEQ ID NO: 291227 - DNA, 25 bp, Rattus norvegicus
gaaatttggacgcaaaagcagggct

SEQ ID NO: 291228 - DNA, 25 bp, Rattus norvegicus
gaaatttggacggaaaagcagggct

SEQ ID NO: 291229 - DNA, 25 bp, Rattus norvegicus
gaaatttggcttcttgtgtggcaca

SEQ ID NO: 291230 - DNA, 25 bp, Rattus norvegicus
gaaatttggcttgttgtgtggcaca

SEQ ID NO: 291231 - DNA, 25 bp, Rattus norvegicus
gaaatttggttcattacatcattat

SEQ ID NO: 291232 - DNA, 25 bp, Rattus norvegicus
gaaatttggttctttacatcattat

SEQ ID NO: 291233 - DNA, 25 bp, Rattus norvegicus
gaaatttgtccgcttatttccaagt

SEQ ID NO: 291234 - DNA, 25 bp, Rattus norvegicus
gaaatttgtccggttatttccaagt

SEQ ID NO: 291235 - DNA, 25 bp, Rattus norvegicus
gaaatttgtcctcttaaccacgtgc

SEQ ID NO: 291236 - DNA, 25 bp, Rattus norvegicus
gaaatttgtcctgttaaccacgtgc

SEQ ID NO: 291237 - DNA, 25 bp, Rattus norvegicus
gaaatttgtgctaccttgttgaaca

SEQ ID NO: 291238 - DNA, 25 bp, Rattus norvegicus
gaaatttgtgcttccttgttgaaca

SEQ ID NO: 291239 - DNA, 25 bp, Rattus norvegicus
gaaattttagtaccagccagccatg

SEQ ID NO: 291240 - DNA, 25 bp, Rattus norvegicus
gaaattttagtagcagccagccatg

SEQ ID NO: 291241 - DNA, 25 bp, Rattus norvegicus
gaaattttcacacctttctaattca

SEQ ID NO: 291242 - DNA, 25 bp, Rattus norvegicus
gaaattttcacagctttctaattca

SEQ ID NO: 291243 - DNA, 25 bp, Rattus norvegicus
gaaattttccaacgcaagcaactct

SEQ ID NO: 291244 - DNA, 25 bp, Rattus norvegicus
gaaattttccaaggcaagcaactct

SEQ ID NO: 291245 - DNA, 25 bp, Rattus norvegicus
gaaattttccataaccgcgaagctt

SEQ ID NO: 291246 - DNA, 25 bp, Rattus norvegicus
gaaattttccattaccgcgaagctt

SEQ ID NO: 291247 - DNA, 25 bp, Rattus norvegicus
gaaattttcgttctttgtacattgt

SEQ ID NO: 291248 - DNA, 25 bp, Rattus norvegicus
gaaattttcgttgtttgtacattgt

SEQ ID NO: 291249 - DNA, 25 bp, Rattus norvegicus
gaaattttctccaagtttgcttccg

SEQ ID NO: 291250 - DNA, 25 bp, Rattus norvegicus
gaaattttctcctagtttgcttccg

SEQ ID NO: 291251 - DNA, 25 bp, Rattus norvegicus
gaaattttgaaaacgaagagcactt

SEQ ID NO: 291252 - DNA, 25 bp, Rattus norvegicus
gaaattttgaaatcgaagagcactt

SEQ ID NO: 291253 - DNA, 25 bp, Rattus norvegicus
gaaattttgacccttgatccataac

SEQ ID NO: 291254 - DNA, 25 bp, Rattus norvegicus
gaaattttgaccgttgatccataac

SEQ ID NO: 291255 - DNA, 25 bp, Rattus norvegicus
gaaattttgtatctgagcccactga

SEQ ID NO: 291256 - DNA, 25 bp, Rattus norvegicus
gaaattttgtatgtgagcccactga

SEQ ID NO: 291257 - DNA, 25 bp, Rattus norvegicus
gaaattttgtggaatggcatatcta

SEQ ID NO: 291258 - DNA, 25 bp, Rattus norvegicus
gaaattttgtggtatggcatatcta

SEQ ID NO: 291259 - DNA, 25 bp, Rattus norvegicus
gaaatttttctcatgtgctgagtat

SEQ ID NO: 291260 - DNA, 25 bp, Rattus norvegicus
gaaatttttctcttgtgctgagtat

SEQ ID NO: 291261 - DNA, 25 bp, Rattus norvegicus
gaacaaaacaggctaccaacatgga

SEQ ID NO: 291262 - DNA, 25 bp, Rattus norvegicus
gaacaaaacagggtaccaacatgga

SEQ ID NO: 291263 - DNA, 25 bp, Rattus norvegicus
gaacaaaaccgtacagtcacctgtg

SEQ ID NO: 291264 - DNA, 25 bp, Rattus norvegicus
gaacaaaaccgttcagtcacctgtg

SEQ ID NO: 291265 - DNA, 25 bp, Rattus norvegicus
gaacaaaaggtgctccagttcccac

SEQ ID NO: 291266 - DNA, 25 bp, Rattus norvegicus
gaacaaaaggtggtccagttcccac

SEQ ID NO: 291267 - DNA, 25 bp, Rattus norvegicus
gaacaaacacacagatcacgatatg

SEQ ID NO: 291268 - DNA, 25 bp, Rattus norvegicus
gaacaaacacactgatcacgatatg

SEQ ID NO: 291269 - DNA, 25 bp, Rattus norvegicus
gaacaaacacctcgtcacctggagg

SEQ ID NO: 291270 - DNA, 25 bp, Rattus norvegicus
gaacaaacacctggtcacctggagg

SEQ ID NO: 291271 - DNA, 25 bp, Rattus norvegicus
gaacaaacagcacgcccgagtgcac

SEQ ID NO: 291272 - DNA, 25 bp, Rattus norvegicus
gaacaaacagcaggcccgagtgcac

SEQ ID NO: 291273 - DNA, 25 bp, Rattus norvegicus
gaacaaacagccactgactggctag

SEQ ID NO: 291274 - DNA, 25 bp, Rattus norvegicus
gaacaaacagcctctgactggctag

SEQ ID NO: 291275 - DNA, 25 bp, Rattus norvegicus
gaacaaaccccaaaagatcatgtat

SEQ ID NO: 291276 - DNA, 25 bp, Rattus norvegicus
gaacaaaccccataagatcatgtat

SEQ ID NO: 291277 - DNA, 25 bp, Rattus norvegicus
gaacaaaccctcatttgcaacccag

SEQ ID NO: 291278 - DNA, 25 bp, Rattus norvegicus
gaacaaaccctcttttgcaacccag

SEQ ID NO: 291279 - DNA, 25 bp, Rattus norvegicus
gaacaaaccgacacaagcacagcta

SEQ ID NO: 291280 - DNA, 25 bp, Rattus norvegicus
gaacaaaccgactcaagcacagcta

SEQ ID NO: 291281 - DNA, 25 bp, Rattus norvegicus
gaacaaacctgtaatctaccaccat

SEQ ID NO: 291282 - DNA, 25 bp, Rattus norvegicus
gaacaaacctgtcccgttggtatga

SEQ ID NO: 291283 - DNA, 25 bp, Rattus norvegicus
gaacaaacctgtgccgttggtatga

SEQ ID NO: 291284 - DNA, 25 bp, Rattus norvegicus
gaacaaacctgttatctaccaccat

SEQ ID NO: 291285 - DNA, 25 bp, Rattus norvegicus
gaacaaactcatatactgcgcgcaa

SEQ ID NO: 291286 - DNA, 25 bp, Rattus norvegicus
gaacaaactcatttactgcgcgcaa

SEQ ID NO: 291287 - DNA, 25 bp, Rattus norvegicus
gaacaaactgctaacactgtgaggc

SEQ ID NO: 291288 - DNA, 25 bp, Rattus norvegicus
gaacaaactgcttacactgtgaggc

SEQ ID NO: 291289 - DNA, 25 bp, Rattus norvegicus
gaacaaactggtatcacaaagtggg

SEQ ID NO: 291290 - DNA, 25 bp, Rattus norvegicus
gaacaaactggtttcacaaagtggg

SEQ ID NO: 291291 - DNA, 25 bp, Rattus norvegicus
gaacaaacttcaatcatcctgtcac

SEQ ID NO: 291292 - DNA, 25 bp, Rattus norvegicus
gaacaaacttcattcatcctgtcac

SEQ ID NO: 291293 - DNA, 25 bp, Rattus norvegicus
gaacaaagccatcccttctaatagt

SEQ ID NO: 291294 - DNA, 25 bp, Rattus norvegicus
gaacaaagccatgccttctaatagt

SEQ ID NO: 291295 - DNA, 25 bp, Rattus norvegicus
gaacaaaggctcactcatgcagtag

SEQ ID NO: 291296 - DNA, 25 bp, Rattus norvegicus
gaacaaaggctctctcatgcagtag

SEQ ID NO: 291297 - DNA, 25 bp, Rattus norvegicus
gaacaaagtgtcagctctgatcatt

SEQ ID NO: 291298 - DNA, 25 bp, Rattus norvegicus
gaacaaagtgtctgctctgatcatt

SEQ ID NO: 291299 - DNA, 25 bp, Rattus norvegicus
gaacaaataggaaactgctgctgga

SEQ ID NO: 291300 - DNA, 25 bp, Rattus norvegicus
gaacaaataggatactgctgctgga

SEQ ID NO: 291301 - DNA, 25 bp, Rattus norvegicus
gaacaaatcagtcactcaaccaagg

SEQ ID NO: 291302 - DNA, 25 bp, Rattus norvegicus
gaacaaatcagtgactcaaccaagg

SEQ ID NO: 291303 - DNA, 25 bp, Rattus norvegicus
gaacaaatccggaagctgctaccag

SEQ ID NO: 291304 - DNA, 25 bp, Rattus norvegicus
gaacaaatccggtagctgctaccag

SEQ ID NO: 291305 - DNA, 25 bp, Rattus norvegicus
gaacaaatgcataagtccactcaga

SEQ ID NO: 291306 - DNA, 25 bp, Rattus norvegicus
gaacaaatgcattagtccactcaga

SEQ ID NO: 291307 - DNA, 25 bp, Rattus norvegicus
gaacaaatgtccagcttctttaaag

SEQ ID NO: 291308 - DNA, 25 bp, Rattus norvegicus
gaacaaatgtcctgcttctttaaag

SEQ ID NO: 291309 - DNA, 25 bp, Rattus norvegicus
gaacaaatgttgacctcgggacttt

SEQ ID NO: 291310 - DNA, 25 bp, Rattus norvegicus
gaacaaatgttgtcctcgggacttt

SEQ ID NO: 291311 - DNA, 25 bp, Rattus norvegicus
gaacaaattcccagaagtccgctct

SEQ ID NO: 291312 - DNA, 25 bp, Rattus norvegicus
gaacaaattccctgaagtccgctct

SEQ ID NO: 291313 - DNA, 25 bp, Rattus norvegicus
gaacaaattcgaagccaactcagaa

SEQ ID NO: 291314 - DNA, 25 bp, Rattus norvegicus
gaacaaattcgatgccaactcagaa

SEQ ID NO: 291315 - DNA, 25 bp, Rattus norvegicus
gaacaacaacagcaaaccaagccaa

SEQ ID NO: 291316 - DNA, 25 bp, Rattus norvegicus
gaacaacaacaggaaaccaagccaa

SEQ ID NO: 291317 - DNA, 25 bp, Rattus norvegicus
gaacaacaaggaaaaacttcctggg

SEQ ID NO: 291318 - DNA, 25 bp, Rattus norvegicus
gaacaacaaggataaacttcctggg

SEQ ID NO: 291319 - DNA, 25 bp, Rattus norvegicus
gaacaacagactaccactgagcgat

SEQ ID NO: 291320 - DNA, 25 bp, Rattus norvegicus
gaacaacagacttccactgagcgat

SEQ ID NO: 291321 - DNA, 25 bp, Rattus norvegicus
gaacaacagcctacgatttgcgcag

SEQ ID NO: 291322 - DNA, 25 bp, Rattus norvegicus
gaacaacagccttcgatttgcgcag

SEQ ID NO: 291323 - DNA, 25 bp, Rattus norvegicus
gaacaacagcttacttattcaatgc

SEQ ID NO: 291324 - DNA, 25 bp, Rattus norvegicus
gaacaacagctttcttattcaatgc

SEQ ID NO: 291325 - DNA, 25 bp, Rattus norvegicus
gaacaacagtcaaagtcccaggcaa

SEQ ID NO: 291326 - DNA, 25 bp, Rattus norvegicus
gaacaacagtcatagtcccaggcaa

SEQ ID NO: 291327 - DNA, 25 bp, Rattus norvegicus
gaacaacagtctaggtttttaatga

SEQ ID NO: 291328 - DNA, 25 bp, Rattus norvegicus
gaacaacagtcttggtttttaatga

SEQ ID NO: 291329 - DNA, 25 bp, Rattus norvegicus
gaacaacataaaccagcctcttcat

SEQ ID NO: 291330 - DNA, 25 bp, Rattus norvegicus
gaacaacataaagcagcctcttcat

SEQ ID NO: 291331 - DNA, 25 bp, Rattus norvegicus
gaacaacatagcactttggaccctc

SEQ ID NO: 291332 - DNA, 25 bp, Rattus norvegicus
gaacaacatagctctttggaccctc

SEQ ID NO: 291333 - DNA, 25 bp, Rattus norvegicus
gaacaacattccagctgacatcgtc

SEQ ID NO: 291334 - DNA, 25 bp, Rattus norvegicus
gaacaacattcctgctgacatcgtc

SEQ ID NO: 291335 - DNA, 25 bp, Rattus norvegicus
gaacaacattgacttcccttagctc

SEQ ID NO: 291336 - DNA, 25 bp, Rattus norvegicus
gaacaacattgagttcccttagctc

SEQ ID NO: 291337 - DNA, 25 bp, Rattus norvegicus
gaacaacatttcaatgcctcaaggg

SEQ ID NO: 291338 - DNA, 25 bp, Rattus norvegicus
gaacaacatttctatgcctcaaggg

SEQ ID NO: 291339 - DNA, 25 bp, Rattus norvegicus
gaacaaccaccacgaatgatgccaa

SEQ ID NO: 291340 - DNA, 25 bp, Rattus norvegicus
gaacaaccaccaggaatgatgccaa

SEQ ID NO: 291341 - DNA, 25 bp, Rattus norvegicus
gaacaaccagcccatgcaggtcatg

SEQ ID NO: 291342 - DNA, 25 bp, Rattus norvegicus
gaacaaccagccgatgcaggtcatg

SEQ ID NO: 291343 - DNA, 25 bp, Rattus norvegicus
gaacaaccaggcaacaggaggactt

SEQ ID NO: 291344 - DNA, 25 bp, Rattus norvegicus
gaacaaccaggctacaggaggactt

SEQ ID NO: 291345 - DNA, 25 bp, Rattus norvegicus
gaacaaccagttcccagtgtaatca

SEQ ID NO: 291346 - DNA, 25 bp, Rattus norvegicus
gaacaaccagttgccagtgtaatca

SEQ ID NO: 291347 - DNA, 25 bp, Rattus norvegicus
gaacaaccatgcatcttaaaccttt

SEQ ID NO: 291348 - DNA, 25 bp, Rattus norvegicus
gaacaaccatgcttcttaaaccttt

SEQ ID NO: 291349 - DNA, 25 bp, Rattus norvegicus
gaacaaccctcacagaactggccaa

SEQ ID NO: 291350 - DNA, 25 bp, Rattus norvegicus
gaacaaccctcagagaactggccaa

SEQ ID NO: 291351 - DNA, 25 bp, Rattus norvegicus
gaacaaccgaagcagggctcttttt

SEQ ID NO: 291352 - DNA, 25 bp, Rattus norvegicus
gaacaaccgaaggagggctcttttt

SEQ ID NO: 291353 - DNA, 25 bp, Rattus norvegicus
gaacaacctatgaaggccaggctgt

SEQ ID NO: 291354 - DNA, 25 bp, Rattus norvegicus
gaacaacctatgtaggccaggctgt

SEQ ID NO: 291355 - DNA, 25 bp, Rattus norvegicus
gaacaacctctgctgtttgtcctta

SEQ ID NO: 291356 - DNA, 25 bp, Rattus norvegicus
gaacaacctctggtgtttgtcctta

SEQ ID NO: 291357 - DNA, 25 bp, Rattus norvegicus
gaacaacctttcacatagtcacctg

SEQ ID NO: 291358 - DNA, 25 bp, Rattus norvegicus
gaacaacctttctcatagtcacctg

SEQ ID NO: 291359 - DNA, 25 bp, Rattus norvegicus
gaacaacgatggctcgactcagaat

SEQ ID NO: 291360 - DNA, 25 bp, Rattus norvegicus
gaacaacgatgggtcgactcagaat

SEQ ID NO: 291361 - DNA, 25 bp, Rattus norvegicus
gaacaacgatttcaaggcagaagta

SEQ ID NO: 291362 - DNA, 25 bp, Rattus norvegicus
gaacaacgatttgaaggcagaagta

SEQ ID NO: 291363 - DNA, 25 bp, Rattus norvegicus
gaacaacgcttcatcggtgaagttc

SEQ ID NO: 291364 - DNA, 25 bp, Rattus norvegicus
gaacaacgcttcttcggtgaagttc

SEQ ID NO: 291365 - DNA, 25 bp, Rattus norvegicus
gaacaacgggagactgccttccctt

SEQ ID NO: 291366 - DNA, 25 bp, Rattus norvegicus
gaacaacgggagtctgccttccctt

SEQ ID NO: 291367 - DNA, 25 bp, Rattus norvegicus
gaacaacggtccaatccaagcttat

SEQ ID NO: 291368 - DNA, 25 bp, Rattus norvegicus
gaacaacggtcctatccaagcttat

SEQ ID NO: 291369 - DNA, 25 bp, Rattus norvegicus
gaacaacgtgacaccagacatgatg

SEQ ID NO: 291370 - DNA, 25 bp, Rattus norvegicus
gaacaacgtgactccagacatgatg

SEQ ID NO: 291371 - DNA, 25 bp, Rattus norvegicus
gaacaacgttgcacatcctaatcat

SEQ ID NO: 291372 - DNA, 25 bp, Rattus norvegicus
gaacaacgttgctcatcctaatcat

SEQ ID NO: 291373 - DNA, 25 bp, Rattus norvegicus
gaacaactaattcaatttccgactt

SEQ ID NO: 291374 - DNA, 25 bp, Rattus norvegicus
gaacaactaattgaatttccgactt

SEQ ID NO: 291375 - DNA, 25 bp, Rattus norvegicus
gaacaactagtcattaatgtatcaa

SEQ ID NO: 291376 - DNA, 25 bp, Rattus norvegicus
gaacaactagtctttaatgtatcaa

SEQ ID NO: 291377 - DNA, 25 bp, Rattus norvegicus
gaacaactagttctccgcatcgttt

SEQ ID NO: 291378 - DNA, 25 bp, Rattus norvegicus
gaacaactagttgtccgcatcgttt

SEQ ID NO: 291379 - DNA, 25 bp, Rattus norvegicus
gaacaactatgtcccactatggctg

SEQ ID NO: 291380 - DNA, 25 bp, Rattus norvegicus
gaacaactatgtgccactatggctg

SEQ ID NO: 291381 - DNA, 25 bp, Rattus norvegicus
gaacaactcaacaacccttgaattt

SEQ ID NO: 291382 - DNA, 25 bp, Rattus norvegicus
gaacaactcaactacccttgaattt

SEQ ID NO: 291383 - DNA, 25 bp, Rattus norvegicus
gaacaactcagcaacagagggaagt

SEQ ID NO: 291384 - DNA, 25 bp, Rattus norvegicus
gaacaactcagctacagagggaagt

SEQ ID NO: 291385 - DNA, 25 bp, Rattus norvegicus
gaacaactccagataagtcccactt

SEQ ID NO: 291386 - DNA, 25 bp, Rattus norvegicus
gaacaactccagttaagtcccactt

SEQ ID NO: 291387 - DNA, 25 bp, Rattus norvegicus
gaacaactctctactgaagcactgg

SEQ ID NO: 291388 - DNA, 25 bp, Rattus norvegicus
gaacaactctctacttaccttactt

SEQ ID NO: 291389 - DNA, 25 bp, Rattus norvegicus
gaacaactctcttctgaagcactgg

SEQ ID NO: 291390 - DNA, 25 bp, Rattus norvegicus
gaacaactctcttcttaccttactt

SEQ ID NO: 291391 - DNA, 25 bp, Rattus norvegicus
gaacaactctgtcgattcccaggtc

SEQ ID NO: 291392 - DNA, 25 bp, Rattus norvegicus
gaacaactctgtggattcccaggtc

SEQ ID NO: 291393 - DNA, 25 bp, Rattus norvegicus
gaacaactcttcctgaagattttgg

SEQ ID NO: 291394 - DNA, 25 bp, Rattus norvegicus
gaacaactcttcgtgaagattttgg

SEQ ID NO: 291395 - DNA, 25 bp, Rattus norvegicus
gaacaactctttctcaggagtcaca

SEQ ID NO: 291396 - DNA, 25 bp, Rattus norvegicus
gaacaactctttgtcaggagtcaca

SEQ ID NO: 291397 - DNA, 25 bp, Rattus norvegicus
gaacaactgactcacataagccaaa

SEQ ID NO: 291398 - DNA, 25 bp, Rattus norvegicus
gaacaactgactgacataagccaaa

SEQ ID NO: 291399 - DNA, 25 bp, Rattus norvegicus
gaacaactggccaatctggacaaga

SEQ ID NO: 291400 - DNA, 25 bp, Rattus norvegicus
gaacaactggcctatctggacaaga

SEQ ID NO: 291401 - DNA, 25 bp, Rattus norvegicus
gaacaactggctcaagctctctcaa

SEQ ID NO: 291402 - DNA, 25 bp, Rattus norvegicus
gaacaactggctgaagctctctcaa

SEQ ID NO: 291403 - DNA, 25 bp, Rattus norvegicus
gaacaactgggcaatcatgtggacc

SEQ ID NO: 291404 - DNA, 25 bp, Rattus norvegicus
gaacaactgggctatcatgtggacc

SEQ ID NO: 291405 - DNA, 25 bp, Rattus norvegicus
gaacaactgggtaactgtcccatct

SEQ ID NO: 291406 - DNA, 25 bp, Rattus norvegicus
gaacaactgggttactgtcccatct

SEQ ID NO: 291407 - DNA, 25 bp, Rattus norvegicus
gaacaactgtggacattttcccttg

SEQ ID NO: 291408 - DNA, 25 bp, Rattus norvegicus
gaacaactgtggtcattttcccttg

SEQ ID NO: 291409 - DNA, 25 bp, Rattus norvegicus
gaacaacttaatatccatcatttga

SEQ ID NO: 291410 - DNA, 25 bp, Rattus norvegicus
gaacaacttaatttccatcatttga

SEQ ID NO: 291411 - DNA, 25 bp, Rattus norvegicus
gaacaacttagcagtgggcgacact

SEQ ID NO: 291412 - DNA, 25 bp, Rattus norvegicus
gaacaacttagctgtgggcgacact

SEQ ID NO: 291413 - DNA, 25 bp, Rattus norvegicus
gaacaacttaggagtcccactgtga

SEQ ID NO: 291414 - DNA, 25 bp, Rattus norvegicus
gaacaacttaggtgtcccactgtga

SEQ ID NO: 291415 - DNA, 25 bp, Rattus norvegicus
gaacaacttcaaccacgtcgtcacg

SEQ ID NO: 291416 - DNA, 25 bp, Rattus norvegicus
gaacaacttcaagcacgtcgtcacg

SEQ ID NO: 291417 - DNA, 25 bp, Rattus norvegicus
gaacaacttctaacccagagacatc

SEQ ID NO: 291418 - DNA, 25 bp, Rattus norvegicus
gaacaacttctatcccagagacatc

SEQ ID NO: 291419 - DNA, 25 bp, Rattus norvegicus
gaacaacttgatctttcacagaaga

SEQ ID NO: 291420 - DNA, 25 bp, Rattus norvegicus
gaacaacttgatgtttcacagaaga

SEQ ID NO: 291421 - DNA, 25 bp, Rattus norvegicus
gaacaactttataagtcagcttatt

SEQ ID NO: 291422 - DNA, 25 bp, Rattus norvegicus
gaacaactttattagtcagcttatt

SEQ ID NO: 291423 - DNA, 25 bp, Rattus norvegicus
gaacaacttttgacctgcagggaca

SEQ ID NO: 291424 - DNA, 25 bp, Rattus norvegicus
gaacaacttttgtcctgcagggaca

SEQ ID NO: 291425 - DNA, 25 bp, Rattus norvegicus
gaacaagaaccactccatctctttc

SEQ ID NO: 291426 - DNA, 25 bp, Rattus norvegicus
gaacaagaaccagtccatctctttc

SEQ ID NO: 291427 - DNA, 25 bp, Rattus norvegicus
gaacaagaacctctgagctctctgt

SEQ ID NO: 291428 - DNA, 25 bp, Rattus norvegicus
gaacaagaacctgtgagctctctgt

SEQ ID NO: 291429 - DNA, 25 bp, Rattus norvegicus
gaacaagaacttcagttaatggcct

SEQ ID NO: 291430 - DNA, 25 bp, Rattus norvegicus
gaacaagaacttgagttaatggcct

SEQ ID NO: 291431 - DNA, 25 bp, Rattus norvegicus
gaacaagaccctacgctatggagtt

SEQ ID NO: 291432 - DNA, 25 bp, Rattus norvegicus
gaacaagacccttcgctatggagtt

SEQ ID NO: 291433 - DNA, 25 bp, Rattus norvegicus
gaacaagactgccagccatgtcagc

SEQ ID NO: 291434 - DNA, 25 bp, Rattus norvegicus
gaacaagactgcgagccatgtcagc

SEQ ID NO: 291435 - DNA, 25 bp, Rattus norvegicus
gaacaagagcgacgacttcaccaac

SEQ ID NO: 291436 - DNA, 25 bp, Rattus norvegicus
gaacaagagcgaggacttcaccaac

SEQ ID NO: 291437 - DNA, 25 bp, Rattus norvegicus
gaacaagagctgacatctaagcaag

SEQ ID NO: 291438 - DNA, 25 bp, Rattus norvegicus
gaacaagagctgtcatctaagcaag

SEQ ID NO: 291439 - DNA, 25 bp, Rattus norvegicus
gaacaagatcatccagcgagctgag

SEQ ID NO: 291440 - DNA, 25 bp, Rattus norvegicus
gaacaagatcatgcagcgagctgag

SEQ ID NO: 291441 - DNA, 25 bp, Rattus norvegicus
gaacaagattccagagctacagcct

SEQ ID NO: 291442 - DNA, 25 bp, Rattus norvegicus
gaacaagattcctgagctacagcct

SEQ ID NO: 291443 - DNA, 25 bp, Rattus norvegicus
gaacaagcacccctttgccctttat

SEQ ID NO: 291444 - DNA, 25 bp, Rattus norvegicus
gaacaagcacccgtttgccctttat

SEQ ID NO: 291445 - DNA, 25 bp, Rattus norvegicus
gaacaagcacgtattccttactgat

SEQ ID NO: 291446 - DNA, 25 bp, Rattus norvegicus
gaacaagcacgttttccttactgat

SEQ ID NO: 291447 - DNA, 25 bp, Rattus norvegicus
gaacaagcagcaatccatcactaaa

SEQ ID NO: 291448 - DNA, 25 bp, Rattus norvegicus
gaacaagcagcattccatcactaaa

SEQ ID NO: 291449 - DNA, 25 bp, Rattus norvegicus
gaacaagccaccctacacggaatag

SEQ ID NO: 291450 - DNA, 25 bp, Rattus norvegicus
gaacaagccaccgtacacggaatag

SEQ ID NO: 291451 - DNA, 25 bp, Rattus norvegicus
gaacaagcccagaaagtccctccgg

SEQ ID NO: 291452 - DNA, 25 bp, Rattus norvegicus
gaacaagcccagtaagtccctccgg

SEQ ID NO: 291453 - DNA, 25 bp, Rattus norvegicus
gaacaagccctactcagtacgcgtg

SEQ ID NO: 291454 - DNA, 25 bp, Rattus norvegicus
gaacaagccctagtcagtacgcgtg

SEQ ID NO: 291455 - DNA, 25 bp, Rattus norvegicus
gaacaagcccttcgtgtggagtctg

SEQ ID NO: 291456 - DNA, 25 bp, Rattus norvegicus
gaacaagcccttggtgtggagtctg

SEQ ID NO: 291457 - DNA, 25 bp, Rattus norvegicus
gaacaagcctacacatggagacaaa

SEQ ID NO: 291458 - DNA, 25 bp, Rattus norvegicus
gaacaagcctactcatggagacaaa

SEQ ID NO: 291459 - DNA, 25 bp, Rattus norvegicus
gaacaagcctcaactgcattctgat

SEQ ID NO: 291460 - DNA, 25 bp, Rattus norvegicus
gaacaagcctcatctgcattctgat

SEQ ID NO: 291461 - DNA, 25 bp, Rattus norvegicus
gaacaagcgcccctgttaatttgaa

SEQ ID NO: 291462 - DNA, 25 bp, Rattus norvegicus
gaacaagcgcccgtgttaatttgaa

SEQ ID NO: 291463 - DNA, 25 bp, Rattus norvegicus
gaacaagctgagactgtggcccaca

SEQ ID NO: 291464 - DNA, 25 bp, Rattus norvegicus
gaacaagctgagtctgtggcccaca

SEQ ID NO: 291465 - DNA, 25 bp, Rattus norvegicus
gaacaagctgcccaagacctggtgc

SEQ ID NO: 291466 - DNA, 25 bp, Rattus norvegicus
gaacaagctgccgaagacctggtgc

SEQ ID NO: 291467 - DNA, 25 bp, Rattus norvegicus
gaacaagctgttatctcacattctt

SEQ ID NO: 291468 - DNA, 25 bp, Rattus norvegicus
gaacaagctgttttctcacattctt

SEQ ID NO: 291469 - DNA, 25 bp, Rattus norvegicus
gaacaagcttcaaagtcgtagaaac

SEQ ID NO: 291470 - DNA, 25 bp, Rattus norvegicus
gaacaagcttcatagtcgtagaaac

SEQ ID NO: 291471 - DNA, 25 bp, Rattus norvegicus
gaacaagcttccagggatgcccaga

SEQ ID NO: 291472 - DNA, 25 bp, Rattus norvegicus
gaacaagcttcctgggatgcccaga

SEQ ID NO: 291473 - DNA, 25 bp, Rattus norvegicus
gaacaagcttcgaggtcagtttgct

SEQ ID NO: 291474 - DNA, 25 bp, Rattus norvegicus
gaacaagcttcgtggtcagtttgct

SEQ ID NO: 291475 - DNA, 25 bp, Rattus norvegicus
gaacaagcttctacctgggcggtgt

SEQ ID NO: 291476 - DNA, 25 bp, Rattus norvegicus
gaacaagcttcttcctgggcggtgt

SEQ ID NO: 291477 - DNA, 25 bp, Rattus norvegicus
gaacaagctttaattagcctcctga

SEQ ID NO: 291478 - DNA, 25 bp, Rattus norvegicus
gaacaagctttatttagcctcctga

SEQ ID NO: 291479 - DNA, 25 bp, Rattus norvegicus
gaacaaggaaaaaacctcttctagg

SEQ ID NO: 291480 - DNA, 25 bp, Rattus norvegicus
gaacaaggaaaatacctcttctagg

SEQ ID NO: 291481 - DNA, 25 bp, Rattus norvegicus
gaacaaggacatagccccaagatgg

SEQ ID NO: 291482 - DNA, 25 bp, Rattus norvegicus
gaacaaggacattgccccaagatgg

SEQ ID NO: 291483 - DNA, 25 bp, Rattus norvegicus
gaacaaggaccgatggaacatggaa

SEQ ID NO: 291484 - DNA, 25 bp, Rattus norvegicus
gaacaaggaccgttggaacatggaa

SEQ ID NO: 291485 - DNA, 25 bp, Rattus norvegicus
gaacaaggcagcacagggtatccca

SEQ ID NO: 291486 - DNA, 25 bp, Rattus norvegicus
gaacaaggcagctcagggtatccca

SEQ ID NO: 291487 - DNA, 25 bp, Rattus norvegicus
gaacaaggcagtcagtcacagggaa

SEQ ID NO: 291488 - DNA, 25 bp, Rattus norvegicus
gaacaaggcagtgagtcacagggaa

SEQ ID NO: 291489 - DNA, 25 bp, Rattus norvegicus
gaacaaggcatcaccatgggctgct

SEQ ID NO: 291490 - DNA, 25 bp, Rattus norvegicus
gaacaaggcatctccatgggctgct

SEQ ID NO: 291491 - DNA, 25 bp, Rattus norvegicus
gaacaaggccctccagagcatggct

SEQ ID NO: 291492 - DNA, 25 bp, Rattus norvegicus
gaacaaggccctgcagagcatggct

SEQ ID NO: 291493 - DNA, 25 bp, Rattus norvegicus
gaacaaggctttctttgtgcctaaa

SEQ ID NO: 291494 - DNA, 25 bp, Rattus norvegicus
gaacaaggctttgtttgtgcctaaa

SEQ ID NO: 291495 - DNA, 25 bp, Rattus norvegicus
gaacaagggtctcctgtcatggatt

SEQ ID NO: 291496 - DNA, 25 bp, Rattus norvegicus
gaacaagggtctgctgtcatggatt

SEQ ID NO: 291497 - DNA, 25 bp, Rattus norvegicus
gaacaaggtggacgataactgcccc

SEQ ID NO: 291498 - DNA, 25 bp, Rattus norvegicus
gaacaaggtggaggataactgcccc

SEQ ID NO: 291499 - DNA, 25 bp, Rattus norvegicus
gaacaaggttacacatagactctct

SEQ ID NO: 291500 - DNA, 25 bp, Rattus norvegicus
gaacaaggttactcatagactctct

SEQ ID NO: 291501 - DNA, 25 bp, Rattus norvegicus
gaacaaggtttgacatcagcctgaa

SEQ ID NO: 291502 - DNA, 25 bp, Rattus norvegicus
gaacaaggtttgtcatcagcctgaa

SEQ ID NO: 291503 - DNA, 25 bp, Rattus norvegicus
gaacaagtacctcctataccataag

SEQ ID NO: 291504 - DNA, 25 bp, Rattus norvegicus
gaacaagtacctgctataccataag

SEQ ID NO: 291505 - DNA, 25 bp, Rattus norvegicus
gaacaagtcagtcgcttgaaaggtg

SEQ ID NO: 291506 - DNA, 25 bp, Rattus norvegicus
gaacaagtcagtggcttgaaaggtg

SEQ ID NO: 291507 - DNA, 25 bp, Rattus norvegicus
gaacaagtccctctctaacagaatg

SEQ ID NO: 291508 - DNA, 25 bp, Rattus norvegicus
gaacaagtccctgtctaacagaatg

SEQ ID NO: 291509 - DNA, 25 bp, Rattus norvegicus
gaacaagtctcgaacactagtcaca

SEQ ID NO: 291510 - DNA, 25 bp, Rattus norvegicus
gaacaagtctcgtacactagtcaca

SEQ ID NO: 291511 - DNA, 25 bp, Rattus norvegicus
gaacaagtctggaaaactctctgga

SEQ ID NO: 291512 - DNA, 25 bp, Rattus norvegicus
gaacaagtctggtaaactctctgga

SEQ ID NO: 291513 - DNA, 25 bp, Rattus norvegicus
gaacaagtgccaattctcactctgg

SEQ ID NO: 291514 - DNA, 25 bp, Rattus norvegicus
gaacaagtgccatttctcactctgg

SEQ ID NO: 291515 - DNA, 25 bp, Rattus norvegicus
gaacaagtgcctctaacccctaagc

SEQ ID NO: 291516 - DNA, 25 bp, Rattus norvegicus
gaacaagtgcctctatgccctggag

SEQ ID NO: 291517 - DNA, 25 bp, Rattus norvegicus
gaacaagtgcctgtaacccctaagc

SEQ ID NO: 291518 - DNA, 25 bp, Rattus norvegicus
gaacaagtgcctgtatgccctggag

SEQ ID NO: 291519 - DNA, 25 bp, Rattus norvegicus
gaacaagtggctatggtggccattt

SEQ ID NO: 291520 - DNA, 25 bp, Rattus norvegicus
gaacaagtggctttggtggccattt

SEQ ID NO: 291521 - DNA, 25 bp, Rattus norvegicus
gaacaagtgtctctggtcatcaatt

SEQ ID NO: 291522 - DNA, 25 bp, Rattus norvegicus
gaacaagtgtctgtggtcatcaatt

SEQ ID NO: 291523 - DNA, 25 bp, Rattus norvegicus
gaacaagttagtcaatgatcactct

SEQ ID NO: 291524 - DNA, 25 bp, Rattus norvegicus
gaacaagttagtgaatgatcactct

SEQ ID NO: 291525 - DNA, 25 bp, Rattus norvegicus
gaacaagttcctcacatactaccct

SEQ ID NO: 291526 - DNA, 25 bp, Rattus norvegicus
gaacaagttcctctctctgaacaat

SEQ ID NO: 291527 - DNA, 25 bp, Rattus norvegicus
gaacaagttcctgacatactaccct

SEQ ID NO: 291528 - DNA, 25 bp, Rattus norvegicus
gaacaagttcctgtctctgaacaat

SEQ ID NO: 291529 - DNA, 25 bp, Rattus norvegicus
gaacaagttctactcttgccaaaga

SEQ ID NO: 291530 - DNA, 25 bp, Rattus norvegicus
gaacaagttctagtcttgccaaaga

SEQ ID NO: 291531 - DNA, 25 bp, Rattus norvegicus
gaacaagttgccctgtctatgacat

SEQ ID NO: 291532 - DNA, 25 bp, Rattus norvegicus
gaacaagttgccgtgtctatgacat

SEQ ID NO: 291533 - DNA, 25 bp, Rattus norvegicus
gaacaagttggtactttgcttcttt

SEQ ID NO: 291534 - DNA, 25 bp, Rattus norvegicus
gaacaagttggttctttgcttcttt

SEQ ID NO: 291535 - DNA, 25 bp, Rattus norvegicus
gaacaagttgtaccctccttcaaaa

SEQ ID NO: 291536 - DNA, 25 bp, Rattus norvegicus
gaacaagttgtagcctccttcaaaa

SEQ ID NO: 291537 - DNA, 25 bp, Rattus norvegicus
gaacaagtttccatatcagggattt

SEQ ID NO: 291538 - DNA, 25 bp, Rattus norvegicus
gaacaagtttccttatcagggattt

SEQ ID NO: 291539 - DNA, 25 bp, Rattus norvegicus
gaacaagtttggctcctgttggaaa

SEQ ID NO: 291540 - DNA, 25 bp, Rattus norvegicus
gaacaagtttgggtcctgttggaaa

SEQ ID NO: 291541 - DNA, 25 bp, Rattus norvegicus
gaacaatagcaacctggcccctgag

SEQ ID NO: 291542 - DNA, 25 bp, Rattus norvegicus
gaacaatagcaagctggcccctgag

SEQ ID NO: 291543 - DNA, 25 bp, Rattus norvegicus
gaacaataggctagtccgctggact

SEQ ID NO: 291544 - DNA, 25 bp, Rattus norvegicus
gaacaataggcttgtccgctggact

SEQ ID NO: 291545 - DNA, 25 bp, Rattus norvegicus
gaacaatatgtacctcccagtcttg

SEQ ID NO: 291546 - DNA, 25 bp, Rattus norvegicus
gaacaatatgtagctcccagtcttg

SEQ ID NO: 291547 - DNA, 25 bp, Rattus norvegicus
gaacaatcacaactttggtggacca

SEQ ID NO: 291548 - DNA, 25 bp, Rattus norvegicus
gaacaatcacaagtttggtggacca

SEQ ID NO: 291549 - DNA, 25 bp, Rattus norvegicus
gaacaatctgcaacacactgaaggg

SEQ ID NO: 291550 - DNA, 25 bp, Rattus norvegicus
gaacaatctgcatcacactgaaggg

SEQ ID NO: 291551 - DNA, 25 bp, Rattus norvegicus
gaacaatctgcgaggcgacgtcagt

SEQ ID NO: 291552 - DNA, 25 bp, Rattus norvegicus
gaacaatctgcgtggcgacgtcagt

SEQ ID NO: 291553 - DNA, 25 bp, Rattus norvegicus
gaacaatctgctcgagatctgcccc

SEQ ID NO: 291554 - DNA, 25 bp, Rattus norvegicus
gaacaatctgctggagatctgcccc

SEQ ID NO: 291555 - DNA, 25 bp, Rattus norvegicus
gaacaatcttctaggttgtacccca

SEQ ID NO: 291556 - DNA, 25 bp, Rattus norvegicus
gaacaatcttcttggttgtacccca

SEQ ID NO: 291557 - DNA, 25 bp, Rattus norvegicus
gaacaatgaaaaccttacttgagtt

SEQ ID NO: 291558 - DNA, 25 bp, Rattus norvegicus
gaacaatgaaaagcttacttgagtt

SEQ ID NO: 291559 - DNA, 25 bp, Rattus norvegicus
gaacaatgaggccttcctccaagag

SEQ ID NO: 291560 - DNA, 25 bp, Rattus norvegicus
gaacaatgaggcgttcctccaagag

SEQ ID NO: 291561 - DNA, 25 bp, Rattus norvegicus
gaacaatgccttcattggcatcccg

SEQ ID NO: 291562 - DNA, 25 bp, Rattus norvegicus
gaacaatgccttgattggcatcccg

SEQ ID NO: 291563 - DNA, 25 bp, Rattus norvegicus
gaacaatgctgcaactagccatcct

SEQ ID NO: 291564 - DNA, 25 bp, Rattus norvegicus
gaacaatgctgctactagccatcct

SEQ ID NO: 291565 - DNA, 25 bp, Rattus norvegicus
gaacaatgctgtagggacctccggt

SEQ ID NO: 291566 - DNA, 25 bp, Rattus norvegicus
gaacaatgctgttgggacctccggt

SEQ ID NO: 291567 - DNA, 25 bp, Rattus norvegicus
gaacaatggacacaacacaaatcaa

SEQ ID NO: 291568 - DNA, 25 bp, Rattus norvegicus
gaacaatggacagaacacaaatcaa

SEQ ID NO: 291569 - DNA, 25 bp, Rattus norvegicus
gaacaatggactcttcctcatacac

SEQ ID NO: 291570 - DNA, 25 bp, Rattus norvegicus
gaacaatggactgttcctcatacac

SEQ ID NO: 291571 - DNA, 25 bp, Rattus norvegicus
gaacaatggatgcagctctcggagc

SEQ ID NO: 291572 - DNA, 25 bp, Rattus norvegicus
gaacaatggatggagctctcggagc

SEQ ID NO: 291573 - DNA, 25 bp, Rattus norvegicus
gaacaatggcctagagtccgcttag

SEQ ID NO: 291574 - DNA, 25 bp, Rattus norvegicus
gaacaatggccttgagtccgcttag

SEQ ID NO: 291575 - DNA, 25 bp, Rattus norvegicus
gaacaatggttcacacatgtggcta

SEQ ID NO: 291576 - DNA, 25 bp, Rattus norvegicus
gaacaatggttctcacatgtggcta

SEQ ID NO: 291577 - DNA, 25 bp, Rattus norvegicus
gaacaatgtctgaataccccatgat

SEQ ID NO: 291578 - DNA, 25 bp, Rattus norvegicus
gaacaatgtctgtataccccatgat

SEQ ID NO: 291579 - DNA, 25 bp, Rattus norvegicus
gaacaatgtggtcctcaacttcttc

SEQ ID NO: 291580 - DNA, 25 bp, Rattus norvegicus
gaacaatgtggtgctcaacttcttc

SEQ ID NO: 291581 - DNA, 25 bp, Rattus norvegicus
gaacaatgtgtgaagcgtgcttctt

SEQ ID NO: 291582 - DNA, 25 bp, Rattus norvegicus
gaacaatgtgtgtagcgtgcttctt

SEQ ID NO: 291583 - DNA, 25 bp, Rattus norvegicus
gaacaatgttctacctttttcgtgt

SEQ ID NO: 291584 - DNA, 25 bp, Rattus norvegicus
gaacaatgttcttcctttttcgtgt

SEQ ID NO: 291585 - DNA, 25 bp, Rattus norvegicus
gaacaattaccacccctactaaagg

SEQ ID NO: 291586 - DNA, 25 bp, Rattus norvegicus
gaacaattaccagccctactaaagg

SEQ ID NO: 291587 - DNA, 25 bp, Rattus norvegicus
gaacaattacgaatgccttctgcat

SEQ ID NO: 291588 - DNA, 25 bp, Rattus norvegicus
gaacaattacgattgccttctgcat

SEQ ID NO: 291589 - DNA, 25 bp, Rattus norvegicus
gaacaattagtcacttcctcgcaaa

SEQ ID NO: 291590 - DNA, 25 bp, Rattus norvegicus
gaacaattagtctcttcctcgcaaa

SEQ ID NO: 291591 - DNA, 25 bp, Rattus norvegicus
gaacaattatctccgagcttctaaa

SEQ ID NO: 291592 - DNA, 25 bp, Rattus norvegicus
gaacaattatctgcgagcttctaaa

SEQ ID NO: 291593 - DNA, 25 bp, Rattus norvegicus
gaacaattgagaatctcctcccttg

SEQ ID NO: 291594 - DNA, 25 bp, Rattus norvegicus
gaacaattgagattctcctcccttg

SEQ ID NO: 291595 - DNA, 25 bp, Rattus norvegicus
gaacaattgcccagccatcatggat

SEQ ID NO: 291596 - DNA, 25 bp, Rattus norvegicus
gaacaattgccctgccatcatggat

SEQ ID NO: 291597 - DNA, 25 bp, Rattus norvegicus
gaacaattgtgacctctgccttctc

SEQ ID NO: 291598 - DNA, 25 bp, Rattus norvegicus
gaacaattgtgagctctgccttctc

SEQ ID NO: 291599 - DNA, 25 bp, Rattus norvegicus
gaacaattgtttcccttcgtgtctt

SEQ ID NO: 291600 - DNA, 25 bp, Rattus norvegicus
gaacaattgtttgccttcgtgtctt

SEQ ID NO: 291601 - DNA, 25 bp, Rattus norvegicus
gaacaatttcaccaacgccatgacc

SEQ ID NO: 291602 - DNA, 25 bp, Rattus norvegicus
gaacaatttcacgaacgccatgacc

SEQ ID NO: 291603 - DNA, 25 bp, Rattus norvegicus
gaacaatttctccttcagtgatata

SEQ ID NO: 291604 - DNA, 25 bp, Rattus norvegicus
gaacaatttctcgttcagtgatata

SEQ ID NO: 291605 - DNA, 25 bp, Rattus norvegicus
gaacaattttgtccctcagactgtc

SEQ ID NO: 291606 - DNA, 25 bp, Rattus norvegicus
gaacaattttgtgcctcagactgtc

SEQ ID NO: 291607 - DNA, 25 bp, Rattus norvegicus
gaacacaaaatcaacagcacgggct

SEQ ID NO: 291608 - DNA, 25 bp, Rattus norvegicus
gaacacaaaatctacagcacgggct

SEQ ID NO: 291609 - DNA, 25 bp, Rattus norvegicus
gaacacaaagccaagaagtaattat

SEQ ID NO: 291610 - DNA, 25 bp, Rattus norvegicus
gaacacaaagcctagaagtaattat

SEQ ID NO: 291611 - DNA, 25 bp, Rattus norvegicus
gaacacaacttgctgacgatggcca

SEQ ID NO: 291612 - DNA, 25 bp, Rattus norvegicus
gaacacaacttggtgacgatggcca

SEQ ID NO: 291613 - DNA, 25 bp, Rattus norvegicus
gaacacaagccactgtaactcctgg

SEQ ID NO: 291614 - DNA, 25 bp, Rattus norvegicus
gaacacaagccagtgtaactcctgg

SEQ ID NO: 291615 - DNA, 25 bp, Rattus norvegicus
gaacacaagcctcgagttcacttga

SEQ ID NO: 291616 - DNA, 25 bp, Rattus norvegicus
gaacacaagcctggagttcacttga

SEQ ID NO: 291617 - DNA, 25 bp, Rattus norvegicus
gaacacaaggacagttggtttctga

SEQ ID NO: 291618 - DNA, 25 bp, Rattus norvegicus
gaacacaaggactgttggtttctga

SEQ ID NO: 291619 - DNA, 25 bp, Rattus norvegicus
gaacacaagtctaagaaagccagaa

SEQ ID NO: 291620 - DNA, 25 bp, Rattus norvegicus
gaacacaagtcttagaaagccagaa

SEQ ID NO: 291621 - DNA, 25 bp, Rattus norvegicus
gaacacaatcatactcaaataccaa

SEQ ID NO: 291622 - DNA, 25 bp, Rattus norvegicus
gaacacaatcattctcaaataccaa

SEQ ID NO: 291623 - DNA, 25 bp, Rattus norvegicus
gaacacaatcttccagagtttccct

SEQ ID NO: 291624 - DNA, 25 bp, Rattus norvegicus
gaacacaatcttgcagagtttccct

SEQ ID NO: 291625 - DNA, 25 bp, Rattus norvegicus
gaacacaatgatatgtgcctacaat

SEQ ID NO: 291626 - DNA, 25 bp, Rattus norvegicus
gaacacaatgatttgtgcctacaat

SEQ ID NO: 291627 - DNA, 25 bp, Rattus norvegicus
gaacacaattcacttctgatgtaca

SEQ ID NO: 291628 - DNA, 25 bp, Rattus norvegicus
gaacacaattcagttctgatgtaca

SEQ ID NO: 291629 - DNA, 25 bp, Rattus norvegicus
gaacacaattccagctcagggtggt

SEQ ID NO: 291630 - DNA, 25 bp, Rattus norvegicus
gaacacaattcctgctcagggtggt

SEQ ID NO: 291631 - DNA, 25 bp, Rattus norvegicus
gaacacacaagtagcctcagaaggg

SEQ ID NO: 291632 - DNA, 25 bp, Rattus norvegicus
gaacacacaagttgcctcagaaggg

SEQ ID NO: 291633 - DNA, 25 bp, Rattus norvegicus
gaacacacagatctggcggtcgtat

SEQ ID NO: 291634 - DNA, 25 bp, Rattus norvegicus
gaacacacagatgtggcggtcgtat

SEQ ID NO: 291635 - DNA, 25 bp, Rattus norvegicus
gaacacacagtcaatgcatccctta

SEQ ID NO: 291636 - DNA, 25 bp, Rattus norvegicus
gaacacacagtctatgcatccctta

SEQ ID NO: 291637 - DNA, 25 bp, Rattus norvegicus
gaacacacatcactagcagcagctc

SEQ ID NO: 291638 - DNA, 25 bp, Rattus norvegicus
gaacacacatcagtagcagcagctc

SEQ ID NO: 291639 - DNA, 25 bp, Rattus norvegicus
gaacacacattcacatcgacggatc

SEQ ID NO: 291640 - DNA, 25 bp, Rattus norvegicus
gaacacacattctcatcgacggatc

SEQ ID NO: 291641 - DNA, 25 bp, Rattus norvegicus
gaacacacatttcacagctgcagtt

SEQ ID NO: 291642 - DNA, 25 bp, Rattus norvegicus
gaacacacatttgacagctgcagtt

SEQ ID NO: 291643 - DNA, 25 bp, Rattus norvegicus
gaacacaccctaattgaactttctt

SEQ ID NO: 291644 - DNA, 25 bp, Rattus norvegicus
gaacacaccctatttgaactttctt

SEQ ID NO: 291645 - DNA, 25 bp, Rattus norvegicus
gaacacacctccattttcatacggg

SEQ ID NO: 291646 - DNA, 25 bp, Rattus norvegicus
gaacacacctcctttttcatacggg

SEQ ID NO: 291647 - DNA, 25 bp, Rattus norvegicus
gaacacacctctagcatgtctagga

SEQ ID NO: 291648 - DNA, 25 bp, Rattus norvegicus
gaacacacctcttgcatgtctagga

SEQ ID NO: 291649 - DNA, 25 bp, Rattus norvegicus
gaacacacgacgactcagtggagta

SEQ ID NO: 291650 - DNA, 25 bp, Rattus norvegicus
gaacacacgacgtctcagtggagta

SEQ ID NO: 291651 - DNA, 25 bp, Rattus norvegicus
gaacacactcagctggacagtacac

SEQ ID NO: 291652 - DNA, 25 bp, Rattus norvegicus
gaacacactcaggtggacagtacac

SEQ ID NO: 291653 - DNA, 25 bp, Rattus norvegicus
gaacacactcggaggaagtagagaa

SEQ ID NO: 291654 - DNA, 25 bp, Rattus norvegicus
gaacacactcggtggaagtagagaa

SEQ ID NO: 291655 - DNA, 25 bp, Rattus norvegicus
gaacacactgttatgactacttttg

SEQ ID NO: 291656 - DNA, 25 bp, Rattus norvegicus
gaacacactgttttgactacttttg

SEQ ID NO: 291657 - DNA, 25 bp, Rattus norvegicus
gaacacactttcatgcttgcattgg

SEQ ID NO: 291658 - DNA, 25 bp, Rattus norvegicus
gaacacactttcttgcttgcattgg

SEQ ID NO: 291659 - DNA, 25 bp, Rattus norvegicus
gaacacagaagacccgcctcaggga

SEQ ID NO: 291660 - DNA, 25 bp, Rattus norvegicus
gaacacagaagagccgcctcaggga

SEQ ID NO: 291661 - DNA, 25 bp, Rattus norvegicus
gaacacagaataccagtctagtcct

SEQ ID NO: 291662 - DNA, 25 bp, Rattus norvegicus
gaacacagaatagcagtctagtcct

SEQ ID NO: 291663 - DNA, 25 bp, Rattus norvegicus
gaacacagactgaatcacctctatc

SEQ ID NO: 291664 - DNA, 25 bp, Rattus norvegicus
gaacacagactgtatcacctctatc

SEQ ID NO: 291665 - DNA, 25 bp, Rattus norvegicus
gaacacagagatcaccacggaccat

SEQ ID NO: 291666 - DNA, 25 bp, Rattus norvegicus
gaacacagagatgaccacggaccat

SEQ ID NO: 291667 - DNA, 25 bp, Rattus norvegicus
gaacacagaggacaacgacacagaa

SEQ ID NO: 291668 - DNA, 25 bp, Rattus norvegicus
gaacacagaggagaacgacacagaa

SEQ ID NO: 291669 - DNA, 25 bp, Rattus norvegicus
gaacacagatgcagttcatcttgct

SEQ ID NO: 291670 - DNA, 25 bp, Rattus norvegicus
gaacacagatgctgttcatcttgct

SEQ ID NO: 291671 - DNA, 25 bp, Rattus norvegicus
gaacacagattccagagcagcctag

SEQ ID NO: 291672 - DNA, 25 bp, Rattus norvegicus
gaacacagattcgagagcagcctag

SEQ ID NO: 291673 - DNA, 25 bp, Rattus norvegicus
gaacacagattgatttctcagcaaa

SEQ ID NO: 291674 - DNA, 25 bp, Rattus norvegicus
gaacacagattgttttctcagcaaa

SEQ ID NO: 291675 - DNA, 25 bp, Rattus norvegicus
gaacacagcacacatttttcaggcg

SEQ ID NO: 291676 - DNA, 25 bp, Rattus norvegicus
gaacacagcacagatttttcaggcg

SEQ ID NO: 291677 - DNA, 25 bp, Rattus norvegicus
gaacacagcagccatggtgtgctct

SEQ ID NO: 291678 - DNA, 25 bp, Rattus norvegicus
gaacacagcagcgatggtgtgctct

SEQ ID NO: 291679 - DNA, 25 bp, Rattus norvegicus
gaacacagcagtccgatgaggcgcc

SEQ ID NO: 291680 - DNA, 25 bp, Rattus norvegicus
gaacacagcagtgcgatgaggcgcc

SEQ ID NO: 291681 - DNA, 25 bp, Rattus norvegicus
gaacacagccaacctgatcctggaa

SEQ ID NO: 291682 - DNA, 25 bp, Rattus norvegicus
gaacacagccaagctgatcctggaa

SEQ ID NO: 291683 - DNA, 25 bp, Rattus norvegicus
gaacacagccacagatagacctcac

SEQ ID NO: 291684 - DNA, 25 bp, Rattus norvegicus
gaacacagccactgatagacctcac

SEQ ID NO: 291685 - DNA, 25 bp, Rattus norvegicus
gaacacagccatcctcagataagta

SEQ ID NO: 291686 - DNA, 25 bp, Rattus norvegicus
gaacacagccatgctcagataagta

SEQ ID NO: 291687 - DNA, 25 bp, Rattus norvegicus
gaacacagcgggaagcctgggcttc

SEQ ID NO: 291688 - DNA, 25 bp, Rattus norvegicus
gaacacagcgggataccaggcacac

SEQ ID NO: 291689 - DNA, 25 bp, Rattus norvegicus
gaacacagcgggtagcctgggcttc

SEQ ID NO: 291690 - DNA, 25 bp, Rattus norvegicus
gaacacagcgggttaccaggcacac

SEQ ID NO: 291691 - DNA, 25 bp, Rattus norvegicus
gaacacagcgttcctcgaggaatca

SEQ ID NO: 291692 - DNA, 25 bp, Rattus norvegicus
gaacacagcgttgctcgaggaatca

SEQ ID NO: 291693 - DNA, 25 bp, Rattus norvegicus
gaacacaggcgacctttgagtcagc

SEQ ID NO: 291694 - DNA, 25 bp, Rattus norvegicus
gaacacaggcgagctttgagtcagc

SEQ ID NO: 291695 - DNA, 25 bp, Rattus norvegicus
gaacacagggtgctcatcaatacca

SEQ ID NO: 291696 - DNA, 25 bp, Rattus norvegicus
gaacacagggtggtcatcaatacca

SEQ ID NO: 291697 - DNA, 25 bp, Rattus norvegicus
gaacacaggtgcagcctagggctga

SEQ ID NO: 291698 - DNA, 25 bp, Rattus norvegicus
gaacacaggtgctgcctagggctga

SEQ ID NO: 291699 - DNA, 25 bp, Rattus norvegicus
gaacacagtgcgatccatattgtga

SEQ ID NO: 291700 - DNA, 25 bp, Rattus norvegicus
gaacacagtgcgttccatattgtga

SEQ ID NO: 291701 - DNA, 25 bp, Rattus norvegicus
gaacacagtggcacccagaagcagg

SEQ ID NO: 291702 - DNA, 25 bp, Rattus norvegicus
gaacacagtggctcccagaagcagg

SEQ ID NO: 291703 - DNA, 25 bp, Rattus norvegicus
gaacacagtgtgcagatctcccgag

SEQ ID NO: 291704 - DNA, 25 bp, Rattus norvegicus
gaacacagtgtggagatctcccgag

SEQ ID NO: 291705 - DNA, 25 bp, Rattus norvegicus
gaacacagttcgatccttcatgaag

SEQ ID NO: 291706 - DNA, 25 bp, Rattus norvegicus
gaacacagttcgttccttcatgaag

SEQ ID NO: 291707 - DNA, 25 bp, Rattus norvegicus
gaacacagttctacttttatgatac

SEQ ID NO: 291708 - DNA, 25 bp, Rattus norvegicus
gaacacagttcttcttttatgatac

SEQ ID NO: 291709 - DNA, 25 bp, Rattus norvegicus
gaacacagtttaatgctgcctcagt

SEQ ID NO: 291710 - DNA, 25 bp, Rattus norvegicus
gaacacagtttattgctgcctcagt

SEQ ID NO: 291711 - DNA, 25 bp, Rattus norvegicus
gaacacatatgcaatcaccatgcca

SEQ ID NO: 291712 - DNA, 25 bp, Rattus norvegicus
gaacacatatgctatcaccatgcca

SEQ ID NO: 291713 - DNA, 25 bp, Rattus norvegicus
gaacacatcaccatcactgtataag

SEQ ID NO: 291714 - DNA, 25 bp, Rattus norvegicus
gaacacatcaccttcactgtataag

SEQ ID NO: 291715 - DNA, 25 bp, Rattus norvegicus
gaacacatccttaagtcatgctcag

SEQ ID NO: 291716 - DNA, 25 bp, Rattus norvegicus
gaacacatcctttagtcatgctcag

SEQ ID NO: 291717 - DNA, 25 bp, Rattus norvegicus
gaacacatctccactcagaactatg

SEQ ID NO: 291718 - DNA, 25 bp, Rattus norvegicus
gaacacatctcctctcagaactatg

SEQ ID NO: 291719 - DNA, 25 bp, Rattus norvegicus
gaacacatggcacctatctgacacc

SEQ ID NO: 291720 - DNA, 25 bp, Rattus norvegicus
gaacacatggcagctatctgacacc

SEQ ID NO: 291721 - DNA, 25 bp, Rattus norvegicus
gaacacatgggcacaagttgaaacc

SEQ ID NO: 291722 - DNA, 25 bp, Rattus norvegicus
gaacacatgggctcaagttgaaacc

SEQ ID NO: 291723 - DNA, 25 bp, Rattus norvegicus
gaacacatggtcaaagagggcatcc

SEQ ID NO: 291724 - DNA, 25 bp, Rattus norvegicus
gaacacatggtctaagagggcatcc

SEQ ID NO: 291725 - DNA, 25 bp, Rattus norvegicus
gaacacatgtggctttgcggtcgtc

SEQ ID NO: 291726 - DNA, 25 bp, Rattus norvegicus
gaacacatgtgggtttgcggtcgtc

SEQ ID NO: 291727 - DNA, 25 bp, Rattus norvegicus
gaacacatgtgtactgtctggaaac

SEQ ID NO: 291728 - DNA, 25 bp, Rattus norvegicus
gaacacatgtgttctgtctggaaac

SEQ ID NO: 291729 - DNA, 25 bp, Rattus norvegicus
gaacacattaacactgggttgcaga

SEQ ID NO: 291730 - DNA, 25 bp, Rattus norvegicus
gaacacattaactctgggttgcaga

SEQ ID NO: 291731 - DNA, 25 bp, Rattus norvegicus
gaacacattccaattgtcctaggat

SEQ ID NO: 291732 - DNA, 25 bp, Rattus norvegicus
gaacacattccatttgtcctaggat

SEQ ID NO: 291733 - DNA, 25 bp, Rattus norvegicus
gaacacattcgacgtctcagctctt

SEQ ID NO: 291734 - DNA, 25 bp, Rattus norvegicus
gaacacattcgaggtctcagctctt

SEQ ID NO: 291735 - DNA, 25 bp, Rattus norvegicus
gaacacattcttaggtaactgtccc

SEQ ID NO: 291736 - DNA, 25 bp, Rattus norvegicus
gaacacattctttggtaactgtccc

SEQ ID NO: 291737 - DNA, 25 bp, Rattus norvegicus
gaacacattgtacctgagctgacag

SEQ ID NO: 291738 - DNA, 25 bp, Rattus norvegicus
gaacacattgtagctgagctgacag

SEQ ID NO: 291739 - DNA, 25 bp, Rattus norvegicus
gaacacatttccacacagagaggca

SEQ ID NO: 291740 - DNA, 25 bp, Rattus norvegicus
gaacacatttcctcacagagaggca

SEQ ID NO: 291741 - DNA, 25 bp, Rattus norvegicus
gaacacatttggctattcctgagac

SEQ ID NO: 291742 - DNA, 25 bp, Rattus norvegicus
gaacacatttgggtattcctgagac

SEQ ID NO: 291743 - DNA, 25 bp, Rattus norvegicus
gaacacattttcatatttccagtag

SEQ ID NO: 291744 - DNA, 25 bp, Rattus norvegicus
gaacacattttcttatttccagtag

SEQ ID NO: 291745 - DNA, 25 bp, Rattus norvegicus
gaacacatttttctcctgcatctgt

SEQ ID NO: 291746 - DNA, 25 bp, Rattus norvegicus
gaacacatttttgtcctgcatctgt

SEQ ID NO: 291747 - DNA, 25 bp, Rattus norvegicus
gaacaccaacccagaggtggtacca

SEQ ID NO: 291748 - DNA, 25 bp, Rattus norvegicus
gaacaccaaccctgaggtggtacca

SEQ ID NO: 291749 - DNA, 25 bp, Rattus norvegicus
gaacaccaagggaaagaggagtctg

SEQ ID NO: 291750 - DNA, 25 bp, Rattus norvegicus
gaacaccaagggtaagaggagtctg

SEQ ID NO: 291751 - DNA, 25 bp, Rattus norvegicus
gaacaccaagtgctacgaactatct

SEQ ID NO: 291752 - DNA, 25 bp, Rattus norvegicus
gaacaccaagtggtacgaactatct

SEQ ID NO: 291753 - DNA, 25 bp, Rattus norvegicus
gaacaccacagaatgaactatccaa

SEQ ID NO: 291754 - DNA, 25 bp, Rattus norvegicus
gaacaccacagattgaactatccaa

SEQ ID NO: 291755 - DNA, 25 bp, Rattus norvegicus
gaacaccacagcctttcaacagcag

SEQ ID NO: 291756 - DNA, 25 bp, Rattus norvegicus
gaacaccacagcgtttcaacagcag

SEQ ID NO: 291757 - DNA, 25 bp, Rattus norvegicus
gaacaccactcaccttctaaagcat

SEQ ID NO: 291758 - DNA, 25 bp, Rattus norvegicus
gaacaccactcagcttctaaagcat

SEQ ID NO: 291759 - DNA, 25 bp, Rattus norvegicus
gaacaccagaccctttaatttatgt

SEQ ID NO: 291760 - DNA, 25 bp, Rattus norvegicus
gaacaccagaccgtttaatttatgt

SEQ ID NO: 291761 - DNA, 25 bp, Rattus norvegicus
gaacaccagtcactaatgatcagtt

SEQ ID NO: 291762 - DNA, 25 bp, Rattus norvegicus
gaacaccagtcagtaatgatcagtt

SEQ ID NO: 291763 - DNA, 25 bp, Rattus norvegicus
gaacaccagtgaacaggctatgcca

SEQ ID NO: 291764 - DNA, 25 bp, Rattus norvegicus
gaacaccagtgatcaggctatgcca

SEQ ID NO: 291765 - DNA, 25 bp, Rattus norvegicus
gaacaccatacccaacagactagag

SEQ ID NO: 291766 - DNA, 25 bp, Rattus norvegicus
gaacaccataccgaacagactagag

SEQ ID NO: 291767 - DNA, 25 bp, Rattus norvegicus
gaacaccatcttaaacctcagtata

SEQ ID NO: 291768 - DNA, 25 bp, Rattus norvegicus
gaacaccatcttcaaatgtccttca

SEQ ID NO: 291769 - DNA, 25 bp, Rattus norvegicus
gaacaccatcttgaaatgtccttca

SEQ ID NO: 291770 - DNA, 25 bp, Rattus norvegicus
gaacaccatctttaacctcagtata

SEQ ID NO: 291771 - DNA, 25 bp, Rattus norvegicus
gaacaccatggactttgctgatgaa

SEQ ID NO: 291772 - DNA, 25 bp, Rattus norvegicus
gaacaccatggagtttgctgatgaa

SEQ ID NO: 291773 - DNA, 25 bp, Rattus norvegicus
gaacaccattgcaccagcagaggat

SEQ ID NO: 291774 - DNA, 25 bp, Rattus norvegicus
gaacaccattgcattccagagattt

SEQ ID NO: 291775 - DNA, 25 bp, Rattus norvegicus
gaacaccattgctccagcagaggat

SEQ ID NO: 291776 - DNA, 25 bp, Rattus norvegicus
gaacaccattgctttccagagattt

SEQ ID NO: 291777 - DNA, 25 bp, Rattus norvegicus
gaacaccattgtccagtgcctttta

SEQ ID NO: 291778 - DNA, 25 bp, Rattus norvegicus
gaacaccattgtgcagtgcctttta

SEQ ID NO: 291779 - DNA, 25 bp, Rattus norvegicus
gaacaccatttccaatgcctatcag

SEQ ID NO: 291780 - DNA, 25 bp, Rattus norvegicus
gaacaccatttcgaatgcctatcag

SEQ ID NO: 291781 - DNA, 25 bp, Rattus norvegicus
gaacacccaaggcttgatcttcgta

SEQ ID NO: 291782 - DNA, 25 bp, Rattus norvegicus
gaacacccaagggttgatcttcgta

SEQ ID NO: 291783 - DNA, 25 bp, Rattus norvegicus
gaacacccaagtcaggaactcagcc

SEQ ID NO: 291784 - DNA, 25 bp, Rattus norvegicus
gaacacccaagtgaggaactcagcc

SEQ ID NO: 291785 - DNA, 25 bp, Rattus norvegicus
gaacacccactaaattacaatgcta

SEQ ID NO: 291786 - DNA, 25 bp, Rattus norvegicus
gaacacccactatattacaatgcta

SEQ ID NO: 291787 - DNA, 25 bp, Rattus norvegicus
gaacacccagtcactacaagtatct

SEQ ID NO: 291788 - DNA, 25 bp, Rattus norvegicus
gaacacccagtctctacaagtatct

SEQ ID NO: 291789 - DNA, 25 bp, Rattus norvegicus
gaacaccccagacaaggacatcttt

SEQ ID NO: 291790 - DNA, 25 bp, Rattus norvegicus
gaacaccccagagaaggacatcttt

SEQ ID NO: 291791 - DNA, 25 bp, Rattus norvegicus
gaacaccctattctactttaacact

SEQ ID NO: 291792 - DNA, 25 bp, Rattus norvegicus
gaacaccctattgtactttaacact

SEQ ID NO: 291793 - DNA, 25 bp, Rattus norvegicus
gaacaccctcaacccggtgtggcag

SEQ ID NO: 291794 - DNA, 25 bp, Rattus norvegicus
gaacaccctcaagccggtgtggcag

SEQ ID NO: 291795 - DNA, 25 bp, Rattus norvegicus
gaacaccctgatatcccaagtgtga

SEQ ID NO: 291796 - DNA, 25 bp, Rattus norvegicus
gaacaccctgatttcccaagtgtga

SEQ ID NO: 291797 - DNA, 25 bp, Rattus norvegicus
gaacaccctgtgcatgcacgctaag

SEQ ID NO: 291798 - DNA, 25 bp, Rattus norvegicus
gaacaccctgtggatgcacgctaag

SEQ ID NO: 291799 - DNA, 25 bp, Rattus norvegicus
gaacacccttggcacagcagtaaga

SEQ ID NO: 291800 - DNA, 25 bp, Rattus norvegicus
gaacacccttgggacagcagtaaga

SEQ ID NO: 291801 - DNA, 25 bp, Rattus norvegicus
gaacaccgagccagtgatggactct

SEQ ID NO: 291802 - DNA, 25 bp, Rattus norvegicus
gaacaccgagcctgtgatggactct

SEQ ID NO: 291803 - DNA, 25 bp, Rattus norvegicus
gaacaccgccgtacatatagtttta

SEQ ID NO: 291804 - DNA, 25 bp, Rattus norvegicus
gaacaccgccgttcatatagtttta

SEQ ID NO: 291805 - DNA, 25 bp, Rattus norvegicus
gaacaccgttacagaggctgaagat

SEQ ID NO: 291806 - DNA, 25 bp, Rattus norvegicus
gaacaccgttactgaggctgaagat

SEQ ID NO: 291807 - DNA, 25 bp, Rattus norvegicus
gaacaccgttggcagcagcagctat

SEQ ID NO: 291808 - DNA, 25 bp, Rattus norvegicus
gaacaccgttgggagcagcagctat

SEQ ID NO: 291809 - DNA, 25 bp, Rattus norvegicus
gaacacctaagactgaccttggcgt

SEQ ID NO: 291810 - DNA, 25 bp, Rattus norvegicus
gaacacctaagagtgaccttggcgt

SEQ ID NO: 291811 - DNA, 25 bp, Rattus norvegicus
gaacacctaataactcatgcatgca

SEQ ID NO: 291812 - DNA, 25 bp, Rattus norvegicus
gaacacctaatatctcatgcatgca

SEQ ID NO: 291813 - DNA, 25 bp, Rattus norvegicus
gaacacctagaaaatcctctgtaaa

SEQ ID NO: 291814 - DNA, 25 bp, Rattus norvegicus
gaacacctagaatatcctctgtaaa

SEQ ID NO: 291815 - DNA, 25 bp, Rattus norvegicus
gaacacctccatcctgcgataagta

SEQ ID NO: 291816 - DNA, 25 bp, Rattus norvegicus
gaacacctccatgctgcgataagta

SEQ ID NO: 291817 - DNA, 25 bp, Rattus norvegicus
gaacacctctgaaatttgtaagtta

SEQ ID NO: 291818 - DNA, 25 bp, Rattus norvegicus
gaacacctctgatatttgtaagtta

SEQ ID NO: 291819 - DNA, 25 bp, Rattus norvegicus
gaacacctgaaaatatctgaacgaa

SEQ ID NO: 291820 - DNA, 25 bp, Rattus norvegicus
gaacacctgaaattatctgaacgaa

SEQ ID NO: 291821 - DNA, 25 bp, Rattus norvegicus
gaacacctgaagaccggtagcctga

SEQ ID NO: 291822 - DNA, 25 bp, Rattus norvegicus
gaacacctgaagtccggtagcctga

SEQ ID NO: 291823 - DNA, 25 bp, Rattus norvegicus
gaacacctggaaacatctgaccaaa

SEQ ID NO: 291824 - DNA, 25 bp, Rattus norvegicus
gaacacctggaatcatctgaccaaa

SEQ ID NO: 291825 - DNA, 25 bp, Rattus norvegicus
gaacacctgtataaattcattcccc

SEQ ID NO: 291826 - DNA, 25 bp, Rattus norvegicus
gaacacctgtatatcttcagtatac

SEQ ID NO: 291827 - DNA, 25 bp, Rattus norvegicus
gaacacctgtattaattcattcccc

SEQ ID NO: 291828 - DNA, 25 bp, Rattus norvegicus
gaacacctgtatttcttcagtatac

SEQ ID NO: 291829 - DNA, 25 bp, Rattus norvegicus
gaacacctgttcatccgagaaacgt

SEQ ID NO: 291830 - DNA, 25 bp, Rattus norvegicus
gaacacctgttcttccgagaaacgt

SEQ ID NO: 291831 - DNA, 25 bp, Rattus norvegicus
gaacaccttagacccaaatctactg

SEQ ID NO: 291832 - DNA, 25 bp, Rattus norvegicus
gaacaccttagagccaaatctactg

SEQ ID NO: 291833 - DNA, 25 bp, Rattus norvegicus
gaacaccttgctcgaggagcctcga

SEQ ID NO: 291834 - DNA, 25 bp, Rattus norvegicus
gaacaccttgctggaggagcctcga

SEQ ID NO: 291835 - DNA, 25 bp, Rattus norvegicus
gaacaccttggtaacctgtggttct

SEQ ID NO: 291836 - DNA, 25 bp, Rattus norvegicus
gaacaccttggttacctgtggttct

SEQ ID NO: 291837 - DNA, 25 bp, Rattus norvegicus
gaacacctttgcagcaccttggaaa

SEQ ID NO: 291838 - DNA, 25 bp, Rattus norvegicus
gaacacctttgctgcaccttggaaa

SEQ ID NO: 291839 - DNA, 25 bp, Rattus norvegicus
gaacacgaagatcatgagtctgcat

SEQ ID NO: 291840 - DNA, 25 bp, Rattus norvegicus
gaacacgaagatgatgagtctgcat

SEQ ID NO: 291841 - DNA, 25 bp, Rattus norvegicus
gaacacgacaggatagccagacagt

SEQ ID NO: 291842 - DNA, 25 bp, Rattus norvegicus
gaacacgacaggttagccagacagt

SEQ ID NO: 291843 - DNA, 25 bp, Rattus norvegicus
gaacacgacgagctgcagggtcatt

SEQ ID NO: 291844 - DNA, 25 bp, Rattus norvegicus
gaacacgacgaggtgcagggtcatt

SEQ ID NO: 291845 - DNA, 25 bp, Rattus norvegicus
gaacacgagcaaccccgtgtgtctt

SEQ ID NO: 291846 - DNA, 25 bp, Rattus norvegicus
gaacacgagcaagcccgtgtgtctt

SEQ ID NO: 291847 - DNA, 25 bp, Rattus norvegicus
gaacacgagcctccgtgaggacatc

SEQ ID NO: 291848 - DNA, 25 bp, Rattus norvegicus
gaacacgagcctgcgtgaggacatc

SEQ ID NO: 291849 - DNA, 25 bp, Rattus norvegicus
gaacacgagcgaatccatactggag

SEQ ID NO: 291850 - DNA, 25 bp, Rattus norvegicus
gaacacgagcgattccatactggag

SEQ ID NO: 291851 - DNA, 25 bp, Rattus norvegicus
gaacacgaggagacgccagtgcgct

SEQ ID NO: 291852 - DNA, 25 bp, Rattus norvegicus
gaacacgaggagtcgccagtgcgct

SEQ ID NO: 291853 - DNA, 25 bp, Rattus norvegicus
gaacacgatgccagaggaccgcgca

SEQ ID NO: 291854 - DNA, 25 bp, Rattus norvegicus
gaacacgatgcctgaggaccgcgca

SEQ ID NO: 291855 - DNA, 25 bp, Rattus norvegicus
gaacacgcagcaataaatctaccat

SEQ ID NO: 291856 - DNA, 25 bp, Rattus norvegicus
gaacacgcagcaatacagtctcaac

SEQ ID NO: 291857 - DNA, 25 bp, Rattus norvegicus
gaacacgcagcattaaatctaccat

SEQ ID NO: 291858 - DNA, 25 bp, Rattus norvegicus
gaacacgcagcattacagtctcaac

SEQ ID NO: 291859 - DNA, 25 bp, Rattus norvegicus
gaacacgcagcgctagcagggccca

SEQ ID NO: 291860 - DNA, 25 bp, Rattus norvegicus
gaacacgcagcggtagcagggccca

SEQ ID NO: 291861 - DNA, 25 bp, Rattus norvegicus
gaacacgcagttcgcaggctcggaa

SEQ ID NO: 291862 - DNA, 25 bp, Rattus norvegicus
gaacacgcagttggcaggctcggaa

SEQ ID NO: 291863 - DNA, 25 bp, Rattus norvegicus
gaacacgccgttcttgccgagacag

SEQ ID NO: 291864 - DNA, 25 bp, Rattus norvegicus
gaacacgccgttgttgccgagacag

SEQ ID NO: 291865 - DNA, 25 bp, Rattus norvegicus
gaacacgcctctctacaagtatttt

SEQ ID NO: 291866 - DNA, 25 bp, Rattus norvegicus
gaacacgcctctgtacaagtatttt

SEQ ID NO: 291867 - DNA, 25 bp, Rattus norvegicus
gaacacgcgacccagttggcaagag

SEQ ID NO: 291868 - DNA, 25 bp, Rattus norvegicus
gaacacgcgaccgagttggcaagag

SEQ ID NO: 291869 - DNA, 25 bp, Rattus norvegicus
gaacacgctcacctttcgtttattt

SEQ ID NO: 291870 - DNA, 25 bp, Rattus norvegicus
gaacacgctcacgtttcgtttattt

SEQ ID NO: 291871 - DNA, 25 bp, Rattus norvegicus
gaacacgctgcaagcgatgtttaga

SEQ ID NO: 291872 - DNA, 25 bp, Rattus norvegicus
gaacacgctgcatgcgatgtttaga

SEQ ID NO: 291873 - DNA, 25 bp, Rattus norvegicus
gaacacgctgccattttcagaagtg

SEQ ID NO: 291874 - DNA, 25 bp, Rattus norvegicus
gaacacgctgcctttttcagaagtg

SEQ ID NO: 291875 - DNA, 25 bp, Rattus norvegicus
gaacacgcttaaccctgtttacaat

SEQ ID NO: 291876 - DNA, 25 bp, Rattus norvegicus
gaacacgcttaagcctgtttacaat

SEQ ID NO: 291877 - DNA, 25 bp, Rattus norvegicus
gaacacgcttgactgaagatgatat

SEQ ID NO: 291878 - DNA, 25 bp, Rattus norvegicus
gaacacgcttgagtgaagatgatat

SEQ ID NO: 291879 - DNA, 25 bp, Rattus norvegicus
gaacacggattaagtctgtctccac

SEQ ID NO: 291880 - DNA, 25 bp, Rattus norvegicus
gaacacggattatgtctgtctccac

SEQ ID NO: 291881 - DNA, 25 bp, Rattus norvegicus
gaacacggcaggaatgaactcaaca

SEQ ID NO: 291882 - DNA, 25 bp, Rattus norvegicus
gaacacggcaggtatgaactcaaca

SEQ ID NO: 291883 - DNA, 25 bp, Rattus norvegicus
gaacacggccatcaggtaaaccctg

SEQ ID NO: 291884 - DNA, 25 bp, Rattus norvegicus
gaacacggccatgaggtaaaccctg

SEQ ID NO: 291885 - DNA, 25 bp, Rattus norvegicus
gaacacggcgtgagcttgggactac

SEQ ID NO: 291886 - DNA, 25 bp, Rattus norvegicus
gaacacggcgtgtgcttgggactac

SEQ ID NO: 291887 - DNA, 25 bp, Rattus norvegicus
gaacacgggagcacactgtggagaa

SEQ ID NO: 291888 - DNA, 25 bp, Rattus norvegicus
gaacacgggagctcactgtggagaa

SEQ ID NO: 291889 - DNA, 25 bp, Rattus norvegicus
gaacacgggcatctccaaacagtct

SEQ ID NO: 291890 - DNA, 25 bp, Rattus norvegicus
gaacacgggcatgtccaaacagtct

SEQ ID NO: 291891 - DNA, 25 bp, Rattus norvegicus
gaacacgggcttatatctcttcagt

SEQ ID NO: 291892 - DNA, 25 bp, Rattus norvegicus
gaacacgggcttttatctcttcagt

SEQ ID NO: 291893 - DNA, 25 bp, Rattus norvegicus
gaacacggtctcagctagggaaaac

SEQ ID NO: 291894 - DNA, 25 bp, Rattus norvegicus
gaacacggtctctgctagggaaaac

SEQ ID NO: 291895 - DNA, 25 bp, Rattus norvegicus
gaacacggtcttcaggtggacacct

SEQ ID NO: 291896 - DNA, 25 bp, Rattus norvegicus
gaacacggtcttgaggtggacacct

SEQ ID NO: 291897 - DNA, 25 bp, Rattus norvegicus
gaacacggtgcaccccgagctcgag

SEQ ID NO: 291898 - DNA, 25 bp, Rattus norvegicus
gaacacggtgcagcccgagctcgag

SEQ ID NO: 291899 - DNA, 25 bp, Rattus norvegicus
gaacacgtagcaccatgagatcacc

SEQ ID NO: 291900 - DNA, 25 bp, Rattus norvegicus
gaacacgtagcagcatgagatcacc

SEQ ID NO: 291901 - DNA, 25 bp, Rattus norvegicus
gaacacgtggtcagaaaacaagctc

SEQ ID NO: 291902 - DNA, 25 bp, Rattus norvegicus
gaacacgtggtctgaaaacaagctc

SEQ ID NO: 291903 - DNA, 25 bp, Rattus norvegicus
gaacacgtggttatgaacagctcct

SEQ ID NO: 291904 - DNA, 25 bp, Rattus norvegicus
gaacacgtggttttgaacagctcct

SEQ ID NO: 291905 - DNA, 25 bp, Rattus norvegicus
gaacacgtgtgtcgcaggtccatcg

SEQ ID NO: 291906 - DNA, 25 bp, Rattus norvegicus
gaacacgtgtgtggcaggtccatcg

SEQ ID NO: 291907 - DNA, 25 bp, Rattus norvegicus
gaacacgttaggattctagcactcg

SEQ ID NO: 291908 - DNA, 25 bp, Rattus norvegicus
gaacacgttaggtttctagcactcg

SEQ ID NO: 291909 - DNA, 25 bp, Rattus norvegicus
gaacactaacctacatgagactacg

SEQ ID NO: 291910 - DNA, 25 bp, Rattus norvegicus
gaacactaacctagtatgcattaac

SEQ ID NO: 291911 - DNA, 25 bp, Rattus norvegicus
gaacactaaccttcatgagactacg

SEQ ID NO: 291912 - DNA, 25 bp, Rattus norvegicus
gaacactaaccttgtatgcattaac

SEQ ID NO: 291913 - DNA, 25 bp, Rattus norvegicus
gaacactaaggactgcagctactaa

SEQ ID NO: 291914 - DNA, 25 bp, Rattus norvegicus
gaacactaaggagtgcagctactaa

SEQ ID NO: 291915 - DNA, 25 bp, Rattus norvegicus
gaacactaagtgactcctcttgttg

SEQ ID NO: 291916 - DNA, 25 bp, Rattus norvegicus
gaacactaagtgtctcctcttgttg

SEQ ID NO: 291917 - DNA, 25 bp, Rattus norvegicus
gaacactactgtaactacctactga

SEQ ID NO: 291918 - DNA, 25 bp, Rattus norvegicus
gaacactactgttactacctactga

SEQ ID NO: 291919 - DNA, 25 bp, Rattus norvegicus
gaacactacttcagctgttaggcac

SEQ ID NO: 291920 - DNA, 25 bp, Rattus norvegicus
gaacactacttctgctgttaggcac

SEQ ID NO: 291921 - DNA, 25 bp, Rattus norvegicus
gaacactaggttaacctcccatgac

SEQ ID NO: 291922 - DNA, 25 bp, Rattus norvegicus
gaacactaggtttacctcccatgac

SEQ ID NO: 291923 - DNA, 25 bp, Rattus norvegicus
gaacactagtgcaccttgagaggac

SEQ ID NO: 291924 - DNA, 25 bp, Rattus norvegicus
gaacactagtgctccttgagaggac

SEQ ID NO: 291925 - DNA, 25 bp, Rattus norvegicus
gaacactataaaccctccatctgat

SEQ ID NO: 291926 - DNA, 25 bp, Rattus norvegicus
gaacactataaagcctccatctgat

SEQ ID NO: 291927 - DNA, 25 bp, Rattus norvegicus
gaacactattccacaaaagccacaa

SEQ ID NO: 291928 - DNA, 25 bp, Rattus norvegicus
gaacactattcctcaaaagccacaa

SEQ ID NO: 291929 - DNA, 25 bp, Rattus norvegicus
gaacactattctagctctgtctaat

SEQ ID NO: 291930 - DNA, 25 bp, Rattus norvegicus
gaacactattcttgctctgtctaat

SEQ ID NO: 291931 - DNA, 25 bp, Rattus norvegicus
gaacactattttcataccctacttt

SEQ ID NO: 291932 - DNA, 25 bp, Rattus norvegicus
gaacactattttgataccctacttt

SEQ ID NO: 291933 - DNA, 25 bp, Rattus norvegicus
gaacactcagagaatatggccttgc

SEQ ID NO: 291934 - DNA, 25 bp, Rattus norvegicus
gaacactcagagagtggctctgtct

SEQ ID NO: 291935 - DNA, 25 bp, Rattus norvegicus
gaacactcagagtatatggccttgc

SEQ ID NO: 291936 - DNA, 25 bp, Rattus norvegicus
gaacactcagagtgtggctctgtct

SEQ ID NO: 291937 - DNA, 25 bp, Rattus norvegicus
gaacactcagctcaggaagatggca

SEQ ID NO: 291938 - DNA, 25 bp, Rattus norvegicus
gaacactcagctgaggaagatggca

SEQ ID NO: 291939 - DNA, 25 bp, Rattus norvegicus
gaacactcattaatccctatctttt

SEQ ID NO: 291940 - DNA, 25 bp, Rattus norvegicus
gaacactcattattccctatctttt

SEQ ID NO: 291941 - DNA, 25 bp, Rattus norvegicus
gaacactcatttcctactggacatg

SEQ ID NO: 291942 - DNA, 25 bp, Rattus norvegicus
gaacactcatttgctactggacatg

SEQ ID NO: 291943 - DNA, 25 bp, Rattus norvegicus
gaacactccaaaatggtctcatttg

SEQ ID NO: 291944 - DNA, 25 bp, Rattus norvegicus
gaacactccaaattggtctcatttg

SEQ ID NO: 291945 - DNA, 25 bp, Rattus norvegicus
gaacactcccagattacagcaggaa

SEQ ID NO: 291946 - DNA, 25 bp, Rattus norvegicus
gaacactcccagtttacagcaggaa

SEQ ID NO: 291947 - DNA, 25 bp, Rattus norvegicus
gaacactccgtaacagcaatgctaa

SEQ ID NO: 291948 - DNA, 25 bp, Rattus norvegicus
gaacactccgtatcagcaatgctaa

SEQ ID NO: 291949 - DNA, 25 bp, Rattus norvegicus
gaacactcctaaccaacatttgctg

SEQ ID NO: 291950 - DNA, 25 bp, Rattus norvegicus
gaacactcctaagcaacatttgctg

SEQ ID NO: 291951 - DNA, 25 bp, Rattus norvegicus
gaacactcctccacactggaggagg

SEQ ID NO: 291952 - DNA, 25 bp, Rattus norvegicus
gaacactcctcctcactggaggagg

SEQ ID NO: 291953 - DNA, 25 bp, Rattus norvegicus
gaacactcctgaataagacggttga

SEQ ID NO: 291954 - DNA, 25 bp, Rattus norvegicus
gaacactcctgattaagacggttga

SEQ ID NO: 291955 - DNA, 25 bp, Rattus norvegicus
gaacactcctgtaccaactggacat

SEQ ID NO: 291956 - DNA, 25 bp, Rattus norvegicus
gaacactcctgttccaactggacat

SEQ ID NO: 291957 - DNA, 25 bp, Rattus norvegicus
gaacactcggtccattcgtgctgag

SEQ ID NO: 291958 - DNA, 25 bp, Rattus norvegicus
gaacactcggtcgattcgtgctgag

SEQ ID NO: 291959 - DNA, 25 bp, Rattus norvegicus
gaacactcgtggagtgctctgacct

SEQ ID NO: 291960 - DNA, 25 bp, Rattus norvegicus
gaacactcgtggtgtgctctgacct

SEQ ID NO: 291961 - DNA, 25 bp, Rattus norvegicus
gaacactcgtgtattgtccaaaagt

SEQ ID NO: 291962 - DNA, 25 bp, Rattus norvegicus
gaacactcgtgttttgtccaaaagt

SEQ ID NO: 291963 - DNA, 25 bp, Rattus norvegicus
gaacactctaaaactctacacgtct

SEQ ID NO: 291964 - DNA, 25 bp, Rattus norvegicus
gaacactctaaatctctacacgtct

SEQ ID NO: 291965 - DNA, 25 bp, Rattus norvegicus
gaacactctgagacttgcgacaatg

SEQ ID NO: 291966 - DNA, 25 bp, Rattus norvegicus
gaacactctgagcaatttcttgctc

SEQ ID NO: 291967 - DNA, 25 bp, Rattus norvegicus
gaacactctgaggaatttcttgctc

SEQ ID NO: 291968 - DNA, 25 bp, Rattus norvegicus
gaacactctgagtcttgcgacaatg

SEQ ID NO: 291969 - DNA, 25 bp, Rattus norvegicus
gaacactctgttccgatttggacct

SEQ ID NO: 291970 - DNA, 25 bp, Rattus norvegicus
gaacactctgttgcgatttggacct

SEQ ID NO: 291971 - DNA, 25 bp, Rattus norvegicus
gaacactgacttagtttagctggaa

SEQ ID NO: 291972 - DNA, 25 bp, Rattus norvegicus
gaacactgactttgtttagctggaa

SEQ ID NO: 291973 - DNA, 25 bp, Rattus norvegicus
gaacactgagctcgccctgctggag

SEQ ID NO: 291974 - DNA, 25 bp, Rattus norvegicus
gaacactgagctggccctgctggag

SEQ ID NO: 291975 - DNA, 25 bp, Rattus norvegicus
gaacactgaggcaaacaccgagtct

SEQ ID NO: 291976 - DNA, 25 bp, Rattus norvegicus
gaacactgaggctaacaccgagtct

SEQ ID NO: 291977 - DNA, 25 bp, Rattus norvegicus
gaacactgagttatcaagatgcctt

SEQ ID NO: 291978 - DNA, 25 bp, Rattus norvegicus
gaacactgagttttcaagatgcctt

SEQ ID NO: 291979 - DNA, 25 bp, Rattus norvegicus
gaacactgatccaggttcccaggga

SEQ ID NO: 291980 - DNA, 25 bp, Rattus norvegicus
gaacactgatcctggttcccaggga

SEQ ID NO: 291981 - DNA, 25 bp, Rattus norvegicus
gaacactgcaacagagtgccactgt

SEQ ID NO: 291982 - DNA, 25 bp, Rattus norvegicus
gaacactgcaactgagtgccactgt

SEQ ID NO: 291983 - DNA, 25 bp, Rattus norvegicus
gaacactgcactctggtggctttat

SEQ ID NO: 291984 - DNA, 25 bp, Rattus norvegicus
gaacactgcactgtggtggctttat

SEQ ID NO: 291985 - DNA, 25 bp, Rattus norvegicus
gaacactgcagaacaaagtccacct

SEQ ID NO: 291986 - DNA, 25 bp, Rattus norvegicus
gaacactgcagatcaaagtccacct

SEQ ID NO: 291987 - DNA, 25 bp, Rattus norvegicus
gaacactgcagtatgcgaggctggt

SEQ ID NO: 291988 - DNA, 25 bp, Rattus norvegicus
gaacactgcagtttgcgaggctggt

SEQ ID NO: 291989 - DNA, 25 bp, Rattus norvegicus
gaacactgccaccagagctgtacag

SEQ ID NO: 291990 - DNA, 25 bp, Rattus norvegicus
gaacactgccacgagagctgtacag

SEQ ID NO: 291991 - DNA, 25 bp, Rattus norvegicus
gaacactgcctcatggccaggacgg

SEQ ID NO: 291992 - DNA, 25 bp, Rattus norvegicus
gaacactgcctccaagtatcttata

SEQ ID NO: 291993 - DNA, 25 bp, Rattus norvegicus
gaacactgcctcgaagtatcttata

SEQ ID NO: 291994 - DNA, 25 bp, Rattus norvegicus
gaacactgcctcttggccaggacgg

SEQ ID NO: 291995 - DNA, 25 bp, Rattus norvegicus
gaacactggatgctccttcaacaca

SEQ ID NO: 291996 - DNA, 25 bp, Rattus norvegicus
gaacactggatggtccttcaacaca

SEQ ID NO: 291997 - DNA, 25 bp, Rattus norvegicus
gaacactggctcacaaactatccta

SEQ ID NO: 291998 - DNA, 25 bp, Rattus norvegicus
gaacactggctctcaaactatccta

SEQ ID NO: 291999 - DNA, 25 bp, Rattus norvegicus
gaacactggtgtctggctgcagcca

SEQ ID NO: 292000 - DNA, 25 bp, Rattus norvegicus
gaacactggtgtgtggctgcagcca

SEQ ID NO: 292001 - DNA, 25 bp, Rattus norvegicus
gaacactgtcatagtggtgcggcct

SEQ ID NO: 292002 - DNA, 25 bp, Rattus norvegicus
gaacactgtcattgtggtgcggcct

SEQ ID NO: 292003 - DNA, 25 bp, Rattus norvegicus
gaacactgtctacgtactgggcact

SEQ ID NO: 292004 - DNA, 25 bp, Rattus norvegicus
gaacactgtctaggtactgggcact

SEQ ID NO: 292005 - DNA, 25 bp, Rattus norvegicus
gaacactgtgaccagtgtcagcact

SEQ ID NO: 292006 - DNA, 25 bp, Rattus norvegicus
gaacactgtgacgagtgtcagcact

SEQ ID NO: 292007 - DNA, 25 bp, Rattus norvegicus
gaacactgtgcacaatgcctgactc

SEQ ID NO: 292008 - DNA, 25 bp, Rattus norvegicus
gaacactgtgcagaatgcctgactc

SEQ ID NO: 292009 - DNA, 25 bp, Rattus norvegicus
gaacacttaaatctccccagatcat

SEQ ID NO: 292010 - DNA, 25 bp, Rattus norvegicus
gaacacttaaatgtccccagatcat

SEQ ID NO: 292011 - DNA, 25 bp, Rattus norvegicus
gaacacttaatcctggccttttttg

SEQ ID NO: 292012 - DNA, 25 bp, Rattus norvegicus
gaacacttaatcgtggccttttttg

SEQ ID NO: 292013 - DNA, 25 bp, Rattus norvegicus
gaacacttacacacagtcttgcagt

SEQ ID NO: 292014 - DNA, 25 bp, Rattus norvegicus
gaacacttacactcagtcttgcagt

SEQ ID NO: 292015 - DNA, 25 bp, Rattus norvegicus
gaacacttacataggactgtggtct

SEQ ID NO: 292016 - DNA, 25 bp, Rattus norvegicus
gaacacttacattggactgtggtct

SEQ ID NO: 292017 - DNA, 25 bp, Rattus norvegicus
gaacacttacctattgacctaatgt

SEQ ID NO: 292018 - DNA, 25 bp, Rattus norvegicus
gaacacttaccttttgacctaatgt

SEQ ID NO: 292019 - DNA, 25 bp, Rattus norvegicus
gaacacttagaccagcctcaaggag

SEQ ID NO: 292020 - DNA, 25 bp, Rattus norvegicus
gaacacttagacgagcctcaaggag

SEQ ID NO: 292021 - DNA, 25 bp, Rattus norvegicus
gaacacttagatacagaacactgga

SEQ ID NO: 292022 - DNA, 25 bp, Rattus norvegicus
gaacacttagattcagaacactgga

SEQ ID NO: 292023 - DNA, 25 bp, Rattus norvegicus
gaacacttatccaagtcagctacga

SEQ ID NO: 292024 - DNA, 25 bp, Rattus norvegicus
gaacacttatcctagtcagctacga

SEQ ID NO: 292025 - DNA, 25 bp, Rattus norvegicus
gaacacttcaaacggttgcgggtcg

SEQ ID NO: 292026 - DNA, 25 bp, Rattus norvegicus
gaacacttcaaagggttgcgggtcg

SEQ ID NO: 292027 - DNA, 25 bp, Rattus norvegicus
gaacacttcaagatgcgttagacat

SEQ ID NO: 292028 - DNA, 25 bp, Rattus norvegicus
gaacacttcaagttgcgttagacat

SEQ ID NO: 292029 - DNA, 25 bp, Rattus norvegicus
gaacacttccccaaaatctaaggca

SEQ ID NO: 292030 - DNA, 25 bp, Rattus norvegicus
gaacacttcccctaaatctaaggca

SEQ ID NO: 292031 - DNA, 25 bp, Rattus norvegicus
gaacacttccttatctcatgtataa

SEQ ID NO: 292032 - DNA, 25 bp, Rattus norvegicus
gaacacttccttttctcatgtataa

SEQ ID NO: 292033 - DNA, 25 bp, Rattus norvegicus
gaacacttctgactacgacagcaag

SEQ ID NO: 292034 - DNA, 25 bp, Rattus norvegicus
gaacacttctgagtacgacagcaag

SEQ ID NO: 292035 - DNA, 25 bp, Rattus norvegicus
gaacacttgagtatcctagaacaga

SEQ ID NO: 292036 - DNA, 25 bp, Rattus norvegicus
gaacacttgagtttcctagaacaga

SEQ ID NO: 292037 - DNA, 25 bp, Rattus norvegicus
gaacacttgctgaacaactgtcctc

SEQ ID NO: 292038 - DNA, 25 bp, Rattus norvegicus
gaacacttgctgatgtggttgttac

SEQ ID NO: 292039 - DNA, 25 bp, Rattus norvegicus
gaacacttgctgtacaactgtcctc

SEQ ID NO: 292040 - DNA, 25 bp, Rattus norvegicus
gaacacttgctgttgtggttgttac

SEQ ID NO: 292041 - DNA, 25 bp, Rattus norvegicus
gaacacttggctactctgagttttc

SEQ ID NO: 292042 - DNA, 25 bp, Rattus norvegicus
gaacacttggcttctctgagttttc

SEQ ID NO: 292043 - DNA, 25 bp, Rattus norvegicus
gaacacttgtataccattcaacaca

SEQ ID NO: 292044 - DNA, 25 bp, Rattus norvegicus
gaacacttgtatatccaaagggaat

SEQ ID NO: 292045 - DNA, 25 bp, Rattus norvegicus
gaacacttgtattccattcaacaca

SEQ ID NO: 292046 - DNA, 25 bp, Rattus norvegicus
gaacacttgtatttccaaagggaat

SEQ ID NO: 292047 - DNA, 25 bp, Rattus norvegicus
gaacactttctcagtagtttctttc

SEQ ID NO: 292048 - DNA, 25 bp, Rattus norvegicus
gaacactttctctgtagtttctttc

SEQ ID NO: 292049 - DNA, 25 bp, Rattus norvegicus
gaacactttcttagactacattagg

SEQ ID NO: 292050 - DNA, 25 bp, Rattus norvegicus
gaacactttcttcggatcactctac

SEQ ID NO: 292051 - DNA, 25 bp, Rattus norvegicus
gaacactttcttgggatcactctac

SEQ ID NO: 292052 - DNA, 25 bp, Rattus norvegicus
gaacactttctttgactacattagg

SEQ ID NO: 292053 - DNA, 25 bp, Rattus norvegicus
gaacacttttctcttttgttgtaag

SEQ ID NO: 292054 - DNA, 25 bp, Rattus norvegicus
gaacacttttctgttttgttgtaag

SEQ ID NO: 292055 - DNA, 25 bp, Rattus norvegicus
gaacagaaactcctgcttcaccgaa

SEQ ID NO: 292056 - DNA, 25 bp, Rattus norvegicus
gaacagaaactcgtgcttcaccgaa

SEQ ID NO: 292057 - DNA, 25 bp, Rattus norvegicus
gaacagaaactgcacccttgggacc

SEQ ID NO: 292058 - DNA, 25 bp, Rattus norvegicus
gaacagaaactggacccttgggacc

SEQ ID NO: 292059 - DNA, 25 bp, Rattus norvegicus
gaacagaaagcacccactaccttgg

SEQ ID NO: 292060 - DNA, 25 bp, Rattus norvegicus
gaacagaaagcagccactaccttgg

SEQ ID NO: 292061 - DNA, 25 bp, Rattus norvegicus
gaacagaacagcaagggctccgtct

SEQ ID NO: 292062 - DNA, 25 bp, Rattus norvegicus
gaacagaacagctagggctccgtct

SEQ ID NO: 292063 - DNA, 25 bp, Rattus norvegicus
gaacagaacaggacgtgaagccagc

SEQ ID NO: 292064 - DNA, 25 bp, Rattus norvegicus
gaacagaacaggtcgtgaagccagc

SEQ ID NO: 292065 - DNA, 25 bp, Rattus norvegicus
gaacagaaccagagtggctcctgag

SEQ ID NO: 292066 - DNA, 25 bp, Rattus norvegicus
gaacagaaccagtgtggctcctgag

SEQ ID NO: 292067 - DNA, 25 bp, Rattus norvegicus
gaacagaactgaaccggctttacca

SEQ ID NO: 292068 - DNA, 25 bp, Rattus norvegicus
gaacagaactgatccggctttacca

SEQ ID NO: 292069 - DNA, 25 bp, Rattus norvegicus
gaacagaactgcacgctgagcgcct

SEQ ID NO: 292070 - DNA, 25 bp, Rattus norvegicus
gaacagaactgcactttcatcttgt

SEQ ID NO: 292071 - DNA, 25 bp, Rattus norvegicus
gaacagaactgctcgctgagcgcct

SEQ ID NO: 292072 - DNA, 25 bp, Rattus norvegicus
gaacagaactgctctttcatcttgt

SEQ ID NO: 292073 - DNA, 25 bp, Rattus norvegicus
gaacagaacttcctatcacgggcca

SEQ ID NO: 292074 - DNA, 25 bp, Rattus norvegicus
gaacagaacttcgtatcacgggcca

SEQ ID NO: 292075 - DNA, 25 bp, Rattus norvegicus
gaacagaacttgatatcttcctaat

SEQ ID NO: 292076 - DNA, 25 bp, Rattus norvegicus
gaacagaacttgttatcttcctaat

SEQ ID NO: 292077 - DNA, 25 bp, Rattus norvegicus
gaacagaagcgcattgccaggcttg

SEQ ID NO: 292078 - DNA, 25 bp, Rattus norvegicus
gaacagaagcgctttgccaggcttg

SEQ ID NO: 292079 - DNA, 25 bp, Rattus norvegicus
gaacagaaggcccatgtcactttac

SEQ ID NO: 292080 - DNA, 25 bp, Rattus norvegicus
gaacagaaggccgatgtcactttac

SEQ ID NO: 292081 - DNA, 25 bp, Rattus norvegicus
gaacagaagggcacctgccttccct

SEQ ID NO: 292082 - DNA, 25 bp, Rattus norvegicus
gaacagaagggctcctgccttccct

SEQ ID NO: 292083 - DNA, 25 bp, Rattus norvegicus
gaacagaaggttcagcttgcacagc

SEQ ID NO: 292084 - DNA, 25 bp, Rattus norvegicus
gaacagaaggttgagcttgcacagc

SEQ ID NO: 292085 - DNA, 25 bp, Rattus norvegicus
gaacagaatcctcaccaccgacggg

SEQ ID NO: 292086 - DNA, 25 bp, Rattus norvegicus
gaacagaatcctgaccaccgacggg

SEQ ID NO: 292087 - DNA, 25 bp, Rattus norvegicus
gaacagaatgcactttgtccacagg

SEQ ID NO: 292088 - DNA, 25 bp, Rattus norvegicus
gaacagaatgcagtttgtccacagg

SEQ ID NO: 292089 - DNA, 25 bp, Rattus norvegicus
gaacagaattcaaagcactttggct

SEQ ID NO: 292090 - DNA, 25 bp, Rattus norvegicus
gaacagaattcaatgtctcccttga

SEQ ID NO: 292091 - DNA, 25 bp, Rattus norvegicus
gaacagaattcatagcactttggct

SEQ ID NO: 292092 - DNA, 25 bp, Rattus norvegicus
gaacagaattcattgtctcccttga

SEQ ID NO: 292093 - DNA, 25 bp, Rattus norvegicus
gaacagaattttccggctatcgcta

SEQ ID NO: 292094 - DNA, 25 bp, Rattus norvegicus
gaacagaattttgcggctatcgcta

SEQ ID NO: 292095 - DNA, 25 bp, Rattus norvegicus
gaacagacagacatacggagagaca

SEQ ID NO: 292096 - DNA, 25 bp, Rattus norvegicus
gaacagacagacctttacagccaat

SEQ ID NO: 292097 - DNA, 25 bp, Rattus norvegicus
gaacagacagacgtttacagccaat

SEQ ID NO: 292098 - DNA, 25 bp, Rattus norvegicus
gaacagacagacttacggagagaca

SEQ ID NO: 292099 - DNA, 25 bp, Rattus norvegicus
gaacagacagcgctgaagtccttcc

SEQ ID NO: 292100 - DNA, 25 bp, Rattus norvegicus
gaacagacagcggtgaagtccttcc

SEQ ID NO: 292101 - DNA, 25 bp, Rattus norvegicus
gaacagacattccactgaccggatg

SEQ ID NO: 292102 - DNA, 25 bp, Rattus norvegicus
gaacagacattcgactgaccggatg

SEQ ID NO: 292103 - DNA, 25 bp, Rattus norvegicus
gaacagaccacaatctatactagac

SEQ ID NO: 292104 - DNA, 25 bp, Rattus norvegicus
gaacagaccacattctatactagac

SEQ ID NO: 292105 - DNA, 25 bp, Rattus norvegicus
gaacagacccttcatgagaaacaaa

SEQ ID NO: 292106 - DNA, 25 bp, Rattus norvegicus
gaacagacccttgatgagaaacaaa

SEQ ID NO: 292107 - DNA, 25 bp, Rattus norvegicus
gaacagacctggctaactccatttt

SEQ ID NO: 292108 - DNA, 25 bp, Rattus norvegicus
gaacagacctgggtaactccatttt

SEQ ID NO: 292109 - DNA, 25 bp, Rattus norvegicus
gaacagacgagccatcaggactcct

SEQ ID NO: 292110 - DNA, 25 bp, Rattus norvegicus
gaacagacgagcgatcaggactcct

SEQ ID NO: 292111 - DNA, 25 bp, Rattus norvegicus
gaacagacggtaccgtgctgtgcct

SEQ ID NO: 292112 - DNA, 25 bp, Rattus norvegicus
gaacagacggtagcgtgctgtgcct

SEQ ID NO: 292113 - DNA, 25 bp, Rattus norvegicus
gaacagacggtcactatggcaacca

SEQ ID NO: 292114 - DNA, 25 bp, Rattus norvegicus
gaacagacggtctctatggcaacca

SEQ ID NO: 292115 - DNA, 25 bp, Rattus norvegicus
gaacagacgtctcctggatgcctct

SEQ ID NO: 292116 - DNA, 25 bp, Rattus norvegicus
gaacagacgtctgctggatgcctct

SEQ ID NO: 292117 - DNA, 25 bp, Rattus norvegicus
gaacagacgttgaccatgcaccaag

SEQ ID NO: 292118 - DNA, 25 bp, Rattus norvegicus
gaacagacgttgtccatgcaccaag

SEQ ID NO: 292119 - DNA, 25 bp, Rattus norvegicus
gaacagactcagccgatgtgcttta

SEQ ID NO: 292120 - DNA, 25 bp, Rattus norvegicus
gaacagactcaggcgatgtgcttta

SEQ ID NO: 292121 - DNA, 25 bp, Rattus norvegicus
gaacagacttggctctgacaaccca

SEQ ID NO: 292122 - DNA, 25 bp, Rattus norvegicus
gaacagacttgggtctgacaaccca

SEQ ID NO: 292123 - DNA, 25 bp, Rattus norvegicus
gaacagagacaaagatggcagcaaa

SEQ ID NO: 292124 - DNA, 25 bp, Rattus norvegicus
gaacagagacaatgatggcagcaaa

SEQ ID NO: 292125 - DNA, 25 bp, Rattus norvegicus
gaacagagacacattgtatgagttg

SEQ ID NO: 292126 - DNA, 25 bp, Rattus norvegicus
gaacagagacactttgtatgagttg

SEQ ID NO: 292127 - DNA, 25 bp, Rattus norvegicus
gaacagagacagagctccctgagca

SEQ ID NO: 292128 - DNA, 25 bp, Rattus norvegicus
gaacagagacagtgctccctgagca

SEQ ID NO: 292129 - DNA, 25 bp, Rattus norvegicus
gaacagagacccacagcaagctttt

SEQ ID NO: 292130 - DNA, 25 bp, Rattus norvegicus
gaacagagaccctcagcaagctttt

SEQ ID NO: 292131 - DNA, 25 bp, Rattus norvegicus
gaacagagcaggactcatgcacctt

SEQ ID NO: 292132 - DNA, 25 bp, Rattus norvegicus
gaacagagcaggtctcatgcacctt

SEQ ID NO: 292133 - DNA, 25 bp, Rattus norvegicus
gaacagagccctctcgagtgggacc

SEQ ID NO: 292134 - DNA, 25 bp, Rattus norvegicus
gaacagagccctgtcgagtgggacc

SEQ ID NO: 292135 - DNA, 25 bp, Rattus norvegicus
gaacagagcctgaacacaatggaga

SEQ ID NO: 292136 - DNA, 25 bp, Rattus norvegicus
gaacagagcctgtacacaatggaga

SEQ ID NO: 292137 - DNA, 25 bp, Rattus norvegicus
gaacagagcgagagctcactgtgta

SEQ ID NO: 292138 - DNA, 25 bp, Rattus norvegicus
gaacagagcgagtgctcactgtgta

SEQ ID NO: 292139 - DNA, 25 bp, Rattus norvegicus
gaacagagctagacctgagccagta

SEQ ID NO: 292140 - DNA, 25 bp, Rattus norvegicus
gaacagagctagtcctgagccagta

SEQ ID NO: 292141 - DNA, 25 bp, Rattus norvegicus
gaacagagctctatactgcttgagt

SEQ ID NO: 292142 - DNA, 25 bp, Rattus norvegicus
gaacagagctctttactgcttgagt

SEQ ID NO: 292143 - DNA, 25 bp, Rattus norvegicus
gaacagaggccactgcagcagatgc

SEQ ID NO: 292144 - DNA, 25 bp, Rattus norvegicus
gaacagaggccagtgcagcagatgc

SEQ ID NO: 292145 - DNA, 25 bp, Rattus norvegicus
gaacagagtccacttactcgctctt

SEQ ID NO: 292146 - DNA, 25 bp, Rattus norvegicus
gaacagagtccagttactcgctctt

SEQ ID NO: 292147 - DNA, 25 bp, Rattus norvegicus
gaacagagtctgctactgctcacag

SEQ ID NO: 292148 - DNA, 25 bp, Rattus norvegicus
gaacagagtctggtactgctcacag

SEQ ID NO: 292149 - DNA, 25 bp, Rattus norvegicus
gaacagagtgctacacgactgacca

SEQ ID NO: 292150 - DNA, 25 bp, Rattus norvegicus
gaacagagtgcttcacgactgacca

SEQ ID NO: 292151 - DNA, 25 bp, Rattus norvegicus
gaacagagtgtgagcacggcctcgc

SEQ ID NO: 292152 - DNA, 25 bp, Rattus norvegicus
gaacagagtgtgtgcacggcctcgc

SEQ ID NO: 292153 - DNA, 25 bp, Rattus norvegicus
gaacagatacatccctattatttta

SEQ ID NO: 292154 - DNA, 25 bp, Rattus norvegicus
gaacagatacatgcctattatttta

SEQ ID NO: 292155 - DNA, 25 bp, Rattus norvegicus
gaacagatagagacatttgccaaca

SEQ ID NO: 292156 - DNA, 25 bp, Rattus norvegicus
gaacagatagagtcatttgccaaca

SEQ ID NO: 292157 - DNA, 25 bp, Rattus norvegicus
gaacagatccacagttgccatggtg

SEQ ID NO: 292158 - DNA, 25 bp, Rattus norvegicus
gaacagatccactgttgccatggtg

SEQ ID NO: 292159 - DNA, 25 bp, Rattus norvegicus
gaacagatctaactctttgtctttt

SEQ ID NO: 292160 - DNA, 25 bp, Rattus norvegicus
gaacagatctaagtctttgtctttt

SEQ ID NO: 292161 - DNA, 25 bp, Rattus norvegicus
gaacagatctcaattggaacgtatt

SEQ ID NO: 292162 - DNA, 25 bp, Rattus norvegicus
gaacagatctcatttggaacgtatt

SEQ ID NO: 292163 - DNA, 25 bp, Rattus norvegicus
gaacagatcttaagcccactacatt

SEQ ID NO: 292164 - DNA, 25 bp, Rattus norvegicus
gaacagatcttatgcccactacatt

SEQ ID NO: 292165 - DNA, 25 bp, Rattus norvegicus
gaacagatgcccaaaccaacgtgat

SEQ ID NO: 292166 - DNA, 25 bp, Rattus norvegicus
gaacagatgccctaaccaacgtgat

SEQ ID NO: 292167 - DNA, 25 bp, Rattus norvegicus
gaacagatgggtagcctctttgctt

SEQ ID NO: 292168 - DNA, 25 bp, Rattus norvegicus
gaacagatgggttgcctctttgctt

SEQ ID NO: 292169 - DNA, 25 bp, Rattus norvegicus
gaacagatgtatcagcctcagcaaa

SEQ ID NO: 292170 - DNA, 25 bp, Rattus norvegicus
gaacagatgtatgagcctcagcaaa

SEQ ID NO: 292171 - DNA, 25 bp, Rattus norvegicus
gaacagattcaaagaggcgcagcct

SEQ ID NO: 292172 - DNA, 25 bp, Rattus norvegicus
gaacagattcaatgaggcgcagcct

SEQ ID NO: 292173 - DNA, 25 bp, Rattus norvegicus
gaacagattcagctacagtaaagct

SEQ ID NO: 292174 - DNA, 25 bp, Rattus norvegicus
gaacagattcaggtacagtaaagct

SEQ ID NO: 292175 - DNA, 25 bp, Rattus norvegicus
gaacagattctgatagaaaccctaa

SEQ ID NO: 292176 - DNA, 25 bp, Rattus norvegicus
gaacagattctgttagaaaccctaa

SEQ ID NO: 292177 - DNA, 25 bp, Rattus norvegicus
gaacagattgaaagccagccttcct

SEQ ID NO: 292178 - DNA, 25 bp, Rattus norvegicus
gaacagattgaatgccagccttcct

SEQ ID NO: 292179 - DNA, 25 bp, Rattus norvegicus
gaacagattggaccgctgacctctt

SEQ ID NO: 292180 - DNA, 25 bp, Rattus norvegicus
gaacagattggagcgctgacctctt

SEQ ID NO: 292181 - DNA, 25 bp, Rattus norvegicus
gaacagattggtctgatccctagta

SEQ ID NO: 292182 - DNA, 25 bp, Rattus norvegicus
gaacagattggtgtgatccctagta

SEQ ID NO: 292183 - DNA, 25 bp, Rattus norvegicus
gaacagattgttccaaagccagaag

SEQ ID NO: 292184 - DNA, 25 bp, Rattus norvegicus
gaacagattgttgcaaagccagaag

SEQ ID NO: 292185 - DNA, 25 bp, Rattus norvegicus
gaacagatttatcagctcttcagca

SEQ ID NO: 292186 - DNA, 25 bp, Rattus norvegicus
gaacagatttatgagctcttcagca

SEQ ID NO: 292187 - DNA, 25 bp, Rattus norvegicus
gaacagatttgtcacctgacctttg

SEQ ID NO: 292188 - DNA, 25 bp, Rattus norvegicus
gaacagatttgtgacctgacctttg

SEQ ID NO: 292189 - DNA, 25 bp, Rattus norvegicus
gaacagattttgagaagtgccttct

SEQ ID NO: 292190 - DNA, 25 bp, Rattus norvegicus
gaacagattttgtgaagtgccttct

SEQ ID NO: 292191 - DNA, 25 bp, Rattus norvegicus
gaacagcaaccactccaagggcttg

SEQ ID NO: 292192 - DNA, 25 bp, Rattus norvegicus
gaacagcaaccagtccaagggcttg

SEQ ID NO: 292193 - DNA, 25 bp, Rattus norvegicus
gaacagcaactcaggcatcatcaag

SEQ ID NO: 292194 - DNA, 25 bp, Rattus norvegicus
gaacagcaactctggcatcatcaag

SEQ ID NO: 292195 - DNA, 25 bp, Rattus norvegicus
gaacagcaatccaggaactgtccaa

SEQ ID NO: 292196 - DNA, 25 bp, Rattus norvegicus
gaacagcaatcctggaactgtccaa

SEQ ID NO: 292197 - DNA, 25 bp, Rattus norvegicus
gaacagcacacaaggctgcccggat

SEQ ID NO: 292198 - DNA, 25 bp, Rattus norvegicus
gaacagcacacatggctgcccggat

SEQ ID NO: 292199 - DNA, 25 bp, Rattus norvegicus
gaacagcacatcactgtccaggaaa

SEQ ID NO: 292200 - DNA, 25 bp, Rattus norvegicus
gaacagcacatctctgtccaggaaa

SEQ ID NO: 292201 - DNA, 25 bp, Rattus norvegicus
gaacagcaccctctcggagagcatg

SEQ ID NO: 292202 - DNA, 25 bp, Rattus norvegicus
gaacagcaccctgtcggagagcatg

SEQ ID NO: 292203 - DNA, 25 bp, Rattus norvegicus
gaacagcacctgatgaacactcggt

SEQ ID NO: 292204 - DNA, 25 bp, Rattus norvegicus
gaacagcacctgttgaacactcggt

SEQ ID NO: 292205 - DNA, 25 bp, Rattus norvegicus
gaacagcaccttactggaggagtac

SEQ ID NO: 292206 - DNA, 25 bp, Rattus norvegicus
gaacagcacctttctggaggagtac

SEQ ID NO: 292207 - DNA, 25 bp, Rattus norvegicus
gaacagcacgctcaactgtgccagc

SEQ ID NO: 292208 - DNA, 25 bp, Rattus norvegicus
gaacagcacgctgaactgtgccagc

SEQ ID NO: 292209 - DNA, 25 bp, Rattus norvegicus
gaacagcagagccaagacatcaact

SEQ ID NO: 292210 - DNA, 25 bp, Rattus norvegicus
gaacagcagagcgaagacatcaact

SEQ ID NO: 292211 - DNA, 25 bp, Rattus norvegicus
gaacagcagcggcacttccacggag

SEQ ID NO: 292212 - DNA, 25 bp, Rattus norvegicus
gaacagcagcgggacttccacggag

SEQ ID NO: 292213 - DNA, 25 bp, Rattus norvegicus
gaacagcagcgtatcataggaagag

SEQ ID NO: 292214 - DNA, 25 bp, Rattus norvegicus
gaacagcagcgtttcataggaagag

SEQ ID NO: 292215 - DNA, 25 bp, Rattus norvegicus
gaacagcagggtcccatagcacttt

SEQ ID NO: 292216 - DNA, 25 bp, Rattus norvegicus
gaacagcagggtgccatagcacttt

SEQ ID NO: 292217 - DNA, 25 bp, Rattus norvegicus
gaacagcagtagaaacaggctctct

SEQ ID NO: 292218 - DNA, 25 bp, Rattus norvegicus
gaacagcagtagaccacttcagcac

SEQ ID NO: 292219 - DNA, 25 bp, Rattus norvegicus
gaacagcagtagtaacaggctctct

SEQ ID NO: 292220 - DNA, 25 bp, Rattus norvegicus
gaacagcagtagtccacttcagcac

SEQ ID NO: 292221 - DNA, 25 bp, Rattus norvegicus
gaacagcatataatgggaaggcgat

SEQ ID NO: 292222 - DNA, 25 bp, Rattus norvegicus
gaacagcatatattgggaaggcgat

SEQ ID NO: 292223 - DNA, 25 bp, Rattus norvegicus
gaacagcatattagctgctccccaa

SEQ ID NO: 292224 - DNA, 25 bp, Rattus norvegicus
gaacagcatatttgctgctccccaa

SEQ ID NO: 292225 - DNA, 25 bp, Rattus norvegicus
gaacagcatcgtctggtgatcctgg

SEQ ID NO: 292226 - DNA, 25 bp, Rattus norvegicus
gaacagcatcgtgtggtgatcctgg

SEQ ID NO: 292227 - DNA, 25 bp, Rattus norvegicus
gaacagcattggagtgctctgtccg

SEQ ID NO: 292228 - DNA, 25 bp, Rattus norvegicus
gaacagcattggtgtgctctgtccg

SEQ ID NO: 292229 - DNA, 25 bp, Rattus norvegicus
gaacagcatttcatcagggtcatag

SEQ ID NO: 292230 - DNA, 25 bp, Rattus norvegicus
gaacagcatttcttcagggtcatag

SEQ ID NO: 292231 - DNA, 25 bp, Rattus norvegicus
gaacagcattttagggttccattgt

SEQ ID NO: 292232 - DNA, 25 bp, Rattus norvegicus
gaacagcatttttgggttccattgt

SEQ ID NO: 292233 - DNA, 25 bp, Rattus norvegicus
gaacagccaaccaagaatcacacag

SEQ ID NO: 292234 - DNA, 25 bp, Rattus norvegicus
gaacagccaacctagaatcacacag

SEQ ID NO: 292235 - DNA, 25 bp, Rattus norvegicus
gaacagccaatgagtccgaggcaat

SEQ ID NO: 292236 - DNA, 25 bp, Rattus norvegicus
gaacagccaatgatttgcacacaga

SEQ ID NO: 292237 - DNA, 25 bp, Rattus norvegicus
gaacagccaatgtgtccgaggcaat

SEQ ID NO: 292238 - DNA, 25 bp, Rattus norvegicus
gaacagccaatgttttgcacacaga

SEQ ID NO: 292239 - DNA, 25 bp, Rattus norvegicus
gaacagccagggatttggcctctga

SEQ ID NO: 292240 - DNA, 25 bp, Rattus norvegicus
gaacagccagggttttggcctctga

SEQ ID NO: 292241 - DNA, 25 bp, Rattus norvegicus
gaacagccagtaaacctgtgatcgc

SEQ ID NO: 292242 - DNA, 25 bp, Rattus norvegicus
gaacagccagtatacctgtgatcgc

SEQ ID NO: 292243 - DNA, 25 bp, Rattus norvegicus
gaacagccagtgctattaacaactg

SEQ ID NO: 292244 - DNA, 25 bp, Rattus norvegicus
gaacagccagtggtattaacaactg

SEQ ID NO: 292245 - DNA, 25 bp, Rattus norvegicus
gaacagccatcacaagtggtatatt

SEQ ID NO: 292246 - DNA, 25 bp, Rattus norvegicus
gaacagccatcagaagtggtatatt

SEQ ID NO: 292247 - DNA, 25 bp, Rattus norvegicus
gaacagcccaggaacaaacagcctc

SEQ ID NO: 292248 - DNA, 25 bp, Rattus norvegicus
gaacagcccaggtacaaacagcctc

SEQ ID NO: 292249 - DNA, 25 bp, Rattus norvegicus
gaacagccccggaggcagagcgata

SEQ ID NO: 292250 - DNA, 25 bp, Rattus norvegicus
gaacagccccggtggcagagcgata

SEQ ID NO: 292251 - DNA, 25 bp, Rattus norvegicus
gaacagcccgaacacattagtgagt

SEQ ID NO: 292252 - DNA, 25 bp, Rattus norvegicus
gaacagcccgaagacattagtgagt

SEQ ID NO: 292253 - DNA, 25 bp, Rattus norvegicus
gaacagccgagcaaacaatctagca

SEQ ID NO: 292254 - DNA, 25 bp, Rattus norvegicus
gaacagccgagctaacaatctagca

SEQ ID NO: 292255 - DNA, 25 bp, Rattus norvegicus
gaacagccgctgcagcctggtaaga

SEQ ID NO: 292256 - DNA, 25 bp, Rattus norvegicus
gaacagccgctggagcctggtaaga

SEQ ID NO: 292257 - DNA, 25 bp, Rattus norvegicus
gaacagccgggcatgcgccattgat

SEQ ID NO: 292258 - DNA, 25 bp, Rattus norvegicus
gaacagccgggcttgcgccattgat

SEQ ID NO: 292259 - DNA, 25 bp, Rattus norvegicus
gaacagcctcaaaagaaacccacat

SEQ ID NO: 292260 - DNA, 25 bp, Rattus norvegicus
gaacagcctcaatagaaacccacat

SEQ ID NO: 292261 - DNA, 25 bp, Rattus norvegicus
gaacagcctcttacttcagaagtcc

SEQ ID NO: 292262 - DNA, 25 bp, Rattus norvegicus
gaacagcctctttcttcagaagtcc

SEQ ID NO: 292263 - DNA, 25 bp, Rattus norvegicus
gaacagcctgagaagtcactttgga

SEQ ID NO: 292264 - DNA, 25 bp, Rattus norvegicus
gaacagcctgagtagtcactttgga

SEQ ID NO: 292265 - DNA, 25 bp, Rattus norvegicus
gaacagcctgatcaatgaacctcat

SEQ ID NO: 292266 - DNA, 25 bp, Rattus norvegicus
gaacagcctgatgaatgaacctcat

SEQ ID NO: 292267 - DNA, 25 bp, Rattus norvegicus
gaacagcctggcagcaccttggtgg

SEQ ID NO: 292268 - DNA, 25 bp, Rattus norvegicus
gaacagcctggctgcaccttggtgg

SEQ ID NO: 292269 - DNA, 25 bp, Rattus norvegicus
gaacagccttatctcacaagaaagc

SEQ ID NO: 292270 - DNA, 25 bp, Rattus norvegicus
gaacagccttatgtcacaagaaagc

SEQ ID NO: 292271 - DNA, 25 bp, Rattus norvegicus
gaacagccttggacagtgctgacct

SEQ ID NO: 292272 - DNA, 25 bp, Rattus norvegicus
gaacagccttggtcagtgctgacct

SEQ ID NO: 292273 - DNA, 25 bp, Rattus norvegicus
gaacagccttttatgactaacatgt

SEQ ID NO: 292274 - DNA, 25 bp, Rattus norvegicus
gaacagccttttttgactaacatgt

SEQ ID NO: 292275 - DNA, 25 bp, Rattus norvegicus
gaacagcgaaaccagcgtttgcgag

SEQ ID NO: 292276 - DNA, 25 bp, Rattus norvegicus
gaacagcgaaacgagcgtttgcgag

SEQ ID NO: 292277 - DNA, 25 bp, Rattus norvegicus
gaacagcgagatacatggccccgga

SEQ ID NO: 292278 - DNA, 25 bp, Rattus norvegicus
gaacagcgagattcatggccccgga

SEQ ID NO: 292279 - DNA, 25 bp, Rattus norvegicus
gaacagcgcaggaatatctcactca

SEQ ID NO: 292280 - DNA, 25 bp, Rattus norvegicus
gaacagcgcaggtatatctcactca

SEQ ID NO: 292281 - DNA, 25 bp, Rattus norvegicus
gaacagcgctggctaccttctgggc

SEQ ID NO: 292282 - DNA, 25 bp, Rattus norvegicus
gaacagcgctgggtaccttctgggc

SEQ ID NO: 292283 - DNA, 25 bp, Rattus norvegicus
gaacagcggcttcgtagaaagtgaa

SEQ ID NO: 292284 - DNA, 25 bp, Rattus norvegicus
gaacagcggcttggtagaaagtgaa

SEQ ID NO: 292285 - DNA, 25 bp, Rattus norvegicus
gaacagcgggccacttgggaagccg

SEQ ID NO: 292286 - DNA, 25 bp, Rattus norvegicus
gaacagcgggcctcttgggaagccg

SEQ ID NO: 292287 - DNA, 25 bp, Rattus norvegicus
gaacagcgggctattgtagatacaa

SEQ ID NO: 292288 - DNA, 25 bp, Rattus norvegicus
gaacagcgggcttttgtagatacaa

SEQ ID NO: 292289 - DNA, 25 bp, Rattus norvegicus
gaacagctaaccaactgcagtcttc

SEQ ID NO: 292290 - DNA, 25 bp, Rattus norvegicus
gaacagctaacctactgcagtcttc

SEQ ID NO: 292291 - DNA, 25 bp, Rattus norvegicus
gaacagctaatccacgtggctttgt

SEQ ID NO: 292292 - DNA, 25 bp, Rattus norvegicus
gaacagctaatcgacgtggctttgt

SEQ ID NO: 292293 - DNA, 25 bp, Rattus norvegicus
gaacagctacataggctcatgggaa

SEQ ID NO: 292294 - DNA, 25 bp, Rattus norvegicus
gaacagctacattggctcatgggaa

SEQ ID NO: 292295 - DNA, 25 bp, Rattus norvegicus
gaacagctacccattgtgagaactc

SEQ ID NO: 292296 - DNA, 25 bp, Rattus norvegicus
gaacagctaccctttgtgagaactc

SEQ ID NO: 292297 - DNA, 25 bp, Rattus norvegicus
gaacagctactgagtgcctagcact

SEQ ID NO: 292298 - DNA, 25 bp, Rattus norvegicus
gaacagctactgtgtgcctagcact

SEQ ID NO: 292299 - DNA, 25 bp, Rattus norvegicus
gaacagctagctcccctgaagaaac

SEQ ID NO: 292300 - DNA, 25 bp, Rattus norvegicus
gaacagctagctgccctgaagaaac

SEQ ID NO: 292301 - DNA, 25 bp, Rattus norvegicus
gaacagctatctaccactttaaatt

SEQ ID NO: 292302 - DNA, 25 bp, Rattus norvegicus
gaacagctatcttccactttaaatt

SEQ ID NO: 292303 - DNA, 25 bp, Rattus norvegicus
gaacagctcaaaccagccaaggact

SEQ ID NO: 292304 - DNA, 25 bp, Rattus norvegicus
gaacagctcaaagcagccaaggact

SEQ ID NO: 292305 - DNA, 25 bp, Rattus norvegicus
gaacagctcaacaaacacgggcagg

SEQ ID NO: 292306 - DNA, 25 bp, Rattus norvegicus
gaacagctcaactaacacgggcagg

SEQ ID NO: 292307 - DNA, 25 bp, Rattus norvegicus
gaacagctcagccaacccgaaatgg

SEQ ID NO: 292308 - DNA, 25 bp, Rattus norvegicus
gaacagctcagcgaacccgaaatgg

SEQ ID NO: 292309 - DNA, 25 bp, Rattus norvegicus
gaacagctccgtcaagcaatgtctt

SEQ ID NO: 292310 - DNA, 25 bp, Rattus norvegicus
gaacagctccgtgaagcaatgtctt

SEQ ID NO: 292311 - DNA, 25 bp, Rattus norvegicus
gaacagctctcgcattttatatgat

SEQ ID NO: 292312 - DNA, 25 bp, Rattus norvegicus
gaacagctctcggattttatatgat

SEQ ID NO: 292313 - DNA, 25 bp, Rattus norvegicus
gaacagctcttgacagattcctcag

SEQ ID NO: 292314 - DNA, 25 bp, Rattus norvegicus
gaacagctcttgcatctggatgccc

SEQ ID NO: 292315 - DNA, 25 bp, Rattus norvegicus
gaacagctcttggatctggatgccc

SEQ ID NO: 292316 - DNA, 25 bp, Rattus norvegicus
gaacagctcttgtcagattcctcag

SEQ ID NO: 292317 - DNA, 25 bp, Rattus norvegicus
gaacagctgaagacattgattctac

SEQ ID NO: 292318 - DNA, 25 bp, Rattus norvegicus
gaacagctgaagctatgaacactaa

SEQ ID NO: 292319 - DNA, 25 bp, Rattus norvegicus
gaacagctgaaggtatgaacactaa

SEQ ID NO: 292320 - DNA, 25 bp, Rattus norvegicus
gaacagctgaagtcattgattctac

SEQ ID NO: 292321 - DNA, 25 bp, Rattus norvegicus
gaacagctgacaactgcgggagttt

SEQ ID NO: 292322 - DNA, 25 bp, Rattus norvegicus
gaacagctgacatctgcgggagttt

SEQ ID NO: 292323 - DNA, 25 bp, Rattus norvegicus
gaacagctgcgtatcaaggcacaat

SEQ ID NO: 292324 - DNA, 25 bp, Rattus norvegicus
gaacagctgcgtttcaaggcacaat

SEQ ID NO: 292325 - DNA, 25 bp, Rattus norvegicus
gaacagctgctgcatcctgaaaaca

SEQ ID NO: 292326 - DNA, 25 bp, Rattus norvegicus
gaacagctgctggatcctgaaaaca

SEQ ID NO: 292327 - DNA, 25 bp, Rattus norvegicus
gaacagctgtaaccacaggcagtct

SEQ ID NO: 292328 - DNA, 25 bp, Rattus norvegicus
gaacagctgtaagcacaggcagtct

SEQ ID NO: 292329 - DNA, 25 bp, Rattus norvegicus
gaacagctgtcaaatctcaaaagtg

SEQ ID NO: 292330 - DNA, 25 bp, Rattus norvegicus
gaacagctgtcatatctcaaaagtg

SEQ ID NO: 292331 - DNA, 25 bp, Rattus norvegicus
gaacagctgtgcaagtaggttatgt

SEQ ID NO: 292332 - DNA, 25 bp, Rattus norvegicus
gaacagctgtgcacctggattcaac

SEQ ID NO: 292333 - DNA, 25 bp, Rattus norvegicus
gaacagctgtgctagtaggttatgt

SEQ ID NO: 292334 - DNA, 25 bp, Rattus norvegicus
gaacagctgtgctcctggattcaac

SEQ ID NO: 292335 - DNA, 25 bp, Rattus norvegicus
gaacagcttaaaccagagcactgct

SEQ ID NO: 292336 - DNA, 25 bp, Rattus norvegicus
gaacagcttaaagcagagcactgct

SEQ ID NO: 292337 - DNA, 25 bp, Rattus norvegicus
gaacagcttagacataaccacaaaa

SEQ ID NO: 292338 - DNA, 25 bp, Rattus norvegicus
gaacagcttagagataaccacaaaa

SEQ ID NO: 292339 - DNA, 25 bp, Rattus norvegicus
gaacagcttagtatcatctactcag

SEQ ID NO: 292340 - DNA, 25 bp, Rattus norvegicus
gaacagcttagtttcatctactcag

SEQ ID NO: 292341 - DNA, 25 bp, Rattus norvegicus
gaacagcttcagcttatcgaaataa

SEQ ID NO: 292342 - DNA, 25 bp, Rattus norvegicus
gaacagcttcaggttatcgaaataa

SEQ ID NO: 292343 - DNA, 25 bp, Rattus norvegicus
gaacagcttcgaaactctggtgcat

SEQ ID NO: 292344 - DNA, 25 bp, Rattus norvegicus
gaacagcttcgatactctggtgcat

SEQ ID NO: 292345 - DNA, 25 bp, Rattus norvegicus
gaacagcttctgaatattgctcaag

SEQ ID NO: 292346 - DNA, 25 bp, Rattus norvegicus
gaacagcttctgtatattgctcaag

SEQ ID NO: 292347 - DNA, 25 bp, Rattus norvegicus
gaacagcttgatctcttaaggcctc

SEQ ID NO: 292348 - DNA, 25 bp, Rattus norvegicus
gaacagcttgatgtcttaaggcctc

SEQ ID NO: 292349 - DNA, 25 bp, Rattus norvegicus
gaacagctttccactgcttcagttc

SEQ ID NO: 292350 - DNA, 25 bp, Rattus norvegicus
gaacagctttcctctgcttcagttc

SEQ ID NO: 292351 - DNA, 25 bp, Rattus norvegicus
gaacagctttggaatgtccaaccac

SEQ ID NO: 292352 - DNA, 25 bp, Rattus norvegicus
gaacagctttggtatgtccaaccac

SEQ ID NO: 292353 - DNA, 25 bp, Rattus norvegicus
gaacaggaaccgcaaactgggacga

SEQ ID NO: 292354 - DNA, 25 bp, Rattus norvegicus
gaacaggaaccggaaactgggacga

SEQ ID NO: 292355 - DNA, 25 bp, Rattus norvegicus
gaacaggaactacaccacccgaagg

SEQ ID NO: 292356 - DNA, 25 bp, Rattus norvegicus
gaacaggaactagaccacccgaagg

SEQ ID NO: 292357 - DNA, 25 bp, Rattus norvegicus
gaacaggaagccacgattcgggacc

SEQ ID NO: 292358 - DNA, 25 bp, Rattus norvegicus
gaacaggaagcctcgattcgggacc

SEQ ID NO: 292359 - DNA, 25 bp, Rattus norvegicus
gaacaggaagtcagaccccgcagga

SEQ ID NO: 292360 - DNA, 25 bp, Rattus norvegicus
gaacaggaagtctgaccccgcagga

SEQ ID NO: 292361 - DNA, 25 bp, Rattus norvegicus
gaacaggacaacatcatagctctta

SEQ ID NO: 292362 - DNA, 25 bp, Rattus norvegicus
gaacaggacaacttcatagctctta

SEQ ID NO: 292363 - DNA, 25 bp, Rattus norvegicus
gaacaggacagactaactttggaat

SEQ ID NO: 292364 - DNA, 25 bp, Rattus norvegicus
gaacaggacagagtaactttggaat

SEQ ID NO: 292365 - DNA, 25 bp, Rattus norvegicus
gaacaggaccctaagcattaatgcc

SEQ ID NO: 292366 - DNA, 25 bp, Rattus norvegicus
gaacaggaccctatcactgggaagt

SEQ ID NO: 292367 - DNA, 25 bp, Rattus norvegicus
gaacaggacccttagcattaatgcc

SEQ ID NO: 292368 - DNA, 25 bp, Rattus norvegicus
gaacaggaccctttcactgggaagt

SEQ ID NO: 292369 - DNA, 25 bp, Rattus norvegicus
gaacaggactatattgaagaccggg

SEQ ID NO: 292370 - DNA, 25 bp, Rattus norvegicus
gaacaggactattttgaagaccggg

SEQ ID NO: 292371 - DNA, 25 bp, Rattus norvegicus
gaacaggacttaccccagtagggaa

SEQ ID NO: 292372 - DNA, 25 bp, Rattus norvegicus
gaacaggacttagcccagtagggaa

SEQ ID NO: 292373 - DNA, 25 bp, Rattus norvegicus
gaacaggagaatatctacctctttt

SEQ ID NO: 292374 - DNA, 25 bp, Rattus norvegicus
gaacaggagaatttctacctctttt

SEQ ID NO: 292375 - DNA, 25 bp, Rattus norvegicus
gaacaggagcatcacaagccggcgc

SEQ ID NO: 292376 - DNA, 25 bp, Rattus norvegicus
gaacaggagcatgacaagccggcgc

SEQ ID NO: 292377 - DNA, 25 bp, Rattus norvegicus
gaacaggaggtcacatcaccctaga

SEQ ID NO: 292378 - DNA, 25 bp, Rattus norvegicus
gaacaggaggtctcatcaccctaga

SEQ ID NO: 292379 - DNA, 25 bp, Rattus norvegicus
gaacaggagtggcattcacctttaa

SEQ ID NO: 292380 - DNA, 25 bp, Rattus norvegicus
gaacaggagtgggattcacctttaa

SEQ ID NO: 292381 - DNA, 25 bp, Rattus norvegicus
gaacaggatcctcgtgatcgccatc

SEQ ID NO: 292382 - DNA, 25 bp, Rattus norvegicus
gaacaggatcctggtgatcgccatc

SEQ ID NO: 292383 - DNA, 25 bp, Rattus norvegicus
gaacaggatctcaggaaccgccttc

SEQ ID NO: 292384 - DNA, 25 bp, Rattus norvegicus
gaacaggatctctggaaccgccttc

SEQ ID NO: 292385 - DNA, 25 bp, Rattus norvegicus
gaacaggattccacttcaagatctg

SEQ ID NO: 292386 - DNA, 25 bp, Rattus norvegicus
gaacaggattccatttctcttttaa

SEQ ID NO: 292387 - DNA, 25 bp, Rattus norvegicus
gaacaggattcctcttcaagatctg

SEQ ID NO: 292388 - DNA, 25 bp, Rattus norvegicus
gaacaggattccttttctcttttaa

SEQ ID NO: 292389 - DNA, 25 bp, Rattus norvegicus
gaacaggcaatcacagtctctgatg

SEQ ID NO: 292390 - DNA, 25 bp, Rattus norvegicus
gaacaggcaatctcagtctctgatg

SEQ ID NO: 292391 - DNA, 25 bp, Rattus norvegicus
gaacaggcacttagtacctcagggt

SEQ ID NO: 292392 - DNA, 25 bp, Rattus norvegicus
gaacaggcactttgtacctcagggt

SEQ ID NO: 292393 - DNA, 25 bp, Rattus norvegicus
gaacaggcagagactagcttaactg

SEQ ID NO: 292394 - DNA, 25 bp, Rattus norvegicus
gaacaggcagagtctagcttaactg

SEQ ID NO: 292395 - DNA, 25 bp, Rattus norvegicus
gaacaggcatttaacacaaccgtga

SEQ ID NO: 292396 - DNA, 25 bp, Rattus norvegicus
gaacaggcattttacacaaccgtga

SEQ ID NO: 292397 - DNA, 25 bp, Rattus norvegicus
gaacaggccaaccacctatgtaata

SEQ ID NO: 292398 - DNA, 25 bp, Rattus norvegicus
gaacaggccaacgacctatgtaata

SEQ ID NO: 292399 - DNA, 25 bp, Rattus norvegicus
gaacaggccagaacttcctgaggac

SEQ ID NO: 292400 - DNA, 25 bp, Rattus norvegicus
gaacaggccagatcttcctgaggac

SEQ ID NO: 292401 - DNA, 25 bp, Rattus norvegicus
gaacaggccagcatcgaagggaact

SEQ ID NO: 292402 - DNA, 25 bp, Rattus norvegicus
gaacaggccagcttcgaagggaact

SEQ ID NO: 292403 - DNA, 25 bp, Rattus norvegicus
gaacaggcccatagcgaggctacag

SEQ ID NO: 292404 - DNA, 25 bp, Rattus norvegicus
gaacaggcccattgcgaggctacag

SEQ ID NO: 292405 - DNA, 25 bp, Rattus norvegicus
gaacaggcggaccagcttcagcttc

SEQ ID NO: 292406 - DNA, 25 bp, Rattus norvegicus
gaacaggcggacgagcttcagcttc

SEQ ID NO: 292407 - DNA, 25 bp, Rattus norvegicus
gaacaggctactaaccgtaggaagc

SEQ ID NO: 292408 - DNA, 25 bp, Rattus norvegicus
gaacaggctactacggcaaatttga

SEQ ID NO: 292409 - DNA, 25 bp, Rattus norvegicus
gaacaggctacttaccgtaggaagc

SEQ ID NO: 292410 - DNA, 25 bp, Rattus norvegicus
gaacaggctacttcggcaaatttga

SEQ ID NO: 292411 - DNA, 25 bp, Rattus norvegicus
gaacaggctatcattagccccaggg

SEQ ID NO: 292412 - DNA, 25 bp, Rattus norvegicus
gaacaggctatctttagccccaggg

SEQ ID NO: 292413 - DNA, 25 bp, Rattus norvegicus
gaacaggctccaaccagcagtgtgt

SEQ ID NO: 292414 - DNA, 25 bp, Rattus norvegicus
gaacaggctccaattaaacacgagt

SEQ ID NO: 292415 - DNA, 25 bp, Rattus norvegicus
gaacaggctccacgaagcagtgctg

SEQ ID NO: 292416 - DNA, 25 bp, Rattus norvegicus
gaacaggctccaggaagcagtgctg

SEQ ID NO: 292417 - DNA, 25 bp, Rattus norvegicus
gaacaggctccatccagcagtgtgt

SEQ ID NO: 292418 - DNA, 25 bp, Rattus norvegicus
gaacaggctccatttaaacacgagt

SEQ ID NO: 292419 - DNA, 25 bp, Rattus norvegicus
gaacaggctcggaacaaggctgcca

SEQ ID NO: 292420 - DNA, 25 bp, Rattus norvegicus
gaacaggctcggtacaaggctgcca

SEQ ID NO: 292421 - DNA, 25 bp, Rattus norvegicus
gaacaggcttatcttgggtatctcc

SEQ ID NO: 292422 - DNA, 25 bp, Rattus norvegicus
gaacaggcttatgttgggtatctcc

SEQ ID NO: 292423 - DNA, 25 bp, Rattus norvegicus
gaacaggcttgaacagtagtgggaa

SEQ ID NO: 292424 - DNA, 25 bp, Rattus norvegicus
gaacaggcttgatcagtagtgggaa

SEQ ID NO: 292425 - DNA, 25 bp, Rattus norvegicus
gaacaggctttcaagcctttgcgtt

SEQ ID NO: 292426 - DNA, 25 bp, Rattus norvegicus
gaacaggctttctagcctttgcgtt

SEQ ID NO: 292427 - DNA, 25 bp, Rattus norvegicus
gaacaggctttgaaaacatacccgg

SEQ ID NO: 292428 - DNA, 25 bp, Rattus norvegicus
gaacaggctttgtaaacatacccgg

SEQ ID NO: 292429 - DNA, 25 bp, Rattus norvegicus
gaacagggaaccatgacgcttgtcc

SEQ ID NO: 292430 - DNA, 25 bp, Rattus norvegicus
gaacagggaaccttgacgcttgtcc

SEQ ID NO: 292431 - DNA, 25 bp, Rattus norvegicus
gaacagggaagacccttgcgtctgc

SEQ ID NO: 292432 - DNA, 25 bp, Rattus norvegicus
gaacagggaagagccttgcgtctgc

SEQ ID NO: 292433 - DNA, 25 bp, Rattus norvegicus
gaacagggagcacgatctgcaagtt

SEQ ID NO: 292434 - DNA, 25 bp, Rattus norvegicus
gaacagggagcaggatctgcaagtt

SEQ ID NO: 292435 - DNA, 25 bp, Rattus norvegicus
gaacagggcatcaagcaacattctt

SEQ ID NO: 292436 - DNA, 25 bp, Rattus norvegicus
gaacagggcatctagcaacattctt

SEQ ID NO: 292437 - DNA, 25 bp, Rattus norvegicus
gaacagggctaaacacgcatgttga

SEQ ID NO: 292438 - DNA, 25 bp, Rattus norvegicus
gaacagggctaatcacgcatgttga

SEQ ID NO: 292439 - DNA, 25 bp, Rattus norvegicus
gaacagggctcacaagatccttctt

SEQ ID NO: 292440 - DNA, 25 bp, Rattus norvegicus
gaacagggctcagaagatccttctt

SEQ ID NO: 292441 - DNA, 25 bp, Rattus norvegicus
gaacagggttgcaagtcagagccat

SEQ ID NO: 292442 - DNA, 25 bp, Rattus norvegicus
gaacagggttgctagtcagagccat

SEQ ID NO: 292443 - DNA, 25 bp, Rattus norvegicus
gaacaggtattcatttcctattaga

SEQ ID NO: 292444 - DNA, 25 bp, Rattus norvegicus
gaacaggtattcttttcctattaga

SEQ ID NO: 292445 - DNA, 25 bp, Rattus norvegicus
gaacaggtcgtgaagccagcaaaga

SEQ ID NO: 292446 - DNA, 25 bp, Rattus norvegicus
gaacaggtcgtgtagccagcaaaga

SEQ ID NO: 292447 - DNA, 25 bp, Rattus norvegicus
gaacaggtctcacagcacaggcaga

SEQ ID NO: 292448 - DNA, 25 bp, Rattus norvegicus
gaacaggtctcagagcacaggcaga

SEQ ID NO: 292449 - DNA, 25 bp, Rattus norvegicus
gaacaggtcttgagctagcttcaaa

SEQ ID NO: 292450 - DNA, 25 bp, Rattus norvegicus
gaacaggtcttgtgctagcttcaaa

SEQ ID NO: 292451 - DNA, 25 bp, Rattus norvegicus
gaacaggtgcacacgtcgaatgctt

SEQ ID NO: 292452 - DNA, 25 bp, Rattus norvegicus
gaacaggtgcactcgtcgaatgctt

SEQ ID NO: 292453 - DNA, 25 bp, Rattus norvegicus
gaacaggtgccaactgtggttccaa

SEQ ID NO: 292454 - DNA, 25 bp, Rattus norvegicus
gaacaggtgccatctgtggttccaa

SEQ ID NO: 292455 - DNA, 25 bp, Rattus norvegicus
gaacaggtggaacccatctgtccct

SEQ ID NO: 292456 - DNA, 25 bp, Rattus norvegicus
gaacaggtggaacctaccctgccat

SEQ ID NO: 292457 - DNA, 25 bp, Rattus norvegicus
gaacaggtggaagccatctgtccct

SEQ ID NO: 292458 - DNA, 25 bp, Rattus norvegicus
gaacaggtggaagctaccctgccat

SEQ ID NO: 292459 - DNA, 25 bp, Rattus norvegicus
gaacaggtggacacatctacgattt

SEQ ID NO: 292460 - DNA, 25 bp, Rattus norvegicus
gaacaggtggactcatctacgattt

SEQ ID NO: 292461 - DNA, 25 bp, Rattus norvegicus
gaacaggtggtgagacactgcccca

SEQ ID NO: 292462 - DNA, 25 bp, Rattus norvegicus
gaacaggtggtgtgacactgcccca

SEQ ID NO: 292463 - DNA, 25 bp, Rattus norvegicus
gaacaggtgtgcaaagttcctcaaa

SEQ ID NO: 292464 - DNA, 25 bp, Rattus norvegicus
gaacaggtgtgctaagttcctcaaa

SEQ ID NO: 292465 - DNA, 25 bp, Rattus norvegicus
gaacaggttcacatatactcagcaa

SEQ ID NO: 292466 - DNA, 25 bp, Rattus norvegicus
gaacaggttcacttatactcagcaa

SEQ ID NO: 292467 - DNA, 25 bp, Rattus norvegicus
gaacaggttgagctcacctacgctg

SEQ ID NO: 292468 - DNA, 25 bp, Rattus norvegicus
gaacaggttgaggtcacctacgctg

SEQ ID NO: 292469 - DNA, 25 bp, Rattus norvegicus
gaacaggttgttcccaaacgctgac

SEQ ID NO: 292470 - DNA, 25 bp, Rattus norvegicus
gaacaggttgttgccaaacgctgac

SEQ ID NO: 292471 - DNA, 25 bp, Rattus norvegicus
gaacagtaagatcaacctccaggga

SEQ ID NO: 292472 - DNA, 25 bp, Rattus norvegicus
gaacagtaagatgaacctccaggga

SEQ ID NO: 292473 - DNA, 25 bp, Rattus norvegicus
gaacagtaagttagcttaatgagct

SEQ ID NO: 292474 - DNA, 25 bp, Rattus norvegicus
gaacagtaagtttgcttaatgagct

SEQ ID NO: 292475 - DNA, 25 bp, Rattus norvegicus
gaacagtaccatagcttgggcaagc

SEQ ID NO: 292476 - DNA, 25 bp, Rattus norvegicus
gaacagtaccattgcttgggcaagc

SEQ ID NO: 292477 - DNA, 25 bp, Rattus norvegicus
gaacagtactatcatccgacagatg

SEQ ID NO: 292478 - DNA, 25 bp, Rattus norvegicus
gaacagtactatgatccgacagatg

SEQ ID NO: 292479 - DNA, 25 bp, Rattus norvegicus
gaacagtagagtaccctcctctgga

SEQ ID NO: 292480 - DNA, 25 bp, Rattus norvegicus
gaacagtagagttccctcctctgga

SEQ ID NO: 292481 - DNA, 25 bp, Rattus norvegicus
gaacagtagatcagaggctcccaac

SEQ ID NO: 292482 - DNA, 25 bp, Rattus norvegicus
gaacagtagatctgaggctcccaac

SEQ ID NO: 292483 - DNA, 25 bp, Rattus norvegicus
gaacagtatcgaattggagtgacca

SEQ ID NO: 292484 - DNA, 25 bp, Rattus norvegicus
gaacagtatcgatttggagtgacca

SEQ ID NO: 292485 - DNA, 25 bp, Rattus norvegicus
gaacagtatgggattaacagcgcta

SEQ ID NO: 292486 - DNA, 25 bp, Rattus norvegicus
gaacagtatgggtttaacagcgcta

SEQ ID NO: 292487 - DNA, 25 bp, Rattus norvegicus
gaacagtcaaatccagccatggcga

SEQ ID NO: 292488 - DNA, 25 bp, Rattus norvegicus
gaacagtcaaatgcagccatggcga

SEQ ID NO: 292489 - DNA, 25 bp, Rattus norvegicus
gaacagtcaagtcagcctgtcccac

SEQ ID NO: 292490 - DNA, 25 bp, Rattus norvegicus
gaacagtcaagtgagcctgtcccac

SEQ ID NO: 292491 - DNA, 25 bp, Rattus norvegicus
gaacagtcacgtatatctggtgctg

SEQ ID NO: 292492 - DNA, 25 bp, Rattus norvegicus
gaacagtcacgtttatctggtgctg

SEQ ID NO: 292493 - DNA, 25 bp, Rattus norvegicus
gaacagtcactcataccggaggcat

SEQ ID NO: 292494 - DNA, 25 bp, Rattus norvegicus
gaacagtcactcttaccggaggcat

SEQ ID NO: 292495 - DNA, 25 bp, Rattus norvegicus
gaacagtcagcgattccaggtttta

SEQ ID NO: 292496 - DNA, 25 bp, Rattus norvegicus
gaacagtcagcgtttccaggtttta

SEQ ID NO: 292497 - DNA, 25 bp, Rattus norvegicus
gaacagtcagtactcccagggcagg

SEQ ID NO: 292498 - DNA, 25 bp, Rattus norvegicus
gaacagtcagtagtcccagggcagg

SEQ ID NO: 292499 - DNA, 25 bp, Rattus norvegicus
gaacagtccagcactcaggagcagc

SEQ ID NO: 292500 - DNA, 25 bp, Rattus norvegicus
gaacagtccagctctcaggagcagc

SEQ ID NO: 292501 - DNA, 25 bp, Rattus norvegicus
gaacagtccgacactgtgagcagtt

SEQ ID NO: 292502 - DNA, 25 bp, Rattus norvegicus
gaacagtccgactctgtgagcagtt

SEQ ID NO: 292503 - DNA, 25 bp, Rattus norvegicus
gaacagtcctatactttggtaccac

SEQ ID NO: 292504 - DNA, 25 bp, Rattus norvegicus
gaacagtcctattctttggtaccac

SEQ ID NO: 292505 - DNA, 25 bp, Rattus norvegicus
gaacagtcgaaaagtcctggcggtt

SEQ ID NO: 292506 - DNA, 25 bp, Rattus norvegicus
gaacagtcgaaatgtcctggcggtt

SEQ ID NO: 292507 - DNA, 25 bp, Rattus norvegicus
gaacagtctacacactgtcgtcttt

SEQ ID NO: 292508 - DNA, 25 bp, Rattus norvegicus
gaacagtctacagactgtcgtcttt

SEQ ID NO: 292509 - DNA, 25 bp, Rattus norvegicus
gaacagtctatacccaagaagtcat

SEQ ID NO: 292510 - DNA, 25 bp, Rattus norvegicus
gaacagtctatagccaagaagtcat

SEQ ID NO: 292511 - DNA, 25 bp, Rattus norvegicus
gaacagtctctgataaggtcacttg

SEQ ID NO: 292512 - DNA, 25 bp, Rattus norvegicus
gaacagtctctgttaaggtcacttg

SEQ ID NO: 292513 - DNA, 25 bp, Rattus norvegicus
gaacagtctcttacggaggctaatt

SEQ ID NO: 292514 - DNA, 25 bp, Rattus norvegicus
gaacagtctcttctctcagaggcag

SEQ ID NO: 292515 - DNA, 25 bp, Rattus norvegicus
gaacagtctcttgtctcagaggcag

SEQ ID NO: 292516 - DNA, 25 bp, Rattus norvegicus
gaacagtctctttcggaggctaatt

SEQ ID NO: 292517 - DNA, 25 bp, Rattus norvegicus
gaacagtctgacaccaagtactaat

SEQ ID NO: 292518 - DNA, 25 bp, Rattus norvegicus
gaacagtctgactccaagtactaat

SEQ ID NO: 292519 - DNA, 25 bp, Rattus norvegicus
gaacagtctgccattggtgtgcttc

SEQ ID NO: 292520 - DNA, 25 bp, Rattus norvegicus
gaacagtctgcctttggtgtgcttc

SEQ ID NO: 292521 - DNA, 25 bp, Rattus norvegicus
gaacagtctggcaggagctaacgaa

SEQ ID NO: 292522 - DNA, 25 bp, Rattus norvegicus
gaacagtctggcaggtggtttaaca

SEQ ID NO: 292523 - DNA, 25 bp, Rattus norvegicus
gaacagtctggctggagctaacgaa

SEQ ID NO: 292524 - DNA, 25 bp, Rattus norvegicus
gaacagtctggctggtggtttaaca

SEQ ID NO: 292525 - DNA, 25 bp, Rattus norvegicus
gaacagtctgtacttcaggacctag

SEQ ID NO: 292526 - DNA, 25 bp, Rattus norvegicus
gaacagtctgtagttcaggacctag

SEQ ID NO: 292527 - DNA, 25 bp, Rattus norvegicus
gaacagtgacaaccttcatttctag

SEQ ID NO: 292528 - DNA, 25 bp, Rattus norvegicus
gaacagtgacaagcttcatttctag

SEQ ID NO: 292529 - DNA, 25 bp, Rattus norvegicus
gaacagtgacagcttcctgtaagta

SEQ ID NO: 292530 - DNA, 25 bp, Rattus norvegicus
gaacagtgacaggttcctgtaagta

SEQ ID NO: 292531 - DNA, 25 bp, Rattus norvegicus
gaacagtgactacaaaccgaatatc

SEQ ID NO: 292532 - DNA, 25 bp, Rattus norvegicus
gaacagtgactagaaaccgaatatc

SEQ ID NO: 292533 - DNA, 25 bp, Rattus norvegicus
gaacagtgatgcagccagtttgggc

SEQ ID NO: 292534 - DNA, 25 bp, Rattus norvegicus
gaacagtgatgctgccagtttgggc

SEQ ID NO: 292535 - DNA, 25 bp, Rattus norvegicus
gaacagtgcaagctaacggctacag

SEQ ID NO: 292536 - DNA, 25 bp, Rattus norvegicus
gaacagtgcaaggtaacggctacag

SEQ ID NO: 292537 - DNA, 25 bp, Rattus norvegicus
gaacagtgctacaagcgcctttaca

SEQ ID NO: 292538 - DNA, 25 bp, Rattus norvegicus
gaacagtgctactagcgcctttaca

SEQ ID NO: 292539 - DNA, 25 bp, Rattus norvegicus
gaacagtgcttcaaaggtctccaga

SEQ ID NO: 292540 - DNA, 25 bp, Rattus norvegicus
gaacagtgcttctaaggtctccaga

SEQ ID NO: 292541 - DNA, 25 bp, Rattus norvegicus
gaacagtgcttgctggtcaaacctg

SEQ ID NO: 292542 - DNA, 25 bp, Rattus norvegicus
gaacagtgcttggtggtcaaacctg

SEQ ID NO: 292543 - DNA, 25 bp, Rattus norvegicus
gaacagtggagaataggcacctgga

SEQ ID NO: 292544 - DNA, 25 bp, Rattus norvegicus
gaacagtggagattaggcacctgga

SEQ ID NO: 292545 - DNA, 25 bp, Rattus norvegicus
gaacagtgtaaaatcgccgtgtaaa

SEQ ID NO: 292546 - DNA, 25 bp, Rattus norvegicus
gaacagtgtaaacgtctcacagtat

SEQ ID NO: 292547 - DNA, 25 bp, Rattus norvegicus
gaacagtgtaaaggtctcacagtat

SEQ ID NO: 292548 - DNA, 25 bp, Rattus norvegicus
gaacagtgtaaattcgccgtgtaaa

SEQ ID NO: 292549 - DNA, 25 bp, Rattus norvegicus
gaacagtgtaggatcgctcgtaacc

SEQ ID NO: 292550 - DNA, 25 bp, Rattus norvegicus
gaacagtgtaggttcgctcgtaacc

SEQ ID NO: 292551 - DNA, 25 bp, Rattus norvegicus
gaacagtgtcaaccatcttgctcta

SEQ ID NO: 292552 - DNA, 25 bp, Rattus norvegicus
gaacagtgtcaagcatcttgctcta

SEQ ID NO: 292553 - DNA, 25 bp, Rattus norvegicus
gaacagtgtcccatgtcctgaaaag

SEQ ID NO: 292554 - DNA, 25 bp, Rattus norvegicus
gaacagtgtcccttgtcctgaaaag

SEQ ID NO: 292555 - DNA, 25 bp, Rattus norvegicus
gaacagtgtgaccaagaacccctta

SEQ ID NO: 292556 - DNA, 25 bp, Rattus norvegicus
gaacagtgtgacgaagaacccctta

SEQ ID NO: 292557 - DNA, 25 bp, Rattus norvegicus
gaacagtgttaacaagtggctcccc

SEQ ID NO: 292558 - DNA, 25 bp, Rattus norvegicus
gaacagtgttaactccaaccatgat

SEQ ID NO: 292559 - DNA, 25 bp, Rattus norvegicus
gaacagtgttaagaagtggctcccc

SEQ ID NO: 292560 - DNA, 25 bp, Rattus norvegicus
gaacagtgttaagtccaaccatgat

SEQ ID NO: 292561 - DNA, 25 bp, Rattus norvegicus
gaacagtgttctacctttgagagct

SEQ ID NO: 292562 - DNA, 25 bp, Rattus norvegicus
gaacagtgttcttcctttgagagct

SEQ ID NO: 292563 - DNA, 25 bp, Rattus norvegicus
gaacagtgtttccatgtagtgcatt

SEQ ID NO: 292564 - DNA, 25 bp, Rattus norvegicus
gaacagtgtttcgatgtagtgcatt

SEQ ID NO: 292565 - DNA, 25 bp, Rattus norvegicus
gaacagttacgacttagaccaggga

SEQ ID NO: 292566 - DNA, 25 bp, Rattus norvegicus
gaacagttacgagttagaccaggga

SEQ ID NO: 292567 - DNA, 25 bp, Rattus norvegicus
gaacagttactcacttgttagtgaa

SEQ ID NO: 292568 - DNA, 25 bp, Rattus norvegicus
gaacagttactctcttgttagtgaa

SEQ ID NO: 292569 - DNA, 25 bp, Rattus norvegicus
gaacagttatgtaatgctccattta

SEQ ID NO: 292570 - DNA, 25 bp, Rattus norvegicus
gaacagttatgttatgctccattta

SEQ ID NO: 292571 - DNA, 25 bp, Rattus norvegicus
gaacagttattgagtgcatggctat

SEQ ID NO: 292572 - DNA, 25 bp, Rattus norvegicus
gaacagttattgtgtgcatggctat

SEQ ID NO: 292573 - DNA, 25 bp, Rattus norvegicus
gaacagttcatcctgagcactgaga

SEQ ID NO: 292574 - DNA, 25 bp, Rattus norvegicus
gaacagttcatcgtgagcactgaga

SEQ ID NO: 292575 - DNA, 25 bp, Rattus norvegicus
gaacagttcgggatattctgacaca

SEQ ID NO: 292576 - DNA, 25 bp, Rattus norvegicus
gaacagttcgggttattctgacaca

SEQ ID NO: 292577 - DNA, 25 bp, Rattus norvegicus
gaacagttcgtacatcacatccggg

SEQ ID NO: 292578 - DNA, 25 bp, Rattus norvegicus
gaacagttcgtagatcacatccggg

SEQ ID NO: 292579 - DNA, 25 bp, Rattus norvegicus
gaacagttctaaaccacagaccaga

SEQ ID NO: 292580 - DNA, 25 bp, Rattus norvegicus
gaacagttctaatccacagaccaga

SEQ ID NO: 292581 - DNA, 25 bp, Rattus norvegicus
gaacagttctatcagtgtccttatt

SEQ ID NO: 292582 - DNA, 25 bp, Rattus norvegicus
gaacagttctatgagtgtccttatt

SEQ ID NO: 292583 - DNA, 25 bp, Rattus norvegicus
gaacagttctctcaggctgactcca

SEQ ID NO: 292584 - DNA, 25 bp, Rattus norvegicus
gaacagttctctgaggctgactcca

SEQ ID NO: 292585 - DNA, 25 bp, Rattus norvegicus
gaacagttctgcaatcaatccaggc

SEQ ID NO: 292586 - DNA, 25 bp, Rattus norvegicus
gaacagttctgcagggaagagcccc

SEQ ID NO: 292587 - DNA, 25 bp, Rattus norvegicus
gaacagttctgctatcaatccaggc

SEQ ID NO: 292588 - DNA, 25 bp, Rattus norvegicus
gaacagttctgctgggaagagcccc

SEQ ID NO: 292589 - DNA, 25 bp, Rattus norvegicus
gaacagttcttgacaatctgaattg

SEQ ID NO: 292590 - DNA, 25 bp, Rattus norvegicus
gaacagttcttgcatcccatgagtg

SEQ ID NO: 292591 - DNA, 25 bp, Rattus norvegicus
gaacagttcttggatcccatgagtg

SEQ ID NO: 292592 - DNA, 25 bp, Rattus norvegicus
gaacagttcttgtcaatctgaattg

SEQ ID NO: 292593 - DNA, 25 bp, Rattus norvegicus
gaacagttgcccaagattcagaaat

SEQ ID NO: 292594 - DNA, 25 bp, Rattus norvegicus
gaacagttgccctagattcagaaat

SEQ ID NO: 292595 - DNA, 25 bp, Rattus norvegicus
gaacagttgtcccagtctgatagga

SEQ ID NO: 292596 - DNA, 25 bp, Rattus norvegicus
gaacagttgtccgagtctgatagga

SEQ ID NO: 292597 - DNA, 25 bp, Rattus norvegicus
gaacagttgtctaagtacctatgga

SEQ ID NO: 292598 - DNA, 25 bp, Rattus norvegicus
gaacagttgtcttagtacctatgga

SEQ ID NO: 292599 - DNA, 25 bp, Rattus norvegicus
gaacagttgtggcttttgcgctatg

SEQ ID NO: 292600 - DNA, 25 bp, Rattus norvegicus
gaacagttgtgggttttgcgctatg

SEQ ID NO: 292601 - DNA, 25 bp, Rattus norvegicus
gaacagttgtgtagtttctccttaa

SEQ ID NO: 292602 - DNA, 25 bp, Rattus norvegicus
gaacagttgtgttgtttctccttaa

SEQ ID NO: 292603 - DNA, 25 bp, Rattus norvegicus
gaacagttgtttccagtgagctact

SEQ ID NO: 292604 - DNA, 25 bp, Rattus norvegicus
gaacagttgtttgcagtgagctact

SEQ ID NO: 292605 - DNA, 25 bp, Rattus norvegicus
gaacagtttacactaagtccatatt

SEQ ID NO: 292606 - DNA, 25 bp, Rattus norvegicus
gaacagtttacagtaagtccatatt

SEQ ID NO: 292607 - DNA, 25 bp, Rattus norvegicus
gaacagtttactacttggagtgtaa

SEQ ID NO: 292608 - DNA, 25 bp, Rattus norvegicus
gaacagtttacttcttggagtgtaa

SEQ ID NO: 292609 - DNA, 25 bp, Rattus norvegicus
gaacagtttagcacctttatggctc

SEQ ID NO: 292610 - DNA, 25 bp, Rattus norvegicus
gaacagtttagctcctttatggctc

SEQ ID NO: 292611 - DNA, 25 bp, Rattus norvegicus
gaacagtttagtactgcctgcttct

SEQ ID NO: 292612 - DNA, 25 bp, Rattus norvegicus
gaacagtttagttctgcctgcttct

SEQ ID NO: 292613 - DNA, 25 bp, Rattus norvegicus
gaacagtttcataccagagctgaca

SEQ ID NO: 292614 - DNA, 25 bp, Rattus norvegicus
gaacagtttcatagggtcgagcgca

SEQ ID NO: 292615 - DNA, 25 bp, Rattus norvegicus
gaacagtttcattccagagctgaca

SEQ ID NO: 292616 - DNA, 25 bp, Rattus norvegicus
gaacagtttcattgggtcgagcgca

SEQ ID NO: 292617 - DNA, 25 bp, Rattus norvegicus
gaacagtttctaagtggccttggaa

SEQ ID NO: 292618 - DNA, 25 bp, Rattus norvegicus
gaacagtttctatgtggccttggaa

SEQ ID NO: 292619 - DNA, 25 bp, Rattus norvegicus
gaacagtttctccaaaacctggata

SEQ ID NO: 292620 - DNA, 25 bp, Rattus norvegicus
gaacagtttctcgaaaacctggata

SEQ ID NO: 292621 - DNA, 25 bp, Rattus norvegicus
gaacagtttgatctcgcagctcacc

SEQ ID NO: 292622 - DNA, 25 bp, Rattus norvegicus
gaacagtttgatgtcgcagctcacc

SEQ ID NO: 292623 - DNA, 25 bp, Rattus norvegicus
gaacagtttgtacccgctctagagc

SEQ ID NO: 292624 - DNA, 25 bp, Rattus norvegicus
gaacagtttgtagccgctctagagc

SEQ ID NO: 292625 - DNA, 25 bp, Rattus norvegicus
gaacagtttgtgcagaccctggaaa

SEQ ID NO: 292626 - DNA, 25 bp, Rattus norvegicus
gaacagtttgtggagaccctggaaa

SEQ ID NO: 292627 - DNA, 25 bp, Rattus norvegicus
gaacagttttccagagtctggtctc

SEQ ID NO: 292628 - DNA, 25 bp, Rattus norvegicus
gaacagttttcctgagtctggtctc

SEQ ID NO: 292629 - DNA, 25 bp, Rattus norvegicus
gaacagttttctaccaataccattg

SEQ ID NO: 292630 - DNA, 25 bp, Rattus norvegicus
gaacagttttctagccacatactct

SEQ ID NO: 292631 - DNA, 25 bp, Rattus norvegicus
gaacagttttcttccaataccattg

SEQ ID NO: 292632 - DNA, 25 bp, Rattus norvegicus
gaacagttttcttgccacatactct

SEQ ID NO: 292633 - DNA, 25 bp, Rattus norvegicus
gaacataaactcacttggtttggca

SEQ ID NO: 292634 - DNA, 25 bp, Rattus norvegicus
gaacataaactctcttggtttggca

SEQ ID NO: 292635 - DNA, 25 bp, Rattus norvegicus
gaacataaggtgactggaacctcag

SEQ ID NO: 292636 - DNA, 25 bp, Rattus norvegicus
gaacataaggtgtctggaacctcag

SEQ ID NO: 292637 - DNA, 25 bp, Rattus norvegicus
gaacataatctgaaatcttgacatt

SEQ ID NO: 292638 - DNA, 25 bp, Rattus norvegicus
gaacataatctgtaatcttgacatt

SEQ ID NO: 292639 - DNA, 25 bp, Rattus norvegicus
gaacataatcttcccttgtgaactt

SEQ ID NO: 292640 - DNA, 25 bp, Rattus norvegicus
gaacataatcttgccttgtgaactt

SEQ ID NO: 292641 - DNA, 25 bp, Rattus norvegicus
gaacataatgtcactttatagaaag

SEQ ID NO: 292642 - DNA, 25 bp, Rattus norvegicus
gaacataatgtctctttatagaaag

SEQ ID NO: 292643 - DNA, 25 bp, Rattus norvegicus
gaacataattttcttcacttgtatt

SEQ ID NO: 292644 - DNA, 25 bp, Rattus norvegicus
gaacataattttgttcacttgtatt

SEQ ID NO: 292645 - DNA, 25 bp, Rattus norvegicus
gaacatacaaagcttgccttcttat

SEQ ID NO: 292646 - DNA, 25 bp, Rattus norvegicus
gaacatacaaaggttgccttcttat

SEQ ID NO: 292647 - DNA, 25 bp, Rattus norvegicus
gaacatacataactctgtaggctga

SEQ ID NO: 292648 - DNA, 25 bp, Rattus norvegicus
gaacatacataagtctgtaggctga

SEQ ID NO: 292649 - DNA, 25 bp, Rattus norvegicus
gaacataccagcatgcactgacttg

SEQ ID NO: 292650 - DNA, 25 bp, Rattus norvegicus
gaacataccagcttgcactgacttg

SEQ ID NO: 292651 - DNA, 25 bp, Rattus norvegicus
gaacataccaggaaagcccctacag

SEQ ID NO: 292652 - DNA, 25 bp, Rattus norvegicus
gaacataccaggtaagcccctacag

SEQ ID NO: 292653 - DNA, 25 bp, Rattus norvegicus
gaacataccgcaaccttatatggaa

SEQ ID NO: 292654 - DNA, 25 bp, Rattus norvegicus
gaacataccgcatccttatatggaa

SEQ ID NO: 292655 - DNA, 25 bp, Rattus norvegicus
gaacatacgtatacctccacaagtt

SEQ ID NO: 292656 - DNA, 25 bp, Rattus norvegicus
gaacatacgtattcctccacaagtt

SEQ ID NO: 292657 - DNA, 25 bp, Rattus norvegicus
gaacatacgtttactaacctgaaag

SEQ ID NO: 292658 - DNA, 25 bp, Rattus norvegicus
gaacatacgttttctaacctgaaag

SEQ ID NO: 292659 - DNA, 25 bp, Rattus norvegicus
gaacatactgtgcagttatacctga

SEQ ID NO: 292660 - DNA, 25 bp, Rattus norvegicus
gaacatactgtggagttatacctga

SEQ ID NO: 292661 - DNA, 25 bp, Rattus norvegicus
gaacatagaaggacagctccaccaa

SEQ ID NO: 292662 - DNA, 25 bp, Rattus norvegicus
gaacatagaaggtcagctccaccaa

SEQ ID NO: 292663 - DNA, 25 bp, Rattus norvegicus
gaacatagaattccttggccctcaa

SEQ ID NO: 292664 - DNA, 25 bp, Rattus norvegicus
gaacatagaattgcttggccctcaa

SEQ ID NO: 292665 - DNA, 25 bp, Rattus norvegicus
gaacatagcatcaggcaattttatt

SEQ ID NO: 292666 - DNA, 25 bp, Rattus norvegicus
gaacatagcatctggcaattttatt

SEQ ID NO: 292667 - DNA, 25 bp, Rattus norvegicus
gaacatagccttcaacagttgtggt

SEQ ID NO: 292668 - DNA, 25 bp, Rattus norvegicus
gaacatagccttgaacagttgtggt

SEQ ID NO: 292669 - DNA, 25 bp, Rattus norvegicus
gaacataggaagaatctggctgtat

SEQ ID NO: 292670 - DNA, 25 bp, Rattus norvegicus
gaacataggaagtatctggctgtat

SEQ ID NO: 292671 - DNA, 25 bp, Rattus norvegicus
gaacataggcttcacctcacagcta

SEQ ID NO: 292672 - DNA, 25 bp, Rattus norvegicus
gaacataggcttgacctcacagcta

SEQ ID NO: 292673 - DNA, 25 bp, Rattus norvegicus
gaacataggtgactcctagctcttc

SEQ ID NO: 292674 - DNA, 25 bp, Rattus norvegicus
gaacataggtgagtcctagctcttc

SEQ ID NO: 292675 - DNA, 25 bp, Rattus norvegicus
gaacatagtgttccgcggttccgac

SEQ ID NO: 292676 - DNA, 25 bp, Rattus norvegicus
gaacatagtgttgcgcggttccgac

SEQ ID NO: 292677 - DNA, 25 bp, Rattus norvegicus
gaacatatactcagggcaaagctgg

SEQ ID NO: 292678 - DNA, 25 bp, Rattus norvegicus
gaacatatactctgggcaaagctgg

SEQ ID NO: 292679 - DNA, 25 bp, Rattus norvegicus
gaacatatccatccgtacaacattg

SEQ ID NO: 292680 - DNA, 25 bp, Rattus norvegicus
gaacatatccatgcgtacaacattg

SEQ ID NO: 292681 - DNA, 25 bp, Rattus norvegicus
gaacatatctttaagtagagactgc

SEQ ID NO: 292682 - DNA, 25 bp, Rattus norvegicus
gaacatatcttttagtagagactgc

SEQ ID NO: 292683 - DNA, 25 bp, Rattus norvegicus
gaacatatgaatcctatactgattt

SEQ ID NO: 292684 - DNA, 25 bp, Rattus norvegicus
gaacatatgaatgctatactgattt

SEQ ID NO: 292685 - DNA, 25 bp, Rattus norvegicus
gaacatatggttctgtgagctctga

SEQ ID NO: 292686 - DNA, 25 bp, Rattus norvegicus
gaacatatggttgtgtgagctctga

SEQ ID NO: 292687 - DNA, 25 bp, Rattus norvegicus
gaacatcaaaatatcctcagacaat

SEQ ID NO: 292688 - DNA, 25 bp, Rattus norvegicus
gaacatcaaaatttcctcagacaat

SEQ ID NO: 292689 - DNA, 25 bp, Rattus norvegicus
gaacatcaaagaattcatctgagag

SEQ ID NO: 292690 - DNA, 25 bp, Rattus norvegicus
gaacatcaaagatttcatctgagag

SEQ ID NO: 292691 - DNA, 25 bp, Rattus norvegicus
gaacatcaaaggctctgtgacttag

SEQ ID NO: 292692 - DNA, 25 bp, Rattus norvegicus
gaacatcaaagggtctgtgacttag

SEQ ID NO: 292693 - DNA, 25 bp, Rattus norvegicus
gaacatcaaccaaccagaacactgc

SEQ ID NO: 292694 - DNA, 25 bp, Rattus norvegicus
gaacatcaaccatccagaacactgc

SEQ ID NO: 292695 - DNA, 25 bp, Rattus norvegicus
gaacatcaacgtctccatggcaacc

SEQ ID NO: 292696 - DNA, 25 bp, Rattus norvegicus
gaacatcaacgtgtccatggcaacc

SEQ ID NO: 292697 - DNA, 25 bp, Rattus norvegicus
gaacatcaagatatcttttcgtgga

SEQ ID NO: 292698 - DNA, 25 bp, Rattus norvegicus
gaacatcaagatttcttttcgtgga

SEQ ID NO: 292699 - DNA, 25 bp, Rattus norvegicus
gaacatcaagcacataccgggccca

SEQ ID NO: 292700 - DNA, 25 bp, Rattus norvegicus
gaacatcaagcagataccgggccca

SEQ ID NO: 292701 - DNA, 25 bp, Rattus norvegicus
gaacatcaagtccaaggtccgagat

SEQ ID NO: 292702 - DNA, 25 bp, Rattus norvegicus
gaacatcaagtcgaaggtccgagat

SEQ ID NO: 292703 - DNA, 25 bp, Rattus norvegicus
gaacatcacatgctagggctcctgc

SEQ ID NO: 292704 - DNA, 25 bp, Rattus norvegicus
gaacatcacatggtagggctcctgc

SEQ ID NO: 292705 - DNA, 25 bp, Rattus norvegicus
gaacatcaccacacactgtgattgg

SEQ ID NO: 292706 - DNA, 25 bp, Rattus norvegicus
gaacatcaccactcactgtgattgg

SEQ ID NO: 292707 - DNA, 25 bp, Rattus norvegicus
gaacatcacctcctttttatatgca

SEQ ID NO: 292708 - DNA, 25 bp, Rattus norvegicus
gaacatcacctcgtttttatatgca

SEQ ID NO: 292709 - DNA, 25 bp, Rattus norvegicus
gaacatcacttgaattcccagagca

SEQ ID NO: 292710 - DNA, 25 bp, Rattus norvegicus
gaacatcacttgtattcccagagca

SEQ ID NO: 292711 - DNA, 25 bp, Rattus norvegicus
gaacatcagagaacagccctttggt

SEQ ID NO: 292712 - DNA, 25 bp, Rattus norvegicus
gaacatcagagatcagccctttggt

SEQ ID NO: 292713 - DNA, 25 bp, Rattus norvegicus
gaacatcagcctcgaggtctgtcag

SEQ ID NO: 292714 - DNA, 25 bp, Rattus norvegicus
gaacatcagcctggaggtctgtcag

SEQ ID NO: 292715 - DNA, 25 bp, Rattus norvegicus
gaacatcaggtgaccactgcgaggg

SEQ ID NO: 292716 - DNA, 25 bp, Rattus norvegicus
gaacatcaggtgtccactgcgaggg

SEQ ID NO: 292717 - DNA, 25 bp, Rattus norvegicus
gaacatcaggttacgcctgtacttg

SEQ ID NO: 292718 - DNA, 25 bp, Rattus norvegicus
gaacatcaggtttcgcctgtacttg

SEQ ID NO: 292719 - DNA, 25 bp, Rattus norvegicus
gaacatcatcagcttgcacatctgg

SEQ ID NO: 292720 - DNA, 25 bp, Rattus norvegicus
gaacatcatcaggttgcacatctgg

SEQ ID NO: 292721 - DNA, 25 bp, Rattus norvegicus
gaacatcatccccaggttgaaactg

SEQ ID NO: 292722 - DNA, 25 bp, Rattus norvegicus
gaacatcatcccgaggttgaaactg

SEQ ID NO: 292723 - DNA, 25 bp, Rattus norvegicus
gaacatcatcctaacagctttgaat

SEQ ID NO: 292724 - DNA, 25 bp, Rattus norvegicus
gaacatcatccttacagctttgaat

SEQ ID NO: 292725 - DNA, 25 bp, Rattus norvegicus
gaacatcatggtatctcttcaagca

SEQ ID NO: 292726 - DNA, 25 bp, Rattus norvegicus
gaacatcatggtttctcttcaagca

SEQ ID NO: 292727 - DNA, 25 bp, Rattus norvegicus
gaacatcatgtcagatttggcacca

SEQ ID NO: 292728 - DNA, 25 bp, Rattus norvegicus
gaacatcatgtctgatttggcacca

SEQ ID NO: 292729 - DNA, 25 bp, Rattus norvegicus
gaacatcattcaaggcagcgattct

SEQ ID NO: 292730 - DNA, 25 bp, Rattus norvegicus
gaacatcattcatggcagcgattct

SEQ ID NO: 292731 - DNA, 25 bp, Rattus norvegicus
gaacatccaaatccgactggcagat

SEQ ID NO: 292732 - DNA, 25 bp, Rattus norvegicus
gaacatccaaatgcgactggcagat

SEQ ID NO: 292733 - DNA, 25 bp, Rattus norvegicus
gaacatccacagagtactgtaggct

SEQ ID NO: 292734 - DNA, 25 bp, Rattus norvegicus
gaacatccacagtgtactgtaggct

SEQ ID NO: 292735 - DNA, 25 bp, Rattus norvegicus
gaacatccatttcgtcactcttcat

SEQ ID NO: 292736 - DNA, 25 bp, Rattus norvegicus
gaacatccatttggtcactcttcat

SEQ ID NO: 292737 - DNA, 25 bp, Rattus norvegicus
gaacatcccattcaggagctgcggt

SEQ ID NO: 292738 - DNA, 25 bp, Rattus norvegicus
gaacatcccattgaggagctgcggt

SEQ ID NO: 292739 - DNA, 25 bp, Rattus norvegicus
gaacatccccatcaagctggcaatt

SEQ ID NO: 292740 - DNA, 25 bp, Rattus norvegicus
gaacatccccatgaagctggcaatt

SEQ ID NO: 292741 - DNA, 25 bp, Rattus norvegicus
gaacatccccggaagacctgcagga

SEQ ID NO: 292742 - DNA, 25 bp, Rattus norvegicus
gaacatccccggtagacctgcagga

SEQ ID NO: 292743 - DNA, 25 bp, Rattus norvegicus
gaacatcccgaaactcagtgagcta

SEQ ID NO: 292744 - DNA, 25 bp, Rattus norvegicus
gaacatcccgaatctcagtgagcta

SEQ ID NO: 292745 - DNA, 25 bp, Rattus norvegicus
gaacatccctcgctgtagagtgctt

SEQ ID NO: 292746 - DNA, 25 bp, Rattus norvegicus
gaacatccctcggtgtagagtgctt

SEQ ID NO: 292747 - DNA, 25 bp, Rattus norvegicus
gaacatccgcaccagagacaacaag

SEQ ID NO: 292748 - DNA, 25 bp, Rattus norvegicus
gaacatccgcacgagagacaacaag

SEQ ID NO: 292749 - DNA, 25 bp, Rattus norvegicus
gaacatccgtatcctgataagtgga

SEQ ID NO: 292750 - DNA, 25 bp, Rattus norvegicus
gaacatccgtatgctgataagtgga

SEQ ID NO: 292751 - DNA, 25 bp, Rattus norvegicus
gaacatcctgagaattttggactct

SEQ ID NO: 292752 - DNA, 25 bp, Rattus norvegicus
gaacatcctgagtattttggactct

SEQ ID NO: 292753 - DNA, 25 bp, Rattus norvegicus
gaacatcctttaccatctgtttaat

SEQ ID NO: 292754 - DNA, 25 bp, Rattus norvegicus
gaacatcctttagcatctgtttaat

SEQ ID NO: 292755 - DNA, 25 bp, Rattus norvegicus
gaacatcctttcagttccttaactc

SEQ ID NO: 292756 - DNA, 25 bp, Rattus norvegicus
gaacatcctttctgttccttaactc

SEQ ID NO: 292757 - DNA, 25 bp, Rattus norvegicus
gaacatcgaagtcgcttctctcact

SEQ ID NO: 292758 - DNA, 25 bp, Rattus norvegicus
gaacatcgaagtggcttctctcact

SEQ ID NO: 292759 - DNA, 25 bp, Rattus norvegicus
gaacatcgacgacagcgccgtgaca

SEQ ID NO: 292760 - DNA, 25 bp, Rattus norvegicus
gaacatcgacgagagcgccgtgaca

SEQ ID NO: 292761 - DNA, 25 bp, Rattus norvegicus
gaacatcgatccagagaatgaccct

SEQ ID NO: 292762 - DNA, 25 bp, Rattus norvegicus
gaacatcgatcctgagaatgaccct

SEQ ID NO: 292763 - DNA, 25 bp, Rattus norvegicus
gaacatcgcagacctaagacagaat

SEQ ID NO: 292764 - DNA, 25 bp, Rattus norvegicus
gaacatcgcagagctaagacagaat

SEQ ID NO: 292765 - DNA, 25 bp, Rattus norvegicus
gaacatcgcgtacatggcactccgt

SEQ ID NO: 292766 - DNA, 25 bp, Rattus norvegicus
gaacatcgcgtagatggcactccgt

SEQ ID NO: 292767 - DNA, 25 bp, Rattus norvegicus
gaacatcgctgcattctattcaaat

SEQ ID NO: 292768 - DNA, 25 bp, Rattus norvegicus
gaacatcgctgctttctattcaaat

SEQ ID NO: 292769 - DNA, 25 bp, Rattus norvegicus
gaacatcggtcccacgaggtctgac

SEQ ID NO: 292770 - DNA, 25 bp, Rattus norvegicus
gaacatcggtccgacgaggtctgac

SEQ ID NO: 292771 - DNA, 25 bp, Rattus norvegicus
gaacatcgtgaaactgaaggccagg

SEQ ID NO: 292772 - DNA, 25 bp, Rattus norvegicus
gaacatcgtgaatctgaaggccagg

SEQ ID NO: 292773 - DNA, 25 bp, Rattus norvegicus
gaacatcgtgatacttaaatggtac

SEQ ID NO: 292774 - DNA, 25 bp, Rattus norvegicus
gaacatcgtgattcttaaatggtac

SEQ ID NO: 292775 - DNA, 25 bp, Rattus norvegicus
gaacatcgtgcaaggcagtggaacc

SEQ ID NO: 292776 - DNA, 25 bp, Rattus norvegicus
gaacatcgtgcatggcagtggaacc

SEQ ID NO: 292777 - DNA, 25 bp, Rattus norvegicus
gaacatcgttgtaggttctcaccca

SEQ ID NO: 292778 - DNA, 25 bp, Rattus norvegicus
gaacatcgttgttggttctcaccca

SEQ ID NO: 292779 - DNA, 25 bp, Rattus norvegicus
gaacatctacctcttttggacttgg

SEQ ID NO: 292780 - DNA, 25 bp, Rattus norvegicus
gaacatctacctgttttggacttgg

SEQ ID NO: 292781 - DNA, 25 bp, Rattus norvegicus
gaacatctatggagtcacggtgcca

SEQ ID NO: 292782 - DNA, 25 bp, Rattus norvegicus
gaacatctatggtgtcacggtgcca

SEQ ID NO: 292783 - DNA, 25 bp, Rattus norvegicus
gaacatctcaatataatagtttgta

SEQ ID NO: 292784 - DNA, 25 bp, Rattus norvegicus
gaacatctcaatttaatagtttgta

SEQ ID NO: 292785 - DNA, 25 bp, Rattus norvegicus
gaacatctcactcatgcgccataag

SEQ ID NO: 292786 - DNA, 25 bp, Rattus norvegicus
gaacatctcactgatgcgccataag

SEQ ID NO: 292787 - DNA, 25 bp, Rattus norvegicus
gaacatctcccaactgtctgatatt

SEQ ID NO: 292788 - DNA, 25 bp, Rattus norvegicus
gaacatctcccatctgtctgatatt

SEQ ID NO: 292789 - DNA, 25 bp, Rattus norvegicus
gaacatctccccagaagaattttga

SEQ ID NO: 292790 - DNA, 25 bp, Rattus norvegicus
gaacatctcccctgaagaattttga

SEQ ID NO: 292791 - DNA, 25 bp, Rattus norvegicus
gaacatctctctaggaagtgtctga

SEQ ID NO: 292792 - DNA, 25 bp, Rattus norvegicus
gaacatctctcttggaagtgtctga

SEQ ID NO: 292793 - DNA, 25 bp, Rattus norvegicus
gaacatctctgcacttacctggaag

SEQ ID NO: 292794 - DNA, 25 bp, Rattus norvegicus
gaacatctctgctcttacctggaag

SEQ ID NO: 292795 - DNA, 25 bp, Rattus norvegicus
gaacatctcttccaaagccaggacg

SEQ ID NO: 292796 - DNA, 25 bp, Rattus norvegicus
gaacatctcttcgaaagccaggacg

SEQ ID NO: 292797 - DNA, 25 bp, Rattus norvegicus
gaacatctctttaacggtggccaga

SEQ ID NO: 292798 - DNA, 25 bp, Rattus norvegicus
gaacatctcttttacggtggccaga

SEQ ID NO: 292799 - DNA, 25 bp, Rattus norvegicus
gaacatctggaactttctaacacta

SEQ ID NO: 292800 - DNA, 25 bp, Rattus norvegicus
gaacatctggaagtttctaacacta

SEQ ID NO: 292801 - DNA, 25 bp, Rattus norvegicus
gaacatctggcactggtatatgaaa

SEQ ID NO: 292802 - DNA, 25 bp, Rattus norvegicus
gaacatctggcagtggtatatgaaa

SEQ ID NO: 292803 - DNA, 25 bp, Rattus norvegicus
gaacatctggcgacacaacaggctg

SEQ ID NO: 292804 - DNA, 25 bp, Rattus norvegicus
gaacatctggcgtcacaacaggctg

SEQ ID NO: 292805 - DNA, 25 bp, Rattus norvegicus
gaacatctgggacaccctgtggtgt

SEQ ID NO: 292806 - DNA, 25 bp, Rattus norvegicus
gaacatctgggagaccctgtggtgt

SEQ ID NO: 292807 - DNA, 25 bp, Rattus norvegicus
gaacatctgtgaccccagagccaag

SEQ ID NO: 292808 - DNA, 25 bp, Rattus norvegicus
gaacatctgtgagcccagagccaag

SEQ ID NO: 292809 - DNA, 25 bp, Rattus norvegicus
gaacatctgtggagttttattggag

SEQ ID NO: 292810 - DNA, 25 bp, Rattus norvegicus
gaacatctgtggtgttttattggag

SEQ ID NO: 292811 - DNA, 25 bp, Rattus norvegicus
gaacatctgttcaggagcactaatc

SEQ ID NO: 292812 - DNA, 25 bp, Rattus norvegicus
gaacatctgttctggagcactaatc

SEQ ID NO: 292813 - DNA, 25 bp, Rattus norvegicus
gaacatctgttgagtactgcatgga

SEQ ID NO: 292814 - DNA, 25 bp, Rattus norvegicus
gaacatctgttgtgtactgcatgga

SEQ ID NO: 292815 - DNA, 25 bp, Rattus norvegicus
gaacatcttcaaagggaccggctgc

SEQ ID NO: 292816 - DNA, 25 bp, Rattus norvegicus
gaacatcttcaactagctatgccca

SEQ ID NO: 292817 - DNA, 25 bp, Rattus norvegicus
gaacatcttcaagtagctatgccca

SEQ ID NO: 292818 - DNA, 25 bp, Rattus norvegicus
gaacatcttcaatgggaccggctgc

SEQ ID NO: 292819 - DNA, 25 bp, Rattus norvegicus
gaacatcttcgacaccatcgtcaac

SEQ ID NO: 292820 - DNA, 25 bp, Rattus norvegicus
gaacatcttcgagaccatcgtcaac

SEQ ID NO: 292821 - DNA, 25 bp, Rattus norvegicus
gaacatcttcttaactctgtgggta

SEQ ID NO: 292822 - DNA, 25 bp, Rattus norvegicus
gaacatcttctttactctgtgggta

SEQ ID NO: 292823 - DNA, 25 bp, Rattus norvegicus
gaacatcttggaccttatcaccgat

SEQ ID NO: 292824 - DNA, 25 bp, Rattus norvegicus
gaacatcttggagcttatcaccgat

SEQ ID NO: 292825 - DNA, 25 bp, Rattus norvegicus
gaacatcttgggatcatagcccatt

SEQ ID NO: 292826 - DNA, 25 bp, Rattus norvegicus
gaacatcttgggttcatagcccatt

SEQ ID NO: 292827 - DNA, 25 bp, Rattus norvegicus
gaacatcttgtacccattaactatg

SEQ ID NO: 292828 - DNA, 25 bp, Rattus norvegicus
gaacatcttgtagccattaactatg

SEQ ID NO: 292829 - DNA, 25 bp, Rattus norvegicus
gaacatctttttcgagacttcctgc

SEQ ID NO: 292830 - DNA, 25 bp, Rattus norvegicus
gaacatctttttggagacttcctgc

SEQ ID NO: 292831 - DNA, 25 bp, Rattus norvegicus
gaacatgaaatgaggccctcttgga

SEQ ID NO: 292832 - DNA, 25 bp, Rattus norvegicus
gaacatgaaatgtggccctcttgga

SEQ ID NO: 292833 - DNA, 25 bp, Rattus norvegicus
gaacatgaactaccaccaacctaag

SEQ ID NO: 292834 - DNA, 25 bp, Rattus norvegicus
gaacatgaactagcaccaacctaag

SEQ ID NO: 292835 - DNA, 25 bp, Rattus norvegicus
gaacatgaagatatgtccatatcag

SEQ ID NO: 292836 - DNA, 25 bp, Rattus norvegicus
gaacatgaagatttgtccatatcag

SEQ ID NO: 292837 - DNA, 25 bp, Rattus norvegicus
gaacatgaagctcgacgacctcttt

SEQ ID NO: 292838 - DNA, 25 bp, Rattus norvegicus
gaacatgaagctggacgacctcttt

SEQ ID NO: 292839 - DNA, 25 bp, Rattus norvegicus
gaacatgacaaaccctgcgtcttct

SEQ ID NO: 292840 - DNA, 25 bp, Rattus norvegicus
gaacatgacaaagcctgcgtcttct

SEQ ID NO: 292841 - DNA, 25 bp, Rattus norvegicus
gaacatgacaataagcctgccaaat

SEQ ID NO: 292842 - DNA, 25 bp, Rattus norvegicus
gaacatgacaattagcctgccaaat

SEQ ID NO: 292843 - DNA, 25 bp, Rattus norvegicus
gaacatgacagaactctccctaata

SEQ ID NO: 292844 - DNA, 25 bp, Rattus norvegicus
gaacatgacagatctctccctaata

SEQ ID NO: 292845 - DNA, 25 bp, Rattus norvegicus
gaacatgaccccacatacagtctaa

SEQ ID NO: 292846 - DNA, 25 bp, Rattus norvegicus
gaacatgacccctcatacagtctaa

SEQ ID NO: 292847 - DNA, 25 bp, Rattus norvegicus
gaacatgacccgcaagtctaagtta

SEQ ID NO: 292848 - DNA, 25 bp, Rattus norvegicus
gaacatgacccggaagtctaagtta

SEQ ID NO: 292849 - DNA, 25 bp, Rattus norvegicus
gaacatgacctacggatgccttcct

SEQ ID NO: 292850 - DNA, 25 bp, Rattus norvegicus
gaacatgacctagggatgccttcct

SEQ ID NO: 292851 - DNA, 25 bp, Rattus norvegicus
gaacatgacgggactccttaacctg

SEQ ID NO: 292852 - DNA, 25 bp, Rattus norvegicus
gaacatgacgggtctccttaacctg

SEQ ID NO: 292853 - DNA, 25 bp, Rattus norvegicus
gaacatgactccctattattaccct

SEQ ID NO: 292854 - DNA, 25 bp, Rattus norvegicus
gaacatgactccgtattattaccct

SEQ ID NO: 292855 - DNA, 25 bp, Rattus norvegicus
gaacatgagacacgccggcgcagta

SEQ ID NO: 292856 - DNA, 25 bp, Rattus norvegicus
gaacatgagacaggccggcgcagta

SEQ ID NO: 292857 - DNA, 25 bp, Rattus norvegicus
gaacatgagataaaagccccaagag

SEQ ID NO: 292858 - DNA, 25 bp, Rattus norvegicus
gaacatgagatataagccccaagag

SEQ ID NO: 292859 - DNA, 25 bp, Rattus norvegicus
gaacatgagcatccacacgaagacc

SEQ ID NO: 292860 - DNA, 25 bp, Rattus norvegicus
gaacatgagcatgcacacgaagacc

SEQ ID NO: 292861 - DNA, 25 bp, Rattus norvegicus
gaacatgagcccaaagcaggctggg

SEQ ID NO: 292862 - DNA, 25 bp, Rattus norvegicus
gaacatgagccctaagcaggctggg

SEQ ID NO: 292863 - DNA, 25 bp, Rattus norvegicus
gaacatgagctgaccgacctttagt

SEQ ID NO: 292864 - DNA, 25 bp, Rattus norvegicus
gaacatgagctgtccgacctttagt

SEQ ID NO: 292865 - DNA, 25 bp, Rattus norvegicus
gaacatgatagacctacagctctca

SEQ ID NO: 292866 - DNA, 25 bp, Rattus norvegicus
gaacatgatagagctacagctctca

SEQ ID NO: 292867 - DNA, 25 bp, Rattus norvegicus
gaacatgatcctcagtgctacttgt

SEQ ID NO: 292868 - DNA, 25 bp, Rattus norvegicus
gaacatgatcctgagtgctacttgt

SEQ ID NO: 292869 - DNA, 25 bp, Rattus norvegicus
gaacatgatcgaagctttccgagac

SEQ ID NO: 292870 - DNA, 25 bp, Rattus norvegicus
gaacatgatcgatgctttccgagac

SEQ ID NO: 292871 - DNA, 25 bp, Rattus norvegicus
gaacatgatgacaactcagcctgca

SEQ ID NO: 292872 - DNA, 25 bp, Rattus norvegicus
gaacatgatgactactcagcctgca

SEQ ID NO: 292873 - DNA, 25 bp, Rattus norvegicus
gaacatgatgcacagctggctcccg

SEQ ID NO: 292874 - DNA, 25 bp, Rattus norvegicus
gaacatgatgcagagctggctcccg

SEQ ID NO: 292875 - DNA, 25 bp, Rattus norvegicus
gaacatgatgtaacggtcgtgccgt

SEQ ID NO: 292876 - DNA, 25 bp, Rattus norvegicus
gaacatgatgtatcggtcgtgccgt

SEQ ID NO: 292877 - DNA, 25 bp, Rattus norvegicus
gaacatgatgtcatacaaggcagga

SEQ ID NO: 292878 - DNA, 25 bp, Rattus norvegicus
gaacatgatgtcttacaaggcagga

SEQ ID NO: 292879 - DNA, 25 bp, Rattus norvegicus
gaacatgcagatacgatcacctgtt

SEQ ID NO: 292880 - DNA, 25 bp, Rattus norvegicus
gaacatgcagattcgatcacctgtt

SEQ ID NO: 292881 - DNA, 25 bp, Rattus norvegicus
gaacatgcagcgatgctcacttaat

SEQ ID NO: 292882 - DNA, 25 bp, Rattus norvegicus
gaacatgcagcgttgctcacttaat

SEQ ID NO: 292883 - DNA, 25 bp, Rattus norvegicus
gaacatgcatctagacaatggtact

SEQ ID NO: 292884 - DNA, 25 bp, Rattus norvegicus
gaacatgcatcttgacaatggtact

SEQ ID NO: 292885 - DNA, 25 bp, Rattus norvegicus
gaacatgccagcatctatggcaaga

SEQ ID NO: 292886 - DNA, 25 bp, Rattus norvegicus
gaacatgccagcttctatggcaaga

SEQ ID NO: 292887 - DNA, 25 bp, Rattus norvegicus
gaacatgcctccaatatggccagaa

SEQ ID NO: 292888 - DNA, 25 bp, Rattus norvegicus
gaacatgcctcctatatggccagaa

SEQ ID NO: 292889 - DNA, 25 bp, Rattus norvegicus
gaacatgcgaagctccttcaacgtt

SEQ ID NO: 292890 - DNA, 25 bp, Rattus norvegicus
gaacatgcgaaggtccttcaacgtt

SEQ ID NO: 292891 - DNA, 25 bp, Rattus norvegicus
gaacatgctaccacaaagtgctgtg

SEQ ID NO: 292892 - DNA, 25 bp, Rattus norvegicus
gaacatgctacctcaaagtgctgtg

SEQ ID NO: 292893 - DNA, 25 bp, Rattus norvegicus
gaacatgctactactggctgaactc

SEQ ID NO: 292894 - DNA, 25 bp, Rattus norvegicus
gaacatgctacttctggctgaactc

SEQ ID NO: 292895 - DNA, 25 bp, Rattus norvegicus
gaacatgctattattactgatgcca

SEQ ID NO: 292896 - DNA, 25 bp, Rattus norvegicus
gaacatgctatttttactgatgcca

SEQ ID NO: 292897 - DNA, 25 bp, Rattus norvegicus
gaacatgctcatcacttttgtataa

SEQ ID NO: 292898 - DNA, 25 bp, Rattus norvegicus
gaacatgctcatgacttttgtataa

SEQ ID NO: 292899 - DNA, 25 bp, Rattus norvegicus
gaacatgctggaaacaactcttaaa

SEQ ID NO: 292900 - DNA, 25 bp, Rattus norvegicus
gaacatgctggatacaactcttaaa

SEQ ID NO: 292901 - DNA, 25 bp, Rattus norvegicus
gaacatgctgtcatctgtgccaaag

SEQ ID NO: 292902 - DNA, 25 bp, Rattus norvegicus
gaacatgctgtcttctgtgccaaag

SEQ ID NO: 292903 - DNA, 25 bp, Rattus norvegicus
gaacatgctgttcttcgcaagtgta

SEQ ID NO: 292904 - DNA, 25 bp, Rattus norvegicus
gaacatgctgttgttcgcaagtgta

SEQ ID NO: 292905 - DNA, 25 bp, Rattus norvegicus
gaacatgcttctacaacagccagtg

SEQ ID NO: 292906 - DNA, 25 bp, Rattus norvegicus
gaacatgcttcttcaacagccagtg

SEQ ID NO: 292907 - DNA, 25 bp, Rattus norvegicus
gaacatgcttgtaggaagaagccca

SEQ ID NO: 292908 - DNA, 25 bp, Rattus norvegicus
gaacatgcttgttggaagaagccca

SEQ ID NO: 292909 - DNA, 25 bp, Rattus norvegicus
gaacatggaacaccacactcagaca

SEQ ID NO: 292910 - DNA, 25 bp, Rattus norvegicus
gaacatggaacagcacactcagaca

SEQ ID NO: 292911 - DNA, 25 bp, Rattus norvegicus
gaacatggagaacttttcctaaata

SEQ ID NO: 292912 - DNA, 25 bp, Rattus norvegicus
gaacatggagaagttttcctaaata

SEQ ID NO: 292913 - DNA, 25 bp, Rattus norvegicus
gaacatggaggaatgcgaggacact

SEQ ID NO: 292914 - DNA, 25 bp, Rattus norvegicus
gaacatggaggattgcgaggacact

SEQ ID NO: 292915 - DNA, 25 bp, Rattus norvegicus
gaacatggattacctgtcacacatc

SEQ ID NO: 292916 - DNA, 25 bp, Rattus norvegicus
gaacatggattagctgtcacacatc

SEQ ID NO: 292917 - DNA, 25 bp, Rattus norvegicus
gaacatggcagccttcattcaagaa

SEQ ID NO: 292918 - DNA, 25 bp, Rattus norvegicus
gaacatggcagcgttcattcaagaa

SEQ ID NO: 292919 - DNA, 25 bp, Rattus norvegicus
gaacatggccttcattttcttcaac

SEQ ID NO: 292920 - DNA, 25 bp, Rattus norvegicus
gaacatggccttgattttcttcaac

SEQ ID NO: 292921 - DNA, 25 bp, Rattus norvegicus
gaacatggcgccagggcccagctca

SEQ ID NO: 292922 - DNA, 25 bp, Rattus norvegicus
gaacatggcgcctgggcccagctca

SEQ ID NO: 292923 - DNA, 25 bp, Rattus norvegicus
gaacatggcggtaccaaaggcccat

SEQ ID NO: 292924 - DNA, 25 bp, Rattus norvegicus
gaacatggcggttccaaaggcccat

SEQ ID NO: 292925 - DNA, 25 bp, Rattus norvegicus
gaacatggctctccagctatatggc

SEQ ID NO: 292926 - DNA, 25 bp, Rattus norvegicus
gaacatggctctgcagctatatggc

SEQ ID NO: 292927 - DNA, 25 bp, Rattus norvegicus
gaacatggctgacttcctgactaat

SEQ ID NO: 292928 - DNA, 25 bp, Rattus norvegicus
gaacatggctgagttcctgactaat

SEQ ID NO: 292929 - DNA, 25 bp, Rattus norvegicus
gaacatggcttacagtacccagcat

SEQ ID NO: 292930 - DNA, 25 bp, Rattus norvegicus
gaacatggcttagagtacccagcat

SEQ ID NO: 292931 - DNA, 25 bp, Rattus norvegicus
gaacatgggagaatcaaggaccaca

SEQ ID NO: 292932 - DNA, 25 bp, Rattus norvegicus
gaacatgggagattcaaggaccaca

SEQ ID NO: 292933 - DNA, 25 bp, Rattus norvegicus
gaacatgggcacatcatcattctat

SEQ ID NO: 292934 - DNA, 25 bp, Rattus norvegicus
gaacatgggcacttcatcattctat

SEQ ID NO: 292935 - DNA, 25 bp, Rattus norvegicus
gaacatgggccaattctactgaaaa

SEQ ID NO: 292936 - DNA, 25 bp, Rattus norvegicus
gaacatgggccatttctactgaaaa

SEQ ID NO: 292937 - DNA, 25 bp, Rattus norvegicus
gaacatgggctaacttcacgagacc

SEQ ID NO: 292938 - DNA, 25 bp, Rattus norvegicus
gaacatgggctactcattccagaag

SEQ ID NO: 292939 - DNA, 25 bp, Rattus norvegicus
gaacatgggctagtcattccagaag

SEQ ID NO: 292940 - DNA, 25 bp, Rattus norvegicus
gaacatgggctatcttcacgagacc

SEQ ID NO: 292941 - DNA, 25 bp, Rattus norvegicus
gaacatgggctcattatttccaaat

SEQ ID NO: 292942 - DNA, 25 bp, Rattus norvegicus
gaacatgggctctttatttccaaat

SEQ ID NO: 292943 - DNA, 25 bp, Rattus norvegicus
gaacatggtacacagtgacccacag

SEQ ID NO: 292944 - DNA, 25 bp, Rattus norvegicus
gaacatggtacactctcagtgaatg

SEQ ID NO: 292945 - DNA, 25 bp, Rattus norvegicus
gaacatggtacagagtgacccacag

SEQ ID NO: 292946 - DNA, 25 bp, Rattus norvegicus
gaacatggtacagtctcagtgaatg

SEQ ID NO: 292947 - DNA, 25 bp, Rattus norvegicus
gaacatggtcccatgaacatgctaa

SEQ ID NO: 292948 - DNA, 25 bp, Rattus norvegicus
gaacatggtcccttgaacatgctaa

SEQ ID NO: 292949 - DNA, 25 bp, Rattus norvegicus
gaacatggtctcagttggcagctta

SEQ ID NO: 292950 - DNA, 25 bp, Rattus norvegicus
gaacatggtctctgttggcagctta

SEQ ID NO: 292951 - DNA, 25 bp, Rattus norvegicus
gaacatggtgatattcccctcaatt

SEQ ID NO: 292952 - DNA, 25 bp, Rattus norvegicus
gaacatggtgattttcccctcaatt

SEQ ID NO: 292953 - DNA, 25 bp, Rattus norvegicus
gaacatggttgtcagtcagaggccc

SEQ ID NO: 292954 - DNA, 25 bp, Rattus norvegicus
gaacatggttgtgagtcagaggccc

SEQ ID NO: 292955 - DNA, 25 bp, Rattus norvegicus
gaacatgtaagcacctttggccaat

SEQ ID NO: 292956 - DNA, 25 bp, Rattus norvegicus
gaacatgtaagctcctttggccaat

SEQ ID NO: 292957 - DNA, 25 bp, Rattus norvegicus
gaacatgtacagcttacctggcctc

SEQ ID NO: 292958 - DNA, 25 bp, Rattus norvegicus
gaacatgtacaggttacctggcctc

SEQ ID NO: 292959 - DNA, 25 bp, Rattus norvegicus
gaacatgtatatagcccacgatcct

SEQ ID NO: 292960 - DNA, 25 bp, Rattus norvegicus
gaacatgtatattgcccacgatcct

SEQ ID NO: 292961 - DNA, 25 bp, Rattus norvegicus
gaacatgtatccagcatttctcctg

SEQ ID NO: 292962 - DNA, 25 bp, Rattus norvegicus
gaacatgtatcctgcatttctcctg

SEQ ID NO: 292963 - DNA, 25 bp, Rattus norvegicus
gaacatgtcaatcggcgctggagca

SEQ ID NO: 292964 - DNA, 25 bp, Rattus norvegicus
gaacatgtcaatgggcgctggagca

SEQ ID NO: 292965 - DNA, 25 bp, Rattus norvegicus
gaacatgtcatgctgtcctgcagta

SEQ ID NO: 292966 - DNA, 25 bp, Rattus norvegicus
gaacatgtcatggtgtcctgcagta

SEQ ID NO: 292967 - DNA, 25 bp, Rattus norvegicus
gaacatgtccctcaaagtgctaaag

SEQ ID NO: 292968 - DNA, 25 bp, Rattus norvegicus
gaacatgtccctgaaagtgctaaag

SEQ ID NO: 292969 - DNA, 25 bp, Rattus norvegicus
gaacatgtccgcatctgacctcgat

SEQ ID NO: 292970 - DNA, 25 bp, Rattus norvegicus
gaacatgtccgcttctgacctcgat

SEQ ID NO: 292971 - DNA, 25 bp, Rattus norvegicus
gaacatgtctgaacatatcctggaa

SEQ ID NO: 292972 - DNA, 25 bp, Rattus norvegicus
gaacatgtctgatcatatcctggaa

SEQ ID NO: 292973 - DNA, 25 bp, Rattus norvegicus
gaacatgtctgcagtagttacccct

SEQ ID NO: 292974 - DNA, 25 bp, Rattus norvegicus
gaacatgtctgccactatagagata

SEQ ID NO: 292975 - DNA, 25 bp, Rattus norvegicus
gaacatgtctgcgactatagagata

SEQ ID NO: 292976 - DNA, 25 bp, Rattus norvegicus
gaacatgtctgctgtagttacccct

SEQ ID NO: 292977 - DNA, 25 bp, Rattus norvegicus
gaacatgtgcacattcaggaaataa

SEQ ID NO: 292978 - DNA, 25 bp, Rattus norvegicus
gaacatgtgcactttcaggaaataa

SEQ ID NO: 292979 - DNA, 25 bp, Rattus norvegicus
gaacatgtgcccatctatgaacctc

SEQ ID NO: 292980 - DNA, 25 bp, Rattus norvegicus
gaacatgtgcccttctatgaacctc

SEQ ID NO: 292981 - DNA, 25 bp, Rattus norvegicus
gaacatgtgcctattccagaactta

SEQ ID NO: 292982 - DNA, 25 bp, Rattus norvegicus
gaacatgtgccttttccagaactta

SEQ ID NO: 292983 - DNA, 25 bp, Rattus norvegicus
gaacatgtgctcacaactgctaatg

SEQ ID NO: 292984 - DNA, 25 bp, Rattus norvegicus
gaacatgtgctctcaactgctaatg

SEQ ID NO: 292985 - DNA, 25 bp, Rattus norvegicus
gaacatgtgtcactttacggtccct

SEQ ID NO: 292986 - DNA, 25 bp, Rattus norvegicus
gaacatgtgtcagtttacggtccct

SEQ ID NO: 292987 - DNA, 25 bp, Rattus norvegicus
gaacatgtgtggaatgcccgggcca

SEQ ID NO: 292988 - DNA, 25 bp, Rattus norvegicus
gaacatgtgtggtatgcccgggcca

SEQ ID NO: 292989 - DNA, 25 bp, Rattus norvegicus
gaacatgtgttcagtaggcagtcac

SEQ ID NO: 292990 - DNA, 25 bp, Rattus norvegicus
gaacatgtgttctgtaggcagtcac

SEQ ID NO: 292991 - DNA, 25 bp, Rattus norvegicus
gaacatgttatcattctttcaggag

SEQ ID NO: 292992 - DNA, 25 bp, Rattus norvegicus
gaacatgttatctttctttcaggag

SEQ ID NO: 292993 - DNA, 25 bp, Rattus norvegicus
gaacatgttattcaccttggaaagg

SEQ ID NO: 292994 - DNA, 25 bp, Rattus norvegicus
gaacatgttattgaccttggaaagg

SEQ ID NO: 292995 - DNA, 25 bp, Rattus norvegicus
gaacatgttcgtccccaccatgcta

SEQ ID NO: 292996 - DNA, 25 bp, Rattus norvegicus
gaacatgttcgtgcccaccatgcta

SEQ ID NO: 292997 - DNA, 25 bp, Rattus norvegicus
gaacatgttgctaaccgcaccattc

SEQ ID NO: 292998 - DNA, 25 bp, Rattus norvegicus
gaacatgttgcttaccgcaccattc

SEQ ID NO: 292999 - DNA, 25 bp, Rattus norvegicus
gaacatgtttcactcagtttcctgt

SEQ ID NO: 293000 - DNA, 25 bp, Rattus norvegicus
gaacatgtttcagtcagtttcctgt

SEQ ID NO: 293001 - DNA, 25 bp, Rattus norvegicus
gaacatgtttctcctgtgatcagct

SEQ ID NO: 293002 - DNA, 25 bp, Rattus norvegicus
gaacatgtttctgctgtgatcagct

SEQ ID NO: 293003 - DNA, 25 bp, Rattus norvegicus
gaacattaagctcagtgaccgttag

SEQ ID NO: 293004 - DNA, 25 bp, Rattus norvegicus
gaacattaagctgagtgaccgttag

SEQ ID NO: 293005 - DNA, 25 bp, Rattus norvegicus
gaacattacataccctgcagtacag

SEQ ID NO: 293006 - DNA, 25 bp, Rattus norvegicus
gaacattacatagcctgcagtacag

SEQ ID NO: 293007 - DNA, 25 bp, Rattus norvegicus
gaacattacctaagctctgttttct

SEQ ID NO: 293008 - DNA, 25 bp, Rattus norvegicus
gaacattacctatgctctgttttct

SEQ ID NO: 293009 - DNA, 25 bp, Rattus norvegicus
gaacattaggagacttcccacagat

SEQ ID NO: 293010 - DNA, 25 bp, Rattus norvegicus
gaacattaggagtcttcccacagat

SEQ ID NO: 293011 - DNA, 25 bp, Rattus norvegicus
gaacattagggaacccacactgtga

SEQ ID NO: 293012 - DNA, 25 bp, Rattus norvegicus
gaacattagggatcccacactgtga

SEQ ID NO: 293013 - DNA, 25 bp, Rattus norvegicus
gaacattatcttagtgatcaccagg

SEQ ID NO: 293014 - DNA, 25 bp, Rattus norvegicus
gaacattatctttgtgatcaccagg

SEQ ID NO: 293015 - DNA, 25 bp, Rattus norvegicus
gaacattatgaaaccaaggcaagcc

SEQ ID NO: 293016 - DNA, 25 bp, Rattus norvegicus
gaacattatgaatccaaggcaagcc

SEQ ID NO: 293017 - DNA, 25 bp, Rattus norvegicus
gaacattattttaacctctgggcag

SEQ ID NO: 293018 - DNA, 25 bp, Rattus norvegicus
gaacattatttttacctctgggcag

SEQ ID NO: 293019 - DNA, 25 bp, Rattus norvegicus
gaacattcaaaacaccaccatctcg

SEQ ID NO: 293020 - DNA, 25 bp, Rattus norvegicus
gaacattcaaaagaccaccatctcg

SEQ ID NO: 293021 - DNA, 25 bp, Rattus norvegicus
gaacattcaccaacagagaactagt

SEQ ID NO: 293022 - DNA, 25 bp, Rattus norvegicus
gaacattcaccatcagagaactagt

SEQ ID NO: 293023 - DNA, 25 bp, Rattus norvegicus
gaacattcactaatacttcccgtgc

SEQ ID NO: 293024 - DNA, 25 bp, Rattus norvegicus
gaacattcactattacttcccgtgc

SEQ ID NO: 293025 - DNA, 25 bp, Rattus norvegicus
gaacattcactgagcatctactgta

SEQ ID NO: 293026 - DNA, 25 bp, Rattus norvegicus
gaacattcactgtgcatctactgta

SEQ ID NO: 293027 - DNA, 25 bp, Rattus norvegicus
gaacattcacttccgacttgacaag

SEQ ID NO: 293028 - DNA, 25 bp, Rattus norvegicus
gaacattcacttgcgacttgacaag

SEQ ID NO: 293029 - DNA, 25 bp, Rattus norvegicus
gaacattcagatcctatggctcttt

SEQ ID NO: 293030 - DNA, 25 bp, Rattus norvegicus
gaacattcagatgctatggctcttt

SEQ ID NO: 293031 - DNA, 25 bp, Rattus norvegicus
gaacattcagtgacacctcttgact

SEQ ID NO: 293032 - DNA, 25 bp, Rattus norvegicus
gaacattcagtgtcacctcttgact

SEQ ID NO: 293033 - DNA, 25 bp, Rattus norvegicus
gaacattcatcacggaactttcctc

SEQ ID NO: 293034 - DNA, 25 bp, Rattus norvegicus
gaacattcatcagggaactttcctc

SEQ ID NO: 293035 - DNA, 25 bp, Rattus norvegicus
gaacattcatttagtctgctatttg

SEQ ID NO: 293036 - DNA, 25 bp, Rattus norvegicus
gaacattcatttcatggaaacactt

SEQ ID NO: 293037 - DNA, 25 bp, Rattus norvegicus
gaacattcatttgatggaaacactt

SEQ ID NO: 293038 - DNA, 25 bp, Rattus norvegicus
gaacattcattttgtctgctatttg

SEQ ID NO: 293039 - DNA, 25 bp, Rattus norvegicus
gaacattccagacagacgcagtcct

SEQ ID NO: 293040 - DNA, 25 bp, Rattus norvegicus
gaacattccagagagacgcagtcct

SEQ ID NO: 293041 - DNA, 25 bp, Rattus norvegicus
gaacattccagcaaactgcggtcga

SEQ ID NO: 293042 - DNA, 25 bp, Rattus norvegicus
gaacattccagctaactgcggtcga

SEQ ID NO: 293043 - DNA, 25 bp, Rattus norvegicus
gaacattcccttcgtatcagatccc

SEQ ID NO: 293044 - DNA, 25 bp, Rattus norvegicus
gaacattcccttggtatcagatccc

SEQ ID NO: 293045 - DNA, 25 bp, Rattus norvegicus
gaacattcgacccaattccttttca

SEQ ID NO: 293046 - DNA, 25 bp, Rattus norvegicus
gaacattcgaccgaattccttttca

SEQ ID NO: 293047 - DNA, 25 bp, Rattus norvegicus
gaacattcgggcagctattatcaac

SEQ ID NO: 293048 - DNA, 25 bp, Rattus norvegicus
gaacattcgggctgctattatcaac

SEQ ID NO: 293049 - DNA, 25 bp, Rattus norvegicus
gaacattcgtttcaggtttcattgt

SEQ ID NO: 293050 - DNA, 25 bp, Rattus norvegicus
gaacattcgtttgaggtttcattgt

SEQ ID NO: 293051 - DNA, 25 bp, Rattus norvegicus
gaacattctacccaagcgtgagaga

SEQ ID NO: 293052 - DNA, 25 bp, Rattus norvegicus
gaacattctaccgaagcgtgagaga

SEQ ID NO: 293053 - DNA, 25 bp, Rattus norvegicus
gaacattctatacaccgagctctac

SEQ ID NO: 293054 - DNA, 25 bp, Rattus norvegicus
gaacattctatagaccgagctctac

SEQ ID NO: 293055 - DNA, 25 bp, Rattus norvegicus
gaacattctcacatgctaggcaatc

SEQ ID NO: 293056 - DNA, 25 bp, Rattus norvegicus
gaacattctcacttgctaggcaatc

SEQ ID NO: 293057 - DNA, 25 bp, Rattus norvegicus
gaacattctcctaagttcctttgtt

SEQ ID NO: 293058 - DNA, 25 bp, Rattus norvegicus
gaacattctccttagttcctttgtt

SEQ ID NO: 293059 - DNA, 25 bp, Rattus norvegicus
gaacattctctgaaggctggtataa

SEQ ID NO: 293060 - DNA, 25 bp, Rattus norvegicus
gaacattctctgtaggctggtataa

SEQ ID NO: 293061 - DNA, 25 bp, Rattus norvegicus
gaacattctgaacctttcactgata

SEQ ID NO: 293062 - DNA, 25 bp, Rattus norvegicus
gaacattctgaagctttcactgata

SEQ ID NO: 293063 - DNA, 25 bp, Rattus norvegicus
gaacattctgcaaatggtcccatga

SEQ ID NO: 293064 - DNA, 25 bp, Rattus norvegicus
gaacattctgcatatggtcccatga

SEQ ID NO: 293065 - DNA, 25 bp, Rattus norvegicus
gaacattctgtcacattatcctggt

SEQ ID NO: 293066 - DNA, 25 bp, Rattus norvegicus
gaacattctgtctcattatcctggt

SEQ ID NO: 293067 - DNA, 25 bp, Rattus norvegicus
gaacattcttacagatgatcttaga

SEQ ID NO: 293068 - DNA, 25 bp, Rattus norvegicus
gaacattcttactgatgatcttaga

SEQ ID NO: 293069 - DNA, 25 bp, Rattus norvegicus
gaacattcttagatctgctttaaaa

SEQ ID NO: 293070 - DNA, 25 bp, Rattus norvegicus
gaacattcttagttctgctttaaaa

SEQ ID NO: 293071 - DNA, 25 bp, Rattus norvegicus
gaacattcttgcaagtgcttagtgt

SEQ ID NO: 293072 - DNA, 25 bp, Rattus norvegicus
gaacattcttgctagtgcttagtgt

SEQ ID NO: 293073 - DNA, 25 bp, Rattus norvegicus
gaacattctttccagagtctcaagt

SEQ ID NO: 293074 - DNA, 25 bp, Rattus norvegicus
gaacattctttcgagagtctcaagt

SEQ ID NO: 293075 - DNA, 25 bp, Rattus norvegicus
gaacattcttttctaccgtggcatt

SEQ ID NO: 293076 - DNA, 25 bp, Rattus norvegicus
gaacattcttttgtaccgtggcatt

SEQ ID NO: 293077 - DNA, 25 bp, Rattus norvegicus
gaacattgaatgcatttgcctgcat

SEQ ID NO: 293078 - DNA, 25 bp, Rattus norvegicus
gaacattgaatggatttgcctgcat

SEQ ID NO: 293079 - DNA, 25 bp, Rattus norvegicus
gaacattgacccacatttagaggct

SEQ ID NO: 293080 - DNA, 25 bp, Rattus norvegicus
gaacattgaccctcatttagaggct

SEQ ID NO: 293081 - DNA, 25 bp, Rattus norvegicus
gaacattgatgcattctgccaacag

SEQ ID NO: 293082 - DNA, 25 bp, Rattus norvegicus
gaacattgatgctttctgccaacag

SEQ ID NO: 293083 - DNA, 25 bp, Rattus norvegicus
gaacattgccatactacaggtgaag

SEQ ID NO: 293084 - DNA, 25 bp, Rattus norvegicus
gaacattgccattctacaggtgaag

SEQ ID NO: 293085 - DNA, 25 bp, Rattus norvegicus
gaacattgcgacactcttgaaggcc

SEQ ID NO: 293086 - DNA, 25 bp, Rattus norvegicus
gaacattgcgactctcttgaaggcc

SEQ ID NO: 293087 - DNA, 25 bp, Rattus norvegicus
gaacattgctttcgacaagacggac

SEQ ID NO: 293088 - DNA, 25 bp, Rattus norvegicus
gaacattgctttggacaagacggac

SEQ ID NO: 293089 - DNA, 25 bp, Rattus norvegicus
gaacattggagaaggccggagccct

SEQ ID NO: 293090 - DNA, 25 bp, Rattus norvegicus
gaacattggagatggccggagccct

SEQ ID NO: 293091 - DNA, 25 bp, Rattus norvegicus
gaacattggcttcaacatcgtagta

SEQ ID NO: 293092 - DNA, 25 bp, Rattus norvegicus
gaacattggcttgaacatcgtagta

SEQ ID NO: 293093 - DNA, 25 bp, Rattus norvegicus
gaacattgtgaactccagaagctac

SEQ ID NO: 293094 - DNA, 25 bp, Rattus norvegicus
gaacattgtgaagtccagaagctac

SEQ ID NO: 293095 - DNA, 25 bp, Rattus norvegicus
gaacattgtgagctgttacccacag

SEQ ID NO: 293096 - DNA, 25 bp, Rattus norvegicus
gaacattgtgaggtgttacccacag

SEQ ID NO: 293097 - DNA, 25 bp, Rattus norvegicus
gaacattgtgatactcgccttttaa

SEQ ID NO: 293098 - DNA, 25 bp, Rattus norvegicus
gaacattgtgattctcgccttttaa

SEQ ID NO: 293099 - DNA, 25 bp, Rattus norvegicus
gaacattgtgtcatggactcttggg

SEQ ID NO: 293100 - DNA, 25 bp, Rattus norvegicus
gaacattgtgtcttggactcttggg

SEQ ID NO: 293101 - DNA, 25 bp, Rattus norvegicus
gaacattgtgtgctcttggtcagac

SEQ ID NO: 293102 - DNA, 25 bp, Rattus norvegicus
gaacattgtgtggtcttggtcagac

SEQ ID NO: 293103 - DNA, 25 bp, Rattus norvegicus
gaacattgtgttctggctctgaact

SEQ ID NO: 293104 - DNA, 25 bp, Rattus norvegicus
gaacattgtgttgtggctctgaact

SEQ ID NO: 293105 - DNA, 25 bp, Rattus norvegicus
gaacattgtttaagtgcagcaaccc

SEQ ID NO: 293106 - DNA, 25 bp, Rattus norvegicus
gaacattgtttacctttcctaagta

SEQ ID NO: 293107 - DNA, 25 bp, Rattus norvegicus
gaacattgtttagctttcctaagta

SEQ ID NO: 293108 - DNA, 25 bp, Rattus norvegicus
gaacattgtttatgtgcagcaaccc

SEQ ID NO: 293109 - DNA, 25 bp, Rattus norvegicus
gaacatttacaaacgcaactctgaa

SEQ ID NO: 293110 - DNA, 25 bp, Rattus norvegicus
gaacatttacaatcgcaactctgaa

SEQ ID NO: 293111 - DNA, 25 bp, Rattus norvegicus
gaacatttagtccacattgtcttgt

SEQ ID NO: 293112 - DNA, 25 bp, Rattus norvegicus
gaacatttagtcgacattgtcttgt

SEQ ID NO: 293113 - DNA, 25 bp, Rattus norvegicus
gaacatttatttcgtttttcctcat

SEQ ID NO: 293114 - DNA, 25 bp, Rattus norvegicus
gaacatttatttggtttttcctcat

SEQ ID NO: 293115 - DNA, 25 bp, Rattus norvegicus
gaacatttcacgatttggtgccgaa

SEQ ID NO: 293116 - DNA, 25 bp, Rattus norvegicus
gaacatttcacgttttggtgccgaa

SEQ ID NO: 293117 - DNA, 25 bp, Rattus norvegicus
gaacatttcaggacagagggacttt

SEQ ID NO: 293118 - DNA, 25 bp, Rattus norvegicus
gaacatttcaggtcagagggacttt

SEQ ID NO: 293119 - DNA, 25 bp, Rattus norvegicus
gaacatttcataagtcctttggtaa

SEQ ID NO: 293120 - DNA, 25 bp, Rattus norvegicus
gaacatttcatatgtcctttggtaa

SEQ ID NO: 293121 - DNA, 25 bp, Rattus norvegicus
gaacatttccataagaatttcagat

SEQ ID NO: 293122 - DNA, 25 bp, Rattus norvegicus
gaacatttccattagaatttcagat

SEQ ID NO: 293123 - DNA, 25 bp, Rattus norvegicus
gaacatttctctagttgccttaagg

SEQ ID NO: 293124 - DNA, 25 bp, Rattus norvegicus
gaacatttctcttgttgccttaagg

SEQ ID NO: 293125 - DNA, 25 bp, Rattus norvegicus
gaacatttctgcacttccaaagatg

SEQ ID NO: 293126 - DNA, 25 bp, Rattus norvegicus
gaacatttctgctcttccaaagatg

SEQ ID NO: 293127 - DNA, 25 bp, Rattus norvegicus
gaacatttctgtactaagcctatta

SEQ ID NO: 293128 - DNA, 25 bp, Rattus norvegicus
gaacatttctgttctaagcctatta

SEQ ID NO: 293129 - DNA, 25 bp, Rattus norvegicus
gaacatttcttcagaactgcttaat

SEQ ID NO: 293130 - DNA, 25 bp, Rattus norvegicus
gaacatttcttctgaactgcttaat

SEQ ID NO: 293131 - DNA, 25 bp, Rattus norvegicus
gaacatttgaaacagccccgacagc

SEQ ID NO: 293132 - DNA, 25 bp, Rattus norvegicus
gaacatttgaaagagccccgacagc

SEQ ID NO: 293133 - DNA, 25 bp, Rattus norvegicus
gaacatttgcagcacaatgcatgca

SEQ ID NO: 293134 - DNA, 25 bp, Rattus norvegicus
gaacatttgcaggacaatgcatgca

SEQ ID NO: 293135 - DNA, 25 bp, Rattus norvegicus
gaacatttgccaactcttgctgctg

SEQ ID NO: 293136 - DNA, 25 bp, Rattus norvegicus
gaacatttgccatctcttgctgctg

SEQ ID NO: 293137 - DNA, 25 bp, Rattus norvegicus
gaacatttggaaccccacctatggc

SEQ ID NO: 293138 - DNA, 25 bp, Rattus norvegicus
gaacatttggaagcccacctatggc

SEQ ID NO: 293139 - DNA, 25 bp, Rattus norvegicus
gaacatttgtgaccttcttgctgtt

SEQ ID NO: 293140 - DNA, 25 bp, Rattus norvegicus
gaacatttgtgagcttcttgctgtt

SEQ ID NO: 293141 - DNA, 25 bp, Rattus norvegicus
gaacatttgttgctttctttgacca

SEQ ID NO: 293142 - DNA, 25 bp, Rattus norvegicus
gaacatttgttggtttctttgacca

SEQ ID NO: 293143 - DNA, 25 bp, Rattus norvegicus
gaacattttacaacaggacacttca

SEQ ID NO: 293144 - DNA, 25 bp, Rattus norvegicus
gaacattttacatcaggacacttca

SEQ ID NO: 293145 - DNA, 25 bp, Rattus norvegicus
gaacattttactccttctatacaaa

SEQ ID NO: 293146 - DNA, 25 bp, Rattus norvegicus
gaacattttactgcttctatacaaa

SEQ ID NO: 293147 - DNA, 25 bp, Rattus norvegicus
gaacattttagtctggagtgcacaa

SEQ ID NO: 293148 - DNA, 25 bp, Rattus norvegicus
gaacattttagtgtggagtgcacaa

SEQ ID NO: 293149 - DNA, 25 bp, Rattus norvegicus
gaacattttcctaacaaagtccagc

SEQ ID NO: 293150 - DNA, 25 bp, Rattus norvegicus
gaacattttccttacaaagtccagc

SEQ ID NO: 293151 - DNA, 25 bp, Rattus norvegicus
gaacattttcgtaattctctcgtgc

SEQ ID NO: 293152 - DNA, 25 bp, Rattus norvegicus
gaacattttcgttattctctcgtgc

SEQ ID NO: 293153 - DNA, 25 bp, Rattus norvegicus
gaacattttctaccttttggataat

SEQ ID NO: 293154 - DNA, 25 bp, Rattus norvegicus
gaacattttctagcttttggataat

SEQ ID NO: 293155 - DNA, 25 bp, Rattus norvegicus
gaacattttctcattccctgatttt

SEQ ID NO: 293156 - DNA, 25 bp, Rattus norvegicus
gaacattttctctttccctgatttt

SEQ ID NO: 293157 - DNA, 25 bp, Rattus norvegicus
gaacattttgtcattaagtctcctg

SEQ ID NO: 293158 - DNA, 25 bp, Rattus norvegicus
gaacattttgtctttaagtctcctg

SEQ ID NO: 293159 - DNA, 25 bp, Rattus norvegicus
gaacattttgtgaggactgtgaaac

SEQ ID NO: 293160 - DNA, 25 bp, Rattus norvegicus
gaacattttgtgtggactgtgaaac

SEQ ID NO: 293161 - DNA, 25 bp, Rattus norvegicus
gaacatttttatactcagcccctaa

SEQ ID NO: 293162 - DNA, 25 bp, Rattus norvegicus
gaacatttttatactcccttgcctg

SEQ ID NO: 293163 - DNA, 25 bp, Rattus norvegicus
gaacatttttattctcagcccctaa

SEQ ID NO: 293164 - DNA, 25 bp, Rattus norvegicus
gaacatttttattctcccttgcctg

SEQ ID NO: 293165 - DNA, 25 bp, Rattus norvegicus
gaacatttttgaactcctcttctgg

SEQ ID NO: 293166 - DNA, 25 bp, Rattus norvegicus
gaacatttttgatctcctcttctgg

SEQ ID NO: 293167 - DNA, 25 bp, Rattus norvegicus
gaacattttttccagccacaaaagt

SEQ ID NO: 293168 - DNA, 25 bp, Rattus norvegicus
gaacattttttcgagccacaaaagt

SEQ ID NO: 293169 - DNA, 25 bp, Rattus norvegicus
gaaccaaaaattcctcacgggactg

SEQ ID NO: 293170 - DNA, 25 bp, Rattus norvegicus
gaaccaaaaattgctcacgggactg

SEQ ID NO: 293171 - DNA, 25 bp, Rattus norvegicus
gaaccaaaagcactaatttcaggga

SEQ ID NO: 293172 - DNA, 25 bp, Rattus norvegicus
gaaccaaaagcagtaatttcaggga

SEQ ID NO: 293173 - DNA, 25 bp, Rattus norvegicus
gaaccaaaatgtcctctcggaatag

SEQ ID NO: 293174 - DNA, 25 bp, Rattus norvegicus
gaaccaaaatgtgctctcggaatag

SEQ ID NO: 293175 - DNA, 25 bp, Rattus norvegicus
gaaccaaacccacgtgctgagacaa

SEQ ID NO: 293176 - DNA, 25 bp, Rattus norvegicus
gaaccaaacccaggtgctgagacaa

SEQ ID NO: 293177 - DNA, 25 bp, Rattus norvegicus
gaaccaaacgcccagaggtctgtca

SEQ ID NO: 293178 - DNA, 25 bp, Rattus norvegicus
gaaccaaacgccgagaggtctgtca

SEQ ID NO: 293179 - DNA, 25 bp, Rattus norvegicus
gaaccaaactctagccctctgaaag

SEQ ID NO: 293180 - DNA, 25 bp, Rattus norvegicus
gaaccaaactcttgccctctgaaag

SEQ ID NO: 293181 - DNA, 25 bp, Rattus norvegicus
gaaccaaagcatcaggatctccatg

SEQ ID NO: 293182 - DNA, 25 bp, Rattus norvegicus
gaaccaaagcatgaggatctccatg

SEQ ID NO: 293183 - DNA, 25 bp, Rattus norvegicus
gaaccaaagcttacaggctgccatg

SEQ ID NO: 293184 - DNA, 25 bp, Rattus norvegicus
gaaccaaagctttcaggctgccatg

SEQ ID NO: 293185 - DNA, 25 bp, Rattus norvegicus
gaaccaaaggccatggcagccggcc

SEQ ID NO: 293186 - DNA, 25 bp, Rattus norvegicus
gaaccaaaggccttggcagccggcc

SEQ ID NO: 293187 - DNA, 25 bp, Rattus norvegicus
gaaccaaagtaaacagccctgcttc

SEQ ID NO: 293188 - DNA, 25 bp, Rattus norvegicus
gaaccaaagtaatcagccctgcttc

SEQ ID NO: 293189 - DNA, 25 bp, Rattus norvegicus
gaaccaaagtgtatgtcttctcccc

SEQ ID NO: 293190 - DNA, 25 bp, Rattus norvegicus
gaaccaaagtgtttgtcttctcccc

SEQ ID NO: 293191 - DNA, 25 bp, Rattus norvegicus
gaaccaaagttgcactacctgggcc

SEQ ID NO: 293192 - DNA, 25 bp, Rattus norvegicus
gaaccaaagttggactacctgggcc

SEQ ID NO: 293193 - DNA, 25 bp, Rattus norvegicus
gaaccaaatacccagtttacactag

SEQ ID NO: 293194 - DNA, 25 bp, Rattus norvegicus
gaaccaaataccgagtttacactag

SEQ ID NO: 293195 - DNA, 25 bp, Rattus norvegicus
gaaccaacacgcacatgaaagtata

SEQ ID NO: 293196 - DNA, 25 bp, Rattus norvegicus
gaaccaacacgctcatgaaagtata

SEQ ID NO: 293197 - DNA, 25 bp, Rattus norvegicus
gaaccaacatccattgggcttagga

SEQ ID NO: 293198 - DNA, 25 bp, Rattus norvegicus
gaaccaacatcctttgggcttagga

SEQ ID NO: 293199 - DNA, 25 bp, Rattus norvegicus
gaaccaaccgttattgactgtgcca

SEQ ID NO: 293200 - DNA, 25 bp, Rattus norvegicus
gaaccaaccgtttttgactgtgcca

SEQ ID NO: 293201 - DNA, 25 bp, Rattus norvegicus
gaaccaacgagtccattgtcttctg

SEQ ID NO: 293202 - DNA, 25 bp, Rattus norvegicus
gaaccaacgagtgcattgtcttctg

SEQ ID NO: 293203 - DNA, 25 bp, Rattus norvegicus
gaaccaacggaacaatacacagagc

SEQ ID NO: 293204 - DNA, 25 bp, Rattus norvegicus
gaaccaacggaagaatacacagagc

SEQ ID NO: 293205 - DNA, 25 bp, Rattus norvegicus
gaaccaacgtttctaaacagtcttg

SEQ ID NO: 293206 - DNA, 25 bp, Rattus norvegicus
gaaccaacgtttgtaaacagtcttg

SEQ ID NO: 293207 - DNA, 25 bp, Rattus norvegicus
gaaccaactagcatctttgacttta

SEQ ID NO: 293208 - DNA, 25 bp, Rattus norvegicus
gaaccaactagcttctttgacttta

SEQ ID NO: 293209 - DNA, 25 bp, Rattus norvegicus
gaaccaactattaacctaactgcat

SEQ ID NO: 293210 - DNA, 25 bp, Rattus norvegicus
gaaccaactatttacctaactgcat

SEQ ID NO: 293211 - DNA, 25 bp, Rattus norvegicus
gaaccaactgttaagcctcctatat

SEQ ID NO: 293212 - DNA, 25 bp, Rattus norvegicus
gaaccaactgtttagcctcctatat

SEQ ID NO: 293213 - DNA, 25 bp, Rattus norvegicus
gaaccaagagacatccacactcagt

SEQ ID NO: 293214 - DNA, 25 bp, Rattus norvegicus
gaaccaagagacttccacactcagt

SEQ ID NO: 293215 - DNA, 25 bp, Rattus norvegicus
gaaccaagagctccgggttgactta

SEQ ID NO: 293216 - DNA, 25 bp, Rattus norvegicus
gaaccaagagctgcgggttgactta

SEQ ID NO: 293217 - DNA, 25 bp, Rattus norvegicus
gaaccaagatgtctgtccactgtct

SEQ ID NO: 293218 - DNA, 25 bp, Rattus norvegicus
gaaccaagatgtgtgtccactgtct

SEQ ID NO: 293219 - DNA, 25 bp, Rattus norvegicus
gaaccaagatttcctccctttcctg

SEQ ID NO: 293220 - DNA, 25 bp, Rattus norvegicus
gaaccaagatttgctccctttcctg

SEQ ID NO: 293221 - DNA, 25 bp, Rattus norvegicus
gaaccaagcaatctcttcaatgatc

SEQ ID NO: 293222 - DNA, 25 bp, Rattus norvegicus
gaaccaagcaatgtcttcaatgatc

SEQ ID NO: 293223 - DNA, 25 bp, Rattus norvegicus
gaaccaagcacgcatatgatgctca

SEQ ID NO: 293224 - DNA, 25 bp, Rattus norvegicus
gaaccaagcacggatatgatgctca

SEQ ID NO: 293225 - DNA, 25 bp, Rattus norvegicus
gaaccaagccatactagttgtcatg

SEQ ID NO: 293226 - DNA, 25 bp, Rattus norvegicus
gaaccaagccattctagttgtcatg

SEQ ID NO: 293227 - DNA, 25 bp, Rattus norvegicus
gaaccaagctagcttttcctgcctt

SEQ ID NO: 293228 - DNA, 25 bp, Rattus norvegicus
gaaccaagctaggttttcctgcctt

SEQ ID NO: 293229 - DNA, 25 bp, Rattus norvegicus
gaaccaagctccacacaaggtgaag

SEQ ID NO: 293230 - DNA, 25 bp, Rattus norvegicus
gaaccaagctcctcacaaggtgaag

SEQ ID NO: 293231 - DNA, 25 bp, Rattus norvegicus
gaaccaagcttgatctggtaccatt

SEQ ID NO: 293232 - DNA, 25 bp, Rattus norvegicus
gaaccaagcttgttctggtaccatt

SEQ ID NO: 293233 - DNA, 25 bp, Rattus norvegicus
gaaccaaggctcacagtgacgccag

SEQ ID NO: 293234 - DNA, 25 bp, Rattus norvegicus
gaaccaaggctctcagtgacgccag

SEQ ID NO: 293235 - DNA, 25 bp, Rattus norvegicus
gaaccaaggtggatgccatctgcac

SEQ ID NO: 293236 - DNA, 25 bp, Rattus norvegicus
gaaccaaggtggttgccatctgcac

SEQ ID NO: 293237 - DNA, 25 bp, Rattus norvegicus
gaaccaagtaccagtgcaccatgga

SEQ ID NO: 293238 - DNA, 25 bp, Rattus norvegicus
gaaccaagtacctgtgcaccatgga

SEQ ID NO: 293239 - DNA, 25 bp, Rattus norvegicus
gaaccaagtcaaccgcaagtcagat

SEQ ID NO: 293240 - DNA, 25 bp, Rattus norvegicus
gaaccaagtcaagcgcaagtcagat

SEQ ID NO: 293241 - DNA, 25 bp, Rattus norvegicus
gaaccaagtccacttcgatgtgcta

SEQ ID NO: 293242 - DNA, 25 bp, Rattus norvegicus
gaaccaagtccagttcgatgtgcta

SEQ ID NO: 293243 - DNA, 25 bp, Rattus norvegicus
gaaccaagtcccaataatgtaaata

SEQ ID NO: 293244 - DNA, 25 bp, Rattus norvegicus
gaaccaagtccctataatgtaaata

SEQ ID NO: 293245 - DNA, 25 bp, Rattus norvegicus
gaaccaagtcttagtgagcaaccag

SEQ ID NO: 293246 - DNA, 25 bp, Rattus norvegicus
gaaccaagtctttgtgagcaaccag

SEQ ID NO: 293247 - DNA, 25 bp, Rattus norvegicus
gaaccaagtgatatcctcacagaaa

SEQ ID NO: 293248 - DNA, 25 bp, Rattus norvegicus
gaaccaagtgatttcctcacagaaa

SEQ ID NO: 293249 - DNA, 25 bp, Rattus norvegicus
gaaccaagttaaacagaaggctcta

SEQ ID NO: 293250 - DNA, 25 bp, Rattus norvegicus
gaaccaagttaatcagaaggctcta

SEQ ID NO: 293251 - DNA, 25 bp, Rattus norvegicus
gaaccaagttagcctggactccggg

SEQ ID NO: 293252 - DNA, 25 bp, Rattus norvegicus
gaaccaagttaggctggactccggg

SEQ ID NO: 293253 - DNA, 25 bp, Rattus norvegicus
gaaccaagttggaattctttgccta

SEQ ID NO: 293254 - DNA, 25 bp, Rattus norvegicus
gaaccaagttggtattctttgccta

SEQ ID NO: 293255 - DNA, 25 bp, Rattus norvegicus
gaaccaatacctcctccaagtgatc

SEQ ID NO: 293256 - DNA, 25 bp, Rattus norvegicus
gaaccaatacctgctccaagtgatc

SEQ ID NO: 293257 - DNA, 25 bp, Rattus norvegicus
gaaccaatactcatcagtggactct

SEQ ID NO: 293258 - DNA, 25 bp, Rattus norvegicus
gaaccaatactcttcagtggactct

SEQ ID NO: 293259 - DNA, 25 bp, Rattus norvegicus
gaaccaatatgactctgtgcctttg

SEQ ID NO: 293260 - DNA, 25 bp, Rattus norvegicus
gaaccaatatgagtctgtgcctttg

SEQ ID NO: 293261 - DNA, 25 bp, Rattus norvegicus
gaaccaatccaccacagtattcaga

SEQ ID NO: 293262 - DNA, 25 bp, Rattus norvegicus
gaaccaatccacgacagtattcaga

SEQ ID NO: 293263 - DNA, 25 bp, Rattus norvegicus
gaaccaatccctctagatagactgc

SEQ ID NO: 293264 - DNA, 25 bp, Rattus norvegicus
gaaccaatccctgtagatagactgc

SEQ ID NO: 293265 - DNA, 25 bp, Rattus norvegicus
gaaccaatgggcagctgtctcagac

SEQ ID NO: 293266 - DNA, 25 bp, Rattus norvegicus
gaaccaatgggctgctgtctcagac

SEQ ID NO: 293267 - DNA, 25 bp, Rattus norvegicus
gaaccaattagtcaacatcttctcg

SEQ ID NO: 293268 - DNA, 25 bp, Rattus norvegicus
gaaccaattagtgaacatcttctcg

SEQ ID NO: 293269 - DNA, 25 bp, Rattus norvegicus
gaaccaattcccatcctaaatcttt

SEQ ID NO: 293270 - DNA, 25 bp, Rattus norvegicus
gaaccaattcccttcctaaatcttt

SEQ ID NO: 293271 - DNA, 25 bp, Rattus norvegicus
gaaccaatttcaacatttacctatg

SEQ ID NO: 293272 - DNA, 25 bp, Rattus norvegicus
gaaccaatttcatcatttacctatg

SEQ ID NO: 293273 - DNA, 25 bp, Rattus norvegicus
gaaccacaacgtccagggcttccat

SEQ ID NO: 293274 - DNA, 25 bp, Rattus norvegicus
gaaccacaacgtgcagggcttccat

SEQ ID NO: 293275 - DNA, 25 bp, Rattus norvegicus
gaaccacaagatcgtgtctcaacag

SEQ ID NO: 293276 - DNA, 25 bp, Rattus norvegicus
gaaccacaagatggtgtctcaacag

SEQ ID NO: 293277 - DNA, 25 bp, Rattus norvegicus
gaaccacaaggtacctatgaaccaa

SEQ ID NO: 293278 - DNA, 25 bp, Rattus norvegicus
gaaccacaaggttcctatgaaccaa

SEQ ID NO: 293279 - DNA, 25 bp, Rattus norvegicus
gaaccacaatgacaactctgaaaat

SEQ ID NO: 293280 - DNA, 25 bp, Rattus norvegicus
gaaccacaatgagaactctgaaaat

SEQ ID NO: 293281 - DNA, 25 bp, Rattus norvegicus
gaaccacacagaagcagacctacag

SEQ ID NO: 293282 - DNA, 25 bp, Rattus norvegicus
gaaccacacagatgcagacctacag

SEQ ID NO: 293283 - DNA, 25 bp, Rattus norvegicus
gaaccacactcacctgacgggtctg

SEQ ID NO: 293284 - DNA, 25 bp, Rattus norvegicus
gaaccacactcagctgacgggtctg

SEQ ID NO: 293285 - DNA, 25 bp, Rattus norvegicus
gaaccacactttatggtctgtgctt

SEQ ID NO: 293286 - DNA, 25 bp, Rattus norvegicus
gaaccacactttcaacgagacacag

SEQ ID NO: 293287 - DNA, 25 bp, Rattus norvegicus
gaaccacactttgaacgagacacag

SEQ ID NO: 293288 - DNA, 25 bp, Rattus norvegicus
gaaccacactttttggtctgtgctt

SEQ ID NO: 293289 - DNA, 25 bp, Rattus norvegicus
gaaccacagagcaattcccttagaa

SEQ ID NO: 293290 - DNA, 25 bp, Rattus norvegicus
gaaccacagagctattcccttagaa

SEQ ID NO: 293291 - DNA, 25 bp, Rattus norvegicus
gaaccacagcagacagtctccaggg

SEQ ID NO: 293292 - DNA, 25 bp, Rattus norvegicus
gaaccacagcagcagagtgcacttt

SEQ ID NO: 293293 - DNA, 25 bp, Rattus norvegicus
gaaccacagcaggagagtgcacttt

SEQ ID NO: 293294 - DNA, 25 bp, Rattus norvegicus
gaaccacagcagtcagtctccaggg

SEQ ID NO: 293295 - DNA, 25 bp, Rattus norvegicus
gaaccacagccgatttgtaccagat

SEQ ID NO: 293296 - DNA, 25 bp, Rattus norvegicus
gaaccacagccgttttgtaccagat

SEQ ID NO: 293297 - DNA, 25 bp, Rattus norvegicus
gaaccacaggacatcattttgcatc

SEQ ID NO: 293298 - DNA, 25 bp, Rattus norvegicus
gaaccacaggacttcattttgcatc

SEQ ID NO: 293299 - DNA, 25 bp, Rattus norvegicus
gaaccacagggaaagcaactctaat

SEQ ID NO: 293300 - DNA, 25 bp, Rattus norvegicus
gaaccacagggatagcaactctaat

SEQ ID NO: 293301 - DNA, 25 bp, Rattus norvegicus
gaaccacaggtcagggcttactgtc

SEQ ID NO: 293302 - DNA, 25 bp, Rattus norvegicus
gaaccacaggtctgggcttactgtc

SEQ ID NO: 293303 - DNA, 25 bp, Rattus norvegicus
gaaccacagtagaacaaggcccttt

SEQ ID NO: 293304 - DNA, 25 bp, Rattus norvegicus
gaaccacagtagtacaaggcccttt

SEQ ID NO: 293305 - DNA, 25 bp, Rattus norvegicus
gaaccacagtgcagtttcgagcttt

SEQ ID NO: 293306 - DNA, 25 bp, Rattus norvegicus
gaaccacagtgctgtttcgagcttt

SEQ ID NO: 293307 - DNA, 25 bp, Rattus norvegicus
gaaccacagttaagagcggaaaatt

SEQ ID NO: 293308 - DNA, 25 bp, Rattus norvegicus
gaaccacagttatgagcggaaaatt

SEQ ID NO: 293309 - DNA, 25 bp, Rattus norvegicus
gaaccacatagtatctactgacagg

SEQ ID NO: 293310 - DNA, 25 bp, Rattus norvegicus
gaaccacatagtttctactgacagg

SEQ ID NO: 293311 - DNA, 25 bp, Rattus norvegicus
gaaccacatgcacttgtgtgctatt

SEQ ID NO: 293312 - DNA, 25 bp, Rattus norvegicus
gaaccacatgcagttgtgtgctatt

SEQ ID NO: 293313 - DNA, 25 bp, Rattus norvegicus
gaaccacatggtctaccgaatctca

SEQ ID NO: 293314 - DNA, 25 bp, Rattus norvegicus
gaaccacatggtgtaccgaatctca

SEQ ID NO: 293315 - DNA, 25 bp, Rattus norvegicus
gaaccacattgcatctgtatttgct

SEQ ID NO: 293316 - DNA, 25 bp, Rattus norvegicus
gaaccacattgccacagtactgcaa

SEQ ID NO: 293317 - DNA, 25 bp, Rattus norvegicus
gaaccacattgcgacagtactgcaa

SEQ ID NO: 293318 - DNA, 25 bp, Rattus norvegicus
gaaccacattgcttctgtatttgct

SEQ ID NO: 293319 - DNA, 25 bp, Rattus norvegicus
gaaccacatttactctctcttgaga

SEQ ID NO: 293320 - DNA, 25 bp, Rattus norvegicus
gaaccacatttagtctctcttgaga

SEQ ID NO: 293321 - DNA, 25 bp, Rattus norvegicus
gaaccaccaagtctgctgtgtctga

SEQ ID NO: 293322 - DNA, 25 bp, Rattus norvegicus
gaaccaccaagtgtgctgtgtctga

SEQ ID NO: 293323 - DNA, 25 bp, Rattus norvegicus
gaaccaccaccacattactttttct

SEQ ID NO: 293324 - DNA, 25 bp, Rattus norvegicus
gaaccaccaccagattactttttct

SEQ ID NO: 293325 - DNA, 25 bp, Rattus norvegicus
gaaccaccaggcaacgagaaagaac

SEQ ID NO: 293326 - DNA, 25 bp, Rattus norvegicus
gaaccaccaggctacgagaaagaac

SEQ ID NO: 293327 - DNA, 25 bp, Rattus norvegicus
gaaccaccagtaagactacacgttt

SEQ ID NO: 293328 - DNA, 25 bp, Rattus norvegicus
gaaccaccagtatgactacacgttt

SEQ ID NO: 293329 - DNA, 25 bp, Rattus norvegicus
gaaccaccccaccttgtagaatgaa

SEQ ID NO: 293330 - DNA, 25 bp, Rattus norvegicus
gaaccaccccacgttgtagaatgaa

SEQ ID NO: 293331 - DNA, 25 bp, Rattus norvegicus
gaaccacctgatagtggacgaccgc

SEQ ID NO: 293332 - DNA, 25 bp, Rattus norvegicus
gaaccacctgattgtggacgaccgc

SEQ ID NO: 293333 - DNA, 25 bp, Rattus norvegicus
gaaccacctgtcacatgtccagagg

SEQ ID NO: 293334 - DNA, 25 bp, Rattus norvegicus
gaaccacctgtctcatgtccagagg

SEQ ID NO: 293335 - DNA, 25 bp, Rattus norvegicus
gaaccaccttgcagtagacgagtct

SEQ ID NO: 293336 - DNA, 25 bp, Rattus norvegicus
gaaccaccttgctgtagacgagtct

SEQ ID NO: 293337 - DNA, 25 bp, Rattus norvegicus
gaaccacgctctcttagatcagtat

SEQ ID NO: 293338 - DNA, 25 bp, Rattus norvegicus
gaaccacgctctgttagatcagtat

SEQ ID NO: 293339 - DNA, 25 bp, Rattus norvegicus
gaaccacggcctacagatggctcct

SEQ ID NO: 293340 - DNA, 25 bp, Rattus norvegicus
gaaccacggccttcagatggctcct

SEQ ID NO: 293341 - DNA, 25 bp, Rattus norvegicus
gaaccacggtgcatggcaagcgact

SEQ ID NO: 293342 - DNA, 25 bp, Rattus norvegicus
gaaccacggtgcttggcaagcgact

SEQ ID NO: 293343 - DNA, 25 bp, Rattus norvegicus
gaaccacggttccaggagcctggct

SEQ ID NO: 293344 - DNA, 25 bp, Rattus norvegicus
gaaccacggttcgaggagcctggct

SEQ ID NO: 293345 - DNA, 25 bp, Rattus norvegicus
gaaccacgtactctgtagccttgta

SEQ ID NO: 293346 - DNA, 25 bp, Rattus norvegicus
gaaccacgtactgtgtagccttgta

SEQ ID NO: 293347 - DNA, 25 bp, Rattus norvegicus
gaaccactacagagttgcctgtgag

SEQ ID NO: 293348 - DNA, 25 bp, Rattus norvegicus
gaaccactacagatgtcgaggccat

SEQ ID NO: 293349 - DNA, 25 bp, Rattus norvegicus
gaaccactacagtgttgcctgtgag

SEQ ID NO: 293350 - DNA, 25 bp, Rattus norvegicus
gaaccactacagttgtcgaggccat

SEQ ID NO: 293351 - DNA, 25 bp, Rattus norvegicus
gaaccactacgaccgacgcagagaa

SEQ ID NO: 293352 - DNA, 25 bp, Rattus norvegicus
gaaccactacgagcgacgcagagaa

SEQ ID NO: 293353 - DNA, 25 bp, Rattus norvegicus
gaaccactagagaaactcggcttta

SEQ ID NO: 293354 - DNA, 25 bp, Rattus norvegicus
gaaccactagagtaactcggcttta

SEQ ID NO: 293355 - DNA, 25 bp, Rattus norvegicus
gaaccactcaggcaacaagctctgg

SEQ ID NO: 293356 - DNA, 25 bp, Rattus norvegicus
gaaccactcagggaacaagctctgg

SEQ ID NO: 293357 - DNA, 25 bp, Rattus norvegicus
gaaccactcatgagctctgtgatct

SEQ ID NO: 293358 - DNA, 25 bp, Rattus norvegicus
gaaccactcatgtgctctgtgatct

SEQ ID NO: 293359 - DNA, 25 bp, Rattus norvegicus
gaaccactccctctgcaatgtggaa

SEQ ID NO: 293360 - DNA, 25 bp, Rattus norvegicus
gaaccactccctgtgcaatgtggaa

SEQ ID NO: 293361 - DNA, 25 bp, Rattus norvegicus
gaaccactcgacaagctctgagcag

SEQ ID NO: 293362 - DNA, 25 bp, Rattus norvegicus
gaaccactcgactagctctgagcag

SEQ ID NO: 293363 - DNA, 25 bp, Rattus norvegicus
gaaccactcggccaagagctcagat

SEQ ID NO: 293364 - DNA, 25 bp, Rattus norvegicus
gaaccactcggcgaagagctcagat

SEQ ID NO: 293365 - DNA, 25 bp, Rattus norvegicus
gaaccactgatacccattttagata

SEQ ID NO: 293366 - DNA, 25 bp, Rattus norvegicus
gaaccactgatagccattttagata

SEQ ID NO: 293367 - DNA, 25 bp, Rattus norvegicus
gaaccactgcctataatacttcaac

SEQ ID NO: 293368 - DNA, 25 bp, Rattus norvegicus
gaaccactgcctttaatacttcaac

SEQ ID NO: 293369 - DNA, 25 bp, Rattus norvegicus
gaaccactggatatcttacgaatgt

SEQ ID NO: 293370 - DNA, 25 bp, Rattus norvegicus
gaaccactggatttcttacgaatgt

SEQ ID NO: 293371 - DNA, 25 bp, Rattus norvegicus
gaaccactggtcaagtaccacctgt

SEQ ID NO: 293372 - DNA, 25 bp, Rattus norvegicus
gaaccactggtctagtaccacctgt

SEQ ID NO: 293373 - DNA, 25 bp, Rattus norvegicus
gaaccactgtctcagcatggctgaa

SEQ ID NO: 293374 - DNA, 25 bp, Rattus norvegicus
gaaccactgtctgagcatggctgaa

SEQ ID NO: 293375 - DNA, 25 bp, Rattus norvegicus
gaaccacttcagagtctaccatgac

SEQ ID NO: 293376 - DNA, 25 bp, Rattus norvegicus
gaaccacttcagtgtctaccatgac

SEQ ID NO: 293377 - DNA, 25 bp, Rattus norvegicus
gaaccacttgctctcgctggtggca

SEQ ID NO: 293378 - DNA, 25 bp, Rattus norvegicus
gaaccacttgctgtcgctggtggca

SEQ ID NO: 293379 - DNA, 25 bp, Rattus norvegicus
gaaccacttggccataaggtccact

SEQ ID NO: 293380 - DNA, 25 bp, Rattus norvegicus
gaaccacttggcgataaggtccact

SEQ ID NO: 293381 - DNA, 25 bp, Rattus norvegicus
gaaccacttggtatgatcaaatgta

SEQ ID NO: 293382 - DNA, 25 bp, Rattus norvegicus
gaaccacttggtttgatcaaatgta

SEQ ID NO: 293383 - DNA, 25 bp, Rattus norvegicus
gaaccagaaaggctctgtccaggca

SEQ ID NO: 293384 - DNA, 25 bp, Rattus norvegicus
gaaccagaaagggtctgtccaggca

SEQ ID NO: 293385 - DNA, 25 bp, Rattus norvegicus
gaaccagaacggatggagagcccca

SEQ ID NO: 293386 - DNA, 25 bp, Rattus norvegicus
gaaccagaacggttggagagcccca

SEQ ID NO: 293387 - DNA, 25 bp, Rattus norvegicus
gaaccagaactgacgattctcctaa

SEQ ID NO: 293388 - DNA, 25 bp, Rattus norvegicus
gaaccagaactgatgtggctggcga

SEQ ID NO: 293389 - DNA, 25 bp, Rattus norvegicus
gaaccagaactgtcgattctcctaa

SEQ ID NO: 293390 - DNA, 25 bp, Rattus norvegicus
gaaccagaactgttgtggctggcga

SEQ ID NO: 293391 - DNA, 25 bp, Rattus norvegicus
gaaccagaagaacctcccatcaaga

SEQ ID NO: 293392 - DNA, 25 bp, Rattus norvegicus
gaaccagaagaagctcccatcaaga

SEQ ID NO: 293393 - DNA, 25 bp, Rattus norvegicus
gaaccagaaggcacctgtgaggtga

SEQ ID NO: 293394 - DNA, 25 bp, Rattus norvegicus
gaaccagaaggcatccgggtggccc

SEQ ID NO: 293395 - DNA, 25 bp, Rattus norvegicus
gaaccagaaggcatgtccagacttg

SEQ ID NO: 293396 - DNA, 25 bp, Rattus norvegicus
gaaccagaaggctcctgtgaggtga

SEQ ID NO: 293397 - DNA, 25 bp, Rattus norvegicus
gaaccagaaggcttccgggtggccc

SEQ ID NO: 293398 - DNA, 25 bp, Rattus norvegicus
gaaccagaaggcttgtccagacttg

SEQ ID NO: 293399 - DNA, 25 bp, Rattus norvegicus
gaaccagaatgtactcgtcctgaaa

SEQ ID NO: 293400 - DNA, 25 bp, Rattus norvegicus
gaaccagaatgttctcgtcctgaaa

SEQ ID NO: 293401 - DNA, 25 bp, Rattus norvegicus
gaaccagaatttatccacagcagca

SEQ ID NO: 293402 - DNA, 25 bp, Rattus norvegicus
gaaccagaatttttccacagcagca

SEQ ID NO: 293403 - DNA, 25 bp, Rattus norvegicus
gaaccagacacaccatattatcaga

SEQ ID NO: 293404 - DNA, 25 bp, Rattus norvegicus
gaaccagacacagcatattatcaga

SEQ ID NO: 293405 - DNA, 25 bp, Rattus norvegicus
gaaccagactcacgagactcagcgt

SEQ ID NO: 293406 - DNA, 25 bp, Rattus norvegicus
gaaccagactcaggagactcagcgt

SEQ ID NO: 293407 - DNA, 25 bp, Rattus norvegicus
gaaccagactgcatgtttgcatcca

SEQ ID NO: 293408 - DNA, 25 bp, Rattus norvegicus
gaaccagactgcttgtttgcatcca

SEQ ID NO: 293409 - DNA, 25 bp, Rattus norvegicus
gaaccagagaggaaacttaaggcac

SEQ ID NO: 293410 - DNA, 25 bp, Rattus norvegicus
gaaccagagaggtaacttaaggcac

SEQ ID NO: 293411 - DNA, 25 bp, Rattus norvegicus
gaaccagagcctcacttgaacatga

SEQ ID NO: 293412 - DNA, 25 bp, Rattus norvegicus
gaaccagagcctgacttgaacatga

SEQ ID NO: 293413 - DNA, 25 bp, Rattus norvegicus
gaaccagagctactagtagccgtat

SEQ ID NO: 293414 - DNA, 25 bp, Rattus norvegicus
gaaccagagctagtagtagccgtat

SEQ ID NO: 293415 - DNA, 25 bp, Rattus norvegicus
gaaccagagggcagcaccgtgatga

SEQ ID NO: 293416 - DNA, 25 bp, Rattus norvegicus
gaaccagagggctgcaccgtgatga

SEQ ID NO: 293417 - DNA, 25 bp, Rattus norvegicus
gaaccagaggtgagaactgtacatt

SEQ ID NO: 293418 - DNA, 25 bp, Rattus norvegicus
gaaccagaggtgtgaactgtacatt

SEQ ID NO: 293419 - DNA, 25 bp, Rattus norvegicus
gaaccagagtagagggaccagcatt

SEQ ID NO: 293420 - DNA, 25 bp, Rattus norvegicus
gaaccagagtagtgggaccagcatt

SEQ ID NO: 293421 - DNA, 25 bp, Rattus norvegicus
gaaccagagtataccatgacagtga

SEQ ID NO: 293422 - DNA, 25 bp, Rattus norvegicus
gaaccagagtattccatgacagtga

SEQ ID NO: 293423 - DNA, 25 bp, Rattus norvegicus
gaaccagagtctacctgttgccaaa

SEQ ID NO: 293424 - DNA, 25 bp, Rattus norvegicus
gaaccagagtcttcctgttgccaaa

SEQ ID NO: 293425 - DNA, 25 bp, Rattus norvegicus
gaaccagagtgaccctgtttgcttg

SEQ ID NO: 293426 - DNA, 25 bp, Rattus norvegicus
gaaccagagtgagcctgtttgcttg

SEQ ID NO: 293427 - DNA, 25 bp, Rattus norvegicus
gaaccagatcagaagctcctgcaaa

SEQ ID NO: 293428 - DNA, 25 bp, Rattus norvegicus
gaaccagatcagtagctcctgcaaa

SEQ ID NO: 293429 - DNA, 25 bp, Rattus norvegicus
gaaccagatgagagcaacgcccgtt

SEQ ID NO: 293430 - DNA, 25 bp, Rattus norvegicus
gaaccagatgagtgcaacgcccgtt

SEQ ID NO: 293431 - DNA, 25 bp, Rattus norvegicus
gaaccagatgtgatgatgcttgctt

SEQ ID NO: 293432 - DNA, 25 bp, Rattus norvegicus
gaaccagatgtgttgatgcttgctt

SEQ ID NO: 293433 - DNA, 25 bp, Rattus norvegicus
gaaccagattcccatgagtacctgg

SEQ ID NO: 293434 - DNA, 25 bp, Rattus norvegicus
gaaccagattccgatgagtacctgg

SEQ ID NO: 293435 - DNA, 25 bp, Rattus norvegicus
gaaccagcacctaaagaacacctac

SEQ ID NO: 293436 - DNA, 25 bp, Rattus norvegicus
gaaccagcaccttaagaacacctac

SEQ ID NO: 293437 - DNA, 25 bp, Rattus norvegicus
gaaccagcactaccaggttaacttt

SEQ ID NO: 293438 - DNA, 25 bp, Rattus norvegicus
gaaccagcactagcaggttaacttt

SEQ ID NO: 293439 - DNA, 25 bp, Rattus norvegicus
gaaccagcagatcacaccgtacatg

SEQ ID NO: 293440 - DNA, 25 bp, Rattus norvegicus
gaaccagcagatgacaccgtacatg

SEQ ID NO: 293441 - DNA, 25 bp, Rattus norvegicus
gaaccagcaggacacatgaattcaa

SEQ ID NO: 293442 - DNA, 25 bp, Rattus norvegicus
gaaccagcaggagacatgaattcaa

SEQ ID NO: 293443 - DNA, 25 bp, Rattus norvegicus
gaaccagcaggcacaacttgaaata

SEQ ID NO: 293444 - DNA, 25 bp, Rattus norvegicus
gaaccagcaggctcaacttgaaata

SEQ ID NO: 293445 - DNA, 25 bp, Rattus norvegicus
gaaccagcagttctggctacaggaa

SEQ ID NO: 293446 - DNA, 25 bp, Rattus norvegicus
gaaccagcagttgtggctacaggaa

SEQ ID NO: 293447 - DNA, 25 bp, Rattus norvegicus
gaaccagcatgcctgtactgagcat

SEQ ID NO: 293448 - DNA, 25 bp, Rattus norvegicus
gaaccagcatgcgtgtactgagcat

SEQ ID NO: 293449 - DNA, 25 bp, Rattus norvegicus
gaaccagcatttaaggccacattta

SEQ ID NO: 293450 - DNA, 25 bp, Rattus norvegicus
gaaccagcattttaggccacattta

SEQ ID NO: 293451 - DNA, 25 bp, Rattus norvegicus
gaaccagccaacattggtgtcacta

SEQ ID NO: 293452 - DNA, 25 bp, Rattus norvegicus
gaaccagccaactttggtgtcacta

SEQ ID NO: 293453 - DNA, 25 bp, Rattus norvegicus
gaaccagccaataagattagccgtg

SEQ ID NO: 293454 - DNA, 25 bp, Rattus norvegicus
gaaccagccaattagattagccgtg

SEQ ID NO: 293455 - DNA, 25 bp, Rattus norvegicus
gaaccagcccgcaggaattcataag

SEQ ID NO: 293456 - DNA, 25 bp, Rattus norvegicus
gaaccagcccgctggaattcataag

SEQ ID NO: 293457 - DNA, 25 bp, Rattus norvegicus
gaaccagccggcaattatacactca

SEQ ID NO: 293458 - DNA, 25 bp, Rattus norvegicus
gaaccagccggctattatacactca

SEQ ID NO: 293459 - DNA, 25 bp, Rattus norvegicus
gaaccagccgttacttcttatgttt

SEQ ID NO: 293460 - DNA, 25 bp, Rattus norvegicus
gaaccagccgtttcttcttatgttt

SEQ ID NO: 293461 - DNA, 25 bp, Rattus norvegicus
gaaccagcctctaagtgttgggaaa

SEQ ID NO: 293462 - DNA, 25 bp, Rattus norvegicus
gaaccagcctctatgcaaaggacta

SEQ ID NO: 293463 - DNA, 25 bp, Rattus norvegicus
gaaccagcctcttagtgttgggaaa

SEQ ID NO: 293464 - DNA, 25 bp, Rattus norvegicus
gaaccagcctctttgcaaaggacta

SEQ ID NO: 293465 - DNA, 25 bp, Rattus norvegicus
gaaccagcctgcaaacctaaggtgt

SEQ ID NO: 293466 - DNA, 25 bp, Rattus norvegicus
gaaccagcctgctaacctaaggtgt

SEQ ID NO: 293467 - DNA, 25 bp, Rattus norvegicus
gaaccagcggttacgctcaaagcat

SEQ ID NO: 293468 - DNA, 25 bp, Rattus norvegicus
gaaccagcggtttcgctcaaagcat

SEQ ID NO: 293469 - DNA, 25 bp, Rattus norvegicus
gaaccagctccgactcagtcctgtg

SEQ ID NO: 293470 - DNA, 25 bp, Rattus norvegicus
gaaccagctccgtctcagtcctgtg

SEQ ID NO: 293471 - DNA, 25 bp, Rattus norvegicus
gaaccagctctgcatatgttggatt

SEQ ID NO: 293472 - DNA, 25 bp, Rattus norvegicus
gaaccagctctggatatgttggatt

SEQ ID NO: 293473 - DNA, 25 bp, Rattus norvegicus
gaaccagctgttaactgcctacatt

SEQ ID NO: 293474 - DNA, 25 bp, Rattus norvegicus
gaaccagctgtttactgcctacatt

SEQ ID NO: 293475 - DNA, 25 bp, Rattus norvegicus
gaaccaggaactcatgacgcacaca

SEQ ID NO: 293476 - DNA, 25 bp, Rattus norvegicus
gaaccaggaactgatgacgcacaca

SEQ ID NO: 293477 - DNA, 25 bp, Rattus norvegicus
gaaccaggaccactaagatctaata

SEQ ID NO: 293478 - DNA, 25 bp, Rattus norvegicus
gaaccaggaccagtaagatctaata

SEQ ID NO: 293479 - DNA, 25 bp, Rattus norvegicus
gaaccaggagcaacaccaaggtctg

SEQ ID NO: 293480 - DNA, 25 bp, Rattus norvegicus
gaaccaggagcatcaccaaggtctg

SEQ ID NO: 293481 - DNA, 25 bp, Rattus norvegicus
gaaccaggagttcaatttgagcact

SEQ ID NO: 293482 - DNA, 25 bp, Rattus norvegicus
gaaccaggagttgaatttgagcact

SEQ ID NO: 293483 - DNA, 25 bp, Rattus norvegicus
gaaccaggcactctggcactagtta

SEQ ID NO: 293484 - DNA, 25 bp, Rattus norvegicus
gaaccaggcactgtggcactagtta

SEQ ID NO: 293485 - DNA, 25 bp, Rattus norvegicus
gaaccaggcagccaaacacacgatg

SEQ ID NO: 293486 - DNA, 25 bp, Rattus norvegicus
gaaccaggcagcgaaacacacgatg

SEQ ID NO: 293487 - DNA, 25 bp, Rattus norvegicus
gaaccaggcccgaaagtacatgaat

SEQ ID NO: 293488 - DNA, 25 bp, Rattus norvegicus
gaaccaggcccgtaagtacatgaat

SEQ ID NO: 293489 - DNA, 25 bp, Rattus norvegicus
gaaccaggcgctacagactgtgtaa

SEQ ID NO: 293490 - DNA, 25 bp, Rattus norvegicus
gaaccaggcgcttcagactgtgtaa

SEQ ID NO: 293491 - DNA, 25 bp, Rattus norvegicus
gaaccaggctacagttgaagtacat

SEQ ID NO: 293492 - DNA, 25 bp, Rattus norvegicus
gaaccaggctactgttgaagtacat

SEQ ID NO: 293493 - DNA, 25 bp, Rattus norvegicus
gaaccaggctgcctctgaactgagg

SEQ ID NO: 293494 - DNA, 25 bp, Rattus norvegicus
gaaccaggctgcgtctgaactgagg

SEQ ID NO: 293495 - DNA, 25 bp, Rattus norvegicus
gaaccagggattcagctcaaggctg

SEQ ID NO: 293496 - DNA, 25 bp, Rattus norvegicus
gaaccagggattgagctcaaggctg

SEQ ID NO: 293497 - DNA, 25 bp, Rattus norvegicus
gaaccagggccacatgtgcatcaac

SEQ ID NO: 293498 - DNA, 25 bp, Rattus norvegicus
gaaccagggccagatgtgcatcaac

SEQ ID NO: 293499 - DNA, 25 bp, Rattus norvegicus
gaaccagggttcctaagtggcccag

SEQ ID NO: 293500 - DNA, 25 bp, Rattus norvegicus
gaaccagggttcgtaagtggcccag

SEQ ID NO: 293501 - DNA, 25 bp, Rattus norvegicus
gaaccaggtcacaacttagcaggct

SEQ ID NO: 293502 - DNA, 25 bp, Rattus norvegicus
gaaccaggtcactacttagcaggct

SEQ ID NO: 293503 - DNA, 25 bp, Rattus norvegicus
gaaccaggtctgagaggctccatag

SEQ ID NO: 293504 - DNA, 25 bp, Rattus norvegicus
gaaccaggtctgtgaggctccatag

SEQ ID NO: 293505 - DNA, 25 bp, Rattus norvegicus
gaaccagtaaccacataggaagagc

SEQ ID NO: 293506 - DNA, 25 bp, Rattus norvegicus
gaaccagtaacctcataggaagagc

SEQ ID NO: 293507 - DNA, 25 bp, Rattus norvegicus
gaaccagtaagcaaggccgctactt

SEQ ID NO: 293508 - DNA, 25 bp, Rattus norvegicus
gaaccagtaagctaggccgctactt

SEQ ID NO: 293509 - DNA, 25 bp, Rattus norvegicus
gaaccagtagctattcttctattga

SEQ ID NO: 293510 - DNA, 25 bp, Rattus norvegicus
gaaccagtagcttttcttctattga

SEQ ID NO: 293511 - DNA, 25 bp, Rattus norvegicus
gaaccagtatccaactgtttgcagt

SEQ ID NO: 293512 - DNA, 25 bp, Rattus norvegicus
gaaccagtatcctactgtttgcagt

SEQ ID NO: 293513 - DNA, 25 bp, Rattus norvegicus
gaaccagtattgatcgcatggcctt

SEQ ID NO: 293514 - DNA, 25 bp, Rattus norvegicus
gaaccagtattgttcgcatggcctt

SEQ ID NO: 293515 - DNA, 25 bp, Rattus norvegicus
gaaccagtcctcatgaagactctgg

SEQ ID NO: 293516 - DNA, 25 bp, Rattus norvegicus
gaaccagtcctcttgaagactctgg

SEQ ID NO: 293517 - DNA, 25 bp, Rattus norvegicus
gaaccagtcgaaagccagatcacat

SEQ ID NO: 293518 - DNA, 25 bp, Rattus norvegicus
gaaccagtcgaatgccagatcacat

SEQ ID NO: 293519 - DNA, 25 bp, Rattus norvegicus
gaaccagtctagatatgacccacta

SEQ ID NO: 293520 - DNA, 25 bp, Rattus norvegicus
gaaccagtctagttatgacccacta

SEQ ID NO: 293521 - DNA, 25 bp, Rattus norvegicus
gaaccagtcttacagtacttccagg

SEQ ID NO: 293522 - DNA, 25 bp, Rattus norvegicus
gaaccagtcttagagtacttccagg

SEQ ID NO: 293523 - DNA, 25 bp, Rattus norvegicus
gaaccagtgacaaatggaccagcac

SEQ ID NO: 293524 - DNA, 25 bp, Rattus norvegicus
gaaccagtgacatatggaccagcac

SEQ ID NO: 293525 - DNA, 25 bp, Rattus norvegicus
gaaccagtgcatcgaggaacgttat

SEQ ID NO: 293526 - DNA, 25 bp, Rattus norvegicus
gaaccagtgcatggaggaacgttat

SEQ ID NO: 293527 - DNA, 25 bp, Rattus norvegicus
gaaccagtgcccacgattggatgct

SEQ ID NO: 293528 - DNA, 25 bp, Rattus norvegicus
gaaccagtgccctcgattggatgct

SEQ ID NO: 293529 - DNA, 25 bp, Rattus norvegicus
gaaccagtggacagaccagctcaga

SEQ ID NO: 293530 - DNA, 25 bp, Rattus norvegicus
gaaccagtggactgaccagctcaga

SEQ ID NO: 293531 - DNA, 25 bp, Rattus norvegicus
gaaccagtgtgtcttttgacactcc

SEQ ID NO: 293532 - DNA, 25 bp, Rattus norvegicus
gaaccagtgtgtgttttgacactcc

SEQ ID NO: 293533 - DNA, 25 bp, Rattus norvegicus
gaaccagtgttgaccagtgggcctt

SEQ ID NO: 293534 - DNA, 25 bp, Rattus norvegicus
gaaccagtgttgtccagtgggcctt

SEQ ID NO: 293535 - DNA, 25 bp, Rattus norvegicus
gaaccagttcaacacagcctctgtt

SEQ ID NO: 293536 - DNA, 25 bp, Rattus norvegicus
gaaccagttcaagacagcctctgtt

SEQ ID NO: 293537 - DNA, 25 bp, Rattus norvegicus
gaaccagttcatcacactgagtgca

SEQ ID NO: 293538 - DNA, 25 bp, Rattus norvegicus
gaaccagttcatgacactgagtgca

SEQ ID NO: 293539 - DNA, 25 bp, Rattus norvegicus
gaaccagttctacagcatgctgcac

SEQ ID NO: 293540 - DNA, 25 bp, Rattus norvegicus
gaaccagttctacagggtcctgatg

SEQ ID NO: 293541 - DNA, 25 bp, Rattus norvegicus
gaaccagttctagagcatgctgcac

SEQ ID NO: 293542 - DNA, 25 bp, Rattus norvegicus
gaaccagttctagagggtcctgatg

SEQ ID NO: 293543 - DNA, 25 bp, Rattus norvegicus
gaaccagttgtcatggcactagctg

SEQ ID NO: 293544 - DNA, 25 bp, Rattus norvegicus
gaaccagttgtcttggcactagctg

SEQ ID NO: 293545 - DNA, 25 bp, Rattus norvegicus
gaaccataaagcacacttgcgaaga

SEQ ID NO: 293546 - DNA, 25 bp, Rattus norvegicus
gaaccataaagctcacttgcgaaga

SEQ ID NO: 293547 - DNA, 25 bp, Rattus norvegicus
gaaccataactccaatgccttgtac

SEQ ID NO: 293548 - DNA, 25 bp, Rattus norvegicus
gaaccataactcgaatgccttgtac

SEQ ID NO: 293549 - DNA, 25 bp, Rattus norvegicus
gaaccatacagtagaacctcctgga

SEQ ID NO: 293550 - DNA, 25 bp, Rattus norvegicus
gaaccatacagttgaacctcctgga

SEQ ID NO: 293551 - DNA, 25 bp, Rattus norvegicus
gaaccatacatacaaaccatcaaag

SEQ ID NO: 293552 - DNA, 25 bp, Rattus norvegicus
gaaccatacatagaaaccatcaaag

SEQ ID NO: 293553 - DNA, 25 bp, Rattus norvegicus
gaaccatacctgcattcactctctg

SEQ ID NO: 293554 - DNA, 25 bp, Rattus norvegicus
gaaccatacctggattcactctctg

SEQ ID NO: 293555 - DNA, 25 bp, Rattus norvegicus
gaaccatagtgccagccctgagtca

SEQ ID NO: 293556 - DNA, 25 bp, Rattus norvegicus
gaaccatagtgcgagccctgagtca

SEQ ID NO: 293557 - DNA, 25 bp, Rattus norvegicus
gaaccatagtggcagcatgctggaa

SEQ ID NO: 293558 - DNA, 25 bp, Rattus norvegicus
gaaccatagtgggagcatgctggaa

SEQ ID NO: 293559 - DNA, 25 bp, Rattus norvegicus
gaaccatatcccattagagcacttg

SEQ ID NO: 293560 - DNA, 25 bp, Rattus norvegicus
gaaccatatccctttagagcacttg

SEQ ID NO: 293561 - DNA, 25 bp, Rattus norvegicus
gaaccatattaaacactgtgctgta

SEQ ID NO: 293562 - DNA, 25 bp, Rattus norvegicus
gaaccatattaatcactgtgctgta

SEQ ID NO: 293563 - DNA, 25 bp, Rattus norvegicus
gaaccatatttcaattttgagctct

SEQ ID NO: 293564 - DNA, 25 bp, Rattus norvegicus
gaaccatatttctattttgagctct

SEQ ID NO: 293565 - DNA, 25 bp, Rattus norvegicus
gaaccatcaagtaagtcctcatgcc

SEQ ID NO: 293566 - DNA, 25 bp, Rattus norvegicus
gaaccatcaagttagtcctcatgcc

SEQ ID NO: 293567 - DNA, 25 bp, Rattus norvegicus
gaaccatcaccaaccactgtagaag

SEQ ID NO: 293568 - DNA, 25 bp, Rattus norvegicus
gaaccatcaccatccactgtagaag

SEQ ID NO: 293569 - DNA, 25 bp, Rattus norvegicus
gaaccatcacttcctccagagggtg

SEQ ID NO: 293570 - DNA, 25 bp, Rattus norvegicus
gaaccatcacttgctccagagggtg

SEQ ID NO: 293571 - DNA, 25 bp, Rattus norvegicus
gaaccatcagcaagagaggcctagg

SEQ ID NO: 293572 - DNA, 25 bp, Rattus norvegicus
gaaccatcagcatgagaggcctagg

SEQ ID NO: 293573 - DNA, 25 bp, Rattus norvegicus
gaaccatcaggcaagtctcacagac

SEQ ID NO: 293574 - DNA, 25 bp, Rattus norvegicus
gaaccatcaggctagtctcacagac

SEQ ID NO: 293575 - DNA, 25 bp, Rattus norvegicus
gaaccatcagttataagcctacttt

SEQ ID NO: 293576 - DNA, 25 bp, Rattus norvegicus
gaaccatcagttttaagcctacttt

SEQ ID NO: 293577 - DNA, 25 bp, Rattus norvegicus
gaaccatccatcagcatgagcctaa

SEQ ID NO: 293578 - DNA, 25 bp, Rattus norvegicus
gaaccatccatctgcatgagcctaa

SEQ ID NO: 293579 - DNA, 25 bp, Rattus norvegicus
gaaccatccccacaggaagcgcaga

SEQ ID NO: 293580 - DNA, 25 bp, Rattus norvegicus
gaaccatccccagaggaagcgcaga

SEQ ID NO: 293581 - DNA, 25 bp, Rattus norvegicus
gaaccatcctagagatagccttgac

SEQ ID NO: 293582 - DNA, 25 bp, Rattus norvegicus
gaaccatcctagtgatagccttgac

SEQ ID NO: 293583 - DNA, 25 bp, Rattus norvegicus
gaaccatcctcacactgccttgtgt

SEQ ID NO: 293584 - DNA, 25 bp, Rattus norvegicus
gaaccatcctcagactgccttgtgt

SEQ ID NO: 293585 - DNA, 25 bp, Rattus norvegicus
gaaccatcctctcctatagtgagct

SEQ ID NO: 293586 - DNA, 25 bp, Rattus norvegicus
gaaccatcctctgctatagtgagct

SEQ ID NO: 293587 - DNA, 25 bp, Rattus norvegicus
gaaccatcgagaacttcctgaccta

SEQ ID NO: 293588 - DNA, 25 bp, Rattus norvegicus
gaaccatcgagatcttcctgaccta

SEQ ID NO: 293589 - DNA, 25 bp, Rattus norvegicus
gaaccatcggaccttgctgttaatt

SEQ ID NO: 293590 - DNA, 25 bp, Rattus norvegicus
gaaccatcggacgttgctgttaatt

SEQ ID NO: 293591 - DNA, 25 bp, Rattus norvegicus
gaaccatctcaaacaacgaaacaaa

SEQ ID NO: 293592 - DNA, 25 bp, Rattus norvegicus
gaaccatctcaatcaacgaaacaaa

SEQ ID NO: 293593 - DNA, 25 bp, Rattus norvegicus
gaaccatctcggcagttctggtgtt

SEQ ID NO: 293594 - DNA, 25 bp, Rattus norvegicus
gaaccatctcgggagttctggtgtt

SEQ ID NO: 293595 - DNA, 25 bp, Rattus norvegicus
gaaccatctctgcttttcatagaac

SEQ ID NO: 293596 - DNA, 25 bp, Rattus norvegicus
gaaccatctctggttttcatagaac

SEQ ID NO: 293597 - DNA, 25 bp, Rattus norvegicus
gaaccatctgcccatcgtatggaat

SEQ ID NO: 293598 - DNA, 25 bp, Rattus norvegicus
gaaccatctgccgatcgtatggaat

SEQ ID NO: 293599 - DNA, 25 bp, Rattus norvegicus
gaaccatctttcagtgctttggagc

SEQ ID NO: 293600 - DNA, 25 bp, Rattus norvegicus
gaaccatctttctgtgctttggagc

SEQ ID NO: 293601 - DNA, 25 bp, Rattus norvegicus
gaaccatctttgaatccgaagttgt

SEQ ID NO: 293602 - DNA, 25 bp, Rattus norvegicus
gaaccatctttgtatccgaagttgt

SEQ ID NO: 293603 - DNA, 25 bp, Rattus norvegicus
gaaccatgaattctaccatcctcat

SEQ ID NO: 293604 - DNA, 25 bp, Rattus norvegicus
gaaccatgaattgtaccatcctcat

SEQ ID NO: 293605 - DNA, 25 bp, Rattus norvegicus
gaaccatgactaatccagcttatcc

SEQ ID NO: 293606 - DNA, 25 bp, Rattus norvegicus
gaaccatgactattccagcttatcc

SEQ ID NO: 293607 - DNA, 25 bp, Rattus norvegicus
gaaccatgagttatgctagctgcaa

SEQ ID NO: 293608 - DNA, 25 bp, Rattus norvegicus
gaaccatgagttttgctagctgcaa

SEQ ID NO: 293609 - DNA, 25 bp, Rattus norvegicus
gaaccatgatatatgaggctagcct

SEQ ID NO: 293610 - DNA, 25 bp, Rattus norvegicus
gaaccatgatatttgaggctagcct

SEQ ID NO: 293611 - DNA, 25 bp, Rattus norvegicus
gaaccatgatcaatgcctgctgaat

SEQ ID NO: 293612 - DNA, 25 bp, Rattus norvegicus
gaaccatgatcattgcctgctgaat

SEQ ID NO: 293613 - DNA, 25 bp, Rattus norvegicus
gaaccatgctctatgattcaggacg

SEQ ID NO: 293614 - DNA, 25 bp, Rattus norvegicus
gaaccatgctctttgattcaggacg

SEQ ID NO: 293615 - DNA, 25 bp, Rattus norvegicus
gaaccatgctgcattttctgatgta

SEQ ID NO: 293616 - DNA, 25 bp, Rattus norvegicus
gaaccatgctgctttttctgatgta

SEQ ID NO: 293617 - DNA, 25 bp, Rattus norvegicus
gaaccatggacacaggtcctctgag

SEQ ID NO: 293618 - DNA, 25 bp, Rattus norvegicus
gaaccatggacagaggtcctctgag

SEQ ID NO: 293619 - DNA, 25 bp, Rattus norvegicus
gaaccatggaccagggcaatgccat

SEQ ID NO: 293620 - DNA, 25 bp, Rattus norvegicus
gaaccatggacctgggcaatgccat

SEQ ID NO: 293621 - DNA, 25 bp, Rattus norvegicus
gaaccatggcctccggactcagata

SEQ ID NO: 293622 - DNA, 25 bp, Rattus norvegicus
gaaccatggcctgcggactcagata

SEQ ID NO: 293623 - DNA, 25 bp, Rattus norvegicus
gaaccatgtctgaagaatgacctgt

SEQ ID NO: 293624 - DNA, 25 bp, Rattus norvegicus
gaaccatgtctgtagaatgacctgt

SEQ ID NO: 293625 - DNA, 25 bp, Rattus norvegicus
gaaccatgtgcacggaacacacaat

SEQ ID NO: 293626 - DNA, 25 bp, Rattus norvegicus
gaaccatgtgcagggaacacacaat

SEQ ID NO: 293627 - DNA, 25 bp, Rattus norvegicus
gaaccatgtgcgactgttaagctta

SEQ ID NO: 293628 - DNA, 25 bp, Rattus norvegicus
gaaccatgtgcgtctgttaagctta

SEQ ID NO: 293629 - DNA, 25 bp, Rattus norvegicus
gaaccatgtggacagcagcttcttc

SEQ ID NO: 293630 - DNA, 25 bp, Rattus norvegicus
gaaccatgtggagagcagcttcttc

SEQ ID NO: 293631 - DNA, 25 bp, Rattus norvegicus
gaaccattaagcctatctctaccat

SEQ ID NO: 293632 - DNA, 25 bp, Rattus norvegicus
gaaccattaagcgtatctctaccat

SEQ ID NO: 293633 - DNA, 25 bp, Rattus norvegicus
gaaccattaggacagcagcgtttct

SEQ ID NO: 293634 - DNA, 25 bp, Rattus norvegicus
gaaccattaggagagcagcgtttct

SEQ ID NO: 293635 - DNA, 25 bp, Rattus norvegicus
gaaccattcaacatgatcacagtga

SEQ ID NO: 293636 - DNA, 25 bp, Rattus norvegicus
gaaccattcaacttgatcacagtga

SEQ ID NO: 293637 - DNA, 25 bp, Rattus norvegicus
gaaccattctaacccagatgagtaa

SEQ ID NO: 293638 - DNA, 25 bp, Rattus norvegicus
gaaccattctaagccagatgagtaa

SEQ ID NO: 293639 - DNA, 25 bp, Rattus norvegicus
gaaccattcttcagctcggatatct

SEQ ID NO: 293640 - DNA, 25 bp, Rattus norvegicus
gaaccattcttctgctcggatatct

SEQ ID NO: 293641 - DNA, 25 bp, Rattus norvegicus
gaaccattgagtatctgctttagta

SEQ ID NO: 293642 - DNA, 25 bp, Rattus norvegicus
gaaccattgagtttctgctttagta

SEQ ID NO: 293643 - DNA, 25 bp, Rattus norvegicus
gaaccattgcccaaagcctcttggg

SEQ ID NO: 293644 - DNA, 25 bp, Rattus norvegicus
gaaccattgccctaagcctcttggg

SEQ ID NO: 293645 - DNA, 25 bp, Rattus norvegicus
gaaccattgcttagctggtggcaga

SEQ ID NO: 293646 - DNA, 25 bp, Rattus norvegicus
gaaccattgctttgctggtggcaga

SEQ ID NO: 293647 - DNA, 25 bp, Rattus norvegicus
gaaccattggacaaatccacgccat

SEQ ID NO: 293648 - DNA, 25 bp, Rattus norvegicus
gaaccattggactaatccacgccat

SEQ ID NO: 293649 - DNA, 25 bp, Rattus norvegicus
gaaccattgtctattgtggtactgt

SEQ ID NO: 293650 - DNA, 25 bp, Rattus norvegicus
gaaccattgtcttttgtggtactgt

SEQ ID NO: 293651 - DNA, 25 bp, Rattus norvegicus
gaaccattgtgaattgctttatcca

SEQ ID NO: 293652 - DNA, 25 bp, Rattus norvegicus
gaaccattgtgatttgctttatcca

SEQ ID NO: 293653 - DNA, 25 bp, Rattus norvegicus
gaaccattgttgataatccagccga

SEQ ID NO: 293654 - DNA, 25 bp, Rattus norvegicus
gaaccattgttgttaatccagccga

SEQ ID NO: 293655 - DNA, 25 bp, Rattus norvegicus
gaaccatttgaaagagcacgtgcct

SEQ ID NO: 293656 - DNA, 25 bp, Rattus norvegicus
gaaccatttgaatgagcacgtgcct

SEQ ID NO: 293657 - DNA, 25 bp, Rattus norvegicus
gaaccatttgccattaacgaaagag

SEQ ID NO: 293658 - DNA, 25 bp, Rattus norvegicus
gaaccatttgcctttaacgaaagag

SEQ ID NO: 293659 - DNA, 25 bp, Rattus norvegicus
gaaccattttaccaaagaccacatc

SEQ ID NO: 293660 - DNA, 25 bp, Rattus norvegicus
gaaccattttacgaaagaccacatc

SEQ ID NO: 293661 - DNA, 25 bp, Rattus norvegicus
gaaccatttttaaaaccgcgtctgg

SEQ ID NO: 293662 - DNA, 25 bp, Rattus norvegicus
gaaccatttttataaccgcgtctgg

SEQ ID NO: 293663 - DNA, 25 bp, Rattus norvegicus
gaacccaaaggaaacagtgctgcag

SEQ ID NO: 293664 - DNA, 25 bp, Rattus norvegicus
gaacccaaaggatacagtgctgcag

SEQ ID NO: 293665 - DNA, 25 bp, Rattus norvegicus
gaacccaaaggcatcatccaggtgt

SEQ ID NO: 293666 - DNA, 25 bp, Rattus norvegicus
gaacccaaaggcttcatccaggtgt

SEQ ID NO: 293667 - DNA, 25 bp, Rattus norvegicus
gaacccaaattcagaaaggagctct

SEQ ID NO: 293668 - DNA, 25 bp, Rattus norvegicus
gaacccaaattctgaaaggagctct

SEQ ID NO: 293669 - DNA, 25 bp, Rattus norvegicus
gaacccaacaacacagctgtcgtga

SEQ ID NO: 293670 - DNA, 25 bp, Rattus norvegicus
gaacccaacaactcagctgtcgtga

SEQ ID NO: 293671 - DNA, 25 bp, Rattus norvegicus
gaacccaacatgaatccaaagctag

SEQ ID NO: 293672 - DNA, 25 bp, Rattus norvegicus
gaacccaacatgtatccaaagctag

SEQ ID NO: 293673 - DNA, 25 bp, Rattus norvegicus
gaacccaaccaacagcagcttccca

SEQ ID NO: 293674 - DNA, 25 bp, Rattus norvegicus
gaacccaaccaagagcagcttccca

SEQ ID NO: 293675 - DNA, 25 bp, Rattus norvegicus
gaacccaacgcgcagtgattgcacc

SEQ ID NO: 293676 - DNA, 25 bp, Rattus norvegicus
gaacccaacgcggagtgattgcacc

SEQ ID NO: 293677 - DNA, 25 bp, Rattus norvegicus
gaacccaacgctcaggagaagttta

SEQ ID NO: 293678 - DNA, 25 bp, Rattus norvegicus
gaacccaacgctgaggagaagttta

SEQ ID NO: 293679 - DNA, 25 bp, Rattus norvegicus
gaacccaactagcagcagggcgctg

SEQ ID NO: 293680 - DNA, 25 bp, Rattus norvegicus
gaacccaactaggagcagggcgctg

SEQ ID NO: 293681 - DNA, 25 bp, Rattus norvegicus
gaacccaagaacacttcaagttgcg

SEQ ID NO: 293682 - DNA, 25 bp, Rattus norvegicus
gaacccaagaactcttcaagttgcg

SEQ ID NO: 293683 - DNA, 25 bp, Rattus norvegicus
gaacccaagaagattccaataagaa

SEQ ID NO: 293684 - DNA, 25 bp, Rattus norvegicus
gaacccaagaagtttccaataagaa

SEQ ID NO: 293685 - DNA, 25 bp, Rattus norvegicus
gaacccaagagtaaggcccaaacag

SEQ ID NO: 293686 - DNA, 25 bp, Rattus norvegicus
gaacccaagagttaggcccaaacag

SEQ ID NO: 293687 - DNA, 25 bp, Rattus norvegicus
gaacccaagcctcgagatctgattg

SEQ ID NO: 293688 - DNA, 25 bp, Rattus norvegicus
gaacccaagcctggagatctgattg

SEQ ID NO: 293689 - DNA, 25 bp, Rattus norvegicus
gaacccaaggtcacacagacagttt

SEQ ID NO: 293690 - DNA, 25 bp, Rattus norvegicus
gaacccaaggtctcacagacagttt

SEQ ID NO: 293691 - DNA, 25 bp, Rattus norvegicus
gaacccaaggttcacactggagagg

SEQ ID NO: 293692 - DNA, 25 bp, Rattus norvegicus
gaacccaaggttgacactggagagg

SEQ ID NO: 293693 - DNA, 25 bp, Rattus norvegicus
gaacccaagtgtatcatgtgaagat

SEQ ID NO: 293694 - DNA, 25 bp, Rattus norvegicus
gaacccaagtgtttcatgtgaagat

SEQ ID NO: 293695 - DNA, 25 bp, Rattus norvegicus
gaacccacaaggcacagtcagaatt

SEQ ID NO: 293696 - DNA, 25 bp, Rattus norvegicus
gaacccacaagggacagtcagaatt

SEQ ID NO: 293697 - DNA, 25 bp, Rattus norvegicus
gaacccacaagtcatagcttctcag

SEQ ID NO: 293698 - DNA, 25 bp, Rattus norvegicus
gaacccacaagtgatagcttctcag

SEQ ID NO: 293699 - DNA, 25 bp, Rattus norvegicus
gaacccacacaccattgtgtttggg

SEQ ID NO: 293700 - DNA, 25 bp, Rattus norvegicus
gaacccacacacgattgtgtttggg

SEQ ID NO: 293701 - DNA, 25 bp, Rattus norvegicus
gaacccacacatccatcatgttaga

SEQ ID NO: 293702 - DNA, 25 bp, Rattus norvegicus
gaacccacacatgcatcatgttaga

SEQ ID NO: 293703 - DNA, 25 bp, Rattus norvegicus
gaacccacagacctccgtgaatgga

SEQ ID NO: 293704 - DNA, 25 bp, Rattus norvegicus
gaacccacagacgtccgtgaatgga

SEQ ID NO: 293705 - DNA, 25 bp, Rattus norvegicus
gaacccacagtgagatggtcccatt

SEQ ID NO: 293706 - DNA, 25 bp, Rattus norvegicus
gaacccacagtgtgatggtcccatt

SEQ ID NO: 293707 - DNA, 25 bp, Rattus norvegicus
gaacccacagttcatgtctaaaacg

SEQ ID NO: 293708 - DNA, 25 bp, Rattus norvegicus
gaacccacagttgatgtctaaaacg

SEQ ID NO: 293709 - DNA, 25 bp, Rattus norvegicus
gaacccacatacattcgtatctaag

SEQ ID NO: 293710 - DNA, 25 bp, Rattus norvegicus
gaacccacatactttcgtatctaag

SEQ ID NO: 293711 - DNA, 25 bp, Rattus norvegicus
gaacccacatggcaagtcttagtag

SEQ ID NO: 293712 - DNA, 25 bp, Rattus norvegicus
gaacccacatgggaagtcttagtag

SEQ ID NO: 293713 - DNA, 25 bp, Rattus norvegicus
gaacccaccccaagctggagcaaga

SEQ ID NO: 293714 - DNA, 25 bp, Rattus norvegicus
gaacccaccccatgctggagcaaga

SEQ ID NO: 293715 - DNA, 25 bp, Rattus norvegicus
gaacccacccgaaattgttagcaga

SEQ ID NO: 293716 - DNA, 25 bp, Rattus norvegicus
gaacccacccgatattgttagcaga

SEQ ID NO: 293717 - DNA, 25 bp, Rattus norvegicus
gaacccacgacaatacaagatccct

SEQ ID NO: 293718 - DNA, 25 bp, Rattus norvegicus
gaacccacgacattacaagatccct

SEQ ID NO: 293719 - DNA, 25 bp, Rattus norvegicus
gaacccacgattctatcacaagtaa

SEQ ID NO: 293720 - DNA, 25 bp, Rattus norvegicus
gaacccacgattgtatcacaagtaa

SEQ ID NO: 293721 - DNA, 25 bp, Rattus norvegicus
gaacccacgcctcttgggaagagat

SEQ ID NO: 293722 - DNA, 25 bp, Rattus norvegicus
gaacccacgcctgttgggaagagat

SEQ ID NO: 293723 - DNA, 25 bp, Rattus norvegicus
gaacccacgtcaaggttccaccagt

SEQ ID NO: 293724 - DNA, 25 bp, Rattus norvegicus
gaacccacgtcatggttccaccagt

SEQ ID NO: 293725 - DNA, 25 bp, Rattus norvegicus
gaacccacgttacctctgtgtggta

SEQ ID NO: 293726 - DNA, 25 bp, Rattus norvegicus
gaacccacgttagctctgtgtggta

SEQ ID NO: 293727 - DNA, 25 bp, Rattus norvegicus
gaacccactgatcctcgggaactct

SEQ ID NO: 293728 - DNA, 25 bp, Rattus norvegicus
gaacccactgatgctcgggaactct

SEQ ID NO: 293729 - DNA, 25 bp, Rattus norvegicus
gaacccactgttaggagtgctgact

SEQ ID NO: 293730 - DNA, 25 bp, Rattus norvegicus
gaacccactgtttggagtgctgact

SEQ ID NO: 293731 - DNA, 25 bp, Rattus norvegicus
gaacccacttaactggagagcacag

SEQ ID NO: 293732 - DNA, 25 bp, Rattus norvegicus
gaacccacttaagtggagagcacag

SEQ ID NO: 293733 - DNA, 25 bp, Rattus norvegicus
gaacccacttgccaaattggactca

SEQ ID NO: 293734 - DNA, 25 bp, Rattus norvegicus
gaacccacttgcgaaattggactca

SEQ ID NO: 293735 - DNA, 25 bp, Rattus norvegicus
gaacccagaataataacagccccat

SEQ ID NO: 293736 - DNA, 25 bp, Rattus norvegicus
gaacccagaatattaacagccccat

SEQ ID NO: 293737 - DNA, 25 bp, Rattus norvegicus
gaacccagaatgattccctaagaga

SEQ ID NO: 293738 - DNA, 25 bp, Rattus norvegicus
gaacccagaatgtttccctaagaga

SEQ ID NO: 293739 - DNA, 25 bp, Rattus norvegicus
gaacccagactacctgtggtgccag

SEQ ID NO: 293740 - DNA, 25 bp, Rattus norvegicus
gaacccagactagctgtggtgccag

SEQ ID NO: 293741 - DNA, 25 bp, Rattus norvegicus
gaacccagagccacaaatacgctag

SEQ ID NO: 293742 - DNA, 25 bp, Rattus norvegicus
gaacccagagcctcaaatacgctag

SEQ ID NO: 293743 - DNA, 25 bp, Rattus norvegicus
gaacccagagggaggtctatactta

SEQ ID NO: 293744 - DNA, 25 bp, Rattus norvegicus
gaacccagagggtggtctatactta

SEQ ID NO: 293745 - DNA, 25 bp, Rattus norvegicus
gaacccagagtgaagtcagccctgt

SEQ ID NO: 293746 - DNA, 25 bp, Rattus norvegicus
gaacccagagtgtagtcagccctgt

SEQ ID NO: 293747 - DNA, 25 bp, Rattus norvegicus
gaacccagagttatctgcaaactag

SEQ ID NO: 293748 - DNA, 25 bp, Rattus norvegicus
gaacccagagttttctgcaaactag

SEQ ID NO: 293749 - DNA, 25 bp, Rattus norvegicus
gaacccagatgtacagcaggccctg

SEQ ID NO: 293750 - DNA, 25 bp, Rattus norvegicus
gaacccagatgttcagcaggccctg

SEQ ID NO: 293751 - DNA, 25 bp, Rattus norvegicus
gaacccagcagaaactaaccggata

SEQ ID NO: 293752 - DNA, 25 bp, Rattus norvegicus
gaacccagcagatactaaccggata

SEQ ID NO: 293753 - DNA, 25 bp, Rattus norvegicus
gaacccagcagccatactgtgagga

SEQ ID NO: 293754 - DNA, 25 bp, Rattus norvegicus
gaacccagcagcgatactgtgagga

SEQ ID NO: 293755 - DNA, 25 bp, Rattus norvegicus
gaacccagcataattcttcaaatgg

SEQ ID NO: 293756 - DNA, 25 bp, Rattus norvegicus
gaacccagcatatttcttcaaatgg

SEQ ID NO: 293757 - DNA, 25 bp, Rattus norvegicus
gaacccagcatgcattttgcaggat

SEQ ID NO: 293758 - DNA, 25 bp, Rattus norvegicus
gaacccagcatggattttgcaggat

SEQ ID NO: 293759 - DNA, 25 bp, Rattus norvegicus
gaacccagccctaatcatgttaagt

SEQ ID NO: 293760 - DNA, 25 bp, Rattus norvegicus
gaacccagcccttatcatgttaagt

SEQ ID NO: 293761 - DNA, 25 bp, Rattus norvegicus
gaacccagctctacgtcaaagttaa

SEQ ID NO: 293762 - DNA, 25 bp, Rattus norvegicus
gaacccagctcttcgtcaaagttaa

SEQ ID NO: 293763 - DNA, 25 bp, Rattus norvegicus
gaacccagctgcatagcaagggctc

SEQ ID NO: 293764 - DNA, 25 bp, Rattus norvegicus
gaacccagctgcttagcaagggctc

SEQ ID NO: 293765 - DNA, 25 bp, Rattus norvegicus
gaacccaggaggatgctagcccagt

SEQ ID NO: 293766 - DNA, 25 bp, Rattus norvegicus
gaacccaggaggttgctagcccagt

SEQ ID NO: 293767 - DNA, 25 bp, Rattus norvegicus
gaacccaggagtcaagccttcggta

SEQ ID NO: 293768 - DNA, 25 bp, Rattus norvegicus
gaacccaggagtctggcatcttctt

SEQ ID NO: 293769 - DNA, 25 bp, Rattus norvegicus
gaacccaggagtgaagccttcggta

SEQ ID NO: 293770 - DNA, 25 bp, Rattus norvegicus
gaacccaggagtgtggcatcttctt

SEQ ID NO: 293771 - DNA, 25 bp, Rattus norvegicus
gaacccagggacaccattaggcgca

SEQ ID NO: 293772 - DNA, 25 bp, Rattus norvegicus
gaacccagggactccattaggcgca

SEQ ID NO: 293773 - DNA, 25 bp, Rattus norvegicus
gaacccagggccacttttgtgttag

SEQ ID NO: 293774 - DNA, 25 bp, Rattus norvegicus
gaacccagggcctcttttgtgttag

SEQ ID NO: 293775 - DNA, 25 bp, Rattus norvegicus
gaacccagggttccatacaacttag

SEQ ID NO: 293776 - DNA, 25 bp, Rattus norvegicus
gaacccagggttgcatacaacttag

SEQ ID NO: 293777 - DNA, 25 bp, Rattus norvegicus
gaacccaggtgaaggtgctgtccac

SEQ ID NO: 293778 - DNA, 25 bp, Rattus norvegicus
gaacccaggtgatggtgctgtccac

SEQ ID NO: 293779 - DNA, 25 bp, Rattus norvegicus
gaacccaggttcagagctggtaact

SEQ ID NO: 293780 - DNA, 25 bp, Rattus norvegicus
gaacccaggttcagattccgtttct

SEQ ID NO: 293781 - DNA, 25 bp, Rattus norvegicus
gaacccaggttctgagctggtaact

SEQ ID NO: 293782 - DNA, 25 bp, Rattus norvegicus
gaacccaggttctgattccgtttct

SEQ ID NO: 293783 - DNA, 25 bp, Rattus norvegicus
gaacccagtaccaacgtagggagtg

SEQ ID NO: 293784 - DNA, 25 bp, Rattus norvegicus
gaacccagtacctacgtagggagtg

SEQ ID NO: 293785 - DNA, 25 bp, Rattus norvegicus
gaacccagtagtattactttctgtg

SEQ ID NO: 293786 - DNA, 25 bp, Rattus norvegicus
gaacccagtagttttactttctgtg

SEQ ID NO: 293787 - DNA, 25 bp, Rattus norvegicus
gaacccagtcacagtttcagctaga

SEQ ID NO: 293788 - DNA, 25 bp, Rattus norvegicus
gaacccagtcactgtttcagctaga

SEQ ID NO: 293789 - DNA, 25 bp, Rattus norvegicus
gaacccagtcttcaacatttacctg

SEQ ID NO: 293790 - DNA, 25 bp, Rattus norvegicus
gaacccagtcttgaacatttacctg

SEQ ID NO: 293791 - DNA, 25 bp, Rattus norvegicus
gaacccagtgctcagattctcgtgt

SEQ ID NO: 293792 - DNA, 25 bp, Rattus norvegicus
gaacccagtgctgagattctcgtgt

SEQ ID NO: 293793 - DNA, 25 bp, Rattus norvegicus
gaacccataatgactacggatatat

SEQ ID NO: 293794 - DNA, 25 bp, Rattus norvegicus
gaacccataatgtctacggatatat

SEQ ID NO: 293795 - DNA, 25 bp, Rattus norvegicus
gaacccataggtagtttccccagag

SEQ ID NO: 293796 - DNA, 25 bp, Rattus norvegicus
gaacccataggttgtttccccagag

SEQ ID NO: 293797 - DNA, 25 bp, Rattus norvegicus
gaacccatagtaacgctcaagtaaa

SEQ ID NO: 293798 - DNA, 25 bp, Rattus norvegicus
gaacccatagtatcgctcaagtaaa

SEQ ID NO: 293799 - DNA, 25 bp, Rattus norvegicus
gaacccatcttgagacctttgctgt

SEQ ID NO: 293800 - DNA, 25 bp, Rattus norvegicus
gaacccatcttgtgacctttgctgt

SEQ ID NO: 293801 - DNA, 25 bp, Rattus norvegicus
gaacccatgaccctgatttagtcgt

SEQ ID NO: 293802 - DNA, 25 bp, Rattus norvegicus
gaacccatgaccgtgatttagtcgt

SEQ ID NO: 293803 - DNA, 25 bp, Rattus norvegicus
gaacccatgatacactagcggacta

SEQ ID NO: 293804 - DNA, 25 bp, Rattus norvegicus
gaacccatgatagactagcggacta

SEQ ID NO: 293805 - DNA, 25 bp, Rattus norvegicus
gaacccatgcagctgtgaagatcgc

SEQ ID NO: 293806 - DNA, 25 bp, Rattus norvegicus
gaacccatgcaggtgtgaagatcgc

SEQ ID NO: 293807 - DNA, 25 bp, Rattus norvegicus
gaacccatgggaccactcacatgaa

SEQ ID NO: 293808 - DNA, 25 bp, Rattus norvegicus
gaacccatgggagcactcacatgaa

SEQ ID NO: 293809 - DNA, 25 bp, Rattus norvegicus
gaacccatgtttagagctactagct

SEQ ID NO: 293810 - DNA, 25 bp, Rattus norvegicus
gaacccatgtttcttatcctctgtt

SEQ ID NO: 293811 - DNA, 25 bp, Rattus norvegicus
gaacccatgtttgttatcctctgtt

SEQ ID NO: 293812 - DNA, 25 bp, Rattus norvegicus
gaacccatgttttgagctactagct

SEQ ID NO: 293813 - DNA, 25 bp, Rattus norvegicus
gaacccattagcatcggcatcgatc

SEQ ID NO: 293814 - DNA, 25 bp, Rattus norvegicus
gaacccattagcttcggcatcgatc

SEQ ID NO: 293815 - DNA, 25 bp, Rattus norvegicus
gaacccattcatcataagtcttaca

SEQ ID NO: 293816 - DNA, 25 bp, Rattus norvegicus
gaacccattcatgataagtcttaca

SEQ ID NO: 293817 - DNA, 25 bp, Rattus norvegicus
gaaccccaaattccctgagaagctg

SEQ ID NO: 293818 - DNA, 25 bp, Rattus norvegicus
gaaccccaaattctgcctcttaaat

SEQ ID NO: 293819 - DNA, 25 bp, Rattus norvegicus
gaaccccaaattgcctgagaagctg

SEQ ID NO: 293820 - DNA, 25 bp, Rattus norvegicus
gaaccccaaattgtgcctcttaaat

SEQ ID NO: 293821 - DNA, 25 bp, Rattus norvegicus
gaaccccaaggtcttcctgtttcag

SEQ ID NO: 293822 - DNA, 25 bp, Rattus norvegicus
gaaccccaaggtgttcctgtttcag

SEQ ID NO: 293823 - DNA, 25 bp, Rattus norvegicus
gaaccccaatacctattccgaagat

SEQ ID NO: 293824 - DNA, 25 bp, Rattus norvegicus
gaaccccaatacgtattccgaagat

SEQ ID NO: 293825 - DNA, 25 bp, Rattus norvegicus
gaaccccacagacaatgccggctta

SEQ ID NO: 293826 - DNA, 25 bp, Rattus norvegicus
gaaccccacagagaatgccggctta

SEQ ID NO: 293827 - DNA, 25 bp, Rattus norvegicus
gaaccccaccttaaaggtgctgaag

SEQ ID NO: 293828 - DNA, 25 bp, Rattus norvegicus
gaaccccacctttaaggtgctgaag

SEQ ID NO: 293829 - DNA, 25 bp, Rattus norvegicus
gaaccccacgcacaatgtcaggtga

SEQ ID NO: 293830 - DNA, 25 bp, Rattus norvegicus
gaaccccacgcagaatgtcaggtga

SEQ ID NO: 293831 - DNA, 25 bp, Rattus norvegicus
gaaccccacgtcatccaatcaggag

SEQ ID NO: 293832 - DNA, 25 bp, Rattus norvegicus
gaaccccacgtcttccaatcaggag

SEQ ID NO: 293833 - DNA, 25 bp, Rattus norvegicus
gaaccccagcagagcggtcctttgg

SEQ ID NO: 293834 - DNA, 25 bp, Rattus norvegicus
gaaccccagcagtgcggtcctttgg

SEQ ID NO: 293835 - DNA, 25 bp, Rattus norvegicus
gaaccccaggtacagatgtctgtgt

SEQ ID NO: 293836 - DNA, 25 bp, Rattus norvegicus
gaaccccaggtagagatgtctgtgt

SEQ ID NO: 293837 - DNA, 25 bp, Rattus norvegicus
gaaccccaggttaagtccatcgata

SEQ ID NO: 293838 - DNA, 25 bp, Rattus norvegicus
gaaccccaggtttagtccatcgata

SEQ ID NO: 293839 - DNA, 25 bp, Rattus norvegicus
gaaccccagtaactacgacgtgtca

SEQ ID NO: 293840 - DNA, 25 bp, Rattus norvegicus
gaaccccagtaagtacgacgtgtca

SEQ ID NO: 293841 - DNA, 25 bp, Rattus norvegicus
gaaccccagtacacggaacgctgaa

SEQ ID NO: 293842 - DNA, 25 bp, Rattus norvegicus
gaaccccagtactcggaacgctgaa

SEQ ID NO: 293843 - DNA, 25 bp, Rattus norvegicus
gaaccccatatacgacacgtacatg

SEQ ID NO: 293844 - DNA, 25 bp, Rattus norvegicus
gaaccccatataggacacgtacatg

SEQ ID NO: 293845 - DNA, 25 bp, Rattus norvegicus
gaaccccatcacaggtaggctaaag

SEQ ID NO: 293846 - DNA, 25 bp, Rattus norvegicus
gaaccccatcactggtaggctaaag

SEQ ID NO: 293847 - DNA, 25 bp, Rattus norvegicus
gaaccccatggtagttttctgattg

SEQ ID NO: 293848 - DNA, 25 bp, Rattus norvegicus
gaaccccatggtatcacaggcaaag

SEQ ID NO: 293849 - DNA, 25 bp, Rattus norvegicus
gaaccccatggttgttttctgattg

SEQ ID NO: 293850 - DNA, 25 bp, Rattus norvegicus
gaaccccatggtttcacaggcaaag

SEQ ID NO: 293851 - DNA, 25 bp, Rattus norvegicus
gaaccccattctatcctgaggaagg

SEQ ID NO: 293852 - DNA, 25 bp, Rattus norvegicus
gaaccccattctttcctgaggaagg

SEQ ID NO: 293853 - DNA, 25 bp, Rattus norvegicus
gaaccccattgacaagtccctttag

SEQ ID NO: 293854 - DNA, 25 bp, Rattus norvegicus
gaaccccattgagaagtccctttag

SEQ ID NO: 293855 - DNA, 25 bp, Rattus norvegicus
gaaccccgacagaggatgtctctag

SEQ ID NO: 293856 - DNA, 25 bp, Rattus norvegicus
gaaccccgacagatgtcttgtattt

SEQ ID NO: 293857 - DNA, 25 bp, Rattus norvegicus
gaaccccgacagtggatgtctctag

SEQ ID NO: 293858 - DNA, 25 bp, Rattus norvegicus
gaaccccgacagttgtcttgtattt

SEQ ID NO: 293859 - DNA, 25 bp, Rattus norvegicus
gaaccccgatgaattgactcaacgt

SEQ ID NO: 293860 - DNA, 25 bp, Rattus norvegicus
gaaccccgatgatttgactcaacgt

SEQ ID NO: 293861 - DNA, 25 bp, Rattus norvegicus
gaaccccgcgttccttgcagcgata

SEQ ID NO: 293862 - DNA, 25 bp, Rattus norvegicus
gaaccccgcgttgcttgcagcgata

SEQ ID NO: 293863 - DNA, 25 bp, Rattus norvegicus
gaaccccgttgcacaggtctttgag

SEQ ID NO: 293864 - DNA, 25 bp, Rattus norvegicus
gaaccccgttgctcaggtctttgag

SEQ ID NO: 293865 - DNA, 25 bp, Rattus norvegicus
gaacccctaaacacaatgctgcaag

SEQ ID NO: 293866 - DNA, 25 bp, Rattus norvegicus
gaacccctaaactcaatgctgcaag

SEQ ID NO: 293867 - DNA, 25 bp, Rattus norvegicus
gaacccctacaaagccacaggagga

SEQ ID NO: 293868 - DNA, 25 bp, Rattus norvegicus
gaacccctacaatgccacaggagga

SEQ ID NO: 293869 - DNA, 25 bp, Rattus norvegicus
gaacccctagtgcatgcttgaaacc

SEQ ID NO: 293870 - DNA, 25 bp, Rattus norvegicus
gaacccctagtggatgcttgaaacc

SEQ ID NO: 293871 - DNA, 25 bp, Rattus norvegicus
gaacccctctaacgacatgtatgca

SEQ ID NO: 293872 - DNA, 25 bp, Rattus norvegicus
gaacccctctaaggacatgtatgca

SEQ ID NO: 293873 - DNA, 25 bp, Rattus norvegicus
gaacccctctcacaatataatcaaa

SEQ ID NO: 293874 - DNA, 25 bp, Rattus norvegicus
gaacccctctcagaatataatcaaa

SEQ ID NO: 293875 - DNA, 25 bp, Rattus norvegicus
gaacccctctgaccaagctgaacat

SEQ ID NO: 293876 - DNA, 25 bp, Rattus norvegicus
gaacccctctgagcaagctgaacat

SEQ ID NO: 293877 - DNA, 25 bp, Rattus norvegicus
gaacccctgaacctgacaatcatta

SEQ ID NO: 293878 - DNA, 25 bp, Rattus norvegicus
gaacccctgaacgtgacaatcatta

SEQ ID NO: 293879 - DNA, 25 bp, Rattus norvegicus
gaacccctgaggcaggaccattcgg

SEQ ID NO: 293880 - DNA, 25 bp, Rattus norvegicus
gaacccctgagggaggaccattcgg

SEQ ID NO: 293881 - DNA, 25 bp, Rattus norvegicus
gaacccctgcacagaatgtacggag

SEQ ID NO: 293882 - DNA, 25 bp, Rattus norvegicus
gaacccctgcactgaatgtacggag

SEQ ID NO: 293883 - DNA, 25 bp, Rattus norvegicus
gaacccctgcagatagtgtagacta

SEQ ID NO: 293884 - DNA, 25 bp, Rattus norvegicus
gaacccctgcagttagtgtagacta

SEQ ID NO: 293885 - DNA, 25 bp, Rattus norvegicus
gaacccctgctaagttggtagtgct

SEQ ID NO: 293886 - DNA, 25 bp, Rattus norvegicus
gaacccctgctatgttggtagtgct

SEQ ID NO: 293887 - DNA, 25 bp, Rattus norvegicus
gaacccctgctgacgcctggaaaaa

SEQ ID NO: 293888 - DNA, 25 bp, Rattus norvegicus
gaacccctgctgtcgcctggaaaaa

SEQ ID NO: 293889 - DNA, 25 bp, Rattus norvegicus
gaacccctggcaacaggatcgttta

SEQ ID NO: 293890 - DNA, 25 bp, Rattus norvegicus
gaacccctggcatcaggatcgttta

SEQ ID NO: 293891 - DNA, 25 bp, Rattus norvegicus
gaacccctgtcaatttagcctgaag

SEQ ID NO: 293892 - DNA, 25 bp, Rattus norvegicus
gaacccctgtcattttagcctgaag

SEQ ID NO: 293893 - DNA, 25 bp, Rattus norvegicus
gaacccctgtggacagttgacagct

SEQ ID NO: 293894 - DNA, 25 bp, Rattus norvegicus
gaacccctgtggtcagttgacagct

SEQ ID NO: 293895 - DNA, 25 bp, Rattus norvegicus
gaacccctgttcatagcaaactgta

SEQ ID NO: 293896 - DNA, 25 bp, Rattus norvegicus
gaacccctgttcttagcaaactgta

SEQ ID NO: 293897 - DNA, 25 bp, Rattus norvegicus
gaacccctgtttagctaccacagag

SEQ ID NO: 293898 - DNA, 25 bp, Rattus norvegicus
gaacccctgtttctaggaagggcat

SEQ ID NO: 293899 - DNA, 25 bp, Rattus norvegicus
gaacccctgtttgtaggaagggcat

SEQ ID NO: 293900 - DNA, 25 bp, Rattus norvegicus
gaacccctgttttgctaccacagag

SEQ ID NO: 293901 - DNA, 25 bp, Rattus norvegicus
gaaccccttcgtcgtagatctttag

SEQ ID NO: 293902 - DNA, 25 bp, Rattus norvegicus
gaaccccttcgtggtagatctttag

SEQ ID NO: 293903 - DNA, 25 bp, Rattus norvegicus
gaaccccttctccaaggtgtagtct

SEQ ID NO: 293904 - DNA, 25 bp, Rattus norvegicus
gaaccccttctcgaaggtgtagtct

SEQ ID NO: 293905 - DNA, 25 bp, Rattus norvegicus
gaacccctttatctatagcctgaga

SEQ ID NO: 293906 - DNA, 25 bp, Rattus norvegicus
gaacccctttatgtatagcctgaga

SEQ ID NO: 293907 - DNA, 25 bp, Rattus norvegicus
gaacccgaagaaatacatcccaggc

SEQ ID NO: 293908 - DNA, 25 bp, Rattus norvegicus
gaacccgaagaattacatcccaggc

SEQ ID NO: 293909 - DNA, 25 bp, Rattus norvegicus
gaacccgactataacgagagcgata

SEQ ID NO: 293910 - DNA, 25 bp, Rattus norvegicus
gaacccgactattacgagagcgata

SEQ ID NO: 293911 - DNA, 25 bp, Rattus norvegicus
gaacccgacttcctggatgttaagc

SEQ ID NO: 293912 - DNA, 25 bp, Rattus norvegicus
gaacccgacttcgtggatgttaagc

SEQ ID NO: 293913 - DNA, 25 bp, Rattus norvegicus
gaacccgagctgacggcggaccgct

SEQ ID NO: 293914 - DNA, 25 bp, Rattus norvegicus
gaacccgagctgtcggcggaccgct

SEQ ID NO: 293915 - DNA, 25 bp, Rattus norvegicus
gaacccgaggccagtgatcagatgt

SEQ ID NO: 293916 - DNA, 25 bp, Rattus norvegicus
gaacccgaggcctgtgatcagatgt

SEQ ID NO: 293917 - DNA, 25 bp, Rattus norvegicus
gaacccgagtctattctaagctggc

SEQ ID NO: 293918 - DNA, 25 bp, Rattus norvegicus
gaacccgagtcttttctaagctggc

SEQ ID NO: 293919 - DNA, 25 bp, Rattus norvegicus
gaacccgatatacaagccctgctgt

SEQ ID NO: 293920 - DNA, 25 bp, Rattus norvegicus
gaacccgatatagaagccctgctgt

SEQ ID NO: 293921 - DNA, 25 bp, Rattus norvegicus
gaacccgatgttaccttaaagtgat

SEQ ID NO: 293922 - DNA, 25 bp, Rattus norvegicus
gaacccgatgtttccttaaagtgat

SEQ ID NO: 293923 - DNA, 25 bp, Rattus norvegicus
gaacccgcggttcattactcagagg

SEQ ID NO: 293924 - DNA, 25 bp, Rattus norvegicus
gaacccgcggttgattactcagagg

SEQ ID NO: 293925 - DNA, 25 bp, Rattus norvegicus
gaacccgcttagattacattgtgac

SEQ ID NO: 293926 - DNA, 25 bp, Rattus norvegicus
gaacccgcttagtttacattgtgac

SEQ ID NO: 293927 - DNA, 25 bp, Rattus norvegicus
gaacccggatctccacaacgcagag

SEQ ID NO: 293928 - DNA, 25 bp, Rattus norvegicus
gaacccggatctgcacaacgcagag

SEQ ID NO: 293929 - DNA, 25 bp, Rattus norvegicus
gaacccggctctcggaaaggacaat

SEQ ID NO: 293930 - DNA, 25 bp, Rattus norvegicus
gaacccggctctgggaaaggacaat

SEQ ID NO: 293931 - DNA, 25 bp, Rattus norvegicus
gaacccgggattcgaaacctgagcg

SEQ ID NO: 293932 - DNA, 25 bp, Rattus norvegicus
gaacccgggattggaaacctgagcg

SEQ ID NO: 293933 - DNA, 25 bp, Rattus norvegicus
gaacccgggtagacagagagccagc

SEQ ID NO: 293934 - DNA, 25 bp, Rattus norvegicus
gaacccgggtagtcagagagccagc

SEQ ID NO: 293935 - DNA, 25 bp, Rattus norvegicus
gaacccggtgttctctgatcatgtc

SEQ ID NO: 293936 - DNA, 25 bp, Rattus norvegicus
gaacccggtgttgtctgatcatgtc

SEQ ID NO: 293937 - DNA, 25 bp, Rattus norvegicus
gaacccgtatcccactaagggcgag

SEQ ID NO: 293938 - DNA, 25 bp, Rattus norvegicus
gaacccgtatccgactaagggcgag

SEQ ID NO: 293939 - DNA, 25 bp, Rattus norvegicus
gaacccgtccatacagaaagcttca

SEQ ID NO: 293940 - DNA, 25 bp, Rattus norvegicus
gaacccgtccattcagaaagcttca

SEQ ID NO: 293941 - DNA, 25 bp, Rattus norvegicus
gaacccgtctaaagtcactatgcac

SEQ ID NO: 293942 - DNA, 25 bp, Rattus norvegicus
gaacccgtctaatgtcactatgcac

SEQ ID NO: 293943 - DNA, 25 bp, Rattus norvegicus
gaacccgtgggtacaaccactacat

SEQ ID NO: 293944 - DNA, 25 bp, Rattus norvegicus
gaacccgtgggttcaaccactacat

SEQ ID NO: 293945 - DNA, 25 bp, Rattus norvegicus
gaacccgtgtctacctaaagatggc

SEQ ID NO: 293946 - DNA, 25 bp, Rattus norvegicus
gaacccgtgtcttcctaaagatggc

SEQ ID NO: 293947 - DNA, 25 bp, Rattus norvegicus
gaacccgttaggagctgtacactgg

SEQ ID NO: 293948 - DNA, 25 bp, Rattus norvegicus
gaacccgttaggtgctgtacactgg

SEQ ID NO: 293949 - DNA, 25 bp, Rattus norvegicus
gaacccgttatcatagtacctgcct

SEQ ID NO: 293950 - DNA, 25 bp, Rattus norvegicus
gaacccgttatcttagtacctgcct

SEQ ID NO: 293951 - DNA, 25 bp, Rattus norvegicus
gaacccgttgttaggctttggagct

SEQ ID NO: 293952 - DNA, 25 bp, Rattus norvegicus
gaacccgttgtttggctttggagct

SEQ ID NO: 293953 - DNA, 25 bp, Rattus norvegicus
gaaccctaaccaattcatgggctat

SEQ ID NO: 293954 - DNA, 25 bp, Rattus norvegicus
gaaccctaaccatttcatgggctat

SEQ ID NO: 293955 - DNA, 25 bp, Rattus norvegicus
gaaccctaagatccacaactcggag

SEQ ID NO: 293956 - DNA, 25 bp, Rattus norvegicus
gaaccctaagatgcacaactcggag

SEQ ID NO: 293957 - DNA, 25 bp, Rattus norvegicus
gaaccctaagcccaaccatagaatg

SEQ ID NO: 293958 - DNA, 25 bp, Rattus norvegicus
gaaccctaagccgaaccatagaatg

SEQ ID NO: 293959 - DNA, 25 bp, Rattus norvegicus
gaaccctaatacatgcctgttgttg

SEQ ID NO: 293960 - DNA, 25 bp, Rattus norvegicus
gaaccctaatacttgcctgttgttg

SEQ ID NO: 293961 - DNA, 25 bp, Rattus norvegicus
gaaccctaatgtatgtaagcacttt

SEQ ID NO: 293962 - DNA, 25 bp, Rattus norvegicus
gaaccctaatgtttgtaagcacttt

SEQ ID NO: 293963 - DNA, 25 bp, Rattus norvegicus
gaaccctacagccatgtggaacctg

SEQ ID NO: 293964 - DNA, 25 bp, Rattus norvegicus
gaaccctacagcgatgtggaacctg

SEQ ID NO: 293965 - DNA, 25 bp, Rattus norvegicus
gaaccctacattctcttactggtga

SEQ ID NO: 293966 - DNA, 25 bp, Rattus norvegicus
gaaccctacattgtcttactggtga

SEQ ID NO: 293967 - DNA, 25 bp, Rattus norvegicus
gaaccctactggacaacagctcaaa

SEQ ID NO: 293968 - DNA, 25 bp, Rattus norvegicus
gaaccctactggtcaacagctcaaa

SEQ ID NO: 293969 - DNA, 25 bp, Rattus norvegicus
gaaccctagctaaaccaacgctaag

SEQ ID NO: 293970 - DNA, 25 bp, Rattus norvegicus
gaaccctagctataccaacgctaag

SEQ ID NO: 293971 - DNA, 25 bp, Rattus norvegicus
gaaccctagctgaaatgtctaacct

SEQ ID NO: 293972 - DNA, 25 bp, Rattus norvegicus
gaaccctagctgtaatgtctaacct

SEQ ID NO: 293973 - DNA, 25 bp, Rattus norvegicus
gaaccctagtacatgggaccctgag

SEQ ID NO: 293974 - DNA, 25 bp, Rattus norvegicus
gaaccctagtacttgggaccctgag

SEQ ID NO: 293975 - DNA, 25 bp, Rattus norvegicus
gaaccctagtcactgatggcaggag

SEQ ID NO: 293976 - DNA, 25 bp, Rattus norvegicus
gaaccctagtcagtgatggcaggag

SEQ ID NO: 293977 - DNA, 25 bp, Rattus norvegicus
gaaccctatatgctgtaagctgctg

SEQ ID NO: 293978 - DNA, 25 bp, Rattus norvegicus
gaaccctatatggtgtaagctgctg

SEQ ID NO: 293979 - DNA, 25 bp, Rattus norvegicus
gaaccctatgttcgatgtcagcatg

SEQ ID NO: 293980 - DNA, 25 bp, Rattus norvegicus
gaaccctatgttggatgtcagcatg

SEQ ID NO: 293981 - DNA, 25 bp, Rattus norvegicus
gaaccctattttacacaagacttgg

SEQ ID NO: 293982 - DNA, 25 bp, Rattus norvegicus
gaaccctatttttcacaagacttgg

SEQ ID NO: 293983 - DNA, 25 bp, Rattus norvegicus
gaaccctcaacaattttctctgtgg

SEQ ID NO: 293984 - DNA, 25 bp, Rattus norvegicus
gaaccctcaacatttttctctgtgg

SEQ ID NO: 293985 - DNA, 25 bp, Rattus norvegicus
gaaccctcacacagctggacattat

SEQ ID NO: 293986 - DNA, 25 bp, Rattus norvegicus
gaaccctcacactgctggacattat

SEQ ID NO: 293987 - DNA, 25 bp, Rattus norvegicus
gaaccctcagatccctgtggcaaag

SEQ ID NO: 293988 - DNA, 25 bp, Rattus norvegicus
gaaccctcagatgcctgtggcaaag

SEQ ID NO: 293989 - DNA, 25 bp, Rattus norvegicus
gaaccctcatacagctacttagttt

SEQ ID NO: 293990 - DNA, 25 bp, Rattus norvegicus
gaaccctcatactgctacttagttt

SEQ ID NO: 293991 - DNA, 25 bp, Rattus norvegicus
gaaccctcccttctgtaagtcatag

SEQ ID NO: 293992 - DNA, 25 bp, Rattus norvegicus
gaaccctcccttgtgtaagtcatag

SEQ ID NO: 293993 - DNA, 25 bp, Rattus norvegicus
gaaccctcggcaaattaactggact

SEQ ID NO: 293994 - DNA, 25 bp, Rattus norvegicus
gaaccctcggcatattaactggact

SEQ ID NO: 293995 - DNA, 25 bp, Rattus norvegicus
gaaccctctaagaatagtaagacca

SEQ ID NO: 293996 - DNA, 25 bp, Rattus norvegicus
gaaccctctaagtatagtaagacca

SEQ ID NO: 293997 - DNA, 25 bp, Rattus norvegicus
gaaccctctacaattggatccatgg

SEQ ID NO: 293998 - DNA, 25 bp, Rattus norvegicus
gaaccctctacatttggatccatgg

SEQ ID NO: 293999 - DNA, 25 bp, Rattus norvegicus
gaaccctgaagaccctgtcgaagtg

SEQ ID NO: 294000 - DNA, 25 bp, Rattus norvegicus
gaaccctgaagagcctgtcgaagtg

SEQ ID NO: 294001 - DNA, 25 bp, Rattus norvegicus
gaaccctgaaggaagtcgcccacat

SEQ ID NO: 294002 - DNA, 25 bp, Rattus norvegicus
gaaccctgaaggtagtcgcccacat

SEQ ID NO: 294003 - DNA, 25 bp, Rattus norvegicus
gaaccctgaattaatctggcagtta

SEQ ID NO: 294004 - DNA, 25 bp, Rattus norvegicus
gaaccctgaatttatctggcagtta

SEQ ID NO: 294005 - DNA, 25 bp, Rattus norvegicus
gaaccctgacatctttcttttcaga

SEQ ID NO: 294006 - DNA, 25 bp, Rattus norvegicus
gaaccctgacatgtttcttttcaga

SEQ ID NO: 294007 - DNA, 25 bp, Rattus norvegicus
gaaccctgacctctagcgttattaa

SEQ ID NO: 294008 - DNA, 25 bp, Rattus norvegicus
gaaccctgacctgtagcgttattaa

SEQ ID NO: 294009 - DNA, 25 bp, Rattus norvegicus
gaaccctgactaatgcaatagcctt

SEQ ID NO: 294010 - DNA, 25 bp, Rattus norvegicus
gaaccctgactattgcaatagcctt

SEQ ID NO: 294011 - DNA, 25 bp, Rattus norvegicus
gaaccctgagagattgttaccattt

SEQ ID NO: 294012 - DNA, 25 bp, Rattus norvegicus
gaaccctgagagtttgttaccattt

SEQ ID NO: 294013 - DNA, 25 bp, Rattus norvegicus
gaaccctgagcaaccttaaaaatag

SEQ ID NO: 294014 - DNA, 25 bp, Rattus norvegicus
gaaccctgagcatccttaaaaatag

SEQ ID NO: 294015 - DNA, 25 bp, Rattus norvegicus
gaaccctgataacccagaggctgca

SEQ ID NO: 294016 - DNA, 25 bp, Rattus norvegicus
gaaccctgataagccagaggctgca

SEQ ID NO: 294017 - DNA, 25 bp, Rattus norvegicus
gaaccctgattcacccattttttat

SEQ ID NO: 294018 - DNA, 25 bp, Rattus norvegicus
gaaccctgattctcccattttttat

SEQ ID NO: 294019 - DNA, 25 bp, Rattus norvegicus
gaaccctgcagcagtagacccagag

SEQ ID NO: 294020 - DNA, 25 bp, Rattus norvegicus
gaaccctgcagctgtagacccagag

SEQ ID NO: 294021 - DNA, 25 bp, Rattus norvegicus
gaaccctgcatcacagggctttgaa

SEQ ID NO: 294022 - DNA, 25 bp, Rattus norvegicus
gaaccctgcatcagctgttgaacag

SEQ ID NO: 294023 - DNA, 25 bp, Rattus norvegicus
gaaccctgcatctcagggctttgaa

SEQ ID NO: 294024 - DNA, 25 bp, Rattus norvegicus
gaaccctgcatctgctgttgaacag

SEQ ID NO: 294025 - DNA, 25 bp, Rattus norvegicus
gaaccctgccatctgctggtagcat

SEQ ID NO: 294026 - DNA, 25 bp, Rattus norvegicus
gaaccctgccatgtgctggtagcat

SEQ ID NO: 294027 - DNA, 25 bp, Rattus norvegicus
gaaccctgctcaaggcctaaattta

SEQ ID NO: 294028 - DNA, 25 bp, Rattus norvegicus
gaaccctgctcatggcctaaattta

SEQ ID NO: 294029 - DNA, 25 bp, Rattus norvegicus
gaaccctggagcaacttcagaggag

SEQ ID NO: 294030 - DNA, 25 bp, Rattus norvegicus
gaaccctggagctacttcagaggag

SEQ ID NO: 294031 - DNA, 25 bp, Rattus norvegicus
gaaccctggtttagtcagatttgtg

SEQ ID NO: 294032 - DNA, 25 bp, Rattus norvegicus
gaaccctggttttgtcagatttgtg

SEQ ID NO: 294033 - DNA, 25 bp, Rattus norvegicus
gaaccctgtaagacaaatctacgta

SEQ ID NO: 294034 - DNA, 25 bp, Rattus norvegicus
gaaccctgtaagtcaaatctacgta

SEQ ID NO: 294035 - DNA, 25 bp, Rattus norvegicus
gaaccctgtggacagatctgcacat

SEQ ID NO: 294036 - DNA, 25 bp, Rattus norvegicus
gaaccctgtggagagatctgcacat

SEQ ID NO: 294037 - DNA, 25 bp, Rattus norvegicus
gaacccttaggccatacacactggc

SEQ ID NO: 294038 - DNA, 25 bp, Rattus norvegicus
gaacccttaggcgatacacactggc

SEQ ID NO: 294039 - DNA, 25 bp, Rattus norvegicus
gaacccttagttcctgagccgggag

SEQ ID NO: 294040 - DNA, 25 bp, Rattus norvegicus
gaacccttagttgctgagccgggag

SEQ ID NO: 294041 - DNA, 25 bp, Rattus norvegicus
gaacccttatgacactttccggaca

SEQ ID NO: 294042 - DNA, 25 bp, Rattus norvegicus
gaacccttatgagactttccggaca

SEQ ID NO: 294043 - DNA, 25 bp, Rattus norvegicus
gaacccttattaaagacctgcaccg

SEQ ID NO: 294044 - DNA, 25 bp, Rattus norvegicus
gaacccttattatagacctgcaccg

SEQ ID NO: 294045 - DNA, 25 bp, Rattus norvegicus
gaacccttcccgagctggagaaaga

SEQ ID NO: 294046 - DNA, 25 bp, Rattus norvegicus
gaacccttcccgtgctggagaaaga

SEQ ID NO: 294047 - DNA, 25 bp, Rattus norvegicus
gaacccttctatctgacccttcaga

SEQ ID NO: 294048 - DNA, 25 bp, Rattus norvegicus
gaacccttctatgtgacccttcaga

SEQ ID NO: 294049 - DNA, 25 bp, Rattus norvegicus
gaacccttgaatccctgctctagga

SEQ ID NO: 294050 - DNA, 25 bp, Rattus norvegicus
gaacccttgaatgcctgctctagga

SEQ ID NO: 294051 - DNA, 25 bp, Rattus norvegicus
gaacccttgatgaacctcttgagtg

SEQ ID NO: 294052 - DNA, 25 bp, Rattus norvegicus
gaacccttgatgtacctcttgagtg

SEQ ID NO: 294053 - DNA, 25 bp, Rattus norvegicus
gaacccttgctaaaatggccatcac

SEQ ID NO: 294054 - DNA, 25 bp, Rattus norvegicus
gaacccttgctaccaggcattctta

SEQ ID NO: 294055 - DNA, 25 bp, Rattus norvegicus
gaacccttgctagcaggcattctta

SEQ ID NO: 294056 - DNA, 25 bp, Rattus norvegicus
gaacccttgctataatggccatcac

SEQ ID NO: 294057 - DNA, 25 bp, Rattus norvegicus
gaacccttggagaggtcagagctta

SEQ ID NO: 294058 - DNA, 25 bp, Rattus norvegicus
gaacccttggagtggtcagagctta

SEQ ID NO: 294059 - DNA, 25 bp, Rattus norvegicus
gaacccttgggcaatggactcatct

SEQ ID NO: 294060 - DNA, 25 bp, Rattus norvegicus
gaacccttgggctatggactcatct

SEQ ID NO: 294061 - DNA, 25 bp, Rattus norvegicus
gaacccttgtcaaggtctgggctgc

SEQ ID NO: 294062 - DNA, 25 bp, Rattus norvegicus
gaacccttgtcacttgtattggcaa

SEQ ID NO: 294063 - DNA, 25 bp, Rattus norvegicus
gaacccttgtcagttgtattggcaa

SEQ ID NO: 294064 - DNA, 25 bp, Rattus norvegicus
gaacccttgtcatggtctgggctgc

SEQ ID NO: 294065 - DNA, 25 bp, Rattus norvegicus
gaacccttgtctagtccactgggtg

SEQ ID NO: 294066 - DNA, 25 bp, Rattus norvegicus
gaacccttgtcttgtccactgggtg

SEQ ID NO: 294067 - DNA, 25 bp, Rattus norvegicus
gaaccctttagtacagcgggtcata

SEQ ID NO: 294068 - DNA, 25 bp, Rattus norvegicus
gaaccctttagtaggaagaagagct

SEQ ID NO: 294069 - DNA, 25 bp, Rattus norvegicus
gaaccctttagttcagcgggtcata

SEQ ID NO: 294070 - DNA, 25 bp, Rattus norvegicus
gaaccctttagttggaagaagagct

SEQ ID NO: 294071 - DNA, 25 bp, Rattus norvegicus
gaaccctttcatctatagcctgagg

SEQ ID NO: 294072 - DNA, 25 bp, Rattus norvegicus
gaaccctttcatgtatagcctgagg

SEQ ID NO: 294073 - DNA, 25 bp, Rattus norvegicus
gaaccctttgaacctgtggtgactt

SEQ ID NO: 294074 - DNA, 25 bp, Rattus norvegicus
gaaccctttgaagctgtggtgactt

SEQ ID NO: 294075 - DNA, 25 bp, Rattus norvegicus
gaaccctttgctcttgttttgactt

SEQ ID NO: 294076 - DNA, 25 bp, Rattus norvegicus
gaaccctttgctgttgttttgactt

SEQ ID NO: 294077 - DNA, 25 bp, Rattus norvegicus
gaaccgaaaagcagggtcatttaat

SEQ ID NO: 294078 - DNA, 25 bp, Rattus norvegicus
gaaccgaaaagctgggtcatttaat

SEQ ID NO: 294079 - DNA, 25 bp, Rattus norvegicus
gaaccgaaccttccatgctgaggct

SEQ ID NO: 294080 - DNA, 25 bp, Rattus norvegicus
gaaccgaaccttgcatgctgaggct

SEQ ID NO: 294081 - DNA, 25 bp, Rattus norvegicus
gaaccgaagaatagtgtctgcccta

SEQ ID NO: 294082 - DNA, 25 bp, Rattus norvegicus
gaaccgaagaattgtgtctgcccta

SEQ ID NO: 294083 - DNA, 25 bp, Rattus norvegicus
gaaccgaaggcgaccccaagaatga

SEQ ID NO: 294084 - DNA, 25 bp, Rattus norvegicus
gaaccgaaggcgtccccaagaatga

SEQ ID NO: 294085 - DNA, 25 bp, Rattus norvegicus
gaaccgaagtggatactttggttgt

SEQ ID NO: 294086 - DNA, 25 bp, Rattus norvegicus
gaaccgaagtggttactttggttgt

SEQ ID NO: 294087 - DNA, 25 bp, Rattus norvegicus
gaaccgactgcaaagtagagctttt

SEQ ID NO: 294088 - DNA, 25 bp, Rattus norvegicus
gaaccgactgcaagaggaactcact

SEQ ID NO: 294089 - DNA, 25 bp, Rattus norvegicus
gaaccgactgcatagtagagctttt

SEQ ID NO: 294090 - DNA, 25 bp, Rattus norvegicus
gaaccgactgcatgaggaactcact

SEQ ID NO: 294091 - DNA, 25 bp, Rattus norvegicus
gaaccgagagttaacaccggcggag

SEQ ID NO: 294092 - DNA, 25 bp, Rattus norvegicus
gaaccgagagtttacaccggcggag

SEQ ID NO: 294093 - DNA, 25 bp, Rattus norvegicus
gaaccgagcctgcatgggtgatcac

SEQ ID NO: 294094 - DNA, 25 bp, Rattus norvegicus
gaaccgagcctggatgggtgatcac

SEQ ID NO: 294095 - DNA, 25 bp, Rattus norvegicus
gaaccgaggaagcacgtgaaactta

SEQ ID NO: 294096 - DNA, 25 bp, Rattus norvegicus
gaaccgaggaaggacgtgaaactta

SEQ ID NO: 294097 - DNA, 25 bp, Rattus norvegicus
gaaccgaggtctcgagtctcacatt

SEQ ID NO: 294098 - DNA, 25 bp, Rattus norvegicus
gaaccgaggtctggagtctcacatt

SEQ ID NO: 294099 - DNA, 25 bp, Rattus norvegicus
gaaccgagtgacaagtgcccagcag

SEQ ID NO: 294100 - DNA, 25 bp, Rattus norvegicus
gaaccgagtgactagtgcccagcag

SEQ ID NO: 294101 - DNA, 25 bp, Rattus norvegicus
gaaccgagtgggaaccgaggcttca

SEQ ID NO: 294102 - DNA, 25 bp, Rattus norvegicus
gaaccgagtgggtaccgaggcttca

SEQ ID NO: 294103 - DNA, 25 bp, Rattus norvegicus
gaaccgatgaaacttctagactcta

SEQ ID NO: 294104 - DNA, 25 bp, Rattus norvegicus
gaaccgatgaaagttctagactcta

SEQ ID NO: 294105 - DNA, 25 bp, Rattus norvegicus
gaaccgatggagctcgatgacccta

SEQ ID NO: 294106 - DNA, 25 bp, Rattus norvegicus
gaaccgatggaggtcgatgacccta

SEQ ID NO: 294107 - DNA, 25 bp, Rattus norvegicus
gaaccgatttacatttgtctcacct

SEQ ID NO: 294108 - DNA, 25 bp, Rattus norvegicus
gaaccgatttacttttgtctcacct

SEQ ID NO: 294109 - DNA, 25 bp, Rattus norvegicus
gaaccgcaagggactctcaaactga

SEQ ID NO: 294110 - DNA, 25 bp, Rattus norvegicus
gaaccgcaagggtctctcaaactga

SEQ ID NO: 294111 - DNA, 25 bp, Rattus norvegicus
gaaccgcagcgacgagtttctcatc

SEQ ID NO: 294112 - DNA, 25 bp, Rattus norvegicus
gaaccgcagcgaggagtttctcatc

SEQ ID NO: 294113 - DNA, 25 bp, Rattus norvegicus
gaaccgcagctgaggactctttgca

SEQ ID NO: 294114 - DNA, 25 bp, Rattus norvegicus
gaaccgcagctgcatttagtctcga

SEQ ID NO: 294115 - DNA, 25 bp, Rattus norvegicus
gaaccgcagctggatttagtctcga

SEQ ID NO: 294116 - DNA, 25 bp, Rattus norvegicus
gaaccgcagctgtggactctttgca

SEQ ID NO: 294117 - DNA, 25 bp, Rattus norvegicus
gaaccgcattgtctggattgctgtt

SEQ ID NO: 294118 - DNA, 25 bp, Rattus norvegicus
gaaccgcattgtgtggattgctgtt

SEQ ID NO: 294119 - DNA, 25 bp, Rattus norvegicus
gaaccgccctagaacttatgaccag

SEQ ID NO: 294120 - DNA, 25 bp, Rattus norvegicus
gaaccgccctagtacttatgaccag

SEQ ID NO: 294121 - DNA, 25 bp, Rattus norvegicus
gaaccgccgcaccaagcagaagaag

SEQ ID NO: 294122 - DNA, 25 bp, Rattus norvegicus
gaaccgccgcacgaagcagaagaag

SEQ ID NO: 294123 - DNA, 25 bp, Rattus norvegicus
gaaccgcctgccctaagaagtccag

SEQ ID NO: 294124 - DNA, 25 bp, Rattus norvegicus
gaaccgcctgccgtaagaagtccag

SEQ ID NO: 294125 - DNA, 25 bp, Rattus norvegicus
gaaccgccttctcagtgggatctgg

SEQ ID NO: 294126 - DNA, 25 bp, Rattus norvegicus
gaaccgccttctgagtgggatctgg

SEQ ID NO: 294127 - DNA, 25 bp, Rattus norvegicus
gaaccgcgacgcattccaaggcacg

SEQ ID NO: 294128 - DNA, 25 bp, Rattus norvegicus
gaaccgcgacgctttccaaggcacg

SEQ ID NO: 294129 - DNA, 25 bp, Rattus norvegicus
gaaccgctcttaaaggatgtgtaca

SEQ ID NO: 294130 - DNA, 25 bp, Rattus norvegicus
gaaccgctcttataggatgtgtaca

SEQ ID NO: 294131 - DNA, 25 bp, Rattus norvegicus
gaaccgctgatgacttgaggtcaag

SEQ ID NO: 294132 - DNA, 25 bp, Rattus norvegicus
gaaccgctgatgtcttgaggtcaag

SEQ ID NO: 294133 - DNA, 25 bp, Rattus norvegicus
gaaccgctgctcaacgacagcgagt

SEQ ID NO: 294134 - DNA, 25 bp, Rattus norvegicus
gaaccgctgctctacgacagcgagt

SEQ ID NO: 294135 - DNA, 25 bp, Rattus norvegicus
gaaccgctggctaggcaagaggcct

SEQ ID NO: 294136 - DNA, 25 bp, Rattus norvegicus
gaaccgctggcttggcaagaggcct

SEQ ID NO: 294137 - DNA, 25 bp, Rattus norvegicus
gaaccgctgttgaaatgctccttaa

SEQ ID NO: 294138 - DNA, 25 bp, Rattus norvegicus
gaaccgctgttgtaatgctccttaa

SEQ ID NO: 294139 - DNA, 25 bp, Rattus norvegicus
gaaccgctttgaccgaacagacaga

SEQ ID NO: 294140 - DNA, 25 bp, Rattus norvegicus
gaaccgctttgagcgaacagacaga

SEQ ID NO: 294141 - DNA, 25 bp, Rattus norvegicus
gaaccggaaccaaacttccagctgt

SEQ ID NO: 294142 - DNA, 25 bp, Rattus norvegicus
gaaccggaaccatacttccagctgt

SEQ ID NO: 294143 - DNA, 25 bp, Rattus norvegicus
gaaccggaagacacagacactggga

SEQ ID NO: 294144 - DNA, 25 bp, Rattus norvegicus
gaaccggaagactcagacactggga

SEQ ID NO: 294145 - DNA, 25 bp, Rattus norvegicus
gaaccggaaggactattccactgcc

SEQ ID NO: 294146 - DNA, 25 bp, Rattus norvegicus
gaaccggaaggagtattccactgcc

SEQ ID NO: 294147 - DNA, 25 bp, Rattus norvegicus
gaaccggacactagcaggccacagt

SEQ ID NO: 294148 - DNA, 25 bp, Rattus norvegicus
gaaccggacacttgcaggccacagt

SEQ ID NO: 294149 - DNA, 25 bp, Rattus norvegicus
gaaccggactctcccacagattgta

SEQ ID NO: 294150 - DNA, 25 bp, Rattus norvegicus
gaaccggactctgccacagattgta

SEQ ID NO: 294151 - DNA, 25 bp, Rattus norvegicus
gaaccggactgcaggttatctatga

SEQ ID NO: 294152 - DNA, 25 bp, Rattus norvegicus
gaaccggactgctggttatctatga

SEQ ID NO: 294153 - DNA, 25 bp, Rattus norvegicus
gaaccggagatcatctgtgctttcc

SEQ ID NO: 294154 - DNA, 25 bp, Rattus norvegicus
gaaccggagatcttctgtgctttcc

SEQ ID NO: 294155 - DNA, 25 bp, Rattus norvegicus
gaaccggattcaccgacgaggagct

SEQ ID NO: 294156 - DNA, 25 bp, Rattus norvegicus
gaaccggattcagcgacgaggagct

SEQ ID NO: 294157 - DNA, 25 bp, Rattus norvegicus
gaaccggattctacagggagagctg

SEQ ID NO: 294158 - DNA, 25 bp, Rattus norvegicus
gaaccggattcttcagggagagctg

SEQ ID NO: 294159 - DNA, 25 bp, Rattus norvegicus
gaaccggcaagaatacacctatgta

SEQ ID NO: 294160 - DNA, 25 bp, Rattus norvegicus
gaaccggcaagattacacctatgta

SEQ ID NO: 294161 - DNA, 25 bp, Rattus norvegicus
gaaccggcacctccatgagtacatg

SEQ ID NO: 294162 - DNA, 25 bp, Rattus norvegicus
gaaccggcacctgcatgagtacatg

SEQ ID NO: 294163 - DNA, 25 bp, Rattus norvegicus
gaaccggcacttcagaggtcgtgat

SEQ ID NO: 294164 - DNA, 25 bp, Rattus norvegicus
gaaccggcacttgagaggtcgtgat

SEQ ID NO: 294165 - DNA, 25 bp, Rattus norvegicus
gaaccggcaggcagcgttaagtctg

SEQ ID NO: 294166 - DNA, 25 bp, Rattus norvegicus
gaaccggcaggctgcgttaagtctg

SEQ ID NO: 294167 - DNA, 25 bp, Rattus norvegicus
gaaccggcagttctaaaggagagct

SEQ ID NO: 294168 - DNA, 25 bp, Rattus norvegicus
gaaccggcagttgtaaaggagagct

SEQ ID NO: 294169 - DNA, 25 bp, Rattus norvegicus
gaaccggcatccaagtgtgacacat

SEQ ID NO: 294170 - DNA, 25 bp, Rattus norvegicus
gaaccggcatcctagtgtgacacat

SEQ ID NO: 294171 - DNA, 25 bp, Rattus norvegicus
gaaccggcttttcctggactgtgag

SEQ ID NO: 294172 - DNA, 25 bp, Rattus norvegicus
gaaccggcttttgctggactgtgag

SEQ ID NO: 294173 - DNA, 25 bp, Rattus norvegicus
gaaccgggccgtactctcgtgggag

SEQ ID NO: 294174 - DNA, 25 bp, Rattus norvegicus
gaaccgggccgttctctcgtgggag

SEQ ID NO: 294175 - DNA, 25 bp, Rattus norvegicus
gaaccggtggccagacccaatactg

SEQ ID NO: 294176 - DNA, 25 bp, Rattus norvegicus
gaaccggtggcctgacccaatactg

SEQ ID NO: 294177 - DNA, 25 bp, Rattus norvegicus
gaaccggttcgcaacctttgaagag

SEQ ID NO: 294178 - DNA, 25 bp, Rattus norvegicus
gaaccggttcgctacctttgaagag

SEQ ID NO: 294179 - DNA, 25 bp, Rattus norvegicus
gaaccggttggtcttgatcctcaag

SEQ ID NO: 294180 - DNA, 25 bp, Rattus norvegicus
gaaccggttggtgttgatcctcaag

SEQ ID NO: 294181 - DNA, 25 bp, Rattus norvegicus
gaaccgtagtacctgtaggcactta

SEQ ID NO: 294182 - DNA, 25 bp, Rattus norvegicus
gaaccgtagtacgtgtaggcactta

SEQ ID NO: 294183 - DNA, 25 bp, Rattus norvegicus
gaaccgtatggtcttaaacttcact

SEQ ID NO: 294184 - DNA, 25 bp, Rattus norvegicus
gaaccgtatggtgttaaacttcact

SEQ ID NO: 294185 - DNA, 25 bp, Rattus norvegicus
gaaccgtcataaataaacagggccg

SEQ ID NO: 294186 - DNA, 25 bp, Rattus norvegicus
gaaccgtcataattaaacagggccg

SEQ ID NO: 294187 - DNA, 25 bp, Rattus norvegicus
gaaccgtcgtctctaatttttgaat

SEQ ID NO: 294188 - DNA, 25 bp, Rattus norvegicus
gaaccgtcgtctgtaatttttgaat

SEQ ID NO: 294189 - DNA, 25 bp, Rattus norvegicus
gaaccgtctactaatgtatgtgcct

SEQ ID NO: 294190 - DNA, 25 bp, Rattus norvegicus
gaaccgtctacttatgtatgtgcct

SEQ ID NO: 294191 - DNA, 25 bp, Rattus norvegicus
gaaccgtcttgcagcaaccgaaact

SEQ ID NO: 294192 - DNA, 25 bp, Rattus norvegicus
gaaccgtcttgctgcaaccgaaact

SEQ ID NO: 294193 - DNA, 25 bp, Rattus norvegicus
gaaccgtgaaccaggtcctatcact

SEQ ID NO: 294194 - DNA, 25 bp, Rattus norvegicus
gaaccgtgaacctggtcctatcact

SEQ ID NO: 294195 - DNA, 25 bp, Rattus norvegicus
gaaccgtgccgtcggtaaatcattt

SEQ ID NO: 294196 - DNA, 25 bp, Rattus norvegicus
gaaccgtgccgtgggtaaatcattt

SEQ ID NO: 294197 - DNA, 25 bp, Rattus norvegicus
gaaccgtgctggctttgaagcttca

SEQ ID NO: 294198 - DNA, 25 bp, Rattus norvegicus
gaaccgtgctgggtttgaagcttca

SEQ ID NO: 294199 - DNA, 25 bp, Rattus norvegicus
gaaccgtgggctagatcagatcact

SEQ ID NO: 294200 - DNA, 25 bp, Rattus norvegicus
gaaccgtgggcttgatcagatcact

SEQ ID NO: 294201 - DNA, 25 bp, Rattus norvegicus
gaaccgtgtgatatcagagctgctg

SEQ ID NO: 294202 - DNA, 25 bp, Rattus norvegicus
gaaccgtgtgatttcagagctgctg

SEQ ID NO: 294203 - DNA, 25 bp, Rattus norvegicus
gaaccgtgtttaagatacagccgtt

SEQ ID NO: 294204 - DNA, 25 bp, Rattus norvegicus
gaaccgtgtttatgatacagccgtt

SEQ ID NO: 294205 - DNA, 25 bp, Rattus norvegicus
gaaccgttacttcactatggacttc

SEQ ID NO: 294206 - DNA, 25 bp, Rattus norvegicus
gaaccgttacttgactatggacttc

SEQ ID NO: 294207 - DNA, 25 bp, Rattus norvegicus
gaaccgttatgtcgactggcctgtc

SEQ ID NO: 294208 - DNA, 25 bp, Rattus norvegicus
gaaccgttatgtggactggcctgtc

SEQ ID NO: 294209 - DNA, 25 bp, Rattus norvegicus
gaaccgttcctccagagttctgaga

SEQ ID NO: 294210 - DNA, 25 bp, Rattus norvegicus
gaaccgttcctcgagagttctgaga

SEQ ID NO: 294211 - DNA, 25 bp, Rattus norvegicus
gaaccgttctgaagtctgtcgttaa

SEQ ID NO: 294212 - DNA, 25 bp, Rattus norvegicus
gaaccgttctgatgtctgtcgttaa

SEQ ID NO: 294213 - DNA, 25 bp, Rattus norvegicus
gaacctaaacgaccgcatcctgcgg

SEQ ID NO: 294214 - DNA, 25 bp, Rattus norvegicus
gaacctaaacgagcgcatcctgcgg

SEQ ID NO: 294215 - DNA, 25 bp, Rattus norvegicus
gaacctaaagagcagtgatcactaa

SEQ ID NO: 294216 - DNA, 25 bp, Rattus norvegicus
gaacctaaagaggagtgatcactaa

SEQ ID NO: 294217 - DNA, 25 bp, Rattus norvegicus
gaacctaaatagaatcctctcagaa

SEQ ID NO: 294218 - DNA, 25 bp, Rattus norvegicus
gaacctaaatagtatcctctcagaa

SEQ ID NO: 294219 - DNA, 25 bp, Rattus norvegicus
gaacctaactgtatctttgaggcga

SEQ ID NO: 294220 - DNA, 25 bp, Rattus norvegicus
gaacctaactgtttctttgaggcga

SEQ ID NO: 294221 - DNA, 25 bp, Rattus norvegicus
gaacctaagcagcagctgcacagca

SEQ ID NO: 294222 - DNA, 25 bp, Rattus norvegicus
gaacctaagcaggagctgcacagca

SEQ ID NO: 294223 - DNA, 25 bp, Rattus norvegicus
gaacctaagccaagagtaactcgag

SEQ ID NO: 294224 - DNA, 25 bp, Rattus norvegicus
gaacctaagccatgagtaactcgag

SEQ ID NO: 294225 - DNA, 25 bp, Rattus norvegicus
gaacctaaggttcccatgaatttaa

SEQ ID NO: 294226 - DNA, 25 bp, Rattus norvegicus
gaacctaaggttgccatgaatttaa

SEQ ID NO: 294227 - DNA, 25 bp, Rattus norvegicus
gaacctaatccaaaccaggcatggg

SEQ ID NO: 294228 - DNA, 25 bp, Rattus norvegicus
gaacctaatccataccaggcatggg

SEQ ID NO: 294229 - DNA, 25 bp, Rattus norvegicus
gaacctaatcccaatagtccagcaa

SEQ ID NO: 294230 - DNA, 25 bp, Rattus norvegicus
gaacctaatccctatagtccagcaa

SEQ ID NO: 294231 - DNA, 25 bp, Rattus norvegicus
gaacctaatgcaagatacctccaaa

SEQ ID NO: 294232 - DNA, 25 bp, Rattus norvegicus
gaacctaatgcatgatacctccaaa

SEQ ID NO: 294233 - DNA, 25 bp, Rattus norvegicus
gaacctaccagaaccaggcttcaga

SEQ ID NO: 294234 - DNA, 25 bp, Rattus norvegicus
gaacctaccagatccaggcttcaga

SEQ ID NO: 294235 - DNA, 25 bp, Rattus norvegicus
gaacctacctcaaagtgcaactgca

SEQ ID NO: 294236 - DNA, 25 bp, Rattus norvegicus
gaacctacctcatagtgcaactgca

SEQ ID NO: 294237 - DNA, 25 bp, Rattus norvegicus
gaacctacgcatacagttgctccaa

SEQ ID NO: 294238 - DNA, 25 bp, Rattus norvegicus
gaacctacgcattcagttgctccaa

SEQ ID NO: 294239 - DNA, 25 bp, Rattus norvegicus
gaacctacgtccagagcgagattta

SEQ ID NO: 294240 - DNA, 25 bp, Rattus norvegicus
gaacctacgtcctgagcgagattta

SEQ ID NO: 294241 - DNA, 25 bp, Rattus norvegicus
gaacctactcctaacaaatcagcag

SEQ ID NO: 294242 - DNA, 25 bp, Rattus norvegicus
gaacctactccttacaaatcagcag

SEQ ID NO: 294243 - DNA, 25 bp, Rattus norvegicus
gaacctactctgcatggatcactaa

SEQ ID NO: 294244 - DNA, 25 bp, Rattus norvegicus
gaacctactctggatggatcactaa

SEQ ID NO: 294245 - DNA, 25 bp, Rattus norvegicus
gaacctactgcgactgcaggacctg

SEQ ID NO: 294246 - DNA, 25 bp, Rattus norvegicus
gaacctactgcgtctgcaggacctg

SEQ ID NO: 294247 - DNA, 25 bp, Rattus norvegicus
gaacctactggactggagacaatgt

SEQ ID NO: 294248 - DNA, 25 bp, Rattus norvegicus
gaacctactggagtggagacaatgt

SEQ ID NO: 294249 - DNA, 25 bp, Rattus norvegicus
gaacctacttggcactgattacgca

SEQ ID NO: 294250 - DNA, 25 bp, Rattus norvegicus
gaacctacttgggactgattacgca

SEQ ID NO: 294251 - DNA, 25 bp, Rattus norvegicus
gaacctagaagtacagcttcgccga

SEQ ID NO: 294252 - DNA, 25 bp, Rattus norvegicus
gaacctagaagttcagcttcgccga

SEQ ID NO: 294253 - DNA, 25 bp, Rattus norvegicus
gaacctagacttcgtttacaggact

SEQ ID NO: 294254 - DNA, 25 bp, Rattus norvegicus
gaacctagacttggtttacaggact

SEQ ID NO: 294255 - DNA, 25 bp, Rattus norvegicus
gaacctagctccatcctgggaagtg

SEQ ID NO: 294256 - DNA, 25 bp, Rattus norvegicus
gaacctagctccttcctgggaagtg

SEQ ID NO: 294257 - DNA, 25 bp, Rattus norvegicus
gaacctaggcatcccgatgttgtaa

SEQ ID NO: 294258 - DNA, 25 bp, Rattus norvegicus
gaacctaggcatgccgatgttgtaa

SEQ ID NO: 294259 - DNA, 25 bp, Rattus norvegicus
gaacctaggcctagtgcacacttga

SEQ ID NO: 294260 - DNA, 25 bp, Rattus norvegicus
gaacctaggccttgtgcacacttga

SEQ ID NO: 294261 - DNA, 25 bp, Rattus norvegicus
gaacctaggctgaagtactgagctc

SEQ ID NO: 294262 - DNA, 25 bp, Rattus norvegicus
gaacctaggctgtagtactgagctc

SEQ ID NO: 294263 - DNA, 25 bp, Rattus norvegicus
gaacctagggtcattacatttgatc

SEQ ID NO: 294264 - DNA, 25 bp, Rattus norvegicus
gaacctagggtctttacatttgatc

SEQ ID NO: 294265 - DNA, 25 bp, Rattus norvegicus
gaacctagtaagagcttagactgtc

SEQ ID NO: 294266 - DNA, 25 bp, Rattus norvegicus
gaacctagtaagtgcttagactgtc

SEQ ID NO: 294267 - DNA, 25 bp, Rattus norvegicus
gaacctagtgagacagcgctggcct

SEQ ID NO: 294268 - DNA, 25 bp, Rattus norvegicus
gaacctagtgagtcagcgctggcct

SEQ ID NO: 294269 - DNA, 25 bp, Rattus norvegicus
gaacctagtgctattggctaaacat

SEQ ID NO: 294270 - DNA, 25 bp, Rattus norvegicus
gaacctagtgcttttggctaaacat

SEQ ID NO: 294271 - DNA, 25 bp, Rattus norvegicus
gaacctagttctcctaaacaatttg

SEQ ID NO: 294272 - DNA, 25 bp, Rattus norvegicus
gaacctagttctgctaaacaatttg

SEQ ID NO: 294273 - DNA, 25 bp, Rattus norvegicus
gaacctagtttaatccagtctcacc

SEQ ID NO: 294274 - DNA, 25 bp, Rattus norvegicus
gaacctagtttattccagtctcacc

SEQ ID NO: 294275 - DNA, 25 bp, Rattus norvegicus
gaacctatacaaatcttctcgcata

SEQ ID NO: 294276 - DNA, 25 bp, Rattus norvegicus
gaacctatacaattcttctcgcata

SEQ ID NO: 294277 - DNA, 25 bp, Rattus norvegicus
gaacctatccctattgtttgtccat

SEQ ID NO: 294278 - DNA, 25 bp, Rattus norvegicus
gaacctatcccttttgtttgtccat

SEQ ID NO: 294279 - DNA, 25 bp, Rattus norvegicus
gaacctatcgcaagggtgaaccctt

SEQ ID NO: 294280 - DNA, 25 bp, Rattus norvegicus
gaacctatcgcatgggtgaaccctt

SEQ ID NO: 294281 - DNA, 25 bp, Rattus norvegicus
gaacctatcgtgagctcagtgtgat

SEQ ID NO: 294282 - DNA, 25 bp, Rattus norvegicus
gaacctatcgtgtgctcagtgtgat

SEQ ID NO: 294283 - DNA, 25 bp, Rattus norvegicus
gaacctatgtctaaaggcttgtcct

SEQ ID NO: 294284 - DNA, 25 bp, Rattus norvegicus
gaacctatgtcttaaggcttgtcct

SEQ ID NO: 294285 - DNA, 25 bp, Rattus norvegicus
gaacctatgtttaacctccacgaat

SEQ ID NO: 294286 - DNA, 25 bp, Rattus norvegicus
gaacctatgttttacctccacgaat

SEQ ID NO: 294287 - DNA, 25 bp, Rattus norvegicus
gaacctattctcctacgtgagggac

SEQ ID NO: 294288 - DNA, 25 bp, Rattus norvegicus
gaacctattctcgtacgtgagggac

SEQ ID NO: 294289 - DNA, 25 bp, Rattus norvegicus
gaacctattgctaccccatgggaat

SEQ ID NO: 294290 - DNA, 25 bp, Rattus norvegicus
gaacctattgcttccccatgggaat

SEQ ID NO: 294291 - DNA, 25 bp, Rattus norvegicus
gaacctattgttcataatcatttgt

SEQ ID NO: 294292 - DNA, 25 bp, Rattus norvegicus
gaacctattgttgataatcatttgt

SEQ ID NO: 294293 - DNA, 25 bp, Rattus norvegicus
gaacctatttgaattactgcagaga

SEQ ID NO: 294294 - DNA, 25 bp, Rattus norvegicus
gaacctatttgatttactgcagaga

SEQ ID NO: 294295 - DNA, 25 bp, Rattus norvegicus
gaacctattttaatcttacctgcca

SEQ ID NO: 294296 - DNA, 25 bp, Rattus norvegicus
gaacctattttattcttacctgcca

SEQ ID NO: 294297 - DNA, 25 bp, Rattus norvegicus
gaacctcaaaatctttttggtccat

SEQ ID NO: 294298 - DNA, 25 bp, Rattus norvegicus
gaacctcaaaatgtttttggtccat

SEQ ID NO: 294299 - DNA, 25 bp, Rattus norvegicus
gaacctcaaagtcctatagccctaa

SEQ ID NO: 294300 - DNA, 25 bp, Rattus norvegicus
gaacctcaaagtgctatagccctaa

SEQ ID NO: 294301 - DNA, 25 bp, Rattus norvegicus
gaacctcaacaaatagttttacact

SEQ ID NO: 294302 - DNA, 25 bp, Rattus norvegicus
gaacctcaacaattagttttacact

SEQ ID NO: 294303 - DNA, 25 bp, Rattus norvegicus
gaacctcaagatatccctgaattca

SEQ ID NO: 294304 - DNA, 25 bp, Rattus norvegicus
gaacctcaagatttccctgaattca

SEQ ID NO: 294305 - DNA, 25 bp, Rattus norvegicus
gaacctcaagccatttatatatggg

SEQ ID NO: 294306 - DNA, 25 bp, Rattus norvegicus
gaacctcaagccttttatatatggg

SEQ ID NO: 294307 - DNA, 25 bp, Rattus norvegicus
gaacctcaaggcctacagatagtct

SEQ ID NO: 294308 - DNA, 25 bp, Rattus norvegicus
gaacctcaaggcgtacagatagtct

SEQ ID NO: 294309 - DNA, 25 bp, Rattus norvegicus
gaacctcaatagaagctgcaagaca

SEQ ID NO: 294310 - DNA, 25 bp, Rattus norvegicus
gaacctcaatagtagctgcaagaca

SEQ ID NO: 294311 - DNA, 25 bp, Rattus norvegicus
gaacctcaattaactcttattttca

SEQ ID NO: 294312 - DNA, 25 bp, Rattus norvegicus
gaacctcaattatctcttattttca

SEQ ID NO: 294313 - DNA, 25 bp, Rattus norvegicus
gaacctcaccgaacgccagatcaag

SEQ ID NO: 294314 - DNA, 25 bp, Rattus norvegicus
gaacctcaccgatcgccagatcaag

SEQ ID NO: 294315 - DNA, 25 bp, Rattus norvegicus
gaacctcacgttaatgtggctacag

SEQ ID NO: 294316 - DNA, 25 bp, Rattus norvegicus
gaacctcacgtttatgtggctacag

SEQ ID NO: 294317 - DNA, 25 bp, Rattus norvegicus
gaacctcagaggacccctgtgataa

SEQ ID NO: 294318 - DNA, 25 bp, Rattus norvegicus
gaacctcagaggtcccctgtgataa

SEQ ID NO: 294319 - DNA, 25 bp, Rattus norvegicus
gaacctcagcctctcaaaagaagac

SEQ ID NO: 294320 - DNA, 25 bp, Rattus norvegicus
gaacctcagcctgtcaaaagaagac

SEQ ID NO: 294321 - DNA, 25 bp, Rattus norvegicus
gaacctcagctaatatccatatcat

SEQ ID NO: 294322 - DNA, 25 bp, Rattus norvegicus
gaacctcagctattatccatatcat

SEQ ID NO: 294323 - DNA, 25 bp, Rattus norvegicus
gaacctcagtatacacaccaaacat

SEQ ID NO: 294324 - DNA, 25 bp, Rattus norvegicus
gaacctcagtattcacaccaaacat

SEQ ID NO: 294325 - DNA, 25 bp, Rattus norvegicus
gaacctcagttgaatggtgaagcaa

SEQ ID NO: 294326 - DNA, 25 bp, Rattus norvegicus
gaacctcagttgtatggtgaagcaa

SEQ ID NO: 294327 - DNA, 25 bp, Rattus norvegicus
gaacctcatctaactctctatttaa

SEQ ID NO: 294328 - DNA, 25 bp, Rattus norvegicus
gaacctcatctatctctctatttaa

SEQ ID NO: 294329 - DNA, 25 bp, Rattus norvegicus
gaacctcatgagctttatcaactga

SEQ ID NO: 294330 - DNA, 25 bp, Rattus norvegicus
gaacctcatgaggtttatcaactga

SEQ ID NO: 294331 - DNA, 25 bp, Rattus norvegicus
gaacctcatgttcaaagatgtaaaa

SEQ ID NO: 294332 - DNA, 25 bp, Rattus norvegicus
gaacctcatgttgaaagatgtaaaa

SEQ ID NO: 294333 - DNA, 25 bp, Rattus norvegicus
gaacctcattgaagccatgacaccg

SEQ ID NO: 294334 - DNA, 25 bp, Rattus norvegicus
gaacctcattgatgccatgacaccg

SEQ ID NO: 294335 - DNA, 25 bp, Rattus norvegicus
gaacctccagaaatcttacttagtg

SEQ ID NO: 294336 - DNA, 25 bp, Rattus norvegicus
gaacctccagaacatcatgctgcat

SEQ ID NO: 294337 - DNA, 25 bp, Rattus norvegicus
gaacctccagaagatcatgctgcat

SEQ ID NO: 294338 - DNA, 25 bp, Rattus norvegicus
gaacctccagaattcttacttagtg

SEQ ID NO: 294339 - DNA, 25 bp, Rattus norvegicus
gaacctccagttattaaacggtgcg

SEQ ID NO: 294340 - DNA, 25 bp, Rattus norvegicus
gaacctccagtttttaaacggtgcg

SEQ ID NO: 294341 - DNA, 25 bp, Rattus norvegicus
gaacctccatgtcaacagcccttta

SEQ ID NO: 294342 - DNA, 25 bp, Rattus norvegicus
gaacctccatgtgaacagcccttta

SEQ ID NO: 294343 - DNA, 25 bp, Rattus norvegicus
gaacctcccaaacacttggtggaca

SEQ ID NO: 294344 - DNA, 25 bp, Rattus norvegicus
gaacctcccaaagacttggtggaca

SEQ ID NO: 294345 - DNA, 25 bp, Rattus norvegicus
gaacctccctgtcctgatcttagaa

SEQ ID NO: 294346 - DNA, 25 bp, Rattus norvegicus
gaacctccctgtgctgatcttagaa

SEQ ID NO: 294347 - DNA, 25 bp, Rattus norvegicus
gaacctccgagtagagttccggcgg

SEQ ID NO: 294348 - DNA, 25 bp, Rattus norvegicus
gaacctccgagttgagttccggcgg

SEQ ID NO: 294349 - DNA, 25 bp, Rattus norvegicus
gaacctccgtttacctattgtcagc

SEQ ID NO: 294350 - DNA, 25 bp, Rattus norvegicus
gaacctccgttttcctattgtcagc

SEQ ID NO: 294351 - DNA, 25 bp, Rattus norvegicus
gaacctcctaataatcatgtgattt

SEQ ID NO: 294352 - DNA, 25 bp, Rattus norvegicus
gaacctcctaattatcatgtgattt

SEQ ID NO: 294353 - DNA, 25 bp, Rattus norvegicus
gaacctcctgcaagttatgtcggat

SEQ ID NO: 294354 - DNA, 25 bp, Rattus norvegicus
gaacctcctgcatgttatgtcggat

SEQ ID NO: 294355 - DNA, 25 bp, Rattus norvegicus
gaacctcctgctacgtataagtgaa

SEQ ID NO: 294356 - DNA, 25 bp, Rattus norvegicus
gaacctcctgctagactatgtatta

SEQ ID NO: 294357 - DNA, 25 bp, Rattus norvegicus
gaacctcctgcttcgtataagtgaa

SEQ ID NO: 294358 - DNA, 25 bp, Rattus norvegicus
gaacctcctgcttgactatgtatta

SEQ ID NO: 294359 - DNA, 25 bp, Rattus norvegicus
gaacctcctggaagctgtagaccaa

SEQ ID NO: 294360 - DNA, 25 bp, Rattus norvegicus
gaacctcctggatgctgtagaccaa

SEQ ID NO: 294361 - DNA, 25 bp, Rattus norvegicus
gaacctcctgggaccagattcattt

SEQ ID NO: 294362 - DNA, 25 bp, Rattus norvegicus
gaacctcctgggtccagattcattt

SEQ ID NO: 294363 - DNA, 25 bp, Rattus norvegicus
gaacctcctgtgagctaacaggctt

SEQ ID NO: 294364 - DNA, 25 bp, Rattus norvegicus
gaacctcctgtgtgctaacaggctt

SEQ ID NO: 294365 - DNA, 25 bp, Rattus norvegicus
gaacctcctttcaagattacagtat

SEQ ID NO: 294366 - DNA, 25 bp, Rattus norvegicus
gaacctcctttctagattacagtat

SEQ ID NO: 294367 - DNA, 25 bp, Rattus norvegicus
gaacctcctttgaacctgcagaagt

SEQ ID NO: 294368 - DNA, 25 bp, Rattus norvegicus
gaacctcctttgtacctgcagaagt

SEQ ID NO: 294369 - DNA, 25 bp, Rattus norvegicus
gaacctcgacaacaaggccagctct

SEQ ID NO: 294370 - DNA, 25 bp, Rattus norvegicus
gaacctcgacaagaaggccagctct

SEQ ID NO: 294371 - DNA, 25 bp, Rattus norvegicus
gaacctcgagcaatgttggcgactg

SEQ ID NO: 294372 - DNA, 25 bp, Rattus norvegicus
gaacctcgagcattgttggcgactg

SEQ ID NO: 294373 - DNA, 25 bp, Rattus norvegicus
gaacctcgagttctgactgacacag

SEQ ID NO: 294374 - DNA, 25 bp, Rattus norvegicus
gaacctcgagttgtgactgacacag

SEQ ID NO: 294375 - DNA, 25 bp, Rattus norvegicus
gaacctcgcgggaggagaagcactt

SEQ ID NO: 294376 - DNA, 25 bp, Rattus norvegicus
gaacctcgcgggtggagaagcactt

SEQ ID NO: 294377 - DNA, 25 bp, Rattus norvegicus
gaacctcgctatctctcttttcttt

SEQ ID NO: 294378 - DNA, 25 bp, Rattus norvegicus
gaacctcgctatgtctcttttcttt

SEQ ID NO: 294379 - DNA, 25 bp, Rattus norvegicus
gaacctcggagaagtcgtcttcaaa

SEQ ID NO: 294380 - DNA, 25 bp, Rattus norvegicus
gaacctcggagatgtcgtcttcaaa

SEQ ID NO: 294381 - DNA, 25 bp, Rattus norvegicus
gaacctcgggctcgacaccaagatg

SEQ ID NO: 294382 - DNA, 25 bp, Rattus norvegicus
gaacctcgggctggacaccaagatg

SEQ ID NO: 294383 - DNA, 25 bp, Rattus norvegicus
gaacctcgtcttagagcaggctcat

SEQ ID NO: 294384 - DNA, 25 bp, Rattus norvegicus
gaacctcgtctttgagcaggctcat

SEQ ID NO: 294385 - DNA, 25 bp, Rattus norvegicus
gaacctctaaggcacctgtcaccat

SEQ ID NO: 294386 - DNA, 25 bp, Rattus norvegicus
gaacctctaagggacctgtcaccat

SEQ ID NO: 294387 - DNA, 25 bp, Rattus norvegicus
gaacctctacatagggcctgtggaa

SEQ ID NO: 294388 - DNA, 25 bp, Rattus norvegicus
gaacctctacattgggcctgtggaa

SEQ ID NO: 294389 - DNA, 25 bp, Rattus norvegicus
gaacctctagataaattggctactg

SEQ ID NO: 294390 - DNA, 25 bp, Rattus norvegicus
gaacctctagattaattggctactg

SEQ ID NO: 294391 - DNA, 25 bp, Rattus norvegicus
gaacctctcaaacactttgtgtctg

SEQ ID NO: 294392 - DNA, 25 bp, Rattus norvegicus
gaacctctcaaagactttgtgtctg

SEQ ID NO: 294393 - DNA, 25 bp, Rattus norvegicus
gaacctctcgccctgagatgggagc

SEQ ID NO: 294394 - DNA, 25 bp, Rattus norvegicus
gaacctctcgccgtgagatgggagc

SEQ ID NO: 294395 - DNA, 25 bp, Rattus norvegicus
gaacctctgaaacacttggtcgtct

SEQ ID NO: 294396 - DNA, 25 bp, Rattus norvegicus
gaacctctgaaagacttggtcgtct

SEQ ID NO: 294397 - DNA, 25 bp, Rattus norvegicus
gaacctctgaacatgtaagctggct

SEQ ID NO: 294398 - DNA, 25 bp, Rattus norvegicus
gaacctctgaacttgtaagctggct

SEQ ID NO: 294399 - DNA, 25 bp, Rattus norvegicus
gaacctctgcataaaaagtccccac

SEQ ID NO: 294400 - DNA, 25 bp, Rattus norvegicus
gaacctctgcattaaaagtccccac

SEQ ID NO: 294401 - DNA, 25 bp, Rattus norvegicus
gaacctctggataactttgaatcac

SEQ ID NO: 294402 - DNA, 25 bp, Rattus norvegicus
gaacctctggattactttgaatcac

SEQ ID NO: 294403 - DNA, 25 bp, Rattus norvegicus
gaacctctgttaaatctgccagtat

SEQ ID NO: 294404 - DNA, 25 bp, Rattus norvegicus
gaacctctgttatatctgccagtat

SEQ ID NO: 294405 - DNA, 25 bp, Rattus norvegicus
gaacctcttactacggatgggaaat

SEQ ID NO: 294406 - DNA, 25 bp, Rattus norvegicus
gaacctcttacttcggatgggaaat

SEQ ID NO: 294407 - DNA, 25 bp, Rattus norvegicus
gaacctcttctaccaagtggctgaa

SEQ ID NO: 294408 - DNA, 25 bp, Rattus norvegicus
gaacctcttctagcaagtggctgaa

SEQ ID NO: 294409 - DNA, 25 bp, Rattus norvegicus
gaacctctttatcaatttctgtctc

SEQ ID NO: 294410 - DNA, 25 bp, Rattus norvegicus
gaacctctttatgaatttctgtctc

SEQ ID NO: 294411 - DNA, 25 bp, Rattus norvegicus
gaacctgaaacacctaatgctcaca

SEQ ID NO: 294412 - DNA, 25 bp, Rattus norvegicus
gaacctgaaacagctaatgctcaca

SEQ ID NO: 294413 - DNA, 25 bp, Rattus norvegicus
gaacctgaaagcagtctccgagcac

SEQ ID NO: 294414 - DNA, 25 bp, Rattus norvegicus
gaacctgaaagctgtctccgagcac

SEQ ID NO: 294415 - DNA, 25 bp, Rattus norvegicus
gaacctgaaataccctttgtttggg

SEQ ID NO: 294416 - DNA, 25 bp, Rattus norvegicus
gaacctgaaatagcctttgtttggg

SEQ ID NO: 294417 - DNA, 25 bp, Rattus norvegicus
gaacctgaaattagctttctctctc

SEQ ID NO: 294418 - DNA, 25 bp, Rattus norvegicus
gaacctgaaatttgctttctctctc

SEQ ID NO: 294419 - DNA, 25 bp, Rattus norvegicus
gaacctgaacccaaaagctgcctgt

SEQ ID NO: 294420 - DNA, 25 bp, Rattus norvegicus
gaacctgaaccctaaagctgcctgt

SEQ ID NO: 294421 - DNA, 25 bp, Rattus norvegicus
gaacctgaactcctttatggctaat

SEQ ID NO: 294422 - DNA, 25 bp, Rattus norvegicus
gaacctgaactcgtttatggctaat

SEQ ID NO: 294423 - DNA, 25 bp, Rattus norvegicus
gaacctgaagacagatcgtatagga

SEQ ID NO: 294424 - DNA, 25 bp, Rattus norvegicus
gaacctgaagactgatcgtatagga

SEQ ID NO: 294425 - DNA, 25 bp, Rattus norvegicus
gaacctgaaggaacatcccatgaat

SEQ ID NO: 294426 - DNA, 25 bp, Rattus norvegicus
gaacctgaaggatcatcccatgaat

SEQ ID NO: 294427 - DNA, 25 bp, Rattus norvegicus
gaacctgaagtgactgagtgctgct

SEQ ID NO: 294428 - DNA, 25 bp, Rattus norvegicus
gaacctgaagtgtctgagtgctgct

SEQ ID NO: 294429 - DNA, 25 bp, Rattus norvegicus
gaacctgaattcatgatcttctttt

SEQ ID NO: 294430 - DNA, 25 bp, Rattus norvegicus
gaacctgaattcttgatcttctttt

SEQ ID NO: 294431 - DNA, 25 bp, Rattus norvegicus
gaacctgaatttcatctccagaacc

SEQ ID NO: 294432 - DNA, 25 bp, Rattus norvegicus
gaacctgaatttgatctccagaacc

SEQ ID NO: 294433 - DNA, 25 bp, Rattus norvegicus
gaacctgacaaactgcttttaccct

SEQ ID NO: 294434 - DNA, 25 bp, Rattus norvegicus
gaacctgacaaagtgcttttaccct

SEQ ID NO: 294435 - DNA, 25 bp, Rattus norvegicus
gaacctgacacccaagatgaataaa

SEQ ID NO: 294436 - DNA, 25 bp, Rattus norvegicus
gaacctgacaccgaagatgaataaa

SEQ ID NO: 294437 - DNA, 25 bp, Rattus norvegicus
gaacctgacagactttgctgtgtga

SEQ ID NO: 294438 - DNA, 25 bp, Rattus norvegicus
gaacctgacagagtttgctgtgtga

SEQ ID NO: 294439 - DNA, 25 bp, Rattus norvegicus
gaacctgacagtcctatcagccgac

SEQ ID NO: 294440 - DNA, 25 bp, Rattus norvegicus
gaacctgacagtgctatcagccgac

SEQ ID NO: 294441 - DNA, 25 bp, Rattus norvegicus
gaacctgaccctcctatttatttta

SEQ ID NO: 294442 - DNA, 25 bp, Rattus norvegicus
gaacctgaccctgctatttatttta

SEQ ID NO: 294443 - DNA, 25 bp, Rattus norvegicus
gaacctgagaacatgcacgttgctt

SEQ ID NO: 294444 - DNA, 25 bp, Rattus norvegicus
gaacctgagaacttgcacgttgctt

SEQ ID NO: 294445 - DNA, 25 bp, Rattus norvegicus
gaacctgagcagatttccactttga

SEQ ID NO: 294446 - DNA, 25 bp, Rattus norvegicus
gaacctgagcagttttccactttga

SEQ ID NO: 294447 - DNA, 25 bp, Rattus norvegicus
gaacctgagcttattcctctgggaa

SEQ ID NO: 294448 - DNA, 25 bp, Rattus norvegicus
gaacctgagctttttcctctgggaa

SEQ ID NO: 294449 - DNA, 25 bp, Rattus norvegicus
gaacctgaggcgacctgttttacag

SEQ ID NO: 294450 - DNA, 25 bp, Rattus norvegicus
gaacctgaggcgtcctgttttacag

SEQ ID NO: 294451 - DNA, 25 bp, Rattus norvegicus
gaacctgaggttcgatttctactat

SEQ ID NO: 294452 - DNA, 25 bp, Rattus norvegicus
gaacctgaggttggatttctactat

SEQ ID NO: 294453 - DNA, 25 bp, Rattus norvegicus
gaacctgagtgcagttgtattggct

SEQ ID NO: 294454 - DNA, 25 bp, Rattus norvegicus
gaacctgagtgctgttgtattggct

SEQ ID NO: 294455 - DNA, 25 bp, Rattus norvegicus
gaacctgagtggatctcagcacccg

SEQ ID NO: 294456 - DNA, 25 bp, Rattus norvegicus
gaacctgagtggttctcagcacccg

SEQ ID NO: 294457 - DNA, 25 bp, Rattus norvegicus
gaacctgatagaagacggccacctg

SEQ ID NO: 294458 - DNA, 25 bp, Rattus norvegicus
gaacctgatagatgacggccacctg

SEQ ID NO: 294459 - DNA, 25 bp, Rattus norvegicus
gaacctgcaagtaactatagagctg

SEQ ID NO: 294460 - DNA, 25 bp, Rattus norvegicus
gaacctgcaagttactatagagctg

SEQ ID NO: 294461 - DNA, 25 bp, Rattus norvegicus
gaacctgcacacataccatatggag

SEQ ID NO: 294462 - DNA, 25 bp, Rattus norvegicus
gaacctgcacacttaccatatggag

SEQ ID NO: 294463 - DNA, 25 bp, Rattus norvegicus
gaacctgcactgacacaattcaagt

SEQ ID NO: 294464 - DNA, 25 bp, Rattus norvegicus
gaacctgcactgagtttgctgtgta

SEQ ID NO: 294465 - DNA, 25 bp, Rattus norvegicus
gaacctgcactgtcacaattcaagt

SEQ ID NO: 294466 - DNA, 25 bp, Rattus norvegicus
gaacctgcactgtgtttgctgtgta

SEQ ID NO: 294467 - DNA, 25 bp, Rattus norvegicus
gaacctgcacttaagctacgtgtga

SEQ ID NO: 294468 - DNA, 25 bp, Rattus norvegicus
gaacctgcactttagctacgtgtga

SEQ ID NO: 294469 - DNA, 25 bp, Rattus norvegicus
gaacctgcagatcgatatgcctcct

SEQ ID NO: 294470 - DNA, 25 bp, Rattus norvegicus
gaacctgcagatggatatgcctcct

SEQ ID NO: 294471 - DNA, 25 bp, Rattus norvegicus
gaacctgcagccagggccggaggct

SEQ ID NO: 294472 - DNA, 25 bp, Rattus norvegicus
gaacctgcagcctgggccggaggct

SEQ ID NO: 294473 - DNA, 25 bp, Rattus norvegicus
gaacctgcaggcatagttattgact

SEQ ID NO: 294474 - DNA, 25 bp, Rattus norvegicus
gaacctgcaggcttagttattgact

SEQ ID NO: 294475 - DNA, 25 bp, Rattus norvegicus
gaacctgcatgtctctggcacagca

SEQ ID NO: 294476 - DNA, 25 bp, Rattus norvegicus
gaacctgcatgtgtctggcacagca

SEQ ID NO: 294477 - DNA, 25 bp, Rattus norvegicus
gaacctgccacacatgtacgtacaa

SEQ ID NO: 294478 - DNA, 25 bp, Rattus norvegicus
gaacctgccacagatgtacgtacaa

SEQ ID NO: 294479 - DNA, 25 bp, Rattus norvegicus
gaacctgccagacagcaggagcaga

SEQ ID NO: 294480 - DNA, 25 bp, Rattus norvegicus
gaacctgccagagagcaggagcaga

SEQ ID NO: 294481 - DNA, 25 bp, Rattus norvegicus
gaacctgccaggatcttactgattt

SEQ ID NO: 294482 - DNA, 25 bp, Rattus norvegicus
gaacctgccaggttcttactgattt

SEQ ID NO: 294483 - DNA, 25 bp, Rattus norvegicus
gaacctgcccatctcttattggtta

SEQ ID NO: 294484 - DNA, 25 bp, Rattus norvegicus
gaacctgcccatgtcttattggtta

SEQ ID NO: 294485 - DNA, 25 bp, Rattus norvegicus
gaacctgccgctcgtaaagagacag

SEQ ID NO: 294486 - DNA, 25 bp, Rattus norvegicus
gaacctgccgctggtaaagagacag

SEQ ID NO: 294487 - DNA, 25 bp, Rattus norvegicus
gaacctgcgaggagccaaccgggat

SEQ ID NO: 294488 - DNA, 25 bp, Rattus norvegicus
gaacctgcgaggtgccaaccgggat

SEQ ID NO: 294489 - DNA, 25 bp, Rattus norvegicus
gaacctgcgctgctggtgctatgca

SEQ ID NO: 294490 - DNA, 25 bp, Rattus norvegicus
gaacctgcgctggtggtgctatgca

SEQ ID NO: 294491 - DNA, 25 bp, Rattus norvegicus
gaacctgcggaacctcatcggtagc

SEQ ID NO: 294492 - DNA, 25 bp, Rattus norvegicus
gaacctgcggaagctcatcggtagc

SEQ ID NO: 294493 - DNA, 25 bp, Rattus norvegicus
gaacctgcgggaacggaaacttgcc

SEQ ID NO: 294494 - DNA, 25 bp, Rattus norvegicus
gaacctgcgggatcggaaacttgcc

SEQ ID NO: 294495 - DNA, 25 bp, Rattus norvegicus
gaacctgcgttgaaggatccctagg

SEQ ID NO: 294496 - DNA, 25 bp, Rattus norvegicus
gaacctgcgttgtaggatccctagg

SEQ ID NO: 294497 - DNA, 25 bp, Rattus norvegicus
gaacctgctactacgagctcagtta

SEQ ID NO: 294498 - DNA, 25 bp, Rattus norvegicus
gaacctgctacttcgagctcagtta

SEQ ID NO: 294499 - DNA, 25 bp, Rattus norvegicus
gaacctgctatcaacatgggcgtca

SEQ ID NO: 294500 - DNA, 25 bp, Rattus norvegicus
gaacctgctatctacatgggcgtca

SEQ ID NO: 294501 - DNA, 25 bp, Rattus norvegicus
gaacctgctcaaaatctgtgtcttt

SEQ ID NO: 294502 - DNA, 25 bp, Rattus norvegicus
gaacctgctcaatatctgtgtcttt

SEQ ID NO: 294503 - DNA, 25 bp, Rattus norvegicus
gaacctgctgcactgacttgattaa

SEQ ID NO: 294504 - DNA, 25 bp, Rattus norvegicus
gaacctgctgcagtgacttgattaa

SEQ ID NO: 294505 - DNA, 25 bp, Rattus norvegicus
gaacctgctgtaccttggacaacaa

SEQ ID NO: 294506 - DNA, 25 bp, Rattus norvegicus
gaacctgctgtagcttggacaacaa

SEQ ID NO: 294507 - DNA, 25 bp, Rattus norvegicus
gaacctgcttataagctcttgaagt

SEQ ID NO: 294508 - DNA, 25 bp, Rattus norvegicus
gaacctgcttattagctcttgaagt

SEQ ID NO: 294509 - DNA, 25 bp, Rattus norvegicus
gaacctgctttgaactggattgtct

SEQ ID NO: 294510 - DNA, 25 bp, Rattus norvegicus
gaacctgctttgtactggattgtct

SEQ ID NO: 294511 - DNA, 25 bp, Rattus norvegicus
gaacctggaagcactgatcacctag

SEQ ID NO: 294512 - DNA, 25 bp, Rattus norvegicus
gaacctggaagctctgatcacctag

SEQ ID NO: 294513 - DNA, 25 bp, Rattus norvegicus
gaacctggaccacaggtggtaatta

SEQ ID NO: 294514 - DNA, 25 bp, Rattus norvegicus
gaacctggaccagaggtggtaatta

SEQ ID NO: 294515 - DNA, 25 bp, Rattus norvegicus
gaacctggactgaggaatcttgatc

SEQ ID NO: 294516 - DNA, 25 bp, Rattus norvegicus
gaacctggactgtggaatcttgatc

SEQ ID NO: 294517 - DNA, 25 bp, Rattus norvegicus
gaacctggagaacctgctgtaatct

SEQ ID NO: 294518 - DNA, 25 bp, Rattus norvegicus
gaacctggagaagctgctgtaatct

SEQ ID NO: 294519 - DNA, 25 bp, Rattus norvegicus
gaacctggagctatattaccagtag

SEQ ID NO: 294520 - DNA, 25 bp, Rattus norvegicus
gaacctggagctttattaccagtag

SEQ ID NO: 294521 - DNA, 25 bp, Rattus norvegicus
gaacctggagtgcttgagtgtccca

SEQ ID NO: 294522 - DNA, 25 bp, Rattus norvegicus
gaacctggagtggttgagtgtccca

SEQ ID NO: 294523 - DNA, 25 bp, Rattus norvegicus
gaacctggcaggaccatggtgtgac

SEQ ID NO: 294524 - DNA, 25 bp, Rattus norvegicus
gaacctggcaggtccatggtgtgac

SEQ ID NO: 294525 - DNA, 25 bp, Rattus norvegicus
gaacctggcagtacttttaggtcaa

SEQ ID NO: 294526 - DNA, 25 bp, Rattus norvegicus
gaacctggcagtcggtttgtaactt

SEQ ID NO: 294527 - DNA, 25 bp, Rattus norvegicus
gaacctggcagtgggtttgtaactt

SEQ ID NO: 294528 - DNA, 25 bp, Rattus norvegicus
gaacctggcagttcttttaggtcaa

SEQ ID NO: 294529 - DNA, 25 bp, Rattus norvegicus
gaacctggcatgattttgacacaag

SEQ ID NO: 294530 - DNA, 25 bp, Rattus norvegicus
gaacctggcatgtttttgacacaag

SEQ ID NO: 294531 - DNA, 25 bp, Rattus norvegicus
gaacctggcctgcaaccaattcaga

SEQ ID NO: 294532 - DNA, 25 bp, Rattus norvegicus
gaacctggcctggaaccaattcaga

SEQ ID NO: 294533 - DNA, 25 bp, Rattus norvegicus
gaacctggctatctttagtgtcacc

SEQ ID NO: 294534 - DNA, 25 bp, Rattus norvegicus
gaacctggctatgtttagtgtcacc

SEQ ID NO: 294535 - DNA, 25 bp, Rattus norvegicus
gaacctggctccatgctgagtgcaa

SEQ ID NO: 294536 - DNA, 25 bp, Rattus norvegicus
gaacctggctccttgctgagtgcaa

SEQ ID NO: 294537 - DNA, 25 bp, Rattus norvegicus
gaacctggctctaagatctatcagt

SEQ ID NO: 294538 - DNA, 25 bp, Rattus norvegicus
gaacctggctcttagatctatcagt

SEQ ID NO: 294539 - DNA, 25 bp, Rattus norvegicus
gaacctggctgaaaacctatgacct

SEQ ID NO: 294540 - DNA, 25 bp, Rattus norvegicus
gaacctggctgataacctatgacct

SEQ ID NO: 294541 - DNA, 25 bp, Rattus norvegicus
gaacctggctgtccatcaaagtagt

SEQ ID NO: 294542 - DNA, 25 bp, Rattus norvegicus
gaacctggctgtgcatcaaagtagt

SEQ ID NO: 294543 - DNA, 25 bp, Rattus norvegicus
gaacctggcttcacatggcttcaca

SEQ ID NO: 294544 - DNA, 25 bp, Rattus norvegicus
gaacctggcttctcatggcttcaca

SEQ ID NO: 294545 - DNA, 25 bp, Rattus norvegicus
gaacctgggaaaattctgcctgaca

SEQ ID NO: 294546 - DNA, 25 bp, Rattus norvegicus
gaacctgggaaatttctgcctgaca

SEQ ID NO: 294547 - DNA, 25 bp, Rattus norvegicus
gaacctgggagaaccccgttggcaa

SEQ ID NO: 294548 - DNA, 25 bp, Rattus norvegicus
gaacctgggagatccccgttggcaa

SEQ ID NO: 294549 - DNA, 25 bp, Rattus norvegicus
gaacctgggagcacgatgatgatca

SEQ ID NO: 294550 - DNA, 25 bp, Rattus norvegicus
gaacctgggagctcgatgatgatca

SEQ ID NO: 294551 - DNA, 25 bp, Rattus norvegicus
gaacctgggctgctagctaactaaa

SEQ ID NO: 294552 - DNA, 25 bp, Rattus norvegicus
gaacctgggctggtagctaactaaa

SEQ ID NO: 294553 - DNA, 25 bp, Rattus norvegicus
gaacctgggtccagcagccaagttg

SEQ ID NO: 294554 - DNA, 25 bp, Rattus norvegicus
gaacctgggtcctgcagccaagttg

SEQ ID NO: 294555 - DNA, 25 bp, Rattus norvegicus
gaacctggtacacacacgtaaagtt

SEQ ID NO: 294556 - DNA, 25 bp, Rattus norvegicus
gaacctggtacagacacgtaaagtt

SEQ ID NO: 294557 - DNA, 25 bp, Rattus norvegicus
gaacctggtagcattcgtgtctgaa

SEQ ID NO: 294558 - DNA, 25 bp, Rattus norvegicus
gaacctggtagctttcgtgtctgaa

SEQ ID NO: 294559 - DNA, 25 bp, Rattus norvegicus
gaacctggtattaatcataactgct

SEQ ID NO: 294560 - DNA, 25 bp, Rattus norvegicus
gaacctggtatttatcataactgct

SEQ ID NO: 294561 - DNA, 25 bp, Rattus norvegicus
gaacctggtcagatcgggttacaca

SEQ ID NO: 294562 - DNA, 25 bp, Rattus norvegicus
gaacctggtcagttcgggttacaca

SEQ ID NO: 294563 - DNA, 25 bp, Rattus norvegicus
gaacctggtcatactgagactcttt

SEQ ID NO: 294564 - DNA, 25 bp, Rattus norvegicus
gaacctggtcattctgagactcttt

SEQ ID NO: 294565 - DNA, 25 bp, Rattus norvegicus
gaacctggtcgacggcctggacttt

SEQ ID NO: 294566 - DNA, 25 bp, Rattus norvegicus
gaacctggtcgagggcctggacttt

SEQ ID NO: 294567 - DNA, 25 bp, Rattus norvegicus
gaacctggtctcaaatatactggaa

SEQ ID NO: 294568 - DNA, 25 bp, Rattus norvegicus
gaacctggtctctaatatactggaa

SEQ ID NO: 294569 - DNA, 25 bp, Rattus norvegicus
gaacctggtgtgagtatgcttttat

SEQ ID NO: 294570 - DNA, 25 bp, Rattus norvegicus
gaacctggtgtgtgtatgcttttat

SEQ ID NO: 294571 - DNA, 25 bp, Rattus norvegicus
gaacctggttcaacatgtgcaccca

SEQ ID NO: 294572 - DNA, 25 bp, Rattus norvegicus
gaacctggttcaaggaaagatcttt

SEQ ID NO: 294573 - DNA, 25 bp, Rattus norvegicus
gaacctggttcatcatgtgcaccca

SEQ ID NO: 294574 - DNA, 25 bp, Rattus norvegicus
gaacctggttcatggaaagatcttt

SEQ ID NO: 294575 - DNA, 25 bp, Rattus norvegicus
gaacctgtatttacttcttatgttg

SEQ ID NO: 294576 - DNA, 25 bp, Rattus norvegicus
gaacctgtattttcttcttatgttg

SEQ ID NO: 294577 - DNA, 25 bp, Rattus norvegicus
gaacctgtcaagcagtgctgtagtt

SEQ ID NO: 294578 - DNA, 25 bp, Rattus norvegicus
gaacctgtcaaggagtgctgtagtt

SEQ ID NO: 294579 - DNA, 25 bp, Rattus norvegicus
gaacctgtcaatctgaactcagtta

SEQ ID NO: 294580 - DNA, 25 bp, Rattus norvegicus
gaacctgtcaatgtgaactcagtta

SEQ ID NO: 294581 - DNA, 25 bp, Rattus norvegicus
gaacctgtcagccaaaccaagcgac

SEQ ID NO: 294582 - DNA, 25 bp, Rattus norvegicus
gaacctgtcagcgaaaccaagcgac

SEQ ID NO: 294583 - DNA, 25 bp, Rattus norvegicus
gaacctgtcattaagtacatcacct

SEQ ID NO: 294584 - DNA, 25 bp, Rattus norvegicus
gaacctgtcattcatttggattaga

SEQ ID NO: 294585 - DNA, 25 bp, Rattus norvegicus
gaacctgtcattgatttggattaga

SEQ ID NO: 294586 - DNA, 25 bp, Rattus norvegicus
gaacctgtcatttagtacatcacct

SEQ ID NO: 294587 - DNA, 25 bp, Rattus norvegicus
gaacctgtccagactcctttagaag

SEQ ID NO: 294588 - DNA, 25 bp, Rattus norvegicus
gaacctgtccagtctcctttagaag

SEQ ID NO: 294589 - DNA, 25 bp, Rattus norvegicus
gaacctgtccccagagaaatagcac

SEQ ID NO: 294590 - DNA, 25 bp, Rattus norvegicus
gaacctgtccccaggaaaattcagt

SEQ ID NO: 294591 - DNA, 25 bp, Rattus norvegicus
gaacctgtcccctgagaaatagcac

SEQ ID NO: 294592 - DNA, 25 bp, Rattus norvegicus
gaacctgtcccctggaaaattcagt

SEQ ID NO: 294593 - DNA, 25 bp, Rattus norvegicus
gaacctgtctgtcgcttatgtagat

SEQ ID NO: 294594 - DNA, 25 bp, Rattus norvegicus
gaacctgtctgtcttaagtctgaaa

SEQ ID NO: 294595 - DNA, 25 bp, Rattus norvegicus
gaacctgtctgtggcttatgtagat

SEQ ID NO: 294596 - DNA, 25 bp, Rattus norvegicus
gaacctgtctgtgttaagtctgaaa

SEQ ID NO: 294597 - DNA, 25 bp, Rattus norvegicus
gaacctgtgaacacaactgctgatt

SEQ ID NO: 294598 - DNA, 25 bp, Rattus norvegicus
gaacctgtgaactcaactgctgatt

SEQ ID NO: 294599 - DNA, 25 bp, Rattus norvegicus
gaacctgtgacaataccggagtcta

SEQ ID NO: 294600 - DNA, 25 bp, Rattus norvegicus
gaacctgtgacacttcgtttaatta

SEQ ID NO: 294601 - DNA, 25 bp, Rattus norvegicus
gaacctgtgacagttcgtttaatta

SEQ ID NO: 294602 - DNA, 25 bp, Rattus norvegicus
gaacctgtgacattaccggagtcta

SEQ ID NO: 294603 - DNA, 25 bp, Rattus norvegicus
gaacctgtgctgactatggctcaag

SEQ ID NO: 294604 - DNA, 25 bp, Rattus norvegicus
gaacctgtgctgtctatggctcaag

SEQ ID NO: 294605 - DNA, 25 bp, Rattus norvegicus
gaacctgtggcgctatggcgacttc

SEQ ID NO: 294606 - DNA, 25 bp, Rattus norvegicus
gaacctgtggcggtatggcgacttc

SEQ ID NO: 294607 - DNA, 25 bp, Rattus norvegicus
gaacctgtggctaatttgagacaac

SEQ ID NO: 294608 - DNA, 25 bp, Rattus norvegicus
gaacctgtggctccggtgaaagctt

SEQ ID NO: 294609 - DNA, 25 bp, Rattus norvegicus
gaacctgtggctgcggtgaaagctt

SEQ ID NO: 294610 - DNA, 25 bp, Rattus norvegicus
gaacctgtggcttatttgagacaac

SEQ ID NO: 294611 - DNA, 25 bp, Rattus norvegicus
gaacctgtgtgacttgggcattgta

SEQ ID NO: 294612 - DNA, 25 bp, Rattus norvegicus
gaacctgtgtgagttgggcattgta

SEQ ID NO: 294613 - DNA, 25 bp, Rattus norvegicus
gaacctgtgttcataaccgatttcg

SEQ ID NO: 294614 - DNA, 25 bp, Rattus norvegicus
gaacctgtgttcttaaccgatttcg

SEQ ID NO: 294615 - DNA, 25 bp, Rattus norvegicus
gaacctgtgtttcttgcccgcttcc

SEQ ID NO: 294616 - DNA, 25 bp, Rattus norvegicus
gaacctgtgtttgttgcccgcttcc

SEQ ID NO: 294617 - DNA, 25 bp, Rattus norvegicus
gaacctgttagaatttgagtctcaa

SEQ ID NO: 294618 - DNA, 25 bp, Rattus norvegicus
gaacctgttagattttgagtctcaa

SEQ ID NO: 294619 - DNA, 25 bp, Rattus norvegicus
gaacctgttcatattccagcttata

SEQ ID NO: 294620 - DNA, 25 bp, Rattus norvegicus
gaacctgttcattttccagcttata

SEQ ID NO: 294621 - DNA, 25 bp, Rattus norvegicus
gaacctgttccgaaaatttgagagc

SEQ ID NO: 294622 - DNA, 25 bp, Rattus norvegicus
gaacctgttccgtaaatttgagagc

SEQ ID NO: 294623 - DNA, 25 bp, Rattus norvegicus
gaacctgttcttccaggaagttccg

SEQ ID NO: 294624 - DNA, 25 bp, Rattus norvegicus
gaacctgttcttgcaggaagttccg

SEQ ID NO: 294625 - DNA, 25 bp, Rattus norvegicus
gaacctgttgcaccaagatgccgta

SEQ ID NO: 294626 - DNA, 25 bp, Rattus norvegicus
gaacctgttgcagcaagatgccgta

SEQ ID NO: 294627 - DNA, 25 bp, Rattus norvegicus
gaacctgttggaaccttagcgtttg

SEQ ID NO: 294628 - DNA, 25 bp, Rattus norvegicus
gaacctgttggatccttagcgtttg

SEQ ID NO: 294629 - DNA, 25 bp, Rattus norvegicus
gaacctgttgtcaatttcattagag

SEQ ID NO: 294630 - DNA, 25 bp, Rattus norvegicus
gaacctgttgtctatttcattagag

SEQ ID NO: 294631 - DNA, 25 bp, Rattus norvegicus
gaacctgtttctagtctttaagatc

SEQ ID NO: 294632 - DNA, 25 bp, Rattus norvegicus
gaacctgtttcttgtctttaagatc

SEQ ID NO: 294633 - DNA, 25 bp, Rattus norvegicus
gaacctgtttggactatcggtactg

SEQ ID NO: 294634 - DNA, 25 bp, Rattus norvegicus
gaacctgtttggtctatcggtactg

SEQ ID NO: 294635 - DNA, 25 bp, Rattus norvegicus
gaacctgttttcattgaggaatcca

SEQ ID NO: 294636 - DNA, 25 bp, Rattus norvegicus
gaacctgttttctttgaggaatcca

SEQ ID NO: 294637 - DNA, 25 bp, Rattus norvegicus
gaacctgttttgatgggtacgtctg

SEQ ID NO: 294638 - DNA, 25 bp, Rattus norvegicus
gaacctgttttgttgggtacgtctg

SEQ ID NO: 294639 - DNA, 25 bp, Rattus norvegicus
gaacctgtttttactctgggtaatg

SEQ ID NO: 294640 - DNA, 25 bp, Rattus norvegicus
gaacctgttttttctctgggtaatg

SEQ ID NO: 294641 - DNA, 25 bp, Rattus norvegicus
gaaccttaactaatatgtcagatga

SEQ ID NO: 294642 - DNA, 25 bp, Rattus norvegicus
gaaccttaactattatgtcagatga

SEQ ID NO: 294643 - DNA, 25 bp, Rattus norvegicus
gaaccttacaagaatcctgttgcaa

SEQ ID NO: 294644 - DNA, 25 bp, Rattus norvegicus
gaaccttacaagtatcctgttgcaa

SEQ ID NO: 294645 - DNA, 25 bp, Rattus norvegicus
gaaccttacagtattagaaatctga

SEQ ID NO: 294646 - DNA, 25 bp, Rattus norvegicus
gaaccttacagttttagaaatctga

SEQ ID NO: 294647 - DNA, 25 bp, Rattus norvegicus
gaaccttacatgactggtcatctga

SEQ ID NO: 294648 - DNA, 25 bp, Rattus norvegicus
gaaccttacatgtctggtcatctga

SEQ ID NO: 294649 - DNA, 25 bp, Rattus norvegicus
gaaccttactcacaagcggctggag

SEQ ID NO: 294650 - DNA, 25 bp, Rattus norvegicus
gaaccttactcagaagcggctggag

SEQ ID NO: 294651 - DNA, 25 bp, Rattus norvegicus
gaaccttatctcacaaagtcatatg

SEQ ID NO: 294652 - DNA, 25 bp, Rattus norvegicus
gaaccttatctctcaaagtcatatg

SEQ ID NO: 294653 - DNA, 25 bp, Rattus norvegicus
gaaccttatgctctgttgttttctc

SEQ ID NO: 294654 - DNA, 25 bp, Rattus norvegicus
gaaccttatgctgtgttgttttctc

SEQ ID NO: 294655 - DNA, 25 bp, Rattus norvegicus
gaaccttcagctcctgttcgtgacg

SEQ ID NO: 294656 - DNA, 25 bp, Rattus norvegicus
gaaccttcagctgctgttcgtgacg

SEQ ID NO: 294657 - DNA, 25 bp, Rattus norvegicus
gaaccttccactcttgttcaggtgg

SEQ ID NO: 294658 - DNA, 25 bp, Rattus norvegicus
gaaccttccactgttgttcaggtgg

SEQ ID NO: 294659 - DNA, 25 bp, Rattus norvegicus
gaaccttcctaacatctgactggaa

SEQ ID NO: 294660 - DNA, 25 bp, Rattus norvegicus
gaaccttcctaagatctgactggaa

SEQ ID NO: 294661 - DNA, 25 bp, Rattus norvegicus
gaaccttcgaccagttgccatcagc

SEQ ID NO: 294662 - DNA, 25 bp, Rattus norvegicus
gaaccttcgacctgttgccatcagc

SEQ ID NO: 294663 - DNA, 25 bp, Rattus norvegicus
gaaccttcggtgctcagggtctcta

SEQ ID NO: 294664 - DNA, 25 bp, Rattus norvegicus
gaaccttcggtggtcagggtctcta

SEQ ID NO: 294665 - DNA, 25 bp, Rattus norvegicus
gaaccttctctcatcattgactggt

SEQ ID NO: 294666 - DNA, 25 bp, Rattus norvegicus
gaaccttctctcttcattgactggt

SEQ ID NO: 294667 - DNA, 25 bp, Rattus norvegicus
gaaccttctgataacttgagggaga

SEQ ID NO: 294668 - DNA, 25 bp, Rattus norvegicus
gaaccttctgattacttgagggaga

SEQ ID NO: 294669 - DNA, 25 bp, Rattus norvegicus
gaaccttctggaagatcttgtcacc

SEQ ID NO: 294670 - DNA, 25 bp, Rattus norvegicus
gaaccttctggatgatcttgtcacc

SEQ ID NO: 294671 - DNA, 25 bp, Rattus norvegicus
gaaccttctgttctgaagccgagtg

SEQ ID NO: 294672 - DNA, 25 bp, Rattus norvegicus
gaaccttctgttgtgaagccgagtg

SEQ ID NO: 294673 - DNA, 25 bp, Rattus norvegicus
gaaccttcttcccattattgtgaca

SEQ ID NO: 294674 - DNA, 25 bp, Rattus norvegicus
gaaccttcttccgattattgtgaca

SEQ ID NO: 294675 - DNA, 25 bp, Rattus norvegicus
gaaccttcttgtagatgaactctgg

SEQ ID NO: 294676 - DNA, 25 bp, Rattus norvegicus
gaaccttcttgttgatgaactctgg

SEQ ID NO: 294677 - DNA, 25 bp, Rattus norvegicus
gaaccttgaaccagactggagcacg

SEQ ID NO: 294678 - DNA, 25 bp, Rattus norvegicus
gaaccttgaacctgactggagcacg

SEQ ID NO: 294679 - DNA, 25 bp, Rattus norvegicus
gaaccttgaagccattctcctccta

SEQ ID NO: 294680 - DNA, 25 bp, Rattus norvegicus
gaaccttgaagcgattctcctccta

SEQ ID NO: 294681 - DNA, 25 bp, Rattus norvegicus
gaaccttgacatcgcttcattatgt

SEQ ID NO: 294682 - DNA, 25 bp, Rattus norvegicus
gaaccttgacatggcttcattatgt

SEQ ID NO: 294683 - DNA, 25 bp, Rattus norvegicus
gaaccttgacctcctggaacaattg

SEQ ID NO: 294684 - DNA, 25 bp, Rattus norvegicus
gaaccttgacctgctggaacaattg

SEQ ID NO: 294685 - DNA, 25 bp, Rattus norvegicus
gaaccttgagcaactggagccttga

SEQ ID NO: 294686 - DNA, 25 bp, Rattus norvegicus
gaaccttgagcatctggagccttga

SEQ ID NO: 294687 - DNA, 25 bp, Rattus norvegicus
gaaccttgatttcttgagactcttc

SEQ ID NO: 294688 - DNA, 25 bp, Rattus norvegicus
gaaccttgatttgttgagactcttc

SEQ ID NO: 294689 - DNA, 25 bp, Rattus norvegicus
gaaccttgctctccttttaagttag

SEQ ID NO: 294690 - DNA, 25 bp, Rattus norvegicus
gaaccttgctctgcttttaagttag

SEQ ID NO: 294691 - DNA, 25 bp, Rattus norvegicus
gaaccttggactatcaggagcctca

SEQ ID NO: 294692 - DNA, 25 bp, Rattus norvegicus
gaaccttggactttcaggagcctca

SEQ ID NO: 294693 - DNA, 25 bp, Rattus norvegicus
gaaccttggataattcacagagcct

SEQ ID NO: 294694 - DNA, 25 bp, Rattus norvegicus
gaaccttggatatttcacagagcct

SEQ ID NO: 294695 - DNA, 25 bp, Rattus norvegicus
gaaccttggcctcagcccttgggaa

SEQ ID NO: 294696 - DNA, 25 bp, Rattus norvegicus
gaaccttggcctgagcccttgggaa

SEQ ID NO: 294697 - DNA, 25 bp, Rattus norvegicus
gaaccttgggaacggcctgcaacca

SEQ ID NO: 294698 - DNA, 25 bp, Rattus norvegicus
gaaccttgggaagggcctgcaacca

SEQ ID NO: 294699 - DNA, 25 bp, Rattus norvegicus
gaaccttgggtgcaatttactcact

SEQ ID NO: 294700 - DNA, 25 bp, Rattus norvegicus
gaaccttgggtggaatttactcact

SEQ ID NO: 294701 - DNA, 25 bp, Rattus norvegicus
gaaccttgtgcaacagagctgccag

SEQ ID NO: 294702 - DNA, 25 bp, Rattus norvegicus
gaaccttgtgcatcagagctgccag

SEQ ID NO: 294703 - DNA, 25 bp, Rattus norvegicus
gaaccttgtggacctcgatggagaa

SEQ ID NO: 294704 - DNA, 25 bp, Rattus norvegicus
gaaccttgtggagctcgatggagaa

SEQ ID NO: 294705 - DNA, 25 bp, Rattus norvegicus
gaaccttgtgtccttcaagtcacct

SEQ ID NO: 294706 - DNA, 25 bp, Rattus norvegicus
gaaccttgtgtcgttcaagtcacct

SEQ ID NO: 294707 - DNA, 25 bp, Rattus norvegicus
gaacctttaaatcattactctgctg

SEQ ID NO: 294708 - DNA, 25 bp, Rattus norvegicus
gaacctttaaatgattactctgctg

SEQ ID NO: 294709 - DNA, 25 bp, Rattus norvegicus
gaacctttaactccttccatgttgg

SEQ ID NO: 294710 - DNA, 25 bp, Rattus norvegicus
gaacctttaactgcttccatgttgg

SEQ ID NO: 294711 - DNA, 25 bp, Rattus norvegicus
gaacctttaagaatccggacgcatt

SEQ ID NO: 294712 - DNA, 25 bp, Rattus norvegicus
gaacctttaagacggcccagccttg

SEQ ID NO: 294713 - DNA, 25 bp, Rattus norvegicus
gaacctttaagagggcccagccttg

SEQ ID NO: 294714 - DNA, 25 bp, Rattus norvegicus
gaacctttaagattccggacgcatt

SEQ ID NO: 294715 - DNA, 25 bp, Rattus norvegicus
gaacctttactacgctactacccat

SEQ ID NO: 294716 - DNA, 25 bp, Rattus norvegicus
gaacctttactaggctactacccat

SEQ ID NO: 294717 - DNA, 25 bp, Rattus norvegicus
gaacctttatttctagctaaaagat

SEQ ID NO: 294718 - DNA, 25 bp, Rattus norvegicus
gaacctttatttgtagctaaaagat

SEQ ID NO: 294719 - DNA, 25 bp, Rattus norvegicus
gaacctttcaagatgtagcctattt

SEQ ID NO: 294720 - DNA, 25 bp, Rattus norvegicus
gaacctttcaagttgtagcctattt

SEQ ID NO: 294721 - DNA, 25 bp, Rattus norvegicus
gaacctttcatgagttttcaagcca

SEQ ID NO: 294722 - DNA, 25 bp, Rattus norvegicus
gaacctttcatgattgctcctgata

SEQ ID NO: 294723 - DNA, 25 bp, Rattus norvegicus
gaacctttcatgtgttttcaagcca

SEQ ID NO: 294724 - DNA, 25 bp, Rattus norvegicus
gaacctttcatgtttgctcctgata

SEQ ID NO: 294725 - DNA, 25 bp, Rattus norvegicus
gaacctttccttcatcttggatgga

SEQ ID NO: 294726 - DNA, 25 bp, Rattus norvegicus
gaacctttccttgatcttggatgga

SEQ ID NO: 294727 - DNA, 25 bp, Rattus norvegicus
gaacctttcgaacatgaacctgaga

SEQ ID NO: 294728 - DNA, 25 bp, Rattus norvegicus
gaacctttcgaagatgaacctgaga

SEQ ID NO: 294729 - DNA, 25 bp, Rattus norvegicus
gaacctttgagaagtccagtctact

SEQ ID NO: 294730 - DNA, 25 bp, Rattus norvegicus
gaacctttgagatgtccagtctact

SEQ ID NO: 294731 - DNA, 25 bp, Rattus norvegicus
gaacctttgccaaattttgaagaaa

SEQ ID NO: 294732 - DNA, 25 bp, Rattus norvegicus
gaacctttgccatattttgaagaaa

SEQ ID NO: 294733 - DNA, 25 bp, Rattus norvegicus
gaacctttgctgctacttgtgaagc

SEQ ID NO: 294734 - DNA, 25 bp, Rattus norvegicus
gaacctttgctggtacttgtgaagc

SEQ ID NO: 294735 - DNA, 25 bp, Rattus norvegicus
gaacctttggaaaatcgattctcag

SEQ ID NO: 294736 - DNA, 25 bp, Rattus norvegicus
gaacctttggaacttgcttctacca

SEQ ID NO: 294737 - DNA, 25 bp, Rattus norvegicus
gaacctttggaagttgcttctacca

SEQ ID NO: 294738 - DNA, 25 bp, Rattus norvegicus
gaacctttggaatatcgattctcag

SEQ ID NO: 294739 - DNA, 25 bp, Rattus norvegicus
gaacctttggagagcgcttaagcat

SEQ ID NO: 294740 - DNA, 25 bp, Rattus norvegicus
gaacctttggagtgcgcttaagcat

SEQ ID NO: 294741 - DNA, 25 bp, Rattus norvegicus
gaacctttgggcaaagcaatgccct

SEQ ID NO: 294742 - DNA, 25 bp, Rattus norvegicus
gaacctttgggctaagcaatgccct

SEQ ID NO: 294743 - DNA, 25 bp, Rattus norvegicus
gaacctttggttagtcctgagatga

SEQ ID NO: 294744 - DNA, 25 bp, Rattus norvegicus
gaacctttggtttgtcctgagatga

SEQ ID NO: 294745 - DNA, 25 bp, Rattus norvegicus
gaacctttgtagaaaaatcatgtga

SEQ ID NO: 294746 - DNA, 25 bp, Rattus norvegicus
gaacctttgtagtaaaatcatgtga

SEQ ID NO: 294747 - DNA, 25 bp, Rattus norvegicus
gaacctttgtctctctttgaaaaat

SEQ ID NO: 294748 - DNA, 25 bp, Rattus norvegicus
gaacctttgtctgtctttgaaaaat

SEQ ID NO: 294749 - DNA, 25 bp, Rattus norvegicus
gaaccttttatcaaatgctgcttgg

SEQ ID NO: 294750 - DNA, 25 bp, Rattus norvegicus
gaaccttttatctaatgctgcttgg

SEQ ID NO: 294751 - DNA, 25 bp, Rattus norvegicus
gaaccttttgatcgaactaataccg

SEQ ID NO: 294752 - DNA, 25 bp, Rattus norvegicus
gaaccttttgatggaactaataccg

SEQ ID NO: 294753 - DNA, 25 bp, Rattus norvegicus
gaaccttttgtcagtcgtagtgcat

SEQ ID NO: 294754 - DNA, 25 bp, Rattus norvegicus
gaaccttttgtctgtcgtagtgcat

SEQ ID NO: 294755 - DNA, 25 bp, Rattus norvegicus
gaaccttttgtgaaggtgccagaac

SEQ ID NO: 294756 - DNA, 25 bp, Rattus norvegicus
gaaccttttgtgtaggtgccagaac

SEQ ID NO: 294757 - DNA, 25 bp, Rattus norvegicus
gaacctttttatcatgcaaggaaaa

SEQ ID NO: 294758 - DNA, 25 bp, Rattus norvegicus
gaacctttttatgatgcaaggaaaa

SEQ ID NO: 294759 - DNA, 25 bp, Rattus norvegicus
gaacctttttgacggcaggtccttg

SEQ ID NO: 294760 - DNA, 25 bp, Rattus norvegicus
gaacctttttgagggcaggtccttg

SEQ ID NO: 294761 - DNA, 25 bp, Rattus norvegicus
gaacgaaaattgagcccagccagaa

SEQ ID NO: 294762 - DNA, 25 bp, Rattus norvegicus
gaacgaaaattgtgcccagccagaa

SEQ ID NO: 294763 - DNA, 25 bp, Rattus norvegicus
gaacgaaaccacactgtccacaatg

SEQ ID NO: 294764 - DNA, 25 bp, Rattus norvegicus
gaacgaaaccactctgtccacaatg

SEQ ID NO: 294765 - DNA, 25 bp, Rattus norvegicus
gaacgaaacctccaagaactccact

SEQ ID NO: 294766 - DNA, 25 bp, Rattus norvegicus
gaacgaaacctcgaagaactccact

SEQ ID NO: 294767 - DNA, 25 bp, Rattus norvegicus
gaacgaaagtgtcctgtcctacata

SEQ ID NO: 294768 - DNA, 25 bp, Rattus norvegicus
gaacgaaagtgtgctgtcctacata

SEQ ID NO: 294769 - DNA, 25 bp, Rattus norvegicus
gaacgaaatctgagtgagccaaggt

SEQ ID NO: 294770 - DNA, 25 bp, Rattus norvegicus
gaacgaaatctgtgtgagccaaggt

SEQ ID NO: 294771 - DNA, 25 bp, Rattus norvegicus
gaacgaaccgtgaagcagcccagaa

SEQ ID NO: 294772 - DNA, 25 bp, Rattus norvegicus
gaacgaaccgtgtagcagcccagaa

SEQ ID NO: 294773 - DNA, 25 bp, Rattus norvegicus
gaacgaacgaccaagcatgaagctt

SEQ ID NO: 294774 - DNA, 25 bp, Rattus norvegicus
gaacgaacgacctagcatgaagctt

SEQ ID NO: 294775 - DNA, 25 bp, Rattus norvegicus
gaacgaactgctcgtgtatctgcta

SEQ ID NO: 294776 - DNA, 25 bp, Rattus norvegicus
gaacgaactgctggtgtatctgcta

SEQ ID NO: 294777 - DNA, 25 bp, Rattus norvegicus
gaacgaacttccacgagcatcggat

SEQ ID NO: 294778 - DNA, 25 bp, Rattus norvegicus
gaacgaacttcctcgagcatcggat

SEQ ID NO: 294779 - DNA, 25 bp, Rattus norvegicus
gaacgaagcccaattggaggtcaat

SEQ ID NO: 294780 - DNA, 25 bp, Rattus norvegicus
gaacgaagcccatttggaggtcaat

SEQ ID NO: 294781 - DNA, 25 bp, Rattus norvegicus
gaacgaagccgacatgctgttctct

SEQ ID NO: 294782 - DNA, 25 bp, Rattus norvegicus
gaacgaagccgagatgctgttctct

SEQ ID NO: 294783 - DNA, 25 bp, Rattus norvegicus
gaacgaagcctcaaaggatcaccag

SEQ ID NO: 294784 - DNA, 25 bp, Rattus norvegicus
gaacgaagcctctaaggatcaccag

SEQ ID NO: 294785 - DNA, 25 bp, Rattus norvegicus
gaacgaaggcacacttgcctcttga

SEQ ID NO: 294786 - DNA, 25 bp, Rattus norvegicus
gaacgaaggcaccatttcggtagtt

SEQ ID NO: 294787 - DNA, 25 bp, Rattus norvegicus
gaacgaaggcacgatttcggtagtt

SEQ ID NO: 294788 - DNA, 25 bp, Rattus norvegicus
gaacgaaggcactcttgcctcttga

SEQ ID NO: 294789 - DNA, 25 bp, Rattus norvegicus
gaacgaaggctaagcccggctgcga

SEQ ID NO: 294790 - DNA, 25 bp, Rattus norvegicus
gaacgaaggctatgcccggctgcga

SEQ ID NO: 294791 - DNA, 25 bp, Rattus norvegicus
gaacgaagggacaggcaagagctct

SEQ ID NO: 294792 - DNA, 25 bp, Rattus norvegicus
gaacgaagggactggcaagagctct

SEQ ID NO: 294793 - DNA, 25 bp, Rattus norvegicus
gaacgaagtatcattccgtctgctg

SEQ ID NO: 294794 - DNA, 25 bp, Rattus norvegicus
gaacgaagtatctttccgtctgctg

SEQ ID NO: 294795 - DNA, 25 bp, Rattus norvegicus
gaacgaagtttacctgagtctctgt

SEQ ID NO: 294796 - DNA, 25 bp, Rattus norvegicus
gaacgaagtttagctgagtctctgt

SEQ ID NO: 294797 - DNA, 25 bp, Rattus norvegicus
gaacgaatgtgtctgctgcctggct

SEQ ID NO: 294798 - DNA, 25 bp, Rattus norvegicus
gaacgaatgtgtgtgctgcctggct

SEQ ID NO: 294799 - DNA, 25 bp, Rattus norvegicus
gaacgacaaactcacttgtgtacag

SEQ ID NO: 294800 - DNA, 25 bp, Rattus norvegicus
gaacgacaaactgacttgtgtacag

SEQ ID NO: 294801 - DNA, 25 bp, Rattus norvegicus
gaacgacacatcagaagcttgactc

SEQ ID NO: 294802 - DNA, 25 bp, Rattus norvegicus
gaacgacacatctgaagcttgactc

SEQ ID NO: 294803 - DNA, 25 bp, Rattus norvegicus
gaacgacaccagcatctattagcga

SEQ ID NO: 294804 - DNA, 25 bp, Rattus norvegicus
gaacgacaccaggatctattagcga

SEQ ID NO: 294805 - DNA, 25 bp, Rattus norvegicus
gaacgacacgatcagctcagtgcgt

SEQ ID NO: 294806 - DNA, 25 bp, Rattus norvegicus
gaacgacacgatgagctcagtgcgt

SEQ ID NO: 294807 - DNA, 25 bp, Rattus norvegicus
gaacgacagggtcgccagacacttc

SEQ ID NO: 294808 - DNA, 25 bp, Rattus norvegicus
gaacgacagggtggccagacacttc

SEQ ID NO: 294809 - DNA, 25 bp, Rattus norvegicus
gaacgacagtgaccatcgcgtgctg

SEQ ID NO: 294810 - DNA, 25 bp, Rattus norvegicus
gaacgacagtgagcatcgcgtgctg

SEQ ID NO: 294811 - DNA, 25 bp, Rattus norvegicus
gaacgacagtgtctcctctcaggag

SEQ ID NO: 294812 - DNA, 25 bp, Rattus norvegicus
gaacgacagtgtgtcctctcaggag

SEQ ID NO: 294813 - DNA, 25 bp, Rattus norvegicus
gaacgacatctgcacttgactgctt

SEQ ID NO: 294814 - DNA, 25 bp, Rattus norvegicus
gaacgacatctggacttgactgctt

SEQ ID NO: 294815 - DNA, 25 bp, Rattus norvegicus
gaacgacattcaccagtattttctg

SEQ ID NO: 294816 - DNA, 25 bp, Rattus norvegicus
gaacgacattcagcagtattttctg

SEQ ID NO: 294817 - DNA, 25 bp, Rattus norvegicus
gaacgacccatgaagcactagctaa

SEQ ID NO: 294818 - DNA, 25 bp, Rattus norvegicus
gaacgacccatgtagcactagctaa

SEQ ID NO: 294819 - DNA, 25 bp, Rattus norvegicus
gaacgaccgcgtagtgagcaacctg

SEQ ID NO: 294820 - DNA, 25 bp, Rattus norvegicus
gaacgaccgcgttgtgagcaacctg

SEQ ID NO: 294821 - DNA, 25 bp, Rattus norvegicus
gaacgacctctgcatgacatcattg

SEQ ID NO: 294822 - DNA, 25 bp, Rattus norvegicus
gaacgacctctggatgacatcattg

SEQ ID NO: 294823 - DNA, 25 bp, Rattus norvegicus
gaacgaccttccctgacctcatttt

SEQ ID NO: 294824 - DNA, 25 bp, Rattus norvegicus
gaacgaccttccgtgacctcatttt

SEQ ID NO: 294825 - DNA, 25 bp, Rattus norvegicus
gaacgacgcgctcattatagccaaa

SEQ ID NO: 294826 - DNA, 25 bp, Rattus norvegicus
gaacgacgcgctgattatagccaaa

SEQ ID NO: 294827 - DNA, 25 bp, Rattus norvegicus
gaacgacggcctctgtttaacaacg

SEQ ID NO: 294828 - DNA, 25 bp, Rattus norvegicus
gaacgacggcctgtgtttaacaacg

SEQ ID NO: 294829 - DNA, 25 bp, Rattus norvegicus
gaacgacgggctctttaagtctcca

SEQ ID NO: 294830 - DNA, 25 bp, Rattus norvegicus
gaacgacgggctgtttaagtctcca

SEQ ID NO: 294831 - DNA, 25 bp, Rattus norvegicus
gaacgactgtacctgtgtggcatca

SEQ ID NO: 294832 - DNA, 25 bp, Rattus norvegicus
gaacgactgtacgtgtgtggcatca

SEQ ID NO: 294833 - DNA, 25 bp, Rattus norvegicus
gaacgacttcaccaaatgagtacct

SEQ ID NO: 294834 - DNA, 25 bp, Rattus norvegicus
gaacgacttcacgaaatgagtacct

SEQ ID NO: 294835 - DNA, 25 bp, Rattus norvegicus
gaacgacttgctaggtcagtggcca

SEQ ID NO: 294836 - DNA, 25 bp, Rattus norvegicus
gaacgacttgcttggtcagtggcca

SEQ ID NO: 294837 - DNA, 25 bp, Rattus norvegicus
gaacgactttggattcagtgtctca

SEQ ID NO: 294838 - DNA, 25 bp, Rattus norvegicus
gaacgactttggtttcagtgtctca

SEQ ID NO: 294839 - DNA, 25 bp, Rattus norvegicus
gaacgactttgtcatgcctgtctgt

SEQ ID NO: 294840 - DNA, 25 bp, Rattus norvegicus
gaacgactttgtgatgcctgtctgt

SEQ ID NO: 294841 - DNA, 25 bp, Rattus norvegicus
gaacgagaatccacgagttgtaaga

SEQ ID NO: 294842 - DNA, 25 bp, Rattus norvegicus
gaacgagaatcctcgagttgtaaga

SEQ ID NO: 294843 - DNA, 25 bp, Rattus norvegicus
gaacgagactcacatgatgccctac

SEQ ID NO: 294844 - DNA, 25 bp, Rattus norvegicus
gaacgagactcagatgatgccctac

SEQ ID NO: 294845 - DNA, 25 bp, Rattus norvegicus
gaacgagaggctcaaggctagcttt

SEQ ID NO: 294846 - DNA, 25 bp, Rattus norvegicus
gaacgagaggctgaaggctagcttt

SEQ ID NO: 294847 - DNA, 25 bp, Rattus norvegicus
gaacgagatcctcaaatgcactaaa

SEQ ID NO: 294848 - DNA, 25 bp, Rattus norvegicus
gaacgagatcctgaaatgcactaaa

SEQ ID NO: 294849 - DNA, 25 bp, Rattus norvegicus
gaacgagatcttcagcacttccagc

SEQ ID NO: 294850 - DNA, 25 bp, Rattus norvegicus
gaacgagatcttgagcacttccagc

SEQ ID NO: 294851 - DNA, 25 bp, Rattus norvegicus
gaacgagatgtacaccttccccatc

SEQ ID NO: 294852 - DNA, 25 bp, Rattus norvegicus
gaacgagatgtagaccttccccatc

SEQ ID NO: 294853 - DNA, 25 bp, Rattus norvegicus
gaacgagcacaactcagtctgaggt

SEQ ID NO: 294854 - DNA, 25 bp, Rattus norvegicus
gaacgagcacaagtcagtctgaggt

SEQ ID NO: 294855 - DNA, 25 bp, Rattus norvegicus
gaacgagcagcaattgtggcctatg

SEQ ID NO: 294856 - DNA, 25 bp, Rattus norvegicus
gaacgagcagcatttgtggcctatg

SEQ ID NO: 294857 - DNA, 25 bp, Rattus norvegicus
gaacgagcggctcagcactaggcct

SEQ ID NO: 294858 - DNA, 25 bp, Rattus norvegicus
gaacgagcggctgagcactaggcct

SEQ ID NO: 294859 - DNA, 25 bp, Rattus norvegicus
gaacgagctagccaagcgcctggct

SEQ ID NO: 294860 - DNA, 25 bp, Rattus norvegicus
gaacgagctagcgaagcgcctggct

SEQ ID NO: 294861 - DNA, 25 bp, Rattus norvegicus
gaacgagctatgcttggccaccgag

SEQ ID NO: 294862 - DNA, 25 bp, Rattus norvegicus
gaacgagctatggttggccaccgag

SEQ ID NO: 294863 - DNA, 25 bp, Rattus norvegicus
gaacgagctcagaactccagagggc

SEQ ID NO: 294864 - DNA, 25 bp, Rattus norvegicus
gaacgagctcagtactccagagggc

SEQ ID NO: 294865 - DNA, 25 bp, Rattus norvegicus
gaacgagctcttatgtgctttggaa

SEQ ID NO: 294866 - DNA, 25 bp, Rattus norvegicus
gaacgagctcttttgtgctttggaa

SEQ ID NO: 294867 - DNA, 25 bp, Rattus norvegicus
gaacgagctggtacgggcagcacta

SEQ ID NO: 294868 - DNA, 25 bp, Rattus norvegicus
gaacgagctggttcgggcagcacta

SEQ ID NO: 294869 - DNA, 25 bp, Rattus norvegicus
gaacgaggattcaccagcaaggcct

SEQ ID NO: 294870 - DNA, 25 bp, Rattus norvegicus
gaacgaggattctccagcaaggcct

SEQ ID NO: 294871 - DNA, 25 bp, Rattus norvegicus
gaacgaggccatagcaagtattgcg

SEQ ID NO: 294872 - DNA, 25 bp, Rattus norvegicus
gaacgaggccattgcaagtattgcg

SEQ ID NO: 294873 - DNA, 25 bp, Rattus norvegicus
gaacgaggctgccagctgacactga

SEQ ID NO: 294874 - DNA, 25 bp, Rattus norvegicus
gaacgaggctgcgagctgacactga

SEQ ID NO: 294875 - DNA, 25 bp, Rattus norvegicus
gaacgagggcgacactttccaccag

SEQ ID NO: 294876 - DNA, 25 bp, Rattus norvegicus
gaacgagggcgagactttccaccag

SEQ ID NO: 294877 - DNA, 25 bp, Rattus norvegicus
gaacgagggctgactctctgagaga

SEQ ID NO: 294878 - DNA, 25 bp, Rattus norvegicus
gaacgagggctgtctctctgagaga

SEQ ID NO: 294879 - DNA, 25 bp, Rattus norvegicus
gaacgagtcaccaacgagtctgcag

SEQ ID NO: 294880 - DNA, 25 bp, Rattus norvegicus
gaacgagtcacctacgagtctgcag

SEQ ID NO: 294881 - DNA, 25 bp, Rattus norvegicus
gaacgagtcagccaggtgctctcct

SEQ ID NO: 294882 - DNA, 25 bp, Rattus norvegicus
gaacgagtcagcgaggtgctctcct

SEQ ID NO: 294883 - DNA, 25 bp, Rattus norvegicus
gaacgagtccgacatttcctttgga

SEQ ID NO: 294884 - DNA, 25 bp, Rattus norvegicus
gaacgagtccgagatttcctttgga

SEQ ID NO: 294885 - DNA, 25 bp, Rattus norvegicus
gaacgagtgcgtccagtatcagcat

SEQ ID NO: 294886 - DNA, 25 bp, Rattus norvegicus
gaacgagtgcgtgcagtatcagcat

SEQ ID NO: 294887 - DNA, 25 bp, Rattus norvegicus
gaacgagtgtcaaagacacatgccg

SEQ ID NO: 294888 - DNA, 25 bp, Rattus norvegicus
gaacgagtgtcatagacacatgccg

SEQ ID NO: 294889 - DNA, 25 bp, Rattus norvegicus
gaacgatcatctcctatctgggcta

SEQ ID NO: 294890 - DNA, 25 bp, Rattus norvegicus
gaacgatcatctgctatctgggcta

SEQ ID NO: 294891 - DNA, 25 bp, Rattus norvegicus
gaacgatcccttaccagttgtaagt

SEQ ID NO: 294892 - DNA, 25 bp, Rattus norvegicus
gaacgatccctttccagttgtaagt

SEQ ID NO: 294893 - DNA, 25 bp, Rattus norvegicus
gaacgatctgacactatttctcttt

SEQ ID NO: 294894 - DNA, 25 bp, Rattus norvegicus
gaacgatctgactctatttctcttt

SEQ ID NO: 294895 - DNA, 25 bp, Rattus norvegicus
gaacgatctgtcattaggtaaacac

SEQ ID NO: 294896 - DNA, 25 bp, Rattus norvegicus
gaacgatctgtctttaggtaaacac

SEQ ID NO: 294897 - DNA, 25 bp, Rattus norvegicus
gaacgatgacatacctaagttgcca

SEQ ID NO: 294898 - DNA, 25 bp, Rattus norvegicus
gaacgatgacattcctaagttgcca

SEQ ID NO: 294899 - DNA, 25 bp, Rattus norvegicus
gaacgatgaccgaatatgcattata

SEQ ID NO: 294900 - DNA, 25 bp, Rattus norvegicus
gaacgatgaccgtatatgcattata

SEQ ID NO: 294901 - DNA, 25 bp, Rattus norvegicus
gaacgatggctgaccctgagattta

SEQ ID NO: 294902 - DNA, 25 bp, Rattus norvegicus
gaacgatggctgtccctgagattta

SEQ ID NO: 294903 - DNA, 25 bp, Rattus norvegicus
gaacgattctgtcctcagtattaga

SEQ ID NO: 294904 - DNA, 25 bp, Rattus norvegicus
gaacgattctgtgctcagtattaga

SEQ ID NO: 294905 - DNA, 25 bp, Rattus norvegicus
gaacgatttcacctgttttagctga

SEQ ID NO: 294906 - DNA, 25 bp, Rattus norvegicus
gaacgatttcacgtgttttagctga

SEQ ID NO: 294907 - DNA, 25 bp, Rattus norvegicus
gaacgatttctaagctggattctga

SEQ ID NO: 294908 - DNA, 25 bp, Rattus norvegicus
gaacgatttctatgctggattctga

SEQ ID NO: 294909 - DNA, 25 bp, Rattus norvegicus
gaacgcaaacgaatctcaaggcaag

SEQ ID NO: 294910 - DNA, 25 bp, Rattus norvegicus
gaacgcaaacgattctcaaggcaag

SEQ ID NO: 294911 - DNA, 25 bp, Rattus norvegicus
gaacgcaaagacacctgtttttcca

SEQ ID NO: 294912 - DNA, 25 bp, Rattus norvegicus
gaacgcaaagactcctgtttttcca

SEQ ID NO: 294913 - DNA, 25 bp, Rattus norvegicus
gaacgcacaatacaatcatagcaat

SEQ ID NO: 294914 - DNA, 25 bp, Rattus norvegicus
gaacgcacaatagaatcatagcaat

SEQ ID NO: 294915 - DNA, 25 bp, Rattus norvegicus
gaacgcacacataatgtcaccgact

SEQ ID NO: 294916 - DNA, 25 bp, Rattus norvegicus
gaacgcacacattatgtcaccgact

SEQ ID NO: 294917 - DNA, 25 bp, Rattus norvegicus
gaacgcacacgtagagaccttatcc

SEQ ID NO: 294918 - DNA, 25 bp, Rattus norvegicus
gaacgcacacgttgagaccttatcc

SEQ ID NO: 294919 - DNA, 25 bp, Rattus norvegicus
gaacgcacagagcagatgaggacac

SEQ ID NO: 294920 - DNA, 25 bp, Rattus norvegicus
gaacgcacagaggagatgaggacac

SEQ ID NO: 294921 - DNA, 25 bp, Rattus norvegicus
gaacgcacagtaattgctgcagaac

SEQ ID NO: 294922 - DNA, 25 bp, Rattus norvegicus
gaacgcacagtatttgctgcagaac

SEQ ID NO: 294923 - DNA, 25 bp, Rattus norvegicus
gaacgcacatcgaccgtattctaag

SEQ ID NO: 294924 - DNA, 25 bp, Rattus norvegicus
gaacgcacatcgtccgtattctaag

SEQ ID NO: 294925 - DNA, 25 bp, Rattus norvegicus
gaacgcacatctatcaaaactgggt

SEQ ID NO: 294926 - DNA, 25 bp, Rattus norvegicus
gaacgcacatctttcaaaactgggt

SEQ ID NO: 294927 - DNA, 25 bp, Rattus norvegicus
gaacgcaccagtaagtgcctgcgat

SEQ ID NO: 294928 - DNA, 25 bp, Rattus norvegicus
gaacgcaccagttagtgcctgcgat

SEQ ID NO: 294929 - DNA, 25 bp, Rattus norvegicus
gaacgcacctgtctttgtactttgt

SEQ ID NO: 294930 - DNA, 25 bp, Rattus norvegicus
gaacgcacctgtgtttgtactttgt

SEQ ID NO: 294931 - DNA, 25 bp, Rattus norvegicus
gaacgcacgctgactttggtggaca

SEQ ID NO: 294932 - DNA, 25 bp, Rattus norvegicus
gaacgcacgctgtctttggtggaca

SEQ ID NO: 294933 - DNA, 25 bp, Rattus norvegicus
gaacgcactagaagcctttgagttt

SEQ ID NO: 294934 - DNA, 25 bp, Rattus norvegicus
gaacgcactagatgcctttgagttt

SEQ ID NO: 294935 - DNA, 25 bp, Rattus norvegicus
gaacgcacttgccttaaaacctgtt

SEQ ID NO: 294936 - DNA, 25 bp, Rattus norvegicus
gaacgcacttgcgttaaaacctgtt

SEQ ID NO: 294937 - DNA, 25 bp, Rattus norvegicus
gaacgcacttggcatcaactttgga

SEQ ID NO: 294938 - DNA, 25 bp, Rattus norvegicus
gaacgcacttgggatcaactttgga

SEQ ID NO: 294939 - DNA, 25 bp, Rattus norvegicus
gaacgcactttaatgaagtcggtca

SEQ ID NO: 294940 - DNA, 25 bp, Rattus norvegicus
gaacgcactttattgaagtcggtca

SEQ ID NO: 294941 - DNA, 25 bp, Rattus norvegicus
gaacgcagacggatacattgatgcc

SEQ ID NO: 294942 - DNA, 25 bp, Rattus norvegicus
gaacgcagacggttacattgatgcc

SEQ ID NO: 294943 - DNA, 25 bp, Rattus norvegicus
gaacgcagcccaatcaactgacgaa

SEQ ID NO: 294944 - DNA, 25 bp, Rattus norvegicus
gaacgcagcccattcaactgacgaa

SEQ ID NO: 294945 - DNA, 25 bp, Rattus norvegicus
gaacgcagctcgatttgcccactgg

SEQ ID NO: 294946 - DNA, 25 bp, Rattus norvegicus
gaacgcagctcgttttgcccactgg

SEQ ID NO: 294947 - DNA, 25 bp, Rattus norvegicus
gaacgcaggcacctatgacgccaag

SEQ ID NO: 294948 - DNA, 25 bp, Rattus norvegicus
gaacgcaggcacgtatgacgccaag

SEQ ID NO: 294949 - DNA, 25 bp, Rattus norvegicus
gaacgcaggcagactgtgcagtcac

SEQ ID NO: 294950 - DNA, 25 bp, Rattus norvegicus
gaacgcaggcagtctgtgcagtcac

SEQ ID NO: 294951 - DNA, 25 bp, Rattus norvegicus
gaacgcaggctaatatactcaaatc

SEQ ID NO: 294952 - DNA, 25 bp, Rattus norvegicus
gaacgcaggctattatactcaaatc

SEQ ID NO: 294953 - DNA, 25 bp, Rattus norvegicus
gaacgcagggcgattgcttgagcct

SEQ ID NO: 294954 - DNA, 25 bp, Rattus norvegicus
gaacgcagggcgtttgcttgagcct

SEQ ID NO: 294955 - DNA, 25 bp, Rattus norvegicus
gaacgcagtactaatctatacccaa

SEQ ID NO: 294956 - DNA, 25 bp, Rattus norvegicus
gaacgcagtacttatctatacccaa

SEQ ID NO: 294957 - DNA, 25 bp, Rattus norvegicus
gaacgcagtctgctttacacagtgt

SEQ ID NO: 294958 - DNA, 25 bp, Rattus norvegicus
gaacgcagtctggtttacacagtgt

SEQ ID NO: 294959 - DNA, 25 bp, Rattus norvegicus
gaacgcatcaccactatcatagcta

SEQ ID NO: 294960 - DNA, 25 bp, Rattus norvegicus
gaacgcatcacctctatcatagcta

SEQ ID NO: 294961 - DNA, 25 bp, Rattus norvegicus
gaacgcatcatcaaccatgctgcag

SEQ ID NO: 294962 - DNA, 25 bp, Rattus norvegicus
gaacgcatcatctaccatgctgcag

SEQ ID NO: 294963 - DNA, 25 bp, Rattus norvegicus
gaacgcatccacattcatggaaaca

SEQ ID NO: 294964 - DNA, 25 bp, Rattus norvegicus
gaacgcatccactttcatggaaaca

SEQ ID NO: 294965 - DNA, 25 bp, Rattus norvegicus
gaacgcatccgtatgccatgaagat

SEQ ID NO: 294966 - DNA, 25 bp, Rattus norvegicus
gaacgcatccgtttgccatgaagat

SEQ ID NO: 294967 - DNA, 25 bp, Rattus norvegicus
gaacgcatgccaaccccagttatta

SEQ ID NO: 294968 - DNA, 25 bp, Rattus norvegicus
gaacgcatgccatccccagttatta

SEQ ID NO: 294969 - DNA, 25 bp, Rattus norvegicus
gaacgcatgctgcagaaggcctttg

SEQ ID NO: 294970 - DNA, 25 bp, Rattus norvegicus
gaacgcatgctggagaaggcctttg

SEQ ID NO: 294971 - DNA, 25 bp, Rattus norvegicus
gaacgcatggttcattctgcagaga

SEQ ID NO: 294972 - DNA, 25 bp, Rattus norvegicus
gaacgcatggttctttgcctctgaa

SEQ ID NO: 294973 - DNA, 25 bp, Rattus norvegicus
gaacgcatggttgattctgcagaga

SEQ ID NO: 294974 - DNA, 25 bp, Rattus norvegicus
gaacgcatggttgtttgcctctgaa

SEQ ID NO: 294975 - DNA, 25 bp, Rattus norvegicus
gaacgccaagctcttttcacttgta

SEQ ID NO: 294976 - DNA, 25 bp, Rattus norvegicus
gaacgccaagctgttttcacttgta

SEQ ID NO: 294977 - DNA, 25 bp, Rattus norvegicus
gaacgccaaggaatagatgtgtatt

SEQ ID NO: 294978 - DNA, 25 bp, Rattus norvegicus
gaacgccaaggattagatgtgtatt

SEQ ID NO: 294979 - DNA, 25 bp, Rattus norvegicus
gaacgccacagcaacatctgtgaag

SEQ ID NO: 294980 - DNA, 25 bp, Rattus norvegicus
gaacgccacagctacatctgtgaag

SEQ ID NO: 294981 - DNA, 25 bp, Rattus norvegicus
gaacgccacaggcactttgaagcca

SEQ ID NO: 294982 - DNA, 25 bp, Rattus norvegicus
gaacgccacagggactttgaagcca

SEQ ID NO: 294983 - DNA, 25 bp, Rattus norvegicus
gaacgccacattctggattctagct

SEQ ID NO: 294984 - DNA, 25 bp, Rattus norvegicus
gaacgccacattgtggattctagct

SEQ ID NO: 294985 - DNA, 25 bp, Rattus norvegicus
gaacgccacgtccagaggcgttcgc

SEQ ID NO: 294986 - DNA, 25 bp, Rattus norvegicus
gaacgccacgtcgagaggcgttcgc

SEQ ID NO: 294987 - DNA, 25 bp, Rattus norvegicus
gaacgccagatcaagtgtccgaagt

SEQ ID NO: 294988 - DNA, 25 bp, Rattus norvegicus
gaacgccagatctagtgtccgaagt

SEQ ID NO: 294989 - DNA, 25 bp, Rattus norvegicus
gaacgccaggcgaggttattgtatt

SEQ ID NO: 294990 - DNA, 25 bp, Rattus norvegicus
gaacgccaggcgtggttattgtatt

SEQ ID NO: 294991 - DNA, 25 bp, Rattus norvegicus
gaacgccatccgagaagcgcagagt

SEQ ID NO: 294992 - DNA, 25 bp, Rattus norvegicus
gaacgccatccgtgaagcgcagagt

SEQ ID NO: 294993 - DNA, 25 bp, Rattus norvegicus
gaacgccatgatagcagcaggactc

SEQ ID NO: 294994 - DNA, 25 bp, Rattus norvegicus
gaacgccatgattgcagcaggactc

SEQ ID NO: 294995 - DNA, 25 bp, Rattus norvegicus
gaacgccatggcaaacaaagacaat

SEQ ID NO: 294996 - DNA, 25 bp, Rattus norvegicus
gaacgccatggctaacaaagacaat

SEQ ID NO: 294997 - DNA, 25 bp, Rattus norvegicus
gaacgccatgggaaaaggctccagg

SEQ ID NO: 294998 - DNA, 25 bp, Rattus norvegicus
gaacgccatgggtaaaggctccagg

SEQ ID NO: 294999 - DNA, 25 bp, Rattus norvegicus
gaacgccatgttcctaactggatct

SEQ ID NO: 295000 - DNA, 25 bp, Rattus norvegicus
gaacgccatgttgctaactggatct

SEQ ID NO: 295001 - DNA, 25 bp, Rattus norvegicus
gaacgcccacagcactttgaaagtg

SEQ ID NO: 295002 - DNA, 25 bp, Rattus norvegicus
gaacgcccacaggactttgaaagtg

SEQ ID NO: 295003 - DNA, 25 bp, Rattus norvegicus
gaacgcccagcactgtgactctgaa

SEQ ID NO: 295004 - DNA, 25 bp, Rattus norvegicus
gaacgcccagcagtgtgactctgaa

SEQ ID NO: 295005 - DNA, 25 bp, Rattus norvegicus
gaacgcccatgcacttggaggctgg

SEQ ID NO: 295006 - DNA, 25 bp, Rattus norvegicus
gaacgcccatgctcttggaggctgg

SEQ ID NO: 295007 - DNA, 25 bp, Rattus norvegicus
gaacgccgccaacaagagagaccaa

SEQ ID NO: 295008 - DNA, 25 bp, Rattus norvegicus
gaacgccgccaagaagagagaccaa

SEQ ID NO: 295009 - DNA, 25 bp, Rattus norvegicus
gaacgccgtttgcaaatgtgatttt

SEQ ID NO: 295010 - DNA, 25 bp, Rattus norvegicus
gaacgccgtttggaaatgtgatttt

SEQ ID NO: 295011 - DNA, 25 bp, Rattus norvegicus
gaacgcctacatatggaattatttt

SEQ ID NO: 295012 - DNA, 25 bp, Rattus norvegicus
gaacgcctacatttggaattatttt

SEQ ID NO: 295013 - DNA, 25 bp, Rattus norvegicus
gaacgcctagaccaggaactccgaa

SEQ ID NO: 295014 - DNA, 25 bp, Rattus norvegicus
gaacgcctagacgaggaactccgaa

SEQ ID NO: 295015 - DNA, 25 bp, Rattus norvegicus
gaacgcctcaggaacaggtactatg

SEQ ID NO: 295016 - DNA, 25 bp, Rattus norvegicus
gaacgcctcaggtacaggtactatg

SEQ ID NO: 295017 - DNA, 25 bp, Rattus norvegicus
gaacgcctctacatgtggagggtac

SEQ ID NO: 295018 - DNA, 25 bp, Rattus norvegicus
gaacgcctctacttgtggagggtac

SEQ ID NO: 295019 - DNA, 25 bp, Rattus norvegicus
gaacgcctgtcaccccagtcaaatt

SEQ ID NO: 295020 - DNA, 25 bp, Rattus norvegicus
gaacgcctgtcagcccagtcaaatt

SEQ ID NO: 295021 - DNA, 25 bp, Rattus norvegicus
gaacgcctgtttcagtgggctcaga

SEQ ID NO: 295022 - DNA, 25 bp, Rattus norvegicus
gaacgcctgtttgagtgggctcaga

SEQ ID NO: 295023 - DNA, 25 bp, Rattus norvegicus
gaacgccttaacctgttgactgttg

SEQ ID NO: 295024 - DNA, 25 bp, Rattus norvegicus
gaacgccttaacgtgttgactgttg

SEQ ID NO: 295025 - DNA, 25 bp, Rattus norvegicus
gaacgccttgtgaaacgcactcaaa

SEQ ID NO: 295026 - DNA, 25 bp, Rattus norvegicus
gaacgccttgtgtaacgcactcaaa

SEQ ID NO: 295027 - DNA, 25 bp, Rattus norvegicus
gaacgcgaacctcatcgaggtcaat

SEQ ID NO: 295028 - DNA, 25 bp, Rattus norvegicus
gaacgcgaacctgatcgaggtcaat

SEQ ID NO: 295029 - DNA, 25 bp, Rattus norvegicus
gaacgcgagacgacttccagaagag

SEQ ID NO: 295030 - DNA, 25 bp, Rattus norvegicus
gaacgcgagacgtcttccagaagag

SEQ ID NO: 295031 - DNA, 25 bp, Rattus norvegicus
gaacgcgatagacgcatctctggtg

SEQ ID NO: 295032 - DNA, 25 bp, Rattus norvegicus
gaacgcgatagaggcatctctggtg

SEQ ID NO: 295033 - DNA, 25 bp, Rattus norvegicus
gaacgcgcccagagccttacaaaag

SEQ ID NO: 295034 - DNA, 25 bp, Rattus norvegicus
gaacgcgcccagtgccttacaaaag

SEQ ID NO: 295035 - DNA, 25 bp, Rattus norvegicus
gaacgcggctcgaatggcaagccaa

SEQ ID NO: 295036 - DNA, 25 bp, Rattus norvegicus
gaacgcggctcgtatggcaagccaa

SEQ ID NO: 295037 - DNA, 25 bp, Rattus norvegicus
gaacgcgtctgaagtcatctttgaa

SEQ ID NO: 295038 - DNA, 25 bp, Rattus norvegicus
gaacgcgtctgatgtcatctttgaa

SEQ ID NO: 295039 - DNA, 25 bp, Rattus norvegicus
gaacgcgtctggatgaccggatcat

SEQ ID NO: 295040 - DNA, 25 bp, Rattus norvegicus
gaacgcgtctggttgaccggatcat

SEQ ID NO: 295041 - DNA, 25 bp, Rattus norvegicus
gaacgcgtgcagaccgatgcctttg

SEQ ID NO: 295042 - DNA, 25 bp, Rattus norvegicus
gaacgcgtgcagtccgatgcctttg

SEQ ID NO: 295043 - DNA, 25 bp, Rattus norvegicus
gaacgcgtggtacacgaacgcccag

SEQ ID NO: 295044 - DNA, 25 bp, Rattus norvegicus
gaacgcgtggtagacgaacgcccag

SEQ ID NO: 295045 - DNA, 25 bp, Rattus norvegicus
gaacgcgtttgaccttttgtgataa

SEQ ID NO: 295046 - DNA, 25 bp, Rattus norvegicus
gaacgcgtttgagcttttgtgataa

SEQ ID NO: 295047 - DNA, 25 bp, Rattus norvegicus
gaacgctaaattcaaaccacccatg

SEQ ID NO: 295048 - DNA, 25 bp, Rattus norvegicus
gaacgctaaattgaaaccacccatg

SEQ ID NO: 295049 - DNA, 25 bp, Rattus norvegicus
gaacgctagatcatcttgcttcagt

SEQ ID NO: 295050 - DNA, 25 bp, Rattus norvegicus
gaacgctagatcttcttgcttcagt

SEQ ID NO: 295051 - DNA, 25 bp, Rattus norvegicus
gaacgctagcccaggccttagggat

SEQ ID NO: 295052 - DNA, 25 bp, Rattus norvegicus
gaacgctagccctggccttagggat

SEQ ID NO: 295053 - DNA, 25 bp, Rattus norvegicus
gaacgctagcgaagggtttaaccta

SEQ ID NO: 295054 - DNA, 25 bp, Rattus norvegicus
gaacgctagcgatgggtttaaccta

SEQ ID NO: 295055 - DNA, 25 bp, Rattus norvegicus
gaacgctagtgcaaacatcacaggt

SEQ ID NO: 295056 - DNA, 25 bp, Rattus norvegicus
gaacgctagtgctaacatcacaggt

SEQ ID NO: 295057 - DNA, 25 bp, Rattus norvegicus
gaacgctcaagtcacatactattca

SEQ ID NO: 295058 - DNA, 25 bp, Rattus norvegicus
gaacgctcaagtgacatactattca

SEQ ID NO: 295059 - DNA, 25 bp, Rattus norvegicus
gaacgctcagaaaaagggcctggca

SEQ ID NO: 295060 - DNA, 25 bp, Rattus norvegicus
gaacgctcagaataagggcctggca

SEQ ID NO: 295061 - DNA, 25 bp, Rattus norvegicus
gaacgctcaggacagaagctcactt

SEQ ID NO: 295062 - DNA, 25 bp, Rattus norvegicus
gaacgctcaggagagaagctcactt

SEQ ID NO: 295063 - DNA, 25 bp, Rattus norvegicus
gaacgctccagaatgtgtggtaaat

SEQ ID NO: 295064 - DNA, 25 bp, Rattus norvegicus
gaacgctccagattgtgtggtaaat

SEQ ID NO: 295065 - DNA, 25 bp, Rattus norvegicus
gaacgctcccaaaaaatactgcatt

SEQ ID NO: 295066 - DNA, 25 bp, Rattus norvegicus
gaacgctcccaataaatactgcatt

SEQ ID NO: 295067 - DNA, 25 bp, Rattus norvegicus
gaacgctcctgtctgcgtggacagt

SEQ ID NO: 295068 - DNA, 25 bp, Rattus norvegicus
gaacgctcctgtgtgcgtggacagt

SEQ ID NO: 295069 - DNA, 25 bp, Rattus norvegicus
gaacgctgacataaagccactgaag

SEQ ID NO: 295070 - DNA, 25 bp, Rattus norvegicus
gaacgctgacattaagccactgaag

SEQ ID NO: 295071 - DNA, 25 bp, Rattus norvegicus
gaacgctgagccaaatgtctatagt

SEQ ID NO: 295072 - DNA, 25 bp, Rattus norvegicus
gaacgctgagcctaatgtctatagt

SEQ ID NO: 295073 - DNA, 25 bp, Rattus norvegicus
gaacgctgccggacgtataagggaa

SEQ ID NO: 295074 - DNA, 25 bp, Rattus norvegicus
gaacgctgccggtcgtataagggaa

SEQ ID NO: 295075 - DNA, 25 bp, Rattus norvegicus
gaacgctgcctgcagtgagcaccgt

SEQ ID NO: 295076 - DNA, 25 bp, Rattus norvegicus
gaacgctgcctggagtgagcaccgt

SEQ ID NO: 295077 - DNA, 25 bp, Rattus norvegicus
gaacgctgtactaccttgaacttac

SEQ ID NO: 295078 - DNA, 25 bp, Rattus norvegicus
gaacgctgtacttccttgaacttac

SEQ ID NO: 295079 - DNA, 25 bp, Rattus norvegicus
gaacgctgtgcgatcgtcagaacga

SEQ ID NO: 295080 - DNA, 25 bp, Rattus norvegicus
gaacgctgtgcgttcgtcagaacga

SEQ ID NO: 295081 - DNA, 25 bp, Rattus norvegicus
gaacgcttactgagctaactattgg

SEQ ID NO: 295082 - DNA, 25 bp, Rattus norvegicus
gaacgcttactgtgctaactattgg

SEQ ID NO: 295083 - DNA, 25 bp, Rattus norvegicus
gaacgcttcggaatgaaggctcaat

SEQ ID NO: 295084 - DNA, 25 bp, Rattus norvegicus
gaacgcttcggattgaaggctcaat

SEQ ID NO: 295085 - DNA, 25 bp, Rattus norvegicus
gaacgcttgagcactctgtgaacca

SEQ ID NO: 295086 - DNA, 25 bp, Rattus norvegicus
gaacgcttgagctctctgtgaacca

SEQ ID NO: 295087 - DNA, 25 bp, Rattus norvegicus
gaacgctttcccagtttctgtttat

SEQ ID NO: 295088 - DNA, 25 bp, Rattus norvegicus
gaacgctttccctgtttctgtttat

SEQ ID NO: 295089 - DNA, 25 bp, Rattus norvegicus
gaacgctttgtgctcaccaagctgc

SEQ ID NO: 295090 - DNA, 25 bp, Rattus norvegicus
gaacgctttgtggtcaccaagctgc

SEQ ID NO: 295091 - DNA, 25 bp, Rattus norvegicus
gaacgcttttcaaggctcaagccat

SEQ ID NO: 295092 - DNA, 25 bp, Rattus norvegicus
gaacgcttttcatggctcaagccat

SEQ ID NO: 295093 - DNA, 25 bp, Rattus norvegicus
gaacgcttttccaaacacattgggt

SEQ ID NO: 295094 - DNA, 25 bp, Rattus norvegicus
gaacgcttttcctaacacattgggt

SEQ ID NO: 295095 - DNA, 25 bp, Rattus norvegicus
gaacggaaaggacgctgtattgact

SEQ ID NO: 295096 - DNA, 25 bp, Rattus norvegicus
gaacggaaaggaggctgtattgact

SEQ ID NO: 295097 - DNA, 25 bp, Rattus norvegicus
gaacggaacacacgcggctctgcca

SEQ ID NO: 295098 - DNA, 25 bp, Rattus norvegicus
gaacggaacacaggcggctctgcca

SEQ ID NO: 295099 - DNA, 25 bp, Rattus norvegicus
gaacggaacctcctcacggactaag

SEQ ID NO: 295100 - DNA, 25 bp, Rattus norvegicus
gaacggaacctcgtcacggactaag

SEQ ID NO: 295101 - DNA, 25 bp, Rattus norvegicus
gaacggaattttacagtgccaaaca

SEQ ID NO: 295102 - DNA, 25 bp, Rattus norvegicus
gaacggaatttttcagtgccaaaca

SEQ ID NO: 295103 - DNA, 25 bp, Rattus norvegicus
gaacggacacctagttacgggtcat

SEQ ID NO: 295104 - DNA, 25 bp, Rattus norvegicus
gaacggacaccttgttacgggtcat

SEQ ID NO: 295105 - DNA, 25 bp, Rattus norvegicus
gaacggacattccagactcttgcct

SEQ ID NO: 295106 - DNA, 25 bp, Rattus norvegicus
gaacggacattcgagactcttgcct

SEQ ID NO: 295107 - DNA, 25 bp, Rattus norvegicus
gaacggacccagcaggttgtattta

SEQ ID NO: 295108 - DNA, 25 bp, Rattus norvegicus
gaacggacccaggaggttgtattta

SEQ ID NO: 295109 - DNA, 25 bp, Rattus norvegicus
gaacggacccctcaatgagtcacaa

SEQ ID NO: 295110 - DNA, 25 bp, Rattus norvegicus
gaacggacccctgaatgagtcacaa

SEQ ID NO: 295111 - DNA, 25 bp, Rattus norvegicus
gaacggaccgcgcagggcgctggct

SEQ ID NO: 295112 - DNA, 25 bp, Rattus norvegicus
gaacggaccgcggagggcgctggct

SEQ ID NO: 295113 - DNA, 25 bp, Rattus norvegicus
gaacggacgcctaaagagaactcta

SEQ ID NO: 295114 - DNA, 25 bp, Rattus norvegicus
gaacggacgccttaagagaactcta

SEQ ID NO: 295115 - DNA, 25 bp, Rattus norvegicus
gaacggacgctgagcatcaacgtgt

SEQ ID NO: 295116 - DNA, 25 bp, Rattus norvegicus
gaacggacgctgtgcatcaacgtgt

SEQ ID NO: 295117 - DNA, 25 bp, Rattus norvegicus
gaacggacgggtcgacactgtccaa

SEQ ID NO: 295118 - DNA, 25 bp, Rattus norvegicus
gaacggacgggtggacactgtccaa

SEQ ID NO: 295119 - DNA, 25 bp, Rattus norvegicus
gaacggactcatatgcaagattgct

SEQ ID NO: 295120 - DNA, 25 bp, Rattus norvegicus
gaacggactcatttgcaagattgct

SEQ ID NO: 295121 - DNA, 25 bp, Rattus norvegicus
gaacggagatcaaacctgcctagac

SEQ ID NO: 295122 - DNA, 25 bp, Rattus norvegicus
gaacggagatcatacctgcctagac

SEQ ID NO: 295123 - DNA, 25 bp, Rattus norvegicus
gaacggagatctaaacctgcagtag

SEQ ID NO: 295124 - DNA, 25 bp, Rattus norvegicus
gaacggagatcttaacctgcagtag

SEQ ID NO: 295125 - DNA, 25 bp, Rattus norvegicus
gaacggagctgcagcgcccggatct

SEQ ID NO: 295126 - DNA, 25 bp, Rattus norvegicus
gaacggagctgctgcgcccggatct

SEQ ID NO: 295127 - DNA, 25 bp, Rattus norvegicus
gaacggaggctccatacctaagtca

SEQ ID NO: 295128 - DNA, 25 bp, Rattus norvegicus
gaacggaggctcgatacctaagtca

SEQ ID NO: 295129 - DNA, 25 bp, Rattus norvegicus
gaacggaggtctaggcttttccctg

SEQ ID NO: 295130 - DNA, 25 bp, Rattus norvegicus
gaacggaggtcttggcttttccctg

SEQ ID NO: 295131 - DNA, 25 bp, Rattus norvegicus
gaacggatccaccagctgggttaca

SEQ ID NO: 295132 - DNA, 25 bp, Rattus norvegicus
gaacggatccacgagctgggttaca

SEQ ID NO: 295133 - DNA, 25 bp, Rattus norvegicus
gaacggatctaaccttccatcttgc

SEQ ID NO: 295134 - DNA, 25 bp, Rattus norvegicus
gaacggatctaagcttccatcttgc

SEQ ID NO: 295135 - DNA, 25 bp, Rattus norvegicus
gaacggatctacataccttggacac

SEQ ID NO: 295136 - DNA, 25 bp, Rattus norvegicus
gaacggatctacttaccttggacac

SEQ ID NO: 295137 - DNA, 25 bp, Rattus norvegicus
gaacggatgcatctcaaggaactga

SEQ ID NO: 295138 - DNA, 25 bp, Rattus norvegicus
gaacggatgcatgtcaaggaactga

SEQ ID NO: 295139 - DNA, 25 bp, Rattus norvegicus
gaacggatgcgcacagaggaaccaa

SEQ ID NO: 295140 - DNA, 25 bp, Rattus norvegicus
gaacggatgcgctcagaggaaccaa

SEQ ID NO: 295141 - DNA, 25 bp, Rattus norvegicus
gaacggattacaatcccgatgaaat

SEQ ID NO: 295142 - DNA, 25 bp, Rattus norvegicus
gaacggattacattcccgatgaaat

SEQ ID NO: 295143 - DNA, 25 bp, Rattus norvegicus
gaacggattatgaaggcccaggcac

SEQ ID NO: 295144 - DNA, 25 bp, Rattus norvegicus
gaacggattatgtaggcccaggcac

SEQ ID NO: 295145 - DNA, 25 bp, Rattus norvegicus
gaacggcagagaacttcacgctgtc

SEQ ID NO: 295146 - DNA, 25 bp, Rattus norvegicus
gaacggcagagatcttcacgctgtc

SEQ ID NO: 295147 - DNA, 25 bp, Rattus norvegicus
gaacggcatctgatcctctttgaga

SEQ ID NO: 295148 - DNA, 25 bp, Rattus norvegicus
gaacggcatctgttcctctttgaga

SEQ ID NO: 295149 - DNA, 25 bp, Rattus norvegicus
gaacggcatgcaacgtgtgtcccaa

SEQ ID NO: 295150 - DNA, 25 bp, Rattus norvegicus
gaacggcatgcaataaccccagaca

SEQ ID NO: 295151 - DNA, 25 bp, Rattus norvegicus
gaacggcatgcatcgtgtgtcccaa

SEQ ID NO: 295152 - DNA, 25 bp, Rattus norvegicus
gaacggcatgcattaaccccagaca

SEQ ID NO: 295153 - DNA, 25 bp, Rattus norvegicus
gaacggcatgtacatccgcatggct

SEQ ID NO: 295154 - DNA, 25 bp, Rattus norvegicus
gaacggcatgtagatccgcatggct

SEQ ID NO: 295155 - DNA, 25 bp, Rattus norvegicus
gaacggccaggtcagtcacaacagt

SEQ ID NO: 295156 - DNA, 25 bp, Rattus norvegicus
gaacggccaggtgagtcacaacagt

SEQ ID NO: 295157 - DNA, 25 bp, Rattus norvegicus
gaacggccatagaggctgactgaag

SEQ ID NO: 295158 - DNA, 25 bp, Rattus norvegicus
gaacggccatagtggctgactgaag

SEQ ID NO: 295159 - DNA, 25 bp, Rattus norvegicus
gaacggcccactctcttatggaaaa

SEQ ID NO: 295160 - DNA, 25 bp, Rattus norvegicus
gaacggcccactgtcttatggaaaa

SEQ ID NO: 295161 - DNA, 25 bp, Rattus norvegicus
gaacggcctgagaggctggtttcca

SEQ ID NO: 295162 - DNA, 25 bp, Rattus norvegicus
gaacggcctgagtggctggtttcca

SEQ ID NO: 295163 - DNA, 25 bp, Rattus norvegicus
gaacggcgacgcaagtaccactgaa

SEQ ID NO: 295164 - DNA, 25 bp, Rattus norvegicus
gaacggcgacgctagtaccactgaa

SEQ ID NO: 295165 - DNA, 25 bp, Rattus norvegicus
gaacggcgggataatttctgcaacc

SEQ ID NO: 295166 - DNA, 25 bp, Rattus norvegicus
gaacggcgggattatttctgcaacc

SEQ ID NO: 295167 - DNA, 25 bp, Rattus norvegicus
gaacggcgggctcgtgccgggccct

SEQ ID NO: 295168 - DNA, 25 bp, Rattus norvegicus
gaacggcgggctggtgccgggccct

SEQ ID NO: 295169 - DNA, 25 bp, Rattus norvegicus
gaacggcgtgcaatatcaacatcat

SEQ ID NO: 295170 - DNA, 25 bp, Rattus norvegicus
gaacggcgtgcattatcaacatcat

SEQ ID NO: 295171 - DNA, 25 bp, Rattus norvegicus
gaacggctacctacacagaggctcc

SEQ ID NO: 295172 - DNA, 25 bp, Rattus norvegicus
gaacggctaccttcacagaggctcc

SEQ ID NO: 295173 - DNA, 25 bp, Rattus norvegicus
gaacggctactgcagggcaacttgt

SEQ ID NO: 295174 - DNA, 25 bp, Rattus norvegicus
gaacggctactggagggcaacttgt

SEQ ID NO: 295175 - DNA, 25 bp, Rattus norvegicus
gaacggctcaataaaccagggcact

SEQ ID NO: 295176 - DNA, 25 bp, Rattus norvegicus
gaacggctcaattaaccagggcact

SEQ ID NO: 295177 - DNA, 25 bp, Rattus norvegicus
gaacggctgaacacgtgactgttga

SEQ ID NO: 295178 - DNA, 25 bp, Rattus norvegicus
gaacggctgaactcgtgactgttga

SEQ ID NO: 295179 - DNA, 25 bp, Rattus norvegicus
gaacggctgagcaacacggatgagt

SEQ ID NO: 295180 - DNA, 25 bp, Rattus norvegicus
gaacggctgagcacagtggtgtact

SEQ ID NO: 295181 - DNA, 25 bp, Rattus norvegicus
gaacggctgagctacacggatgagt

SEQ ID NO: 295182 - DNA, 25 bp, Rattus norvegicus
gaacggctgagctcagtggtgtact

SEQ ID NO: 295183 - DNA, 25 bp, Rattus norvegicus
gaacggctgatcaaggcactcggtg

SEQ ID NO: 295184 - DNA, 25 bp, Rattus norvegicus
gaacggctgatctaggcactcggtg

SEQ ID NO: 295185 - DNA, 25 bp, Rattus norvegicus
gaacggcttgatcgtgtctggtttt

SEQ ID NO: 295186 - DNA, 25 bp, Rattus norvegicus
gaacggcttgatggtgtctggtttt

SEQ ID NO: 295187 - DNA, 25 bp, Rattus norvegicus
gaacgggaaagcatatgtctcacaa

SEQ ID NO: 295188 - DNA, 25 bp, Rattus norvegicus
gaacgggaaagcttatgtctcacaa

SEQ ID NO: 295189 - DNA, 25 bp, Rattus norvegicus
gaacgggaatttcaggtcacatcct

SEQ ID NO: 295190 - DNA, 25 bp, Rattus norvegicus
gaacgggaatttgaggtcacatcct

SEQ ID NO: 295191 - DNA, 25 bp, Rattus norvegicus
gaacgggactagattcattttgtag

SEQ ID NO: 295192 - DNA, 25 bp, Rattus norvegicus
gaacgggactagtttcattttgtag

SEQ ID NO: 295193 - DNA, 25 bp, Rattus norvegicus
gaacgggactcgaaggaccatcctg

SEQ ID NO: 295194 - DNA, 25 bp, Rattus norvegicus
gaacgggactcgtaggaccatcctg

SEQ ID NO: 295195 - DNA, 25 bp, Rattus norvegicus
gaacgggagaacctgccgctcatcg

SEQ ID NO: 295196 - DNA, 25 bp, Rattus norvegicus
gaacgggagaacgtgccgctcatcg

SEQ ID NO: 295197 - DNA, 25 bp, Rattus norvegicus
gaacgggagtgtccgatttcgccct

SEQ ID NO: 295198 - DNA, 25 bp, Rattus norvegicus
gaacgggagtgtgcgatttcgccct

SEQ ID NO: 295199 - DNA, 25 bp, Rattus norvegicus
gaacgggatataaacctggccagct

SEQ ID NO: 295200 - DNA, 25 bp, Rattus norvegicus
gaacgggatatatacctggccagct

SEQ ID NO: 295201 - DNA, 25 bp, Rattus norvegicus
gaacgggattttactgacgcccatg

SEQ ID NO: 295202 - DNA, 25 bp, Rattus norvegicus
gaacgggatttttctgacgcccatg

SEQ ID NO: 295203 - DNA, 25 bp, Rattus norvegicus
gaacgggcagcgagtggcatcacca

SEQ ID NO: 295204 - DNA, 25 bp, Rattus norvegicus
gaacgggcagcgtgtggcatcacca

SEQ ID NO: 295205 - DNA, 25 bp, Rattus norvegicus
gaacgggcaggaatgtcccttgctg

SEQ ID NO: 295206 - DNA, 25 bp, Rattus norvegicus
gaacgggcaggattgtcccttgctg

SEQ ID NO: 295207 - DNA, 25 bp, Rattus norvegicus
gaacgggcaggcaagcagtgttaat

SEQ ID NO: 295208 - DNA, 25 bp, Rattus norvegicus
gaacgggcaggctagcagtgttaat

SEQ ID NO: 295209 - DNA, 25 bp, Rattus norvegicus
gaacgggcatttcacaaggcagacc

SEQ ID NO: 295210 - DNA, 25 bp, Rattus norvegicus
gaacgggcatttgacaaggcagacc

SEQ ID NO: 295211 - DNA, 25 bp, Rattus norvegicus
gaacgggctcagatagtagcacgat

SEQ ID NO: 295212 - DNA, 25 bp, Rattus norvegicus
gaacgggctcagttagtagcacgat

SEQ ID NO: 295213 - DNA, 25 bp, Rattus norvegicus
gaacgggtaccactggaactcctat

SEQ ID NO: 295214 - DNA, 25 bp, Rattus norvegicus
gaacgggtaccagtggaactcctat

SEQ ID NO: 295215 - DNA, 25 bp, Rattus norvegicus
gaacgggtccaacggagcccctctg

SEQ ID NO: 295216 - DNA, 25 bp, Rattus norvegicus
gaacgggtccaagggagcccctctg

SEQ ID NO: 295217 - DNA, 25 bp, Rattus norvegicus
gaacgggtcgtgctttttgaatatt

SEQ ID NO: 295218 - DNA, 25 bp, Rattus norvegicus
gaacgggtcgtggtttttgaatatt

SEQ ID NO: 295219 - DNA, 25 bp, Rattus norvegicus
gaacgggtgcagagtgatctatttt

SEQ ID NO: 295220 - DNA, 25 bp, Rattus norvegicus
gaacgggtgcagtgtgatctatttt

SEQ ID NO: 295221 - DNA, 25 bp, Rattus norvegicus
gaacgggttccccaagcagacagcc

SEQ ID NO: 295222 - DNA, 25 bp, Rattus norvegicus
gaacgggttcccgaagcagacagcc

SEQ ID NO: 295223 - DNA, 25 bp, Rattus norvegicus
gaacgggttgttaaggattgcttct

SEQ ID NO: 295224 - DNA, 25 bp, Rattus norvegicus
gaacgggttgtttaggattgcttct

SEQ ID NO: 295225 - DNA, 25 bp, Rattus norvegicus
gaacggtaccgccacctgatcgagg

SEQ ID NO: 295226 - DNA, 25 bp, Rattus norvegicus
gaacggtaccgcgacctgatcgagg

SEQ ID NO: 295227 - DNA, 25 bp, Rattus norvegicus
gaacggtacgcgaggccgaaactgt

SEQ ID NO: 295228 - DNA, 25 bp, Rattus norvegicus
gaacggtacgcgtggccgaaactgt

SEQ ID NO: 295229 - DNA, 16 bp, Rattus norvegicus
gaacggtagcatcttg

SEQ ID NO: 295230 - DNA, 25 bp, Rattus norvegicus
gaacggtcaaatctcaggatcacct

SEQ ID NO: 295231 - DNA, 25 bp, Rattus norvegicus
gaacggtcaaatgtcaggatcacct

SEQ ID NO: 295232 - DNA, 25 bp, Rattus norvegicus
gaacggtcacaaaagcatgcagatt

SEQ ID NO: 295233 - DNA, 25 bp, Rattus norvegicus
gaacggtcacaatagcatgcagatt

SEQ ID NO: 295234 - DNA, 25 bp, Rattus norvegicus
gaacggtgaactagccttggtaact

SEQ ID NO: 295235 - DNA, 25 bp, Rattus norvegicus
gaacggtgaacttgccttggtaact

SEQ ID NO: 295236 - DNA, 25 bp, Rattus norvegicus
gaacggtgcactcatgaaacccagt

SEQ ID NO: 295237 - DNA, 25 bp, Rattus norvegicus
gaacggtgcactgatgaaacccagt

SEQ ID NO: 295238 - DNA, 25 bp, Rattus norvegicus
gaacggtgcccaagtttgttttgct

SEQ ID NO: 295239 - DNA, 25 bp, Rattus norvegicus
gaacggtgcccatgtttgttttgct

SEQ ID NO: 295240 - DNA, 25 bp, Rattus norvegicus
gaacggtggaatatgaacattcaaa

SEQ ID NO: 295241 - DNA, 25 bp, Rattus norvegicus
gaacggtggaatttgaacattcaaa

SEQ ID NO: 295242 - DNA, 25 bp, Rattus norvegicus
gaacggtggttcactctgagggaca

SEQ ID NO: 295243 - DNA, 25 bp, Rattus norvegicus
gaacggtggttctctctgagggaca

SEQ ID NO: 295244 - DNA, 25 bp, Rattus norvegicus
gaacggtgtggaatcgaatcaactt

SEQ ID NO: 295245 - DNA, 25 bp, Rattus norvegicus
gaacggtgtggattcgaatcaactt

SEQ ID NO: 295246 - DNA, 25 bp, Rattus norvegicus
gaacggtgttccacagagctctttg

SEQ ID NO: 295247 - DNA, 25 bp, Rattus norvegicus
gaacggtgttcctcagagctctttg

SEQ ID NO: 295248 - DNA, 25 bp, Rattus norvegicus
gaacggttaaaacgatgctactgaa

SEQ ID NO: 295249 - DNA, 25 bp, Rattus norvegicus
gaacggttaaaaggatgctactgaa

SEQ ID NO: 295250 - DNA, 25 bp, Rattus norvegicus
gaacggttatgaaagcactcagcaa

SEQ ID NO: 295251 - DNA, 25 bp, Rattus norvegicus
gaacggttatgatagcactcagcaa

SEQ ID NO: 295252 - DNA, 25 bp, Rattus norvegicus
gaacggttcaatctgatttcatctg

SEQ ID NO: 295253 - DNA, 25 bp, Rattus norvegicus
gaacggttcaatgtgatttcatctg

SEQ ID NO: 295254 - DNA, 25 bp, Rattus norvegicus
gaacggttcagaatgtcccaatgtt

SEQ ID NO: 295255 - DNA, 25 bp, Rattus norvegicus
gaacggttcagattgtcccaatgtt

SEQ ID NO: 295256 - DNA, 25 bp, Rattus norvegicus
gaacggttcctgaagtggtcactta

SEQ ID NO: 295257 - DNA, 25 bp, Rattus norvegicus
gaacggttcctgtagtggtcactta

SEQ ID NO: 295258 - DNA, 25 bp, Rattus norvegicus
gaacggttctacaaacagtcctctg

SEQ ID NO: 295259 - DNA, 25 bp, Rattus norvegicus
gaacggttctactaacagtcctctg

SEQ ID NO: 295260 - DNA, 25 bp, Rattus norvegicus
gaacggttgcctatacagacatgac

SEQ ID NO: 295261 - DNA, 25 bp, Rattus norvegicus
gaacggttgcctttacagacatgac

SEQ ID NO: 295262 - DNA, 25 bp, Rattus norvegicus
gaacggtttcatagcctaaactgtt

SEQ ID NO: 295263 - DNA, 25 bp, Rattus norvegicus
gaacggtttcattgcctaaactgtt

SEQ ID NO: 295264 - DNA, 25 bp, Rattus norvegicus
gaacggtttctgagcccttgggcat

SEQ ID NO: 295265 - DNA, 25 bp, Rattus norvegicus
gaacggtttctgtgcccttgggcat

SEQ ID NO: 295266 - DNA, 25 bp, Rattus norvegicus
gaacggttttctcctcggatccagt

SEQ ID NO: 295267 - DNA, 25 bp, Rattus norvegicus
gaacggttttctgctcggatccagt

SEQ ID NO: 295268 - DNA, 25 bp, Rattus norvegicus
gaacgtaacaaaatggcggcagcga

SEQ ID NO: 295269 - DNA, 25 bp, Rattus norvegicus
gaacgtaacaaattggcggcagcga

SEQ ID NO: 295270 - DNA, 25 bp, Rattus norvegicus
gaacgtaacagtatttaatgtccat

SEQ ID NO: 295271 - DNA, 25 bp, Rattus norvegicus
gaacgtaacagtttttaatgtccat

SEQ ID NO: 295272 - DNA, 25 bp, Rattus norvegicus
gaacgtaatgttcgcacagccatga

SEQ ID NO: 295273 - DNA, 25 bp, Rattus norvegicus
gaacgtaatgttggcacagccatga

SEQ ID NO: 295274 - DNA, 25 bp, Rattus norvegicus
gaacgtaattaaccagcccctggga

SEQ ID NO: 295275 - DNA, 25 bp, Rattus norvegicus
gaacgtaattaagcagcccctggga

SEQ ID NO: 295276 - DNA, 25 bp, Rattus norvegicus
gaacgtaattctctccagtgctgca

SEQ ID NO: 295277 - DNA, 25 bp, Rattus norvegicus
gaacgtaattctgtccagtgctgca

SEQ ID NO: 295278 - DNA, 25 bp, Rattus norvegicus
gaacgtacattcaagataccccagg

SEQ ID NO: 295279 - DNA, 25 bp, Rattus norvegicus
gaacgtacattctagataccccagg

SEQ ID NO: 295280 - DNA, 25 bp, Rattus norvegicus
gaacgtactaaacctggccaacgga

SEQ ID NO: 295281 - DNA, 25 bp, Rattus norvegicus
gaacgtactaaagctggccaacgga

SEQ ID NO: 295282 - DNA, 25 bp, Rattus norvegicus
gaacgtagcctacccattgcgcgag

SEQ ID NO: 295283 - DNA, 25 bp, Rattus norvegicus
gaacgtagcctagccattgcgcgag

SEQ ID NO: 295284 - DNA, 25 bp, Rattus norvegicus
gaacgtagctgtatctgagcacaca

SEQ ID NO: 295285 - DNA, 25 bp, Rattus norvegicus
gaacgtagctgtttctgagcacaca

SEQ ID NO: 295286 - DNA, 25 bp, Rattus norvegicus
gaacgtagtaacacagctgggcact

SEQ ID NO: 295287 - DNA, 25 bp, Rattus norvegicus
gaacgtagtaactcagctgggcact

SEQ ID NO: 295288 - DNA, 25 bp, Rattus norvegicus
gaacgtagtaggaaccgtgcactgt

SEQ ID NO: 295289 - DNA, 25 bp, Rattus norvegicus
gaacgtagtaggtaccgtgcactgt

SEQ ID NO: 295290 - DNA, 25 bp, Rattus norvegicus
gaacgtagtcttatggaggtattag

SEQ ID NO: 295291 - DNA, 25 bp, Rattus norvegicus
gaacgtagtcttttggaggtattag

SEQ ID NO: 295292 - DNA, 25 bp, Rattus norvegicus
gaacgtagtgctcagaactggcgta

SEQ ID NO: 295293 - DNA, 25 bp, Rattus norvegicus
gaacgtagtgctgagaactggcgta

SEQ ID NO: 295294 - DNA, 25 bp, Rattus norvegicus
gaacgtatagttcagggcagtcctt

SEQ ID NO: 295295 - DNA, 25 bp, Rattus norvegicus
gaacgtatagttgagggcagtcctt

SEQ ID NO: 295296 - DNA, 25 bp, Rattus norvegicus
gaacgtatcactctggttaccgact

SEQ ID NO: 295297 - DNA, 25 bp, Rattus norvegicus
gaacgtatcactgtggttaccgact

SEQ ID NO: 295298 - DNA, 25 bp, Rattus norvegicus
gaacgtatctctctgtccatgaata

SEQ ID NO: 295299 - DNA, 25 bp, Rattus norvegicus
gaacgtatctctgtgtccatgaata

SEQ ID NO: 295300 - DNA, 25 bp, Rattus norvegicus
gaacgtattagactggcacggccct

SEQ ID NO: 295301 - DNA, 25 bp, Rattus norvegicus
gaacgtattagagtggcacggccct

SEQ ID NO: 295302 - DNA, 25 bp, Rattus norvegicus
gaacgtattgatagcccttaaatat

SEQ ID NO: 295303 - DNA, 25 bp, Rattus norvegicus
gaacgtattgattgcccttaaatat

SEQ ID NO: 295304 - DNA, 25 bp, Rattus norvegicus
gaacgtattggtcatctgtcaccag

SEQ ID NO: 295305 - DNA, 25 bp, Rattus norvegicus
gaacgtattggtgatctgtcaccag

SEQ ID NO: 295306 - DNA, 25 bp, Rattus norvegicus
gaacgtatttctactcaattggttt

SEQ ID NO: 295307 - DNA, 25 bp, Rattus norvegicus
gaacgtatttcttctcaattggttt

SEQ ID NO: 295308 - DNA, 25 bp, Rattus norvegicus
gaacgtcaagtccattgtacccatg

SEQ ID NO: 295309 - DNA, 25 bp, Rattus norvegicus
gaacgtcaagtcgattgtacccatg

SEQ ID NO: 295310 - DNA, 25 bp, Rattus norvegicus
gaacgtcactctacttatttttgct

SEQ ID NO: 295311 - DNA, 25 bp, Rattus norvegicus
gaacgtcactcttcttatttttgct

SEQ ID NO: 295312 - DNA, 25 bp, Rattus norvegicus
gaacgtcactgaaaatggcagctat

SEQ ID NO: 295313 - DNA, 25 bp, Rattus norvegicus
gaacgtcactgataatggcagctat

SEQ ID NO: 295314 - DNA, 25 bp, Rattus norvegicus
gaacgtcagcagaaccaggaggcac

SEQ ID NO: 295315 - DNA, 25 bp, Rattus norvegicus
gaacgtcagcagtaccaggaggcac

SEQ ID NO: 295316 - DNA, 25 bp, Rattus norvegicus
gaacgtcagcgaaggcaccgagtgt

SEQ ID NO: 295317 - DNA, 25 bp, Rattus norvegicus
gaacgtcagcgatggcaccgagtgt

SEQ ID NO: 295318 - DNA, 25 bp, Rattus norvegicus
gaacgtcagtaccaggcaacgtcct

SEQ ID NO: 295319 - DNA, 25 bp, Rattus norvegicus
gaacgtcagtacgaggcaacgtcct

SEQ ID NO: 295320 - DNA, 25 bp, Rattus norvegicus
gaacgtcatggtccattttcatggt

SEQ ID NO: 295321 - DNA, 25 bp, Rattus norvegicus
gaacgtcatggtgcattttcatggt

SEQ ID NO: 295322 - DNA, 25 bp, Rattus norvegicus
gaacgtccaaggcattgtacctcga

SEQ ID NO: 295323 - DNA, 25 bp, Rattus norvegicus
gaacgtccaagggattgtacctcga

SEQ ID NO: 295324 - DNA, 25 bp, Rattus norvegicus
gaacgtccacacctaggtgaggcct

SEQ ID NO: 295325 - DNA, 25 bp, Rattus norvegicus
gaacgtccacacgtaggtgaggcct

SEQ ID NO: 295326 - DNA, 25 bp, Rattus norvegicus
gaacgtccagacacagatcccagtt

SEQ ID NO: 295327 - DNA, 25 bp, Rattus norvegicus
gaacgtccagacacatcggttgtat

SEQ ID NO: 295328 - DNA, 25 bp, Rattus norvegicus
gaacgtccagactcagatcccagtt

SEQ ID NO: 295329 - DNA, 25 bp, Rattus norvegicus
gaacgtccagactcatcggttgtat

SEQ ID NO: 295330 - DNA, 25 bp, Rattus norvegicus
gaacgtccgggcacagcaggcagca

SEQ ID NO: 295331 - DNA, 25 bp, Rattus norvegicus
gaacgtccgggcactgtacatcaag

SEQ ID NO: 295332 - DNA, 25 bp, Rattus norvegicus
gaacgtccgggctcagcaggcagca

SEQ ID NO: 295333 - DNA, 25 bp, Rattus norvegicus
gaacgtccgggctctgtacatcaag

SEQ ID NO: 295334 - DNA, 25 bp, Rattus norvegicus
gaacgtcgacgtagccggaatgttt

SEQ ID NO: 295335 - DNA, 25 bp, Rattus norvegicus
gaacgtcgacgttgccggaatgttt

SEQ ID NO: 295336 - DNA, 25 bp, Rattus norvegicus
gaacgtcgtggtcaaacagcaaagg

SEQ ID NO: 295337 - DNA, 25 bp, Rattus norvegicus
gaacgtcgtggtgaaacagcaaagg

SEQ ID NO: 295338 - DNA, 25 bp, Rattus norvegicus
gaacgtctacacagatggttttgaa

SEQ ID NO: 295339 - DNA, 25 bp, Rattus norvegicus
gaacgtctacactgatggttttgaa

SEQ ID NO: 295340 - DNA, 25 bp, Rattus norvegicus
gaacgtctagacatttgattttaaa

SEQ ID NO: 295341 - DNA, 25 bp, Rattus norvegicus
gaacgtctagacttttgattttaaa

SEQ ID NO: 295342 - DNA, 25 bp, Rattus norvegicus
gaacgtctcttcaaaggcttcacat

SEQ ID NO: 295343 - DNA, 25 bp, Rattus norvegicus
gaacgtctcttctaaggcttcacat

SEQ ID NO: 295344 - DNA, 25 bp, Rattus norvegicus
gaacgtctgaatccgacacttcggt

SEQ ID NO: 295345 - DNA, 25 bp, Rattus norvegicus
gaacgtctgaatgcgacacttcggt

SEQ ID NO: 295346 - DNA, 25 bp, Rattus norvegicus
gaacgtctgcagaagcaacctctta

SEQ ID NO: 295347 - DNA, 25 bp, Rattus norvegicus
gaacgtctgcagtagcaacctctta

SEQ ID NO: 295348 - DNA, 25 bp, Rattus norvegicus
gaacgtctgcatatttagcaacctt

SEQ ID NO: 295349 - DNA, 25 bp, Rattus norvegicus
gaacgtctgcatttttagcaacctt

SEQ ID NO: 295350 - DNA, 25 bp, Rattus norvegicus
gaacgtctgcggctttgaacctgat

SEQ ID NO: 295351 - DNA, 25 bp, Rattus norvegicus
gaacgtctgcgggtttgaacctgat

SEQ ID NO: 295352 - DNA, 25 bp, Rattus norvegicus
gaacgtcttaatcccagaggtcact

SEQ ID NO: 295353 - DNA, 25 bp, Rattus norvegicus
gaacgtcttaatgccagaggtcact

SEQ ID NO: 295354 - DNA, 25 bp, Rattus norvegicus
gaacgtcttcgactggccgaacata

SEQ ID NO: 295355 - DNA, 25 bp, Rattus norvegicus
gaacgtcttcgagtggccgaacata

SEQ ID NO: 295356 - DNA, 25 bp, Rattus norvegicus
gaacgtcttgtcacacaggttgcac

SEQ ID NO: 295357 - DNA, 25 bp, Rattus norvegicus
gaacgtcttgtctcacaggttgcac

SEQ ID NO: 295358 - DNA, 25 bp, Rattus norvegicus
gaacgtgacctcagaagacagggct

SEQ ID NO: 295359 - DNA, 25 bp, Rattus norvegicus
gaacgtgacctctgaagacagggct

SEQ ID NO: 295360 - DNA, 25 bp, Rattus norvegicus
gaacgtgagaggagccggctaccac

SEQ ID NO: 295361 - DNA, 25 bp, Rattus norvegicus
gaacgtgagaggtgccggctaccac

SEQ ID NO: 295362 - DNA, 25 bp, Rattus norvegicus
gaacgtgagcgaaatcttccggtat

SEQ ID NO: 295363 - DNA, 25 bp, Rattus norvegicus
gaacgtgagcgatatcttccggtat

SEQ ID NO: 295364 - DNA, 25 bp, Rattus norvegicus
gaacgtgatcacctgcagcgacaaa

SEQ ID NO: 295365 - DNA, 25 bp, Rattus norvegicus
gaacgtgatcacgtgcagcgacaaa

SEQ ID NO: 295366 - DNA, 25 bp, Rattus norvegicus
gaacgtgattgtcgcttcctgacag

SEQ ID NO: 295367 - DNA, 25 bp, Rattus norvegicus
gaacgtgattgtggcttcctgacag

SEQ ID NO: 295368 - DNA, 25 bp, Rattus norvegicus
gaacgtgcacagacctaatgaaatg

SEQ ID NO: 295369 - DNA, 25 bp, Rattus norvegicus
gaacgtgcacagtcctaatgaaatg

SEQ ID NO: 295370 - DNA, 25 bp, Rattus norvegicus
gaacgtgcagacacaggctttaaac

SEQ ID NO: 295371 - DNA, 25 bp, Rattus norvegicus
gaacgtgcagactcaggctttaaac

SEQ ID NO: 295372 - DNA, 25 bp, Rattus norvegicus
gaacgtgcattcattgatcctttag

SEQ ID NO: 295373 - DNA, 25 bp, Rattus norvegicus
gaacgtgcattctttgatcctttag

SEQ ID NO: 295374 - DNA, 25 bp, Rattus norvegicus
gaacgtgccactagaataaagtcgg

SEQ ID NO: 295375 - DNA, 25 bp, Rattus norvegicus
gaacgtgccacttgaataaagtcgg

SEQ ID NO: 295376 - DNA, 25 bp, Rattus norvegicus
gaacgtgccttccagcgagctgcag

SEQ ID NO: 295377 - DNA, 25 bp, Rattus norvegicus
gaacgtgccttcgagcgagctgcag

SEQ ID NO: 295378 - DNA, 25 bp, Rattus norvegicus
gaacgtgcctttcagaagtcccact

SEQ ID NO: 295379 - DNA, 25 bp, Rattus norvegicus
gaacgtgcctttgagaagtcccact

SEQ ID NO: 295380 - DNA, 25 bp, Rattus norvegicus
gaacgtgcgcttcagcaccatcgtg

SEQ ID NO: 295381 - DNA, 25 bp, Rattus norvegicus
gaacgtgcgcttgagcaccatcgtg

SEQ ID NO: 295382 - DNA, 25 bp, Rattus norvegicus
gaacgtgctcctctgtccacagtgt

SEQ ID NO: 295383 - DNA, 25 bp, Rattus norvegicus
gaacgtgctcctgtgtccacagtgt

SEQ ID NO: 295384 - DNA, 25 bp, Rattus norvegicus
gaacgtgctcgcactgtggtgcaaa

SEQ ID NO: 295385 - DNA, 25 bp, Rattus norvegicus
gaacgtgctcgctctgtggtgcaaa

SEQ ID NO: 295386 - DNA, 25 bp, Rattus norvegicus
gaacgtgctgagattgaaccaagaa

SEQ ID NO: 295387 - DNA, 25 bp, Rattus norvegicus
gaacgtgctgagtttgaaccaagaa

SEQ ID NO: 295388 - DNA, 25 bp, Rattus norvegicus
gaacgtgcttctatgtaatgaccga

SEQ ID NO: 295389 - DNA, 25 bp, Rattus norvegicus
gaacgtgcttctttgtaatgaccga

SEQ ID NO: 295390 - DNA, 25 bp, Rattus norvegicus
gaacgtgcttttactaccacttgaa

SEQ ID NO: 295391 - DNA, 25 bp, Rattus norvegicus
gaacgtgctttttctaccacttgaa

SEQ ID NO: 295392 - DNA, 25 bp, Rattus norvegicus
gaacgtggcagaatactcagtgtat

SEQ ID NO: 295393 - DNA, 25 bp, Rattus norvegicus
gaacgtggcagattactcagtgtat

SEQ ID NO: 295394 - DNA, 25 bp, Rattus norvegicus
gaacgtgggcgtatagctgcttctc

SEQ ID NO: 295395 - DNA, 25 bp, Rattus norvegicus
gaacgtgggcgtttagctgcttctc

SEQ ID NO: 295396 - DNA, 25 bp, Rattus norvegicus
gaacgtgggcttccatcagacactg

SEQ ID NO: 295397 - DNA, 25 bp, Rattus norvegicus
gaacgtgggcttgcatcagacactg

SEQ ID NO: 295398 - DNA, 25 bp, Rattus norvegicus
gaacgtgtaagcagcttccttcatg

SEQ ID NO: 295399 - DNA, 25 bp, Rattus norvegicus
gaacgtgtaagctgcttccttcatg

SEQ ID NO: 295400 - DNA, 25 bp, Rattus norvegicus
gaacgtgtacacacagacacatatg

SEQ ID NO: 295401 - DNA, 25 bp, Rattus norvegicus
gaacgtgtacactcagacacatatg

SEQ ID NO: 295402 - DNA, 25 bp, Rattus norvegicus
gaacgtgtacatccctggcagcaat

SEQ ID NO: 295403 - DNA, 25 bp, Rattus norvegicus
gaacgtgtacatgcctggcagcaat

SEQ ID NO: 295404 - DNA, 25 bp, Rattus norvegicus
gaacgtgtactgcacctcttgaacg

SEQ ID NO: 295405 - DNA, 25 bp, Rattus norvegicus
gaacgtgtactggacctcttgaacg

SEQ ID NO: 295406 - DNA, 25 bp, Rattus norvegicus
gaacgtgtcgggatgacacacgtgt

SEQ ID NO: 295407 - DNA, 25 bp, Rattus norvegicus
gaacgtgtcgggttgacacacgtgt

SEQ ID NO: 295408 - DNA, 25 bp, Rattus norvegicus
gaacgtgtctgccagtgtacacaga

SEQ ID NO: 295409 - DNA, 25 bp, Rattus norvegicus
gaacgtgtctgcgagtgtacacaga

SEQ ID NO: 295410 - DNA, 25 bp, Rattus norvegicus
gaacgtgtgattctgcttaactgaa

SEQ ID NO: 295411 - DNA, 25 bp, Rattus norvegicus
gaacgtgtgattgtgcttaactgaa

SEQ ID NO: 295412 - DNA, 25 bp, Rattus norvegicus
gaacgtgtgctgacattgacactga

SEQ ID NO: 295413 - DNA, 25 bp, Rattus norvegicus
gaacgtgtgctgtcattgacactga

SEQ ID NO: 295414 - DNA, 25 bp, Rattus norvegicus
gaacgtgtggatctccttgtcttgc

SEQ ID NO: 295415 - DNA, 25 bp, Rattus norvegicus
gaacgtgtggatgtccttgtcttgc

SEQ ID NO: 295416 - DNA, 25 bp, Rattus norvegicus
gaacgtgttgcccaaaggacataaa

SEQ ID NO: 295417 - DNA, 25 bp, Rattus norvegicus
gaacgtgttgccgaaaggacataaa

SEQ ID NO: 295418 - DNA, 25 bp, Rattus norvegicus
gaacgtgtttccaaagcctaaattg

SEQ ID NO: 295419 - DNA, 25 bp, Rattus norvegicus
gaacgtgtttcctaagcctaaattg

SEQ ID NO: 295420 - DNA, 25 bp, Rattus norvegicus
gaacgttaacacagtagttgctaga

SEQ ID NO: 295421 - DNA, 25 bp, Rattus norvegicus
gaacgttaacactgtagttgctaga

SEQ ID NO: 295422 - DNA, 25 bp, Rattus norvegicus
gaacgttaatgccagagctcggaat

SEQ ID NO: 295423 - DNA, 25 bp, Rattus norvegicus
gaacgttaatgcgagagctcggaat

SEQ ID NO: 295424 - DNA, 25 bp, Rattus norvegicus
gaacgttacaatagtggcagcaaca

SEQ ID NO: 295425 - DNA, 25 bp, Rattus norvegicus
gaacgttacaattgtggcagcaaca

SEQ ID NO: 295426 - DNA, 25 bp, Rattus norvegicus
gaacgttaggcaacagatcactgta

SEQ ID NO: 295427 - DNA, 25 bp, Rattus norvegicus
gaacgttaggcatcagatcactgta

SEQ ID NO: 295428 - DNA, 25 bp, Rattus norvegicus
gaacgttagttaatgctgatcacca

SEQ ID NO: 295429 - DNA, 25 bp, Rattus norvegicus
gaacgttagttattgctgatcacca

SEQ ID NO: 295430 - DNA, 25 bp, Rattus norvegicus
gaacgttagttgcttctgtctttgc

SEQ ID NO: 295431 - DNA, 25 bp, Rattus norvegicus
gaacgttagttggttctgtctttgc

SEQ ID NO: 295432 - DNA, 25 bp, Rattus norvegicus
gaacgttcaggcaccctggacatga

SEQ ID NO: 295433 - DNA, 25 bp, Rattus norvegicus
gaacgttcaggctccctggacatga

SEQ ID NO: 295434 - DNA, 25 bp, Rattus norvegicus
gaacgttccagcatactgcaatgaa

SEQ ID NO: 295435 - DNA, 25 bp, Rattus norvegicus
gaacgttccagcttactgcaatgaa

SEQ ID NO: 295436 - DNA, 25 bp, Rattus norvegicus
gaacgttcccgtatggtagatctca

SEQ ID NO: 295437 - DNA, 25 bp, Rattus norvegicus
gaacgttcccgtttggtagatctca

SEQ ID NO: 295438 - DNA, 25 bp, Rattus norvegicus
gaacgttccctccaaatctgtcttg

SEQ ID NO: 295439 - DNA, 25 bp, Rattus norvegicus
gaacgttccctcgaaatctgtcttg

SEQ ID NO: 295440 - DNA, 25 bp, Rattus norvegicus
gaacgttctctgaagtgtgtatcca

SEQ ID NO: 295441 - DNA, 25 bp, Rattus norvegicus
gaacgttctctgtagtgtgtatcca

SEQ ID NO: 295442 - DNA, 25 bp, Rattus norvegicus
gaacgttctgtcaggttgctgggaa

SEQ ID NO: 295443 - DNA, 25 bp, Rattus norvegicus
gaacgttctgtctggttgctgggaa

SEQ ID NO: 295444 - DNA, 25 bp, Rattus norvegicus
gaacgttcttggagcctgtgatgga

SEQ ID NO: 295445 - DNA, 25 bp, Rattus norvegicus
gaacgttcttggtgcctgtgatgga

SEQ ID NO: 295446 - DNA, 25 bp, Rattus norvegicus
gaacgttctttactgtgctctactc

SEQ ID NO: 295447 - DNA, 25 bp, Rattus norvegicus
gaacgttctttagtgtgctctactc

SEQ ID NO: 295448 - DNA, 25 bp, Rattus norvegicus
gaacgttgcctgcagaaaccgtgat

SEQ ID NO: 295449 - DNA, 25 bp, Rattus norvegicus
gaacgttgcctggagaaaccgtgat

SEQ ID NO: 295450 - DNA, 25 bp, Rattus norvegicus
gaacgttggtaaccgtgaccttcag

SEQ ID NO: 295451 - DNA, 25 bp, Rattus norvegicus
gaacgttggtaagcgtgaccttcag

SEQ ID NO: 295452 - DNA, 25 bp, Rattus norvegicus
gaacgttgtcatatttaactcctat

SEQ ID NO: 295453 - DNA, 25 bp, Rattus norvegicus
gaacgttgtcatttttaactcctat

SEQ ID NO: 295454 - DNA, 25 bp, Rattus norvegicus
gaacgttgtcttcccaataagtgtt

SEQ ID NO: 295455 - DNA, 25 bp, Rattus norvegicus
gaacgttgtcttgccaataagtgtt

SEQ ID NO: 295456 - DNA, 25 bp, Rattus norvegicus
gaacgttgttaccactacagcatga

SEQ ID NO: 295457 - DNA, 25 bp, Rattus norvegicus
gaacgttgttacgactacagcatga

SEQ ID NO: 295458 - DNA, 25 bp, Rattus norvegicus
gaacgtttatcacttcctcagaagc

SEQ ID NO: 295459 - DNA, 25 bp, Rattus norvegicus
gaacgtttatcagttcctcagaagc

SEQ ID NO: 295460 - DNA, 25 bp, Rattus norvegicus
gaacgtttcgtgagactgcgtacca

SEQ ID NO: 295461 - DNA, 25 bp, Rattus norvegicus
gaacgtttcgtgtgactgcgtacca

SEQ ID NO: 295462 - DNA, 25 bp, Rattus norvegicus
gaacgtttgcagcttgagtcacagg

SEQ ID NO: 295463 - DNA, 25 bp, Rattus norvegicus
gaacgtttgcaggttgagtcacagg

SEQ ID NO: 295464 - DNA, 25 bp, Rattus norvegicus
gaacgtttgcatcttcctggtttct

SEQ ID NO: 295465 - DNA, 25 bp, Rattus norvegicus
gaacgtttgcatgttcctggtttct

SEQ ID NO: 295466 - DNA, 25 bp, Rattus norvegicus
gaacgtttgttcagtctaacatact

SEQ ID NO: 295467 - DNA, 25 bp, Rattus norvegicus
gaacgtttgttctgtctaacatact

SEQ ID NO: 295468 - DNA, 25 bp, Rattus norvegicus
gaacgttttatcacagctgctggga

SEQ ID NO: 295469 - DNA, 25 bp, Rattus norvegicus
gaacgttttatctcagctgctggga

SEQ ID NO: 295470 - DNA, 25 bp, Rattus norvegicus
gaacgttttcttcttgacacttttg

SEQ ID NO: 295471 - DNA, 25 bp, Rattus norvegicus
gaacgttttcttgttgacacttttg

SEQ ID NO: 295472 - DNA, 25 bp, Rattus norvegicus
gaacgttttggccaagctgctacaa

SEQ ID NO: 295473 - DNA, 25 bp, Rattus norvegicus
gaacgttttggcgaagctgctacaa

SEQ ID NO: 295474 - DNA, 25 bp, Rattus norvegicus
gaacgtttttccacacgaggtctga

SEQ ID NO: 295475 - DNA, 25 bp, Rattus norvegicus
gaacgtttttcctcacgaggtctga

SEQ ID NO: 295476 - DNA, 25 bp, Rattus norvegicus
gaactaaagatgacgccgcacgcct

SEQ ID NO: 295477 - DNA, 25 bp, Rattus norvegicus
gaactaaagatgtcgccgcacgcct

SEQ ID NO: 295478 - DNA, 25 bp, Rattus norvegicus
gaactaaagcttcaaggccgtttga

SEQ ID NO: 295479 - DNA, 25 bp, Rattus norvegicus
gaactaaagcttgaaggccgtttga

SEQ ID NO: 295480 - DNA, 25 bp, Rattus norvegicus
gaactaaatactaagaccctgtctt

SEQ ID NO: 295481 - DNA, 25 bp, Rattus norvegicus
gaactaaatacttagaccctgtctt

SEQ ID NO: 295482 - DNA, 25 bp, Rattus norvegicus
gaactaaatgaaaaaccctaataat

SEQ ID NO: 295483 - DNA, 25 bp, Rattus norvegicus
gaactaaatgaataaccctaataat

SEQ ID NO: 295484 - DNA, 25 bp, Rattus norvegicus
gaactaaatgctcccttcatggaat

SEQ ID NO: 295485 - DNA, 25 bp, Rattus norvegicus
gaactaaatgctgccttcatggaat

SEQ ID NO: 295486 - DNA, 25 bp, Rattus norvegicus
gaactaacagccagttgtgagccac

SEQ ID NO: 295487 - DNA, 25 bp, Rattus norvegicus
gaactaacagcctgttgtgagccac

SEQ ID NO: 295488 - DNA, 25 bp, Rattus norvegicus
gaactaacatctccttacctttgta

SEQ ID NO: 295489 - DNA, 25 bp, Rattus norvegicus
gaactaacatctgcttacctttgta

SEQ ID NO: 295490 - DNA, 25 bp, Rattus norvegicus
gaactaacattcagccatttggaac

SEQ ID NO: 295491 - DNA, 25 bp, Rattus norvegicus
gaactaacattctgccatttggaac

SEQ ID NO: 295492 - DNA, 25 bp, Rattus norvegicus
gaactaaccccgaccatactggaag

SEQ ID NO: 295493 - DNA, 25 bp, Rattus norvegicus
gaactaaccccgtccatactggaag

SEQ ID NO: 295494 - DNA, 25 bp, Rattus norvegicus
gaactaaccttcagccagggtctaa

SEQ ID NO: 295495 - DNA, 25 bp, Rattus norvegicus
gaactaaccttctgccagggtctaa

SEQ ID NO: 295496 - DNA, 25 bp, Rattus norvegicus
gaactaacctttcctatggctaaat

SEQ ID NO: 295497 - DNA, 25 bp, Rattus norvegicus
gaactaacctttgctatggctaaat

SEQ ID NO: 295498 - DNA, 25 bp, Rattus norvegicus
gaactaactccaacttagatgcccc

SEQ ID NO: 295499 - DNA, 25 bp, Rattus norvegicus
gaactaactccatcttagatgcccc

SEQ ID NO: 295500 - DNA, 25 bp, Rattus norvegicus
gaactaactcgtcactttactctta

SEQ ID NO: 295501 - DNA, 25 bp, Rattus norvegicus
gaactaactcgtgactttactctta

SEQ ID NO: 295502 - DNA, 25 bp, Rattus norvegicus
gaactaagacaccttgtcctgcttc

SEQ ID NO: 295503 - DNA, 25 bp, Rattus norvegicus
gaactaagacacgttgtcctgcttc

SEQ ID NO: 295504 - DNA, 25 bp, Rattus norvegicus
gaactaagattaccataatgtcctt

SEQ ID NO: 295505 - DNA, 25 bp, Rattus norvegicus
gaactaagattagcataatgtcctt

SEQ ID NO: 295506 - DNA, 25 bp, Rattus norvegicus
gaactaagccataaactaactccaa

SEQ ID NO: 295507 - DNA, 25 bp, Rattus norvegicus
gaactaagccattaactaactccaa

SEQ ID NO: 295508 - DNA, 25 bp, Rattus norvegicus
gaactaagctctcggtggagccacc

SEQ ID NO: 295509 - DNA, 25 bp, Rattus norvegicus
gaactaagctctgggtggagccacc

SEQ ID NO: 295510 - DNA, 25 bp, Rattus norvegicus
gaactaagggacaccacagttgcca

SEQ ID NO: 295511 - DNA, 25 bp, Rattus norvegicus
gaactaagggactccacagttgcca

SEQ ID NO: 295512 - DNA, 25 bp, Rattus norvegicus
gaactaagtgagactccctgtcgta

SEQ ID NO: 295513 - DNA, 25 bp, Rattus norvegicus
gaactaagtgagtctccctgtcgta

SEQ ID NO: 295514 - DNA, 25 bp, Rattus norvegicus
gaactaataatcactcccaaggctt

SEQ ID NO: 295515 - DNA, 25 bp, Rattus norvegicus
gaactaataatctctcccaaggctt

SEQ ID NO: 295516 - DNA, 25 bp, Rattus norvegicus
gaactaatctcaactcaaggggcca

SEQ ID NO: 295517 - DNA, 25 bp, Rattus norvegicus
gaactaatctcatctcaaggggcca

SEQ ID NO: 295518 - DNA, 25 bp, Rattus norvegicus
gaactaatgcccaaacatccaagca

SEQ ID NO: 295519 - DNA, 25 bp, Rattus norvegicus
gaactaatgccctaacatccaagca

SEQ ID NO: 295520 - DNA, 25 bp, Rattus norvegicus
gaactaatgctcactagtctgcaga

SEQ ID NO: 295521 - DNA, 25 bp, Rattus norvegicus
gaactaatgctctctagtctgcaga

SEQ ID NO: 295522 - DNA, 25 bp, Rattus norvegicus
gaactaatgtgactctggctaccac

SEQ ID NO: 295523 - DNA, 25 bp, Rattus norvegicus
gaactaatgtgagtctggctaccac

SEQ ID NO: 295524 - DNA, 25 bp, Rattus norvegicus
gaactaattcaccagcagtctctgc

SEQ ID NO: 295525 - DNA, 25 bp, Rattus norvegicus
gaactaattcacgagcagtctctgc

SEQ ID NO: 295526 - DNA, 25 bp, Rattus norvegicus
gaactaattgtgatgcctttgcatt

SEQ ID NO: 295527 - DNA, 25 bp, Rattus norvegicus
gaactaattgtgttgcctttgcatt

SEQ ID NO: 295528 - DNA, 25 bp, Rattus norvegicus
gaactaatttgccttcagcccttct

SEQ ID NO: 295529 - DNA, 25 bp, Rattus norvegicus
gaactaatttgcgttcagcccttct

SEQ ID NO: 295530 - DNA, 25 bp, Rattus norvegicus
gaactaatttttccatttgcatatt

SEQ ID NO: 295531 - DNA, 25 bp, Rattus norvegicus
gaactaatttttgcatttgcatatt

SEQ ID NO: 295532 - DNA, 25 bp, Rattus norvegicus
gaactacaaccacgtgggctagcat

SEQ ID NO: 295533 - DNA, 25 bp, Rattus norvegicus
gaactacaaccaggtgggctagcat

SEQ ID NO: 295534 - DNA, 25 bp, Rattus norvegicus
gaactacaatttagccatcctctag

SEQ ID NO: 295535 - DNA, 25 bp, Rattus norvegicus
gaactacaattttgccatcctctag

SEQ ID NO: 295536 - DNA, 25 bp, Rattus norvegicus
gaactacacacccagactttgtctc

SEQ ID NO: 295537 - DNA, 25 bp, Rattus norvegicus
gaactacacaccgagactttgtctc

SEQ ID NO: 295538 - DNA, 25 bp, Rattus norvegicus
gaactacacactcttggtctagcct

SEQ ID NO: 295539 - DNA, 25 bp, Rattus norvegicus
gaactacacactgttggtctagcct

SEQ ID NO: 295540 - DNA, 25 bp, Rattus norvegicus
gaactacaccaactggtacccagga

SEQ ID NO: 295541 - DNA, 25 bp, Rattus norvegicus
gaactacaccaagtggtacccagga

SEQ ID NO: 295542 - DNA, 25 bp, Rattus norvegicus
gaactacactgtaccatctgtcaca

SEQ ID NO: 295543 - DNA, 25 bp, Rattus norvegicus
gaactacactgttccatctgtcaca

SEQ ID NO: 295544 - DNA, 25 bp, Rattus norvegicus
gaactacacttaatttgttggtccg

SEQ ID NO: 295545 - DNA, 25 bp, Rattus norvegicus
gaactacacttaccgagggccgaag

SEQ ID NO: 295546 - DNA, 25 bp, Rattus norvegicus
gaactacacttagcgagggccgaag

SEQ ID NO: 295547 - DNA, 25 bp, Rattus norvegicus
gaactacacttattttgttggtccg

SEQ ID NO: 295548 - DNA, 25 bp, Rattus norvegicus
gaactacagcctactgttttccttt

SEQ ID NO: 295549 - DNA, 25 bp, Rattus norvegicus
gaactacagccttctgttttccttt

SEQ ID NO: 295550 - DNA, 25 bp, Rattus norvegicus
gaactacagcttaccttttcctctt

SEQ ID NO: 295551 - DNA, 25 bp, Rattus norvegicus
gaactacagctttccttttcctctt

SEQ ID NO: 295552 - DNA, 25 bp, Rattus norvegicus
gaactacaggacatacttgtttctt

SEQ ID NO: 295553 - DNA, 25 bp, Rattus norvegicus
gaactacaggacttacttgtttctt

SEQ ID NO: 295554 - DNA, 25 bp, Rattus norvegicus
gaactacagggcaacttgcagaaga

SEQ ID NO: 295555 - DNA, 25 bp, Rattus norvegicus
gaactacagggctacttgcagaaga

SEQ ID NO: 295556 - DNA, 25 bp, Rattus norvegicus
gaactacattctctccataagtgct

SEQ ID NO: 295557 - DNA, 25 bp, Rattus norvegicus
gaactacattctgtccataagtgct

SEQ ID NO: 295558 - DNA, 25 bp, Rattus norvegicus
gaactaccactacgcttaggccaaa

SEQ ID NO: 295559 - DNA, 25 bp, Rattus norvegicus
gaactaccactaggcttaggccaaa

SEQ ID NO: 295560 - DNA, 25 bp, Rattus norvegicus
gaactaccagcccaagctgagctaa

SEQ ID NO: 295561 - DNA, 25 bp, Rattus norvegicus
gaactaccagccgaagctgagctaa

SEQ ID NO: 295562 - DNA, 25 bp, Rattus norvegicus
gaactacccaatcgtatgttcgggc

SEQ ID NO: 295563 - DNA, 25 bp, Rattus norvegicus
gaactacccaatggtatgttcgggc

SEQ ID NO: 295564 - DNA, 25 bp, Rattus norvegicus
gaactacccatgagccttgaaaata

SEQ ID NO: 295565 - DNA, 25 bp, Rattus norvegicus
gaactacccatgtgccttgaaaata

SEQ ID NO: 295566 - DNA, 25 bp, Rattus norvegicus
gaactaccccttcggccagattata

SEQ ID NO: 295567 - DNA, 25 bp, Rattus norvegicus
gaactaccccttgggccagattata

SEQ ID NO: 295568 - DNA, 25 bp, Rattus norvegicus
gaactacccttcactgcttcagtgt

SEQ ID NO: 295569 - DNA, 25 bp, Rattus norvegicus
gaactacccttctctgcttcagtgt

SEQ ID NO: 295570 - DNA, 25 bp, Rattus norvegicus
gaactacctactacatactgtacag

SEQ ID NO: 295571 - DNA, 25 bp, Rattus norvegicus
gaactacctacttcatactgtacag

SEQ ID NO: 295572 - DNA, 25 bp, Rattus norvegicus
gaactacctagcacttctaactgac

SEQ ID NO: 295573 - DNA, 25 bp, Rattus norvegicus
gaactacctagctcttctaactgac

SEQ ID NO: 295574 - DNA, 25 bp, Rattus norvegicus
gaactacctttcagaacccgtggag

SEQ ID NO: 295575 - DNA, 25 bp, Rattus norvegicus
gaactacctttctgaacccgtggag

SEQ ID NO: 295576 - DNA, 25 bp, Rattus norvegicus
gaactacgaggacgcacttcggctc

SEQ ID NO: 295577 - DNA, 25 bp, Rattus norvegicus
gaactacgaggaggcacttcggctc

SEQ ID NO: 295578 - DNA, 25 bp, Rattus norvegicus
gaactacgcactatgttaatttttg

SEQ ID NO: 295579 - DNA, 25 bp, Rattus norvegicus
gaactacgcactttgttaatttttg

SEQ ID NO: 295580 - DNA, 25 bp, Rattus norvegicus
gaactacgtggaagtgtcgctgatt

SEQ ID NO: 295581 - DNA, 25 bp, Rattus norvegicus
gaactacgtggatgtgtcgctgatt

SEQ ID NO: 295582 - DNA, 25 bp, Rattus norvegicus
gaactactaagtatcttctcatcaa

SEQ ID NO: 295583 - DNA, 25 bp, Rattus norvegicus
gaactactaagtttcttctcatcaa

SEQ ID NO: 295584 - DNA, 25 bp, Rattus norvegicus
gaactactcaagacgcagtgcatgg

SEQ ID NO: 295585 - DNA, 25 bp, Rattus norvegicus
gaactactcaagtcgcagtgcatgg

SEQ ID NO: 295586 - DNA, 25 bp, Rattus norvegicus
gaactactctggatgttaggcctct

SEQ ID NO: 295587 - DNA, 25 bp, Rattus norvegicus
gaactactctggttgttaggcctct

SEQ ID NO: 295588 - DNA, 25 bp, Rattus norvegicus
gaactactgaacagcacgtgccaga

SEQ ID NO: 295589 - DNA, 25 bp, Rattus norvegicus
gaactactgaactgcacgtgccaga

SEQ ID NO: 295590 - DNA, 25 bp, Rattus norvegicus
gaactactgctgataattttttaat

SEQ ID NO: 295591 - DNA, 25 bp, Rattus norvegicus
gaactactgctgttaattttttaat

SEQ ID NO: 295592 - DNA, 25 bp, Rattus norvegicus
gaactactggacataggccctcggg

SEQ ID NO: 295593 - DNA, 25 bp, Rattus norvegicus
gaactactggacttaggccctcggg

SEQ ID NO: 295594 - DNA, 25 bp, Rattus norvegicus
gaactactggatagtctgaagaact

SEQ ID NO: 295595 - DNA, 25 bp, Rattus norvegicus
gaactactggattgtctgaagaact

SEQ ID NO: 295596 - DNA, 25 bp, Rattus norvegicus
gaactactggcaactaaggagtact

SEQ ID NO: 295597 - DNA, 25 bp, Rattus norvegicus
gaactactggcatctaaggagtact

SEQ ID NO: 295598 - DNA, 25 bp, Rattus norvegicus
gaactactgtcgatcctctgaagta

SEQ ID NO: 295599 - DNA, 25 bp, Rattus norvegicus
gaactactgtcgttcctctgaagta

SEQ ID NO: 295600 - DNA, 25 bp, Rattus norvegicus
gaactacttagccttggtttagcta

SEQ ID NO: 295601 - DNA, 25 bp, Rattus norvegicus
gaactacttagcgttggtttagcta

SEQ ID NO: 295602 - DNA, 25 bp, Rattus norvegicus
gaactacttccaagagatgcctcca

SEQ ID NO: 295603 - DNA, 25 bp, Rattus norvegicus
gaactacttccatgagatgcctcca

SEQ ID NO: 295604 - DNA, 25 bp, Rattus norvegicus
gaactacttgagactatgcttatgt

SEQ ID NO: 295605 - DNA, 25 bp, Rattus norvegicus
gaactacttgagtctatgcttatgt

SEQ ID NO: 295606 - DNA, 25 bp, Rattus norvegicus
gaactacttgataagtctgccagga

SEQ ID NO: 295607 - DNA, 25 bp, Rattus norvegicus
gaactacttgattagtctgccagga

SEQ ID NO: 295608 - DNA, 25 bp, Rattus norvegicus
gaactacttggacatcctcgtgagg

SEQ ID NO: 295609 - DNA, 25 bp, Rattus norvegicus
gaactacttggagatcctcgtgagg

SEQ ID NO: 295610 - DNA, 25 bp, Rattus norvegicus
gaactagaagctcgtatggattata

SEQ ID NO: 295611 - DNA, 25 bp, Rattus norvegicus
gaactagaagctggtatggattata

SEQ ID NO: 295612 - DNA, 25 bp, Rattus norvegicus
gaactagaccaaaactcctgagcct

SEQ ID NO: 295613 - DNA, 25 bp, Rattus norvegicus
gaactagaccaatactcctgagcct

SEQ ID NO: 295614 - DNA, 25 bp, Rattus norvegicus
gaactagagttaaagtctccatgag

SEQ ID NO: 295615 - DNA, 25 bp, Rattus norvegicus
gaactagagttatagtctccatgag

SEQ ID NO: 295616 - DNA, 25 bp, Rattus norvegicus
gaactagatctacggcattgcatgt

SEQ ID NO: 295617 - DNA, 25 bp, Rattus norvegicus
gaactagatctagggcattgcatgt

SEQ ID NO: 295618 - DNA, 25 bp, Rattus norvegicus
gaactagcaaaacccgcatgtccat

SEQ ID NO: 295619 - DNA, 25 bp, Rattus norvegicus
gaactagcaaaagccgcatgtccat

SEQ ID NO: 295620 - DNA, 25 bp, Rattus norvegicus
gaactagcagatatggtaggcacct

SEQ ID NO: 295621 - DNA, 25 bp, Rattus norvegicus
gaactagcagatttggtaggcacct

SEQ ID NO: 295622 - DNA, 25 bp, Rattus norvegicus
gaactagcaggtaaaccatgaggtt

SEQ ID NO: 295623 - DNA, 25 bp, Rattus norvegicus
gaactagcaggttaaccatgaggtt

SEQ ID NO: 295624 - DNA, 25 bp, Rattus norvegicus
gaactagccaaccatttccagaatg

SEQ ID NO: 295625 - DNA, 25 bp, Rattus norvegicus
gaactagccaacgatttccagaatg

SEQ ID NO: 295626 - DNA, 25 bp, Rattus norvegicus
gaactagccttgagctgtgggtgcc

SEQ ID NO: 295627 - DNA, 25 bp, Rattus norvegicus
gaactagccttgtgctgtgggtgcc

SEQ ID NO: 295628 - DNA, 25 bp, Rattus norvegicus
gaactagcctttcaatttcatctca

SEQ ID NO: 295629 - DNA, 25 bp, Rattus norvegicus
gaactagcctttgaatttcatctca

SEQ ID NO: 295630 - DNA, 25 bp, Rattus norvegicus
gaactagctcgtcggttttccagat

SEQ ID NO: 295631 - DNA, 25 bp, Rattus norvegicus
gaactagctcgtgggttttccagat

SEQ ID NO: 295632 - DNA, 25 bp, Rattus norvegicus
gaactagctgaccttattcccagaa

SEQ ID NO: 295633 - DNA, 25 bp, Rattus norvegicus
gaactagctgacgttattcccagaa

SEQ ID NO: 295634 - DNA, 25 bp, Rattus norvegicus
gaactagctgccctttactttgtag

SEQ ID NO: 295635 - DNA, 25 bp, Rattus norvegicus
gaactagctgccgtttactttgtag

SEQ ID NO: 295636 - DNA, 25 bp, Rattus norvegicus
gaactagcttatctctttatatttg

SEQ ID NO: 295637 - DNA, 25 bp, Rattus norvegicus
gaactagcttatgtctttatatttg

SEQ ID NO: 295638 - DNA, 25 bp, Rattus norvegicus
gaactagcttgtatcgacaggtctg

SEQ ID NO: 295639 - DNA, 25 bp, Rattus norvegicus
gaactagcttgtttcgacaggtctg

SEQ ID NO: 295640 - DNA, 25 bp, Rattus norvegicus
gaactaggagagatccatctgctgt

SEQ ID NO: 295641 - DNA, 25 bp, Rattus norvegicus
gaactaggagagttccatctgctgt

SEQ ID NO: 295642 - DNA, 25 bp, Rattus norvegicus
gaactaggccaccatgcctttcaaa

SEQ ID NO: 295643 - DNA, 25 bp, Rattus norvegicus
gaactaggccacgatgcctttcaaa

SEQ ID NO: 295644 - DNA, 25 bp, Rattus norvegicus
gaactagggattacttttcaatgtt

SEQ ID NO: 295645 - DNA, 25 bp, Rattus norvegicus
gaactagggatttcttttcaatgtt

SEQ ID NO: 295646 - DNA, 25 bp, Rattus norvegicus
gaactagggcctcatgggcactcca

SEQ ID NO: 295647 - DNA, 25 bp, Rattus norvegicus
gaactagggcctcatgggctctgca

SEQ ID NO: 295648 - DNA, 25 bp, Rattus norvegicus
gaactagggcctgatgggcactcca

SEQ ID NO: 295649 - DNA, 25 bp, Rattus norvegicus
gaactagggcctgatgggctctgca

SEQ ID NO: 295650 - DNA, 25 bp, Rattus norvegicus
gaactagggcttccatagtcacaat

SEQ ID NO: 295651 - DNA, 25 bp, Rattus norvegicus
gaactagggcttgcatagtcacaat

SEQ ID NO: 295652 - DNA, 25 bp, Rattus norvegicus
gaactaggtagcctatccattccca

SEQ ID NO: 295653 - DNA, 25 bp, Rattus norvegicus
gaactaggtagcgtatccattccca

SEQ ID NO: 295654 - DNA, 25 bp, Rattus norvegicus
gaactagtctatattgtacagcacg

SEQ ID NO: 295655 - DNA, 25 bp, Rattus norvegicus
gaactagtctattttgtacagcacg

SEQ ID NO: 295656 - DNA, 25 bp, Rattus norvegicus
gaactagtctgaactctcatggtct

SEQ ID NO: 295657 - DNA, 25 bp, Rattus norvegicus
gaactagtctgatctctcatggtct

SEQ ID NO: 295658 - DNA, 25 bp, Rattus norvegicus
gaactagtcttcaggagtactttgt

SEQ ID NO: 295659 - DNA, 25 bp, Rattus norvegicus
gaactagtcttctggagtactttgt

SEQ ID NO: 295660 - DNA, 25 bp, Rattus norvegicus
gaactagtgcgcatcaggcttaagg

SEQ ID NO: 295661 - DNA, 25 bp, Rattus norvegicus
gaactagtgcgcttcaggcttaagg

SEQ ID NO: 295662 - DNA, 25 bp, Rattus norvegicus
gaactagtgtatccttgaaatagca

SEQ ID NO: 295663 - DNA, 25 bp, Rattus norvegicus
gaactagtgtatgcttgaaatagca

SEQ ID NO: 295664 - DNA, 25 bp, Rattus norvegicus
gaactagttcagcaggtgaccggcc

SEQ ID NO: 295665 - DNA, 25 bp, Rattus norvegicus
gaactagttcaggaggtgaccggcc

SEQ ID NO: 295666 - DNA, 25 bp, Rattus norvegicus
gaactagttgctcgtttcgtactca

SEQ ID NO: 295667 - DNA, 25 bp, Rattus norvegicus
gaactagttgctggtttcgtactca

SEQ ID NO: 295668 - DNA, 25 bp, Rattus norvegicus
gaactagttgtaaagaccacgggtg

SEQ ID NO: 295669 - DNA, 25 bp, Rattus norvegicus
gaactagttgtatagaccacgggtg

SEQ ID NO: 295670 - DNA, 25 bp, Rattus norvegicus
gaactagtttcaagtgcctactgcc

SEQ ID NO: 295671 - DNA, 25 bp, Rattus norvegicus
gaactagtttcatgtgcctactgcc

SEQ ID NO: 295672 - DNA, 25 bp, Rattus norvegicus
gaactataatccagcatcttttact

SEQ ID NO: 295673 - DNA, 25 bp, Rattus norvegicus
gaactataatcctgcatcttttact

SEQ ID NO: 295674 - DNA, 25 bp, Rattus norvegicus
gaactatactccatctttggtgaca

SEQ ID NO: 295675 - DNA, 25 bp, Rattus norvegicus
gaactatactccttctttggtgaca

SEQ ID NO: 295676 - DNA, 25 bp, Rattus norvegicus
gaactatactgcattgagatctcat

SEQ ID NO: 295677 - DNA, 25 bp, Rattus norvegicus
gaactatactgctttgagatctcat

SEQ ID NO: 295678 - DNA, 25 bp, Rattus norvegicus
gaactatagtttatactggtatcac

SEQ ID NO: 295679 - DNA, 25 bp, Rattus norvegicus
gaactatagtttttactggtatcac

SEQ ID NO: 295680 - DNA, 25 bp, Rattus norvegicus
gaactatatatcagatgctccttgt

SEQ ID NO: 295681 - DNA, 25 bp, Rattus norvegicus
gaactatatatctgatgctccttgt

SEQ ID NO: 295682 - DNA, 25 bp, Rattus norvegicus
gaactatatggtattccctattcag

SEQ ID NO: 295683 - DNA, 25 bp, Rattus norvegicus
gaactatatggttttccctattcag

SEQ ID NO: 295684 - DNA, 25 bp, Rattus norvegicus
gaactatcacgtctatctcagaaat

SEQ ID NO: 295685 - DNA, 25 bp, Rattus norvegicus
gaactatcacgtgtatctcagaaat

SEQ ID NO: 295686 - DNA, 25 bp, Rattus norvegicus
gaactatcaggccttaccgtttaca

SEQ ID NO: 295687 - DNA, 25 bp, Rattus norvegicus
gaactatcaggcgttaccgtttaca

SEQ ID NO: 295688 - DNA, 25 bp, Rattus norvegicus
gaactatccaaactccaccaattta

SEQ ID NO: 295689 - DNA, 25 bp, Rattus norvegicus
gaactatccaaagtccaccaattta

SEQ ID NO: 295690 - DNA, 25 bp, Rattus norvegicus
gaactatccgcacgtggcagcagca

SEQ ID NO: 295691 - DNA, 25 bp, Rattus norvegicus
gaactatccgcaggtggcagcagca

SEQ ID NO: 295692 - DNA, 25 bp, Rattus norvegicus
gaactatctgatatcaccttccggc

SEQ ID NO: 295693 - DNA, 25 bp, Rattus norvegicus
gaactatctgatttcaccttccggc

SEQ ID NO: 295694 - DNA, 25 bp, Rattus norvegicus
gaactatctgctacttcatctaaat

SEQ ID NO: 295695 - DNA, 25 bp, Rattus norvegicus
gaactatctgcttcttcatctaaat

SEQ ID NO: 295696 - DNA, 25 bp, Rattus norvegicus
gaactatgaaccatgtgctgacctc

SEQ ID NO: 295697 - DNA, 25 bp, Rattus norvegicus
gaactatgaaccttgtgctgacctc

SEQ ID NO: 295698 - DNA, 25 bp, Rattus norvegicus
gaactatgagttctgctctgtgaat

SEQ ID NO: 295699 - DNA, 25 bp, Rattus norvegicus
gaactatgagttgtgctctgtgaat

SEQ ID NO: 295700 - DNA, 25 bp, Rattus norvegicus
gaactatgcaaacactgcccttcct

SEQ ID NO: 295701 - DNA, 25 bp, Rattus norvegicus
gaactatgcaaagactgcccttcct

SEQ ID NO: 295702 - DNA, 25 bp, Rattus norvegicus
gaactatgcaacagattgtggtggc

SEQ ID NO: 295703 - DNA, 25 bp, Rattus norvegicus
gaactatgcaactgattgtggtggc

SEQ ID NO: 295704 - DNA, 25 bp, Rattus norvegicus
gaactatgccatcaagccacaagcg

SEQ ID NO: 295705 - DNA, 25 bp, Rattus norvegicus
gaactatgccatcatctggatacat

SEQ ID NO: 295706 - DNA, 25 bp, Rattus norvegicus
gaactatgccatgaagccacaagcg

SEQ ID NO: 295707 - DNA, 25 bp, Rattus norvegicus
gaactatgccatgatctggatacat

SEQ ID NO: 295708 - DNA, 25 bp, Rattus norvegicus
gaactatgctacacgttggcctaga

SEQ ID NO: 295709 - DNA, 25 bp, Rattus norvegicus
gaactatgctactcgttggcctaga

SEQ ID NO: 295710 - DNA, 25 bp, Rattus norvegicus
gaactatggagccaccaggcgctgt

SEQ ID NO: 295711 - DNA, 25 bp, Rattus norvegicus
gaactatggagcgaccaggcgctgt

SEQ ID NO: 295712 - DNA, 25 bp, Rattus norvegicus
gaactatgggataccttttgctttg

SEQ ID NO: 295713 - DNA, 25 bp, Rattus norvegicus
gaactatgggattccttttgctttg

SEQ ID NO: 295714 - DNA, 25 bp, Rattus norvegicus
gaactatggttcattccgtgccgta

SEQ ID NO: 295715 - DNA, 25 bp, Rattus norvegicus
gaactatggttctttccgtgccgta

SEQ ID NO: 295716 - DNA, 25 bp, Rattus norvegicus
gaactatgtgacaagcctccttttt

SEQ ID NO: 295717 - DNA, 25 bp, Rattus norvegicus
gaactatgtgactagcctccttttt

SEQ ID NO: 295718 - DNA, 25 bp, Rattus norvegicus
gaactatgtggacgcactttctaat

SEQ ID NO: 295719 - DNA, 25 bp, Rattus norvegicus
gaactatgtggaggcactttctaat

SEQ ID NO: 295720 - DNA, 25 bp, Rattus norvegicus
gaactatgtggcatgcttacgcagc

SEQ ID NO: 295721 - DNA, 25 bp, Rattus norvegicus
gaactatgtggcttgcttacgcagc

SEQ ID NO: 295722 - DNA, 25 bp, Rattus norvegicus
gaactattaactaggtatcgcaggt

SEQ ID NO: 295723 - DNA, 25 bp, Rattus norvegicus
gaactattaacttggtatcgcaggt

SEQ ID NO: 295724 - DNA, 25 bp, Rattus norvegicus
gaactattacagcatcctttcctga

SEQ ID NO: 295725 - DNA, 25 bp, Rattus norvegicus
gaactattacaggatcctttcctga

SEQ ID NO: 295726 - DNA, 25 bp, Rattus norvegicus
gaactattcagactagtcccttgag

SEQ ID NO: 295727 - DNA, 25 bp, Rattus norvegicus
gaactattcagagtagtcccttgag

SEQ ID NO: 295728 - DNA, 25 bp, Rattus norvegicus
gaactattctgtatgtttccataaa

SEQ ID NO: 295729 - DNA, 25 bp, Rattus norvegicus
gaactattctgtttgtttccataaa

SEQ ID NO: 295730 - DNA, 25 bp, Rattus norvegicus
gaactattcttcatgccaatctggc

SEQ ID NO: 295731 - DNA, 25 bp, Rattus norvegicus
gaactattcttcttgccaatctggc

SEQ ID NO: 295732 - DNA, 25 bp, Rattus norvegicus
gaactattgtcaatgtgcttgaggt

SEQ ID NO: 295733 - DNA, 25 bp, Rattus norvegicus
gaactattgtcattgtgcttgaggt

SEQ ID NO: 295734 - DNA, 25 bp, Rattus norvegicus
gaactattgtgtataaatttggtca

SEQ ID NO: 295735 - DNA, 25 bp, Rattus norvegicus
gaactattgtgtttaaatttggtca

SEQ ID NO: 295736 - DNA, 25 bp, Rattus norvegicus
gaactatttgctaagggcctggaga

SEQ ID NO: 295737 - DNA, 25 bp, Rattus norvegicus
gaactatttgcttagggcctggaga

SEQ ID NO: 295738 - DNA, 25 bp, Rattus norvegicus
gaactattttctactcaaacagagt

SEQ ID NO: 295739 - DNA, 25 bp, Rattus norvegicus
gaactattttcttctcaaacagagt

SEQ ID NO: 295740 - DNA, 25 bp, Rattus norvegicus
gaactattttggattcgacctctta

SEQ ID NO: 295741 - DNA, 25 bp, Rattus norvegicus
gaactattttggtttcgacctctta

SEQ ID NO: 295742 - DNA, 25 bp, Rattus norvegicus
gaactcaaaacacatctcaggccat

SEQ ID NO: 295743 - DNA, 25 bp, Rattus norvegicus
gaactcaaaacagatctcaggccat

SEQ ID NO: 295744 - DNA, 25 bp, Rattus norvegicus
gaactcaaaccaacagggcctacta

SEQ ID NO: 295745 - DNA, 25 bp, Rattus norvegicus
gaactcaaaccatcagggcctacta

SEQ ID NO: 295746 - DNA, 25 bp, Rattus norvegicus
gaactcaaacctaggctcagaagct

SEQ ID NO: 295747 - DNA, 25 bp, Rattus norvegicus
gaactcaaaccttggctcagaagct

SEQ ID NO: 295748 - DNA, 25 bp, Rattus norvegicus
gaactcaaacgtcgatctctccgag

SEQ ID NO: 295749 - DNA, 25 bp, Rattus norvegicus
gaactcaaacgtggatctctccgag

SEQ ID NO: 295750 - DNA, 25 bp, Rattus norvegicus
gaactcaaagatctacctgcctcta

SEQ ID NO: 295751 - DNA, 25 bp, Rattus norvegicus
gaactcaaagatgtacctgcctcta

SEQ ID NO: 295752 - DNA, 25 bp, Rattus norvegicus
gaactcaaattcctcactgcaaagc

SEQ ID NO: 295753 - DNA, 25 bp, Rattus norvegicus
gaactcaaattcgtcactgcaaagc

SEQ ID NO: 295754 - DNA, 25 bp, Rattus norvegicus
gaactcaacattcctaatccctagg

SEQ ID NO: 295755 - DNA, 25 bp, Rattus norvegicus
gaactcaacattgctaatccctagg

SEQ ID NO: 295756 - DNA, 25 bp, Rattus norvegicus
gaactcaaccgaccaggtgggcacc

SEQ ID NO: 295757 - DNA, 25 bp, Rattus norvegicus
gaactcaaccgagcaggtgggcacc

SEQ ID NO: 295758 - DNA, 25 bp, Rattus norvegicus
gaactcaacctaaatacagctgtgc

SEQ ID NO: 295759 - DNA, 25 bp, Rattus norvegicus
gaactcaacctatatacagctgtgc

SEQ ID NO: 295760 - DNA, 25 bp, Rattus norvegicus
gaactcaacgcaagctttccaaaag

SEQ ID NO: 295761 - DNA, 25 bp, Rattus norvegicus
gaactcaacgcatgctttccaaaag

SEQ ID NO: 295762 - DNA, 25 bp, Rattus norvegicus
gaactcaagaaaacagctcgggctg

SEQ ID NO: 295763 - DNA, 25 bp, Rattus norvegicus
gaactcaagaaatcagctcgggctg

SEQ ID NO: 295764 - DNA, 25 bp, Rattus norvegicus
gaactcaagaggaggcagctggcct

SEQ ID NO: 295765 - DNA, 25 bp, Rattus norvegicus
gaactcaagaggtggcagctggcct

SEQ ID NO: 295766 - DNA, 25 bp, Rattus norvegicus
gaactcaagcccaattcagtcagca

SEQ ID NO: 295767 - DNA, 25 bp, Rattus norvegicus
gaactcaagccctattcagtcagca

SEQ ID NO: 295768 - DNA, 25 bp, Rattus norvegicus
gaactcaagcttcacttccatctga

SEQ ID NO: 295769 - DNA, 25 bp, Rattus norvegicus
gaactcaagcttgacttccatctga

SEQ ID NO: 295770 - DNA, 25 bp, Rattus norvegicus
gaactcaagtgtattgctgctgatg

SEQ ID NO: 295771 - DNA, 25 bp, Rattus norvegicus
gaactcaagtgttttgctgctgatg

SEQ ID NO: 295772 - DNA, 25 bp, Rattus norvegicus
gaactcaagttgactatgccgccaa

SEQ ID NO: 295773 - DNA, 25 bp, Rattus norvegicus
gaactcaagttgtctatgccgccaa

SEQ ID NO: 295774 - DNA, 25 bp, Rattus norvegicus
gaactcaatccaccatttgtagcag

SEQ ID NO: 295775 - DNA, 25 bp, Rattus norvegicus
gaactcaatccagcatttgtagcag

SEQ ID NO: 295776 - DNA, 25 bp, Rattus norvegicus
gaactcaatctacttcccaggatga

SEQ ID NO: 295777 - DNA, 25 bp, Rattus norvegicus
gaactcaatctagttcccaggatga

SEQ ID NO: 295778 - DNA, 25 bp, Rattus norvegicus
gaactcaatgagatttcctgcctca

SEQ ID NO: 295779 - DNA, 25 bp, Rattus norvegicus
gaactcaatgagttttcctgcctca

SEQ ID NO: 295780 - DNA, 25 bp, Rattus norvegicus
gaactcaatgcaagatgactcttct

SEQ ID NO: 295781 - DNA, 25 bp, Rattus norvegicus
gaactcaatgcatgatgactcttct

SEQ ID NO: 295782 - DNA, 25 bp, Rattus norvegicus
gaactcaatgtcctgactttttgga

SEQ ID NO: 295783 - DNA, 25 bp, Rattus norvegicus
gaactcaatgtcgtgactttttgga

SEQ ID NO: 295784 - DNA, 25 bp, Rattus norvegicus
gaactcacaagcagaccaagacctg

SEQ ID NO: 295785 - DNA, 25 bp, Rattus norvegicus
gaactcacaagctgaccaagacctg

SEQ ID NO: 295786 - DNA, 25 bp, Rattus norvegicus
gaactcacactccatagactaggct

SEQ ID NO: 295787 - DNA, 25 bp, Rattus norvegicus
gaactcacactcgatagactaggct

SEQ ID NO: 295788 - DNA, 25 bp, Rattus norvegicus
gaactcacagatctggttacctgcc

SEQ ID NO: 295789 - DNA, 25 bp, Rattus norvegicus
gaactcacagatgtggttacctgcc

SEQ ID NO: 295790 - DNA, 25 bp, Rattus norvegicus
gaactcacagtaactatgacttttt

SEQ ID NO: 295791 - DNA, 25 bp, Rattus norvegicus
gaactcacagtatctatgacttttt

SEQ ID NO: 295792 - DNA, 25 bp, Rattus norvegicus
gaactcacatagacctgtctctgtt

SEQ ID NO: 295793 - DNA, 25 bp, Rattus norvegicus
gaactcacatagatctacttccgct

SEQ ID NO: 295794 - DNA, 25 bp, Rattus norvegicus
gaactcacatagtcctgtctctgtt

SEQ ID NO: 295795 - DNA, 25 bp, Rattus norvegicus
gaactcacatagttctacttccgct

SEQ ID NO: 295796 - DNA, 25 bp, Rattus norvegicus
gaactcacatttaacacaaggccgg

SEQ ID NO: 295797 - DNA, 25 bp, Rattus norvegicus
gaactcacattttacacaaggccgg

SEQ ID NO: 295798 - DNA, 25 bp, Rattus norvegicus
gaactcaccaagatccatctgcttg

SEQ ID NO: 295799 - DNA, 25 bp, Rattus norvegicus
gaactcaccaagttccatctgcttg

SEQ ID NO: 295800 - DNA, 25 bp, Rattus norvegicus
gaactcaccagaaggttcatcaggt

SEQ ID NO: 295801 - DNA, 25 bp, Rattus norvegicus
gaactcaccagatggttcatcaggt

SEQ ID NO: 295802 - DNA, 25 bp, Rattus norvegicus
gaactcaccatgaacaccaggttgg

SEQ ID NO: 295803 - DNA, 25 bp, Rattus norvegicus
gaactcaccatgtacaccaggttgg

SEQ ID NO: 295804 - DNA, 25 bp, Rattus norvegicus
gaactcaccccaaagaatcctacag

SEQ ID NO: 295805 - DNA, 25 bp, Rattus norvegicus
gaactcaccccatagaatcctacag

SEQ ID NO: 295806 - DNA, 25 bp, Rattus norvegicus
gaactcacctttctaaagcgctgtg

SEQ ID NO: 295807 - DNA, 25 bp, Rattus norvegicus
gaactcacctttgtaaagcgctgtg

SEQ ID NO: 295808 - DNA, 25 bp, Rattus norvegicus
gaactcacgcatcgagttgtccctg

SEQ ID NO: 295809 - DNA, 25 bp, Rattus norvegicus
gaactcacgcatggagttgtccctg

SEQ ID NO: 295810 - DNA, 25 bp, Rattus norvegicus
gaactcacgctgcaggatagtacag

SEQ ID NO: 295811 - DNA, 25 bp, Rattus norvegicus
gaactcacgctggaggatagtacag

SEQ ID NO: 295812 - DNA, 25 bp, Rattus norvegicus
gaactcacgtacaaatggcaccatt

SEQ ID NO: 295813 - DNA, 25 bp, Rattus norvegicus
gaactcacgtactaatggcaccatt

SEQ ID NO: 295814 - DNA, 25 bp, Rattus norvegicus
gaactcacgtctactaattttcttg

SEQ ID NO: 295815 - DNA, 25 bp, Rattus norvegicus
gaactcacgtcttctaattttcttg

SEQ ID NO: 295816 - DNA, 25 bp, Rattus norvegicus
gaactcactataaagccaagcctgg

SEQ ID NO: 295817 - DNA, 25 bp, Rattus norvegicus
gaactcactataactcagttgccgg

SEQ ID NO: 295818 - DNA, 25 bp, Rattus norvegicus
gaactcactatatagccaagcctgg

SEQ ID NO: 295819 - DNA, 25 bp, Rattus norvegicus
gaactcactatatctcagttgccgg

SEQ ID NO: 295820 - DNA, 25 bp, Rattus norvegicus
gaactcactctaagccagacaaggt

SEQ ID NO: 295821 - DNA, 25 bp, Rattus norvegicus
gaactcactctatgccagacaaggt

SEQ ID NO: 295822 - DNA, 25 bp, Rattus norvegicus
gaactcactgaacactgtgggcact

SEQ ID NO: 295823 - DNA, 25 bp, Rattus norvegicus
gaactcactgaagactgtgggcact

SEQ ID NO: 295824 - DNA, 25 bp, Rattus norvegicus
gaactcactgtacttcctgttttca

SEQ ID NO: 295825 - DNA, 25 bp, Rattus norvegicus
gaactcactgtagttcctgttttca

SEQ ID NO: 295826 - DNA, 25 bp, Rattus norvegicus
gaactcactgtgaagctcaggcaaa

SEQ ID NO: 295827 - DNA, 25 bp, Rattus norvegicus
gaactcactgtgtagctcaggcaaa

SEQ ID NO: 295828 - DNA, 25 bp, Rattus norvegicus
gaactcacttccagagtgtagaccc

SEQ ID NO: 295829 - DNA, 25 bp, Rattus norvegicus
gaactcacttcctgagtgtagaccc

SEQ ID NO: 295830 - DNA, 25 bp, Rattus norvegicus
gaactcagaaatctggtgcgccagg

SEQ ID NO: 295831 - DNA, 25 bp, Rattus norvegicus
gaactcagaaatgtggtgcgccagg

SEQ ID NO: 295832 - DNA, 25 bp, Rattus norvegicus
gaactcagactgaggatctcaagcc

SEQ ID NO: 295833 - DNA, 25 bp, Rattus norvegicus
gaactcagactgtggatctcaagcc

SEQ ID NO: 295834 - DNA, 25 bp, Rattus norvegicus
gaactcagagcaacaatgagcgggt

SEQ ID NO: 295835 - DNA, 25 bp, Rattus norvegicus
gaactcagagcatcaatgagcgggt

SEQ ID NO: 295836 - DNA, 25 bp, Rattus norvegicus
gaactcagagttagattccagcaca

SEQ ID NO: 295837 - DNA, 25 bp, Rattus norvegicus
gaactcagagtttgattccagcaca

SEQ ID NO: 295838 - DNA, 25 bp, Rattus norvegicus
gaactcagatcaaggctggttgtac

SEQ ID NO: 295839 - DNA, 25 bp, Rattus norvegicus
gaactcagatcatggctggttgtac

SEQ ID NO: 295840 - DNA, 25 bp, Rattus norvegicus
gaactcagcaccagtgaagggcttt

SEQ ID NO: 295841 - DNA, 25 bp, Rattus norvegicus
gaactcagcacctgtgaagggcttt

SEQ ID NO: 295842 - DNA, 25 bp, Rattus norvegicus
gaactcagcagtacccatttaaaaa

SEQ ID NO: 295843 - DNA, 25 bp, Rattus norvegicus
gaactcagcagttcccatttaaaaa

SEQ ID NO: 295844 - DNA, 25 bp, Rattus norvegicus
gaactcagccggctcaggcacctta

SEQ ID NO: 295845 - DNA, 25 bp, Rattus norvegicus
gaactcagccgggtcaggcacctta

SEQ ID NO: 295846 - DNA, 25 bp, Rattus norvegicus
gaactcagccttccaggttgcacag

SEQ ID NO: 295847 - DNA, 25 bp, Rattus norvegicus
gaactcagccttgcaggttgcacag

SEQ ID NO: 295848 - DNA, 25 bp, Rattus norvegicus
gaactcagctctatgggtgtttctt

SEQ ID NO: 295849 - DNA, 25 bp, Rattus norvegicus
gaactcagctctttgggtgtttctt

SEQ ID NO: 295850 - DNA, 25 bp, Rattus norvegicus
gaactcagctggcttttgtgacaag

SEQ ID NO: 295851 - DNA, 25 bp, Rattus norvegicus
gaactcagctgggttttgtgacaag

SEQ ID NO: 295852 - DNA, 25 bp, Rattus norvegicus
gaactcaggaagcttcagatgaagt

SEQ ID NO: 295853 - DNA, 25 bp, Rattus norvegicus
gaactcaggaaggttcagatgaagt

SEQ ID NO: 295854 - DNA, 25 bp, Rattus norvegicus
gaactcaggagcagtcgttgctctt

SEQ ID NO: 295855 - DNA, 25 bp, Rattus norvegicus
gaactcaggagctgtcgttgctctt

SEQ ID NO: 295856 - DNA, 25 bp, Rattus norvegicus
gaactcaggcatagggcattgtccg

SEQ ID NO: 295857 - DNA, 25 bp, Rattus norvegicus
gaactcaggcattgggcattgtccg

SEQ ID NO: 295858 - DNA, 25 bp, Rattus norvegicus
gaactcaggcctcgctgcagagctc

SEQ ID NO: 295859 - DNA, 25 bp, Rattus norvegicus
gaactcaggcctggctgcagagctc

SEQ ID NO: 295860 - DNA, 25 bp, Rattus norvegicus
gaactcaggctgaatcattctattt

SEQ ID NO: 295861 - DNA, 25 bp, Rattus norvegicus
gaactcaggctgtatcattctattt

SEQ ID NO: 295862 - DNA, 25 bp, Rattus norvegicus
gaactcagggccaggtgacactaaa

SEQ ID NO: 295863 - DNA, 25 bp, Rattus norvegicus
gaactcagggccattttcaatttgt

SEQ ID NO: 295864 - DNA, 25 bp, Rattus norvegicus
gaactcagggcctggtgacactaaa

SEQ ID NO: 295865 - DNA, 25 bp, Rattus norvegicus
gaactcagggcctttttcaatttgt

SEQ ID NO: 295866 - DNA, 25 bp, Rattus norvegicus
gaactcaggtagacacggagtaccg

SEQ ID NO: 295867 - DNA, 25 bp, Rattus norvegicus
gaactcaggtagtcacggagtaccg

SEQ ID NO: 295868 - DNA, 25 bp, Rattus norvegicus
gaactcaggtcaacacatggtagaa

SEQ ID NO: 295869 - DNA, 25 bp, Rattus norvegicus
gaactcaggtcatcacatggtagaa

SEQ ID NO: 295870 - DNA, 25 bp, Rattus norvegicus
gaactcaggtgacctctgagcccat

SEQ ID NO: 295871 - DNA, 25 bp, Rattus norvegicus
gaactcaggtgagctctgagcccat

SEQ ID NO: 295872 - DNA, 25 bp, Rattus norvegicus
gaactcaggtggcattgctgtcttt

SEQ ID NO: 295873 - DNA, 25 bp, Rattus norvegicus
gaactcaggtgggattgctgtcttt

SEQ ID NO: 295874 - DNA, 25 bp, Rattus norvegicus
gaactcaggttcagcacttggccta

SEQ ID NO: 295875 - DNA, 25 bp, Rattus norvegicus
gaactcaggttctgcacttggccta

SEQ ID NO: 295876 - DNA, 25 bp, Rattus norvegicus
gaactcagtattccctttgtgatgt

SEQ ID NO: 295877 - DNA, 25 bp, Rattus norvegicus
gaactcagtattgcctttgtgatgt

SEQ ID NO: 295878 - DNA, 25 bp, Rattus norvegicus
gaactcagtcctccttctgcgtgct

SEQ ID NO: 295879 - DNA, 25 bp, Rattus norvegicus
gaactcagtcctgcttctgcgtgct

SEQ ID NO: 295880 - DNA, 25 bp, Rattus norvegicus
gaactcagtctacgtaaagccacag

SEQ ID NO: 295881 - DNA, 25 bp, Rattus norvegicus
gaactcagtctaggtaaagccacag

SEQ ID NO: 295882 - DNA, 25 bp, Rattus norvegicus
gaactcagtgctaccatcattttga

SEQ ID NO: 295883 - DNA, 25 bp, Rattus norvegicus
gaactcagtgctatctcgatgctgt

SEQ ID NO: 295884 - DNA, 25 bp, Rattus norvegicus
gaactcagtgcttccatcattttga

SEQ ID NO: 295885 - DNA, 25 bp, Rattus norvegicus
gaactcagtgctttctcgatgctgt

SEQ ID NO: 295886 - DNA, 25 bp, Rattus norvegicus
gaactcagtgtcagcttttctgttt

SEQ ID NO: 295887 - DNA, 25 bp, Rattus norvegicus
gaactcagtgtctgcttttctgttt

SEQ ID NO: 295888 - DNA, 25 bp, Rattus norvegicus
gaactcagtgttacagatggcccag

SEQ ID NO: 295889 - DNA, 25 bp, Rattus norvegicus
gaactcagtgttactacagtgtaag

SEQ ID NO: 295890 - DNA, 25 bp, Rattus norvegicus
gaactcagtgtttcagatggcccag

SEQ ID NO: 295891 - DNA, 25 bp, Rattus norvegicus
gaactcagtgtttctacagtgtaag

SEQ ID NO: 295892 - DNA, 25 bp, Rattus norvegicus
gaactcagttcacaagaccccaggt

SEQ ID NO: 295893 - DNA, 25 bp, Rattus norvegicus
gaactcagttcagaagaccccaggt

SEQ ID NO: 295894 - DNA, 25 bp, Rattus norvegicus
gaactcagtttcatgaggccctctg

SEQ ID NO: 295895 - DNA, 25 bp, Rattus norvegicus
gaactcagtttcctatactcttctg

SEQ ID NO: 295896 - DNA, 25 bp, Rattus norvegicus
gaactcagtttcgtatactcttctg

SEQ ID NO: 295897 - DNA, 25 bp, Rattus norvegicus
gaactcagtttcttgaggccctctg

SEQ ID NO: 295898 - DNA, 25 bp, Rattus norvegicus
gaactcataatcatggactgtttat

SEQ ID NO: 295899 - DNA, 25 bp, Rattus norvegicus
gaactcataatcttggactgtttat

SEQ ID NO: 295900 - DNA, 25 bp, Rattus norvegicus
gaactcatagatatctgcctgcctc

SEQ ID NO: 295901 - DNA, 25 bp, Rattus norvegicus
gaactcatagatttctgcctgcctc

SEQ ID NO: 295902 - DNA, 25 bp, Rattus norvegicus
gaactcatagttcctacaaatgtta

SEQ ID NO: 295903 - DNA, 25 bp, Rattus norvegicus
gaactcatagttgctacaaatgtta

SEQ ID NO: 295904 - DNA, 25 bp, Rattus norvegicus
gaactcatcatacgcatttgctgac

SEQ ID NO: 295905 - DNA, 25 bp, Rattus norvegicus
gaactcatcataggcatttgctgac

SEQ ID NO: 295906 - DNA, 25 bp, Rattus norvegicus
gaactcatcattacagccgatctga

SEQ ID NO: 295907 - DNA, 25 bp, Rattus norvegicus
gaactcatcatttcagccgatctga

SEQ ID NO: 295908 - DNA, 25 bp, Rattus norvegicus
gaactcatctaaaggcgactcgcac

SEQ ID NO: 295909 - DNA, 25 bp, Rattus norvegicus
gaactcatctaatggcgactcgcac

SEQ ID NO: 295910 - DNA, 25 bp, Rattus norvegicus
gaactcatctgtatcacatttccac

SEQ ID NO: 295911 - DNA, 25 bp, Rattus norvegicus
gaactcatctgtttcacatttccac

SEQ ID NO: 295912 - DNA, 25 bp, Rattus norvegicus
gaactcatctttcctggaggagccc

SEQ ID NO: 295913 - DNA, 25 bp, Rattus norvegicus
gaactcatctttctgacttctgtat

SEQ ID NO: 295914 - DNA, 25 bp, Rattus norvegicus
gaactcatctttgctggaggagccc

SEQ ID NO: 295915 - DNA, 25 bp, Rattus norvegicus
gaactcatctttgtgacttctgtat

SEQ ID NO: 295916 - DNA, 25 bp, Rattus norvegicus
gaactcatgatcacggtgcaggagc

SEQ ID NO: 295917 - DNA, 25 bp, Rattus norvegicus
gaactcatgatctcggtgcaggagc

SEQ ID NO: 295918 - DNA, 25 bp, Rattus norvegicus
gaactcatgccccaaacaggaagtc

SEQ ID NO: 295919 - DNA, 25 bp, Rattus norvegicus
gaactcatgcccgaaacaggaagtc

SEQ ID NO: 295920 - DNA, 25 bp, Rattus norvegicus
gaactcatgctcagacttctcagat

SEQ ID NO: 295921 - DNA, 25 bp, Rattus norvegicus
gaactcatgctctgacttctcagat

SEQ ID NO: 295922 - DNA, 25 bp, Rattus norvegicus
gaactcatggaaaacagcctgttga

SEQ ID NO: 295923 - DNA, 25 bp, Rattus norvegicus
gaactcatggaacggccactcagga

SEQ ID NO: 295924 - DNA, 25 bp, Rattus norvegicus
gaactcatggaagggccactcagga

SEQ ID NO: 295925 - DNA, 25 bp, Rattus norvegicus
gaactcatggaatacagcctgttga

SEQ ID NO: 295926 - DNA, 25 bp, Rattus norvegicus
gaactcatgggcactttgctgggac

SEQ ID NO: 295927 - DNA, 25 bp, Rattus norvegicus
gaactcatgggctctttgctgggac

SEQ ID NO: 295928 - DNA, 25 bp, Rattus norvegicus
gaactcatggttaagaaattgcctt

SEQ ID NO: 295929 - DNA, 25 bp, Rattus norvegicus
gaactcatggtttagaaattgcctt

SEQ ID NO: 295930 - DNA, 25 bp, Rattus norvegicus
gaactcatgttgcagattctcagaa

SEQ ID NO: 295931 - DNA, 25 bp, Rattus norvegicus
gaactcatgttggagattctcagaa

SEQ ID NO: 295932 - DNA, 25 bp, Rattus norvegicus
gaactcatgtttaaggagccacagt

SEQ ID NO: 295933 - DNA, 25 bp, Rattus norvegicus
gaactcatgtttctgtagcaattgc

SEQ ID NO: 295934 - DNA, 25 bp, Rattus norvegicus
gaactcatgtttgtgtagcaattgc

SEQ ID NO: 295935 - DNA, 25 bp, Rattus norvegicus
gaactcatgttttaggagccacagt

SEQ ID NO: 295936 - DNA, 25 bp, Rattus norvegicus
gaactcattcacctacagtagcaga

SEQ ID NO: 295937 - DNA, 25 bp, Rattus norvegicus
gaactcattcacgtacagtagcaga

SEQ ID NO: 295938 - DNA, 25 bp, Rattus norvegicus
gaactcattctgaagcctgggctgg

SEQ ID NO: 295939 - DNA, 25 bp, Rattus norvegicus
gaactcattctgtagcctgggctgg

SEQ ID NO: 295940 - DNA, 25 bp, Rattus norvegicus
gaactcatttctattcagtaggcac

SEQ ID NO: 295941 - DNA, 25 bp, Rattus norvegicus
gaactcatttcttttcagtaggcac

SEQ ID NO: 295942 - DNA, 25 bp, Rattus norvegicus
gaactcattttcaaatttccagtaa

SEQ ID NO: 295943 - DNA, 25 bp, Rattus norvegicus
gaactcattttctaatttccagtaa

SEQ ID NO: 295944 - DNA, 25 bp, Rattus norvegicus
gaactccaaggcaaaccacaacatt

SEQ ID NO: 295945 - DNA, 25 bp, Rattus norvegicus
gaactccaaggctaaccacaacatt

SEQ ID NO: 295946 - DNA, 25 bp, Rattus norvegicus
gaactccaatccaggctgatgcaga

SEQ ID NO: 295947 - DNA, 25 bp, Rattus norvegicus
gaactccaatcctggctgatgcaga

SEQ ID NO: 295948 - DNA, 25 bp, Rattus norvegicus
gaactccaatgactcaggctctaag

SEQ ID NO: 295949 - DNA, 25 bp, Rattus norvegicus
gaactccaatgagtcaggctctaag

SEQ ID NO: 295950 - DNA, 25 bp, Rattus norvegicus
gaactccacagaaggcagctcttgc

SEQ ID NO: 295951 - DNA, 25 bp, Rattus norvegicus
gaactccacagatggcagctcttgc

SEQ ID NO: 295952 - DNA, 25 bp, Rattus norvegicus
gaactccacaggcttaccaggaact

SEQ ID NO: 295953 - DNA, 25 bp, Rattus norvegicus
gaactccacagggttaccaggaact

SEQ ID NO: 295954 - DNA, 25 bp, Rattus norvegicus
gaactccacagtaataccacttgat

SEQ ID NO: 295955 - DNA, 25 bp, Rattus norvegicus
gaactccacagttataccacttgat

SEQ ID NO: 295956 - DNA, 25 bp, Rattus norvegicus
gaactccactacatttctagatcag

SEQ ID NO: 295957 - DNA, 25 bp, Rattus norvegicus
gaactccactacttttctagatcag

SEQ ID NO: 295958 - DNA, 25 bp, Rattus norvegicus
gaactccactcactgaaccttgtgt

SEQ ID NO: 295959 - DNA, 25 bp, Rattus norvegicus
gaactccactcagtgaaccttgtgt

SEQ ID NO: 295960 - DNA, 25 bp, Rattus norvegicus
gaactccagaaactacggaaggctg

SEQ ID NO: 295961 - DNA, 25 bp, Rattus norvegicus
gaactccagaaagtacggaaggctg

SEQ ID NO: 295962 - DNA, 25 bp, Rattus norvegicus
gaactccagaacaactccctttcta

SEQ ID NO: 295963 - DNA, 25 bp, Rattus norvegicus
gaactccagaactactccctttcta

SEQ ID NO: 295964 - DNA, 25 bp, Rattus norvegicus
gaactccagagaatccagcaaatag

SEQ ID NO: 295965 - DNA, 25 bp, Rattus norvegicus
gaactccagagactaagtacttgct

SEQ ID NO: 295966 - DNA, 25 bp, Rattus norvegicus
gaactccagagagtaagtacttgct

SEQ ID NO: 295967 - DNA, 25 bp, Rattus norvegicus
gaactccagagattccagcaaatag

SEQ ID NO: 295968 - DNA, 25 bp, Rattus norvegicus
gaactccagatacccaagttctctg

SEQ ID NO: 295969 - DNA, 25 bp, Rattus norvegicus
gaactccagatagccaagttctctg

SEQ ID NO: 295970 - DNA, 25 bp, Rattus norvegicus
gaactccagctgaaagacgtcgtaa

SEQ ID NO: 295971 - DNA, 25 bp, Rattus norvegicus
gaactccagctgtaagacgtcgtaa

SEQ ID NO: 295972 - DNA, 25 bp, Rattus norvegicus
gaactccagcttccgaggatccaat

SEQ ID NO: 295973 - DNA, 25 bp, Rattus norvegicus
gaactccagcttgcgaggatccaat

SEQ ID NO: 295974 - DNA, 25 bp, Rattus norvegicus
gaactccaggagactttatttgcaa

SEQ ID NO: 295975 - DNA, 25 bp, Rattus norvegicus
gaactccaggagtctttatttgcaa

SEQ ID NO: 295976 - DNA, 25 bp, Rattus norvegicus
gaactccagtatacacctgtgtctg

SEQ ID NO: 295977 - DNA, 25 bp, Rattus norvegicus
gaactccagtattcacctgtgtctg

SEQ ID NO: 295978 - DNA, 25 bp, Rattus norvegicus
gaactccagtcaagcttctagaatg

SEQ ID NO: 295979 - DNA, 25 bp, Rattus norvegicus
gaactccagtcatgcttctagaatg

SEQ ID NO: 295980 - DNA, 25 bp, Rattus norvegicus
gaactccatatgaagcacaccaggc

SEQ ID NO: 295981 - DNA, 25 bp, Rattus norvegicus
gaactccatatgtagcacaccaggc

SEQ ID NO: 295982 - DNA, 25 bp, Rattus norvegicus
gaactccatcctatgtaactgattg

SEQ ID NO: 295983 - DNA, 25 bp, Rattus norvegicus
gaactccatcctttgtaactgattg

SEQ ID NO: 295984 - DNA, 25 bp, Rattus norvegicus
gaactccatctcaggattcctttat

SEQ ID NO: 295985 - DNA, 25 bp, Rattus norvegicus
gaactccatctctggattcctttat

SEQ ID NO: 295986 - DNA, 25 bp, Rattus norvegicus
gaactccatgttatgcttgcaataa

SEQ ID NO: 295987 - DNA, 25 bp, Rattus norvegicus
gaactccatgttttgcttgcaataa

SEQ ID NO: 295988 - DNA, 25 bp, Rattus norvegicus
gaactccattgtccaagtgacccgt

SEQ ID NO: 295989 - DNA, 25 bp, Rattus norvegicus
gaactccattgtgcaagtgacccgt

SEQ ID NO: 295990 - DNA, 25 bp, Rattus norvegicus
gaactcccataacattctccaagag

SEQ ID NO: 295991 - DNA, 25 bp, Rattus norvegicus
gaactcccataagattctccaagag

SEQ ID NO: 295992 - DNA, 25 bp, Rattus norvegicus
gaactcccattactttgtgatacct

SEQ ID NO: 295993 - DNA, 25 bp, Rattus norvegicus
gaactcccattagtttgtgatacct

SEQ ID NO: 295994 - DNA, 25 bp, Rattus norvegicus
gaactcccgaaacactaatgccaaa

SEQ ID NO: 295995 - DNA, 25 bp, Rattus norvegicus
gaactcccgaaagactaatgccaaa

SEQ ID NO: 295996 - DNA, 25 bp, Rattus norvegicus
gaactcccgaacactcaacagtggt

SEQ ID NO: 295997 - DNA, 25 bp, Rattus norvegicus
gaactcccgaactctcaacagtggt

SEQ ID NO: 295998 - DNA, 25 bp, Rattus norvegicus
gaactcccggagcacaagtgctaga

SEQ ID NO: 295999 - DNA, 25 bp, Rattus norvegicus
gaactcccggaggacaagtgctaga

SEQ ID NO: 296000 - DNA, 25 bp, Rattus norvegicus
gaactccctggaatatccctgagaa

SEQ ID NO: 296001 - DNA, 25 bp, Rattus norvegicus
gaactccctggattatccctgagaa

SEQ ID NO: 296002 - DNA, 25 bp, Rattus norvegicus
gaactccctggtacaagggctctag

SEQ ID NO: 296003 - DNA, 25 bp, Rattus norvegicus
gaactccctggttcaagggctctag

SEQ ID NO: 296004 - DNA, 25 bp, Rattus norvegicus
gaactccgcagcagctacttgagca

SEQ ID NO: 296005 - DNA, 25 bp, Rattus norvegicus
gaactccgcagctgctacttgagca

SEQ ID NO: 296006 - DNA, 25 bp, Rattus norvegicus
gaactccgcctgagagaagccaatg

SEQ ID NO: 296007 - DNA, 25 bp, Rattus norvegicus
gaactccgcctgtgagaagccaatg

SEQ ID NO: 296008 - DNA, 25 bp, Rattus norvegicus
gaactccgggagaggaagatcctta

SEQ ID NO: 296009 - DNA, 25 bp, Rattus norvegicus
gaactccgggagtggaagatcctta

SEQ ID NO: 296010 - DNA, 25 bp, Rattus norvegicus
gaactccgtctgattaacacttcag

SEQ ID NO: 296011 - DNA, 25 bp, Rattus norvegicus
gaactccgtctgtttaacacttcag

SEQ ID NO: 296012 - DNA, 25 bp, Rattus norvegicus
gaactcctacaactgataaataact

SEQ ID NO: 296013 - DNA, 25 bp, Rattus norvegicus
gaactcctacaagtgataaataact

SEQ ID NO: 296014 - DNA, 25 bp, Rattus norvegicus
gaactcctacgcagcgccagtggta

SEQ ID NO: 296015 - DNA, 25 bp, Rattus norvegicus
gaactcctacgctgcgccagtggta

SEQ ID NO: 296016 - DNA, 25 bp, Rattus norvegicus
gaactcctatttaaacgcctgtgac

SEQ ID NO: 296017 - DNA, 25 bp, Rattus norvegicus
gaactcctattttaacgcctgtgac

SEQ ID NO: 296018 - DNA, 25 bp, Rattus norvegicus
gaactcctcatactgcatgcagtgg

SEQ ID NO: 296019 - DNA, 25 bp, Rattus norvegicus
gaactcctcatagtgcatgcagtgg

SEQ ID NO: 296020 - DNA, 25 bp, Rattus norvegicus
gaactcctccacataagagacacag

SEQ ID NO: 296021 - DNA, 25 bp, Rattus norvegicus
gaactcctccacttaagagacacag

SEQ ID NO: 296022 - DNA, 25 bp, Rattus norvegicus
gaactcctcggaccagtttgagaag

SEQ ID NO: 296023 - DNA, 25 bp, Rattus norvegicus
gaactcctcggagcagtttgagaag

SEQ ID NO: 296024 - DNA, 25 bp, Rattus norvegicus
gaactcctgaagcaacaccagacac

SEQ ID NO: 296025 - DNA, 25 bp, Rattus norvegicus
gaactcctgaaggaacaccagacac

SEQ ID NO: 296026 - DNA, 25 bp, Rattus norvegicus
gaactcctgacaagcatttttctaa

SEQ ID NO: 296027 - DNA, 25 bp, Rattus norvegicus
gaactcctgacatgcatttttctaa

SEQ ID NO: 296028 - DNA, 25 bp, Rattus norvegicus
gaactcctgagcctacaagacaaca

SEQ ID NO: 296029 - DNA, 25 bp, Rattus norvegicus
gaactcctgagcgtacaagacaaca

SEQ ID NO: 296030 - DNA, 25 bp, Rattus norvegicus
gaactcctgagtatgttaagctata

SEQ ID NO: 296031 - DNA, 25 bp, Rattus norvegicus
gaactcctgagtttgttaagctata

SEQ ID NO: 296032 - DNA, 25 bp, Rattus norvegicus
gaactcctgataagtgtccaaatgg

SEQ ID NO: 296033 - DNA, 25 bp, Rattus norvegicus
gaactcctgatatgtgtccaaatgg

SEQ ID NO: 296034 - DNA, 25 bp, Rattus norvegicus
gaactcctgcataactgtgacgggc

SEQ ID NO: 296035 - DNA, 25 bp, Rattus norvegicus
gaactcctgcattactgtgacgggc

SEQ ID NO: 296036 - DNA, 25 bp, Rattus norvegicus
gaactcctgcccagttttcttttgg

SEQ ID NO: 296037 - DNA, 25 bp, Rattus norvegicus
gaactcctgccctgttttcttttgg

SEQ ID NO: 296038 - DNA, 25 bp, Rattus norvegicus
gaactcctggcgctagaggtcagca

SEQ ID NO: 296039 - DNA, 25 bp, Rattus norvegicus
gaactcctggcggtagaggtcagca

SEQ ID NO: 296040 - DNA, 25 bp, Rattus norvegicus
gaactcctgtgtctaaaactcctgc

SEQ ID NO: 296041 - DNA, 25 bp, Rattus norvegicus
gaactcctgtgtgtaaaactcctgc

SEQ ID NO: 296042 - DNA, 25 bp, Rattus norvegicus
gaactccttaatacttttttctgct

SEQ ID NO: 296043 - DNA, 25 bp, Rattus norvegicus
gaactccttaattcttttttctgct

SEQ ID NO: 296044 - DNA, 25 bp, Rattus norvegicus
gaactccttattacacgtggtgcag

SEQ ID NO: 296045 - DNA, 25 bp, Rattus norvegicus
gaactccttatttcacgtggtgcag

SEQ ID NO: 296046 - DNA, 25 bp, Rattus norvegicus
gaactccttcacaccctgtgaatat

SEQ ID NO: 296047 - DNA, 25 bp, Rattus norvegicus
gaactccttcactccctgtgaatat

SEQ ID NO: 296048 - DNA, 25 bp, Rattus norvegicus
gaactccttgggaagattattgaat

SEQ ID NO: 296049 - DNA, 25 bp, Rattus norvegicus
gaactccttgggtagattattgaat

SEQ ID NO: 296050 - DNA, 25 bp, Rattus norvegicus
gaactcgacagtcgagatgacgtca

SEQ ID NO: 296051 - DNA, 25 bp, Rattus norvegicus
gaactcgacagtggagatgacgtca

SEQ ID NO: 296052 - DNA, 25 bp, Rattus norvegicus
gaactcgaccttctaaaacactgta

SEQ ID NO: 296053 - DNA, 25 bp, Rattus norvegicus
gaactcgaccttgtaaaacactgta

SEQ ID NO: 296054 - DNA, 25 bp, Rattus norvegicus
gaactcgagaagattctggcccatt

SEQ ID NO: 296055 - DNA, 25 bp, Rattus norvegicus
gaactcgagaagtttctggcccatt

SEQ ID NO: 296056 - DNA, 25 bp, Rattus norvegicus
gaactcgagactaggcaggacacta

SEQ ID NO: 296057 - DNA, 25 bp, Rattus norvegicus
gaactcgagacttggcaggacacta

SEQ ID NO: 296058 - DNA, 25 bp, Rattus norvegicus
gaactcgagagtatggctgcgctga

SEQ ID NO: 296059 - DNA, 25 bp, Rattus norvegicus
gaactcgagagtttggctgcgctga

SEQ ID NO: 296060 - DNA, 25 bp, Rattus norvegicus
gaactcgatatcactgggcagtcac

SEQ ID NO: 296061 - DNA, 25 bp, Rattus norvegicus
gaactcgatatctctgggcagtcac

SEQ ID NO: 296062 - DNA, 25 bp, Rattus norvegicus
gaactcgattgtattgccttcaccc

SEQ ID NO: 296063 - DNA, 25 bp, Rattus norvegicus
gaactcgattgttttgccttcaccc

SEQ ID NO: 296064 - DNA, 25 bp, Rattus norvegicus
gaactcgcaccaaatatttctcatt

SEQ ID NO: 296065 - DNA, 25 bp, Rattus norvegicus
gaactcgcaccatatatttctcatt

SEQ ID NO: 296066 - DNA, 25 bp, Rattus norvegicus
gaactcgcggttattgccggtccag

SEQ ID NO: 296067 - DNA, 25 bp, Rattus norvegicus
gaactcgcggtttttgccggtccag

SEQ ID NO: 296068 - DNA, 25 bp, Rattus norvegicus
gaactcgctgtgatagggaaactgt

SEQ ID NO: 296069 - DNA, 25 bp, Rattus norvegicus
gaactcgctgtgttagggaaactgt

SEQ ID NO: 296070 - DNA, 25 bp, Rattus norvegicus
gaactcgctgttataacttctgcaa

SEQ ID NO: 296071 - DNA, 25 bp, Rattus norvegicus
gaactcgctgttttaacttctgcaa

SEQ ID NO: 296072 - DNA, 25 bp, Rattus norvegicus
gaactcggaagacggccttggccca

SEQ ID NO: 296073 - DNA, 25 bp, Rattus norvegicus
gaactcggaagagggccttggccca

SEQ ID NO: 296074 - DNA, 25 bp, Rattus norvegicus
gaactcggaattagaacctaataca

SEQ ID NO: 296075 - DNA, 25 bp, Rattus norvegicus
gaactcggaatttgaacctaataca

SEQ ID NO: 296076 - DNA, 25 bp, Rattus norvegicus
gaactcggacaaacttttccagcgg

SEQ ID NO: 296077 - DNA, 25 bp, Rattus norvegicus
gaactcggacaatcttttccagcgg

SEQ ID NO: 296078 - DNA, 25 bp, Rattus norvegicus
gaactcggcgagcacagtcctgtga

SEQ ID NO: 296079 - DNA, 25 bp, Rattus norvegicus
gaactcggcgaggacagtcctgtga

SEQ ID NO: 296080 - DNA, 25 bp, Rattus norvegicus
gaactcgggatcaggtttaccagaa

SEQ ID NO: 296081 - DNA, 25 bp, Rattus norvegicus
gaactcgggatctggtttaccagaa

SEQ ID NO: 296082 - DNA, 25 bp, Rattus norvegicus
gaactcgggctgcagagtgcctcaa

SEQ ID NO: 296083 - DNA, 25 bp, Rattus norvegicus
gaactcgggctggagagtgcctcaa

SEQ ID NO: 296084 - DNA, 25 bp, Rattus norvegicus
gaactcgggtctataggcttggttg

SEQ ID NO: 296085 - DNA, 25 bp, Rattus norvegicus
gaactcgggtctttaggcttggttg

SEQ ID NO: 296086 - DNA, 25 bp, Rattus norvegicus
gaactcgtgccccttaaatacatgt

SEQ ID NO: 296087 - DNA, 25 bp, Rattus norvegicus
gaactcgtgcccgttaaatacatgt

SEQ ID NO: 296088 - DNA, 25 bp, Rattus norvegicus
gaactcgtgcttccttttaaggtgc

SEQ ID NO: 296089 - DNA, 25 bp, Rattus norvegicus
gaactcgtgcttgcttttaaggtgc

SEQ ID NO: 296090 - DNA, 25 bp, Rattus norvegicus
gaactcgtgtagatctacccgctag

SEQ ID NO: 296091 - DNA, 25 bp, Rattus norvegicus
gaactcgtgtagttctacccgctag

SEQ ID NO: 296092 - DNA, 25 bp, Rattus norvegicus
gaactcgttaggcttcatgtgggaa

SEQ ID NO: 296093 - DNA, 25 bp, Rattus norvegicus
gaactcgttagggttcatgtgggaa

SEQ ID NO: 296094 - DNA, 25 bp, Rattus norvegicus
gaactcgttattctatccgctaaaa

SEQ ID NO: 296095 - DNA, 25 bp, Rattus norvegicus
gaactcgttattgtatccgctaaaa

SEQ ID NO: 296096 - DNA, 25 bp, Rattus norvegicus
gaactcgttctcacatatgtagctt

SEQ ID NO: 296097 - DNA, 25 bp, Rattus norvegicus
gaactcgttctctcatatgtagctt

SEQ ID NO: 296098 - DNA, 25 bp, Rattus norvegicus
gaactcgtttaacatggcagctgca

SEQ ID NO: 296099 - DNA, 25 bp, Rattus norvegicus
gaactcgtttaagatggcagctgca

SEQ ID NO: 296100 - DNA, 25 bp, Rattus norvegicus
gaactctaaagcacttgcaacgaca

SEQ ID NO: 296101 - DNA, 25 bp, Rattus norvegicus
gaactctaaagctcttgcaacgaca

SEQ ID NO: 296102 - DNA, 25 bp, Rattus norvegicus
gaactctaacttagttccggtcagt

SEQ ID NO: 296103 - DNA, 25 bp, Rattus norvegicus
gaactctaactttgttccggtcagt

SEQ ID NO: 296104 - DNA, 25 bp, Rattus norvegicus
gaactctaatgaacagtcactcgcc

SEQ ID NO: 296105 - DNA, 25 bp, Rattus norvegicus
gaactctaatgatcagtcactcgcc

SEQ ID NO: 296106 - DNA, 25 bp, Rattus norvegicus
gaactctacaaaactaagccccgat

SEQ ID NO: 296107 - DNA, 25 bp, Rattus norvegicus
gaactctacaaatctaagccccgat

SEQ ID NO: 296108 - DNA, 25 bp, Rattus norvegicus
gaactctactctaaccattttattt

SEQ ID NO: 296109 - DNA, 25 bp, Rattus norvegicus
gaactctactcttaccattttattt

SEQ ID NO: 296110 - DNA, 25 bp, Rattus norvegicus
gaactctagcacagacgatgagaac

SEQ ID NO: 296111 - DNA, 25 bp, Rattus norvegicus
gaactctagcactgacgatgagaac

SEQ ID NO: 296112 - DNA, 25 bp, Rattus norvegicus
gaactctaggccatatcagctttgt

SEQ ID NO: 296113 - DNA, 25 bp, Rattus norvegicus
gaactctaggccttatcagctttgt

SEQ ID NO: 296114 - DNA, 25 bp, Rattus norvegicus
gaactctagggcaaccaccttagga

SEQ ID NO: 296115 - DNA, 25 bp, Rattus norvegicus
gaactctagggctaccaccttagga

SEQ ID NO: 296116 - DNA, 25 bp, Rattus norvegicus
gaactctagtacatgtagctcctct

SEQ ID NO: 296117 - DNA, 25 bp, Rattus norvegicus
gaactctagtacttgtagctcctct

SEQ ID NO: 296118 - DNA, 25 bp, Rattus norvegicus
gaactctagtccctgaatactgtct

SEQ ID NO: 296119 - DNA, 25 bp, Rattus norvegicus
gaactctagtccgtgaatactgtct

SEQ ID NO: 296120 - DNA, 25 bp, Rattus norvegicus
gaactctatgagactgagggcaaga

SEQ ID NO: 296121 - DNA, 25 bp, Rattus norvegicus
gaactctatgagtctgagggcaaga

SEQ ID NO: 296122 - DNA, 25 bp, Rattus norvegicus
gaactctatgggaatctcagtgctg

SEQ ID NO: 296123 - DNA, 25 bp, Rattus norvegicus
gaactctatgggtatctcagtgctg

SEQ ID NO: 296124 - DNA, 25 bp, Rattus norvegicus
gaactctcaatcctgaatgtttatg

SEQ ID NO: 296125 - DNA, 25 bp, Rattus norvegicus
gaactctcaatcgtgaatgtttatg

SEQ ID NO: 296126 - DNA, 25 bp, Rattus norvegicus
gaactctcacagcactgggccagag

SEQ ID NO: 296127 - DNA, 25 bp, Rattus norvegicus
gaactctcacaggactgggccagag

SEQ ID NO: 296128 - DNA, 25 bp, Rattus norvegicus
gaactctcagttctagtcttttttg

SEQ ID NO: 296129 - DNA, 25 bp, Rattus norvegicus
gaactctcagttgtagtcttttttg

SEQ ID NO: 296130 - DNA, 25 bp, Rattus norvegicus
gaactctcatggcagcttgctttca

SEQ ID NO: 296131 - DNA, 25 bp, Rattus norvegicus
gaactctcatgggagcttgctttca

SEQ ID NO: 296132 - DNA, 25 bp, Rattus norvegicus
gaactctcattgagcatggtctgac

SEQ ID NO: 296133 - DNA, 25 bp, Rattus norvegicus
gaactctcattgtgcatggtctgac

SEQ ID NO: 296134 - DNA, 25 bp, Rattus norvegicus
gaactctccaagactacttctgtca

SEQ ID NO: 296135 - DNA, 25 bp, Rattus norvegicus
gaactctccaagtctacttctgtca

SEQ ID NO: 296136 - DNA, 25 bp, Rattus norvegicus
gaactctccagaatgtgctgctgtc

SEQ ID NO: 296137 - DNA, 25 bp, Rattus norvegicus
gaactctccagattgtgctgctgtc

SEQ ID NO: 296138 - DNA, 25 bp, Rattus norvegicus
gaactctccaggacatgtcgagtct

SEQ ID NO: 296139 - DNA, 25 bp, Rattus norvegicus
gaactctccaggtcatgtcgagtct

SEQ ID NO: 296140 - DNA, 25 bp, Rattus norvegicus
gaactctccattcttcagacaagtg

SEQ ID NO: 296141 - DNA, 25 bp, Rattus norvegicus
gaactctccattgttcagacaagtg

SEQ ID NO: 296142 - DNA, 25 bp, Rattus norvegicus
gaactctccctacagacagtaccag

SEQ ID NO: 296143 - DNA, 25 bp, Rattus norvegicus
gaactctccctagagacagtaccag

SEQ ID NO: 296144 - DNA, 25 bp, Rattus norvegicus
gaactctcctcacgacttcttgtgt

SEQ ID NO: 296145 - DNA, 25 bp, Rattus norvegicus
gaactctcctcaggacttcttgtgt

SEQ ID NO: 296146 - DNA, 25 bp, Rattus norvegicus
gaactctcggagaaacttcaaatca

SEQ ID NO: 296147 - DNA, 25 bp, Rattus norvegicus
gaactctcggagtaacttcaaatca

SEQ ID NO: 296148 - DNA, 25 bp, Rattus norvegicus
gaactctcggttcccaaagctagaa

SEQ ID NO: 296149 - DNA, 25 bp, Rattus norvegicus
gaactctcggttgccaaagctagaa

SEQ ID NO: 296150 - DNA, 25 bp, Rattus norvegicus
gaactctctaaactgtctccatttt

SEQ ID NO: 296151 - DNA, 25 bp, Rattus norvegicus
gaactctctaaagtgtctccatttt

SEQ ID NO: 296152 - DNA, 25 bp, Rattus norvegicus
gaactctctgagaggcagcagcacc

SEQ ID NO: 296153 - DNA, 25 bp, Rattus norvegicus
gaactctctgagtggcagcagcacc

SEQ ID NO: 296154 - DNA, 25 bp, Rattus norvegicus
gaactctctgatctgagggacctac

SEQ ID NO: 296155 - DNA, 25 bp, Rattus norvegicus
gaactctctgatctgttagacaccg

SEQ ID NO: 296156 - DNA, 25 bp, Rattus norvegicus
gaactctctgatgtgagggacctac

SEQ ID NO: 296157 - DNA, 25 bp, Rattus norvegicus
gaactctctgatgtgttagacaccg

SEQ ID NO: 296158 - DNA, 25 bp, Rattus norvegicus
gaactctcttccaaatgtttcactc

SEQ ID NO: 296159 - DNA, 25 bp, Rattus norvegicus
gaactctcttcctaatgtttcactc

SEQ ID NO: 296160 - DNA, 25 bp, Rattus norvegicus
gaactctcttgcctcttttaaacat

SEQ ID NO: 296161 - DNA, 25 bp, Rattus norvegicus
gaactctcttgcgtcttttaaacat

SEQ ID NO: 296162 - DNA, 25 bp, Rattus norvegicus
gaactctctttaccttatgggttta

SEQ ID NO: 296163 - DNA, 25 bp, Rattus norvegicus
gaactctctttactttgtcgggtag

SEQ ID NO: 296164 - DNA, 25 bp, Rattus norvegicus
gaactctctttagcttatgggttta

SEQ ID NO: 296165 - DNA, 25 bp, Rattus norvegicus
gaactctctttagtttgtcgggtag

SEQ ID NO: 296166 - DNA, 25 bp, Rattus norvegicus
gaactctctttcatagatggtttag

SEQ ID NO: 296167 - DNA, 25 bp, Rattus norvegicus
gaactctctttcttagatggtttag

SEQ ID NO: 296168 - DNA, 25 bp, Rattus norvegicus
gaactctcttttccttgttgcatca

SEQ ID NO: 296169 - DNA, 25 bp, Rattus norvegicus
gaactctcttttgcttgttgcatca

SEQ ID NO: 296170 - DNA, 25 bp, Rattus norvegicus
gaactctgaaagctaggcacatcat

SEQ ID NO: 296171 - DNA, 25 bp, Rattus norvegicus
gaactctgaaaggtaggcacatcat

SEQ ID NO: 296172 - DNA, 25 bp, Rattus norvegicus
gaactctgaactcgaagatctctgt

SEQ ID NO: 296173 - DNA, 25 bp, Rattus norvegicus
gaactctgaactggaagatctctgt

SEQ ID NO: 296174 - DNA, 25 bp, Rattus norvegicus
gaactctgaattcttttgtgcacat

SEQ ID NO: 296175 - DNA, 25 bp, Rattus norvegicus
gaactctgaattgttttgtgcacat

SEQ ID NO: 296176 - DNA, 25 bp, Rattus norvegicus
gaactctgacgcattaatgcctcaa

SEQ ID NO: 296177 - DNA, 25 bp, Rattus norvegicus
gaactctgacgctttaatgcctcaa

SEQ ID NO: 296178 - DNA, 25 bp, Rattus norvegicus
gaactctgagcaagcacggagtcgt

SEQ ID NO: 296179 - DNA, 25 bp, Rattus norvegicus
gaactctgagcatgcacggagtcgt

SEQ ID NO: 296180 - DNA, 25 bp, Rattus norvegicus
gaactctgagtaccaagctgtggct

SEQ ID NO: 296181 - DNA, 25 bp, Rattus norvegicus
gaactctgagtagcaagctgtggct

SEQ ID NO: 296182 - DNA, 25 bp, Rattus norvegicus
gaactctgagtcagggtacatcctt

SEQ ID NO: 296183 - DNA, 25 bp, Rattus norvegicus
gaactctgagtctgggtacatcctt

SEQ ID NO: 296184 - DNA, 25 bp, Rattus norvegicus
gaactctgagtgagacttggcatca

SEQ ID NO: 296185 - DNA, 25 bp, Rattus norvegicus
gaactctgagtgcatgcgttgtact

SEQ ID NO: 296186 - DNA, 25 bp, Rattus norvegicus
gaactctgagtggatgcgttgtact

SEQ ID NO: 296187 - DNA, 25 bp, Rattus norvegicus
gaactctgagtgtgacttggcatca

SEQ ID NO: 296188 - DNA, 25 bp, Rattus norvegicus
gaactctgatcaaacggtctcatga

SEQ ID NO: 296189 - DNA, 25 bp, Rattus norvegicus
gaactctgatcaccacagactgcct

SEQ ID NO: 296190 - DNA, 25 bp, Rattus norvegicus
gaactctgatcagcacagactgcct

SEQ ID NO: 296191 - DNA, 25 bp, Rattus norvegicus
gaactctgatcatacggtctcatga

SEQ ID NO: 296192 - DNA, 25 bp, Rattus norvegicus
gaactctgatccatgtgcatgctaa

SEQ ID NO: 296193 - DNA, 25 bp, Rattus norvegicus
gaactctgatccttgtgcatgctaa

SEQ ID NO: 296194 - DNA, 25 bp, Rattus norvegicus
gaactctgatgtatatctctgcctc

SEQ ID NO: 296195 - DNA, 25 bp, Rattus norvegicus
gaactctgatgtttatctctgcctc

SEQ ID NO: 296196 - DNA, 25 bp, Rattus norvegicus
gaactctgatttataccagctctag

SEQ ID NO: 296197 - DNA, 25 bp, Rattus norvegicus
gaactctgatttttaccagctctag

SEQ ID NO: 296198 - DNA, 25 bp, Rattus norvegicus
gaactctgcaagcaggacaccacct

SEQ ID NO: 296199 - DNA, 25 bp, Rattus norvegicus
gaactctgcaaggaggacaccacct

SEQ ID NO: 296200 - DNA, 25 bp, Rattus norvegicus
gaactctgcatcatgtcacaggagg

SEQ ID NO: 296201 - DNA, 25 bp, Rattus norvegicus
gaactctgcatcttgtcacaggagg

SEQ ID NO: 296202 - DNA, 25 bp, Rattus norvegicus
gaactctgcggcaacaacaacgtta

SEQ ID NO: 296203 - DNA, 25 bp, Rattus norvegicus
gaactctgcggctacaacaacgtta

SEQ ID NO: 296204 - DNA, 25 bp, Rattus norvegicus
gaactctgctgaagggctgctgaaa

SEQ ID NO: 296205 - DNA, 25 bp, Rattus norvegicus
gaactctgctgatgggctgctgaaa

SEQ ID NO: 296206 - DNA, 25 bp, Rattus norvegicus
gaactctggagtagagtcgccaccg

SEQ ID NO: 296207 - DNA, 25 bp, Rattus norvegicus
gaactctggagttgagtcgccaccg

SEQ ID NO: 296208 - DNA, 25 bp, Rattus norvegicus
gaactctggattcgaggcaccggaa

SEQ ID NO: 296209 - DNA, 25 bp, Rattus norvegicus
gaactctggattggaggcaccggaa

SEQ ID NO: 296210 - DNA, 25 bp, Rattus norvegicus
gaactctggccaacattggaattgt

SEQ ID NO: 296211 - DNA, 25 bp, Rattus norvegicus
gaactctggccacctcaaagctgta

SEQ ID NO: 296212 - DNA, 25 bp, Rattus norvegicus
gaactctggccagctcaaagctgta

SEQ ID NO: 296213 - DNA, 25 bp, Rattus norvegicus
gaactctggccatcattggaattgt

SEQ ID NO: 296214 - DNA, 25 bp, Rattus norvegicus
gaactctggcttacatgtcagtgtg

SEQ ID NO: 296215 - DNA, 25 bp, Rattus norvegicus
gaactctggcttcgttcagctgccg

SEQ ID NO: 296216 - DNA, 25 bp, Rattus norvegicus
gaactctggcttggttcagctgccg

SEQ ID NO: 296217 - DNA, 25 bp, Rattus norvegicus
gaactctggctttcatgtcagtgtg

SEQ ID NO: 296218 - DNA, 25 bp, Rattus norvegicus
gaactctgggcaagacgacaaacga

SEQ ID NO: 296219 - DNA, 25 bp, Rattus norvegicus
gaactctgggcatgacgacaaacga

SEQ ID NO: 296220 - DNA, 25 bp, Rattus norvegicus
gaactctgggttctctgacatttac

SEQ ID NO: 296221 - DNA, 25 bp, Rattus norvegicus
gaactctgggttgtctgacatttac

SEQ ID NO: 296222 - DNA, 25 bp, Rattus norvegicus
gaactctggtcaagtgacacctcca

SEQ ID NO: 296223 - DNA, 25 bp, Rattus norvegicus
gaactctggtcatgtgacacctcca

SEQ ID NO: 296224 - DNA, 25 bp, Rattus norvegicus
gaactctggtgcatctatagggctc

SEQ ID NO: 296225 - DNA, 25 bp, Rattus norvegicus
gaactctggtgcttctatagggctc

SEQ ID NO: 296226 - DNA, 25 bp, Rattus norvegicus
gaactctggtggaggtcagccaaca

SEQ ID NO: 296227 - DNA, 25 bp, Rattus norvegicus
gaactctggtggtggtcagccaaca

SEQ ID NO: 296228 - DNA, 25 bp, Rattus norvegicus
gaactctgtagtagacccatttgat

SEQ ID NO: 296229 - DNA, 25 bp, Rattus norvegicus
gaactctgtagttgacccatttgat

SEQ ID NO: 296230 - DNA, 25 bp, Rattus norvegicus
gaactctgtattatgctgtactgaa

SEQ ID NO: 296231 - DNA, 25 bp, Rattus norvegicus
gaactctgtattttgctgtactgaa

SEQ ID NO: 296232 - DNA, 25 bp, Rattus norvegicus
gaactctgtctactggcaatgggat

SEQ ID NO: 296233 - DNA, 25 bp, Rattus norvegicus
gaactctgtctagtggcaatgggat

SEQ ID NO: 296234 - DNA, 25 bp, Rattus norvegicus
gaactctgtcttcgttgataatctt

SEQ ID NO: 296235 - DNA, 25 bp, Rattus norvegicus
gaactctgtcttggttgataatctt

SEQ ID NO: 296236 - DNA, 25 bp, Rattus norvegicus
gaactctgtgtgcatcatttggaaa

SEQ ID NO: 296237 - DNA, 25 bp, Rattus norvegicus
gaactctgtgtggatcatttggaaa

SEQ ID NO: 296238 - DNA, 25 bp, Rattus norvegicus
gaactctgtgttctattcttcccac

SEQ ID NO: 296239 - DNA, 25 bp, Rattus norvegicus
gaactctgtgttgtattcttcccac

SEQ ID NO: 296240 - DNA, 25 bp, Rattus norvegicus
gaactcttacagatggatgccttat

SEQ ID NO: 296241 - DNA, 25 bp, Rattus norvegicus
gaactcttacagttggatgccttat

SEQ ID NO: 296242 - DNA, 25 bp, Rattus norvegicus
gaactcttactgactaaaccaccaa

SEQ ID NO: 296243 - DNA, 25 bp, Rattus norvegicus
gaactcttactgtctaaaccaccaa

SEQ ID NO: 296244 - DNA, 25 bp, Rattus norvegicus
gaactcttagcactttcaaccttcc

SEQ ID NO: 296245 - DNA, 25 bp, Rattus norvegicus
gaactcttagcagtttcaaccttcc

SEQ ID NO: 296246 - DNA, 25 bp, Rattus norvegicus
gaactcttattgctctctgtatgtc

SEQ ID NO: 296247 - DNA, 25 bp, Rattus norvegicus
gaactcttattggtctctgtatgtc

SEQ ID NO: 296248 - DNA, 25 bp, Rattus norvegicus
gaactcttcaaacaagacagagcgt

SEQ ID NO: 296249 - DNA, 25 bp, Rattus norvegicus
gaactcttcaaagaagacagagcgt

SEQ ID NO: 296250 - DNA, 25 bp, Rattus norvegicus
gaactcttcgggattctgtgacaag

SEQ ID NO: 296251 - DNA, 25 bp, Rattus norvegicus
gaactcttcgggtttctgtgacaag

SEQ ID NO: 296252 - DNA, 25 bp, Rattus norvegicus
gaactcttcgtgcaggccgtggaac

SEQ ID NO: 296253 - DNA, 25 bp, Rattus norvegicus
gaactcttcgtggaggccgtggaac

SEQ ID NO: 296254 - DNA, 25 bp, Rattus norvegicus
gaactcttctaaatgtgggttttca

SEQ ID NO: 296255 - DNA, 25 bp, Rattus norvegicus
gaactcttctaattgtgggttttca

SEQ ID NO: 296256 - DNA, 25 bp, Rattus norvegicus
gaactcttctcaaactgttttctta

SEQ ID NO: 296257 - DNA, 25 bp, Rattus norvegicus
gaactcttctcatactgttttctta

SEQ ID NO: 296258 - DNA, 25 bp, Rattus norvegicus
gaactcttcttcatttctagtaggt

SEQ ID NO: 296259 - DNA, 25 bp, Rattus norvegicus
gaactcttcttcttttctagtaggt

SEQ ID NO: 296260 - DNA, 25 bp, Rattus norvegicus
gaactcttgaacatttcttcattat

SEQ ID NO: 296261 - DNA, 25 bp, Rattus norvegicus
gaactcttgaacttttcttcattat

SEQ ID NO: 296262 - DNA, 25 bp, Rattus norvegicus
gaactcttgactacaaatgccatgt

SEQ ID NO: 296263 - DNA, 25 bp, Rattus norvegicus
gaactcttgacttcaaatgccatgt

SEQ ID NO: 296264 - DNA, 25 bp, Rattus norvegicus
gaactcttgagtattgggacttcta

SEQ ID NO: 296265 - DNA, 25 bp, Rattus norvegicus
gaactcttgagttttgggacttcta

SEQ ID NO: 296266 - DNA, 25 bp, Rattus norvegicus
gaactcttgattatccaggctctat

SEQ ID NO: 296267 - DNA, 25 bp, Rattus norvegicus
gaactcttgattttccaggctctat

SEQ ID NO: 296268 - DNA, 25 bp, Rattus norvegicus
gaactcttgccacatagactctggg

SEQ ID NO: 296269 - DNA, 25 bp, Rattus norvegicus
gaactcttgccagatagactctggg

SEQ ID NO: 296270 - DNA, 25 bp, Rattus norvegicus
gaactcttggaactgctgtcaatca

SEQ ID NO: 296271 - DNA, 25 bp, Rattus norvegicus
gaactcttggaagtgctgtcaatca

SEQ ID NO: 296272 - DNA, 25 bp, Rattus norvegicus
gaactcttggccactgccatatggg

SEQ ID NO: 296273 - DNA, 25 bp, Rattus norvegicus
gaactcttggcctctgccatatggg

SEQ ID NO: 296274 - DNA, 25 bp, Rattus norvegicus
gaactcttgtaaagcttgtcttctg

SEQ ID NO: 296275 - DNA, 25 bp, Rattus norvegicus
gaactcttgtaatgcttgtcttctg

SEQ ID NO: 296276 - DNA, 25 bp, Rattus norvegicus
gaactcttgtgacattagcccatgg

SEQ ID NO: 296277 - DNA, 25 bp, Rattus norvegicus
gaactcttgtgagattagcccatgg

SEQ ID NO: 296278 - DNA, 25 bp, Rattus norvegicus
gaactcttgtgtctacttttatctt

SEQ ID NO: 296279 - DNA, 25 bp, Rattus norvegicus
gaactcttgtgtgtacttttatctt

SEQ ID NO: 296280 - DNA, 25 bp, Rattus norvegicus
gaactctttaccatgaatgcaccag

SEQ ID NO: 296281 - DNA, 25 bp, Rattus norvegicus
gaactctttaccttgaatgcaccag

SEQ ID NO: 296282 - DNA, 25 bp, Rattus norvegicus
gaactctttataaggtggctcattg

SEQ ID NO: 296283 - DNA, 25 bp, Rattus norvegicus
gaactctttatatggtggctcattg

SEQ ID NO: 296284 - DNA, 25 bp, Rattus norvegicus
gaactctttcatataatctctatta

SEQ ID NO: 296285 - DNA, 25 bp, Rattus norvegicus
gaactctttcatttaatctctatta

SEQ ID NO: 296286 - DNA, 25 bp, Rattus norvegicus
gaactctttcctctaagttagcctt

SEQ ID NO: 296287 - DNA, 25 bp, Rattus norvegicus
gaactctttcctgtaagttagcctt

SEQ ID NO: 296288 - DNA, 25 bp, Rattus norvegicus
gaactctttctgaattgctgtctaa

SEQ ID NO: 296289 - DNA, 25 bp, Rattus norvegicus
gaactctttctgtattgctgtctaa

SEQ ID NO: 296290 - DNA, 25 bp, Rattus norvegicus
gaactctttgacaatgcctacgagg

SEQ ID NO: 296291 - DNA, 25 bp, Rattus norvegicus
gaactctttgactatgcctacgagg

SEQ ID NO: 296292 - DNA, 25 bp, Rattus norvegicus
gaactctttgtgcagacattgtgct

SEQ ID NO: 296293 - DNA, 25 bp, Rattus norvegicus
gaactctttgtggagacattgtgct

SEQ ID NO: 296294 - DNA, 25 bp, Rattus norvegicus
gaactgaaaactccctctctagctg

SEQ ID NO: 296295 - DNA, 25 bp, Rattus norvegicus
gaactgaaaactgcctctctagctg

SEQ ID NO: 296296 - DNA, 25 bp, Rattus norvegicus
gaactgaaaataagccccctggttg

SEQ ID NO: 296297 - DNA, 25 bp, Rattus norvegicus
gaactgaaaatatgccccctggttg

SEQ ID NO: 296298 - DNA, 25 bp, Rattus norvegicus
gaactgaaacttcagggacccattg

SEQ ID NO: 296299 - DNA, 25 bp, Rattus norvegicus
gaactgaaacttgagggacccattg

SEQ ID NO: 296300 - DNA, 25 bp, Rattus norvegicus
gaactgaaagccaagatccttagta

SEQ ID NO: 296301 - DNA, 25 bp, Rattus norvegicus
gaactgaaagcctagatccttagta

SEQ ID NO: 296302 - DNA, 25 bp, Rattus norvegicus
gaactgaaagtgagcatggcctcca

SEQ ID NO: 296303 - DNA, 25 bp, Rattus norvegicus
gaactgaaagtgtgcatggcctcca

SEQ ID NO: 296304 - DNA, 25 bp, Rattus norvegicus
gaactgaaatccatgggcccttctg

SEQ ID NO: 296305 - DNA, 25 bp, Rattus norvegicus
gaactgaaatccttgggcccttctg

SEQ ID NO: 296306 - DNA, 25 bp, Rattus norvegicus
gaactgaaattcatgggtcttgcaa

SEQ ID NO: 296307 - DNA, 25 bp, Rattus norvegicus
gaactgaaattcttgggtcttgcaa

SEQ ID NO: 296308 - DNA, 25 bp, Rattus norvegicus
gaactgaaatttacctgtttggagt

SEQ ID NO: 296309 - DNA, 25 bp, Rattus norvegicus
gaactgaaattttcctgtttggagt

SEQ ID NO: 296310 - DNA, 25 bp, Rattus norvegicus
gaactgaacacaattctgtaaccaa

SEQ ID NO: 296311 - DNA, 25 bp, Rattus norvegicus
gaactgaacacatttctgtaaccaa

SEQ ID NO: 296312 - DNA, 25 bp, Rattus norvegicus
gaactgaaccacacagctgagcaca

SEQ ID NO: 296313 - DNA, 25 bp, Rattus norvegicus
gaactgaaccactcagctgagcaca

SEQ ID NO: 296314 - DNA, 25 bp, Rattus norvegicus
gaactgaacccacgtggtcaggctt

SEQ ID NO: 296315 - DNA, 25 bp, Rattus norvegicus
gaactgaacccaggtggtcaggctt

SEQ ID NO: 296316 - DNA, 25 bp, Rattus norvegicus
gaactgaactgccaatgtccgctga

SEQ ID NO: 296317 - DNA, 25 bp, Rattus norvegicus
gaactgaactgcgaatgtccgctga

SEQ ID NO: 296318 - DNA, 25 bp, Rattus norvegicus
gaactgaacttcacactgttgcctt

SEQ ID NO: 296319 - DNA, 25 bp, Rattus norvegicus
gaactgaacttctcactgttgcctt

SEQ ID NO: 296320 - DNA, 25 bp, Rattus norvegicus
gaactgaagaatcctccgtaatttt

SEQ ID NO: 296321 - DNA, 25 bp, Rattus norvegicus
gaactgaagaatgctccgtaatttt

SEQ ID NO: 296322 - DNA, 25 bp, Rattus norvegicus
gaactgaagacaatctcccctaagt

SEQ ID NO: 296323 - DNA, 25 bp, Rattus norvegicus
gaactgaagacattctcccctaagt

SEQ ID NO: 296324 - DNA, 25 bp, Rattus norvegicus
gaactgaagaggacctgtcacccga

SEQ ID NO: 296325 - DNA, 25 bp, Rattus norvegicus
gaactgaagaggtcctgtcacccga

SEQ ID NO: 296326 - DNA, 25 bp, Rattus norvegicus
gaactgaagattacttgcctggcat

SEQ ID NO: 296327 - DNA, 25 bp, Rattus norvegicus
gaactgaagattctcctggccgcga

SEQ ID NO: 296328 - DNA, 25 bp, Rattus norvegicus
gaactgaagattgtcctggccgcga

SEQ ID NO: 296329 - DNA, 25 bp, Rattus norvegicus
gaactgaagatttcttgcctggcat

SEQ ID NO: 296330 - DNA, 25 bp, Rattus norvegicus
gaactgaagccacagcccatgatta

SEQ ID NO: 296331 - DNA, 25 bp, Rattus norvegicus
gaactgaagccagagcccatgatta

SEQ ID NO: 296332 - DNA, 25 bp, Rattus norvegicus
gaactgaaggagacctgcatctttt

SEQ ID NO: 296333 - DNA, 25 bp, Rattus norvegicus
gaactgaaggagtcctgcatctttt

SEQ ID NO: 296334 - DNA, 25 bp, Rattus norvegicus
gaactgaaggcccatcgttaacacc

SEQ ID NO: 296335 - DNA, 25 bp, Rattus norvegicus
gaactgaaggccgatcgttaacacc

SEQ ID NO: 296336 - DNA, 25 bp, Rattus norvegicus
gaactgaagtagcttggcttcctca

SEQ ID NO: 296337 - DNA, 25 bp, Rattus norvegicus
gaactgaagtaggttggcttcctca

SEQ ID NO: 296338 - DNA, 25 bp, Rattus norvegicus
gaactgaagtctaaggccttggcct

SEQ ID NO: 296339 - DNA, 25 bp, Rattus norvegicus
gaactgaagtcttaggccttggcct

SEQ ID NO: 296340 - DNA, 25 bp, Rattus norvegicus
gaactgaagtgactcccggtttcct

SEQ ID NO: 296341 - DNA, 25 bp, Rattus norvegicus
gaactgaagtgagtcccggtttcct

SEQ ID NO: 296342 - DNA, 25 bp, Rattus norvegicus
gaactgaatacaagtggccctacct

SEQ ID NO: 296343 - DNA, 25 bp, Rattus norvegicus
gaactgaatacacacatctatcatg

SEQ ID NO: 296344 - DNA, 25 bp, Rattus norvegicus
gaactgaatacagacatctatcatg

SEQ ID NO: 296345 - DNA, 25 bp, Rattus norvegicus
gaactgaatacatgtggccctacct

SEQ ID NO: 296346 - DNA, 25 bp, Rattus norvegicus
gaactgaatcccactgtgaatcatg

SEQ ID NO: 296347 - DNA, 25 bp, Rattus norvegicus
gaactgaatccctctgtgaatcatg

SEQ ID NO: 296348 - DNA, 25 bp, Rattus norvegicus
gaactgaatcttccttgtcttagta

SEQ ID NO: 296349 - DNA, 25 bp, Rattus norvegicus
gaactgaatcttgcttgtcttagta

SEQ ID NO: 296350 - DNA, 25 bp, Rattus norvegicus
gaactgaatgcacatgggccttctc

SEQ ID NO: 296351 - DNA, 25 bp, Rattus norvegicus
gaactgaatgcagatgggccttctc

SEQ ID NO: 296352 - DNA, 25 bp, Rattus norvegicus
gaactgaatgttcaacttgcaaagg

SEQ ID NO: 296353 - DNA, 25 bp, Rattus norvegicus
gaactgaatgttgaacttgcaaagg

SEQ ID NO: 296354 - DNA, 25 bp, Rattus norvegicus
gaactgacaaagcactgctgctgtt

SEQ ID NO: 296355 - DNA, 25 bp, Rattus norvegicus
gaactgacaaaggactgctgctgtt

SEQ ID NO: 296356 - DNA, 25 bp, Rattus norvegicus
gaactgacaatgagcactgggccca

SEQ ID NO: 296357 - DNA, 25 bp, Rattus norvegicus
gaactgacaatgtgcactgggccca

SEQ ID NO: 296358 - DNA, 25 bp, Rattus norvegicus
gaactgacacaactttgccttaaag

SEQ ID NO: 296359 - DNA, 25 bp, Rattus norvegicus
gaactgacacaagtttgccttaaag

SEQ ID NO: 296360 - DNA, 25 bp, Rattus norvegicus
gaactgacacgaaccctctaatata

SEQ ID NO: 296361 - DNA, 25 bp, Rattus norvegicus
gaactgacacgatccctctaatata

SEQ ID NO: 296362 - DNA, 25 bp, Rattus norvegicus
gaactgacactgctgcttcattatc

SEQ ID NO: 296363 - DNA, 25 bp, Rattus norvegicus
gaactgacactggtgcttcattatc

SEQ ID NO: 296364 - DNA, 25 bp, Rattus norvegicus
gaactgacagtcatgagccgaagaa

SEQ ID NO: 296365 - DNA, 25 bp, Rattus norvegicus
gaactgacagtcttgagccgaagaa

SEQ ID NO: 296366 - DNA, 25 bp, Rattus norvegicus
gaactgaccaccatagtgtatctga

SEQ ID NO: 296367 - DNA, 25 bp, Rattus norvegicus
gaactgaccaccttagtgtatctga

SEQ ID NO: 296368 - DNA, 25 bp, Rattus norvegicus
gaactgaccattactctctttggag

SEQ ID NO: 296369 - DNA, 25 bp, Rattus norvegicus
gaactgaccatttctctctttggag

SEQ ID NO: 296370 - DNA, 25 bp, Rattus norvegicus
gaactgacccaaccaggttctagtt

SEQ ID NO: 296371 - DNA, 25 bp, Rattus norvegicus
gaactgacccaagcaggttctagtt

SEQ ID NO: 296372 - DNA, 25 bp, Rattus norvegicus
gaactgaccctaacagaagcactgg

SEQ ID NO: 296373 - DNA, 25 bp, Rattus norvegicus
gaactgaccctatcagaagcactgg

SEQ ID NO: 296374 - DNA, 25 bp, Rattus norvegicus
gaactgaccctcaacatgactaatt

SEQ ID NO: 296375 - DNA, 25 bp, Rattus norvegicus
gaactgaccctctacatgactaatt

SEQ ID NO: 296376 - DNA, 25 bp, Rattus norvegicus
gaactgaccgccaaacatgggcttt

SEQ ID NO: 296377 - DNA, 25 bp, Rattus norvegicus
gaactgaccgcctaacatgggcttt

SEQ ID NO: 296378 - DNA, 25 bp, Rattus norvegicus
gaactgaccgtaagcgaagcatgcg

SEQ ID NO: 296379 - DNA, 25 bp, Rattus norvegicus
gaactgaccgtatgcgaagcatgcg

SEQ ID NO: 296380 - DNA, 25 bp, Rattus norvegicus
gaactgaccgtgagcctctgacttt

SEQ ID NO: 296381 - DNA, 25 bp, Rattus norvegicus
gaactgaccgtgtgcctctgacttt

SEQ ID NO: 296382 - DNA, 25 bp, Rattus norvegicus
gaactgacctgtcaaatgacattga

SEQ ID NO: 296383 - DNA, 25 bp, Rattus norvegicus
gaactgacctgtgaaatgacattga

SEQ ID NO: 296384 - DNA, 25 bp, Rattus norvegicus
gaactgacctttagtgctgtagctg

SEQ ID NO: 296385 - DNA, 25 bp, Rattus norvegicus
gaactgaccttttgtgctgtagctg

SEQ ID NO: 296386 - DNA, 25 bp, Rattus norvegicus
gaactgacgtggagttccctagtca

SEQ ID NO: 296387 - DNA, 25 bp, Rattus norvegicus
gaactgacgtggtgttccctagtca

SEQ ID NO: 296388 - DNA, 25 bp, Rattus norvegicus
gaactgactaatcatcacacgccca

SEQ ID NO: 296389 - DNA, 25 bp, Rattus norvegicus
gaactgactaatgatcacacgccca

SEQ ID NO: 296390 - DNA, 25 bp, Rattus norvegicus
gaactgactatacggccacctaggc

SEQ ID NO: 296391 - DNA, 25 bp, Rattus norvegicus
gaactgactatagggccacctaggc

SEQ ID NO: 296392 - DNA, 25 bp, Rattus norvegicus
gaactgactcaaacataaccccaag

SEQ ID NO: 296393 - DNA, 25 bp, Rattus norvegicus
gaactgactcaatcataaccccaag

SEQ ID NO: 296394 - DNA, 25 bp, Rattus norvegicus
gaactgactcacagtaggtcgtcct

SEQ ID NO: 296395 - DNA, 25 bp, Rattus norvegicus
gaactgactcactgtaggtcgtcct

SEQ ID NO: 296396 - DNA, 25 bp, Rattus norvegicus
gaactgactgctattgtgggcactt

SEQ ID NO: 296397 - DNA, 25 bp, Rattus norvegicus
gaactgactgcttttgtgggcactt

SEQ ID NO: 296398 - DNA, 25 bp, Rattus norvegicus
gaactgactggtctgctctttagag

SEQ ID NO: 296399 - DNA, 25 bp, Rattus norvegicus
gaactgactggtgtgctctttagag

SEQ ID NO: 296400 - DNA, 25 bp, Rattus norvegicus
gaactgactttaacctctgaatagc

SEQ ID NO: 296401 - DNA, 25 bp, Rattus norvegicus
gaactgactttatcctctgaatagc

SEQ ID NO: 296402 - DNA, 25 bp, Rattus norvegicus
gaactgagacgaatgcaattggata

SEQ ID NO: 296403 - DNA, 25 bp, Rattus norvegicus
gaactgagacgattgcaattggata

SEQ ID NO: 296404 - DNA, 25 bp, Rattus norvegicus
gaactgagaggaaaactgggatgct

SEQ ID NO: 296405 - DNA, 25 bp, Rattus norvegicus
gaactgagaggaaccctgagcccag

SEQ ID NO: 296406 - DNA, 25 bp, Rattus norvegicus
gaactgagaggataactgggatgct

SEQ ID NO: 296407 - DNA, 25 bp, Rattus norvegicus
gaactgagaggatccctgagcccag

SEQ ID NO: 296408 - DNA, 25 bp, Rattus norvegicus
gaactgagcctaccctccaggaggg

SEQ ID NO: 296409 - DNA, 25 bp, Rattus norvegicus
gaactgagcctagcctccaggaggg

SEQ ID NO: 296410 - DNA, 25 bp, Rattus norvegicus
gaactgagctaactagaactgagct

SEQ ID NO: 296411 - DNA, 25 bp, Rattus norvegicus
gaactgagctaagtagaactgagct

SEQ ID NO: 296412 - DNA, 25 bp, Rattus norvegicus
gaactgagctcactgttcgtgactg

SEQ ID NO: 296413 - DNA, 25 bp, Rattus norvegicus
gaactgagctcagtgttcgtgactg

SEQ ID NO: 296414 - DNA, 25 bp, Rattus norvegicus
gaactgaggaccctgtgagattcca

SEQ ID NO: 296415 - DNA, 25 bp, Rattus norvegicus
gaactgaggaccgtgtgagattcca

SEQ ID NO: 296416 - DNA, 25 bp, Rattus norvegicus
gaactgaggattcaagcccgggcct

SEQ ID NO: 296417 - DNA, 25 bp, Rattus norvegicus
gaactgaggattgaagcccgggcct

SEQ ID NO: 296418 - DNA, 25 bp, Rattus norvegicus
gaactgaggcaacgtctccaggcaa

SEQ ID NO: 296419 - DNA, 25 bp, Rattus norvegicus
gaactgaggcaaggtctccaggcaa

SEQ ID NO: 296420 - DNA, 25 bp, Rattus norvegicus
gaactgaggccacggttttgctcat

SEQ ID NO: 296421 - DNA, 25 bp, Rattus norvegicus
gaactgaggccagggttttgctcat

SEQ ID NO: 296422 - DNA, 25 bp, Rattus norvegicus
gaactgagggaacacaccgtgtcag

SEQ ID NO: 296423 - DNA, 25 bp, Rattus norvegicus
gaactgagggaagacaccgtgtcag

SEQ ID NO: 296424 - DNA, 25 bp, Rattus norvegicus
gaactgaggtacatttccatttcta

SEQ ID NO: 296425 - DNA, 25 bp, Rattus norvegicus
gaactgaggtacttttccatttcta

SEQ ID NO: 296426 - DNA, 25 bp, Rattus norvegicus
gaactgaggtctactcaaggcctct

SEQ ID NO: 296427 - DNA, 25 bp, Rattus norvegicus
gaactgaggtcttctcaaggcctct

SEQ ID NO: 296428 - DNA, 25 bp, Rattus norvegicus
gaactgaggttcatgatgcttcctg

SEQ ID NO: 296429 - DNA, 25 bp, Rattus norvegicus
gaactgaggttcttgatgcttcctg

SEQ ID NO: 296430 - DNA, 25 bp, Rattus norvegicus
gaactgagtagaacctgttactaaa

SEQ ID NO: 296431 - DNA, 25 bp, Rattus norvegicus
gaactgagtagatcctgttactaaa

SEQ ID NO: 296432 - DNA, 25 bp, Rattus norvegicus
gaactgagtctgaggatggaactaa

SEQ ID NO: 296433 - DNA, 25 bp, Rattus norvegicus
gaactgagtctgtggatggaactaa

SEQ ID NO: 296434 - DNA, 25 bp, Rattus norvegicus
gaactgataagcagcactcaggaat

SEQ ID NO: 296435 - DNA, 25 bp, Rattus norvegicus
gaactgataagctgcactcaggaat

SEQ ID NO: 296436 - DNA, 25 bp, Rattus norvegicus
gaactgatatttatggatcccataa

SEQ ID NO: 296437 - DNA, 25 bp, Rattus norvegicus
gaactgatatttttggatcccataa

SEQ ID NO: 296438 - DNA, 25 bp, Rattus norvegicus
gaactgatcaaactattgtccccaa

SEQ ID NO: 296439 - DNA, 25 bp, Rattus norvegicus
gaactgatcaaagtattgtccccaa

SEQ ID NO: 296440 - DNA, 25 bp, Rattus norvegicus
gaactgatccatcctaaagcctaga

SEQ ID NO: 296441 - DNA, 25 bp, Rattus norvegicus
gaactgatccatgctaaagcctaga

SEQ ID NO: 296442 - DNA, 25 bp, Rattus norvegicus
gaactgatgggccattctactgaat

SEQ ID NO: 296443 - DNA, 25 bp, Rattus norvegicus
gaactgatgggcgattctactgaat

SEQ ID NO: 296444 - DNA, 25 bp, Rattus norvegicus
gaactgatgtaaactccttcctacc

SEQ ID NO: 296445 - DNA, 25 bp, Rattus norvegicus
gaactgatgtaatctccttcctacc

SEQ ID NO: 296446 - DNA, 25 bp, Rattus norvegicus
gaactgatgtggactgtctatttaa

SEQ ID NO: 296447 - DNA, 25 bp, Rattus norvegicus
gaactgatgtggtctgtctatttaa

SEQ ID NO: 296448 - DNA, 25 bp, Rattus norvegicus
gaactgattcggctttggctacaaa

SEQ ID NO: 296449 - DNA, 25 bp, Rattus norvegicus
gaactgattcgggtttggctacaaa

SEQ ID NO: 296450 - DNA, 25 bp, Rattus norvegicus
gaactgattcgtattcttcctttag

SEQ ID NO: 296451 - DNA, 25 bp, Rattus norvegicus
gaactgattcgttttcttcctttag

SEQ ID NO: 296452 - DNA, 25 bp, Rattus norvegicus
gaactgattgacaagtcctggcatg

SEQ ID NO: 296453 - DNA, 25 bp, Rattus norvegicus
gaactgattgactagtcctggcatg

SEQ ID NO: 296454 - DNA, 25 bp, Rattus norvegicus
gaactgattgccacacagtccacat

SEQ ID NO: 296455 - DNA, 25 bp, Rattus norvegicus
gaactgattgcctcacagtccacat

SEQ ID NO: 296456 - DNA, 25 bp, Rattus norvegicus
gaactgatttctcaaagttgtcctc

SEQ ID NO: 296457 - DNA, 25 bp, Rattus norvegicus
gaactgatttctgaaagttgtcctc

SEQ ID NO: 296458 - DNA, 25 bp, Rattus norvegicus
gaactgatttgcatccagtctagca

SEQ ID NO: 296459 - DNA, 25 bp, Rattus norvegicus
gaactgatttgcttccagtctagca

SEQ ID NO: 296460 - DNA, 25 bp, Rattus norvegicus
gaactgattttgctctaattgctat

SEQ ID NO: 296461 - DNA, 25 bp, Rattus norvegicus
gaactgattttggtctaattgctat

SEQ ID NO: 296462 - DNA, 25 bp, Rattus norvegicus
gaactgatttttcgaagcgtgagct

SEQ ID NO: 296463 - DNA, 25 bp, Rattus norvegicus
gaactgatttttggaagcgtgagct

SEQ ID NO: 296464 - DNA, 25 bp, Rattus norvegicus
gaactgcaaagacctgtttgacctg

SEQ ID NO: 296465 - DNA, 25 bp, Rattus norvegicus
gaactgcaaagagctgtttgacctg

SEQ ID NO: 296466 - DNA, 25 bp, Rattus norvegicus
gaactgcaacatcagaatgggacct

SEQ ID NO: 296467 - DNA, 25 bp, Rattus norvegicus
gaactgcaacatgagaatgggacct

SEQ ID NO: 296468 - DNA, 25 bp, Rattus norvegicus
gaactgcaagataccgtctttctca

SEQ ID NO: 296469 - DNA, 25 bp, Rattus norvegicus
gaactgcaagattccgtctttctca

SEQ ID NO: 296470 - DNA, 25 bp, Rattus norvegicus
gaactgcaaggaatccaggctccta

SEQ ID NO: 296471 - DNA, 25 bp, Rattus norvegicus
gaactgcaaggattccaggctccta

SEQ ID NO: 296472 - DNA, 25 bp, Rattus norvegicus
gaactgcaattgataatgtctttgt

SEQ ID NO: 296473 - DNA, 25 bp, Rattus norvegicus
gaactgcaattgttaatgtctttgt

SEQ ID NO: 296474 - DNA, 25 bp, Rattus norvegicus
gaactgcacaataagctgcgcctgc

SEQ ID NO: 296475 - DNA, 25 bp, Rattus norvegicus
gaactgcacaatactctgacatcag

SEQ ID NO: 296476 - DNA, 25 bp, Rattus norvegicus
gaactgcacaattagctgcgcctgc

SEQ ID NO: 296477 - DNA, 25 bp, Rattus norvegicus
gaactgcacaattctctgacatcag

SEQ ID NO: 296478 - DNA, 25 bp, Rattus norvegicus
gaactgcacattcaaaatccgcttt

SEQ ID NO: 296479 - DNA, 25 bp, Rattus norvegicus
gaactgcacattgaaaatccgcttt

SEQ ID NO: 296480 - DNA, 25 bp, Rattus norvegicus
gaactgcactaaactccacaaaatg

SEQ ID NO: 296481 - DNA, 25 bp, Rattus norvegicus
gaactgcactaatctccacaaaatg

SEQ ID NO: 296482 - DNA, 25 bp, Rattus norvegicus
gaactgcactgaatatatcctgaca

SEQ ID NO: 296483 - DNA, 25 bp, Rattus norvegicus
gaactgcactgattatatcctgaca

SEQ ID NO: 296484 - DNA, 25 bp, Rattus norvegicus
gaactgcagaaaatggtggacactt

SEQ ID NO: 296485 - DNA, 25 bp, Rattus norvegicus
gaactgcagaaacccacggtcctgt

SEQ ID NO: 296486 - DNA, 25 bp, Rattus norvegicus
gaactgcagaaagccacggtcctgt

SEQ ID NO: 296487 - DNA, 25 bp, Rattus norvegicus
gaactgcagaaattggtggacactt

SEQ ID NO: 296488 - DNA, 25 bp, Rattus norvegicus
gaactgcagaatcacttccttggaa

SEQ ID NO: 296489 - DNA, 25 bp, Rattus norvegicus
gaactgcagaatgacttccttggaa

SEQ ID NO: 296490 - DNA, 25 bp, Rattus norvegicus
gaactgcagaccaagtgagcttgaa

SEQ ID NO: 296491 - DNA, 25 bp, Rattus norvegicus
gaactgcagacctagtgagcttgaa

SEQ ID NO: 296492 - DNA, 25 bp, Rattus norvegicus
gaactgcagagccaagaagaaccta

SEQ ID NO: 296493 - DNA, 25 bp, Rattus norvegicus
gaactgcagagcgaagaagaaccta

SEQ ID NO: 296494 - DNA, 25 bp, Rattus norvegicus
gaactgcagcaacaccttgtaacaa

SEQ ID NO: 296495 - DNA, 25 bp, Rattus norvegicus
gaactgcagcaagaccttgtaacaa

SEQ ID NO: 296496 - DNA, 25 bp, Rattus norvegicus
gaactgcagtcgacataagcccttt

SEQ ID NO: 296497 - DNA, 25 bp, Rattus norvegicus
gaactgcagtcgtcataagcccttt

SEQ ID NO: 296498 - DNA, 25 bp, Rattus norvegicus
gaactgcagtgtactgtctggagtt

SEQ ID NO: 296499 - DNA, 25 bp, Rattus norvegicus
gaactgcagtgttctgtctggagtt

SEQ ID NO: 296500 - DNA, 25 bp, Rattus norvegicus
gaactgcagttgatctagcatgaat

SEQ ID NO: 296501 - DNA, 25 bp, Rattus norvegicus
gaactgcagttgttctagcatgaat

SEQ ID NO: 296502 - DNA, 25 bp, Rattus norvegicus
gaactgcatcctaagggctacatgt

SEQ ID NO: 296503 - DNA, 25 bp, Rattus norvegicus
gaactgcatccttagggctacatgt

SEQ ID NO: 296504 - DNA, 25 bp, Rattus norvegicus
gaactgcatggacctaacattcgat

SEQ ID NO: 296505 - DNA, 25 bp, Rattus norvegicus
gaactgcatggagctaacattcgat

SEQ ID NO: 296506 - DNA, 25 bp, Rattus norvegicus
gaactgcattcaaaacctgcctttt

SEQ ID NO: 296507 - DNA, 25 bp, Rattus norvegicus
gaactgcattcataacctgcctttt

SEQ ID NO: 296508 - DNA, 25 bp, Rattus norvegicus
gaactgccaaatacattgtccttct

SEQ ID NO: 296509 - DNA, 25 bp, Rattus norvegicus
gaactgccaaattcattgtccttct

SEQ ID NO: 296510 - DNA, 25 bp, Rattus norvegicus
gaactgccaagaactttccacatag

SEQ ID NO: 296511 - DNA, 25 bp, Rattus norvegicus
gaactgccaagatctttccacatag

SEQ ID NO: 296512 - DNA, 25 bp, Rattus norvegicus
gaactgccaatcaaatgcatgctaa

SEQ ID NO: 296513 - DNA, 25 bp, Rattus norvegicus
gaactgccaatctaatgcatgctaa

SEQ ID NO: 296514 - DNA, 25 bp, Rattus norvegicus
gaactgccaatgatacaaagatcgg

SEQ ID NO: 296515 - DNA, 25 bp, Rattus norvegicus
gaactgccaatgttacaaagatcgg

SEQ ID NO: 296516 - DNA, 25 bp, Rattus norvegicus
gaactgccacctagacagagtgcca

SEQ ID NO: 296517 - DNA, 25 bp, Rattus norvegicus
gaactgccaccttgacagagtgcca

SEQ ID NO: 296518 - DNA, 25 bp, Rattus norvegicus
gaactgccagctcaagggaccatga

SEQ ID NO: 296519 - DNA, 25 bp, Rattus norvegicus
gaactgccagctgaagggaccatga

SEQ ID NO: 296520 - DNA, 25 bp, Rattus norvegicus
gaactgccaggtccacacagataga

SEQ ID NO: 296521 - DNA, 25 bp, Rattus norvegicus
gaactgccaggtgcacacagataga

SEQ ID NO: 296522 - DNA, 25 bp, Rattus norvegicus
gaactgccagttcatcgactcggtg

SEQ ID NO: 296523 - DNA, 25 bp, Rattus norvegicus
gaactgccagttgatcgactcggtg

SEQ ID NO: 296524 - DNA, 25 bp, Rattus norvegicus
gaactgccatctcatccgctcttat

SEQ ID NO: 296525 - DNA, 25 bp, Rattus norvegicus
gaactgccatctgatccgctcttat

SEQ ID NO: 296526 - DNA, 25 bp, Rattus norvegicus
gaactgcccagccttttactgtttt

SEQ ID NO: 296527 - DNA, 25 bp, Rattus norvegicus
gaactgcccagcgttttactgtttt

SEQ ID NO: 296528 - DNA, 25 bp, Rattus norvegicus
gaactgcccagtaacctccaataaa

SEQ ID NO: 296529 - DNA, 25 bp, Rattus norvegicus
gaactgcccagttacctccaataaa

SEQ ID NO: 296530 - DNA, 25 bp, Rattus norvegicus
gaactgccctgtctgttatgagcgg

SEQ ID NO: 296531 - DNA, 25 bp, Rattus norvegicus
gaactgccctgtgtgttatgagcgg

SEQ ID NO: 296532 - DNA, 25 bp, Rattus norvegicus
gaactgcccttcaagagtaacacta

SEQ ID NO: 296533 - DNA, 25 bp, Rattus norvegicus
gaactgcccttctagagtaacacta

SEQ ID NO: 296534 - DNA, 25 bp, Rattus norvegicus
gaactgcctgagatgtctggaaaat

SEQ ID NO: 296535 - DNA, 25 bp, Rattus norvegicus
gaactgcctgagttgtctggaaaat

SEQ ID NO: 296536 - DNA, 25 bp, Rattus norvegicus
gaactgccttctatagctcctgagg

SEQ ID NO: 296537 - DNA, 25 bp, Rattus norvegicus
gaactgccttctttagctcctgagg

SEQ ID NO: 296538 - DNA, 25 bp, Rattus norvegicus
gaactgcctttaaaaatcctatgag

SEQ ID NO: 296539 - DNA, 25 bp, Rattus norvegicus
gaactgcctttataaatcctatgag

SEQ ID NO: 296540 - DNA, 25 bp, Rattus norvegicus
gaactgcgactactagagatgtcat

SEQ ID NO: 296541 - DNA, 25 bp, Rattus norvegicus
gaactgcgactagtagagatgtcat

SEQ ID NO: 296542 - DNA, 25 bp, Rattus norvegicus
gaactgcgtctgacttaggttggag

SEQ ID NO: 296543 - DNA, 25 bp, Rattus norvegicus
gaactgcgtctgtcttaggttggag

SEQ ID NO: 296544 - DNA, 25 bp, Rattus norvegicus
gaactgcgtgtcattcttcgatgag

SEQ ID NO: 296545 - DNA, 25 bp, Rattus norvegicus
gaactgcgtgtctttcttcgatgag

SEQ ID NO: 296546 - DNA, 25 bp, Rattus norvegicus
gaactgctaggcagagcccagctat

SEQ ID NO: 296547 - DNA, 25 bp, Rattus norvegicus
gaactgctaggctgagcccagctat

SEQ ID NO: 296548 - DNA, 25 bp, Rattus norvegicus
gaactgctcaacatgcactgtggct

SEQ ID NO: 296549 - DNA, 25 bp, Rattus norvegicus
gaactgctcaacttgcactgtggct

SEQ ID NO: 296550 - DNA, 25 bp, Rattus norvegicus
gaactgctccagataccagagcgtt

SEQ ID NO: 296551 - DNA, 25 bp, Rattus norvegicus
gaactgctccagattcttgatcaag

SEQ ID NO: 296552 - DNA, 25 bp, Rattus norvegicus
gaactgctccagttaccagagcgtt

SEQ ID NO: 296553 - DNA, 25 bp, Rattus norvegicus
gaactgctccagtttcttgatcaag

SEQ ID NO: 296554 - DNA, 25 bp, Rattus norvegicus
gaactgctcgttagttgacctgtca

SEQ ID NO: 296555 - DNA, 25 bp, Rattus norvegicus
gaactgctcgtttgttgacctgtca

SEQ ID NO: 296556 - DNA, 25 bp, Rattus norvegicus
gaactgctctgcaaacacatgggaa

SEQ ID NO: 296557 - DNA, 25 bp, Rattus norvegicus
gaactgctctgctaacacatgggaa

SEQ ID NO: 296558 - DNA, 25 bp, Rattus norvegicus
gaactgctctttattgctatgatag

SEQ ID NO: 296559 - DNA, 25 bp, Rattus norvegicus
gaactgctcttttttgctatgatag

SEQ ID NO: 296560 - DNA, 25 bp, Rattus norvegicus
gaactgctgaaaatctgtatcaggt

SEQ ID NO: 296561 - DNA, 25 bp, Rattus norvegicus
gaactgctgaaattctgtatcaggt

SEQ ID NO: 296562 - DNA, 25 bp, Rattus norvegicus
gaactgctgacacagaaacccctgt

SEQ ID NO: 296563 - DNA, 25 bp, Rattus norvegicus
gaactgctgacagagaaacccctgt

SEQ ID NO: 296564 - DNA, 25 bp, Rattus norvegicus
gaactgctgaggacacttttagata

SEQ ID NO: 296565 - DNA, 25 bp, Rattus norvegicus
gaactgctgaggtcacttttagata

SEQ ID NO: 296566 - DNA, 25 bp, Rattus norvegicus
gaactgctgatcatgccgtgagtaa

SEQ ID NO: 296567 - DNA, 25 bp, Rattus norvegicus
gaactgctgatccttctgcttgcac

SEQ ID NO: 296568 - DNA, 25 bp, Rattus norvegicus
gaactgctgatcgttctgcttgcac

SEQ ID NO: 296569 - DNA, 25 bp, Rattus norvegicus
gaactgctgatcttgccgtgagtaa

SEQ ID NO: 296570 - DNA, 25 bp, Rattus norvegicus
gaactgctgatgagccctgtggtgt

SEQ ID NO: 296571 - DNA, 25 bp, Rattus norvegicus
gaactgctgatgtgccctgtggtgt

SEQ ID NO: 296572 - DNA, 25 bp, Rattus norvegicus
gaactgctgattaggtctggctaag

SEQ ID NO: 296573 - DNA, 25 bp, Rattus norvegicus
gaactgctgatttggtctggctaag

SEQ ID NO: 296574 - DNA, 25 bp, Rattus norvegicus
gaactgctgcagcaaggatatatct

SEQ ID NO: 296575 - DNA, 25 bp, Rattus norvegicus
gaactgctgcaggaaggatatatct

SEQ ID NO: 296576 - DNA, 25 bp, Rattus norvegicus
gaactgctgctgaccacacggagtg

SEQ ID NO: 296577 - DNA, 25 bp, Rattus norvegicus
gaactgctgctgacttgttagcccg

SEQ ID NO: 296578 - DNA, 25 bp, Rattus norvegicus
gaactgctgctgtccacacggagtg

SEQ ID NO: 296579 - DNA, 25 bp, Rattus norvegicus
gaactgctgctgtcttgttagcccg

SEQ ID NO: 296580 - DNA, 25 bp, Rattus norvegicus
gaactgctggaaattgcccaacttg

SEQ ID NO: 296581 - DNA, 25 bp, Rattus norvegicus
gaactgctggaatttgcccaacttg

SEQ ID NO: 296582 - DNA, 25 bp, Rattus norvegicus
gaactgctggagcactctgctgaaa

SEQ ID NO: 296583 - DNA, 25 bp, Rattus norvegicus
gaactgctggaggactctgctgaaa

SEQ ID NO: 296584 - DNA, 25 bp, Rattus norvegicus
gaactgctgggtcagaaaaacctct

SEQ ID NO: 296585 - DNA, 25 bp, Rattus norvegicus
gaactgctgggtgagaaaaacctct

SEQ ID NO: 296586 - DNA, 25 bp, Rattus norvegicus
gaactgctggttaagtagatcctga

SEQ ID NO: 296587 - DNA, 25 bp, Rattus norvegicus
gaactgctggttctcatctgttaca

SEQ ID NO: 296588 - DNA, 25 bp, Rattus norvegicus
gaactgctggttgtcatctgttaca

SEQ ID NO: 296589 - DNA, 25 bp, Rattus norvegicus
gaactgctggtttagtagatcctga

SEQ ID NO: 296590 - DNA, 25 bp, Rattus norvegicus
gaactgctgttcactctgttgtgac

SEQ ID NO: 296591 - DNA, 25 bp, Rattus norvegicus
gaactgctgttctctctgttgtgac

SEQ ID NO: 296592 - DNA, 25 bp, Rattus norvegicus
gaactgcttaggacgctgtataaac

SEQ ID NO: 296593 - DNA, 25 bp, Rattus norvegicus
gaactgcttaggtcgctgtataaac

SEQ ID NO: 296594 - DNA, 25 bp, Rattus norvegicus
gaactgcttccaagcaagtgtgaga

SEQ ID NO: 296595 - DNA, 25 bp, Rattus norvegicus
gaactgcttccatgcaagtgtgaga

SEQ ID NO: 296596 - DNA, 25 bp, Rattus norvegicus
gaactgcttggcagatacccagcaa

SEQ ID NO: 296597 - DNA, 25 bp, Rattus norvegicus
gaactgcttggctgatacccagcaa

SEQ ID NO: 296598 - DNA, 25 bp, Rattus norvegicus
gaactgcttggtcagacccaggtcc

SEQ ID NO: 296599 - DNA, 25 bp, Rattus norvegicus
gaactgcttggtgagacccaggtcc

SEQ ID NO: 296600 - DNA, 25 bp, Rattus norvegicus
gaactgctttgacctgtccatctac

SEQ ID NO: 296601 - DNA, 25 bp, Rattus norvegicus
gaactgctttgagctgtccatctac

SEQ ID NO: 296602 - DNA, 25 bp, Rattus norvegicus
gaactgctttgtcaggaagcccctg

SEQ ID NO: 296603 - DNA, 25 bp, Rattus norvegicus
gaactgctttgtgaggaagcccctg

SEQ ID NO: 296604 - DNA, 25 bp, Rattus norvegicus
gaactggaaaacacagatccgccaa

SEQ ID NO: 296605 - DNA, 25 bp, Rattus norvegicus
gaactggaaaactcagatccgccaa

SEQ ID NO: 296606 - DNA, 25 bp, Rattus norvegicus
gaactggaaaatactctgaggcata

SEQ ID NO: 296607 - DNA, 25 bp, Rattus norvegicus
gaactggaaaattctctgaggcata

SEQ ID NO: 296608 - DNA, 25 bp, Rattus norvegicus
gaactggaaacaacccgactgtggc

SEQ ID NO: 296609 - DNA, 25 bp, Rattus norvegicus
gaactggaaacatcccgactgtggc

SEQ ID NO: 296610 - DNA, 25 bp, Rattus norvegicus
gaactggaacttatgcagcttttac

SEQ ID NO: 296611 - DNA, 25 bp, Rattus norvegicus
gaactggaacttttgcagcttttac

SEQ ID NO: 296612 - DNA, 25 bp, Rattus norvegicus
gaactggaatgcaagcaagctacag

SEQ ID NO: 296613 - DNA, 25 bp, Rattus norvegicus
gaactggaatgctagcaagctacag

SEQ ID NO: 296614 - DNA, 25 bp, Rattus norvegicus
gaactggacaataaccgcactactt

SEQ ID NO: 296615 - DNA, 25 bp, Rattus norvegicus
gaactggacaattaccgcactactt

SEQ ID NO: 296616 - DNA, 25 bp, Rattus norvegicus
gaactggacagtcacccttttgaga

SEQ ID NO: 296617 - DNA, 25 bp, Rattus norvegicus
gaactggacagtgacccttttgaga

SEQ ID NO: 296618 - DNA, 25 bp, Rattus norvegicus
gaactggaccttaggtcacccagga

SEQ ID NO: 296619 - DNA, 25 bp, Rattus norvegicus
gaactggacctttggtcacccagga

SEQ ID NO: 296620 - DNA, 25 bp, Rattus norvegicus
gaactggacgcccaacgcaaacgat

SEQ ID NO: 296621 - DNA, 25 bp, Rattus norvegicus
gaactggacgccgaacgcaaacgat

SEQ ID NO: 296622 - DNA, 25 bp, Rattus norvegicus
gaactggactttattgtgttgcaag

SEQ ID NO: 296623 - DNA, 25 bp, Rattus norvegicus
gaactggacttttttgtgttgcaag

SEQ ID NO: 296624 - DNA, 25 bp, Rattus norvegicus
gaactggagaaaagccgcggcgtct

SEQ ID NO: 296625 - DNA, 25 bp, Rattus norvegicus
gaactggagaaatgccgcggcgtct

SEQ ID NO: 296626 - DNA, 25 bp, Rattus norvegicus
gaactggagaccatctgtactgtca

SEQ ID NO: 296627 - DNA, 25 bp, Rattus norvegicus
gaactggagaccttctgtactgtca

SEQ ID NO: 296628 - DNA, 25 bp, Rattus norvegicus
gaactggagataagtgcatactgca

SEQ ID NO: 296629 - DNA, 25 bp, Rattus norvegicus
gaactggagatatgtgcatactgca

SEQ ID NO: 296630 - DNA, 25 bp, Rattus norvegicus
gaactggagcctctaacaatgcttt

SEQ ID NO: 296631 - DNA, 25 bp, Rattus norvegicus
gaactggagcctgtaacaatgcttt

SEQ ID NO: 296632 - DNA, 25 bp, Rattus norvegicus
gaactggagtacacctgacaggtat

SEQ ID NO: 296633 - DNA, 25 bp, Rattus norvegicus
gaactggagtactcctgacaggtat

SEQ ID NO: 296634 - DNA, 25 bp, Rattus norvegicus
gaactggagttcacaaccctacaac

SEQ ID NO: 296635 - DNA, 25 bp, Rattus norvegicus
gaactggagttcacggtgattgaca

SEQ ID NO: 296636 - DNA, 25 bp, Rattus norvegicus
gaactggagttctcaaccctacaac

SEQ ID NO: 296637 - DNA, 25 bp, Rattus norvegicus
gaactggagttctcggtgattgaca

SEQ ID NO: 296638 - DNA, 25 bp, Rattus norvegicus
gaactggatccccaagttatctgca

SEQ ID NO: 296639 - DNA, 25 bp, Rattus norvegicus
gaactggatcccgaagttatctgca

SEQ ID NO: 296640 - DNA, 25 bp, Rattus norvegicus
gaactggatcggctttgctgccagc

SEQ ID NO: 296641 - DNA, 25 bp, Rattus norvegicus
gaactggatcgggtttgctgccagc

SEQ ID NO: 296642 - DNA, 25 bp, Rattus norvegicus
gaactggatctgctcagggtctaca

SEQ ID NO: 296643 - DNA, 25 bp, Rattus norvegicus
gaactggatctggtcagggtctaca

SEQ ID NO: 296644 - DNA, 25 bp, Rattus norvegicus
gaactggatgcgaccacggctgtga

SEQ ID NO: 296645 - DNA, 25 bp, Rattus norvegicus
gaactggatgcgtccacggctgtga

SEQ ID NO: 296646 - DNA, 25 bp, Rattus norvegicus
gaactggattcaccagaccgtcgct

SEQ ID NO: 296647 - DNA, 25 bp, Rattus norvegicus
gaactggattcagcagaccgtcgct

SEQ ID NO: 296648 - DNA, 25 bp, Rattus norvegicus
gaactggattccagtcggatgtgta

SEQ ID NO: 296649 - DNA, 25 bp, Rattus norvegicus
gaactggattcctgtcggatgtgta

SEQ ID NO: 296650 - DNA, 25 bp, Rattus norvegicus
gaactggattttcacctgctgtaat

SEQ ID NO: 296651 - DNA, 25 bp, Rattus norvegicus
gaactggattttgacctgctgtaat

SEQ ID NO: 296652 - DNA, 25 bp, Rattus norvegicus
gaactggcaacgcttttaccaactg

SEQ ID NO: 296653 - DNA, 25 bp, Rattus norvegicus
gaactggcaacggttttaccaactg

SEQ ID NO: 296654 - DNA, 25 bp, Rattus norvegicus
gaactggcacagaacgcctcagagc

SEQ ID NO: 296655 - DNA, 25 bp, Rattus norvegicus
gaactggcacagtacgcctcagagc

SEQ ID NO: 296656 - DNA, 25 bp, Rattus norvegicus
gaactggcagaacaggctggaccca

SEQ ID NO: 296657 - DNA, 25 bp, Rattus norvegicus
gaactggcagaagaggctggaccca

SEQ ID NO: 296658 - DNA, 25 bp, Rattus norvegicus
gaactggcatctcaggagcttttcc

SEQ ID NO: 296659 - DNA, 25 bp, Rattus norvegicus
gaactggcatctgaggagcttttcc

SEQ ID NO: 296660 - DNA, 25 bp, Rattus norvegicus
gaactggcattgagacattataaca

SEQ ID NO: 296661 - DNA, 25 bp, Rattus norvegicus
gaactggcattgattggtacaacat

SEQ ID NO: 296662 - DNA, 25 bp, Rattus norvegicus
gaactggcattgtgacattataaca

SEQ ID NO: 296663 - DNA, 25 bp, Rattus norvegicus
gaactggcattgtttggtacaacat

SEQ ID NO: 296664 - DNA, 25 bp, Rattus norvegicus
gaactggccaggagagttgctcatt

SEQ ID NO: 296665 - DNA, 25 bp, Rattus norvegicus
gaactggccaggtgagttgctcatt

SEQ ID NO: 296666 - DNA, 25 bp, Rattus norvegicus
gaactggccatgaggttaagcaagt

SEQ ID NO: 296667 - DNA, 25 bp, Rattus norvegicus
gaactggccatgtggttaagcaagt

SEQ ID NO: 296668 - DNA, 25 bp, Rattus norvegicus
gaactggccccaaatgacaggtgct

SEQ ID NO: 296669 - DNA, 25 bp, Rattus norvegicus
gaactggccccatatgacaggtgct

SEQ ID NO: 296670 - DNA, 25 bp, Rattus norvegicus
gaactggccggtccactggcagaaa

SEQ ID NO: 296671 - DNA, 25 bp, Rattus norvegicus
gaactggccggtgcactggcagaaa

SEQ ID NO: 296672 - DNA, 25 bp, Rattus norvegicus
gaactggcggatctttttgtgaact

SEQ ID NO: 296673 - DNA, 25 bp, Rattus norvegicus
gaactggcggatgtttttgtgaact

SEQ ID NO: 296674 - DNA, 25 bp, Rattus norvegicus
gaactggcggctcaggaacattaac

SEQ ID NO: 296675 - DNA, 25 bp, Rattus norvegicus
gaactggcggctgaggaacattaac

SEQ ID NO: 296676 - DNA, 25 bp, Rattus norvegicus
gaactggcgggcacttcacggtctc

SEQ ID NO: 296677 - DNA, 25 bp, Rattus norvegicus
gaactggcgggctcttcacggtctc

SEQ ID NO: 296678 - DNA, 25 bp, Rattus norvegicus
gaactggcggttcgtccccagcaga

SEQ ID NO: 296679 - DNA, 25 bp, Rattus norvegicus
gaactggcggttggtccccagcaga

SEQ ID NO: 296680 - DNA, 25 bp, Rattus norvegicus
gaactggcgtacatgcggctttgct

SEQ ID NO: 296681 - DNA, 25 bp, Rattus norvegicus
gaactggcgtacttgcggctttgct

SEQ ID NO: 296682 - DNA, 25 bp, Rattus norvegicus
gaactggctaagcagtcaactgaca

SEQ ID NO: 296683 - DNA, 25 bp, Rattus norvegicus
gaactggctaaggagtcaactgaca

SEQ ID NO: 296684 - DNA, 25 bp, Rattus norvegicus
gaactggctacacagttgaccaaca

SEQ ID NO: 296685 - DNA, 25 bp, Rattus norvegicus
gaactggctacagagttgaccaaca

SEQ ID NO: 296686 - DNA, 25 bp, Rattus norvegicus
gaactggctgagagtttccgcatct

SEQ ID NO: 296687 - DNA, 25 bp, Rattus norvegicus
gaactggctgagtgtttccgcatct

SEQ ID NO: 296688 - DNA, 25 bp, Rattus norvegicus
gaactggctgcccttttgaaaatac

SEQ ID NO: 296689 - DNA, 25 bp, Rattus norvegicus
gaactggctgccgttttgaaaatac

SEQ ID NO: 296690 - DNA, 25 bp, Rattus norvegicus
gaactggctgtacttttcctgagaa

SEQ ID NO: 296691 - DNA, 25 bp, Rattus norvegicus
gaactggctgtagttttcctgagaa

SEQ ID NO: 296692 - DNA, 25 bp, Rattus norvegicus
gaactggctttgagtgcccagagca

SEQ ID NO: 296693 - DNA, 25 bp, Rattus norvegicus
gaactggctttgtgtgcccagagca

SEQ ID NO: 296694 - DNA, 25 bp, Rattus norvegicus
gaactggcttttcactcatctttct

SEQ ID NO: 296695 - DNA, 25 bp, Rattus norvegicus
gaactggcttttgactcatctttct

SEQ ID NO: 296696 - DNA, 25 bp, Rattus norvegicus
gaactgggaaatagctggcagtcaa

SEQ ID NO: 296697 - DNA, 25 bp, Rattus norvegicus
gaactgggaaattgctggcagtcaa

SEQ ID NO: 296698 - DNA, 25 bp, Rattus norvegicus
gaactgggacccaccatgaagttga

SEQ ID NO: 296699 - DNA, 25 bp, Rattus norvegicus
gaactgggaccctccatgaagttga

SEQ ID NO: 296700 - DNA, 25 bp, Rattus norvegicus
gaactgggacttagtctctatctgt

SEQ ID NO: 296701 - DNA, 25 bp, Rattus norvegicus
gaactgggacttatcacagaggcgt

SEQ ID NO: 296702 - DNA, 25 bp, Rattus norvegicus
gaactgggactttgtctctatctgt

SEQ ID NO: 296703 - DNA, 25 bp, Rattus norvegicus
gaactgggacttttcacagaggcgt

SEQ ID NO: 296704 - DNA, 25 bp, Rattus norvegicus
gaactgggatccacaggattgcaca

SEQ ID NO: 296705 - DNA, 25 bp, Rattus norvegicus
gaactgggatcctcaggattgcaca

SEQ ID NO: 296706 - DNA, 25 bp, Rattus norvegicus
gaactgggcagtagtatcccttcct

SEQ ID NO: 296707 - DNA, 25 bp, Rattus norvegicus
gaactgggcagttgtatcccttcct

SEQ ID NO: 296708 - DNA, 25 bp, Rattus norvegicus
gaactgggcattctcgggctgtatc

SEQ ID NO: 296709 - DNA, 25 bp, Rattus norvegicus
gaactgggcattgtcgggctgtatc

SEQ ID NO: 296710 - DNA, 25 bp, Rattus norvegicus
gaactgggccaacaactgctgcgga

SEQ ID NO: 296711 - DNA, 25 bp, Rattus norvegicus
gaactgggccaagaactgctgcgga

SEQ ID NO: 296712 - DNA, 25 bp, Rattus norvegicus
gaactgggcctgagttcccaaagca

SEQ ID NO: 296713 - DNA, 25 bp, Rattus norvegicus
gaactgggcctgtgttcccaaagca

SEQ ID NO: 296714 - DNA, 25 bp, Rattus norvegicus
gaactgggcgccaattacttctgat

SEQ ID NO: 296715 - DNA, 25 bp, Rattus norvegicus
gaactgggcgcctattacttctgat

SEQ ID NO: 296716 - DNA, 25 bp, Rattus norvegicus
gaactgggcgggacatcgacacctg

SEQ ID NO: 296717 - DNA, 25 bp, Rattus norvegicus
gaactgggcgggtcatcgacacctg

SEQ ID NO: 296718 - DNA, 25 bp, Rattus norvegicus
gaactgggcgtcacactaaactata

SEQ ID NO: 296719 - DNA, 25 bp, Rattus norvegicus
gaactgggcgtctcactaaactata

SEQ ID NO: 296720 - DNA, 25 bp, Rattus norvegicus
gaactgggctatattcctgaccaat

SEQ ID NO: 296721 - DNA, 25 bp, Rattus norvegicus
gaactgggctatcggaagtgatcca

SEQ ID NO: 296722 - DNA, 25 bp, Rattus norvegicus
gaactgggctatgggaagtgatcca

SEQ ID NO: 296723 - DNA, 25 bp, Rattus norvegicus
gaactgggctattttcctgaccaat

SEQ ID NO: 296724 - DNA, 25 bp, Rattus norvegicus
gaactgggctcgcagcatcgaactg

SEQ ID NO: 296725 - DNA, 25 bp, Rattus norvegicus
gaactgggctcggagcatcgaactg

SEQ ID NO: 296726 - DNA, 25 bp, Rattus norvegicus
gaactgggctgtctccattgtggtc

SEQ ID NO: 296727 - DNA, 25 bp, Rattus norvegicus
gaactgggctgtgtccattgtggtc

SEQ ID NO: 296728 - DNA, 25 bp, Rattus norvegicus
gaactgggcttcactgggcttgttg

SEQ ID NO: 296729 - DNA, 25 bp, Rattus norvegicus
gaactgggcttctctgggcttgttg

SEQ ID NO: 296730 - DNA, 25 bp, Rattus norvegicus
gaactgggcttgaggatctactgat

SEQ ID NO: 296731 - DNA, 25 bp, Rattus norvegicus
gaactgggcttgctacaggaggcct

SEQ ID NO: 296732 - DNA, 25 bp, Rattus norvegicus
gaactgggcttggtacaggaggcct

SEQ ID NO: 296733 - DNA, 25 bp, Rattus norvegicus
gaactgggcttgtggatctactgat

SEQ ID NO: 296734 - DNA, 25 bp, Rattus norvegicus
gaactgggctttcaacatgtatgat

SEQ ID NO: 296735 - DNA, 25 bp, Rattus norvegicus
gaactgggctttgaacatgtatgat

SEQ ID NO: 296736 - DNA, 25 bp, Rattus norvegicus
gaactgggtcacaaatgaacgcact

SEQ ID NO: 296737 - DNA, 25 bp, Rattus norvegicus
gaactgggtcacaggatacttctcc

SEQ ID NO: 296738 - DNA, 25 bp, Rattus norvegicus
gaactgggtcactaatgaacgcact

SEQ ID NO: 296739 - DNA, 25 bp, Rattus norvegicus
gaactgggtcactggatacttctcc

SEQ ID NO: 296740 - DNA, 25 bp, Rattus norvegicus
gaactgggtgtactcccatgacggc

SEQ ID NO: 296741 - DNA, 25 bp, Rattus norvegicus
gaactgggtgtagtcccatgacggc

SEQ ID NO: 296742 - DNA, 25 bp, Rattus norvegicus
gaactgggtttcagaccatgaggtt

SEQ ID NO: 296743 - DNA, 25 bp, Rattus norvegicus
gaactgggtttctgaccatgaggtt

SEQ ID NO: 296744 - DNA, 25 bp, Rattus norvegicus
gaactggtaactccaccgcaactga

SEQ ID NO: 296745 - DNA, 25 bp, Rattus norvegicus
gaactggtaactgcaccgcaactga

SEQ ID NO: 296746 - DNA, 25 bp, Rattus norvegicus
gaactggtaaggacaatggagccaa

SEQ ID NO: 296747 - DNA, 25 bp, Rattus norvegicus
gaactggtaaggtcaatggagccaa

SEQ ID NO: 296748 - DNA, 25 bp, Rattus norvegicus
gaactggtcaagcaacatacctgaa

SEQ ID NO: 296749 - DNA, 25 bp, Rattus norvegicus
gaactggtcaaggaacatacctgaa

SEQ ID NO: 296750 - DNA, 25 bp, Rattus norvegicus
gaactggtcaatacttcctaatgag

SEQ ID NO: 296751 - DNA, 25 bp, Rattus norvegicus
gaactggtcaattcttcctaatgag

SEQ ID NO: 296752 - DNA, 25 bp, Rattus norvegicus
gaactggtcagactctagctcctgg

SEQ ID NO: 296753 - DNA, 25 bp, Rattus norvegicus
gaactggtcagagtctagctcctgg

SEQ ID NO: 296754 - DNA, 25 bp, Rattus norvegicus
gaactggtcattcgtgggacacgcc

SEQ ID NO: 296755 - DNA, 25 bp, Rattus norvegicus
gaactggtcattggtgggacacgcc

SEQ ID NO: 296756 - DNA, 25 bp, Rattus norvegicus
gaactggtccataaacaactcgctg

SEQ ID NO: 296757 - DNA, 25 bp, Rattus norvegicus
gaactggtccattaacaactcgctg

SEQ ID NO: 296758 - DNA, 25 bp, Rattus norvegicus
gaactggtcgacaaggtcttgcacc

SEQ ID NO: 296759 - DNA, 25 bp, Rattus norvegicus
gaactggtcgactaggtcttgcacc

SEQ ID NO: 296760 - DNA, 25 bp, Rattus norvegicus
gaactggtctaccaagaggcaacct

SEQ ID NO: 296761 - DNA, 25 bp, Rattus norvegicus
gaactggtctacgaagaggcaacct

SEQ ID NO: 296762 - DNA, 25 bp, Rattus norvegicus
gaactggtctgtaaacaggccctca

SEQ ID NO: 296763 - DNA, 25 bp, Rattus norvegicus
gaactggtctgttaacaggccctca

SEQ ID NO: 296764 - DNA, 25 bp, Rattus norvegicus
gaactggtctttagcattttgttgt

SEQ ID NO: 296765 - DNA, 25 bp, Rattus norvegicus
gaactggtcttttgcattttgttgt

SEQ ID NO: 296766 - DNA, 25 bp, Rattus norvegicus
gaactggtgaagctgttgtactcct

SEQ ID NO: 296767 - DNA, 25 bp, Rattus norvegicus
gaactggtgaaggtgttgtactcct

SEQ ID NO: 296768 - DNA, 25 bp, Rattus norvegicus
gaactggtgggcaatactgttgtct

SEQ ID NO: 296769 - DNA, 25 bp, Rattus norvegicus
gaactggtgggctatactgttgtct

SEQ ID NO: 296770 - DNA, 25 bp, Rattus norvegicus
gaactggtggtgatgctcagactca

SEQ ID NO: 296771 - DNA, 25 bp, Rattus norvegicus
gaactggtggtgttgctcagactca

SEQ ID NO: 296772 - DNA, 25 bp, Rattus norvegicus
gaactggtggttaccagatccttct

SEQ ID NO: 296773 - DNA, 25 bp, Rattus norvegicus
gaactggtggtttccagatccttct

SEQ ID NO: 296774 - DNA, 25 bp, Rattus norvegicus
gaactggtgtccattggcattgcct

SEQ ID NO: 296775 - DNA, 25 bp, Rattus norvegicus
gaactggtgtcctttggcattgcct

SEQ ID NO: 296776 - DNA, 25 bp, Rattus norvegicus
gaactggtgtgcacaattctgctca

SEQ ID NO: 296777 - DNA, 25 bp, Rattus norvegicus
gaactggtgtgctcaattctgctca

SEQ ID NO: 296778 - DNA, 25 bp, Rattus norvegicus
gaactggttaatcctatcatgggaa

SEQ ID NO: 296779 - DNA, 25 bp, Rattus norvegicus
gaactggttaatgctatcatgggaa

SEQ ID NO: 296780 - DNA, 25 bp, Rattus norvegicus
gaactggttcaaagtgcatgctaca

SEQ ID NO: 296781 - DNA, 25 bp, Rattus norvegicus
gaactggttcaatgtgcatgctaca

SEQ ID NO: 296782 - DNA, 25 bp, Rattus norvegicus
gaactggttccccagttggtgaagt

SEQ ID NO: 296783 - DNA, 25 bp, Rattus norvegicus
gaactggttcccgagttggtgaagt

SEQ ID NO: 296784 - DNA, 25 bp, Rattus norvegicus
gaactggttcttcgcaaaggcactt

SEQ ID NO: 296785 - DNA, 25 bp, Rattus norvegicus
gaactggttcttggcaaaggcactt

SEQ ID NO: 296786 - DNA, 25 bp, Rattus norvegicus
gaactggtttccatgactttctaga

SEQ ID NO: 296787 - DNA, 25 bp, Rattus norvegicus
gaactggtttccttgactttctaga

SEQ ID NO: 296788 - DNA, 25 bp, Rattus norvegicus
gaactggttttcacagagtcatctg

SEQ ID NO: 296789 - DNA, 25 bp, Rattus norvegicus
gaactggttttcagagacgctcaac

SEQ ID NO: 296790 - DNA, 25 bp, Rattus norvegicus
gaactggttttctcagagtcatctg

SEQ ID NO: 296791 - DNA, 25 bp, Rattus norvegicus
gaactggttttctgagacgctcaac

SEQ ID NO: 296792 - DNA, 25 bp, Rattus norvegicus
gaactgtaaaacaatctgcaccatg

SEQ ID NO: 296793 - DNA, 25 bp, Rattus norvegicus
gaactgtaaaactatctgcaccatg

SEQ ID NO: 296794 - DNA, 25 bp, Rattus norvegicus
gaactgtaaactcttccattttagg

SEQ ID NO: 296795 - DNA, 25 bp, Rattus norvegicus
gaactgtaaactgttccattttagg

SEQ ID NO: 296796 - DNA, 25 bp, Rattus norvegicus
gaactgtaaatcaaggctcccaaat

SEQ ID NO: 296797 - DNA, 25 bp, Rattus norvegicus
gaactgtaaatctaggctcccaaat

SEQ ID NO: 296798 - DNA, 25 bp, Rattus norvegicus
gaactgtaatctaatctcttagcat

SEQ ID NO: 296799 - DNA, 25 bp, Rattus norvegicus
gaactgtaatcttatctcttagcat

SEQ ID NO: 296800 - DNA, 25 bp, Rattus norvegicus
gaactgtaattcataacttgcacta

SEQ ID NO: 296801 - DNA, 25 bp, Rattus norvegicus
gaactgtaattcttaacttgcacta

SEQ ID NO: 296802 - DNA, 25 bp, Rattus norvegicus
gaactgtacaaccttatgcgcctat

SEQ ID NO: 296803 - DNA, 25 bp, Rattus norvegicus
gaactgtacaacgttatgcgcctat

SEQ ID NO: 296804 - DNA, 25 bp, Rattus norvegicus
gaactgtacctgcaacctctgtaag

SEQ ID NO: 296805 - DNA, 25 bp, Rattus norvegicus
gaactgtacctggaacctctgtaag

SEQ ID NO: 296806 - DNA, 25 bp, Rattus norvegicus
gaactgtacgacaatgctccgggat

SEQ ID NO: 296807 - DNA, 25 bp, Rattus norvegicus
gaactgtacgactatgctccgggat

SEQ ID NO: 296808 - DNA, 25 bp, Rattus norvegicus
gaactgtagaaaccgcagccgacca

SEQ ID NO: 296809 - DNA, 25 bp, Rattus norvegicus
gaactgtagaaagcgcagccgacca

SEQ ID NO: 296810 - DNA, 25 bp, Rattus norvegicus
gaactgtagaacctacttgttatta

SEQ ID NO: 296811 - DNA, 25 bp, Rattus norvegicus
gaactgtagaacgtacttgttatta

SEQ ID NO: 296812 - DNA, 25 bp, Rattus norvegicus
gaactgtagattctggcctctggca

SEQ ID NO: 296813 - DNA, 25 bp, Rattus norvegicus
gaactgtagattgtggcctctggca

SEQ ID NO: 296814 - DNA, 25 bp, Rattus norvegicus
gaactgtagctgaaccatctggaaa

SEQ ID NO: 296815 - DNA, 25 bp, Rattus norvegicus
gaactgtagctgtaccatctggaaa

SEQ ID NO: 296816 - DNA, 25 bp, Rattus norvegicus
gaactgtagcttccagatgccacct

SEQ ID NO: 296817 - DNA, 25 bp, Rattus norvegicus
gaactgtagcttgcagatgccacct

SEQ ID NO: 296818 - DNA, 25 bp, Rattus norvegicus
gaactgtaggtgctaatagtctaaa

SEQ ID NO: 296819 - DNA, 25 bp, Rattus norvegicus
gaactgtaggtggtaatagtctaaa

SEQ ID NO: 296820 - DNA, 25 bp, Rattus norvegicus
gaactgtagtcaacccgggtctgca

SEQ ID NO: 296821 - DNA, 25 bp, Rattus norvegicus
gaactgtagtcatcccgggtctgca

SEQ ID NO: 296822 - DNA, 25 bp, Rattus norvegicus
gaactgtagtttcctctgagagctc

SEQ ID NO: 296823 - DNA, 25 bp, Rattus norvegicus
gaactgtagtttgctctgagagctc

SEQ ID NO: 296824 - DNA, 25 bp, Rattus norvegicus
gaactgtataagagctgtgtgttta

SEQ ID NO: 296825 - DNA, 25 bp, Rattus norvegicus
gaactgtataagtgctgtgtgttta

SEQ ID NO: 296826 - DNA, 25 bp, Rattus norvegicus
gaactgtatactcagtttttcaaac

SEQ ID NO: 296827 - DNA, 25 bp, Rattus norvegicus
gaactgtatactgagtttttcaaac

SEQ ID NO: 296828 - DNA, 25 bp, Rattus norvegicus
gaactgtatatgacttcctggagag

SEQ ID NO: 296829 - DNA, 25 bp, Rattus norvegicus
gaactgtatatgtcttcctggagag

SEQ ID NO: 296830 - DNA, 25 bp, Rattus norvegicus
gaactgtatgaaacttaggtccttt

SEQ ID NO: 296831 - DNA, 25 bp, Rattus norvegicus
gaactgtatgaatcttaggtccttt

SEQ ID NO: 296832 - DNA, 25 bp, Rattus norvegicus
gaactgtatttactttcccaggagg

SEQ ID NO: 296833 - DNA, 25 bp, Rattus norvegicus
gaactgtatttagtttcccaggagg

SEQ ID NO: 296834 - DNA, 25 bp, Rattus norvegicus
gaactgtatttcaatttgacgccca

SEQ ID NO: 296835 - DNA, 25 bp, Rattus norvegicus
gaactgtatttctatttgacgccca

SEQ ID NO: 296836 - DNA, 25 bp, Rattus norvegicus
gaactgtatttgctgatcccctgaa

SEQ ID NO: 296837 - DNA, 25 bp, Rattus norvegicus
gaactgtatttggtgatcccctgaa

SEQ ID NO: 296838 - DNA, 25 bp, Rattus norvegicus
gaactgtcaagtaacccacctctgg

SEQ ID NO: 296839 - DNA, 25 bp, Rattus norvegicus
gaactgtcaagttacccacctctgg

SEQ ID NO: 296840 - DNA, 25 bp, Rattus norvegicus
gaactgtcaatcatggcgtgctatg

SEQ ID NO: 296841 - DNA, 25 bp, Rattus norvegicus
gaactgtcaatcttggcgtgctatg

SEQ ID NO: 296842 - DNA, 25 bp, Rattus norvegicus
gaactgtcaattaggtaccgattac

SEQ ID NO: 296843 - DNA, 25 bp, Rattus norvegicus
gaactgtcaatttggtaccgattac

SEQ ID NO: 296844 - DNA, 25 bp, Rattus norvegicus
gaactgtcacaacagaaccagacca

SEQ ID NO: 296845 - DNA, 25 bp, Rattus norvegicus
gaactgtcacaagagaaccagacca

SEQ ID NO: 296846 - DNA, 25 bp, Rattus norvegicus
gaactgtcacagagacttgctcgtc

SEQ ID NO: 296847 - DNA, 25 bp, Rattus norvegicus
gaactgtcacagtgacttgctcgtc

SEQ ID NO: 296848 - DNA, 25 bp, Rattus norvegicus
gaactgtcacatcagaaccgtcttg

SEQ ID NO: 296849 - DNA, 25 bp, Rattus norvegicus
gaactgtcacatgagaaccgtcttg

SEQ ID NO: 296850 - DNA, 25 bp, Rattus norvegicus
gaactgtcactactgcatcatgagt

SEQ ID NO: 296851 - DNA, 25 bp, Rattus norvegicus
gaactgtcactagtgcatcatgagt

SEQ ID NO: 296852 - DNA, 25 bp, Rattus norvegicus
gaactgtcagctacattccgggata

SEQ ID NO: 296853 - DNA, 25 bp, Rattus norvegicus
gaactgtcagcttcattccgggata

SEQ ID NO: 296854 - DNA, 25 bp, Rattus norvegicus
gaactgtcagtaagcttctttcgct

SEQ ID NO: 296855 - DNA, 25 bp, Rattus norvegicus
gaactgtcagtatgcttctttcgct

SEQ ID NO: 296856 - DNA, 25 bp, Rattus norvegicus
gaactgtccaggattattgctgctg

SEQ ID NO: 296857 - DNA, 25 bp, Rattus norvegicus
gaactgtccaggtttattgctgctg

SEQ ID NO: 296858 - DNA, 25 bp, Rattus norvegicus
gaactgtccattcggttcattcatt

SEQ ID NO: 296859 - DNA, 25 bp, Rattus norvegicus
gaactgtccattgggttcattcatt

SEQ ID NO: 296860 - DNA, 25 bp, Rattus norvegicus
gaactgtcccacaaagcacttctgt

SEQ ID NO: 296861 - DNA, 25 bp, Rattus norvegicus
gaactgtcccactaagcacttctgt

SEQ ID NO: 296862 - DNA, 25 bp, Rattus norvegicus
gaactgtcctgtaggaagctgccag

SEQ ID NO: 296863 - DNA, 25 bp, Rattus norvegicus
gaactgtcctgttggaagctgccag

SEQ ID NO: 296864 - DNA, 25 bp, Rattus norvegicus
gaactgtcctttagtcaagccttaa

SEQ ID NO: 296865 - DNA, 25 bp, Rattus norvegicus
gaactgtcctttcccctggtgaata

SEQ ID NO: 296866 - DNA, 25 bp, Rattus norvegicus
gaactgtcctttgccctggtgaata

SEQ ID NO: 296867 - DNA, 25 bp, Rattus norvegicus
gaactgtccttttgtcaagccttaa

SEQ ID NO: 296868 - DNA, 25 bp, Rattus norvegicus
gaactgtcgcaccagaattctctga

SEQ ID NO: 296869 - DNA, 25 bp, Rattus norvegicus
gaactgtcgcacgagaattctctga

SEQ ID NO: 296870 - DNA, 25 bp, Rattus norvegicus
gaactgtcgcgactagcagggtccc

SEQ ID NO: 296871 - DNA, 25 bp, Rattus norvegicus
gaactgtcgcgagtagcagggtccc

SEQ ID NO: 296872 - DNA, 25 bp, Rattus norvegicus
gaactgtcgtctattttctctgtga

SEQ ID NO: 296873 - DNA, 25 bp, Rattus norvegicus
gaactgtcgtcttttttctctgtga

SEQ ID NO: 296874 - DNA, 25 bp, Rattus norvegicus
gaactgtctccaactttttctatga

SEQ ID NO: 296875 - DNA, 25 bp, Rattus norvegicus
gaactgtctccatctttttctatga

SEQ ID NO: 296876 - DNA, 25 bp, Rattus norvegicus
gaactgtctgcaactcatactggga

SEQ ID NO: 296877 - DNA, 25 bp, Rattus norvegicus
gaactgtctgcatctcatactggga

SEQ ID NO: 296878 - DNA, 25 bp, Rattus norvegicus
gaactgtctgtaagaactgccgtgg

SEQ ID NO: 296879 - DNA, 25 bp, Rattus norvegicus
gaactgtctgtactagctttcacac

SEQ ID NO: 296880 - DNA, 25 bp, Rattus norvegicus
gaactgtctgtagtagctttcacac

SEQ ID NO: 296881 - DNA, 25 bp, Rattus norvegicus
gaactgtctgtatgaactgccgtgg

SEQ ID NO: 296882 - DNA, 25 bp, Rattus norvegicus
gaactgtgaaccagtgaacctgtga

SEQ ID NO: 296883 - DNA, 25 bp, Rattus norvegicus
gaactgtgaacctgtgaacctgtga

SEQ ID NO: 296884 - DNA, 25 bp, Rattus norvegicus
gaactgtgaagaatcggcctgcccc

SEQ ID NO: 296885 - DNA, 25 bp, Rattus norvegicus
gaactgtgaagattcggcctgcccc

SEQ ID NO: 296886 - DNA, 25 bp, Rattus norvegicus
gaactgtgacttattagctgtacta

SEQ ID NO: 296887 - DNA, 25 bp, Rattus norvegicus
gaactgtgactttttagctgtacta

SEQ ID NO: 296888 - DNA, 25 bp, Rattus norvegicus
gaactgtgagatagggtccatccct

SEQ ID NO: 296889 - DNA, 25 bp, Rattus norvegicus
gaactgtgagattgggtccatccct

SEQ ID NO: 296890 - DNA, 25 bp, Rattus norvegicus
gaactgtgagcacttcgtgaacgaa

SEQ ID NO: 296891 - DNA, 25 bp, Rattus norvegicus
gaactgtgagcagttcgtgaacgaa

SEQ ID NO: 296892 - DNA, 25 bp, Rattus norvegicus
gaactgtgaggcctcgtcccagatg

SEQ ID NO: 296893 - DNA, 25 bp, Rattus norvegicus
gaactgtgaggcgtcgtcccagatg

SEQ ID NO: 296894 - DNA, 25 bp, Rattus norvegicus
gaactgtgatgtctgacagcttcct

SEQ ID NO: 296895 - DNA, 25 bp, Rattus norvegicus
gaactgtgatgtgtgacagcttcct

SEQ ID NO: 296896 - DNA, 25 bp, Rattus norvegicus
gaactgtgcaagacaatcactgttg

SEQ ID NO: 296897 - DNA, 25 bp, Rattus norvegicus
gaactgtgcaagtcaatcactgttg

SEQ ID NO: 296898 - DNA, 25 bp, Rattus norvegicus
gaactgtgcaatactgtgactgctt

SEQ ID NO: 296899 - DNA, 25 bp, Rattus norvegicus
gaactgtgcaattctgtgactgctt

SEQ ID NO: 296900 - DNA, 25 bp, Rattus norvegicus
gaactgtgcaccatgtcatctctgc

SEQ ID NO: 296901 - DNA, 25 bp, Rattus norvegicus
gaactgtgcaccttgtcatctctgc

SEQ ID NO: 296902 - DNA, 25 bp, Rattus norvegicus
gaactgtgccagcttgtctctaagt

SEQ ID NO: 296903 - DNA, 25 bp, Rattus norvegicus
gaactgtgccaggttgtctctaagt

SEQ ID NO: 296904 - DNA, 25 bp, Rattus norvegicus
gaactgtgcccaagttttgcagaga

SEQ ID NO: 296905 - DNA, 25 bp, Rattus norvegicus
gaactgtgcccatgttttgcagaga

SEQ ID NO: 296906 - DNA, 25 bp, Rattus norvegicus
gaactgtgcgttcattttggcagaa

SEQ ID NO: 296907 - DNA, 25 bp, Rattus norvegicus
gaactgtgcgttcccttggctttaa

SEQ ID NO: 296908 - DNA, 25 bp, Rattus norvegicus
gaactgtgcgttgattttggcagaa

SEQ ID NO: 296909 - DNA, 25 bp, Rattus norvegicus
gaactgtgcgttgccttggctttaa

SEQ ID NO: 296910 - DNA, 25 bp, Rattus norvegicus
gaactgtgcttgatgaaggaccctg

SEQ ID NO: 296911 - DNA, 25 bp, Rattus norvegicus
gaactgtgcttgttgaaggaccctg

SEQ ID NO: 296912 - DNA, 25 bp, Rattus norvegicus
gaactgtgctttacatgacggcctt

SEQ ID NO: 296913 - DNA, 25 bp, Rattus norvegicus
gaactgtgcttttcatgacggcctt

SEQ ID NO: 296914 - DNA, 25 bp, Rattus norvegicus
gaactgtggagcaggcctaaacaat

SEQ ID NO: 296915 - DNA, 25 bp, Rattus norvegicus
gaactgtggagctggcctaaacaat

SEQ ID NO: 296916 - DNA, 25 bp, Rattus norvegicus
gaactgtggatcacctacaatttta

SEQ ID NO: 296917 - DNA, 25 bp, Rattus norvegicus
gaactgtggatctcctacaatttta

SEQ ID NO: 296918 - DNA, 25 bp, Rattus norvegicus
gaactgtggcatatattggcagcca

SEQ ID NO: 296919 - DNA, 25 bp, Rattus norvegicus
gaactgtggcatttattggcagcca

SEQ ID NO: 296920 - DNA, 25 bp, Rattus norvegicus
gaactgtggccaaatttaatgtcat

SEQ ID NO: 296921 - DNA, 25 bp, Rattus norvegicus
gaactgtggccatatttaatgtcat

SEQ ID NO: 296922 - DNA, 25 bp, Rattus norvegicus
gaactgtggcccagcgacagcgccg

SEQ ID NO: 296923 - DNA, 25 bp, Rattus norvegicus
gaactgtggccctgcgacagcgccg

SEQ ID NO: 296924 - DNA, 25 bp, Rattus norvegicus
gaactgtggcctacattgaaactga

SEQ ID NO: 296925 - DNA, 25 bp, Rattus norvegicus
gaactgtggccttcattgaaactga

SEQ ID NO: 296926 - DNA, 25 bp, Rattus norvegicus
gaactgtggcttctgattagcctca

SEQ ID NO: 296927 - DNA, 25 bp, Rattus norvegicus
gaactgtggcttgtgattagcctca

SEQ ID NO: 296928 - DNA, 25 bp, Rattus norvegicus
gaactgtgggagcttcattactaag

SEQ ID NO: 296929 - DNA, 25 bp, Rattus norvegicus
gaactgtgggaggttcattactaag

SEQ ID NO: 296930 - DNA, 25 bp, Rattus norvegicus
gaactgtggtcaagcattctgtctg

SEQ ID NO: 296931 - DNA, 25 bp, Rattus norvegicus
gaactgtggtcatgcattctgtctg

SEQ ID NO: 296932 - DNA, 25 bp, Rattus norvegicus
gaactgtggtctaaacaggcctgga

SEQ ID NO: 296933 - DNA, 25 bp, Rattus norvegicus
gaactgtggtcttaacaggcctgga

SEQ ID NO: 296934 - DNA, 25 bp, Rattus norvegicus
gaactgtggtgtccatagctcttta

SEQ ID NO: 296935 - DNA, 25 bp, Rattus norvegicus
gaactgtggtgtgcatagctcttta

SEQ ID NO: 296936 - DNA, 25 bp, Rattus norvegicus
gaactgtgtactatgactttctagt

SEQ ID NO: 296937 - DNA, 25 bp, Rattus norvegicus
gaactgtgtactttgactttctagt

SEQ ID NO: 296938 - DNA, 25 bp, Rattus norvegicus
gaactgtgtataacccttgcagagg

SEQ ID NO: 296939 - DNA, 25 bp, Rattus norvegicus
gaactgtgtatatcccttgcagagg

SEQ ID NO: 296940 - DNA, 25 bp, Rattus norvegicus
gaactgtgtatcattagtgcatata

SEQ ID NO: 296941 - DNA, 25 bp, Rattus norvegicus
gaactgtgtatctttagtgcatata

SEQ ID NO: 296942 - DNA, 25 bp, Rattus norvegicus
gaactgtgtcacagcaaactcactg

SEQ ID NO: 296943 - DNA, 25 bp, Rattus norvegicus
gaactgtgtcactgcaaactcactg

SEQ ID NO: 296944 - DNA, 25 bp, Rattus norvegicus
gaactgtgtcatacatagctgctgt

SEQ ID NO: 296945 - DNA, 25 bp, Rattus norvegicus
gaactgtgtcattcatagctgctgt

SEQ ID NO: 296946 - DNA, 25 bp, Rattus norvegicus
gaactgtgtcttatccaaggctttg

SEQ ID NO: 296947 - DNA, 25 bp, Rattus norvegicus
gaactgtgtcttttccaaggctttg

SEQ ID NO: 296948 - DNA, 25 bp, Rattus norvegicus
gaactgttaagcctcgacgccggtg

SEQ ID NO: 296949 - DNA, 25 bp, Rattus norvegicus
gaactgttaagcgtcgacgccggtg

SEQ ID NO: 296950 - DNA, 25 bp, Rattus norvegicus
gaactgttaattaccccaaagatag

SEQ ID NO: 296951 - DNA, 25 bp, Rattus norvegicus
gaactgttaatttccccaaagatag

SEQ ID NO: 296952 - DNA, 25 bp, Rattus norvegicus
gaactgttacctaggcatttcaaaa

SEQ ID NO: 296953 - DNA, 25 bp, Rattus norvegicus
gaactgttaccttggcatttcaaaa

SEQ ID NO: 296954 - DNA, 25 bp, Rattus norvegicus
gaactgttactacgcctggcagggc

SEQ ID NO: 296955 - DNA, 25 bp, Rattus norvegicus
gaactgttactaggcctggcagggc

SEQ ID NO: 296956 - DNA, 25 bp, Rattus norvegicus
gaactgttagatcctgttgcaagaa

SEQ ID NO: 296957 - DNA, 25 bp, Rattus norvegicus
gaactgttagatgctgttgcaagaa

SEQ ID NO: 296958 - DNA, 25 bp, Rattus norvegicus
gaactgttagcaatcctaccgatgt

SEQ ID NO: 296959 - DNA, 25 bp, Rattus norvegicus
gaactgttagcattcctaccgatgt

SEQ ID NO: 296960 - DNA, 25 bp, Rattus norvegicus
gaactgttatggagccactgagccc

SEQ ID NO: 296961 - DNA, 25 bp, Rattus norvegicus
gaactgttatggtgccactgagccc

SEQ ID NO: 296962 - DNA, 25 bp, Rattus norvegicus
gaactgttcactcttgggcctggaa

SEQ ID NO: 296963 - DNA, 25 bp, Rattus norvegicus
gaactgttcactgttgggcctggaa

SEQ ID NO: 296964 - DNA, 25 bp, Rattus norvegicus
gaactgttcagcagacttattgatc

SEQ ID NO: 296965 - DNA, 25 bp, Rattus norvegicus
gaactgttcagctgacttattgatc

SEQ ID NO: 296966 - DNA, 25 bp, Rattus norvegicus
gaactgttccatacattgtattcat

SEQ ID NO: 296967 - DNA, 25 bp, Rattus norvegicus
gaactgttccattcattgtattcat

SEQ ID NO: 296968 - DNA, 25 bp, Rattus norvegicus
gaactgttccgaagtgtgcacgagt

SEQ ID NO: 296969 - DNA, 25 bp, Rattus norvegicus
gaactgttccgatgtgtgcacgagt

SEQ ID NO: 296970 - DNA, 25 bp, Rattus norvegicus
gaactgttcgcacccgaagagcagg

SEQ ID NO: 296971 - DNA, 25 bp, Rattus norvegicus
gaactgttcgcagccgaagagcagg

SEQ ID NO: 296972 - DNA, 25 bp, Rattus norvegicus
gaactgttctatatctggccaggat

SEQ ID NO: 296973 - DNA, 25 bp, Rattus norvegicus
gaactgttctatttctggccaggat

SEQ ID NO: 296974 - DNA, 25 bp, Rattus norvegicus
gaactgttctgaagtagaccgcaca

SEQ ID NO: 296975 - DNA, 25 bp, Rattus norvegicus
gaactgttctgatgtagaccgcaca

SEQ ID NO: 296976 - DNA, 25 bp, Rattus norvegicus
gaactgttggccagcactgtcgggt

SEQ ID NO: 296977 - DNA, 25 bp, Rattus norvegicus
gaactgttggcctgcactgtcgggt

SEQ ID NO: 296978 - DNA, 25 bp, Rattus norvegicus
gaactgttgggacggaccatgccat

SEQ ID NO: 296979 - DNA, 25 bp, Rattus norvegicus
gaactgttgggagggaccatgccat

SEQ ID NO: 296980 - DNA, 25 bp, Rattus norvegicus
gaactgttggtaattttctcatatt

SEQ ID NO: 296981 - DNA, 25 bp, Rattus norvegicus
gaactgttggtatttttctcatatt

SEQ ID NO: 296982 - DNA, 25 bp, Rattus norvegicus
gaactgttgtacatggatccatcta

SEQ ID NO: 296983 - DNA, 25 bp, Rattus norvegicus
gaactgttgtacttggatccatcta

SEQ ID NO: 296984 - DNA, 25 bp, Rattus norvegicus
gaactgtttaacactgaccattttt

SEQ ID NO: 296985 - DNA, 25 bp, Rattus norvegicus
gaactgtttaactctgaccattttt

SEQ ID NO: 296986 - DNA, 25 bp, Rattus norvegicus
gaactgtttaccacagcagctagca

SEQ ID NO: 296987 - DNA, 25 bp, Rattus norvegicus
gaactgtttacctcagcagctagca

SEQ ID NO: 296988 - DNA, 25 bp, Rattus norvegicus
gaactgtttactatggttacaagat

SEQ ID NO: 296989 - DNA, 25 bp, Rattus norvegicus
gaactgtttactttggttacaagat

SEQ ID NO: 296990 - DNA, 25 bp, Rattus norvegicus
gaactgtttattctgccttaaaggg

SEQ ID NO: 296991 - DNA, 25 bp, Rattus norvegicus
gaactgtttattgtgccttaaaggg

SEQ ID NO: 296992 - DNA, 25 bp, Rattus norvegicus
gaactgtttccactacaaatcaaga

SEQ ID NO: 296993 - DNA, 25 bp, Rattus norvegicus
gaactgtttccagtacaaatcaaga

SEQ ID NO: 296994 - DNA, 25 bp, Rattus norvegicus
gaactgtttctgagtgccaagcaca

SEQ ID NO: 296995 - DNA, 25 bp, Rattus norvegicus
gaactgtttctgtgtgccaagcaca

SEQ ID NO: 296996 - DNA, 25 bp, Rattus norvegicus
gaactgtttgctcttcatttactaa

SEQ ID NO: 296997 - DNA, 25 bp, Rattus norvegicus
gaactgtttgctgttcatttactaa

SEQ ID NO: 296998 - DNA, 25 bp, Rattus norvegicus
gaactgtttgtgacgctttcacttt

SEQ ID NO: 296999 - DNA, 25 bp, Rattus norvegicus
gaactgtttgtgtcgctttcacttt

SEQ ID NO: 297000 - DNA, 25 bp, Rattus norvegicus
gaactgttttcaactctgtcaaatg

SEQ ID NO: 297001 - DNA, 25 bp, Rattus norvegicus
gaactgttttcatctctgtcaaatg

SEQ ID NO: 297002 - DNA, 25 bp, Rattus norvegicus
gaactgttttccatcaacttctgaa

SEQ ID NO: 297003 - DNA, 25 bp, Rattus norvegicus
gaactgttttccttcaacttctgaa

SEQ ID NO: 297004 - DNA, 25 bp, Rattus norvegicus
gaacttaaaagcacaaggtacctgt

SEQ ID NO: 297005 - DNA, 25 bp, Rattus norvegicus
gaacttaaaagctcaaggtacctgt

SEQ ID NO: 297006 - DNA, 25 bp, Rattus norvegicus
gaacttaaactacttccgtgcagtc

SEQ ID NO: 297007 - DNA, 25 bp, Rattus norvegicus
gaacttaaactagttccgtgcagtc

SEQ ID NO: 297008 - DNA, 25 bp, Rattus norvegicus
gaacttaaattactgcagctccgtt

SEQ ID NO: 297009 - DNA, 25 bp, Rattus norvegicus
gaacttaaattagtgcagctccgtt

SEQ ID NO: 297010 - DNA, 25 bp, Rattus norvegicus
gaacttaacaccagttggccttctg

SEQ ID NO: 297011 - DNA, 25 bp, Rattus norvegicus
gaacttaacacctgttggccttctg

SEQ ID NO: 297012 - DNA, 25 bp, Rattus norvegicus
gaacttaacctgagtggcttccagc

SEQ ID NO: 297013 - DNA, 25 bp, Rattus norvegicus
gaacttaacctgtgtggcttccagc

SEQ ID NO: 297014 - DNA, 25 bp, Rattus norvegicus
gaacttaagactaggcagtgccact

SEQ ID NO: 297015 - DNA, 25 bp, Rattus norvegicus
gaacttaagacttggcagtgccact

SEQ ID NO: 297016 - DNA, 25 bp, Rattus norvegicus
gaacttaatatgaagaccagctggg

SEQ ID NO: 297017 - DNA, 25 bp, Rattus norvegicus
gaacttaatatgtagaccagctggg

SEQ ID NO: 297018 - DNA, 25 bp, Rattus norvegicus
gaacttaatgccatgcacctcggaa

SEQ ID NO: 297019 - DNA, 25 bp, Rattus norvegicus
gaacttaatgccttgcacctcggaa

SEQ ID NO: 297020 - DNA, 25 bp, Rattus norvegicus
gaacttaatggcatttggtcatcct

SEQ ID NO: 297021 - DNA, 25 bp, Rattus norvegicus
gaacttaatggcttttggtcatcct

SEQ ID NO: 297022 - DNA, 25 bp, Rattus norvegicus
gaacttacagttccagcagagccat

SEQ ID NO: 297023 - DNA, 25 bp, Rattus norvegicus
gaacttacagttgcagcagagccat

SEQ ID NO: 297024 - DNA, 25 bp, Rattus norvegicus
gaacttaccagaaatgctgcctcca

SEQ ID NO: 297025 - DNA, 25 bp, Rattus norvegicus
gaacttaccagatatgctgcctcca

SEQ ID NO: 297026 - DNA, 25 bp, Rattus norvegicus
gaacttaccgctagtgatactgaaa

SEQ ID NO: 297027 - DNA, 25 bp, Rattus norvegicus
gaacttaccgcttgtgatactgaaa

SEQ ID NO: 297028 - DNA, 25 bp, Rattus norvegicus
gaacttacctttatgtgcactgtct

SEQ ID NO: 297029 - DNA, 25 bp, Rattus norvegicus
gaacttacctttttgtgcactgtct

SEQ ID NO: 297030 - DNA, 25 bp, Rattus norvegicus
gaacttacgactatttgcattagct

SEQ ID NO: 297031 - DNA, 25 bp, Rattus norvegicus
gaacttacgactttttgcattagct

SEQ ID NO: 297032 - DNA, 25 bp, Rattus norvegicus
gaacttacgtagatggccagtggga

SEQ ID NO: 297033 - DNA, 25 bp, Rattus norvegicus
gaacttacgtagttggccagtggga

SEQ ID NO: 297034 - DNA, 25 bp, Rattus norvegicus
gaacttacgttacgtacatccctat

SEQ ID NO: 297035 - DNA, 25 bp, Rattus norvegicus
gaacttacgttaggtacatccctat

SEQ ID NO: 297036 - DNA, 25 bp, Rattus norvegicus
gaacttactataaatttgcctttta

SEQ ID NO: 297037 - DNA, 25 bp, Rattus norvegicus
gaacttactatatatttgcctttta

SEQ ID NO: 297038 - DNA, 25 bp, Rattus norvegicus
gaacttactatgaacccaaggctgg

SEQ ID NO: 297039 - DNA, 25 bp, Rattus norvegicus
gaacttactatgtacccaaggctgg

SEQ ID NO: 297040 - DNA, 25 bp, Rattus norvegicus
gaacttactcatatatgcttcccgt

SEQ ID NO: 297041 - DNA, 25 bp, Rattus norvegicus
gaacttactcatttatgcttcccgt

SEQ ID NO: 297042 - DNA, 25 bp, Rattus norvegicus
gaacttactggtcacctaactgagc

SEQ ID NO: 297043 - DNA, 25 bp, Rattus norvegicus
gaacttactggtgacctaactgagc

SEQ ID NO: 297044 - DNA, 25 bp, Rattus norvegicus
gaacttacttgtctgtacctaccct

SEQ ID NO: 297045 - DNA, 25 bp, Rattus norvegicus
gaacttacttgtgtgtacctaccct

SEQ ID NO: 297046 - DNA, 25 bp, Rattus norvegicus
gaacttagagttacatcccctgaga

SEQ ID NO: 297047 - DNA, 25 bp, Rattus norvegicus
gaacttagagtttcatcccctgaga

SEQ ID NO: 297048 - DNA, 25 bp, Rattus norvegicus
gaacttagcaatagtccttggtgaa

SEQ ID NO: 297049 - DNA, 25 bp, Rattus norvegicus
gaacttagcaattgtccttggtgaa

SEQ ID NO: 297050 - DNA, 25 bp, Rattus norvegicus
gaacttagcacaaactcattatttt

SEQ ID NO: 297051 - DNA, 25 bp, Rattus norvegicus
gaacttagcacatactcattatttt

SEQ ID NO: 297052 - DNA, 25 bp, Rattus norvegicus
gaacttagcataccacctggacttc

SEQ ID NO: 297053 - DNA, 25 bp, Rattus norvegicus
gaacttagcatagcacctggacttc

SEQ ID NO: 297054 - DNA, 25 bp, Rattus norvegicus
gaacttagcggtcagtgtgcataca

SEQ ID NO: 297055 - DNA, 25 bp, Rattus norvegicus
gaacttagcggtgagtgtgcataca

SEQ ID NO: 297056 - DNA, 25 bp, Rattus norvegicus
gaacttagcgttctactggatccta

SEQ ID NO: 297057 - DNA, 25 bp, Rattus norvegicus
gaacttagcgttgtactggatccta

SEQ ID NO: 297058 - DNA, 25 bp, Rattus norvegicus
gaacttagtcagaggcctgctgcgg

SEQ ID NO: 297059 - DNA, 25 bp, Rattus norvegicus
gaacttagtcagtggcctgctgcgg

SEQ ID NO: 297060 - DNA, 25 bp, Rattus norvegicus
gaacttagtcatcattccttgcagc

SEQ ID NO: 297061 - DNA, 25 bp, Rattus norvegicus
gaacttagtcatgattccttgcagc

SEQ ID NO: 297062 - DNA, 25 bp, Rattus norvegicus
gaacttagttctataattcaaagcc

SEQ ID NO: 297063 - DNA, 25 bp, Rattus norvegicus
gaacttagttctctctgcaatttat

SEQ ID NO: 297064 - DNA, 25 bp, Rattus norvegicus
gaacttagttctgtctgcaatttat

SEQ ID NO: 297065 - DNA, 25 bp, Rattus norvegicus
gaacttagttctttaattcaaagcc

SEQ ID NO: 297066 - DNA, 25 bp, Rattus norvegicus
gaacttatactcacacagacttaga

SEQ ID NO: 297067 - DNA, 25 bp, Rattus norvegicus
gaacttatactctcacagacttaga

SEQ ID NO: 297068 - DNA, 25 bp, Rattus norvegicus
gaacttatcactatcttcttggtta

SEQ ID NO: 297069 - DNA, 25 bp, Rattus norvegicus
gaacttatcactttcttcttggtta

SEQ ID NO: 297070 - DNA, 25 bp, Rattus norvegicus
gaacttatgatgctcctcgggacac

SEQ ID NO: 297071 - DNA, 25 bp, Rattus norvegicus
gaacttatgatggtcctcgggacac

SEQ ID NO: 297072 - DNA, 25 bp, Rattus norvegicus
gaacttatggttcctggttgccagg

SEQ ID NO: 297073 - DNA, 25 bp, Rattus norvegicus
gaacttatggttgctggttgccagg

SEQ ID NO: 297074 - DNA, 25 bp, Rattus norvegicus
gaacttattcatctacttgctggga

SEQ ID NO: 297075 - DNA, 25 bp, Rattus norvegicus
gaacttattcatgtacttgctggga

SEQ ID NO: 297076 - DNA, 25 bp, Rattus norvegicus
gaacttcaacagactccaaaacgct

SEQ ID NO: 297077 - DNA, 25 bp, Rattus norvegicus
gaacttcaacagtctccaaaacgct

SEQ ID NO: 297078 - DNA, 25 bp, Rattus norvegicus
gaacttcaatatccagccttgtgag

SEQ ID NO: 297079 - DNA, 25 bp, Rattus norvegicus
gaacttcaatatgcagccttgtgag

SEQ ID NO: 297080 - DNA, 25 bp, Rattus norvegicus
gaacttcaatcactgtagtctaaga

SEQ ID NO: 297081 - DNA, 25 bp, Rattus norvegicus
gaacttcaatcagtgtagtctaaga

SEQ ID NO: 297082 - DNA, 25 bp, Rattus norvegicus
gaacttcacaaaatcctcatctggg

SEQ ID NO: 297083 - DNA, 25 bp, Rattus norvegicus
gaacttcacaaattcctcatctggg

SEQ ID NO: 297084 - DNA, 25 bp, Rattus norvegicus
gaacttcaccagaagtgcagaccct

SEQ ID NO: 297085 - DNA, 25 bp, Rattus norvegicus
gaacttcaccagtagtgcagaccct

SEQ ID NO: 297086 - DNA, 25 bp, Rattus norvegicus
gaacttcaccttctttatcacaaag

SEQ ID NO: 297087 - DNA, 25 bp, Rattus norvegicus
gaacttcaccttgtttatcacaaag

SEQ ID NO: 297088 - DNA, 25 bp, Rattus norvegicus
gaacttcacttgactttattcacat

SEQ ID NO: 297089 - DNA, 25 bp, Rattus norvegicus
gaacttcacttgtctttattcacat

SEQ ID NO: 297090 - DNA, 25 bp, Rattus norvegicus
gaacttcactttctggacacacctt

SEQ ID NO: 297091 - DNA, 25 bp, Rattus norvegicus
gaacttcactttgtggacacacctt

SEQ ID NO: 297092 - DNA, 25 bp, Rattus norvegicus
gaacttcagactatggtgactctca

SEQ ID NO: 297093 - DNA, 25 bp, Rattus norvegicus
gaacttcagactttggtgactctca

SEQ ID NO: 297094 - DNA, 25 bp, Rattus norvegicus
gaacttcagagtcaaagcctcagag

SEQ ID NO: 297095 - DNA, 25 bp, Rattus norvegicus
gaacttcagagtgaaagcctcagag

SEQ ID NO: 297096 - DNA, 25 bp, Rattus norvegicus
gaacttcagcctagcatcacttttt

SEQ ID NO: 297097 - DNA, 25 bp, Rattus norvegicus
gaacttcagccttgcatcacttttt

SEQ ID NO: 297098 - DNA, 25 bp, Rattus norvegicus
gaacttcagctgatctcatctgcaa

SEQ ID NO: 297099 - DNA, 25 bp, Rattus norvegicus
gaacttcagctgttctcatctgcaa

SEQ ID NO: 297100 - DNA, 25 bp, Rattus norvegicus
gaacttcagttaatggcctgggccc

SEQ ID NO: 297101 - DNA, 25 bp, Rattus norvegicus
gaacttcagttattggcctgggccc

SEQ ID NO: 297102 - DNA, 25 bp, Rattus norvegicus
gaacttcagttgagcattgcctccc

SEQ ID NO: 297103 - DNA, 25 bp, Rattus norvegicus
gaacttcagttgtgcattgcctccc

SEQ ID NO: 297104 - DNA, 25 bp, Rattus norvegicus
gaacttcatcgtcaaccacatgagg

SEQ ID NO: 297105 - DNA, 25 bp, Rattus norvegicus
gaacttcatcgtgaaccacatgagg

SEQ ID NO: 297106 - DNA, 25 bp, Rattus norvegicus
gaacttcatcttaaaaaagcccagt

SEQ ID NO: 297107 - DNA, 25 bp, Rattus norvegicus
gaacttcatctttaaaaagcccagt

SEQ ID NO: 297108 - DNA, 25 bp, Rattus norvegicus
gaacttcatgcccacggttgtcttt

SEQ ID NO: 297109 - DNA, 25 bp, Rattus norvegicus
gaacttcatgccgacggttgtcttt

SEQ ID NO: 297110 - DNA, 25 bp, Rattus norvegicus
gaacttcatgcgcaccatgtatggg

SEQ ID NO: 297111 - DNA, 25 bp, Rattus norvegicus
gaacttcatgcggaccatgtatggg

SEQ ID NO: 297112 - DNA, 25 bp, Rattus norvegicus
gaacttcatgctaggcagacactgc

SEQ ID NO: 297113 - DNA, 25 bp, Rattus norvegicus
gaacttcatgcttggcagacactgc

SEQ ID NO: 297114 - DNA, 25 bp, Rattus norvegicus
gaacttcatggaactccaggccaag

SEQ ID NO: 297115 - DNA, 25 bp, Rattus norvegicus
gaacttcatggatctccaggccaag

SEQ ID NO: 297116 - DNA, 25 bp, Rattus norvegicus
gaacttcattaacactctaggcatt

SEQ ID NO: 297117 - DNA, 25 bp, Rattus norvegicus
gaacttcattaagactctaggcatt

SEQ ID NO: 297118 - DNA, 25 bp, Rattus norvegicus
gaacttcattcccaagacaggtact

SEQ ID NO: 297119 - DNA, 25 bp, Rattus norvegicus
gaacttcattccgaagacaggtact

SEQ ID NO: 297120 - DNA, 25 bp, Rattus norvegicus
gaacttcattttcgcaactctaatt

SEQ ID NO: 297121 - DNA, 25 bp, Rattus norvegicus
gaacttcattttggcaactctaatt

SEQ ID NO: 297122 - DNA, 25 bp, Rattus norvegicus
gaacttccagatcaagcatccccat

SEQ ID NO: 297123 - DNA, 25 bp, Rattus norvegicus
gaacttccagatgaagcatccccat

SEQ ID NO: 297124 - DNA, 25 bp, Rattus norvegicus
gaacttcccagtcttactctaggag

SEQ ID NO: 297125 - DNA, 25 bp, Rattus norvegicus
gaacttcccagtgttactctaggag

SEQ ID NO: 297126 - DNA, 25 bp, Rattus norvegicus
gaacttcccattaaaccactgttga

SEQ ID NO: 297127 - DNA, 25 bp, Rattus norvegicus
gaacttcccattatacaagcttcgg

SEQ ID NO: 297128 - DNA, 25 bp, Rattus norvegicus
gaacttcccatttaaccactgttga

SEQ ID NO: 297129 - DNA, 25 bp, Rattus norvegicus
gaacttcccattttacaagcttcgg

SEQ ID NO: 297130 - DNA, 25 bp, Rattus norvegicus
gaacttccccaaaactacttgctat

SEQ ID NO: 297131 - DNA, 25 bp, Rattus norvegicus
gaacttccccaatactacttgctat

SEQ ID NO: 297132 - DNA, 25 bp, Rattus norvegicus
gaacttcccgccaacaagaggctaa

SEQ ID NO: 297133 - DNA, 25 bp, Rattus norvegicus
gaacttcccgcctacaagaggctaa

SEQ ID NO: 297134 - DNA, 25 bp, Rattus norvegicus
gaacttcccggcactgtttgacagt

SEQ ID NO: 297135 - DNA, 25 bp, Rattus norvegicus
gaacttcccggctctgtttgacagt

SEQ ID NO: 297136 - DNA, 25 bp, Rattus norvegicus
gaacttccgggacagcagcagtgca

SEQ ID NO: 297137 - DNA, 25 bp, Rattus norvegicus
gaacttccgggagagcagcagtgca

SEQ ID NO: 297138 - DNA, 25 bp, Rattus norvegicus
gaacttcctaagataaccacttgat

SEQ ID NO: 297139 - DNA, 25 bp, Rattus norvegicus
gaacttcctaagttaaccacttgat

SEQ ID NO: 297140 - DNA, 25 bp, Rattus norvegicus
gaacttcctgccactatgaacttga

SEQ ID NO: 297141 - DNA, 25 bp, Rattus norvegicus
gaacttcctgcctctatgaacttga

SEQ ID NO: 297142 - DNA, 25 bp, Rattus norvegicus
gaacttcctggacatggtacaccga

SEQ ID NO: 297143 - DNA, 25 bp, Rattus norvegicus
gaacttcctggagatggtacaccga

SEQ ID NO: 297144 - DNA, 25 bp, Rattus norvegicus
gaacttcctgtcagtattcttttta

SEQ ID NO: 297145 - DNA, 25 bp, Rattus norvegicus
gaacttcctgtctgtattcttttta

SEQ ID NO: 297146 - DNA, 25 bp, Rattus norvegicus
gaacttccttcacaatttcattcct

SEQ ID NO: 297147 - DNA, 25 bp, Rattus norvegicus
gaacttccttcagaatttcattcct

SEQ ID NO: 297148 - DNA, 25 bp, Rattus norvegicus
gaacttccttcgcatctgttttgaa

SEQ ID NO: 297149 - DNA, 25 bp, Rattus norvegicus
gaacttccttcggatctgttttgaa

SEQ ID NO: 297150 - DNA, 25 bp, Rattus norvegicus
gaacttcctttcaaatgagatttgc

SEQ ID NO: 297151 - DNA, 25 bp, Rattus norvegicus
gaacttcctttccttgtcattaaat

SEQ ID NO: 297152 - DNA, 25 bp, Rattus norvegicus
gaacttcctttcgttgtcattaaat

SEQ ID NO: 297153 - DNA, 25 bp, Rattus norvegicus
gaacttcctttctaatgagatttgc

SEQ ID NO: 297154 - DNA, 25 bp, Rattus norvegicus
gaacttcgaatgcactgtccactgg

SEQ ID NO: 297155 - DNA, 25 bp, Rattus norvegicus
gaacttcgaatggactgtccactgg

SEQ ID NO: 297156 - DNA, 25 bp, Rattus norvegicus
gaacttcgagaaatactgtccatca

SEQ ID NO: 297157 - DNA, 25 bp, Rattus norvegicus
gaacttcgagaattactgtccatca

SEQ ID NO: 297158 - DNA, 25 bp, Rattus norvegicus
gaacttcgagatcccttactcttga

SEQ ID NO: 297159 - DNA, 25 bp, Rattus norvegicus
gaacttcgagatgccttactcttga

SEQ ID NO: 297160 - DNA, 25 bp, Rattus norvegicus
gaacttcgcggcactacttgaggag

SEQ ID NO: 297161 - DNA, 25 bp, Rattus norvegicus
gaacttcgcggctctacttgaggag

SEQ ID NO: 297162 - DNA, 25 bp, Rattus norvegicus
gaacttcgcttccaaacactggtgt

SEQ ID NO: 297163 - DNA, 25 bp, Rattus norvegicus
gaacttcgcttcgaaacactggtgt

SEQ ID NO: 297164 - DNA, 25 bp, Rattus norvegicus
gaacttcgtttgacagcagtccgta

SEQ ID NO: 297165 - DNA, 25 bp, Rattus norvegicus
gaacttcgtttgtcagcagtccgta

SEQ ID NO: 297166 - DNA, 25 bp, Rattus norvegicus
gaacttctaaagactgtttcctggg

SEQ ID NO: 297167 - DNA, 25 bp, Rattus norvegicus
gaacttctaaagtctgtttcctggg

SEQ ID NO: 297168 - DNA, 25 bp, Rattus norvegicus
gaacttctacccagacctctgaagg

SEQ ID NO: 297169 - DNA, 25 bp, Rattus norvegicus
gaacttctaccctgacctctgaagg

SEQ ID NO: 297170 - DNA, 25 bp, Rattus norvegicus
gaacttctacggagccaacggcatg

SEQ ID NO: 297171 - DNA, 25 bp, Rattus norvegicus
gaacttctacggtgccaacggcatg

SEQ ID NO: 297172 - DNA, 25 bp, Rattus norvegicus
gaacttctatgtcttttgggaccga

SEQ ID NO: 297173 - DNA, 25 bp, Rattus norvegicus
gaacttctatgtgttttgggaccga

SEQ ID NO: 297174 - DNA, 25 bp, Rattus norvegicus
gaacttctcattacagtttgctaat

SEQ ID NO: 297175 - DNA, 25 bp, Rattus norvegicus
gaacttctcatttcagtttgctaat

SEQ ID NO: 297176 - DNA, 25 bp, Rattus norvegicus
gaacttctccggcaagtaccaagtg

SEQ ID NO: 297177 - DNA, 25 bp, Rattus norvegicus
gaacttctccgggaagtaccaagtg

SEQ ID NO: 297178 - DNA, 25 bp, Rattus norvegicus
gaacttctcctaatcaccagtactt

SEQ ID NO: 297179 - DNA, 25 bp, Rattus norvegicus
gaacttctcctattcaccagtactt

SEQ ID NO: 297180 - DNA, 25 bp, Rattus norvegicus
gaacttctccttctgaccagtaact

SEQ ID NO: 297181 - DNA, 25 bp, Rattus norvegicus
gaacttctccttgtgaccagtaact

SEQ ID NO: 297182 - DNA, 25 bp, Rattus norvegicus
gaacttctcggcaaattgtgtcact

SEQ ID NO: 297183 - DNA, 25 bp, Rattus norvegicus
gaacttctcggctaattgtgtcact

SEQ ID NO: 297184 - DNA, 25 bp, Rattus norvegicus
gaacttctcggtcagtgaccgctct

SEQ ID NO: 297185 - DNA, 25 bp, Rattus norvegicus
gaacttctcggtgagtgaccgctct

SEQ ID NO: 297186 - DNA, 25 bp, Rattus norvegicus
gaacttctctgtctccatacgggaa

SEQ ID NO: 297187 - DNA, 25 bp, Rattus norvegicus
gaacttctctgtgtccatacgggaa

SEQ ID NO: 297188 - DNA, 25 bp, Rattus norvegicus
gaacttctcttcctgatggttaatg

SEQ ID NO: 297189 - DNA, 25 bp, Rattus norvegicus
gaacttctcttcgtgatggttaatg

SEQ ID NO: 297190 - DNA, 25 bp, Rattus norvegicus
gaacttctcttgctccttagatgaa

SEQ ID NO: 297191 - DNA, 25 bp, Rattus norvegicus
gaacttctcttggtccttagatgaa

SEQ ID NO: 297192 - DNA, 25 bp, Rattus norvegicus
gaacttctgcagaccataggagccc

SEQ ID NO: 297193 - DNA, 25 bp, Rattus norvegicus
gaacttctgcagtccataggagccc

SEQ ID NO: 297194 - DNA, 25 bp, Rattus norvegicus
gaacttctggagactatttttgtta

SEQ ID NO: 297195 - DNA, 25 bp, Rattus norvegicus
gaacttctggagtctatttttgtta

SEQ ID NO: 297196 - DNA, 25 bp, Rattus norvegicus
gaacttctggccacgtgattaatac

SEQ ID NO: 297197 - DNA, 25 bp, Rattus norvegicus
gaacttctggcctcgtgattaatac

SEQ ID NO: 297198 - DNA, 25 bp, Rattus norvegicus
gaacttctggctagcaaatcttaga

SEQ ID NO: 297199 - DNA, 25 bp, Rattus norvegicus
gaacttctggcttgcaaatcttaga

SEQ ID NO: 297200 - DNA, 25 bp, Rattus norvegicus
gaacttctgggcagcttcggactta

SEQ ID NO: 297201 - DNA, 25 bp, Rattus norvegicus
gaacttctgggcagtgaaggcacga

SEQ ID NO: 297202 - DNA, 25 bp, Rattus norvegicus
gaacttctgggctgcttcggactta

SEQ ID NO: 297203 - DNA, 25 bp, Rattus norvegicus
gaacttctgggctgtgaaggcacga

SEQ ID NO: 297204 - DNA, 25 bp, Rattus norvegicus
gaacttctggtccttaagtgcacac

SEQ ID NO: 297205 - DNA, 25 bp, Rattus norvegicus
gaacttctggtcgttaagtgcacac

SEQ ID NO: 297206 - DNA, 25 bp, Rattus norvegicus
gaacttctgtaccaactttgaataa

SEQ ID NO: 297207 - DNA, 25 bp, Rattus norvegicus
gaacttctgtacgaactttgaataa

SEQ ID NO: 297208 - DNA, 25 bp, Rattus norvegicus
gaacttctgtggaccctgtgagata

SEQ ID NO: 297209 - DNA, 25 bp, Rattus norvegicus
gaacttctgtggtccctgtgagata

SEQ ID NO: 297210 - DNA, 25 bp, Rattus norvegicus
gaacttctgtgtactaggctgacct

SEQ ID NO: 297211 - DNA, 25 bp, Rattus norvegicus
gaacttctgtgttctaggctgacct

SEQ ID NO: 297212 - DNA, 25 bp, Rattus norvegicus
gaacttctgtttcatgtcttggtct

SEQ ID NO: 297213 - DNA, 25 bp, Rattus norvegicus
gaacttctgtttgatgtcttggtct

SEQ ID NO: 297214 - DNA, 25 bp, Rattus norvegicus
gaacttcttagaattgcaaactgga

SEQ ID NO: 297215 - DNA, 25 bp, Rattus norvegicus
gaacttcttagatttgcaaactgga

SEQ ID NO: 297216 - DNA, 25 bp, Rattus norvegicus
gaacttcttcagctgaaggcacagt

SEQ ID NO: 297217 - DNA, 25 bp, Rattus norvegicus
gaacttcttcaggtgaaggcacagt

SEQ ID NO: 297218 - DNA, 25 bp, Rattus norvegicus
gaacttcttgcaaacactggcagaa

SEQ ID NO: 297219 - DNA, 25 bp, Rattus norvegicus
gaacttcttgcatacactggcagaa

SEQ ID NO: 297220 - DNA, 25 bp, Rattus norvegicus
gaacttcttgctcgtttcagacaga

SEQ ID NO: 297221 - DNA, 25 bp, Rattus norvegicus
gaacttcttgctggtttcagacaga

SEQ ID NO: 297222 - DNA, 25 bp, Rattus norvegicus
gaacttcttggcctgtgacttaatt

SEQ ID NO: 297223 - DNA, 25 bp, Rattus norvegicus
gaacttcttggcgtgtgacttaatt

SEQ ID NO: 297224 - DNA, 25 bp, Rattus norvegicus
gaacttcttttgactcatgagtcct

SEQ ID NO: 297225 - DNA, 25 bp, Rattus norvegicus
gaacttcttttgtctcatgagtcct

SEQ ID NO: 297226 - DNA, 25 bp, Rattus norvegicus
gaacttctttttcacacttctggag

SEQ ID NO: 297227 - DNA, 25 bp, Rattus norvegicus
gaacttctttttgacacttctggag

SEQ ID NO: 297228 - DNA, 25 bp, Rattus norvegicus
gaacttgaaagtcctcgaactgcaa

SEQ ID NO: 297229 - DNA, 25 bp, Rattus norvegicus
gaacttgaaagtgctcgaactgcaa

SEQ ID NO: 297230 - DNA, 25 bp, Rattus norvegicus
gaacttgaagcacaatatggctcag

SEQ ID NO: 297231 - DNA, 25 bp, Rattus norvegicus
gaacttgaagcagaatatggctcag

SEQ ID NO: 297232 - DNA, 25 bp, Rattus norvegicus
gaacttgaagctagcacatacccgc

SEQ ID NO: 297233 - DNA, 25 bp, Rattus norvegicus
gaacttgaagcttgcacatacccgc

SEQ ID NO: 297234 - DNA, 25 bp, Rattus norvegicus
gaacttgaaggcatccatctttctc

SEQ ID NO: 297235 - DNA, 25 bp, Rattus norvegicus
gaacttgaaggcttccatctttctc

SEQ ID NO: 297236 - DNA, 25 bp, Rattus norvegicus
gaacttgacattcaaacgcgaactg

SEQ ID NO: 297237 - DNA, 25 bp, Rattus norvegicus
gaacttgacattgaaacgcgaactg

SEQ ID NO: 297238 - DNA, 25 bp, Rattus norvegicus
gaacttgaccagaacgaacccagaa

SEQ ID NO: 297239 - DNA, 25 bp, Rattus norvegicus
gaacttgaccagatagattctaaat

SEQ ID NO: 297240 - DNA, 25 bp, Rattus norvegicus
gaacttgaccagtacgaacccagaa

SEQ ID NO: 297241 - DNA, 25 bp, Rattus norvegicus
gaacttgaccagttagattctaaat

SEQ ID NO: 297242 - DNA, 25 bp, Rattus norvegicus
gaacttgacctgatagggcattaaa

SEQ ID NO: 297243 - DNA, 25 bp, Rattus norvegicus
gaacttgacctgttagggcattaaa

SEQ ID NO: 297244 - DNA, 25 bp, Rattus norvegicus
gaacttgaccttctcagaacacaca

SEQ ID NO: 297245 - DNA, 25 bp, Rattus norvegicus
gaacttgaccttgtcagaacacaca

SEQ ID NO: 297246 - DNA, 25 bp, Rattus norvegicus
gaacttgacgctccagttgtgaatc

SEQ ID NO: 297247 - DNA, 25 bp, Rattus norvegicus
gaacttgacgctgcagttgtgaatc

SEQ ID NO: 297248 - DNA, 25 bp, Rattus norvegicus
gaacttgactctccacaaaacacta

SEQ ID NO: 297249 - DNA, 25 bp, Rattus norvegicus
gaacttgactctgcacaaaacacta

SEQ ID NO: 297250 - DNA, 25 bp, Rattus norvegicus
gaacttgactggatgcgacagagaa

SEQ ID NO: 297251 - DNA, 25 bp, Rattus norvegicus
gaacttgactggttgcgacagagaa

SEQ ID NO: 297252 - DNA, 25 bp, Rattus norvegicus
gaacttgagaaaaattctgcaccca

SEQ ID NO: 297253 - DNA, 25 bp, Rattus norvegicus
gaacttgagaaatattctgcaccca

SEQ ID NO: 297254 - DNA, 25 bp, Rattus norvegicus
gaacttgagagaagagccatgtcat

SEQ ID NO: 297255 - DNA, 25 bp, Rattus norvegicus
gaacttgagagatgagccatgtcat

SEQ ID NO: 297256 - DNA, 25 bp, Rattus norvegicus
gaacttgagcccactggagcagcag

SEQ ID NO: 297257 - DNA, 25 bp, Rattus norvegicus
gaacttgagccccaagtctgagaag

SEQ ID NO: 297258 - DNA, 25 bp, Rattus norvegicus
gaacttgagcccgaagtctgagaag

SEQ ID NO: 297259 - DNA, 25 bp, Rattus norvegicus
gaacttgagccctctggagcagcag

SEQ ID NO: 297260 - DNA, 25 bp, Rattus norvegicus
gaacttgagcctaatgtcgggccac

SEQ ID NO: 297261 - DNA, 25 bp, Rattus norvegicus
gaacttgagccttatgtcgggccac

SEQ ID NO: 297262 - DNA, 25 bp, Rattus norvegicus
gaacttgagcggctcattcctgcac

SEQ ID NO: 297263 - DNA, 25 bp, Rattus norvegicus
gaacttgagcgggtcattcctgcac

SEQ ID NO: 297264 - DNA, 25 bp, Rattus norvegicus
gaacttgaggccagaatctcctacc

SEQ ID NO: 297265 - DNA, 25 bp, Rattus norvegicus
gaacttgaggccagtgttgtctaca

SEQ ID NO: 297266 - DNA, 25 bp, Rattus norvegicus
gaacttgaggcctgaatctcctacc

SEQ ID NO: 297267 - DNA, 25 bp, Rattus norvegicus
gaacttgaggcctgtgttgtctaca

SEQ ID NO: 297268 - DNA, 25 bp, Rattus norvegicus
gaacttgagggaccgtaccctacac

SEQ ID NO: 297269 - DNA, 25 bp, Rattus norvegicus
gaacttgagggagcgtaccctacac

SEQ ID NO: 297270 - DNA, 25 bp, Rattus norvegicus
gaacttgagtatacagactgctgat

SEQ ID NO: 297271 - DNA, 25 bp, Rattus norvegicus
gaacttgagtataggccgctcatgg

SEQ ID NO: 297272 - DNA, 25 bp, Rattus norvegicus
gaacttgagtattcagactgctgat

SEQ ID NO: 297273 - DNA, 25 bp, Rattus norvegicus
gaacttgagtattggccgctcatgg

SEQ ID NO: 297274 - DNA, 25 bp, Rattus norvegicus
gaacttgagttcaaaccttcttcat

SEQ ID NO: 297275 - DNA, 25 bp, Rattus norvegicus
gaacttgagttctaaccttcttcat

SEQ ID NO: 297276 - DNA, 25 bp, Rattus norvegicus
gaacttgagtttaaccactcctcct

SEQ ID NO: 297277 - DNA, 25 bp, Rattus norvegicus
gaacttgagttttaccactcctcct

SEQ ID NO: 297278 - DNA, 25 bp, Rattus norvegicus
gaacttgatacaatcttttctccag

SEQ ID NO: 297279 - DNA, 25 bp, Rattus norvegicus
gaacttgatacattcttttctccag

SEQ ID NO: 297280 - DNA, 25 bp, Rattus norvegicus
gaacttgatcctaagcatggcagat

SEQ ID NO: 297281 - DNA, 25 bp, Rattus norvegicus
gaacttgatcctcaggaccacttga

SEQ ID NO: 297282 - DNA, 25 bp, Rattus norvegicus
gaacttgatcctgaggaccacttga

SEQ ID NO: 297283 - DNA, 25 bp, Rattus norvegicus
gaacttgatccttagcatggcagat

SEQ ID NO: 297284 - DNA, 25 bp, Rattus norvegicus
gaacttgatcttctgcagactcaga

SEQ ID NO: 297285 - DNA, 25 bp, Rattus norvegicus
gaacttgatcttgtgcagactcaga

SEQ ID NO: 297286 - DNA, 25 bp, Rattus norvegicus
gaacttgatttcatggatgctctgc

SEQ ID NO: 297287 - DNA, 25 bp, Rattus norvegicus
gaacttgatttcttggatgctctgc

SEQ ID NO: 297288 - DNA, 25 bp, Rattus norvegicus
gaacttgcaaaaaggctcctgtcca

SEQ ID NO: 297289 - DNA, 25 bp, Rattus norvegicus
gaacttgcaaaatggctcctgtcca

SEQ ID NO: 297290 - DNA, 25 bp, Rattus norvegicus
gaacttgcactactattttaccacc

SEQ ID NO: 297291 - DNA, 25 bp, Rattus norvegicus
gaacttgcactagtattttaccacc

SEQ ID NO: 297292 - DNA, 25 bp, Rattus norvegicus
gaacttgcagaaagcactggaagag

SEQ ID NO: 297293 - DNA, 25 bp, Rattus norvegicus
gaacttgcagaatgcactggaagag

SEQ ID NO: 297294 - DNA, 25 bp, Rattus norvegicus
gaacttgcagatagtcttccttgtg

SEQ ID NO: 297295 - DNA, 25 bp, Rattus norvegicus
gaacttgcagattgtcttccttgtg

SEQ ID NO: 297296 - DNA, 25 bp, Rattus norvegicus
gaacttgccaaacaaattccatgtg

SEQ ID NO: 297297 - DNA, 25 bp, Rattus norvegicus
gaacttgccaaagaaattccatgtg

SEQ ID NO: 297298 - DNA, 25 bp, Rattus norvegicus
gaacttgccacacatacatgaggtt

SEQ ID NO: 297299 - DNA, 25 bp, Rattus norvegicus
gaacttgccacagatacatgaggtt

SEQ ID NO: 297300 - DNA, 25 bp, Rattus norvegicus
gaacttgccagcatttccacttctt

SEQ ID NO: 297301 - DNA, 25 bp, Rattus norvegicus
gaacttgccagcttttccacttctt

SEQ ID NO: 297302 - DNA, 25 bp, Rattus norvegicus
gaacttgcctagcttaaatactcta

SEQ ID NO: 297303 - DNA, 25 bp, Rattus norvegicus
gaacttgcctaggttaaatactcta

SEQ ID NO: 297304 - DNA, 25 bp, Rattus norvegicus
gaacttgcctgtcacagctactgga

SEQ ID NO: 297305 - DNA, 25 bp, Rattus norvegicus
gaacttgcctgtgacagctactgga

SEQ ID NO: 297306 - DNA, 25 bp, Rattus norvegicus
gaacttgcgcacagtgggcccagga

SEQ ID NO: 297307 - DNA, 25 bp, Rattus norvegicus
gaacttgcgcactgtgggcccagga

SEQ ID NO: 297308 - DNA, 25 bp, Rattus norvegicus
gaacttgcgccgagttgcccgagag

SEQ ID NO: 297309 - DNA, 25 bp, Rattus norvegicus
gaacttgcgccgtgttgcccgagag

SEQ ID NO: 297310 - DNA, 25 bp, Rattus norvegicus
gaacttgctaccaagggtggccttg

SEQ ID NO: 297311 - DNA, 25 bp, Rattus norvegicus
gaacttgctacctagggtggccttg

SEQ ID NO: 297312 - DNA, 25 bp, Rattus norvegicus
gaacttgctatgaaaggccgtgtgg

SEQ ID NO: 297313 - DNA, 25 bp, Rattus norvegicus
gaacttgctatgaacattccaaaat

SEQ ID NO: 297314 - DNA, 25 bp, Rattus norvegicus
gaacttgctatgaggacccagttgg

SEQ ID NO: 297315 - DNA, 25 bp, Rattus norvegicus
gaacttgctatgtaaggccgtgtgg

SEQ ID NO: 297316 - DNA, 25 bp, Rattus norvegicus
gaacttgctatgtacattccaaaat

SEQ ID NO: 297317 - DNA, 25 bp, Rattus norvegicus
gaacttgctatgtggacccagttgg

SEQ ID NO: 297318 - DNA, 25 bp, Rattus norvegicus
gaacttgctcttctaagaccaggct

SEQ ID NO: 297319 - DNA, 25 bp, Rattus norvegicus
gaacttgctcttgtaagaccaggct

SEQ ID NO: 297320 - DNA, 25 bp, Rattus norvegicus
gaacttgctgctcagagatgcatcc

SEQ ID NO: 297321 - DNA, 25 bp, Rattus norvegicus
gaacttgctgctcgctgaggtcatc

SEQ ID NO: 297322 - DNA, 25 bp, Rattus norvegicus
gaacttgctgctcttaaataagact

SEQ ID NO: 297323 - DNA, 25 bp, Rattus norvegicus
gaacttgctgctgagagatgcatcc

SEQ ID NO: 297324 - DNA, 25 bp, Rattus norvegicus
gaacttgctgctggctgaggtcatc

SEQ ID NO: 297325 - DNA, 25 bp, Rattus norvegicus
gaacttgctgctgttaaataagact

SEQ ID NO: 297326 - DNA, 25 bp, Rattus norvegicus
gaacttgctggtatctgctgacgac

SEQ ID NO: 297327 - DNA, 25 bp, Rattus norvegicus
gaacttgctggtctttcagtcctca

SEQ ID NO: 297328 - DNA, 25 bp, Rattus norvegicus
gaacttgctggtgtttcagtcctca

SEQ ID NO: 297329 - DNA, 25 bp, Rattus norvegicus
gaacttgctggtttctgctgacgac

SEQ ID NO: 297330 - DNA, 25 bp, Rattus norvegicus
gaacttgctttaatgctatgtgtta

SEQ ID NO: 297331 - DNA, 25 bp, Rattus norvegicus
gaacttgctttattgctatgtgtta

SEQ ID NO: 297332 - DNA, 25 bp, Rattus norvegicus
gaacttgctttcaccaatgctttgt

SEQ ID NO: 297333 - DNA, 25 bp, Rattus norvegicus
gaacttgctttctccaatgctttgt

SEQ ID NO: 297334 - DNA, 25 bp, Rattus norvegicus
gaacttggaatgaacctggatttgt

SEQ ID NO: 297335 - DNA, 25 bp, Rattus norvegicus
gaacttggaatgtacctggatttgt

SEQ ID NO: 297336 - DNA, 25 bp, Rattus norvegicus
gaacttggacataggtattgacgct

SEQ ID NO: 297337 - DNA, 25 bp, Rattus norvegicus
gaacttggacattggtattgacgct

SEQ ID NO: 297338 - DNA, 25 bp, Rattus norvegicus
gaacttggaccgctagggattccca

SEQ ID NO: 297339 - DNA, 25 bp, Rattus norvegicus
gaacttggaccggtagggattccca

SEQ ID NO: 297340 - DNA, 25 bp, Rattus norvegicus
gaacttggacttacattcctctgta

SEQ ID NO: 297341 - DNA, 25 bp, Rattus norvegicus
gaacttggacttatattgatgccct

SEQ ID NO: 297342 - DNA, 25 bp, Rattus norvegicus
gaacttggacttcacagcactgatg

SEQ ID NO: 297343 - DNA, 25 bp, Rattus norvegicus
gaacttggacttgacagcactgatg

SEQ ID NO: 297344 - DNA, 25 bp, Rattus norvegicus
gaacttggactttcattcctctgta

SEQ ID NO: 297345 - DNA, 25 bp, Rattus norvegicus
gaacttggacttttattgatgccct

SEQ ID NO: 297346 - DNA, 25 bp, Rattus norvegicus
gaacttggaggtcttaagcacccta

SEQ ID NO: 297347 - DNA, 25 bp, Rattus norvegicus
gaacttggaggtgttaagcacccta

SEQ ID NO: 297348 - DNA, 25 bp, Rattus norvegicus
gaacttggattgaaatgtctgctgt

SEQ ID NO: 297349 - DNA, 25 bp, Rattus norvegicus
gaacttggattgtaatgtctgctgt

SEQ ID NO: 297350 - DNA, 25 bp, Rattus norvegicus
gaacttggcaagacacatctaggtt

SEQ ID NO: 297351 - DNA, 25 bp, Rattus norvegicus
gaacttggcaagacgctgcacttga

SEQ ID NO: 297352 - DNA, 25 bp, Rattus norvegicus
gaacttggcaagactcactcagagc

SEQ ID NO: 297353 - DNA, 25 bp, Rattus norvegicus
gaacttggcaagtcacatctaggtt

SEQ ID NO: 297354 - DNA, 25 bp, Rattus norvegicus
gaacttggcaagtcgctgcacttga

SEQ ID NO: 297355 - DNA, 25 bp, Rattus norvegicus
gaacttggcaagtctcactcagagc

SEQ ID NO: 297356 - DNA, 25 bp, Rattus norvegicus
gaacttggcaataagatcaccatct

SEQ ID NO: 297357 - DNA, 25 bp, Rattus norvegicus
gaacttggcaattagatcaccatct

SEQ ID NO: 297358 - DNA, 25 bp, Rattus norvegicus
gaacttggcacacttctatctggtg

SEQ ID NO: 297359 - DNA, 25 bp, Rattus norvegicus
gaacttggcacagttctatctggtg

SEQ ID NO: 297360 - DNA, 25 bp, Rattus norvegicus
gaacttggcccgagggtcctatgtg

SEQ ID NO: 297361 - DNA, 25 bp, Rattus norvegicus
gaacttggcccgtgggtcctatgtg

SEQ ID NO: 297362 - DNA, 25 bp, Rattus norvegicus
gaacttggcctcaatgtttgctgtt

SEQ ID NO: 297363 - DNA, 25 bp, Rattus norvegicus
gaacttggcctctatgtttgctgtt

SEQ ID NO: 297364 - DNA, 25 bp, Rattus norvegicus
gaacttggccttatgtccagaagct

SEQ ID NO: 297365 - DNA, 25 bp, Rattus norvegicus
gaacttggccttttgtccagaagct

SEQ ID NO: 297366 - DNA, 25 bp, Rattus norvegicus
gaacttggcgtgcttgccctcgtta

SEQ ID NO: 297367 - DNA, 25 bp, Rattus norvegicus
gaacttggcgtggttgccctcgtta

SEQ ID NO: 297368 - DNA, 25 bp, Rattus norvegicus
gaacttggcttcatatgtcttactg

SEQ ID NO: 297369 - DNA, 25 bp, Rattus norvegicus
gaacttggcttcttatgtcttactg

SEQ ID NO: 297370 - DNA, 25 bp, Rattus norvegicus
gaacttgggaatctacctgagcttc

SEQ ID NO: 297371 - DNA, 25 bp, Rattus norvegicus
gaacttgggaatgtacctgagcttc

SEQ ID NO: 297372 - DNA, 25 bp, Rattus norvegicus
gaacttggtgaaccttcgtgaacta

SEQ ID NO: 297373 - DNA, 25 bp, Rattus norvegicus
gaacttggtgaacgctaagctactg

SEQ ID NO: 297374 - DNA, 25 bp, Rattus norvegicus
gaacttggtgaagcttcgtgaacta

SEQ ID NO: 297375 - DNA, 25 bp, Rattus norvegicus
gaacttggtgaaggctaagctactg

SEQ ID NO: 297376 - DNA, 25 bp, Rattus norvegicus
gaacttggtgataatccgagccgcc

SEQ ID NO: 297377 - DNA, 25 bp, Rattus norvegicus
gaacttggtgattatccgagccgcc

SEQ ID NO: 297378 - DNA, 25 bp, Rattus norvegicus
gaacttggtgctacaaacacccact

SEQ ID NO: 297379 - DNA, 25 bp, Rattus norvegicus
gaacttggtgcttcaaacacccact

SEQ ID NO: 297380 - DNA, 25 bp, Rattus norvegicus
gaacttggtggaatcctgtctccaa

SEQ ID NO: 297381 - DNA, 25 bp, Rattus norvegicus
gaacttggtggattcctgtctccaa

SEQ ID NO: 297382 - DNA, 25 bp, Rattus norvegicus
gaacttggtgtccattgtcatgcaa

SEQ ID NO: 297383 - DNA, 25 bp, Rattus norvegicus
gaacttggtgtcgattgtcatgcaa

SEQ ID NO: 297384 - DNA, 25 bp, Rattus norvegicus
gaacttggtgttcgtctttacccag

SEQ ID NO: 297385 - DNA, 25 bp, Rattus norvegicus
gaacttggtgttggtctttacccag

SEQ ID NO: 297386 - DNA, 25 bp, Rattus norvegicus
gaacttggttacacagttggtcctg

SEQ ID NO: 297387 - DNA, 25 bp, Rattus norvegicus
gaacttggttactcagttggtcctg

SEQ ID NO: 297388 - DNA, 25 bp, Rattus norvegicus
gaacttggtttgaggactcagactt

SEQ ID NO: 297389 - DNA, 25 bp, Rattus norvegicus
gaacttggtttgtggactcagactt

SEQ ID NO: 297390 - DNA, 25 bp, Rattus norvegicus
gaacttggttttcttgtctcggtca

SEQ ID NO: 297391 - DNA, 25 bp, Rattus norvegicus
gaacttggttttgttgtctcggtca

SEQ ID NO: 297392 - DNA, 25 bp, Rattus norvegicus
gaacttgtacgcaccttggcaggta

SEQ ID NO: 297393 - DNA, 25 bp, Rattus norvegicus
gaacttgtacgctccttggcaggta

SEQ ID NO: 297394 - DNA, 25 bp, Rattus norvegicus
gaacttgtagttctccagcctcagc

SEQ ID NO: 297395 - DNA, 25 bp, Rattus norvegicus
gaacttgtagttgtccagcctcagc

SEQ ID NO: 297396 - DNA, 25 bp, Rattus norvegicus
gaacttgtatacattcgcttgccta

SEQ ID NO: 297397 - DNA, 25 bp, Rattus norvegicus
gaacttgtatactttcgcttgccta

SEQ ID NO: 297398 - DNA, 25 bp, Rattus norvegicus
gaacttgtatatcactcctttaata

SEQ ID NO: 297399 - DNA, 25 bp, Rattus norvegicus
gaacttgtatatgactcctttaata

SEQ ID NO: 297400 - DNA, 25 bp, Rattus norvegicus
gaacttgtatccattgcctgttgtc

SEQ ID NO: 297401 - DNA, 25 bp, Rattus norvegicus
gaacttgtatcctttgcctgttgtc

SEQ ID NO: 297402 - DNA, 25 bp, Rattus norvegicus
gaacttgtcaagacgtcaccgttct

SEQ ID NO: 297403 - DNA, 25 bp, Rattus norvegicus
gaacttgtcaagtcgtcaccgttct

SEQ ID NO: 297404 - DNA, 25 bp, Rattus norvegicus
gaacttgtcaccagctatttattgt

SEQ ID NO: 297405 - DNA, 25 bp, Rattus norvegicus
gaacttgtcacctgctatttattgt

SEQ ID NO: 297406 - DNA, 25 bp, Rattus norvegicus
gaacttgtccaccaagctcaggata

SEQ ID NO: 297407 - DNA, 25 bp, Rattus norvegicus
gaacttgtccacgaagctcaggata

SEQ ID NO: 297408 - DNA, 25 bp, Rattus norvegicus
gaacttgtccctacagagtcaccag

SEQ ID NO: 297409 - DNA, 25 bp, Rattus norvegicus
gaacttgtcccttcagagtcaccag

SEQ ID NO: 297410 - DNA, 25 bp, Rattus norvegicus
gaacttgtcctgagagctgtcgccg

SEQ ID NO: 297411 - DNA, 25 bp, Rattus norvegicus
gaacttgtcctgtgagctgtcgccg

SEQ ID NO: 297412 - DNA, 25 bp, Rattus norvegicus
gaacttgtctccattgatgagccat

SEQ ID NO: 297413 - DNA, 25 bp, Rattus norvegicus
gaacttgtctcctttgatgagccat

SEQ ID NO: 297414 - DNA, 25 bp, Rattus norvegicus
gaacttgtctgtaaaacactcacag

SEQ ID NO: 297415 - DNA, 25 bp, Rattus norvegicus
gaacttgtctgttaaacactcacag

SEQ ID NO: 297416 - DNA, 25 bp, Rattus norvegicus
gaacttgtgaagaagctgtcgctga

SEQ ID NO: 297417 - DNA, 25 bp, Rattus norvegicus
gaacttgtgaagtagctgtcgctga

SEQ ID NO: 297418 - DNA, 25 bp, Rattus norvegicus
gaacttgtgactaaggcttttagcc

SEQ ID NO: 297419 - DNA, 25 bp, Rattus norvegicus
gaacttgtgacttaggcttttagcc

SEQ ID NO: 297420 - DNA, 25 bp, Rattus norvegicus
gaacttgtgaggaactggtcagatt

SEQ ID NO: 297421 - DNA, 25 bp, Rattus norvegicus
gaacttgtgaggtactggtcagatt

SEQ ID NO: 297422 - DNA, 25 bp, Rattus norvegicus
gaacttgtgccccttgttatctatc

SEQ ID NO: 297423 - DNA, 25 bp, Rattus norvegicus
gaacttgtgcccgttgttatctatc

SEQ ID NO: 297424 - DNA, 25 bp, Rattus norvegicus
gaacttgtggaaatcagactcccaa

SEQ ID NO: 297425 - DNA, 25 bp, Rattus norvegicus
gaacttgtggaattcagactcccaa

SEQ ID NO: 297426 - DNA, 25 bp, Rattus norvegicus
gaacttgtgtttactactgtgacat

SEQ ID NO: 297427 - DNA, 25 bp, Rattus norvegicus
gaacttgtgtttcagggtggcccta

SEQ ID NO: 297428 - DNA, 25 bp, Rattus norvegicus
gaacttgtgtttgagggtggcccta

SEQ ID NO: 297429 - DNA, 25 bp, Rattus norvegicus
gaacttgtgttttctactgtgacat

SEQ ID NO: 297430 - DNA, 25 bp, Rattus norvegicus
gaacttgttactagtttttgctaga

SEQ ID NO: 297431 - DNA, 25 bp, Rattus norvegicus
gaacttgttacttgtttttgctaga

SEQ ID NO: 297432 - DNA, 25 bp, Rattus norvegicus
gaacttgttagtacctccagggcat

SEQ ID NO: 297433 - DNA, 25 bp, Rattus norvegicus
gaacttgttagttcctccagggcat

SEQ ID NO: 297434 - DNA, 25 bp, Rattus norvegicus
gaacttgttatgcagtccagagagt

SEQ ID NO: 297435 - DNA, 25 bp, Rattus norvegicus
gaacttgttatggagtccagagagt

SEQ ID NO: 297436 - DNA, 25 bp, Rattus norvegicus
gaacttgttattagtggaccctcaa

SEQ ID NO: 297437 - DNA, 25 bp, Rattus norvegicus
gaacttgttatttgtggaccctcaa

SEQ ID NO: 297438 - DNA, 25 bp, Rattus norvegicus
gaacttgttcaaccagctgcccgag

SEQ ID NO: 297439 - DNA, 25 bp, Rattus norvegicus
gaacttgttcaagcagctgcccgag

SEQ ID NO: 297440 - DNA, 25 bp, Rattus norvegicus
gaacttgttcacagagctgctgata

SEQ ID NO: 297441 - DNA, 25 bp, Rattus norvegicus
gaacttgttcactgagctgctgata

SEQ ID NO: 297442 - DNA, 25 bp, Rattus norvegicus
gaacttgttcatcctcatgcagaag

SEQ ID NO: 297443 - DNA, 25 bp, Rattus norvegicus
gaacttgttcatgctcatgcagaag

SEQ ID NO: 297444 - DNA, 25 bp, Rattus norvegicus
gaacttgttcccaatggcttggagt

SEQ ID NO: 297445 - DNA, 25 bp, Rattus norvegicus
gaacttgttccctatggcttggagt

SEQ ID NO: 297446 - DNA, 25 bp, Rattus norvegicus
gaacttgttcctatgttatgacatg

SEQ ID NO: 297447 - DNA, 25 bp, Rattus norvegicus
gaacttgttcctttgttatgacatg

SEQ ID NO: 297448 - DNA, 25 bp, Rattus norvegicus
gaacttgttctgcaggcgtggccct

SEQ ID NO: 297449 - DNA, 25 bp, Rattus norvegicus
gaacttgttctggaggcgtggccct

SEQ ID NO: 297450 - DNA, 25 bp, Rattus norvegicus
gaacttgttggacgaatcatttcat

SEQ ID NO: 297451 - DNA, 25 bp, Rattus norvegicus
gaacttgttggaggaatcatttcat

SEQ ID NO: 297452 - DNA, 25 bp, Rattus norvegicus
gaactttaacagctcagtgccagtg

SEQ ID NO: 297453 - DNA, 25 bp, Rattus norvegicus
gaactttaacaggtcagtgccagtg

SEQ ID NO: 297454 - DNA, 25 bp, Rattus norvegicus
gaactttaagctcctgggtaacgtg

SEQ ID NO: 297455 - DNA, 25 bp, Rattus norvegicus
gaactttaagctgctgggtaacgtg

SEQ ID NO: 297456 - DNA, 25 bp, Rattus norvegicus
gaactttaagtactacagctcctga

SEQ ID NO: 297457 - DNA, 25 bp, Rattus norvegicus
gaactttaagtagtacagctcctga

SEQ ID NO: 297458 - DNA, 25 bp, Rattus norvegicus
gaactttaataactttgcccacagg

SEQ ID NO: 297459 - DNA, 25 bp, Rattus norvegicus
gaactttaataagtttgcccacagg

SEQ ID NO: 297460 - DNA, 25 bp, Rattus norvegicus
gaactttaatcacacgtaggcatgg

SEQ ID NO: 297461 - DNA, 25 bp, Rattus norvegicus
gaactttaatcagacgtaggcatgg

SEQ ID NO: 297462 - DNA, 25 bp, Rattus norvegicus
gaactttaatgcattcaatcagtaa

SEQ ID NO: 297463 - DNA, 25 bp, Rattus norvegicus
gaactttaatgctttcaatcagtaa

SEQ ID NO: 297464 - DNA, 25 bp, Rattus norvegicus
gaactttaccccaagtgtgtcatag

SEQ ID NO: 297465 - DNA, 25 bp, Rattus norvegicus
gaactttacccctagtgtgtcatag

SEQ ID NO: 297466 - DNA, 25 bp, Rattus norvegicus
gaactttaccggatctcaacaggag

SEQ ID NO: 297467 - DNA, 25 bp, Rattus norvegicus
gaactttaccggttctcaacaggag

SEQ ID NO: 297468 - DNA, 25 bp, Rattus norvegicus
gaactttactcaaactatccaggat

SEQ ID NO: 297469 - DNA, 25 bp, Rattus norvegicus
gaactttactcatactatccaggat

SEQ ID NO: 297470 - DNA, 25 bp, Rattus norvegicus
gaactttactctcacctgtgatcat

SEQ ID NO: 297471 - DNA, 25 bp, Rattus norvegicus
gaactttactctgacctgtgatcat

SEQ ID NO: 297472 - DNA, 25 bp, Rattus norvegicus
gaactttagattctgctacattcag

SEQ ID NO: 297473 - DNA, 25 bp, Rattus norvegicus
gaactttagattgtgctacattcag

SEQ ID NO: 297474 - DNA, 25 bp, Rattus norvegicus
gaactttaggcacattccttttagg

SEQ ID NO: 297475 - DNA, 25 bp, Rattus norvegicus
gaactttaggcagattccttttagg

SEQ ID NO: 297476 - DNA, 25 bp, Rattus norvegicus
gaactttagtgtcgtgctctgggtc

SEQ ID NO: 297477 - DNA, 25 bp, Rattus norvegicus
gaactttagtgtggtgctctgggtc

SEQ ID NO: 297478 - DNA, 25 bp, Rattus norvegicus
gaactttcaaagcttagtccagtga

SEQ ID NO: 297479 - DNA, 25 bp, Rattus norvegicus
gaactttcaaaggttagtccagtga

SEQ ID NO: 297480 - DNA, 25 bp, Rattus norvegicus
gaactttcacacacagaatgggtct

SEQ ID NO: 297481 - DNA, 25 bp, Rattus norvegicus
gaactttcacactcagaatgggtct

SEQ ID NO: 297482 - DNA, 25 bp, Rattus norvegicus
gaactttcacctactggtctttcta

SEQ ID NO: 297483 - DNA, 25 bp, Rattus norvegicus
gaactttcaccttctggtctttcta

SEQ ID NO: 297484 - DNA, 25 bp, Rattus norvegicus
gaactttcactaattgtggcctggt

SEQ ID NO: 297485 - DNA, 25 bp, Rattus norvegicus
gaactttcactatttgtggcctggt

SEQ ID NO: 297486 - DNA, 25 bp, Rattus norvegicus
gaactttcagaaacacaactgcagt

SEQ ID NO: 297487 - DNA, 25 bp, Rattus norvegicus
gaactttcagaatcacaactgcagt

SEQ ID NO: 297488 - DNA, 25 bp, Rattus norvegicus
gaactttcagttcgcgttctgtctt

SEQ ID NO: 297489 - DNA, 25 bp, Rattus norvegicus
gaactttcagttggcgttctgtctt

SEQ ID NO: 297490 - DNA, 25 bp, Rattus norvegicus
gaactttcatttctctactgtactg

SEQ ID NO: 297491 - DNA, 25 bp, Rattus norvegicus
gaactttcatttgtctactgtactg

SEQ ID NO: 297492 - DNA, 25 bp, Rattus norvegicus
gaactttccactcgaagtcctcttc

SEQ ID NO: 297493 - DNA, 25 bp, Rattus norvegicus
gaactttccactggaagtcctcttc

SEQ ID NO: 297494 - DNA, 25 bp, Rattus norvegicus
gaactttccctaacaacaattacta

SEQ ID NO: 297495 - DNA, 25 bp, Rattus norvegicus
gaactttccctatcaacaattacta

SEQ ID NO: 297496 - DNA, 25 bp, Rattus norvegicus
gaactttctagaccataattgccga

SEQ ID NO: 297497 - DNA, 25 bp, Rattus norvegicus
gaactttctagagcataattgccga

SEQ ID NO: 297498 - DNA, 25 bp, Rattus norvegicus
gaactttctaggcttttgtcaaaat

SEQ ID NO: 297499 - DNA, 25 bp, Rattus norvegicus
gaactttctagggttttgtcaaaat

SEQ ID NO: 297500 - DNA, 25 bp, Rattus norvegicus
gaactttctctacttactactgtgg

SEQ ID NO: 297501 - DNA, 25 bp, Rattus norvegicus
gaactttctctagttactactgtgg

SEQ ID NO: 297502 - DNA, 25 bp, Rattus norvegicus
gaactttctgacagtcttggacaaa

SEQ ID NO: 297503 - DNA, 25 bp, Rattus norvegicus
gaactttctgactgtcttggacaaa

SEQ ID NO: 297504 - DNA, 25 bp, Rattus norvegicus
gaactttctgctcgcttggtagcaa

SEQ ID NO: 297505 - DNA, 25 bp, Rattus norvegicus
gaactttctgctggcttggtagcaa

SEQ ID NO: 297506 - DNA, 25 bp, Rattus norvegicus
gaactttctgtaacttcagaggttt

SEQ ID NO: 297507 - DNA, 25 bp, Rattus norvegicus
gaactttctgtatcttcagaggttt

SEQ ID NO: 297508 - DNA, 25 bp, Rattus norvegicus
gaactttctgtcagggcctttagaa

SEQ ID NO: 297509 - DNA, 25 bp, Rattus norvegicus
gaactttctgtctgggcctttagaa

SEQ ID NO: 297510 - DNA, 25 bp, Rattus norvegicus
gaactttcttggatgctgtgtttcg

SEQ ID NO: 297511 - DNA, 25 bp, Rattus norvegicus
gaactttcttggttgctgtgtttcg

SEQ ID NO: 297512 - DNA, 25 bp, Rattus norvegicus
gaactttgaaacacttttgatggtg

SEQ ID NO: 297513 - DNA, 25 bp, Rattus norvegicus
gaactttgaaactcttttgatggtg

SEQ ID NO: 297514 - DNA, 25 bp, Rattus norvegicus
gaactttgacaaacccgtgtacttg

SEQ ID NO: 297515 - DNA, 25 bp, Rattus norvegicus
gaactttgacaatcccgtgtacttg

SEQ ID NO: 297516 - DNA, 25 bp, Rattus norvegicus
gaactttgacctctgcagcaataaa

SEQ ID NO: 297517 - DNA, 25 bp, Rattus norvegicus
gaactttgacctgtgcagcaataaa

SEQ ID NO: 297518 - DNA, 25 bp, Rattus norvegicus
gaactttgacttagagaggctccca

SEQ ID NO: 297519 - DNA, 25 bp, Rattus norvegicus
gaactttgactttgagaggctccca

SEQ ID NO: 297520 - DNA, 25 bp, Rattus norvegicus
gaactttgaggtcgactgcatttaa

SEQ ID NO: 297521 - DNA, 25 bp, Rattus norvegicus
gaactttgaggtggactgcatttaa

SEQ ID NO: 297522 - DNA, 25 bp, Rattus norvegicus
gaactttgatttctcatgtcacact

SEQ ID NO: 297523 - DNA, 25 bp, Rattus norvegicus
gaactttgatttgtcatgtcacact

SEQ ID NO: 297524 - DNA, 25 bp, Rattus norvegicus
gaactttgcacgctggaggtaccgt

SEQ ID NO: 297525 - DNA, 25 bp, Rattus norvegicus
gaactttgcacggtggaggtaccgt

SEQ ID NO: 297526 - DNA, 25 bp, Rattus norvegicus
gaactttgcatgctaagggctcaca

SEQ ID NO: 297527 - DNA, 25 bp, Rattus norvegicus
gaactttgcatggtaagggctcaca

SEQ ID NO: 297528 - DNA, 25 bp, Rattus norvegicus
gaactttgccaaagatagtgaccac

SEQ ID NO: 297529 - DNA, 25 bp, Rattus norvegicus
gaactttgccaatgatagtgaccac

SEQ ID NO: 297530 - DNA, 25 bp, Rattus norvegicus
gaactttggacgcagatcttaaaaa

SEQ ID NO: 297531 - DNA, 25 bp, Rattus norvegicus
gaactttggacggagatcttaaaaa

SEQ ID NO: 297532 - DNA, 25 bp, Rattus norvegicus
gaactttggactcgatctctgaata

SEQ ID NO: 297533 - DNA, 25 bp, Rattus norvegicus
gaactttggactggatctctgaata

SEQ ID NO: 297534 - DNA, 25 bp, Rattus norvegicus
gaactttggatcacaagggctgcta

SEQ ID NO: 297535 - DNA, 25 bp, Rattus norvegicus
gaactttggatcactgtatagactg

SEQ ID NO: 297536 - DNA, 25 bp, Rattus norvegicus
gaactttggatctcaagggctgcta

SEQ ID NO: 297537 - DNA, 25 bp, Rattus norvegicus
gaactttggatctctgtatagactg

SEQ ID NO: 297538 - DNA, 25 bp, Rattus norvegicus
gaactttggctacatgataaaactg

SEQ ID NO: 297539 - DNA, 25 bp, Rattus norvegicus
gaactttggctagatgataaaactg

SEQ ID NO: 297540 - DNA, 25 bp, Rattus norvegicus
gaactttggtagagccattgtctgt

SEQ ID NO: 297541 - DNA, 25 bp, Rattus norvegicus
gaactttggtagtgccattgtctgt

SEQ ID NO: 297542 - DNA, 25 bp, Rattus norvegicus
gaactttgtacacattctctttaga

SEQ ID NO: 297543 - DNA, 25 bp, Rattus norvegicus
gaactttgtacagattctctttaga

SEQ ID NO: 297544 - DNA, 25 bp, Rattus norvegicus
gaactttgtaccaattgacctggat

SEQ ID NO: 297545 - DNA, 25 bp, Rattus norvegicus
gaactttgtacctattgacctggat

SEQ ID NO: 297546 - DNA, 25 bp, Rattus norvegicus
gaactttgtaggaactatctgtctt

SEQ ID NO: 297547 - DNA, 25 bp, Rattus norvegicus
gaactttgtaggtactatctgtctt

SEQ ID NO: 297548 - DNA, 25 bp, Rattus norvegicus
gaactttgtccccttggcagtgagg

SEQ ID NO: 297549 - DNA, 25 bp, Rattus norvegicus
gaactttgtcccgttggcagtgagg

SEQ ID NO: 297550 - DNA, 25 bp, Rattus norvegicus
gaactttgtgatactctttaaggct

SEQ ID NO: 297551 - DNA, 25 bp, Rattus norvegicus
gaactttgtgattctctttaaggct

SEQ ID NO: 297552 - DNA, 25 bp, Rattus norvegicus
gaactttgttagacctgtgtttctg

SEQ ID NO: 297553 - DNA, 25 bp, Rattus norvegicus
gaactttgttagtcctgtgtttctg

SEQ ID NO: 297554 - DNA, 25 bp, Rattus norvegicus
gaactttgtttgactgtaacctgcc

SEQ ID NO: 297555 - DNA, 25 bp, Rattus norvegicus
gaactttgtttgtctgtaacctgcc

SEQ ID NO: 297556 - DNA, 25 bp, Rattus norvegicus
gaacttttaactcttccaggacagg

SEQ ID NO: 297557 - DNA, 25 bp, Rattus norvegicus
gaacttttaactgttccaggacagg

SEQ ID NO: 297558 - DNA, 25 bp, Rattus norvegicus
gaacttttaagtacagagcaagggc

SEQ ID NO: 297559 - DNA, 25 bp, Rattus norvegicus
gaacttttaagttcagagcaagggc

SEQ ID NO: 297560 - DNA, 25 bp, Rattus norvegicus
gaacttttactgagggctgcttagc

SEQ ID NO: 297561 - DNA, 25 bp, Rattus norvegicus
gaacttttactgtgggctgcttagc

SEQ ID NO: 297562 - DNA, 25 bp, Rattus norvegicus
gaacttttatacagtcctcgctgtc

SEQ ID NO: 297563 - DNA, 25 bp, Rattus norvegicus
gaacttttatactgtcctcgctgtc

SEQ ID NO: 297564 - DNA, 25 bp, Rattus norvegicus
gaacttttatttcacttatgttgga

SEQ ID NO: 297565 - DNA, 25 bp, Rattus norvegicus
gaacttttatttgacttatgttgga

SEQ ID NO: 297566 - DNA, 25 bp, Rattus norvegicus
gaacttttcaacaatccctagctgt

SEQ ID NO: 297567 - DNA, 25 bp, Rattus norvegicus
gaacttttcaactatccctagctgt

SEQ ID NO: 297568 - DNA, 25 bp, Rattus norvegicus
gaacttttcagacgcagagacaatg

SEQ ID NO: 297569 - DNA, 25 bp, Rattus norvegicus
gaacttttcagaggcagagacaatg

SEQ ID NO: 297570 - DNA, 25 bp, Rattus norvegicus
gaacttttcctgacaccttttggag

SEQ ID NO: 297571 - DNA, 25 bp, Rattus norvegicus
gaacttttcctgtcaccttttggag

SEQ ID NO: 297572 - DNA, 25 bp, Rattus norvegicus
gaacttttgcctcaagcttaaacta

SEQ ID NO: 297573 - DNA, 25 bp, Rattus norvegicus
gaacttttgcctgaagcttaaacta

SEQ ID NO: 297574 - DNA, 25 bp, Rattus norvegicus
gaacttttgtagcacgtccgtgccg

SEQ ID NO: 297575 - DNA, 25 bp, Rattus norvegicus
gaacttttgtaggacgtccgtgccg

SEQ ID NO: 297576 - DNA, 25 bp, Rattus norvegicus
gaacttttgtatcatcatgcctggt

SEQ ID NO: 297577 - DNA, 25 bp, Rattus norvegicus
gaacttttgtatgatcatgcctggt

SEQ ID NO: 297578 - DNA, 25 bp, Rattus norvegicus
gaacttttgtgccttctcagcattt

SEQ ID NO: 297579 - DNA, 25 bp, Rattus norvegicus
gaacttttgtgcgttctcagcattt

SEQ ID NO: 297580 - DNA, 25 bp, Rattus norvegicus
gaactttttattaggcgtgtgccat

SEQ ID NO: 297581 - DNA, 25 bp, Rattus norvegicus
gaactttttatttggcgtgtgccat

SEQ ID NO: 297582 - DNA, 25 bp, Rattus norvegicus
gaactttttctaagactctggatgg

SEQ ID NO: 297583 - DNA, 25 bp, Rattus norvegicus
gaactttttctatgactctggatgg

SEQ ID NO: 297584 - DNA, 25 bp, Rattus norvegicus
gaactttttgtcaccaatctcatta

SEQ ID NO: 297585 - DNA, 25 bp, Rattus norvegicus
gaactttttgtctccaatctcatta

SEQ ID NO: 297586 - DNA, 25 bp, Rattus norvegicus
gaacttttttggacgggcatttgag

SEQ ID NO: 297587 - DNA, 25 bp, Rattus norvegicus
gaacttttttggtcgggcatttgag

SEQ ID NO: 297588 - DNA, 25 bp, Rattus norvegicus
gaagaaaaagacctcccgcaaacag

SEQ ID NO: 297589 - DNA, 25 bp, Rattus norvegicus
gaagaaaaagacgtcccgcaaacag

SEQ ID NO: 297590 - DNA, 25 bp, Rattus norvegicus
gaagaaaaatgtcccctaacctgcc

SEQ ID NO: 297591 - DNA, 25 bp, Rattus norvegicus
gaagaaaaatgtgccctaacctgcc

SEQ ID NO: 297592 - DNA, 25 bp, Rattus norvegicus
gaagaaaacatcagttatctgggta

SEQ ID NO: 297593 - DNA, 25 bp, Rattus norvegicus
gaagaaaacatctgttatctgggta

SEQ ID NO: 297594 - DNA, 25 bp, Rattus norvegicus
gaagaaaaccgcctcatggtcgttt

SEQ ID NO: 297595 - DNA, 25 bp, Rattus norvegicus
gaagaaaaccgcgtcatggtcgttt

SEQ ID NO: 297596 - DNA, 25 bp, Rattus norvegicus
gaagaaaacctgcttggcctgtttg

SEQ ID NO: 297597 - DNA, 25 bp, Rattus norvegicus
gaagaaaacctggttggcctgtttg

SEQ ID NO: 297598 - DNA, 25 bp, Rattus norvegicus
gaagaaaagccgagatacagttatt

SEQ ID NO: 297599 - DNA, 25 bp, Rattus norvegicus
gaagaaaagccgcacgatgcttaca

SEQ ID NO: 297600 - DNA, 25 bp, Rattus norvegicus
gaagaaaagccggacgatgcttaca

SEQ ID NO: 297601 - DNA, 25 bp, Rattus norvegicus
gaagaaaagccgtgatacagttatt

SEQ ID NO: 297602 - DNA, 25 bp, Rattus norvegicus
gaagaaaagcttcctaccatttgag

SEQ ID NO: 297603 - DNA, 25 bp, Rattus norvegicus
gaagaaaagcttgctaccatttgag

SEQ ID NO: 297604 - DNA, 25 bp, Rattus norvegicus
gaagaaaaggtgacagccagaacgg

SEQ ID NO: 297605 - DNA, 25 bp, Rattus norvegicus
gaagaaaaggtgtcagccagaacgg

SEQ ID NO: 297606 - DNA, 25 bp, Rattus norvegicus
gaagaaaagtctccgtaggccagtg

SEQ ID NO: 297607 - DNA, 25 bp, Rattus norvegicus
gaagaaaagtctgcgtaggccagtg

SEQ ID NO: 297608 - DNA, 25 bp, Rattus norvegicus
gaagaaaagttcattgctaagcccc

SEQ ID NO: 297609 - DNA, 25 bp, Rattus norvegicus
gaagaaaagttctttgctaagcccc

SEQ ID NO: 297610 - DNA, 25 bp, Rattus norvegicus
gaagaaaataccaatggtccagtag

SEQ ID NO: 297611 - DNA, 25 bp, Rattus norvegicus
gaagaaaatacctatggtccagtag

SEQ ID NO: 297612 - DNA, 25 bp, Rattus norvegicus
gaagaaaatatcatacctgcacata

SEQ ID NO: 297613 - DNA, 25 bp, Rattus norvegicus
gaagaaaatatcttacctgcacata

SEQ ID NO: 297614 - DNA, 25 bp, Rattus norvegicus
gaagaaaatcacatagtgccaccca

SEQ ID NO: 297615 - DNA, 25 bp, Rattus norvegicus
gaagaaaatcacttagtgccaccca

SEQ ID NO: 297616 - DNA, 25 bp, Rattus norvegicus
gaagaaaatctcaccgaccacaaag

SEQ ID NO: 297617 - DNA, 25 bp, Rattus norvegicus
gaagaaaatctctccgaccacaaag

SEQ ID NO: 297618 - DNA, 25 bp, Rattus norvegicus
gaagaaacaagtacagctggaggct

SEQ ID NO: 297619 - DNA, 25 bp, Rattus norvegicus
gaagaaacaagttcagctggaggct

SEQ ID NO: 297620 - DNA, 25 bp, Rattus norvegicus
gaagaaacacaacttcaaagatttt

SEQ ID NO: 297621 - DNA, 25 bp, Rattus norvegicus
gaagaaacacaagttcaaagatttt

SEQ ID NO: 297622 - DNA, 25 bp, Rattus norvegicus
gaagaaaccataagtcctggcttta

SEQ ID NO: 297623 - DNA, 25 bp, Rattus norvegicus
gaagaaaccatatgtcctggcttta

SEQ ID NO: 297624 - DNA, 25 bp, Rattus norvegicus
gaagaaaccccacattgcctaggta

SEQ ID NO: 297625 - DNA, 25 bp, Rattus norvegicus
gaagaaaccccagattgcctaggta

SEQ ID NO: 297626 - DNA, 25 bp, Rattus norvegicus
gaagaaacccctcgtggcactggtg

SEQ ID NO: 297627 - DNA, 25 bp, Rattus norvegicus
gaagaaacccctggtggcactggtg

SEQ ID NO: 297628 - DNA, 25 bp, Rattus norvegicus
gaagaaaccctaaggcactatcagc

SEQ ID NO: 297629 - DNA, 25 bp, Rattus norvegicus
gaagaaaccctatggcactatcagc

SEQ ID NO: 297630 - DNA, 25 bp, Rattus norvegicus
gaagaaaccctgagatgacctcact

SEQ ID NO: 297631 - DNA, 25 bp, Rattus norvegicus
gaagaaaccctgtgatgacctcact

SEQ ID NO: 297632 - DNA, 25 bp, Rattus norvegicus
gaagaaaccgagctggccccattct

SEQ ID NO: 297633 - DNA, 25 bp, Rattus norvegicus
gaagaaaccgaggtggccccattct

SEQ ID NO: 297634 - DNA, 25 bp, Rattus norvegicus
gaagaaaccgcacaccctcatggag

SEQ ID NO: 297635 - DNA, 25 bp, Rattus norvegicus
gaagaaaccgcagaccctcatggag

SEQ ID NO: 297636 - DNA, 25 bp, Rattus norvegicus
gaagaaaccggcaggccaatgccac

SEQ ID NO: 297637 - DNA, 25 bp, Rattus norvegicus
gaagaaaccggctggccaatgccac

SEQ ID NO: 297638 - DNA, 25 bp, Rattus norvegicus
gaagaaacctcaacattatctacat

SEQ ID NO: 297639 - DNA, 25 bp, Rattus norvegicus
gaagaaacctcatcattatctacat

SEQ ID NO: 297640 - DNA, 25 bp, Rattus norvegicus
gaagaaacctgacatgccgaagaat

SEQ ID NO: 297641 - DNA, 25 bp, Rattus norvegicus
gaagaaacctgagatgccgaagaat

SEQ ID NO: 297642 - DNA, 25 bp, Rattus norvegicus
gaagaaacgcccaaaatgtacagag

SEQ ID NO: 297643 - DNA, 25 bp, Rattus norvegicus
gaagaaacgccctaaatgtacagag

SEQ ID NO: 297644 - DNA, 25 bp, Rattus norvegicus
gaagaaacgcttcttgtccacagtc

SEQ ID NO: 297645 - DNA, 25 bp, Rattus norvegicus
gaagaaacgcttgttgtccacagtc

SEQ ID NO: 297646 - DNA, 25 bp, Rattus norvegicus
gaagaaacgggcactagacaactcc

SEQ ID NO: 297647 - DNA, 25 bp, Rattus norvegicus
gaagaaacgggctctagacaactcc

SEQ ID NO: 297648 - DNA, 25 bp, Rattus norvegicus
gaagaaacgtaaccaagccacagcc

SEQ ID NO: 297649 - DNA, 25 bp, Rattus norvegicus
gaagaaacgtaagcaagccacagcc

SEQ ID NO: 297650 - DNA, 25 bp, Rattus norvegicus
gaagaaactacaagcctgtacacca

SEQ ID NO: 297651 - DNA, 25 bp, Rattus norvegicus
gaagaaactacatgcctgtacacca

SEQ ID NO: 297652 - DNA, 25 bp, Rattus norvegicus
gaagaaactcagctccagggacagt

SEQ ID NO: 297653 - DNA, 25 bp, Rattus norvegicus
gaagaaactcaggtccagggacagt

SEQ ID NO: 297654 - DNA, 25 bp, Rattus norvegicus
gaagaaactgacagaccttgcccag

SEQ ID NO: 297655 - DNA, 25 bp, Rattus norvegicus
gaagaaactgactgaccttgcccag

SEQ ID NO: 297656 - DNA, 25 bp, Rattus norvegicus
gaagaaactgctaaataccttattt

SEQ ID NO: 297657 - DNA, 25 bp, Rattus norvegicus
gaagaaactgcttaataccttattt

SEQ ID NO: 297658 - DNA, 25 bp, Rattus norvegicus
gaagaaactggtcacatgaaccgtg

SEQ ID NO: 297659 - DNA, 25 bp, Rattus norvegicus
gaagaaactggtgacatgaaccgtg

SEQ ID NO: 297660 - DNA, 25 bp, Rattus norvegicus
gaagaaagaacgctggccacaaccc

SEQ ID NO: 297661 - DNA, 25 bp, Rattus norvegicus
gaagaaagaacggtggccacaaccc

SEQ ID NO: 297662 - DNA, 25 bp, Rattus norvegicus
gaagaaagattgagccccattccca

SEQ ID NO: 297663 - DNA, 25 bp, Rattus norvegicus
gaagaaagattgtgccccattccca

SEQ ID NO: 297664 - DNA, 25 bp, Rattus norvegicus
gaagaaagccaacacaagcctaagt

SEQ ID NO: 297665 - DNA, 25 bp, Rattus norvegicus
gaagaaagccaagacaagcctaagt

SEQ ID NO: 297666 - DNA, 25 bp, Rattus norvegicus
gaagaaagccatcaacgacctagac

SEQ ID NO: 297667 - DNA, 25 bp, Rattus norvegicus
gaagaaagccatcaccagccaatgc

SEQ ID NO: 297668 - DNA, 25 bp, Rattus norvegicus
gaagaaagccatgaacgacctagac

SEQ ID NO: 297669 - DNA, 25 bp, Rattus norvegicus
gaagaaagccatgaccagccaatgc

SEQ ID NO: 297670 - DNA, 25 bp, Rattus norvegicus
gaagaaagcctcataggtcccactt

SEQ ID NO: 297671 - DNA, 25 bp, Rattus norvegicus
gaagaaagcctcttaggtcccactt

SEQ ID NO: 297672 - DNA, 25 bp, Rattus norvegicus
gaagaaagctatccgttgtaacaag

SEQ ID NO: 297673 - DNA, 25 bp, Rattus norvegicus
gaagaaagctatgcgttgtaacaag

SEQ ID NO: 297674 - DNA, 25 bp, Rattus norvegicus
gaagaaaggacccactggaagacca

SEQ ID NO: 297675 - DNA, 25 bp, Rattus norvegicus
gaagaaaggaccgactggaagacca

SEQ ID NO: 297676 - DNA, 25 bp, Rattus norvegicus
gaagaaaggctacctgagccctcgt

SEQ ID NO: 297677 - DNA, 25 bp, Rattus norvegicus
gaagaaaggctagctgagccctcgt

SEQ ID NO: 297678 - DNA, 25 bp, Rattus norvegicus
gaagaaagggctcccatgcctattt

SEQ ID NO: 297679 - DNA, 25 bp, Rattus norvegicus
gaagaaagggctgccatgcctattt

SEQ ID NO: 297680 - DNA, 25 bp, Rattus norvegicus
gaagaaagggttacaaggcctctgg

SEQ ID NO: 297681 - DNA, 25 bp, Rattus norvegicus
gaagaaagggtttcaaggcctctgg

SEQ ID NO: 297682 - DNA, 25 bp, Rattus norvegicus
gaagaaaggtaccaggacccctgag

SEQ ID NO: 297683 - DNA, 25 bp, Rattus norvegicus
gaagaaaggtacgaggacccctgag

SEQ ID NO: 297684 - DNA, 25 bp, Rattus norvegicus
gaagaaaggtgcagaatctctcatt

SEQ ID NO: 297685 - DNA, 25 bp, Rattus norvegicus
gaagaaaggtgctgaatctctcatt

SEQ ID NO: 297686 - DNA, 25 bp, Rattus norvegicus
gaagaaagtcaaatgcattgccact

SEQ ID NO: 297687 - DNA, 25 bp, Rattus norvegicus
gaagaaagtcaattgcattgccact

SEQ ID NO: 297688 - DNA, 25 bp, Rattus norvegicus
gaagaaagtcgcatccctgtacttc

SEQ ID NO: 297689 - DNA, 25 bp, Rattus norvegicus
gaagaaagtcgcttccctgtacttc

SEQ ID NO: 297690 - DNA, 25 bp, Rattus norvegicus
gaagaaatactaccctggacaatgt

SEQ ID NO: 297691 - DNA, 25 bp, Rattus norvegicus
gaagaaatactagcctggacaatgt

SEQ ID NO: 297692 - DNA, 25 bp, Rattus norvegicus
gaagaaatatgtccctcagcttaga

SEQ ID NO: 297693 - DNA, 25 bp, Rattus norvegicus
gaagaaatatgtgcctcagcttaga

SEQ ID NO: 297694 - DNA, 25 bp, Rattus norvegicus
gaagaaatcagtctgtcctgggttt

SEQ ID NO: 297695 - DNA, 25 bp, Rattus norvegicus
gaagaaatcagtgtgtcctgggttt

SEQ ID NO: 297696 - DNA, 25 bp, Rattus norvegicus
gaagaaatccaaaggactggccaat

SEQ ID NO: 297697 - DNA, 25 bp, Rattus norvegicus
gaagaaatccaatggactggccaat

SEQ ID NO: 297698 - DNA, 25 bp, Rattus norvegicus
gaagaaatccatctcccagcaaaag

SEQ ID NO: 297699 - DNA, 25 bp, Rattus norvegicus
gaagaaatccatgtcccagcaaaag

SEQ ID NO: 297700 - DNA, 25 bp, Rattus norvegicus
gaagaaatccggaacctttcaagag

SEQ ID NO: 297701 - DNA, 25 bp, Rattus norvegicus
gaagaaatccggtacctttcaagag

SEQ ID NO: 297702 - DNA, 25 bp, Rattus norvegicus
gaagaaatcctgagccatgtataat

SEQ ID NO: 297703 - DNA, 25 bp, Rattus norvegicus
gaagaaatcctgtgccatgtataat

SEQ ID NO: 297704 - DNA, 25 bp, Rattus norvegicus
gaagaaatctgtaacccatcctaga

SEQ ID NO: 297705 - DNA, 25 bp, Rattus norvegicus
gaagaaatctgtcaaagtacctgct

SEQ ID NO: 297706 - DNA, 25 bp, Rattus norvegicus
gaagaaatctgtgaaagtacctgct

SEQ ID NO: 297707 - DNA, 25 bp, Rattus norvegicus
gaagaaatctgttacccatcctaga

SEQ ID NO: 297708 - DNA, 25 bp, Rattus norvegicus
gaagaaatgaagagcctgtccctaa

SEQ ID NO: 297709 - DNA, 25 bp, Rattus norvegicus
gaagaaatgaagtgcctgtccctaa

SEQ ID NO: 297710 - DNA, 25 bp, Rattus norvegicus
gaagaaatgattccctccagagccc

SEQ ID NO: 297711 - DNA, 25 bp, Rattus norvegicus
gaagaaatgattgcctccagagccc

SEQ ID NO: 297712 - DNA, 25 bp, Rattus norvegicus
gaagaaatgcaaatcctgcctagct

SEQ ID NO: 297713 - DNA, 25 bp, Rattus norvegicus
gaagaaatgcaattcctgcctagct

SEQ ID NO: 297714 - DNA, 25 bp, Rattus norvegicus
gaagaaatgccaacaccagatccct

SEQ ID NO: 297715 - DNA, 25 bp, Rattus norvegicus
gaagaaatgccatcaccagatccct

SEQ ID NO: 297716 - DNA, 25 bp, Rattus norvegicus
gaagaaatgtgacaaccatcatcat

SEQ ID NO: 297717 - DNA, 25 bp, Rattus norvegicus
gaagaaatgtgagaaccatcatcat

SEQ ID NO: 297718 - DNA, 25 bp, Rattus norvegicus
gaagaaatgtgcctgctagaccctc

SEQ ID NO: 297719 - DNA, 25 bp, Rattus norvegicus
gaagaaatgtgcgtgctagaccctc

SEQ ID NO: 297720 - DNA, 25 bp, Rattus norvegicus
gaagaaatgtttctgtccccaacaa

SEQ ID NO: 297721 - DNA, 25 bp, Rattus norvegicus
gaagaaatgtttgtgtccccaacaa

SEQ ID NO: 297722 - DNA, 25 bp, Rattus norvegicus
gaagaaattccgcacaccttctttt

SEQ ID NO: 297723 - DNA, 25 bp, Rattus norvegicus
gaagaaattccggacaccttctttt

SEQ ID NO: 297724 - DNA, 25 bp, Rattus norvegicus
gaagaaatttgactcctctcgggac

SEQ ID NO: 297725 - DNA, 25 bp, Rattus norvegicus
gaagaaatttgagtcctctcgggac

SEQ ID NO: 297726 - DNA, 25 bp, Rattus norvegicus
gaagaacaaagcatttacttcccct

SEQ ID NO: 297727 - DNA, 25 bp, Rattus norvegicus
gaagaacaaagcttttacttcccct

SEQ ID NO: 297728 - DNA, 25 bp, Rattus norvegicus
gaagaacaacctccgagactggctg

SEQ ID NO: 297729 - DNA, 25 bp, Rattus norvegicus
gaagaacaacctgcgagactggctg

SEQ ID NO: 297730 - DNA, 25 bp, Rattus norvegicus
gaagaacaactcaggctcctggtct

SEQ ID NO: 297731 - DNA, 25 bp, Rattus norvegicus
gaagaacaactctggctcctggtct

SEQ ID NO: 297732 - DNA, 25 bp, Rattus norvegicus
gaagaacaatatcatccagacctgg

SEQ ID NO: 297733 - DNA, 25 bp, Rattus norvegicus
gaagaacaatatgatccagacctgg

SEQ ID NO: 297734 - DNA, 25 bp, Rattus norvegicus
gaagaacaatccacccaccatcgtg

SEQ ID NO: 297735 - DNA, 25 bp, Rattus norvegicus
gaagaacaatccatgcaccaattat

SEQ ID NO: 297736 - DNA, 25 bp, Rattus norvegicus
gaagaacaatcctcccaccatcgtg

SEQ ID NO: 297737 - DNA, 25 bp, Rattus norvegicus
gaagaacaatccttgcaccaattat

SEQ ID NO: 297738 - DNA, 25 bp, Rattus norvegicus
gaagaacaattacagcagcttatag

SEQ ID NO: 297739 - DNA, 25 bp, Rattus norvegicus
gaagaacaattagagcagcttatag

SEQ ID NO: 297740 - DNA, 25 bp, Rattus norvegicus
gaagaacaccttcgcccgacggaag

SEQ ID NO: 297741 - DNA, 25 bp, Rattus norvegicus
gaagaacaccttggcccgacggaag

SEQ ID NO: 297742 - DNA, 25 bp, Rattus norvegicus
gaagaacactcaccgtgtaagcccc

SEQ ID NO: 297743 - DNA, 25 bp, Rattus norvegicus
gaagaacactcagcgtgtaagcccc

SEQ ID NO: 297744 - DNA, 25 bp, Rattus norvegicus
gaagaacactccaattgctcagatt

SEQ ID NO: 297745 - DNA, 25 bp, Rattus norvegicus
gaagaacactcctattgctcagatt

SEQ ID NO: 297746 - DNA, 25 bp, Rattus norvegicus
gaagaacacttgctggtccgtatct

SEQ ID NO: 297747 - DNA, 25 bp, Rattus norvegicus
gaagaacacttggtggtccgtatct

SEQ ID NO: 297748 - DNA, 25 bp, Rattus norvegicus
gaagaacagcttagaaattctacag

SEQ ID NO: 297749 - DNA, 25 bp, Rattus norvegicus
gaagaacagctttgaaattctacag

SEQ ID NO: 297750 - DNA, 25 bp, Rattus norvegicus
gaagaacaggtcatcagccttggac

SEQ ID NO: 297751 - DNA, 25 bp, Rattus norvegicus
gaagaacaggtcttcagccttggac

SEQ ID NO: 297752 - DNA, 25 bp, Rattus norvegicus
gaagaacagttacacctccaggagt

SEQ ID NO: 297753 - DNA, 25 bp, Rattus norvegicus
gaagaacagttagacctccaggagt

SEQ ID NO: 297754 - DNA, 25 bp, Rattus norvegicus
gaagaacatcgaccagtgctcagag

SEQ ID NO: 297755 - DNA, 25 bp, Rattus norvegicus
gaagaacatcgagcagtgctcagag

SEQ ID NO: 297756 - DNA, 25 bp, Rattus norvegicus
gaagaacatctacagaagctgcatg

SEQ ID NO: 297757 - DNA, 25 bp, Rattus norvegicus
gaagaacatctagagaagctgcatg

SEQ ID NO: 297758 - DNA, 25 bp, Rattus norvegicus
gaagaacatctcaatggcgtccagc

SEQ ID NO: 297759 - DNA, 25 bp, Rattus norvegicus
gaagaacatctcctacaagtaccgc

SEQ ID NO: 297760 - DNA, 25 bp, Rattus norvegicus
gaagaacatctcgtacaagtaccgc

SEQ ID NO: 297761 - DNA, 25 bp, Rattus norvegicus
gaagaacatctctatggcgtccagc

SEQ ID NO: 297762 - DNA, 25 bp, Rattus norvegicus
gaagaacatgctactctcggtggcc

SEQ ID NO: 297763 - DNA, 25 bp, Rattus norvegicus
gaagaacatgctaggcagccagatg

SEQ ID NO: 297764 - DNA, 25 bp, Rattus norvegicus
gaagaacatgcttctctcggtggcc

SEQ ID NO: 297765 - DNA, 25 bp, Rattus norvegicus
gaagaacatgcttggcagccagatg

SEQ ID NO: 297766 - DNA, 25 bp, Rattus norvegicus
gaagaacatgtcagtccatctcttt

SEQ ID NO: 297767 - DNA, 25 bp, Rattus norvegicus
gaagaacatgtctgtccatctcttt

SEQ ID NO: 297768 - DNA, 25 bp, Rattus norvegicus
gaagaacatgttcctgacccgggcc

SEQ ID NO: 297769 - DNA, 25 bp, Rattus norvegicus
gaagaacatgttgctgacccgggcc

SEQ ID NO: 297770 - DNA, 25 bp, Rattus norvegicus
gaagaaccaacccaagtgtgtatcc

SEQ ID NO: 297771 - DNA, 25 bp, Rattus norvegicus
gaagaaccaaccgaagtgtgtatcc

SEQ ID NO: 297772 - DNA, 25 bp, Rattus norvegicus
gaagaaccaagacagcccatgagcg

SEQ ID NO: 297773 - DNA, 25 bp, Rattus norvegicus
gaagaaccaagagagcccatgagcg

SEQ ID NO: 297774 - DNA, 25 bp, Rattus norvegicus
gaagaaccaagcactattttccaga

SEQ ID NO: 297775 - DNA, 25 bp, Rattus norvegicus
gaagaaccaagctctattttccaga

SEQ ID NO: 297776 - DNA, 25 bp, Rattus norvegicus
gaagaaccacaaagtcacacagcat

SEQ ID NO: 297777 - DNA, 25 bp, Rattus norvegicus
gaagaaccacaatgtcacacagcat

SEQ ID NO: 297778 - DNA, 25 bp, Rattus norvegicus
gaagaaccacatatattcaattgtt

SEQ ID NO: 297779 - DNA, 25 bp, Rattus norvegicus
gaagaaccacatttattcaattgtt

SEQ ID NO: 297780 - DNA, 25 bp, Rattus norvegicus
gaagaaccacttccctgaagccctg

SEQ ID NO: 297781 - DNA, 25 bp, Rattus norvegicus
gaagaaccacttgcctgaagccctg

SEQ ID NO: 297782 - DNA, 25 bp, Rattus norvegicus
gaagaaccagaaacacagactccct

SEQ ID NO: 297783 - DNA, 25 bp, Rattus norvegicus
gaagaaccagaaacctcatctcact

SEQ ID NO: 297784 - DNA, 25 bp, Rattus norvegicus
gaagaaccagaatcacagactccct

SEQ ID NO: 297785 - DNA, 25 bp, Rattus norvegicus
gaagaaccagaatcctcatctcact

SEQ ID NO: 297786 - DNA, 25 bp, Rattus norvegicus
gaagaaccagatcctcatgacccct

SEQ ID NO: 297787 - DNA, 25 bp, Rattus norvegicus
gaagaaccagatgctcatgacccct

SEQ ID NO: 297788 - DNA, 25 bp, Rattus norvegicus
gaagaaccagccctgccccagacat

SEQ ID NO: 297789 - DNA, 25 bp, Rattus norvegicus
gaagaaccagccgtgccccagacat

SEQ ID NO: 297790 - DNA, 25 bp, Rattus norvegicus
gaagaaccaggtccacaccttggag

SEQ ID NO: 297791 - DNA, 25 bp, Rattus norvegicus
gaagaaccaggtgcacaccttggag

SEQ ID NO: 297792 - DNA, 25 bp, Rattus norvegicus
gaagaaccatgcacagttttcctgc

SEQ ID NO: 297793 - DNA, 25 bp, Rattus norvegicus
gaagaaccatgctcagttttcctgc

SEQ ID NO: 297794 - DNA, 25 bp, Rattus norvegicus
gaagaaccattcactccgtgtatgt

SEQ ID NO: 297795 - DNA, 25 bp, Rattus norvegicus
gaagaaccattctctccgtgtatgt

SEQ ID NO: 297796 - DNA, 25 bp, Rattus norvegicus
gaagaacccagactttcacggttat

SEQ ID NO: 297797 - DNA, 25 bp, Rattus norvegicus
gaagaacccagagtttcacggttat

SEQ ID NO: 297798 - DNA, 25 bp, Rattus norvegicus
gaagaaccctatcttccgttcccag

SEQ ID NO: 297799 - DNA, 25 bp, Rattus norvegicus
gaagaaccctatgttccgttcccag

SEQ ID NO: 297800 - DNA, 25 bp, Rattus norvegicus
gaagaacccttgaagtgtgatgtta

SEQ ID NO: 297801 - DNA, 25 bp, Rattus norvegicus
gaagaacccttgtagtgtgatgtta

SEQ ID NO: 297802 - DNA, 25 bp, Rattus norvegicus
gaagaaccgtctacagcctcagcaa

SEQ ID NO: 297803 - DNA, 25 bp, Rattus norvegicus
gaagaaccgtcttcagcctcagcaa

SEQ ID NO: 297804 - DNA, 25 bp, Rattus norvegicus
gaagaaccgttcctgttcctctgta

SEQ ID NO: 297805 - DNA, 25 bp, Rattus norvegicus
gaagaaccgttcgtgttcctctgta

SEQ ID NO: 297806 - DNA, 25 bp, Rattus norvegicus
gaagaacctaacatcgtgaccgata

SEQ ID NO: 297807 - DNA, 25 bp, Rattus norvegicus
gaagaacctaacttcgtgaccgata

SEQ ID NO: 297808 - DNA, 25 bp, Rattus norvegicus
gaagaacctacaagctatcctctgt

SEQ ID NO: 297809 - DNA, 25 bp, Rattus norvegicus
gaagaacctacatgctatcctctgt

SEQ ID NO: 297810 - DNA, 25 bp, Rattus norvegicus
gaagaacctactccgactgcaggac

SEQ ID NO: 297811 - DNA, 25 bp, Rattus norvegicus
gaagaacctactgcgactgcaggac

SEQ ID NO: 297812 - DNA, 25 bp, Rattus norvegicus
gaagaacctagtatatgtcatttta

SEQ ID NO: 297813 - DNA, 25 bp, Rattus norvegicus
gaagaacctagtttatgtcatttta

SEQ ID NO: 297814 - DNA, 25 bp, Rattus norvegicus
gaagaacctatgatagtcagttact

SEQ ID NO: 297815 - DNA, 25 bp, Rattus norvegicus
gaagaacctatgttagtcagttact

SEQ ID NO: 297816 - DNA, 25 bp, Rattus norvegicus
gaagaacctcaaacagatcctcgct

SEQ ID NO: 297817 - DNA, 25 bp, Rattus norvegicus
gaagaacctcaatcagatcctcgct

SEQ ID NO: 297818 - DNA, 25 bp, Rattus norvegicus
gaagaacctcacattaaccagactc

SEQ ID NO: 297819 - DNA, 25 bp, Rattus norvegicus
gaagaacctcactttaaccagactc

SEQ ID NO: 297820 - DNA, 25 bp, Rattus norvegicus
gaagaacctcatccggagactacag

SEQ ID NO: 297821 - DNA, 25 bp, Rattus norvegicus
gaagaacctcatgcggagactacag

SEQ ID NO: 297822 - DNA, 25 bp, Rattus norvegicus
gaagaacctctgaaatgtccaagaa

SEQ ID NO: 297823 - DNA, 25 bp, Rattus norvegicus
gaagaacctctgtaatgtccaagaa

SEQ ID NO: 297824 - DNA, 25 bp, Rattus norvegicus
gaagaacctgacaggagccagcctc

SEQ ID NO: 297825 - DNA, 25 bp, Rattus norvegicus
gaagaacctgactggagccagcctc

SEQ ID NO: 297826 - DNA, 25 bp, Rattus norvegicus
gaagaaccttcactgggcaattcca

SEQ ID NO: 297827 - DNA, 25 bp, Rattus norvegicus
gaagaaccttcagtgggcaattcca

SEQ ID NO: 297828 - DNA, 25 bp, Rattus norvegicus
gaagaacctttcattgccagggtga

SEQ ID NO: 297829 - DNA, 25 bp, Rattus norvegicus
gaagaacctttccaacatgaacctg

SEQ ID NO: 297830 - DNA, 25 bp, Rattus norvegicus
gaagaacctttccacattacctgta

SEQ ID NO: 297831 - DNA, 25 bp, Rattus norvegicus
gaagaacctttcgaacatgaacctg

SEQ ID NO: 297832 - DNA, 25 bp, Rattus norvegicus
gaagaacctttcgacattacctgta

SEQ ID NO: 297833 - DNA, 25 bp, Rattus norvegicus
gaagaacctttctttgccagggtga

SEQ ID NO: 297834 - DNA, 25 bp, Rattus norvegicus
gaagaacgagccctatcagccctat

SEQ ID NO: 297835 - DNA, 25 bp, Rattus norvegicus
gaagaacgagccgtatcagccctat

SEQ ID NO: 297836 - DNA, 25 bp, Rattus norvegicus
gaagaacgcacacccaggagtgtcc

SEQ ID NO: 297837 - DNA, 25 bp, Rattus norvegicus
gaagaacgcacagccaggagtgtcc

SEQ ID NO: 297838 - DNA, 25 bp, Rattus norvegicus
gaagaacgccaccagcagaagactt

SEQ ID NO: 297839 - DNA, 25 bp, Rattus norvegicus
gaagaacgccacgagcagaagactt

SEQ ID NO: 297840 - DNA, 25 bp, Rattus norvegicus
gaagaacgccttcctcagtatgagt

SEQ ID NO: 297841 - DNA, 25 bp, Rattus norvegicus
gaagaacgccttgctcagtatgagt

SEQ ID NO: 297842 - DNA, 25 bp, Rattus norvegicus
gaagaacgtgtgcttctctcagtgc

SEQ ID NO: 297843 - DNA, 25 bp, Rattus norvegicus
gaagaacgtgtggttctctcagtgc

SEQ ID NO: 297844 - DNA, 25 bp, Rattus norvegicus
gaagaacgttccatggtgcttggct

SEQ ID NO: 297845 - DNA, 25 bp, Rattus norvegicus
gaagaacgttccttggtgcttggct

SEQ ID NO: 297846 - DNA, 25 bp, Rattus norvegicus
gaagaacgttgaacacacactgtgg

SEQ ID NO: 297847 - DNA, 25 bp, Rattus norvegicus
gaagaacgttgatcacacactgtgg

SEQ ID NO: 297848 - DNA, 25 bp, Rattus norvegicus
gaagaacgttgtctccaggaggaat

SEQ ID NO: 297849 - DNA, 25 bp, Rattus norvegicus
gaagaacgttgtgtccaggaggaat

SEQ ID NO: 297850 - DNA, 25 bp, Rattus norvegicus
gaagaactaagaactaccccagact

SEQ ID NO: 297851 - DNA, 25 bp, Rattus norvegicus
gaagaactaagatctaccccagact

SEQ ID NO: 297852 - DNA, 25 bp, Rattus norvegicus
gaagaactacttaactgtggcacaa

SEQ ID NO: 297853 - DNA, 25 bp, Rattus norvegicus
gaagaactactttactgtggcacaa

SEQ ID NO: 297854 - DNA, 25 bp, Rattus norvegicus
gaagaactaggcaacacactgtgtg

SEQ ID NO: 297855 - DNA, 25 bp, Rattus norvegicus
gaagaactaggctacacactgtgtg

SEQ ID NO: 297856 - DNA, 25 bp, Rattus norvegicus
gaagaactatgacgccttctgcggc

SEQ ID NO: 297857 - DNA, 25 bp, Rattus norvegicus
gaagaactatgaggccttctgcggc

SEQ ID NO: 297858 - DNA, 25 bp, Rattus norvegicus
gaagaactattccacagccctgaag

SEQ ID NO: 297859 - DNA, 25 bp, Rattus norvegicus
gaagaactattcgacagccctgaag

SEQ ID NO: 297860 - DNA, 25 bp, Rattus norvegicus
gaagaactcaggatgcaaacggata

SEQ ID NO: 297861 - DNA, 25 bp, Rattus norvegicus
gaagaactcaggttgcaaacggata

SEQ ID NO: 297862 - DNA, 25 bp, Rattus norvegicus
gaagaactcattcaccctgactcag

SEQ ID NO: 297863 - DNA, 25 bp, Rattus norvegicus
gaagaactcattgaccctgactcag

SEQ ID NO: 297864 - DNA, 25 bp, Rattus norvegicus
gaagaactcccacatttcaggctta

SEQ ID NO: 297865 - DNA, 25 bp, Rattus norvegicus
gaagaactcccagatttcaggctta

SEQ ID NO: 297866 - DNA, 25 bp, Rattus norvegicus
gaagaactcctaaagaagccagcag

SEQ ID NO: 297867 - DNA, 25 bp, Rattus norvegicus
gaagaactcctatagaagccagcag

SEQ ID NO: 297868 - DNA, 25 bp, Rattus norvegicus
gaagaactccttcgaccagtgcatg

SEQ ID NO: 297869 - DNA, 25 bp, Rattus norvegicus
gaagaactccttggaccagtgcatg

SEQ ID NO: 297870 - DNA, 25 bp, Rattus norvegicus
gaagaactcgatcggtcggaccact

SEQ ID NO: 297871 - DNA, 25 bp, Rattus norvegicus
gaagaactcgatgggtcggaccact

SEQ ID NO: 297872 - DNA, 25 bp, Rattus norvegicus
gaagaactcttgacgtgggcttgac

SEQ ID NO: 297873 - DNA, 25 bp, Rattus norvegicus
gaagaactcttgtcgtgggcttgac

SEQ ID NO: 297874 - DNA, 25 bp, Rattus norvegicus
gaagaactgacaccttaaagcccaa

SEQ ID NO: 297875 - DNA, 25 bp, Rattus norvegicus
gaagaactgacagcttaaagcccaa

SEQ ID NO: 297876 - DNA, 25 bp, Rattus norvegicus
gaagaactgatccacttcagcaatg

SEQ ID NO: 297877 - DNA, 25 bp, Rattus norvegicus
gaagaactgatcgacttcagcaatg

SEQ ID NO: 297878 - DNA, 25 bp, Rattus norvegicus
gaagaactgctgctctcttttttgg

SEQ ID NO: 297879 - DNA, 25 bp, Rattus norvegicus
gaagaactgctggtctcttttttgg

SEQ ID NO: 297880 - DNA, 25 bp, Rattus norvegicus
gaagaactggtcacccttagtaagg

SEQ ID NO: 297881 - DNA, 25 bp, Rattus norvegicus
gaagaactggtctcccttagtaagg

SEQ ID NO: 297882 - DNA, 25 bp, Rattus norvegicus
gaagaactgtgacctaatcatatta

SEQ ID NO: 297883 - DNA, 25 bp, Rattus norvegicus
gaagaactgtgagctaatcatatta

SEQ ID NO: 297884 - DNA, 25 bp, Rattus norvegicus
gaagaactgttacctgcctgtcggt

SEQ ID NO: 297885 - DNA, 25 bp, Rattus norvegicus
gaagaactgttagctgcctgtcggt

SEQ ID NO: 297886 - DNA, 25 bp, Rattus norvegicus
gaagaactgtttattgcctgctggt

SEQ ID NO: 297887 - DNA, 25 bp, Rattus norvegicus
gaagaactgttttttgcctgctggt

SEQ ID NO: 297888 - DNA, 25 bp, Rattus norvegicus
gaagaacttaccactaggcgtgatg

SEQ ID NO: 297889 - DNA, 25 bp, Rattus norvegicus
gaagaacttacctctaggcgtgatg

SEQ ID NO: 297890 - DNA, 25 bp, Rattus norvegicus
gaagaacttcagacctttcaaggcc

SEQ ID NO: 297891 - DNA, 25 bp, Rattus norvegicus
gaagaacttcagtcctttcaaggcc

SEQ ID NO: 297892 - DNA, 25 bp, Rattus norvegicus
gaagaacttcatcattgtgcaacta

SEQ ID NO: 297893 - DNA, 25 bp, Rattus norvegicus
gaagaacttcatgattgtgcaacta

SEQ ID NO: 297894 - DNA, 25 bp, Rattus norvegicus
gaagaacttccacatcatccacggc

SEQ ID NO: 297895 - DNA, 25 bp, Rattus norvegicus
gaagaacttccagatcatccacggc

SEQ ID NO: 297896 - DNA, 25 bp, Rattus norvegicus
gaagaacttcggcatctggctgcgc

SEQ ID NO: 297897 - DNA, 25 bp, Rattus norvegicus
gaagaacttcgggatctggctgcgc

SEQ ID NO: 297898 - DNA, 25 bp, Rattus norvegicus
gaagaacttcgtaagcattacactt

SEQ ID NO: 297899 - DNA, 25 bp, Rattus norvegicus
gaagaacttcgttagcattacactt

SEQ ID NO: 297900 - DNA, 25 bp, Rattus norvegicus
gaagaacttctgagacatcctgatc

SEQ ID NO: 297901 - DNA, 25 bp, Rattus norvegicus
gaagaacttctgtgacatcctgatc

SEQ ID NO: 297902 - DNA, 25 bp, Rattus norvegicus
gaagaacttgacaaccgcgactggc

SEQ ID NO: 297903 - DNA, 25 bp, Rattus norvegicus
gaagaacttgactaccgcgactggc

SEQ ID NO: 297904 - DNA, 25 bp, Rattus norvegicus
gaagaacttgctctgaacttggttt

SEQ ID NO: 297905 - DNA, 25 bp, Rattus norvegicus
gaagaacttgctgtgaacttggttt

SEQ ID NO: 297906 - DNA, 25 bp, Rattus norvegicus
gaagaacttggtctagctgactcaa

SEQ ID NO: 297907 - DNA, 25 bp, Rattus norvegicus
gaagaacttggtgtagctgactcaa

SEQ ID NO: 297908 - DNA, 25 bp, Rattus norvegicus
gaagaacttgtcaggtcctgttccc

SEQ ID NO: 297909 - DNA, 25 bp, Rattus norvegicus
gaagaacttgtctggtcctgttccc

SEQ ID NO: 297910 - DNA, 25 bp, Rattus norvegicus
gaagaactttctaagtgcttacaga

SEQ ID NO: 297911 - DNA, 25 bp, Rattus norvegicus
gaagaactttcttagtgcttacaga

SEQ ID NO: 297912 - DNA, 25 bp, Rattus norvegicus
gaagaacttttcagttttcactgag

SEQ ID NO: 297913 - DNA, 25 bp, Rattus norvegicus
gaagaacttttctgttttcactgag

SEQ ID NO: 297914 - DNA, 25 bp, Rattus norvegicus
gaagaagaaaccacacccatgtcct

SEQ ID NO: 297915 - DNA, 25 bp, Rattus norvegicus
gaagaagaaacctcacccatgtcct

SEQ ID NO: 297916 - DNA, 25 bp, Rattus norvegicus
gaagaagaaagcctccaccagactg

SEQ ID NO: 297917 - DNA, 25 bp, Rattus norvegicus
gaagaagaaagcgtccaccagactg

SEQ ID NO: 297918 - DNA, 25 bp, Rattus norvegicus
gaagaagaacaactcagcccctctc

SEQ ID NO: 297919 - DNA, 25 bp, Rattus norvegicus
gaagaagaacaagtcagcccctctc

SEQ ID NO: 297920 - DNA, 25 bp, Rattus norvegicus
gaagaagaaggcagcgaccccgcca

SEQ ID NO: 297921 - DNA, 25 bp, Rattus norvegicus
gaagaagaaggctgcgaccccgcca

SEQ ID NO: 297922 - DNA, 25 bp, Rattus norvegicus
gaagaagaatgtcggtcagttcagt

SEQ ID NO: 297923 - DNA, 25 bp, Rattus norvegicus
gaagaagaatgtgggtcagttcagt

SEQ ID NO: 297924 - DNA, 25 bp, Rattus norvegicus
gaagaagaattgctccagtccacct

SEQ ID NO: 297925 - DNA, 25 bp, Rattus norvegicus
gaagaagaattggtccagtccacct

SEQ ID NO: 297926 - DNA, 25 bp, Rattus norvegicus
gaagaagacaaaatggtgcctacca

SEQ ID NO: 297927 - DNA, 25 bp, Rattus norvegicus
gaagaagacaaattggtgcctacca

SEQ ID NO: 297928 - DNA, 25 bp, Rattus norvegicus
gaagaagacaatccggtccctcagc

SEQ ID NO: 297929 - DNA, 25 bp, Rattus norvegicus
gaagaagacaatgcggtccctcagc

SEQ ID NO: 297930 - DNA, 25 bp, Rattus norvegicus
gaagaagacccacgatgaactatag

SEQ ID NO: 297931 - DNA, 25 bp, Rattus norvegicus
gaagaagacccaggatgaactatag

SEQ ID NO: 297932 - DNA, 25 bp, Rattus norvegicus
gaagaagaccccacgctgggacata

SEQ ID NO: 297933 - DNA, 25 bp, Rattus norvegicus
gaagaagacccctcgctgggacata

SEQ ID NO: 297934 - DNA, 25 bp, Rattus norvegicus
gaagaagacccgagtgcctgtgagt

SEQ ID NO: 297935 - DNA, 25 bp, Rattus norvegicus
gaagaagacccgtgtgcctgtgagt

SEQ ID NO: 297936 - DNA, 25 bp, Rattus norvegicus
gaagaagactcaccactttccaggt

SEQ ID NO: 297937 - DNA, 25 bp, Rattus norvegicus
gaagaagactcagcactttccaggt

SEQ ID NO: 297938 - DNA, 25 bp, Rattus norvegicus
gaagaagactccacctcggaagtcg

SEQ ID NO: 297939 - DNA, 25 bp, Rattus norvegicus
gaagaagactcctcctcggaagtcg

SEQ ID NO: 297940 - DNA, 25 bp, Rattus norvegicus
gaagaagacttcacaggctcactgg

SEQ ID NO: 297941 - DNA, 25 bp, Rattus norvegicus
gaagaagacttctcaggctcactgg

SEQ ID NO: 297942 - DNA, 25 bp, Rattus norvegicus
gaagaagagaccacctccatcaggc

SEQ ID NO: 297943 - DNA, 25 bp, Rattus norvegicus
gaagaagagacctcctccatcaggc

SEQ ID NO: 297944 - DNA, 25 bp, Rattus norvegicus
gaagaagagcacctttggctcctgt

SEQ ID NO: 297945 - DNA, 25 bp, Rattus norvegicus
gaagaagagcacgtttggctcctgt

SEQ ID NO: 297946 - DNA, 25 bp, Rattus norvegicus
gaagaagaggagaccgagttttcag

SEQ ID NO: 297947 - DNA, 25 bp, Rattus norvegicus
gaagaagaggagtccgagttttcag

SEQ ID NO: 297948 - DNA, 25 bp, Rattus norvegicus
gaagaagatcaaccgccctgtggta

SEQ ID NO: 297949 - DNA, 25 bp, Rattus norvegicus
gaagaagatcaagcgccctgtggta

SEQ ID NO: 297950 - DNA, 25 bp, Rattus norvegicus
gaagaagatcccactgaacagccat

SEQ ID NO: 297951 - DNA, 25 bp, Rattus norvegicus
gaagaagatccctctgaacagccat

SEQ ID NO: 297952 - DNA, 25 bp, Rattus norvegicus
gaagaagatccgaacgtcacccact

SEQ ID NO: 297953 - DNA, 25 bp, Rattus norvegicus
gaagaagatccgagggctttctcca

SEQ ID NO: 297954 - DNA, 25 bp, Rattus norvegicus
gaagaagatccgtacgtcacccact

SEQ ID NO: 297955 - DNA, 25 bp, Rattus norvegicus
gaagaagatccgtgggctttctcca

SEQ ID NO: 297956 - DNA, 25 bp, Rattus norvegicus
gaagaagatgctactctttcctcac

SEQ ID NO: 297957 - DNA, 25 bp, Rattus norvegicus
gaagaagatgcttctctttcctcac

SEQ ID NO: 297958 - DNA, 25 bp, Rattus norvegicus
gaagaagattctactgactgggaaa

SEQ ID NO: 297959 - DNA, 25 bp, Rattus norvegicus
gaagaagattcttctgactgggaaa

SEQ ID NO: 297960 - DNA, 25 bp, Rattus norvegicus
gaagaagattggactcacttacagt

SEQ ID NO: 297961 - DNA, 25 bp, Rattus norvegicus
gaagaagattggtctcacttacagt

SEQ ID NO: 297962 - DNA, 25 bp, Rattus norvegicus
gaagaagatttcaatggagacgtgg

SEQ ID NO: 297963 - DNA, 25 bp, Rattus norvegicus
gaagaagatttctatggagacgtgg

SEQ ID NO: 297964 - DNA, 25 bp, Rattus norvegicus
gaagaagcaattcctttggccctaa

SEQ ID NO: 297965 - DNA, 25 bp, Rattus norvegicus
gaagaagcaattgctttggccctaa

SEQ ID NO: 297966 - DNA, 25 bp, Rattus norvegicus
gaagaagcaccacccatgtgttcca

SEQ ID NO: 297967 - DNA, 25 bp, Rattus norvegicus
gaagaagcaccagccatgtgttcca

SEQ ID NO: 297968 - DNA, 25 bp, Rattus norvegicus
gaagaagcacttcattgaaagtagt

SEQ ID NO: 297969 - DNA, 25 bp, Rattus norvegicus
gaagaagcacttgattgaaagtagt

SEQ ID NO: 297970 - DNA, 25 bp, Rattus norvegicus
gaagaagcagctctgtccagtacac

SEQ ID NO: 297971 - DNA, 25 bp, Rattus norvegicus
gaagaagcagctgtgtccagtacac

SEQ ID NO: 297972 - DNA, 25 bp, Rattus norvegicus
gaagaagcaggcacctcatccacag

SEQ ID NO: 297973 - DNA, 25 bp, Rattus norvegicus
gaagaagcaggcagttccccagctt

SEQ ID NO: 297974 - DNA, 25 bp, Rattus norvegicus
gaagaagcaggctcctcatccacag

SEQ ID NO: 297975 - DNA, 25 bp, Rattus norvegicus
gaagaagcaggctgttccccagctt

SEQ ID NO: 297976 - DNA, 25 bp, Rattus norvegicus
gaagaagcagtacccaacggccttt

SEQ ID NO: 297977 - DNA, 25 bp, Rattus norvegicus
gaagaagcagtagccaacggccttt

SEQ ID NO: 297978 - DNA, 25 bp, Rattus norvegicus
gaagaagcagtccaggcacctaccc

SEQ ID NO: 297979 - DNA, 25 bp, Rattus norvegicus
gaagaagcagtcgaggcacctaccc

SEQ ID NO: 297980 - DNA, 25 bp, Rattus norvegicus
gaagaagcatctctcttcttgtctc

SEQ ID NO: 297981 - DNA, 25 bp, Rattus norvegicus
gaagaagcatctgtcttcttgtctc

SEQ ID NO: 297982 - DNA, 25 bp, Rattus norvegicus
gaagaagccaagagaccaaacgtga

SEQ ID NO: 297983 - DNA, 25 bp, Rattus norvegicus
gaagaagccaagtgaccaaacgtga

SEQ ID NO: 297984 - DNA, 25 bp, Rattus norvegicus
gaagaagccagacctcactcttgtt

SEQ ID NO: 297985 - DNA, 25 bp, Rattus norvegicus
gaagaagccagagctcactcttgtt

SEQ ID NO: 297986 - DNA, 25 bp, Rattus norvegicus
gaagaagccagtacacacagcgggt

SEQ ID NO: 297987 - DNA, 25 bp, Rattus norvegicus
gaagaagccagttcacacagcgggt

SEQ ID NO: 297988 - DNA, 25 bp, Rattus norvegicus
gaagaagccatcacccaagtggaca

SEQ ID NO: 297989 - DNA, 25 bp, Rattus norvegicus
gaagaagccatctcccaagtggaca

SEQ ID NO: 297990 - DNA, 25 bp, Rattus norvegicus
gaagaagcccagatgtcgctggctc

SEQ ID NO: 297991 - DNA, 25 bp, Rattus norvegicus
gaagaagcccagttgtcgctggctc

SEQ ID NO: 297992 - DNA, 25 bp, Rattus norvegicus
gaagaagcccgacgtctagaccgaa

SEQ ID NO: 297993 - DNA, 25 bp, Rattus norvegicus
gaagaagcccgaggtctagaccgaa

SEQ ID NO: 297994 - DNA, 25 bp, Rattus norvegicus
gaagaagcccgtcagcagcaagaga

SEQ ID NO: 297995 - DNA, 25 bp, Rattus norvegicus
gaagaagcccgtgagcagcaagaga

SEQ ID NO: 297996 - DNA, 25 bp, Rattus norvegicus
gaagaagccgcaaactgtcactgac

SEQ ID NO: 297997 - DNA, 25 bp, Rattus norvegicus
gaagaagccgcatactgtcactgac

SEQ ID NO: 297998 - DNA, 25 bp, Rattus norvegicus
gaagaagccgttattctccaggcat

SEQ ID NO: 297999 - DNA, 25 bp, Rattus norvegicus
gaagaagccgttctacgagaaccag

SEQ ID NO: 298000 - DNA, 25 bp, Rattus norvegicus
gaagaagccgttgtacgagaaccag

SEQ ID NO: 298001 - DNA, 25 bp, Rattus norvegicus
gaagaagccgtttttctccaggcat

SEQ ID NO: 298002 - DNA, 25 bp, Rattus norvegicus
gaagaagcctgcaatgctcagacca

SEQ ID NO: 298003 - DNA, 25 bp, Rattus norvegicus
gaagaagcctgctatgctcagacca

SEQ ID NO: 298004 - DNA, 25 bp, Rattus norvegicus
gaagaagccttcactgggagctaga

SEQ ID NO: 298005 - DNA, 25 bp, Rattus norvegicus
gaagaagccttctctgggagctaga

SEQ ID NO: 298006 - DNA, 25 bp, Rattus norvegicus
gaagaagccttgaagacctccagcc

SEQ ID NO: 298007 - DNA, 25 bp, Rattus norvegicus
gaagaagccttgtagacctccagcc

SEQ ID NO: 298008 - DNA, 25 bp, Rattus norvegicus
gaagaagcctttctttactctccca

SEQ ID NO: 298009 - DNA, 25 bp, Rattus norvegicus
gaagaagcctttgtttactctccca

SEQ ID NO: 298010 - DNA, 25 bp, Rattus norvegicus
gaagaagcgactaattccccaaagg

SEQ ID NO: 298011 - DNA, 25 bp, Rattus norvegicus
gaagaagcgacttattccccaaagg

SEQ ID NO: 298012 - DNA, 25 bp, Rattus norvegicus
gaagaagcgcaaccggacttccatc

SEQ ID NO: 298013 - DNA, 25 bp, Rattus norvegicus
gaagaagcgcaagcggacttccatc

SEQ ID NO: 298014 - DNA, 25 bp, Rattus norvegicus
gaagaagcgcatcaccttggtacaa

SEQ ID NO: 298015 - DNA, 25 bp, Rattus norvegicus
gaagaagcgcatgaccttggtacaa

SEQ ID NO: 298016 - DNA, 25 bp, Rattus norvegicus
gaagaagcgcttcagggagtcctta

SEQ ID NO: 298017 - DNA, 25 bp, Rattus norvegicus
gaagaagcgcttgagggagtcctta

SEQ ID NO: 298018 - DNA, 25 bp, Rattus norvegicus
gaagaagcggccactgagctacatc

SEQ ID NO: 298019 - DNA, 25 bp, Rattus norvegicus
gaagaagcggcctctgagctacatc

SEQ ID NO: 298020 - DNA, 25 bp, Rattus norvegicus
gaagaagctcctctgactgaaactg

SEQ ID NO: 298021 - DNA, 25 bp, Rattus norvegicus
gaagaagctcctgtgactgaaactg

SEQ ID NO: 298022 - DNA, 25 bp, Rattus norvegicus
gaagaagctgacatctccccgggaa

SEQ ID NO: 298023 - DNA, 25 bp, Rattus norvegicus
gaagaagctgacttctccccgggaa

SEQ ID NO: 298024 - DNA, 25 bp, Rattus norvegicus
gaagaagctgatctcacgggcatgt

SEQ ID NO: 298025 - DNA, 25 bp, Rattus norvegicus
gaagaagctgatgtcacgggcatgt

SEQ ID NO: 298026 - DNA, 25 bp, Rattus norvegicus
gaagaagctgccacacacaaggact

SEQ ID NO: 298027 - DNA, 25 bp, Rattus norvegicus
gaagaagctgcctcacacaaggact

SEQ ID NO: 298028 - DNA, 25 bp, Rattus norvegicus
gaagaagctgctaggccaattccat

SEQ ID NO: 298029 - DNA, 25 bp, Rattus norvegicus
gaagaagctgcttggccaattccat

SEQ ID NO: 298030 - DNA, 25 bp, Rattus norvegicus
gaagaagctttacgtcaccggcagg

SEQ ID NO: 298031 - DNA, 25 bp, Rattus norvegicus
gaagaagctttaggtcaccggcagg

SEQ ID NO: 298032 - DNA, 25 bp, Rattus norvegicus
gaagaagctttgatggcagctgaaa

SEQ ID NO: 298033 - DNA, 25 bp, Rattus norvegicus
gaagaagctttgttggcagctgaaa

SEQ ID NO: 298034 - DNA, 25 bp, Rattus norvegicus
gaagaagcttttctggtggtactat

SEQ ID NO: 298035 - DNA, 25 bp, Rattus norvegicus
gaagaagcttttgtggtggtactat

SEQ ID NO: 298036 - DNA, 25 bp, Rattus norvegicus
gaagaaggaactccatagctcccct

SEQ ID NO: 298037 - DNA, 25 bp, Rattus norvegicus
gaagaaggaactgcatagctcccct

SEQ ID NO: 298038 - DNA, 25 bp, Rattus norvegicus
gaagaaggacaaccgcctggcctac

SEQ ID NO: 298039 - DNA, 25 bp, Rattus norvegicus
gaagaaggacaagcgcctggcctac

SEQ ID NO: 298040 - DNA, 25 bp, Rattus norvegicus
gaagaaggactcataaggctgttaa

SEQ ID NO: 298041 - DNA, 25 bp, Rattus norvegicus
gaagaaggactcttaaggctgttaa

SEQ ID NO: 298042 - DNA, 25 bp, Rattus norvegicus
gaagaaggagcaatcctgtgcacct

SEQ ID NO: 298043 - DNA, 25 bp, Rattus norvegicus
gaagaaggagcattcctgtgcacct

SEQ ID NO: 298044 - DNA, 25 bp, Rattus norvegicus
gaagaaggcagcacggaccctgagt

SEQ ID NO: 298045 - DNA, 25 bp, Rattus norvegicus
gaagaaggcagctcggaccctgagt

SEQ ID NO: 298046 - DNA, 25 bp, Rattus norvegicus
gaagaaggcccgcatagctatgact

SEQ ID NO: 298047 - DNA, 25 bp, Rattus norvegicus
gaagaaggcccggatagctatgact

SEQ ID NO: 298048 - DNA, 25 bp, Rattus norvegicus
gaagaaggccctcctgaaactcaat

SEQ ID NO: 298049 - DNA, 25 bp, Rattus norvegicus
gaagaaggccctgctgaaactcaat

SEQ ID NO: 298050 - DNA, 25 bp, Rattus norvegicus
gaagaaggcctcaggccactttcct

SEQ ID NO: 298051 - DNA, 25 bp, Rattus norvegicus
gaagaaggcctctggccactttcct

SEQ ID NO: 298052 - DNA, 25 bp, Rattus norvegicus
gaagaaggcctgcaattgcctgctg

SEQ ID NO: 298053 - DNA, 25 bp, Rattus norvegicus
gaagaaggcctggaattgcctgctg

SEQ ID NO: 298054 - DNA, 25 bp, Rattus norvegicus
gaagaaggcgcacctagcttggacc

SEQ ID NO: 298055 - DNA, 25 bp, Rattus norvegicus
gaagaaggcgcagctagcttggacc

SEQ ID NO: 298056 - DNA, 25 bp, Rattus norvegicus
gaagaaggctttagccaaccccgag

SEQ ID NO: 298057 - DNA, 25 bp, Rattus norvegicus
gaagaaggcttttgccaaccccgag

SEQ ID NO: 298058 - DNA, 25 bp, Rattus norvegicus
gaagaagggatgactgtctgtcagt

SEQ ID NO: 298059 - DNA, 25 bp, Rattus norvegicus
gaagaagggatgtctgtctgtcagt

SEQ ID NO: 298060 - DNA, 25 bp, Rattus norvegicus
gaagaagggccgatctgccatcaac

SEQ ID NO: 298061 - DNA, 25 bp, Rattus norvegicus
gaagaagggccgttctgccatcaac

SEQ ID NO: 298062 - DNA, 25 bp, Rattus norvegicus
gaagaagggcttcccaagatgccat

SEQ ID NO: 298063 - DNA, 25 bp, Rattus norvegicus
gaagaagggcttgccaagatgccat

SEQ ID NO: 298064 - DNA, 25 bp, Rattus norvegicus
gaagaagggttaaaccacgcctctt

SEQ ID NO: 298065 - DNA, 25 bp, Rattus norvegicus
gaagaagggttataccacgcctctt

SEQ ID NO: 298066 - DNA, 25 bp, Rattus norvegicus
gaagaaggtactatgtcctctccta

SEQ ID NO: 298067 - DNA, 25 bp, Rattus norvegicus
gaagaaggtactttgtcctctccta

SEQ ID NO: 298068 - DNA, 25 bp, Rattus norvegicus
gaagaaggtcaaatagagctgggcc

SEQ ID NO: 298069 - DNA, 25 bp, Rattus norvegicus
gaagaaggtcaattagagctgggcc

SEQ ID NO: 298070 - DNA, 25 bp, Rattus norvegicus
gaagaaggtcagctgtgcgctttct

SEQ ID NO: 298071 - DNA, 25 bp, Rattus norvegicus
gaagaaggtcaggtgtgcgctttct

SEQ ID NO: 298072 - DNA, 25 bp, Rattus norvegicus
gaagaaggtgctatctgcttactga

SEQ ID NO: 298073 - DNA, 25 bp, Rattus norvegicus
gaagaaggtgctttctgcttactga

SEQ ID NO: 298074 - DNA, 25 bp, Rattus norvegicus
gaagaaggtgtcagatctcattaca

SEQ ID NO: 298075 - DNA, 25 bp, Rattus norvegicus
gaagaaggtgtctgatctcattaca

SEQ ID NO: 298076 - DNA, 25 bp, Rattus norvegicus
gaagaaggtgtgacctttccccaca

SEQ ID NO: 298077 - DNA, 25 bp, Rattus norvegicus
gaagaaggtgtgtcctttccccaca

SEQ ID NO: 298078 - DNA, 25 bp, Rattus norvegicus
gaagaaggtttcaccatccaggcac

SEQ ID NO: 298079 - DNA, 25 bp, Rattus norvegicus
gaagaaggtttctccatccaggcac

SEQ ID NO: 298080 - DNA, 25 bp, Rattus norvegicus
gaagaaggttttcagcctatgccct

SEQ ID NO: 298081 - DNA, 25 bp, Rattus norvegicus
gaagaaggttttgagcctatgccct

SEQ ID NO: 298082 - DNA, 25 bp, Rattus norvegicus
gaagaagtaacaacatctgctgtga

SEQ ID NO: 298083 - DNA, 25 bp, Rattus norvegicus
gaagaagtaacatcatctgctgtga

SEQ ID NO: 298084 - DNA, 25 bp, Rattus norvegicus
gaagaagtaactccacagagccaag

SEQ ID NO: 298085 - DNA, 25 bp, Rattus norvegicus
gaagaagtaactgcacagagccaag

SEQ ID NO: 298086 - DNA, 25 bp, Rattus norvegicus
gaagaagtaagactgccagcgcaaa

SEQ ID NO: 298087 - DNA, 25 bp, Rattus norvegicus
gaagaagtaagagtgccagcgcaaa

SEQ ID NO: 298088 - DNA, 25 bp, Rattus norvegicus
gaagaagtaccccatcgtgtggcag

SEQ ID NO: 298089 - DNA, 25 bp, Rattus norvegicus
gaagaagtacccgatcgtgtggcag

SEQ ID NO: 298090 - DNA, 25 bp, Rattus norvegicus
gaagaagtacggaatccctctctgc

SEQ ID NO: 298091 - DNA, 25 bp, Rattus norvegicus
gaagaagtacggtatccctctctgc

SEQ ID NO: 298092 - DNA, 25 bp, Rattus norvegicus
gaagaagtccaaccctgtcaacaag

SEQ ID NO: 298093 - DNA, 25 bp, Rattus norvegicus
gaagaagtccaagcctgtcaacaag

SEQ ID NO: 298094 - DNA, 25 bp, Rattus norvegicus
gaagaagtccagagcctttctattt

SEQ ID NO: 298095 - DNA, 25 bp, Rattus norvegicus
gaagaagtccagtgcctttctattt

SEQ ID NO: 298096 - DNA, 25 bp, Rattus norvegicus
gaagaagtctacatttgcgcgccta

SEQ ID NO: 298097 - DNA, 25 bp, Rattus norvegicus
gaagaagtctacttttgcgcgccta

SEQ ID NO: 298098 - DNA, 25 bp, Rattus norvegicus
gaagaagtcttcctccaagagcaaa

SEQ ID NO: 298099 - DNA, 25 bp, Rattus norvegicus
gaagaagtcttcgtccaagagcaaa

SEQ ID NO: 298100 - DNA, 25 bp, Rattus norvegicus
gaagaagtctttacctgttctctct

SEQ ID NO: 298101 - DNA, 25 bp, Rattus norvegicus
gaagaagtcttttcctgttctctct

SEQ ID NO: 298102 - DNA, 25 bp, Rattus norvegicus
gaagaagtgaaactccgatccgcct

SEQ ID NO: 298103 - DNA, 25 bp, Rattus norvegicus
gaagaagtgaaagtccgatccgcct

SEQ ID NO: 298104 - DNA, 25 bp, Rattus norvegicus
gaagaagtgaacagtacatttttaa

SEQ ID NO: 298105 - DNA, 25 bp, Rattus norvegicus
gaagaagtgaactgtacatttttaa

SEQ ID NO: 298106 - DNA, 25 bp, Rattus norvegicus
gaagaagtgcatcgacctccgggaa

SEQ ID NO: 298107 - DNA, 25 bp, Rattus norvegicus
gaagaagtgcatggacctccgggaa

SEQ ID NO: 298108 - DNA, 25 bp, Rattus norvegicus
gaagaagtgccccaagcgtatacat

SEQ ID NO: 298109 - DNA, 25 bp, Rattus norvegicus
gaagaagtgcccgaagcgtatacat

SEQ ID NO: 298110 - DNA, 25 bp, Rattus norvegicus
gaagaagtgcgcatctgtaccacca

SEQ ID NO: 298111 - DNA, 25 bp, Rattus norvegicus
gaagaagtgcgcttctgtaccacca

SEQ ID NO: 298112 - DNA, 25 bp, Rattus norvegicus
gaagaagtgctcagggcccaggctt

SEQ ID NO: 298113 - DNA, 25 bp, Rattus norvegicus
gaagaagtgctctgggcccaggctt

SEQ ID NO: 298114 - DNA, 25 bp, Rattus norvegicus
gaagaagtggccactcactcaaatt

SEQ ID NO: 298115 - DNA, 25 bp, Rattus norvegicus
gaagaagtggcctctcactcaaatt

SEQ ID NO: 298116 - DNA, 25 bp, Rattus norvegicus
gaagaagtgtccagaccaggctctc

SEQ ID NO: 298117 - DNA, 25 bp, Rattus norvegicus
gaagaagtgtcctgaccaggctctc

SEQ ID NO: 298118 - DNA, 25 bp, Rattus norvegicus
gaagaagtgtggcacttcctccgca

SEQ ID NO: 298119 - DNA, 25 bp, Rattus norvegicus
gaagaagtgtgggacttcctccgca

SEQ ID NO: 298120 - DNA, 25 bp, Rattus norvegicus
gaagaagttacccagtacagagaag

SEQ ID NO: 298121 - DNA, 25 bp, Rattus norvegicus
gaagaagttaccgagtacagagaag

SEQ ID NO: 298122 - DNA, 25 bp, Rattus norvegicus
gaagaagttcccagatctacttccc

SEQ ID NO: 298123 - DNA, 25 bp, Rattus norvegicus
gaagaagttccctgatctacttccc

SEQ ID NO: 298124 - DNA, 25 bp, Rattus norvegicus
gaagaagttcttagcaccatgtgtg

SEQ ID NO: 298125 - DNA, 25 bp, Rattus norvegicus
gaagaagttcttctgtgcgctcctc

SEQ ID NO: 298126 - DNA, 25 bp, Rattus norvegicus
gaagaagttcttgtgtgcgctcctc

SEQ ID NO: 298127 - DNA, 25 bp, Rattus norvegicus
gaagaagttctttgcaccatgtgtg

SEQ ID NO: 298128 - DNA, 25 bp, Rattus norvegicus
gaagaagttgccaactttccctcaa

SEQ ID NO: 298129 - DNA, 25 bp, Rattus norvegicus
gaagaagttgcctactttccctcaa

SEQ ID NO: 298130 - DNA, 25 bp, Rattus norvegicus
gaagaagttgctccaacaatttttt

SEQ ID NO: 298131 - DNA, 25 bp, Rattus norvegicus
gaagaagttgctgcaacaatttttt

SEQ ID NO: 298132 - DNA, 25 bp, Rattus norvegicus
gaagaagtttctccctgctgttaag

SEQ ID NO: 298133 - DNA, 25 bp, Rattus norvegicus
gaagaagtttctgcctgctgttaag

SEQ ID NO: 298134 - DNA, 25 bp, Rattus norvegicus
gaagaataaaaccaccctataactg

SEQ ID NO: 298135 - DNA, 25 bp, Rattus norvegicus
gaagaataaaacgaccctataactg

SEQ ID NO: 298136 - DNA, 25 bp, Rattus norvegicus
gaagaataaagccttccgcccaatt

SEQ ID NO: 298137 - DNA, 25 bp, Rattus norvegicus
gaagaataaagcgttccgcccaatt

SEQ ID NO: 298138 - DNA, 25 bp, Rattus norvegicus
gaagaataacttcacccagaacaga

SEQ ID NO: 298139 - DNA, 25 bp, Rattus norvegicus
gaagaataacttgacccagaacaga

SEQ ID NO: 298140 - DNA, 25 bp, Rattus norvegicus
gaagaataccataggccaggcttga

SEQ ID NO: 298141 - DNA, 25 bp, Rattus norvegicus
gaagaataccattggccaggcttga

SEQ ID NO: 298142 - DNA, 25 bp, Rattus norvegicus
gaagaatacccaatggcagcaccta

SEQ ID NO: 298143 - DNA, 25 bp, Rattus norvegicus
gaagaatacccattggcagcaccta

SEQ ID NO: 298144 - DNA, 25 bp, Rattus norvegicus
gaagaatactcccattgtcgcctag

SEQ ID NO: 298145 - DNA, 25 bp, Rattus norvegicus
gaagaatactccgattgtcgcctag

SEQ ID NO: 298146 - DNA, 25 bp, Rattus norvegicus
gaagaatcatccaaaaccgcatcct

SEQ ID NO: 298147 - DNA, 25 bp, Rattus norvegicus
gaagaatcatcctaaaccgcatcct

SEQ ID NO: 298148 - DNA, 25 bp, Rattus norvegicus
gaagaatcccaactgatattcagaa

SEQ ID NO: 298149 - DNA, 25 bp, Rattus norvegicus
gaagaatcccaagtgatattcagaa

SEQ ID NO: 298150 - DNA, 25 bp, Rattus norvegicus
gaagaatcccaccatctggaagagg

SEQ ID NO: 298151 - DNA, 25 bp, Rattus norvegicus
gaagaatcccacgatctggaagagg

SEQ ID NO: 298152 - DNA, 25 bp, Rattus norvegicus
gaagaatcccagatctcacacagta

SEQ ID NO: 298153 - DNA, 25 bp, Rattus norvegicus
gaagaatcccagttctcacacagta

SEQ ID NO: 298154 - DNA, 25 bp, Rattus norvegicus
gaagaatcctctagatgtccactct

SEQ ID NO: 298155 - DNA, 25 bp, Rattus norvegicus
gaagaatcctcttgatgtccactct

SEQ ID NO: 298156 - DNA, 25 bp, Rattus norvegicus
gaagaatccttaacgctagcttggt

SEQ ID NO: 298157 - DNA, 25 bp, Rattus norvegicus
gaagaatccttacagctggcttgag

SEQ ID NO: 298158 - DNA, 25 bp, Rattus norvegicus
gaagaatccttagagctggcttgag

SEQ ID NO: 298159 - DNA, 25 bp, Rattus norvegicus
gaagaatccttatcgctagcttggt

SEQ ID NO: 298160 - DNA, 25 bp, Rattus norvegicus
gaagaatccttcaacgctgtacaag

SEQ ID NO: 298161 - DNA, 25 bp, Rattus norvegicus
gaagaatccttctacgctgtacaag

SEQ ID NO: 298162 - DNA, 25 bp, Rattus norvegicus
gaagaatcggacatgcagccttgcc

SEQ ID NO: 298163 - DNA, 25 bp, Rattus norvegicus
gaagaatcggacttgcagccttgcc

SEQ ID NO: 298164 - DNA, 25 bp, Rattus norvegicus
gaagaatcgtggcatccgggactca

SEQ ID NO: 298165 - DNA, 25 bp, Rattus norvegicus
gaagaatcgtgggatccgggactca

SEQ ID NO: 298166 - DNA, 25 bp, Rattus norvegicus
gaagaatctaagcttggtctctcaa

SEQ ID NO: 298167 - DNA, 25 bp, Rattus norvegicus
gaagaatctaaggttggtctctcaa

SEQ ID NO: 298168 - DNA, 25 bp, Rattus norvegicus
gaagaatctaccagtgttccagcct

SEQ ID NO: 298169 - DNA, 25 bp, Rattus norvegicus
gaagaatctacctgtgttccagcct

SEQ ID NO: 298170 - DNA, 25 bp, Rattus norvegicus
gaagaatctagtagtccgtgtgtat

SEQ ID NO: 298171 - DNA, 25 bp, Rattus norvegicus
gaagaatctagttgtccgtgtgtat

SEQ ID NO: 298172 - DNA, 25 bp, Rattus norvegicus
gaagaatctggcaccgttctttaag

SEQ ID NO: 298173 - DNA, 25 bp, Rattus norvegicus
gaagaatctggctccgttctttaag

SEQ ID NO: 298174 - DNA, 25 bp, Rattus norvegicus
gaagaatcttatccccgtgtgcatt

SEQ ID NO: 298175 - DNA, 25 bp, Rattus norvegicus
gaagaatcttatgcccgtgtgcatt

SEQ ID NO: 298176 - DNA, 25 bp, Rattus norvegicus
gaagaatcttccctaatgtggtcac

SEQ ID NO: 298177 - DNA, 25 bp, Rattus norvegicus
gaagaatcttccgtaatgtggtcac

SEQ ID NO: 298178 - DNA, 25 bp, Rattus norvegicus
gaagaatcttctcctggtctgctga

SEQ ID NO: 298179 - DNA, 25 bp, Rattus norvegicus
gaagaatcttctgctggtctgctga

SEQ ID NO: 298180 - DNA, 25 bp, Rattus norvegicus
gaagaatgacatccccagcatcaag

SEQ ID NO: 298181 - DNA, 25 bp, Rattus norvegicus
gaagaatgacatgcccagcatcaag

SEQ ID NO: 298182 - DNA, 25 bp, Rattus norvegicus
gaagaatgagccagcctgactccat

SEQ ID NO: 298183 - DNA, 25 bp, Rattus norvegicus
gaagaatgagcctgcctgactccat

SEQ ID NO: 298184 - DNA, 25 bp, Rattus norvegicus
gaagaatgaggcactcccgaggctc

SEQ ID NO: 298185 - DNA, 25 bp, Rattus norvegicus
gaagaatgaggctctcccgaggctc

SEQ ID NO: 298186 - DNA, 25 bp, Rattus norvegicus
gaagaatgatgaaagccctgcccat

SEQ ID NO: 298187 - DNA, 25 bp, Rattus norvegicus
gaagaatgatgatagccctgcccat

SEQ ID NO: 298188 - DNA, 25 bp, Rattus norvegicus
gaagaatgcagtaccaagctcccat

SEQ ID NO: 298189 - DNA, 25 bp, Rattus norvegicus
gaagaatgcagttccaagctcccat

SEQ ID NO: 298190 - DNA, 25 bp, Rattus norvegicus
gaagaatgcgcacaccacagatttg

SEQ ID NO: 298191 - DNA, 25 bp, Rattus norvegicus
gaagaatgcgcagaccacagatttg

SEQ ID NO: 298192 - DNA, 25 bp, Rattus norvegicus
gaagaatgctgcataaaaatgcccc

SEQ ID NO: 298193 - DNA, 25 bp, Rattus norvegicus
gaagaatgctgcttaaaaatgcccc

SEQ ID NO: 298194 - DNA, 25 bp, Rattus norvegicus
gaagaatggctaacccaggttgaaa

SEQ ID NO: 298195 - DNA, 25 bp, Rattus norvegicus
gaagaatggctatcccaggttgaaa

SEQ ID NO: 298196 - DNA, 25 bp, Rattus norvegicus
gaagaatggcttctcgttctcatcg

SEQ ID NO: 298197 - DNA, 25 bp, Rattus norvegicus
gaagaatggcttgtcgttctcatcg

SEQ ID NO: 298198 - DNA, 25 bp, Rattus norvegicus
gaagaatgggtcattctgccatagt

SEQ ID NO: 298199 - DNA, 25 bp, Rattus norvegicus
gaagaatgggtctttctgccatagt

SEQ ID NO: 298200 - DNA, 25 bp, Rattus norvegicus
gaagaatggttaccagagactctgg

SEQ ID NO: 298201 - DNA, 25 bp, Rattus norvegicus
gaagaatggttagcagagactctgg

SEQ ID NO: 298202 - DNA, 25 bp, Rattus norvegicus
gaagaatgtaacatgccaccacaca

SEQ ID NO: 298203 - DNA, 25 bp, Rattus norvegicus
gaagaatgtaacttgccaccacaca

SEQ ID NO: 298204 - DNA, 25 bp, Rattus norvegicus
gaagaatgtcagagaagttccccac

SEQ ID NO: 298205 - DNA, 25 bp, Rattus norvegicus
gaagaatgtcagtgaagttccccac

SEQ ID NO: 298206 - DNA, 25 bp, Rattus norvegicus
gaagaatgtcccatctaaggtccat

SEQ ID NO: 298207 - DNA, 25 bp, Rattus norvegicus
gaagaatgtcccatgcttgctcagt

SEQ ID NO: 298208 - DNA, 25 bp, Rattus norvegicus
gaagaatgtcccttctaaggtccat

SEQ ID NO: 298209 - DNA, 25 bp, Rattus norvegicus
gaagaatgtcccttgcttgctcagt

SEQ ID NO: 298210 - DNA, 25 bp, Rattus norvegicus
gaagaatgtgtccagctacccaaaa

SEQ ID NO: 298211 - DNA, 25 bp, Rattus norvegicus
gaagaatgtgtcgagctacccaaaa

SEQ ID NO: 298212 - DNA, 25 bp, Rattus norvegicus
gaagaatgtgtgcacagcgccctca

SEQ ID NO: 298213 - DNA, 25 bp, Rattus norvegicus
gaagaatgtgtggacagcgccctca

SEQ ID NO: 298214 - DNA, 25 bp, Rattus norvegicus
gaagaatgtgttccagctcatccag

SEQ ID NO: 298215 - DNA, 25 bp, Rattus norvegicus
gaagaatgtgttgcagctcatccag

SEQ ID NO: 298216 - DNA, 25 bp, Rattus norvegicus
gaagaatgttatatggctttctaat

SEQ ID NO: 298217 - DNA, 25 bp, Rattus norvegicus
gaagaatgttatttggctttctaat

SEQ ID NO: 298218 - DNA, 25 bp, Rattus norvegicus
gaagaatgttcgctttcactcgtgt

SEQ ID NO: 298219 - DNA, 25 bp, Rattus norvegicus
gaagaatgttcggtttcactcgtgt

SEQ ID NO: 298220 - DNA, 25 bp, Rattus norvegicus
gaagaatgttctcttagggcttaaa

SEQ ID NO: 298221 - DNA, 25 bp, Rattus norvegicus
gaagaatgttctgttagggcttaaa

SEQ ID NO: 298222 - DNA, 25 bp, Rattus norvegicus
gaagaattaacacgccctgccagca

SEQ ID NO: 298223 - DNA, 25 bp, Rattus norvegicus
gaagaattaacaggccctgccagca

SEQ ID NO: 298224 - DNA, 25 bp, Rattus norvegicus
gaagaattcaacagtgctcactgca

SEQ ID NO: 298225 - DNA, 25 bp, Rattus norvegicus
gaagaattcaactgtgctcactgca

SEQ ID NO: 298226 - DNA, 25 bp, Rattus norvegicus
gaagaattcacaccggaccatccat

SEQ ID NO: 298227 - DNA, 25 bp, Rattus norvegicus
gaagaattcacagcggaccatccat

SEQ ID NO: 298228 - DNA, 25 bp, Rattus norvegicus
gaagaattcagccacaatcccagag

SEQ ID NO: 298229 - DNA, 25 bp, Rattus norvegicus
gaagaattcagcgacaatcccagag

SEQ ID NO: 298230 - DNA, 25 bp, Rattus norvegicus
gaagaattcatcaatccaaaaggca

SEQ ID NO: 298231 - DNA, 25 bp, Rattus norvegicus
gaagaattcatctatccaaaaggca

SEQ ID NO: 298232 - DNA, 25 bp, Rattus norvegicus
gaagaattcattcacctctggagac

SEQ ID NO: 298233 - DNA, 25 bp, Rattus norvegicus
gaagaattcattgacctctggagac

SEQ ID NO: 298234 - DNA, 25 bp, Rattus norvegicus
gaagaattccctactccaatacatt

SEQ ID NO: 298235 - DNA, 25 bp, Rattus norvegicus
gaagaattcccttctccaatacatt

SEQ ID NO: 298236 - DNA, 25 bp, Rattus norvegicus
gaagaattctgcaattcgcccagcg

SEQ ID NO: 298237 - DNA, 25 bp, Rattus norvegicus
gaagaattctgcctcaaacgctgac

SEQ ID NO: 298238 - DNA, 25 bp, Rattus norvegicus
gaagaattctgcgtcaaacgctgac

SEQ ID NO: 298239 - DNA, 25 bp, Rattus norvegicus
gaagaattctgctattcgcccagcg

SEQ ID NO: 298240 - DNA, 25 bp, Rattus norvegicus
gaagaattctgtatcctggaatgag

SEQ ID NO: 298241 - DNA, 25 bp, Rattus norvegicus
gaagaattctgtttcctggaatgag

SEQ ID NO: 298242 - DNA, 25 bp, Rattus norvegicus
gaagaattgccaactgtggcgccat

SEQ ID NO: 298243 - DNA, 25 bp, Rattus norvegicus
gaagaattgccatctgtggcgccat

SEQ ID NO: 298244 - DNA, 25 bp, Rattus norvegicus
gaagaattgcccaggctctgagaaa

SEQ ID NO: 298245 - DNA, 25 bp, Rattus norvegicus
gaagaattgccctggctctgagaaa

SEQ ID NO: 298246 - DNA, 25 bp, Rattus norvegicus
gaagaattgcttactctactttcaa

SEQ ID NO: 298247 - DNA, 25 bp, Rattus norvegicus
gaagaattgctttctctactttcaa

SEQ ID NO: 298248 - DNA, 25 bp, Rattus norvegicus
gaagaattggcccttcaatcaatga

SEQ ID NO: 298249 - DNA, 25 bp, Rattus norvegicus
gaagaattggccgttcaatcaatga

SEQ ID NO: 298250 - DNA, 25 bp, Rattus norvegicus
gaagaattgtatacctgccgcagaa

SEQ ID NO: 298251 - DNA, 25 bp, Rattus norvegicus
gaagaattgtattcctgccgcagaa

SEQ ID NO: 298252 - DNA, 25 bp, Rattus norvegicus
gaagaattgtgtcctgagctagaga

SEQ ID NO: 298253 - DNA, 25 bp, Rattus norvegicus
gaagaattgtgtgctgagctagaga

SEQ ID NO: 298254 - DNA, 25 bp, Rattus norvegicus
gaagaatttctgagtctccgccaaa

SEQ ID NO: 298255 - DNA, 25 bp, Rattus norvegicus
gaagaatttctgtgtctccgccaaa

SEQ ID NO: 298256 - DNA, 25 bp, Rattus norvegicus
gaagaatttcttaccagctttgagg

SEQ ID NO: 298257 - DNA, 25 bp, Rattus norvegicus
gaagaatttctttccagctttgagg

SEQ ID NO: 298258 - DNA, 25 bp, Rattus norvegicus
gaagaatttgaccatcggtatgttt

SEQ ID NO: 298259 - DNA, 25 bp, Rattus norvegicus
gaagaatttgacgatcggtatgttt

SEQ ID NO: 298260 - DNA, 25 bp, Rattus norvegicus
gaagaatttgtgcacctctactgcc

SEQ ID NO: 298261 - DNA, 25 bp, Rattus norvegicus
gaagaatttgtggacctctactgcc

SEQ ID NO: 298262 - DNA, 25 bp, Rattus norvegicus
gaagacaaaagtagccccatacttg

SEQ ID NO: 298263 - DNA, 25 bp, Rattus norvegicus
gaagacaaaagttgccccatacttg

SEQ ID NO: 298264 - DNA, 25 bp, Rattus norvegicus
gaagacaaacatactctgaattagc

SEQ ID NO: 298265 - DNA, 25 bp, Rattus norvegicus
gaagacaaacattctctgaattagc

SEQ ID NO: 298266 - DNA, 25 bp, Rattus norvegicus
gaagacaaactaatccctaccagtt

SEQ ID NO: 298267 - DNA, 25 bp, Rattus norvegicus
gaagacaaactattccctaccagtt

SEQ ID NO: 298268 - DNA, 25 bp, Rattus norvegicus
gaagacaacccaaacactcaggaca

SEQ ID NO: 298269 - DNA, 25 bp, Rattus norvegicus
gaagacaacccatacactcaggaca

SEQ ID NO: 298270 - DNA, 25 bp, Rattus norvegicus
gaagacaactacctgtagctccgcg

SEQ ID NO: 298271 - DNA, 25 bp, Rattus norvegicus
gaagacaactacgtgtagctccgcg

SEQ ID NO: 298272 - DNA, 25 bp, Rattus norvegicus
gaagacaactcaacaggctgtatga

SEQ ID NO: 298273 - DNA, 25 bp, Rattus norvegicus
gaagacaactcatcaggctgtatga

SEQ ID NO: 298274 - DNA, 25 bp, Rattus norvegicus
gaagacaacttcaccactgaagctt

SEQ ID NO: 298275 - DNA, 25 bp, Rattus norvegicus
gaagacaacttctccactgaagctt

SEQ ID NO: 298276 - DNA, 25 bp, Rattus norvegicus
gaagacaagaccattctgccaagat

SEQ ID NO: 298277 - DNA, 25 bp, Rattus norvegicus
gaagacaagacctttctgccaagat

SEQ ID NO: 298278 - DNA, 25 bp, Rattus norvegicus
gaagacaagagtcctgccgagtcct

SEQ ID NO: 298279 - DNA, 25 bp, Rattus norvegicus
gaagacaagagtgctgccgagtcct

SEQ ID NO: 298280 - DNA, 25 bp, Rattus norvegicus
gaagacaagataaaggcccctccaa

SEQ ID NO: 298281 - DNA, 25 bp, Rattus norvegicus
gaagacaagatataggcccctccaa

SEQ ID NO: 298282 - DNA, 25 bp, Rattus norvegicus
gaagacaagatcctgcactcacact

SEQ ID NO: 298283 - DNA, 25 bp, Rattus norvegicus
gaagacaagatcgtgcactcacact

SEQ ID NO: 298284 - DNA, 25 bp, Rattus norvegicus
gaagacaagctacgctgggcttttt

SEQ ID NO: 298285 - DNA, 25 bp, Rattus norvegicus
gaagacaagctaggctgggcttttt

SEQ ID NO: 298286 - DNA, 25 bp, Rattus norvegicus
gaagacaagtctataggccagagtt

SEQ ID NO: 298287 - DNA, 25 bp, Rattus norvegicus
gaagacaagtctctgatcgacacat

SEQ ID NO: 298288 - DNA, 25 bp, Rattus norvegicus
gaagacaagtctgtgatcgacacat

SEQ ID NO: 298289 - DNA, 25 bp, Rattus norvegicus
gaagacaagtctttaggccagagtt

SEQ ID NO: 298290 - DNA, 25 bp, Rattus norvegicus
gaagacaatcagacactgggcctct

SEQ ID NO: 298291 - DNA, 25 bp, Rattus norvegicus
gaagacaatcagtcactgggcctct

SEQ ID NO: 298292 - DNA, 25 bp, Rattus norvegicus
gaagacaatcccagcaaaactgtga

SEQ ID NO: 298293 - DNA, 25 bp, Rattus norvegicus
gaagacaatccctgcaaaactgtga

SEQ ID NO: 298294 - DNA, 25 bp, Rattus norvegicus
gaagacaattacagcccggatcaca

SEQ ID NO: 298295 - DNA, 25 bp, Rattus norvegicus
gaagacaattactgcccggatcaca

SEQ ID NO: 298296 - DNA, 25 bp, Rattus norvegicus
gaagacacagtgaaccaaacacaga

SEQ ID NO: 298297 - DNA, 25 bp, Rattus norvegicus
gaagacacagtgtaccaaacacaga

SEQ ID NO: 298298 - DNA, 25 bp, Rattus norvegicus
gaagacacatccagaagactctcgc

SEQ ID NO: 298299 - DNA, 25 bp, Rattus norvegicus
gaagacacatcctgaagactctcgc

SEQ ID NO: 298300 - DNA, 25 bp, Rattus norvegicus
gaagacaccaagaaacagcctaatt

SEQ ID NO: 298301 - DNA, 25 bp, Rattus norvegicus
gaagacaccaagaaccactcaggag

SEQ ID NO: 298302 - DNA, 25 bp, Rattus norvegicus
gaagacaccaagatcaaccaccgtc

SEQ ID NO: 298303 - DNA, 25 bp, Rattus norvegicus
gaagacaccaagtaacagcctaatt

SEQ ID NO: 298304 - DNA, 25 bp, Rattus norvegicus
gaagacaccaagtaccactcaggag

SEQ ID NO: 298305 - DNA, 25 bp, Rattus norvegicus
gaagacaccaagttcaaccaccgtc

SEQ ID NO: 298306 - DNA, 25 bp, Rattus norvegicus
gaagacaccacacatgactccgagc

SEQ ID NO: 298307 - DNA, 25 bp, Rattus norvegicus
gaagacaccacagatgactccgagc

SEQ ID NO: 298308 - DNA, 25 bp, Rattus norvegicus
gaagacaccagtcctcaacctctag

SEQ ID NO: 298309 - DNA, 25 bp, Rattus norvegicus
gaagacaccagtgctcaacctctag

SEQ ID NO: 298310 - DNA, 25 bp, Rattus norvegicus
gaagacacccaccattacttacagt

SEQ ID NO: 298311 - DNA, 25 bp, Rattus norvegicus
gaagacacccacgattacttacagt

SEQ ID NO: 298312 - DNA, 25 bp, Rattus norvegicus
gaagacacccttactctgtaagaga

SEQ ID NO: 298313 - DNA, 25 bp, Rattus norvegicus
gaagacaccctttctctgtaagaga

SEQ ID NO: 298314 - DNA, 25 bp, Rattus norvegicus
gaagacaccggaagaagccatccta

SEQ ID NO: 298315 - DNA, 25 bp, Rattus norvegicus
gaagacaccggatgaagccatccta

SEQ ID NO: 298316 - DNA, 25 bp, Rattus norvegicus
gaagacacctacagttcatcatgag

SEQ ID NO: 298317 - DNA, 25 bp, Rattus norvegicus
gaagacacctacattccatgacaaa

SEQ ID NO: 298318 - DNA, 25 bp, Rattus norvegicus
gaagacacctactgttcatcatgag

SEQ ID NO: 298319 - DNA, 25 bp, Rattus norvegicus
gaagacacctactttccatgacaaa

SEQ ID NO: 298320 - DNA, 25 bp, Rattus norvegicus
gaagacaccttcatgtgtatatggt

SEQ ID NO: 298321 - DNA, 25 bp, Rattus norvegicus
gaagacaccttcttgtgtatatggt

SEQ ID NO: 298322 - DNA, 25 bp, Rattus norvegicus
gaagacacctttacaagtgcctctg

SEQ ID NO: 298323 - DNA, 25 bp, Rattus norvegicus
gaagacaccttttcaagtgcctctg

SEQ ID NO: 298324 - DNA, 25 bp, Rattus norvegicus
gaagacactaaacaaatcactgaga

SEQ ID NO: 298325 - DNA, 25 bp, Rattus norvegicus
gaagacactaaagaaatcactgaga

SEQ ID NO: 298326 - DNA, 25 bp, Rattus norvegicus
gaagacactatactaggtccctagg

SEQ ID NO: 298327 - DNA, 25 bp, Rattus norvegicus
gaagacactatagtaggtccctagg

SEQ ID NO: 298328 - DNA, 25 bp, Rattus norvegicus
gaagacactcggcatcaaaaccaac

SEQ ID NO: 298329 - DNA, 25 bp, Rattus norvegicus
gaagacactcgggatcaaaaccaac

SEQ ID NO: 298330 - DNA, 25 bp, Rattus norvegicus
gaagacactgacatctcggtgaagg

SEQ ID NO: 298331 - DNA, 25 bp, Rattus norvegicus
gaagacactgacattcaggagtcag

SEQ ID NO: 298332 - DNA, 25 bp, Rattus norvegicus
gaagacactgacttctcggtgaagg

SEQ ID NO: 298333 - DNA, 25 bp, Rattus norvegicus
gaagacactgactttcaggagtcag

SEQ ID NO: 298334 - DNA, 25 bp, Rattus norvegicus
gaagacactgctatgctatatttaa

SEQ ID NO: 298335 - DNA, 25 bp, Rattus norvegicus
gaagacactgctcttttgacactcc

SEQ ID NO: 298336 - DNA, 25 bp, Rattus norvegicus
gaagacactgctgttttgacactcc

SEQ ID NO: 298337 - DNA, 25 bp, Rattus norvegicus
gaagacactgctttgctatatttaa

SEQ ID NO: 298338 - DNA, 25 bp, Rattus norvegicus
gaagacactggaatgcttgactgct

SEQ ID NO: 298339 - DNA, 25 bp, Rattus norvegicus
gaagacactggattgcttgactgct

SEQ ID NO: 298340 - DNA, 25 bp, Rattus norvegicus
gaagacactgtaccggacgcgtcct

SEQ ID NO: 298341 - DNA, 25 bp, Rattus norvegicus
gaagacactgtagcggacgcgtcct

SEQ ID NO: 298342 - DNA, 25 bp, Rattus norvegicus
gaagacactgtcactgatggacccc

SEQ ID NO: 298343 - DNA, 25 bp, Rattus norvegicus
gaagacactgtcatgaattgttgaa

SEQ ID NO: 298344 - DNA, 25 bp, Rattus norvegicus
gaagacactgtctctgatggacccc

SEQ ID NO: 298345 - DNA, 25 bp, Rattus norvegicus
gaagacactgtcttgaattgttgaa

SEQ ID NO: 298346 - DNA, 25 bp, Rattus norvegicus
gaagacactgttatgctccatacac

SEQ ID NO: 298347 - DNA, 25 bp, Rattus norvegicus
gaagacactgttctctgtgttacct

SEQ ID NO: 298348 - DNA, 25 bp, Rattus norvegicus
gaagacactgttgtctgtgttacct

SEQ ID NO: 298349 - DNA, 25 bp, Rattus norvegicus
gaagacactgttttgctccatacac

SEQ ID NO: 298350 - DNA, 25 bp, Rattus norvegicus
gaagacacttaaatcacctgaacta

SEQ ID NO: 298351 - DNA, 25 bp, Rattus norvegicus
gaagacacttaattcacctgaacta

SEQ ID NO: 298352 - DNA, 25 bp, Rattus norvegicus
gaagacacttatcccaggctaatgg

SEQ ID NO: 298353 - DNA, 25 bp, Rattus norvegicus
gaagacacttatgccaggctaatgg

SEQ ID NO: 298354 - DNA, 25 bp, Rattus norvegicus
gaagacactttgagcctttcagata

SEQ ID NO: 298355 - DNA, 25 bp, Rattus norvegicus
gaagacactttgtgcctttcagata

SEQ ID NO: 298356 - DNA, 25 bp, Rattus norvegicus
gaagacagaacccatctcgttgctc

SEQ ID NO: 298357 - DNA, 25 bp, Rattus norvegicus
gaagacagaaccgatctcgttgctc

SEQ ID NO: 298358 - DNA, 25 bp, Rattus norvegicus
gaagacagaactaaccagagcattg

SEQ ID NO: 298359 - DNA, 25 bp, Rattus norvegicus
gaagacagaactacaacccgcagac

SEQ ID NO: 298360 - DNA, 25 bp, Rattus norvegicus
gaagacagaacttaccagagcattg

SEQ ID NO: 298361 - DNA, 25 bp, Rattus norvegicus
gaagacagaacttcaacccgcagac

SEQ ID NO: 298362 - DNA, 25 bp, Rattus norvegicus
gaagacagacacagccagttacaca

SEQ ID NO: 298363 - DNA, 25 bp, Rattus norvegicus
gaagacagacactgccagttacaca

SEQ ID NO: 298364 - DNA, 25 bp, Rattus norvegicus
gaagacagacatcacaggacccagg

SEQ ID NO: 298365 - DNA, 25 bp, Rattus norvegicus
gaagacagacatgacaggacccagg

SEQ ID NO: 298366 - DNA, 25 bp, Rattus norvegicus
gaagacagacctcacatgggaagaa

SEQ ID NO: 298367 - DNA, 25 bp, Rattus norvegicus
gaagacagacctgacatgggaagaa

SEQ ID NO: 298368 - DNA, 25 bp, Rattus norvegicus
gaagacagactcagagtgccgccca

SEQ ID NO: 298369 - DNA, 25 bp, Rattus norvegicus
gaagacagactctgagtgccgccca

SEQ ID NO: 298370 - DNA, 25 bp, Rattus norvegicus
gaagacagagccataccttacagaa

SEQ ID NO: 298371 - DNA, 25 bp, Rattus norvegicus
gaagacagagccttaccttacagaa

SEQ ID NO: 298372 - DNA, 25 bp, Rattus norvegicus
gaagacagatgcctacgtctgtccc

SEQ ID NO: 298373 - DNA, 25 bp, Rattus norvegicus
gaagacagatgcgtacgtctgtccc

SEQ ID NO: 298374 - DNA, 25 bp, Rattus norvegicus
gaagacagatgtagctctttctttt

SEQ ID NO: 298375 - DNA, 25 bp, Rattus norvegicus
gaagacagatgttgctctttctttt

SEQ ID NO: 298376 - DNA, 25 bp, Rattus norvegicus
gaagacagcaacaacatcacagtag

SEQ ID NO: 298377 - DNA, 25 bp, Rattus norvegicus
gaagacagcaactacatcacagtag

SEQ ID NO: 298378 - DNA, 25 bp, Rattus norvegicus
gaagacagcagccttaatctcctgg

SEQ ID NO: 298379 - DNA, 25 bp, Rattus norvegicus
gaagacagcagcgttaatctcctgg

SEQ ID NO: 298380 - DNA, 25 bp, Rattus norvegicus
gaagacagccaaatcattttccata

SEQ ID NO: 298381 - DNA, 25 bp, Rattus norvegicus
gaagacagccaattcattttccata

SEQ ID NO: 298382 - DNA, 25 bp, Rattus norvegicus
gaagacagccgaccctgctgtgtga

SEQ ID NO: 298383 - DNA, 25 bp, Rattus norvegicus
gaagacagccgagcctgctgtgtga

SEQ ID NO: 298384 - DNA, 25 bp, Rattus norvegicus
gaagacagcgggatggcaatgcact

SEQ ID NO: 298385 - DNA, 25 bp, Rattus norvegicus
gaagacagcgggttggcaatgcact

SEQ ID NO: 298386 - DNA, 25 bp, Rattus norvegicus
gaagacagctcaattctggtggaaa

SEQ ID NO: 298387 - DNA, 25 bp, Rattus norvegicus
gaagacagctcatttctggtggaaa

SEQ ID NO: 298388 - DNA, 25 bp, Rattus norvegicus
gaagacagctgtcttcagcctcagt

SEQ ID NO: 298389 - DNA, 25 bp, Rattus norvegicus
gaagacagctgtgttcagcctcagt

SEQ ID NO: 298390 - DNA, 25 bp, Rattus norvegicus
gaagacagctttccaccctgagaga

SEQ ID NO: 298391 - DNA, 25 bp, Rattus norvegicus
gaagacagctttgcaccctgagaga

SEQ ID NO: 298392 - DNA, 25 bp, Rattus norvegicus
gaagacaggacactgtctgcctgct

SEQ ID NO: 298393 - DNA, 25 bp, Rattus norvegicus
gaagacaggacagtgtctgcctgct

SEQ ID NO: 298394 - DNA, 25 bp, Rattus norvegicus
gaagacaggccacgctgctggattc

SEQ ID NO: 298395 - DNA, 25 bp, Rattus norvegicus
gaagacaggccaggctgctggattc

SEQ ID NO: 298396 - DNA, 25 bp, Rattus norvegicus
gaagacaggcttaactgctgcctca

SEQ ID NO: 298397 - DNA, 25 bp, Rattus norvegicus
gaagacaggctttactgctgcctca

SEQ ID NO: 298398 - DNA, 25 bp, Rattus norvegicus
gaagacaggtgaaatgctcactaat

SEQ ID NO: 298399 - DNA, 25 bp, Rattus norvegicus
gaagacaggtgatatgctcactaat

SEQ ID NO: 298400 - DNA, 25 bp, Rattus norvegicus
gaagacaggtgcatgctacgctgct

SEQ ID NO: 298401 - DNA, 25 bp, Rattus norvegicus
gaagacaggtgcttgctacgctgct

SEQ ID NO: 298402 - DNA, 25 bp, Rattus norvegicus
gaagacaggttgatcccaggcaaaa

SEQ ID NO: 298403 - DNA, 25 bp, Rattus norvegicus
gaagacaggttgttcccaggcaaaa

SEQ ID NO: 298404 - DNA, 25 bp, Rattus norvegicus
gaagacagtagacaccagagagcaa

SEQ ID NO: 298405 - DNA, 25 bp, Rattus norvegicus
gaagacagtagagaccagagagcaa

SEQ ID NO: 298406 - DNA, 25 bp, Rattus norvegicus
gaagacagtatcagctgccaggact

SEQ ID NO: 298407 - DNA, 25 bp, Rattus norvegicus
gaagacagtatctgctgccaggact

SEQ ID NO: 298408 - DNA, 25 bp, Rattus norvegicus
gaagacagtattccagcctgtgcac

SEQ ID NO: 298409 - DNA, 25 bp, Rattus norvegicus
gaagacagtattgcagcctgtgcac

SEQ ID NO: 298410 - DNA, 25 bp, Rattus norvegicus
gaagacagtcagaggcagcaaatgc

SEQ ID NO: 298411 - DNA, 25 bp, Rattus norvegicus
gaagacagtcagtggcagcaaatgc

SEQ ID NO: 298412 - DNA, 25 bp, Rattus norvegicus
gaagacagtcatacccatgttcatg

SEQ ID NO: 298413 - DNA, 25 bp, Rattus norvegicus
gaagacagtcatcaccagtattcat

SEQ ID NO: 298414 - DNA, 25 bp, Rattus norvegicus
gaagacagtcatgaccagtattcat

SEQ ID NO: 298415 - DNA, 25 bp, Rattus norvegicus
gaagacagtcattcccatgttcatg

SEQ ID NO: 298416 - DNA, 25 bp, Rattus norvegicus
gaagacagtgccaacgggagccagt

SEQ ID NO: 298417 - DNA, 25 bp, Rattus norvegicus
gaagacagtgcctacgggagccagt

SEQ ID NO: 298418 - DNA, 25 bp, Rattus norvegicus
gaagacagtgctaactctaatgtta

SEQ ID NO: 298419 - DNA, 25 bp, Rattus norvegicus
gaagacagtgcttactctaatgtta

SEQ ID NO: 298420 - DNA, 25 bp, Rattus norvegicus
gaagacagtgtcacgtctcatgtat

SEQ ID NO: 298421 - DNA, 25 bp, Rattus norvegicus
gaagacagtgtctcgtctcatgtat

SEQ ID NO: 298422 - DNA, 25 bp, Rattus norvegicus
gaagacagttttccattaggctgta

SEQ ID NO: 298423 - DNA, 25 bp, Rattus norvegicus
gaagacagttttctgcaatttagaa

SEQ ID NO: 298424 - DNA, 25 bp, Rattus norvegicus
gaagacagttttgcattaggctgta

SEQ ID NO: 298425 - DNA, 25 bp, Rattus norvegicus
gaagacagttttgtgcaatttagaa

SEQ ID NO: 298426 - DNA, 25 bp, Rattus norvegicus
gaagacataagcatagcccagccat

SEQ ID NO: 298427 - DNA, 25 bp, Rattus norvegicus
gaagacataagcttagcccagccat

SEQ ID NO: 298428 - DNA, 25 bp, Rattus norvegicus
gaagacataatcactggtgccagtg

SEQ ID NO: 298429 - DNA, 25 bp, Rattus norvegicus
gaagacataatccaacgctcagttc

SEQ ID NO: 298430 - DNA, 25 bp, Rattus norvegicus
gaagacataatcgaacgctcagttc

SEQ ID NO: 298431 - DNA, 25 bp, Rattus norvegicus
gaagacataatctctggtgccagtg

SEQ ID NO: 298432 - DNA, 25 bp, Rattus norvegicus
gaagacataccaagtagcctactac

SEQ ID NO: 298433 - DNA, 25 bp, Rattus norvegicus
gaagacataccatgtagcctactac

SEQ ID NO: 298434 - DNA, 25 bp, Rattus norvegicus
gaagacatacggctagttttggact

SEQ ID NO: 298435 - DNA, 25 bp, Rattus norvegicus
gaagacatacgggtagttttggact

SEQ ID NO: 298436 - DNA, 25 bp, Rattus norvegicus
gaagacatatctaaacttgcttgag

SEQ ID NO: 298437 - DNA, 25 bp, Rattus norvegicus
gaagacatatcttaacttgcttgag

SEQ ID NO: 298438 - DNA, 25 bp, Rattus norvegicus
gaagacatattcctgcgcatcacca

SEQ ID NO: 298439 - DNA, 25 bp, Rattus norvegicus
gaagacatattcgtgcgcatcacca

SEQ ID NO: 298440 - DNA, 25 bp, Rattus norvegicus
gaagacatccagaaccgtgtgataa

SEQ ID NO: 298441 - DNA, 25 bp, Rattus norvegicus
gaagacatccagtaccgtgtgataa

SEQ ID NO: 298442 - DNA, 25 bp, Rattus norvegicus
gaagacatcctcaggttctttgcca

SEQ ID NO: 298443 - DNA, 25 bp, Rattus norvegicus
gaagacatcctctggttctttgcca

SEQ ID NO: 298444 - DNA, 25 bp, Rattus norvegicus
gaagacatcctgcaatccatcaaca

SEQ ID NO: 298445 - DNA, 25 bp, Rattus norvegicus
gaagacatcctggaatccatcaaca

SEQ ID NO: 298446 - DNA, 25 bp, Rattus norvegicus
gaagacatcttcaacctggtgggca

SEQ ID NO: 298447 - DNA, 25 bp, Rattus norvegicus
gaagacatcttctacctggtgggca

SEQ ID NO: 298448 - DNA, 25 bp, Rattus norvegicus
gaagacatgaaacccacactgtgca

SEQ ID NO: 298449 - DNA, 25 bp, Rattus norvegicus
gaagacatgaaagccacactgtgca

SEQ ID NO: 298450 - DNA, 25 bp, Rattus norvegicus
gaagacatgataacaccctgcatcc

SEQ ID NO: 298451 - DNA, 25 bp, Rattus norvegicus
gaagacatgatatcaccctgcatcc

SEQ ID NO: 298452 - DNA, 25 bp, Rattus norvegicus
gaagacatgcatactccatcgatgt

SEQ ID NO: 298453 - DNA, 25 bp, Rattus norvegicus
gaagacatgcattctccatcgatgt

SEQ ID NO: 298454 - DNA, 25 bp, Rattus norvegicus
gaagacatgccaatactgctccaaa

SEQ ID NO: 298455 - DNA, 25 bp, Rattus norvegicus
gaagacatgccattactgctccaaa

SEQ ID NO: 298456 - DNA, 25 bp, Rattus norvegicus
gaagacatgcttattccttactgtt

SEQ ID NO: 298457 - DNA, 25 bp, Rattus norvegicus
gaagacatgctttttccttactgtt

SEQ ID NO: 298458 - DNA, 25 bp, Rattus norvegicus
gaagacatggacatccaggccactg

SEQ ID NO: 298459 - DNA, 25 bp, Rattus norvegicus
gaagacatggacttccaggccactg

SEQ ID NO: 298460 - DNA, 25 bp, Rattus norvegicus
gaagacatggtcacccagaaggctg

SEQ ID NO: 298461 - DNA, 25 bp, Rattus norvegicus
gaagacatggtctcccagaaggctg

SEQ ID NO: 298462 - DNA, 25 bp, Rattus norvegicus
gaagacatgtccagcagcaaccgca

SEQ ID NO: 298463 - DNA, 25 bp, Rattus norvegicus
gaagacatgtcctgcagcaaccgca

SEQ ID NO: 298464 - DNA, 25 bp, Rattus norvegicus
gaagacattagacccctgtctcatt

SEQ ID NO: 298465 - DNA, 25 bp, Rattus norvegicus
gaagacattagagccctgtctcatt

SEQ ID NO: 298466 - DNA, 25 bp, Rattus norvegicus
gaagacattattatccattatttgg

SEQ ID NO: 298467 - DNA, 25 bp, Rattus norvegicus
gaagacattattttccattatttgg

SEQ ID NO: 298468 - DNA, 25 bp, Rattus norvegicus
gaagacattcacatcctgttagctt

SEQ ID NO: 298469 - DNA, 25 bp, Rattus norvegicus
gaagacattcacttcctgttagctt

SEQ ID NO: 298470 - DNA, 25 bp, Rattus norvegicus
gaagacattcctaggatcgtagtca

SEQ ID NO: 298471 - DNA, 25 bp, Rattus norvegicus
gaagacattcctcggtgtttatccc

SEQ ID NO: 298472 - DNA, 25 bp, Rattus norvegicus
gaagacattcctgggtgtttatccc

SEQ ID NO: 298473 - DNA, 25 bp, Rattus norvegicus
gaagacattccttggatcgtagtca

SEQ ID NO: 298474 - DNA, 25 bp, Rattus norvegicus
gaagacattctgatcctggaagaaa

SEQ ID NO: 298475 - DNA, 25 bp, Rattus norvegicus
gaagacattctgttcctggaagaaa

SEQ ID NO: 298476 - DNA, 25 bp, Rattus norvegicus
gaagacattcttcttcctgtctcac

SEQ ID NO: 298477 - DNA, 25 bp, Rattus norvegicus
gaagacattcttgttcctgtctcac

SEQ ID NO: 298478 - DNA, 25 bp, Rattus norvegicus
gaagacattgctccatatatccaag

SEQ ID NO: 298479 - DNA, 25 bp, Rattus norvegicus
gaagacattgctgcatatatccaag

SEQ ID NO: 298480 - DNA, 25 bp, Rattus norvegicus
gaagacattggccagtcctagtcat

SEQ ID NO: 298481 - DNA, 25 bp, Rattus norvegicus
gaagacattggcgagtcctagtcat

SEQ ID NO: 298482 - DNA, 25 bp, Rattus norvegicus
gaagacattggtcgcagcctcctga

SEQ ID NO: 298483 - DNA, 25 bp, Rattus norvegicus
gaagacattggtggcagcctcctga

SEQ ID NO: 298484 - DNA, 25 bp, Rattus norvegicus
gaagacattgtcacatgcgagcatc

SEQ ID NO: 298485 - DNA, 25 bp, Rattus norvegicus
gaagacattgtctcatgcgagcatc

SEQ ID NO: 298486 - DNA, 25 bp, Rattus norvegicus
gaagacatttccagcagtttgccag

SEQ ID NO: 298487 - DNA, 25 bp, Rattus norvegicus
gaagacatttcccttgccgtctcca

SEQ ID NO: 298488 - DNA, 25 bp, Rattus norvegicus
gaagacatttccgttgccgtctcca

SEQ ID NO: 298489 - DNA, 25 bp, Rattus norvegicus
gaagacatttcctgcagtttgccag

SEQ ID NO: 298490 - DNA, 25 bp, Rattus norvegicus
gaagaccaacacactggctgcccag

SEQ ID NO: 298491 - DNA, 25 bp, Rattus norvegicus
gaagaccaacactctggctgcccag

SEQ ID NO: 298492 - DNA, 25 bp, Rattus norvegicus
gaagaccaacagagtgatccaacct

SEQ ID NO: 298493 - DNA, 25 bp, Rattus norvegicus
gaagaccaacagtgtgatccaacct

SEQ ID NO: 298494 - DNA, 25 bp, Rattus norvegicus
gaagaccaagaaccactatgcccca

SEQ ID NO: 298495 - DNA, 25 bp, Rattus norvegicus
gaagaccaagaagcactatgcccca

SEQ ID NO: 298496 - DNA, 25 bp, Rattus norvegicus
gaagaccaagcacaaaggccctgaa

SEQ ID NO: 298497 - DNA, 25 bp, Rattus norvegicus
gaagaccaagcagaaaggccctgaa

SEQ ID NO: 298498 - DNA, 25 bp, Rattus norvegicus
gaagaccaaggcatagcatatcaaa

SEQ ID NO: 298499 - DNA, 25 bp, Rattus norvegicus
gaagaccaaggcttagcatatcaaa

SEQ ID NO: 298500 - DNA, 25 bp, Rattus norvegicus
gaagaccaagtcagctacatatagt

SEQ ID NO: 298501 - DNA, 25 bp, Rattus norvegicus
gaagaccaagtctgctacatatagt

SEQ ID NO: 298502 - DNA, 25 bp, Rattus norvegicus
gaagaccaagtgagcccataagaaa

SEQ ID NO: 298503 - DNA, 25 bp, Rattus norvegicus
gaagaccaagtgtgcccataagaaa

SEQ ID NO: 298504 - DNA, 25 bp, Rattus norvegicus
gaagaccaatagcttccatgatggt

SEQ ID NO: 298505 - DNA, 25 bp, Rattus norvegicus
gaagaccaataggttccatgatggt

SEQ ID NO: 298506 - DNA, 25 bp, Rattus norvegicus
gaagaccacaggctaatttgcttac

SEQ ID NO: 298507 - DNA, 25 bp, Rattus norvegicus
gaagaccacagggtaatttgcttac

SEQ ID NO: 298508 - DNA, 25 bp, Rattus norvegicus
gaagaccacagtactcttgagaaac

SEQ ID NO: 298509 - DNA, 25 bp, Rattus norvegicus
gaagaccacagttctcttgagaaac

SEQ ID NO: 298510 - DNA, 25 bp, Rattus norvegicus
gaagaccacattacccaagtatctg

SEQ ID NO: 298511 - DNA, 25 bp, Rattus norvegicus
gaagaccacatttcccaagtatctg

SEQ ID NO: 298512 - DNA, 25 bp, Rattus norvegicus
gaagaccaccagaggctacgcagga

SEQ ID NO: 298513 - DNA, 25 bp, Rattus norvegicus
gaagaccaccagtggctacgcagga

SEQ ID NO: 298514 - DNA, 25 bp, Rattus norvegicus
gaagaccacccgcaaatggttatct

SEQ ID NO: 298515 - DNA, 25 bp, Rattus norvegicus
gaagaccacccggaaatggttatct

SEQ ID NO: 298516 - DNA, 25 bp, Rattus norvegicus
gaagaccacctgaaagttatcccta

SEQ ID NO: 298517 - DNA, 25 bp, Rattus norvegicus
gaagaccacctgtaagttatcccta

SEQ ID NO: 298518 - DNA, 25 bp, Rattus norvegicus
gaagaccacgaacgactgccaacag

SEQ ID NO: 298519 - DNA, 25 bp, Rattus norvegicus
gaagaccacgaaggactgccaacag

SEQ ID NO: 298520 - DNA, 25 bp, Rattus norvegicus
gaagaccacgaccaagaagccagac

SEQ ID NO: 298521 - DNA, 25 bp, Rattus norvegicus
gaagaccacgacgaagaagccagac

SEQ ID NO: 298522 - DNA, 25 bp, Rattus norvegicus
gaagaccactgaagaggacctctca

SEQ ID NO: 298523 - DNA, 25 bp, Rattus norvegicus
gaagaccactgatgaggacctctca

SEQ ID NO: 298524 - DNA, 25 bp, Rattus norvegicus
gaagaccacttgcagcaggtgctcg

SEQ ID NO: 298525 - DNA, 25 bp, Rattus norvegicus
gaagaccacttggagcaggtgctcg

SEQ ID NO: 298526 - DNA, 25 bp, Rattus norvegicus
gaagaccagaagagttacccatagt

SEQ ID NO: 298527 - DNA, 25 bp, Rattus norvegicus
gaagaccagaagtgttacccatagt

SEQ ID NO: 298528 - DNA, 25 bp, Rattus norvegicus
gaagaccagagtacccttgaattgt

SEQ ID NO: 298529 - DNA, 25 bp, Rattus norvegicus
gaagaccagagttcccttgaattgt

SEQ ID NO: 298530 - DNA, 25 bp, Rattus norvegicus
gaagaccagatcaattggcaggcat

SEQ ID NO: 298531 - DNA, 25 bp, Rattus norvegicus
gaagaccagatctattggcaggcat

SEQ ID NO: 298532 - DNA, 25 bp, Rattus norvegicus
gaagaccagcctctgatggaactga

SEQ ID NO: 298533 - DNA, 25 bp, Rattus norvegicus
gaagaccagcctgtgatggaactga

SEQ ID NO: 298534 - DNA, 25 bp, Rattus norvegicus
gaagaccagctgcaagccttcctga

SEQ ID NO: 298535 - DNA, 25 bp, Rattus norvegicus
gaagaccagctgcttgcatccctct

SEQ ID NO: 298536 - DNA, 25 bp, Rattus norvegicus
gaagaccagctggaagccttcctga

SEQ ID NO: 298537 - DNA, 25 bp, Rattus norvegicus
gaagaccagctggttgcatccctct

SEQ ID NO: 298538 - DNA, 25 bp, Rattus norvegicus
gaagaccaggaaagagacccctcaa

SEQ ID NO: 298539 - DNA, 25 bp, Rattus norvegicus
gaagaccaggaatgagacccctcaa

SEQ ID NO: 298540 - DNA, 25 bp, Rattus norvegicus
gaagaccaggcacgctgctctcaga

SEQ ID NO: 298541 - DNA, 25 bp, Rattus norvegicus
gaagaccaggcaggctgctctcaga

SEQ ID NO: 298542 - DNA, 25 bp, Rattus norvegicus
gaagaccagttcatccaggatccat

SEQ ID NO: 298543 - DNA, 25 bp, Rattus norvegicus
gaagaccagttcttccaggatccat

SEQ ID NO: 298544 - DNA, 25 bp, Rattus norvegicus
gaagaccataatctgctgattttag

SEQ ID NO: 298545 - DNA, 25 bp, Rattus norvegicus
gaagaccataatgtgctgattttag

SEQ ID NO: 298546 - DNA, 25 bp, Rattus norvegicus
gaagaccatcagaaggacccaccct

SEQ ID NO: 298547 - DNA, 25 bp, Rattus norvegicus
gaagaccatcagactctgtgcagag

SEQ ID NO: 298548 - DNA, 25 bp, Rattus norvegicus
gaagaccatcagtaggacccaccct

SEQ ID NO: 298549 - DNA, 25 bp, Rattus norvegicus
gaagaccatcagtctctgtgcagag

SEQ ID NO: 298550 - DNA, 25 bp, Rattus norvegicus
gaagaccatgatcggaggctcctag

SEQ ID NO: 298551 - DNA, 25 bp, Rattus norvegicus
gaagaccatgatgggaggctcctag

SEQ ID NO: 298552 - DNA, 25 bp, Rattus norvegicus
gaagaccattccaaccttgaagcgt

SEQ ID NO: 298553 - DNA, 25 bp, Rattus norvegicus
gaagaccattcctaccttgaagcgt

SEQ ID NO: 298554 - DNA, 25 bp, Rattus norvegicus
gaagaccattctagaaccctacagc

SEQ ID NO: 298555 - DNA, 25 bp, Rattus norvegicus
gaagaccattcttgaaccctacagc

SEQ ID NO: 298556 - DNA, 25 bp, Rattus norvegicus
gaagaccattttcctagtcctacac

SEQ ID NO: 298557 - DNA, 25 bp, Rattus norvegicus
gaagaccattttgctagtcctacac

SEQ ID NO: 298558 - DNA, 25 bp, Rattus norvegicus
gaagacccacagatttctgagcttt

SEQ ID NO: 298559 - DNA, 25 bp, Rattus norvegicus
gaagacccacagttttctgagcttt

SEQ ID NO: 298560 - DNA, 25 bp, Rattus norvegicus
gaagacccactgaagctgggcagga

SEQ ID NO: 298561 - DNA, 25 bp, Rattus norvegicus
gaagacccactgtagctgggcagga

SEQ ID NO: 298562 - DNA, 25 bp, Rattus norvegicus
gaagacccagatccatttttattta

SEQ ID NO: 298563 - DNA, 25 bp, Rattus norvegicus
gaagacccagatgcatttttattta

SEQ ID NO: 298564 - DNA, 25 bp, Rattus norvegicus
gaagacccagccctttcagttcaga

SEQ ID NO: 298565 - DNA, 25 bp, Rattus norvegicus
gaagacccagccgtttcagttcaga

SEQ ID NO: 298566 - DNA, 25 bp, Rattus norvegicus
gaagacccattcattgcaatccatg

SEQ ID NO: 298567 - DNA, 25 bp, Rattus norvegicus
gaagacccattctttgcaatccatg

SEQ ID NO: 298568 - DNA, 25 bp, Rattus norvegicus
gaagaccccgatctccggatgtgtc

SEQ ID NO: 298569 - DNA, 25 bp, Rattus norvegicus
gaagaccccgatgtccggatgtgtc

SEQ ID NO: 298570 - DNA, 25 bp, Rattus norvegicus
gaagaccccttgattctcaatacaa

SEQ ID NO: 298571 - DNA, 25 bp, Rattus norvegicus
gaagaccccttgtttctcaatacaa

SEQ ID NO: 298572 - DNA, 25 bp, Rattus norvegicus
gaagacccgactctgcgaagtattc

SEQ ID NO: 298573 - DNA, 25 bp, Rattus norvegicus
gaagacccgactgtgcgaagtattc

SEQ ID NO: 298574 - DNA, 25 bp, Rattus norvegicus
gaagacccgcctcgcaggaagcaca

SEQ ID NO: 298575 - DNA, 25 bp, Rattus norvegicus
gaagacccgcctggcaggaagcaca

SEQ ID NO: 298576 - DNA, 25 bp, Rattus norvegicus
gaagacccggccactcttgttgtga

SEQ ID NO: 298577 - DNA, 25 bp, Rattus norvegicus
gaagacccggcctctcttgttgtga

SEQ ID NO: 298578 - DNA, 25 bp, Rattus norvegicus
gaagacccggctaaaattgcaccca

SEQ ID NO: 298579 - DNA, 25 bp, Rattus norvegicus
gaagacccggcttaaattgcaccca

SEQ ID NO: 298580 - DNA, 25 bp, Rattus norvegicus
gaagacccgggacctgttccgtaat

SEQ ID NO: 298581 - DNA, 25 bp, Rattus norvegicus
gaagacccgggagctgttccgtaat

SEQ ID NO: 298582 - DNA, 25 bp, Rattus norvegicus
gaagacccgggcctacaatggacag

SEQ ID NO: 298583 - DNA, 25 bp, Rattus norvegicus
gaagacccgggcgtacaatggacag

SEQ ID NO: 298584 - DNA, 25 bp, Rattus norvegicus
gaagaccctcacacctgactgttga

SEQ ID NO: 298585 - DNA, 25 bp, Rattus norvegicus
gaagaccctcactcctgactgttga

SEQ ID NO: 298586 - DNA, 25 bp, Rattus norvegicus
gaagaccctccacgatactctgtgt

SEQ ID NO: 298587 - DNA, 25 bp, Rattus norvegicus
gaagaccctccaggatactctgtgt

SEQ ID NO: 298588 - DNA, 25 bp, Rattus norvegicus
gaagaccctcctcatgaaaagcaaa

SEQ ID NO: 298589 - DNA, 25 bp, Rattus norvegicus
gaagaccctcctgatgaaaagcaaa

SEQ ID NO: 298590 - DNA, 25 bp, Rattus norvegicus
gaagaccctctgcatacagctgcga

SEQ ID NO: 298591 - DNA, 25 bp, Rattus norvegicus
gaagaccctctggatacagctgcga

SEQ ID NO: 298592 - DNA, 25 bp, Rattus norvegicus
gaagaccctgaaacccgagtttaat

SEQ ID NO: 298593 - DNA, 25 bp, Rattus norvegicus
gaagaccctgaatcccgagtttaat

SEQ ID NO: 298594 - DNA, 25 bp, Rattus norvegicus
gaagaccctgagagctgctgaggct

SEQ ID NO: 298595 - DNA, 25 bp, Rattus norvegicus
gaagaccctgagtgctgctgaggct

SEQ ID NO: 298596 - DNA, 25 bp, Rattus norvegicus
gaagaccctgatcaatattcccctc

SEQ ID NO: 298597 - DNA, 25 bp, Rattus norvegicus
gaagaccctgatgaatattcccctc

SEQ ID NO: 298598 - DNA, 25 bp, Rattus norvegicus
gaagaccctgtgaaagtaaatcatg

SEQ ID NO: 298599 - DNA, 25 bp, Rattus norvegicus
gaagaccctgtgtaagtaaatcatg

SEQ ID NO: 298600 - DNA, 25 bp, Rattus norvegicus
gaagacccttacaggagcagccatt

SEQ ID NO: 298601 - DNA, 25 bp, Rattus norvegicus
gaagacccttactggagcagccatt

SEQ ID NO: 298602 - DNA, 25 bp, Rattus norvegicus
gaagacccttctactttagttactg

SEQ ID NO: 298603 - DNA, 25 bp, Rattus norvegicus
gaagacccttctagtgtgatgagat

SEQ ID NO: 298604 - DNA, 25 bp, Rattus norvegicus
gaagacccttcttctttagttactg

SEQ ID NO: 298605 - DNA, 25 bp, Rattus norvegicus
gaagacccttcttgtgtgatgagat

SEQ ID NO: 298606 - DNA, 25 bp, Rattus norvegicus
gaagaccgcagtatggagtctctag

SEQ ID NO: 298607 - DNA, 25 bp, Rattus norvegicus
gaagaccgcagtttggagtctctag

SEQ ID NO: 298608 - DNA, 25 bp, Rattus norvegicus
gaagaccgccatatctcaggagttt

SEQ ID NO: 298609 - DNA, 25 bp, Rattus norvegicus
gaagaccgccatttctcaggagttt

SEQ ID NO: 298610 - DNA, 25 bp, Rattus norvegicus
gaagaccgcgtgctatgacattgat

SEQ ID NO: 298611 - DNA, 25 bp, Rattus norvegicus
gaagaccgcgtggtatgacattgat

SEQ ID NO: 298612 - DNA, 25 bp, Rattus norvegicus
gaagaccggaatagctgctgttcga

SEQ ID NO: 298613 - DNA, 25 bp, Rattus norvegicus
gaagaccggaattgctgctgttcga

SEQ ID NO: 298614 - DNA, 25 bp, Rattus norvegicus
gaagaccgggttcgctcatacagcg

SEQ ID NO: 298615 - DNA, 25 bp, Rattus norvegicus
gaagaccgggttggctcatacagcg

SEQ ID NO: 298616 - DNA, 25 bp, Rattus norvegicus
gaagaccggtctctgaagctttatg

SEQ ID NO: 298617 - DNA, 25 bp, Rattus norvegicus
gaagaccggtctgtgaagctttatg

SEQ ID NO: 298618 - DNA, 25 bp, Rattus norvegicus
gaagaccgtcagctggcttagacct

SEQ ID NO: 298619 - DNA, 25 bp, Rattus norvegicus
gaagaccgtcaggtggcttagacct

SEQ ID NO: 298620 - DNA, 25 bp, Rattus norvegicus
gaagaccgtggaccacctggaggca

SEQ ID NO: 298621 - DNA, 25 bp, Rattus norvegicus
gaagaccgtggagcacctggaggca

SEQ ID NO: 298622 - DNA, 25 bp, Rattus norvegicus
gaagaccgttctatttccagtaatg

SEQ ID NO: 298623 - DNA, 25 bp, Rattus norvegicus
gaagaccgttctttttccagtaatg

SEQ ID NO: 298624 - DNA, 25 bp, Rattus norvegicus
gaagacctaagtaggtattcagcaa

SEQ ID NO: 298625 - DNA, 25 bp, Rattus norvegicus
gaagacctaagttggtattcagcaa

SEQ ID NO: 298626 - DNA, 25 bp, Rattus norvegicus
gaagacctacaacggtcctgcttat

SEQ ID NO: 298627 - DNA, 25 bp, Rattus norvegicus
gaagacctacaagggtcctgcttat

SEQ ID NO: 298628 - DNA, 25 bp, Rattus norvegicus
gaagacctacatcattgtgttcaca

SEQ ID NO: 298629 - DNA, 25 bp, Rattus norvegicus
gaagacctacatgattgtgttcaca

SEQ ID NO: 298630 - DNA, 25 bp, Rattus norvegicus
gaagacctacttagtcaagcagatc

SEQ ID NO: 298631 - DNA, 25 bp, Rattus norvegicus
gaagacctacttctagcaccagcat

SEQ ID NO: 298632 - DNA, 25 bp, Rattus norvegicus
gaagacctacttgtagcaccagcat

SEQ ID NO: 298633 - DNA, 25 bp, Rattus norvegicus
gaagacctactttgtcaagcagatc

SEQ ID NO: 298634 - DNA, 25 bp, Rattus norvegicus
gaagacctcactatgataacatgct

SEQ ID NO: 298635 - DNA, 25 bp, Rattus norvegicus
gaagacctcactttgataacatgct

SEQ ID NO: 298636 - DNA, 25 bp, Rattus norvegicus
gaagacctcagacactcaaggcaag

SEQ ID NO: 298637 - DNA, 25 bp, Rattus norvegicus
gaagacctcagagactcaaggcaag

SEQ ID NO: 298638 - DNA, 25 bp, Rattus norvegicus
gaagacctcagtaatttgtgactat

SEQ ID NO: 298639 - DNA, 25 bp, Rattus norvegicus
gaagacctcagtaccccgagtaaga

SEQ ID NO: 298640 - DNA, 25 bp, Rattus norvegicus
gaagacctcagtcttgatctcctga

SEQ ID NO: 298641 - DNA, 25 bp, Rattus norvegicus
gaagacctcagtgttgatctcctga

SEQ ID NO: 298642 - DNA, 25 bp, Rattus norvegicus
gaagacctcagttatttgtgactat

SEQ ID NO: 298643 - DNA, 25 bp, Rattus norvegicus
gaagacctcagttccccgagtaaga

SEQ ID NO: 298644 - DNA, 25 bp, Rattus norvegicus
gaagacctctctcatgtaactgatg

SEQ ID NO: 298645 - DNA, 25 bp, Rattus norvegicus
gaagacctctctgatgtaactgatg

SEQ ID NO: 298646 - DNA, 25 bp, Rattus norvegicus
gaagacctgaatcaagaagcttgca

SEQ ID NO: 298647 - DNA, 25 bp, Rattus norvegicus
gaagacctgaatgaagaagcttgca

SEQ ID NO: 298648 - DNA, 25 bp, Rattus norvegicus
gaagacctgaggagacagccctctc

SEQ ID NO: 298649 - DNA, 25 bp, Rattus norvegicus
gaagacctgaggtgacagccctctc

SEQ ID NO: 298650 - DNA, 25 bp, Rattus norvegicus
gaagacctgagtacctttgtcaaaa

SEQ ID NO: 298651 - DNA, 25 bp, Rattus norvegicus
gaagacctgagttcctttgtcaaaa

SEQ ID NO: 298652 - DNA, 25 bp, Rattus norvegicus
gaagacctgccaactcaggataaaa

SEQ ID NO: 298653 - DNA, 25 bp, Rattus norvegicus
gaagacctgccatctcaggataaaa

SEQ ID NO: 298654 - DNA, 25 bp, Rattus norvegicus
gaagacctgcttcgtgccctgtcca

SEQ ID NO: 298655 - DNA, 25 bp, Rattus norvegicus
gaagacctgcttggtgccctgtcca

SEQ ID NO: 298656 - DNA, 25 bp, Rattus norvegicus
gaagacctggacacgttggaatctg

SEQ ID NO: 298657 - DNA, 25 bp, Rattus norvegicus
gaagacctggacagtagcagccagc

SEQ ID NO: 298658 - DNA, 25 bp, Rattus norvegicus
gaagacctggactcgttggaatctg

SEQ ID NO: 298659 - DNA, 25 bp, Rattus norvegicus
gaagacctggactgtagcagccagc

SEQ ID NO: 298660 - DNA, 25 bp, Rattus norvegicus
gaagacctgtgcactagctgggaaa

SEQ ID NO: 298661 - DNA, 25 bp, Rattus norvegicus
gaagacctgtgctctagctgggaaa

SEQ ID NO: 298662 - DNA, 25 bp, Rattus norvegicus
gaagacctgtgtaaggattctcaga

SEQ ID NO: 298663 - DNA, 25 bp, Rattus norvegicus
gaagacctgtgttaggattctcaga

SEQ ID NO: 298664 - DNA, 25 bp, Rattus norvegicus
gaagacctgttgagctcatgcagac

SEQ ID NO: 298665 - DNA, 25 bp, Rattus norvegicus
gaagacctgttgtgctcatgcagac

SEQ ID NO: 298666 - DNA, 25 bp, Rattus norvegicus
gaagaccttcatcgctagggagtga

SEQ ID NO: 298667 - DNA, 25 bp, Rattus norvegicus
gaagaccttcatggctagggagtga

SEQ ID NO: 298668 - DNA, 25 bp, Rattus norvegicus
gaagaccttcgtatttctcaagatg

SEQ ID NO: 298669 - DNA, 25 bp, Rattus norvegicus
gaagaccttcgtttttctcaagatg

SEQ ID NO: 298670 - DNA, 25 bp, Rattus norvegicus
gaagaccttctcataagtacaggaa

SEQ ID NO: 298671 - DNA, 25 bp, Rattus norvegicus
gaagaccttctcttaagtacaggaa

SEQ ID NO: 298672 - DNA, 25 bp, Rattus norvegicus
gaagaccttctgaaagtgtccatca

SEQ ID NO: 298673 - DNA, 25 bp, Rattus norvegicus
gaagaccttctgagatcaatcatca

SEQ ID NO: 298674 - DNA, 25 bp, Rattus norvegicus
gaagaccttctgtaagtgtccatca

SEQ ID NO: 298675 - DNA, 25 bp, Rattus norvegicus
gaagaccttctgtgatcaatcatca

SEQ ID NO: 298676 - DNA, 25 bp, Rattus norvegicus
gaagaccttgaacaagccaatccat

SEQ ID NO: 298677 - DNA, 25 bp, Rattus norvegicus
gaagaccttgaacacaaacctggga

SEQ ID NO: 298678 - DNA, 25 bp, Rattus norvegicus
gaagaccttgaagaagccaatccat

SEQ ID NO: 298679 - DNA, 25 bp, Rattus norvegicus
gaagaccttgaagacaaacctggga

SEQ ID NO: 298680 - DNA, 25 bp, Rattus norvegicus
gaagaccttgcaaagccctgtacca

SEQ ID NO: 298681 - DNA, 25 bp, Rattus norvegicus
gaagaccttgcatagccctgtacca

SEQ ID NO: 298682 - DNA, 25 bp, Rattus norvegicus
gaagaccttggacaatcccacagaa

SEQ ID NO: 298683 - DNA, 25 bp, Rattus norvegicus
gaagaccttggactgtttccaaaag

SEQ ID NO: 298684 - DNA, 25 bp, Rattus norvegicus
gaagaccttggagaatcccacagaa

SEQ ID NO: 298685 - DNA, 25 bp, Rattus norvegicus
gaagaccttggagtgtttccaaaag

SEQ ID NO: 298686 - DNA, 25 bp, Rattus norvegicus
gaagacctttacactatgggtgacc

SEQ ID NO: 298687 - DNA, 25 bp, Rattus norvegicus
gaagacctttactctatgggtgacc

SEQ ID NO: 298688 - DNA, 25 bp, Rattus norvegicus
gaagacctttggactcatattatta

SEQ ID NO: 298689 - DNA, 25 bp, Rattus norvegicus
gaagacctttggatgctggaagact

SEQ ID NO: 298690 - DNA, 25 bp, Rattus norvegicus
gaagacctttggtctcatattatta

SEQ ID NO: 298691 - DNA, 25 bp, Rattus norvegicus
gaagacctttggttgctggaagact

SEQ ID NO: 298692 - DNA, 25 bp, Rattus norvegicus
gaagacctttttctgcactatatgc

SEQ ID NO: 298693 - DNA, 25 bp, Rattus norvegicus
gaagacctttttgtgcactatatgc

SEQ ID NO: 298694 - DNA, 25 bp, Rattus norvegicus
gaagacgaacagcatctgcatgtaa

SEQ ID NO: 298695 - DNA, 25 bp, Rattus norvegicus
gaagacgaacaggatctgcatgtaa

SEQ ID NO: 298696 - DNA, 25 bp, Rattus norvegicus
gaagacgacacacctgggaccagga

SEQ ID NO: 298697 - DNA, 25 bp, Rattus norvegicus
gaagacgacacagctgggaccagga

SEQ ID NO: 298698 - DNA, 25 bp, Rattus norvegicus
gaagacgaccgtcttttcttgcacc

SEQ ID NO: 298699 - DNA, 25 bp, Rattus norvegicus
gaagacgaccgtgttttcttgcacc

SEQ ID NO: 298700 - DNA, 25 bp, Rattus norvegicus
gaagacgaccttctgcttgagctct

SEQ ID NO: 298701 - DNA, 25 bp, Rattus norvegicus
gaagacgaccttgtgcttgagctct

SEQ ID NO: 298702 - DNA, 25 bp, Rattus norvegicus
gaagacgagcccactgaaacagaga

SEQ ID NO: 298703 - DNA, 25 bp, Rattus norvegicus
gaagacgagccctctgaaacagaga

SEQ ID NO: 298704 - DNA, 25 bp, Rattus norvegicus
gaagacgatcttcccctgtcaggag

SEQ ID NO: 298705 - DNA, 25 bp, Rattus norvegicus
gaagacgatcttgccctgtcaggag

SEQ ID NO: 298706 - DNA, 25 bp, Rattus norvegicus
gaagacgatgatcagggcccaccag

SEQ ID NO: 298707 - DNA, 25 bp, Rattus norvegicus
gaagacgatgatgagggcccaccag

SEQ ID NO: 298708 - DNA, 25 bp, Rattus norvegicus
gaagacgcagagagcagtgacccca

SEQ ID NO: 298709 - DNA, 25 bp, Rattus norvegicus
gaagacgcagagtgcagtgacccca

SEQ ID NO: 298710 - DNA, 25 bp, Rattus norvegicus
gaagacgcaggccagacgaccagct

SEQ ID NO: 298711 - DNA, 25 bp, Rattus norvegicus
gaagacgcaggcgagacgaccagct

SEQ ID NO: 298712 - DNA, 25 bp, Rattus norvegicus
gaagacgcaggtaccaggcacgcat

SEQ ID NO: 298713 - DNA, 25 bp, Rattus norvegicus
gaagacgcaggttccaggcacgcat

SEQ ID NO: 298714 - DNA, 25 bp, Rattus norvegicus
gaagacgcatttaccgggtgaatca

SEQ ID NO: 298715 - DNA, 25 bp, Rattus norvegicus
gaagacgcattttccgggtgaatca

SEQ ID NO: 298716 - DNA, 25 bp, Rattus norvegicus
gaagacgccaacatacggctgtgcc

SEQ ID NO: 298717 - DNA, 25 bp, Rattus norvegicus
gaagacgccaacttacggctgtgcc

SEQ ID NO: 298718 - DNA, 25 bp, Rattus norvegicus
gaagacgccacccagtgagatgttc

SEQ ID NO: 298719 - DNA, 25 bp, Rattus norvegicus
gaagacgccaccgagtgagatgttc

SEQ ID NO: 298720 - DNA, 25 bp, Rattus norvegicus
gaagacgccagcactgactatgcct

SEQ ID NO: 298721 - DNA, 25 bp, Rattus norvegicus
gaagacgccagctctgactatgcct

SEQ ID NO: 298722 - DNA, 25 bp, Rattus norvegicus
gaagacgcccagatgctgaaagaga

SEQ ID NO: 298723 - DNA, 25 bp, Rattus norvegicus
gaagacgcccagttgctgaaagaga

SEQ ID NO: 298724 - DNA, 25 bp, Rattus norvegicus
gaagacgccttaatcagggacaagt

SEQ ID NO: 298725 - DNA, 25 bp, Rattus norvegicus
gaagacgccttattcagggacaagt

SEQ ID NO: 298726 - DNA, 25 bp, Rattus norvegicus
gaagacgccttcaacagctgggaga

SEQ ID NO: 298727 - DNA, 25 bp, Rattus norvegicus
gaagacgccttctacagctgggaga

SEQ ID NO: 298728 - DNA, 25 bp, Rattus norvegicus
gaagacgcgcaccagttggtcacaa

SEQ ID NO: 298729 - DNA, 25 bp, Rattus norvegicus
gaagacgcgcacgagttggtcacaa

SEQ ID NO: 298730 - DNA, 25 bp, Rattus norvegicus
gaagacgctcagatcctgaaggtta

SEQ ID NO: 298731 - DNA, 25 bp, Rattus norvegicus
gaagacgctcagttcctgaaggtta

SEQ ID NO: 298732 - DNA, 25 bp, Rattus norvegicus
gaagacgctgaacccggaatttaat

SEQ ID NO: 298733 - DNA, 25 bp, Rattus norvegicus
gaagacgctgaagccggaatttaat

SEQ ID NO: 298734 - DNA, 25 bp, Rattus norvegicus
gaagacgctgcaaaagatcatcgaa

SEQ ID NO: 298735 - DNA, 25 bp, Rattus norvegicus
gaagacgctgcataagatcatcgaa

SEQ ID NO: 298736 - DNA, 25 bp, Rattus norvegicus
gaagacgctgttctccacttagcta

SEQ ID NO: 298737 - DNA, 25 bp, Rattus norvegicus
gaagacgctgttctggcagttcctc

SEQ ID NO: 298738 - DNA, 25 bp, Rattus norvegicus
gaagacgctgttgtccacttagcta

SEQ ID NO: 298739 - DNA, 25 bp, Rattus norvegicus
gaagacgctgttgtggcagttcctc

SEQ ID NO: 298740 - DNA, 25 bp, Rattus norvegicus
gaagacggaaagacctggagcgcct

SEQ ID NO: 298741 - DNA, 25 bp, Rattus norvegicus
gaagacggaaagtcctggagcgcct

SEQ ID NO: 298742 - DNA, 25 bp, Rattus norvegicus
gaagacggaacaaatcccgctcaag

SEQ ID NO: 298743 - DNA, 25 bp, Rattus norvegicus
gaagacggaacatatcccgctcaag

SEQ ID NO: 298744 - DNA, 25 bp, Rattus norvegicus
gaagacgggactcacttcagtgccc

SEQ ID NO: 298745 - DNA, 25 bp, Rattus norvegicus
gaagacgggactgacttcagtgccc

SEQ ID NO: 298746 - DNA, 25 bp, Rattus norvegicus
gaagacgggtgcatttcccatgtct

SEQ ID NO: 298747 - DNA, 25 bp, Rattus norvegicus
gaagacgggtgcttttcccatgtct

SEQ ID NO: 298748 - DNA, 25 bp, Rattus norvegicus
gaagacggtcaacttctcgctccac

SEQ ID NO: 298749 - DNA, 25 bp, Rattus norvegicus
gaagacggtcaagttctcgctccac

SEQ ID NO: 298750 - DNA, 25 bp, Rattus norvegicus
gaagacggtgctcgtatccactgcc

SEQ ID NO: 298751 - DNA, 25 bp, Rattus norvegicus
gaagacggtgctggtatccactgcc

SEQ ID NO: 298752 - DNA, 25 bp, Rattus norvegicus
gaagacgtactcacacactcaggac

SEQ ID NO: 298753 - DNA, 25 bp, Rattus norvegicus
gaagacgtactctcacactcaggac

SEQ ID NO: 298754 - DNA, 25 bp, Rattus norvegicus
gaagacgtctgtagccttaagggaa

SEQ ID NO: 298755 - DNA, 25 bp, Rattus norvegicus
gaagacgtctgttgccttaagggaa

SEQ ID NO: 298756 - DNA, 25 bp, Rattus norvegicus
gaagacgtgccaattccacagaatg

SEQ ID NO: 298757 - DNA, 25 bp, Rattus norvegicus
gaagacgtgccatttccacagaatg

SEQ ID NO: 298758 - DNA, 25 bp, Rattus norvegicus
gaagacgtgtcacaatgtccttggg

SEQ ID NO: 298759 - DNA, 25 bp, Rattus norvegicus
gaagacgtgtcagaatgtccttggg

SEQ ID NO: 298760 - DNA, 25 bp, Rattus norvegicus
gaagacgtgtccagttgggactctc

SEQ ID NO: 298761 - DNA, 25 bp, Rattus norvegicus
gaagacgtgtcctgttgggactctc

SEQ ID NO: 298762 - DNA, 25 bp, Rattus norvegicus
gaagacgtgttcaggcgcattgcat

SEQ ID NO: 298763 - DNA, 25 bp, Rattus norvegicus
gaagacgtgttctggcgcattgcat

SEQ ID NO: 298764 - DNA, 25 bp, Rattus norvegicus
gaagacgttcgtaatgggttcctgt

SEQ ID NO: 298765 - DNA, 25 bp, Rattus norvegicus
gaagacgttcgttatgggttcctgt

SEQ ID NO: 298766 - DNA, 25 bp, Rattus norvegicus
gaagactaaaacacatggccttgga

SEQ ID NO: 298767 - DNA, 25 bp, Rattus norvegicus
gaagactaaaactcatggccttgga

SEQ ID NO: 298768 - DNA, 25 bp, Rattus norvegicus
gaagactacgtgcagatgaaggaac

SEQ ID NO: 298769 - DNA, 25 bp, Rattus norvegicus
gaagactacgtggagatgaaggaac

SEQ ID NO: 298770 - DNA, 25 bp, Rattus norvegicus
gaagactactttccagggaccgggt

SEQ ID NO: 298771 - DNA, 25 bp, Rattus norvegicus
gaagactactttgcagggaccgggt

SEQ ID NO: 298772 - DNA, 25 bp, Rattus norvegicus
gaagactagaacactttcctggaag

SEQ ID NO: 298773 - DNA, 25 bp, Rattus norvegicus
gaagactagaactctttcctggaag

SEQ ID NO: 298774 - DNA, 25 bp, Rattus norvegicus
gaagactatcgtacaagctatgatt

SEQ ID NO: 298775 - DNA, 25 bp, Rattus norvegicus
gaagactatcgttcaagctatgatt

SEQ ID NO: 298776 - DNA, 25 bp, Rattus norvegicus
gaagactatctcagaaatcctctga

SEQ ID NO: 298777 - DNA, 25 bp, Rattus norvegicus
gaagactatctctgaaatcctctga

SEQ ID NO: 298778 - DNA, 25 bp, Rattus norvegicus
gaagactatgacatttgggctccct

SEQ ID NO: 298779 - DNA, 25 bp, Rattus norvegicus
gaagactatgacttttgggctccct

SEQ ID NO: 298780 - DNA, 25 bp, Rattus norvegicus
gaagactatgatcggcttttttcag

SEQ ID NO: 298781 - DNA, 25 bp, Rattus norvegicus
gaagactatgatgggcttttttcag

SEQ ID NO: 298782 - DNA, 25 bp, Rattus norvegicus
gaagactatgcaactatggcctttg

SEQ ID NO: 298783 - DNA, 25 bp, Rattus norvegicus
gaagactatgcatctatggcctttg

SEQ ID NO: 298784 - DNA, 25 bp, Rattus norvegicus
gaagactcaactcatatcatctgtg

SEQ ID NO: 298785 - DNA, 25 bp, Rattus norvegicus
gaagactcaactgatatcatctgtg

SEQ ID NO: 298786 - DNA, 25 bp, Rattus norvegicus
gaagactcacgcaccggagagggat

SEQ ID NO: 298787 - DNA, 25 bp, Rattus norvegicus
gaagactcacgcattaaagggtttg

SEQ ID NO: 298788 - DNA, 25 bp, Rattus norvegicus
gaagactcacgctccggagagggat

SEQ ID NO: 298789 - DNA, 25 bp, Rattus norvegicus
gaagactcacgctttaaagggtttg

SEQ ID NO: 298790 - DNA, 25 bp, Rattus norvegicus
gaagactcaggtactgtcattctca

SEQ ID NO: 298791 - DNA, 25 bp, Rattus norvegicus
gaagactcaggttctgtcattctca

SEQ ID NO: 298792 - DNA, 25 bp, Rattus norvegicus
gaagactcatcaatggactccattg

SEQ ID NO: 298793 - DNA, 25 bp, Rattus norvegicus
gaagactcatcattggactccattg

SEQ ID NO: 298794 - DNA, 25 bp, Rattus norvegicus
gaagactcatctactcaactcttag

SEQ ID NO: 298795 - DNA, 25 bp, Rattus norvegicus
gaagactcatcttctcaactcttag

SEQ ID NO: 298796 - DNA, 25 bp, Rattus norvegicus
gaagactccaagaagccgaactgct

SEQ ID NO: 298797 - DNA, 25 bp, Rattus norvegicus
gaagactccaagtagccgaactgct

SEQ ID NO: 298798 - DNA, 25 bp, Rattus norvegicus
gaagactccagacacctaagtggta

SEQ ID NO: 298799 - DNA, 25 bp, Rattus norvegicus
gaagactccagagacctaagtggta

SEQ ID NO: 298800 - DNA, 25 bp, Rattus norvegicus
gaagactccattcacaggccaagtt

SEQ ID NO: 298801 - DNA, 25 bp, Rattus norvegicus
gaagactccattgacaggccaagtt

SEQ ID NO: 298802 - DNA, 25 bp, Rattus norvegicus
gaagactccctaccaactgaataca

SEQ ID NO: 298803 - DNA, 25 bp, Rattus norvegicus
gaagactccctagcaactgaataca

SEQ ID NO: 298804 - DNA, 25 bp, Rattus norvegicus
gaagactccctcaggcaagaactgt

SEQ ID NO: 298805 - DNA, 25 bp, Rattus norvegicus
gaagactccctctggcaagaactgt

SEQ ID NO: 298806 - DNA, 25 bp, Rattus norvegicus
gaagactccgacactcattgtatat

SEQ ID NO: 298807 - DNA, 25 bp, Rattus norvegicus
gaagactccgactctcattgtatat

SEQ ID NO: 298808 - DNA, 25 bp, Rattus norvegicus
gaagactccgatcccatggattgga

SEQ ID NO: 298809 - DNA, 25 bp, Rattus norvegicus
gaagactccgatgccatggattgga

SEQ ID NO: 298810 - DNA, 25 bp, Rattus norvegicus
gaagactcgatcctccatagtgatg

SEQ ID NO: 298811 - DNA, 25 bp, Rattus norvegicus
gaagactcgatcgtccatagtgatg

SEQ ID NO: 298812 - DNA, 25 bp, Rattus norvegicus
gaagactctagaaggcgaacttgat

SEQ ID NO: 298813 - DNA, 25 bp, Rattus norvegicus
gaagactctagatggcgaacttgat

SEQ ID NO: 298814 - DNA, 25 bp, Rattus norvegicus
gaagactctagcaagagctaaacca

SEQ ID NO: 298815 - DNA, 25 bp, Rattus norvegicus
gaagactctagctagagctaaacca

SEQ ID NO: 298816 - DNA, 25 bp, Rattus norvegicus
gaagactctagtaactgctccagca

SEQ ID NO: 298817 - DNA, 25 bp, Rattus norvegicus
gaagactctagttactgctccagca

SEQ ID NO: 298818 - DNA, 25 bp, Rattus norvegicus
gaagactctataccccagtgtaggg

SEQ ID NO: 298819 - DNA, 25 bp, Rattus norvegicus
gaagactctatagcccagtgtaggg

SEQ ID NO: 298820 - DNA, 25 bp, Rattus norvegicus
gaagactctcacaaacgtcaagttg

SEQ ID NO: 298821 - DNA, 25 bp, Rattus norvegicus
gaagactctcactaacgtcaagttg

SEQ ID NO: 298822 - DNA, 25 bp, Rattus norvegicus
gaagactctctacatgctgggcaat

SEQ ID NO: 298823 - DNA, 25 bp, Rattus norvegicus
gaagactctctagatgctgggcaat

SEQ ID NO: 298824 - DNA, 25 bp, Rattus norvegicus
gaagactctcttcctgatgatctgt

SEQ ID NO: 298825 - DNA, 25 bp, Rattus norvegicus
gaagactctcttcggtgtctttctt

SEQ ID NO: 298826 - DNA, 25 bp, Rattus norvegicus
gaagactctcttgctgatgatctgt

SEQ ID NO: 298827 - DNA, 25 bp, Rattus norvegicus
gaagactctcttgggtgtctttctt

SEQ ID NO: 298828 - DNA, 25 bp, Rattus norvegicus
gaagactctgaacaattccgggatg

SEQ ID NO: 298829 - DNA, 25 bp, Rattus norvegicus
gaagactctgaagaattccgggatg

SEQ ID NO: 298830 - DNA, 25 bp, Rattus norvegicus
gaagactctgacactgagagaccaa

SEQ ID NO: 298831 - DNA, 25 bp, Rattus norvegicus
gaagactctgactctgagagaccaa

SEQ ID NO: 298832 - DNA, 25 bp, Rattus norvegicus
gaagactctgtcaggcaactgtgtc

SEQ ID NO: 298833 - DNA, 25 bp, Rattus norvegicus
gaagactctgtctggcaactgtgtc

SEQ ID NO: 298834 - DNA, 25 bp, Rattus norvegicus
gaagactcttcccatcgatggccct

SEQ ID NO: 298835 - DNA, 25 bp, Rattus norvegicus
gaagactcttccgatcgatggccct

SEQ ID NO: 298836 - DNA, 25 bp, Rattus norvegicus
gaagactgaaatcctcatacatgtt

SEQ ID NO: 298837 - DNA, 25 bp, Rattus norvegicus
gaagactgaaatgctcatacatgtt

SEQ ID NO: 298838 - DNA, 25 bp, Rattus norvegicus
gaagactgaagaatgcctgccagga

SEQ ID NO: 298839 - DNA, 25 bp, Rattus norvegicus
gaagactgaagattgcctgccagga

SEQ ID NO: 298840 - DNA, 25 bp, Rattus norvegicus
gaagactgacacatggaccattgcc

SEQ ID NO: 298841 - DNA, 25 bp, Rattus norvegicus
gaagactgacacttggaccattgcc

SEQ ID NO: 298842 - DNA, 25 bp, Rattus norvegicus
gaagactgacagacgaggcgagcta

SEQ ID NO: 298843 - DNA, 25 bp, Rattus norvegicus
gaagactgacagtcgaggcgagcta

SEQ ID NO: 298844 - DNA, 25 bp, Rattus norvegicus
gaagactgaccaaaggccagggcag

SEQ ID NO: 298845 - DNA, 25 bp, Rattus norvegicus
gaagactgaccacccaagtcaaggg

SEQ ID NO: 298846 - DNA, 25 bp, Rattus norvegicus
gaagactgaccagccaagtcaaggg

SEQ ID NO: 298847 - DNA, 25 bp, Rattus norvegicus
gaagactgaccataggccagggcag

SEQ ID NO: 298848 - DNA, 25 bp, Rattus norvegicus
gaagactgacctaatcggtctcgtt

SEQ ID NO: 298849 - DNA, 25 bp, Rattus norvegicus
gaagactgacctcctattaggcaca

SEQ ID NO: 298850 - DNA, 25 bp, Rattus norvegicus
gaagactgacctctgtggctcccga

SEQ ID NO: 298851 - DNA, 25 bp, Rattus norvegicus
gaagactgacctgctattaggcaca

SEQ ID NO: 298852 - DNA, 25 bp, Rattus norvegicus
gaagactgacctgtgtggctcccga

SEQ ID NO: 298853 - DNA, 25 bp, Rattus norvegicus
gaagactgaccttatcggtctcgtt

SEQ ID NO: 298854 - DNA, 25 bp, Rattus norvegicus
gaagactgatgacgatgactagaca

SEQ ID NO: 298855 - DNA, 25 bp, Rattus norvegicus
gaagactgatgaggatgactagaca

SEQ ID NO: 298856 - DNA, 25 bp, Rattus norvegicus
gaagactgcagaactgggtcctgga

SEQ ID NO: 298857 - DNA, 25 bp, Rattus norvegicus
gaagactgcagatctgggtcctgga

SEQ ID NO: 298858 - DNA, 25 bp, Rattus norvegicus
gaagactgcagtagtcaggagataa

SEQ ID NO: 298859 - DNA, 25 bp, Rattus norvegicus
gaagactgcagttgtcaggagataa

SEQ ID NO: 298860 - DNA, 25 bp, Rattus norvegicus
gaagactgccagagagctggacttt

SEQ ID NO: 298861 - DNA, 25 bp, Rattus norvegicus
gaagactgccagtgagctggacttt

SEQ ID NO: 298862 - DNA, 25 bp, Rattus norvegicus
gaagactgcctgatcattttttaaa

SEQ ID NO: 298863 - DNA, 25 bp, Rattus norvegicus
gaagactgcctgttcattttttaaa

SEQ ID NO: 298864 - DNA, 25 bp, Rattus norvegicus
gaagactgccttagcacggttttgt

SEQ ID NO: 298865 - DNA, 25 bp, Rattus norvegicus
gaagactgcctttgcacggttttgt

SEQ ID NO: 298866 - DNA, 25 bp, Rattus norvegicus
gaagactgcgatattcagaggcata

SEQ ID NO: 298867 - DNA, 25 bp, Rattus norvegicus
gaagactgcgattttcagaggcata

SEQ ID NO: 298868 - DNA, 25 bp, Rattus norvegicus
gaagactgcgcaatagaaccctggg

SEQ ID NO: 298869 - DNA, 25 bp, Rattus norvegicus
gaagactgcgcattagaaccctggg

SEQ ID NO: 298870 - DNA, 25 bp, Rattus norvegicus
gaagactgcgttctgatcatttggc

SEQ ID NO: 298871 - DNA, 25 bp, Rattus norvegicus
gaagactgcgttgtgatcatttggc

SEQ ID NO: 298872 - DNA, 25 bp, Rattus norvegicus
gaagactgctgaagtccatcttaga

SEQ ID NO: 298873 - DNA, 25 bp, Rattus norvegicus
gaagactgctgatgtccatcttaga

SEQ ID NO: 298874 - DNA, 25 bp, Rattus norvegicus
gaagactgcttgatcttggaaccca

SEQ ID NO: 298875 - DNA, 25 bp, Rattus norvegicus
gaagactgcttgttcttggaaccca

SEQ ID NO: 298876 - DNA, 25 bp, Rattus norvegicus
gaagactgggtaatctctgctggcc

SEQ ID NO: 298877 - DNA, 25 bp, Rattus norvegicus
gaagactgggtattctctgctggcc

SEQ ID NO: 298878 - DNA, 25 bp, Rattus norvegicus
gaagactgggttctagcactaggaa

SEQ ID NO: 298879 - DNA, 25 bp, Rattus norvegicus
gaagactgggttgtagcactaggaa

SEQ ID NO: 298880 - DNA, 25 bp, Rattus norvegicus
gaagactggtgcctgtcaagcttta

SEQ ID NO: 298881 - DNA, 25 bp, Rattus norvegicus
gaagactggtgcgtgtcaagcttta

SEQ ID NO: 298882 - DNA, 25 bp, Rattus norvegicus
gaagactgtaaccaagcaatgcaaa

SEQ ID NO: 298883 - DNA, 25 bp, Rattus norvegicus
gaagactgtaacgaagcaatgcaaa

SEQ ID NO: 298884 - DNA, 25 bp, Rattus norvegicus
gaagactgtgtaagtaacgctactt

SEQ ID NO: 298885 - DNA, 25 bp, Rattus norvegicus
gaagactgtgtatgtaacgctactt

SEQ ID NO: 298886 - DNA, 25 bp, Rattus norvegicus
gaagactgtgtgctatccgccacaa

SEQ ID NO: 298887 - DNA, 25 bp, Rattus norvegicus
gaagactgtgtggtatccgccacaa

SEQ ID NO: 298888 - DNA, 25 bp, Rattus norvegicus
gaagactgttaacccctgaacattt

SEQ ID NO: 298889 - DNA, 25 bp, Rattus norvegicus
gaagactgttaagccctgaacattt

SEQ ID NO: 298890 - DNA, 25 bp, Rattus norvegicus
gaagactgttgcctctttgttatag

SEQ ID NO: 298891 - DNA, 25 bp, Rattus norvegicus
gaagactgttgcgtctttgttatag

SEQ ID NO: 298892 - DNA, 25 bp, Rattus norvegicus
gaagacttaattagccctttctaca

SEQ ID NO: 298893 - DNA, 25 bp, Rattus norvegicus
gaagacttaatttgccctttctaca

SEQ ID NO: 298894 - DNA, 25 bp, Rattus norvegicus
gaagacttacgaacgccttgttgcc

SEQ ID NO: 298895 - DNA, 25 bp, Rattus norvegicus
gaagacttacgatcgccttgttgcc

SEQ ID NO: 298896 - DNA, 25 bp, Rattus norvegicus
gaagacttactaatgtgacctgaga

SEQ ID NO: 298897 - DNA, 25 bp, Rattus norvegicus
gaagacttactattgtgacctgaga

SEQ ID NO: 298898 - DNA, 25 bp, Rattus norvegicus
gaagacttactgagctacatgttga

SEQ ID NO: 298899 - DNA, 25 bp, Rattus norvegicus
gaagacttactgtgctacatgttga

SEQ ID NO: 298900 - DNA, 25 bp, Rattus norvegicus
gaagacttagccatgatgcctagga

SEQ ID NO: 298901 - DNA, 25 bp, Rattus norvegicus
gaagacttagccttgatgcctagga

SEQ ID NO: 298902 - DNA, 25 bp, Rattus norvegicus
gaagacttatttcttggagtttcaa

SEQ ID NO: 298903 - DNA, 25 bp, Rattus norvegicus
gaagacttatttgttggagtttcaa

SEQ ID NO: 298904 - DNA, 25 bp, Rattus norvegicus
gaagacttcagaagagcagctgcag

SEQ ID NO: 298905 - DNA, 25 bp, Rattus norvegicus
gaagacttcagatgagcagctgcag

SEQ ID NO: 298906 - DNA, 25 bp, Rattus norvegicus
gaagacttcataattctattgagga

SEQ ID NO: 298907 - DNA, 25 bp, Rattus norvegicus
gaagacttcatatttctattgagga

SEQ ID NO: 298908 - DNA, 25 bp, Rattus norvegicus
gaagacttcatgagacattttatct

SEQ ID NO: 298909 - DNA, 25 bp, Rattus norvegicus
gaagacttcatgtgacattttatct

SEQ ID NO: 298910 - DNA, 25 bp, Rattus norvegicus
gaagacttcattaatagtctcccat

SEQ ID NO: 298911 - DNA, 25 bp, Rattus norvegicus
gaagacttcatttatagtctcccat

SEQ ID NO: 298912 - DNA, 25 bp, Rattus norvegicus
gaagacttccagaactgttaccata

SEQ ID NO: 298913 - DNA, 25 bp, Rattus norvegicus
gaagacttccagacctttaatgcag

SEQ ID NO: 298914 - DNA, 25 bp, Rattus norvegicus
gaagacttccagtactgttaccata

SEQ ID NO: 298915 - DNA, 25 bp, Rattus norvegicus
gaagacttccagtcctttaatgcag

SEQ ID NO: 298916 - DNA, 25 bp, Rattus norvegicus
gaagacttccgtcagtttgagtcca

SEQ ID NO: 298917 - DNA, 25 bp, Rattus norvegicus
gaagacttccgtgagtttgagtcca

SEQ ID NO: 298918 - DNA, 25 bp, Rattus norvegicus
gaagacttcctacactgccgtgagt

SEQ ID NO: 298919 - DNA, 25 bp, Rattus norvegicus
gaagacttcctagactgccgtgagt

SEQ ID NO: 298920 - DNA, 25 bp, Rattus norvegicus
gaagacttcctgaactcaatcatca

SEQ ID NO: 298921 - DNA, 25 bp, Rattus norvegicus
gaagacttcctgtactcaatcatca

SEQ ID NO: 298922 - DNA, 25 bp, Rattus norvegicus
gaagacttccttccaaggctggtga

SEQ ID NO: 298923 - DNA, 25 bp, Rattus norvegicus
gaagacttccttgcaaggctggtga

SEQ ID NO: 298924 - DNA, 25 bp, Rattus norvegicus
gaagacttcggaacttgtttctgct

SEQ ID NO: 298925 - DNA, 25 bp, Rattus norvegicus
gaagacttcggatcttgtttctgct

SEQ ID NO: 298926 - DNA, 25 bp, Rattus norvegicus
gaagacttcgtcagctctaggaccg

SEQ ID NO: 298927 - DNA, 25 bp, Rattus norvegicus
gaagacttcgtctgctctaggaccg

SEQ ID NO: 298928 - DNA, 25 bp, Rattus norvegicus
gaagacttcgtgatggctgtccagt

SEQ ID NO: 298929 - DNA, 25 bp, Rattus norvegicus
gaagacttcgtgttggctgtccagt

SEQ ID NO: 298930 - DNA, 25 bp, Rattus norvegicus
gaagacttcttgacctttacacaga

SEQ ID NO: 298931 - DNA, 25 bp, Rattus norvegicus
gaagacttcttgtcctttacacaga

SEQ ID NO: 298932 - DNA, 25 bp, Rattus norvegicus
gaagacttgaatataatacaacagg

SEQ ID NO: 298933 - DNA, 25 bp, Rattus norvegicus
gaagacttgaatttaatacaacagg

SEQ ID NO: 298934 - DNA, 25 bp, Rattus norvegicus
gaagacttgagaacactggctgtgg

SEQ ID NO: 298935 - DNA, 25 bp, Rattus norvegicus
gaagacttgagatcactggctgtgg

SEQ ID NO: 298936 - DNA, 25 bp, Rattus norvegicus
gaagacttgcaacctgctctgcggg

SEQ ID NO: 298937 - DNA, 25 bp, Rattus norvegicus
gaagacttgcaagctgctctgcggg

SEQ ID NO: 298938 - DNA, 25 bp, Rattus norvegicus
gaagacttgcagacctttggcactc

SEQ ID NO: 298939 - DNA, 25 bp, Rattus norvegicus
gaagacttgcagtcctttggcactc

SEQ ID NO: 298940 - DNA, 25 bp, Rattus norvegicus
gaagacttggaactggccattgcac

SEQ ID NO: 298941 - DNA, 25 bp, Rattus norvegicus
gaagacttggaagtggccattgcac

SEQ ID NO: 298942 - DNA, 25 bp, Rattus norvegicus
gaagacttgtccaggttccttagct

SEQ ID NO: 298943 - DNA, 25 bp, Rattus norvegicus
gaagacttgtcctggttccttagct

SEQ ID NO: 298944 - DNA, 25 bp, Rattus norvegicus
gaagactttatcagtatgactgaga

SEQ ID NO: 298945 - DNA, 25 bp, Rattus norvegicus
gaagactttatctgtatgactgaga

SEQ ID NO: 298946 - DNA, 25 bp, Rattus norvegicus
gaagactttcaacgcctggcttagc

SEQ ID NO: 298947 - DNA, 25 bp, Rattus norvegicus
gaagactttcaaggcctggcttagc

SEQ ID NO: 298948 - DNA, 25 bp, Rattus norvegicus
gaagactttccaactgaccttgaca

SEQ ID NO: 298949 - DNA, 25 bp, Rattus norvegicus
gaagactttccatctgaccttgaca

SEQ ID NO: 298950 - DNA, 25 bp, Rattus norvegicus
gaagactttcccacttggagtgttt

SEQ ID NO: 298951 - DNA, 25 bp, Rattus norvegicus
gaagactttccctcttggagtgttt

SEQ ID NO: 298952 - DNA, 25 bp, Rattus norvegicus
gaagactttctacagtgagagcagg

SEQ ID NO: 298953 - DNA, 25 bp, Rattus norvegicus
gaagactttctagagtgagagcagg

SEQ ID NO: 298954 - DNA, 25 bp, Rattus norvegicus
gaagactttctgagacctgccatag

SEQ ID NO: 298955 - DNA, 25 bp, Rattus norvegicus
gaagactttctgagcagctgctact

SEQ ID NO: 298956 - DNA, 25 bp, Rattus norvegicus
gaagactttctgatgttattccgaa

SEQ ID NO: 298957 - DNA, 25 bp, Rattus norvegicus
gaagactttctgtgacctgccatag

SEQ ID NO: 298958 - DNA, 25 bp, Rattus norvegicus
gaagactttctgtgcagctgctact

SEQ ID NO: 298959 - DNA, 25 bp, Rattus norvegicus
gaagactttctgttgttattccgaa

SEQ ID NO: 298960 - DNA, 25 bp, Rattus norvegicus
gaagactttgagacccactcatcag

SEQ ID NO: 298961 - DNA, 25 bp, Rattus norvegicus
gaagactttgagatttgttcttagg

SEQ ID NO: 298962 - DNA, 25 bp, Rattus norvegicus
gaagactttgagtcccactcatcag

SEQ ID NO: 298963 - DNA, 25 bp, Rattus norvegicus
gaagactttgagttttgttcttagg

SEQ ID NO: 298964 - DNA, 25 bp, Rattus norvegicus
gaagactttgatacaattctgtgtg

SEQ ID NO: 298965 - DNA, 25 bp, Rattus norvegicus
gaagactttgattcaattctgtgtg

SEQ ID NO: 298966 - DNA, 25 bp, Rattus norvegicus
gaagactttgcaccccaggttttct

SEQ ID NO: 298967 - DNA, 25 bp, Rattus norvegicus
gaagactttgcagcccaggttttct

SEQ ID NO: 298968 - DNA, 25 bp, Rattus norvegicus
gaagactttgccacattcgattata

SEQ ID NO: 298969 - DNA, 25 bp, Rattus norvegicus
gaagactttgcctcattcgattata

SEQ ID NO: 298970 - DNA, 25 bp, Rattus norvegicus
gaagactttgtaccactcagtgcac

SEQ ID NO: 298971 - DNA, 25 bp, Rattus norvegicus
gaagactttgtagcactcagtgcac

SEQ ID NO: 298972 - DNA, 25 bp, Rattus norvegicus
gaagactttgttaatagtggccatg

SEQ ID NO: 298973 - DNA, 25 bp, Rattus norvegicus
gaagactttgtttatagtggccatg

SEQ ID NO: 298974 - DNA, 25 bp, Rattus norvegicus
gaagacttttgccttggacttaatc

SEQ ID NO: 298975 - DNA, 25 bp, Rattus norvegicus
gaagacttttgcgttggacttaatc

SEQ ID NO: 298976 - DNA, 25 bp, Rattus norvegicus
gaagagaaaccacagccattgaacc

SEQ ID NO: 298977 - DNA, 25 bp, Rattus norvegicus
gaagagaaaccagagccattgaacc

SEQ ID NO: 298978 - DNA, 25 bp, Rattus norvegicus
gaagagaacaccatcaaaatatttt

SEQ ID NO: 298979 - DNA, 25 bp, Rattus norvegicus
gaagagaacaccttcaaaatatttt

SEQ ID NO: 298980 - DNA, 25 bp, Rattus norvegicus
gaagagaacagccaggagccctcct

SEQ ID NO: 298981 - DNA, 25 bp, Rattus norvegicus
gaagagaacagcgaggagccctcct

SEQ ID NO: 298982 - DNA, 25 bp, Rattus norvegicus
gaagagaaccatccggaagactgct

SEQ ID NO: 298983 - DNA, 25 bp, Rattus norvegicus
gaagagaaccatgcggaagactgct

SEQ ID NO: 298984 - DNA, 25 bp, Rattus norvegicus
gaagagaacggcaccgctgcgatca

SEQ ID NO: 298985 - DNA, 25 bp, Rattus norvegicus
gaagagaacggctccgctgcgatca

SEQ ID NO: 298986 - DNA, 25 bp, Rattus norvegicus
gaagagaactgaccgctgcatggac

SEQ ID NO: 298987 - DNA, 25 bp, Rattus norvegicus
gaagagaactgagcgctgcatggac

SEQ ID NO: 298988 - DNA, 25 bp, Rattus norvegicus
gaagagaactgtcccgaggtctacg

SEQ ID NO: 298989 - DNA, 25 bp, Rattus norvegicus
gaagagaactgtgccgaggtctacg

SEQ ID NO: 298990 - DNA, 25 bp, Rattus norvegicus
gaagagaagcaaatgctctttctcc

SEQ ID NO: 298991 - DNA, 25 bp, Rattus norvegicus
gaagagaagcaactgaaggtttccc

SEQ ID NO: 298992 - DNA, 25 bp, Rattus norvegicus
gaagagaagcaagtgaaggtttccc

SEQ ID NO: 298993 - DNA, 25 bp, Rattus norvegicus
gaagagaagcaattgctctttctcc

SEQ ID NO: 298994 - DNA, 25 bp, Rattus norvegicus
gaagagaagcttagccaaggcccct

SEQ ID NO: 298995 - DNA, 25 bp, Rattus norvegicus
gaagagaagctttgccaaggcccct

SEQ ID NO: 298996 - DNA, 25 bp, Rattus norvegicus
gaagagaaggaacccgccgcatgcc

SEQ ID NO: 298997 - DNA, 25 bp, Rattus norvegicus
gaagagaaggaagccgccgcatgcc

SEQ ID NO: 298998 - DNA, 25 bp, Rattus norvegicus
gaagagaagggtctctgctctgccc

SEQ ID NO: 298999 - DNA, 25 bp, Rattus norvegicus
gaagagaagggtgtctgctctgccc

SEQ ID NO: 299000 - DNA, 25 bp, Rattus norvegicus
gaagagaagttgctgcctcccttac

SEQ ID NO: 299001 - DNA, 25 bp, Rattus norvegicus
gaagagaagttggtgcctcccttac

SEQ ID NO: 299002 - DNA, 25 bp, Rattus norvegicus
gaagagaatatgaccacctatctag

SEQ ID NO: 299003 - DNA, 25 bp, Rattus norvegicus
gaagagaatatgtccacctatctag

SEQ ID NO: 299004 - DNA, 25 bp, Rattus norvegicus
gaagagacaaggctgccccacggac

SEQ ID NO: 299005 - DNA, 25 bp, Rattus norvegicus
gaagagacaagggtgccccacggac

SEQ ID NO: 299006 - DNA, 25 bp, Rattus norvegicus
gaagagacacacctcacactggaga

SEQ ID NO: 299007 - DNA, 25 bp, Rattus norvegicus
gaagagacacacgtcacactggaga

SEQ ID NO: 299008 - DNA, 25 bp, Rattus norvegicus
gaagagacacgcacagtggccctct

SEQ ID NO: 299009 - DNA, 25 bp, Rattus norvegicus
gaagagacacgctcagtggccctct

SEQ ID NO: 299010 - DNA, 25 bp, Rattus norvegicus
gaagagacacggcatcaacccgcag

SEQ ID NO: 299011 - DNA, 25 bp, Rattus norvegicus
gaagagacacgggatcaacccgcag

SEQ ID NO: 299012 - DNA, 25 bp, Rattus norvegicus
gaagagacagttcgcactttgtcct

SEQ ID NO: 299013 - DNA, 25 bp, Rattus norvegicus
gaagagacagttggcactttgtcct

SEQ ID NO: 299014 - DNA, 25 bp, Rattus norvegicus
gaagagacattgacaccatctgctc

SEQ ID NO: 299015 - DNA, 25 bp, Rattus norvegicus
gaagagacattgtcaccatctgctc

SEQ ID NO: 299016 - DNA, 25 bp, Rattus norvegicus
gaagagaccccgaggccagcaacaa

SEQ ID NO: 299017 - DNA, 25 bp, Rattus norvegicus
gaagagaccccgtggccagcaacaa

SEQ ID NO: 299018 - DNA, 25 bp, Rattus norvegicus
gaagagaccgtcagcagtatatata

SEQ ID NO: 299019 - DNA, 25 bp, Rattus norvegicus
gaagagaccgtctgcagtatatata

SEQ ID NO: 299020 - DNA, 25 bp, Rattus norvegicus
gaagagacgacaatcacctgggaaa

SEQ ID NO: 299021 - DNA, 25 bp, Rattus norvegicus
gaagagacgacattcacctgggaaa

SEQ ID NO: 299022 - DNA, 25 bp, Rattus norvegicus
gaagagacgtcaacaggatcaccaa

SEQ ID NO: 299023 - DNA, 25 bp, Rattus norvegicus
gaagagacgtcatcaggatcaccaa

SEQ ID NO: 299024 - DNA, 25 bp, Rattus norvegicus
gaagagacgttcaaaccgccaagtt

SEQ ID NO: 299025 - DNA, 25 bp, Rattus norvegicus
gaagagacgttctaaccgccaagtt

SEQ ID NO: 299026 - DNA, 25 bp, Rattus norvegicus
gaagagactaaacagactgcctgag

SEQ ID NO: 299027 - DNA, 25 bp, Rattus norvegicus
gaagagactaaagagactgcctgag

SEQ ID NO: 299028 - DNA, 25 bp, Rattus norvegicus
gaagagactactaacctttgaggta

SEQ ID NO: 299029 - DNA, 25 bp, Rattus norvegicus
gaagagactacttacctttgaggta

SEQ ID NO: 299030 - DNA, 25 bp, Rattus norvegicus
gaagagactagaaacccatcactgt

SEQ ID NO: 299031 - DNA, 25 bp, Rattus norvegicus
gaagagactagatacccatcactgt

SEQ ID NO: 299032 - DNA, 25 bp, Rattus norvegicus
gaagagactcacaccaaccaaatta

SEQ ID NO: 299033 - DNA, 25 bp, Rattus norvegicus
gaagagactcactccaaccaaatta

SEQ ID NO: 299034 - DNA, 25 bp, Rattus norvegicus
gaagagactcccaagaactggcctc

SEQ ID NO: 299035 - DNA, 25 bp, Rattus norvegicus
gaagagactccctagaactggcctc

SEQ ID NO: 299036 - DNA, 25 bp, Rattus norvegicus
gaagagactcgcacagttctcggaa

SEQ ID NO: 299037 - DNA, 25 bp, Rattus norvegicus
gaagagactcgctcagttctcggaa

SEQ ID NO: 299038 - DNA, 25 bp, Rattus norvegicus
gaagagactctcctgggatgatgac

SEQ ID NO: 299039 - DNA, 25 bp, Rattus norvegicus
gaagagactctcgtgggatgatgac

SEQ ID NO: 299040 - DNA, 25 bp, Rattus norvegicus
gaagagacttcaccaaacctactta

SEQ ID NO: 299041 - DNA, 25 bp, Rattus norvegicus
gaagagacttcagcaaacctactta

SEQ ID NO: 299042 - DNA, 25 bp, Rattus norvegicus
gaagagacttctatttaatctgtaa

SEQ ID NO: 299043 - DNA, 25 bp, Rattus norvegicus
gaagagacttctttttaatctgtaa

SEQ ID NO: 299044 - DNA, 25 bp, Rattus norvegicus
gaagagactttccaacatttgccat

SEQ ID NO: 299045 - DNA, 25 bp, Rattus norvegicus
gaagagactttcgaacatttgccat

SEQ ID NO: 299046 - DNA, 25 bp, Rattus norvegicus
gaagagagaagactgctcccctgca

SEQ ID NO: 299047 - DNA, 25 bp, Rattus norvegicus
gaagagagaagagtgctcccctgca

SEQ ID NO: 299048 - DNA, 25 bp, Rattus norvegicus
gaagagagccatcccaagggtccag

SEQ ID NO: 299049 - DNA, 25 bp, Rattus norvegicus
gaagagagccatgccaagggtccag

SEQ ID NO: 299050 - DNA, 25 bp, Rattus norvegicus
gaagagagccggaagcaccctccag

SEQ ID NO: 299051 - DNA, 25 bp, Rattus norvegicus
gaagagagccggtagcaccctccag

SEQ ID NO: 299052 - DNA, 25 bp, Rattus norvegicus
gaagagagcgacactgcactcatat

SEQ ID NO: 299053 - DNA, 25 bp, Rattus norvegicus
gaagagagcgactctgcactcatat

SEQ ID NO: 299054 - DNA, 25 bp, Rattus norvegicus
gaagagagcgagaggtcctccagtc

SEQ ID NO: 299055 - DNA, 25 bp, Rattus norvegicus
gaagagagcgagtggtcctccagtc

SEQ ID NO: 299056 - DNA, 25 bp, Rattus norvegicus
gaagagagcggtcgcttctcccgtt

SEQ ID NO: 299057 - DNA, 25 bp, Rattus norvegicus
gaagagagcggtggcttctcccgtt

SEQ ID NO: 299058 - DNA, 25 bp, Rattus norvegicus
gaagagagctatcagggctgcaaca

SEQ ID NO: 299059 - DNA, 25 bp, Rattus norvegicus
gaagagagctatgagggctgcaaca

SEQ ID NO: 299060 - DNA, 25 bp, Rattus norvegicus
gaagagagctctatctccatttatt

SEQ ID NO: 299061 - DNA, 25 bp, Rattus norvegicus
gaagagagctctttctccatttatt

SEQ ID NO: 299062 - DNA, 25 bp, Rattus norvegicus
gaagagaggcatcccaaccactcca

SEQ ID NO: 299063 - DNA, 25 bp, Rattus norvegicus
gaagagaggcatgccaaccactcca

SEQ ID NO: 299064 - DNA, 25 bp, Rattus norvegicus
gaagagaggcttcaagctcagtcct

SEQ ID NO: 299065 - DNA, 25 bp, Rattus norvegicus
gaagagaggcttgaagctcagtcct

SEQ ID NO: 299066 - DNA, 25 bp, Rattus norvegicus
gaagagagtcataagtgcctggagc

SEQ ID NO: 299067 - DNA, 25 bp, Rattus norvegicus
gaagagagtcattagtgcctggagc

SEQ ID NO: 299068 - DNA, 25 bp, Rattus norvegicus
gaagagagtcctaggcaccgagtct

SEQ ID NO: 299069 - DNA, 25 bp, Rattus norvegicus
gaagagagtccttggcaccgagtct

SEQ ID NO: 299070 - DNA, 25 bp, Rattus norvegicus
gaagagagtggcagttaatgcccag

SEQ ID NO: 299071 - DNA, 25 bp, Rattus norvegicus
gaagagagtggctgttaatgcccag

SEQ ID NO: 299072 - DNA, 25 bp, Rattus norvegicus
gaagagatattaccaccttacatca

SEQ ID NO: 299073 - DNA, 25 bp, Rattus norvegicus
gaagagatattagcaccttacatca

SEQ ID NO: 299074 - DNA, 25 bp, Rattus norvegicus
gaagagatcacaagggtcacctaaa

SEQ ID NO: 299075 - DNA, 25 bp, Rattus norvegicus
gaagagatcacatgggtcacctaaa

SEQ ID NO: 299076 - DNA, 25 bp, Rattus norvegicus
gaagagatcaggaccacacccatgg

SEQ ID NO: 299077 - DNA, 25 bp, Rattus norvegicus
gaagagatcaggtccacacccatgg

SEQ ID NO: 299078 - DNA, 25 bp, Rattus norvegicus
gaagagatccgaatctgtgcccagc

SEQ ID NO: 299079 - DNA, 25 bp, Rattus norvegicus
gaagagatccgattctgtgcccagc

SEQ ID NO: 299080 - DNA, 25 bp, Rattus norvegicus
gaagagatcgtgacactgtctcagg

SEQ ID NO: 299081 - DNA, 25 bp, Rattus norvegicus
gaagagatcgtgtcactgtctcagg

SEQ ID NO: 299082 - DNA, 25 bp, Rattus norvegicus
gaagagatctggatttgagcaccca

SEQ ID NO: 299083 - DNA, 25 bp, Rattus norvegicus
gaagagatctggttttgagcaccca

SEQ ID NO: 299084 - DNA, 25 bp, Rattus norvegicus
gaagagatcttgacttttccctaag

SEQ ID NO: 299085 - DNA, 25 bp, Rattus norvegicus
gaagagatcttgtcttttccctaag

SEQ ID NO: 299086 - DNA, 25 bp, Rattus norvegicus
gaagagatgcccctcaacgttgctg

SEQ ID NO: 299087 - DNA, 25 bp, Rattus norvegicus
gaagagatgcccgtcaacgttgctg

SEQ ID NO: 299088 - DNA, 25 bp, Rattus norvegicus
gaagagatggtccttgctcggtcca

SEQ ID NO: 299089 - DNA, 25 bp, Rattus norvegicus
gaagagatggtcgttgctcggtcca

SEQ ID NO: 299090 - DNA, 25 bp, Rattus norvegicus
gaagagattatccagctgaagcagc

SEQ ID NO: 299091 - DNA, 25 bp, Rattus norvegicus
gaagagattatcgagctgaagcagc

SEQ ID NO: 299092 - DNA, 25 bp, Rattus norvegicus
gaagagattattaagcttgaaatgt

SEQ ID NO: 299093 - DNA, 25 bp, Rattus norvegicus
gaagagattatttagcttgaaatgt

SEQ ID NO: 299094 - DNA, 25 bp, Rattus norvegicus
gaagagattcacctgcagatgcctg

SEQ ID NO: 299095 - DNA, 25 bp, Rattus norvegicus
gaagagattcacgtgcagatgcctg

SEQ ID NO: 299096 - DNA, 25 bp, Rattus norvegicus
gaagagattcttattctgaaaatga

SEQ ID NO: 299097 - DNA, 25 bp, Rattus norvegicus
gaagagattcttccctgaatcctcc

SEQ ID NO: 299098 - DNA, 25 bp, Rattus norvegicus
gaagagattcttgcctgaatcctcc

SEQ ID NO: 299099 - DNA, 25 bp, Rattus norvegicus
gaagagattctttttctgaaaatga

SEQ ID NO: 299100 - DNA, 25 bp, Rattus norvegicus
gaagagatttcaaggttctgacaac

SEQ ID NO: 299101 - DNA, 25 bp, Rattus norvegicus
gaagagatttcatggttctgacaac

SEQ ID NO: 299102 - DNA, 25 bp, Rattus norvegicus
gaagagcaaaaaactacgctattgg

SEQ ID NO: 299103 - DNA, 25 bp, Rattus norvegicus
gaagagcaaaaatctacgctattgg

SEQ ID NO: 299104 - DNA, 25 bp, Rattus norvegicus
gaagagcaacgaagcccaagccata

SEQ ID NO: 299105 - DNA, 25 bp, Rattus norvegicus
gaagagcaacgatgcccaagccata

SEQ ID NO: 299106 - DNA, 25 bp, Rattus norvegicus
gaagagcaagcacccctagcaagca

SEQ ID NO: 299107 - DNA, 25 bp, Rattus norvegicus
gaagagcaagcactgcgtgcgcaca

SEQ ID NO: 299108 - DNA, 25 bp, Rattus norvegicus
gaagagcaagcagccctagcaagca

SEQ ID NO: 299109 - DNA, 25 bp, Rattus norvegicus
gaagagcaagcagtgcgtgcgcaca

SEQ ID NO: 299110 - DNA, 25 bp, Rattus norvegicus
gaagagcaaggtccctaccttcttc

SEQ ID NO: 299111 - DNA, 25 bp, Rattus norvegicus
gaagagcaaggtgcctaccttcttc

SEQ ID NO: 299112 - DNA, 25 bp, Rattus norvegicus
gaagagcaattcagaggacccatct

SEQ ID NO: 299113 - DNA, 25 bp, Rattus norvegicus
gaagagcaattctgaggacccatct

SEQ ID NO: 299114 - DNA, 25 bp, Rattus norvegicus
gaagagcacagtactagtcacaccc

SEQ ID NO: 299115 - DNA, 25 bp, Rattus norvegicus
gaagagcacagttctagtcacaccc

SEQ ID NO: 299116 - DNA, 25 bp, Rattus norvegicus
gaagagcagaggcatccagtgaacc

SEQ ID NO: 299117 - DNA, 25 bp, Rattus norvegicus
gaagagcagagggatccagtgaacc

SEQ ID NO: 299118 - DNA, 25 bp, Rattus norvegicus
gaagagcagcaaccctttccagcgg

SEQ ID NO: 299119 - DNA, 25 bp, Rattus norvegicus
gaagagcagcaagcctttccagcgg

SEQ ID NO: 299120 - DNA, 25 bp, Rattus norvegicus
gaagagcagccgctacctctcaaca

SEQ ID NO: 299121 - DNA, 25 bp, Rattus norvegicus
gaagagcagccggtacctctcaaca

SEQ ID NO: 299122 - DNA, 25 bp, Rattus norvegicus
gaagagcagcttcacctgtctgtgc

SEQ ID NO: 299123 - DNA, 25 bp, Rattus norvegicus
gaagagcagcttgacctgtctgtgc

SEQ ID NO: 299124 - DNA, 25 bp, Rattus norvegicus
gaagagcaggaactccttctgcaaa

SEQ ID NO: 299125 - DNA, 25 bp, Rattus norvegicus
gaagagcaggaagtccttctgcaaa

SEQ ID NO: 299126 - DNA, 25 bp, Rattus norvegicus
gaagagcagtctatcctgctggtta

SEQ ID NO: 299127 - DNA, 25 bp, Rattus norvegicus
gaagagcagtctttcctgctggtta

SEQ ID NO: 299128 - DNA, 25 bp, Rattus norvegicus
gaagagcatatccagaagtgtgtta

SEQ ID NO: 299129 - DNA, 25 bp, Rattus norvegicus
gaagagcatatcgagaagtgtgtta

SEQ ID NO: 299130 - DNA, 25 bp, Rattus norvegicus
gaagagcatcgacctcatccagaag

SEQ ID NO: 299131 - DNA, 25 bp, Rattus norvegicus
gaagagcatcgacttccgggctcaa

SEQ ID NO: 299132 - DNA, 25 bp, Rattus norvegicus
gaagagcatcgagctcatccagaag

SEQ ID NO: 299133 - DNA, 25 bp, Rattus norvegicus
gaagagcatcgagttccgggctcaa

SEQ ID NO: 299134 - DNA, 25 bp, Rattus norvegicus
gaagagcatcgtagcttcccgaggg

SEQ ID NO: 299135 - DNA, 25 bp, Rattus norvegicus
gaagagcatcgttgcttcccgaggg

SEQ ID NO: 299136 - DNA, 25 bp, Rattus norvegicus
gaagagccaaagcaacctttgcagc

SEQ ID NO: 299137 - DNA, 25 bp, Rattus norvegicus
gaagagccaaaggaacctttgcagc

SEQ ID NO: 299138 - DNA, 25 bp, Rattus norvegicus
gaagagccacatacacacattactg

SEQ ID NO: 299139 - DNA, 25 bp, Rattus norvegicus
gaagagccacattcacacattactg

SEQ ID NO: 299140 - DNA, 25 bp, Rattus norvegicus
gaagagccaccgcaaacctgggaca

SEQ ID NO: 299141 - DNA, 25 bp, Rattus norvegicus
gaagagccaccggaaacctgggaca

SEQ ID NO: 299142 - DNA, 25 bp, Rattus norvegicus
gaagagccactaattaccctttcgt

SEQ ID NO: 299143 - DNA, 25 bp, Rattus norvegicus
gaagagccactatttaccctttcgt

SEQ ID NO: 299144 - DNA, 25 bp, Rattus norvegicus
gaagagccacttaccgaggaggagc

SEQ ID NO: 299145 - DNA, 25 bp, Rattus norvegicus
gaagagccactttccgaggaggagc

SEQ ID NO: 299146 - DNA, 25 bp, Rattus norvegicus
gaagagccagccagagtcttgtgtc

SEQ ID NO: 299147 - DNA, 25 bp, Rattus norvegicus
gaagagccagcctgagtcttgtgtc

SEQ ID NO: 299148 - DNA, 25 bp, Rattus norvegicus
gaagagccagctagtactccagtct

SEQ ID NO: 299149 - DNA, 25 bp, Rattus norvegicus
gaagagccagcttgtactccagtct

SEQ ID NO: 299150 - DNA, 25 bp, Rattus norvegicus
gaagagccagtcagaggagcagtct

SEQ ID NO: 299151 - DNA, 25 bp, Rattus norvegicus
gaagagccagtctgaggagcagtct

SEQ ID NO: 299152 - DNA, 25 bp, Rattus norvegicus
gaagagccagttcttacggtgtcct

SEQ ID NO: 299153 - DNA, 25 bp, Rattus norvegicus
gaagagccagttgttacggtgtcct

SEQ ID NO: 299154 - DNA, 25 bp, Rattus norvegicus
gaagagccatcccagagacagtaac

SEQ ID NO: 299155 - DNA, 25 bp, Rattus norvegicus
gaagagccatccgagagacagtaac

SEQ ID NO: 299156 - DNA, 25 bp, Rattus norvegicus
gaagagccatgacaatgcccagcta

SEQ ID NO: 299157 - DNA, 25 bp, Rattus norvegicus
gaagagccatgagaatgcccagcta

SEQ ID NO: 299158 - DNA, 25 bp, Rattus norvegicus
gaagagccatggaccaggatcaggt

SEQ ID NO: 299159 - DNA, 25 bp, Rattus norvegicus
gaagagccatggtccaggatcaggt

SEQ ID NO: 299160 - DNA, 25 bp, Rattus norvegicus
gaagagcccacaacagagaccaaag

SEQ ID NO: 299161 - DNA, 25 bp, Rattus norvegicus
gaagagcccacatcagagaccaaag

SEQ ID NO: 299162 - DNA, 25 bp, Rattus norvegicus
gaagagcccattcccgactaaaaga

SEQ ID NO: 299163 - DNA, 25 bp, Rattus norvegicus
gaagagcccattctgaagtggtata

SEQ ID NO: 299164 - DNA, 25 bp, Rattus norvegicus
gaagagcccattgccgactaaaaga

SEQ ID NO: 299165 - DNA, 25 bp, Rattus norvegicus
gaagagcccattgtgaagtggtata

SEQ ID NO: 299166 - DNA, 25 bp, Rattus norvegicus
gaagagccccagattctaagaattt

SEQ ID NO: 299167 - DNA, 25 bp, Rattus norvegicus
gaagagccccagtttctaagaattt

SEQ ID NO: 299168 - DNA, 25 bp, Rattus norvegicus
gaagagcccctcaacagcgaagatg

SEQ ID NO: 299169 - DNA, 25 bp, Rattus norvegicus
gaagagcccctctacagcgaagatg

SEQ ID NO: 299170 - DNA, 25 bp, Rattus norvegicus
gaagagcccctgagatctttccatg

SEQ ID NO: 299171 - DNA, 25 bp, Rattus norvegicus
gaagagcccctgtgatctttccatg

SEQ ID NO: 299172 - DNA, 25 bp, Rattus norvegicus
gaagagccctggataggccttggat

SEQ ID NO: 299173 - DNA, 25 bp, Rattus norvegicus
gaagagccctggttaggccttggat

SEQ ID NO: 299174 - DNA, 25 bp, Rattus norvegicus
gaagagcctattctcctttgtgaat

SEQ ID NO: 299175 - DNA, 25 bp, Rattus norvegicus
gaagagcctattgtcctttgtgaat

SEQ ID NO: 299176 - DNA, 25 bp, Rattus norvegicus
gaagagcctcagaaaccctggaaaa

SEQ ID NO: 299177 - DNA, 25 bp, Rattus norvegicus
gaagagcctcagtaaccctggaaaa

SEQ ID NO: 299178 - DNA, 25 bp, Rattus norvegicus
gaagagcctcggatacttaatgaag

SEQ ID NO: 299179 - DNA, 25 bp, Rattus norvegicus
gaagagcctcggttacttaatgaag

SEQ ID NO: 299180 - DNA, 25 bp, Rattus norvegicus
gaagagcctgcaaagagctacctag

SEQ ID NO: 299181 - DNA, 25 bp, Rattus norvegicus
gaagagcctgcatagagctacctag

SEQ ID NO: 299182 - DNA, 25 bp, Rattus norvegicus
gaagagcctggaaggactcctctcc

SEQ ID NO: 299183 - DNA, 25 bp, Rattus norvegicus
gaagagcctggatggactcctctcc

SEQ ID NO: 299184 - DNA, 25 bp, Rattus norvegicus
gaagagccttgcatgttagcttctt

SEQ ID NO: 299185 - DNA, 25 bp, Rattus norvegicus
gaagagccttgcttgttagcttctt

SEQ ID NO: 299186 - DNA, 25 bp, Rattus norvegicus
gaagagcctttcaatccagactacg

SEQ ID NO: 299187 - DNA, 25 bp, Rattus norvegicus
gaagagcctttcacatgctcagtga

SEQ ID NO: 299188 - DNA, 25 bp, Rattus norvegicus
gaagagcctttctatccagactacg

SEQ ID NO: 299189 - DNA, 25 bp, Rattus norvegicus
gaagagcctttctcatgctcagtga

SEQ ID NO: 299190 - DNA, 25 bp, Rattus norvegicus
gaagagcctttgacttaacttggac

SEQ ID NO: 299191 - DNA, 25 bp, Rattus norvegicus
gaagagcctttgtcttaacttggac

SEQ ID NO: 299192 - DNA, 25 bp, Rattus norvegicus
gaagagccttttccctagcaagttg

SEQ ID NO: 299193 - DNA, 25 bp, Rattus norvegicus
gaagagccttttgcctagcaagttg

SEQ ID NO: 299194 - DNA, 25 bp, Rattus norvegicus
gaagagcgccacagcacgggttgtt

SEQ ID NO: 299195 - DNA, 25 bp, Rattus norvegicus
gaagagcgccactgcacgggttgtt

SEQ ID NO: 299196 - DNA, 25 bp, Rattus norvegicus
gaagagcgccagcacaacatggact

SEQ ID NO: 299197 - DNA, 25 bp, Rattus norvegicus
gaagagcgccaggacaacatggact

SEQ ID NO: 299198 - DNA, 25 bp, Rattus norvegicus
gaagagcgcgctcgctctgcagtat

SEQ ID NO: 299199 - DNA, 25 bp, Rattus norvegicus
gaagagcgcgctggctctgcagtat

SEQ ID NO: 299200 - DNA, 25 bp, Rattus norvegicus
gaagagcggtccacacacgtcggcg

SEQ ID NO: 299201 - DNA, 25 bp, Rattus norvegicus
gaagagcggtcctcacacgtcggcg

SEQ ID NO: 299202 - DNA, 25 bp, Rattus norvegicus
gaagagcgtctcacattaagagagg

SEQ ID NO: 299203 - DNA, 25 bp, Rattus norvegicus
gaagagcgtctctcattaagagagg

SEQ ID NO: 299204 - DNA, 25 bp, Rattus norvegicus
gaagagcgttttacacctgtacgag

SEQ ID NO: 299205 - DNA, 25 bp, Rattus norvegicus
gaagagcgtttttcacctgtacgag

SEQ ID NO: 299206 - DNA, 25 bp, Rattus norvegicus
gaagagctacagcatcctgtacagt

SEQ ID NO: 299207 - DNA, 25 bp, Rattus norvegicus
gaagagctacaggatcctgtacagt

SEQ ID NO: 299208 - DNA, 25 bp, Rattus norvegicus
gaagagctacgaacttcccgatggc

SEQ ID NO: 299209 - DNA, 25 bp, Rattus norvegicus
gaagagctacgatcttcccgatggc

SEQ ID NO: 299210 - DNA, 25 bp, Rattus norvegicus
gaagagctactcaggcccatgaagc

SEQ ID NO: 299211 - DNA, 25 bp, Rattus norvegicus
gaagagctactctggcccatgaagc

SEQ ID NO: 299212 - DNA, 25 bp, Rattus norvegicus
gaagagctatttcactcccaggtcc

SEQ ID NO: 299213 - DNA, 25 bp, Rattus norvegicus
gaagagctatttccatggaccaaca

SEQ ID NO: 299214 - DNA, 25 bp, Rattus norvegicus
gaagagctatttgactcccaggtcc

SEQ ID NO: 299215 - DNA, 25 bp, Rattus norvegicus
gaagagctatttgcatggaccaaca

SEQ ID NO: 299216 - DNA, 25 bp, Rattus norvegicus
gaagagctcacacccatgacacggg

SEQ ID NO: 299217 - DNA, 25 bp, Rattus norvegicus
gaagagctcacagccatgacacggg

SEQ ID NO: 299218 - DNA, 25 bp, Rattus norvegicus
gaagagctcactaacgtgccaaaat

SEQ ID NO: 299219 - DNA, 25 bp, Rattus norvegicus
gaagagctcacttacgtgccaaaat

SEQ ID NO: 299220 - DNA, 25 bp, Rattus norvegicus
gaagagctcagacctcctaaagcat

SEQ ID NO: 299221 - DNA, 25 bp, Rattus norvegicus
gaagagctcagagctcctaaagcat

SEQ ID NO: 299222 - DNA, 25 bp, Rattus norvegicus
gaagagctcagtaaccattggcaag

SEQ ID NO: 299223 - DNA, 25 bp, Rattus norvegicus
gaagagctcagttaccattggcaag

SEQ ID NO: 299224 - DNA, 25 bp, Rattus norvegicus
gaagagctccaaagtctatatagta

SEQ ID NO: 299225 - DNA, 25 bp, Rattus norvegicus
gaagagctccaatgtctatatagta

SEQ ID NO: 299226 - DNA, 25 bp, Rattus norvegicus
gaagagctcctaattaaaagggcag

SEQ ID NO: 299227 - DNA, 25 bp, Rattus norvegicus
gaagagctcctatttaaaagggcag

SEQ ID NO: 299228 - DNA, 25 bp, Rattus norvegicus
gaagagctctctcgctagcacttac

SEQ ID NO: 299229 - DNA, 25 bp, Rattus norvegicus
gaagagctctctggctagcacttac

SEQ ID NO: 299230 - DNA, 25 bp, Rattus norvegicus
gaagagctcttcaattcgtacatgg

SEQ ID NO: 299231 - DNA, 25 bp, Rattus norvegicus
gaagagctcttcagcatggcaggat

SEQ ID NO: 299232 - DNA, 25 bp, Rattus norvegicus
gaagagctcttctattcgtacatgg

SEQ ID NO: 299233 - DNA, 25 bp, Rattus norvegicus
gaagagctcttctgcatggcaggat

SEQ ID NO: 299234 - DNA, 25 bp, Rattus norvegicus
gaagagctgaagatccatgactaac

SEQ ID NO: 299235 - DNA, 25 bp, Rattus norvegicus
gaagagctgaagttccatgactaac

SEQ ID NO: 299236 - DNA, 25 bp, Rattus norvegicus
gaagagctgagaccagatgccctct

SEQ ID NO: 299237 - DNA, 25 bp, Rattus norvegicus
gaagagctgagagcagatgccctct

SEQ ID NO: 299238 - DNA, 25 bp, Rattus norvegicus
gaagagctgagtagcctgcgcccct

SEQ ID NO: 299239 - DNA, 25 bp, Rattus norvegicus
gaagagctgagttgcctgcgcccct

SEQ ID NO: 299240 - DNA, 25 bp, Rattus norvegicus
gaagagctgcaaaccactacacaga

SEQ ID NO: 299241 - DNA, 25 bp, Rattus norvegicus
gaagagctgcaatccactacacaga

SEQ ID NO: 299242 - DNA, 25 bp, Rattus norvegicus
gaagagctgctgcaggagctacaca

SEQ ID NO: 299243 - DNA, 25 bp, Rattus norvegicus
gaagagctgctggaggagctacaca

SEQ ID NO: 299244 - DNA, 25 bp, Rattus norvegicus
gaagagctgcttactggttcagtgt

SEQ ID NO: 299245 - DNA, 25 bp, Rattus norvegicus
gaagagctgctttctggttcagtgt

SEQ ID NO: 299246 - DNA, 25 bp, Rattus norvegicus
gaagagctggcaactctcttctgct

SEQ ID NO: 299247 - DNA, 25 bp, Rattus norvegicus
gaagagctggcatctctcttctgct

SEQ ID NO: 299248 - DNA, 25 bp, Rattus norvegicus
gaagagctggctctaccctcagagt

SEQ ID NO: 299249 - DNA, 25 bp, Rattus norvegicus
gaagagctggctgtaccctcagagt

SEQ ID NO: 299250 - DNA, 25 bp, Rattus norvegicus
gaagagctgtagcatgccgtacatc

SEQ ID NO: 299251 - DNA, 25 bp, Rattus norvegicus
gaagagctgtaggatgccgtacatc

SEQ ID NO: 299252 - DNA, 25 bp, Rattus norvegicus
gaagagctgtatacattcctccctt

SEQ ID NO: 299253 - DNA, 25 bp, Rattus norvegicus
gaagagctgtattcattcctccctt

SEQ ID NO: 299254 - DNA, 25 bp, Rattus norvegicus
gaagagctgtgcagttgttacccag

SEQ ID NO: 299255 - DNA, 25 bp, Rattus norvegicus
gaagagctgtgctgttgttacccag

SEQ ID NO: 299256 - DNA, 25 bp, Rattus norvegicus
gaagagctgtggcttccagccaaat

SEQ ID NO: 299257 - DNA, 25 bp, Rattus norvegicus
gaagagctgtgggttccagccaaat

SEQ ID NO: 299258 - DNA, 25 bp, Rattus norvegicus
gaagagcttaagaggcgacttgcca

SEQ ID NO: 299259 - DNA, 25 bp, Rattus norvegicus
gaagagcttaagtggcgacttgcca

SEQ ID NO: 299260 - DNA, 25 bp, Rattus norvegicus
gaagagcttaatatggtcggtagaa

SEQ ID NO: 299261 - DNA, 25 bp, Rattus norvegicus
gaagagcttaatttggtcggtagaa

SEQ ID NO: 299262 - DNA, 25 bp, Rattus norvegicus
gaagagcttattcggtacagatacc

SEQ ID NO: 299263 - DNA, 25 bp, Rattus norvegicus
gaagagcttattgggtacagatacc

SEQ ID NO: 299264 - DNA, 25 bp, Rattus norvegicus
gaagagcttcagcgcccgtggcttc

SEQ ID NO: 299265 - DNA, 25 bp, Rattus norvegicus
gaagagcttcagggcccgtggcttc

SEQ ID NO: 299266 - DNA, 25 bp, Rattus norvegicus
gaagagcttggactcagccttgaag

SEQ ID NO: 299267 - DNA, 25 bp, Rattus norvegicus
gaagagcttggagtcagccttgaag

SEQ ID NO: 299268 - DNA, 25 bp, Rattus norvegicus
gaagagcttggtctcatcatcaaca

SEQ ID NO: 299269 - DNA, 25 bp, Rattus norvegicus
gaagagcttggtgtcatcatcaaca

SEQ ID NO: 299270 - DNA, 25 bp, Rattus norvegicus
gaagagcttgtcaagaatacccaaa

SEQ ID NO: 299271 - DNA, 25 bp, Rattus norvegicus
gaagagcttgtctagaatacccaaa

SEQ ID NO: 299272 - DNA, 25 bp, Rattus norvegicus
gaagagctttaacgcctggctgtgt

SEQ ID NO: 299273 - DNA, 25 bp, Rattus norvegicus
gaagagctttaaggcctggctgtgt

SEQ ID NO: 299274 - DNA, 25 bp, Rattus norvegicus
gaagaggaacaaatagtcagccatt

SEQ ID NO: 299275 - DNA, 25 bp, Rattus norvegicus
gaagaggaacaattagtcagccatt

SEQ ID NO: 299276 - DNA, 25 bp, Rattus norvegicus
gaagaggaacacatggcagctatct

SEQ ID NO: 299277 - DNA, 25 bp, Rattus norvegicus
gaagaggaacaccttccaagacaaa

SEQ ID NO: 299278 - DNA, 25 bp, Rattus norvegicus
gaagaggaacacgttccaagacaaa

SEQ ID NO: 299279 - DNA, 25 bp, Rattus norvegicus
gaagaggaacacttggcagctatct

SEQ ID NO: 299280 - DNA, 25 bp, Rattus norvegicus
gaagaggaaccgaccttccagggct

SEQ ID NO: 299281 - DNA, 25 bp, Rattus norvegicus
gaagaggaaccgtccttccagggct

SEQ ID NO: 299282 - DNA, 25 bp, Rattus norvegicus
gaagaggaacgaccacagagaccgc

SEQ ID NO: 299283 - DNA, 25 bp, Rattus norvegicus
gaagaggaacgagcacagagaccgc

SEQ ID NO: 299284 - DNA, 25 bp, Rattus norvegicus
gaagaggaacggaggagccgggcgc

SEQ ID NO: 299285 - DNA, 25 bp, Rattus norvegicus
gaagaggaacggtggagccgggcgc

SEQ ID NO: 299286 - DNA, 25 bp, Rattus norvegicus
gaagaggacaagctggtctctctac

SEQ ID NO: 299287 - DNA, 25 bp, Rattus norvegicus
gaagaggacaaggtggtctctctac

SEQ ID NO: 299288 - DNA, 25 bp, Rattus norvegicus
gaagaggacatcagctctgacacat

SEQ ID NO: 299289 - DNA, 25 bp, Rattus norvegicus
gaagaggacatctgctctgacacat

SEQ ID NO: 299290 - DNA, 25 bp, Rattus norvegicus
gaagaggacccacgtctgctgctgt

SEQ ID NO: 299291 - DNA, 25 bp, Rattus norvegicus
gaagaggacccaggtctgctgctgt

SEQ ID NO: 299292 - DNA, 25 bp, Rattus norvegicus
gaagaggactacagtgtactaatat

SEQ ID NO: 299293 - DNA, 25 bp, Rattus norvegicus
gaagaggactactgtgtactaatat

SEQ ID NO: 299294 - DNA, 25 bp, Rattus norvegicus
gaagaggactctcgttcacgctcca

SEQ ID NO: 299295 - DNA, 25 bp, Rattus norvegicus
gaagaggactctggttcacgctcca

SEQ ID NO: 299296 - DNA, 25 bp, Rattus norvegicus
gaagaggacttcctggagtcagaca

SEQ ID NO: 299297 - DNA, 25 bp, Rattus norvegicus
gaagaggacttcgtggagtcagaca

SEQ ID NO: 299298 - DNA, 25 bp, Rattus norvegicus
gaagaggagacaccccgctgacttc

SEQ ID NO: 299299 - DNA, 25 bp, Rattus norvegicus
gaagaggagacagcccgctgacttc

SEQ ID NO: 299300 - DNA, 25 bp, Rattus norvegicus
gaagaggagagacccacagtcccaa

SEQ ID NO: 299301 - DNA, 25 bp, Rattus norvegicus
gaagaggagagagccacagtcccaa

SEQ ID NO: 299302 - DNA, 25 bp, Rattus norvegicus
gaagaggagatcaaggttctctctg

SEQ ID NO: 299303 - DNA, 25 bp, Rattus norvegicus
gaagaggagatctaggttctctctg

SEQ ID NO: 299304 - DNA, 25 bp, Rattus norvegicus
gaagaggagtatccttctttagacc

SEQ ID NO: 299305 - DNA, 25 bp, Rattus norvegicus
gaagaggagtatgcttctttagacc

SEQ ID NO: 299306 - DNA, 25 bp, Rattus norvegicus
gaagaggagtcccagttttcagaga

SEQ ID NO: 299307 - DNA, 25 bp, Rattus norvegicus
gaagaggagtccgagttttcagaga

SEQ ID NO: 299308 - DNA, 25 bp, Rattus norvegicus
gaagaggatcctccggacgctcaaa

SEQ ID NO: 299309 - DNA, 25 bp, Rattus norvegicus
gaagaggatcctgcggacgctcaaa

SEQ ID NO: 299310 - DNA, 25 bp, Rattus norvegicus
gaagaggatggaactcacccggaaa

SEQ ID NO: 299311 - DNA, 25 bp, Rattus norvegicus
gaagaggatggatctcacccggaaa

SEQ ID NO: 299312 - DNA, 25 bp, Rattus norvegicus
gaagaggatttgacactccccaccc

SEQ ID NO: 299313 - DNA, 25 bp, Rattus norvegicus
gaagaggatttgtcactccccaccc

SEQ ID NO: 299314 - DNA, 25 bp, Rattus norvegicus
gaagaggcaaaccagccagtgatta

SEQ ID NO: 299315 - DNA, 25 bp, Rattus norvegicus
gaagaggcaaacgagccagtgatta

SEQ ID NO: 299316 - DNA, 25 bp, Rattus norvegicus
gaagaggcaagcatttgtctctccc

SEQ ID NO: 299317 - DNA, 25 bp, Rattus norvegicus
gaagaggcaagcttttgtctctccc

SEQ ID NO: 299318 - DNA, 25 bp, Rattus norvegicus
gaagaggcacacagcactgtagaaa

SEQ ID NO: 299319 - DNA, 25 bp, Rattus norvegicus
gaagaggcacactgcactgtagaaa

SEQ ID NO: 299320 - DNA, 25 bp, Rattus norvegicus
gaagaggcagctccttacatccagt

SEQ ID NO: 299321 - DNA, 25 bp, Rattus norvegicus
gaagaggcagctgcttacatccagt

SEQ ID NO: 299322 - DNA, 25 bp, Rattus norvegicus
gaagaggcaggaccacgtgatctaa

SEQ ID NO: 299323 - DNA, 25 bp, Rattus norvegicus
gaagaggcaggagcacgtgatctaa

SEQ ID NO: 299324 - DNA, 25 bp, Rattus norvegicus
gaagaggccaccagtgctaacaggt

SEQ ID NO: 299325 - DNA, 25 bp, Rattus norvegicus
gaagaggccacctgtgctaacaggt

SEQ ID NO: 299326 - DNA, 25 bp, Rattus norvegicus
gaagaggccagcatgcttctgaagc

SEQ ID NO: 299327 - DNA, 25 bp, Rattus norvegicus
gaagaggccagcttgcttctgaagc

SEQ ID NO: 299328 - DNA, 25 bp, Rattus norvegicus
gaagaggccagtctgctatgcagct

SEQ ID NO: 299329 - DNA, 25 bp, Rattus norvegicus
gaagaggccagtgtgctatgcagct

SEQ ID NO: 299330 - DNA, 25 bp, Rattus norvegicus
gaagaggccatacacattcctttgt

SEQ ID NO: 299331 - DNA, 25 bp, Rattus norvegicus
gaagaggccatacccactagttggt

SEQ ID NO: 299332 - DNA, 25 bp, Rattus norvegicus
gaagaggccatagacattcctttgt

SEQ ID NO: 299333 - DNA, 25 bp, Rattus norvegicus
gaagaggccatagccactagttggt

SEQ ID NO: 299334 - DNA, 25 bp, Rattus norvegicus
gaagaggcccaaatggctgcttaaa

SEQ ID NO: 299335 - DNA, 25 bp, Rattus norvegicus
gaagaggcccaattggctgcttaaa

SEQ ID NO: 299336 - DNA, 25 bp, Rattus norvegicus
gaagaggccccgacgagtttcccag

SEQ ID NO: 299337 - DNA, 25 bp, Rattus norvegicus
gaagaggccccgtcgagtttcccag

SEQ ID NO: 299338 - DNA, 25 bp, Rattus norvegicus
gaagaggcccgcatggctaccatca

SEQ ID NO: 299339 - DNA, 25 bp, Rattus norvegicus
gaagaggcccgcttggctaccatca

SEQ ID NO: 299340 - DNA, 25 bp, Rattus norvegicus
gaagaggccgtacaagcaaccccga

SEQ ID NO: 299341 - DNA, 25 bp, Rattus norvegicus
gaagaggccgtagaagcaaccccga

SEQ ID NO: 299342 - DNA, 25 bp, Rattus norvegicus
gaagaggccgttccagaagtctcgc

SEQ ID NO: 299343 - DNA, 25 bp, Rattus norvegicus
gaagaggccgttgcagaagtctcgc

SEQ ID NO: 299344 - DNA, 25 bp, Rattus norvegicus
gaagaggcctctcttgtggacatgc

SEQ ID NO: 299345 - DNA, 25 bp, Rattus norvegicus
gaagaggcctctgttgtggacatgc

SEQ ID NO: 299346 - DNA, 25 bp, Rattus norvegicus
gaagaggccttcagtgctggccctg

SEQ ID NO: 299347 - DNA, 25 bp, Rattus norvegicus
gaagaggccttctgtgctggccctg

SEQ ID NO: 299348 - DNA, 25 bp, Rattus norvegicus
gaagaggcctttcatgccatctgcc

SEQ ID NO: 299349 - DNA, 25 bp, Rattus norvegicus
gaagaggcctttgatgccatctgcc

SEQ ID NO: 299350 - DNA, 25 bp, Rattus norvegicus
gaagaggcgccacgatcttctctgg

SEQ ID NO: 299351 - DNA, 25 bp, Rattus norvegicus
gaagaggcgccaggatcttctctgg

SEQ ID NO: 299352 - DNA, 25 bp, Rattus norvegicus
gaagaggcgcttagccagccgagcc

SEQ ID NO: 299353 - DNA, 25 bp, Rattus norvegicus
gaagaggcgctttgccagccgagcc

SEQ ID NO: 299354 - DNA, 25 bp, Rattus norvegicus
gaagaggcgtccaacccttgtgaaa

SEQ ID NO: 299355 - DNA, 25 bp, Rattus norvegicus
gaagaggcgtccaatgactctgact

SEQ ID NO: 299356 - DNA, 25 bp, Rattus norvegicus
gaagaggcgtcctacccttgtgaaa

SEQ ID NO: 299357 - DNA, 25 bp, Rattus norvegicus
gaagaggcgtcctatgactctgact

SEQ ID NO: 299358 - DNA, 25 bp, Rattus norvegicus
gaagaggctctgaatctgatgaatt

SEQ ID NO: 299359 - DNA, 25 bp, Rattus norvegicus
gaagaggctctgtatctgatgaatt

SEQ ID NO: 299360 - DNA, 25 bp, Rattus norvegicus
gaagaggctcttcatccaaaaggga

SEQ ID NO: 299361 - DNA, 25 bp, Rattus norvegicus
gaagaggctcttgatccaaaaggga

SEQ ID NO: 299362 - DNA, 25 bp, Rattus norvegicus
gaagaggctgatccctggaactgca

SEQ ID NO: 299363 - DNA, 25 bp, Rattus norvegicus
gaagaggctgatgcctggaactgca

SEQ ID NO: 299364 - DNA, 25 bp, Rattus norvegicus
gaagaggctgcaacaactgaaaaga

SEQ ID NO: 299365 - DNA, 25 bp, Rattus norvegicus
gaagaggctgcatcaactgaaaaga

SEQ ID NO: 299366 - DNA, 25 bp, Rattus norvegicus
gaagaggctgccacatgcttgtgtc

SEQ ID NO: 299367 - DNA, 25 bp, Rattus norvegicus
gaagaggctgcctcatgcttgtgtc

SEQ ID NO: 299368 - DNA, 25 bp, Rattus norvegicus
gaagaggctgctactaactaaccct

SEQ ID NO: 299369 - DNA, 25 bp, Rattus norvegicus
gaagaggctgcttctaactaaccct

SEQ ID NO: 299370 - DNA, 25 bp, Rattus norvegicus
gaagaggctggaccaagttatcctt

SEQ ID NO: 299371 - DNA, 25 bp, Rattus norvegicus
gaagaggctggagcaagttatcctt

SEQ ID NO: 299372 - DNA, 25 bp, Rattus norvegicus
gaagaggctggtcgataccctccca

SEQ ID NO: 299373 - DNA, 25 bp, Rattus norvegicus
gaagaggctggtggataccctccca

SEQ ID NO: 299374 - DNA, 25 bp, Rattus norvegicus
gaagaggcttccaaacaagagagat

SEQ ID NO: 299375 - DNA, 25 bp, Rattus norvegicus
gaagaggcttcctaacaagagagat

SEQ ID NO: 299376 - DNA, 25 bp, Rattus norvegicus
gaagagggactgatttccagaattt

SEQ ID NO: 299377 - DNA, 25 bp, Rattus norvegicus
gaagagggactgttttccagaattt

SEQ ID NO: 299378 - DNA, 25 bp, Rattus norvegicus
gaagagggcaggctttaccatttct

SEQ ID NO: 299379 - DNA, 25 bp, Rattus norvegicus
gaagagggcagggtttaccatttct

SEQ ID NO: 299380 - DNA, 25 bp, Rattus norvegicus
gaagagggcctcaactgtctaagct

SEQ ID NO: 299381 - DNA, 25 bp, Rattus norvegicus
gaagagggcctctactgtctaagct

SEQ ID NO: 299382 - DNA, 25 bp, Rattus norvegicus
gaagagggcgacagatcctccggaa

SEQ ID NO: 299383 - DNA, 25 bp, Rattus norvegicus
gaagagggcgactgatcctccggaa

SEQ ID NO: 299384 - DNA, 25 bp, Rattus norvegicus
gaagagggctgcatccgttttacaa

SEQ ID NO: 299385 - DNA, 25 bp, Rattus norvegicus
gaagagggctgcttccgttttacaa

SEQ ID NO: 299386 - DNA, 25 bp, Rattus norvegicus
gaagagggtaccaatgatcacacca

SEQ ID NO: 299387 - DNA, 25 bp, Rattus norvegicus
gaagagggtacctatgatcacacca

SEQ ID NO: 299388 - DNA, 25 bp, Rattus norvegicus
gaagagggtccaagccaagggcaca

SEQ ID NO: 299389 - DNA, 25 bp, Rattus norvegicus
gaagagggtccatgccaagggcaca

SEQ ID NO: 299390 - DNA, 25 bp, Rattus norvegicus
gaagagggtgacacactctgctgtg

SEQ ID NO: 299391 - DNA, 25 bp, Rattus norvegicus
gaagagggtgactcactctgctgtg

SEQ ID NO: 299392 - DNA, 25 bp, Rattus norvegicus
gaagagggttttcgatcccaggaat

SEQ ID NO: 299393 - DNA, 25 bp, Rattus norvegicus
gaagagggttttggatcccaggaat

SEQ ID NO: 299394 - DNA, 25 bp, Rattus norvegicus
gaagaggtcacacgtctggccagct

SEQ ID NO: 299395 - DNA, 25 bp, Rattus norvegicus
gaagaggtcacaggtctggccagct

SEQ ID NO: 299396 - DNA, 25 bp, Rattus norvegicus
gaagaggtcagcagttacagtatgt

SEQ ID NO: 299397 - DNA, 25 bp, Rattus norvegicus
gaagaggtcagctgttacagtatgt

SEQ ID NO: 299398 - DNA, 25 bp, Rattus norvegicus
gaagaggtccctatggctatgattg

SEQ ID NO: 299399 - DNA, 25 bp, Rattus norvegicus
gaagaggtccctttggctatgattg

SEQ ID NO: 299400 - DNA, 25 bp, Rattus norvegicus
gaagaggtgattcaaaccaacaggg

SEQ ID NO: 299401 - DNA, 25 bp, Rattus norvegicus
gaagaggtgattgaaaccaacaggg

SEQ ID NO: 299402 - DNA, 25 bp, Rattus norvegicus
gaagaggtgcccagtgtctctgcaa

SEQ ID NO: 299403 - DNA, 25 bp, Rattus norvegicus
gaagaggtgccctgtgtctctgcaa

SEQ ID NO: 299404 - DNA, 25 bp, Rattus norvegicus
gaagaggtgttcctcagtgtgcctt

SEQ ID NO: 299405 - DNA, 25 bp, Rattus norvegicus
gaagaggtgttcgtcagtgtgcctt

SEQ ID NO: 299406 - DNA, 25 bp, Rattus norvegicus
gaagaggttgacacagttctctgaa

SEQ ID NO: 299407 - DNA, 25 bp, Rattus norvegicus
gaagaggttgactcagttctctgaa

SEQ ID NO: 299408 - DNA, 25 bp, Rattus norvegicus
gaagaggttgatattctccaccatc

SEQ ID NO: 299409 - DNA, 25 bp, Rattus norvegicus
gaagaggttgattttctccaccatc

SEQ ID NO: 299410 - DNA, 25 bp, Rattus norvegicus
gaagaggtttctaggacacgtcacc

SEQ ID NO: 299411 - DNA, 25 bp, Rattus norvegicus
gaagaggtttctcgtcttgccagac

SEQ ID NO: 299412 - DNA, 25 bp, Rattus norvegicus
gaagaggtttctggtcttgccagac

SEQ ID NO: 299413 - DNA, 25 bp, Rattus norvegicus
gaagaggtttcttggacacgtcacc

SEQ ID NO: 299414 - DNA, 25 bp, Rattus norvegicus
gaagaggtttgcctcagtgtttccc

SEQ ID NO: 299415 - DNA, 25 bp, Rattus norvegicus
gaagaggtttgcgtcagtgtttccc

SEQ ID NO: 299416 - DNA, 25 bp, Rattus norvegicus
gaagaggtttttcccagtcatttga

SEQ ID NO: 299417 - DNA, 25 bp, Rattus norvegicus
gaagaggtttttgccagtcatttga

SEQ ID NO: 299418 - DNA, 25 bp, Rattus norvegicus
gaagagtaacccagttgcatagcaa

SEQ ID NO: 299419 - DNA, 25 bp, Rattus norvegicus
gaagagtaaccctgttgcatagcaa

SEQ ID NO: 299420 - DNA, 25 bp, Rattus norvegicus
gaagagtaaccgctaacgtcgtcag

SEQ ID NO: 299421 - DNA, 25 bp, Rattus norvegicus
gaagagtaaccggtaacgtcgtcag

SEQ ID NO: 299422 - DNA, 25 bp, Rattus norvegicus
gaagagtaacctatgcagcctgttt

SEQ ID NO: 299423 - DNA, 25 bp, Rattus norvegicus
gaagagtaacctttgcagcctgttt

SEQ ID NO: 299424 - DNA, 25 bp, Rattus norvegicus
gaagagtaacttagacaccgttgat

SEQ ID NO: 299425 - DNA, 25 bp, Rattus norvegicus
gaagagtaactttgacaccgttgat

SEQ ID NO: 299426 - DNA, 25 bp, Rattus norvegicus
gaagagtaagaaccacggccgcaga

SEQ ID NO: 299427 - DNA, 25 bp, Rattus norvegicus
gaagagtaagaagcacggccgcaga

SEQ ID NO: 299428 - DNA, 25 bp, Rattus norvegicus
gaagagtaatacatacagactgttt

SEQ ID NO: 299429 - DNA, 25 bp, Rattus norvegicus
gaagagtaatacttacagactgttt

SEQ ID NO: 299430 - DNA, 25 bp, Rattus norvegicus
gaagagtaatatccttgctgcttaa

SEQ ID NO: 299431 - DNA, 25 bp, Rattus norvegicus
gaagagtaatatgcttgctgcttaa

SEQ ID NO: 299432 - DNA, 25 bp, Rattus norvegicus
gaagagtacgtgatggctgccatca

SEQ ID NO: 299433 - DNA, 25 bp, Rattus norvegicus
gaagagtacgtgttggctgccatca

SEQ ID NO: 299434 - DNA, 25 bp, Rattus norvegicus
gaagagtagagccttaatgcagaga

SEQ ID NO: 299435 - DNA, 25 bp, Rattus norvegicus
gaagagtagagcgttaatgcagaga

SEQ ID NO: 299436 - DNA, 25 bp, Rattus norvegicus
gaagagtagatcatgtgctacccaa

SEQ ID NO: 299437 - DNA, 25 bp, Rattus norvegicus
gaagagtagatcttgtgctacccaa

SEQ ID NO: 299438 - DNA, 25 bp, Rattus norvegicus
gaagagtagcagctttctcccaaga

SEQ ID NO: 299439 - DNA, 25 bp, Rattus norvegicus
gaagagtagcaggtttctcccaaga

SEQ ID NO: 299440 - DNA, 25 bp, Rattus norvegicus
gaagagtatcacctgacccttcagg

SEQ ID NO: 299441 - DNA, 25 bp, Rattus norvegicus
gaagagtatcacgtgacccttcagg

SEQ ID NO: 299442 - DNA, 25 bp, Rattus norvegicus
gaagagtatcatacgacaggtcctt

SEQ ID NO: 299443 - DNA, 25 bp, Rattus norvegicus
gaagagtatcattcgacaggtcctt

SEQ ID NO: 299444 - DNA, 25 bp, Rattus norvegicus
gaagagtatcggctccctggaaaat

SEQ ID NO: 299445 - DNA, 25 bp, Rattus norvegicus
gaagagtatcgggtccctggaaaat

SEQ ID NO: 299446 - DNA, 25 bp, Rattus norvegicus
gaagagtatcttccccttaagggtg

SEQ ID NO: 299447 - DNA, 25 bp, Rattus norvegicus
gaagagtatcttgcccttaagggtg

SEQ ID NO: 299448 - DNA, 25 bp, Rattus norvegicus
gaagagtattccagtcctaaatttg

SEQ ID NO: 299449 - DNA, 25 bp, Rattus norvegicus
gaagagtattcctgtcctaaatttg

SEQ ID NO: 299450 - DNA, 25 bp, Rattus norvegicus
gaagagtattttctgctacatgcat

SEQ ID NO: 299451 - DNA, 25 bp, Rattus norvegicus
gaagagtattttgtgctacatgcat

SEQ ID NO: 299452 - DNA, 25 bp, Rattus norvegicus
gaagagtcatcaagcattgagttca

SEQ ID NO: 299453 - DNA, 25 bp, Rattus norvegicus
gaagagtcatcatgcattgagttca

SEQ ID NO: 299454 - DNA, 25 bp, Rattus norvegicus
gaagagtcatcccactgctaccaag

SEQ ID NO: 299455 - DNA, 25 bp, Rattus norvegicus
gaagagtcatccgactgctaccaag

SEQ ID NO: 299456 - DNA, 25 bp, Rattus norvegicus
gaagagtcatggagagccccacctt

SEQ ID NO: 299457 - DNA, 25 bp, Rattus norvegicus
gaagagtcatggtgagccccacctt

SEQ ID NO: 299458 - DNA, 25 bp, Rattus norvegicus
gaagagtcatgtactgacctccatg

SEQ ID NO: 299459 - DNA, 25 bp, Rattus norvegicus
gaagagtcatgtccccaataaacag

SEQ ID NO: 299460 - DNA, 25 bp, Rattus norvegicus
gaagagtcatgtgcccaataaacag

SEQ ID NO: 299461 - DNA, 25 bp, Rattus norvegicus
gaagagtcatgttctgacctccatg

SEQ ID NO: 299462 - DNA, 25 bp, Rattus norvegicus
gaagagtccgatccctataagttta

SEQ ID NO: 299463 - DNA, 25 bp, Rattus norvegicus
gaagagtccgatgcctataagttta

SEQ ID NO: 299464 - DNA, 25 bp, Rattus norvegicus
gaagagtcctcaagaatgggccagt

SEQ ID NO: 299465 - DNA, 25 bp, Rattus norvegicus
gaagagtcctcaccagagcacactt

SEQ ID NO: 299466 - DNA, 25 bp, Rattus norvegicus
gaagagtcctcagcagagcacactt

SEQ ID NO: 299467 - DNA, 25 bp, Rattus norvegicus
gaagagtcctcatgaatgggccagt

SEQ ID NO: 299468 - DNA, 25 bp, Rattus norvegicus
gaagagtcctgtcttgataccaact

SEQ ID NO: 299469 - DNA, 25 bp, Rattus norvegicus
gaagagtcctgtgttgataccaact

SEQ ID NO: 299470 - DNA, 25 bp, Rattus norvegicus
gaagagtcgcgtagtgcctgaagct

SEQ ID NO: 299471 - DNA, 25 bp, Rattus norvegicus
gaagagtcgcgttgtgcctgaagct

SEQ ID NO: 299472 - DNA, 25 bp, Rattus norvegicus
gaagagtcgtgtagtgctttcaact

SEQ ID NO: 299473 - DNA, 25 bp, Rattus norvegicus
gaagagtcgtgttgtgctttcaact

SEQ ID NO: 299474 - DNA, 25 bp, Rattus norvegicus
gaagagtctacccatccaattttgt

SEQ ID NO: 299475 - DNA, 25 bp, Rattus norvegicus
gaagagtctaccgatccaattttgt

SEQ ID NO: 299476 - DNA, 25 bp, Rattus norvegicus
gaagagtctctaaacacaggccaac

SEQ ID NO: 299477 - DNA, 25 bp, Rattus norvegicus
gaagagtctctaccatggaatccat

SEQ ID NO: 299478 - DNA, 25 bp, Rattus norvegicus
gaagagtctctagcatggaatccat

SEQ ID NO: 299479 - DNA, 25 bp, Rattus norvegicus
gaagagtctctatacacaggccaac

SEQ ID NO: 299480 - DNA, 25 bp, Rattus norvegicus
gaagagtctctgaggacctaccttt

SEQ ID NO: 299481 - DNA, 25 bp, Rattus norvegicus
gaagagtctctgtggacctaccttt

SEQ ID NO: 299482 - DNA, 25 bp, Rattus norvegicus
gaagagtctcttcccatgacgttgc

SEQ ID NO: 299483 - DNA, 25 bp, Rattus norvegicus
gaagagtctcttgccatgacgttgc

SEQ ID NO: 299484 - DNA, 25 bp, Rattus norvegicus
gaagagtcttcacccagacctggag

SEQ ID NO: 299485 - DNA, 25 bp, Rattus norvegicus
gaagagtcttcagccagacctggag

SEQ ID NO: 299486 - DNA, 25 bp, Rattus norvegicus
gaagagtcttgtatgctgataagaa

SEQ ID NO: 299487 - DNA, 25 bp, Rattus norvegicus
gaagagtcttgtttgctgataagaa

SEQ ID NO: 299488 - DNA, 25 bp, Rattus norvegicus
gaagagtctttgagccatggtcccc

SEQ ID NO: 299489 - DNA, 25 bp, Rattus norvegicus
gaagagtctttgtgccatggtcccc

SEQ ID NO: 299490 - DNA, 25 bp, Rattus norvegicus
gaagagtgaactctcgtgtgatatt

SEQ ID NO: 299491 - DNA, 25 bp, Rattus norvegicus
gaagagtgaactgtcgtgtgatatt

SEQ ID NO: 299492 - DNA, 25 bp, Rattus norvegicus
gaagagtgacttcctggttaataaa

SEQ ID NO: 299493 - DNA, 25 bp, Rattus norvegicus
gaagagtgacttgctggttaataaa

SEQ ID NO: 299494 - DNA, 25 bp, Rattus norvegicus
gaagagtgatccagtcaggttcccc

SEQ ID NO: 299495 - DNA, 25 bp, Rattus norvegicus
gaagagtgatcctgtcaggttcccc

SEQ ID NO: 299496 - DNA, 25 bp, Rattus norvegicus
gaagagtgatcgatccaaagcagga

SEQ ID NO: 299497 - DNA, 25 bp, Rattus norvegicus
gaagagtgatcgttccaaagcagga

SEQ ID NO: 299498 - DNA, 25 bp, Rattus norvegicus
gaagagtgatctatgtctcttcccc

SEQ ID NO: 299499 - DNA, 25 bp, Rattus norvegicus
gaagagtgatctttgtctcttcccc

SEQ ID NO: 299500 - DNA, 25 bp, Rattus norvegicus
gaagagtgcagactccctttccttg

SEQ ID NO: 299501 - DNA, 25 bp, Rattus norvegicus
gaagagtgcagagtccctttccttg

SEQ ID NO: 299502 - DNA, 25 bp, Rattus norvegicus
gaagagtgcagtcagcctgccctca

SEQ ID NO: 299503 - DNA, 25 bp, Rattus norvegicus
gaagagtgcagtgagcctgccctca

SEQ ID NO: 299504 - DNA, 25 bp, Rattus norvegicus
gaagagtgcatgactgcctgtgtgt

SEQ ID NO: 299505 - DNA, 25 bp, Rattus norvegicus
gaagagtgcatgtctgcctgtgtgt

SEQ ID NO: 299506 - DNA, 25 bp, Rattus norvegicus
gaagagtgccagagtttgctgcaat

SEQ ID NO: 299507 - DNA, 25 bp, Rattus norvegicus
gaagagtgccagtgtttgctgcaat

SEQ ID NO: 299508 - DNA, 25 bp, Rattus norvegicus
gaagagtgcggcacctttgatcatc

SEQ ID NO: 299509 - DNA, 25 bp, Rattus norvegicus
gaagagtgcggctcctttgatcatc

SEQ ID NO: 299510 - DNA, 25 bp, Rattus norvegicus
gaagagtgctatcgcccactgtgct

SEQ ID NO: 299511 - DNA, 25 bp, Rattus norvegicus
gaagagtgctatggcccactgtgct

SEQ ID NO: 299512 - DNA, 25 bp, Rattus norvegicus
gaagagtgctctagtcaggacagta

SEQ ID NO: 299513 - DNA, 25 bp, Rattus norvegicus
gaagagtgctcttgtcaggacagta

SEQ ID NO: 299514 - DNA, 25 bp, Rattus norvegicus
gaagagtgcttgaggctcttgcaga

SEQ ID NO: 299515 - DNA, 25 bp, Rattus norvegicus
gaagagtgcttgtggctcttgcaga

SEQ ID NO: 299516 - DNA, 25 bp, Rattus norvegicus
gaagagtgctttatgcctcacgata

SEQ ID NO: 299517 - DNA, 25 bp, Rattus norvegicus
gaagagtgctttatggtcctgaaaa

SEQ ID NO: 299518 - DNA, 25 bp, Rattus norvegicus
gaagagtgctttttgcctcacgata

SEQ ID NO: 299519 - DNA, 25 bp, Rattus norvegicus
gaagagtgctttttggtcctgaaaa

SEQ ID NO: 299520 - DNA, 25 bp, Rattus norvegicus
gaagagtggatcacctctcacagga

SEQ ID NO: 299521 - DNA, 25 bp, Rattus norvegicus
gaagagtggatctcctctcacagga

SEQ ID NO: 299522 - DNA, 25 bp, Rattus norvegicus
gaagagtggcacatttattgataga

SEQ ID NO: 299523 - DNA, 25 bp, Rattus norvegicus
gaagagtggcacttttattgataga

SEQ ID NO: 299524 - DNA, 25 bp, Rattus norvegicus
gaagagtgtctgagacccaaagtca

SEQ ID NO: 299525 - DNA, 25 bp, Rattus norvegicus
gaagagtgtctgtgacccaaagtca

SEQ ID NO: 299526 - DNA, 25 bp, Rattus norvegicus
gaagagtgtggaagtcactcccctc

SEQ ID NO: 299527 - DNA, 25 bp, Rattus norvegicus
gaagagtgtggatgtcactcccctc

SEQ ID NO: 299528 - DNA, 25 bp, Rattus norvegicus
gaagagtgttgtagttggccgtaaa

SEQ ID NO: 299529 - DNA, 25 bp, Rattus norvegicus
gaagagtgttgttgttggccgtaaa

SEQ ID NO: 299530 - DNA, 25 bp, Rattus norvegicus
gaagagtgtttcctcgcacaagaga

SEQ ID NO: 299531 - DNA, 25 bp, Rattus norvegicus
gaagagtgtttcgtcgcacaagaga

SEQ ID NO: 299532 - DNA, 25 bp, Rattus norvegicus
gaagagttacagcatctggccctaa

SEQ ID NO: 299533 - DNA, 25 bp, Rattus norvegicus
gaagagttacaggatctggccctaa

SEQ ID NO: 299534 - DNA, 25 bp, Rattus norvegicus
gaagagttacgtcaacgagagcact

SEQ ID NO: 299535 - DNA, 25 bp, Rattus norvegicus
gaagagttacgtgaacgagagcact

SEQ ID NO: 299536 - DNA, 25 bp, Rattus norvegicus
gaagagttatgcaccattggttact

SEQ ID NO: 299537 - DNA, 25 bp, Rattus norvegicus
gaagagttatgctccattggttact

SEQ ID NO: 299538 - DNA, 25 bp, Rattus norvegicus
gaagagttccacagagctgctccgg

SEQ ID NO: 299539 - DNA, 25 bp, Rattus norvegicus
gaagagttccactgagctgctccgg

SEQ ID NO: 299540 - DNA, 25 bp, Rattus norvegicus
gaagagttcgcgcaccccttcgctt

SEQ ID NO: 299541 - DNA, 25 bp, Rattus norvegicus
gaagagttcgcggaccccttcgctt

SEQ ID NO: 299542 - DNA, 25 bp, Rattus norvegicus
gaagagttctccctggacgcctatg

SEQ ID NO: 299543 - DNA, 25 bp, Rattus norvegicus
gaagagttctccgtggacgcctatg

SEQ ID NO: 299544 - DNA, 25 bp, Rattus norvegicus
gaagagttctgaccagacccctcaa

SEQ ID NO: 299545 - DNA, 25 bp, Rattus norvegicus
gaagagttctgagcagacccctcaa

SEQ ID NO: 299546 - DNA, 25 bp, Rattus norvegicus
gaagagttgctgaagggtccctcct

SEQ ID NO: 299547 - DNA, 25 bp, Rattus norvegicus
gaagagttgctgtagggtccctcct

SEQ ID NO: 299548 - DNA, 25 bp, Rattus norvegicus
gaagagttgcttcccaaagcacagc

SEQ ID NO: 299549 - DNA, 25 bp, Rattus norvegicus
gaagagttgcttgccaaagcacagc

SEQ ID NO: 299550 - DNA, 25 bp, Rattus norvegicus
gaagagtttccacaggagatgctga

SEQ ID NO: 299551 - DNA, 25 bp, Rattus norvegicus
gaagagtttccagaggagatgctga

SEQ ID NO: 299552 - DNA, 25 bp, Rattus norvegicus
gaagagtttcccaagccaaggcttt

SEQ ID NO: 299553 - DNA, 25 bp, Rattus norvegicus
gaagagtttcccaatgacgcagagt

SEQ ID NO: 299554 - DNA, 25 bp, Rattus norvegicus
gaagagtttccctagccaaggcttt

SEQ ID NO: 299555 - DNA, 25 bp, Rattus norvegicus
gaagagtttccctatgacgcagagt

SEQ ID NO: 299556 - DNA, 25 bp, Rattus norvegicus
gaagagtttctgcacactgttgaga

SEQ ID NO: 299557 - DNA, 25 bp, Rattus norvegicus
gaagagtttctggacactgttgaga

SEQ ID NO: 299558 - DNA, 25 bp, Rattus norvegicus
gaagagtttgctaatgttttgaata

SEQ ID NO: 299559 - DNA, 25 bp, Rattus norvegicus
gaagagtttgcttatgttttgaata

SEQ ID NO: 299560 - DNA, 25 bp, Rattus norvegicus
gaagagttttccaaacttgagacct

SEQ ID NO: 299561 - DNA, 25 bp, Rattus norvegicus
gaagagttttcctaacttgagacct

SEQ ID NO: 299562 - DNA, 25 bp, Rattus norvegicus
gaagataaactgctcctggtgggta

SEQ ID NO: 299563 - DNA, 25 bp, Rattus norvegicus
gaagataaactggtcctggtgggta

SEQ ID NO: 299564 - DNA, 25 bp, Rattus norvegicus
gaagataacacgattcccaaactga

SEQ ID NO: 299565 - DNA, 25 bp, Rattus norvegicus
gaagataacacgtttcccaaactga

SEQ ID NO: 299566 - DNA, 25 bp, Rattus norvegicus
gaagataaccagcacatccttaaat

SEQ ID NO: 299567 - DNA, 25 bp, Rattus norvegicus
gaagataaccaggacatccttaaat

SEQ ID NO: 299568 - DNA, 25 bp, Rattus norvegicus
gaagataacccaacatgcagctata

SEQ ID NO: 299569 - DNA, 25 bp, Rattus norvegicus
gaagataacccatcatgcagctata

SEQ ID NO: 299570 - DNA, 25 bp, Rattus norvegicus
gaagataactaaatcctgccggata

SEQ ID NO: 299571 - DNA, 25 bp, Rattus norvegicus
gaagataactaattcctgccggata

SEQ ID NO: 299572 - DNA, 25 bp, Rattus norvegicus
gaagataactcaaccttttcttatt

SEQ ID NO: 299573 - DNA, 25 bp, Rattus norvegicus
gaagataactcatccttttcttatt

SEQ ID NO: 299574 - DNA, 25 bp, Rattus norvegicus
gaagataagcctcacccaaagcatt

SEQ ID NO: 299575 - DNA, 25 bp, Rattus norvegicus
gaagataagcctgacccaaagcatt

SEQ ID NO: 299576 - DNA, 25 bp, Rattus norvegicus
gaagatacacacctctgatcagtcc

SEQ ID NO: 299577 - DNA, 25 bp, Rattus norvegicus
gaagatacacacgtctgatcagtcc

SEQ ID NO: 299578 - DNA, 25 bp, Rattus norvegicus
gaagatacacatctggccgtttcac

SEQ ID NO: 299579 - DNA, 25 bp, Rattus norvegicus
gaagatacacatgtggccgtttcac

SEQ ID NO: 299580 - DNA, 25 bp, Rattus norvegicus
gaagatacagacactactggaccct

SEQ ID NO: 299581 - DNA, 25 bp, Rattus norvegicus
gaagatacagactctactggaccct

SEQ ID NO: 299582 - DNA, 25 bp, Rattus norvegicus
gaagatacagcgcttcttgtcacag

SEQ ID NO: 299583 - DNA, 25 bp, Rattus norvegicus
gaagatacagcggttcttgtcacag

SEQ ID NO: 299584 - DNA, 25 bp, Rattus norvegicus
gaagatacaggcctctgtggctacc

SEQ ID NO: 299585 - DNA, 25 bp, Rattus norvegicus
gaagatacaggcgtctgtggctacc

SEQ ID NO: 299586 - DNA, 25 bp, Rattus norvegicus
gaagatacatcccagaaccagcact

SEQ ID NO: 299587 - DNA, 25 bp, Rattus norvegicus
gaagatacatccgagaaccagcact

SEQ ID NO: 299588 - DNA, 25 bp, Rattus norvegicus
gaagatacccttcttacaggttctc

SEQ ID NO: 299589 - DNA, 25 bp, Rattus norvegicus
gaagatacccttgttacaggttctc

SEQ ID NO: 299590 - DNA, 25 bp, Rattus norvegicus
gaagatacgtaccagcacgggccaa

SEQ ID NO: 299591 - DNA, 25 bp, Rattus norvegicus
gaagatacgtacgagcacgggccaa

SEQ ID NO: 299592 - DNA, 25 bp, Rattus norvegicus
gaagatactcagctttggctcctgg

SEQ ID NO: 299593 - DNA, 25 bp, Rattus norvegicus
gaagatactcaggtttggctcctgg

SEQ ID NO: 299594 - DNA, 25 bp, Rattus norvegicus
gaagatacttgactcctcatgcaac

SEQ ID NO: 299595 - DNA, 25 bp, Rattus norvegicus
gaagatacttgagtcctcatgcaac

SEQ ID NO: 299596 - DNA, 25 bp, Rattus norvegicus
gaagatacttttacgggacccattg

SEQ ID NO: 299597 - DNA, 25 bp, Rattus norvegicus
gaagatactttttcgggacccattg

SEQ ID NO: 299598 - DNA, 25 bp, Rattus norvegicus
gaagatagaacgctggcctcaagaa

SEQ ID NO: 299599 - DNA, 25 bp, Rattus norvegicus
gaagatagaacggtggcctcaagaa

SEQ ID NO: 299600 - DNA, 25 bp, Rattus norvegicus
gaagatagagctctcacttcccaaa

SEQ ID NO: 299601 - DNA, 25 bp, Rattus norvegicus
gaagatagagctgtcacttcccaaa

SEQ ID NO: 299602 - DNA, 25 bp, Rattus norvegicus
gaagatagcgcaagagccccagggc

SEQ ID NO: 299603 - DNA, 25 bp, Rattus norvegicus
gaagatagcgcatgagccccagggc

SEQ ID NO: 299604 - DNA, 25 bp, Rattus norvegicus
gaagatagcttcatctctgtccatg

SEQ ID NO: 299605 - DNA, 25 bp, Rattus norvegicus
gaagatagcttcttctctgtccatg

SEQ ID NO: 299606 - DNA, 25 bp, Rattus norvegicus
gaagatagtccacgctctgtctaac

SEQ ID NO: 299607 - DNA, 25 bp, Rattus norvegicus
gaagatagtccaggctctgtctaac

SEQ ID NO: 299608 - DNA, 25 bp, Rattus norvegicus
gaagatagttgaccccactgacctc

SEQ ID NO: 299609 - DNA, 25 bp, Rattus norvegicus
gaagatagttgagcccactgacctc

SEQ ID NO: 299610 - DNA, 25 bp, Rattus norvegicus
gaagatatacttcggtgactgggaa

SEQ ID NO: 299611 - DNA, 25 bp, Rattus norvegicus
gaagatatacttgggtgactgggaa

SEQ ID NO: 299612 - DNA, 25 bp, Rattus norvegicus
gaagatatcaataccctcaatcccg

SEQ ID NO: 299613 - DNA, 25 bp, Rattus norvegicus
gaagatatcaattccctcaatcccg

SEQ ID NO: 299614 - DNA, 25 bp, Rattus norvegicus
gaagatatcactagttttgagtttg

SEQ ID NO: 299615 - DNA, 25 bp, Rattus norvegicus
gaagatatcacttgttttgagtttg

SEQ ID NO: 299616 - DNA, 25 bp, Rattus norvegicus
gaagatatgctcctgaaagtgctag

SEQ ID NO: 299617 - DNA, 25 bp, Rattus norvegicus
gaagatatgctcgtgaaagtgctag

SEQ ID NO: 299618 - DNA, 25 bp, Rattus norvegicus
gaagatatgtctcatttgtcctaaa

SEQ ID NO: 299619 - DNA, 25 bp, Rattus norvegicus
gaagatatgtctgatttgtcctaaa

SEQ ID NO: 299620 - DNA, 25 bp, Rattus norvegicus
gaagatatgttcctctgacctttga

SEQ ID NO: 299621 - DNA, 25 bp, Rattus norvegicus
gaagatatgttcgtctgacctttga

SEQ ID NO: 299622 - DNA, 25 bp, Rattus norvegicus
gaagatattcccctgcttgctgagc

SEQ ID NO: 299623 - DNA, 25 bp, Rattus norvegicus
gaagatattcccgtgcttgctgagc

SEQ ID NO: 299624 - DNA, 25 bp, Rattus norvegicus
gaagatattcgaaccattggcgaag

SEQ ID NO: 299625 - DNA, 25 bp, Rattus norvegicus
gaagatattcgatccattggcgaag

SEQ ID NO: 299626 - DNA, 25 bp, Rattus norvegicus
gaagatcaactcaaccatcaactcg

SEQ ID NO: 299627 - DNA, 25 bp, Rattus norvegicus
gaagatcaactctaccatcaactcg

SEQ ID NO: 299628 - DNA, 25 bp, Rattus norvegicus
gaagatcaccatctccgactgtgga

SEQ ID NO: 299629 - DNA, 25 bp, Rattus norvegicus
gaagatcaccatgtccgactgtgga

SEQ ID NO: 299630 - DNA, 25 bp, Rattus norvegicus
gaagatcacccacaagctctaagct

SEQ ID NO: 299631 - DNA, 25 bp, Rattus norvegicus
gaagatcacccagaagctctaagct

SEQ ID NO: 299632 - DNA, 25 bp, Rattus norvegicus
gaagatcacctgaaagacctgggtc

SEQ ID NO: 299633 - DNA, 25 bp, Rattus norvegicus
gaagatcacctgtaagacctgggtc

SEQ ID NO: 299634 - DNA, 25 bp, Rattus norvegicus
gaagatcactaccactttagttaca

SEQ ID NO: 299635 - DNA, 25 bp, Rattus norvegicus
gaagatcactacgactttagttaca

SEQ ID NO: 299636 - DNA, 25 bp, Rattus norvegicus
gaagatcactgcacccatgcagaag

SEQ ID NO: 299637 - DNA, 25 bp, Rattus norvegicus
gaagatcactgctcccatgcagaag

SEQ ID NO: 299638 - DNA, 25 bp, Rattus norvegicus
gaagatcactggatccttttataaa

SEQ ID NO: 299639 - DNA, 25 bp, Rattus norvegicus
gaagatcactggttccttttataaa

SEQ ID NO: 299640 - DNA, 25 bp, Rattus norvegicus
gaagatcagactaagctgctaacac

SEQ ID NO: 299641 - DNA, 25 bp, Rattus norvegicus
gaagatcagacttagctgctaacac

SEQ ID NO: 299642 - DNA, 25 bp, Rattus norvegicus
gaagatcagcataaagcccacctgc

SEQ ID NO: 299643 - DNA, 25 bp, Rattus norvegicus
gaagatcagcattaagcccacctgc

SEQ ID NO: 299644 - DNA, 25 bp, Rattus norvegicus
gaagatcatcaaaccctacagtaag

SEQ ID NO: 299645 - DNA, 25 bp, Rattus norvegicus
gaagatcatcaatccctacagtaag

SEQ ID NO: 299646 - DNA, 25 bp, Rattus norvegicus
gaagatcatcatcggtctggacaag

SEQ ID NO: 299647 - DNA, 25 bp, Rattus norvegicus
gaagatcatcatgggtctggacaag

SEQ ID NO: 299648 - DNA, 25 bp, Rattus norvegicus
gaagatcatcgtacaagacggtgat

SEQ ID NO: 299649 - DNA, 25 bp, Rattus norvegicus
gaagatcatcgttcaagacggtgat

SEQ ID NO: 299650 - DNA, 25 bp, Rattus norvegicus
gaagatcatctcagcaattggtcta

SEQ ID NO: 299651 - DNA, 25 bp, Rattus norvegicus
gaagatcatctctgcaattggtcta

SEQ ID NO: 299652 - DNA, 25 bp, Rattus norvegicus
gaagatccaactaccaccttagatc

SEQ ID NO: 299653 - DNA, 25 bp, Rattus norvegicus
gaagatccaacttccaccttagatc

SEQ ID NO: 299654 - DNA, 25 bp, Rattus norvegicus
gaagatccaagtccaagtcctcgtc

SEQ ID NO: 299655 - DNA, 25 bp, Rattus norvegicus
gaagatccaagtgcaagtcctcgtc

SEQ ID NO: 299656 - DNA, 25 bp, Rattus norvegicus
gaagatccacgaaaggttcctatgc

SEQ ID NO: 299657 - DNA, 25 bp, Rattus norvegicus
gaagatccacgacaacgagaagcgc

SEQ ID NO: 299658 - DNA, 25 bp, Rattus norvegicus
gaagatccacgagaacgagaagcgc

SEQ ID NO: 299659 - DNA, 25 bp, Rattus norvegicus
gaagatccacgataggttcctatgc

SEQ ID NO: 299660 - DNA, 25 bp, Rattus norvegicus
gaagatccaggaagaacaccttcct

SEQ ID NO: 299661 - DNA, 25 bp, Rattus norvegicus
gaagatccaggatgaacaccttcct

SEQ ID NO: 299662 - DNA, 25 bp, Rattus norvegicus
gaagatccaggcagaattcccaaca

SEQ ID NO: 299663 - DNA, 25 bp, Rattus norvegicus
gaagatccaggctgaattcccaaca

SEQ ID NO: 299664 - DNA, 25 bp, Rattus norvegicus
gaagatccagttaacggttccgctg

SEQ ID NO: 299665 - DNA, 25 bp, Rattus norvegicus
gaagatccagtttacggttccgctg

SEQ ID NO: 299666 - DNA, 25 bp, Rattus norvegicus
gaagatccatcacaagcaggaggaa

SEQ ID NO: 299667 - DNA, 25 bp, Rattus norvegicus
gaagatccatcagaagcaggaggaa

SEQ ID NO: 299668 - DNA, 25 bp, Rattus norvegicus
gaagatccattgctaaactctgctg

SEQ ID NO: 299669 - DNA, 25 bp, Rattus norvegicus
gaagatccattggtaaactctgctg

SEQ ID NO: 299670 - DNA, 25 bp, Rattus norvegicus
gaagatccccaaaggcaagcttttg

SEQ ID NO: 299671 - DNA, 25 bp, Rattus norvegicus
gaagatccccaactcaagtcacatt

SEQ ID NO: 299672 - DNA, 25 bp, Rattus norvegicus
gaagatccccaagtcaagtcacatt

SEQ ID NO: 299673 - DNA, 25 bp, Rattus norvegicus
gaagatccccaatggcaagcttttg

SEQ ID NO: 299674 - DNA, 25 bp, Rattus norvegicus
gaagatcccttcaggtgctgtagga

SEQ ID NO: 299675 - DNA, 25 bp, Rattus norvegicus
gaagatcccttctggtgctgtagga

SEQ ID NO: 299676 - DNA, 25 bp, Rattus norvegicus
gaagatcccttgaaacctgggctct

SEQ ID NO: 299677 - DNA, 25 bp, Rattus norvegicus
gaagatcccttgtaacctgggctct

SEQ ID NO: 299678 - DNA, 25 bp, Rattus norvegicus
gaagatccgaagcttccagccagca

SEQ ID NO: 299679 - DNA, 25 bp, Rattus norvegicus
gaagatccgaaggttccagccagca

SEQ ID NO: 299680 - DNA, 25 bp, Rattus norvegicus
gaagatccgaccaaactgctcgaag

SEQ ID NO: 299681 - DNA, 25 bp, Rattus norvegicus
gaagatccgacctaactgctcgaag

SEQ ID NO: 299682 - DNA, 25 bp, Rattus norvegicus
gaagatcctaacaagtcctctgtgt

SEQ ID NO: 299683 - DNA, 25 bp, Rattus norvegicus
gaagatcctaactagtcctctgtgt

SEQ ID NO: 299684 - DNA, 25 bp, Rattus norvegicus
gaagatcctctaaatcgcattgcct

SEQ ID NO: 299685 - DNA, 25 bp, Rattus norvegicus
gaagatcctctatatcgcattgcct

SEQ ID NO: 299686 - DNA, 25 bp, Rattus norvegicus
gaagatcctcttatagacgtgtagt

SEQ ID NO: 299687 - DNA, 25 bp, Rattus norvegicus
gaagatcctcttccaggagactcgg

SEQ ID NO: 299688 - DNA, 25 bp, Rattus norvegicus
gaagatcctcttgcaggagactcgg

SEQ ID NO: 299689 - DNA, 25 bp, Rattus norvegicus
gaagatcctcttttagacgtgtagt

SEQ ID NO: 299690 - DNA, 25 bp, Rattus norvegicus
gaagatcctgaccgagcgtggctac

SEQ ID NO: 299691 - DNA, 25 bp, Rattus norvegicus
gaagatcctgacggagcgtggctac

SEQ ID NO: 299692 - DNA, 25 bp, Rattus norvegicus
gaagatcctgccaaaagctcaaagt

SEQ ID NO: 299693 - DNA, 25 bp, Rattus norvegicus
gaagatcctgcctaaagctcaaagt

SEQ ID NO: 299694 - DNA, 25 bp, Rattus norvegicus
gaagatcctgttatattccagctct

SEQ ID NO: 299695 - DNA, 25 bp, Rattus norvegicus
gaagatcctgttttattccagctct

SEQ ID NO: 299696 - DNA, 25 bp, Rattus norvegicus
gaagatccttccaagttaggccatg

SEQ ID NO: 299697 - DNA, 25 bp, Rattus norvegicus
gaagatccttcctagttaggccatg

SEQ ID NO: 299698 - DNA, 25 bp, Rattus norvegicus
gaagatcgacctctggcatcaggag

SEQ ID NO: 299699 - DNA, 25 bp, Rattus norvegicus
gaagatcgacctgtggcatcaggag

SEQ ID NO: 299700 - DNA, 25 bp, Rattus norvegicus
gaagatcgagccagtagtcctgcca

SEQ ID NO: 299701 - DNA, 25 bp, Rattus norvegicus
gaagatcgagcctgtagtcctgcca

SEQ ID NO: 299702 - DNA, 25 bp, Rattus norvegicus
gaagatcgccgccatcgccgagaaa

SEQ ID NO: 299703 - DNA, 25 bp, Rattus norvegicus
gaagatcgccgcgatcgccgagaaa

SEQ ID NO: 299704 - DNA, 25 bp, Rattus norvegicus
gaagatcgcgtaagcaaccacctgg

SEQ ID NO: 299705 - DNA, 25 bp, Rattus norvegicus
gaagatcgcgtatgcaaccacctgg

SEQ ID NO: 299706 - DNA, 25 bp, Rattus norvegicus
gaagatcggattatccttttcagaa

SEQ ID NO: 299707 - DNA, 25 bp, Rattus norvegicus
gaagatcggattctcatggcacacg

SEQ ID NO: 299708 - DNA, 25 bp, Rattus norvegicus
gaagatcggattgtcatggcacacg

SEQ ID NO: 299709 - DNA, 25 bp, Rattus norvegicus
gaagatcggattttccttttcagaa

SEQ ID NO: 299710 - DNA, 25 bp, Rattus norvegicus
gaagatcggcttcctgaatgacaag

SEQ ID NO: 299711 - DNA, 25 bp, Rattus norvegicus
gaagatcggcttgctgaatgacaag

SEQ ID NO: 299712 - DNA, 25 bp, Rattus norvegicus
gaagatcgtcggaaacaaatgggaa

SEQ ID NO: 299713 - DNA, 25 bp, Rattus norvegicus
gaagatcgtcggtaacaaatgggaa

SEQ ID NO: 299714 - DNA, 25 bp, Rattus norvegicus
gaagatcgtgtcatgctttgccagt

SEQ ID NO: 299715 - DNA, 25 bp, Rattus norvegicus
gaagatcgtgtcttgctttgccagt

SEQ ID NO: 299716 - DNA, 25 bp, Rattus norvegicus
gaagatcgttcgagcccaagtttga

SEQ ID NO: 299717 - DNA, 25 bp, Rattus norvegicus
gaagatcgttcgtgcccaagtttga

SEQ ID NO: 299718 - DNA, 25 bp, Rattus norvegicus
gaagatctaaatctccaggtcagca

SEQ ID NO: 299719 - DNA, 25 bp, Rattus norvegicus
gaagatctaaatgtccaggtcagca

SEQ ID NO: 299720 - DNA, 25 bp, Rattus norvegicus
gaagatctaggtaacaagggcccat

SEQ ID NO: 299721 - DNA, 25 bp, Rattus norvegicus
gaagatctaggtattgtcacctgct

SEQ ID NO: 299722 - DNA, 25 bp, Rattus norvegicus
gaagatctaggttacaagggcccat

SEQ ID NO: 299723 - DNA, 25 bp, Rattus norvegicus
gaagatctaggttttgtcacctgct

SEQ ID NO: 299724 - DNA, 25 bp, Rattus norvegicus
gaagatctatgcaagtacctgctct

SEQ ID NO: 299725 - DNA, 25 bp, Rattus norvegicus
gaagatctatgctagtacctgctct

SEQ ID NO: 299726 - DNA, 25 bp, Rattus norvegicus
gaagatctcagacagtctggacata

SEQ ID NO: 299727 - DNA, 25 bp, Rattus norvegicus
gaagatctcagagagtctggacata

SEQ ID NO: 299728 - DNA, 25 bp, Rattus norvegicus
gaagatctccgaaacactgaccagt

SEQ ID NO: 299729 - DNA, 25 bp, Rattus norvegicus
gaagatctccgatacactgaccagt

SEQ ID NO: 299730 - DNA, 25 bp, Rattus norvegicus
gaagatctccgtaagccagaggtca

SEQ ID NO: 299731 - DNA, 25 bp, Rattus norvegicus
gaagatctccgttagccagaggtca

SEQ ID NO: 299732 - DNA, 25 bp, Rattus norvegicus
gaagatctcctgcttaccgtgtatt

SEQ ID NO: 299733 - DNA, 25 bp, Rattus norvegicus
gaagatctcctggttaccgtgtatt

SEQ ID NO: 299734 - DNA, 25 bp, Rattus norvegicus
gaagatctctttaccagagaagcag

SEQ ID NO: 299735 - DNA, 25 bp, Rattus norvegicus
gaagatctctttaccgcagaaacag

SEQ ID NO: 299736 - DNA, 25 bp, Rattus norvegicus
gaagatctcttttccagagaagcag

SEQ ID NO: 299737 - DNA, 25 bp, Rattus norvegicus
gaagatctcttttccgcagaaacag

SEQ ID NO: 299738 - DNA, 25 bp, Rattus norvegicus
gaagatctgaaccacctgtaggcaa

SEQ ID NO: 299739 - DNA, 25 bp, Rattus norvegicus
gaagatctgaacgacctgtaggcaa

SEQ ID NO: 299740 - DNA, 25 bp, Rattus norvegicus
gaagatctgaccacagctgactgtc

SEQ ID NO: 299741 - DNA, 25 bp, Rattus norvegicus
gaagatctgacctcagctgactgtc

SEQ ID NO: 299742 - DNA, 25 bp, Rattus norvegicus
gaagatctgagcctcactaaccagg

SEQ ID NO: 299743 - DNA, 25 bp, Rattus norvegicus
gaagatctgagcgtcactaaccagg

SEQ ID NO: 299744 - DNA, 25 bp, Rattus norvegicus
gaagatctgataccctgggtctccc

SEQ ID NO: 299745 - DNA, 25 bp, Rattus norvegicus
gaagatctgatagcctgggtctccc

SEQ ID NO: 299746 - DNA, 25 bp, Rattus norvegicus
gaagatctgcccactgaagccaaag

SEQ ID NO: 299747 - DNA, 25 bp, Rattus norvegicus
gaagatctgccctctgaagccaaag

SEQ ID NO: 299748 - DNA, 25 bp, Rattus norvegicus
gaagatctgctcaagacgtccagca

SEQ ID NO: 299749 - DNA, 25 bp, Rattus norvegicus
gaagatctgctctagacgtccagca

SEQ ID NO: 299750 - DNA, 25 bp, Rattus norvegicus
gaagatctggaacctagccgacatt

SEQ ID NO: 299751 - DNA, 25 bp, Rattus norvegicus
gaagatctggaagctagccgacatt

SEQ ID NO: 299752 - DNA, 25 bp, Rattus norvegicus
gaagatctgggactatctgaaacta

SEQ ID NO: 299753 - DNA, 25 bp, Rattus norvegicus
gaagatctgggagtatctgaaacta

SEQ ID NO: 299754 - DNA, 25 bp, Rattus norvegicus
gaagatctggttaacctcaaagtca

SEQ ID NO: 299755 - DNA, 25 bp, Rattus norvegicus
gaagatctggtttacctcaaagtca

SEQ ID NO: 299756 - DNA, 25 bp, Rattus norvegicus
gaagatctgtgaccagagcctgctg

SEQ ID NO: 299757 - DNA, 25 bp, Rattus norvegicus
gaagatctgtgagcagagcctgctg

SEQ ID NO: 299758 - DNA, 25 bp, Rattus norvegicus
gaagatcttaaccttgggcttgaac

SEQ ID NO: 299759 - DNA, 25 bp, Rattus norvegicus
gaagatcttaacgttgggcttgaac

SEQ ID NO: 299760 - DNA, 25 bp, Rattus norvegicus
gaagatcttagccactctctctgga

SEQ ID NO: 299761 - DNA, 25 bp, Rattus norvegicus
gaagatcttagcgactctctctgga

SEQ ID NO: 299762 - DNA, 25 bp, Rattus norvegicus
gaagatcttcagagtaagcaccacc

SEQ ID NO: 299763 - DNA, 25 bp, Rattus norvegicus
gaagatcttcagtgtaagcaccacc

SEQ ID NO: 299764 - DNA, 25 bp, Rattus norvegicus
gaagatctttgaagttcacggccaa

SEQ ID NO: 299765 - DNA, 25 bp, Rattus norvegicus
gaagatctttgatgttcacggccaa

SEQ ID NO: 299766 - DNA, 25 bp, Rattus norvegicus
gaagatctttgtcactccattttgt

SEQ ID NO: 299767 - DNA, 25 bp, Rattus norvegicus
gaagatctttgtgactccattttgt

SEQ ID NO: 299768 - DNA, 25 bp, Rattus norvegicus
gaagatcttttcactatccttcctc

SEQ ID NO: 299769 - DNA, 25 bp, Rattus norvegicus
gaagatcttttctctatccttcctc

SEQ ID NO: 299770 - DNA, 25 bp, Rattus norvegicus
gaagatgaaaacaccactctctgcc

SEQ ID NO: 299771 - DNA, 25 bp, Rattus norvegicus
gaagatgaaaactccactctctgcc

SEQ ID NO: 299772 - DNA, 25 bp, Rattus norvegicus
gaagatgaaatgagcccaccgcaaa

SEQ ID NO: 299773 - DNA, 25 bp, Rattus norvegicus
gaagatgaaatgtgcccaccgcaaa

SEQ ID NO: 299774 - DNA, 25 bp, Rattus norvegicus
gaagatgaatacactgttcagctgg

SEQ ID NO: 299775 - DNA, 25 bp, Rattus norvegicus
gaagatgaatactctgttcagctgg

SEQ ID NO: 299776 - DNA, 25 bp, Rattus norvegicus
gaagatgaatgaagcccctgagact

SEQ ID NO: 299777 - DNA, 25 bp, Rattus norvegicus
gaagatgaatgatgcccctgagact

SEQ ID NO: 299778 - DNA, 25 bp, Rattus norvegicus
gaagatgacacacaatgtccagaaa

SEQ ID NO: 299779 - DNA, 25 bp, Rattus norvegicus
gaagatgacacagaatgtccagaaa

SEQ ID NO: 299780 - DNA, 25 bp, Rattus norvegicus
gaagatgacagcaatcaagcacgca

SEQ ID NO: 299781 - DNA, 25 bp, Rattus norvegicus
gaagatgacagctatcaagcacgca

SEQ ID NO: 299782 - DNA, 25 bp, Rattus norvegicus
gaagatgaccaactccccagaggag

SEQ ID NO: 299783 - DNA, 25 bp, Rattus norvegicus
gaagatgaccaagtccccagaggag

SEQ ID NO: 299784 - DNA, 25 bp, Rattus norvegicus
gaagatgacctcagctacctgcaga

SEQ ID NO: 299785 - DNA, 25 bp, Rattus norvegicus
gaagatgacctctgctacctgcaga

SEQ ID NO: 299786 - DNA, 25 bp, Rattus norvegicus
gaagatgacctgctcgacctgaacc

SEQ ID NO: 299787 - DNA, 25 bp, Rattus norvegicus
gaagatgacctggtcgacctgaacc

SEQ ID NO: 299788 - DNA, 25 bp, Rattus norvegicus
gaagatgacgagctcctaatcgaaa

SEQ ID NO: 299789 - DNA, 25 bp, Rattus norvegicus
gaagatgacgaggtcctaatcgaaa

SEQ ID NO: 299790 - DNA, 25 bp, Rattus norvegicus
gaagatgactccagtgaatatagca

SEQ ID NO: 299791 - DNA, 25 bp, Rattus norvegicus
gaagatgactcctgtgaatatagca

SEQ ID NO: 299792 - DNA, 25 bp, Rattus norvegicus
gaagatgagaacaaccctggctggt

SEQ ID NO: 299793 - DNA, 25 bp, Rattus norvegicus
gaagatgagaactaccctggctggt

SEQ ID NO: 299794 - DNA, 25 bp, Rattus norvegicus
gaagatgagactacctactcgctca

SEQ ID NO: 299795 - DNA, 25 bp, Rattus norvegicus
gaagatgagacttcctactcgctca

SEQ ID NO: 299796 - DNA, 25 bp, Rattus norvegicus
gaagatgagcctcaagtgcctggct

SEQ ID NO: 299797 - DNA, 25 bp, Rattus norvegicus
gaagatgagcctgaagtgcctggct

SEQ ID NO: 299798 - DNA, 25 bp, Rattus norvegicus
gaagatgaggtcatgcctccgcagg

SEQ ID NO: 299799 - DNA, 25 bp, Rattus norvegicus
gaagatgaggtcttgcctccgcagg

SEQ ID NO: 299800 - DNA, 25 bp, Rattus norvegicus
gaagatgaggtgctgctctcacagt

SEQ ID NO: 299801 - DNA, 25 bp, Rattus norvegicus
gaagatgaggtggtgctctcacagt

SEQ ID NO: 299802 - DNA, 25 bp, Rattus norvegicus
gaagatgagtgtctacacgacaagg

SEQ ID NO: 299803 - DNA, 25 bp, Rattus norvegicus
gaagatgagtgtgtacacgacaagg

SEQ ID NO: 299804 - DNA, 25 bp, Rattus norvegicus
gaagatgatactcactaccctcgct

SEQ ID NO: 299805 - DNA, 25 bp, Rattus norvegicus
gaagatgatactgactaccctcgct

SEQ ID NO: 299806 - DNA, 25 bp, Rattus norvegicus
gaagatgatcaactctcggcccatg

SEQ ID NO: 299807 - DNA, 25 bp, Rattus norvegicus
gaagatgatcaagtctcggcccatg

SEQ ID NO: 299808 - DNA, 25 bp, Rattus norvegicus
gaagatgatcgcctctttgcatatt

SEQ ID NO: 299809 - DNA, 25 bp, Rattus norvegicus
gaagatgatcgcgtctttgcatatt

SEQ ID NO: 299810 - DNA, 25 bp, Rattus norvegicus
gaagatgatctgactctgagccttg

SEQ ID NO: 299811 - DNA, 25 bp, Rattus norvegicus
gaagatgatctgtctctgagccttg

SEQ ID NO: 299812 - DNA, 25 bp, Rattus norvegicus
gaagatgatcttccatcggttgcta

SEQ ID NO: 299813 - DNA, 25 bp, Rattus norvegicus
gaagatgatcttgcatcggttgcta

SEQ ID NO: 299814 - DNA, 25 bp, Rattus norvegicus
gaagatgatggccttgttccttgtc

SEQ ID NO: 299815 - DNA, 25 bp, Rattus norvegicus
gaagatgatggcgttgttccttgtc

SEQ ID NO: 299816 - DNA, 25 bp, Rattus norvegicus
gaagatgattatatcccggtttcaa

SEQ ID NO: 299817 - DNA, 25 bp, Rattus norvegicus
gaagatgattatttcccggtttcaa

SEQ ID NO: 299818 - DNA, 25 bp, Rattus norvegicus
gaagatgattttacagataaccaga

SEQ ID NO: 299819 - DNA, 25 bp, Rattus norvegicus
gaagatgatttttcagataaccaga

SEQ ID NO: 299820 - DNA, 25 bp, Rattus norvegicus
gaagatgcaaagctagatgccaaag

SEQ ID NO: 299821 - DNA, 25 bp, Rattus norvegicus
gaagatgcaaaggtagatgccaaag

SEQ ID NO: 299822 - DNA, 25 bp, Rattus norvegicus
gaagatgcacatattgtctgcaact

SEQ ID NO: 299823 - DNA, 25 bp, Rattus norvegicus
gaagatgcacattttgtctgcaact

SEQ ID NO: 299824 - DNA, 25 bp, Rattus norvegicus
gaagatgcaccaagtgttgcttgag

SEQ ID NO: 299825 - DNA, 25 bp, Rattus norvegicus
gaagatgcaccatgtgttgcttgag

SEQ ID NO: 299826 - DNA, 25 bp, Rattus norvegicus
gaagatgcacctaactctcgagact

SEQ ID NO: 299827 - DNA, 25 bp, Rattus norvegicus
gaagatgcacctcagatggtaacaa

SEQ ID NO: 299828 - DNA, 25 bp, Rattus norvegicus
gaagatgcacctcgttatgtttctg

SEQ ID NO: 299829 - DNA, 25 bp, Rattus norvegicus
gaagatgcacctgagatggtaacaa

SEQ ID NO: 299830 - DNA, 25 bp, Rattus norvegicus
gaagatgcacctggttatgtttctg

SEQ ID NO: 299831 - DNA, 25 bp, Rattus norvegicus
gaagatgcaccttactctcgagact

SEQ ID NO: 299832 - DNA, 25 bp, Rattus norvegicus
gaagatgcagaaccagcccggcaga

SEQ ID NO: 299833 - DNA, 25 bp, Rattus norvegicus
gaagatgcagaagcagcccggcaga

SEQ ID NO: 299834 - DNA, 25 bp, Rattus norvegicus
gaagatgcagacctttccagacctc

SEQ ID NO: 299835 - DNA, 25 bp, Rattus norvegicus
gaagatgcagacgtttccagacctc

SEQ ID NO: 299836 - DNA, 25 bp, Rattus norvegicus
gaagatgcagcacgaggcggcggct

SEQ ID NO: 299837 - DNA, 25 bp, Rattus norvegicus
gaagatgcagcaggaggcggcggct

SEQ ID NO: 299838 - DNA, 25 bp, Rattus norvegicus
gaagatgcagttagtcctagagtac

SEQ ID NO: 299839 - DNA, 25 bp, Rattus norvegicus
gaagatgcagtttgtcctagagtac

SEQ ID NO: 299840 - DNA, 25 bp, Rattus norvegicus
gaagatgcatggatgttgccctgcg

SEQ ID NO: 299841 - DNA, 25 bp, Rattus norvegicus
gaagatgcatggttgttgccctgcg

SEQ ID NO: 299842 - DNA, 25 bp, Rattus norvegicus
gaagatgccaaactttctgctgctg

SEQ ID NO: 299843 - DNA, 25 bp, Rattus norvegicus
gaagatgccaaagtttctgctgctg

SEQ ID NO: 299844 - DNA, 25 bp, Rattus norvegicus
gaagatgccagccatacacagcctg

SEQ ID NO: 299845 - DNA, 25 bp, Rattus norvegicus
gaagatgccagccttgtttcagctt

SEQ ID NO: 299846 - DNA, 25 bp, Rattus norvegicus
gaagatgccagcgatacacagcctg

SEQ ID NO: 299847 - DNA, 25 bp, Rattus norvegicus
gaagatgccagcgttgtttcagctt

SEQ ID NO: 299848 - DNA, 25 bp, Rattus norvegicus
gaagatgccatcagtccagctgtga

SEQ ID NO: 299849 - DNA, 25 bp, Rattus norvegicus
gaagatgccatcatgcactcagaag

SEQ ID NO: 299850 - DNA, 25 bp, Rattus norvegicus
gaagatgccatctgtccagctgtga

SEQ ID NO: 299851 - DNA, 25 bp, Rattus norvegicus
gaagatgccatcttgcactcagaag

SEQ ID NO: 299852 - DNA, 25 bp, Rattus norvegicus
gaagatgccatgataagtcccacag

SEQ ID NO: 299853 - DNA, 25 bp, Rattus norvegicus
gaagatgccatgttaagtcccacag

SEQ ID NO: 299854 - DNA, 25 bp, Rattus norvegicus
gaagatgcccatcgaccatgagcca

SEQ ID NO: 299855 - DNA, 25 bp, Rattus norvegicus
gaagatgcccatggaccatgagcca

SEQ ID NO: 299856 - DNA, 25 bp, Rattus norvegicus
gaagatgccccgagggtttgttcac

SEQ ID NO: 299857 - DNA, 25 bp, Rattus norvegicus
gaagatgccccgcaagtcattgcct

SEQ ID NO: 299858 - DNA, 25 bp, Rattus norvegicus
gaagatgccccggaagtcattgcct

SEQ ID NO: 299859 - DNA, 25 bp, Rattus norvegicus
gaagatgccccgtgggtttgttcac

SEQ ID NO: 299860 - DNA, 25 bp, Rattus norvegicus
gaagatgccctaagctgtgtactct

SEQ ID NO: 299861 - DNA, 25 bp, Rattus norvegicus
gaagatgccctatgctgtgtactct

SEQ ID NO: 299862 - DNA, 25 bp, Rattus norvegicus
gaagatgcccttccggtgacatgat

SEQ ID NO: 299863 - DNA, 25 bp, Rattus norvegicus
gaagatgcccttgcggtgacatgat

SEQ ID NO: 299864 - DNA, 25 bp, Rattus norvegicus
gaagatgccgacaggttcatgaaca

SEQ ID NO: 299865 - DNA, 25 bp, Rattus norvegicus
gaagatgccgacagttatgatgatg

SEQ ID NO: 299866 - DNA, 25 bp, Rattus norvegicus
gaagatgccgactggttcatgaaca

SEQ ID NO: 299867 - DNA, 25 bp, Rattus norvegicus
gaagatgccgactgttatgatgatg

SEQ ID NO: 299868 - DNA, 25 bp, Rattus norvegicus
gaagatgcctacatgctgttgagtt

SEQ ID NO: 299869 - DNA, 25 bp, Rattus norvegicus
gaagatgcctacttgctgttgagtt

SEQ ID NO: 299870 - DNA, 25 bp, Rattus norvegicus
gaagatgcgaatactcctgctggag

SEQ ID NO: 299871 - DNA, 25 bp, Rattus norvegicus
gaagatgcgaattctcctgctggag

SEQ ID NO: 299872 - DNA, 25 bp, Rattus norvegicus
gaagatgcgattactggttgccaag

SEQ ID NO: 299873 - DNA, 25 bp, Rattus norvegicus
gaagatgcgatttctggttgccaag

SEQ ID NO: 299874 - DNA, 25 bp, Rattus norvegicus
gaagatgctactcctatttctaatt

SEQ ID NO: 299875 - DNA, 25 bp, Rattus norvegicus
gaagatgctactgctatttctaatt

SEQ ID NO: 299876 - DNA, 25 bp, Rattus norvegicus
gaagatgctcacaaccatttcatag

SEQ ID NO: 299877 - DNA, 25 bp, Rattus norvegicus
gaagatgctcactaccatttcatag

SEQ ID NO: 299878 - DNA, 25 bp, Rattus norvegicus
gaagatgctcccatgattaccggat

SEQ ID NO: 299879 - DNA, 25 bp, Rattus norvegicus
gaagatgctcccttgattaccggat

SEQ ID NO: 299880 - DNA, 25 bp, Rattus norvegicus
gaagatgctcgcagagacgctgact

SEQ ID NO: 299881 - DNA, 25 bp, Rattus norvegicus
gaagatgctcgctgagacgctgact

SEQ ID NO: 299882 - DNA, 25 bp, Rattus norvegicus
gaagatgctcttcgcccagtggaga

SEQ ID NO: 299883 - DNA, 25 bp, Rattus norvegicus
gaagatgctcttggcccagtggaga

SEQ ID NO: 299884 - DNA, 25 bp, Rattus norvegicus
gaagatgctgatcactatgaataat

SEQ ID NO: 299885 - DNA, 25 bp, Rattus norvegicus
gaagatgctgatgactatgaataat

SEQ ID NO: 299886 - DNA, 25 bp, Rattus norvegicus
gaagatgctgctctaatactcgaca

SEQ ID NO: 299887 - DNA, 25 bp, Rattus norvegicus
gaagatgctgctgtaatactcgaca

SEQ ID NO: 299888 - DNA, 25 bp, Rattus norvegicus
gaagatgctgtccagatctcaggcc

SEQ ID NO: 299889 - DNA, 25 bp, Rattus norvegicus
gaagatgctgtcgagatctcaggcc

SEQ ID NO: 299890 - DNA, 25 bp, Rattus norvegicus
gaagatgcttccagttaggcttaac

SEQ ID NO: 299891 - DNA, 25 bp, Rattus norvegicus
gaagatgcttcctgttaggcttaac

SEQ ID NO: 299892 - DNA, 25 bp, Rattus norvegicus
gaagatgcttctcattactttttaa

SEQ ID NO: 299893 - DNA, 25 bp, Rattus norvegicus
gaagatgcttctgattactttttaa

SEQ ID NO: 299894 - DNA, 25 bp, Rattus norvegicus
gaagatgcttgtagctgccggtttc

SEQ ID NO: 299895 - DNA, 25 bp, Rattus norvegicus
gaagatgcttgttgctgccggtttc

SEQ ID NO: 299896 - DNA, 25 bp, Rattus norvegicus
gaagatggacaacatccgtgggatt

SEQ ID NO: 299897 - DNA, 25 bp, Rattus norvegicus
gaagatggacaagatccgtgggatt

SEQ ID NO: 299898 - DNA, 25 bp, Rattus norvegicus
gaagatggcagcagtttttctacct

SEQ ID NO: 299899 - DNA, 25 bp, Rattus norvegicus
gaagatggcagctgtttttctacct

SEQ ID NO: 299900 - DNA, 25 bp, Rattus norvegicus
gaagatggcagtatggcaatcacaa

SEQ ID NO: 299901 - DNA, 25 bp, Rattus norvegicus
gaagatggcagtttggcaatcacaa

SEQ ID NO: 299902 - DNA, 25 bp, Rattus norvegicus
gaagatggcatgctgccctcattca

SEQ ID NO: 299903 - DNA, 25 bp, Rattus norvegicus
gaagatggcatggtgccctcattca

SEQ ID NO: 299904 - DNA, 25 bp, Rattus norvegicus
gaagatggcccacgacacaggtctc

SEQ ID NO: 299905 - DNA, 25 bp, Rattus norvegicus
gaagatggcccaggacacaggtctc

SEQ ID NO: 299906 - DNA, 25 bp, Rattus norvegicus
gaagatggcccgaaccaagcagacc

SEQ ID NO: 299907 - DNA, 25 bp, Rattus norvegicus
gaagatggcccgtaccaagcagacc

SEQ ID NO: 299908 - DNA, 25 bp, Rattus norvegicus
gaagatggccgtactttgtctgact

SEQ ID NO: 299909 - DNA, 25 bp, Rattus norvegicus
gaagatggccgttctttgtctgact

SEQ ID NO: 299910 - DNA, 25 bp, Rattus norvegicus
gaagatggccttaacgctgagagtt

SEQ ID NO: 299911 - DNA, 25 bp, Rattus norvegicus
gaagatggccttcctaaagagttta

SEQ ID NO: 299912 - DNA, 25 bp, Rattus norvegicus
gaagatggccttgctaaagagttta

SEQ ID NO: 299913 - DNA, 25 bp, Rattus norvegicus
gaagatggcctttacgctgagagtt

SEQ ID NO: 299914 - DNA, 25 bp, Rattus norvegicus
gaagatggcgtcattcccatttata

SEQ ID NO: 299915 - DNA, 25 bp, Rattus norvegicus
gaagatggcgtccaactcagtacct

SEQ ID NO: 299916 - DNA, 25 bp, Rattus norvegicus
gaagatggcgtcgaactcagtacct

SEQ ID NO: 299917 - DNA, 25 bp, Rattus norvegicus
gaagatggcgtctttcccatttata

SEQ ID NO: 299918 - DNA, 25 bp, Rattus norvegicus
gaagatggctaaccctggagtatca

SEQ ID NO: 299919 - DNA, 25 bp, Rattus norvegicus
gaagatggctaagcctggagtatca

SEQ ID NO: 299920 - DNA, 25 bp, Rattus norvegicus
gaagatggctttctgtcacccatcg

SEQ ID NO: 299921 - DNA, 25 bp, Rattus norvegicus
gaagatggctttgtgtcacccatcg

SEQ ID NO: 299922 - DNA, 25 bp, Rattus norvegicus
gaagatgggcggaaccctgtccagt

SEQ ID NO: 299923 - DNA, 25 bp, Rattus norvegicus
gaagatgggcggtaccctgtccagt

SEQ ID NO: 299924 - DNA, 25 bp, Rattus norvegicus
gaagatgggctgatccaaacagaag

SEQ ID NO: 299925 - DNA, 25 bp, Rattus norvegicus
gaagatgggctgattgacctctctg

SEQ ID NO: 299926 - DNA, 25 bp, Rattus norvegicus
gaagatgggctgttccaaacagaag

SEQ ID NO: 299927 - DNA, 25 bp, Rattus norvegicus
gaagatgggctgtttgacctctctg

SEQ ID NO: 299928 - DNA, 25 bp, Rattus norvegicus
gaagatgggcttcaggtccttttcc

SEQ ID NO: 299929 - DNA, 25 bp, Rattus norvegicus
gaagatgggcttgaggtccttttcc

SEQ ID NO: 299930 - DNA, 25 bp, Rattus norvegicus
gaagatgggttacgttacacctggt

SEQ ID NO: 299931 - DNA, 25 bp, Rattus norvegicus
gaagatgggttaggttacacctggt

SEQ ID NO: 299932 - DNA, 25 bp, Rattus norvegicus
gaagatggtggtagaacttctgcac

SEQ ID NO: 299933 - DNA, 25 bp, Rattus norvegicus
gaagatggtggttgaacttctgcac

SEQ ID NO: 299934 - DNA, 25 bp, Rattus norvegicus
gaagatggtgtccatggcccgaaac

SEQ ID NO: 299935 - DNA, 25 bp, Rattus norvegicus
gaagatggtgtcgatggcccgaaac

SEQ ID NO: 299936 - DNA, 25 bp, Rattus norvegicus
gaagatggtgtgatcgacatccact

SEQ ID NO: 299937 - DNA, 25 bp, Rattus norvegicus
gaagatggtgtgttcgacatccact

SEQ ID NO: 299938 - DNA, 25 bp, Rattus norvegicus
gaagatgtaaacagctccccttatt

SEQ ID NO: 299939 - DNA, 25 bp, Rattus norvegicus
gaagatgtaaactgctccccttatt

SEQ ID NO: 299940 - DNA, 25 bp, Rattus norvegicus
gaagatgtaacacagcgtcaccact

SEQ ID NO: 299941 - DNA, 25 bp, Rattus norvegicus
gaagatgtaacagagcgtcaccact

SEQ ID NO: 299942 - DNA, 25 bp, Rattus norvegicus
gaagatgtaagcactcagttttctg

SEQ ID NO: 299943 - DNA, 25 bp, Rattus norvegicus
gaagatgtaagctctcagttttctg

SEQ ID NO: 299944 - DNA, 25 bp, Rattus norvegicus
gaagatgtacaccaaagctctcctg

SEQ ID NO: 299945 - DNA, 25 bp, Rattus norvegicus
gaagatgtacacgaaagctctcctg

SEQ ID NO: 299946 - DNA, 25 bp, Rattus norvegicus
gaagatgtacttcggcagcatccat

SEQ ID NO: 299947 - DNA, 25 bp, Rattus norvegicus
gaagatgtacttgggcagcatccat

SEQ ID NO: 299948 - DNA, 25 bp, Rattus norvegicus
gaagatgtagctctcccgccagggt

SEQ ID NO: 299949 - DNA, 25 bp, Rattus norvegicus
gaagatgtagctgtcccgccagggt

SEQ ID NO: 299950 - DNA, 25 bp, Rattus norvegicus
gaagatgtagtcagaagccgccaca

SEQ ID NO: 299951 - DNA, 25 bp, Rattus norvegicus
gaagatgtagtctgaagccgccaca

SEQ ID NO: 299952 - DNA, 25 bp, Rattus norvegicus
gaagatgtattgactcagttttcaa

SEQ ID NO: 299953 - DNA, 25 bp, Rattus norvegicus
gaagatgtattgtctcagttttcaa

SEQ ID NO: 299954 - DNA, 25 bp, Rattus norvegicus
gaagatgtcacccagggcaggcttt

SEQ ID NO: 299955 - DNA, 25 bp, Rattus norvegicus
gaagatgtcaccgagggcaggcttt

SEQ ID NO: 299956 - DNA, 25 bp, Rattus norvegicus
gaagatgtcactatgccagagtcag

SEQ ID NO: 299957 - DNA, 25 bp, Rattus norvegicus
gaagatgtcactttgccagagtcag

SEQ ID NO: 299958 - DNA, 25 bp, Rattus norvegicus
gaagatgtcatcaacctagcaatag

SEQ ID NO: 299959 - DNA, 25 bp, Rattus norvegicus
gaagatgtcatctacctagcaatag

SEQ ID NO: 299960 - DNA, 25 bp, Rattus norvegicus
gaagatgtcattaccacactgcagt

SEQ ID NO: 299961 - DNA, 25 bp, Rattus norvegicus
gaagatgtcattccctgactccaga

SEQ ID NO: 299962 - DNA, 25 bp, Rattus norvegicus
gaagatgtcattgcctgactccaga

SEQ ID NO: 299963 - DNA, 25 bp, Rattus norvegicus
gaagatgtcatttccacactgcagt

SEQ ID NO: 299964 - DNA, 25 bp, Rattus norvegicus
gaagatgtccacacctgttgaagtt

SEQ ID NO: 299965 - DNA, 25 bp, Rattus norvegicus
gaagatgtccactcctgttgaagtt

SEQ ID NO: 299966 - DNA, 25 bp, Rattus norvegicus
gaagatgtcctaaccacctaagaaa

SEQ ID NO: 299967 - DNA, 25 bp, Rattus norvegicus
gaagatgtcctatccacctaagaaa

SEQ ID NO: 299968 - DNA, 25 bp, Rattus norvegicus
gaagatgtctacacctggaacacct

SEQ ID NO: 299969 - DNA, 25 bp, Rattus norvegicus
gaagatgtctactcctggaacacct

SEQ ID NO: 299970 - DNA, 25 bp, Rattus norvegicus
gaagatgtctccacaagcctgtggg

SEQ ID NO: 299971 - DNA, 25 bp, Rattus norvegicus
gaagatgtctcctcaagcctgtggg

SEQ ID NO: 299972 - DNA, 25 bp, Rattus norvegicus
gaagatgtctgccacctcaggaatg

SEQ ID NO: 299973 - DNA, 25 bp, Rattus norvegicus
gaagatgtctgcgacctcaggaatg

SEQ ID NO: 299974 - DNA, 25 bp, Rattus norvegicus
gaagatgtgaacagctcccttctct

SEQ ID NO: 299975 - DNA, 25 bp, Rattus norvegicus
gaagatgtgaactgctcccttctct

SEQ ID NO: 299976 - DNA, 25 bp, Rattus norvegicus
gaagatgtgcccatccggtaccgta

SEQ ID NO: 299977 - DNA, 25 bp, Rattus norvegicus
gaagatgtgcccttccggtaccgta

SEQ ID NO: 299978 - DNA, 25 bp, Rattus norvegicus
gaagatgtgcttaacacttgggagc

SEQ ID NO: 299979 - DNA, 25 bp, Rattus norvegicus
gaagatgtgcttagactcctagtgt

SEQ ID NO: 299980 - DNA, 25 bp, Rattus norvegicus
gaagatgtgctttacacttgggagc

SEQ ID NO: 299981 - DNA, 25 bp, Rattus norvegicus
gaagatgtgctttgactcctagtgt

SEQ ID NO: 299982 - DNA, 25 bp, Rattus norvegicus
gaagatgtggatcccctcaagtcct

SEQ ID NO: 299983 - DNA, 25 bp, Rattus norvegicus
gaagatgtggatgccctcaagtcct

SEQ ID NO: 299984 - DNA, 25 bp, Rattus norvegicus
gaagatgtggcaacgtgtcctagct

SEQ ID NO: 299985 - DNA, 25 bp, Rattus norvegicus
gaagatgtggcatcgtgtcctagct

SEQ ID NO: 299986 - DNA, 25 bp, Rattus norvegicus
gaagatgtggttagccacctgtgct

SEQ ID NO: 299987 - DNA, 25 bp, Rattus norvegicus
gaagatgtggtttgccacctgtgct

SEQ ID NO: 299988 - DNA, 25 bp, Rattus norvegicus
gaagatgtgtaccttactaagcatt

SEQ ID NO: 299989 - DNA, 25 bp, Rattus norvegicus
gaagatgtgtacgttactaagcatt

SEQ ID NO: 299990 - DNA, 25 bp, Rattus norvegicus
gaagatgtgtctagggcatggaacc

SEQ ID NO: 299991 - DNA, 25 bp, Rattus norvegicus
gaagatgtgtcttgggcatggaacc

SEQ ID NO: 299992 - DNA, 25 bp, Rattus norvegicus
gaagatgttaccacatttttactga

SEQ ID NO: 299993 - DNA, 25 bp, Rattus norvegicus
gaagatgttacctcatttttactga

SEQ ID NO: 299994 - DNA, 25 bp, Rattus norvegicus
gaagatgttcacactccttgtgtca

SEQ ID NO: 299995 - DNA, 25 bp, Rattus norvegicus
gaagatgttcactctccttgtgtca

SEQ ID NO: 299996 - DNA, 25 bp, Rattus norvegicus
gaagatgttcgccattatcttctat

SEQ ID NO: 299997 - DNA, 25 bp, Rattus norvegicus
gaagatgttcgcgattatcttctat

SEQ ID NO: 299998 - DNA, 25 bp, Rattus norvegicus
gaagatgttctgcatggagccctct

SEQ ID NO: 299999 - DNA, 25 bp, Rattus norvegicus
gaagatgttctggatggagccctct

SEQ ID NO: 300000 - DNA, 25 bp, Rattus norvegicus
gaagatgttggaccactcatcctgc

SEQ ID NO: 300001 - DNA, 25 bp, Rattus norvegicus
gaagatgttggagcactcatcctgc

SEQ ID NO: 300002 - DNA, 25 bp, Rattus norvegicus
gaagatgttgtgcttctccctgcaa

SEQ ID NO: 300003 - DNA, 25 bp, Rattus norvegicus
gaagatgttgtggttctccctgcaa

SEQ ID NO: 300004 - DNA, 25 bp, Rattus norvegicus
gaagatgtttttcacagtatgaaca

SEQ ID NO: 300005 - DNA, 25 bp, Rattus norvegicus
gaagatgtttttgacagtatgaaca

SEQ ID NO: 300006 - DNA, 25 bp, Rattus norvegicus
gaagattaaaatcaatgcccccttt

SEQ ID NO: 300007 - DNA, 25 bp, Rattus norvegicus
gaagattaaaatgaatgcccccttt

SEQ ID NO: 300008 - DNA, 25 bp, Rattus norvegicus
gaagattaacccagagaactccaag

SEQ ID NO: 300009 - DNA, 25 bp, Rattus norvegicus
gaagattaaccctgagaactccaag

SEQ ID NO: 300010 - DNA, 25 bp, Rattus norvegicus
gaagattaagtgatgttttgaacct

SEQ ID NO: 300011 - DNA, 25 bp, Rattus norvegicus
gaagattaagtgttgttttgaacct

SEQ ID NO: 300012 - DNA, 25 bp, Rattus norvegicus
gaagattaccctagcataaactcta

SEQ ID NO: 300013 - DNA, 25 bp, Rattus norvegicus
gaagattacccttgcataaactcta

SEQ ID NO: 300014 - DNA, 25 bp, Rattus norvegicus
gaagattactggagtcgtgtcatgt

SEQ ID NO: 300015 - DNA, 25 bp, Rattus norvegicus
gaagattactggtgtcgtgtcatgt

SEQ ID NO: 300016 - DNA, 25 bp, Rattus norvegicus
gaagattactttctccactctgatg

SEQ ID NO: 300017 - DNA, 25 bp, Rattus norvegicus
gaagattactttgtccactctgatg

SEQ ID NO: 300018 - DNA, 25 bp, Rattus norvegicus
gaagattcaactccgcaagctctag

SEQ ID NO: 300019 - DNA, 25 bp, Rattus norvegicus
gaagattcaactgcgcaagctctag

SEQ ID NO: 300020 - DNA, 25 bp, Rattus norvegicus
gaagattcaatccacagatctgatg

SEQ ID NO: 300021 - DNA, 25 bp, Rattus norvegicus
gaagattcaatcgacagatctgatg

SEQ ID NO: 300022 - DNA, 25 bp, Rattus norvegicus
gaagattcacgacaaactccgctat

SEQ ID NO: 300023 - DNA, 25 bp, Rattus norvegicus
gaagattcacgagaaactccgctat

SEQ ID NO: 300024 - DNA, 25 bp, Rattus norvegicus
gaagattcacttaacactcctcaaa

SEQ ID NO: 300025 - DNA, 25 bp, Rattus norvegicus
gaagattcactttacactcctcaaa

SEQ ID NO: 300026 - DNA, 25 bp, Rattus norvegicus
gaagattcagatatgcatacgtgtt

SEQ ID NO: 300027 - DNA, 25 bp, Rattus norvegicus
gaagattcagatttgcatacgtgtt

SEQ ID NO: 300028 - DNA, 25 bp, Rattus norvegicus
gaagattcatcgcagctcacctgca

SEQ ID NO: 300029 - DNA, 25 bp, Rattus norvegicus
gaagattcatcggagctcacctgca

SEQ ID NO: 300030 - DNA, 25 bp, Rattus norvegicus
gaagattcatctcccggacatgagt

SEQ ID NO: 300031 - DNA, 25 bp, Rattus norvegicus
gaagattcatctgccggacatgagt

SEQ ID NO: 300032 - DNA, 25 bp, Rattus norvegicus
gaagattcccaaagaccagaacaac

SEQ ID NO: 300033 - DNA, 25 bp, Rattus norvegicus
gaagattcccaatgaccagaacaac

SEQ ID NO: 300034 - DNA, 25 bp, Rattus norvegicus
gaagattcccatatctgtacacaca

SEQ ID NO: 300035 - DNA, 25 bp, Rattus norvegicus
gaagattcccatttctgtacacaca

SEQ ID NO: 300036 - DNA, 25 bp, Rattus norvegicus
gaagattccccacggctcaaagttg

SEQ ID NO: 300037 - DNA, 25 bp, Rattus norvegicus
gaagattccccagggctcaaagttg

SEQ ID NO: 300038 - DNA, 25 bp, Rattus norvegicus
gaagattcccttaagctactattgt

SEQ ID NO: 300039 - DNA, 25 bp, Rattus norvegicus
gaagattccctttagctactattgt

SEQ ID NO: 300040 - DNA, 25 bp, Rattus norvegicus
gaagattcctggaagacaagcctat

SEQ ID NO: 300041 - DNA, 25 bp, Rattus norvegicus
gaagattcctggtagacaagcctat

SEQ ID NO: 300042 - DNA, 25 bp, Rattus norvegicus
gaagattcgggaagattggcagatc

SEQ ID NO: 300043 - DNA, 25 bp, Rattus norvegicus
gaagattcgggatgattggcagatc

SEQ ID NO: 300044 - DNA, 25 bp, Rattus norvegicus
gaagattctaaacccagctagtaat

SEQ ID NO: 300045 - DNA, 25 bp, Rattus norvegicus
gaagattctaaagccagctagtaat

SEQ ID NO: 300046 - DNA, 25 bp, Rattus norvegicus
gaagattctaatactgccacctact

SEQ ID NO: 300047 - DNA, 25 bp, Rattus norvegicus
gaagattctaattctgccacctact

SEQ ID NO: 300048 - DNA, 25 bp, Rattus norvegicus
gaagattctagactttcctggctga

SEQ ID NO: 300049 - DNA, 25 bp, Rattus norvegicus
gaagattctagagtttcctggctga

SEQ ID NO: 300050 - DNA, 25 bp, Rattus norvegicus
gaagattctgacattctacataaga

SEQ ID NO: 300051 - DNA, 25 bp, Rattus norvegicus
gaagattctgactttctacataaga

SEQ ID NO: 300052 - DNA, 25 bp, Rattus norvegicus
gaagattctgctccatttccattca

SEQ ID NO: 300053 - DNA, 25 bp, Rattus norvegicus
gaagattctgctgcatttccattca

SEQ ID NO: 300054 - DNA, 25 bp, Rattus norvegicus
gaagattctggaacacctaggtgga

SEQ ID NO: 300055 - DNA, 25 bp, Rattus norvegicus
gaagattctggatcacctaggtgga

SEQ ID NO: 300056 - DNA, 25 bp, Rattus norvegicus
gaagattctgtcagtctttggtcac

SEQ ID NO: 300057 - DNA, 25 bp, Rattus norvegicus
gaagattctgtctgtctttggtcac

SEQ ID NO: 300058 - DNA, 25 bp, Rattus norvegicus
gaagattcttatccatcacgggcct

SEQ ID NO: 300059 - DNA, 25 bp, Rattus norvegicus
gaagattcttatgcatcacgggcct

SEQ ID NO: 300060 - DNA, 25 bp, Rattus norvegicus
gaagattctttcagcaggagctctg

SEQ ID NO: 300061 - DNA, 25 bp, Rattus norvegicus
gaagattctttctgcaggagctctg

SEQ ID NO: 300062 - DNA, 25 bp, Rattus norvegicus
gaagattgccaaccgattcctccag

SEQ ID NO: 300063 - DNA, 25 bp, Rattus norvegicus
gaagattgccaactttctagacaag

SEQ ID NO: 300064 - DNA, 25 bp, Rattus norvegicus
gaagattgccaagcgattcctccag

SEQ ID NO: 300065 - DNA, 25 bp, Rattus norvegicus
gaagattgccaagtttctagacaag

SEQ ID NO: 300066 - DNA, 25 bp, Rattus norvegicus
gaagattgccatcagttgaagggta

SEQ ID NO: 300067 - DNA, 25 bp, Rattus norvegicus
gaagattgccatgagttgaagggta

SEQ ID NO: 300068 - DNA, 25 bp, Rattus norvegicus
gaagattgccccataagtctgagga

SEQ ID NO: 300069 - DNA, 25 bp, Rattus norvegicus
gaagattgccccttaagtctgagga

SEQ ID NO: 300070 - DNA, 25 bp, Rattus norvegicus
gaagattgcctacttcacacgagca

SEQ ID NO: 300071 - DNA, 25 bp, Rattus norvegicus
gaagattgcctagttcacacgagca

SEQ ID NO: 300072 - DNA, 25 bp, Rattus norvegicus
gaagattgctgaaccgggctattct

SEQ ID NO: 300073 - DNA, 25 bp, Rattus norvegicus
gaagattgctgatccgggctattct

SEQ ID NO: 300074 - DNA, 25 bp, Rattus norvegicus
gaagattgcttaacctctccaagag

SEQ ID NO: 300075 - DNA, 25 bp, Rattus norvegicus
gaagattgcttatcctctccaagag

SEQ ID NO: 300076 - DNA, 25 bp, Rattus norvegicus
gaagattgctttcaacgggtctgcc

SEQ ID NO: 300077 - DNA, 25 bp, Rattus norvegicus
gaagattgctttgaacgggtctgcc

SEQ ID NO: 300078 - DNA, 25 bp, Rattus norvegicus
gaagattggactacaattcccagaa

SEQ ID NO: 300079 - DNA, 25 bp, Rattus norvegicus
gaagattggacttcaattcccagaa

SEQ ID NO: 300080 - DNA, 25 bp, Rattus norvegicus
gaagattggtccctgtgcactggat

SEQ ID NO: 300081 - DNA, 25 bp, Rattus norvegicus
gaagattggtccgtgtgcactggat

SEQ ID NO: 300082 - DNA, 25 bp, Rattus norvegicus
gaagattgtccaacagagccatcat

SEQ ID NO: 300083 - DNA, 25 bp, Rattus norvegicus
gaagattgtccatcagagccatcat

SEQ ID NO: 300084 - DNA, 25 bp, Rattus norvegicus
gaagattgtcggacagccctggtct

SEQ ID NO: 300085 - DNA, 25 bp, Rattus norvegicus
gaagattgtcggtcagccctggtct

SEQ ID NO: 300086 - DNA, 25 bp, Rattus norvegicus
gaagattgtgtcactctggcaacaa

SEQ ID NO: 300087 - DNA, 25 bp, Rattus norvegicus
gaagattgtgtctctctggcaacaa

SEQ ID NO: 300088 - DNA, 25 bp, Rattus norvegicus
gaagattgttctactgcatgggaag

SEQ ID NO: 300089 - DNA, 25 bp, Rattus norvegicus
gaagattgttcttctgcatgggaag

SEQ ID NO: 300090 - DNA, 25 bp, Rattus norvegicus
gaagattgtttgctctgacatccct

SEQ ID NO: 300091 - DNA, 25 bp, Rattus norvegicus
gaagattgtttggtctgacatccct

SEQ ID NO: 300092 - DNA, 25 bp, Rattus norvegicus
gaagattgttttagcaccagaggag

SEQ ID NO: 300093 - DNA, 25 bp, Rattus norvegicus
gaagattgtttttgcaccagaggag

SEQ ID NO: 300094 - DNA, 25 bp, Rattus norvegicus
gaagatttcaaccaaatgggcttac

SEQ ID NO: 300095 - DNA, 25 bp, Rattus norvegicus
gaagatttcaacgaaatgggcttac

SEQ ID NO: 300096 - DNA, 25 bp, Rattus norvegicus
gaagatttcacacggtttgaaacta

SEQ ID NO: 300097 - DNA, 25 bp, Rattus norvegicus
gaagatttcacagggtttgaaacta

SEQ ID NO: 300098 - DNA, 25 bp, Rattus norvegicus
gaagatttccatcaaccttaccgaa

SEQ ID NO: 300099 - DNA, 25 bp, Rattus norvegicus
gaagatttccatgaaccttaccgaa

SEQ ID NO: 300100 - DNA, 25 bp, Rattus norvegicus
gaagatttccgcagtccgtgtaagc

SEQ ID NO: 300101 - DNA, 25 bp, Rattus norvegicus
gaagatttccgctgtccgtgtaagc

SEQ ID NO: 300102 - DNA, 25 bp, Rattus norvegicus
gaagatttcctcatggctaccgata

SEQ ID NO: 300103 - DNA, 25 bp, Rattus norvegicus
gaagatttcctcttggctaccgata

SEQ ID NO: 300104 - DNA, 25 bp, Rattus norvegicus
gaagatttcctgacccgacttcgtg

SEQ ID NO: 300105 - DNA, 25 bp, Rattus norvegicus
gaagatttcctgtcccgacttcgtg

SEQ ID NO: 300106 - DNA, 25 bp, Rattus norvegicus
gaagatttcgccactaactgtagat

SEQ ID NO: 300107 - DNA, 25 bp, Rattus norvegicus
gaagatttcgcctctaactgtagat

SEQ ID NO: 300108 - DNA, 25 bp, Rattus norvegicus
gaagatttcttacccactgggaagt

SEQ ID NO: 300109 - DNA, 25 bp, Rattus norvegicus
gaagatttcttagccactgggaagt

SEQ ID NO: 300110 - DNA, 25 bp, Rattus norvegicus
gaagatttcttcagaatccctagag

SEQ ID NO: 300111 - DNA, 25 bp, Rattus norvegicus
gaagatttcttctgaatccctagag

SEQ ID NO: 300112 - DNA, 25 bp, Rattus norvegicus
gaagatttgcatatctttacctgct

SEQ ID NO: 300113 - DNA, 25 bp, Rattus norvegicus
gaagatttgcatttctttacctgct

SEQ ID NO: 300114 - DNA, 25 bp, Rattus norvegicus
gaagatttgcttatcactgtgactg

SEQ ID NO: 300115 - DNA, 25 bp, Rattus norvegicus
gaagatttgcttttcactgtgactg

SEQ ID NO: 300116 - DNA, 25 bp, Rattus norvegicus
gaagatttggaaagatttacactaa

SEQ ID NO: 300117 - DNA, 25 bp, Rattus norvegicus
gaagatttggaatgatttacactaa

SEQ ID NO: 300118 - DNA, 25 bp, Rattus norvegicus
gaagatttggacaagcctggctcgc

SEQ ID NO: 300119 - DNA, 25 bp, Rattus norvegicus
gaagatttggactagcctggctcgc

SEQ ID NO: 300120 - DNA, 25 bp, Rattus norvegicus
gaagattttatcacgaactgcatag

SEQ ID NO: 300121 - DNA, 25 bp, Rattus norvegicus
gaagattttatctcgaactgcatag

SEQ ID NO: 300122 - DNA, 25 bp, Rattus norvegicus
gaagattttgcaacacttttgctat

SEQ ID NO: 300123 - DNA, 25 bp, Rattus norvegicus
gaagattttgcatcacttttgctat

SEQ ID NO: 300124 - DNA, 25 bp, Rattus norvegicus
gaagattttggaaaatgctgccaaa

SEQ ID NO: 300125 - DNA, 25 bp, Rattus norvegicus
gaagattttggataatgctgccaaa

SEQ ID NO: 300126 - DNA, 25 bp, Rattus norvegicus
gaagattttggcaccttacctggaa

SEQ ID NO: 300127 - DNA, 25 bp, Rattus norvegicus
gaagattttggcctgcactgcaaac

SEQ ID NO: 300128 - DNA, 25 bp, Rattus norvegicus
gaagattttggcgtgcactgcaaac

SEQ ID NO: 300129 - DNA, 25 bp, Rattus norvegicus
gaagattttggctccttacctggaa

SEQ ID NO: 300130 - DNA, 25 bp, Rattus norvegicus
gaagatttttacatcaacccaggat

SEQ ID NO: 300131 - DNA, 25 bp, Rattus norvegicus
gaagatttttacttcaacccaggat

SEQ ID NO: 300132 - DNA, 25 bp, Rattus norvegicus
gaagatttttctccacacttagtag

SEQ ID NO: 300133 - DNA, 25 bp, Rattus norvegicus
gaagatttttctgcacacttagtag

SEQ ID NO: 300134 - DNA, 25 bp, Rattus norvegicus
gaagcaaaaaccactgtcttgattt

SEQ ID NO: 300135 - DNA, 25 bp, Rattus norvegicus
gaagcaaaaacctctgtcttgattt

SEQ ID NO: 300136 - DNA, 25 bp, Rattus norvegicus
gaagcaaaagacactacgctgtcat

SEQ ID NO: 300137 - DNA, 25 bp, Rattus norvegicus
gaagcaaaagactctacgctgtcat

SEQ ID NO: 300138 - DNA, 25 bp, Rattus norvegicus
gaagcaaaagcaagagtattgttac

SEQ ID NO: 300139 - DNA, 25 bp, Rattus norvegicus
gaagcaaaagcatgagtattgttac

SEQ ID NO: 300140 - DNA, 25 bp, Rattus norvegicus
gaagcaaaagctatacctcctgcaa

SEQ ID NO: 300141 - DNA, 25 bp, Rattus norvegicus
gaagcaaaagctttacctcctgcaa

SEQ ID NO: 300142 - DNA, 25 bp, Rattus norvegicus
gaagcaaacaccagacgcataagta

SEQ ID NO: 300143 - DNA, 25 bp, Rattus norvegicus
gaagcaaacacctgacgcataagta

SEQ ID NO: 300144 - DNA, 25 bp, Rattus norvegicus
gaagcaaacacgcagtctttcagat

SEQ ID NO: 300145 - DNA, 25 bp, Rattus norvegicus
gaagcaaacacggagtctttcagat

SEQ ID NO: 300146 - DNA, 25 bp, Rattus norvegicus
gaagcaaacactagactgaaccagt

SEQ ID NO: 300147 - DNA, 25 bp, Rattus norvegicus
gaagcaaacacttgactgaaccagt

SEQ ID NO: 300148 - DNA, 25 bp, Rattus norvegicus
gaagcaaacaggaaattccctacgg

SEQ ID NO: 300149 - DNA, 25 bp, Rattus norvegicus
gaagcaaacaggtaattccctacgg

SEQ ID NO: 300150 - DNA, 25 bp, Rattus norvegicus
gaagcaaaccccagtgagcgagaga

SEQ ID NO: 300151 - DNA, 25 bp, Rattus norvegicus
gaagcaaacccctgtgagcgagaga

SEQ ID NO: 300152 - DNA, 25 bp, Rattus norvegicus
gaagcaaaccgtagttatcattcct

SEQ ID NO: 300153 - DNA, 25 bp, Rattus norvegicus
gaagcaaaccgttgttatcattcct

SEQ ID NO: 300154 - DNA, 25 bp, Rattus norvegicus
gaagcaaaccttatttcctgtgata

SEQ ID NO: 300155 - DNA, 25 bp, Rattus norvegicus
gaagcaaaccttcaacccatgagcc

SEQ ID NO: 300156 - DNA, 25 bp, Rattus norvegicus
gaagcaaaccttgaacccatgagcc

SEQ ID NO: 300157 - DNA, 25 bp, Rattus norvegicus
gaagcaaaccttttttcctgtgata

SEQ ID NO: 300158 - DNA, 25 bp, Rattus norvegicus
gaagcaaactggatgccagcccagt

SEQ ID NO: 300159 - DNA, 25 bp, Rattus norvegicus
gaagcaaactggttgccagcccagt

SEQ ID NO: 300160 - DNA, 25 bp, Rattus norvegicus
gaagcaaactgtcgccgtgtttttt

SEQ ID NO: 300161 - DNA, 25 bp, Rattus norvegicus
gaagcaaactgtggccgtgtttttt

SEQ ID NO: 300162 - DNA, 25 bp, Rattus norvegicus
gaagcaaagaagacagccctccact

SEQ ID NO: 300163 - DNA, 25 bp, Rattus norvegicus
gaagcaaagaagtcagccctccact

SEQ ID NO: 300164 - DNA, 25 bp, Rattus norvegicus
gaagcaaagacaatcccgaagccgt

SEQ ID NO: 300165 - DNA, 25 bp, Rattus norvegicus
gaagcaaagacattcccgaagccgt

SEQ ID NO: 300166 - DNA, 25 bp, Rattus norvegicus
gaagcaaagacgacaagagccttgt

SEQ ID NO: 300167 - DNA, 25 bp, Rattus norvegicus
gaagcaaagacgtcaagagccttgt

SEQ ID NO: 300168 - DNA, 25 bp, Rattus norvegicus
gaagcaaagcccatgttttctctat

SEQ ID NO: 300169 - DNA, 25 bp, Rattus norvegicus
gaagcaaagcccttgttttctctat

SEQ ID NO: 300170 - DNA, 25 bp, Rattus norvegicus
gaagcaaagccgatgatgctcccca

SEQ ID NO: 300171 - DNA, 25 bp, Rattus norvegicus
gaagcaaagccgttgatgctcccca

SEQ ID NO: 300172 - DNA, 25 bp, Rattus norvegicus
gaagcaaagcctaccttggcataca

SEQ ID NO: 300173 - DNA, 25 bp, Rattus norvegicus
gaagcaaagccttccttggcataca

SEQ ID NO: 300174 - DNA, 25 bp, Rattus norvegicus
gaagcaaagcttaccgaagcccttt

SEQ ID NO: 300175 - DNA, 25 bp, Rattus norvegicus
gaagcaaagctttccgaagcccttt

SEQ ID NO: 300176 - DNA, 25 bp, Rattus norvegicus
gaagcaaaggacaccagctcccagt

SEQ ID NO: 300177 - DNA, 25 bp, Rattus norvegicus
gaagcaaaggactccagctcccagt

SEQ ID NO: 300178 - DNA, 25 bp, Rattus norvegicus
gaagcaaagggactacatctgagaa

SEQ ID NO: 300179 - DNA, 25 bp, Rattus norvegicus
gaagcaaagggagtacatctgagaa

SEQ ID NO: 300180 - DNA, 25 bp, Rattus norvegicus
gaagcaaagtgcctatcagcagtgt

SEQ ID NO: 300181 - DNA, 25 bp, Rattus norvegicus
gaagcaaagtgcgtatcagcagtgt

SEQ ID NO: 300182 - DNA, 25 bp, Rattus norvegicus
gaagcaaataccaatgcatcccttt

SEQ ID NO: 300183 - DNA, 25 bp, Rattus norvegicus
gaagcaaatacctatgcatcccttt

SEQ ID NO: 300184 - DNA, 25 bp, Rattus norvegicus
gaagcaaatagccagccgcaccagt

SEQ ID NO: 300185 - DNA, 25 bp, Rattus norvegicus
gaagcaaatagcgagccgcaccagt

SEQ ID NO: 300186 - DNA, 25 bp, Rattus norvegicus
gaagcaaatcccagtctcatcaagt

SEQ ID NO: 300187 - DNA, 25 bp, Rattus norvegicus
gaagcaaatccctgtctcatcaagt

SEQ ID NO: 300188 - DNA, 25 bp, Rattus norvegicus
gaagcaaatctgacgccagcgtggc

SEQ ID NO: 300189 - DNA, 25 bp, Rattus norvegicus
gaagcaaatctgtcgccagcgtggc

SEQ ID NO: 300190 - DNA, 25 bp, Rattus norvegicus
gaagcaaattccaaaaagcctgtat

SEQ ID NO: 300191 - DNA, 25 bp, Rattus norvegicus
gaagcaaattccacatttacttgtt

SEQ ID NO: 300192 - DNA, 25 bp, Rattus norvegicus
gaagcaaattcctaaaagcctgtat

SEQ ID NO: 300193 - DNA, 25 bp, Rattus norvegicus
gaagcaaattcctcatttacttgtt

SEQ ID NO: 300194 - DNA, 25 bp, Rattus norvegicus
gaagcaaattctatccttctttggc

SEQ ID NO: 300195 - DNA, 25 bp, Rattus norvegicus
gaagcaaattctttccttctttggc

SEQ ID NO: 300196 - DNA, 25 bp, Rattus norvegicus
gaagcaaattgaaccctgggtttta

SEQ ID NO: 300197 - DNA, 25 bp, Rattus norvegicus
gaagcaaattgatccctgggtttta

SEQ ID NO: 300198 - DNA, 25 bp, Rattus norvegicus
gaagcaaattggcaccagctgccct

SEQ ID NO: 300199 - DNA, 25 bp, Rattus norvegicus
gaagcaaattgggaccagctgccct

SEQ ID NO: 300200 - DNA, 25 bp, Rattus norvegicus
gaagcaacacttcgcaataaactca

SEQ ID NO: 300201 - DNA, 25 bp, Rattus norvegicus
gaagcaacacttggcaataaactca

SEQ ID NO: 300202 - DNA, 25 bp, Rattus norvegicus
gaagcaacagccatgagccaggaat

SEQ ID NO: 300203 - DNA, 25 bp, Rattus norvegicus
gaagcaacagccttgagccaggaat

SEQ ID NO: 300204 - DNA, 25 bp, Rattus norvegicus
gaagcaacatggacccaagcatctg

SEQ ID NO: 300205 - DNA, 25 bp, Rattus norvegicus
gaagcaacatggtcccaagcatctg

SEQ ID NO: 300206 - DNA, 25 bp, Rattus norvegicus
gaagcaacgtggcatttatttttac

SEQ ID NO: 300207 - DNA, 25 bp, Rattus norvegicus
gaagcaacgtgggatttatttttac

SEQ ID NO: 300208 - DNA, 25 bp, Rattus norvegicus
gaagcaactgacacttgttccagca

SEQ ID NO: 300209 - DNA, 25 bp, Rattus norvegicus
gaagcaactgaccagcaagttagta

SEQ ID NO: 300210 - DNA, 25 bp, Rattus norvegicus
gaagcaactgacgagcaagttagta

SEQ ID NO: 300211 - DNA, 25 bp, Rattus norvegicus
gaagcaactgactcttgttccagca

SEQ ID NO: 300212 - DNA, 25 bp, Rattus norvegicus
gaagcaactgggacagatgcctcaa

SEQ ID NO: 300213 - DNA, 25 bp, Rattus norvegicus
gaagcaactgggtcagatgcctcaa

SEQ ID NO: 300214 - DNA, 25 bp, Rattus norvegicus
gaagcaacttacaggaactatgaca

SEQ ID NO: 300215 - DNA, 25 bp, Rattus norvegicus
gaagcaacttactggaactatgaca

SEQ ID NO: 300216 - DNA, 25 bp, Rattus norvegicus
gaagcaactttcacattacccagat

SEQ ID NO: 300217 - DNA, 25 bp, Rattus norvegicus
gaagcaactttctcattacccagat

SEQ ID NO: 300218 - DNA, 25 bp, Rattus norvegicus
gaagcaagactaactcaggtttgag

SEQ ID NO: 300219 - DNA, 25 bp, Rattus norvegicus
gaagcaagactatctcaggtttgag

SEQ ID NO: 300220 - DNA, 25 bp, Rattus norvegicus
gaagcaagactcagaggacctcgcc

SEQ ID NO: 300221 - DNA, 25 bp, Rattus norvegicus
gaagcaagactctgaggacctcgcc

SEQ ID NO: 300222 - DNA, 25 bp, Rattus norvegicus
gaagcaagacttagatgagaacgac

SEQ ID NO: 300223 - DNA, 25 bp, Rattus norvegicus
gaagcaagactttgatgagaacgac

SEQ ID NO: 300224 - DNA, 25 bp, Rattus norvegicus
gaagcaagagaaccccaactggaca

SEQ ID NO: 300225 - DNA, 25 bp, Rattus norvegicus
gaagcaagagaagcccaactggaca

SEQ ID NO: 300226 - DNA, 25 bp, Rattus norvegicus
gaagcaagaggtccactgcctgtgc

SEQ ID NO: 300227 - DNA, 25 bp, Rattus norvegicus
gaagcaagaggtgcactgcctgtgc

SEQ ID NO: 300228 - DNA, 25 bp, Rattus norvegicus
gaagcaagatctacttacctggtgt

SEQ ID NO: 300229 - DNA, 25 bp, Rattus norvegicus
gaagcaagatcttcttacctggtgt

SEQ ID NO: 300230 - DNA, 25 bp, Rattus norvegicus
gaagcaagatgtcacctgtctcaat

SEQ ID NO: 300231 - DNA, 25 bp, Rattus norvegicus
gaagcaagatgtgacctgtctcaat

SEQ ID NO: 300232 - DNA, 25 bp, Rattus norvegicus
gaagcaagcaaacacactgaagtcc

SEQ ID NO: 300233 - DNA, 25 bp, Rattus norvegicus
gaagcaagcaaagacactgaagtcc

SEQ ID NO: 300234 - DNA, 25 bp, Rattus norvegicus
gaagcaagcacaagtggccactggt

SEQ ID NO: 300235 - DNA, 25 bp, Rattus norvegicus
gaagcaagcacatgtggccactggt

SEQ ID NO: 300236 - DNA, 25 bp, Rattus norvegicus
gaagcaagcactctcctgtaaacat

SEQ ID NO: 300237 - DNA, 25 bp, Rattus norvegicus
gaagcaagcactgtcctgtaaacat

SEQ ID NO: 300238 - DNA, 25 bp, Rattus norvegicus
gaagcaagcatcagaggactccaac

SEQ ID NO: 300239 - DNA, 25 bp, Rattus norvegicus
gaagcaagcatctgaggactccaac

SEQ ID NO: 300240 - DNA, 25 bp, Rattus norvegicus
gaagcaagcattaattcacctgcaa

SEQ ID NO: 300241 - DNA, 25 bp, Rattus norvegicus
gaagcaagcatttattcacctgcaa

SEQ ID NO: 300242 - DNA, 25 bp, Rattus norvegicus
gaagcaagccgccatgttgtagtgt

SEQ ID NO: 300243 - DNA, 25 bp, Rattus norvegicus
gaagcaagccgcgatgttgtagtgt

SEQ ID NO: 300244 - DNA, 25 bp, Rattus norvegicus
gaagcaagctcccttttttcagaga

SEQ ID NO: 300245 - DNA, 25 bp, Rattus norvegicus
gaagcaagctccgttttttcagaga

SEQ ID NO: 300246 - DNA, 25 bp, Rattus norvegicus
gaagcaaggacaagcgtgcgcacat

SEQ ID NO: 300247 - DNA, 25 bp, Rattus norvegicus
gaagcaaggacatgcgtgcgcacat

SEQ ID NO: 300248 - DNA, 25 bp, Rattus norvegicus
gaagcaaggactctgtaacccacga

SEQ ID NO: 300249 - DNA, 25 bp, Rattus norvegicus
gaagcaaggactgtgtaacccacga

SEQ ID NO: 300250 - DNA, 25 bp, Rattus norvegicus
gaagcaaggtgtatacctactcagc

SEQ ID NO: 300251 - DNA, 25 bp, Rattus norvegicus
gaagcaaggtgtccctggttctcaa

SEQ ID NO: 300252 - DNA, 25 bp, Rattus norvegicus
gaagcaaggtgtgcctggttctcaa

SEQ ID NO: 300253 - DNA, 25 bp, Rattus norvegicus
gaagcaaggtgtttacctactcagc

SEQ ID NO: 300254 - DNA, 25 bp, Rattus norvegicus
gaagcaagtcctccctgtgatcaga

SEQ ID NO: 300255 - DNA, 25 bp, Rattus norvegicus
gaagcaagtcctgcctgtgatcaga

SEQ ID NO: 300256 - DNA, 25 bp, Rattus norvegicus
gaagcaagtctactccaacaagcct

SEQ ID NO: 300257 - DNA, 25 bp, Rattus norvegicus
gaagcaagtctagtccaacaagcct

SEQ ID NO: 300258 - DNA, 25 bp, Rattus norvegicus
gaagcaagtctgacttacaaaagat

SEQ ID NO: 300259 - DNA, 25 bp, Rattus norvegicus
gaagcaagtctgtcttacaaaagat

SEQ ID NO: 300260 - DNA, 25 bp, Rattus norvegicus
gaagcaagtgatcagggtctcctgt

SEQ ID NO: 300261 - DNA, 25 bp, Rattus norvegicus
gaagcaagtgatgagggtctcctgt

SEQ ID NO: 300262 - DNA, 25 bp, Rattus norvegicus
gaagcaagtgcaataccacctctcc

SEQ ID NO: 300263 - DNA, 25 bp, Rattus norvegicus
gaagcaagtgcattaccacctctcc

SEQ ID NO: 300264 - DNA, 25 bp, Rattus norvegicus
gaagcaagtgtacgacgcgcacacc

SEQ ID NO: 300265 - DNA, 25 bp, Rattus norvegicus
gaagcaagtgtaggacgcgcacacc

SEQ ID NO: 300266 - DNA, 25 bp, Rattus norvegicus
gaagcaagtgtcactctagcgtgga

SEQ ID NO: 300267 - DNA, 25 bp, Rattus norvegicus
gaagcaagtgtctctctagcgtgga

SEQ ID NO: 300268 - DNA, 25 bp, Rattus norvegicus
gaagcaagtgttctcctaattgaca

SEQ ID NO: 300269 - DNA, 25 bp, Rattus norvegicus
gaagcaagtgttgtcctaattgaca

SEQ ID NO: 300270 - DNA, 25 bp, Rattus norvegicus
gaagcaataccacgagccatctcat

SEQ ID NO: 300271 - DNA, 25 bp, Rattus norvegicus
gaagcaataccaggagccatctcat

SEQ ID NO: 300272 - DNA, 25 bp, Rattus norvegicus
gaagcaatagcaagcgagcccctct

SEQ ID NO: 300273 - DNA, 25 bp, Rattus norvegicus
gaagcaatagcatgcgagcccctct

SEQ ID NO: 300274 - DNA, 25 bp, Rattus norvegicus
gaagcaatatctccgtgttttgtat

SEQ ID NO: 300275 - DNA, 25 bp, Rattus norvegicus
gaagcaatatctcttctatgtatga

SEQ ID NO: 300276 - DNA, 25 bp, Rattus norvegicus
gaagcaatatctgcgtgttttgtat

SEQ ID NO: 300277 - DNA, 25 bp, Rattus norvegicus
gaagcaatatctgttctatgtatga

SEQ ID NO: 300278 - DNA, 25 bp, Rattus norvegicus
gaagcaatatttacactcctttagc

SEQ ID NO: 300279 - DNA, 25 bp, Rattus norvegicus
gaagcaatatttatacttaaggcat

SEQ ID NO: 300280 - DNA, 25 bp, Rattus norvegicus
gaagcaatattttcactcctttagc

SEQ ID NO: 300281 - DNA, 25 bp, Rattus norvegicus
gaagcaatatttttacttaaggcat

SEQ ID NO: 300282 - DNA, 25 bp, Rattus norvegicus
gaagcaatcatcagctcgatcgcca

SEQ ID NO: 300283 - DNA, 25 bp, Rattus norvegicus
gaagcaatcatctgctcgatcgcca

SEQ ID NO: 300284 - DNA, 25 bp, Rattus norvegicus
gaagcaatcattagccgcattcact

SEQ ID NO: 300285 - DNA, 25 bp, Rattus norvegicus
gaagcaatcatttgccgcattcact

SEQ ID NO: 300286 - DNA, 25 bp, Rattus norvegicus
gaagcaatccggctttgccaacaca

SEQ ID NO: 300287 - DNA, 25 bp, Rattus norvegicus
gaagcaatccgggtttgccaacaca

SEQ ID NO: 300288 - DNA, 25 bp, Rattus norvegicus
gaagcaatccgtaactcatgggtct

SEQ ID NO: 300289 - DNA, 25 bp, Rattus norvegicus
gaagcaatccgttactcatgggtct

SEQ ID NO: 300290 - DNA, 25 bp, Rattus norvegicus
gaagcaatctcaaacagttgtgcag

SEQ ID NO: 300291 - DNA, 25 bp, Rattus norvegicus
gaagcaatctcatacagttgtgcag

SEQ ID NO: 300292 - DNA, 25 bp, Rattus norvegicus
gaagcaatcttcactccaagaaagt

SEQ ID NO: 300293 - DNA, 25 bp, Rattus norvegicus
gaagcaatcttctctccaagaaagt

SEQ ID NO: 300294 - DNA, 25 bp, Rattus norvegicus
gaagcaatctttactttcagatcat

SEQ ID NO: 300295 - DNA, 25 bp, Rattus norvegicus
gaagcaatcttttctttcagatcat

SEQ ID NO: 300296 - DNA, 25 bp, Rattus norvegicus
gaagcaatgaggaagactgtccatg

SEQ ID NO: 300297 - DNA, 25 bp, Rattus norvegicus
gaagcaatgaggtagactgtccatg

SEQ ID NO: 300298 - DNA, 25 bp, Rattus norvegicus
gaagcaatgcagagggtcccttcct

SEQ ID NO: 300299 - DNA, 25 bp, Rattus norvegicus
gaagcaatgcagtgggtcccttcct

SEQ ID NO: 300300 - DNA, 25 bp, Rattus norvegicus
gaagcaatgcccctgtgaggttcta

SEQ ID NO: 300301 - DNA, 25 bp, Rattus norvegicus
gaagcaatgcccgtgtgaggttcta

SEQ ID NO: 300302 - DNA, 25 bp, Rattus norvegicus
gaagcaatgcggacctcagacaggc

SEQ ID NO: 300303 - DNA, 25 bp, Rattus norvegicus
gaagcaatgcggtcctcagacaggc

SEQ ID NO: 300304 - DNA, 25 bp, Rattus norvegicus
gaagcaatgtccactcaaagctcag

SEQ ID NO: 300305 - DNA, 25 bp, Rattus norvegicus
gaagcaatgtcctctcaaagctcag

SEQ ID NO: 300306 - DNA, 25 bp, Rattus norvegicus
gaagcaattccaatttaggtactac

SEQ ID NO: 300307 - DNA, 25 bp, Rattus norvegicus
gaagcaattccattttaggtactac

SEQ ID NO: 300308 - DNA, 25 bp, Rattus norvegicus
gaagcaatttccacagtactctggt

SEQ ID NO: 300309 - DNA, 25 bp, Rattus norvegicus
gaagcaatttcctcagtactctggt

SEQ ID NO: 300310 - DNA, 25 bp, Rattus norvegicus
gaagcacaaaataccactgacagaa

SEQ ID NO: 300311 - DNA, 25 bp, Rattus norvegicus
gaagcacaaaattccactgacagaa

SEQ ID NO: 300312 - DNA, 25 bp, Rattus norvegicus
gaagcacaaagacgcgtccatactg

SEQ ID NO: 300313 - DNA, 25 bp, Rattus norvegicus
gaagcacaaagaggcgtccatactg

SEQ ID NO: 300314 - DNA, 25 bp, Rattus norvegicus
gaagcacaacaaacctaggcggccg

SEQ ID NO: 300315 - DNA, 25 bp, Rattus norvegicus
gaagcacaacaatcctaggcggccg

SEQ ID NO: 300316 - DNA, 25 bp, Rattus norvegicus
gaagcacaagacaagttctgaccaa

SEQ ID NO: 300317 - DNA, 25 bp, Rattus norvegicus
gaagcacaagactagttctgaccaa

SEQ ID NO: 300318 - DNA, 25 bp, Rattus norvegicus
gaagcacaagcacactgactacatg

SEQ ID NO: 300319 - DNA, 25 bp, Rattus norvegicus
gaagcacaagcagactgactacatg

SEQ ID NO: 300320 - DNA, 25 bp, Rattus norvegicus
gaagcacaaggcacaccaagttatc

SEQ ID NO: 300321 - DNA, 25 bp, Rattus norvegicus
gaagcacaaggctcaccaagttatc

SEQ ID NO: 300322 - DNA, 25 bp, Rattus norvegicus
gaagcacaagtaacaccggatctcc

SEQ ID NO: 300323 - DNA, 25 bp, Rattus norvegicus
gaagcacaagtatcaccggatctcc

SEQ ID NO: 300324 - DNA, 25 bp, Rattus norvegicus
gaagcacaatctaagctttgtacat

SEQ ID NO: 300325 - DNA, 25 bp, Rattus norvegicus
gaagcacaatcttagctttgtacat

SEQ ID NO: 300326 - DNA, 25 bp, Rattus norvegicus
gaagcacaatggcttttcttgttat

SEQ ID NO: 300327 - DNA, 25 bp, Rattus norvegicus
gaagcacaatgggttttcttgttat

SEQ ID NO: 300328 - DNA, 25 bp, Rattus norvegicus
gaagcacaattacctctgggccctg

SEQ ID NO: 300329 - DNA, 25 bp, Rattus norvegicus
gaagcacaattagctctgggccctg

SEQ ID NO: 300330 - DNA, 25 bp, Rattus norvegicus
gaagcacacaatctctggcgcacac

SEQ ID NO: 300331 - DNA, 25 bp, Rattus norvegicus
gaagcacacaatgtctggcgcacac

SEQ ID NO: 300332 - DNA, 25 bp, Rattus norvegicus
gaagcacacactcactcagttatta

SEQ ID NO: 300333 - DNA, 25 bp, Rattus norvegicus
gaagcacacactgactcagttatta

SEQ ID NO: 300334 - DNA, 25 bp, Rattus norvegicus
gaagcacacagtcaacttgcgaagt

SEQ ID NO: 300335 - DNA, 25 bp, Rattus norvegicus
gaagcacacagtcgacttcacttct

SEQ ID NO: 300336 - DNA, 25 bp, Rattus norvegicus
gaagcacacagtgaacttgcgaagt

SEQ ID NO: 300337 - DNA, 25 bp, Rattus norvegicus
gaagcacacagtggacttcacttct

SEQ ID NO: 300338 - DNA, 25 bp, Rattus norvegicus
gaagcacacatcaaacggagccaat

SEQ ID NO: 300339 - DNA, 25 bp, Rattus norvegicus
gaagcacacatctaacggagccaat

SEQ ID NO: 300340 - DNA, 25 bp, Rattus norvegicus
gaagcacaccatctttggacgggtt

SEQ ID NO: 300341 - DNA, 25 bp, Rattus norvegicus
gaagcacaccatgtttggacgggtt

SEQ ID NO: 300342 - DNA, 25 bp, Rattus norvegicus
gaagcacaccttaaaagacctctcc

SEQ ID NO: 300343 - DNA, 25 bp, Rattus norvegicus
gaagcacacctttaaagacctctcc

SEQ ID NO: 300344 - DNA, 25 bp, Rattus norvegicus
gaagcacacggtcactttcatgccg

SEQ ID NO: 300345 - DNA, 25 bp, Rattus norvegicus
gaagcacacggtgactttcatgccg

SEQ ID NO: 300346 - DNA, 25 bp, Rattus norvegicus
gaagcacacgttcccgtagggagat

SEQ ID NO: 300347 - DNA, 25 bp, Rattus norvegicus
gaagcacacgttgccgtagggagat

SEQ ID NO: 300348 - DNA, 25 bp, Rattus norvegicus
gaagcacactctatggctgaagcca

SEQ ID NO: 300349 - DNA, 25 bp, Rattus norvegicus
gaagcacactctttggctgaagcca

SEQ ID NO: 300350 - DNA, 25 bp, Rattus norvegicus
gaagcacagaaacagagtccagact

SEQ ID NO: 300351 - DNA, 25 bp, Rattus norvegicus
gaagcacagaaagagagtccagact

SEQ ID NO: 300352 - DNA, 25 bp, Rattus norvegicus
gaagcacagctgattctgagtcact

SEQ ID NO: 300353 - DNA, 25 bp, Rattus norvegicus
gaagcacagctgtttctgagtcact

SEQ ID NO: 300354 - DNA, 25 bp, Rattus norvegicus
gaagcacagcttcaagtcattcatc

SEQ ID NO: 300355 - DNA, 25 bp, Rattus norvegicus
gaagcacagcttccagtctgggtca

SEQ ID NO: 300356 - DNA, 25 bp, Rattus norvegicus
gaagcacagcttgaagtcattcatc

SEQ ID NO: 300357 - DNA, 25 bp, Rattus norvegicus
gaagcacagcttgcagtctgggtca

SEQ ID NO: 300358 - DNA, 25 bp, Rattus norvegicus
gaagcacaggccaaactggctgaag

SEQ ID NO: 300359 - DNA, 25 bp, Rattus norvegicus
gaagcacaggcctaactggctgaag

SEQ ID NO: 300360 - DNA, 25 bp, Rattus norvegicus
gaagcacataatatatagacaggga

SEQ ID NO: 300361 - DNA, 25 bp, Rattus norvegicus
gaagcacataatttatagacaggga

SEQ ID NO: 300362 - DNA, 25 bp, Rattus norvegicus
gaagcacatcaaactctgggctgag

SEQ ID NO: 300363 - DNA, 25 bp, Rattus norvegicus
gaagcacatcaaatttgtctgtcag

SEQ ID NO: 300364 - DNA, 25 bp, Rattus norvegicus
gaagcacatcaatctctgggctgag

SEQ ID NO: 300365 - DNA, 25 bp, Rattus norvegicus
gaagcacatcaattttgtctgtcag

SEQ ID NO: 300366 - DNA, 25 bp, Rattus norvegicus
gaagcacatcgtaagttacctctta

SEQ ID NO: 300367 - DNA, 25 bp, Rattus norvegicus
gaagcacatcgttagttacctctta

SEQ ID NO: 300368 - DNA, 25 bp, Rattus norvegicus
gaagcacatctaactgatgccgagc

SEQ ID NO: 300369 - DNA, 25 bp, Rattus norvegicus
gaagcacatctatctgatgccgagc

SEQ ID NO: 300370 - DNA, 25 bp, Rattus norvegicus
gaagcacatctcaacattcagggcc

SEQ ID NO: 300371 - DNA, 25 bp, Rattus norvegicus
gaagcacatctctacattcagggcc

SEQ ID NO: 300372 - DNA, 25 bp, Rattus norvegicus
gaagcacatcttcgctgcagaacaa

SEQ ID NO: 300373 - DNA, 25 bp, Rattus norvegicus
gaagcacatcttggctgcagaacaa

SEQ ID NO: 300374 - DNA, 25 bp, Rattus norvegicus
gaagcacatgagatgccaccctcaa

SEQ ID NO: 300375 - DNA, 25 bp, Rattus norvegicus
gaagcacatgagttgccaccctcaa

SEQ ID NO: 300376 - DNA, 25 bp, Rattus norvegicus
gaagcacatgcaactctctgggttt

SEQ ID NO: 300377 - DNA, 25 bp, Rattus norvegicus
gaagcacatgcacttctgttaggag

SEQ ID NO: 300378 - DNA, 25 bp, Rattus norvegicus
gaagcacatgcagttctgttaggag

SEQ ID NO: 300379 - DNA, 25 bp, Rattus norvegicus
gaagcacatgcatctctctgggttt

SEQ ID NO: 300380 - DNA, 25 bp, Rattus norvegicus
gaagcacatggtagagagcctttga

SEQ ID NO: 300381 - DNA, 25 bp, Rattus norvegicus
gaagcacatggtcactgaggttatt

SEQ ID NO: 300382 - DNA, 25 bp, Rattus norvegicus
gaagcacatggtgactgaggttatt

SEQ ID NO: 300383 - DNA, 25 bp, Rattus norvegicus
gaagcacatggttgagagcctttga

SEQ ID NO: 300384 - DNA, 25 bp, Rattus norvegicus
gaagcacatgttacattctctgcct

SEQ ID NO: 300385 - DNA, 25 bp, Rattus norvegicus
gaagcacatgtttcattctctgcct

SEQ ID NO: 300386 - DNA, 25 bp, Rattus norvegicus
gaagcacattagatggcctccaatt

SEQ ID NO: 300387 - DNA, 25 bp, Rattus norvegicus
gaagcacattagttggcctccaatt

SEQ ID NO: 300388 - DNA, 25 bp, Rattus norvegicus
gaagcacattcaagtcctgggccgt

SEQ ID NO: 300389 - DNA, 25 bp, Rattus norvegicus
gaagcacattcatgtcctgggccgt

SEQ ID NO: 300390 - DNA, 25 bp, Rattus norvegicus
gaagcacatttcactgtaggcctca

SEQ ID NO: 300391 - DNA, 25 bp, Rattus norvegicus
gaagcacatttctctgtaggcctca

SEQ ID NO: 300392 - DNA, 25 bp, Rattus norvegicus
gaagcacattttcatttgcaggata

SEQ ID NO: 300393 - DNA, 25 bp, Rattus norvegicus
gaagcacattttgatttgcaggata

SEQ ID NO: 300394 - DNA, 25 bp, Rattus norvegicus
gaagcaccaaagctgccagtgagaa

SEQ ID NO: 300395 - DNA, 25 bp, Rattus norvegicus
gaagcaccaaaggtgccagtgagaa

SEQ ID NO: 300396 - DNA, 25 bp, Rattus norvegicus
gaagcaccactgataacatgtttat

SEQ ID NO: 300397 - DNA, 25 bp, Rattus norvegicus
gaagcaccactgttaacatgtttat

SEQ ID NO: 300398 - DNA, 25 bp, Rattus norvegicus
gaagcaccaggcaaagcacactgta

SEQ ID NO: 300399 - DNA, 25 bp, Rattus norvegicus
gaagcaccaggctaagcacactgta

SEQ ID NO: 300400 - DNA, 25 bp, Rattus norvegicus
gaagcaccattgatccatttatctg

SEQ ID NO: 300401 - DNA, 25 bp, Rattus norvegicus
gaagcaccattgttccatttatctg

SEQ ID NO: 300402 - DNA, 25 bp, Rattus norvegicus
gaagcacccagtcgacacagcaaga

SEQ ID NO: 300403 - DNA, 25 bp, Rattus norvegicus
gaagcacccagtggacacagcaaga

SEQ ID NO: 300404 - DNA, 25 bp, Rattus norvegicus
gaagcacccattaactttctttaag

SEQ ID NO: 300405 - DNA, 25 bp, Rattus norvegicus
gaagcacccatttactttctttaag

SEQ ID NO: 300406 - DNA, 25 bp, Rattus norvegicus
gaagcaccccagatcacgagaggac

SEQ ID NO: 300407 - DNA, 25 bp, Rattus norvegicus
gaagcaccccagttcacgagaggac

SEQ ID NO: 300408 - DNA, 25 bp, Rattus norvegicus
gaagcaccccatctctgtggagacc

SEQ ID NO: 300409 - DNA, 25 bp, Rattus norvegicus
gaagcaccccatgtctgtggagacc

SEQ ID NO: 300410 - DNA, 25 bp, Rattus norvegicus
gaagcaccctgtaaaccttttagag

SEQ ID NO: 300411 - DNA, 25 bp, Rattus norvegicus
gaagcaccctgttaaccttttagag

SEQ ID NO: 300412 - DNA, 25 bp, Rattus norvegicus
gaagcaccctttctatcagatgtct

SEQ ID NO: 300413 - DNA, 25 bp, Rattus norvegicus
gaagcaccctttgtatcagatgtct

SEQ ID NO: 300414 - DNA, 25 bp, Rattus norvegicus
gaagcaccgtgcaagtctaagccta

SEQ ID NO: 300415 - DNA, 25 bp, Rattus norvegicus
gaagcaccgtgctagtctaagccta

SEQ ID NO: 300416 - DNA, 25 bp, Rattus norvegicus
gaagcacctaacatccagtctggag

SEQ ID NO: 300417 - DNA, 25 bp, Rattus norvegicus
gaagcacctaacttccagtctggag

SEQ ID NO: 300418 - DNA, 25 bp, Rattus norvegicus
gaagcacctacactgagttgttgaa

SEQ ID NO: 300419 - DNA, 25 bp, Rattus norvegicus
gaagcacctacagtgagttgttgaa

SEQ ID NO: 300420 - DNA, 25 bp, Rattus norvegicus
gaagcacctcagcacggactggaga

SEQ ID NO: 300421 - DNA, 25 bp, Rattus norvegicus
gaagcacctcaggacggactggaga

SEQ ID NO: 300422 - DNA, 25 bp, Rattus norvegicus
gaagcacctccacggtgtagccctg

SEQ ID NO: 300423 - DNA, 25 bp, Rattus norvegicus
gaagcacctccagggtgtagccctg

SEQ ID NO: 300424 - DNA, 25 bp, Rattus norvegicus
gaagcacctcccagataccaaatgc

SEQ ID NO: 300425 - DNA, 25 bp, Rattus norvegicus
gaagcacctccctgataccaaatgc

SEQ ID NO: 300426 - DNA, 25 bp, Rattus norvegicus
gaagcacctcctagtaagttcattg

SEQ ID NO: 300427 - DNA, 25 bp, Rattus norvegicus
gaagcacctccttgtaagttcattg

SEQ ID NO: 300428 - DNA, 25 bp, Rattus norvegicus
gaagcacctgaaaccagacctgaag

SEQ ID NO: 300429 - DNA, 25 bp, Rattus norvegicus
gaagcacctgaatccagacctgaag

SEQ ID NO: 300430 - DNA, 25 bp, Rattus norvegicus
gaagcacctgacaaatgtatcacga

SEQ ID NO: 300431 - DNA, 25 bp, Rattus norvegicus
gaagcacctgactaatgtatcacga

SEQ ID NO: 300432 - DNA, 25 bp, Rattus norvegicus
gaagcacctgccagagcatgtggac

SEQ ID NO: 300433 - DNA, 25 bp, Rattus norvegicus
gaagcacctgcctgagcatgtggac

SEQ ID NO: 300434 - DNA, 25 bp, Rattus norvegicus
gaagcacctgttagaattcagttgt

SEQ ID NO: 300435 - DNA, 25 bp, Rattus norvegicus
gaagcacctgtttgaattcagttgt

SEQ ID NO: 300436 - DNA, 25 bp, Rattus norvegicus
gaagcaccttacactttgtaccagc

SEQ ID NO: 300437 - DNA, 25 bp, Rattus norvegicus
gaagcaccttactctttgtaccagc

SEQ ID NO: 300438 - DNA, 25 bp, Rattus norvegicus
gaagcaccttccatcggaatgctat

SEQ ID NO: 300439 - DNA, 25 bp, Rattus norvegicus
gaagcaccttccttcggaatgctat

SEQ ID NO: 300440 - DNA, 25 bp, Rattus norvegicus
gaagcaccttttatcccaggtatgg

SEQ ID NO: 300441 - DNA, 25 bp, Rattus norvegicus
gaagcaccttttttcccaggtatgg

SEQ ID NO: 300442 - DNA, 25 bp, Rattus norvegicus
gaagcacgagtaacccaggaactga

SEQ ID NO: 300443 - DNA, 25 bp, Rattus norvegicus
gaagcacgagtatcccaggaactga

SEQ ID NO: 300444 - DNA, 25 bp, Rattus norvegicus
gaagcacgagtgacacttcacaaat

SEQ ID NO: 300445 - DNA, 25 bp, Rattus norvegicus
gaagcacgagtgtcacttcacaaat

SEQ ID NO: 300446 - DNA, 25 bp, Rattus norvegicus
gaagcacgcaggaaccttgtgactg

SEQ ID NO: 300447 - DNA, 25 bp, Rattus norvegicus
gaagcacgcaggtaccttgtgactg

SEQ ID NO: 300448 - DNA, 25 bp, Rattus norvegicus
gaagcacgctgaatgtttatctccc

SEQ ID NO: 300449 - DNA, 25 bp, Rattus norvegicus
gaagcacgctgattgtttatctccc

SEQ ID NO: 300450 - DNA, 25 bp, Rattus norvegicus
gaagcacggcatcttgcaggcagac

SEQ ID NO: 300451 - DNA, 25 bp, Rattus norvegicus
gaagcacggcatgttgcaggcagac

SEQ ID NO: 300452 - DNA, 25 bp, Rattus norvegicus
gaagcacggccaattacaacttgga

SEQ ID NO: 300453 - DNA, 25 bp, Rattus norvegicus
gaagcacggccatttacaacttgga

SEQ ID NO: 300454 - DNA, 25 bp, Rattus norvegicus
gaagcacgggacatgttggcatcat

SEQ ID NO: 300455 - DNA, 25 bp, Rattus norvegicus
gaagcacgggacttgttggcatcat

SEQ ID NO: 300456 - DNA, 25 bp, Rattus norvegicus
gaagcacgtaaaatctcccggtgaa

SEQ ID NO: 300457 - DNA, 25 bp, Rattus norvegicus
gaagcacgtaaattctcccggtgaa

SEQ ID NO: 300458 - DNA, 25 bp, Rattus norvegicus
gaagcacgtaatcaatgctcctctc

SEQ ID NO: 300459 - DNA, 25 bp, Rattus norvegicus
gaagcacgtaatgaatgctcctctc

SEQ ID NO: 300460 - DNA, 25 bp, Rattus norvegicus
gaagcacgtcctctgaaacctgcgt

SEQ ID NO: 300461 - DNA, 25 bp, Rattus norvegicus
gaagcacgtcctgtgaaacctgcgt

SEQ ID NO: 300462 - DNA, 25 bp, Rattus norvegicus
gaagcacgtgctccccgggacaaag

SEQ ID NO: 300463 - DNA, 25 bp, Rattus norvegicus
gaagcacgtgctgcccgggacaaag

SEQ ID NO: 300464 - DNA, 25 bp, Rattus norvegicus
gaagcacgtgttccctggctttcta

SEQ ID NO: 300465 - DNA, 25 bp, Rattus norvegicus
gaagcacgtgttgcctggctttcta

SEQ ID NO: 300466 - DNA, 25 bp, Rattus norvegicus
gaagcacgttttcatctctgagcta

SEQ ID NO: 300467 - DNA, 25 bp, Rattus norvegicus
gaagcacgttttgatctctgagcta

SEQ ID NO: 300468 - DNA, 25 bp, Rattus norvegicus
gaagcactaaacactttctatgaaa

SEQ ID NO: 300469 - DNA, 25 bp, Rattus norvegicus
gaagcactaaactctttctatgaaa

SEQ ID NO: 300470 - DNA, 25 bp, Rattus norvegicus
gaagcactaaggatgtccagtttcc

SEQ ID NO: 300471 - DNA, 25 bp, Rattus norvegicus
gaagcactaaggttgtccagtttcc

SEQ ID NO: 300472 - DNA, 25 bp, Rattus norvegicus
gaagcactaattccattacattggt

SEQ ID NO: 300473 - DNA, 25 bp, Rattus norvegicus
gaagcactaattgcattacattggt

SEQ ID NO: 300474 - DNA, 25 bp, Rattus norvegicus
gaagcactacggctgctctttatac

SEQ ID NO: 300475 - DNA, 25 bp, Rattus norvegicus
gaagcactacgggtgctctttatac

SEQ ID NO: 300476 - DNA, 25 bp, Rattus norvegicus
gaagcactacgtcgtgtagccctgt

SEQ ID NO: 300477 - DNA, 25 bp, Rattus norvegicus
gaagcactacgtggtgtagccctgt

SEQ ID NO: 300478 - DNA, 25 bp, Rattus norvegicus
gaagcactacttctactcagacctt

SEQ ID NO: 300479 - DNA, 25 bp, Rattus norvegicus
gaagcactacttgtactcagacctt

SEQ ID NO: 300480 - DNA, 25 bp, Rattus norvegicus
gaagcactatgtattcttaggcaaa

SEQ ID NO: 300481 - DNA, 25 bp, Rattus norvegicus
gaagcactatgttttcttaggcaaa

SEQ ID NO: 300482 - DNA, 25 bp, Rattus norvegicus
gaagcactcaccatgcaggaagcaa

SEQ ID NO: 300483 - DNA, 25 bp, Rattus norvegicus
gaagcactcaccttgcaggaagcaa

SEQ ID NO: 300484 - DNA, 25 bp, Rattus norvegicus
gaagcactcactactttgactgcat

SEQ ID NO: 300485 - DNA, 25 bp, Rattus norvegicus
gaagcactcacttctttgactgcat

SEQ ID NO: 300486 - DNA, 25 bp, Rattus norvegicus
gaagcactcattcccaaacagttgc

SEQ ID NO: 300487 - DNA, 25 bp, Rattus norvegicus
gaagcactcattgccaaacagttgc

SEQ ID NO: 300488 - DNA, 25 bp, Rattus norvegicus
gaagcactccagatcattgagagga

SEQ ID NO: 300489 - DNA, 25 bp, Rattus norvegicus
gaagcactccagttcattgagagga

SEQ ID NO: 300490 - DNA, 25 bp, Rattus norvegicus
gaagcactccggagaagctctccca

SEQ ID NO: 300491 - DNA, 25 bp, Rattus norvegicus
gaagcactccggtgaagctctccca

SEQ ID NO: 300492 - DNA, 25 bp, Rattus norvegicus
gaagcactccttatgcagtgtcata

SEQ ID NO: 300493 - DNA, 25 bp, Rattus norvegicus
gaagcactccttttgcagtgtcata

SEQ ID NO: 300494 - DNA, 25 bp, Rattus norvegicus
gaagcactctccagtaggtggcgaa

SEQ ID NO: 300495 - DNA, 25 bp, Rattus norvegicus
gaagcactctcctgtaggtggcgaa

SEQ ID NO: 300496 - DNA, 25 bp, Rattus norvegicus
gaagcactcttaactatgagcaaag

SEQ ID NO: 300497 - DNA, 25 bp, Rattus norvegicus
gaagcactcttatctatgagcaaag

SEQ ID NO: 300498 - DNA, 25 bp, Rattus norvegicus
gaagcactgagacctccaggctagc

SEQ ID NO: 300499 - DNA, 25 bp, Rattus norvegicus
gaagcactgagagctccaggctagc

SEQ ID NO: 300500 - DNA, 25 bp, Rattus norvegicus
gaagcactgccccttcagaatataa

SEQ ID NO: 300501 - DNA, 25 bp, Rattus norvegicus
gaagcactgcccgttcagaatataa

SEQ ID NO: 300502 - DNA, 25 bp, Rattus norvegicus
gaagcactgctaccatgaggccatg

SEQ ID NO: 300503 - DNA, 25 bp, Rattus norvegicus
gaagcactgctagcatgaggccatg

SEQ ID NO: 300504 - DNA, 25 bp, Rattus norvegicus
gaagcactggccactgtgggaatca

SEQ ID NO: 300505 - DNA, 25 bp, Rattus norvegicus
gaagcactggcctctgtgggaatca

SEQ ID NO: 300506 - DNA, 25 bp, Rattus norvegicus
gaagcactggctcggcattttaatt

SEQ ID NO: 300507 - DNA, 25 bp, Rattus norvegicus
gaagcactggctgggcattttaatt

SEQ ID NO: 300508 - DNA, 25 bp, Rattus norvegicus
gaagcactggtcatcgactaccttt

SEQ ID NO: 300509 - DNA, 25 bp, Rattus norvegicus
gaagcactggtcttcgactaccttt

SEQ ID NO: 300510 - DNA, 25 bp, Rattus norvegicus
gaagcactgtaccattaggccacat

SEQ ID NO: 300511 - DNA, 25 bp, Rattus norvegicus
gaagcactgtacgattaggccacat

SEQ ID NO: 300512 - DNA, 25 bp, Rattus norvegicus
gaagcactgtttcctccaggcagaa

SEQ ID NO: 300513 - DNA, 25 bp, Rattus norvegicus
gaagcactgtttgctccaggcagaa

SEQ ID NO: 300514 - DNA, 25 bp, Rattus norvegicus
gaagcacttaaccagtcccctgtgc

SEQ ID NO: 300515 - DNA, 25 bp, Rattus norvegicus
gaagcacttaacgagtcccctgtgc

SEQ ID NO: 300516 - DNA, 25 bp, Rattus norvegicus
gaagcacttaagactggagcctaga

SEQ ID NO: 300517 - DNA, 25 bp, Rattus norvegicus
gaagcacttaagtctggagcctaga

SEQ ID NO: 300518 - DNA, 25 bp, Rattus norvegicus
gaagcacttagtcgctgactccctg

SEQ ID NO: 300519 - DNA, 25 bp, Rattus norvegicus
gaagcacttagtggctgactccctg

SEQ ID NO: 300520 - DNA, 25 bp, Rattus norvegicus
gaagcacttcccagaaggacagaat

SEQ ID NO: 300521 - DNA, 25 bp, Rattus norvegicus
gaagcacttccctgaaggacagaat

SEQ ID NO: 300522 - DNA, 25 bp, Rattus norvegicus
gaagcacttgggagtttctgcaaga

SEQ ID NO: 300523 - DNA, 25 bp, Rattus norvegicus
gaagcacttgggtgtttctgcaaga

SEQ ID NO: 300524 - DNA, 25 bp, Rattus norvegicus
gaagcacttgttaggatgggtctgt

SEQ ID NO: 300525 - DNA, 25 bp, Rattus norvegicus
gaagcacttgtttggatgggtctgt

SEQ ID NO: 300526 - DNA, 25 bp, Rattus norvegicus
gaagcactttatcgactgcgggaat

SEQ ID NO: 300527 - DNA, 25 bp, Rattus norvegicus
gaagcactttatggactgcgggaat

SEQ ID NO: 300528 - DNA, 25 bp, Rattus norvegicus
gaagcactttcaaattattgtccct

SEQ ID NO: 300529 - DNA, 25 bp, Rattus norvegicus
gaagcactttcatattattgtccct

SEQ ID NO: 300530 - DNA, 25 bp, Rattus norvegicus
gaagcactttcccttctgaaccatg

SEQ ID NO: 300531 - DNA, 25 bp, Rattus norvegicus
gaagcactttccgttctgaaccatg

SEQ ID NO: 300532 - DNA, 25 bp, Rattus norvegicus
gaagcactttgccttggtttaatct

SEQ ID NO: 300533 - DNA, 25 bp, Rattus norvegicus
gaagcactttgcgttggtttaatct

SEQ ID NO: 300534 - DNA, 25 bp, Rattus norvegicus
gaagcagaaatgatagtagactcca

SEQ ID NO: 300535 - DNA, 25 bp, Rattus norvegicus
gaagcagaaatgttagtagactcca

SEQ ID NO: 300536 - DNA, 25 bp, Rattus norvegicus
gaagcagaaattccctttgattttc

SEQ ID NO: 300537 - DNA, 25 bp, Rattus norvegicus
gaagcagaaattgcctttgattttc

SEQ ID NO: 300538 - DNA, 25 bp, Rattus norvegicus
gaagcagaacccatcaggctttggg

SEQ ID NO: 300539 - DNA, 25 bp, Rattus norvegicus
gaagcagaacccttcaggctttggg

SEQ ID NO: 300540 - DNA, 25 bp, Rattus norvegicus
gaagcagaactcctttgtgcaatga

SEQ ID NO: 300541 - DNA, 25 bp, Rattus norvegicus
gaagcagaactcgtttgtgcaatga

SEQ ID NO: 300542 - DNA, 25 bp, Rattus norvegicus
gaagcagaagcccagggtccgtacc

SEQ ID NO: 300543 - DNA, 25 bp, Rattus norvegicus
gaagcagaagccgagggtccgtacc

SEQ ID NO: 300544 - DNA, 25 bp, Rattus norvegicus
gaagcagaagcgctggccatttttc

SEQ ID NO: 300545 - DNA, 25 bp, Rattus norvegicus
gaagcagaagcggtggccatttttc

SEQ ID NO: 300546 - DNA, 25 bp, Rattus norvegicus
gaagcagaagctactatgcacccag

SEQ ID NO: 300547 - DNA, 25 bp, Rattus norvegicus
gaagcagaagcttctatgcacccag

SEQ ID NO: 300548 - DNA, 25 bp, Rattus norvegicus
gaagcagaagttcctctgtgagttt

SEQ ID NO: 300549 - DNA, 25 bp, Rattus norvegicus
gaagcagaagttgctctgtgagttt

SEQ ID NO: 300550 - DNA, 25 bp, Rattus norvegicus
gaagcagaattcatggaggagtact

SEQ ID NO: 300551 - DNA, 25 bp, Rattus norvegicus
gaagcagaattccaacatgctgtta

SEQ ID NO: 300552 - DNA, 25 bp, Rattus norvegicus
gaagcagaattcgaacatgctgtta

SEQ ID NO: 300553 - DNA, 25 bp, Rattus norvegicus
gaagcagaattcttggaggagtact

SEQ ID NO: 300554 - DNA, 25 bp, Rattus norvegicus
gaagcagacagaatctcacaccggc

SEQ ID NO: 300555 - DNA, 25 bp, Rattus norvegicus
gaagcagacagattctcacaccggc

SEQ ID NO: 300556 - DNA, 25 bp, Rattus norvegicus
gaagcagacagtagacacgggagca

SEQ ID NO: 300557 - DNA, 25 bp, Rattus norvegicus
gaagcagacagttgacacgggagca

SEQ ID NO: 300558 - DNA, 25 bp, Rattus norvegicus
gaagcagaccgtaacgggtcccatt

SEQ ID NO: 300559 - DNA, 25 bp, Rattus norvegicus
gaagcagaccgttacgggtcccatt

SEQ ID NO: 300560 - DNA, 25 bp, Rattus norvegicus
gaagcagacgcaataccagcctaag

SEQ ID NO: 300561 - DNA, 25 bp, Rattus norvegicus
gaagcagacgcattaccagcctaag

SEQ ID NO: 300562 - DNA, 25 bp, Rattus norvegicus
gaagcagactgaccaggaagcataa

SEQ ID NO: 300563 - DNA, 25 bp, Rattus norvegicus
gaagcagactgagcaggaagcataa

SEQ ID NO: 300564 - DNA, 25 bp, Rattus norvegicus
gaagcagactggacatggacatggt

SEQ ID NO: 300565 - DNA, 25 bp, Rattus norvegicus
gaagcagactggtcatggacatggt

SEQ ID NO: 300566 - DNA, 25 bp, Rattus norvegicus
gaagcagagattctctccctactga

SEQ ID NO: 300567 - DNA, 25 bp, Rattus norvegicus
gaagcagagattgtctccctactga

SEQ ID NO: 300568 - DNA, 25 bp, Rattus norvegicus
gaagcagagcttctgctatgcacgg

SEQ ID NO: 300569 - DNA, 25 bp, Rattus norvegicus
gaagcagagcttgtgctatgcacgg

SEQ ID NO: 300570 - DNA, 25 bp, Rattus norvegicus
gaagcagaggagatgtgaagtccct

SEQ ID NO: 300571 - DNA, 25 bp, Rattus norvegicus
gaagcagaggagttgtgaagtccct

SEQ ID NO: 300572 - DNA, 25 bp, Rattus norvegicus
gaagcagaggtcacccagctagcga

SEQ ID NO: 300573 - DNA, 25 bp, Rattus norvegicus
gaagcagaggtccttctgtctacaa

SEQ ID NO: 300574 - DNA, 25 bp, Rattus norvegicus
gaagcagaggtcgttctgtctacaa

SEQ ID NO: 300575 - DNA, 25 bp, Rattus norvegicus
gaagcagaggtctcccagctagcga

SEQ ID NO: 300576 - DNA, 25 bp, Rattus norvegicus
gaagcagatcggagcagccacttac

SEQ ID NO: 300577 - DNA, 25 bp, Rattus norvegicus
gaagcagatcggtgcagccacttac

SEQ ID NO: 300578 - DNA, 25 bp, Rattus norvegicus
gaagcagatgacagagcccgagctg

SEQ ID NO: 300579 - DNA, 25 bp, Rattus norvegicus
gaagcagatgactgagcccgagctg

SEQ ID NO: 300580 - DNA, 25 bp, Rattus norvegicus
gaagcagatgctattcaggtatcaa

SEQ ID NO: 300581 - DNA, 25 bp, Rattus norvegicus
gaagcagatgcttttcaggtatcaa

SEQ ID NO: 300582 - DNA, 25 bp, Rattus norvegicus
gaagcagattctccgagctgtctac

SEQ ID NO: 300583 - DNA, 25 bp, Rattus norvegicus
gaagcagattctgcgagctgtctac

SEQ ID NO: 300584 - DNA, 25 bp, Rattus norvegicus
gaagcagattttagccacgtctctc

SEQ ID NO: 300585 - DNA, 25 bp, Rattus norvegicus
gaagcagatttttgccacgtctctc

SEQ ID NO: 300586 - DNA, 25 bp, Rattus norvegicus
gaagcagcaactcctgagcacggga

SEQ ID NO: 300587 - DNA, 25 bp, Rattus norvegicus
gaagcagcaactgctgagcacggga

SEQ ID NO: 300588 - DNA, 25 bp, Rattus norvegicus
gaagcagcaagacctcaacatcatg

SEQ ID NO: 300589 - DNA, 25 bp, Rattus norvegicus
gaagcagcaagagctcaacatcatg

SEQ ID NO: 300590 - DNA, 25 bp, Rattus norvegicus
gaagcagcaaggacactcttgttcc

SEQ ID NO: 300591 - DNA, 25 bp, Rattus norvegicus
gaagcagcaaggtcactcttgttcc

SEQ ID NO: 300592 - DNA, 25 bp, Rattus norvegicus
gaagcagcacatcggctacgccaaa

SEQ ID NO: 300593 - DNA, 25 bp, Rattus norvegicus
gaagcagcacatgggctacgccaaa

SEQ ID NO: 300594 - DNA, 25 bp, Rattus norvegicus
gaagcagcacctcctgtccatgaaa

SEQ ID NO: 300595 - DNA, 25 bp, Rattus norvegicus
gaagcagcacctgctgtccatgaaa

SEQ ID NO: 300596 - DNA, 25 bp, Rattus norvegicus
gaagcagcactgactaccttacgtc

SEQ ID NO: 300597 - DNA, 25 bp, Rattus norvegicus
gaagcagcactgtctaccttacgtc

SEQ ID NO: 300598 - DNA, 25 bp, Rattus norvegicus
gaagcagcagaactgtcttccagct

SEQ ID NO: 300599 - DNA, 25 bp, Rattus norvegicus
gaagcagcagaagtgtcttccagct

SEQ ID NO: 300600 - DNA, 25 bp, Rattus norvegicus
gaagcagcagagctcgcgcagctcc

SEQ ID NO: 300601 - DNA, 25 bp, Rattus norvegicus
gaagcagcagaggtcgcgcagctcc

SEQ ID NO: 300602 - DNA, 25 bp, Rattus norvegicus
gaagcagcagcaactttaattacaa

SEQ ID NO: 300603 - DNA, 25 bp, Rattus norvegicus
gaagcagcagcatctttaattacaa

SEQ ID NO: 300604 - DNA, 25 bp, Rattus norvegicus
gaagcagcagctccaacagtacgtc

SEQ ID NO: 300605 - DNA, 25 bp, Rattus norvegicus
gaagcagcagctgcaacagtacgtc

SEQ ID NO: 300606 - DNA, 25 bp, Rattus norvegicus
gaagcagcagtcattacttccagcc

SEQ ID NO: 300607 - DNA, 25 bp, Rattus norvegicus
gaagcagcagtctttacttccagcc

SEQ ID NO: 300608 - DNA, 25 bp, Rattus norvegicus
gaagcagcagtgacagttcaatcaa

SEQ ID NO: 300609 - DNA, 25 bp, Rattus norvegicus
gaagcagcagtgtcagttcaatcaa

SEQ ID NO: 300610 - DNA, 25 bp, Rattus norvegicus
gaagcagcataaccagaccgctctc

SEQ ID NO: 300611 - DNA, 25 bp, Rattus norvegicus
gaagcagcataagcagaccgctctc

SEQ ID NO: 300612 - DNA, 25 bp, Rattus norvegicus
gaagcagcatatcggttctgaatat

SEQ ID NO: 300613 - DNA, 25 bp, Rattus norvegicus
gaagcagcatatgggttctgaatat

SEQ ID NO: 300614 - DNA, 25 bp, Rattus norvegicus
gaagcagcatcaatcaagtgcccat

SEQ ID NO: 300615 - DNA, 25 bp, Rattus norvegicus
gaagcagcatcattcaagtgcccat

SEQ ID NO: 300616 - DNA, 25 bp, Rattus norvegicus
gaagcagccagaatcagacctgtgg

SEQ ID NO: 300617 - DNA, 25 bp, Rattus norvegicus
gaagcagccagaccatagaaacaag

SEQ ID NO: 300618 - DNA, 25 bp, Rattus norvegicus
gaagcagccagagcatagaaacaag

SEQ ID NO: 300619 - DNA, 25 bp, Rattus norvegicus
gaagcagccagattcagacctgtgg

SEQ ID NO: 300620 - DNA, 25 bp, Rattus norvegicus
gaagcagccatgatcatgcacatga

SEQ ID NO: 300621 - DNA, 25 bp, Rattus norvegicus
gaagcagccatgttcatgcacatga

SEQ ID NO: 300622 - DNA, 25 bp, Rattus norvegicus
gaagcagccctaagctattccatgg

SEQ ID NO: 300623 - DNA, 25 bp, Rattus norvegicus
gaagcagccctatgctattccatgg

SEQ ID NO: 300624 - DNA, 25 bp, Rattus norvegicus
gaagcagccgtaatgcagattttat

SEQ ID NO: 300625 - DNA, 25 bp, Rattus norvegicus
gaagcagccgtactgctgaccagca

SEQ ID NO: 300626 - DNA, 25 bp, Rattus norvegicus
gaagcagccgtagtgctgaccagca

SEQ ID NO: 300627 - DNA, 25 bp, Rattus norvegicus
gaagcagccgtattgcagattttat

SEQ ID NO: 300628 - DNA, 25 bp, Rattus norvegicus
gaagcagcctcactctttgtgttca

SEQ ID NO: 300629 - DNA, 25 bp, Rattus norvegicus
gaagcagcctcagtctttgtgttca

SEQ ID NO: 300630 - DNA, 25 bp, Rattus norvegicus
gaagcagcctctacagcagctggaa

SEQ ID NO: 300631 - DNA, 25 bp, Rattus norvegicus
gaagcagcctcttcagcagctggaa

SEQ ID NO: 300632 - DNA, 25 bp, Rattus norvegicus
gaagcagcctggctctgatccactt

SEQ ID NO: 300633 - DNA, 25 bp, Rattus norvegicus
gaagcagcctgggtctgatccactt

SEQ ID NO: 300634 - DNA, 25 bp, Rattus norvegicus
gaagcagccttcacctttggttcat

SEQ ID NO: 300635 - DNA, 25 bp, Rattus norvegicus
gaagcagccttctcctttggttcat

SEQ ID NO: 300636 - DNA, 25 bp, Rattus norvegicus
gaagcagccttgaatcatccctgaa

SEQ ID NO: 300637 - DNA, 25 bp, Rattus norvegicus
gaagcagccttgcaaccatatttcc

SEQ ID NO: 300638 - DNA, 25 bp, Rattus norvegicus
gaagcagccttggaaccatatttcc

SEQ ID NO: 300639 - DNA, 25 bp, Rattus norvegicus
gaagcagccttgtatcatccctgaa

SEQ ID NO: 300640 - DNA, 25 bp, Rattus norvegicus
gaagcagcgaatccagactccagtg

SEQ ID NO: 300641 - DNA, 25 bp, Rattus norvegicus
gaagcagcgaatgcagactccagtg

SEQ ID NO: 300642 - DNA, 25 bp, Rattus norvegicus
gaagcagcgacaactcagcagtgga

SEQ ID NO: 300643 - DNA, 25 bp, Rattus norvegicus
gaagcagcgacatctcagcagtgga

SEQ ID NO: 300644 - DNA, 25 bp, Rattus norvegicus
gaagcagcggacattgtccatgatt

SEQ ID NO: 300645 - DNA, 25 bp, Rattus norvegicus
gaagcagcggactttgtccatgatt

SEQ ID NO: 300646 - DNA, 25 bp, Rattus norvegicus
gaagcagcggatcctgaagccgtta

SEQ ID NO: 300647 - DNA, 25 bp, Rattus norvegicus
gaagcagcggatgctgaagccgtta

SEQ ID NO: 300648 - DNA, 25 bp, Rattus norvegicus
gaagcagcgggtcacagccctgtat

SEQ ID NO: 300649 - DNA, 25 bp, Rattus norvegicus
gaagcagcgggtgacagccctgtat

SEQ ID NO: 300650 - DNA, 25 bp, Rattus norvegicus
gaagcagctacaaaccactgagtaa

SEQ ID NO: 300651 - DNA, 25 bp, Rattus norvegicus
gaagcagctacactgagcccagaca

SEQ ID NO: 300652 - DNA, 25 bp, Rattus norvegicus
gaagcagctacagtgagcccagaca

SEQ ID NO: 300653 - DNA, 25 bp, Rattus norvegicus
gaagcagctacataccactgagtaa

SEQ ID NO: 300654 - DNA, 25 bp, Rattus norvegicus
gaagcagctagaacgggcacaatta

SEQ ID NO: 300655 - DNA, 25 bp, Rattus norvegicus
gaagcagctagatcgggcacaatta

SEQ ID NO: 300656 - DNA, 25 bp, Rattus norvegicus
gaagcagctagtatcagctctggcc

SEQ ID NO: 300657 - DNA, 25 bp, Rattus norvegicus
gaagcagctagtttcagctctggcc

SEQ ID NO: 300658 - DNA, 25 bp, Rattus norvegicus
gaagcagctcttcatgctttggata

SEQ ID NO: 300659 - DNA, 25 bp, Rattus norvegicus
gaagcagctcttgatgctttggata

SEQ ID NO: 300660 - DNA, 25 bp, Rattus norvegicus
gaagcagctgaaccagcccgcatat

SEQ ID NO: 300661 - DNA, 25 bp, Rattus norvegicus
gaagcagctgaagcagcccgcatat

SEQ ID NO: 300662 - DNA, 25 bp, Rattus norvegicus
gaagcagctgatcaagcagggcctc

SEQ ID NO: 300663 - DNA, 25 bp, Rattus norvegicus
gaagcagctgatgaagcagggcctc

SEQ ID NO: 300664 - DNA, 25 bp, Rattus norvegicus
gaagcagctgccaccagactgatct

SEQ ID NO: 300665 - DNA, 25 bp, Rattus norvegicus
gaagcagctgcctccagactgatct

SEQ ID NO: 300666 - DNA, 25 bp, Rattus norvegicus
gaagcagctgctctaagccaagcgt

SEQ ID NO: 300667 - DNA, 25 bp, Rattus norvegicus
gaagcagctgctgtaagccaagcgt

SEQ ID NO: 300668 - DNA, 25 bp, Rattus norvegicus
gaagcagctggcaagaagctctcat

SEQ ID NO: 300669 - DNA, 25 bp, Rattus norvegicus
gaagcagctggctagaagctctcat

SEQ ID NO: 300670 - DNA, 25 bp, Rattus norvegicus
gaagcagcttccaggagcctacagt

SEQ ID NO: 300671 - DNA, 25 bp, Rattus norvegicus
gaagcagcttcctggagcctacagt

SEQ ID NO: 300672 - DNA, 25 bp, Rattus norvegicus
gaagcagcttctcacttttacagga

SEQ ID NO: 300673 - DNA, 25 bp, Rattus norvegicus
gaagcagcttctgacttttacagga

SEQ ID NO: 300674 - DNA, 25 bp, Rattus norvegicus
gaagcagcttggacaaagcctgtca

SEQ ID NO: 300675 - DNA, 25 bp, Rattus norvegicus
gaagcagcttggtcaaagcctgtca

SEQ ID NO: 300676 - DNA, 25 bp, Rattus norvegicus
gaagcagctttgaagcaccttggtt

SEQ ID NO: 300677 - DNA, 25 bp, Rattus norvegicus
gaagcagctttgtagcaccttggtt

SEQ ID NO: 300678 - DNA, 25 bp, Rattus norvegicus
gaagcaggaaggcaccatgcaccat

SEQ ID NO: 300679 - DNA, 25 bp, Rattus norvegicus
gaagcaggaagggaccatgcaccat

SEQ ID NO: 300680 - DNA, 25 bp, Rattus norvegicus
gaagcaggactcactgctttgactc

SEQ ID NO: 300681 - DNA, 25 bp, Rattus norvegicus
gaagcaggactctctgctttgactc

SEQ ID NO: 300682 - DNA, 25 bp, Rattus norvegicus
gaagcaggactgaaaagccagtgtt

SEQ ID NO: 300683 - DNA, 25 bp, Rattus norvegicus
gaagcaggactgtaaagccagtgtt

SEQ ID NO: 300684 - DNA, 25 bp, Rattus norvegicus
gaagcaggagcacataccactgaca

SEQ ID NO: 300685 - DNA, 25 bp, Rattus norvegicus
gaagcaggagcagataccactgaca

SEQ ID NO: 300686 - DNA, 25 bp, Rattus norvegicus
gaagcaggagccatcaggatgccct

SEQ ID NO: 300687 - DNA, 25 bp, Rattus norvegicus
gaagcaggagccttcaggatgccct

SEQ ID NO: 300688 - DNA, 25 bp, Rattus norvegicus
gaagcaggaggtattcctttgtcct

SEQ ID NO: 300689 - DNA, 25 bp, Rattus norvegicus
gaagcaggaggttttcctttgtcct

SEQ ID NO: 300690 - DNA, 25 bp, Rattus norvegicus
gaagcaggatcgagagtctctagcc

SEQ ID NO: 300691 - DNA, 25 bp, Rattus norvegicus
gaagcaggatcgtgagtctctagcc

SEQ ID NO: 300692 - DNA, 25 bp, Rattus norvegicus
gaagcaggcactcgagcaaatccct

SEQ ID NO: 300693 - DNA, 25 bp, Rattus norvegicus
gaagcaggcactggagcaaatccct

SEQ ID NO: 300694 - DNA, 25 bp, Rattus norvegicus
gaagcaggcagtcctacagatccaa

SEQ ID NO: 300695 - DNA, 25 bp, Rattus norvegicus
gaagcaggcagtgctacagatccaa

SEQ ID NO: 300696 - DNA, 25 bp, Rattus norvegicus
gaagcaggccacatttactggagtt

SEQ ID NO: 300697 - DNA, 25 bp, Rattus norvegicus
gaagcaggccacttttactggagtt

SEQ ID NO: 300698 - DNA, 25 bp, Rattus norvegicus
gaagcaggcccacaacattgttatg

SEQ ID NO: 300699 - DNA, 25 bp, Rattus norvegicus
gaagcaggcccagaacattgttatg

SEQ ID NO: 300700 - DNA, 25 bp, Rattus norvegicus
gaagcaggcctacgagcaagagcaa

SEQ ID NO: 300701 - DNA, 25 bp, Rattus norvegicus
gaagcaggcctaggagcaagagcaa

SEQ ID NO: 300702 - DNA, 25 bp, Rattus norvegicus
gaagcaggcggacctcacagagact

SEQ ID NO: 300703 - DNA, 25 bp, Rattus norvegicus
gaagcaggcggagctcacagagact

SEQ ID NO: 300704 - DNA, 25 bp, Rattus norvegicus
gaagcaggctataggtaccatcagt

SEQ ID NO: 300705 - DNA, 25 bp, Rattus norvegicus
gaagcaggctattggtaccatcagt

SEQ ID NO: 300706 - DNA, 25 bp, Rattus norvegicus
gaagcaggctgcagtggtcctagat

SEQ ID NO: 300707 - DNA, 25 bp, Rattus norvegicus
gaagcaggctgctgtggtcctagat

SEQ ID NO: 300708 - DNA, 25 bp, Rattus norvegicus
gaagcagggactacattgcagggtc

SEQ ID NO: 300709 - DNA, 25 bp, Rattus norvegicus
gaagcagggacttcattgcagggtc

SEQ ID NO: 300710 - DNA, 25 bp, Rattus norvegicus
gaagcagggcacaatatcgagcctc

SEQ ID NO: 300711 - DNA, 25 bp, Rattus norvegicus
gaagcagggcactatatcgagcctc

SEQ ID NO: 300712 - DNA, 25 bp, Rattus norvegicus
gaagcagggccaagtgagccacttt

SEQ ID NO: 300713 - DNA, 25 bp, Rattus norvegicus
gaagcagggccatgtgagccacttt

SEQ ID NO: 300714 - DNA, 25 bp, Rattus norvegicus
gaagcagggcctagatccatacaaa

SEQ ID NO: 300715 - DNA, 25 bp, Rattus norvegicus
gaagcagggccttgatccatacaaa

SEQ ID NO: 300716 - DNA, 25 bp, Rattus norvegicus
gaagcagggctgaaactatcaccat

SEQ ID NO: 300717 - DNA, 25 bp, Rattus norvegicus
gaagcagggctgtaactatcaccat

SEQ ID NO: 300718 - DNA, 25 bp, Rattus norvegicus
gaagcagggtcgaactcccggtgtc

SEQ ID NO: 300719 - DNA, 25 bp, Rattus norvegicus
gaagcagggtcgtactcccggtgtc

SEQ ID NO: 300720 - DNA, 25 bp, Rattus norvegicus
gaagcaggtcctaagtcatttaaaa

SEQ ID NO: 300721 - DNA, 25 bp, Rattus norvegicus
gaagcaggtccttagtcatttaaaa

SEQ ID NO: 300722 - DNA, 25 bp, Rattus norvegicus
gaagcaggtgcacaaccggttcgct

SEQ ID NO: 300723 - DNA, 25 bp, Rattus norvegicus
gaagcaggtgcagaaccggttcgct

SEQ ID NO: 300724 - DNA, 25 bp, Rattus norvegicus
gaagcaggtggtattctgaattcaa

SEQ ID NO: 300725 - DNA, 25 bp, Rattus norvegicus
gaagcaggtggttttctgaattcaa

SEQ ID NO: 300726 - DNA, 25 bp, Rattus norvegicus
gaagcaggtgtcagtcagtgtttat

SEQ ID NO: 300727 - DNA, 25 bp, Rattus norvegicus
gaagcaggtgtctgtcagtgtttat

SEQ ID NO: 300728 - DNA, 25 bp, Rattus norvegicus
gaagcagtaacactgaaaccttgtt

SEQ ID NO: 300729 - DNA, 25 bp, Rattus norvegicus
gaagcagtaacagtgaaaccttgtt

SEQ ID NO: 300730 - DNA, 25 bp, Rattus norvegicus
gaagcagtaagtaggcactgtgcca

SEQ ID NO: 300731 - DNA, 25 bp, Rattus norvegicus
gaagcagtaagttggcactgtgcca

SEQ ID NO: 300732 - DNA, 25 bp, Rattus norvegicus
gaagcagtaccaagagatacctgaa

SEQ ID NO: 300733 - DNA, 25 bp, Rattus norvegicus
gaagcagtaccatgagatacctgaa

SEQ ID NO: 300734 - DNA, 25 bp, Rattus norvegicus
gaagcagtagagacttctggtgaca

SEQ ID NO: 300735 - DNA, 25 bp, Rattus norvegicus
gaagcagtagagtcttctggtgaca

SEQ ID NO: 300736 - DNA, 25 bp, Rattus norvegicus
gaagcagtagtgacaccctgaggaa

SEQ ID NO: 300737 - DNA, 25 bp, Rattus norvegicus
gaagcagtagtgtcaccctgaggaa

SEQ ID NO: 300738 - DNA, 25 bp, Rattus norvegicus
gaagcagtatccatgttgccttgtg

SEQ ID NO: 300739 - DNA, 25 bp, Rattus norvegicus
gaagcagtatccttgttgccttgtg

SEQ ID NO: 300740 - DNA, 25 bp, Rattus norvegicus
gaagcagtcaccacagagagcagat

SEQ ID NO: 300741 - DNA, 25 bp, Rattus norvegicus
gaagcagtcacctcagagagcagat

SEQ ID NO: 300742 - DNA, 25 bp, Rattus norvegicus
gaagcagtcaggaacccgagtctgt

SEQ ID NO: 300743 - DNA, 25 bp, Rattus norvegicus
gaagcagtcaggtacccgagtctgt

SEQ ID NO: 300744 - DNA, 25 bp, Rattus norvegicus
gaagcagtcatcagcaacagtggtg

SEQ ID NO: 300745 - DNA, 25 bp, Rattus norvegicus
gaagcagtcatctgcaacagtggtg

SEQ ID NO: 300746 - DNA, 25 bp, Rattus norvegicus
gaagcagtcatgagctgacacgaaa

SEQ ID NO: 300747 - DNA, 25 bp, Rattus norvegicus
gaagcagtcatgtgctgacacgaaa

SEQ ID NO: 300748 - DNA, 25 bp, Rattus norvegicus
gaagcagtctaaaatattttgcact

SEQ ID NO: 300749 - DNA, 25 bp, Rattus norvegicus
gaagcagtctaatatattttgcact

SEQ ID NO: 300750 - DNA, 25 bp, Rattus norvegicus
gaagcagtctgacggccttaccaaa

SEQ ID NO: 300751 - DNA, 25 bp, Rattus norvegicus
gaagcagtctgagggccttaccaaa

SEQ ID NO: 300752 - DNA, 25 bp, Rattus norvegicus
gaagcagtgacactccagtgatcct

SEQ ID NO: 300753 - DNA, 25 bp, Rattus norvegicus
gaagcagtgacagtccagtgatcct

SEQ ID NO: 300754 - DNA, 25 bp, Rattus norvegicus
gaagcagtgaccaacatagaacgat

SEQ ID NO: 300755 - DNA, 25 bp, Rattus norvegicus
gaagcagtgacctacatagaacgat

SEQ ID NO: 300756 - DNA, 25 bp, Rattus norvegicus
gaagcagtgcatccattttctttag

SEQ ID NO: 300757 - DNA, 25 bp, Rattus norvegicus
gaagcagtgcatgcattttctttag

SEQ ID NO: 300758 - DNA, 25 bp, Rattus norvegicus
gaagcagtgcctcccagccatggtg

SEQ ID NO: 300759 - DNA, 25 bp, Rattus norvegicus
gaagcagtgcctgccagccatggtg

SEQ ID NO: 300760 - DNA, 25 bp, Rattus norvegicus
gaagcagtggctacagatccctgaa

SEQ ID NO: 300761 - DNA, 25 bp, Rattus norvegicus
gaagcagtggcttcagatccctgaa

SEQ ID NO: 300762 - DNA, 25 bp, Rattus norvegicus
gaagcagtggtcaccttgcatgttg

SEQ ID NO: 300763 - DNA, 25 bp, Rattus norvegicus
gaagcagtggtctccttgcatgttg

SEQ ID NO: 300764 - DNA, 25 bp, Rattus norvegicus
gaagcagtgtgtcgctctcttcaag

SEQ ID NO: 300765 - DNA, 25 bp, Rattus norvegicus
gaagcagtgtgtggctctcttcaag

SEQ ID NO: 300766 - DNA, 25 bp, Rattus norvegicus
gaagcagtgttcattgacgtactag

SEQ ID NO: 300767 - DNA, 25 bp, Rattus norvegicus
gaagcagtgttctttgacgtactag

SEQ ID NO: 300768 - DNA, 25 bp, Rattus norvegicus
gaagcagttacaaccgtctttcatc

SEQ ID NO: 300769 - DNA, 25 bp, Rattus norvegicus
gaagcagttacatccgtctttcatc

SEQ ID NO: 300770 - DNA, 25 bp, Rattus norvegicus
gaagcagttattcaagtccccaaac

SEQ ID NO: 300771 - DNA, 25 bp, Rattus norvegicus
gaagcagttattgaagtccccaaac

SEQ ID NO: 300772 - DNA, 25 bp, Rattus norvegicus
gaagcagttcacctttgggttattt

SEQ ID NO: 300773 - DNA, 25 bp, Rattus norvegicus
gaagcagttcacgtttgggttattt

SEQ ID NO: 300774 - DNA, 25 bp, Rattus norvegicus
gaagcagttcataaccggctggcaa

SEQ ID NO: 300775 - DNA, 25 bp, Rattus norvegicus
gaagcagttcattaccggctggcaa

SEQ ID NO: 300776 - DNA, 25 bp, Rattus norvegicus
gaagcagttccccaaaggtgtacaa

SEQ ID NO: 300777 - DNA, 25 bp, Rattus norvegicus
gaagcagttcccgaaaggtgtacaa

SEQ ID NO: 300778 - DNA, 25 bp, Rattus norvegicus
gaagcagttcgtctgtaccatttac

SEQ ID NO: 300779 - DNA, 25 bp, Rattus norvegicus
gaagcagttcgtgtgtaccatttac

SEQ ID NO: 300780 - DNA, 25 bp, Rattus norvegicus
gaagcagttctacgacaccaagcgt

SEQ ID NO: 300781 - DNA, 25 bp, Rattus norvegicus
gaagcagttctaggacaccaagcgt

SEQ ID NO: 300782 - DNA, 25 bp, Rattus norvegicus
gaagcagttctcacaacgttgctag

SEQ ID NO: 300783 - DNA, 25 bp, Rattus norvegicus
gaagcagttctctcaacgttgctag

SEQ ID NO: 300784 - DNA, 25 bp, Rattus norvegicus
gaagcagttcttattgacatggaaa

SEQ ID NO: 300785 - DNA, 25 bp, Rattus norvegicus
gaagcagttctttttgacatggaaa

SEQ ID NO: 300786 - DNA, 25 bp, Rattus norvegicus
gaagcagttgagacaacactctgaa

SEQ ID NO: 300787 - DNA, 25 bp, Rattus norvegicus
gaagcagttgagcaatccacagcaa

SEQ ID NO: 300788 - DNA, 25 bp, Rattus norvegicus
gaagcagttgaggaatccacagcaa

SEQ ID NO: 300789 - DNA, 25 bp, Rattus norvegicus
gaagcagttgagtcaacactctgaa

SEQ ID NO: 300790 - DNA, 25 bp, Rattus norvegicus
gaagcagttgcgacagtcagaacct

SEQ ID NO: 300791 - DNA, 25 bp, Rattus norvegicus
gaagcagttgcgtcagtcagaacct

SEQ ID NO: 300792 - DNA, 25 bp, Rattus norvegicus
gaagcagttgttctcaccaatacca

SEQ ID NO: 300793 - DNA, 25 bp, Rattus norvegicus
gaagcagttgttgtcaccaatacca

SEQ ID NO: 300794 - DNA, 25 bp, Rattus norvegicus
gaagcagtttcaactagctccagtg

SEQ ID NO: 300795 - DNA, 25 bp, Rattus norvegicus
gaagcagtttcatctagctccagtg

SEQ ID NO: 300796 - DNA, 25 bp, Rattus norvegicus
gaagcagtttgcagtcactctggag

SEQ ID NO: 300797 - DNA, 25 bp, Rattus norvegicus
gaagcagtttgccacaggtctggat

SEQ ID NO: 300798 - DNA, 25 bp, Rattus norvegicus
gaagcagtttgcgacaggtctggat

SEQ ID NO: 300799 - DNA, 25 bp, Rattus norvegicus
gaagcagtttgctgtcactctggag

SEQ ID NO: 300800 - DNA, 25 bp, Rattus norvegicus
gaagcataactcaccctggtaggaa

SEQ ID NO: 300801 - DNA, 25 bp, Rattus norvegicus
gaagcataactctccctggtaggaa

SEQ ID NO: 300802 - DNA, 25 bp, Rattus norvegicus
gaagcatacaaaccagaccacagca

SEQ ID NO: 300803 - DNA, 25 bp, Rattus norvegicus
gaagcatacaaagcagaccacagca

SEQ ID NO: 300804 - DNA, 25 bp, Rattus norvegicus
gaagcatacacgactcagatagaca

SEQ ID NO: 300805 - DNA, 25 bp, Rattus norvegicus
gaagcatacacgtctcagatagaca

SEQ ID NO: 300806 - DNA, 25 bp, Rattus norvegicus
gaagcatacattatacgctgctaat

SEQ ID NO: 300807 - DNA, 25 bp, Rattus norvegicus
gaagcatacattttacgctgctaat

SEQ ID NO: 300808 - DNA, 25 bp, Rattus norvegicus
gaagcataccaaatgggtgacgtca

SEQ ID NO: 300809 - DNA, 25 bp, Rattus norvegicus
gaagcataccaattgggtgacgtca

SEQ ID NO: 300810 - DNA, 25 bp, Rattus norvegicus
gaagcataccacagtcctaggaaga

SEQ ID NO: 300811 - DNA, 25 bp, Rattus norvegicus
gaagcataccactgtcctaggaaga

SEQ ID NO: 300812 - DNA, 25 bp, Rattus norvegicus
gaagcataccgcagagactgcagat

SEQ ID NO: 300813 - DNA, 25 bp, Rattus norvegicus
gaagcataccgctgagactgcagat

SEQ ID NO: 300814 - DNA, 25 bp, Rattus norvegicus
gaagcatacctcaacttcattgccc

SEQ ID NO: 300815 - DNA, 25 bp, Rattus norvegicus
gaagcatacctctacttcattgccc

SEQ ID NO: 300816 - DNA, 25 bp, Rattus norvegicus
gaagcataccttcctggccgagtta

SEQ ID NO: 300817 - DNA, 25 bp, Rattus norvegicus
gaagcataccttgctggccgagtta

SEQ ID NO: 300818 - DNA, 25 bp, Rattus norvegicus
gaagcatagacactttgtgcctgaa

SEQ ID NO: 300819 - DNA, 25 bp, Rattus norvegicus
gaagcatagacagtttgtgcctgaa

SEQ ID NO: 300820 - DNA, 25 bp, Rattus norvegicus
gaagcatagcccacaaaactccgga

SEQ ID NO: 300821 - DNA, 25 bp, Rattus norvegicus
gaagcatagccctcaaaactccgga

SEQ ID NO: 300822 - DNA, 25 bp, Rattus norvegicus
gaagcatagcttctttgctaccaag

SEQ ID NO: 300823 - DNA, 25 bp, Rattus norvegicus
gaagcatagcttgtttgctaccaag

SEQ ID NO: 300824 - DNA, 25 bp, Rattus norvegicus
gaagcatagtttcaaagccaaacaa

SEQ ID NO: 300825 - DNA, 25 bp, Rattus norvegicus
gaagcatagtttgaaagccaaacaa

SEQ ID NO: 300826 - DNA, 25 bp, Rattus norvegicus
gaagcatatactcaagcccgggact

SEQ ID NO: 300827 - DNA, 25 bp, Rattus norvegicus
gaagcatatactgaagcccgggact

SEQ ID NO: 300828 - DNA, 25 bp, Rattus norvegicus
gaagcatatctacttgcccaagacc

SEQ ID NO: 300829 - DNA, 25 bp, Rattus norvegicus
gaagcatatctagttgcccaagacc

SEQ ID NO: 300830 - DNA, 25 bp, Rattus norvegicus
gaagcatatctcaaggaatcgcccc

SEQ ID NO: 300831 - DNA, 25 bp, Rattus norvegicus
gaagcatatctctaggaatcgcccc

SEQ ID NO: 300832 - DNA, 25 bp, Rattus norvegicus
gaagcatatcttccagtttgacaaa

SEQ ID NO: 300833 - DNA, 25 bp, Rattus norvegicus
gaagcatatcttgcagtttgacaaa

SEQ ID NO: 300834 - DNA, 25 bp, Rattus norvegicus
gaagcatattccaccttgaagcctc

SEQ ID NO: 300835 - DNA, 25 bp, Rattus norvegicus
gaagcatattcctccttgaagcctc

SEQ ID NO: 300836 - DNA, 25 bp, Rattus norvegicus
gaagcatcaaccagacttcatctac

SEQ ID NO: 300837 - DNA, 25 bp, Rattus norvegicus
gaagcatcaacctgacttcatctac

SEQ ID NO: 300838 - DNA, 25 bp, Rattus norvegicus
gaagcatcaagtagcccgaggtccc

SEQ ID NO: 300839 - DNA, 25 bp, Rattus norvegicus
gaagcatcaagttgcccgaggtccc

SEQ ID NO: 300840 - DNA, 25 bp, Rattus norvegicus
gaagcatcactacctggtgagcttg

SEQ ID NO: 300841 - DNA, 25 bp, Rattus norvegicus
gaagcatcactactcactgaaaggt

SEQ ID NO: 300842 - DNA, 25 bp, Rattus norvegicus
gaagcatcactagctggtgagcttg

SEQ ID NO: 300843 - DNA, 25 bp, Rattus norvegicus
gaagcatcactagtcactgaaaggt

SEQ ID NO: 300844 - DNA, 25 bp, Rattus norvegicus
gaagcatcactgagattttgcatct

SEQ ID NO: 300845 - DNA, 25 bp, Rattus norvegicus
gaagcatcactgtgattttgcatct

SEQ ID NO: 300846 - DNA, 25 bp, Rattus norvegicus
gaagcatcacttatgttttggctca

SEQ ID NO: 300847 - DNA, 25 bp, Rattus norvegicus
gaagcatcacttttgttttggctca

SEQ ID NO: 300848 - DNA, 25 bp, Rattus norvegicus
gaagcatcagaactctggaccgagt

SEQ ID NO: 300849 - DNA, 25 bp, Rattus norvegicus
gaagcatcagaagtctggaccgagt

SEQ ID NO: 300850 - DNA, 25 bp, Rattus norvegicus
gaagcatcagcaagtggtccacacg

SEQ ID NO: 300851 - DNA, 25 bp, Rattus norvegicus
gaagcatcagcatgtggtccacacg

SEQ ID NO: 300852 - DNA, 25 bp, Rattus norvegicus
gaagcatcagccacaagctagacag

SEQ ID NO: 300853 - DNA, 25 bp, Rattus norvegicus
gaagcatcagcctcaagctagacag

SEQ ID NO: 300854 - DNA, 25 bp, Rattus norvegicus
gaagcatcatttcggcatgccacac

SEQ ID NO: 300855 - DNA, 25 bp, Rattus norvegicus
gaagcatcatttgggcatgccacac

SEQ ID NO: 300856 - DNA, 25 bp, Rattus norvegicus
gaagcatccaggacctttcaagtgg

SEQ ID NO: 300857 - DNA, 25 bp, Rattus norvegicus
gaagcatccaggtcctttcaagtgg

SEQ ID NO: 300858 - DNA, 25 bp, Rattus norvegicus
gaagcatcctacataagctatgaat

SEQ ID NO: 300859 - DNA, 25 bp, Rattus norvegicus
gaagcatcctacttaagctatgaat

SEQ ID NO: 300860 - DNA, 25 bp, Rattus norvegicus
gaagcatcctagcaagtcttagatc

SEQ ID NO: 300861 - DNA, 25 bp, Rattus norvegicus
gaagcatcctagcttttggcaggca

SEQ ID NO: 300862 - DNA, 25 bp, Rattus norvegicus
gaagcatcctaggaagtcttagatc

SEQ ID NO: 300863 - DNA, 25 bp, Rattus norvegicus
gaagcatcctaggttttggcaggca

SEQ ID NO: 300864 - DNA, 25 bp, Rattus norvegicus
gaagcatcctctattgaatcaccct

SEQ ID NO: 300865 - DNA, 25 bp, Rattus norvegicus
gaagcatcctcttttgaatcaccct

SEQ ID NO: 300866 - DNA, 25 bp, Rattus norvegicus
gaagcatcctgtatgtccaacaagg

SEQ ID NO: 300867 - DNA, 25 bp, Rattus norvegicus
gaagcatcctgtttgtccaacaagg

SEQ ID NO: 300868 - DNA, 25 bp, Rattus norvegicus
gaagcatccttacattcaggacctg

SEQ ID NO: 300869 - DNA, 25 bp, Rattus norvegicus
gaagcatccttagattcaggacctg

SEQ ID NO: 300870 - DNA, 25 bp, Rattus norvegicus
gaagcatccttcaaggtggcctgtg

SEQ ID NO: 300871 - DNA, 25 bp, Rattus norvegicus
gaagcatccttctaggtggcctgtg

SEQ ID NO: 300872 - DNA, 25 bp, Rattus norvegicus
gaagcatcctttaagttcttggaat

SEQ ID NO: 300873 - DNA, 25 bp, Rattus norvegicus
gaagcatccttttagttcttggaat

SEQ ID NO: 300874 - DNA, 25 bp, Rattus norvegicus
gaagcatcgactcggcttacgacct

SEQ ID NO: 300875 - DNA, 25 bp, Rattus norvegicus
gaagcatcgactgggcttacgacct

SEQ ID NO: 300876 - DNA, 25 bp, Rattus norvegicus
gaagcatcgtggactttctacacta

SEQ ID NO: 300877 - DNA, 25 bp, Rattus norvegicus
gaagcatcgtggtctttctacacta

SEQ ID NO: 300878 - DNA, 25 bp, Rattus norvegicus
gaagcatctaacacagcggacgact

SEQ ID NO: 300879 - DNA, 25 bp, Rattus norvegicus
gaagcatctaactcagcggacgact

SEQ ID NO: 300880 - DNA, 25 bp, Rattus norvegicus
gaagcatctaagctttgctgcaata

SEQ ID NO: 300881 - DNA, 25 bp, Rattus norvegicus
gaagcatctaaggtttgctgcaata

SEQ ID NO: 300882 - DNA, 25 bp, Rattus norvegicus
gaagcatctaggaattctactgaga

SEQ ID NO: 300883 - DNA, 25 bp, Rattus norvegicus
gaagcatctaggtattctactgaga

SEQ ID NO: 300884 - DNA, 25 bp, Rattus norvegicus
gaagcatctcaactctcacgaggga

SEQ ID NO: 300885 - DNA, 25 bp, Rattus norvegicus
gaagcatctcaagtctcacgaggga

SEQ ID NO: 300886 - DNA, 25 bp, Rattus norvegicus
gaagcatctcagactcagtttcact

SEQ ID NO: 300887 - DNA, 25 bp, Rattus norvegicus
gaagcatctcagtctcagtttcact

SEQ ID NO: 300888 - DNA, 25 bp, Rattus norvegicus
gaagcatctcgaacccatgggcact

SEQ ID NO: 300889 - DNA, 25 bp, Rattus norvegicus
gaagcatctcgatcccatgggcact

SEQ ID NO: 300890 - DNA, 25 bp, Rattus norvegicus
gaagcatctcttctgttcgatgaaa

SEQ ID NO: 300891 - DNA, 25 bp, Rattus norvegicus
gaagcatctcttgtgttcgatgaaa

SEQ ID NO: 300892 - DNA, 25 bp, Rattus norvegicus
gaagcatctttgaaagcaggagcta

SEQ ID NO: 300893 - DNA, 25 bp, Rattus norvegicus
gaagcatctttgtaagcaggagcta

SEQ ID NO: 300894 - DNA, 25 bp, Rattus norvegicus
gaagcatcttttactttaattgggc

SEQ ID NO: 300895 - DNA, 25 bp, Rattus norvegicus
gaagcatctttttctttaattgggc

SEQ ID NO: 300896 - DNA, 25 bp, Rattus norvegicus
gaagcatgaaaaccctcccacttaa

SEQ ID NO: 300897 - DNA, 25 bp, Rattus norvegicus
gaagcatgaaaagcctcccacttaa

SEQ ID NO: 300898 - DNA, 25 bp, Rattus norvegicus
gaagcatgaacgctcctcagacaag

SEQ ID NO: 300899 - DNA, 25 bp, Rattus norvegicus
gaagcatgaacggtcctcagacaag

SEQ ID NO: 300900 - DNA, 25 bp, Rattus norvegicus
gaagcatgaagactcctctgtcccc

SEQ ID NO: 300901 - DNA, 25 bp, Rattus norvegicus
gaagcatgaagagtcctctgtcccc

SEQ ID NO: 300902 - DNA, 25 bp, Rattus norvegicus
gaagcatgacatctttctccaggtc

SEQ ID NO: 300903 - DNA, 25 bp, Rattus norvegicus
gaagcatgacatgtttctccaggtc

SEQ ID NO: 300904 - DNA, 25 bp, Rattus norvegicus
gaagcatgaccccaagatcgtgaca

SEQ ID NO: 300905 - DNA, 25 bp, Rattus norvegicus
gaagcatgacccgaagatcgtgaca

SEQ ID NO: 300906 - DNA, 25 bp, Rattus norvegicus
gaagcatgatttaggtcactttgat

SEQ ID NO: 300907 - DNA, 25 bp, Rattus norvegicus
gaagcatgattttggtcactttgat

SEQ ID NO: 300908 - DNA, 25 bp, Rattus norvegicus
gaagcatgcagaaagctccctataa

SEQ ID NO: 300909 - DNA, 25 bp, Rattus norvegicus
gaagcatgcagatagctccctataa

SEQ ID NO: 300910 - DNA, 25 bp, Rattus norvegicus
gaagcatgccttcctgtctttttat

SEQ ID NO: 300911 - DNA, 25 bp, Rattus norvegicus
gaagcatgccttgctgtctttttat

SEQ ID NO: 300912 - DNA, 25 bp, Rattus norvegicus
gaagcatggagtcactcttgcgctg

SEQ ID NO: 300913 - DNA, 25 bp, Rattus norvegicus
gaagcatggagtgactcttgcgctg

SEQ ID NO: 300914 - DNA, 25 bp, Rattus norvegicus
gaagcatggcacattaggctccccg

SEQ ID NO: 300915 - DNA, 25 bp, Rattus norvegicus
gaagcatggcactttaggctccccg

SEQ ID NO: 300916 - DNA, 25 bp, Rattus norvegicus
gaagcatgggctacccttgaacaga

SEQ ID NO: 300917 - DNA, 25 bp, Rattus norvegicus
gaagcatgggcttcccttgaacaga

SEQ ID NO: 300918 - DNA, 25 bp, Rattus norvegicus
gaagcatgggtgcactcaaggcaaa

SEQ ID NO: 300919 - DNA, 25 bp, Rattus norvegicus
gaagcatgggtggactcaaggcaaa

SEQ ID NO: 300920 - DNA, 25 bp, Rattus norvegicus
gaagcatggttcattagccacttga

SEQ ID NO: 300921 - DNA, 25 bp, Rattus norvegicus
gaagcatggttctttagccacttga

SEQ ID NO: 300922 - DNA, 25 bp, Rattus norvegicus
gaagcatgtctcattcaatgttatg

SEQ ID NO: 300923 - DNA, 25 bp, Rattus norvegicus
gaagcatgtctctttcaatgttatg

SEQ ID NO: 300924 - DNA, 25 bp, Rattus norvegicus
gaagcatgtgacactgttctcttaa

SEQ ID NO: 300925 - DNA, 25 bp, Rattus norvegicus
gaagcatgtgactctgttctcttaa

SEQ ID NO: 300926 - DNA, 25 bp, Rattus norvegicus
gaagcatgtgctagcaacttaaata

SEQ ID NO: 300927 - DNA, 25 bp, Rattus norvegicus
gaagcatgtgcttgcaacttaaata

SEQ ID NO: 300928 - DNA, 25 bp, Rattus norvegicus
gaagcatgttcccttcgtgcgaagg

SEQ ID NO: 300929 - DNA, 25 bp, Rattus norvegicus
gaagcatgttccgttcgtgcgaagg

SEQ ID NO: 300930 - DNA, 25 bp, Rattus norvegicus
gaagcatgtttaagcatctgtcaga

SEQ ID NO: 300931 - DNA, 25 bp, Rattus norvegicus
gaagcatgtttatgcatctgtcaga

SEQ ID NO: 300932 - DNA, 25 bp, Rattus norvegicus
gaagcatgttttccctgttgttaga

SEQ ID NO: 300933 - DNA, 25 bp, Rattus norvegicus
gaagcatgttttgcctgttgttaga

SEQ ID NO: 300934 - DNA, 25 bp, Rattus norvegicus
gaagcattacagaaccaaccacgag

SEQ ID NO: 300935 - DNA, 25 bp, Rattus norvegicus
gaagcattacagactgggccaggct

SEQ ID NO: 300936 - DNA, 25 bp, Rattus norvegicus
gaagcattacagtaccaaccacgag

SEQ ID NO: 300937 - DNA, 25 bp, Rattus norvegicus
gaagcattacagtctgggccaggct

SEQ ID NO: 300938 - DNA, 25 bp, Rattus norvegicus
gaagcattagagatgacctatcttt

SEQ ID NO: 300939 - DNA, 25 bp, Rattus norvegicus
gaagcattagagttgacctatcttt

SEQ ID NO: 300940 - DNA, 25 bp, Rattus norvegicus
gaagcattcattatatctactcttg

SEQ ID NO: 300941 - DNA, 25 bp, Rattus norvegicus
gaagcattcattcagtcctcatgtg

SEQ ID NO: 300942 - DNA, 25 bp, Rattus norvegicus
gaagcattcattgagtcctcatgtg

SEQ ID NO: 300943 - DNA, 25 bp, Rattus norvegicus
gaagcattcattttatctactcttg

SEQ ID NO: 300944 - DNA, 25 bp, Rattus norvegicus
gaagcattccacctagagacagttt

SEQ ID NO: 300945 - DNA, 25 bp, Rattus norvegicus
gaagcattccacgtagagacagttt

SEQ ID NO: 300946 - DNA, 25 bp, Rattus norvegicus
gaagcattcctgaccttatgttaaa

SEQ ID NO: 300947 - DNA, 25 bp, Rattus norvegicus
gaagcattcctgtccttatgttaaa

SEQ ID NO: 300948 - DNA, 25 bp, Rattus norvegicus
gaagcattccttctttgataatgtt

SEQ ID NO: 300949 - DNA, 25 bp, Rattus norvegicus
gaagcattccttgtttgataatgtt

SEQ ID NO: 300950 - DNA, 25 bp, Rattus norvegicus
gaagcattcggaagccaaaccatgg

SEQ ID NO: 300951 - DNA, 25 bp, Rattus norvegicus
gaagcattcggatgccaaaccatgg

SEQ ID NO: 300952 - DNA, 25 bp, Rattus norvegicus
gaagcattctccactaatgggatca

SEQ ID NO: 300953 - DNA, 25 bp, Rattus norvegicus
gaagcattctcctctaatgggatca

SEQ ID NO: 300954 - DNA, 25 bp, Rattus norvegicus
gaagcattctgactttaccatttgt

SEQ ID NO: 300955 - DNA, 25 bp, Rattus norvegicus
gaagcattctgagtttaccatttgt

SEQ ID NO: 300956 - DNA, 25 bp, Rattus norvegicus
gaagcattctgtcactgcaggctca

SEQ ID NO: 300957 - DNA, 25 bp, Rattus norvegicus
gaagcattctgtgactgcaggctca

SEQ ID NO: 300958 - DNA, 25 bp, Rattus norvegicus
gaagcattgaggatacaatccagat

SEQ ID NO: 300959 - DNA, 25 bp, Rattus norvegicus
gaagcattgaggttacaatccagat

SEQ ID NO: 300960 - DNA, 25 bp, Rattus norvegicus
gaagcattgatcactttgagcctca

SEQ ID NO: 300961 - DNA, 25 bp, Rattus norvegicus
gaagcattgatctctttgagcctca

SEQ ID NO: 300962 - DNA, 25 bp, Rattus norvegicus
gaagcattgcaaagccattcatatt

SEQ ID NO: 300963 - DNA, 25 bp, Rattus norvegicus
gaagcattgcaatgccattcatatt

SEQ ID NO: 300964 - DNA, 25 bp, Rattus norvegicus
gaagcattgcgcagctcaggatttc

SEQ ID NO: 300965 - DNA, 25 bp, Rattus norvegicus
gaagcattgcgctgctcaggatttc

SEQ ID NO: 300966 - DNA, 25 bp, Rattus norvegicus
gaagcattgctgactgttctccaga

SEQ ID NO: 300967 - DNA, 25 bp, Rattus norvegicus
gaagcattgctgtctgttctccaga

SEQ ID NO: 300968 - DNA, 25 bp, Rattus norvegicus
gaagcatttagccactctttatgtt

SEQ ID NO: 300969 - DNA, 25 bp, Rattus norvegicus
gaagcatttagcgactctttatgtt

SEQ ID NO: 300970 - DNA, 25 bp, Rattus norvegicus
gaagcatttataactcccaagtgac

SEQ ID NO: 300971 - DNA, 25 bp, Rattus norvegicus
gaagcatttatatctcccaagtgac

SEQ ID NO: 300972 - DNA, 25 bp, Rattus norvegicus
gaagcatttcacagtaataagaccc

SEQ ID NO: 300973 - DNA, 25 bp, Rattus norvegicus
gaagcatttcactgtaataagaccc

SEQ ID NO: 300974 - DNA, 25 bp, Rattus norvegicus
gaagcatttcctcaatattgtcccc

SEQ ID NO: 300975 - DNA, 25 bp, Rattus norvegicus
gaagcatttcctgaatattgtcccc

SEQ ID NO: 300976 - DNA, 25 bp, Rattus norvegicus
gaagcatttctcagaatgcagaagt

SEQ ID NO: 300977 - DNA, 25 bp, Rattus norvegicus
gaagcatttctctgaatgcagaagt

SEQ ID NO: 300978 - DNA, 25 bp, Rattus norvegicus
gaagcatttctgattctcctcttaa

SEQ ID NO: 300979 - DNA, 25 bp, Rattus norvegicus
gaagcatttctgtttctcctcttaa

SEQ ID NO: 300980 - DNA, 25 bp, Rattus norvegicus
gaagcatttgaacacagcccaccac

SEQ ID NO: 300981 - DNA, 25 bp, Rattus norvegicus
gaagcatttgaagacagcccaccac

SEQ ID NO: 300982 - DNA, 25 bp, Rattus norvegicus
gaagcatttgacatccaagggcaaa

SEQ ID NO: 300983 - DNA, 25 bp, Rattus norvegicus
gaagcatttgacattgcgaagaatc

SEQ ID NO: 300984 - DNA, 25 bp, Rattus norvegicus
gaagcatttgacttccaagggcaaa

SEQ ID NO: 300985 - DNA, 25 bp, Rattus norvegicus
gaagcatttgactttgcgaagaatc

SEQ ID NO: 300986 - DNA, 25 bp, Rattus norvegicus
gaagcatttggacgtttccccaaga

SEQ ID NO: 300987 - DNA, 25 bp, Rattus norvegicus
gaagcatttggaggtttccccaaga

SEQ ID NO: 300988 - DNA, 25 bp, Rattus norvegicus
gaagcatttgtgatatgtccctact

SEQ ID NO: 300989 - DNA, 25 bp, Rattus norvegicus
gaagcatttgtgatcttctccaatg

SEQ ID NO: 300990 - DNA, 25 bp, Rattus norvegicus
gaagcatttgtgttatgtccctact

SEQ ID NO: 300991 - DNA, 25 bp, Rattus norvegicus
gaagcatttgtgttcttctccaatg

SEQ ID NO: 300992 - DNA, 25 bp, Rattus norvegicus
gaagcattttaaagtactatttgat

SEQ ID NO: 300993 - DNA, 25 bp, Rattus norvegicus
gaagcattttaatgtactatttgat

SEQ ID NO: 300994 - DNA, 25 bp, Rattus norvegicus
gaagcattttccagttaaggtaatc

SEQ ID NO: 300995 - DNA, 25 bp, Rattus norvegicus
gaagcattttccctggacagctctt

SEQ ID NO: 300996 - DNA, 25 bp, Rattus norvegicus
gaagcattttccgtggacagctctt

SEQ ID NO: 300997 - DNA, 25 bp, Rattus norvegicus
gaagcattttcctgttaaggtaatc

SEQ ID NO: 300998 - DNA, 25 bp, Rattus norvegicus
gaagcattttctaacaactccaaat

SEQ ID NO: 300999 - DNA, 25 bp, Rattus norvegicus
gaagcattttcttacaactccaaat

SEQ ID NO: 301000 - DNA, 25 bp, Rattus norvegicus
gaagcattttgccatagatgtcatg

SEQ ID NO: 301001 - DNA, 25 bp, Rattus norvegicus
gaagcattttgcgatagatgtcatg

SEQ ID NO: 301002 - DNA, 25 bp, Rattus norvegicus
gaagcatttttccttctgcaaaccc

SEQ ID NO: 301003 - DNA, 25 bp, Rattus norvegicus
gaagcatttttcgttctgcaaaccc

SEQ ID NO: 301004 - DNA, 25 bp, Rattus norvegicus
gaagccaaaataatgctgtttgcag

SEQ ID NO: 301005 - DNA, 25 bp, Rattus norvegicus
gaagccaaaatattgctgtttgcag

SEQ ID NO: 301006 - DNA, 25 bp, Rattus norvegicus
gaagccaaaatccacaactgcatgt

SEQ ID NO: 301007 - DNA, 25 bp, Rattus norvegicus
gaagccaaaatcgacaactgcatgt

SEQ ID NO: 301008 - DNA, 25 bp, Rattus norvegicus
gaagccaaacccacagtgtgatgac

SEQ ID NO: 301009 - DNA, 25 bp, Rattus norvegicus
gaagccaaaccctcagtgtgatgac

SEQ ID NO: 301010 - DNA, 25 bp, Rattus norvegicus
gaagccaaactgactcagattccca

SEQ ID NO: 301011 - DNA, 25 bp, Rattus norvegicus
gaagccaaactgtctcagattccca

SEQ ID NO: 301012 - DNA, 25 bp, Rattus norvegicus
gaagccaaagaactctgcacaccac

SEQ ID NO: 301013 - DNA, 25 bp, Rattus norvegicus
gaagccaaagaagtctgcacaccac

SEQ ID NO: 301014 - DNA, 25 bp, Rattus norvegicus
gaagccaaaggcagctgctacggca

SEQ ID NO: 301015 - DNA, 25 bp, Rattus norvegicus
gaagccaaaggctgctgctacggca

SEQ ID NO: 301016 - DNA, 25 bp, Rattus norvegicus
gaagccaaaggtctcaacgctcctg

SEQ ID NO: 301017 - DNA, 25 bp, Rattus norvegicus
gaagccaaaggtgtcaacgctcctg

SEQ ID NO: 301018 - DNA, 25 bp, Rattus norvegicus
gaagccaaatacactgccttttatg

SEQ ID NO: 301019 - DNA, 25 bp, Rattus norvegicus
gaagccaaatactctgccttttatg

SEQ ID NO: 301020 - DNA, 25 bp, Rattus norvegicus
gaagccaaatatagaacctcctgag

SEQ ID NO: 301021 - DNA, 25 bp, Rattus norvegicus
gaagccaaatatatattcctcttgt

SEQ ID NO: 301022 - DNA, 25 bp, Rattus norvegicus
gaagccaaatattgaacctcctgag

SEQ ID NO: 301023 - DNA, 25 bp, Rattus norvegicus
gaagccaaatatttattcctcttgt

SEQ ID NO: 301024 - DNA, 25 bp, Rattus norvegicus
gaagccaaatgcacttcacaggcat

SEQ ID NO: 301025 - DNA, 25 bp, Rattus norvegicus
gaagccaaatgctcttcacaggcat

SEQ ID NO: 301026 - DNA, 25 bp, Rattus norvegicus
gaagccaaattcaactccaggtatt

SEQ ID NO: 301027 - DNA, 25 bp, Rattus norvegicus
gaagccaaattcaatttctaccata

SEQ ID NO: 301028 - DNA, 25 bp, Rattus norvegicus
gaagccaaattctactccaggtatt

SEQ ID NO: 301029 - DNA, 25 bp, Rattus norvegicus
gaagccaaattctatttctaccata

SEQ ID NO: 301030 - DNA, 25 bp, Rattus norvegicus
gaagccaaatttccaagctgtcttg

SEQ ID NO: 301031 - DNA, 25 bp, Rattus norvegicus
gaagccaaatttgcaagctgtcttg

SEQ ID NO: 301032 - DNA, 25 bp, Rattus norvegicus
gaagccaacatactcgtagccagca

SEQ ID NO: 301033 - DNA, 25 bp, Rattus norvegicus
gaagccaacatagtcgtagccagca

SEQ ID NO: 301034 - DNA, 25 bp, Rattus norvegicus
gaagccaacatgagtgagcctagca

SEQ ID NO: 301035 - DNA, 25 bp, Rattus norvegicus
gaagccaacatgtgtgagcctagca

SEQ ID NO: 301036 - DNA, 25 bp, Rattus norvegicus
gaagccaaccacagcatgaccttga

SEQ ID NO: 301037 - DNA, 25 bp, Rattus norvegicus
gaagccaaccactgcatgaccttga

SEQ ID NO: 301038 - DNA, 25 bp, Rattus norvegicus
gaagccaacgatctttgtgcctaga

SEQ ID NO: 301039 - DNA, 25 bp, Rattus norvegicus
gaagccaacgatgtttgtgcctaga

SEQ ID NO: 301040 - DNA, 25 bp, Rattus norvegicus
gaagccaactatcctaaccactgag

SEQ ID NO: 301041 - DNA, 25 bp, Rattus norvegicus
gaagccaactatgctaaccactgag

SEQ ID NO: 301042 - DNA, 25 bp, Rattus norvegicus
gaagccaactggacgagaagcattg

SEQ ID NO: 301043 - DNA, 25 bp, Rattus norvegicus
gaagccaactggtcgagaagcattg

SEQ ID NO: 301044 - DNA, 25 bp, Rattus norvegicus
gaagccaactgtcggctgctgtact

SEQ ID NO: 301045 - DNA, 25 bp, Rattus norvegicus
gaagccaactgtgggctgctgtact

SEQ ID NO: 301046 - DNA, 25 bp, Rattus norvegicus
gaagccaagaacattccagcctttc

SEQ ID NO: 301047 - DNA, 25 bp, Rattus norvegicus
gaagccaagaactttccagcctttc

SEQ ID NO: 301048 - DNA, 25 bp, Rattus norvegicus
gaagccaagacaatgttgggtcagt

SEQ ID NO: 301049 - DNA, 25 bp, Rattus norvegicus
gaagccaagacattgttgggtcagt

SEQ ID NO: 301050 - DNA, 25 bp, Rattus norvegicus
gaagccaagcagaagtacactgatc

SEQ ID NO: 301051 - DNA, 25 bp, Rattus norvegicus
gaagccaagcagcaagttccaccat

SEQ ID NO: 301052 - DNA, 25 bp, Rattus norvegicus
gaagccaagcagcttcatcggagca

SEQ ID NO: 301053 - DNA, 25 bp, Rattus norvegicus
gaagccaagcaggaagttccaccat

SEQ ID NO: 301054 - DNA, 25 bp, Rattus norvegicus
gaagccaagcaggttcatcggagca

SEQ ID NO: 301055 - DNA, 25 bp, Rattus norvegicus
gaagccaagcagtagtacactgatc

SEQ ID NO: 301056 - DNA, 25 bp, Rattus norvegicus
gaagccaagcatcagctcgagtcat

SEQ ID NO: 301057 - DNA, 25 bp, Rattus norvegicus
gaagccaagcatgagctcgagtcat

SEQ ID NO: 301058 - DNA, 25 bp, Rattus norvegicus
gaagccaagcctcgacatttattgt

SEQ ID NO: 301059 - DNA, 25 bp, Rattus norvegicus
gaagccaagcctggacatttattgt

SEQ ID NO: 301060 - DNA, 25 bp, Rattus norvegicus
gaagccaaggctcaatatcacgtct

SEQ ID NO: 301061 - DNA, 25 bp, Rattus norvegicus
gaagccaaggctgaatatcacgtct

SEQ ID NO: 301062 - DNA, 25 bp, Rattus norvegicus
gaagccaaggtcagttgcctgccgt

SEQ ID NO: 301063 - DNA, 25 bp, Rattus norvegicus
gaagccaaggtctgttgcctgccgt

SEQ ID NO: 301064 - DNA, 25 bp, Rattus norvegicus
gaagccaagtacctgtgttcagcct

SEQ ID NO: 301065 - DNA, 25 bp, Rattus norvegicus
gaagccaagtacgtgtgttcagcct

SEQ ID NO: 301066 - DNA, 25 bp, Rattus norvegicus
gaagccaatcacagttgttctaatt

SEQ ID NO: 301067 - DNA, 25 bp, Rattus norvegicus
gaagccaatcactgttgttctaatt

SEQ ID NO: 301068 - DNA, 25 bp, Rattus norvegicus
gaagccaatgatctttgtcccagat

SEQ ID NO: 301069 - DNA, 25 bp, Rattus norvegicus
gaagccaatgatgtttgtcccagat

SEQ ID NO: 301070 - DNA, 25 bp, Rattus norvegicus
gaagccaatggtaactagttttcaa

SEQ ID NO: 301071 - DNA, 25 bp, Rattus norvegicus
gaagccaatggttactagttttcaa

SEQ ID NO: 301072 - DNA, 25 bp, Rattus norvegicus
gaagccaatgtgatcgcagttacca

SEQ ID NO: 301073 - DNA, 25 bp, Rattus norvegicus
gaagccaatgtgttcgcagttacca

SEQ ID NO: 301074 - DNA, 25 bp, Rattus norvegicus
gaagccacacatctttgtgtatttt

SEQ ID NO: 301075 - DNA, 25 bp, Rattus norvegicus
gaagccacacatgtttgtgtatttt

SEQ ID NO: 301076 - DNA, 25 bp, Rattus norvegicus
gaagccacacgcatcattgtaactg

SEQ ID NO: 301077 - DNA, 25 bp, Rattus norvegicus
gaagccacacgcttcattgtaactg

SEQ ID NO: 301078 - DNA, 25 bp, Rattus norvegicus
gaagccacacggcatgttggaaatt

SEQ ID NO: 301079 - DNA, 25 bp, Rattus norvegicus
gaagccacacgggatgttggaaatt

SEQ ID NO: 301080 - DNA, 25 bp, Rattus norvegicus
gaagccacagcaccaagacacgcag

SEQ ID NO: 301081 - DNA, 25 bp, Rattus norvegicus
gaagccacagcaccggacggcgaaa

SEQ ID NO: 301082 - DNA, 25 bp, Rattus norvegicus
gaagccacagcagcaagacacgcag

SEQ ID NO: 301083 - DNA, 25 bp, Rattus norvegicus
gaagccacagcagcggacggcgaaa

SEQ ID NO: 301084 - DNA, 25 bp, Rattus norvegicus
gaagccacaggcaagatcacatttg

SEQ ID NO: 301085 - DNA, 25 bp, Rattus norvegicus
gaagccacaggctagatcacatttg

SEQ ID NO: 301086 - DNA, 25 bp, Rattus norvegicus
gaagccacatctagacaccattgta

SEQ ID NO: 301087 - DNA, 25 bp, Rattus norvegicus
gaagccacatcttgacaccattgta

SEQ ID NO: 301088 - DNA, 25 bp, Rattus norvegicus
gaagccacatgacattcctcaacag

SEQ ID NO: 301089 - DNA, 25 bp, Rattus norvegicus
gaagccacatgagattcctcaacag

SEQ ID NO: 301090 - DNA, 25 bp, Rattus norvegicus
gaagccacatggcagatcccagaga

SEQ ID NO: 301091 - DNA, 25 bp, Rattus norvegicus
gaagccacatgggagatcccagaga

SEQ ID NO: 301092 - DNA, 25 bp, Rattus norvegicus
gaagccaccagcacagtccagagag

SEQ ID NO: 301093 - DNA, 25 bp, Rattus norvegicus
gaagccaccagctcagtccagagag

SEQ ID NO: 301094 - DNA, 25 bp, Rattus norvegicus
gaagccaccctgaacttatagagag

SEQ ID NO: 301095 - DNA, 25 bp, Rattus norvegicus
gaagccaccctgcactatttactga

SEQ ID NO: 301096 - DNA, 25 bp, Rattus norvegicus
gaagccaccctggactatttactga

SEQ ID NO: 301097 - DNA, 25 bp, Rattus norvegicus
gaagccaccctgtacttatagagag

SEQ ID NO: 301098 - DNA, 25 bp, Rattus norvegicus
gaagccacccttacctggaggagtt

SEQ ID NO: 301099 - DNA, 25 bp, Rattus norvegicus
gaagccaccctttcctggaggagtt

SEQ ID NO: 301100 - DNA, 25 bp, Rattus norvegicus
gaagccacctaacaggcctctgaag

SEQ ID NO: 301101 - DNA, 25 bp, Rattus norvegicus
gaagccacctaagaggcctctgaag

SEQ ID NO: 301102 - DNA, 25 bp, Rattus norvegicus
gaagccacctcgattttcctgtctt

SEQ ID NO: 301103 - DNA, 25 bp, Rattus norvegicus
gaagccacctcgtttttcctgtctt

SEQ ID NO: 301104 - DNA, 25 bp, Rattus norvegicus
gaagccaccttcaaccaaatctggt

SEQ ID NO: 301105 - DNA, 25 bp, Rattus norvegicus
gaagccaccttctaccaaatctggt

SEQ ID NO: 301106 - DNA, 25 bp, Rattus norvegicus
gaagccacgcaaaaaagcatctctg

SEQ ID NO: 301107 - DNA, 25 bp, Rattus norvegicus
gaagccacgcaataaagcatctctg

SEQ ID NO: 301108 - DNA, 25 bp, Rattus norvegicus
gaagccacgctgagcgcaggcgcac

SEQ ID NO: 301109 - DNA, 25 bp, Rattus norvegicus
gaagccacgctgtgcgcaggcgcac

SEQ ID NO: 301110 - DNA, 25 bp, Rattus norvegicus
gaagccacggtcagggatgcacaca

SEQ ID NO: 301111 - DNA, 25 bp, Rattus norvegicus
gaagccacggtctgggatgcacaca

SEQ ID NO: 301112 - DNA, 25 bp, Rattus norvegicus
gaagccacgtggcttagcctgagac

SEQ ID NO: 301113 - DNA, 25 bp, Rattus norvegicus
gaagccacgtgggttagcctgagac

SEQ ID NO: 301114 - DNA, 25 bp, Rattus norvegicus
gaagccactagcctgtatccgtgtg

SEQ ID NO: 301115 - DNA, 25 bp, Rattus norvegicus
gaagccactagcgtgtatccgtgtg

SEQ ID NO: 301116 - DNA, 25 bp, Rattus norvegicus
gaagccactattacggagtttgcct

SEQ ID NO: 301117 - DNA, 25 bp, Rattus norvegicus
gaagccactatttcggagtttgcct

SEQ ID NO: 301118 - DNA, 25 bp, Rattus norvegicus
gaagccactctgcatgattgtgcac

SEQ ID NO: 301119 - DNA, 25 bp, Rattus norvegicus
gaagccactctggatgattgtgcac

SEQ ID NO: 301120 - DNA, 25 bp, Rattus norvegicus
gaagccactgatattcaggaaaatg

SEQ ID NO: 301121 - DNA, 25 bp, Rattus norvegicus
gaagccactgattttcaggaaaatg

SEQ ID NO: 301122 - DNA, 25 bp, Rattus norvegicus
gaagccactgcactgtaaaagacat

SEQ ID NO: 301123 - DNA, 25 bp, Rattus norvegicus
gaagccactgcagtgtaaaagacat

SEQ ID NO: 301124 - DNA, 25 bp, Rattus norvegicus
gaagccactgctctgcggagttatg

SEQ ID NO: 301125 - DNA, 25 bp, Rattus norvegicus
gaagccactgctgtgcggagttatg

SEQ ID NO: 301126 - DNA, 25 bp, Rattus norvegicus
gaagccactgtccatggtggccact

SEQ ID NO: 301127 - DNA, 25 bp, Rattus norvegicus
gaagccactgtcgatggtggccact

SEQ ID NO: 301128 - DNA, 25 bp, Rattus norvegicus
gaagccactttaaataattcccagt

SEQ ID NO: 301129 - DNA, 25 bp, Rattus norvegicus
gaagccactttaacattttcctgct

SEQ ID NO: 301130 - DNA, 25 bp, Rattus norvegicus
gaagccactttatataattcccagt

SEQ ID NO: 301131 - DNA, 25 bp, Rattus norvegicus
gaagccactttatcattttcctgct

SEQ ID NO: 301132 - DNA, 25 bp, Rattus norvegicus
gaagccacttttaaaacagcggaga

SEQ ID NO: 301133 - DNA, 25 bp, Rattus norvegicus
gaagccactttttaaacagcggaga

SEQ ID NO: 301134 - DNA, 25 bp, Rattus norvegicus
gaagccagaaatcccatcaagaaca

SEQ ID NO: 301135 - DNA, 25 bp, Rattus norvegicus
gaagccagaaatgccatcaagaaca

SEQ ID NO: 301136 - DNA, 25 bp, Rattus norvegicus
gaagccagaagccatgcctcaagtg

SEQ ID NO: 301137 - DNA, 25 bp, Rattus norvegicus
gaagccagaagcgatgcctcaagtg

SEQ ID NO: 301138 - DNA, 25 bp, Rattus norvegicus
gaagccagaaggaaacattctccga

SEQ ID NO: 301139 - DNA, 25 bp, Rattus norvegicus
gaagccagaaggtaacattctccga

SEQ ID NO: 301140 - DNA, 25 bp, Rattus norvegicus
gaagccagaagtattcgtcacccct

SEQ ID NO: 301141 - DNA, 25 bp, Rattus norvegicus
gaagccagaagttttcgtcacccct

SEQ ID NO: 301142 - DNA, 25 bp, Rattus norvegicus
gaagccagacgacgagcatcagatc

SEQ ID NO: 301143 - DNA, 25 bp, Rattus norvegicus
gaagccagacgaggagcatcagatc

SEQ ID NO: 301144 - DNA, 25 bp, Rattus norvegicus
gaagccagactcaaacggctgctta

SEQ ID NO: 301145 - DNA, 25 bp, Rattus norvegicus
gaagccagactctaacggctgctta

SEQ ID NO: 301146 - DNA, 25 bp, Rattus norvegicus
gaagccagactgcttcagacaaatt

SEQ ID NO: 301147 - DNA, 25 bp, Rattus norvegicus
gaagccagactggttcagacaaatt

SEQ ID NO: 301148 - DNA, 25 bp, Rattus norvegicus
gaagccagagagctgtcctttcttg

SEQ ID NO: 301149 - DNA, 25 bp, Rattus norvegicus
gaagccagagaggtgtcctttcttg

SEQ ID NO: 301150 - DNA, 25 bp, Rattus norvegicus
gaagccagagctacctgaatgctag

SEQ ID NO: 301151 - DNA, 25 bp, Rattus norvegicus
gaagccagagctagttgaatcccag

SEQ ID NO: 301152 - DNA, 25 bp, Rattus norvegicus
gaagccagagcttcctgaatgctag

SEQ ID NO: 301153 - DNA, 25 bp, Rattus norvegicus
gaagccagagcttgttgaatcccag

SEQ ID NO: 301154 - DNA, 25 bp, Rattus norvegicus
gaagccagatccaaaggccgcttat

SEQ ID NO: 301155 - DNA, 25 bp, Rattus norvegicus
gaagccagatcctaaggccgcttat

SEQ ID NO: 301156 - DNA, 25 bp, Rattus norvegicus
gaagccagcattcattgggttagaa

SEQ ID NO: 301157 - DNA, 25 bp, Rattus norvegicus
gaagccagcattgattgggttagaa

SEQ ID NO: 301158 - DNA, 25 bp, Rattus norvegicus
gaagccagccaaaccactcagaatg

SEQ ID NO: 301159 - DNA, 25 bp, Rattus norvegicus
gaagccagccaaatccaaggcggca

SEQ ID NO: 301160 - DNA, 25 bp, Rattus norvegicus
gaagccagccaatccactcagaatg

SEQ ID NO: 301161 - DNA, 25 bp, Rattus norvegicus
gaagccagccaattccaaggcggca

SEQ ID NO: 301162 - DNA, 25 bp, Rattus norvegicus
gaagccagccatcagagtagaacct

SEQ ID NO: 301163 - DNA, 25 bp, Rattus norvegicus
gaagccagccatgagagtagaacct

SEQ ID NO: 301164 - DNA, 25 bp, Rattus norvegicus
gaagccagcctaagttgcacagggt

SEQ ID NO: 301165 - DNA, 25 bp, Rattus norvegicus
gaagccagcctatgttgcacagggt

SEQ ID NO: 301166 - DNA, 25 bp, Rattus norvegicus
gaagccagcctgcaggtgactgatt

SEQ ID NO: 301167 - DNA, 25 bp, Rattus norvegicus
gaagccagcctggaggtgactgatt

SEQ ID NO: 301168 - DNA, 25 bp, Rattus norvegicus
gaagccagccttcactaaacgagat

SEQ ID NO: 301169 - DNA, 25 bp, Rattus norvegicus
gaagccagccttgactaaacgagat

SEQ ID NO: 301170 - DNA, 25 bp, Rattus norvegicus
gaagccagctatattgccaaaggat

SEQ ID NO: 301171 - DNA, 25 bp, Rattus norvegicus
gaagccagctattttgccaaaggat

SEQ ID NO: 301172 - DNA, 25 bp, Rattus norvegicus
gaagccagctccagtctaggctgaa

SEQ ID NO: 301173 - DNA, 25 bp, Rattus norvegicus
gaagccagctcctgtctaggctgaa

SEQ ID NO: 301174 - DNA, 25 bp, Rattus norvegicus
gaagccagctctaacttttgcagta

SEQ ID NO: 301175 - DNA, 25 bp, Rattus norvegicus
gaagccagctcttacttttgcagta

SEQ ID NO: 301176 - DNA, 25 bp, Rattus norvegicus
gaagccagctgaccgaaacttgagt

SEQ ID NO: 301177 - DNA, 25 bp, Rattus norvegicus
gaagccagctgagcgaaacttgagt

SEQ ID NO: 301178 - DNA, 25 bp, Rattus norvegicus
gaagccagcttcatttgacccaatt

SEQ ID NO: 301179 - DNA, 25 bp, Rattus norvegicus
gaagccagcttcttttgacccaatt

SEQ ID NO: 301180 - DNA, 25 bp, Rattus norvegicus
gaagccagcttgattacatgcttat

SEQ ID NO: 301181 - DNA, 25 bp, Rattus norvegicus
gaagccagcttgtttacatgcttat

SEQ ID NO: 301182 - DNA, 25 bp, Rattus norvegicus
gaagccagctttacttattcctata

SEQ ID NO: 301183 - DNA, 25 bp, Rattus norvegicus
gaagccagcttttcttattcctata

SEQ ID NO: 301184 - DNA, 25 bp, Rattus norvegicus
gaagccaggaaacgctgtgatctca

SEQ ID NO: 301185 - DNA, 25 bp, Rattus norvegicus
gaagccaggaaaggctgtgatctca

SEQ ID NO: 301186 - DNA, 25 bp, Rattus norvegicus
gaagccaggagtctatgcagcatta

SEQ ID NO: 301187 - DNA, 25 bp, Rattus norvegicus
gaagccaggagtgtatgcagcatta

SEQ ID NO: 301188 - DNA, 25 bp, Rattus norvegicus
gaagccaggcaaccacagcaagaca

SEQ ID NO: 301189 - DNA, 25 bp, Rattus norvegicus
gaagccaggcaagcacagcaagaca

SEQ ID NO: 301190 - DNA, 25 bp, Rattus norvegicus
gaagccaggcttagtgtgacctcag

SEQ ID NO: 301191 - DNA, 25 bp, Rattus norvegicus
gaagccaggctttgtgtgacctcag

SEQ ID NO: 301192 - DNA, 25 bp, Rattus norvegicus
gaagccagggctcaggaccattgta

SEQ ID NO: 301193 - DNA, 25 bp, Rattus norvegicus
gaagccagggctgaggaccattgta

SEQ ID NO: 301194 - DNA, 25 bp, Rattus norvegicus
gaagccaggtatactgctacagttt

SEQ ID NO: 301195 - DNA, 25 bp, Rattus norvegicus
gaagccaggtattctgctacagttt

SEQ ID NO: 301196 - DNA, 25 bp, Rattus norvegicus
gaagccaggttcacgccaaatctgt

SEQ ID NO: 301197 - DNA, 25 bp, Rattus norvegicus
gaagccaggttctcgccaaatctgt

SEQ ID NO: 301198 - DNA, 25 bp, Rattus norvegicus
gaagccaggtttcggatcagcagat

SEQ ID NO: 301199 - DNA, 25 bp, Rattus norvegicus
gaagccaggtttgggatcagcagat

SEQ ID NO: 301200 - DNA, 25 bp, Rattus norvegicus
gaagccagtctaataacacagcgag

SEQ ID NO: 301201 - DNA, 25 bp, Rattus norvegicus
gaagccagtctattaacacagcgag

SEQ ID NO: 301202 - DNA, 25 bp, Rattus norvegicus
gaagccagtctcaaacctgggtgaa

SEQ ID NO: 301203 - DNA, 25 bp, Rattus norvegicus
gaagccagtctctaacctgggtgaa

SEQ ID NO: 301204 - DNA, 25 bp, Rattus norvegicus
gaagccagttatacaatcgtaccta

SEQ ID NO: 301205 - DNA, 25 bp, Rattus norvegicus
gaagccagttattcaatcgtaccta

SEQ ID NO: 301206 - DNA, 25 bp, Rattus norvegicus
gaagccagtttcctcggatgtttat

SEQ ID NO: 301207 - DNA, 25 bp, Rattus norvegicus
gaagccagtttcgtcggatgtttat

SEQ ID NO: 301208 - DNA, 25 bp, Rattus norvegicus
gaagccataatgaccgagctgctgg

SEQ ID NO: 301209 - DNA, 25 bp, Rattus norvegicus
gaagccataatgtccgagctgctgg

SEQ ID NO: 301210 - DNA, 25 bp, Rattus norvegicus
gaagccatactacagaaatccatct

SEQ ID NO: 301211 - DNA, 25 bp, Rattus norvegicus
gaagccatactagagaaatccatct

SEQ ID NO: 301212 - DNA, 25 bp, Rattus norvegicus
gaagccatagaacatcaagccctcc

SEQ ID NO: 301213 - DNA, 25 bp, Rattus norvegicus
gaagccatagaagatcaagccctcc

SEQ ID NO: 301214 - DNA, 25 bp, Rattus norvegicus
gaagccataggtatcattgtgagca

SEQ ID NO: 301215 - DNA, 25 bp, Rattus norvegicus
gaagccataggtttcattgtgagca

SEQ ID NO: 301216 - DNA, 25 bp, Rattus norvegicus
gaagccatatctatgtttactgaaa

SEQ ID NO: 301217 - DNA, 25 bp, Rattus norvegicus
gaagccatatctttgtttactgaaa

SEQ ID NO: 301218 - DNA, 25 bp, Rattus norvegicus
gaagccatcaagagtcatgctaaat

SEQ ID NO: 301219 - DNA, 25 bp, Rattus norvegicus
gaagccatcaagtgtcatgctaaat

SEQ ID NO: 301220 - DNA, 25 bp, Rattus norvegicus
gaagccatcaatcccttgaggcctt

SEQ ID NO: 301221 - DNA, 25 bp, Rattus norvegicus
gaagccatcaatgccttgaggcctt

SEQ ID NO: 301222 - DNA, 25 bp, Rattus norvegicus
gaagccatccatcgactgatgtctc

SEQ ID NO: 301223 - DNA, 25 bp, Rattus norvegicus
gaagccatccatggactgatgtctc

SEQ ID NO: 301224 - DNA, 25 bp, Rattus norvegicus
gaagccatcctcagattgatccaga

SEQ ID NO: 301225 - DNA, 25 bp, Rattus norvegicus
gaagccatcctctgattgatccaga

SEQ ID NO: 301226 - DNA, 25 bp, Rattus norvegicus
gaagccatctacactacgagagttg

SEQ ID NO: 301227 - DNA, 25 bp, Rattus norvegicus
gaagccatctactctacgagagttg

SEQ ID NO: 301228 - DNA, 25 bp, Rattus norvegicus
gaagccatctgaacagctagccaaa

SEQ ID NO: 301229 - DNA, 25 bp, Rattus norvegicus
gaagccatctgatcagctagccaaa

SEQ ID NO: 301230 - DNA, 25 bp, Rattus norvegicus
gaagccatcttcatgtccagaggag

SEQ ID NO: 301231 - DNA, 25 bp, Rattus norvegicus
gaagccatcttcttgtccagaggag

SEQ ID NO: 301232 - DNA, 25 bp, Rattus norvegicus
gaagccatctttaagccagtcatgt

SEQ ID NO: 301233 - DNA, 25 bp, Rattus norvegicus
gaagccatcttttagccagtcatgt

SEQ ID NO: 301234 - DNA, 25 bp, Rattus norvegicus
gaagccatgaggactgactatacag

SEQ ID NO: 301235 - DNA, 25 bp, Rattus norvegicus
gaagccatgaggtctgactatacag

SEQ ID NO: 301236 - DNA, 25 bp, Rattus norvegicus
gaagccatgcacattccttgcattt

SEQ ID NO: 301237 - DNA, 25 bp, Rattus norvegicus
gaagccatgcactttccttgcattt

SEQ ID NO: 301238 - DNA, 25 bp, Rattus norvegicus
gaagccatgcatcctctgaagaaag

SEQ ID NO: 301239 - DNA, 25 bp, Rattus norvegicus
gaagccatgcatgctctgaagaaag

SEQ ID NO: 301240 - DNA, 25 bp, Rattus norvegicus
gaagccatgccaaatatgtccacct

SEQ ID NO: 301241 - DNA, 25 bp, Rattus norvegicus
gaagccatgccaattttcagaggtg

SEQ ID NO: 301242 - DNA, 25 bp, Rattus norvegicus
gaagccatgccatatatgtccacct

SEQ ID NO: 301243 - DNA, 25 bp, Rattus norvegicus
gaagccatgccatttttcagaggtg

SEQ ID NO: 301244 - DNA, 25 bp, Rattus norvegicus
gaagccatgctcatactgaggactc

SEQ ID NO: 301245 - DNA, 25 bp, Rattus norvegicus
gaagccatgctcttactgaggactc

SEQ ID NO: 301246 - DNA, 25 bp, Rattus norvegicus
gaagccatggagacagcattatcac

SEQ ID NO: 301247 - DNA, 25 bp, Rattus norvegicus
gaagccatggagtcagcattatcac

SEQ ID NO: 301248 - DNA, 25 bp, Rattus norvegicus
gaagccatggcacgagacattaaga

SEQ ID NO: 301249 - DNA, 25 bp, Rattus norvegicus
gaagccatggcaggagacattaaga

SEQ ID NO: 301250 - DNA, 25 bp, Rattus norvegicus
gaagccatgttccagagatatccaa

SEQ ID NO: 301251 - DNA, 25 bp, Rattus norvegicus
gaagccatgttcgagagatatccaa

SEQ ID NO: 301252 - DNA, 25 bp, Rattus norvegicus
gaagccattctgatgtggcacactg

SEQ ID NO: 301253 - DNA, 25 bp, Rattus norvegicus
gaagccattctgcatatgcctttga

SEQ ID NO: 301254 - DNA, 25 bp, Rattus norvegicus
gaagccattctggatatgcctttga

SEQ ID NO: 301255 - DNA, 25 bp, Rattus norvegicus
gaagccattctgttgtggcacactg

SEQ ID NO: 301256 - DNA, 25 bp, Rattus norvegicus
gaagccattgccactttaatgcaga

SEQ ID NO: 301257 - DNA, 25 bp, Rattus norvegicus
gaagccattgcctctttaatgcaga

SEQ ID NO: 301258 - DNA, 25 bp, Rattus norvegicus
gaagccattgtaaagctttcagatg

SEQ ID NO: 301259 - DNA, 25 bp, Rattus norvegicus
gaagccattgtatagctttcagatg

SEQ ID NO: 301260 - DNA, 25 bp, Rattus norvegicus
gaagccatttcaatcccagttgggt

SEQ ID NO: 301261 - DNA, 25 bp, Rattus norvegicus
gaagccatttcattcccagttgggt

SEQ ID NO: 301262 - DNA, 25 bp, Rattus norvegicus
gaagccattttgacaattcaccaac

SEQ ID NO: 301263 - DNA, 25 bp, Rattus norvegicus
gaagccattttgtcaattcaccaac

SEQ ID NO: 301264 - DNA, 25 bp, Rattus norvegicus
gaagccatttttccaggcccagaga

SEQ ID NO: 301265 - DNA, 25 bp, Rattus norvegicus
gaagccatttttgcaggcccagaga

SEQ ID NO: 301266 - DNA, 25 bp, Rattus norvegicus
gaagcccaaacaaggtaccatatca

SEQ ID NO: 301267 - DNA, 25 bp, Rattus norvegicus
gaagcccaaacatggtaccatatca

SEQ ID NO: 301268 - DNA, 25 bp, Rattus norvegicus
gaagcccaaatactcctccggaaat

SEQ ID NO: 301269 - DNA, 25 bp, Rattus norvegicus
gaagcccaaatagtcctccggaaat

SEQ ID NO: 301270 - DNA, 25 bp, Rattus norvegicus
gaagcccaagaccaggagacccgat

SEQ ID NO: 301271 - DNA, 25 bp, Rattus norvegicus
gaagcccaagacgaggagacccgat

SEQ ID NO: 301272 - DNA, 25 bp, Rattus norvegicus
gaagcccaagatcttttctcgtgtt

SEQ ID NO: 301273 - DNA, 25 bp, Rattus norvegicus
gaagcccaagatgttttctcgtgtt

SEQ ID NO: 301274 - DNA, 25 bp, Rattus norvegicus
gaagcccaaggcagaagacttaaga

SEQ ID NO: 301275 - DNA, 25 bp, Rattus norvegicus
gaagcccaaggctgaagacttaaga

SEQ ID NO: 301276 - DNA, 25 bp, Rattus norvegicus
gaagcccaatgaaagtgcaccttaa

SEQ ID NO: 301277 - DNA, 25 bp, Rattus norvegicus
gaagcccaatgatagtgcaccttaa

SEQ ID NO: 301278 - DNA, 25 bp, Rattus norvegicus
gaagcccaatgtcgcaggcattccc

SEQ ID NO: 301279 - DNA, 25 bp, Rattus norvegicus
gaagcccaatgtggcaggcattccc

SEQ ID NO: 301280 - DNA, 25 bp, Rattus norvegicus
gaagcccaattcactcaaatgtttt

SEQ ID NO: 301281 - DNA, 25 bp, Rattus norvegicus
gaagcccaattctctcaaatgtttt

SEQ ID NO: 301282 - DNA, 25 bp, Rattus norvegicus
gaagcccacaaacaggatgctgagc

SEQ ID NO: 301283 - DNA, 25 bp, Rattus norvegicus
gaagcccacaaagaggatgctgagc

SEQ ID NO: 301284 - DNA, 25 bp, Rattus norvegicus
gaagcccaccaacagtcatagaagt

SEQ ID NO: 301285 - DNA, 25 bp, Rattus norvegicus
gaagcccaccaagagtcatagaagt

SEQ ID NO: 301286 - DNA, 25 bp, Rattus norvegicus
gaagcccacccaatgtgtggctgta

SEQ ID NO: 301287 - DNA, 25 bp, Rattus norvegicus
gaagcccacccattgtgtggctgta

SEQ ID NO: 301288 - DNA, 25 bp, Rattus norvegicus
gaagcccacgccatataatatacct

SEQ ID NO: 301289 - DNA, 25 bp, Rattus norvegicus
gaagcccacgccttataatatacct

SEQ ID NO: 301290 - DNA, 25 bp, Rattus norvegicus
gaagcccacggcacggagctctgga

SEQ ID NO: 301291 - DNA, 25 bp, Rattus norvegicus
gaagcccacggctcggagctctgga

SEQ ID NO: 301292 - DNA, 25 bp, Rattus norvegicus
gaagcccacttcagtgccagagaat

SEQ ID NO: 301293 - DNA, 25 bp, Rattus norvegicus
gaagcccacttctgtgccagagaat

SEQ ID NO: 301294 - DNA, 25 bp, Rattus norvegicus
gaagcccacttgcattttcataatt

SEQ ID NO: 301295 - DNA, 25 bp, Rattus norvegicus
gaagcccacttggattttcataatt

SEQ ID NO: 301296 - DNA, 25 bp, Rattus norvegicus
gaagcccagaatatttccaggtgat

SEQ ID NO: 301297 - DNA, 25 bp, Rattus norvegicus
gaagcccagaatttttccaggtgat

SEQ ID NO: 301298 - DNA, 25 bp, Rattus norvegicus
gaagcccagactcactgacgtgcga

SEQ ID NO: 301299 - DNA, 25 bp, Rattus norvegicus
gaagcccagactgactgacgtgcga

SEQ ID NO: 301300 - DNA, 25 bp, Rattus norvegicus
gaagcccagagacagagcctcttct

SEQ ID NO: 301301 - DNA, 25 bp, Rattus norvegicus
gaagcccagagagagagcctcttct

SEQ ID NO: 301302 - DNA, 25 bp, Rattus norvegicus
gaagcccagagcatcctggaggtga

SEQ ID NO: 301303 - DNA, 25 bp, Rattus norvegicus
gaagcccagagcttcctggaggtga

SEQ ID NO: 301304 - DNA, 25 bp, Rattus norvegicus
gaagcccagagtcctagtggtcagt

SEQ ID NO: 301305 - DNA, 25 bp, Rattus norvegicus
gaagcccagagtgctagtggtcagt

SEQ ID NO: 301306 - DNA, 25 bp, Rattus norvegicus
gaagcccagcctcctgcagacagat

SEQ ID NO: 301307 - DNA, 25 bp, Rattus norvegicus
gaagcccagcctgctgcagacagat

SEQ ID NO: 301308 - DNA, 25 bp, Rattus norvegicus
gaagcccagcgcctttatgtaaaat

SEQ ID NO: 301309 - DNA, 25 bp, Rattus norvegicus
gaagcccagcgcgtttatgtaaaat

SEQ ID NO: 301310 - DNA, 25 bp, Rattus norvegicus
gaagcccagctcagagtctagattt

SEQ ID NO: 301311 - DNA, 25 bp, Rattus norvegicus
gaagcccagctctgagtctagattt

SEQ ID NO: 301312 - DNA, 25 bp, Rattus norvegicus
gaagcccaggctcaaattgaacagt

SEQ ID NO: 301313 - DNA, 25 bp, Rattus norvegicus
gaagcccaggctgaaattgaacagt

SEQ ID NO: 301314 - DNA, 25 bp, Rattus norvegicus
gaagcccagggcaagaactgtccat

SEQ ID NO: 301315 - DNA, 25 bp, Rattus norvegicus
gaagcccagggctagaactgtccat

SEQ ID NO: 301316 - DNA, 25 bp, Rattus norvegicus
gaagcccaggttacgagacagctga

SEQ ID NO: 301317 - DNA, 25 bp, Rattus norvegicus
gaagcccaggtttcgagacagctga

SEQ ID NO: 301318 - DNA, 25 bp, Rattus norvegicus
gaagcccagtgcaggctaaggtttt

SEQ ID NO: 301319 - DNA, 25 bp, Rattus norvegicus
gaagcccagtgctggctaaggtttt

SEQ ID NO: 301320 - DNA, 25 bp, Rattus norvegicus
gaagcccagtttcaaatcttgccaa

SEQ ID NO: 301321 - DNA, 25 bp, Rattus norvegicus
gaagcccagtttcttgctgtcgtgc

SEQ ID NO: 301322 - DNA, 25 bp, Rattus norvegicus
gaagcccagtttgaaatcttgccaa

SEQ ID NO: 301323 - DNA, 25 bp, Rattus norvegicus
gaagcccagtttgttgctgtcgtgc

SEQ ID NO: 301324 - DNA, 25 bp, Rattus norvegicus
gaagcccatccaatagttctgcaag

SEQ ID NO: 301325 - DNA, 25 bp, Rattus norvegicus
gaagcccatccattagttctgcaag

SEQ ID NO: 301326 - DNA, 25 bp, Rattus norvegicus
gaagcccatctaactacggactcag

SEQ ID NO: 301327 - DNA, 25 bp, Rattus norvegicus
gaagcccatctatctacggactcag

SEQ ID NO: 301328 - DNA, 25 bp, Rattus norvegicus
gaagcccatgacatcatccacgctg

SEQ ID NO: 301329 - DNA, 25 bp, Rattus norvegicus
gaagcccatgacttcatccacgctg

SEQ ID NO: 301330 - DNA, 25 bp, Rattus norvegicus
gaagcccatgagcactgagcagaga

SEQ ID NO: 301331 - DNA, 25 bp, Rattus norvegicus
gaagcccatgaggactgagcagaga

SEQ ID NO: 301332 - DNA, 25 bp, Rattus norvegicus
gaagcccatgggaggccacaagtca

SEQ ID NO: 301333 - DNA, 25 bp, Rattus norvegicus
gaagcccatgggtggccacaagtca

SEQ ID NO: 301334 - DNA, 25 bp, Rattus norvegicus
gaagcccatgttctctttatacaca

SEQ ID NO: 301335 - DNA, 25 bp, Rattus norvegicus
gaagcccatgttgtctttatacaca

SEQ ID NO: 301336 - DNA, 25 bp, Rattus norvegicus
gaagcccattaaatgggttccccat

SEQ ID NO: 301337 - DNA, 25 bp, Rattus norvegicus
gaagcccattaattgggttccccat

SEQ ID NO: 301338 - DNA, 25 bp, Rattus norvegicus
gaagcccattttaggctgttgattc

SEQ ID NO: 301339 - DNA, 25 bp, Rattus norvegicus
gaagcccattttctctttatagtgt

SEQ ID NO: 301340 - DNA, 25 bp, Rattus norvegicus
gaagcccattttgtctttatagtgt

SEQ ID NO: 301341 - DNA, 25 bp, Rattus norvegicus
gaagcccatttttggctgttgattc

SEQ ID NO: 301342 - DNA, 25 bp, Rattus norvegicus
gaagccccaacacagacgccggcgt

SEQ ID NO: 301343 - DNA, 25 bp, Rattus norvegicus
gaagccccaacagagacgccggcgt

SEQ ID NO: 301344 - DNA, 25 bp, Rattus norvegicus
gaagccccagaacaaactgaaccag

SEQ ID NO: 301345 - DNA, 25 bp, Rattus norvegicus
gaagccccagaagaaactgaaccag

SEQ ID NO: 301346 - DNA, 25 bp, Rattus norvegicus
gaagccccagccaatgatcaagaaa

SEQ ID NO: 301347 - DNA, 25 bp, Rattus norvegicus
gaagccccagcctatgatcaagaaa

SEQ ID NO: 301348 - DNA, 25 bp, Rattus norvegicus
gaagccccaggaaagctgggtcaat

SEQ ID NO: 301349 - DNA, 25 bp, Rattus norvegicus
gaagccccaggatagctgggtcaat

SEQ ID NO: 301350 - DNA, 25 bp, Rattus norvegicus
gaagccccaggcagccgcgaggaat

SEQ ID NO: 301351 - DNA, 25 bp, Rattus norvegicus
gaagccccaggctgccgcgaggaat

SEQ ID NO: 301352 - DNA, 25 bp, Rattus norvegicus
gaagccccagggatgcagtctcaat

SEQ ID NO: 301353 - DNA, 25 bp, Rattus norvegicus
gaagccccagggttgcagtctcaat

SEQ ID NO: 301354 - DNA, 25 bp, Rattus norvegicus
gaagccccagtccagtgaagtacag

SEQ ID NO: 301355 - DNA, 25 bp, Rattus norvegicus
gaagccccagtcgagtgaagtacag

SEQ ID NO: 301356 - DNA, 25 bp, Rattus norvegicus
gaagccccatgacacagttgatcga

SEQ ID NO: 301357 - DNA, 25 bp, Rattus norvegicus
gaagccccatgagacagttgatcga

SEQ ID NO: 301358 - DNA, 25 bp, Rattus norvegicus
gaagccccatttaccttgtgtagaa

SEQ ID NO: 301359 - DNA, 25 bp, Rattus norvegicus
gaagccccattttccttgtgtagaa

SEQ ID NO: 301360 - DNA, 25 bp, Rattus norvegicus
gaagccccgaatatgatccccaaca

SEQ ID NO: 301361 - DNA, 25 bp, Rattus norvegicus
gaagccccgaatttgatccccaaca

SEQ ID NO: 301362 - DNA, 25 bp, Rattus norvegicus
gaagccccgagtacaagttcgagca

SEQ ID NO: 301363 - DNA, 25 bp, Rattus norvegicus
gaagccccgagttcaagttcgagca

SEQ ID NO: 301364 - DNA, 25 bp, Rattus norvegicus
gaagccccgctgagtgctttgccaa

SEQ ID NO: 301365 - DNA, 25 bp, Rattus norvegicus
gaagccccgctgtgtgctttgccaa

SEQ ID NO: 301366 - DNA, 25 bp, Rattus norvegicus
gaagccccggatagcaagcagccag

SEQ ID NO: 301367 - DNA, 25 bp, Rattus norvegicus
gaagccccggattgcaagcagccag

SEQ ID NO: 301368 - DNA, 25 bp, Rattus norvegicus
gaagccccggtcatcagaagcagag

SEQ ID NO: 301369 - DNA, 25 bp, Rattus norvegicus
gaagccccggtcttcagaagcagag

SEQ ID NO: 301370 - DNA, 25 bp, Rattus norvegicus
gaagccccgtggcactgagaaagca

SEQ ID NO: 301371 - DNA, 25 bp, Rattus norvegicus
gaagccccgtgggactgagaaagca

SEQ ID NO: 301372 - DNA, 25 bp, Rattus norvegicus
gaagcccctagtatatgcagttatt

SEQ ID NO: 301373 - DNA, 25 bp, Rattus norvegicus
gaagcccctagtttatgcagttatt

SEQ ID NO: 301374 - DNA, 25 bp, Rattus norvegicus
gaagcccctattcgcctctgggttt

SEQ ID NO: 301375 - DNA, 25 bp, Rattus norvegicus
gaagcccctattggcctctgggttt

SEQ ID NO: 301376 - DNA, 25 bp, Rattus norvegicus
gaagcccctcagcaagagaatcgag

SEQ ID NO: 301377 - DNA, 25 bp, Rattus norvegicus
gaagcccctcaggaagagaatcgag

SEQ ID NO: 301378 - DNA, 25 bp, Rattus norvegicus
gaagcccctcatacaagtcatactg

SEQ ID NO: 301379 - DNA, 25 bp, Rattus norvegicus
gaagcccctcattcaagtcatactg

SEQ ID NO: 301380 - DNA, 25 bp, Rattus norvegicus
gaagcccctctaataagatggtgca

SEQ ID NO: 301381 - DNA, 25 bp, Rattus norvegicus
gaagcccctctattaagatggtgca

SEQ ID NO: 301382 - DNA, 25 bp, Rattus norvegicus
gaagcccctgaaacagcccaagaag

SEQ ID NO: 301383 - DNA, 25 bp, Rattus norvegicus
gaagcccctgaaatttgctcagtat

SEQ ID NO: 301384 - DNA, 25 bp, Rattus norvegicus
gaagcccctgaatcagcccaagaag

SEQ ID NO: 301385 - DNA, 25 bp, Rattus norvegicus
gaagcccctgaattttgctcagtat

SEQ ID NO: 301386 - DNA, 25 bp, Rattus norvegicus
gaagcccctgcaccagctatggaat

SEQ ID NO: 301387 - DNA, 25 bp, Rattus norvegicus
gaagcccctgcagcagctatggaat

SEQ ID NO: 301388 - DNA, 25 bp, Rattus norvegicus
gaagcccctgccagtgattatgaga

SEQ ID NO: 301389 - DNA, 25 bp, Rattus norvegicus
gaagcccctgcctgtgattatgaga

SEQ ID NO: 301390 - DNA, 25 bp, Rattus norvegicus
gaagcccctggaaggttaggcatgt

SEQ ID NO: 301391 - DNA, 25 bp, Rattus norvegicus
gaagcccctggatggttaggcatgt

SEQ ID NO: 301392 - DNA, 25 bp, Rattus norvegicus
gaagcccctggtacacattgaatag

SEQ ID NO: 301393 - DNA, 25 bp, Rattus norvegicus
gaagcccctggttcacattgaatag

SEQ ID NO: 301394 - DNA, 25 bp, Rattus norvegicus
gaagcccctgtcactttaaggaatg

SEQ ID NO: 301395 - DNA, 25 bp, Rattus norvegicus
gaagcccctgtctctttaaggaatg

SEQ ID NO: 301396 - DNA, 25 bp, Rattus norvegicus
gaagcccctgttctctttacttggg

SEQ ID NO: 301397 - DNA, 25 bp, Rattus norvegicus
gaagcccctgttgtctttacttggg

SEQ ID NO: 301398 - DNA, 25 bp, Rattus norvegicus
gaagccccttaaagcattcatgttg

SEQ ID NO: 301399 - DNA, 25 bp, Rattus norvegicus
gaagccccttaatgcattcatgttg

SEQ ID NO: 301400 - DNA, 25 bp, Rattus norvegicus
gaagcccgaaaaccgacagatctct

SEQ ID NO: 301401 - DNA, 25 bp, Rattus norvegicus
gaagcccgaaaagcgacagatctct

SEQ ID NO: 301402 - DNA, 25 bp, Rattus norvegicus
gaagcccgaaggacatggtggcact

SEQ ID NO: 301403 - DNA, 25 bp, Rattus norvegicus
gaagcccgaaggtcatggtggcact

SEQ ID NO: 301404 - DNA, 25 bp, Rattus norvegicus
gaagcccgaggcagctcctgtggaa

SEQ ID NO: 301405 - DNA, 25 bp, Rattus norvegicus
gaagcccgaggctgctcctgtggaa

SEQ ID NO: 301406 - DNA, 25 bp, Rattus norvegicus
gaagcccgatgcaggttcatttaga

SEQ ID NO: 301407 - DNA, 25 bp, Rattus norvegicus
gaagcccgatgctggttcatttaga

SEQ ID NO: 301408 - DNA, 25 bp, Rattus norvegicus
gaagcccgcttgagatcacctggga

SEQ ID NO: 301409 - DNA, 25 bp, Rattus norvegicus
gaagcccgcttgtgatcacctggga

SEQ ID NO: 301410 - DNA, 25 bp, Rattus norvegicus
gaagcccgggtgagtgttgaaataa

SEQ ID NO: 301411 - DNA, 25 bp, Rattus norvegicus
gaagcccgggtgtgtgttgaaataa

SEQ ID NO: 301412 - DNA, 25 bp, Rattus norvegicus
gaagcccgtgagatgatgccagttc

SEQ ID NO: 301413 - DNA, 25 bp, Rattus norvegicus
gaagcccgtgagttgatgccagttc

SEQ ID NO: 301414 - DNA, 25 bp, Rattus norvegicus
gaagcccgtgatcaacaccagtgca

SEQ ID NO: 301415 - DNA, 25 bp, Rattus norvegicus
gaagcccgtgatgaacaccagtgca

SEQ ID NO: 301416 - DNA, 25 bp, Rattus norvegicus
gaagcccgtgtgatttggaagacct

SEQ ID NO: 301417 - DNA, 25 bp, Rattus norvegicus
gaagcccgtgtgttttggaagacct

SEQ ID NO: 301418 - DNA, 25 bp, Rattus norvegicus
gaagcccgtttcatactgcttttct

SEQ ID NO: 301419 - DNA, 25 bp, Rattus norvegicus
gaagcccgtttcttactgcttttct

SEQ ID NO: 301420 - DNA, 25 bp, Rattus norvegicus
gaagcccgttttctccagattagat

SEQ ID NO: 301421 - DNA, 25 bp, Rattus norvegicus
gaagcccgttttgtccagattagat

SEQ ID NO: 301422 - DNA, 25 bp, Rattus norvegicus
gaagccctaacccttcaatatggtg

SEQ ID NO: 301423 - DNA, 25 bp, Rattus norvegicus
gaagccctaaccgttcaatatggtg

SEQ ID NO: 301424 - DNA, 25 bp, Rattus norvegicus
gaagccctaagcactcacagacgaa

SEQ ID NO: 301425 - DNA, 25 bp, Rattus norvegicus
gaagccctaagctctcacagacgaa

SEQ ID NO: 301426 - DNA, 25 bp, Rattus norvegicus
gaagccctaataaagacccgtgctg

SEQ ID NO: 301427 - DNA, 25 bp, Rattus norvegicus
gaagccctaatatagacccgtgctg

SEQ ID NO: 301428 - DNA, 25 bp, Rattus norvegicus
gaagccctagatatcctgactatat

SEQ ID NO: 301429 - DNA, 25 bp, Rattus norvegicus
gaagccctagatttcctgactatat

SEQ ID NO: 301430 - DNA, 25 bp, Rattus norvegicus
gaagccctagctagtccagttggag

SEQ ID NO: 301431 - DNA, 25 bp, Rattus norvegicus
gaagccctagcttgtccagttggag

SEQ ID NO: 301432 - DNA, 25 bp, Rattus norvegicus
gaagccctagttatctgctgtgatt

SEQ ID NO: 301433 - DNA, 25 bp, Rattus norvegicus
gaagccctagttttctgctgtgatt

SEQ ID NO: 301434 - DNA, 25 bp, Rattus norvegicus
gaagccctatagatgtgaccagtgt

SEQ ID NO: 301435 - DNA, 25 bp, Rattus norvegicus
gaagccctatagttgtgaccagtgt

SEQ ID NO: 301436 - DNA, 25 bp, Rattus norvegicus
gaagccctatgcatgtaacaactgt

SEQ ID NO: 301437 - DNA, 25 bp, Rattus norvegicus
gaagccctatgcttgtaacaactgt

SEQ ID NO: 301438 - DNA, 25 bp, Rattus norvegicus
gaagccctcagtcttgagattcaaa

SEQ ID NO: 301439 - DNA, 25 bp, Rattus norvegicus
gaagccctcagtgttgagattcaaa

SEQ ID NO: 301440 - DNA, 25 bp, Rattus norvegicus
gaagccctcataacccagaaggcag

SEQ ID NO: 301441 - DNA, 25 bp, Rattus norvegicus
gaagccctcatatcccagaaggcag

SEQ ID NO: 301442 - DNA, 25 bp, Rattus norvegicus
gaagccctcgaacgtctcgctgaga

SEQ ID NO: 301443 - DNA, 25 bp, Rattus norvegicus
gaagccctcgaaggtctcgctgaga

SEQ ID NO: 301444 - DNA, 25 bp, Rattus norvegicus
gaagccctctacatatggctgaact

SEQ ID NO: 301445 - DNA, 25 bp, Rattus norvegicus
gaagccctctacttatggctgaact

SEQ ID NO: 301446 - DNA, 25 bp, Rattus norvegicus
gaagccctctctctgagaagcggtc

SEQ ID NO: 301447 - DNA, 25 bp, Rattus norvegicus
gaagccctctctgtgagaagcggtc

SEQ ID NO: 301448 - DNA, 25 bp, Rattus norvegicus
gaagccctctggcttcagccacagt

SEQ ID NO: 301449 - DNA, 25 bp, Rattus norvegicus
gaagccctctgggttcagccacagt

SEQ ID NO: 301450 - DNA, 25 bp, Rattus norvegicus
gaagccctctgtctgtgacctcttg

SEQ ID NO: 301451 - DNA, 25 bp, Rattus norvegicus
gaagccctctgtgtgtgacctcttg

SEQ ID NO: 301452 - DNA, 25 bp, Rattus norvegicus
gaagccctcttaagatgtatagcca

SEQ ID NO: 301453 - DNA, 25 bp, Rattus norvegicus
gaagccctcttatgatgtatagcca

SEQ ID NO: 301454 - DNA, 25 bp, Rattus norvegicus
gaagccctgagaaaggcaatcaagg

SEQ ID NO: 301455 - DNA, 25 bp, Rattus norvegicus
gaagccctgagataggcaatcaagg

SEQ ID NO: 301456 - DNA, 25 bp, Rattus norvegicus
gaagccctgcccaagattgttgagt

SEQ ID NO: 301457 - DNA, 25 bp, Rattus norvegicus
gaagccctgccctagattgttgagt

SEQ ID NO: 301458 - DNA, 25 bp, Rattus norvegicus
gaagccctgctaacatgatacacat

SEQ ID NO: 301459 - DNA, 25 bp, Rattus norvegicus
gaagccctgctatcatgatacacat

SEQ ID NO: 301460 - DNA, 25 bp, Rattus norvegicus
gaagccctgctgatagttatgctga

SEQ ID NO: 301461 - DNA, 25 bp, Rattus norvegicus
gaagccctgctgttagttatgctga

SEQ ID NO: 301462 - DNA, 25 bp, Rattus norvegicus
gaagccctggaaaccggtctggaag

SEQ ID NO: 301463 - DNA, 25 bp, Rattus norvegicus
gaagccctggaatccggtctggaag

SEQ ID NO: 301464 - DNA, 25 bp, Rattus norvegicus
gaagccctggagaccctcggagtaa

SEQ ID NO: 301465 - DNA, 25 bp, Rattus norvegicus
gaagccctggagtccctcggagtaa

SEQ ID NO: 301466 - DNA, 25 bp, Rattus norvegicus
gaagccctggcaatcccggaactta

SEQ ID NO: 301467 - DNA, 25 bp, Rattus norvegicus
gaagccctggcattcccggaactta

SEQ ID NO: 301468 - DNA, 25 bp, Rattus norvegicus
gaagccctggctaatctggaactca

SEQ ID NO: 301469 - DNA, 25 bp, Rattus norvegicus
gaagccctggctactaaattatcca

SEQ ID NO: 301470 - DNA, 25 bp, Rattus norvegicus
gaagccctggcttatctggaactca

SEQ ID NO: 301471 - DNA, 25 bp, Rattus norvegicus
gaagccctggcttctaaattatcca

SEQ ID NO: 301472 - DNA, 25 bp, Rattus norvegicus
gaagccctgggaacatggatcagca

SEQ ID NO: 301473 - DNA, 25 bp, Rattus norvegicus
gaagccctgggatcatggatcagca

SEQ ID NO: 301474 - DNA, 25 bp, Rattus norvegicus
gaagccctgggtcactgaagtccta

SEQ ID NO: 301475 - DNA, 25 bp, Rattus norvegicus
gaagccctgggtgactgaagtccta

SEQ ID NO: 301476 - DNA, 25 bp, Rattus norvegicus
gaagccctggttcctggttgaaaca

SEQ ID NO: 301477 - DNA, 25 bp, Rattus norvegicus
gaagccctggttgctggttgaaaca

SEQ ID NO: 301478 - DNA, 25 bp, Rattus norvegicus
gaagccctgtccagggaagcagtgc

SEQ ID NO: 301479 - DNA, 25 bp, Rattus norvegicus
gaagccctgtcctgggaagcagtgc

SEQ ID NO: 301480 - DNA, 25 bp, Rattus norvegicus
gaagccctgtggacacagtgacctg

SEQ ID NO: 301481 - DNA, 25 bp, Rattus norvegicus
gaagccctgtggtcacagtgacctg

SEQ ID NO: 301482 - DNA, 25 bp, Rattus norvegicus
gaagccctgttaaacctggcagaga

SEQ ID NO: 301483 - DNA, 25 bp, Rattus norvegicus
gaagccctgttatacctggcagaga

SEQ ID NO: 301484 - DNA, 25 bp, Rattus norvegicus
gaagccctgttcctaaaattgccag

SEQ ID NO: 301485 - DNA, 25 bp, Rattus norvegicus
gaagccctgttcgtaaaattgccag

SEQ ID NO: 301486 - DNA, 25 bp, Rattus norvegicus
gaagcccttacaacaggattcagca

SEQ ID NO: 301487 - DNA, 25 bp, Rattus norvegicus
gaagcccttacatcaggattcagca

SEQ ID NO: 301488 - DNA, 25 bp, Rattus norvegicus
gaagcccttcaactgcgagttcgag

SEQ ID NO: 301489 - DNA, 25 bp, Rattus norvegicus
gaagcccttcaagtgcgagttcgag

SEQ ID NO: 301490 - DNA, 25 bp, Rattus norvegicus
gaagcccttcatctagctcagcagc

SEQ ID NO: 301491 - DNA, 25 bp, Rattus norvegicus
gaagcccttcatgtagctcagcagc

SEQ ID NO: 301492 - DNA, 25 bp, Rattus norvegicus
gaagcccttcctaccgtgggaatct

SEQ ID NO: 301493 - DNA, 25 bp, Rattus norvegicus
gaagcccttcctctagctaaaggtc

SEQ ID NO: 301494 - DNA, 25 bp, Rattus norvegicus
gaagcccttcctgtagctaaaggtc

SEQ ID NO: 301495 - DNA, 25 bp, Rattus norvegicus
gaagcccttccttccgtgggaatct

SEQ ID NO: 301496 - DNA, 25 bp, Rattus norvegicus
gaagcccttggaagacttgagcaca

SEQ ID NO: 301497 - DNA, 25 bp, Rattus norvegicus
gaagcccttggaagcaaagaaatca

SEQ ID NO: 301498 - DNA, 25 bp, Rattus norvegicus
gaagcccttggatgacttgagcaca

SEQ ID NO: 301499 - DNA, 25 bp, Rattus norvegicus
gaagcccttggatgcaaagaaatca

SEQ ID NO: 301500 - DNA, 25 bp, Rattus norvegicus
gaagcccttgttactcgatgtaaat

SEQ ID NO: 301501 - DNA, 25 bp, Rattus norvegicus
gaagcccttgtttctcgatgtaaat

SEQ ID NO: 301502 - DNA, 25 bp, Rattus norvegicus
gaagccctttaacatcagctgctgg

SEQ ID NO: 301503 - DNA, 25 bp, Rattus norvegicus
gaagccctttaagatcagctgctgg

SEQ ID NO: 301504 - DNA, 25 bp, Rattus norvegicus
gaagccctttcccactctgaggtat

SEQ ID NO: 301505 - DNA, 25 bp, Rattus norvegicus
gaagccctttccgactctgaggtat

SEQ ID NO: 301506 - DNA, 25 bp, Rattus norvegicus
gaagccctttgaatgccagacctgt

SEQ ID NO: 301507 - DNA, 25 bp, Rattus norvegicus
gaagccctttgattgccagacctgt

SEQ ID NO: 301508 - DNA, 25 bp, Rattus norvegicus
gaagccctttgtacgtgtagtttga

SEQ ID NO: 301509 - DNA, 25 bp, Rattus norvegicus
gaagccctttgtcctgtcaaggctg

SEQ ID NO: 301510 - DNA, 25 bp, Rattus norvegicus
gaagccctttgtgctgtcaaggctg

SEQ ID NO: 301511 - DNA, 25 bp, Rattus norvegicus
gaagccctttgttcgtgtagtttga

SEQ ID NO: 301512 - DNA, 25 bp, Rattus norvegicus
gaagcccttttcagggccttaagag

SEQ ID NO: 301513 - DNA, 25 bp, Rattus norvegicus
gaagcccttttctgggccttaagag

SEQ ID NO: 301514 - DNA, 25 bp, Rattus norvegicus
gaagccgaaggcacacagtgctctc

SEQ ID NO: 301515 - DNA, 25 bp, Rattus norvegicus
gaagccgaaggctcacagtgctctc

SEQ ID NO: 301516 - DNA, 25 bp, Rattus norvegicus
gaagccgaatgaccacacagtgtga

SEQ ID NO: 301517 - DNA, 25 bp, Rattus norvegicus
gaagccgaatgagcacacagtgtga

SEQ ID NO: 301518 - DNA, 25 bp, Rattus norvegicus
gaagccgacgatctgactcaagaaa

SEQ ID NO: 301519 - DNA, 25 bp, Rattus norvegicus
gaagccgacgatgtgactcaagaaa

SEQ ID NO: 301520 - DNA, 25 bp, Rattus norvegicus
gaagccgacggcagtcacagcaact

SEQ ID NO: 301521 - DNA, 25 bp, Rattus norvegicus
gaagccgacggctgtcacagcaact

SEQ ID NO: 301522 - DNA, 25 bp, Rattus norvegicus
gaagccgacttgactctgacttggt

SEQ ID NO: 301523 - DNA, 25 bp, Rattus norvegicus
gaagccgacttgtctctgacttggt

SEQ ID NO: 301524 - DNA, 25 bp, Rattus norvegicus
gaagccgagcggattacgtcctgga

SEQ ID NO: 301525 - DNA, 25 bp, Rattus norvegicus
gaagccgagcggtttacgtcctgga

SEQ ID NO: 301526 - DNA, 25 bp, Rattus norvegicus
gaagccgaggccagagcagaagaca

SEQ ID NO: 301527 - DNA, 25 bp, Rattus norvegicus
gaagccgaggcctgagcagaagaca

SEQ ID NO: 301528 - DNA, 25 bp, Rattus norvegicus
gaagccgagttcaccaagtccattg

SEQ ID NO: 301529 - DNA, 25 bp, Rattus norvegicus
gaagccgagttctccaagtccattg

SEQ ID NO: 301530 - DNA, 25 bp, Rattus norvegicus
gaagccgatggccttcaccgagaac

SEQ ID NO: 301531 - DNA, 25 bp, Rattus norvegicus
gaagccgatggcgttcaccgagaac

SEQ ID NO: 301532 - DNA, 25 bp, Rattus norvegicus
gaagccgattgtatatgtctagatt

SEQ ID NO: 301533 - DNA, 25 bp, Rattus norvegicus
gaagccgattgtttatgtctagatt

SEQ ID NO: 301534 - DNA, 25 bp, Rattus norvegicus
gaagccgcaatcatcttctgagata

SEQ ID NO: 301535 - DNA, 25 bp, Rattus norvegicus
gaagccgcaatcttcttctgagata

SEQ ID NO: 301536 - DNA, 25 bp, Rattus norvegicus
gaagccgcacagaaaggttttagca

SEQ ID NO: 301537 - DNA, 25 bp, Rattus norvegicus
gaagccgcacagtaaggttttagca

SEQ ID NO: 301538 - DNA, 25 bp, Rattus norvegicus
gaagccgcaggtatttgtgtccaat

SEQ ID NO: 301539 - DNA, 25 bp, Rattus norvegicus
gaagccgcaggtttttgtgtccaat

SEQ ID NO: 301540 - DNA, 25 bp, Rattus norvegicus
gaagccgccaatcgatggacagata

SEQ ID NO: 301541 - DNA, 25 bp, Rattus norvegicus
gaagccgccaatggatggacagata

SEQ ID NO: 301542 - DNA, 25 bp, Rattus norvegicus
gaagccgccatcacaatcagaggga

SEQ ID NO: 301543 - DNA, 25 bp, Rattus norvegicus
gaagccgccatctcaatcagaggga

SEQ ID NO: 301544 - DNA, 25 bp, Rattus norvegicus
gaagccgccttcatgaaattggaca

SEQ ID NO: 301545 - DNA, 25 bp, Rattus norvegicus
gaagccgccttcttgaaattggaca

SEQ ID NO: 301546 - DNA, 25 bp, Rattus norvegicus
gaagccgcgctcagttttgggaata

SEQ ID NO: 301547 - DNA, 25 bp, Rattus norvegicus
gaagccgcgctctgttttgggaata

SEQ ID NO: 301548 - DNA, 25 bp, Rattus norvegicus
gaagccgcgtttcactttgcatatg

SEQ ID NO: 301549 - DNA, 25 bp, Rattus norvegicus
gaagccgcgtttgactttgcatatg

SEQ ID NO: 301550 - DNA, 25 bp, Rattus norvegicus
gaagccgctcatctgcatattcata

SEQ ID NO: 301551 - DNA, 25 bp, Rattus norvegicus
gaagccgctcatgtgcatattcata

SEQ ID NO: 301552 - DNA, 25 bp, Rattus norvegicus
gaagccgcttcaatcaagttggtgt

SEQ ID NO: 301553 - DNA, 25 bp, Rattus norvegicus
gaagccgcttcattcaagttggtgt

SEQ ID NO: 301554 - DNA, 25 bp, Rattus norvegicus
gaagccgcttcgagactgtaggata

SEQ ID NO: 301555 - DNA, 25 bp, Rattus norvegicus
gaagccgcttcgtgactgtaggata

SEQ ID NO: 301556 - DNA, 25 bp, Rattus norvegicus
gaagccggagacagaaagccccact

SEQ ID NO: 301557 - DNA, 25 bp, Rattus norvegicus
gaagccggagactgaaagccccact

SEQ ID NO: 301558 - DNA, 25 bp, Rattus norvegicus
gaagccggagataagctccctccag

SEQ ID NO: 301559 - DNA, 25 bp, Rattus norvegicus
gaagccggagattagctccctccag

SEQ ID NO: 301560 - DNA, 25 bp, Rattus norvegicus
gaagccggatacagatgccgtcaca

SEQ ID NO: 301561 - DNA, 25 bp, Rattus norvegicus
gaagccggatactgatgccgtcaca

SEQ ID NO: 301562 - DNA, 25 bp, Rattus norvegicus
gaagccggcacgaaatcctctggaa

SEQ ID NO: 301563 - DNA, 25 bp, Rattus norvegicus
gaagccggcacgtaatcctctggaa

SEQ ID NO: 301564 - DNA, 25 bp, Rattus norvegicus
gaagccggccagaacaatgacaatt

SEQ ID NO: 301565 - DNA, 25 bp, Rattus norvegicus
gaagccggccagtacaatgacaatt

SEQ ID NO: 301566 - DNA, 25 bp, Rattus norvegicus
gaagccgtacataactcaggcaata

SEQ ID NO: 301567 - DNA, 25 bp, Rattus norvegicus
gaagccgtacattactcaggcaata

SEQ ID NO: 301568 - DNA, 25 bp, Rattus norvegicus
gaagccgtagctcctgtcatggcca

SEQ ID NO: 301569 - DNA, 25 bp, Rattus norvegicus
gaagccgtagctgctgtcatggcca

SEQ ID NO: 301570 - DNA, 25 bp, Rattus norvegicus
gaagccgtcaggagccaagtgtgcc

SEQ ID NO: 301571 - DNA, 25 bp, Rattus norvegicus
gaagccgtcaggtgccaagtgtgcc

SEQ ID NO: 301572 - DNA, 25 bp, Rattus norvegicus
gaagccgtccttctggagtgaaccc

SEQ ID NO: 301573 - DNA, 25 bp, Rattus norvegicus
gaagccgtccttgtggagtgaaccc

SEQ ID NO: 301574 - DNA, 25 bp, Rattus norvegicus
gaagccgtctttcttggttcagatt

SEQ ID NO: 301575 - DNA, 25 bp, Rattus norvegicus
gaagccgtctttgttggttcagatt

SEQ ID NO: 301576 - DNA, 25 bp, Rattus norvegicus
gaagccgtgaaacacccatccagag

SEQ ID NO: 301577 - DNA, 25 bp, Rattus norvegicus
gaagccgtgaaagacccatccagag

SEQ ID NO: 301578 - DNA, 25 bp, Rattus norvegicus
gaagccgtgaacacaactcagccac

SEQ ID NO: 301579 - DNA, 25 bp, Rattus norvegicus
gaagccgtgaactcaactcagccac

SEQ ID NO: 301580 - DNA, 25 bp, Rattus norvegicus
gaagccgtgactcaacgagggcatc

SEQ ID NO: 301581 - DNA, 25 bp, Rattus norvegicus
gaagccgtgactgaacgagggcatc

SEQ ID NO: 301582 - DNA, 25 bp, Rattus norvegicus
gaagccgtgctgaagaacctaatag

SEQ ID NO: 301583 - DNA, 25 bp, Rattus norvegicus
gaagccgtgctgtagaacctaatag

SEQ ID NO: 301584 - DNA, 25 bp, Rattus norvegicus
gaagccgttaaacactcgcactctc

SEQ ID NO: 301585 - DNA, 25 bp, Rattus norvegicus
gaagccgttaaagactcgcactctc

SEQ ID NO: 301586 - DNA, 25 bp, Rattus norvegicus
gaagccgttcctcgcaggacgaaga

SEQ ID NO: 301587 - DNA, 25 bp, Rattus norvegicus
gaagccgttcctggcaggacgaaga

SEQ ID NO: 301588 - DNA, 25 bp, Rattus norvegicus
gaagccgttctgaatccaacatggc

SEQ ID NO: 301589 - DNA, 25 bp, Rattus norvegicus
gaagccgttctgtatccaacatggc

SEQ ID NO: 301590 - DNA, 25 bp, Rattus norvegicus
gaagccgttgcacattggagatcca

SEQ ID NO: 301591 - DNA, 25 bp, Rattus norvegicus
gaagccgttgcagattggagatcca

SEQ ID NO: 301592 - DNA, 25 bp, Rattus norvegicus
gaagccgttgccatcctgatagtca

SEQ ID NO: 301593 - DNA, 25 bp, Rattus norvegicus
gaagccgttgccttcctgatagtca

SEQ ID NO: 301594 - DNA, 25 bp, Rattus norvegicus
gaagccgttgcgaactgtgatgtta

SEQ ID NO: 301595 - DNA, 25 bp, Rattus norvegicus
gaagccgttgcgtactgtgatgtta

SEQ ID NO: 301596 - DNA, 25 bp, Rattus norvegicus
gaagccgttgggacctcccaggccg

SEQ ID NO: 301597 - DNA, 25 bp, Rattus norvegicus
gaagccgttgggtcctcccaggccg

SEQ ID NO: 301598 - DNA, 25 bp, Rattus norvegicus
gaagccgttttaactaatactgtaa

SEQ ID NO: 301599 - DNA, 25 bp, Rattus norvegicus
gaagccgttttatctaatactgtaa

SEQ ID NO: 301600 - DNA, 25 bp, Rattus norvegicus
gaagcctaaactatttactgtgaat

SEQ ID NO: 301601 - DNA, 25 bp, Rattus norvegicus
gaagcctaaactttttactgtgaat

SEQ ID NO: 301602 - DNA, 25 bp, Rattus norvegicus
gaagcctaactgacacgtcaagcgt

SEQ ID NO: 301603 - DNA, 25 bp, Rattus norvegicus
gaagcctaactgtcacgtcaagcgt

SEQ ID NO: 301604 - DNA, 25 bp, Rattus norvegicus
gaagcctagaaacttggcccttgct

SEQ ID NO: 301605 - DNA, 25 bp, Rattus norvegicus
gaagcctagaaagttggcccttgct

SEQ ID NO: 301606 - DNA, 25 bp, Rattus norvegicus
gaagcctagcgcagagctttcggaa

SEQ ID NO: 301607 - DNA, 25 bp, Rattus norvegicus
gaagcctagcgctgagctttcggaa

SEQ ID NO: 301608 - DNA, 25 bp, Rattus norvegicus
gaagcctatcccctaacgtgaggtt

SEQ ID NO: 301609 - DNA, 25 bp, Rattus norvegicus
gaagcctatcccgtaacgtgaggtt

SEQ ID NO: 301610 - DNA, 25 bp, Rattus norvegicus
gaagcctatcttcttcaacttccag

SEQ ID NO: 301611 - DNA, 25 bp, Rattus norvegicus
gaagcctatcttgttcaacttccag

SEQ ID NO: 301612 - DNA, 25 bp, Rattus norvegicus
gaagcctatttccacgaacctgcag

SEQ ID NO: 301613 - DNA, 25 bp, Rattus norvegicus
gaagcctatttcgacgaacctgcag

SEQ ID NO: 301614 - DNA, 25 bp, Rattus norvegicus
gaagcctcaaccctgccaggtggga

SEQ ID NO: 301615 - DNA, 25 bp, Rattus norvegicus
gaagcctcaaccgtgccaggtggga

SEQ ID NO: 301616 - DNA, 25 bp, Rattus norvegicus
gaagcctcagatacttccaggtttt

SEQ ID NO: 301617 - DNA, 25 bp, Rattus norvegicus
gaagcctcagattcttccaggtttt

SEQ ID NO: 301618 - DNA, 25 bp, Rattus norvegicus
gaagcctcagctatatttcccagag

SEQ ID NO: 301619 - DNA, 25 bp, Rattus norvegicus
gaagcctcagctttatttcccagag

SEQ ID NO: 301620 - DNA, 25 bp, Rattus norvegicus
gaagcctcaggacagcaaagcatcg

SEQ ID NO: 301621 - DNA, 25 bp, Rattus norvegicus
gaagcctcaggagagcaaagcatcg

SEQ ID NO: 301622 - DNA, 25 bp, Rattus norvegicus
gaagcctcagggattggctacaaca

SEQ ID NO: 301623 - DNA, 25 bp, Rattus norvegicus
gaagcctcagggtttggctacaaca

SEQ ID NO: 301624 - DNA, 25 bp, Rattus norvegicus
gaagcctcatatcagaagctactgg

SEQ ID NO: 301625 - DNA, 25 bp, Rattus norvegicus
gaagcctcatatgagaagctactgg

SEQ ID NO: 301626 - DNA, 25 bp, Rattus norvegicus
gaagcctcatgtctcaggaacatct

SEQ ID NO: 301627 - DNA, 25 bp, Rattus norvegicus
gaagcctcatgtgtcaggaacatct

SEQ ID NO: 301628 - DNA, 25 bp, Rattus norvegicus
gaagcctcccagagtagccaggtat

SEQ ID NO: 301629 - DNA, 25 bp, Rattus norvegicus
gaagcctcccagtgtagccaggtat

SEQ ID NO: 301630 - DNA, 25 bp, Rattus norvegicus
gaagcctccgcacataccagaatag

SEQ ID NO: 301631 - DNA, 25 bp, Rattus norvegicus
gaagcctccgcagataccagaatag

SEQ ID NO: 301632 - DNA, 25 bp, Rattus norvegicus
gaagcctcgggaaagcacttagatt

SEQ ID NO: 301633 - DNA, 25 bp, Rattus norvegicus
gaagcctcgggatagcacttagatt

SEQ ID NO: 301634 - DNA, 25 bp, Rattus norvegicus
gaagcctcgggcactattgtcagaa

SEQ ID NO: 301635 - DNA, 25 bp, Rattus norvegicus
gaagcctcgggctctattgtcagaa

SEQ ID NO: 301636 - DNA, 25 bp, Rattus norvegicus
gaagcctctaggactataataaccg

SEQ ID NO: 301637 - DNA, 25 bp, Rattus norvegicus
gaagcctctaggtctataataaccg

SEQ ID NO: 301638 - DNA, 25 bp, Rattus norvegicus
gaagcctctcagcatacattttatt

SEQ ID NO: 301639 - DNA, 25 bp, Rattus norvegicus
gaagcctctcaggatacattttatt

SEQ ID NO: 301640 - DNA, 25 bp, Rattus norvegicus
gaagcctcttttccaagttcagaaa

SEQ ID NO: 301641 - DNA, 25 bp, Rattus norvegicus
gaagcctcttttctacatttcctgc

SEQ ID NO: 301642 - DNA, 25 bp, Rattus norvegicus
gaagcctcttttgcaagttcagaaa

SEQ ID NO: 301643 - DNA, 25 bp, Rattus norvegicus
gaagcctcttttgtacatttcctgc

SEQ ID NO: 301644 - DNA, 25 bp, Rattus norvegicus
gaagcctgaaacactgtctgctctg

SEQ ID NO: 301645 - DNA, 25 bp, Rattus norvegicus
gaagcctgaaactctgtctgctctg

SEQ ID NO: 301646 - DNA, 25 bp, Rattus norvegicus
gaagcctgaagcattgctccgtaga

SEQ ID NO: 301647 - DNA, 25 bp, Rattus norvegicus
gaagcctgaagctttgctccgtaga

SEQ ID NO: 301648 - DNA, 25 bp, Rattus norvegicus
gaagcctgaagtcgccatggacagc

SEQ ID NO: 301649 - DNA, 25 bp, Rattus norvegicus
gaagcctgaagtggccatggacagc

SEQ ID NO: 301650 - DNA, 25 bp, Rattus norvegicus
gaagcctgaataaatcttgccatga

SEQ ID NO: 301651 - DNA, 25 bp, Rattus norvegicus
gaagcctgaatatatcttgccatga

SEQ ID NO: 301652 - DNA, 25 bp, Rattus norvegicus
gaagcctgacagaagcagcctgaat

SEQ ID NO: 301653 - DNA, 25 bp, Rattus norvegicus
gaagcctgacagtagcagcctgaat

SEQ ID NO: 301654 - DNA, 25 bp, Rattus norvegicus
gaagcctgagcactgtctttctctc

SEQ ID NO: 301655 - DNA, 25 bp, Rattus norvegicus
gaagcctgagcagtgtctttctctc

SEQ ID NO: 301656 - DNA, 25 bp, Rattus norvegicus
gaagcctgagctcagtgtgtgagga

SEQ ID NO: 301657 - DNA, 25 bp, Rattus norvegicus
gaagcctgagctgagtgtgtgagga

SEQ ID NO: 301658 - DNA, 25 bp, Rattus norvegicus
gaagcctgaggaccttaattcatcc

SEQ ID NO: 301659 - DNA, 25 bp, Rattus norvegicus
gaagcctgaggagcttaattcatcc

SEQ ID NO: 301660 - DNA, 25 bp, Rattus norvegicus
gaagcctgatctattatcatctgtt

SEQ ID NO: 301661 - DNA, 25 bp, Rattus norvegicus
gaagcctgatcttttatcatctgtt

SEQ ID NO: 301662 - DNA, 25 bp, Rattus norvegicus
gaagcctgcactactcaagctaaag

SEQ ID NO: 301663 - DNA, 25 bp, Rattus norvegicus
gaagcctgcacttctcaagctaaag

SEQ ID NO: 301664 - DNA, 25 bp, Rattus norvegicus
gaagcctgcagaatgaagtgtaaac

SEQ ID NO: 301665 - DNA, 25 bp, Rattus norvegicus
gaagcctgcagattgaagtgtaaac

SEQ ID NO: 301666 - DNA, 25 bp, Rattus norvegicus
gaagcctgcagccaattggccagaa

SEQ ID NO: 301667 - DNA, 25 bp, Rattus norvegicus
gaagcctgcagcgaattggccagaa

SEQ ID NO: 301668 - DNA, 25 bp, Rattus norvegicus
gaagcctgccagagtgtaaagtgtc

SEQ ID NO: 301669 - DNA, 25 bp, Rattus norvegicus
gaagcctgccagtgtgtaaagtgtc

SEQ ID NO: 301670 - DNA, 25 bp, Rattus norvegicus
gaagcctgcctgcagttagactgtg

SEQ ID NO: 301671 - DNA, 25 bp, Rattus norvegicus
gaagcctgcctggagttagactgtg

SEQ ID NO: 301672 - DNA, 25 bp, Rattus norvegicus
gaagcctgcgttcgacaagggccca

SEQ ID NO: 301673 - DNA, 25 bp, Rattus norvegicus
gaagcctgcgttggacaagggccca

SEQ ID NO: 301674 - DNA, 25 bp, Rattus norvegicus
gaagcctgctgcaaacagtagctgg

SEQ ID NO: 301675 - DNA, 25 bp, Rattus norvegicus
gaagcctgctgctaacagtagctgg

SEQ ID NO: 301676 - DNA, 25 bp, Rattus norvegicus
gaagcctgcttgacaaagctgacct

SEQ ID NO: 301677 - DNA, 25 bp, Rattus norvegicus
gaagcctgcttgtcaaagctgacct

SEQ ID NO: 301678 - DNA, 25 bp, Rattus norvegicus
gaagcctggagccttttcaagaaag

SEQ ID NO: 301679 - DNA, 25 bp, Rattus norvegicus
gaagcctggagcgttttcaagaaag

SEQ ID NO: 301680 - DNA, 25 bp, Rattus norvegicus
gaagcctggatcagaatgctgccga

SEQ ID NO: 301681 - DNA, 25 bp, Rattus norvegicus
gaagcctggatctgaatgctgccga

SEQ ID NO: 301682 - DNA, 25 bp, Rattus norvegicus
gaagcctggcagactgtagcgtact

SEQ ID NO: 301683 - DNA, 25 bp, Rattus norvegicus
gaagcctggcagtctgtagcgtact

SEQ ID NO: 301684 - DNA, 25 bp, Rattus norvegicus
gaagcctggcatcagtcactgctga

SEQ ID NO: 301685 - DNA, 25 bp, Rattus norvegicus
gaagcctggcatgagtcactgctga

SEQ ID NO: 301686 - DNA, 25 bp, Rattus norvegicus
gaagcctggctccttgagaattcac

SEQ ID NO: 301687 - DNA, 25 bp, Rattus norvegicus
gaagcctggctcgttgagaattcac

SEQ ID NO: 301688 - DNA, 25 bp, Rattus norvegicus
gaagcctgggttactaacgacacct

SEQ ID NO: 301689 - DNA, 25 bp, Rattus norvegicus
gaagcctgggtttctaacgacacct

SEQ ID NO: 301690 - DNA, 25 bp, Rattus norvegicus
gaagcctggtcccagttctagaacg

SEQ ID NO: 301691 - DNA, 25 bp, Rattus norvegicus
gaagcctggtccgagttctagaacg

SEQ ID NO: 301692 - DNA, 25 bp, Rattus norvegicus
gaagcctgtaagactatagtatttg

SEQ ID NO: 301693 - DNA, 25 bp, Rattus norvegicus
gaagcctgtaagtctatagtatttg

SEQ ID NO: 301694 - DNA, 25 bp, Rattus norvegicus
gaagcctgtcaaaatctggtccctc

SEQ ID NO: 301695 - DNA, 25 bp, Rattus norvegicus
gaagcctgtcaatatctggtccctc

SEQ ID NO: 301696 - DNA, 25 bp, Rattus norvegicus
gaagcctgtcacactacagcggtca

SEQ ID NO: 301697 - DNA, 25 bp, Rattus norvegicus
gaagcctgtcactctacagcggtca

SEQ ID NO: 301698 - DNA, 25 bp, Rattus norvegicus
gaagcctgtctgagtatcaatcggg

SEQ ID NO: 301699 - DNA, 25 bp, Rattus norvegicus
gaagcctgtctgtgtatcaatcggg

SEQ ID NO: 301700 - DNA, 25 bp, Rattus norvegicus
gaagcctgtggcaccagagctatgt

SEQ ID NO: 301701 - DNA, 25 bp, Rattus norvegicus
gaagcctgtggctccagagctatgt

SEQ ID NO: 301702 - DNA, 25 bp, Rattus norvegicus
gaagcctgtgtaacccttcaaggat

SEQ ID NO: 301703 - DNA, 25 bp, Rattus norvegicus
gaagcctgtgtatcccttcaaggat

SEQ ID NO: 301704 - DNA, 25 bp, Rattus norvegicus
gaagcctgtgttatctagtattgta

SEQ ID NO: 301705 - DNA, 25 bp, Rattus norvegicus
gaagcctgtgttttctagtattgta

SEQ ID NO: 301706 - DNA, 25 bp, Rattus norvegicus
gaagcctgttagcattctagttaca

SEQ ID NO: 301707 - DNA, 25 bp, Rattus norvegicus
gaagcctgttaggattctagttaca

SEQ ID NO: 301708 - DNA, 25 bp, Rattus norvegicus
gaagcctgttcacttcttccagaca

SEQ ID NO: 301709 - DNA, 25 bp, Rattus norvegicus
gaagcctgttcagttcttccagaca

SEQ ID NO: 301710 - DNA, 25 bp, Rattus norvegicus
gaagccttaaaaccagctgtgcagg

SEQ ID NO: 301711 - DNA, 25 bp, Rattus norvegicus
gaagccttaaaagcagctgtgcagg

SEQ ID NO: 301712 - DNA, 25 bp, Rattus norvegicus
gaagccttaatgcttgcagggtaac

SEQ ID NO: 301713 - DNA, 25 bp, Rattus norvegicus
gaagccttaatggttgcagggtaac

SEQ ID NO: 301714 - DNA, 25 bp, Rattus norvegicus
gaagccttaattagcacagggtgac

SEQ ID NO: 301715 - DNA, 25 bp, Rattus norvegicus
gaagccttaatttgcacagggtgac

SEQ ID NO: 301716 - DNA, 25 bp, Rattus norvegicus
gaagccttacaaatgtgacacctgt

SEQ ID NO: 301717 - DNA, 25 bp, Rattus norvegicus
gaagccttacaattgtgacacctgt

SEQ ID NO: 301718 - DNA, 25 bp, Rattus norvegicus
gaagccttactaagtcaggactctt

SEQ ID NO: 301719 - DNA, 25 bp, Rattus norvegicus
gaagccttactacacaggcagctga

SEQ ID NO: 301720 - DNA, 25 bp, Rattus norvegicus
gaagccttactagacaggcagctga

SEQ ID NO: 301721 - DNA, 25 bp, Rattus norvegicus
gaagccttactatgtcaggactctt

SEQ ID NO: 301722 - DNA, 25 bp, Rattus norvegicus
gaagccttagctcccaaaagaatca

SEQ ID NO: 301723 - DNA, 25 bp, Rattus norvegicus
gaagccttagctgccaaaagaatca

SEQ ID NO: 301724 - DNA, 25 bp, Rattus norvegicus
gaagccttcacaatcgacctgaaac

SEQ ID NO: 301725 - DNA, 25 bp, Rattus norvegicus
gaagccttcacattcgacctgaaac

SEQ ID NO: 301726 - DNA, 25 bp, Rattus norvegicus
gaagccttcaccaggatgtcaatat

SEQ ID NO: 301727 - DNA, 25 bp, Rattus norvegicus
gaagccttcacctggatgtcaatat

SEQ ID NO: 301728 - DNA, 25 bp, Rattus norvegicus
gaagccttcagaaacagagggcaac

SEQ ID NO: 301729 - DNA, 25 bp, Rattus norvegicus
gaagccttcagatacagagggcaac

SEQ ID NO: 301730 - DNA, 25 bp, Rattus norvegicus
gaagccttcagcagcattgaccaga

SEQ ID NO: 301731 - DNA, 25 bp, Rattus norvegicus
gaagccttcagctgcattgaccaga

SEQ ID NO: 301732 - DNA, 25 bp, Rattus norvegicus
gaagccttcattaactactgtcata

SEQ ID NO: 301733 - DNA, 25 bp, Rattus norvegicus
gaagccttcatttactactgtcata

SEQ ID NO: 301734 - DNA, 25 bp, Rattus norvegicus
gaagccttccatctctttaaggtgt

SEQ ID NO: 301735 - DNA, 25 bp, Rattus norvegicus
gaagccttccatgtctttaaggtgt

SEQ ID NO: 301736 - DNA, 25 bp, Rattus norvegicus
gaagccttcccaagctgtttagaat

SEQ ID NO: 301737 - DNA, 25 bp, Rattus norvegicus
gaagccttcccatgctgtttagaat

SEQ ID NO: 301738 - DNA, 25 bp, Rattus norvegicus
gaagccttccgcaagctttttacaa

SEQ ID NO: 301739 - DNA, 25 bp, Rattus norvegicus
gaagccttccgctagctttttacaa

SEQ ID NO: 301740 - DNA, 25 bp, Rattus norvegicus
gaagccttcggtccctgaatagaaa

SEQ ID NO: 301741 - DNA, 25 bp, Rattus norvegicus
gaagccttcggtgcctgaatagaaa

SEQ ID NO: 301742 - DNA, 25 bp, Rattus norvegicus
gaagccttcgtaacctcagttagat

SEQ ID NO: 301743 - DNA, 25 bp, Rattus norvegicus
gaagccttcgtatcctcagttagat

SEQ ID NO: 301744 - DNA, 25 bp, Rattus norvegicus
gaagccttgcagcatacaccctatc

SEQ ID NO: 301745 - DNA, 25 bp, Rattus norvegicus
gaagccttgcaggatacaccctatc

SEQ ID NO: 301746 - DNA, 25 bp, Rattus norvegicus
gaagccttgctgaactaagttttgt

SEQ ID NO: 301747 - DNA, 25 bp, Rattus norvegicus
gaagccttgctgtactaagttttgt

SEQ ID NO: 301748 - DNA, 25 bp, Rattus norvegicus
gaagccttgcttaatttcatccata

SEQ ID NO: 301749 - DNA, 25 bp, Rattus norvegicus
gaagccttgctttatttcatccata

SEQ ID NO: 301750 - DNA, 25 bp, Rattus norvegicus
gaagccttggaaagagtctaaccag

SEQ ID NO: 301751 - DNA, 25 bp, Rattus norvegicus
gaagccttggaatgagtctaaccag

SEQ ID NO: 301752 - DNA, 25 bp, Rattus norvegicus
gaagccttggcacatgagcagcgta

SEQ ID NO: 301753 - DNA, 25 bp, Rattus norvegicus
gaagccttggcagatgagcagcgta

SEQ ID NO: 301754 - DNA, 25 bp, Rattus norvegicus
gaagccttggctaaaactctcagta

SEQ ID NO: 301755 - DNA, 25 bp, Rattus norvegicus
gaagccttggcttaaactctcagta

SEQ ID NO: 301756 - DNA, 25 bp, Rattus norvegicus
gaagccttggttatgagcgcttgga

SEQ ID NO: 301757 - DNA, 25 bp, Rattus norvegicus
gaagccttggttttgagcgcttgga

SEQ ID NO: 301758 - DNA, 25 bp, Rattus norvegicus
gaagccttgttaagtgccaactcat

SEQ ID NO: 301759 - DNA, 25 bp, Rattus norvegicus
gaagccttgttatgtgccaactcat

SEQ ID NO: 301760 - DNA, 25 bp, Rattus norvegicus
gaagccttgttcagagtgacggttt

SEQ ID NO: 301761 - DNA, 25 bp, Rattus norvegicus
gaagccttgttctgagtgacggttt

SEQ ID NO: 301762 - DNA, 25 bp, Rattus norvegicus
gaagccttgtttacaggagctttaa

SEQ ID NO: 301763 - DNA, 25 bp, Rattus norvegicus
gaagccttgtttcttagtgacccaa

SEQ ID NO: 301764 - DNA, 25 bp, Rattus norvegicus
gaagccttgtttgttagtgacccaa

SEQ ID NO: 301765 - DNA, 25 bp, Rattus norvegicus
gaagccttgttttcaggagctttaa

SEQ ID NO: 301766 - DNA, 25 bp, Rattus norvegicus
gaagcctttctgatatccagaactc

SEQ ID NO: 301767 - DNA, 25 bp, Rattus norvegicus
gaagcctttctgttatccagaactc

SEQ ID NO: 301768 - DNA, 25 bp, Rattus norvegicus
gaagcctttgaacagaccccgaaga

SEQ ID NO: 301769 - DNA, 25 bp, Rattus norvegicus
gaagcctttgaagagaccccgaaga

SEQ ID NO: 301770 - DNA, 25 bp, Rattus norvegicus
gaagcctttgacagatgccagttgg

SEQ ID NO: 301771 - DNA, 25 bp, Rattus norvegicus
gaagcctttgactgatgccagttgg

SEQ ID NO: 301772 - DNA, 25 bp, Rattus norvegicus
gaagcctttgatatcacgggtacac

SEQ ID NO: 301773 - DNA, 25 bp, Rattus norvegicus
gaagcctttgatcgaagctgtgtat

SEQ ID NO: 301774 - DNA, 25 bp, Rattus norvegicus
gaagcctttgatggaagctgtgtat

SEQ ID NO: 301775 - DNA, 25 bp, Rattus norvegicus
gaagcctttgatttcacgggtacac

SEQ ID NO: 301776 - DNA, 25 bp, Rattus norvegicus
gaagcctttgctctttgcctgctgc

SEQ ID NO: 301777 - DNA, 25 bp, Rattus norvegicus
gaagcctttgctgtttgcctgctgc

SEQ ID NO: 301778 - DNA, 25 bp, Rattus norvegicus
gaagcctttggcatagaaccctact

SEQ ID NO: 301779 - DNA, 25 bp, Rattus norvegicus
gaagcctttggcttagaaccctact

SEQ ID NO: 301780 - DNA, 25 bp, Rattus norvegicus
gaagcctttggtattccactccata

SEQ ID NO: 301781 - DNA, 25 bp, Rattus norvegicus
gaagcctttggttttccactccata

SEQ ID NO: 301782 - DNA, 25 bp, Rattus norvegicus
gaagcctttgttatccaggcaagga

SEQ ID NO: 301783 - DNA, 25 bp, Rattus norvegicus
gaagcctttgttttccaggcaagga

SEQ ID NO: 301784 - DNA, 25 bp, Rattus norvegicus
gaagccttttatctttccatctatg

SEQ ID NO: 301785 - DNA, 25 bp, Rattus norvegicus
gaagccttttatgtttccatctatg

SEQ ID NO: 301786 - DNA, 25 bp, Rattus norvegicus
gaagccttttgcatatttccaaaag

SEQ ID NO: 301787 - DNA, 25 bp, Rattus norvegicus
gaagccttttgcttatttccaaaag

SEQ ID NO: 301788 - DNA, 25 bp, Rattus norvegicus
gaagcctttttactcctttctgatg

SEQ ID NO: 301789 - DNA, 25 bp, Rattus norvegicus
gaagcctttttagtcctttctgatg

SEQ ID NO: 301790 - DNA, 25 bp, Rattus norvegicus
gaagcgaaagcgaagggccattgaa

SEQ ID NO: 301791 - DNA, 25 bp, Rattus norvegicus
gaagcgaaagcgtagggccattgaa

SEQ ID NO: 301792 - DNA, 25 bp, Rattus norvegicus
gaagcgaacgacatccaggttctca

SEQ ID NO: 301793 - DNA, 25 bp, Rattus norvegicus
gaagcgaacgacttccaggttctca

SEQ ID NO: 301794 - DNA, 25 bp, Rattus norvegicus
gaagcgaactccactttaggcaaag

SEQ ID NO: 301795 - DNA, 25 bp, Rattus norvegicus
gaagcgaactcctctttaggcaaag

SEQ ID NO: 301796 - DNA, 25 bp, Rattus norvegicus
gaagcgaagcaacagagtctctcaa

SEQ ID NO: 301797 - DNA, 25 bp, Rattus norvegicus
gaagcgaagcaagagagtctctcaa

SEQ ID NO: 301798 - DNA, 25 bp, Rattus norvegicus
gaagcgaagtctcgccgagtgaaca

SEQ ID NO: 301799 - DNA, 25 bp, Rattus norvegicus
gaagcgaagtctggccgagtgaaca

SEQ ID NO: 301800 - DNA, 25 bp, Rattus norvegicus
gaagcgaatctgctgttgagcacac

SEQ ID NO: 301801 - DNA, 25 bp, Rattus norvegicus
gaagcgaatctggtgttgagcacac

SEQ ID NO: 301802 - DNA, 25 bp, Rattus norvegicus
gaagcgaattcaactccgtgctgaa

SEQ ID NO: 301803 - DNA, 25 bp, Rattus norvegicus
gaagcgaattcatctccgtgctgaa

SEQ ID NO: 301804 - DNA, 25 bp, Rattus norvegicus
gaagcgacaactccagcctaaggaa

SEQ ID NO: 301805 - DNA, 25 bp, Rattus norvegicus
gaagcgacaactgcagcctaaggaa

SEQ ID NO: 301806 - DNA, 25 bp, Rattus norvegicus
gaagcgacaatgatcggtgtacgac

SEQ ID NO: 301807 - DNA, 25 bp, Rattus norvegicus
gaagcgacaatgttcggtgtacgac

SEQ ID NO: 301808 - DNA, 25 bp, Rattus norvegicus
gaagcgacacagatatccacacgtt

SEQ ID NO: 301809 - DNA, 25 bp, Rattus norvegicus
gaagcgacacagttatccacacgtt

SEQ ID NO: 301810 - DNA, 25 bp, Rattus norvegicus
gaagcgacatcacctctggatacgg

SEQ ID NO: 301811 - DNA, 25 bp, Rattus norvegicus
gaagcgacatcagctctggatacgg

SEQ ID NO: 301812 - DNA, 25 bp, Rattus norvegicus
gaagcgagagaactacctttatcaa

SEQ ID NO: 301813 - DNA, 25 bp, Rattus norvegicus
gaagcgagagaagtacctttatcaa

SEQ ID NO: 301814 - DNA, 25 bp, Rattus norvegicus
gaagcgagcgtcagtcttagaactg

SEQ ID NO: 301815 - DNA, 25 bp, Rattus norvegicus
gaagcgagcgtctgtcttagaactg

SEQ ID NO: 301816 - DNA, 25 bp, Rattus norvegicus
gaagcgagttgactttgctccgcca

SEQ ID NO: 301817 - DNA, 25 bp, Rattus norvegicus
gaagcgagttgagtttgctccgcca

SEQ ID NO: 301818 - DNA, 25 bp, Rattus norvegicus
gaagcgatcagcaaagaggctcagc

SEQ ID NO: 301819 - DNA, 25 bp, Rattus norvegicus
gaagcgatcagctaagaggctcagc

SEQ ID NO: 301820 - DNA, 25 bp, Rattus norvegicus
gaagcgatcatgagctggttctcca

SEQ ID NO: 301821 - DNA, 25 bp, Rattus norvegicus
gaagcgatcatgtgctggttctcca

SEQ ID NO: 301822 - DNA, 25 bp, Rattus norvegicus
gaagcgatccataggcagagccagc

SEQ ID NO: 301823 - DNA, 25 bp, Rattus norvegicus
gaagcgatccattggcagagccagc

SEQ ID NO: 301824 - DNA, 25 bp, Rattus norvegicus
gaagcgatctttaccgccggaatcc

SEQ ID NO: 301825 - DNA, 25 bp, Rattus norvegicus
gaagcgatcttttccgccggaatcc

SEQ ID NO: 301826 - DNA, 25 bp, Rattus norvegicus
gaagcgattcatccagacctcggcc

SEQ ID NO: 301827 - DNA, 25 bp, Rattus norvegicus
gaagcgattcatgcagacctcggcc

SEQ ID NO: 301828 - DNA, 25 bp, Rattus norvegicus
gaagcgattgggatggtccgaacct

SEQ ID NO: 301829 - DNA, 25 bp, Rattus norvegicus
gaagcgattgggttggtccgaacct

SEQ ID NO: 301830 - DNA, 25 bp, Rattus norvegicus
gaagcgcaaactcatccagcagcag

SEQ ID NO: 301831 - DNA, 25 bp, Rattus norvegicus
gaagcgcaaactgatccagcagcag

SEQ ID NO: 301832 - DNA, 25 bp, Rattus norvegicus
gaagcgcaacatagaagctgtcaag

SEQ ID NO: 301833 - DNA, 25 bp, Rattus norvegicus
gaagcgcaacattgaagctgtcaag

SEQ ID NO: 301834 - DNA, 25 bp, Rattus norvegicus
gaagcgcaagcaacatggagacgtg

SEQ ID NO: 301835 - DNA, 25 bp, Rattus norvegicus
gaagcgcaagcatcatggagacgtg

SEQ ID NO: 301836 - DNA, 25 bp, Rattus norvegicus
gaagcgcaagccacgcttgatggag

SEQ ID NO: 301837 - DNA, 25 bp, Rattus norvegicus
gaagcgcaagcctcgcttgatggag

SEQ ID NO: 301838 - DNA, 25 bp, Rattus norvegicus
gaagcgcagcgcagaaaccacatgt

SEQ ID NO: 301839 - DNA, 25 bp, Rattus norvegicus
gaagcgcagcgctgaaaccacatgt

SEQ ID NO: 301840 - DNA, 25 bp, Rattus norvegicus
gaagcgcagggtccacatctctgat

SEQ ID NO: 301841 - DNA, 25 bp, Rattus norvegicus
gaagcgcagggtgcacatctctgat

SEQ ID NO: 301842 - DNA, 25 bp, Rattus norvegicus
gaagcgcatccgataccatggccga

SEQ ID NO: 301843 - DNA, 25 bp, Rattus norvegicus
gaagcgcatccgttaccatggccga

SEQ ID NO: 301844 - DNA, 25 bp, Rattus norvegicus
gaagcgccaggcagaggcacagaaa

SEQ ID NO: 301845 - DNA, 25 bp, Rattus norvegicus
gaagcgccaggctgaggcacagaaa

SEQ ID NO: 301846 - DNA, 25 bp, Rattus norvegicus
gaagcgccatctatgcgaggccggc

SEQ ID NO: 301847 - DNA, 25 bp, Rattus norvegicus
gaagcgccatctttgcgaggccggc

SEQ ID NO: 301848 - DNA, 25 bp, Rattus norvegicus
gaagcgccgagacgaatacaccctt

SEQ ID NO: 301849 - DNA, 25 bp, Rattus norvegicus
gaagcgccgagaggaatacaccctt

SEQ ID NO: 301850 - DNA, 25 bp, Rattus norvegicus
gaagcgcctgatcaacgactgggac

SEQ ID NO: 301851 - DNA, 25 bp, Rattus norvegicus
gaagcgcctgatgaacgactgggac

SEQ ID NO: 301852 - DNA, 25 bp, Rattus norvegicus
gaagcgcctgggaatcaacctgttg

SEQ ID NO: 301853 - DNA, 25 bp, Rattus norvegicus
gaagcgcctgggtatcaacctgttg

SEQ ID NO: 301854 - DNA, 25 bp, Rattus norvegicus
gaagcgccttcaaacgaggagtcca

SEQ ID NO: 301855 - DNA, 25 bp, Rattus norvegicus
gaagcgccttcatacgaggagtcca

SEQ ID NO: 301856 - DNA, 25 bp, Rattus norvegicus
gaagcgcgacagagagctagccata

SEQ ID NO: 301857 - DNA, 25 bp, Rattus norvegicus
gaagcgcgacagtgagctagccata

SEQ ID NO: 301858 - DNA, 25 bp, Rattus norvegicus
gaagcgcgagcgagacgagtacaaa

SEQ ID NO: 301859 - DNA, 25 bp, Rattus norvegicus
gaagcgcgagcgtgacgagtacaaa

SEQ ID NO: 301860 - DNA, 25 bp, Rattus norvegicus
gaagcgcgcattagcacccaagaga

SEQ ID NO: 301861 - DNA, 25 bp, Rattus norvegicus
gaagcgcgcatttgcacccaagaga

SEQ ID NO: 301862 - DNA, 25 bp, Rattus norvegicus
gaagcgctaaacagtgctagtcatc

SEQ ID NO: 301863 - DNA, 25 bp, Rattus norvegicus
gaagcgctaaactgtgctagtcatc

SEQ ID NO: 301864 - DNA, 25 bp, Rattus norvegicus
gaagcgctactacagcatctgccaa

SEQ ID NO: 301865 - DNA, 25 bp, Rattus norvegicus
gaagcgctactagagcatctgccaa

SEQ ID NO: 301866 - DNA, 25 bp, Rattus norvegicus
gaagcgctctcgaggcaaccggaag

SEQ ID NO: 301867 - DNA, 25 bp, Rattus norvegicus
gaagcgctctcgtggcaaccggaag

SEQ ID NO: 301868 - DNA, 25 bp, Rattus norvegicus
gaagcgctctgtctggtttaactta

SEQ ID NO: 301869 - DNA, 25 bp, Rattus norvegicus
gaagcgctctgtgtggtttaactta

SEQ ID NO: 301870 - DNA, 25 bp, Rattus norvegicus
gaagcgctgaagactttctcaaagt

SEQ ID NO: 301871 - DNA, 25 bp, Rattus norvegicus
gaagcgctgaagtctttctcaaagt

SEQ ID NO: 301872 - DNA, 25 bp, Rattus norvegicus
gaagcgctgatgaacccggattgga

SEQ ID NO: 301873 - DNA, 25 bp, Rattus norvegicus
gaagcgctgatgtacccggattgga

SEQ ID NO: 301874 - DNA, 25 bp, Rattus norvegicus
gaagcgctgctcagggcagaagcat

SEQ ID NO: 301875 - DNA, 25 bp, Rattus norvegicus
gaagcgctgctctgggcagaagcat

SEQ ID NO: 301876 - DNA, 25 bp, Rattus norvegicus
gaagcgctgctgaactgtagtcaca

SEQ ID NO: 301877 - DNA, 25 bp, Rattus norvegicus
gaagcgctgctgtactgtagtcaca

SEQ ID NO: 301878 - DNA, 25 bp, Rattus norvegicus
gaagcgctgtgaagggtctctgtaa

SEQ ID NO: 301879 - DNA, 25 bp, Rattus norvegicus
gaagcgctgtgatgggtctctgtaa

SEQ ID NO: 301880 - DNA, 25 bp, Rattus norvegicus
gaagcgctgtttcctgtgcttaaga

SEQ ID NO: 301881 - DNA, 25 bp, Rattus norvegicus
gaagcgctgtttgctgtgcttaaga

SEQ ID NO: 301882 - DNA, 25 bp, Rattus norvegicus
gaagcgcttaccatgcatgtgcagg

SEQ ID NO: 301883 - DNA, 25 bp, Rattus norvegicus
gaagcgcttaccttgcatgtgcagg

SEQ ID NO: 301884 - DNA, 25 bp, Rattus norvegicus
gaagcgcttcagcaacacttggccg

SEQ ID NO: 301885 - DNA, 25 bp, Rattus norvegicus
gaagcgcttcaggaacacttggccg

SEQ ID NO: 301886 - DNA, 25 bp, Rattus norvegicus
gaagcgcttcgtcagtggtgttaca

SEQ ID NO: 301887 - DNA, 25 bp, Rattus norvegicus
gaagcgcttcgtgagtggtgttaca

SEQ ID NO: 301888 - DNA, 25 bp, Rattus norvegicus
gaagcgcttgctatcttgtggcatc

SEQ ID NO: 301889 - DNA, 25 bp, Rattus norvegicus
gaagcgcttgctttcttgtggcatc

SEQ ID NO: 301890 - DNA, 25 bp, Rattus norvegicus
gaagcgctttacacgttcggatgag

SEQ ID NO: 301891 - DNA, 25 bp, Rattus norvegicus
gaagcgctttactcgttcggatgag

SEQ ID NO: 301892 - DNA, 25 bp, Rattus norvegicus
gaagcgctttgtatcagggacaccg

SEQ ID NO: 301893 - DNA, 25 bp, Rattus norvegicus
gaagcgctttgtttcagggacaccg

SEQ ID NO: 301894 - DNA, 25 bp, Rattus norvegicus
gaagcggaaggaacataggtttaag

SEQ ID NO: 301895 - DNA, 25 bp, Rattus norvegicus
gaagcggaaggatcataggtttaag

SEQ ID NO: 301896 - DNA, 25 bp, Rattus norvegicus
gaagcggacaagagagactccagca

SEQ ID NO: 301897 - DNA, 25 bp, Rattus norvegicus
gaagcggacaagtgagactccagca

SEQ ID NO: 301898 - DNA, 25 bp, Rattus norvegicus
gaagcggagcgaccctcatcaccag

SEQ ID NO: 301899 - DNA, 25 bp, Rattus norvegicus
gaagcggagcgagcctcatcaccag

SEQ ID NO: 301900 - DNA, 25 bp, Rattus norvegicus
gaagcggataaaatcccctacgagg

SEQ ID NO: 301901 - DNA, 25 bp, Rattus norvegicus
gaagcggataaattcccctacgagg

SEQ ID NO: 301902 - DNA, 25 bp, Rattus norvegicus
gaagcggatcccaagaggcagaaga

SEQ ID NO: 301903 - DNA, 25 bp, Rattus norvegicus
gaagcggatccctagaggcagaaga

SEQ ID NO: 301904 - DNA, 25 bp, Rattus norvegicus
gaagcggatgcgacttcagcaagcc

SEQ ID NO: 301905 - DNA, 25 bp, Rattus norvegicus
gaagcggatgcgtcttcagcaagcc

SEQ ID NO: 301906 - DNA, 25 bp, Rattus norvegicus
gaagcggcacccagtgtctgtaaga

SEQ ID NO: 301907 - DNA, 25 bp, Rattus norvegicus
gaagcggcaccctgtgtctgtaaga

SEQ ID NO: 301908 - DNA, 25 bp, Rattus norvegicus
gaagcggcagaaccacagctcctga

SEQ ID NO: 301909 - DNA, 25 bp, Rattus norvegicus
gaagcggcagaagcacagctcctga

SEQ ID NO: 301910 - DNA, 25 bp, Rattus norvegicus
gaagcggcataactggtcagtcctg

SEQ ID NO: 301911 - DNA, 25 bp, Rattus norvegicus
gaagcggcataagtggtcagtcctg

SEQ ID NO: 301912 - DNA, 25 bp, Rattus norvegicus
gaagcggccattctgataagccaca

SEQ ID NO: 301913 - DNA, 25 bp, Rattus norvegicus
gaagcggccattgtgataagccaca

SEQ ID NO: 301914 - DNA, 25 bp, Rattus norvegicus
gaagcggcgaataccccgttttgag

SEQ ID NO: 301915 - DNA, 25 bp, Rattus norvegicus
gaagcggcgaattccccgttttgag

SEQ ID NO: 301916 - DNA, 25 bp, Rattus norvegicus
gaagcggctgacatgctgaaggcat

SEQ ID NO: 301917 - DNA, 25 bp, Rattus norvegicus
gaagcggctgacttgctgaaggcat

SEQ ID NO: 301918 - DNA, 25 bp, Rattus norvegicus
gaagcggctgctcaaataaccagaa

SEQ ID NO: 301919 - DNA, 25 bp, Rattus norvegicus
gaagcggctgctgaaataaccagaa

SEQ ID NO: 301920 - DNA, 25 bp, Rattus norvegicus
gaagcgggcagaattctatgagttc

SEQ ID NO: 301921 - DNA, 25 bp, Rattus norvegicus
gaagcgggcagatttctatgagttc

SEQ ID NO: 301922 - DNA, 25 bp, Rattus norvegicus
gaagcgggcatccagcgaaagtacc

SEQ ID NO: 301923 - DNA, 25 bp, Rattus norvegicus
gaagcgggcatcgagcgaaagtacc

SEQ ID NO: 301924 - DNA, 25 bp, Rattus norvegicus
gaagcgggcattcgcttaaccctgt

SEQ ID NO: 301925 - DNA, 25 bp, Rattus norvegicus
gaagcgggcattggcttaaccctgt

SEQ ID NO: 301926 - DNA, 25 bp, Rattus norvegicus
gaagcgggccacagttctagagtct

SEQ ID NO: 301927 - DNA, 25 bp, Rattus norvegicus
gaagcgggccactgttctagagtct

SEQ ID NO: 301928 - DNA, 25 bp, Rattus norvegicus
gaagcgggccttccaggacaagtac

SEQ ID NO: 301929 - DNA, 25 bp, Rattus norvegicus
gaagcgggccttgcaggacaagtac

SEQ ID NO: 301930 - DNA, 25 bp, Rattus norvegicus
gaagcggtactgaatctctccaagg

SEQ ID NO: 301931 - DNA, 25 bp, Rattus norvegicus
gaagcggtactgtatctctccaagg

SEQ ID NO: 301932 - DNA, 25 bp, Rattus norvegicus
gaagcggtacttagttcccgaaatg

SEQ ID NO: 301933 - DNA, 25 bp, Rattus norvegicus
gaagcggtactttgttcccgaaatg

SEQ ID NO: 301934 - DNA, 25 bp, Rattus norvegicus
gaagcggttctcagaatccaggata

SEQ ID NO: 301935 - DNA, 25 bp, Rattus norvegicus
gaagcggttctctgaatccaggata

SEQ ID NO: 301936 - DNA, 25 bp, Rattus norvegicus
gaagcggttgtgacatccgagttca

SEQ ID NO: 301937 - DNA, 25 bp, Rattus norvegicus
gaagcggttgtgtcatccgagttca

SEQ ID NO: 301938 - DNA, 25 bp, Rattus norvegicus
gaagcgtactttcacgttccggttg

SEQ ID NO: 301939 - DNA, 25 bp, Rattus norvegicus
gaagcgtactttgacgttccggttg

SEQ ID NO: 301940 - DNA, 25 bp, Rattus norvegicus
gaagcgtatggcactgatctggaag

SEQ ID NO: 301941 - DNA, 25 bp, Rattus norvegicus
gaagcgtatggctctgatctggaag

SEQ ID NO: 301942 - DNA, 25 bp, Rattus norvegicus
gaagcgtatttcctttcggagtgct

SEQ ID NO: 301943 - DNA, 25 bp, Rattus norvegicus
gaagcgtatttcgtttcggagtgct

SEQ ID NO: 301944 - DNA, 25 bp, Rattus norvegicus
gaagcgtccaacattaggtctaact

SEQ ID NO: 301945 - DNA, 25 bp, Rattus norvegicus
gaagcgtccaactttaggtctaact

SEQ ID NO: 301946 - DNA, 25 bp, Rattus norvegicus
gaagcgtccaggctcagtgtgaaca

SEQ ID NO: 301947 - DNA, 25 bp, Rattus norvegicus
gaagcgtccagggtcagtgtgaaca

SEQ ID NO: 301948 - DNA, 25 bp, Rattus norvegicus
gaagcgtccgcaccgtgaaacgcat

SEQ ID NO: 301949 - DNA, 25 bp, Rattus norvegicus
gaagcgtccgcagcgtgaaacgcat

SEQ ID NO: 301950 - DNA, 25 bp, Rattus norvegicus
gaagcgtcgtttactgttgtcaaat

SEQ ID NO: 301951 - DNA, 25 bp, Rattus norvegicus
gaagcgtcgttttctgttgtcaaat

SEQ ID NO: 301952 - DNA, 25 bp, Rattus norvegicus
gaagcgtgctctcgagtgacagaac

SEQ ID NO: 301953 - DNA, 25 bp, Rattus norvegicus
gaagcgtgctctggagtgacagaac

SEQ ID NO: 301954 - DNA, 25 bp, Rattus norvegicus
gaagcgtggcacaacatcatgctgt

SEQ ID NO: 301955 - DNA, 25 bp, Rattus norvegicus
gaagcgtggcactacatcatgctgt

SEQ ID NO: 301956 - DNA, 25 bp, Rattus norvegicus
gaagcgtgtggcatttctgaagtct

SEQ ID NO: 301957 - DNA, 25 bp, Rattus norvegicus
gaagcgtgtggcttttctgaagtct

SEQ ID NO: 301958 - DNA, 25 bp, Rattus norvegicus
gaagcgtgtttccagatgtttcttt

SEQ ID NO: 301959 - DNA, 25 bp, Rattus norvegicus
gaagcgtgtttcgagatgtttcttt

SEQ ID NO: 301960 - DNA, 25 bp, Rattus norvegicus
gaagcgtgtttgatttctccattat

SEQ ID NO: 301961 - DNA, 25 bp, Rattus norvegicus
gaagcgtgtttgttttctccattat

SEQ ID NO: 301962 - DNA, 25 bp, Rattus norvegicus
gaagcgttactgctgccgccgcatg

SEQ ID NO: 301963 - DNA, 25 bp, Rattus norvegicus
gaagcgttactggtgccgccgcatg

SEQ ID NO: 301964 - DNA, 25 bp, Rattus norvegicus
gaagcgttcattatcttaactgtta

SEQ ID NO: 301965 - DNA, 25 bp, Rattus norvegicus
gaagcgttcattttcttaactgtta

SEQ ID NO: 301966 - DNA, 25 bp, Rattus norvegicus
gaagcgttctaacccatacgtgaag

SEQ ID NO: 301967 - DNA, 25 bp, Rattus norvegicus
gaagcgttctaagccatacgtgaag

SEQ ID NO: 301968 - DNA, 25 bp, Rattus norvegicus
gaagcgttgacaccctgttttacct

SEQ ID NO: 301969 - DNA, 25 bp, Rattus norvegicus
gaagcgttgacagcctgttttacct

SEQ ID NO: 301970 - DNA, 25 bp, Rattus norvegicus
gaagcgttgcagataccaaggatga

SEQ ID NO: 301971 - DNA, 25 bp, Rattus norvegicus
gaagcgttgcagttaccaaggatga

SEQ ID NO: 301972 - DNA, 25 bp, Rattus norvegicus
gaagcgttggctccggattcccgcc

SEQ ID NO: 301973 - DNA, 25 bp, Rattus norvegicus
gaagcgttggctgcggattcccgcc

SEQ ID NO: 301974 - DNA, 25 bp, Rattus norvegicus
gaagcgttggtgattaactctgtgg

SEQ ID NO: 301975 - DNA, 25 bp, Rattus norvegicus
gaagcgttggtgtttaactctgtgg

SEQ ID NO: 301976 - DNA, 25 bp, Rattus norvegicus
gaagcgtttataaaggtagatgcca

SEQ ID NO: 301977 - DNA, 25 bp, Rattus norvegicus
gaagcgtttatataggtagatgcca

SEQ ID NO: 301978 - DNA, 25 bp, Rattus norvegicus
gaagcgtttctgcagccatttaatc

SEQ ID NO: 301979 - DNA, 25 bp, Rattus norvegicus
gaagcgtttctggagccatttaatc

SEQ ID NO: 301980 - DNA, 25 bp, Rattus norvegicus
gaagcgtttgttactacattaaatg

SEQ ID NO: 301981 - DNA, 25 bp, Rattus norvegicus
gaagcgtttgtttctacattaaatg

SEQ ID NO: 301982 - DNA, 25 bp, Rattus norvegicus
gaagcgttttctctattgacctgaa

SEQ ID NO: 301983 - DNA, 25 bp, Rattus norvegicus
gaagcgttttctgtattgacctgaa

SEQ ID NO: 301984 - DNA, 25 bp, Rattus norvegicus
gaagctaaaagcatacttggatctt

SEQ ID NO: 301985 - DNA, 25 bp, Rattus norvegicus
gaagctaaaagcttacttggatctt

SEQ ID NO: 301986 - DNA, 25 bp, Rattus norvegicus
gaagctaaaatcctaagacttgaga

SEQ ID NO: 301987 - DNA, 25 bp, Rattus norvegicus
gaagctaaaatcgtaagacttgaga

SEQ ID NO: 301988 - DNA, 25 bp, Rattus norvegicus
gaagctaaaatgaatgccccatccc

SEQ ID NO: 301989 - DNA, 25 bp, Rattus norvegicus
gaagctaaaatgtatgccccatccc

SEQ ID NO: 301990 - DNA, 25 bp, Rattus norvegicus
gaagctaaaggaagccctctcatga

SEQ ID NO: 301991 - DNA, 25 bp, Rattus norvegicus
gaagctaaaggatgccctctcatga

SEQ ID NO: 301992 - DNA, 25 bp, Rattus norvegicus
gaagctaaatcactcttcccacagc

SEQ ID NO: 301993 - DNA, 25 bp, Rattus norvegicus
gaagctaaatcagtcttcccacagc

SEQ ID NO: 301994 - DNA, 25 bp, Rattus norvegicus
gaagctaaatccatgttgaatactg

SEQ ID NO: 301995 - DNA, 25 bp, Rattus norvegicus
gaagctaaatccttgttgaatactg

SEQ ID NO: 301996 - DNA, 25 bp, Rattus norvegicus
gaagctaacgctccatggtctttgt

SEQ ID NO: 301997 - DNA, 25 bp, Rattus norvegicus
gaagctaacgctgcatggtctttgt

SEQ ID NO: 301998 - DNA, 25 bp, Rattus norvegicus
gaagctaacggtcacaggtgacctc

SEQ ID NO: 301999 - DNA, 25 bp, Rattus norvegicus
gaagctaacggtgacaggtgacctc

SEQ ID NO: 302000 - DNA, 25 bp, Rattus norvegicus
gaagctaactgccacaagtcttact

SEQ ID NO: 302001 - DNA, 25 bp, Rattus norvegicus
gaagctaactgcgacaagtcttact

SEQ ID NO: 302002 - DNA, 25 bp, Rattus norvegicus
gaagctaagaggactgccctcccat

SEQ ID NO: 302003 - DNA, 25 bp, Rattus norvegicus
gaagctaagaggtctgccctcccat

SEQ ID NO: 302004 - DNA, 25 bp, Rattus norvegicus
gaagctaagcaaacggctcctgagc

SEQ ID NO: 302005 - DNA, 25 bp, Rattus norvegicus
gaagctaagcaatcggctcctgagc

SEQ ID NO: 302006 - DNA, 25 bp, Rattus norvegicus
gaagctaagcatacctgaagtggta

SEQ ID NO: 302007 - DNA, 25 bp, Rattus norvegicus
gaagctaagcattcctgaagtggta

SEQ ID NO: 302008 - DNA, 25 bp, Rattus norvegicus
gaagctaatattcctgtccacatcc

SEQ ID NO: 302009 - DNA, 25 bp, Rattus norvegicus
gaagctaatattgctgtccacatcc

SEQ ID NO: 302010 - DNA, 25 bp, Rattus norvegicus
gaagctacaaaacacatacctcaaa

SEQ ID NO: 302011 - DNA, 25 bp, Rattus norvegicus
gaagctacaaaagacatacctcaaa

SEQ ID NO: 302012 - DNA, 25 bp, Rattus norvegicus
gaagctacaatcacctccagggaga

SEQ ID NO: 302013 - DNA, 25 bp, Rattus norvegicus
gaagctacaatctcctccagggaga

SEQ ID NO: 302014 - DNA, 25 bp, Rattus norvegicus
gaagctacagacattcttgtcagca

SEQ ID NO: 302015 - DNA, 25 bp, Rattus norvegicus
gaagctacagactttcttgtcagca

SEQ ID NO: 302016 - DNA, 25 bp, Rattus norvegicus
gaagctacagccacctaaaatgtct

SEQ ID NO: 302017 - DNA, 25 bp, Rattus norvegicus
gaagctacagcctcctaaaatgtct

SEQ ID NO: 302018 - DNA, 25 bp, Rattus norvegicus
gaagctaccctcattcgcgagtggg

SEQ ID NO: 302019 - DNA, 25 bp, Rattus norvegicus
gaagctaccctctttcgcgagtggg

SEQ ID NO: 302020 - DNA, 25 bp, Rattus norvegicus
gaagctaccgttcttttggaatgat

SEQ ID NO: 302021 - DNA, 25 bp, Rattus norvegicus
gaagctaccgttgttttggaatgat

SEQ ID NO: 302022 - DNA, 25 bp, Rattus norvegicus
gaagctacgaccatggagaacgcaa

SEQ ID NO: 302023 - DNA, 25 bp, Rattus norvegicus
gaagctacgaccttggagaacgcaa

SEQ ID NO: 302024 - DNA, 25 bp, Rattus norvegicus
gaagctacgcaaaacgcacactact

SEQ ID NO: 302025 - DNA, 25 bp, Rattus norvegicus
gaagctacgcaatacgcacactact

SEQ ID NO: 302026 - DNA, 25 bp, Rattus norvegicus
gaagctacgtagagtaaccttattt

SEQ ID NO: 302027 - DNA, 25 bp, Rattus norvegicus
gaagctacgtagtgtaaccttattt

SEQ ID NO: 302028 - DNA, 25 bp, Rattus norvegicus
gaagctacgttgactatttctcctc

SEQ ID NO: 302029 - DNA, 25 bp, Rattus norvegicus
gaagctacgttgtctatttctcctc

SEQ ID NO: 302030 - DNA, 25 bp, Rattus norvegicus
gaagctactcagctgttcctgaagc

SEQ ID NO: 302031 - DNA, 25 bp, Rattus norvegicus
gaagctactcaggtgttcctgaagc

SEQ ID NO: 302032 - DNA, 25 bp, Rattus norvegicus
gaagctactgacaacctctacaagg

SEQ ID NO: 302033 - DNA, 25 bp, Rattus norvegicus
gaagctactgactacctctacaagg

SEQ ID NO: 302034 - DNA, 25 bp, Rattus norvegicus
gaagctacttgtagattcgctccct

SEQ ID NO: 302035 - DNA, 25 bp, Rattus norvegicus
gaagctacttgttgattcgctccct

SEQ ID NO: 302036 - DNA, 25 bp, Rattus norvegicus
gaagctagaattatttctgcgttca

SEQ ID NO: 302037 - DNA, 25 bp, Rattus norvegicus
gaagctagaattttttctgcgttca

SEQ ID NO: 302038 - DNA, 25 bp, Rattus norvegicus
gaagctagacccaggccagaatgtg

SEQ ID NO: 302039 - DNA, 25 bp, Rattus norvegicus
gaagctagaccctggccagaatgtg

SEQ ID NO: 302040 - DNA, 25 bp, Rattus norvegicus
gaagctagactgaaccttctacctg

SEQ ID NO: 302041 - DNA, 25 bp, Rattus norvegicus
gaagctagactgtaccttctacctg

SEQ ID NO: 302042 - DNA, 25 bp, Rattus norvegicus
gaagctagcaaaccctgtgtgacct

SEQ ID NO: 302043 - DNA, 25 bp, Rattus norvegicus
gaagctagcaaagcctgtgtgacct

SEQ ID NO: 302044 - DNA, 25 bp, Rattus norvegicus
gaagctagcaatactggttggctat

SEQ ID NO: 302045 - DNA, 25 bp, Rattus norvegicus
gaagctagcaattctggttggctat

SEQ ID NO: 302046 - DNA, 25 bp, Rattus norvegicus
gaagctagcatacactccagatcct

SEQ ID NO: 302047 - DNA, 25 bp, Rattus norvegicus
gaagctagcatagactccagatcct

SEQ ID NO: 302048 - DNA, 25 bp, Rattus norvegicus
gaagctagcccacgtaacttgattg

SEQ ID NO: 302049 - DNA, 25 bp, Rattus norvegicus
gaagctagcccaggtaacttgattg

SEQ ID NO: 302050 - DNA, 25 bp, Rattus norvegicus
gaagctagccttcctttttacacag

SEQ ID NO: 302051 - DNA, 25 bp, Rattus norvegicus
gaagctagccttgctttttacacag

SEQ ID NO: 302052 - DNA, 25 bp, Rattus norvegicus
gaagctagctaaccggatgctgtat

SEQ ID NO: 302053 - DNA, 25 bp, Rattus norvegicus
gaagctagctaagcggatgctgtat

SEQ ID NO: 302054 - DNA, 25 bp, Rattus norvegicus
gaagctagctgaacatgaccaaaag

SEQ ID NO: 302055 - DNA, 25 bp, Rattus norvegicus
gaagctagctgatcatgaccaaaag

SEQ ID NO: 302056 - DNA, 25 bp, Rattus norvegicus
gaagctagctggacaggacagcaca

SEQ ID NO: 302057 - DNA, 25 bp, Rattus norvegicus
gaagctagctggtcaggacagcaca

SEQ ID NO: 302058 - DNA, 25 bp, Rattus norvegicus
gaagctaggagacccattgccactg

SEQ ID NO: 302059 - DNA, 25 bp, Rattus norvegicus
gaagctaggagagccattgccactg

SEQ ID NO: 302060 - DNA, 25 bp, Rattus norvegicus
gaagctaggccaatgatccatgaac

SEQ ID NO: 302061 - DNA, 25 bp, Rattus norvegicus
gaagctaggccattgatccatgaac

SEQ ID NO: 302062 - DNA, 25 bp, Rattus norvegicus
gaagctaggtaacgtagacgccagt

SEQ ID NO: 302063 - DNA, 25 bp, Rattus norvegicus
gaagctaggtaaggtagacgccagt

SEQ ID NO: 302064 - DNA, 25 bp, Rattus norvegicus
gaagctagtcttcttctgtgctaca

SEQ ID NO: 302065 - DNA, 25 bp, Rattus norvegicus
gaagctagtcttgttctgtgctaca

SEQ ID NO: 302066 - DNA, 25 bp, Rattus norvegicus
gaagctagtgagactgatgagagaa

SEQ ID NO: 302067 - DNA, 25 bp, Rattus norvegicus
gaagctagtgagtctgatgagagaa

SEQ ID NO: 302068 - DNA, 25 bp, Rattus norvegicus
gaagctagtgcccaatgtgtcctaa

SEQ ID NO: 302069 - DNA, 25 bp, Rattus norvegicus
gaagctagtgccgaatgtgtcctaa

SEQ ID NO: 302070 - DNA, 25 bp, Rattus norvegicus
gaagctagtttccttatctttcctg

SEQ ID NO: 302071 - DNA, 25 bp, Rattus norvegicus
gaagctagtttcgttatctttcctg

SEQ ID NO: 302072 - DNA, 25 bp, Rattus norvegicus
gaagctataagcaatgtatgtatcc

SEQ ID NO: 302073 - DNA, 25 bp, Rattus norvegicus
gaagctataagctatgtatgtatcc

SEQ ID NO: 302074 - DNA, 25 bp, Rattus norvegicus
gaagctatatgcaatcgttgttaac

SEQ ID NO: 302075 - DNA, 25 bp, Rattus norvegicus
gaagctatatgctatcgttgttaac

SEQ ID NO: 302076 - DNA, 25 bp, Rattus norvegicus
gaagctatcatcaatctggaccaag

SEQ ID NO: 302077 - DNA, 25 bp, Rattus norvegicus
gaagctatcatctatctggaccaag

SEQ ID NO: 302078 - DNA, 25 bp, Rattus norvegicus
gaagctatccttagatttttgtcag

SEQ ID NO: 302079 - DNA, 25 bp, Rattus norvegicus
gaagctatcctttgatttttgtcag

SEQ ID NO: 302080 - DNA, 25 bp, Rattus norvegicus
gaagctatctacaaaggctgttagt

SEQ ID NO: 302081 - DNA, 25 bp, Rattus norvegicus
gaagctatctacaagtatgttctac

SEQ ID NO: 302082 - DNA, 25 bp, Rattus norvegicus
gaagctatctactaaggctgttagt

SEQ ID NO: 302083 - DNA, 25 bp, Rattus norvegicus
gaagctatctactagtatgttctac

SEQ ID NO: 302084 - DNA, 25 bp, Rattus norvegicus
gaagctatctgtcctggagggacac

SEQ ID NO: 302085 - DNA, 25 bp, Rattus norvegicus
gaagctatctgtgctggagggacac

SEQ ID NO: 302086 - DNA, 25 bp, Rattus norvegicus
gaagctatgataccgaggctgccac

SEQ ID NO: 302087 - DNA, 25 bp, Rattus norvegicus
gaagctatgatagcgaggctgccac

SEQ ID NO: 302088 - DNA, 25 bp, Rattus norvegicus
gaagctatgctgaaaggacactgta

SEQ ID NO: 302089 - DNA, 25 bp, Rattus norvegicus
gaagctatgctgtaaggacactgta

SEQ ID NO: 302090 - DNA, 25 bp, Rattus norvegicus
gaagctatggacaatgatcctcctc

SEQ ID NO: 302091 - DNA, 25 bp, Rattus norvegicus
gaagctatggactatgatcctcctc

SEQ ID NO: 302092 - DNA, 25 bp, Rattus norvegicus
gaagctatgggcagggcctttgcac

SEQ ID NO: 302093 - DNA, 25 bp, Rattus norvegicus
gaagctatgggctgggcctttgcac

SEQ ID NO: 302094 - DNA, 25 bp, Rattus norvegicus
gaagctatggtactctctcctagcc

SEQ ID NO: 302095 - DNA, 25 bp, Rattus norvegicus
gaagctatggtagtctctcctagcc

SEQ ID NO: 302096 - DNA, 25 bp, Rattus norvegicus
gaagctatgtgacccttccttctgc

SEQ ID NO: 302097 - DNA, 25 bp, Rattus norvegicus
gaagctatgtgagccttccttctgc

SEQ ID NO: 302098 - DNA, 25 bp, Rattus norvegicus
gaagctattacaaataccactggaa

SEQ ID NO: 302099 - DNA, 25 bp, Rattus norvegicus
gaagctattacatataccactggaa

SEQ ID NO: 302100 - DNA, 25 bp, Rattus norvegicus
gaagctattagacctgcttggcaaa

SEQ ID NO: 302101 - DNA, 25 bp, Rattus norvegicus
gaagctattagagctgcttggcaaa

SEQ ID NO: 302102 - DNA, 25 bp, Rattus norvegicus
gaagctattgaccatttccatccct

SEQ ID NO: 302103 - DNA, 25 bp, Rattus norvegicus
gaagctattgacgatttccatccct

SEQ ID NO: 302104 - DNA, 25 bp, Rattus norvegicus
gaagctattgcacctggcatcttta

SEQ ID NO: 302105 - DNA, 25 bp, Rattus norvegicus
gaagctattgcagctggcatcttta

SEQ ID NO: 302106 - DNA, 25 bp, Rattus norvegicus
gaagctattgctcaagcgccttgcc

SEQ ID NO: 302107 - DNA, 25 bp, Rattus norvegicus
gaagctattgctgaagcgccttgcc

SEQ ID NO: 302108 - DNA, 25 bp, Rattus norvegicus
gaagctatttaacttgaactggtca

SEQ ID NO: 302109 - DNA, 25 bp, Rattus norvegicus
gaagctatttaagttgaactggtca

SEQ ID NO: 302110 - DNA, 25 bp, Rattus norvegicus
gaagctatttacaatctatttctaa

SEQ ID NO: 302111 - DNA, 25 bp, Rattus norvegicus
gaagctatttactatctatttctaa

SEQ ID NO: 302112 - DNA, 25 bp, Rattus norvegicus
gaagctatttctatgtcctgtataa

SEQ ID NO: 302113 - DNA, 25 bp, Rattus norvegicus
gaagctatttctttgtcctgtataa

SEQ ID NO: 302114 - DNA, 25 bp, Rattus norvegicus
gaagctatttgcacattttgggcat

SEQ ID NO: 302115 - DNA, 25 bp, Rattus norvegicus
gaagctatttgctcattttgggcat

SEQ ID NO: 302116 - DNA, 25 bp, Rattus norvegicus
gaagctcaaagcctagacaatacca

SEQ ID NO: 302117 - DNA, 25 bp, Rattus norvegicus
gaagctcaaagcgtagacaatacca

SEQ ID NO: 302118 - DNA, 25 bp, Rattus norvegicus
gaagctcaacaactacgagcccttc

SEQ ID NO: 302119 - DNA, 25 bp, Rattus norvegicus
gaagctcaacaagtacgagcccttc

SEQ ID NO: 302120 - DNA, 25 bp, Rattus norvegicus
gaagctcaacccaaatctttattaa

SEQ ID NO: 302121 - DNA, 25 bp, Rattus norvegicus
gaagctcaaccctaatctttattaa

SEQ ID NO: 302122 - DNA, 25 bp, Rattus norvegicus
gaagctcaacctactcatgggattt

SEQ ID NO: 302123 - DNA, 25 bp, Rattus norvegicus
gaagctcaaccttctcatgggattt

SEQ ID NO: 302124 - DNA, 25 bp, Rattus norvegicus
gaagctcaacgcacctaggaagcat

SEQ ID NO: 302125 - DNA, 25 bp, Rattus norvegicus
gaagctcaacgctcctaggaagcat

SEQ ID NO: 302126 - DNA, 25 bp, Rattus norvegicus
gaagctcaaggtcatgcttcccctc

SEQ ID NO: 302127 - DNA, 25 bp, Rattus norvegicus
gaagctcaaggtgatgcttcccctc

SEQ ID NO: 302128 - DNA, 25 bp, Rattus norvegicus
gaagctcaatcccaaccttaggtat

SEQ ID NO: 302129 - DNA, 25 bp, Rattus norvegicus
gaagctcaatccgaaccttaggtat

SEQ ID NO: 302130 - DNA, 25 bp, Rattus norvegicus
gaagctcacaaactcttcttcgcag

SEQ ID NO: 302131 - DNA, 25 bp, Rattus norvegicus
gaagctcacaaagtcttcttcgcag

SEQ ID NO: 302132 - DNA, 25 bp, Rattus norvegicus
gaagctcacaatatcctgtaactgc

SEQ ID NO: 302133 - DNA, 25 bp, Rattus norvegicus
gaagctcacaatttcctgtaactgc

SEQ ID NO: 302134 - DNA, 25 bp, Rattus norvegicus
gaagctcacagtccagtggttacaa

SEQ ID NO: 302135 - DNA, 25 bp, Rattus norvegicus
gaagctcacagtgcagtggttacaa

SEQ ID NO: 302136 - DNA, 25 bp, Rattus norvegicus
gaagctcacatcaaaactccagacc

SEQ ID NO: 302137 - DNA, 25 bp, Rattus norvegicus
gaagctcacatctaaactccagacc

SEQ ID NO: 302138 - DNA, 25 bp, Rattus norvegicus
gaagctcacattccatccataatca

SEQ ID NO: 302139 - DNA, 25 bp, Rattus norvegicus
gaagctcacattgcatccataatca

SEQ ID NO: 302140 - DNA, 25 bp, Rattus norvegicus
gaagctcaccaaaaatgcaagcgct

SEQ ID NO: 302141 - DNA, 25 bp, Rattus norvegicus
gaagctcaccaacaaggagacactc

SEQ ID NO: 302142 - DNA, 25 bp, Rattus norvegicus
gaagctcaccaagaaggagacactc

SEQ ID NO: 302143 - DNA, 25 bp, Rattus norvegicus
gaagctcaccaataatgcaagcgct

SEQ ID NO: 302144 - DNA, 25 bp, Rattus norvegicus
gaagctcaccagatccaggattcct

SEQ ID NO: 302145 - DNA, 25 bp, Rattus norvegicus
gaagctcaccagttccaggattcct

SEQ ID NO: 302146 - DNA, 25 bp, Rattus norvegicus
gaagctcaccatctactgaggattt

SEQ ID NO: 302147 - DNA, 25 bp, Rattus norvegicus
gaagctcaccatgtactgaggattt

SEQ ID NO: 302148 - DNA, 25 bp, Rattus norvegicus
gaagctcacccaactgacaagtata

SEQ ID NO: 302149 - DNA, 25 bp, Rattus norvegicus
gaagctcacccactgtgacttttaa

SEQ ID NO: 302150 - DNA, 25 bp, Rattus norvegicus
gaagctcacccagtgtgacttttaa

SEQ ID NO: 302151 - DNA, 25 bp, Rattus norvegicus
gaagctcacccatctgacaagtata

SEQ ID NO: 302152 - DNA, 25 bp, Rattus norvegicus
gaagctcaccttcgagtgcagcgat

SEQ ID NO: 302153 - DNA, 25 bp, Rattus norvegicus
gaagctcaccttcgcatgacctgga

SEQ ID NO: 302154 - DNA, 25 bp, Rattus norvegicus
gaagctcaccttggagtgcagcgat

SEQ ID NO: 302155 - DNA, 25 bp, Rattus norvegicus
gaagctcaccttggcatgacctgga

SEQ ID NO: 302156 - DNA, 25 bp, Rattus norvegicus
gaagctcacggtctcaggctttcta

SEQ ID NO: 302157 - DNA, 25 bp, Rattus norvegicus
gaagctcacggtgtcaggctttcta

SEQ ID NO: 302158 - DNA, 25 bp, Rattus norvegicus
gaagctcactatacattctacactc

SEQ ID NO: 302159 - DNA, 25 bp, Rattus norvegicus
gaagctcactattcattctacactc

SEQ ID NO: 302160 - DNA, 25 bp, Rattus norvegicus
gaagctcactgaagtcagacaggat

SEQ ID NO: 302161 - DNA, 25 bp, Rattus norvegicus
gaagctcactgatgtcagacaggat

SEQ ID NO: 302162 - DNA, 25 bp, Rattus norvegicus
gaagctcactgcctccggagagtag

SEQ ID NO: 302163 - DNA, 25 bp, Rattus norvegicus
gaagctcactgcgtccggagagtag

SEQ ID NO: 302164 - DNA, 25 bp, Rattus norvegicus
gaagctcactgtccactagtgtctc

SEQ ID NO: 302165 - DNA, 25 bp, Rattus norvegicus
gaagctcactgtgcactagtgtctc

SEQ ID NO: 302166 - DNA, 25 bp, Rattus norvegicus
gaagctcagaccagctgtgtgggta

SEQ ID NO: 302167 - DNA, 25 bp, Rattus norvegicus
gaagctcagacctgctgtgtgggta

SEQ ID NO: 302168 - DNA, 25 bp, Rattus norvegicus
gaagctcagagaatgacccttggta

SEQ ID NO: 302169 - DNA, 25 bp, Rattus norvegicus
gaagctcagagattgacccttggta

SEQ ID NO: 302170 - DNA, 25 bp, Rattus norvegicus
gaagctcagaggaaggctggtctct

SEQ ID NO: 302171 - DNA, 25 bp, Rattus norvegicus
gaagctcagaggagtcttggcacta

SEQ ID NO: 302172 - DNA, 25 bp, Rattus norvegicus
gaagctcagaggtaggctggtctct

SEQ ID NO: 302173 - DNA, 25 bp, Rattus norvegicus
gaagctcagaggtgtcttggcacta

SEQ ID NO: 302174 - DNA, 25 bp, Rattus norvegicus
gaagctcagagtactcagcctagca

SEQ ID NO: 302175 - DNA, 25 bp, Rattus norvegicus
gaagctcagagttctcagcctagca

SEQ ID NO: 302176 - DNA, 25 bp, Rattus norvegicus
gaagctcagcagatgattacccggc

SEQ ID NO: 302177 - DNA, 25 bp, Rattus norvegicus
gaagctcagcagcaacttgaagaac

SEQ ID NO: 302178 - DNA, 25 bp, Rattus norvegicus
gaagctcagcaggaacttgaagaac

SEQ ID NO: 302179 - DNA, 25 bp, Rattus norvegicus
gaagctcagcagttgattacccggc

SEQ ID NO: 302180 - DNA, 25 bp, Rattus norvegicus
gaagctcagcatagccaaagacgga

SEQ ID NO: 302181 - DNA, 25 bp, Rattus norvegicus
gaagctcagcattgccaaagacgga

SEQ ID NO: 302182 - DNA, 25 bp, Rattus norvegicus
gaagctcagcttccacacagattac

SEQ ID NO: 302183 - DNA, 25 bp, Rattus norvegicus
gaagctcagcttgcacacagattac

SEQ ID NO: 302184 - DNA, 25 bp, Rattus norvegicus
gaagctcaggaaaaaggcgaccact

SEQ ID NO: 302185 - DNA, 25 bp, Rattus norvegicus
gaagctcaggaataaggcgaccact

SEQ ID NO: 302186 - DNA, 25 bp, Rattus norvegicus
gaagctcagggtaagaatggcgcac

SEQ ID NO: 302187 - DNA, 25 bp, Rattus norvegicus
gaagctcagggttagaatggcgcac

SEQ ID NO: 302188 - DNA, 25 bp, Rattus norvegicus
gaagctcaggtgcacattcaatttg

SEQ ID NO: 302189 - DNA, 25 bp, Rattus norvegicus
gaagctcaggtggacattcaatttg

SEQ ID NO: 302190 - DNA, 25 bp, Rattus norvegicus
gaagctcagtatacacttgttttca

SEQ ID NO: 302191 - DNA, 25 bp, Rattus norvegicus
gaagctcagtattcacttgttttca

SEQ ID NO: 302192 - DNA, 25 bp, Rattus norvegicus
gaagctcagtcaacacattggtggg

SEQ ID NO: 302193 - DNA, 25 bp, Rattus norvegicus
gaagctcagtcatcacattggtggg

SEQ ID NO: 302194 - DNA, 25 bp, Rattus norvegicus
gaagctcagtccaaggaacctgggc

SEQ ID NO: 302195 - DNA, 25 bp, Rattus norvegicus
gaagctcagtcctaggaacctgggc

SEQ ID NO: 302196 - DNA, 25 bp, Rattus norvegicus
gaagctcatcagaccagaggttcgt

SEQ ID NO: 302197 - DNA, 25 bp, Rattus norvegicus
gaagctcatcagtccagaggttcgt

SEQ ID NO: 302198 - DNA, 25 bp, Rattus norvegicus
gaagctcatcgtcgtcaaacaggaa

SEQ ID NO: 302199 - DNA, 25 bp, Rattus norvegicus
gaagctcatcgtggtcaaacaggaa

SEQ ID NO: 302200 - DNA, 25 bp, Rattus norvegicus
gaagctcatctcatctttcaaaggg

SEQ ID NO: 302201 - DNA, 25 bp, Rattus norvegicus
gaagctcatctcattactggtgaac

SEQ ID NO: 302202 - DNA, 25 bp, Rattus norvegicus
gaagctcatctcttctttcaaaggg

SEQ ID NO: 302203 - DNA, 25 bp, Rattus norvegicus
gaagctcatctctttactggtgaac

SEQ ID NO: 302204 - DNA, 25 bp, Rattus norvegicus
gaagctcatcttccaacatttacta

SEQ ID NO: 302205 - DNA, 25 bp, Rattus norvegicus
gaagctcatcttgcaacatttacta

SEQ ID NO: 302206 - DNA, 25 bp, Rattus norvegicus
gaagctcatgagaaaaggtacaact

SEQ ID NO: 302207 - DNA, 25 bp, Rattus norvegicus
gaagctcatgagtaaaggtacaact

SEQ ID NO: 302208 - DNA, 25 bp, Rattus norvegicus
gaagctcatgcaatgtctgccaaat

SEQ ID NO: 302209 - DNA, 25 bp, Rattus norvegicus
gaagctcatgcattgtctgccaaat

SEQ ID NO: 302210 - DNA, 25 bp, Rattus norvegicus
gaagctcatgtgcatgtatcttaaa

SEQ ID NO: 302211 - DNA, 25 bp, Rattus norvegicus
gaagctcatgtggatgtatcttaaa

SEQ ID NO: 302212 - DNA, 25 bp, Rattus norvegicus
gaagctcattcaacacaagagacag

SEQ ID NO: 302213 - DNA, 25 bp, Rattus norvegicus
gaagctcattcatcacaagagacag

SEQ ID NO: 302214 - DNA, 25 bp, Rattus norvegicus
gaagctcattttagtttagttgtgt

SEQ ID NO: 302215 - DNA, 25 bp, Rattus norvegicus
gaagctcatttttgtttagttgtgt

SEQ ID NO: 302216 - DNA, 25 bp, Rattus norvegicus
gaagctccaagtagttagtgtgtgc

SEQ ID NO: 302217 - DNA, 25 bp, Rattus norvegicus
gaagctccaagttgttagtgtgtgc

SEQ ID NO: 302218 - DNA, 25 bp, Rattus norvegicus
gaagctccaattatccaagtggcag

SEQ ID NO: 302219 - DNA, 25 bp, Rattus norvegicus
gaagctccaattttccaagtggcag

SEQ ID NO: 302220 - DNA, 25 bp, Rattus norvegicus
gaagctccacggatagcacagcaga

SEQ ID NO: 302221 - DNA, 25 bp, Rattus norvegicus
gaagctccacggttagcacagcaga

SEQ ID NO: 302222 - DNA, 25 bp, Rattus norvegicus
gaagctccagaaaccacagaacaca

SEQ ID NO: 302223 - DNA, 25 bp, Rattus norvegicus
gaagctccagaatccacagaacaca

SEQ ID NO: 302224 - DNA, 25 bp, Rattus norvegicus
gaagctccagcaatgatgggcgtcc

SEQ ID NO: 302225 - DNA, 25 bp, Rattus norvegicus
gaagctccagcattgatgggcgtcc

SEQ ID NO: 302226 - DNA, 25 bp, Rattus norvegicus
gaagctccaggacatttcatgacta

SEQ ID NO: 302227 - DNA, 25 bp, Rattus norvegicus
gaagctccaggagatttcatgacta

SEQ ID NO: 302228 - DNA, 25 bp, Rattus norvegicus
gaagctccagtacgacctgcagagg

SEQ ID NO: 302229 - DNA, 25 bp, Rattus norvegicus
gaagctccagtaggacctgcagagg

SEQ ID NO: 302230 - DNA, 25 bp, Rattus norvegicus
gaagctccatagagtgctgtcagca

SEQ ID NO: 302231 - DNA, 25 bp, Rattus norvegicus
gaagctccatagtgtgctgtcagca

SEQ ID NO: 302232 - DNA, 25 bp, Rattus norvegicus
gaagctccattcacaggcatcactg

SEQ ID NO: 302233 - DNA, 25 bp, Rattus norvegicus
gaagctccattctcaggcatcactg

SEQ ID NO: 302234 - DNA, 25 bp, Rattus norvegicus
gaagctcccagacaggttcaacaac

SEQ ID NO: 302235 - DNA, 25 bp, Rattus norvegicus
gaagctcccagagaggttcaacaac

SEQ ID NO: 302236 - DNA, 25 bp, Rattus norvegicus
gaagctcccaggactgtagctgagg

SEQ ID NO: 302237 - DNA, 25 bp, Rattus norvegicus
gaagctcccaggtctgtagctgagg

SEQ ID NO: 302238 - DNA, 25 bp, Rattus norvegicus
gaagctcccatcaagacggaagcag

SEQ ID NO: 302239 - DNA, 25 bp, Rattus norvegicus
gaagctcccatctagacggaagcag

SEQ ID NO: 302240 - DNA, 25 bp, Rattus norvegicus
gaagctcccatgaagtgctgcagct

SEQ ID NO: 302241 - DNA, 25 bp, Rattus norvegicus
gaagctcccatgtagtgctgcagct

SEQ ID NO: 302242 - DNA, 25 bp, Rattus norvegicus
gaagctcccattaggaaatcgtggt

SEQ ID NO: 302243 - DNA, 25 bp, Rattus norvegicus
gaagctcccatttggaaatcgtggt

SEQ ID NO: 302244 - DNA, 25 bp, Rattus norvegicus
gaagctccccagcaggctggctaaa

SEQ ID NO: 302245 - DNA, 25 bp, Rattus norvegicus
gaagctccccaggaggctggctaaa

SEQ ID NO: 302246 - DNA, 25 bp, Rattus norvegicus
gaagctccccttagccaagtgggaa

SEQ ID NO: 302247 - DNA, 25 bp, Rattus norvegicus
gaagctcccctttgccaagtgggaa

SEQ ID NO: 302248 - DNA, 25 bp, Rattus norvegicus
gaagctccctctattgtacattgtt

SEQ ID NO: 302249 - DNA, 25 bp, Rattus norvegicus
gaagctccctcttttgtacattgtt

SEQ ID NO: 302250 - DNA, 25 bp, Rattus norvegicus
gaagctccgcagcaaccagatccat

SEQ ID NO: 302251 - DNA, 25 bp, Rattus norvegicus
gaagctccgcaggaaccagatccat

SEQ ID NO: 302252 - DNA, 25 bp, Rattus norvegicus
gaagctcctaagatatggtgatcac

SEQ ID NO: 302253 - DNA, 25 bp, Rattus norvegicus
gaagctcctaagttatggtgatcac

SEQ ID NO: 302254 - DNA, 25 bp, Rattus norvegicus
gaagctcctagaaagcctcaggaac

SEQ ID NO: 302255 - DNA, 25 bp, Rattus norvegicus
gaagctcctagatagcctcaggaac

SEQ ID NO: 302256 - DNA, 25 bp, Rattus norvegicus
gaagctcctccacaaagcgcttaat

SEQ ID NO: 302257 - DNA, 25 bp, Rattus norvegicus
gaagctcctccagaaagcgcttaat

SEQ ID NO: 302258 - DNA, 25 bp, Rattus norvegicus
gaagctcctgatcctatcatatcaa

SEQ ID NO: 302259 - DNA, 25 bp, Rattus norvegicus
gaagctcctgatgctatcatatcaa

SEQ ID NO: 302260 - DNA, 25 bp, Rattus norvegicus
gaagctcctgcacgtgatctgtgta

SEQ ID NO: 302261 - DNA, 25 bp, Rattus norvegicus
gaagctcctgcaggtgatctgtgta

SEQ ID NO: 302262 - DNA, 25 bp, Rattus norvegicus
gaagctcctggacattgccatcaac

SEQ ID NO: 302263 - DNA, 25 bp, Rattus norvegicus
gaagctcctggagattgccatcaac

SEQ ID NO: 302264 - DNA, 25 bp, Rattus norvegicus
gaagctcctgtaagcgttactgcaa

SEQ ID NO: 302265 - DNA, 25 bp, Rattus norvegicus
gaagctcctgtatgcgttactgcaa

SEQ ID NO: 302266 - DNA, 25 bp, Rattus norvegicus
gaagctcctgttatactcagtgact

SEQ ID NO: 302267 - DNA, 25 bp, Rattus norvegicus
gaagctcctgttttactcagtgact

SEQ ID NO: 302268 - DNA, 25 bp, Rattus norvegicus
gaagctcgaacacccacctgtggca

SEQ ID NO: 302269 - DNA, 25 bp, Rattus norvegicus
gaagctcgaacagccacctgtggca

SEQ ID NO: 302270 - DNA, 25 bp, Rattus norvegicus
gaagctcgaataccgacagcggcta

SEQ ID NO: 302271 - DNA, 25 bp, Rattus norvegicus
gaagctcgaatagcgacagcggcta

SEQ ID NO: 302272 - DNA, 25 bp, Rattus norvegicus
gaagctcgagagacagggaagccat

SEQ ID NO: 302273 - DNA, 25 bp, Rattus norvegicus
gaagctcgagagtcagggaagccat

SEQ ID NO: 302274 - DNA, 25 bp, Rattus norvegicus
gaagctcgatatagaacacggagaa

SEQ ID NO: 302275 - DNA, 25 bp, Rattus norvegicus
gaagctcgatattgaacacggagaa

SEQ ID NO: 302276 - DNA, 25 bp, Rattus norvegicus
gaagctcgatgtctctgtgaagtca

SEQ ID NO: 302277 - DNA, 25 bp, Rattus norvegicus
gaagctcgatgtgtctgtgaagtca

SEQ ID NO: 302278 - DNA, 25 bp, Rattus norvegicus
gaagctcgcagtatggctaagcatt

SEQ ID NO: 302279 - DNA, 25 bp, Rattus norvegicus
gaagctcgcagtttggctaagcatt

SEQ ID NO: 302280 - DNA, 25 bp, Rattus norvegicus
gaagctcgccaacctttgtcatgga

SEQ ID NO: 302281 - DNA, 25 bp, Rattus norvegicus
gaagctcgccaagctttgtcatgga

SEQ ID NO: 302282 - DNA, 25 bp, Rattus norvegicus
gaagctcgccgtcacagtgtgttta

SEQ ID NO: 302283 - DNA, 25 bp, Rattus norvegicus
gaagctcgccgtgacagtgtgttta

SEQ ID NO: 302284 - DNA, 25 bp, Rattus norvegicus
gaagctcggacaattttatgtctta

SEQ ID NO: 302285 - DNA, 25 bp, Rattus norvegicus
gaagctcggacatttttatgtctta

SEQ ID NO: 302286 - DNA, 25 bp, Rattus norvegicus
gaagctcggaggatgcgctgacctt

SEQ ID NO: 302287 - DNA, 25 bp, Rattus norvegicus
gaagctcggaggttgcgctgacctt

SEQ ID NO: 302288 - DNA, 25 bp, Rattus norvegicus
gaagctcggcggaacaggctcatga

SEQ ID NO: 302289 - DNA, 25 bp, Rattus norvegicus
gaagctcggcggtacaggctcatga

SEQ ID NO: 302290 - DNA, 25 bp, Rattus norvegicus
gaagctcgtgaaacatggcgtcaga

SEQ ID NO: 302291 - DNA, 25 bp, Rattus norvegicus
gaagctcgtgaatcatggcgtcaga

SEQ ID NO: 302292 - DNA, 25 bp, Rattus norvegicus
gaagctcgttcacctgacacacagg

SEQ ID NO: 302293 - DNA, 25 bp, Rattus norvegicus
gaagctcgttcagctgacacacagg

SEQ ID NO: 302294 - DNA, 25 bp, Rattus norvegicus
gaagctctacacacacttatcagtg

SEQ ID NO: 302295 - DNA, 25 bp, Rattus norvegicus
gaagctctacactcacttatcagtg

SEQ ID NO: 302296 - DNA, 25 bp, Rattus norvegicus
gaagctctaccaatgaactgtttaa

SEQ ID NO: 302297 - DNA, 25 bp, Rattus norvegicus
gaagctctaccacaggaggactcca

SEQ ID NO: 302298 - DNA, 25 bp, Rattus norvegicus
gaagctctaccagaggaggactcca

SEQ ID NO: 302299 - DNA, 25 bp, Rattus norvegicus
gaagctctaccattgaactgtttaa

SEQ ID NO: 302300 - DNA, 25 bp, Rattus norvegicus
gaagctctagctacaggctagcgtt

SEQ ID NO: 302301 - DNA, 25 bp, Rattus norvegicus
gaagctctagcttcaggctagcgtt

SEQ ID NO: 302302 - DNA, 25 bp, Rattus norvegicus
gaagctctcagtcctctgccaggag

SEQ ID NO: 302303 - DNA, 25 bp, Rattus norvegicus
gaagctctcagtgctctgccaggag

SEQ ID NO: 302304 - DNA, 25 bp, Rattus norvegicus
gaagctctccttcaggatgctaaaa

SEQ ID NO: 302305 - DNA, 25 bp, Rattus norvegicus
gaagctctccttgaggatgctaaaa

SEQ ID NO: 302306 - DNA, 25 bp, Rattus norvegicus
gaagctctcgttagaccagggaatt

SEQ ID NO: 302307 - DNA, 25 bp, Rattus norvegicus
gaagctctcgtttgaccagggaatt

SEQ ID NO: 302308 - DNA, 25 bp, Rattus norvegicus
gaagctctctagaattccacagtta

SEQ ID NO: 302309 - DNA, 25 bp, Rattus norvegicus
gaagctctctagtattccacagtta

SEQ ID NO: 302310 - DNA, 25 bp, Rattus norvegicus
gaagctctctatactgatttactga

SEQ ID NO: 302311 - DNA, 25 bp, Rattus norvegicus
gaagctctctattctgatttactga

SEQ ID NO: 302312 - DNA, 25 bp, Rattus norvegicus
gaagctctctgcaacaaggcctaga

SEQ ID NO: 302313 - DNA, 25 bp, Rattus norvegicus
gaagctctctgctacaaggcctaga

SEQ ID NO: 302314 - DNA, 25 bp, Rattus norvegicus
gaagctctctggcaatattgaggac

SEQ ID NO: 302315 - DNA, 25 bp, Rattus norvegicus
gaagctctctgggaatattgaggac

SEQ ID NO: 302316 - DNA, 25 bp, Rattus norvegicus
gaagctctctgtcagaactttccag

SEQ ID NO: 302317 - DNA, 25 bp, Rattus norvegicus
gaagctctctgtgagaactttccag

SEQ ID NO: 302318 - DNA, 25 bp, Rattus norvegicus
gaagctctcttcagtcggatcaatg

SEQ ID NO: 302319 - DNA, 25 bp, Rattus norvegicus
gaagctctcttctgtcggatcaatg

SEQ ID NO: 302320 - DNA, 25 bp, Rattus norvegicus
gaagctctgaagcatgactctattc

SEQ ID NO: 302321 - DNA, 25 bp, Rattus norvegicus
gaagctctgaaggatgactctattc

SEQ ID NO: 302322 - DNA, 25 bp, Rattus norvegicus
gaagctctgaatcttgcctggctcc

SEQ ID NO: 302323 - DNA, 25 bp, Rattus norvegicus
gaagctctgaatgttgcctggctcc

SEQ ID NO: 302324 - DNA, 25 bp, Rattus norvegicus
gaagctctgaccacttggtgtagca

SEQ ID NO: 302325 - DNA, 25 bp, Rattus norvegicus
gaagctctgacctcttggtgtagca

SEQ ID NO: 302326 - DNA, 25 bp, Rattus norvegicus
gaagctctgagcctcctaaatgaca

SEQ ID NO: 302327 - DNA, 25 bp, Rattus norvegicus
gaagctctgagcgtcctaaatgaca

SEQ ID NO: 302328 - DNA, 25 bp, Rattus norvegicus
gaagctctgaggctcctgagctcag

SEQ ID NO: 302329 - DNA, 25 bp, Rattus norvegicus
gaagctctgagggtcctgagctcag

SEQ ID NO: 302330 - DNA, 25 bp, Rattus norvegicus
gaagctctgctcagattgcccttcg

SEQ ID NO: 302331 - DNA, 25 bp, Rattus norvegicus
gaagctctgctctgattgcccttcg

SEQ ID NO: 302332 - DNA, 25 bp, Rattus norvegicus
gaagctctgctgatttgttataatg

SEQ ID NO: 302333 - DNA, 25 bp, Rattus norvegicus
gaagctctgctgttttgttataatg

SEQ ID NO: 302334 - DNA, 25 bp, Rattus norvegicus
gaagctctggaaaaacctgccagga

SEQ ID NO: 302335 - DNA, 25 bp, Rattus norvegicus
gaagctctggaaacagaagcacatg

SEQ ID NO: 302336 - DNA, 25 bp, Rattus norvegicus
gaagctctggaataacctgccagga

SEQ ID NO: 302337 - DNA, 25 bp, Rattus norvegicus
gaagctctggaatcagaagcacatg

SEQ ID NO: 302338 - DNA, 25 bp, Rattus norvegicus
gaagctctggatctttctccttgga

SEQ ID NO: 302339 - DNA, 25 bp, Rattus norvegicus
gaagctctggatgtttctccttgga

SEQ ID NO: 302340 - DNA, 25 bp, Rattus norvegicus
gaagctctggcgaacatgcaaatgt

SEQ ID NO: 302341 - DNA, 25 bp, Rattus norvegicus
gaagctctggcgtacatgcaaatgt

SEQ ID NO: 302342 - DNA, 25 bp, Rattus norvegicus
gaagctctgggcaacctggtcgaag

SEQ ID NO: 302343 - DNA, 25 bp, Rattus norvegicus
gaagctctgggctacctggtcgaag

SEQ ID NO: 302344 - DNA, 25 bp, Rattus norvegicus
gaagctctgggtatgattcctaggt

SEQ ID NO: 302345 - DNA, 25 bp, Rattus norvegicus
gaagctctgggtttgattcctaggt

SEQ ID NO: 302346 - DNA, 25 bp, Rattus norvegicus
gaagctctggttactgtacgatgca

SEQ ID NO: 302347 - DNA, 25 bp, Rattus norvegicus
gaagctctggtttctgtacgatgca

SEQ ID NO: 302348 - DNA, 25 bp, Rattus norvegicus
gaagctctgtaaagcatttcatgtt

SEQ ID NO: 302349 - DNA, 25 bp, Rattus norvegicus
gaagctctgtaatgcatttcatgtt

SEQ ID NO: 302350 - DNA, 25 bp, Rattus norvegicus
gaagctctgtcaagggttggtctct

SEQ ID NO: 302351 - DNA, 25 bp, Rattus norvegicus
gaagctctgtcatgggttggtctct

SEQ ID NO: 302352 - DNA, 25 bp, Rattus norvegicus
gaagctctgtctctaaaacgggaag

SEQ ID NO: 302353 - DNA, 25 bp, Rattus norvegicus
gaagctctgtctgtaaaacgggaag

SEQ ID NO: 302354 - DNA, 25 bp, Rattus norvegicus
gaagctctgtttactcctcttagca

SEQ ID NO: 302355 - DNA, 25 bp, Rattus norvegicus
gaagctctgttttctcctcttagca

SEQ ID NO: 302356 - DNA, 25 bp, Rattus norvegicus
gaagctcttaatctgattccgtgag

SEQ ID NO: 302357 - DNA, 25 bp, Rattus norvegicus
gaagctcttaatgtgattccgtgag

SEQ ID NO: 302358 - DNA, 25 bp, Rattus norvegicus
gaagctcttagaaatcgccaccaag

SEQ ID NO: 302359 - DNA, 25 bp, Rattus norvegicus
gaagctcttagatatcgccaccaag

SEQ ID NO: 302360 - DNA, 25 bp, Rattus norvegicus
gaagctcttatactgagattgactg

SEQ ID NO: 302361 - DNA, 25 bp, Rattus norvegicus
gaagctcttatagtgagattgactg

SEQ ID NO: 302362 - DNA, 25 bp, Rattus norvegicus
gaagctcttcagatccctccaagga

SEQ ID NO: 302363 - DNA, 25 bp, Rattus norvegicus
gaagctcttcagttccctccaagga

SEQ ID NO: 302364 - DNA, 25 bp, Rattus norvegicus
gaagctcttccgaactgaggacttt

SEQ ID NO: 302365 - DNA, 25 bp, Rattus norvegicus
gaagctcttccgtactgaggacttt

SEQ ID NO: 302366 - DNA, 25 bp, Rattus norvegicus
gaagctcttgaaacgccattggagg

SEQ ID NO: 302367 - DNA, 25 bp, Rattus norvegicus
gaagctcttgaatcgccattggagg

SEQ ID NO: 302368 - DNA, 25 bp, Rattus norvegicus
gaagctcttgataatgatagttcag

SEQ ID NO: 302369 - DNA, 25 bp, Rattus norvegicus
gaagctcttgattatgatagttcag

SEQ ID NO: 302370 - DNA, 25 bp, Rattus norvegicus
gaagctcttgccagaaatatcattt

SEQ ID NO: 302371 - DNA, 25 bp, Rattus norvegicus
gaagctcttgcctgaaatatcattt

SEQ ID NO: 302372 - DNA, 25 bp, Rattus norvegicus
gaagctcttggccagagagtgcctc

SEQ ID NO: 302373 - DNA, 25 bp, Rattus norvegicus
gaagctcttggcgagagagtgcctc

SEQ ID NO: 302374 - DNA, 25 bp, Rattus norvegicus
gaagctcttttgattccttatgtat

SEQ ID NO: 302375 - DNA, 25 bp, Rattus norvegicus
gaagctcttttgtttccttatgtat

SEQ ID NO: 302376 - DNA, 25 bp, Rattus norvegicus
gaagctctttttaaccttggtgtag

SEQ ID NO: 302377 - DNA, 25 bp, Rattus norvegicus
gaagctcttttttaccttggtgtag

SEQ ID NO: 302378 - DNA, 25 bp, Rattus norvegicus
gaagctgaaaacagaacgccattgc

SEQ ID NO: 302379 - DNA, 25 bp, Rattus norvegicus
gaagctgaaaactgaacgccattgc

SEQ ID NO: 302380 - DNA, 25 bp, Rattus norvegicus
gaagctgaaacgaagtccactgaat

SEQ ID NO: 302381 - DNA, 25 bp, Rattus norvegicus
gaagctgaaacgtagtccactgaat

SEQ ID NO: 302382 - DNA, 25 bp, Rattus norvegicus
gaagctgaaactatgaatgcgtttt

SEQ ID NO: 302383 - DNA, 25 bp, Rattus norvegicus
gaagctgaaactcaaccccatgagg

SEQ ID NO: 302384 - DNA, 25 bp, Rattus norvegicus
gaagctgaaactgaaccccatgagg

SEQ ID NO: 302385 - DNA, 25 bp, Rattus norvegicus
gaagctgaaactttgaatgcgtttt

SEQ ID NO: 302386 - DNA, 25 bp, Rattus norvegicus
gaagctgaaagtcctcctcaggaac

SEQ ID NO: 302387 - DNA, 25 bp, Rattus norvegicus
gaagctgaaagtgctcctcaggaac

SEQ ID NO: 302388 - DNA, 25 bp, Rattus norvegicus
gaagctgaaccaaaacctcccaatg

SEQ ID NO: 302389 - DNA, 25 bp, Rattus norvegicus
gaagctgaaccataacctcccaatg

SEQ ID NO: 302390 - DNA, 25 bp, Rattus norvegicus
gaagctgaacctaccccaaaaacag

SEQ ID NO: 302391 - DNA, 25 bp, Rattus norvegicus
gaagctgaaccttccccaaaaacag

SEQ ID NO: 302392 - DNA, 25 bp, Rattus norvegicus
gaagctgaactgacttcttcagcct

SEQ ID NO: 302393 - DNA, 25 bp, Rattus norvegicus
gaagctgaactgtcttcttcagcct

SEQ ID NO: 302394 - DNA, 25 bp, Rattus norvegicus
gaagctgaagatcgaccagattctg

SEQ ID NO: 302395 - DNA, 25 bp, Rattus norvegicus
gaagctgaagatggaccagattctg

SEQ ID NO: 302396 - DNA, 25 bp, Rattus norvegicus
gaagctgaagcaaccggatttagag

SEQ ID NO: 302397 - DNA, 25 bp, Rattus norvegicus
gaagctgaagcatccggatttagag

SEQ ID NO: 302398 - DNA, 25 bp, Rattus norvegicus
gaagctgaagccctcattcattcag

SEQ ID NO: 302399 - DNA, 25 bp, Rattus norvegicus
gaagctgaagccgtcattcattcag

SEQ ID NO: 302400 - DNA, 25 bp, Rattus norvegicus
gaagctgaagctattctacggcatg

SEQ ID NO: 302401 - DNA, 25 bp, Rattus norvegicus
gaagctgaagcttttctacggcatg

SEQ ID NO: 302402 - DNA, 25 bp, Rattus norvegicus
gaagctgaaggccttggaaaaccag

SEQ ID NO: 302403 - DNA, 25 bp, Rattus norvegicus
gaagctgaaggcgttggaaaaccag

SEQ ID NO: 302404 - DNA, 25 bp, Rattus norvegicus
gaagctgaagtacctcaagcctgag

SEQ ID NO: 302405 - DNA, 25 bp, Rattus norvegicus
gaagctgaagtagctcaagcctgag

SEQ ID NO: 302406 - DNA, 25 bp, Rattus norvegicus
gaagctgaagtcattatgtctacaa

SEQ ID NO: 302407 - DNA, 25 bp, Rattus norvegicus
gaagctgaagtctttatgtctacaa

SEQ ID NO: 302408 - DNA, 25 bp, Rattus norvegicus
gaagctgaatacaggttttcaccat

SEQ ID NO: 302409 - DNA, 25 bp, Rattus norvegicus
gaagctgaatactggttttcaccat

SEQ ID NO: 302410 - DNA, 25 bp, Rattus norvegicus
gaagctgaatgaagtcatccggcag

SEQ ID NO: 302411 - DNA, 25 bp, Rattus norvegicus
gaagctgaatgatgtcatccggcag

SEQ ID NO: 302412 - DNA, 25 bp, Rattus norvegicus
gaagctgaattccatgttgccaaca

SEQ ID NO: 302413 - DNA, 25 bp, Rattus norvegicus
gaagctgaattcgatgttgccaaca

SEQ ID NO: 302414 - DNA, 25 bp, Rattus norvegicus
gaagctgacaagatcagaccccagt

SEQ ID NO: 302415 - DNA, 25 bp, Rattus norvegicus
gaagctgacaagttcagaccccagt

SEQ ID NO: 302416 - DNA, 25 bp, Rattus norvegicus
gaagctgacaccagtgagtgccttt

SEQ ID NO: 302417 - DNA, 25 bp, Rattus norvegicus
gaagctgacacctgtgagtgccttt

SEQ ID NO: 302418 - DNA, 25 bp, Rattus norvegicus
gaagctgaccagaagtcttgctgtc

SEQ ID NO: 302419 - DNA, 25 bp, Rattus norvegicus
gaagctgaccagtagtcttgctgtc

SEQ ID NO: 302420 - DNA, 25 bp, Rattus norvegicus
gaagctgacccacagatgtctggtg

SEQ ID NO: 302421 - DNA, 25 bp, Rattus norvegicus
gaagctgacccagagatgtctggtg

SEQ ID NO: 302422 - DNA, 25 bp, Rattus norvegicus
gaagctgaccctcagtggcatctgc

SEQ ID NO: 302423 - DNA, 25 bp, Rattus norvegicus
gaagctgaccctgagtggcatctgc

SEQ ID NO: 302424 - DNA, 25 bp, Rattus norvegicus
gaagctgactcccatatcagtggaa

SEQ ID NO: 302425 - DNA, 25 bp, Rattus norvegicus
gaagctgactccgatatcagtggaa

SEQ ID NO: 302426 - DNA, 25 bp, Rattus norvegicus
gaagctgactgtaccttggtgctgg

SEQ ID NO: 302427 - DNA, 25 bp, Rattus norvegicus
gaagctgactgttccttggtgctgg

SEQ ID NO: 302428 - DNA, 25 bp, Rattus norvegicus
gaagctgagaacatccaaggcccat

SEQ ID NO: 302429 - DNA, 25 bp, Rattus norvegicus
gaagctgagaacttccaaggcccat

SEQ ID NO: 302430 - DNA, 25 bp, Rattus norvegicus
gaagctgagacactttcacccttta

SEQ ID NO: 302431 - DNA, 25 bp, Rattus norvegicus
gaagctgagacagtttcacccttta

SEQ ID NO: 302432 - DNA, 25 bp, Rattus norvegicus
gaagctgagaggatccgctgcacca

SEQ ID NO: 302433 - DNA, 25 bp, Rattus norvegicus
gaagctgagaggttccgctgcacca

SEQ ID NO: 302434 - DNA, 25 bp, Rattus norvegicus
gaagctgagagtcccctcctgagaa

SEQ ID NO: 302435 - DNA, 25 bp, Rattus norvegicus
gaagctgagagtgccctcctgagaa

SEQ ID NO: 302436 - DNA, 25 bp, Rattus norvegicus
gaagctgagattcacttggatcctg

SEQ ID NO: 302437 - DNA, 25 bp, Rattus norvegicus
gaagctgagattgacttggatcctg

SEQ ID NO: 302438 - DNA, 25 bp, Rattus norvegicus
gaagctgagcacaaggagcccaatg

SEQ ID NO: 302439 - DNA, 25 bp, Rattus norvegicus
gaagctgagcactaggagcccaatg

SEQ ID NO: 302440 - DNA, 25 bp, Rattus norvegicus
gaagctgagccaatcattcgagagg

SEQ ID NO: 302441 - DNA, 25 bp, Rattus norvegicus
gaagctgagccattcattcgagagg

SEQ ID NO: 302442 - DNA, 25 bp, Rattus norvegicus
gaagctgagcccaagctgtgtgtaa

SEQ ID NO: 302443 - DNA, 25 bp, Rattus norvegicus
gaagctgagcccaccacagaagaag

SEQ ID NO: 302444 - DNA, 25 bp, Rattus norvegicus
gaagctgagccctagctgtgtgtaa

SEQ ID NO: 302445 - DNA, 25 bp, Rattus norvegicus
gaagctgagccctccacagaagaag

SEQ ID NO: 302446 - DNA, 25 bp, Rattus norvegicus
gaagctgagcgcaagaccaacatcc

SEQ ID NO: 302447 - DNA, 25 bp, Rattus norvegicus
gaagctgagcgctagaccaacatcc

SEQ ID NO: 302448 - DNA, 25 bp, Rattus norvegicus
gaagctgaggacaagctctgccgcc

SEQ ID NO: 302449 - DNA, 25 bp, Rattus norvegicus
gaagctgaggactagctctgccgcc

SEQ ID NO: 302450 - DNA, 25 bp, Rattus norvegicus
gaagctgaggcacggatatcattga

SEQ ID NO: 302451 - DNA, 25 bp, Rattus norvegicus
gaagctgaggcagggatatcattga

SEQ ID NO: 302452 - DNA, 25 bp, Rattus norvegicus
gaagctgaggctctgtatgaacccc

SEQ ID NO: 302453 - DNA, 25 bp, Rattus norvegicus
gaagctgaggctgtgtatgaacccc

SEQ ID NO: 302454 - DNA, 25 bp, Rattus norvegicus
gaagctgagggcatgggcattccca

SEQ ID NO: 302455 - DNA, 25 bp, Rattus norvegicus
gaagctgagggcttgggcattccca

SEQ ID NO: 302456 - DNA, 25 bp, Rattus norvegicus
gaagctgagtcacccacaactgctt

SEQ ID NO: 302457 - DNA, 25 bp, Rattus norvegicus
gaagctgagtcagccacaactgctt

SEQ ID NO: 302458 - DNA, 25 bp, Rattus norvegicus
gaagctgatcttagttaatgtcttg

SEQ ID NO: 302459 - DNA, 25 bp, Rattus norvegicus
gaagctgatctttgttaatgtcttg

SEQ ID NO: 302460 - DNA, 25 bp, Rattus norvegicus
gaagctgatgacaggagcaatccca

SEQ ID NO: 302461 - DNA, 25 bp, Rattus norvegicus
gaagctgatgactggagcaatccca

SEQ ID NO: 302462 - DNA, 25 bp, Rattus norvegicus
gaagctgatgatactgtggcaccca

SEQ ID NO: 302463 - DNA, 25 bp, Rattus norvegicus
gaagctgatgattctgtggcaccca

SEQ ID NO: 302464 - DNA, 25 bp, Rattus norvegicus
gaagctgatgtacgactgcataggt

SEQ ID NO: 302465 - DNA, 25 bp, Rattus norvegicus
gaagctgatgtaggactgcataggt

SEQ ID NO: 302466 - DNA, 25 bp, Rattus norvegicus
gaagctgatgtcactgtagggcccc

SEQ ID NO: 302467 - DNA, 25 bp, Rattus norvegicus
gaagctgatgtctctgtagggcccc

SEQ ID NO: 302468 - DNA, 25 bp, Rattus norvegicus
gaagctgatgttcagtttgctactc

SEQ ID NO: 302469 - DNA, 25 bp, Rattus norvegicus
gaagctgatgttgagtttgctactc

SEQ ID NO: 302470 - DNA, 25 bp, Rattus norvegicus
gaagctgatttgaatgcacggacgt

SEQ ID NO: 302471 - DNA, 25 bp, Rattus norvegicus
gaagctgatttgtatgcacggacgt

SEQ ID NO: 302472 - DNA, 25 bp, Rattus norvegicus
gaagctgcaaggagggttctgccat

SEQ ID NO: 302473 - DNA, 25 bp, Rattus norvegicus
gaagctgcaaggtgggttctgccat

SEQ ID NO: 302474 - DNA, 25 bp, Rattus norvegicus
gaagctgcaagtacagtccagtggg

SEQ ID NO: 302475 - DNA, 25 bp, Rattus norvegicus
gaagctgcaagttcagtccagtggg

SEQ ID NO: 302476 - DNA, 25 bp, Rattus norvegicus
gaagctgcacacatcgtggagagct

SEQ ID NO: 302477 - DNA, 25 bp, Rattus norvegicus
gaagctgcacacttcgtggagagct

SEQ ID NO: 302478 - DNA, 25 bp, Rattus norvegicus
gaagctgcaccgagaatgagtccac

SEQ ID NO: 302479 - DNA, 25 bp, Rattus norvegicus
gaagctgcaccgtgaatgagtccac

SEQ ID NO: 302480 - DNA, 25 bp, Rattus norvegicus
gaagctgcacgtatagtccggaata

SEQ ID NO: 302481 - DNA, 25 bp, Rattus norvegicus
gaagctgcacgtttagtccggaata

SEQ ID NO: 302482 - DNA, 25 bp, Rattus norvegicus
gaagctgcactcatcagaagtccta

SEQ ID NO: 302483 - DNA, 25 bp, Rattus norvegicus
gaagctgcactcttcagaagtccta

SEQ ID NO: 302484 - DNA, 25 bp, Rattus norvegicus
gaagctgcagcaacatctgtccata

SEQ ID NO: 302485 - DNA, 25 bp, Rattus norvegicus
gaagctgcagcatcatctgtccata

SEQ ID NO: 302486 - DNA, 25 bp, Rattus norvegicus
gaagctgcagccaagaagaacgaat

SEQ ID NO: 302487 - DNA, 25 bp, Rattus norvegicus
gaagctgcagcctagaagaacgaat

SEQ ID NO: 302488 - DNA, 25 bp, Rattus norvegicus
gaagctgcagctccgctaccaggag

SEQ ID NO: 302489 - DNA, 25 bp, Rattus norvegicus
gaagctgcagctgcgctaccaggag

SEQ ID NO: 302490 - DNA, 25 bp, Rattus norvegicus
gaagctgcagggcactctcgagtct

SEQ ID NO: 302491 - DNA, 25 bp, Rattus norvegicus
gaagctgcaggggactctcgagtct

SEQ ID NO: 302492 - DNA, 25 bp, Rattus norvegicus
gaagctgcagtgactgcccgatcta

SEQ ID NO: 302493 - DNA, 25 bp, Rattus norvegicus
gaagctgcagtgtctgcccgatcta

SEQ ID NO: 302494 - DNA, 25 bp, Rattus norvegicus
gaagctgcagttcttcatccaggag

SEQ ID NO: 302495 - DNA, 25 bp, Rattus norvegicus
gaagctgcagttgttcatccaggag

SEQ ID NO: 302496 - DNA, 25 bp, Rattus norvegicus
gaagctgcatagaagggcctcctgg

SEQ ID NO: 302497 - DNA, 25 bp, Rattus norvegicus
gaagctgcatagtagggcctcctgg

SEQ ID NO: 302498 - DNA, 25 bp, Rattus norvegicus
gaagctgcatctctgagctctagat

SEQ ID NO: 302499 - DNA, 25 bp, Rattus norvegicus
gaagctgcatctgtgagctctagat

SEQ ID NO: 302500 - DNA, 25 bp, Rattus norvegicus
gaagctgcatgaagagacgctcact

SEQ ID NO: 302501 - DNA, 25 bp, Rattus norvegicus
gaagctgcatgacaacaacccacgt

SEQ ID NO: 302502 - DNA, 25 bp, Rattus norvegicus
gaagctgcatgagaacaacccacgt

SEQ ID NO: 302503 - DNA, 25 bp, Rattus norvegicus
gaagctgcatgatgagacgctcact

SEQ ID NO: 302504 - DNA, 25 bp, Rattus norvegicus
gaagctgcatgcaacaggctggcta

SEQ ID NO: 302505 - DNA, 25 bp, Rattus norvegicus
gaagctgcatgctacaggctggcta

SEQ ID NO: 302506 - DNA, 25 bp, Rattus norvegicus
gaagctgcattgagactttaagtct

SEQ ID NO: 302507 - DNA, 25 bp, Rattus norvegicus
gaagctgcattgtgactttaagtct

SEQ ID NO: 302508 - DNA, 25 bp, Rattus norvegicus
gaagctgccaaaaagtgaccccaac

SEQ ID NO: 302509 - DNA, 25 bp, Rattus norvegicus
gaagctgccaaacgctctggacaga

SEQ ID NO: 302510 - DNA, 25 bp, Rattus norvegicus
gaagctgccaaaggctctggacaga

SEQ ID NO: 302511 - DNA, 25 bp, Rattus norvegicus
gaagctgccaaatagtgaccccaac

SEQ ID NO: 302512 - DNA, 25 bp, Rattus norvegicus
gaagctgccaccactaaatcctgaa

SEQ ID NO: 302513 - DNA, 25 bp, Rattus norvegicus
gaagctgccacccttccgcgaggtg

SEQ ID NO: 302514 - DNA, 25 bp, Rattus norvegicus
gaagctgccaccgttccgcgaggtg

SEQ ID NO: 302515 - DNA, 25 bp, Rattus norvegicus
gaagctgccacctctaaatcctgaa

SEQ ID NO: 302516 - DNA, 25 bp, Rattus norvegicus
gaagctgccagacagagcaccggaa

SEQ ID NO: 302517 - DNA, 25 bp, Rattus norvegicus
gaagctgccagagagagcaccggaa

SEQ ID NO: 302518 - DNA, 25 bp, Rattus norvegicus
gaagctgccataaaagtaccacgat

SEQ ID NO: 302519 - DNA, 25 bp, Rattus norvegicus
gaagctgccatataagtaccacgat

SEQ ID NO: 302520 - DNA, 25 bp, Rattus norvegicus
gaagctgcccatctgtgacaaatgt

SEQ ID NO: 302521 - DNA, 25 bp, Rattus norvegicus
gaagctgcccatgtgtgacaaatgt

SEQ ID NO: 302522 - DNA, 25 bp, Rattus norvegicus
gaagctgccctgctaaggagcccta

SEQ ID NO: 302523 - DNA, 25 bp, Rattus norvegicus
gaagctgccctggtaaggagcccta

SEQ ID NO: 302524 - DNA, 25 bp, Rattus norvegicus
gaagctgcccttcgagagcactagg

SEQ ID NO: 302525 - DNA, 25 bp, Rattus norvegicus
gaagctgcccttggagagcactagg

SEQ ID NO: 302526 - DNA, 25 bp, Rattus norvegicus
gaagctgccgaacaggatccagata

SEQ ID NO: 302527 - DNA, 25 bp, Rattus norvegicus
gaagctgccgaagaggatccagata

SEQ ID NO: 302528 - DNA, 25 bp, Rattus norvegicus
gaagctgccgacaaagccctgaaaa

SEQ ID NO: 302529 - DNA, 25 bp, Rattus norvegicus
gaagctgccgactaagccctgaaaa

SEQ ID NO: 302530 - DNA, 25 bp, Rattus norvegicus
gaagctgccgatccgttcctgaaac

SEQ ID NO: 302531 - DNA, 25 bp, Rattus norvegicus
gaagctgccgatgcgttcctgaaac

SEQ ID NO: 302532 - DNA, 25 bp, Rattus norvegicus
gaagctgccgccataatgactattt

SEQ ID NO: 302533 - DNA, 25 bp, Rattus norvegicus
gaagctgccgccttaatgactattt

SEQ ID NO: 302534 - DNA, 25 bp, Rattus norvegicus
gaagctgccttcactgtacatatgt

SEQ ID NO: 302535 - DNA, 25 bp, Rattus norvegicus
gaagctgccttctctgtacatatgt

SEQ ID NO: 302536 - DNA, 25 bp, Rattus norvegicus
gaagctgcgatgattcctctttcca

SEQ ID NO: 302537 - DNA, 25 bp, Rattus norvegicus
gaagctgcgatgtttcctctttcca

SEQ ID NO: 302538 - DNA, 25 bp, Rattus norvegicus
gaagctgcgcagctcacagctcgct

SEQ ID NO: 302539 - DNA, 25 bp, Rattus norvegicus
gaagctgcgcaggtcacagctcgct

SEQ ID NO: 302540 - DNA, 25 bp, Rattus norvegicus
gaagctgcgtctaatctggaccaga

SEQ ID NO: 302541 - DNA, 25 bp, Rattus norvegicus
gaagctgcgtcttatctggaccaga

SEQ ID NO: 302542 - DNA, 25 bp, Rattus norvegicus
gaagctgctaaacaatgtcgacgtc

SEQ ID NO: 302543 - DNA, 25 bp, Rattus norvegicus
gaagctgctaaagaatgtcgacgtc

SEQ ID NO: 302544 - DNA, 25 bp, Rattus norvegicus
gaagctgctcagagtcgcggtcgca

SEQ ID NO: 302545 - DNA, 25 bp, Rattus norvegicus
gaagctgctcagataacttgtataa

SEQ ID NO: 302546 - DNA, 25 bp, Rattus norvegicus
gaagctgctcagtgtcgcggtcgca

SEQ ID NO: 302547 - DNA, 25 bp, Rattus norvegicus
gaagctgctcagttaacttgtataa

SEQ ID NO: 302548 - DNA, 25 bp, Rattus norvegicus
gaagctgctcgtaacttaactgtaa

SEQ ID NO: 302549 - DNA, 25 bp, Rattus norvegicus
gaagctgctcgttacttaactgtaa

SEQ ID NO: 302550 - DNA, 25 bp, Rattus norvegicus
gaagctgctctacacagcctgataa

SEQ ID NO: 302551 - DNA, 25 bp, Rattus norvegicus
gaagctgctctagacagcctgataa

SEQ ID NO: 302552 - DNA, 25 bp, Rattus norvegicus
gaagctgctctcagaacttgactct

SEQ ID NO: 302553 - DNA, 25 bp, Rattus norvegicus
gaagctgctctccatgctctgtttt

SEQ ID NO: 302554 - DNA, 25 bp, Rattus norvegicus
gaagctgctctcgatgctctgtttt

SEQ ID NO: 302555 - DNA, 25 bp, Rattus norvegicus
gaagctgctctctgaacttgactct

SEQ ID NO: 302556 - DNA, 25 bp, Rattus norvegicus
gaagctgctctgctgctgagttagc

SEQ ID NO: 302557 - DNA, 25 bp, Rattus norvegicus
gaagctgctctggtgctgagttagc

SEQ ID NO: 302558 - DNA, 25 bp, Rattus norvegicus
gaagctgctgacaggccgcttgaca

SEQ ID NO: 302559 - DNA, 25 bp, Rattus norvegicus
gaagctgctgactggccgcttgaca

SEQ ID NO: 302560 - DNA, 25 bp, Rattus norvegicus
gaagctgctgagagtcgctgaccga

SEQ ID NO: 302561 - DNA, 25 bp, Rattus norvegicus
gaagctgctgagtgtcgctgaccga

SEQ ID NO: 302562 - DNA, 25 bp, Rattus norvegicus
gaagctgctgcaactgtaaatgctt

SEQ ID NO: 302563 - DNA, 25 bp, Rattus norvegicus
gaagctgctgcatctgtaaatgctt

SEQ ID NO: 302564 - DNA, 25 bp, Rattus norvegicus
gaagctgctgccactgacatggata

SEQ ID NO: 302565 - DNA, 25 bp, Rattus norvegicus
gaagctgctgcctctgacatggata

SEQ ID NO: 302566 - DNA, 25 bp, Rattus norvegicus
gaagctgctggtatagctgcagtac

SEQ ID NO: 302567 - DNA, 25 bp, Rattus norvegicus
gaagctgctggtattggagatgccc

SEQ ID NO: 302568 - DNA, 25 bp, Rattus norvegicus
gaagctgctggtttagctgcagtac

SEQ ID NO: 302569 - DNA, 25 bp, Rattus norvegicus
gaagctgctggttttggagatgccc

SEQ ID NO: 302570 - DNA, 25 bp, Rattus norvegicus
gaagctgctgtaagtatcctttcag

SEQ ID NO: 302571 - DNA, 25 bp, Rattus norvegicus
gaagctgctgtatgtatcctttcag

SEQ ID NO: 302572 - DNA, 25 bp, Rattus norvegicus
gaagctgctgtcacaatttcattct

SEQ ID NO: 302573 - DNA, 25 bp, Rattus norvegicus
gaagctgctgtctcaatttcattct

SEQ ID NO: 302574 - DNA, 25 bp, Rattus norvegicus
gaagctgctgtgaaagtctctttga

SEQ ID NO: 302575 - DNA, 25 bp, Rattus norvegicus
gaagctgctgtgtaagtctctttga

SEQ ID NO: 302576 - DNA, 25 bp, Rattus norvegicus
gaagctgcttaaagccaggcggcga

SEQ ID NO: 302577 - DNA, 25 bp, Rattus norvegicus
gaagctgcttaatgccaggcggcga

SEQ ID NO: 302578 - DNA, 25 bp, Rattus norvegicus
gaagctgcttcacggaactatcaga

SEQ ID NO: 302579 - DNA, 25 bp, Rattus norvegicus
gaagctgcttcagggaactatcaga

SEQ ID NO: 302580 - DNA, 25 bp, Rattus norvegicus
gaagctgctttgaaagttgttctgc

SEQ ID NO: 302581 - DNA, 25 bp, Rattus norvegicus
gaagctgctttgtaagttgttctgc

SEQ ID NO: 302582 - DNA, 25 bp, Rattus norvegicus
gaagctggaaggcacaacaaactca

SEQ ID NO: 302583 - DNA, 25 bp, Rattus norvegicus
gaagctggaagggacaacaaactca

SEQ ID NO: 302584 - DNA, 25 bp, Rattus norvegicus
gaagctggacagagtcaagttccac

SEQ ID NO: 302585 - DNA, 25 bp, Rattus norvegicus
gaagctggacagtgtcaagttccac

SEQ ID NO: 302586 - DNA, 25 bp, Rattus norvegicus
gaagctggacttactttttgcgtgt

SEQ ID NO: 302587 - DNA, 25 bp, Rattus norvegicus
gaagctggacttctcccaagaacaa

SEQ ID NO: 302588 - DNA, 25 bp, Rattus norvegicus
gaagctggacttgtcccaagaacaa

SEQ ID NO: 302589 - DNA, 25 bp, Rattus norvegicus
gaagctggactttctttttgcgtgt

SEQ ID NO: 302590 - DNA, 25 bp, Rattus norvegicus
gaagctggagcccacatggatgcca

SEQ ID NO: 302591 - DNA, 25 bp, Rattus norvegicus
gaagctggagccctaaacctttatc

SEQ ID NO: 302592 - DNA, 25 bp, Rattus norvegicus
gaagctggagccgacatggatgcca

SEQ ID NO: 302593 - DNA, 25 bp, Rattus norvegicus
gaagctggagccgtaaacctttatc

SEQ ID NO: 302594 - DNA, 25 bp, Rattus norvegicus
gaagctggagcgatatcttaagggc

SEQ ID NO: 302595 - DNA, 25 bp, Rattus norvegicus
gaagctggagcgttatcttaagggc

SEQ ID NO: 302596 - DNA, 25 bp, Rattus norvegicus
gaagctggaggacatagccctgccc

SEQ ID NO: 302597 - DNA, 25 bp, Rattus norvegicus
gaagctggaggagatagccctgccc

SEQ ID NO: 302598 - DNA, 25 bp, Rattus norvegicus
gaagctggatggaactccagtaatt

SEQ ID NO: 302599 - DNA, 25 bp, Rattus norvegicus
gaagctggatggacgcttttctgca

SEQ ID NO: 302600 - DNA, 25 bp, Rattus norvegicus
gaagctggatggtactccagtaatt

SEQ ID NO: 302601 - DNA, 25 bp, Rattus norvegicus
gaagctggatggtcgcttttctgca

SEQ ID NO: 302602 - DNA, 25 bp, Rattus norvegicus
gaagctggcaacatctatacttgta

SEQ ID NO: 302603 - DNA, 25 bp, Rattus norvegicus
gaagctggcaacttctatacttgta

SEQ ID NO: 302604 - DNA, 25 bp, Rattus norvegicus
gaagctggcagcaacgaccaaggat

SEQ ID NO: 302605 - DNA, 25 bp, Rattus norvegicus
gaagctggcagcagtttccggtcct

SEQ ID NO: 302606 - DNA, 25 bp, Rattus norvegicus
gaagctggcagctacgaccaaggat

SEQ ID NO: 302607 - DNA, 25 bp, Rattus norvegicus
gaagctggcagctgtttccggtcct

SEQ ID NO: 302608 - DNA, 25 bp, Rattus norvegicus
gaagctggcatgcactagatttaac

SEQ ID NO: 302609 - DNA, 25 bp, Rattus norvegicus
gaagctggcatggactagatttaac

SEQ ID NO: 302610 - DNA, 25 bp, Rattus norvegicus
gaagctggccagaataacaaccatc

SEQ ID NO: 302611 - DNA, 25 bp, Rattus norvegicus
gaagctggccagtataacaaccatc

SEQ ID NO: 302612 - DNA, 25 bp, Rattus norvegicus
gaagctggccataaaacccttctac

SEQ ID NO: 302613 - DNA, 25 bp, Rattus norvegicus
gaagctggccatccttgggattttc

SEQ ID NO: 302614 - DNA, 25 bp, Rattus norvegicus
gaagctggccatgcttgggattttc

SEQ ID NO: 302615 - DNA, 25 bp, Rattus norvegicus
gaagctggccattaaacccttctac

SEQ ID NO: 302616 - DNA, 25 bp, Rattus norvegicus
gaagctggcccgctacgtgctgatc

SEQ ID NO: 302617 - DNA, 25 bp, Rattus norvegicus
gaagctggcccggtacgtgctgatc

SEQ ID NO: 302618 - DNA, 25 bp, Rattus norvegicus
gaagctggcctccaccgagatgaaa

SEQ ID NO: 302619 - DNA, 25 bp, Rattus norvegicus
gaagctggcctcgaccgagatgaaa

SEQ ID NO: 302620 - DNA, 25 bp, Rattus norvegicus
gaagctggccttagagaccacagtg

SEQ ID NO: 302621 - DNA, 25 bp, Rattus norvegicus
gaagctggcctttgagaccacagtg

SEQ ID NO: 302622 - DNA, 25 bp, Rattus norvegicus
gaagctggcgctagacatcgagatc
